United States Patent 7,888,497 (BIOINFORMATICALLY DETECTABLE GROUP OF NOVEL REGULATORY OLIGONUCLEOTIDES AND USES THEREOF) - sequence listing, part 54

SEQ ID NO: 2266368 - DNA, 20 bp, Homo sapiens
atgctgagtttgtgctggtg

SEQ ID NO: 2266369 - DNA, 15 bp, Homo sapiens
atggaacgcgttgaa

SEQ ID NO: 2266370 - DNA, 16 bp, Homo sapiens
atggactgtggtgact

SEQ ID NO: 2266371 - DNA, 17 bp, Homo sapiens
atggactgtggtgactt

SEQ ID NO: 2266372 - DNA, 18 bp, Homo sapiens
atggagcctgcacggtga

SEQ ID NO: 2266373 - DNA, 22 bp, Homo sapiens
atggagcctgcacggtgaatgg

SEQ ID NO: 2266374 - DNA, 15 bp, Homo sapiens
atgggataaatgcca

SEQ ID NO: 2266375 - DNA, 19 bp, Homo sapiens
atggtccgtgctaaggact

SEQ ID NO: 2266376 - DNA, 20 bp, Homo sapiens
atggtccgtgctaaggactt

SEQ ID NO: 2266377 - DNA, 14 bp, Homo sapiens
atgtaaatcccatt

SEQ ID NO: 2266378 - DNA, 13 bp, Homo sapiens
atgttaaaccatg

SEQ ID NO: 2266379 - DNA, 15 bp, Homo sapiens
atgtttattacagta

SEQ ID NO: 2266380 - DNA, 16 bp, Homo sapiens
atgtttattacagtat

SEQ ID NO: 2266381 - DNA, 23 bp, Homo sapiens
atgtttattacagtataattaac

SEQ ID NO: 2266382 - DNA, 19 bp, Homo sapiens
attaacatgttaaaccatg

SEQ ID NO: 2266383 - DNA, 12 bp, Homo sapiens
attacagtataa

SEQ ID NO: 2266384 - DNA, 16 bp, Homo sapiens
attagaattctgtata

SEQ ID NO: 2266385 - DNA, 17 bp, Homo sapiens
attagaattctgtatag

SEQ ID NO: 2266386 - DNA, 18 bp, Homo sapiens
attagaattctgtataga

SEQ ID NO: 2266387 - DNA, 17 bp, Homo sapiens
attagagagtgttgaaa

SEQ ID NO: 2266388 - DNA, 19 bp, Homo sapiens
attatatctgaggaattct

SEQ ID NO: 2266389 - DNA, 12 bp, Homo sapiens
attatgtaaatc

SEQ ID NO: 2266390 - DNA, 17 bp, Homo sapiens
attatgtaaatcccatt

SEQ ID NO: 2266391 - DNA, 19 bp, Homo sapiens
attattcaaagttgcctaa

SEQ ID NO: 2266392 - DNA, 20 bp, Homo sapiens
attcaaagttgcctaaatcc

SEQ ID NO: 2266393 - DNA, 12 bp, Homo sapiens
attcactgattt

SEQ ID NO: 2266394 - DNA, 17 bp, Homo sapiens
attcactgatttgacat

SEQ ID NO: 2266395 - DNA, 19 bp, Homo sapiens
attcttaaagttgaattta

SEQ ID NO: 2266396 - DNA, 13 bp, Homo sapiens
attggcttttctg

SEQ ID NO: 2266397 - DNA, 15 bp, Homo sapiens
attggcttttctgat

SEQ ID NO: 2266398 - DNA, 22 bp, Homo sapiens
attggggattcttaaagttgaa

SEQ ID NO: 2266399 - DNA, 14 bp, Homo sapiens
attggtgttgtact

SEQ ID NO: 2266400 - DNA, 17 bp, Homo sapiens
attgtaattatatctga

SEQ ID NO: 2266401 - DNA, 19 bp, Homo sapiens
attgtacaaagtattaagc

SEQ ID NO: 2266402 - DNA, 22 bp, Homo sapiens
attgtacaaagtattaagcata

SEQ ID NO: 2266403 - DNA, 15 bp, Homo sapiens
atttaataattatat

SEQ ID NO: 2266404 - DNA, 16 bp, Homo sapiens
atttactaaaatggac

SEQ ID NO: 2266405 - DNA, 19 bp, Homo sapiens
atttctatgctgagtttgt

SEQ ID NO: 2266406 - DNA, 21 bp, Homo sapiens
atttctatgctgagtttgtgc

SEQ ID NO: 2266407 - DNA, 22 bp, Homo sapiens
atttctatgctgagtttgtgct

SEQ ID NO: 2266408 - DNA, 17 bp, Homo sapiens
atttgacatagtctggc

SEQ ID NO: 2266409 - DNA, 13 bp, Homo sapiens
atttggaaatctt

SEQ ID NO: 2266410 - DNA, 20 bp, Homo sapiens
atttggaaatctttaaaaaa

SEQ ID NO: 2266411 - DNA, 17 bp, Homo sapiens
attttaacaacagctgg

SEQ ID NO: 2266412 - DNA, 11 bp, Homo sapiens
attttattatg

SEQ ID NO: 2266413 - DNA, 12 bp, Homo sapiens
attttattatga

SEQ ID NO: 2266414 - DNA, 13 bp, Homo sapiens
attttattatgta

SEQ ID NO: 2266415 - DNA, 15 bp, Homo sapiens
attttattatgtaaa

SEQ ID NO: 2266416 - DNA, 16 bp, Homo sapiens
attttattatgtaaat

SEQ ID NO: 2266417 - DNA, 11 bp, Homo sapiens
attttgtttct

SEQ ID NO: 2266418 - DNA, 15 bp, Homo sapiens
attttgtttctgtac

SEQ ID NO: 2266419 - DNA, 19 bp, Homo sapiens
caaaaaccagtattgtaca

SEQ ID NO: 2266420 - DNA, 15 bp, Homo sapiens
caaaaatattttatg

SEQ ID NO: 2266421 - DNA, 18 bp, Homo sapiens
ttatgaaacttgtgtaaa

SEQ ID NO: 2266422 - DNA, 13 bp, Homo sapiens
ttatgtaaatccc

SEQ ID NO: 2266423 - DNA, 14 bp, Homo sapiens
ttattacagtataa

SEQ ID NO: 2266424 - DNA, 16 bp, Homo sapiens
ttattacagtataatt

SEQ ID NO: 2266425 - DNA, 14 bp, Homo sapiens
ttattatgtaaatc

SEQ ID NO: 2266426 - DNA, 16 bp, Homo sapiens
ttattggcttttctga

SEQ ID NO: 2266427 - DNA, 22 bp, Homo sapiens
ttattggcttttctgatccagt

SEQ ID NO: 2266428 - DNA, 17 bp, Homo sapiens
ttctatgctgagtttgt

SEQ ID NO: 2266429 - DNA, 13 bp, Homo sapiens
ttctgatagagga

SEQ ID NO: 2266430 - DNA, 11 bp, Homo sapiens
ttctgtataga

SEQ ID NO: 2266431 - DNA, 13 bp, Homo sapiens
ttcttaaagttga

SEQ ID NO: 2266432 - DNA, 18 bp, Homo sapiens
ttctttaattttggaatt

SEQ ID NO: 2266433 - DNA, 22 bp, Homo sapiens
ttgaaacggatgatttctatgc

SEQ ID NO: 2266434 - DNA, 17 bp, Homo sapiens
ttgaaattgtaattata

SEQ ID NO: 2266435 - DNA, 18 bp, Homo sapiens
ttgaatttattggctttt

SEQ ID NO: 2266436 - DNA, 17 bp, Homo sapiens
ttgaattttgtgttaga

SEQ ID NO: 2266437 - DNA, 21 bp, Homo sapiens
ttgaattttgtgttagagatt

SEQ ID NO: 2266438 - DNA, 12 bp, Homo sapiens
ttgcctttttca

SEQ ID NO: 2266439 - DNA, 12 bp, Homo sapiens
ttggaaatcttt

SEQ ID NO: 2266440 - DNA, 15 bp, Homo sapiens
ttggataataaggaa

SEQ ID NO: 2266441 - DNA, 20 bp, Homo sapiens
ttggcataacataaatctgt

SEQ ID NO: 2266442 - DNA, 22 bp, Homo sapiens
ttggcataacataaatctgtga

SEQ ID NO: 2266443 - DNA, 15 bp, Homo sapiens
ttggcttttctgatc

SEQ ID NO: 2266444 - DNA, 13 bp, Homo sapiens
ttgtacaaagtat

SEQ ID NO: 2266445 - DNA, 17 bp, Homo sapiens
ttgtacaaagtattaag

SEQ ID NO: 2266446 - DNA, 21 bp, Homo sapiens
ttgtacaaagtattaagcata

SEQ ID NO: 2266447 - DNA, 22 bp, Homo sapiens
ttgtgcgctaaacttttctgat

SEQ ID NO: 2266448 - DNA, 12 bp, Homo sapiens
ttgtttctgtac

SEQ ID NO: 2266449 - DNA, 21 bp, Homo sapiens
ttgtttggaccaaaaaccagt

SEQ ID NO: 2266450 - DNA, 14 bp, Homo sapiens
ttgtttgtttagtc

SEQ ID NO: 2266451 - DNA, 17 bp, Homo sapiens
tttaaaaaaaaaattgg

SEQ ID NO: 2266452 - DNA, 14 bp, Homo sapiens
tttaataattatat

SEQ ID NO: 2266453 - DNA, 20 bp, Homo sapiens
tttaatattaaagccatgtt

SEQ ID NO: 2266454 - DNA, 21 bp, Homo sapiens
tttaatattaaagccatgttt

SEQ ID NO: 2266455 - DNA, 15 bp, Homo sapiens
tttactaaaatggac

SEQ ID NO: 2266456 - DNA, 17 bp, Homo sapiens
tttagtcttgtctcaga

SEQ ID NO: 2266457 - DNA, 16 bp, Homo sapiens
tttattatgtaaatcc

SEQ ID NO: 2266458 - DNA, 21 bp, Homo sapiens
tttattggcttttctgatcca

SEQ ID NO: 2266459 - DNA, 20 bp, Homo sapiens
tttcattattttattatgaa

SEQ ID NO: 2266460 - DNA, 13 bp, Homo sapiens
tttctgatccagt

SEQ ID NO: 2266461 - DNA, 16 bp, Homo sapiens
tttctgatccagtttt

SEQ ID NO: 2266462 - DNA, 22 bp, Homo sapiens
tttctgatccagttttgtttgg

SEQ ID NO: 2266463 - DNA, 19 bp, Homo sapiens
tttctgtactttttggcat

SEQ ID NO: 2266464 - DNA, 16 bp, Homo sapiens
tttggaaatctttaaa

SEQ ID NO: 2266465 - DNA, 21 bp, Homo sapiens
tttggcataacataaatctgt

SEQ ID NO: 2266466 - DNA, 12 bp, Homo sapiens
tttgtgttagag

SEQ ID NO: 2266467 - DNA, 12 bp, Homo sapiens
tttgttgtttgt

SEQ ID NO: 2266468 - DNA, 13 bp, Homo sapiens
ttttatgatccag

SEQ ID NO: 2266469 - DNA, 15 bp, Homo sapiens
ttttatgatccagca

SEQ ID NO: 2266470 - DNA, 15 bp, Homo sapiens
ttttcattattttat

SEQ ID NO: 2266471 - DNA, 19 bp, Homo sapiens
ttttctgatccagttttgt

SEQ ID NO: 2266472 - DNA, 21 bp, Homo sapiens
ttttggcataacataaatctg

SEQ ID NO: 2266473 - DNA, 12 bp, Homo sapiens
ttttgtttctgt

SEQ ID NO: 2266474 - DNA, 23 bp, Homo sapiens
aaaaaattggggattcttaaagt

SEQ ID NO: 2266475 - DNA, 18 bp, Homo sapiens
aaaaaccagtattgtaca

SEQ ID NO: 2266476 - DNA, 14 bp, Homo sapiens
aaaaatattttatg

SEQ ID NO: 2266477 - DNA, 18 bp, Homo sapiens
aaaaattggggattctta

SEQ ID NO: 2266478 - DNA, 20 bp, Homo sapiens
aaaagtttaatattaaagcc

SEQ ID NO: 2266479 - DNA, 18 bp, Homo sapiens
aaaccagtattgtacaaa

SEQ ID NO: 2266480 - DNA, 16 bp, Homo sapiens
aaacggatgatttcta

SEQ ID NO: 2266481 - DNA, 18 bp, Homo sapiens
aaacggatgatttctatg

SEQ ID NO: 2266482 - DNA, 17 bp, Homo sapiens
aaacttgtgtaaataca

SEQ ID NO: 2266483 - DNA, 11 bp, Homo sapiens
aaacttttctg

SEQ ID NO: 2266484 - DNA, 14 bp, Homo sapiens
aaagccatgtttat

SEQ ID NO: 2266485 - DNA, 18 bp, Homo sapiens
aaagccatgtttattaca

SEQ ID NO: 2266486 - DNA, 13 bp, Homo sapiens
aaagttgaattta

SEQ ID NO: 2266487 - DNA, 16 bp, Homo sapiens
aaagttgaatttattg

SEQ ID NO: 2266488 - DNA, 13 bp, Homo sapiens
aaagttgcctaaa

SEQ ID NO: 2266489 - DNA, 16 bp, Homo sapiens
aaagttgcctaaatcc

SEQ ID NO: 2266490 - DNA, 23 bp, Homo sapiens
aaagttgcctaaatccatttgga

SEQ ID NO: 2266491 - DNA, 19 bp, Homo sapiens
aaagtttaatattaaagcc

SEQ ID NO: 2266492 - DNA, 20 bp, Homo sapiens
aaagtttaatattaaagcca

SEQ ID NO: 2266493 - DNA, 21 bp, Homo sapiens
aaagtttaatattaaagccat

SEQ ID NO: 2266494 - DNA, 22 bp, Homo sapiens
aaagtttaatattaaagccatg

SEQ ID NO: 2266495 - DNA, 15 bp, Homo sapiens
aaatccatttggaaa

SEQ ID NO: 2266496 - DNA, 22 bp, Homo sapiens
aaatccatttggaaatctttaa

SEQ ID NO: 2266497 - DNA, 23 bp, Homo sapiens
aaatccatttggaaatctttaaa

SEQ ID NO: 2266498 - DNA, 16 bp, Homo sapiens
aaatcccattattcaa

SEQ ID NO: 2266499 - DNA, 16 bp, Homo sapiens
aaatctgtgaacttga

SEQ ID NO: 2266500 - DNA, 18 bp, Homo sapiens
aaatctgtgaacttgaaa

SEQ ID NO: 2266501 - DNA, 16 bp, Homo sapiens
aaattggggattctta

SEQ ID NO: 2266502 - DNA, 12 bp, Homo sapiens
aaatttgaattt

SEQ ID NO: 2266503 - DNA, 19 bp, Homo sapiens
aacagctggtgccctgctt

SEQ ID NO: 2266504 - DNA, 15 bp, Homo sapiens
aaccagtattgtaca

SEQ ID NO: 2266505 - DNA, 21 bp, Homo sapiens
aaccagtattgtacaaagtat

SEQ ID NO: 2266506 - DNA, 18 bp, Homo sapiens
aaccatgggataaatgcc

SEQ ID NO: 2266507 - DNA, 20 bp, Homo sapiens
aaccatgggataaatgccat

SEQ ID NO: 2266508 - DNA, 20 bp, Homo sapiens
aacttgtgtaaatacaattt

SEQ ID NO: 2266509 - DNA, 14 bp, Homo sapiens
aaggacttctttaa

SEQ ID NO: 2266510 - DNA, 20 bp, Homo sapiens
aaggacttctttaattttgg

SEQ ID NO: 2266511 - DNA, 15 bp, Homo sapiens
aaggacttgttagat

SEQ ID NO: 2266512 - DNA, 21 bp, Homo sapiens
aagtcagatctgcctaaggac

SEQ ID NO: 2266513 - DNA, 15 bp, Homo sapiens
aagttgaatttattg

SEQ ID NO: 2266514 - DNA, 17 bp, Homo sapiens
aagttgaatttattggc

SEQ ID NO: 2266515 - DNA, 23 bp, Homo sapiens
aagttgaatttattggcttttct

SEQ ID NO: 2266516 - DNA, 15 bp, Homo sapiens
aagttgcctaaatcc

SEQ ID NO: 2266517 - DNA, 18 bp, Homo sapiens
aagttgcctaaatccatt

SEQ ID NO: 2266518 - DNA, 15 bp, Homo sapiens
aataaggaaaagttt

SEQ ID NO: 2266519 - DNA, 16 bp, Homo sapiens
aataaggaaaagttta

SEQ ID NO: 2266520 - DNA, 21 bp, Homo sapiens
aatagctagactggtgactga

SEQ ID NO: 2266521 - DNA, 13 bp, Homo sapiens
aatattaaagcca

SEQ ID NO: 2266522 - DNA, 20 bp, Homo sapiens
aatattaaagccatgtttat

SEQ ID NO: 2266523 - DNA, 17 bp, Homo sapiens
aatattttatgatccag

SEQ ID NO: 2266524 - DNA, 14 bp, Homo sapiens
aatcccattattca

SEQ ID NO: 2266525 - DNA, 16 bp, Homo sapiens
aatcccattattcaaa

SEQ ID NO: 2266526 - DNA, 13 bp, Homo sapiens
aatctgtgaactt

SEQ ID NO: 2266527 - DNA, 23 bp, Homo sapiens
aatgccatcaataaaaaattatg

SEQ ID NO: 2266528 - DNA, 16 bp, Homo sapiens
aatggactgtggtgac

SEQ ID NO: 2266529 - DNA, 20 bp, Homo sapiens
aatggactgtggtgactttg

SEQ ID NO: 2266530 - DNA, 15 bp, Homo sapiens
aatggctttgtatag

SEQ ID NO: 2266531 - DNA, 21 bp, Homo sapiens
aatggtccgtgctaaggactt

SEQ ID NO: 2266532 - DNA, 17 bp, Homo sapiens
aattggggattcttaaa

SEQ ID NO: 2266533 - DNA, 16 bp, Homo sapiens
aattgtaattatatct

SEQ ID NO: 2266534 - DNA, 15 bp, Homo sapiens
aattttgtttctgta

SEQ ID NO: 2266535 - DNA, 16 bp, Homo sapiens
acaaagtattaagcat

SEQ ID NO: 2266536 - DNA, 15 bp, Homo sapiens
acaacagctggtgcc

SEQ ID NO: 2266537 - DNA, 15 bp, Homo sapiens
acaattttgtttctg

SEQ ID NO: 2266538 - DNA, 13 bp, Homo sapiens
acagtataattaa

SEQ ID NO: 2266539 - DNA, 20 bp, Homo sapiens
acagtataattaacatgtta

SEQ ID NO: 2266540 - DNA, 23 bp, Homo sapiens
acagtataattaacatgttaaac

SEQ ID NO: 2266541 - DNA, 20 bp, Homo sapiens
acatagtctggctgtaccca

SEQ ID NO: 2266542 - DNA, 14 bp, Homo sapiens
acatgttaaaccat

SEQ ID NO: 2266543 - DNA, 15 bp, Homo sapiens
accagtattgtacaa

SEQ ID NO: 2266544 - DNA, 22 bp, Homo sapiens
accagtattgtacaaagtatta

SEQ ID NO: 2266545 - DNA, 20 bp, Homo sapiens
acggtgaatggctttgtata

SEQ ID NO: 2266546 - DNA, 22 bp, Homo sapiens
actctccatttaataattatat

SEQ ID NO: 2266547 - DNA, 13 bp, Homo sapiens
actgattcttcag

SEQ ID NO: 2266548 - DNA, 15 bp, Homo sapiens
actgattcttcagca

SEQ ID NO: 2266549 - DNA, 22 bp, Homo sapiens
actgatttgacatagtctggct

SEQ ID NO: 2266550 - DNA, 12 bp, Homo sapiens
tattaaagccat

SEQ ID NO: 2266551 - DNA, 14 bp, Homo sapiens
tattaaagccatgt

SEQ ID NO: 2266552 - DNA, 18 bp, Homo sapiens
aaaaaattggggattctt

SEQ ID NO: 2266553 - DNA, 16 bp, Homo sapiens
aaaaaccagtattgta

SEQ ID NO: 2266554 - DNA, 20 bp, Homo sapiens
aaaaaccagtattgtacaaa

SEQ ID NO: 2266555 - DNA, 19 bp, Homo sapiens
aaaaattggggattcttaa

SEQ ID NO: 2266556 - DNA, 17 bp, Homo sapiens
aaaaccagtattgtaca

SEQ ID NO: 2266557 - DNA, 14 bp, Homo sapiens
aaaagtttaatatt

SEQ ID NO: 2266558 - DNA, 16 bp, Homo sapiens
aaaagtttaatattaa

SEQ ID NO: 2266559 - DNA, 21 bp, Homo sapiens
aaaagtttaatattaaagcca

SEQ ID NO: 2266560 - DNA, 22 bp, Homo sapiens
aaaagtttaatattaaagccat

SEQ ID NO: 2266561 - DNA, 18 bp, Homo sapiens
aaaatattttatgatcca

SEQ ID NO: 2266562 - DNA, 17 bp, Homo sapiens
aaaattggggattctta

SEQ ID NO: 2266563 - DNA, 19 bp, Homo sapiens
aaaattggggattcttaaa

SEQ ID NO: 2266564 - DNA, 17 bp, Homo sapiens
aaaccagtattgtacaa

SEQ ID NO: 2266565 - DNA, 20 bp, Homo sapiens
aaaccatgggataaatgcca

SEQ ID NO: 2266566 - DNA, 14 bp, Homo sapiens
aaacttttctgata

SEQ ID NO: 2266567 - DNA, 17 bp, Homo sapiens
aaagccatgtttattac

SEQ ID NO: 2266568 - DNA, 18 bp, Homo sapiens
aaagtattaagcatatat

SEQ ID NO: 2266569 - DNA, 20 bp, Homo sapiens
aaagtattaagcatatattt

SEQ ID NO: 2266570 - DNA, 22 bp, Homo sapiens
aaagttgaatttattggctttt

SEQ ID NO: 2266571 - DNA, 17 bp, Homo sapiens
aaagttgcctaaatcca

SEQ ID NO: 2266572 - DNA, 12 bp, Homo sapiens
aaagtttaatat

SEQ ID NO: 2266573 - DNA, 10 bp, Homo sapiens
aaataaataa

SEQ ID NO: 2266574 - DNA, 13 bp, Homo sapiens
aaatacaattttg

SEQ ID NO: 2266575 - DNA, 14 bp, Homo sapiens
aaatacaattttgt

SEQ ID NO: 2266576 - DNA, 18 bp, Homo sapiens
aaatacaattttgtttct

SEQ ID NO: 2266577 - DNA, 22 bp, Homo sapiens
aaatacaattttgtttctgtac

SEQ ID NO: 2266578 - DNA, 18 bp, Homo sapiens
aaatattttatgatccag

SEQ ID NO: 2266579 - DNA, 14 bp, Homo sapiens
aaatccatttggaa

SEQ ID NO: 2266580 - DNA, 16 bp, Homo sapiens
aaatccatttggaaat

SEQ ID NO: 2266581 - DNA, 21 bp, Homo sapiens
aaatccatttggaaatcttta

SEQ ID NO: 2266582 - DNA, 13 bp, Homo sapiens
aaatcccattatt

SEQ ID NO: 2266583 - DNA, 15 bp, Homo sapiens
aaatcccattattca

SEQ ID NO: 2266584 - DNA, 17 bp, Homo sapiens
aaatcccattattcaaa

SEQ ID NO: 2266585 - DNA, 20 bp, Homo sapiens
aaatcccattattcaaagtt

SEQ ID NO: 2266586 - DNA, 15 bp, Homo sapiens
aaatctgtgaacttg

SEQ ID NO: 2266587 - DNA, 23 bp, Homo sapiens
aaatggactgtggtgactttgga

SEQ ID NO: 2266588 - DNA, 20 bp, Homo sapiens
aaattggggattcttaaagt

SEQ ID NO: 2266589 - DNA, 22 bp, Homo sapiens
aaattggggattcttaaagttg

SEQ ID NO: 2266590 - DNA, 23 bp, Homo sapiens
aaattggggattcttaaagttga

SEQ ID NO: 2266591 - DNA, 14 bp, Homo sapiens
aaattgtaattata

SEQ ID NO: 2266592 - DNA, 17 bp, Homo sapiens
aacagctggtgccctgc

SEQ ID NO: 2266593 - DNA, 20 bp, Homo sapiens
aacagctggtgccctgcttt

SEQ ID NO: 2266594 - DNA, 12 bp, Homo sapiens
aacataaatctg

SEQ ID NO: 2266595 - DNA, 13 bp, Homo sapiens
aacgcgttgaaat

SEQ ID NO: 2266596 - DNA, 15 bp, Homo sapiens
aacgcgttgaaattg

SEQ ID NO: 2266597 - DNA, 16 bp, Homo sapiens
aacggatgatttctat

SEQ ID NO: 2266598 - DNA, 12 bp, Homo sapiens
aacttgaaattt

SEQ ID NO: 2266599 - DNA, 19 bp, Homo sapiens
aagaatggtccgtgctaag

SEQ ID NO: 2266600 - DNA, 16 bp, Homo sapiens
aagccatgtttattac

SEQ ID NO: 2266601 - DNA, 21 bp, Homo sapiens
aagccatgtttattacagtat

SEQ ID NO: 2266602 - DNA, 22 bp, Homo sapiens
aagccatgtttattacagtata

SEQ ID NO: 2266603 - DNA, 15 bp, Homo sapiens
aaggacttctttaat

SEQ ID NO: 2266604 - DNA, 21 bp, Homo sapiens
aaggacttgttagatctagtt

SEQ ID NO: 2266605 - DNA, 23 bp, Homo sapiens
aaggacttgttagatctagttca

SEQ ID NO: 2266606 - DNA, 13 bp, Homo sapiens
aagtattaagcat

SEQ ID NO: 2266607 - DNA, 16 bp, Homo sapiens
aagtattaagcatata

SEQ ID NO: 2266608 - DNA, 17 bp, Homo sapiens
aagtattaagcatatat

SEQ ID NO: 2266609 - DNA, 18 bp, Homo sapiens
aagtattaagcatatatt

SEQ ID NO: 2266610 - DNA, 24 bp, Homo sapiens
aagttgaatttattggcttttctg

SEQ ID NO: 2266611 - DNA, 12 bp, Homo sapiens
aagttgcctaaa

SEQ ID NO: 2266612 - DNA, 17 bp, Homo sapiens
aagtttaatattaaagc

SEQ ID NO: 2266613 - DNA, 18 bp, Homo sapiens
aagtttaatattaaagcc

SEQ ID NO: 2266614 - DNA, 19 bp, Homo sapiens
aagtttaatattaaagcca

SEQ ID NO: 2266615 - DNA, 15 bp, Homo sapiens
aataaaaaattatga

SEQ ID NO: 2266616 - DNA, 21 bp, Homo sapiens
aataaatagctagactggtga

SEQ ID NO: 2266617 - DNA, 22 bp, Homo sapiens
aataaggaaaagtttaatatta

SEQ ID NO: 2266618 - DNA, 14 bp, Homo sapiens
aataattatatgct

SEQ ID NO: 2266619 - DNA, 15 bp, Homo sapiens
aatacaattttgttt

SEQ ID NO: 2266620 - DNA, 17 bp, Homo sapiens
aatacaattttgtttct

SEQ ID NO: 2266621 - DNA, 20 bp, Homo sapiens
aatacaattttgtttctgta

SEQ ID NO: 2266622 - DNA, 20 bp, Homo sapiens
aatagctagactggtgactg

SEQ ID NO: 2266623 - DNA, 15 bp, Homo sapiens
aatattaaagccatg

SEQ ID NO: 2266624 - DNA, 19 bp, Homo sapiens
aatattaaagccatgttta

SEQ ID NO: 2266625 - DNA, 18 bp, Homo sapiens
aatattttatgatccagc

SEQ ID NO: 2266626 - DNA, 17 bp, Homo sapiens
aatccatttggaaatct

SEQ ID NO: 2266627 - DNA, 17 bp, Homo sapiens
aatctgtgaacttgaaa

SEQ ID NO: 2266628 - DNA, 19 bp, Homo sapiens
aatctgtgaacttgaaatt

SEQ ID NO: 2266629 - DNA, 20 bp, Homo sapiens
aatctgtgaacttgaaattt

SEQ ID NO: 2266630 - DNA, 21 bp, Homo sapiens
aatctgtgaacttgaaatttg

SEQ ID NO: 2266631 - DNA, 19 bp, Homo sapiens
aatctttaaaaaaaaaatt

SEQ ID NO: 2266632 - DNA, 16 bp, Homo sapiens
aatgccatcaataaaa

SEQ ID NO: 2266633 - DNA, 21 bp, Homo sapiens
aatgccatcaataaaaaatta

SEQ ID NO: 2266634 - DNA, 14 bp, Homo sapiens
aattaacatgttaa

SEQ ID NO: 2266635 - DNA, 20 bp, Homo sapiens
aattaacatgttaaaccatg

SEQ ID NO: 2266636 - DNA, 20 bp, Homo sapiens
aattatatgctatttctata

SEQ ID NO: 2266637 - DNA, 12 bp, Homo sapiens
aattctgtatag

SEQ ID NO: 2266638 - DNA, 13 bp, Homo sapiens
aattctgtataga

SEQ ID NO: 2266639 - DNA, 14 bp, Homo sapiens
aattctgtatagat

SEQ ID NO: 2266640 - DNA, 17 bp, Homo sapiens
aattgtaattatatctg

SEQ ID NO: 2266641 - DNA, 17 bp, Homo sapiens
aatttattggcttttct

SEQ ID NO: 2266642 - DNA, 13 bp, Homo sapiens
aatttgaattttg

SEQ ID NO: 2266643 - DNA, 16 bp, Homo sapiens
aatttgaattttgtgt

SEQ ID NO: 2266644 - DNA, 17 bp, Homo sapiens
acaattttgtttctgta

SEQ ID NO: 2266645 - DNA, 18 bp, Homo sapiens
acaattttgtttctgtac

SEQ ID NO: 2266646 - DNA, 15 bp, Homo sapiens
acataaatctgtgaa

SEQ ID NO: 2266647 - DNA, 18 bp, Homo sapiens
acataaatctgtgaactt

SEQ ID NO: 2266648 - DNA, 14 bp, Homo sapiens
acattggtgttgta

SEQ ID NO: 2266649 - DNA, 16 bp, Homo sapiens
acattggtgttgtact

SEQ ID NO: 2266650 - DNA, 22 bp, Homo sapiens
acattggtgttgtactcaattt

SEQ ID NO: 2266651 - DNA, 23 bp, Homo sapiens
acattggtgttgtactcaatttt

SEQ ID NO: 2266652 - DNA, 14 bp, Homo sapiens
accagtattgtaca

SEQ ID NO: 2266653 - DNA, 23 bp, Homo sapiens
accagtattgtacaaagtattaa

SEQ ID NO: 2266654 - DNA, 17 bp, Homo sapiens
accatgggataaatgcc

SEQ ID NO: 2266655 - DNA, 19 bp, Homo sapiens
acctgtcttgcctttttca

SEQ ID NO: 2266656 - DNA, 22 bp, Homo sapiens
acctgtcttgcctttttcatta

SEQ ID NO: 2266657 - DNA, 20 bp, Homo sapiens
acgcgttgaaattgtaatta

SEQ ID NO: 2266658 - DNA, 13 bp, Homo sapiens
acggatgatttct

SEQ ID NO: 2266659 - DNA, 14 bp, Homo sapiens
acggatgatttcta

SEQ ID NO: 2266660 - DNA, 19 bp, Homo sapiens
acggtgaatggctttgtat

SEQ ID NO: 2266661 - DNA, 19 bp, Homo sapiens
actggtgactgattcttca

SEQ ID NO: 2266662 - DNA, 18 bp, Homo sapiens
actgtggtgactttggat

SEQ ID NO: 2266663 - DNA, 21 bp, Homo sapiens
actgtggtgactttggataat

SEQ ID NO: 2266664 - DNA, 18 bp, Homo sapiens
acttctttaattttggaa

SEQ ID NO: 2266665 - DNA, 19 bp, Homo sapiens
acttctttaattttggaat

SEQ ID NO: 2266666 - DNA, 14 bp, Homo sapiens
acttgttagatcta

SEQ ID NO: 2266667 - DNA, 10 bp, Homo sapiens
tatgatccag

SEQ ID NO: 2266668 - DNA, 11 bp, Homo sapiens
tatgatccagc

SEQ ID NO: 2266669 - DNA, 19 bp, Homo sapiens
tatgatccagcagattatt

SEQ ID NO: 2266670 - DNA, 15 bp, Homo sapiens
tatgctatttctata

SEQ ID NO: 2266671 - DNA, 23 bp, Homo sapiens
tatgctatttctatattttcatt

SEQ ID NO: 2266672 - DNA, 12 bp, Homo sapiens
tatgtaaatccc

SEQ ID NO: 2266673 - DNA, 23 bp, Homo sapiens
tatgtaaatcccattattcaaag

SEQ ID NO: 2266674 - DNA, 12 bp, Homo sapiens
tatgtgtgaagt

SEQ ID NO: 2266675 - DNA, 14 bp, Homo sapiens
tatgtgtgaagtga

SEQ ID NO: 2266676 - DNA, 17 bp, Homo sapiens
tattaaagccatgttta

SEQ ID NO: 2266677 - DNA, 16 bp, Homo sapiens
tattaagcatatattt

SEQ ID NO: 2266678 - DNA, 14 bp, Homo sapiens
tattacagtataat

SEQ ID NO: 2266679 - DNA, 18 bp, Homo sapiens
tattcaaagttgcctaaa

SEQ ID NO: 2266680 - DNA, 13 bp, Homo sapiens
tattcactgattt

SEQ ID NO: 2266681 - DNA, 14 bp, Homo sapiens
tattggcttttctg

SEQ ID NO: 2266682 - DNA, 21 bp, Homo sapiens
tattggcttttctgatccagt

SEQ ID NO: 2266683 - DNA, 19 bp, Homo sapiens
tattgtgcgctaaactttt

SEQ ID NO: 2266684 - DNA, 16 bp, Homo sapiens
tatttctatattttca

SEQ ID NO: 2266685 - DNA, 23 bp, Homo sapiens
tattttattatgaaacttgtgta

SEQ ID NO: 2266686 - DNA, 16 bp, Homo sapiens
tatttttatatttact

SEQ ID NO: 2266687 - DNA, 13 bp, Homo sapiens
tcaataaaaaatt

SEQ ID NO: 2266688 - DNA, 13 bp, Homo sapiens
tcaattttaacaa

SEQ ID NO: 2266689 - DNA, 19 bp, Homo sapiens
tcacctgtcttgccttttt

SEQ ID NO: 2266690 - DNA, 15 bp, Homo sapiens
tcagatactggattg

SEQ ID NO: 2266691 - DNA, 20 bp, Homo sapiens
tcagatctgcctaaggactt

SEQ ID NO: 2266692 - DNA, 14 bp, Homo sapiens
tcagattttattat

SEQ ID NO: 2266693 - DNA, 23 bp, Homo sapiens
tcagattttattatgtaaatccc

SEQ ID NO: 2266694 - DNA, 20 bp, Homo sapiens
tcatggaacgcgttgaaatt

SEQ ID NO: 2266695 - DNA, 14 bp, Homo sapiens
tcattattttatta

SEQ ID NO: 2266696 - DNA, 14 bp, Homo sapiens
tccagcagattatt

SEQ ID NO: 2266697 - DNA, 20 bp, Homo sapiens
tccagcagattattcactga

SEQ ID NO: 2266698 - DNA, 14 bp, Homo sapiens
tccgtgctaaggac

SEQ ID NO: 2266699 - DNA, 16 bp, Homo sapiens
tccgtgctaaggactt

SEQ ID NO: 2266700 - DNA, 16 bp, Homo sapiens
tctatattttcattct

SEQ ID NO: 2266701 - DNA, 19 bp, Homo sapiens
tctatattttcattctcct

SEQ ID NO: 2266702 - DNA, 13 bp, Homo sapiens
tctcagattttat

SEQ ID NO: 2266703 - DNA, 22 bp, Homo sapiens
tctcagattttattatgtaaat

SEQ ID NO: 2266704 - DNA, 19 bp, Homo sapiens
tctccatttaataattata

SEQ ID NO: 2266705 - DNA, 19 bp, Homo sapiens
tctgaagtcagatctgcct

SEQ ID NO: 2266706 - DNA, 14 bp, Homo sapiens
tctgaggaattctg

SEQ ID NO: 2266707 - DNA, 14 bp, Homo sapiens
tctgcctaaggact

SEQ ID NO: 2266708 - DNA, 15 bp, Homo sapiens
tctgcctaaggactt

SEQ ID NO: 2266709 - DNA, 13 bp, Homo sapiens
tctgtactttttg

SEQ ID NO: 2266710 - DNA, 22 bp, Homo sapiens
tcttcagcaaaaatattttatg

SEQ ID NO: 2266711 - DNA, 16 bp, Homo sapiens
tcttgcctttttcatt

SEQ ID NO: 2266712 - DNA, 12 bp, Homo sapiens
tcttgtctcaga

SEQ ID NO: 2266713 - DNA, 16 bp, Homo sapiens
tctttaattttggaat

SEQ ID NO: 2266714 - DNA, 17 bp, Homo sapiens
tctttaattttggaatt

SEQ ID NO: 2266715 - DNA, 20 bp, Homo sapiens
tgaaacggatgatttctatg

SEQ ID NO: 2266716 - DNA, 13 bp, Homo sapiens
tgaaattgtaatt

SEQ ID NO: 2266717 - DNA, 20 bp, Homo sapiens
tgaaattgtaattatatctg

SEQ ID NO: 2266718 - DNA, 14 bp, Homo sapiens
tgaaatttgaattt

SEQ ID NO: 2266719 - DNA, 15 bp, Homo sapiens
tgaaatttgaatttt

SEQ ID NO: 2266720 - DNA, 23 bp, Homo sapiens
tgaagtcagatctgcctaaggac

SEQ ID NO: 2266721 - DNA, 12 bp, Homo sapiens
tgaatggctttg

SEQ ID NO: 2266722 - DNA, 12 bp, Homo sapiens
tgaatttattgg

SEQ ID NO: 2266723 - DNA, 16 bp, Homo sapiens
tgaatttattggcttt

SEQ ID NO: 2266724 - DNA, 17 bp, Homo sapiens
tgaatttattggctttt

SEQ ID NO: 2266725 - DNA, 15 bp, Homo sapiens
tgatagaggaagcct

SEQ ID NO: 2266726 - DNA, 20 bp, Homo sapiens
tgatccagcagattattcac

SEQ ID NO: 2266727 - DNA, 21 bp, Homo sapiens
tgattcttcagcaaaaatatt

SEQ ID NO: 2266728 - DNA, 15 bp, Homo sapiens
tgatttctatgctga

SEQ ID NO: 2266729 - DNA, 23 bp, Homo sapiens
tgatttgacatagtctggctgta

SEQ ID NO: 2266730 - DNA, 18 bp, Homo sapiens
tgcacggtgaatggcttt

SEQ ID NO: 2266731 - DNA, 22 bp, Homo sapiens
tgcacggtgaatggctttgtat

SEQ ID NO: 2266732 - DNA, 23 bp, Homo sapiens
tgcacggtgaatggctttgtata

SEQ ID NO: 2266733 - DNA, 12 bp, Homo sapiens
tgccctgctttc

SEQ ID NO: 2266734 - DNA, 20 bp, Homo sapiens
tgcctaaatccatttggaaa

SEQ ID NO: 2266735 - DNA, 23 bp, Homo sapiens
tgcctaaatccatttggaaatct

SEQ ID NO: 2266736 - DNA, 13 bp, Homo sapiens
tgcctttttcatt

SEQ ID NO: 2266737 - DNA, 17 bp, Homo sapiens
tgcctttttcattattt

SEQ ID NO: 2266738 - DNA, 21 bp, Homo sapiens
tgcgctaaacttttctgatag

SEQ ID NO: 2266739 - DNA, 17 bp, Homo sapiens
tgctgagtttgtgctgg

SEQ ID NO: 2266740 - DNA, 17 bp, Homo sapiens
tgctggggttatctgaa

SEQ ID NO: 2266741 - DNA, 16 bp, Homo sapiens
tgctttcagatactgg

SEQ ID NO: 2266742 - DNA, 17 bp, Homo sapiens
tgctttcagatactgga

SEQ ID NO: 2266743 - DNA, 20 bp, Homo sapiens
tgctttcagatactggattg

SEQ ID NO: 2266744 - DNA, 21 bp, Homo sapiens
tggaattttcctcctttctct

SEQ ID NO: 2266745 - DNA, 22 bp, Homo sapiens
tggaccaaaaaccagtattgta

SEQ ID NO: 2266746 - DNA, 15 bp, Homo sapiens
tggactgtggtgact

SEQ ID NO: 2266747 - DNA, 16 bp, Homo sapiens
tggactgtggtgactt

SEQ ID NO: 2266748 - DNA, 20 bp, Homo sapiens
tggataataaggaaaagttt

SEQ ID NO: 2266749 - DNA, 21 bp, Homo sapiens
tggcataacataaatctgtga

SEQ ID NO: 2266750 - DNA, 22 bp, Homo sapiens
tggcataacataaatctgtgaa

SEQ ID NO: 2266751 - DNA, 17 bp, Homo sapiens
tggcttttctgatccag

SEQ ID NO: 2266752 - DNA, 18 bp, Homo sapiens
tggcttttctgatccagt

SEQ ID NO: 2266753 - DNA, 19 bp, Homo sapiens
tggcttttctgatccagtt

SEQ ID NO: 2266754 - DNA, 12 bp, Homo sapiens
tggggattctta

SEQ ID NO: 2266755 - DNA, 16 bp, Homo sapiens
tggggattcttaaagt

SEQ ID NO: 2266756 - DNA, 19 bp, Homo sapiens
tggtgactttggataataa

SEQ ID NO: 2266757 - DNA, 16 bp, Homo sapiens
tgtaaatacaattttg

SEQ ID NO: 2266758 - DNA, 16 bp, Homo sapiens
tgtaaatcccattatt

SEQ ID NO: 2266759 - DNA, 13 bp, Homo sapiens
tgtaattatatct

SEQ ID NO: 2266760 - DNA, 15 bp, Homo sapiens
tgtactttttggcat

SEQ ID NO: 2266761 - DNA, 17 bp, Homo sapiens
tgtactttttggcataa

SEQ ID NO: 2266762 - DNA, 21 bp, Homo sapiens
tgtcttgcctttttcattatt

SEQ ID NO: 2266763 - DNA, 14 bp, Homo sapiens
tgtgcgctaaactt

SEQ ID NO: 2266764 - DNA, 19 bp, Homo sapiens
tgtgcgctaaacttttctg

SEQ ID NO: 2266765 - DNA, 18 bp, Homo sapiens
tgtgctggggttatctga

SEQ ID NO: 2266766 - DNA, 17 bp, Homo sapiens
tgtgtgaagtgagtgag

SEQ ID NO: 2266767 - DNA, 18 bp, Homo sapiens
tgttaaaccatgggataa

SEQ ID NO: 2266768 - DNA, 20 bp, Homo sapiens
tgttaaaccatgggataaat

SEQ ID NO: 2266769 - DNA, 21 bp, Homo sapiens
tgttgaaacggatgatttcta

SEQ ID NO: 2266770 - DNA, 23 bp, Homo sapiens
tgttgaaacggatgatttctatg

SEQ ID NO: 2266771 - DNA, 21 bp, Homo sapiens
tgttgtactcaattttaacaa

SEQ ID NO: 2266772 - DNA, 22 bp, Homo sapiens
tgtttagtcttgtctcagattt

SEQ ID NO: 2266773 - DNA, 23 bp, Homo sapiens
tgtttagtcttgtctcagatttt

SEQ ID NO: 2266774 - DNA, 23 bp, Homo sapiens
tgtttctgtactttttggcataa

SEQ ID NO: 2266775 - DNA, 21 bp, Homo sapiens
tgtttgtttagtcttgtctca

SEQ ID NO: 2266776 - DNA, 15 bp, Homo sapiens
ttaaaaaaaaaattg

SEQ ID NO: 2266777 - DNA, 14 bp, Homo sapiens
ttaaagccatgttt

SEQ ID NO: 2266778 - DNA, 13 bp, Homo sapiens
ttaaagttgaatt

SEQ ID NO: 2266779 - DNA, 17 bp, Homo sapiens
ttaaagttgaatttatt

SEQ ID NO: 2266780 - DNA, 12 bp, Homo sapiens
ttaacatgttaa

SEQ ID NO: 2266781 - DNA, 18 bp, Homo sapiens
ttaagcatatatttttat

SEQ ID NO: 2266782 - DNA, 18 bp, Homo sapiens
ttaataattatatgctat

SEQ ID NO: 2266783 - DNA, 23 bp, Homo sapiens
ttaataattatatgctatttcta

SEQ ID NO: 2266784 - DNA, 13 bp, Homo sapiens
ttaattttggaat

SEQ ID NO: 2266785 - DNA, 14 bp, Homo sapiens
ttaattttggaatt

SEQ ID NO: 2266786 - DNA, 16 bp, Homo sapiens
ttacagtataattaac

SEQ ID NO: 2266787 - DNA, 18 bp, Homo sapiens
ttacagtataattaacat

SEQ ID NO: 2266788 - DNA, 19 bp, Homo sapiens
ttacagtataattaacatg

SEQ ID NO: 2266789 - DNA, 16 bp, Homo sapiens
ttactaaaatggactg

SEQ ID NO: 2266790 - DNA, 15 bp, Homo sapiens
ttagaattctgtata

SEQ ID NO: 2266791 - DNA, 16 bp, Homo sapiens
ttagagagtgttgaaa

SEQ ID NO: 2266792 - DNA, 22 bp, Homo sapiens
ttatatctgaggaattctgtat

SEQ ID NO: 2266793 - DNA, 18 bp, Homo sapiens
acaaagtattaagcatat

SEQ ID NO: 2266794 - DNA, 20 bp, Homo sapiens
acaaagtattaagcatatat

SEQ ID NO: 2266795 - DNA, 20 bp, Homo sapiens
acaattttgtttctgtactt

SEQ ID NO: 2266796 - DNA, 17 bp, Homo sapiens
acaccattatgtgcgct

SEQ ID NO: 2266797 - DNA, 15 bp, Homo sapiens
acagtataattaaca

SEQ ID NO: 2266798 - DNA, 23 bp, Homo sapiens
acatgttaaaccatgggataaat

SEQ ID NO: 2266799 - DNA, 12 bp, Homo sapiens
accaaaaaccag

SEQ ID NO: 2266800 - DNA, 20 bp, Homo sapiens
accagtattgtacaaagtat

SEQ ID NO: 2266801 - DNA, 18 bp, Homo sapiens
accatgggataaatgcca

SEQ ID NO: 2266802 - DNA, 13 bp, Homo sapiens
acgcgttgaaatt

SEQ ID NO: 2266803 - DNA, 16 bp, Homo sapiens
acggtgaatggctttg

SEQ ID NO: 2266804 - DNA, 15 bp, Homo sapiens
actcaattttaacaa

SEQ ID NO: 2266805 - DNA, 22 bp, Homo sapiens
actgattcttcagcaaaaatat

SEQ ID NO: 2266806 - DNA, 16 bp, Homo sapiens
actggattgtactttg

SEQ ID NO: 2266807 - DNA, 20 bp, Homo sapiens
actggtgactgattcttcag

SEQ ID NO: 2266808 - DNA, 12 bp, Homo sapiens
actgtggtgact

SEQ ID NO: 2266809 - DNA, 20 bp, Homo sapiens
acttctttaattttggaatt

SEQ ID NO: 2266810 - DNA, 21 bp, Homo sapiens
acttctttaattttggaattt

SEQ ID NO: 2266811 - DNA, 19 bp, Homo sapiens
acttgaaatttgaattttg

SEQ ID NO: 2266812 - DNA, 21 bp, Homo sapiens
agaagccccaccctgcctcac

SEQ ID NO: 2266813 - DNA, 16 bp, Homo sapiens
agagagtgttgaaacg

SEQ ID NO: 2266814 - DNA, 23 bp, Homo sapiens
agagatttttttgttgtttgttt

SEQ ID NO: 2266815 - DNA, 14 bp, Homo sapiens
agatactggattgt

SEQ ID NO: 2266816 - DNA, 18 bp, Homo sapiens
agatctgcctaaggactt

SEQ ID NO: 2266817 - DNA, 15 bp, Homo sapiens
agattagaattctgt

SEQ ID NO: 2266818 - DNA, 16 bp, Homo sapiens
agattagaattctgta

SEQ ID NO: 2266819 - DNA, 22 bp, Homo sapiens
agattagaattctgtatagatt

SEQ ID NO: 2266820 - DNA, 16 bp, Homo sapiens
agattattcactgatt

SEQ ID NO: 2266821 - DNA, 14 bp, Homo sapiens
agattttattatgt

SEQ ID NO: 2266822 - DNA, 16 bp, Homo sapiens
agattttattatgtaa

SEQ ID NO: 2266823 - DNA, 19 bp, Homo sapiens
agattttattatgtaaatc

SEQ ID NO: 2266824 - DNA, 22 bp, Homo sapiens
agattttattatgtaaatccca

SEQ ID NO: 2266825 - DNA, 15 bp, Homo sapiens
agcaaaaatatttta

SEQ ID NO: 2266826 - DNA, 16 bp, Homo sapiens
agcagattattcactg

SEQ ID NO: 2266827 - DNA, 20 bp, Homo sapiens
agcagattattcactgattt

SEQ ID NO: 2266828 - DNA, 18 bp, Homo sapiens
agcatatatttttatatt

SEQ ID NO: 2266829 - DNA, 20 bp, Homo sapiens
agcatatatttttatattta

SEQ ID NO: 2266830 - DNA, 14 bp, Homo sapiens
agccatgtttatta

SEQ ID NO: 2266831 - DNA, 16 bp, Homo sapiens
agctagactggtgact

SEQ ID NO: 2266832 - DNA, 24 bp, Homo sapiens
aggaaaagtttaatattaaagcca

SEQ ID NO: 2266833 - DNA, 22 bp, Homo sapiens
aggaattctgtatagattagaa

SEQ ID NO: 2266834 - DNA, 16 bp, Homo sapiens
aggacttctttaattt

SEQ ID NO: 2266835 - DNA, 21 bp, Homo sapiens
aggacttctttaattttggaa

SEQ ID NO: 2266836 - DNA, 23 bp, Homo sapiens
aggacttctttaattttggaatt

SEQ ID NO: 2266837 - DNA, 16 bp, Homo sapiens
aggacttgttagatct

SEQ ID NO: 2266838 - DNA, 16 bp, Homo sapiens
agtataattaacatgt

SEQ ID NO: 2266839 - DNA, 12 bp, Homo sapiens
agtattaagcat

SEQ ID NO: 2266840 - DNA, 14 bp, Homo sapiens
agtattaagcatat

SEQ ID NO: 2266841 - DNA, 11 bp, Homo sapiens
agtattgtaca

SEQ ID NO: 2266842 - DNA, 20 bp, Homo sapiens
agtattgtacaaagtattaa

SEQ ID NO: 2266843 - DNA, 17 bp, Homo sapiens
agtcttgtctcagattt

SEQ ID NO: 2266844 - DNA, 19 bp, Homo sapiens
agtcttgtctcagatttta

SEQ ID NO: 2266845 - DNA, 21 bp, Homo sapiens
agtcttgtctcagattttatt

SEQ ID NO: 2266846 - DNA, 20 bp, Homo sapiens
agtgagttgggtgtattgtg

SEQ ID NO: 2266847 - DNA, 24 bp, Homo sapiens
agttcactctccatttaataatta

SEQ ID NO: 2266848 - DNA, 15 bp, Homo sapiens
agttgcctaaatcca

SEQ ID NO: 2266849 - DNA, 16 bp, Homo sapiens
agttgggtgtattgtg

SEQ ID NO: 2266850 - DNA, 17 bp, Homo sapiens
agttgggtgtattgtgc

SEQ ID NO: 2266851 - DNA, 20 bp, Homo sapiens
agttgggtgtattgtgcgct

SEQ ID NO: 2266852 - DNA, 16 bp, Homo sapiens
agtttaatattaaagc

SEQ ID NO: 2266853 - DNA, 14 bp, Homo sapiens
agttttgtttggac

SEQ ID NO: 2266854 - DNA, 16 bp, Homo sapiens
ataaaaaattatgaca

SEQ ID NO: 2266855 - DNA, 16 bp, Homo sapiens
ataaatagctagactg

SEQ ID NO: 2266856 - DNA, 18 bp, Homo sapiens
ataaatagctagactggt

SEQ ID NO: 2266857 - DNA, 21 bp, Homo sapiens
ataaatagctagactggtgac

SEQ ID NO: 2266858 - DNA, 15 bp, Homo sapiens
ataaatctgtgaact

SEQ ID NO: 2266859 - DNA, 17 bp, Homo sapiens
ataacataaatctgtga

SEQ ID NO: 2266860 - DNA, 16 bp, Homo sapiens
ataataaggaaaagtt

SEQ ID NO: 2266861 - DNA, 17 bp, Homo sapiens
ataataaggaaaagttt

SEQ ID NO: 2266862 - DNA, 22 bp, Homo sapiens
ataattaacatgttaaaccatg

SEQ ID NO: 2266863 - DNA, 17 bp, Homo sapiens
atacaattttgtttctg

SEQ ID NO: 2266864 - DNA, 21 bp, Homo sapiens
atagaggaagcctgattaaag

SEQ ID NO: 2266865 - DNA, 13 bp, Homo sapiens
atagattagaatt

SEQ ID NO: 2266866 - DNA, 14 bp, Homo sapiens
atagctagactggt

SEQ ID NO: 2266867 - DNA, 19 bp, Homo sapiens
atagctagactggtgactg

SEQ ID NO: 2266868 - DNA, 13 bp, Homo sapiens
atatatttttata

SEQ ID NO: 2266869 - DNA, 19 bp, Homo sapiens
atatatttttatatttact

SEQ ID NO: 2266870 - DNA, 16 bp, Homo sapiens
atatctgaggaattct

SEQ ID NO: 2266871 - DNA, 19 bp, Homo sapiens
atatctgaggaattctgta

SEQ ID NO: 2266872 - DNA, 22 bp, Homo sapiens
atatgctatttctatattttca

SEQ ID NO: 2266873 - DNA, 18 bp, Homo sapiens
atattaaagccatgttta

SEQ ID NO: 2266874 - DNA, 13 bp, Homo sapiens
atattttatgatc

SEQ ID NO: 2266875 - DNA, 17 bp, Homo sapiens
atattttatgatccagc

SEQ ID NO: 2266876 - DNA, 17 bp, Homo sapiens
atattttcattctccta

SEQ ID NO: 2266877 - DNA, 15 bp, Homo sapiens
atcaataaaaaatta

SEQ ID NO: 2266878 - DNA, 21 bp, Homo sapiens
atccagttttgtttggaccaa

SEQ ID NO: 2266879 - DNA, 13 bp, Homo sapiens
atccatttggaaa

SEQ ID NO: 2266880 - DNA, 15 bp, Homo sapiens
atcccattattcaaa

SEQ ID NO: 2266881 - DNA, 20 bp, Homo sapiens
atcccattattcaaagttgc

SEQ ID NO: 2266882 - DNA, 18 bp, Homo sapiens
atctgaagtcagatctgc

SEQ ID NO: 2266883 - DNA, 15 bp, Homo sapiens
atctgaggaattctg

SEQ ID NO: 2266884 - DNA, 16 bp, Homo sapiens
atctgaggaattctgt

SEQ ID NO: 2266885 - DNA, 17 bp, Homo sapiens
atctgaggaattctgta

SEQ ID NO: 2266886 - DNA, 18 bp, Homo sapiens
atctgaggaattctgtat

SEQ ID NO: 2266887 - DNA, 20 bp, Homo sapiens
atctgaggaattctgtatag

SEQ ID NO: 2266888 - DNA, 14 bp, Homo sapiens
atctgcctaaggac

SEQ ID NO: 2266889 - DNA, 15 bp, Homo sapiens
atctgcctaaggact

SEQ ID NO: 2266890 - DNA, 13 bp, Homo sapiens
atgatttctatgc

SEQ ID NO: 2266891 - DNA, 13 bp, Homo sapiens
atgctatttctat

SEQ ID NO: 2266892 - DNA, 15 bp, Homo sapiens
atgctatttctatat

SEQ ID NO: 2266893 - DNA, 21 bp, Homo sapiens
atgctatttctatattttcat

SEQ ID NO: 2266894 - DNA, 22 bp, Homo sapiens
atgctatttctatattttcatt

SEQ ID NO: 2266895 - DNA, 18 bp, Homo sapiens
atggaacgcgttgaaatt

SEQ ID NO: 2266896 - DNA, 18 bp, Homo sapiens
atggctttgtatagaacc

SEQ ID NO: 2266897 - DNA, 19 bp, Homo sapiens
atggctttgtatagaacct

SEQ ID NO: 2266898 - DNA, 16 bp, Homo sapiens
atgggataaatgccat

SEQ ID NO: 2266899 - DNA, 18 bp, Homo sapiens
atggtccgtgctaaggac

SEQ ID NO: 2266900 - DNA, 12 bp, Homo sapiens
atgtttattaca

SEQ ID NO: 2266901 - DNA, 19 bp, Homo sapiens
atgtttattacagtataat

SEQ ID NO: 2266902 - DNA, 11 bp, Homo sapiens
attaaagccat

SEQ ID NO: 2266903 - DNA, 16 bp, Homo sapiens
attaaagccatgttta

SEQ ID NO: 2266904 - DNA, 17 bp, Homo sapiens
attaacatgttaaacca

SEQ ID NO: 2266905 - DNA, 14 bp, Homo sapiens
attaagcatatatt

SEQ ID NO: 2266906 - DNA, 15 bp, Homo sapiens
attacagtataatta

SEQ ID NO: 2266907 - DNA, 16 bp, Homo sapiens
attacagtataattaa

SEQ ID NO: 2266908 - DNA, 13 bp, Homo sapiens
attagaattctgt

SEQ ID NO: 2266909 - DNA, 17 bp, Homo sapiens
aaaaattggggattctt

SEQ ID NO: 2266910 - DNA, 20 bp, Homo sapiens
aaaaattggggattcttaaa

SEQ ID NO: 2266911 - DNA, 18 bp, Homo sapiens
aaaagtttaatattaaag

SEQ ID NO: 2266912 - DNA, 23 bp, Homo sapiens
aaaagtttaatattaaagccatg

SEQ ID NO: 2266913 - DNA, 15 bp, Homo sapiens
aaaatattttatgat

SEQ ID NO: 2266914 - DNA, 22 bp, Homo sapiens
aaaatggactgtggtgactttg

SEQ ID NO: 2266915 - DNA, 23 bp, Homo sapiens
aaaattggggattcttaaagttg

SEQ ID NO: 2266916 - DNA, 14 bp, Homo sapiens
aaaccagtattgta

SEQ ID NO: 2266917 - DNA, 16 bp, Homo sapiens
aaaccagtattgtaca

SEQ ID NO: 2266918 - DNA, 22 bp, Homo sapiens
aaaccagtattgtacaaagtat

SEQ ID NO: 2266919 - DNA, 15 bp, Homo sapiens
aaaccatgggataaa

SEQ ID NO: 2266920 - DNA, 12 bp, Homo sapiens
aaacttttctga

SEQ ID NO: 2266921 - DNA, 13 bp, Homo sapiens
aaacttttctgat

SEQ ID NO: 2266922 - DNA, 16 bp, Homo sapiens
aaacttttctgataga

SEQ ID NO: 2266923 - DNA, 17 bp, Homo sapiens
aaacttttctgatagag

SEQ ID NO: 2266924 - DNA, 19 bp, Homo sapiens
aaagtattaagcatatatt

SEQ ID NO: 2266925 - DNA, 12 bp, Homo sapiens
aaagttgaattt

SEQ ID NO: 2266926 - DNA, 14 bp, Homo sapiens
aaagttgcctaaat

SEQ ID NO: 2266927 - DNA, 14 bp, Homo sapiens
aaagtttaatatta

SEQ ID NO: 2266928 - DNA, 19 bp, Homo sapiens
aaatcccattattcaaagt

SEQ ID NO: 2266929 - DNA, 22 bp, Homo sapiens
aaatcccattattcaaagttgc

SEQ ID NO: 2266930 - DNA, 20 bp, Homo sapiens
aaatctgtgaacttgaaatt

SEQ ID NO: 2266931 - DNA, 19 bp, Homo sapiens
aaatggactgtggtgactt

SEQ ID NO: 2266932 - DNA, 20 bp, Homo sapiens
aaatggactgtggtgacttt

SEQ ID NO: 2266933 - DNA, 21 bp, Homo sapiens
aaatggactgtggtgactttg

SEQ ID NO: 2266934 - DNA, 17 bp, Homo sapiens
aaattggggattcttaa

SEQ ID NO: 2266935 - DNA, 18 bp, Homo sapiens
aaattggggattcttaaa

SEQ ID NO: 2266936 - DNA, 19 bp, Homo sapiens
aaattggggattcttaaag

SEQ ID NO: 2266937 - DNA, 22 bp, Homo sapiens
aaatttgaattttgtgttagag

SEQ ID NO: 2266938 - DNA, 14 bp, Homo sapiens
aacataaatctgtg

SEQ ID NO: 2266939 - DNA, 15 bp, Homo sapiens
aacataaatctgtga

SEQ ID NO: 2266940 - DNA, 14 bp, Homo sapiens
aacatgttaaacca

SEQ ID NO: 2266941 - DNA, 15 bp, Homo sapiens
aacatgttaaaccat

SEQ ID NO: 2266942 - DNA, 23 bp, Homo sapiens
aacatgttaaaccatgggataaa

SEQ ID NO: 2266943 - DNA, 22 bp, Homo sapiens
aaccagtattgtacaaagtatt

SEQ ID NO: 2266944 - DNA, 21 bp, Homo sapiens
aaccatgggataaatgccatc

SEQ ID NO: 2266945 - DNA, 14 bp, Homo sapiens
aacgcgttgaaatt

SEQ ID NO: 2266946 - DNA, 17 bp, Homo sapiens
aacgcgttgaaattgta

SEQ ID NO: 2266947 - DNA, 15 bp, Homo sapiens
aacggatgatttcta

SEQ ID NO: 2266948 - DNA, 17 bp, Homo sapiens
aacggatgatttctatg

SEQ ID NO: 2266949 - DNA, 13 bp, Homo sapiens
aacttgaaatttg

SEQ ID NO: 2266950 - DNA, 19 bp, Homo sapiens
aacttgaaatttgaatttt

SEQ ID NO: 2266951 - DNA, 14 bp, Homo sapiens
aacttgtgtaaata

SEQ ID NO: 2266952 - DNA, 12 bp, Homo sapiens
aacttttctgat

SEQ ID NO: 2266953 - DNA, 13 bp, Homo sapiens
aacttttctgata

SEQ ID NO: 2266954 - DNA, 22 bp, Homo sapiens
aagaatggtccgtgctaaggac

SEQ ID NO: 2266955 - DNA, 23 bp, Homo sapiens
aagcatatatttttatatttact

SEQ ID NO: 2266956 - DNA, 15 bp, Homo sapiens
aagccatgtttatta

SEQ ID NO: 2266957 - DNA, 23 bp, Homo sapiens
aaggacttctttaattttggaat

SEQ ID NO: 2266958 - DNA, 14 bp, Homo sapiens
aagtattaagcata

SEQ ID NO: 2266959 - DNA, 15 bp, Homo sapiens
aagtattaagcatat

SEQ ID NO: 2266960 - DNA, 18 bp, Homo sapiens
aagtcagatctgcctaag

SEQ ID NO: 2266961 - DNA, 23 bp, Homo sapiens
aagtcagatctgcctaaggactt

SEQ ID NO: 2266962 - DNA, 14 bp, Homo sapiens
aagttgaatttatt

SEQ ID NO: 2266963 - DNA, 19 bp, Homo sapiens
aagttgcctaaatccattt

SEQ ID NO: 2266964 - DNA, 20 bp, Homo sapiens
aagtttaatattaaagccat

SEQ ID NO: 2266965 - DNA, 21 bp, Homo sapiens
aagtttaatattaaagccatg

SEQ ID NO: 2266966 - DNA, 22 bp, Homo sapiens
aataattatatgctatttctat

SEQ ID NO: 2266967 - DNA, 23 bp, Homo sapiens
aataattatatgctatttctata

SEQ ID NO: 2266968 - DNA, 12 bp, Homo sapiens
aatacaattttg

SEQ ID NO: 2266969 - DNA, 18 bp, Homo sapiens
aatacaattttgtttctg

SEQ ID NO: 2266970 - DNA, 22 bp, Homo sapiens
aatacaattttgtttctgtact

SEQ ID NO: 2266971 - DNA, 14 bp, Homo sapiens
aatagctagactgg

SEQ ID NO: 2266972 - DNA, 12 bp, Homo sapiens
aatattaaagcc

SEQ ID NO: 2266973 - DNA, 16 bp, Homo sapiens
aatattaaagccatgt

SEQ ID NO: 2266974 - DNA, 22 bp, Homo sapiens
aatattaaagccatgtttatta

SEQ ID NO: 2266975 - DNA, 14 bp, Homo sapiens
aatccatttggaaa

SEQ ID NO: 2266976 - DNA, 21 bp, Homo sapiens
aatcccattattcaaagttgc

SEQ ID NO: 2266977 - DNA, 16 bp, Homo sapiens
aatggctttgtataga

SEQ ID NO: 2266978 - DNA, 18 bp, Homo sapiens
aatggctttgtatagaac

SEQ ID NO: 2266979 - DNA, 18 bp, Homo sapiens
aattaacatgttaaacca

SEQ ID NO: 2266980 - DNA, 19 bp, Homo sapiens
aattaacatgttaaaccat

SEQ ID NO: 2266981 - DNA, 23 bp, Homo sapiens
aattatatctgaggaattctgta

SEQ ID NO: 2266982 - DNA, 19 bp, Homo sapiens
aattatatgctatttctat

SEQ ID NO: 2266983 - DNA, 20 bp, Homo sapiens
aattggggattcttaaagtt

SEQ ID NO: 2266984 - DNA, 14 bp, Homo sapiens
aattgtaattatat

SEQ ID NO: 2266985 - DNA, 20 bp, Homo sapiens
aatttattggcttttctgat

SEQ ID NO: 2266986 - DNA, 21 bp, Homo sapiens
aatttattggcttttctgatc

SEQ ID NO: 2266987 - DNA, 18 bp, Homo sapiens
aatttgaattttgtgtta

SEQ ID NO: 2266988 - DNA, 14 bp, Homo sapiens
aattttgtttctgt

SEQ ID NO: 2266989 - DNA, 13 bp, Homo sapiens
acaaagtattaag

SEQ ID NO: 2266990 - DNA, 15 bp, Homo sapiens
acaaagtattaagca

SEQ ID NO: 2266991 - DNA, 16 bp, Homo sapiens
gaaatttgaattttgt

SEQ ID NO: 2266992 - DNA, 15 bp, Homo sapiens
gaacgcgttgaaatt

SEQ ID NO: 2266993 - DNA, 16 bp, Homo sapiens
gaatggctttgtatag

SEQ ID NO: 2266994 - DNA, 17 bp, Homo sapiens
gaatggctttgtataga

SEQ ID NO: 2266995 - DNA, 11 bp, Homo sapiens
gaattctgtat

SEQ ID NO: 2266996 - DNA, 13 bp, Homo sapiens
gaattctgtatag

SEQ ID NO: 2266997 - DNA, 21 bp, Homo sapiens
gaattctgtatagattagaat

SEQ ID NO: 2266998 - DNA, 13 bp, Homo sapiens
gaattttgtgtta

SEQ ID NO: 2266999 - DNA, 16 bp, Homo sapiens
gaattttgtgttagag

SEQ ID NO: 2267000 - DNA, 22 bp, Homo sapiens
gaattttgtgttagagattttt

SEQ ID NO: 2267001 - DNA, 19 bp, Homo sapiens
gaccaaaaaccagtattgt

SEQ ID NO: 2267002 - DNA, 15 bp, Homo sapiens
gactggtgactgatt

SEQ ID NO: 2267003 - DNA, 17 bp, Homo sapiens
gacttctttaattttgg

SEQ ID NO: 2267004 - DNA, 20 bp, Homo sapiens
gacttctttaattttggaat

SEQ ID NO: 2267005 - DNA, 12 bp, Homo sapiens
gacttgttagat

SEQ ID NO: 2267006 - DNA, 23 bp, Homo sapiens
gagcctgcacggtgaatggcttt

SEQ ID NO: 2267007 - DNA, 16 bp, Homo sapiens
gagtgttgaaacggat

SEQ ID NO: 2267008 - DNA, 15 bp, Homo sapiens
gataaatgccatcaa

SEQ ID NO: 2267009 - DNA, 21 bp, Homo sapiens
gataataaggaaaagtttaat

SEQ ID NO: 2267010 - DNA, 22 bp, Homo sapiens
gataataaggaaaagtttaata

SEQ ID NO: 2267011 - DNA, 16 bp, Homo sapiens
gatactggattgtact

SEQ ID NO: 2267012 - DNA, 14 bp, Homo sapiens
gatagaggaagcct

SEQ ID NO: 2267013 - DNA, 19 bp, Homo sapiens
gatccagcagattattcac

SEQ ID NO: 2267014 - DNA, 17 bp, Homo sapiens
gatctgcctaaggactt

SEQ ID NO: 2267015 - DNA, 20 bp, Homo sapiens
gatctgcctaaggacttctt

SEQ ID NO: 2267016 - DNA, 13 bp, Homo sapiens
gatgatttctatg

SEQ ID NO: 2267017 - DNA, 15 bp, Homo sapiens
gattagaattctgta

SEQ ID NO: 2267018 - DNA, 23 bp, Homo sapiens
gattagaattctgtatagattag

SEQ ID NO: 2267019 - DNA, 14 bp, Homo sapiens
gattagagagtgtt

SEQ ID NO: 2267020 - DNA, 13 bp, Homo sapiens
gattattcactga

SEQ ID NO: 2267021 - DNA, 16 bp, Homo sapiens
gattcttaaagttgaa

SEQ ID NO: 2267022 - DNA, 17 bp, Homo sapiens
gattcttaaagttgaat

SEQ ID NO: 2267023 - DNA, 21 bp, Homo sapiens
gatttttttgttgtttgttta

SEQ ID NO: 2267024 - DNA, 22 bp, Homo sapiens
gcaaaaatattttatgatccag

SEQ ID NO: 2267025 - DNA, 18 bp, Homo sapiens
gcacggtgaatggctttg

SEQ ID NO: 2267026 - DNA, 13 bp, Homo sapiens
gcagattattcac

SEQ ID NO: 2267027 - DNA, 18 bp, Homo sapiens
gcagattattcactgatt

SEQ ID NO: 2267028 - DNA, 20 bp, Homo sapiens
gcatatatttttatatttac

SEQ ID NO: 2267029 - DNA, 18 bp, Homo sapiens
gccatgtttattacagta

SEQ ID NO: 2267030 - DNA, 22 bp, Homo sapiens
gccatgtttattacagtataat

SEQ ID NO: 2267031 - DNA, 11 bp, Homo sapiens
gcctaaatcca

SEQ ID NO: 2267032 - DNA, 21 bp, Homo sapiens
gcctaaatccatttggaaatc

SEQ ID NO: 2267033 - DNA, 22 bp, Homo sapiens
gcctaaatccatttggaaatct

SEQ ID NO: 2267034 - DNA, 18 bp, Homo sapiens
gcctaaggacttctttaa

SEQ ID NO: 2267035 - DNA, 17 bp, Homo sapiens
gctaaacttttctgata

SEQ ID NO: 2267036 - DNA, 13 bp, Homo sapiens
gctatttctatat

SEQ ID NO: 2267037 - DNA, 15 bp, Homo sapiens
gctatttctatattt

SEQ ID NO: 2267038 - DNA, 16 bp, Homo sapiens
gctatttctatatttt

SEQ ID NO: 2267039 - DNA, 22 bp, Homo sapiens
gctggggttatctgaagtcaga

SEQ ID NO: 2267040 - DNA, 24 bp, Homo sapiens
gctggtgccctgctttcagatact

SEQ ID NO: 2267041 - DNA, 23 bp, Homo sapiens
gctttcagatactggattgtact

SEQ ID NO: 2267042 - DNA, 14 bp, Homo sapiens
gctttgtatagaac

SEQ ID NO: 2267043 - DNA, 20 bp, Homo sapiens
gctttgtatagaacctcttt

SEQ ID NO: 2267044 - DNA, 11 bp, Homo sapiens
gcttttctgat

SEQ ID NO: 2267045 - DNA, 12 bp, Homo sapiens
gcttttctgatc

SEQ ID NO: 2267046 - DNA, 14 bp, Homo sapiens
ggaccaaaaaccag

SEQ ID NO: 2267047 - DNA, 23 bp, Homo sapiens
ggaccaaaaaccagtattgtaca

SEQ ID NO: 2267048 - DNA, 17 bp, Homo sapiens
ggactgtggtgactttg

SEQ ID NO: 2267049 - DNA, 12 bp, Homo sapiens
ggataaatgcca

SEQ ID NO: 2267050 - DNA, 13 bp, Homo sapiens
ggattcttaaagt

SEQ ID NO: 2267051 - DNA, 16 bp, Homo sapiens
ggattcttaaagttga

SEQ ID NO: 2267052 - DNA, 18 bp, Homo sapiens
ggattcttaaagttgaat

SEQ ID NO: 2267053 - DNA, 17 bp, Homo sapiens
ggcataacataaatctg

SEQ ID NO: 2267054 - DNA, 12 bp, Homo sapiens
ggcttttctgat

SEQ ID NO: 2267055 - DNA, 18 bp, Homo sapiens
ggtccgtgctaaggactt

SEQ ID NO: 2267056 - DNA, 20 bp, Homo sapiens
ggtgaatggctttgtataga

SEQ ID NO: 2267057 - DNA, 23 bp, Homo sapiens
gtaaatacaattttgtttctgta

SEQ ID NO: 2267058 - DNA, 18 bp, Homo sapiens
gtaaatcccattattcaa

SEQ ID NO: 2267059 - DNA, 13 bp, Homo sapiens
gtaattatatctg

SEQ ID NO: 2267060 - DNA, 12 bp, Homo sapiens
gtactttttggc

SEQ ID NO: 2267061 - DNA, 13 bp, Homo sapiens
gtataattaacat

SEQ ID NO: 2267062 - DNA, 13 bp, Homo sapiens
gtatgtgtgaagt

SEQ ID NO: 2267063 - DNA, 19 bp, Homo sapiens
gtattgtacaaagtattaa

SEQ ID NO: 2267064 - DNA, 23 bp, Homo sapiens
gtattgtacaaagtattaagcat

SEQ ID NO: 2267065 - DNA, 16 bp, Homo sapiens
gtcagatctgcctaag

SEQ ID NO: 2267066 - DNA, 18 bp, Homo sapiens
gtcagatctgcctaagga

SEQ ID NO: 2267067 - DNA, 20 bp, Homo sapiens
gtcagatctgcctaaggact

SEQ ID NO: 2267068 - DNA, 21 bp, Homo sapiens
gtcagatctgcctaaggactt

SEQ ID NO: 2267069 - DNA, 16 bp, Homo sapiens
gtccgtgctaaggact

SEQ ID NO: 2267070 - DNA, 17 bp, Homo sapiens
gtccgtgctaaggactt

SEQ ID NO: 2267071 - DNA, 16 bp, Homo sapiens
gtctcagattttatta

SEQ ID NO: 2267072 - DNA, 21 bp, Homo sapiens
gtctcagattttattatgtaa

SEQ ID NO: 2267073 - DNA, 15 bp, Homo sapiens
gtcttgcctttttca

SEQ ID NO: 2267074 - DNA, 17 bp, Homo sapiens
gtcttgcctttttcatt

SEQ ID NO: 2267075 - DNA, 20 bp, Homo sapiens
gtcttgtctcagattttatt

SEQ ID NO: 2267076 - DNA, 15 bp, Homo sapiens
gtgaacttgaaattt

SEQ ID NO: 2267077 - DNA, 18 bp, Homo sapiens
gtgaatggctttgtatag

SEQ ID NO: 2267078 - DNA, 19 bp, Homo sapiens
gtgaatggctttgtataga

SEQ ID NO: 2267079 - DNA, 12 bp, Homo sapiens
gtgactttggat

SEQ ID NO: 2267080 - DNA, 17 bp, Homo sapiens
gtgcgctaaacttttct

SEQ ID NO: 2267081 - DNA, 19 bp, Homo sapiens
gtgctggtgtatgtgtgaa

SEQ ID NO: 2267082 - DNA, 13 bp, Homo sapiens
gtggtgactttgg

SEQ ID NO: 2267083 - DNA, 15 bp, Homo sapiens
gtggtgactttggat

SEQ ID NO: 2267084 - DNA, 16 bp, Homo sapiens
gtggtgactttggata

SEQ ID NO: 2267085 - DNA, 18 bp, Homo sapiens
gtgtaaatacaattttgt

SEQ ID NO: 2267086 - DNA, 21 bp, Homo sapiens
gtgtaaatacaattttgtttc

SEQ ID NO: 2267087 - DNA, 23 bp, Homo sapiens
gtgttgaaacggatgatttctat

SEQ ID NO: 2267088 - DNA, 13 bp, Homo sapiens
taatattaaagcc

SEQ ID NO: 2267089 - DNA, 16 bp, Homo sapiens
taatattaaagccatg

SEQ ID NO: 2267090 - DNA, 17 bp, Homo sapiens
taatattaaagccatgt

SEQ ID NO: 2267091 - DNA, 18 bp, Homo sapiens
taattaacatgttaaacc

SEQ ID NO: 2267092 - DNA, 19 bp, Homo sapiens
taattaacatgttaaacca

SEQ ID NO: 2267093 - DNA, 13 bp, Homo sapiens
taattatatctga

SEQ ID NO: 2267094 - DNA, 22 bp, Homo sapiens
taattatatctgaggaattctg

SEQ ID NO: 2267095 - DNA, 14 bp, Homo sapiens
tacaaagtattaag

SEQ ID NO: 2267096 - DNA, 15 bp, Homo sapiens
tacaattttgtttct

SEQ ID NO: 2267097 - DNA, 14 bp, Homo sapiens
tacaccattatgtg

SEQ ID NO: 2267098 - DNA, 19 bp, Homo sapiens
tacagtataattaacatgt

SEQ ID NO: 2267099 - DNA, 15 bp, Homo sapiens
tactaaaatggactg

SEQ ID NO: 2267100 - DNA, 23 bp, Homo sapiens
tactaaaatggactgtggtgact

SEQ ID NO: 2267101 - DNA, 14 bp, Homo sapiens
tactggattgtact

SEQ ID NO: 2267102 - DNA, 20 bp, Homo sapiens
tactttttggcataacataa

SEQ ID NO: 2267103 - DNA, 14 bp, Homo sapiens
tagaacctctttgt

SEQ ID NO: 2267104 - DNA, 15 bp, Homo sapiens
tagaattctgtatag

SEQ ID NO: 2267105 - DNA, 17 bp, Homo sapiens
tagactggtgactgatt

SEQ ID NO: 2267106 - DNA, 21 bp, Homo sapiens
tagactggtgactgattcttc

SEQ ID NO: 2267107 - DNA, 23 bp, Homo sapiens
tagagatttttttgttgtttgtt

SEQ ID NO: 2267108 - DNA, 14 bp, Homo sapiens
tagatctagttcac

SEQ ID NO: 2267109 - DNA, 15 bp, Homo sapiens
tagattagaattctg

SEQ ID NO: 2267110 - DNA, 20 bp, Homo sapiens
tagattagaattctgtatag

SEQ ID NO: 2267111 - DNA, 18 bp, Homo sapiens
tataattaacatgttaaa

SEQ ID NO: 2267112 - DNA, 22 bp, Homo sapiens
tataattaacatgttaaaccat

SEQ ID NO: 2267113 - DNA, 16 bp, Homo sapiens
tatatgctatttctat

SEQ ID NO: 2267114 - DNA, 20 bp, Homo sapiens
tatatttactaaaatggact

SEQ ID NO: 2267115 - DNA, 21 bp, Homo sapiens
tatatttactaaaatggactg

SEQ ID NO: 2267116 - DNA, 18 bp, Homo sapiens
tatatttttatatttact

SEQ ID NO: 2267117 - DNA, 19 bp, Homo sapiens
tatatttttatatttacta

SEQ ID NO: 2267118 - DNA, 17 bp, Homo sapiens
tatctgaggaattctgt

SEQ ID NO: 2267119 - DNA, 18 bp, Homo sapiens
tatctgaggaattctgta

SEQ ID NO: 2267120 - DNA, 21 bp, Homo sapiens
tatctgaggaattctgtatag

SEQ ID NO: 2267121 - DNA, 22 bp, Homo sapiens
tatgatccagcagattattcac

SEQ ID NO: 2267122 - DNA, 14 bp, Homo sapiens
tatgctatttctat

SEQ ID NO: 2267123 - DNA, 22 bp, Homo sapiens
tatgctatttctatattttcat

SEQ ID NO: 2267124 - DNA, 15 bp, Homo sapiens
tatgtaaatcccatt

SEQ ID NO: 2267125 - DNA, 13 bp, Homo sapiens
tattaaagccatg

SEQ ID NO: 2267126 - DNA, 18 bp, Homo sapiens
tattaaagccatgtttat

SEQ ID NO: 2267127 - DNA, 12 bp, Homo sapiens
tattacagtata

SEQ ID NO: 2267128 - DNA, 20 bp, Homo sapiens
tattatgaaacttgtgtaaa

SEQ ID NO: 2267129 - DNA, 22 bp, Homo sapiens
tattatgaaacttgtgtaaata

SEQ ID NO: 2267130 - DNA, 12 bp, Homo sapiens
tattatgtaaat

SEQ ID NO: 2267131 - DNA, 15 bp, Homo sapiens
tattatgtaaatccc

SEQ ID NO: 2267132 - DNA, 22 bp, Homo sapiens
tattcactgatttgacatagtc

SEQ ID NO: 2267133 - DNA, 15 bp, Homo sapiens
tattggcttttctga

SEQ ID NO: 2267134 - DNA, 17 bp, Homo sapiens
tattggcttttctgatc

SEQ ID NO: 2267135 - DNA, 21 bp, Homo sapiens
tattgtacaaagtattaagca

SEQ ID NO: 2267136 - DNA, 23 bp, Homo sapiens
tattgtacaaagtattaagcata

SEQ ID NO: 2267137 - DNA, 18 bp, Homo sapiens
tatttctatattttcatt

SEQ ID NO: 2267138 - DNA, 18 bp, Homo sapiens
tattttattatgaaactt

SEQ ID NO: 2267139 - DNA, 15 bp, Homo sapiens
tattttcattctcct

SEQ ID NO: 2267140 - DNA, 15 bp, Homo sapiens
tcaaagttgcctaaa

SEQ ID NO: 2267141 - DNA, 21 bp, Homo sapiens
tcaaagttgcctaaatccatt

SEQ ID NO: 2267142 - DNA, 22 bp, Homo sapiens
tcaaagttgcctaaatccattt

SEQ ID NO: 2267143 - DNA, 18 bp, Homo sapiens
tcacattggtgttgtact

SEQ ID NO: 2267144 - DNA, 18 bp, Homo sapiens
tcactctccatttaataa

SEQ ID NO: 2267145 - DNA, 20 bp, Homo sapiens
tcagatactggattgtactt

SEQ ID NO: 2267146 - DNA, 13 bp, Homo sapiens
tcagattttatta

SEQ ID NO: 2267147 - DNA, 15 bp, Homo sapiens
tcagattttattatg

SEQ ID NO: 2267148 - DNA, 20 bp, Homo sapiens
tcagcaaaaatattttatga

SEQ ID NO: 2267149 - DNA, 15 bp, Homo sapiens
tcattattttattat

SEQ ID NO: 2267150 - DNA, 18 bp, Homo sapiens
tcattattttattatgaa

SEQ ID NO: 2267151 - DNA, 19 bp, Homo sapiens
tcattattttattatgaaa

SEQ ID NO: 2267152 - DNA, 15 bp, Homo sapiens
tccagcagattattc

SEQ ID NO: 2267153 - DNA, 15 bp, Homo sapiens
tccagttttgtttgg

SEQ ID NO: 2267154 - DNA, 18 bp, Homo sapiens
tccatttaataattatat

SEQ ID NO: 2267155 - DNA, 12 bp, Homo sapiens
tccatttggaaa

SEQ ID NO: 2267156 - DNA, 19 bp, Homo sapiens
tccatttggaaatctttaa

SEQ ID NO: 2267157 - DNA, 18 bp, Homo sapiens
tcccattattcaaagttg

SEQ ID NO: 2267158 - DNA, 15 bp, Homo sapiens
tccgtgctaaggact

SEQ ID NO: 2267159 - DNA, 18 bp, Homo sapiens
tccgtgctaaggacttgt

SEQ ID NO: 2267160 - DNA, 20 bp, Homo sapiens
tcctatcacctgtcttgcct

SEQ ID NO: 2267161 - DNA, 13 bp, Homo sapiens
tctatattttcat

SEQ ID NO: 2267162 - DNA, 15 bp, Homo sapiens
tctatattttcattc

SEQ ID NO: 2267163 - DNA, 20 bp, Homo sapiens
tctatgctgagtttgtgctg

SEQ ID NO: 2267164 - DNA, 16 bp, Homo sapiens
tctcagattttattat

SEQ ID NO: 2267165 - DNA, 18 bp, Homo sapiens
tctcagattttattatgt

SEQ ID NO: 2267166 - DNA, 23 bp, Homo sapiens
tctcagattttattatgtaaatc

SEQ ID NO: 2267167 - DNA, 12 bp, Homo sapiens
tctccatttaat

SEQ ID NO: 2267168 - DNA, 15 bp, Homo sapiens
tctgaggaattctgt

SEQ ID NO: 2267169 - DNA, 16 bp, Homo sapiens
tctgaggaattctgta

SEQ ID NO: 2267170 - DNA, 18 bp, Homo sapiens
tctgaggaattctgtata

SEQ ID NO: 2267171 - DNA, 11 bp, Homo sapiens
tctgatccagt

SEQ ID NO: 2267172 - DNA, 14 bp, Homo sapiens
tctgatccagtttt

SEQ ID NO: 2267173 - DNA, 23 bp, Homo sapiens
tctgcctaaggacttctttaatt

SEQ ID NO: 2267174 - DNA, 14 bp, Homo sapiens
tctgtgaacttgaa

SEQ ID NO: 2267175 - DNA, 22 bp, Homo sapiens
tctgtgaacttgaaatttgaat

SEQ ID NO: 2267176 - DNA, 16 bp, Homo sapiens
tcttaaagttgaattt

SEQ ID NO: 2267177 - DNA, 23 bp, Homo sapiens
tcttcagcaaaaatattttatga

SEQ ID NO: 2267178 - DNA, 15 bp, Homo sapiens
tcttgtctcagattt

SEQ ID NO: 2267179 - DNA, 15 bp, Homo sapiens
tctttaattttggaa

SEQ ID NO: 2267180 - DNA, 18 bp, Homo sapiens
tgaaacggatgatttcta

SEQ ID NO: 2267181 - DNA, 15 bp, Homo sapiens
tggtgactgattctt

SEQ ID NO: 2267182 - DNA, 19 bp, Homo sapiens
tggtgactgattcttcagc

SEQ ID NO: 2267183 - DNA, 16 bp, Homo sapiens
tggtgccctgctttca

SEQ ID NO: 2267184 - DNA, 19 bp, Homo sapiens
tggtgccctgctttcagat

SEQ ID NO: 2267185 - DNA, 20 bp, Homo sapiens
tggtgccctgctttcagata

SEQ ID NO: 2267186 - DNA, 17 bp, Homo sapiens
tgtaaatacaattttgt

SEQ ID NO: 2267187 - DNA, 18 bp, Homo sapiens
tgtaaatcccattattca

SEQ ID NO: 2267188 - DNA, 19 bp, Homo sapiens
tgtacaaagtattaagcat

SEQ ID NO: 2267189 - DNA, 15 bp, Homo sapiens
tgtatagattagaat

SEQ ID NO: 2267190 - DNA, 23 bp, Homo sapiens
tgtatagattagagagtgttgaa

SEQ ID NO: 2267191 - DNA, 17 bp, Homo sapiens
tgtctacaccattatgt

SEQ ID NO: 2267192 - DNA, 18 bp, Homo sapiens
tgtctacaccattatgtg

SEQ ID NO: 2267193 - DNA, 17 bp, Homo sapiens
tgtcttgcctttttcat

SEQ ID NO: 2267194 - DNA, 12 bp, Homo sapiens
tgtgaacttgaa

SEQ ID NO: 2267195 - DNA, 14 bp, Homo sapiens
tgtgaacttgaaat

SEQ ID NO: 2267196 - DNA, 15 bp, Homo sapiens
tgtgaacttgaaatt

SEQ ID NO: 2267197 - DNA, 16 bp, Homo sapiens
tgtgaacttgaaattt

SEQ ID NO: 2267198 - DNA, 16 bp, Homo sapiens
tgtgttagagattttt

SEQ ID NO: 2267199 - DNA, 16 bp, Homo sapiens
tgttaaaccatgggat

SEQ ID NO: 2267200 - DNA, 21 bp, Homo sapiens
tgttaaaccatgggataaatg

SEQ ID NO: 2267201 - DNA, 22 bp, Homo sapiens
tgttgaaacggatgatttctat

SEQ ID NO: 2267202 - DNA, 14 bp, Homo sapiens
tgttgtttgtttag

SEQ ID NO: 2267203 - DNA, 19 bp, Homo sapiens
tgtttggaccaaaaaccag

SEQ ID NO: 2267204 - DNA, 22 bp, Homo sapiens
ttaaaccatgggataaatgcca

SEQ ID NO: 2267205 - DNA, 23 bp, Homo sapiens
ttaaaccatgggataaatgccat

SEQ ID NO: 2267206 - DNA, 20 bp, Homo sapiens
ttaaagccatgtttattaca

SEQ ID NO: 2267207 - DNA, 16 bp, Homo sapiens
ttaaagttgaatttat

SEQ ID NO: 2267208 - DNA, 19 bp, Homo sapiens
ttaacatgttaaaccatgg

SEQ ID NO: 2267209 - DNA, 19 bp, Homo sapiens
ttaagcatatatttttata

SEQ ID NO: 2267210 - DNA, 14 bp, Homo sapiens
ttaatattaaagcc

SEQ ID NO: 2267211 - DNA, 16 bp, Homo sapiens
ttaatattaaagccat

SEQ ID NO: 2267212 - DNA, 21 bp, Homo sapiens
ttaatattaaagccatgttta

SEQ ID NO: 2267213 - DNA, 15 bp, Homo sapiens
ttaattttggaattt

SEQ ID NO: 2267214 - DNA, 13 bp, Homo sapiens
ttacagtataatt

SEQ ID NO: 2267215 - DNA, 20 bp, Homo sapiens
ttacagtataattaacatgt

SEQ ID NO: 2267216 - DNA, 14 bp, Homo sapiens
ttagaattctgtat

SEQ ID NO: 2267217 - DNA, 17 bp, Homo sapiens
ttagaattctgtataga

SEQ ID NO: 2267218 - DNA, 16 bp, Homo sapiens
ttatgaaacttgtgta

SEQ ID NO: 2267219 - DNA, 19 bp, Homo sapiens
ttatgaaacttgtgtaaat

SEQ ID NO: 2267220 - DNA, 18 bp, Homo sapiens
ttatgatccagcagatta

SEQ ID NO: 2267221 - DNA, 22 bp, Homo sapiens
ttatgatccagcagattattca

SEQ ID NO: 2267222 - DNA, 23 bp, Homo sapiens
ttatgatccagcagattattcac

SEQ ID NO: 2267223 - DNA, 11 bp, Homo sapiens
ttatgtaaatc

SEQ ID NO: 2267224 - DNA, 12 bp, Homo sapiens
ttatgtaaatcc

SEQ ID NO: 2267225 - DNA, 19 bp, Homo sapiens
ttatgtaaatcccattatt

SEQ ID NO: 2267226 - DNA, 16 bp, Homo sapiens
ttatgtgcgctgataa

SEQ ID NO: 2267227 - DNA, 20 bp, Homo sapiens
ttattatgaaacttgtgtaa

SEQ ID NO: 2267228 - DNA, 22 bp, Homo sapiens
ttattatgtaaatcccattatt

SEQ ID NO: 2267229 - DNA, 15 bp, Homo sapiens
ttattcaaagttgcc

SEQ ID NO: 2267230 - DNA, 14 bp, Homo sapiens
ttattttattatga

SEQ ID NO: 2267231 - DNA, 15 bp, Homo sapiens
ttattttattatgaa

SEQ ID NO: 2267232 - DNA, 16 bp, Homo sapiens
ttattttattatgaaa

SEQ ID NO: 2267233 - DNA, 16 bp, Homo sapiens
ttcaaagttgcctaaa

SEQ ID NO: 2267234 - DNA, 17 bp, Homo sapiens
ttcaaagttgcctaaat

SEQ ID NO: 2267235 - DNA, 21 bp, Homo sapiens
ttcactctccatttaataatt

SEQ ID NO: 2267236 - DNA, 19 bp, Homo sapiens
ttcatggaacgcgttgaaa

SEQ ID NO: 2267237 - DNA, 11 bp, Homo sapiens
ttctatatttt

SEQ ID NO: 2267238 - DNA, 14 bp, Homo sapiens
ttctatattttcat

SEQ ID NO: 2267239 - DNA, 16 bp, Homo sapiens
ttctatattttcattc

SEQ ID NO: 2267240 - DNA, 21 bp, Homo sapiens
ttctatattttcattctccta

SEQ ID NO: 2267241 - DNA, 16 bp, Homo sapiens
ttgaaacggatgattt

SEQ ID NO: 2267242 - DNA, 13 bp, Homo sapiens
ttgcctaaatcca

SEQ ID NO: 2267243 - DNA, 14 bp, Homo sapiens
ttgcctaaatccat

SEQ ID NO: 2267244 - DNA, 15 bp, Homo sapiens
ttgcctaaatccatt

SEQ ID NO: 2267245 - DNA, 17 bp, Homo sapiens
ttgcctttttcattatt

SEQ ID NO: 2267246 - DNA, 15 bp, Homo sapiens
ttggaaatctttaaa

SEQ ID NO: 2267247 - DNA, 19 bp, Homo sapiens
ttggcataacataaatctg

SEQ ID NO: 2267248 - DNA, 23 bp, Homo sapiens
ttggcataacataaatctgtgaa

SEQ ID NO: 2267249 - DNA, 19 bp, Homo sapiens
ttggcttttctgatccagt

SEQ ID NO: 2267250 - DNA, 13 bp, Homo sapiens
ttggggattctta

SEQ ID NO: 2267251 - DNA, 15 bp, Homo sapiens
ttgtaattatatctg

SEQ ID NO: 2267252 - DNA, 14 bp, Homo sapiens
ttgtactcaatttt

SEQ ID NO: 2267253 - DNA, 15 bp, Homo sapiens
ttgtactcaatttta

SEQ ID NO: 2267254 - DNA, 20 bp, Homo sapiens
ttgtctacaccattatgtgc

SEQ ID NO: 2267255 - DNA, 23 bp, Homo sapiens
ttgtgcgctaaacttttctgata

SEQ ID NO: 2267256 - DNA, 17 bp, Homo sapiens
ttgttagatctagttca

SEQ ID NO: 2267257 - DNA, 13 bp, Homo sapiens
ttgtttgtttagt

SEQ ID NO: 2267258 - DNA, 18 bp, Homo sapiens
tttaataattatatgcta

SEQ ID NO: 2267259 - DNA, 23 bp, Homo sapiens
tttagtcttgtctcagattttat

SEQ ID NO: 2267260 - DNA, 13 bp, Homo sapiens
tttatatttacta

SEQ ID NO: 2267261 - DNA, 17 bp, Homo sapiens
tttattatgtaaatccc

SEQ ID NO: 2267262 - DNA, 19 bp, Homo sapiens
tttcattattttattatga

SEQ ID NO: 2267263 - DNA, 13 bp, Homo sapiens
tttctatattttc

SEQ ID NO: 2267264 - DNA, 18 bp, Homo sapiens
tttctatattttcattct

SEQ ID NO: 2267265 - DNA, 14 bp, Homo sapiens
tttctctttcgtta

SEQ ID NO: 2267266 - DNA, 15 bp, Homo sapiens
tttggaaatctttaa

SEQ ID NO: 2267267 - DNA, 22 bp, Homo sapiens
tttggaattttcctcctttctc

SEQ ID NO: 2267268 - DNA, 18 bp, Homo sapiens
tttggaccaaaaaccagt

SEQ ID NO: 2267269 - DNA, 13 bp, Homo sapiens
actggattgtact

SEQ ID NO: 2267270 - DNA, 15 bp, Homo sapiens
actgtggtgactttg

SEQ ID NO: 2267271 - DNA, 20 bp, Homo sapiens
acttgaaatttgaattttgt

SEQ ID NO: 2267272 - DNA, 13 bp, Homo sapiens
acttgtgtaaata

SEQ ID NO: 2267273 - DNA, 22 bp, Homo sapiens
acttgtgtaaatacaattttgt

SEQ ID NO: 2267274 - DNA, 23 bp, Homo sapiens
acttgtgtaaatacaattttgtt

SEQ ID NO: 2267275 - DNA, 17 bp, Homo sapiens
actttggataataagga

SEQ ID NO: 2267276 - DNA, 19 bp, Homo sapiens
actttggataataaggaaa

SEQ ID NO: 2267277 - DNA, 23 bp, Homo sapiens
agaatggtccgtgctaaggactt

SEQ ID NO: 2267278 - DNA, 12 bp, Homo sapiens
agactggtgact

SEQ ID NO: 2267279 - DNA, 13 bp, Homo sapiens
agactggtgactg

SEQ ID NO: 2267280 - DNA, 14 bp, Homo sapiens
agagtgttgaaacg

SEQ ID NO: 2267281 - DNA, 23 bp, Homo sapiens
agattagaattctgtatagatta

SEQ ID NO: 2267282 - DNA, 18 bp, Homo sapiens
agattttattatgtaaat

SEQ ID NO: 2267283 - DNA, 20 bp, Homo sapiens
agattttattatgtaaatcc

SEQ ID NO: 2267284 - DNA, 18 bp, Homo sapiens
agatttttttgttgtttg

SEQ ID NO: 2267285 - DNA, 15 bp, Homo sapiens
agcagattattcact

SEQ ID NO: 2267286 - DNA, 13 bp, Homo sapiens
agccatgtttatt

SEQ ID NO: 2267287 - DNA, 17 bp, Homo sapiens
agccatgtttattacag

SEQ ID NO: 2267288 - DNA, 18 bp, Homo sapiens
agcctgcacggtgaatgg

SEQ ID NO: 2267289 - DNA, 13 bp, Homo sapiens
agctagactggtg

SEQ ID NO: 2267290 - DNA, 14 bp, Homo sapiens
agctagactggtga

SEQ ID NO: 2267291 - DNA, 23 bp, Homo sapiens
aggaaaagtttaatattaaagcc

SEQ ID NO: 2267292 - DNA, 17 bp, Homo sapiens
aggaagcctgattaaag

SEQ ID NO: 2267293 - DNA, 18 bp, Homo sapiens
aggaagcctgattaaaga

SEQ ID NO: 2267294 - DNA, 16 bp, Homo sapiens
aggaattctgtataga

SEQ ID NO: 2267295 - DNA, 17 bp, Homo sapiens
aggaattctgtatagat

SEQ ID NO: 2267296 - DNA, 14 bp, Homo sapiens
aggacttctttaat

SEQ ID NO: 2267297 - DNA, 14 bp, Homo sapiens
agtataattaacat

SEQ ID NO: 2267298 - DNA, 15 bp, Homo sapiens
agtattgtacaaagt

SEQ ID NO: 2267299 - DNA, 23 bp, Homo sapiens
agtattgtacaaagtattaagca

SEQ ID NO: 2267300 - DNA, 17 bp, Homo sapiens
agtcagatctgcctaag

SEQ ID NO: 2267301 - DNA, 21 bp, Homo sapiens
agtcagatctgcctaaggact

SEQ ID NO: 2267302 - DNA, 22 bp, Homo sapiens
agtcagatctgcctaaggactt

SEQ ID NO: 2267303 - DNA, 23 bp, Homo sapiens
agtcagatctgcctaaggacttc

SEQ ID NO: 2267304 - DNA, 20 bp, Homo sapiens
agtcttgtctcagattttat

SEQ ID NO: 2267305 - DNA, 22 bp, Homo sapiens
agttcactctccatttaataat

SEQ ID NO: 2267306 - DNA, 13 bp, Homo sapiens
agttgaatttatt

SEQ ID NO: 2267307 - DNA, 19 bp, Homo sapiens
agttgaatttattggcttt

SEQ ID NO: 2267308 - DNA, 16 bp, Homo sapiens
agttgcctaaatccat

SEQ ID NO: 2267309 - DNA, 17 bp, Homo sapiens
agttgcctaaatccatt

SEQ ID NO: 2267310 - DNA, 15 bp, Homo sapiens
agtttaatattaaag

SEQ ID NO: 2267311 - DNA, 18 bp, Homo sapiens
agtttaatattaaagcca

SEQ ID NO: 2267312 - DNA, 20 bp, Homo sapiens
ataaatctgtgaacttgaaa

SEQ ID NO: 2267313 - DNA, 17 bp, Homo sapiens
ataaatgccatcaataa

SEQ ID NO: 2267314 - DNA, 19 bp, Homo sapiens
ataacataaatctgtgaac

SEQ ID NO: 2267315 - DNA, 16 bp, Homo sapiens
ataaggaaaagtttaa

SEQ ID NO: 2267316 - DNA, 15 bp, Homo sapiens
ataattaacatgtta

SEQ ID NO: 2267317 - DNA, 17 bp, Homo sapiens
ataattaacatgttaaa

SEQ ID NO: 2267318 - DNA, 21 bp, Homo sapiens
ataattatatgctatttctat

SEQ ID NO: 2267319 - DNA, 18 bp, Homo sapiens
atacaattttgtttctgt

SEQ ID NO: 2267320 - DNA, 16 bp, Homo sapiens
atagattagaattctg

SEQ ID NO: 2267321 - DNA, 22 bp, Homo sapiens
atagattagagagtgttgaaac

SEQ ID NO: 2267322 - DNA, 18 bp, Homo sapiens
atagctagactggtgact

SEQ ID NO: 2267323 - DNA, 18 bp, Homo sapiens
atatatttttatatttac

SEQ ID NO: 2267324 - DNA, 20 bp, Homo sapiens
atatatttttatatttacta

SEQ ID NO: 2267325 - DNA, 23 bp, Homo sapiens
atatctgaggaattctgtataga

SEQ ID NO: 2267326 - DNA, 15 bp, Homo sapiens
atatgctatttctat

SEQ ID NO: 2267327 - DNA, 16 bp, Homo sapiens
atatgctatttctata

SEQ ID NO: 2267328 - DNA, 19 bp, Homo sapiens
atatgctatttctatattt

SEQ ID NO: 2267329 - DNA, 14 bp, Homo sapiens
atattaaagccatg

SEQ ID NO: 2267330 - DNA, 15 bp, Homo sapiens
atattaaagccatgt

SEQ ID NO: 2267331 - DNA, 18 bp, Homo sapiens
atatttactaaaatggac

SEQ ID NO: 2267332 - DNA, 12 bp, Homo sapiens
atattttatgat

SEQ ID NO: 2267333 - DNA, 17 bp, Homo sapiens
atcaataaaaaattatg

SEQ ID NO: 2267334 - DNA, 18 bp, Homo sapiens
atcaataaaaaattatga

SEQ ID NO: 2267335 - DNA, 21 bp, Homo sapiens
atcacctgtcttgcctttttc

SEQ ID NO: 2267336 - DNA, 20 bp, Homo sapiens
atccatttggaaatctttaa

SEQ ID NO: 2267337 - DNA, 16 bp, Homo sapiens
atctgaagtcagatct

SEQ ID NO: 2267338 - DNA, 17 bp, Homo sapiens
atctgaagtcagatctg

SEQ ID NO: 2267339 - DNA, 21 bp, Homo sapiens
atctgaggaattctgtataga

SEQ ID NO: 2267340 - DNA, 11 bp, Homo sapiens
atctgcctaag

SEQ ID NO: 2267341 - DNA, 18 bp, Homo sapiens
atctgcctaaggacttct

SEQ ID NO: 2267342 - DNA, 20 bp, Homo sapiens
atctgcctaaggacttcttt

SEQ ID NO: 2267343 - DNA, 19 bp, Homo sapiens
atgatccagcagattattc

SEQ ID NO: 2267344 - DNA, 12 bp, Homo sapiens
atgatttctatg

SEQ ID NO: 2267345 - DNA, 14 bp, Homo sapiens
atgccatcaataaa

SEQ ID NO: 2267346 - DNA, 17 bp, Homo sapiens
atggaacgcgttgaaat

SEQ ID NO: 2267347 - DNA, 23 bp, Homo sapiens
atggaacgcgttgaaattgtaat

SEQ ID NO: 2267348 - DNA, 16 bp, Homo sapiens
atggctttgtatagaa

SEQ ID NO: 2267349 - DNA, 20 bp, Homo sapiens
atgtaaatcccattattcaa

SEQ ID NO: 2267350 - DNA, 22 bp, Homo sapiens
atgtaaatcccattattcaaag

SEQ ID NO: 2267351 - DNA, 23 bp, Homo sapiens
atgtaaatcccattattcaaagt

SEQ ID NO: 2267352 - DNA, 13 bp, Homo sapiens
atgtgtgaagtga

SEQ ID NO: 2267353 - DNA, 21 bp, Homo sapiens
attaaagccatgtttattaca

SEQ ID NO: 2267354 - DNA, 13 bp, Homo sapiens
attaacatgttaa

SEQ ID NO: 2267355 - DNA, 15 bp, Homo sapiens
attaagcatatattt

SEQ ID NO: 2267356 - DNA, 21 bp, Homo sapiens
attaagcatatatttttatat

SEQ ID NO: 2267357 - DNA, 14 bp, Homo sapiens
attacagtataatt

SEQ ID NO: 2267358 - DNA, 12 bp, Homo sapiens
attagaattctg

SEQ ID NO: 2267359 - DNA, 14 bp, Homo sapiens
attagaattctgta

SEQ ID NO: 2267360 - DNA, 18 bp, Homo sapiens
attatatctgaggaattc

SEQ ID NO: 2267361 - DNA, 21 bp, Homo sapiens
attatatctgaggaattctgt

SEQ ID NO: 2267362 - DNA, 14 bp, Homo sapiens
attatgaaacttgt

SEQ ID NO: 2267363 - DNA, 22 bp, Homo sapiens
attatgtaaatcccattattca

SEQ ID NO: 2267364 - DNA, 13 bp, Homo sapiens
attattcaaagtt

SEQ ID NO: 2267365 - DNA, 22 bp, Homo sapiens
attattcaaagttgcctaaatc

SEQ ID NO: 2267366 - DNA, 15 bp, Homo sapiens
attattttattatga

SEQ ID NO: 2267367 - DNA, 21 bp, Homo sapiens
attattttattatgaaacttg

SEQ ID NO: 2267368 - DNA, 17 bp, Homo sapiens
attcaaagttgcctaaa

SEQ ID NO: 2267369 - DNA, 22 bp, Homo sapiens
attcaaagttgcctaaatccat

SEQ ID NO: 2267370 - DNA, 13 bp, Homo sapiens
attctgtatagat

SEQ ID NO: 2267371 - DNA, 15 bp, Homo sapiens
attcttaaagttgaa

SEQ ID NO: 2267372 - DNA, 16 bp, Homo sapiens
attcttaaagttgaat

SEQ ID NO: 2267373 - DNA, 15 bp, Homo sapiens
attcttcagcaaaaa

SEQ ID NO: 2267374 - DNA, 14 bp, Homo sapiens
attggggattctta

SEQ ID NO: 2267375 - DNA, 23 bp, Homo sapiens
attggtgttgtactcaattttaa

SEQ ID NO: 2267376 - DNA, 14 bp, Homo sapiens
attgtaattatatc

SEQ ID NO: 2267377 - DNA, 16 bp, Homo sapiens
attgtaattatatctg

SEQ ID NO: 2267378 - DNA, 21 bp, Homo sapiens
attgtaattatatctgaggaa

SEQ ID NO: 2267379 - DNA, 20 bp, Homo sapiens
attgtacaaagtattaagca

SEQ ID NO: 2267380 - DNA, 19 bp, Homo sapiens
atttactaaaatggactgt

SEQ ID NO: 2267381 - DNA, 20 bp, Homo sapiens
atttattggcttttctgatc

SEQ ID NO: 2267382 - DNA, 15 bp, Homo sapiens
atttctatattttca

SEQ ID NO: 2267383 - DNA, 18 bp, Homo sapiens
atttctatattttcattc

SEQ ID NO: 2267384 - DNA, 15 bp, Homo sapiens
atttgaattttgtgt

SEQ ID NO: 2267385 - DNA, 14 bp, Homo sapiens
attttattatgaaa

SEQ ID NO: 2267386 - DNA, 18 bp, Homo sapiens
attttattatgaaacttg

SEQ ID NO: 2267387 - DNA, 14 bp, Homo sapiens
attttattatgtaa

SEQ ID NO: 2267388 - DNA, 18 bp, Homo sapiens
attttattatgtaaatcc

SEQ ID NO: 2267389 - DNA, 20 bp, Homo sapiens
attttattatgtaaatccca

SEQ ID NO: 2267390 - DNA, 13 bp, Homo sapiens
attttcctccttt

SEQ ID NO: 2267391 - DNA, 12 bp, Homo sapiens
attttggaattt

SEQ ID NO: 2267392 - DNA, 20 bp, Homo sapiens
caaaaaccagtattgtacaa

SEQ ID NO: 2267393 - DNA, 17 bp, Homo sapiens
caaaaatattttatgat

SEQ ID NO: 2267394 - DNA, 21 bp, Homo sapiens
caaaaatattttatgatccag

SEQ ID NO: 2267395 - DNA, 14 bp, Homo sapiens
caaagtattaagca

SEQ ID NO: 2267396 - DNA, 16 bp, Homo sapiens
caataaaaaattatga

SEQ ID NO: 2267397 - DNA, 20 bp, Homo sapiens
cacattggtgttgtactcaa

SEQ ID NO: 2267398 - DNA, 15 bp, Homo sapiens
cacccaccctttttt

SEQ ID NO: 2267399 - DNA, 17 bp, Homo sapiens
cacctgtcttgcctttt

SEQ ID NO: 2267400 - DNA, 15 bp, Homo sapiens
cactctccatttaat

SEQ ID NO: 2267401 - DNA, 13 bp, Homo sapiens
cagatactggatt

SEQ ID NO: 2267402 - DNA, 21 bp, Homo sapiens
cagatctgcctaaggacttct

SEQ ID NO: 2267403 - DNA, 16 bp, Homo sapiens
cagattttattatgta

SEQ ID NO: 2267404 - DNA, 20 bp, Homo sapiens
cagattttattatgtaaatc

SEQ ID NO: 2267405 - DNA, 21 bp, Homo sapiens
cagattttattatgtaaatcc

SEQ ID NO: 2267406 - DNA, 19 bp, Homo sapiens
cagcagattattcactgat

SEQ ID NO: 2267407 - DNA, 18 bp, Homo sapiens
cagctggtgccctgcttt

SEQ ID NO: 2267408 - DNA, 17 bp, Homo sapiens
caggaatggagcctgca

SEQ ID NO: 2267409 - DNA, 23 bp, Homo sapiens
caggaatggagcctgcacggtga

SEQ ID NO: 2267410 - DNA, 12 bp, Homo sapiens
cagtattgtaca

SEQ ID NO: 2267411 - DNA, 23 bp, Homo sapiens
cataaatctgtgaacttgaaatt

SEQ ID NO: 2267412 - DNA, 12 bp, Homo sapiens
cataacataaat

SEQ ID NO: 2267413 - DNA, 21 bp, Homo sapiens
cataacataaatctgtgaact

SEQ ID NO: 2267414 - DNA, 21 bp, Homo sapiens
catatatttttatatttacta

SEQ ID NO: 2267415 - DNA, 22 bp, Homo sapiens
catatatttttatatttactaa

SEQ ID NO: 2267416 - DNA, 18 bp, Homo sapiens
catggaacgcgttgaaat

SEQ ID NO: 2267417 - DNA, 20 bp, Homo sapiens
catggaacgcgttgaaattg

SEQ ID NO: 2267418 - DNA, 16 bp, Homo sapiens
catgggataaatgcca

SEQ ID NO: 2267419 - DNA, 17 bp, Homo sapiens
catgggataaatgccat

SEQ ID NO: 2267420 - DNA, 23 bp, Homo sapiens
catgggataaatgccatcaataa

SEQ ID NO: 2267421 - DNA, 22 bp, Homo sapiens
catgtttattacagtataatta

SEQ ID NO: 2267422 - DNA, 17 bp, Homo sapiens
cattggtgttgtactca

SEQ ID NO: 2267423 - DNA, 12 bp, Homo sapiens
catttaataatt

SEQ ID NO: 2267424 - DNA, 16 bp, Homo sapiens
catttaataattatat

SEQ ID NO: 2267425 - DNA, 11 bp, Homo sapiens
catttggaaat

SEQ ID NO: 2267426 - DNA, 17 bp, Homo sapiens
catttggaaatctttaa

SEQ ID NO: 2267427 - DNA, 18 bp, Homo sapiens
catttggaaatctttaaa

SEQ ID NO: 2267428 - DNA, 20 bp, Homo sapiens
ccaggaatggagcctgcacg

SEQ ID NO: 2267429 - DNA, 13 bp, Homo sapiens
ccatgggataaat

SEQ ID NO: 2267430 - DNA, 22 bp, Homo sapiens
cccaggaatggagcctgcacgg

SEQ ID NO: 2267431 - DNA, 13 bp, Homo sapiens
ccgtgctaaggac

SEQ ID NO: 2267432 - DNA, 14 bp, Homo sapiens
ccgtgctaaggact

SEQ ID NO: 2267433 - DNA, 19 bp, Homo sapiens
cctaaatccatttggaaat

SEQ ID NO: 2267434 - DNA, 12 bp, Homo sapiens
cctaaggacttc

SEQ ID NO: 2267435 - DNA, 23 bp, Homo sapiens
cctaaggacttctttaattttgg

SEQ ID NO: 2267436 - DNA, 12 bp, Homo sapiens
cctgattaaaga

SEQ ID NO: 2267437 - DNA, 15 bp, Homo sapiens
cctttttcattattt

SEQ ID NO: 2267438 - DNA, 17 bp, Homo sapiens
cgcgttgaaattgtaat

SEQ ID NO: 2267439 - DNA, 17 bp, Homo sapiens
cgctaaacttttctgat

SEQ ID NO: 2267440 - DNA, 18 bp, Homo sapiens
cggtgaatggctttgtat

SEQ ID NO: 2267441 - DNA, 16 bp, Homo sapiens
cgtgctaaggacttgt

SEQ ID NO: 2267442 - DNA, 23 bp, Homo sapiens
cgttgaaattgtaattatatctg

SEQ ID NO: 2267443 - DNA, 21 bp, Homo sapiens
ctaaaatggactgtggtgact

SEQ ID NO: 2267444 - DNA, 22 bp, Homo sapiens
ctaaaatggactgtggtgactt

SEQ ID NO: 2267445 - DNA, 13 bp, Homo sapiens
ctaaacttttctg

SEQ ID NO: 2267446 - DNA, 15 bp, Homo sapiens
ctaaacttttctgat

SEQ ID NO: 2267447 - DNA, 19 bp, Homo sapiens
ctaaatccatttggaaatc

SEQ ID NO: 2267448 - DNA, 11 bp, Homo sapiens
ctaaggacttg

SEQ ID NO: 2267449 - DNA, 17 bp, Homo sapiens
ctaaggacttgttagat

SEQ ID NO: 2267450 - DNA, 14 bp, Homo sapiens
ctagactggtgact

SEQ ID NO: 2267451 - DNA, 14 bp, Homo sapiens
ctatgctgagtttg

SEQ ID NO: 2267452 - DNA, 14 bp, Homo sapiens
ctatttctatattt

SEQ ID NO: 2267453 - DNA, 20 bp, Homo sapiens
ctatttctatattttcattc

SEQ ID NO: 2267454 - DNA, 15 bp, Homo sapiens
ctcagattttattat

SEQ ID NO: 2267455 - DNA, 22 bp, Homo sapiens
ctcagattttattatgtaaatc

SEQ ID NO: 2267456 - DNA, 15 bp, Homo sapiens
ctgaagtcagatctg

SEQ ID NO: 2267457 - DNA, 15 bp, Homo sapiens
ctgaggaattctgta

SEQ ID NO: 2267458 - DNA, 19 bp, Homo sapiens
ctgaggaattctgtataga

SEQ ID NO: 2267459 - DNA, 21 bp, Homo sapiens
ctgatttgacatagtctggct

SEQ ID NO: 2267460 - DNA, 23 bp, Homo sapiens
ctgatttgacatagtctggctgt

SEQ ID NO: 2267461 - DNA, 15 bp, Homo sapiens
ctgcacggtgaatgg

SEQ ID NO: 2267462 - DNA, 20 bp, Homo sapiens
ctgcacggtgaatggctttg

SEQ ID NO: 2267463 - DNA, 12 bp, Homo sapiens
ctgcctaaggac

SEQ ID NO: 2267464 - DNA, 20 bp, Homo sapiens
ctgcctaaggacttctttaa

SEQ ID NO: 2267465 - DNA, 22 bp, Homo sapiens
ctgcctaaggacttctttaatt

SEQ ID NO: 2267466 - DNA, 16 bp, Homo sapiens
ctgctttcagatactg

SEQ ID NO: 2267467 - DNA, 18 bp, Homo sapiens
ctgctttcagatactgga

SEQ ID NO: 2267468 - DNA, 21 bp, Homo sapiens
ctgctttcagatactggattg

SEQ ID NO: 2267469 - DNA, 19 bp, Homo sapiens
ctggattgtactttgtgct

SEQ ID NO: 2267470 - DNA, 20 bp, Homo sapiens
ctggattgtactttgtgctg

SEQ ID NO: 2267471 - DNA, 14 bp, Homo sapiens
ctggggttatctga

SEQ ID NO: 2267472 - DNA, 14 bp, Homo sapiens
ctggtgactgattc

SEQ ID NO: 2267473 - DNA, 15 bp, Homo sapiens
ctggtgtatgtgtga

SEQ ID NO: 2267474 - DNA, 15 bp, Homo sapiens
ctgtatagattagag

SEQ ID NO: 2267475 - DNA, 23 bp, Homo sapiens
ctgtcttgcctttttcattattt

SEQ ID NO: 2267476 - DNA, 15 bp, Homo sapiens
ctgtgaacttgaaat

SEQ ID NO: 2267477 - DNA, 17 bp, Homo sapiens
ctgtgaacttgaaattt

SEQ ID NO: 2267478 - DNA, 15 bp, Homo sapiens
ctgtggtgactttgg

SEQ ID NO: 2267479 - DNA, 18 bp, Homo sapiens
cttaaagttgaatttatt

SEQ ID NO: 2267480 - DNA, 22 bp, Homo sapiens
cttaaagttgaatttattggct

SEQ ID NO: 2267481 - DNA, 20 bp, Homo sapiens
cttcagcaaaaatattttat

SEQ ID NO: 2267482 - DNA, 17 bp, Homo sapiens
cttctttaattttggaa

SEQ ID NO: 2267483 - DNA, 14 bp, Homo sapiens
cttgcctttttcat

SEQ ID NO: 2267484 - DNA, 22 bp, Homo sapiens
cttgcctttttcattattttat

SEQ ID NO: 2267485 - DNA, 14 bp, Homo sapiens
cttgtctcagattt

SEQ ID NO: 2267486 - DNA, 17 bp, Homo sapiens
cttgtctcagattttat

SEQ ID NO: 2267487 - DNA, 18 bp, Homo sapiens
cttgtctcagattttatt

SEQ ID NO: 2267488 - DNA, 14 bp, Homo sapiens
cttgtgtaaataca

SEQ ID NO: 2267489 - DNA, 14 bp, Homo sapiens
ctttcagatactgg

SEQ ID NO: 2267490 - DNA, 16 bp, Homo sapiens
ctttggataataagga

SEQ ID NO: 2267491 - DNA, 23 bp, Homo sapiens
ctttgtctacaccattatgtgcg

SEQ ID NO: 2267492 - DNA, 15 bp, Homo sapiens
ctttgtgctggggtt

SEQ ID NO: 2267493 - DNA, 16 bp, Homo sapiens
ctttttggcataacat

SEQ ID NO: 2267494 - DNA, 15 bp, Homo sapiens
gaaaagtttaatatt

SEQ ID NO: 2267495 - DNA, 19 bp, Homo sapiens
gaaaagtttaatattaaag

SEQ ID NO: 2267496 - DNA, 24 bp, Homo sapiens
gaaatttgaattttgtgttagaga

SEQ ID NO: 2267497 - DNA, 14 bp, Homo sapiens
gaatggctttgtat

SEQ ID NO: 2267498 - DNA, 20 bp, Homo sapiens
gaatggtccgtgctaaggac

SEQ ID NO: 2267499 - DNA, 22 bp, Homo sapiens
gaatggtccgtgctaaggactt

SEQ ID NO: 2267500 - DNA, 23 bp, Homo sapiens
gaatggtccgtgctaaggacttg

SEQ ID NO: 2267501 - DNA, 22 bp, Homo sapiens
gaattctgtatagattagaatt

SEQ ID NO: 2267502 - DNA, 14 bp, Homo sapiens
gaatttattggctt

SEQ ID NO: 2267503 - DNA, 21 bp, Homo sapiens
gaatttattggcttttctgat

SEQ ID NO: 2267504 - DNA, 22 bp, Homo sapiens
gaatttattggcttttctgatc

SEQ ID NO: 2267505 - DNA, 16 bp, Homo sapiens
gactgattcttcagca

SEQ ID NO: 2267506 - DNA, 13 bp, Homo sapiens
gactgtggtgact

SEQ ID NO: 2267507 - DNA, 14 bp, Homo sapiens
gactgtggtgactt

SEQ ID NO: 2267508 - DNA, 19 bp, Homo sapiens
gacttctttaattttggaa

SEQ ID NO: 2267509 - DNA, 17 bp, Homo sapiens
gaggaattctgtataga

SEQ ID NO: 2267510 - DNA, 20 bp, Homo sapiens
gataataaggaaaagtttaa

SEQ ID NO: 2267511 - DNA, 22 bp, Homo sapiens
gatagaggaagcctgattaaag

SEQ ID NO: 2267512 - DNA, 18 bp, Homo sapiens
gatctgcctaaggacttc

SEQ ID NO: 2267513 - DNA, 23 bp, Homo sapiens
gattcttcagcaaaaatatttta

SEQ ID NO: 2267514 - DNA, 15 bp, Homo sapiens
gcatatatttttata

SEQ ID NO: 2267515 - DNA, 16 bp, Homo sapiens
gcatatatttttatat

SEQ ID NO: 2267516 - DNA, 11 bp, Homo sapiens
gccatgtttat

SEQ ID NO: 2267517 - DNA, 13 bp, Homo sapiens
gccatgtttatta

SEQ ID NO: 2267518 - DNA, 14 bp, Homo sapiens
gccatgtttattac

SEQ ID NO: 2267519 - DNA, 12 bp, Homo sapiens
gcctaaatccat

SEQ ID NO: 2267520 - DNA, 23 bp, Homo sapiens
gcctaaatccatttggaaatctt

SEQ ID NO: 2267521 - DNA, 20 bp, Homo sapiens
tattaaagccatgtttatta

SEQ ID NO: 2267522 - DNA, 16 bp, Homo sapiens
tattacagtataatta

SEQ ID NO: 2267523 - DNA, 18 bp, Homo sapiens
tattacagtataattaac

SEQ ID NO: 2267524 - DNA, 21 bp, Homo sapiens
tattacagtataattaacatg

SEQ ID NO: 2267525 - DNA, 12 bp, Homo sapiens
tattatgaaact

SEQ ID NO: 2267526 - DNA, 12 bp, Homo sapiens
tattcaaagttg

SEQ ID NO: 2267527 - DNA, 13 bp, Homo sapiens
tattcaaagttgc

SEQ ID NO: 2267528 - DNA, 16 bp, Homo sapiens
tattcaaagttgccta

SEQ ID NO: 2267529 - DNA, 21 bp, Homo sapiens
tattcaaagttgcctaaatcc

SEQ ID NO: 2267530 - DNA, 18 bp, Homo sapiens
tattggcttttctgatcc

SEQ ID NO: 2267531 - DNA, 22 bp, Homo sapiens
tattggcttttctgatccagtt

SEQ ID NO: 2267532 - DNA, 15 bp, Homo sapiens
tattgtacaaagtat

SEQ ID NO: 2267533 - DNA, 17 bp, Homo sapiens
tatttctatattttcat

SEQ ID NO: 2267534 - DNA, 12 bp, Homo sapiens
tattttatgatc

SEQ ID NO: 2267535 - DNA, 18 bp, Homo sapiens
tcaaagttgcctaaatcc

SEQ ID NO: 2267536 - DNA, 19 bp, Homo sapiens
tcaaagttgcctaaatcca

SEQ ID NO: 2267537 - DNA, 14 bp, Homo sapiens
tcaataaaaaatta

SEQ ID NO: 2267538 - DNA, 19 bp, Homo sapiens
tcaataaaaaattatgaca

SEQ ID NO: 2267539 - DNA, 20 bp, Homo sapiens
tcacctgtcttgcctttttc

SEQ ID NO: 2267540 - DNA, 16 bp, Homo sapiens
tcagatactggattgt

SEQ ID NO: 2267541 - DNA, 19 bp, Homo sapiens
tcagatactggattgtact

SEQ ID NO: 2267542 - DNA, 13 bp, Homo sapiens
tcagatctgccta

SEQ ID NO: 2267543 - DNA, 18 bp, Homo sapiens
tcagatctgcctaaggac

SEQ ID NO: 2267544 - DNA, 20 bp, Homo sapiens
tcagattttattatgtaaat

SEQ ID NO: 2267545 - DNA, 22 bp, Homo sapiens
tcagattttattatgtaaatcc

SEQ ID NO: 2267546 - DNA, 19 bp, Homo sapiens
tcagcaaaaatattttatg

SEQ ID NO: 2267547 - DNA, 16 bp, Homo sapiens
tcattattttattatg

SEQ ID NO: 2267548 - DNA, 23 bp, Homo sapiens
tcattattttattatgaaacttg

SEQ ID NO: 2267549 - DNA, 16 bp, Homo sapiens
tccagcagattattca

SEQ ID NO: 2267550 - DNA, 17 bp, Homo sapiens
tccagcagattattcac

SEQ ID NO: 2267551 - DNA, 22 bp, Homo sapiens
tccagcagattattcactgatt

SEQ ID NO: 2267552 - DNA, 12 bp, Homo sapiens
tccatttaataa

SEQ ID NO: 2267553 - DNA, 17 bp, Homo sapiens
tccatttaataattata

SEQ ID NO: 2267554 - DNA, 13 bp, Homo sapiens
tcccattattcaa

SEQ ID NO: 2267555 - DNA, 23 bp, Homo sapiens
tccgtgctaaggacttgttagat

SEQ ID NO: 2267556 - DNA, 16 bp, Homo sapiens
tctagttcactctcca

SEQ ID NO: 2267557 - DNA, 14 bp, Homo sapiens
tctatattttcatt

SEQ ID NO: 2267558 - DNA, 16 bp, Homo sapiens
tctatgctgagtttgt

SEQ ID NO: 2267559 - DNA, 14 bp, Homo sapiens
tctcagattttatt

SEQ ID NO: 2267560 - DNA, 17 bp, Homo sapiens
tctcagattttattatg

SEQ ID NO: 2267561 - DNA, 19 bp, Homo sapiens
tctcagattttattatgta

SEQ ID NO: 2267562 - DNA, 16 bp, Homo sapiens
tctccatttaataatt

SEQ ID NO: 2267563 - DNA, 15 bp, Homo sapiens
tctgaagtcagatct

SEQ ID NO: 2267564 - DNA, 19 bp, Homo sapiens
tctgaggaattctgtatag

SEQ ID NO: 2267565 - DNA, 20 bp, Homo sapiens
tctgaggaattctgtataga

SEQ ID NO: 2267566 - DNA, 20 bp, Homo sapiens
tctgcctaaggacttcttta

SEQ ID NO: 2267567 - DNA, 21 bp, Homo sapiens
tctgcctaaggacttctttaa

SEQ ID NO: 2267568 - DNA, 17 bp, Homo sapiens
tctgtatagattagaat

SEQ ID NO: 2267569 - DNA, 16 bp, Homo sapiens
tctgtatagattagag

SEQ ID NO: 2267570 - DNA, 18 bp, Homo sapiens
tctgtgaacttgaaattt

SEQ ID NO: 2267571 - DNA, 19 bp, Homo sapiens
tctgtgaacttgaaatttg

SEQ ID NO: 2267572 - DNA, 12 bp, Homo sapiens
tcttaaagttga

SEQ ID NO: 2267573 - DNA, 13 bp, Homo sapiens
tcttaaagttgaa

SEQ ID NO: 2267574 - DNA, 21 bp, Homo sapiens
tcttaaagttgaatttattgg

SEQ ID NO: 2267575 - DNA, 15 bp, Homo sapiens
tcttgcctttttcat

SEQ ID NO: 2267576 - DNA, 17 bp, Homo sapiens
tcttgcctttttcatta

SEQ ID NO: 2267577 - DNA, 14 bp, Homo sapiens
tctttaattttgga

SEQ ID NO: 2267578 - DNA, 15 bp, Homo sapiens
tgaaacggatgattt

SEQ ID NO: 2267579 - DNA, 17 bp, Homo sapiens
tgaaacggatgatttct

SEQ ID NO: 2267580 - DNA, 21 bp, Homo sapiens
tgaaattgtaattatatctga

SEQ ID NO: 2267581 - DNA, 16 bp, Homo sapiens
tgaaatttgaattttg

SEQ ID NO: 2267582 - DNA, 14 bp, Homo sapiens
tgaacttgaaattt

SEQ ID NO: 2267583 - DNA, 18 bp, Homo sapiens
tgaacttgaaatttgaat

SEQ ID NO: 2267584 - DNA, 20 bp, Homo sapiens
tgaagtcagatctgcctaag

SEQ ID NO: 2267585 - DNA, 11 bp, Homo sapiens
tgaatggcttt

SEQ ID NO: 2267586 - DNA, 22 bp, Homo sapiens
tgaatttattggcttttctgat

SEQ ID NO: 2267587 - DNA, 17 bp, Homo sapiens
tgaattttgtgttagag

SEQ ID NO: 2267588 - DNA, 16 bp, Homo sapiens
tgacatagtctggctg

SEQ ID NO: 2267589 - DNA, 14 bp, Homo sapiens
tgactgattcttca

SEQ ID NO: 2267590 - DNA, 15 bp, Homo sapiens
tgactgattcttcag

SEQ ID NO: 2267591 - DNA, 17 bp, Homo sapiens
tgactgattcttcagca

SEQ ID NO: 2267592 - DNA, 12 bp, Homo sapiens
tgactttggata

SEQ ID NO: 2267593 - DNA, 13 bp, Homo sapiens
tgactttggataa

SEQ ID NO: 2267594 - DNA, 15 bp, Homo sapiens
tgactttggataata

SEQ ID NO: 2267595 - DNA, 20 bp, Homo sapiens
tgactttggataataaggaa

SEQ ID NO: 2267596 - DNA, 18 bp, Homo sapiens
tgaggaattctgtataga

SEQ ID NO: 2267597 - DNA, 19 bp, Homo sapiens
tgatccagcagattattca

SEQ ID NO: 2267598 - DNA, 21 bp, Homo sapiens
tgatccagcagattattcact

SEQ ID NO: 2267599 - DNA, 14 bp, Homo sapiens
tgccatcaataaaa

SEQ ID NO: 2267600 - DNA, 16 bp, Homo sapiens
tgccctgctttcagat

SEQ ID NO: 2267601 - DNA, 19 bp, Homo sapiens
tgcctaaatccatttggaa

SEQ ID NO: 2267602 - DNA, 15 bp, Homo sapiens
tgcctaaggacttct

SEQ ID NO: 2267603 - DNA, 16 bp, Homo sapiens
tgcctaaggacttctt

SEQ ID NO: 2267604 - DNA, 23 bp, Homo sapiens
tgcctaaggacttctttaatttt

SEQ ID NO: 2267605 - DNA, 20 bp, Homo sapiens
tgcctcacccaccctttttt

SEQ ID NO: 2267606 - DNA, 19 bp, Homo sapiens
tgcgctaaacttttctgat

SEQ ID NO: 2267607 - DNA, 20 bp, Homo sapiens
tgcgctaaacttttctgata

SEQ ID NO: 2267608 - DNA, 22 bp, Homo sapiens
tgctaaggacttgttagatcta

SEQ ID NO: 2267609 - DNA, 13 bp, Homo sapiens
tgctatttctata

SEQ ID NO: 2267610 - DNA, 21 bp, Homo sapiens
tgctatttctatattttcatt

SEQ ID NO: 2267611 - DNA, 22 bp, Homo sapiens
tgctatttctatattttcattc

SEQ ID NO: 2267612 - DNA, 13 bp, Homo sapiens
tgctggtgtatgt

SEQ ID NO: 2267613 - DNA, 21 bp, Homo sapiens
tgctttcagatactggattgt

SEQ ID NO: 2267614 - DNA, 15 bp, Homo sapiens
tggaaatctttaaaa

SEQ ID NO: 2267615 - DNA, 19 bp, Homo sapiens
tggaacgcgttgaaattgt

SEQ ID NO: 2267616 - DNA, 17 bp, Homo sapiens
tggaattttcctccttt

SEQ ID NO: 2267617 - DNA, 21 bp, Homo sapiens
tggactgtggtgactttggat

SEQ ID NO: 2267618 - DNA, 15 bp, Homo sapiens
tggcataacataaat

SEQ ID NO: 2267619 - DNA, 17 bp, Homo sapiens
tggcataacataaatct

SEQ ID NO: 2267620 - DNA, 14 bp, Homo sapiens
tggctttgtataga

SEQ ID NO: 2267621 - DNA, 13 bp, Homo sapiens
tggcttttctgat

SEQ ID NO: 2267622 - DNA, 13 bp, Homo sapiens
tgggataaatgcc

SEQ ID NO: 2267623 - DNA, 14 bp, Homo sapiens
tgggataaatgcca

SEQ ID NO: 2267624 - DNA, 20 bp, Homo sapiens
tggggattcttaaagttgaa

SEQ ID NO: 2267625 - DNA, 23 bp, Homo sapiens
tggggttatctgaagtcagatct

SEQ ID NO: 2267626 - DNA, 16 bp, Homo sapiens
tggtgactgattcttc

SEQ ID NO: 2267627 - DNA, 19 bp, Homo sapiens
tgtaaatacaattttgttt

SEQ ID NO: 2267628 - DNA, 10 bp, Homo sapiens
tgtaaatccc

SEQ ID NO: 2267629 - DNA, 19 bp, Homo sapiens
tgtaaatcccattattcaa

SEQ ID NO: 2267630 - DNA, 20 bp, Homo sapiens
tgtaaatcccattattcaaa

SEQ ID NO: 2267631 - DNA, 14 bp, Homo sapiens
tgtaattatatctg

SEQ ID NO: 2267632 - DNA, 13 bp, Homo sapiens
tgtacaaagtatt

SEQ ID NO: 2267633 - DNA, 17 bp, Homo sapiens
tgtacaaagtattaagc

SEQ ID NO: 2267634 - DNA, 18 bp, Homo sapiens
tgtacaaagtattaagca

SEQ ID NO: 2267635 - DNA, 20 bp, Homo sapiens
tgtacaaagtattaagcata

SEQ ID NO: 2267636 - DNA, 21 bp, Homo sapiens
tgtacaaagtattaagcatat

SEQ ID NO: 2267637 - DNA, 13 bp, Homo sapiens
tgtactcaatttt

SEQ ID NO: 2267638 - DNA, 16 bp, Homo sapiens
tgtactttttggcata

SEQ ID NO: 2267639 - DNA, 16 bp, Homo sapiens
tgtatagaacctcttt

SEQ ID NO: 2267640 - DNA, 23 bp, Homo sapiens
tgtatagaacctctttgtctaca

SEQ ID NO: 2267641 - DNA, 21 bp, Homo sapiens
tgtatagattagaattctgta

SEQ ID NO: 2267642 - DNA, 12 bp, Homo sapiens
tgtatgtgtgaa

SEQ ID NO: 2267643 - DNA, 16 bp, Homo sapiens
tgtctcagattttatt

SEQ ID NO: 2267644 - DNA, 15 bp, Homo sapiens
tgtcttgcctttttc

SEQ ID NO: 2267645 - DNA, 16 bp, Homo sapiens
ccactgtgcaccaggc

SEQ ID NO: 2267646 - DNA, 21 bp, Homo sapiens
ccagaagaagggtggagtcag

SEQ ID NO: 2267647 - DNA, 14 bp, Homo sapiens
ccagacagaggcag

SEQ ID NO: 2267648 - DNA, 20 bp, Homo sapiens
ccagacagaggcagggcagc

SEQ ID NO: 2267649 - DNA, 21 bp, Homo sapiens
ccagagctgtcctcctggcac

SEQ ID NO: 2267650 - DNA, 21 bp, Homo sapiens
ccaggcactaagtctctagcc

SEQ ID NO: 2267651 - DNA, 14 bp, Homo sapiens
ccaggcagaggcag

SEQ ID NO: 2267652 - DNA, 14 bp, Homo sapiens
ccaggtactgagtg

SEQ ID NO: 2267653 - DNA, 18 bp, Homo sapiens
ccaggtactgagtgggga

SEQ ID NO: 2267654 - DNA, 11 bp, Homo sapiens
ccatcctggcc

SEQ ID NO: 2267655 - DNA, 13 bp, Homo sapiens
ccatgctctctgt

SEQ ID NO: 2267656 - DNA, 13 bp, Homo sapiens
cccccacctgcag

SEQ ID NO: 2267657 - DNA, 21 bp, Homo sapiens
cccctagacatggcctctgga

SEQ ID NO: 2267658 - DNA, 14 bp, Homo sapiens
cccctgcttctggc

SEQ ID NO: 2267659 - DNA, 17 bp, Homo sapiens
cccggtcagtcagagaa

SEQ ID NO: 2267660 - DNA, 22 bp, Homo sapiens
ccctagacatggcctctggaaa

SEQ ID NO: 2267661 - DNA, 16 bp, Homo sapiens
ccctctccagcctgct

SEQ ID NO: 2267662 - DNA, 16 bp, Homo sapiens
ccctgaggctgtgagc

SEQ ID NO: 2267663 - DNA, 17 bp, Homo sapiens
ccgcttctcctgcagtg

SEQ ID NO: 2267664 - DNA, 18 bp, Homo sapiens
ccggagggagccctgagc

SEQ ID NO: 2267665 - DNA, 11 bp, Homo sapiens
ccgtccctcct

SEQ ID NO: 2267666 - DNA, 23 bp, Homo sapiens
cctccagagctgtcctcctggca

SEQ ID NO: 2267667 - DNA, 15 bp, Homo sapiens
cctcctggcacctga

SEQ ID NO: 2267668 - DNA, 15 bp, Homo sapiens
cctctccagcctgct

SEQ ID NO: 2267669 - DNA, 12 bp, Homo sapiens
cctggcacctga

SEQ ID NO: 2267670 - DNA, 18 bp, Homo sapiens
cctggcacctgagtgtcc

SEQ ID NO: 2267671 - DNA, 12 bp, Homo sapiens
cctgggaggccc

SEQ ID NO: 2267672 - DNA, 21 bp, Homo sapiens
ccttgaacccccctccgcccc

SEQ ID NO: 2267673 - DNA, 18 bp, Homo sapiens
ccttgatttccagccgca

SEQ ID NO: 2267674 - DNA, 18 bp, Homo sapiens
cctttctgtggtgaggga

SEQ ID NO: 2267675 - DNA, 17 bp, Homo sapiens
cgcaatctggctcctcc

SEQ ID NO: 2267676 - DNA, 18 bp, Homo sapiens
cgcccaggccagtgctgt

SEQ ID NO: 2267677 - DNA, 18 bp, Homo sapiens
cgcccccatgctctctgt

SEQ ID NO: 2267678 - DNA, 20 bp, Homo sapiens
cggcctctacggccccgacg

SEQ ID NO: 2267679 - DNA, 15 bp, Homo sapiens
cgtgcgcgcccaggc

SEQ ID NO: 2267680 - DNA, 17 bp, Homo sapiens
cgtgcgcgcccaggcca

SEQ ID NO: 2267681 - DNA, 14 bp, Homo sapiens
cgtgtgtgtatgct

SEQ ID NO: 2267682 - DNA, 19 bp, Homo sapiens
ctaccagaagaagggtgga

SEQ ID NO: 2267683 - DNA, 15 bp, Homo sapiens
ctaggctcctgggag

SEQ ID NO: 2267684 - DNA, 16 bp, Homo sapiens
ctaggctcctgggagg

SEQ ID NO: 2267685 - DNA, 16 bp, Homo sapiens
ctatccattctctcct

SEQ ID NO: 2267686 - DNA, 21 bp, Homo sapiens
ctatccattctctccttccct

SEQ ID NO: 2267687 - DNA, 13 bp, Homo sapiens
ctatgagcccagc

SEQ ID NO: 2267688 - DNA, 20 bp, Homo sapiens
ctatggctggctgggcaagg

SEQ ID NO: 2267689 - DNA, 14 bp, Homo sapiens
ctcacactgcacca

SEQ ID NO: 2267690 - DNA, 12 bp, Homo sapiens
ctcatctatgct

SEQ ID NO: 2267691 - DNA, 23 bp, Homo sapiens
ctccagagctgtcctcctggcac

SEQ ID NO: 2267692 - DNA, 23 bp, Homo sapiens
ctccaggtccctaagctggggac

SEQ ID NO: 2267693 - DNA, 13 bp, Homo sapiens
ctcctcaggagaa

SEQ ID NO: 2267694 - DNA, 13 bp, Homo sapiens
ctcctcctggaaa

SEQ ID NO: 2267695 - DNA, 14 bp, Homo sapiens
ctcctggcacctga

SEQ ID NO: 2267696 - DNA, 16 bp, Homo sapiens
gccctgagcctggcag

SEQ ID NO: 2267697 - DNA, 18 bp, Homo sapiens
gccctgagcctggcaggt

SEQ ID NO: 2267698 - DNA, 22 bp, Homo sapiens
gccgcaatctggctcctcctgg

SEQ ID NO: 2267699 - DNA, 20 bp, Homo sapiens
gcctacgttggtgcaagtgt

SEQ ID NO: 2267700 - DNA, 12 bp, Homo sapiens
gcctcccagcta

SEQ ID NO: 2267701 - DNA, 14 bp, Homo sapiens
gcctctttctccct

SEQ ID NO: 2267702 - DNA, 14 bp, Homo sapiens
gcgagggcagcagg

SEQ ID NO: 2267703 - DNA, 23 bp, Homo sapiens
gcgcagagtagctgcttcctgga

SEQ ID NO: 2267704 - DNA, 18 bp, Homo sapiens
gcgcccaggccagtgctg

SEQ ID NO: 2267705 - DNA, 16 bp, Homo sapiens
gctagtgacagccact

SEQ ID NO: 2267706 - DNA, 19 bp, Homo sapiens
gctatggagaggactctcc

SEQ ID NO: 2267707 - DNA, 18 bp, Homo sapiens
gctcccctagacatggcc

SEQ ID NO: 2267708 - DNA, 24 bp, Homo sapiens
gctcccctagacatggcctctgga

SEQ ID NO: 2267709 - DNA, 18 bp, Homo sapiens
gctctttcctgtcttcct

SEQ ID NO: 2267710 - DNA, 19 bp, Homo sapiens
gctctttcctgtcttcctt

SEQ ID NO: 2267711 - DNA, 11 bp, Homo sapiens
gctgccctggg

SEQ ID NO: 2267712 - DNA, 15 bp, Homo sapiens
gctgccggagggagc

SEQ ID NO: 2267713 - DNA, 17 bp, Homo sapiens
gctgccggagggagccc

SEQ ID NO: 2267714 - DNA, 20 bp, Homo sapiens
gctgccggagggagccctga

SEQ ID NO: 2267715 - DNA, 17 bp, Homo sapiens
gctgctgtgctgggtgc

SEQ ID NO: 2267716 - DNA, 15 bp, Homo sapiens
gctggggagggaggc

SEQ ID NO: 2267717 - DNA, 18 bp, Homo sapiens
gctgtcctcctggcacct

SEQ ID NO: 2267718 - DNA, 15 bp, Homo sapiens
gctgtgagcagctag

SEQ ID NO: 2267719 - DNA, 21 bp, Homo sapiens
gctgtgagcaggcggggagga

SEQ ID NO: 2267720 - DNA, 22 bp, Homo sapiens
gcttcctggacgtgcgcgccca

SEQ ID NO: 2267721 - DNA, 12 bp, Homo sapiens
gcttctcctgca

SEQ ID NO: 2267722 - DNA, 18 bp, Homo sapiens
ggaaactctggagagcct

SEQ ID NO: 2267723 - DNA, 17 bp, Homo sapiens
ggacgcttgtgaggccc

SEQ ID NO: 2267724 - DNA, 13 bp, Homo sapiens
ggacggagagcct

SEQ ID NO: 2267725 - DNA, 16 bp, Homo sapiens
ggactgagctggggag

SEQ ID NO: 2267726 - DNA, 12 bp, Homo sapiens
ggagagcctgca

SEQ ID NO: 2267727 - DNA, 23 bp, Homo sapiens
ggagagccttggcgagggcagca

SEQ ID NO: 2267728 - DNA, 15 bp, Homo sapiens
ggagccctgagcctg

SEQ ID NO: 2267729 - DNA, 23 bp, Homo sapiens
ggaggaggctgccggagggagcc

SEQ ID NO: 2267730 - DNA, 12 bp, Homo sapiens
ggaggccctggc

SEQ ID NO: 2267731 - DNA, 14 bp, Homo sapiens
ggagggagccctga

SEQ ID NO: 2267732 - DNA, 20 bp, Homo sapiens
ggagggagccctgagcctgg

SEQ ID NO: 2267733 - DNA, 18 bp, Homo sapiens
ggatagagcagcctgctg

SEQ ID NO: 2267734 - DNA, 15 bp, Homo sapiens
ggcagaaggagatgg

SEQ ID NO: 2267735 - DNA, 20 bp, Homo sapiens
ggcagatctgagtctagaac

SEQ ID NO: 2267736 - DNA, 11 bp, Homo sapiens
ggcagggcagc

SEQ ID NO: 2267737 - DNA, 22 bp, Homo sapiens
ggcagtgagctatgagcccagc

SEQ ID NO: 2267738 - DNA, 12 bp, Homo sapiens
ggcagttcctgg

SEQ ID NO: 2267739 - DNA, 17 bp, Homo sapiens
ggccctggcagaagcca

SEQ ID NO: 2267740 - DNA, 19 bp, Homo sapiens
ggctcctaccactggacag

SEQ ID NO: 2267741 - DNA, 21 bp, Homo sapiens
ggctcctaccactggacagtc

SEQ ID NO: 2267742 - DNA, 12 bp, Homo sapiens
ggctcctgggag

SEQ ID NO: 2267743 - DNA, 12 bp, Homo sapiens
ggctgaagggag

SEQ ID NO: 2267744 - DNA, 15 bp, Homo sapiens
ggctgccctgggcca

SEQ ID NO: 2267745 - DNA, 22 bp, Homo sapiens
ggctgccggagggagccctgag

SEQ ID NO: 2267746 - DNA, 19 bp, Homo sapiens
ggctggccccatcctggcc

SEQ ID NO: 2267747 - DNA, 13 bp, Homo sapiens
ggctggctgggca

SEQ ID NO: 2267748 - DNA, 18 bp, Homo sapiens
gggacaagggctgcttcc

SEQ ID NO: 2267749 - DNA, 21 bp, Homo sapiens
gggctggccccatcctggccc

SEQ ID NO: 2267750 - DNA, 14 bp, Homo sapiens
ggggaagggaagga

SEQ ID NO: 2267751 - DNA, 14 bp, Homo sapiens
ggggactgagctgg

SEQ ID NO: 2267752 - DNA, 22 bp, Homo sapiens
ggggagtgtacagacccctgcc

SEQ ID NO: 2267753 - DNA, 12 bp, Homo sapiens
ggggctggcccc

SEQ ID NO: 2267754 - DNA, 16 bp, Homo sapiens
ggtactgagtggggag

SEQ ID NO: 2267755 - DNA, 20 bp, Homo sapiens
ggtccaaaaaaggctgccct

SEQ ID NO: 2267756 - DNA, 15 bp, Homo sapiens
ggtcccctgccctga

SEQ ID NO: 2267757 - DNA, 16 bp, Homo sapiens
ggtcccctgccctgag

SEQ ID NO: 2267758 - DNA, 16 bp, Homo sapiens
gtactgagtggggagt

SEQ ID NO: 2267759 - DNA, 22 bp, Homo sapiens
gtatctatctcacactgcacca

SEQ ID NO: 2267760 - DNA, 14 bp, Homo sapiens
gtcctcacatgcag

SEQ ID NO: 2267761 - DNA, 16 bp, Homo sapiens
gtctgaagttggcccc

SEQ ID NO: 2267762 - DNA, 20 bp, Homo sapiens
gtcttgcagtggacggagag

SEQ ID NO: 2267763 - DNA, 18 bp, Homo sapiens
gtgacagccacttggcct

SEQ ID NO: 2267764 - DNA, 22 bp, Homo sapiens
gtggatagagcagcctgctgct

SEQ ID NO: 2267765 - DNA, 19 bp, Homo sapiens
gtgggtgccagtcctcctc

SEQ ID NO: 2267766 - DNA, 22 bp, Homo sapiens
gtggtaagagggaaactctgga

SEQ ID NO: 2267767 - DNA, 17 bp, Homo sapiens
gtgtacagacccctgcc

SEQ ID NO: 2267768 - DNA, 14 bp, Homo sapiens
gtgtcaaccagaga

SEQ ID NO: 2267769 - DNA, 13 bp, Homo sapiens
gtgtgggtgccag

SEQ ID NO: 2267770 - DNA, 23 bp, Homo sapiens
gtgtgggtgccagtcctcctcag

SEQ ID NO: 2267771 - DNA, 11 bp, Homo sapiens
gttcctggcat

SEQ ID NO: 2267772 - DNA, 17 bp, Homo sapiens
gtttggggctggcccca

SEQ ID NO: 2267773 - DNA, 16 bp, Homo sapiens
taaatccgcttctcct

SEQ ID NO: 2267774 - DNA, 21 bp, Homo sapiens
taagagggaaactctggagag

SEQ ID NO: 2267775 - DNA, 18 bp, Homo sapiens
taccttccttcaactgct

SEQ ID NO: 2267776 - DNA, 16 bp, Homo sapiens
taccttgaacccccct

SEQ ID NO: 2267777 - DNA, 18 bp, Homo sapiens
taccttgaacccccctcc

SEQ ID NO: 2267778 - DNA, 15 bp, Homo sapiens
tatccattctctcct

SEQ ID NO: 2267779 - DNA, 13 bp, Homo sapiens
tatctaccttcct

SEQ ID NO: 2267780 - DNA, 21 bp, Homo sapiens
tcaaaagagattaactgggat

SEQ ID NO: 2267781 - DNA, 19 bp, Homo sapiens
tcacccatctcactctccc

SEQ ID NO: 2267782 - DNA, 22 bp, Homo sapiens
tcaccccaacaaactcctctag

SEQ ID NO: 2267783 - DNA, 14 bp, Homo sapiens
tcagggaactggga

SEQ ID NO: 2267784 - DNA, 13 bp, Homo sapiens
tcatccccacccc

SEQ ID NO: 2267785 - DNA, 18 bp, Homo sapiens
tccagagctgtcctcctg

SEQ ID NO: 2267786 - DNA, 24 bp, Homo sapiens
tccagagctgtcctcctggcacct

SEQ ID NO: 2267787 - DNA, 11 bp, Homo sapiens
tccagcctgct

SEQ ID NO: 2267788 - DNA, 22 bp, Homo sapiens
tcccagctagactgtaagccct

SEQ ID NO: 2267789 - DNA, 14 bp, Homo sapiens
tccccaacctgcaa

SEQ ID NO: 2267790 - DNA, 15 bp, Homo sapiens
tccccagtcctcagg

SEQ ID NO: 2267791 - DNA, 13 bp, Homo sapiens
tcccccacctgca

SEQ ID NO: 2267792 - DNA, 18 bp, Homo sapiens
tcccctgcttctggctcc

SEQ ID NO: 2267793 - DNA, 17 bp, Homo sapiens
tccctctccagcctgct

SEQ ID NO: 2267794 - DNA, 17 bp, Homo sapiens
tccgcttctcctgcagt

SEQ ID NO: 2267795 - DNA, 18 bp, Homo sapiens
tccgcttctcctgcagtg

SEQ ID NO: 2267796 - DNA, 19 bp, Homo sapiens
tccgcttctcctgcagtgg

SEQ ID NO: 2267797 - DNA, 16 bp, Homo sapiens
tcctaccactggacag

SEQ ID NO: 2267798 - DNA, 20 bp, Homo sapiens
tcctaccactggacagtcat

SEQ ID NO: 2267799 - DNA, 15 bp, Homo sapiens
tcctaggctcctggg

SEQ ID NO: 2267800 - DNA, 17 bp, Homo sapiens
tcctaggctcctgggag

SEQ ID NO: 2267801 - DNA, 15 bp, Homo sapiens
tcctcacatgcagag

SEQ ID NO: 2267802 - DNA, 14 bp, Homo sapiens
tcctcaggagaagg

SEQ ID NO: 2267803 - DNA, 18 bp, Homo sapiens
tcctcctggcacctgagt

SEQ ID NO: 2267804 - DNA, 17 bp, Homo sapiens
tcctttctgtggtgagg

SEQ ID NO: 2267805 - DNA, 13 bp, Homo sapiens
tctcacttcccct

SEQ ID NO: 2267806 - DNA, 16 bp, Homo sapiens
tctcacttccccttgc

SEQ ID NO: 2267807 - DNA, 14 bp, Homo sapiens
tctccttccctctc

SEQ ID NO: 2267808 - DNA, 15 bp, Homo sapiens
tctgaagttggcccc

SEQ ID NO: 2267809 - DNA, 19 bp, Homo sapiens
tctgcatataataagcact

SEQ ID NO: 2267810 - DNA, 12 bp, Homo sapiens
tctggagagcct

SEQ ID NO: 2267811 - DNA, 22 bp, Homo sapiens
tctggctcctaccactggacag

SEQ ID NO: 2267812 - DNA, 21 bp, Homo sapiens
tcttaccctgaatgtgtgccc

SEQ ID NO: 2267813 - DNA, 18 bp, Homo sapiens
tctttctcccttctgctc

SEQ ID NO: 2267814 - DNA, 13 bp, Homo sapiens
tgaacccccctcc

SEQ ID NO: 2267815 - DNA, 21 bp, Homo sapiens
tgacctccagagctgtcctcc

SEQ ID NO: 2267816 - DNA, 23 bp, Homo sapiens
tgacctccagagctgtcctcctg

SEQ ID NO: 2267817 - DNA, 17 bp, Homo sapiens
tgagcagctagtggtgg

SEQ ID NO: 2267818 - DNA, 18 bp, Homo sapiens
tgagcaggcggggaggag

SEQ ID NO: 2267819 - DNA, 23 bp, Homo sapiens
tgagcaggcggggaggaggctgc

SEQ ID NO: 2267820 - DNA, 12 bp, Homo sapiens
tgagctggggag

SEQ ID NO: 2267821 - DNA, 16 bp, Homo sapiens
tgagctggggagggag

SEQ ID NO: 2267822 - DNA, 21 bp, Homo sapiens
tgatcttcctcaaacttcaga

SEQ ID NO: 2267823 - DNA, 22 bp, Homo sapiens
tgcaaccatgggcaccaggcaa

SEQ ID NO: 2267824 - DNA, 15 bp, Homo sapiens
tgcaagtgtgcatgg

SEQ ID NO: 2267825 - DNA, 16 bp, Homo sapiens
tgcagagttgtgcatg

SEQ ID NO: 2267826 - DNA, 21 bp, Homo sapiens
tgcagcgctgggccccaaggc

SEQ ID NO: 2267827 - DNA, 17 bp, Homo sapiens
tgcatgcccctgagtgt

SEQ ID NO: 2267828 - DNA, 15 bp, Homo sapiens
tgcatggctggggac

SEQ ID NO: 2267829 - DNA, 21 bp, Homo sapiens
tgccaaatgactttgcacctg

SEQ ID NO: 2267830 - DNA, 13 bp, Homo sapiens
tgccagtcctcct

SEQ ID NO: 2267831 - DNA, 17 bp, Homo sapiens
tgccggagggagccctg

SEQ ID NO: 2267832 - DNA, 19 bp, Homo sapiens
tgcctcccagctagactgt

SEQ ID NO: 2267833 - DNA, 13 bp, Homo sapiens
tgctatggagagg

SEQ ID NO: 2267834 - DNA, 14 bp, Homo sapiens
tggacggagagcct

SEQ ID NO: 2267835 - DNA, 11 bp, Homo sapiens
tggagagcctg

SEQ ID NO: 2267836 - DNA, 12 bp, Homo sapiens
tggagagcctgc

SEQ ID NO: 2267837 - DNA, 18 bp, Homo sapiens
tggcaggtcccctgccct

SEQ ID NO: 2267838 - DNA, 16 bp, Homo sapiens
tggccccatcctggcc

SEQ ID NO: 2267839 - DNA, 12 bp, Homo sapiens
tggctcctcctg

SEQ ID NO: 2267840 - DNA, 15 bp, Homo sapiens
tgggaggccctggca

SEQ ID NO: 2267841 - DNA, 17 bp, Homo sapiens
tgggaggccctggcaga

SEQ ID NO: 2267842 - DNA, 13 bp, Homo sapiens
tgggtgaggggag

SEQ ID NO: 2267843 - DNA, 16 bp, Homo sapiens
tgggtggtaagaggga

SEQ ID NO: 2267844 - DNA, 21 bp, Homo sapiens
tggtgagggagaacctctcca

SEQ ID NO: 2267845 - DNA, 13 bp, Homo sapiens
tgtcttgcagtgg

SEQ ID NO: 2267846 - DNA, 21 bp, Homo sapiens
tgtgagcaggcggggaggagg

SEQ ID NO: 2267847 - DNA, 18 bp, Homo sapiens
tgtgtcccctctcatcta

SEQ ID NO: 2267848 - DNA, 15 bp, Homo sapiens
ttctcttttgtcctc

SEQ ID NO: 2267849 - DNA, 24 bp, Homo sapiens
ttctggctcctaccactggacagt

SEQ ID NO: 2267850 - DNA, 14 bp, Homo sapiens
ttggattgcatctc

SEQ ID NO: 2267851 - DNA, 21 bp, Homo sapiens
ttgtggatagagcagcctgct

SEQ ID NO: 2267852 - DNA, 14 bp, Homo sapiens
atttctgcttcctg

SEQ ID NO: 2267853 - DNA, 19 bp, Homo sapiens
caaatcctaggctcctggg

SEQ ID NO: 2267854 - DNA, 18 bp, Homo sapiens
caacccactgtcttgcag

SEQ ID NO: 2267855 - DNA, 18 bp, Homo sapiens
caagactcattgctggag

SEQ ID NO: 2267856 - DNA, 14 bp, Homo sapiens
caagatccaggcag

SEQ ID NO: 2267857 - DNA, 12 bp, Homo sapiens
caaggcagtgag

SEQ ID NO: 2267858 - DNA, 10 bp, Homo sapiens
caagtgagcc

SEQ ID NO: 2267859 - DNA, 22 bp, Homo sapiens
cacaagtgagccctcttgccca

SEQ ID NO: 2267860 - DNA, 19 bp, Homo sapiens
caccccaacaaactcctct

SEQ ID NO: 2267861 - DNA, 21 bp, Homo sapiens
cactcagtttcacaagtgagc

SEQ ID NO: 2267862 - DNA, 17 bp, Homo sapiens
cactgtcttgcagtgga

SEQ ID NO: 2267863 - DNA, 10 bp, Homo sapiens
cacttcccct

SEQ ID NO: 2267864 - DNA, 19 bp, Homo sapiens
cagaaggagtctgatgctc

SEQ ID NO: 2267865 - DNA, 18 bp, Homo sapiens
cagacagaggcagggcag

SEQ ID NO: 2267866 - DNA, 18 bp, Homo sapiens
cagagctgtcctcctggc

SEQ ID NO: 2267867 - DNA, 15 bp, Homo sapiens
cagaggcagggcagc

SEQ ID NO: 2267868 - DNA, 21 bp, Homo sapiens
cagcagcttttccaccccagg

SEQ ID NO: 2267869 - DNA, 15 bp, Homo sapiens
cagccacttggcctc

SEQ ID NO: 2267870 - DNA, 14 bp, Homo sapiens
cagccatgaagggt

SEQ ID NO: 2267871 - DNA, 16 bp, Homo sapiens
cagcccaacccactgt

SEQ ID NO: 2267872 - DNA, 19 bp, Homo sapiens
cagcccgtgatcccctgct

SEQ ID NO: 2267873 - DNA, 19 bp, Homo sapiens
cagccgcaatctggctcct

SEQ ID NO: 2267874 - DNA, 24 bp, Homo sapiens
cagccgcaatctggctcctcctgg

SEQ ID NO: 2267875 - DNA, 9 bp, Homo sapiens
cagcctgct

SEQ ID NO: 2267876 - DNA, 19 bp, Homo sapiens
cagcgctgggccccaaggc

SEQ ID NO: 2267877 - DNA, 21 bp, Homo sapiens
cagctagtggtggcttctcca

SEQ ID NO: 2267878 - DNA, 16 bp, Homo sapiens
cagggcagcatggaga

SEQ ID NO: 2267879 - DNA, 14 bp, Homo sapiens
cagggtagagagga

SEQ ID NO: 2267880 - DNA, 16 bp, Homo sapiens
cagtcctcctcaggag

SEQ ID NO: 2267881 - DNA, 16 bp, Homo sapiens
cagtgagctatgagcc

SEQ ID NO: 2267882 - DNA, 13 bp, Homo sapiens
cagtggacggaga

SEQ ID NO: 2267883 - DNA, 20 bp, Homo sapiens
catatgtgctatggagagga

SEQ ID NO: 2267884 - DNA, 11 bp, Homo sapiens
catcctggccc

SEQ ID NO: 2267885 - DNA, 12 bp, Homo sapiens
catcctggccca

SEQ ID NO: 2267886 - DNA, 15 bp, Homo sapiens
catggcctctggaaa

SEQ ID NO: 2267887 - DNA, 12 bp, Homo sapiens
catggctgggga

SEQ ID NO: 2267888 - DNA, 16 bp, Homo sapiens
catgtgggtcatacct

SEQ ID NO: 2267889 - DNA, 22 bp, Homo sapiens
cattatttctgcttcctggggg

SEQ ID NO: 2267890 - DNA, 18 bp, Homo sapiens
ccaaatgactttgcacct

SEQ ID NO: 2267891 - DNA, 21 bp, Homo sapiens
ccaccccgtccctcctctccc

SEQ ID NO: 2267892 - DNA, 11 bp, Homo sapiens
ccactggacag

SEQ ID NO: 2267893 - DNA, 15 bp, Homo sapiens
ccactgtcttgcagt

SEQ ID NO: 2267894 - DNA, 13 bp, Homo sapiens
ccagagattagcc

SEQ ID NO: 2267895 - DNA, 10 bp, Homo sapiens
ccagcctgct

SEQ ID NO: 2267896 - DNA, 15 bp, Homo sapiens
ccagtcctcctcagg

SEQ ID NO: 2267897 - DNA, 15 bp, Homo sapiens
cccacctccttcctc

SEQ ID NO: 2267898 - DNA, 12 bp, Homo sapiens
cccacctgcagc

SEQ ID NO: 2267899 - DNA, 16 bp, Homo sapiens
cccagtcctcaggcag

SEQ ID NO: 2267900 - DNA, 17 bp, Homo sapiens
cccagtcctcaggcagc

SEQ ID NO: 2267901 - DNA, 13 bp, Homo sapiens
ccccacctgcagc

SEQ ID NO: 2267902 - DNA, 22 bp, Homo sapiens
ccccacctgcagcgctgggccc

SEQ ID NO: 2267903 - DNA, 12 bp, Homo sapiens
cccccacctgca

SEQ ID NO: 2267904 - DNA, 20 bp, Homo sapiens
ccccttatcgtcccctgtga

SEQ ID NO: 2267905 - DNA, 21 bp, Homo sapiens
ccctaagctggggacagagaa

SEQ ID NO: 2267906 - DNA, 14 bp, Homo sapiens
ccctgagcctggca

SEQ ID NO: 2267907 - DNA, 22 bp, Homo sapiens
ccctgggccatatgtgctatgg

SEQ ID NO: 2267908 - DNA, 21 bp, Homo sapiens
cccttcctccccaacctgcaa

SEQ ID NO: 2267909 - DNA, 14 bp, Homo sapiens
ccgcttctcctgca

SEQ ID NO: 2267910 - DNA, 15 bp, Homo sapiens
cctaccacccagccc

SEQ ID NO: 2267911 - DNA, 17 bp, Homo sapiens
cctaggctcctgggagg

SEQ ID NO: 2267912 - DNA, 13 bp, Homo sapiens
cctcacatgcaga

SEQ ID NO: 2267913 - DNA, 16 bp, Homo sapiens
cctccccaacctgcaa

SEQ ID NO: 2267914 - DNA, 11 bp, Homo sapiens
cctcctggcac

SEQ ID NO: 2267915 - DNA, 13 bp, Homo sapiens
cctctacggcccc

SEQ ID NO: 2267916 - DNA, 16 bp, Homo sapiens
cctctttctcccttct

SEQ ID NO: 2267917 - DNA, 18 bp, Homo sapiens
cctgcagcgctgggcccc

SEQ ID NO: 2267918 - DNA, 15 bp, Homo sapiens
cctggcaggtcccct

SEQ ID NO: 2267919 - DNA, 13 bp, Homo sapiens
cctggcccagcct

SEQ ID NO: 2267920 - DNA, 13 bp, Homo sapiens
cctgggagcccac

SEQ ID NO: 2267921 - DNA, 17 bp, Homo sapiens
cctgggaggccctggca

SEQ ID NO: 2267922 - DNA, 19 bp, Homo sapiens
cctgggaggccctggcaga

SEQ ID NO: 2267923 - DNA, 20 bp, Homo sapiens
cctgggaggccctggcagaa

SEQ ID NO: 2267924 - DNA, 17 bp, Homo sapiens
cctgggggaaggatgca

SEQ ID NO: 2267925 - DNA, 21 bp, Homo sapiens
ccttggcgagggcagcagggt

SEQ ID NO: 2267926 - DNA, 22 bp, Homo sapiens
cgcaatctggctcctcctggaa

SEQ ID NO: 2267927 - DNA, 15 bp, Homo sapiens
cggagggagccctga

SEQ ID NO: 2267928 - DNA, 16 bp, Homo sapiens
cggggaggaggctgcc

SEQ ID NO: 2267929 - DNA, 16 bp, Homo sapiens
ctacgttggtgcaagt

SEQ ID NO: 2267930 - DNA, 13 bp, Homo sapiens
ctaggctcctggg

SEQ ID NO: 2267931 - DNA, 14 bp, Homo sapiens
ctatctcacactgc

SEQ ID NO: 2267932 - DNA, 16 bp, Homo sapiens
ctatctcacactgcac

SEQ ID NO: 2267933 - DNA, 13 bp, Homo sapiens
ctcactctcccca

SEQ ID NO: 2267934 - DNA, 17 bp, Homo sapiens
ctcacttccccttgcac

SEQ ID NO: 2267935 - DNA, 13 bp, Homo sapiens
ctccaggcagagg

SEQ ID NO: 2267936 - DNA, 16 bp, Homo sapiens
ctccaggcagaggcag

SEQ ID NO: 2267937 - DNA, 15 bp, Homo sapiens
ctccccaacctgcaa

SEQ ID NO: 2267938 - DNA, 19 bp, Homo sapiens
ctccccagtcctcaggcag

SEQ ID NO: 2267939 - DNA, 15 bp, Homo sapiens
ctcctctcccgcagg

SEQ ID NO: 2267940 - DNA, 12 bp, Homo sapiens
ctcctgggaggc

SEQ ID NO: 2267941 - DNA, 19 bp, Homo sapiens
ctcctgggaggccctggca

SEQ ID NO: 2267942 - DNA, 21 bp, Homo sapiens
ctccttccctctccagcctgc

SEQ ID NO: 2267943 - DNA, 21 bp, Homo sapiens
ctctagaggttcaaaggcagc

SEQ ID NO: 2267944 - DNA, 12 bp, Homo sapiens
ctctggagagcc

SEQ ID NO: 2267945 - DNA, 15 bp, Homo sapiens
ctctggagagcctgc

SEQ ID NO: 2267946 - DNA, 13 bp, Homo sapiens
ctctgtctgcctc

SEQ ID NO: 2267947 - DNA, 14 bp, Homo sapiens
ctgagctggggagg

SEQ ID NO: 2267948 - DNA, 23 bp, Homo sapiens
ctgcaataaatccgcttctcctg

SEQ ID NO: 2267949 - DNA, 17 bp, Homo sapiens
ctgccggagggagccct

SEQ ID NO: 2267950 - DNA, 14 bp, Homo sapiens
ctgctgctctcagg

SEQ ID NO: 2267951 - DNA, 17 bp, Homo sapiens
ctggccccatcctggcc

SEQ ID NO: 2267952 - DNA, 16 bp, Homo sapiens
ctggctcctcctggaa

SEQ ID NO: 2267953 - DNA, 17 bp, Homo sapiens
ctggctcctcctggaaa

SEQ ID NO: 2267954 - DNA, 17 bp, Homo sapiens
ctgggaggccctggcag

SEQ ID NO: 2267955 - DNA, 21 bp, Homo sapiens
ctgggccatatgtgctatgga

SEQ ID NO: 2267956 - DNA, 18 bp, Homo sapiens
ctgggtgccttgcatgca

SEQ ID NO: 2267957 - DNA, 22 bp, Homo sapiens
ctgtatctatctcacactgcac

SEQ ID NO: 2267958 - DNA, 23 bp, Homo sapiens
ctgtgctgggtgccttgcatgca

SEQ ID NO: 2267959 - DNA, 16 bp, Homo sapiens
ctgtggtgagggagaa

SEQ ID NO: 2267960 - DNA, 12 bp, Homo sapiens
ctgttccttctc

SEQ ID NO: 2267961 - DNA, 12 bp, Homo sapiens
cttccccttgca

SEQ ID NO: 2267962 - DNA, 20 bp, Homo sapiens
cttccttgaccaaagctctc

SEQ ID NO: 2267963 - DNA, 17 bp, Homo sapiens
cttgcaccccttcctcc

SEQ ID NO: 2267964 - DNA, 15 bp, Homo sapiens
cttgggtgaggggag

SEQ ID NO: 2267965 - DNA, 22 bp, Homo sapiens
cttgtgaggcccgaggcagaag

SEQ ID NO: 2267966 - DNA, 14 bp, Homo sapiens
ctttgcacctgcaa

SEQ ID NO: 2267967 - DNA, 21 bp, Homo sapiens
gaaattggcagttcctggcat

SEQ ID NO: 2267968 - DNA, 24 bp, Homo sapiens
gaacccccctccgcccccatgctc

SEQ ID NO: 2267969 - DNA, 16 bp, Homo sapiens
gaaggatgcagaagga

SEQ ID NO: 2267970 - DNA, 21 bp, Homo sapiens
gaagttggccccccagcgcag

SEQ ID NO: 2267971 - DNA, 23 bp, Homo sapiens
gacaaatcctaggctcctgggag

SEQ ID NO: 2267972 - DNA, 23 bp, Homo sapiens
gacagtcattgtggatagagcag

SEQ ID NO: 2267973 - DNA, 16 bp, Homo sapiens
gactcattgctggagg

SEQ ID NO: 2267974 - DNA, 18 bp, Homo sapiens
gactgagctggggaggga

SEQ ID NO: 2267975 - DNA, 19 bp, Homo sapiens
gacttatctgatcttcctc

SEQ ID NO: 2267976 - DNA, 14 bp, Homo sapiens
gacttctcacttcc

SEQ ID NO: 2267977 - DNA, 21 bp, Homo sapiens
gagagccttggcgagggcagc

SEQ ID NO: 2267978 - DNA, 16 bp, Homo sapiens
gagagtcctgggagcc

SEQ ID NO: 2267979 - DNA, 16 bp, Homo sapiens
gagccctcttgcccag

SEQ ID NO: 2267980 - DNA, 18 bp, Homo sapiens
gagccctgagcctggcag

SEQ ID NO: 2267981 - DNA, 21 bp, Homo sapiens
gagcctggcaggtcccctgcc

SEQ ID NO: 2267982 - DNA, 14 bp, Homo sapiens
gagctatgagccca

SEQ ID NO: 2267983 - DNA, 15 bp, Homo sapiens
gagctatgagcccag

SEQ ID NO: 2267984 - DNA, 17 bp, Homo sapiens
gagctatgagcccagca

SEQ ID NO: 2267985 - DNA, 12 bp, Homo sapiens
gagctggggagg

SEQ ID NO: 2267986 - DNA, 16 bp, Homo sapiens
gagctgtcctcctggc

SEQ ID NO: 2267987 - DNA, 20 bp, Homo sapiens
gagctgtcctcctggcacct

SEQ ID NO: 2267988 - DNA, 13 bp, Homo sapiens
gaggcagggcagc

SEQ ID NO: 2267989 - DNA, 23 bp, Homo sapiens
gaggctgccggagggagccctga

SEQ ID NO: 2267990 - DNA, 16 bp, Homo sapiens
gaggctgtgagcagct

SEQ ID NO: 2267991 - DNA, 18 bp, Homo sapiens
gagggaaactctggagag

SEQ ID NO: 2267992 - DNA, 19 bp, Homo sapiens
gagggaaactctggagagc

SEQ ID NO: 2267993 - DNA, 17 bp, Homo sapiens
gagggagccctgagcct

SEQ ID NO: 2267994 - DNA, 18 bp, Homo sapiens
gagggagccctgagcctg

SEQ ID NO: 2267995 - DNA, 21 bp, Homo sapiens
gaggtcaaaaaaggattccaa

SEQ ID NO: 2267996 - DNA, 15 bp, Homo sapiens
gagtcctgggagccc

SEQ ID NO: 2267997 - DNA, 20 bp, Homo sapiens
gagtgtacagacccctgcct

SEQ ID NO: 2267998 - DNA, 18 bp, Homo sapiens
gatggccaaagcaaagga

SEQ ID NO: 2267999 - DNA, 18 bp, Homo sapiens
gcaatctggctcctcctg

SEQ ID NO: 2268000 - DNA, 22 bp, Homo sapiens
gcacccactgtgcaccaggcac

SEQ ID NO: 2268001 - DNA, 21 bp, Homo sapiens
gcagagtagctgcttcctgga

SEQ ID NO: 2268002 - DNA, 20 bp, Homo sapiens
gcagtgagctatgagcccag

SEQ ID NO: 2268003 - DNA, 17 bp, Homo sapiens
gcagtggacggagagcc

SEQ ID NO: 2268004 - DNA, 18 bp, Homo sapiens
gcagtggacggagagcct

SEQ ID NO: 2268005 - DNA, 14 bp, Homo sapiens
gcatggctggggac

SEQ ID NO: 2268006 - DNA, 21 bp, Homo sapiens
gccaagactcattgctggagg

SEQ ID NO: 2268007 - DNA, 14 bp, Homo sapiens
gccacttggcctca

SEQ ID NO: 2268008 - DNA, 22 bp, Homo sapiens
gccagaacacatggctgggcct

SEQ ID NO: 2268009 - DNA, 15 bp, Homo sapiens
gccagtgctgtgagc

SEQ ID NO: 2268010 - DNA, 17 bp, Homo sapiens
gccccatcctggcccag

SEQ ID NO: 2268011 - DNA, 14 bp, Homo sapiens
gccccccagcgcag

SEQ ID NO: 2268012 - DNA, 12 bp, Homo sapiens
gccctggcagaa

SEQ ID NO: 2268013 - DNA, 16 bp, Homo sapiens
gccgcaatctggctcc

SEQ ID NO: 2268014 - DNA, 23 bp, Homo sapiens
gccgcaatctggctcctcctgga

SEQ ID NO: 2268015 - DNA, 17 bp, Homo sapiens
gcctacgttggtgcaag

SEQ ID NO: 2268016 - DNA, 15 bp, Homo sapiens
gcctcactaccagaa

SEQ ID NO: 2268017 - DNA, 22 bp, Homo sapiens
gcctgcacccaggtactgagtg

SEQ ID NO: 2268018 - DNA, 19 bp, Homo sapiens
gcctggcaggtcccctgcc

SEQ ID NO: 2268019 - DNA, 13 bp, Homo sapiens
gcgctcaggcatg

SEQ ID NO: 2268020 - DNA, 18 bp, Homo sapiens
gctagactgtaagccctt

SEQ ID NO: 2268021 - DNA, 19 bp, Homo sapiens
gctcctgggaggccctggc

SEQ ID NO: 2268022 - DNA, 22 bp, Homo sapiens
gctcctgggaggccctggcaga

SEQ ID NO: 2268023 - DNA, 17 bp, Homo sapiens
gctctcaggaccagaga

SEQ ID NO: 2268024 - DNA, 21 bp, Homo sapiens
gctgccggagggagccctgag

SEQ ID NO: 2268025 - DNA, 14 bp, Homo sapiens
gctgcttcctggac

SEQ ID NO: 2268026 - DNA, 21 bp, Homo sapiens
gctggccccatcctggcccag

SEQ ID NO: 2268027 - DNA, 16 bp, Homo sapiens
gctgggtgccttgcat

SEQ ID NO: 2268028 - DNA, 14 bp, Homo sapiens
gctgtcctcctggc

SEQ ID NO: 2268029 - DNA, 13 bp, Homo sapiens
gctgtgagcagct

SEQ ID NO: 2268030 - DNA, 17 bp, Homo sapiens
gctgtgtgtgcccggga

SEQ ID NO: 2268031 - DNA, 14 bp, Homo sapiens
gcttctggctccta

SEQ ID NO: 2268032 - DNA, 14 bp, Homo sapiens
ggaatctctgttcc

SEQ ID NO: 2268033 - DNA, 14 bp, Homo sapiens
ggacaagggctgct

SEQ ID NO: 2268034 - DNA, 12 bp, Homo sapiens
ggagagtcctgg

SEQ ID NO: 2268035 - DNA, 18 bp, Homo sapiens
ggagccctgagcctggca

SEQ ID NO: 2268036 - DNA, 19 bp, Homo sapiens
ggagccctgagcctggcag

SEQ ID NO: 2268037 - DNA, 18 bp, Homo sapiens
ggcagcaaggcagtgagc

SEQ ID NO: 2268038 - DNA, 15 bp, Homo sapiens
ggcagttcctggcat

SEQ ID NO: 2268039 - DNA, 18 bp, Homo sapiens
ggccccatcctggcccag

SEQ ID NO: 2268040 - DNA, 16 bp, Homo sapiens
ggctcctgggaggccc

SEQ ID NO: 2268041 - DNA, 24 bp, Homo sapiens
ggctcctgggaggccctggcagaa

SEQ ID NO: 2268042 - DNA, 12 bp, Homo sapiens
ggctgccctggg

SEQ ID NO: 2268043 - DNA, 14 bp, Homo sapiens
ggctgccggaggga

SEQ ID NO: 2268044 - DNA, 24 bp, Homo sapiens
ggctgccggagggagccctgagcc

SEQ ID NO: 2268045 - DNA, 20 bp, Homo sapiens
ggctggccccatcctggccc

SEQ ID NO: 2268046 - DNA, 18 bp, Homo sapiens
ggctggggacttctcact

SEQ ID NO: 2268047 - DNA, 17 bp, Homo sapiens
gggaatgatgcaactgg

SEQ ID NO: 2268048 - DNA, 17 bp, Homo sapiens
gggactgagctggggag

SEQ ID NO: 2268049 - DNA, 20 bp, Homo sapiens
gggagtgtacagacccctgc

SEQ ID NO: 2268050 - DNA, 22 bp, Homo sapiens
gggccatatgtgctatggagag

SEQ ID NO: 2268051 - DNA, 20 bp, Homo sapiens
gggcctttgtcttgggtgag

SEQ ID NO: 2268052 - DNA, 17 bp, Homo sapiens
gggctggtttctgccct

SEQ ID NO: 2268053 - DNA, 18 bp, Homo sapiens
ggggctggtttctgccct

SEQ ID NO: 2268054 - DNA, 20 bp, Homo sapiens
gggtgccttgcatgcacgga

SEQ ID NO: 2268055 - DNA, 20 bp, Homo sapiens
ggtaagagggaaactctgga

SEQ ID NO: 2268056 - DNA, 23 bp, Homo sapiens
ggtaagagggaaactctggagag

SEQ ID NO: 2268057 - DNA, 17 bp, Homo sapiens
ggtactgagtggggagt

SEQ ID NO: 2268058 - DNA, 17 bp, Homo sapiens
ggtttggggctggcccc

SEQ ID NO: 2268059 - DNA, 14 bp, Homo sapiens
gtacagacccctgc

SEQ ID NO: 2268060 - DNA, 16 bp, Homo sapiens
gtagctgcttcctgga

SEQ ID NO: 2268061 - DNA, 16 bp, Homo sapiens
gtcctcacatgcagag

SEQ ID NO: 2268062 - DNA, 15 bp, Homo sapiens
gtcctcctggcacct

SEQ ID NO: 2268063 - DNA, 21 bp, Homo sapiens
gtcctcctggcacctgagtgt

SEQ ID NO: 2268064 - DNA, 19 bp, Homo sapiens
gtgacctccagagctgtcc

SEQ ID NO: 2268065 - DNA, 15 bp, Homo sapiens
gtgagctatgagccc

SEQ ID NO: 2268066 - DNA, 13 bp, Homo sapiens
gtgctatggagag

SEQ ID NO: 2268067 - DNA, 16 bp, Homo sapiens
gtgctatggagaggac

SEQ ID NO: 2268068 - DNA, 14 bp, Homo sapiens
gtggatagagcagc

SEQ ID NO: 2268069 - DNA, 20 bp, Homo sapiens
tacagattcagaaaccaagg

SEQ ID NO: 2268070 - DNA, 18 bp, Homo sapiens
taccctgaatgtgtgccc

SEQ ID NO: 2268071 - DNA, 16 bp, Homo sapiens
tagacacttcttgaaa

SEQ ID NO: 2268072 - DNA, 14 bp, Homo sapiens
tagagcagcctgct

SEQ ID NO: 2268073 - DNA, 16 bp, Homo sapiens
tcactctccccagtcc

SEQ ID NO: 2268074 - DNA, 16 bp, Homo sapiens
tcattgctggaggtag

SEQ ID NO: 2268075 - DNA, 18 bp, Homo sapiens
tccaaaaaaggctgccct

SEQ ID NO: 2268076 - DNA, 13 bp, Homo sapiens
tccccaacctgca

SEQ ID NO: 2268077 - DNA, 21 bp, Homo sapiens
tcccctagacatggcctctgg

SEQ ID NO: 2268078 - DNA, 15 bp, Homo sapiens
tccccttatcgtccc

SEQ ID NO: 2268079 - DNA, 16 bp, Homo sapiens
tcccttacctcctttc

SEQ ID NO: 2268080 - DNA, 17 bp, Homo sapiens
tcctaccactggacagt

SEQ ID NO: 2268081 - DNA, 18 bp, Homo sapiens
tcctaggctcctgggagg

SEQ ID NO: 2268082 - DNA, 21 bp, Homo sapiens
tcctaggctcctgggaggccc

SEQ ID NO: 2268083 - DNA, 15 bp, Homo sapiens
tcctcaggagaaggg

SEQ ID NO: 2268084 - DNA, 19 bp, Homo sapiens
tcctgggaggccctggcag

SEQ ID NO: 2268085 - DNA, 15 bp, Homo sapiens
tcgttgatggccaaa

SEQ ID NO: 2268086 - DNA, 22 bp, Homo sapiens
tctccaaagaggaagcaggcat

SEQ ID NO: 2268087 - DNA, 12 bp, Homo sapiens
tctcccacctcc

SEQ ID NO: 2268088 - DNA, 19 bp, Homo sapiens
tctctgtggcctccatgcc

SEQ ID NO: 2268089 - DNA, 16 bp, Homo sapiens
tctgaagttggccccc

SEQ ID NO: 2268090 - DNA, 14 bp, Homo sapiens
tctgatcttcctca

SEQ ID NO: 2268091 - DNA, 22 bp, Homo sapiens
tctgccctttaagagcacccgg

SEQ ID NO: 2268092 - DNA, 21 bp, Homo sapiens
tcttgcagtggacggagagcc

SEQ ID NO: 2268093 - DNA, 20 bp, Homo sapiens
tgacctccagagctgtcctc

SEQ ID NO: 2268094 - DNA, 20 bp, Homo sapiens
tgacgcatgtaaagatgctg

SEQ ID NO: 2268095 - DNA, 20 bp, Homo sapiens
tgacttctccaggcagaggc

SEQ ID NO: 2268096 - DNA, 20 bp, Homo sapiens
tgagcctggcaggtcccctg

SEQ ID NO: 2268097 - DNA, 14 bp, Homo sapiens
tgagctatgagccc

SEQ ID NO: 2268098 - DNA, 17 bp, Homo sapiens
tgagtgtccttgctcta

SEQ ID NO: 2268099 - DNA, 12 bp, Homo sapiens
tgatcttcctca

SEQ ID NO: 2268100 - DNA, 14 bp, Homo sapiens
tgcaagtgtgcatg

SEQ ID NO: 2268101 - DNA, 14 bp, Homo sapiens
tgcaccccttcctc

SEQ ID NO: 2268102 - DNA, 15 bp, Homo sapiens
tgcaccccttcctcc

SEQ ID NO: 2268103 - DNA, 11 bp, Homo sapiens
tgcacctgcaa

SEQ ID NO: 2268104 - DNA, 17 bp, Homo sapiens
tgccagtcctcctcagg

SEQ ID NO: 2268105 - DNA, 21 bp, Homo sapiens
tgcccagcacacacctatggc

SEQ ID NO: 2268106 - DNA, 19 bp, Homo sapiens
tgcccgggacccccgtctc

SEQ ID NO: 2268107 - DNA, 14 bp, Homo sapiens
tgccctgaggctgt

SEQ ID NO: 2268108 - DNA, 19 bp, Homo sapiens
tgctggaggtagagaggtg

SEQ ID NO: 2268109 - DNA, 15 bp, Homo sapiens
tggacggagagcctt

SEQ ID NO: 2268110 - DNA, 13 bp, Homo sapiens
tggagagcctgca

SEQ ID NO: 2268111 - DNA, 18 bp, Homo sapiens
tggagccaacacttgaac

SEQ ID NO: 2268112 - DNA, 17 bp, Homo sapiens
tggcccagcctcttaac

SEQ ID NO: 2268113 - DNA, 13 bp, Homo sapiens
tggcctctggaaa

SEQ ID NO: 2268114 - DNA, 14 bp, Homo sapiens
tggctcctcctgga

SEQ ID NO: 2268115 - DNA, 14 bp, Homo sapiens
tgggacccgggcct

SEQ ID NO: 2268116 - DNA, 23 bp, Homo sapiens
tgggccatatgtgctatggagag

SEQ ID NO: 2268117 - DNA, 19 bp, Homo sapiens
tgggtttggggctggcccc

SEQ ID NO: 2268118 - DNA, 14 bp, Homo sapiens
tggtggcttctcca

SEQ ID NO: 2268119 - DNA, 18 bp, Homo sapiens
ctcctgggaggccctggc

SEQ ID NO: 2268120 - DNA, 22 bp, Homo sapiens
ctcctgggaggccctggcagaa

SEQ ID NO: 2268121 - DNA, 10 bp, Homo sapiens
ctctggagag

SEQ ID NO: 2268122 - DNA, 13 bp, Homo sapiens
ctcttgcccagca

SEQ ID NO: 2268123 - DNA, 16 bp, Homo sapiens
ctgaagttggcccccc

SEQ ID NO: 2268124 - DNA, 22 bp, Homo sapiens
ctgagcctggcaggtcccctgc

SEQ ID NO: 2268125 - DNA, 12 bp, Homo sapiens
ctgctgtgctgg

SEQ ID NO: 2268126 - DNA, 15 bp, Homo sapiens
ctgcttcctggggga

SEQ ID NO: 2268127 - DNA, 15 bp, Homo sapiens
ctgcttctggctcct

SEQ ID NO: 2268128 - DNA, 11 bp, Homo sapiens
ctggagagcct

SEQ ID NO: 2268129 - DNA, 16 bp, Homo sapiens
ctggaggtagagaggt

SEQ ID NO: 2268130 - DNA, 15 bp, Homo sapiens
ctggcacctgagtgt

SEQ ID NO: 2268131 - DNA, 23 bp, Homo sapiens
ctggcacctgagtgtccttgctc

SEQ ID NO: 2268132 - DNA, 13 bp, Homo sapiens
ctggctcctcctg

SEQ ID NO: 2268133 - DNA, 15 bp, Homo sapiens
ctggctcctcctgga

SEQ ID NO: 2268134 - DNA, 15 bp, Homo sapiens
ctgggaggccctggc

SEQ ID NO: 2268135 - DNA, 15 bp, Homo sapiens
ctggggacagagaag

SEQ ID NO: 2268136 - DNA, 16 bp, Homo sapiens
ctggggacttctcact

SEQ ID NO: 2268137 - DNA, 21 bp, Homo sapiens
ctgggggaaggatgcagaagg

SEQ ID NO: 2268138 - DNA, 14 bp, Homo sapiens
ctggtttctgccct

SEQ ID NO: 2268139 - DNA, 14 bp, Homo sapiens
ctgtcctcctggca

SEQ ID NO: 2268140 - DNA, 14 bp, Homo sapiens
ctgtcttgcagtgg

SEQ ID NO: 2268141 - DNA, 16 bp, Homo sapiens
ctgtcttgcagtggac

SEQ ID NO: 2268142 - DNA, 14 bp, Homo sapiens
ctgtggtgagggag

SEQ ID NO: 2268143 - DNA, 21 bp, Homo sapiens
ctgtggtgagggagaacctct

SEQ ID NO: 2268144 - DNA, 18 bp, Homo sapiens
cttatctgatcttcctca

SEQ ID NO: 2268145 - DNA, 18 bp, Homo sapiens
cttcctccccaacctgca

SEQ ID NO: 2268146 - DNA, 20 bp, Homo sapiens
cttcctcctaccacccagcc

SEQ ID NO: 2268147 - DNA, 20 bp, Homo sapiens
cttctcacttccccttgcac

SEQ ID NO: 2268148 - DNA, 22 bp, Homo sapiens
cttctccagcctttttcaggga

SEQ ID NO: 2268149 - DNA, 13 bp, Homo sapiens
cttctccaggcag

SEQ ID NO: 2268150 - DNA, 16 bp, Homo sapiens
cttctccaggcagagg

SEQ ID NO: 2268151 - DNA, 13 bp, Homo sapiens
cttctcctgcagt

SEQ ID NO: 2268152 - DNA, 22 bp, Homo sapiens
cttcttgaaaggagacactcag

SEQ ID NO: 2268153 - DNA, 16 bp, Homo sapiens
cttgcaccccttcctc

SEQ ID NO: 2268154 - DNA, 14 bp, Homo sapiens
cttgcatgcacgga

SEQ ID NO: 2268155 - DNA, 18 bp, Homo sapiens
cttggatggcgttctcct

SEQ ID NO: 2268156 - DNA, 18 bp, Homo sapiens
cttggcgagggcagcagg

SEQ ID NO: 2268157 - DNA, 15 bp, Homo sapiens
ctttcctgtcttcct

SEQ ID NO: 2268158 - DNA, 20 bp, Homo sapiens
ctttgagagggctgaaggga

SEQ ID NO: 2268159 - DNA, 12 bp, Homo sapiens
gaaactctggag

SEQ ID NO: 2268160 - DNA, 14 bp, Homo sapiens
gaaactctggagag

SEQ ID NO: 2268161 - DNA, 20 bp, Homo sapiens
gaaactctggagagcctgca

SEQ ID NO: 2268162 - DNA, 21 bp, Homo sapiens
gacaaatcctaggctcctggg

SEQ ID NO: 2268163 - DNA, 14 bp, Homo sapiens
gacccctgccttgg

SEQ ID NO: 2268164 - DNA, 19 bp, Homo sapiens
gacgcatgtaaagatgctg

SEQ ID NO: 2268165 - DNA, 16 bp, Homo sapiens
gactgagctggggagg

SEQ ID NO: 2268166 - DNA, 12 bp, Homo sapiens
gactgtaagccc

SEQ ID NO: 2268167 - DNA, 15 bp, Homo sapiens
gacttctccaggcag

SEQ ID NO: 2268168 - DNA, 18 bp, Homo sapiens
gacttctccaggcagagg

SEQ ID NO: 2268169 - DNA, 22 bp, Homo sapiens
gagacaaatcctaggctcctgg

SEQ ID NO: 2268170 - DNA, 13 bp, Homo sapiens
gagagtcctggga

SEQ ID NO: 2268171 - DNA, 17 bp, Homo sapiens
gagcaggcggggaggag

SEQ ID NO: 2268172 - DNA, 19 bp, Homo sapiens
gagccctcttgcccagcac

SEQ ID NO: 2268173 - DNA, 12 bp, Homo sapiens
gagcctgcaccc

SEQ ID NO: 2268174 - DNA, 18 bp, Homo sapiens
gagctgtcctcctggcac

SEQ ID NO: 2268175 - DNA, 12 bp, Homo sapiens
gaggctgtgagc

SEQ ID NO: 2268176 - DNA, 14 bp, Homo sapiens
gaggctgtgagcag

SEQ ID NO: 2268177 - DNA, 15 bp, Homo sapiens
gaggctgtgagcagc

SEQ ID NO: 2268178 - DNA, 20 bp, Homo sapiens
gagggaaactctggagagcc

SEQ ID NO: 2268179 - DNA, 21 bp, Homo sapiens
gagggagccctgagcctggca

SEQ ID NO: 2268180 - DNA, 22 bp, Homo sapiens
gaggtccaaaaaaggctgccct

SEQ ID NO: 2268181 - DNA, 12 bp, Homo sapiens
gagtcctgggag

SEQ ID NO: 2268182 - DNA, 13 bp, Homo sapiens
gagtcctgggagc

SEQ ID NO: 2268183 - DNA, 15 bp, Homo sapiens
gatagagcagcctgc

SEQ ID NO: 2268184 - DNA, 16 bp, Homo sapiens
gatcccctgcttctgg

SEQ ID NO: 2268185 - DNA, 20 bp, Homo sapiens
gatcccctgcttctggctcc

SEQ ID NO: 2268186 - DNA, 18 bp, Homo sapiens
gatctgagtctagaaccc

SEQ ID NO: 2268187 - DNA, 14 bp, Homo sapiens
gattccaagtgatg

SEQ ID NO: 2268188 - DNA, 12 bp, Homo sapiens
gattgcatctcc

SEQ ID NO: 2268189 - DNA, 15 bp, Homo sapiens
gcacccactgtgcac

SEQ ID NO: 2268190 - DNA, 17 bp, Homo sapiens
gcaccccttcctcccca

SEQ ID NO: 2268191 - DNA, 16 bp, Homo sapiens
gcacccggtcagtcag

SEQ ID NO: 2268192 - DNA, 19 bp, Homo sapiens
gcagaaaacaaaagccctt

SEQ ID NO: 2268193 - DNA, 14 bp, Homo sapiens
gcagttcctggcat

SEQ ID NO: 2268194 - DNA, 20 bp, Homo sapiens
gcatctcttgtgtaccagct

SEQ ID NO: 2268195 - DNA, 21 bp, Homo sapiens
gcatctcttgtgtaccagctg

SEQ ID NO: 2268196 - DNA, 19 bp, Homo sapiens
gcatgtaaagatgctgtgt

SEQ ID NO: 2268197 - DNA, 15 bp, Homo sapiens
gccagtcctcctcag

SEQ ID NO: 2268198 - DNA, 15 bp, Homo sapiens
gcccagattggagtc

SEQ ID NO: 2268199 - DNA, 16 bp, Homo sapiens
gcccaggccagtgctg

SEQ ID NO: 2268200 - DNA, 15 bp, Homo sapiens
gccctgagcctggca

SEQ ID NO: 2268201 - DNA, 17 bp, Homo sapiens
aaagtctcacaggtagt

SEQ ID NO: 2268202 - DNA, 20 bp, Homo sapiens
aaatgtgaaatccctaccat

SEQ ID NO: 2268203 - DNA, 22 bp, Homo sapiens
aagacagtgtataaggaacatc

SEQ ID NO: 2268204 - DNA, 15 bp, Homo sapiens
aagtgatggaactcc

SEQ ID NO: 2268205 - DNA, 22 bp, Homo sapiens
aagtgtgcatggctggggactt

SEQ ID NO: 2268206 - DNA, 15 bp, Homo sapiens
acaagatccaggcag

SEQ ID NO: 2268207 - DNA, 16 bp, Homo sapiens
acaagatccaggcaga

SEQ ID NO: 2268208 - DNA, 16 bp, Homo sapiens
acccactgtcttgcag

SEQ ID NO: 2268209 - DNA, 13 bp, Homo sapiens
acccactgtgcac

SEQ ID NO: 2268210 - DNA, 18 bp, Homo sapiens
accctgaatgtgtgccct

SEQ ID NO: 2268211 - DNA, 21 bp, Homo sapiens
acctcatccccaccccacctc

SEQ ID NO: 2268212 - DNA, 15 bp, Homo sapiens
acctccagagctgtc

SEQ ID NO: 2268213 - DNA, 14 bp, Homo sapiens
acggagagccttgg

SEQ ID NO: 2268214 - DNA, 17 bp, Homo sapiens
acgtgcgcgcccaggcc

SEQ ID NO: 2268215 - DNA, 15 bp, Homo sapiens
actaagtctctagcc

SEQ ID NO: 2268216 - DNA, 22 bp, Homo sapiens
actcagtttcacaagtgagccc

SEQ ID NO: 2268217 - DNA, 23 bp, Homo sapiens
actcagtttcacaagtgagccct

SEQ ID NO: 2268218 - DNA, 13 bp, Homo sapiens
actctccccagtc

SEQ ID NO: 2268219 - DNA, 11 bp, Homo sapiens
actctggagag

SEQ ID NO: 2268220 - DNA, 18 bp, Homo sapiens
actgggaacttaggggac

SEQ ID NO: 2268221 - DNA, 14 bp, Homo sapiens
acttccccttgcac

SEQ ID NO: 2268222 - DNA, 21 bp, Homo sapiens
acttccccttgcaccccttcc

SEQ ID NO: 2268223 - DNA, 15 bp, Homo sapiens
agaacacatggctgg

SEQ ID NO: 2268224 - DNA, 15 bp, Homo sapiens
agacatggcctctgg

SEQ ID NO: 2268225 - DNA, 18 bp, Homo sapiens
agactcattgctggaggt

SEQ ID NO: 2268226 - DNA, 19 bp, Homo sapiens
agagaaggttctgagctgt

SEQ ID NO: 2268227 - DNA, 17 bp, Homo sapiens
agagggaaactctggag

SEQ ID NO: 2268228 - DNA, 19 bp, Homo sapiens
agagggaaactctggagag

SEQ ID NO: 2268229 - DNA, 20 bp, Homo sapiens
agagggaaactctggagagc

SEQ ID NO: 2268230 - DNA, 13 bp, Homo sapiens
agagtcctgggag

SEQ ID NO: 2268231 - DNA, 14 bp, Homo sapiens
agattggagtcaga

SEQ ID NO: 2268232 - DNA, 21 bp, Homo sapiens
agcaaaggagagtcctgggag

SEQ ID NO: 2268233 - DNA, 16 bp, Homo sapiens
agcacccactgtgcac

SEQ ID NO: 2268234 - DNA, 19 bp, Homo sapiens
agcacccactgtgcaccag

SEQ ID NO: 2268235 - DNA, 19 bp, Homo sapiens
agcatggatgtgtctcagg

SEQ ID NO: 2268236 - DNA, 21 bp, Homo sapiens
agcccacaagatccaggcaga

SEQ ID NO: 2268237 - DNA, 18 bp, Homo sapiens
agcccgtgatcccctgct

SEQ ID NO: 2268238 - DNA, 18 bp, Homo sapiens
agccctgagcctggcagg

SEQ ID NO: 2268239 - DNA, 21 bp, Homo sapiens
agccgcaatctggctcctcct

SEQ ID NO: 2268240 - DNA, 24 bp, Homo sapiens
agcctcttaacctcttcttaccct

SEQ ID NO: 2268241 - DNA, 17 bp, Homo sapiens
agccttggcgagggcag

SEQ ID NO: 2268242 - DNA, 14 bp, Homo sapiens
agctagtgacagcc

SEQ ID NO: 2268243 - DNA, 22 bp, Homo sapiens
agctagtggtggcttctccagc

SEQ ID NO: 2268244 - DNA, 16 bp, Homo sapiens
agctatgagcccagca

SEQ ID NO: 2268245 - DNA, 22 bp, Homo sapiens
aggaatctctgttccttctctg

SEQ ID NO: 2268246 - DNA, 15 bp, Homo sapiens
aggagagtcctggga

SEQ ID NO: 2268247 - DNA, 14 bp, Homo sapiens
aggccctggcagaa

SEQ ID NO: 2268248 - DNA, 13 bp, Homo sapiens
aggctcctgggag

SEQ ID NO: 2268249 - DNA, 13 bp, Homo sapiens
aggctgccctggg

SEQ ID NO: 2268250 - DNA, 22 bp, Homo sapiens
aggctgccggagggagccctga

SEQ ID NO: 2268251 - DNA, 11 bp, Homo sapiens
aggctgtgagc

SEQ ID NO: 2268252 - DNA, 22 bp, Homo sapiens
agggaaactctggagagcctgc

SEQ ID NO: 2268253 - DNA, 12 bp, Homo sapiens
agggaactggga

SEQ ID NO: 2268254 - DNA, 16 bp, Homo sapiens
agggagccctgagcct

SEQ ID NO: 2268255 - DNA, 21 bp, Homo sapiens
agggagccctgagcctggcag

SEQ ID NO: 2268256 - DNA, 14 bp, Homo sapiens
agggcagcatggag

SEQ ID NO: 2268257 - DNA, 14 bp, Homo sapiens
aggtcccctgccct

SEQ ID NO: 2268258 - DNA, 18 bp, Homo sapiens
aggtcccctgccctgagg

SEQ ID NO: 2268259 - DNA, 21 bp, Homo sapiens
agtcattgtggatagagcagc

SEQ ID NO: 2268260 - DNA, 18 bp, Homo sapiens
agtgacctccagagctgt

SEQ ID NO: 2268261 - DNA, 17 bp, Homo sapiens
agtggacggagagcctt

SEQ ID NO: 2268262 - DNA, 19 bp, Homo sapiens
agtttcacaagtgagccct

SEQ ID NO: 2268263 - DNA, 16 bp, Homo sapiens
atacaatgcctcccag

SEQ ID NO: 2268264 - DNA, 21 bp, Homo sapiens
atagagcagcctgctgctctc

SEQ ID NO: 2268265 - DNA, 15 bp, Homo sapiens
atattgttcttccca

SEQ ID NO: 2268266 - DNA, 18 bp, Homo sapiens
atccaggcagaaggagat

SEQ ID NO: 2268267 - DNA, 13 bp, Homo sapiens
atccgcttctcct

SEQ ID NO: 2268268 - DNA, 17 bp, Homo sapiens
atccgcttctcctgcag

SEQ ID NO: 2268269 - DNA, 21 bp, Homo sapiens
atctctgtaattgtgtcccct

SEQ ID NO: 2268270 - DNA, 14 bp, Homo sapiens
atctggctcctcct

SEQ ID NO: 2268271 - DNA, 17 bp, Homo sapiens
attatttctgcttcctg

SEQ ID NO: 2268272 - DNA, 18 bp, Homo sapiens
attggcagttcctggcat

SEQ ID NO: 2268273 - DNA, 17 bp, Homo sapiens
atttcccccacctgcag

SEQ ID NO: 2268274 - DNA, 13 bp, Homo sapiens
caaagcttcccct

SEQ ID NO: 2268275 - DNA, 18 bp, Homo sapiens
caaatcctaggctcctgg

SEQ ID NO: 2268276 - DNA, 21 bp, Homo sapiens
caaatgactttgcacctgcaa

SEQ ID NO: 2268277 - DNA, 16 bp, Homo sapiens
caaccatgggcaccag

SEQ ID NO: 2268278 - DNA, 21 bp, Homo sapiens
caagatccaggcagaaggaga

SEQ ID NO: 2268279 - DNA, 13 bp, Homo sapiens
caagtgagccctc

SEQ ID NO: 2268280 - DNA, 21 bp, Homo sapiens
caatctggctcctcctggaaa

SEQ ID NO: 2268281 - DNA, 16 bp, Homo sapiens
cacaagatccaggcag

SEQ ID NO: 2268282 - DNA, 12 bp, Homo sapiens
cacaagtgagcc

SEQ ID NO: 2268283 - DNA, 21 bp, Homo sapiens
caccaaaccagacagaggcag

SEQ ID NO: 2268284 - DNA, 20 bp, Homo sapiens
cacccatctcactctcccca

SEQ ID NO: 2268285 - DNA, 13 bp, Homo sapiens
cacctccttcctc

SEQ ID NO: 2268286 - DNA, 14 bp, Homo sapiens
cactgtcttgcagt

SEQ ID NO: 2268287 - DNA, 16 bp, Homo sapiens
cactgtgcaccaggca

SEQ ID NO: 2268288 - DNA, 17 bp, Homo sapiens
cagagaacagctcccct

SEQ ID NO: 2268289 - DNA, 17 bp, Homo sapiens
cagagctgtcctcctgg

SEQ ID NO: 2268290 - DNA, 19 bp, Homo sapiens
cagagctgtcctcctggca

SEQ ID NO: 2268291 - DNA, 19 bp, Homo sapiens
cagccacttggcctcacta

SEQ ID NO: 2268292 - DNA, 15 bp, Homo sapiens
cagcccaacccactg

SEQ ID NO: 2268293 - DNA, 16 bp, Homo sapiens
cagcgctgggccccaa

SEQ ID NO: 2268294 - DNA, 14 bp, Homo sapiens
cagctcccctagac

SEQ ID NO: 2268295 - DNA, 17 bp, Homo sapiens
cagctgctgtgctgggt

SEQ ID NO: 2268296 - DNA, 17 bp, Homo sapiens
caggaccagagaaggga

SEQ ID NO: 2268297 - DNA, 16 bp, Homo sapiens
caggcatatgagtgcg

SEQ ID NO: 2268298 - DNA, 14 bp, Homo sapiens
caggtactgagtgg

SEQ ID NO: 2268299 - DNA, 21 bp, Homo sapiens
caggtagtatatggtggagcc

SEQ ID NO: 2268300 - DNA, 22 bp, Homo sapiens
caggtagtatatggtggagcca

SEQ ID NO: 2268301 - DNA, 18 bp, Homo sapiens
caggtcccctgccctgag

SEQ ID NO: 2268302 - DNA, 19 bp, Homo sapiens
caggtcccctgccctgagg

SEQ ID NO: 2268303 - DNA, 20 bp, Homo sapiens
caggtctgaagttggccccc

SEQ ID NO: 2268304 - DNA, 14 bp, Homo sapiens
cagtcctcaggcag

SEQ ID NO: 2268305 - DNA, 14 bp, Homo sapiens
cagtcctcctcagg

SEQ ID NO: 2268306 - DNA, 18 bp, Homo sapiens
cagtcctcctcaggagaa

SEQ ID NO: 2268307 - DNA, 17 bp, Homo sapiens
cagtggacggagagcct

SEQ ID NO: 2268308 - DNA, 19 bp, Homo sapiens
cagtttcacaagtgagccc

SEQ ID NO: 2268309 - DNA, 18 bp, Homo sapiens
catcctggcccagcctct

SEQ ID NO: 2268310 - DNA, 21 bp, Homo sapiens
catctatgctctttcctgtct

SEQ ID NO: 2268311 - DNA, 15 bp, Homo sapiens
catgcccctgagtgt

SEQ ID NO: 2268312 - DNA, 19 bp, Homo sapiens
catgctctctgtggcctcc

SEQ ID NO: 2268313 - DNA, 13 bp, Homo sapiens
catggcctctgga

SEQ ID NO: 2268314 - DNA, 14 bp, Homo sapiens
catggcctctggaa

SEQ ID NO: 2268315 - DNA, 16 bp, Homo sapiens
catgggcaccaggcaa

SEQ ID NO: 2268316 - DNA, 13 bp, Homo sapiens
cattatttctgct

SEQ ID NO: 2268317 - DNA, 11 bp, Homo sapiens
ccacctgcagc

SEQ ID NO: 2268318 - DNA, 14 bp, Homo sapiens
acgtgcgcgcccag

SEQ ID NO: 2268319 - DNA, 15 bp, Homo sapiens
actcattgctggagg

SEQ ID NO: 2268320 - DNA, 18 bp, Homo sapiens
actccaggggtggaggga

SEQ ID NO: 2268321 - DNA, 15 bp, Homo sapiens
actgagctggggagg

SEQ ID NO: 2268322 - DNA, 21 bp, Homo sapiens
agaaggttctgagctgtccca

SEQ ID NO: 2268323 - DNA, 17 bp, Homo sapiens
agactcattgctggagg

SEQ ID NO: 2268324 - DNA, 12 bp, Homo sapiens
agagcagcctgc

SEQ ID NO: 2268325 - DNA, 13 bp, Homo sapiens
agagcagcctgct

SEQ ID NO: 2268326 - DNA, 20 bp, Homo sapiens
agagccttggcgagggcagc

SEQ ID NO: 2268327 - DNA, 17 bp, Homo sapiens
agagctgtcctcctggc

SEQ ID NO: 2268328 - DNA, 16 bp, Homo sapiens
agagtcctgggagccc

SEQ ID NO: 2268329 - DNA, 16 bp, Homo sapiens
agattggagtcagagg

SEQ ID NO: 2268330 - DNA, 19 bp, Homo sapiens
agcacacacctatggctgg

SEQ ID NO: 2268331 - DNA, 17 bp, Homo sapiens
agcacccggtcagtcag

SEQ ID NO: 2268332 - DNA, 23 bp, Homo sapiens
agccaagaatttctctctatgtc

SEQ ID NO: 2268333 - DNA, 17 bp, Homo sapiens
agccctcttgcccagca

SEQ ID NO: 2268334 - DNA, 16 bp, Homo sapiens
agccctgagcctggca

SEQ ID NO: 2268335 - DNA, 19 bp, Homo sapiens
agcctggcaggtcccctgc

SEQ ID NO: 2268336 - DNA, 17 bp, Homo sapiens
agcgcagagtagctgct

SEQ ID NO: 2268337 - DNA, 15 bp, Homo sapiens
agctgcttcctggac

SEQ ID NO: 2268338 - DNA, 15 bp, Homo sapiens
agctgtcctcctggc

SEQ ID NO: 2268339 - DNA, 17 bp, Homo sapiens
agctgtcctcctggcac

SEQ ID NO: 2268340 - DNA, 21 bp, Homo sapiens
agcttccccttatcgtcccct

SEQ ID NO: 2268341 - DNA, 15 bp, Homo sapiens
aggaccagagaaggg

SEQ ID NO: 2268342 - DNA, 14 bp, Homo sapiens
aggagagtcctggg

SEQ ID NO: 2268343 - DNA, 18 bp, Homo sapiens
aggagagtcctgggagcc

SEQ ID NO: 2268344 - DNA, 22 bp, Homo sapiens
aggcactaagtctctagcctct

SEQ ID NO: 2268345 - DNA, 19 bp, Homo sapiens
aggcagcaaggcagtgagc

SEQ ID NO: 2268346 - DNA, 12 bp, Homo sapiens
aggcagggcagc

SEQ ID NO: 2268347 - DNA, 23 bp, Homo sapiens
aggcaggtgggtggtaagaggga

SEQ ID NO: 2268348 - DNA, 12 bp, Homo sapiens
aggccctggcag

SEQ ID NO: 2268349 - DNA, 14 bp, Homo sapiens
aggctcctgggagg

SEQ ID NO: 2268350 - DNA, 15 bp, Homo sapiens
aggctcctgggaggc

SEQ ID NO: 2268351 - DNA, 23 bp, Homo sapiens
aggctcctgggaggccctggcag

SEQ ID NO: 2268352 - DNA, 17 bp, Homo sapiens
aggctgccggagggagc

SEQ ID NO: 2268353 - DNA, 16 bp, Homo sapiens
agggaaactctggaga

SEQ ID NO: 2268354 - DNA, 20 bp, Homo sapiens
agggaaactctggagagcct

SEQ ID NO: 2268355 - DNA, 23 bp, Homo sapiens
agggaaactctggagagcctgca

SEQ ID NO: 2268356 - DNA, 18 bp, Homo sapiens
agggaaatgacttctcca

SEQ ID NO: 2268357 - DNA, 12 bp, Homo sapiens
agggagccctga

SEQ ID NO: 2268358 - DNA, 22 bp, Homo sapiens
agggagccctgagcctggcagg

SEQ ID NO: 2268359 - DNA, 14 bp, Homo sapiens
agggcagcagggta

SEQ ID NO: 2268360 - DNA, 14 bp, Homo sapiens
agggctgaagggag

SEQ ID NO: 2268361 - DNA, 19 bp, Homo sapiens
agggctgaagggagggcct

SEQ ID NO: 2268362 - DNA, 20 bp, Homo sapiens
aggggactgagctggggagg

SEQ ID NO: 2268363 - DNA, 12 bp, Homo sapiens
aggggtggaggg

SEQ ID NO: 2268364 - DNA, 16 bp, Homo sapiens
aggtcccctgccctga

SEQ ID NO: 2268365 - DNA, 21 bp, Homo sapiens
aggttcaaaggcagcaaggca

SEQ ID NO: 2268366 - DNA, 17 bp, Homo sapiens
agtagctgcttcctgga

SEQ ID NO: 2268367 - DNA, 18 bp, Homo sapiens
agtagctgcttcctggac

SEQ ID NO: 2268368 - DNA, 13 bp, Homo sapiens
agtcctcaggcag

SEQ ID NO: 2268369 - DNA, 16 bp, Homo sapiens
agtggacggagagcct

SEQ ID NO: 2268370 - DNA, 16 bp, Homo sapiens
agtggtggcttctcca

SEQ ID NO: 2268371 - DNA, 15 bp, Homo sapiens
atccccaccccacct

SEQ ID NO: 2268372 - DNA, 21 bp, Homo sapiens
atccgcttctcctgcagtgga

SEQ ID NO: 2268373 - DNA, 12 bp, Homo sapiens
atctcactctcc

SEQ ID NO: 2268374 - DNA, 12 bp, Homo sapiens
atgacttctcca

SEQ ID NO: 2268375 - DNA, 20 bp, Homo sapiens
atgagtgtgggtgccagtcc

SEQ ID NO: 2268376 - DNA, 20 bp, Homo sapiens
atgggtttggggctggcccc

SEQ ID NO: 2268377 - DNA, 15 bp, Homo sapiens
atgtgctatggagag

SEQ ID NO: 2268378 - DNA, 16 bp, Homo sapiens
atgtgctatggagagg

SEQ ID NO: 2268379 - DNA, 15 bp, Homo sapiens
attctctccttccct

SEQ ID NO: 2268380 - DNA, 12 bp, Homo sapiens
attgttcttccc

SEQ ID NO: 2268381 - DNA, 22 bp, Homo sapiens
caaaaaaggctgccctgggcca

SEQ ID NO: 2268382 - DNA, 16 bp, Homo sapiens
caaaggagagtcctgg

SEQ ID NO: 2268383 - DNA, 21 bp, Homo sapiens
caaaggcagcaaggcagtgag

SEQ ID NO: 2268384 - DNA, 21 bp, Homo sapiens
caaatcctaggctcctgggag

SEQ ID NO: 2268385 - DNA, 22 bp, Homo sapiens
caacccactgtcttgcagtgga

SEQ ID NO: 2268386 - DNA, 10 bp, Homo sapiens
caacctgcaa

SEQ ID NO: 2268387 - DNA, 15 bp, Homo sapiens
caagtgtgcatggct

SEQ ID NO: 2268388 - DNA, 14 bp, Homo sapiens
cacccactgtgcac

SEQ ID NO: 2268389 - DNA, 13 bp, Homo sapiens
caccccttcctcc

SEQ ID NO: 2268390 - DNA, 20 bp, Homo sapiens
cacctgcagcgctgggcccc

SEQ ID NO: 2268391 - DNA, 21 bp, Homo sapiens
cactgagacaaatcctaggct

SEQ ID NO: 2268392 - DNA, 22 bp, Homo sapiens
cactttgagagggctgaaggga

SEQ ID NO: 2268393 - DNA, 21 bp, Homo sapiens
cagacctccaggtccctaagc

SEQ ID NO: 2268394 - DNA, 20 bp, Homo sapiens
cagagctgtcctcctggcac

SEQ ID NO: 2268395 - DNA, 16 bp, Homo sapiens
cagaggcagggcagca

SEQ ID NO: 2268396 - DNA, 21 bp, Homo sapiens
cagagtagctgcttcctggac

SEQ ID NO: 2268397 - DNA, 22 bp, Homo sapiens
cagagtagctgcttcctggacg

SEQ ID NO: 2268398 - DNA, 16 bp, Homo sapiens
cagagttgtgcatgcc

SEQ ID NO: 2268399 - DNA, 22 bp, Homo sapiens
cagagttgtgcatgcccctgag

SEQ ID NO: 2268400 - DNA, 17 bp, Homo sapiens
cagcagggtagagagga

SEQ ID NO: 2268401 - DNA, 19 bp, Homo sapiens
cagccctatccattctctc

SEQ ID NO: 2268402 - DNA, 18 bp, Homo sapiens
cagccgcaatctggctcc

SEQ ID NO: 2268403 - DNA, 18 bp, Homo sapiens
caggagaaggggaaggga

SEQ ID NO: 2268404 - DNA, 14 bp, Homo sapiens
cagggaactgggaa

SEQ ID NO: 2268405 - DNA, 19 bp, Homo sapiens
caggggtggagggaaattg

SEQ ID NO: 2268406 - DNA, 20 bp, Homo sapiens
caggtcccctgccctgaggc

SEQ ID NO: 2268407 - DNA, 16 bp, Homo sapiens
cagtggacggagagcc

SEQ ID NO: 2268408 - DNA, 18 bp, Homo sapiens
cagtggacggagagcctt

SEQ ID NO: 2268409 - DNA, 13 bp, Homo sapiens
cagttcctggcat

SEQ ID NO: 2268410 - DNA, 14 bp, Homo sapiens
catcctggcccagc

SEQ ID NO: 2268411 - DNA, 20 bp, Homo sapiens
catctatgctctttcctgtc

SEQ ID NO: 2268412 - DNA, 19 bp, Homo sapiens
catgatttttccactgaga

SEQ ID NO: 2268413 - DNA, 23 bp, Homo sapiens
catttcattatttctgcttcctg

SEQ ID NO: 2268414 - DNA, 15 bp, Homo sapiens
ccaaaaaaggctgcc

SEQ ID NO: 2268415 - DNA, 23 bp, Homo sapiens
ccaagaaagacagtgtataagga

SEQ ID NO: 2268416 - DNA, 18 bp, Homo sapiens
ccaccccgtccctcctct

SEQ ID NO: 2268417 - DNA, 14 bp, Homo sapiens
ccactgtcttgcag

SEQ ID NO: 2268418 - DNA, 21 bp, Homo sapiens
ccagaacacatggctgggcct

SEQ ID NO: 2268419 - DNA, 19 bp, Homo sapiens
ccagacagaggcagggcag

SEQ ID NO: 2268420 - DNA, 16 bp, Homo sapiens
ccagagctgtcctcct

SEQ ID NO: 2268421 - DNA, 23 bp, Homo sapiens
ccagccgcaatctggctcctcct

SEQ ID NO: 2268422 - DNA, 15 bp, Homo sapiens
ccagcgcagagtagc

SEQ ID NO: 2268423 - DNA, 20 bp, Homo sapiens
ccagctgctgtgctgggtgc

SEQ ID NO: 2268424 - DNA, 14 bp, Homo sapiens
ccaggccagtgctg

SEQ ID NO: 2268425 - DNA, 15 bp, Homo sapiens
ccaggggtggaggga

SEQ ID NO: 2268426 - DNA, 20 bp, Homo sapiens
ccaggtactgagtggggagt

SEQ ID NO: 2268427 - DNA, 19 bp, Homo sapiens
ccagtgctgtgagcaggcg

SEQ ID NO: 2268428 - DNA, 20 bp, Homo sapiens
ccatatgtgctatggagagg

SEQ ID NO: 2268429 - DNA, 22 bp, Homo sapiens
ccatccaagaaagacagtgtat

SEQ ID NO: 2268430 - DNA, 16 bp, Homo sapiens
ccatcctggcccagcc

SEQ ID NO: 2268431 - DNA, 19 bp, Homo sapiens
cccaatagctagtgacagc

SEQ ID NO: 2268432 - DNA, 21 bp, Homo sapiens
cccatgctctctgtggcctcc

SEQ ID NO: 2268433 - DNA, 13 bp, Homo sapiens
ccccaacctgcaa

SEQ ID NO: 2268434 - DNA, 15 bp, Homo sapiens
ccccagtcctcaggc

SEQ ID NO: 2268435 - DNA, 16 bp, Homo sapiens
ccctgagcctggcagg

SEQ ID NO: 2268436 - DNA, 15 bp, Homo sapiens
ccctgcttctggctc

SEQ ID NO: 2268437 - DNA, 15 bp, Homo sapiens
ccgcttctcctgcag

SEQ ID NO: 2268438 - DNA, 17 bp, Homo sapiens
ccgtgacaaaggtagag

SEQ ID NO: 2268439 - DNA, 14 bp, Homo sapiens
cctcaaacttcaga

SEQ ID NO: 2268440 - DNA, 15 bp, Homo sapiens
cctcaggagaagggg

SEQ ID NO: 2268441 - DNA, 21 bp, Homo sapiens
cctcatccccaccccacctca

SEQ ID NO: 2268442 - DNA, 22 bp, Homo sapiens
cctccagagctgtcctcctggc

SEQ ID NO: 2268443 - DNA, 22 bp, Homo sapiens
cctccaggtccctaagctgggg

SEQ ID NO: 2268444 - DNA, 14 bp, Homo sapiens
cctcctcaggagaa

SEQ ID NO: 2268445 - DNA, 12 bp, Homo sapiens
cctccttcctcc

SEQ ID NO: 2268446 - DNA, 15 bp, Homo sapiens
cctctcatctatgct

SEQ ID NO: 2268447 - DNA, 18 bp, Homo sapiens
cctggcaggtcccctgcc

SEQ ID NO: 2268448 - DNA, 18 bp, Homo sapiens
cctgggaggccctggcag

SEQ ID NO: 2268449 - DNA, 18 bp, Homo sapiens
cctgggggaaggatgcag

SEQ ID NO: 2268450 - DNA, 19 bp, Homo sapiens
ccttcctccccaacctgca

SEQ ID NO: 2268451 - DNA, 20 bp, Homo sapiens
ccttcctccccaacctgcaa

SEQ ID NO: 2268452 - DNA, 16 bp, Homo sapiens
ccttggcgagggcagc

SEQ ID NO: 2268453 - DNA, 17 bp, Homo sapiens
cctttctgtggtgaggg

SEQ ID NO: 2268454 - DNA, 20 bp, Homo sapiens
cctttctgtggtgagggaga

SEQ ID NO: 2268455 - DNA, 21 bp, Homo sapiens
cgcaatctggctcctcctgga

SEQ ID NO: 2268456 - DNA, 22 bp, Homo sapiens
cgcccaggccagtgctgtgagc

SEQ ID NO: 2268457 - DNA, 15 bp, Homo sapiens
cgcttctcctgcagt

SEQ ID NO: 2268458 - DNA, 18 bp, Homo sapiens
cgcttctcctgcagtgga

SEQ ID NO: 2268459 - DNA, 17 bp, Homo sapiens
cggcctctacggccccg

SEQ ID NO: 2268460 - DNA, 14 bp, Homo sapiens
cgtgatcccctgct

SEQ ID NO: 2268461 - DNA, 21 bp, Homo sapiens
cgtgatcccctgcttctggct

SEQ ID NO: 2268462 - DNA, 12 bp, Homo sapiens
ctaagctgggga

SEQ ID NO: 2268463 - DNA, 15 bp, Homo sapiens
ctagcctctttctcc

SEQ ID NO: 2268464 - DNA, 19 bp, Homo sapiens
ctagtgacagccacttggc

SEQ ID NO: 2268465 - DNA, 13 bp, Homo sapiens
ctagtgtgcaagt

SEQ ID NO: 2268466 - DNA, 18 bp, Homo sapiens
ctatccattctctccttc

SEQ ID NO: 2268467 - DNA, 18 bp, Homo sapiens
ctatgagcccagcatgga

SEQ ID NO: 2268468 - DNA, 21 bp, Homo sapiens
ctcactctccccagtcctcag

SEQ ID NO: 2268469 - DNA, 22 bp, Homo sapiens
ctcactctccccagtcctcagg

SEQ ID NO: 2268470 - DNA, 19 bp, Homo sapiens
ctcacttccccttgcaccc

SEQ ID NO: 2268471 - DNA, 19 bp, Homo sapiens
ctcagtttcacaagtgagc

SEQ ID NO: 2268472 - DNA, 19 bp, Homo sapiens
ctccagagctgtcctcctg

SEQ ID NO: 2268473 - DNA, 21 bp, Homo sapiens
ctccagagctgtcctcctggc

SEQ ID NO: 2268474 - DNA, 22 bp, Homo sapiens
ctccagagctgtcctcctggca

SEQ ID NO: 2268475 - DNA, 12 bp, Homo sapiens
ctccagcctgct

SEQ ID NO: 2268476 - DNA, 14 bp, Homo sapiens
ctcctctcccgcag

SEQ ID NO: 2268477 - DNA, 13 bp, Homo sapiens
ctcctgcagtgga

SEQ ID NO: 2268478 - DNA, 20 bp, Homo sapiens
ctcctgggaggccctggcag

SEQ ID NO: 2268479 - DNA, 21 bp, Homo sapiens
ctcctgggaggccctggcaga

SEQ ID NO: 2268480 - DNA, 23 bp, Homo sapiens
ctcctgggaggccctggcagaag

SEQ ID NO: 2268481 - DNA, 16 bp, Homo sapiens
ctctggagagcctgca

SEQ ID NO: 2268482 - DNA, 13 bp, Homo sapiens
ctctgtggcctcc

SEQ ID NO: 2268483 - DNA, 23 bp, Homo sapiens
ctgagacaaatcctaggctcctg

SEQ ID NO: 2268484 - DNA, 13 bp, Homo sapiens
ctgagcctggcag

SEQ ID NO: 2268485 - DNA, 18 bp, Homo sapiens
ctgagctggggagggagg

SEQ ID NO: 2268486 - DNA, 15 bp, Homo sapiens
ctgaggctgtgagca

SEQ ID NO: 2268487 - DNA, 22 bp, Homo sapiens
ctgcaataaatccgcttctcct

SEQ ID NO: 2268488 - DNA, 19 bp, Homo sapiens
ctgcaccaagcacccactg

SEQ ID NO: 2268489 - DNA, 18 bp, Homo sapiens
ctgccctgaggctgtgag

SEQ ID NO: 2268490 - DNA, 19 bp, Homo sapiens
ctggcaggtcccctgccct

SEQ ID NO: 2268491 - DNA, 20 bp, Homo sapiens
ctggcaggtcccctgccctg

SEQ ID NO: 2268492 - DNA, 14 bp, Homo sapiens
ctgggaggccctgg

SEQ ID NO: 2268493 - DNA, 18 bp, Homo sapiens
ctgggaggccctggcaga

SEQ ID NO: 2268494 - DNA, 13 bp, Homo sapiens
ctggggagggagg

SEQ ID NO: 2268495 - DNA, 15 bp, Homo sapiens
ctgtcctcctggcac

SEQ ID NO: 2268496 - DNA, 17 bp, Homo sapiens
ctgtcctcctggcacct

SEQ ID NO: 2268497 - DNA, 19 bp, Homo sapiens
ctgtcctcctggcacctga

SEQ ID NO: 2268498 - DNA, 23 bp, Homo sapiens
ctgtcctcctggcacctgagtgt

SEQ ID NO: 2268499 - DNA, 21 bp, Homo sapiens
ctgtcttgcagtggacggaga

SEQ ID NO: 2268500 - DNA, 19 bp, Homo sapiens
ctgtgctgggtgccttgca

SEQ ID NO: 2268501 - DNA, 14 bp, Homo sapiens
cttccttcaactgc

SEQ ID NO: 2268502 - DNA, 19 bp, Homo sapiens
cttctcacttccccttgca

SEQ ID NO: 2268503 - DNA, 12 bp, Homo sapiens
cttctcctgcag

SEQ ID NO: 2268504 - DNA, 15 bp, Homo sapiens
cttctcctgcagtgg

SEQ ID NO: 2268505 - DNA, 16 bp, Homo sapiens
cttctcctgcagtgga

SEQ ID NO: 2268506 - DNA, 14 bp, Homo sapiens
cttgggtgagggga

SEQ ID NO: 2268507 - DNA, 18 bp, Homo sapiens
cttgtgaggcccgaggca

SEQ ID NO: 2268508 - DNA, 14 bp, Homo sapiens
gacatggcctctgg

SEQ ID NO: 2268509 - DNA, 15 bp, Homo sapiens
gaccagagaagggaa

SEQ ID NO: 2268510 - DNA, 20 bp, Homo sapiens
gacttatctgatcttcctca

SEQ ID NO: 2268511 - DNA, 17 bp, Homo sapiens
gacttctccaggcagag

SEQ ID NO: 2268512 - DNA, 14 bp, Homo sapiens
gactttgcacctgc

SEQ ID NO: 2268513 - DNA, 13 bp, Homo sapiens
gagaacagctccc

SEQ ID NO: 2268514 - DNA, 22 bp, Homo sapiens
gagaaggttctgagctgtccca

SEQ ID NO: 2268515 - DNA, 14 bp, Homo sapiens
gagagtcctgggag

SEQ ID NO: 2268516 - DNA, 21 bp, Homo sapiens
gagcccacaagatccaggcag

SEQ ID NO: 2268517 - DNA, 14 bp, Homo sapiens
gagccctcttgccc

SEQ ID NO: 2268518 - DNA, 19 bp, Homo sapiens
gagccctgagcctggcagg

SEQ ID NO: 2268519 - DNA, 22 bp, Homo sapiens
gagctgtcctcctggcacctga

SEQ ID NO: 2268520 - DNA, 23 bp, Homo sapiens
gaggcagggcagcatggagacag

SEQ ID NO: 2268521 - DNA, 19 bp, Homo sapiens
gaggcaggtgggtggtaag

SEQ ID NO: 2268522 - DNA, 18 bp, Homo sapiens
gaggccactttgagaggg

SEQ ID NO: 2268523 - DNA, 11 bp, Homo sapiens
gaggccctggc

SEQ ID NO: 2268524 - DNA, 21 bp, Homo sapiens
gagggaaactctggagagcct

SEQ ID NO: 2268525 - DNA, 22 bp, Homo sapiens
gagggaaactctggagagcctg

SEQ ID NO: 2268526 - DNA, 19 bp, Homo sapiens
gagggagccctgagcctgg

SEQ ID NO: 2268527 - DNA, 21 bp, Homo sapiens
gaggtccaaaaaaggctgccc

SEQ ID NO: 2268528 - DNA, 16 bp, Homo sapiens
gagtagctgcttcctg

SEQ ID NO: 2268529 - DNA, 16 bp, Homo sapiens
gatagagcagcctgct

SEQ ID NO: 2268530 - DNA, 23 bp, Homo sapiens
gatcacacacaccaaaccagaca

SEQ ID NO: 2268531 - DNA, 21 bp, Homo sapiens
gatgggtttggggctggcccc

SEQ ID NO: 2268532 - DNA, 11 bp, Homo sapiens
gatttgcacct

SEQ ID NO: 2268533 - DNA, 20 bp, Homo sapiens
gcaaaggagagtcctgggag

SEQ ID NO: 2268534 - DNA, 20 bp, Homo sapiens
gcaatctggctcctcctgga

SEQ ID NO: 2268535 - DNA, 21 bp, Homo sapiens
gcaatctggctcctcctggaa

SEQ ID NO: 2268536 - DNA, 19 bp, Homo sapiens
gcacccaggtactgagtgg

SEQ ID NO: 2268537 - DNA, 13 bp, Homo sapiens
gcagttcctggca

SEQ ID NO: 2268538 - DNA, 14 bp, Homo sapiens
gccccatcctggcc

SEQ ID NO: 2268539 - DNA, 15 bp, Homo sapiens
gccccatcctggccc

SEQ ID NO: 2268540 - DNA, 16 bp, Homo sapiens
gccccatcctggccca

SEQ ID NO: 2268541 - DNA, 21 bp, Homo sapiens
gcccccatgctctctgtggcc

SEQ ID NO: 2268542 - DNA, 16 bp, Homo sapiens
gccccccagcgcagag

SEQ ID NO: 2268543 - DNA, 17 bp, Homo sapiens
gccctgagcctggcagg

SEQ ID NO: 2268544 - DNA, 19 bp, Homo sapiens
gccctgagcctggcaggtc

SEQ ID NO: 2268545 - DNA, 21 bp, Homo sapiens
gccggagggagccctgagcct

SEQ ID NO: 2268546 - DNA, 16 bp, Homo sapiens
gcctggcaggtcccct

SEQ ID NO: 2268547 - DNA, 12 bp, Homo sapiens
gcgcagagtagc

SEQ ID NO: 2268548 - DNA, 22 bp, Homo sapiens
gcgcagagtagctgcttcctgg

SEQ ID NO: 2268549 - DNA, 15 bp, Homo sapiens
gcggggaggaggctg

SEQ ID NO: 2268550 - DNA, 23 bp, Homo sapiens
gcgttctcctatctaccttcctt

SEQ ID NO: 2268551 - DNA, 17 bp, Homo sapiens
gctatgagcccagcatg

SEQ ID NO: 2268552 - DNA, 13 bp, Homo sapiens
gctatggagagga

SEQ ID NO: 2268553 - DNA, 22 bp, Homo sapiens
gctcaggcatgcaaccatgggc

SEQ ID NO: 2268554 - DNA, 18 bp, Homo sapiens
gctcctaccactggacag

SEQ ID NO: 2268555 - DNA, 18 bp, Homo sapiens
gctcctgggaggccctgg

SEQ ID NO: 2268556 - DNA, 18 bp, Homo sapiens
gctggccccatcctggcc

SEQ ID NO: 2268557 - DNA, 22 bp, Homo sapiens
gctggccccatcctggcccagc

SEQ ID NO: 2268558 - DNA, 15 bp, Homo sapiens
gctggtttctgccct

SEQ ID NO: 2268559 - DNA, 13 bp, Homo sapiens
gctgtcctcctgg

SEQ ID NO: 2268560 - DNA, 15 bp, Homo sapiens
gctgtcctcctggca

SEQ ID NO: 2268561 - DNA, 22 bp, Homo sapiens
gctgtgagcagctagtggtggc

SEQ ID NO: 2268562 - DNA, 14 bp, Homo sapiens
gctgtgtgtgcccg

SEQ ID NO: 2268563 - DNA, 15 bp, Homo sapiens
ggaaactctggagag

SEQ ID NO: 2268564 - DNA, 14 bp, Homo sapiens
ggaaattggcagtt

SEQ ID NO: 2268565 - DNA, 20 bp, Homo sapiens
ggagggaaattggcagttcc

SEQ ID NO: 2268566 - DNA, 13 bp, Homo sapiens
ggatagagcagcc

SEQ ID NO: 2268567 - DNA, 14 bp, Homo sapiens
ggcagcatggagac

SEQ ID NO: 2268568 - DNA, 17 bp, Homo sapiens
ggcagcatggagacagg

SEQ ID NO: 2268569 - DNA, 17 bp, Homo sapiens
ggcaggtgggtggtaag

SEQ ID NO: 2268570 - DNA, 16 bp, Homo sapiens
ggccagtgctgtgagc

SEQ ID NO: 2268571 - DNA, 19 bp, Homo sapiens
ggctcctgggaggccctgg

SEQ ID NO: 2268572 - DNA, 13 bp, Homo sapiens
ggctgccctgggc

SEQ ID NO: 2268573 - DNA, 21 bp, Homo sapiens
ggctgccggagggagccctga

SEQ ID NO: 2268574 - DNA, 19 bp, Homo sapiens
ggctgggcaaggcgctcag

SEQ ID NO: 2268575 - DNA, 18 bp, Homo sapiens
gggaaactctggagagcc

SEQ ID NO: 2268576 - DNA, 23 bp, Homo sapiens
gggaaattggcagttcctggcat

SEQ ID NO: 2268577 - DNA, 21 bp, Homo sapiens
gggcagcagggtagagaggac

SEQ ID NO: 2268578 - DNA, 15 bp, Homo sapiens
gggcccaccccgtcc

SEQ ID NO: 2268579 - DNA, 18 bp, Homo sapiens
ggggactgagctggggag

SEQ ID NO: 2268580 - DNA, 21 bp, Homo sapiens
ggggctggccccatcctggcc

SEQ ID NO: 2268581 - DNA, 22 bp, Homo sapiens
gggtgaggggagatttgcacct

SEQ ID NO: 2268582 - DNA, 21 bp, Homo sapiens
aaagcaaaggagagtcctggg

SEQ ID NO: 2268583 - DNA, 20 bp, Homo sapiens
aaatgacttctccaggcaga

SEQ ID NO: 2268584 - DNA, 17 bp, Homo sapiens
aacacatggctgggcct

SEQ ID NO: 2268585 - DNA, 20 bp, Homo sapiens
aaccccgtgacaaaggtaga

SEQ ID NO: 2268586 - DNA, 13 bp, Homo sapiens
aactctggagagc

SEQ ID NO: 2268587 - DNA, 17 bp, Homo sapiens
aagactcattgctggag

SEQ ID NO: 2268588 - DNA, 18 bp, Homo sapiens
aagagggaaactctggag

SEQ ID NO: 2268589 - DNA, 22 bp, Homo sapiens
aagatttcctttctgtggtgag

SEQ ID NO: 2268590 - DNA, 13 bp, Homo sapiens
aaggctgccctgg

SEQ ID NO: 2268591 - DNA, 19 bp, Homo sapiens
aatctggctcctcctggaa

SEQ ID NO: 2268592 - DNA, 15 bp, Homo sapiens
accagacagaggcag

SEQ ID NO: 2268593 - DNA, 19 bp, Homo sapiens
accagagaacagctcccct

SEQ ID NO: 2268594 - DNA, 14 bp, Homo sapiens
accatttctagcct

SEQ ID NO: 2268595 - DNA, 16 bp, Homo sapiens
acccactgtgcaccag

SEQ ID NO: 2268596 - DNA, 17 bp, Homo sapiens
accctgaatgtgtgccc

SEQ ID NO: 2268597 - DNA, 23 bp, Homo sapiens
acgtgcgcgcccaggccagtgct

SEQ ID NO: 2268598 - DNA, 19 bp, Homo sapiens
actaagtctctagcctctt

SEQ ID NO: 2268599 - DNA, 14 bp, Homo sapiens
actctggagagcct

SEQ ID NO: 2268600 - DNA, 17 bp, Homo sapiens
actctggagagcctgca

SEQ ID NO: 2268601 - DNA, 23 bp, Homo sapiens
actgtcttgcagtggacggagag

SEQ ID NO: 2268602 - DNA, 16 bp, Homo sapiens
actgtgcaccaggcac

SEQ ID NO: 2268603 - DNA, 14 bp, Homo sapiens
acttctccaggcag

SEQ ID NO: 2268604 - DNA, 17 bp, Homo sapiens
agaagggtggagtcaga

SEQ ID NO: 2268605 - DNA, 14 bp, Homo sapiens
agacagacctccag

SEQ ID NO: 2268606 - DNA, 16 bp, Homo sapiens
agacagaggcagggca

SEQ ID NO: 2268607 - DNA, 18 bp, Homo sapiens
agacatggcctctggaaa

SEQ ID NO: 2268608 - DNA, 14 bp, Homo sapiens
agagggctgaaggg

SEQ ID NO: 2268609 - DNA, 23 bp, Homo sapiens
agcacacacctatggctggctgg

SEQ ID NO: 2268610 - DNA, 18 bp, Homo sapiens
agcatggagacaggtaga

SEQ ID NO: 2268611 - DNA, 20 bp, Homo sapiens
agcccacaagatccaggcag

SEQ ID NO: 2268612 - DNA, 23 bp, Homo sapiens
agcccgtgatcccctgcttctgg

SEQ ID NO: 2268613 - DNA, 18 bp, Homo sapiens
agccctcttgcccagcac

SEQ ID NO: 2268614 - DNA, 23 bp, Homo sapiens
agccctttggggacaagggctgc

SEQ ID NO: 2268615 - DNA, 16 bp, Homo sapiens
agcctctattgcccag

SEQ ID NO: 2268616 - DNA, 15 bp, Homo sapiens
agcctctttctccct

SEQ ID NO: 2268617 - DNA, 17 bp, Homo sapiens
agcctgctgctctcagg

SEQ ID NO: 2268618 - DNA, 21 bp, Homo sapiens
agccttggcgagggcagcagg

SEQ ID NO: 2268619 - DNA, 23 bp, Homo sapiens
agccttggcgagggcagcagggt

SEQ ID NO: 2268620 - DNA, 17 bp, Homo sapiens
agctggggacagagaag

SEQ ID NO: 2268621 - DNA, 14 bp, Homo sapiens
agctgtcctcctgg

SEQ ID NO: 2268622 - DNA, 16 bp, Homo sapiens
agctgtcctcctggca

SEQ ID NO: 2268623 - DNA, 21 bp, Homo sapiens
aggaggctgccggagggagcc

SEQ ID NO: 2268624 - DNA, 16 bp, Homo sapiens
aggccactttgagagg

SEQ ID NO: 2268625 - DNA, 20 bp, Homo sapiens
aggccagtactactgctctc

SEQ ID NO: 2268626 - DNA, 17 bp, Homo sapiens
aggccagtgctgtgagc

SEQ ID NO: 2268627 - DNA, 19 bp, Homo sapiens
aggccagtgctgtgagcag

SEQ ID NO: 2268628 - DNA, 13 bp, Homo sapiens
aggccctggcaga

SEQ ID NO: 2268629 - DNA, 15 bp, Homo sapiens
aggcggggaggaggc

SEQ ID NO: 2268630 - DNA, 22 bp, Homo sapiens
aggctcctgggaggccctggca

SEQ ID NO: 2268631 - DNA, 16 bp, Homo sapiens
aggctgccggagggag

SEQ ID NO: 2268632 - DNA, 13 bp, Homo sapiens
agggaactgggaa

SEQ ID NO: 2268633 - DNA, 15 bp, Homo sapiens
agggcagcatggaga

SEQ ID NO: 2268634 - DNA, 22 bp, Homo sapiens
agggccttgatttccagccgca

SEQ ID NO: 2268635 - DNA, 13 bp, Homo sapiens
agggctgaaggga

SEQ ID NO: 2268636 - DNA, 19 bp, Homo sapiens
aggggactgagctggggag

SEQ ID NO: 2268637 - DNA, 13 bp, Homo sapiens
agggtggagtcag

SEQ ID NO: 2268638 - DNA, 18 bp, Homo sapiens
aggtactgagtggggagt

SEQ ID NO: 2268639 - DNA, 21 bp, Homo sapiens
aggtccaaaaaaggctgccct

SEQ ID NO: 2268640 - DNA, 19 bp, Homo sapiens
aggtcccctgccctgaggc

SEQ ID NO: 2268641 - DNA, 15 bp, Homo sapiens
agtagctgcttcctg

SEQ ID NO: 2268642 - DNA, 14 bp, Homo sapiens
agtcctcaggcagc

SEQ ID NO: 2268643 - DNA, 19 bp, Homo sapiens
agtgagctatgagcccagc

SEQ ID NO: 2268644 - DNA, 17 bp, Homo sapiens
ataaatccgcttctcct

SEQ ID NO: 2268645 - DNA, 15 bp, Homo sapiens
atccgcttctcctgc

SEQ ID NO: 2268646 - DNA, 14 bp, Homo sapiens
atcctaggctcctg

SEQ ID NO: 2268647 - DNA, 14 bp, Homo sapiens
atcctggcccagcc

SEQ ID NO: 2268648 - DNA, 16 bp, Homo sapiens
atctctgttccttctc

SEQ ID NO: 2268649 - DNA, 14 bp, Homo sapiens
atctgatcttcctc

SEQ ID NO: 2268650 - DNA, 16 bp, Homo sapiens
atctggctcctcctgg

SEQ ID NO: 2268651 - DNA, 17 bp, Homo sapiens
atgacttctccaggcag

SEQ ID NO: 2268652 - DNA, 14 bp, Homo sapiens
atgcccctgagtgt

SEQ ID NO: 2268653 - DNA, 14 bp, Homo sapiens
atgcctcccagcta

SEQ ID NO: 2268654 - DNA, 20 bp, Homo sapiens
atggccaaagcaaaggagag

SEQ ID NO: 2268655 - DNA, 17 bp, Homo sapiens
atgtgctatggagagga

SEQ ID NO: 2268656 - DNA, 17 bp, Homo sapiens
attggcagttcctggca

SEQ ID NO: 2268657 - DNA, 24 bp, Homo sapiens
atttccagccgcaatctggctcct

SEQ ID NO: 2268658 - DNA, 13 bp, Homo sapiens
atttctgcttcct

SEQ ID NO: 2268659 - DNA, 20 bp, Homo sapiens
aaaaactaaatgtgaaatcc

SEQ ID NO: 2268660 - DNA, 13 bp, Homo sapiens
aaactctggagag

SEQ ID NO: 2268661 - DNA, 12 bp, Homo sapiens
aactctggagag

SEQ ID NO: 2268662 - DNA, 23 bp, Homo sapiens
aagccctttgtgggacccgggcc

SEQ ID NO: 2268663 - DNA, 23 bp, Homo sapiens
aaggagtctgatgctcaacatcc

SEQ ID NO: 2268664 - DNA, 16 bp, Homo sapiens
aagtgtgcatggctgg

SEQ ID NO: 2268665 - DNA, 20 bp, Homo sapiens
acaaatcctaggctcctggg

SEQ ID NO: 2268666 - DNA, 20 bp, Homo sapiens
acaagatccaggcagaagga

SEQ ID NO: 2268667 - DNA, 13 bp, Homo sapiens
acagacccctgcc

SEQ ID NO: 2268668 - DNA, 14 bp, Homo sapiens
acagacccctgcct

SEQ ID NO: 2268669 - DNA, 15 bp, Homo sapiens
acatggctgggcctt

SEQ ID NO: 2268670 - DNA, 19 bp, Homo sapiens
actcctctagaagaagcca

SEQ ID NO: 2268671 - DNA, 12 bp, Homo sapiens
actctggagagc

SEQ ID NO: 2268672 - DNA, 13 bp, Homo sapiens
actgagctgggga

SEQ ID NO: 2268673 - DNA, 16 bp, Homo sapiens
actgagtggggagtgt

SEQ ID NO: 2268674 - DNA, 21 bp, Homo sapiens
actgggaacttaggggactga

SEQ ID NO: 2268675 - DNA, 15 bp, Homo sapiens
actttgcacctgcaa

SEQ ID NO: 2268676 - DNA, 22 bp, Homo sapiens
agacaaatcctaggctcctggg

SEQ ID NO: 2268677 - DNA, 14 bp, Homo sapiens
agacagaggcaggg

SEQ ID NO: 2268678 - DNA, 16 bp, Homo sapiens
agacatggcctctgga

SEQ ID NO: 2268679 - DNA, 15 bp, Homo sapiens
agagattaactggga

SEQ ID NO: 2268680 - DNA, 19 bp, Homo sapiens
agagctgtcctcctggcac

SEQ ID NO: 2268681 - DNA, 18 bp, Homo sapiens
agagggaaactctggaga

SEQ ID NO: 2268682 - DNA, 19 bp, Homo sapiens
agagggctgaagggagggc

SEQ ID NO: 2268683 - DNA, 14 bp, Homo sapiens
agagtcctgggagc

SEQ ID NO: 2268684 - DNA, 22 bp, Homo sapiens
agatgggtttggggctggcccc

SEQ ID NO: 2268685 - DNA, 21 bp, Homo sapiens
agcaaatattgttcttcccat

SEQ ID NO: 2268686 - DNA, 22 bp, Homo sapiens
agcaggcggggaggaggctgcc

SEQ ID NO: 2268687 - DNA, 15 bp, Homo sapiens
agccctcttgcccag

SEQ ID NO: 2268688 - DNA, 17 bp, Homo sapiens
agccctgagcctggcag

SEQ ID NO: 2268689 - DNA, 17 bp, Homo sapiens
agcctggcaggtcccct

SEQ ID NO: 2268690 - DNA, 14 bp, Homo sapiens
agctatgagcccag

SEQ ID NO: 2268691 - DNA, 16 bp, Homo sapiens
agctggggagggaggc

SEQ ID NO: 2268692 - DNA, 20 bp, Homo sapiens
aggaggccactttgagaggg

SEQ ID NO: 2268693 - DNA, 18 bp, Homo sapiens
aggaggctgccggaggga

SEQ ID NO: 2268694 - DNA, 20 bp, Homo sapiens
aggcagggcagcatggagac

SEQ ID NO: 2268695 - DNA, 12 bp, Homo sapiens
aggcccccagcc

SEQ ID NO: 2268696 - DNA, 17 bp, Homo sapiens
aggctcctgggaggccc

SEQ ID NO: 2268697 - DNA, 21 bp, Homo sapiens
aggctcctgggaggccctggc

SEQ ID NO: 2268698 - DNA, 14 bp, Homo sapiens
agggaaactctgga

SEQ ID NO: 2268699 - DNA, 17 bp, Homo sapiens
agggaaactctggagag

SEQ ID NO: 2268700 - DNA, 19 bp, Homo sapiens
agggaaactctggagagcc

SEQ ID NO: 2268701 - DNA, 22 bp, Homo sapiens
agggaaggaggccactttgaga

SEQ ID NO: 2268702 - DNA, 17 bp, Homo sapiens
agggagccctgagcctg

SEQ ID NO: 2268703 - DNA, 13 bp, Homo sapiens
aggggtggaggga

SEQ ID NO: 2268704 - DNA, 17 bp, Homo sapiens
aggtactgagtggggag

SEQ ID NO: 2268705 - DNA, 20 bp, Homo sapiens
aggtccaaaaaaggctgccc

SEQ ID NO: 2268706 - DNA, 15 bp, Homo sapiens
aggttctgagctgtc

SEQ ID NO: 2268707 - DNA, 19 bp, Homo sapiens
agtcctcctcaggagaagg

SEQ ID NO: 2268708 - DNA, 13 bp, Homo sapiens
agtgagccctctt

SEQ ID NO: 2268709 - DNA, 19 bp, Homo sapiens
agtgagccctcttgcccag

SEQ ID NO: 2268710 - DNA, 15 bp, Homo sapiens
agtggacggagagcc

SEQ ID NO: 2268711 - DNA, 18 bp, Homo sapiens
agtgtccttgctctagag

SEQ ID NO: 2268712 - DNA, 14 bp, Homo sapiens
agtgtgggtgccag

SEQ ID NO: 2268713 - DNA, 20 bp, Homo sapiens
agtttcacaagtgagccctc

SEQ ID NO: 2268714 - DNA, 15 bp, Homo sapiens
atagagcagcctgct

SEQ ID NO: 2268715 - DNA, 17 bp, Homo sapiens
atatgtgctatggagag

SEQ ID NO: 2268716 - DNA, 21 bp, Homo sapiens
atccatcacccatctcactct

SEQ ID NO: 2268717 - DNA, 20 bp, Homo sapiens
atcccctgcttctggctcct

SEQ ID NO: 2268718 - DNA, 11 bp, Homo sapiens
atcctggccca

SEQ ID NO: 2268719 - DNA, 17 bp, Homo sapiens
atcctggcccagcctct

SEQ ID NO: 2268720 - DNA, 13 bp, Homo sapiens
atctaccttcctt

SEQ ID NO: 2268721 - DNA, 19 bp, Homo sapiens
atgacttctccaggcagag

SEQ ID NO: 2268722 - DNA, 23 bp, Homo sapiens
atggccaaagcaaaggagagtcc

SEQ ID NO: 2268723 - DNA, 14 bp, Homo sapiens
attctctccttccc

SEQ ID NO: 2268724 - DNA, 17 bp, Homo sapiens
caaaggagagtcctggg

SEQ ID NO: 2268725 - DNA, 19 bp, Homo sapiens
caaaggagagtcctgggag

SEQ ID NO: 2268726 - DNA, 17 bp, Homo sapiens
caaaggcagcaaggcag

SEQ ID NO: 2268727 - DNA, 16 bp, Homo sapiens
caaaggcccccagcca

SEQ ID NO: 2268728 - DNA, 20 bp, Homo sapiens
caaagtgacctccagagctg

SEQ ID NO: 2268729 - DNA, 19 bp, Homo sapiens
caaatattgttcttcccat

SEQ ID NO: 2268730 - DNA, 15 bp, Homo sapiens
caacatcccttacct

SEQ ID NO: 2268731 - DNA, 14 bp, Homo sapiens
caagtgtgcatggc

SEQ ID NO: 2268732 - DNA, 20 bp, Homo sapiens
caagtgtgcatggctgggga

SEQ ID NO: 2268733 - DNA, 19 bp, Homo sapiens
caataaatccgcttctcct

SEQ ID NO: 2268734 - DNA, 21 bp, Homo sapiens
cacacacctatggctggctgg

SEQ ID NO: 2268735 - DNA, 19 bp, Homo sapiens
cacacctatggctggctgg

SEQ ID NO: 2268736 - DNA, 18 bp, Homo sapiens
caccccgtccctcctctc

SEQ ID NO: 2268737 - DNA, 17 bp, Homo sapiens
cacctatggctggctgg

SEQ ID NO: 2268738 - DNA, 17 bp, Homo sapiens
cacctgagtgtccttgc

SEQ ID NO: 2268739 - DNA, 12 bp, Homo sapiens
cactcaataaat

SEQ ID NO: 2268740 - DNA, 13 bp, Homo sapiens
cactttgagaggg

SEQ ID NO: 2268741 - DNA, 16 bp, Homo sapiens
cagacagaggcagggc

SEQ ID NO: 2268742 - DNA, 19 bp, Homo sapiens
cagacagaggcagggcagc

SEQ ID NO: 2268743 - DNA, 22 bp, Homo sapiens
cagagctgtcctcctggcacct

SEQ ID NO: 2268744 - DNA, 14 bp, Homo sapiens
cagaggcagggcag

SEQ ID NO: 2268745 - DNA, 15 bp, Homo sapiens
cagcaaggcagtgag

SEQ ID NO: 2268746 - DNA, 16 bp, Homo sapiens
cagcaaggcagtgagc

SEQ ID NO: 2268747 - DNA, 18 bp, Homo sapiens
cagcccgtgatcccctgc

SEQ ID NO: 2268748 - DNA, 14 bp, Homo sapiens
cagcctgctgctct

SEQ ID NO: 2268749 - DNA, 13 bp, Homo sapiens
cagcgcagagtag

SEQ ID NO: 2268750 - DNA, 23 bp, Homo sapiens
cagcgcagagtagctgcttcctg

SEQ ID NO: 2268751 - DNA, 18 bp, Homo sapiens
cagcgctgggccccaagg

SEQ ID NO: 2268752 - DNA, 14 bp, Homo sapiens
caggaccagagaag

SEQ ID NO: 2268753 - DNA, 18 bp, Homo sapiens
caggcatatgagtgcgca

SEQ ID NO: 2268754 - DNA, 19 bp, Homo sapiens
caggccagtgctgtgagca

SEQ ID NO: 2268755 - DNA, 13 bp, Homo sapiens
cagggaactggga

SEQ ID NO: 2268756 - DNA, 18 bp, Homo sapiens
caggtactgagtggggag

SEQ ID NO: 2268757 - DNA, 15 bp, Homo sapiens
caggtcccctgccct

SEQ ID NO: 2268758 - DNA, 20 bp, Homo sapiens
cagtgagctatgagcccagc

SEQ ID NO: 2268759 - DNA, 14 bp, Homo sapiens
cagtggacggagag

SEQ ID NO: 2268760 - DNA, 12 bp, Homo sapiens
cagttcctggca

SEQ ID NO: 2268761 - DNA, 18 bp, Homo sapiens
catatgtgctatggagag

SEQ ID NO: 2268762 - DNA, 17 bp, Homo sapiens
catctatgctctttcct

SEQ ID NO: 2268763 - DNA, 13 bp, Homo sapiens
catgcccctgagt

SEQ ID NO: 2268764 - DNA, 16 bp, Homo sapiens
ccactgtcttgcagtg

SEQ ID NO: 2268765 - DNA, 18 bp, Homo sapiens
ccactgtcttgcagtgga

SEQ ID NO: 2268766 - DNA, 15 bp, Homo sapiens
ccactttgagagggc

SEQ ID NO: 2268767 - DNA, 18 bp, Homo sapiens
ccagagaacagctcccct

SEQ ID NO: 2268768 - DNA, 17 bp, Homo sapiens
ccagattggagtcagag

SEQ ID NO: 2268769 - DNA, 21 bp, Homo sapiens
ccagcctgctgtataagtaac

SEQ ID NO: 2268770 - DNA, 21 bp, Homo sapiens
ccagtcctcctcaggagaagg

SEQ ID NO: 2268771 - DNA, 13 bp, Homo sapiens
ccatcctggccca

SEQ ID NO: 2268772 - DNA, 14 bp, Homo sapiens
ccatgggcaccagg

SEQ ID NO: 2268773 - DNA, 15 bp, Homo sapiens
cccactgtcttgcag

SEQ ID NO: 2268774 - DNA, 18 bp, Homo sapiens
cccacttcggcgcagaaa

SEQ ID NO: 2268775 - DNA, 19 bp, Homo sapiens
cccagcacacacctatggc

SEQ ID NO: 2268776 - DNA, 14 bp, Homo sapiens
cccagcgcagagta

SEQ ID NO: 2268777 - DNA, 20 bp, Homo sapiens
ccccaatagctagtgacagc

SEQ ID NO: 2268778 - DNA, 18 bp, Homo sapiens
ccccagtcctcaggcagc

SEQ ID NO: 2268779 - DNA, 14 bp, Homo sapiens
cccccacctgcagc

SEQ ID NO: 2268780 - DNA, 23 bp, Homo sapiens
cccccacctgcagcgctgggccc

SEQ ID NO: 2268781 - DNA, 22 bp, Homo sapiens
ccccttcctccccaacctgcaa

SEQ ID NO: 2268782 - DNA, 12 bp, Homo sapiens
ccctgagcctgg

SEQ ID NO: 2268783 - DNA, 15 bp, Homo sapiens
ccctgagcctggcag

SEQ ID NO: 2268784 - DNA, 15 bp, Homo sapiens
ccctgaggctgtgag

SEQ ID NO: 2268785 - DNA, 16 bp, Homo sapiens
ccctgcttctggctcc

SEQ ID NO: 2268786 - DNA, 20 bp, Homo sapiens
cccttcctccccaacctgca

SEQ ID NO: 2268787 - DNA, 18 bp, Homo sapiens
cccttgcaccccttcctc

SEQ ID NO: 2268788 - DNA, 15 bp, Homo sapiens
ccgcaatctggctcc

SEQ ID NO: 2268789 - DNA, 16 bp, Homo sapiens
ccgcttctcctgcagt

SEQ ID NO: 2268790 - DNA, 18 bp, Homo sapiens
cctacgttggtgcaagtg

SEQ ID NO: 2268791 - DNA, 16 bp, Homo sapiens
cctagacatggcctct

SEQ ID NO: 2268792 - DNA, 14 bp, Homo sapiens
cctaggctcctggg

SEQ ID NO: 2268793 - DNA, 19 bp, Homo sapiens
cctatcttttctcccacct

SEQ ID NO: 2268794 - DNA, 20 bp, Homo sapiens
cctccagagctgtcctcctg

SEQ ID NO: 2268795 - DNA, 15 bp, Homo sapiens
cctcctctcccgcag

SEQ ID NO: 2268796 - DNA, 14 bp, Homo sapiens
cctgagcctggcag

SEQ ID NO: 2268797 - DNA, 15 bp, Homo sapiens
cctgagcctggcagg

SEQ ID NO: 2268798 - DNA, 12 bp, Homo sapiens
cctgccctgagg

SEQ ID NO: 2268799 - DNA, 14 bp, Homo sapiens
cctgcttctggctc

SEQ ID NO: 2268800 - DNA, 15 bp, Homo sapiens
cctggcacctgagtg

SEQ ID NO: 2268801 - DNA, 12 bp, Homo sapiens
cctggcccagcc

SEQ ID NO: 2268802 - DNA, 21 bp, Homo sapiens
ccttcctcctaccacccagcc

SEQ ID NO: 2268803 - DNA, 17 bp, Homo sapiens
cgcatgtaaagatgctg

SEQ ID NO: 2268804 - DNA, 21 bp, Homo sapiens
cgcccaggccagtgctgtgag

SEQ ID NO: 2268805 - DNA, 18 bp, Homo sapiens
cgtgtgtgtatgctgtgt

SEQ ID NO: 2268806 - DNA, 12 bp, Homo sapiens
cgttggtgcaag

SEQ ID NO: 2268807 - DNA, 22 bp, Homo sapiens
ctaccttccttcaactgctctg

SEQ ID NO: 2268808 - DNA, 17 bp, Homo sapiens
ctagacatggcctctgg

SEQ ID NO: 2268809 - DNA, 12 bp, Homo sapiens
ctaggctcctgg

SEQ ID NO: 2268810 - DNA, 21 bp, Homo sapiens
ctagtgacagccacttggcct

SEQ ID NO: 2268811 - DNA, 14 bp, Homo sapiens
ctagtgtgcaagtg

SEQ ID NO: 2268812 - DNA, 15 bp, Homo sapiens
ctagtgtgcaagtgt

SEQ ID NO: 2268813 - DNA, 16 bp, Homo sapiens
ctatctaccttccttc

SEQ ID NO: 2268814 - DNA, 16 bp, Homo sapiens
ctcaacatcccttacc

SEQ ID NO: 2268815 - DNA, 14 bp, Homo sapiens
ctcacatgcagagt

SEQ ID NO: 2268816 - DNA, 15 bp, Homo sapiens
ctcacttccccttgc

SEQ ID NO: 2268817 - DNA, 20 bp, Homo sapiens
ctccagagctgtcctcctgg

SEQ ID NO: 2268818 - DNA, 14 bp, Homo sapiens
ctcccacctccttc

SEQ ID NO: 2268819 - DNA, 16 bp, Homo sapiens
ctcccacctccttcct

SEQ ID NO: 2268820 - DNA, 14 bp, Homo sapiens
ctccccaacctgca

SEQ ID NO: 2268821 - DNA, 14 bp, Homo sapiens
ctctccagcctgct

SEQ ID NO: 2268822 - DNA, 19 bp, Homo sapiens
ctctctgtggcctccatgc

SEQ ID NO: 2268823 - DNA, 15 bp, Homo sapiens
ctctgttccttctct

SEQ ID NO: 2268824 - DNA, 20 bp, Homo sapiens
ctctttctcccttctgctcc

SEQ ID NO: 2268825 - DNA, 23 bp, Homo sapiens
ctgagcctggcaggtcccctgcc

SEQ ID NO: 2268826 - DNA, 12 bp, Homo sapiens
ctgagctgggga

SEQ ID NO: 2268827 - DNA, 20 bp, Homo sapiens
ctgcaccaagcacccactgt

SEQ ID NO: 2268828 - DNA, 14 bp, Homo sapiens
ctgccggagggagc

SEQ ID NO: 2268829 - DNA, 19 bp, Homo sapiens
ctgccggagggagccctga

SEQ ID NO: 2268830 - DNA, 21 bp, Homo sapiens
ctgccggagggagccctgagc

SEQ ID NO: 2268831 - DNA, 14 bp, Homo sapiens
ctggagagcctgca

SEQ ID NO: 2268832 - DNA, 12 bp, Homo sapiens
ctggctcctcct

SEQ ID NO: 2268833 - DNA, 19 bp, Homo sapiens
ctgggaggccctggcagaa

SEQ ID NO: 2268834 - DNA, 15 bp, Homo sapiens
ctgtgcaccaggcac

SEQ ID NO: 2268835 - DNA, 19 bp, Homo sapiens
cttcctccccaacctgcaa

SEQ ID NO: 2268836 - DNA, 13 bp, Homo sapiens
cttcctcctacca

SEQ ID NO: 2268837 - DNA, 19 bp, Homo sapiens
cttctaaatttctaggcca

SEQ ID NO: 2268838 - DNA, 14 bp, Homo sapiens
cttgaacccccctc

SEQ ID NO: 2268839 - DNA, 14 bp, Homo sapiens
cttgcaccccttcc

SEQ ID NO: 2268840 - DNA, 22 bp, Homo sapiens
cttgcagtggacggagagcctt

SEQ ID NO: 2268841 - DNA, 22 bp, Homo sapiens
cttgccaagactcattgctgga

SEQ ID NO: 2268842 - DNA, 16 bp, Homo sapiens
cttggcctcactacca

SEQ ID NO: 2268843 - DNA, 13 bp, Homo sapiens
cttggcgagggca

SEQ ID NO: 2268844 - DNA, 15 bp, Homo sapiens
cttggcgagggcagc

SEQ ID NO: 2268845 - DNA, 24 bp, Homo sapiens
cttggcgagggcagcagggtagag

SEQ ID NO: 2268846 - DNA, 23 bp, Homo sapiens
cttgtgaggcccgaggcagaagg

SEQ ID NO: 2268847 - DNA, 18 bp, Homo sapiens
cttgtgtaccagctgctg

SEQ ID NO: 2268848 - DNA, 13 bp, Homo sapiens
ctttgcacctgca

SEQ ID NO: 2268849 - DNA, 16 bp, Homo sapiens
cttttctcccacctcc

SEQ ID NO: 2268850 - DNA, 23 bp, Homo sapiens
cttttctcccacctccttcctcc

SEQ ID NO: 2268851 - DNA, 21 bp, Homo sapiens
cttttgtcctcacatgcagag

SEQ ID NO: 2268852 - DNA, 21 bp, Homo sapiens
ctttttggattgcatctcccc

SEQ ID NO: 2268853 - DNA, 21 bp, Homo sapiens
gaaaatttcccccacctgcag

SEQ ID NO: 2268854 - DNA, 19 bp, Homo sapiens
gaaactctggagagcctgc

SEQ ID NO: 2268855 - DNA, 20 bp, Homo sapiens
gaaatgacttctccaggcag

SEQ ID NO: 2268856 - DNA, 14 bp, Homo sapiens
gaaggaggccactt

SEQ ID NO: 2268857 - DNA, 19 bp, Homo sapiens
gaaggaggccactttgaga

SEQ ID NO: 2268858 - DNA, 16 bp, Homo sapiens
gacagaggcagggcag

SEQ ID NO: 2268859 - DNA, 19 bp, Homo sapiens
gacggagagccttggcgag

SEQ ID NO: 2268860 - DNA, 20 bp, Homo sapiens
gacgtgcgcgcccaggccag

SEQ ID NO: 2268861 - DNA, 15 bp, Homo sapiens
gactgagctggggag

SEQ ID NO: 2268862 - DNA, 21 bp, Homo sapiens
gactgtaagccctttggggac

SEQ ID NO: 2268863 - DNA, 18 bp, Homo sapiens
gacttatctgatcttcct

SEQ ID NO: 2268864 - DNA, 20 bp, Homo sapiens
gagaaggttctgagctgtcc

SEQ ID NO: 2268865 - DNA, 12 bp, Homo sapiens
gagagtcctggg

SEQ ID NO: 2268866 - DNA, 23 bp, Homo sapiens
gagatgggtttggggctggcccc

SEQ ID NO: 2268867 - DNA, 16 bp, Homo sapiens
gagcagctagtggtgg

SEQ ID NO: 2268868 - DNA, 15 bp, Homo sapiens
gagccctcttgccca

SEQ ID NO: 2268869 - DNA, 13 bp, Homo sapiens
gagccttggcgag

SEQ ID NO: 2268870 - DNA, 21 bp, Homo sapiens
gaggcagggcagcatggagac

SEQ ID NO: 2268871 - DNA, 15 bp, Homo sapiens
gaggccactttgaga

SEQ ID NO: 2268872 - DNA, 18 bp, Homo sapiens
gaggcccgaggcagaagg

SEQ ID NO: 2268873 - DNA, 12 bp, Homo sapiens
gaggccctggca

SEQ ID NO: 2268874 - DNA, 13 bp, Homo sapiens
gaggccctggcag

SEQ ID NO: 2268875 - DNA, 15 bp, Homo sapiens
gaggccctggcagaa

SEQ ID NO: 2268876 - DNA, 19 bp, Homo sapiens
gaggctgccggagggagcc

SEQ ID NO: 2268877 - DNA, 17 bp, Homo sapiens
gagggaaactctggaga

SEQ ID NO: 2268878 - DNA, 22 bp, Homo sapiens
gagggagccctgagcctggcag

SEQ ID NO: 2268879 - DNA, 23 bp, Homo sapiens
gaggttcaaaggcagcaaggcag

SEQ ID NO: 2268880 - DNA, 13 bp, Homo sapiens
gagtctagaaccc

SEQ ID NO: 2268881 - DNA, 19 bp, Homo sapiens
gagtgtacagacccctgcc

SEQ ID NO: 2268882 - DNA, 19 bp, Homo sapiens
gagttgtgcatgcccctga

SEQ ID NO: 2268883 - DNA, 20 bp, Homo sapiens
gatcttcctcaaacttcaga

SEQ ID NO: 2268884 - DNA, 20 bp, Homo sapiens
gatttcctttctgtggtgag

SEQ ID NO: 2268885 - DNA, 14 bp, Homo sapiens
gcaaggcgctcagg

SEQ ID NO: 2268886 - DNA, 17 bp, Homo sapiens
gcaatctggctcctcct

SEQ ID NO: 2268887 - DNA, 22 bp, Homo sapiens
gcacacacctatggctggctgg

SEQ ID NO: 2268888 - DNA, 14 bp, Homo sapiens
gcaccccttcctcc

SEQ ID NO: 2268889 - DNA, 15 bp, Homo sapiens
gcagagtagctgctt

SEQ ID NO: 2268890 - DNA, 17 bp, Homo sapiens
gcagagtagctgcttcc

SEQ ID NO: 2268891 - DNA, 14 bp, Homo sapiens
gcagggtagagagg

SEQ ID NO: 2268892 - DNA, 16 bp, Homo sapiens
gcagtggacggagagc

SEQ ID NO: 2268893 - DNA, 16 bp, Homo sapiens
gccagtcctcctcagg

SEQ ID NO: 2268894 - DNA, 22 bp, Homo sapiens
gccatatgtgctatggagagga

SEQ ID NO: 2268895 - DNA, 22 bp, Homo sapiens
gcccaacccactgtcttgcagt

SEQ ID NO: 2268896 - DNA, 18 bp, Homo sapiens
gcccaggccagtgctgtg

SEQ ID NO: 2268897 - DNA, 19 bp, Homo sapiens
gccctttaagagcacccgg

SEQ ID NO: 2268898 - DNA, 15 bp, Homo sapiens
gccgcaatctggctc

SEQ ID NO: 2268899 - DNA, 17 bp, Homo sapiens
gccgcaatctggctcct

SEQ ID NO: 2268900 - DNA, 22 bp, Homo sapiens
gcctttccagcccaacccactg

SEQ ID NO: 2268901 - DNA, 22 bp, Homo sapiens
gcgcccaggccagtgctgtgag

SEQ ID NO: 2268902 - DNA, 12 bp, Homo sapiens
gctcctcctgga

SEQ ID NO: 2268903 - DNA, 21 bp, Homo sapiens
gctcctgggaggccctggcag

SEQ ID NO: 2268904 - DNA, 21 bp, Homo sapiens
gctctctgtggcctccatgcc

SEQ ID NO: 2268905 - DNA, 22 bp, Homo sapiens
gctgccggagggagccctgagc

SEQ ID NO: 2268906 - DNA, 16 bp, Homo sapiens
gctggaggtagagagg

SEQ ID NO: 2268907 - DNA, 11 bp, Homo sapiens
gctggccccat

SEQ ID NO: 2268908 - DNA, 21 bp, Homo sapiens
gctgggcctttccagcccaac

SEQ ID NO: 2268909 - DNA, 17 bp, Homo sapiens
gctggggacagagaagg

SEQ ID NO: 2268910 - DNA, 16 bp, Homo sapiens
gctgtcctcctggcac

SEQ ID NO: 2268911 - DNA, 14 bp, Homo sapiens
gcttcctgggggaa

SEQ ID NO: 2268912 - DNA, 13 bp, Homo sapiens
gcttctcctgcag

SEQ ID NO: 2268913 - DNA, 16 bp, Homo sapiens
gcttctcctgcagtgg

SEQ ID NO: 2268914 - DNA, 19 bp, Homo sapiens
gcttctcctgcagtggatg

SEQ ID NO: 2268915 - DNA, 13 bp, Homo sapiens
ggaccagagaagg

SEQ ID NO: 2268916 - DNA, 15 bp, Homo sapiens
ggagagtcctgggag

SEQ ID NO: 2268917 - DNA, 14 bp, Homo sapiens
ggaggccctggcag

SEQ ID NO: 2268918 - DNA, 17 bp, Homo sapiens
ggatagagcagcctgct

SEQ ID NO: 2268919 - DNA, 15 bp, Homo sapiens
ggcagcagcttttcc

SEQ ID NO: 2268920 - DNA, 21 bp, Homo sapiens
ggccatatgtgctatggagag

SEQ ID NO: 2268921 - DNA, 22 bp, Homo sapiens
ggccatatgtgctatggagagg

SEQ ID NO: 2268922 - DNA, 16 bp, Homo sapiens
ggccccatcctggccc

SEQ ID NO: 2268923 - DNA, 15 bp, Homo sapiens
ggctcctcctggaaa

SEQ ID NO: 2268924 - DNA, 20 bp, Homo sapiens
ggctcctgggaggccctggc

SEQ ID NO: 2268925 - DNA, 22 bp, Homo sapiens
ggctcctgggaggccctggcag

SEQ ID NO: 2268926 - DNA, 23 bp, Homo sapiens
ggctcctgggaggccctggcaga

SEQ ID NO: 2268927 - DNA, 11 bp, Homo sapiens
ggctggcccca

SEQ ID NO: 2268928 - DNA, 21 bp, Homo sapiens
ggctggccccatcctggccca

SEQ ID NO: 2268929 - DNA, 16 bp, Homo sapiens
ggctggtttctgccct

SEQ ID NO: 2268930 - DNA, 16 bp, Homo sapiens
gggaaactctggagag

SEQ ID NO: 2268931 - DNA, 13 bp, Homo sapiens
gggacagagaagg

SEQ ID NO: 2268932 - DNA, 13 bp, Homo sapiens
gggacccgggcct

SEQ ID NO: 2268933 - DNA, 13 bp, Homo sapiens
gggactgagctgg

SEQ ID NO: 2268934 - DNA, 15 bp, Homo sapiens
gggctggccccatcc

SEQ ID NO: 2268935 - DNA, 23 bp, Homo sapiens
ggtccaaaaaaggctgccctggg

SEQ ID NO: 2268936 - DNA, 13 bp, Homo sapiens
ggtcccctgccct

SEQ ID NO: 2268937 - DNA, 19 bp, Homo sapiens
ggtgccagtcctcctcagg

SEQ ID NO: 2268938 - DNA, 23 bp, Homo sapiens
ggtgccagtcctcctcaggagaa

SEQ ID NO: 2268939 - DNA, 21 bp, Homo sapiens
gtaagagggaaactctggaga

SEQ ID NO: 2268940 - DNA, 17 bp, Homo sapiens
gtagctgcttcctggac

SEQ ID NO: 2268941 - DNA, 15 bp, Homo sapiens
gtcccctgccctgag

SEQ ID NO: 2268942 - DNA, 16 bp, Homo sapiens
gtcccctgccctgagg

SEQ ID NO: 2268943 - DNA, 13 bp, Homo sapiens
gtcctcctggcac

SEQ ID NO: 2268944 - DNA, 10 bp, Homo sapiens
gtcctgggag

SEQ ID NO: 2268945 - DNA, 19 bp, Homo sapiens
gtctccaggggtgccccag

SEQ ID NO: 2268946 - DNA, 12 bp, Homo sapiens
gtcttgcagtgg

SEQ ID NO: 2268947 - DNA, 23 bp, Homo sapiens
gtcttgcagtggacggagagcct

SEQ ID NO: 2268948 - DNA, 19 bp, Homo sapiens
gtgagcaggcggggaggag

SEQ ID NO: 2268949 - DNA, 19 bp, Homo sapiens
gtgaggcccgaggcagaag

SEQ ID NO: 2268950 - DNA, 23 bp, Homo sapiens
gtgccagtcctcctcaggagaag

SEQ ID NO: 2268951 - DNA, 14 bp, Homo sapiens
gtgctatggagagg

SEQ ID NO: 2268952 - DNA, 12 bp, Homo sapiens
gtggacggagag

SEQ ID NO: 2268953 - DNA, 15 bp, Homo sapiens
gtggacggagagcct

SEQ ID NO: 2268954 - DNA, 15 bp, Homo sapiens
gtggtgagggagaac

SEQ ID NO: 2268955 - DNA, 20 bp, Homo sapiens
gtgtaccagctgctgtgctg

SEQ ID NO: 2268956 - DNA, 23 bp, Homo sapiens
gtgtatgctgtgtgtgcccggga

SEQ ID NO: 2268957 - DNA, 21 bp, Homo sapiens
gtgtgccctatcttttctccc

SEQ ID NO: 2268958 - DNA, 16 bp, Homo sapiens
gttctcttttgtcctc

SEQ ID NO: 2268959 - DNA, 22 bp, Homo sapiens
gttcttggatggcgttctccta

SEQ ID NO: 2268960 - DNA, 17 bp, Homo sapiens
taaatccgcttctcctg

SEQ ID NO: 2268961 - DNA, 22 bp, Homo sapiens
taagagggaaactctggagagc

SEQ ID NO: 2268962 - DNA, 17 bp, Homo sapiens
taattgtgtcccctctc

SEQ ID NO: 2268963 - DNA, 21 bp, Homo sapiens
tacccatccatcacccatctc

SEQ ID NO: 2268964 - DNA, 13 bp, Homo sapiens
tagagcagcctgc

SEQ ID NO: 2268965 - DNA, 13 bp, Homo sapiens
tagctgcttcctg

SEQ ID NO: 2268966 - DNA, 15 bp, Homo sapiens
tagtatatggtggag

SEQ ID NO: 2268967 - DNA, 14 bp, Homo sapiens
tatgctctttcctg

SEQ ID NO: 2268968 - DNA, 13 bp, Homo sapiens
tcaaccagagaac

SEQ ID NO: 2268969 - DNA, 22 bp, Homo sapiens
tcaaccagagaacagctcccct

SEQ ID NO: 2268970 - DNA, 14 bp, Homo sapiens
tcacaagtgagccc

SEQ ID NO: 2268971 - DNA, 21 bp, Homo sapiens
tcacgtgtgtgtatgctgtgt

SEQ ID NO: 2268972 - DNA, 11 bp, Homo sapiens
tcacttcccct

SEQ ID NO: 2268973 - DNA, 16 bp, Homo sapiens
tcaggcacctcatccc

SEQ ID NO: 2268974 - DNA, 15 bp, Homo sapiens
tcagggaactgggaa

SEQ ID NO: 2268975 - DNA, 13 bp, Homo sapiens
tcagtcagagaac

SEQ ID NO: 2268976 - DNA, 21 bp, Homo sapiens
tcataccttgaacccccctcc

SEQ ID NO: 2268977 - DNA, 18 bp, Homo sapiens
tcatctatgctctttcct

SEQ ID NO: 2268978 - DNA, 19 bp, Homo sapiens
tccaggcagaaggagatgg

SEQ ID NO: 2268979 - DNA, 18 bp, Homo sapiens
tccatgccttcaagactt

SEQ ID NO: 2268980 - DNA, 16 bp, Homo sapiens
tcccacctccttcctc

SEQ ID NO: 2268981 - DNA, 19 bp, Homo sapiens
tcccacctccttcctccta

SEQ ID NO: 2268982 - DNA, 15 bp, Homo sapiens
tccccaacctgcaat

SEQ ID NO: 2268983 - DNA, 15 bp, Homo sapiens
tcccccacctgcagc

SEQ ID NO: 2268984 - DNA, 13 bp, Homo sapiens
tccctcctctccc

SEQ ID NO: 2268985 - DNA, 13 bp, Homo sapiens
tccgcccccatgc

SEQ ID NO: 2268986 - DNA, 16 bp, Homo sapiens
tcctcacatgcagagt

SEQ ID NO: 2268987 - DNA, 13 bp, Homo sapiens
tcctcctggcacc

SEQ ID NO: 2268988 - DNA, 9 bp, Homo sapiens
tcctgggag

SEQ ID NO: 2268989 - DNA, 13 bp, Homo sapiens
tccttccctctcc

SEQ ID NO: 2268990 - DNA, 14 bp, Homo sapiens
tctcaaaagagatt

SEQ ID NO: 2268991 - DNA, 15 bp, Homo sapiens
tctccaggggtgccc

SEQ ID NO: 2268992 - DNA, 17 bp, Homo sapiens
tctccccagtcctcagg

SEQ ID NO: 2268993 - DNA, 15 bp, Homo sapiens
tctcctgcagtggat

SEQ ID NO: 2268994 - DNA, 15 bp, Homo sapiens
tctggctcctaccac

SEQ ID NO: 2268995 - DNA, 20 bp, Homo sapiens
tcttaacctcttcttaccct

SEQ ID NO: 2268996 - DNA, 23 bp, Homo sapiens
tcttgcagtggacggagagcctt

SEQ ID NO: 2268997 - DNA, 18 bp, Homo sapiens
tcttttctcccacctcct

SEQ ID NO: 2268998 - DNA, 11 bp, Homo sapiens
tgacttctcca

SEQ ID NO: 2268999 - DNA, 14 bp, Homo sapiens
tgactttgcacctg

SEQ ID NO: 2269000 - DNA, 16 bp, Homo sapiens
tgactttgcacctgca

SEQ ID NO: 2269001 - DNA, 17 bp, Homo sapiens
tgactttgcacctgcaa

SEQ ID NO: 2269002 - DNA, 13 bp, Homo sapiens
tgagcctggcagg

SEQ ID NO: 2269003 - DNA, 17 bp, Homo sapiens
tgagctatgagcccagc

SEQ ID NO: 2269004 - DNA, 19 bp, Homo sapiens
tgagggagaacctctccaa

SEQ ID NO: 2269005 - DNA, 19 bp, Homo sapiens
tgaggtccaaaaaaggctg

SEQ ID NO: 2269006 - DNA, 22 bp, Homo sapiens
tgatcccctgcttctggctcct

SEQ ID NO: 2269007 - DNA, 18 bp, Homo sapiens
tgatggccaaagcaaagg

SEQ ID NO: 2269008 - DNA, 21 bp, Homo sapiens
tgcaagtgtgttcatccccaa

SEQ ID NO: 2269009 - DNA, 23 bp, Homo sapiens
tgcaccaagcacccactgtgcac

SEQ ID NO: 2269010 - DNA, 17 bp, Homo sapiens
tgcagagttgtgcatgc

SEQ ID NO: 2269011 - DNA, 17 bp, Homo sapiens
tgcagtggacggagagc

SEQ ID NO: 2269012 - DNA, 19 bp, Homo sapiens
tgcagtggacggagagcct

SEQ ID NO: 2269013 - DNA, 14 bp, Homo sapiens
tgccagtcctcctc

SEQ ID NO: 2269014 - DNA, 15 bp, Homo sapiens
tgccagtcctcctca

SEQ ID NO: 2269015 - DNA, 21 bp, Homo sapiens
tgccagtcctcctcaggagaa

SEQ ID NO: 2269016 - DNA, 17 bp, Homo sapiens
tgccctttaagagcacc

SEQ ID NO: 2269017 - DNA, 15 bp, Homo sapiens
tgccggagggagccc

SEQ ID NO: 2269018 - DNA, 21 bp, Homo sapiens
tgcctacgttggtgcaagtgt

SEQ ID NO: 2269019 - DNA, 15 bp, Homo sapiens
tgctgtgctgggtgc

SEQ ID NO: 2269020 - DNA, 17 bp, Homo sapiens
tggacggagagccttgg

SEQ ID NO: 2269021 - DNA, 18 bp, Homo sapiens
tggatagagcagcctgct

SEQ ID NO: 2269022 - DNA, 19 bp, Homo sapiens
tggcaggtcccctgccctg

SEQ ID NO: 2269023 - DNA, 14 bp, Homo sapiens
tgggaggccctggc

SEQ ID NO: 2269024 - DNA, 16 bp, Homo sapiens
tggggacagagaaggt

SEQ ID NO: 2269025 - DNA, 17 bp, Homo sapiens
tggggctggccccatcc

SEQ ID NO: 2269026 - DNA, 16 bp, Homo sapiens
tgtcctcctggcacct

SEQ ID NO: 2269027 - DNA, 22 bp, Homo sapiens
tgtcttgcagtggacggagagc

SEQ ID NO: 2269028 - DNA, 22 bp, Homo sapiens
tgtggatagagcagcctgctgc

SEQ ID NO: 2269029 - DNA, 15 bp, Homo sapiens
ttatttctgcttcct

SEQ ID NO: 2269030 - DNA, 17 bp, Homo sapiens
ttccagcccaacccact

SEQ ID NO: 2269031 - DNA, 19 bp, Homo sapiens
ttctcccacctccttcctc

SEQ ID NO: 2269032 - DNA, 21 bp, Homo sapiens
ttctcccttctgctcccatcc

SEQ ID NO: 2269033 - DNA, 19 bp, Homo sapiens
ttctctccttccctctcca

SEQ ID NO: 2269034 - DNA, 19 bp, Homo sapiens
ttctctgtctgcctctcca

SEQ ID NO: 2269035 - DNA, 22 bp, Homo sapiens
ttctcttttgtcctcacatgca

SEQ ID NO: 2269036 - DNA, 14 bp, Homo sapiens
ttggggctggcccc

SEQ ID NO: 2269037 - DNA, 15 bp, Homo sapiens
tttctcccttctgct

SEQ ID NO: 2269038 - DNA, 13 bp, Homo sapiens
aaaaggctgccct

SEQ ID NO: 2269039 - DNA, 16 bp, Homo sapiens
aaaaggctgccctggg

SEQ ID NO: 2269040 - DNA, 14 bp, Homo sapiens
aacaaaagcccttt

SEQ ID NO: 2269041 - DNA, 23 bp, Homo sapiens
aacagctcccctagacatggcct

SEQ ID NO: 2269042 - DNA, 15 bp, Homo sapiens
aacatcccttacctc

SEQ ID NO: 2269043 - DNA, 12 bp, Homo sapiens
aacccccctccg

SEQ ID NO: 2269044 - DNA, 18 bp, Homo sapiens
aactgggattaagtgaga

SEQ ID NO: 2269045 - DNA, 18 bp, Homo sapiens
aagactcattgctggagg

SEQ ID NO: 2269046 - DNA, 20 bp, Homo sapiens
aagagcacccggtcagtcag

SEQ ID NO: 2269047 - DNA, 16 bp, Homo sapiens
aaggctaagggactgg

SEQ ID NO: 2269048 - DNA, 14 bp, Homo sapiens
aaggctgccctggg

SEQ ID NO: 2269049 - DNA, 21 bp, Homo sapiens
aataaatgctcatttgccaat

SEQ ID NO: 2269050 - DNA, 17 bp, Homo sapiens
aatctttggtggccaaa

SEQ ID NO: 2269051 - DNA, 19 bp, Homo sapiens
aatgacttctccaggcaga

SEQ ID NO: 2269052 - DNA, 14 bp, Homo sapiens
aatttcccccacct

SEQ ID NO: 2269053 - DNA, 18 bp, Homo sapiens
aatttcccccacctgcag

SEQ ID NO: 2269054 - DNA, 19 bp, Homo sapiens
acaatgcctcccagctaga

SEQ ID NO: 2269055 - DNA, 16 bp, Homo sapiens
acagaggcagggcagc

SEQ ID NO: 2269056 - DNA, 23 bp, Homo sapiens
accaggcactaagtctctagcct

SEQ ID NO: 2269057 - DNA, 22 bp, Homo sapiens
acccagagattagcctcccact

SEQ ID NO: 2269058 - DNA, 14 bp, Homo sapiens
accccgtccctcct

SEQ ID NO: 2269059 - DNA, 12 bp, Homo sapiens
acctccttcctc

SEQ ID NO: 2269060 - DNA, 13 bp, Homo sapiens
acctccttcctcc

SEQ ID NO: 2269061 - DNA, 15 bp, Homo sapiens
acgcttgtgaggccc

SEQ ID NO: 2269062 - DNA, 22 bp, Homo sapiens
gtaagagggaaactctggagag

SEQ ID NO: 2269063 - DNA, 23 bp, Homo sapiens
gtaagagggaaactctggagagc

SEQ ID NO: 2269064 - DNA, 13 bp, Homo sapiens
gtaccagctgctg

SEQ ID NO: 2269065 - DNA, 15 bp, Homo sapiens
gtaccagctgctgtg

SEQ ID NO: 2269066 - DNA, 23 bp, Homo sapiens
gtaccagctgctgtgctgggtgc

SEQ ID NO: 2269067 - DNA, 19 bp, Homo sapiens
gtcagaaaccaaagtgacc

SEQ ID NO: 2269068 - DNA, 12 bp, Homo sapiens
gtctgcctctcc

SEQ ID NO: 2269069 - DNA, 18 bp, Homo sapiens
gtgagccctcttgcccag

SEQ ID NO: 2269070 - DNA, 15 bp, Homo sapiens
gtgcatgcccctgag

SEQ ID NO: 2269071 - DNA, 16 bp, Homo sapiens
gtgcgcgcccaggcca

SEQ ID NO: 2269072 - DNA, 19 bp, Homo sapiens
gtggatagagcagcctgct

SEQ ID NO: 2269073 - DNA, 20 bp, Homo sapiens
gtggccaaagatttcctttc

SEQ ID NO: 2269074 - DNA, 22 bp, Homo sapiens
gtgtgccctatcttttctccca

SEQ ID NO: 2269075 - DNA, 21 bp, Homo sapiens
gttgtgcatgcccctgagtgt

SEQ ID NO: 2269076 - DNA, 20 bp, Homo sapiens
taagagggaaactctggaga

SEQ ID NO: 2269077 - DNA, 16 bp, Homo sapiens
taattgtgtcccctct

SEQ ID NO: 2269078 - DNA, 12 bp, Homo sapiens
taggctcctggg

SEQ ID NO: 2269079 - DNA, 14 bp, Homo sapiens
taggctcctgggag

SEQ ID NO: 2269080 - DNA, 22 bp, Homo sapiens
tatccattctctccttccctct

SEQ ID NO: 2269081 - DNA, 16 bp, Homo sapiens
tatctgatcttcctca

SEQ ID NO: 2269082 - DNA, 17 bp, Homo sapiens
tatgtgctatggagagg

SEQ ID NO: 2269083 - DNA, 12 bp, Homo sapiens
tcaactgctctg

SEQ ID NO: 2269084 - DNA, 21 bp, Homo sapiens
tcattgctggaggtagagagg

SEQ ID NO: 2269085 - DNA, 14 bp, Homo sapiens
tccaaagcttcccc

SEQ ID NO: 2269086 - DNA, 15 bp, Homo sapiens
tccaaagcttcccct

SEQ ID NO: 2269087 - DNA, 22 bp, Homo sapiens
tccagagctgtcctcctggcac

SEQ ID NO: 2269088 - DNA, 23 bp, Homo sapiens
tccaggggtgccccagacccaga

SEQ ID NO: 2269089 - DNA, 23 bp, Homo sapiens
tcccacctccttcctcctaccac

SEQ ID NO: 2269090 - DNA, 19 bp, Homo sapiens
tccccaacctgcaataaat

SEQ ID NO: 2269091 - DNA, 16 bp, Homo sapiens
tccccaccccacctca

SEQ ID NO: 2269092 - DNA, 18 bp, Homo sapiens
tcccctagacatggcctc

SEQ ID NO: 2269093 - DNA, 19 bp, Homo sapiens
tccctctccagcctgctgt

SEQ ID NO: 2269094 - DNA, 13 bp, Homo sapiens
tccgcttctcctg

SEQ ID NO: 2269095 - DNA, 15 bp, Homo sapiens
tccgcttctcctgca

SEQ ID NO: 2269096 - DNA, 23 bp, Homo sapiens
tcctcaggagaaggggaagggaa

SEQ ID NO: 2269097 - DNA, 17 bp, Homo sapiens
tcctccccaacctgcaa

SEQ ID NO: 2269098 - DNA, 12 bp, Homo sapiens
tcctcctggcac

SEQ ID NO: 2269099 - DNA, 16 bp, Homo sapiens
tcctggcacctgagtg

SEQ ID NO: 2269100 - DNA, 20 bp, Homo sapiens
tcctgggaggccctggcaga

SEQ ID NO: 2269101 - DNA, 18 bp, Homo sapiens
tcctttctgtggtgaggg

SEQ ID NO: 2269102 - DNA, 19 bp, Homo sapiens
tctatctcacactgcacca

SEQ ID NO: 2269103 - DNA, 12 bp, Homo sapiens
tctccttccctc

SEQ ID NO: 2269104 - DNA, 14 bp, Homo sapiens
tctctgtggcctcc

SEQ ID NO: 2269105 - DNA, 23 bp, Homo sapiens
tctcttttgtcctcacatgcaga

SEQ ID NO: 2269106 - DNA, 18 bp, Homo sapiens
tctggagagcctgcaccc

SEQ ID NO: 2269107 - DNA, 14 bp, Homo sapiens
tctgtctgtatcta

SEQ ID NO: 2269108 - DNA, 19 bp, Homo sapiens
tcttgcagtggacggagag

SEQ ID NO: 2269109 - DNA, 22 bp, Homo sapiens
tgaagggttttgctatttccaa

SEQ ID NO: 2269110 - DNA, 15 bp, Homo sapiens
tgactttgcacctgc

SEQ ID NO: 2269111 - DNA, 23 bp, Homo sapiens
tgagacaaatcctaggctcctgg

SEQ ID NO: 2269112 - DNA, 12 bp, Homo sapiens
tgagcctggcag

SEQ ID NO: 2269113 - DNA, 16 bp, Homo sapiens
tgcaagtgtgcatggc

SEQ ID NO: 2269114 - DNA, 22 bp, Homo sapiens
tgcaataaatccgcttctcctg

SEQ ID NO: 2269115 - DNA, 16 bp, Homo sapiens
tgcagtggacggagag

SEQ ID NO: 2269116 - DNA, 14 bp, Homo sapiens
tgcatggctgggga

SEQ ID NO: 2269117 - DNA, 23 bp, Homo sapiens
tgccctatcttttctcccacctc

SEQ ID NO: 2269118 - DNA, 17 bp, Homo sapiens
tgccctgaggctgtgag

SEQ ID NO: 2269119 - DNA, 16 bp, Homo sapiens
tgccggagggagccct

SEQ ID NO: 2269120 - DNA, 13 bp, Homo sapiens
tgcgcgcccaggc

SEQ ID NO: 2269121 - DNA, 14 bp, Homo sapiens
tgctatggagagga

SEQ ID NO: 2269122 - DNA, 14 bp, Homo sapiens
tgctgtgtgtgccc

SEQ ID NO: 2269123 - DNA, 14 bp, Homo sapiens
tgcttctggctcct

SEQ ID NO: 2269124 - DNA, 14 bp, Homo sapiens
tggcaggtcccctg

SEQ ID NO: 2269125 - DNA, 16 bp, Homo sapiens
tggcagttcctggcat

SEQ ID NO: 2269126 - DNA, 24 bp, Homo sapiens
tggccaaagcaaaggagagtcctg

SEQ ID NO: 2269127 - DNA, 16 bp, Homo sapiens
tggccccccagcgcag

SEQ ID NO: 2269128 - DNA, 20 bp, Homo sapiens
tggctcctaccactggacag

SEQ ID NO: 2269129 - DNA, 13 bp, Homo sapiens
tgggaggccctgg

SEQ ID NO: 2269130 - DNA, 15 bp, Homo sapiens
tggggacaagggctg

SEQ ID NO: 2269131 - DNA, 13 bp, Homo sapiens
tggggctggcccc

SEQ ID NO: 2269132 - DNA, 16 bp, Homo sapiens
tgtcctcacatgcaga

SEQ ID NO: 2269133 - DNA, 14 bp, Homo sapiens
tgtgcatgcccctg

SEQ ID NO: 2269134 - DNA, 22 bp, Homo sapiens
tgtgccaaatgactttgcacct

SEQ ID NO: 2269135 - DNA, 20 bp, Homo sapiens
tgtggatagagcagcctgct

SEQ ID NO: 2269136 - DNA, 14 bp, Homo sapiens
tgtgggtgccagtc

SEQ ID NO: 2269137 - DNA, 13 bp, Homo sapiens
tgtggtgagggag

SEQ ID NO: 2269138 - DNA, 22 bp, Homo sapiens
tgttccttctctgtctgcctct

SEQ ID NO: 2269139 - DNA, 22 bp, Homo sapiens
ttcacaagtgagccctcttgcc

SEQ ID NO: 2269140 - DNA, 15 bp, Homo sapiens
ttcccccacctgcag

SEQ ID NO: 2269141 - DNA, 10 bp, Homo sapiens
ttcctggcat

SEQ ID NO: 2269142 - DNA, 15 bp, Homo sapiens
ttctcccttctgctc

SEQ ID NO: 2269143 - DNA, 22 bp, Homo sapiens
ttctcctatctaccttccttca

SEQ ID NO: 2269144 - DNA, 21 bp, Homo sapiens
ttcttggatggcgttctccta

SEQ ID NO: 2269145 - DNA, 16 bp, Homo sapiens
ttgcacctagacactt

SEQ ID NO: 2269146 - DNA, 16 bp, Homo sapiens
ttggcagttcctggca

SEQ ID NO: 2269147 - DNA, 19 bp, Homo sapiens
tttctcccacctccttcct

SEQ ID NO: 2269148 - DNA, 16 bp, Homo sapiens
tttggggctggcccca

SEQ ID NO: 2269149 - DNA, 13 bp, Homo sapiens
tggtttctgccct

SEQ ID NO: 2269150 - DNA, 23 bp, Homo sapiens
tgtaagccctttggggacaaggg

SEQ ID NO: 2269151 - DNA, 19 bp, Homo sapiens
tgtaccagctgctgtgctg

SEQ ID NO: 2269152 - DNA, 17 bp, Homo sapiens
tgtcccatactcccact

SEQ ID NO: 2269153 - DNA, 13 bp, Homo sapiens
tgtcctcacatgc

SEQ ID NO: 2269154 - DNA, 14 bp, Homo sapiens
tgtcctcctggcac

SEQ ID NO: 2269155 - DNA, 22 bp, Homo sapiens
tgtgaggcccgaggcagaaggg

SEQ ID NO: 2269156 - DNA, 16 bp, Homo sapiens
tgtgctatggagagga

SEQ ID NO: 2269157 - DNA, 20 bp, Homo sapiens
tgtggtgagggagaacctct

SEQ ID NO: 2269158 - DNA, 15 bp, Homo sapiens
ttatctgatcttcct

SEQ ID NO: 2269159 - DNA, 23 bp, Homo sapiens
ttgatggccaaagcaaaggagag

SEQ ID NO: 2269160 - DNA, 17 bp, Homo sapiens
ttggcagttcctggcat

SEQ ID NO: 2269161 - DNA, 22 bp, Homo sapiens
tttctcccacctccttcctcct

SEQ ID NO: 2269162 - DNA, 21 bp, Homo sapiens
aaaaaataacatattcttgct

SEQ ID NO: 2269163 - DNA, 13 bp, Homo sapiens
aaaaaatgaatag

SEQ ID NO: 2269164 - DNA, 11 bp, Homo sapiens
aaaaaatgtca

SEQ ID NO: 2269165 - DNA, 22 bp, Homo sapiens
aaaaacactggattcatttcat

SEQ ID NO: 2269166 - DNA, 14 bp, Homo sapiens
aagaggatgtggtt

SEQ ID NO: 2269167 - DNA, 16 bp, Homo sapiens
aagaggcattcagcaa

SEQ ID NO: 2269168 - DNA, 19 bp, Homo sapiens
aagaggggtataggacaag

SEQ ID NO: 2269169 - DNA, 15 bp, Homo sapiens
aagaggtccattaat

SEQ ID NO: 2269170 - DNA, 21 bp, Homo sapiens
aagagtacaggtcttctttaa

SEQ ID NO: 2269171 - DNA, 16 bp, Homo sapiens
aagataaatgctttaa

SEQ ID NO: 2269172 - DNA, 21 bp, Homo sapiens
aagataaatgctttaaatagt

SEQ ID NO: 2269173 - DNA, 22 bp, Homo sapiens
aagatacaagaaaaagtagaaa

SEQ ID NO: 2269174 - DNA, 20 bp, Homo sapiens
aagatactgtatatgtcaaa

SEQ ID NO: 2269175 - DNA, 15 bp, Homo sapiens
aagatagcagaagag

SEQ ID NO: 2269176 - DNA, 21 bp, Homo sapiens
aagataggaagaaaatttcct

SEQ ID NO: 2269177 - DNA, 18 bp, Homo sapiens
aagatctcagataaagtg

SEQ ID NO: 2269178 - DNA, 19 bp, Homo sapiens
aagatctcagataaagtga

SEQ ID NO: 2269179 - DNA, 15 bp, Homo sapiens
aagatggttcaaaga

SEQ ID NO: 2269180 - DNA, 16 bp, Homo sapiens
aagatggttcaaagat

SEQ ID NO: 2269181 - DNA, 17 bp, Homo sapiens
aagatggttcaaagata

SEQ ID NO: 2269182 - DNA, 19 bp, Homo sapiens
aagatggttcaaagataca

SEQ ID NO: 2269183 - DNA, 24 bp, Homo sapiens
aagatggttcaaagatacaagaaa

SEQ ID NO: 2269184 - DNA, 18 bp, Homo sapiens
aagatgtgacatgtttta

SEQ ID NO: 2269185 - DNA, 22 bp, Homo sapiens
aagatgtgtaaataagcgttta

SEQ ID NO: 2269186 - DNA, 14 bp, Homo sapiens
aagatgtttttaga

SEQ ID NO: 2269187 - DNA, 15 bp, Homo sapiens
aagatgtttttagag

SEQ ID NO: 2269188 - DNA, 17 bp, Homo sapiens
aagattaaaattagtga

SEQ ID NO: 2269189 - DNA, 12 bp, Homo sapiens
aagattctaaaa

SEQ ID NO: 2269190 - DNA, 22 bp, Homo sapiens
aagcaaaaaacttcaacatgca

SEQ ID NO: 2269191 - DNA, 18 bp, Homo sapiens
aagcaatactgccgctgc

SEQ ID NO: 2269192 - DNA, 18 bp, Homo sapiens
aagcacaaactgtcgtct

SEQ ID NO: 2269193 - DNA, 17 bp, Homo sapiens
aagcactaccagtatct

SEQ ID NO: 2269194 - DNA, 15 bp, Homo sapiens
aagcagtgcatgctg

SEQ ID NO: 2269195 - DNA, 19 bp, Homo sapiens
aagcagttgcaatgatcag

SEQ ID NO: 2269196 - DNA, 21 bp, Homo sapiens
aagcagttgcaatgatcagac

SEQ ID NO: 2269197 - DNA, 18 bp, Homo sapiens
aagcatcatggatcaacc

SEQ ID NO: 2269198 - DNA, 23 bp, Homo sapiens
aagcattctgtgcataaaagtta

SEQ ID NO: 2269199 - DNA, 19 bp, Homo sapiens
aagccaaacattcttattt

SEQ ID NO: 2269200 - DNA, 19 bp, Homo sapiens
aagccaaccactttcacct

SEQ ID NO: 2269201 - DNA, 15 bp, Homo sapiens
aagccaatgtgaatt

SEQ ID NO: 2269202 - DNA, 15 bp, Homo sapiens
aagccacgttgcaga

SEQ ID NO: 2269203 - DNA, 12 bp, Homo sapiens
aagccagagccg

SEQ ID NO: 2269204 - DNA, 10 bp, Homo sapiens
aagcccaccc

SEQ ID NO: 2269205 - DNA, 15 bp, Homo sapiens
aagcgaacaaaaagt

SEQ ID NO: 2269206 - DNA, 18 bp, Homo sapiens
aagcgatcctccttcctc

SEQ ID NO: 2269207 - DNA, 23 bp, Homo sapiens
aagctcaactgttgccaggagat

SEQ ID NO: 2269208 - DNA, 12 bp, Homo sapiens
aagctgaagatc

SEQ ID NO: 2269209 - DNA, 15 bp, Homo sapiens
aagctggcaggagac

SEQ ID NO: 2269210 - DNA, 13 bp, Homo sapiens
aagcttatttcta

SEQ ID NO: 2269211 - DNA, 13 bp, Homo sapiens
aagctttaacaga

SEQ ID NO: 2269212 - DNA, 14 bp, Homo sapiens
aagctttaacagac

SEQ ID NO: 2269213 - DNA, 21 bp, Homo sapiens
aagctttagattgaaatttat

SEQ ID NO: 2269214 - DNA, 22 bp, Homo sapiens
aagctttcctgtttccagggtc

SEQ ID NO: 2269215 - DNA, 20 bp, Homo sapiens
aagctttcttacaatgtgga

SEQ ID NO: 2269216 - DNA, 20 bp, Homo sapiens
aaggaaaagagaaacactaa

SEQ ID NO: 2269217 - DNA, 22 bp, Homo sapiens
aaggaagaataaaaaagaagag

SEQ ID NO: 2269218 - DNA, 17 bp, Homo sapiens
aaggaagagccagccgt

SEQ ID NO: 2269219 - DNA, 16 bp, Homo sapiens
aaggaaggacatttcc

SEQ ID NO: 2269220 - DNA, 23 bp, Homo sapiens
aaggaatgattaattaaaacaca

SEQ ID NO: 2269221 - DNA, 16 bp, Homo sapiens
aaggagacagaatgag

SEQ ID NO: 2269222 - DNA, 22 bp, Homo sapiens
aaggagcactagaatgagaaat

SEQ ID NO: 2269223 - DNA, 12 bp, Homo sapiens
aaggatcctgag

SEQ ID NO: 2269224 - DNA, 13 bp, Homo sapiens
aaggatcctgagc

SEQ ID NO: 2269225 - DNA, 14 bp, Homo sapiens
aaggatcctgagcc

SEQ ID NO: 2269226 - DNA, 22 bp, Homo sapiens
aaggatgggggctcctggcagt

SEQ ID NO: 2269227 - DNA, 22 bp, Homo sapiens
aaggattcttttttcaatgtac

SEQ ID NO: 2269228 - DNA, 12 bp, Homo sapiens
aaggatttgaaa

SEQ ID NO: 2269229 - DNA, 22 bp, Homo sapiens
aaggatttgaaaacaccaagag

SEQ ID NO: 2269230 - DNA, 19 bp, Homo sapiens
aaggcaaagtaaaattaga

SEQ ID NO: 2269231 - DNA, 15 bp, Homo sapiens
aaggcaaagtttcca

SEQ ID NO: 2269232 - DNA, 15 bp, Homo sapiens
aaggcaaggctgtca

SEQ ID NO: 2269233 - DNA, 16 bp, Homo sapiens
aaggcaaggctgtcaa

SEQ ID NO: 2269234 - DNA, 17 bp, Homo sapiens
aaggcaaggctgtcaat

SEQ ID NO: 2269235 - DNA, 17 bp, Homo sapiens
aaggcacaggtgtaaat

SEQ ID NO: 2269236 - DNA, 15 bp, Homo sapiens
aaggcaccagcaaat

SEQ ID NO: 2269237 - DNA, 23 bp, Homo sapiens
aaggcctgagggaagcccacccg

SEQ ID NO: 2269238 - DNA, 14 bp, Homo sapiens
aaggctgccctgtc

SEQ ID NO: 2269239 - DNA, 23 bp, Homo sapiens
aagggacggggcccgccccaggc

SEQ ID NO: 2269240 - DNA, 16 bp, Homo sapiens
aagggaggggaagaga

SEQ ID NO: 2269241 - DNA, 20 bp, Homo sapiens
aagggaggggaagagagagg

SEQ ID NO: 2269242 - DNA, 19 bp, Homo sapiens
aagggagtaggctgtattt

SEQ ID NO: 2269243 - DNA, 14 bp, Homo sapiens
aagggatccagaga

SEQ ID NO: 2269244 - DNA, 15 bp, Homo sapiens
aagggatccagagac

SEQ ID NO: 2269245 - DNA, 22 bp, Homo sapiens
aagggatccagagacctgctcc

SEQ ID NO: 2269246 - DNA, 12 bp, Homo sapiens
aagggcaggcct

SEQ ID NO: 2269247 - DNA, 15 bp, Homo sapiens
aagggcgggcctgtt

SEQ ID NO: 2269248 - DNA, 19 bp, Homo sapiens
aagggctatgcctccattt

SEQ ID NO: 2269249 - DNA, 14 bp, Homo sapiens
aagggctttaaata

SEQ ID NO: 2269250 - DNA, 18 bp, Homo sapiens
aagggctttaaataaaag

SEQ ID NO: 2269251 - DNA, 20 bp, Homo sapiens
aagggctttaaataaaagag

SEQ ID NO: 2269252 - DNA, 21 bp, Homo sapiens
aaggggatcataaagttagaa

SEQ ID NO: 2269253 - DNA, 16 bp, Homo sapiens
aaggggccaggaaggg

SEQ ID NO: 2269254 - DNA, 21 bp, Homo sapiens
aaggggccaggaaggggacag

SEQ ID NO: 2269255 - DNA, 18 bp, Homo sapiens
aaggggtcccatcagtga

SEQ ID NO: 2269256 - DNA, 14 bp, Homo sapiens
aaggggtggaaggg

SEQ ID NO: 2269257 - DNA, 17 bp, Homo sapiens
aaggggtggaagggcag

SEQ ID NO: 2269258 - DNA, 19 bp, Homo sapiens
aagggtaaattataaatgt

SEQ ID NO: 2269259 - DNA, 14 bp, Homo sapiens
aagggtgggccctg

SEQ ID NO: 2269260 - DNA, 16 bp, Homo sapiens
aagggtgggccctgga

SEQ ID NO: 2269261 - DNA, 20 bp, Homo sapiens
aaggtaacttctcccttctc

SEQ ID NO: 2269262 - DNA, 14 bp, Homo sapiens
aaggtcacctcact

SEQ ID NO: 2269263 - DNA, 12 bp, Homo sapiens
aaggtcatctca

SEQ ID NO: 2269264 - DNA, 14 bp, Homo sapiens
aaggtgtttcaaag

SEQ ID NO: 2269265 - DNA, 15 bp, Homo sapiens
aagtaagttctgaaa

SEQ ID NO: 2269266 - DNA, 15 bp, Homo sapiens
aagtactggagaaaa

SEQ ID NO: 2269267 - DNA, 18 bp, Homo sapiens
aagtagaaaaaaaaataa

SEQ ID NO: 2269268 - DNA, 22 bp, Homo sapiens
aagtatctctactttcctgatg

SEQ ID NO: 2269269 - DNA, 21 bp, Homo sapiens
aagtatgaaccacatggaact

SEQ ID NO: 2269270 - DNA, 22 bp, Homo sapiens
aagtatgaaccacatggaactt

SEQ ID NO: 2269271 - DNA, 18 bp, Homo sapiens
aagtattttatctgtgtt

SEQ ID NO: 2269272 - DNA, 19 bp, Homo sapiens
aagtcatgggagaagaggg

SEQ ID NO: 2269273 - DNA, 17 bp, Homo sapiens
aagtccagctctcccct

SEQ ID NO: 2269274 - DNA, 17 bp, Homo sapiens
aagtcccatctcacctc

SEQ ID NO: 2269275 - DNA, 11 bp, Homo sapiens
aagtccctgag

SEQ ID NO: 2269276 - DNA, 22 bp, Homo sapiens
aagtccgaggcctggctctgga

SEQ ID NO: 2269277 - DNA, 23 bp, Homo sapiens
aagtccgaggcctggctctggag

SEQ ID NO: 2269278 - DNA, 20 bp, Homo sapiens
aagtccttagaatgagggaa

SEQ ID NO: 2269279 - DNA, 14 bp, Homo sapiens
aagtctgctgctgt

SEQ ID NO: 2269280 - DNA, 16 bp, Homo sapiens
aagtgaggatgaaaaa

SEQ ID NO: 2269281 - DNA, 11 bp, Homo sapiens
aagtgctggga

SEQ ID NO: 2269282 - DNA, 22 bp, Homo sapiens
aagtgctgggattacaggtgtg

SEQ ID NO: 2269283 - DNA, 12 bp, Homo sapiens
aagtgcttcctt

SEQ ID NO: 2269284 - DNA, 15 bp, Homo sapiens
aagtgtacaattttc

SEQ ID NO: 2269285 - DNA, 14 bp, Homo sapiens
aagtgtacatttga

SEQ ID NO: 2269286 - DNA, 18 bp, Homo sapiens
aagtgtgctgtgacaagc

SEQ ID NO: 2269287 - DNA, 16 bp, Homo sapiens
aagtgtgtgtttcttg

SEQ ID NO: 2269288 - DNA, 20 bp, Homo sapiens
aagtgttgtaccatatgtag

SEQ ID NO: 2269289 - DNA, 20 bp, Homo sapiens
aagtgtttttctttaatcaa

SEQ ID NO: 2269290 - DNA, 23 bp, Homo sapiens
aagtgtttttctttaatcaaaag

SEQ ID NO: 2269291 - DNA, 16 bp, Homo sapiens
aagttaaagagacaaa

SEQ ID NO: 2269292 - DNA, 17 bp, Homo sapiens
aagttaaagagacaaat

SEQ ID NO: 2269293 - DNA, 19 bp, Homo sapiens
aagttacacggggttacac

SEQ ID NO: 2269294 - DNA, 19 bp, Homo sapiens
aagttatgtgttaaattta

SEQ ID NO: 2269295 - DNA, 22 bp, Homo sapiens
aagttatgtgttaaatttagtg

SEQ ID NO: 2269296 - DNA, 13 bp, Homo sapiens
aagttatttgtct

SEQ ID NO: 2269297 - DNA, 14 bp, Homo sapiens
aagttctattatct

SEQ ID NO: 2269298 - DNA, 16 bp, Homo sapiens
aagttctattatctgg

SEQ ID NO: 2269299 - DNA, 18 bp, Homo sapiens
aagttctgaaaactgttt

SEQ ID NO: 2269300 - DNA, 15 bp, Homo sapiens
aagttgaagggaaat

SEQ ID NO: 2269301 - DNA, 17 bp, Homo sapiens
aagttgatctccccagc

SEQ ID NO: 2269302 - DNA, 22 bp, Homo sapiens
aaaaaccattataaaatctttc

SEQ ID NO: 2269303 - DNA, 15 bp, Homo sapiens
aaaaactgatttttt

SEQ ID NO: 2269304 - DNA, 13 bp, Homo sapiens
aaaaagatactgt

SEQ ID NO: 2269305 - DNA, 18 bp, Homo sapiens
aaaaaggcctaatgcatt

SEQ ID NO: 2269306 - DNA, 19 bp, Homo sapiens
aaaaagtggaatttcttgt

SEQ ID NO: 2269307 - DNA, 11 bp, Homo sapiens
aaaaatatttt

SEQ ID NO: 2269308 - DNA, 20 bp, Homo sapiens
aaaaatgtatccagtctgaa

SEQ ID NO: 2269309 - DNA, 19 bp, Homo sapiens
aaaaattacattatgccct

SEQ ID NO: 2269310 - DNA, 21 bp, Homo sapiens
aaaaattctagtctgtttcat

SEQ ID NO: 2269311 - DNA, 18 bp, Homo sapiens
aaaacagaccagcatagt

SEQ ID NO: 2269312 - DNA, 14 bp, Homo sapiens
aaaacataagacga

SEQ ID NO: 2269313 - DNA, 14 bp, Homo sapiens
aaaacataatatct

SEQ ID NO: 2269314 - DNA, 16 bp, Homo sapiens
aaaacgtggctgcttc

SEQ ID NO: 2269315 - DNA, 15 bp, Homo sapiens
aaaactgatttccca

SEQ ID NO: 2269316 - DNA, 18 bp, Homo sapiens
aaaactgatttttttttc

SEQ ID NO: 2269317 - DNA, 12 bp, Homo sapiens
aaaactgtttat

SEQ ID NO: 2269318 - DNA, 20 bp, Homo sapiens
aaaacttataatttccaaac

SEQ ID NO: 2269319 - DNA, 14 bp, Homo sapiens
aaaagaagaaagtc

SEQ ID NO: 2269320 - DNA, 15 bp, Homo sapiens
aaaagaggtccatta

SEQ ID NO: 2269321 - DNA, 13 bp, Homo sapiens
aaaagcccaacct

SEQ ID NO: 2269322 - DNA, 15 bp, Homo sapiens
aaaagcccaacctct

SEQ ID NO: 2269323 - DNA, 20 bp, Homo sapiens
aaaagctgaaattctcagaa

SEQ ID NO: 2269324 - DNA, 19 bp, Homo sapiens
aaaagctttagattgaaat

SEQ ID NO: 2269325 - DNA, 20 bp, Homo sapiens
aaaaggcctaatgcattatt

SEQ ID NO: 2269326 - DNA, 19 bp, Homo sapiens
aaaaggctggatgtgcttt

SEQ ID NO: 2269327 - DNA, 16 bp, Homo sapiens
aaaataaaataaatta

SEQ ID NO: 2269328 - DNA, 20 bp, Homo sapiens
aaaataacatattcttgctt

SEQ ID NO: 2269329 - DNA, 13 bp, Homo sapiens
aaaataaccaaaa

SEQ ID NO: 2269330 - DNA, 16 bp, Homo sapiens
aaaataattagctata

SEQ ID NO: 2269331 - DNA, 15 bp, Homo sapiens
aaaatactcaccaaa

SEQ ID NO: 2269332 - DNA, 15 bp, Homo sapiens
aaaatagaatatata

SEQ ID NO: 2269333 - DNA, 19 bp, Homo sapiens
aaaatagcaaaatattatc

SEQ ID NO: 2269334 - DNA, 13 bp, Homo sapiens
aaaatagctttta

SEQ ID NO: 2269335 - DNA, 22 bp, Homo sapiens
aaaatagtcatgtttctgcagt

SEQ ID NO: 2269336 - DNA, 15 bp, Homo sapiens
aaaatagttctattt

SEQ ID NO: 2269337 - DNA, 12 bp, Homo sapiens
aaaatagttttc

SEQ ID NO: 2269338 - DNA, 13 bp, Homo sapiens
aaaatagttttct

SEQ ID NO: 2269339 - DNA, 15 bp, Homo sapiens
aaaatagttttctaa

SEQ ID NO: 2269340 - DNA, 23 bp, Homo sapiens
aaaatagttttctaaatgtttct

SEQ ID NO: 2269341 - DNA, 15 bp, Homo sapiens
aaaatattctgtcat

SEQ ID NO: 2269342 - DNA, 12 bp, Homo sapiens
aaaatattgtgt

SEQ ID NO: 2269343 - DNA, 20 bp, Homo sapiens
aaaatattgtgtaagaatca

SEQ ID NO: 2269344 - DNA, 13 bp, Homo sapiens
aaaatatttctaa

SEQ ID NO: 2269345 - DNA, 20 bp, Homo sapiens
aaaatatttctaagcttatt

SEQ ID NO: 2269346 - DNA, 21 bp, Homo sapiens
aaaatatttctaagcttattt

SEQ ID NO: 2269347 - DNA, 23 bp, Homo sapiens
aaaatatttctaagcttatttct

SEQ ID NO: 2269348 - DNA, 14 bp, Homo sapiens
aaaatgaactgtat

SEQ ID NO: 2269349 - DNA, 13 bp, Homo sapiens
aaaatgctttctc

SEQ ID NO: 2269350 - DNA, 14 bp, Homo sapiens
aaaatgctttctca

SEQ ID NO: 2269351 - DNA, 15 bp, Homo sapiens
aaaatgctttctcat

SEQ ID NO: 2269352 - DNA, 16 bp, Homo sapiens
aaaatgttaacaactt

SEQ ID NO: 2269353 - DNA, 15 bp, Homo sapiens
aaaatgtttacattt

SEQ ID NO: 2269354 - DNA, 19 bp, Homo sapiens
aaaatgtttacattttctt

SEQ ID NO: 2269355 - DNA, 12 bp, Homo sapiens
aaaattctagtc

SEQ ID NO: 2269356 - DNA, 20 bp, Homo sapiens
aaaattctagtctctgattt

SEQ ID NO: 2269357 - DNA, 21 bp, Homo sapiens
aaaatttaattgtgtaactgt

SEQ ID NO: 2269358 - DNA, 23 bp, Homo sapiens
aaaatttaattgtgtaactgttc

SEQ ID NO: 2269359 - DNA, 14 bp, Homo sapiens
aaacaaaaatagaa

SEQ ID NO: 2269360 - DNA, 15 bp, Homo sapiens
aaacaacagaaactt

SEQ ID NO: 2269361 - DNA, 21 bp, Homo sapiens
aaacaactgccaaataaaatg

SEQ ID NO: 2269362 - DNA, 23 bp, Homo sapiens
aaacaactgccaaataaaatgtt

SEQ ID NO: 2269363 - DNA, 21 bp, Homo sapiens
aaacaagtctcattagctctc

SEQ ID NO: 2269364 - DNA, 20 bp, Homo sapiens
aaacaatttagccagaatgt

SEQ ID NO: 2269365 - DNA, 23 bp, Homo sapiens
aaacacccaagcacaaactgtcg

SEQ ID NO: 2269366 - DNA, 23 bp, Homo sapiens
aaacaccttcttattatatatat

SEQ ID NO: 2269367 - DNA, 22 bp, Homo sapiens
aaacactgcttaaggaaaagag

SEQ ID NO: 2269368 - DNA, 23 bp, Homo sapiens
aaacagtccaaactgttctgaga

SEQ ID NO: 2269369 - DNA, 18 bp, Homo sapiens
aaacataaaatatacaaa

SEQ ID NO: 2269370 - DNA, 22 bp, Homo sapiens
aaacatgtggcaacctgttctt

SEQ ID NO: 2269371 - DNA, 17 bp, Homo sapiens
aaacattctttaacata

SEQ ID NO: 2269372 - DNA, 19 bp, Homo sapiens
aaacattctttaacataca

SEQ ID NO: 2269373 - DNA, 18 bp, Homo sapiens
aaacattgagactgctag

SEQ ID NO: 2269374 - DNA, 23 bp, Homo sapiens
aaacattgagactgctagaacca

SEQ ID NO: 2269375 - DNA, 20 bp, Homo sapiens
aaacatttctttttccttct

SEQ ID NO: 2269376 - DNA, 19 bp, Homo sapiens
aaacattttaaaatcaact

SEQ ID NO: 2269377 - DNA, 17 bp, Homo sapiens
aaaccataaaataaata

SEQ ID NO: 2269378 - DNA, 18 bp, Homo sapiens
aaaccatcattgaaatct

SEQ ID NO: 2269379 - DNA, 19 bp, Homo sapiens
aaaccatcatttaatttct

SEQ ID NO: 2269380 - DNA, 13 bp, Homo sapiens
aaacctgtgcttt

SEQ ID NO: 2269381 - DNA, 22 bp, Homo sapiens
aaaccttctatgttcataaaaa

SEQ ID NO: 2269382 - DNA, 14 bp, Homo sapiens
aaacgatatatgta

SEQ ID NO: 2269383 - DNA, 17 bp, Homo sapiens
aaacgatatatgtaaat

SEQ ID NO: 2269384 - DNA, 17 bp, Homo sapiens
aaacgtggctgcttcaa

SEQ ID NO: 2269385 - DNA, 20 bp, Homo sapiens
aaacgtggctgcttcaagga

SEQ ID NO: 2269386 - DNA, 16 bp, Homo sapiens
aaactaaaatagttta

SEQ ID NO: 2269387 - DNA, 18 bp, Homo sapiens
aaactatcggttcaagtt

SEQ ID NO: 2269388 - DNA, 22 bp, Homo sapiens
aaactcagtctcaaataataat

SEQ ID NO: 2269389 - DNA, 18 bp, Homo sapiens
aaactgatgtatagcttt

SEQ ID NO: 2269390 - DNA, 21 bp, Homo sapiens
aaactgatgtatagctttaac

SEQ ID NO: 2269391 - DNA, 23 bp, Homo sapiens
aaactgatgtatagctttaacat

SEQ ID NO: 2269392 - DNA, 14 bp, Homo sapiens
aaactgatttccca

SEQ ID NO: 2269393 - DNA, 22 bp, Homo sapiens
aaactgatttttttttccttca

SEQ ID NO: 2269394 - DNA, 21 bp, Homo sapiens
aaactggttttaagtgctttc

SEQ ID NO: 2269395 - DNA, 20 bp, Homo sapiens
aaactgtcgtctttttccaa

SEQ ID NO: 2269396 - DNA, 14 bp, Homo sapiens
aaactgttttcatg

SEQ ID NO: 2269397 - DNA, 23 bp, Homo sapiens
aaactgttttgggtagctgccac

SEQ ID NO: 2269398 - DNA, 14 bp, Homo sapiens
aaacttataatttc

SEQ ID NO: 2269399 - DNA, 16 bp, Homo sapiens
aaacttgaacaagaaa

SEQ ID NO: 2269400 - DNA, 17 bp, Homo sapiens
aaactttcctgtactca

SEQ ID NO: 2269401 - DNA, 13 bp, Homo sapiens
aaacttttggcaa

SEQ ID NO: 2269402 - DNA, 16 bp, Homo sapiens
aaagaaacactttctt

SEQ ID NO: 2269403 - DNA, 22 bp, Homo sapiens
aaagaaatattaatatgtactt

SEQ ID NO: 2269404 - DNA, 15 bp, Homo sapiens
aaagaatgaaaacaa

SEQ ID NO: 2269405 - DNA, 14 bp, Homo sapiens
aaagaatgtacaga

SEQ ID NO: 2269406 - DNA, 16 bp, Homo sapiens
aaagaatgtacagaaa

SEQ ID NO: 2269407 - DNA, 17 bp, Homo sapiens
aaagaatgttttggaat

SEQ ID NO: 2269408 - DNA, 13 bp, Homo sapiens
aaagaatttgaaa

SEQ ID NO: 2269409 - DNA, 15 bp, Homo sapiens
aaagacatttaaaat

SEQ ID NO: 2269410 - DNA, 15 bp, Homo sapiens
aaagacatttcatcc

SEQ ID NO: 2269411 - DNA, 18 bp, Homo sapiens
aaagacttaatcatatca

SEQ ID NO: 2269412 - DNA, 15 bp, Homo sapiens
aaagagaaaatgctt

SEQ ID NO: 2269413 - DNA, 14 bp, Homo sapiens
aaagagttgagcac

SEQ ID NO: 2269414 - DNA, 19 bp, Homo sapiens
aaagatagcagaagagtag

SEQ ID NO: 2269415 - DNA, 18 bp, Homo sapiens
aaagatgcttaaaaacct

SEQ ID NO: 2269416 - DNA, 20 bp, Homo sapiens
aaagatggcgcacccggcag

SEQ ID NO: 2269417 - DNA, 20 bp, Homo sapiens
aaagatgtccttggagatga

SEQ ID NO: 2269418 - DNA, 22 bp, Homo sapiens
aaagcagtcagcggagaggacc

SEQ ID NO: 2269419 - DNA, 15 bp, Homo sapiens
aaagcccaacctctt

SEQ ID NO: 2269420 - DNA, 19 bp, Homo sapiens
aaagctgaaattctcagaa

SEQ ID NO: 2269421 - DNA, 22 bp, Homo sapiens
aaagctgaaattctcagaatta

SEQ ID NO: 2269422 - DNA, 14 bp, Homo sapiens
aaagctgctatcca

SEQ ID NO: 2269423 - DNA, 22 bp, Homo sapiens
aaagctgtggctcaacacatga

SEQ ID NO: 2269424 - DNA, 22 bp, Homo sapiens
aaagcttgccactttccagcct

SEQ ID NO: 2269425 - DNA, 21 bp, Homo sapiens
aaagctttagattgaaattta

SEQ ID NO: 2269426 - DNA, 23 bp, Homo sapiens
aaagctttagattgaaatttatg

SEQ ID NO: 2269427 - DNA, 13 bp, Homo sapiens
aaagggcgggcct

SEQ ID NO: 2269428 - DNA, 16 bp, Homo sapiens
aaaggtcacctcactc

SEQ ID NO: 2269429 - DNA, 24 bp, Homo sapiens
aaaggtcacctcactcagcaccac

SEQ ID NO: 2269430 - DNA, 14 bp, Homo sapiens
aaagtaaaattaga

SEQ ID NO: 2269431 - DNA, 21 bp, Homo sapiens
aaagtaatgtatatctgtaat

SEQ ID NO: 2269432 - DNA, 22 bp, Homo sapiens
aaagtcattcagttatcactac

SEQ ID NO: 2269433 - DNA, 18 bp, Homo sapiens
aaagtggaatttcttgtt

SEQ ID NO: 2269434 - DNA, 19 bp, Homo sapiens
aaagtggaatttcttgttt

SEQ ID NO: 2269435 - DNA, 14 bp, Homo sapiens
aaagtgtacaattt

SEQ ID NO: 2269436 - DNA, 17 bp, Homo sapiens
aaagtgtacaattttca

SEQ ID NO: 2269437 - DNA, 20 bp, Homo sapiens
aaagtgtacaattttcatcc

SEQ ID NO: 2269438 - DNA, 19 bp, Homo sapiens
aaagtgtcactaagaatat

SEQ ID NO: 2269439 - DNA, 13 bp, Homo sapiens
aaagttaacatta

SEQ ID NO: 2269440 - DNA, 15 bp, Homo sapiens
aaagttagaatctat

SEQ ID NO: 2269441 - DNA, 18 bp, Homo sapiens
aaagttagaatctatttt

SEQ ID NO: 2269442 - DNA, 19 bp, Homo sapiens
aaagttagaatctattttc

SEQ ID NO: 2269443 - DNA, 22 bp, Homo sapiens
aaagttagggcatttttcttgg

SEQ ID NO: 2269444 - DNA, 20 bp, Homo sapiens
aaagttctattatctgggtt

SEQ ID NO: 2269445 - DNA, 21 bp, Homo sapiens
aaagttctattatctgggttt

SEQ ID NO: 2269446 - DNA, 15 bp, Homo sapiens
aaataaaaataattg

SEQ ID NO: 2269447 - DNA, 14 bp, Homo sapiens
aaataaaaatattc

SEQ ID NO: 2269448 - DNA, 13 bp, Homo sapiens
aaataaaacaatg

SEQ ID NO: 2269449 - DNA, 14 bp, Homo sapiens
aaataaaataaatt

SEQ ID NO: 2269450 - DNA, 17 bp, Homo sapiens
aaataaaatgtttacat

SEQ ID NO: 2269451 - DNA, 22 bp, Homo sapiens
aaataaaatgtttacattttct

SEQ ID NO: 2269452 - DNA, 16 bp, Homo sapiens
aaataaataatctcat

SEQ ID NO: 2269453 - DNA, 12 bp, Homo sapiens
aaataaatctaa

SEQ ID NO: 2269454 - DNA, 15 bp, Homo sapiens
aaataataatattta

SEQ ID NO: 2269455 - DNA, 20 bp, Homo sapiens
aaataatgattcaatgtgaa

SEQ ID NO: 2269456 - DNA, 13 bp, Homo sapiens
aaataatgattta

SEQ ID NO: 2269457 - DNA, 22 bp, Homo sapiens
aaataatgcttaacataaactt

SEQ ID NO: 2269458 - DNA, 22 bp, Homo sapiens
aaatacataaaagaatgtacag

SEQ ID NO: 2269459 - DNA, 18 bp, Homo sapiens
aaatactcaccaaaatat

SEQ ID NO: 2269460 - DNA, 19 bp, Homo sapiens
aaatactcaccaaaatata

SEQ ID NO: 2269461 - DNA, 12 bp, Homo sapiens
aaatagaatata

SEQ ID NO: 2269462 - DNA, 14 bp, Homo sapiens
aaatagaatatata

SEQ ID NO: 2269463 - DNA, 17 bp, Homo sapiens
aaatagaatatataaac

SEQ ID NO: 2269464 - DNA, 20 bp, Homo sapiens
aaatagtcatacgtctttag

SEQ ID NO: 2269465 - DNA, 23 bp, Homo sapiens
aaatagtcatacgtctttagatg

SEQ ID NO: 2269466 - DNA, 19 bp, Homo sapiens
aaatagtcctccaaaacac

SEQ ID NO: 2269467 - DNA, 20 bp, Homo sapiens
aaatagtgttgatcagatct

SEQ ID NO: 2269468 - DNA, 16 bp, Homo sapiens
aaatagtttaaaaata

SEQ ID NO: 2269469 - DNA, 19 bp, Homo sapiens
aaatagtttaaaaatattc

SEQ ID NO: 2269470 - DNA, 17 bp, Homo sapiens
aaatagtttcaaatgag

SEQ ID NO: 2269471 - DNA, 18 bp, Homo sapiens
aaatagttttacattaac

SEQ ID NO: 2269472 - DNA, 14 bp, Homo sapiens
aaatagttttctaa

SEQ ID NO: 2269473 - DNA, 15 bp, Homo sapiens
aaatagttttctaaa

SEQ ID NO: 2269474 - DNA, 14 bp, Homo sapiens
aaatataaaataca

SEQ ID NO: 2269475 - DNA, 20 bp, Homo sapiens
aaatataaacttgtgtatga

SEQ ID NO: 2269476 - DNA, 20 bp, Homo sapiens
aaatatacaaacatgtggca

SEQ ID NO: 2269477 - DNA, 13 bp, Homo sapiens
aaatatacagcat

SEQ ID NO: 2269478 - DNA, 20 bp, Homo sapiens
aaatatacagcatgagattg

SEQ ID NO: 2269479 - DNA, 13 bp, Homo sapiens
aaatatatatata

SEQ ID NO: 2269480 - DNA, 22 bp, Homo sapiens
aaatatgaaaagtcattcagtt

SEQ ID NO: 2269481 - DNA, 16 bp, Homo sapiens
aaatatgacagaattt

SEQ ID NO: 2269482 - DNA, 15 bp, Homo sapiens
aaatatgcaacctgt

SEQ ID NO: 2269483 - DNA, 18 bp, Homo sapiens
aaatatgcaacctgtgca

SEQ ID NO: 2269484 - DNA, 20 bp, Homo sapiens
aaatatgcaacctgtgcaaa

SEQ ID NO: 2269485 - DNA, 13 bp, Homo sapiens
aaatattctaaaa

SEQ ID NO: 2269486 - DNA, 14 bp, Homo sapiens
aaatattctaaaaa

SEQ ID NO: 2269487 - DNA, 14 bp, Homo sapiens
aaatattctgtcat

SEQ ID NO: 2269488 - DNA, 15 bp, Homo sapiens
aaatattctgtcatt

SEQ ID NO: 2269489 - DNA, 13 bp, Homo sapiens
aaatatttctaag

SEQ ID NO: 2269490 - DNA, 20 bp, Homo sapiens
aaatatttctaagcttattt

SEQ ID NO: 2269491 - DNA, 16 bp, Homo sapiens
aaatatttgcttattt

SEQ ID NO: 2269492 - DNA, 19 bp, Homo sapiens
aaatcattcaaaactttca

SEQ ID NO: 2269493 - DNA, 14 bp, Homo sapiens
aaatcatttcatgt

SEQ ID NO: 2269494 - DNA, 18 bp, Homo sapiens
aaatcctgttacttaaat

SEQ ID NO: 2269495 - DNA, 20 bp, Homo sapiens
aaatctacaacataatgata

SEQ ID NO: 2269496 - DNA, 19 bp, Homo sapiens
aaatctagacatagatcct

SEQ ID NO: 2269497 - DNA, 22 bp, Homo sapiens
aaatctgtctgattctatgcct

SEQ ID NO: 2269498 - DNA, 14 bp, Homo sapiens
aaatctttcagaat

SEQ ID NO: 2269499 - DNA, 13 bp, Homo sapiens
aaatctttttgct

SEQ ID NO: 2269500 - DNA, 21 bp, Homo sapiens
aaatgaatagtacatgcagaa

SEQ ID NO: 2269501 - DNA, 15 bp, Homo sapiens
aaatgaatgcctttc

SEQ ID NO: 2269502 - DNA, 12 bp, Homo sapiens
aaatgagaaatt

SEQ ID NO: 2269503 - DNA, 12 bp, Homo sapiens
aaatgagcattt

SEQ ID NO: 2269504 - DNA, 20 bp, Homo sapiens
aaatgcaaacactgtgtatt

SEQ ID NO: 2269505 - DNA, 21 bp, Homo sapiens
aaatgcaaacactgtgtattt

SEQ ID NO: 2269506 - DNA, 18 bp, Homo sapiens
aaatgctaaatgcaaaca

SEQ ID NO: 2269507 - DNA, 13 bp, Homo sapiens
aaatgctatggaa

SEQ ID NO: 2269508 - DNA, 20 bp, Homo sapiens
aaatgctgttggtgagaatc

SEQ ID NO: 2269509 - DNA, 11 bp, Homo sapiens
aaatgctttct

SEQ ID NO: 2269510 - DNA, 12 bp, Homo sapiens
aaatgctttctc

SEQ ID NO: 2269511 - DNA, 13 bp, Homo sapiens
aaatgctttctca

SEQ ID NO: 2269512 - DNA, 14 bp, Homo sapiens
aaatgctttctcat

SEQ ID NO: 2269513 - DNA, 14 bp, Homo sapiens
aaatggaaacagag

SEQ ID NO: 2269514 - DNA, 14 bp, Homo sapiens
aaatggacgtgtta

SEQ ID NO: 2269515 - DNA, 18 bp, Homo sapiens
aaatggtcatggggatga

SEQ ID NO: 2269516 - DNA, 16 bp, Homo sapiens
aaatgtagttgatgta

SEQ ID NO: 2269517 - DNA, 19 bp, Homo sapiens
aaatgtagttgatgtatcc

SEQ ID NO: 2269518 - DNA, 19 bp, Homo sapiens
aaatgtgtaaatgtggaca

SEQ ID NO: 2269519 - DNA, 12 bp, Homo sapiens
aaatgttatttc

SEQ ID NO: 2269520 - DNA, 16 bp, Homo sapiens
aaatgttgtatttcaa

SEQ ID NO: 2269521 - DNA, 15 bp, Homo sapiens
aaatgtttacatttt

SEQ ID NO: 2269522 - DNA, 18 bp, Homo sapiens
aaatgtttacattttctt

SEQ ID NO: 2269523 - DNA, 13 bp, Homo sapiens
aaatgtttctttt

SEQ ID NO: 2269524 - DNA, 23 bp, Homo sapiens
aaatgtttctttttcttttttga

SEQ ID NO: 2269525 - DNA, 18 bp, Homo sapiens
aaattagtgagatttgta

SEQ ID NO: 2269526 - DNA, 16 bp, Homo sapiens
aaattataaatgtttc

SEQ ID NO: 2269527 - DNA, 19 bp, Homo sapiens
aaattataaatgtttcatg

SEQ ID NO: 2269528 - DNA, 18 bp, Homo sapiens
aaattatgaaaatgtaag

SEQ ID NO: 2269529 - DNA, 12 bp, Homo sapiens
aaattattctag

SEQ ID NO: 2269530 - DNA, 14 bp, Homo sapiens
aaattattctagtc

SEQ ID NO: 2269531 - DNA, 14 bp, Homo sapiens
aaattcaacaaatg

SEQ ID NO: 2269532 - DNA, 14 bp, Homo sapiens
aaattcatggaact

SEQ ID NO: 2269533 - DNA, 19 bp, Homo sapiens
aaattcatggaactttcat

SEQ ID NO: 2269534 - DNA, 13 bp, Homo sapiens
aaattcctgttgt

SEQ ID NO: 2269535 - DNA, 18 bp, Homo sapiens
aaattctgtggctgccat

SEQ ID NO: 2269536 - DNA, 18 bp, Homo sapiens
aaattgtagaacatagat

SEQ ID NO: 2269537 - DNA, 18 bp, Homo sapiens
aaattgtgccaaagatag

SEQ ID NO: 2269538 - DNA, 17 bp, Homo sapiens
aaattgtgttcttaaaa

SEQ ID NO: 2269539 - DNA, 18 bp, Homo sapiens
aaattgtgttcttaaaat

SEQ ID NO: 2269540 - DNA, 16 bp, Homo sapiens
aaattgtttctataaa

SEQ ID NO: 2269541 - DNA, 16 bp, Homo sapiens
aaatttaactgcatat

SEQ ID NO: 2269542 - DNA, 16 bp, Homo sapiens
aaatttaatatactgc

SEQ ID NO: 2269543 - DNA, 20 bp, Homo sapiens
aaatttcacaagctaggcca

SEQ ID NO: 2269544 - DNA, 22 bp, Homo sapiens
aaatttcattgtgttgatttct

SEQ ID NO: 2269545 - DNA, 21 bp, Homo sapiens
aaatttcctccacattcatgt

SEQ ID NO: 2269546 - DNA, 20 bp, Homo sapiens
aaatttggggacagattcag

SEQ ID NO: 2269547 - DNA, 14 bp, Homo sapiens
aaattttaatgtaa

SEQ ID NO: 2269548 - DNA, 20 bp, Homo sapiens
aaatttttaaatcatttcat

SEQ ID NO: 2269549 - DNA, 24 bp, Homo sapiens
aaatttttaaatcatttcatgtta

SEQ ID NO: 2269550 - DNA, 22 bp, Homo sapiens
aaatttttactcaggctttcta

SEQ ID NO: 2269551 - DNA, 23 bp, Homo sapiens
aaatttttactcaggctttctat

SEQ ID NO: 2269552 - DNA, 13 bp, Homo sapiens
aacaaaaaatatt

SEQ ID NO: 2269553 - DNA, 13 bp, Homo sapiens
aacaaaatctgtt

SEQ ID NO: 2269554 - DNA, 21 bp, Homo sapiens
aacaaacctctatatgttgct

SEQ ID NO: 2269555 - DNA, 19 bp, Homo sapiens
aacaaacttactgtcagag

SEQ ID NO: 2269556 - DNA, 21 bp, Homo sapiens
aacaactccaggaaaactgtt

SEQ ID NO: 2269557 - DNA, 11 bp, Homo sapiens
aacaagagacc

SEQ ID NO: 2269558 - DNA, 22 bp, Homo sapiens
aacaagccaaacattcttattt

SEQ ID NO: 2269559 - DNA, 15 bp, Homo sapiens
aacaagccagagccg

SEQ ID NO: 2269560 - DNA, 18 bp, Homo sapiens
aacaaggaaggacatttc

SEQ ID NO: 2269561 - DNA, 15 bp, Homo sapiens
aacaaggcaaggctg

SEQ ID NO: 2269562 - DNA, 23 bp, Homo sapiens
aacaaggcaaggctgtcaattac

SEQ ID NO: 2269563 - DNA, 20 bp, Homo sapiens
aacaagtgctcctgaaagaa

SEQ ID NO: 2269564 - DNA, 19 bp, Homo sapiens
aacacacttttctttttaa

SEQ ID NO: 2269565 - DNA, 23 bp, Homo sapiens
aacacacttttctttttaaatgt

SEQ ID NO: 2269566 - DNA, 13 bp, Homo sapiens
aacacccagcccc

SEQ ID NO: 2269567 - DNA, 19 bp, Homo sapiens
aacaccttcttattatata

SEQ ID NO: 2269568 - DNA, 20 bp, Homo sapiens
aacaccttcttattatatat

SEQ ID NO: 2269569 - DNA, 14 bp, Homo sapiens
aacactaatggcca

SEQ ID NO: 2269570 - DNA, 15 bp, Homo sapiens
aacactcactgcctg

SEQ ID NO: 2269571 - DNA, 18 bp, Homo sapiens
aacactcacttaattctc

SEQ ID NO: 2269572 - DNA, 20 bp, Homo sapiens
aacactgcttaaggaaaaga

SEQ ID NO: 2269573 - DNA, 12 bp, Homo sapiens
aacagacatgta

SEQ ID NO: 2269574 - DNA, 22 bp, Homo sapiens
aacagacctcactgctttgtag

SEQ ID NO: 2269575 - DNA, 12 bp, Homo sapiens
aacagaggacca

SEQ ID NO: 2269576 - DNA, 13 bp, Homo sapiens
aacagaggaccag

SEQ ID NO: 2269577 - DNA, 18 bp, Homo sapiens
aacagaggaccagcacac

SEQ ID NO: 2269578 - DNA, 21 bp, Homo sapiens
aacagaggaccagcacactcc

SEQ ID NO: 2269579 - DNA, 13 bp, Homo sapiens
aacagagtatata

SEQ ID NO: 2269580 - DNA, 15 bp, Homo sapiens
aacagagtatatatg

SEQ ID NO: 2269581 - DNA, 19 bp, Homo sapiens
aacagatgagaagactagc

SEQ ID NO: 2269582 - DNA, 23 bp, Homo sapiens
aacagatgagaagactagcagct

SEQ ID NO: 2269583 - DNA, 21 bp, Homo sapiens
aacagcaagtatgaaccacat

SEQ ID NO: 2269584 - DNA, 15 bp, Homo sapiens
aacagcatgtctact

SEQ ID NO: 2269585 - DNA, 13 bp, Homo sapiens
aacagtgtgactc

SEQ ID NO: 2269586 - DNA, 16 bp, Homo sapiens
aacataatatcttgaa

SEQ ID NO: 2269587 - DNA, 18 bp, Homo sapiens
aacatatgggtgtgaagt

SEQ ID NO: 2269588 - DNA, 13 bp, Homo sapiens
aacatccactctc

SEQ ID NO: 2269589 - DNA, 16 bp, Homo sapiens
aacatccactctctct

SEQ ID NO: 2269590 - DNA, 17 bp, Homo sapiens
aacatgagtttatggga

SEQ ID NO: 2269591 - DNA, 12 bp, Homo sapiens
aacatgcatatg

SEQ ID NO: 2269592 - DNA, 19 bp, Homo sapiens
aacatgtatgatttctgtt

SEQ ID NO: 2269593 - DNA, 13 bp, Homo sapiens
aacattaatttta

SEQ ID NO: 2269594 - DNA, 13 bp, Homo sapiens
aacattgagactg

SEQ ID NO: 2269595 - DNA, 14 bp, Homo sapiens
aacattgagactgc

SEQ ID NO: 2269596 - DNA, 20 bp, Homo sapiens
aacatttctaactaaggaca

SEQ ID NO: 2269597 - DNA, 23 bp, Homo sapiens
aacatttgggacctggataatta

SEQ ID NO: 2269598 - DNA, 16 bp, Homo sapiens
aaccactttcacctgg

SEQ ID NO: 2269599 - DNA, 19 bp, Homo sapiens
aaccactttcacctgggat

SEQ ID NO: 2269600 - DNA, 13 bp, Homo sapiens
aaccagagcactg

SEQ ID NO: 2269601 - DNA, 14 bp, Homo sapiens
aaccagagcactgt

SEQ ID NO: 2269602 - DNA, 17 bp, Homo sapiens
aaccagcactcccaggg

SEQ ID NO: 2269603 - DNA, 18 bp, Homo sapiens
aaccagctattggaacag

SEQ ID NO: 2269604 - DNA, 18 bp, Homo sapiens
aaccataaaataaataat

SEQ ID NO: 2269605 - DNA, 17 bp, Homo sapiens
aaccatcattgaaatct

SEQ ID NO: 2269606 - DNA, 20 bp, Homo sapiens
aaccatcattgaaatctttt

SEQ ID NO: 2269607 - DNA, 19 bp, Homo sapiens
aaccatcatttaatttcta

SEQ ID NO: 2269608 - DNA, 14 bp, Homo sapiens
aaccatcctctgtt

SEQ ID NO: 2269609 - DNA, 23 bp, Homo sapiens
aaccattgttctgacacgacttc

SEQ ID NO: 2269610 - DNA, 23 bp, Homo sapiens
aacccctgcagctcctctgcctt

SEQ ID NO: 2269611 - DNA, 15 bp, Homo sapiens
aaccctataaaagtg

SEQ ID NO: 2269612 - DNA, 17 bp, Homo sapiens
aaccctgagagtctgag

SEQ ID NO: 2269613 - DNA, 17 bp, Homo sapiens
aaccctgccctgcacct

SEQ ID NO: 2269614 - DNA, 13 bp, Homo sapiens
aacccttcagtgc

SEQ ID NO: 2269615 - DNA, 17 bp, Homo sapiens
aaccgtcaatgtgaaat

SEQ ID NO: 2269616 - DNA, 22 bp, Homo sapiens
aacctcaatttatgttaacaga

SEQ ID NO: 2269617 - DNA, 14 bp, Homo sapiens
aacctctatatgtt

SEQ ID NO: 2269618 - DNA, 15 bp, Homo sapiens
aacctgcaaggcaaa

SEQ ID NO: 2269619 - DNA, 17 bp, Homo sapiens
aacctgcatttaagaac

SEQ ID NO: 2269620 - DNA, 18 bp, Homo sapiens
aacctgcatttaagaaca

SEQ ID NO: 2269621 - DNA, 23 bp, Homo sapiens
aacctggaggctggaccaactgc

SEQ ID NO: 2269622 - DNA, 20 bp, Homo sapiens
aacctgttcttcctaccaaa

SEQ ID NO: 2269623 - DNA, 15 bp, Homo sapiens
aaccttacttaaagc

SEQ ID NO: 2269624 - DNA, 16 bp, Homo sapiens
aaccttttgagtgcct

SEQ ID NO: 2269625 - DNA, 17 bp, Homo sapiens
aacgatatatgtaaata

SEQ ID NO: 2269626 - DNA, 13 bp, Homo sapiens
aacgtggctgctt

SEQ ID NO: 2269627 - DNA, 16 bp, Homo sapiens
aactaaaattcaacaa

SEQ ID NO: 2269628 - DNA, 20 bp, Homo sapiens
aactaaaattcaacaaatga

SEQ ID NO: 2269629 - DNA, 15 bp, Homo sapiens
aactaagttgtattt

SEQ ID NO: 2269630 - DNA, 16 bp, Homo sapiens
aactaagttgtatttt

SEQ ID NO: 2269631 - DNA, 22 bp, Homo sapiens
aactaccgttcccaaattggtg

SEQ ID NO: 2269632 - DNA, 15 bp, Homo sapiens
aactagatctcctgt

SEQ ID NO: 2269633 - DNA, 22 bp, Homo sapiens
aactagatctcctgtaattttg

SEQ ID NO: 2269634 - DNA, 21 bp, Homo sapiens
aactatggtgtgcttatgttt

SEQ ID NO: 2269635 - DNA, 23 bp, Homo sapiens
aactattaggaggaatgtgcttt

SEQ ID NO: 2269636 - DNA, 15 bp, Homo sapiens
aactcaatgcatgat

SEQ ID NO: 2269637 - DNA, 19 bp, Homo sapiens
aactcagtctcaaataata

SEQ ID NO: 2269638 - DNA, 19 bp, Homo sapiens
aactccaacatccactctc

SEQ ID NO: 2269639 - DNA, 13 bp, Homo sapiens
aactcttggcctc

SEQ ID NO: 2269640 - DNA, 22 bp, Homo sapiens
aactgatgagatacatttgatc

SEQ ID NO: 2269641 - DNA, 13 bp, Homo sapiens
aactgatgtatag

SEQ ID NO: 2269642 - DNA, 22 bp, Homo sapiens
aactgatgtatagctttaacat

SEQ ID NO: 2269643 - DNA, 19 bp, Homo sapiens
aactgatttttttttcctt

SEQ ID NO: 2269644 - DNA, 23 bp, Homo sapiens
aactgatttttttttccttcagt

SEQ ID NO: 2269645 - DNA, 19 bp, Homo sapiens
aactgccaaataaaatgtt

SEQ ID NO: 2269646 - DNA, 19 bp, Homo sapiens
aactgctgttttatgtcat

SEQ ID NO: 2269647 - DNA, 20 bp, Homo sapiens
aactgctgttttatgtcata

SEQ ID NO: 2269648 - DNA, 22 bp, Homo sapiens
aactgctttgttttggctgctc

SEQ ID NO: 2269649 - DNA, 22 bp, Homo sapiens
aactggatagaaaaatgctgtt

SEQ ID NO: 2269650 - DNA, 14 bp, Homo sapiens
aactgtagtaattg

SEQ ID NO: 2269651 - DNA, 22 bp, Homo sapiens
aactgtagtaattgttacaatt

SEQ ID NO: 2269652 - DNA, 14 bp, Homo sapiens
aactgtatattatt

SEQ ID NO: 2269653 - DNA, 19 bp, Homo sapiens
aactgttaacccagtgttc

SEQ ID NO: 2269654 - DNA, 16 bp, Homo sapiens
aactgttctttgcagt

SEQ ID NO: 2269655 - DNA, 18 bp, Homo sapiens
aactgttctttgcagtga

SEQ ID NO: 2269656 - DNA, 23 bp, Homo sapiens
aactgttctttgcagtgaagatg

SEQ ID NO: 2269657 - DNA, 10 bp, Homo sapiens
aactgtttat

SEQ ID NO: 2269658 - DNA, 13 bp, Homo sapiens
aacttaaaacata

SEQ ID NO: 2269659 - DNA, 18 bp, Homo sapiens
aacttaaacctgtgcttt

SEQ ID NO: 2269660 - DNA, 17 bp, Homo sapiens
aacttatctccagccaa

SEQ ID NO: 2269661 - DNA, 18 bp, Homo sapiens
aacttcctttgagaattg

SEQ ID NO: 2269662 - DNA, 16 bp, Homo sapiens
aacttctcccttctcc

SEQ ID NO: 2269663 - DNA, 18 bp, Homo sapiens
aagaaaaaaatagtttta

SEQ ID NO: 2269664 - DNA, 16 bp, Homo sapiens
aagaaaaaattttaaa

SEQ ID NO: 2269665 - DNA, 21 bp, Homo sapiens
aagaaaaaattttaaaaatct

SEQ ID NO: 2269666 - DNA, 20 bp, Homo sapiens
aagaaaacttgaacaagaaa

SEQ ID NO: 2269667 - DNA, 12 bp, Homo sapiens
aagaaaataacc

SEQ ID NO: 2269668 - DNA, 22 bp, Homo sapiens
aagaaatgagaaattgtgccaa

SEQ ID NO: 2269669 - DNA, 20 bp, Homo sapiens
aagaaatgctaatgtaatca

SEQ ID NO: 2269670 - DNA, 22 bp, Homo sapiens
aagaacactgcagtgttatttt

SEQ ID NO: 2269671 - DNA, 12 bp, Homo sapiens
aagaacagaaca

SEQ ID NO: 2269672 - DNA, 20 bp, Homo sapiens
aagaagaaagtctatgctta

SEQ ID NO: 2269673 - DNA, 13 bp, Homo sapiens
aagaagattctaa

SEQ ID NO: 2269674 - DNA, 14 bp, Homo sapiens
aagaagattctaaa

SEQ ID NO: 2269675 - DNA, 17 bp, Homo sapiens
aagaaggaaagaaccga

SEQ ID NO: 2269676 - DNA, 22 bp, Homo sapiens
aagaaggaaagaaccgaagagc

SEQ ID NO: 2269677 - DNA, 23 bp, Homo sapiens
aagaaggcacaggtgtaaatata

SEQ ID NO: 2269678 - DNA, 17 bp, Homo sapiens
aagaagggaaattcaca

SEQ ID NO: 2269679 - DNA, 13 bp, Homo sapiens
aagaagtcaaatg

SEQ ID NO: 2269680 - DNA, 19 bp, Homo sapiens
aagaataaataaagaagaa

SEQ ID NO: 2269681 - DNA, 21 bp, Homo sapiens
aagaataaataaagaagaaaa

SEQ ID NO: 2269682 - DNA, 14 bp, Homo sapiens
aagaatataaatat

SEQ ID NO: 2269683 - DNA, 21 bp, Homo sapiens
aagaatgtacagaaaatagct

SEQ ID NO: 2269684 - DNA, 22 bp, Homo sapiens
aagaatgtacagaaaatagctt

SEQ ID NO: 2269685 - DNA, 13 bp, Homo sapiens
aagacaaaattta

SEQ ID NO: 2269686 - DNA, 16 bp, Homo sapiens
aagacaaaatttaatt

SEQ ID NO: 2269687 - DNA, 17 bp, Homo sapiens
aagacaaaatttaattg

SEQ ID NO: 2269688 - DNA, 13 bp, Homo sapiens
aagacaatcacgc

SEQ ID NO: 2269689 - DNA, 20 bp, Homo sapiens
aagacaatcacgctgggaat

SEQ ID NO: 2269690 - DNA, 19 bp, Homo sapiens
aagacactagtagagcaaa

SEQ ID NO: 2269691 - DNA, 18 bp, Homo sapiens
aagacagagatggcagag

SEQ ID NO: 2269692 - DNA, 21 bp, Homo sapiens
aagacagagatggcagagcca

SEQ ID NO: 2269693 - DNA, 14 bp, Homo sapiens
aagacatttaaaat

SEQ ID NO: 2269694 - DNA, 13 bp, Homo sapiens
aagacatttcatc

SEQ ID NO: 2269695 - DNA, 14 bp, Homo sapiens
aagacccggccagg

SEQ ID NO: 2269696 - DNA, 15 bp, Homo sapiens
aagaccttctgaaga

SEQ ID NO: 2269697 - DNA, 19 bp, Homo sapiens
aagaccttctgaagatctc

SEQ ID NO: 2269698 - DNA, 13 bp, Homo sapiens
aagactcttggac

SEQ ID NO: 2269699 - DNA, 17 bp, Homo sapiens
aagacttaatcatatca

SEQ ID NO: 2269700 - DNA, 18 bp, Homo sapiens
aagacttttagcggtttg

SEQ ID NO: 2269701 - DNA, 23 bp, Homo sapiens
aagacttttagcggtttgcaaac

SEQ ID NO: 2269702 - DNA, 19 bp, Homo sapiens
aagacttttctttcagcca

SEQ ID NO: 2269703 - DNA, 12 bp, Homo sapiens
aagagaaaagat

SEQ ID NO: 2269704 - DNA, 21 bp, Homo sapiens
aagagaaacactaatggccaa

SEQ ID NO: 2269705 - DNA, 11 bp, Homo sapiens
aagagaattca

SEQ ID NO: 2269706 - DNA, 12 bp, Homo sapiens
aagagacaaata

SEQ ID NO: 2269707 - DNA, 13 bp, Homo sapiens
aagagatgctcta

SEQ ID NO: 2269708 - DNA, 16 bp, Homo sapiens
aagagcaaacaaaagt

SEQ ID NO: 2269709 - DNA, 19 bp, Homo sapiens
aagagcatgtaagaaataa

SEQ ID NO: 2269710 - DNA, 16 bp, Homo sapiens
aagagcccttccagga

SEQ ID NO: 2269711 - DNA, 22 bp, Homo sapiens
aagagcttcccctaacctgggt

SEQ ID NO: 2269712 - DNA, 15 bp, Homo sapiens
agagcagagccccca

SEQ ID NO: 2269713 - DNA, 12 bp, Homo sapiens
agagccccggag

SEQ ID NO: 2269714 - DNA, 15 bp, Homo sapiens
agagcgccacccgcc

SEQ ID NO: 2269715 - DNA, 21 bp, Homo sapiens
agaggaaatcaccgaaaacgt

SEQ ID NO: 2269716 - DNA, 17 bp, Homo sapiens
agaggagggatagagac

SEQ ID NO: 2269717 - DNA, 16 bp, Homo sapiens
agaggatttggctcgc

SEQ ID NO: 2269718 - DNA, 21 bp, Homo sapiens
agaggatttggctcgctgtgg

SEQ ID NO: 2269719 - DNA, 13 bp, Homo sapiens
agaggcagggccc

SEQ ID NO: 2269720 - DNA, 17 bp, Homo sapiens
agaggcggttgtaagag

SEQ ID NO: 2269721 - DNA, 17 bp, Homo sapiens
agagggctgagcccctc

SEQ ID NO: 2269722 - DNA, 17 bp, Homo sapiens
agaggggtataggacaa

SEQ ID NO: 2269723 - DNA, 17 bp, Homo sapiens
agaggtgagggaggcct

SEQ ID NO: 2269724 - DNA, 18 bp, Homo sapiens
agaggtgagggaggcctg

SEQ ID NO: 2269725 - DNA, 20 bp, Homo sapiens
agagtatatatgtacagtta

SEQ ID NO: 2269726 - DNA, 21 bp, Homo sapiens
agagtatgcaagaagaatata

SEQ ID NO: 2269727 - DNA, 21 bp, Homo sapiens
agagttctccttgtacttgaa

SEQ ID NO: 2269728 - DNA, 14 bp, Homo sapiens
agataaactgaaat

SEQ ID NO: 2269729 - DNA, 12 bp, Homo sapiens
agataaatattt

SEQ ID NO: 2269730 - DNA, 18 bp, Homo sapiens
agataaatgctttaaata

SEQ ID NO: 2269731 - DNA, 22 bp, Homo sapiens
agataaatgctttaaatagttt

SEQ ID NO: 2269732 - DNA, 12 bp, Homo sapiens
agataagtgctc

SEQ ID NO: 2269733 - DNA, 20 bp, Homo sapiens
agataagtgctcagtattga

SEQ ID NO: 2269734 - DNA, 22 bp, Homo sapiens
agatacaagaaaaagtagaaaa

SEQ ID NO: 2269735 - DNA, 24 bp, Homo sapiens
agatactatttagataacaagaat

SEQ ID NO: 2269736 - DNA, 17 bp, Homo sapiens
agatactttttcttttg

SEQ ID NO: 2269737 - DNA, 19 bp, Homo sapiens
agatactttttcttttgta

SEQ ID NO: 2269738 - DNA, 21 bp, Homo sapiens
agatactttttcttttgtaag

SEQ ID NO: 2269739 - DNA, 17 bp, Homo sapiens
agatatatatttccaaa

SEQ ID NO: 2269740 - DNA, 22 bp, Homo sapiens
agatatatatttccaaatattc

SEQ ID NO: 2269741 - DNA, 12 bp, Homo sapiens
agatatggtgga

SEQ ID NO: 2269742 - DNA, 14 bp, Homo sapiens
agatattatgtata

SEQ ID NO: 2269743 - DNA, 21 bp, Homo sapiens
agatattatgtatagaaaata

SEQ ID NO: 2269744 - DNA, 15 bp, Homo sapiens
agatatttaaattta

SEQ ID NO: 2269745 - DNA, 21 bp, Homo sapiens
agatcacgccattgcactcca

SEQ ID NO: 2269746 - DNA, 24 bp, Homo sapiens
agatcagcattcaaaatagttcta

SEQ ID NO: 2269747 - DNA, 22 bp, Homo sapiens
agatccctcggtcagcaccgtg

SEQ ID NO: 2269748 - DNA, 17 bp, Homo sapiens
agatccgccctgggctc

SEQ ID NO: 2269749 - DNA, 22 bp, Homo sapiens
agatcctctttccccactgaag

SEQ ID NO: 2269750 - DNA, 22 bp, Homo sapiens
agatctcagataaagtgaccag

SEQ ID NO: 2269751 - DNA, 14 bp, Homo sapiens
agatctcggtgctg

SEQ ID NO: 2269752 - DNA, 16 bp, Homo sapiens
agatcttacaagttta

SEQ ID NO: 2269753 - DNA, 19 bp, Homo sapiens
agatgaacaactttgcctt

SEQ ID NO: 2269754 - DNA, 18 bp, Homo sapiens
agatgacacataaatctg

SEQ ID NO: 2269755 - DNA, 19 bp, Homo sapiens
agatgacacataaatctgt

SEQ ID NO: 2269756 - DNA, 13 bp, Homo sapiens
agatgactggaaa

SEQ ID NO: 2269757 - DNA, 20 bp, Homo sapiens
agatgaggaaataagacttt

SEQ ID NO: 2269758 - DNA, 14 bp, Homo sapiens
agatgatccatttg

SEQ ID NO: 2269759 - DNA, 17 bp, Homo sapiens
agatgctaatagaaaac

SEQ ID NO: 2269760 - DNA, 18 bp, Homo sapiens
agatgctaatagaaaact

SEQ ID NO: 2269761 - DNA, 13 bp, Homo sapiens
agatgcttaaaaa

SEQ ID NO: 2269762 - DNA, 21 bp, Homo sapiens
agatggaatatcaatgcccaa

SEQ ID NO: 2269763 - DNA, 15 bp, Homo sapiens
agatggatattagat

SEQ ID NO: 2269764 - DNA, 17 bp, Homo sapiens
agatggatattagatgc

SEQ ID NO: 2269765 - DNA, 16 bp, Homo sapiens
agatggcgcacccggc

SEQ ID NO: 2269766 - DNA, 21 bp, Homo sapiens
agatggcgcacccggcagccc

SEQ ID NO: 2269767 - DNA, 15 bp, Homo sapiens
agatggtaatctttt

SEQ ID NO: 2269768 - DNA, 23 bp, Homo sapiens
agatggtaatcttttctgaggtt

SEQ ID NO: 2269769 - DNA, 23 bp, Homo sapiens
agatgtaagaagcccgatccaca

SEQ ID NO: 2269770 - DNA, 14 bp, Homo sapiens
agatgtaccatgtt

SEQ ID NO: 2269771 - DNA, 21 bp, Homo sapiens
agatgtattttcaataaagaa

SEQ ID NO: 2269772 - DNA, 17 bp, Homo sapiens
agatgtcagtctgtcca

SEQ ID NO: 2269773 - DNA, 16 bp, Homo sapiens
agatgtgtaaataagc

SEQ ID NO: 2269774 - DNA, 12 bp, Homo sapiens
agatgttttaga

SEQ ID NO: 2269775 - DNA, 19 bp, Homo sapiens
agatgttttagagataaat

SEQ ID NO: 2269776 - DNA, 14 bp, Homo sapiens
agatgtttttagag

SEQ ID NO: 2269777 - DNA, 16 bp, Homo sapiens
agattaaaattagtga

SEQ ID NO: 2269778 - DNA, 20 bp, Homo sapiens
agattaaaattagtgagatt

SEQ ID NO: 2269779 - DNA, 13 bp, Homo sapiens
agattaatttgtg

SEQ ID NO: 2269780 - DNA, 15 bp, Homo sapiens
agattattttctata

SEQ ID NO: 2269781 - DNA, 16 bp, Homo sapiens
agattattttctatat

SEQ ID NO: 2269782 - DNA, 13 bp, Homo sapiens
agattcagtcttg

SEQ ID NO: 2269783 - DNA, 15 bp, Homo sapiens
agattccagaacgcc

SEQ ID NO: 2269784 - DNA, 18 bp, Homo sapiens
agattccagaacgccctg

SEQ ID NO: 2269785 - DNA, 13 bp, Homo sapiens
agatttcactctc

SEQ ID NO: 2269786 - DNA, 15 bp, Homo sapiens
agatttgagctgcct

SEQ ID NO: 2269787 - DNA, 12 bp, Homo sapiens
agatttgtattt

SEQ ID NO: 2269788 - DNA, 18 bp, Homo sapiens
agatttgtatttatatta

SEQ ID NO: 2269789 - DNA, 22 bp, Homo sapiens
agattttatccctttctcttct

SEQ ID NO: 2269790 - DNA, 17 bp, Homo sapiens
agcaaaaaatacccttg

SEQ ID NO: 2269791 - DNA, 14 bp, Homo sapiens
agcaaagacttaat

SEQ ID NO: 2269792 - DNA, 19 bp, Homo sapiens
agcaaataaaacagtgaaa

SEQ ID NO: 2269793 - DNA, 17 bp, Homo sapiens
agcaaccagagcactgt

SEQ ID NO: 2269794 - DNA, 20 bp, Homo sapiens
agcaactgttggataataac

SEQ ID NO: 2269795 - DNA, 11 bp, Homo sapiens
agcaaggctgc

SEQ ID NO: 2269796 - DNA, 14 bp, Homo sapiens
agcaaggctgccct

SEQ ID NO: 2269797 - DNA, 13 bp, Homo sapiens
agcaaggctgcta

SEQ ID NO: 2269798 - DNA, 20 bp, Homo sapiens
agcaatactgccgctgcccc

SEQ ID NO: 2269799 - DNA, 13 bp, Homo sapiens
agcaatatatttg

SEQ ID NO: 2269800 - DNA, 15 bp, Homo sapiens
agcaatatatttgta

SEQ ID NO: 2269801 - DNA, 20 bp, Homo sapiens
agcaatgtttttctcaaaaa

SEQ ID NO: 2269802 - DNA, 22 bp, Homo sapiens
agcaattaaagacatttaaaat

SEQ ID NO: 2269803 - DNA, 17 bp, Homo sapiens
agcacaaactgtcgtct

SEQ ID NO: 2269804 - DNA, 19 bp, Homo sapiens
agcacacatgcatcctccc

SEQ ID NO: 2269805 - DNA, 19 bp, Homo sapiens
agcacagataaaaagtgga

SEQ ID NO: 2269806 - DNA, 18 bp, Homo sapiens
agcacagtatttactgtg

SEQ ID NO: 2269807 - DNA, 13 bp, Homo sapiens
agcaccagcctga

SEQ ID NO: 2269808 - DNA, 16 bp, Homo sapiens
agcaccagcctgagcc

SEQ ID NO: 2269809 - DNA, 21 bp, Homo sapiens
agcaccaggtgttaaaaacca

SEQ ID NO: 2269810 - DNA, 23 bp, Homo sapiens
agcaccaggtgttaaaaaccatt

SEQ ID NO: 2269811 - DNA, 18 bp, Homo sapiens
agcacccccagcctcccc

SEQ ID NO: 2269812 - DNA, 19 bp, Homo sapiens
agcacccccagcctccccc

SEQ ID NO: 2269813 - DNA, 21 bp, Homo sapiens
agcaccgtggtgtgaggcccc

SEQ ID NO: 2269814 - DNA, 18 bp, Homo sapiens
agcacctgccctctgttt

SEQ ID NO: 2269815 - DNA, 15 bp, Homo sapiens
agcactcccagggcc

SEQ ID NO: 2269816 - DNA, 18 bp, Homo sapiens
agcactcccagggcccga

SEQ ID NO: 2269817 - DNA, 19 bp, Homo sapiens
agcactcccagggcccgag

SEQ ID NO: 2269818 - DNA, 12 bp, Homo sapiens
agcactgtatac

SEQ ID NO: 2269819 - DNA, 18 bp, Homo sapiens
agcactttgggaggtcga

SEQ ID NO: 2269820 - DNA, 17 bp, Homo sapiens
agcagaaaggctctgaa

SEQ ID NO: 2269821 - DNA, 16 bp, Homo sapiens
agcagagacggcagcc

SEQ ID NO: 2269822 - DNA, 21 bp, Homo sapiens
agcagagacggcagccccatc

SEQ ID NO: 2269823 - DNA, 15 bp, Homo sapiens
agcagagtcattgtt

SEQ ID NO: 2269824 - DNA, 19 bp, Homo sapiens
agcagatggagaccccttg

SEQ ID NO: 2269825 - DNA, 16 bp, Homo sapiens
agcagcaggtctagaa

SEQ ID NO: 2269826 - DNA, 17 bp, Homo sapiens
agcagcgtgcaggagca

SEQ ID NO: 2269827 - DNA, 14 bp, Homo sapiens
agcagctagcaagg

SEQ ID NO: 2269828 - DNA, 11 bp, Homo sapiens
agcagctccaa

SEQ ID NO: 2269829 - DNA, 23 bp, Homo sapiens
agcagctccaacctggaggctgg

SEQ ID NO: 2269830 - DNA, 13 bp, Homo sapiens
agcagctggactg

SEQ ID NO: 2269831 - DNA, 12 bp, Homo sapiens
agcaggaaatag

SEQ ID NO: 2269832 - DNA, 17 bp, Homo sapiens
agcaggctcgggctccc

SEQ ID NO: 2269833 - DNA, 15 bp, Homo sapiens
agcaggttctaggct

SEQ ID NO: 2269834 - DNA, 16 bp, Homo sapiens
agcagtaccatcccac

SEQ ID NO: 2269835 - DNA, 18 bp, Homo sapiens
agcagtcagcggagagga

SEQ ID NO: 2269836 - DNA, 17 bp, Homo sapiens
agcagtctaaacagagt

SEQ ID NO: 2269837 - DNA, 19 bp, Homo sapiens
agcagtctccgctcccgca

SEQ ID NO: 2269838 - DNA, 13 bp, Homo sapiens
agcagtgcatgct

SEQ ID NO: 2269839 - DNA, 16 bp, Homo sapiens
agcagtgcatgctgtc

SEQ ID NO: 2269840 - DNA, 13 bp, Homo sapiens
agcagtggggagc

SEQ ID NO: 2269841 - DNA, 15 bp, Homo sapiens
agcagtggggagcgg

SEQ ID NO: 2269842 - DNA, 17 bp, Homo sapiens
agcagtttggggcaggg

SEQ ID NO: 2269843 - DNA, 13 bp, Homo sapiens
agcataaatctgt

SEQ ID NO: 2269844 - DNA, 20 bp, Homo sapiens
agcatagttctgcaataaca

SEQ ID NO: 2269845 - DNA, 23 bp, Homo sapiens
agcatccatgcggccggcctggg

SEQ ID NO: 2269846 - DNA, 13 bp, Homo sapiens
agcatctgctctt

SEQ ID NO: 2269847 - DNA, 14 bp, Homo sapiens
agcatgagattgta

SEQ ID NO: 2269848 - DNA, 19 bp, Homo sapiens
agcatgagattgtacattt

SEQ ID NO: 2269849 - DNA, 14 bp, Homo sapiens
agaaaatagctttt

SEQ ID NO: 2269850 - DNA, 22 bp, Homo sapiens
agaaaatagcttttattgagta

SEQ ID NO: 2269851 - DNA, 18 bp, Homo sapiens
agaaaatgctttctcatg

SEQ ID NO: 2269852 - DNA, 22 bp, Homo sapiens
agaaaatggacgtgttatgact

SEQ ID NO: 2269853 - DNA, 15 bp, Homo sapiens
agaaacaactgccaa

SEQ ID NO: 2269854 - DNA, 19 bp, Homo sapiens
agaaacaactgccaaataa

SEQ ID NO: 2269855 - DNA, 13 bp, Homo sapiens
agaaacactttct

SEQ ID NO: 2269856 - DNA, 22 bp, Homo sapiens
agaaaggggcccattcagcctc

SEQ ID NO: 2269857 - DNA, 22 bp, Homo sapiens
agaaagttctgtgtaaacagaa

SEQ ID NO: 2269858 - DNA, 22 bp, Homo sapiens
agaaatattaatatgtactttt

SEQ ID NO: 2269859 - DNA, 12 bp, Homo sapiens
agaaatgagaaa

SEQ ID NO: 2269860 - DNA, 14 bp, Homo sapiens
agaaatgagaaatt

SEQ ID NO: 2269861 - DNA, 21 bp, Homo sapiens
agaaatgctaatgtaatcatt

SEQ ID NO: 2269862 - DNA, 22 bp, Homo sapiens
agaaatgctaatgtaatcattt

SEQ ID NO: 2269863 - DNA, 10 bp, Homo sapiens
agaaatgtag

SEQ ID NO: 2269864 - DNA, 15 bp, Homo sapiens
agaaatgtagttgat

SEQ ID NO: 2269865 - DNA, 20 bp, Homo sapiens
agaaattctataagagacaa

SEQ ID NO: 2269866 - DNA, 14 bp, Homo sapiens
agaaattgtgccaa

SEQ ID NO: 2269867 - DNA, 13 bp, Homo sapiens
agaaattttctac

SEQ ID NO: 2269868 - DNA, 15 bp, Homo sapiens
agaaattttctacag

SEQ ID NO: 2269869 - DNA, 13 bp, Homo sapiens
agaacaagagacc

SEQ ID NO: 2269870 - DNA, 21 bp, Homo sapiens
agaacaagagacccctgtctg

SEQ ID NO: 2269871 - DNA, 16 bp, Homo sapiens
agaacaagccagagcc

SEQ ID NO: 2269872 - DNA, 17 bp, Homo sapiens
agaacaggaggtgtgaa

SEQ ID NO: 2269873 - DNA, 19 bp, Homo sapiens
agaacaggaggtgtgaatg

SEQ ID NO: 2269874 - DNA, 21 bp, Homo sapiens
agaacaggaggtgtgaatgca

SEQ ID NO: 2269875 - DNA, 23 bp, Homo sapiens
agaacaggaggtgtgaatgcacg

SEQ ID NO: 2269876 - DNA, 17 bp, Homo sapiens
agaacagggtttctcag

SEQ ID NO: 2269877 - DNA, 19 bp, Homo sapiens
agaacaggtgttcctcctc

SEQ ID NO: 2269878 - DNA, 21 bp, Homo sapiens
agaacatgagtttatgggaat

SEQ ID NO: 2269879 - DNA, 16 bp, Homo sapiens
agaaccagcactccca

SEQ ID NO: 2269880 - DNA, 16 bp, Homo sapiens
agaacctgcatttaag

SEQ ID NO: 2269881 - DNA, 17 bp, Homo sapiens
agaacgggcctccccgg

SEQ ID NO: 2269882 - DNA, 18 bp, Homo sapiens
agaacgtactttctgtta

SEQ ID NO: 2269883 - DNA, 20 bp, Homo sapiens
agaactgaagtgtgctgtga

SEQ ID NO: 2269884 - DNA, 20 bp, Homo sapiens
agaactgtcccacaaaatat

SEQ ID NO: 2269885 - DNA, 15 bp, Homo sapiens
agaagattctaaaac

SEQ ID NO: 2269886 - DNA, 22 bp, Homo sapiens
agaagcacaggaatagtgagtg

SEQ ID NO: 2269887 - DNA, 20 bp, Homo sapiens
agaaggacttcctgctacag

SEQ ID NO: 2269888 - DNA, 14 bp, Homo sapiens
agaagggaaattca

SEQ ID NO: 2269889 - DNA, 21 bp, Homo sapiens
agaagtagttttgttcatgaa

SEQ ID NO: 2269890 - DNA, 17 bp, Homo sapiens
agaagtccatgagttga

SEQ ID NO: 2269891 - DNA, 22 bp, Homo sapiens
agaagtccatgagttgagtggg

SEQ ID NO: 2269892 - DNA, 12 bp, Homo sapiens
agaagtttcttc

SEQ ID NO: 2269893 - DNA, 17 bp, Homo sapiens
agaataaatgagcattt

SEQ ID NO: 2269894 - DNA, 23 bp, Homo sapiens
agaataattttaacagacatgta

SEQ ID NO: 2269895 - DNA, 18 bp, Homo sapiens
agaatattgttaaaacct

SEQ ID NO: 2269896 - DNA, 16 bp, Homo sapiens
agaatctaggaaatta

SEQ ID NO: 2269897 - DNA, 12 bp, Homo sapiens
agaatctatttt

SEQ ID NO: 2269898 - DNA, 13 bp, Homo sapiens
agaatctccattt

SEQ ID NO: 2269899 - DNA, 17 bp, Homo sapiens
agaatgagagagaaaag

SEQ ID NO: 2269900 - DNA, 11 bp, Homo sapiens
agaatgtacag

SEQ ID NO: 2269901 - DNA, 13 bp, Homo sapiens
agaatgtacagaa

SEQ ID NO: 2269902 - DNA, 19 bp, Homo sapiens
agaatgtacagaaaatagc

SEQ ID NO: 2269903 - DNA, 22 bp, Homo sapiens
agaatgtacagaaaatagcttt

SEQ ID NO: 2269904 - DNA, 16 bp, Homo sapiens
agaatgtttcctgtgg

SEQ ID NO: 2269905 - DNA, 15 bp, Homo sapiens
agaatgttttggaat

SEQ ID NO: 2269906 - DNA, 21 bp, Homo sapiens
agaattaggtaatggatatga

SEQ ID NO: 2269907 - DNA, 19 bp, Homo sapiens
agaattgaaccgtcaatgt

SEQ ID NO: 2269908 - DNA, 17 bp, Homo sapiens
agaatttcccaaagcag

SEQ ID NO: 2269909 - DNA, 13 bp, Homo sapiens
agaatttgaaagt

SEQ ID NO: 2269910 - DNA, 15 bp, Homo sapiens
agaatttgaaagttt

SEQ ID NO: 2269911 - DNA, 21 bp, Homo sapiens
agaatttgaaagtttccttat

SEQ ID NO: 2269912 - DNA, 18 bp, Homo sapiens
agacaaaatttaattgtg

SEQ ID NO: 2269913 - DNA, 20 bp, Homo sapiens
agacaaaatttaattgtgta

SEQ ID NO: 2269914 - DNA, 18 bp, Homo sapiens
agacactagtagagcaaa

SEQ ID NO: 2269915 - DNA, 17 bp, Homo sapiens
agacactcaagagccct

SEQ ID NO: 2269916 - DNA, 13 bp, Homo sapiens
agacactggtctc

SEQ ID NO: 2269917 - DNA, 17 bp, Homo sapiens
agacactggtctcagag

SEQ ID NO: 2269918 - DNA, 17 bp, Homo sapiens
agacagaaaaaaataaa

SEQ ID NO: 2269919 - DNA, 18 bp, Homo sapiens
agacagaatgagagagaa

SEQ ID NO: 2269920 - DNA, 11 bp, Homo sapiens
agacagagatc

SEQ ID NO: 2269921 - DNA, 19 bp, Homo sapiens
agacagagatggcagagcc

SEQ ID NO: 2269922 - DNA, 20 bp, Homo sapiens
agacagagatggcagagcca

SEQ ID NO: 2269923 - DNA, 21 bp, Homo sapiens
agacaggattctgacagagca

SEQ ID NO: 2269924 - DNA, 15 bp, Homo sapiens
agacagtcaggaagc

SEQ ID NO: 2269925 - DNA, 21 bp, Homo sapiens
agacagtcaggaagcctcctg

SEQ ID NO: 2269926 - DNA, 18 bp, Homo sapiens
agacagttgggatccaaa

SEQ ID NO: 2269927 - DNA, 13 bp, Homo sapiens
agacagtttgtaa

SEQ ID NO: 2269928 - DNA, 17 bp, Homo sapiens
agacagtttgtaaatgt

SEQ ID NO: 2269929 - DNA, 18 bp, Homo sapiens
agacagtttgtaaatgtt

SEQ ID NO: 2269930 - DNA, 20 bp, Homo sapiens
agacatgtatactccataga

SEQ ID NO: 2269931 - DNA, 17 bp, Homo sapiens
agaccaaatggaaacag

SEQ ID NO: 2269932 - DNA, 12 bp, Homo sapiens
agaccagcctga

SEQ ID NO: 2269933 - DNA, 18 bp, Homo sapiens
agaccaggactctgcctt

SEQ ID NO: 2269934 - DNA, 19 bp, Homo sapiens
agaccccatccagccaggg

SEQ ID NO: 2269935 - DNA, 14 bp, Homo sapiens
agacccctggggga

SEQ ID NO: 2269936 - DNA, 23 bp, Homo sapiens
agacccctgggggaggcttccag

SEQ ID NO: 2269937 - DNA, 23 bp, Homo sapiens
agaccgagtgtggagctgcttcc

SEQ ID NO: 2269938 - DNA, 21 bp, Homo sapiens
agacctccagattattttcta

SEQ ID NO: 2269939 - DNA, 12 bp, Homo sapiens
agacctccccca

SEQ ID NO: 2269940 - DNA, 17 bp, Homo sapiens
agacctcccccagggag

SEQ ID NO: 2269941 - DNA, 19 bp, Homo sapiens
agacctcccccagggaggg

SEQ ID NO: 2269942 - DNA, 19 bp, Homo sapiens
agaccttctgaagatctca

SEQ ID NO: 2269943 - DNA, 13 bp, Homo sapiens
agacgcagagcaa

SEQ ID NO: 2269944 - DNA, 13 bp, Homo sapiens
agacggcagcccc

SEQ ID NO: 2269945 - DNA, 12 bp, Homo sapiens
agactatgtgtc

SEQ ID NO: 2269946 - DNA, 20 bp, Homo sapiens
agactcaaggaagaataatt

SEQ ID NO: 2269947 - DNA, 22 bp, Homo sapiens
agactcaaggaagaataatttt

SEQ ID NO: 2269948 - DNA, 21 bp, Homo sapiens
agactcactgttaagaataga

SEQ ID NO: 2269949 - DNA, 13 bp, Homo sapiens
agactcaggccca

SEQ ID NO: 2269950 - DNA, 15 bp, Homo sapiens
agactcgcgacaatg

SEQ ID NO: 2269951 - DNA, 17 bp, Homo sapiens
agactcgcgacaatgca

SEQ ID NO: 2269952 - DNA, 19 bp, Homo sapiens
agactcgcgacaatgcaaa

SEQ ID NO: 2269953 - DNA, 21 bp, Homo sapiens
agactcgcgacaatgcaaacc

SEQ ID NO: 2269954 - DNA, 12 bp, Homo sapiens
agactgaattta

SEQ ID NO: 2269955 - DNA, 11 bp, Homo sapiens
agactgcccac

SEQ ID NO: 2269956 - DNA, 14 bp, Homo sapiens
agactgcccaccct

SEQ ID NO: 2269957 - DNA, 15 bp, Homo sapiens
agactgcccaccctg

SEQ ID NO: 2269958 - DNA, 21 bp, Homo sapiens
agactgcccaccctgggcctc

SEQ ID NO: 2269959 - DNA, 23 bp, Homo sapiens
agactgcccaccctgggcctccc

SEQ ID NO: 2269960 - DNA, 15 bp, Homo sapiens
agacttgatttacaa

SEQ ID NO: 2269961 - DNA, 20 bp, Homo sapiens
agactttaattcttctcttt

SEQ ID NO: 2269962 - DNA, 16 bp, Homo sapiens
agagaaaatgctttct

SEQ ID NO: 2269963 - DNA, 19 bp, Homo sapiens
agagaaaatgctttctcat

SEQ ID NO: 2269964 - DNA, 16 bp, Homo sapiens
agagaataatttttgt

SEQ ID NO: 2269965 - DNA, 16 bp, Homo sapiens
agagaattcactttac

SEQ ID NO: 2269966 - DNA, 22 bp, Homo sapiens
agagaattctaagattgtacat

SEQ ID NO: 2269967 - DNA, 17 bp, Homo sapiens
agagacaaagtttggaa

SEQ ID NO: 2269968 - DNA, 13 bp, Homo sapiens
agagacaaatagt

SEQ ID NO: 2269969 - DNA, 14 bp, Homo sapiens
agagacaaatagta

SEQ ID NO: 2269970 - DNA, 13 bp, Homo sapiens
agagacagggtct

SEQ ID NO: 2269971 - DNA, 15 bp, Homo sapiens
agagacccctgtctg

SEQ ID NO: 2269972 - DNA, 22 bp, Homo sapiens
agagacgaggtgtcttccttcc

SEQ ID NO: 2269973 - DNA, 20 bp, Homo sapiens
agagacggcagccccatcct

SEQ ID NO: 2269974 - DNA, 17 bp, Homo sapiens
agagactctgtgatcta

SEQ ID NO: 2269975 - DNA, 11 bp, Homo sapiens
agagagaggcc

SEQ ID NO: 2269976 - DNA, 13 bp, Homo sapiens
agagagcgcagcc

SEQ ID NO: 2269977 - DNA, 11 bp, Homo sapiens
agagaggcctg

SEQ ID NO: 2269978 - DNA, 21 bp, Homo sapiens
agagaggcctgggtgtgacct

SEQ ID NO: 2269979 - DNA, 14 bp, Homo sapiens
agagataaatattt

SEQ ID NO: 2269980 - DNA, 18 bp, Homo sapiens
agagataaatatttatgc

SEQ ID NO: 2269981 - DNA, 16 bp, Homo sapiens
agagatgtcaaaatgt

SEQ ID NO: 2269982 - DNA, 20 bp, Homo sapiens
agagatgtcaaaatgtgatt

SEQ ID NO: 2269983 - DNA, 13 bp, Homo sapiens
agagatgtgtcca

SEQ ID NO: 2269984 - DNA, 14 bp, Homo sapiens
agagattaatttgt

SEQ ID NO: 2269985 - DNA, 23 bp, Homo sapiens
agagcaaagtcatgtcagaagga

SEQ ID NO: 2269986 - DNA, 21 bp, Homo sapiens
actcgagagggctgagcccct

SEQ ID NO: 2269987 - DNA, 22 bp, Homo sapiens
actcgagagggctgagcccctc

SEQ ID NO: 2269988 - DNA, 16 bp, Homo sapiens
actcgagttacagaca

SEQ ID NO: 2269989 - DNA, 15 bp, Homo sapiens
actcgcgacaatgca

SEQ ID NO: 2269990 - DNA, 19 bp, Homo sapiens
actcgcttagctgaaacct

SEQ ID NO: 2269991 - DNA, 17 bp, Homo sapiens
actctccaggcaccgcc

SEQ ID NO: 2269992 - DNA, 22 bp, Homo sapiens
actctgaatcaaaagctgaaat

SEQ ID NO: 2269993 - DNA, 11 bp, Homo sapiens
actctgagact

SEQ ID NO: 2269994 - DNA, 15 bp, Homo sapiens
actctgccttccagg

SEQ ID NO: 2269995 - DNA, 16 bp, Homo sapiens
actctgccttccaggc

SEQ ID NO: 2269996 - DNA, 16 bp, Homo sapiens
actctggaaccatcct

SEQ ID NO: 2269997 - DNA, 19 bp, Homo sapiens
actctggaaccatcctctg

SEQ ID NO: 2269998 - DNA, 17 bp, Homo sapiens
actctgtggggccacac

SEQ ID NO: 2269999 - DNA, 17 bp, Homo sapiens
actcttgtctcctcctc

SEQ ID NO: 2270000 - DNA, 13 bp, Homo sapiens
actgaaacctctg

SEQ ID NO: 2270001 - DNA, 14 bp, Homo sapiens
actgaaatttgcta

SEQ ID NO: 2270002 - DNA, 20 bp, Homo sapiens
actgaagtaataactgatga

SEQ ID NO: 2270003 - DNA, 21 bp, Homo sapiens
actgaattgttatgtaaacat

SEQ ID NO: 2270004 - DNA, 16 bp, Homo sapiens
actgagagagcgcagc

SEQ ID NO: 2270005 - DNA, 22 bp, Homo sapiens
actgagtctcattcctctgtcc

SEQ ID NO: 2270006 - DNA, 21 bp, Homo sapiens
actgatatcacgggcccgctc

SEQ ID NO: 2270007 - DNA, 17 bp, Homo sapiens
actgatgagatacattt

SEQ ID NO: 2270008 - DNA, 21 bp, Homo sapiens
actgatgggtcctgctgctcg

SEQ ID NO: 2270009 - DNA, 16 bp, Homo sapiens
actgatgtatagcttt

SEQ ID NO: 2270010 - DNA, 18 bp, Homo sapiens
actgatttttttttcctt

SEQ ID NO: 2270011 - DNA, 23 bp, Homo sapiens
actgatttttttttccttcagtg

SEQ ID NO: 2270012 - DNA, 12 bp, Homo sapiens
actgcagcctcg

SEQ ID NO: 2270013 - DNA, 15 bp, Homo sapiens
actgccaaataaaat

SEQ ID NO: 2270014 - DNA, 16 bp, Homo sapiens
actgccaaataaaatg

SEQ ID NO: 2270015 - DNA, 20 bp, Homo sapiens
actgccaaataaaatgttta

SEQ ID NO: 2270016 - DNA, 20 bp, Homo sapiens
actgccattagactgaattt

SEQ ID NO: 2270017 - DNA, 11 bp, Homo sapiens
actgcccaccc

SEQ ID NO: 2270018 - DNA, 12 bp, Homo sapiens
actgcccaccct

SEQ ID NO: 2270019 - DNA, 14 bp, Homo sapiens
actgcccaccctgg

SEQ ID NO: 2270020 - DNA, 18 bp, Homo sapiens
actgccgctgcccccacc

SEQ ID NO: 2270021 - DNA, 20 bp, Homo sapiens
actgccgctgcccccaccct

SEQ ID NO: 2270022 - DNA, 16 bp, Homo sapiens
actgcctgcagctgag

SEQ ID NO: 2270023 - DNA, 21 bp, Homo sapiens
actgctaaggattagtccctg

SEQ ID NO: 2270024 - DNA, 19 bp, Homo sapiens
actgctagaaccaagcact

SEQ ID NO: 2270025 - DNA, 14 bp, Homo sapiens
actgcttaaggaaa

SEQ ID NO: 2270026 - DNA, 23 bp, Homo sapiens
actgctttgttttggctgctctc

SEQ ID NO: 2270027 - DNA, 14 bp, Homo sapiens
actggaaaatagtc

SEQ ID NO: 2270028 - DNA, 13 bp, Homo sapiens
actggagtagttg

SEQ ID NO: 2270029 - DNA, 16 bp, Homo sapiens
actggagtagttgcta

SEQ ID NO: 2270030 - DNA, 16 bp, Homo sapiens
actggccccaggcgga

SEQ ID NO: 2270031 - DNA, 20 bp, Homo sapiens
actggcccctaggctgctgc

SEQ ID NO: 2270032 - DNA, 19 bp, Homo sapiens
actggctgacccctccttg

SEQ ID NO: 2270033 - DNA, 18 bp, Homo sapiens
actgggaatttatttatg

SEQ ID NO: 2270034 - DNA, 20 bp, Homo sapiens
actgggtaaaagcagggcag

SEQ ID NO: 2270035 - DNA, 18 bp, Homo sapiens
actgggtgggccccacag

SEQ ID NO: 2270036 - DNA, 12 bp, Homo sapiens
actggtctcaga

SEQ ID NO: 2270037 - DNA, 17 bp, Homo sapiens
actggttttaagtgctt

SEQ ID NO: 2270038 - DNA, 15 bp, Homo sapiens
actgtaagaaatgta

SEQ ID NO: 2270039 - DNA, 17 bp, Homo sapiens
actgtaccctatgttca

SEQ ID NO: 2270040 - DNA, 15 bp, Homo sapiens
actgtagcaatatat

SEQ ID NO: 2270041 - DNA, 19 bp, Homo sapiens
actgtagcaatatatttgt

SEQ ID NO: 2270042 - DNA, 14 bp, Homo sapiens
actgtagtaattgt

SEQ ID NO: 2270043 - DNA, 18 bp, Homo sapiens
actgtataccgtgtgctc

SEQ ID NO: 2270044 - DNA, 17 bp, Homo sapiens
actgtatagacagtttg

SEQ ID NO: 2270045 - DNA, 18 bp, Homo sapiens
actgtatagacagtttgt

SEQ ID NO: 2270046 - DNA, 21 bp, Homo sapiens
actgtatagacagtttgtaaa

SEQ ID NO: 2270047 - DNA, 14 bp, Homo sapiens
actgtatatgtcaa

SEQ ID NO: 2270048 - DNA, 19 bp, Homo sapiens
actgtatatgtcaaaaata

SEQ ID NO: 2270049 - DNA, 20 bp, Homo sapiens
actgtatatgtcaaaaatat

SEQ ID NO: 2270050 - DNA, 13 bp, Homo sapiens
actgtatattatt

SEQ ID NO: 2270051 - DNA, 19 bp, Homo sapiens
actgtatctaaaaaataac

SEQ ID NO: 2270052 - DNA, 21 bp, Homo sapiens
actgtatctaaaaaataactg

SEQ ID NO: 2270053 - DNA, 23 bp, Homo sapiens
actgtcaatgaggttatgagaaa

SEQ ID NO: 2270054 - DNA, 18 bp, Homo sapiens
actgtcagagaatatgac

SEQ ID NO: 2270055 - DNA, 21 bp, Homo sapiens
actgtcataatctctttccat

SEQ ID NO: 2270056 - DNA, 20 bp, Homo sapiens
actgtgctaatgggctgctg

SEQ ID NO: 2270057 - DNA, 21 bp, Homo sapiens
actgtgctaatgggctgctgt

SEQ ID NO: 2270058 - DNA, 13 bp, Homo sapiens
actgtgctggaga

SEQ ID NO: 2270059 - DNA, 15 bp, Homo sapiens
actgtggaacactaa

SEQ ID NO: 2270060 - DNA, 18 bp, Homo sapiens
actgtggtctggtgttcc

SEQ ID NO: 2270061 - DNA, 22 bp, Homo sapiens
actgtgtactgtatagacagtt

SEQ ID NO: 2270062 - DNA, 19 bp, Homo sapiens
actgtgttacatgttgtat

SEQ ID NO: 2270063 - DNA, 16 bp, Homo sapiens
actgttaacccagtgt

SEQ ID NO: 2270064 - DNA, 13 bp, Homo sapiens
actgttctgagaa

SEQ ID NO: 2270065 - DNA, 18 bp, Homo sapiens
actgtttatggtattttc

SEQ ID NO: 2270066 - DNA, 16 bp, Homo sapiens
actgtttcttgcttgt

SEQ ID NO: 2270067 - DNA, 21 bp, Homo sapiens
actgtttcttgcttgtacctc

SEQ ID NO: 2270068 - DNA, 17 bp, Homo sapiens
actgtttgtaatataca

SEQ ID NO: 2270069 - DNA, 13 bp, Homo sapiens
actgttttcatgt

SEQ ID NO: 2270070 - DNA, 15 bp, Homo sapiens
actgtttttgaagaa

SEQ ID NO: 2270071 - DNA, 16 bp, Homo sapiens
actgtttttgaagaag

SEQ ID NO: 2270072 - DNA, 22 bp, Homo sapiens
actgtttttgaagaagggaaat

SEQ ID NO: 2270073 - DNA, 13 bp, Homo sapiens
acttaaaacatat

SEQ ID NO: 2270074 - DNA, 17 bp, Homo sapiens
acttaaacctgtgcttt

SEQ ID NO: 2270075 - DNA, 13 bp, Homo sapiens
acttaagcacact

SEQ ID NO: 2270076 - DNA, 14 bp, Homo sapiens
acttaatcatatca

SEQ ID NO: 2270077 - DNA, 13 bp, Homo sapiens
acttaattctcat

SEQ ID NO: 2270078 - DNA, 23 bp, Homo sapiens
acttaattctcattatgaagatg

SEQ ID NO: 2270079 - DNA, 15 bp, Homo sapiens
acttagcctttcttt

SEQ ID NO: 2270080 - DNA, 15 bp, Homo sapiens
acttataatttccaa

SEQ ID NO: 2270081 - DNA, 23 bp, Homo sapiens
acttataatttccaaactgttgt

SEQ ID NO: 2270082 - DNA, 22 bp, Homo sapiens
acttatcaaatcattcaaaact

SEQ ID NO: 2270083 - DNA, 15 bp, Homo sapiens
acttattttctgaat

SEQ ID NO: 2270084 - DNA, 21 bp, Homo sapiens
acttattttctgaattcataa

SEQ ID NO: 2270085 - DNA, 16 bp, Homo sapiens
acttcactttcatctg

SEQ ID NO: 2270086 - DNA, 18 bp, Homo sapiens
acttcagttctcatcttg

SEQ ID NO: 2270087 - DNA, 13 bp, Homo sapiens
acttccagatttg

SEQ ID NO: 2270088 - DNA, 15 bp, Homo sapiens
acttcccagctggca

SEQ ID NO: 2270089 - DNA, 16 bp, Homo sapiens
acttcccagctggcag

SEQ ID NO: 2270090 - DNA, 14 bp, Homo sapiens
acttctgaaactta

SEQ ID NO: 2270091 - DNA, 15 bp, Homo sapiens
acttctggggccagc

SEQ ID NO: 2270092 - DNA, 13 bp, Homo sapiens
acttgaacaagaa

SEQ ID NO: 2270093 - DNA, 16 bp, Homo sapiens
acttgacgcagccccc

SEQ ID NO: 2270094 - DNA, 18 bp, Homo sapiens
acttgatataattactta

SEQ ID NO: 2270095 - DNA, 22 bp, Homo sapiens
acttgatataattacttaatgt

SEQ ID NO: 2270096 - DNA, 15 bp, Homo sapiens
acttgcaaatgaatg

SEQ ID NO: 2270097 - DNA, 19 bp, Homo sapiens
acttgtacttacactgaaa

SEQ ID NO: 2270098 - DNA, 21 bp, Homo sapiens
acttgtacttacactgaaatc

SEQ ID NO: 2270099 - DNA, 23 bp, Homo sapiens
acttgtacttacactgaaatcca

SEQ ID NO: 2270100 - DNA, 21 bp, Homo sapiens
actttaagaagcgaacaaaaa

SEQ ID NO: 2270101 - DNA, 13 bp, Homo sapiens
actttcaggggct

SEQ ID NO: 2270102 - DNA, 22 bp, Homo sapiens
actttccctgtgtaccctccat

SEQ ID NO: 2270103 - DNA, 22 bp, Homo sapiens
actttcctgatgttgataatag

SEQ ID NO: 2270104 - DNA, 14 bp, Homo sapiens
actttcgcctcctc

SEQ ID NO: 2270105 - DNA, 14 bp, Homo sapiens
actttgccatcctt

SEQ ID NO: 2270106 - DNA, 12 bp, Homo sapiens
actttggtaatg

SEQ ID NO: 2270107 - DNA, 12 bp, Homo sapiens
actttgtgagcc

SEQ ID NO: 2270108 - DNA, 19 bp, Homo sapiens
acttttcatttttgctttt

SEQ ID NO: 2270109 - DNA, 13 bp, Homo sapiens
acttttctgcatt

SEQ ID NO: 2270110 - DNA, 16 bp, Homo sapiens
acttttctttttaaat

SEQ ID NO: 2270111 - DNA, 20 bp, Homo sapiens
acttttctttttaaatgtgc

SEQ ID NO: 2270112 - DNA, 15 bp, Homo sapiens
acttttgaaatttaa

SEQ ID NO: 2270113 - DNA, 18 bp, Homo sapiens
acttttgtgtattctgtg

SEQ ID NO: 2270114 - DNA, 14 bp, Homo sapiens
actttttcttttgt

SEQ ID NO: 2270115 - DNA, 12 bp, Homo sapiens
agaaaaaaacag

SEQ ID NO: 2270116 - DNA, 13 bp, Homo sapiens
agaaaaaaacagc

SEQ ID NO: 2270117 - DNA, 19 bp, Homo sapiens
agaaaacagaccagcatag

SEQ ID NO: 2270118 - DNA, 12 bp, Homo sapiens
agaaaagacact

SEQ ID NO: 2270119 - DNA, 16 bp, Homo sapiens
agaaaagacacttcaa

SEQ ID NO: 2270120 - DNA, 20 bp, Homo sapiens
agaaaaggtccaaaactgta

SEQ ID NO: 2270121 - DNA, 17 bp, Homo sapiens
agaaaataaaataaatt

SEQ ID NO: 2270122 - DNA, 19 bp, Homo sapiens
agaaaataaaataaattat

SEQ ID NO: 2270123 - DNA, 19 bp, Homo sapiens
acctccagattattttcta

SEQ ID NO: 2270124 - DNA, 20 bp, Homo sapiens
acctccagattattttctat

SEQ ID NO: 2270125 - DNA, 15 bp, Homo sapiens
acctcccccagggag

SEQ ID NO: 2270126 - DNA, 12 bp, Homo sapiens
acctcgccctct

SEQ ID NO: 2270127 - DNA, 20 bp, Homo sapiens
acctcgccctctctcaccag

SEQ ID NO: 2270128 - DNA, 18 bp, Homo sapiens
acctcgctccaactccaa

SEQ ID NO: 2270129 - DNA, 18 bp, Homo sapiens
acctctaggcctcagtgt

SEQ ID NO: 2270130 - DNA, 20 bp, Homo sapiens
acctctatatgttgctgaaa

SEQ ID NO: 2270131 - DNA, 14 bp, Homo sapiens
acctctcagatccc

SEQ ID NO: 2270132 - DNA, 13 bp, Homo sapiens
acctctggctgac

SEQ ID NO: 2270133 - DNA, 15 bp, Homo sapiens
acctgaagtctttgt

SEQ ID NO: 2270134 - DNA, 22 bp, Homo sapiens
acctgaagtctttgtacagaca

SEQ ID NO: 2270135 - DNA, 12 bp, Homo sapiens
acctgacacctg

SEQ ID NO: 2270136 - DNA, 20 bp, Homo sapiens
acctgacactaaccagagtc

SEQ ID NO: 2270137 - DNA, 17 bp, Homo sapiens
acctgaggcaggagggc

SEQ ID NO: 2270138 - DNA, 19 bp, Homo sapiens
acctgaggcaggagggcat

SEQ ID NO: 2270139 - DNA, 18 bp, Homo sapiens
acctgcaggactcgggct

SEQ ID NO: 2270140 - DNA, 17 bp, Homo sapiens
acctgcatttaagaaca

SEQ ID NO: 2270141 - DNA, 19 bp, Homo sapiens
acctgcccagttagcccgg

SEQ ID NO: 2270142 - DNA, 12 bp, Homo sapiens
acctgccgctgc

SEQ ID NO: 2270143 - DNA, 21 bp, Homo sapiens
acctgccgctgcttgagtgga

SEQ ID NO: 2270144 - DNA, 21 bp, Homo sapiens
acctgcctctgaactgctgct

SEQ ID NO: 2270145 - DNA, 13 bp, Homo sapiens
acctgctccagat

SEQ ID NO: 2270146 - DNA, 15 bp, Homo sapiens
acctgctccagatcc

SEQ ID NO: 2270147 - DNA, 13 bp, Homo sapiens
acctggaggctgg

SEQ ID NO: 2270148 - DNA, 13 bp, Homo sapiens
acctgggccctgg

SEQ ID NO: 2270149 - DNA, 14 bp, Homo sapiens
acctgggccctggt

SEQ ID NO: 2270150 - DNA, 22 bp, Homo sapiens
acctggttttcattattttccc

SEQ ID NO: 2270151 - DNA, 16 bp, Homo sapiens
acctgtctcagctgtt

SEQ ID NO: 2270152 - DNA, 12 bp, Homo sapiens
acctgtgctttc

SEQ ID NO: 2270153 - DNA, 19 bp, Homo sapiens
accttacttaaagcttgtt

SEQ ID NO: 2270154 - DNA, 18 bp, Homo sapiens
accttcactctccagggt

SEQ ID NO: 2270155 - DNA, 14 bp, Homo sapiens
accttcagcagtta

SEQ ID NO: 2270156 - DNA, 12 bp, Homo sapiens
accttctgaaga

SEQ ID NO: 2270157 - DNA, 15 bp, Homo sapiens
accttgaatgatgcc

SEQ ID NO: 2270158 - DNA, 23 bp, Homo sapiens
accttggcgcgcagcccgggaga

SEQ ID NO: 2270159 - DNA, 19 bp, Homo sapiens
accttgggcacgggagagc

SEQ ID NO: 2270160 - DNA, 23 bp, Homo sapiens
accttgggcacgggagagcgcca

SEQ ID NO: 2270161 - DNA, 16 bp, Homo sapiens
acctttcaataggaaa

SEQ ID NO: 2270162 - DNA, 17 bp, Homo sapiens
acctttcaataggaaaa

SEQ ID NO: 2270163 - DNA, 23 bp, Homo sapiens
acctttcaataggaaaaactgat

SEQ ID NO: 2270164 - DNA, 18 bp, Homo sapiens
acctttcatgtgcctgaa

SEQ ID NO: 2270165 - DNA, 17 bp, Homo sapiens
accttttataagacaaa

SEQ ID NO: 2270166 - DNA, 20 bp, Homo sapiens
accttttgagtgccttacac

SEQ ID NO: 2270167 - DNA, 14 bp, Homo sapiens
acgaatattgctga

SEQ ID NO: 2270168 - DNA, 18 bp, Homo sapiens
acgaatattgctgatggt

SEQ ID NO: 2270169 - DNA, 22 bp, Homo sapiens
acgaggccttcagaaaagacac

SEQ ID NO: 2270170 - DNA, 13 bp, Homo sapiens
acgatatatgtaa

SEQ ID NO: 2270171 - DNA, 18 bp, Homo sapiens
acgatgggatcattattt

SEQ ID NO: 2270172 - DNA, 22 bp, Homo sapiens
acgatgggatcattatttcatg

SEQ ID NO: 2270173 - DNA, 22 bp, Homo sapiens
acgcacttctggggccagcccc

SEQ ID NO: 2270174 - DNA, 23 bp, Homo sapiens
acgcacttctggggccagcccct

SEQ ID NO: 2270175 - DNA, 15 bp, Homo sapiens
acgcagagccccgga

SEQ ID NO: 2270176 - DNA, 16 bp, Homo sapiens
acgcagagccccggag

SEQ ID NO: 2270177 - DNA, 17 bp, Homo sapiens
acgcagagccccggagc

SEQ ID NO: 2270178 - DNA, 20 bp, Homo sapiens
acgcagagccccggagcacc

SEQ ID NO: 2270179 - DNA, 22 bp, Homo sapiens
acgcagccccccacgcttctgg

SEQ ID NO: 2270180 - DNA, 16 bp, Homo sapiens
acgcaggcatctgatt

SEQ ID NO: 2270181 - DNA, 15 bp, Homo sapiens
acgcagggagaccct

SEQ ID NO: 2270182 - DNA, 16 bp, Homo sapiens
acgcagggagaccctg

SEQ ID NO: 2270183 - DNA, 17 bp, Homo sapiens
acgcagggagaccctgg

SEQ ID NO: 2270184 - DNA, 18 bp, Homo sapiens
acgcatgaagaacagtgc

SEQ ID NO: 2270185 - DNA, 15 bp, Homo sapiens
acgccggggctggcc

SEQ ID NO: 2270186 - DNA, 11 bp, Homo sapiens
acgctggctcg

SEQ ID NO: 2270187 - DNA, 19 bp, Homo sapiens
acgcttctggaggtgggga

SEQ ID NO: 2270188 - DNA, 14 bp, Homo sapiens
acggaccctgtgtg

SEQ ID NO: 2270189 - DNA, 18 bp, Homo sapiens
acggacgggacagcggcc

SEQ ID NO: 2270190 - DNA, 21 bp, Homo sapiens
acggacgggacagcggcccgg

SEQ ID NO: 2270191 - DNA, 22 bp, Homo sapiens
acggcactgagagagcgcagcc

SEQ ID NO: 2270192 - DNA, 11 bp, Homo sapiens
acggcagcccc

SEQ ID NO: 2270193 - DNA, 14 bp, Homo sapiens
acggccgtccctga

SEQ ID NO: 2270194 - DNA, 21 bp, Homo sapiens
acggccgtccctgacttccca

SEQ ID NO: 2270195 - DNA, 21 bp, Homo sapiens
acgggacagcggcccggccca

SEQ ID NO: 2270196 - DNA, 21 bp, Homo sapiens
acgggagagcgccacccgccc

SEQ ID NO: 2270197 - DNA, 12 bp, Homo sapiens
acggggcagagc

SEQ ID NO: 2270198 - DNA, 13 bp, Homo sapiens
acggggcagagct

SEQ ID NO: 2270199 - DNA, 19 bp, Homo sapiens
acggtctaaacacacttag

SEQ ID NO: 2270200 - DNA, 17 bp, Homo sapiens
acggtggctcacacctg

SEQ ID NO: 2270201 - DNA, 23 bp, Homo sapiens
acggtggctcacacctgtaatcc

SEQ ID NO: 2270202 - DNA, 17 bp, Homo sapiens
acgtctttagatgctat

SEQ ID NO: 2270203 - DNA, 22 bp, Homo sapiens
acgtgctcttctgttctcaaat

SEQ ID NO: 2270204 - DNA, 22 bp, Homo sapiens
acgtggagagaagttgccctcc

SEQ ID NO: 2270205 - DNA, 15 bp, Homo sapiens
acgtggcacctcctc

SEQ ID NO: 2270206 - DNA, 11 bp, Homo sapiens
acgtggctgct

SEQ ID NO: 2270207 - DNA, 13 bp, Homo sapiens
acgtggctgcttc

SEQ ID NO: 2270208 - DNA, 15 bp, Homo sapiens
acgtggctgcttcaa

SEQ ID NO: 2270209 - DNA, 21 bp, Homo sapiens
acgtggctgcttcaaggatcc

SEQ ID NO: 2270210 - DNA, 16 bp, Homo sapiens
actaaaaatatgaaat

SEQ ID NO: 2270211 - DNA, 12 bp, Homo sapiens
actaaaattcaa

SEQ ID NO: 2270212 - DNA, 17 bp, Homo sapiens
actaaaattcaacaaat

SEQ ID NO: 2270213 - DNA, 13 bp, Homo sapiens
actaaaatttaaa

SEQ ID NO: 2270214 - DNA, 12 bp, Homo sapiens
actaaactaaaa

SEQ ID NO: 2270215 - DNA, 15 bp, Homo sapiens
actaaataaaacaat

SEQ ID NO: 2270216 - DNA, 22 bp, Homo sapiens
actaaataatgatcttccaaat

SEQ ID NO: 2270217 - DNA, 19 bp, Homo sapiens
actaaatttggggacagat

SEQ ID NO: 2270218 - DNA, 23 bp, Homo sapiens
actaacataaagaaacactttct

SEQ ID NO: 2270219 - DNA, 20 bp, Homo sapiens
actaagaataaataaagaag

SEQ ID NO: 2270220 - DNA, 15 bp, Homo sapiens
actaagaatataaat

SEQ ID NO: 2270221 - DNA, 19 bp, Homo sapiens
actaaggcaggtgggcaga

SEQ ID NO: 2270222 - DNA, 12 bp, Homo sapiens
actacattaaaa

SEQ ID NO: 2270223 - DNA, 16 bp, Homo sapiens
actacattaaaagctt

SEQ ID NO: 2270224 - DNA, 18 bp, Homo sapiens
actacattaaaagcttta

SEQ ID NO: 2270225 - DNA, 16 bp, Homo sapiens
actagaatgagaaatc

SEQ ID NO: 2270226 - DNA, 16 bp, Homo sapiens
actagagactctgtga

SEQ ID NO: 2270227 - DNA, 11 bp, Homo sapiens
actagatctcc

SEQ ID NO: 2270228 - DNA, 14 bp, Homo sapiens
actagatctcctgt

SEQ ID NO: 2270229 - DNA, 22 bp, Homo sapiens
actagcaaacaaaaatagaata

SEQ ID NO: 2270230 - DNA, 14 bp, Homo sapiens
actagctaattagc

SEQ ID NO: 2270231 - DNA, 18 bp, Homo sapiens
actagtttttcctgtgca

SEQ ID NO: 2270232 - DNA, 23 bp, Homo sapiens
actataatttacctgaagtcttt

SEQ ID NO: 2270233 - DNA, 15 bp, Homo sapiens
actatcggttcaagt

SEQ ID NO: 2270234 - DNA, 19 bp, Homo sapiens
actatcggttcaagttgat

SEQ ID NO: 2270235 - DNA, 17 bp, Homo sapiens
actatggctgtattttt

SEQ ID NO: 2270236 - DNA, 14 bp, Homo sapiens
actatgggtgagca

SEQ ID NO: 2270237 - DNA, 16 bp, Homo sapiens
actatgtaagggcttt

SEQ ID NO: 2270238 - DNA, 23 bp, Homo sapiens
actatgtaagggctttaaataaa

SEQ ID NO: 2270239 - DNA, 17 bp, Homo sapiens
actatttcaataagtgt

SEQ ID NO: 2270240 - DNA, 21 bp, Homo sapiens
actcaagagcccttccaggag

SEQ ID NO: 2270241 - DNA, 22 bp, Homo sapiens
actcaaggaagaataattttaa

SEQ ID NO: 2270242 - DNA, 19 bp, Homo sapiens
actcacaatcatcttctcc

SEQ ID NO: 2270243 - DNA, 15 bp, Homo sapiens
actcaccaaaatata

SEQ ID NO: 2270244 - DNA, 14 bp, Homo sapiens
actcactgcctgca

SEQ ID NO: 2270245 - DNA, 18 bp, Homo sapiens
actcactgcctgcagctg

SEQ ID NO: 2270246 - DNA, 22 bp, Homo sapiens
actcagtgggccaattgttctt

SEQ ID NO: 2270247 - DNA, 15 bp, Homo sapiens
actccaacatccact

SEQ ID NO: 2270248 - DNA, 17 bp, Homo sapiens
actccagaatttcccaa

SEQ ID NO: 2270249 - DNA, 17 bp, Homo sapiens
actccaggaaaactgtt

SEQ ID NO: 2270250 - DNA, 18 bp, Homo sapiens
actccaggaaaactgttt

SEQ ID NO: 2270251 - DNA, 18 bp, Homo sapiens
actccattactaaagaca

SEQ ID NO: 2270252 - DNA, 17 bp, Homo sapiens
actcccagggcccgagc

SEQ ID NO: 2270253 - DNA, 19 bp, Homo sapiens
actcccagggcccgagcgc

SEQ ID NO: 2270254 - DNA, 15 bp, Homo sapiens
actccgactccccct

SEQ ID NO: 2270255 - DNA, 18 bp, Homo sapiens
actccgactccccctccc

SEQ ID NO: 2270256 - DNA, 20 bp, Homo sapiens
actcctcaactgatgataga

SEQ ID NO: 2270257 - DNA, 20 bp, Homo sapiens
actcctgccccggcccaacc

SEQ ID NO: 2270258 - DNA, 16 bp, Homo sapiens
actcctgggccccaga

SEQ ID NO: 2270259 - DNA, 24 bp, Homo sapiens
actcctttctaaggagcactagaa

SEQ ID NO: 2270260 - DNA, 13 bp, Homo sapiens
acagtttgtaaat

SEQ ID NO: 2270261 - DNA, 16 bp, Homo sapiens
acagtttttgtaacca

SEQ ID NO: 2270262 - DNA, 18 bp, Homo sapiens
acataaaagaatgtacag

SEQ ID NO: 2270263 - DNA, 13 bp, Homo sapiens
acataaaatatac

SEQ ID NO: 2270264 - DNA, 19 bp, Homo sapiens
acataaagtaataactgtt

SEQ ID NO: 2270265 - DNA, 21 bp, Homo sapiens
acataatatcttgaagaatat

SEQ ID NO: 2270266 - DNA, 22 bp, Homo sapiens
acatacctctctctatatatac

SEQ ID NO: 2270267 - DNA, 14 bp, Homo sapiens
acatatacatctag

SEQ ID NO: 2270268 - DNA, 13 bp, Homo sapiens
acatatatctgat

SEQ ID NO: 2270269 - DNA, 21 bp, Homo sapiens
acatattcttgctttcacaaa

SEQ ID NO: 2270270 - DNA, 18 bp, Homo sapiens
acatcataaatagtaaat

SEQ ID NO: 2270271 - DNA, 14 bp, Homo sapiens
acatccgctttatg

SEQ ID NO: 2270272 - DNA, 14 bp, Homo sapiens
acatctgaaaagaa

SEQ ID NO: 2270273 - DNA, 18 bp, Homo sapiens
acatctgtatatcagctc

SEQ ID NO: 2270274 - DNA, 15 bp, Homo sapiens
acatgagtaaagcag

SEQ ID NO: 2270275 - DNA, 19 bp, Homo sapiens
acatggaacttaaaacata

SEQ ID NO: 2270276 - DNA, 14 bp, Homo sapiens
acatgtaaaaatgt

SEQ ID NO: 2270277 - DNA, 15 bp, Homo sapiens
acatgtaaaaatgtt

SEQ ID NO: 2270278 - DNA, 23 bp, Homo sapiens
acatgtatactccatagaaacta

SEQ ID NO: 2270279 - DNA, 15 bp, Homo sapiens
acatgtatagtgagt

SEQ ID NO: 2270280 - DNA, 18 bp, Homo sapiens
acatgtatgatttctgtt

SEQ ID NO: 2270281 - DNA, 13 bp, Homo sapiens
acattaattttat

SEQ ID NO: 2270282 - DNA, 16 bp, Homo sapiens
acattatcctgtgtga

SEQ ID NO: 2270283 - DNA, 17 bp, Homo sapiens
acattctgctgccccca

SEQ ID NO: 2270284 - DNA, 23 bp, Homo sapiens
acattgcaggaagagatgctcta

SEQ ID NO: 2270285 - DNA, 22 bp, Homo sapiens
acattgcccacacctgcctctg

SEQ ID NO: 2270286 - DNA, 14 bp, Homo sapiens
acatttaaaatagt

SEQ ID NO: 2270287 - DNA, 17 bp, Homo sapiens
acatttaaaatagtttt

SEQ ID NO: 2270288 - DNA, 20 bp, Homo sapiens
acatttaaaatagttttcta

SEQ ID NO: 2270289 - DNA, 23 bp, Homo sapiens
acatttaaaatagttttctaaat

SEQ ID NO: 2270290 - DNA, 20 bp, Homo sapiens
acatttagaacctgcattta

SEQ ID NO: 2270291 - DNA, 20 bp, Homo sapiens
acatttagtccaatgaagat

SEQ ID NO: 2270292 - DNA, 21 bp, Homo sapiens
acatttcatccaccaatatca

SEQ ID NO: 2270293 - DNA, 15 bp, Homo sapiens
acatttcatttatac

SEQ ID NO: 2270294 - DNA, 21 bp, Homo sapiens
acatttgatttgatatacaga

SEQ ID NO: 2270295 - DNA, 18 bp, Homo sapiens
acatttgtcactgaataa

SEQ ID NO: 2270296 - DNA, 22 bp, Homo sapiens
acattttaaaaataaatgaaaa

SEQ ID NO: 2270297 - DNA, 13 bp, Homo sapiens
acattttaaaatc

SEQ ID NO: 2270298 - DNA, 15 bp, Homo sapiens
acattttaaaatcaa

SEQ ID NO: 2270299 - DNA, 18 bp, Homo sapiens
acattttaaaatcaactt

SEQ ID NO: 2270300 - DNA, 14 bp, Homo sapiens
acattttgtttcca

SEQ ID NO: 2270301 - DNA, 14 bp, Homo sapiens
accaaaaaatgtga

SEQ ID NO: 2270302 - DNA, 16 bp, Homo sapiens
accaactatttcaata

SEQ ID NO: 2270303 - DNA, 17 bp, Homo sapiens
accaagatcacaaatag

SEQ ID NO: 2270304 - DNA, 15 bp, Homo sapiens
accaagcactaccag

SEQ ID NO: 2270305 - DNA, 18 bp, Homo sapiens
accaagggtatctgctgc

SEQ ID NO: 2270306 - DNA, 13 bp, Homo sapiens
accaatatcatgt

SEQ ID NO: 2270307 - DNA, 12 bp, Homo sapiens
accaatcatctt

SEQ ID NO: 2270308 - DNA, 23 bp, Homo sapiens
accaatggctgcatcaaatgcat

SEQ ID NO: 2270309 - DNA, 23 bp, Homo sapiens
accacggggtcgggggaggagca

SEQ ID NO: 2270310 - DNA, 16 bp, Homo sapiens
accactcaagaccaaa

SEQ ID NO: 2270311 - DNA, 23 bp, Homo sapiens
accactgtttcttgcttgtacct

SEQ ID NO: 2270312 - DNA, 12 bp, Homo sapiens
accagcactccc

SEQ ID NO: 2270313 - DNA, 14 bp, Homo sapiens
accagcactcccag

SEQ ID NO: 2270314 - DNA, 18 bp, Homo sapiens
accagcactcccagggcc

SEQ ID NO: 2270315 - DNA, 23 bp, Homo sapiens
accagcactcccagggcccgagc

SEQ ID NO: 2270316 - DNA, 14 bp, Homo sapiens
accagcctgagcca

SEQ ID NO: 2270317 - DNA, 20 bp, Homo sapiens
accagctgccaaaatcgtag

SEQ ID NO: 2270318 - DNA, 23 bp, Homo sapiens
accaggtcctgtgagcaaagtgc

SEQ ID NO: 2270319 - DNA, 19 bp, Homo sapiens
accaggtgttaaaaaccat

SEQ ID NO: 2270320 - DNA, 16 bp, Homo sapiens
accagttatgataacc

SEQ ID NO: 2270321 - DNA, 18 bp, Homo sapiens
accataaaataaataatc

SEQ ID NO: 2270322 - DNA, 14 bp, Homo sapiens
accatagaactgtc

SEQ ID NO: 2270323 - DNA, 15 bp, Homo sapiens
accatatgattgaaa

SEQ ID NO: 2270324 - DNA, 18 bp, Homo sapiens
accatatgattgaaaaga

SEQ ID NO: 2270325 - DNA, 23 bp, Homo sapiens
accatatgattgaaaagaagaaa

SEQ ID NO: 2270326 - DNA, 12 bp, Homo sapiens
accatcattgaa

SEQ ID NO: 2270327 - DNA, 15 bp, Homo sapiens
accatcattgaaatc

SEQ ID NO: 2270328 - DNA, 14 bp, Homo sapiens
accatcccactgat

SEQ ID NO: 2270329 - DNA, 15 bp, Homo sapiens
accatgttgcccaga

SEQ ID NO: 2270330 - DNA, 14 bp, Homo sapiens
accattataaaatc

SEQ ID NO: 2270331 - DNA, 15 bp, Homo sapiens
accattggaatggac

SEQ ID NO: 2270332 - DNA, 17 bp, Homo sapiens
accatttcttatggaaa

SEQ ID NO: 2270333 - DNA, 22 bp, Homo sapiens
accattttgctgtcccttttcc

SEQ ID NO: 2270334 - DNA, 15 bp, Homo sapiens
acccaaataaatgtg

SEQ ID NO: 2270335 - DNA, 15 bp, Homo sapiens
acccaagcacaaact

SEQ ID NO: 2270336 - DNA, 22 bp, Homo sapiens
acccaagtcttgagcaatgttt

SEQ ID NO: 2270337 - DNA, 22 bp, Homo sapiens
acccacaccccgtctgcccctt

SEQ ID NO: 2270338 - DNA, 21 bp, Homo sapiens
acccaggtgatgttagtgttt

SEQ ID NO: 2270339 - DNA, 18 bp, Homo sapiens
accccaaaggggcctctc

SEQ ID NO: 2270340 - DNA, 19 bp, Homo sapiens
accccacacgccggggctg

SEQ ID NO: 2270341 - DNA, 22 bp, Homo sapiens
accccacacgccggggctggcc

SEQ ID NO: 2270342 - DNA, 23 bp, Homo sapiens
accccacacgccggggctggccc

SEQ ID NO: 2270343 - DNA, 16 bp, Homo sapiens
accccatccagccagg

SEQ ID NO: 2270344 - DNA, 17 bp, Homo sapiens
accccattctgggactg

SEQ ID NO: 2270345 - DNA, 16 bp, Homo sapiens
acccccacctcccggt

SEQ ID NO: 2270346 - DNA, 18 bp, Homo sapiens
acccccactttcgcctcc

SEQ ID NO: 2270347 - DNA, 12 bp, Homo sapiens
acccccagcctc

SEQ ID NO: 2270348 - DNA, 14 bp, Homo sapiens
acccccgggtgcct

SEQ ID NO: 2270349 - DNA, 13 bp, Homo sapiens
accccgctgcctg

SEQ ID NO: 2270350 - DNA, 18 bp, Homo sapiens
accccgtcccggccccgc

SEQ ID NO: 2270351 - DNA, 19 bp, Homo sapiens
accccgtcccggccccgcg

SEQ ID NO: 2270352 - DNA, 15 bp, Homo sapiens
accccgtctgcccct

SEQ ID NO: 2270353 - DNA, 17 bp, Homo sapiens
accccgtgaagcatcca

SEQ ID NO: 2270354 - DNA, 15 bp, Homo sapiens
acccctcctccttgc

SEQ ID NO: 2270355 - DNA, 15 bp, Homo sapiens
acccctgggggaggc

SEQ ID NO: 2270356 - DNA, 20 bp, Homo sapiens
acccctgggggaggcttcca

SEQ ID NO: 2270357 - DNA, 22 bp, Homo sapiens
acccctgggggaggcttccagc

SEQ ID NO: 2270358 - DNA, 15 bp, Homo sapiens
acccgccccagagac

SEQ ID NO: 2270359 - DNA, 23 bp, Homo sapiens
acccgccccagagactgcccacc

SEQ ID NO: 2270360 - DNA, 14 bp, Homo sapiens
acccgcccgccccc

SEQ ID NO: 2270361 - DNA, 17 bp, Homo sapiens
acccgcccgcccccgcc

SEQ ID NO: 2270362 - DNA, 17 bp, Homo sapiens
accctagtgatttttgg

SEQ ID NO: 2270363 - DNA, 13 bp, Homo sapiens
accctctgctgca

SEQ ID NO: 2270364 - DNA, 15 bp, Homo sapiens
accctctgctgcaca

SEQ ID NO: 2270365 - DNA, 16 bp, Homo sapiens
accctctggggccctt

SEQ ID NO: 2270366 - DNA, 18 bp, Homo sapiens
accctgaggagtgatggg

SEQ ID NO: 2270367 - DNA, 22 bp, Homo sapiens
accctgagggtttccaccttgg

SEQ ID NO: 2270368 - DNA, 14 bp, Homo sapiens
accctgccaccctc

SEQ ID NO: 2270369 - DNA, 14 bp, Homo sapiens
accctgcttctgct

SEQ ID NO: 2270370 - DNA, 15 bp, Homo sapiens
accctgcttctgctg

SEQ ID NO: 2270371 - DNA, 18 bp, Homo sapiens
accctgcttctgctgcct

SEQ ID NO: 2270372 - DNA, 19 bp, Homo sapiens
accctgcttctgctgcctg

SEQ ID NO: 2270373 - DNA, 20 bp, Homo sapiens
accctgcttctgctgcctgt

SEQ ID NO: 2270374 - DNA, 12 bp, Homo sapiens
accctggagtgg

SEQ ID NO: 2270375 - DNA, 15 bp, Homo sapiens
accctggagtggcat

SEQ ID NO: 2270376 - DNA, 10 bp, Homo sapiens
acccttttct

SEQ ID NO: 2270377 - DNA, 20 bp, Homo sapiens
accgaaaacgtggctgcttc

SEQ ID NO: 2270378 - DNA, 11 bp, Homo sapiens
accgaggactc

SEQ ID NO: 2270379 - DNA, 16 bp, Homo sapiens
accgaggactccaggg

SEQ ID NO: 2270380 - DNA, 19 bp, Homo sapiens
accgagtgtggagctgctt

SEQ ID NO: 2270381 - DNA, 23 bp, Homo sapiens
accgagtgtggagctgcttccag

SEQ ID NO: 2270382 - DNA, 19 bp, Homo sapiens
accgccatgcatgatgggt

SEQ ID NO: 2270383 - DNA, 19 bp, Homo sapiens
accgcccaacccccacctc

SEQ ID NO: 2270384 - DNA, 14 bp, Homo sapiens
accgcccacccaca

SEQ ID NO: 2270385 - DNA, 16 bp, Homo sapiens
accggcccgccacctt

SEQ ID NO: 2270386 - DNA, 19 bp, Homo sapiens
accgggagcctgcgtggcc

SEQ ID NO: 2270387 - DNA, 20 bp, Homo sapiens
accggttatcagttggacag

SEQ ID NO: 2270388 - DNA, 17 bp, Homo sapiens
acctaaatccattttct

SEQ ID NO: 2270389 - DNA, 20 bp, Homo sapiens
acctaaatccattttctaaa

SEQ ID NO: 2270390 - DNA, 21 bp, Homo sapiens
acctaaatccattttctaaac

SEQ ID NO: 2270391 - DNA, 13 bp, Homo sapiens
acctaaatgaata

SEQ ID NO: 2270392 - DNA, 12 bp, Homo sapiens
acctacagcctc

SEQ ID NO: 2270393 - DNA, 14 bp, Homo sapiens
acctcaaactgggt

SEQ ID NO: 2270394 - DNA, 15 bp, Homo sapiens
acctcaatttatgtt

SEQ ID NO: 2270395 - DNA, 14 bp, Homo sapiens
acctcactcagcac

SEQ ID NO: 2270396 - DNA, 19 bp, Homo sapiens
acctcatgccgctgtgtct

SEQ ID NO: 2270397 - DNA, 17 bp, Homo sapiens
acaaatttttactcagg

SEQ ID NO: 2270398 - DNA, 18 bp, Homo sapiens
acaaatttttactcaggc

SEQ ID NO: 2270399 - DNA, 19 bp, Homo sapiens
acaacaaagtgcttccttt

SEQ ID NO: 2270400 - DNA, 15 bp, Homo sapiens
acaacaacttaatgt

SEQ ID NO: 2270401 - DNA, 17 bp, Homo sapiens
acaacagaaacttctca

SEQ ID NO: 2270402 - DNA, 15 bp, Homo sapiens
acaactccaggaaaa

SEQ ID NO: 2270403 - DNA, 21 bp, Homo sapiens
acaactccaggaaaactgttt

SEQ ID NO: 2270404 - DNA, 22 bp, Homo sapiens
acaactgccaaataaaatgttt

SEQ ID NO: 2270405 - DNA, 17 bp, Homo sapiens
acaactgtttttgaaga

SEQ ID NO: 2270406 - DNA, 12 bp, Homo sapiens
acaacttccaga

SEQ ID NO: 2270407 - DNA, 14 bp, Homo sapiens
acaacttccagatt

SEQ ID NO: 2270408 - DNA, 18 bp, Homo sapiens
acaacttgatacttttat

SEQ ID NO: 2270409 - DNA, 11 bp, Homo sapiens
acaacttttct

SEQ ID NO: 2270410 - DNA, 13 bp, Homo sapiens
acaacttttctgc

SEQ ID NO: 2270411 - DNA, 19 bp, Homo sapiens
acaagaaaaagtagaaaaa

SEQ ID NO: 2270412 - DNA, 18 bp, Homo sapiens
acaagcatcatggatcaa

SEQ ID NO: 2270413 - DNA, 17 bp, Homo sapiens
acaagccacgttgcaga

SEQ ID NO: 2270414 - DNA, 19 bp, Homo sapiens
acaagccacgttgcagaaa

SEQ ID NO: 2270415 - DNA, 12 bp, Homo sapiens
acaaggcaaggc

SEQ ID NO: 2270416 - DNA, 15 bp, Homo sapiens
acaaggcaaggctgt

SEQ ID NO: 2270417 - DNA, 15 bp, Homo sapiens
acaaggggtggaagg

SEQ ID NO: 2270418 - DNA, 22 bp, Homo sapiens
acaaggggtggaagggcaggag

SEQ ID NO: 2270419 - DNA, 23 bp, Homo sapiens
acaaggggtggaagggcaggagc

SEQ ID NO: 2270420 - DNA, 16 bp, Homo sapiens
acaagtgaaaactgat

SEQ ID NO: 2270421 - DNA, 15 bp, Homo sapiens
acaagtgctctttcc

SEQ ID NO: 2270422 - DNA, 16 bp, Homo sapiens
acaagtttatgtggca

SEQ ID NO: 2270423 - DNA, 19 bp, Homo sapiens
acaatatccaatgaagaag

SEQ ID NO: 2270424 - DNA, 19 bp, Homo sapiens
acaatatgtgttttttaat

SEQ ID NO: 2270425 - DNA, 17 bp, Homo sapiens
acaatgcaaaccatcat

SEQ ID NO: 2270426 - DNA, 23 bp, Homo sapiens
acaatgcaaaccatcattgaaat

SEQ ID NO: 2270427 - DNA, 18 bp, Homo sapiens
acaatggtagctctgaag

SEQ ID NO: 2270428 - DNA, 19 bp, Homo sapiens
acaatggtagctctgaagg

SEQ ID NO: 2270429 - DNA, 14 bp, Homo sapiens
acaattcagtttta

SEQ ID NO: 2270430 - DNA, 14 bp, Homo sapiens
acaattcttttgaa

SEQ ID NO: 2270431 - DNA, 15 bp, Homo sapiens
acaattcttttgaaa

SEQ ID NO: 2270432 - DNA, 16 bp, Homo sapiens
acaattgaaattttta

SEQ ID NO: 2270433 - DNA, 20 bp, Homo sapiens
acaatttagccagaatgttt

SEQ ID NO: 2270434 - DNA, 13 bp, Homo sapiens
acacaaaggggat

SEQ ID NO: 2270435 - DNA, 13 bp, Homo sapiens
acacacttagaat

SEQ ID NO: 2270436 - DNA, 12 bp, Homo sapiens
acacagcagctc

SEQ ID NO: 2270437 - DNA, 14 bp, Homo sapiens
acacagcagctcca

SEQ ID NO: 2270438 - DNA, 16 bp, Homo sapiens
acacagcagctccaac

SEQ ID NO: 2270439 - DNA, 23 bp, Homo sapiens
acaccaaattctgtggctgccat

SEQ ID NO: 2270440 - DNA, 19 bp, Homo sapiens
acaccccctttccatctgt

SEQ ID NO: 2270441 - DNA, 16 bp, Homo sapiens
acaccccgtctgcccc

SEQ ID NO: 2270442 - DNA, 18 bp, Homo sapiens
acaccccgtctgcccctt

SEQ ID NO: 2270443 - DNA, 21 bp, Homo sapiens
acaccgcaccgggctggcctg

SEQ ID NO: 2270444 - DNA, 17 bp, Homo sapiens
acacctgccgctgcttg

SEQ ID NO: 2270445 - DNA, 19 bp, Homo sapiens
acacctgccgctgcttgag

SEQ ID NO: 2270446 - DNA, 13 bp, Homo sapiens
acacctgtaatcc

SEQ ID NO: 2270447 - DNA, 15 bp, Homo sapiens
acacctttatctcaa

SEQ ID NO: 2270448 - DNA, 19 bp, Homo sapiens
acacctttatctcaagata

SEQ ID NO: 2270449 - DNA, 15 bp, Homo sapiens
acacgaatattgctg

SEQ ID NO: 2270450 - DNA, 18 bp, Homo sapiens
acacgccggggctggccc

SEQ ID NO: 2270451 - DNA, 21 bp, Homo sapiens
acacgccggggctggccctgc

SEQ ID NO: 2270452 - DNA, 22 bp, Homo sapiens
acacgccggggctggccctgcc

SEQ ID NO: 2270453 - DNA, 12 bp, Homo sapiens
acacggcctctg

SEQ ID NO: 2270454 - DNA, 10 bp, Homo sapiens
acactaaaat

SEQ ID NO: 2270455 - DNA, 22 bp, Homo sapiens
acactaatgaggaaactgcact

SEQ ID NO: 2270456 - DNA, 15 bp, Homo sapiens
acactacaaatgtta

SEQ ID NO: 2270457 - DNA, 17 bp, Homo sapiens
acactgatgggtcctgc

SEQ ID NO: 2270458 - DNA, 22 bp, Homo sapiens
acactgatgggtcctgctgctc

SEQ ID NO: 2270459 - DNA, 15 bp, Homo sapiens
acactgtactgcaat

SEQ ID NO: 2270460 - DNA, 15 bp, Homo sapiens
acactgtatctaaaa

SEQ ID NO: 2270461 - DNA, 18 bp, Homo sapiens
acactgtatctaaaaaat

SEQ ID NO: 2270462 - DNA, 20 bp, Homo sapiens
acactgtatctaaaaaataa

SEQ ID NO: 2270463 - DNA, 14 bp, Homo sapiens
acactgtcaatgag

SEQ ID NO: 2270464 - DNA, 16 bp, Homo sapiens
acactgtggaacacta

SEQ ID NO: 2270465 - DNA, 15 bp, Homo sapiens
acactgtggtgtctc

SEQ ID NO: 2270466 - DNA, 14 bp, Homo sapiens
acacttaactaaaa

SEQ ID NO: 2270467 - DNA, 13 bp, Homo sapiens
acacttagaatac

SEQ ID NO: 2270468 - DNA, 16 bp, Homo sapiens
acacttagaatactac

SEQ ID NO: 2270469 - DNA, 14 bp, Homo sapiens
acacttattttctg

SEQ ID NO: 2270470 - DNA, 21 bp, Homo sapiens
acacttattttctgaattcat

SEQ ID NO: 2270471 - DNA, 15 bp, Homo sapiens
acagaaccagcactc

SEQ ID NO: 2270472 - DNA, 16 bp, Homo sapiens
acagaaccagcactcc

SEQ ID NO: 2270473 - DNA, 20 bp, Homo sapiens
acagaaccagcactcccagg

SEQ ID NO: 2270474 - DNA, 16 bp, Homo sapiens
acagaagcctgtttca

SEQ ID NO: 2270475 - DNA, 22 bp, Homo sapiens
acagaccagcatagttctgcaa

SEQ ID NO: 2270476 - DNA, 20 bp, Homo sapiens
acagacggacgggacagcgg

SEQ ID NO: 2270477 - DNA, 22 bp, Homo sapiens
acagacggacgggacagcggcc

SEQ ID NO: 2270478 - DNA, 15 bp, Homo sapiens
acagagatggcagag

SEQ ID NO: 2270479 - DNA, 16 bp, Homo sapiens
acagagatggcagagc

SEQ ID NO: 2270480 - DNA, 17 bp, Homo sapiens
acagagatggcagagcc

SEQ ID NO: 2270481 - DNA, 21 bp, Homo sapiens
acagagccctatctatgtcct

SEQ ID NO: 2270482 - DNA, 15 bp, Homo sapiens
acagaggaccagcac

SEQ ID NO: 2270483 - DNA, 20 bp, Homo sapiens
acagaggaccagcacactcc

SEQ ID NO: 2270484 - DNA, 21 bp, Homo sapiens
acagaggaccagcacactccc

SEQ ID NO: 2270485 - DNA, 22 bp, Homo sapiens
acagataaaaagtggaatttct

SEQ ID NO: 2270486 - DNA, 17 bp, Homo sapiens
acagatgagaagactag

SEQ ID NO: 2270487 - DNA, 21 bp, Homo sapiens
acagatgggtgtcccctggtg

SEQ ID NO: 2270488 - DNA, 14 bp, Homo sapiens
acagattcagtctt

SEQ ID NO: 2270489 - DNA, 17 bp, Homo sapiens
acagattcagtcttgcc

SEQ ID NO: 2270490 - DNA, 21 bp, Homo sapiens
acagcaaataaaacagtgaaa

SEQ ID NO: 2270491 - DNA, 22 bp, Homo sapiens
acagcactttcctgttgcactg

SEQ ID NO: 2270492 - DNA, 13 bp, Homo sapiens
acagcagctccaa

SEQ ID NO: 2270493 - DNA, 22 bp, Homo sapiens
acagcagctccaacctggaggc

SEQ ID NO: 2270494 - DNA, 14 bp, Homo sapiens
acagcagctggact

SEQ ID NO: 2270495 - DNA, 15 bp, Homo sapiens
acagcagctggactg

SEQ ID NO: 2270496 - DNA, 19 bp, Homo sapiens
acagcatagggtccacttt

SEQ ID NO: 2270497 - DNA, 22 bp, Homo sapiens
acagcatccccaaaacaaagtc

SEQ ID NO: 2270498 - DNA, 17 bp, Homo sapiens
acagcatgagattgtac

SEQ ID NO: 2270499 - DNA, 17 bp, Homo sapiens
acagccccttgcttcta

SEQ ID NO: 2270500 - DNA, 15 bp, Homo sapiens
acagcctcacccctg

SEQ ID NO: 2270501 - DNA, 14 bp, Homo sapiens
acagcctcttcctc

SEQ ID NO: 2270502 - DNA, 16 bp, Homo sapiens
acagcctgaaggaatt

SEQ ID NO: 2270503 - DNA, 22 bp, Homo sapiens
acagcctttgcgctctgggttt

SEQ ID NO: 2270504 - DNA, 13 bp, Homo sapiens
acagcggcccggc

SEQ ID NO: 2270505 - DNA, 14 bp, Homo sapiens
acagcggcccggcc

SEQ ID NO: 2270506 - DNA, 20 bp, Homo sapiens
acagcggcccggcccacgca

SEQ ID NO: 2270507 - DNA, 14 bp, Homo sapiens
acagctaacatgga

SEQ ID NO: 2270508 - DNA, 18 bp, Homo sapiens
acagctcattcgctccag

SEQ ID NO: 2270509 - DNA, 16 bp, Homo sapiens
acaggaacacccagcc

SEQ ID NO: 2270510 - DNA, 23 bp, Homo sapiens
acaggagggtatggtgctgctct

SEQ ID NO: 2270511 - DNA, 17 bp, Homo sapiens
acaggaggtgtgaatgc

SEQ ID NO: 2270512 - DNA, 18 bp, Homo sapiens
acaggattgtctgctgcc

SEQ ID NO: 2270513 - DNA, 15 bp, Homo sapiens
acaggcaacattaca

SEQ ID NO: 2270514 - DNA, 18 bp, Homo sapiens
acaggcaacattacaaac

SEQ ID NO: 2270515 - DNA, 16 bp, Homo sapiens
acaggcccatgccctc

SEQ ID NO: 2270516 - DNA, 20 bp, Homo sapiens
acaggccgcacatctcactt

SEQ ID NO: 2270517 - DNA, 19 bp, Homo sapiens
acaggctgccccacccctc

SEQ ID NO: 2270518 - DNA, 21 bp, Homo sapiens
acaggggcaaaagtcattgct

SEQ ID NO: 2270519 - DNA, 12 bp, Homo sapiens
acagggtctcac

SEQ ID NO: 2270520 - DNA, 16 bp, Homo sapiens
acagggtctcactgtg

SEQ ID NO: 2270521 - DNA, 18 bp, Homo sapiens
acagggtctcactgtgtt

SEQ ID NO: 2270522 - DNA, 15 bp, Homo sapiens
acaggtcttctttaa

SEQ ID NO: 2270523 - DNA, 13 bp, Homo sapiens
acaggtgtaaata

SEQ ID NO: 2270524 - DNA, 17 bp, Homo sapiens
acaggtgttcctcctcc

SEQ ID NO: 2270525 - DNA, 19 bp, Homo sapiens
acagtaaaacaggctgctt

SEQ ID NO: 2270526 - DNA, 21 bp, Homo sapiens
acagtagctgtggggagctgg

SEQ ID NO: 2270527 - DNA, 22 bp, Homo sapiens
acagtagctgtggggagctggt

SEQ ID NO: 2270528 - DNA, 14 bp, Homo sapiens
acagtagtgttggg

SEQ ID NO: 2270529 - DNA, 18 bp, Homo sapiens
acagtctcattacagatt

SEQ ID NO: 2270530 - DNA, 20 bp, Homo sapiens
acagtggcaagctaccaact

SEQ ID NO: 2270531 - DNA, 14 bp, Homo sapiens
acagtggggcccat

SEQ ID NO: 2270532 - DNA, 22 bp, Homo sapiens
acagtggggcccatggccccag

SEQ ID NO: 2270533 - DNA, 13 bp, Homo sapiens
acagttatacata

SEQ ID NO: 2270534 - DNA, 22 bp, Homo sapiens
aatgcaaaccatcattgaaatc

SEQ ID NO: 2270535 - DNA, 23 bp, Homo sapiens
aatgcaaaccatcattgaaatct

SEQ ID NO: 2270536 - DNA, 21 bp, Homo sapiens
aatgcaattagatagaaaagg

SEQ ID NO: 2270537 - DNA, 17 bp, Homo sapiens
aatgcatgatgactctt

SEQ ID NO: 2270538 - DNA, 14 bp, Homo sapiens
aatgctaaatgcaa

SEQ ID NO: 2270539 - DNA, 16 bp, Homo sapiens
aatgctattttaaaat

SEQ ID NO: 2270540 - DNA, 18 bp, Homo sapiens
aatgctgttcagaaatat

SEQ ID NO: 2270541 - DNA, 19 bp, Homo sapiens
aatgctgttggtgagaatc

SEQ ID NO: 2270542 - DNA, 16 bp, Homo sapiens
aatgctttctctcctc

SEQ ID NO: 2270543 - DNA, 18 bp, Homo sapiens
aatggaaacagaggacca

SEQ ID NO: 2270544 - DNA, 15 bp, Homo sapiens
aatggagtccagacc

SEQ ID NO: 2270545 - DNA, 17 bp, Homo sapiens
aatggatatgaaagaga

SEQ ID NO: 2270546 - DNA, 20 bp, Homo sapiens
aatgggagtgaacatttcta

SEQ ID NO: 2270547 - DNA, 13 bp, Homo sapiens
aatgggctgctgt

SEQ ID NO: 2270548 - DNA, 19 bp, Homo sapiens
aatggtagctctgaaggga

SEQ ID NO: 2270549 - DNA, 20 bp, Homo sapiens
aatggtagctctgaagggag

SEQ ID NO: 2270550 - DNA, 21 bp, Homo sapiens
aatggtagctctgaagggagg

SEQ ID NO: 2270551 - DNA, 16 bp, Homo sapiens
aatggttttcttgtgt

SEQ ID NO: 2270552 - DNA, 17 bp, Homo sapiens
aatgtaagttatgtgtt

SEQ ID NO: 2270553 - DNA, 13 bp, Homo sapiens
aatgtaatcattt

SEQ ID NO: 2270554 - DNA, 20 bp, Homo sapiens
aatgtaccatgttgcccaga

SEQ ID NO: 2270555 - DNA, 13 bp, Homo sapiens
aatgtactgtatt

SEQ ID NO: 2270556 - DNA, 15 bp, Homo sapiens
aatgtagttgatgta

SEQ ID NO: 2270557 - DNA, 16 bp, Homo sapiens
aatgtagttgatgtat

SEQ ID NO: 2270558 - DNA, 12 bp, Homo sapiens
aatgtatcttat

SEQ ID NO: 2270559 - DNA, 14 bp, Homo sapiens
aatgtatcttattt

SEQ ID NO: 2270560 - DNA, 15 bp, Homo sapiens
aatgtatcttattta

SEQ ID NO: 2270561 - DNA, 17 bp, Homo sapiens
aatgtattcttttatat

SEQ ID NO: 2270562 - DNA, 18 bp, Homo sapiens
aatgtattcttttatata

SEQ ID NO: 2270563 - DNA, 22 bp, Homo sapiens
aatgtattcttttatataacta

SEQ ID NO: 2270564 - DNA, 12 bp, Homo sapiens
aatgtcaaggca

SEQ ID NO: 2270565 - DNA, 17 bp, Homo sapiens
aatgtcagtgtgactga

SEQ ID NO: 2270566 - DNA, 21 bp, Homo sapiens
aatgtcagtgtgactgatctc

SEQ ID NO: 2270567 - DNA, 16 bp, Homo sapiens
aatgtccccattctat

SEQ ID NO: 2270568 - DNA, 17 bp, Homo sapiens
aatgtccccattctata

SEQ ID NO: 2270569 - DNA, 19 bp, Homo sapiens
aatgtccccattctataaa

SEQ ID NO: 2270570 - DNA, 22 bp, Homo sapiens
aatgtctccattgttaaatgtt

SEQ ID NO: 2270571 - DNA, 20 bp, Homo sapiens
aatgtgaaataaagagttct

SEQ ID NO: 2270572 - DNA, 21 bp, Homo sapiens
aatgtgatgcttgatataata

SEQ ID NO: 2270573 - DNA, 18 bp, Homo sapiens
aatgtgccaaaatgtcaa

SEQ ID NO: 2270574 - DNA, 21 bp, Homo sapiens
aatgtgcttttccatctaaaa

SEQ ID NO: 2270575 - DNA, 22 bp, Homo sapiens
aatgtgcttttccatctaaaat

SEQ ID NO: 2270576 - DNA, 16 bp, Homo sapiens
aatgtgtcaaagagat

SEQ ID NO: 2270577 - DNA, 20 bp, Homo sapiens
aatgtgtcaaagagatgagg

SEQ ID NO: 2270578 - DNA, 14 bp, Homo sapiens
aatgttaacaactt

SEQ ID NO: 2270579 - DNA, 11 bp, Homo sapiens
aatgttaacat

SEQ ID NO: 2270580 - DNA, 14 bp, Homo sapiens
aatgttaacatgcg

SEQ ID NO: 2270581 - DNA, 16 bp, Homo sapiens
aatgttatatcatcaa

SEQ ID NO: 2270582 - DNA, 13 bp, Homo sapiens
aatgttgttaaat

SEQ ID NO: 2270583 - DNA, 18 bp, Homo sapiens
aatgttgttaaatgctat

SEQ ID NO: 2270584 - DNA, 15 bp, Homo sapiens
aatgtttacattttc

SEQ ID NO: 2270585 - DNA, 22 bp, Homo sapiens
aatgtttacattttctttcata

SEQ ID NO: 2270586 - DNA, 14 bp, Homo sapiens
aatgtttccaggca

SEQ ID NO: 2270587 - DNA, 17 bp, Homo sapiens
aatgtttcctgtggaaa

SEQ ID NO: 2270588 - DNA, 12 bp, Homo sapiens
aatgtttctttt

SEQ ID NO: 2270589 - DNA, 23 bp, Homo sapiens
aatgtttctttttcttttttgag

SEQ ID NO: 2270590 - DNA, 23 bp, Homo sapiens
aattaatattttggcagatgata

SEQ ID NO: 2270591 - DNA, 11 bp, Homo sapiens
aattacaggaa

SEQ ID NO: 2270592 - DNA, 17 bp, Homo sapiens
aattacaggaaatgcaa

SEQ ID NO: 2270593 - DNA, 17 bp, Homo sapiens
aattacttaatgtgatg

SEQ ID NO: 2270594 - DNA, 14 bp, Homo sapiens
aattagatagaaaa

SEQ ID NO: 2270595 - DNA, 22 bp, Homo sapiens
aattagctctcgcctcaggctt

SEQ ID NO: 2270596 - DNA, 14 bp, Homo sapiens
aattaggtaatgga

SEQ ID NO: 2270597 - DNA, 14 bp, Homo sapiens
aattataaatgttt

SEQ ID NO: 2270598 - DNA, 22 bp, Homo sapiens
aattatatcagagtatgtcagt

SEQ ID NO: 2270599 - DNA, 18 bp, Homo sapiens
aattatgaaaatgtaagt

SEQ ID NO: 2270600 - DNA, 20 bp, Homo sapiens
aattatgaaaatgtaagtta

SEQ ID NO: 2270601 - DNA, 17 bp, Homo sapiens
aattatgctaacaaact

SEQ ID NO: 2270602 - DNA, 23 bp, Homo sapiens
aattatgctaacaaactgaaaaa

SEQ ID NO: 2270603 - DNA, 14 bp, Homo sapiens
aattattctagtca

SEQ ID NO: 2270604 - DNA, 22 bp, Homo sapiens
aattattctagtcaactgctgt

SEQ ID NO: 2270605 - DNA, 23 bp, Homo sapiens
aattatttaactaattaaaaaat

SEQ ID NO: 2270606 - DNA, 16 bp, Homo sapiens
aattcaacaaatgatg

SEQ ID NO: 2270607 - DNA, 19 bp, Homo sapiens
aattcaacaaatgatgttg

SEQ ID NO: 2270608 - DNA, 16 bp, Homo sapiens
aattcaacacttattt

SEQ ID NO: 2270609 - DNA, 21 bp, Homo sapiens
aattcagtcctgggcaaaggt

SEQ ID NO: 2270610 - DNA, 17 bp, Homo sapiens
aattcagttgttagtgt

SEQ ID NO: 2270611 - DNA, 22 bp, Homo sapiens
aattcagttgttagtgtgtctt

SEQ ID NO: 2270612 - DNA, 19 bp, Homo sapiens
aattcagttttagtttcaa

SEQ ID NO: 2270613 - DNA, 21 bp, Homo sapiens
aattcagttttagtttcaaaa

SEQ ID NO: 2270614 - DNA, 16 bp, Homo sapiens
aattcataaaaataac

SEQ ID NO: 2270615 - DNA, 19 bp, Homo sapiens
aattcatatcatttggccg

SEQ ID NO: 2270616 - DNA, 16 bp, Homo sapiens
aattcatatttatgaa

SEQ ID NO: 2270617 - DNA, 20 bp, Homo sapiens
aattcatggaactttcatac

SEQ ID NO: 2270618 - DNA, 12 bp, Homo sapiens
aattcatttaag

SEQ ID NO: 2270619 - DNA, 22 bp, Homo sapiens
aattcccatctgctttattgcc

SEQ ID NO: 2270620 - DNA, 16 bp, Homo sapiens
aattctagtctctgat

SEQ ID NO: 2270621 - DNA, 17 bp, Homo sapiens
aattctagtctctgatt

SEQ ID NO: 2270622 - DNA, 18 bp, Homo sapiens
aattctagtctgtttcat

SEQ ID NO: 2270623 - DNA, 20 bp, Homo sapiens
aattctcagaattacaggaa

SEQ ID NO: 2270624 - DNA, 17 bp, Homo sapiens
aattctcattatgaaga

SEQ ID NO: 2270625 - DNA, 17 bp, Homo sapiens
aattctgtggctgccat

SEQ ID NO: 2270626 - DNA, 17 bp, Homo sapiens
aattcttttcctctctt

SEQ ID NO: 2270627 - DNA, 20 bp, Homo sapiens
aattgaaatttttaaatcat

SEQ ID NO: 2270628 - DNA, 22 bp, Homo sapiens
aattgcacgtttggtgaaagtt

SEQ ID NO: 2270629 - DNA, 12 bp, Homo sapiens
aattgtaaggaa

SEQ ID NO: 2270630 - DNA, 16 bp, Homo sapiens
aattgtaaggaatgat

SEQ ID NO: 2270631 - DNA, 17 bp, Homo sapiens
aattgtgccaaagatag

SEQ ID NO: 2270632 - DNA, 13 bp, Homo sapiens
aattgtgtaactg

SEQ ID NO: 2270633 - DNA, 17 bp, Homo sapiens
aattgtgtaactgttct

SEQ ID NO: 2270634 - DNA, 15 bp, Homo sapiens
aattgtgttcttaaa

SEQ ID NO: 2270635 - DNA, 16 bp, Homo sapiens
aattgttacaattttc

SEQ ID NO: 2270636 - DNA, 19 bp, Homo sapiens
aattgttatgtaaacatca

SEQ ID NO: 2270637 - DNA, 16 bp, Homo sapiens
aattgttcaaaaataa

SEQ ID NO: 2270638 - DNA, 15 bp, Homo sapiens
aattgtttaaaagca

SEQ ID NO: 2270639 - DNA, 22 bp, Homo sapiens
aatttaaaaatctttcagaata

SEQ ID NO: 2270640 - DNA, 15 bp, Homo sapiens
aatttaactgcatat

SEQ ID NO: 2270641 - DNA, 18 bp, Homo sapiens
aatttaactgcatataga

SEQ ID NO: 2270642 - DNA, 22 bp, Homo sapiens
aatttaactgcatatagataat

SEQ ID NO: 2270643 - DNA, 20 bp, Homo sapiens
aatttaattgtgtaactgtt

SEQ ID NO: 2270644 - DNA, 15 bp, Homo sapiens
aatttacctgaagtc

SEQ ID NO: 2270645 - DNA, 13 bp, Homo sapiens
aatttatttatgt

SEQ ID NO: 2270646 - DNA, 22 bp, Homo sapiens
aatttcaaagaaaacagaccag

SEQ ID NO: 2270647 - DNA, 16 bp, Homo sapiens
aatttcaaagtatgtt

SEQ ID NO: 2270648 - DNA, 18 bp, Homo sapiens
aatttccatgatacaaag

SEQ ID NO: 2270649 - DNA, 17 bp, Homo sapiens
aatttcccaaagcagtg

SEQ ID NO: 2270650 - DNA, 15 bp, Homo sapiens
aatttctaatttcaa

SEQ ID NO: 2270651 - DNA, 16 bp, Homo sapiens
aatttgccagacagag

SEQ ID NO: 2270652 - DNA, 16 bp, Homo sapiens
aatttgctatataatt

SEQ ID NO: 2270653 - DNA, 13 bp, Homo sapiens
aatttgtgaatat

SEQ ID NO: 2270654 - DNA, 20 bp, Homo sapiens
aattttaaaaaataacatat

SEQ ID NO: 2270655 - DNA, 13 bp, Homo sapiens
aattttaatgtaa

SEQ ID NO: 2270656 - DNA, 17 bp, Homo sapiens
acaaaaaatattcatct

SEQ ID NO: 2270657 - DNA, 22 bp, Homo sapiens
acaaaaagtaatgtatatctgt

SEQ ID NO: 2270658 - DNA, 14 bp, Homo sapiens
acaaaaatagaata

SEQ ID NO: 2270659 - DNA, 17 bp, Homo sapiens
acaaaaatagaatatat

SEQ ID NO: 2270660 - DNA, 14 bp, Homo sapiens
acaaaactggatag

SEQ ID NO: 2270661 - DNA, 16 bp, Homo sapiens
acaaaacttataattt

SEQ ID NO: 2270662 - DNA, 12 bp, Homo sapiens
acaaaaggctgg

SEQ ID NO: 2270663 - DNA, 18 bp, Homo sapiens
acaaacagaaacgagatt

SEQ ID NO: 2270664 - DNA, 17 bp, Homo sapiens
acaaacctctatatgtt

SEQ ID NO: 2270665 - DNA, 21 bp, Homo sapiens
acaaacctgtttctgcagcca

SEQ ID NO: 2270666 - DNA, 14 bp, Homo sapiens
acaaactgaaaaat

SEQ ID NO: 2270667 - DNA, 16 bp, Homo sapiens
acaaagaaggcacagg

SEQ ID NO: 2270668 - DNA, 16 bp, Homo sapiens
acaaagggcaggcctg

SEQ ID NO: 2270669 - DNA, 21 bp, Homo sapiens
acaaaggggatcataaagtta

SEQ ID NO: 2270670 - DNA, 14 bp, Homo sapiens
acaaatgttaaagt

SEQ ID NO: 2270671 - DNA, 16 bp, Homo sapiens
aagttgctaacctcaa

SEQ ID NO: 2270672 - DNA, 22 bp, Homo sapiens
aagttgtattttaataaagatt

SEQ ID NO: 2270673 - DNA, 20 bp, Homo sapiens
aagtttatgtggcacacaat

SEQ ID NO: 2270674 - DNA, 12 bp, Homo sapiens
aagtttccttat

SEQ ID NO: 2270675 - DNA, 22 bp, Homo sapiens
aagtttggaagtacataaagta

SEQ ID NO: 2270676 - DNA, 19 bp, Homo sapiens
aagtttgtctacactaaaa

SEQ ID NO: 2270677 - DNA, 19 bp, Homo sapiens
aataaaataccttttatgt

SEQ ID NO: 2270678 - DNA, 16 bp, Homo sapiens
aataaaatgagttacc

SEQ ID NO: 2270679 - DNA, 12 bp, Homo sapiens
aataaagaaaaa

SEQ ID NO: 2270680 - DNA, 20 bp, Homo sapiens
aataaagaaaaaaatagttt

SEQ ID NO: 2270681 - DNA, 21 bp, Homo sapiens
aataaagaaaaaaatagtttt

SEQ ID NO: 2270682 - DNA, 12 bp, Homo sapiens
aataaagaagaa

SEQ ID NO: 2270683 - DNA, 16 bp, Homo sapiens
aataaataaaaataat

SEQ ID NO: 2270684 - DNA, 14 bp, Homo sapiens
aataaataaagaag

SEQ ID NO: 2270685 - DNA, 17 bp, Homo sapiens
aataaataaagaagaaa

SEQ ID NO: 2270686 - DNA, 18 bp, Homo sapiens
aataacaacaacttaatg

SEQ ID NO: 2270687 - DNA, 20 bp, Homo sapiens
aataacaacaacttaatgtg

SEQ ID NO: 2270688 - DNA, 14 bp, Homo sapiens
aataacctttttgt

SEQ ID NO: 2270689 - DNA, 22 bp, Homo sapiens
aataacttagaatgcttcaagt

SEQ ID NO: 2270690 - DNA, 15 bp, Homo sapiens
aataagcgtttaatg

SEQ ID NO: 2270691 - DNA, 19 bp, Homo sapiens
aataagcgtttaatggtat

SEQ ID NO: 2270692 - DNA, 17 bp, Homo sapiens
aataagttgactttcaa

SEQ ID NO: 2270693 - DNA, 12 bp, Homo sapiens
aataatactaat

SEQ ID NO: 2270694 - DNA, 11 bp, Homo sapiens
aataatgattt

SEQ ID NO: 2270695 - DNA, 14 bp, Homo sapiens
aataatgatttaag

SEQ ID NO: 2270696 - DNA, 16 bp, Homo sapiens
aataattacttaatgt

SEQ ID NO: 2270697 - DNA, 18 bp, Homo sapiens
aataattagctatatttt

SEQ ID NO: 2270698 - DNA, 19 bp, Homo sapiens
aataatttagatattcata

SEQ ID NO: 2270699 - DNA, 14 bp, Homo sapiens
aataattttaacag

SEQ ID NO: 2270700 - DNA, 14 bp, Homo sapiens
aataatttttgtgg

SEQ ID NO: 2270701 - DNA, 18 bp, Homo sapiens
aatacataaaagaatgta

SEQ ID NO: 2270702 - DNA, 16 bp, Homo sapiens
aataccaactatttca

SEQ ID NO: 2270703 - DNA, 19 bp, Homo sapiens
aatacgcaggcatctgatt

SEQ ID NO: 2270704 - DNA, 17 bp, Homo sapiens
aatacttccttataaaa

SEQ ID NO: 2270705 - DNA, 18 bp, Homo sapiens
aatacttccttataaaaa

SEQ ID NO: 2270706 - DNA, 19 bp, Homo sapiens
aatacttttgtgtattctg

SEQ ID NO: 2270707 - DNA, 21 bp, Homo sapiens
aatacttttgtgtattctgtg

SEQ ID NO: 2270708 - DNA, 13 bp, Homo sapiens
aatagaaaactgt

SEQ ID NO: 2270709 - DNA, 14 bp, Homo sapiens
aatagcttttattg

SEQ ID NO: 2270710 - DNA, 23 bp, Homo sapiens
aatagcttttattgagtaatatt

SEQ ID NO: 2270711 - DNA, 16 bp, Homo sapiens
aataggaaaaactgat

SEQ ID NO: 2270712 - DNA, 19 bp, Homo sapiens
aataggaaaaactgatttt

SEQ ID NO: 2270713 - DNA, 23 bp, Homo sapiens
aatagtaaataatgattcaatgt

SEQ ID NO: 2270714 - DNA, 21 bp, Homo sapiens
aatagtaatggttctagaagg

SEQ ID NO: 2270715 - DNA, 17 bp, Homo sapiens
aatagtacatgcagaaa

SEQ ID NO: 2270716 - DNA, 18 bp, Homo sapiens
aatagtaggctaaaaaca

SEQ ID NO: 2270717 - DNA, 19 bp, Homo sapiens
aatagtaggctaaaaacat

SEQ ID NO: 2270718 - DNA, 19 bp, Homo sapiens
aatagtcctccaaaacaca

SEQ ID NO: 2270719 - DNA, 23 bp, Homo sapiens
aatagtgttgatcagatcttaca

SEQ ID NO: 2270720 - DNA, 18 bp, Homo sapiens
aatagttctatttctatc

SEQ ID NO: 2270721 - DNA, 20 bp, Homo sapiens
aatagttctatttctatctg

SEQ ID NO: 2270722 - DNA, 23 bp, Homo sapiens
aatagttctatttctatctgcaa

SEQ ID NO: 2270723 - DNA, 21 bp, Homo sapiens
aatagtttaaaaatattccct

SEQ ID NO: 2270724 - DNA, 14 bp, Homo sapiens
aatagttttctaaa

SEQ ID NO: 2270725 - DNA, 21 bp, Homo sapiens
aatagttttctaaatgtttct

SEQ ID NO: 2270726 - DNA, 12 bp, Homo sapiens
aatataaacttg

SEQ ID NO: 2270727 - DNA, 20 bp, Homo sapiens
aatataatattatactgcta

SEQ ID NO: 2270728 - DNA, 20 bp, Homo sapiens
aatatacagcatgagattgt

SEQ ID NO: 2270729 - DNA, 23 bp, Homo sapiens
aatatacagcatgagattgtaca

SEQ ID NO: 2270730 - DNA, 21 bp, Homo sapiens
aatatagttaattgtggcttt

SEQ ID NO: 2270731 - DNA, 22 bp, Homo sapiens
aatatagttaattgtggcttta

SEQ ID NO: 2270732 - DNA, 16 bp, Homo sapiens
aatatagttgaacaag

SEQ ID NO: 2270733 - DNA, 17 bp, Homo sapiens
aatatagttgaacaaga

SEQ ID NO: 2270734 - DNA, 18 bp, Homo sapiens
aatatagttgaacaagat

SEQ ID NO: 2270735 - DNA, 19 bp, Homo sapiens
aatatataaacgatatatg

SEQ ID NO: 2270736 - DNA, 15 bp, Homo sapiens
aatatatacataaaa

SEQ ID NO: 2270737 - DNA, 21 bp, Homo sapiens
aatatatatatatatcagttt

SEQ ID NO: 2270738 - DNA, 17 bp, Homo sapiens
aatatccaatgaagaag

SEQ ID NO: 2270739 - DNA, 14 bp, Homo sapiens
aatatgaaagccta

SEQ ID NO: 2270740 - DNA, 18 bp, Homo sapiens
aatatgaatatatacata

SEQ ID NO: 2270741 - DNA, 13 bp, Homo sapiens
aatatgacagaat

SEQ ID NO: 2270742 - DNA, 16 bp, Homo sapiens
aatatgtacttttcca

SEQ ID NO: 2270743 - DNA, 14 bp, Homo sapiens
aatattacatttca

SEQ ID NO: 2270744 - DNA, 17 bp, Homo sapiens
aatattagccaaagagg

SEQ ID NO: 2270745 - DNA, 18 bp, Homo sapiens
aatattatacttctttat

SEQ ID NO: 2270746 - DNA, 12 bp, Homo sapiens
aatattcatctg

SEQ ID NO: 2270747 - DNA, 18 bp, Homo sapiens
aatattctaaaaaagata

SEQ ID NO: 2270748 - DNA, 22 bp, Homo sapiens
aatattgctattgtttatagga

SEQ ID NO: 2270749 - DNA, 15 bp, Homo sapiens
aatattgctgatggt

SEQ ID NO: 2270750 - DNA, 16 bp, Homo sapiens
aatattgtgtaagaat

SEQ ID NO: 2270751 - DNA, 12 bp, Homo sapiens
aatattgttaaa

SEQ ID NO: 2270752 - DNA, 22 bp, Homo sapiens
aatattgttaaaaccttactta

SEQ ID NO: 2270753 - DNA, 22 bp, Homo sapiens
aatatttctaagcttatttcta

SEQ ID NO: 2270754 - DNA, 16 bp, Homo sapiens
aatatttgcttattta

SEQ ID NO: 2270755 - DNA, 18 bp, Homo sapiens
aatattttgcaagctctg

SEQ ID NO: 2270756 - DNA, 12 bp, Homo sapiens
aatattttgtat

SEQ ID NO: 2270757 - DNA, 16 bp, Homo sapiens
aatattttgtattatt

SEQ ID NO: 2270758 - DNA, 16 bp, Homo sapiens
aatatttttatgtgaa

SEQ ID NO: 2270759 - DNA, 14 bp, Homo sapiens
aatcaaaagtcctt

SEQ ID NO: 2270760 - DNA, 20 bp, Homo sapiens
aatcaaaagtccttagaatg

SEQ ID NO: 2270761 - DNA, 18 bp, Homo sapiens
aatcaaagacatttcatc

SEQ ID NO: 2270762 - DNA, 22 bp, Homo sapiens
aatcaatttaaaggaaagttct

SEQ ID NO: 2270763 - DNA, 23 bp, Homo sapiens
aatcaccgaaaacgtggctgctt

SEQ ID NO: 2270764 - DNA, 23 bp, Homo sapiens
aatcacctttccaaggccccacc

SEQ ID NO: 2270765 - DNA, 16 bp, Homo sapiens
aatcatatcaacttaa

SEQ ID NO: 2270766 - DNA, 17 bp, Homo sapiens
aatcatatgtgatctgt

SEQ ID NO: 2270767 - DNA, 23 bp, Homo sapiens
aatcatatgtgatctgtcttgta

SEQ ID NO: 2270768 - DNA, 15 bp, Homo sapiens
aatcatcttctccca

SEQ ID NO: 2270769 - DNA, 13 bp, Homo sapiens
aatcattcaaaac

SEQ ID NO: 2270770 - DNA, 18 bp, Homo sapiens
aatcattcaaaactttca

SEQ ID NO: 2270771 - DNA, 20 bp, Homo sapiens
aatccaaaatagtcatgttt

SEQ ID NO: 2270772 - DNA, 15 bp, Homo sapiens
aatccatatcagctc

SEQ ID NO: 2270773 - DNA, 17 bp, Homo sapiens
aatccatatcagctctg

SEQ ID NO: 2270774 - DNA, 19 bp, Homo sapiens
aatcccacttatcaaatca

SEQ ID NO: 2270775 - DNA, 18 bp, Homo sapiens
aatcctgggcatccccag

SEQ ID NO: 2270776 - DNA, 21 bp, Homo sapiens
aatcctgggcatccccagccc

SEQ ID NO: 2270777 - DNA, 16 bp, Homo sapiens
aatcgcttgaacccag

SEQ ID NO: 2270778 - DNA, 13 bp, Homo sapiens
aatctacgtcttt

SEQ ID NO: 2270779 - DNA, 18 bp, Homo sapiens
aatctaggaaattagttg

SEQ ID NO: 2270780 - DNA, 19 bp, Homo sapiens
aatctattttctatgtact

SEQ ID NO: 2270781 - DNA, 20 bp, Homo sapiens
aatctattttctatgtacta

SEQ ID NO: 2270782 - DNA, 13 bp, Homo sapiens
aatctctgtgact

SEQ ID NO: 2270783 - DNA, 16 bp, Homo sapiens
aatctgttagcattat

SEQ ID NO: 2270784 - DNA, 19 bp, Homo sapiens
aatctgttagcattattgc

SEQ ID NO: 2270785 - DNA, 19 bp, Homo sapiens
aatctgtttctatgtccaa

SEQ ID NO: 2270786 - DNA, 20 bp, Homo sapiens
aatctgtttctatgtccaaa

SEQ ID NO: 2270787 - DNA, 18 bp, Homo sapiens
aatcttagtgaatgggaa

SEQ ID NO: 2270788 - DNA, 18 bp, Homo sapiens
aatcttggccctattcat

SEQ ID NO: 2270789 - DNA, 16 bp, Homo sapiens
aatctttcagaataca

SEQ ID NO: 2270790 - DNA, 16 bp, Homo sapiens
aatctttccatctcat

SEQ ID NO: 2270791 - DNA, 12 bp, Homo sapiens
aatgaaaacaat

SEQ ID NO: 2270792 - DNA, 13 bp, Homo sapiens
aatgaaatatttg

SEQ ID NO: 2270793 - DNA, 19 bp, Homo sapiens
aatgaactgtatattattg

SEQ ID NO: 2270794 - DNA, 18 bp, Homo sapiens
aatgaagataaatgcttt

SEQ ID NO: 2270795 - DNA, 23 bp, Homo sapiens
aatgaagataaatgctttaaata

SEQ ID NO: 2270796 - DNA, 14 bp, Homo sapiens
aatgacctttcaat

SEQ ID NO: 2270797 - DNA, 17 bp, Homo sapiens
aatgacctttcaatagg

SEQ ID NO: 2270798 - DNA, 17 bp, Homo sapiens
aatgaggttatgagaaa

SEQ ID NO: 2270799 - DNA, 13 bp, Homo sapiens
aatgagttacctc

SEQ ID NO: 2270800 - DNA, 19 bp, Homo sapiens
aatgagtttaaaaaaataa

SEQ ID NO: 2270801 - DNA, 21 bp, Homo sapiens
aatgagtttaaaaaaataaca

SEQ ID NO: 2270802 - DNA, 22 bp, Homo sapiens
aatgagtttaaaaaaataacat

SEQ ID NO: 2270803 - DNA, 20 bp, Homo sapiens
aatgatgccatgaggaacaa

SEQ ID NO: 2270804 - DNA, 15 bp, Homo sapiens
aatgatggcagagga

SEQ ID NO: 2270805 - DNA, 16 bp, Homo sapiens
aatgattcatttttct

SEQ ID NO: 2270806 - DNA, 12 bp, Homo sapiens
aatgcaaaccat

SEQ ID NO: 2270807 - DNA, 15 bp, Homo sapiens
aggaaatcaccgaaa

SEQ ID NO: 2270808 - DNA, 19 bp, Homo sapiens
aggaacaaggcaaggctgt

SEQ ID NO: 2270809 - DNA, 20 bp, Homo sapiens
aggaacaaggcaaggctgtc

SEQ ID NO: 2270810 - DNA, 15 bp, Homo sapiens
aggaagagccagccg

SEQ ID NO: 2270811 - DNA, 16 bp, Homo sapiens
aggaagaggggcgctg

SEQ ID NO: 2270812 - DNA, 22 bp, Homo sapiens
aggacaaggggtggaagggcag

SEQ ID NO: 2270813 - DNA, 23 bp, Homo sapiens
aggacactgatgggtcctgctgc

SEQ ID NO: 2270814 - DNA, 21 bp, Homo sapiens
aggacaggccagtagggggag

SEQ ID NO: 2270815 - DNA, 17 bp, Homo sapiens
aggaccccatctgctga

SEQ ID NO: 2270816 - DNA, 18 bp, Homo sapiens
aggaccccatctgctgag

SEQ ID NO: 2270817 - DNA, 18 bp, Homo sapiens
aggaccccattctgggac

SEQ ID NO: 2270818 - DNA, 18 bp, Homo sapiens
aggacgcagggagaccct

SEQ ID NO: 2270819 - DNA, 21 bp, Homo sapiens
aggactccaggggctggggac

SEQ ID NO: 2270820 - DNA, 20 bp, Homo sapiens
aggagaatcgcttgaaccca

SEQ ID NO: 2270821 - DNA, 21 bp, Homo sapiens
aggagacactggtctcagagg

SEQ ID NO: 2270822 - DNA, 19 bp, Homo sapiens
aggagacagtcaggaagcc

SEQ ID NO: 2270823 - DNA, 19 bp, Homo sapiens
aggagactcaggcccacat

SEQ ID NO: 2270824 - DNA, 20 bp, Homo sapiens
aggagaggtgataatgaatg

SEQ ID NO: 2270825 - DNA, 15 bp, Homo sapiens
aggagcacccccagc

SEQ ID NO: 2270826 - DNA, 19 bp, Homo sapiens
aggagcacccccagcctcc

SEQ ID NO: 2270827 - DNA, 21 bp, Homo sapiens
aggagcacccccagcctcccc

SEQ ID NO: 2270828 - DNA, 22 bp, Homo sapiens
aggagcacccccagcctccccc

SEQ ID NO: 2270829 - DNA, 21 bp, Homo sapiens
aggaggagacagtcaggaagc

SEQ ID NO: 2270830 - DNA, 18 bp, Homo sapiens
aggaggcagtggcttgga

SEQ ID NO: 2270831 - DNA, 20 bp, Homo sapiens
aggaggcagtggcttggagc

SEQ ID NO: 2270832 - DNA, 19 bp, Homo sapiens
aggaggggagcaaggctgc

SEQ ID NO: 2270833 - DNA, 18 bp, Homo sapiens
aggagggtttgggcagag

SEQ ID NO: 2270834 - DNA, 19 bp, Homo sapiens
aggagggtttgggcagagc

SEQ ID NO: 2270835 - DNA, 22 bp, Homo sapiens
aggagtgatgggcaaggggcca

SEQ ID NO: 2270836 - DNA, 20 bp, Homo sapiens
aggagtggctgaccaggccc

SEQ ID NO: 2270837 - DNA, 22 bp, Homo sapiens
aggagtggctgaccaggccctg

SEQ ID NO: 2270838 - DNA, 21 bp, Homo sapiens
aggagtgggtgggacacagag

SEQ ID NO: 2270839 - DNA, 15 bp, Homo sapiens
aggagttgtctgtcc

SEQ ID NO: 2270840 - DNA, 16 bp, Homo sapiens
aggagttgtctgtcct

SEQ ID NO: 2270841 - DNA, 18 bp, Homo sapiens
aggagttgtctgtcctgg

SEQ ID NO: 2270842 - DNA, 15 bp, Homo sapiens
aggatcctgagccag

SEQ ID NO: 2270843 - DNA, 23 bp, Homo sapiens
aggatgaggaacctcaaactggg

SEQ ID NO: 2270844 - DNA, 14 bp, Homo sapiens
aggatggcgtgtcc

SEQ ID NO: 2270845 - DNA, 15 bp, Homo sapiens
aggatgggggctcct

SEQ ID NO: 2270846 - DNA, 17 bp, Homo sapiens
aggattaatctctaaaa

SEQ ID NO: 2270847 - DNA, 20 bp, Homo sapiens
aggattaatctctaaaattc

SEQ ID NO: 2270848 - DNA, 19 bp, Homo sapiens
aggattctgacagagcaag

SEQ ID NO: 2270849 - DNA, 23 bp, Homo sapiens
aggattcttttttcaatgtactg

SEQ ID NO: 2270850 - DNA, 21 bp, Homo sapiens
aggattgtctgctgcctccaa

SEQ ID NO: 2270851 - DNA, 22 bp, Homo sapiens
aggattgtctgctgcctccaag

SEQ ID NO: 2270852 - DNA, 15 bp, Homo sapiens
aggatttgaaaacac

SEQ ID NO: 2270853 - DNA, 19 bp, Homo sapiens
aggatttggctcgctgtgg

SEQ ID NO: 2270854 - DNA, 20 bp, Homo sapiens
aggcaacattacaaacaaag

SEQ ID NO: 2270855 - DNA, 20 bp, Homo sapiens
aggcaccgcctgcccccagc

SEQ ID NO: 2270856 - DNA, 14 bp, Homo sapiens
aggcagctcccagg

SEQ ID NO: 2270857 - DNA, 19 bp, Homo sapiens
aggcaggaggccattccag

SEQ ID NO: 2270858 - DNA, 13 bp, Homo sapiens
aggcagggccctg

SEQ ID NO: 2270859 - DNA, 16 bp, Homo sapiens
aggcaggggcttccca

SEQ ID NO: 2270860 - DNA, 11 bp, Homo sapiens
aggcagggtct

SEQ ID NO: 2270861 - DNA, 16 bp, Homo sapiens
aggcaggtgggcagac

SEQ ID NO: 2270862 - DNA, 13 bp, Homo sapiens
aggcatgaccctg

SEQ ID NO: 2270863 - DNA, 14 bp, Homo sapiens
aggcatgaccctgg

SEQ ID NO: 2270864 - DNA, 21 bp, Homo sapiens
aggcatgtgatgagaggaaat

SEQ ID NO: 2270865 - DNA, 23 bp, Homo sapiens
aggcatgtgatgagaggaaatca

SEQ ID NO: 2270866 - DNA, 23 bp, Homo sapiens
aggcattcagcaattaaagacat

SEQ ID NO: 2270867 - DNA, 16 bp, Homo sapiens
aggccaaacacccaag

SEQ ID NO: 2270868 - DNA, 13 bp, Homo sapiens
aggccagtacttt

SEQ ID NO: 2270869 - DNA, 19 bp, Homo sapiens
aggccagtagggggaggga

SEQ ID NO: 2270870 - DNA, 18 bp, Homo sapiens
aggccatctcagcttgct

SEQ ID NO: 2270871 - DNA, 15 bp, Homo sapiens
aggccatgcccaccg

SEQ ID NO: 2270872 - DNA, 23 bp, Homo sapiens
aggccatgcccaccgcccctgga

SEQ ID NO: 2270873 - DNA, 19 bp, Homo sapiens
aggcccacattgcccacac

SEQ ID NO: 2270874 - DNA, 13 bp, Homo sapiens
aggccccaccttc

SEQ ID NO: 2270875 - DNA, 13 bp, Homo sapiens
aggcccccggagg

SEQ ID NO: 2270876 - DNA, 15 bp, Homo sapiens
aggccgacaggaggc

SEQ ID NO: 2270877 - DNA, 23 bp, Homo sapiens
aggccgacaggaggccatgccca

SEQ ID NO: 2270878 - DNA, 17 bp, Homo sapiens
aggcctcgagcagagag

SEQ ID NO: 2270879 - DNA, 18 bp, Homo sapiens
aggcctgaaatgtttcca

SEQ ID NO: 2270880 - DNA, 15 bp, Homo sapiens
aggcctgagggaagc

SEQ ID NO: 2270881 - DNA, 17 bp, Homo sapiens
aggcctgagggaagccc

SEQ ID NO: 2270882 - DNA, 21 bp, Homo sapiens
aggcctgagggaagcccaccc

SEQ ID NO: 2270883 - DNA, 23 bp, Homo sapiens
aggcctgagggaagcccacccgc

SEQ ID NO: 2270884 - DNA, 12 bp, Homo sapiens
aggcctgttccc

SEQ ID NO: 2270885 - DNA, 20 bp, Homo sapiens
aggcctgttccctgaggacc

SEQ ID NO: 2270886 - DNA, 15 bp, Homo sapiens
aggccttcagaaaag

SEQ ID NO: 2270887 - DNA, 23 bp, Homo sapiens
aggccttcagaaaagacacttca

SEQ ID NO: 2270888 - DNA, 13 bp, Homo sapiens
aggcgcccacctg

SEQ ID NO: 2270889 - DNA, 16 bp, Homo sapiens
aggcgcccacctgccc

SEQ ID NO: 2270890 - DNA, 16 bp, Homo sapiens
aggcgcgcaccgccca

SEQ ID NO: 2270891 - DNA, 23 bp, Homo sapiens
aggcggaggggcttggagcagag

SEQ ID NO: 2270892 - DNA, 18 bp, Homo sapiens
aggcggtatccagaggtg

SEQ ID NO: 2270893 - DNA, 21 bp, Homo sapiens
aggcggttgtaagaggatgtg

SEQ ID NO: 2270894 - DNA, 14 bp, Homo sapiens
aggcgtagggccag

SEQ ID NO: 2270895 - DNA, 16 bp, Homo sapiens
aggcgtagggccaggg

SEQ ID NO: 2270896 - DNA, 17 bp, Homo sapiens
aggcgtagggccagggc

SEQ ID NO: 2270897 - DNA, 22 bp, Homo sapiens
aggcgtagggccagggctctgg

SEQ ID NO: 2270898 - DNA, 15 bp, Homo sapiens
aggcgtcttgtattt

SEQ ID NO: 2270899 - DNA, 14 bp, Homo sapiens
aggctccccaagac

SEQ ID NO: 2270900 - DNA, 22 bp, Homo sapiens
aggctctatttcggaaatacac

SEQ ID NO: 2270901 - DNA, 12 bp, Homo sapiens
aggctctgaagg

SEQ ID NO: 2270902 - DNA, 17 bp, Homo sapiens
aggctgaatcaaagaca

SEQ ID NO: 2270903 - DNA, 15 bp, Homo sapiens
aggctgagccgatct

SEQ ID NO: 2270904 - DNA, 17 bp, Homo sapiens
aggctgccccacccctc

SEQ ID NO: 2270905 - DNA, 20 bp, Homo sapiens
aggctgccccacccctccat

SEQ ID NO: 2270906 - DNA, 15 bp, Homo sapiens
aggctgcgcctgccc

SEQ ID NO: 2270907 - DNA, 19 bp, Homo sapiens
aggctgctaagtggaagac

SEQ ID NO: 2270908 - DNA, 22 bp, Homo sapiens
aggctgctaagtggaagacaga

SEQ ID NO: 2270909 - DNA, 14 bp, Homo sapiens
aggctggaccaact

SEQ ID NO: 2270910 - DNA, 16 bp, Homo sapiens
aggctggaccaactgc

SEQ ID NO: 2270911 - DNA, 18 bp, Homo sapiens
aggctggatgtgctttca

SEQ ID NO: 2270912 - DNA, 20 bp, Homo sapiens
aggctgtattttcttttata

SEQ ID NO: 2270913 - DNA, 20 bp, Homo sapiens
aggctgtcaattacaggaag

SEQ ID NO: 2270914 - DNA, 21 bp, Homo sapiens
aggctgtcaattacaggaagt

SEQ ID NO: 2270915 - DNA, 15 bp, Homo sapiens
aggcttccagctcag

SEQ ID NO: 2270916 - DNA, 17 bp, Homo sapiens
aggcttccagctcagtc

SEQ ID NO: 2270917 - DNA, 15 bp, Homo sapiens
aggcttcgtctcaga

SEQ ID NO: 2270918 - DNA, 19 bp, Homo sapiens
aggcttcgtctcagaaggc

SEQ ID NO: 2270919 - DNA, 22 bp, Homo sapiens
aggcttcgtctcagaaggctct

SEQ ID NO: 2270920 - DNA, 12 bp, Homo sapiens
aggctttctatt

SEQ ID NO: 2270921 - DNA, 22 bp, Homo sapiens
agggaaatcaatttaaaggaaa

SEQ ID NO: 2270922 - DNA, 19 bp, Homo sapiens
agggaagcccacccgcccc

SEQ ID NO: 2270923 - DNA, 20 bp, Homo sapiens
agggaagcccacccgcccca

SEQ ID NO: 2270924 - DNA, 21 bp, Homo sapiens
agggaagcccacccgccccag

SEQ ID NO: 2270925 - DNA, 21 bp, Homo sapiens
agggaatccatatcagctctg

SEQ ID NO: 2270926 - DNA, 22 bp, Homo sapiens
agggacggggcccgccccaggc

SEQ ID NO: 2270927 - DNA, 12 bp, Homo sapiens
agggactccaga

SEQ ID NO: 2270928 - DNA, 13 bp, Homo sapiens
agggagaccctgg

SEQ ID NO: 2270929 - DNA, 13 bp, Homo sapiens
agggagaggggaa

SEQ ID NO: 2270930 - DNA, 17 bp, Homo sapiens
agggagccacaggctct

SEQ ID NO: 2270931 - DNA, 16 bp, Homo sapiens
agggagccatgctctt

SEQ ID NO: 2270932 - DNA, 15 bp, Homo sapiens
agggatccagagacc

SEQ ID NO: 2270933 - DNA, 17 bp, Homo sapiens
agggcactaaccccatt

SEQ ID NO: 2270934 - DNA, 12 bp, Homo sapiens
agggcaggagct

SEQ ID NO: 2270935 - DNA, 16 bp, Homo sapiens
agggcaggagctcaca

SEQ ID NO: 2270936 - DNA, 20 bp, Homo sapiens
agggcaggagctcacaccgc

SEQ ID NO: 2270937 - DNA, 15 bp, Homo sapiens
agggccagggctctg

SEQ ID NO: 2270938 - DNA, 16 bp, Homo sapiens
agggccagggctctgg

SEQ ID NO: 2270939 - DNA, 22 bp, Homo sapiens
agggcccagaggggcggggcca

SEQ ID NO: 2270940 - DNA, 23 bp, Homo sapiens
agggcccagaggggcggggccag

SEQ ID NO: 2270941 - DNA, 16 bp, Homo sapiens
agggcccgggaagcaa

SEQ ID NO: 2270942 - DNA, 17 bp, Homo sapiens
agcatggtttgcatgac

SEQ ID NO: 2270943 - DNA, 14 bp, Homo sapiens
agcatgtctactgc

SEQ ID NO: 2270944 - DNA, 17 bp, Homo sapiens
agcatgtctactgcttg

SEQ ID NO: 2270945 - DNA, 22 bp, Homo sapiens
agcattagttggagctagaaaa

SEQ ID NO: 2270946 - DNA, 19 bp, Homo sapiens
agcattattgccaaataag

SEQ ID NO: 2270947 - DNA, 20 bp, Homo sapiens
agcattcaaaatagttctat

SEQ ID NO: 2270948 - DNA, 22 bp, Homo sapiens
agcattcaaaatagttctattt

SEQ ID NO: 2270949 - DNA, 16 bp, Homo sapiens
agcattgaaataataa

SEQ ID NO: 2270950 - DNA, 19 bp, Homo sapiens
agcattgaaataataatat

SEQ ID NO: 2270951 - DNA, 16 bp, Homo sapiens
agccaaagaggcattc

SEQ ID NO: 2270952 - DNA, 18 bp, Homo sapiens
agccaaagaggcattcag

SEQ ID NO: 2270953 - DNA, 16 bp, Homo sapiens
agccaacttaaacctg

SEQ ID NO: 2270954 - DNA, 23 bp, Homo sapiens
agccaacttaaacctgtgctttc

SEQ ID NO: 2270955 - DNA, 13 bp, Homo sapiens
agccacagcactc

SEQ ID NO: 2270956 - DNA, 20 bp, Homo sapiens
agccactggggtgggagggg

SEQ ID NO: 2270957 - DNA, 23 bp, Homo sapiens
agccactggggtgggagggggca

SEQ ID NO: 2270958 - DNA, 23 bp, Homo sapiens
agccagaatgtttcctgtggaaa

SEQ ID NO: 2270959 - DNA, 21 bp, Homo sapiens
agccagagccgcaccctggct

SEQ ID NO: 2270960 - DNA, 17 bp, Homo sapiens
agccagatttcactctc

SEQ ID NO: 2270961 - DNA, 20 bp, Homo sapiens
agccagatttcactctcctt

SEQ ID NO: 2270962 - DNA, 14 bp, Homo sapiens
agccatccaccctg

SEQ ID NO: 2270963 - DNA, 12 bp, Homo sapiens
agccatgctctt

SEQ ID NO: 2270964 - DNA, 11 bp, Homo sapiens
agcccaacctc

SEQ ID NO: 2270965 - DNA, 18 bp, Homo sapiens
agcccacccgccccagag

SEQ ID NO: 2270966 - DNA, 20 bp, Homo sapiens
agcccaggcaatagtgttga

SEQ ID NO: 2270967 - DNA, 20 bp, Homo sapiens
agccccatcccaaacccttc

SEQ ID NO: 2270968 - DNA, 15 bp, Homo sapiens
agccccatccttccc

SEQ ID NO: 2270969 - DNA, 20 bp, Homo sapiens
agccccccacgcttctggag

SEQ ID NO: 2270970 - DNA, 16 bp, Homo sapiens
agccccctggcccctc

SEQ ID NO: 2270971 - DNA, 17 bp, Homo sapiens
agcccctccccgcctcc

SEQ ID NO: 2270972 - DNA, 13 bp, Homo sapiens
agcccctcctctc

SEQ ID NO: 2270973 - DNA, 21 bp, Homo sapiens
agccccttgcttctaagggat

SEQ ID NO: 2270974 - DNA, 14 bp, Homo sapiens
agcccggccaagga

SEQ ID NO: 2270975 - DNA, 21 bp, Homo sapiens
agcccggccaaggacactgat

SEQ ID NO: 2270976 - DNA, 19 bp, Homo sapiens
agccctatctatgtcctgg

SEQ ID NO: 2270977 - DNA, 20 bp, Homo sapiens
agccctatctatgtcctgga

SEQ ID NO: 2270978 - DNA, 22 bp, Homo sapiens
agccctatctatgtcctggaag

SEQ ID NO: 2270979 - DNA, 14 bp, Homo sapiens
agccgagcccaggg

SEQ ID NO: 2270980 - DNA, 18 bp, Homo sapiens
agccgagctctcctgggc

SEQ ID NO: 2270981 - DNA, 16 bp, Homo sapiens
agccgccttcacagca

SEQ ID NO: 2270982 - DNA, 14 bp, Homo sapiens
agccgcgctctgcc

SEQ ID NO: 2270983 - DNA, 15 bp, Homo sapiens
agccgcgctctgccc

SEQ ID NO: 2270984 - DNA, 16 bp, Homo sapiens
agccgggccccatggt

SEQ ID NO: 2270985 - DNA, 22 bp, Homo sapiens
agccgggccccatggtcacaga

SEQ ID NO: 2270986 - DNA, 22 bp, Homo sapiens
agccgtaatggggactctccag

SEQ ID NO: 2270987 - DNA, 22 bp, Homo sapiens
agcctagaacaagccagagccg

SEQ ID NO: 2270988 - DNA, 14 bp, Homo sapiens
agcctcacccctgc

SEQ ID NO: 2270989 - DNA, 15 bp, Homo sapiens
agcctcactgcatct

SEQ ID NO: 2270990 - DNA, 19 bp, Homo sapiens
agcctcagagtcctgccga

SEQ ID NO: 2270991 - DNA, 22 bp, Homo sapiens
agcctcccccaggctgcgcctg

SEQ ID NO: 2270992 - DNA, 19 bp, Homo sapiens
agcctcctgagtagctggg

SEQ ID NO: 2270993 - DNA, 13 bp, Homo sapiens
agcctcctgctga

SEQ ID NO: 2270994 - DNA, 21 bp, Homo sapiens
agcctcctgctgagtggtcca

SEQ ID NO: 2270995 - DNA, 16 bp, Homo sapiens
agcctcgacctccctg

SEQ ID NO: 2270996 - DNA, 17 bp, Homo sapiens
agcctcgacctccctgg

SEQ ID NO: 2270997 - DNA, 19 bp, Homo sapiens
agcctcgacctccctggct

SEQ ID NO: 2270998 - DNA, 17 bp, Homo sapiens
agcctcgtctttcagcg

SEQ ID NO: 2270999 - DNA, 16 bp, Homo sapiens
agcctgagccacagtg

SEQ ID NO: 2271000 - DNA, 19 bp, Homo sapiens
agcctgagccacagtgggg

SEQ ID NO: 2271001 - DNA, 20 bp, Homo sapiens
agcctgagccacagtggggc

SEQ ID NO: 2271002 - DNA, 12 bp, Homo sapiens
agcctgagctcc

SEQ ID NO: 2271003 - DNA, 16 bp, Homo sapiens
agcctgtgtgaaaata

SEQ ID NO: 2271004 - DNA, 11 bp, Homo sapiens
agcctgtttca

SEQ ID NO: 2271005 - DNA, 20 bp, Homo sapiens
agccttagcactatggacat

SEQ ID NO: 2271006 - DNA, 19 bp, Homo sapiens
agcctttcttttctttctt

SEQ ID NO: 2271007 - DNA, 20 bp, Homo sapiens
agcctttgcgctctgggttt

SEQ ID NO: 2271008 - DNA, 18 bp, Homo sapiens
agcgaagacccggccagg

SEQ ID NO: 2271009 - DNA, 22 bp, Homo sapiens
agcgagggccccagcgtgaagc

SEQ ID NO: 2271010 - DNA, 16 bp, Homo sapiens
agcgagtctggagacc

SEQ ID NO: 2271011 - DNA, 17 bp, Homo sapiens
agcgagtctggagacca

SEQ ID NO: 2271012 - DNA, 21 bp, Homo sapiens
agcgagtctggagaccaggac

SEQ ID NO: 2271013 - DNA, 14 bp, Homo sapiens
agcgccacccgccc

SEQ ID NO: 2271014 - DNA, 20 bp, Homo sapiens
agcgcctcccgccgcctcgg

SEQ ID NO: 2271015 - DNA, 16 bp, Homo sapiens
agcgcgtgccttcccc

SEQ ID NO: 2271016 - DNA, 16 bp, Homo sapiens
agcggccccgcacccc

SEQ ID NO: 2271017 - DNA, 18 bp, Homo sapiens
agcggccccgcacccctc

SEQ ID NO: 2271018 - DNA, 19 bp, Homo sapiens
agcggccccgcacccctcc

SEQ ID NO: 2271019 - DNA, 23 bp, Homo sapiens
agcggcccggcccacgcagagcc

SEQ ID NO: 2271020 - DNA, 15 bp, Homo sapiens
agcggctgaggacgg

SEQ ID NO: 2271021 - DNA, 20 bp, Homo sapiens
agcggctgaggacggggcag

SEQ ID NO: 2271022 - DNA, 22 bp, Homo sapiens
agcggctgaggacggggcagag

SEQ ID NO: 2271023 - DNA, 20 bp, Homo sapiens
agcgggcgcgggacaggact

SEQ ID NO: 2271024 - DNA, 13 bp, Homo sapiens
agcgggggctaac

SEQ ID NO: 2271025 - DNA, 21 bp, Homo sapiens
agcgggggctaactggcccca

SEQ ID NO: 2271026 - DNA, 19 bp, Homo sapiens
agcgtgaagccagggcccg

SEQ ID NO: 2271027 - DNA, 16 bp, Homo sapiens
agcgttaagggcagag

SEQ ID NO: 2271028 - DNA, 23 bp, Homo sapiens
agcgtttaatggtatctgttact

SEQ ID NO: 2271029 - DNA, 19 bp, Homo sapiens
agctaacatggaagtacta

SEQ ID NO: 2271030 - DNA, 18 bp, Homo sapiens
agctaccaactaagttgt

SEQ ID NO: 2271031 - DNA, 22 bp, Homo sapiens
agctaccaactaagttgtattt

SEQ ID NO: 2271032 - DNA, 19 bp, Homo sapiens
agctataacaactctattt

SEQ ID NO: 2271033 - DNA, 16 bp, Homo sapiens
agctataatgtttccc

SEQ ID NO: 2271034 - DNA, 21 bp, Homo sapiens
agctatatatatatatatatg

SEQ ID NO: 2271035 - DNA, 18 bp, Homo sapiens
agctatgagagatgtgtc

SEQ ID NO: 2271036 - DNA, 13 bp, Homo sapiens
agctcactgcagc

SEQ ID NO: 2271037 - DNA, 14 bp, Homo sapiens
agctcactgcagcc

SEQ ID NO: 2271038 - DNA, 16 bp, Homo sapiens
agctcactgcagcctc

SEQ ID NO: 2271039 - DNA, 17 bp, Homo sapiens
agctcagcacagcctca

SEQ ID NO: 2271040 - DNA, 14 bp, Homo sapiens
agctcaggtgcctt

SEQ ID NO: 2271041 - DNA, 17 bp, Homo sapiens
agctcagtcccacagcc

SEQ ID NO: 2271042 - DNA, 15 bp, Homo sapiens
agctccaccctcccc

SEQ ID NO: 2271043 - DNA, 19 bp, Homo sapiens
agctcccaggacgcaggga

SEQ ID NO: 2271044 - DNA, 18 bp, Homo sapiens
agctctaaagcagagatg

SEQ ID NO: 2271045 - DNA, 12 bp, Homo sapiens
agctctcccctg

SEQ ID NO: 2271046 - DNA, 13 bp, Homo sapiens
agctctcccctgc

SEQ ID NO: 2271047 - DNA, 23 bp, Homo sapiens
agctctcccctgcgcaggccctc

SEQ ID NO: 2271048 - DNA, 15 bp, Homo sapiens
agctctcctgggcca

SEQ ID NO: 2271049 - DNA, 18 bp, Homo sapiens
agctctcctgggccaggg

SEQ ID NO: 2271050 - DNA, 21 bp, Homo sapiens
agctctgaagggaggggaaga

SEQ ID NO: 2271051 - DNA, 21 bp, Homo sapiens
agctctggaattgttgaatgt

SEQ ID NO: 2271052 - DNA, 22 bp, Homo sapiens
agctctggaattgttgaatgta

SEQ ID NO: 2271053 - DNA, 12 bp, Homo sapiens
agctgaggcagg

SEQ ID NO: 2271054 - DNA, 22 bp, Homo sapiens
agctgagtcggctgggcagggc

SEQ ID NO: 2271055 - DNA, 15 bp, Homo sapiens
agctgctatccaatg

SEQ ID NO: 2271056 - DNA, 14 bp, Homo sapiens
agctgcttccagtt

SEQ ID NO: 2271057 - DNA, 14 bp, Homo sapiens
agctgcttttgcat

SEQ ID NO: 2271058 - DNA, 18 bp, Homo sapiens
agctgcttttgcatttct

SEQ ID NO: 2271059 - DNA, 18 bp, Homo sapiens
agctggactgggtgggcc

SEQ ID NO: 2271060 - DNA, 20 bp, Homo sapiens
agctggcagcgcctcccgcc

SEQ ID NO: 2271061 - DNA, 21 bp, Homo sapiens
agctggctgggtcgcccctcc

SEQ ID NO: 2271062 - DNA, 14 bp, Homo sapiens
agctgtgaggacag

SEQ ID NO: 2271063 - DNA, 14 bp, Homo sapiens
agctgttagcacgt

SEQ ID NO: 2271064 - DNA, 13 bp, Homo sapiens
agctgttggaatg

SEQ ID NO: 2271065 - DNA, 12 bp, Homo sapiens
agcttatttcta

SEQ ID NO: 2271066 - DNA, 16 bp, Homo sapiens
agcttatttctaacta

SEQ ID NO: 2271067 - DNA, 13 bp, Homo sapiens
agctttaacattt

SEQ ID NO: 2271068 - DNA, 16 bp, Homo sapiens
agcttttactccctga

SEQ ID NO: 2271069 - DNA, 12 bp, Homo sapiens
aggaaaagagaa

SEQ ID NO: 2271070 - DNA, 15 bp, Homo sapiens
aggaaaagaggccca

SEQ ID NO: 2271071 - DNA, 12 bp, Homo sapiens
aggaaaatacat

SEQ ID NO: 2271072 - DNA, 13 bp, Homo sapiens
aggaaagttctat

SEQ ID NO: 2271073 - DNA, 22 bp, Homo sapiens
aggaaagttctattatctgggt

SEQ ID NO: 2271074 - DNA, 14 bp, Homo sapiens
aggaaataaatcta

SEQ ID NO: 2271075 - DNA, 14 bp, Homo sapiens
aggaaatacagaga

SEQ ID NO: 2271076 - DNA, 16 bp, Homo sapiens
aggaaatagtgttctt

SEQ ID NO: 2271077 - DNA, 23 bp, Homo sapiens
aggaaatagtgttctttttaaaa

SEQ ID NO: 2271078 - DNA, 20 bp, Homo sapiens
agggccctggggtctctgag

SEQ ID NO: 2271079 - DNA, 12 bp, Homo sapiens
agggccctgtgg

SEQ ID NO: 2271080 - DNA, 15 bp, Homo sapiens
agggcctctggacag

SEQ ID NO: 2271081 - DNA, 17 bp, Homo sapiens
agggcgctccggcagag

SEQ ID NO: 2271082 - DNA, 17 bp, Homo sapiens
agggctccacgggggcc

SEQ ID NO: 2271083 - DNA, 15 bp, Homo sapiens
agggctctggcaggt

SEQ ID NO: 2271084 - DNA, 22 bp, Homo sapiens
agggctctggcaggtggccagg

SEQ ID NO: 2271085 - DNA, 15 bp, Homo sapiens
agggctgagcccctc

SEQ ID NO: 2271086 - DNA, 19 bp, Homo sapiens
agggctttaaataaaagag

SEQ ID NO: 2271087 - DNA, 14 bp, Homo sapiens
aggggaaaatagta

SEQ ID NO: 2271088 - DNA, 20 bp, Homo sapiens
aggggaagagagaggcctgg

SEQ ID NO: 2271089 - DNA, 14 bp, Homo sapiens
aggggcaaaaatat

SEQ ID NO: 2271090 - DNA, 20 bp, Homo sapiens
aggggcaaaagtcattgctg

SEQ ID NO: 2271091 - DNA, 18 bp, Homo sapiens
aggggccaggaaggggac

SEQ ID NO: 2271092 - DNA, 19 bp, Homo sapiens
aggggccaggaaggggaca

SEQ ID NO: 2271093 - DNA, 20 bp, Homo sapiens
aggggcgctgcccccacaga

SEQ ID NO: 2271094 - DNA, 14 bp, Homo sapiens
aggggcggggccag

SEQ ID NO: 2271095 - DNA, 12 bp, Homo sapiens
aggggctggagg

SEQ ID NO: 2271096 - DNA, 16 bp, Homo sapiens
aggggctggagggctg

SEQ ID NO: 2271097 - DNA, 23 bp, Homo sapiens
aggggcttcccacagcctcttcc

SEQ ID NO: 2271098 - DNA, 16 bp, Homo sapiens
aggggcttggagcaga

SEQ ID NO: 2271099 - DNA, 23 bp, Homo sapiens
agggggcttggctcgcaccccca

SEQ ID NO: 2271100 - DNA, 21 bp, Homo sapiens
agggggttctgggacccactc

SEQ ID NO: 2271101 - DNA, 22 bp, Homo sapiens
aggggtcgcgatgatgggctgg

SEQ ID NO: 2271102 - DNA, 17 bp, Homo sapiens
aggggtggaagggcagg

SEQ ID NO: 2271103 - DNA, 16 bp, Homo sapiens
agggtcctcttcctca

SEQ ID NO: 2271104 - DNA, 10 bp, Homo sapiens
agggtctgag

SEQ ID NO: 2271105 - DNA, 14 bp, Homo sapiens
agggtgggccctgg

SEQ ID NO: 2271106 - DNA, 20 bp, Homo sapiens
aggtaccaagatcacaaata

SEQ ID NO: 2271107 - DNA, 17 bp, Homo sapiens
aggtatactatgtaagg

SEQ ID NO: 2271108 - DNA, 19 bp, Homo sapiens
aggtcaatgaaatatttgc

SEQ ID NO: 2271109 - DNA, 17 bp, Homo sapiens
aggtcacctcactcagc

SEQ ID NO: 2271110 - DNA, 18 bp, Homo sapiens
aggtcacctcactcagca

SEQ ID NO: 2271111 - DNA, 20 bp, Homo sapiens
aggtcacctcactcagcacc

SEQ ID NO: 2271112 - DNA, 21 bp, Homo sapiens
aggtcacctcactcagcacca

SEQ ID NO: 2271113 - DNA, 20 bp, Homo sapiens
aggtcatcccggggccatgg

SEQ ID NO: 2271114 - DNA, 23 bp, Homo sapiens
aggtcatttgtagatatatattt

SEQ ID NO: 2271115 - DNA, 13 bp, Homo sapiens
aggtcgaggactg

SEQ ID NO: 2271116 - DNA, 17 bp, Homo sapiens
aggtgagggaggcctga

SEQ ID NO: 2271117 - DNA, 17 bp, Homo sapiens
aggtgcattgtcctttt

SEQ ID NO: 2271118 - DNA, 17 bp, Homo sapiens
aggtgcctgagagcaga

SEQ ID NO: 2271119 - DNA, 18 bp, Homo sapiens
aggtgcggaccggagcgg

SEQ ID NO: 2271120 - DNA, 14 bp, Homo sapiens
aggtggccagggct

SEQ ID NO: 2271121 - DNA, 18 bp, Homo sapiens
aggtggccagggctccac

SEQ ID NO: 2271122 - DNA, 11 bp, Homo sapiens
aggtggggagg

SEQ ID NO: 2271123 - DNA, 13 bp, Homo sapiens
aggtggggagggc

SEQ ID NO: 2271124 - DNA, 16 bp, Homo sapiens
aggtggggagggcctc

SEQ ID NO: 2271125 - DNA, 13 bp, Homo sapiens
aggtgggggcagc

SEQ ID NO: 2271126 - DNA, 21 bp, Homo sapiens
aggtgggggcagcggccccgc

SEQ ID NO: 2271127 - DNA, 17 bp, Homo sapiens
aggtgtactatggctgt

SEQ ID NO: 2271128 - DNA, 12 bp, Homo sapiens
aggtgtgaatgc

SEQ ID NO: 2271129 - DNA, 22 bp, Homo sapiens
aggtgtttcaaagggtaaatta

SEQ ID NO: 2271130 - DNA, 17 bp, Homo sapiens
aggttatgagaaaaaaa

SEQ ID NO: 2271131 - DNA, 22 bp, Homo sapiens
aggttatgcaagtcgccaggca

SEQ ID NO: 2271132 - DNA, 11 bp, Homo sapiens
aggttttcctg

SEQ ID NO: 2271133 - DNA, 20 bp, Homo sapiens
agtaaataatgattcaatgt

SEQ ID NO: 2271134 - DNA, 14 bp, Homo sapiens
agtaataactgatg

SEQ ID NO: 2271135 - DNA, 17 bp, Homo sapiens
agtaatattacatttca

SEQ ID NO: 2271136 - DNA, 14 bp, Homo sapiens
agtaatggcagagc

SEQ ID NO: 2271137 - DNA, 15 bp, Homo sapiens
agtaatggttctaga

SEQ ID NO: 2271138 - DNA, 20 bp, Homo sapiens
agtaatggttctagaaggat

SEQ ID NO: 2271139 - DNA, 12 bp, Homo sapiens
agtaatgtatat

SEQ ID NO: 2271140 - DNA, 17 bp, Homo sapiens
agtaattgttacaattt

SEQ ID NO: 2271141 - DNA, 20 bp, Homo sapiens
agtacataaagtaataactg

SEQ ID NO: 2271142 - DNA, 21 bp, Homo sapiens
agtacatgacccggatgaact

SEQ ID NO: 2271143 - DNA, 22 bp, Homo sapiens
agtacatgacccggatgaactc

SEQ ID NO: 2271144 - DNA, 15 bp, Homo sapiens
agtaccatcccactg

SEQ ID NO: 2271145 - DNA, 16 bp, Homo sapiens
agtaccatcccactga

SEQ ID NO: 2271146 - DNA, 18 bp, Homo sapiens
agtaccatcccactgata

SEQ ID NO: 2271147 - DNA, 15 bp, Homo sapiens
agtactgtgtactgt

SEQ ID NO: 2271148 - DNA, 19 bp, Homo sapiens
agtactttgccatccttgc

SEQ ID NO: 2271149 - DNA, 17 bp, Homo sapiens
agtagaaaaaaaaataa

SEQ ID NO: 2271150 - DNA, 19 bp, Homo sapiens
agtagaaaaaaaaataaca

SEQ ID NO: 2271151 - DNA, 17 bp, Homo sapiens
agtagagcaaagactta

SEQ ID NO: 2271152 - DNA, 23 bp, Homo sapiens
agtagcccacaataatgaataat

SEQ ID NO: 2271153 - DNA, 19 bp, Homo sapiens
agtagctgtggggagctgg

SEQ ID NO: 2271154 - DNA, 21 bp, Homo sapiens
agtaggctaaaaacattttaa

SEQ ID NO: 2271155 - DNA, 18 bp, Homo sapiens
agtaggctgtattttctt

SEQ ID NO: 2271156 - DNA, 15 bp, Homo sapiens
agtatatctcagttt

SEQ ID NO: 2271157 - DNA, 13 bp, Homo sapiens
agtatcagagggt

SEQ ID NO: 2271158 - DNA, 20 bp, Homo sapiens
agtatgaaccacatggaact

SEQ ID NO: 2271159 - DNA, 18 bp, Homo sapiens
agtatgcaagaagaatat

SEQ ID NO: 2271160 - DNA, 22 bp, Homo sapiens
agtattctgtagccaacttaaa

SEQ ID NO: 2271161 - DNA, 18 bp, Homo sapiens
agtatttacaagctattt

SEQ ID NO: 2271162 - DNA, 17 bp, Homo sapiens
agtattttttatttaat

SEQ ID NO: 2271163 - DNA, 22 bp, Homo sapiens
agtattttttatttaattatat

SEQ ID NO: 2271164 - DNA, 16 bp, Homo sapiens
agtcaacaggtcactt

SEQ ID NO: 2271165 - DNA, 19 bp, Homo sapiens
agtcacggtctaaacacac

SEQ ID NO: 2271166 - DNA, 13 bp, Homo sapiens
agtcactgggaga

SEQ ID NO: 2271167 - DNA, 14 bp, Homo sapiens
agtcactttgctta

SEQ ID NO: 2271168 - DNA, 18 bp, Homo sapiens
agtcactttgcttaagat

SEQ ID NO: 2271169 - DNA, 22 bp, Homo sapiens
agtcagaaaattggcagtggca

SEQ ID NO: 2271170 - DNA, 16 bp, Homo sapiens
agtcagggagccctgg

SEQ ID NO: 2271171 - DNA, 17 bp, Homo sapiens
agtcagggagccctggg

SEQ ID NO: 2271172 - DNA, 13 bp, Homo sapiens
agtcatatttttg

SEQ ID NO: 2271173 - DNA, 12 bp, Homo sapiens
agtcatctcaaa

SEQ ID NO: 2271174 - DNA, 15 bp, Homo sapiens
agtcatgggagaaga

SEQ ID NO: 2271175 - DNA, 17 bp, Homo sapiens
agtcatgtttctgcagt

SEQ ID NO: 2271176 - DNA, 18 bp, Homo sapiens
agtcattccacacatttc

SEQ ID NO: 2271177 - DNA, 22 bp, Homo sapiens
agtcattgctgacagagcccta

SEQ ID NO: 2271178 - DNA, 15 bp, Homo sapiens
agtccaatgaagata

SEQ ID NO: 2271179 - DNA, 17 bp, Homo sapiens
agtccaatgaagataaa

SEQ ID NO: 2271180 - DNA, 23 bp, Homo sapiens
agtccaatgtaccatgttgccca

SEQ ID NO: 2271181 - DNA, 19 bp, Homo sapiens
agtccacttatgtagacaa

SEQ ID NO: 2271182 - DNA, 15 bp, Homo sapiens
agtccagacctgggc

SEQ ID NO: 2271183 - DNA, 15 bp, Homo sapiens
agtccagctctcccc

SEQ ID NO: 2271184 - DNA, 23 bp, Homo sapiens
agtccagctctcccctgcgcagg

SEQ ID NO: 2271185 - DNA, 17 bp, Homo sapiens
agtccagtgagaaatta

SEQ ID NO: 2271186 - DNA, 13 bp, Homo sapiens
agtcccacagccc

SEQ ID NO: 2271187 - DNA, 18 bp, Homo sapiens
agtccctcctcccccacg

SEQ ID NO: 2271188 - DNA, 15 bp, Homo sapiens
agtccctgagaagcc

SEQ ID NO: 2271189 - DNA, 23 bp, Homo sapiens
agtccctgagaagcctcatggga

SEQ ID NO: 2271190 - DNA, 21 bp, Homo sapiens
agtccgaggcctggctctgga

SEQ ID NO: 2271191 - DNA, 16 bp, Homo sapiens
agtccgggagaatgct

SEQ ID NO: 2271192 - DNA, 16 bp, Homo sapiens
agtcctccaaaacaca

SEQ ID NO: 2271193 - DNA, 16 bp, Homo sapiens
agtcctcctttgcttg

SEQ ID NO: 2271194 - DNA, 20 bp, Homo sapiens
agtcctgccgacggagccac

SEQ ID NO: 2271195 - DNA, 22 bp, Homo sapiens
agtcctggcatgggaatgaatg

SEQ ID NO: 2271196 - DNA, 18 bp, Homo sapiens
agtccttagaatgaggga

SEQ ID NO: 2271197 - DNA, 17 bp, Homo sapiens
agtcctttgagctcctg

SEQ ID NO: 2271198 - DNA, 18 bp, Homo sapiens
agtcggctgggcagggcc

SEQ ID NO: 2271199 - DNA, 17 bp, Homo sapiens
agtctcttgattcataa

SEQ ID NO: 2271200 - DNA, 20 bp, Homo sapiens
agtctgcttaccaaaacata

SEQ ID NO: 2271201 - DNA, 21 bp, Homo sapiens
agtctgcttaccaaaacataa

SEQ ID NO: 2271202 - DNA, 16 bp, Homo sapiens
agtctggagcaaagca

SEQ ID NO: 2271203 - DNA, 15 bp, Homo sapiens
agtcttaggtttcca

SEQ ID NO: 2271204 - DNA, 20 bp, Homo sapiens
agtcttcatggtctcttcca

SEQ ID NO: 2271205 - DNA, 11 bp, Homo sapiens
agtcttgtata

SEQ ID NO: 2271206 - DNA, 14 bp, Homo sapiens
agtctttgtacaga

SEQ ID NO: 2271207 - DNA, 12 bp, Homo sapiens
agtgaacatttc

SEQ ID NO: 2271208 - DNA, 15 bp, Homo sapiens
agtgaagaaaacttg

SEQ ID NO: 2271209 - DNA, 12 bp, Homo sapiens
agtgaagatgtg

SEQ ID NO: 2271210 - DNA, 12 bp, Homo sapiens
agtgaatgttaa

SEQ ID NO: 2271211 - DNA, 21 bp, Homo sapiens
agtgacatcggttcaggagga

SEQ ID NO: 2271212 - DNA, 17 bp, Homo sapiens
agtgagatttgtattta

SEQ ID NO: 2271213 - DNA, 16 bp, Homo sapiens
agtgagctaccaggaa

SEQ ID NO: 2271214 - DNA, 23 bp, Homo sapiens
agtgatcagttgctctctgttca

SEQ ID NO: 2271215 - DNA, 19 bp, Homo sapiens
catattgatagatgcaaga

SEQ ID NO: 2271216 - DNA, 13 bp, Homo sapiens
catcaaatgcatg

SEQ ID NO: 2271217 - DNA, 14 bp, Homo sapiens
catcaagatgtgac

SEQ ID NO: 2271218 - DNA, 23 bp, Homo sapiens
catcaatacttttgtgtattctg

SEQ ID NO: 2271219 - DNA, 13 bp, Homo sapiens
catcacaggctct

SEQ ID NO: 2271220 - DNA, 13 bp, Homo sapiens
catcagaaatttt

SEQ ID NO: 2271221 - DNA, 12 bp, Homo sapiens
catcagcccctg

SEQ ID NO: 2271222 - DNA, 17 bp, Homo sapiens
catcagcccctgctgct

SEQ ID NO: 2271223 - DNA, 18 bp, Homo sapiens
catcagcccctgctgctc

SEQ ID NO: 2271224 - DNA, 23 bp, Homo sapiens
catcatggatcaaccaagttaca

SEQ ID NO: 2271225 - DNA, 21 bp, Homo sapiens
catcatgtaatagtggctttc

SEQ ID NO: 2271226 - DNA, 14 bp, Homo sapiens
catcattgaaatct

SEQ ID NO: 2271227 - DNA, 16 bp, Homo sapiens
catcatttcccctccc

SEQ ID NO: 2271228 - DNA, 19 bp, Homo sapiens
catccacacacagcagctc

SEQ ID NO: 2271229 - DNA, 21 bp, Homo sapiens
catccacacacagcagctcca

SEQ ID NO: 2271230 - DNA, 22 bp, Homo sapiens
catccacacacagcagctccaa

SEQ ID NO: 2271231 - DNA, 15 bp, Homo sapiens
catccaccctgagga

SEQ ID NO: 2271232 - DNA, 17 bp, Homo sapiens
catccaccctgaggagt

SEQ ID NO: 2271233 - DNA, 22 bp, Homo sapiens
catccatgcggccggcctgggg

SEQ ID NO: 2271234 - DNA, 22 bp, Homo sapiens
catccccaaaacaaagtctttg

SEQ ID NO: 2271235 - DNA, 12 bp, Homo sapiens
catccccagccc

SEQ ID NO: 2271236 - DNA, 15 bp, Homo sapiens
catccccagccccct

SEQ ID NO: 2271237 - DNA, 12 bp, Homo sapiens
catcctctgtta

SEQ ID NO: 2271238 - DNA, 19 bp, Homo sapiens
catcctgattattgaatgt

SEQ ID NO: 2271239 - DNA, 19 bp, Homo sapiens
catcctggctcagctctca

SEQ ID NO: 2271240 - DNA, 14 bp, Homo sapiens
catccttaactgtc

SEQ ID NO: 2271241 - DNA, 18 bp, Homo sapiens
catccttcccgcagcacc

SEQ ID NO: 2271242 - DNA, 14 bp, Homo sapiens
catccttgaggacc

SEQ ID NO: 2271243 - DNA, 21 bp, Homo sapiens
catccttttgcttcatctgga

SEQ ID NO: 2271244 - DNA, 23 bp, Homo sapiens
catccttttgcttcatctggagt

SEQ ID NO: 2271245 - DNA, 16 bp, Homo sapiens
catcggttcaggagga

SEQ ID NO: 2271246 - DNA, 14 bp, Homo sapiens
catctaaaatactc

SEQ ID NO: 2271247 - DNA, 14 bp, Homo sapiens
catctataaaatga

SEQ ID NO: 2271248 - DNA, 16 bp, Homo sapiens
catctcattacagctc

SEQ ID NO: 2271249 - DNA, 21 bp, Homo sapiens
catctctgtagatacaggggc

SEQ ID NO: 2271250 - DNA, 22 bp, Homo sapiens
catctcttgtaaatacatgtcc

SEQ ID NO: 2271251 - DNA, 20 bp, Homo sapiens
catctcttgtaccagcccag

SEQ ID NO: 2271252 - DNA, 23 bp, Homo sapiens
catctcttgtaccagcccaggca

SEQ ID NO: 2271253 - DNA, 12 bp, Homo sapiens
catctgaaaaga

SEQ ID NO: 2271254 - DNA, 15 bp, Homo sapiens
catctgatttgcata

SEQ ID NO: 2271255 - DNA, 17 bp, Homo sapiens
catctgctcttctctta

SEQ ID NO: 2271256 - DNA, 14 bp, Homo sapiens
catctgctgagctc

SEQ ID NO: 2271257 - DNA, 17 bp, Homo sapiens
catctttctcttcccat

SEQ ID NO: 2271258 - DNA, 13 bp, Homo sapiens
catgaaggagagg

SEQ ID NO: 2271259 - DNA, 23 bp, Homo sapiens
catgacacgaatattgctgatgg

SEQ ID NO: 2271260 - DNA, 15 bp, Homo sapiens
catgaccctggagcc

SEQ ID NO: 2271261 - DNA, 16 bp, Homo sapiens
catgaccctggagccc

SEQ ID NO: 2271262 - DNA, 23 bp, Homo sapiens
catgactggtgcgttcctaaact

SEQ ID NO: 2271263 - DNA, 22 bp, Homo sapiens
catgagactttccgactgcttt

SEQ ID NO: 2271264 - DNA, 17 bp, Homo sapiens
catgagattgtacattt

SEQ ID NO: 2271265 - DNA, 20 bp, Homo sapiens
catgaggaacaaggcaaggc

SEQ ID NO: 2271266 - DNA, 23 bp, Homo sapiens
catgaggaacaaggcaaggctgt

SEQ ID NO: 2271267 - DNA, 12 bp, Homo sapiens
catgatacaaag

SEQ ID NO: 2271268 - DNA, 19 bp, Homo sapiens
catgattccaagggcccag

SEQ ID NO: 2271269 - DNA, 20 bp, Homo sapiens
catgattccaagggcccaga

SEQ ID NO: 2271270 - DNA, 19 bp, Homo sapiens
catgcaaaaaaaaaaatgt

SEQ ID NO: 2271271 - DNA, 16 bp, Homo sapiens
catgcaacaccctctt

SEQ ID NO: 2271272 - DNA, 15 bp, Homo sapiens
catgcatagacaagt

SEQ ID NO: 2271273 - DNA, 23 bp, Homo sapiens
catgcatatgatatatagttaca

SEQ ID NO: 2271274 - DNA, 13 bp, Homo sapiens
catgcatttctcg

SEQ ID NO: 2271275 - DNA, 15 bp, Homo sapiens
catgccgctgtgtct

SEQ ID NO: 2271276 - DNA, 21 bp, Homo sapiens
catgcggccggcctggggccg

SEQ ID NO: 2271277 - DNA, 14 bp, Homo sapiens
catgctccttgcct

SEQ ID NO: 2271278 - DNA, 15 bp, Homo sapiens
catgctgcagtgggt

SEQ ID NO: 2271279 - DNA, 22 bp, Homo sapiens
catgctgtcccttacgtgagtc

SEQ ID NO: 2271280 - DNA, 19 bp, Homo sapiens
catggaacttaaaacatat

SEQ ID NO: 2271281 - DNA, 14 bp, Homo sapiens
catggaccactgtt

SEQ ID NO: 2271282 - DNA, 22 bp, Homo sapiens
catggaccactgtttcttgctt

SEQ ID NO: 2271283 - DNA, 20 bp, Homo sapiens
catggacgtgtctgcacagg

SEQ ID NO: 2271284 - DNA, 19 bp, Homo sapiens
catggatttcctttgacct

SEQ ID NO: 2271285 - DNA, 12 bp, Homo sapiens
catggccccagc

SEQ ID NO: 2271286 - DNA, 13 bp, Homo sapiens
catggccccagct

SEQ ID NO: 2271287 - DNA, 17 bp, Homo sapiens
catgggagaagaggggt

SEQ ID NO: 2271288 - DNA, 19 bp, Homo sapiens
catgggagtcagggagccc

SEQ ID NO: 2271289 - DNA, 15 bp, Homo sapiens
catgggctctggccc

SEQ ID NO: 2271290 - DNA, 12 bp, Homo sapiens
catgggttcctc

SEQ ID NO: 2271291 - DNA, 21 bp, Homo sapiens
catggtcacagacccctgggg

SEQ ID NO: 2271292 - DNA, 22 bp, Homo sapiens
catggtcacagacccctggggg

SEQ ID NO: 2271293 - DNA, 23 bp, Homo sapiens
catggtcacagacccctggggga

SEQ ID NO: 2271294 - DNA, 14 bp, Homo sapiens
catggtcctgtgcc

SEQ ID NO: 2271295 - DNA, 15 bp, Homo sapiens
catggtcctgtgccc

SEQ ID NO: 2271296 - DNA, 16 bp, Homo sapiens
catggtttgcatgact

SEQ ID NO: 2271297 - DNA, 14 bp, Homo sapiens
catgtaagaaataa

SEQ ID NO: 2271298 - DNA, 19 bp, Homo sapiens
catgtagccagcagaactg

SEQ ID NO: 2271299 - DNA, 17 bp, Homo sapiens
catgtatactccataga

SEQ ID NO: 2271300 - DNA, 14 bp, Homo sapiens
catgtatgatttct

SEQ ID NO: 2271301 - DNA, 12 bp, Homo sapiens
catgtctactgc

SEQ ID NO: 2271302 - DNA, 16 bp, Homo sapiens
catgtgatgagaggaa

SEQ ID NO: 2271303 - DNA, 12 bp, Homo sapiens
catgtgcagaca

SEQ ID NO: 2271304 - DNA, 16 bp, Homo sapiens
catgtgcagacactca

SEQ ID NO: 2271305 - DNA, 12 bp, Homo sapiens
catgtggccttg

SEQ ID NO: 2271306 - DNA, 14 bp, Homo sapiens
catgtgtacagaaa

SEQ ID NO: 2271307 - DNA, 12 bp, Homo sapiens
catgtgtggaaa

SEQ ID NO: 2271308 - DNA, 20 bp, Homo sapiens
catgttagtaatggcagagc

SEQ ID NO: 2271309 - DNA, 13 bp, Homo sapiens
catgttgcccaga

SEQ ID NO: 2271310 - DNA, 22 bp, Homo sapiens
catgtttctgcagtattctgta

SEQ ID NO: 2271311 - DNA, 16 bp, Homo sapiens
cattaaaaagaataga

SEQ ID NO: 2271312 - DNA, 14 bp, Homo sapiens
cattaaatataaaa

SEQ ID NO: 2271313 - DNA, 16 bp, Homo sapiens
cattaaatataaaata

SEQ ID NO: 2271314 - DNA, 16 bp, Homo sapiens
cattaattttatgaac

SEQ ID NO: 2271315 - DNA, 16 bp, Homo sapiens
cattacaaacaaagga

SEQ ID NO: 2271316 - DNA, 17 bp, Homo sapiens
cattacatcctctgctt

SEQ ID NO: 2271317 - DNA, 16 bp, Homo sapiens
cattagactgaattta

SEQ ID NO: 2271318 - DNA, 22 bp, Homo sapiens
cattagactgaatttaactact

SEQ ID NO: 2271319 - DNA, 23 bp, Homo sapiens
cattaggaacagagtatatatgt

SEQ ID NO: 2271320 - DNA, 20 bp, Homo sapiens
cattaggctgtggtgcagta

SEQ ID NO: 2271321 - DNA, 21 bp, Homo sapiens
cattagttggagctagaaaat

SEQ ID NO: 2271322 - DNA, 18 bp, Homo sapiens
cattataaaatctttcca

SEQ ID NO: 2271323 - DNA, 20 bp, Homo sapiens
cattataaaatctttccatc

SEQ ID NO: 2271324 - DNA, 22 bp, Homo sapiens
cattatcctgtgtgattacagc

SEQ ID NO: 2271325 - DNA, 17 bp, Homo sapiens
cattatgaagatgtttt

SEQ ID NO: 2271326 - DNA, 12 bp, Homo sapiens
cattatgccctt

SEQ ID NO: 2271327 - DNA, 21 bp, Homo sapiens
cattattttgtcataaaatgc

SEQ ID NO: 2271328 - DNA, 20 bp, Homo sapiens
cattcagcagaatgactctg

SEQ ID NO: 2271329 - DNA, 12 bp, Homo sapiens
cattcagcctcg

SEQ ID NO: 2271330 - DNA, 15 bp, Homo sapiens
cattcatactaaata

SEQ ID NO: 2271331 - DNA, 18 bp, Homo sapiens
cattccagcgtctgctgt

SEQ ID NO: 2271332 - DNA, 19 bp, Homo sapiens
cattccagcgtctgctgtt

SEQ ID NO: 2271333 - DNA, 16 bp, Homo sapiens
cattccaggagtggga

SEQ ID NO: 2271334 - DNA, 20 bp, Homo sapiens
cattctgctgcccccagacc

SEQ ID NO: 2271335 - DNA, 21 bp, Homo sapiens
cattctttataaaccataaaa

SEQ ID NO: 2271336 - DNA, 22 bp, Homo sapiens
cattctttctctttgaaaaaaa

SEQ ID NO: 2271337 - DNA, 23 bp, Homo sapiens
cattcttttcagcttgtttctat

SEQ ID NO: 2271338 - DNA, 12 bp, Homo sapiens
cattgaaataat

SEQ ID NO: 2271339 - DNA, 14 bp, Homo sapiens
cattgaaataataa

SEQ ID NO: 2271340 - DNA, 19 bp, Homo sapiens
cattgaaatctttttgctt

SEQ ID NO: 2271341 - DNA, 21 bp, Homo sapiens
cattgcactccagcctgggca

SEQ ID NO: 2271342 - DNA, 15 bp, Homo sapiens
cattgcagtatcaga

SEQ ID NO: 2271343 - DNA, 19 bp, Homo sapiens
cattgcagtatcagagggt

SEQ ID NO: 2271344 - DNA, 23 bp, Homo sapiens
cattgcagtatcagagggtggag

SEQ ID NO: 2271345 - DNA, 18 bp, Homo sapiens
ccagagacctgctccaga

SEQ ID NO: 2271346 - DNA, 19 bp, Homo sapiens
ccagagacctgctccagat

SEQ ID NO: 2271347 - DNA, 20 bp, Homo sapiens
ccagagacctgctccagatc

SEQ ID NO: 2271348 - DNA, 21 bp, Homo sapiens
ccagagacctgctccagatcc

SEQ ID NO: 2271349 - DNA, 12 bp, Homo sapiens
taattgtgtaac

SEQ ID NO: 2271350 - DNA, 19 bp, Homo sapiens
taattgtgtaactgttctt

SEQ ID NO: 2271351 - DNA, 18 bp, Homo sapiens
taatttacctgaagtctt

SEQ ID NO: 2271352 - DNA, 15 bp, Homo sapiens
taatttctaatttca

SEQ ID NO: 2271353 - DNA, 16 bp, Homo sapiens
taatttgccagacaga

SEQ ID NO: 2271354 - DNA, 15 bp, Homo sapiens
taattttgtagtagt

SEQ ID NO: 2271355 - DNA, 19 bp, Homo sapiens
taattttgtagtagttgat

SEQ ID NO: 2271356 - DNA, 18 bp, Homo sapiens
taattttgtatcacctct

SEQ ID NO: 2271357 - DNA, 21 bp, Homo sapiens
taatttttaccccctaaggaa

SEQ ID NO: 2271358 - DNA, 12 bp, Homo sapiens
tacaaagctgtc

SEQ ID NO: 2271359 - DNA, 15 bp, Homo sapiens
tacaaatttttactc

SEQ ID NO: 2271360 - DNA, 19 bp, Homo sapiens
tacaaatttttactcaggc

SEQ ID NO: 2271361 - DNA, 17 bp, Homo sapiens
tacaaccggttatcagt

SEQ ID NO: 2271362 - DNA, 14 bp, Homo sapiens
tacaagaaaaagta

SEQ ID NO: 2271363 - DNA, 18 bp, Homo sapiens
tacaatcttagtgaatgg

SEQ ID NO: 2271364 - DNA, 24 bp, Homo sapiens
tacacaaaggggatcataaagtta

SEQ ID NO: 2271365 - DNA, 19 bp, Homo sapiens
tacacggggttacactgtt

SEQ ID NO: 2271366 - DNA, 15 bp, Homo sapiens
tacactaaaatttaa

SEQ ID NO: 2271367 - DNA, 16 bp, Homo sapiens
tacactacaaatgtta

SEQ ID NO: 2271368 - DNA, 18 bp, Homo sapiens
acagagtatatatgtaca

SEQ ID NO: 2271369 - DNA, 22 bp, Homo sapiens
acagagtatatatgtacagtta

SEQ ID NO: 2271370 - DNA, 13 bp, Homo sapiens
acagatgagaaga

SEQ ID NO: 2271371 - DNA, 18 bp, Homo sapiens
acagattcagtcttgcct

SEQ ID NO: 2271372 - DNA, 12 bp, Homo sapiens
acagcagctcca

SEQ ID NO: 2271373 - DNA, 20 bp, Homo sapiens
acagcagctccaacctggag

SEQ ID NO: 2271374 - DNA, 23 bp, Homo sapiens
acagcagctccaacctggaggct

SEQ ID NO: 2271375 - DNA, 12 bp, Homo sapiens
acagcagctgga

SEQ ID NO: 2271376 - DNA, 21 bp, Homo sapiens
acagcagctggactgggtggg

SEQ ID NO: 2271377 - DNA, 15 bp, Homo sapiens
acagccccttgcttc

SEQ ID NO: 2271378 - DNA, 13 bp, Homo sapiens
acagcctcttcct

SEQ ID NO: 2271379 - DNA, 19 bp, Homo sapiens
acagcggcccggcccacgc

SEQ ID NO: 2271380 - DNA, 21 bp, Homo sapiens
acagcggcccggcccacgcag

SEQ ID NO: 2271381 - DNA, 13 bp, Homo sapiens
acagctaacatgg

SEQ ID NO: 2271382 - DNA, 23 bp, Homo sapiens
acagctacgtgtgcccctctcat

SEQ ID NO: 2271383 - DNA, 14 bp, Homo sapiens
acagctcctcccct

SEQ ID NO: 2271384 - DNA, 17 bp, Homo sapiens
acagctgactgaatgca

SEQ ID NO: 2271385 - DNA, 15 bp, Homo sapiens
acagctgtgaggaca

SEQ ID NO: 2271386 - DNA, 21 bp, Homo sapiens
acaggaacacccagccccagc

SEQ ID NO: 2271387 - DNA, 16 bp, Homo sapiens
acaggaggtgtgaatg

SEQ ID NO: 2271388 - DNA, 17 bp, Homo sapiens
acaggattctgacagag

SEQ ID NO: 2271389 - DNA, 17 bp, Homo sapiens
acaggattgtctgctgc

SEQ ID NO: 2271390 - DNA, 22 bp, Homo sapiens
acaggattgtctgctgcctcca

SEQ ID NO: 2271391 - DNA, 21 bp, Homo sapiens
acaggcaacattacaaacaaa

SEQ ID NO: 2271392 - DNA, 15 bp, Homo sapiens
acaggccatttcatt

SEQ ID NO: 2271393 - DNA, 12 bp, Homo sapiens
acaggctgcccc

SEQ ID NO: 2271394 - DNA, 23 bp, Homo sapiens
acaggctgccccacccctccatg

SEQ ID NO: 2271395 - DNA, 17 bp, Homo sapiens
acaggcttcgtctcaga

SEQ ID NO: 2271396 - DNA, 21 bp, Homo sapiens
acaggcttcgtctcagaaggc

SEQ ID NO: 2271397 - DNA, 21 bp, Homo sapiens
acaggggctggagggctgggc

SEQ ID NO: 2271398 - DNA, 23 bp, Homo sapiens
acaggggctggagggctgggcag

SEQ ID NO: 2271399 - DNA, 15 bp, Homo sapiens
acagggtctcactgt

SEQ ID NO: 2271400 - DNA, 12 bp, Homo sapiens
acaggtgtaaat

SEQ ID NO: 2271401 - DNA, 24 bp, Homo sapiens
acaggtgtactatggctgtatttt

SEQ ID NO: 2271402 - DNA, 11 bp, Homo sapiens
acaggttcctt

SEQ ID NO: 2271403 - DNA, 18 bp, Homo sapiens
acaggttccttttgaagc

SEQ ID NO: 2271404 - DNA, 22 bp, Homo sapiens
acaggttttattttatcacttg

SEQ ID NO: 2271405 - DNA, 13 bp, Homo sapiens
acagtcaggaagc

SEQ ID NO: 2271406 - DNA, 21 bp, Homo sapiens
acagtcatttcctacccttta

SEQ ID NO: 2271407 - DNA, 14 bp, Homo sapiens
acagtctagtttcc

SEQ ID NO: 2271408 - DNA, 14 bp, Homo sapiens
acagtctcattaca

SEQ ID NO: 2271409 - DNA, 15 bp, Homo sapiens
acagtggggcccatg

SEQ ID NO: 2271410 - DNA, 18 bp, Homo sapiens
acagtggggcccatggcc

SEQ ID NO: 2271411 - DNA, 23 bp, Homo sapiens
acagtggtcagcgattcctgcca

SEQ ID NO: 2271412 - DNA, 19 bp, Homo sapiens
acagttctcccttcaactg

SEQ ID NO: 2271413 - DNA, 17 bp, Homo sapiens
acagtttgtaaatgtta

SEQ ID NO: 2271414 - DNA, 18 bp, Homo sapiens
acagtttgtaaatgttat

SEQ ID NO: 2271415 - DNA, 22 bp, Homo sapiens
acagtttgtaaatgttatttct

SEQ ID NO: 2271416 - DNA, 14 bp, Homo sapiens
acataaaaattgtt

SEQ ID NO: 2271417 - DNA, 15 bp, Homo sapiens
acataaaagaatgta

SEQ ID NO: 2271418 - DNA, 19 bp, Homo sapiens
acataaaatatacaaacat

SEQ ID NO: 2271419 - DNA, 18 bp, Homo sapiens
acataaagaaacactttc

SEQ ID NO: 2271420 - DNA, 24 bp, Homo sapiens
acataaagtaataactgttagaat

SEQ ID NO: 2271421 - DNA, 13 bp, Homo sapiens
acataaatctgtc

SEQ ID NO: 2271422 - DNA, 15 bp, Homo sapiens
acataaatctgtctg

SEQ ID NO: 2271423 - DNA, 14 bp, Homo sapiens
acatagatgctaca

SEQ ID NO: 2271424 - DNA, 19 bp, Homo sapiens
acatatatcttatccaatt

SEQ ID NO: 2271425 - DNA, 13 bp, Homo sapiens
acatcaacattcc

SEQ ID NO: 2271426 - DNA, 19 bp, Homo sapiens
acatccactctctcttgtt

SEQ ID NO: 2271427 - DNA, 22 bp, Homo sapiens
acatccactctctcttgttctt

SEQ ID NO: 2271428 - DNA, 17 bp, Homo sapiens
acatcggttcaggagga

SEQ ID NO: 2271429 - DNA, 18 bp, Homo sapiens
acatctagcacagctgtg

SEQ ID NO: 2271430 - DNA, 19 bp, Homo sapiens
acatctcacttcagttgtg

SEQ ID NO: 2271431 - DNA, 23 bp, Homo sapiens
acatctcacttcagttgtggcct

SEQ ID NO: 2271432 - DNA, 11 bp, Homo sapiens
acatctcagag

SEQ ID NO: 2271433 - DNA, 11 bp, Homo sapiens
acatctgaaaa

SEQ ID NO: 2271434 - DNA, 12 bp, Homo sapiens
acatctgaaaag

SEQ ID NO: 2271435 - DNA, 18 bp, Homo sapiens
acatctgaaaagaaatgc

SEQ ID NO: 2271436 - DNA, 14 bp, Homo sapiens
acatctgaaatcta

SEQ ID NO: 2271437 - DNA, 15 bp, Homo sapiens
acatgcactcagtgt

SEQ ID NO: 2271438 - DNA, 19 bp, Homo sapiens
acatgcatcctcccctctc

SEQ ID NO: 2271439 - DNA, 16 bp, Homo sapiens
acatggaacttaaaac

SEQ ID NO: 2271440 - DNA, 18 bp, Homo sapiens
acatggaacttaaaacat

SEQ ID NO: 2271441 - DNA, 20 bp, Homo sapiens
acatggaacttaaaacatat

SEQ ID NO: 2271442 - DNA, 22 bp, Homo sapiens
acatggaacttaaaacatatgg

SEQ ID NO: 2271443 - DNA, 19 bp, Homo sapiens
acatggattgattaaaagc

SEQ ID NO: 2271444 - DNA, 13 bp, Homo sapiens
acatgggttcaat

SEQ ID NO: 2271445 - DNA, 22 bp, Homo sapiens
acatgtatactccatagaaact

SEQ ID NO: 2271446 - DNA, 13 bp, Homo sapiens
acatgtatagtga

SEQ ID NO: 2271447 - DNA, 13 bp, Homo sapiens
acatgtctaaagt

SEQ ID NO: 2271448 - DNA, 11 bp, Homo sapiens
acattaaaatg

SEQ ID NO: 2271449 - DNA, 18 bp, Homo sapiens
acattaggaacagagtat

SEQ ID NO: 2271450 - DNA, 19 bp, Homo sapiens
acattaggaacagagtata

SEQ ID NO: 2271451 - DNA, 20 bp, Homo sapiens
acattgcataagtggaccca

SEQ ID NO: 2271452 - DNA, 17 bp, Homo sapiens
acattgcccacacctgc

SEQ ID NO: 2271453 - DNA, 19 bp, Homo sapiens
acattgcccacacctgcct

SEQ ID NO: 2271454 - DNA, 19 bp, Homo sapiens
acattgctttagacaaatt

SEQ ID NO: 2271455 - DNA, 23 bp, Homo sapiens
acattgttatgcacttttcccca

SEQ ID NO: 2271456 - DNA, 13 bp, Homo sapiens
acatttaactagc

SEQ ID NO: 2271457 - DNA, 21 bp, Homo sapiens
acatttagaacctgcatttaa

SEQ ID NO: 2271458 - DNA, 16 bp, Homo sapiens
acatttagtccaatga

SEQ ID NO: 2271459 - DNA, 19 bp, Homo sapiens
acatttagtccaatgaaga

SEQ ID NO: 2271460 - DNA, 21 bp, Homo sapiens
acatttagtccaatgaagata

SEQ ID NO: 2271461 - DNA, 16 bp, Homo sapiens
acatttccctatttta

SEQ ID NO: 2271462 - DNA, 14 bp, Homo sapiens
acatttgtcactga

SEQ ID NO: 2271463 - DNA, 17 bp, Homo sapiens
acattttaaaatcaact

SEQ ID NO: 2271464 - DNA, 18 bp, Homo sapiens
acattttgggctggataa

SEQ ID NO: 2271465 - DNA, 17 bp, Homo sapiens
accaaaacataagacga

SEQ ID NO: 2271466 - DNA, 21 bp, Homo sapiens
accaaatataaacttgtgtat

SEQ ID NO: 2271467 - DNA, 21 bp, Homo sapiens
accaaattctgtggctgccat

SEQ ID NO: 2271468 - DNA, 22 bp, Homo sapiens
accaactaagttgtattttaat

SEQ ID NO: 2271469 - DNA, 16 bp, Homo sapiens
accaagatcacaaata

SEQ ID NO: 2271470 - DNA, 20 bp, Homo sapiens
accaagctgtgaccctcaat

SEQ ID NO: 2271471 - DNA, 12 bp, Homo sapiens
accaagttacac

SEQ ID NO: 2271472 - DNA, 12 bp, Homo sapiens
accaataaaagt

SEQ ID NO: 2271473 - DNA, 13 bp, Homo sapiens
accaatctctgtg

SEQ ID NO: 2271474 - DNA, 16 bp, Homo sapiens
accaatctctgtgact

SEQ ID NO: 2271475 - DNA, 15 bp, Homo sapiens
accaattgtttcttg

SEQ ID NO: 2271476 - DNA, 16 bp, Homo sapiens
accacatggaacttaa

SEQ ID NO: 2271477 - DNA, 13 bp, Homo sapiens
accaccaaatgac

SEQ ID NO: 2271478 - DNA, 13 bp, Homo sapiens
accactgtttctt

SEQ ID NO: 2271479 - DNA, 17 bp, Homo sapiens
accactgtttcttgctt

SEQ ID NO: 2271480 - DNA, 19 bp, Homo sapiens
accactgtttcttgcttgt

SEQ ID NO: 2271481 - DNA, 20 bp, Homo sapiens
accactgtttcttgcttgta

SEQ ID NO: 2271482 - DNA, 20 bp, Homo sapiens
accagagcactgtatacccc

SEQ ID NO: 2271483 - DNA, 17 bp, Homo sapiens
accagagtcagcacagg

SEQ ID NO: 2271484 - DNA, 21 bp, Homo sapiens
accagatgacacataaatctg

SEQ ID NO: 2271485 - DNA, 14 bp, Homo sapiens
accagcacactccc

SEQ ID NO: 2271486 - DNA, 16 bp, Homo sapiens
accagcacactcccga

SEQ ID NO: 2271487 - DNA, 17 bp, Homo sapiens
accagcactcccagggc

SEQ ID NO: 2271488 - DNA, 19 bp, Homo sapiens
accagcactcccagggccc

SEQ ID NO: 2271489 - DNA, 16 bp, Homo sapiens
accagcatagttctgc

SEQ ID NO: 2271490 - DNA, 12 bp, Homo sapiens
accagcctgagc

SEQ ID NO: 2271491 - DNA, 13 bp, Homo sapiens
accagcctgagcc

SEQ ID NO: 2271492 - DNA, 15 bp, Homo sapiens
accagcctgagccac

SEQ ID NO: 2271493 - DNA, 22 bp, Homo sapiens
accaggactctgccttccaggc

SEQ ID NO: 2271494 - DNA, 14 bp, Homo sapiens
accaggtcctgtga

SEQ ID NO: 2271495 - DNA, 15 bp, Homo sapiens
accagtatctccatc

SEQ ID NO: 2271496 - DNA, 20 bp, Homo sapiens
accagtttcacataagttat

SEQ ID NO: 2271497 - DNA, 22 bp, Homo sapiens
accataaaataaataatctcat

SEQ ID NO: 2271498 - DNA, 19 bp, Homo sapiens
accatatgattgaaaagaa

SEQ ID NO: 2271499 - DNA, 21 bp, Homo sapiens
accatatgtagcattaaatat

SEQ ID NO: 2271500 - DNA, 21 bp, Homo sapiens
accatcatttaatttctaatt

SEQ ID NO: 2271501 - DNA, 10 bp, Homo sapiens
accatgagaa

SEQ ID NO: 2271502 - DNA, 23 bp, Homo sapiens
accattttgctgtcccttttcct

SEQ ID NO: 2271503 - DNA, 12 bp, Homo sapiens
acccaaaagatt

SEQ ID NO: 2271504 - DNA, 13 bp, Homo sapiens
acccaaataaatg

SEQ ID NO: 2271505 - DNA, 16 bp, Homo sapiens
acccaaataaatgtgt

SEQ ID NO: 2271506 - DNA, 21 bp, Homo sapiens
acccaaataaatgtgtaaatg

SEQ ID NO: 2271507 - DNA, 22 bp, Homo sapiens
acccaagcacaaactgtcgtct

SEQ ID NO: 2271508 - DNA, 14 bp, Homo sapiens
acccaattttaaaa

SEQ ID NO: 2271509 - DNA, 22 bp, Homo sapiens
acccaattttaaaaaataacat

SEQ ID NO: 2271510 - DNA, 21 bp, Homo sapiens
acccactccgactccccctcc

SEQ ID NO: 2271511 - DNA, 16 bp, Homo sapiens
acccaggtgtggccta

SEQ ID NO: 2271512 - DNA, 18 bp, Homo sapiens
acccattcatactaaata

SEQ ID NO: 2271513 - DNA, 13 bp, Homo sapiens
accccaagcattc

SEQ ID NO: 2271514 - DNA, 15 bp, Homo sapiens
accccacacgccggg

SEQ ID NO: 2271515 - DNA, 20 bp, Homo sapiens
accccacacgccggggctgg

SEQ ID NO: 2271516 - DNA, 13 bp, Homo sapiens
accccatccagcc

SEQ ID NO: 2271517 - DNA, 14 bp, Homo sapiens
acccccacctcccg

SEQ ID NO: 2271518 - DNA, 16 bp, Homo sapiens
acccccactttcgcct

SEQ ID NO: 2271519 - DNA, 21 bp, Homo sapiens
acccccactttcgcctcctcc

SEQ ID NO: 2271520 - DNA, 16 bp, Homo sapiens
acccccgggtgcctgt

SEQ ID NO: 2271521 - DNA, 15 bp, Homo sapiens
acccccgtgccaaat

SEQ ID NO: 2271522 - DNA, 23 bp, Homo sapiens
acccccgtgccaaatcctgggca

SEQ ID NO: 2271523 - DNA, 14 bp, Homo sapiens
accccgctgcctgg

SEQ ID NO: 2271524 - DNA, 21 bp, Homo sapiens
accccgctgcctggcgggcag

SEQ ID NO: 2271525 - DNA, 14 bp, Homo sapiens
accccgtctgcccc

SEQ ID NO: 2271526 - DNA, 19 bp, Homo sapiens
acccctaggtcatttgtag

SEQ ID NO: 2271527 - DNA, 17 bp, Homo sapiens
acccctcctccttgctg

SEQ ID NO: 2271528 - DNA, 18 bp, Homo sapiens
acccctgcagctcctctg

SEQ ID NO: 2271529 - DNA, 23 bp, Homo sapiens
acccctgggggaggcttccagct

SEQ ID NO: 2271530 - DNA, 20 bp, Homo sapiens
acccgccccagagactgccc

SEQ ID NO: 2271531 - DNA, 14 bp, Homo sapiens
acccgcccctgccc

SEQ ID NO: 2271532 - DNA, 14 bp, Homo sapiens
acccggatgaactc

SEQ ID NO: 2271533 - DNA, 21 bp, Homo sapiens
acccggatgaactcaatgcat

SEQ ID NO: 2271534 - DNA, 20 bp, Homo sapiens
acccggcatgccgagtgccc

SEQ ID NO: 2271535 - DNA, 12 bp, Homo sapiens
accctctgctgc

SEQ ID NO: 2271536 - DNA, 16 bp, Homo sapiens
accctctgctgcacag

SEQ ID NO: 2271537 - DNA, 11 bp, Homo sapiens
accctctgggg

SEQ ID NO: 2271538 - DNA, 15 bp, Homo sapiens
accctctggggccct

SEQ ID NO: 2271539 - DNA, 17 bp, Homo sapiens
accctgaggagtgatgg

SEQ ID NO: 2271540 - DNA, 17 bp, Homo sapiens
accctgccaccctctgc

SEQ ID NO: 2271541 - DNA, 21 bp, Homo sapiens
accctgccaccctctgctgca

SEQ ID NO: 2271542 - DNA, 23 bp, Homo sapiens
accctgccaccctctgctgcaca

SEQ ID NO: 2271543 - DNA, 13 bp, Homo sapiens
accctgccctgca

SEQ ID NO: 2271544 - DNA, 19 bp, Homo sapiens
accctgccctgcaccttgg

SEQ ID NO: 2271545 - DNA, 17 bp, Homo sapiens
accctggagtggcatgg

SEQ ID NO: 2271546 - DNA, 18 bp, Homo sapiens
accctggagtggcatggt

SEQ ID NO: 2271547 - DNA, 22 bp, Homo sapiens
accctggagtggcatggtcctg

SEQ ID NO: 2271548 - DNA, 14 bp, Homo sapiens
accctggctggaat

SEQ ID NO: 2271549 - DNA, 14 bp, Homo sapiens
accctgggcctccc

SEQ ID NO: 2271550 - DNA, 20 bp, Homo sapiens
acccttgttttttatagttg

SEQ ID NO: 2271551 - DNA, 19 bp, Homo sapiens
accgaaaacgtggctgctt

SEQ ID NO: 2271552 - DNA, 17 bp, Homo sapiens
accgagtgtggagctgc

SEQ ID NO: 2271553 - DNA, 22 bp, Homo sapiens
accgagtgtggagctgcttcca

SEQ ID NO: 2271554 - DNA, 18 bp, Homo sapiens
accgcaccgggctggcct

SEQ ID NO: 2271555 - DNA, 21 bp, Homo sapiens
accgcaccgggctggcctgac

SEQ ID NO: 2271556 - DNA, 21 bp, Homo sapiens
accgcccaacccccacctccc

SEQ ID NO: 2271557 - DNA, 12 bp, Homo sapiens
accgcccaccca

SEQ ID NO: 2271558 - DNA, 12 bp, Homo sapiens
accgcctgcccc

SEQ ID NO: 2271559 - DNA, 14 bp, Homo sapiens
accgcgcctacctt

SEQ ID NO: 2271560 - DNA, 22 bp, Homo sapiens
accgggagcctgcgtggcctgg

SEQ ID NO: 2271561 - DNA, 23 bp, Homo sapiens
accgggagcctgcgtggcctggg

SEQ ID NO: 2271562 - DNA, 23 bp, Homo sapiens
accggggtcctgaggctggggct

SEQ ID NO: 2271563 - DNA, 11 bp, Homo sapiens
accgtgtgctc

SEQ ID NO: 2271564 - DNA, 18 bp, Homo sapiens
acctaaatccattttcta

SEQ ID NO: 2271565 - DNA, 12 bp, Homo sapiens
acctacatctga

SEQ ID NO: 2271566 - DNA, 14 bp, Homo sapiens
acctacatctgaaa

SEQ ID NO: 2271567 - DNA, 15 bp, Homo sapiens
acctaccactacatt

SEQ ID NO: 2271568 - DNA, 19 bp, Homo sapiens
acctataaaattatgaaaa

SEQ ID NO: 2271569 - DNA, 20 bp, Homo sapiens
acctcaatttatgttaacag

SEQ ID NO: 2271570 - DNA, 15 bp, Homo sapiens
acctcactcagcacc

SEQ ID NO: 2271571 - DNA, 22 bp, Homo sapiens
acctcactcagcaccactcaag

SEQ ID NO: 2271572 - DNA, 17 bp, Homo sapiens
acctcactgctttgtag

SEQ ID NO: 2271573 - DNA, 18 bp, Homo sapiens
acctcatgccgctgtgtc

SEQ ID NO: 2271574 - DNA, 20 bp, Homo sapiens
acctcatgccgctgtgtcta

SEQ ID NO: 2271575 - DNA, 12 bp, Homo sapiens
acctcccccagg

SEQ ID NO: 2271576 - DNA, 13 bp, Homo sapiens
acctcccccaggg

SEQ ID NO: 2271577 - DNA, 12 bp, Homo sapiens
acctccctggct

SEQ ID NO: 2271578 - DNA, 14 bp, Homo sapiens
acctccctggcttg

SEQ ID NO: 2271579 - DNA, 14 bp, Homo sapiens
acctcgccctctct

SEQ ID NO: 2271580 - DNA, 21 bp, Homo sapiens
acctcgccctctctcaccagc

SEQ ID NO: 2271581 - DNA, 19 bp, Homo sapiens
acctcgctccaactccaac

SEQ ID NO: 2271582 - DNA, 19 bp, Homo sapiens
acctcggaatttctatgag

SEQ ID NO: 2271583 - DNA, 22 bp, Homo sapiens
acctctatatgttgctgaaaca

SEQ ID NO: 2271584 - DNA, 17 bp, Homo sapiens
acctctcacttttttat

SEQ ID NO: 2271585 - DNA, 17 bp, Homo sapiens
acctctcagatccctcg

SEQ ID NO: 2271586 - DNA, 14 bp, Homo sapiens
acctgaaacacttt

SEQ ID NO: 2271587 - DNA, 14 bp, Homo sapiens
acctgacacctgcc

SEQ ID NO: 2271588 - DNA, 15 bp, Homo sapiens
acctgacacctgccg

SEQ ID NO: 2271589 - DNA, 18 bp, Homo sapiens
acctgacacctgccgctg

SEQ ID NO: 2271590 - DNA, 19 bp, Homo sapiens
acctgacacctgccgctgc

SEQ ID NO: 2271591 - DNA, 22 bp, Homo sapiens
acctgaggcaggagggcatgtg

SEQ ID NO: 2271592 - DNA, 15 bp, Homo sapiens
acctgatttctcctg

SEQ ID NO: 2271593 - DNA, 15 bp, Homo sapiens
acctgcaaggcaaag

SEQ ID NO: 2271594 - DNA, 19 bp, Homo sapiens
acctgcaggactcgggcta

SEQ ID NO: 2271595 - DNA, 22 bp, Homo sapiens
acctgcatttaagaacagaaca

SEQ ID NO: 2271596 - DNA, 10 bp, Homo sapiens
acctgcccag

SEQ ID NO: 2271597 - DNA, 22 bp, Homo sapiens
acctgcccagttagcccggcca

SEQ ID NO: 2271598 - DNA, 21 bp, Homo sapiens
acctgcgcaaagggcgggcct

SEQ ID NO: 2271599 - DNA, 12 bp, Homo sapiens
acctgctccaga

SEQ ID NO: 2271600 - DNA, 14 bp, Homo sapiens
acctgctccagatc

SEQ ID NO: 2271601 - DNA, 18 bp, Homo sapiens
acctggaggctggaccaa

SEQ ID NO: 2271602 - DNA, 22 bp, Homo sapiens
acctggaggctggaccaactgc

SEQ ID NO: 2271603 - DNA, 15 bp, Homo sapiens
acctgggagatgctg

SEQ ID NO: 2271604 - DNA, 18 bp, Homo sapiens
acctgggagatgctggga

SEQ ID NO: 2271605 - DNA, 22 bp, Homo sapiens
acctgggagatgctgggaccct

SEQ ID NO: 2271606 - DNA, 21 bp, Homo sapiens
acctggggtcccccctccctg

SEQ ID NO: 2271607 - DNA, 17 bp, Homo sapiens
acctggttttcattatt

SEQ ID NO: 2271608 - DNA, 13 bp, Homo sapiens
acctgtgcaaaat

SEQ ID NO: 2271609 - DNA, 11 bp, Homo sapiens
acctgtgtctc

SEQ ID NO: 2271610 - DNA, 19 bp, Homo sapiens
acctgtttctgcagccact

SEQ ID NO: 2271611 - DNA, 20 bp, Homo sapiens
accttgtgtactttcttccc

SEQ ID NO: 2271612 - DNA, 17 bp, Homo sapiens
acctttgggactaagct

SEQ ID NO: 2271613 - DNA, 14 bp, Homo sapiens
accttttgagtgcc

SEQ ID NO: 2271614 - DNA, 18 bp, Homo sapiens
acctttttgaacatgtat

SEQ ID NO: 2271615 - DNA, 15 bp, Homo sapiens
acgaatattgctgat

SEQ ID NO: 2271616 - DNA, 21 bp, Homo sapiens
acgacctacatctgaaatcta

SEQ ID NO: 2271617 - DNA, 11 bp, Homo sapiens
acgagatttgc

SEQ ID NO: 2271618 - DNA, 18 bp, Homo sapiens
acgaggccttcagaaaag

SEQ ID NO: 2271619 - DNA, 19 bp, Homo sapiens
acgagttaatgatggcaga

SEQ ID NO: 2271620 - DNA, 14 bp, Homo sapiens
acgcacttctgggg

SEQ ID NO: 2271621 - DNA, 12 bp, Homo sapiens
acgcagagcccc

SEQ ID NO: 2271622 - DNA, 14 bp, Homo sapiens
acgcagagccccgg

SEQ ID NO: 2271623 - DNA, 20 bp, Homo sapiens
acgcagggagaccctgggag

SEQ ID NO: 2271624 - DNA, 17 bp, Homo sapiens
acgccggggctggccct

SEQ ID NO: 2271625 - DNA, 23 bp, Homo sapiens
acgccggggctggccctgccctc

SEQ ID NO: 2271626 - DNA, 18 bp, Homo sapiens
acgcctcttgttcatgtc

SEQ ID NO: 2271627 - DNA, 22 bp, Homo sapiens
acgctgggaataggtttcaaca

SEQ ID NO: 2271628 - DNA, 14 bp, Homo sapiens
acggcagccccatc

SEQ ID NO: 2271629 - DNA, 13 bp, Homo sapiens
acggcctctgggg

SEQ ID NO: 2271630 - DNA, 13 bp, Homo sapiens
acgggagagcgcc

SEQ ID NO: 2271631 - DNA, 20 bp, Homo sapiens
acgggcaacactcactgcct

SEQ ID NO: 2271632 - DNA, 14 bp, Homo sapiens
acggggacacggcc

SEQ ID NO: 2271633 - DNA, 15 bp, Homo sapiens
acggggcagagctga

SEQ ID NO: 2271634 - DNA, 15 bp, Homo sapiens
acggggccagcatcc

SEQ ID NO: 2271635 - DNA, 18 bp, Homo sapiens
acggggcccgccccaggc

SEQ ID NO: 2271636 - DNA, 16 bp, Homo sapiens
acggggttacactgtt

SEQ ID NO: 2271637 - DNA, 14 bp, Homo sapiens
acgggtgtggctcg

SEQ ID NO: 2271638 - DNA, 13 bp, Homo sapiens
acggtctgtgccc

SEQ ID NO: 2271639 - DNA, 15 bp, Homo sapiens
acggtctgtgcccga

SEQ ID NO: 2271640 - DNA, 18 bp, Homo sapiens
acgtgctcttctgttctc

SEQ ID NO: 2271641 - DNA, 14 bp, Homo sapiens
acgtggcacctcct

SEQ ID NO: 2271642 - DNA, 16 bp, Homo sapiens
acgtggcacctcctcg

SEQ ID NO: 2271643 - DNA, 17 bp, Homo sapiens
acgtggctgcttcaagg

SEQ ID NO: 2271644 - DNA, 19 bp, Homo sapiens
acgtggctgcttcaaggat

SEQ ID NO: 2271645 - DNA, 23 bp, Homo sapiens
acgtggctgcttcaaggatcctg

SEQ ID NO: 2271646 - DNA, 21 bp, Homo sapiens
actaaaatagtttaaaaatat

SEQ ID NO: 2271647 - DNA, 18 bp, Homo sapiens
actaaaattcaacaaatg

SEQ ID NO: 2271648 - DNA, 21 bp, Homo sapiens
actaaataatgatcttccaaa

SEQ ID NO: 2271649 - DNA, 14 bp, Homo sapiens
actaaggcaggtgg

SEQ ID NO: 2271650 - DNA, 14 bp, Homo sapiens
actaattaaaaaat

SEQ ID NO: 2271651 - DNA, 23 bp, Homo sapiens
actacataattaaattttaatgt

SEQ ID NO: 2271652 - DNA, 17 bp, Homo sapiens
actacattaaaagcttt

SEQ ID NO: 2271653 - DNA, 14 bp, Homo sapiens
actacggttgggag

SEQ ID NO: 2271654 - DNA, 13 bp, Homo sapiens
actacttgatata

SEQ ID NO: 2271655 - DNA, 17 bp, Homo sapiens
actagagactctgtgat

SEQ ID NO: 2271656 - DNA, 15 bp, Homo sapiens
actagatctcctgta

SEQ ID NO: 2271657 - DNA, 16 bp, Homo sapiens
actagatctcctgtaa

SEQ ID NO: 2271658 - DNA, 15 bp, Homo sapiens
actagcaaacaaaaa

SEQ ID NO: 2271659 - DNA, 13 bp, Homo sapiens
actagtactgtgt

SEQ ID NO: 2271660 - DNA, 23 bp, Homo sapiens
actagtactgtgtactgtataga

SEQ ID NO: 2271661 - DNA, 13 bp, Homo sapiens
actagtgaaaaat

SEQ ID NO: 2271662 - DNA, 22 bp, Homo sapiens
actatggctgtatttttagaga

SEQ ID NO: 2271663 - DNA, 19 bp, Homo sapiens
actatggtgtgcttatgtt

SEQ ID NO: 2271664 - DNA, 18 bp, Homo sapiens
actatgtgtcatgatttc

SEQ ID NO: 2271665 - DNA, 16 bp, Homo sapiens
actattgttagtctct

SEQ ID NO: 2271666 - DNA, 15 bp, Homo sapiens
actatttagataaca

SEQ ID NO: 2271667 - DNA, 21 bp, Homo sapiens
actcaaagaggccagtacttt

SEQ ID NO: 2271668 - DNA, 12 bp, Homo sapiens
actcaaggaatg

SEQ ID NO: 2271669 - DNA, 14 bp, Homo sapiens
actcaatgcatgat

SEQ ID NO: 2271670 - DNA, 14 bp, Homo sapiens
actcaccaaaatat

SEQ ID NO: 2271671 - DNA, 13 bp, Homo sapiens
actcactgcctgc

SEQ ID NO: 2271672 - DNA, 17 bp, Homo sapiens
actcactgcctgcagct

SEQ ID NO: 2271673 - DNA, 22 bp, Homo sapiens
actcacttaattctcattatga

SEQ ID NO: 2271674 - DNA, 14 bp, Homo sapiens
actcaggcccacat

SEQ ID NO: 2271675 - DNA, 16 bp, Homo sapiens
actcaggctttctatt

SEQ ID NO: 2271676 - DNA, 14 bp, Homo sapiens
actcagttcttggc

SEQ ID NO: 2271677 - DNA, 16 bp, Homo sapiens
actccaaaaagaaata

SEQ ID NO: 2271678 - DNA, 19 bp, Homo sapiens
actccaaaaagaaatatta

SEQ ID NO: 2271679 - DNA, 14 bp, Homo sapiens
actccaaggtggca

SEQ ID NO: 2271680 - DNA, 20 bp, Homo sapiens
actccaaggtggcatagcca

SEQ ID NO: 2271681 - DNA, 22 bp, Homo sapiens
actccaaggtggcatagccatt

SEQ ID NO: 2271682 - DNA, 23 bp, Homo sapiens
actccagaatttcccaaagcagt

SEQ ID NO: 2271683 - DNA, 21 bp, Homo sapiens
actccattactaaagacagaa

SEQ ID NO: 2271684 - DNA, 12 bp, Homo sapiens
actcccagggcc

SEQ ID NO: 2271685 - DNA, 16 bp, Homo sapiens
actcccagggcccgag

SEQ ID NO: 2271686 - DNA, 17 bp, Homo sapiens
actccccctccccggca

SEQ ID NO: 2271687 - DNA, 20 bp, Homo sapiens
actccccgcccgccctcctc

SEQ ID NO: 2271688 - DNA, 21 bp, Homo sapiens
actccccgcccgccctcctct

SEQ ID NO: 2271689 - DNA, 16 bp, Homo sapiens
actcgcgacaatgcaa

SEQ ID NO: 2271690 - DNA, 23 bp, Homo sapiens
actcgcgacaatgcaaaccatca

SEQ ID NO: 2271691 - DNA, 14 bp, Homo sapiens
actcgcgagagggt

SEQ ID NO: 2271692 - DNA, 11 bp, Homo sapiens
actctccaggc

SEQ ID NO: 2271693 - DNA, 20 bp, Homo sapiens
actctccaggcaccgcctgc

SEQ ID NO: 2271694 - DNA, 23 bp, Homo sapiens
actctccaggcaccgcctgcccc

SEQ ID NO: 2271695 - DNA, 14 bp, Homo sapiens
actctgaaatcagc

SEQ ID NO: 2271696 - DNA, 22 bp, Homo sapiens
actctgagactcgcgacaatgc

SEQ ID NO: 2271697 - DNA, 14 bp, Homo sapiens
actctgccttccag

SEQ ID NO: 2271698 - DNA, 13 bp, Homo sapiens
actctgctcaggg

SEQ ID NO: 2271699 - DNA, 15 bp, Homo sapiens
actctgctcagggcc

SEQ ID NO: 2271700 - DNA, 20 bp, Homo sapiens
actctggaaccatcctctgt

SEQ ID NO: 2271701 - DNA, 14 bp, Homo sapiens
actctgggaagaat

SEQ ID NO: 2271702 - DNA, 12 bp, Homo sapiens
actctgtgatct

SEQ ID NO: 2271703 - DNA, 18 bp, Homo sapiens
actctgtgtaatctctga

SEQ ID NO: 2271704 - DNA, 18 bp, Homo sapiens
actctgttgaccaggctg

SEQ ID NO: 2271705 - DNA, 21 bp, Homo sapiens
actcttgtctcctcctccagg

SEQ ID NO: 2271706 - DNA, 16 bp, Homo sapiens
actgaaaaatctagac

SEQ ID NO: 2271707 - DNA, 14 bp, Homo sapiens
actgaaacctctgt

SEQ ID NO: 2271708 - DNA, 15 bp, Homo sapiens
actgaaacctctgtt

SEQ ID NO: 2271709 - DNA, 13 bp, Homo sapiens
actgaacagaaat

SEQ ID NO: 2271710 - DNA, 14 bp, Homo sapiens
actgaatttaacta

SEQ ID NO: 2271711 - DNA, 20 bp, Homo sapiens
actgatatcacgggcccgct

SEQ ID NO: 2271712 - DNA, 20 bp, Homo sapiens
actgatgagatacatttgat

SEQ ID NO: 2271713 - DNA, 20 bp, Homo sapiens
actgatgtatagctttaaca

SEQ ID NO: 2271714 - DNA, 20 bp, Homo sapiens
actgatttcccattttaaag

SEQ ID NO: 2271715 - DNA, 19 bp, Homo sapiens
actgatttttttttccttc

SEQ ID NO: 2271716 - DNA, 16 bp, Homo sapiens
actgcacttagctgtt

SEQ ID NO: 2271717 - DNA, 14 bp, Homo sapiens
actgcagcagaaag

SEQ ID NO: 2271718 - DNA, 22 bp, Homo sapiens
actgcagcctcgacctccctgg

SEQ ID NO: 2271719 - DNA, 15 bp, Homo sapiens
actgcatctttctct

SEQ ID NO: 2271720 - DNA, 17 bp, Homo sapiens
actgccaaataaaatgt

SEQ ID NO: 2271721 - DNA, 14 bp, Homo sapiens
actgccaacctcgc

SEQ ID NO: 2271722 - DNA, 16 bp, Homo sapiens
actgccattagactga

SEQ ID NO: 2271723 - DNA, 17 bp, Homo sapiens
actgcccaccctgggcc

SEQ ID NO: 2271724 - DNA, 15 bp, Homo sapiens
actgcccagatgttt

SEQ ID NO: 2271725 - DNA, 16 bp, Homo sapiens
actgcccattgtaact

SEQ ID NO: 2271726 - DNA, 14 bp, Homo sapiens
actgccgctgcccc

SEQ ID NO: 2271727 - DNA, 15 bp, Homo sapiens
actgccgctgccccc

SEQ ID NO: 2271728 - DNA, 13 bp, Homo sapiens
actgcctgcagct

SEQ ID NO: 2271729 - DNA, 15 bp, Homo sapiens
actgcctgcagctga

SEQ ID NO: 2271730 - DNA, 20 bp, Homo sapiens
actgctagaaccaagcacta

SEQ ID NO: 2271731 - DNA, 21 bp, Homo sapiens
actgctttgttttggctgctc

SEQ ID NO: 2271732 - DNA, 20 bp, Homo sapiens
actggaaggctttattcttc

SEQ ID NO: 2271733 - DNA, 17 bp, Homo sapiens
actggaattcaaagata

SEQ ID NO: 2271734 - DNA, 14 bp, Homo sapiens
actggactagtgaa

SEQ ID NO: 2271735 - DNA, 19 bp, Homo sapiens
actggactcttcaaaaact

SEQ ID NO: 2271736 - DNA, 22 bp, Homo sapiens
actggactcttcaaaaactgtt

SEQ ID NO: 2271737 - DNA, 14 bp, Homo sapiens
actggatagaaaaa

SEQ ID NO: 2271738 - DNA, 12 bp, Homo sapiens
actggccccagg

SEQ ID NO: 2271739 - DNA, 13 bp, Homo sapiens
actggccccaggc

SEQ ID NO: 2271740 - DNA, 14 bp, Homo sapiens
actggccccaggcg

SEQ ID NO: 2271741 - DNA, 18 bp, Homo sapiens
actggggtgggagggggc

SEQ ID NO: 2271742 - DNA, 21 bp, Homo sapiens
actggggtgggagggggcagg

SEQ ID NO: 2271743 - DNA, 23 bp, Homo sapiens
actggggtgggagggggcagggg

SEQ ID NO: 2271744 - DNA, 19 bp, Homo sapiens
actggttatagttgatatg

SEQ ID NO: 2271745 - DNA, 23 bp, Homo sapiens
actggttatagttgatatgtaac

SEQ ID NO: 2271746 - DNA, 13 bp, Homo sapiens
actgtagcaatat

SEQ ID NO: 2271747 - DNA, 16 bp, Homo sapiens
actgtatagacagttt

SEQ ID NO: 2271748 - DNA, 21 bp, Homo sapiens
actgtatatgtcaaaaatatt

SEQ ID NO: 2271749 - DNA, 16 bp, Homo sapiens
actgtatattattgct

SEQ ID NO: 2271750 - DNA, 22 bp, Homo sapiens
actgtatctaaaaaataactgt

SEQ ID NO: 2271751 - DNA, 17 bp, Homo sapiens
actgtcagagaatatga

SEQ ID NO: 2271752 - DNA, 17 bp, Homo sapiens
actgtccagtccagtga

SEQ ID NO: 2271753 - DNA, 17 bp, Homo sapiens
actgtctgtaagagaat

SEQ ID NO: 2271754 - DNA, 16 bp, Homo sapiens
actgtcttcaaccctg

SEQ ID NO: 2271755 - DNA, 18 bp, Homo sapiens
actgtcttcaaccctgcc

SEQ ID NO: 2271756 - DNA, 20 bp, Homo sapiens
actgtcttcaaccctgccct

SEQ ID NO: 2271757 - DNA, 22 bp, Homo sapiens
actgtcttcaaccctgccctgc

SEQ ID NO: 2271758 - DNA, 12 bp, Homo sapiens
aggaggggagca

SEQ ID NO: 2271759 - DNA, 13 bp, Homo sapiens
aggaggggagcaa

SEQ ID NO: 2271760 - DNA, 18 bp, Homo sapiens
aggaggggagcaaggctg

SEQ ID NO: 2271761 - DNA, 20 bp, Homo sapiens
aggaggggagcaaggctgct

SEQ ID NO: 2271762 - DNA, 17 bp, Homo sapiens
aggagggtttgggcaga

SEQ ID NO: 2271763 - DNA, 13 bp, Homo sapiens
aggaggtgcctga

SEQ ID NO: 2271764 - DNA, 16 bp, Homo sapiens
aggagtgatgggcaag

SEQ ID NO: 2271765 - DNA, 23 bp, Homo sapiens
aggagtgatgggcaaggggccag

SEQ ID NO: 2271766 - DNA, 11 bp, Homo sapiens
aggagtggctg

SEQ ID NO: 2271767 - DNA, 13 bp, Homo sapiens
aggagtggctgac

SEQ ID NO: 2271768 - DNA, 14 bp, Homo sapiens
aggagtgggctctg

SEQ ID NO: 2271769 - DNA, 16 bp, Homo sapiens
aggagttaatgatcgt

SEQ ID NO: 2271770 - DNA, 17 bp, Homo sapiens
aggagttgtctgtcctg

SEQ ID NO: 2271771 - DNA, 13 bp, Homo sapiens
aggataaaccaat

SEQ ID NO: 2271772 - DNA, 19 bp, Homo sapiens
aggataaaccaatcatctt

SEQ ID NO: 2271773 - DNA, 16 bp, Homo sapiens
aggatcctgagccaga

SEQ ID NO: 2271774 - DNA, 18 bp, Homo sapiens
aggatcctgagccagatt

SEQ ID NO: 2271775 - DNA, 23 bp, Homo sapiens
aggatctctgagaccacagaggc

SEQ ID NO: 2271776 - DNA, 11 bp, Homo sapiens
aggattctttt

SEQ ID NO: 2271777 - DNA, 22 bp, Homo sapiens
aggattcttttttcaatgtact

SEQ ID NO: 2271778 - DNA, 23 bp, Homo sapiens
aggattgtctgctgcctccaagt

SEQ ID NO: 2271779 - DNA, 18 bp, Homo sapiens
actgtgttgcccaggctg

SEQ ID NO: 2271780 - DNA, 19 bp, Homo sapiens
actgttaacccagtgttca

SEQ ID NO: 2271781 - DNA, 15 bp, Homo sapiens
actgttcatttccac

SEQ ID NO: 2271782 - DNA, 22 bp, Homo sapiens
actgttctaactagtaatcttg

SEQ ID NO: 2271783 - DNA, 14 bp, Homo sapiens
actgttctttgcag

SEQ ID NO: 2271784 - DNA, 17 bp, Homo sapiens
actgttctttgcagtga

SEQ ID NO: 2271785 - DNA, 18 bp, Homo sapiens
actgtttgtaatatacag

SEQ ID NO: 2271786 - DNA, 18 bp, Homo sapiens
acttaaacctgtgctttc

SEQ ID NO: 2271787 - DNA, 16 bp, Homo sapiens
acttaaagcttgtttg

SEQ ID NO: 2271788 - DNA, 19 bp, Homo sapiens
acttaattctcattatgaa

SEQ ID NO: 2271789 - DNA, 22 bp, Homo sapiens
acttaattctcattatgaagat

SEQ ID NO: 2271790 - DNA, 18 bp, Homo sapiens
acttacactgaaatccaa

SEQ ID NO: 2271791 - DNA, 19 bp, Homo sapiens
acttagaatgcttcaagtt

SEQ ID NO: 2271792 - DNA, 17 bp, Homo sapiens
acttatatatttgaaag

SEQ ID NO: 2271793 - DNA, 14 bp, Homo sapiens
acttatctccagcc

SEQ ID NO: 2271794 - DNA, 11 bp, Homo sapiens
acttatgtaga

SEQ ID NO: 2271795 - DNA, 20 bp, Homo sapiens
acttattttccacttatctt

SEQ ID NO: 2271796 - DNA, 16 bp, Homo sapiens
acttcaacatgcatat

SEQ ID NO: 2271797 - DNA, 13 bp, Homo sapiens
acttcacaaaatg

SEQ ID NO: 2271798 - DNA, 22 bp, Homo sapiens
acttccagatttgagctgcctg

SEQ ID NO: 2271799 - DNA, 23 bp, Homo sapiens
acttcccagctggcagcgcctcc

SEQ ID NO: 2271800 - DNA, 14 bp, Homo sapiens
acttccccttggga

SEQ ID NO: 2271801 - DNA, 14 bp, Homo sapiens
acttccctagaagt

SEQ ID NO: 2271802 - DNA, 22 bp, Homo sapiens
acttcctggattttctttctat

SEQ ID NO: 2271803 - DNA, 15 bp, Homo sapiens
acttccttataaaaa

SEQ ID NO: 2271804 - DNA, 16 bp, Homo sapiens
acttccttataaaaat

SEQ ID NO: 2271805 - DNA, 21 bp, Homo sapiens
acttccttataaaaattctag

SEQ ID NO: 2271806 - DNA, 14 bp, Homo sapiens
acttcgaaaacaga

SEQ ID NO: 2271807 - DNA, 18 bp, Homo sapiens
acttcgaaaacagatgag

SEQ ID NO: 2271808 - DNA, 19 bp, Homo sapiens
acttcgggggcggctctgg

SEQ ID NO: 2271809 - DNA, 17 bp, Homo sapiens
acttctggggccagccc

SEQ ID NO: 2271810 - DNA, 19 bp, Homo sapiens
acttgaacaaaatctgttg

SEQ ID NO: 2271811 - DNA, 22 bp, Homo sapiens
acttgctagtgatacactgtat

SEQ ID NO: 2271812 - DNA, 21 bp, Homo sapiens
acttgttttttatcctgcctc

SEQ ID NO: 2271813 - DNA, 15 bp, Homo sapiens
actttcatacgtaaa

SEQ ID NO: 2271814 - DNA, 15 bp, Homo sapiens
actttcgcctcctcc

SEQ ID NO: 2271815 - DNA, 18 bp, Homo sapiens
actttcgcctcctccagc

SEQ ID NO: 2271816 - DNA, 21 bp, Homo sapiens
actttggtaatgtgtcaaaga

SEQ ID NO: 2271817 - DNA, 17 bp, Homo sapiens
actttgtggatatattt

SEQ ID NO: 2271818 - DNA, 20 bp, Homo sapiens
acttttagcggtttgcaaac

SEQ ID NO: 2271819 - DNA, 17 bp, Homo sapiens
acttttccccaattcat

SEQ ID NO: 2271820 - DNA, 17 bp, Homo sapiens
acttttctttttaaatg

SEQ ID NO: 2271821 - DNA, 16 bp, Homo sapiens
acttttgaaatttaaa

SEQ ID NO: 2271822 - DNA, 18 bp, Homo sapiens
actttttcttttgtaagt

SEQ ID NO: 2271823 - DNA, 15 bp, Homo sapiens
acttttttaaaattg

SEQ ID NO: 2271824 - DNA, 23 bp, Homo sapiens
acttttttaaaattgtgttctta

SEQ ID NO: 2271825 - DNA, 14 bp, Homo sapiens
agaaaaaaaaataa

SEQ ID NO: 2271826 - DNA, 17 bp, Homo sapiens
agaaaaaaaaataacac

SEQ ID NO: 2271827 - DNA, 15 bp, Homo sapiens
agaaaaaattttaaa

SEQ ID NO: 2271828 - DNA, 21 bp, Homo sapiens
agaaaaaattttaaaaatcta

SEQ ID NO: 2271829 - DNA, 23 bp, Homo sapiens
agaaaaatgctgttcagaaatat

SEQ ID NO: 2271830 - DNA, 18 bp, Homo sapiens
agaaaacagaccagcata

SEQ ID NO: 2271831 - DNA, 15 bp, Homo sapiens
agaaaagacacttca

SEQ ID NO: 2271832 - DNA, 21 bp, Homo sapiens
agaaaagattaaaattagtga

SEQ ID NO: 2271833 - DNA, 16 bp, Homo sapiens
agaaaataaaataaat

SEQ ID NO: 2271834 - DNA, 11 bp, Homo sapiens
agaaaataacc

SEQ ID NO: 2271835 - DNA, 13 bp, Homo sapiens
agaaaatgctttc

SEQ ID NO: 2271836 - DNA, 17 bp, Homo sapiens
agaaaatgctttctcat

SEQ ID NO: 2271837 - DNA, 18 bp, Homo sapiens
agaaaatgggaagcatta

SEQ ID NO: 2271838 - DNA, 11 bp, Homo sapiens
agaaacacttt

SEQ ID NO: 2271839 - DNA, 17 bp, Homo sapiens
agaaacgagatttgcca

SEQ ID NO: 2271840 - DNA, 15 bp, Homo sapiens
agaaagtcatccttt

SEQ ID NO: 2271841 - DNA, 23 bp, Homo sapiens
agaaagttctgtgtaaacagaag

SEQ ID NO: 2271842 - DNA, 19 bp, Homo sapiens
agaaatattaatatgtact

SEQ ID NO: 2271843 - DNA, 18 bp, Homo sapiens
agaaatcatgcctagtta

SEQ ID NO: 2271844 - DNA, 23 bp, Homo sapiens
agaaatctattacacctttatct

SEQ ID NO: 2271845 - DNA, 17 bp, Homo sapiens
agaaatgccgctgtgtc

SEQ ID NO: 2271846 - DNA, 17 bp, Homo sapiens
agaaattacaggttcct

SEQ ID NO: 2271847 - DNA, 11 bp, Homo sapiens
agaaattctat

SEQ ID NO: 2271848 - DNA, 12 bp, Homo sapiens
agaaattctata

SEQ ID NO: 2271849 - DNA, 13 bp, Homo sapiens
agaaattctataa

SEQ ID NO: 2271850 - DNA, 15 bp, Homo sapiens
agaaattgtgccaaa

SEQ ID NO: 2271851 - DNA, 16 bp, Homo sapiens
agaaattgtgccaaag

SEQ ID NO: 2271852 - DNA, 17 bp, Homo sapiens
agaaattgtgccaaaga

SEQ ID NO: 2271853 - DNA, 20 bp, Homo sapiens
agaaattgtgccaaagatag

SEQ ID NO: 2271854 - DNA, 17 bp, Homo sapiens
agaacaaaaccccagaa

SEQ ID NO: 2271855 - DNA, 19 bp, Homo sapiens
agaacaaacctctatatgt

SEQ ID NO: 2271856 - DNA, 15 bp, Homo sapiens
agaacaagccagagc

SEQ ID NO: 2271857 - DNA, 17 bp, Homo sapiens
agaacaagccagagccg

SEQ ID NO: 2271858 - DNA, 18 bp, Homo sapiens
agaaccagcactcccagg

SEQ ID NO: 2271859 - DNA, 22 bp, Homo sapiens
agaaccagcactcccagggccc

SEQ ID NO: 2271860 - DNA, 20 bp, Homo sapiens
agaacgccctgtgtccacag

SEQ ID NO: 2271861 - DNA, 15 bp, Homo sapiens
agaacgggcctcccc

SEQ ID NO: 2271862 - DNA, 16 bp, Homo sapiens
agaacgggcctccccg

SEQ ID NO: 2271863 - DNA, 15 bp, Homo sapiens
agaactcctttctaa

SEQ ID NO: 2271864 - DNA, 16 bp, Homo sapiens
agaactgaagtgtgct

SEQ ID NO: 2271865 - DNA, 17 bp, Homo sapiens
agaactgtcccacaaaa

SEQ ID NO: 2271866 - DNA, 22 bp, Homo sapiens
agaactgtcccacaaaatattt

SEQ ID NO: 2271867 - DNA, 19 bp, Homo sapiens
agaagaagtggatctaaat

SEQ ID NO: 2271868 - DNA, 16 bp, Homo sapiens
agaagactagcagcta

SEQ ID NO: 2271869 - DNA, 22 bp, Homo sapiens
agaagactagcagctagcaagg

SEQ ID NO: 2271870 - DNA, 19 bp, Homo sapiens
agaagaggggtataggaca

SEQ ID NO: 2271871 - DNA, 12 bp, Homo sapiens
agaagattctaa

SEQ ID NO: 2271872 - DNA, 14 bp, Homo sapiens
agaagattctaaaa

SEQ ID NO: 2271873 - DNA, 23 bp, Homo sapiens
agaaggattcttttttcaatgta

SEQ ID NO: 2271874 - DNA, 19 bp, Homo sapiens
agaaggcacaggtgtaaat

SEQ ID NO: 2271875 - DNA, 18 bp, Homo sapiens
agaaggtatttttgaagt

SEQ ID NO: 2271876 - DNA, 20 bp, Homo sapiens
agaaggtatttttgaagtct

SEQ ID NO: 2271877 - DNA, 20 bp, Homo sapiens
agaagtagttttgttcatga

SEQ ID NO: 2271878 - DNA, 14 bp, Homo sapiens
agaagtcttcatgg

SEQ ID NO: 2271879 - DNA, 17 bp, Homo sapiens
agaagttgccctccagg

SEQ ID NO: 2271880 - DNA, 12 bp, Homo sapiens
agaataaataaa

SEQ ID NO: 2271881 - DNA, 14 bp, Homo sapiens
agaataaataaaga

SEQ ID NO: 2271882 - DNA, 19 bp, Homo sapiens
agaataaataaagaagaaa

SEQ ID NO: 2271883 - DNA, 11 bp, Homo sapiens
agaatacctcc

SEQ ID NO: 2271884 - DNA, 15 bp, Homo sapiens
agaatactacagcat

SEQ ID NO: 2271885 - DNA, 14 bp, Homo sapiens
agaatataaataaa

SEQ ID NO: 2271886 - DNA, 12 bp, Homo sapiens
agaatatataaa

SEQ ID NO: 2271887 - DNA, 14 bp, Homo sapiens
agaatatataaacg

SEQ ID NO: 2271888 - DNA, 14 bp, Homo sapiens
agaatatggacaaa

SEQ ID NO: 2271889 - DNA, 15 bp, Homo sapiens
agaatattgttaaaa

SEQ ID NO: 2271890 - DNA, 20 bp, Homo sapiens
agaatcgacctcactgtcag

SEQ ID NO: 2271891 - DNA, 14 bp, Homo sapiens
agaatctattttct

SEQ ID NO: 2271892 - DNA, 16 bp, Homo sapiens
agaatctattttctat

SEQ ID NO: 2271893 - DNA, 21 bp, Homo sapiens
agaatctattttctatgtact

SEQ ID NO: 2271894 - DNA, 19 bp, Homo sapiens
agaatgaaaacaatatgtt

SEQ ID NO: 2271895 - DNA, 14 bp, Homo sapiens
agaatgactctgga

SEQ ID NO: 2271896 - DNA, 15 bp, Homo sapiens
agaatgagagagaaa

SEQ ID NO: 2271897 - DNA, 14 bp, Homo sapiens
agaatgtacagaaa

SEQ ID NO: 2271898 - DNA, 17 bp, Homo sapiens
agaatgtacagaaaata

SEQ ID NO: 2271899 - DNA, 15 bp, Homo sapiens
agaatgtttcctgtg

SEQ ID NO: 2271900 - DNA, 21 bp, Homo sapiens
agaatgtttcctgtggaaata

SEQ ID NO: 2271901 - DNA, 20 bp, Homo sapiens
agaattacaggaaatgcaaa

SEQ ID NO: 2271902 - DNA, 19 bp, Homo sapiens
agaattaggtaatggatat

SEQ ID NO: 2271903 - DNA, 12 bp, Homo sapiens
agaattcacttt

SEQ ID NO: 2271904 - DNA, 18 bp, Homo sapiens
agaattccagttgtattt

SEQ ID NO: 2271905 - DNA, 20 bp, Homo sapiens
agaattccagttgtatttga

SEQ ID NO: 2271906 - DNA, 16 bp, Homo sapiens
agaattctaagattgt

SEQ ID NO: 2271907 - DNA, 21 bp, Homo sapiens
agaattctaagattgtacata

SEQ ID NO: 2271908 - DNA, 20 bp, Homo sapiens
agaattgaaccgtcaatgtg

SEQ ID NO: 2271909 - DNA, 22 bp, Homo sapiens
agaattgtgcgacttcacaaaa

SEQ ID NO: 2271910 - DNA, 23 bp, Homo sapiens
agaattgtgcgacttcacaaaat

SEQ ID NO: 2271911 - DNA, 19 bp, Homo sapiens
aggggtggaagggcaggag

SEQ ID NO: 2271912 - DNA, 21 bp, Homo sapiens
agggtccactttggtaatgtg

SEQ ID NO: 2271913 - DNA, 19 bp, Homo sapiens
agggtctcgtcaggaggtg

SEQ ID NO: 2271914 - DNA, 11 bp, Homo sapiens
agggtctgagt

SEQ ID NO: 2271915 - DNA, 19 bp, Homo sapiens
agggtgagggaggacaggc

SEQ ID NO: 2271916 - DNA, 12 bp, Homo sapiens
agggtgggccct

SEQ ID NO: 2271917 - DNA, 19 bp, Homo sapiens
agggtttagccgggcccca

SEQ ID NO: 2271918 - DNA, 15 bp, Homo sapiens
agggtttgggcagag

SEQ ID NO: 2271919 - DNA, 19 bp, Homo sapiens
aggtaacttctcccttctc

SEQ ID NO: 2271920 - DNA, 20 bp, Homo sapiens
aggtaacttctcccttctcc

SEQ ID NO: 2271921 - DNA, 14 bp, Homo sapiens
aggtaatggatatg

SEQ ID NO: 2271922 - DNA, 22 bp, Homo sapiens
aggtaatggatatgaaagagaa

SEQ ID NO: 2271923 - DNA, 24 bp, Homo sapiens
aggtaccaagatcacaaatagtgt

SEQ ID NO: 2271924 - DNA, 14 bp, Homo sapiens
aggtcacctcactc

SEQ ID NO: 2271925 - DNA, 19 bp, Homo sapiens
aggtcacctcactcagcac

SEQ ID NO: 2271926 - DNA, 13 bp, Homo sapiens
aggtcatttgtag

SEQ ID NO: 2271927 - DNA, 20 bp, Homo sapiens
aggtcctgtgagcaaagtgc

SEQ ID NO: 2271928 - DNA, 23 bp, Homo sapiens
aggtgaacaccactttgtctctg

SEQ ID NO: 2271929 - DNA, 21 bp, Homo sapiens
aggtgcggaccggagcggctg

SEQ ID NO: 2271930 - DNA, 22 bp, Homo sapiens
aggtgcggaccggagcggctga

SEQ ID NO: 2271931 - DNA, 15 bp, Homo sapiens
aggtggccagggctc

SEQ ID NO: 2271932 - DNA, 19 bp, Homo sapiens
aggtggccagggctccacg

SEQ ID NO: 2271933 - DNA, 20 bp, Homo sapiens
aggtggccagggctccacgg

SEQ ID NO: 2271934 - DNA, 11 bp, Homo sapiens
aggtgtaaata

SEQ ID NO: 2271935 - DNA, 16 bp, Homo sapiens
aggtgttaaaaaccat

SEQ ID NO: 2271936 - DNA, 21 bp, Homo sapiens
aggtgttaaaaaccattataa

SEQ ID NO: 2271937 - DNA, 21 bp, Homo sapiens
aggtgttcctcctcccctctc

SEQ ID NO: 2271938 - DNA, 20 bp, Homo sapiens
aggttacccgagaagcactt

SEQ ID NO: 2271939 - DNA, 12 bp, Homo sapiens
aggtttagagat

SEQ ID NO: 2271940 - DNA, 13 bp, Homo sapiens
aggtttagcgttt

SEQ ID NO: 2271941 - DNA, 17 bp, Homo sapiens
aggtttagcgttttaag

SEQ ID NO: 2271942 - DNA, 19 bp, Homo sapiens
aggtttttcttgctatgtt

SEQ ID NO: 2271943 - DNA, 13 bp, Homo sapiens
agtaaaattagag

SEQ ID NO: 2271944 - DNA, 17 bp, Homo sapiens
agtaagaacgtactttc

SEQ ID NO: 2271945 - DNA, 21 bp, Homo sapiens
agtaagattttatccctttct

SEQ ID NO: 2271946 - DNA, 14 bp, Homo sapiens
agtaagttctgaaa

SEQ ID NO: 2271947 - DNA, 12 bp, Homo sapiens
agtaataactga

SEQ ID NO: 2271948 - DNA, 13 bp, Homo sapiens
agtaatattacat

SEQ ID NO: 2271949 - DNA, 15 bp, Homo sapiens
agtaatattacattt

SEQ ID NO: 2271950 - DNA, 16 bp, Homo sapiens
agtaatattacatttc

SEQ ID NO: 2271951 - DNA, 20 bp, Homo sapiens
agtaatattacatttcattt

SEQ ID NO: 2271952 - DNA, 22 bp, Homo sapiens
agtaatattacatttcatttat

SEQ ID NO: 2271953 - DNA, 13 bp, Homo sapiens
agtaatggcagag

SEQ ID NO: 2271954 - DNA, 16 bp, Homo sapiens
agtaattcccatctgc

SEQ ID NO: 2271955 - DNA, 22 bp, Homo sapiens
agtaattcccatctgctttatt

SEQ ID NO: 2271956 - DNA, 16 bp, Homo sapiens
agtacataaagtaata

SEQ ID NO: 2271957 - DNA, 21 bp, Homo sapiens
agtacataaagtaataactgt

SEQ ID NO: 2271958 - DNA, 13 bp, Homo sapiens
agtacatgcagaa

SEQ ID NO: 2271959 - DNA, 14 bp, Homo sapiens
agtaccatcccact

SEQ ID NO: 2271960 - DNA, 21 bp, Homo sapiens
agtacccaaccaaagatgctt

SEQ ID NO: 2271961 - DNA, 14 bp, Homo sapiens
agtacttgagaata

SEQ ID NO: 2271962 - DNA, 14 bp, Homo sapiens
agtagcagctgtgt

SEQ ID NO: 2271963 - DNA, 23 bp, Homo sapiens
agtagttgatgaccaatctctgt

SEQ ID NO: 2271964 - DNA, 17 bp, Homo sapiens
agtagttttgttcatga

SEQ ID NO: 2271965 - DNA, 15 bp, Homo sapiens
agtatacatttagtt

SEQ ID NO: 2271966 - DNA, 20 bp, Homo sapiens
agtatacatttagttaacac

SEQ ID NO: 2271967 - DNA, 12 bp, Homo sapiens
agtatatatgta

SEQ ID NO: 2271968 - DNA, 20 bp, Homo sapiens
agtatctccatccttaactg

SEQ ID NO: 2271969 - DNA, 22 bp, Homo sapiens
agtatctccatccttaactgtc

SEQ ID NO: 2271970 - DNA, 20 bp, Homo sapiens
agtatctctactttcctgat

SEQ ID NO: 2271971 - DNA, 21 bp, Homo sapiens
agtatctctactttcctgatg

SEQ ID NO: 2271972 - DNA, 12 bp, Homo sapiens
agtatcttgaag

SEQ ID NO: 2271973 - DNA, 17 bp, Homo sapiens
agtatgcaagaagaata

SEQ ID NO: 2271974 - DNA, 21 bp, Homo sapiens
agtatgtcagtccaataaatt

SEQ ID NO: 2271975 - DNA, 20 bp, Homo sapiens
agtatgtgtgcgtgagctgg

SEQ ID NO: 2271976 - DNA, 22 bp, Homo sapiens
agtattgacgacctacatctga

SEQ ID NO: 2271977 - DNA, 15 bp, Homo sapiens
agtatttgtatcctg

SEQ ID NO: 2271978 - DNA, 13 bp, Homo sapiens
agtcaactgctgt

SEQ ID NO: 2271979 - DNA, 15 bp, Homo sapiens
agtcactttgcttaa

SEQ ID NO: 2271980 - DNA, 22 bp, Homo sapiens
agtcactttgcttaagatgcta

SEQ ID NO: 2271981 - DNA, 15 bp, Homo sapiens
agtcagggagccctg

SEQ ID NO: 2271982 - DNA, 13 bp, Homo sapiens
agtcatcatctca

SEQ ID NO: 2271983 - DNA, 16 bp, Homo sapiens
agtcatctcaaacact

SEQ ID NO: 2271984 - DNA, 17 bp, Homo sapiens
agtcatgggagaagagg

SEQ ID NO: 2271985 - DNA, 16 bp, Homo sapiens
agtccaaaatcattcc

SEQ ID NO: 2271986 - DNA, 15 bp, Homo sapiens
agtccaataaattat

SEQ ID NO: 2271987 - DNA, 14 bp, Homo sapiens
agtccaatgaagat

SEQ ID NO: 2271988 - DNA, 22 bp, Homo sapiens
agtccaatgaagataaatgctt

SEQ ID NO: 2271989 - DNA, 23 bp, Homo sapiens
agtccaatgaagataaatgcttt

SEQ ID NO: 2271990 - DNA, 21 bp, Homo sapiens
agtccacttaaataatcctct

SEQ ID NO: 2271991 - DNA, 16 bp, Homo sapiens
agtccagctctcccct

SEQ ID NO: 2271992 - DNA, 20 bp, Homo sapiens
agtccagctctcccctgcgc

SEQ ID NO: 2271993 - DNA, 16 bp, Homo sapiens
agtccagtgagaaatt

SEQ ID NO: 2271994 - DNA, 21 bp, Homo sapiens
agtcccacagccccttgcttc

SEQ ID NO: 2271995 - DNA, 15 bp, Homo sapiens
agtcccagttcccat

SEQ ID NO: 2271996 - DNA, 13 bp, Homo sapiens
agtcccatctcac

SEQ ID NO: 2271997 - DNA, 16 bp, Homo sapiens
agtccctcctccccca

SEQ ID NO: 2271998 - DNA, 16 bp, Homo sapiens
agtccgaggcctggct

SEQ ID NO: 2271999 - DNA, 17 bp, Homo sapiens
agtcctccaaaacacaa

SEQ ID NO: 2272000 - DNA, 23 bp, Homo sapiens
agtcctccggttgcatactggac

SEQ ID NO: 2272001 - DNA, 20 bp, Homo sapiens
agtcctggcatgggaatgaa

SEQ ID NO: 2272002 - DNA, 21 bp, Homo sapiens
agtcctggcatgggaatgaat

SEQ ID NO: 2272003 - DNA, 14 bp, Homo sapiens
agtccttagaatga

SEQ ID NO: 2272004 - DNA, 16 bp, Homo sapiens
agtctcaaataataat

SEQ ID NO: 2272005 - DNA, 23 bp, Homo sapiens
agtctcaaataataataataaca

SEQ ID NO: 2272006 - DNA, 19 bp, Homo sapiens
agtctggagaccaggactc

SEQ ID NO: 2272007 - DNA, 18 bp, Homo sapiens
agtcttgagcaatgtttt

SEQ ID NO: 2272008 - DNA, 10 bp, Homo sapiens
agtcttgtat

SEQ ID NO: 2272009 - DNA, 15 bp, Homo sapiens
agtgaagatgtgtaa

SEQ ID NO: 2272010 - DNA, 23 bp, Homo sapiens
agtgaccaggctcacaactgttt

SEQ ID NO: 2272011 - DNA, 16 bp, Homo sapiens
agtgagatttgtattt

SEQ ID NO: 2272012 - DNA, 15 bp, Homo sapiens
agtgagctaccagga

SEQ ID NO: 2272013 - DNA, 17 bp, Homo sapiens
agtgagctaccaggaag

SEQ ID NO: 2272014 - DNA, 19 bp, Homo sapiens
agtgagtttccagctgctc

SEQ ID NO: 2272015 - DNA, 15 bp, Homo sapiens
agtgatacactgtat

SEQ ID NO: 2272016 - DNA, 19 bp, Homo sapiens
agtgatcagttgctctctg

SEQ ID NO: 2272017 - DNA, 19 bp, Homo sapiens
agtgatcctcccgccccag

SEQ ID NO: 2272018 - DNA, 19 bp, Homo sapiens
agtgatgggcaaggggcca

SEQ ID NO: 2272019 - DNA, 21 bp, Homo sapiens
agtgcaagttcatgtgtggaa

SEQ ID NO: 2272020 - DNA, 18 bp, Homo sapiens
agtgcagcaaccagagca

SEQ ID NO: 2272021 - DNA, 21 bp, Homo sapiens
agtgcagcaaccagagcactg

SEQ ID NO: 2272022 - DNA, 22 bp, Homo sapiens
agtgcagcaaccagagcactgt

SEQ ID NO: 2272023 - DNA, 14 bp, Homo sapiens
agtgccaaaaacaa

SEQ ID NO: 2272024 - DNA, 16 bp, Homo sapiens
agtgccccagaaatgc

SEQ ID NO: 2272025 - DNA, 20 bp, Homo sapiens
agtgccccagaaatgccgct

SEQ ID NO: 2272026 - DNA, 23 bp, Homo sapiens
agtgcccttaaaataatgattta

SEQ ID NO: 2272027 - DNA, 13 bp, Homo sapiens
agtgccttatgga

SEQ ID NO: 2272028 - DNA, 18 bp, Homo sapiens
agtgccttatggaacact

SEQ ID NO: 2272029 - DNA, 20 bp, Homo sapiens
agtgccttatggaacactct

SEQ ID NO: 2272030 - DNA, 14 bp, Homo sapiens
agtgctacataaat

SEQ ID NO: 2272031 - DNA, 17 bp, Homo sapiens
agtgctacataaattgg

SEQ ID NO: 2272032 - DNA, 17 bp, Homo sapiens
agtgctaggataaacca

SEQ ID NO: 2272033 - DNA, 12 bp, Homo sapiens
agtgcttccttt

SEQ ID NO: 2272034 - DNA, 14 bp, Homo sapiens
agtgcttccttttc

SEQ ID NO: 2272035 - DNA, 15 bp, Homo sapiens
agtgctttgcccttg

SEQ ID NO: 2272036 - DNA, 15 bp, Homo sapiens
agtggaagacagaga

SEQ ID NO: 2272037 - DNA, 17 bp, Homo sapiens
agtggaagacagagatg

SEQ ID NO: 2272038 - DNA, 22 bp, Homo sapiens
agtggaagacagagatggcaga

SEQ ID NO: 2272039 - DNA, 15 bp, Homo sapiens
agtggacagcagctg

SEQ ID NO: 2272040 - DNA, 12 bp, Homo sapiens
agtggcagagaa

SEQ ID NO: 2272041 - DNA, 20 bp, Homo sapiens
agtggcatggtcctgtgccc

SEQ ID NO: 2272042 - DNA, 19 bp, Homo sapiens
agtggctgaccaggccctg

SEQ ID NO: 2272043 - DNA, 21 bp, Homo sapiens
agtggctgaccaggccctgct

SEQ ID NO: 2272044 - DNA, 23 bp, Homo sapiens
agtggcttggagcagaggtgggg

SEQ ID NO: 2272045 - DNA, 15 bp, Homo sapiens
agtgggctctgagca

SEQ ID NO: 2272046 - DNA, 23 bp, Homo sapiens
agtggggaggagactcaggccca

SEQ ID NO: 2272047 - DNA, 21 bp, Homo sapiens
agtggggcccatggccccagc

SEQ ID NO: 2272048 - DNA, 19 bp, Homo sapiens
agtgggtatttcttatttg

SEQ ID NO: 2272049 - DNA, 22 bp, Homo sapiens
agtggtccacattctgctgccc

SEQ ID NO: 2272050 - DNA, 22 bp, Homo sapiens
agtggtggcagtgcagcaacca

SEQ ID NO: 2272051 - DNA, 18 bp, Homo sapiens
agtggtgtgatcccagct

SEQ ID NO: 2272052 - DNA, 23 bp, Homo sapiens
agtggttcgggggaaatagttcc

SEQ ID NO: 2272053 - DNA, 13 bp, Homo sapiens
agtgtacaatttt

SEQ ID NO: 2272054 - DNA, 15 bp, Homo sapiens
agtgtccccaggggc

SEQ ID NO: 2272055 - DNA, 19 bp, Homo sapiens
agtgtccccaggggcacac

SEQ ID NO: 2272056 - DNA, 23 bp, Homo sapiens
agtgtccccaggggcacacttcc

SEQ ID NO: 2272057 - DNA, 17 bp, Homo sapiens
agtgtcctcatctataa

SEQ ID NO: 2272058 - DNA, 15 bp, Homo sapiens
agtgtggcgggaagg

SEQ ID NO: 2272059 - DNA, 20 bp, Homo sapiens
agtgtgtcttagtgtgtgca

SEQ ID NO: 2272060 - DNA, 16 bp, Homo sapiens
agtgttcagcatagag

SEQ ID NO: 2272061 - DNA, 14 bp, Homo sapiens
agtgttgaggaggg

SEQ ID NO: 2272062 - DNA, 20 bp, Homo sapiens
agtgttgaggaggggagcaa

SEQ ID NO: 2272063 - DNA, 22 bp, Homo sapiens
agtgttgtaccatatgtagcat

SEQ ID NO: 2272064 - DNA, 21 bp, Homo sapiens
agtgttttaagaaatgtagtt

SEQ ID NO: 2272065 - DNA, 14 bp, Homo sapiens
agtgttttcttgtg

SEQ ID NO: 2272066 - DNA, 14 bp, Homo sapiens
agtgtttttcttta

SEQ ID NO: 2272067 - DNA, 21 bp, Homo sapiens
agtgtttttctttaatcaaaa

SEQ ID NO: 2272068 - DNA, 17 bp, Homo sapiens
agttaaagagacaaata

SEQ ID NO: 2272069 - DNA, 14 bp, Homo sapiens
agttaatgtgccaa

SEQ ID NO: 2272070 - DNA, 16 bp, Homo sapiens
agttacaacattaatt

SEQ ID NO: 2272071 - DNA, 20 bp, Homo sapiens
agttacaacattaattttat

SEQ ID NO: 2272072 - DNA, 15 bp, Homo sapiens
atttattattttcat

SEQ ID NO: 2272073 - DNA, 18 bp, Homo sapiens
atttattcatgtgtacag

SEQ ID NO: 2272074 - DNA, 13 bp, Homo sapiens
atttatttatgtt

SEQ ID NO: 2272075 - DNA, 13 bp, Homo sapiens
atttatttattca

SEQ ID NO: 2272076 - DNA, 16 bp, Homo sapiens
atttatttattcatgt

SEQ ID NO: 2272077 - DNA, 15 bp, Homo sapiens
atttcatattgagat

SEQ ID NO: 2272078 - DNA, 17 bp, Homo sapiens
atttcatccaccaatat

SEQ ID NO: 2272079 - DNA, 15 bp, Homo sapiens
atttcatgactggtg

SEQ ID NO: 2272080 - DNA, 17 bp, Homo sapiens
atttcatgttagtctta

SEQ ID NO: 2272081 - DNA, 19 bp, Homo sapiens
atttcattgagggaaaaca

SEQ ID NO: 2272082 - DNA, 23 bp, Homo sapiens
atttccaacaaacttactgtcag

SEQ ID NO: 2272083 - DNA, 14 bp, Homo sapiens
atttcccaaagcag

SEQ ID NO: 2272084 - DNA, 19 bp, Homo sapiens
atttcccaaagcagtgcat

SEQ ID NO: 2272085 - DNA, 23 bp, Homo sapiens
atttcccagccctcttcttctca

SEQ ID NO: 2272086 - DNA, 23 bp, Homo sapiens
atttcccctcccgcttcctccgg

SEQ ID NO: 2272087 - DNA, 14 bp, Homo sapiens
atttccctaaaaat

SEQ ID NO: 2272088 - DNA, 21 bp, Homo sapiens
atttccctattttaggctatt

SEQ ID NO: 2272089 - DNA, 21 bp, Homo sapiens
atttccgaagaccttctgaag

SEQ ID NO: 2272090 - DNA, 22 bp, Homo sapiens
atttctaagcttatttctaact

SEQ ID NO: 2272091 - DNA, 14 bp, Homo sapiens
atttctatctgcaa

SEQ ID NO: 2272092 - DNA, 17 bp, Homo sapiens
atttcttattaaccaaa

SEQ ID NO: 2272093 - DNA, 11 bp, Homo sapiens
atttcttattt

SEQ ID NO: 2272094 - DNA, 15 bp, Homo sapiens
atttcttatttgaaa

SEQ ID NO: 2272095 - DNA, 16 bp, Homo sapiens
atttcttatttgaaag

SEQ ID NO: 2272096 - DNA, 22 bp, Homo sapiens
atttgaaaacaccaagagtaca

SEQ ID NO: 2272097 - DNA, 17 bp, Homo sapiens
atttgatcccaatagaa

SEQ ID NO: 2272098 - DNA, 19 bp, Homo sapiens
atttgatttgatatacaga

SEQ ID NO: 2272099 - DNA, 22 bp, Homo sapiens
atttgcaacaggaagacactgg

SEQ ID NO: 2272100 - DNA, 20 bp, Homo sapiens
atttgcacacattggccgct

SEQ ID NO: 2272101 - DNA, 23 bp, Homo sapiens
atttgcacacattggccgcttca

SEQ ID NO: 2272102 - DNA, 15 bp, Homo sapiens
atttgccaaaaacta

SEQ ID NO: 2272103 - DNA, 22 bp, Homo sapiens
atttgccaaaaactaaaattca

SEQ ID NO: 2272104 - DNA, 19 bp, Homo sapiens
atttgccagacagagatca

SEQ ID NO: 2272105 - DNA, 14 bp, Homo sapiens
atttgccatagcag

SEQ ID NO: 2272106 - DNA, 20 bp, Homo sapiens
atttgctatataattaatat

SEQ ID NO: 2272107 - DNA, 18 bp, Homo sapiens
atttgcttatttatattc

SEQ ID NO: 2272108 - DNA, 20 bp, Homo sapiens
atttggccgagtcagcacgt

SEQ ID NO: 2272109 - DNA, 15 bp, Homo sapiens
atttgtaatgtatct

SEQ ID NO: 2272110 - DNA, 22 bp, Homo sapiens
atttgtaatgtatcttatttat

SEQ ID NO: 2272111 - DNA, 21 bp, Homo sapiens
atttgtaggtatactatgtaa

SEQ ID NO: 2272112 - DNA, 21 bp, Homo sapiens
atttgtatttatattagagtg

SEQ ID NO: 2272113 - DNA, 13 bp, Homo sapiens
atttgtgaatata

SEQ ID NO: 2272114 - DNA, 14 bp, Homo sapiens
atttgtgaatatat

SEQ ID NO: 2272115 - DNA, 19 bp, Homo sapiens
atttgtgagccaaagagaa

SEQ ID NO: 2272116 - DNA, 21 bp, Homo sapiens
atttgtgagccaaagagaaaa

SEQ ID NO: 2272117 - DNA, 23 bp, Homo sapiens
atttgtgagccaaagagaaaaga

SEQ ID NO: 2272118 - DNA, 21 bp, Homo sapiens
atttgtgtagattgtgtaaat

SEQ ID NO: 2272119 - DNA, 16 bp, Homo sapiens
attttaaaaaataaca

SEQ ID NO: 2272120 - DNA, 17 bp, Homo sapiens
attttaaaaaataacat

SEQ ID NO: 2272121 - DNA, 14 bp, Homo sapiens
attttaaaaatcta

SEQ ID NO: 2272122 - DNA, 13 bp, Homo sapiens
attttaaaatcaa

SEQ ID NO: 2272123 - DNA, 17 bp, Homo sapiens
attttaaaatcaacttt

SEQ ID NO: 2272124 - DNA, 22 bp, Homo sapiens
attttaaaatcaacttttgaaa

SEQ ID NO: 2272125 - DNA, 13 bp, Homo sapiens
attttaataaaga

SEQ ID NO: 2272126 - DNA, 14 bp, Homo sapiens
attttaataaagat

SEQ ID NO: 2272127 - DNA, 15 bp, Homo sapiens
attttaatgtaaaat

SEQ ID NO: 2272128 - DNA, 15 bp, Homo sapiens
attttaattcagttg

SEQ ID NO: 2272129 - DNA, 21 bp, Homo sapiens
attttaggctattataatata

SEQ ID NO: 2272130 - DNA, 23 bp, Homo sapiens
attttatccctttctcttctgac

SEQ ID NO: 2272131 - DNA, 14 bp, Homo sapiens
attttatctgtgtt

SEQ ID NO: 2272132 - DNA, 21 bp, Homo sapiens
attttatctgtgttgtctctc

SEQ ID NO: 2272133 - DNA, 17 bp, Homo sapiens
attttcagatagcacat

SEQ ID NO: 2272134 - DNA, 15 bp, Homo sapiens
attttcataattcat

SEQ ID NO: 2272135 - DNA, 16 bp, Homo sapiens
attttccacttatctt

SEQ ID NO: 2272136 - DNA, 17 bp, Homo sapiens
attttcgtgcatttgtg

SEQ ID NO: 2272137 - DNA, 21 bp, Homo sapiens
attttctatgtactagtactg

SEQ ID NO: 2272138 - DNA, 22 bp, Homo sapiens
attttctatgtactagtactgt

SEQ ID NO: 2272139 - DNA, 18 bp, Homo sapiens
attttctgaattcataaa

SEQ ID NO: 2272140 - DNA, 17 bp, Homo sapiens
attttcttcccatttgt

SEQ ID NO: 2272141 - DNA, 12 bp, Homo sapiens
attttctttcta

SEQ ID NO: 2272142 - DNA, 13 bp, Homo sapiens
attttctttctat

SEQ ID NO: 2272143 - DNA, 21 bp, Homo sapiens
attttctttctatgtagaact

SEQ ID NO: 2272144 - DNA, 22 bp, Homo sapiens
attttctttctatgtagaactg

SEQ ID NO: 2272145 - DNA, 18 bp, Homo sapiens
attttcttttatatctgt

SEQ ID NO: 2272146 - DNA, 22 bp, Homo sapiens
attttgagacaccaataaaagt

SEQ ID NO: 2272147 - DNA, 23 bp, Homo sapiens
attttgagacaccaataaaagtt

SEQ ID NO: 2272148 - DNA, 18 bp, Homo sapiens
attttggctcagagtcca

SEQ ID NO: 2272149 - DNA, 20 bp, Homo sapiens
attttgggctggataaatat

SEQ ID NO: 2272150 - DNA, 17 bp, Homo sapiens
attttgtattattgctg

SEQ ID NO: 2272151 - DNA, 21 bp, Homo sapiens
attttgtcataaaatgctatt

SEQ ID NO: 2272152 - DNA, 13 bp, Homo sapiens
attttgtgcaagc

SEQ ID NO: 2272153 - DNA, 20 bp, Homo sapiens
attttgtggctgatttcaaa

SEQ ID NO: 2272154 - DNA, 19 bp, Homo sapiens
attttgtttccaaagctga

SEQ ID NO: 2272155 - DNA, 17 bp, Homo sapiens
atttttaaatcatttca

SEQ ID NO: 2272156 - DNA, 18 bp, Homo sapiens
atttttaaatcatttcat

SEQ ID NO: 2272157 - DNA, 19 bp, Homo sapiens
atttttaaatcatttcatg

SEQ ID NO: 2272158 - DNA, 15 bp, Homo sapiens
atttttactcaggct

SEQ ID NO: 2272159 - DNA, 21 bp, Homo sapiens
atttttactcaggctttctat

SEQ ID NO: 2272160 - DNA, 23 bp, Homo sapiens
atttttactcaggctttctattg

SEQ ID NO: 2272161 - DNA, 13 bp, Homo sapiens
atttttagagatt

SEQ ID NO: 2272162 - DNA, 20 bp, Homo sapiens
atttttagagattaatttgt

SEQ ID NO: 2272163 - DNA, 21 bp, Homo sapiens
atttttctcacctagctgctc

SEQ ID NO: 2272164 - DNA, 14 bp, Homo sapiens
atttttctgcacct

SEQ ID NO: 2272165 - DNA, 23 bp, Homo sapiens
atttttgtggcatgttgtaacat

SEQ ID NO: 2272166 - DNA, 15 bp, Homo sapiens
attttttactacata

SEQ ID NO: 2272167 - DNA, 23 bp, Homo sapiens
attttttactacataattaaatt

SEQ ID NO: 2272168 - DNA, 13 bp, Homo sapiens
atttttttctagc

SEQ ID NO: 2272169 - DNA, 21 bp, Homo sapiens
atttttttctagctataacaa

SEQ ID NO: 2272170 - DNA, 22 bp, Homo sapiens
atttttttttccttcagtgcct

SEQ ID NO: 2272171 - DNA, 17 bp, Homo sapiens
caaaaaaaaaaatgtca

SEQ ID NO: 2272172 - DNA, 12 bp, Homo sapiens
caaaaagaaata

SEQ ID NO: 2272173 - DNA, 20 bp, Homo sapiens
caaaaagtaatgtatatctg

SEQ ID NO: 2272174 - DNA, 15 bp, Homo sapiens
caaaaatagaatata

SEQ ID NO: 2272175 - DNA, 19 bp, Homo sapiens
caaaaatagaatatataaa

SEQ ID NO: 2272176 - DNA, 21 bp, Homo sapiens
caaaaatatttttatgtgaag

SEQ ID NO: 2272177 - DNA, 15 bp, Homo sapiens
caaaacaaagtcttt

SEQ ID NO: 2272178 - DNA, 12 bp, Homo sapiens
caaaaccccaga

SEQ ID NO: 2272179 - DNA, 20 bp, Homo sapiens
caaaacttataatttccaaa

SEQ ID NO: 2272180 - DNA, 17 bp, Homo sapiens
caaaagtccttagaatg

SEQ ID NO: 2272181 - DNA, 17 bp, Homo sapiens
caaaataaaatgagtta

SEQ ID NO: 2272182 - DNA, 19 bp, Homo sapiens
caaaataattagctatatt

SEQ ID NO: 2272183 - DNA, 14 bp, Homo sapiens
caaaatagttctat

SEQ ID NO: 2272184 - DNA, 17 bp, Homo sapiens
caaaatagttctatttc

SEQ ID NO: 2272185 - DNA, 17 bp, Homo sapiens
caaaatattatctgaac

SEQ ID NO: 2272186 - DNA, 13 bp, Homo sapiens
caaaatatttcta

SEQ ID NO: 2272187 - DNA, 14 bp, Homo sapiens
caaaatatttctaa

SEQ ID NO: 2272188 - DNA, 17 bp, Homo sapiens
caaaatatttctaagct

SEQ ID NO: 2272189 - DNA, 22 bp, Homo sapiens
caaaatgaaacgcaaccaccac

SEQ ID NO: 2272190 - DNA, 18 bp, Homo sapiens
caaaatgtcaatttttaa

SEQ ID NO: 2272191 - DNA, 10 bp, Homo sapiens
caaaatgtta

SEQ ID NO: 2272192 - DNA, 20 bp, Homo sapiens
caaaatttaattgtgtaact

SEQ ID NO: 2272193 - DNA, 22 bp, Homo sapiens
caaaatttaattgtgtaactgt

SEQ ID NO: 2272194 - DNA, 20 bp, Homo sapiens
caaacaaaaatagaatatat

SEQ ID NO: 2272195 - DNA, 21 bp, Homo sapiens
caaacaaaaatagaatatata

SEQ ID NO: 2272196 - DNA, 21 bp, Homo sapiens
caaacaaaggatttgaaaaca

SEQ ID NO: 2272197 - DNA, 16 bp, Homo sapiens
caaacacccaagcaca

SEQ ID NO: 2272198 - DNA, 22 bp, Homo sapiens
caaacatgtggcaacctgttct

SEQ ID NO: 2272199 - DNA, 14 bp, Homo sapiens
caaacattcttatt

SEQ ID NO: 2272200 - DNA, 16 bp, Homo sapiens
caaacattcttatttt

SEQ ID NO: 2272201 - DNA, 18 bp, Homo sapiens
caaacattgagactgcta

SEQ ID NO: 2272202 - DNA, 17 bp, Homo sapiens
caaaccatcattgaaat

SEQ ID NO: 2272203 - DNA, 14 bp, Homo sapiens
caaacccttcagtg

SEQ ID NO: 2272204 - DNA, 12 bp, Homo sapiens
caaactgaaaaa

SEQ ID NO: 2272205 - DNA, 16 bp, Homo sapiens
caaactgaaaaatcta

SEQ ID NO: 2272206 - DNA, 22 bp, Homo sapiens
caaactgtagtaattgttacaa

SEQ ID NO: 2272207 - DNA, 23 bp, Homo sapiens
caaactgttgtctagtatacagt

SEQ ID NO: 2272208 - DNA, 14 bp, Homo sapiens
caaagaaggcacag

SEQ ID NO: 2272209 - DNA, 21 bp, Homo sapiens
caaagaaggcacaggtgtaaa

SEQ ID NO: 2272210 - DNA, 19 bp, Homo sapiens
caaagacttaatcatatca

SEQ ID NO: 2272211 - DNA, 23 bp, Homo sapiens
caaagacttaatcatatcaactt

SEQ ID NO: 2272212 - DNA, 23 bp, Homo sapiens
caaagagaaaagattaaaattag

SEQ ID NO: 2272213 - DNA, 15 bp, Homo sapiens
caaagaggcattcag

SEQ ID NO: 2272214 - DNA, 16 bp, Homo sapiens
caaagatacaagaaaa

SEQ ID NO: 2272215 - DNA, 20 bp, Homo sapiens
caaagatacaagaaaaagta

SEQ ID NO: 2272216 - DNA, 22 bp, Homo sapiens
caaagatacaagaaaaagtaga

SEQ ID NO: 2272217 - DNA, 18 bp, Homo sapiens
caaagcagtgcatgctgt

SEQ ID NO: 2272218 - DNA, 14 bp, Homo sapiens
caaaggatttgaaa

SEQ ID NO: 2272219 - DNA, 15 bp, Homo sapiens
caaagggcaggcctg

SEQ ID NO: 2272220 - DNA, 15 bp, Homo sapiens
caaagggtaaattat

SEQ ID NO: 2272221 - DNA, 19 bp, Homo sapiens
caaagggtaaattataaat

SEQ ID NO: 2272222 - DNA, 20 bp, Homo sapiens
caaagtcatgtcagaaggag

SEQ ID NO: 2272223 - DNA, 14 bp, Homo sapiens
caaagtgcttcctt

SEQ ID NO: 2272224 - DNA, 16 bp, Homo sapiens
caaagtggtgagaggc

SEQ ID NO: 2272225 - DNA, 17 bp, Homo sapiens
caaagtggtgagaggca

SEQ ID NO: 2272226 - DNA, 19 bp, Homo sapiens
caaagtggtgagaggcatc

SEQ ID NO: 2272227 - DNA, 13 bp, Homo sapiens
caaagtttggaag

SEQ ID NO: 2272228 - DNA, 16 bp, Homo sapiens
caaataaaatgtttac

SEQ ID NO: 2272229 - DNA, 18 bp, Homo sapiens
caaataaaatgtttacat

SEQ ID NO: 2272230 - DNA, 20 bp, Homo sapiens
caaataaaatgtttacattt

SEQ ID NO: 2272231 - DNA, 15 bp, Homo sapiens
caaataaatgtgtaa

SEQ ID NO: 2272232 - DNA, 20 bp, Homo sapiens
caaataaatgtgtaaatgtg

SEQ ID NO: 2272233 - DNA, 19 bp, Homo sapiens
caaataataataataacaa

SEQ ID NO: 2272234 - DNA, 20 bp, Homo sapiens
caaataatactaatttataa

SEQ ID NO: 2272235 - DNA, 23 bp, Homo sapiens
caaatagtaggctaaaaacattt

SEQ ID NO: 2272236 - DNA, 23 bp, Homo sapiens
caaatagtgttgatcagatctta

SEQ ID NO: 2272237 - DNA, 18 bp, Homo sapiens
caaatattgctattgttt

SEQ ID NO: 2272238 - DNA, 12 bp, Homo sapiens
caaatgaatgag

SEQ ID NO: 2272239 - DNA, 20 bp, Homo sapiens
caaatgaatgcctttcaaac

SEQ ID NO: 2272240 - DNA, 14 bp, Homo sapiens
caaatggaaacaga

SEQ ID NO: 2272241 - DNA, 13 bp, Homo sapiens
caaattattctag

SEQ ID NO: 2272242 - DNA, 16 bp, Homo sapiens
caaattcttgaataaa

SEQ ID NO: 2272243 - DNA, 17 bp, Homo sapiens
caaattggtgtttctga

SEQ ID NO: 2272244 - DNA, 22 bp, Homo sapiens
caaatttttactcaggctttct

SEQ ID NO: 2272245 - DNA, 23 bp, Homo sapiens
caaatttttactcaggctttcta

SEQ ID NO: 2272246 - DNA, 13 bp, Homo sapiens
caacaacttaatg

SEQ ID NO: 2272247 - DNA, 15 bp, Homo sapiens
caacaacttaatgtg

SEQ ID NO: 2272248 - DNA, 13 bp, Homo sapiens
caacactcactgc

SEQ ID NO: 2272249 - DNA, 19 bp, Homo sapiens
caacactcactgcctgcag

SEQ ID NO: 2272250 - DNA, 16 bp, Homo sapiens
caacacttattttctg

SEQ ID NO: 2272251 - DNA, 17 bp, Homo sapiens
caacagcatgtctactg

SEQ ID NO: 2272252 - DNA, 18 bp, Homo sapiens
caacagggtttttttcca

SEQ ID NO: 2272253 - DNA, 11 bp, Homo sapiens
caacattacaa

SEQ ID NO: 2272254 - DNA, 18 bp, Homo sapiens
caacattatcctgtgtga

SEQ ID NO: 2272255 - DNA, 12 bp, Homo sapiens
caaccaataaaa

SEQ ID NO: 2272256 - DNA, 18 bp, Homo sapiens
caaccactgcgaccacaa

SEQ ID NO: 2272257 - DNA, 12 bp, Homo sapiens
caacccccacct

SEQ ID NO: 2272258 - DNA, 14 bp, Homo sapiens
caacccccacctcc

SEQ ID NO: 2272259 - DNA, 17 bp, Homo sapiens
caacccccacctcccgg

SEQ ID NO: 2272260 - DNA, 13 bp, Homo sapiens
caacctcgccctc

SEQ ID NO: 2272261 - DNA, 16 bp, Homo sapiens
caacctcgctccaact

SEQ ID NO: 2272262 - DNA, 17 bp, Homo sapiens
caacctcgctccaactc

SEQ ID NO: 2272263 - DNA, 21 bp, Homo sapiens
caacctcgctccaactccaac

SEQ ID NO: 2272264 - DNA, 14 bp, Homo sapiens
caacctggaggctg

SEQ ID NO: 2272265 - DNA, 12 bp, Homo sapiens
caacctgtgcaa

SEQ ID NO: 2272266 - DNA, 21 bp, Homo sapiens
caacctgtgcaaaataaaatg

SEQ ID NO: 2272267 - DNA, 18 bp, Homo sapiens
caactccaggaaaactgt

SEQ ID NO: 2272268 - DNA, 17 bp, Homo sapiens
caactgcatcaagatgt

SEQ ID NO: 2272269 - DNA, 22 bp, Homo sapiens
caactgccaaataaaatgttta

SEQ ID NO: 2272270 - DNA, 15 bp, Homo sapiens
caactgtttttgaag

SEQ ID NO: 2272271 - DNA, 18 bp, Homo sapiens
caacttaaacctgtgctt

SEQ ID NO: 2272272 - DNA, 12 bp, Homo sapiens
caacttaatgtg

SEQ ID NO: 2272273 - DNA, 16 bp, Homo sapiens
caacttccagatttga

SEQ ID NO: 2272274 - DNA, 15 bp, Homo sapiens
caacttgaattacaa

SEQ ID NO: 2272275 - DNA, 18 bp, Homo sapiens
caacttttgaaatttaaa

SEQ ID NO: 2272276 - DNA, 19 bp, Homo sapiens
caacttttgaaatttaaaa

SEQ ID NO: 2272277 - DNA, 13 bp, Homo sapiens
caagaacaaacag

SEQ ID NO: 2272278 - DNA, 17 bp, Homo sapiens
caagaagaatataaata

SEQ ID NO: 2272279 - DNA, 18 bp, Homo sapiens
caagaagattctaaaaca

SEQ ID NO: 2272280 - DNA, 16 bp, Homo sapiens
caagaagtttcttcag

SEQ ID NO: 2272281 - DNA, 19 bp, Homo sapiens
caagaatggaattttctga

SEQ ID NO: 2272282 - DNA, 17 bp, Homo sapiens
caagactgctccctttt

SEQ ID NO: 2272283 - DNA, 22 bp, Homo sapiens
caagatgttggggggccccacg

SEQ ID NO: 2272284 - DNA, 23 bp, Homo sapiens
caagatttccctaaaaattccac

SEQ ID NO: 2272285 - DNA, 18 bp, Homo sapiens
caagcacaaactgtcgtc

SEQ ID NO: 2272286 - DNA, 21 bp, Homo sapiens
caagccagagccgcaccctgg

SEQ ID NO: 2272287 - DNA, 17 bp, Homo sapiens
caagctttaacagacta

SEQ ID NO: 2272288 - DNA, 12 bp, Homo sapiens
caaggacactga

SEQ ID NO: 2272289 - DNA, 14 bp, Homo sapiens
caaggacactgatg

SEQ ID NO: 2272290 - DNA, 14 bp, Homo sapiens
caaggcaaggctgt

SEQ ID NO: 2272291 - DNA, 16 bp, Homo sapiens
caaggcaaggctgtca

SEQ ID NO: 2272292 - DNA, 16 bp, Homo sapiens
caaggcaccagcaaat

SEQ ID NO: 2272293 - DNA, 18 bp, Homo sapiens
caagggaagcctgcctgg

SEQ ID NO: 2272294 - DNA, 15 bp, Homo sapiens
caagggcccagaggg

SEQ ID NO: 2272295 - DNA, 13 bp, Homo sapiens
caaggggtggaag

SEQ ID NO: 2272296 - DNA, 15 bp, Homo sapiens
caaggggtggaaggg

SEQ ID NO: 2272297 - DNA, 19 bp, Homo sapiens
caaggggtggaagggcagg

SEQ ID NO: 2272298 - DNA, 18 bp, Homo sapiens
caagggtgcttgtggtca

SEQ ID NO: 2272299 - DNA, 21 bp, Homo sapiens
caaggtgcggaccggagcggc

SEQ ID NO: 2272300 - DNA, 14 bp, Homo sapiens
caagtcatgggaga

SEQ ID NO: 2272301 - DNA, 16 bp, Homo sapiens
caagtcatgggagaag

SEQ ID NO: 2272302 - DNA, 19 bp, Homo sapiens
caagtgaaaactgatttcc

SEQ ID NO: 2272303 - DNA, 14 bp, Homo sapiens
caagtgtacatttg

SEQ ID NO: 2272304 - DNA, 15 bp, Homo sapiens
caagtgtacatttga

SEQ ID NO: 2272305 - DNA, 23 bp, Homo sapiens
caagttacacggggttacactgt

SEQ ID NO: 2272306 - DNA, 21 bp, Homo sapiens
caataagcgttaagggcagag

SEQ ID NO: 2272307 - DNA, 22 bp, Homo sapiens
caataagcgttaagggcagagt

SEQ ID NO: 2272308 - DNA, 19 bp, Homo sapiens
caataagtgttgtaccata

SEQ ID NO: 2272309 - DNA, 17 bp, Homo sapiens
caatactgccgctgccc

SEQ ID NO: 2272310 - DNA, 17 bp, Homo sapiens
caatacttttgtgtatt

SEQ ID NO: 2272311 - DNA, 20 bp, Homo sapiens
caatagcatggatagagtat

SEQ ID NO: 2272312 - DNA, 12 bp, Homo sapiens
caataggaaaaa

SEQ ID NO: 2272313 - DNA, 14 bp, Homo sapiens
caataggaaaaact

SEQ ID NO: 2272314 - DNA, 15 bp, Homo sapiens
caataggaaaaactg

SEQ ID NO: 2272315 - DNA, 17 bp, Homo sapiens
caataggaaaaactgat

SEQ ID NO: 2272316 - DNA, 22 bp, Homo sapiens
caatagtgttgaggaggggagc

SEQ ID NO: 2272317 - DNA, 23 bp, Homo sapiens
caatatatttgtaggtatactat

SEQ ID NO: 2272318 - DNA, 13 bp, Homo sapiens
caatatcatgtgt

SEQ ID NO: 2272319 - DNA, 18 bp, Homo sapiens
caatatcatgtgtagata

SEQ ID NO: 2272320 - DNA, 17 bp, Homo sapiens
caatgaaatatttgctt

SEQ ID NO: 2272321 - DNA, 23 bp, Homo sapiens
caatgaaatatttgcttatttat

SEQ ID NO: 2272322 - DNA, 15 bp, Homo sapiens
caatgaagataaatg

SEQ ID NO: 2272323 - DNA, 18 bp, Homo sapiens
caatgaagataaatgctt

SEQ ID NO: 2272324 - DNA, 19 bp, Homo sapiens
caatgaagataaatgcttt

SEQ ID NO: 2272325 - DNA, 20 bp, Homo sapiens
caatgaagataaatgcttta

SEQ ID NO: 2272326 - DNA, 13 bp, Homo sapiens
caatgacctttca

SEQ ID NO: 2272327 - DNA, 21 bp, Homo sapiens
caatgacctttcaataggaaa

SEQ ID NO: 2272328 - DNA, 20 bp, Homo sapiens
caatgaggttatgagaaaaa

SEQ ID NO: 2272329 - DNA, 16 bp, Homo sapiens
caatgatataggaaaa

SEQ ID NO: 2272330 - DNA, 21 bp, Homo sapiens
caatgatataggaaaatacat

SEQ ID NO: 2272331 - DNA, 14 bp, Homo sapiens
caatgatcagactt

SEQ ID NO: 2272332 - DNA, 22 bp, Homo sapiens
caatgcaaaccatcattgaaat

SEQ ID NO: 2272333 - DNA, 15 bp, Homo sapiens
caatgcatgatgact

SEQ ID NO: 2272334 - DNA, 22 bp, Homo sapiens
caatggtagctctgaagggagg

SEQ ID NO: 2272335 - DNA, 14 bp, Homo sapiens
caatgtactgtatt

SEQ ID NO: 2272336 - DNA, 15 bp, Homo sapiens
caatgtactgtattg

SEQ ID NO: 2272337 - DNA, 21 bp, Homo sapiens
caatgtgaattttaaaatgca

SEQ ID NO: 2272338 - DNA, 16 bp, Homo sapiens
caatgtttttctcaaa

SEQ ID NO: 2272339 - DNA, 19 bp, Homo sapiens
caattaaaaagttgggaaa

SEQ ID NO: 2272340 - DNA, 16 bp, Homo sapiens
caattacaggaagtac

SEQ ID NO: 2272341 - DNA, 16 bp, Homo sapiens
caattagatagaaaag

SEQ ID NO: 2272342 - DNA, 22 bp, Homo sapiens
caattagatagaaaaggtccaa

SEQ ID NO: 2272343 - DNA, 20 bp, Homo sapiens
caattcatatttatgaatct

SEQ ID NO: 2272344 - DNA, 17 bp, Homo sapiens
caattcattaataaaat

SEQ ID NO: 2272345 - DNA, 16 bp, Homo sapiens
caattcttttgaaaga

SEQ ID NO: 2272346 - DNA, 23 bp, Homo sapiens
caatttaaaggaaagttctatta

SEQ ID NO: 2272347 - DNA, 18 bp, Homo sapiens
caatttagccagaatgtt

SEQ ID NO: 2272348 - DNA, 17 bp, Homo sapiens
caatttatgttaacaga

SEQ ID NO: 2272349 - DNA, 19 bp, Homo sapiens
caatttatgttaacagatg

SEQ ID NO: 2272350 - DNA, 16 bp, Homo sapiens
caatttctccaaagct

SEQ ID NO: 2272351 - DNA, 22 bp, Homo sapiens
caattttaaaaaataacatatt

SEQ ID NO: 2272352 - DNA, 14 bp, Homo sapiens
caattttcatccca

SEQ ID NO: 2272353 - DNA, 15 bp, Homo sapiens
caattttcatcccac

SEQ ID NO: 2272354 - DNA, 22 bp, Homo sapiens
cacaaaaggctggatgtgcttt

SEQ ID NO: 2272355 - DNA, 15 bp, Homo sapiens
cacaaactgtcgtct

SEQ ID NO: 2272356 - DNA, 22 bp, Homo sapiens
cacaaaggggatcataaagtta

SEQ ID NO: 2272357 - DNA, 19 bp, Homo sapiens
cacaacaaagtgcttcctt

SEQ ID NO: 2272358 - DNA, 18 bp, Homo sapiens
cacaactgtttttgaaga

SEQ ID NO: 2272359 - DNA, 20 bp, Homo sapiens
cacaactgtttttgaagaag

SEQ ID NO: 2272360 - DNA, 12 bp, Homo sapiens
cacacagcagct

SEQ ID NO: 2272361 - DNA, 15 bp, Homo sapiens
cacacattggccgct

SEQ ID NO: 2272362 - DNA, 19 bp, Homo sapiens
cacaccccgtctgcccctt

SEQ ID NO: 2272363 - DNA, 12 bp, Homo sapiens
cacaccctggag

SEQ ID NO: 2272364 - DNA, 21 bp, Homo sapiens
cacaccctggagtggcatggt

SEQ ID NO: 2272365 - DNA, 18 bp, Homo sapiens
cacaccgcaccgggctgg

SEQ ID NO: 2272366 - DNA, 18 bp, Homo sapiens
cacacctgcctctgaact

SEQ ID NO: 2272367 - DNA, 14 bp, Homo sapiens
cacacctgtaatcc

SEQ ID NO: 2272368 - DNA, 18 bp, Homo sapiens
cacacgccggggctggcc

SEQ ID NO: 2272369 - DNA, 19 bp, Homo sapiens
cacacgccggggctggccc

SEQ ID NO: 2272370 - DNA, 20 bp, Homo sapiens
cacacgccggggctggccct

SEQ ID NO: 2272371 - DNA, 23 bp, Homo sapiens
cacacgccggggctggccctgcc

SEQ ID NO: 2272372 - DNA, 18 bp, Homo sapiens
cacacgctgcctcctcag

SEQ ID NO: 2272373 - DNA, 12 bp, Homo sapiens
cacactatttta

SEQ ID NO: 2272374 - DNA, 14 bp, Homo sapiens
cacactattttaga

SEQ ID NO: 2272375 - DNA, 20 bp, Homo sapiens
cacactgtgcgttttagagt

SEQ ID NO: 2272376 - DNA, 19 bp, Homo sapiens
cacactgtggtgtctcttg

SEQ ID NO: 2272377 - DNA, 21 bp, Homo sapiens
cacacttgacatcaactgcat

SEQ ID NO: 2272378 - DNA, 20 bp, Homo sapiens
cacacttgcaaatgaatgcc

SEQ ID NO: 2272379 - DNA, 11 bp, Homo sapiens
cacagaacagg

SEQ ID NO: 2272380 - DNA, 16 bp, Homo sapiens
cacagacccctggggg

SEQ ID NO: 2272381 - DNA, 19 bp, Homo sapiens
cacagacccctgggggagg

SEQ ID NO: 2272382 - DNA, 23 bp, Homo sapiens
cacagatccatccttttgcttca

SEQ ID NO: 2272383 - DNA, 20 bp, Homo sapiens
cacagcctcttcctccccat

SEQ ID NO: 2272384 - DNA, 20 bp, Homo sapiens
cacagcctttgcgctctggg

SEQ ID NO: 2272385 - DNA, 23 bp, Homo sapiens
cacagcctttgcgctctgggttt

SEQ ID NO: 2272386 - DNA, 13 bp, Homo sapiens
cacaggctgcccc

SEQ ID NO: 2272387 - DNA, 20 bp, Homo sapiens
cacaggctgccccacccctc

SEQ ID NO: 2272388 - DNA, 14 bp, Homo sapiens
cacaggctggcagt

SEQ ID NO: 2272389 - DNA, 13 bp, Homo sapiens
cacaggtgtaaat

SEQ ID NO: 2272390 - DNA, 14 bp, Homo sapiens
cacaggtgtaaata

SEQ ID NO: 2272391 - DNA, 16 bp, Homo sapiens
cacaggtgtaaatata

SEQ ID NO: 2272392 - DNA, 21 bp, Homo sapiens
cacagtagtgttgggtggagg

SEQ ID NO: 2272393 - DNA, 18 bp, Homo sapiens
cacataaatctgtctgat

SEQ ID NO: 2272394 - DNA, 19 bp, Homo sapiens
cacataaatctgtctgatt

SEQ ID NO: 2272395 - DNA, 20 bp, Homo sapiens
cacataaatctgtctgattc

SEQ ID NO: 2272396 - DNA, 22 bp, Homo sapiens
cacataaatctgtctgattcta

SEQ ID NO: 2272397 - DNA, 14 bp, Homo sapiens
cacatatacatcta

SEQ ID NO: 2272398 - DNA, 22 bp, Homo sapiens
cacatcatgtaatagtggcttt

SEQ ID NO: 2272399 - DNA, 23 bp, Homo sapiens
cacatctcacttcagttgtggcc

SEQ ID NO: 2272400 - DNA, 20 bp, Homo sapiens
cacatctgtatatcagctct

SEQ ID NO: 2272401 - DNA, 16 bp, Homo sapiens
cacatgcactcagtgt

SEQ ID NO: 2272402 - DNA, 17 bp, Homo sapiens
cacatgcatcctcccct

SEQ ID NO: 2272403 - DNA, 21 bp, Homo sapiens
cacatggaacttaaaacatat

SEQ ID NO: 2272404 - DNA, 15 bp, Homo sapiens
cacattcatgtacaa

SEQ ID NO: 2272405 - DNA, 19 bp, Homo sapiens
cacatttagtccaatgaag

SEQ ID NO: 2272406 - DNA, 20 bp, Homo sapiens
cacatttgtcactgaataat

SEQ ID NO: 2272407 - DNA, 19 bp, Homo sapiens
caccaagggtatctgctgc

SEQ ID NO: 2272408 - DNA, 23 bp, Homo sapiens
caccacggggtcgggggaggagc

SEQ ID NO: 2272409 - DNA, 16 bp, Homo sapiens
caccactcaagaccaa

SEQ ID NO: 2272410 - DNA, 22 bp, Homo sapiens
caccactttgtctctgagaaca

SEQ ID NO: 2272411 - DNA, 13 bp, Homo sapiens
caccagcctgagc

SEQ ID NO: 2272412 - DNA, 14 bp, Homo sapiens
caccagcctgagcc

SEQ ID NO: 2272413 - DNA, 18 bp, Homo sapiens
caccagcctgagccacag

SEQ ID NO: 2272414 - DNA, 20 bp, Homo sapiens
caccagctgccaaaatcgta

SEQ ID NO: 2272415 - DNA, 12 bp, Homo sapiens
caccaggtcctg

SEQ ID NO: 2272416 - DNA, 18 bp, Homo sapiens
caccaggtcctgtgagca

SEQ ID NO: 2272417 - DNA, 15 bp, Homo sapiens
cacccagccccagcg

SEQ ID NO: 2272418 - DNA, 19 bp, Homo sapiens
caccccaaaggggcctctc

SEQ ID NO: 2272419 - DNA, 19 bp, Homo sapiens
cacccccactttcgcctcc

SEQ ID NO: 2272420 - DNA, 21 bp, Homo sapiens
cacccccactttcgcctcctc

SEQ ID NO: 2272421 - DNA, 24 bp, Homo sapiens
cacccccactttcgcctcctccag

SEQ ID NO: 2272422 - DNA, 15 bp, Homo sapiens
cacccccagcctccc

SEQ ID NO: 2272423 - DNA, 20 bp, Homo sapiens
cacccccagcctcccccagg

SEQ ID NO: 2272424 - DNA, 23 bp, Homo sapiens
caccccgctgcctggcgggcagc

SEQ ID NO: 2272425 - DNA, 16 bp, Homo sapiens
caccccgtctgcccct

SEQ ID NO: 2272426 - DNA, 12 bp, Homo sapiens
cacccctcctcc

SEQ ID NO: 2272427 - DNA, 17 bp, Homo sapiens
cacccctcctccttgct

SEQ ID NO: 2272428 - DNA, 18 bp, Homo sapiens
cacccctcctccttgctg

SEQ ID NO: 2272429 - DNA, 17 bp, Homo sapiens
cacccgccccagagact

SEQ ID NO: 2272430 - DNA, 21 bp, Homo sapiens
cacccgccccagagactgccc

SEQ ID NO: 2272431 - DNA, 23 bp, Homo sapiens
cacccgccccagagactgcccac

SEQ ID NO: 2272432 - DNA, 17 bp, Homo sapiens
cacccgcccgcccccgc

SEQ ID NO: 2272433 - DNA, 16 bp, Homo sapiens
caccctaggttctaca

SEQ ID NO: 2272434 - DNA, 12 bp, Homo sapiens
caccctattttc

SEQ ID NO: 2272435 - DNA, 17 bp, Homo sapiens
caccctccccattagta

SEQ ID NO: 2272436 - DNA, 13 bp, Homo sapiens
caccctcccctct

SEQ ID NO: 2272437 - DNA, 13 bp, Homo sapiens
caccctctgctgc

SEQ ID NO: 2272438 - DNA, 14 bp, Homo sapiens
caccctctgctgca

SEQ ID NO: 2272439 - DNA, 20 bp, Homo sapiens
caccctgaggagtgatgggc

SEQ ID NO: 2272440 - DNA, 18 bp, Homo sapiens
caccctgccaccctctgc

SEQ ID NO: 2272441 - DNA, 22 bp, Homo sapiens
caccctgccaccctctgctgca

SEQ ID NO: 2272442 - DNA, 16 bp, Homo sapiens
caccctgcttctgctg

SEQ ID NO: 2272443 - DNA, 12 bp, Homo sapiens
caccctggctgg

SEQ ID NO: 2272444 - DNA, 15 bp, Homo sapiens
caccgaaaacgtggc

SEQ ID NO: 2272445 - DNA, 18 bp, Homo sapiens
caccgaaaacgtggctgc

SEQ ID NO: 2272446 - DNA, 18 bp, Homo sapiens
caccgcaccgggctggcc

SEQ ID NO: 2272447 - DNA, 16 bp, Homo sapiens
caccgccatgcatgat

SEQ ID NO: 2272448 - DNA, 21 bp, Homo sapiens
caccgcccaacccccacctcc

SEQ ID NO: 2272449 - DNA, 12 bp, Homo sapiens
caccgcccaccc

SEQ ID NO: 2272450 - DNA, 13 bp, Homo sapiens
caccgcccaccca

SEQ ID NO: 2272451 - DNA, 14 bp, Homo sapiens
caccgcctgccccc

SEQ ID NO: 2272452 - DNA, 23 bp, Homo sapiens
caccgtggtgtgaggcccccgga

SEQ ID NO: 2272453 - DNA, 21 bp, Homo sapiens
cacctataaaattatgaaaat

SEQ ID NO: 2272454 - DNA, 17 bp, Homo sapiens
cacctcactcagcacca

SEQ ID NO: 2272455 - DNA, 20 bp, Homo sapiens
cacctcactcagcaccactc

SEQ ID NO: 2272456 - DNA, 22 bp, Homo sapiens
cacctcctcggctggctgtcca

SEQ ID NO: 2272457 - DNA, 14 bp, Homo sapiens
cacctcttcacaat

SEQ ID NO: 2272458 - DNA, 15 bp, Homo sapiens
cacctgaaacacttt

SEQ ID NO: 2272459 - DNA, 11 bp, Homo sapiens
cacctgcccag

SEQ ID NO: 2272460 - DNA, 14 bp, Homo sapiens
cacctgcccagtta

SEQ ID NO: 2272461 - DNA, 21 bp, Homo sapiens
cacctgcccagttagcccggc

SEQ ID NO: 2272462 - DNA, 17 bp, Homo sapiens
cacctgccgctgcttga

SEQ ID NO: 2272463 - DNA, 16 bp, Homo sapiens
cacctgcctctgaact

SEQ ID NO: 2272464 - DNA, 16 bp, Homo sapiens
cacctgggagatgctg

SEQ ID NO: 2272465 - DNA, 17 bp, Homo sapiens
caccttcactctccagg

SEQ ID NO: 2272466 - DNA, 20 bp, Homo sapiens
caccttcttattatatatat

SEQ ID NO: 2272467 - DNA, 20 bp, Homo sapiens
caccttgggcacgggagagc

SEQ ID NO: 2272468 - DNA, 16 bp, Homo sapiens
cacgaatattgctgat

SEQ ID NO: 2272469 - DNA, 19 bp, Homo sapiens
cacgaggccttcagaaaag

SEQ ID NO: 2272470 - DNA, 23 bp, Homo sapiens
cacgcagagccccggagcaccac

SEQ ID NO: 2272471 - DNA, 22 bp, Homo sapiens
cacgccggggctggccctgccc

SEQ ID NO: 2272472 - DNA, 11 bp, Homo sapiens
cacgcctccat

SEQ ID NO: 2272473 - DNA, 19 bp, Homo sapiens
cacgctgcctcctcagcag

SEQ ID NO: 2272474 - DNA, 15 bp, Homo sapiens
cacgcttctggaggt

SEQ ID NO: 2272475 - DNA, 23 bp, Homo sapiens
cacgcttctggaggtggggaggg

SEQ ID NO: 2272476 - DNA, 21 bp, Homo sapiens
cacggacccattcatactaaa

SEQ ID NO: 2272477 - DNA, 13 bp, Homo sapiens
cacggaccctgtg

SEQ ID NO: 2272478 - DNA, 23 bp, Homo sapiens
cacggaggcctcgagcagagaga

SEQ ID NO: 2272479 - DNA, 23 bp, Homo sapiens
cacggccgtccctgacttcccag

SEQ ID NO: 2272480 - DNA, 22 bp, Homo sapiens
agttacacggggttacactgtt

SEQ ID NO: 2272481 - DNA, 16 bp, Homo sapiens
agttacagacaaagcg

SEQ ID NO: 2272482 - DNA, 15 bp, Homo sapiens
agttagaatctattt

SEQ ID NO: 2272483 - DNA, 13 bp, Homo sapiens
agttagcccggcc

SEQ ID NO: 2272484 - DNA, 20 bp, Homo sapiens
agttagggcatttttcttgg

SEQ ID NO: 2272485 - DNA, 14 bp, Homo sapiens
agttaggtgtgcca

SEQ ID NO: 2272486 - DNA, 21 bp, Homo sapiens
agttatgataaccaagaatgt

SEQ ID NO: 2272487 - DNA, 20 bp, Homo sapiens
agttatgtgttaaatttagt

SEQ ID NO: 2272488 - DNA, 21 bp, Homo sapiens
agttatgtgttaaatttagtg

SEQ ID NO: 2272489 - DNA, 24 bp, Homo sapiens
agttatgtgttaaatttagtgcaa

SEQ ID NO: 2272490 - DNA, 13 bp, Homo sapiens
agttcatcttgaa

SEQ ID NO: 2272491 - DNA, 22 bp, Homo sapiens
agttcatcttgaattgtaagga

SEQ ID NO: 2272492 - DNA, 23 bp, Homo sapiens
agttcctgggtttagctgtgaaa

SEQ ID NO: 2272493 - DNA, 14 bp, Homo sapiens
agttcctgtccctg

SEQ ID NO: 2272494 - DNA, 16 bp, Homo sapiens
agttctatttctatct

SEQ ID NO: 2272495 - DNA, 20 bp, Homo sapiens
agttctatttctatctgcaa

SEQ ID NO: 2272496 - DNA, 12 bp, Homo sapiens
agttctcatctt

SEQ ID NO: 2272497 - DNA, 13 bp, Homo sapiens
agttctccttgta

SEQ ID NO: 2272498 - DNA, 17 bp, Homo sapiens
agttctgcaataacagt

SEQ ID NO: 2272499 - DNA, 20 bp, Homo sapiens
agttctgtgtaaacagaagc

SEQ ID NO: 2272500 - DNA, 12 bp, Homo sapiens
agttcttggcct

SEQ ID NO: 2272501 - DNA, 19 bp, Homo sapiens
agttgaacaagatttccct

SEQ ID NO: 2272502 - DNA, 22 bp, Homo sapiens
agttgaagggaaatcaatttaa

SEQ ID NO: 2272503 - DNA, 23 bp, Homo sapiens
agttgatgaccaatctctgtgac

SEQ ID NO: 2272504 - DNA, 15 bp, Homo sapiens
agttgcaaagcattt

SEQ ID NO: 2272505 - DNA, 15 bp, Homo sapiens
agttgccctccaggc

SEQ ID NO: 2272506 - DNA, 18 bp, Homo sapiens
agttgccctccaggccga

SEQ ID NO: 2272507 - DNA, 16 bp, Homo sapiens
agttgctctctgttca

SEQ ID NO: 2272508 - DNA, 18 bp, Homo sapiens
agttgctttgcggcatct

SEQ ID NO: 2272509 - DNA, 15 bp, Homo sapiens
agttggactgtggcc

SEQ ID NO: 2272510 - DNA, 21 bp, Homo sapiens
agttggctcacatcatgtaat

SEQ ID NO: 2272511 - DNA, 20 bp, Homo sapiens
agttggtgattttagatttc

SEQ ID NO: 2272512 - DNA, 18 bp, Homo sapiens
agttgtattttaataaag

SEQ ID NO: 2272513 - DNA, 17 bp, Homo sapiens
agttgttagtgtgtctt

SEQ ID NO: 2272514 - DNA, 18 bp, Homo sapiens
agtttaaaaaaataacat

SEQ ID NO: 2272515 - DNA, 12 bp, Homo sapiens
agtttaaaaata

SEQ ID NO: 2272516 - DNA, 20 bp, Homo sapiens
agtttaacagatatttaaat

SEQ ID NO: 2272517 - DNA, 21 bp, Homo sapiens
agtttaacagatatttaaatt

SEQ ID NO: 2272518 - DNA, 20 bp, Homo sapiens
agtttaccaatcaacagcat

SEQ ID NO: 2272519 - DNA, 15 bp, Homo sapiens
agtttacttcacttt

SEQ ID NO: 2272520 - DNA, 20 bp, Homo sapiens
agtttcacataagttatttg

SEQ ID NO: 2272521 - DNA, 24 bp, Homo sapiens
agtttcaggcaaggcagctcccag

SEQ ID NO: 2272522 - DNA, 23 bp, Homo sapiens
agtttctgcaaagtgtatgtgac

SEQ ID NO: 2272523 - DNA, 20 bp, Homo sapiens
agtttgatcacactatttta

SEQ ID NO: 2272524 - DNA, 19 bp, Homo sapiens
agtttgcatacttcctgga

SEQ ID NO: 2272525 - DNA, 21 bp, Homo sapiens
agtttgctgtccttcttagaa

SEQ ID NO: 2272526 - DNA, 20 bp, Homo sapiens
agtttggaagtacataaagt

SEQ ID NO: 2272527 - DNA, 20 bp, Homo sapiens
agtttgtaaatgttatttct

SEQ ID NO: 2272528 - DNA, 22 bp, Homo sapiens
agtttgtaaatgttatttctgc

SEQ ID NO: 2272529 - DNA, 15 bp, Homo sapiens
agttttcacagaggc

SEQ ID NO: 2272530 - DNA, 16 bp, Homo sapiens
agttttctaaatgttt

SEQ ID NO: 2272531 - DNA, 16 bp, Homo sapiens
ataaaaacataaaata

SEQ ID NO: 2272532 - DNA, 20 bp, Homo sapiens
ataaaaagtggaatttcttg

SEQ ID NO: 2272533 - DNA, 20 bp, Homo sapiens
ataaaacaatgtaattacat

SEQ ID NO: 2272534 - DNA, 21 bp, Homo sapiens
ataaaagaatgtacagaaaat

SEQ ID NO: 2272535 - DNA, 13 bp, Homo sapiens
ataaaataaatta

SEQ ID NO: 2272536 - DNA, 18 bp, Homo sapiens
ataaaataccttttatgt

SEQ ID NO: 2272537 - DNA, 20 bp, Homo sapiens
ataaaatctttccatctcat

SEQ ID NO: 2272538 - DNA, 11 bp, Homo sapiens
ataaaatgcta

SEQ ID NO: 2272539 - DNA, 13 bp, Homo sapiens
ataaaatgctatt

SEQ ID NO: 2272540 - DNA, 22 bp, Homo sapiens
ataaaatgctattttaaaattc

SEQ ID NO: 2272541 - DNA, 16 bp, Homo sapiens
ataaaatgtttacatt

SEQ ID NO: 2272542 - DNA, 20 bp, Homo sapiens
ataaaatgtttacattttct

SEQ ID NO: 2272543 - DNA, 17 bp, Homo sapiens
ataaacaacagaaactt

SEQ ID NO: 2272544 - DNA, 14 bp, Homo sapiens
ataaacgatatatg

SEQ ID NO: 2272545 - DNA, 13 bp, Homo sapiens
ataaacttgtgta

SEQ ID NO: 2272546 - DNA, 18 bp, Homo sapiens
ataaagaaaaaaatagtt

SEQ ID NO: 2272547 - DNA, 22 bp, Homo sapiens
ataaataaagaagaaaataacc

SEQ ID NO: 2272548 - DNA, 15 bp, Homo sapiens
ataaatagtaaataa

SEQ ID NO: 2272549 - DNA, 12 bp, Homo sapiens
ataaatctaaat

SEQ ID NO: 2272550 - DNA, 19 bp, Homo sapiens
ataaatctgtctgattcta

SEQ ID NO: 2272551 - DNA, 18 bp, Homo sapiens
ataaatctgttagcatta

SEQ ID NO: 2272552 - DNA, 22 bp, Homo sapiens
ataaatctgttagcattattgc

SEQ ID NO: 2272553 - DNA, 14 bp, Homo sapiens
ataaatgagcattt

SEQ ID NO: 2272554 - DNA, 12 bp, Homo sapiens
ataaatgcttta

SEQ ID NO: 2272555 - DNA, 15 bp, Homo sapiens
ataaatgctttaaat

SEQ ID NO: 2272556 - DNA, 18 bp, Homo sapiens
ataaatgctttaaatagt

SEQ ID NO: 2272557 - DNA, 21 bp, Homo sapiens
ataaatgtgatttttttatat

SEQ ID NO: 2272558 - DNA, 14 bp, Homo sapiens
ataaatgtgtaaat

SEQ ID NO: 2272559 - DNA, 15 bp, Homo sapiens
ataaatgtttcatga

SEQ ID NO: 2272560 - DNA, 16 bp, Homo sapiens
ataaatgtttcatgaa

SEQ ID NO: 2272561 - DNA, 19 bp, Homo sapiens
ataaattataatgcatcta

SEQ ID NO: 2272562 - DNA, 22 bp, Homo sapiens
ataacagagaatcttgattaaa

SEQ ID NO: 2272563 - DNA, 17 bp, Homo sapiens
ataacatattcttgctt

SEQ ID NO: 2272564 - DNA, 13 bp, Homo sapiens
ataacatctgaaa

SEQ ID NO: 2272565 - DNA, 14 bp, Homo sapiens
ataacatctgaaaa

SEQ ID NO: 2272566 - DNA, 16 bp, Homo sapiens
ataacatctgaaaaga

SEQ ID NO: 2272567 - DNA, 17 bp, Homo sapiens
ataacatctgaaaagaa

SEQ ID NO: 2272568 - DNA, 14 bp, Homo sapiens
ataactacattaaa

SEQ ID NO: 2272569 - DNA, 13 bp, Homo sapiens
ataactagatctc

SEQ ID NO: 2272570 - DNA, 14 bp, Homo sapiens
ataactagatctcc

SEQ ID NO: 2272571 - DNA, 18 bp, Homo sapiens
ataactagatctcctgta

SEQ ID NO: 2272572 - DNA, 19 bp, Homo sapiens
ataactagatctcctgtaa

SEQ ID NO: 2272573 - DNA, 21 bp, Homo sapiens
ataactgatgagatacatttg

SEQ ID NO: 2272574 - DNA, 23 bp, Homo sapiens
ataagaaccttttgagtgcctta

SEQ ID NO: 2272575 - DNA, 17 bp, Homo sapiens
ataagacaaaatttaat

SEQ ID NO: 2272576 - DNA, 21 bp, Homo sapiens
ataagagaaatggtagaagat

SEQ ID NO: 2272577 - DNA, 16 bp, Homo sapiens
ataaggcaacaaaatg

SEQ ID NO: 2272578 - DNA, 22 bp, Homo sapiens
ataaggtaccaagatcacaaat

SEQ ID NO: 2272579 - DNA, 13 bp, Homo sapiens
ataagtgctcagt

SEQ ID NO: 2272580 - DNA, 20 bp, Homo sapiens
ataataacaacaacttaatg

SEQ ID NO: 2272581 - DNA, 21 bp, Homo sapiens
ataataactagatctcctgta

SEQ ID NO: 2272582 - DNA, 16 bp, Homo sapiens
atactccatagaaact

SEQ ID NO: 2272583 - DNA, 19 bp, Homo sapiens
atactccatagaaactaaa

SEQ ID NO: 2272584 - DNA, 20 bp, Homo sapiens
atactctgtgtaatctctga

SEQ ID NO: 2272585 - DNA, 23 bp, Homo sapiens
atactctgtgtaatctctgatta

SEQ ID NO: 2272586 - DNA, 22 bp, Homo sapiens
atactgcatatcctggtgtcta

SEQ ID NO: 2272587 - DNA, 17 bp, Homo sapiens
atactgccgctgccccc

SEQ ID NO: 2272588 - DNA, 18 bp, Homo sapiens
atactgccgctgccccca

SEQ ID NO: 2272589 - DNA, 14 bp, Homo sapiens
atactggttatagt

SEQ ID NO: 2272590 - DNA, 23 bp, Homo sapiens
atactggttatagttgatatgta

SEQ ID NO: 2272591 - DNA, 22 bp, Homo sapiens
atactgtatatgtcaaaaatat

SEQ ID NO: 2272592 - DNA, 14 bp, Homo sapiens
atacttcctggatt

SEQ ID NO: 2272593 - DNA, 14 bp, Homo sapiens
atacttccttataa

SEQ ID NO: 2272594 - DNA, 18 bp, Homo sapiens
atacttccttataaaaat

SEQ ID NO: 2272595 - DNA, 22 bp, Homo sapiens
atacttccttataaaaattcta

SEQ ID NO: 2272596 - DNA, 16 bp, Homo sapiens
atacttgaatattata

SEQ ID NO: 2272597 - DNA, 11 bp, Homo sapiens
atactttctca

SEQ ID NO: 2272598 - DNA, 15 bp, Homo sapiens
atactttctcacatg

SEQ ID NO: 2272599 - DNA, 13 bp, Homo sapiens
atacttttgtgta

SEQ ID NO: 2272600 - DNA, 22 bp, Homo sapiens
atacttttgtgtattctgtgga

SEQ ID NO: 2272601 - DNA, 21 bp, Homo sapiens
atactttttcttttgtaagtg

SEQ ID NO: 2272602 - DNA, 21 bp, Homo sapiens
atagaaaataaaataaattat

SEQ ID NO: 2272603 - DNA, 23 bp, Homo sapiens
atagaactgtcccacaaaatatt

SEQ ID NO: 2272604 - DNA, 14 bp, Homo sapiens
atagaatatataaa

SEQ ID NO: 2272605 - DNA, 15 bp, Homo sapiens
atagaatatataaac

SEQ ID NO: 2272606 - DNA, 22 bp, Homo sapiens
atagagtttaacagatatttaa

SEQ ID NO: 2272607 - DNA, 13 bp, Homo sapiens
atagataattatc

SEQ ID NO: 2272608 - DNA, 15 bp, Homo sapiens
atagataattatcca

SEQ ID NO: 2272609 - DNA, 17 bp, Homo sapiens
atagatcacggcatgtt

SEQ ID NO: 2272610 - DNA, 18 bp, Homo sapiens
atagatcacggcatgttt

SEQ ID NO: 2272611 - DNA, 15 bp, Homo sapiens
atagctttaacattt

SEQ ID NO: 2272612 - DNA, 23 bp, Homo sapiens
atagctttaacattttgtttcca

SEQ ID NO: 2272613 - DNA, 14 bp, Homo sapiens
ataggaaaaactga

SEQ ID NO: 2272614 - DNA, 17 bp, Homo sapiens
ataggaaaaactgattt

SEQ ID NO: 2272615 - DNA, 16 bp, Homo sapiens
ataggaaaatacattg

SEQ ID NO: 2272616 - DNA, 15 bp, Homo sapiens
ataggaaataaatct

SEQ ID NO: 2272617 - DNA, 19 bp, Homo sapiens
ataggaagacgcagagcaa

SEQ ID NO: 2272618 - DNA, 22 bp, Homo sapiens
ataggtagcttgtccaaggtct

SEQ ID NO: 2272619 - DNA, 17 bp, Homo sapiens
atagtaggctaaaaaca

SEQ ID NO: 2272620 - DNA, 19 bp, Homo sapiens
atagtcatgtttctgcagt

SEQ ID NO: 2272621 - DNA, 13 bp, Homo sapiens
atagtctgtactt

SEQ ID NO: 2272622 - DNA, 14 bp, Homo sapiens
atagtctgtacttc

SEQ ID NO: 2272623 - DNA, 22 bp, Homo sapiens
atagtggctttcatttcttatt

SEQ ID NO: 2272624 - DNA, 19 bp, Homo sapiens
atagtgttgatcagatctt

SEQ ID NO: 2272625 - DNA, 13 bp, Homo sapiens
atagttacaacat

SEQ ID NO: 2272626 - DNA, 18 bp, Homo sapiens
atagttacaacattaatt

SEQ ID NO: 2272627 - DNA, 20 bp, Homo sapiens
atagttcacttactcttaca

SEQ ID NO: 2272628 - DNA, 14 bp, Homo sapiens
atagttctatttct

SEQ ID NO: 2272629 - DNA, 18 bp, Homo sapiens
atagttctatttctatct

SEQ ID NO: 2272630 - DNA, 19 bp, Homo sapiens
atagttctgcaataacagt

SEQ ID NO: 2272631 - DNA, 22 bp, Homo sapiens
atagttctgcaataacagtttt

SEQ ID NO: 2272632 - DNA, 23 bp, Homo sapiens
atagtttacttcactttcatctg

SEQ ID NO: 2272633 - DNA, 22 bp, Homo sapiens
atagtttattatagtctgtact

SEQ ID NO: 2272634 - DNA, 14 bp, Homo sapiens
atagtttgttttct

SEQ ID NO: 2272635 - DNA, 15 bp, Homo sapiens
atagtttgttttctt

SEQ ID NO: 2272636 - DNA, 22 bp, Homo sapiens
atagtttgttttctttttctgt

SEQ ID NO: 2272637 - DNA, 16 bp, Homo sapiens
atagttttctaaatgt

SEQ ID NO: 2272638 - DNA, 20 bp, Homo sapiens
atataaacgatatatgtaaa

SEQ ID NO: 2272639 - DNA, 12 bp, Homo sapiens
atataaacttgt

SEQ ID NO: 2272640 - DNA, 14 bp, Homo sapiens
atataactacatta

SEQ ID NO: 2272641 - DNA, 22 bp, Homo sapiens
atataactacattaaaagcttt

SEQ ID NO: 2272642 - DNA, 14 bp, Homo sapiens
atataagttaaaga

SEQ ID NO: 2272643 - DNA, 17 bp, Homo sapiens
atataagttaaagagac

SEQ ID NO: 2272644 - DNA, 14 bp, Homo sapiens
atataataattact

SEQ ID NO: 2272645 - DNA, 20 bp, Homo sapiens
atataataattacttaatgt

SEQ ID NO: 2272646 - DNA, 15 bp, Homo sapiens
atataattacttaat

SEQ ID NO: 2272647 - DNA, 17 bp, Homo sapiens
atataattacttaatgt

SEQ ID NO: 2272648 - DNA, 20 bp, Homo sapiens
atatacagcatgagattgta

SEQ ID NO: 2272649 - DNA, 14 bp, Homo sapiens
atatactaaccatt

SEQ ID NO: 2272650 - DNA, 21 bp, Homo sapiens
atatagaccccaagcattctg

SEQ ID NO: 2272651 - DNA, 16 bp, Homo sapiens
atataggaaaatacat

SEQ ID NO: 2272652 - DNA, 19 bp, Homo sapiens
atataggaaaatacattgt

SEQ ID NO: 2272653 - DNA, 15 bp, Homo sapiens
atatagttgaacaag

SEQ ID NO: 2272654 - DNA, 11 bp, Homo sapiens
atatagtttgt

SEQ ID NO: 2272655 - DNA, 23 bp, Homo sapiens
atatagtttgttttctttttctg

SEQ ID NO: 2272656 - DNA, 21 bp, Homo sapiens
atatataaacgatatatgtaa

SEQ ID NO: 2272657 - DNA, 13 bp, Homo sapiens
atatatacatgta

SEQ ID NO: 2272658 - DNA, 14 bp, Homo sapiens
atatatacatgtat

SEQ ID NO: 2272659 - DNA, 17 bp, Homo sapiens
atatatacatgtatagt

SEQ ID NO: 2272660 - DNA, 19 bp, Homo sapiens
atatatacatgtatagtga

SEQ ID NO: 2272661 - DNA, 20 bp, Homo sapiens
atatatagttacaacattaa

SEQ ID NO: 2272662 - DNA, 15 bp, Homo sapiens
atatatataatatat

SEQ ID NO: 2272663 - DNA, 12 bp, Homo sapiens
atatatatgtat

SEQ ID NO: 2272664 - DNA, 13 bp, Homo sapiens
atatatatgtata

SEQ ID NO: 2272665 - DNA, 16 bp, Homo sapiens
atatatgtaaatatac

SEQ ID NO: 2272666 - DNA, 17 bp, Homo sapiens
atatatttaaaattcat

SEQ ID NO: 2272667 - DNA, 15 bp, Homo sapiens
atatatttccaaata

SEQ ID NO: 2272668 - DNA, 16 bp, Homo sapiens
atatatttccaaatat

SEQ ID NO: 2272669 - DNA, 14 bp, Homo sapiens
atatatttgaaaga

SEQ ID NO: 2272670 - DNA, 23 bp, Homo sapiens
atatcagctctaaagcagagatg

SEQ ID NO: 2272671 - DNA, 15 bp, Homo sapiens
atatcatgtgtagat

SEQ ID NO: 2272672 - DNA, 19 bp, Homo sapiens
atatcatgtgtagatatta

SEQ ID NO: 2272673 - DNA, 21 bp, Homo sapiens
atatctgtaaatttaactgca

SEQ ID NO: 2272674 - DNA, 13 bp, Homo sapiens
atatcttgaagaa

SEQ ID NO: 2272675 - DNA, 14 bp, Homo sapiens
atatgaaagagaaa

SEQ ID NO: 2272676 - DNA, 17 bp, Homo sapiens
atatgaaagagaaaatg

SEQ ID NO: 2272677 - DNA, 13 bp, Homo sapiens
atatgaaagccta

SEQ ID NO: 2272678 - DNA, 18 bp, Homo sapiens
atatgaagtaagttctga

SEQ ID NO: 2272679 - DNA, 13 bp, Homo sapiens
atgcttcaagttt

SEQ ID NO: 2272680 - DNA, 13 bp, Homo sapiens
atgctttaaatag

SEQ ID NO: 2272681 - DNA, 13 bp, Homo sapiens
atgctttctcatg

SEQ ID NO: 2272682 - DNA, 14 bp, Homo sapiens
atgctttctcatgc

SEQ ID NO: 2272683 - DNA, 17 bp, Homo sapiens
atggaaatacatttaga

SEQ ID NO: 2272684 - DNA, 13 bp, Homo sapiens
atggaaatcctgt

SEQ ID NO: 2272685 - DNA, 14 bp, Homo sapiens
atggaacactctga

SEQ ID NO: 2272686 - DNA, 23 bp, Homo sapiens
atggaagctggcaggagacactg

SEQ ID NO: 2272687 - DNA, 22 bp, Homo sapiens
atggaccactgtttcttgcttg

SEQ ID NO: 2272688 - DNA, 22 bp, Homo sapiens
atggacgtgtctgcacagggtc

SEQ ID NO: 2272689 - DNA, 23 bp, Homo sapiens
atggacttaattatgctaacaaa

SEQ ID NO: 2272690 - DNA, 20 bp, Homo sapiens
atggagcacgaggccttcag

SEQ ID NO: 2272691 - DNA, 21 bp, Homo sapiens
atggagtgtcaccagctgcca

SEQ ID NO: 2272692 - DNA, 16 bp, Homo sapiens
atggatattagatgcc

SEQ ID NO: 2272693 - DNA, 12 bp, Homo sapiens
atggcagagcag

SEQ ID NO: 2272694 - DNA, 13 bp, Homo sapiens
atggcagagccat

SEQ ID NO: 2272695 - DNA, 18 bp, Homo sapiens
atggcagagccatccacc

SEQ ID NO: 2272696 - DNA, 16 bp, Homo sapiens
atggccaagtgtacat

SEQ ID NO: 2272697 - DNA, 17 bp, Homo sapiens
atggccaagtgtacatt

SEQ ID NO: 2272698 - DNA, 20 bp, Homo sapiens
atggcgcacccggcagcccc

SEQ ID NO: 2272699 - DNA, 15 bp, Homo sapiens
atggcgtgtcccctg

SEQ ID NO: 2272700 - DNA, 19 bp, Homo sapiens
atggcgtgtcccctgcctg

SEQ ID NO: 2272701 - DNA, 14 bp, Homo sapiens
atggctgcagtcct

SEQ ID NO: 2272702 - DNA, 13 bp, Homo sapiens
atggctgtatttt

SEQ ID NO: 2272703 - DNA, 16 bp, Homo sapiens
atgggagtcagggagc

SEQ ID NO: 2272704 - DNA, 19 bp, Homo sapiens
atgggatcattatttcatg

SEQ ID NO: 2272705 - DNA, 20 bp, Homo sapiens
atgggcaaggggccaggaag

SEQ ID NO: 2272706 - DNA, 23 bp, Homo sapiens
atgggcaaggggccaggaagggg

SEQ ID NO: 2272707 - DNA, 13 bp, Homo sapiens
atgggcacaggct

SEQ ID NO: 2272708 - DNA, 19 bp, Homo sapiens
atgggcacaggctgcccca

SEQ ID NO: 2272709 - DNA, 16 bp, Homo sapiens
atgggggccaggctga

SEQ ID NO: 2272710 - DNA, 14 bp, Homo sapiens
atgggggctcctgg

SEQ ID NO: 2272711 - DNA, 17 bp, Homo sapiens
atgggggctcctggcag

SEQ ID NO: 2272712 - DNA, 17 bp, Homo sapiens
atggggttgggctctgc

SEQ ID NO: 2272713 - DNA, 19 bp, Homo sapiens
atgggtgtcccctggtgcc

SEQ ID NO: 2272714 - DNA, 22 bp, Homo sapiens
atgggttcctcccttcttctga

SEQ ID NO: 2272715 - DNA, 23 bp, Homo sapiens
atggtagctctgaagggagggga

SEQ ID NO: 2272716 - DNA, 12 bp, Homo sapiens
atggtattttcg

SEQ ID NO: 2272717 - DNA, 21 bp, Homo sapiens
atggtattttcgtgcatttgt

SEQ ID NO: 2272718 - DNA, 23 bp, Homo sapiens
atggtattttcgtgcatttgtga

SEQ ID NO: 2272719 - DNA, 15 bp, Homo sapiens
atggtcacagacccc

SEQ ID NO: 2272720 - DNA, 16 bp, Homo sapiens
atggtcacagacccct

SEQ ID NO: 2272721 - DNA, 14 bp, Homo sapiens
atggtctcttccag

SEQ ID NO: 2272722 - DNA, 13 bp, Homo sapiens
atggtgcaatgac

SEQ ID NO: 2272723 - DNA, 17 bp, Homo sapiens
atggtgcaatgaccttt

SEQ ID NO: 2272724 - DNA, 23 bp, Homo sapiens
atgtaaactttcctgtactcact

SEQ ID NO: 2272725 - DNA, 11 bp, Homo sapiens
atgtaaatata

SEQ ID NO: 2272726 - DNA, 18 bp, Homo sapiens
atgtaacagttggtgatt

SEQ ID NO: 2272727 - DNA, 13 bp, Homo sapiens
atgtaagaagccc

SEQ ID NO: 2272728 - DNA, 16 bp, Homo sapiens
atgtaagggctttaaa

SEQ ID NO: 2272729 - DNA, 17 bp, Homo sapiens
atgtaagggctttaaat

SEQ ID NO: 2272730 - DNA, 11 bp, Homo sapiens
atgttttagag

SEQ ID NO: 2272731 - DNA, 12 bp, Homo sapiens
atgttttagaga

SEQ ID NO: 2272732 - DNA, 20 bp, Homo sapiens
atgttttagagataaatatt

SEQ ID NO: 2272733 - DNA, 23 bp, Homo sapiens
atgttttagagataaatatttat

SEQ ID NO: 2272734 - DNA, 22 bp, Homo sapiens
atgtttttagaggggcaaaaat

SEQ ID NO: 2272735 - DNA, 22 bp, Homo sapiens
atgtttttctcaaaaagctgct

SEQ ID NO: 2272736 - DNA, 17 bp, Homo sapiens
attaaaagctttagatt

SEQ ID NO: 2272737 - DNA, 23 bp, Homo sapiens
attaaaagctttagattgaaatt

SEQ ID NO: 2272738 - DNA, 14 bp, Homo sapiens
attaaagacattta

SEQ ID NO: 2272739 - DNA, 17 bp, Homo sapiens
attaaagacatttaaaa

SEQ ID NO: 2272740 - DNA, 21 bp, Homo sapiens
attaaagtttcattagtcata

SEQ ID NO: 2272741 - DNA, 14 bp, Homo sapiens
attaaatataaaat

SEQ ID NO: 2272742 - DNA, 15 bp, Homo sapiens
attaaatataaaata

SEQ ID NO: 2272743 - DNA, 18 bp, Homo sapiens
attaaatataaaatacat

SEQ ID NO: 2272744 - DNA, 19 bp, Homo sapiens
attaaatataaaatacata

SEQ ID NO: 2272745 - DNA, 22 bp, Homo sapiens
attaaattccttccatgataga

SEQ ID NO: 2272746 - DNA, 16 bp, Homo sapiens
attaaattttaatgta

SEQ ID NO: 2272747 - DNA, 13 bp, Homo sapiens
attaaccaaatta

SEQ ID NO: 2272748 - DNA, 19 bp, Homo sapiens
attaaccaaattaaccttt

SEQ ID NO: 2272749 - DNA, 20 bp, Homo sapiens
attaatatgtacttttccat

SEQ ID NO: 2272750 - DNA, 14 bp, Homo sapiens
attaatctctaaaa

SEQ ID NO: 2272751 - DNA, 22 bp, Homo sapiens
attaatctctaaaattctagtc

SEQ ID NO: 2272752 - DNA, 16 bp, Homo sapiens
attaatgattcaatta

SEQ ID NO: 2272753 - DNA, 16 bp, Homo sapiens
attaatttgtgtagat

SEQ ID NO: 2272754 - DNA, 15 bp, Homo sapiens
attacaaacaaagga

SEQ ID NO: 2272755 - DNA, 22 bp, Homo sapiens
attacaaacaaaggatttgaaa

SEQ ID NO: 2272756 - DNA, 15 bp, Homo sapiens
attacactgtaagaa

SEQ ID NO: 2272757 - DNA, 15 bp, Homo sapiens
attacagatttagtt

SEQ ID NO: 2272758 - DNA, 17 bp, Homo sapiens
attacagatttagttta

SEQ ID NO: 2272759 - DNA, 16 bp, Homo sapiens
attacaggtgtgagcc

SEQ ID NO: 2272760 - DNA, 20 bp, Homo sapiens
attacaggtgtgagccacag

SEQ ID NO: 2272761 - DNA, 11 bp, Homo sapiens
attacatttca

SEQ ID NO: 2272762 - DNA, 19 bp, Homo sapiens
attaccgataaatgaacat

SEQ ID NO: 2272763 - DNA, 22 bp, Homo sapiens
attactaaggcaggtgggcaga

SEQ ID NO: 2272764 - DNA, 17 bp, Homo sapiens
attactgcccagatgtt

SEQ ID NO: 2272765 - DNA, 18 bp, Homo sapiens
attactgcccagatgttt

SEQ ID NO: 2272766 - DNA, 11 bp, Homo sapiens
attacttaatg

SEQ ID NO: 2272767 - DNA, 12 bp, Homo sapiens
attacttaatgt

SEQ ID NO: 2272768 - DNA, 13 bp, Homo sapiens
attacttaatgtg

SEQ ID NO: 2272769 - DNA, 13 bp, Homo sapiens
attactttcagaa

SEQ ID NO: 2272770 - DNA, 14 bp, Homo sapiens
attagaatccaatt

SEQ ID NO: 2272771 - DNA, 15 bp, Homo sapiens
attagactgaattta

SEQ ID NO: 2272772 - DNA, 20 bp, Homo sapiens
attagcctcgtctttcagcg

SEQ ID NO: 2272773 - DNA, 19 bp, Homo sapiens
attagctatatttttatat

SEQ ID NO: 2272774 - DNA, 24 bp, Homo sapiens
attagctatatttttatataatat

SEQ ID NO: 2272775 - DNA, 18 bp, Homo sapiens
attaggaacagagtatat

SEQ ID NO: 2272776 - DNA, 22 bp, Homo sapiens
attaggaacagagtatatatgt

SEQ ID NO: 2272777 - DNA, 14 bp, Homo sapiens
attaggtgtaagac

SEQ ID NO: 2272778 - DNA, 15 bp, Homo sapiens
attagtatcctgtta

SEQ ID NO: 2272779 - DNA, 15 bp, Homo sapiens
attagtgagatttgt

SEQ ID NO: 2272780 - DNA, 18 bp, Homo sapiens
attagttggagctagaaa

SEQ ID NO: 2272781 - DNA, 19 bp, Homo sapiens
attagttggagctagaaaa

SEQ ID NO: 2272782 - DNA, 14 bp, Homo sapiens
attataaaatcttt

SEQ ID NO: 2272783 - DNA, 15 bp, Homo sapiens
attataaatgtttca

SEQ ID NO: 2272784 - DNA, 16 bp, Homo sapiens
attataaatgtttcat

SEQ ID NO: 2272785 - DNA, 16 bp, Homo sapiens
attataatgcatctaa

SEQ ID NO: 2272786 - DNA, 14 bp, Homo sapiens
attatagtctgtac

SEQ ID NO: 2272787 - DNA, 17 bp, Homo sapiens
attatatatataatata

SEQ ID NO: 2272788 - DNA, 15 bp, Homo sapiens
attatattatgaata

SEQ ID NO: 2272789 - DNA, 20 bp, Homo sapiens
attatattatgaataaaatt

SEQ ID NO: 2272790 - DNA, 13 bp, Homo sapiens
attatctgggttt

SEQ ID NO: 2272791 - DNA, 22 bp, Homo sapiens
attatgaaaatgtaagttatgt

SEQ ID NO: 2272792 - DNA, 14 bp, Homo sapiens
attatgaagatgtt

SEQ ID NO: 2272793 - DNA, 22 bp, Homo sapiens
attatgaagatgtttttagagg

SEQ ID NO: 2272794 - DNA, 18 bp, Homo sapiens
attatggtgatactccaa

SEQ ID NO: 2272795 - DNA, 20 bp, Homo sapiens
attattacactgtaagaaat

SEQ ID NO: 2272796 - DNA, 18 bp, Homo sapiens
attattcatcaaactctt

SEQ ID NO: 2272797 - DNA, 18 bp, Homo sapiens
attattctagtcaactgc

SEQ ID NO: 2272798 - DNA, 13 bp, Homo sapiens
attattgaatgtt

SEQ ID NO: 2272799 - DNA, 20 bp, Homo sapiens
attattgaatgttatatcat

SEQ ID NO: 2272800 - DNA, 21 bp, Homo sapiens
attattgccaaataagacagt

SEQ ID NO: 2272801 - DNA, 19 bp, Homo sapiens
attattgctatatttgcta

SEQ ID NO: 2272802 - DNA, 15 bp, Homo sapiens
attattgctgttgct

SEQ ID NO: 2272803 - DNA, 16 bp, Homo sapiens
attattttcccacaat

SEQ ID NO: 2272804 - DNA, 16 bp, Homo sapiens
attattttgtcataaa

SEQ ID NO: 2272805 - DNA, 22 bp, Homo sapiens
attattttgtcataaaatgcta

SEQ ID NO: 2272806 - DNA, 17 bp, Homo sapiens
attcaaaatagttctat

SEQ ID NO: 2272807 - DNA, 19 bp, Homo sapiens
attcaaaatagttctattt

SEQ ID NO: 2272808 - DNA, 23 bp, Homo sapiens
attcaaaatagttctatttctat

SEQ ID NO: 2272809 - DNA, 18 bp, Homo sapiens
attcaacacttattttct

SEQ ID NO: 2272810 - DNA, 12 bp, Homo sapiens
attcaatgtgaa

SEQ ID NO: 2272811 - DNA, 23 bp, Homo sapiens
attcaattaagttattaacattt

SEQ ID NO: 2272812 - DNA, 13 bp, Homo sapiens
attcacactgtgc

SEQ ID NO: 2272813 - DNA, 18 bp, Homo sapiens
attcacactgtgcgtttt

SEQ ID NO: 2272814 - DNA, 14 bp, Homo sapiens
attcagagatgtac

SEQ ID NO: 2272815 - DNA, 17 bp, Homo sapiens
attcagagatgtaccat

SEQ ID NO: 2272816 - DNA, 16 bp, Homo sapiens
attcagcaattaaaga

SEQ ID NO: 2272817 - DNA, 12 bp, Homo sapiens
attcagtcttgc

SEQ ID NO: 2272818 - DNA, 17 bp, Homo sapiens
attcagtcttgccttac

SEQ ID NO: 2272819 - DNA, 15 bp, Homo sapiens
attcataaaaataac

SEQ ID NO: 2272820 - DNA, 19 bp, Homo sapiens
attcataatgacttaagca

SEQ ID NO: 2272821 - DNA, 13 bp, Homo sapiens
attcatactaaat

SEQ ID NO: 2272822 - DNA, 13 bp, Homo sapiens
attcatactcaaa

SEQ ID NO: 2272823 - DNA, 15 bp, Homo sapiens
attcatactcaaaga

SEQ ID NO: 2272824 - DNA, 15 bp, Homo sapiens
attcatactttccaa

SEQ ID NO: 2272825 - DNA, 17 bp, Homo sapiens
attcatagcatcctgat

SEQ ID NO: 2272826 - DNA, 19 bp, Homo sapiens
attcatagcatcctgatta

SEQ ID NO: 2272827 - DNA, 21 bp, Homo sapiens
attcatagcatcctgattatt

SEQ ID NO: 2272828 - DNA, 18 bp, Homo sapiens
attcatggaccactgttt

SEQ ID NO: 2272829 - DNA, 22 bp, Homo sapiens
attcatggaccactgtttcttg

SEQ ID NO: 2272830 - DNA, 21 bp, Homo sapiens
attcatgtacaatgatgtaaa

SEQ ID NO: 2272831 - DNA, 12 bp, Homo sapiens
attcatgtgtac

SEQ ID NO: 2272832 - DNA, 13 bp, Homo sapiens
attcatgtgtaca

SEQ ID NO: 2272833 - DNA, 16 bp, Homo sapiens
attcattctttataaa

SEQ ID NO: 2272834 - DNA, 16 bp, Homo sapiens
attcatttaagaacaa

SEQ ID NO: 2272835 - DNA, 22 bp, Homo sapiens
attcatttaagaacaagagacc

SEQ ID NO: 2272836 - DNA, 15 bp, Homo sapiens
attccaagggcccag

SEQ ID NO: 2272837 - DNA, 15 bp, Homo sapiens
attccaggagtggga

SEQ ID NO: 2272838 - DNA, 19 bp, Homo sapiens
attccccccatctccattg

SEQ ID NO: 2272839 - DNA, 15 bp, Homo sapiens
attccccggagctgg

SEQ ID NO: 2272840 - DNA, 14 bp, Homo sapiens
attcctgaatgtaa

SEQ ID NO: 2272841 - DNA, 20 bp, Homo sapiens
attctagtcaactgctgttt

SEQ ID NO: 2272842 - DNA, 21 bp, Homo sapiens
attctagtcaactgctgtttt

SEQ ID NO: 2272843 - DNA, 17 bp, Homo sapiens
attctagtctctgattt

SEQ ID NO: 2272844 - DNA, 16 bp, Homo sapiens
attctagtctgtttca

SEQ ID NO: 2272845 - DNA, 18 bp, Homo sapiens
attctagtctgtttcatt

SEQ ID NO: 2272846 - DNA, 15 bp, Homo sapiens
attctataagagaca

SEQ ID NO: 2272847 - DNA, 20 bp, Homo sapiens
attctataagagacaaagtt

SEQ ID NO: 2272848 - DNA, 15 bp, Homo sapiens
attctatatttcata

SEQ ID NO: 2272849 - DNA, 21 bp, Homo sapiens
attctatgcctgtatttccaa

SEQ ID NO: 2272850 - DNA, 18 bp, Homo sapiens
attctcattatgaagatg

SEQ ID NO: 2272851 - DNA, 21 bp, Homo sapiens
attctcctttttacccctcta

SEQ ID NO: 2272852 - DNA, 21 bp, Homo sapiens
attctgcagctgcttttgcat

SEQ ID NO: 2272853 - DNA, 17 bp, Homo sapiens
attctgtggattctata

SEQ ID NO: 2272854 - DNA, 18 bp, Homo sapiens
attctgtggattctatat

SEQ ID NO: 2272855 - DNA, 16 bp, Homo sapiens
attcttttatataact

SEQ ID NO: 2272856 - DNA, 20 bp, Homo sapiens
attcttttcagcttgtttct

SEQ ID NO: 2272857 - DNA, 21 bp, Homo sapiens
attcttttcagcttgtttcta

SEQ ID NO: 2272858 - DNA, 15 bp, Homo sapiens
attcttttttcaatg

SEQ ID NO: 2272859 - DNA, 19 bp, Homo sapiens
attcttttttcaatgtact

SEQ ID NO: 2272860 - DNA, 18 bp, Homo sapiens
attgaaaagaagaaagtc

SEQ ID NO: 2272861 - DNA, 20 bp, Homo sapiens
attgaaatctttttgctttg

SEQ ID NO: 2272862 - DNA, 19 bp, Homo sapiens
attgaaatttttaaatcat

SEQ ID NO: 2272863 - DNA, 23 bp, Homo sapiens
attgaaatttttaaatcatttca

SEQ ID NO: 2272864 - DNA, 16 bp, Homo sapiens
attgaaccgtcaatgt

SEQ ID NO: 2272865 - DNA, 16 bp, Homo sapiens
attgaatgttatatca

SEQ ID NO: 2272866 - DNA, 21 bp, Homo sapiens
attgacgacctacatctgaaa

SEQ ID NO: 2272867 - DNA, 22 bp, Homo sapiens
attgagatcagcattcaaaata

SEQ ID NO: 2272868 - DNA, 23 bp, Homo sapiens
attgagatcagcattcaaaatag

SEQ ID NO: 2272869 - DNA, 22 bp, Homo sapiens
attgagggaaaacataatatct

SEQ ID NO: 2272870 - DNA, 17 bp, Homo sapiens
attgagtaatattacat

SEQ ID NO: 2272871 - DNA, 20 bp, Homo sapiens
attgagtaatattacatttc

SEQ ID NO: 2272872 - DNA, 21 bp, Homo sapiens
attgataagaaccttttgagt

SEQ ID NO: 2272873 - DNA, 14 bp, Homo sapiens
attgattaaaagca

SEQ ID NO: 2272874 - DNA, 19 bp, Homo sapiens
attgcataagtggacccag

SEQ ID NO: 2272875 - DNA, 17 bp, Homo sapiens
attgccaaataagacag

SEQ ID NO: 2272876 - DNA, 20 bp, Homo sapiens
attgcccacacctgcctctg

SEQ ID NO: 2272877 - DNA, 21 bp, Homo sapiens
attgcctctgtcttaaagaat

SEQ ID NO: 2272878 - DNA, 19 bp, Homo sapiens
attgctgatggtgcaatga

SEQ ID NO: 2272879 - DNA, 15 bp, Homo sapiens
attgtaaggaatgat

SEQ ID NO: 2272880 - DNA, 15 bp, Homo sapiens
attgtacatatggaa

SEQ ID NO: 2272881 - DNA, 17 bp, Homo sapiens
attgtacattttttact

SEQ ID NO: 2272882 - DNA, 16 bp, Homo sapiens
attgtagagcacattt

SEQ ID NO: 2272883 - DNA, 12 bp, Homo sapiens
attgtctgctgc

SEQ ID NO: 2272884 - DNA, 15 bp, Homo sapiens
attgtctgctgcctc

SEQ ID NO: 2272885 - DNA, 19 bp, Homo sapiens
attgtctgctgcctccaag

SEQ ID NO: 2272886 - DNA, 21 bp, Homo sapiens
attgtgaccacaggctggtgt

SEQ ID NO: 2272887 - DNA, 16 bp, Homo sapiens
attgtgccaaagatag

SEQ ID NO: 2272888 - DNA, 21 bp, Homo sapiens
attgtgccaaagatagcagaa

SEQ ID NO: 2272889 - DNA, 15 bp, Homo sapiens
attgtgtaactgttc

SEQ ID NO: 2272890 - DNA, 14 bp, Homo sapiens
attgtgttcttaaa

SEQ ID NO: 2272891 - DNA, 14 bp, Homo sapiens
attgttacaatttt

SEQ ID NO: 2272892 - DNA, 19 bp, Homo sapiens
attgttacaggtgtactat

SEQ ID NO: 2272893 - DNA, 23 bp, Homo sapiens
attgttatacctttttgaacatg

SEQ ID NO: 2272894 - DNA, 21 bp, Homo sapiens
attgttatgcacttttcccca

SEQ ID NO: 2272895 - DNA, 12 bp, Homo sapiens
attgttatttca

SEQ ID NO: 2272896 - DNA, 13 bp, Homo sapiens
attgttcttaaaa

SEQ ID NO: 2272897 - DNA, 14 bp, Homo sapiens
attgttgaatgtat

SEQ ID NO: 2272898 - DNA, 17 bp, Homo sapiens
atttaaaaatctttcag

SEQ ID NO: 2272899 - DNA, 12 bp, Homo sapiens
atttaaaatagt

SEQ ID NO: 2272900 - DNA, 21 bp, Homo sapiens
atttaaaatagttttctaaat

SEQ ID NO: 2272901 - DNA, 13 bp, Homo sapiens
atttaaatttagt

SEQ ID NO: 2272902 - DNA, 18 bp, Homo sapiens
atttaaatttagtgctca

SEQ ID NO: 2272903 - DNA, 12 bp, Homo sapiens
atttaactgcat

SEQ ID NO: 2272904 - DNA, 15 bp, Homo sapiens
atttaagcattttac

SEQ ID NO: 2272905 - DNA, 22 bp, Homo sapiens
atttaattgtgtaactgttctt

SEQ ID NO: 2272906 - DNA, 19 bp, Homo sapiens
atttaatttctaatttcaa

SEQ ID NO: 2272907 - DNA, 21 bp, Homo sapiens
atttacaagcatcatggatca

SEQ ID NO: 2272908 - DNA, 19 bp, Homo sapiens
atttagaacctgcatttaa

SEQ ID NO: 2272909 - DNA, 22 bp, Homo sapiens
atttagaacctgcatttaagaa

SEQ ID NO: 2272910 - DNA, 21 bp, Homo sapiens
atttagccagaatgtttcctg

SEQ ID NO: 2272911 - DNA, 15 bp, Homo sapiens
atttagtgctcagaa

SEQ ID NO: 2272912 - DNA, 17 bp, Homo sapiens
atttagttaacacacat

SEQ ID NO: 2272913 - DNA, 12 bp, Homo sapiens
atttatactgta

SEQ ID NO: 2272914 - DNA, 16 bp, Homo sapiens
atttatatatgaagta

SEQ ID NO: 2272915 - DNA, 13 bp, Homo sapiens
atttatattagag

SEQ ID NO: 2272916 - DNA, 18 bp, Homo sapiens
atttatgcagaaggtatt

SEQ ID NO: 2272917 - DNA, 19 bp, Homo sapiens
atttatgcagaaggtattt

SEQ ID NO: 2272918 - DNA, 22 bp, Homo sapiens
atttatgcagaaggtatttttg

SEQ ID NO: 2272919 - DNA, 23 bp, Homo sapiens
atttatgcagaaggtatttttga

SEQ ID NO: 2272920 - DNA, 14 bp, Homo sapiens
atttatgttctcaa

SEQ ID NO: 2272921 - DNA, 20 bp, Homo sapiens
atttattaaggttacagatt

SEQ ID NO: 2272922 - DNA, 14 bp, Homo sapiens
atttattattttca

SEQ ID NO: 2272923 - DNA, 20 bp, Homo sapiens
caggcgtagggccagggctc

SEQ ID NO: 2272924 - DNA, 22 bp, Homo sapiens
caggcgtagggccagggctctg

SEQ ID NO: 2272925 - DNA, 14 bp, Homo sapiens
caggctccccaaga

SEQ ID NO: 2272926 - DNA, 21 bp, Homo sapiens
caggctgagccgatctggtct

SEQ ID NO: 2272927 - DNA, 15 bp, Homo sapiens
caggctttttccata

SEQ ID NO: 2272928 - DNA, 13 bp, Homo sapiens
cagggagaccctg

SEQ ID NO: 2272929 - DNA, 16 bp, Homo sapiens
cagggagaccctggga

SEQ ID NO: 2272930 - DNA, 18 bp, Homo sapiens
cagggagaccctgggaga

SEQ ID NO: 2272931 - DNA, 22 bp, Homo sapiens
cagggagccctggggtttccac

SEQ ID NO: 2272932 - DNA, 15 bp, Homo sapiens
cagggcccgagcgcg

SEQ ID NO: 2272933 - DNA, 24 bp, Homo sapiens
cagggccctggggtctctgagcag

SEQ ID NO: 2272934 - DNA, 17 bp, Homo sapiens
cagggccctgtggctcc

SEQ ID NO: 2272935 - DNA, 21 bp, Homo sapiens
cagggccctgtggctccagga

SEQ ID NO: 2272936 - DNA, 22 bp, Homo sapiens
cagggccctgtggctccaggag

SEQ ID NO: 2272937 - DNA, 15 bp, Homo sapiens
cagggccgcagggcg

SEQ ID NO: 2272938 - DNA, 19 bp, Homo sapiens
cagggccgcagggcgctcc

SEQ ID NO: 2272939 - DNA, 19 bp, Homo sapiens
cagggcgctccggcagagg

SEQ ID NO: 2272940 - DNA, 21 bp, Homo sapiens
cagggctctggcaggtggcca

SEQ ID NO: 2272941 - DNA, 16 bp, Homo sapiens
caggggacctcctggg

SEQ ID NO: 2272942 - DNA, 12 bp, Homo sapiens
caggggcacact

SEQ ID NO: 2272943 - DNA, 21 bp, Homo sapiens
caggggctgactctccaggga

SEQ ID NO: 2272944 - DNA, 14 bp, Homo sapiens
caggggctggaggg

SEQ ID NO: 2272945 - DNA, 16 bp, Homo sapiens
cagggggatttggtag

SEQ ID NO: 2272946 - DNA, 23 bp, Homo sapiens
cagggggttctgggacccactcc

SEQ ID NO: 2272947 - DNA, 20 bp, Homo sapiens
caggggtcgcgatgatgggc

SEQ ID NO: 2272948 - DNA, 14 bp, Homo sapiens
cagggtctcactgt

SEQ ID NO: 2272949 - DNA, 16 bp, Homo sapiens
cagggtctcactgtgt

SEQ ID NO: 2272950 - DNA, 21 bp, Homo sapiens
cagggtctcactgtgttgccc

SEQ ID NO: 2272951 - DNA, 19 bp, Homo sapiens
cagggtctcgtcaggaggt

SEQ ID NO: 2272952 - DNA, 19 bp, Homo sapiens
cagggtgcaggcgcgcacc

SEQ ID NO: 2272953 - DNA, 17 bp, Homo sapiens
caggtaagtctggtttt

SEQ ID NO: 2272954 - DNA, 16 bp, Homo sapiens
caggtggccagggctc

SEQ ID NO: 2272955 - DNA, 19 bp, Homo sapiens
caggttccttttgaagctc

SEQ ID NO: 2272956 - DNA, 16 bp, Homo sapiens
cagtaaaacaggctgc

SEQ ID NO: 2272957 - DNA, 18 bp, Homo sapiens
cagtacacccaattttaa

SEQ ID NO: 2272958 - DNA, 22 bp, Homo sapiens
cagtacatgacccggatgaact

SEQ ID NO: 2272959 - DNA, 16 bp, Homo sapiens
cagtagcagctgtgtt

SEQ ID NO: 2272960 - DNA, 13 bp, Homo sapiens
cagtagctgtggg

SEQ ID NO: 2272961 - DNA, 19 bp, Homo sapiens
cagtagctgtggggagctg

SEQ ID NO: 2272962 - DNA, 20 bp, Homo sapiens
cagtagctgtggggagctgg

SEQ ID NO: 2272963 - DNA, 22 bp, Homo sapiens
cagtagctgtggggagctggtg

SEQ ID NO: 2272964 - DNA, 17 bp, Homo sapiens
cagtagtgttgggtgga

SEQ ID NO: 2272965 - DNA, 19 bp, Homo sapiens
cagtagtgttgggtggagg

SEQ ID NO: 2272966 - DNA, 19 bp, Homo sapiens
cagtatcagagggtggaga

SEQ ID NO: 2272967 - DNA, 12 bp, Homo sapiens
cagtatcttgaa

SEQ ID NO: 2272968 - DNA, 20 bp, Homo sapiens
cagtattatagatataaata

SEQ ID NO: 2272969 - DNA, 11 bp, Homo sapiens
cagtattctgt

SEQ ID NO: 2272970 - DNA, 14 bp, Homo sapiens
cagtattctgtagc

SEQ ID NO: 2272971 - DNA, 17 bp, Homo sapiens
cagtattctgtagccaa

SEQ ID NO: 2272972 - DNA, 15 bp, Homo sapiens
cagtcataaagaggt

SEQ ID NO: 2272973 - DNA, 20 bp, Homo sapiens
cagtcatttcctacccttta

SEQ ID NO: 2272974 - DNA, 14 bp, Homo sapiens
cagtccaataaatt

SEQ ID NO: 2272975 - DNA, 17 bp, Homo sapiens
cagtcggagcctcactc

SEQ ID NO: 2272976 - DNA, 16 bp, Homo sapiens
cagtctaaacagagtc

SEQ ID NO: 2272977 - DNA, 19 bp, Homo sapiens
cagtctggagcaaagcaga

SEQ ID NO: 2272978 - DNA, 15 bp, Homo sapiens
cagtctgtccacgtg

SEQ ID NO: 2272979 - DNA, 19 bp, Homo sapiens
cagtctgtccacgtggaga

SEQ ID NO: 2272980 - DNA, 15 bp, Homo sapiens
cagtgaagatgtgta

SEQ ID NO: 2272981 - DNA, 16 bp, Homo sapiens
cagtgaagatgtgtaa

SEQ ID NO: 2272982 - DNA, 18 bp, Homo sapiens
cagtgaagatgtgtaaat

SEQ ID NO: 2272983 - DNA, 24 bp, Homo sapiens
cagtgatcagttgctctctgttca

SEQ ID NO: 2272984 - DNA, 14 bp, Homo sapiens
cagtgattagcctc

SEQ ID NO: 2272985 - DNA, 14 bp, Homo sapiens
cagtgcacccccta

SEQ ID NO: 2272986 - DNA, 22 bp, Homo sapiens
cagtgcagcaaccagagcactg

SEQ ID NO: 2272987 - DNA, 16 bp, Homo sapiens
cagtgcatgctgtccc

SEQ ID NO: 2272988 - DNA, 15 bp, Homo sapiens
cagtgccaaaaacaa

SEQ ID NO: 2272989 - DNA, 11 bp, Homo sapiens
cagtgccttat

SEQ ID NO: 2272990 - DNA, 21 bp, Homo sapiens
cagtgccttatggaacactct

SEQ ID NO: 2272991 - DNA, 21 bp, Homo sapiens
cagtgctaggataaaccaatc

SEQ ID NO: 2272992 - DNA, 16 bp, Homo sapiens
cagtgctttgcccttg

SEQ ID NO: 2272993 - DNA, 19 bp, Homo sapiens
cagtggaaaccctgagagt

SEQ ID NO: 2272994 - DNA, 22 bp, Homo sapiens
cagtggacccgcccgcggccct

SEQ ID NO: 2272995 - DNA, 12 bp, Homo sapiens
cagtggcagaga

SEQ ID NO: 2272996 - DNA, 13 bp, Homo sapiens
cagtggcagagaa

SEQ ID NO: 2272997 - DNA, 14 bp, Homo sapiens
cagtggcagagaat

SEQ ID NO: 2272998 - DNA, 20 bp, Homo sapiens
cagtggcttggagcagaggt

SEQ ID NO: 2272999 - DNA, 15 bp, Homo sapiens
cagtggggcccatgg

SEQ ID NO: 2273000 - DNA, 21 bp, Homo sapiens
cagtggggcccatggccccag

SEQ ID NO: 2273001 - DNA, 22 bp, Homo sapiens
cagtgtggactgggaagcatta

SEQ ID NO: 2273002 - DNA, 21 bp, Homo sapiens
cagtgttcagcatagagctat

SEQ ID NO: 2273003 - DNA, 15 bp, Homo sapiens
cagtgtttggacagg

SEQ ID NO: 2273004 - DNA, 16 bp, Homo sapiens
cagtgttttcttgtgt

SEQ ID NO: 2273005 - DNA, 13 bp, Homo sapiens
cagttaattcttg

SEQ ID NO: 2273006 - DNA, 19 bp, Homo sapiens
cagttagcccggccaagga

SEQ ID NO: 2273007 - DNA, 13 bp, Homo sapiens
cagttctcatctt

SEQ ID NO: 2273008 - DNA, 19 bp, Homo sapiens
cagttctcccttcaactgt

SEQ ID NO: 2273009 - DNA, 13 bp, Homo sapiens
cagttcttggcct

SEQ ID NO: 2273010 - DNA, 11 bp, Homo sapiens
cagttgattaa

SEQ ID NO: 2273011 - DNA, 18 bp, Homo sapiens
cagttgcaatgatcagac

SEQ ID NO: 2273012 - DNA, 22 bp, Homo sapiens
cagttgctcattgtagagcaca

SEQ ID NO: 2273013 - DNA, 16 bp, Homo sapiens
cagttggactgtggcc

SEQ ID NO: 2273014 - DNA, 17 bp, Homo sapiens
cagttggtgattttaga

SEQ ID NO: 2273015 - DNA, 13 bp, Homo sapiens
cagttgtggcctc

SEQ ID NO: 2273016 - DNA, 20 bp, Homo sapiens
cagtttgatcacactatttt

SEQ ID NO: 2273017 - DNA, 22 bp, Homo sapiens
cagtttgtaaatgttatttctg

SEQ ID NO: 2273018 - DNA, 16 bp, Homo sapiens
cagttttcacagaggc

SEQ ID NO: 2273019 - DNA, 18 bp, Homo sapiens
cataaaaaataacaactg

SEQ ID NO: 2273020 - DNA, 13 bp, Homo sapiens
cataaaaataacc

SEQ ID NO: 2273021 - DNA, 19 bp, Homo sapiens
cataaaaattgtttctata

SEQ ID NO: 2273022 - DNA, 10 bp, Homo sapiens
cataaaagaa

SEQ ID NO: 2273023 - DNA, 18 bp, Homo sapiens
cataaaagaatgtacaga

SEQ ID NO: 2273024 - DNA, 9 bp, Homo sapiens
cataaaata

SEQ ID NO: 2273025 - DNA, 17 bp, Homo sapiens
cataaaataaataatct

SEQ ID NO: 2273026 - DNA, 12 bp, Homo sapiens
cataaaatatac

SEQ ID NO: 2273027 - DNA, 20 bp, Homo sapiens
cataaaatatacaaacatgt

SEQ ID NO: 2273028 - DNA, 22 bp, Homo sapiens
cataaagttagaatctattttc

SEQ ID NO: 2273029 - DNA, 15 bp, Homo sapiens
cataaatctgtctga

SEQ ID NO: 2273030 - DNA, 18 bp, Homo sapiens
cataaatctgttagcatt

SEQ ID NO: 2273031 - DNA, 22 bp, Homo sapiens
cataaccaacattttaaaaata

SEQ ID NO: 2273032 - DNA, 17 bp, Homo sapiens
cataagattatatacaa

SEQ ID NO: 2273033 - DNA, 22 bp, Homo sapiens
cataagattatatacaaagctg

SEQ ID NO: 2273034 - DNA, 23 bp, Homo sapiens
cataagattatatacaaagctgt

SEQ ID NO: 2273035 - DNA, 21 bp, Homo sapiens
cataagctggtatcagtggtt

SEQ ID NO: 2273036 - DNA, 21 bp, Homo sapiens
cataatatcttgaagaatatt

SEQ ID NO: 2273037 - DNA, 13 bp, Homo sapiens
cataattaaattt

SEQ ID NO: 2273038 - DNA, 12 bp, Homo sapiens
cataattcattt

SEQ ID NO: 2273039 - DNA, 16 bp, Homo sapiens
cataattcatttaaga

SEQ ID NO: 2273040 - DNA, 17 bp, Homo sapiens
cataattcatttaagaa

SEQ ID NO: 2273041 - DNA, 20 bp, Homo sapiens
cataattcatttaagaacaa

SEQ ID NO: 2273042 - DNA, 22 bp, Homo sapiens
cataatttccatgatacaaaga

SEQ ID NO: 2273043 - DNA, 13 bp, Homo sapiens
catacattcctaa

SEQ ID NO: 2273044 - DNA, 15 bp, Homo sapiens
catacctctctctat

SEQ ID NO: 2273045 - DNA, 13 bp, Homo sapiens
catacctgtctca

SEQ ID NO: 2273046 - DNA, 19 bp, Homo sapiens
catacgcctcttgttcatg

SEQ ID NO: 2273047 - DNA, 22 bp, Homo sapiens
catactctgtgtaatctctgat

SEQ ID NO: 2273048 - DNA, 15 bp, Homo sapiens
catactggactcttc

SEQ ID NO: 2273049 - DNA, 20 bp, Homo sapiens
catacttcctggattttctt

SEQ ID NO: 2273050 - DNA, 23 bp, Homo sapiens
catagaactgtcccacaaaatat

SEQ ID NO: 2273051 - DNA, 19 bp, Homo sapiens
catagccattcatttacaa

SEQ ID NO: 2273052 - DNA, 21 bp, Homo sapiens
catagctctcatgtatttaaa

SEQ ID NO: 2273053 - DNA, 14 bp, Homo sapiens
cataggagggaagg

SEQ ID NO: 2273054 - DNA, 16 bp, Homo sapiens
catagggtttggaaga

SEQ ID NO: 2273055 - DNA, 23 bp, Homo sapiens
catatagtttgttttctttttct

SEQ ID NO: 2273056 - DNA, 20 bp, Homo sapiens
catatcctggtgtctagttt

SEQ ID NO: 2273057 - DNA, 14 bp, Homo sapiens
catatgattgaaaa

SEQ ID NO: 2273058 - DNA, 15 bp, Homo sapiens
catatgattgaaaag

SEQ ID NO: 2273059 - DNA, 19 bp, Homo sapiens
cccctcctccttgctgatt

SEQ ID NO: 2273060 - DNA, 11 bp, Homo sapiens
cccctcctctc

SEQ ID NO: 2273061 - DNA, 17 bp, Homo sapiens
cccctgcagctcctctg

SEQ ID NO: 2273062 - DNA, 18 bp, Homo sapiens
cccctgcccctgctactg

SEQ ID NO: 2273063 - DNA, 12 bp, Homo sapiens
cccctgcctgtg

SEQ ID NO: 2273064 - DNA, 14 bp, Homo sapiens
cccctgggggaggc

SEQ ID NO: 2273065 - DNA, 19 bp, Homo sapiens
cccctgggggaggcttcca

SEQ ID NO: 2273066 - DNA, 21 bp, Homo sapiens
cccctgggggaggcttccagc

SEQ ID NO: 2273067 - DNA, 22 bp, Homo sapiens
cccctgggggaggcttccagct

SEQ ID NO: 2273068 - DNA, 13 bp, Homo sapiens
cccctggtgcccc

SEQ ID NO: 2273069 - DNA, 16 bp, Homo sapiens
ccccttgaccccacac

SEQ ID NO: 2273070 - DNA, 22 bp, Homo sapiens
ccccttgggatgggcacaggct

SEQ ID NO: 2273071 - DNA, 17 bp, Homo sapiens
cccgaaaggtcacctca

SEQ ID NO: 2273072 - DNA, 20 bp, Homo sapiens
cccgaaaggtcacctcactc

SEQ ID NO: 2273073 - DNA, 21 bp, Homo sapiens
cccgaaaggtcacctcactca

SEQ ID NO: 2273074 - DNA, 18 bp, Homo sapiens
cccgagacggcactgaga

SEQ ID NO: 2273075 - DNA, 20 bp, Homo sapiens
cccgagcgcgtgccttcccc

SEQ ID NO: 2273076 - DNA, 12 bp, Homo sapiens
cccgcacccctc

SEQ ID NO: 2273077 - DNA, 19 bp, Homo sapiens
cccgcacccctcctccttg

SEQ ID NO: 2273078 - DNA, 13 bp, Homo sapiens
cccgcagcaccag

SEQ ID NO: 2273079 - DNA, 15 bp, Homo sapiens
cccgcagcaccagcc

SEQ ID NO: 2273080 - DNA, 17 bp, Homo sapiens
cccgcagcaccagcctg

SEQ ID NO: 2273081 - DNA, 13 bp, Homo sapiens
cccgcccaccccg

SEQ ID NO: 2273082 - DNA, 17 bp, Homo sapiens
cccgcccaccccgctgc

SEQ ID NO: 2273083 - DNA, 15 bp, Homo sapiens
cccgccccagagact

SEQ ID NO: 2273084 - DNA, 18 bp, Homo sapiens
cccgccccagagactgcc

SEQ ID NO: 2273085 - DNA, 15 bp, Homo sapiens
cccgcccccgccctc

SEQ ID NO: 2273086 - DNA, 14 bp, Homo sapiens
cccgccctcctctg

SEQ ID NO: 2273087 - DNA, 21 bp, Homo sapiens
cccgccctcctctgccccctc

SEQ ID NO: 2273088 - DNA, 11 bp, Homo sapiens
cccgccctcgc

SEQ ID NO: 2273089 - DNA, 21 bp, Homo sapiens
cccgccggccgcgcaccgcca

SEQ ID NO: 2273090 - DNA, 23 bp, Homo sapiens
cccgccggccgcgcaccgccatg

SEQ ID NO: 2273091 - DNA, 22 bp, Homo sapiens
cccgccggttggccggctggcc

SEQ ID NO: 2273092 - DNA, 23 bp, Homo sapiens
cccgcctcaaggaagagccagcc

SEQ ID NO: 2273093 - DNA, 17 bp, Homo sapiens
cccgcgcgtgcccccag

SEQ ID NO: 2273094 - DNA, 15 bp, Homo sapiens
cccgctctgccatca

SEQ ID NO: 2273095 - DNA, 15 bp, Homo sapiens
cccggacgctggctc

SEQ ID NO: 2273096 - DNA, 20 bp, Homo sapiens
cccggagctgggaaggtccc

SEQ ID NO: 2273097 - DNA, 19 bp, Homo sapiens
cccggaggcgcccacctgc

SEQ ID NO: 2273098 - DNA, 22 bp, Homo sapiens
cccggaggcgcccacctgccca

SEQ ID NO: 2273099 - DNA, 17 bp, Homo sapiens
cccggcagccccccagt

SEQ ID NO: 2273100 - DNA, 13 bp, Homo sapiens
cccggcagtgcac

SEQ ID NO: 2273101 - DNA, 17 bp, Homo sapiens
cccggccaaggacactg

SEQ ID NO: 2273102 - DNA, 14 bp, Homo sapiens
cccggcccaacctc

SEQ ID NO: 2273103 - DNA, 21 bp, Homo sapiens
cccgggagatccgccctgggc

SEQ ID NO: 2273104 - DNA, 14 bp, Homo sapiens
cccggtgtgaggag

SEQ ID NO: 2273105 - DNA, 17 bp, Homo sapiens
cccgtccgtccgcccgc

SEQ ID NO: 2273106 - DNA, 19 bp, Homo sapiens
cccgtctctactaaaaata

SEQ ID NO: 2273107 - DNA, 22 bp, Homo sapiens
cccgtgcggcccgtgcgcagcc

SEQ ID NO: 2273108 - DNA, 21 bp, Homo sapiens
ccctccaggccgacaggaggc

SEQ ID NO: 2273109 - DNA, 22 bp, Homo sapiens
ccctccatgattccaagggccc

SEQ ID NO: 2273110 - DNA, 14 bp, Homo sapiens
ccctcccacatccc

SEQ ID NO: 2273111 - DNA, 16 bp, Homo sapiens
ccctcccacatccccc

SEQ ID NO: 2273112 - DNA, 23 bp, Homo sapiens
ccctcccccacggccgtccctga

SEQ ID NO: 2273113 - DNA, 17 bp, Homo sapiens
ccctccccggcatcatt

SEQ ID NO: 2273114 - DNA, 18 bp, Homo sapiens
ccctccctgtaatgcact

SEQ ID NO: 2273115 - DNA, 16 bp, Homo sapiens
ccctccgcgggggaca

SEQ ID NO: 2273116 - DNA, 19 bp, Homo sapiens
ccctccgtccccagggtgc

SEQ ID NO: 2273117 - DNA, 16 bp, Homo sapiens
ccctcctcccccacgc

SEQ ID NO: 2273118 - DNA, 14 bp, Homo sapiens
ccctcctctgcccc

SEQ ID NO: 2273119 - DNA, 16 bp, Homo sapiens
ccctcctctgccccct

SEQ ID NO: 2273120 - DNA, 16 bp, Homo sapiens
ccctcggggcaggaag

SEQ ID NO: 2273121 - DNA, 14 bp, Homo sapiens
ccctcggtcagcac

SEQ ID NO: 2273122 - DNA, 15 bp, Homo sapiens
ccctcggtcagcacc

SEQ ID NO: 2273123 - DNA, 20 bp, Homo sapiens
ccctcggtcagcaccgtggt

SEQ ID NO: 2273124 - DNA, 21 bp, Homo sapiens
ccctcggtcagcaccgtggtg

SEQ ID NO: 2273125 - DNA, 16 bp, Homo sapiens
ccctctccttgtcaca

SEQ ID NO: 2273126 - DNA, 15 bp, Homo sapiens
ccctctctcaccagc

SEQ ID NO: 2273127 - DNA, 17 bp, Homo sapiens
ccctctctcaccagcct

SEQ ID NO: 2273128 - DNA, 19 bp, Homo sapiens
ccctctctcaccagccttg

SEQ ID NO: 2273129 - DNA, 15 bp, Homo sapiens
ccctctggggccctt

SEQ ID NO: 2273130 - DNA, 16 bp, Homo sapiens
ccctcttcttctcaag

SEQ ID NO: 2273131 - DNA, 22 bp, Homo sapiens
ccctcttcttgcggcaccgccc

SEQ ID NO: 2273132 - DNA, 13 bp, Homo sapiens
ccctgacttccca

SEQ ID NO: 2273133 - DNA, 14 bp, Homo sapiens
ccctgacttcccag

SEQ ID NO: 2273134 - DNA, 17 bp, Homo sapiens
ccctgacttcccagctg

SEQ ID NO: 2273135 - DNA, 21 bp, Homo sapiens
ccctgacttcccagctggcag

SEQ ID NO: 2273136 - DNA, 12 bp, Homo sapiens
ccctgccaccct

SEQ ID NO: 2273137 - DNA, 13 bp, Homo sapiens
ccctgccaccctc

SEQ ID NO: 2273138 - DNA, 22 bp, Homo sapiens
ccctgccaccctctgctgcaca

SEQ ID NO: 2273139 - DNA, 15 bp, Homo sapiens
ccctgccctccccca

SEQ ID NO: 2273140 - DNA, 16 bp, Homo sapiens
ccctgccctcccccac

SEQ ID NO: 2273141 - DNA, 12 bp, Homo sapiens
ccctgccctgca

SEQ ID NO: 2273142 - DNA, 15 bp, Homo sapiens
ccctgccctgcacct

SEQ ID NO: 2273143 - DNA, 14 bp, Homo sapiens
ccctgccctggcca

SEQ ID NO: 2273144 - DNA, 17 bp, Homo sapiens
ccctgccctggccactg

SEQ ID NO: 2273145 - DNA, 21 bp, Homo sapiens
ccctgcctggcggcaggggtc

SEQ ID NO: 2273146 - DNA, 22 bp, Homo sapiens
ccctgctactgccaacctcgct

SEQ ID NO: 2273147 - DNA, 12 bp, Homo sapiens
ccctgctggacc

SEQ ID NO: 2273148 - DNA, 14 bp, Homo sapiens
ccctggactctgtg

SEQ ID NO: 2273149 - DNA, 12 bp, Homo sapiens
ccctggagtggc

SEQ ID NO: 2273150 - DNA, 17 bp, Homo sapiens
ccctggagtggcatggt

SEQ ID NO: 2273151 - DNA, 21 bp, Homo sapiens
ccctggagtggcatggtcctg

SEQ ID NO: 2273152 - DNA, 16 bp, Homo sapiens
ccctggccactggccc

SEQ ID NO: 2273153 - DNA, 17 bp, Homo sapiens
ccctggccactggccct

SEQ ID NO: 2273154 - DNA, 14 bp, Homo sapiens
ccctgggagagtga

SEQ ID NO: 2273155 - DNA, 16 bp, Homo sapiens
ccctgggagagtgagg

SEQ ID NO: 2273156 - DNA, 23 bp, Homo sapiens
ccctgggagagtgaggtcatccc

SEQ ID NO: 2273157 - DNA, 17 bp, Homo sapiens
ccctgggggaggcttcc

SEQ ID NO: 2273158 - DNA, 21 bp, Homo sapiens
ccctgggggaggcttccagct

SEQ ID NO: 2273159 - DNA, 22 bp, Homo sapiens
ccctgggggaggcttccagctc

SEQ ID NO: 2273160 - DNA, 23 bp, Homo sapiens
ccctgggggaggcttccagctca

SEQ ID NO: 2273161 - DNA, 15 bp, Homo sapiens
ccctggggtctctga

SEQ ID NO: 2273162 - DNA, 18 bp, Homo sapiens
ccctggggtctctgagca

SEQ ID NO: 2273163 - DNA, 23 bp, Homo sapiens
ccctggggtctctgagcagtggg

SEQ ID NO: 2273164 - DNA, 21 bp, Homo sapiens
ccctggggtttccacacaggc

SEQ ID NO: 2273165 - DNA, 23 bp, Homo sapiens
ccctggttgagaaacattgcttt

SEQ ID NO: 2273166 - DNA, 14 bp, Homo sapiens
ccctgtaatgcact

SEQ ID NO: 2273167 - DNA, 18 bp, Homo sapiens
ccctgtaatgcactcctg

SEQ ID NO: 2273168 - DNA, 19 bp, Homo sapiens
ccctgtggctccaggagca

SEQ ID NO: 2273169 - DNA, 15 bp, Homo sapiens
ccctgtgtccacagt

SEQ ID NO: 2273170 - DNA, 22 bp, Homo sapiens
ccctgtgtccacagtgattagc

SEQ ID NO: 2273171 - DNA, 20 bp, Homo sapiens
cccttctatactttctcaca

SEQ ID NO: 2273172 - DNA, 14 bp, Homo sapiens
cccttgaccccaca

SEQ ID NO: 2273173 - DNA, 15 bp, Homo sapiens
cccttgaccccacac

SEQ ID NO: 2273174 - DNA, 12 bp, Homo sapiens
cccttgggatgg

SEQ ID NO: 2273175 - DNA, 19 bp, Homo sapiens
cccttgggatgggcacagg

SEQ ID NO: 2273176 - DNA, 10 bp, Homo sapiens
ccctttcaca

SEQ ID NO: 2273177 - DNA, 13 bp, Homo sapiens
cccttttctgttt

SEQ ID NO: 2273178 - DNA, 16 bp, Homo sapiens
ccgaaaacgtggctgc

SEQ ID NO: 2273179 - DNA, 23 bp, Homo sapiens
ccgaaaggtcacctcactcagca

SEQ ID NO: 2273180 - DNA, 15 bp, Homo sapiens
ccgacaggaggccat

SEQ ID NO: 2273181 - DNA, 15 bp, Homo sapiens
ccgacggagccactg

SEQ ID NO: 2273182 - DNA, 14 bp, Homo sapiens
ccgactccccctcc

SEQ ID NO: 2273183 - DNA, 17 bp, Homo sapiens
ccgagccgagctctcct

SEQ ID NO: 2273184 - DNA, 17 bp, Homo sapiens
ccgagcgcgtgccttcc

SEQ ID NO: 2273185 - DNA, 18 bp, Homo sapiens
ccgagcgcgtgccttccc

SEQ ID NO: 2273186 - DNA, 16 bp, Homo sapiens
ccgaggcctggctctg

SEQ ID NO: 2273187 - DNA, 18 bp, Homo sapiens
ccgaggcctggctctgga

SEQ ID NO: 2273188 - DNA, 22 bp, Homo sapiens
ccgaggcctggctctggagccc

SEQ ID NO: 2273189 - DNA, 15 bp, Homo sapiens
ccgaggttttgaggc

SEQ ID NO: 2273190 - DNA, 18 bp, Homo sapiens
ccgagtgtggagctgctt

SEQ ID NO: 2273191 - DNA, 12 bp, Homo sapiens
ccgatttttcca

SEQ ID NO: 2273192 - DNA, 15 bp, Homo sapiens
ccgcaccgggctggc

SEQ ID NO: 2273193 - DNA, 16 bp, Homo sapiens
ccgcagatcctgtccc

SEQ ID NO: 2273194 - DNA, 12 bp, Homo sapiens
ccgcagcaccag

SEQ ID NO: 2273195 - DNA, 17 bp, Homo sapiens
ccgcagggcgctccggc

SEQ ID NO: 2273196 - DNA, 18 bp, Homo sapiens
ccgcccacccacaccccg

SEQ ID NO: 2273197 - DNA, 12 bp, Homo sapiens
ccgcccaccccg

SEQ ID NO: 2273198 - DNA, 18 bp, Homo sapiens
ccgcccaccccgctgcct

SEQ ID NO: 2273199 - DNA, 18 bp, Homo sapiens
ccgcccgcccaccccgct

SEQ ID NO: 2273200 - DNA, 11 bp, Homo sapiens
ccgccctcctc

SEQ ID NO: 2273201 - DNA, 13 bp, Homo sapiens
ccgccctcctctg

SEQ ID NO: 2273202 - DNA, 15 bp, Homo sapiens
ccgccgcctcgggcc

SEQ ID NO: 2273203 - DNA, 23 bp, Homo sapiens
ccgccggccgcgcaccgccatgc

SEQ ID NO: 2273204 - DNA, 16 bp, Homo sapiens
ccgccggttggccggc

SEQ ID NO: 2273205 - DNA, 15 bp, Homo sapiens
ccgcctcaaggaaga

SEQ ID NO: 2273206 - DNA, 22 bp, Homo sapiens
ccgcctcaaggaagagccagcc

SEQ ID NO: 2273207 - DNA, 13 bp, Homo sapiens
ccgcctcctccct

SEQ ID NO: 2273208 - DNA, 13 bp, Homo sapiens
ccgcctgcgcccc

SEQ ID NO: 2273209 - DNA, 19 bp, Homo sapiens
ccgcgcaccgccatgcatg

SEQ ID NO: 2273210 - DNA, 19 bp, Homo sapiens
ccgcgggcgagaagggcgc

SEQ ID NO: 2273211 - DNA, 18 bp, Homo sapiens
ccgcgggggacaggaaca

SEQ ID NO: 2273212 - DNA, 15 bp, Homo sapiens
ccgctgcccccaccc

SEQ ID NO: 2273213 - DNA, 23 bp, Homo sapiens
ccgctgcctggcgggcagcccct

SEQ ID NO: 2273214 - DNA, 20 bp, Homo sapiens
ccgcttcctccggctggacc

SEQ ID NO: 2273215 - DNA, 12 bp, Homo sapiens
ccggagcaccac

SEQ ID NO: 2273216 - DNA, 17 bp, Homo sapiens
ccggagcggctgaggac

SEQ ID NO: 2273217 - DNA, 20 bp, Homo sapiens
ccggagcggctgaggacggg

SEQ ID NO: 2273218 - DNA, 11 bp, Homo sapiens
ccggagctggg

SEQ ID NO: 2273219 - DNA, 19 bp, Homo sapiens
ccggaggcgcccacctgcc

SEQ ID NO: 2273220 - DNA, 20 bp, Homo sapiens
ccggatgaactcaatgcatg

SEQ ID NO: 2273221 - DNA, 14 bp, Homo sapiens
ccggcagaggcagg

SEQ ID NO: 2273222 - DNA, 15 bp, Homo sapiens
ccggcagaggcaggg

SEQ ID NO: 2273223 - DNA, 23 bp, Homo sapiens
ccggcagaggcagggccctgggg

SEQ ID NO: 2273224 - DNA, 12 bp, Homo sapiens
ccggcccaacct

SEQ ID NO: 2273225 - DNA, 20 bp, Homo sapiens
ccggcccaacctcgccctct

SEQ ID NO: 2273226 - DNA, 16 bp, Homo sapiens
ccggcccacgcagagc

SEQ ID NO: 2273227 - DNA, 17 bp, Homo sapiens
ccggccccgcgcgtgcc

SEQ ID NO: 2273228 - DNA, 18 bp, Homo sapiens
ccggccccgcgcgtgccc

SEQ ID NO: 2273229 - DNA, 20 bp, Homo sapiens
ccggccccgcgcgtgccccc

SEQ ID NO: 2273230 - DNA, 15 bp, Homo sapiens
ccggcccgccacctt

SEQ ID NO: 2273231 - DNA, 17 bp, Homo sapiens
ccggcctgcagcccaga

SEQ ID NO: 2273232 - DNA, 19 bp, Homo sapiens
ccggcctggggccgggctg

SEQ ID NO: 2273233 - DNA, 13 bp, Homo sapiens
ccggcgccccgga

SEQ ID NO: 2273234 - DNA, 19 bp, Homo sapiens
ccggctggacctggggtcc

SEQ ID NO: 2273235 - DNA, 15 bp, Homo sapiens
ccggctggccggtcc

SEQ ID NO: 2273236 - DNA, 16 bp, Homo sapiens
ccggctggccggtcca

SEQ ID NO: 2273237 - DNA, 21 bp, Homo sapiens
ccggctggccggtccaccccg

SEQ ID NO: 2273238 - DNA, 21 bp, Homo sapiens
ccgggacgtggcacctcctcg

SEQ ID NO: 2273239 - DNA, 24 bp, Homo sapiens
ccgggagatccgccctgggctctg

SEQ ID NO: 2273240 - DNA, 22 bp, Homo sapiens
ccgggagcctgcgtggcctggg

SEQ ID NO: 2273241 - DNA, 12 bp, Homo sapiens
ccgggctggcct

SEQ ID NO: 2273242 - DNA, 13 bp, Homo sapiens
ccgggctggcctg

SEQ ID NO: 2273243 - DNA, 12 bp, Homo sapiens
ccggggccatgg

SEQ ID NO: 2273244 - DNA, 16 bp, Homo sapiens
ccggggctggccctgc

SEQ ID NO: 2273245 - DNA, 22 bp, Homo sapiens
ccggggctggccctgccctccc

SEQ ID NO: 2273246 - DNA, 13 bp, Homo sapiens
ccggtgtgaggag

SEQ ID NO: 2273247 - DNA, 22 bp, Homo sapiens
ccgtaatggggactctccaggc

SEQ ID NO: 2273248 - DNA, 17 bp, Homo sapiens
ccgtccgcccgcccacc

SEQ ID NO: 2273249 - DNA, 18 bp, Homo sapiens
ccgtccgcccgcccaccc

SEQ ID NO: 2273250 - DNA, 17 bp, Homo sapiens
ccgtcctggcagggcag

SEQ ID NO: 2273251 - DNA, 13 bp, Homo sapiens
ccgtgcacggggc

SEQ ID NO: 2273252 - DNA, 14 bp, Homo sapiens
ccgtggtgtgaggc

SEQ ID NO: 2273253 - DNA, 16 bp, Homo sapiens
ccgtggtgtgaggccc

SEQ ID NO: 2273254 - DNA, 18 bp, Homo sapiens
ccgtgtgctccagtgttt

SEQ ID NO: 2273255 - DNA, 19 bp, Homo sapiens
cctaaacacacttttcttt

SEQ ID NO: 2273256 - DNA, 22 bp, Homo sapiens
cctaaataggtttttcttgcta

SEQ ID NO: 2273257 - DNA, 17 bp, Homo sapiens
cctaaatccattttcta

SEQ ID NO: 2273258 - DNA, 12 bp, Homo sapiens
cctaaatttcac

SEQ ID NO: 2273259 - DNA, 23 bp, Homo sapiens
cctagaaaggggcccattcagcc

SEQ ID NO: 2273260 - DNA, 15 bp, Homo sapiens
cctagaaagttctgt

SEQ ID NO: 2273261 - DNA, 21 bp, Homo sapiens
cctagacaataacccgaggga

SEQ ID NO: 2273262 - DNA, 21 bp, Homo sapiens
cctagagagtgtgatgttcac

SEQ ID NO: 2273263 - DNA, 21 bp, Homo sapiens
cctagcctagaacaagccaga

SEQ ID NO: 2273264 - DNA, 19 bp, Homo sapiens
cctagtggcttcagcccct

SEQ ID NO: 2273265 - DNA, 15 bp, Homo sapiens
cctatctatgtcctg

SEQ ID NO: 2273266 - DNA, 18 bp, Homo sapiens
cctcactcagcaccactc

SEQ ID NO: 2273267 - DNA, 16 bp, Homo sapiens
cctcagagtcctgccg

SEQ ID NO: 2273268 - DNA, 17 bp, Homo sapiens
cctcagagtcctgccga

SEQ ID NO: 2273269 - DNA, 17 bp, Homo sapiens
cctcagtctacactcac

SEQ ID NO: 2273270 - DNA, 23 bp, Homo sapiens
cctcatccttctaaagtgctggg

SEQ ID NO: 2273271 - DNA, 13 bp, Homo sapiens
cctcatgggagtc

SEQ ID NO: 2273272 - DNA, 18 bp, Homo sapiens
cctccacctgggagatgc

SEQ ID NO: 2273273 - DNA, 20 bp, Homo sapiens
cctccagattattttctata

SEQ ID NO: 2273274 - DNA, 19 bp, Homo sapiens
cctccatgattccaagggc

SEQ ID NO: 2273275 - DNA, 23 bp, Homo sapiens
cctccatgattccaagggcccag

SEQ ID NO: 2273276 - DNA, 15 bp, Homo sapiens
cctcccacatccccc

SEQ ID NO: 2273277 - DNA, 12 bp, Homo sapiens
cctcccccacgc

SEQ ID NO: 2273278 - DNA, 13 bp, Homo sapiens
cctcccccaggct

SEQ ID NO: 2273279 - DNA, 14 bp, Homo sapiens
cctcccccaggctg

SEQ ID NO: 2273280 - DNA, 18 bp, Homo sapiens
cctcccccaggctgcgcc

SEQ ID NO: 2273281 - DNA, 23 bp, Homo sapiens
cctcccccaggctgcgcctgccc

SEQ ID NO: 2273282 - DNA, 13 bp, Homo sapiens
cctccccgcctcc

SEQ ID NO: 2273283 - DNA, 16 bp, Homo sapiens
cctcccgccccagcct

SEQ ID NO: 2273284 - DNA, 19 bp, Homo sapiens
cctcccgccccagcctcct

SEQ ID NO: 2273285 - DNA, 23 bp, Homo sapiens
cctcccgccccagcctcctgagt

SEQ ID NO: 2273286 - DNA, 13 bp, Homo sapiens
cctcccgcttcct

SEQ ID NO: 2273287 - DNA, 16 bp, Homo sapiens
cctcccgcttcctccg

SEQ ID NO: 2273288 - DNA, 15 bp, Homo sapiens
cctccctggcttgag

SEQ ID NO: 2273289 - DNA, 13 bp, Homo sapiens
cctcctccagact

SEQ ID NO: 2273290 - DNA, 19 bp, Homo sapiens
cctcctccagctcctgccc

SEQ ID NO: 2273291 - DNA, 14 bp, Homo sapiens
cctcctcccccacg

SEQ ID NO: 2273292 - DNA, 17 bp, Homo sapiens
cctcctccttgctgatt

SEQ ID NO: 2273293 - DNA, 21 bp, Homo sapiens
cctcctcggctggctgtccac

SEQ ID NO: 2273294 - DNA, 14 bp, Homo sapiens
cctcctcgggcgcc

SEQ ID NO: 2273295 - DNA, 13 bp, Homo sapiens
cctcctctgcccc

SEQ ID NO: 2273296 - DNA, 15 bp, Homo sapiens
cctcctctgccccct

SEQ ID NO: 2273297 - DNA, 20 bp, Homo sapiens
cctcctctgccccctccccc

SEQ ID NO: 2273298 - DNA, 15 bp, Homo sapiens
cctcctgacacccca

SEQ ID NO: 2273299 - DNA, 17 bp, Homo sapiens
cctcctgacaccccact

SEQ ID NO: 2273300 - DNA, 20 bp, Homo sapiens
cctcctgagtagctgggact

SEQ ID NO: 2273301 - DNA, 13 bp, Homo sapiens
cctccttgctgat

SEQ ID NO: 2273302 - DNA, 17 bp, Homo sapiens
cctcgccctctctcacc

SEQ ID NO: 2273303 - DNA, 20 bp, Homo sapiens
cctcgccctctctcaccagc

SEQ ID NO: 2273304 - DNA, 15 bp, Homo sapiens
cctcggccagagctc

SEQ ID NO: 2273305 - DNA, 16 bp, Homo sapiens
cctcggccagagctcc

SEQ ID NO: 2273306 - DNA, 20 bp, Homo sapiens
cctcggccagagctcccagg

SEQ ID NO: 2273307 - DNA, 18 bp, Homo sapiens
cctcgggccgcctcctcc

SEQ ID NO: 2273308 - DNA, 20 bp, Homo sapiens
cctcgggccgcctcctccag

SEQ ID NO: 2273309 - DNA, 21 bp, Homo sapiens
cctcgggccgcctcctccaga

SEQ ID NO: 2273310 - DNA, 14 bp, Homo sapiens
cctcgggcgcctgc

SEQ ID NO: 2273311 - DNA, 16 bp, Homo sapiens
cctcgggcgcctgcgc

SEQ ID NO: 2273312 - DNA, 23 bp, Homo sapiens
cctcgggcgcctgcgctcctctg

SEQ ID NO: 2273313 - DNA, 17 bp, Homo sapiens
cctcgtccggcctgcag

SEQ ID NO: 2273314 - DNA, 14 bp, Homo sapiens
cctctaggcctcag

SEQ ID NO: 2273315 - DNA, 14 bp, Homo sapiens
cctctcagatccct

SEQ ID NO: 2273316 - DNA, 19 bp, Homo sapiens
cctctcagatccctcggtc

SEQ ID NO: 2273317 - DNA, 16 bp, Homo sapiens
cctctcctcgtccggc

SEQ ID NO: 2273318 - DNA, 20 bp, Homo sapiens
cctctcctcgtccggcctgc

SEQ ID NO: 2273319 - DNA, 23 bp, Homo sapiens
cctctcctgcgtgtgcccactga

SEQ ID NO: 2273320 - DNA, 13 bp, Homo sapiens
cctctctcaccag

SEQ ID NO: 2273321 - DNA, 17 bp, Homo sapiens
cctctctcaccagcctt

SEQ ID NO: 2273322 - DNA, 20 bp, Homo sapiens
cctctcttttttggggggag

SEQ ID NO: 2273323 - DNA, 11 bp, Homo sapiens
cctctgaaaat

SEQ ID NO: 2273324 - DNA, 23 bp, Homo sapiens
cctctgaaaatatttttttctag

SEQ ID NO: 2273325 - DNA, 20 bp, Homo sapiens
cctctgaactgctgctggtc

SEQ ID NO: 2273326 - DNA, 16 bp, Homo sapiens
cctctgcagcctgagc

SEQ ID NO: 2273327 - DNA, 18 bp, Homo sapiens
cctctgcagcctgagctc

SEQ ID NO: 2273328 - DNA, 21 bp, Homo sapiens
cctctgcttgtcattctgcta

SEQ ID NO: 2273329 - DNA, 11 bp, Homo sapiens
cctctggacag

SEQ ID NO: 2273330 - DNA, 22 bp, Homo sapiens
cctctgtccccgagccgagctc

SEQ ID NO: 2273331 - DNA, 15 bp, Homo sapiens
cctctgtgctctcct

SEQ ID NO: 2273332 - DNA, 18 bp, Homo sapiens
cctctgttacccgcagat

SEQ ID NO: 2273333 - DNA, 17 bp, Homo sapiens
cctcttaagacactagt

SEQ ID NO: 2273334 - DNA, 10 bp, Homo sapiens
cctcttcctc

SEQ ID NO: 2273335 - DNA, 11 bp, Homo sapiens
cctcttcctca

SEQ ID NO: 2273336 - DNA, 15 bp, Homo sapiens
cctcttcttctcaag

SEQ ID NO: 2273337 - DNA, 16 bp, Homo sapiens
cctctttccccactga

SEQ ID NO: 2273338 - DNA, 14 bp, Homo sapiens
cctgaaataaaact

SEQ ID NO: 2273339 - DNA, 22 bp, Homo sapiens
cctgaagtctttgtacagacaa

SEQ ID NO: 2273340 - DNA, 22 bp, Homo sapiens
cctgacacctgccgctgcttga

SEQ ID NO: 2273341 - DNA, 18 bp, Homo sapiens
cctgacctacttcctcct

SEQ ID NO: 2273342 - DNA, 20 bp, Homo sapiens
cctgacttcccagctggcag

SEQ ID NO: 2273343 - DNA, 16 bp, Homo sapiens
cctgagccacagtggg

SEQ ID NO: 2273344 - DNA, 12 bp, Homo sapiens
cctgagccagat

SEQ ID NO: 2273345 - DNA, 15 bp, Homo sapiens
cctgagccagatttc

SEQ ID NO: 2273346 - DNA, 13 bp, Homo sapiens
cctgagctccacc

SEQ ID NO: 2273347 - DNA, 14 bp, Homo sapiens
cctgagctccaccc

SEQ ID NO: 2273348 - DNA, 17 bp, Homo sapiens
cctgagctccaccctcc

SEQ ID NO: 2273349 - DNA, 20 bp, Homo sapiens
cctgaggcaggagggcatgt

SEQ ID NO: 2273350 - DNA, 20 bp, Homo sapiens
cctgagggaagagtagctgt

SEQ ID NO: 2273351 - DNA, 12 bp, Homo sapiens
cctgagggaagc

SEQ ID NO: 2273352 - DNA, 20 bp, Homo sapiens
cctgagggaagcccacccgc

SEQ ID NO: 2273353 - DNA, 20 bp, Homo sapiens
cctgagggtttccaccttgg

SEQ ID NO: 2273354 - DNA, 13 bp, Homo sapiens
cctgcacattgtt

SEQ ID NO: 2273355 - DNA, 15 bp, Homo sapiens
cctgcagcccagaac

SEQ ID NO: 2273356 - DNA, 16 bp, Homo sapiens
cctgcagcccagaacg

SEQ ID NO: 2273357 - DNA, 14 bp, Homo sapiens
cctgcagctcctct

SEQ ID NO: 2273358 - DNA, 15 bp, Homo sapiens
cctgcattcacagct

SEQ ID NO: 2273359 - DNA, 15 bp, Homo sapiens
cctgcatttaagaac

SEQ ID NO: 2273360 - DNA, 22 bp, Homo sapiens
cctgcatttaagaacagaacag

SEQ ID NO: 2273361 - DNA, 12 bp, Homo sapiens
cctgccaccctc

SEQ ID NO: 2273362 - DNA, 14 bp, Homo sapiens
cctgccaccctctg

SEQ ID NO: 2273363 - DNA, 18 bp, Homo sapiens
cctgcccagttagcccgg

SEQ ID NO: 2273364 - DNA, 20 bp, Homo sapiens
cctgcccagttagcccggcc

SEQ ID NO: 2273365 - DNA, 17 bp, Homo sapiens
cctgcccccgctctgcc

SEQ ID NO: 2273366 - DNA, 15 bp, Homo sapiens
cctgcccgcccgccg

SEQ ID NO: 2273367 - DNA, 13 bp, Homo sapiens
cctgccctccccc

SEQ ID NO: 2273368 - DNA, 13 bp, Homo sapiens
cctgccctggcca

SEQ ID NO: 2273369 - DNA, 18 bp, Homo sapiens
cctgccctggccactggc

SEQ ID NO: 2273370 - DNA, 21 bp, Homo sapiens
cctgccgacggagccactggg

SEQ ID NO: 2273371 - DNA, 23 bp, Homo sapiens
cctgcctctgaactgctgctggt

SEQ ID NO: 2273372 - DNA, 16 bp, Homo sapiens
cctgcgcaaagggcgg

SEQ ID NO: 2273373 - DNA, 16 bp, Homo sapiens
cctgcgccccccagtg

SEQ ID NO: 2273374 - DNA, 16 bp, Homo sapiens
cctgcgtggcctgggg

SEQ ID NO: 2273375 - DNA, 13 bp, Homo sapiens
cctgctactgcca

SEQ ID NO: 2273376 - DNA, 21 bp, Homo sapiens
cctgctactgccaacctcgct

SEQ ID NO: 2273377 - DNA, 17 bp, Homo sapiens
cctgctgctcgggaagg

SEQ ID NO: 2273378 - DNA, 16 bp, Homo sapiens
cctgcttctgctgcct

SEQ ID NO: 2273379 - DNA, 20 bp, Homo sapiens
cctgcttggcttatgaaaac

SEQ ID NO: 2273380 - DNA, 21 bp, Homo sapiens
cctgcttggcttatgaaaaca

SEQ ID NO: 2273381 - DNA, 13 bp, Homo sapiens
cctggaaaactgg

SEQ ID NO: 2273382 - DNA, 21 bp, Homo sapiens
cctggaagagccgagcacctg

SEQ ID NO: 2273383 - DNA, 13 bp, Homo sapiens
cctggacaggctt

SEQ ID NO: 2273384 - DNA, 12 bp, Homo sapiens
cctggactctgt

SEQ ID NO: 2273385 - DNA, 17 bp, Homo sapiens
cctggagaaggaagctg

SEQ ID NO: 2273386 - DNA, 22 bp, Homo sapiens
cctggagaaggaagctgcctgg

SEQ ID NO: 2273387 - DNA, 13 bp, Homo sapiens
cctggaggctgga

SEQ ID NO: 2273388 - DNA, 18 bp, Homo sapiens
cctggaggctggaccaac

SEQ ID NO: 2273389 - DNA, 22 bp, Homo sapiens
cctggaggctggaccaactgct

SEQ ID NO: 2273390 - DNA, 23 bp, Homo sapiens
cctggaggctggaccaactgctt

SEQ ID NO: 2273391 - DNA, 17 bp, Homo sapiens
cctggaggggcccatgt

SEQ ID NO: 2273392 - DNA, 14 bp, Homo sapiens
cctggagtgaagaa

SEQ ID NO: 2273393 - DNA, 15 bp, Homo sapiens
cctggagtggcatgg

SEQ ID NO: 2273394 - DNA, 19 bp, Homo sapiens
cctggagtggcatggtcct

SEQ ID NO: 2273395 - DNA, 23 bp, Homo sapiens
cctggagtggcatggtcctgtgc

SEQ ID NO: 2273396 - DNA, 14 bp, Homo sapiens
cctggataattata

SEQ ID NO: 2273397 - DNA, 13 bp, Homo sapiens
cctggattttctt

SEQ ID NO: 2273398 - DNA, 13 bp, Homo sapiens
cctggcagggcag

SEQ ID NO: 2273399 - DNA, 14 bp, Homo sapiens
cctggcatgggaat

SEQ ID NO: 2273400 - DNA, 18 bp, Homo sapiens
cctggcatgggaatgaat

SEQ ID NO: 2273401 - DNA, 14 bp, Homo sapiens
cctggccactggcc

SEQ ID NO: 2273402 - DNA, 15 bp, Homo sapiens
cctggcccctcccac

SEQ ID NO: 2273403 - DNA, 20 bp, Homo sapiens
cctggccctgggccccgcct

SEQ ID NO: 2273404 - DNA, 22 bp, Homo sapiens
cctggccctgggccccgcctca

SEQ ID NO: 2273405 - DNA, 15 bp, Homo sapiens
cctggcgggcagccc

SEQ ID NO: 2273406 - DNA, 19 bp, Homo sapiens
cctggcgggcagcccctgc

SEQ ID NO: 2273407 - DNA, 22 bp, Homo sapiens
cctggcgggcagcccctgctgg

SEQ ID NO: 2273408 - DNA, 19 bp, Homo sapiens
cctggcttgagtgatcctc

SEQ ID NO: 2273409 - DNA, 20 bp, Homo sapiens
cctggcttgagtgatcctcc

SEQ ID NO: 2273410 - DNA, 22 bp, Homo sapiens
cctgggagagtgaggtcatccc

SEQ ID NO: 2273411 - DNA, 17 bp, Homo sapiens
cctgggagatgctggga

SEQ ID NO: 2273412 - DNA, 23 bp, Homo sapiens
cctgggagatgctgggaccctcg

SEQ ID NO: 2273413 - DNA, 14 bp, Homo sapiens
cctgggcatcccca

SEQ ID NO: 2273414 - DNA, 13 bp, Homo sapiens
cctgggccagggt

SEQ ID NO: 2273415 - DNA, 17 bp, Homo sapiens
cctgggccccgcctcaa

SEQ ID NO: 2273416 - DNA, 13 bp, Homo sapiens
cctgggcctcccg

SEQ ID NO: 2273417 - DNA, 16 bp, Homo sapiens
cctgggcctcccgtcc

SEQ ID NO: 2273418 - DNA, 22 bp, Homo sapiens
cctgggcctcccgtccgtccgc

SEQ ID NO: 2273419 - DNA, 11 bp, Homo sapiens
cctgggctctg

SEQ ID NO: 2273420 - DNA, 15 bp, Homo sapiens
cctgggggaggcttc

SEQ ID NO: 2273421 - DNA, 14 bp, Homo sapiens
cctggggtcccccc

SEQ ID NO: 2273422 - DNA, 16 bp, Homo sapiens
cctggggtcccccctc

SEQ ID NO: 2273423 - DNA, 20 bp, Homo sapiens
cctggggtcccccctccctg

SEQ ID NO: 2273424 - DNA, 17 bp, Homo sapiens
cctggggtctctgagca

SEQ ID NO: 2273425 - DNA, 21 bp, Homo sapiens
cctggggtttccacacaggcc

SEQ ID NO: 2273426 - DNA, 24 bp, Homo sapiens
cctgggtgtgacctgacacctgcc

SEQ ID NO: 2273427 - DNA, 19 bp, Homo sapiens
cctggtcagttttcacaga

SEQ ID NO: 2273428 - DNA, 21 bp, Homo sapiens
cctggtcagttttcacagagg

SEQ ID NO: 2273429 - DNA, 16 bp, Homo sapiens
cctggtgtctagtttg

SEQ ID NO: 2273430 - DNA, 21 bp, Homo sapiens
cctggttttcattattttccc

SEQ ID NO: 2273431 - DNA, 13 bp, Homo sapiens
cctgtatttccaa

SEQ ID NO: 2273432 - DNA, 13 bp, Homo sapiens
cctgtccactctg

SEQ ID NO: 2273433 - DNA, 18 bp, Homo sapiens
cctgtccactctgctcag

SEQ ID NO: 2273434 - DNA, 13 bp, Homo sapiens
cctgtcccatggg

SEQ ID NO: 2273435 - DNA, 19 bp, Homo sapiens
cctgtcccatgggctctgg

SEQ ID NO: 2273436 - DNA, 18 bp, Homo sapiens
cctgtccccagttaatgt

SEQ ID NO: 2273437 - DNA, 15 bp, Homo sapiens
cctgtctcagctgtt

SEQ ID NO: 2273438 - DNA, 22 bp, Homo sapiens
cctgtgaccggggtcctgaggc

SEQ ID NO: 2273439 - DNA, 14 bp, Homo sapiens
cctgtgctttcatg

SEQ ID NO: 2273440 - DNA, 14 bp, Homo sapiens
cctgtggctccagg

SEQ ID NO: 2273441 - DNA, 17 bp, Homo sapiens
cctgtggctccaggagc

SEQ ID NO: 2273442 - DNA, 15 bp, Homo sapiens
cctgtgtccacagtg

SEQ ID NO: 2273443 - DNA, 13 bp, Homo sapiens
cctgttccctgag

SEQ ID NO: 2273444 - DNA, 17 bp, Homo sapiens
cctgttccctgaggacc

SEQ ID NO: 2273445 - DNA, 19 bp, Homo sapiens
cctgttccctgaggacctg

SEQ ID NO: 2273446 - DNA, 13 bp, Homo sapiens
cctgttctgtgtc

SEQ ID NO: 2273447 - DNA, 20 bp, Homo sapiens
cctgttctgtgtctgctgta

SEQ ID NO: 2273448 - DNA, 14 bp, Homo sapiens
cctgtttccagggt

SEQ ID NO: 2273449 - DNA, 15 bp, Homo sapiens
cctgtttggtgagga

SEQ ID NO: 2273450 - DNA, 17 bp, Homo sapiens
cctgtttggtgaggacc

SEQ ID NO: 2273451 - DNA, 19 bp, Homo sapiens
cctgtttggtgaggacctg

SEQ ID NO: 2273452 - DNA, 17 bp, Homo sapiens
ccttaaaataatgattt

SEQ ID NO: 2273453 - DNA, 12 bp, Homo sapiens
ccttaactgtcc

SEQ ID NO: 2273454 - DNA, 16 bp, Homo sapiens
ccttagaatgagggaa

SEQ ID NO: 2273455 - DNA, 18 bp, Homo sapiens
ccttagcactatggacat

SEQ ID NO: 2273456 - DNA, 16 bp, Homo sapiens
ccttatggaacactct

SEQ ID NO: 2273457 - DNA, 18 bp, Homo sapiens
ccttatggaacactctga

SEQ ID NO: 2273458 - DNA, 19 bp, Homo sapiens
ccttatggaacactctgag

SEQ ID NO: 2273459 - DNA, 17 bp, Homo sapiens
ccttcactctccagggt

SEQ ID NO: 2273460 - DNA, 11 bp, Homo sapiens
ccttcagtgcc

SEQ ID NO: 2273461 - DNA, 14 bp, Homo sapiens
ccttcagtgcctta

SEQ ID NO: 2273462 - DNA, 20 bp, Homo sapiens
ccttcagtgccttatggaac

SEQ ID NO: 2273463 - DNA, 20 bp, Homo sapiens
ccttccaggcgtagggccag

SEQ ID NO: 2273464 - DNA, 21 bp, Homo sapiens
ccttcccgcagcaccagcctg

SEQ ID NO: 2273465 - DNA, 15 bp, Homo sapiens
ccttcctcatccttc

SEQ ID NO: 2273466 - DNA, 22 bp, Homo sapiens
ccttcctgttctgtgtctgctg

SEQ ID NO: 2273467 - DNA, 18 bp, Homo sapiens
ccttctatgttcataaaa

SEQ ID NO: 2273468 - DNA, 16 bp, Homo sapiens
ccttctgaagatctca

SEQ ID NO: 2273469 - DNA, 17 bp, Homo sapiens
ccttcttattatatata

SEQ ID NO: 2273470 - DNA, 12 bp, Homo sapiens
ccttcttctgag

SEQ ID NO: 2273471 - DNA, 22 bp, Homo sapiens
ccttcttctgagtgaatgttaa

SEQ ID NO: 2273472 - DNA, 19 bp, Homo sapiens
ccttgaggacctccacctg

SEQ ID NO: 2273473 - DNA, 21 bp, Homo sapiens
ccttggacggggacacggcct

SEQ ID NO: 2273474 - DNA, 17 bp, Homo sapiens
ccttgggatgggcacag

SEQ ID NO: 2273475 - DNA, 21 bp, Homo sapiens
ccttgggatgggcacaggctg

SEQ ID NO: 2273476 - DNA, 17 bp, Homo sapiens
ccttgggcacgggagag

SEQ ID NO: 2273477 - DNA, 18 bp, Homo sapiens
ccttgggcacgggagagc

SEQ ID NO: 2273478 - DNA, 14 bp, Homo sapiens
ccttggggagcagg

SEQ ID NO: 2273479 - DNA, 19 bp, Homo sapiens
ccttggtgtcgggcatgac

SEQ ID NO: 2273480 - DNA, 20 bp, Homo sapiens
ccttggtgtcgggcatgaca

SEQ ID NO: 2273481 - DNA, 21 bp, Homo sapiens
ccttgtcacagaatctccatt

SEQ ID NO: 2273482 - DNA, 15 bp, Homo sapiens
cctttcaataggaaa

SEQ ID NO: 2273483 - DNA, 17 bp, Homo sapiens
cctttcaataggaaaaa

SEQ ID NO: 2273484 - DNA, 18 bp, Homo sapiens
cctttcaataggaaaaac

SEQ ID NO: 2273485 - DNA, 18 bp, Homo sapiens
cgaaaacagatgagaaga

SEQ ID NO: 2273486 - DNA, 21 bp, Homo sapiens
cgaaaacagatgagaagacta

SEQ ID NO: 2273487 - DNA, 15 bp, Homo sapiens
cgaaaacgtggctgc

SEQ ID NO: 2273488 - DNA, 16 bp, Homo sapiens
cagatttcactctcct

SEQ ID NO: 2273489 - DNA, 18 bp, Homo sapiens
cagatttcactctccttg

SEQ ID NO: 2273490 - DNA, 20 bp, Homo sapiens
cagatttcactctccttggt

SEQ ID NO: 2273491 - DNA, 14 bp, Homo sapiens
cagcaaccagagca

SEQ ID NO: 2273492 - DNA, 20 bp, Homo sapiens
cagcaattaaagacatttaa

SEQ ID NO: 2273493 - DNA, 19 bp, Homo sapiens
cagcacagataaaaagtgg

SEQ ID NO: 2273494 - DNA, 16 bp, Homo sapiens
cagcaccagcctgagc

SEQ ID NO: 2273495 - DNA, 18 bp, Homo sapiens
cagcaccagcctgagcca

SEQ ID NO: 2273496 - DNA, 15 bp, Homo sapiens
cagcacggtgcctcc

SEQ ID NO: 2273497 - DNA, 20 bp, Homo sapiens
cagcactcccagggcccgag

SEQ ID NO: 2273498 - DNA, 18 bp, Homo sapiens
cagcagaaaacctgttca

SEQ ID NO: 2273499 - DNA, 17 bp, Homo sapiens
cagcagctccaacctgg

SEQ ID NO: 2273500 - DNA, 15 bp, Homo sapiens
cagcagggaacaaaa

SEQ ID NO: 2273501 - DNA, 19 bp, Homo sapiens
cagcagggaacaaaactcc

SEQ ID NO: 2273502 - DNA, 22 bp, Homo sapiens
cagcagtaccatcccactgata

SEQ ID NO: 2273503 - DNA, 22 bp, Homo sapiens
cagcatagggtccactttggta

SEQ ID NO: 2273504 - DNA, 19 bp, Homo sapiens
cagcatagttctgcaataa

SEQ ID NO: 2273505 - DNA, 21 bp, Homo sapiens
cagcatatgtgccataaacag

SEQ ID NO: 2273506 - DNA, 15 bp, Homo sapiens
cagcatcatgtagtg

SEQ ID NO: 2273507 - DNA, 22 bp, Homo sapiens
cagcatgagattgtacattttt

SEQ ID NO: 2273508 - DNA, 11 bp, Homo sapiens
cagcatggttt

SEQ ID NO: 2273509 - DNA, 17 bp, Homo sapiens
cagcatggtttgcatga

SEQ ID NO: 2273510 - DNA, 12 bp, Homo sapiens
cagcattcaaaa

SEQ ID NO: 2273511 - DNA, 14 bp, Homo sapiens
cagcattcaaaata

SEQ ID NO: 2273512 - DNA, 22 bp, Homo sapiens
cagcattcaaaatagttctatt

SEQ ID NO: 2273513 - DNA, 13 bp, Homo sapiens
cagccaatttcaa

SEQ ID NO: 2273514 - DNA, 23 bp, Homo sapiens
cagcccagaacgggcctccccgg

SEQ ID NO: 2273515 - DNA, 19 bp, Homo sapiens
cagccccagcgagtctgga

SEQ ID NO: 2273516 - DNA, 21 bp, Homo sapiens
cagccccatcccaaacccttc

SEQ ID NO: 2273517 - DNA, 20 bp, Homo sapiens
cagccccccacgcttctgga

SEQ ID NO: 2273518 - DNA, 21 bp, Homo sapiens
cagccccccagtgtccccagg

SEQ ID NO: 2273519 - DNA, 16 bp, Homo sapiens
cagccccctggcccct

SEQ ID NO: 2273520 - DNA, 16 bp, Homo sapiens
cagcccctccccgcct

SEQ ID NO: 2273521 - DNA, 20 bp, Homo sapiens
cagcccctccccgcctcctc

SEQ ID NO: 2273522 - DNA, 22 bp, Homo sapiens
cagcccgggagatccgccctgg

SEQ ID NO: 2273523 - DNA, 23 bp, Homo sapiens
cagcccgggagatccgccctggg

SEQ ID NO: 2273524 - DNA, 20 bp, Homo sapiens
cagcccggtgtgaggagggg

SEQ ID NO: 2273525 - DNA, 18 bp, Homo sapiens
cagccctcggcgctccgg

SEQ ID NO: 2273526 - DNA, 15 bp, Homo sapiens
cagccgagcccaggg

SEQ ID NO: 2273527 - DNA, 21 bp, Homo sapiens
cagccgagcttttactccctg

SEQ ID NO: 2273528 - DNA, 15 bp, Homo sapiens
cagccgcgctctgcc

SEQ ID NO: 2273529 - DNA, 17 bp, Homo sapiens
cagccgcgctctgcccc

SEQ ID NO: 2273530 - DNA, 16 bp, Homo sapiens
cagcctcacccctgca

SEQ ID NO: 2273531 - DNA, 11 bp, Homo sapiens
cagcctccccc

SEQ ID NO: 2273532 - DNA, 17 bp, Homo sapiens
cagcctcccccaggctg

SEQ ID NO: 2273533 - DNA, 22 bp, Homo sapiens
cagcctcccccaggctgcgcct

SEQ ID NO: 2273534 - DNA, 16 bp, Homo sapiens
cagcctcctgagtagc

SEQ ID NO: 2273535 - DNA, 23 bp, Homo sapiens
cagcctcgacctccctggcttga

SEQ ID NO: 2273536 - DNA, 13 bp, Homo sapiens
cagcctcttcctc

SEQ ID NO: 2273537 - DNA, 12 bp, Homo sapiens
cagcctgagcca

SEQ ID NO: 2273538 - DNA, 14 bp, Homo sapiens
cagcctgagccaca

SEQ ID NO: 2273539 - DNA, 15 bp, Homo sapiens
cagcctgagccacag

SEQ ID NO: 2273540 - DNA, 17 bp, Homo sapiens
cagcctgagctccaccc

SEQ ID NO: 2273541 - DNA, 19 bp, Homo sapiens
cagcctgagctccaccctc

SEQ ID NO: 2273542 - DNA, 19 bp, Homo sapiens
cagcctttgcgctctgggt

SEQ ID NO: 2273543 - DNA, 12 bp, Homo sapiens
cagcgagggccc

SEQ ID NO: 2273544 - DNA, 12 bp, Homo sapiens
cagcgagtctgg

SEQ ID NO: 2273545 - DNA, 16 bp, Homo sapiens
cagcgagtctggagac

SEQ ID NO: 2273546 - DNA, 16 bp, Homo sapiens
cagcgattcctgccaa

SEQ ID NO: 2273547 - DNA, 12 bp, Homo sapiens
cagcgcctcccg

SEQ ID NO: 2273548 - DNA, 13 bp, Homo sapiens
cagcgcctcccgc

SEQ ID NO: 2273549 - DNA, 22 bp, Homo sapiens
cagcgcctcccgccgcctcggg

SEQ ID NO: 2273550 - DNA, 16 bp, Homo sapiens
cagcggagaggacccc

SEQ ID NO: 2273551 - DNA, 21 bp, Homo sapiens
cagcggccccgcacccctcct

SEQ ID NO: 2273552 - DNA, 13 bp, Homo sapiens
cagcggcccggcc

SEQ ID NO: 2273553 - DNA, 17 bp, Homo sapiens
cagcggcccggcccacg

SEQ ID NO: 2273554 - DNA, 22 bp, Homo sapiens
cagcggcccggcccacgcagag

SEQ ID NO: 2273555 - DNA, 13 bp, Homo sapiens
cagcgtctgctgt

SEQ ID NO: 2273556 - DNA, 22 bp, Homo sapiens
cagcgtgggggtggccactcct

SEQ ID NO: 2273557 - DNA, 24 bp, Homo sapiens
cagcgtgggggtggccactcctgg

SEQ ID NO: 2273558 - DNA, 20 bp, Homo sapiens
cagctaacatggaagtacta

SEQ ID NO: 2273559 - DNA, 21 bp, Homo sapiens
cagctaatctttaatataata

SEQ ID NO: 2273560 - DNA, 17 bp, Homo sapiens
cagctcagtcccacagc

SEQ ID NO: 2273561 - DNA, 16 bp, Homo sapiens
cagctcattcgctcca

SEQ ID NO: 2273562 - DNA, 14 bp, Homo sapiens
cagctccaacctgg

SEQ ID NO: 2273563 - DNA, 16 bp, Homo sapiens
cagctcctgccccgcc

SEQ ID NO: 2273564 - DNA, 12 bp, Homo sapiens
cagctctaaagc

SEQ ID NO: 2273565 - DNA, 19 bp, Homo sapiens
cagctctaaagcagagatg

SEQ ID NO: 2273566 - DNA, 16 bp, Homo sapiens
cagctctcccctgcgc

SEQ ID NO: 2273567 - DNA, 18 bp, Homo sapiens
cagctctcccctgcgcag

SEQ ID NO: 2273568 - DNA, 19 bp, Homo sapiens
cagctctcccctgcgcagg

SEQ ID NO: 2273569 - DNA, 14 bp, Homo sapiens
cagctggcagcgcc

SEQ ID NO: 2273570 - DNA, 20 bp, Homo sapiens
cagctgtgtttgagtttctg

SEQ ID NO: 2273571 - DNA, 15 bp, Homo sapiens
cagcttgtttctata

SEQ ID NO: 2273572 - DNA, 11 bp, Homo sapiens
cagctttgtcc

SEQ ID NO: 2273573 - DNA, 18 bp, Homo sapiens
caggaaaactgtttttca

SEQ ID NO: 2273574 - DNA, 15 bp, Homo sapiens
caggaacacccagcc

SEQ ID NO: 2273575 - DNA, 19 bp, Homo sapiens
caggaacacccagccccag

SEQ ID NO: 2273576 - DNA, 17 bp, Homo sapiens
caggaagagatgctcta

SEQ ID NO: 2273577 - DNA, 19 bp, Homo sapiens
caggaagaggggcgctgcc

SEQ ID NO: 2273578 - DNA, 18 bp, Homo sapiens
caggaagcctcctgctga

SEQ ID NO: 2273579 - DNA, 19 bp, Homo sapiens
caggaagcctcctgctgag

SEQ ID NO: 2273580 - DNA, 15 bp, Homo sapiens
caggaaggggacagg

SEQ ID NO: 2273581 - DNA, 12 bp, Homo sapiens
caggaagtactg

SEQ ID NO: 2273582 - DNA, 16 bp, Homo sapiens
caggaagtactggaga

SEQ ID NO: 2273583 - DNA, 18 bp, Homo sapiens
caggaagtactggagaaa

SEQ ID NO: 2273584 - DNA, 20 bp, Homo sapiens
caggaagtactggagaaaat

SEQ ID NO: 2273585 - DNA, 13 bp, Homo sapiens
caggaagtccctg

SEQ ID NO: 2273586 - DNA, 14 bp, Homo sapiens
caggaagtccctga

SEQ ID NO: 2273587 - DNA, 15 bp, Homo sapiens
caggaccccatctgc

SEQ ID NO: 2273588 - DNA, 23 bp, Homo sapiens
caggaccccatctgctgagctct

SEQ ID NO: 2273589 - DNA, 15 bp, Homo sapiens
caggacgcagggaga

SEQ ID NO: 2273590 - DNA, 17 bp, Homo sapiens
caggacggtctgtgccc

SEQ ID NO: 2273591 - DNA, 14 bp, Homo sapiens
caggactctgcctt

SEQ ID NO: 2273592 - DNA, 15 bp, Homo sapiens
caggactctgccttc

SEQ ID NO: 2273593 - DNA, 18 bp, Homo sapiens
caggagcaaggctgccct

SEQ ID NO: 2273594 - DNA, 13 bp, Homo sapiens
caggagctcacac

SEQ ID NO: 2273595 - DNA, 13 bp, Homo sapiens
caggaggagacag

SEQ ID NO: 2273596 - DNA, 21 bp, Homo sapiens
caggaggagacagtcaggaag

SEQ ID NO: 2273597 - DNA, 15 bp, Homo sapiens
caggaggtgcctgag

SEQ ID NO: 2273598 - DNA, 18 bp, Homo sapiens
caggagtgggtcgcccac

SEQ ID NO: 2273599 - DNA, 17 bp, Homo sapiens
caggagtgggtgggaca

SEQ ID NO: 2273600 - DNA, 18 bp, Homo sapiens
caggagtgggtgggacac

SEQ ID NO: 2273601 - DNA, 20 bp, Homo sapiens
caggagtgggtgggacacag

SEQ ID NO: 2273602 - DNA, 23 bp, Homo sapiens
caggatgaggaacctcaaactgg

SEQ ID NO: 2273603 - DNA, 18 bp, Homo sapiens
caggatggcgtgtcccct

SEQ ID NO: 2273604 - DNA, 19 bp, Homo sapiens
caggattctgacagagcaa

SEQ ID NO: 2273605 - DNA, 17 bp, Homo sapiens
caggattgtctgctgcc

SEQ ID NO: 2273606 - DNA, 19 bp, Homo sapiens
caggattgtctgctgcctc

SEQ ID NO: 2273607 - DNA, 20 bp, Homo sapiens
caggattgtctgctgcctcc

SEQ ID NO: 2273608 - DNA, 14 bp, Homo sapiens
caggcaaggcagct

SEQ ID NO: 2273609 - DNA, 15 bp, Homo sapiens
caggcaatagtgttg

SEQ ID NO: 2273610 - DNA, 23 bp, Homo sapiens
caggcaatagtgttgaggagggg

SEQ ID NO: 2273611 - DNA, 13 bp, Homo sapiens
caggcaccgcctg

SEQ ID NO: 2273612 - DNA, 20 bp, Homo sapiens
caggcaccgcctgcccccag

SEQ ID NO: 2273613 - DNA, 16 bp, Homo sapiens
caggcaggggcttccc

SEQ ID NO: 2273614 - DNA, 15 bp, Homo sapiens
caggcagtagcagct

SEQ ID NO: 2273615 - DNA, 19 bp, Homo sapiens
caggcatgaccctggagcc

SEQ ID NO: 2273616 - DNA, 12 bp, Homo sapiens
caggccctccgc

SEQ ID NO: 2273617 - DNA, 14 bp, Homo sapiens
caggccctgctcat

SEQ ID NO: 2273618 - DNA, 15 bp, Homo sapiens
caggcctgttccctg

SEQ ID NO: 2273619 - DNA, 16 bp, Homo sapiens
caggcgcgcaccgccc

SEQ ID NO: 2273620 - DNA, 19 bp, Homo sapiens
caggcgcgcaccgcccaac

SEQ ID NO: 2273621 - DNA, 23 bp, Homo sapiens
caggcgcgcaccgcccaaccccc

SEQ ID NO: 2273622 - DNA, 20 bp, Homo sapiens
caggcggaggggcttggagc

SEQ ID NO: 2273623 - DNA, 24 bp, Homo sapiens
caggcggggggttgtctcagccga

SEQ ID NO: 2273624 - DNA, 15 bp, Homo sapiens
caggcgtagggccag

SEQ ID NO: 2273625 - DNA, 19 bp, Homo sapiens
cacggcctctggggagacc

SEQ ID NO: 2273626 - DNA, 19 bp, Homo sapiens
cacgggagagcgccacccg

SEQ ID NO: 2273627 - DNA, 22 bp, Homo sapiens
cacgggcaacactcactgcctg

SEQ ID NO: 2273628 - DNA, 14 bp, Homo sapiens
cacgggcccgctca

SEQ ID NO: 2273629 - DNA, 14 bp, Homo sapiens
cactaaaatttaaa

SEQ ID NO: 2273630 - DNA, 22 bp, Homo sapiens
cactaaagagctaggaaagagt

SEQ ID NO: 2273631 - DNA, 14 bp, Homo sapiens
cactagtagagcaa

SEQ ID NO: 2273632 - DNA, 18 bp, Homo sapiens
cactcaagagcccttcca

SEQ ID NO: 2273633 - DNA, 22 bp, Homo sapiens
cactcaagagcccttccaggag

SEQ ID NO: 2273634 - DNA, 14 bp, Homo sapiens
cactcactgcctgc

SEQ ID NO: 2273635 - DNA, 15 bp, Homo sapiens
cactcagcaccactc

SEQ ID NO: 2273636 - DNA, 18 bp, Homo sapiens
cactcagcaccactcaag

SEQ ID NO: 2273637 - DNA, 19 bp, Homo sapiens
cactcagtgtggactggga

SEQ ID NO: 2273638 - DNA, 13 bp, Homo sapiens
cactcccagggcc

SEQ ID NO: 2273639 - DNA, 15 bp, Homo sapiens
cactcccagggcccg

SEQ ID NO: 2273640 - DNA, 20 bp, Homo sapiens
cactccccgccgtacagttc

SEQ ID NO: 2273641 - DNA, 16 bp, Homo sapiens
cactccgactccccct

SEQ ID NO: 2273642 - DNA, 21 bp, Homo sapiens
cactccgactccccctccccg

SEQ ID NO: 2273643 - DNA, 16 bp, Homo sapiens
cactcctgccccggcc

SEQ ID NO: 2273644 - DNA, 13 bp, Homo sapiens
cactcctgggccc

SEQ ID NO: 2273645 - DNA, 22 bp, Homo sapiens
cactcctgggccccagaaagcc

SEQ ID NO: 2273646 - DNA, 23 bp, Homo sapiens
cactctgagactcgcgacaatgc

SEQ ID NO: 2273647 - DNA, 16 bp, Homo sapiens
cactgaaacctctgtt

SEQ ID NO: 2273648 - DNA, 18 bp, Homo sapiens
cactgaaacctctgttct

SEQ ID NO: 2273649 - DNA, 18 bp, Homo sapiens
cactgagagagcgcagcc

SEQ ID NO: 2273650 - DNA, 22 bp, Homo sapiens
cactgatatcacgggcccgctc

SEQ ID NO: 2273651 - DNA, 19 bp, Homo sapiens
cactgatgggtcctgctgc

SEQ ID NO: 2273652 - DNA, 14 bp, Homo sapiens
cactgcctgcagct

SEQ ID NO: 2273653 - DNA, 13 bp, Homo sapiens
cactggccctgtt

SEQ ID NO: 2273654 - DNA, 20 bp, Homo sapiens
cactgggaatttatttatgt

SEQ ID NO: 2273655 - DNA, 20 bp, Homo sapiens
cactgtgcgttttagagtat

SEQ ID NO: 2273656 - DNA, 15 bp, Homo sapiens
cactgtgttgcccag

SEQ ID NO: 2273657 - DNA, 17 bp, Homo sapiens
cactgtttcttgcttgt

SEQ ID NO: 2273658 - DNA, 14 bp, Homo sapiens
cacttagaatacta

SEQ ID NO: 2273659 - DNA, 21 bp, Homo sapiens
cacttatgtagacaaaactta

SEQ ID NO: 2273660 - DNA, 19 bp, Homo sapiens
cacttcagttgtggcctca

SEQ ID NO: 2273661 - DNA, 14 bp, Homo sapiens
cacttctggggcca

SEQ ID NO: 2273662 - DNA, 15 bp, Homo sapiens
cacttctggggccag

SEQ ID NO: 2273663 - DNA, 17 bp, Homo sapiens
cacttctggggccagcc

SEQ ID NO: 2273664 - DNA, 20 bp, Homo sapiens
cacttctggggccagcccct

SEQ ID NO: 2273665 - DNA, 22 bp, Homo sapiens
cacttctggggccagcccctcc

SEQ ID NO: 2273666 - DNA, 22 bp, Homo sapiens
cacttgaacaaaatctgttgcc

SEQ ID NO: 2273667 - DNA, 20 bp, Homo sapiens
cacttgctagtgatacactg

SEQ ID NO: 2273668 - DNA, 21 bp, Homo sapiens
cactttaaatatgaaagccta

SEQ ID NO: 2273669 - DNA, 15 bp, Homo sapiens
cactttcgcctcctc

SEQ ID NO: 2273670 - DNA, 16 bp, Homo sapiens
cactttcgcctcctcc

SEQ ID NO: 2273671 - DNA, 23 bp, Homo sapiens
cactttcgcctcctccagctcct

SEQ ID NO: 2273672 - DNA, 20 bp, Homo sapiens
cactttgcttaagatgctaa

SEQ ID NO: 2273673 - DNA, 23 bp, Homo sapiens
cacttttctttttaaatgtgctt

SEQ ID NO: 2273674 - DNA, 13 bp, Homo sapiens
cacttttttataa

SEQ ID NO: 2273675 - DNA, 14 bp, Homo sapiens
cacttttttataaa

SEQ ID NO: 2273676 - DNA, 20 bp, Homo sapiens
cagaaaacctgttcaggcag

SEQ ID NO: 2273677 - DNA, 16 bp, Homo sapiens
cagaaacaactgccaa

SEQ ID NO: 2273678 - DNA, 14 bp, Homo sapiens
cagaaacttctcag

SEQ ID NO: 2273679 - DNA, 19 bp, Homo sapiens
cagaaatgccgctgtgtcc

SEQ ID NO: 2273680 - DNA, 15 bp, Homo sapiens
cagaaattttctaca

SEQ ID NO: 2273681 - DNA, 14 bp, Homo sapiens
cagaacaaaagata

SEQ ID NO: 2273682 - DNA, 20 bp, Homo sapiens
cagaacaggaggtgtgaatg

SEQ ID NO: 2273683 - DNA, 13 bp, Homo sapiens
cagaacatgagtt

SEQ ID NO: 2273684 - DNA, 13 bp, Homo sapiens
cagaaccagcact

SEQ ID NO: 2273685 - DNA, 14 bp, Homo sapiens
cagaaccagcactc

SEQ ID NO: 2273686 - DNA, 15 bp, Homo sapiens
cagaaccagcactcc

SEQ ID NO: 2273687 - DNA, 23 bp, Homo sapiens
cagaaccagcactcccagggccc

SEQ ID NO: 2273688 - DNA, 15 bp, Homo sapiens
cagaacgccctgtgt

SEQ ID NO: 2273689 - DNA, 16 bp, Homo sapiens
cagaacgggcctcccc

SEQ ID NO: 2273690 - DNA, 15 bp, Homo sapiens
cagaagcctgtttca

SEQ ID NO: 2273691 - DNA, 14 bp, Homo sapiens
cagaaggagacaga

SEQ ID NO: 2273692 - DNA, 15 bp, Homo sapiens
cagaaggcaaagttt

SEQ ID NO: 2273693 - DNA, 16 bp, Homo sapiens
cagaatgagagagaaa

SEQ ID NO: 2273694 - DNA, 17 bp, Homo sapiens
cagaatgtttcctgtgg

SEQ ID NO: 2273695 - DNA, 21 bp, Homo sapiens
cagaatgtttcctgtggaaat

SEQ ID NO: 2273696 - DNA, 21 bp, Homo sapiens
cagaattgaaccgtcaatgtg

SEQ ID NO: 2273697 - DNA, 18 bp, Homo sapiens
cagaatttgtgaatatat

SEQ ID NO: 2273698 - DNA, 20 bp, Homo sapiens
cagaatttgtgaatatattt

SEQ ID NO: 2273699 - DNA, 21 bp, Homo sapiens
cagaatttgtgaatatatttt

SEQ ID NO: 2273700 - DNA, 20 bp, Homo sapiens
cagacaacaaacctgtttct

SEQ ID NO: 2273701 - DNA, 21 bp, Homo sapiens
cagacacgcacttctggggcc

SEQ ID NO: 2273702 - DNA, 15 bp, Homo sapiens
cagacagacagacag

SEQ ID NO: 2273703 - DNA, 14 bp, Homo sapiens
cagacagacagacg

SEQ ID NO: 2273704 - DNA, 14 bp, Homo sapiens
cagacattcagaga

SEQ ID NO: 2273705 - DNA, 21 bp, Homo sapiens
cagaccccatccagccagggg

SEQ ID NO: 2273706 - DNA, 20 bp, Homo sapiens
cagacctcactgctttgtag

SEQ ID NO: 2273707 - DNA, 16 bp, Homo sapiens
cagacctgggccctgg

SEQ ID NO: 2273708 - DNA, 18 bp, Homo sapiens
cagacctgggccctggtt

SEQ ID NO: 2273709 - DNA, 19 bp, Homo sapiens
cagacctgggccctggttc

SEQ ID NO: 2273710 - DNA, 18 bp, Homo sapiens
cagacctttttctctctt

SEQ ID NO: 2273711 - DNA, 21 bp, Homo sapiens
cagacggacgggacagcggcc

SEQ ID NO: 2273712 - DNA, 20 bp, Homo sapiens
cagactagagaataattttt

SEQ ID NO: 2273713 - DNA, 20 bp, Homo sapiens
cagactcgagagggctgagc

SEQ ID NO: 2273714 - DNA, 22 bp, Homo sapiens
cagactcgagagggctgagccc

SEQ ID NO: 2273715 - DNA, 13 bp, Homo sapiens
cagacttgattta

SEQ ID NO: 2273716 - DNA, 14 bp, Homo sapiens
cagagacctgctcc

SEQ ID NO: 2273717 - DNA, 16 bp, Homo sapiens
cagagacctgctccag

SEQ ID NO: 2273718 - DNA, 20 bp, Homo sapiens
cagagacctgctccagatcc

SEQ ID NO: 2273719 - DNA, 15 bp, Homo sapiens
cagagactgcccacc

SEQ ID NO: 2273720 - DNA, 21 bp, Homo sapiens
cagagactgcccaccctgggc

SEQ ID NO: 2273721 - DNA, 15 bp, Homo sapiens
cagagatggcagagc

SEQ ID NO: 2273722 - DNA, 15 bp, Homo sapiens
cagagatgtattatg

SEQ ID NO: 2273723 - DNA, 22 bp, Homo sapiens
cagagcaagcgaaagagcaaag

SEQ ID NO: 2273724 - DNA, 23 bp, Homo sapiens
cagagcaagcgaaagagcaaagt

SEQ ID NO: 2273725 - DNA, 13 bp, Homo sapiens
cagagcactgtat

SEQ ID NO: 2273726 - DNA, 18 bp, Homo sapiens
cagagcagtctaaacaga

SEQ ID NO: 2273727 - DNA, 15 bp, Homo sapiens
cagagccccggagca

SEQ ID NO: 2273728 - DNA, 19 bp, Homo sapiens
cagagccccggagcaccac

SEQ ID NO: 2273729 - DNA, 19 bp, Homo sapiens
cagagcctgtgtgaaaata

SEQ ID NO: 2273730 - DNA, 18 bp, Homo sapiens
cagagctcagcacagcct

SEQ ID NO: 2273731 - DNA, 14 bp, Homo sapiens
cagagctcccagga

SEQ ID NO: 2273732 - DNA, 15 bp, Homo sapiens
cagagctcccaggac

SEQ ID NO: 2273733 - DNA, 22 bp, Homo sapiens
cagagctcccaggacgcaggga

SEQ ID NO: 2273734 - DNA, 19 bp, Homo sapiens
cagagctgagtcggctggg

SEQ ID NO: 2273735 - DNA, 21 bp, Homo sapiens
cagagctgagtcggctgggca

SEQ ID NO: 2273736 - DNA, 22 bp, Homo sapiens
cagagctgcggtgtctccctgc

SEQ ID NO: 2273737 - DNA, 12 bp, Homo sapiens
cagaggcagggc

SEQ ID NO: 2273738 - DNA, 17 bp, Homo sapiens
cagaggggcggggccag

SEQ ID NO: 2273739 - DNA, 21 bp, Homo sapiens
cagaggggcggggccaggatg

SEQ ID NO: 2273740 - DNA, 14 bp, Homo sapiens
cagaggtgagggag

SEQ ID NO: 2273741 - DNA, 18 bp, Homo sapiens
cagagtatatatgtacag

SEQ ID NO: 2273742 - DNA, 20 bp, Homo sapiens
cagagtccgggagaatgctg

SEQ ID NO: 2273743 - DNA, 23 bp, Homo sapiens
cagagtcctgccgacggagccac

SEQ ID NO: 2273744 - DNA, 21 bp, Homo sapiens
cagatatttaaatttagtgct

SEQ ID NO: 2273745 - DNA, 21 bp, Homo sapiens
cagatccatccttttgcttca

SEQ ID NO: 2273746 - DNA, 22 bp, Homo sapiens
cagatccatccttttgcttcat

SEQ ID NO: 2273747 - DNA, 14 bp, Homo sapiens
cagatccctcggtc

SEQ ID NO: 2273748 - DNA, 20 bp, Homo sapiens
cagatccctcggtcagcacc

SEQ ID NO: 2273749 - DNA, 14 bp, Homo sapiens
cagatcttacaagt

SEQ ID NO: 2273750 - DNA, 17 bp, Homo sapiens
cagatcttacaagttta

SEQ ID NO: 2273751 - DNA, 16 bp, Homo sapiens
cagatgacacataaat

SEQ ID NO: 2273752 - DNA, 18 bp, Homo sapiens
cagatgacacataaatct

SEQ ID NO: 2273753 - DNA, 19 bp, Homo sapiens
cagatgggtgtcccctggt

SEQ ID NO: 2273754 - DNA, 20 bp, Homo sapiens
cagatgtaagaagcccgatc

SEQ ID NO: 2273755 - DNA, 21 bp, Homo sapiens
cagatgttttagagataaata

SEQ ID NO: 2273756 - DNA, 22 bp, Homo sapiens
cagatgttttagagataaatat

SEQ ID NO: 2273757 - DNA, 23 bp, Homo sapiens
cagatgttttagagataaatatt

SEQ ID NO: 2273758 - DNA, 16 bp, Homo sapiens
cagattattttctata

SEQ ID NO: 2273759 - DNA, 16 bp, Homo sapiens
cagattcagtcttgcc

SEQ ID NO: 2273760 - DNA, 21 bp, Homo sapiens
ctggttcccccaggaccctga

SEQ ID NO: 2273761 - DNA, 23 bp, Homo sapiens
ctggttcccccaggaccctgagg

SEQ ID NO: 2273762 - DNA, 12 bp, Homo sapiens
ctggttttcatt

SEQ ID NO: 2273763 - DNA, 17 bp, Homo sapiens
ctgtaaatttaactgca

SEQ ID NO: 2273764 - DNA, 20 bp, Homo sapiens
ctgtaaatttaactgcatat

SEQ ID NO: 2273765 - DNA, 21 bp, Homo sapiens
ctgtaaatttaactgcatata

SEQ ID NO: 2273766 - DNA, 18 bp, Homo sapiens
ctgtaagacggccttgga

SEQ ID NO: 2273767 - DNA, 15 bp, Homo sapiens
ctgtaatatataatc

SEQ ID NO: 2273768 - DNA, 19 bp, Homo sapiens
ctgtaatgcactcctgccc

SEQ ID NO: 2273769 - DNA, 15 bp, Homo sapiens
ctgtaccatccatgg

SEQ ID NO: 2273770 - DNA, 16 bp, Homo sapiens
ctgtactcactgagta

SEQ ID NO: 2273771 - DNA, 19 bp, Homo sapiens
ctgtacttcagttctcatc

SEQ ID NO: 2273772 - DNA, 17 bp, Homo sapiens
ctgtagatacaggggca

SEQ ID NO: 2273773 - DNA, 17 bp, Homo sapiens
ctgtagcaatatatttg

SEQ ID NO: 2273774 - DNA, 18 bp, Homo sapiens
ctgtagcaggttctaggc

SEQ ID NO: 2273775 - DNA, 19 bp, Homo sapiens
ctgtagccaacttaaacct

SEQ ID NO: 2273776 - DNA, 14 bp, Homo sapiens
ctgtagtaattgtt

SEQ ID NO: 2273777 - DNA, 21 bp, Homo sapiens
ctgtataccccgtgaagcatc

SEQ ID NO: 2273778 - DNA, 16 bp, Homo sapiens
ctgtatagacagtttg

SEQ ID NO: 2273779 - DNA, 23 bp, Homo sapiens
ctgtatagacagtttgtaaatgt

SEQ ID NO: 2273780 - DNA, 16 bp, Homo sapiens
ctgtatatgtcaaaaa

SEQ ID NO: 2273781 - DNA, 19 bp, Homo sapiens
ctgtatatgtcaaaaatat

SEQ ID NO: 2273782 - DNA, 15 bp, Homo sapiens
ctgtatattattgct

SEQ ID NO: 2273783 - DNA, 22 bp, Homo sapiens
ctgtatgactgaagtaataact

SEQ ID NO: 2273784 - DNA, 19 bp, Homo sapiens
ctgtatgtgttgcacgatg

SEQ ID NO: 2273785 - DNA, 21 bp, Homo sapiens
ctgtattttcttttatatctg

SEQ ID NO: 2273786 - DNA, 18 bp, Homo sapiens
ctgtcagagaatatgacc

SEQ ID NO: 2273787 - DNA, 20 bp, Homo sapiens
ctgtcataatctctttccat

SEQ ID NO: 2273788 - DNA, 16 bp, Homo sapiens
ctgtcccacaaaatat

SEQ ID NO: 2273789 - DNA, 17 bp, Homo sapiens
ctgtcccacaaaatatt

SEQ ID NO: 2273790 - DNA, 16 bp, Homo sapiens
ctgtcccatgggctct

SEQ ID NO: 2273791 - DNA, 23 bp, Homo sapiens
ctgtccccgagccgagctctcct

SEQ ID NO: 2273792 - DNA, 22 bp, Homo sapiens
ctgtcccttacgtgagtcctgg

SEQ ID NO: 2273793 - DNA, 19 bp, Homo sapiens
ctgtcctcaggtgaataac

SEQ ID NO: 2273794 - DNA, 23 bp, Homo sapiens
ctgtcctggtcagttttcacaga

SEQ ID NO: 2273795 - DNA, 23 bp, Homo sapiens
ctgtcgtctttttccaaacaatt

SEQ ID NO: 2273796 - DNA, 17 bp, Homo sapiens
ctgtctattgtcacatg

SEQ ID NO: 2273797 - DNA, 13 bp, Homo sapiens
ctgtctgattcta

SEQ ID NO: 2273798 - DNA, 15 bp, Homo sapiens
ctgtctgattctatg

SEQ ID NO: 2273799 - DNA, 16 bp, Homo sapiens
ctgtctggctgtacgt

SEQ ID NO: 2273800 - DNA, 15 bp, Homo sapiens
ctgtcttaaagaatt

SEQ ID NO: 2273801 - DNA, 19 bp, Homo sapiens
ctgtcttcaaccctgccct

SEQ ID NO: 2273802 - DNA, 13 bp, Homo sapiens
ctgtcttgtaata

SEQ ID NO: 2273803 - DNA, 14 bp, Homo sapiens
ctgtcttgtaatat

SEQ ID NO: 2273804 - DNA, 21 bp, Homo sapiens
ctgtgaccctcaattcatatt

SEQ ID NO: 2273805 - DNA, 21 bp, Homo sapiens
ctgtgaccggggtcctgaggc

SEQ ID NO: 2273806 - DNA, 15 bp, Homo sapiens
ctgtgagcaaagtgc

SEQ ID NO: 2273807 - DNA, 15 bp, Homo sapiens
ctgtgaggacagaca

SEQ ID NO: 2273808 - DNA, 17 bp, Homo sapiens
ctgtgatctaagcagtt

SEQ ID NO: 2273809 - DNA, 21 bp, Homo sapiens
ctgtgatctaagcagttgcaa

SEQ ID NO: 2273810 - DNA, 17 bp, Homo sapiens
ctgtgcaaaataaaatg

SEQ ID NO: 2273811 - DNA, 20 bp, Homo sapiens
ctgtgcaaaataaaatgagt

SEQ ID NO: 2273812 - DNA, 15 bp, Homo sapiens
ctgtgcataaaagtt

SEQ ID NO: 2273813 - DNA, 20 bp, Homo sapiens
ctgtgcccgaggttcctgtc

SEQ ID NO: 2273814 - DNA, 17 bp, Homo sapiens
ctgtgcgggcgcccgga

SEQ ID NO: 2273815 - DNA, 14 bp, Homo sapiens
ctgtgctggagaat

SEQ ID NO: 2273816 - DNA, 21 bp, Homo sapiens
ctgtgctttcatgtttaagaa

SEQ ID NO: 2273817 - DNA, 21 bp, Homo sapiens
ctgtggaaatatgcaacctgt

SEQ ID NO: 2273818 - DNA, 23 bp, Homo sapiens
ctgtggccacctagaaaggggcc

SEQ ID NO: 2273819 - DNA, 12 bp, Homo sapiens
ctgtggcctcag

SEQ ID NO: 2273820 - DNA, 15 bp, Homo sapiens
ctgtggcctcaggag

SEQ ID NO: 2273821 - DNA, 16 bp, Homo sapiens
ctgtggcctcaggagg

SEQ ID NO: 2273822 - DNA, 19 bp, Homo sapiens
ctgtggcctcaggaggcag

SEQ ID NO: 2273823 - DNA, 12 bp, Homo sapiens
ctgtggctccag

SEQ ID NO: 2273824 - DNA, 19 bp, Homo sapiens
ctgtggctccaggagcagc

SEQ ID NO: 2273825 - DNA, 13 bp, Homo sapiens
ctgtggggagctg

SEQ ID NO: 2273826 - DNA, 16 bp, Homo sapiens
ctgtggggagctggtg

SEQ ID NO: 2273827 - DNA, 14 bp, Homo sapiens
ctgtggggccacac

SEQ ID NO: 2273828 - DNA, 16 bp, Homo sapiens
ctgtgtaatctctgat

SEQ ID NO: 2273829 - DNA, 18 bp, Homo sapiens
ctgtgtaatctctgatta

SEQ ID NO: 2273830 - DNA, 14 bp, Homo sapiens
ctgtgtccacagtg

SEQ ID NO: 2273831 - DNA, 23 bp, Homo sapiens
ctgtgtccacagtgattagcctc

SEQ ID NO: 2273832 - DNA, 22 bp, Homo sapiens
ctgtgtccccgcgggcagtgac

SEQ ID NO: 2273833 - DNA, 14 bp, Homo sapiens
ctgtgtctgctgta

SEQ ID NO: 2273834 - DNA, 13 bp, Homo sapiens
ctgtgttgcccag

SEQ ID NO: 2273835 - DNA, 16 bp, Homo sapiens
ctgtgttgcccaggct

SEQ ID NO: 2273836 - DNA, 19 bp, Homo sapiens
ctgtgttgcccaggctggt

SEQ ID NO: 2273837 - DNA, 23 bp, Homo sapiens
ctgtgttgtgattccccggagct

SEQ ID NO: 2273838 - DNA, 16 bp, Homo sapiens
ctgtgtttcaaacctg

SEQ ID NO: 2273839 - DNA, 20 bp, Homo sapiens
ctgttaatcatgggttcctc

SEQ ID NO: 2273840 - DNA, 16 bp, Homo sapiens
ctgttacacaatatgt

SEQ ID NO: 2273841 - DNA, 15 bp, Homo sapiens
ctgttactccaaaaa

SEQ ID NO: 2273842 - DNA, 15 bp, Homo sapiens
ctgttacttaaatag

SEQ ID NO: 2273843 - DNA, 17 bp, Homo sapiens
ctgttagcattattgcc

SEQ ID NO: 2273844 - DNA, 20 bp, Homo sapiens
cgaaaacgtggctgcttcaa

SEQ ID NO: 2273845 - DNA, 21 bp, Homo sapiens
cgaaaggtcacctcactcagc

SEQ ID NO: 2273846 - DNA, 22 bp, Homo sapiens
cgaagaccttctgaagatctca

SEQ ID NO: 2273847 - DNA, 17 bp, Homo sapiens
cgaagtccgaggcctgg

SEQ ID NO: 2273848 - DNA, 15 bp, Homo sapiens
cgaatggagtccaga

SEQ ID NO: 2273849 - DNA, 17 bp, Homo sapiens
cgaatggagtccagacc

SEQ ID NO: 2273850 - DNA, 14 bp, Homo sapiens
cgacctccctggct

SEQ ID NO: 2273851 - DNA, 20 bp, Homo sapiens
cgagcacggttgcctgaggt

SEQ ID NO: 2273852 - DNA, 21 bp, Homo sapiens
cgagcacggttgcctgaggtc

SEQ ID NO: 2273853 - DNA, 18 bp, Homo sapiens
cgagcgcgtgccttcccc

SEQ ID NO: 2273854 - DNA, 16 bp, Homo sapiens
cgaggactccaggggc

SEQ ID NO: 2273855 - DNA, 17 bp, Homo sapiens
cgaggcctggctctgga

SEQ ID NO: 2273856 - DNA, 18 bp, Homo sapiens
cgaggcctggctctggag

SEQ ID NO: 2273857 - DNA, 23 bp, Homo sapiens
cgaggccttcagaaaagacactt

SEQ ID NO: 2273858 - DNA, 23 bp, Homo sapiens
cgaggcctttgctttacagcact

SEQ ID NO: 2273859 - DNA, 21 bp, Homo sapiens
cgaggtgggcgtatcacctga

SEQ ID NO: 2273860 - DNA, 21 bp, Homo sapiens
cgagtgagctaccaggaagag

SEQ ID NO: 2273861 - DNA, 13 bp, Homo sapiens
cgagtgccccaga

SEQ ID NO: 2273862 - DNA, 20 bp, Homo sapiens
cgagtgtggagctgcttcca

SEQ ID NO: 2273863 - DNA, 17 bp, Homo sapiens
cgagttacagacaaagc

SEQ ID NO: 2273864 - DNA, 15 bp, Homo sapiens
cgatgatgggctgga

SEQ ID NO: 2273865 - DNA, 21 bp, Homo sapiens
cgatgggatcattatttcatg

SEQ ID NO: 2273866 - DNA, 19 bp, Homo sapiens
cgcaaagggcgggcctgtt

SEQ ID NO: 2273867 - DNA, 12 bp, Homo sapiens
cgcacccctcct

SEQ ID NO: 2273868 - DNA, 17 bp, Homo sapiens
cgcaccgggctggcctg

SEQ ID NO: 2273869 - DNA, 19 bp, Homo sapiens
cgcagcaccagcctgagcc

SEQ ID NO: 2273870 - DNA, 20 bp, Homo sapiens
cgcagcaccagcctgagcca

SEQ ID NO: 2273871 - DNA, 21 bp, Homo sapiens
cgcagcaccagcctgagccac

SEQ ID NO: 2273872 - DNA, 16 bp, Homo sapiens
cgcagccgcgctctgc

SEQ ID NO: 2273873 - DNA, 17 bp, Homo sapiens
cgcagccgcgctctgcc

SEQ ID NO: 2273874 - DNA, 22 bp, Homo sapiens
cgcagcgggcgcgggacaggac

SEQ ID NO: 2273875 - DNA, 17 bp, Homo sapiens
cgcaggaaccgaggact

SEQ ID NO: 2273876 - DNA, 18 bp, Homo sapiens
cgcaggaaccgaggactc

SEQ ID NO: 2273877 - DNA, 13 bp, Homo sapiens
cgcagggagaccc

SEQ ID NO: 2273878 - DNA, 15 bp, Homo sapiens
cgcagggagaccctg

SEQ ID NO: 2273879 - DNA, 20 bp, Homo sapiens
cgcagggcgctccggcagag

SEQ ID NO: 2273880 - DNA, 21 bp, Homo sapiens
cgcagggcgctccggcagagg

SEQ ID NO: 2273881 - DNA, 22 bp, Homo sapiens
cgccacccgcccgcccccgccc

SEQ ID NO: 2273882 - DNA, 20 bp, Homo sapiens
cgccaccttgtacagaacca

SEQ ID NO: 2273883 - DNA, 19 bp, Homo sapiens
cgcccaacccccacctccc

SEQ ID NO: 2273884 - DNA, 22 bp, Homo sapiens
cgcccacccacaccccgtctgc

SEQ ID NO: 2273885 - DNA, 13 bp, Homo sapiens
cgcccacctgccc

SEQ ID NO: 2273886 - DNA, 16 bp, Homo sapiens
cgcccacctgcccagt

SEQ ID NO: 2273887 - DNA, 15 bp, Homo sapiens
cgccccagcctcctg

SEQ ID NO: 2273888 - DNA, 18 bp, Homo sapiens
cgccccagcctcctgagt

SEQ ID NO: 2273889 - DNA, 15 bp, Homo sapiens
cgccccccagtggac

SEQ ID NO: 2273890 - DNA, 18 bp, Homo sapiens
cgccccgaaaggtcacct

SEQ ID NO: 2273891 - DNA, 18 bp, Homo sapiens
cgccccggacgccgcgat

SEQ ID NO: 2273892 - DNA, 11 bp, Homo sapiens
cgcccctcctc

SEQ ID NO: 2273893 - DNA, 14 bp, Homo sapiens
cgcccctcctcggg

SEQ ID NO: 2273894 - DNA, 12 bp, Homo sapiens
cgcccgcccacc

SEQ ID NO: 2273895 - DNA, 13 bp, Homo sapiens
cgcccgcccccgc

SEQ ID NO: 2273896 - DNA, 14 bp, Homo sapiens
cgcccgcccccgcc

SEQ ID NO: 2273897 - DNA, 23 bp, Homo sapiens
cgcccgcccccgccctcgctccg

SEQ ID NO: 2273898 - DNA, 19 bp, Homo sapiens
cgcccgccctcctctgccc

SEQ ID NO: 2273899 - DNA, 21 bp, Homo sapiens
cgcccgccctcctctgccccc

SEQ ID NO: 2273900 - DNA, 11 bp, Homo sapiens
cgccctcctct

SEQ ID NO: 2273901 - DNA, 19 bp, Homo sapiens
cgccctctctcaccagcct

SEQ ID NO: 2273902 - DNA, 20 bp, Homo sapiens
cgccctctctcaccagcctt

SEQ ID NO: 2273903 - DNA, 13 bp, Homo sapiens
cgccctgggctct

SEQ ID NO: 2273904 - DNA, 21 bp, Homo sapiens
cgccctgtgtccacagtgatt

SEQ ID NO: 2273905 - DNA, 18 bp, Homo sapiens
cgccgcctcgggccgcct

SEQ ID NO: 2273906 - DNA, 20 bp, Homo sapiens
cgccggcgccccggacgccg

SEQ ID NO: 2273907 - DNA, 14 bp, Homo sapiens
cgccggggctggcc

SEQ ID NO: 2273908 - DNA, 16 bp, Homo sapiens
cgccggggctggccct

SEQ ID NO: 2273909 - DNA, 18 bp, Homo sapiens
cgccggggctggccctgc

SEQ ID NO: 2273910 - DNA, 23 bp, Homo sapiens
cgccggggctggccctgccctcc

SEQ ID NO: 2273911 - DNA, 21 bp, Homo sapiens
cgccggttggccggctggccg

SEQ ID NO: 2273912 - DNA, 20 bp, Homo sapiens
cgcctcaaggaagagccagc

SEQ ID NO: 2273913 - DNA, 24 bp, Homo sapiens
cgcctcaaggaagagccagccgta

SEQ ID NO: 2273914 - DNA, 20 bp, Homo sapiens
cgcctccatccacacacagc

SEQ ID NO: 2273915 - DNA, 13 bp, Homo sapiens
cgcctcctccagc

SEQ ID NO: 2273916 - DNA, 16 bp, Homo sapiens
cgcctcctccagctcc

SEQ ID NO: 2273917 - DNA, 17 bp, Homo sapiens
cgcctcctccagctcct

SEQ ID NO: 2273918 - DNA, 17 bp, Homo sapiens
cgcctcctccctgcctg

SEQ ID NO: 2273919 - DNA, 19 bp, Homo sapiens
cgcctcgggccgcctcctc

SEQ ID NO: 2273920 - DNA, 21 bp, Homo sapiens
cgcctcgggccgcctcctcca

SEQ ID NO: 2273921 - DNA, 14 bp, Homo sapiens
cgcctgcccccagc

SEQ ID NO: 2273922 - DNA, 17 bp, Homo sapiens
cgcctgcccccagcgtg

SEQ ID NO: 2273923 - DNA, 14 bp, Homo sapiens
cgcctgcgctcctc

SEQ ID NO: 2273924 - DNA, 15 bp, Homo sapiens
cgcctgcgctcctct

SEQ ID NO: 2273925 - DNA, 17 bp, Homo sapiens
cgcctgcgctcctctgc

SEQ ID NO: 2273926 - DNA, 22 bp, Homo sapiens
cgcctgcgctcctctgcagcct

SEQ ID NO: 2273927 - DNA, 18 bp, Homo sapiens
cgcgaagtccgaggcctg

SEQ ID NO: 2273928 - DNA, 13 bp, Homo sapiens
cgcgatgatgggc

SEQ ID NO: 2273929 - DNA, 13 bp, Homo sapiens
cgcgcaccgccca

SEQ ID NO: 2273930 - DNA, 22 bp, Homo sapiens
cgcgggcgagaagggcgcagga

SEQ ID NO: 2273931 - DNA, 14 bp, Homo sapiens
cgcgggggacagga

SEQ ID NO: 2273932 - DNA, 14 bp, Homo sapiens
cgcgtgccttcccc

SEQ ID NO: 2273933 - DNA, 20 bp, Homo sapiens
cgctcaacctctcagatccc

SEQ ID NO: 2273934 - DNA, 17 bp, Homo sapiens
cgctccggcagaggcag

SEQ ID NO: 2273935 - DNA, 20 bp, Homo sapiens
cgctccggcagaggcagggc

SEQ ID NO: 2273936 - DNA, 21 bp, Homo sapiens
cgctccggcagaggcagggcc

SEQ ID NO: 2273937 - DNA, 20 bp, Homo sapiens
cgctccgggacgtggcacct

SEQ ID NO: 2273938 - DNA, 14 bp, Homo sapiens
cgctcctctgcagc

SEQ ID NO: 2273939 - DNA, 18 bp, Homo sapiens
cgctcctctgcagcctga

SEQ ID NO: 2273940 - DNA, 13 bp, Homo sapiens
cgctctgcccctc

SEQ ID NO: 2273941 - DNA, 14 bp, Homo sapiens
cgctgcccccaccc

SEQ ID NO: 2273942 - DNA, 17 bp, Homo sapiens
cgctgcccccaccctgc

SEQ ID NO: 2273943 - DNA, 18 bp, Homo sapiens
cgctgcccccaccctgct

SEQ ID NO: 2273944 - DNA, 22 bp, Homo sapiens
cgctgcccccaccctgcttctg

SEQ ID NO: 2273945 - DNA, 17 bp, Homo sapiens
cgctgcctggcgggcag

SEQ ID NO: 2273946 - DNA, 23 bp, Homo sapiens
cgctgcttgagtggacagcagct

SEQ ID NO: 2273947 - DNA, 18 bp, Homo sapiens
cgcttcagacacgcactt

SEQ ID NO: 2273948 - DNA, 18 bp, Homo sapiens
cgcttcctccggctggac

SEQ ID NO: 2273949 - DNA, 20 bp, Homo sapiens
cgcttcctccggctggacct

SEQ ID NO: 2273950 - DNA, 13 bp, Homo sapiens
cggaccctgtgtg

SEQ ID NO: 2273951 - DNA, 14 bp, Homo sapiens
cggaccctgtgtgg

SEQ ID NO: 2273952 - DNA, 16 bp, Homo sapiens
cggacgggacagcggc

SEQ ID NO: 2273953 - DNA, 21 bp, Homo sapiens
cggagaggaccccattctggg

SEQ ID NO: 2273954 - DNA, 16 bp, Homo sapiens
cggaggcctcgagcag

SEQ ID NO: 2273955 - DNA, 21 bp, Homo sapiens
cggaggcgcccacctgcccag

SEQ ID NO: 2273956 - DNA, 15 bp, Homo sapiens
cggaggggcttggag

SEQ ID NO: 2273957 - DNA, 18 bp, Homo sapiens
cggaggggcttggagcag

SEQ ID NO: 2273958 - DNA, 19 bp, Homo sapiens
cggcaacccctgcagctcc

SEQ ID NO: 2273959 - DNA, 12 bp, Homo sapiens
cggcaccgccca

SEQ ID NO: 2273960 - DNA, 14 bp, Homo sapiens
cggcaccgcccacc

SEQ ID NO: 2273961 - DNA, 17 bp, Homo sapiens
cggcagaggcagggccc

SEQ ID NO: 2273962 - DNA, 24 bp, Homo sapiens
cggcagaggcagggccctggggtc

SEQ ID NO: 2273963 - DNA, 15 bp, Homo sapiens
cggcagccccatcct

SEQ ID NO: 2273964 - DNA, 19 bp, Homo sapiens
cggcagccccccagtgtcc

SEQ ID NO: 2273965 - DNA, 21 bp, Homo sapiens
cggcatgccgagtgccccaga

SEQ ID NO: 2273966 - DNA, 12 bp, Homo sapiens
cggcatgtttcc

SEQ ID NO: 2273967 - DNA, 12 bp, Homo sapiens
cggccagagctc

SEQ ID NO: 2273968 - DNA, 21 bp, Homo sapiens
cggcccaacctcgccctctct

SEQ ID NO: 2273969 - DNA, 16 bp, Homo sapiens
cggcccacgcagagcc

SEQ ID NO: 2273970 - DNA, 21 bp, Homo sapiens
cggccccgcacccctcctcct

SEQ ID NO: 2273971 - DNA, 14 bp, Homo sapiens
cggcccggcccacg

SEQ ID NO: 2273972 - DNA, 17 bp, Homo sapiens
cggcccggcccacgcag

SEQ ID NO: 2273973 - DNA, 15 bp, Homo sapiens
cggcccgtgcgcagc

SEQ ID NO: 2273974 - DNA, 16 bp, Homo sapiens
cggcccgtgcgcagcc

SEQ ID NO: 2273975 - DNA, 17 bp, Homo sapiens
cggcccgtgcgcagccg

SEQ ID NO: 2273976 - DNA, 21 bp, Homo sapiens
cggcctggggccgggctggct

SEQ ID NO: 2273977 - DNA, 19 bp, Homo sapiens
cggcgccttctacctgcag

SEQ ID NO: 2273978 - DNA, 15 bp, Homo sapiens
cggcggcctcagagt

SEQ ID NO: 2273979 - DNA, 14 bp, Homo sapiens
cggctggccggtcc

SEQ ID NO: 2273980 - DNA, 15 bp, Homo sapiens
cttattaaccaaatt

SEQ ID NO: 2273981 - DNA, 15 bp, Homo sapiens
cttatttatatatga

SEQ ID NO: 2273982 - DNA, 19 bp, Homo sapiens
cttatttatatatgaagta

SEQ ID NO: 2273983 - DNA, 13 bp, Homo sapiens
cttattttcataa

SEQ ID NO: 2273984 - DNA, 20 bp, Homo sapiens
cttattttccacttatcttg

SEQ ID NO: 2273985 - DNA, 11 bp, Homo sapiens
cttattttctg

SEQ ID NO: 2273986 - DNA, 13 bp, Homo sapiens
cttattttctgaa

SEQ ID NO: 2273987 - DNA, 19 bp, Homo sapiens
cttattttctgaattcata

SEQ ID NO: 2273988 - DNA, 19 bp, Homo sapiens
cttcaaaaatgtgctgcct

SEQ ID NO: 2273989 - DNA, 20 bp, Homo sapiens
cttcaaaaatgtgctgccta

SEQ ID NO: 2273990 - DNA, 19 bp, Homo sapiens
cttcaaccctgccctgcac

SEQ ID NO: 2273991 - DNA, 18 bp, Homo sapiens
cttcaaggatcctgagcc

SEQ ID NO: 2273992 - DNA, 13 bp, Homo sapiens
cttcacaaaatgc

SEQ ID NO: 2273993 - DNA, 14 bp, Homo sapiens
cttcactctccagg

SEQ ID NO: 2273994 - DNA, 21 bp, Homo sapiens
cttcactttcatctgagcttt

SEQ ID NO: 2273995 - DNA, 15 bp, Homo sapiens
cttcagacacgcact

SEQ ID NO: 2273996 - DNA, 13 bp, Homo sapiens
cttcagcccctgg

SEQ ID NO: 2273997 - DNA, 18 bp, Homo sapiens
cttcagtgccttatggaa

SEQ ID NO: 2273998 - DNA, 22 bp, Homo sapiens
cttcagtgccttatggaacact

SEQ ID NO: 2273999 - DNA, 13 bp, Homo sapiens
cttcagttctcat

SEQ ID NO: 2274000 - DNA, 19 bp, Homo sapiens
cttcagttctcatcttgta

SEQ ID NO: 2274001 - DNA, 18 bp, Homo sapiens
cttcagttgtggcctcat

SEQ ID NO: 2274002 - DNA, 20 bp, Homo sapiens
cttcatctggagtccctcct

SEQ ID NO: 2274003 - DNA, 17 bp, Homo sapiens
cttcatggtctcttcca

SEQ ID NO: 2274004 - DNA, 18 bp, Homo sapiens
cttccaagttcattcata

SEQ ID NO: 2274005 - DNA, 20 bp, Homo sapiens
cttccagctcagtcccacag

SEQ ID NO: 2274006 - DNA, 23 bp, Homo sapiens
cttccagctcagtcccacagccc

SEQ ID NO: 2274007 - DNA, 16 bp, Homo sapiens
cttccaggaggacata

SEQ ID NO: 2274008 - DNA, 13 bp, Homo sapiens
cttccaggagtgg

SEQ ID NO: 2274009 - DNA, 21 bp, Homo sapiens
cttccagttggactgtggcct

SEQ ID NO: 2274010 - DNA, 16 bp, Homo sapiens
cttcccacagcctctt

SEQ ID NO: 2274011 - DNA, 20 bp, Homo sapiens
cttcccagctggcagcgcct

SEQ ID NO: 2274012 - DNA, 14 bp, Homo sapiens
cttcccatttgtaa

SEQ ID NO: 2274013 - DNA, 20 bp, Homo sapiens
cttcccgcagcaccagcctg

SEQ ID NO: 2274014 - DNA, 15 bp, Homo sapiens
cttccctagaagtct

SEQ ID NO: 2274015 - DNA, 13 bp, Homo sapiens
cttcctaaatttc

SEQ ID NO: 2274016 - DNA, 15 bp, Homo sapiens
cttcctaaatttcat

SEQ ID NO: 2274017 - DNA, 19 bp, Homo sapiens
cttcctccggctggacctg

SEQ ID NO: 2274018 - DNA, 14 bp, Homo sapiens
cttcctcctgacac

SEQ ID NO: 2274019 - DNA, 15 bp, Homo sapiens
cttcctcctgacacc

SEQ ID NO: 2274020 - DNA, 17 bp, Homo sapiens
cttcctgttctgtgtct

SEQ ID NO: 2274021 - DNA, 14 bp, Homo sapiens
cttcgtctcagaag

SEQ ID NO: 2274022 - DNA, 19 bp, Homo sapiens
cttctaaagtgctgggatt

SEQ ID NO: 2274023 - DNA, 18 bp, Homo sapiens
cttctacctgcaggactc

SEQ ID NO: 2274024 - DNA, 22 bp, Homo sapiens
cttctacctgcaggactcgggc

SEQ ID NO: 2274025 - DNA, 19 bp, Homo sapiens
cttctatgttcataaaaaa

SEQ ID NO: 2274026 - DNA, 20 bp, Homo sapiens
cttctatgttcataaaaaat

SEQ ID NO: 2274027 - DNA, 21 bp, Homo sapiens
cttctcttacgctctctgtct

SEQ ID NO: 2274028 - DNA, 15 bp, Homo sapiens
cttctgaagatctca

SEQ ID NO: 2274029 - DNA, 15 bp, Homo sapiens
cttctgagtgaatgt

SEQ ID NO: 2274030 - DNA, 18 bp, Homo sapiens
cttctggaatactgaaaa

SEQ ID NO: 2274031 - DNA, 17 bp, Homo sapiens
cttctggaggtggggag

SEQ ID NO: 2274032 - DNA, 20 bp, Homo sapiens
cttctggaggtggggagggc

SEQ ID NO: 2274033 - DNA, 16 bp, Homo sapiens
cttctggggccagccc

SEQ ID NO: 2274034 - DNA, 17 bp, Homo sapiens
cttctggggccagcccc

SEQ ID NO: 2274035 - DNA, 15 bp, Homo sapiens
cttctgttctcaaat

SEQ ID NO: 2274036 - DNA, 19 bp, Homo sapiens
cttcttattatatatataa

SEQ ID NO: 2274037 - DNA, 14 bp, Homo sapiens
cttcttgcggcacc

SEQ ID NO: 2274038 - DNA, 19 bp, Homo sapiens
cttcttgcggcaccgccca

SEQ ID NO: 2274039 - DNA, 20 bp, Homo sapiens
cttcttgcggcaccgcccac

SEQ ID NO: 2274040 - DNA, 22 bp, Homo sapiens
cttgaaaatgtggcttcttcaa

SEQ ID NO: 2274041 - DNA, 17 bp, Homo sapiens
cttgaactcttggcctc

SEQ ID NO: 2274042 - DNA, 18 bp, Homo sapiens
cttgaactcttggcctca

SEQ ID NO: 2274043 - DNA, 17 bp, Homo sapiens
cttgaactgtggccacc

SEQ ID NO: 2274044 - DNA, 18 bp, Homo sapiens
cttgaagaatattgttaa

SEQ ID NO: 2274045 - DNA, 18 bp, Homo sapiens
cttgaattgtaaggaatg

SEQ ID NO: 2274046 - DNA, 16 bp, Homo sapiens
cttgacgcagcccccc

SEQ ID NO: 2274047 - DNA, 17 bp, Homo sapiens
cttgacgcagcccccca

SEQ ID NO: 2274048 - DNA, 13 bp, Homo sapiens
cttgagcaatgtt

SEQ ID NO: 2274049 - DNA, 19 bp, Homo sapiens
cttgaggacctccacctgg

SEQ ID NO: 2274050 - DNA, 12 bp, Homo sapiens
cttgaggcaggg

SEQ ID NO: 2274051 - DNA, 21 bp, Homo sapiens
cttgagtggacagcagctgga

SEQ ID NO: 2274052 - DNA, 23 bp, Homo sapiens
cttgagtggacagcagctggact

SEQ ID NO: 2274053 - DNA, 21 bp, Homo sapiens
cttgatacttttattgttata

SEQ ID NO: 2274054 - DNA, 15 bp, Homo sapiens
cttgatataataatt

SEQ ID NO: 2274055 - DNA, 19 bp, Homo sapiens
cttgatataataattactt

SEQ ID NO: 2274056 - DNA, 15 bp, Homo sapiens
cttgatataattact

SEQ ID NO: 2274057 - DNA, 16 bp, Homo sapiens
cttgatataattactt

SEQ ID NO: 2274058 - DNA, 23 bp, Homo sapiens
cttgatataattacttaatgtga

SEQ ID NO: 2274059 - DNA, 17 bp, Homo sapiens
cttgatcatgctgcagt

SEQ ID NO: 2274060 - DNA, 15 bp, Homo sapiens
cttgatttacaagca

SEQ ID NO: 2274061 - DNA, 17 bp, Homo sapiens
cttgcaaatgaatgcct

SEQ ID NO: 2274062 - DNA, 15 bp, Homo sapiens
cttgccttacacaaa

SEQ ID NO: 2274063 - DNA, 18 bp, Homo sapiens
cttgcggcaccgcccacc

SEQ ID NO: 2274064 - DNA, 23 bp, Homo sapiens
cttgctagtgatacactgtatct

SEQ ID NO: 2274065 - DNA, 13 bp, Homo sapiens
cttgctgatttgc

SEQ ID NO: 2274066 - DNA, 18 bp, Homo sapiens
cttgctttcacaaatata

SEQ ID NO: 2274067 - DNA, 14 bp, Homo sapiens
cttggacggggaca

SEQ ID NO: 2274068 - DNA, 19 bp, Homo sapiens
cttggacggggacacggcc

SEQ ID NO: 2274069 - DNA, 16 bp, Homo sapiens
cttggagcagagacgg

SEQ ID NO: 2274070 - DNA, 21 bp, Homo sapiens
cttggagcagagacggcagcc

SEQ ID NO: 2274071 - DNA, 20 bp, Homo sapiens
cttggatccatacaaaacta

SEQ ID NO: 2274072 - DNA, 21 bp, Homo sapiens
gaaccagcactcccagggccc

SEQ ID NO: 2274073 - DNA, 23 bp, Homo sapiens
gaaccagcactcccagggcccga

SEQ ID NO: 2274074 - DNA, 12 bp, Homo sapiens
gaaccctctggg

SEQ ID NO: 2274075 - DNA, 19 bp, Homo sapiens
gaaccgaggactccagggg

SEQ ID NO: 2274076 - DNA, 13 bp, Homo sapiens
gaaccgtcaatgt

SEQ ID NO: 2274077 - DNA, 16 bp, Homo sapiens
gaacctgcatttaaga

SEQ ID NO: 2274078 - DNA, 16 bp, Homo sapiens
gaacctgctcttcatt

SEQ ID NO: 2274079 - DNA, 21 bp, Homo sapiens
gaaccttttgagtgccttaca

SEQ ID NO: 2274080 - DNA, 19 bp, Homo sapiens
gaacgccctgtgtccacag

SEQ ID NO: 2274081 - DNA, 14 bp, Homo sapiens
gaacgtactttctg

SEQ ID NO: 2274082 - DNA, 23 bp, Homo sapiens
gaactagagactctgtgatctaa

SEQ ID NO: 2274083 - DNA, 15 bp, Homo sapiens
gaactcaatgcatga

SEQ ID NO: 2274084 - DNA, 17 bp, Homo sapiens
gaactcaatgcatgatg

SEQ ID NO: 2274085 - DNA, 15 bp, Homo sapiens
gaactgctgctggtc

SEQ ID NO: 2274086 - DNA, 14 bp, Homo sapiens
gaactgtatattat

SEQ ID NO: 2274087 - DNA, 20 bp, Homo sapiens
gaactgtatattattgctat

SEQ ID NO: 2274088 - DNA, 17 bp, Homo sapiens
gaactgtcccacaaaat

SEQ ID NO: 2274089 - DNA, 16 bp, Homo sapiens
gaactgttcatttcca

SEQ ID NO: 2274090 - DNA, 13 bp, Homo sapiens
gaacttaaaacat

SEQ ID NO: 2274091 - DNA, 14 bp, Homo sapiens
gaacttaaaacata

SEQ ID NO: 2274092 - DNA, 21 bp, Homo sapiens
gaagaaacacgtggtcatgaa

SEQ ID NO: 2274093 - DNA, 12 bp, Homo sapiens
gaagaaagggag

SEQ ID NO: 2274094 - DNA, 14 bp, Homo sapiens
gaagaacccttctc

SEQ ID NO: 2274095 - DNA, 16 bp, Homo sapiens
gaagaataaaaaagaa

SEQ ID NO: 2274096 - DNA, 17 bp, Homo sapiens
gaagaatgtctcctgcc

SEQ ID NO: 2274097 - DNA, 16 bp, Homo sapiens
gaagaccttctgaaga

SEQ ID NO: 2274098 - DNA, 19 bp, Homo sapiens
gaagacgcagagcaaatga

SEQ ID NO: 2274099 - DNA, 14 bp, Homo sapiens
gaagagagaggcct

SEQ ID NO: 2274100 - DNA, 20 bp, Homo sapiens
gaagaggggcgctgccccca

SEQ ID NO: 2274101 - DNA, 23 bp, Homo sapiens
gaagaggggcgctgcccccacag

SEQ ID NO: 2274102 - DNA, 21 bp, Homo sapiens
gaagaggggtataggacaagg

SEQ ID NO: 2274103 - DNA, 16 bp, Homo sapiens
gaagagtagataagtg

SEQ ID NO: 2274104 - DNA, 14 bp, Homo sapiens
gaagataaatgctt

SEQ ID NO: 2274105 - DNA, 12 bp, Homo sapiens
gaagatgtgtaa

SEQ ID NO: 2274106 - DNA, 14 bp, Homo sapiens
gaagatgtgtaaat

SEQ ID NO: 2274107 - DNA, 15 bp, Homo sapiens
gaagatgtttttaga

SEQ ID NO: 2274108 - DNA, 15 bp, Homo sapiens
gaagattctaaaaca

SEQ ID NO: 2274109 - DNA, 11 bp, Homo sapiens
gaagcatccag

SEQ ID NO: 2274110 - DNA, 14 bp, Homo sapiens
gaagcatccaggca

SEQ ID NO: 2274111 - DNA, 18 bp, Homo sapiens
gaagcattagttggagct

SEQ ID NO: 2274112 - DNA, 23 bp, Homo sapiens
gaagcattagttggagctagaaa

SEQ ID NO: 2274113 - DNA, 14 bp, Homo sapiens
gaagcccacccgcc

SEQ ID NO: 2274114 - DNA, 19 bp, Homo sapiens
gaagcccacccgccccaga

SEQ ID NO: 2274115 - DNA, 22 bp, Homo sapiens
gaagcccacccgccccagagac

SEQ ID NO: 2274116 - DNA, 20 bp, Homo sapiens
gaagcctcctgctgagtggt

SEQ ID NO: 2274117 - DNA, 12 bp, Homo sapiens
gaaggagacaga

SEQ ID NO: 2274118 - DNA, 13 bp, Homo sapiens
gaaggatgaacag

SEQ ID NO: 2274119 - DNA, 19 bp, Homo sapiens
gaaggatgggggctcctgg

SEQ ID NO: 2274120 - DNA, 23 bp, Homo sapiens
gaaggatgggggctcctggcagt

SEQ ID NO: 2274121 - DNA, 22 bp, Homo sapiens
gaaggattcagtcataaagagg

SEQ ID NO: 2274122 - DNA, 21 bp, Homo sapiens
gaaggattcttttttcaatgt

SEQ ID NO: 2274123 - DNA, 21 bp, Homo sapiens
gaaggcacaggtgtaaatata

SEQ ID NO: 2274124 - DNA, 14 bp, Homo sapiens
gaaggcctgaggga

SEQ ID NO: 2274125 - DNA, 19 bp, Homo sapiens
gaaggcctgagggaagccc

SEQ ID NO: 2274126 - DNA, 20 bp, Homo sapiens
gaaggctctatctgctgggc

SEQ ID NO: 2274127 - DNA, 16 bp, Homo sapiens
gaagggaaatcaattt

SEQ ID NO: 2274128 - DNA, 11 bp, Homo sapiens
gaagggaaatt

SEQ ID NO: 2274129 - DNA, 21 bp, Homo sapiens
gaagggaccgggagcctgcgt

SEQ ID NO: 2274130 - DNA, 17 bp, Homo sapiens
gaagggaggggaagaga

SEQ ID NO: 2274131 - DNA, 13 bp, Homo sapiens
gaaggggacagga

SEQ ID NO: 2274132 - DNA, 20 bp, Homo sapiens
gaagggtgggccctggaggg

SEQ ID NO: 2274133 - DNA, 23 bp, Homo sapiens
gaagtaagttctgaaaactgttt

SEQ ID NO: 2274134 - DNA, 15 bp, Homo sapiens
gaagtactggagaaa

SEQ ID NO: 2274135 - DNA, 17 bp, Homo sapiens
gaagtagttttgttcat

SEQ ID NO: 2274136 - DNA, 23 bp, Homo sapiens
gaagtccgaggcctggctctgga

SEQ ID NO: 2274137 - DNA, 11 bp, Homo sapiens
gaagtcttgta

SEQ ID NO: 2274138 - DNA, 14 bp, Homo sapiens
gaagtctttgtaca

SEQ ID NO: 2274139 - DNA, 20 bp, Homo sapiens
gaagtctttgtacagacaac

SEQ ID NO: 2274140 - DNA, 16 bp, Homo sapiens
gaagtgagatacaaag

SEQ ID NO: 2274141 - DNA, 12 bp, Homo sapiens
gaagttaccttt

SEQ ID NO: 2274142 - DNA, 13 bp, Homo sapiens
gaagttacctttt

SEQ ID NO: 2274143 - DNA, 18 bp, Homo sapiens
gaagttgccctccaggcc

SEQ ID NO: 2274144 - DNA, 20 bp, Homo sapiens
gaataaactccccagcgtat

SEQ ID NO: 2274145 - DNA, 18 bp, Homo sapiens
gaataaataaagaagaaa

SEQ ID NO: 2274146 - DNA, 13 bp, Homo sapiens
gaatacaacttga

SEQ ID NO: 2274147 - DNA, 18 bp, Homo sapiens
gaatactgaaaaagaatg

SEQ ID NO: 2274148 - DNA, 22 bp, Homo sapiens
gaatactgaaaaagaatgaaaa

SEQ ID NO: 2274149 - DNA, 22 bp, Homo sapiens
gaatatatacataaaaattgtt

SEQ ID NO: 2274150 - DNA, 20 bp, Homo sapiens
gaatatgacctaaatccatt

SEQ ID NO: 2274151 - DNA, 11 bp, Homo sapiens
gaatattgctg

SEQ ID NO: 2274152 - DNA, 14 bp, Homo sapiens
gaatattgctgatg

SEQ ID NO: 2274153 - DNA, 22 bp, Homo sapiens
gaatattgctgatggtgcaatg

SEQ ID NO: 2274154 - DNA, 14 bp, Homo sapiens
gaatcaaagacatt

SEQ ID NO: 2274155 - DNA, 18 bp, Homo sapiens
gaatcaaagacatttcat

SEQ ID NO: 2274156 - DNA, 23 bp, Homo sapiens
gaatccaattaatgattcaatta

SEQ ID NO: 2274157 - DNA, 16 bp, Homo sapiens
gaatctattttctatg

SEQ ID NO: 2274158 - DNA, 22 bp, Homo sapiens
gaatctcaatgacctgttgatt

SEQ ID NO: 2274159 - DNA, 11 bp, Homo sapiens
gaatgaatgtc

SEQ ID NO: 2274160 - DNA, 12 bp, Homo sapiens
gaatgagaaatc

SEQ ID NO: 2274161 - DNA, 16 bp, Homo sapiens
gaatgagaaatcatgt

SEQ ID NO: 2274162 - DNA, 14 bp, Homo sapiens
gaatgcctttcaaa

SEQ ID NO: 2274163 - DNA, 19 bp, Homo sapiens
gaatggagtccagacctgg

SEQ ID NO: 2274164 - DNA, 21 bp, Homo sapiens
gaatgggggccaggctgagcc

SEQ ID NO: 2274165 - DNA, 21 bp, Homo sapiens
gaatgtcagtgtgactgatct

SEQ ID NO: 2274166 - DNA, 19 bp, Homo sapiens
gaatgtccccattctataa

SEQ ID NO: 2274167 - DNA, 21 bp, Homo sapiens
gaatgtccccattctataaat

SEQ ID NO: 2274168 - DNA, 13 bp, Homo sapiens
gaatgttaacatg

SEQ ID NO: 2274169 - DNA, 15 bp, Homo sapiens
gaatgttgttaaatg

SEQ ID NO: 2274170 - DNA, 17 bp, Homo sapiens
gaatgttgttaaatgct

SEQ ID NO: 2274171 - DNA, 18 bp, Homo sapiens
gaatgttgttaaatgcta

SEQ ID NO: 2274172 - DNA, 15 bp, Homo sapiens
gaatgtttcctgtgg

SEQ ID NO: 2274173 - DNA, 16 bp, Homo sapiens
gaatgtttcctgtgga

SEQ ID NO: 2274174 - DNA, 22 bp, Homo sapiens
gaatgtttcctgtggaaatatg

SEQ ID NO: 2274175 - DNA, 20 bp, Homo sapiens
gaattaaggaaaaataagtg

SEQ ID NO: 2274176 - DNA, 12 bp, Homo sapiens
gaattcataaaa

SEQ ID NO: 2274177 - DNA, 15 bp, Homo sapiens
gaattcataaaaata

SEQ ID NO: 2274178 - DNA, 18 bp, Homo sapiens
gaattctaagattgtaca

SEQ ID NO: 2274179 - DNA, 19 bp, Homo sapiens
gaattgaaccgtcaatgtg

SEQ ID NO: 2274180 - DNA, 14 bp, Homo sapiens
gaatttatttatgt

SEQ ID NO: 2274181 - DNA, 18 bp, Homo sapiens
gaatttcccaaagcagtg

SEQ ID NO: 2274182 - DNA, 22 bp, Homo sapiens
gaatttcccaaagcagtgcatg

SEQ ID NO: 2274183 - DNA, 14 bp, Homo sapiens
gaattttgcttcct

SEQ ID NO: 2274184 - DNA, 15 bp, Homo sapiens
gacaaggggtggaag

SEQ ID NO: 2274185 - DNA, 12 bp, Homo sapiens
gacaatgcaaac

SEQ ID NO: 2274186 - DNA, 20 bp, Homo sapiens
gacaatttgccatagcagtg

SEQ ID NO: 2274187 - DNA, 14 bp, Homo sapiens
gacaccccacttag

SEQ ID NO: 2274188 - DNA, 15 bp, Homo sapiens
gacacgaatattgct

SEQ ID NO: 2274189 - DNA, 19 bp, Homo sapiens
gacacgaatattgctgatg

SEQ ID NO: 2274190 - DNA, 22 bp, Homo sapiens
gacacgaatattgctgatggtg

SEQ ID NO: 2274191 - DNA, 16 bp, Homo sapiens
gacacggaccctgtgt

SEQ ID NO: 2274192 - DNA, 19 bp, Homo sapiens
gacacggcctctggggaga

SEQ ID NO: 2274193 - DNA, 21 bp, Homo sapiens
gacactagtagagcaaagact

SEQ ID NO: 2274194 - DNA, 19 bp, Homo sapiens
gacactgatgggtcctgct

SEQ ID NO: 2274195 - DNA, 20 bp, Homo sapiens
gacactgatgggtcctgctg

SEQ ID NO: 2274196 - DNA, 23 bp, Homo sapiens
gacactgatgggtcctgctgctc

SEQ ID NO: 2274197 - DNA, 14 bp, Homo sapiens
gacactggtctcag

SEQ ID NO: 2274198 - DNA, 20 bp, Homo sapiens
gacagaatgagagagaaaag

SEQ ID NO: 2274199 - DNA, 17 bp, Homo sapiens
gacagatgggtgtcccc

SEQ ID NO: 2274200 - DNA, 22 bp, Homo sapiens
gacagatgggtgtcccctggtg

SEQ ID NO: 2274201 - DNA, 17 bp, Homo sapiens
gacagattcagtcttgc

SEQ ID NO: 2274202 - DNA, 17 bp, Homo sapiens
gacagcggcccggccca

SEQ ID NO: 2274203 - DNA, 19 bp, Homo sapiens
gacaggaacacccagcccc

SEQ ID NO: 2274204 - DNA, 18 bp, Homo sapiens
gacaggacttgtgcgccg

SEQ ID NO: 2274205 - DNA, 17 bp, Homo sapiens
gacaggaggccatgccc

SEQ ID NO: 2274206 - DNA, 18 bp, Homo sapiens
gacaggattgtctgctgc

SEQ ID NO: 2274207 - DNA, 21 bp, Homo sapiens
gacaggattgtctgctgcctc

SEQ ID NO: 2274208 - DNA, 16 bp, Homo sapiens
gacaggccagtagggg

SEQ ID NO: 2274209 - DNA, 11 bp, Homo sapiens
gctcagggccg

SEQ ID NO: 2274210 - DNA, 15 bp, Homo sapiens
gctcagtcccacagc

SEQ ID NO: 2274211 - DNA, 19 bp, Homo sapiens
gctccaacctggaggctgg

SEQ ID NO: 2274212 - DNA, 20 bp, Homo sapiens
gctccaacctggaggctgga

SEQ ID NO: 2274213 - DNA, 22 bp, Homo sapiens
gctccaacctggaggctggacc

SEQ ID NO: 2274214 - DNA, 21 bp, Homo sapiens
gctccaactccaacatccact

SEQ ID NO: 2274215 - DNA, 20 bp, Homo sapiens
gctccaccctcccctcttct

SEQ ID NO: 2274216 - DNA, 14 bp, Homo sapiens
gctccagatcctct

SEQ ID NO: 2274217 - DNA, 18 bp, Homo sapiens
gctccagtgttttcttgt

SEQ ID NO: 2274218 - DNA, 14 bp, Homo sapiens
gctccggcagaggc

SEQ ID NO: 2274219 - DNA, 20 bp, Homo sapiens
gctccggcagaggcagggcc

SEQ ID NO: 2274220 - DNA, 21 bp, Homo sapiens
gctccgggacgtggcacctcc

SEQ ID NO: 2274221 - DNA, 22 bp, Homo sapiens
gctccgggacgtggcacctcct

SEQ ID NO: 2274222 - DNA, 22 bp, Homo sapiens
gctcctcggccagagctcccag

SEQ ID NO: 2274223 - DNA, 13 bp, Homo sapiens
gctcctctgcagc

SEQ ID NO: 2274224 - DNA, 14 bp, Homo sapiens
gctcctctgcagcc

SEQ ID NO: 2274225 - DNA, 18 bp, Homo sapiens
gctcctctgcagcctgag

SEQ ID NO: 2274226 - DNA, 19 bp, Homo sapiens
gaccctcggggcaggaagt

SEQ ID NO: 2274227 - DNA, 18 bp, Homo sapiens
gaccctggagcccggcag

SEQ ID NO: 2274228 - DNA, 23 bp, Homo sapiens
gaccctggagcccggcagtgcac

SEQ ID NO: 2274229 - DNA, 12 bp, Homo sapiens
gaccctgggaga

SEQ ID NO: 2274230 - DNA, 18 bp, Homo sapiens
gaccgagtgtggagctgc

SEQ ID NO: 2274231 - DNA, 21 bp, Homo sapiens
gaccgagtgtggagctgcttc

SEQ ID NO: 2274232 - DNA, 23 bp, Homo sapiens
gaccgggagcctgcgtggcctgg

SEQ ID NO: 2274233 - DNA, 12 bp, Homo sapiens
gaccggggtcct

SEQ ID NO: 2274234 - DNA, 17 bp, Homo sapiens
gacctacatctgaaatc

SEQ ID NO: 2274235 - DNA, 17 bp, Homo sapiens
gacctactacgcagagg

SEQ ID NO: 2274236 - DNA, 16 bp, Homo sapiens
gacctatctgtaagag

SEQ ID NO: 2274237 - DNA, 17 bp, Homo sapiens
gacctccacctgggaga

SEQ ID NO: 2274238 - DNA, 22 bp, Homo sapiens
gacctccagattattttctata

SEQ ID NO: 2274239 - DNA, 14 bp, Homo sapiens
gacctccctggctt

SEQ ID NO: 2274240 - DNA, 15 bp, Homo sapiens
gacctgacacctgcc

SEQ ID NO: 2274241 - DNA, 21 bp, Homo sapiens
gacctgacacctgccgctgct

SEQ ID NO: 2274242 - DNA, 16 bp, Homo sapiens
gacctgggccctggtt

SEQ ID NO: 2274243 - DNA, 17 bp, Homo sapiens
gacctgggccctggttc

SEQ ID NO: 2274244 - DNA, 16 bp, Homo sapiens
gacctggggtcccccc

SEQ ID NO: 2274245 - DNA, 20 bp, Homo sapiens
gacgaggcctttgctttaca

SEQ ID NO: 2274246 - DNA, 18 bp, Homo sapiens
gacgcagggagaccctgg

SEQ ID NO: 2274247 - DNA, 22 bp, Homo sapiens
gacggagccactggggtgggag

SEQ ID NO: 2274248 - DNA, 23 bp, Homo sapiens
gacggagccactggggtgggagg

SEQ ID NO: 2274249 - DNA, 14 bp, Homo sapiens
gacggcagccccat

SEQ ID NO: 2274250 - DNA, 18 bp, Homo sapiens
gacggcagccccatcctt

SEQ ID NO: 2274251 - DNA, 21 bp, Homo sapiens
gacggcgagaaatgcctctgg

SEQ ID NO: 2274252 - DNA, 19 bp, Homo sapiens
gacgggacagcggcccggc

SEQ ID NO: 2274253 - DNA, 21 bp, Homo sapiens
gacgggacagcggcccggccc

SEQ ID NO: 2274254 - DNA, 15 bp, Homo sapiens
gacggggcagagctg

SEQ ID NO: 2274255 - DNA, 19 bp, Homo sapiens
gacggggcccgccccaggc

SEQ ID NO: 2274256 - DNA, 16 bp, Homo sapiens
gacggtctgtgcccga

SEQ ID NO: 2274257 - DNA, 15 bp, Homo sapiens
gacgtgagtggggag

SEQ ID NO: 2274258 - DNA, 16 bp, Homo sapiens
gacgtggcacctcctc

SEQ ID NO: 2274259 - DNA, 22 bp, Homo sapiens
gacgtgttatgactccagaatt

SEQ ID NO: 2274260 - DNA, 20 bp, Homo sapiens
gactaaatttggggacagat

SEQ ID NO: 2274261 - DNA, 20 bp, Homo sapiens
gactagcaaacaaaaataga

SEQ ID NO: 2274262 - DNA, 11 bp, Homo sapiens
gactagcagct

SEQ ID NO: 2274263 - DNA, 23 bp, Homo sapiens
gactcagcactgttttcatcaca

SEQ ID NO: 2274264 - DNA, 16 bp, Homo sapiens
gactcaggaagcaggg

SEQ ID NO: 2274265 - DNA, 20 bp, Homo sapiens
gactcagttcttggcctgct

SEQ ID NO: 2274266 - DNA, 18 bp, Homo sapiens
gactccccctccccggca

SEQ ID NO: 2274267 - DNA, 16 bp, Homo sapiens
gactcgagagggctga

SEQ ID NO: 2274268 - DNA, 17 bp, Homo sapiens
gactcgagagggctgag

SEQ ID NO: 2274269 - DNA, 18 bp, Homo sapiens
gactcgagagggctgagc

SEQ ID NO: 2274270 - DNA, 19 bp, Homo sapiens
gactcgcgacaatgcaaac

SEQ ID NO: 2274271 - DNA, 23 bp, Homo sapiens
gactcgggctaagtccagctctc

SEQ ID NO: 2274272 - DNA, 12 bp, Homo sapiens
gactctccaggc

SEQ ID NO: 2274273 - DNA, 23 bp, Homo sapiens
gactctccaggcaccgcctgccc

SEQ ID NO: 2274274 - DNA, 13 bp, Homo sapiens
gactctccaggga

SEQ ID NO: 2274275 - DNA, 15 bp, Homo sapiens
gactctgccttccag

SEQ ID NO: 2274276 - DNA, 22 bp, Homo sapiens
gactctggaaccatcctctgtt

SEQ ID NO: 2274277 - DNA, 19 bp, Homo sapiens
gactcttgggccgtcccca

SEQ ID NO: 2274278 - DNA, 14 bp, Homo sapiens
gactgaagggacta

SEQ ID NO: 2274279 - DNA, 15 bp, Homo sapiens
gactgaatttaacta

SEQ ID NO: 2274280 - DNA, 17 bp, Homo sapiens
gactgcccaccctgggc

SEQ ID NO: 2274281 - DNA, 18 bp, Homo sapiens
gactgcccaccctgggcc

SEQ ID NO: 2274282 - DNA, 17 bp, Homo sapiens
gactgctcaggctcccc

SEQ ID NO: 2274283 - DNA, 19 bp, Homo sapiens
gactgctcaggctccccaa

SEQ ID NO: 2274284 - DNA, 20 bp, Homo sapiens
gactgctcaggctccccaag

SEQ ID NO: 2274285 - DNA, 22 bp, Homo sapiens
gactgctcaggctccccaagac

SEQ ID NO: 2274286 - DNA, 20 bp, Homo sapiens
gactgggtgggccccacagt

SEQ ID NO: 2274287 - DNA, 22 bp, Homo sapiens
gactgttctaactagtaatctt

SEQ ID NO: 2274288 - DNA, 20 bp, Homo sapiens
gacttatatatttgaaagaa

SEQ ID NO: 2274289 - DNA, 15 bp, Homo sapiens
gacttcacaaaatgc

SEQ ID NO: 2274290 - DNA, 14 bp, Homo sapiens
gacttcccagctgg

SEQ ID NO: 2274291 - DNA, 16 bp, Homo sapiens
gacttcccagctggca

SEQ ID NO: 2274292 - DNA, 22 bp, Homo sapiens
gacttcccagctggcagcgcct

SEQ ID NO: 2274293 - DNA, 21 bp, Homo sapiens
gacttcgggggcggctctggg

SEQ ID NO: 2274294 - DNA, 23 bp, Homo sapiens
gacttgtgcgccggcgccccgga

SEQ ID NO: 2274295 - DNA, 22 bp, Homo sapiens
gactttaagaagcgaacaaaaa

SEQ ID NO: 2274296 - DNA, 18 bp, Homo sapiens
gagaaaatgctttctcat

SEQ ID NO: 2274297 - DNA, 21 bp, Homo sapiens
gagaaaatggacgtgttatga

SEQ ID NO: 2274298 - DNA, 19 bp, Homo sapiens
gagaaattacaggttcctt

SEQ ID NO: 2274299 - DNA, 16 bp, Homo sapiens
gagaagggcgcaggaa

SEQ ID NO: 2274300 - DNA, 20 bp, Homo sapiens
gagacactggtctcagagga

SEQ ID NO: 2274301 - DNA, 19 bp, Homo sapiens
gagacagggtctcactgtg

SEQ ID NO: 2274302 - DNA, 15 bp, Homo sapiens
gagaccctgggagag

SEQ ID NO: 2274303 - DNA, 20 bp, Homo sapiens
gagaccgagtgtggagctgc

SEQ ID NO: 2274304 - DNA, 14 bp, Homo sapiens
gagactcaggccca

SEQ ID NO: 2274305 - DNA, 16 bp, Homo sapiens
gagactcgcgacaatg

SEQ ID NO: 2274306 - DNA, 21 bp, Homo sapiens
gagactcgcgacaatgcaaac

SEQ ID NO: 2274307 - DNA, 20 bp, Homo sapiens
gagactctgtgatctaagca

SEQ ID NO: 2274308 - DNA, 16 bp, Homo sapiens
gagactgcccaccctg

SEQ ID NO: 2274309 - DNA, 19 bp, Homo sapiens
gagactgcccaccctgggc

SEQ ID NO: 2274310 - DNA, 23 bp, Homo sapiens
gagactgtttgaatcttgtctca

SEQ ID NO: 2274311 - DNA, 22 bp, Homo sapiens
gagacttccttgtgtcagggca

SEQ ID NO: 2274312 - DNA, 19 bp, Homo sapiens
gagactttccgactgcttt

SEQ ID NO: 2274313 - DNA, 13 bp, Homo sapiens
gagagaggcctgg

SEQ ID NO: 2274314 - DNA, 18 bp, Homo sapiens
gagagaggcctgggtgtg

SEQ ID NO: 2274315 - DNA, 23 bp, Homo sapiens
gagagatgtctgttctaagtcca

SEQ ID NO: 2274316 - DNA, 14 bp, Homo sapiens
gagagcgccacccg

SEQ ID NO: 2274317 - DNA, 16 bp, Homo sapiens
gagagcgccacccgcc

SEQ ID NO: 2274318 - DNA, 18 bp, Homo sapiens
gagagctgggactcagtt

SEQ ID NO: 2274319 - DNA, 20 bp, Homo sapiens
gagaggatttggctcgctgt

SEQ ID NO: 2274320 - DNA, 22 bp, Homo sapiens
gagaggcatccagtatcttgaa

SEQ ID NO: 2274321 - DNA, 14 bp, Homo sapiens
gagaggcctgggtg

SEQ ID NO: 2274322 - DNA, 16 bp, Homo sapiens
gagagggctgagcccc

SEQ ID NO: 2274323 - DNA, 22 bp, Homo sapiens
gagagtgaggtcatcccggggc

SEQ ID NO: 2274324 - DNA, 15 bp, Homo sapiens
gagataaactgaaat

SEQ ID NO: 2274325 - DNA, 12 bp, Homo sapiens
gagataaatatt

SEQ ID NO: 2274326 - DNA, 15 bp, Homo sapiens
gagataaatatttat

SEQ ID NO: 2274327 - DNA, 19 bp, Homo sapiens
gagataagtaggctggttt

SEQ ID NO: 2274328 - DNA, 13 bp, Homo sapiens
gagatactttttc

SEQ ID NO: 2274329 - DNA, 23 bp, Homo sapiens
gagatactttttcttttgtaagt

SEQ ID NO: 2274330 - DNA, 11 bp, Homo sapiens
gagatcagcat

SEQ ID NO: 2274331 - DNA, 17 bp, Homo sapiens
gagatccgccctgggct

SEQ ID NO: 2274332 - DNA, 14 bp, Homo sapiens
gagatggcagagcc

SEQ ID NO: 2274333 - DNA, 18 bp, Homo sapiens
gagatgtaccatgttaaa

SEQ ID NO: 2274334 - DNA, 15 bp, Homo sapiens
gagatgtcaaaatgt

SEQ ID NO: 2274335 - DNA, 23 bp, Homo sapiens
gagatgtctgttctaagtccact

SEQ ID NO: 2274336 - DNA, 17 bp, Homo sapiens
gagatttgtatttatat

SEQ ID NO: 2274337 - DNA, 11 bp, Homo sapiens
gagcaaagcag

SEQ ID NO: 2274338 - DNA, 23 bp, Homo sapiens
gcaataaggggagagtaaccctg

SEQ ID NO: 2274339 - DNA, 18 bp, Homo sapiens
gcaatactgccgctgccc

SEQ ID NO: 2274340 - DNA, 17 bp, Homo sapiens
gcaatgacctttcaata

SEQ ID NO: 2274341 - DNA, 19 bp, Homo sapiens
gcaatgatcagacttgatt

SEQ ID NO: 2274342 - DNA, 20 bp, Homo sapiens
gcaatgatcagacttgattt

SEQ ID NO: 2274343 - DNA, 17 bp, Homo sapiens
gcaatgtttttctcaaa

SEQ ID NO: 2274344 - DNA, 23 bp, Homo sapiens
gcaatgtttttctcaaaaagctg

SEQ ID NO: 2274345 - DNA, 19 bp, Homo sapiens
gcaattaaagacatttaaa

SEQ ID NO: 2274346 - DNA, 16 bp, Homo sapiens
gcacaaactgtcgtct

SEQ ID NO: 2274347 - DNA, 20 bp, Homo sapiens
gcacaaagggcaggcctgtt

SEQ ID NO: 2274348 - DNA, 18 bp, Homo sapiens
gcacacatgcatcctccc

SEQ ID NO: 2274349 - DNA, 21 bp, Homo sapiens
gcacacatgcatcctcccctc

SEQ ID NO: 2274350 - DNA, 16 bp, Homo sapiens
gcacacattggccgct

SEQ ID NO: 2274351 - DNA, 12 bp, Homo sapiens
gcacagaacagg

SEQ ID NO: 2274352 - DNA, 19 bp, Homo sapiens
gcacagaacaggaggtgtg

SEQ ID NO: 2274353 - DNA, 19 bp, Homo sapiens
gcacagataaaaagtggaa

SEQ ID NO: 2274354 - DNA, 20 bp, Homo sapiens
gcacagataaaaagtggaat

SEQ ID NO: 2274355 - DNA, 20 bp, Homo sapiens
gcacagcctcacccctgcag

SEQ ID NO: 2274356 - DNA, 19 bp, Homo sapiens
gcacagctaacatggaagt

SEQ ID NO: 2274357 - DNA, 13 bp, Homo sapiens
gcacaggctgccc

SEQ ID NO: 2274358 - DNA, 18 bp, Homo sapiens
gcacaggctgccccaccc

SEQ ID NO: 2274359 - DNA, 19 bp, Homo sapiens
gcacaggctgccccacccc

SEQ ID NO: 2274360 - DNA, 16 bp, Homo sapiens
gcacatatacatctag

SEQ ID NO: 2274361 - DNA, 15 bp, Homo sapiens
gcacatctcacttca

SEQ ID NO: 2274362 - DNA, 21 bp, Homo sapiens
gcacatctcacttcagttgtg

SEQ ID NO: 2274363 - DNA, 21 bp, Homo sapiens
gcacattaggaacagagtata

SEQ ID NO: 2274364 - DNA, 17 bp, Homo sapiens
gcaccactcaagaccaa

SEQ ID NO: 2274365 - DNA, 18 bp, Homo sapiens
gcaccactcaagaccaaa

SEQ ID NO: 2274366 - DNA, 16 bp, Homo sapiens
gcaccagatgacacat

SEQ ID NO: 2274367 - DNA, 15 bp, Homo sapiens
gcaccagcctgagcc

SEQ ID NO: 2274368 - DNA, 17 bp, Homo sapiens
gcacccccagcctcccc

SEQ ID NO: 2274369 - DNA, 18 bp, Homo sapiens
gcacccccagcctccccc

SEQ ID NO: 2274370 - DNA, 23 bp, Homo sapiens
gcacccggcagccccccagtgtc

SEQ ID NO: 2274371 - DNA, 14 bp, Homo sapiens
gcaccctggctgga

SEQ ID NO: 2274372 - DNA, 13 bp, Homo sapiens
gcaccgccatgca

SEQ ID NO: 2274373 - DNA, 15 bp, Homo sapiens
gcaccgcccaacccc

SEQ ID NO: 2274374 - DNA, 16 bp, Homo sapiens
gcaccgcctgccccca

SEQ ID NO: 2274375 - DNA, 18 bp, Homo sapiens
gcaccgtggtgtgaggcc

SEQ ID NO: 2274376 - DNA, 13 bp, Homo sapiens
gcacgggagagcg

SEQ ID NO: 2274377 - DNA, 20 bp, Homo sapiens
gcacgggagagcgccacccg

SEQ ID NO: 2274378 - DNA, 22 bp, Homo sapiens
gcacgggagagcgccacccgcc

SEQ ID NO: 2274379 - DNA, 19 bp, Homo sapiens
gcacggtggctcacacctg

SEQ ID NO: 2274380 - DNA, 17 bp, Homo sapiens
gcacggttgcctgaggt

SEQ ID NO: 2274381 - DNA, 18 bp, Homo sapiens
gcacggttgcctgaggtc

SEQ ID NO: 2274382 - DNA, 13 bp, Homo sapiens
gcactcccagggc

SEQ ID NO: 2274383 - DNA, 11 bp, Homo sapiens
gcactcctgcc

SEQ ID NO: 2274384 - DNA, 13 bp, Homo sapiens
gcactcctgcccc

SEQ ID NO: 2274385 - DNA, 18 bp, Homo sapiens
gcactcctgccccggccc

SEQ ID NO: 2274386 - DNA, 21 bp, Homo sapiens
gcactgccattagactgaatt

SEQ ID NO: 2274387 - DNA, 22 bp, Homo sapiens
gcactgggaatttatttatgtt

SEQ ID NO: 2274388 - DNA, 13 bp, Homo sapiens
gcactgtttcttc

SEQ ID NO: 2274389 - DNA, 20 bp, Homo sapiens
gcacttctggaatactgaaa

SEQ ID NO: 2274390 - DNA, 18 bp, Homo sapiens
gcacttctggggccagcc

SEQ ID NO: 2274391 - DNA, 19 bp, Homo sapiens
gcacttctggggccagccc

SEQ ID NO: 2274392 - DNA, 20 bp, Homo sapiens
gcacttctggggccagcccc

SEQ ID NO: 2274393 - DNA, 17 bp, Homo sapiens
gcacttctgttatcagg

SEQ ID NO: 2274394 - DNA, 20 bp, Homo sapiens
gcacttgattaagcttttgt

SEQ ID NO: 2274395 - DNA, 17 bp, Homo sapiens
gcacttgtgatcctaaa

SEQ ID NO: 2274396 - DNA, 19 bp, Homo sapiens
gcagaaatgtggatgctct

SEQ ID NO: 2274397 - DNA, 17 bp, Homo sapiens
gcagaacggtttttgga

SEQ ID NO: 2274398 - DNA, 18 bp, Homo sapiens
gcagacactcaagagccc

SEQ ID NO: 2274399 - DNA, 15 bp, Homo sapiens
gcagagacggcagcc

SEQ ID NO: 2274400 - DNA, 16 bp, Homo sapiens
gcagagacggcagccc

SEQ ID NO: 2274401 - DNA, 17 bp, Homo sapiens
gcagagacggcagcccc

SEQ ID NO: 2274402 - DNA, 19 bp, Homo sapiens
gcagagacggcagccccat

SEQ ID NO: 2274403 - DNA, 22 bp, Homo sapiens
gcagagccatccaccctgagga

SEQ ID NO: 2274404 - DNA, 14 bp, Homo sapiens
gcagagccccggag

SEQ ID NO: 2274405 - DNA, 13 bp, Homo sapiens
gcagagctgagtc

SEQ ID NO: 2274406 - DNA, 20 bp, Homo sapiens
gcagagctgagtcggctggg

SEQ ID NO: 2274407 - DNA, 15 bp, Homo sapiens
gcagatcctgtccca

SEQ ID NO: 2274408 - DNA, 16 bp, Homo sapiens
gcagatttcagatgta

SEQ ID NO: 2274409 - DNA, 15 bp, Homo sapiens
gcagcaaccagagca

SEQ ID NO: 2274410 - DNA, 17 bp, Homo sapiens
gcagcaaccagagcact

SEQ ID NO: 2274411 - DNA, 18 bp, Homo sapiens
gcagcaaccagagcactg

SEQ ID NO: 2274412 - DNA, 13 bp, Homo sapiens
gcagcaccagcct

SEQ ID NO: 2274413 - DNA, 20 bp, Homo sapiens
gcagcaccagcctgagccac

SEQ ID NO: 2274414 - DNA, 23 bp, Homo sapiens
gcagcaccagcctgagccacagt

SEQ ID NO: 2274415 - DNA, 16 bp, Homo sapiens
gcagcatggagagagg

SEQ ID NO: 2274416 - DNA, 19 bp, Homo sapiens
gcagcccagaacgggcctc

SEQ ID NO: 2274417 - DNA, 21 bp, Homo sapiens
gcagcccagaacgggcctccc

SEQ ID NO: 2274418 - DNA, 22 bp, Homo sapiens
gcagcccagaacgggcctcccc

SEQ ID NO: 2274419 - DNA, 23 bp, Homo sapiens
gcagcccagaacgggcctccccg

SEQ ID NO: 2274420 - DNA, 17 bp, Homo sapiens
gcagccccatccttccc

SEQ ID NO: 2274421 - DNA, 11 bp, Homo sapiens
gcagcccctgc

SEQ ID NO: 2274422 - DNA, 15 bp, Homo sapiens
gcagcccctgctgga

SEQ ID NO: 2274423 - DNA, 18 bp, Homo sapiens
gcagcccctgctggacca

SEQ ID NO: 2274424 - DNA, 18 bp, Homo sapiens
gcagccgccttcacagca

SEQ ID NO: 2274425 - DNA, 15 bp, Homo sapiens
gcagccgcgctctgc

SEQ ID NO: 2274426 - DNA, 21 bp, Homo sapiens
gcagccgcgctctgcccctcc

SEQ ID NO: 2274427 - DNA, 19 bp, Homo sapiens
gcagcctcgacctccctgg

SEQ ID NO: 2274428 - DNA, 21 bp, Homo sapiens
gcagcctcgacctccctggct

SEQ ID NO: 2274429 - DNA, 16 bp, Homo sapiens
gcagcctgagctccac

SEQ ID NO: 2274430 - DNA, 17 bp, Homo sapiens
gcagcctgagctccacc

SEQ ID NO: 2274431 - DNA, 18 bp, Homo sapiens
gcagcctgagctccaccc

SEQ ID NO: 2274432 - DNA, 21 bp, Homo sapiens
gcagcctgagctccaccctcc

SEQ ID NO: 2274433 - DNA, 15 bp, Homo sapiens
gcagcgcctcccgcc

SEQ ID NO: 2274434 - DNA, 17 bp, Homo sapiens
gcagcgcctcccgccgc

SEQ ID NO: 2274435 - DNA, 15 bp, Homo sapiens
gcagctcccaggttt

SEQ ID NO: 2274436 - DNA, 16 bp, Homo sapiens
gcagctggactgggtg

SEQ ID NO: 2274437 - DNA, 21 bp, Homo sapiens
gcaggaaccgaggactccagg

SEQ ID NO: 2274438 - DNA, 17 bp, Homo sapiens
gcaggaagagatgctct

SEQ ID NO: 2274439 - DNA, 16 bp, Homo sapiens
gcaggaagtccctgag

SEQ ID NO: 2274440 - DNA, 17 bp, Homo sapiens
gcaggaagtccctgaga

SEQ ID NO: 2274441 - DNA, 14 bp, Homo sapiens
gcaggagacactgg

SEQ ID NO: 2274442 - DNA, 22 bp, Homo sapiens
gcaggagacactggtctcagag

SEQ ID NO: 2274443 - DNA, 13 bp, Homo sapiens
gcaggagcaaggc

SEQ ID NO: 2274444 - DNA, 17 bp, Homo sapiens
gcaggagtgggctctga

SEQ ID NO: 2274445 - DNA, 23 bp, Homo sapiens
gcaggccctccgcgggggacagg

SEQ ID NO: 2274446 - DNA, 22 bp, Homo sapiens
gcaggcctgttccctgaggacc

SEQ ID NO: 2274447 - DNA, 22 bp, Homo sapiens
gcaggctcgggctccccagccc

SEQ ID NO: 2274448 - DNA, 16 bp, Homo sapiens
gcagggagaccctggg

SEQ ID NO: 2274449 - DNA, 14 bp, Homo sapiens
gcagggccctgggg

SEQ ID NO: 2274450 - DNA, 20 bp, Homo sapiens
gcagggccctggggtctctg

SEQ ID NO: 2274451 - DNA, 22 bp, Homo sapiens
gcagggccctggggtctctgag

SEQ ID NO: 2274452 - DNA, 12 bp, Homo sapiens
gcagggccctgt

SEQ ID NO: 2274453 - DNA, 16 bp, Homo sapiens
gcagggccctgtggct

SEQ ID NO: 2274454 - DNA, 19 bp, Homo sapiens
gcagggccctgtggctcca

SEQ ID NO: 2274455 - DNA, 14 bp, Homo sapiens
gcagggccgcaggg

SEQ ID NO: 2274456 - DNA, 18 bp, Homo sapiens
gcagggccgcagggcgct

SEQ ID NO: 2274457 - DNA, 14 bp, Homo sapiens
gcagggcgctccgg

SEQ ID NO: 2274458 - DNA, 20 bp, Homo sapiens
gcagggcgctccggcagagg

SEQ ID NO: 2274459 - DNA, 18 bp, Homo sapiens
gcaggtggccagggctcc

SEQ ID NO: 2274460 - DNA, 15 bp, Homo sapiens
gcagtcagcggagag

SEQ ID NO: 2274461 - DNA, 20 bp, Homo sapiens
gcagtcagcggagaggaccc

SEQ ID NO: 2274462 - DNA, 14 bp, Homo sapiens
gcagtgaagatgtg

SEQ ID NO: 2274463 - DNA, 16 bp, Homo sapiens
gcagtgaagatgtgta

SEQ ID NO: 2274464 - DNA, 18 bp, Homo sapiens
gcagtgaagatgtgtaaa

SEQ ID NO: 2274465 - DNA, 17 bp, Homo sapiens
gcagtgacgtgagtggg

SEQ ID NO: 2274466 - DNA, 23 bp, Homo sapiens
gcagtgcagcaaccagagcactg

SEQ ID NO: 2274467 - DNA, 15 bp, Homo sapiens
gcagtgcatgctgtc

SEQ ID NO: 2274468 - DNA, 14 bp, Homo sapiens
gcagttaccgagga

SEQ ID NO: 2274469 - DNA, 17 bp, Homo sapiens
gctggccctgccctccc

SEQ ID NO: 2274470 - DNA, 19 bp, Homo sapiens
gctggccctgccctccccc

SEQ ID NO: 2274471 - DNA, 20 bp, Homo sapiens
gctggccctgccctccccca

SEQ ID NO: 2274472 - DNA, 18 bp, Homo sapiens
gctggccggtccaccccg

SEQ ID NO: 2274473 - DNA, 20 bp, Homo sapiens
gctggccggtccaccccgtc

SEQ ID NO: 2274474 - DNA, 14 bp, Homo sapiens
gctggcctgacaca

SEQ ID NO: 2274475 - DNA, 17 bp, Homo sapiens
gctggctgatcattgca

SEQ ID NO: 2274476 - DNA, 15 bp, Homo sapiens
gctggcttctccctg

SEQ ID NO: 2274477 - DNA, 19 bp, Homo sapiens
gctggcttctccctggact

SEQ ID NO: 2274478 - DNA, 19 bp, Homo sapiens
gctgggactcagttcttgg

SEQ ID NO: 2274479 - DNA, 20 bp, Homo sapiens
gctgggactcagttcttggc

SEQ ID NO: 2274480 - DNA, 18 bp, Homo sapiens
gctgggattacaggtgtg

SEQ ID NO: 2274481 - DNA, 18 bp, Homo sapiens
gctgggcagggccctgtg

SEQ ID NO: 2274482 - DNA, 22 bp, Homo sapiens
gctgggcagggccctgtggctc

SEQ ID NO: 2274483 - DNA, 14 bp, Homo sapiens
gctgggcagggccg

SEQ ID NO: 2274484 - DNA, 16 bp, Homo sapiens
gctgggcagggccgca

SEQ ID NO: 2274485 - DNA, 17 bp, Homo sapiens
gctgggcagggccgcag

SEQ ID NO: 2274486 - DNA, 18 bp, Homo sapiens
gctggggcttttgtgcca

SEQ ID NO: 2274487 - DNA, 20 bp, Homo sapiens
gctggggcttttgtgccagg

SEQ ID NO: 2274488 - DNA, 14 bp, Homo sapiens
gctgggtcgcccct

SEQ ID NO: 2274489 - DNA, 17 bp, Homo sapiens
gctgggtcgcccctcct

SEQ ID NO: 2274490 - DNA, 18 bp, Homo sapiens
gctgggtcgcccctcctc

SEQ ID NO: 2274491 - DNA, 12 bp, Homo sapiens
gctggtcacccc

SEQ ID NO: 2274492 - DNA, 19 bp, Homo sapiens
gctgtaagacggccttgga

SEQ ID NO: 2274493 - DNA, 21 bp, Homo sapiens
gctgtatgactgaagtaataa

SEQ ID NO: 2274494 - DNA, 24 bp, Homo sapiens
gctgtattttcttttatatctgta

SEQ ID NO: 2274495 - DNA, 19 bp, Homo sapiens
gctgtcaattacaggaagt

SEQ ID NO: 2274496 - DNA, 14 bp, Homo sapiens
gctgtccacccgcc

SEQ ID NO: 2274497 - DNA, 19 bp, Homo sapiens
gctgtcccttacgtgagtc

SEQ ID NO: 2274498 - DNA, 22 bp, Homo sapiens
gctgtcccttacgtgagtcctg

SEQ ID NO: 2274499 - DNA, 16 bp, Homo sapiens
gctgtggctcaacaca

SEQ ID NO: 2274500 - DNA, 21 bp, Homo sapiens
gctgtggctcaacacatgaga

SEQ ID NO: 2274501 - DNA, 15 bp, Homo sapiens
gctgtggggagctgg

SEQ ID NO: 2274502 - DNA, 16 bp, Homo sapiens
gctgtggggagctggt

SEQ ID NO: 2274503 - DNA, 14 bp, Homo sapiens
gctgttggaatgtt

SEQ ID NO: 2274504 - DNA, 21 bp, Homo sapiens
gctgttttatgtcatactctg

SEQ ID NO: 2274505 - DNA, 20 bp, Homo sapiens
gcttaaaagaaaatgttcac

SEQ ID NO: 2274506 - DNA, 15 bp, Homo sapiens
gcttaacataaactt

SEQ ID NO: 2274507 - DNA, 20 bp, Homo sapiens
gcttaagatgctaatagaaa

SEQ ID NO: 2274508 - DNA, 21 bp, Homo sapiens
gcttagctgaaacctaaggca

SEQ ID NO: 2274509 - DNA, 22 bp, Homo sapiens
gcttagtaatagatcacggcat

SEQ ID NO: 2274510 - DNA, 16 bp, Homo sapiens
gcttatcagaactcct

SEQ ID NO: 2274511 - DNA, 15 bp, Homo sapiens
gcttatgaaaacacc

SEQ ID NO: 2274512 - DNA, 18 bp, Homo sapiens
gcttatgaaagaggcagc

SEQ ID NO: 2274513 - DNA, 14 bp, Homo sapiens
gcttatttatattc

SEQ ID NO: 2274514 - DNA, 13 bp, Homo sapiens
gcttatttctaac

SEQ ID NO: 2274515 - DNA, 21 bp, Homo sapiens
gcttcaaggatcctgagccag

SEQ ID NO: 2274516 - DNA, 12 bp, Homo sapiens
gcttccagctca

SEQ ID NO: 2274517 - DNA, 21 bp, Homo sapiens
gcttccagttggactgtggcc

SEQ ID NO: 2274518 - DNA, 23 bp, Homo sapiens
gcttcgaggagataaactgaaat

SEQ ID NO: 2274519 - DNA, 17 bp, Homo sapiens
gcttcgtctcagaaggc

SEQ ID NO: 2274520 - DNA, 20 bp, Homo sapiens
gcttctaagggatccagaga

SEQ ID NO: 2274521 - DNA, 21 bp, Homo sapiens
gcttctaagggatccagagac

SEQ ID NO: 2274522 - DNA, 23 bp, Homo sapiens
gcttctaagggatccagagacct

SEQ ID NO: 2274523 - DNA, 17 bp, Homo sapiens
gcttctccctggactct

SEQ ID NO: 2274524 - DNA, 15 bp, Homo sapiens
gcttctgctgcctgt

SEQ ID NO: 2274525 - DNA, 19 bp, Homo sapiens
gcttctgctgcctgtttgg

SEQ ID NO: 2274526 - DNA, 11 bp, Homo sapiens
gcttgaatgct

SEQ ID NO: 2274527 - DNA, 13 bp, Homo sapiens
gcttgagtggaca

SEQ ID NO: 2274528 - DNA, 20 bp, Homo sapiens
ggactccaggggctggggac

SEQ ID NO: 2274529 - DNA, 18 bp, Homo sapiens
ggactcgcgagagggtgc

SEQ ID NO: 2274530 - DNA, 20 bp, Homo sapiens
ggactcgcgagagggtgccg

SEQ ID NO: 2274531 - DNA, 22 bp, Homo sapiens
ggactcgggctaagtccagctc

SEQ ID NO: 2274532 - DNA, 19 bp, Homo sapiens
ggactctgtggggccacac

SEQ ID NO: 2274533 - DNA, 17 bp, Homo sapiens
ggactgctcaggctccc

SEQ ID NO: 2274534 - DNA, 20 bp, Homo sapiens
ggactgctcaggctccccaa

SEQ ID NO: 2274535 - DNA, 19 bp, Homo sapiens
ggactgggtgggccccaca

SEQ ID NO: 2274536 - DNA, 21 bp, Homo sapiens
ggactgtcttcaaccctgccc

SEQ ID NO: 2274537 - DNA, 15 bp, Homo sapiens
ggactgtggcctcag

SEQ ID NO: 2274538 - DNA, 21 bp, Homo sapiens
ggagaacaggtgttcctcctc

SEQ ID NO: 2274539 - DNA, 23 bp, Homo sapiens
ggagaattccagttgtatttgaa

SEQ ID NO: 2274540 - DNA, 13 bp, Homo sapiens
ggagaccaggact

SEQ ID NO: 2274541 - DNA, 15 bp, Homo sapiens
ggagactatgtgtca

SEQ ID NO: 2274542 - DNA, 15 bp, Homo sapiens
ggagagcgccacccg

SEQ ID NO: 2274543 - DNA, 17 bp, Homo sapiens
ggagagcgccacccgcc

SEQ ID NO: 2274544 - DNA, 18 bp, Homo sapiens
ggagagcgccacccgccc

SEQ ID NO: 2274545 - DNA, 21 bp, Homo sapiens
ggagaggaccccattctggga

SEQ ID NO: 2274546 - DNA, 14 bp, Homo sapiens
ggagatccgccctg

SEQ ID NO: 2274547 - DNA, 12 bp, Homo sapiens
ggagcaaggctg

SEQ ID NO: 2274548 - DNA, 16 bp, Homo sapiens
ggagcaaggctgccct

SEQ ID NO: 2274549 - DNA, 21 bp, Homo sapiens
ggagcacccccagcctccccc

SEQ ID NO: 2274550 - DNA, 12 bp, Homo sapiens
ggagcacgaggc

SEQ ID NO: 2274551 - DNA, 16 bp, Homo sapiens
ggagcagagacggcag

SEQ ID NO: 2274552 - DNA, 22 bp, Homo sapiens
ggagcagcgtgcaggagcaagg

SEQ ID NO: 2274553 - DNA, 16 bp, Homo sapiens
ggagccactggggtgg

SEQ ID NO: 2274554 - DNA, 21 bp, Homo sapiens
ggagccactggggtgggaggg

SEQ ID NO: 2274555 - DNA, 22 bp, Homo sapiens
ggagcccgaagtctgctgctgt

SEQ ID NO: 2274556 - DNA, 16 bp, Homo sapiens
ggagcccgcctgcgcc

SEQ ID NO: 2274557 - DNA, 19 bp, Homo sapiens
ggagcccgcctgcgccccc

SEQ ID NO: 2274558 - DNA, 19 bp, Homo sapiens
ggagccctggggtttccac

SEQ ID NO: 2274559 - DNA, 23 bp, Homo sapiens
ggagcgggggctaactggcccca

SEQ ID NO: 2274560 - DNA, 14 bp, Homo sapiens
ggagctgtcaggca

SEQ ID NO: 2274561 - DNA, 13 bp, Homo sapiens
ggaggactgttct

SEQ ID NO: 2274562 - DNA, 11 bp, Homo sapiens
ggaggagcacc

SEQ ID NO: 2274563 - DNA, 16 bp, Homo sapiens
ggaggagttgtctgtc

SEQ ID NO: 2274564 - DNA, 20 bp, Homo sapiens
ggaggagttgtctgtcctgg

SEQ ID NO: 2274565 - DNA, 11 bp, Homo sapiens
ggaggcagcat

SEQ ID NO: 2274566 - DNA, 21 bp, Homo sapiens
ggaggcatgtgatgagaggaa

SEQ ID NO: 2274567 - DNA, 18 bp, Homo sapiens
ggaggccaaacacccaag

SEQ ID NO: 2274568 - DNA, 13 bp, Homo sapiens
ggaggcgcccacc

SEQ ID NO: 2274569 - DNA, 12 bp, Homo sapiens
ggaggctggacc

SEQ ID NO: 2274570 - DNA, 18 bp, Homo sapiens
ggaggctggaccaactgc

SEQ ID NO: 2274571 - DNA, 12 bp, Homo sapiens
ggaggcttccag

SEQ ID NO: 2274572 - DNA, 13 bp, Homo sapiens
ggaggcttccagc

SEQ ID NO: 2274573 - DNA, 13 bp, Homo sapiens
ggagggctgggca

SEQ ID NO: 2274574 - DNA, 18 bp, Homo sapiens
ggagggctgggcagggcc

SEQ ID NO: 2274575 - DNA, 16 bp, Homo sapiens
ggaggggcgggagtga

SEQ ID NO: 2274576 - DNA, 13 bp, Homo sapiens
ggaggggcttgga

SEQ ID NO: 2274577 - DNA, 13 bp, Homo sapiens
ggagggggcaggg

SEQ ID NO: 2274578 - DNA, 15 bp, Homo sapiens
ggaggggggcggtga

SEQ ID NO: 2274579 - DNA, 18 bp, Homo sapiens
ggaggtggggagggcctc

SEQ ID NO: 2274580 - DNA, 20 bp, Homo sapiens
ggaggtggggagggcctctg

SEQ ID NO: 2274581 - DNA, 17 bp, Homo sapiens
ggagtcagggagccctg

SEQ ID NO: 2274582 - DNA, 18 bp, Homo sapiens
ggagtcagggagccctgg

SEQ ID NO: 2274583 - DNA, 15 bp, Homo sapiens
ggagtccagacctgg

SEQ ID NO: 2274584 - DNA, 11 bp, Homo sapiens
ggagtccctcc

SEQ ID NO: 2274585 - DNA, 17 bp, Homo sapiens
ggagtccctgcaggtga

SEQ ID NO: 2274586 - DNA, 18 bp, Homo sapiens
ggagtctgattgcaggaa

SEQ ID NO: 2274587 - DNA, 17 bp, Homo sapiens
ggagtgatgggcaaggg

SEQ ID NO: 2274588 - DNA, 23 bp, Homo sapiens
ggagtggctgaccaggccctgct

SEQ ID NO: 2274589 - DNA, 18 bp, Homo sapiens
ggagtgggctctgagcag

SEQ ID NO: 2274590 - DNA, 16 bp, Homo sapiens
ggagttgtctgtcctg

SEQ ID NO: 2274591 - DNA, 13 bp, Homo sapiens
ggatatatttaaa

SEQ ID NO: 2274592 - DNA, 17 bp, Homo sapiens
ggatcaaccaagttaca

SEQ ID NO: 2274593 - DNA, 13 bp, Homo sapiens
ggatcataaagtt

SEQ ID NO: 2274594 - DNA, 15 bp, Homo sapiens
ggatcattatttcat

SEQ ID NO: 2274595 - DNA, 18 bp, Homo sapiens
ggcgtagggccagggctc

SEQ ID NO: 2274596 - DNA, 17 bp, Homo sapiens
ggctaactggccccagg

SEQ ID NO: 2274597 - DNA, 19 bp, Homo sapiens
ggctaactggccccaggcg

SEQ ID NO: 2274598 - DNA, 18 bp, Homo sapiens
ggctaagtccagctctcc

SEQ ID NO: 2274599 - DNA, 18 bp, Homo sapiens
ggctatgcctccatttca

SEQ ID NO: 2274600 - DNA, 15 bp, Homo sapiens
ggctattataatata

SEQ ID NO: 2274601 - DNA, 22 bp, Homo sapiens
ggctattataatatagaaagaa

SEQ ID NO: 2274602 - DNA, 14 bp, Homo sapiens
ggctcacccactgc

SEQ ID NO: 2274603 - DNA, 22 bp, Homo sapiens
ggctccacgggggcctagtggc

SEQ ID NO: 2274604 - DNA, 15 bp, Homo sapiens
ggctctatctgctgg

SEQ ID NO: 2274605 - DNA, 19 bp, Homo sapiens
ggctctatctgctgggctg

SEQ ID NO: 2274606 - DNA, 12 bp, Homo sapiens
ggctctggcccc

SEQ ID NO: 2274607 - DNA, 16 bp, Homo sapiens
ggctctggccccaaga

SEQ ID NO: 2274608 - DNA, 19 bp, Homo sapiens
ggctctgggttcgggaaga

SEQ ID NO: 2274609 - DNA, 22 bp, Homo sapiens
ggctgaaggatgggggctcctg

SEQ ID NO: 2274610 - DNA, 21 bp, Homo sapiens
ggctgaatcaaagacatttca

SEQ ID NO: 2274611 - DNA, 16 bp, Homo sapiens
ggctgaccaggccctg

SEQ ID NO: 2274612 - DNA, 19 bp, Homo sapiens
ggctgacccctccttgtaa

SEQ ID NO: 2274613 - DNA, 11 bp, Homo sapiens
ggctgagcccc

SEQ ID NO: 2274614 - DNA, 14 bp, Homo sapiens
ggctgagcccctcc

SEQ ID NO: 2274615 - DNA, 19 bp, Homo sapiens
ggctgccctgtccactctg

SEQ ID NO: 2274616 - DNA, 17 bp, Homo sapiens
ggctgcgcctgcccgcc

SEQ ID NO: 2274617 - DNA, 15 bp, Homo sapiens
ggctgctaagtggaa

SEQ ID NO: 2274618 - DNA, 16 bp, Homo sapiens
ggctgctaagtggaag

SEQ ID NO: 2274619 - DNA, 17 bp, Homo sapiens
ggctgctaagtggaaga

SEQ ID NO: 2274620 - DNA, 23 bp, Homo sapiens
ggctgctaagtggaagacagaga

SEQ ID NO: 2274621 - DNA, 15 bp, Homo sapiens
ggctgctctccatct

SEQ ID NO: 2274622 - DNA, 14 bp, Homo sapiens
ggctgcttcaagga

SEQ ID NO: 2274623 - DNA, 20 bp, Homo sapiens
ggctgcttcaaggatcctga

SEQ ID NO: 2274624 - DNA, 23 bp, Homo sapiens
ggctgcttcaaggatcctgagcc

SEQ ID NO: 2274625 - DNA, 15 bp, Homo sapiens
ggctggaccaactgc

SEQ ID NO: 2274626 - DNA, 23 bp, Homo sapiens
ggctggacctggggtcccccctc

SEQ ID NO: 2274627 - DNA, 16 bp, Homo sapiens
ggctggagggctgggc

SEQ ID NO: 2274628 - DNA, 21 bp, Homo sapiens
ggctggagggctgggcagggc

SEQ ID NO: 2274629 - DNA, 24 bp, Homo sapiens
ggctggagggctgggcagggccct

SEQ ID NO: 2274630 - DNA, 10 bp, Homo sapiens
ggctggccct

SEQ ID NO: 2274631 - DNA, 18 bp, Homo sapiens
ggctggccctgccctccc

SEQ ID NO: 2274632 - DNA, 14 bp, Homo sapiens
ggctgggcagggcc

SEQ ID NO: 2274633 - DNA, 16 bp, Homo sapiens
ggctgggcagggccct

SEQ ID NO: 2274634 - DNA, 19 bp, Homo sapiens
ggctgggcagggccctgtg

SEQ ID NO: 2274635 - DNA, 17 bp, Homo sapiens
ggctgggcagggccgca

SEQ ID NO: 2274636 - DNA, 18 bp, Homo sapiens
ggctgggcagggccgcag

SEQ ID NO: 2274637 - DNA, 19 bp, Homo sapiens
ggctggggcttttgtgcca

SEQ ID NO: 2274638 - DNA, 14 bp, Homo sapiens
ggctgggtcgcccc

SEQ ID NO: 2274639 - DNA, 19 bp, Homo sapiens
ggctgggtcgcccctcctc

SEQ ID NO: 2274640 - DNA, 21 bp, Homo sapiens
ggctgggtcgcccctcctcgg

SEQ ID NO: 2274641 - DNA, 19 bp, Homo sapiens
ggctgtgcgggcgcccgga

SEQ ID NO: 2274642 - DNA, 15 bp, Homo sapiens
ggcttccagctcagt

SEQ ID NO: 2274643 - DNA, 21 bp, Homo sapiens
ggcttccagctcagtcccaca

SEQ ID NO: 2274644 - DNA, 17 bp, Homo sapiens
ggcttcgtctcagaagg

SEQ ID NO: 2274645 - DNA, 18 bp, Homo sapiens
ggcttcgtctcagaaggc

SEQ ID NO: 2274646 - DNA, 13 bp, Homo sapiens
ggcttggagcaga

SEQ ID NO: 2274647 - DNA, 15 bp, Homo sapiens
ggcttggagcagaga

SEQ ID NO: 2274648 - DNA, 17 bp, Homo sapiens
ggcttggagcagagacg

SEQ ID NO: 2274649 - DNA, 17 bp, Homo sapiens
gggctgatttgggtctc

SEQ ID NO: 2274650 - DNA, 21 bp, Homo sapiens
gggctgccgtgcacggggcca

SEQ ID NO: 2274651 - DNA, 20 bp, Homo sapiens
gggctggagggctgggcagg

SEQ ID NO: 2274652 - DNA, 13 bp, Homo sapiens
gggctggccctgc

SEQ ID NO: 2274653 - DNA, 14 bp, Homo sapiens
gggctggccctgcc

SEQ ID NO: 2274654 - DNA, 16 bp, Homo sapiens
gggctggccctgccct

SEQ ID NO: 2274655 - DNA, 19 bp, Homo sapiens
gggctggccctgccctccc

SEQ ID NO: 2274656 - DNA, 21 bp, Homo sapiens
gggcttggctcgcacccccac

SEQ ID NO: 2274657 - DNA, 12 bp, Homo sapiens
gggctttaaata

SEQ ID NO: 2274658 - DNA, 22 bp, Homo sapiens
ggggaagagagaggcctgggtg

SEQ ID NO: 2274659 - DNA, 23 bp, Homo sapiens
ggggacaggattgtctgctgcct

SEQ ID NO: 2274660 - DNA, 15 bp, Homo sapiens
ggggactagacagtt

SEQ ID NO: 2274661 - DNA, 14 bp, Homo sapiens
ggggagctggtggg

SEQ ID NO: 2274662 - DNA, 16 bp, Homo sapiens
ggggaggagcaccccc

SEQ ID NO: 2274663 - DNA, 20 bp, Homo sapiens
ggggaggcacaaagggcagg

SEQ ID NO: 2274664 - DNA, 17 bp, Homo sapiens
ggggcacacttcccctt

SEQ ID NO: 2274665 - DNA, 14 bp, Homo sapiens
ggggcagagctgag

SEQ ID NO: 2274666 - DNA, 11 bp, Homo sapiens
ggggccagccc

SEQ ID NO: 2274667 - DNA, 13 bp, Homo sapiens
ggggccagcccct

SEQ ID NO: 2274668 - DNA, 15 bp, Homo sapiens
ggggccagcccctcc

SEQ ID NO: 2274669 - DNA, 17 bp, Homo sapiens
ggggccaggctgagccg

SEQ ID NO: 2274670 - DNA, 13 bp, Homo sapiens
ggggccgggctgg

SEQ ID NO: 2274671 - DNA, 17 bp, Homo sapiens
ggggcctagtggcttca

SEQ ID NO: 2274672 - DNA, 13 bp, Homo sapiens
ggggcgctgcccc

SEQ ID NO: 2274673 - DNA, 13 bp, Homo sapiens
ggggcgggagtga

SEQ ID NO: 2274674 - DNA, 13 bp, Homo sapiens
ggggcggggccag

SEQ ID NO: 2274675 - DNA, 20 bp, Homo sapiens
ggggcggtgaggtgggggca

SEQ ID NO: 2274676 - DNA, 17 bp, Homo sapiens
ggggctaacgggcgcct

SEQ ID NO: 2274677 - DNA, 15 bp, Homo sapiens
ggggctaactggccc

SEQ ID NO: 2274678 - DNA, 17 bp, Homo sapiens
ggggctaactggcccca

SEQ ID NO: 2274679 - DNA, 15 bp, Homo sapiens
ggggctggccctgcc

SEQ ID NO: 2274680 - DNA, 17 bp, Homo sapiens
ggggctggccctgccct

SEQ ID NO: 2274681 - DNA, 20 bp, Homo sapiens
ggggctggccctgccctccc

SEQ ID NO: 2274682 - DNA, 23 bp, Homo sapiens
ggggctggccctgccctccccca

SEQ ID NO: 2274683 - DNA, 15 bp, Homo sapiens
gggggaggagcaccc

SEQ ID NO: 2274684 - DNA, 18 bp, Homo sapiens
gggggcagggggcttggc

SEQ ID NO: 2274685 - DNA, 13 bp, Homo sapiens
gggggccaggctg

SEQ ID NO: 2274686 - DNA, 17 bp, Homo sapiens
gggggcctagtggcttc

SEQ ID NO: 2274687 - DNA, 16 bp, Homo sapiens
gggggcggctctggga

SEQ ID NO: 2274688 - DNA, 17 bp, Homo sapiens
gggggctaactggcccc

SEQ ID NO: 2274689 - DNA, 21 bp, Homo sapiens
ggggtaagttgaagggaaatc

SEQ ID NO: 2274690 - DNA, 16 bp, Homo sapiens
ggggtcccatcagtga

SEQ ID NO: 2274691 - DNA, 17 bp, Homo sapiens
ggggtcccccctccctg

SEQ ID NO: 2274692 - DNA, 18 bp, Homo sapiens
ggggtcccccctccctgt

SEQ ID NO: 2274693 - DNA, 15 bp, Homo sapiens
ggggtccccggacgc

SEQ ID NO: 2274694 - DNA, 16 bp, Homo sapiens
ggggtcctgaggctgg

SEQ ID NO: 2274695 - DNA, 20 bp, Homo sapiens
ggggtcgggggaggagcacc

SEQ ID NO: 2274696 - DNA, 22 bp, Homo sapiens
ggggtcgggggaggagcacccc

SEQ ID NO: 2274697 - DNA, 16 bp, Homo sapiens
ggggtggccactcctg

SEQ ID NO: 2274698 - DNA, 14 bp, Homo sapiens
gggtatcctgtgca

SEQ ID NO: 2274699 - DNA, 14 bp, Homo sapiens
gggtcccccctccc

SEQ ID NO: 2274700 - DNA, 12 bp, Homo sapiens
gggtccccggac

SEQ ID NO: 2274701 - DNA, 14 bp, Homo sapiens
gggtcctgctgctc

SEQ ID NO: 2274702 - DNA, 15 bp, Homo sapiens
gggtcgcccctcctc

SEQ ID NO: 2274703 - DNA, 16 bp, Homo sapiens
gggtcgggggaggagc

SEQ ID NO: 2274704 - DNA, 19 bp, Homo sapiens
gggtcgggggaggagcacc

SEQ ID NO: 2274705 - DNA, 20 bp, Homo sapiens
gggtctattttataagggca

SEQ ID NO: 2274706 - DNA, 22 bp, Homo sapiens
gggtctcactgtgttgcccagg

SEQ ID NO: 2274707 - DNA, 13 bp, Homo sapiens
gggtctctgagca

SEQ ID NO: 2274708 - DNA, 15 bp, Homo sapiens
gggtctctgagcagt

SEQ ID NO: 2274709 - DNA, 22 bp, Homo sapiens
gggtgcaggcgcgcaccgccca

SEQ ID NO: 2274710 - DNA, 18 bp, Homo sapiens
gggtgcgtgaccggcccg

SEQ ID NO: 2274711 - DNA, 16 bp, Homo sapiens
gggtggaagggcagga

SEQ ID NO: 2274712 - DNA, 19 bp, Homo sapiens
gggtgggagggggcagggg

SEQ ID NO: 2274713 - DNA, 21 bp, Homo sapiens
gggtgggagggggcagggggc

SEQ ID NO: 2274714 - DNA, 23 bp, Homo sapiens
gggtgggccccacagtggtcagc

SEQ ID NO: 2274715 - DNA, 13 bp, Homo sapiens
gggtgggccctgg

SEQ ID NO: 2274716 - DNA, 11 bp, Homo sapiens
gggtggggatg

SEQ ID NO: 2274717 - DNA, 15 bp, Homo sapiens
gggttacactgttaa

SEQ ID NO: 2274718 - DNA, 13 bp, Homo sapiens
gggttcgggaaga

SEQ ID NO: 2274719 - DNA, 23 bp, Homo sapiens
gggttgtctcagccgagcccagg

SEQ ID NO: 2274720 - DNA, 17 bp, Homo sapiens
gggttttagaaattcta

SEQ ID NO: 2274721 - DNA, 17 bp, Homo sapiens
ggtaagttgaagggaaa

SEQ ID NO: 2274722 - DNA, 16 bp, Homo sapiens
ggtagagttcctttct

SEQ ID NO: 2274723 - DNA, 12 bp, Homo sapiens
ggtatttcttat

SEQ ID NO: 2274724 - DNA, 20 bp, Homo sapiens
ggtattttcgtgcatttgtg

SEQ ID NO: 2274725 - DNA, 21 bp, Homo sapiens
ggtattttcgtgcatttgtga

SEQ ID NO: 2274726 - DNA, 23 bp, Homo sapiens
ggtcaaggcaccagcaaatttgg

SEQ ID NO: 2274727 - DNA, 15 bp, Homo sapiens
ggtcacagacccctg

SEQ ID NO: 2274728 - DNA, 14 bp, Homo sapiens
ggtcacccccaccc

SEQ ID NO: 2274729 - DNA, 21 bp, Homo sapiens
ggtcacctcactcagcaccac

SEQ ID NO: 2274730 - DNA, 17 bp, Homo sapiens
ggtcactggagtagttg

SEQ ID NO: 2274731 - DNA, 23 bp, Homo sapiens
ggtcagcaccgtggtgtgaggcc

SEQ ID NO: 2274732 - DNA, 15 bp, Homo sapiens
ggtcagcgattcctg

SEQ ID NO: 2274733 - DNA, 14 bp, Homo sapiens
ggtcagctcagagc

SEQ ID NO: 2274734 - DNA, 17 bp, Homo sapiens
ggtcagttttcacagag

SEQ ID NO: 2274735 - DNA, 14 bp, Homo sapiens
ggtccaccccgtcc

SEQ ID NO: 2274736 - DNA, 15 bp, Homo sapiens
ggtccaccccgtccc

SEQ ID NO: 2274737 - DNA, 18 bp, Homo sapiens
ggtcccatcagtgaaaga

SEQ ID NO: 2274738 - DNA, 15 bp, Homo sapiens
ggtcccccctccctg

SEQ ID NO: 2274739 - DNA, 20 bp, Homo sapiens
ggtccccggacgctggctcg

SEQ ID NO: 2274740 - DNA, 21 bp, Homo sapiens
ggtccccggacgctggctcgg

SEQ ID NO: 2274741 - DNA, 14 bp, Homo sapiens
ggtcctcttcctca

SEQ ID NO: 2274742 - DNA, 17 bp, Homo sapiens
ggtcctgaggctggggc

SEQ ID NO: 2274743 - DNA, 18 bp, Homo sapiens
ggtcctgaggctggggct

SEQ ID NO: 2274744 - DNA, 20 bp, Homo sapiens
ggtcgcccacgggtgtggct

SEQ ID NO: 2274745 - DNA, 14 bp, Homo sapiens
ggtcgcccctcctc

SEQ ID NO: 2274746 - DNA, 22 bp, Homo sapiens
ggtcgcgatgatgggctggagc

SEQ ID NO: 2274747 - DNA, 23 bp, Homo sapiens
ggtcgggggaggagcacccccag

SEQ ID NO: 2274748 - DNA, 16 bp, Homo sapiens
ggtctacactgcaatc

SEQ ID NO: 2274749 - DNA, 19 bp, Homo sapiens
ggtctcactgtgttgccca

SEQ ID NO: 2274750 - DNA, 22 bp, Homo sapiens
ggtctcactgtgttgcccaggc

SEQ ID NO: 2274751 - DNA, 23 bp, Homo sapiens
ggtctcactgtgttgcccaggct

SEQ ID NO: 2274752 - DNA, 14 bp, Homo sapiens
ggtctcagaggagg

SEQ ID NO: 2274753 - DNA, 23 bp, Homo sapiens
ggtctcagaggagggatagagac

SEQ ID NO: 2274754 - DNA, 19 bp, Homo sapiens
ggtctgagtgcaagttcat

SEQ ID NO: 2274755 - DNA, 11 bp, Homo sapiens
ggtctgtgccc

SEQ ID NO: 2274756 - DNA, 13 bp, Homo sapiens
ggtctgtgcccga

SEQ ID NO: 2274757 - DNA, 13 bp, Homo sapiens
ggtgaaagaacaa

SEQ ID NO: 2274758 - DNA, 15 bp, Homo sapiens
ggtgagggaggcctg

SEQ ID NO: 2274759 - DNA, 16 bp, Homo sapiens
ggtgcaatgacctttc

SEQ ID NO: 2274760 - DNA, 18 bp, Homo sapiens
ggtgcacacctgtaatcc

SEQ ID NO: 2274761 - DNA, 20 bp, Homo sapiens
ggtgcaggcgcgcaccgccc

SEQ ID NO: 2274762 - DNA, 18 bp, Homo sapiens
ggtgcagtaaccatttaa

SEQ ID NO: 2274763 - DNA, 23 bp, Homo sapiens
ggtgcattgtccttttcttttct

SEQ ID NO: 2274764 - DNA, 20 bp, Homo sapiens
ggtgcccaggacggtctgtg

SEQ ID NO: 2274765 - DNA, 22 bp, Homo sapiens
ggtgcccaggacggtctgtgcc

SEQ ID NO: 2274766 - DNA, 23 bp, Homo sapiens
ggtgcccaggacggtctgtgccc

SEQ ID NO: 2274767 - DNA, 15 bp, Homo sapiens
ggtgcctgagagcag

SEQ ID NO: 2274768 - DNA, 12 bp, Homo sapiens
ggtgcctgtgac

SEQ ID NO: 2274769 - DNA, 14 bp, Homo sapiens
ggtgcggaccggag

SEQ ID NO: 2274770 - DNA, 15 bp, Homo sapiens
ggtgcggaccggagc

SEQ ID NO: 2274771 - DNA, 16 bp, Homo sapiens
ggtgcgtgaccggccc

SEQ ID NO: 2274772 - DNA, 15 bp, Homo sapiens
ggtggaagggcagga

SEQ ID NO: 2274773 - DNA, 21 bp, Homo sapiens
ggtggaagggcaggagctcac

SEQ ID NO: 2274774 - DNA, 21 bp, Homo sapiens
ggtggcagtgcagcaaccaga

SEQ ID NO: 2274775 - DNA, 13 bp, Homo sapiens
ggtgggagggggc

SEQ ID NO: 2274776 - DNA, 13 bp, Homo sapiens
ggtgggccccaca

SEQ ID NO: 2274777 - DNA, 23 bp, Homo sapiens
ggtgggccccacagtggtcagcg

SEQ ID NO: 2274778 - DNA, 13 bp, Homo sapiens
ggtggggagggcc

SEQ ID NO: 2274779 - DNA, 15 bp, Homo sapiens
ggtggggagggcctc

SEQ ID NO: 2274780 - DNA, 13 bp, Homo sapiens
ggtgtgaatgcac

SEQ ID NO: 2274781 - DNA, 22 bp, Homo sapiens
ggtgtgacctgacacctgccgc

SEQ ID NO: 2274782 - DNA, 18 bp, Homo sapiens
ggtgtgagccacagcact

SEQ ID NO: 2274783 - DNA, 20 bp, Homo sapiens
ggtgtgttttgtcttcaact

SEQ ID NO: 2274784 - DNA, 22 bp, Homo sapiens
ggtgtttcaaagggtaaattat

SEQ ID NO: 2274785 - DNA, 14 bp, Homo sapiens
ggttggccggctgg

SEQ ID NO: 2274786 - DNA, 17 bp, Homo sapiens
gtggcagtgcagcaacc

SEQ ID NO: 2274787 - DNA, 22 bp, Homo sapiens
gtggcagtgcagcaaccagagc

SEQ ID NO: 2274788 - DNA, 19 bp, Homo sapiens
gtggcatggtcctgtgccc

SEQ ID NO: 2274789 - DNA, 10 bp, Homo sapiens
gtggccactc

SEQ ID NO: 2274790 - DNA, 14 bp, Homo sapiens
gtggccactcctgg

SEQ ID NO: 2274791 - DNA, 17 bp, Homo sapiens
gtggccactcctgggcc

SEQ ID NO: 2274792 - DNA, 22 bp, Homo sapiens
gtggccactcctgggccccaga

SEQ ID NO: 2274793 - DNA, 15 bp, Homo sapiens
gtggcctcaggaggc

SEQ ID NO: 2274794 - DNA, 18 bp, Homo sapiens
gtggcctcattcagcaga

SEQ ID NO: 2274795 - DNA, 14 bp, Homo sapiens
gtggcctggggctg

SEQ ID NO: 2274796 - DNA, 22 bp, Homo sapiens
gtggcgggaagggtgggccctg

SEQ ID NO: 2274797 - DNA, 23 bp, Homo sapiens
gtggcgggaagggtgggccctgg

SEQ ID NO: 2274798 - DNA, 14 bp, Homo sapiens
gtggctccaggagc

SEQ ID NO: 2274799 - DNA, 15 bp, Homo sapiens
gtggctgaccaggcc

SEQ ID NO: 2274800 - DNA, 20 bp, Homo sapiens
gtggctgatttcaaatgcag

SEQ ID NO: 2274801 - DNA, 19 bp, Homo sapiens
gtggctgcttcaaggatcc

SEQ ID NO: 2274802 - DNA, 23 bp, Homo sapiens
gtggctgtcctcttaagacacta

SEQ ID NO: 2274803 - DNA, 18 bp, Homo sapiens
gtggcttggagcagaggt

SEQ ID NO: 2274804 - DNA, 19 bp, Homo sapiens
gtggcttggagcagaggtg

SEQ ID NO: 2274805 - DNA, 17 bp, Homo sapiens
gtggctttcatttctta

SEQ ID NO: 2274806 - DNA, 13 bp, Homo sapiens
gtgggagggggca

SEQ ID NO: 2274807 - DNA, 14 bp, Homo sapiens
gtgggctctgagca

SEQ ID NO: 2274808 - DNA, 12 bp, Homo sapiens
gtggggccacac

SEQ ID NO: 2274809 - DNA, 16 bp, Homo sapiens
gtggggcccatggccc

SEQ ID NO: 2274810 - DNA, 23 bp, Homo sapiens
gtggggcccatggccccagctgg

SEQ ID NO: 2274811 - DNA, 16 bp, Homo sapiens
taaaaacattttaaaa

SEQ ID NO: 2274812 - DNA, 19 bp, Homo sapiens
taaaaacattttaaaatca

SEQ ID NO: 2274813 - DNA, 23 bp, Homo sapiens
taaaaacattttaaaatcaactt

SEQ ID NO: 2274814 - DNA, 23 bp, Homo sapiens
taaaaaccattataaaatctttc

SEQ ID NO: 2274815 - DNA, 12 bp, Homo sapiens
taaaaagcccaa

SEQ ID NO: 2274816 - DNA, 12 bp, Homo sapiens
taaaaagtggaa

SEQ ID NO: 2274817 - DNA, 18 bp, Homo sapiens
taaaaataaccaaaaaat

SEQ ID NO: 2274818 - DNA, 17 bp, Homo sapiens
taaaaatctacgtcttt

SEQ ID NO: 2274819 - DNA, 21 bp, Homo sapiens
taaaaatctacgtctttatta

SEQ ID NO: 2274820 - DNA, 12 bp, Homo sapiens
taaaaatctttc

SEQ ID NO: 2274821 - DNA, 18 bp, Homo sapiens
taaaaatctttcagaata

SEQ ID NO: 2274822 - DNA, 23 bp, Homo sapiens
taaaacacaacatctttttctac

SEQ ID NO: 2274823 - DNA, 15 bp, Homo sapiens
taaaacaggctgctt

SEQ ID NO: 2274824 - DNA, 18 bp, Homo sapiens
taaaagaatgtacagaaa

SEQ ID NO: 2274825 - DNA, 15 bp, Homo sapiens
taaaagctttagatt

SEQ ID NO: 2274826 - DNA, 20 bp, Homo sapiens
taaaagctttagattgaaat

SEQ ID NO: 2274827 - DNA, 21 bp, Homo sapiens
taaaagtgtcactaagaatat

SEQ ID NO: 2274828 - DNA, 12 bp, Homo sapiens
taaaataaatta

SEQ ID NO: 2274829 - DNA, 14 bp, Homo sapiens
tgttcttaaaatat

SEQ ID NO: 2274830 - DNA, 16 bp, Homo sapiens
tgttcttaaaatattg

SEQ ID NO: 2274831 - DNA, 15 bp, Homo sapiens
tgttctttgcagtga

SEQ ID NO: 2274832 - DNA, 15 bp, Homo sapiens
tgttgacaatttgcc

SEQ ID NO: 2274833 - DNA, 18 bp, Homo sapiens
tgttgaccaggctggagt

SEQ ID NO: 2274834 - DNA, 18 bp, Homo sapiens
tgttgatcagatcttaca

SEQ ID NO: 2274835 - DNA, 20 bp, Homo sapiens
tgttgccaggagatggaata

SEQ ID NO: 2274836 - DNA, 14 bp, Homo sapiens
tgttgggtggaccc

SEQ ID NO: 2274837 - DNA, 20 bp, Homo sapiens
tgttgggtggaccccgagca

SEQ ID NO: 2274838 - DNA, 21 bp, Homo sapiens
tgttgtaccatatgtagcatt

SEQ ID NO: 2274839 - DNA, 23 bp, Homo sapiens
tgttgttcgatcgtttcacatct

SEQ ID NO: 2274840 - DNA, 21 bp, Homo sapiens
tgtttaagaaatgagaaattg

SEQ ID NO: 2274841 - DNA, 18 bp, Homo sapiens
tgtttaattcctggaaaa

SEQ ID NO: 2274842 - DNA, 15 bp, Homo sapiens
tgtttaattgtaggt

SEQ ID NO: 2274843 - DNA, 22 bp, Homo sapiens
tgtttataggaaataaatctaa

SEQ ID NO: 2274844 - DNA, 17 bp, Homo sapiens
tgtttattgtcaaagtg

SEQ ID NO: 2274845 - DNA, 19 bp, Homo sapiens
tgtttcatgaagaaaaaat

SEQ ID NO: 2274846 - DNA, 23 bp, Homo sapiens
tgtttcatgaagaaaaaatttta

SEQ ID NO: 2274847 - DNA, 22 bp, Homo sapiens
tgtttcctgtggaaatatgcaa

SEQ ID NO: 2274848 - DNA, 23 bp, Homo sapiens
tgtttctatactgtttgtaatat

SEQ ID NO: 2274849 - DNA, 12 bp, Homo sapiens
tgtttcttctca

SEQ ID NO: 2274850 - DNA, 14 bp, Homo sapiens
tgtttcttgctttg

SEQ ID NO: 2274851 - DNA, 18 bp, Homo sapiens
tgtttgtgtccataagag

SEQ ID NO: 2274852 - DNA, 21 bp, Homo sapiens
tgttttattttaattcagttg

SEQ ID NO: 2274853 - DNA, 15 bp, Homo sapiens
tgttttctttttctg

SEQ ID NO: 2274854 - DNA, 20 bp, Homo sapiens
tgttttgctttttaaactga

SEQ ID NO: 2274855 - DNA, 21 bp, Homo sapiens
tgttttgctttttaaactgat

SEQ ID NO: 2274856 - DNA, 23 bp, Homo sapiens
tgtttttagaggggcaaaaatat

SEQ ID NO: 2274857 - DNA, 12 bp, Homo sapiens
tgtttttctcaa

SEQ ID NO: 2274858 - DNA, 20 bp, Homo sapiens
ttaaaaaaaatattctgtca

SEQ ID NO: 2274859 - DNA, 22 bp, Homo sapiens
ttaaaaaaaatattctgtcatt

SEQ ID NO: 2274860 - DNA, 22 bp, Homo sapiens
ttaaaaaaataacatctgaaaa

SEQ ID NO: 2274861 - DNA, 14 bp, Homo sapiens
ttaaaaaatagttg

SEQ ID NO: 2274862 - DNA, 18 bp, Homo sapiens
ttaaaaaatgaatagtac

SEQ ID NO: 2274863 - DNA, 19 bp, Homo sapiens
ttaaaaagttgcacattag

SEQ ID NO: 2274864 - DNA, 13 bp, Homo sapiens
ttaaaatagtttt

SEQ ID NO: 2274865 - DNA, 18 bp, Homo sapiens
ttaaaatagttttctaaa

SEQ ID NO: 2274866 - DNA, 20 bp, Homo sapiens
ttaaaatagttttctaaatg

SEQ ID NO: 2274867 - DNA, 16 bp, Homo sapiens
ttaaaattgtgttctt

SEQ ID NO: 2274868 - DNA, 17 bp, Homo sapiens
ttaaaattgtgttctta

SEQ ID NO: 2274869 - DNA, 20 bp, Homo sapiens
ttaaactgatgtatagcttt

SEQ ID NO: 2274870 - DNA, 21 bp, Homo sapiens
ttaaactgatgtatagcttta

SEQ ID NO: 2274871 - DNA, 13 bp, Homo sapiens
ttaaagacattta

SEQ ID NO: 2274872 - DNA, 19 bp, Homo sapiens
ttaaagaggcgtcttgtat

SEQ ID NO: 2274873 - DNA, 20 bp, Homo sapiens
ttaaagaggcgtcttgtatt

SEQ ID NO: 2274874 - DNA, 21 bp, Homo sapiens
ttaaagaggcgtcttgtattt

SEQ ID NO: 2274875 - DNA, 12 bp, Homo sapiens
ttaaataaaaga

SEQ ID NO: 2274876 - DNA, 13 bp, Homo sapiens
ttaaataaaagag

SEQ ID NO: 2274877 - DNA, 13 bp, Homo sapiens
ttaaatataaaat

SEQ ID NO: 2274878 - DNA, 16 bp, Homo sapiens
ttaaatataaaataca

SEQ ID NO: 2274879 - DNA, 23 bp, Homo sapiens
ttaaatataaaatacataaaaga

SEQ ID NO: 2274880 - DNA, 12 bp, Homo sapiens
ttaaatgtgctt

SEQ ID NO: 2274881 - DNA, 16 bp, Homo sapiens
ttaaatttaatatact

SEQ ID NO: 2274882 - DNA, 20 bp, Homo sapiens
ttaacagatatttaaattta

SEQ ID NO: 2274883 - DNA, 22 bp, Homo sapiens
ttaacagatgatccatttgaac

SEQ ID NO: 2274884 - DNA, 15 bp, Homo sapiens
ttaacatacatctaa

SEQ ID NO: 2274885 - DNA, 13 bp, Homo sapiens
ttaactgcatata

SEQ ID NO: 2274886 - DNA, 15 bp, Homo sapiens
ttaactgcatataga

SEQ ID NO: 2274887 - DNA, 15 bp, Homo sapiens
ttaacttatctccag

SEQ ID NO: 2274888 - DNA, 21 bp, Homo sapiens
ttaagaaaaatcataactcac

SEQ ID NO: 2274889 - DNA, 17 bp, Homo sapiens
ttaagaaatgagaaatt

SEQ ID NO: 2274890 - DNA, 21 bp, Homo sapiens
ttaagaaatgtagttgatgta

SEQ ID NO: 2274891 - DNA, 15 bp, Homo sapiens
ttaagaacagaacag

SEQ ID NO: 2274892 - DNA, 22 bp, Homo sapiens
ttaagacactagtagagcaaag

SEQ ID NO: 2274893 - DNA, 11 bp, Homo sapiens
ttaagatgcta

SEQ ID NO: 2274894 - DNA, 11 bp, Homo sapiens
ttaagcagctt

SEQ ID NO: 2274895 - DNA, 15 bp, Homo sapiens
ttaaggaaaagagaa

SEQ ID NO: 2274896 - DNA, 12 bp, Homo sapiens
ttaagggcagag

SEQ ID NO: 2274897 - DNA, 22 bp, Homo sapiens
ttaatataatattatactgcta

SEQ ID NO: 2274898 - DNA, 18 bp, Homo sapiens
ttaatatgtacttttcca

SEQ ID NO: 2274899 - DNA, 21 bp, Homo sapiens
ttaattatgctaacaaactga

SEQ ID NO: 2274900 - DNA, 14 bp, Homo sapiens
ttaattctcattat

SEQ ID NO: 2274901 - DNA, 16 bp, Homo sapiens
ttaattctcattatga

SEQ ID NO: 2274902 - DNA, 19 bp, Homo sapiens
ttaattctcattatgaaga

SEQ ID NO: 2274903 - DNA, 23 bp, Homo sapiens
ttaattgtaggtcaatgaaatat

SEQ ID NO: 2274904 - DNA, 16 bp, Homo sapiens
ttaattgtgtaactgt

SEQ ID NO: 2274905 - DNA, 23 bp, Homo sapiens
ttaattgtgtaactgttctttgc

SEQ ID NO: 2274906 - DNA, 20 bp, Homo sapiens
ttacaaatttttactcaggc

SEQ ID NO: 2274907 - DNA, 22 bp, Homo sapiens
ttacaaccggttatcagttgga

SEQ ID NO: 2274908 - DNA, 15 bp, Homo sapiens
ttacaggtgtactat

SEQ ID NO: 2274909 - DNA, 19 bp, Homo sapiens
ttacaggtgtgagccacag

SEQ ID NO: 2274910 - DNA, 17 bp, Homo sapiens
ttacatccgctttatgg

SEQ ID NO: 2274911 - DNA, 23 bp, Homo sapiens
ttacatgttgtattagtaaatta

SEQ ID NO: 2274912 - DNA, 12 bp, Homo sapiens
ttacattatgcc

SEQ ID NO: 2274913 - DNA, 13 bp, Homo sapiens
ttacattatgccc

SEQ ID NO: 2274914 - DNA, 16 bp, Homo sapiens
ttacattttctttcat

SEQ ID NO: 2274915 - DNA, 17 bp, Homo sapiens
ttaccatgcatttctcg

SEQ ID NO: 2274916 - DNA, 21 bp, Homo sapiens
ttacctcatgccgctgtgtct

SEQ ID NO: 2274917 - DNA, 22 bp, Homo sapiens
ttacctcatgccgctgtgtcta

SEQ ID NO: 2274918 - DNA, 13 bp, Homo sapiens
ttacgctctctgt

SEQ ID NO: 2274919 - DNA, 22 bp, Homo sapiens
ttactacataattaaattttaa

SEQ ID NO: 2274920 - DNA, 16 bp, Homo sapiens
ttactcaggctttcta

SEQ ID NO: 2274921 - DNA, 15 bp, Homo sapiens
ttactgcccagatgt

SEQ ID NO: 2274922 - DNA, 17 bp, Homo sapiens
ttactgcccagatgttt

SEQ ID NO: 2274923 - DNA, 14 bp, Homo sapiens
ttactgtcagagaa

SEQ ID NO: 2274924 - DNA, 18 bp, Homo sapiens
ttacttaaagcttgtttg

SEQ ID NO: 2274925 - DNA, 13 bp, Homo sapiens
ttacttaatgtga

SEQ ID NO: 2274926 - DNA, 12 bp, Homo sapiens
ttacttcacttt

SEQ ID NO: 2274927 - DNA, 17 bp, Homo sapiens
ttataggaaataaatct

SEQ ID NO: 2274928 - DNA, 14 bp, Homo sapiens
ttatagtctgtact

SEQ ID NO: 2274929 - DNA, 16 bp, Homo sapiens
ttatagtctgtacttc

SEQ ID NO: 2274930 - DNA, 21 bp, Homo sapiens
ttatcaaatcattcaaaactt

SEQ ID NO: 2274931 - DNA, 21 bp, Homo sapiens
ttatcagaactcctttctaag

SEQ ID NO: 2274932 - DNA, 15 bp, Homo sapiens
ttatcctgtgtgatt

SEQ ID NO: 2274933 - DNA, 16 bp, Homo sapiens
ttatctgggttttaga

SEQ ID NO: 2274934 - DNA, 14 bp, Homo sapiens
ttatcttatctagc

SEQ ID NO: 2274935 - DNA, 18 bp, Homo sapiens
ttatgaaaatgtaagtta

SEQ ID NO: 2274936 - DNA, 13 bp, Homo sapiens
ttatgaagatagt

SEQ ID NO: 2274937 - DNA, 13 bp, Homo sapiens
ttatgaagatgtt

SEQ ID NO: 2274938 - DNA, 17 bp, Homo sapiens
ttatgagaaaaaaacag

SEQ ID NO: 2274939 - DNA, 16 bp, Homo sapiens
ttatggaacactctga

SEQ ID NO: 2274940 - DNA, 20 bp, Homo sapiens
ttatggaacactctgagact

SEQ ID NO: 2274941 - DNA, 13 bp, Homo sapiens
ttatggtattttc

SEQ ID NO: 2274942 - DNA, 16 bp, Homo sapiens
ttatgtgaaggtgttt

SEQ ID NO: 2274943 - DNA, 16 bp, Homo sapiens
ttattacacaaactat

SEQ ID NO: 2274944 - DNA, 22 bp, Homo sapiens
ttattatagtctgtacttcagt

SEQ ID NO: 2274945 - DNA, 19 bp, Homo sapiens
ttattcatgtgtacagaaa

SEQ ID NO: 2274946 - DNA, 21 bp, Homo sapiens
ttattcatgtgtacagaaaca

SEQ ID NO: 2274947 - DNA, 14 bp, Homo sapiens
ttattcttccaagt

SEQ ID NO: 2274948 - DNA, 18 bp, Homo sapiens
ttattgagtaatattaca

SEQ ID NO: 2274949 - DNA, 20 bp, Homo sapiens
ttattgccaaataagacagt

SEQ ID NO: 2274950 - DNA, 17 bp, Homo sapiens
ttattgtcaaagtggtg

SEQ ID NO: 2274951 - DNA, 21 bp, Homo sapiens
ttatttaattatattatgaat

SEQ ID NO: 2274952 - DNA, 14 bp, Homo sapiens
ttatttatatatga

SEQ ID NO: 2274953 - DNA, 12 bp, Homo sapiens
ttatttcatgac

SEQ ID NO: 2274954 - DNA, 11 bp, Homo sapiens
ttatttgaaag

SEQ ID NO: 2274955 - DNA, 21 bp, Homo sapiens
ttattttatcacttgccgtgt

SEQ ID NO: 2274956 - DNA, 21 bp, Homo sapiens
ttattttcagtgctttgccct

SEQ ID NO: 2274957 - DNA, 13 bp, Homo sapiens
ttcaaaaactgtt

SEQ ID NO: 2274958 - DNA, 13 bp, Homo sapiens
ttcaaaactttca

SEQ ID NO: 2274959 - DNA, 18 bp, Homo sapiens
ttcaaaatagttctattt

SEQ ID NO: 2274960 - DNA, 12 bp, Homo sapiens
ttcaaaatgtta

SEQ ID NO: 2274961 - DNA, 16 bp, Homo sapiens
ttcaaaccaaataaga

SEQ ID NO: 2274962 - DNA, 22 bp, Homo sapiens
ttcaaacctgcaaggcaaagta

SEQ ID NO: 2274963 - DNA, 22 bp, Homo sapiens
ttcaaagataaggcaacaaaat

SEQ ID NO: 2274964 - DNA, 21 bp, Homo sapiens
ttcaaagatacaagaaaaagt

SEQ ID NO: 2274965 - DNA, 15 bp, Homo sapiens
ttcaaagggtaaatt

SEQ ID NO: 2274966 - DNA, 21 bp, Homo sapiens
ttcaacacttattttctgaat

SEQ ID NO: 2274967 - DNA, 20 bp, Homo sapiens
ttcaactacttctcttgcat

SEQ ID NO: 2274968 - DNA, 22 bp, Homo sapiens
ttcaactctgaatcaaaagctg

SEQ ID NO: 2274969 - DNA, 15 bp, Homo sapiens
ttcaaggatcctgag

SEQ ID NO: 2274970 - DNA, 21 bp, Homo sapiens
ttcaatgggagtgaacatttc

SEQ ID NO: 2274971 - DNA, 23 bp, Homo sapiens
ttcaatgggagtgaacatttcta

SEQ ID NO: 2274972 - DNA, 18 bp, Homo sapiens
ttcacaaatatagttgaa

SEQ ID NO: 2274973 - DNA, 16 bp, Homo sapiens
ttcacactgtgcgttt

SEQ ID NO: 2274974 - DNA, 13 bp, Homo sapiens
ttcacatctctgt

SEQ ID NO: 2274975 - DNA, 23 bp, Homo sapiens
ttcacgggcaacactcactgcct

SEQ ID NO: 2274976 - DNA, 18 bp, Homo sapiens
ttcagagatgtaccatgt

SEQ ID NO: 2274977 - DNA, 19 bp, Homo sapiens
ttcagcaattaaagacatt

SEQ ID NO: 2274978 - DNA, 23 bp, Homo sapiens
ttcagcagaatgactctggaacc

SEQ ID NO: 2274979 - DNA, 19 bp, Homo sapiens
ttcagcatggtttgcatga

SEQ ID NO: 2274980 - DNA, 10 bp, Homo sapiens
ttcagcctcg

SEQ ID NO: 2274981 - DNA, 22 bp, Homo sapiens
ttcaggaccccatctgctgagc

SEQ ID NO: 2274982 - DNA, 16 bp, Homo sapiens
ttcaggcaaggcagct

SEQ ID NO: 2274983 - DNA, 16 bp, Homo sapiens
ttcagtgccaaaaaca

SEQ ID NO: 2274984 - DNA, 12 bp, Homo sapiens
ttcagtgcctta

SEQ ID NO: 2274985 - DNA, 21 bp, Homo sapiens
ttcagtgccttatggaacact

SEQ ID NO: 2274986 - DNA, 17 bp, Homo sapiens
ttcagttttagtttcaa

SEQ ID NO: 2274987 - DNA, 13 bp, Homo sapiens
ttcataaaaataa

SEQ ID NO: 2274988 - DNA, 23 bp, Homo sapiens
ttcataattcatttaagaacaag

SEQ ID NO: 2274989 - DNA, 14 bp, Homo sapiens
ttcatacattccta

SEQ ID NO: 2274990 - DNA, 12 bp, Homo sapiens
ttcatactaaat

SEQ ID NO: 2274991 - DNA, 21 bp, Homo sapiens
ttcatacttacggcctttaca

SEQ ID NO: 2274992 - DNA, 13 bp, Homo sapiens
ttcatatcatttg

SEQ ID NO: 2274993 - DNA, 15 bp, Homo sapiens
ttcatccaccaatat

SEQ ID NO: 2274994 - DNA, 18 bp, Homo sapiens
ttcatccaccaatatcat

SEQ ID NO: 2274995 - DNA, 22 bp, Homo sapiens
ttcatctggagtccctcctccc

SEQ ID NO: 2274996 - DNA, 11 bp, Homo sapiens
ttcatcttgaa

SEQ ID NO: 2274997 - DNA, 12 bp, Homo sapiens
ttcatcttgaat

SEQ ID NO: 2274998 - DNA, 17 bp, Homo sapiens
ttcatcttgaattgtaa

SEQ ID NO: 2274999 - DNA, 16 bp, Homo sapiens
ttcatggaccactgtt

SEQ ID NO: 2275000 - DNA, 17 bp, Homo sapiens
ttcatggaccactgttt

SEQ ID NO: 2275001 - DNA, 19 bp, Homo sapiens
ttcatgtactaccctcagt

SEQ ID NO: 2275002 - DNA, 18 bp, Homo sapiens
ttcatgtgtacagaaaca

SEQ ID NO: 2275003 - DNA, 23 bp, Homo sapiens
ttcatgtgttgcaaattattcta

SEQ ID NO: 2275004 - DNA, 18 bp, Homo sapiens
ttcatgtttaagaaatga

SEQ ID NO: 2275005 - DNA, 18 bp, Homo sapiens
ttcattcatggaccactg

SEQ ID NO: 2275006 - DNA, 19 bp, Homo sapiens
ttcatttaagaacaagaga

SEQ ID NO: 2275007 - DNA, 16 bp, Homo sapiens
ttcatttttctgttag

SEQ ID NO: 2275008 - DNA, 22 bp, Homo sapiens
ttccaaatattctaaaaaagat

SEQ ID NO: 2275009 - DNA, 22 bp, Homo sapiens
ttccaagggtcttcctcctaaa

SEQ ID NO: 2275010 - DNA, 21 bp, Homo sapiens
ttccacacatttccctatttt

SEQ ID NO: 2275011 - DNA, 12 bp, Homo sapiens
ttccaccttggc

SEQ ID NO: 2275012 - DNA, 19 bp, Homo sapiens
ttccagaacgccctgtgtc

SEQ ID NO: 2275013 - DNA, 20 bp, Homo sapiens
ttccagaacgccctgtgtcc

SEQ ID NO: 2275014 - DNA, 21 bp, Homo sapiens
ttccagaacgccctgtgtcca

SEQ ID NO: 2275015 - DNA, 15 bp, Homo sapiens
ttccagcgtctgctg

SEQ ID NO: 2275016 - DNA, 18 bp, Homo sapiens
ttccaggcatgaccctgg

SEQ ID NO: 2275017 - DNA, 19 bp, Homo sapiens
ttccaggcatgaccctgga

SEQ ID NO: 2275018 - DNA, 19 bp, Homo sapiens
ttccaggcgtagggccagg

SEQ ID NO: 2275019 - DNA, 18 bp, Homo sapiens
ttccagttggactgtggc

SEQ ID NO: 2275020 - DNA, 24 bp, Homo sapiens
ttccagttggactgtggcctcagg

SEQ ID NO: 2275021 - DNA, 17 bp, Homo sapiens
ttccatatagtttgttt

SEQ ID NO: 2275022 - DNA, 15 bp, Homo sapiens
ttcccacaattcttt

SEQ ID NO: 2275023 - DNA, 18 bp, Homo sapiens
ttcccatttgtaatgtat

SEQ ID NO: 2275024 - DNA, 20 bp, Homo sapiens
ttcccctcagaacaccctgt

SEQ ID NO: 2275025 - DNA, 22 bp, Homo sapiens
ttcccctcccgcttcctccggc

SEQ ID NO: 2275026 - DNA, 23 bp, Homo sapiens
ttcccctcccgcttcctccggct

SEQ ID NO: 2275027 - DNA, 18 bp, Homo sapiens
ttcccgtatgctttcttc

SEQ ID NO: 2275028 - DNA, 21 bp, Homo sapiens
ttccgaagaccttctgaagat

SEQ ID NO: 2275029 - DNA, 17 bp, Homo sapiens
ttcctaaactctgaaat

SEQ ID NO: 2275030 - DNA, 18 bp, Homo sapiens
ttcctagaggcagaggtt

SEQ ID NO: 2275031 - DNA, 15 bp, Homo sapiens
ttcctcatctccatg

SEQ ID NO: 2275032 - DNA, 17 bp, Homo sapiens
ttcctcatctccatgct

SEQ ID NO: 2275033 - DNA, 11 bp, Homo sapiens
tcttttgtaag

SEQ ID NO: 2275034 - DNA, 18 bp, Homo sapiens
tctttttaaaaagttgca

SEQ ID NO: 2275035 - DNA, 13 bp, Homo sapiens
tcttttttcaatg

SEQ ID NO: 2275036 - DNA, 17 bp, Homo sapiens
tgaaaaagaatgaaaac

SEQ ID NO: 2275037 - DNA, 15 bp, Homo sapiens
tgaaaacaccaagag

SEQ ID NO: 2275038 - DNA, 17 bp, Homo sapiens
tgaaaagaaatgctaat

SEQ ID NO: 2275039 - DNA, 18 bp, Homo sapiens
tgaaaagaagaaagtcta

SEQ ID NO: 2275040 - DNA, 19 bp, Homo sapiens
tgaaaatatttttttctag

SEQ ID NO: 2275041 - DNA, 18 bp, Homo sapiens
tgaaaatggtgaagaatg

SEQ ID NO: 2275042 - DNA, 22 bp, Homo sapiens
tgaaaatgtatggatgaattct

SEQ ID NO: 2275043 - DNA, 24 bp, Homo sapiens
tgaaaatgtatggatgaattctga

SEQ ID NO: 2275044 - DNA, 11 bp, Homo sapiens
tgaaacacttt

SEQ ID NO: 2275045 - DNA, 13 bp, Homo sapiens
tgaaacctctgtt

SEQ ID NO: 2275046 - DNA, 23 bp, Homo sapiens
tgaaacctctgttctcatgaagg

SEQ ID NO: 2275047 - DNA, 17 bp, Homo sapiens
tgaaagaagtcaaatga

SEQ ID NO: 2275048 - DNA, 13 bp, Homo sapiens
tgaaagagaaaat

SEQ ID NO: 2275049 - DNA, 18 bp, Homo sapiens
tgaaagagaaaatgcttt

SEQ ID NO: 2275050 - DNA, 23 bp, Homo sapiens
tgaaagtttcttcaactctgaat

SEQ ID NO: 2275051 - DNA, 12 bp, Homo sapiens
tgaaataaaact

SEQ ID NO: 2275052 - DNA, 14 bp, Homo sapiens
tgaaataataatat

SEQ ID NO: 2275053 - DNA, 16 bp, Homo sapiens
tgaaatatttgcttat

SEQ ID NO: 2275054 - DNA, 17 bp, Homo sapiens
tgaaatatttgcttatt

SEQ ID NO: 2275055 - DNA, 19 bp, Homo sapiens
tgaaatatttgcttattta

SEQ ID NO: 2275056 - DNA, 22 bp, Homo sapiens
tgaaatccaaaatagtcatgtt

SEQ ID NO: 2275057 - DNA, 12 bp, Homo sapiens
tgaaatctacaa

SEQ ID NO: 2275058 - DNA, 23 bp, Homo sapiens
tgaaatctacaacataatgatac

SEQ ID NO: 2275059 - DNA, 17 bp, Homo sapiens
tgaaatgtttccaggca

SEQ ID NO: 2275060 - DNA, 18 bp, Homo sapiens
tgaaatgtttccaggcat

SEQ ID NO: 2275061 - DNA, 18 bp, Homo sapiens
tgaaattagccagggtgg

SEQ ID NO: 2275062 - DNA, 15 bp, Homo sapiens
tgaaatttaaaaatc

SEQ ID NO: 2275063 - DNA, 20 bp, Homo sapiens
tgaaatttaaaaatctttca

SEQ ID NO: 2275064 - DNA, 15 bp, Homo sapiens
tgaaatttatgacta

SEQ ID NO: 2275065 - DNA, 15 bp, Homo sapiens
tgaaatttgctatat

SEQ ID NO: 2275066 - DNA, 18 bp, Homo sapiens
tgaacaaaatctgttgcc

SEQ ID NO: 2275067 - DNA, 24 bp, Homo sapiens
tgaacaagaaattggtattatcaa

SEQ ID NO: 2275068 - DNA, 14 bp, Homo sapiens
tgaacatgtatgat

SEQ ID NO: 2275069 - DNA, 23 bp, Homo sapiens
tgaacatttctaactaaggacag

SEQ ID NO: 2275070 - DNA, 19 bp, Homo sapiens
tgaaccgtcaatgtgaaat

SEQ ID NO: 2275071 - DNA, 21 bp, Homo sapiens
tgaaccgtcaatgtgaaataa

SEQ ID NO: 2275072 - DNA, 14 bp, Homo sapiens
tgaacctgtgcaat

SEQ ID NO: 2275073 - DNA, 16 bp, Homo sapiens
tgaacgacagtcccag

SEQ ID NO: 2275074 - DNA, 14 bp, Homo sapiens
tgaactagagactc

SEQ ID NO: 2275075 - DNA, 17 bp, Homo sapiens
tgaactagagactctgt

SEQ ID NO: 2275076 - DNA, 19 bp, Homo sapiens
tgaactagagactctgtga

SEQ ID NO: 2275077 - DNA, 21 bp, Homo sapiens
tgaactagagactctgtgatc

SEQ ID NO: 2275078 - DNA, 16 bp, Homo sapiens
tgaactcttggcctca

SEQ ID NO: 2275079 - DNA, 15 bp, Homo sapiens
tgaactgctgctggt

SEQ ID NO: 2275080 - DNA, 16 bp, Homo sapiens
tgaactgtatattatt

SEQ ID NO: 2275081 - DNA, 17 bp, Homo sapiens
tgaagaaaaaattttaa

SEQ ID NO: 2275082 - DNA, 15 bp, Homo sapiens
tgaagaaaacttgaa

SEQ ID NO: 2275083 - DNA, 15 bp, Homo sapiens
tgaagacactgtcaa

SEQ ID NO: 2275084 - DNA, 15 bp, Homo sapiens
tgaagataaatgctt

SEQ ID NO: 2275085 - DNA, 17 bp, Homo sapiens
tgaagataaatgcttta

SEQ ID NO: 2275086 - DNA, 11 bp, Homo sapiens
tgaagatctca

SEQ ID NO: 2275087 - DNA, 21 bp, Homo sapiens
tgaaggagaggatttggctcg

SEQ ID NO: 2275088 - DNA, 22 bp, Homo sapiens
tctgacagagcaagcgaaagag

SEQ ID NO: 2275089 - DNA, 21 bp, Homo sapiens
tctgagaacagacgttaccaa

SEQ ID NO: 2275090 - DNA, 16 bp, Homo sapiens
tctgagaccacagagg

SEQ ID NO: 2275091 - DNA, 21 bp, Homo sapiens
tctgagactcgcgacaatgca

SEQ ID NO: 2275092 - DNA, 23 bp, Homo sapiens
tctgagactcgcgacaatgcaaa

SEQ ID NO: 2275093 - DNA, 22 bp, Homo sapiens
tctgatagagtttaacagatat

SEQ ID NO: 2275094 - DNA, 23 bp, Homo sapiens
tctgatggcacctataaaattat

SEQ ID NO: 2275095 - DNA, 21 bp, Homo sapiens
tctgattaaatttaatatact

SEQ ID NO: 2275096 - DNA, 17 bp, Homo sapiens
tctgatttgcaaatgca

SEQ ID NO: 2275097 - DNA, 16 bp, Homo sapiens
tctgcaaatagtttca

SEQ ID NO: 2275098 - DNA, 14 bp, Homo sapiens
tctgcaataacagt

SEQ ID NO: 2275099 - DNA, 16 bp, Homo sapiens
tctgcacagctcctcc

SEQ ID NO: 2275100 - DNA, 19 bp, Homo sapiens
tctgcagcctgagctccac

SEQ ID NO: 2275101 - DNA, 24 bp, Homo sapiens
tctgcagcctgagctccaccctcc

SEQ ID NO: 2275102 - DNA, 13 bp, Homo sapiens
tctgcatacacat

SEQ ID NO: 2275103 - DNA, 17 bp, Homo sapiens
tctgcccacctcggcct

SEQ ID NO: 2275104 - DNA, 14 bp, Homo sapiens
tctgccccctcccc

SEQ ID NO: 2275105 - DNA, 16 bp, Homo sapiens
tctgcccctccgtccc

SEQ ID NO: 2275106 - DNA, 20 bp, Homo sapiens
tctgcccctccgtccccagg

SEQ ID NO: 2275107 - DNA, 21 bp, Homo sapiens
tctgcccctccgtccccaggg

SEQ ID NO: 2275108 - DNA, 17 bp, Homo sapiens
tctgccccttgacccca

SEQ ID NO: 2275109 - DNA, 19 bp, Homo sapiens
tctgccccttgaccccaca

SEQ ID NO: 2275110 - DNA, 20 bp, Homo sapiens
tctgccccttgaccccacac

SEQ ID NO: 2275111 - DNA, 18 bp, Homo sapiens
tctgccctgccctggcca

SEQ ID NO: 2275112 - DNA, 19 bp, Homo sapiens
tctgctaccagggctcacc

SEQ ID NO: 2275113 - DNA, 19 bp, Homo sapiens
tctgctacctggttttcat

SEQ ID NO: 2275114 - DNA, 18 bp, Homo sapiens
tctgctctgtgcactcac

SEQ ID NO: 2275115 - DNA, 22 bp, Homo sapiens
tctgctctgtgcactcacgctc

SEQ ID NO: 2275116 - DNA, 19 bp, Homo sapiens
tctgctgagctctgacctg

SEQ ID NO: 2275117 - DNA, 22 bp, Homo sapiens
tctgctgggctggcggccatcc

SEQ ID NO: 2275118 - DNA, 22 bp, Homo sapiens
tctgctgtaagacggccttgga

SEQ ID NO: 2275119 - DNA, 15 bp, Homo sapiens
tctgcttaccaaaac

SEQ ID NO: 2275120 - DNA, 17 bp, Homo sapiens
tctgcttaccaaaacat

SEQ ID NO: 2275121 - DNA, 18 bp, Homo sapiens
tctgctttattgcctctg

SEQ ID NO: 2275122 - DNA, 22 bp, Homo sapiens
tctgctttggggcttatcagaa

SEQ ID NO: 2275123 - DNA, 15 bp, Homo sapiens
tctggaatactgaaa

SEQ ID NO: 2275124 - DNA, 16 bp, Homo sapiens
tctggaatactgaaaa

SEQ ID NO: 2275125 - DNA, 20 bp, Homo sapiens
tctggaatactgaaaaagaa

SEQ ID NO: 2275126 - DNA, 16 bp, Homo sapiens
tctggagaccaggact

SEQ ID NO: 2275127 - DNA, 17 bp, Homo sapiens
tctggagaccaggactc

SEQ ID NO: 2275128 - DNA, 14 bp, Homo sapiens
tctggagtccctcc

SEQ ID NO: 2275129 - DNA, 19 bp, Homo sapiens
tctggcaggtggccagggc

SEQ ID NO: 2275130 - DNA, 16 bp, Homo sapiens
tctggctgaaaatggt

SEQ ID NO: 2275131 - DNA, 20 bp, Homo sapiens
tctggctgtacgtctggtgt

SEQ ID NO: 2275132 - DNA, 15 bp, Homo sapiens
tctgggacccactcc

SEQ ID NO: 2275133 - DNA, 19 bp, Homo sapiens
tctgggtgtgactgattcc

SEQ ID NO: 2275134 - DNA, 12 bp, Homo sapiens
tgcttgaatgct

SEQ ID NO: 2275135 - DNA, 15 bp, Homo sapiens
tgcttgatataataa

SEQ ID NO: 2275136 - DNA, 22 bp, Homo sapiens
tgcttgatataataattactta

SEQ ID NO: 2275137 - DNA, 16 bp, Homo sapiens
tgcttggatccataca

SEQ ID NO: 2275138 - DNA, 12 bp, Homo sapiens
tgcttgtacctc

SEQ ID NO: 2275139 - DNA, 14 bp, Homo sapiens
tgcttgtacctctg

SEQ ID NO: 2275140 - DNA, 12 bp, Homo sapiens
tgctttcatcca

SEQ ID NO: 2275141 - DNA, 12 bp, Homo sapiens
tgctttctcatg

SEQ ID NO: 2275142 - DNA, 18 bp, Homo sapiens
tgctttgaatgcatgtgt

SEQ ID NO: 2275143 - DNA, 22 bp, Homo sapiens
tgcttttccataaccaacattt

SEQ ID NO: 2275144 - DNA, 14 bp, Homo sapiens
tgcttttccatcta

SEQ ID NO: 2275145 - DNA, 17 bp, Homo sapiens
tgcttttgcatttctct

SEQ ID NO: 2275146 - DNA, 20 bp, Homo sapiens
tggaaacagaggaccagcac

SEQ ID NO: 2275147 - DNA, 18 bp, Homo sapiens
tggaaatacatttagaac

SEQ ID NO: 2275148 - DNA, 19 bp, Homo sapiens
tggaaatatgcaacctgtg

SEQ ID NO: 2275149 - DNA, 21 bp, Homo sapiens
tggaaatatgcaacctgtgca

SEQ ID NO: 2275150 - DNA, 17 bp, Homo sapiens
tggaaccatcctctgtt

SEQ ID NO: 2275151 - DNA, 13 bp, Homo sapiens
tggaagacagaga

SEQ ID NO: 2275152 - DNA, 21 bp, Homo sapiens
tggaagacagagatggcagag

SEQ ID NO: 2275153 - DNA, 23 bp, Homo sapiens
tggaagcactgccattagactga

SEQ ID NO: 2275154 - DNA, 12 bp, Homo sapiens
tggaagggcagg

SEQ ID NO: 2275155 - DNA, 17 bp, Homo sapiens
tggaagggcaggagctc

SEQ ID NO: 2275156 - DNA, 20 bp, Homo sapiens
tggaagggtccaccctagcc

SEQ ID NO: 2275157 - DNA, 20 bp, Homo sapiens
tggaagtactataatttacc

SEQ ID NO: 2275158 - DNA, 13 bp, Homo sapiens
tggaatactgaaa

SEQ ID NO: 2275159 - DNA, 18 bp, Homo sapiens
tggaatgggggccaggct

SEQ ID NO: 2275160 - DNA, 23 bp, Homo sapiens
tggaatgggggccaggctgagcc

SEQ ID NO: 2275161 - DNA, 18 bp, Homo sapiens
tggaatgttgttaaatgc

SEQ ID NO: 2275162 - DNA, 19 bp, Homo sapiens
tggaatgttgttaaatgct

SEQ ID NO: 2275163 - DNA, 14 bp, Homo sapiens
tggaattatgtata

SEQ ID NO: 2275164 - DNA, 16 bp, Homo sapiens
tggaattatgtataac

SEQ ID NO: 2275165 - DNA, 18 bp, Homo sapiens
tggaattgttgaatgtat

SEQ ID NO: 2275166 - DNA, 18 bp, Homo sapiens
tggacagatgggtgtccc

SEQ ID NO: 2275167 - DNA, 17 bp, Homo sapiens
tggacaggcttcgtctc

SEQ ID NO: 2275168 - DNA, 23 bp, Homo sapiens
tggacaggcttcgtctcagaagg

SEQ ID NO: 2275169 - DNA, 20 bp, Homo sapiens
tggaccacagcatgaacctt

SEQ ID NO: 2275170 - DNA, 14 bp, Homo sapiens
tggaccactgtttc

SEQ ID NO: 2275171 - DNA, 20 bp, Homo sapiens
tggaccactgtttcttgctt

SEQ ID NO: 2275172 - DNA, 21 bp, Homo sapiens
tggaccactgtttcttgcttg

SEQ ID NO: 2275173 - DNA, 19 bp, Homo sapiens
tggacctggggtcccccct

SEQ ID NO: 2275174 - DNA, 19 bp, Homo sapiens
tggacgagtgagctaccag

SEQ ID NO: 2275175 - DNA, 18 bp, Homo sapiens
tggacggggacacggcct

SEQ ID NO: 2275176 - DNA, 19 bp, Homo sapiens
tggacggggacacggcctc

SEQ ID NO: 2275177 - DNA, 21 bp, Homo sapiens
tggacggggacacggcctctg

SEQ ID NO: 2275178 - DNA, 20 bp, Homo sapiens
tggactcttcaaaaactgtt

SEQ ID NO: 2275179 - DNA, 14 bp, Homo sapiens
tggactgaagttat

SEQ ID NO: 2275180 - DNA, 19 bp, Homo sapiens
tggactgggtgggccccac

SEQ ID NO: 2275181 - DNA, 20 bp, Homo sapiens
tggactgggtgggccccaca

SEQ ID NO: 2275182 - DNA, 17 bp, Homo sapiens
tggactgtggcctcagg

SEQ ID NO: 2275183 - DNA, 14 bp, Homo sapiens
tggagaccaggact

SEQ ID NO: 2275184 - DNA, 15 bp, Homo sapiens
tggagaccaggactc

SEQ ID NO: 2275185 - DNA, 13 bp, Homo sapiens
tggagcagagacg

SEQ ID NO: 2275186 - DNA, 17 bp, Homo sapiens
tggagcagagacggcag

SEQ ID NO: 2275187 - DNA, 15 bp, Homo sapiens
tggagcagaggtggg

SEQ ID NO: 2275188 - DNA, 19 bp, Homo sapiens
tggagcagtttggggcagg

SEQ ID NO: 2275189 - DNA, 14 bp, Homo sapiens
tggagctagaaaat

SEQ ID NO: 2275190 - DNA, 14 bp, Homo sapiens
tggagctgcttcca

SEQ ID NO: 2275191 - DNA, 14 bp, Homo sapiens
tggaggatggacga

SEQ ID NO: 2275192 - DNA, 22 bp, Homo sapiens
tggaggcatgtgatgagaggaa

SEQ ID NO: 2275193 - DNA, 12 bp, Homo sapiens
tggagggctggg

SEQ ID NO: 2275194 - DNA, 20 bp, Homo sapiens
tggagggctgggcagggccc

SEQ ID NO: 2275195 - DNA, 16 bp, Homo sapiens
tggagtccctcctccc

SEQ ID NO: 2275196 - DNA, 13 bp, Homo sapiens
tggagtggcatgg

SEQ ID NO: 2275197 - DNA, 19 bp, Homo sapiens
tggagtggcatggtcctgt

SEQ ID NO: 2275198 - DNA, 16 bp, Homo sapiens
tggatatgaaagagaa

SEQ ID NO: 2275199 - DNA, 18 bp, Homo sapiens
tggatccatacaaaacta

SEQ ID NO: 2275200 - DNA, 21 bp, Homo sapiens
tggatctaaatggaagcatct

SEQ ID NO: 2275201 - DNA, 14 bp, Homo sapiens
tggatttcctttga

SEQ ID NO: 2275202 - DNA, 14 bp, Homo sapiens
tggcaacctgttct

SEQ ID NO: 2275203 - DNA, 22 bp, Homo sapiens
tggcacctcctcggctggctgt

SEQ ID NO: 2275204 - DNA, 20 bp, Homo sapiens
tggcagagccatccaccctg

SEQ ID NO: 2275205 - DNA, 17 bp, Homo sapiens
tggcagcgcctcccgcc

SEQ ID NO: 2275206 - DNA, 24 bp, Homo sapiens
tggcagcgcctcccgccgcctcgg

SEQ ID NO: 2275207 - DNA, 19 bp, Homo sapiens
tggcagggcaggcagagct

SEQ ID NO: 2275208 - DNA, 18 bp, Homo sapiens
tggcaggtggccagggct

SEQ ID NO: 2275209 - DNA, 16 bp, Homo sapiens
tgatgggcaaggggcc

SEQ ID NO: 2275210 - DNA, 14 bp, Homo sapiens
tgatgggctggagc

SEQ ID NO: 2275211 - DNA, 13 bp, Homo sapiens
tgatgggtcctgc

SEQ ID NO: 2275212 - DNA, 15 bp, Homo sapiens
tgatggtgcaatgac

SEQ ID NO: 2275213 - DNA, 17 bp, Homo sapiens
tgatggtgcaatgacct

SEQ ID NO: 2275214 - DNA, 17 bp, Homo sapiens
tgatgtaaatatttcaa

SEQ ID NO: 2275215 - DNA, 20 bp, Homo sapiens
tgatgtatagctttaacatt

SEQ ID NO: 2275216 - DNA, 18 bp, Homo sapiens
tgatgttgataatagtaa

SEQ ID NO: 2275217 - DNA, 18 bp, Homo sapiens
tgattaaatttaatatac

SEQ ID NO: 2275218 - DNA, 19 bp, Homo sapiens
tgattagcctcgtctttca

SEQ ID NO: 2275219 - DNA, 20 bp, Homo sapiens
tgattcaacaggttttcctg

SEQ ID NO: 2275220 - DNA, 19 bp, Homo sapiens
tgattcaatgtgaatttta

SEQ ID NO: 2275221 - DNA, 21 bp, Homo sapiens
tgattcataatgacttaagca

SEQ ID NO: 2275222 - DNA, 20 bp, Homo sapiens
tgattccaagggcccagagg

SEQ ID NO: 2275223 - DNA, 22 bp, Homo sapiens
tgattctatgcctgtatttcca

SEQ ID NO: 2275224 - DNA, 17 bp, Homo sapiens
tgattgaaaagaagaaa

SEQ ID NO: 2275225 - DNA, 16 bp, Homo sapiens
tgattgtttaattgta

SEQ ID NO: 2275226 - DNA, 15 bp, Homo sapiens
tgatttcaaatgcag

SEQ ID NO: 2275227 - DNA, 17 bp, Homo sapiens
tgatttcccattttaaa

SEQ ID NO: 2275228 - DNA, 19 bp, Homo sapiens
tgatttcccattttaaaga

SEQ ID NO: 2275229 - DNA, 16 bp, Homo sapiens
tgatttttttttcctt

SEQ ID NO: 2275230 - DNA, 17 bp, Homo sapiens
tgatttttttttccttc

SEQ ID NO: 2275231 - DNA, 18 bp, Homo sapiens
tgcaaaccatcattgaaa

SEQ ID NO: 2275232 - DNA, 20 bp, Homo sapiens
tgcaaaccatcattgaaatc

SEQ ID NO: 2275233 - DNA, 21 bp, Homo sapiens
tgcaaaccatcattgaaatct

SEQ ID NO: 2275234 - DNA, 18 bp, Homo sapiens
tgcaaatagtttcaaatg

SEQ ID NO: 2275235 - DNA, 20 bp, Homo sapiens
tgcaaatgaatgcctttcaa

SEQ ID NO: 2275236 - DNA, 17 bp, Homo sapiens
tgcaaatgcacatttgt

SEQ ID NO: 2275237 - DNA, 19 bp, Homo sapiens
tgcaaatgcacatttgtca

SEQ ID NO: 2275238 - DNA, 19 bp, Homo sapiens
tgcaaatgttgtatttcaa

SEQ ID NO: 2275239 - DNA, 16 bp, Homo sapiens
tgcaaattattctagt

SEQ ID NO: 2275240 - DNA, 18 bp, Homo sapiens
tgcaagctttaacagact

SEQ ID NO: 2275241 - DNA, 12 bp, Homo sapiens
tgcaataacagt

SEQ ID NO: 2275242 - DNA, 19 bp, Homo sapiens
tgcaataacagttttaaga

SEQ ID NO: 2275243 - DNA, 21 bp, Homo sapiens
tgcaataacagttttaagatg

SEQ ID NO: 2275244 - DNA, 12 bp, Homo sapiens
tgcaatatgtaa

SEQ ID NO: 2275245 - DNA, 13 bp, Homo sapiens
tgcaatgaccttt

SEQ ID NO: 2275246 - DNA, 16 bp, Homo sapiens
tgcaatgacctttcaa

SEQ ID NO: 2275247 - DNA, 19 bp, Homo sapiens
tgcaatgacctttcaatag

SEQ ID NO: 2275248 - DNA, 16 bp, Homo sapiens
tgcaattagatagaaa

SEQ ID NO: 2275249 - DNA, 20 bp, Homo sapiens
tgcacacattggccgcttca

SEQ ID NO: 2275250 - DNA, 17 bp, Homo sapiens
tgcacagctaacatgga

SEQ ID NO: 2275251 - DNA, 18 bp, Homo sapiens
tgcacagctaacatggaa

SEQ ID NO: 2275252 - DNA, 18 bp, Homo sapiens
tgcacaggctggaggagg

SEQ ID NO: 2275253 - DNA, 12 bp, Homo sapiens
tgcacagggtcc

SEQ ID NO: 2275254 - DNA, 22 bp, Homo sapiens
tgcaccttcactctccagggta

SEQ ID NO: 2275255 - DNA, 16 bp, Homo sapiens
tgcactccagcctggg

SEQ ID NO: 2275256 - DNA, 14 bp, Homo sapiens
tgcacttctgttat

SEQ ID NO: 2275257 - DNA, 14 bp, Homo sapiens
tgcacttttcccca

SEQ ID NO: 2275258 - DNA, 17 bp, Homo sapiens
tgcagaaaaagagcttc

SEQ ID NO: 2275259 - DNA, 21 bp, Homo sapiens
tgcagaaatgtggatgctctt

SEQ ID NO: 2275260 - DNA, 15 bp, Homo sapiens
tgcagactagctaat

SEQ ID NO: 2275261 - DNA, 20 bp, Homo sapiens
tgcagatgactggaaacaag

SEQ ID NO: 2275262 - DNA, 18 bp, Homo sapiens
tgcagcaaccagagcact

SEQ ID NO: 2275263 - DNA, 22 bp, Homo sapiens
tgcagcaaccagagcactgtat

SEQ ID NO: 2275264 - DNA, 19 bp, Homo sapiens
tgcagcagtaccatcccac

SEQ ID NO: 2275265 - DNA, 20 bp, Homo sapiens
tgcagcccagaacgggcctc

SEQ ID NO: 2275266 - DNA, 22 bp, Homo sapiens
tgcagcccagaacgggcctccc

SEQ ID NO: 2275267 - DNA, 22 bp, Homo sapiens
tgcagcctcgacctccctggct

SEQ ID NO: 2275268 - DNA, 21 bp, Homo sapiens
tgcagcctgagctccaccctc

SEQ ID NO: 2275269 - DNA, 14 bp, Homo sapiens
tgcaggactcgggc

SEQ ID NO: 2275270 - DNA, 22 bp, Homo sapiens
tgcaggagcaaggctgccctgt

SEQ ID NO: 2275271 - DNA, 20 bp, Homo sapiens
tgcaggcggtatccagaggt

SEQ ID NO: 2275272 - DNA, 19 bp, Homo sapiens
tgcaggtaagtctggtttt

SEQ ID NO: 2275273 - DNA, 18 bp, Homo sapiens
tgcagtccagtgagaaat

SEQ ID NO: 2275274 - DNA, 17 bp, Homo sapiens
tgcagtgaagatgtgta

SEQ ID NO: 2275275 - DNA, 23 bp, Homo sapiens
tgcagtgaagatgtgtaaataag

SEQ ID NO: 2275276 - DNA, 19 bp, Homo sapiens
tgcagttgctcattgtaga

SEQ ID NO: 2275277 - DNA, 19 bp, Homo sapiens
tgcatcaagatgtgacatg

SEQ ID NO: 2275278 - DNA, 18 bp, Homo sapiens
tgcatctttctcttccca

SEQ ID NO: 2275279 - DNA, 14 bp, Homo sapiens
tgcatgctgtccct

SEQ ID NO: 2275280 - DNA, 16 bp, Homo sapiens
tgcatgctgtccctta

SEQ ID NO: 2275281 - DNA, 19 bp, Homo sapiens
tgcatgctgtcccttacgt

SEQ ID NO: 2275282 - DNA, 16 bp, Homo sapiens
tgcatgtgtgaagatt

SEQ ID NO: 2275283 - DNA, 16 bp, Homo sapiens
tgcattccagcgtctg

SEQ ID NO: 2275284 - DNA, 22 bp, Homo sapiens
tgcattccagcgtctgctgttg

SEQ ID NO: 2275285 - DNA, 19 bp, Homo sapiens
tgcatttctcttcctaaat

SEQ ID NO: 2275286 - DNA, 22 bp, Homo sapiens
tgccaaaaactaaaattcaaca

SEQ ID NO: 2275287 - DNA, 22 bp, Homo sapiens
tgccaaataaaatgtttacatt

SEQ ID NO: 2275288 - DNA, 16 bp, Homo sapiens
tgccaaatcctgggca

SEQ ID NO: 2275289 - DNA, 17 bp, Homo sapiens
tgccaaatcctgggcat

SEQ ID NO: 2275290 - DNA, 23 bp, Homo sapiens
tgccaaatcctgggcatccccag

SEQ ID NO: 2275291 - DNA, 19 bp, Homo sapiens
tgccaacctcgctccaact

SEQ ID NO: 2275292 - DNA, 13 bp, Homo sapiens
tgccagcgtggca

SEQ ID NO: 2275293 - DNA, 23 bp, Homo sapiens
tgccagcttcccttttctcccaa

SEQ ID NO: 2275294 - DNA, 20 bp, Homo sapiens
tgccaggagatggaatatca

SEQ ID NO: 2275295 - DNA, 13 bp, Homo sapiens
tgccaggagtggg

SEQ ID NO: 2275296 - DNA, 17 bp, Homo sapiens
tgccaggagtgggtggg

SEQ ID NO: 2275297 - DNA, 21 bp, Homo sapiens
tgccatcagaaattttctaca

SEQ ID NO: 2275298 - DNA, 22 bp, Homo sapiens
tgccatcagaaattttctacag

SEQ ID NO: 2275299 - DNA, 14 bp, Homo sapiens
tgccatcagcccct

SEQ ID NO: 2275300 - DNA, 19 bp, Homo sapiens
tgccattagactgaattta

SEQ ID NO: 2275301 - DNA, 19 bp, Homo sapiens
tgcccacacctgcctctga

SEQ ID NO: 2275302 - DNA, 12 bp, Homo sapiens
tgcccaccctgg

SEQ ID NO: 2275303 - DNA, 23 bp, Homo sapiens
tgcccagttagcccggccaagga

SEQ ID NO: 2275304 - DNA, 17 bp, Homo sapiens
tgcccagttcatcccaa

SEQ ID NO: 2275305 - DNA, 16 bp, Homo sapiens
tgccccacccctccat

SEQ ID NO: 2275306 - DNA, 13 bp, Homo sapiens
tgcccccaccctg

SEQ ID NO: 2275307 - DNA, 15 bp, Homo sapiens
tgcccccagacccca

SEQ ID NO: 2275308 - DNA, 19 bp, Homo sapiens
tgcccccagaccccatcca

SEQ ID NO: 2275309 - DNA, 11 bp, Homo sapiens
tgcccccagcg

SEQ ID NO: 2275310 - DNA, 14 bp, Homo sapiens
tgccccctcccccg

SEQ ID NO: 2275311 - DNA, 17 bp, Homo sapiens
tgccccctcccccgcag

SEQ ID NO: 2275312 - DNA, 21 bp, Homo sapiens
tgccccctcccccgcagacag

SEQ ID NO: 2275313 - DNA, 23 bp, Homo sapiens
tgccccgaccccacctgaggcag

SEQ ID NO: 2275314 - DNA, 22 bp, Homo sapiens
tgccccggcccaacctcgccct

SEQ ID NO: 2275315 - DNA, 17 bp, Homo sapiens
tgccccttgaccccaca

SEQ ID NO: 2275316 - DNA, 18 bp, Homo sapiens
tgccccttgaccccacac

SEQ ID NO: 2275317 - DNA, 15 bp, Homo sapiens
tgcccgaggttcctg

SEQ ID NO: 2275318 - DNA, 13 bp, Homo sapiens
tgccctccaggcc

SEQ ID NO: 2275319 - DNA, 12 bp, Homo sapiens
tgccctccccca

SEQ ID NO: 2275320 - DNA, 15 bp, Homo sapiens
tgccctcccccacgg

SEQ ID NO: 2275321 - DNA, 18 bp, Homo sapiens
tgccctccgtcctggcag

SEQ ID NO: 2275322 - DNA, 19 bp, Homo sapiens
tgccctccgtcctggcagg

SEQ ID NO: 2275323 - DNA, 22 bp, Homo sapiens
tgccctccgtcctggcagggca

SEQ ID NO: 2275324 - DNA, 13 bp, Homo sapiens
tgccctgccctgg

SEQ ID NO: 2275325 - DNA, 22 bp, Homo sapiens
tgccctgtccactctgctcagg

SEQ ID NO: 2275326 - DNA, 21 bp, Homo sapiens
tgcccttaaaataatgattta

SEQ ID NO: 2275327 - DNA, 22 bp, Homo sapiens
tgcccttctatactttctcaca

SEQ ID NO: 2275328 - DNA, 15 bp, Homo sapiens
tgcccttgagtctag

SEQ ID NO: 2275329 - DNA, 16 bp, Homo sapiens
tgccgagtgccccaga

SEQ ID NO: 2275330 - DNA, 15 bp, Homo sapiens
tgcctaaatttcaca

SEQ ID NO: 2275331 - DNA, 12 bp, Homo sapiens
tgcctctgaaaa

SEQ ID NO: 2275332 - DNA, 17 bp, Homo sapiens
tgcctctgaaaatattt

SEQ ID NO: 2275333 - DNA, 16 bp, Homo sapiens
tgcctgcagctgagat

SEQ ID NO: 2275334 - DNA, 15 bp, Homo sapiens
tgcctgtatttccaa

SEQ ID NO: 2275335 - DNA, 17 bp, Homo sapiens
tgcctgtgaccggggtc

SEQ ID NO: 2275336 - DNA, 16 bp, Homo sapiens
tgcctgtttggggagg

SEQ ID NO: 2275337 - DNA, 15 bp, Homo sapiens
tgccttatggaacac

SEQ ID NO: 2275338 - DNA, 22 bp, Homo sapiens
tgccttcaaaaatgtgctgcct

SEQ ID NO: 2275339 - DNA, 21 bp, Homo sapiens
tgcctttagcgtgtaaatgga

SEQ ID NO: 2275340 - DNA, 19 bp, Homo sapiens
tgcgcagccgcgctctgcc

SEQ ID NO: 2275341 - DNA, 20 bp, Homo sapiens
tgcgcagccgcgctctgccc

SEQ ID NO: 2275342 - DNA, 21 bp, Homo sapiens
tgcgcagccgcgctctgcccc

SEQ ID NO: 2275343 - DNA, 22 bp, Homo sapiens
tgcgcagccgcgctctgcccct

SEQ ID NO: 2275344 - DNA, 15 bp, Homo sapiens
gcccccaccctgctt

SEQ ID NO: 2275345 - DNA, 17 bp, Homo sapiens
gcccccagaccccatcc

SEQ ID NO: 2275346 - DNA, 17 bp, Homo sapiens
gcccccagcgtgggggt

SEQ ID NO: 2275347 - DNA, 19 bp, Homo sapiens
gcccccgccctcgctccgg

SEQ ID NO: 2275348 - DNA, 20 bp, Homo sapiens
gcccccgccctcgctccggg

SEQ ID NO: 2275349 - DNA, 18 bp, Homo sapiens
gcccccggaggcgcccac

SEQ ID NO: 2275350 - DNA, 16 bp, Homo sapiens
tactatggctgtattt

SEQ ID NO: 2275351 - DNA, 15 bp, Homo sapiens
tactcaccaaaatat

SEQ ID NO: 2275352 - DNA, 20 bp, Homo sapiens
tactcactgagtaacagcta

SEQ ID NO: 2275353 - DNA, 13 bp, Homo sapiens
tactccaaaaaga

SEQ ID NO: 2275354 - DNA, 16 bp, Homo sapiens
tagttctatttctatc

SEQ ID NO: 2275355 - DNA, 17 bp, Homo sapiens
tccccaaaacaaagtct

SEQ ID NO: 2275356 - DNA, 21 bp, Homo sapiens
tccccaaaacaaagtctttgg

SEQ ID NO: 2275357 - DNA, 15 bp, Homo sapiens
tccccacaccctgga

SEQ ID NO: 2275358 - DNA, 14 bp, Homo sapiens
tccccactgaagaa

SEQ ID NO: 2275359 - DNA, 20 bp, Homo sapiens
tccccagttaatgtgccaaa

SEQ ID NO: 2275360 - DNA, 21 bp, Homo sapiens
tccccagttaatgtgccaaaa

SEQ ID NO: 2275361 - DNA, 15 bp, Homo sapiens
tcccccacgcctcca

SEQ ID NO: 2275362 - DNA, 12 bp, Homo sapiens
tcccccaggacc

SEQ ID NO: 2275363 - DNA, 20 bp, Homo sapiens
tccccctccccggcatcatt

SEQ ID NO: 2275364 - DNA, 21 bp, Homo sapiens
tccccgagccgagctctcctg

SEQ ID NO: 2275365 - DNA, 18 bp, Homo sapiens
tccccgcccgccctcctc

SEQ ID NO: 2275366 - DNA, 14 bp, Homo sapiens
tccccgcctcctcc

SEQ ID NO: 2275367 - DNA, 18 bp, Homo sapiens
tccccgcctcctccctgc

SEQ ID NO: 2275368 - DNA, 17 bp, Homo sapiens
tccccggacgctggctc

SEQ ID NO: 2275369 - DNA, 16 bp, Homo sapiens
tccccgtgttgggtgg

SEQ ID NO: 2275370 - DNA, 15 bp, Homo sapiens
tcccctgcgcaggcc

SEQ ID NO: 2275371 - DNA, 19 bp, Homo sapiens
tcccctgcgcaggccctcc

SEQ ID NO: 2275372 - DNA, 20 bp, Homo sapiens
tcccctgcgcaggccctccg

SEQ ID NO: 2275373 - DNA, 14 bp, Homo sapiens
tcccctggtgcccc

SEQ ID NO: 2275374 - DNA, 23 bp, Homo sapiens
tcccgaatggagtccagacctgg

SEQ ID NO: 2275375 - DNA, 19 bp, Homo sapiens
tcccgagacggcactgaga

SEQ ID NO: 2275376 - DNA, 22 bp, Homo sapiens
tcccgcagcaccagcctgagcc

SEQ ID NO: 2275377 - DNA, 15 bp, Homo sapiens
tcccgccccagcctc

SEQ ID NO: 2275378 - DNA, 19 bp, Homo sapiens
tcccgccccagcctcctga

SEQ ID NO: 2275379 - DNA, 14 bp, Homo sapiens
tcccgcttcctccg

SEQ ID NO: 2275380 - DNA, 16 bp, Homo sapiens
tcccgcttcctccggc

SEQ ID NO: 2275381 - DNA, 17 bp, Homo sapiens
tcccgtatgctttcttc

SEQ ID NO: 2275382 - DNA, 14 bp, Homo sapiens
tcccgtccgtccgc

SEQ ID NO: 2275383 - DNA, 15 bp, Homo sapiens
tcccgtccgtccgcc

SEQ ID NO: 2275384 - DNA, 22 bp, Homo sapiens
tccctcctcccccacgcctcca

SEQ ID NO: 2275385 - DNA, 18 bp, Homo sapiens
tccctcggtcagcaccgt

SEQ ID NO: 2275386 - DNA, 18 bp, Homo sapiens
tccctgacttcccagctg

SEQ ID NO: 2275387 - DNA, 13 bp, Homo sapiens
tcgcccctcctcg

SEQ ID NO: 2275388 - DNA, 20 bp, Homo sapiens
tcgcctcaggctttttccat

SEQ ID NO: 2275389 - DNA, 11 bp, Homo sapiens
tcgcctcctcc

SEQ ID NO: 2275390 - DNA, 15 bp, Homo sapiens
tcgcctcctccagct

SEQ ID NO: 2275391 - DNA, 18 bp, Homo sapiens
tcgcctcctccagctcct

SEQ ID NO: 2275392 - DNA, 20 bp, Homo sapiens
tcgcctcctccagctcctgc

SEQ ID NO: 2275393 - DNA, 13 bp, Homo sapiens
tcgcgacaatgca

SEQ ID NO: 2275394 - DNA, 16 bp, Homo sapiens
tcgcgacaatgcaaac

SEQ ID NO: 2275395 - DNA, 19 bp, Homo sapiens
tcgctggctgatcattgca

SEQ ID NO: 2275396 - DNA, 22 bp, Homo sapiens
tcggaaatacactacaaatgtt

SEQ ID NO: 2275397 - DNA, 12 bp, Homo sapiens
tcggccagagct

SEQ ID NO: 2275398 - DNA, 15 bp, Homo sapiens
tcggctgggcagggc

SEQ ID NO: 2275399 - DNA, 21 bp, Homo sapiens
tcggctgggcagggccgcagg

SEQ ID NO: 2275400 - DNA, 16 bp, Homo sapiens
tcgggaaggcctgagg

SEQ ID NO: 2275401 - DNA, 21 bp, Homo sapiens
tcgggaaggcctgagggaagc

SEQ ID NO: 2275402 - DNA, 16 bp, Homo sapiens
tcgggccgcctcctcc

SEQ ID NO: 2275403 - DNA, 18 bp, Homo sapiens
tcgggctaagtccagctc

SEQ ID NO: 2275404 - DNA, 22 bp, Homo sapiens
tcggggcaggaagtccctgaga

SEQ ID NO: 2275405 - DNA, 14 bp, Homo sapiens
tcgggggaggagca

SEQ ID NO: 2275406 - DNA, 17 bp, Homo sapiens
tcgggggaggagcaccc

SEQ ID NO: 2275407 - DNA, 19 bp, Homo sapiens
tcgggggaggagcaccccc

SEQ ID NO: 2275408 - DNA, 17 bp, Homo sapiens
tcgggggcggctctggg

SEQ ID NO: 2275409 - DNA, 15 bp, Homo sapiens
tcgggtgcccaggac

SEQ ID NO: 2275410 - DNA, 20 bp, Homo sapiens
tcgtactttcacatctctgt

SEQ ID NO: 2275411 - DNA, 16 bp, Homo sapiens
tcgtccggcctgcagc

SEQ ID NO: 2275412 - DNA, 17 bp, Homo sapiens
tcgtccggcctgcagcc

SEQ ID NO: 2275413 - DNA, 22 bp, Homo sapiens
tcgtccggcctgcagcccagaa

SEQ ID NO: 2275414 - DNA, 13 bp, Homo sapiens
tcgtctttcagcg

SEQ ID NO: 2275415 - DNA, 14 bp, Homo sapiens
tcgtctttcagcga

SEQ ID NO: 2275416 - DNA, 17 bp, Homo sapiens
tcgtgcatttgtgagcc

SEQ ID NO: 2275417 - DNA, 15 bp, Homo sapiens
tcgtgttcgctggct

SEQ ID NO: 2275418 - DNA, 22 bp, Homo sapiens
tctaaaatactcaccaaaatat

SEQ ID NO: 2275419 - DNA, 21 bp, Homo sapiens
tctaaacacacttagaatact

SEQ ID NO: 2275420 - DNA, 20 bp, Homo sapiens
tctaaagcagagatgtatta

SEQ ID NO: 2275421 - DNA, 14 bp, Homo sapiens
tctaaatgtttctt

SEQ ID NO: 2275422 - DNA, 15 bp, Homo sapiens
tctaactaaggacag

SEQ ID NO: 2275423 - DNA, 16 bp, Homo sapiens
tctaactagtaatctt

SEQ ID NO: 2275424 - DNA, 16 bp, Homo sapiens
tctaagattgtacata

SEQ ID NO: 2275425 - DNA, 23 bp, Homo sapiens
tctaagtcagtttcacatatttg

SEQ ID NO: 2275426 - DNA, 22 bp, Homo sapiens
tctacaacataatgatactgaa

SEQ ID NO: 2275427 - DNA, 22 bp, Homo sapiens
ttcctccagcccagtcttacat

SEQ ID NO: 2275428 - DNA, 17 bp, Homo sapiens
ttcctccggctggacct

SEQ ID NO: 2275429 - DNA, 12 bp, Homo sapiens
ttcctcctgaca

SEQ ID NO: 2275430 - DNA, 18 bp, Homo sapiens
ttcctgaagaattgaaaa

SEQ ID NO: 2275431 - DNA, 14 bp, Homo sapiens
ttcctgaattggaa

SEQ ID NO: 2275432 - DNA, 15 bp, Homo sapiens
ttcctgctacagtag

SEQ ID NO: 2275433 - DNA, 18 bp, Homo sapiens
ttcctggagtgaagaaaa

SEQ ID NO: 2275434 - DNA, 22 bp, Homo sapiens
ttcctggattttctttctatgt

SEQ ID NO: 2275435 - DNA, 15 bp, Homo sapiens
ttcctgtttccaggg

SEQ ID NO: 2275436 - DNA, 16 bp, Homo sapiens
ttcctgtttccagggt

SEQ ID NO: 2275437 - DNA, 11 bp, Homo sapiens
ttccttcagtg

SEQ ID NO: 2275438 - DNA, 23 bp, Homo sapiens
ttccttcagtgccttatggaaca

SEQ ID NO: 2275439 - DNA, 14 bp, Homo sapiens
ttccttcctgttct

SEQ ID NO: 2275440 - DNA, 16 bp, Homo sapiens
ttcctttgacctctca

SEQ ID NO: 2275441 - DNA, 17 bp, Homo sapiens
ttccttttgaagctcaa

SEQ ID NO: 2275442 - DNA, 23 bp, Homo sapiens
ttcgatcgtttcacatctgtata

SEQ ID NO: 2275443 - DNA, 20 bp, Homo sapiens
ttcgcctcctccagctcctg

SEQ ID NO: 2275444 - DNA, 11 bp, Homo sapiens
ttcgggaagaa

SEQ ID NO: 2275445 - DNA, 11 bp, Homo sapiens
ttcgtgcattt

SEQ ID NO: 2275446 - DNA, 12 bp, Homo sapiens
ttcgtgcatttg

SEQ ID NO: 2275447 - DNA, 15 bp, Homo sapiens
ttcgtgcatttgtga

SEQ ID NO: 2275448 - DNA, 18 bp, Homo sapiens
ttctaaaaaagatactgt

SEQ ID NO: 2275449 - DNA, 15 bp, Homo sapiens
ttctaaaacattctt

SEQ ID NO: 2275450 - DNA, 19 bp, Homo sapiens
ttctaaactgttttcatgt

SEQ ID NO: 2275451 - DNA, 21 bp, Homo sapiens
ttctaaactgttttcatgtgt

SEQ ID NO: 2275452 - DNA, 12 bp, Homo sapiens
ttctaaatgttt

SEQ ID NO: 2275453 - DNA, 15 bp, Homo sapiens
ttctaaatgtttctt

SEQ ID NO: 2275454 - DNA, 13 bp, Homo sapiens
ttctaactaagga

SEQ ID NO: 2275455 - DNA, 21 bp, Homo sapiens
ttctaagcttatttctaacta

SEQ ID NO: 2275456 - DNA, 17 bp, Homo sapiens
ttctaagggatccagag

SEQ ID NO: 2275457 - DNA, 20 bp, Homo sapiens
ttctacaggaaatacagaga

SEQ ID NO: 2275458 - DNA, 14 bp, Homo sapiens
ttctagcaactgtt

SEQ ID NO: 2275459 - DNA, 18 bp, Homo sapiens
ttctagctataacaactc

SEQ ID NO: 2275460 - DNA, 20 bp, Homo sapiens
ttctagctataacaactcta

SEQ ID NO: 2275461 - DNA, 18 bp, Homo sapiens
ttctagtcaactgctgtt

SEQ ID NO: 2275462 - DNA, 21 bp, Homo sapiens
ttctagtcaactgctgtttta

SEQ ID NO: 2275463 - DNA, 14 bp, Homo sapiens
ttctagtctctgat

SEQ ID NO: 2275464 - DNA, 13 bp, Homo sapiens
ttctatactgttt

SEQ ID NO: 2275465 - DNA, 19 bp, Homo sapiens
ttctatactgtttgtaata

SEQ ID NO: 2275466 - DNA, 24 bp, Homo sapiens
ttctatactgtttgtaatatacag

SEQ ID NO: 2275467 - DNA, 16 bp, Homo sapiens
ttctatatttggattc

SEQ ID NO: 2275468 - DNA, 23 bp, Homo sapiens
ttctatatttggattcacagcct

SEQ ID NO: 2275469 - DNA, 15 bp, Homo sapiens
ttctatgcctgtatt

SEQ ID NO: 2275470 - DNA, 17 bp, Homo sapiens
ttctatgtagaactgtt

SEQ ID NO: 2275471 - DNA, 13 bp, Homo sapiens
ttctatttctatc

SEQ ID NO: 2275472 - DNA, 14 bp, Homo sapiens
ttctatttctatct

SEQ ID NO: 2275473 - DNA, 22 bp, Homo sapiens
ttctcaaaaagctgctatccaa

SEQ ID NO: 2275474 - DNA, 21 bp, Homo sapiens
ttctcacatgtggctccccct

SEQ ID NO: 2275475 - DNA, 13 bp, Homo sapiens
ttctcattatgaa

SEQ ID NO: 2275476 - DNA, 16 bp, Homo sapiens
ttctccttgtacttga

SEQ ID NO: 2275477 - DNA, 18 bp, Homo sapiens
ttctccttgtacttgaat

SEQ ID NO: 2275478 - DNA, 16 bp, Homo sapiens
ttctcctttttacccc

SEQ ID NO: 2275479 - DNA, 15 bp, Homo sapiens
ttctctagacaaaat

SEQ ID NO: 2275480 - DNA, 21 bp, Homo sapiens
ttctctgatcacaacttttct

SEQ ID NO: 2275481 - DNA, 21 bp, Homo sapiens
ttctctgccctgccctggcca

SEQ ID NO: 2275482 - DNA, 22 bp, Homo sapiens
ttctcttacgctctctgtctgg

SEQ ID NO: 2275483 - DNA, 13 bp, Homo sapiens
ttctcttcctaaa

SEQ ID NO: 2275484 - DNA, 17 bp, Homo sapiens
ttctgaaaactgtttat

SEQ ID NO: 2275485 - DNA, 13 bp, Homo sapiens
ttctgaattcata

SEQ ID NO: 2275486 - DNA, 16 bp, Homo sapiens
ttctgagtgaatgtta

SEQ ID NO: 2275487 - DNA, 23 bp, Homo sapiens
ttctgagtgaatgttaacatgcg

SEQ ID NO: 2275488 - DNA, 23 bp, Homo sapiens
ttctgataagactggaaaatagt

SEQ ID NO: 2275489 - DNA, 14 bp, Homo sapiens
ttctgcaataacag

SEQ ID NO: 2275490 - DNA, 18 bp, Homo sapiens
ttctgcaataacagtttt

SEQ ID NO: 2275491 - DNA, 19 bp, Homo sapiens
ttctgcaataacagtttta

SEQ ID NO: 2275492 - DNA, 22 bp, Homo sapiens
ttctgcaataacagttttaaga

SEQ ID NO: 2275493 - DNA, 16 bp, Homo sapiens
ttctgcatttggtaaa

SEQ ID NO: 2275494 - DNA, 14 bp, Homo sapiens
ttctgctaatttat

SEQ ID NO: 2275495 - DNA, 16 bp, Homo sapiens
ttctgctaatttatga

SEQ ID NO: 2275496 - DNA, 18 bp, Homo sapiens
ttctggaggtggggaggg

SEQ ID NO: 2275497 - DNA, 14 bp, Homo sapiens
ttctggctgaaaat

SEQ ID NO: 2275498 - DNA, 14 bp, Homo sapiens
ttctggggccagcc

SEQ ID NO: 2275499 - DNA, 15 bp, Homo sapiens
ttctggggccagccc

SEQ ID NO: 2275500 - DNA, 18 bp, Homo sapiens
ttctggggccagcccctc

SEQ ID NO: 2275501 - DNA, 21 bp, Homo sapiens
ttctgtcctcaggtgaataac

SEQ ID NO: 2275502 - DNA, 21 bp, Homo sapiens
ttctgtgtaaacagaagcctg

SEQ ID NO: 2275503 - DNA, 18 bp, Homo sapiens
ttctgttacacaatatgt

SEQ ID NO: 2275504 - DNA, 24 bp, Homo sapiens
ttctgttgttcagtcctctgcact

SEQ ID NO: 2275505 - DNA, 16 bp, Homo sapiens
ttcttaaaatattgtg

SEQ ID NO: 2275506 - DNA, 22 bp, Homo sapiens
ttcttatcacacttgcaaatga

SEQ ID NO: 2275507 - DNA, 20 bp, Homo sapiens
ttcttcccatttgtaatgta

SEQ ID NO: 2275508 - DNA, 22 bp, Homo sapiens
ttcttgcggcaccgcccaccca

SEQ ID NO: 2275509 - DNA, 13 bp, Homo sapiens
ttcttgcttgtac

SEQ ID NO: 2275510 - DNA, 14 bp, Homo sapiens
ttcttgctttcaca

SEQ ID NO: 2275511 - DNA, 19 bp, Homo sapiens
ttcttggatctttttgcag

SEQ ID NO: 2275512 - DNA, 22 bp, Homo sapiens
ttcttggcctgctagcggctga

SEQ ID NO: 2275513 - DNA, 17 bp, Homo sapiens
ttcttgtgttgttttct

SEQ ID NO: 2275514 - DNA, 19 bp, Homo sapiens
ttcttgtgttgttttctct

SEQ ID NO: 2275515 - DNA, 21 bp, Homo sapiens
ttcttgtgttgttttctctga

SEQ ID NO: 2275516 - DNA, 14 bp, Homo sapiens
ttctttaatcaaaa

SEQ ID NO: 2275517 - DNA, 13 bp, Homo sapiens
ttctttattcaca

SEQ ID NO: 2275518 - DNA, 12 bp, Homo sapiens
ttctttctatgt

SEQ ID NO: 2275519 - DNA, 14 bp, Homo sapiens
ttctttctatgtag

SEQ ID NO: 2275520 - DNA, 16 bp, Homo sapiens
ttcttttatatctgta

SEQ ID NO: 2275521 - DNA, 17 bp, Homo sapiens
ttcttttcagcttgttt

SEQ ID NO: 2275522 - DNA, 16 bp, Homo sapiens
ttcttttcctctctta

SEQ ID NO: 2275523 - DNA, 21 bp, Homo sapiens
ttcttttttcaatgtactgta

SEQ ID NO: 2275524 - DNA, 20 bp, Homo sapiens
ttgaaaagaagaaagtctat

SEQ ID NO: 2275525 - DNA, 23 bp, Homo sapiens
ttgaaaagaagaaagtctatgct

SEQ ID NO: 2275526 - DNA, 18 bp, Homo sapiens
ttgaaagaagtcaaatga

SEQ ID NO: 2275527 - DNA, 19 bp, Homo sapiens
ttgaaagaagtcaaatgaa

SEQ ID NO: 2275528 - DNA, 18 bp, Homo sapiens
ttgaaatactctacaaga

SEQ ID NO: 2275529 - DNA, 14 bp, Homo sapiens
ttgaaatttatgac

SEQ ID NO: 2275530 - DNA, 20 bp, Homo sapiens
ttgaacaagatttccctaaa

SEQ ID NO: 2275531 - DNA, 22 bp, Homo sapiens
ttgaacagttggctgtatgact

SEQ ID NO: 2275532 - DNA, 14 bp, Homo sapiens
ttgaactcttggcc

SEQ ID NO: 2275533 - DNA, 18 bp, Homo sapiens
ttgaagaaggaaagaacc

SEQ ID NO: 2275534 - DNA, 17 bp, Homo sapiens
ttgaagtctccttttgt

SEQ ID NO: 2275535 - DNA, 11 bp, Homo sapiens
ttgaagtcttg

SEQ ID NO: 2275536 - DNA, 12 bp, Homo sapiens
ttgaatgatgcc

SEQ ID NO: 2275537 - DNA, 20 bp, Homo sapiens
ttgaatgtccccattctata

SEQ ID NO: 2275538 - DNA, 12 bp, Homo sapiens
ttgacaatttgc

SEQ ID NO: 2275539 - DNA, 22 bp, Homo sapiens
ttgacctctcacttttttataa

SEQ ID NO: 2275540 - DNA, 21 bp, Homo sapiens
ttgacgacctacatctgaaat

SEQ ID NO: 2275541 - DNA, 22 bp, Homo sapiens
ttgacgacctacatctgaaatc

SEQ ID NO: 2275542 - DNA, 14 bp, Homo sapiens
ttgagactgctaga

SEQ ID NO: 2275543 - DNA, 18 bp, Homo sapiens
ttgagatactttttcttt

SEQ ID NO: 2275544 - DNA, 23 bp, Homo sapiens
ttgagatactttttcttttgtaa

SEQ ID NO: 2275545 - DNA, 19 bp, Homo sapiens
ttgaggaggggagcaaggc

SEQ ID NO: 2275546 - DNA, 19 bp, Homo sapiens
ttgagtaatattacatttc

SEQ ID NO: 2275547 - DNA, 20 bp, Homo sapiens
ttgagtaatattacatttca

SEQ ID NO: 2275548 - DNA, 23 bp, Homo sapiens
ttgatataataattacttaatgt

SEQ ID NO: 2275549 - DNA, 15 bp, Homo sapiens
ttgatataattactt

SEQ ID NO: 2275550 - DNA, 17 bp, Homo sapiens
ttgatcacactatttta

SEQ ID NO: 2275551 - DNA, 19 bp, Homo sapiens
ttgatcagacattcagaga

SEQ ID NO: 2275552 - DNA, 17 bp, Homo sapiens
ttgatcagatcttacaa

SEQ ID NO: 2275553 - DNA, 18 bp, Homo sapiens
ttgatcagatcttacaag

SEQ ID NO: 2275554 - DNA, 21 bp, Homo sapiens
ttgatcccaatagaatacctc

SEQ ID NO: 2275555 - DNA, 18 bp, Homo sapiens
ttgatgaccaatctctgt

SEQ ID NO: 2275556 - DNA, 20 bp, Homo sapiens
ttgatgaccaatctctgtga

SEQ ID NO: 2275557 - DNA, 22 bp, Homo sapiens
ttgatgtatccaacaagccaga

SEQ ID NO: 2275558 - DNA, 13 bp, Homo sapiens
ttgattaaaagca

SEQ ID NO: 2275559 - DNA, 17 bp, Homo sapiens
ttgattaagcttttgtc

SEQ ID NO: 2275560 - DNA, 13 bp, Homo sapiens
ttgattccactga

SEQ ID NO: 2275561 - DNA, 21 bp, Homo sapiens
ttgatttctttccttcccaat

SEQ ID NO: 2275562 - DNA, 18 bp, Homo sapiens
ttgatttttttgttcatt

SEQ ID NO: 2275563 - DNA, 15 bp, Homo sapiens
tttcacatctgtata

SEQ ID NO: 2275564 - DNA, 19 bp, Homo sapiens
tttcaccctgccaccctct

SEQ ID NO: 2275565 - DNA, 21 bp, Homo sapiens
tttcaccctgccaccctctgc

SEQ ID NO: 2275566 - DNA, 22 bp, Homo sapiens
tttcacgggcaacactcactgc

SEQ ID NO: 2275567 - DNA, 16 bp, Homo sapiens
tttcagaatattttca

SEQ ID NO: 2275568 - DNA, 22 bp, Homo sapiens
tttcaggggctgactctccagg

SEQ ID NO: 2275569 - DNA, 17 bp, Homo sapiens
tttcaggttaaattaaa

SEQ ID NO: 2275570 - DNA, 15 bp, Homo sapiens
tttcataattcattt

SEQ ID NO: 2275571 - DNA, 19 bp, Homo sapiens
tttcataattcatttaaga

SEQ ID NO: 2275572 - DNA, 15 bp, Homo sapiens
tttcatccaccaata

SEQ ID NO: 2275573 - DNA, 16 bp, Homo sapiens
tttcatccaccaatat

SEQ ID NO: 2275574 - DNA, 16 bp, Homo sapiens
tttcatctgagctttt

SEQ ID NO: 2275575 - DNA, 12 bp, Homo sapiens
tttcatgaagaa

SEQ ID NO: 2275576 - DNA, 21 bp, Homo sapiens
tttcatgaagaaaaaatttta

SEQ ID NO: 2275577 - DNA, 20 bp, Homo sapiens
tttcatgactggtgcgttcc

SEQ ID NO: 2275578 - DNA, 22 bp, Homo sapiens
tttcattgagggaaaacataat

SEQ ID NO: 2275579 - DNA, 16 bp, Homo sapiens
tttcatttcttattaa

SEQ ID NO: 2275580 - DNA, 23 bp, Homo sapiens
tttccaaacaatttagccagaat

SEQ ID NO: 2275581 - DNA, 13 bp, Homo sapiens
tttccaaagctga

SEQ ID NO: 2275582 - DNA, 21 bp, Homo sapiens
tttccaacaggggctggaggg

SEQ ID NO: 2275583 - DNA, 11 bp, Homo sapiens
tttccaaggcc

SEQ ID NO: 2275584 - DNA, 13 bp, Homo sapiens
tttccacacaggc

SEQ ID NO: 2275585 - DNA, 23 bp, Homo sapiens
tttccactataattttacaaagt

SEQ ID NO: 2275586 - DNA, 18 bp, Homo sapiens
tttccatatagtttgttt

SEQ ID NO: 2275587 - DNA, 17 bp, Homo sapiens
tttccatgatacaaaga

SEQ ID NO: 2275588 - DNA, 17 bp, Homo sapiens
tttcccacaattctttt

SEQ ID NO: 2275589 - DNA, 13 bp, Homo sapiens
tttccctatttta

SEQ ID NO: 2275590 - DNA, 14 bp, Homo sapiens
tttccctattttag

SEQ ID NO: 2275591 - DNA, 19 bp, Homo sapiens
tttccctgtgtaccctcca

SEQ ID NO: 2275592 - DNA, 15 bp, Homo sapiens
tttcctatttgcaca

SEQ ID NO: 2275593 - DNA, 16 bp, Homo sapiens
tttcctgatgttgata

SEQ ID NO: 2275594 - DNA, 19 bp, Homo sapiens
tttcctgtggaaatatgca

SEQ ID NO: 2275595 - DNA, 12 bp, Homo sapiens
tttccttcagtg

SEQ ID NO: 2275596 - DNA, 13 bp, Homo sapiens
tttcgcctcctcc

SEQ ID NO: 2275597 - DNA, 23 bp, Homo sapiens
tttcggaaatacactacaaatgt

SEQ ID NO: 2275598 - DNA, 14 bp, Homo sapiens
tttcgtgcatttgt

SEQ ID NO: 2275599 - DNA, 13 bp, Homo sapiens
tttctaaatgttt

SEQ ID NO: 2275600 - DNA, 17 bp, Homo sapiens
tttctaaatgtttcttt

SEQ ID NO: 2275601 - DNA, 23 bp, Homo sapiens
tttctagctataacaactctatt

SEQ ID NO: 2275602 - DNA, 15 bp, Homo sapiens
tttctatctgcaaat

SEQ ID NO: 2275603 - DNA, 13 bp, Homo sapiens
tttctatgtacta

SEQ ID NO: 2275604 - DNA, 23 bp, Homo sapiens
tttctatgtactagtactgtgta

SEQ ID NO: 2275605 - DNA, 21 bp, Homo sapiens
tttctatgtagaactgttcat

SEQ ID NO: 2275606 - DNA, 14 bp, Homo sapiens
tttctcattcttgc

SEQ ID NO: 2275607 - DNA, 23 bp, Homo sapiens
tttctcgtactttcacatctctg

SEQ ID NO: 2275608 - DNA, 15 bp, Homo sapiens
tttcttcccatttgt

SEQ ID NO: 2275609 - DNA, 20 bp, Homo sapiens
tttcttcccatttgtaatgt

SEQ ID NO: 2275610 - DNA, 22 bp, Homo sapiens
tttcttcccatttgtaatgtat

SEQ ID NO: 2275611 - DNA, 16 bp, Homo sapiens
tttcttgcttgtacct

SEQ ID NO: 2275612 - DNA, 12 bp, Homo sapiens
tttcttgctttg

SEQ ID NO: 2275613 - DNA, 23 bp, Homo sapiens
tttgaaaacaccaagagtacagg

SEQ ID NO: 2275614 - DNA, 16 bp, Homo sapiens
tttgaaagaagtcaaa

SEQ ID NO: 2275615 - DNA, 16 bp, Homo sapiens
tttgaaagatggtaat

SEQ ID NO: 2275616 - DNA, 20 bp, Homo sapiens
tttgaaagatggtaatcttt

SEQ ID NO: 2275617 - DNA, 23 bp, Homo sapiens
tttgaaagatggtaatcttttct

SEQ ID NO: 2275618 - DNA, 21 bp, Homo sapiens
tttgaaagtgtttttctttaa

SEQ ID NO: 2275619 - DNA, 22 bp, Homo sapiens
tttgaaatttaaaaatctttca

SEQ ID NO: 2275620 - DNA, 17 bp, Homo sapiens
tttgaagaagggaaatt

SEQ ID NO: 2275621 - DNA, 13 bp, Homo sapiens
tttgaagtcttgt

SEQ ID NO: 2275622 - DNA, 13 bp, Homo sapiens
tttgagtgtgcaa

SEQ ID NO: 2275623 - DNA, 15 bp, Homo sapiens
tttgagtgtgcaata

SEQ ID NO: 2275624 - DNA, 21 bp, Homo sapiens
tttgagtttctggctgaaaat

SEQ ID NO: 2275625 - DNA, 22 bp, Homo sapiens
tttgatgttctttcaccctttt

SEQ ID NO: 2275626 - DNA, 14 bp, Homo sapiens
tttgattctgaagt

SEQ ID NO: 2275627 - DNA, 14 bp, Homo sapiens
tttgattgtgaaac

SEQ ID NO: 2275628 - DNA, 15 bp, Homo sapiens
tttgcaaacaaaatg

SEQ ID NO: 2275629 - DNA, 18 bp, Homo sapiens
tttgcaaacaaaatgatg

SEQ ID NO: 2275630 - DNA, 18 bp, Homo sapiens
tttgcattccagcgtctg

SEQ ID NO: 2275631 - DNA, 20 bp, Homo sapiens
tttgcattccagcgtctgct

SEQ ID NO: 2275632 - DNA, 22 bp, Homo sapiens
tttgcattccagcgtctgctgt

SEQ ID NO: 2275633 - DNA, 21 bp, Homo sapiens
tttgcatttctcttcctaaat

SEQ ID NO: 2275634 - DNA, 16 bp, Homo sapiens
tttgcgctctgggttt

SEQ ID NO: 2275635 - DNA, 13 bp, Homo sapiens
tttgcttatttat

SEQ ID NO: 2275636 - DNA, 17 bp, Homo sapiens
tttgcttatttatattc

SEQ ID NO: 2275637 - DNA, 13 bp, Homo sapiens
tttggaagaaagg

SEQ ID NO: 2275638 - DNA, 16 bp, Homo sapiens
tttggcattttggctc

SEQ ID NO: 2275639 - DNA, 12 bp, Homo sapiens
tttggctcgctg

SEQ ID NO: 2275640 - DNA, 12 bp, Homo sapiens
tttggctgctct

SEQ ID NO: 2275641 - DNA, 17 bp, Homo sapiens
tttggctgctctccatc

SEQ ID NO: 2275642 - DNA, 18 bp, Homo sapiens
tttggctgctctccatct

SEQ ID NO: 2275643 - DNA, 19 bp, Homo sapiens
tttggctgctctccatctc

SEQ ID NO: 2275644 - DNA, 23 bp, Homo sapiens
tttggggacagattcagtcttgc

SEQ ID NO: 2275645 - DNA, 12 bp, Homo sapiens
tttggggcaggg

SEQ ID NO: 2275646 - DNA, 18 bp, Homo sapiens
tttggggcttatcagaac

SEQ ID NO: 2275647 - DNA, 13 bp, Homo sapiens
tttggtcctgcct

SEQ ID NO: 2275648 - DNA, 21 bp, Homo sapiens
tttggtcctgcctaaatttca

SEQ ID NO: 2275649 - DNA, 23 bp, Homo sapiens
tttggtcctgcctaaatttcaca

SEQ ID NO: 2275650 - DNA, 13 bp, Homo sapiens
tttggtgaataac

SEQ ID NO: 2275651 - DNA, 12 bp, Homo sapiens
tttggtgaggac

SEQ ID NO: 2275652 - DNA, 22 bp, Homo sapiens
tttgtaaatatcttttcttctc

SEQ ID NO: 2275653 - DNA, 15 bp, Homo sapiens
tttgtaaccatatga

SEQ ID NO: 2275654 - DNA, 18 bp, Homo sapiens
tttgtaatatacagtttt

SEQ ID NO: 2275655 - DNA, 18 bp, Homo sapiens
tttgtagatatatatttc

SEQ ID NO: 2275656 - DNA, 18 bp, Homo sapiens
tttgtagatgtattttca

SEQ ID NO: 2275657 - DNA, 16 bp, Homo sapiens
tttgtcataaaatgct

SEQ ID NO: 2275658 - DNA, 18 bp, Homo sapiens
tttgtctctgagaacaga

SEQ ID NO: 2275659 - DNA, 13 bp, Homo sapiens
tttgtcttcaact

SEQ ID NO: 2275660 - DNA, 20 bp, Homo sapiens
tttgtgtccataagagaaat

SEQ ID NO: 2275661 - DNA, 21 bp, Homo sapiens
tttgtgtccataagagaaatg

SEQ ID NO: 2275662 - DNA, 16 bp, Homo sapiens
tttgttttggctgctc

SEQ ID NO: 2275663 - DNA, 16 bp, Homo sapiens
ttttaaaaaataacat

SEQ ID NO: 2275664 - DNA, 23 bp, Homo sapiens
ttttaaaattgtgttcttaaaat

SEQ ID NO: 2275665 - DNA, 12 bp, Homo sapiens
ttttaaatcatt

SEQ ID NO: 2275666 - DNA, 13 bp, Homo sapiens
ttttaataaaagt

SEQ ID NO: 2275667 - DNA, 23 bp, Homo sapiens
ttttaatatactaaccatttctt

SEQ ID NO: 2275668 - DNA, 20 bp, Homo sapiens
ttttactcaggctttctatt

SEQ ID NO: 2275669 - DNA, 22 bp, Homo sapiens
ttttactcaggctttctattgg

SEQ ID NO: 2275670 - DNA, 16 bp, Homo sapiens
ttttagatttctttga

SEQ ID NO: 2275671 - DNA, 14 bp, Homo sapiens
ttttaggctattat

SEQ ID NO: 2275672 - DNA, 14 bp, Homo sapiens
ttttataagacaaa

SEQ ID NO: 2275673 - DNA, 13 bp, Homo sapiens
ttttatataacta

SEQ ID NO: 2275674 - DNA, 16 bp, Homo sapiens
ttttatatctgtaaat

SEQ ID NO: 2275675 - DNA, 22 bp, Homo sapiens
ttttatgtcatactctgtgtaa

SEQ ID NO: 2275676 - DNA, 20 bp, Homo sapiens
ttttatgtgaaggtgtttca

SEQ ID NO: 2275677 - DNA, 14 bp, Homo sapiens
ttttattgaataac

SEQ ID NO: 2275678 - DNA, 18 bp, Homo sapiens
ttttcacctgaaacactt

SEQ ID NO: 2275679 - DNA, 20 bp, Homo sapiens
ttttcagcttgtttctatac

SEQ ID NO: 2275680 - DNA, 21 bp, Homo sapiens
ttttcagtgctttgcccttga

SEQ ID NO: 2275681 - DNA, 14 bp, Homo sapiens
ttttcatcacaact

SEQ ID NO: 2275682 - DNA, 11 bp, Homo sapiens
ttttcatccca

SEQ ID NO: 2275683 - DNA, 16 bp, Homo sapiens
ttttccagctgagcat

SEQ ID NO: 2275684 - DNA, 17 bp, Homo sapiens
ttttccatatagtttgt

SEQ ID NO: 2275685 - DNA, 18 bp, Homo sapiens
ttttccatctaaaatact

SEQ ID NO: 2275686 - DNA, 15 bp, Homo sapiens
ttttccttcttagat

SEQ ID NO: 2275687 - DNA, 15 bp, Homo sapiens
ttttcgtgcatttgt

SEQ ID NO: 2275688 - DNA, 13 bp, Homo sapiens
ttttctaaactgt

SEQ ID NO: 2275689 - DNA, 20 bp, Homo sapiens
ttttctactcgagttacaga

SEQ ID NO: 2275690 - DNA, 14 bp, Homo sapiens
ttttctatgtacta

SEQ ID NO: 2275691 - DNA, 16 bp, Homo sapiens
ttttctccatgtctgt

SEQ ID NO: 2275692 - DNA, 14 bp, Homo sapiens
ttttctctgatcac

SEQ ID NO: 2275693 - DNA, 22 bp, Homo sapiens
ttttcttcccatttgtaatgta

SEQ ID NO: 2275694 - DNA, 22 bp, Homo sapiens
ttttgaagaagggaaattcaca

SEQ ID NO: 2275695 - DNA, 13 bp, Homo sapiens
ttttgagtgtgca

SEQ ID NO: 2275696 - DNA, 14 bp, Homo sapiens
ttttgagtgtgcaa

SEQ ID NO: 2275697 - DNA, 13 bp, Homo sapiens
ttttgggtagctg

SEQ ID NO: 2275698 - DNA, 13 bp, Homo sapiens
ttttgtttccaaa

SEQ ID NO: 2275699 - DNA, 18 bp, Homo sapiens
tttttaaatgtgcttcat

SEQ ID NO: 2275700 - DNA, 19 bp, Homo sapiens
tttttaacttatctccagc

SEQ ID NO: 2275701 - DNA, 17 bp, Homo sapiens
tttttactacataatta

SEQ ID NO: 2275702 - DNA, 21 bp, Homo sapiens
tttttactcaggctttctatt

SEQ ID NO: 2275703 - DNA, 21 bp, Homo sapiens
tttttatataagttaaagaga

SEQ ID NO: 2275704 - DNA, 19 bp, Homo sapiens
tttttatataatatgaata

SEQ ID NO: 2275705 - DNA, 16 bp, Homo sapiens
tttttcaatgtactgt

SEQ ID NO: 2275706 - DNA, 20 bp, Homo sapiens
tttttcacctgaaacacttt

SEQ ID NO: 2275707 - DNA, 19 bp, Homo sapiens
tttttccttcagtgcctta

SEQ ID NO: 2275708 - DNA, 11 bp, Homo sapiens
tttttgaagaa

SEQ ID NO: 2275709 - DNA, 21 bp, Homo sapiens
tttttgtaaccatatgattga

SEQ ID NO: 2275710 - DNA, 19 bp, Homo sapiens
ttttttcacctgaaacact

SEQ ID NO: 2275711 - DNA, 14 bp, Homo sapiens
ttttttctggtaag

SEQ ID NO: 2275712 - DNA, 15 bp, Homo sapiens
tgagccaaagagaaa

SEQ ID NO: 2275713 - DNA, 23 bp, Homo sapiens
tgagccaaagagaaaagattaaa

SEQ ID NO: 2275714 - DNA, 14 bp, Homo sapiens
tgagccacagcact

SEQ ID NO: 2275715 - DNA, 15 bp, Homo sapiens
tgagccacagtgggg

SEQ ID NO: 2275716 - DNA, 16 bp, Homo sapiens
tgagccacagtggggc

SEQ ID NO: 2275717 - DNA, 19 bp, Homo sapiens
tgagccacagtggggccca

SEQ ID NO: 2275718 - DNA, 14 bp, Homo sapiens
tgagccagatttca

SEQ ID NO: 2275719 - DNA, 22 bp, Homo sapiens
tgagccagatttcactctcctt

SEQ ID NO: 2275720 - DNA, 20 bp, Homo sapiens
tgagcccaacactcacttaa

SEQ ID NO: 2275721 - DNA, 11 bp, Homo sapiens
tgagcccctcc

SEQ ID NO: 2275722 - DNA, 18 bp, Homo sapiens
tgagctataatgtttccc

SEQ ID NO: 2275723 - DNA, 17 bp, Homo sapiens
tgagctccaccctcccc

SEQ ID NO: 2275724 - DNA, 18 bp, Homo sapiens
tgagctctgacctgcccc

SEQ ID NO: 2275725 - DNA, 20 bp, Homo sapiens
tgaggaaataagacttttag

SEQ ID NO: 2275726 - DNA, 22 bp, Homo sapiens
tgaggacctccacctgggagat

SEQ ID NO: 2275727 - DNA, 20 bp, Homo sapiens
tgaggacggggcagagctga

SEQ ID NO: 2275728 - DNA, 15 bp, Homo sapiens
tgaggcaggagggca

SEQ ID NO: 2275729 - DNA, 18 bp, Homo sapiens
tgaggcaggagggcatgt

SEQ ID NO: 2275730 - DNA, 15 bp, Homo sapiens
tgaggcagggtctca

SEQ ID NO: 2275731 - DNA, 16 bp, Homo sapiens
tgaggcagggtctcac

SEQ ID NO: 2275732 - DNA, 22 bp, Homo sapiens
tgaggcccccggaggcgcccac

SEQ ID NO: 2275733 - DNA, 18 bp, Homo sapiens
tgaggcgggaaccctctg

SEQ ID NO: 2275734 - DNA, 20 bp, Homo sapiens
tgaggcgggaaccctctggg

SEQ ID NO: 2275735 - DNA, 18 bp, Homo sapiens
tgagggaaacaaaatatt

SEQ ID NO: 2275736 - DNA, 16 bp, Homo sapiens
tgagggaagcccaccc

SEQ ID NO: 2275737 - DNA, 22 bp, Homo sapiens
tgagggaagcccacccgcccca

SEQ ID NO: 2275738 - DNA, 18 bp, Homo sapiens
tgaggtgggggcagcggc

SEQ ID NO: 2275739 - DNA, 16 bp, Homo sapiens
tgaggttatgagaaaa

SEQ ID NO: 2275740 - DNA, 19 bp, Homo sapiens
tgaggttatgagaaaaaaa

SEQ ID NO: 2275741 - DNA, 23 bp, Homo sapiens
tgagtaacagctaatctttaata

SEQ ID NO: 2275742 - DNA, 17 bp, Homo sapiens
tgagtaatattacattt

SEQ ID NO: 2275743 - DNA, 14 bp, Homo sapiens
tgagtcggctgggc

SEQ ID NO: 2275744 - DNA, 23 bp, Homo sapiens
tgagtctcattcctctgtccccg

SEQ ID NO: 2275745 - DNA, 13 bp, Homo sapiens
tgagtgaatgtta

SEQ ID NO: 2275746 - DNA, 20 bp, Homo sapiens
tgagtgccttacacaatggt

SEQ ID NO: 2275747 - DNA, 13 bp, Homo sapiens
tgagtggacagca

SEQ ID NO: 2275748 - DNA, 14 bp, Homo sapiens
tgagtggacagcag

SEQ ID NO: 2275749 - DNA, 16 bp, Homo sapiens
tgagtggacagcagct

SEQ ID NO: 2275750 - DNA, 17 bp, Homo sapiens
tgagtggacagcagctg

SEQ ID NO: 2275751 - DNA, 19 bp, Homo sapiens
tgagtgtggcgggaagggt

SEQ ID NO: 2275752 - DNA, 23 bp, Homo sapiens
tgagtttctggctgaaaatggtg

SEQ ID NO: 2275753 - DNA, 19 bp, Homo sapiens
tgataaagatggggaaact

SEQ ID NO: 2275754 - DNA, 14 bp, Homo sapiens
tgatacactgtatc

SEQ ID NO: 2275755 - DNA, 16 bp, Homo sapiens
tgatacactgtatcta

SEQ ID NO: 2275756 - DNA, 18 bp, Homo sapiens
tgatacactgtatctaaa

SEQ ID NO: 2275757 - DNA, 20 bp, Homo sapiens
tgatacactgtatctaaaaa

SEQ ID NO: 2275758 - DNA, 21 bp, Homo sapiens
tgatactgaattgttatgtaa

SEQ ID NO: 2275759 - DNA, 21 bp, Homo sapiens
tgatagacttcgaaaacagat

SEQ ID NO: 2275760 - DNA, 18 bp, Homo sapiens
tgatatacaattagagat

SEQ ID NO: 2275761 - DNA, 14 bp, Homo sapiens
tgatatacagacct

SEQ ID NO: 2275762 - DNA, 16 bp, Homo sapiens
tgatcacactatttta

SEQ ID NO: 2275763 - DNA, 17 bp, Homo sapiens
tgatcagacattcagag

SEQ ID NO: 2275764 - DNA, 21 bp, Homo sapiens
tgatcattgcagtatcagagg

SEQ ID NO: 2275765 - DNA, 13 bp, Homo sapiens
tgatcccagctca

SEQ ID NO: 2275766 - DNA, 24 bp, Homo sapiens
tgatcctcccgccccagcctcctg

SEQ ID NO: 2275767 - DNA, 16 bp, Homo sapiens
tgatctgtcttgtaat

SEQ ID NO: 2275768 - DNA, 15 bp, Homo sapiens
tgatgaccaatctct

SEQ ID NO: 2275769 - DNA, 19 bp, Homo sapiens
tgatgactcttcttatcac

SEQ ID NO: 2275770 - DNA, 18 bp, Homo sapiens
tgatgcttgatataataa

SEQ ID NO: 2275771 - DNA, 18 bp, Homo sapiens
tgatggcacctataaaat

SEQ ID NO: 2275772 - DNA, 12 bp, Homo sapiens
tgatggcagagg

SEQ ID NO: 2275773 - DNA, 21 bp, Homo sapiens
agcctcccccaggctgcgcct

SEQ ID NO: 2275774 - DNA, 15 bp, Homo sapiens
agcctcctgagtagc

SEQ ID NO: 2275775 - DNA, 12 bp, Homo sapiens
agcctcctgctg

SEQ ID NO: 2275776 - DNA, 22 bp, Homo sapiens
agcctcgacctccctggcttga

SEQ ID NO: 2275777 - DNA, 14 bp, Homo sapiens
agcctcgtctttca

SEQ ID NO: 2275778 - DNA, 20 bp, Homo sapiens
agcctgaaccgttacaaaag

SEQ ID NO: 2275779 - DNA, 13 bp, Homo sapiens
agcctgagccaca

SEQ ID NO: 2275780 - DNA, 13 bp, Homo sapiens
agcctgagctcca

SEQ ID NO: 2275781 - DNA, 14 bp, Homo sapiens
agcctgagctccac

SEQ ID NO: 2275782 - DNA, 15 bp, Homo sapiens
agcctgcgtggcctg

SEQ ID NO: 2275783 - DNA, 16 bp, Homo sapiens
agcctgcgtggcctgg

SEQ ID NO: 2275784 - DNA, 14 bp, Homo sapiens
agcctgcttctgcc

SEQ ID NO: 2275785 - DNA, 17 bp, Homo sapiens
agcctttgcgctctggg

SEQ ID NO: 2275786 - DNA, 12 bp, Homo sapiens
aaaaaaataaca

SEQ ID NO: 2275787 - DNA, 12 bp, Homo sapiens
aaaaaataattt

SEQ ID NO: 2275788 - DNA, 19 bp, Homo sapiens
aaaaaattttaaaaatcta

SEQ ID NO: 2275789 - DNA, 20 bp, Homo sapiens
aaaaacattttaaaatcaac

SEQ ID NO: 2275790 - DNA, 22 bp, Homo sapiens
aaaaagctgctatccaatgata

SEQ ID NO: 2275791 - DNA, 15 bp, Homo sapiens
aaaaagttgcacatt

SEQ ID NO: 2275792 - DNA, 14 bp, Homo sapiens
aaaaatagaatata

SEQ ID NO: 2275793 - DNA, 21 bp, Homo sapiens
aaaaatagttttacattaaca

SEQ ID NO: 2275794 - DNA, 12 bp, Homo sapiens
aaaaatctttca

SEQ ID NO: 2275795 - DNA, 18 bp, Homo sapiens
aaaaattacattatgccc

SEQ ID NO: 2275796 - DNA, 13 bp, Homo sapiens
aaaaattgtttct

SEQ ID NO: 2275797 - DNA, 21 bp, Homo sapiens
aaaacaccaccaaatgacaag

SEQ ID NO: 2275798 - DNA, 19 bp, Homo sapiens
aaaacagatgagaagacta

SEQ ID NO: 2275799 - DNA, 14 bp, Homo sapiens
aaaacaggctgctt

SEQ ID NO: 2275800 - DNA, 17 bp, Homo sapiens
aaaacataaaatataca

SEQ ID NO: 2275801 - DNA, 18 bp, Homo sapiens
aaaacattttaaaatcaa

SEQ ID NO: 2275802 - DNA, 21 bp, Homo sapiens
aaaacgtggctgcttcaagga

SEQ ID NO: 2275803 - DNA, 15 bp, Homo sapiens
aaaactaaaattcaa

SEQ ID NO: 2275804 - DNA, 23 bp, Homo sapiens
aaaactgttttgggtagctgcca

SEQ ID NO: 2275805 - DNA, 14 bp, Homo sapiens
aaaacttataattt

SEQ ID NO: 2275806 - DNA, 23 bp, Homo sapiens
aaaacttcaacatgcatatgata

SEQ ID NO: 2275807 - DNA, 14 bp, Homo sapiens
aaaacttttctgca

SEQ ID NO: 2275808 - DNA, 22 bp, Homo sapiens
aaaagaaatattaatatgtact

SEQ ID NO: 2275809 - DNA, 12 bp, Homo sapiens
aaaagaatgtac

SEQ ID NO: 2275810 - DNA, 19 bp, Homo sapiens
aaaagaatgtacagaaaat

SEQ ID NO: 2275811 - DNA, 13 bp, Homo sapiens
aaaagagcttccc

SEQ ID NO: 2275812 - DNA, 17 bp, Homo sapiens
aaaagaggtccattaat

SEQ ID NO: 2275813 - DNA, 15 bp, Homo sapiens
aaaagcagggcagca

SEQ ID NO: 2275814 - DNA, 20 bp, Homo sapiens
aaaagcccaacctcttcctc

SEQ ID NO: 2275815 - DNA, 18 bp, Homo sapiens
aaaagctttagattgaaa

SEQ ID NO: 2275816 - DNA, 22 bp, Homo sapiens
aaaagctttagattgaaattta

SEQ ID NO: 2275817 - DNA, 18 bp, Homo sapiens
aaaaggcctaatgcatta

SEQ ID NO: 2275818 - DNA, 23 bp, Homo sapiens
aaaagtggaatttcttgtttctc

SEQ ID NO: 2275819 - DNA, 16 bp, Homo sapiens
aaaataacatctgaaa

SEQ ID NO: 2275820 - DNA, 21 bp, Homo sapiens
aaaataacatctgaaaagaaa

SEQ ID NO: 2275821 - DNA, 18 bp, Homo sapiens
aaaatacataaaagaatg

SEQ ID NO: 2275822 - DNA, 14 bp, Homo sapiens
aaaatacattgtgt

SEQ ID NO: 2275823 - DNA, 18 bp, Homo sapiens
aaaatactggaattcaaa

SEQ ID NO: 2275824 - DNA, 12 bp, Homo sapiens
aaaatagctttt

SEQ ID NO: 2275825 - DNA, 19 bp, Homo sapiens
aaaatagcttttattgagt

SEQ ID NO: 2275826 - DNA, 21 bp, Homo sapiens
aaaatagtcatgtttctgcag

SEQ ID NO: 2275827 - DNA, 17 bp, Homo sapiens
aaaatagttctatttct

SEQ ID NO: 2275828 - DNA, 20 bp, Homo sapiens
aaaatagtttaaaaatattc

SEQ ID NO: 2275829 - DNA, 17 bp, Homo sapiens
aaaatagttttctaaat

SEQ ID NO: 2275830 - DNA, 18 bp, Homo sapiens
aaaatagttttctaaatg

SEQ ID NO: 2275831 - DNA, 12 bp, Homo sapiens
aaaatatgaaat

SEQ ID NO: 2275832 - DNA, 16 bp, Homo sapiens
aaaatattatctgaac

SEQ ID NO: 2275833 - DNA, 16 bp, Homo sapiens
aaaatattctgtcatt

SEQ ID NO: 2275834 - DNA, 19 bp, Homo sapiens
aaaatattgtgtaagaatc

SEQ ID NO: 2275835 - DNA, 22 bp, Homo sapiens
aaaatattgtgtaagaatcact

SEQ ID NO: 2275836 - DNA, 13 bp, Homo sapiens
aaaatatttattt

SEQ ID NO: 2275837 - DNA, 20 bp, Homo sapiens
aaaatattttgcaagctctg

SEQ ID NO: 2275838 - DNA, 20 bp, Homo sapiens
aaaatatttttttctagcta

SEQ ID NO: 2275839 - DNA, 16 bp, Homo sapiens
aaaatcaacttttgaa

SEQ ID NO: 2275840 - DNA, 22 bp, Homo sapiens
aaaatccaagctgctcatttca

SEQ ID NO: 2275841 - DNA, 18 bp, Homo sapiens
aaaatctacgtctttatt

SEQ ID NO: 2275842 - DNA, 16 bp, Homo sapiens
aaaatctagtatttgt

SEQ ID NO: 2275843 - DNA, 23 bp, Homo sapiens
aaaatctttcagaatacaattca

SEQ ID NO: 2275844 - DNA, 22 bp, Homo sapiens
aaaatctttccatctcattaca

SEQ ID NO: 2275845 - DNA, 19 bp, Homo sapiens
aaaatgaactgtatattat

SEQ ID NO: 2275846 - DNA, 12 bp, Homo sapiens
aaaatgcaaata

SEQ ID NO: 2275847 - DNA, 23 bp, Homo sapiens
aaaatgctattttaaaattcatg

SEQ ID NO: 2275848 - DNA, 12 bp, Homo sapiens
aaaatgctttct

SEQ ID NO: 2275849 - DNA, 17 bp, Homo sapiens
aaaatgctttctcatgc

SEQ ID NO: 2275850 - DNA, 19 bp, Homo sapiens
aaaatgctttctcatgcat

SEQ ID NO: 2275851 - DNA, 22 bp, Homo sapiens
aaaatgctttctcatgcataga

SEQ ID NO: 2275852 - DNA, 21 bp, Homo sapiens
aaaatggacgtgttatgactc

SEQ ID NO: 2275853 - DNA, 20 bp, Homo sapiens
aaaatgtatggatgaattct

SEQ ID NO: 2275854 - DNA, 20 bp, Homo sapiens
aaaatgtttacattttcttt

SEQ ID NO: 2275855 - DNA, 22 bp, Homo sapiens
aaaatgtttacattttctttca

SEQ ID NO: 2275856 - DNA, 19 bp, Homo sapiens
aaaattaccaaacaaagca

SEQ ID NO: 2275857 - DNA, 23 bp, Homo sapiens
aaaattagtgagatttgtattta

SEQ ID NO: 2275858 - DNA, 12 bp, Homo sapiens
aaaattcatagc

SEQ ID NO: 2275859 - DNA, 20 bp, Homo sapiens
aaaattcatggaactttcat

SEQ ID NO: 2275860 - DNA, 21 bp, Homo sapiens
aaaattcatggaactttcata

SEQ ID NO: 2275861 - DNA, 13 bp, Homo sapiens
aaaattctagtct

SEQ ID NO: 2275862 - DNA, 15 bp, Homo sapiens
aaaattgcattttta

SEQ ID NO: 2275863 - DNA, 19 bp, Homo sapiens
aaaatttaattgtgtaact

SEQ ID NO: 2275864 - DNA, 22 bp, Homo sapiens
aaaatttcctccacattcatgt

SEQ ID NO: 2275865 - DNA, 15 bp, Homo sapiens
aaaattttaaaaatc

SEQ ID NO: 2275866 - DNA, 13 bp, Homo sapiens
aaacaaaatattt

SEQ ID NO: 2275867 - DNA, 18 bp, Homo sapiens
aaacaaacaccttcttat

SEQ ID NO: 2275868 - DNA, 19 bp, Homo sapiens
aaacaaaggatttgaaaac

SEQ ID NO: 2275869 - DNA, 19 bp, Homo sapiens
aaacaacagaaacttctca

SEQ ID NO: 2275870 - DNA, 17 bp, Homo sapiens
aaacaactgccaaataa

SEQ ID NO: 2275871 - DNA, 18 bp, Homo sapiens
aaacaaggaaggacattt

SEQ ID NO: 2275872 - DNA, 14 bp, Homo sapiens
aaacaatgtaatta

SEQ ID NO: 2275873 - DNA, 19 bp, Homo sapiens
aaacacacaggccatttca

SEQ ID NO: 2275874 - DNA, 19 bp, Homo sapiens
aaacacacttagaatacta

SEQ ID NO: 2275875 - DNA, 18 bp, Homo sapiens
aaacaccaagagtacagg

SEQ ID NO: 2275876 - DNA, 20 bp, Homo sapiens
aaacaccaccaaatgacaag

SEQ ID NO: 2275877 - DNA, 21 bp, Homo sapiens
aaacacccaagcacaaactgt

SEQ ID NO: 2275878 - DNA, 22 bp, Homo sapiens
aaacacccaagcacaaactgtc

SEQ ID NO: 2275879 - DNA, 15 bp, Homo sapiens
aaacacgtggtcatg

SEQ ID NO: 2275880 - DNA, 23 bp, Homo sapiens
aaacactaatggccaagtgtaca

SEQ ID NO: 2275881 - DNA, 18 bp, Homo sapiens
aaacagaagcctgtttca

SEQ ID NO: 2275882 - DNA, 18 bp, Homo sapiens
aaacagatgagaagacta

SEQ ID NO: 2275883 - DNA, 14 bp, Homo sapiens
aaacagtgaaagcc

SEQ ID NO: 2275884 - DNA, 24 bp, Homo sapiens
aaacataaaatatacaaacatgtg

SEQ ID NO: 2275885 - DNA, 16 bp, Homo sapiens
aaacattttaaaatca

SEQ ID NO: 2275886 - DNA, 19 bp, Homo sapiens
aaaccattataaaatcttt

SEQ ID NO: 2275887 - DNA, 15 bp, Homo sapiens
aaaccccggggctcc

SEQ ID NO: 2275888 - DNA, 15 bp, Homo sapiens
aaacctctatatgtt

SEQ ID NO: 2275889 - DNA, 16 bp, Homo sapiens
aaacctgcaaggcaaa

SEQ ID NO: 2275890 - DNA, 15 bp, Homo sapiens
aaacctgtgctttca

SEQ ID NO: 2275891 - DNA, 20 bp, Homo sapiens
aaacctgtgctttcatgttt

SEQ ID NO: 2275892 - DNA, 22 bp, Homo sapiens
aaacctgttcaggcaggctttc

SEQ ID NO: 2275893 - DNA, 16 bp, Homo sapiens
aaacgatatatgtaaa

SEQ ID NO: 2275894 - DNA, 18 bp, Homo sapiens
aaacgatatatgtaaata

SEQ ID NO: 2275895 - DNA, 12 bp, Homo sapiens
aaacgccatgtc

SEQ ID NO: 2275896 - DNA, 21 bp, Homo sapiens
aaacgtggctgcttcaaggat

SEQ ID NO: 2275897 - DNA, 21 bp, Homo sapiens
aaactatcggttcaagttgat

SEQ ID NO: 2275898 - DNA, 21 bp, Homo sapiens
aaactatggtgtgcttatgtt

SEQ ID NO: 2275899 - DNA, 20 bp, Homo sapiens
aaactcagtctcaaataata

SEQ ID NO: 2275900 - DNA, 20 bp, Homo sapiens
aaactgatttttttttcctt

SEQ ID NO: 2275901 - DNA, 23 bp, Homo sapiens
aaactgatttttttttccttcag

SEQ ID NO: 2275902 - DNA, 12 bp, Homo sapiens
aaactgtagtaa

SEQ ID NO: 2275903 - DNA, 18 bp, Homo sapiens
aaactgttgtctagtata

SEQ ID NO: 2275904 - DNA, 23 bp, Homo sapiens
aatgactctggaaccatcctctg

SEQ ID NO: 2275905 - DNA, 15 bp, Homo sapiens
aatgagaaattgtgc

SEQ ID NO: 2275906 - DNA, 15 bp, Homo sapiens
aatgagggaaacaaa

SEQ ID NO: 2275907 - DNA, 19 bp, Homo sapiens
aatgagggaaacaaaatat

SEQ ID NO: 2275908 - DNA, 22 bp, Homo sapiens
aatgagggaaacaaaatattta

SEQ ID NO: 2275909 - DNA, 20 bp, Homo sapiens
aatgaggttatgagaaaaaa

SEQ ID NO: 2275910 - DNA, 23 bp, Homo sapiens
aatgaggttatgagaaaaaaaca

SEQ ID NO: 2275911 - DNA, 19 bp, Homo sapiens
aatgatataggaaaataca

SEQ ID NO: 2275912 - DNA, 20 bp, Homo sapiens
aatgatataggaaaatacat

SEQ ID NO: 2275913 - DNA, 15 bp, Homo sapiens
aatgatctgaatctg

SEQ ID NO: 2275914 - DNA, 16 bp, Homo sapiens
aatgatcttccaaata

SEQ ID NO: 2275915 - DNA, 19 bp, Homo sapiens
aatgatgccatgaggaaca

SEQ ID NO: 2275916 - DNA, 16 bp, Homo sapiens
aatgattaattaaaac

SEQ ID NO: 2275917 - DNA, 17 bp, Homo sapiens
aatgattcaatgtgaat

SEQ ID NO: 2275918 - DNA, 20 bp, Homo sapiens
aatgattcaatgtgaatttt

SEQ ID NO: 2275919 - DNA, 20 bp, Homo sapiens
aatgattcaattaacatata

SEQ ID NO: 2275920 - DNA, 12 bp, Homo sapiens
aatgattgttta

SEQ ID NO: 2275921 - DNA, 11 bp, Homo sapiens
aatgcaaacca

SEQ ID NO: 2275922 - DNA, 16 bp, Homo sapiens
aatgcaaaccatcatt

SEQ ID NO: 2275923 - DNA, 20 bp, Homo sapiens
aatgcaaatattgctattgt

SEQ ID NO: 2275924 - DNA, 13 bp, Homo sapiens
aatgcaattagat

SEQ ID NO: 2275925 - DNA, 14 bp, Homo sapiens
aatgcactcctgcc

SEQ ID NO: 2275926 - DNA, 14 bp, Homo sapiens
aatgcatgatgact

SEQ ID NO: 2275927 - DNA, 16 bp, Homo sapiens
aatgcatgatgactct

SEQ ID NO: 2275928 - DNA, 19 bp, Homo sapiens
aatgcattattttgtcata

SEQ ID NO: 2275929 - DNA, 21 bp, Homo sapiens
aatgccgccctcccagctctg

SEQ ID NO: 2275930 - DNA, 22 bp, Homo sapiens
aatgctaatgtaatcatttatc

SEQ ID NO: 2275931 - DNA, 19 bp, Homo sapiens
aatgctatggaaatacatt

SEQ ID NO: 2275932 - DNA, 12 bp, Homo sapiens
aatgctatttta

SEQ ID NO: 2275933 - DNA, 18 bp, Homo sapiens
aatgctattttaaaattc

SEQ ID NO: 2275934 - DNA, 19 bp, Homo sapiens
aatgctattttaaaattca

SEQ ID NO: 2275935 - DNA, 23 bp, Homo sapiens
aatgctattttaaaattcatgga

SEQ ID NO: 2275936 - DNA, 22 bp, Homo sapiens
aatgctggcaaaggctggctgt

SEQ ID NO: 2275937 - DNA, 16 bp, Homo sapiens
aatgcttaacataaac

SEQ ID NO: 2275938 - DNA, 18 bp, Homo sapiens
aatgcttaacataaactt

SEQ ID NO: 2275939 - DNA, 16 bp, Homo sapiens
aatgctttaaatagtt

SEQ ID NO: 2275940 - DNA, 21 bp, Homo sapiens
aatgctttctcatgcatagac

SEQ ID NO: 2275941 - DNA, 12 bp, Homo sapiens
aatgcttttcta

SEQ ID NO: 2275942 - DNA, 23 bp, Homo sapiens
aatgcttttctagcaactgttgg

SEQ ID NO: 2275943 - DNA, 17 bp, Homo sapiens
aatggaaacagaggacc

SEQ ID NO: 2275944 - DNA, 16 bp, Homo sapiens
aatggacgtgttatga

SEQ ID NO: 2275945 - DNA, 21 bp, Homo sapiens
aatggacgtgttatgactcca

SEQ ID NO: 2275946 - DNA, 23 bp, Homo sapiens
aatggacgtgttatgactccaga

SEQ ID NO: 2275947 - DNA, 20 bp, Homo sapiens
aatgggggtatcctgtgcat

SEQ ID NO: 2275948 - DNA, 16 bp, Homo sapiens
aatgggtagcaacagg

SEQ ID NO: 2275949 - DNA, 14 bp, Homo sapiens
aatggtatctgtta

SEQ ID NO: 2275950 - DNA, 17 bp, Homo sapiens
aatggttttcttgtgtg

SEQ ID NO: 2275951 - DNA, 18 bp, Homo sapiens
aatggttttcttgtgtgt

SEQ ID NO: 2275952 - DNA, 20 bp, Homo sapiens
aatgtacagaaaatagcttt

SEQ ID NO: 2275953 - DNA, 13 bp, Homo sapiens
aatgtatcttatt

SEQ ID NO: 2275954 - DNA, 18 bp, Homo sapiens
aatgtatcttatttatat

SEQ ID NO: 2275955 - DNA, 20 bp, Homo sapiens
aatgtatcttatttatatat

SEQ ID NO: 2275956 - DNA, 17 bp, Homo sapiens
aatgtcaatttttaact

SEQ ID NO: 2275957 - DNA, 17 bp, Homo sapiens
aatgtctgacctagcct

SEQ ID NO: 2275958 - DNA, 14 bp, Homo sapiens
aatgtgaattttaa

SEQ ID NO: 2275959 - DNA, 12 bp, Homo sapiens
aatgtgccaaaa

SEQ ID NO: 2275960 - DNA, 15 bp, Homo sapiens
aatgtgcttcattgt

SEQ ID NO: 2275961 - DNA, 21 bp, Homo sapiens
aatgtgcttcattgtttgatt

SEQ ID NO: 2275962 - DNA, 20 bp, Homo sapiens
aatgtgcttttccatctaaa

SEQ ID NO: 2275963 - DNA, 15 bp, Homo sapiens
aatgtggatgctctt

SEQ ID NO: 2275964 - DNA, 14 bp, Homo sapiens
aatgtggccgggca

SEQ ID NO: 2275965 - DNA, 17 bp, Homo sapiens
aatgttatttctgcaaa

SEQ ID NO: 2275966 - DNA, 15 bp, Homo sapiens
aatgttgtatttcaa

SEQ ID NO: 2275967 - DNA, 19 bp, Homo sapiens
aatgttgttaaatgctatg

SEQ ID NO: 2275968 - DNA, 13 bp, Homo sapiens
aatgtttacattt

SEQ ID NO: 2275969 - DNA, 14 bp, Homo sapiens
aatgtttacatttt

SEQ ID NO: 2275970 - DNA, 17 bp, Homo sapiens
aatgtttacattttctt

SEQ ID NO: 2275971 - DNA, 12 bp, Homo sapiens
aatgtttcatga

SEQ ID NO: 2275972 - DNA, 21 bp, Homo sapiens
aatgtttcctgtggaaatatg

SEQ ID NO: 2275973 - DNA, 22 bp, Homo sapiens
aatgtttttctcaaaaagctgc

SEQ ID NO: 2275974 - DNA, 20 bp, Homo sapiens
aattaaaaagttgggaaaat

SEQ ID NO: 2275975 - DNA, 18 bp, Homo sapiens
aattaaaacacaacatct

SEQ ID NO: 2275976 - DNA, 16 bp, Homo sapiens
aattaaagacatttaa

SEQ ID NO: 2275977 - DNA, 14 bp, Homo sapiens
aattaaattttaat

SEQ ID NO: 2275978 - DNA, 17 bp, Homo sapiens
aattaacctttcaggaa

SEQ ID NO: 2275979 - DNA, 23 bp, Homo sapiens
aattaacctttcaggaaagtatc

SEQ ID NO: 2275980 - DNA, 20 bp, Homo sapiens
aattacactcttcctccatt

SEQ ID NO: 2275981 - DNA, 15 bp, Homo sapiens
aattacaggttcctt

SEQ ID NO: 2275982 - DNA, 11 bp, Homo sapiens
aattacattat

SEQ ID NO: 2275983 - DNA, 12 bp, Homo sapiens
aattacttaatg

SEQ ID NO: 2275984 - DNA, 14 bp, Homo sapiens
aattacttaatgtg

SEQ ID NO: 2275985 - DNA, 22 bp, Homo sapiens
aattactttcagaatattttca

SEQ ID NO: 2275986 - DNA, 18 bp, Homo sapiens
aattagtgagatttgtat

SEQ ID NO: 2275987 - DNA, 13 bp, Homo sapiens
aattataaatgtt

SEQ ID NO: 2275988 - DNA, 23 bp, Homo sapiens
aattataaatgtttcatgaagaa

SEQ ID NO: 2275989 - DNA, 15 bp, Homo sapiens
aattataatgcatct

SEQ ID NO: 2275990 - DNA, 19 bp, Homo sapiens
aattatattatgaataaaa

SEQ ID NO: 2275991 - DNA, 22 bp, Homo sapiens
aattatattatgaataaaattg

SEQ ID NO: 2275992 - DNA, 18 bp, Homo sapiens
aattatccaggatgtgtg

SEQ ID NO: 2275993 - DNA, 22 bp, Homo sapiens
aattatctctcatttgttgttg

SEQ ID NO: 2275994 - DNA, 15 bp, Homo sapiens
aattcataaaaataa

SEQ ID NO: 2275995 - DNA, 14 bp, Homo sapiens
aattcatggaactt

SEQ ID NO: 2275996 - DNA, 18 bp, Homo sapiens
aattcatggaactttcat

SEQ ID NO: 2275997 - DNA, 15 bp, Homo sapiens
aattcattaataaaa

SEQ ID NO: 2275998 - DNA, 13 bp, Homo sapiens
aattcatttaaga

SEQ ID NO: 2275999 - DNA, 17 bp, Homo sapiens
aattcatttaagaacaa

SEQ ID NO: 2276000 - DNA, 16 bp, Homo sapiens
aattcccatctgcttt

SEQ ID NO: 2276001 - DNA, 19 bp, Homo sapiens
aattctaagattgtacata

SEQ ID NO: 2276002 - DNA, 15 bp, Homo sapiens
aattctagtctctga

SEQ ID NO: 2276003 - DNA, 13 bp, Homo sapiens
aattctataagag

SEQ ID NO: 2276004 - DNA, 22 bp, Homo sapiens
aattctcagaattacaggaaat

SEQ ID NO: 2276005 - DNA, 22 bp, Homo sapiens
aattctcattatgaagatgttt

SEQ ID NO: 2276006 - DNA, 16 bp, Homo sapiens
aattctgttacacaat

SEQ ID NO: 2276007 - DNA, 13 bp, Homo sapiens
aattcttaaatat

SEQ ID NO: 2276008 - DNA, 14 bp, Homo sapiens
aattcttgaataaa

SEQ ID NO: 2276009 - DNA, 17 bp, Homo sapiens
aattcttttgaaagatg

SEQ ID NO: 2276010 - DNA, 19 bp, Homo sapiens
aattgaaccgtcaatgtga

SEQ ID NO: 2276011 - DNA, 20 bp, Homo sapiens
aattgaaccgtcaatgtgaa

SEQ ID NO: 2276012 - DNA, 21 bp, Homo sapiens
aattgaaccgtcaatgtgaaa

SEQ ID NO: 2276013 - DNA, 19 bp, Homo sapiens
aattgacctgatttccatt

SEQ ID NO: 2276014 - DNA, 15 bp, Homo sapiens
aattgaggttaggaa

SEQ ID NO: 2276015 - DNA, 17 bp, Homo sapiens
aattgcatttttacctt

SEQ ID NO: 2276016 - DNA, 18 bp, Homo sapiens
aattgcatttttaccttt

SEQ ID NO: 2276017 - DNA, 18 bp, Homo sapiens
aattggcagtggcagaga

SEQ ID NO: 2276018 - DNA, 22 bp, Homo sapiens
aattgtaaggaatgattaatta

SEQ ID NO: 2276019 - DNA, 21 bp, Homo sapiens
aattgtgcgacttcacaaaat

SEQ ID NO: 2276020 - DNA, 18 bp, Homo sapiens
aattgtgtaactgttctt

SEQ ID NO: 2276021 - DNA, 14 bp, Homo sapiens
aattgttacaattt

SEQ ID NO: 2276022 - DNA, 16 bp, Homo sapiens
aattgttcttaaaacc

SEQ ID NO: 2276023 - DNA, 14 bp, Homo sapiens
aattgttgaatgta

SEQ ID NO: 2276024 - DNA, 15 bp, Homo sapiens
aattgttgaatgtat

SEQ ID NO: 2276025 - DNA, 17 bp, Homo sapiens
aattgttgaatgtattc

SEQ ID NO: 2276026 - DNA, 13 bp, Homo sapiens
aatttaactgcat

SEQ ID NO: 2276027 - DNA, 15 bp, Homo sapiens
aatttaatatactgc

SEQ ID NO: 2276028 - DNA, 23 bp, Homo sapiens
aatttaattgtgtaactgttctt

SEQ ID NO: 2276029 - DNA, 17 bp, Homo sapiens
aatttacctgaagtctt

SEQ ID NO: 2276030 - DNA, 15 bp, Homo sapiens
aatttatctgtgaat

SEQ ID NO: 2276031 - DNA, 17 bp, Homo sapiens
aatttatttatgttctc

SEQ ID NO: 2276032 - DNA, 12 bp, Homo sapiens
aatttcaaagaa

SEQ ID NO: 2276033 - DNA, 15 bp, Homo sapiens
aatttcattgtgttg

SEQ ID NO: 2276034 - DNA, 15 bp, Homo sapiens
aatttcccaaagcag

SEQ ID NO: 2276035 - DNA, 15 bp, Homo sapiens
aatttcttgtttctc

SEQ ID NO: 2276036 - DNA, 19 bp, Homo sapiens
aatttgaaagtttccttat

SEQ ID NO: 2276037 - DNA, 20 bp, Homo sapiens
actatgtaagggctttaaat

SEQ ID NO: 2276038 - DNA, 17 bp, Homo sapiens
actattaggaggaatgt

SEQ ID NO: 2276039 - DNA, 18 bp, Homo sapiens
actatttcaataagtgtt

SEQ ID NO: 2276040 - DNA, 12 bp, Homo sapiens
actcaatgcatg

SEQ ID NO: 2276041 - DNA, 13 bp, Homo sapiens
actcaatgcatga

SEQ ID NO: 2276042 - DNA, 13 bp, Homo sapiens
actcacaaaaggc

SEQ ID NO: 2276043 - DNA, 17 bp, Homo sapiens
actcaccaaaatatagt

SEQ ID NO: 2276044 - DNA, 19 bp, Homo sapiens
actcactgcctgcagctga

SEQ ID NO: 2276045 - DNA, 20 bp, Homo sapiens
actcacttaattctcattat

SEQ ID NO: 2276046 - DNA, 22 bp, Homo sapiens
actcagcaccactcaagaccaa

SEQ ID NO: 2276047 - DNA, 12 bp, Homo sapiens
actcaggcccac

SEQ ID NO: 2276048 - DNA, 23 bp, Homo sapiens
actcagtgggccaattgttctta

SEQ ID NO: 2276049 - DNA, 15 bp, Homo sapiens
actcagttcttggcc

SEQ ID NO: 2276050 - DNA, 17 bp, Homo sapiens
actcagttcttggcctg

SEQ ID NO: 2276051 - DNA, 20 bp, Homo sapiens
actcagttcttggcctgcta

SEQ ID NO: 2276052 - DNA, 16 bp, Homo sapiens
actccaacatccactc

SEQ ID NO: 2276053 - DNA, 19 bp, Homo sapiens
actccaacatccactctct

SEQ ID NO: 2276054 - DNA, 15 bp, Homo sapiens
actccagaatttccc

SEQ ID NO: 2276055 - DNA, 21 bp, Homo sapiens
actccaggaaaactgtttttc

SEQ ID NO: 2276056 - DNA, 17 bp, Homo sapiens
actccaggggctgggga

SEQ ID NO: 2276057 - DNA, 14 bp, Homo sapiens
actcccagggcccg

SEQ ID NO: 2276058 - DNA, 23 bp, Homo sapiens
actccccgcccgccctcctctgc

SEQ ID NO: 2276059 - DNA, 19 bp, Homo sapiens
actccctccctttctcttt

SEQ ID NO: 2276060 - DNA, 16 bp, Homo sapiens
actccgggtcaagttg

SEQ ID NO: 2276061 - DNA, 16 bp, Homo sapiens
actcgagagggctgag

SEQ ID NO: 2276062 - DNA, 18 bp, Homo sapiens
actcgagagggctgagcc

SEQ ID NO: 2276063 - DNA, 19 bp, Homo sapiens
actcgagagggctgagccc

SEQ ID NO: 2276064 - DNA, 23 bp, Homo sapiens
actcgagagggctgagcccctcc

SEQ ID NO: 2276065 - DNA, 17 bp, Homo sapiens
actcgcgacaatgcaaa

SEQ ID NO: 2276066 - DNA, 18 bp, Homo sapiens
actcgcgacaatgcaaac

SEQ ID NO: 2276067 - DNA, 20 bp, Homo sapiens
actcgcgacaatgcaaacca

SEQ ID NO: 2276068 - DNA, 22 bp, Homo sapiens
actctacaagaaagctgtggct

SEQ ID NO: 2276069 - DNA, 18 bp, Homo sapiens
actctccaggcaccgcct

SEQ ID NO: 2276070 - DNA, 19 bp, Homo sapiens
actctccaggcaccgcctg

SEQ ID NO: 2276071 - DNA, 15 bp, Homo sapiens
actctccttggtgtc

SEQ ID NO: 2276072 - DNA, 23 bp, Homo sapiens
actctccttggtgtcgggcatga

SEQ ID NO: 2276073 - DNA, 19 bp, Homo sapiens
actctctcttgttcttact

SEQ ID NO: 2276074 - DNA, 19 bp, Homo sapiens
actctgaatcaaaagctga

SEQ ID NO: 2276075 - DNA, 19 bp, Homo sapiens
actctgccttccaggcgta

SEQ ID NO: 2276076 - DNA, 12 bp, Homo sapiens
actctgggaaga

SEQ ID NO: 2276077 - DNA, 16 bp, Homo sapiens
actctgtgatctaagc

SEQ ID NO: 2276078 - DNA, 17 bp, Homo sapiens
actctgtgatctaagca

SEQ ID NO: 2276079 - DNA, 14 bp, Homo sapiens
actctgtggggcca

SEQ ID NO: 2276080 - DNA, 16 bp, Homo sapiens
actctgtggggccaca

SEQ ID NO: 2276081 - DNA, 14 bp, Homo sapiens
actctgtgtaatct

SEQ ID NO: 2276082 - DNA, 20 bp, Homo sapiens
actctgtgtaatctctgatt

SEQ ID NO: 2276083 - DNA, 17 bp, Homo sapiens
actctgttgaccaggct

SEQ ID NO: 2276084 - DNA, 20 bp, Homo sapiens
actctgttgaccaggctgga

SEQ ID NO: 2276085 - DNA, 18 bp, Homo sapiens
actcttcaaaaactgttt

SEQ ID NO: 2276086 - DNA, 15 bp, Homo sapiens
actcttcttatcaca

SEQ ID NO: 2276087 - DNA, 23 bp, Homo sapiens
actcttcttatcacacttgcaaa

SEQ ID NO: 2276088 - DNA, 20 bp, Homo sapiens
actcttgtctcctcctccag

SEQ ID NO: 2276089 - DNA, 21 bp, Homo sapiens
actctttgcccagttcatccc

SEQ ID NO: 2276090 - DNA, 17 bp, Homo sapiens
actgaaaaagaatgaaa

SEQ ID NO: 2276091 - DNA, 22 bp, Homo sapiens
actgaaacctctgttctcatga

SEQ ID NO: 2276092 - DNA, 15 bp, Homo sapiens
actgaagtaataact

SEQ ID NO: 2276093 - DNA, 18 bp, Homo sapiens
actgaagtatacatttag

SEQ ID NO: 2276094 - DNA, 21 bp, Homo sapiens
actgaataatggaattatgta

SEQ ID NO: 2276095 - DNA, 13 bp, Homo sapiens
actgaatttaact

SEQ ID NO: 2276096 - DNA, 21 bp, Homo sapiens
actgagatgttaaaatagtca

SEQ ID NO: 2276097 - DNA, 16 bp, Homo sapiens
actgatatcacgggcc

SEQ ID NO: 2276098 - DNA, 18 bp, Homo sapiens
actgatatcacgggcccg

SEQ ID NO: 2276099 - DNA, 13 bp, Homo sapiens
actgatctctcgt

SEQ ID NO: 2276100 - DNA, 21 bp, Homo sapiens
actgatttttttttccttcag

SEQ ID NO: 2276101 - DNA, 22 bp, Homo sapiens
actgatttttttttccttcagt

SEQ ID NO: 2276102 - DNA, 15 bp, Homo sapiens
actgcaatcatatgt

SEQ ID NO: 2276103 - DNA, 17 bp, Homo sapiens
actgcaatcatatgtga

SEQ ID NO: 2276104 - DNA, 22 bp, Homo sapiens
actgcagcagaaaggctctgaa

SEQ ID NO: 2276105 - DNA, 23 bp, Homo sapiens
actgcatatcctggtgtctagtt

SEQ ID NO: 2276106 - DNA, 19 bp, Homo sapiens
actgccaaataaaatgttt

SEQ ID NO: 2276107 - DNA, 19 bp, Homo sapiens
actgccattagactgaatt

SEQ ID NO: 2276108 - DNA, 17 bp, Homo sapiens
actgccgctgcccccac

SEQ ID NO: 2276109 - DNA, 22 bp, Homo sapiens
actgccgctgcccccaccctgc

SEQ ID NO: 2276110 - DNA, 19 bp, Homo sapiens
actgcctgcagctgagatt

SEQ ID NO: 2276111 - DNA, 18 bp, Homo sapiens
actgctcaggctccccaa

SEQ ID NO: 2276112 - DNA, 13 bp, Homo sapiens
actgctgttttat

SEQ ID NO: 2276113 - DNA, 19 bp, Homo sapiens
actgctgttttatgtcata

SEQ ID NO: 2276114 - DNA, 13 bp, Homo sapiens
actgcttcatgta

SEQ ID NO: 2276115 - DNA, 16 bp, Homo sapiens
actggaaacaaggaag

SEQ ID NO: 2276116 - DNA, 21 bp, Homo sapiens
actggaaacaaggaaggacat

SEQ ID NO: 2276117 - DNA, 14 bp, Homo sapiens
actggactcttcaa

SEQ ID NO: 2276118 - DNA, 14 bp, Homo sapiens
actggagaaaatgg

SEQ ID NO: 2276119 - DNA, 11 bp, Homo sapiens
actggccccag

SEQ ID NO: 2276120 - DNA, 14 bp, Homo sapiens
actgggaagcatta

SEQ ID NO: 2276121 - DNA, 17 bp, Homo sapiens
actgggaagcattactt

SEQ ID NO: 2276122 - DNA, 19 bp, Homo sapiens
actgggaagcattactttg

SEQ ID NO: 2276123 - DNA, 13 bp, Homo sapiens
actgggaatttat

SEQ ID NO: 2276124 - DNA, 19 bp, Homo sapiens
actgggaatttatttatgt

SEQ ID NO: 2276125 - DNA, 22 bp, Homo sapiens
actggggtgggagggggcaggg

SEQ ID NO: 2276126 - DNA, 14 bp, Homo sapiens
actggtctcagagg

SEQ ID NO: 2276127 - DNA, 20 bp, Homo sapiens
actggttatagttgatatgt

SEQ ID NO: 2276128 - DNA, 16 bp, Homo sapiens
actgtaccctatgttc

SEQ ID NO: 2276129 - DNA, 17 bp, Homo sapiens
actgtagcaatatattt

SEQ ID NO: 2276130 - DNA, 21 bp, Homo sapiens
actgtagcaatatatttgtag

SEQ ID NO: 2276131 - DNA, 21 bp, Homo sapiens
actgtataccccgtgaagcat

SEQ ID NO: 2276132 - DNA, 22 bp, Homo sapiens
actgtatatgtcaaaaatattt

SEQ ID NO: 2276133 - DNA, 14 bp, Homo sapiens
actgtatattattg

SEQ ID NO: 2276134 - DNA, 22 bp, Homo sapiens
actgtatattattgctatattt

SEQ ID NO: 2276135 - DNA, 12 bp, Homo sapiens
actgtatctaaa

SEQ ID NO: 2276136 - DNA, 23 bp, Homo sapiens
actgtattgggacgctggtaact

SEQ ID NO: 2276137 - DNA, 14 bp, Homo sapiens
actgtcaatgaggt

SEQ ID NO: 2276138 - DNA, 16 bp, Homo sapiens
actgtcccacaaaata

SEQ ID NO: 2276139 - DNA, 19 bp, Homo sapiens
actgtcccacaaaatattt

SEQ ID NO: 2276140 - DNA, 22 bp, Homo sapiens
actgtcccacaaaatatttcta

SEQ ID NO: 2276141 - DNA, 19 bp, Homo sapiens
actgtcttcaaccctgccc

SEQ ID NO: 2276142 - DNA, 17 bp, Homo sapiens
actgtgcgttttagagt

SEQ ID NO: 2276143 - DNA, 21 bp, Homo sapiens
actgtggaacactaaagagct

SEQ ID NO: 2276144 - DNA, 15 bp, Homo sapiens
actgtggcctcagga

SEQ ID NO: 2276145 - DNA, 16 bp, Homo sapiens
actgtgttgcccaggc

SEQ ID NO: 2276146 - DNA, 22 bp, Homo sapiens
actgtgttgcccaggctggtct

SEQ ID NO: 2276147 - DNA, 21 bp, Homo sapiens
actgttaatcatgggttcctc

SEQ ID NO: 2276148 - DNA, 14 bp, Homo sapiens
actgtttcttctca

SEQ ID NO: 2276149 - DNA, 13 bp, Homo sapiens
actgtttcttgct

SEQ ID NO: 2276150 - DNA, 19 bp, Homo sapiens
actgtttcttgcttgtacc

SEQ ID NO: 2276151 - DNA, 20 bp, Homo sapiens
actgtttcttgcttgtacct

SEQ ID NO: 2276152 - DNA, 20 bp, Homo sapiens
actgtttgtaatatacagtt

SEQ ID NO: 2276153 - DNA, 15 bp, Homo sapiens
actgttttcatgtgt

SEQ ID NO: 2276154 - DNA, 18 bp, Homo sapiens
actgttttgggtagctgc

SEQ ID NO: 2276155 - DNA, 20 bp, Homo sapiens
acttaaatagcatctgctct

SEQ ID NO: 2276156 - DNA, 14 bp, Homo sapiens
acttacactgaaat

SEQ ID NO: 2276157 - DNA, 15 bp, Homo sapiens
acttactcttacacc

SEQ ID NO: 2276158 - DNA, 19 bp, Homo sapiens
acttactgtcagagaatat

SEQ ID NO: 2276159 - DNA, 22 bp, Homo sapiens
acttactgtcagagaatatgac

SEQ ID NO: 2276160 - DNA, 14 bp, Homo sapiens
acttataatttcca

SEQ ID NO: 2276161 - DNA, 17 bp, Homo sapiens
acttatcaaatcattca

SEQ ID NO: 2276162 - DNA, 16 bp, Homo sapiens
acttatgtagacaaaa

SEQ ID NO: 2276163 - DNA, 14 bp, Homo sapiens
acttattttctgaa

SEQ ID NO: 2276164 - DNA, 22 bp, Homo sapiens
acttattttctgaattcataaa

SEQ ID NO: 2276165 - DNA, 20 bp, Homo sapiens
acttcaacatgcatatgata

SEQ ID NO: 2276166 - DNA, 15 bp, Homo sapiens
acttcactttcatct

SEQ ID NO: 2276167 - DNA, 15 bp, Homo sapiens
acttcagttgtggcc

SEQ ID NO: 2276168 - DNA, 19 bp, Homo sapiens
aggtggtgtccctttcaca

SEQ ID NO: 2276169 - DNA, 14 bp, Homo sapiens
aggtgtaaatatag

SEQ ID NO: 2276170 - DNA, 19 bp, Homo sapiens
aggtgtaagactttaagaa

SEQ ID NO: 2276171 - DNA, 24 bp, Homo sapiens
aggtgtaagactttaagaagcgaa

SEQ ID NO: 2276172 - DNA, 13 bp, Homo sapiens
aggtgtgaatgca

SEQ ID NO: 2276173 - DNA, 15 bp, Homo sapiens
aggtgtgagccacag

SEQ ID NO: 2276174 - DNA, 19 bp, Homo sapiens
aggtgtgagccacagcact

SEQ ID NO: 2276175 - DNA, 18 bp, Homo sapiens
aggtgttaaaaaccatta

SEQ ID NO: 2276176 - DNA, 14 bp, Homo sapiens
aggttcctgtcaat

SEQ ID NO: 2276177 - DNA, 20 bp, Homo sapiens
aggttccttttgaagctcaa

SEQ ID NO: 2276178 - DNA, 15 bp, Homo sapiens
aggttgggagttcga

SEQ ID NO: 2276179 - DNA, 14 bp, Homo sapiens
aggtttagagatta

SEQ ID NO: 2276180 - DNA, 15 bp, Homo sapiens
aggtttagagattaa

SEQ ID NO: 2276181 - DNA, 21 bp, Homo sapiens
agtaacagctaatctttaata

SEQ ID NO: 2276182 - DNA, 19 bp, Homo sapiens
agtaagttctgaaaactgt

SEQ ID NO: 2276183 - DNA, 15 bp, Homo sapiens
agtaataactgttag

SEQ ID NO: 2276184 - DNA, 11 bp, Homo sapiens
agtaatattac

SEQ ID NO: 2276185 - DNA, 21 bp, Homo sapiens
agtaatattacatttcattta

SEQ ID NO: 2276186 - DNA, 21 bp, Homo sapiens
agtaattcccatctgctttat

SEQ ID NO: 2276187 - DNA, 14 bp, Homo sapiens
agtaccctagcctc

SEQ ID NO: 2276188 - DNA, 14 bp, Homo sapiens
agtactataattta

SEQ ID NO: 2276189 - DNA, 15 bp, Homo sapiens
agtactggagaaaat

SEQ ID NO: 2276190 - DNA, 14 bp, Homo sapiens
agtaggctgtattt

SEQ ID NO: 2276191 - DNA, 15 bp, Homo sapiens
agtagtgttgggtgg

SEQ ID NO: 2276192 - DNA, 21 bp, Homo sapiens
agtagttgatgaccaatctct

SEQ ID NO: 2276193 - DNA, 16 bp, Homo sapiens
agtataatatgcagtt

SEQ ID NO: 2276194 - DNA, 14 bp, Homo sapiens
agtatatatgtaca

SEQ ID NO: 2276195 - DNA, 12 bp, Homo sapiens
agtatcagaggg

SEQ ID NO: 2276196 - DNA, 21 bp, Homo sapiens
agtatcatgtactacacttct

SEQ ID NO: 2276197 - DNA, 11 bp, Homo sapiens
agtatctccat

SEQ ID NO: 2276198 - DNA, 19 bp, Homo sapiens
agtatctctactttcctga

SEQ ID NO: 2276199 - DNA, 23 bp, Homo sapiens
agtatctctactttcctgatgtt

SEQ ID NO: 2276200 - DNA, 11 bp, Homo sapiens
agtatcttgaa

SEQ ID NO: 2276201 - DNA, 14 bp, Homo sapiens
agtatgaagacact

SEQ ID NO: 2276202 - DNA, 23 bp, Homo sapiens
agtatgaagacactgtcaatgag

SEQ ID NO: 2276203 - DNA, 16 bp, Homo sapiens
agtatgcaagaagaat

SEQ ID NO: 2276204 - DNA, 16 bp, Homo sapiens
agtatgctatgctatg

SEQ ID NO: 2276205 - DNA, 22 bp, Homo sapiens
agtatgtcagtccaataaatta

SEQ ID NO: 2276206 - DNA, 12 bp, Homo sapiens
agtattctgtag

SEQ ID NO: 2276207 - DNA, 16 bp, Homo sapiens
agtattttatctgtgt

SEQ ID NO: 2276208 - DNA, 23 bp, Homo sapiens
agtattttttatttaattatatt

SEQ ID NO: 2276209 - DNA, 18 bp, Homo sapiens
agtcaacaggtcacttga

SEQ ID NO: 2276210 - DNA, 16 bp, Homo sapiens
agtcaactgctgtttt

SEQ ID NO: 2276211 - DNA, 21 bp, Homo sapiens
agtcaactgctgttttatgtc

SEQ ID NO: 2276212 - DNA, 17 bp, Homo sapiens
agtcacggtctaaacac

SEQ ID NO: 2276213 - DNA, 15 bp, Homo sapiens
agtcagcggagagga

SEQ ID NO: 2276214 - DNA, 20 bp, Homo sapiens
agtcaggaagcctcctgctg

SEQ ID NO: 2276215 - DNA, 19 bp, Homo sapiens
agtcagtacacccaatttt

SEQ ID NO: 2276216 - DNA, 16 bp, Homo sapiens
agtcatatttttgtaa

SEQ ID NO: 2276217 - DNA, 19 bp, Homo sapiens
agtcatatttttgtaaata

SEQ ID NO: 2276218 - DNA, 13 bp, Homo sapiens
agtcatctcaaac

SEQ ID NO: 2276219 - DNA, 16 bp, Homo sapiens
agtcatgtcagaagga

SEQ ID NO: 2276220 - DNA, 19 bp, Homo sapiens
agtcattgctgacagagcc

SEQ ID NO: 2276221 - DNA, 20 bp, Homo sapiens
agtcattgctgacagagccc

SEQ ID NO: 2276222 - DNA, 13 bp, Homo sapiens
agtccaaaatcat

SEQ ID NO: 2276223 - DNA, 14 bp, Homo sapiens
agtccaaaatcatt

SEQ ID NO: 2276224 - DNA, 21 bp, Homo sapiens
agtccaatgtaccatgttgcc

SEQ ID NO: 2276225 - DNA, 16 bp, Homo sapiens
agtccacttatgtaga

SEQ ID NO: 2276226 - DNA, 16 bp, Homo sapiens
agtccatgagttgagt

SEQ ID NO: 2276227 - DNA, 17 bp, Homo sapiens
agtcccatctcacctct

SEQ ID NO: 2276228 - DNA, 19 bp, Homo sapiens
agtccctcctcccccacgc

SEQ ID NO: 2276229 - DNA, 18 bp, Homo sapiens
agtccctgagaagcctca

SEQ ID NO: 2276230 - DNA, 18 bp, Homo sapiens
agtccctgcaggtgaata

SEQ ID NO: 2276231 - DNA, 12 bp, Homo sapiens
agtccgaggcct

SEQ ID NO: 2276232 - DNA, 19 bp, Homo sapiens
agtcctccggttgcatact

SEQ ID NO: 2276233 - DNA, 17 bp, Homo sapiens
agtcgccaggcaggagg

SEQ ID NO: 2276234 - DNA, 13 bp, Homo sapiens
agtcggctgggca

SEQ ID NO: 2276235 - DNA, 15 bp, Homo sapiens
agtcggctgggcagg

SEQ ID NO: 2276236 - DNA, 19 bp, Homo sapiens
agtcggctgggcagggccg

SEQ ID NO: 2276237 - DNA, 20 bp, Homo sapiens
agtcggctgggcagggccgc

SEQ ID NO: 2276238 - DNA, 15 bp, Homo sapiens
agtctcaaataataa

SEQ ID NO: 2276239 - DNA, 18 bp, Homo sapiens
agtctcattcctctgtcc

SEQ ID NO: 2276240 - DNA, 19 bp, Homo sapiens
agtctctgatttgcaaatg

SEQ ID NO: 2276241 - DNA, 16 bp, Homo sapiens
agtctcttgattcata

SEQ ID NO: 2276242 - DNA, 11 bp, Homo sapiens
agtctgaagat

SEQ ID NO: 2276243 - DNA, 14 bp, Homo sapiens
agtctggagaccag

SEQ ID NO: 2276244 - DNA, 15 bp, Homo sapiens
agtctggagaccagg

SEQ ID NO: 2276245 - DNA, 12 bp, Homo sapiens
agtctgtacttc

SEQ ID NO: 2276246 - DNA, 19 bp, Homo sapiens
agtctgtacttcagttctc

SEQ ID NO: 2276247 - DNA, 22 bp, Homo sapiens
agtctgtacttcagttctcatc

SEQ ID NO: 2276248 - DNA, 21 bp, Homo sapiens
agtcttgagcaatgtttttct

SEQ ID NO: 2276249 - DNA, 12 bp, Homo sapiens
agtctttggggt

SEQ ID NO: 2276250 - DNA, 13 bp, Homo sapiens
agtgaacatttct

SEQ ID NO: 2276251 - DNA, 14 bp, Homo sapiens
agtgaacatttcta

SEQ ID NO: 2276252 - DNA, 14 bp, Homo sapiens
agtgaagatgtgta

SEQ ID NO: 2276253 - DNA, 17 bp, Homo sapiens
agtgacatcggttcagg

SEQ ID NO: 2276254 - DNA, 16 bp, Homo sapiens
agtgacgtgagtgggg

SEQ ID NO: 2276255 - DNA, 22 bp, Homo sapiens
agtgagaaattacaggttcctt

SEQ ID NO: 2276256 - DNA, 19 bp, Homo sapiens
agtgagatttgtatttata

SEQ ID NO: 2276257 - DNA, 20 bp, Homo sapiens
agtgagatttgtatttatat

SEQ ID NO: 2276258 - DNA, 23 bp, Homo sapiens
agtgagatttgtatttatattag

SEQ ID NO: 2276259 - DNA, 16 bp, Homo sapiens
agtgagtgtggcttag

SEQ ID NO: 2276260 - DNA, 16 bp, Homo sapiens
agtgatacactgtatc

SEQ ID NO: 2276261 - DNA, 22 bp, Homo sapiens
agtgatcctcccgccccagcct

SEQ ID NO: 2276262 - DNA, 20 bp, Homo sapiens
agtgatgggcaaggggccag

SEQ ID NO: 2276263 - DNA, 22 bp, Homo sapiens
agtgatgggcaaggggccagga

SEQ ID NO: 2276264 - DNA, 20 bp, Homo sapiens
agtgatgtgggaagttacct

SEQ ID NO: 2276265 - DNA, 18 bp, Homo sapiens
agtgcaagctttaacaga

SEQ ID NO: 2276266 - DNA, 16 bp, Homo sapiens
agtgcaagttcatgtg

SEQ ID NO: 2276267 - DNA, 19 bp, Homo sapiens
agtgcagcaaccagagcac

SEQ ID NO: 2276268 - DNA, 20 bp, Homo sapiens
agtgcagcaaccagagcact

SEQ ID NO: 2276269 - DNA, 14 bp, Homo sapiens
agtgcatgctgtcc

SEQ ID NO: 2276270 - DNA, 16 bp, Homo sapiens
agtgccaaaaacaaca

SEQ ID NO: 2276271 - DNA, 15 bp, Homo sapiens
agtgccttacacaat

SEQ ID NO: 2276272 - DNA, 14 bp, Homo sapiens
agtgccttatggaa

SEQ ID NO: 2276273 - DNA, 15 bp, Homo sapiens
agtgccttatggaac

SEQ ID NO: 2276274 - DNA, 19 bp, Homo sapiens
agtgccttatggaacactc

SEQ ID NO: 2276275 - DNA, 21 bp, Homo sapiens
agtgccttatggaacactctg

SEQ ID NO: 2276276 - DNA, 22 bp, Homo sapiens
agtgctaggataaaccaatcat

SEQ ID NO: 2276277 - DNA, 16 bp, Homo sapiens
agtgctcagaatccac

SEQ ID NO: 2276278 - DNA, 12 bp, Homo sapiens
agtgctttgccc

SEQ ID NO: 2276279 - DNA, 14 bp, Homo sapiens
agtggaagacagag

SEQ ID NO: 2276280 - DNA, 14 bp, Homo sapiens
agtggaatttcttg

SEQ ID NO: 2276281 - DNA, 19 bp, Homo sapiens
agtggacccgcccgcggcc

SEQ ID NO: 2276282 - DNA, 12 bp, Homo sapiens
agtggcaagcta

SEQ ID NO: 2276283 - DNA, 14 bp, Homo sapiens
agtggcatggtcct

SEQ ID NO: 2276284 - DNA, 18 bp, Homo sapiens
agtggcatggtcctgtgc

SEQ ID NO: 2276285 - DNA, 13 bp, Homo sapiens
agtggctgaccag

SEQ ID NO: 2276286 - DNA, 17 bp, Homo sapiens
agtggctgaccaggccc

SEQ ID NO: 2276287 - DNA, 20 bp, Homo sapiens
agtggggaggagactcaggc

SEQ ID NO: 2276288 - DNA, 18 bp, Homo sapiens
agtggggcccatggcccc

SEQ ID NO: 2276289 - DNA, 22 bp, Homo sapiens
agtggggcccatggccccagct

SEQ ID NO: 2276290 - DNA, 15 bp, Homo sapiens
agtgggtatttctta

SEQ ID NO: 2276291 - DNA, 16 bp, Homo sapiens
agtgggtgggacacag

SEQ ID NO: 2276292 - DNA, 20 bp, Homo sapiens
agtgggtgggacacagagac

SEQ ID NO: 2276293 - DNA, 21 bp, Homo sapiens
agtggtcagcgattcctgcca

SEQ ID NO: 2276294 - DNA, 19 bp, Homo sapiens
agtggtccacattctgctg

SEQ ID NO: 2276295 - DNA, 17 bp, Homo sapiens
agtggttcgggggaaat

SEQ ID NO: 2276296 - DNA, 12 bp, Homo sapiens
agtgtacatttg

SEQ ID NO: 2276297 - DNA, 21 bp, Homo sapiens
agtgtacatttgatttgatat

SEQ ID NO: 2276298 - DNA, 15 bp, Homo sapiens
agtgtactttgaact

SEQ ID NO: 2276299 - DNA, 20 bp, Homo sapiens
agtgtgactgatctctcgtg

SEQ ID NO: 2276300 - DNA, 17 bp, Homo sapiens
agtgtggactgggaagc

SEQ ID NO: 2276301 - DNA, 22 bp, Homo sapiens
atctggtctcgtgttcgctggc

SEQ ID NO: 2276302 - DNA, 23 bp, Homo sapiens
atctggtctcgtgttcgctggct

SEQ ID NO: 2276303 - DNA, 17 bp, Homo sapiens
atctgtaaatttaactg

SEQ ID NO: 2276304 - DNA, 17 bp, Homo sapiens
atctgtatatcagctct

SEQ ID NO: 2276305 - DNA, 16 bp, Homo sapiens
atctgtctgattctat

SEQ ID NO: 2276306 - DNA, 13 bp, Homo sapiens
atctgtcttgtaa

SEQ ID NO: 2276307 - DNA, 14 bp, Homo sapiens
atctgtcttgtaat

SEQ ID NO: 2276308 - DNA, 22 bp, Homo sapiens
atctgtcttgtaatattttgta

SEQ ID NO: 2276309 - DNA, 18 bp, Homo sapiens
atctgtgccatagaacaa

SEQ ID NO: 2276310 - DNA, 16 bp, Homo sapiens
atctgtgttgtctctc

SEQ ID NO: 2276311 - DNA, 22 bp, Homo sapiens
atctgttactccaaaaagaaat

SEQ ID NO: 2276312 - DNA, 23 bp, Homo sapiens
atctgttactccaaaaagaaata

SEQ ID NO: 2276313 - DNA, 14 bp, Homo sapiens
atctgttagcatta

SEQ ID NO: 2276314 - DNA, 17 bp, Homo sapiens
atctgttagcattattg

SEQ ID NO: 2276315 - DNA, 12 bp, Homo sapiens
atcttatttata

SEQ ID NO: 2276316 - DNA, 13 bp, Homo sapiens
atcttatttatat

SEQ ID NO: 2276317 - DNA, 14 bp, Homo sapiens
atcttatttatata

SEQ ID NO: 2276318 - DNA, 19 bp, Homo sapiens
atcttcaactaatttttga

SEQ ID NO: 2276319 - DNA, 14 bp, Homo sapiens
atcttccaaatatt

SEQ ID NO: 2276320 - DNA, 12 bp, Homo sapiens
atcttgaagaat

SEQ ID NO: 2276321 - DNA, 15 bp, Homo sapiens
atcttgaagaatatt

SEQ ID NO: 2276322 - DNA, 18 bp, Homo sapiens
atcttgaagacttttctt

SEQ ID NO: 2276323 - DNA, 13 bp, Homo sapiens
atctttcagaata

SEQ ID NO: 2276324 - DNA, 21 bp, Homo sapiens
atgaaaataaataaaaataat

SEQ ID NO: 2276325 - DNA, 17 bp, Homo sapiens
atgaaatatttgcttat

SEQ ID NO: 2276326 - DNA, 19 bp, Homo sapiens
atgaactagagactctgtg

SEQ ID NO: 2276327 - DNA, 13 bp, Homo sapiens
atgaactgtatat

SEQ ID NO: 2276328 - DNA, 17 bp, Homo sapiens
atgaagatgtttttaga

SEQ ID NO: 2276329 - DNA, 16 bp, Homo sapiens
atgaatgtcagtgtga

SEQ ID NO: 2276330 - DNA, 18 bp, Homo sapiens
atgaatgtcagtgtgact

SEQ ID NO: 2276331 - DNA, 17 bp, Homo sapiens
atgaccaatctctgtga

SEQ ID NO: 2276332 - DNA, 22 bp, Homo sapiens
atgacccggatgaactcaatgc

SEQ ID NO: 2276333 - DNA, 23 bp, Homo sapiens
atgacctaaatccattttctaaa

SEQ ID NO: 2276334 - DNA, 13 bp, Homo sapiens
atgactcttctta

SEQ ID NO: 2276335 - DNA, 14 bp, Homo sapiens
atgactgaagggac

SEQ ID NO: 2276336 - DNA, 16 bp, Homo sapiens
atgactgaagtaataa

SEQ ID NO: 2276337 - DNA, 16 bp, Homo sapiens
atgagaaaaaaacagc

SEQ ID NO: 2276338 - DNA, 17 bp, Homo sapiens
atgagaaaaaaacagca

SEQ ID NO: 2276339 - DNA, 14 bp, Homo sapiens
atgagaaatcatgc

SEQ ID NO: 2276340 - DNA, 22 bp, Homo sapiens
atgagaaattgtgccaaagata

SEQ ID NO: 2276341 - DNA, 23 bp, Homo sapiens
atgagacctcccccagggagggg

SEQ ID NO: 2276342 - DNA, 15 bp, Homo sapiens
atgagagagaaaaga

SEQ ID NO: 2276343 - DNA, 14 bp, Homo sapiens
atgagaggaaatca

SEQ ID NO: 2276344 - DNA, 19 bp, Homo sapiens
atgaggttatgagaaaaaa

SEQ ID NO: 2276345 - DNA, 20 bp, Homo sapiens
atgagtttaaaaaaataaca

SEQ ID NO: 2276346 - DNA, 15 bp, Homo sapiens
atgagtttatgggaa

SEQ ID NO: 2276347 - DNA, 12 bp, Homo sapiens
atgatacaaaga

SEQ ID NO: 2276348 - DNA, 21 bp, Homo sapiens
atgatagacttcgaaaacaga

SEQ ID NO: 2276349 - DNA, 19 bp, Homo sapiens
atgatataggaaaatacat

SEQ ID NO: 2276350 - DNA, 22 bp, Homo sapiens
atgatataggaaaatacattgt

SEQ ID NO: 2276351 - DNA, 17 bp, Homo sapiens
atgatccaagtatttta

SEQ ID NO: 2276352 - DNA, 16 bp, Homo sapiens
atgatgccatgaggaa

SEQ ID NO: 2276353 - DNA, 21 bp, Homo sapiens
atgattcaacaggttttcctg

SEQ ID NO: 2276354 - DNA, 15 bp, Homo sapiens
atgattcaatgtgaa

SEQ ID NO: 2276355 - DNA, 22 bp, Homo sapiens
atgattcaatgtgaattttaaa

SEQ ID NO: 2276356 - DNA, 17 bp, Homo sapiens
atgattcaattaacata

SEQ ID NO: 2276357 - DNA, 16 bp, Homo sapiens
atgatttcaatgattg

SEQ ID NO: 2276358 - DNA, 16 bp, Homo sapiens
atgcaaacactgtgta

SEQ ID NO: 2276359 - DNA, 20 bp, Homo sapiens
atgcaaacactgtgtattta

SEQ ID NO: 2276360 - DNA, 19 bp, Homo sapiens
atgcaaaccatcattgaaa

SEQ ID NO: 2276361 - DNA, 22 bp, Homo sapiens
atgcaaaccatcattgaaatct

SEQ ID NO: 2276362 - DNA, 20 bp, Homo sapiens
atgcaacctgtgcaaaataa

SEQ ID NO: 2276363 - DNA, 21 bp, Homo sapiens
atgcacatttgtcactgaata

SEQ ID NO: 2276364 - DNA, 14 bp, Homo sapiens
atgcatatgatata

SEQ ID NO: 2276365 - DNA, 13 bp, Homo sapiens
atgccaatgacat

SEQ ID NO: 2276366 - DNA, 22 bp, Homo sapiens
atgcccaccgcccctggacagg

SEQ ID NO: 2276367 - DNA, 14 bp, Homo sapiens
atgccgctgtgtct

SEQ ID NO: 2276368 - DNA, 21 bp, Homo sapiens
atgccgctgtgtctatgaact

SEQ ID NO: 2276369 - DNA, 12 bp, Homo sapiens
atgcctgtattt

SEQ ID NO: 2276370 - DNA, 17 bp, Homo sapiens
atgcctgtatttccaac

SEQ ID NO: 2276371 - DNA, 13 bp, Homo sapiens
atgcggccggcct

SEQ ID NO: 2276372 - DNA, 19 bp, Homo sapiens
atgctaacaaactgaaaaa

SEQ ID NO: 2276373 - DNA, 17 bp, Homo sapiens
atgctaatagaaaactg

SEQ ID NO: 2276374 - DNA, 23 bp, Homo sapiens
atgctactgtgttacatgttgta

SEQ ID NO: 2276375 - DNA, 21 bp, Homo sapiens
atgctatggaaatacatttag

SEQ ID NO: 2276376 - DNA, 16 bp, Homo sapiens
atgctcttaaaggcag

SEQ ID NO: 2276377 - DNA, 15 bp, Homo sapiens
atgctctttcaccct

SEQ ID NO: 2276378 - DNA, 17 bp, Homo sapiens
atgctgttcagaaatat

SEQ ID NO: 2276379 - DNA, 22 bp, Homo sapiens
atgcttaacataaacttgtact

SEQ ID NO: 2276380 - DNA, 12 bp, Homo sapiens
atgctttaaata

SEQ ID NO: 2276381 - DNA, 20 bp, Homo sapiens
atgctttctcatgcatagac

SEQ ID NO: 2276382 - DNA, 21 bp, Homo sapiens
atgcttttctagcaactgttg

SEQ ID NO: 2276383 - DNA, 17 bp, Homo sapiens
atggaaaggtcctgtgg

SEQ ID NO: 2276384 - DNA, 14 bp, Homo sapiens
atggaaatacattt

SEQ ID NO: 2276385 - DNA, 15 bp, Homo sapiens
atggaacactctgag

SEQ ID NO: 2276386 - DNA, 18 bp, Homo sapiens
atggaacactctgagact

SEQ ID NO: 2276387 - DNA, 16 bp, Homo sapiens
atggaacttaaaacat

SEQ ID NO: 2276388 - DNA, 19 bp, Homo sapiens
atggaacttaaaacatatg

SEQ ID NO: 2276389 - DNA, 15 bp, Homo sapiens
atggaattatgtata

SEQ ID NO: 2276390 - DNA, 19 bp, Homo sapiens
atggaattatgtataacaa

SEQ ID NO: 2276391 - DNA, 18 bp, Homo sapiens
atggacctatctgtaaga

SEQ ID NO: 2276392 - DNA, 23 bp, Homo sapiens
atggacgtgttatgactccagaa

SEQ ID NO: 2276393 - DNA, 21 bp, Homo sapiens
atggagtccagacctgggccc

SEQ ID NO: 2276394 - DNA, 16 bp, Homo sapiens
atggatagagtattga

SEQ ID NO: 2276395 - DNA, 15 bp, Homo sapiens
atggatatgaaagag

SEQ ID NO: 2276396 - DNA, 12 bp, Homo sapiens
atggcagagcca

SEQ ID NO: 2276397 - DNA, 14 bp, Homo sapiens
atggccccagctgg

SEQ ID NO: 2276398 - DNA, 18 bp, Homo sapiens
atggcgtgtcccctgcct

SEQ ID NO: 2276399 - DNA, 22 bp, Homo sapiens
atggctgcatcaaatgcatgcg

SEQ ID NO: 2276400 - DNA, 16 bp, Homo sapiens
atggctgtatttttag

SEQ ID NO: 2276401 - DNA, 19 bp, Homo sapiens
atggctgtatttttagaga

SEQ ID NO: 2276402 - DNA, 21 bp, Homo sapiens
atgggaatgaatgtcagtgtg

SEQ ID NO: 2276403 - DNA, 17 bp, Homo sapiens
atgggacggaggtcctt

SEQ ID NO: 2276404 - DNA, 19 bp, Homo sapiens
atgggagtgaacatttcta

SEQ ID NO: 2276405 - DNA, 14 bp, Homo sapiens
atgggatcattatt

SEQ ID NO: 2276406 - DNA, 15 bp, Homo sapiens
atgggatcattattt

SEQ ID NO: 2276407 - DNA, 17 bp, Homo sapiens
atgggcaaggggccagg

SEQ ID NO: 2276408 - DNA, 18 bp, Homo sapiens
atgggcaaggggccagga

SEQ ID NO: 2276409 - DNA, 14 bp, Homo sapiens
atgggctctggccc

SEQ ID NO: 2276410 - DNA, 17 bp, Homo sapiens
atggggactctccaggc

SEQ ID NO: 2276411 - DNA, 13 bp, Homo sapiens
atggggttgggct

SEQ ID NO: 2276412 - DNA, 16 bp, Homo sapiens
atggggttgggctctg

SEQ ID NO: 2276413 - DNA, 15 bp, Homo sapiens
atgggtgtcccctgg

SEQ ID NO: 2276414 - DNA, 16 bp, Homo sapiens
atgggtgtcccctggt

SEQ ID NO: 2276415 - DNA, 18 bp, Homo sapiens
atgggttgaacaagccac

SEQ ID NO: 2276416 - DNA, 18 bp, Homo sapiens
atggtaatcttttctgag

SEQ ID NO: 2276417 - DNA, 15 bp, Homo sapiens
atggtagctctgaag

SEQ ID NO: 2276418 - DNA, 18 bp, Homo sapiens
atggtagctctgaaggga

SEQ ID NO: 2276419 - DNA, 22 bp, Homo sapiens
atggtattttcgtgcatttgtg

SEQ ID NO: 2276420 - DNA, 14 bp, Homo sapiens
atggtcacagaccc

SEQ ID NO: 2276421 - DNA, 17 bp, Homo sapiens
atggtcctgtgccccga

SEQ ID NO: 2276422 - DNA, 21 bp, Homo sapiens
atggtctcttccagcccagac

SEQ ID NO: 2276423 - DNA, 18 bp, Homo sapiens
atggtgatactccaaggt

SEQ ID NO: 2276424 - DNA, 12 bp, Homo sapiens
atggtgcaatga

SEQ ID NO: 2276425 - DNA, 15 bp, Homo sapiens
atggtgcaatgacct

SEQ ID NO: 2276426 - DNA, 14 bp, Homo sapiens
atggttcaaagata

SEQ ID NO: 2276427 - DNA, 22 bp, Homo sapiens
atggttccgctaatctcttcta

SEQ ID NO: 2276428 - DNA, 13 bp, Homo sapiens
atggttctagaag

SEQ ID NO: 2276429 - DNA, 14 bp, Homo sapiens
atggttttcttgtg

SEQ ID NO: 2276430 - DNA, 14 bp, Homo sapiens
atgtaagggcttta

SEQ ID NO: 2276431 - DNA, 16 bp, Homo sapiens
atgtaatagtggcttt

SEQ ID NO: 2276432 - DNA, 17 bp, Homo sapiens
atgtaatcatttatctt

SEQ ID NO: 2276433 - DNA, 16 bp, Homo sapiens
atgtaattacattaaa

SEQ ID NO: 2276434 - DNA, 13 bp, Homo sapiens
caaccaagttaca

SEQ ID NO: 2276435 - DNA, 13 bp, Homo sapiens
caaccagagcact

SEQ ID NO: 2276436 - DNA, 16 bp, Homo sapiens
caaccagagcactgta

SEQ ID NO: 2276437 - DNA, 20 bp, Homo sapiens
caaccagagcactgtatacc

SEQ ID NO: 2276438 - DNA, 13 bp, Homo sapiens
caacccccacctc

SEQ ID NO: 2276439 - DNA, 19 bp, Homo sapiens
caacccccacctcccggtg

SEQ ID NO: 2276440 - DNA, 13 bp, Homo sapiens
caaccctgccctg

SEQ ID NO: 2276441 - DNA, 18 bp, Homo sapiens
caaccctgccctgcacct

SEQ ID NO: 2276442 - DNA, 14 bp, Homo sapiens
caacctcgccctct

SEQ ID NO: 2276443 - DNA, 23 bp, Homo sapiens
caacctcgccctctctcaccagc

SEQ ID NO: 2276444 - DNA, 13 bp, Homo sapiens
caacctcgctcca

SEQ ID NO: 2276445 - DNA, 16 bp, Homo sapiens
caacctcttcctcctg

SEQ ID NO: 2276446 - DNA, 16 bp, Homo sapiens
caacctggaggctgga

SEQ ID NO: 2276447 - DNA, 23 bp, Homo sapiens
caactaagtagactttaattctt

SEQ ID NO: 2276448 - DNA, 22 bp, Homo sapiens
caactacggttgggagaatgag

SEQ ID NO: 2276449 - DNA, 18 bp, Homo sapiens
caactatttcaataagtg

SEQ ID NO: 2276450 - DNA, 17 bp, Homo sapiens
caactccaacatccact

SEQ ID NO: 2276451 - DNA, 18 bp, Homo sapiens
caactccaacatccactc

SEQ ID NO: 2276452 - DNA, 20 bp, Homo sapiens
caactccaacatccactctc

SEQ ID NO: 2276453 - DNA, 16 bp, Homo sapiens
caactgagatgttaaa

SEQ ID NO: 2276454 - DNA, 21 bp, Homo sapiens
caactgatgatagacttcgaa

SEQ ID NO: 2276455 - DNA, 20 bp, Homo sapiens
caactgcatcaagatgtgac

SEQ ID NO: 2276456 - DNA, 14 bp, Homo sapiens
caactgccaaataa

SEQ ID NO: 2276457 - DNA, 20 bp, Homo sapiens
caactgccaaataaaatgtt

SEQ ID NO: 2276458 - DNA, 17 bp, Homo sapiens
caactgctgttttatgt

SEQ ID NO: 2276459 - DNA, 19 bp, Homo sapiens
caactgtataccgtgtgct

SEQ ID NO: 2276460 - DNA, 22 bp, Homo sapiens
caactgtataccgtgtgctcca

SEQ ID NO: 2276461 - DNA, 23 bp, Homo sapiens
caactgtataccgtgtgctccag

SEQ ID NO: 2276462 - DNA, 23 bp, Homo sapiens
caacttaaacctgtgctttcatg

SEQ ID NO: 2276463 - DNA, 14 bp, Homo sapiens
caacttgaattaca

SEQ ID NO: 2276464 - DNA, 13 bp, Homo sapiens
caacttttgaaat

SEQ ID NO: 2276465 - DNA, 18 bp, Homo sapiens
caagaaaaagtagaaaaa

SEQ ID NO: 2276466 - DNA, 18 bp, Homo sapiens
caagaagaatataaataa

SEQ ID NO: 2276467 - DNA, 17 bp, Homo sapiens
caagacttgacgcagcc

SEQ ID NO: 2276468 - DNA, 16 bp, Homo sapiens
caagagcaaaactcag

SEQ ID NO: 2276469 - DNA, 17 bp, Homo sapiens
caagagcccttccagga

SEQ ID NO: 2276470 - DNA, 12 bp, Homo sapiens
caagagtacagg

SEQ ID NO: 2276471 - DNA, 15 bp, Homo sapiens
caagatcacaaatag

SEQ ID NO: 2276472 - DNA, 18 bp, Homo sapiens
caagatcacaaatagtgt

SEQ ID NO: 2276473 - DNA, 21 bp, Homo sapiens
caagcacaaactgtcgtcttt

SEQ ID NO: 2276474 - DNA, 14 bp, Homo sapiens
caagccatcacagg

SEQ ID NO: 2276475 - DNA, 17 bp, Homo sapiens
caaggaagagccagccg

SEQ ID NO: 2276476 - DNA, 15 bp, Homo sapiens
caaggaaggacattt

SEQ ID NO: 2276477 - DNA, 17 bp, Homo sapiens
caaggaaggacatttcc

SEQ ID NO: 2276478 - DNA, 13 bp, Homo sapiens
caaggatcctgag

SEQ ID NO: 2276479 - DNA, 14 bp, Homo sapiens
caaggatcctgagc

SEQ ID NO: 2276480 - DNA, 15 bp, Homo sapiens
caaggatcctgagcc

SEQ ID NO: 2276481 - DNA, 18 bp, Homo sapiens
caaggcaaagtaaaatta

SEQ ID NO: 2276482 - DNA, 19 bp, Homo sapiens
caaggcaaagtaaaattag

SEQ ID NO: 2276483 - DNA, 20 bp, Homo sapiens
caaggcaccagcaaatttgg

SEQ ID NO: 2276484 - DNA, 15 bp, Homo sapiens
caaggcagctcccag

SEQ ID NO: 2276485 - DNA, 13 bp, Homo sapiens
caaggctcacatg

SEQ ID NO: 2276486 - DNA, 17 bp, Homo sapiens
caaggctcacatgctcc

SEQ ID NO: 2276487 - DNA, 15 bp, Homo sapiens
caaggctgccctgtc

SEQ ID NO: 2276488 - DNA, 20 bp, Homo sapiens
caaggctgctaagtggaaga

SEQ ID NO: 2276489 - DNA, 14 bp, Homo sapiens
caaggggtggaagg

SEQ ID NO: 2276490 - DNA, 18 bp, Homo sapiens
caaggggtggaagggcag

SEQ ID NO: 2276491 - DNA, 21 bp, Homo sapiens
caaggggtggaagggcaggag

SEQ ID NO: 2276492 - DNA, 22 bp, Homo sapiens
caaggggtggaagggcaggagc

SEQ ID NO: 2276493 - DNA, 16 bp, Homo sapiens
caagtagaccatggtc

SEQ ID NO: 2276494 - DNA, 21 bp, Homo sapiens
caagtagggtttagccgggcc

SEQ ID NO: 2276495 - DNA, 13 bp, Homo sapiens
caagtcatgggag

SEQ ID NO: 2276496 - DNA, 17 bp, Homo sapiens
caagtcatgggagaaga

SEQ ID NO: 2276497 - DNA, 16 bp, Homo sapiens
caagtgctctttccac

SEQ ID NO: 2276498 - DNA, 17 bp, Homo sapiens
caataacagttttaaga

SEQ ID NO: 2276499 - DNA, 20 bp, Homo sapiens
caataagtgttgtaccatat

SEQ ID NO: 2276500 - DNA, 23 bp, Homo sapiens
caataagtgttgtaccatatgta

SEQ ID NO: 2276501 - DNA, 21 bp, Homo sapiens
caataattatttgtctcagat

SEQ ID NO: 2276502 - DNA, 16 bp, Homo sapiens
caatatcatgtgtaga

SEQ ID NO: 2276503 - DNA, 22 bp, Homo sapiens
caatatcatgtgtagatattat

SEQ ID NO: 2276504 - DNA, 17 bp, Homo sapiens
caatatccaatgaagaa

SEQ ID NO: 2276505 - DNA, 16 bp, Homo sapiens
caatatgtaacatgtc

SEQ ID NO: 2276506 - DNA, 23 bp, Homo sapiens
caatatgtaacatgtctaaagtt

SEQ ID NO: 2276507 - DNA, 14 bp, Homo sapiens
caatctctgtgact

SEQ ID NO: 2276508 - DNA, 15 bp, Homo sapiens
caatctctgtgactc

SEQ ID NO: 2276509 - DNA, 17 bp, Homo sapiens
caatgaagataaatgct

SEQ ID NO: 2276510 - DNA, 14 bp, Homo sapiens
caatgacctttcaa

SEQ ID NO: 2276511 - DNA, 16 bp, Homo sapiens
caatgacctttcaata

SEQ ID NO: 2276512 - DNA, 13 bp, Homo sapiens
caatgatatagga

SEQ ID NO: 2276513 - DNA, 19 bp, Homo sapiens
caatgattgtttaattgta

SEQ ID NO: 2276514 - DNA, 23 bp, Homo sapiens
caatgcaaaccatcattgaaatc

SEQ ID NO: 2276515 - DNA, 22 bp, Homo sapiens
caatgcttttctagcaactgtt

SEQ ID NO: 2276516 - DNA, 18 bp, Homo sapiens
caatgggagtgaacattt

SEQ ID NO: 2276517 - DNA, 21 bp, Homo sapiens
caatgggagtgaacatttcta

SEQ ID NO: 2276518 - DNA, 20 bp, Homo sapiens
caatgtaaacacttaacaga

SEQ ID NO: 2276519 - DNA, 21 bp, Homo sapiens
caatgtaattacattaaaatg

SEQ ID NO: 2276520 - DNA, 18 bp, Homo sapiens
caatgtaccatgttgccc

SEQ ID NO: 2276521 - DNA, 21 bp, Homo sapiens
caatgtaccatgttgcccaga

SEQ ID NO: 2276522 - DNA, 16 bp, Homo sapiens
caatgtgaaataaaga

SEQ ID NO: 2276523 - DNA, 18 bp, Homo sapiens
caattaaagacatttaaa

SEQ ID NO: 2276524 - DNA, 18 bp, Homo sapiens
caattacaggaagtactg

SEQ ID NO: 2276525 - DNA, 14 bp, Homo sapiens
caattcagttttag

SEQ ID NO: 2276526 - DNA, 16 bp, Homo sapiens
caattcattaataaaa

SEQ ID NO: 2276527 - DNA, 18 bp, Homo sapiens
caattcattaataaaata

SEQ ID NO: 2276528 - DNA, 15 bp, Homo sapiens
caattcttttgaaag

SEQ ID NO: 2276529 - DNA, 22 bp, Homo sapiens
caattgaaatttttaaatcatt

SEQ ID NO: 2276530 - DNA, 22 bp, Homo sapiens
caatttaaaggaaagttctatt

SEQ ID NO: 2276531 - DNA, 23 bp, Homo sapiens
caatttatcttccatatgctctt

SEQ ID NO: 2276532 - DNA, 18 bp, Homo sapiens
caatttatgttaacagat

SEQ ID NO: 2276533 - DNA, 17 bp, Homo sapiens
caatttcaaagaaaaca

SEQ ID NO: 2276534 - DNA, 18 bp, Homo sapiens
caatttcaaagaaaacag

SEQ ID NO: 2276535 - DNA, 19 bp, Homo sapiens
caatttcaaagaaaacaga

SEQ ID NO: 2276536 - DNA, 23 bp, Homo sapiens
caatttgccatagcagtgctagg

SEQ ID NO: 2276537 - DNA, 14 bp, Homo sapiens
caattttaaaaaat

SEQ ID NO: 2276538 - DNA, 16 bp, Homo sapiens
caattttaaaaaataa

SEQ ID NO: 2276539 - DNA, 20 bp, Homo sapiens
caattttctatttaaaaaat

SEQ ID NO: 2276540 - DNA, 14 bp, Homo sapiens
caatttttaactta

SEQ ID NO: 2276541 - DNA, 19 bp, Homo sapiens
caatttttaacttatctcc

SEQ ID NO: 2276542 - DNA, 13 bp, Homo sapiens
cacaaaaggctgg

SEQ ID NO: 2276543 - DNA, 20 bp, Homo sapiens
cacaaactatggtgtgctta

SEQ ID NO: 2276544 - DNA, 14 bp, Homo sapiens
cacaaagggcaggc

SEQ ID NO: 2276545 - DNA, 16 bp, Homo sapiens
cacaataatgaataat

SEQ ID NO: 2276546 - DNA, 15 bp, Homo sapiens
cacaatggtagctct

SEQ ID NO: 2276547 - DNA, 16 bp, Homo sapiens
cacacacagcagctcc

SEQ ID NO: 2276548 - DNA, 18 bp, Homo sapiens
cacacacagcagctccaa

SEQ ID NO: 2276549 - DNA, 15 bp, Homo sapiens
cacacagcagctcca

SEQ ID NO: 2276550 - DNA, 14 bp, Homo sapiens
cacacatatatctg

SEQ ID NO: 2276551 - DNA, 16 bp, Homo sapiens
cacacatttaattcag

SEQ ID NO: 2276552 - DNA, 13 bp, Homo sapiens
cacacatttccct

SEQ ID NO: 2276553 - DNA, 14 bp, Homo sapiens
cacacatttcccta

SEQ ID NO: 2276554 - DNA, 21 bp, Homo sapiens
cacacatttccctattttagg

SEQ ID NO: 2276555 - DNA, 17 bp, Homo sapiens
cacaccccgtctgcccc

SEQ ID NO: 2276556 - DNA, 20 bp, Homo sapiens
cacaccccgtctgccccttg

SEQ ID NO: 2276557 - DNA, 15 bp, Homo sapiens
cacaccctggagtgg

SEQ ID NO: 2276558 - DNA, 15 bp, Homo sapiens
cacacctgcctctga

SEQ ID NO: 2276559 - DNA, 15 bp, Homo sapiens
cacacgccggggctg

SEQ ID NO: 2276560 - DNA, 22 bp, Homo sapiens
cacacgccggggctggccctgc

SEQ ID NO: 2276561 - DNA, 17 bp, Homo sapiens
cacacgtccatgtttat

SEQ ID NO: 2276562 - DNA, 15 bp, Homo sapiens
cacacttagaatact

SEQ ID NO: 2276563 - DNA, 12 bp, Homo sapiens
cacacttcccct

SEQ ID NO: 2276564 - DNA, 19 bp, Homo sapiens
cacacttgcaaatgaatgc

SEQ ID NO: 2276565 - DNA, 15 bp, Homo sapiens
cacagaatctccatt

SEQ ID NO: 2276566 - DNA, 17 bp, Homo sapiens
catctcaaacactgctt

SEQ ID NO: 2276567 - DNA, 16 bp, Homo sapiens
catctcacttcagttg

SEQ ID NO: 2276568 - DNA, 12 bp, Homo sapiens
catctccatgct

SEQ ID NO: 2276569 - DNA, 14 bp, Homo sapiens
catctccatgctct

SEQ ID NO: 2276570 - DNA, 13 bp, Homo sapiens
catctgaaatcta

SEQ ID NO: 2276571 - DNA, 14 bp, Homo sapiens
catctgagctttta

SEQ ID NO: 2276572 - DNA, 13 bp, Homo sapiens
catctgatttgca

SEQ ID NO: 2276573 - DNA, 19 bp, Homo sapiens
catctgatttgcatattca

SEQ ID NO: 2276574 - DNA, 18 bp, Homo sapiens
catctgttgacaatttgc

SEQ ID NO: 2276575 - DNA, 12 bp, Homo sapiens
catcttgtaaat

SEQ ID NO: 2276576 - DNA, 12 bp, Homo sapiens
catgaagaaaaa

SEQ ID NO: 2276577 - DNA, 15 bp, Homo sapiens
catgaaggagaggat

SEQ ID NO: 2276578 - DNA, 18 bp, Homo sapiens
catgagattgtacatttt

SEQ ID NO: 2276579 - DNA, 16 bp, Homo sapiens
catgaggaacaaggca

SEQ ID NO: 2276580 - DNA, 17 bp, Homo sapiens
catgaggaacaaggcaa

SEQ ID NO: 2276581 - DNA, 21 bp, Homo sapiens
catgaggaacaaggcaaggct

SEQ ID NO: 2276582 - DNA, 13 bp, Homo sapiens
catgatacaaaga

SEQ ID NO: 2276583 - DNA, 20 bp, Homo sapiens
catgatgactcttcttatca

SEQ ID NO: 2276584 - DNA, 22 bp, Homo sapiens
catgatgactcttcttatcaca

SEQ ID NO: 2276585 - DNA, 18 bp, Homo sapiens
catgcccaccgcccctgg

SEQ ID NO: 2276586 - DNA, 19 bp, Homo sapiens
catgcggccggcctggggc

SEQ ID NO: 2276587 - DNA, 16 bp, Homo sapiens
catgctatccaatctc

SEQ ID NO: 2276588 - DNA, 20 bp, Homo sapiens
catgctatccaatctcatct

SEQ ID NO: 2276589 - DNA, 23 bp, Homo sapiens
catgctatccaatctcatctctt

SEQ ID NO: 2276590 - DNA, 18 bp, Homo sapiens
catgctctttcaccctgc

SEQ ID NO: 2276591 - DNA, 19 bp, Homo sapiens
catgctctttcaccctgcc

SEQ ID NO: 2276592 - DNA, 21 bp, Homo sapiens
catgctctttcaccctgccac

SEQ ID NO: 2276593 - DNA, 21 bp, Homo sapiens
catgctgagtcatgtctttcc

SEQ ID NO: 2276594 - DNA, 13 bp, Homo sapiens
catgctgtccctt

SEQ ID NO: 2276595 - DNA, 17 bp, Homo sapiens
catgctgtcccttacgt

SEQ ID NO: 2276596 - DNA, 18 bp, Homo sapiens
catggaacttaaaacata

SEQ ID NO: 2276597 - DNA, 15 bp, Homo sapiens
catggaactttcata

SEQ ID NO: 2276598 - DNA, 16 bp, Homo sapiens
catggaagctggcagg

SEQ ID NO: 2276599 - DNA, 22 bp, Homo sapiens
catggaagtactataatttacc

SEQ ID NO: 2276600 - DNA, 18 bp, Homo sapiens
catggaccactgtttctt

SEQ ID NO: 2276601 - DNA, 21 bp, Homo sapiens
catggatcaaccaagttacac

SEQ ID NO: 2276602 - DNA, 14 bp, Homo sapiens
catggattgattaa

SEQ ID NO: 2276603 - DNA, 19 bp, Homo sapiens
catggattgattaaaagca

SEQ ID NO: 2276604 - DNA, 16 bp, Homo sapiens
catgggaatgaatgtc

SEQ ID NO: 2276605 - DNA, 17 bp, Homo sapiens
catgggaatgaatgtca

SEQ ID NO: 2276606 - DNA, 22 bp, Homo sapiens
catgggaatgaatgtcagtgtg

SEQ ID NO: 2276607 - DNA, 17 bp, Homo sapiens
catgggagtcagggagc

SEQ ID NO: 2276608 - DNA, 22 bp, Homo sapiens
catgggagtcagggagccctgg

SEQ ID NO: 2276609 - DNA, 13 bp, Homo sapiens
catgggctctggc

SEQ ID NO: 2276610 - DNA, 14 bp, Homo sapiens
catgggctctggcc

SEQ ID NO: 2276611 - DNA, 16 bp, Homo sapiens
catgggctctggcccc

SEQ ID NO: 2276612 - DNA, 12 bp, Homo sapiens
catggtcctgtg

SEQ ID NO: 2276613 - DNA, 15 bp, Homo sapiens
catgtatagtgagtg

SEQ ID NO: 2276614 - DNA, 15 bp, Homo sapiens
catgtatgatttctg

SEQ ID NO: 2276615 - DNA, 19 bp, Homo sapiens
catgtatttaaagaacact

SEQ ID NO: 2276616 - DNA, 13 bp, Homo sapiens
catgtccccctgt

SEQ ID NO: 2276617 - DNA, 14 bp, Homo sapiens
catgtctaaagtta

SEQ ID NO: 2276618 - DNA, 13 bp, Homo sapiens
catgtctgtagtt

SEQ ID NO: 2276619 - DNA, 21 bp, Homo sapiens
catgtgatgagaggaaatcac

SEQ ID NO: 2276620 - DNA, 20 bp, Homo sapiens
catgtgcagacactcaagag

SEQ ID NO: 2276621 - DNA, 21 bp, Homo sapiens
catgtgcagacactcaagagc

SEQ ID NO: 2276622 - DNA, 18 bp, Homo sapiens
catgtggccttgagcaag

SEQ ID NO: 2276623 - DNA, 23 bp, Homo sapiens
catgtgtacagaaacaactgcca

SEQ ID NO: 2276624 - DNA, 17 bp, Homo sapiens
catgtgttgcaaattat

SEQ ID NO: 2276625 - DNA, 23 bp, Homo sapiens
catgtgttgcaaattattctagt

SEQ ID NO: 2276626 - DNA, 17 bp, Homo sapiens
catgtttaagaaatgag

SEQ ID NO: 2276627 - DNA, 22 bp, Homo sapiens
catgttttgaatgattgaagat

SEQ ID NO: 2276628 - DNA, 18 bp, Homo sapiens
cattaaatataaaataca

SEQ ID NO: 2276629 - DNA, 20 bp, Homo sapiens
cattaaatataaaatacata

SEQ ID NO: 2276630 - DNA, 23 bp, Homo sapiens
cattacatcctctgcttgtcatt

SEQ ID NO: 2276631 - DNA, 18 bp, Homo sapiens
cattactaaggcaggtgg

SEQ ID NO: 2276632 - DNA, 19 bp, Homo sapiens
cattactgcccagatgttt

SEQ ID NO: 2276633 - DNA, 22 bp, Homo sapiens
cattaggaacagagtatatatg

SEQ ID NO: 2276634 - DNA, 23 bp, Homo sapiens
cattagttggagctagaaaatga

SEQ ID NO: 2276635 - DNA, 16 bp, Homo sapiens
cattatgaagatgttt

SEQ ID NO: 2276636 - DNA, 14 bp, Homo sapiens
cattatgagtaaaa

SEQ ID NO: 2276637 - DNA, 12 bp, Homo sapiens
cattattgccaa

SEQ ID NO: 2276638 - DNA, 18 bp, Homo sapiens
cattattgccaaataaga

SEQ ID NO: 2276639 - DNA, 21 bp, Homo sapiens
cattattgccaaataagacag

SEQ ID NO: 2276640 - DNA, 15 bp, Homo sapiens
cattattttgtcata

SEQ ID NO: 2276641 - DNA, 22 bp, Homo sapiens
cattattttgtcataaaatgct

SEQ ID NO: 2276642 - DNA, 20 bp, Homo sapiens
cattcaaaatagttctattt

SEQ ID NO: 2276643 - DNA, 23 bp, Homo sapiens
cattcaaaatagttctatttcta

SEQ ID NO: 2276644 - DNA, 20 bp, Homo sapiens
cattcatactaaataaaaca

SEQ ID NO: 2276645 - DNA, 21 bp, Homo sapiens
cattcatactaaataaaacaa

SEQ ID NO: 2276646 - DNA, 19 bp, Homo sapiens
cattcatactcaaagaggc

SEQ ID NO: 2276647 - DNA, 22 bp, Homo sapiens
cattcatggaccactgtttctt

SEQ ID NO: 2276648 - DNA, 21 bp, Homo sapiens
cattcatgtactaccctcagt

SEQ ID NO: 2276649 - DNA, 21 bp, Homo sapiens
cattccagcgtctgctgttga

SEQ ID NO: 2276650 - DNA, 23 bp, Homo sapiens
cattccagcgtctgctgttgatt

SEQ ID NO: 2276651 - DNA, 20 bp, Homo sapiens
cattctccttagcttctggc

SEQ ID NO: 2276652 - DNA, 17 bp, Homo sapiens
cattctgctgcccccag

SEQ ID NO: 2276653 - DNA, 14 bp, Homo sapiens
cattctgttgttca

SEQ ID NO: 2276654 - DNA, 13 bp, Homo sapiens
cattcttatttta

SEQ ID NO: 2276655 - DNA, 22 bp, Homo sapiens
cattgagggaaaacataatatc

SEQ ID NO: 2276656 - DNA, 18 bp, Homo sapiens
cattgcactccagcctgg

SEQ ID NO: 2276657 - DNA, 23 bp, Homo sapiens
cattgcataagtggacccagctg

SEQ ID NO: 2276658 - DNA, 14 bp, Homo sapiens
cattgcccacacct

SEQ ID NO: 2276659 - DNA, 16 bp, Homo sapiens
cattgcccacacctgc

SEQ ID NO: 2276660 - DNA, 15 bp, Homo sapiens
cattggttacaaatt

SEQ ID NO: 2276661 - DNA, 19 bp, Homo sapiens
cattgtagagcacatttag

SEQ ID NO: 2276662 - DNA, 20 bp, Homo sapiens
cattgtgttttcctaaacac

SEQ ID NO: 2276663 - DNA, 19 bp, Homo sapiens
cattgttacaggtgtacta

SEQ ID NO: 2276664 - DNA, 21 bp, Homo sapiens
catttaaaatagttttctaaa

SEQ ID NO: 2276665 - DNA, 14 bp, Homo sapiens
catttaagaaaaat

SEQ ID NO: 2276666 - DNA, 17 bp, Homo sapiens
catttaagaacaagaga

SEQ ID NO: 2276667 - DNA, 14 bp, Homo sapiens
catttaagaacaga

SEQ ID NO: 2276668 - DNA, 19 bp, Homo sapiens
catttaatgtcgaggctct

SEQ ID NO: 2276669 - DNA, 15 bp, Homo sapiens
catttaatttctaat

SEQ ID NO: 2276670 - DNA, 20 bp, Homo sapiens
catttaatttctaatttcaa

SEQ ID NO: 2276671 - DNA, 23 bp, Homo sapiens
catttatttattcatgtgtacag

SEQ ID NO: 2276672 - DNA, 21 bp, Homo sapiens
catttcatccaccaatatcat

SEQ ID NO: 2276673 - DNA, 18 bp, Homo sapiens
catttcatttatactgta

SEQ ID NO: 2276674 - DNA, 23 bp, Homo sapiens
catttccaccaagggtatctgct

SEQ ID NO: 2276675 - DNA, 23 bp, Homo sapiens
catttccgtgagagtcatctcaa

SEQ ID NO: 2276676 - DNA, 22 bp, Homo sapiens
catttcttatggaaaggtcctg

SEQ ID NO: 2276677 - DNA, 11 bp, Homo sapiens
catttcttatt

SEQ ID NO: 2276678 - DNA, 16 bp, Homo sapiens
catttgtagatatata

SEQ ID NO: 2276679 - DNA, 19 bp, Homo sapiens
catttgtagatatatattt

SEQ ID NO: 2276680 - DNA, 23 bp, Homo sapiens
cattttaaaaataaatgaaaaac

SEQ ID NO: 2276681 - DNA, 16 bp, Homo sapiens
cattttaaaatcaact

SEQ ID NO: 2276682 - DNA, 16 bp, Homo sapiens
cattttactgtctgta

SEQ ID NO: 2276683 - DNA, 17 bp, Homo sapiens
cattttctaaactgttt

SEQ ID NO: 2276684 - DNA, 16 bp, Homo sapiens
cattttggctcagagt

SEQ ID NO: 2276685 - DNA, 19 bp, Homo sapiens
cattttggctcagagtcca

SEQ ID NO: 2276686 - DNA, 14 bp, Homo sapiens
catttttcttggat

SEQ ID NO: 2276687 - DNA, 19 bp, Homo sapiens
ccaaaaaatgtgagctata

SEQ ID NO: 2276688 - DNA, 14 bp, Homo sapiens
ccaaactgtagtaa

SEQ ID NO: 2276689 - DNA, 14 bp, Homo sapiens
ccaaactgttctga

SEQ ID NO: 2276690 - DNA, 13 bp, Homo sapiens
ccaaagagaaaag

SEQ ID NO: 2276691 - DNA, 23 bp, Homo sapiens
ccaaagcagtgcatgctgtccct

SEQ ID NO: 2276692 - DNA, 22 bp, Homo sapiens
ccaaataaaatgtttacatttt

SEQ ID NO: 2276693 - DNA, 19 bp, Homo sapiens
ccaaataaatgtgtaaatg

SEQ ID NO: 2276694 - DNA, 22 bp, Homo sapiens
ccaaataaatgtgtaaatgtgg

SEQ ID NO: 2276695 - DNA, 14 bp, Homo sapiens
ccaaatataaactt

SEQ ID NO: 2276696 - DNA, 17 bp, Homo sapiens
ccaaatattcattttga

SEQ ID NO: 2276697 - DNA, 23 bp, Homo sapiens
ccgtgtattcaggaccccatctg

SEQ ID NO: 2276698 - DNA, 13 bp, Homo sapiens
ccgttacaaaaga

SEQ ID NO: 2276699 - DNA, 16 bp, Homo sapiens
cctaaagaaaaagata

SEQ ID NO: 2276700 - DNA, 20 bp, Homo sapiens
cctaaagatggcgcacccgg

SEQ ID NO: 2276701 - DNA, 14 bp, Homo sapiens
cctaacctgggttg

SEQ ID NO: 2276702 - DNA, 15 bp, Homo sapiens
cctaaggaatatcca

SEQ ID NO: 2276703 - DNA, 22 bp, Homo sapiens
cctaaggcaacatttccgaaga

SEQ ID NO: 2276704 - DNA, 15 bp, Homo sapiens
cctacagcctcactc

SEQ ID NO: 2276705 - DNA, 23 bp, Homo sapiens
cctacatctgaaatctacaacat

SEQ ID NO: 2276706 - DNA, 15 bp, Homo sapiens
cctactctgggaaga

SEQ ID NO: 2276707 - DNA, 20 bp, Homo sapiens
cctagaacaagccagagccg

SEQ ID NO: 2276708 - DNA, 22 bp, Homo sapiens
cctagaacaagccagagccgca

SEQ ID NO: 2276709 - DNA, 20 bp, Homo sapiens
cctagcaaccaactttacct

SEQ ID NO: 2276710 - DNA, 13 bp, Homo sapiens
cctaggctgctgc

SEQ ID NO: 2276711 - DNA, 18 bp, Homo sapiens
cctaggtcatttgtagat

SEQ ID NO: 2276712 - DNA, 15 bp, Homo sapiens
cctagtgatttttgg

SEQ ID NO: 2276713 - DNA, 22 bp, Homo sapiens
cctagtggcttcagcccctggg

SEQ ID NO: 2276714 - DNA, 14 bp, Homo sapiens
cctatctgtaagag

SEQ ID NO: 2276715 - DNA, 11 bp, Homo sapiens
cctcaaactgg

SEQ ID NO: 2276716 - DNA, 16 bp, Homo sapiens
cctcaaggaagagcca

SEQ ID NO: 2276717 - DNA, 19 bp, Homo sapiens
cctcaaggaagagccagcc

SEQ ID NO: 2276718 - DNA, 21 bp, Homo sapiens
cctcaaggaagagccagccgt

SEQ ID NO: 2276719 - DNA, 18 bp, Homo sapiens
cctcacccctgcaggcgg

SEQ ID NO: 2276720 - DNA, 12 bp, Homo sapiens
cctcactgcatc

SEQ ID NO: 2276721 - DNA, 21 bp, Homo sapiens
cctcactgcatctttctcttc

SEQ ID NO: 2276722 - DNA, 23 bp, Homo sapiens
cctcactgcatctttctcttccc

SEQ ID NO: 2276723 - DNA, 22 bp, Homo sapiens
cctcactgtcagcgtttctcca

SEQ ID NO: 2276724 - DNA, 13 bp, Homo sapiens
cctcagagtcctg

SEQ ID NO: 2276725 - DNA, 13 bp, Homo sapiens
cctcaggaggcag

SEQ ID NO: 2276726 - DNA, 15 bp, Homo sapiens
cctcaggtgaataac

SEQ ID NO: 2276727 - DNA, 21 bp, Homo sapiens
cctcatctataaaatgaggga

SEQ ID NO: 2276728 - DNA, 18 bp, Homo sapiens
cctcatgccgctgtgtct

SEQ ID NO: 2276729 - DNA, 19 bp, Homo sapiens
cctccacacccgcgccccg

SEQ ID NO: 2276730 - DNA, 22 bp, Homo sapiens
cctccacctgggagatgctggg

SEQ ID NO: 2276731 - DNA, 21 bp, Homo sapiens
cctccagactcgagagggctg

SEQ ID NO: 2276732 - DNA, 17 bp, Homo sapiens
cctccagattattttct

SEQ ID NO: 2276733 - DNA, 14 bp, Homo sapiens
cctccagctcctgc

SEQ ID NO: 2276734 - DNA, 22 bp, Homo sapiens
cctccatccacacacagcagct

SEQ ID NO: 2276735 - DNA, 16 bp, Homo sapiens
cctcccccacgcctcc

SEQ ID NO: 2276736 - DNA, 21 bp, Homo sapiens
cctcccccaggctgcgcctgc

SEQ ID NO: 2276737 - DNA, 12 bp, Homo sapiens
cctcccccaggg

SEQ ID NO: 2276738 - DNA, 14 bp, Homo sapiens
cctcccccagggag

SEQ ID NO: 2276739 - DNA, 15 bp, Homo sapiens
cctcccccagggagg

SEQ ID NO: 2276740 - DNA, 16 bp, Homo sapiens
cctcccccagggaggg

SEQ ID NO: 2276741 - DNA, 17 bp, Homo sapiens
cctcccccgcagacaga

SEQ ID NO: 2276742 - DNA, 18 bp, Homo sapiens
cctccccgggggtccccg

SEQ ID NO: 2276743 - DNA, 14 bp, Homo sapiens
cctcccctctcctg

SEQ ID NO: 2276744 - DNA, 17 bp, Homo sapiens
cctcccgccccagcctc

SEQ ID NO: 2276745 - DNA, 18 bp, Homo sapiens
cctcccgccccagcctcc

SEQ ID NO: 2276746 - DNA, 20 bp, Homo sapiens
cctcccgccccagcctcctg

SEQ ID NO: 2276747 - DNA, 23 bp, Homo sapiens
cctcccgccgcctcgggccgcct

SEQ ID NO: 2276748 - DNA, 14 bp, Homo sapiens
cctcccgcttcctc

SEQ ID NO: 2276749 - DNA, 17 bp, Homo sapiens
cctcccgcttcctccgg

SEQ ID NO: 2276750 - DNA, 13 bp, Homo sapiens
cctccctgcctgg

SEQ ID NO: 2276751 - DNA, 14 bp, Homo sapiens
cctccctgcctggc

SEQ ID NO: 2276752 - DNA, 20 bp, Homo sapiens
cctccctgtaatgcactcct

SEQ ID NO: 2276753 - DNA, 21 bp, Homo sapiens
cctccctgtaatgcactcctg

SEQ ID NO: 2276754 - DNA, 22 bp, Homo sapiens
cctccctgtaatgcactcctgc

SEQ ID NO: 2276755 - DNA, 23 bp, Homo sapiens
cctccctgtaatgcactcctgcc

SEQ ID NO: 2276756 - DNA, 22 bp, Homo sapiens
cctccgaggttttgaggcggga

SEQ ID NO: 2276757 - DNA, 21 bp, Homo sapiens
cctccgcgggggacaggaaca

SEQ ID NO: 2276758 - DNA, 16 bp, Homo sapiens
cctccggctggacctg

SEQ ID NO: 2276759 - DNA, 21 bp, Homo sapiens
cctccggctggacctggggtc

SEQ ID NO: 2276760 - DNA, 13 bp, Homo sapiens
cctccgtccccag

SEQ ID NO: 2276761 - DNA, 23 bp, Homo sapiens
cctccgtcctggcagggcaggca

SEQ ID NO: 2276762 - DNA, 20 bp, Homo sapiens
cctcctcagcacggtgcctc

SEQ ID NO: 2276763 - DNA, 11 bp, Homo sapiens
cctcctccaga

SEQ ID NO: 2276764 - DNA, 14 bp, Homo sapiens
cctcctccagactc

SEQ ID NO: 2276765 - DNA, 12 bp, Homo sapiens
cctcctccagct

SEQ ID NO: 2276766 - DNA, 15 bp, Homo sapiens
cctcctccagctcct

SEQ ID NO: 2276767 - DNA, 16 bp, Homo sapiens
cctcctccagctcctg

SEQ ID NO: 2276768 - DNA, 17 bp, Homo sapiens
cctcctccagctcctgc

SEQ ID NO: 2276769 - DNA, 15 bp, Homo sapiens
cctcctccctgcctg

SEQ ID NO: 2276770 - DNA, 17 bp, Homo sapiens
cctcctcggctggctgt

SEQ ID NO: 2276771 - DNA, 15 bp, Homo sapiens
cctcctcgggcgcct

SEQ ID NO: 2276772 - DNA, 17 bp, Homo sapiens
cctcctcgggcgcctgc

SEQ ID NO: 2276773 - DNA, 15 bp, Homo sapiens
cctcctctcctcgtc

SEQ ID NO: 2276774 - DNA, 14 bp, Homo sapiens
cctcctctgccccc

SEQ ID NO: 2276775 - DNA, 17 bp, Homo sapiens
cctcctctgccccctcc

SEQ ID NO: 2276776 - DNA, 23 bp, Homo sapiens
cctcctctgccccctcccccgca

SEQ ID NO: 2276777 - DNA, 16 bp, Homo sapiens
cctcctgagtagctgg

SEQ ID NO: 2276778 - DNA, 18 bp, Homo sapiens
cctcctgagtagctggga

SEQ ID NO: 2276779 - DNA, 15 bp, Homo sapiens
cctcgacctccctgg

SEQ ID NO: 2276780 - DNA, 18 bp, Homo sapiens
cctcgacctccctggctt

SEQ ID NO: 2276781 - DNA, 17 bp, Homo sapiens
cctcgcagccacaccta

SEQ ID NO: 2276782 - DNA, 22 bp, Homo sapiens
cctcgccctctctcaccagcct

SEQ ID NO: 2276783 - DNA, 19 bp, Homo sapiens
cctcggccagagctcccag

SEQ ID NO: 2276784 - DNA, 17 bp, Homo sapiens
cctcggctggctgtcca

SEQ ID NO: 2276785 - DNA, 12 bp, Homo sapiens
cctcgggccgcc

SEQ ID NO: 2276786 - DNA, 22 bp, Homo sapiens
cctcgtccggcctgcagcccag

SEQ ID NO: 2276787 - DNA, 18 bp, Homo sapiens
cctctcctagcagcccta

SEQ ID NO: 2276788 - DNA, 12 bp, Homo sapiens
cctctcctcgtc

SEQ ID NO: 2276789 - DNA, 22 bp, Homo sapiens
cctctcctcgtccggcctgcag

SEQ ID NO: 2276790 - DNA, 23 bp, Homo sapiens
cctctcctcgtccggcctgcagc

SEQ ID NO: 2276791 - DNA, 17 bp, Homo sapiens
cctctccttttctccac

SEQ ID NO: 2276792 - DNA, 18 bp, Homo sapiens
cctctgaactgctgctgg

SEQ ID NO: 2276793 - DNA, 13 bp, Homo sapiens
cctctgcagcctg

SEQ ID NO: 2276794 - DNA, 14 bp, Homo sapiens
cctctgcagcctga

SEQ ID NO: 2276795 - DNA, 22 bp, Homo sapiens
cctctgcagcctgagctccacc

SEQ ID NO: 2276796 - DNA, 23 bp, Homo sapiens
cctctgcagcctgagctccaccc

SEQ ID NO: 2276797 - DNA, 13 bp, Homo sapiens
cctctgccccctc

SEQ ID NO: 2276798 - DNA, 14 bp, Homo sapiens
cctctgctgcacag

SEQ ID NO: 2276799 - DNA, 17 bp, Homo sapiens
cctctgcttgtcattct

SEQ ID NO: 2276800 - DNA, 23 bp, Homo sapiens
cctctgcttgtcattctgctaat

SEQ ID NO: 2276801 - DNA, 12 bp, Homo sapiens
cctctggacaga

SEQ ID NO: 2276802 - DNA, 14 bp, Homo sapiens
cctctgtccccgag

SEQ ID NO: 2276803 - DNA, 15 bp, Homo sapiens
cctgaaatgtttcca

SEQ ID NO: 2276804 - DNA, 16 bp, Homo sapiens
cctgaaatgtttccag

SEQ ID NO: 2276805 - DNA, 17 bp, Homo sapiens
cctgaaatgtttccagg

SEQ ID NO: 2276806 - DNA, 21 bp, Homo sapiens
cctgaaatgtttccaggcatg

SEQ ID NO: 2276807 - DNA, 16 bp, Homo sapiens
cctgaattttgcttcc

SEQ ID NO: 2276808 - DNA, 20 bp, Homo sapiens
cctgaattttgcttcctttg

SEQ ID NO: 2276809 - DNA, 18 bp, Homo sapiens
cctgacaccccacttagc

SEQ ID NO: 2276810 - DNA, 12 bp, Homo sapiens
cctgacacctgc

SEQ ID NO: 2276811 - DNA, 14 bp, Homo sapiens
cctgacacctgccg

SEQ ID NO: 2276812 - DNA, 18 bp, Homo sapiens
cctgacttcccagctggc

SEQ ID NO: 2276813 - DNA, 21 bp, Homo sapiens
cctgacttcccagctggcagc

SEQ ID NO: 2276814 - DNA, 17 bp, Homo sapiens
cctgagccacagtgggg

SEQ ID NO: 2276815 - DNA, 21 bp, Homo sapiens
cctgagccacagtggggccca

SEQ ID NO: 2276816 - DNA, 15 bp, Homo sapiens
cctgagctccaccct

SEQ ID NO: 2276817 - DNA, 19 bp, Homo sapiens
cctgagctccaccctcccc

SEQ ID NO: 2276818 - DNA, 22 bp, Homo sapiens
cctgagctccaccctcccctct

SEQ ID NO: 2276819 - DNA, 14 bp, Homo sapiens
cctgaggcaggagg

SEQ ID NO: 2276820 - DNA, 18 bp, Homo sapiens
cctgaggcaggagggcat

SEQ ID NO: 2276821 - DNA, 13 bp, Homo sapiens
cctgagggaagcc

SEQ ID NO: 2276822 - DNA, 18 bp, Homo sapiens
cctgagggaagcccaccc

SEQ ID NO: 2276823 - DNA, 19 bp, Homo sapiens
cctgagggaagcccacccg

SEQ ID NO: 2276824 - DNA, 15 bp, Homo sapiens
cctgatttctcctgc

SEQ ID NO: 2276825 - DNA, 15 bp, Homo sapiens
cctgcaaagctggtt

SEQ ID NO: 2276826 - DNA, 22 bp, Homo sapiens
cctgccaccctctgctgcacag

SEQ ID NO: 2276827 - DNA, 13 bp, Homo sapiens
cctgcccccagcg

SEQ ID NO: 2276828 - DNA, 23 bp, Homo sapiens
cctgccccggcccaacctcgccc

SEQ ID NO: 2276829 - DNA, 22 bp, Homo sapiens
ctccatagttctgactcctgaa

SEQ ID NO: 2276830 - DNA, 20 bp, Homo sapiens
ctccatccacacacagcagc

SEQ ID NO: 2276831 - DNA, 21 bp, Homo sapiens
ctccatccacacacagcagct

SEQ ID NO: 2276832 - DNA, 22 bp, Homo sapiens
ctccatccacacacagcagctc

SEQ ID NO: 2276833 - DNA, 18 bp, Homo sapiens
ctccatctcttgtaccag

SEQ ID NO: 2276834 - DNA, 19 bp, Homo sapiens
ctccatgattccaagggcc

SEQ ID NO: 2276835 - DNA, 22 bp, Homo sapiens
ctccatgattccaagggcccag

SEQ ID NO: 2276836 - DNA, 20 bp, Homo sapiens
ctccatgctctttcaccctg

SEQ ID NO: 2276837 - DNA, 23 bp, Homo sapiens
ctccatggacgtgtctgcacagg

SEQ ID NO: 2276838 - DNA, 13 bp, Homo sapiens
ctccatgtctgta

SEQ ID NO: 2276839 - DNA, 14 bp, Homo sapiens
ctccatttctgctc

SEQ ID NO: 2276840 - DNA, 23 bp, Homo sapiens
ctcccaacaagtgctctttccac

SEQ ID NO: 2276841 - DNA, 14 bp, Homo sapiens
ctcccacatccccc

SEQ ID NO: 2276842 - DNA, 20 bp, Homo sapiens
ctcccaggacgcagggagac

SEQ ID NO: 2276843 - DNA, 15 bp, Homo sapiens
ctcccagggcccgag

SEQ ID NO: 2276844 - DNA, 19 bp, Homo sapiens
ctcccagggcccgagcgcg

SEQ ID NO: 2276845 - DNA, 15 bp, Homo sapiens
ctccccaagacttga

SEQ ID NO: 2276846 - DNA, 20 bp, Homo sapiens
ctccccagccccatcccaaa

SEQ ID NO: 2276847 - DNA, 18 bp, Homo sapiens
ctcccccacgcctccatc

SEQ ID NO: 2276848 - DNA, 11 bp, Homo sapiens
ctcccccaggc

SEQ ID NO: 2276849 - DNA, 18 bp, Homo sapiens
ctcccccaggctgcgcct

SEQ ID NO: 2276850 - DNA, 22 bp, Homo sapiens
ctcccccaggctgcgcctgccc

SEQ ID NO: 2276851 - DNA, 19 bp, Homo sapiens
ctccccgcctcctccctgc

SEQ ID NO: 2276852 - DNA, 19 bp, Homo sapiens
ctccccgggggtccccgga

SEQ ID NO: 2276853 - DNA, 20 bp, Homo sapiens
ctcccctgcgcaggccctcc

SEQ ID NO: 2276854 - DNA, 23 bp, Homo sapiens
ctccccttcgcgtatttcaggat

SEQ ID NO: 2276855 - DNA, 16 bp, Homo sapiens
ctccccttgccacatc

SEQ ID NO: 2276856 - DNA, 20 bp, Homo sapiens
ctcccgagacggcactgaga

SEQ ID NO: 2276857 - DNA, 20 bp, Homo sapiens
ctcccgccccagcctcctga

SEQ ID NO: 2276858 - DNA, 22 bp, Homo sapiens
ctcccgccccagcctcctgagt

SEQ ID NO: 2276859 - DNA, 13 bp, Homo sapiens
ctcccgccgcctc

SEQ ID NO: 2276860 - DNA, 13 bp, Homo sapiens
ctcccgcttcctc

SEQ ID NO: 2276861 - DNA, 22 bp, Homo sapiens
ctcccgtccgtccgcccgccca

SEQ ID NO: 2276862 - DNA, 23 bp, Homo sapiens
ctcccgtccgtccgcccgcccac

SEQ ID NO: 2276863 - DNA, 17 bp, Homo sapiens
ctccctggcttgagtga

SEQ ID NO: 2276864 - DNA, 17 bp, Homo sapiens
ctcccttggatttttga

SEQ ID NO: 2276865 - DNA, 16 bp, Homo sapiens
ctccgcgggggacagg

SEQ ID NO: 2276866 - DNA, 15 bp, Homo sapiens
ctccggcagaggcag

SEQ ID NO: 2276867 - DNA, 18 bp, Homo sapiens
ctccggcagaggcagggc

SEQ ID NO: 2276868 - DNA, 19 bp, Homo sapiens
ctccggctggacctggggt

SEQ ID NO: 2276869 - DNA, 13 bp, Homo sapiens
ctccgtccccagg

SEQ ID NO: 2276870 - DNA, 18 bp, Homo sapiens
ctccgtcctggcagggca

SEQ ID NO: 2276871 - DNA, 17 bp, Homo sapiens
ctcctccagctcctgcc

SEQ ID NO: 2276872 - DNA, 18 bp, Homo sapiens
ctcctccagctcctgccc

SEQ ID NO: 2276873 - DNA, 15 bp, Homo sapiens
ctcctcccccacgcc

SEQ ID NO: 2276874 - DNA, 19 bp, Homo sapiens
ctcctcccccacgcctcca

SEQ ID NO: 2276875 - DNA, 21 bp, Homo sapiens
ctcctcccccacgcctccatc

SEQ ID NO: 2276876 - DNA, 17 bp, Homo sapiens
ctcctcggccagagctc

SEQ ID NO: 2276877 - DNA, 23 bp, Homo sapiens
ctcctcggccagagctcccagga

SEQ ID NO: 2276878 - DNA, 21 bp, Homo sapiens
ctcctcggctggctgtccacc

SEQ ID NO: 2276879 - DNA, 18 bp, Homo sapiens
ctcctcgtccggcctgca

SEQ ID NO: 2276880 - DNA, 20 bp, Homo sapiens
ctcctcgtccggcctgcagc

SEQ ID NO: 2276881 - DNA, 13 bp, Homo sapiens
ctcctctgcagcc

SEQ ID NO: 2276882 - DNA, 21 bp, Homo sapiens
ctcctctgcagcctgagctcc

SEQ ID NO: 2276883 - DNA, 11 bp, Homo sapiens
ctcctctgccc

SEQ ID NO: 2276884 - DNA, 14 bp, Homo sapiens
ctcctctgccccct

SEQ ID NO: 2276885 - DNA, 14 bp, Homo sapiens
ctcctgctgagtgg

SEQ ID NO: 2276886 - DNA, 15 bp, Homo sapiens
ctcctgggccagggt

SEQ ID NO: 2276887 - DNA, 14 bp, Homo sapiens
ctcctgggccccag

SEQ ID NO: 2276888 - DNA, 15 bp, Homo sapiens
ctcctgggccccaga

SEQ ID NO: 2276889 - DNA, 13 bp, Homo sapiens
ctccttgtacttg

SEQ ID NO: 2276890 - DNA, 21 bp, Homo sapiens
ctccttgtcacagaatctcca

SEQ ID NO: 2276891 - DNA, 16 bp, Homo sapiens
ctccttttctccactg

SEQ ID NO: 2276892 - DNA, 19 bp, Homo sapiens
ctcgagagggctgagcccc

SEQ ID NO: 2276893 - DNA, 20 bp, Homo sapiens
ctcgagagggctgagcccct

SEQ ID NO: 2276894 - DNA, 23 bp, Homo sapiens
ctcgagagggctgagcccctcct

SEQ ID NO: 2276895 - DNA, 16 bp, Homo sapiens
ctcgagttacagacaa

SEQ ID NO: 2276896 - DNA, 14 bp, Homo sapiens
ctcgcacccccact

SEQ ID NO: 2276897 - DNA, 19 bp, Homo sapiens
ctcgccctctctcaccagc

SEQ ID NO: 2276898 - DNA, 13 bp, Homo sapiens
ctcgcgacaatgc

SEQ ID NO: 2276899 - DNA, 17 bp, Homo sapiens
ctcgctccaactccaac

SEQ ID NO: 2276900 - DNA, 11 bp, Homo sapiens
ctcgctgtggt

SEQ ID NO: 2276901 - DNA, 18 bp, Homo sapiens
ctcgctgtggtttctcgt

SEQ ID NO: 2276902 - DNA, 14 bp, Homo sapiens
ctcgcttagctgaa

SEQ ID NO: 2276903 - DNA, 17 bp, Homo sapiens
ctcggaatttctatgag

SEQ ID NO: 2276904 - DNA, 22 bp, Homo sapiens
ctcggaatttctatgagacctc

SEQ ID NO: 2276905 - DNA, 22 bp, Homo sapiens
ctcggccagagctcccaggacg

SEQ ID NO: 2276906 - DNA, 13 bp, Homo sapiens
ctcgggaaggcct

SEQ ID NO: 2276907 - DNA, 17 bp, Homo sapiens
ctcgggaaggcctgagg

SEQ ID NO: 2276908 - DNA, 12 bp, Homo sapiens
ctcgggccgcct

SEQ ID NO: 2276909 - DNA, 20 bp, Homo sapiens
ctcgggcgcctgcgctcctc

SEQ ID NO: 2276910 - DNA, 21 bp, Homo sapiens
ctcgggctaagtccagctctc

SEQ ID NO: 2276911 - DNA, 18 bp, Homo sapiens
ctcggggcaggaagtccc

SEQ ID NO: 2276912 - DNA, 22 bp, Homo sapiens
ctcgtactttcacatctctgta

SEQ ID NO: 2276913 - DNA, 18 bp, Homo sapiens
ctcgtcaggaggtgcctg

SEQ ID NO: 2276914 - DNA, 16 bp, Homo sapiens
ctcgtctttcagcgag

SEQ ID NO: 2276915 - DNA, 15 bp, Homo sapiens
ctctaaaattctagt

SEQ ID NO: 2276916 - DNA, 22 bp, Homo sapiens
ctctaataacctttatctaaat

SEQ ID NO: 2276917 - DNA, 20 bp, Homo sapiens
ctctactttcctgatgttga

SEQ ID NO: 2276918 - DNA, 20 bp, Homo sapiens
ctctaggcctcagtgtcctc

SEQ ID NO: 2276919 - DNA, 21 bp, Homo sapiens
ctctcaatagcaaaagtgatg

SEQ ID NO: 2276920 - DNA, 23 bp, Homo sapiens
ctctcacttttttataaattata

SEQ ID NO: 2276921 - DNA, 17 bp, Homo sapiens
ctctcagatccctcggt

SEQ ID NO: 2276922 - DNA, 18 bp, Homo sapiens
ctctcagatccctcggtc

SEQ ID NO: 2276923 - DNA, 13 bp, Homo sapiens
ctctccaggcacc

SEQ ID NO: 2276924 - DNA, 18 bp, Homo sapiens
ctctccaggcaccgcctg

SEQ ID NO: 2276925 - DNA, 22 bp, Homo sapiens
ctctccaggcaccgcctgcccc

SEQ ID NO: 2276926 - DNA, 17 bp, Homo sapiens
ctctcccctgcgcaggc

SEQ ID NO: 2276927 - DNA, 21 bp, Homo sapiens
ctctcctgcgtgtgcccactg

SEQ ID NO: 2276928 - DNA, 18 bp, Homo sapiens
ctctcgcctcaggctttt

SEQ ID NO: 2276929 - DNA, 22 bp, Homo sapiens
ctctcgcctcaggctttttcca

SEQ ID NO: 2276930 - DNA, 18 bp, Homo sapiens
ctctcgggtgccctgcat

SEQ ID NO: 2276931 - DNA, 15 bp, Homo sapiens
ctctctaatagaagt

SEQ ID NO: 2276932 - DNA, 15 bp, Homo sapiens
ctctctatatataca

SEQ ID NO: 2276933 - DNA, 13 bp, Homo sapiens
ctctctcaccagc

SEQ ID NO: 2276934 - DNA, 15 bp, Homo sapiens
ctctctcaccagcct

SEQ ID NO: 2276935 - DNA, 16 bp, Homo sapiens
ctctctcaccagcctt

SEQ ID NO: 2276936 - DNA, 13 bp, Homo sapiens
ctctctctatata

SEQ ID NO: 2276937 - DNA, 15 bp, Homo sapiens
ctctctctatatata

SEQ ID NO: 2276938 - DNA, 17 bp, Homo sapiens
ctctctctatatataca

SEQ ID NO: 2276939 - DNA, 17 bp, Homo sapiens
ctctctgagtatttcct

SEQ ID NO: 2276940 - DNA, 24 bp, Homo sapiens
ctctgaaaatatttttttctagct

SEQ ID NO: 2276941 - DNA, 18 bp, Homo sapiens
ctctgaactgctgctggt

SEQ ID NO: 2276942 - DNA, 12 bp, Homo sapiens
ctctgaatcaaa

SEQ ID NO: 2276943 - DNA, 21 bp, Homo sapiens
ctctgagactcgcgacaatgc

SEQ ID NO: 2276944 - DNA, 23 bp, Homo sapiens
ctctgagactcgcgacaatgcaa

SEQ ID NO: 2276945 - DNA, 14 bp, Homo sapiens
ctctgagcagtggg

SEQ ID NO: 2276946 - DNA, 16 bp, Homo sapiens
ctctgagcagtgggga

SEQ ID NO: 2276947 - DNA, 12 bp, Homo sapiens
ctctgcagcctg

SEQ ID NO: 2276948 - DNA, 13 bp, Homo sapiens
ctctgcagcctga

SEQ ID NO: 2276949 - DNA, 16 bp, Homo sapiens
ctctgcagcctgagct

SEQ ID NO: 2276950 - DNA, 23 bp, Homo sapiens
ctctgcagcctgagctccaccct

SEQ ID NO: 2276951 - DNA, 19 bp, Homo sapiens
ctctgcataagattatata

SEQ ID NO: 2276952 - DNA, 18 bp, Homo sapiens
ctctgccatcagcccctg

SEQ ID NO: 2276953 - DNA, 14 bp, Homo sapiens
ctctgccccctccc

SEQ ID NO: 2276954 - DNA, 18 bp, Homo sapiens
ctctgcccctccgtcccc

SEQ ID NO: 2276955 - DNA, 15 bp, Homo sapiens
ctctgccttccaggc

SEQ ID NO: 2276956 - DNA, 17 bp, Homo sapiens
ctctgcctttgtgctct

SEQ ID NO: 2276957 - DNA, 19 bp, Homo sapiens
ctctgcctttgtgctctgt

SEQ ID NO: 2276958 - DNA, 20 bp, Homo sapiens
ctctgcgtcccactgagtct

SEQ ID NO: 2276959 - DNA, 12 bp, Homo sapiens
ctctgctcaggg

SEQ ID NO: 2276960 - DNA, 24 bp, Homo sapiens
ctctggaaccatcctctgttaccc

SEQ ID NO: 2276961 - DNA, 18 bp, Homo sapiens
cttgcttgtacctctggc

SEQ ID NO: 2276962 - DNA, 17 bp, Homo sapiens
cttgctttgaatgcatg

SEQ ID NO: 2276963 - DNA, 18 bp, Homo sapiens
cttgctttgaatgcatgt

SEQ ID NO: 2276964 - DNA, 20 bp, Homo sapiens
cttggagacaggattctgac

SEQ ID NO: 2276965 - DNA, 16 bp, Homo sapiens
cttggatctttttgca

SEQ ID NO: 2276966 - DNA, 23 bp, Homo sapiens
cttggcaggagtgggctctgagc

SEQ ID NO: 2276967 - DNA, 16 bp, Homo sapiens
cttggctcgcaccccc

SEQ ID NO: 2276968 - DNA, 17 bp, Homo sapiens
cttggctcgcaccccca

SEQ ID NO: 2276969 - DNA, 19 bp, Homo sapiens
cttgggatgggcacaggct

SEQ ID NO: 2276970 - DNA, 20 bp, Homo sapiens
cttggggaaggatctccccg

SEQ ID NO: 2276971 - DNA, 19 bp, Homo sapiens
cttggtgtcgggcatgaca

SEQ ID NO: 2276972 - DNA, 22 bp, Homo sapiens
cttgtaaatacatgtccccctg

SEQ ID NO: 2276973 - DNA, 16 bp, Homo sapiens
cttgtaatattttgta

SEQ ID NO: 2276974 - DNA, 17 bp, Homo sapiens
cttgtaatattttgtat

SEQ ID NO: 2276975 - DNA, 20 bp, Homo sapiens
cttgtaatattttgtattat

SEQ ID NO: 2276976 - DNA, 23 bp, Homo sapiens
cttgtacctctggctgactaaat

SEQ ID NO: 2276977 - DNA, 19 bp, Homo sapiens
cttgtacttacactgaaat

SEQ ID NO: 2276978 - DNA, 21 bp, Homo sapiens
cttgtacttacactgaaatcc

SEQ ID NO: 2276979 - DNA, 22 bp, Homo sapiens
cttgtaggtaagttggctcaca

SEQ ID NO: 2276980 - DNA, 22 bp, Homo sapiens
cttgtattttcttcccatttgt

SEQ ID NO: 2276981 - DNA, 23 bp, Homo sapiens
cttgtattttcttcccatttgta

SEQ ID NO: 2276982 - DNA, 21 bp, Homo sapiens
cttgtgtgtttattgtcaaag

SEQ ID NO: 2276983 - DNA, 20 bp, Homo sapiens
cttgtgtttaactgtgaaca

SEQ ID NO: 2276984 - DNA, 19 bp, Homo sapiens
ctttaacattttgtttcca

SEQ ID NO: 2276985 - DNA, 19 bp, Homo sapiens
ctttaatcaaaagtcctta

SEQ ID NO: 2276986 - DNA, 21 bp, Homo sapiens
ctttactttgtggatatattt

SEQ ID NO: 2276987 - DNA, 13 bp, Homo sapiens
ctttagattgaaa

SEQ ID NO: 2276988 - DNA, 17 bp, Homo sapiens
ctttagattgaaattta

SEQ ID NO: 2276989 - DNA, 20 bp, Homo sapiens
ctttagattgaaatttatga

SEQ ID NO: 2276990 - DNA, 19 bp, Homo sapiens
ctttatgttgcaattaaaa

SEQ ID NO: 2276991 - DNA, 14 bp, Homo sapiens
ctttattacacaaa

SEQ ID NO: 2276992 - DNA, 20 bp, Homo sapiens
ctttatttgtactttttcct

SEQ ID NO: 2276993 - DNA, 23 bp, Homo sapiens
ctttatttgtgttcttttttccc

SEQ ID NO: 2276994 - DNA, 23 bp, Homo sapiens
ctttcaaacattgagactgctag

SEQ ID NO: 2276995 - DNA, 21 bp, Homo sapiens
ctttcaataggaaaaactgat

SEQ ID NO: 2276996 - DNA, 15 bp, Homo sapiens
ctttcacccttttct

SEQ ID NO: 2276997 - DNA, 16 bp, Homo sapiens
ctttcagaatattttc

SEQ ID NO: 2276998 - DNA, 23 bp, Homo sapiens
ctttcagccaagaattcttaaat

SEQ ID NO: 2276999 - DNA, 16 bp, Homo sapiens
ctttcatctgagcttt

SEQ ID NO: 2277000 - DNA, 20 bp, Homo sapiens
ctttcatgtttaagaaatga

SEQ ID NO: 2277001 - DNA, 14 bp, Homo sapiens
ctttccccactgaa

SEQ ID NO: 2277002 - DNA, 20 bp, Homo sapiens
ctttccctgtgtaccctcca

SEQ ID NO: 2277003 - DNA, 21 bp, Homo sapiens
ctttccctgtgtaccctccat

SEQ ID NO: 2277004 - DNA, 17 bp, Homo sapiens
ctttcctactctgggaa

SEQ ID NO: 2277005 - DNA, 14 bp, Homo sapiens
ctttcctcccttct

SEQ ID NO: 2277006 - DNA, 20 bp, Homo sapiens
ctttcctgatgttgataata

SEQ ID NO: 2277007 - DNA, 13 bp, Homo sapiens
ctttcctgtttct

SEQ ID NO: 2277008 - DNA, 12 bp, Homo sapiens
ctttccttccca

SEQ ID NO: 2277009 - DNA, 12 bp, Homo sapiens
ctttcgcctcct

SEQ ID NO: 2277010 - DNA, 21 bp, Homo sapiens
ctttctctcctcttctccctt

SEQ ID NO: 2277011 - DNA, 15 bp, Homo sapiens
ctttcttttctttct

SEQ ID NO: 2277012 - DNA, 18 bp, Homo sapiens
ctttgaacctgtgcaata

SEQ ID NO: 2277013 - DNA, 16 bp, Homo sapiens
ctttgaacttcgatgt

SEQ ID NO: 2277014 - DNA, 16 bp, Homo sapiens
ctttgaatgcatgtgt

SEQ ID NO: 2277015 - DNA, 15 bp, Homo sapiens
ctttgcagtgaagat

SEQ ID NO: 2277016 - DNA, 20 bp, Homo sapiens
ctttgcagtgaagatgtgta

SEQ ID NO: 2277017 - DNA, 23 bp, Homo sapiens
ctttgggaggtcgaggtgggcgt

SEQ ID NO: 2277018 - DNA, 17 bp, Homo sapiens
ctttggggcttatcaga

SEQ ID NO: 2277019 - DNA, 17 bp, Homo sapiens
ctttggggtctacactg

SEQ ID NO: 2277020 - DNA, 19 bp, Homo sapiens
ctttggtaatgtgtcaaag

SEQ ID NO: 2277021 - DNA, 22 bp, Homo sapiens
ctttgtagatgtattttcaata

SEQ ID NO: 2277022 - DNA, 19 bp, Homo sapiens
ctttgtgctctgttcctgt

SEQ ID NO: 2277023 - DNA, 21 bp, Homo sapiens
ctttgttttggctgctctcca

SEQ ID NO: 2277024 - DNA, 18 bp, Homo sapiens
ctttgtttttggcatttc

SEQ ID NO: 2277025 - DNA, 22 bp, Homo sapiens
cttttagcggtttgcaaacaaa

SEQ ID NO: 2277026 - DNA, 23 bp, Homo sapiens
cttttattgagtaatattacatt

SEQ ID NO: 2277027 - DNA, 22 bp, Homo sapiens
cttttcagcatggtttgcatga

SEQ ID NO: 2277028 - DNA, 15 bp, Homo sapiens
cttttcagcttgttt

SEQ ID NO: 2277029 - DNA, 13 bp, Homo sapiens
cttttctgaggtt

SEQ ID NO: 2277030 - DNA, 14 bp, Homo sapiens
cttttctgaggttt

SEQ ID NO: 2277031 - DNA, 15 bp, Homo sapiens
cttttctgtttgcta

SEQ ID NO: 2277032 - DNA, 23 bp, Homo sapiens
cttttcttacagtaactgagtgt

SEQ ID NO: 2277033 - DNA, 14 bp, Homo sapiens
cttttcttgaggca

SEQ ID NO: 2277034 - DNA, 19 bp, Homo sapiens
cttttgaaatttaaaaatc

SEQ ID NO: 2277035 - DNA, 23 bp, Homo sapiens
cttttgcatttctcttcctaaat

SEQ ID NO: 2277036 - DNA, 23 bp, Homo sapiens
cttttggggaggagttgtctgtc

SEQ ID NO: 2277037 - DNA, 14 bp, Homo sapiens
cttttgtgtattct

SEQ ID NO: 2277038 - DNA, 16 bp, Homo sapiens
cttttgtgtattctgt

SEQ ID NO: 2277039 - DNA, 18 bp, Homo sapiens
ctttttaaactgatgtat

SEQ ID NO: 2277040 - DNA, 13 bp, Homo sapiens
ctttttaaatgtg

SEQ ID NO: 2277041 - DNA, 19 bp, Homo sapiens
ctttttctcgagtccaaaa

SEQ ID NO: 2277042 - DNA, 16 bp, Homo sapiens
ctttttcttttttgag

SEQ ID NO: 2277043 - DNA, 22 bp, Homo sapiens
ctttttcttttttgagtgtgca

SEQ ID NO: 2277044 - DNA, 20 bp, Homo sapiens
cttttttataaattataatg

SEQ ID NO: 2277045 - DNA, 12 bp, Homo sapiens
cttttttcaatg

SEQ ID NO: 2277046 - DNA, 14 bp, Homo sapiens
cttttttcaatgta

SEQ ID NO: 2277047 - DNA, 19 bp, Homo sapiens
cttttttcaatgtactgta

SEQ ID NO: 2277048 - DNA, 16 bp, Homo sapiens
cttttttgagtgtgca

SEQ ID NO: 2277049 - DNA, 13 bp, Homo sapiens
gaaaaaaaaataa

SEQ ID NO: 2277050 - DNA, 14 bp, Homo sapiens
gaaaaactgatttt

SEQ ID NO: 2277051 - DNA, 17 bp, Homo sapiens
gaaaaatctagtatttg

SEQ ID NO: 2277052 - DNA, 21 bp, Homo sapiens
gaaaaatctagtatttgtatc

SEQ ID NO: 2277053 - DNA, 22 bp, Homo sapiens
gaaaaatgctgttcagaaatat

SEQ ID NO: 2277054 - DNA, 16 bp, Homo sapiens
gaaaacaccaagagta

SEQ ID NO: 2277055 - DNA, 20 bp, Homo sapiens
gaaaacagatgagaagacta

SEQ ID NO: 2277056 - DNA, 21 bp, Homo sapiens
gaaaacataatatcttgaaga

SEQ ID NO: 2277057 - DNA, 14 bp, Homo sapiens
gaaaacgtggctgc

SEQ ID NO: 2277058 - DNA, 18 bp, Homo sapiens
gaaaacgtggctgcttca

SEQ ID NO: 2277059 - DNA, 22 bp, Homo sapiens
gaaaactgcctgacctttggga

SEQ ID NO: 2277060 - DNA, 15 bp, Homo sapiens
gaaaagaaatgctaa

SEQ ID NO: 2277061 - DNA, 21 bp, Homo sapiens
gaaaagattaaaattagtgag

SEQ ID NO: 2277062 - DNA, 18 bp, Homo sapiens
gaaaaggtccaaaactgt

SEQ ID NO: 2277063 - DNA, 15 bp, Homo sapiens
gaaaatactggaatt

SEQ ID NO: 2277064 - DNA, 18 bp, Homo sapiens
gaaaatagcttttattga

SEQ ID NO: 2277065 - DNA, 19 bp, Homo sapiens
gaaaataggaacgactcta

SEQ ID NO: 2277066 - DNA, 15 bp, Homo sapiens
gaaaatagtcctcca

SEQ ID NO: 2277067 - DNA, 22 bp, Homo sapiens
gaaaatagtcctccaaaacaca

SEQ ID NO: 2277068 - DNA, 17 bp, Homo sapiens
gaaaatatttttttcta

SEQ ID NO: 2277069 - DNA, 14 bp, Homo sapiens
gaaaatgctttctc

SEQ ID NO: 2277070 - DNA, 23 bp, Homo sapiens
gaaaatggacgtgttatgactcc

SEQ ID NO: 2277071 - DNA, 17 bp, Homo sapiens
gaaaatgggaagcatta

SEQ ID NO: 2277072 - DNA, 18 bp, Homo sapiens
gaaacaaaaaatattcat

SEQ ID NO: 2277073 - DNA, 19 bp, Homo sapiens
gaaacaactgccaaataaa

SEQ ID NO: 2277074 - DNA, 16 bp, Homo sapiens
gaaacaaggaaggaca

SEQ ID NO: 2277075 - DNA, 19 bp, Homo sapiens
gaaaccaattaagcagctt

SEQ ID NO: 2277076 - DNA, 15 bp, Homo sapiens
gaaacctctgttctc

SEQ ID NO: 2277077 - DNA, 18 bp, Homo sapiens
gaaacgagatttgccaaa

SEQ ID NO: 2277078 - DNA, 21 bp, Homo sapiens
gaaactagctgtttaaagttt

SEQ ID NO: 2277079 - DNA, 13 bp, Homo sapiens
gaaagaacaagtt

SEQ ID NO: 2277080 - DNA, 11 bp, Homo sapiens
gaaagagaaaa

SEQ ID NO: 2277081 - DNA, 16 bp, Homo sapiens
gaaagagaaaatgctt

SEQ ID NO: 2277082 - DNA, 17 bp, Homo sapiens
gaaagagttgagcacag

SEQ ID NO: 2277083 - DNA, 14 bp, Homo sapiens
gaaaggaaaagagg

SEQ ID NO: 2277084 - DNA, 18 bp, Homo sapiens
gaaaggactgtgtgacct

SEQ ID NO: 2277085 - DNA, 17 bp, Homo sapiens
gaaaggggattacagtt

SEQ ID NO: 2277086 - DNA, 18 bp, Homo sapiens
gaaagtcagctcttgtca

SEQ ID NO: 2277087 - DNA, 22 bp, Homo sapiens
gaaagttctattatctgggttt

SEQ ID NO: 2277088 - DNA, 14 bp, Homo sapiens
gaaagtttccttat

SEQ ID NO: 2277089 - DNA, 16 bp, Homo sapiens
gaaataaatctaaata

SEQ ID NO: 2277090 - DNA, 14 bp, Homo sapiens
gaaatacatttaga

SEQ ID NO: 2277091 - DNA, 19 bp, Homo sapiens
gaaatatgcaacctgtgca

SEQ ID NO: 2277092 - DNA, 23 bp, Homo sapiens
gaggtccattaatacttccttat

SEQ ID NO: 2277093 - DNA, 19 bp, Homo sapiens
gaggtgagctactttgtga

SEQ ID NO: 2277094 - DNA, 17 bp, Homo sapiens
gaggtgagggaggcctg

SEQ ID NO: 2277095 - DNA, 18 bp, Homo sapiens
gaggtgagggaggcctga

SEQ ID NO: 2277096 - DNA, 22 bp, Homo sapiens
gaggtgcctgagagcagaatga

SEQ ID NO: 2277097 - DNA, 14 bp, Homo sapiens
gaggtggggagggc

SEQ ID NO: 2277098 - DNA, 21 bp, Homo sapiens
gaggtggggagggcctctgga

SEQ ID NO: 2277099 - DNA, 22 bp, Homo sapiens
gaggtggggagggcctctggac

SEQ ID NO: 2277100 - DNA, 13 bp, Homo sapiens
gaggtgggggcag

SEQ ID NO: 2277101 - DNA, 23 bp, Homo sapiens
gaggtgggggcagcggccccgca

SEQ ID NO: 2277102 - DNA, 15 bp, Homo sapiens
gaggttttctccccc

SEQ ID NO: 2277103 - DNA, 21 bp, Homo sapiens
gagtaatattacatttcattt

SEQ ID NO: 2277104 - DNA, 20 bp, Homo sapiens
gagtagctgggactagaggc

SEQ ID NO: 2277105 - DNA, 12 bp, Homo sapiens
gagtatatatgt

SEQ ID NO: 2277106 - DNA, 19 bp, Homo sapiens
gagtatgcaagaagaatat

SEQ ID NO: 2277107 - DNA, 14 bp, Homo sapiens
gagtcagggagccc

SEQ ID NO: 2277108 - DNA, 15 bp, Homo sapiens
gagtccaaaatcatt

SEQ ID NO: 2277109 - DNA, 17 bp, Homo sapiens
gagtccctcctccccca

SEQ ID NO: 2277110 - DNA, 22 bp, Homo sapiens
gagtcctgccgacggagccact

SEQ ID NO: 2277111 - DNA, 15 bp, Homo sapiens
gagtcggctgggcag

SEQ ID NO: 2277112 - DNA, 19 bp, Homo sapiens
gagtcggctgggcagggcc

SEQ ID NO: 2277113 - DNA, 19 bp, Homo sapiens
gagtgacatcggttcagga

SEQ ID NO: 2277114 - DNA, 22 bp, Homo sapiens
gagtgacatcggttcaggagga

SEQ ID NO: 2277115 - DNA, 17 bp, Homo sapiens
gagtgagctaccaggaa

SEQ ID NO: 2277116 - DNA, 14 bp, Homo sapiens
gagtgatgggcaag

SEQ ID NO: 2277117 - DNA, 22 bp, Homo sapiens
gagtgccccagaaatgccgctg

SEQ ID NO: 2277118 - DNA, 23 bp, Homo sapiens
gagtgcccttaaaataatgattt

SEQ ID NO: 2277119 - DNA, 15 bp, Homo sapiens
gagtggacagcagct

SEQ ID NO: 2277120 - DNA, 18 bp, Homo sapiens
gagtggacagcagctgga

SEQ ID NO: 2277121 - DNA, 16 bp, Homo sapiens
gagtggcatggtcctg

SEQ ID NO: 2277122 - DNA, 21 bp, Homo sapiens
gagtggcatggtcctgtgccc

SEQ ID NO: 2277123 - DNA, 18 bp, Homo sapiens
gagtggctgaccaggccc

SEQ ID NO: 2277124 - DNA, 19 bp, Homo sapiens
gagtggctgaccaggccct

SEQ ID NO: 2277125 - DNA, 15 bp, Homo sapiens
gagtggggtttgctt

SEQ ID NO: 2277126 - DNA, 21 bp, Homo sapiens
gagtgggtgggacacagagac

SEQ ID NO: 2277127 - DNA, 10 bp, Homo sapiens
gagtgtgcaa

SEQ ID NO: 2277128 - DNA, 15 bp, Homo sapiens
gagtgtgcaatatgt

SEQ ID NO: 2277129 - DNA, 19 bp, Homo sapiens
gagtgtggagctgcttcca

SEQ ID NO: 2277130 - DNA, 19 bp, Homo sapiens
gagtgtgtagaaacacagc

SEQ ID NO: 2277131 - DNA, 20 bp, Homo sapiens
gagttcatcttgaattgtaa

SEQ ID NO: 2277132 - DNA, 14 bp, Homo sapiens
gagttcctttctgg

SEQ ID NO: 2277133 - DNA, 20 bp, Homo sapiens
gagttgagtgggtatttctt

SEQ ID NO: 2277134 - DNA, 18 bp, Homo sapiens
gagtttaacagatattta

SEQ ID NO: 2277135 - DNA, 15 bp, Homo sapiens
gataaatatttatgc

SEQ ID NO: 2277136 - DNA, 19 bp, Homo sapiens
gataaatatttatgcagaa

SEQ ID NO: 2277137 - DNA, 15 bp, Homo sapiens
gataaatgctttaaa

SEQ ID NO: 2277138 - DNA, 15 bp, Homo sapiens
gataaccaagaatgt

SEQ ID NO: 2277139 - DNA, 18 bp, Homo sapiens
gataataactagatctcc

SEQ ID NO: 2277140 - DNA, 23 bp, Homo sapiens
gataatagtaatggttctagaag

SEQ ID NO: 2277141 - DNA, 13 bp, Homo sapiens
gataattatatca

SEQ ID NO: 2277142 - DNA, 11 bp, Homo sapiens
gatacaagaaa

SEQ ID NO: 2277143 - DNA, 21 bp, Homo sapiens
gatacaagaaaaagtagaaaa

SEQ ID NO: 2277144 - DNA, 22 bp, Homo sapiens
gatacaagaaaaagtagaaaaa

SEQ ID NO: 2277145 - DNA, 23 bp, Homo sapiens
gatacaagaaaaagtagaaaaaa

SEQ ID NO: 2277146 - DNA, 15 bp, Homo sapiens
gatagaactgtggca

SEQ ID NO: 2277147 - DNA, 22 bp, Homo sapiens
gatagaggacacggaccctgtg

SEQ ID NO: 2277148 - DNA, 12 bp, Homo sapiens
gatatatatttc

SEQ ID NO: 2277149 - DNA, 14 bp, Homo sapiens
gatatatatttcca

SEQ ID NO: 2277150 - DNA, 15 bp, Homo sapiens
gatatatatttccaa

SEQ ID NO: 2277151 - DNA, 17 bp, Homo sapiens
gatatatatttccaaat

SEQ ID NO: 2277152 - DNA, 18 bp, Homo sapiens
gatattatgtatagaaaa

SEQ ID NO: 2277153 - DNA, 16 bp, Homo sapiens
gatcagacttgattta

SEQ ID NO: 2277154 - DNA, 19 bp, Homo sapiens
gatcagatcttacaagttt

SEQ ID NO: 2277155 - DNA, 17 bp, Homo sapiens
gatcagcattcaaaata

SEQ ID NO: 2277156 - DNA, 24 bp, Homo sapiens
gatcagcattcaaaatagttctat

SEQ ID NO: 2277157 - DNA, 17 bp, Homo sapiens
gatcagttgctctctgt

SEQ ID NO: 2277158 - DNA, 20 bp, Homo sapiens
gatcagttgctctctgttca

SEQ ID NO: 2277159 - DNA, 19 bp, Homo sapiens
gatcataaagttagaatct

SEQ ID NO: 2277160 - DNA, 20 bp, Homo sapiens
gatccagagacctgctccag

SEQ ID NO: 2277161 - DNA, 20 bp, Homo sapiens
gatcccaatagaatacctcc

SEQ ID NO: 2277162 - DNA, 19 bp, Homo sapiens
gatccctcggtcagcaccg

SEQ ID NO: 2277163 - DNA, 18 bp, Homo sapiens
gatcctcccgccccagcc

SEQ ID NO: 2277164 - DNA, 17 bp, Homo sapiens
gatcctctgatatacaa

SEQ ID NO: 2277165 - DNA, 20 bp, Homo sapiens
gatcctctttccccactgaa

SEQ ID NO: 2277166 - DNA, 23 bp, Homo sapiens
gatcctgtcccatgggctctggc

SEQ ID NO: 2277167 - DNA, 19 bp, Homo sapiens
gatctctgagaccacagag

SEQ ID NO: 2277168 - DNA, 15 bp, Homo sapiens
gatctggtctcgtgt

SEQ ID NO: 2277169 - DNA, 13 bp, Homo sapiens
gatctgtcttgta

SEQ ID NO: 2277170 - DNA, 15 bp, Homo sapiens
gatgaaaaaataaca

SEQ ID NO: 2277171 - DNA, 15 bp, Homo sapiens
gatgaacagttctcc

SEQ ID NO: 2277172 - DNA, 21 bp, Homo sapiens
gatgaatcagtatgaagacac

SEQ ID NO: 2277173 - DNA, 15 bp, Homo sapiens
gatgacacataaatc

SEQ ID NO: 2277174 - DNA, 18 bp, Homo sapiens
gatgaccaatctctgtga

SEQ ID NO: 2277175 - DNA, 22 bp, Homo sapiens
gatgactcttcttatcacactt

SEQ ID NO: 2277176 - DNA, 12 bp, Homo sapiens
gatgatagactt

SEQ ID NO: 2277177 - DNA, 16 bp, Homo sapiens
gatgatccatttgaac

SEQ ID NO: 2277178 - DNA, 20 bp, Homo sapiens
gatgctgctggaggaatcag

SEQ ID NO: 2277179 - DNA, 15 bp, Homo sapiens
gatgcttgatataat

SEQ ID NO: 2277180 - DNA, 13 bp, Homo sapiens
gatggaaaggtga

SEQ ID NO: 2277181 - DNA, 17 bp, Homo sapiens
gatggatattagatgcc

SEQ ID NO: 2277182 - DNA, 18 bp, Homo sapiens
gatggatattagatgccc

SEQ ID NO: 2277183 - DNA, 12 bp, Homo sapiens
gatggcagagcc

SEQ ID NO: 2277184 - DNA, 14 bp, Homo sapiens
gatggcagagccat

SEQ ID NO: 2277185 - DNA, 17 bp, Homo sapiens
gatggcccgagagctgg

SEQ ID NO: 2277186 - DNA, 20 bp, Homo sapiens
gatggcgtgtcccctgcctg

SEQ ID NO: 2277187 - DNA, 16 bp, Homo sapiens
gatgggcaaggggcca

SEQ ID NO: 2277188 - DNA, 19 bp, Homo sapiens
gatgggcaaggggccagga

SEQ ID NO: 2277189 - DNA, 14 bp, Homo sapiens
gatgggcacaggct

SEQ ID NO: 2277190 - DNA, 15 bp, Homo sapiens
gatgggcacaggctg

SEQ ID NO: 2277191 - DNA, 15 bp, Homo sapiens
gatgggtgtcccctg

SEQ ID NO: 2277192 - DNA, 16 bp, Homo sapiens
gatggtaatcttttct

SEQ ID NO: 2277193 - DNA, 14 bp, Homo sapiens
gatggtgcaatgac

SEQ ID NO: 2277194 - DNA, 17 bp, Homo sapiens
gatggtgcaatgacctt

SEQ ID NO: 2277195 - DNA, 20 bp, Homo sapiens
gatggtgcaatgacctttca

SEQ ID NO: 2277196 - DNA, 14 bp, Homo sapiens
gatgtaagaagccc

SEQ ID NO: 2277197 - DNA, 22 bp, Homo sapiens
gatgtggttattttctccatgt

SEQ ID NO: 2277198 - DNA, 20 bp, Homo sapiens
gatgtgtggctcattctttt

SEQ ID NO: 2277199 - DNA, 14 bp, Homo sapiens
gatgttagtgtttt

SEQ ID NO: 2277200 - DNA, 15 bp, Homo sapiens
gatgttcacctcctg

SEQ ID NO: 2277201 - DNA, 23 bp, Homo sapiens
gatgttttagagataaatattta

SEQ ID NO: 2277202 - DNA, 22 bp, Homo sapiens
gattaaatttaatatactgcat

SEQ ID NO: 2277203 - DNA, 19 bp, Homo sapiens
gattaatctctaaaattct

SEQ ID NO: 2277204 - DNA, 20 bp, Homo sapiens
gattattgaatgttatatca

SEQ ID NO: 2277205 - DNA, 13 bp, Homo sapiens
gattcaatgtgaa

SEQ ID NO: 2277206 - DNA, 15 bp, Homo sapiens
gattcagtcttgcct

SEQ ID NO: 2277207 - DNA, 17 bp, Homo sapiens
gattccaagggcccaga

SEQ ID NO: 2277208 - DNA, 20 bp, Homo sapiens
gattccagaacgccctgtgt

SEQ ID NO: 2277209 - DNA, 20 bp, Homo sapiens
gattccccggagctgggaag

SEQ ID NO: 2277210 - DNA, 18 bp, Homo sapiens
gattctatgcctgtattt

SEQ ID NO: 2277211 - DNA, 18 bp, Homo sapiens
gattcttttttcaatgta

SEQ ID NO: 2277212 - DNA, 12 bp, Homo sapiens
gattgaaaagaa

SEQ ID NO: 2277213 - DNA, 12 bp, Homo sapiens
gattgaaattta

SEQ ID NO: 2277214 - DNA, 20 bp, Homo sapiens
gattgtacatatggaaatcc

SEQ ID NO: 2277215 - DNA, 13 bp, Homo sapiens
gattgtctgctgc

SEQ ID NO: 2277216 - DNA, 13 bp, Homo sapiens
gatttcaaatgca

SEQ ID NO: 2277217 - DNA, 14 bp, Homo sapiens
gatttcaatgattg

SEQ ID NO: 2277218 - DNA, 11 bp, Homo sapiens
gatttcactct

SEQ ID NO: 2277219 - DNA, 13 bp, Homo sapiens
gatttcagatgta

SEQ ID NO: 2277220 - DNA, 15 bp, Homo sapiens
gatttccctaaaaat

SEQ ID NO: 2277221 - DNA, 17 bp, Homo sapiens
gatttgcaaatgcacat

SEQ ID NO: 2277222 - DNA, 21 bp, Homo sapiens
gatttgcaaatgcacatttgt

SEQ ID NO: 2277223 - DNA, 22 bp, Homo sapiens
gatttgcacacattggccgctt

SEQ ID NO: 2277224 - DNA, 22 bp, Homo sapiens
gcctagaacaagccagagccgc

SEQ ID NO: 2277225 - DNA, 21 bp, Homo sapiens
gcctagtggcttcagcccctg

SEQ ID NO: 2277226 - DNA, 23 bp, Homo sapiens
gcctagtggcttcagcccctggg

SEQ ID NO: 2277227 - DNA, 23 bp, Homo sapiens
gcctcaagcgatcctccttcctc

SEQ ID NO: 2277228 - DNA, 18 bp, Homo sapiens
gcctcaaggaagagccag

SEQ ID NO: 2277229 - DNA, 20 bp, Homo sapiens
gcctcaaggaagagccagcc

SEQ ID NO: 2277230 - DNA, 17 bp, Homo sapiens
gcctcagagtcctgccg

SEQ ID NO: 2277231 - DNA, 18 bp, Homo sapiens
gcctcaggctttttccat

SEQ ID NO: 2277232 - DNA, 23 bp, Homo sapiens
gcctccatccacacacagcagct

SEQ ID NO: 2277233 - DNA, 12 bp, Homo sapiens
gcctcccccagg

SEQ ID NO: 2277234 - DNA, 13 bp, Homo sapiens
gcctcccccaggc

SEQ ID NO: 2277235 - DNA, 16 bp, Homo sapiens
gcctcccccaggctgc

SEQ ID NO: 2277236 - DNA, 19 bp, Homo sapiens
gcctcccccaggctgcgcc

SEQ ID NO: 2277237 - DNA, 15 bp, Homo sapiens
gcctcctccagactc

SEQ ID NO: 2277238 - DNA, 16 bp, Homo sapiens
gcctcctccagctcct

SEQ ID NO: 2277239 - DNA, 18 bp, Homo sapiens
gcctcctccagctcctgc

SEQ ID NO: 2277240 - DNA, 12 bp, Homo sapiens
gcctcctccctg

SEQ ID NO: 2277241 - DNA, 15 bp, Homo sapiens
gcctcctccctgcct

SEQ ID NO: 2277242 - DNA, 16 bp, Homo sapiens
gcctcctccctgcctg

SEQ ID NO: 2277243 - DNA, 21 bp, Homo sapiens
gcctcctgagtagctgggact

SEQ ID NO: 2277244 - DNA, 16 bp, Homo sapiens
gcctcctgctgagtgg

SEQ ID NO: 2277245 - DNA, 14 bp, Homo sapiens
gcctcgggccgcct

SEQ ID NO: 2277246 - DNA, 21 bp, Homo sapiens
gcctcgggccgcctcctccag

SEQ ID NO: 2277247 - DNA, 22 bp, Homo sapiens
gcctcgggccgcctcctccaga

SEQ ID NO: 2277248 - DNA, 18 bp, Homo sapiens
gcctcgtctttcagcgag

SEQ ID NO: 2277249 - DNA, 15 bp, Homo sapiens
gcctctgaaaatatt

SEQ ID NO: 2277250 - DNA, 19 bp, Homo sapiens
gcctctgaactgctgctgg

SEQ ID NO: 2277251 - DNA, 15 bp, Homo sapiens
gcctctggggagacc

SEQ ID NO: 2277252 - DNA, 23 bp, Homo sapiens
gcctctggggagaccgagtgtgg

SEQ ID NO: 2277253 - DNA, 18 bp, Homo sapiens
gcctctgtcttaaagaat

SEQ ID NO: 2277254 - DNA, 22 bp, Homo sapiens
gcctcttcctccccatgtcacc

SEQ ID NO: 2277255 - DNA, 18 bp, Homo sapiens
gcctgaaatgtttccagg

SEQ ID NO: 2277256 - DNA, 20 bp, Homo sapiens
gcctgaaatgtttccaggca

SEQ ID NO: 2277257 - DNA, 21 bp, Homo sapiens
gcctgaaatgtttccaggcat

SEQ ID NO: 2277258 - DNA, 12 bp, Homo sapiens
gcctgagccaca

SEQ ID NO: 2277259 - DNA, 17 bp, Homo sapiens
gcctgagccacagtggg

SEQ ID NO: 2277260 - DNA, 15 bp, Homo sapiens
gcctgagctccaccc

SEQ ID NO: 2277261 - DNA, 20 bp, Homo sapiens
gcctgagctccaccctcccc

SEQ ID NO: 2277262 - DNA, 21 bp, Homo sapiens
gcctgagctccaccctcccct

SEQ ID NO: 2277263 - DNA, 14 bp, Homo sapiens
gcctgagggaagcc

SEQ ID NO: 2277264 - DNA, 16 bp, Homo sapiens
gcctgagggaagccca

SEQ ID NO: 2277265 - DNA, 19 bp, Homo sapiens
gcctgagggaagcccaccc

SEQ ID NO: 2277266 - DNA, 20 bp, Homo sapiens
gcctgagggaagcccacccg

SEQ ID NO: 2277267 - DNA, 21 bp, Homo sapiens
gcctgagggaagcccacccgc

SEQ ID NO: 2277268 - DNA, 17 bp, Homo sapiens
gcctgaggtccgatggc

SEQ ID NO: 2277269 - DNA, 13 bp, Homo sapiens
gcctgcccccagc

SEQ ID NO: 2277270 - DNA, 14 bp, Homo sapiens
gcctgcctggaaga

SEQ ID NO: 2277271 - DNA, 15 bp, Homo sapiens
gcctgcgctcctctg

SEQ ID NO: 2277272 - DNA, 16 bp, Homo sapiens
gcctgcgctcctctgc

SEQ ID NO: 2277273 - DNA, 20 bp, Homo sapiens
gcctgcgctcctctgcagcc

SEQ ID NO: 2277274 - DNA, 21 bp, Homo sapiens
gcctgcgctcctctgcagcct

SEQ ID NO: 2277275 - DNA, 15 bp, Homo sapiens
gcctgcgtggcctgg

SEQ ID NO: 2277276 - DNA, 16 bp, Homo sapiens
gcctgcgtggcctggg

SEQ ID NO: 2277277 - DNA, 23 bp, Homo sapiens
gcctgcgtggcctggggctgccg

SEQ ID NO: 2277278 - DNA, 13 bp, Homo sapiens
gcctgcttctgcc

SEQ ID NO: 2277279 - DNA, 16 bp, Homo sapiens
gcctggcggcaggggt

SEQ ID NO: 2277280 - DNA, 21 bp, Homo sapiens
gcctggcgggcagcccctgct

SEQ ID NO: 2277281 - DNA, 12 bp, Homo sapiens
gcctggctctgg

SEQ ID NO: 2277282 - DNA, 13 bp, Homo sapiens
gcctggctctgga

SEQ ID NO: 2277283 - DNA, 22 bp, Homo sapiens
gcctgggcaacaagagcaaaac

SEQ ID NO: 2277284 - DNA, 15 bp, Homo sapiens
gcctggggctgccgt

SEQ ID NO: 2277285 - DNA, 19 bp, Homo sapiens
gcctgtgaccggggtcctg

SEQ ID NO: 2277286 - DNA, 23 bp, Homo sapiens
gcctgtgaccggggtcctgaggc

SEQ ID NO: 2277287 - DNA, 13 bp, Homo sapiens
gcctgtgagtgac

SEQ ID NO: 2277288 - DNA, 21 bp, Homo sapiens
gcctgtttggggaggggggcg

SEQ ID NO: 2277289 - DNA, 15 bp, Homo sapiens
gccttacacaatggt

SEQ ID NO: 2277290 - DNA, 20 bp, Homo sapiens
gccttacacaatggttttct

SEQ ID NO: 2277291 - DNA, 16 bp, Homo sapiens
gccttatggaacactc

SEQ ID NO: 2277292 - DNA, 19 bp, Homo sapiens
gccttatggaacactctga

SEQ ID NO: 2277293 - DNA, 21 bp, Homo sapiens
gccttccaggcgtagggccag

SEQ ID NO: 2277294 - DNA, 15 bp, Homo sapiens
gccttctacctgcag

SEQ ID NO: 2277295 - DNA, 18 bp, Homo sapiens
gcctttagcgtgtaaatg

SEQ ID NO: 2277296 - DNA, 17 bp, Homo sapiens
gcctttcttttctttct

SEQ ID NO: 2277297 - DNA, 12 bp, Homo sapiens
gccttttcctga

SEQ ID NO: 2277298 - DNA, 21 bp, Homo sapiens
gcgacaatgcaaaccatcatt

SEQ ID NO: 2277299 - DNA, 15 bp, Homo sapiens
gcgatgatgggctgg

SEQ ID NO: 2277300 - DNA, 15 bp, Homo sapiens
gcgcaaagggcgggc

SEQ ID NO: 2277301 - DNA, 12 bp, Homo sapiens
gcgcacccggca

SEQ ID NO: 2277302 - DNA, 15 bp, Homo sapiens
gcgcaccgccatgca

SEQ ID NO: 2277303 - DNA, 16 bp, Homo sapiens
gcgcaccgccatgcat

SEQ ID NO: 2277304 - DNA, 19 bp, Homo sapiens
gcgcaccgccatgcatgat

SEQ ID NO: 2277305 - DNA, 23 bp, Homo sapiens
gcgcaccgcccaacccccacctc

SEQ ID NO: 2277306 - DNA, 14 bp, Homo sapiens
gcgccacccgcccg

SEQ ID NO: 2277307 - DNA, 17 bp, Homo sapiens
gcgccggcgccccggac

SEQ ID NO: 2277308 - DNA, 21 bp, Homo sapiens
gcgccggcgccccggacgccg

SEQ ID NO: 2277309 - DNA, 11 bp, Homo sapiens
gcgcctgcccg

SEQ ID NO: 2277310 - DNA, 18 bp, Homo sapiens
gcgcctgcgctcctctgc

SEQ ID NO: 2277311 - DNA, 17 bp, Homo sapiens
gcgccttctacctgcag

SEQ ID NO: 2277312 - DNA, 19 bp, Homo sapiens
gcgccttctacctgcagga

SEQ ID NO: 2277313 - DNA, 20 bp, Homo sapiens
gcgccttctacctgcaggac

SEQ ID NO: 2277314 - DNA, 17 bp, Homo sapiens
gcgcgcaccgcccaacc

SEQ ID NO: 2277315 - DNA, 13 bp, Homo sapiens
gcgcgtgccccca

SEQ ID NO: 2277316 - DNA, 14 bp, Homo sapiens
gcgcgtgccttccc

SEQ ID NO: 2277317 - DNA, 20 bp, Homo sapiens
gcgctccggcagaggcaggg

SEQ ID NO: 2277318 - DNA, 21 bp, Homo sapiens
gcgctccggcagaggcagggc

SEQ ID NO: 2277319 - DNA, 22 bp, Homo sapiens
gcgctccggcagaggcagggcc

SEQ ID NO: 2277320 - DNA, 12 bp, Homo sapiens
gcgctcctctgc

SEQ ID NO: 2277321 - DNA, 21 bp, Homo sapiens
gcgctcctctgcagcctgagc

SEQ ID NO: 2277322 - DNA, 23 bp, Homo sapiens
gcgctcctctgcagcctgagctc

SEQ ID NO: 2277323 - DNA, 18 bp, Homo sapiens
gcgctctgcccctccgtc

SEQ ID NO: 2277324 - DNA, 15 bp, Homo sapiens
gcgctgcccccacag

SEQ ID NO: 2277325 - DNA, 16 bp, Homo sapiens
gcgctgcccccacaga

SEQ ID NO: 2277326 - DNA, 18 bp, Homo sapiens
gcggaccggagcggctga

SEQ ID NO: 2277327 - DNA, 20 bp, Homo sapiens
gcggaccggagcggctgagg

SEQ ID NO: 2277328 - DNA, 13 bp, Homo sapiens
gcggagaggaccc

SEQ ID NO: 2277329 - DNA, 21 bp, Homo sapiens
gcggaggggcttggagcagag

SEQ ID NO: 2277330 - DNA, 15 bp, Homo sapiens
gcggcaccgcccacc

SEQ ID NO: 2277331 - DNA, 16 bp, Homo sapiens
gcggcaccgcccaccc

SEQ ID NO: 2277332 - DNA, 17 bp, Homo sapiens
gcggccatccccgtgtt

SEQ ID NO: 2277333 - DNA, 17 bp, Homo sapiens
gcggccggcctggggcc

SEQ ID NO: 2277334 - DNA, 19 bp, Homo sapiens
gcggccggcctggggccgg

SEQ ID NO: 2277335 - DNA, 12 bp, Homo sapiens
gcggctctggga

SEQ ID NO: 2277336 - DNA, 18 bp, Homo sapiens
gcgggaaccctctggggc

SEQ ID NO: 2277337 - DNA, 20 bp, Homo sapiens
gcgggaaccctctggggccc

SEQ ID NO: 2277338 - DNA, 22 bp, Homo sapiens
gcgggaaccctctggggccctt

SEQ ID NO: 2277339 - DNA, 16 bp, Homo sapiens
gcgggcagcccctgct

SEQ ID NO: 2277340 - DNA, 21 bp, Homo sapiens
gcgggcctgtttggtgaggac

SEQ ID NO: 2277341 - DNA, 14 bp, Homo sapiens
gcgggcgcgggaca

SEQ ID NO: 2277342 - DNA, 22 bp, Homo sapiens
gcggggctgtgcgggcgcccgg

SEQ ID NO: 2277343 - DNA, 22 bp, Homo sapiens
gcgggggctaactggccccagg

SEQ ID NO: 2277344 - DNA, 14 bp, Homo sapiens
gcggtatccagagg

SEQ ID NO: 2277345 - DNA, 17 bp, Homo sapiens
gcggtgaggtgggggca

SEQ ID NO: 2277346 - DNA, 23 bp, Homo sapiens
gcgtctgctgttgattccactga

SEQ ID NO: 2277347 - DNA, 14 bp, Homo sapiens
gcgtcttgtatttt

SEQ ID NO: 2277348 - DNA, 18 bp, Homo sapiens
gcgtgaccggcccgccac

SEQ ID NO: 2277349 - DNA, 14 bp, Homo sapiens
gcgtgggggtggcc

SEQ ID NO: 2277350 - DNA, 15 bp, Homo sapiens
gcgttaagggcagag

SEQ ID NO: 2277351 - DNA, 18 bp, Homo sapiens
gctaacaaactgaaaaat

SEQ ID NO: 2277352 - DNA, 14 bp, Homo sapiens
gctaacctcaattt

SEQ ID NO: 2277353 - DNA, 18 bp, Homo sapiens
gctaatctcttctaggat

SEQ ID NO: 2277354 - DNA, 13 bp, Homo sapiens
gctaatgtaatca

SEQ ID NO: 2277355 - DNA, 13 bp, Homo sapiens
gctacataaattg

SEQ ID NO: 2277356 - DNA, 18 bp, Homo sapiens
ggcccatggccccagctg

SEQ ID NO: 2277357 - DNA, 14 bp, Homo sapiens
ggcccattcagcct

SEQ ID NO: 2277358 - DNA, 19 bp, Homo sapiens
ggccccagaaagcctcaga

SEQ ID NO: 2277359 - DNA, 19 bp, Homo sapiens
ggccccagctggctgggtc

SEQ ID NO: 2277360 - DNA, 13 bp, Homo sapiens
ggccccgcacccc

SEQ ID NO: 2277361 - DNA, 15 bp, Homo sapiens
ggccccgcacccctc

SEQ ID NO: 2277362 - DNA, 13 bp, Homo sapiens
ggccccgcctcaa

SEQ ID NO: 2277363 - DNA, 22 bp, Homo sapiens
ggccccgcgcgtgcccccagcg

SEQ ID NO: 2277364 - DNA, 16 bp, Homo sapiens
ggcccgagagctggga

SEQ ID NO: 2277365 - DNA, 22 bp, Homo sapiens
ggcccgagagctgggactcagt

SEQ ID NO: 2277366 - DNA, 14 bp, Homo sapiens
ggcccgccaccttg

SEQ ID NO: 2277367 - DNA, 15 bp, Homo sapiens
ggcccgccccaggcc

SEQ ID NO: 2277368 - DNA, 18 bp, Homo sapiens
ggcccgctcaacctctca

SEQ ID NO: 2277369 - DNA, 20 bp, Homo sapiens
ggcccgctcaacctctcaga

SEQ ID NO: 2277370 - DNA, 14 bp, Homo sapiens
ggcccggcccacgc

SEQ ID NO: 2277371 - DNA, 15 bp, Homo sapiens
ggcccggcccacgca

SEQ ID NO: 2277372 - DNA, 17 bp, Homo sapiens
ggcccggcccacgcaga

SEQ ID NO: 2277373 - DNA, 14 bp, Homo sapiens
ggcccgtgcgcagc

SEQ ID NO: 2277374 - DNA, 22 bp, Homo sapiens
ggccctggttcccccaggaccc

SEQ ID NO: 2277375 - DNA, 18 bp, Homo sapiens
ggccctgtggctccagga

SEQ ID NO: 2277376 - DNA, 15 bp, Homo sapiens
ggccgacaggaggcc

SEQ ID NO: 2277377 - DNA, 14 bp, Homo sapiens
ggccgagggaaatg

SEQ ID NO: 2277378 - DNA, 17 bp, Homo sapiens
ggccgagggaaatgctg

SEQ ID NO: 2277379 - DNA, 12 bp, Homo sapiens
ggccggctggcc

SEQ ID NO: 2277380 - DNA, 22 bp, Homo sapiens
ggccggctggccggtccacccc

SEQ ID NO: 2277381 - DNA, 21 bp, Homo sapiens
ggccgggctggcttctccctg

SEQ ID NO: 2277382 - DNA, 21 bp, Homo sapiens
ggcctagtggcttcagcccct

SEQ ID NO: 2277383 - DNA, 13 bp, Homo sapiens
ggcctcaggaggc

SEQ ID NO: 2277384 - DNA, 21 bp, Homo sapiens
ggcctcccgtccgtccgcccg

SEQ ID NO: 2277385 - DNA, 16 bp, Homo sapiens
ggcctctccttttctc

SEQ ID NO: 2277386 - DNA, 11 bp, Homo sapiens
ggcctctggac

SEQ ID NO: 2277387 - DNA, 20 bp, Homo sapiens
ggcctgagggaagcccaccc

SEQ ID NO: 2277388 - DNA, 12 bp, Homo sapiens
ggcctgcagccc

SEQ ID NO: 2277389 - DNA, 13 bp, Homo sapiens
ggcctgcagccca

SEQ ID NO: 2277390 - DNA, 15 bp, Homo sapiens
ggcctgcagcccaga

SEQ ID NO: 2277391 - DNA, 17 bp, Homo sapiens
ggcctgctagcggctga

SEQ ID NO: 2277392 - DNA, 15 bp, Homo sapiens
ggcctggctctggag

SEQ ID NO: 2277393 - DNA, 17 bp, Homo sapiens
ggcctggctctggagcc

SEQ ID NO: 2277394 - DNA, 18 bp, Homo sapiens
ggcctggctctggagccc

SEQ ID NO: 2277395 - DNA, 14 bp, Homo sapiens
ggcctgttccctga

SEQ ID NO: 2277396 - DNA, 20 bp, Homo sapiens
ggcctgttccctgaggacct

SEQ ID NO: 2277397 - DNA, 17 bp, Homo sapiens
ggcctgtttggtgagga

SEQ ID NO: 2277398 - DNA, 19 bp, Homo sapiens
ggcctgtttggtgaggacc

SEQ ID NO: 2277399 - DNA, 22 bp, Homo sapiens
ggcgagacctgatttctcctgc

SEQ ID NO: 2277400 - DNA, 18 bp, Homo sapiens
ggcgcacccggcagcccc

SEQ ID NO: 2277401 - DNA, 19 bp, Homo sapiens
ggcgcacccggcagccccc

SEQ ID NO: 2277402 - DNA, 13 bp, Homo sapiens
ggcgcccacctgc

SEQ ID NO: 2277403 - DNA, 14 bp, Homo sapiens
ggcgcccacctgcc

SEQ ID NO: 2277404 - DNA, 17 bp, Homo sapiens
ggcgcccacctgcccag

SEQ ID NO: 2277405 - DNA, 15 bp, Homo sapiens
ggcgccccggacgcc

SEQ ID NO: 2277406 - DNA, 16 bp, Homo sapiens
ggcgcccggactgacc

SEQ ID NO: 2277407 - DNA, 14 bp, Homo sapiens
ggcgcctgcgctcc

SEQ ID NO: 2277408 - DNA, 18 bp, Homo sapiens
ggcgcctgcgctcctctg

SEQ ID NO: 2277409 - DNA, 24 bp, Homo sapiens
ggcgcctgcgctcctctgcagcct

SEQ ID NO: 2277410 - DNA, 17 bp, Homo sapiens
ggcgctccggcagaggc

SEQ ID NO: 2277411 - DNA, 20 bp, Homo sapiens
ggcgctggaagaacccttct

SEQ ID NO: 2277412 - DNA, 15 bp, Homo sapiens
ggcgggaaccctctg

SEQ ID NO: 2277413 - DNA, 19 bp, Homo sapiens
ggcgggaaccctctggggc

SEQ ID NO: 2277414 - DNA, 13 bp, Homo sapiens
ggcgggcagcccc

SEQ ID NO: 2277415 - DNA, 23 bp, Homo sapiens
ggcgggcagcccctgctggacca

SEQ ID NO: 2277416 - DNA, 19 bp, Homo sapiens
ggcgtagggccagggctct

SEQ ID NO: 2277417 - DNA, 14 bp, Homo sapiens
ggcgtgtcccctgc

SEQ ID NO: 2277418 - DNA, 14 bp, Homo sapiens
ggctaacgggcgcc

SEQ ID NO: 2277419 - DNA, 13 bp, Homo sapiens
ggctaactggccc

SEQ ID NO: 2277420 - DNA, 14 bp, Homo sapiens
ggctaactggcccc

SEQ ID NO: 2277421 - DNA, 15 bp, Homo sapiens
ggctaagtccagctc

SEQ ID NO: 2277422 - DNA, 21 bp, Homo sapiens
ggctaccagaagaggggcagc

SEQ ID NO: 2277423 - DNA, 18 bp, Homo sapiens
ggctccccaagacttgac

SEQ ID NO: 2277424 - DNA, 13 bp, Homo sapiens
ggctcgcaccccc

SEQ ID NO: 2277425 - DNA, 18 bp, Homo sapiens
ggctcgggtgcccaggac

SEQ ID NO: 2277426 - DNA, 17 bp, Homo sapiens
ggctctatctgctgggc

SEQ ID NO: 2277427 - DNA, 19 bp, Homo sapiens
ggctctgcatacacatgca

SEQ ID NO: 2277428 - DNA, 20 bp, Homo sapiens
ggctctggcaggtggccagg

SEQ ID NO: 2277429 - DNA, 17 bp, Homo sapiens
ggctgaccaggccctgc

SEQ ID NO: 2277430 - DNA, 13 bp, Homo sapiens
ggctgagcccctc

SEQ ID NO: 2277431 - DNA, 18 bp, Homo sapiens
ggctgagcccctcctctc

SEQ ID NO: 2277432 - DNA, 17 bp, Homo sapiens
ggctgaggacggggcag

SEQ ID NO: 2277433 - DNA, 19 bp, Homo sapiens
ggctgaggacggggcagag

SEQ ID NO: 2277434 - DNA, 13 bp, Homo sapiens
ggctgcagtcctc

SEQ ID NO: 2277435 - DNA, 22 bp, Homo sapiens
ggctgcagtcctccggttgcat

SEQ ID NO: 2277436 - DNA, 17 bp, Homo sapiens
ggctgccccacccctcc

SEQ ID NO: 2277437 - DNA, 15 bp, Homo sapiens
ggctgcgcctgcccg

SEQ ID NO: 2277438 - DNA, 19 bp, Homo sapiens
ggctgcgcctgcccgcccg

SEQ ID NO: 2277439 - DNA, 22 bp, Homo sapiens
ggctgctaagtggaagacagag

SEQ ID NO: 2277440 - DNA, 11 bp, Homo sapiens
ggctgcttcaa

SEQ ID NO: 2277441 - DNA, 15 bp, Homo sapiens
ggctgcttcaaggat

SEQ ID NO: 2277442 - DNA, 19 bp, Homo sapiens
ggctgcttcaaggatcctg

SEQ ID NO: 2277443 - DNA, 21 bp, Homo sapiens
ggctgcttcaaggatcctgag

SEQ ID NO: 2277444 - DNA, 15 bp, Homo sapiens
ggctggagggctggg

SEQ ID NO: 2277445 - DNA, 22 bp, Homo sapiens
ggctggagggctgggcagggcc

SEQ ID NO: 2277446 - DNA, 11 bp, Homo sapiens
ggctggccctg

SEQ ID NO: 2277447 - DNA, 22 bp, Homo sapiens
ggctggccctgccctcccccac

SEQ ID NO: 2277448 - DNA, 13 bp, Homo sapiens
ggctggcctgaca

SEQ ID NO: 2277449 - DNA, 20 bp, Homo sapiens
ggctggcggccatccccgtg

SEQ ID NO: 2277450 - DNA, 21 bp, Homo sapiens
ggctggcttctccctggactc

SEQ ID NO: 2277451 - DNA, 15 bp, Homo sapiens
ggctgggcagggccc

SEQ ID NO: 2277452 - DNA, 19 bp, Homo sapiens
ggctgggcagggccgcagg

SEQ ID NO: 2277453 - DNA, 22 bp, Homo sapiens
ggctggggcttttgtgccagga

SEQ ID NO: 2277454 - DNA, 17 bp, Homo sapiens
ggctgtatttttagaga

SEQ ID NO: 2277455 - DNA, 15 bp, Homo sapiens
ggctgtcaattacag

SEQ ID NO: 2277456 - DNA, 16 bp, Homo sapiens
ggcttagtaatagatc

SEQ ID NO: 2277457 - DNA, 15 bp, Homo sapiens
ggcttatgaaagagg

SEQ ID NO: 2277458 - DNA, 14 bp, Homo sapiens
ggcttcagcccctg

SEQ ID NO: 2277459 - DNA, 13 bp, Homo sapiens
ggcttccagctca

SEQ ID NO: 2277460 - DNA, 23 bp, Homo sapiens
ggcttccagctcagtcccacagc

SEQ ID NO: 2277461 - DNA, 19 bp, Homo sapiens
ggcttcccacagcctcttc

SEQ ID NO: 2277462 - DNA, 14 bp, Homo sapiens
ggcttcgtctcaga

SEQ ID NO: 2277463 - DNA, 21 bp, Homo sapiens
ggcttctctgccctgccctgg

SEQ ID NO: 2277464 - DNA, 18 bp, Homo sapiens
ggcttggctcgcaccccc

SEQ ID NO: 2277465 - DNA, 19 bp, Homo sapiens
ggctttctgggtgtgactg

SEQ ID NO: 2277466 - DNA, 17 bp, Homo sapiens
ggcttttgtgccaggag

SEQ ID NO: 2277467 - DNA, 16 bp, Homo sapiens
gggaaaacataatatc

SEQ ID NO: 2277468 - DNA, 12 bp, Homo sapiens
gggaaagggaga

SEQ ID NO: 2277469 - DNA, 16 bp, Homo sapiens
gggaagagagaggcct

SEQ ID NO: 2277470 - DNA, 17 bp, Homo sapiens
gggaagagagaggcctg

SEQ ID NO: 2277471 - DNA, 13 bp, Homo sapiens
gggaagcccaccc

SEQ ID NO: 2277472 - DNA, 18 bp, Homo sapiens
gggaagcccacccgcccc

SEQ ID NO: 2277473 - DNA, 12 bp, Homo sapiens
gggaaggcctga

SEQ ID NO: 2277474 - DNA, 12 bp, Homo sapiens
gggacacagaga

SEQ ID NO: 2277475 - DNA, 20 bp, Homo sapiens
gggacacggcctctggggag

SEQ ID NO: 2277476 - DNA, 22 bp, Homo sapiens
gggacacggcctctggggagac

SEQ ID NO: 2277477 - DNA, 14 bp, Homo sapiens
gggacagattcagt

SEQ ID NO: 2277478 - DNA, 12 bp, Homo sapiens
gggacagcggcc

SEQ ID NO: 2277479 - DNA, 15 bp, Homo sapiens
gggacagcggcccgg

SEQ ID NO: 2277480 - DNA, 16 bp, Homo sapiens
gggacagcggcccggc

SEQ ID NO: 2277481 - DNA, 18 bp, Homo sapiens
gggacagcggcccggccc

SEQ ID NO: 2277482 - DNA, 20 bp, Homo sapiens
gggacaggaacacccagccc

SEQ ID NO: 2277483 - DNA, 17 bp, Homo sapiens
gggacaggattgtctgc

SEQ ID NO: 2277484 - DNA, 21 bp, Homo sapiens
gggaccctcggggcaggaagt

SEQ ID NO: 2277485 - DNA, 20 bp, Homo sapiens
gggacgcggccggcggcctc

SEQ ID NO: 2277486 - DNA, 14 bp, Homo sapiens
gggactgctcaggc

SEQ ID NO: 2277487 - DNA, 22 bp, Homo sapiens
gggactgtcttcaaccctgccc

SEQ ID NO: 2277488 - DNA, 23 bp, Homo sapiens
gggacttcgggggcggctctggg

SEQ ID NO: 2277489 - DNA, 23 bp, Homo sapiens
gtgagatttgtatttatattaga

SEQ ID NO: 2277490 - DNA, 18 bp, Homo sapiens
gtgagccaaagcttatgt

SEQ ID NO: 2277491 - DNA, 17 bp, Homo sapiens
gtgaggacctgcggcct

SEQ ID NO: 2277492 - DNA, 18 bp, Homo sapiens
gtgaggacctgcggcctt

SEQ ID NO: 2277493 - DNA, 19 bp, Homo sapiens
gtgaggacctgcggccttg

SEQ ID NO: 2277494 - DNA, 15 bp, Homo sapiens
gtgaggcccccggag

SEQ ID NO: 2277495 - DNA, 23 bp, Homo sapiens
gtgaggtcatcccggggccatgg

SEQ ID NO: 2277496 - DNA, 17 bp, Homo sapiens
gtgagtcctggcatggg

SEQ ID NO: 2277497 - DNA, 12 bp, Homo sapiens
gtgatacactgt

SEQ ID NO: 2277498 - DNA, 14 bp, Homo sapiens
gtgatacactgtat

SEQ ID NO: 2277499 - DNA, 19 bp, Homo sapiens
gtgatcagttgctctctgt

SEQ ID NO: 2277500 - DNA, 14 bp, Homo sapiens
gtgatcccagctca

SEQ ID NO: 2277501 - DNA, 15 bp, Homo sapiens
gtgatcccagctcac

SEQ ID NO: 2277502 - DNA, 23 bp, Homo sapiens
gtgatcctcccgccccagcctcc

SEQ ID NO: 2277503 - DNA, 15 bp, Homo sapiens
gtgatctaagcagtt

SEQ ID NO: 2277504 - DNA, 20 bp, Homo sapiens
gtgatgcttgatataataat

SEQ ID NO: 2277505 - DNA, 14 bp, Homo sapiens
gtgatgggcaaggg

SEQ ID NO: 2277506 - DNA, 18 bp, Homo sapiens
gtgatgggcaaggggcca

SEQ ID NO: 2277507 - DNA, 13 bp, Homo sapiens
gtgatgttagtgt

SEQ ID NO: 2277508 - DNA, 17 bp, Homo sapiens
gtgcaaaataaaatgag

SEQ ID NO: 2277509 - DNA, 23 bp, Homo sapiens
gtgcaaaataaaatgagttacct

SEQ ID NO: 2277510 - DNA, 23 bp, Homo sapiens
gtgcaagttcatgtgtggaaatg

SEQ ID NO: 2277511 - DNA, 14 bp, Homo sapiens
gtgcacggggccag

SEQ ID NO: 2277512 - DNA, 12 bp, Homo sapiens
gtgcactacagt

SEQ ID NO: 2277513 - DNA, 18 bp, Homo sapiens
gtgcagacactcaagagc

SEQ ID NO: 2277514 - DNA, 19 bp, Homo sapiens
gtgcagacactcaagagcc

SEQ ID NO: 2277515 - DNA, 18 bp, Homo sapiens
gtgcagcaaccagagcac

SEQ ID NO: 2277516 - DNA, 16 bp, Homo sapiens
gtgcaggagcaaggct

SEQ ID NO: 2277517 - DNA, 20 bp, Homo sapiens
gtgcaggcgcgcaccgccca

SEQ ID NO: 2277518 - DNA, 17 bp, Homo sapiens
gtgcataaaagttaaca

SEQ ID NO: 2277519 - DNA, 23 bp, Homo sapiens
gtgcatttgtgagccaaagagaa

SEQ ID NO: 2277520 - DNA, 24 bp, Homo sapiens
gtgccaaatcctgggcatccccag

SEQ ID NO: 2277521 - DNA, 18 bp, Homo sapiens
gtgcccgaggttcctgtc

SEQ ID NO: 2277522 - DNA, 15 bp, Homo sapiens
gtgcgcagccgcgct

SEQ ID NO: 2277523 - DNA, 22 bp, Homo sapiens
gtgcgcagccgcgctctgcccc

SEQ ID NO: 2277524 - DNA, 16 bp, Homo sapiens
gtgcgccggcgccccg

SEQ ID NO: 2277525 - DNA, 18 bp, Homo sapiens
gtgcgccggcgccccgga

SEQ ID NO: 2277526 - DNA, 18 bp, Homo sapiens
gtgcggcccgtgcgcagc

SEQ ID NO: 2277527 - DNA, 14 bp, Homo sapiens
gtgcgggcgcccgg

SEQ ID NO: 2277528 - DNA, 22 bp, Homo sapiens
gtgctcagtattgacgacctac

SEQ ID NO: 2277529 - DNA, 14 bp, Homo sapiens
gtgctccagtgttt

SEQ ID NO: 2277530 - DNA, 20 bp, Homo sapiens
gtgctccagtgttttcttgt

SEQ ID NO: 2277531 - DNA, 14 bp, Homo sapiens
gtgctcctgaaaga

SEQ ID NO: 2277532 - DNA, 17 bp, Homo sapiens
gtgctcttatccccagc

SEQ ID NO: 2277533 - DNA, 21 bp, Homo sapiens
gtgctcttatccccagctgtt

SEQ ID NO: 2277534 - DNA, 22 bp, Homo sapiens
gtgctgggattacaggtgtgag

SEQ ID NO: 2277535 - DNA, 14 bp, Homo sapiens
gtgcttccttttca

SEQ ID NO: 2277536 - DNA, 23 bp, Homo sapiens
gtgcttccttttcagcatggttt

SEQ ID NO: 2277537 - DNA, 17 bp, Homo sapiens
gtgcttttccatctaaa

SEQ ID NO: 2277538 - DNA, 19 bp, Homo sapiens
gtggaacactaaagagcta

SEQ ID NO: 2277539 - DNA, 22 bp, Homo sapiens
gtggaagacagagatggcagag

SEQ ID NO: 2277540 - DNA, 23 bp, Homo sapiens
gtggaagacagagatggcagagc

SEQ ID NO: 2277541 - DNA, 15 bp, Homo sapiens
gtggaatttcttgtt

SEQ ID NO: 2277542 - DNA, 18 bp, Homo sapiens
gtggaatttcttgtttct

SEQ ID NO: 2277543 - DNA, 17 bp, Homo sapiens
gtggactcgcgagaggg

SEQ ID NO: 2277544 - DNA, 19 bp, Homo sapiens
gtggagagaagttgccctc

SEQ ID NO: 2277545 - DNA, 23 bp, Homo sapiens
gtggcatgttgtaacatttcaca

SEQ ID NO: 2277546 - DNA, 12 bp, Homo sapiens
gtggccactcct

SEQ ID NO: 2277547 - DNA, 18 bp, Homo sapiens
gtggctcgggtgcccagg

SEQ ID NO: 2277548 - DNA, 17 bp, Homo sapiens
gtggctgaccaggccct

SEQ ID NO: 2277549 - DNA, 18 bp, Homo sapiens
gtggctgaccaggccctg

SEQ ID NO: 2277550 - DNA, 22 bp, Homo sapiens
gtggctgaccaggccctgctca

SEQ ID NO: 2277551 - DNA, 15 bp, Homo sapiens
gtggctgatttcaaa

SEQ ID NO: 2277552 - DNA, 14 bp, Homo sapiens
gtggctgcttcaag

SEQ ID NO: 2277553 - DNA, 15 bp, Homo sapiens
gtggctgcttcaagg

SEQ ID NO: 2277554 - DNA, 23 bp, Homo sapiens
gtggctgcttcaaggatcctgag

SEQ ID NO: 2277555 - DNA, 23 bp, Homo sapiens
gtggcttcagcccctggggtact

SEQ ID NO: 2277556 - DNA, 18 bp, Homo sapiens
gtggctttcatttcttat

SEQ ID NO: 2277557 - DNA, 17 bp, Homo sapiens
gtgggagggggcagggg

SEQ ID NO: 2277558 - DNA, 14 bp, Homo sapiens
gtgggccccacagt

SEQ ID NO: 2277559 - DNA, 20 bp, Homo sapiens
gtgggccctggaggggccca

SEQ ID NO: 2277560 - DNA, 16 bp, Homo sapiens
gtggggagggcctctg

SEQ ID NO: 2277561 - DNA, 18 bp, Homo sapiens
gtggggcccatggcccca

SEQ ID NO: 2277562 - DNA, 18 bp, Homo sapiens
gtgggggtggccactcct

SEQ ID NO: 2277563 - DNA, 23 bp, Homo sapiens
gtgggtcgcccacgggtgtggct

SEQ ID NO: 2277564 - DNA, 23 bp, Homo sapiens
gtggtcacaggattctcttctca

SEQ ID NO: 2277565 - DNA, 18 bp, Homo sapiens
gtggtcagcgattcctgc

SEQ ID NO: 2277566 - DNA, 14 bp, Homo sapiens
gtggtgtgaggccc

SEQ ID NO: 2277567 - DNA, 16 bp, Homo sapiens
gtggtgtgaggccccc

SEQ ID NO: 2277568 - DNA, 19 bp, Homo sapiens
gtggtgtgaggcccccgga

SEQ ID NO: 2277569 - DNA, 19 bp, Homo sapiens
gtgtaaataagcgtttaat

SEQ ID NO: 2277570 - DNA, 18 bp, Homo sapiens
gtgtaactgttctttgca

SEQ ID NO: 2277571 - DNA, 19 bp, Homo sapiens
gtgtactgtatagacagtt

SEQ ID NO: 2277572 - DNA, 15 bp, Homo sapiens
gtgtagatattatgt

SEQ ID NO: 2277573 - DNA, 12 bp, Homo sapiens
gtgtattctgtg

SEQ ID NO: 2277574 - DNA, 12 bp, Homo sapiens
gtgtcaaagaga

SEQ ID NO: 2277575 - DNA, 13 bp, Homo sapiens
gtgtcatgatttc

SEQ ID NO: 2277576 - DNA, 19 bp, Homo sapiens
gtgtccccaggggcacact

SEQ ID NO: 2277577 - DNA, 16 bp, Homo sapiens
gtgtcccctggtgccc

SEQ ID NO: 2277578 - DNA, 15 bp, Homo sapiens
gtgtcgggcatgaca

SEQ ID NO: 2277579 - DNA, 11 bp, Homo sapiens
gtgtgaatgca

SEQ ID NO: 2277580 - DNA, 14 bp, Homo sapiens
gtgtgagccacagc

SEQ ID NO: 2277581 - DNA, 12 bp, Homo sapiens
gtgtgaggcccc

SEQ ID NO: 2277582 - DNA, 14 bp, Homo sapiens
gtgtgatcccagct

SEQ ID NO: 2277583 - DNA, 19 bp, Homo sapiens
gtgtggagctgcttccagt

SEQ ID NO: 2277584 - DNA, 15 bp, Homo sapiens
gtgtgtttcttgctt

SEQ ID NO: 2277585 - DNA, 15 bp, Homo sapiens
gtgttcgctggctga

SEQ ID NO: 2277586 - DNA, 17 bp, Homo sapiens
gtgttctcaatgctttt

SEQ ID NO: 2277587 - DNA, 19 bp, Homo sapiens
gtgttctcaatgcttttct

SEQ ID NO: 2277588 - DNA, 20 bp, Homo sapiens
gtgttcttaaaatattgtgt

SEQ ID NO: 2277589 - DNA, 13 bp, Homo sapiens
gtgttgaggaggg

SEQ ID NO: 2277590 - DNA, 16 bp, Homo sapiens
gtgttgcccaggctgg

SEQ ID NO: 2277591 - DNA, 22 bp, Homo sapiens
gtgttgtaccatatgtagcatt

SEQ ID NO: 2277592 - DNA, 13 bp, Homo sapiens
gtgttgttttctc

SEQ ID NO: 2277593 - DNA, 13 bp, Homo sapiens
gtgttttgctttg

SEQ ID NO: 2277594 - DNA, 19 bp, Homo sapiens
gtgttttgggtttttaaaa

SEQ ID NO: 2277595 - DNA, 22 bp, Homo sapiens
gttaaaaaccattataaaatct

SEQ ID NO: 2277596 - DNA, 16 bp, Homo sapiens
gttaaagagacaaata

SEQ ID NO: 2277597 - DNA, 18 bp, Homo sapiens
gttaaatgctatggaaat

SEQ ID NO: 2277598 - DNA, 22 bp, Homo sapiens
gttaaatgctatggaaatacat

SEQ ID NO: 2277599 - DNA, 13 bp, Homo sapiens
gttaaatttagtg

SEQ ID NO: 2277600 - DNA, 15 bp, Homo sapiens
gttaacaacttgaat

SEQ ID NO: 2277601 - DNA, 11 bp, Homo sapiens
gttaacatgcg

SEQ ID NO: 2277602 - DNA, 17 bp, Homo sapiens
gttaatgatggcagagg

SEQ ID NO: 2277603 - DNA, 13 bp, Homo sapiens
gttacagacaaag

SEQ ID NO: 2277604 - DNA, 14 bp, Homo sapiens
gttagaatctattt

SEQ ID NO: 2277605 - DNA, 17 bp, Homo sapiens
gttagaatctattttct

SEQ ID NO: 2277606 - DNA, 19 bp, Homo sapiens
gttagaatctattttctat

SEQ ID NO: 2277607 - DNA, 13 bp, Homo sapiens
gttagcccggcca

SEQ ID NO: 2277608 - DNA, 17 bp, Homo sapiens
gttagtaatggcagagc

SEQ ID NO: 2277609 - DNA, 19 bp, Homo sapiens
gttagtaatggcagagcag

SEQ ID NO: 2277610 - DNA, 14 bp, Homo sapiens
gttatatcatcaat

SEQ ID NO: 2277611 - DNA, 18 bp, Homo sapiens
gttcaattggacaattat

SEQ ID NO: 2277612 - DNA, 16 bp, Homo sapiens
gttcacgggtggcctg

SEQ ID NO: 2277613 - DNA, 23 bp, Homo sapiens
gttcatgaaataaagactcttgg

SEQ ID NO: 2277614 - DNA, 23 bp, Homo sapiens
gttcatgtcagcttatatgtgac

SEQ ID NO: 2277615 - DNA, 18 bp, Homo sapiens
gttcattcatactcaaag

SEQ ID NO: 2277616 - DNA, 22 bp, Homo sapiens
gttcattcatactcaaagaggc

SEQ ID NO: 2277617 - DNA, 15 bp, Homo sapiens
gttccacttctctag

SEQ ID NO: 2277618 - DNA, 19 bp, Homo sapiens
gttccacttctctagagaa

SEQ ID NO: 2277619 - DNA, 14 bp, Homo sapiens
gttccattctatga

SEQ ID NO: 2277620 - DNA, 18 bp, Homo sapiens
gttcccccaggaccctga

SEQ ID NO: 2277621 - DNA, 14 bp, Homo sapiens
tagagataaatatt

SEQ ID NO: 2277622 - DNA, 17 bp, Homo sapiens
tagagatatttttatat

SEQ ID NO: 2277623 - DNA, 18 bp, Homo sapiens
tagagatatttttatata

SEQ ID NO: 2277624 - DNA, 14 bp, Homo sapiens
tagagattaatttg

SEQ ID NO: 2277625 - DNA, 15 bp, Homo sapiens
tagagcaaagactta

SEQ ID NO: 2277626 - DNA, 17 bp, Homo sapiens
tagagctaccaattgtt

SEQ ID NO: 2277627 - DNA, 20 bp, Homo sapiens
tagaggacacggaccctgtg

SEQ ID NO: 2277628 - DNA, 17 bp, Homo sapiens
tagaggggcaaaaatat

SEQ ID NO: 2277629 - DNA, 17 bp, Homo sapiens
tagagtatgcaagaaga

SEQ ID NO: 2277630 - DNA, 18 bp, Homo sapiens
tagagtatgcaagaagaa

SEQ ID NO: 2277631 - DNA, 17 bp, Homo sapiens
tagagtttaacagatat

SEQ ID NO: 2277632 - DNA, 14 bp, Homo sapiens
tagataattatcca

SEQ ID NO: 2277633 - DNA, 17 bp, Homo sapiens
tagatatatatttccaa

SEQ ID NO: 2277634 - DNA, 19 bp, Homo sapiens
tagatattcatactttcca

SEQ ID NO: 2277635 - DNA, 17 bp, Homo sapiens
tagattaggtgtaagac

SEQ ID NO: 2277636 - DNA, 23 bp, Homo sapiens
tagatttctagcagtatgtgtgc

SEQ ID NO: 2277637 - DNA, 13 bp, Homo sapiens
tagatttctttga

SEQ ID NO: 2277638 - DNA, 15 bp, Homo sapiens
tagcaaaatattatc

SEQ ID NO: 2277639 - DNA, 20 bp, Homo sapiens
tagcaaaatattatctgaac

SEQ ID NO: 2277640 - DNA, 14 bp, Homo sapiens
tagcaaacaaaaat

SEQ ID NO: 2277641 - DNA, 16 bp, Homo sapiens
tagcaagaagattcta

SEQ ID NO: 2277642 - DNA, 17 bp, Homo sapiens
tagcaagaagattctaa

SEQ ID NO: 2277643 - DNA, 18 bp, Homo sapiens
tagcaagaagattctaaa

SEQ ID NO: 2277644 - DNA, 19 bp, Homo sapiens
tagcaagaagattctaaaa

SEQ ID NO: 2277645 - DNA, 15 bp, Homo sapiens
tagcaatatatttgt

SEQ ID NO: 2277646 - DNA, 13 bp, Homo sapiens
tagcacagctgtg

SEQ ID NO: 2277647 - DNA, 17 bp, Homo sapiens
tagcacagtatttactg

SEQ ID NO: 2277648 - DNA, 13 bp, Homo sapiens
tagcaggaaatag

SEQ ID NO: 2277649 - DNA, 20 bp, Homo sapiens
tagcatctgctcttctctta

SEQ ID NO: 2277650 - DNA, 17 bp, Homo sapiens
tagcattaaatataaaa

SEQ ID NO: 2277651 - DNA, 14 bp, Homo sapiens
tagcattgaaataa

SEQ ID NO: 2277652 - DNA, 15 bp, Homo sapiens
tagcattgaaataat

SEQ ID NO: 2277653 - DNA, 17 bp, Homo sapiens
tagccaacttaaacctg

SEQ ID NO: 2277654 - DNA, 21 bp, Homo sapiens
tagccagaatgtttcctgtgg

SEQ ID NO: 2277655 - DNA, 22 bp, Homo sapiens
tagccagaatgtttcctgtgga

SEQ ID NO: 2277656 - DNA, 13 bp, Homo sapiens
tagccattcattt

SEQ ID NO: 2277657 - DNA, 16 bp, Homo sapiens
tagccattcatttaca

SEQ ID NO: 2277658 - DNA, 22 bp, Homo sapiens
tagcctagaacaagccagagcc

SEQ ID NO: 2277659 - DNA, 20 bp, Homo sapiens
tagcctcgtctttcagcgag

SEQ ID NO: 2277660 - DNA, 15 bp, Homo sapiens
tagctaattagctct

SEQ ID NO: 2277661 - DNA, 20 bp, Homo sapiens
tagctataacaactctattt

SEQ ID NO: 2277662 - DNA, 19 bp, Homo sapiens
tagctctcatgtatttaaa

SEQ ID NO: 2277663 - DNA, 14 bp, Homo sapiens
tagctctgaaggga

SEQ ID NO: 2277664 - DNA, 19 bp, Homo sapiens
tagctctgaagggagggga

SEQ ID NO: 2277665 - DNA, 19 bp, Homo sapiens
tagctgaaacctaaggcaa

SEQ ID NO: 2277666 - DNA, 14 bp, Homo sapiens
taggaaaatacatt

SEQ ID NO: 2277667 - DNA, 15 bp, Homo sapiens
taggaaataaatcta

SEQ ID NO: 2277668 - DNA, 19 bp, Homo sapiens
taggaaataaatctaaata

SEQ ID NO: 2277669 - DNA, 17 bp, Homo sapiens
taggaacagagtatata

SEQ ID NO: 2277670 - DNA, 22 bp, Homo sapiens
taggaacagagtatatatgtac

SEQ ID NO: 2277671 - DNA, 12 bp, Homo sapiens
taggaacccggc

SEQ ID NO: 2277672 - DNA, 22 bp, Homo sapiens
taggaacccggcatgccgagtg

SEQ ID NO: 2277673 - DNA, 15 bp, Homo sapiens
taggataaaccaatc

SEQ ID NO: 2277674 - DNA, 15 bp, Homo sapiens
taggccaatgaaggc

SEQ ID NO: 2277675 - DNA, 21 bp, Homo sapiens
taggctattataatatagaaa

SEQ ID NO: 2277676 - DNA, 22 bp, Homo sapiens
taggctttcatgttgcaaagaa

SEQ ID NO: 2277677 - DNA, 18 bp, Homo sapiens
tagggtccactttggtaa

SEQ ID NO: 2277678 - DNA, 16 bp, Homo sapiens
tagggtttagccgggc

SEQ ID NO: 2277679 - DNA, 15 bp, Homo sapiens
taggtcatttgtaga

SEQ ID NO: 2277680 - DNA, 14 bp, Homo sapiens
taggtgcattgtcc

SEQ ID NO: 2277681 - DNA, 14 bp, Homo sapiens
tagtactgtgtact

SEQ ID NO: 2277682 - DNA, 15 bp, Homo sapiens
tagtcaactgctgtt

SEQ ID NO: 2277683 - DNA, 23 bp, Homo sapiens
tagtcatacgtctttagatgcta

SEQ ID NO: 2277684 - DNA, 21 bp, Homo sapiens
tagtcatgtttctgcagtatt

SEQ ID NO: 2277685 - DNA, 23 bp, Homo sapiens
tagtccaatgaagataaatgctt

SEQ ID NO: 2277686 - DNA, 13 bp, Homo sapiens
tagtctctgattt

SEQ ID NO: 2277687 - DNA, 19 bp, Homo sapiens
tagtctctgatttgcaaat

SEQ ID NO: 2277688 - DNA, 15 bp, Homo sapiens
tagtctgtacttcag

SEQ ID NO: 2277689 - DNA, 14 bp, Homo sapiens
tagtctgtttcatt

SEQ ID NO: 2277690 - DNA, 15 bp, Homo sapiens
tagtctgtttcatta

SEQ ID NO: 2277691 - DNA, 23 bp, Homo sapiens
tagtgaaaaatctagtatttgta

SEQ ID NO: 2277692 - DNA, 13 bp, Homo sapiens
tagtgaatgggaa

SEQ ID NO: 2277693 - DNA, 22 bp, Homo sapiens
tagtgcaagctttaacagacta

SEQ ID NO: 2277694 - DNA, 18 bp, Homo sapiens
tagtggcttcagcccctg

SEQ ID NO: 2277695 - DNA, 13 bp, Homo sapiens
tagtgttgaggag

SEQ ID NO: 2277696 - DNA, 15 bp, Homo sapiens
tagtgttgaggaggg

SEQ ID NO: 2277697 - DNA, 21 bp, Homo sapiens
tagtgttgggtggaggatgga

SEQ ID NO: 2277698 - DNA, 18 bp, Homo sapiens
tagtgttttaagaaatgt

SEQ ID NO: 2277699 - DNA, 19 bp, Homo sapiens
tagttaaattgaagaaagt

SEQ ID NO: 2277700 - DNA, 16 bp, Homo sapiens
tagttagcaggaaata

SEQ ID NO: 2277701 - DNA, 16 bp, Homo sapiens
tagttaggtgtgccaa

SEQ ID NO: 2277702 - DNA, 20 bp, Homo sapiens
tagttaggtgtgccaaacta

SEQ ID NO: 2277703 - DNA, 23 bp, Homo sapiens
tagttgaacaagatttccctaaa

SEQ ID NO: 2277704 - DNA, 14 bp, Homo sapiens
tagttgatgaccaa

SEQ ID NO: 2277705 - DNA, 14 bp, Homo sapiens
tagtttaaaaatat

SEQ ID NO: 2277706 - DNA, 16 bp, Homo sapiens
tagtttaaaaatattc

SEQ ID NO: 2277707 - DNA, 21 bp, Homo sapiens
tagtttcaggcaaggcagctc

SEQ ID NO: 2277708 - DNA, 14 bp, Homo sapiens
tagttttctaaatg

SEQ ID NO: 2277709 - DNA, 13 bp, Homo sapiens
tagttttctcagc

SEQ ID NO: 2277710 - DNA, 15 bp, Homo sapiens
tataaaatacataaa

SEQ ID NO: 2277711 - DNA, 14 bp, Homo sapiens
tataaaatctttcc

SEQ ID NO: 2277712 - DNA, 15 bp, Homo sapiens
tataaaatctttcca

SEQ ID NO: 2277713 - DNA, 16 bp, Homo sapiens
tataaaattatgaaaa

SEQ ID NO: 2277714 - DNA, 15 bp, Homo sapiens
tataaaccataaaat

SEQ ID NO: 2277715 - DNA, 19 bp, Homo sapiens
tataaacgatatatgtaaa

SEQ ID NO: 2277716 - DNA, 20 bp, Homo sapiens
tataaacgatatatgtaaat

SEQ ID NO: 2277717 - DNA, 20 bp, Homo sapiens
tataaataaataaaaatatt

SEQ ID NO: 2277718 - DNA, 15 bp, Homo sapiens
tataaatgtttcatg

SEQ ID NO: 2277719 - DNA, 14 bp, Homo sapiens
tataaattataatg

SEQ ID NO: 2277720 - DNA, 15 bp, Homo sapiens
tataactaacagcat

SEQ ID NO: 2277721 - DNA, 15 bp, Homo sapiens
tataactacattaaa

SEQ ID NO: 2277722 - DNA, 21 bp, Homo sapiens
tataactacattaaaagcttt

SEQ ID NO: 2277723 - DNA, 18 bp, Homo sapiens
tataagagacaaagtttg

SEQ ID NO: 2277724 - DNA, 18 bp, Homo sapiens
tataagggagtaggctgt

SEQ ID NO: 2277725 - DNA, 21 bp, Homo sapiens
tataagggagtaggctgtatt

SEQ ID NO: 2277726 - DNA, 22 bp, Homo sapiens
tataagggagtaggctgtattt

SEQ ID NO: 2277727 - DNA, 14 bp, Homo sapiens
tataatatagaaag

SEQ ID NO: 2277728 - DNA, 16 bp, Homo sapiens
tataatatagaaagaa

SEQ ID NO: 2277729 - DNA, 22 bp, Homo sapiens
tataatgtttccctcaagaaca

SEQ ID NO: 2277730 - DNA, 22 bp, Homo sapiens
tatacaaagctgtcactcacaa

SEQ ID NO: 2277731 - DNA, 14 bp, Homo sapiens
tatacagcatgaga

SEQ ID NO: 2277732 - DNA, 14 bp, Homo sapiens
tatacatacctctc

SEQ ID NO: 2277733 - DNA, 12 bp, Homo sapiens
tatacatctagc

SEQ ID NO: 2277734 - DNA, 18 bp, Homo sapiens
tatacatgtaaaaatgtt

SEQ ID NO: 2277735 - DNA, 14 bp, Homo sapiens
tataccagcagaaa

SEQ ID NO: 2277736 - DNA, 22 bp, Homo sapiens
tataccccgtgaagcatccagg

SEQ ID NO: 2277737 - DNA, 21 bp, Homo sapiens
tatactggttatagttgatat

SEQ ID NO: 2277738 - DNA, 16 bp, Homo sapiens
tatactgtttgtaata

SEQ ID NO: 2277739 - DNA, 21 bp, Homo sapiens
tatagaaaataaaataaatta

SEQ ID NO: 2277740 - DNA, 16 bp, Homo sapiens
tatagacagtttgtaa

SEQ ID NO: 2277741 - DNA, 14 bp, Homo sapiens
tatagctttaacat

SEQ ID NO: 2277742 - DNA, 12 bp, Homo sapiens
tataggaaaata

SEQ ID NO: 2277743 - DNA, 15 bp, Homo sapiens
tatagttgaacaaga

SEQ ID NO: 2277744 - DNA, 15 bp, Homo sapiens
tatagttgatatgta

SEQ ID NO: 2277745 - DNA, 19 bp, Homo sapiens
tatataaacgatatatgta

SEQ ID NO: 2277746 - DNA, 15 bp, Homo sapiens
tatatacatgtatag

SEQ ID NO: 2277747 - DNA, 17 bp, Homo sapiens
tatatacatgtatagtg

SEQ ID NO: 2277748 - DNA, 14 bp, Homo sapiens
tatatatacatgta

SEQ ID NO: 2277749 - DNA, 15 bp, Homo sapiens
tatatatacatgtat

SEQ ID NO: 2277750 - DNA, 21 bp, Homo sapiens
tatatatgtacagttatacat

SEQ ID NO: 2277751 - DNA, 22 bp, Homo sapiens
tatatatttattattttcatat

SEQ ID NO: 2277752 - DNA, 14 bp, Homo sapiens
tatatatttccaaa

SEQ ID NO: 2277753 - DNA, 16 bp, Homo sapiens
tatatatttccaaata

SEQ ID NO: 2277754 - DNA, 22 bp, Homo sapiens
tccaccaatatcatgtgtagat

SEQ ID NO: 2277755 - DNA, 13 bp, Homo sapiens
tccaccctcccct

SEQ ID NO: 2277756 - DNA, 14 bp, Homo sapiens
tccaccctcccctc

SEQ ID NO: 2277757 - DNA, 13 bp, Homo sapiens
tccaccctgagga

SEQ ID NO: 2277758 - DNA, 14 bp, Homo sapiens
tccacctgggagat

SEQ ID NO: 2277759 - DNA, 16 bp, Homo sapiens
tccacctgggagatgc

SEQ ID NO: 2277760 - DNA, 22 bp, Homo sapiens
tccaccttggcgcgcagcccgg

SEQ ID NO: 2277761 - DNA, 23 bp, Homo sapiens
tccacggacccattcatactaaa

SEQ ID NO: 2277762 - DNA, 21 bp, Homo sapiens
tccactataattttacaaagt

SEQ ID NO: 2277763 - DNA, 18 bp, Homo sapiens
tccactgaaacctctgtt

SEQ ID NO: 2277764 - DNA, 19 bp, Homo sapiens
tccactgaaacctctgttc

SEQ ID NO: 2277765 - DNA, 14 bp, Homo sapiens
tccacttaaataat

SEQ ID NO: 2277766 - DNA, 14 bp, Homo sapiens
tccacttatgtaga

SEQ ID NO: 2277767 - DNA, 18 bp, Homo sapiens
tccacttatgtagacaaa

SEQ ID NO: 2277768 - DNA, 20 bp, Homo sapiens
tccacttctctagagaacat

SEQ ID NO: 2277769 - DNA, 24 bp, Homo sapiens
tccactttttaactcgtttgctga

SEQ ID NO: 2277770 - DNA, 21 bp, Homo sapiens
tccagaaatctattacacctt

SEQ ID NO: 2277771 - DNA, 21 bp, Homo sapiens
tccagaacgccctgtgtccac

SEQ ID NO: 2277772 - DNA, 14 bp, Homo sapiens
tccagaatttccca

SEQ ID NO: 2277773 - DNA, 22 bp, Homo sapiens
tccagaatttcccaaagcagtg

SEQ ID NO: 2277774 - DNA, 14 bp, Homo sapiens
tccagacctgggcc

SEQ ID NO: 2277775 - DNA, 16 bp, Homo sapiens
tccagacctgggccct

SEQ ID NO: 2277776 - DNA, 17 bp, Homo sapiens
tccagacctgggccctg

SEQ ID NO: 2277777 - DNA, 18 bp, Homo sapiens
tccagacctgggccctgg

SEQ ID NO: 2277778 - DNA, 15 bp, Homo sapiens
tccagactatgcagc

SEQ ID NO: 2277779 - DNA, 13 bp, Homo sapiens
tccagaggtgagg

SEQ ID NO: 2277780 - DNA, 14 bp, Homo sapiens
tccagaggtgaggg

SEQ ID NO: 2277781 - DNA, 21 bp, Homo sapiens
tccagaggtgagggaggcctg

SEQ ID NO: 2277782 - DNA, 16 bp, Homo sapiens
tccagattattttcta

SEQ ID NO: 2277783 - DNA, 18 bp, Homo sapiens
tccagattattttctata

SEQ ID NO: 2277784 - DNA, 12 bp, Homo sapiens
tccagattttta

SEQ ID NO: 2277785 - DNA, 16 bp, Homo sapiens
tccagcacctttgtaa

SEQ ID NO: 2277786 - DNA, 18 bp, Homo sapiens
tccagcaggggtctccca

SEQ ID NO: 2277787 - DNA, 15 bp, Homo sapiens
tccagcgtctgctgt

SEQ ID NO: 2277788 - DNA, 19 bp, Homo sapiens
tccagcgtctgctgttgat

SEQ ID NO: 2277789 - DNA, 16 bp, Homo sapiens
tccagctcagtcccac

SEQ ID NO: 2277790 - DNA, 17 bp, Homo sapiens
tccagctcagtcccaca

SEQ ID NO: 2277791 - DNA, 16 bp, Homo sapiens
tccaggagcagcgtgc

SEQ ID NO: 2277792 - DNA, 18 bp, Homo sapiens
tccaggaggactgttcta

SEQ ID NO: 2277793 - DNA, 21 bp, Homo sapiens
tccaggaggactgttctaact

SEQ ID NO: 2277794 - DNA, 13 bp, Homo sapiens
tccaggcaccgcc

SEQ ID NO: 2277795 - DNA, 18 bp, Homo sapiens
tccaggcaccgcctgccc

SEQ ID NO: 2277796 - DNA, 21 bp, Homo sapiens
tccaggcaccgcctgccccca

SEQ ID NO: 2277797 - DNA, 15 bp, Homo sapiens
tccaggcatgaccct

SEQ ID NO: 2277798 - DNA, 19 bp, Homo sapiens
tccaggcgtagggccaggg

SEQ ID NO: 2277799 - DNA, 20 bp, Homo sapiens
tccaggcgtagggccagggc

SEQ ID NO: 2277800 - DNA, 21 bp, Homo sapiens
tccaggcgtagggccagggct

SEQ ID NO: 2277801 - DNA, 23 bp, Homo sapiens
tccaggcgtagggccagggctct

SEQ ID NO: 2277802 - DNA, 23 bp, Homo sapiens
tccaggggctggggacttcgggg

SEQ ID NO: 2277803 - DNA, 14 bp, Homo sapiens
tccagtatcttgaa

SEQ ID NO: 2277804 - DNA, 16 bp, Homo sapiens
tccagtgttttcttgt

SEQ ID NO: 2277805 - DNA, 22 bp, Homo sapiens
tccagtgttttcttgtgttgtt

SEQ ID NO: 2277806 - DNA, 23 bp, Homo sapiens
tccagtgttttcttgtgttgttt

SEQ ID NO: 2277807 - DNA, 17 bp, Homo sapiens
tccagttgtatttgaag

SEQ ID NO: 2277808 - DNA, 19 bp, Homo sapiens
tccagtttcagagttctca

SEQ ID NO: 2277809 - DNA, 15 bp, Homo sapiens
tccatatagtttgtt

SEQ ID NO: 2277810 - DNA, 13 bp, Homo sapiens
tccatatgctctt

SEQ ID NO: 2277811 - DNA, 22 bp, Homo sapiens
tccatcaagccaagcctcctgt

SEQ ID NO: 2277812 - DNA, 20 bp, Homo sapiens
tccatccacacacagcagct

SEQ ID NO: 2277813 - DNA, 21 bp, Homo sapiens
tccatccacacacagcagctc

SEQ ID NO: 2277814 - DNA, 18 bp, Homo sapiens
tccatccttttgcttcat

SEQ ID NO: 2277815 - DNA, 22 bp, Homo sapiens
tccatctaaaatactcaccaaa

SEQ ID NO: 2277816 - DNA, 19 bp, Homo sapiens
tccatctcttgtaccagcc

SEQ ID NO: 2277817 - DNA, 17 bp, Homo sapiens
tccatcttacttgccct

SEQ ID NO: 2277818 - DNA, 15 bp, Homo sapiens
tccatgattccaagg

SEQ ID NO: 2277819 - DNA, 23 bp, Homo sapiens
tccatgattccaagggcccagag

SEQ ID NO: 2277820 - DNA, 17 bp, Homo sapiens
tccatgtgaaatttaca

SEQ ID NO: 2277821 - DNA, 14 bp, Homo sapiens
tccatgtttatcca

SEQ ID NO: 2277822 - DNA, 21 bp, Homo sapiens
tccatgtttatccatgtactt

SEQ ID NO: 2277823 - DNA, 21 bp, Homo sapiens
tccattctatgactcttgtct

SEQ ID NO: 2277824 - DNA, 14 bp, Homo sapiens
tccatttcacgggc

SEQ ID NO: 2277825 - DNA, 14 bp, Homo sapiens
tccattttctaaac

SEQ ID NO: 2277826 - DNA, 19 bp, Homo sapiens
tccattttctaaactgttt

SEQ ID NO: 2277827 - DNA, 23 bp, Homo sapiens
tccattttctaaactgttttcat

SEQ ID NO: 2277828 - DNA, 21 bp, Homo sapiens
tcccaaagcagtgcatgctgt

SEQ ID NO: 2277829 - DNA, 23 bp, Homo sapiens
tcccaacaagtgctctttccacc

SEQ ID NO: 2277830 - DNA, 17 bp, Homo sapiens
tcccaatagaatacctc

SEQ ID NO: 2277831 - DNA, 18 bp, Homo sapiens
tcccacaaaatatttcta

SEQ ID NO: 2277832 - DNA, 19 bp, Homo sapiens
tcccacaaaatatttctaa

SEQ ID NO: 2277833 - DNA, 20 bp, Homo sapiens
tcccacaattcttttgaaag

SEQ ID NO: 2277834 - DNA, 17 bp, Homo sapiens
tcccacagccccttgct

SEQ ID NO: 2277835 - DNA, 15 bp, Homo sapiens
tcccacatcccccgt

SEQ ID NO: 2277836 - DNA, 21 bp, Homo sapiens
tcccactgatatcacgggccc

SEQ ID NO: 2277837 - DNA, 18 bp, Homo sapiens
tcccagctcactgcagcc

SEQ ID NO: 2277838 - DNA, 20 bp, Homo sapiens
tcccagctcactgcagcctc

SEQ ID NO: 2277839 - DNA, 22 bp, Homo sapiens
tcccagctcactgcagcctcga

SEQ ID NO: 2277840 - DNA, 16 bp, Homo sapiens
tcccagctggcagcgc

SEQ ID NO: 2277841 - DNA, 18 bp, Homo sapiens
tcccaggacgcagggaga

SEQ ID NO: 2277842 - DNA, 23 bp, Homo sapiens
tcccaggacgcagggagaccctg

SEQ ID NO: 2277843 - DNA, 22 bp, Homo sapiens
tcccagggcccgagcgcgtgcc

SEQ ID NO: 2277844 - DNA, 18 bp, Homo sapiens
tcccatctcacctctagg

SEQ ID NO: 2277845 - DNA, 18 bp, Homo sapiens
tcccatgcaacaccctct

SEQ ID NO: 2277846 - DNA, 19 bp, Homo sapiens
tcccatttgtaatgtatct

SEQ ID NO: 2277847 - DNA, 18 bp, Homo sapiens
tccccagttaatgtgcca

SEQ ID NO: 2277848 - DNA, 16 bp, Homo sapiens
tccccatccccagctg

SEQ ID NO: 2277849 - DNA, 15 bp, Homo sapiens
tccccattagtatcc

SEQ ID NO: 2277850 - DNA, 17 bp, Homo sapiens
tcccccacgcctccatc

SEQ ID NO: 2277851 - DNA, 20 bp, Homo sapiens
tcccccacgcctccatccac

SEQ ID NO: 2277852 - DNA, 21 bp, Homo sapiens
tcccccacgcctccatccaca

SEQ ID NO: 2277853 - DNA, 13 bp, Homo sapiens
tcccccaggctgc

SEQ ID NO: 2277854 - DNA, 16 bp, Homo sapiens
tcccccaggctgcgcc

SEQ ID NO: 2277855 - DNA, 20 bp, Homo sapiens
tcccccaggctgcgcctgcc

SEQ ID NO: 2277856 - DNA, 21 bp, Homo sapiens
tcccccaggctgcgcctgccc

SEQ ID NO: 2277857 - DNA, 16 bp, Homo sapiens
tccccccatctccatt

SEQ ID NO: 2277858 - DNA, 14 bp, Homo sapiens
tccccgagccgagc

SEQ ID NO: 2277859 - DNA, 16 bp, Homo sapiens
tccccgcccgccctcc

SEQ ID NO: 2277860 - DNA, 19 bp, Homo sapiens
tccccgcccgccctcctct

SEQ ID NO: 2277861 - DNA, 23 bp, Homo sapiens
tccccgcccgccctcctctgccc

SEQ ID NO: 2277862 - DNA, 17 bp, Homo sapiens
tccccgcctcctccctg

SEQ ID NO: 2277863 - DNA, 21 bp, Homo sapiens
tccccgcctcctccctgcctg

SEQ ID NO: 2277864 - DNA, 15 bp, Homo sapiens
tccccgcgggcagtg

SEQ ID NO: 2277865 - DNA, 18 bp, Homo sapiens
tccccggacgctggctcg

SEQ ID NO: 2277866 - DNA, 13 bp, Homo sapiens
tccccggagctgg

SEQ ID NO: 2277867 - DNA, 23 bp, Homo sapiens
tcccctcccgcttcctccggctg

SEQ ID NO: 2277868 - DNA, 12 bp, Homo sapiens
tcccctctcctg

SEQ ID NO: 2277869 - DNA, 13 bp, Homo sapiens
tcccctgctcctg

SEQ ID NO: 2277870 - DNA, 16 bp, Homo sapiens
tcccctggtgcccctc

SEQ ID NO: 2277871 - DNA, 15 bp, Homo sapiens
tccccttgccacatc

SEQ ID NO: 2277872 - DNA, 16 bp, Homo sapiens
tcccgaatggagtcca

SEQ ID NO: 2277873 - DNA, 21 bp, Homo sapiens
tcccgaatggagtccagacct

SEQ ID NO: 2277874 - DNA, 14 bp, Homo sapiens
tcccgcagcaccag

SEQ ID NO: 2277875 - DNA, 15 bp, Homo sapiens
tcccgcagcaccagc

SEQ ID NO: 2277876 - DNA, 17 bp, Homo sapiens
tcccgcagcaccagcct

SEQ ID NO: 2277877 - DNA, 21 bp, Homo sapiens
tcccgcagcgggcgcgggaca

SEQ ID NO: 2277878 - DNA, 16 bp, Homo sapiens
tcccgccccagcctcc

SEQ ID NO: 2277879 - DNA, 17 bp, Homo sapiens
tcccgccccagcctcct

SEQ ID NO: 2277880 - DNA, 13 bp, Homo sapiens
tcccgccgcctcg

SEQ ID NO: 2277881 - DNA, 23 bp, Homo sapiens
tcccgccgcctcgggccgcctcc

SEQ ID NO: 2277882 - DNA, 17 bp, Homo sapiens
tcccggtgtatgcagtg

SEQ ID NO: 2277883 - DNA, 19 bp, Homo sapiens
tccctccccttgccacatc

SEQ ID NO: 2277884 - DNA, 22 bp, Homo sapiens
tccctgcttggcttatgaaaac

SEQ ID NO: 2277885 - DNA, 21 bp, Homo sapiens
tgaggaggggagcaaggctgc

SEQ ID NO: 2277886 - DNA, 22 bp, Homo sapiens
tgaggaggggagcaaggctgct

SEQ ID NO: 2277887 - DNA, 23 bp, Homo sapiens
tgaggaggggagcaaggctgcta

SEQ ID NO: 2277888 - DNA, 18 bp, Homo sapiens
tgaggagtgatgggcaag

SEQ ID NO: 2277889 - DNA, 22 bp, Homo sapiens
tgaggatgaaaaaataacactg

SEQ ID NO: 2277890 - DNA, 20 bp, Homo sapiens
tgaggcaggagggcatgtgc

SEQ ID NO: 2277891 - DNA, 12 bp, Homo sapiens
tgaggcccccgg

SEQ ID NO: 2277892 - DNA, 14 bp, Homo sapiens
tgaggcccccggag

SEQ ID NO: 2277893 - DNA, 15 bp, Homo sapiens
tgaggcccccggagg

SEQ ID NO: 2277894 - DNA, 16 bp, Homo sapiens
tgaggcccccggaggc

SEQ ID NO: 2277895 - DNA, 23 bp, Homo sapiens
tgaggcgggaaccctctggggcc

SEQ ID NO: 2277896 - DNA, 13 bp, Homo sapiens
tgaggctggggct

SEQ ID NO: 2277897 - DNA, 14 bp, Homo sapiens
tgagggaaaacata

SEQ ID NO: 2277898 - DNA, 13 bp, Homo sapiens
tgagggaagccca

SEQ ID NO: 2277899 - DNA, 15 bp, Homo sapiens
tgagggaagcccacc

SEQ ID NO: 2277900 - DNA, 18 bp, Homo sapiens
tgagggaagcccacccgc

SEQ ID NO: 2277901 - DNA, 15 bp, Homo sapiens
tgagggtttccacct

SEQ ID NO: 2277902 - DNA, 15 bp, Homo sapiens
tgaggtcatcccggg

SEQ ID NO: 2277903 - DNA, 19 bp, Homo sapiens
tgaggtcatcccggggcca

SEQ ID NO: 2277904 - DNA, 13 bp, Homo sapiens
tgagtaaaagcag

SEQ ID NO: 2277905 - DNA, 15 bp, Homo sapiens
tgagtaatattacat

SEQ ID NO: 2277906 - DNA, 16 bp, Homo sapiens
tgagtaatattacatt

SEQ ID NO: 2277907 - DNA, 18 bp, Homo sapiens
tgagtaatattacatttc

SEQ ID NO: 2277908 - DNA, 20 bp, Homo sapiens
tgagtaatattacatttcat

SEQ ID NO: 2277909 - DNA, 21 bp, Homo sapiens
tgagtaatattacatttcatt

SEQ ID NO: 2277910 - DNA, 11 bp, Homo sapiens
tgagtcctggc

SEQ ID NO: 2277911 - DNA, 18 bp, Homo sapiens
tgagtcctggcatgggaa

SEQ ID NO: 2277912 - DNA, 18 bp, Homo sapiens
tgagtgagaagataaaaa

SEQ ID NO: 2277913 - DNA, 14 bp, Homo sapiens
tgagtgccttacac

SEQ ID NO: 2277914 - DNA, 15 bp, Homo sapiens
tgagtgggagctgtc

SEQ ID NO: 2277915 - DNA, 18 bp, Homo sapiens
tgagtgggtatttcttat

SEQ ID NO: 2277916 - DNA, 20 bp, Homo sapiens
tgagtggtccacattctgct

SEQ ID NO: 2277917 - DNA, 18 bp, Homo sapiens
tgagtgtgcaatatgtaa

SEQ ID NO: 2277918 - DNA, 15 bp, Homo sapiens
tgagtgtggcgggaa

SEQ ID NO: 2277919 - DNA, 20 bp, Homo sapiens
tgagtttaaaaaaataacat

SEQ ID NO: 2277920 - DNA, 21 bp, Homo sapiens
tgagtttaaaaaaataacatc

SEQ ID NO: 2277921 - DNA, 22 bp, Homo sapiens
tgagtttatgggaatgcctttt

SEQ ID NO: 2277922 - DNA, 16 bp, Homo sapiens
tgataaccaagaatgt

SEQ ID NO: 2277923 - DNA, 15 bp, Homo sapiens
tgatacactgtatct

SEQ ID NO: 2277924 - DNA, 21 bp, Homo sapiens
tgatacactgtatctaaaaaa

SEQ ID NO: 2277925 - DNA, 16 bp, Homo sapiens
tgatagacttcgaaaa

SEQ ID NO: 2277926 - DNA, 19 bp, Homo sapiens
tgatagacttcgaaaacag

SEQ ID NO: 2277927 - DNA, 22 bp, Homo sapiens
tgatagagtttaacagatattt

SEQ ID NO: 2277928 - DNA, 18 bp, Homo sapiens
tgatataataattactta

SEQ ID NO: 2277929 - DNA, 22 bp, Homo sapiens
tgatataataattacttaatgt

SEQ ID NO: 2277930 - DNA, 16 bp, Homo sapiens
tgatatacaattagag

SEQ ID NO: 2277931 - DNA, 15 bp, Homo sapiens
tgatataggaaaata

SEQ ID NO: 2277932 - DNA, 23 bp, Homo sapiens
tgatataggaaaatacattgtgt

SEQ ID NO: 2277933 - DNA, 18 bp, Homo sapiens
tgatatcacgggcccgct

SEQ ID NO: 2277934 - DNA, 15 bp, Homo sapiens
tgatcagatcttaca

SEQ ID NO: 2277935 - DNA, 15 bp, Homo sapiens
tgatcattgcagtat

SEQ ID NO: 2277936 - DNA, 14 bp, Homo sapiens
tgatccatttgaac

SEQ ID NO: 2277937 - DNA, 12 bp, Homo sapiens
tgatcccagctc

SEQ ID NO: 2277938 - DNA, 22 bp, Homo sapiens
tgatcccagctcactgcagcct

SEQ ID NO: 2277939 - DNA, 18 bp, Homo sapiens
tgatcctcccgccccagc

SEQ ID NO: 2277940 - DNA, 20 bp, Homo sapiens
tgatcctcccgccccagcct

SEQ ID NO: 2277941 - DNA, 22 bp, Homo sapiens
tgatcctcccgccccagcctcc

SEQ ID NO: 2277942 - DNA, 17 bp, Homo sapiens
tgatctctcgtgattga

SEQ ID NO: 2277943 - DNA, 17 bp, Homo sapiens
tgatctgtcttgtaata

SEQ ID NO: 2277944 - DNA, 19 bp, Homo sapiens
tgatctgtcttgtaatatt

SEQ ID NO: 2277945 - DNA, 22 bp, Homo sapiens
tgatgactcttcttatcacact

SEQ ID NO: 2277946 - DNA, 15 bp, Homo sapiens
tgatgagaggaaatc

SEQ ID NO: 2277947 - DNA, 16 bp, Homo sapiens
tgatgagaggaaatca

SEQ ID NO: 2277948 - DNA, 23 bp, Homo sapiens
tgatgatagacttcgaaaacaga

SEQ ID NO: 2277949 - DNA, 14 bp, Homo sapiens
tgatgggcaagggg

SEQ ID NO: 2277950 - DNA, 17 bp, Homo sapiens
tgatgggcaaggggcca

SEQ ID NO: 2277951 - DNA, 23 bp, Homo sapiens
tgatgggcaaggggccaggaagg

SEQ ID NO: 2277952 - DNA, 18 bp, Homo sapiens
tgatggtcaatcagtgtt

SEQ ID NO: 2277953 - DNA, 23 bp, Homo sapiens
tgatggtgcaatgacctttcaat

SEQ ID NO: 2277954 - DNA, 18 bp, Homo sapiens
tgatgtatagctttaaca

SEQ ID NO: 2277955 - DNA, 19 bp, Homo sapiens
tgattaaatttaatatact

SEQ ID NO: 2277956 - DNA, 15 bp, Homo sapiens
tgattagtatgctat

SEQ ID NO: 2277957 - DNA, 22 bp, Homo sapiens
tgattattgaatgttatatcat

SEQ ID NO: 2277958 - DNA, 16 bp, Homo sapiens
tgattcataatgactt

SEQ ID NO: 2277959 - DNA, 22 bp, Homo sapiens
tgattccactgaaacctctgtt

SEQ ID NO: 2277960 - DNA, 22 bp, Homo sapiens
tgattgaaaagaagaaagtcta

SEQ ID NO: 2277961 - DNA, 15 bp, Homo sapiens
tgattgtttaattgt

SEQ ID NO: 2277962 - DNA, 14 bp, Homo sapiens
tgatttaagcattt

SEQ ID NO: 2277963 - DNA, 11 bp, Homo sapiens
tgatttcaaat

SEQ ID NO: 2277964 - DNA, 14 bp, Homo sapiens
tgatttcaaatgca

SEQ ID NO: 2277965 - DNA, 21 bp, Homo sapiens
tgatttccctaaggagcctgg

SEQ ID NO: 2277966 - DNA, 16 bp, Homo sapiens
tgatttctttccttcc

SEQ ID NO: 2277967 - DNA, 16 bp, Homo sapiens
tgatttgatatacaga

SEQ ID NO: 2277968 - DNA, 15 bp, Homo sapiens
tgatttgcatattca

SEQ ID NO: 2277969 - DNA, 19 bp, Homo sapiens
tgatttggtcctgcctaaa

SEQ ID NO: 2277970 - DNA, 23 bp, Homo sapiens
tgatttggtcctgcctaaatttc

SEQ ID NO: 2277971 - DNA, 19 bp, Homo sapiens
tgattttagatttctttga

SEQ ID NO: 2277972 - DNA, 22 bp, Homo sapiens
tgatttttttttccttcagtgc

SEQ ID NO: 2277973 - DNA, 19 bp, Homo sapiens
tgcaaacactgtgtattta

SEQ ID NO: 2277974 - DNA, 14 bp, Homo sapiens
tgcaaacatttctt

SEQ ID NO: 2277975 - DNA, 12 bp, Homo sapiens
tgcaaaccatca

SEQ ID NO: 2277976 - DNA, 13 bp, Homo sapiens
tgcaaaccatcat

SEQ ID NO: 2277977 - DNA, 20 bp, Homo sapiens
tgcaaagaactccagagtca

SEQ ID NO: 2277978 - DNA, 17 bp, Homo sapiens
tgcaaatagtttcaaat

SEQ ID NO: 2277979 - DNA, 16 bp, Homo sapiens
tgcaaatgaatgcctt

SEQ ID NO: 2277980 - DNA, 19 bp, Homo sapiens
tgcaaatgaatgcctttca

SEQ ID NO: 2277981 - DNA, 23 bp, Homo sapiens
tgcaaatgaatgcctttcaaaca

SEQ ID NO: 2277982 - DNA, 15 bp, Homo sapiens
tgcaaatgcacattt

SEQ ID NO: 2277983 - DNA, 12 bp, Homo sapiens
tgcaaattattc

SEQ ID NO: 2277984 - DNA, 17 bp, Homo sapiens
tgcaaattattctagtc

SEQ ID NO: 2277985 - DNA, 19 bp, Homo sapiens
tgcaaattattctagtcaa

SEQ ID NO: 2277986 - DNA, 19 bp, Homo sapiens
tgcaacctgtgcaaaataa

SEQ ID NO: 2277987 - DNA, 22 bp, Homo sapiens
tgcaacctgtgcaaaataaaat

SEQ ID NO: 2277988 - DNA, 13 bp, Homo sapiens
tgcaagaagaata

SEQ ID NO: 2277989 - DNA, 14 bp, Homo sapiens
tgcaagaagaatat

SEQ ID NO: 2277990 - DNA, 17 bp, Homo sapiens
tgcaagaagaatataaa

SEQ ID NO: 2277991 - DNA, 17 bp, Homo sapiens
tgcaagctctggaattg

SEQ ID NO: 2277992 - DNA, 21 bp, Homo sapiens
tgcaagctctggaattgttga

SEQ ID NO: 2277993 - DNA, 23 bp, Homo sapiens
tgcaagctctggaattgttgaat

SEQ ID NO: 2277994 - DNA, 16 bp, Homo sapiens
tgcaataacagtttta

SEQ ID NO: 2277995 - DNA, 19 bp, Homo sapiens
tgcaatatgtaacatgtct

SEQ ID NO: 2277996 - DNA, 15 bp, Homo sapiens
tgcaatcatatgtga

SEQ ID NO: 2277997 - DNA, 17 bp, Homo sapiens
tgcaatcatatgtgatc

SEQ ID NO: 2277998 - DNA, 22 bp, Homo sapiens
tgcaatgacctttcaataggaa

SEQ ID NO: 2277999 - DNA, 14 bp, Homo sapiens
tgcaatgatcagac

SEQ ID NO: 2278000 - DNA, 16 bp, Homo sapiens
tgcaatgatcagactt

SEQ ID NO: 2278001 - DNA, 19 bp, Homo sapiens
tgcacacattggccgcttc

SEQ ID NO: 2278002 - DNA, 15 bp, Homo sapiens
tgcacacctgtaatc

SEQ ID NO: 2278003 - DNA, 20 bp, Homo sapiens
tgcacattaggaacagagta

SEQ ID NO: 2278004 - DNA, 21 bp, Homo sapiens
tgcacattaggaacagagtat

SEQ ID NO: 2278005 - DNA, 14 bp, Homo sapiens
tgcaccttgggcac

SEQ ID NO: 2278006 - DNA, 12 bp, Homo sapiens
tgcactcagtgt

SEQ ID NO: 2278007 - DNA, 17 bp, Homo sapiens
tgcactgcacttctgga

SEQ ID NO: 2278008 - DNA, 18 bp, Homo sapiens
tgcactgggaatttattt

SEQ ID NO: 2278009 - DNA, 13 bp, Homo sapiens
tgcacttctgtta

SEQ ID NO: 2278010 - DNA, 15 bp, Homo sapiens
tgcacttctgttatc

SEQ ID NO: 2278011 - DNA, 21 bp, Homo sapiens
tgcacttgattaagcttttgt

SEQ ID NO: 2278012 - DNA, 15 bp, Homo sapiens
tgcagacactcaaga

SEQ ID NO: 2278013 - DNA, 19 bp, Homo sapiens
tgcagacactcaagagccc

SEQ ID NO: 2278014 - DNA, 17 bp, Homo sapiens
tgcagacatattttctt

SEQ ID NO: 2278015 - DNA, 13 bp, Homo sapiens
tgcagagtaaatc

SEQ ID NO: 2278016 - DNA, 23 bp, Homo sapiens
tgcagagtaaatcccacgacata

SEQ ID NO: 2278017 - DNA, 15 bp, Homo sapiens
tgtaatgtatcttat

SEQ ID NO: 2278018 - DNA, 15 bp, Homo sapiens
tgtaattttgtagta

SEQ ID NO: 2278019 - DNA, 17 bp, Homo sapiens
tgtaattttgtagtagt

SEQ ID NO: 2278020 - DNA, 18 bp, Homo sapiens
tgtacaattttcatccca

SEQ ID NO: 2278021 - DNA, 21 bp, Homo sapiens
tgtacagaaacaactgccaaa

SEQ ID NO: 2278022 - DNA, 14 bp, Homo sapiens
tgtacagacaacaa

SEQ ID NO: 2278023 - DNA, 14 bp, Homo sapiens
tgtaccatgttaaa

SEQ ID NO: 2278024 - DNA, 16 bp, Homo sapiens
tgtaccatgttaaaga

SEQ ID NO: 2278025 - DNA, 17 bp, Homo sapiens
tgtacctctggctgact

SEQ ID NO: 2278026 - DNA, 20 bp, Homo sapiens
tgtacctctggctgactaaa

SEQ ID NO: 2278027 - DNA, 15 bp, Homo sapiens
tgtactacacttctg

SEQ ID NO: 2278028 - DNA, 19 bp, Homo sapiens
tgtactatggctgtatttt

SEQ ID NO: 2278029 - DNA, 19 bp, Homo sapiens
tgtactcactgagtaacag

SEQ ID NO: 2278030 - DNA, 19 bp, Homo sapiens
tgtactgtatagacagttt

SEQ ID NO: 2278031 - DNA, 21 bp, Homo sapiens
tgtactgtatagacagtttgt

SEQ ID NO: 2278032 - DNA, 23 bp, Homo sapiens
tgtactgtatagacagtttgtaa

SEQ ID NO: 2278033 - DNA, 21 bp, Homo sapiens
tgtacttacactgaaatccaa

SEQ ID NO: 2278034 - DNA, 17 bp, Homo sapiens
tgtacttcagttctcat

SEQ ID NO: 2278035 - DNA, 22 bp, Homo sapiens
tgtactttccctgtgtaccctc

SEQ ID NO: 2278036 - DNA, 18 bp, Homo sapiens
tgtagaactgttcatttc

SEQ ID NO: 2278037 - DNA, 19 bp, Homo sapiens
tgtagaactgttcatttcc

SEQ ID NO: 2278038 - DNA, 21 bp, Homo sapiens
tgtagaactgttcatttccac

SEQ ID NO: 2278039 - DNA, 20 bp, Homo sapiens
tgtagacaaaacttataatt

SEQ ID NO: 2278040 - DNA, 15 bp, Homo sapiens
tgtagagacagggtc

SEQ ID NO: 2278041 - DNA, 16 bp, Homo sapiens
tgtagagacagggtct

SEQ ID NO: 2278042 - DNA, 16 bp, Homo sapiens
tgtagagcacatttag

SEQ ID NO: 2278043 - DNA, 16 bp, Homo sapiens
tgtagatacaggggca

SEQ ID NO: 2278044 - DNA, 15 bp, Homo sapiens
tgtagatatatattt

SEQ ID NO: 2278045 - DNA, 18 bp, Homo sapiens
tgtagatatatatttcca

SEQ ID NO: 2278046 - DNA, 21 bp, Homo sapiens
tgtagatatatatttccaaat

SEQ ID NO: 2278047 - DNA, 18 bp, Homo sapiens
tgtagatattatgtatag

SEQ ID NO: 2278048 - DNA, 16 bp, Homo sapiens
tgtagattgtgtaaat

SEQ ID NO: 2278049 - DNA, 18 bp, Homo sapiens
tgtagctacaagggaagc

SEQ ID NO: 2278050 - DNA, 15 bp, Homo sapiens
tgtagctagaatatc

SEQ ID NO: 2278051 - DNA, 16 bp, Homo sapiens
tgtagctagaatatcc

SEQ ID NO: 2278052 - DNA, 20 bp, Homo sapiens
tgtaggtatactatgtaagg

SEQ ID NO: 2278053 - DNA, 18 bp, Homo sapiens
tgtagtaattgttacaat

SEQ ID NO: 2278054 - DNA, 16 bp, Homo sapiens
tgtagttgatgtatcc

SEQ ID NO: 2278055 - DNA, 17 bp, Homo sapiens
tgtataccgtgtgctcc

SEQ ID NO: 2278056 - DNA, 17 bp, Homo sapiens
tgtatactccatagaaa

SEQ ID NO: 2278057 - DNA, 21 bp, Homo sapiens
tgtatagaaaataaaataaat

SEQ ID NO: 2278058 - DNA, 19 bp, Homo sapiens
tgtatagtgagtgtggctt

SEQ ID NO: 2278059 - DNA, 22 bp, Homo sapiens
tgtatatatttattattttcat

SEQ ID NO: 2278060 - DNA, 23 bp, Homo sapiens
tgtatatatttattattttcata

SEQ ID NO: 2278061 - DNA, 14 bp, Homo sapiens
tgtatatcagctct

SEQ ID NO: 2278062 - DNA, 22 bp, Homo sapiens
tgtatatcagctctaaagcaga

SEQ ID NO: 2278063 - DNA, 14 bp, Homo sapiens
tgtatatctgtaat

SEQ ID NO: 2278064 - DNA, 19 bp, Homo sapiens
tgtatatgtcaaaaatatt

SEQ ID NO: 2278065 - DNA, 15 bp, Homo sapiens
tgtatctaaaaaata

SEQ ID NO: 2278066 - DNA, 20 bp, Homo sapiens
tgtatctaaaaaataactgt

SEQ ID NO: 2278067 - DNA, 21 bp, Homo sapiens
tgtatctaaaaaataactgtg

SEQ ID NO: 2278068 - DNA, 15 bp, Homo sapiens
tgtattattgctgtt

SEQ ID NO: 2278069 - DNA, 16 bp, Homo sapiens
tgtattttaataaaga

SEQ ID NO: 2278070 - DNA, 22 bp, Homo sapiens
tgtattttcaataaagaaaaaa

SEQ ID NO: 2278071 - DNA, 20 bp, Homo sapiens
tgtattttcttcccatttgt

SEQ ID NO: 2278072 - DNA, 19 bp, Homo sapiens
tgtattttcttttatatct

SEQ ID NO: 2278073 - DNA, 20 bp, Homo sapiens
tgtattttcttttatatctg

SEQ ID NO: 2278074 - DNA, 23 bp, Homo sapiens
tgtattttcttttatatctgtaa

SEQ ID NO: 2278075 - DNA, 13 bp, Homo sapiens
tgtcaaaaatatt

SEQ ID NO: 2278076 - DNA, 13 bp, Homo sapiens
tgtcaaaatgtga

SEQ ID NO: 2278077 - DNA, 15 bp, Homo sapiens
tgtcaaagtggtgag

SEQ ID NO: 2278078 - DNA, 22 bp, Homo sapiens
tgtcaatgaggttatgagaaaa

SEQ ID NO: 2278079 - DNA, 19 bp, Homo sapiens
tgtcaattcattaataaaa

SEQ ID NO: 2278080 - DNA, 15 bp, Homo sapiens
tgtcagaaggagaca

SEQ ID NO: 2278081 - DNA, 13 bp, Homo sapiens
tgtcagcgtttct

SEQ ID NO: 2278082 - DNA, 18 bp, Homo sapiens
tgtcaggcagtagcagct

SEQ ID NO: 2278083 - DNA, 16 bp, Homo sapiens
tgtcagtgtgactgat

SEQ ID NO: 2278084 - DNA, 19 bp, Homo sapiens
tgtcagtgtgactgatctc

SEQ ID NO: 2278085 - DNA, 16 bp, Homo sapiens
tgtcataaaatgctat

SEQ ID NO: 2278086 - DNA, 14 bp, Homo sapiens
tgtcatactctgtg

SEQ ID NO: 2278087 - DNA, 15 bp, Homo sapiens
tgtcatactctgtgt

SEQ ID NO: 2278088 - DNA, 14 bp, Homo sapiens
tgtcatgaaagcac

SEQ ID NO: 2278089 - DNA, 17 bp, Homo sapiens
tgtcatgaaagcacctg

SEQ ID NO: 2278090 - DNA, 17 bp, Homo sapiens
tgtcattggttacaaat

SEQ ID NO: 2278091 - DNA, 20 bp, Homo sapiens
tgtccaacaactccaggaaa

SEQ ID NO: 2278092 - DNA, 21 bp, Homo sapiens
tgtccaacaactccaggaaaa

SEQ ID NO: 2278093 - DNA, 18 bp, Homo sapiens
tgtccagaacaaaagata

SEQ ID NO: 2278094 - DNA, 17 bp, Homo sapiens
tgtccagtccagtgatg

SEQ ID NO: 2278095 - DNA, 16 bp, Homo sapiens
tgtccataagagaaat

SEQ ID NO: 2278096 - DNA, 14 bp, Homo sapiens
tgtccatgtgaaat

SEQ ID NO: 2278097 - DNA, 12 bp, Homo sapiens
tgtcccacaaaa

SEQ ID NO: 2278098 - DNA, 17 bp, Homo sapiens
tgtcccatgggctctgg

SEQ ID NO: 2278099 - DNA, 15 bp, Homo sapiens
tgtccccaggggcac

SEQ ID NO: 2278100 - DNA, 13 bp, Homo sapiens
tgtccccctgtga

SEQ ID NO: 2278101 - DNA, 13 bp, Homo sapiens
tgtcccttccagg

SEQ ID NO: 2278102 - DNA, 12 bp, Homo sapiens
tgtcccttttcc

SEQ ID NO: 2278103 - DNA, 17 bp, Homo sapiens
tgtcccttttccttttt

SEQ ID NO: 2278104 - DNA, 23 bp, Homo sapiens
tgtcctaggggccgagggaaatg

SEQ ID NO: 2278105 - DNA, 17 bp, Homo sapiens
tgtcctcatctataaaa

SEQ ID NO: 2278106 - DNA, 17 bp, Homo sapiens
tgtccttttcttttctt

SEQ ID NO: 2278107 - DNA, 14 bp, Homo sapiens
tgtcgggcatgaca

SEQ ID NO: 2278108 - DNA, 15 bp, Homo sapiens
tgtcgggcatgacac

SEQ ID NO: 2278109 - DNA, 22 bp, Homo sapiens
tgtctaaagttagggcattttt

SEQ ID NO: 2278110 - DNA, 14 bp, Homo sapiens
tgtctaatgaaacc

SEQ ID NO: 2278111 - DNA, 21 bp, Homo sapiens
tgtctatgaactagagactct

SEQ ID NO: 2278112 - DNA, 23 bp, Homo sapiens
tgtctcagccgagcccaggggag

SEQ ID NO: 2278113 - DNA, 13 bp, Homo sapiens
tgtctctgagagt

SEQ ID NO: 2278114 - DNA, 14 bp, Homo sapiens
tgtctgagctgctg

SEQ ID NO: 2278115 - DNA, 16 bp, Homo sapiens
tgtctgattctatgcc

SEQ ID NO: 2278116 - DNA, 14 bp, Homo sapiens
tgtctgctgcctcc

SEQ ID NO: 2278117 - DNA, 15 bp, Homo sapiens
tgtctgctgcctcca

SEQ ID NO: 2278118 - DNA, 14 bp, Homo sapiens
tgtctgtaagagaa

SEQ ID NO: 2278119 - DNA, 18 bp, Homo sapiens
tgtctgtaagagaattct

SEQ ID NO: 2278120 - DNA, 12 bp, Homo sapiens
tgtctgtcctgg

SEQ ID NO: 2278121 - DNA, 13 bp, Homo sapiens
tgtctgtcctggt

SEQ ID NO: 2278122 - DNA, 18 bp, Homo sapiens
tgtcttcaaccctgccct

SEQ ID NO: 2278123 - DNA, 20 bp, Homo sapiens
tgtcttcaaccctgccctgc

SEQ ID NO: 2278124 - DNA, 19 bp, Homo sapiens
tgtcttgtaatattttgta

SEQ ID NO: 2278125 - DNA, 22 bp, Homo sapiens
tgtgaaacagggagctatgaga

SEQ ID NO: 2278126 - DNA, 15 bp, Homo sapiens
tgtgacatgttttat

SEQ ID NO: 2278127 - DNA, 19 bp, Homo sapiens
tgtgaccacaggctggtgt

SEQ ID NO: 2278128 - DNA, 22 bp, Homo sapiens
tgtgaccggggtcctgaggctg

SEQ ID NO: 2278129 - DNA, 16 bp, Homo sapiens
tgtgacctgacacctg

SEQ ID NO: 2278130 - DNA, 14 bp, Homo sapiens
tgtgacttctctct

SEQ ID NO: 2278131 - DNA, 13 bp, Homo sapiens
tgtgaggaggggc

SEQ ID NO: 2278132 - DNA, 21 bp, Homo sapiens
tgtgatcccagctcactgcag

SEQ ID NO: 2278133 - DNA, 22 bp, Homo sapiens
tgtgatctaagcagttgcaatg

SEQ ID NO: 2278134 - DNA, 13 bp, Homo sapiens
tgtgatctgtctt

SEQ ID NO: 2278135 - DNA, 16 bp, Homo sapiens
tgtgatctgtcttgta

SEQ ID NO: 2278136 - DNA, 17 bp, Homo sapiens
tgtgatctgtcttgtaa

SEQ ID NO: 2278137 - DNA, 18 bp, Homo sapiens
tgtgatctgtcttgtaat

SEQ ID NO: 2278138 - DNA, 18 bp, Homo sapiens
tgtgatgagaggaaatca

SEQ ID NO: 2278139 - DNA, 15 bp, Homo sapiens
tgtgatgcttgatat

SEQ ID NO: 2278140 - DNA, 12 bp, Homo sapiens
tgtgattacagc

SEQ ID NO: 2278141 - DNA, 17 bp, Homo sapiens
tgtgattccccggagct

SEQ ID NO: 2278142 - DNA, 16 bp, Homo sapiens
tgtgcaaaataaaatg

SEQ ID NO: 2278143 - DNA, 20 bp, Homo sapiens
tgtgcaaaataaaatgagtt

SEQ ID NO: 2278144 - DNA, 19 bp, Homo sapiens
tgtgcagcatggaattcct

SEQ ID NO: 2278145 - DNA, 18 bp, Homo sapiens
tgtgcataaaagttaaca

SEQ ID NO: 2278146 - DNA, 21 bp, Homo sapiens
tgtgcataaaagttaacatta

SEQ ID NO: 2278147 - DNA, 12 bp, Homo sapiens
tgtgccaaacta

SEQ ID NO: 2278148 - DNA, 14 bp, Homo sapiens
tgtgccaaagatag

SEQ ID NO: 2278149 - DNA, 19 bp, Homo sapiens
tgtgccaaagatagcagaa

SEQ ID NO: 2278150 - DNA, 21 bp, Homo sapiens
ttcttgtgtgtttattgtcaa

SEQ ID NO: 2278151 - DNA, 20 bp, Homo sapiens
ttcttgtgttgttttctctg

SEQ ID NO: 2278152 - DNA, 19 bp, Homo sapiens
ttctttaacatacatctaa

SEQ ID NO: 2278153 - DNA, 22 bp, Homo sapiens
ttctttaaggaagaataaaaaa

SEQ ID NO: 2278154 - DNA, 16 bp, Homo sapiens
ttctttataaaccata

SEQ ID NO: 2278155 - DNA, 15 bp, Homo sapiens
ttctttccttcccaa

SEQ ID NO: 2278156 - DNA, 16 bp, Homo sapiens
ttctttccttcccaat

SEQ ID NO: 2278157 - DNA, 14 bp, Homo sapiens
ttctttttaaatgt

SEQ ID NO: 2278158 - DNA, 15 bp, Homo sapiens
ttctttttaaatgtg

SEQ ID NO: 2278159 - DNA, 13 bp, Homo sapiens
ttgaaaagaagaa

SEQ ID NO: 2278160 - DNA, 18 bp, Homo sapiens
ttgaaaagaagaaagtct

SEQ ID NO: 2278161 - DNA, 22 bp, Homo sapiens
ttgaaaagaagaaagtctatgc

SEQ ID NO: 2278162 - DNA, 20 bp, Homo sapiens
ttgaaagaagtcaaatgaat

SEQ ID NO: 2278163 - DNA, 19 bp, Homo sapiens
ttgaaatactctacaagaa

SEQ ID NO: 2278164 - DNA, 11 bp, Homo sapiens
ttgaaatcttt

SEQ ID NO: 2278165 - DNA, 16 bp, Homo sapiens
ttgaactgtggccacc

SEQ ID NO: 2278166 - DNA, 19 bp, Homo sapiens
ttgaagaaagtcagctctt

SEQ ID NO: 2278167 - DNA, 19 bp, Homo sapiens
ttgaagacttttctttcag

SEQ ID NO: 2278168 - DNA, 15 bp, Homo sapiens
ttgaagctcaactgt

SEQ ID NO: 2278169 - DNA, 14 bp, Homo sapiens
ttgaagggaaatca

SEQ ID NO: 2278170 - DNA, 14 bp, Homo sapiens
ttgaagtcttgtat

SEQ ID NO: 2278171 - DNA, 16 bp, Homo sapiens
ttgaagtcttgtataa

SEQ ID NO: 2278172 - DNA, 16 bp, Homo sapiens
ttgaatgatgccatga

SEQ ID NO: 2278173 - DNA, 15 bp, Homo sapiens
ttgaatgtattcttt

SEQ ID NO: 2278174 - DNA, 13 bp, Homo sapiens
ttgacatcaactg

SEQ ID NO: 2278175 - DNA, 19 bp, Homo sapiens
ttgacgcagccccccacgc

SEQ ID NO: 2278176 - DNA, 16 bp, Homo sapiens
ttgactgtgctggaga

SEQ ID NO: 2278177 - DNA, 17 bp, Homo sapiens
ttgagaataaatgagca

SEQ ID NO: 2278178 - DNA, 20 bp, Homo sapiens
ttgagatactttttcttttg

SEQ ID NO: 2278179 - DNA, 19 bp, Homo sapiens
ttgagcaatgtttttctca

SEQ ID NO: 2278180 - DNA, 11 bp, Homo sapiens
ttgagcacagg

SEQ ID NO: 2278181 - DNA, 13 bp, Homo sapiens
ttgagctcctggg

SEQ ID NO: 2278182 - DNA, 17 bp, Homo sapiens
ttgaggaggggagcaag

SEQ ID NO: 2278183 - DNA, 23 bp, Homo sapiens
ttgaggcagggtctcactctgtt

SEQ ID NO: 2278184 - DNA, 17 bp, Homo sapiens
ttgagtggacagcagct

SEQ ID NO: 2278185 - DNA, 21 bp, Homo sapiens
ttgagtggacagcagctggac

SEQ ID NO: 2278186 - DNA, 18 bp, Homo sapiens
ttgagtgggtatttctta

SEQ ID NO: 2278187 - DNA, 21 bp, Homo sapiens
ttgataatagtaatggttcta

SEQ ID NO: 2278188 - DNA, 13 bp, Homo sapiens
ttgatataataat

SEQ ID NO: 2278189 - DNA, 17 bp, Homo sapiens
ttgatataataattact

SEQ ID NO: 2278190 - DNA, 20 bp, Homo sapiens
ttgatataattacttaatgt

SEQ ID NO: 2278191 - DNA, 21 bp, Homo sapiens
ttgatataattacttaatgtg

SEQ ID NO: 2278192 - DNA, 15 bp, Homo sapiens
ttgatatacagacct

SEQ ID NO: 2278193 - DNA, 12 bp, Homo sapiens
ttgatctcccca

SEQ ID NO: 2278194 - DNA, 17 bp, Homo sapiens
ttgattcataatgactt

SEQ ID NO: 2278195 - DNA, 20 bp, Homo sapiens
ttgcaaacaaaatgatggga

SEQ ID NO: 2278196 - DNA, 15 bp, Homo sapiens
ttgcaaattattcta

SEQ ID NO: 2278197 - DNA, 18 bp, Homo sapiens
ttgcaaattattctagtc

SEQ ID NO: 2278198 - DNA, 20 bp, Homo sapiens
ttgcaaattattctagtcaa

SEQ ID NO: 2278199 - DNA, 20 bp, Homo sapiens
ttgcacatggattgattaaa

SEQ ID NO: 2278200 - DNA, 13 bp, Homo sapiens
ttgcacattagga

SEQ ID NO: 2278201 - DNA, 22 bp, Homo sapiens
ttgcacttgattaagcttttgt

SEQ ID NO: 2278202 - DNA, 20 bp, Homo sapiens
ttgcaggaagagatgctcta

SEQ ID NO: 2278203 - DNA, 17 bp, Homo sapiens
ttgcaggaagggaagag

SEQ ID NO: 2278204 - DNA, 15 bp, Homo sapiens
ttgcagtgaagatgt

SEQ ID NO: 2278205 - DNA, 17 bp, Homo sapiens
ttgcagtgaagatgtgt

SEQ ID NO: 2278206 - DNA, 14 bp, Homo sapiens
ttgcattatgagta

SEQ ID NO: 2278207 - DNA, 16 bp, Homo sapiens
ttgcattccagcgtct

SEQ ID NO: 2278208 - DNA, 20 bp, Homo sapiens
ttgcattccagcgtctgctg

SEQ ID NO: 2278209 - DNA, 23 bp, Homo sapiens
ttgccatccttgcacttctgtta

SEQ ID NO: 2278210 - DNA, 18 bp, Homo sapiens
ttgcccacacctgcctct

SEQ ID NO: 2278211 - DNA, 20 bp, Homo sapiens
ttgcccttctatactttctc

SEQ ID NO: 2278212 - DNA, 15 bp, Homo sapiens
ttgcgctctgggttt

SEQ ID NO: 2278213 - DNA, 20 bp, Homo sapiens
ttgctagtgatacactgtat

SEQ ID NO: 2278214 - DNA, 21 bp, Homo sapiens
ttgctagtgatacactgtatc

SEQ ID NO: 2278215 - DNA, 13 bp, Homo sapiens
ttgctgacagagc

SEQ ID NO: 2278216 - DNA, 14 bp, Homo sapiens
ttgctgacagagcc

SEQ ID NO: 2278217 - DNA, 20 bp, Homo sapiens
ttgctgaccccacttggact

SEQ ID NO: 2278218 - DNA, 23 bp, Homo sapiens
ttgctgatttgcacacattggcc

SEQ ID NO: 2278219 - DNA, 20 bp, Homo sapiens
ttgctgtgtttcaaacctgc

SEQ ID NO: 2278220 - DNA, 23 bp, Homo sapiens
ttgcttaagatgctaatagaaaa

SEQ ID NO: 2278221 - DNA, 14 bp, Homo sapiens
ttgcttcatctgga

SEQ ID NO: 2278222 - DNA, 23 bp, Homo sapiens
ttgcttctaagggatccagagac

SEQ ID NO: 2278223 - DNA, 13 bp, Homo sapiens
ttgcttgaatgct

SEQ ID NO: 2278224 - DNA, 15 bp, Homo sapiens
ttgcttgtacctctg

SEQ ID NO: 2278225 - DNA, 19 bp, Homo sapiens
ttggactgtggcctcagga

SEQ ID NO: 2278226 - DNA, 21 bp, Homo sapiens
ttggataataactagatctcc

SEQ ID NO: 2278227 - DNA, 15 bp, Homo sapiens
ttggatctttttgca

SEQ ID NO: 2278228 - DNA, 16 bp, Homo sapiens
ttggctttcctgtttc

SEQ ID NO: 2278229 - DNA, 13 bp, Homo sapiens
ttgggatgggcac

SEQ ID NO: 2278230 - DNA, 19 bp, Homo sapiens
ttgggcccccatccctccc

SEQ ID NO: 2278231 - DNA, 19 bp, Homo sapiens
ttgggctggataaatatgt

SEQ ID NO: 2278232 - DNA, 12 bp, Homo sapiens
ttggggaggggg

SEQ ID NO: 2278233 - DNA, 20 bp, Homo sapiens
ttggggcttatcagaactcc

SEQ ID NO: 2278234 - DNA, 12 bp, Homo sapiens
ttgggtggagga

SEQ ID NO: 2278235 - DNA, 22 bp, Homo sapiens
ttggtcctgcctaaatttcaca

SEQ ID NO: 2278236 - DNA, 12 bp, Homo sapiens
ttggtgaataac

SEQ ID NO: 2278237 - DNA, 11 bp, Homo sapiens
ttggtgaggac

SEQ ID NO: 2278238 - DNA, 15 bp, Homo sapiens
ttggttacaaatttt

SEQ ID NO: 2278239 - DNA, 12 bp, Homo sapiens
ttgtaaatgtta

SEQ ID NO: 2278240 - DNA, 14 bp, Homo sapiens
ttgtaaatgttatt

SEQ ID NO: 2278241 - DNA, 17 bp, Homo sapiens
ttgtaaatgttatttct

SEQ ID NO: 2278242 - DNA, 14 bp, Homo sapiens
ttgtaaggaatgat

SEQ ID NO: 2278243 - DNA, 17 bp, Homo sapiens
ttgtaagtgctacataa

SEQ ID NO: 2278244 - DNA, 19 bp, Homo sapiens
ttgtaatatacagtttttg

SEQ ID NO: 2278245 - DNA, 14 bp, Homo sapiens
ttgtaatattttgt

SEQ ID NO: 2278246 - DNA, 15 bp, Homo sapiens
ttgtaatattttgta

SEQ ID NO: 2278247 - DNA, 14 bp, Homo sapiens
ttgtaatgtatctt

SEQ ID NO: 2278248 - DNA, 15 bp, Homo sapiens
ttgtacatatggaaa

SEQ ID NO: 2278249 - DNA, 11 bp, Homo sapiens
ttgtacatttt

SEQ ID NO: 2278250 - DNA, 13 bp, Homo sapiens
ttgtacttacact

SEQ ID NO: 2278251 - DNA, 15 bp, Homo sapiens
ttgtaggtatactat

SEQ ID NO: 2278252 - DNA, 17 bp, Homo sapiens
ttgtaggtatactatgt

SEQ ID NO: 2278253 - DNA, 19 bp, Homo sapiens
ttgtaggtcaatgaaatat

SEQ ID NO: 2278254 - DNA, 14 bp, Homo sapiens
ttgtatcctggcaa

SEQ ID NO: 2278255 - DNA, 19 bp, Homo sapiens
ttgtattattgctgttgct

SEQ ID NO: 2278256 - DNA, 17 bp, Homo sapiens
ttgtattttaataaaga

SEQ ID NO: 2278257 - DNA, 18 bp, Homo sapiens
ttgtattttcttcccatt

SEQ ID NO: 2278258 - DNA, 15 bp, Homo sapiens
ttgtcataaaatgct

SEQ ID NO: 2278259 - DNA, 17 bp, Homo sapiens
ttgtcataaaatgctat

SEQ ID NO: 2278260 - DNA, 20 bp, Homo sapiens
ttgtcataaaatgctatttt

SEQ ID NO: 2278261 - DNA, 21 bp, Homo sapiens
ttgtcataaaatgctatttta

SEQ ID NO: 2278262 - DNA, 16 bp, Homo sapiens
ttgtcattctgctaat

SEQ ID NO: 2278263 - DNA, 20 bp, Homo sapiens
ttgtccaaaggaaagcttaa

SEQ ID NO: 2278264 - DNA, 19 bp, Homo sapiens
ttgtcccatgtggcttgtt

SEQ ID NO: 2278265 - DNA, 11 bp, Homo sapiens
ttgtctgctgc

SEQ ID NO: 2278266 - DNA, 21 bp, Homo sapiens
ttgtctgtaggtgaaagaaca

SEQ ID NO: 2278267 - DNA, 21 bp, Homo sapiens
ttgtggctgatttcaaatgca

SEQ ID NO: 2278268 - DNA, 13 bp, Homo sapiens
ttgtgtaactgtt

SEQ ID NO: 2278269 - DNA, 15 bp, Homo sapiens
ttgtgtaactgttct

SEQ ID NO: 2278270 - DNA, 15 bp, Homo sapiens
ttgtgtagattgtgt

SEQ ID NO: 2278271 - DNA, 18 bp, Homo sapiens
ttgtgtagattgtgtaaa

SEQ ID NO: 2278272 - DNA, 15 bp, Homo sapiens
ttgtgtatgatccaa

SEQ ID NO: 2278273 - DNA, 13 bp, Homo sapiens
ttgtgttcttaaa

SEQ ID NO: 2278274 - DNA, 15 bp, Homo sapiens
ttgtgttttcctaaa

SEQ ID NO: 2278275 - DNA, 18 bp, Homo sapiens
ttgttaaaaccttactta

SEQ ID NO: 2278276 - DNA, 13 bp, Homo sapiens
ttgttaaatgcta

SEQ ID NO: 2278277 - DNA, 13 bp, Homo sapiens
ttgttaatataac

SEQ ID NO: 2278278 - DNA, 20 bp, Homo sapiens
ttgttagtgtgtcttagtgt

SEQ ID NO: 2278279 - DNA, 20 bp, Homo sapiens
ttgttctagttagcaggaaa

SEQ ID NO: 2278280 - DNA, 13 bp, Homo sapiens
ttgttgaatgtat

SEQ ID NO: 2278281 - DNA, 14 bp, Homo sapiens
ttgttgaatgtatt

SEQ ID NO: 2278282 - DNA, 13 bp, Homo sapiens
ttgtttctatact

SEQ ID NO: 2278283 - DNA, 19 bp, Homo sapiens
tttaaaaaaaatattctgt

SEQ ID NO: 2278284 - DNA, 17 bp, Homo sapiens
aaaaaatgaatagtaca

SEQ ID NO: 2278285 - DNA, 15 bp, Homo sapiens
aaaaaatgcgtatat

SEQ ID NO: 2278286 - DNA, 22 bp, Homo sapiens
aaaaacattttaaaatcaactt

SEQ ID NO: 2278287 - DNA, 13 bp, Homo sapiens
aaaaagaatagaa

SEQ ID NO: 2278288 - DNA, 16 bp, Homo sapiens
aaaaagatactgtata

SEQ ID NO: 2278289 - DNA, 18 bp, Homo sapiens
aaaaataaaaacataaaa

SEQ ID NO: 2278290 - DNA, 15 bp, Homo sapiens
aaaaatattctccat

SEQ ID NO: 2278291 - DNA, 14 bp, Homo sapiens
aaaaatctttcaga

SEQ ID NO: 2278292 - DNA, 18 bp, Homo sapiens
aaaaccttctatgttcat

SEQ ID NO: 2278293 - DNA, 18 bp, Homo sapiens
aaaacgtggctgcttcaa

SEQ ID NO: 2278294 - DNA, 22 bp, Homo sapiens
aaaactcagtctcaaataataa

SEQ ID NO: 2278295 - DNA, 18 bp, Homo sapiens
aaaacttttctgcatttg

SEQ ID NO: 2278296 - DNA, 14 bp, Homo sapiens
aaaacttttggcaa

SEQ ID NO: 2278297 - DNA, 21 bp, Homo sapiens
aaaagaagaaagtctatgctt

SEQ ID NO: 2278298 - DNA, 19 bp, Homo sapiens
aaaagatactgtatatgtc

SEQ ID NO: 2278299 - DNA, 22 bp, Homo sapiens
aaaaggctggatgtgctttcat

SEQ ID NO: 2278300 - DNA, 16 bp, Homo sapiens
aaaagtcattcagtta

SEQ ID NO: 2278301 - DNA, 17 bp, Homo sapiens
aaaagtccttagaatga

SEQ ID NO: 2278302 - DNA, 14 bp, Homo sapiens
aaaagttaacatta

SEQ ID NO: 2278303 - DNA, 17 bp, Homo sapiens
aaaataaaaacataaaa

SEQ ID NO: 2278304 - DNA, 18 bp, Homo sapiens
aaaataaaaacataaaat

SEQ ID NO: 2278305 - DNA, 18 bp, Homo sapiens
aaaataaatgaaaaacag

SEQ ID NO: 2278306 - DNA, 13 bp, Homo sapiens
aaaataacatatt

SEQ ID NO: 2278307 - DNA, 17 bp, Homo sapiens
aaaataacatctgaaaa

SEQ ID NO: 2278308 - DNA, 20 bp, Homo sapiens
aaaataacatctgaaaagaa

SEQ ID NO: 2278309 - DNA, 16 bp, Homo sapiens
aaaataactgtgcact

SEQ ID NO: 2278310 - DNA, 15 bp, Homo sapiens
aaaataattgggtga

SEQ ID NO: 2278311 - DNA, 22 bp, Homo sapiens
aaaatactggaattcaaagata

SEQ ID NO: 2278312 - DNA, 19 bp, Homo sapiens
aaaatagttctatttctat

SEQ ID NO: 2278313 - DNA, 23 bp, Homo sapiens
aaaatagttctatttctatctgc

SEQ ID NO: 2278314 - DNA, 15 bp, Homo sapiens
aaaatagttttacat

SEQ ID NO: 2278315 - DNA, 17 bp, Homo sapiens
aaaatatacaaacatgt

SEQ ID NO: 2278316 - DNA, 21 bp, Homo sapiens
aaaatatagttaattgtggct

SEQ ID NO: 2278317 - DNA, 20 bp, Homo sapiens
aaaatgaactgtatattatt

SEQ ID NO: 2278318 - DNA, 20 bp, Homo sapiens
aaaatgtcaatttttaactt

SEQ ID NO: 2278319 - DNA, 14 bp, Homo sapiens
aaaatgtgctgcct

SEQ ID NO: 2278320 - DNA, 12 bp, Homo sapiens
aaaatgttaaca

SEQ ID NO: 2278321 - DNA, 18 bp, Homo sapiens
aaaatgttaacaacttga

SEQ ID NO: 2278322 - DNA, 13 bp, Homo sapiens
aaaattacattat

SEQ ID NO: 2278323 - DNA, 22 bp, Homo sapiens
aaaattagtgagatttgtattt

SEQ ID NO: 2278324 - DNA, 13 bp, Homo sapiens
aaaattcaacaaa

SEQ ID NO: 2278325 - DNA, 15 bp, Homo sapiens
aaaattcatggaact

SEQ ID NO: 2278326 - DNA, 21 bp, Homo sapiens
aaaattctagtctgtttcatt

SEQ ID NO: 2278327 - DNA, 16 bp, Homo sapiens
aaaattgtgttcttaa

SEQ ID NO: 2278328 - DNA, 13 bp, Homo sapiens
aaacaaaaataga

SEQ ID NO: 2278329 - DNA, 13 bp, Homo sapiens
aaatatgaaagcc

SEQ ID NO: 2278330 - DNA, 20 bp, Homo sapiens
aaatatgacagaatttgtga

SEQ ID NO: 2278331 - DNA, 17 bp, Homo sapiens
aaatatgcaacctgtgc

SEQ ID NO: 2278332 - DNA, 19 bp, Homo sapiens
aaatatgcaacctgtgcaa

SEQ ID NO: 2278333 - DNA, 19 bp, Homo sapiens
aaatattaatatgtacttt

SEQ ID NO: 2278334 - DNA, 20 bp, Homo sapiens
aaatattaatatgtactttt

SEQ ID NO: 2278335 - DNA, 19 bp, Homo sapiens
aaatattctaaaaaagata

SEQ ID NO: 2278336 - DNA, 23 bp, Homo sapiens
aaatattctaaaaaagatactgt

SEQ ID NO: 2278337 - DNA, 13 bp, Homo sapiens
aaatattctgtca

SEQ ID NO: 2278338 - DNA, 12 bp, Homo sapiens
aaatatttatgc

SEQ ID NO: 2278339 - DNA, 22 bp, Homo sapiens
aaatatttatgcagaaggtatt

SEQ ID NO: 2278340 - DNA, 19 bp, Homo sapiens
aaatatttatttgttttgg

SEQ ID NO: 2278341 - DNA, 17 bp, Homo sapiens
aaatatttcaataactt

SEQ ID NO: 2278342 - DNA, 14 bp, Homo sapiens
aaatatttttatgt

SEQ ID NO: 2278343 - DNA, 21 bp, Homo sapiens
aaatatttttttctagctata

SEQ ID NO: 2278344 - DNA, 23 bp, Homo sapiens
aaatatttttttctagctataac

SEQ ID NO: 2278345 - DNA, 13 bp, Homo sapiens
aaatcaatttaaa

SEQ ID NO: 2278346 - DNA, 14 bp, Homo sapiens
aaatcaatttaaag

SEQ ID NO: 2278347 - DNA, 14 bp, Homo sapiens
aaatcattcaaaac

SEQ ID NO: 2278348 - DNA, 22 bp, Homo sapiens
aaatcattcaaaactttcagct

SEQ ID NO: 2278349 - DNA, 23 bp, Homo sapiens
aaatcctgggcatccccagcccc

SEQ ID NO: 2278350 - DNA, 14 bp, Homo sapiens
aaatctagtatttg

SEQ ID NO: 2278351 - DNA, 19 bp, Homo sapiens
aaatctgtctgattctatg

SEQ ID NO: 2278352 - DNA, 20 bp, Homo sapiens
aaatctgtctgattctatgc

SEQ ID NO: 2278353 - DNA, 18 bp, Homo sapiens
aaatctgttagcattatt

SEQ ID NO: 2278354 - DNA, 18 bp, Homo sapiens
aaatctttccatctcatt

SEQ ID NO: 2278355 - DNA, 22 bp, Homo sapiens
aaatctttccatctcattacag

SEQ ID NO: 2278356 - DNA, 14 bp, Homo sapiens
aaatctttttgctt

SEQ ID NO: 2278357 - DNA, 14 bp, Homo sapiens
aaatgaactgtata

SEQ ID NO: 2278358 - DNA, 19 bp, Homo sapiens
aaatgaactgtatattatt

SEQ ID NO: 2278359 - DNA, 14 bp, Homo sapiens
aaatgaatagtaca

SEQ ID NO: 2278360 - DNA, 19 bp, Homo sapiens
aaatgaatgagctctctaa

SEQ ID NO: 2278361 - DNA, 14 bp, Homo sapiens
aaatgagaaattgt

SEQ ID NO: 2278362 - DNA, 14 bp, Homo sapiens
aaatgagcattttt

SEQ ID NO: 2278363 - DNA, 16 bp, Homo sapiens
aaatgagttacctcat

SEQ ID NO: 2278364 - DNA, 18 bp, Homo sapiens
aaatgagttacctcatgc

SEQ ID NO: 2278365 - DNA, 16 bp, Homo sapiens
aaatgagtttaaaaaa

SEQ ID NO: 2278366 - DNA, 22 bp, Homo sapiens
aaatgagtttaaaaaaataaca

SEQ ID NO: 2278367 - DNA, 17 bp, Homo sapiens
aaatgcaaacactgtgt

SEQ ID NO: 2278368 - DNA, 22 bp, Homo sapiens
aaatgcagtccagtgagaaatt

SEQ ID NO: 2278369 - DNA, 14 bp, Homo sapiens
aaatgctaatgtaa

SEQ ID NO: 2278370 - DNA, 21 bp, Homo sapiens
aaatgctatggaaatacattt

SEQ ID NO: 2278371 - DNA, 13 bp, Homo sapiens
aaatgctatttta

SEQ ID NO: 2278372 - DNA, 14 bp, Homo sapiens
aaatgctttaaata

SEQ ID NO: 2278373 - DNA, 15 bp, Homo sapiens
aaatgctttctcatg

SEQ ID NO: 2278374 - DNA, 18 bp, Homo sapiens
aaatgctttctcatgcat

SEQ ID NO: 2278375 - DNA, 21 bp, Homo sapiens
aaatgctttctcatgcataga

SEQ ID NO: 2278376 - DNA, 17 bp, Homo sapiens
aaatggacgtgttatga

SEQ ID NO: 2278377 - DNA, 21 bp, Homo sapiens
aaatggacgtgttatgactcc

SEQ ID NO: 2278378 - DNA, 21 bp, Homo sapiens
aaatgtgatttttttatataa

SEQ ID NO: 2278379 - DNA, 12 bp, Homo sapiens
aaatgtgcttca

SEQ ID NO: 2278380 - DNA, 20 bp, Homo sapiens
aaatgtgcttcattgtttga

SEQ ID NO: 2278381 - DNA, 17 bp, Homo sapiens
aaatgttgtatttcaaa

SEQ ID NO: 2278382 - DNA, 21 bp, Homo sapiens
aaatgtttacattttctttca

SEQ ID NO: 2278383 - DNA, 18 bp, Homo sapiens
aaatgtttccttttagtt

SEQ ID NO: 2278384 - DNA, 16 bp, Homo sapiens
aaatgtttctttttct

SEQ ID NO: 2278385 - DNA, 17 bp, Homo sapiens
aaatgtttctttttctt

SEQ ID NO: 2278386 - DNA, 16 bp, Homo sapiens
aaattacattatgccc

SEQ ID NO: 2278387 - DNA, 13 bp, Homo sapiens
aaattagtgagat

SEQ ID NO: 2278388 - DNA, 15 bp, Homo sapiens
aaattataatgcatc

SEQ ID NO: 2278389 - DNA, 16 bp, Homo sapiens
aaattcaacaaatgat

SEQ ID NO: 2278390 - DNA, 14 bp, Homo sapiens
aaattcacactgtg

SEQ ID NO: 2278391 - DNA, 16 bp, Homo sapiens
aaattctagtctctga

SEQ ID NO: 2278392 - DNA, 16 bp, Homo sapiens
aaattgttatttcaat

SEQ ID NO: 2278393 - DNA, 17 bp, Homo sapiens
aaattgttcaaaaataa

SEQ ID NO: 2278394 - DNA, 18 bp, Homo sapiens
aaatttaaaaagcccaac

SEQ ID NO: 2278395 - DNA, 13 bp, Homo sapiens
aaatttaaaaatc

SEQ ID NO: 2278396 - DNA, 16 bp, Homo sapiens
aaatttaaaaatcttt

SEQ ID NO: 2278397 - DNA, 14 bp, Homo sapiens
aaatttaatatact

SEQ ID NO: 2278398 - DNA, 20 bp, Homo sapiens
aaatttaatatactgcatat

SEQ ID NO: 2278399 - DNA, 22 bp, Homo sapiens
aaatttaattgtgtaactgttc

SEQ ID NO: 2278400 - DNA, 20 bp, Homo sapiens
aaatttagtgctcagaatcc

SEQ ID NO: 2278401 - DNA, 22 bp, Homo sapiens
aaatttgatcccaatagaatac

SEQ ID NO: 2278402 - DNA, 13 bp, Homo sapiens
aaattttctacag

SEQ ID NO: 2278403 - DNA, 19 bp, Homo sapiens
aaatttttaaatcatttca

SEQ ID NO: 2278404 - DNA, 21 bp, Homo sapiens
aaatttttactcaggctttct

SEQ ID NO: 2278405 - DNA, 14 bp, Homo sapiens
aacaaaaatagaat

SEQ ID NO: 2278406 - DNA, 15 bp, Homo sapiens
aacaaaaatagaata

SEQ ID NO: 2278407 - DNA, 20 bp, Homo sapiens
aacaaaaatagaatatataa

SEQ ID NO: 2278408 - DNA, 21 bp, Homo sapiens
aacaaaatatttatttgtttt

SEQ ID NO: 2278409 - DNA, 16 bp, Homo sapiens
aacaaacaccttctta

SEQ ID NO: 2278410 - DNA, 15 bp, Homo sapiens
aacaaactgaaaaat

SEQ ID NO: 2278411 - DNA, 21 bp, Homo sapiens
aacaaaggatttgaaaacacc

SEQ ID NO: 2278412 - DNA, 18 bp, Homo sapiens
aacaactgagatgttaaa

SEQ ID NO: 2278413 - DNA, 23 bp, Homo sapiens
aacaactgccaaataaaatgttt

SEQ ID NO: 2278414 - DNA, 14 bp, Homo sapiens
aacaagatttccct

SEQ ID NO: 2278415 - DNA, 18 bp, Homo sapiens
aacaaggcaaggctgtca

SEQ ID NO: 2278416 - DNA, 20 bp, Homo sapiens
aacacacttttctttttaaa

SEQ ID NO: 2278417 - DNA, 18 bp, Homo sapiens
aacaccactttgtctctg

SEQ ID NO: 2278418 - DNA, 16 bp, Homo sapiens
aacactaatggccaag

SEQ ID NO: 2278419 - DNA, 19 bp, Homo sapiens
aacactcactgcctgcagc

SEQ ID NO: 2278420 - DNA, 13 bp, Homo sapiens
aacactcacttaa

SEQ ID NO: 2278421 - DNA, 21 bp, Homo sapiens
aacactcacttaattctcatt

SEQ ID NO: 2278422 - DNA, 11 bp, Homo sapiens
aacactctgag

SEQ ID NO: 2278423 - DNA, 13 bp, Homo sapiens
aacactctgagac

SEQ ID NO: 2278424 - DNA, 21 bp, Homo sapiens
aacactgcagtgttattttct

SEQ ID NO: 2278425 - DNA, 18 bp, Homo sapiens
aacacttattttctgaat

SEQ ID NO: 2278426 - DNA, 23 bp, Homo sapiens
aacacttattttctgaattcata

SEQ ID NO: 2278427 - DNA, 20 bp, Homo sapiens
aacagaaacgagatttgcca

SEQ ID NO: 2278428 - DNA, 16 bp, Homo sapiens
aacagaacagcaagta

SEQ ID NO: 2278429 - DNA, 19 bp, Homo sapiens
aacagaccagcatagttct

SEQ ID NO: 2278430 - DNA, 20 bp, Homo sapiens
aacagaggaccagcacactc

SEQ ID NO: 2278431 - DNA, 17 bp, Homo sapiens
aacagagtatatatgta

SEQ ID NO: 2278432 - DNA, 18 bp, Homo sapiens
aacagagtatatatgtac

SEQ ID NO: 2278433 - DNA, 21 bp, Homo sapiens
aacagatgagaagactagcag

SEQ ID NO: 2278434 - DNA, 22 bp, Homo sapiens
aacagcatccccaaaacaaagt

SEQ ID NO: 2278435 - DNA, 17 bp, Homo sapiens
aacagcatgtctactgc

SEQ ID NO: 2278436 - DNA, 18 bp, Homo sapiens
aacagggcaaccaataaa

SEQ ID NO: 2278437 - DNA, 21 bp, Homo sapiens
aacagggcaaccaataaaagt

SEQ ID NO: 2278438 - DNA, 16 bp, Homo sapiens
aacaggggctggaggg

SEQ ID NO: 2278439 - DNA, 22 bp, Homo sapiens
aacaggggctggagggctgggc

SEQ ID NO: 2278440 - DNA, 15 bp, Homo sapiens
aacaggtgttcctcc

SEQ ID NO: 2278441 - DNA, 17 bp, Homo sapiens
aacaggtgttcctcctc

SEQ ID NO: 2278442 - DNA, 18 bp, Homo sapiens
aacagtggcaagctacca

SEQ ID NO: 2278443 - DNA, 22 bp, Homo sapiens
aacagttctcccttcaactgta

SEQ ID NO: 2278444 - DNA, 17 bp, Homo sapiens
aacagttggtgatttta

SEQ ID NO: 2278445 - DNA, 17 bp, Homo sapiens
aacataaacttgtactt

SEQ ID NO: 2278446 - DNA, 18 bp, Homo sapiens
aacataaagaaacacttt

SEQ ID NO: 2278447 - DNA, 22 bp, Homo sapiens
aacataatatcttgaagaatat

SEQ ID NO: 2278448 - DNA, 21 bp, Homo sapiens
aacataatgatactgaattgt

SEQ ID NO: 2278449 - DNA, 23 bp, Homo sapiens
aacatacatctaagtcagtttca

SEQ ID NO: 2278450 - DNA, 18 bp, Homo sapiens
aacatagcacagtattta

SEQ ID NO: 2278451 - DNA, 15 bp, Homo sapiens
aacatccactctctc

SEQ ID NO: 2278452 - DNA, 13 bp, Homo sapiens
aacatctgaaaag

SEQ ID NO: 2278453 - DNA, 16 bp, Homo sapiens
aacatctgaaaagaaa

SEQ ID NO: 2278454 - DNA, 18 bp, Homo sapiens
aacatctgaaaagaaatg

SEQ ID NO: 2278455 - DNA, 18 bp, Homo sapiens
aacattctttaacataca

SEQ ID NO: 2278456 - DNA, 12 bp, Homo sapiens
aacattgagact

SEQ ID NO: 2278457 - DNA, 16 bp, Homo sapiens
aacattgagactgcta

SEQ ID NO: 2278458 - DNA, 11 bp, Homo sapiens
aacatttcaca

SEQ ID NO: 2278459 - DNA, 17 bp, Homo sapiens
aacatttcacagtattt

SEQ ID NO: 2278460 - DNA, 21 bp, Homo sapiens
aacatttgggacctggataat

SEQ ID NO: 2278461 - DNA, 22 bp, Homo sapiens
aagcccacccgccccagagact

SEQ ID NO: 2278462 - DNA, 14 bp, Homo sapiens
aagcctcctgctga

SEQ ID NO: 2278463 - DNA, 23 bp, Homo sapiens
aagcgatcctccttcctcatcct

SEQ ID NO: 2278464 - DNA, 18 bp, Homo sapiens
aagcgttaagggcagagt

SEQ ID NO: 2278465 - DNA, 22 bp, Homo sapiens
aagctgaagatccccattcttt

SEQ ID NO: 2278466 - DNA, 19 bp, Homo sapiens
aagctgctcactgctcaca

SEQ ID NO: 2278467 - DNA, 19 bp, Homo sapiens
aagctttagattgaaattt

SEQ ID NO: 2278468 - DNA, 23 bp, Homo sapiens
aagctttagattgaaatttatga

SEQ ID NO: 2278469 - DNA, 14 bp, Homo sapiens
aaggaaaagagaaa

SEQ ID NO: 2278470 - DNA, 15 bp, Homo sapiens
aaggaagaataattt

SEQ ID NO: 2278471 - DNA, 14 bp, Homo sapiens
aaggacaggatggc

SEQ ID NO: 2278472 - DNA, 13 bp, Homo sapiens
aaggagacagaat

SEQ ID NO: 2278473 - DNA, 11 bp, Homo sapiens
aaggatcctga

SEQ ID NO: 2278474 - DNA, 22 bp, Homo sapiens
aaggatcctgagccagatttca

SEQ ID NO: 2278475 - DNA, 21 bp, Homo sapiens
aaggattcttttttcaatgta

SEQ ID NO: 2278476 - DNA, 16 bp, Homo sapiens
aaggatttgaaaacac

SEQ ID NO: 2278477 - DNA, 18 bp, Homo sapiens
aaggcaaggctgtcaatt

SEQ ID NO: 2278478 - DNA, 12 bp, Homo sapiens
aaggcctgaggg

SEQ ID NO: 2278479 - DNA, 19 bp, Homo sapiens
aaggcctgagggaagccca

SEQ ID NO: 2278480 - DNA, 13 bp, Homo sapiens
aaggctgaatcaa

SEQ ID NO: 2278481 - DNA, 23 bp, Homo sapiens
aaggctgctaagtggaagacaga

SEQ ID NO: 2278482 - DNA, 14 bp, Homo sapiens
aaggctggctgtgt

SEQ ID NO: 2278483 - DNA, 17 bp, Homo sapiens
aagggagccatgctctt

SEQ ID NO: 2278484 - DNA, 23 bp, Homo sapiens
aagggatccagagacctgctcca

SEQ ID NO: 2278485 - DNA, 17 bp, Homo sapiens
aagggcaagctggagtt

SEQ ID NO: 2278486 - DNA, 11 bp, Homo sapiens
aagggcagagt

SEQ ID NO: 2278487 - DNA, 18 bp, Homo sapiens
aagggcagcaagataaac

SEQ ID NO: 2278488 - DNA, 16 bp, Homo sapiens
aagggctttaaataaa

SEQ ID NO: 2278489 - DNA, 20 bp, Homo sapiens
aaggggcaaaaaaaaaaatt

SEQ ID NO: 2278490 - DNA, 21 bp, Homo sapiens
aaggggcccattcagcctcgt

SEQ ID NO: 2278491 - DNA, 15 bp, Homo sapiens
aaggggtggaagggc

SEQ ID NO: 2278492 - DNA, 20 bp, Homo sapiens
aaggggtggaagggcaggag

SEQ ID NO: 2278493 - DNA, 17 bp, Homo sapiens
aagggtaaattataaat

SEQ ID NO: 2278494 - DNA, 18 bp, Homo sapiens
aagggtaaattataaatg

SEQ ID NO: 2278495 - DNA, 15 bp, Homo sapiens
aagggtgggccctgg

SEQ ID NO: 2278496 - DNA, 18 bp, Homo sapiens
aagggtgggccctggagg

SEQ ID NO: 2278497 - DNA, 15 bp, Homo sapiens
aaggtatgtaaactt

SEQ ID NO: 2278498 - DNA, 20 bp, Homo sapiens
aaggtatgtaaactttcctg

SEQ ID NO: 2278499 - DNA, 22 bp, Homo sapiens
aaggtatgtaaactttcctgta

SEQ ID NO: 2278500 - DNA, 17 bp, Homo sapiens
aagtaaaattagagcaa

SEQ ID NO: 2278501 - DNA, 21 bp, Homo sapiens
aagtaaaattagagcaagaac

SEQ ID NO: 2278502 - DNA, 21 bp, Homo sapiens
aagtacttgagaataaatgag

SEQ ID NO: 2278503 - DNA, 19 bp, Homo sapiens
aagtacttttgattatttt

SEQ ID NO: 2278504 - DNA, 14 bp, Homo sapiens
aagtatacatttag

SEQ ID NO: 2278505 - DNA, 16 bp, Homo sapiens
aagtatacatttagtt

SEQ ID NO: 2278506 - DNA, 19 bp, Homo sapiens
aagtatctctactttcctg

SEQ ID NO: 2278507 - DNA, 20 bp, Homo sapiens
aagtattttatctgtgttgt

SEQ ID NO: 2278508 - DNA, 20 bp, Homo sapiens
aagtcacggtctaaacacac

SEQ ID NO: 2278509 - DNA, 18 bp, Homo sapiens
aagtcatgggagaagagg

SEQ ID NO: 2278510 - DNA, 22 bp, Homo sapiens
aagtcattgctgacagagccct

SEQ ID NO: 2278511 - DNA, 18 bp, Homo sapiens
aagtccacttatgtagac

SEQ ID NO: 2278512 - DNA, 15 bp, Homo sapiens
aagtccagctctccc

SEQ ID NO: 2278513 - DNA, 11 bp, Homo sapiens
aagtctatgct

SEQ ID NO: 2278514 - DNA, 13 bp, Homo sapiens
aagtctatgctta

SEQ ID NO: 2278515 - DNA, 15 bp, Homo sapiens
aagtctgctgctgtg

SEQ ID NO: 2278516 - DNA, 20 bp, Homo sapiens
aagtctgcttaccaaaacat

SEQ ID NO: 2278517 - DNA, 20 bp, Homo sapiens
aagtcttcatggtctcttcc

SEQ ID NO: 2278518 - DNA, 19 bp, Homo sapiens
aagtcttgagcaatgtttt

SEQ ID NO: 2278519 - DNA, 17 bp, Homo sapiens
aagtgctacataaattg

SEQ ID NO: 2278520 - DNA, 12 bp, Homo sapiens
aagtgctcagta

SEQ ID NO: 2278521 - DNA, 14 bp, Homo sapiens
aagtgctcagtatt

SEQ ID NO: 2278522 - DNA, 21 bp, Homo sapiens
aagtgctgggattacaggtgt

SEQ ID NO: 2278523 - DNA, 14 bp, Homo sapiens
aagtgcttcctttt

SEQ ID NO: 2278524 - DNA, 20 bp, Homo sapiens
aagtggaagacagagatggc

SEQ ID NO: 2278525 - DNA, 21 bp, Homo sapiens
aagtggaatttcttgtttctc

SEQ ID NO: 2278526 - DNA, 13 bp, Homo sapiens
aagtgtgtgtttc

SEQ ID NO: 2278527 - DNA, 16 bp, Homo sapiens
aagtgttgtaccatat

SEQ ID NO: 2278528 - DNA, 16 bp, Homo sapiens
aagtgtttttctttaa

SEQ ID NO: 2278529 - DNA, 21 bp, Homo sapiens
aagttacacggggttacactg

SEQ ID NO: 2278530 - DNA, 23 bp, Homo sapiens
aagttacacggggttacactgtt

SEQ ID NO: 2278531 - DNA, 15 bp, Homo sapiens
aagttaccttttata

SEQ ID NO: 2278532 - DNA, 20 bp, Homo sapiens
aagttaccttttataagaca

SEQ ID NO: 2278533 - DNA, 14 bp, Homo sapiens
aagttagaatctat

SEQ ID NO: 2278534 - DNA, 16 bp, Homo sapiens
aagttagaatctattt

SEQ ID NO: 2278535 - DNA, 19 bp, Homo sapiens
aagttagaatctattttct

SEQ ID NO: 2278536 - DNA, 16 bp, Homo sapiens
aagttagggcattttt

SEQ ID NO: 2278537 - DNA, 18 bp, Homo sapiens
aagttagggcatttttct

SEQ ID NO: 2278538 - DNA, 19 bp, Homo sapiens
aagttagggcatttttctt

SEQ ID NO: 2278539 - DNA, 23 bp, Homo sapiens
aagttagggcatttttcttggat

SEQ ID NO: 2278540 - DNA, 18 bp, Homo sapiens
aagttatgtgttaaattt

SEQ ID NO: 2278541 - DNA, 23 bp, Homo sapiens
aagttcatcctttgactgtgctg

SEQ ID NO: 2278542 - DNA, 22 bp, Homo sapiens
aagttcattcatactcaaagag

SEQ ID NO: 2278543 - DNA, 18 bp, Homo sapiens
aagttctattatctgggt

SEQ ID NO: 2278544 - DNA, 22 bp, Homo sapiens
aagttgctaacctcaatttatg

SEQ ID NO: 2278545 - DNA, 18 bp, Homo sapiens
aagttgtgataaatttga

SEQ ID NO: 2278546 - DNA, 22 bp, Homo sapiens
aagtttgtctacactaaaattt

SEQ ID NO: 2278547 - DNA, 15 bp, Homo sapiens
aataaaataaattat

SEQ ID NO: 2278548 - DNA, 14 bp, Homo sapiens
aataaaatgtttac

SEQ ID NO: 2278549 - DNA, 16 bp, Homo sapiens
aataaaatgtttacat

SEQ ID NO: 2278550 - DNA, 18 bp, Homo sapiens
aataaaatgtttacattt

SEQ ID NO: 2278551 - DNA, 13 bp, Homo sapiens
aataaagaagaaa

SEQ ID NO: 2278552 - DNA, 12 bp, Homo sapiens
aataaatctaaa

SEQ ID NO: 2278553 - DNA, 13 bp, Homo sapiens
aataaatgaaaaa

SEQ ID NO: 2278554 - DNA, 18 bp, Homo sapiens
aataaatgtgtaaatgtg

SEQ ID NO: 2278555 - DNA, 16 bp, Homo sapiens
aataacatctgaaaag

SEQ ID NO: 2278556 - DNA, 18 bp, Homo sapiens
aataactagatctcctgt

SEQ ID NO: 2278557 - DNA, 22 bp, Homo sapiens
aataactagatctcctgtaatt

SEQ ID NO: 2278558 - DNA, 22 bp, Homo sapiens
aataactgatgagatacatttg

SEQ ID NO: 2278559 - DNA, 21 bp, Homo sapiens
aataagtgttgtaccatatgt

SEQ ID NO: 2278560 - DNA, 23 bp, Homo sapiens
aataagtgttgtaccatatgtag

SEQ ID NO: 2278561 - DNA, 19 bp, Homo sapiens
aataagttgactttcaaat

SEQ ID NO: 2278562 - DNA, 15 bp, Homo sapiens
aataatcctctatgt

SEQ ID NO: 2278563 - DNA, 15 bp, Homo sapiens
aataatgattcaatg

SEQ ID NO: 2278564 - DNA, 23 bp, Homo sapiens
aataatgcttaacataaacttgt

SEQ ID NO: 2278565 - DNA, 15 bp, Homo sapiens
aataattacttaatg

SEQ ID NO: 2278566 - DNA, 22 bp, Homo sapiens
aataattttaacagacatgtat

SEQ ID NO: 2278567 - DNA, 14 bp, Homo sapiens
aatacactacaaat

SEQ ID NO: 2278568 - DNA, 18 bp, Homo sapiens
aatacagtctagtttcct

SEQ ID NO: 2278569 - DNA, 19 bp, Homo sapiens
aatacataaaagaatgtac

SEQ ID NO: 2278570 - DNA, 19 bp, Homo sapiens
aatacattgtgttttccta

SEQ ID NO: 2278571 - DNA, 12 bp, Homo sapiens
aatacatttaga

SEQ ID NO: 2278572 - DNA, 13 bp, Homo sapiens
aataccaactatt

SEQ ID NO: 2278573 - DNA, 23 bp, Homo sapiens
aatacccttgttttttatagttg

SEQ ID NO: 2278574 - DNA, 16 bp, Homo sapiens
aatactaatttataat

SEQ ID NO: 2278575 - DNA, 16 bp, Homo sapiens
aatactcaccaaaata

SEQ ID NO: 2278576 - DNA, 15 bp, Homo sapiens
aatactctacaagaa

SEQ ID NO: 2278577 - DNA, 16 bp, Homo sapiens
aatactgaaaaagaat

SEQ ID NO: 2278578 - DNA, 23 bp, Homo sapiens
aatacttccttataaaaattcta

SEQ ID NO: 2278579 - DNA, 12 bp, Homo sapiens
aatagaatacct

SEQ ID NO: 2278580 - DNA, 13 bp, Homo sapiens
aatagaatatata

SEQ ID NO: 2278581 - DNA, 15 bp, Homo sapiens
aatagaatatataaa

SEQ ID NO: 2278582 - DNA, 23 bp, Homo sapiens
aatagataacagagaatcttgat

SEQ ID NO: 2278583 - DNA, 16 bp, Homo sapiens
aatagcaatagcatgg

SEQ ID NO: 2278584 - DNA, 21 bp, Homo sapiens
aatagtattctgatcagttgc

SEQ ID NO: 2278585 - DNA, 16 bp, Homo sapiens
aatagtcatgtttctg

SEQ ID NO: 2278586 - DNA, 18 bp, Homo sapiens
aatagtcctccaaaacac

SEQ ID NO: 2278587 - DNA, 16 bp, Homo sapiens
aatagttccattctat

SEQ ID NO: 2278588 - DNA, 19 bp, Homo sapiens
aatagttctatttctatct

SEQ ID NO: 2278589 - DNA, 16 bp, Homo sapiens
aatagtttaaaaatat

SEQ ID NO: 2278590 - DNA, 18 bp, Homo sapiens
aatagtttaaaaatattc

SEQ ID NO: 2278591 - DNA, 17 bp, Homo sapiens
aatagtttacttcactt

SEQ ID NO: 2278592 - DNA, 20 bp, Homo sapiens
aatagtttcaaatgagttta

SEQ ID NO: 2278593 - DNA, 19 bp, Homo sapiens
aatgtatcttatttatata

SEQ ID NO: 2278594 - DNA, 22 bp, Homo sapiens
aatgtatcttatttatatatga

SEQ ID NO: 2278595 - DNA, 13 bp, Homo sapiens
aatgtcagtgtga

SEQ ID NO: 2278596 - DNA, 12 bp, Homo sapiens
aatgtcatctct

SEQ ID NO: 2278597 - DNA, 23 bp, Homo sapiens
aatgtccccattctataaattca

SEQ ID NO: 2278598 - DNA, 18 bp, Homo sapiens
aatgtgagctataatgtt

SEQ ID NO: 2278599 - DNA, 17 bp, Homo sapiens
aatgtgccaaaatgtca

SEQ ID NO: 2278600 - DNA, 13 bp, Homo sapiens
aatgtgctgccta

SEQ ID NO: 2278601 - DNA, 15 bp, Homo sapiens
aatgtgcttttccat

SEQ ID NO: 2278602 - DNA, 12 bp, Homo sapiens
aatgttatttct

SEQ ID NO: 2278603 - DNA, 16 bp, Homo sapiens
aatgttgttaaatgct

SEQ ID NO: 2278604 - DNA, 20 bp, Homo sapiens
aatgtttacattttctttca

SEQ ID NO: 2278605 - DNA, 21 bp, Homo sapiens
aatgtttccaggcatgaccct

SEQ ID NO: 2278606 - DNA, 23 bp, Homo sapiens
aatgtttccaggcatgaccctgg

SEQ ID NO: 2278607 - DNA, 23 bp, Homo sapiens
aatgtttcctgtggaaatatgca

SEQ ID NO: 2278608 - DNA, 14 bp, Homo sapiens
aatgtttctttttc

SEQ ID NO: 2278609 - DNA, 15 bp, Homo sapiens
aatgtttctttttct

SEQ ID NO: 2278610 - DNA, 17 bp, Homo sapiens
aatgtttttctcaaaaa

SEQ ID NO: 2278611 - DNA, 11 bp, Homo sapiens
aattaaaaaat

SEQ ID NO: 2278612 - DNA, 14 bp, Homo sapiens
aattaaagacattt

SEQ ID NO: 2278613 - DNA, 21 bp, Homo sapiens
aattaacctttcaggaaagta

SEQ ID NO: 2278614 - DNA, 18 bp, Homo sapiens
aattaagttattaacatt

SEQ ID NO: 2278615 - DNA, 17 bp, Homo sapiens
aattacaggaagtactg

SEQ ID NO: 2278616 - DNA, 20 bp, Homo sapiens
aattacaggttccttttgaa

SEQ ID NO: 2278617 - DNA, 14 bp, Homo sapiens
aattactttcagaa

SEQ ID NO: 2278618 - DNA, 19 bp, Homo sapiens
aattagagatatttttata

SEQ ID NO: 2278619 - DNA, 16 bp, Homo sapiens
aattagtgagatttgt

SEQ ID NO: 2278620 - DNA, 17 bp, Homo sapiens
aattagtgagatttgta

SEQ ID NO: 2278621 - DNA, 18 bp, Homo sapiens
aattataaatgtttcatg

SEQ ID NO: 2278622 - DNA, 15 bp, Homo sapiens
aattattacactgta

SEQ ID NO: 2278623 - DNA, 17 bp, Homo sapiens
aattatttaactaatta

SEQ ID NO: 2278624 - DNA, 11 bp, Homo sapiens
aattcagttgt

SEQ ID NO: 2278625 - DNA, 14 bp, Homo sapiens
aattcataaaaata

SEQ ID NO: 2278626 - DNA, 19 bp, Homo sapiens
aattcatggaactttcata

SEQ ID NO: 2278627 - DNA, 16 bp, Homo sapiens
aattcatttaagaaca

SEQ ID NO: 2278628 - DNA, 14 bp, Homo sapiens
aattccaccaggat

SEQ ID NO: 2278629 - DNA, 16 bp, Homo sapiens
aattcctggaaaactg

SEQ ID NO: 2278630 - DNA, 20 bp, Homo sapiens
aattctagtctgtttcatta

SEQ ID NO: 2278631 - DNA, 19 bp, Homo sapiens
aattctcattatgaagatg

SEQ ID NO: 2278632 - DNA, 21 bp, Homo sapiens
aattctcattatgaagatgtt

SEQ ID NO: 2278633 - DNA, 20 bp, Homo sapiens
aattctgttacacaatatgt

SEQ ID NO: 2278634 - DNA, 11 bp, Homo sapiens
aattcttttga

SEQ ID NO: 2278635 - DNA, 16 bp, Homo sapiens
aattcttttgaaagat

SEQ ID NO: 2278636 - DNA, 23 bp, Homo sapiens
aattcttttgaaagatggtaatc

SEQ ID NO: 2278637 - DNA, 21 bp, Homo sapiens
aattgaaatttttaaatcatt

SEQ ID NO: 2278638 - DNA, 20 bp, Homo sapiens
aattgacctgatttccattt

SEQ ID NO: 2278639 - DNA, 17 bp, Homo sapiens
aattgcacgtttggtga

SEQ ID NO: 2278640 - DNA, 12 bp, Homo sapiens
aattggaatcaa

SEQ ID NO: 2278641 - DNA, 20 bp, Homo sapiens
aattggtattatcaaagcat

SEQ ID NO: 2278642 - DNA, 16 bp, Homo sapiens
aattgtagaacataga

SEQ ID NO: 2278643 - DNA, 17 bp, Homo sapiens
aattgtagaacatagat

SEQ ID NO: 2278644 - DNA, 21 bp, Homo sapiens
aattgtagaacatagatgcta

SEQ ID NO: 2278645 - DNA, 16 bp, Homo sapiens
aattgtgtaactgttc

SEQ ID NO: 2278646 - DNA, 21 bp, Homo sapiens
aattgtgttcttaaaatattg

SEQ ID NO: 2278647 - DNA, 22 bp, Homo sapiens
aattgttatgtaaacatcataa

SEQ ID NO: 2278648 - DNA, 15 bp, Homo sapiens
aattgttatttcaat

SEQ ID NO: 2278649 - DNA, 17 bp, Homo sapiens
aattgttatttcaatag

SEQ ID NO: 2278650 - DNA, 19 bp, Homo sapiens
aattgttcttaaaaccaat

SEQ ID NO: 2278651 - DNA, 20 bp, Homo sapiens
aattgttgaatgtattcttt

SEQ ID NO: 2278652 - DNA, 14 bp, Homo sapiens
aattgtttaaaagc

SEQ ID NO: 2278653 - DNA, 17 bp, Homo sapiens
aatttaaaaagcccaac

SEQ ID NO: 2278654 - DNA, 13 bp, Homo sapiens
aatttaaaaatct

SEQ ID NO: 2278655 - DNA, 17 bp, Homo sapiens
aatttaattgtgtaact

SEQ ID NO: 2278656 - DNA, 22 bp, Homo sapiens
aatttaattgtgtaactgttct

SEQ ID NO: 2278657 - DNA, 17 bp, Homo sapiens
aatttagatattcatac

SEQ ID NO: 2278658 - DNA, 18 bp, Homo sapiens
aatttagccagaatgttt

SEQ ID NO: 2278659 - DNA, 22 bp, Homo sapiens
aatttagccagaatgtttcctg

SEQ ID NO: 2278660 - DNA, 22 bp, Homo sapiens
aatttatcttccatatgctctt

SEQ ID NO: 2278661 - DNA, 13 bp, Homo sapiens
aatttatgactag

SEQ ID NO: 2278662 - DNA, 19 bp, Homo sapiens
aatttatttatgttctcaa

SEQ ID NO: 2278663 - DNA, 16 bp, Homo sapiens
aatttctaatttcaag

SEQ ID NO: 2278664 - DNA, 11 bp, Homo sapiens
aatttcttgtt

SEQ ID NO: 2278665 - DNA, 21 bp, Homo sapiens
aatttgccatagcagtgctag

SEQ ID NO: 2278666 - DNA, 23 bp, Homo sapiens
aatttggggacagattcagtctt

SEQ ID NO: 2278667 - DNA, 18 bp, Homo sapiens
aatttgtgaatatatttt

SEQ ID NO: 2278668 - DNA, 13 bp, Homo sapiens
aatttgtgtagat

SEQ ID NO: 2278669 - DNA, 14 bp, Homo sapiens
aattttaaaaaata

SEQ ID NO: 2278670 - DNA, 17 bp, Homo sapiens
aattttaaaaaataaca

SEQ ID NO: 2278671 - DNA, 15 bp, Homo sapiens
aattttaaaaatcta

SEQ ID NO: 2278672 - DNA, 22 bp, Homo sapiens
aatttttaccatagttttctca

SEQ ID NO: 2278673 - DNA, 17 bp, Homo sapiens
aatttttactcaggctt

SEQ ID NO: 2278674 - DNA, 15 bp, Homo sapiens
acaaaaatagaatat

SEQ ID NO: 2278675 - DNA, 17 bp, Homo sapiens
acaaaaggctggatgtg

SEQ ID NO: 2278676 - DNA, 23 bp, Homo sapiens
acaaaaggctggatgtgctttca

SEQ ID NO: 2278677 - DNA, 15 bp, Homo sapiens
acaaaatatttctaa

SEQ ID NO: 2278678 - DNA, 13 bp, Homo sapiens
acaaaatgaaacg

SEQ ID NO: 2278679 - DNA, 21 bp, Homo sapiens
acaaacaccttcttattatat

SEQ ID NO: 2278680 - DNA, 14 bp, Homo sapiens
acaaactgtcgtct

SEQ ID NO: 2278681 - DNA, 15 bp, Homo sapiens
acaaacttactgtca

SEQ ID NO: 2278682 - DNA, 22 bp, Homo sapiens
acaaatagtaggctaaaaacat

SEQ ID NO: 2278683 - DNA, 16 bp, Homo sapiens
acaaatatagttgaac

SEQ ID NO: 2278684 - DNA, 20 bp, Homo sapiens
acaaatcaccttaactccct

SEQ ID NO: 2278685 - DNA, 14 bp, Homo sapiens
acaaatttttactc

SEQ ID NO: 2278686 - DNA, 15 bp, Homo sapiens
acaaatttttactca

SEQ ID NO: 2278687 - DNA, 20 bp, Homo sapiens
acaaatttttactcaggctt

SEQ ID NO: 2278688 - DNA, 18 bp, Homo sapiens
acaacaaagtgcttcctt

SEQ ID NO: 2278689 - DNA, 17 bp, Homo sapiens
acaacatctttttctac

SEQ ID NO: 2278690 - DNA, 14 bp, Homo sapiens
acaacattaatttt

SEQ ID NO: 2278691 - DNA, 17 bp, Homo sapiens
acaacattaattttatg

SEQ ID NO: 2278692 - DNA, 14 bp, Homo sapiens
acaaccatagaact

SEQ ID NO: 2278693 - DNA, 15 bp, Homo sapiens
acaaccatagaactg

SEQ ID NO: 2278694 - DNA, 17 bp, Homo sapiens
acaactgagatgttaaa

SEQ ID NO: 2278695 - DNA, 17 bp, Homo sapiens
acaagaaaaagtagaaa

SEQ ID NO: 2278696 - DNA, 21 bp, Homo sapiens
acaagccaaacattcttattt

SEQ ID NO: 2278697 - DNA, 12 bp, Homo sapiens
acaagccagagc

SEQ ID NO: 2278698 - DNA, 14 bp, Homo sapiens
acaagccagagccg

SEQ ID NO: 2278699 - DNA, 14 bp, Homo sapiens
acaaggcaaggctg

SEQ ID NO: 2278700 - DNA, 17 bp, Homo sapiens
acaaggcaaggctgtca

SEQ ID NO: 2278701 - DNA, 20 bp, Homo sapiens
acaaggcaaggctgtcaatt

SEQ ID NO: 2278702 - DNA, 21 bp, Homo sapiens
acaaggggtggaagggcagga

SEQ ID NO: 2278703 - DNA, 19 bp, Homo sapiens
acaagtcacggtctaaaca

SEQ ID NO: 2278704 - DNA, 17 bp, Homo sapiens
acaagtgctctttccac

SEQ ID NO: 2278705 - DNA, 21 bp, Homo sapiens
acaataagcgttaagggcaga

SEQ ID NO: 2278706 - DNA, 15 bp, Homo sapiens
acaataatgaataat

SEQ ID NO: 2278707 - DNA, 19 bp, Homo sapiens
acaatgcaaaccatcattg

SEQ ID NO: 2278708 - DNA, 20 bp, Homo sapiens
acaatgtaattacattaaaa

SEQ ID NO: 2278709 - DNA, 19 bp, Homo sapiens
acaattgaaatttttaaat

SEQ ID NO: 2278710 - DNA, 22 bp, Homo sapiens
acaattgaaatttttaaatcat

SEQ ID NO: 2278711 - DNA, 13 bp, Homo sapiens
acaatttgccata

SEQ ID NO: 2278712 - DNA, 16 bp, Homo sapiens
acaattttcatcccac

SEQ ID NO: 2278713 - DNA, 23 bp, Homo sapiens
acacaaaggggatcataaagtta

SEQ ID NO: 2278714 - DNA, 16 bp, Homo sapiens
acacacagcagctcca

SEQ ID NO: 2278715 - DNA, 18 bp, Homo sapiens
acacacaggccatttcat

SEQ ID NO: 2278716 - DNA, 19 bp, Homo sapiens
acacacttagaatactaca

SEQ ID NO: 2278717 - DNA, 11 bp, Homo sapiens
acacagcagct

SEQ ID NO: 2278718 - DNA, 20 bp, Homo sapiens
acacagcagctccaacctgg

SEQ ID NO: 2278719 - DNA, 16 bp, Homo sapiens
acacagttggaagcag

SEQ ID NO: 2278720 - DNA, 14 bp, Homo sapiens
acacatgcactcag

SEQ ID NO: 2278721 - DNA, 14 bp, Homo sapiens
acacatttaattca

SEQ ID NO: 2278722 - DNA, 17 bp, Homo sapiens
acacctgcctctgaact

SEQ ID NO: 2278723 - DNA, 23 bp, Homo sapiens
acacgcacttctggggccagccc

SEQ ID NO: 2278724 - DNA, 15 bp, Homo sapiens
acacgccggggctgg

SEQ ID NO: 2278725 - DNA, 17 bp, Homo sapiens
acacgccggggctggcc

SEQ ID NO: 2278726 - DNA, 18 bp, Homo sapiens
acatttgatcttgtaaaa

SEQ ID NO: 2278727 - DNA, 15 bp, Homo sapiens
acattttctttcata

SEQ ID NO: 2278728 - DNA, 14 bp, Homo sapiens
accaaatggaaaca

SEQ ID NO: 2278729 - DNA, 17 bp, Homo sapiens
accaaattaacctttca

SEQ ID NO: 2278730 - DNA, 22 bp, Homo sapiens
accaaattctgtggctgccatc

SEQ ID NO: 2278731 - DNA, 15 bp, Homo sapiens
accaactaagttgta

SEQ ID NO: 2278732 - DNA, 15 bp, Homo sapiens
accaactatttcaat

SEQ ID NO: 2278733 - DNA, 19 bp, Homo sapiens
accaactgctttgttttgg

SEQ ID NO: 2278734 - DNA, 16 bp, Homo sapiens
accaagaatgtctcca

SEQ ID NO: 2278735 - DNA, 19 bp, Homo sapiens
accaagatcacaaatagtg

SEQ ID NO: 2278736 - DNA, 21 bp, Homo sapiens
accaagatcacaaatagtgtt

SEQ ID NO: 2278737 - DNA, 23 bp, Homo sapiens
accaagctgttccacttctctag

SEQ ID NO: 2278738 - DNA, 17 bp, Homo sapiens
accaagggtatctgctg

SEQ ID NO: 2278739 - DNA, 20 bp, Homo sapiens
accaatcaacagcatgtcta

SEQ ID NO: 2278740 - DNA, 14 bp, Homo sapiens
accaatcatcttaa

SEQ ID NO: 2278741 - DNA, 19 bp, Homo sapiens
accacatggaacttaaaac

SEQ ID NO: 2278742 - DNA, 23 bp, Homo sapiens
accacgattccaacccaggtctg

SEQ ID NO: 2278743 - DNA, 19 bp, Homo sapiens
accacggggtcgggggagg

SEQ ID NO: 2278744 - DNA, 18 bp, Homo sapiens
accactgtttcttgcttg

SEQ ID NO: 2278745 - DNA, 22 bp, Homo sapiens
accactgtttcttgcttgtacc

SEQ ID NO: 2278746 - DNA, 13 bp, Homo sapiens
accagagcactgt

SEQ ID NO: 2278747 - DNA, 14 bp, Homo sapiens
accagagcactgta

SEQ ID NO: 2278748 - DNA, 15 bp, Homo sapiens
accagagcactgtat

SEQ ID NO: 2278749 - DNA, 16 bp, Homo sapiens
accagagcactgtata

SEQ ID NO: 2278750 - DNA, 17 bp, Homo sapiens
accagagcactgtatac

SEQ ID NO: 2278751 - DNA, 17 bp, Homo sapiens
accagagcgtgcacttg

SEQ ID NO: 2278752 - DNA, 16 bp, Homo sapiens
accagagtcagcacag

SEQ ID NO: 2278753 - DNA, 13 bp, Homo sapiens
accagcacactcc

SEQ ID NO: 2278754 - DNA, 15 bp, Homo sapiens
accagcacactcccg

SEQ ID NO: 2278755 - DNA, 13 bp, Homo sapiens
accagcactccca

SEQ ID NO: 2278756 - DNA, 16 bp, Homo sapiens
accagcactcccaggg

SEQ ID NO: 2278757 - DNA, 18 bp, Homo sapiens
accagcatagttctgcaa

SEQ ID NO: 2278758 - DNA, 12 bp, Homo sapiens
accagcccaggc

SEQ ID NO: 2278759 - DNA, 18 bp, Homo sapiens
accagctattggaacaga

SEQ ID NO: 2278760 - DNA, 15 bp, Homo sapiens
accaggactctgcct

SEQ ID NO: 2278761 - DNA, 16 bp, Homo sapiens
accaggactctgcctt

SEQ ID NO: 2278762 - DNA, 20 bp, Homo sapiens
accaggactctgccttccag

SEQ ID NO: 2278763 - DNA, 19 bp, Homo sapiens
accaggtcctgtgagcaaa

SEQ ID NO: 2278764 - DNA, 13 bp, Homo sapiens
accataaactggg

SEQ ID NO: 2278765 - DNA, 13 bp, Homo sapiens
accatagaactgt

SEQ ID NO: 2278766 - DNA, 23 bp, Homo sapiens
accatcattgaaatctttttgct

SEQ ID NO: 2278767 - DNA, 19 bp, Homo sapiens
accatcatttaatttctaa

SEQ ID NO: 2278768 - DNA, 15 bp, Homo sapiens
accatcccactgata

SEQ ID NO: 2278769 - DNA, 13 bp, Homo sapiens
accatcctctgtt

SEQ ID NO: 2278770 - DNA, 14 bp, Homo sapiens
accatcctctgtta

SEQ ID NO: 2278771 - DNA, 14 bp, Homo sapiens
accatgcatttctc

SEQ ID NO: 2278772 - DNA, 14 bp, Homo sapiens
accatgttgcccag

SEQ ID NO: 2278773 - DNA, 20 bp, Homo sapiens
accattaagaacaaggaatt

SEQ ID NO: 2278774 - DNA, 20 bp, Homo sapiens
accattataaaatctttcca

SEQ ID NO: 2278775 - DNA, 21 bp, Homo sapiens
acccaattttaaaaaataaca

SEQ ID NO: 2278776 - DNA, 20 bp, Homo sapiens
acccacaccccgtctgcccc

SEQ ID NO: 2278777 - DNA, 22 bp, Homo sapiens
acccagccccagcgagtctgga

SEQ ID NO: 2278778 - DNA, 12 bp, Homo sapiens
acccagtgttca

SEQ ID NO: 2278779 - DNA, 16 bp, Homo sapiens
acccagtgttcagcat

SEQ ID NO: 2278780 - DNA, 22 bp, Homo sapiens
accccacttagcctttcttttc

SEQ ID NO: 2278781 - DNA, 20 bp, Homo sapiens
accccatccagccaggggtg

SEQ ID NO: 2278782 - DNA, 13 bp, Homo sapiens
accccatctgctg

SEQ ID NO: 2278783 - DNA, 16 bp, Homo sapiens
accccattctgggact

SEQ ID NO: 2278784 - DNA, 20 bp, Homo sapiens
acccccactttcgcctcctc

SEQ ID NO: 2278785 - DNA, 16 bp, Homo sapiens
acccccagcctccccc

SEQ ID NO: 2278786 - DNA, 17 bp, Homo sapiens
acccccagcctccccca

SEQ ID NO: 2278787 - DNA, 22 bp, Homo sapiens
acccccgtgccaaatcctgggc

SEQ ID NO: 2278788 - DNA, 20 bp, Homo sapiens
accccgtcccggccccgcgc

SEQ ID NO: 2278789 - DNA, 16 bp, Homo sapiens
acccctctaccaagct

SEQ ID NO: 2278790 - DNA, 12 bp, Homo sapiens
acccctgcaggc

SEQ ID NO: 2278791 - DNA, 16 bp, Homo sapiens
acccctgggggaggct

SEQ ID NO: 2278792 - DNA, 17 bp, Homo sapiens
acccctgggggaggctt

SEQ ID NO: 2278793 - DNA, 19 bp, Homo sapiens
acccctgggggaggcttcc

SEQ ID NO: 2278794 - DNA, 21 bp, Homo sapiens
acccctgggggaggcttccag

SEQ ID NO: 2278795 - DNA, 18 bp, Homo sapiens
acccgccccagagactgc

SEQ ID NO: 2278796 - DNA, 22 bp, Homo sapiens
acccgccccagagactgcccac

SEQ ID NO: 2278797 - DNA, 20 bp, Homo sapiens
acccggatgaactcaatgca

SEQ ID NO: 2278798 - DNA, 15 bp, Homo sapiens
acccggcagcccccc

SEQ ID NO: 2278799 - DNA, 22 bp, Homo sapiens
acccggcatgccgagtgcccca

SEQ ID NO: 2278800 - DNA, 22 bp, Homo sapiens
acccggccaggaccttggtgag

SEQ ID NO: 2278801 - DNA, 17 bp, Homo sapiens
accctgagagtctgaga

SEQ ID NO: 2278802 - DNA, 16 bp, Homo sapiens
accctgccaccctctg

SEQ ID NO: 2278803 - DNA, 12 bp, Homo sapiens
accctgccctgc

SEQ ID NO: 2278804 - DNA, 15 bp, Homo sapiens
accctgccctgcacc

SEQ ID NO: 2278805 - DNA, 16 bp, Homo sapiens
accctgccctgcacct

SEQ ID NO: 2278806 - DNA, 12 bp, Homo sapiens
accctggctgga

SEQ ID NO: 2278807 - DNA, 15 bp, Homo sapiens
accctgtaaaagaca

SEQ ID NO: 2278808 - DNA, 17 bp, Homo sapiens
accgaaaacgtggctgc

SEQ ID NO: 2278809 - DNA, 20 bp, Homo sapiens
accgaagggacggggcccgc

SEQ ID NO: 2278810 - DNA, 14 bp, Homo sapiens
accgaggactccag

SEQ ID NO: 2278811 - DNA, 19 bp, Homo sapiens
accgaggactccaggggct

SEQ ID NO: 2278812 - DNA, 16 bp, Homo sapiens
accgcccaacccccac

SEQ ID NO: 2278813 - DNA, 17 bp, Homo sapiens
accgcccaacccccacc

SEQ ID NO: 2278814 - DNA, 18 bp, Homo sapiens
accgcccaacccccacct

SEQ ID NO: 2278815 - DNA, 20 bp, Homo sapiens
accgcccaacccccacctcc

SEQ ID NO: 2278816 - DNA, 16 bp, Homo sapiens
accgcccacccacacc

SEQ ID NO: 2278817 - DNA, 19 bp, Homo sapiens
accgcccctggacaggctt

SEQ ID NO: 2278818 - DNA, 15 bp, Homo sapiens
accggagcggctgag

SEQ ID NO: 2278819 - DNA, 14 bp, Homo sapiens
accgtcaatgtgaa

SEQ ID NO: 2278820 - DNA, 15 bp, Homo sapiens
accgtcaatgtgaaa

SEQ ID NO: 2278821 - DNA, 18 bp, Homo sapiens
accgtggtgtgaggcccc

SEQ ID NO: 2278822 - DNA, 22 bp, Homo sapiens
accgtgtgctccagtgttttct

SEQ ID NO: 2278823 - DNA, 23 bp, Homo sapiens
accgtgtgctccagtgttttctt

SEQ ID NO: 2278824 - DNA, 16 bp, Homo sapiens
acctacatctgaaatc

SEQ ID NO: 2278825 - DNA, 15 bp, Homo sapiens
acctagaaacaagga

SEQ ID NO: 2278826 - DNA, 17 bp, Homo sapiens
acctataaaattatgaa

SEQ ID NO: 2278827 - DNA, 15 bp, Homo sapiens
acctatctgtaagag

SEQ ID NO: 2278828 - DNA, 16 bp, Homo sapiens
acctcactcagcacca

SEQ ID NO: 2278829 - DNA, 17 bp, Homo sapiens
acctcactcagcaccac

SEQ ID NO: 2278830 - DNA, 14 bp, Homo sapiens
acctccacctggga

SEQ ID NO: 2278831 - DNA, 14 bp, Homo sapiens
acctccagattatt

SEQ ID NO: 2278832 - DNA, 13 bp, Homo sapiens
acctccctggctt

SEQ ID NO: 2278833 - DNA, 13 bp, Homo sapiens
acctcctcacatt

SEQ ID NO: 2278834 - DNA, 22 bp, Homo sapiens
acctcctcggctggctgtccac

SEQ ID NO: 2278835 - DNA, 16 bp, Homo sapiens
acctcgccctctctca

SEQ ID NO: 2278836 - DNA, 22 bp, Homo sapiens
acctcgccctctctcaccagcc

SEQ ID NO: 2278837 - DNA, 16 bp, Homo sapiens
acctctaggcctcagt

SEQ ID NO: 2278838 - DNA, 17 bp, Homo sapiens
acctctctctatatata

SEQ ID NO: 2278839 - DNA, 16 bp, Homo sapiens
acctctggctgactaa

SEQ ID NO: 2278840 - DNA, 14 bp, Homo sapiens
acctctgttctcat

SEQ ID NO: 2278841 - DNA, 13 bp, Homo sapiens
acctgacacctgc

SEQ ID NO: 2278842 - DNA, 16 bp, Homo sapiens
acctgaggcaggaggg

SEQ ID NO: 2278843 - DNA, 20 bp, Homo sapiens
acctgaggcaggagggcatg

SEQ ID NO: 2278844 - DNA, 23 bp, Homo sapiens
acctgaggcaggagggcatgtgc

SEQ ID NO: 2278845 - DNA, 17 bp, Homo sapiens
acctgcaaggcaaagta

SEQ ID NO: 2278846 - DNA, 13 bp, Homo sapiens
acctgcaggactc

SEQ ID NO: 2278847 - DNA, 19 bp, Homo sapiens
acctgcatttaagaacaga

SEQ ID NO: 2278848 - DNA, 13 bp, Homo sapiens
acctgccaagagt

SEQ ID NO: 2278849 - DNA, 15 bp, Homo sapiens
acctgccaagagtca

SEQ ID NO: 2278850 - DNA, 20 bp, Homo sapiens
acctgcccagttagcccggc

SEQ ID NO: 2278851 - DNA, 15 bp, Homo sapiens
acctgcccccgctct

SEQ ID NO: 2278852 - DNA, 19 bp, Homo sapiens
acctgcccccgctctgcca

SEQ ID NO: 2278853 - DNA, 23 bp, Homo sapiens
acctgcgcaaagggcgggcctgt

SEQ ID NO: 2278854 - DNA, 16 bp, Homo sapiens
acctgcggccttgggt

SEQ ID NO: 2278855 - DNA, 21 bp, Homo sapiens
acctggagaaggaagctgcct

SEQ ID NO: 2278856 - DNA, 12 bp, Homo sapiens
acctggaggctg

SEQ ID NO: 2278857 - DNA, 14 bp, Homo sapiens
acctggaggctgga

SEQ ID NO: 2278858 - DNA, 15 bp, Homo sapiens
acctggaggctggac

SEQ ID NO: 2278859 - DNA, 20 bp, Homo sapiens
actgatgatagacttcgaaa

SEQ ID NO: 2278860 - DNA, 15 bp, Homo sapiens
actgatgggtcctgc

SEQ ID NO: 2278861 - DNA, 18 bp, Homo sapiens
actgatgggtcctgctgc

SEQ ID NO: 2278862 - DNA, 21 bp, Homo sapiens
actgatgtatagctttaacat

SEQ ID NO: 2278863 - DNA, 23 bp, Homo sapiens
actgatgtatagctttaacattt

SEQ ID NO: 2278864 - DNA, 16 bp, Homo sapiens
actgatttttttttcc

SEQ ID NO: 2278865 - DNA, 17 bp, Homo sapiens
actgatttttttttcct

SEQ ID NO: 2278866 - DNA, 20 bp, Homo sapiens
actgatttttttttccttca

SEQ ID NO: 2278867 - DNA, 21 bp, Homo sapiens
actgcaatttctccaaagctt

SEQ ID NO: 2278868 - DNA, 13 bp, Homo sapiens
actgcactgtttt

SEQ ID NO: 2278869 - DNA, 23 bp, Homo sapiens
actgcagcctcgacctccctggc

SEQ ID NO: 2278870 - DNA, 19 bp, Homo sapiens
actgcatatagataattat

SEQ ID NO: 2278871 - DNA, 20 bp, Homo sapiens
actgcatcaagatgtgacat

SEQ ID NO: 2278872 - DNA, 22 bp, Homo sapiens
actgcatcaagatgtgacatgt

SEQ ID NO: 2278873 - DNA, 18 bp, Homo sapiens
actgccaacctcgctcca

SEQ ID NO: 2278874 - DNA, 13 bp, Homo sapiens
actgcccaccctg

SEQ ID NO: 2278875 - DNA, 16 bp, Homo sapiens
actgcccaccctgggc

SEQ ID NO: 2278876 - DNA, 18 bp, Homo sapiens
actgcccaccctgggcct

SEQ ID NO: 2278877 - DNA, 21 bp, Homo sapiens
actgcccaccctgggcctccc

SEQ ID NO: 2278878 - DNA, 16 bp, Homo sapiens
actgccgctgccccca

SEQ ID NO: 2278879 - DNA, 21 bp, Homo sapiens
actgccgctgcccccaccctg

SEQ ID NO: 2278880 - DNA, 14 bp, Homo sapiens
actgcctgcagctg

SEQ ID NO: 2278881 - DNA, 18 bp, Homo sapiens
actgcctgcagctgagat

SEQ ID NO: 2278882 - DNA, 19 bp, Homo sapiens
actgctcaggctccccaag

SEQ ID NO: 2278883 - DNA, 21 bp, Homo sapiens
actgctcaggctccccaagac

SEQ ID NO: 2278884 - DNA, 12 bp, Homo sapiens
actgctgtttta

SEQ ID NO: 2278885 - DNA, 15 bp, Homo sapiens
actgctgttttatgt

SEQ ID NO: 2278886 - DNA, 21 bp, Homo sapiens
actgcttaaggaaaagagaaa

SEQ ID NO: 2278887 - DNA, 20 bp, Homo sapiens
actgcttggatccatacaaa

SEQ ID NO: 2278888 - DNA, 23 bp, Homo sapiens
actgcttggatccatacaaaact

SEQ ID NO: 2278889 - DNA, 12 bp, Homo sapiens
actgctttgtag

SEQ ID NO: 2278890 - DNA, 20 bp, Homo sapiens
actgcttttttgattctgaa

SEQ ID NO: 2278891 - DNA, 15 bp, Homo sapiens
actggagaaaatgga

SEQ ID NO: 2278892 - DNA, 10 bp, Homo sapiens
actggcccca

SEQ ID NO: 2278893 - DNA, 22 bp, Homo sapiens
actggccccaggcggaggggct

SEQ ID NO: 2278894 - DNA, 12 bp, Homo sapiens
actggccctgtt

SEQ ID NO: 2278895 - DNA, 12 bp, Homo sapiens
actggctgaccc

SEQ ID NO: 2278896 - DNA, 21 bp, Homo sapiens
actgggtaaaagcagggcagc

SEQ ID NO: 2278897 - DNA, 17 bp, Homo sapiens
actgggtatgcgtttca

SEQ ID NO: 2278898 - DNA, 19 bp, Homo sapiens
actgggtgggccccacagt

SEQ ID NO: 2278899 - DNA, 15 bp, Homo sapiens
actggtctcagagga

SEQ ID NO: 2278900 - DNA, 18 bp, Homo sapiens
actgtaagaaatgtatat

SEQ ID NO: 2278901 - DNA, 13 bp, Homo sapiens
actgtaatgcagg

SEQ ID NO: 2278902 - DNA, 14 bp, Homo sapiens
actgtagcaatata

SEQ ID NO: 2278903 - DNA, 16 bp, Homo sapiens
actgtagcaatatatt

SEQ ID NO: 2278904 - DNA, 15 bp, Homo sapiens
actgtagcaggttct

SEQ ID NO: 2278905 - DNA, 15 bp, Homo sapiens
actgtatagacagtt

SEQ ID NO: 2278906 - DNA, 22 bp, Homo sapiens
actgtatagacagtttgtaaat

SEQ ID NO: 2278907 - DNA, 17 bp, Homo sapiens
actgtatatgtcaaaaa

SEQ ID NO: 2278908 - DNA, 17 bp, Homo sapiens
actgtatctaaaaaata

SEQ ID NO: 2278909 - DNA, 18 bp, Homo sapiens
actgtatctaaaaaataa

SEQ ID NO: 2278910 - DNA, 23 bp, Homo sapiens
actgtcccacaaaatatttctaa

SEQ ID NO: 2278911 - DNA, 22 bp, Homo sapiens
actgtcgtctttttccaaacaa

SEQ ID NO: 2278912 - DNA, 17 bp, Homo sapiens
actgtcttcaaccctgc

SEQ ID NO: 2278913 - DNA, 20 bp, Homo sapiens
actgtgcgttttagagtatg

SEQ ID NO: 2278914 - DNA, 13 bp, Homo sapiens
actgtggccacct

SEQ ID NO: 2278915 - DNA, 14 bp, Homo sapiens
actgtggcctcagg

SEQ ID NO: 2278916 - DNA, 18 bp, Homo sapiens
actgtggcctcaggaggc

SEQ ID NO: 2278917 - DNA, 15 bp, Homo sapiens
actgtgttgcccagg

SEQ ID NO: 2278918 - DNA, 17 bp, Homo sapiens
actgttaacccagtgtt

SEQ ID NO: 2278919 - DNA, 12 bp, Homo sapiens
actgttctaact

SEQ ID NO: 2278920 - DNA, 19 bp, Homo sapiens
actgtttatggtattttcg

SEQ ID NO: 2278921 - DNA, 14 bp, Homo sapiens
actgtttcttgctt

SEQ ID NO: 2278922 - DNA, 12 bp, Homo sapiens
actgtttgtaat

SEQ ID NO: 2278923 - DNA, 13 bp, Homo sapiens
actgtttgtaata

SEQ ID NO: 2278924 - DNA, 22 bp, Homo sapiens
actgtttgtaatatacagtttt

SEQ ID NO: 2278925 - DNA, 14 bp, Homo sapiens
actgttttcatgtg

SEQ ID NO: 2278926 - DNA, 19 bp, Homo sapiens
actgttttgggtagctgcc

SEQ ID NO: 2278927 - DNA, 14 bp, Homo sapiens
actgtttttgaaga

SEQ ID NO: 2278928 - DNA, 15 bp, Homo sapiens
acttaaacctgtgct

SEQ ID NO: 2278929 - DNA, 19 bp, Homo sapiens
acttaaacctgtgctttca

SEQ ID NO: 2278930 - DNA, 15 bp, Homo sapiens
acttaaagcttgttt

SEQ ID NO: 2278931 - DNA, 15 bp, Homo sapiens
acttaatcatatcaa

SEQ ID NO: 2278932 - DNA, 14 bp, Homo sapiens
acttaattctcatt

SEQ ID NO: 2278933 - DNA, 13 bp, Homo sapiens
acttacactgaaa

SEQ ID NO: 2278934 - DNA, 13 bp, Homo sapiens
acttagaatacta

SEQ ID NO: 2278935 - DNA, 16 bp, Homo sapiens
acttataatttccaaa

SEQ ID NO: 2278936 - DNA, 14 bp, Homo sapiens
acttatcaaatcat

SEQ ID NO: 2278937 - DNA, 20 bp, Homo sapiens
acttatcaaatcattcaaaa

SEQ ID NO: 2278938 - DNA, 13 bp, Homo sapiens
acttatctccagc

SEQ ID NO: 2278939 - DNA, 15 bp, Homo sapiens
acttatgtagacaaa

SEQ ID NO: 2278940 - DNA, 20 bp, Homo sapiens
acttcaatgggagtgaacat

SEQ ID NO: 2278941 - DNA, 14 bp, Homo sapiens
acttcagttctcat

SEQ ID NO: 2278942 - DNA, 15 bp, Homo sapiens
acttcagttctcatc

SEQ ID NO: 2278943 - DNA, 20 bp, Homo sapiens
acttcagttctcatcttgta

SEQ ID NO: 2278944 - DNA, 18 bp, Homo sapiens
acttcagttgtggcctca

SEQ ID NO: 2278945 - DNA, 21 bp, Homo sapiens
acttccagatttgagctgcct

SEQ ID NO: 2278946 - DNA, 12 bp, Homo sapiens
acttcccagctg

SEQ ID NO: 2278947 - DNA, 14 bp, Homo sapiens
acttcccagctggc

SEQ ID NO: 2278948 - DNA, 23 bp, Homo sapiens
acttcctggattttctttctatg

SEQ ID NO: 2278949 - DNA, 21 bp, Homo sapiens
acttcgggggcggctctggga

SEQ ID NO: 2278950 - DNA, 17 bp, Homo sapiens
acttctggaatactgaa

SEQ ID NO: 2278951 - DNA, 18 bp, Homo sapiens
acttctggaatactgaaa

SEQ ID NO: 2278952 - DNA, 23 bp, Homo sapiens
acttctggggccagcccctcccc

SEQ ID NO: 2278953 - DNA, 15 bp, Homo sapiens
acttctgttatcagg

SEQ ID NO: 2278954 - DNA, 14 bp, Homo sapiens
acttgagaataaat

SEQ ID NO: 2278955 - DNA, 23 bp, Homo sapiens
acttgcccttctatactttctca

SEQ ID NO: 2278956 - DNA, 18 bp, Homo sapiens
acttggctaacatagcac

SEQ ID NO: 2278957 - DNA, 19 bp, Homo sapiens
acttggctttcctgtttct

SEQ ID NO: 2278958 - DNA, 23 bp, Homo sapiens
acttgtgtatgatccaagtattt

SEQ ID NO: 2278959 - DNA, 12 bp, Homo sapiens
actttccaacat

SEQ ID NO: 2278960 - DNA, 14 bp, Homo sapiens
actttcctgatgtt

SEQ ID NO: 2278961 - DNA, 14 bp, Homo sapiens
actttcctgtactc

SEQ ID NO: 2278962 - DNA, 16 bp, Homo sapiens
actttcgcctcctcca

SEQ ID NO: 2278963 - DNA, 17 bp, Homo sapiens
actttcgcctcctccag

SEQ ID NO: 2278964 - DNA, 24 bp, Homo sapiens
actttcgcctcctccagctcctgc

SEQ ID NO: 2278965 - DNA, 16 bp, Homo sapiens
actttcttgagcacca

SEQ ID NO: 2278966 - DNA, 17 bp, Homo sapiens
actttcttgagcaccag

SEQ ID NO: 2278967 - DNA, 20 bp, Homo sapiens
actttcttgagcaccaggtg

SEQ ID NO: 2278968 - DNA, 15 bp, Homo sapiens
actttggcttatgaa

SEQ ID NO: 2278969 - DNA, 17 bp, Homo sapiens
actttggtaatgtgtca

SEQ ID NO: 2278970 - DNA, 13 bp, Homo sapiens
actttgtctctga

SEQ ID NO: 2278971 - DNA, 15 bp, Homo sapiens
acttttattgttata

SEQ ID NO: 2278972 - DNA, 19 bp, Homo sapiens
acttttccccaattcatgt

SEQ ID NO: 2278973 - DNA, 17 bp, Homo sapiens
acttttgtgtattctgt

SEQ ID NO: 2278974 - DNA, 19 bp, Homo sapiens
acttttgtgtattctgtgg

SEQ ID NO: 2278975 - DNA, 18 bp, Homo sapiens
agaaaaaaatagttttac

SEQ ID NO: 2278976 - DNA, 13 bp, Homo sapiens
agaaaaaatttta

SEQ ID NO: 2278977 - DNA, 20 bp, Homo sapiens
agaaaacagaccagcatagt

SEQ ID NO: 2278978 - DNA, 22 bp, Homo sapiens
agaaaactgtggttaaagattt

SEQ ID NO: 2278979 - DNA, 20 bp, Homo sapiens
agaaaacttgaacaagaaat

SEQ ID NO: 2278980 - DNA, 19 bp, Homo sapiens
agaaaatagcttttattga

SEQ ID NO: 2278981 - DNA, 17 bp, Homo sapiens
agaaaatgaactgtata

SEQ ID NO: 2278982 - DNA, 14 bp, Homo sapiens
agaaaatgctttct

SEQ ID NO: 2278983 - DNA, 16 bp, Homo sapiens
agaaaatgctttctca

SEQ ID NO: 2278984 - DNA, 19 bp, Homo sapiens
agaaaatgctttctcatgc

SEQ ID NO: 2278985 - DNA, 15 bp, Homo sapiens
agaaaatggacgtgt

SEQ ID NO: 2278986 - DNA, 20 bp, Homo sapiens
agaaaatggacgtgttatga

SEQ ID NO: 2278987 - DNA, 23 bp, Homo sapiens
agaaaatggacgtgttatgactc

SEQ ID NO: 2278988 - DNA, 13 bp, Homo sapiens
agaaacaactgcc

SEQ ID NO: 2278989 - DNA, 14 bp, Homo sapiens
agaaacaactgcca

SEQ ID NO: 2278990 - DNA, 14 bp, Homo sapiens
agaaacttctcagt

SEQ ID NO: 2278991 - DNA, 18 bp, Homo sapiens
agaaaggctctgaaggtc

SEQ ID NO: 2278992 - DNA, 18 bp, Homo sapiens
agagcaaagtcatgtcag

SEQ ID NO: 2278993 - DNA, 13 bp, Homo sapiens
agagcacatttag

SEQ ID NO: 2278994 - DNA, 19 bp, Homo sapiens
agagcagtctaaacagagt

SEQ ID NO: 2278995 - DNA, 21 bp, Homo sapiens
agagccatccaccctgaggag

SEQ ID NO: 2278996 - DNA, 16 bp, Homo sapiens
agagccccggagcacc

SEQ ID NO: 2278997 - DNA, 16 bp, Homo sapiens
agagcccttccaggag

SEQ ID NO: 2278998 - DNA, 18 bp, Homo sapiens
agagccgcaccctggctg

SEQ ID NO: 2278999 - DNA, 16 bp, Homo sapiens
agagcgccacccgccc

SEQ ID NO: 2279000 - DNA, 17 bp, Homo sapiens
agagcgccacccgcccg

SEQ ID NO: 2279001 - DNA, 17 bp, Homo sapiens
agagctcagcacagcct

SEQ ID NO: 2279002 - DNA, 22 bp, Homo sapiens
agagctcagcacagcctcaccc

SEQ ID NO: 2279003 - DNA, 14 bp, Homo sapiens
agagctcccaggac

SEQ ID NO: 2279004 - DNA, 15 bp, Homo sapiens
agagctcccaggacg

SEQ ID NO: 2279005 - DNA, 17 bp, Homo sapiens
agagctgagtcggctgg

SEQ ID NO: 2279006 - DNA, 18 bp, Homo sapiens
agagctgagtcggctggg

SEQ ID NO: 2279007 - DNA, 20 bp, Homo sapiens
agagctggcaaactgtgaat

SEQ ID NO: 2279008 - DNA, 22 bp, Homo sapiens
agagcttcccctaacctgggtt

SEQ ID NO: 2279009 - DNA, 19 bp, Homo sapiens
agaggagggatagagacgc

SEQ ID NO: 2279010 - DNA, 13 bp, Homo sapiens
agaggatttggct

SEQ ID NO: 2279011 - DNA, 19 bp, Homo sapiens
agaggatttggctcgctgt

SEQ ID NO: 2279012 - DNA, 20 bp, Homo sapiens
agaggatttggctcgctgtg

SEQ ID NO: 2279013 - DNA, 23 bp, Homo sapiens
agaggatttggctcgctgtggtt

SEQ ID NO: 2279014 - DNA, 12 bp, Homo sapiens
agaggcagggcc

SEQ ID NO: 2279015 - DNA, 15 bp, Homo sapiens
agaggcagggccctg

SEQ ID NO: 2279016 - DNA, 17 bp, Homo sapiens
agaggcagggccctggg

SEQ ID NO: 2279017 - DNA, 19 bp, Homo sapiens
agaggcctgggtgtgacct

SEQ ID NO: 2279018 - DNA, 17 bp, Homo sapiens
agaggcgtcttgtattt

SEQ ID NO: 2279019 - DNA, 14 bp, Homo sapiens
agagggctgagccc

SEQ ID NO: 2279020 - DNA, 14 bp, Homo sapiens
agaggggcgctgcc

SEQ ID NO: 2279021 - DNA, 23 bp, Homo sapiens
agagggtggagatgtcagtctgt

SEQ ID NO: 2279022 - DNA, 19 bp, Homo sapiens
agaggtgagggaggcctga

SEQ ID NO: 2279023 - DNA, 13 bp, Homo sapiens
agagtatatatgt

SEQ ID NO: 2279024 - DNA, 15 bp, Homo sapiens
agagtatatatgtac

SEQ ID NO: 2279025 - DNA, 18 bp, Homo sapiens
agagtatgcaagaagaat

SEQ ID NO: 2279026 - DNA, 20 bp, Homo sapiens
agagtatgcaagaagaatat

SEQ ID NO: 2279027 - DNA, 15 bp, Homo sapiens
agagtcactggaaca

SEQ ID NO: 2279028 - DNA, 22 bp, Homo sapiens
agagtcctgccgacggagccac

SEQ ID NO: 2279029 - DNA, 23 bp, Homo sapiens
agagtgaggtcatcccggggcca

SEQ ID NO: 2279030 - DNA, 18 bp, Homo sapiens
agagttcctttctgggaa

SEQ ID NO: 2279031 - DNA, 18 bp, Homo sapiens
agagttctccttgtactt

SEQ ID NO: 2279032 - DNA, 15 bp, Homo sapiens
agagttgagcacagg

SEQ ID NO: 2279033 - DNA, 16 bp, Homo sapiens
agataaactgaaattt

SEQ ID NO: 2279034 - DNA, 17 bp, Homo sapiens
agataaatgctttaaat

SEQ ID NO: 2279035 - DNA, 16 bp, Homo sapiens
agatactgtatatgtc

SEQ ID NO: 2279036 - DNA, 17 bp, Homo sapiens
agatactgtatatgtca

SEQ ID NO: 2279037 - DNA, 19 bp, Homo sapiens
agatactgtatatgtcaaa

SEQ ID NO: 2279038 - DNA, 23 bp, Homo sapiens
agatagaaaaggtccaaaactgt

SEQ ID NO: 2279039 - DNA, 13 bp, Homo sapiens
agatattatgtat

SEQ ID NO: 2279040 - DNA, 16 bp, Homo sapiens
agatattatgtataga

SEQ ID NO: 2279041 - DNA, 19 bp, Homo sapiens
agatattatgtatagaaaa

SEQ ID NO: 2279042 - DNA, 12 bp, Homo sapiens
agatatttaaat

SEQ ID NO: 2279043 - DNA, 13 bp, Homo sapiens
agatatttaaatt

SEQ ID NO: 2279044 - DNA, 18 bp, Homo sapiens
agatatttaaatttagtg

SEQ ID NO: 2279045 - DNA, 17 bp, Homo sapiens
agatcagcattcaaaat

SEQ ID NO: 2279046 - DNA, 20 bp, Homo sapiens
agatcagcattcaaaatagt

SEQ ID NO: 2279047 - DNA, 19 bp, Homo sapiens
agatccatccttttgcttc

SEQ ID NO: 2279048 - DNA, 16 bp, Homo sapiens
agatccccattctttc

SEQ ID NO: 2279049 - DNA, 15 bp, Homo sapiens
agatccctcggtcag

SEQ ID NO: 2279050 - DNA, 20 bp, Homo sapiens
agatccctcggtcagcaccg

SEQ ID NO: 2279051 - DNA, 14 bp, Homo sapiens
agatccgccctggg

SEQ ID NO: 2279052 - DNA, 21 bp, Homo sapiens
agatccgccctgggctctggg

SEQ ID NO: 2279053 - DNA, 21 bp, Homo sapiens
agatcctctttccccactgaa

SEQ ID NO: 2279054 - DNA, 13 bp, Homo sapiens
agatctcctgtaa

SEQ ID NO: 2279055 - DNA, 15 bp, Homo sapiens
agatctcggtgctga

SEQ ID NO: 2279056 - DNA, 20 bp, Homo sapiens
agatctgtgccatagaacaa

SEQ ID NO: 2279057 - DNA, 21 bp, Homo sapiens
agatgaagtgagatacaaagc

SEQ ID NO: 2279058 - DNA, 14 bp, Homo sapiens
agatgacacataaa

SEQ ID NO: 2279059 - DNA, 15 bp, Homo sapiens
agatgacatttgctt

SEQ ID NO: 2279060 - DNA, 20 bp, Homo sapiens
agatgactggaaacaaggaa

SEQ ID NO: 2279061 - DNA, 14 bp, Homo sapiens
agatgctaatagaa

SEQ ID NO: 2279062 - DNA, 15 bp, Homo sapiens
agatggcagagccat

SEQ ID NO: 2279063 - DNA, 14 bp, Homo sapiens
agatggcgcacccg

SEQ ID NO: 2279064 - DNA, 14 bp, Homo sapiens
agatgtattttcaa

SEQ ID NO: 2279065 - DNA, 14 bp, Homo sapiens
agatgtcaaaatgt

SEQ ID NO: 2279066 - DNA, 19 bp, Homo sapiens
agatgtcagtctgtccacg

SEQ ID NO: 2279067 - DNA, 13 bp, Homo sapiens
agatgtctgttct

SEQ ID NO: 2279068 - DNA, 17 bp, Homo sapiens
agatgtctgttctaagt

SEQ ID NO: 2279069 - DNA, 15 bp, Homo sapiens
agatgttaaaatagt

SEQ ID NO: 2279070 - DNA, 23 bp, Homo sapiens
agatgttggggggccccacggag

SEQ ID NO: 2279071 - DNA, 20 bp, Homo sapiens
agatgttttagagataaata

SEQ ID NO: 2279072 - DNA, 21 bp, Homo sapiens
agatgttttagagataaatat

SEQ ID NO: 2279073 - DNA, 19 bp, Homo sapiens
agattatatacaaagctgt

SEQ ID NO: 2279074 - DNA, 21 bp, Homo sapiens
agattatatacaaagctgtca

SEQ ID NO: 2279075 - DNA, 14 bp, Homo sapiens
agattattttctat

SEQ ID NO: 2279076 - DNA, 20 bp, Homo sapiens
agattccagaacgccctgtg

SEQ ID NO: 2279077 - DNA, 21 bp, Homo sapiens
agattccagaacgccctgtgt

SEQ ID NO: 2279078 - DNA, 15 bp, Homo sapiens
agattccccaggaat

SEQ ID NO: 2279079 - DNA, 15 bp, Homo sapiens
agattctaaaacatt

SEQ ID NO: 2279080 - DNA, 17 bp, Homo sapiens
agattctaaaacattct

SEQ ID NO: 2279081 - DNA, 13 bp, Homo sapiens
agattgaaattta

SEQ ID NO: 2279082 - DNA, 15 bp, Homo sapiens
agattgaaatttatg

SEQ ID NO: 2279083 - DNA, 16 bp, Homo sapiens
agattgaaatttatga

SEQ ID NO: 2279084 - DNA, 17 bp, Homo sapiens
agattgaaatttatgac

SEQ ID NO: 2279085 - DNA, 13 bp, Homo sapiens
agattgtacattt

SEQ ID NO: 2279086 - DNA, 14 bp, Homo sapiens
agatttcactctcc

SEQ ID NO: 2279087 - DNA, 17 bp, Homo sapiens
agatttcactctccttg

SEQ ID NO: 2279088 - DNA, 19 bp, Homo sapiens
agatttcactctccttggt

SEQ ID NO: 2279089 - DNA, 17 bp, Homo sapiens
agatttgtatttatatt

SEQ ID NO: 2279090 - DNA, 20 bp, Homo sapiens
agatttgtatttatattaga

SEQ ID NO: 2279091 - DNA, 23 bp, Homo sapiens
agcaaacaaaaatagaatatata

SEQ ID NO: 2279092 - DNA, 18 bp, Homo sapiens
agcaaagtcatgtcagaa

SEQ ID NO: 2279093 - DNA, 12 bp, Homo sapiens
agcaactgttgg

SEQ ID NO: 2279094 - DNA, 16 bp, Homo sapiens
agcaagcgaaagagca

SEQ ID NO: 2279095 - DNA, 16 bp, Homo sapiens
agcaaggctgctaagt

SEQ ID NO: 2279096 - DNA, 21 bp, Homo sapiens
agcaaggctgctaagtggaag

SEQ ID NO: 2279097 - DNA, 22 bp, Homo sapiens
agcaaggctgctaagtggaaga

SEQ ID NO: 2279098 - DNA, 22 bp, Homo sapiens
agcaatactgccgctgccccca

SEQ ID NO: 2279099 - DNA, 18 bp, Homo sapiens
agcaatatatttgtaggt

SEQ ID NO: 2279100 - DNA, 17 bp, Homo sapiens
agcaatgtttttctcaa

SEQ ID NO: 2279101 - DNA, 21 bp, Homo sapiens
agcaatgtttttctcaaaaag

SEQ ID NO: 2279102 - DNA, 23 bp, Homo sapiens
agcaatgtttttctcaaaaagct

SEQ ID NO: 2279103 - DNA, 23 bp, Homo sapiens
agcacacttgacatcaactgcat

SEQ ID NO: 2279104 - DNA, 21 bp, Homo sapiens
agcacagataaaaagtggaat

SEQ ID NO: 2279105 - DNA, 17 bp, Homo sapiens
agcacagcctcacccct

SEQ ID NO: 2279106 - DNA, 22 bp, Homo sapiens
agcacagcctcacccctgcagg

SEQ ID NO: 2279107 - DNA, 23 bp, Homo sapiens
agcacaggcaacattacaaacaa

SEQ ID NO: 2279108 - DNA, 15 bp, Homo sapiens
agcacaggctggcag

SEQ ID NO: 2279109 - DNA, 16 bp, Homo sapiens
agcaccacggggtcgg

SEQ ID NO: 2279110 - DNA, 17 bp, Homo sapiens
agcaccagcctgagcca

SEQ ID NO: 2279111 - DNA, 11 bp, Homo sapiens
agcacccccag

SEQ ID NO: 2279112 - DNA, 15 bp, Homo sapiens
agcacccccagcctc

SEQ ID NO: 2279113 - DNA, 17 bp, Homo sapiens
agcacccccagcctccc

SEQ ID NO: 2279114 - DNA, 19 bp, Homo sapiens
agcaccgtggtgtgaggcc

SEQ ID NO: 2279115 - DNA, 23 bp, Homo sapiens
agcacctgtgcccatggcttctg

SEQ ID NO: 2279116 - DNA, 13 bp, Homo sapiens
agcacctttgtaa

SEQ ID NO: 2279117 - DNA, 17 bp, Homo sapiens
agcacggttgcctgagg

SEQ ID NO: 2279118 - DNA, 18 bp, Homo sapiens
agcacggttgcctgaggt

SEQ ID NO: 2279119 - DNA, 13 bp, Homo sapiens
agcactagaatga

SEQ ID NO: 2279120 - DNA, 19 bp, Homo sapiens
agcactagaatgagaaatc

SEQ ID NO: 2279121 - DNA, 23 bp, Homo sapiens
agcactgtatgtgttgcacgatg

SEQ ID NO: 2279122 - DNA, 22 bp, Homo sapiens
agcagaaaacctgttcaggcag

SEQ ID NO: 2279123 - DNA, 16 bp, Homo sapiens
agcagaatgactctgg

SEQ ID NO: 2279124 - DNA, 16 bp, Homo sapiens
agctgactgaatgcag

SEQ ID NO: 2279125 - DNA, 15 bp, Homo sapiens
agctggactgggtgg

SEQ ID NO: 2279126 - DNA, 18 bp, Homo sapiens
agctggcaaactgtgaat

SEQ ID NO: 2279127 - DNA, 15 bp, Homo sapiens
agctggcagcgcctc

SEQ ID NO: 2279128 - DNA, 17 bp, Homo sapiens
agctggcagcgcctccc

SEQ ID NO: 2279129 - DNA, 19 bp, Homo sapiens
agctggcagcgcctcccgc

SEQ ID NO: 2279130 - DNA, 19 bp, Homo sapiens
agctggcaggagacactgg

SEQ ID NO: 2279131 - DNA, 13 bp, Homo sapiens
agctgtcaggcag

SEQ ID NO: 2279132 - DNA, 15 bp, Homo sapiens
agctgtggggagctg

SEQ ID NO: 2279133 - DNA, 16 bp, Homo sapiens
agctgtggggagctgg

SEQ ID NO: 2279134 - DNA, 23 bp, Homo sapiens
agctgtgtgcctgcctgggagac

SEQ ID NO: 2279135 - DNA, 16 bp, Homo sapiens
agcttatgtgacatgg

SEQ ID NO: 2279136 - DNA, 15 bp, Homo sapiens
agcttatttctaact

SEQ ID NO: 2279137 - DNA, 21 bp, Homo sapiens
agcttcaactacttctcttgc

SEQ ID NO: 2279138 - DNA, 11 bp, Homo sapiens
agcttgaatgt

SEQ ID NO: 2279139 - DNA, 22 bp, Homo sapiens
agcttgaatgtccccattctat

SEQ ID NO: 2279140 - DNA, 23 bp, Homo sapiens
agcttgaatgtccccattctata

SEQ ID NO: 2279141 - DNA, 17 bp, Homo sapiens
agcttggagacaggatt

SEQ ID NO: 2279142 - DNA, 13 bp, Homo sapiens
agcttgtttctat

SEQ ID NO: 2279143 - DNA, 14 bp, Homo sapiens
agcttgtttctata

SEQ ID NO: 2279144 - DNA, 17 bp, Homo sapiens
agcttgtttctatactg

SEQ ID NO: 2279145 - DNA, 19 bp, Homo sapiens
agcttgtttctatactgtt

SEQ ID NO: 2279146 - DNA, 23 bp, Homo sapiens
agctttactttgtggatatattt

SEQ ID NO: 2279147 - DNA, 15 bp, Homo sapiens
agctttagattgaaa

SEQ ID NO: 2279148 - DNA, 17 bp, Homo sapiens
agctttagattgaaatt

SEQ ID NO: 2279149 - DNA, 20 bp, Homo sapiens
agctttagattgaaatttat

SEQ ID NO: 2279150 - DNA, 22 bp, Homo sapiens
agctttagattgaaatttatga

SEQ ID NO: 2279151 - DNA, 19 bp, Homo sapiens
agcttttattgagtaatat

SEQ ID NO: 2279152 - DNA, 15 bp, Homo sapiens
aggaaaaactgattt

SEQ ID NO: 2279153 - DNA, 12 bp, Homo sapiens
aggaaaactgtt

SEQ ID NO: 2279154 - DNA, 15 bp, Homo sapiens
aggaaagtatctcta

SEQ ID NO: 2279155 - DNA, 21 bp, Homo sapiens
aggaaagtatctctactttcc

SEQ ID NO: 2279156 - DNA, 22 bp, Homo sapiens
aggaaagtatctctactttcct

SEQ ID NO: 2279157 - DNA, 15 bp, Homo sapiens
aggaaagttctatta

SEQ ID NO: 2279158 - DNA, 18 bp, Homo sapiens
aggaaataagacttttag

SEQ ID NO: 2279159 - DNA, 18 bp, Homo sapiens
aggaaatagtgttctttt

SEQ ID NO: 2279160 - DNA, 19 bp, Homo sapiens
aggaaatcaccgaaaacgt

SEQ ID NO: 2279161 - DNA, 12 bp, Homo sapiens
aggaacaaggca

SEQ ID NO: 2279162 - DNA, 16 bp, Homo sapiens
aggaacctcaaactgg

SEQ ID NO: 2279163 - DNA, 20 bp, Homo sapiens
aggaagaataaaaaagaaga

SEQ ID NO: 2279164 - DNA, 14 bp, Homo sapiens
aggaagaataattt

SEQ ID NO: 2279165 - DNA, 18 bp, Homo sapiens
aggaagcctcctgctgag

SEQ ID NO: 2279166 - DNA, 14 bp, Homo sapiens
aggaaggacatttc

SEQ ID NO: 2279167 - DNA, 18 bp, Homo sapiens
aggaaggggacaggattg

SEQ ID NO: 2279168 - DNA, 13 bp, Homo sapiens
aggaagtccctga

SEQ ID NO: 2279169 - DNA, 18 bp, Homo sapiens
aggacaaggggtggaagg

SEQ ID NO: 2279170 - DNA, 13 bp, Homo sapiens
aggacacatttgg

SEQ ID NO: 2279171 - DNA, 20 bp, Homo sapiens
aggacactgatgggtcctgc

SEQ ID NO: 2279172 - DNA, 18 bp, Homo sapiens
aggaccagcacactcccg

SEQ ID NO: 2279173 - DNA, 16 bp, Homo sapiens
aggaccccatctgctg

SEQ ID NO: 2279174 - DNA, 19 bp, Homo sapiens
aggaccccattctgggact

SEQ ID NO: 2279175 - DNA, 19 bp, Homo sapiens
aggaccctgagggtttcca

SEQ ID NO: 2279176 - DNA, 19 bp, Homo sapiens
aggacctccacctgggaga

SEQ ID NO: 2279177 - DNA, 13 bp, Homo sapiens
aggacctgcggcc

SEQ ID NO: 2279178 - DNA, 17 bp, Homo sapiens
aggacggggcagagctg

SEQ ID NO: 2279179 - DNA, 16 bp, Homo sapiens
aggacggtctgtgccc

SEQ ID NO: 2279180 - DNA, 14 bp, Homo sapiens
aggacttcctgcta

SEQ ID NO: 2279181 - DNA, 13 bp, Homo sapiens
aggagacactggt

SEQ ID NO: 2279182 - DNA, 23 bp, Homo sapiens
aggagaggatttggctcgctgtg

SEQ ID NO: 2279183 - DNA, 16 bp, Homo sapiens
aggagataaactgaaa

SEQ ID NO: 2279184 - DNA, 16 bp, Homo sapiens
aggagatggaatatca

SEQ ID NO: 2279185 - DNA, 18 bp, Homo sapiens
aggagcaaggctgccctg

SEQ ID NO: 2279186 - DNA, 11 bp, Homo sapiens
aggagcacccc

SEQ ID NO: 2279187 - DNA, 18 bp, Homo sapiens
aggagcacccccagcctc

SEQ ID NO: 2279188 - DNA, 23 bp, Homo sapiens
aggagcacccccagcctccccca

SEQ ID NO: 2279189 - DNA, 24 bp, Homo sapiens
aggagccagtgaacttggctttcc

SEQ ID NO: 2279190 - DNA, 16 bp, Homo sapiens
aggaggcctgcacagg

SEQ ID NO: 2279191 - DNA, 14 bp, Homo sapiens
aggaggtgtgaatg

SEQ ID NO: 2279192 - DNA, 12 bp, Homo sapiens
aggagtgatggg

SEQ ID NO: 2279193 - DNA, 21 bp, Homo sapiens
aggagtgatgggcaaggggcc

SEQ ID NO: 2279194 - DNA, 18 bp, Homo sapiens
aggagtgggctctgagca

SEQ ID NO: 2279195 - DNA, 19 bp, Homo sapiens
aggagtgggtcgcccacgg

SEQ ID NO: 2279196 - DNA, 19 bp, Homo sapiens
aggagtgggtgggacacag

SEQ ID NO: 2279197 - DNA, 19 bp, Homo sapiens
aggagttgtctgtcctggt

SEQ ID NO: 2279198 - DNA, 15 bp, Homo sapiens
aggataaaatggtac

SEQ ID NO: 2279199 - DNA, 13 bp, Homo sapiens
aggatcctgagcc

SEQ ID NO: 2279200 - DNA, 22 bp, Homo sapiens
aggatgaggaacctcaaactgg

SEQ ID NO: 2279201 - DNA, 14 bp, Homo sapiens
aggattctcctttt

SEQ ID NO: 2279202 - DNA, 17 bp, Homo sapiens
aggattcttttttcaat

SEQ ID NO: 2279203 - DNA, 19 bp, Homo sapiens
aggattcttttttcaatgt

SEQ ID NO: 2279204 - DNA, 20 bp, Homo sapiens
aggattcttttttcaatgta

SEQ ID NO: 2279205 - DNA, 15 bp, Homo sapiens
aggattgtctgctgc

SEQ ID NO: 2279206 - DNA, 17 bp, Homo sapiens
aggatttggctcgctgt

SEQ ID NO: 2279207 - DNA, 23 bp, Homo sapiens
aggattttgggtggccaaagtgt

SEQ ID NO: 2279208 - DNA, 21 bp, Homo sapiens
aggcaaattgttcaaaaataa

SEQ ID NO: 2279209 - DNA, 19 bp, Homo sapiens
aggcaacattacaaacaaa

SEQ ID NO: 2279210 - DNA, 20 bp, Homo sapiens
aggcaacttttcatttttgc

SEQ ID NO: 2279211 - DNA, 18 bp, Homo sapiens
aggcaatagtgttgagga

SEQ ID NO: 2279212 - DNA, 19 bp, Homo sapiens
aggcaatagtgttgaggag

SEQ ID NO: 2279213 - DNA, 20 bp, Homo sapiens
aggcacaaagggcaggcctg

SEQ ID NO: 2279214 - DNA, 21 bp, Homo sapiens
aggcacttaaagccttttcct

SEQ ID NO: 2279215 - DNA, 14 bp, Homo sapiens
aggcaggctttctg

SEQ ID NO: 2279216 - DNA, 14 bp, Homo sapiens
aggcagggccctgg

SEQ ID NO: 2279217 - DNA, 16 bp, Homo sapiens
aggcatctgatttgca

SEQ ID NO: 2279218 - DNA, 22 bp, Homo sapiens
aggccaaacacccaagcacaaa

SEQ ID NO: 2279219 - DNA, 22 bp, Homo sapiens
aggccgacaggaggccatgccc

SEQ ID NO: 2279220 - DNA, 19 bp, Homo sapiens
aggcctgaaatgtttccag

SEQ ID NO: 2279221 - DNA, 22 bp, Homo sapiens
aggcctgaaatgtttccaggca

SEQ ID NO: 2279222 - DNA, 23 bp, Homo sapiens
aggcctgaaatgtttccaggcat

SEQ ID NO: 2279223 - DNA, 16 bp, Homo sapiens
aggcctggctctggag

SEQ ID NO: 2279224 - DNA, 12 bp, Homo sapiens
aggcctgggtgt

SEQ ID NO: 2279225 - DNA, 19 bp, Homo sapiens
aggcctgggtgtgacctga

SEQ ID NO: 2279226 - DNA, 23 bp, Homo sapiens
aggcctgggtgtgacctgacacc

SEQ ID NO: 2279227 - DNA, 19 bp, Homo sapiens
aggcctgtgctagaagctc

SEQ ID NO: 2279228 - DNA, 15 bp, Homo sapiens
aggcctgttccctga

SEQ ID NO: 2279229 - DNA, 17 bp, Homo sapiens
aggcctgttccctgagg

SEQ ID NO: 2279230 - DNA, 22 bp, Homo sapiens
aggcctgttccctgaggacctg

SEQ ID NO: 2279231 - DNA, 12 bp, Homo sapiens
aggcgcccacct

SEQ ID NO: 2279232 - DNA, 14 bp, Homo sapiens
aggcgcccacctgc

SEQ ID NO: 2279233 - DNA, 15 bp, Homo sapiens
aggcgcccacctgcc

SEQ ID NO: 2279234 - DNA, 18 bp, Homo sapiens
aggcgcccacctgcccag

SEQ ID NO: 2279235 - DNA, 12 bp, Homo sapiens
aggcgcgcaccg

SEQ ID NO: 2279236 - DNA, 21 bp, Homo sapiens
aggcggaggggcttggagcag

SEQ ID NO: 2279237 - DNA, 22 bp, Homo sapiens
aggcgggaaccctctggggccc

SEQ ID NO: 2279238 - DNA, 15 bp, Homo sapiens
aggcgtagggccagg

SEQ ID NO: 2279239 - DNA, 19 bp, Homo sapiens
aggcgtagggccagggctc

SEQ ID NO: 2279240 - DNA, 21 bp, Homo sapiens
aggcgtagggccagggctctg

SEQ ID NO: 2279241 - DNA, 13 bp, Homo sapiens
aggcgtcttgtat

SEQ ID NO: 2279242 - DNA, 13 bp, Homo sapiens
aggctaaaaacat

SEQ ID NO: 2279243 - DNA, 22 bp, Homo sapiens
aggctattataatatagaaaga

SEQ ID NO: 2279244 - DNA, 15 bp, Homo sapiens
aggctctatctgctg

SEQ ID NO: 2279245 - DNA, 16 bp, Homo sapiens
aggctctatctgctgg

SEQ ID NO: 2279246 - DNA, 17 bp, Homo sapiens
aggctctatctgctggg

SEQ ID NO: 2279247 - DNA, 22 bp, Homo sapiens
aggctgaatcaaagacatttca

SEQ ID NO: 2279248 - DNA, 21 bp, Homo sapiens
aggctgagccgatctggtctc

SEQ ID NO: 2279249 - DNA, 18 bp, Homo sapiens
aggctgctaagtggaaga

SEQ ID NO: 2279250 - DNA, 24 bp, Homo sapiens
aggctgctaagtggaagacagaga

SEQ ID NO: 2279251 - DNA, 17 bp, Homo sapiens
aggctggagtgaagtgg

SEQ ID NO: 2279252 - DNA, 21 bp, Homo sapiens
aggctggggcttttgtgccag

SEQ ID NO: 2279253 - DNA, 23 bp, Homo sapiens
aggctgtattttcttttatatct

SEQ ID NO: 2279254 - DNA, 12 bp, Homo sapiens
aggctgtcaatt

SEQ ID NO: 2279255 - DNA, 13 bp, Homo sapiens
aggcttccagctc

SEQ ID NO: 2279256 - DNA, 22 bp, Homo sapiens
agtagttgatgaccaatctctg

SEQ ID NO: 2279257 - DNA, 14 bp, Homo sapiens
agtatacatttagt

SEQ ID NO: 2279258 - DNA, 15 bp, Homo sapiens
agtatatatgtacag

SEQ ID NO: 2279259 - DNA, 16 bp, Homo sapiens
agtatatatgtacagt

SEQ ID NO: 2279260 - DNA, 23 bp, Homo sapiens
agtatctccatccttaactgtcc

SEQ ID NO: 2279261 - DNA, 17 bp, Homo sapiens
agtatctctactttcct

SEQ ID NO: 2279262 - DNA, 18 bp, Homo sapiens
agtatctctactttcctg

SEQ ID NO: 2279263 - DNA, 15 bp, Homo sapiens
agtatcttgaagact

SEQ ID NO: 2279264 - DNA, 23 bp, Homo sapiens
agtatgaaccacatggaacttaa

SEQ ID NO: 2279265 - DNA, 19 bp, Homo sapiens
agtatgcaagaagaatata

SEQ ID NO: 2279266 - DNA, 23 bp, Homo sapiens
agtatgcaagaagaatataaata

SEQ ID NO: 2279267 - DNA, 15 bp, Homo sapiens
agtatgctatgctat

SEQ ID NO: 2279268 - DNA, 15 bp, Homo sapiens
agtatgtgtgctctt

SEQ ID NO: 2279269 - DNA, 14 bp, Homo sapiens
agtattatagatat

SEQ ID NO: 2279270 - DNA, 17 bp, Homo sapiens
agtcaaagacgctgagt

SEQ ID NO: 2279271 - DNA, 21 bp, Homo sapiens
agtcaaagacgctgagtggga

SEQ ID NO: 2279272 - DNA, 20 bp, Homo sapiens
agtcagaaaattggcagtgg

SEQ ID NO: 2279273 - DNA, 24 bp, Homo sapiens
agtcagaaaattggcagtggcaga

SEQ ID NO: 2279274 - DNA, 18 bp, Homo sapiens
agtcagcggagaggaccc

SEQ ID NO: 2279275 - DNA, 19 bp, Homo sapiens
agtcaggaagcctcctgct

SEQ ID NO: 2279276 - DNA, 22 bp, Homo sapiens
agtcatacgtctttagatgcta

SEQ ID NO: 2279277 - DNA, 22 bp, Homo sapiens
agtcatctcaaacactgcttaa

SEQ ID NO: 2279278 - DNA, 16 bp, Homo sapiens
agtcatgggagaagag

SEQ ID NO: 2279279 - DNA, 22 bp, Homo sapiens
agtcatgtcagaaggagacaga

SEQ ID NO: 2279280 - DNA, 18 bp, Homo sapiens
agtcattgctgacagagc

SEQ ID NO: 2279281 - DNA, 23 bp, Homo sapiens
agtcattgttacaggtgtactat

SEQ ID NO: 2279282 - DNA, 16 bp, Homo sapiens
agtccaatgaagataa

SEQ ID NO: 2279283 - DNA, 21 bp, Homo sapiens
agtccaatgaagataaatgct

SEQ ID NO: 2279284 - DNA, 13 bp, Homo sapiens
agtccagacctgg

SEQ ID NO: 2279285 - DNA, 16 bp, Homo sapiens
agtccagacctgggcc

SEQ ID NO: 2279286 - DNA, 19 bp, Homo sapiens
agtccagacctgggccctg

SEQ ID NO: 2279287 - DNA, 20 bp, Homo sapiens
agtccagacctgggccctgg

SEQ ID NO: 2279288 - DNA, 21 bp, Homo sapiens
agtccagacctgggccctggt

SEQ ID NO: 2279289 - DNA, 13 bp, Homo sapiens
agtccagctctcc

SEQ ID NO: 2279290 - DNA, 14 bp, Homo sapiens
agtccagctctccc

SEQ ID NO: 2279291 - DNA, 17 bp, Homo sapiens
agtccagctctcccctg

SEQ ID NO: 2279292 - DNA, 19 bp, Homo sapiens
agtccagtgagaaattaca

SEQ ID NO: 2279293 - DNA, 15 bp, Homo sapiens
agtcccacagcccct

SEQ ID NO: 2279294 - DNA, 13 bp, Homo sapiens
agtccctcctccc

SEQ ID NO: 2279295 - DNA, 22 bp, Homo sapiens
agtcctgccgacggagccactg

SEQ ID NO: 2279296 - DNA, 17 bp, Homo sapiens
agtccttagaatgaggg

SEQ ID NO: 2279297 - DNA, 14 bp, Homo sapiens
agtcggctgggcag

SEQ ID NO: 2279298 - DNA, 17 bp, Homo sapiens
agtcggctgggcagggc

SEQ ID NO: 2279299 - DNA, 16 bp, Homo sapiens
agtctcattacagatt

SEQ ID NO: 2279300 - DNA, 15 bp, Homo sapiens
agtctcattcctctg

SEQ ID NO: 2279301 - DNA, 23 bp, Homo sapiens
agtctctgatttgcaaatgcaca

SEQ ID NO: 2279302 - DNA, 21 bp, Homo sapiens
agtctggagaccaggactctg

SEQ ID NO: 2279303 - DNA, 18 bp, Homo sapiens
agtctggagcaaagcaga

SEQ ID NO: 2279304 - DNA, 18 bp, Homo sapiens
agtctgtacttcagttct

SEQ ID NO: 2279305 - DNA, 20 bp, Homo sapiens
agtctgtccacgtggagaga

SEQ ID NO: 2279306 - DNA, 14 bp, Homo sapiens
agtctgtttcatta

SEQ ID NO: 2279307 - DNA, 18 bp, Homo sapiens
agtctgtttcattactgc

SEQ ID NO: 2279308 - DNA, 21 bp, Homo sapiens
agtcttcatggtctcttccag

SEQ ID NO: 2279309 - DNA, 17 bp, Homo sapiens
agtcttgagcaatgttt

SEQ ID NO: 2279310 - DNA, 15 bp, Homo sapiens
agtcttgtataacta

SEQ ID NO: 2279311 - DNA, 16 bp, Homo sapiens
agtgaagatgtgtaaa

SEQ ID NO: 2279312 - DNA, 19 bp, Homo sapiens
agtgaagatgtgtaaataa

SEQ ID NO: 2279313 - DNA, 11 bp, Homo sapiens
agtgaatgtta

SEQ ID NO: 2279314 - DNA, 14 bp, Homo sapiens
agtgaatgttaaca

SEQ ID NO: 2279315 - DNA, 21 bp, Homo sapiens
agtgaccaggctcacaactgt

SEQ ID NO: 2279316 - DNA, 16 bp, Homo sapiens
agtgagaagataaaaa

SEQ ID NO: 2279317 - DNA, 18 bp, Homo sapiens
agtgagctaccaggaaga

SEQ ID NO: 2279318 - DNA, 16 bp, Homo sapiens
agtgaggatgaaaaaa

SEQ ID NO: 2279319 - DNA, 17 bp, Homo sapiens
agtgaggtcatcccggg

SEQ ID NO: 2279320 - DNA, 18 bp, Homo sapiens
agtgatacactgtatcta

SEQ ID NO: 2279321 - DNA, 21 bp, Homo sapiens
agtgatacactgtatctaaaa

SEQ ID NO: 2279322 - DNA, 23 bp, Homo sapiens
agtgatcctcccgccccagcctc

SEQ ID NO: 2279323 - DNA, 17 bp, Homo sapiens
agtgatgcaataaacaa

SEQ ID NO: 2279324 - DNA, 14 bp, Homo sapiens
agtgatgggcaagg

SEQ ID NO: 2279325 - DNA, 13 bp, Homo sapiens
agtgatgtgggaa

SEQ ID NO: 2279326 - DNA, 21 bp, Homo sapiens
agtgcaagctttaacagacta

SEQ ID NO: 2279327 - DNA, 17 bp, Homo sapiens
agtgcaagttcatgtgt

SEQ ID NO: 2279328 - DNA, 18 bp, Homo sapiens
agtgccttacacaatggt

SEQ ID NO: 2279329 - DNA, 10 bp, Homo sapiens
agtgccttat

SEQ ID NO: 2279330 - DNA, 22 bp, Homo sapiens
agtgccttatggaacactctga

SEQ ID NO: 2279331 - DNA, 15 bp, Homo sapiens
agtgctcagtattga

SEQ ID NO: 2279332 - DNA, 14 bp, Homo sapiens
agtgctcctgaaag

SEQ ID NO: 2279333 - DNA, 14 bp, Homo sapiens
agtgctctttccac

SEQ ID NO: 2279334 - DNA, 11 bp, Homo sapiens
agtgctgggat

SEQ ID NO: 2279335 - DNA, 14 bp, Homo sapiens
agtgctttgccctt

SEQ ID NO: 2279336 - DNA, 13 bp, Homo sapiens
agtggacagcagc

SEQ ID NO: 2279337 - DNA, 14 bp, Homo sapiens
agtggacagcagct

SEQ ID NO: 2279338 - DNA, 17 bp, Homo sapiens
agtggacagcagctgga

SEQ ID NO: 2279339 - DNA, 20 bp, Homo sapiens
agtggacagcagctggactg

SEQ ID NO: 2279340 - DNA, 19 bp, Homo sapiens
agtggactcgcgagagggt

SEQ ID NO: 2279341 - DNA, 17 bp, Homo sapiens
agtggcatggtcctgtg

SEQ ID NO: 2279342 - DNA, 21 bp, Homo sapiens
agtggcatggtcctgtgcccc

SEQ ID NO: 2279343 - DNA, 18 bp, Homo sapiens
agtggctgaccaggccct

SEQ ID NO: 2279344 - DNA, 18 bp, Homo sapiens
agtggcttcagcccctgg

SEQ ID NO: 2279345 - DNA, 20 bp, Homo sapiens
agtggcttggagcagaggtg

SEQ ID NO: 2279346 - DNA, 16 bp, Homo sapiens
agtggggaggagactc

SEQ ID NO: 2279347 - DNA, 20 bp, Homo sapiens
agtggggcccatggccccag

SEQ ID NO: 2279348 - DNA, 13 bp, Homo sapiens
agtgggggcaggt

SEQ ID NO: 2279349 - DNA, 22 bp, Homo sapiens
agtgggtatttcttatttgaaa

SEQ ID NO: 2279350 - DNA, 21 bp, Homo sapiens
agtgggtcgcccacgggtgtg

SEQ ID NO: 2279351 - DNA, 19 bp, Homo sapiens
agtgggtgggacacagaga

SEQ ID NO: 2279352 - DNA, 15 bp, Homo sapiens
agtggtccacattct

SEQ ID NO: 2279353 - DNA, 21 bp, Homo sapiens
agtggtccacattctgctgcc

SEQ ID NO: 2279354 - DNA, 17 bp, Homo sapiens
agtgtactttgaacttc

SEQ ID NO: 2279355 - DNA, 20 bp, Homo sapiens
agtgtcaccagctgccaaaa

SEQ ID NO: 2279356 - DNA, 16 bp, Homo sapiens
agtgtccccaggggca

SEQ ID NO: 2279357 - DNA, 18 bp, Homo sapiens
agtgttgaggaggggagc

SEQ ID NO: 2279358 - DNA, 16 bp, Homo sapiens
agtgttgggtggagga

SEQ ID NO: 2279359 - DNA, 19 bp, Homo sapiens
agtgttgtaccatatgtag

SEQ ID NO: 2279360 - DNA, 19 bp, Homo sapiens
agtgttttcttgtgttgtt

SEQ ID NO: 2279361 - DNA, 21 bp, Homo sapiens
agttaaaaaaaaaacagcctg

SEQ ID NO: 2279362 - DNA, 15 bp, Homo sapiens
agttaatgtgccaaa

SEQ ID NO: 2279363 - DNA, 16 bp, Homo sapiens
agttaatgtgccaaaa

SEQ ID NO: 2279364 - DNA, 18 bp, Homo sapiens
agttacagacaaagcgtg

SEQ ID NO: 2279365 - DNA, 24 bp, Homo sapiens
agttacatccgctttatggagata

SEQ ID NO: 2279366 - DNA, 17 bp, Homo sapiens
agttagaatctattttc

SEQ ID NO: 2279367 - DNA, 18 bp, Homo sapiens
agttagaatctattttct

SEQ ID NO: 2279368 - DNA, 17 bp, Homo sapiens
agttaggtgtgccaaac

SEQ ID NO: 2279369 - DNA, 17 bp, Homo sapiens
agttcacttactcttac

SEQ ID NO: 2279370 - DNA, 18 bp, Homo sapiens
agttcacttactcttaca

SEQ ID NO: 2279371 - DNA, 15 bp, Homo sapiens
agttcctgctgcctg

SEQ ID NO: 2279372 - DNA, 14 bp, Homo sapiens
agttcctgtgcctc

SEQ ID NO: 2279373 - DNA, 19 bp, Homo sapiens
agttctattatctgggttt

SEQ ID NO: 2279374 - DNA, 23 bp, Homo sapiens
agttctatttctatctgcaaata

SEQ ID NO: 2279375 - DNA, 15 bp, Homo sapiens
agttctcatcttgta

SEQ ID NO: 2279376 - DNA, 16 bp, Homo sapiens
agttctccttgtactt

SEQ ID NO: 2279377 - DNA, 17 bp, Homo sapiens
agttctccttgtacttg

SEQ ID NO: 2279378 - DNA, 16 bp, Homo sapiens
agttctgaaaactgtt

SEQ ID NO: 2279379 - DNA, 13 bp, Homo sapiens
agttcttggcctg

SEQ ID NO: 2279380 - DNA, 17 bp, Homo sapiens
agttgaagggaaatcaa

SEQ ID NO: 2279381 - DNA, 21 bp, Homo sapiens
agttgagcacaggcaacatta

SEQ ID NO: 2279382 - DNA, 16 bp, Homo sapiens
agttgatatgtaacag

SEQ ID NO: 2279383 - DNA, 14 bp, Homo sapiens
agttgatctcccca

SEQ ID NO: 2279384 - DNA, 14 bp, Homo sapiens
agttgatgaccaat

SEQ ID NO: 2279385 - DNA, 14 bp, Homo sapiens
agttgatgtatcca

SEQ ID NO: 2279386 - DNA, 15 bp, Homo sapiens
agttgctcattgtag

SEQ ID NO: 2279387 - DNA, 17 bp, Homo sapiens
agttggagctagaaaat

SEQ ID NO: 2279388 - DNA, 14 bp, Homo sapiens
atagatataaagga

SEQ ID NO: 2279389 - DNA, 14 bp, Homo sapiens
atagatataaatat

SEQ ID NO: 2279390 - DNA, 23 bp, Homo sapiens
atagatcctctgatatacaatta

SEQ ID NO: 2279391 - DNA, 21 bp, Homo sapiens
atagcaaaatattatctgaac

SEQ ID NO: 2279392 - DNA, 12 bp, Homo sapiens
atagcagaagag

SEQ ID NO: 2279393 - DNA, 22 bp, Homo sapiens
atagcagtgctaggataaacca

SEQ ID NO: 2279394 - DNA, 18 bp, Homo sapiens
atagcatggatagagtat

SEQ ID NO: 2279395 - DNA, 20 bp, Homo sapiens
atagccattcatttacaact

SEQ ID NO: 2279396 - DNA, 14 bp, Homo sapiens
atagctttaacatt

SEQ ID NO: 2279397 - DNA, 12 bp, Homo sapiens
ataggaaaaact

SEQ ID NO: 2279398 - DNA, 14 bp, Homo sapiens
ataggaaaatacat

SEQ ID NO: 2279399 - DNA, 15 bp, Homo sapiens
ataggaaaatacatt

SEQ ID NO: 2279400 - DNA, 17 bp, Homo sapiens
ataggaaaatacattgt

SEQ ID NO: 2279401 - DNA, 20 bp, Homo sapiens
ataggaaataaatctaaata

SEQ ID NO: 2279402 - DNA, 23 bp, Homo sapiens
atagtaaataatgattcaatgtg

SEQ ID NO: 2279403 - DNA, 19 bp, Homo sapiens
atagtagcagagtcattgt

SEQ ID NO: 2279404 - DNA, 17 bp, Homo sapiens
atagtcaatatgcctgc

SEQ ID NO: 2279405 - DNA, 15 bp, Homo sapiens
atagtggctttcatt

SEQ ID NO: 2279406 - DNA, 14 bp, Homo sapiens
atagtgttgaggag

SEQ ID NO: 2279407 - DNA, 20 bp, Homo sapiens
atagttctatttctatctgc

SEQ ID NO: 2279408 - DNA, 16 bp, Homo sapiens
atagttgaacaagatt

SEQ ID NO: 2279409 - DNA, 17 bp, Homo sapiens
atagtttaaaaatattc

SEQ ID NO: 2279410 - DNA, 17 bp, Homo sapiens
atagtttattatagtct

SEQ ID NO: 2279411 - DNA, 13 bp, Homo sapiens
atagttttctaaa

SEQ ID NO: 2279412 - DNA, 17 bp, Homo sapiens
atagttttctaaatgtt

SEQ ID NO: 2279413 - DNA, 13 bp, Homo sapiens
atataaaatacat

SEQ ID NO: 2279414 - DNA, 14 bp, Homo sapiens
atataaaatacata

SEQ ID NO: 2279415 - DNA, 18 bp, Homo sapiens
atataaacgatatatgta

SEQ ID NO: 2279416 - DNA, 20 bp, Homo sapiens
atataactacattaaaagct

SEQ ID NO: 2279417 - DNA, 21 bp, Homo sapiens
atataagttaaagagacaaat

SEQ ID NO: 2279418 - DNA, 14 bp, Homo sapiens
atataatatgaata

SEQ ID NO: 2279419 - DNA, 13 bp, Homo sapiens
atataatcaaatg

SEQ ID NO: 2279420 - DNA, 23 bp, Homo sapiens
atataatttgccagacagagatc

SEQ ID NO: 2279421 - DNA, 17 bp, Homo sapiens
atatacagacctccaga

SEQ ID NO: 2279422 - DNA, 17 bp, Homo sapiens
atatacagtttttgtaa

SEQ ID NO: 2279423 - DNA, 14 bp, Homo sapiens
atatacataaaaat

SEQ ID NO: 2279424 - DNA, 18 bp, Homo sapiens
atatacatctagcacagc

SEQ ID NO: 2279425 - DNA, 15 bp, Homo sapiens
atatacatgtatagt

SEQ ID NO: 2279426 - DNA, 16 bp, Homo sapiens
atatagtttgttttct

SEQ ID NO: 2279427 - DNA, 17 bp, Homo sapiens
atatagtttgttttctt

SEQ ID NO: 2279428 - DNA, 13 bp, Homo sapiens
atatatacataaa

SEQ ID NO: 2279429 - DNA, 14 bp, Homo sapiens
atatatacataaaa

SEQ ID NO: 2279430 - DNA, 12 bp, Homo sapiens
atatatacatgt

SEQ ID NO: 2279431 - DNA, 16 bp, Homo sapiens
atatatatatcagttt

SEQ ID NO: 2279432 - DNA, 14 bp, Homo sapiens
atatatatatgtat

SEQ ID NO: 2279433 - DNA, 21 bp, Homo sapiens
atatatctgatggcacctata

SEQ ID NO: 2279434 - DNA, 20 bp, Homo sapiens
atatatcttatccaattcat

SEQ ID NO: 2279435 - DNA, 12 bp, Homo sapiens
atatatgtaaat

SEQ ID NO: 2279436 - DNA, 15 bp, Homo sapiens
atatatgtaaatata

SEQ ID NO: 2279437 - DNA, 12 bp, Homo sapiens
atatatgtacag

SEQ ID NO: 2279438 - DNA, 20 bp, Homo sapiens
atatattacggaggaacaga

SEQ ID NO: 2279439 - DNA, 22 bp, Homo sapiens
atatatttattattttcatata

SEQ ID NO: 2279440 - DNA, 13 bp, Homo sapiens
atatatttgaaag

SEQ ID NO: 2279441 - DNA, 22 bp, Homo sapiens
atatatttgaaagaagtcaaat

SEQ ID NO: 2279442 - DNA, 20 bp, Homo sapiens
atatatttttaaagcaaaaa

SEQ ID NO: 2279443 - DNA, 14 bp, Homo sapiens
atatcagctctgca

SEQ ID NO: 2279444 - DNA, 12 bp, Homo sapiens
atatcagtttga

SEQ ID NO: 2279445 - DNA, 22 bp, Homo sapiens
atatcatgtgtagatattatgt

SEQ ID NO: 2279446 - DNA, 19 bp, Homo sapiens
atatcctggtgtctagttt

SEQ ID NO: 2279447 - DNA, 17 bp, Homo sapiens
atatctgtaaatttaac

SEQ ID NO: 2279448 - DNA, 18 bp, Homo sapiens
atatcttatccaattcat

SEQ ID NO: 2279449 - DNA, 15 bp, Homo sapiens
atatcttgaagaata

SEQ ID NO: 2279450 - DNA, 16 bp, Homo sapiens
atatcttttcttctcc

SEQ ID NO: 2279451 - DNA, 20 bp, Homo sapiens
atatgaagtaagttctgaaa

SEQ ID NO: 2279452 - DNA, 12 bp, Homo sapiens
atatgaatatat

SEQ ID NO: 2279453 - DNA, 19 bp, Homo sapiens
atatgaatgcttgtaatag

SEQ ID NO: 2279454 - DNA, 22 bp, Homo sapiens
atatgacctaaatccattttct

SEQ ID NO: 2279455 - DNA, 14 bp, Homo sapiens
atatgattgaaaag

SEQ ID NO: 2279456 - DNA, 16 bp, Homo sapiens
atatgattgaaaagaa

SEQ ID NO: 2279457 - DNA, 11 bp, Homo sapiens
atatgctcttt

SEQ ID NO: 2279458 - DNA, 14 bp, Homo sapiens
atatgtaacagttg

SEQ ID NO: 2279459 - DNA, 13 bp, Homo sapiens
atatgtaacatgt

SEQ ID NO: 2279460 - DNA, 17 bp, Homo sapiens
atatgtacttttccatt

SEQ ID NO: 2279461 - DNA, 17 bp, Homo sapiens
atatgtagcattaaata

SEQ ID NO: 2279462 - DNA, 19 bp, Homo sapiens
atatgtagcattaaatata

SEQ ID NO: 2279463 - DNA, 14 bp, Homo sapiens
atatgtcaaaaata

SEQ ID NO: 2279464 - DNA, 15 bp, Homo sapiens
atatgtcaaaaatat

SEQ ID NO: 2279465 - DNA, 16 bp, Homo sapiens
atatgttgctgaaaca

SEQ ID NO: 2279466 - DNA, 16 bp, Homo sapiens
atattaatatgtactt

SEQ ID NO: 2279467 - DNA, 15 bp, Homo sapiens
atattacatttcatt

SEQ ID NO: 2279468 - DNA, 17 bp, Homo sapiens
atattacatttcattta

SEQ ID NO: 2279469 - DNA, 19 bp, Homo sapiens
atattacatttcatttata

SEQ ID NO: 2279470 - DNA, 17 bp, Homo sapiens
atattagagtgccctta

SEQ ID NO: 2279471 - DNA, 20 bp, Homo sapiens
atattagagtgcccttaaaa

SEQ ID NO: 2279472 - DNA, 14 bp, Homo sapiens
atattagatgcccg

SEQ ID NO: 2279473 - DNA, 22 bp, Homo sapiens
atattatagctcctattaaatt

SEQ ID NO: 2279474 - DNA, 15 bp, Homo sapiens
atattatgaataaaa

SEQ ID NO: 2279475 - DNA, 16 bp, Homo sapiens
atattatgaataaaat

SEQ ID NO: 2279476 - DNA, 19 bp, Homo sapiens
atattattgctatatttgc

SEQ ID NO: 2279477 - DNA, 14 bp, Homo sapiens
atattcagagatgt

SEQ ID NO: 2279478 - DNA, 20 bp, Homo sapiens
atattcatactttccaacat

SEQ ID NO: 2279479 - DNA, 22 bp, Homo sapiens
atattctaaaaaagatactgta

SEQ ID NO: 2279480 - DNA, 19 bp, Homo sapiens
atattcttgctttcacaaa

SEQ ID NO: 2279481 - DNA, 22 bp, Homo sapiens
atattgagatcagcattcaaaa

SEQ ID NO: 2279482 - DNA, 21 bp, Homo sapiens
atattgctattgtttatagga

SEQ ID NO: 2279483 - DNA, 17 bp, Homo sapiens
atattgctgatggtgca

SEQ ID NO: 2279484 - DNA, 22 bp, Homo sapiens
atattgctgatggtgcaatgac

SEQ ID NO: 2279485 - DNA, 14 bp, Homo sapiens
atattgtgtaagaa

SEQ ID NO: 2279486 - DNA, 15 bp, Homo sapiens
atattgtgtaagaat

SEQ ID NO: 2279487 - DNA, 20 bp, Homo sapiens
atatttccaaatattctaaa

SEQ ID NO: 2279488 - DNA, 20 bp, Homo sapiens
atatttctaagcttatttct

SEQ ID NO: 2279489 - DNA, 17 bp, Homo sapiens
atatttgctaataccaa

SEQ ID NO: 2279490 - DNA, 18 bp, Homo sapiens
atatttgcttatttatat

SEQ ID NO: 2279491 - DNA, 20 bp, Homo sapiens
atatttgtaggtatactatg

SEQ ID NO: 2279492 - DNA, 23 bp, Homo sapiens
atattttgcaagctctggaattg

SEQ ID NO: 2279493 - DNA, 18 bp, Homo sapiens
atattttgtattattgct

SEQ ID NO: 2279494 - DNA, 14 bp, Homo sapiens
atatttttatgtga

SEQ ID NO: 2279495 - DNA, 18 bp, Homo sapiens
atatttttgtaaatatga

SEQ ID NO: 2279496 - DNA, 17 bp, Homo sapiens
atatttttttctagcta

SEQ ID NO: 2279497 - DNA, 18 bp, Homo sapiens
atatttttttctagctat

SEQ ID NO: 2279498 - DNA, 15 bp, Homo sapiens
atcaacttttgaaat

SEQ ID NO: 2279499 - DNA, 22 bp, Homo sapiens
atcaacttttgaaatttaaaaa

SEQ ID NO: 2279500 - DNA, 14 bp, Homo sapiens
atcaatacttttgt

SEQ ID NO: 2279501 - DNA, 14 bp, Homo sapiens
atcaatttaaagga

SEQ ID NO: 2279502 - DNA, 16 bp, Homo sapiens
atcacacttgcaaatg

SEQ ID NO: 2279503 - DNA, 19 bp, Homo sapiens
atcacacttgcaaatgaat

SEQ ID NO: 2279504 - DNA, 19 bp, Homo sapiens
atcaccgaaaacgtggctg

SEQ ID NO: 2279505 - DNA, 20 bp, Homo sapiens
atcacgggcccgctcaacct

SEQ ID NO: 2279506 - DNA, 17 bp, Homo sapiens
atcagaaattttctaca

SEQ ID NO: 2279507 - DNA, 18 bp, Homo sapiens
atcagaactcctttctaa

SEQ ID NO: 2279508 - DNA, 23 bp, Homo sapiens
atcagaattgaaccgtcaatgtg

SEQ ID NO: 2279509 - DNA, 21 bp, Homo sapiens
atcagacttgatttacaagca

SEQ ID NO: 2279510 - DNA, 14 bp, Homo sapiens
atcagcattcaaaa

SEQ ID NO: 2279511 - DNA, 13 bp, Homo sapiens
atcagcccctgct

SEQ ID NO: 2279512 - DNA, 14 bp, Homo sapiens
atcagctctaaagc

SEQ ID NO: 2279513 - DNA, 18 bp, Homo sapiens
atcagggaccaccagagg

SEQ ID NO: 2279514 - DNA, 10 bp, Homo sapiens
atcagtttga

SEQ ID NO: 2279515 - DNA, 22 bp, Homo sapiens
atcagtttgatcacactatttt

SEQ ID NO: 2279516 - DNA, 14 bp, Homo sapiens
atcataaagttaga

SEQ ID NO: 2279517 - DNA, 23 bp, Homo sapiens
atcatacttgctccttgaataag

SEQ ID NO: 2279518 - DNA, 13 bp, Homo sapiens
atcatatgtgatc

SEQ ID NO: 2279519 - DNA, 18 bp, Homo sapiens
atcatatgtgatctgtct

SEQ ID NO: 2279520 - DNA, 20 bp, Homo sapiens
atcatcaatacttttgtgta

SEQ ID NO: 2279521 - DNA, 20 bp, Homo sapiens
atgagacctcccccagggag

SEQ ID NO: 2279522 - DNA, 21 bp, Homo sapiens
atgagactttccgactgcttt

SEQ ID NO: 2279523 - DNA, 12 bp, Homo sapiens
atgagaggaaat

SEQ ID NO: 2279524 - DNA, 14 bp, Homo sapiens
atgagattgtacat

SEQ ID NO: 2279525 - DNA, 15 bp, Homo sapiens
atgagattgtacatt

SEQ ID NO: 2279526 - DNA, 17 bp, Homo sapiens
atgagattgtacatttt

SEQ ID NO: 2279527 - DNA, 19 bp, Homo sapiens
atgaggaacctcaaactgg

SEQ ID NO: 2279528 - DNA, 14 bp, Homo sapiens
atgaggttatgaga

SEQ ID NO: 2279529 - DNA, 16 bp, Homo sapiens
atgaggttatgagaaa

SEQ ID NO: 2279530 - DNA, 17 bp, Homo sapiens
atgagtttaaaaaaata

SEQ ID NO: 2279531 - DNA, 17 bp, Homo sapiens
atgataaccaagaatgt

SEQ ID NO: 2279532 - DNA, 11 bp, Homo sapiens
atgatacaaag

SEQ ID NO: 2279533 - DNA, 21 bp, Homo sapiens
atgatactgaattgttatgta

SEQ ID NO: 2279534 - DNA, 14 bp, Homo sapiens
atgatagacttcga

SEQ ID NO: 2279535 - DNA, 17 bp, Homo sapiens
atgatagacttcgaaaa

SEQ ID NO: 2279536 - DNA, 24 bp, Homo sapiens
atgatccatttgaacagttggctg

SEQ ID NO: 2279537 - DNA, 20 bp, Homo sapiens
atgatcgttctgggtcagct

SEQ ID NO: 2279538 - DNA, 18 bp, Homo sapiens
atgatgactcttcttatc

SEQ ID NO: 2279539 - DNA, 19 bp, Homo sapiens
atgatgactcttcttatca

SEQ ID NO: 2279540 - DNA, 21 bp, Homo sapiens
atgatgactcttcttatcaca

SEQ ID NO: 2279541 - DNA, 17 bp, Homo sapiens
atgatgccatgaggaac

SEQ ID NO: 2279542 - DNA, 12 bp, Homo sapiens
atgattcaatgt

SEQ ID NO: 2279543 - DNA, 13 bp, Homo sapiens
atgattcaatgtg

SEQ ID NO: 2279544 - DNA, 21 bp, Homo sapiens
atgattccaagggcccagagg

SEQ ID NO: 2279545 - DNA, 16 bp, Homo sapiens
atgattgaaaagaaga

SEQ ID NO: 2279546 - DNA, 17 bp, Homo sapiens
atgattgtttaattgta

SEQ ID NO: 2279547 - DNA, 17 bp, Homo sapiens
atgatttaagcatttta

SEQ ID NO: 2279548 - DNA, 20 bp, Homo sapiens
atgatttcaatgattgttta

SEQ ID NO: 2279549 - DNA, 23 bp, Homo sapiens
atgcaaaaaaaaaaatgtcaaga

SEQ ID NO: 2279550 - DNA, 20 bp, Homo sapiens
atgcaaaccatcattgaaat

SEQ ID NO: 2279551 - DNA, 12 bp, Homo sapiens
atgcaacctgtg

SEQ ID NO: 2279552 - DNA, 17 bp, Homo sapiens
atgcaattagatagaaa

SEQ ID NO: 2279553 - DNA, 18 bp, Homo sapiens
atgcaattagatagaaaa

SEQ ID NO: 2279554 - DNA, 14 bp, Homo sapiens
atgcacagctaaca

SEQ ID NO: 2279555 - DNA, 15 bp, Homo sapiens
atgcactcagtgtgg

SEQ ID NO: 2279556 - DNA, 22 bp, Homo sapiens
atgcagaaatgtggatgctctt

SEQ ID NO: 2279557 - DNA, 18 bp, Homo sapiens
atgcagaaggtatttttg

SEQ ID NO: 2279558 - DNA, 22 bp, Homo sapiens
atgcagaaggtatttttgaagt

SEQ ID NO: 2279559 - DNA, 17 bp, Homo sapiens
atgcagcttggagacag

SEQ ID NO: 2279560 - DNA, 16 bp, Homo sapiens
atgcagtccagtgaga

SEQ ID NO: 2279561 - DNA, 15 bp, Homo sapiens
atgcatatgatatat

SEQ ID NO: 2279562 - DNA, 13 bp, Homo sapiens
atgcatgatgggt

SEQ ID NO: 2279563 - DNA, 20 bp, Homo sapiens
atgcattattttgtcataaa

SEQ ID NO: 2279564 - DNA, 20 bp, Homo sapiens
atgcccaacagggcaaccaa

SEQ ID NO: 2279565 - DNA, 16 bp, Homo sapiens
atgcctccatttcaga

SEQ ID NO: 2279566 - DNA, 16 bp, Homo sapiens
atgcctgtatttccaa

SEQ ID NO: 2279567 - DNA, 20 bp, Homo sapiens
atgcctgtatttccaacaaa

SEQ ID NO: 2279568 - DNA, 22 bp, Homo sapiens
atgcgtgcagttcctgctgcct

SEQ ID NO: 2279569 - DNA, 14 bp, Homo sapiens
atgcgtttcatgta

SEQ ID NO: 2279570 - DNA, 20 bp, Homo sapiens
atgctaaatgcaaacactgt

SEQ ID NO: 2279571 - DNA, 16 bp, Homo sapiens
atgctaacaaactgaa

SEQ ID NO: 2279572 - DNA, 14 bp, Homo sapiens
atgctaatagaaaa

SEQ ID NO: 2279573 - DNA, 13 bp, Homo sapiens
atgctaatgtaat

SEQ ID NO: 2279574 - DNA, 23 bp, Homo sapiens
atgctaatgtaatcatttatctt

SEQ ID NO: 2279575 - DNA, 15 bp, Homo sapiens
atgctacagtatttt

SEQ ID NO: 2279576 - DNA, 16 bp, Homo sapiens
atgctatggaaataca

SEQ ID NO: 2279577 - DNA, 17 bp, Homo sapiens
atgctatggaaatacat

SEQ ID NO: 2279578 - DNA, 20 bp, Homo sapiens
atgctatggaaatacattta

SEQ ID NO: 2279579 - DNA, 17 bp, Homo sapiens
atgctctttcaccctgc

SEQ ID NO: 2279580 - DNA, 19 bp, Homo sapiens
atgctgctggaggaatcag

SEQ ID NO: 2279581 - DNA, 19 bp, Homo sapiens
atgctgtcccttacgtgag

SEQ ID NO: 2279582 - DNA, 17 bp, Homo sapiens
atgctgttggtgagaat

SEQ ID NO: 2279583 - DNA, 16 bp, Homo sapiens
atgcttgatataataa

SEQ ID NO: 2279584 - DNA, 16 bp, Homo sapiens
atgctttctcatgcat

SEQ ID NO: 2279585 - DNA, 23 bp, Homo sapiens
atgctttctcatgcatagacaag

SEQ ID NO: 2279586 - DNA, 15 bp, Homo sapiens
atggaaatcctgtta

SEQ ID NO: 2279587 - DNA, 11 bp, Homo sapiens
atggaacactc

SEQ ID NO: 2279588 - DNA, 16 bp, Homo sapiens
atggaacactctgaga

SEQ ID NO: 2279589 - DNA, 20 bp, Homo sapiens
atggaacttaaaacatatgg

SEQ ID NO: 2279590 - DNA, 13 bp, Homo sapiens
atggacattttgg

SEQ ID NO: 2279591 - DNA, 21 bp, Homo sapiens
atggaccactgtttcttgctt

SEQ ID NO: 2279592 - DNA, 19 bp, Homo sapiens
atggacctatctgtaagag

SEQ ID NO: 2279593 - DNA, 20 bp, Homo sapiens
atggacgagtgagctaccag

SEQ ID NO: 2279594 - DNA, 20 bp, Homo sapiens
atggacgtgttatgactcca

SEQ ID NO: 2279595 - DNA, 17 bp, Homo sapiens
atggagtccagacctgg

SEQ ID NO: 2279596 - DNA, 20 bp, Homo sapiens
atggagtccagacctgggcc

SEQ ID NO: 2279597 - DNA, 15 bp, Homo sapiens
atggatattagatgc

SEQ ID NO: 2279598 - DNA, 12 bp, Homo sapiens
atggccccagct

SEQ ID NO: 2279599 - DNA, 13 bp, Homo sapiens
atggccccagctg

SEQ ID NO: 2279600 - DNA, 16 bp, Homo sapiens
atggccccagctggct

SEQ ID NO: 2279601 - DNA, 20 bp, Homo sapiens
atggccccagctggctgggt

SEQ ID NO: 2279602 - DNA, 15 bp, Homo sapiens
atggctgcagtcctc

SEQ ID NO: 2279603 - DNA, 21 bp, Homo sapiens
atggctgcatcaaatgcatgc

SEQ ID NO: 2279604 - DNA, 15 bp, Homo sapiens
atgggaatgaatgtc

SEQ ID NO: 2279605 - DNA, 17 bp, Homo sapiens
atgggaattggaatcaa

SEQ ID NO: 2279606 - DNA, 22 bp, Homo sapiens
atgggagaagaggggtatagga

SEQ ID NO: 2279607 - DNA, 19 bp, Homo sapiens
atgggagtcagggagccct

SEQ ID NO: 2279608 - DNA, 17 bp, Homo sapiens
atgggagtgaacatttc

SEQ ID NO: 2279609 - DNA, 18 bp, Homo sapiens
atgggagtgaacatttct

SEQ ID NO: 2279610 - DNA, 14 bp, Homo sapiens
atgggcaaggggcc

SEQ ID NO: 2279611 - DNA, 19 bp, Homo sapiens
atgggcaaggggccaggaa

SEQ ID NO: 2279612 - DNA, 15 bp, Homo sapiens
atgggctctggcccc

SEQ ID NO: 2279613 - DNA, 20 bp, Homo sapiens
atggggactctccaggcacc

SEQ ID NO: 2279614 - DNA, 14 bp, Homo sapiens
atggggttgggctc

SEQ ID NO: 2279615 - DNA, 24 bp, Homo sapiens
atggggttgggctctgcgtcccac

SEQ ID NO: 2279616 - DNA, 14 bp, Homo sapiens
atgggtcctgctgc

SEQ ID NO: 2279617 - DNA, 15 bp, Homo sapiens
atggtaatcttttct

SEQ ID NO: 2279618 - DNA, 16 bp, Homo sapiens
atggtagctctgaagg

SEQ ID NO: 2279619 - DNA, 17 bp, Homo sapiens
atggtagctctgaaggg

SEQ ID NO: 2279620 - DNA, 15 bp, Homo sapiens
atggtatctgttact

SEQ ID NO: 2279621 - DNA, 15 bp, Homo sapiens
atggtgatactccaa

SEQ ID NO: 2279622 - DNA, 19 bp, Homo sapiens
atggtgcaatgacctttca

SEQ ID NO: 2279623 - DNA, 15 bp, Homo sapiens
atggttctagaagga

SEQ ID NO: 2279624 - DNA, 18 bp, Homo sapiens
atggttgcgtcctttgaa

SEQ ID NO: 2279625 - DNA, 13 bp, Homo sapiens
atgtaaaaatgtt

SEQ ID NO: 2279626 - DNA, 12 bp, Homo sapiens
atgtaaaattca

SEQ ID NO: 2279627 - DNA, 14 bp, Homo sapiens
atgtaaaattcata

SEQ ID NO: 2279628 - DNA, 15 bp, Homo sapiens
atgtaaacatcataa

SEQ ID NO: 2279629 - DNA, 14 bp, Homo sapiens
atgtaaatatacag

SEQ ID NO: 2279630 - DNA, 22 bp, Homo sapiens
atgtaacagttggtgattttag

SEQ ID NO: 2279631 - DNA, 16 bp, Homo sapiens
atgtaacatgtctaaa

SEQ ID NO: 2279632 - DNA, 15 bp, Homo sapiens
atgtaagggctttaa

SEQ ID NO: 2279633 - DNA, 19 bp, Homo sapiens
atgtaagggctttaaataa

SEQ ID NO: 2279634 - DNA, 20 bp, Homo sapiens
atgtaagggctttaaataaa

SEQ ID NO: 2279635 - DNA, 21 bp, Homo sapiens
atgtaagggctttaaataaaa

SEQ ID NO: 2279636 - DNA, 23 bp, Homo sapiens
atgtaagggctttaaataaaaga

SEQ ID NO: 2279637 - DNA, 19 bp, Homo sapiens
atgtaatcatttatcttat

SEQ ID NO: 2279638 - DNA, 17 bp, Homo sapiens
atgtaccatgttaaaga

SEQ ID NO: 2279639 - DNA, 14 bp, Homo sapiens
atgtagaactgttc

SEQ ID NO: 2279640 - DNA, 15 bp, Homo sapiens
atgtagaactgttca

SEQ ID NO: 2279641 - DNA, 23 bp, Homo sapiens
atgtagacaaaacttataatttc

SEQ ID NO: 2279642 - DNA, 17 bp, Homo sapiens
atgtagacagactttgt

SEQ ID NO: 2279643 - DNA, 16 bp, Homo sapiens
atgtagaggctttatg

SEQ ID NO: 2279644 - DNA, 20 bp, Homo sapiens
atgtagccagcagaactgaa

SEQ ID NO: 2279645 - DNA, 15 bp, Homo sapiens
atgtagttgatgtat

SEQ ID NO: 2279646 - DNA, 17 bp, Homo sapiens
atgtagttgatgtatcc

SEQ ID NO: 2279647 - DNA, 13 bp, Homo sapiens
atgtatagaaaat

SEQ ID NO: 2279648 - DNA, 12 bp, Homo sapiens
atgtatagcttt

SEQ ID NO: 2279649 - DNA, 22 bp, Homo sapiens
atgtatatgctactgtgttaca

SEQ ID NO: 2279650 - DNA, 18 bp, Homo sapiens
atgtatatgttatttttg

SEQ ID NO: 2279651 - DNA, 21 bp, Homo sapiens
atgtatcttatttatatatga

SEQ ID NO: 2279652 - DNA, 21 bp, Homo sapiens
atgtattcttttatataacta

SEQ ID NO: 2279653 - DNA, 14 bp, Homo sapiens
atgtcaaaaatatt

SEQ ID NO: 2279654 - DNA, 22 bp, Homo sapiens
atttgtaggtatactatgtaag

SEQ ID NO: 2279655 - DNA, 14 bp, Homo sapiens
atttgtatttatat

SEQ ID NO: 2279656 - DNA, 18 bp, Homo sapiens
atttgtgagccaaagaga

SEQ ID NO: 2279657 - DNA, 20 bp, Homo sapiens
atttgtgagccaaagagaaa

SEQ ID NO: 2279658 - DNA, 22 bp, Homo sapiens
atttgtgagccaaagagaaaag

SEQ ID NO: 2279659 - DNA, 14 bp, Homo sapiens
attttaaaaaataa

SEQ ID NO: 2279660 - DNA, 22 bp, Homo sapiens
attttaaaaatctacgtcttta

SEQ ID NO: 2279661 - DNA, 14 bp, Homo sapiens
attttaaaatgcaa

SEQ ID NO: 2279662 - DNA, 19 bp, Homo sapiens
attttaacagacatgtata

SEQ ID NO: 2279663 - DNA, 20 bp, Homo sapiens
attttaatgtaaaattcata

SEQ ID NO: 2279664 - DNA, 21 bp, Homo sapiens
attttagacaaccatagaact

SEQ ID NO: 2279665 - DNA, 22 bp, Homo sapiens
attttatccctttctcttctga

SEQ ID NO: 2279666 - DNA, 15 bp, Homo sapiens
attttcaataaagaa

SEQ ID NO: 2279667 - DNA, 10 bp, Homo sapiens
attttcagat

SEQ ID NO: 2279668 - DNA, 19 bp, Homo sapiens
attttcagtgctttgccct

SEQ ID NO: 2279669 - DNA, 23 bp, Homo sapiens
attttcccacaattcttttgaaa

SEQ ID NO: 2279670 - DNA, 18 bp, Homo sapiens
attttcctggagtgaaga

SEQ ID NO: 2279671 - DNA, 19 bp, Homo sapiens
attttcctggagtgaagaa

SEQ ID NO: 2279672 - DNA, 23 bp, Homo sapiens
attttcctggagtgaagaaaact

SEQ ID NO: 2279673 - DNA, 23 bp, Homo sapiens
attttccttcctgttctgtgtct

SEQ ID NO: 2279674 - DNA, 13 bp, Homo sapiens
attttcgtgcatt

SEQ ID NO: 2279675 - DNA, 16 bp, Homo sapiens
attttctaaactgttt

SEQ ID NO: 2279676 - DNA, 17 bp, Homo sapiens
attttctacagtacatg

SEQ ID NO: 2279677 - DNA, 22 bp, Homo sapiens
attttctactccacctcttcct

SEQ ID NO: 2279678 - DNA, 15 bp, Homo sapiens
attttctatgtacta

SEQ ID NO: 2279679 - DNA, 19 bp, Homo sapiens
attttctatgtactagtac

SEQ ID NO: 2279680 - DNA, 23 bp, Homo sapiens
attttctatgtactagtactgtg

SEQ ID NO: 2279681 - DNA, 15 bp, Homo sapiens
attttctatttaaaa

SEQ ID NO: 2279682 - DNA, 16 bp, Homo sapiens
attttctgaattcata

SEQ ID NO: 2279683 - DNA, 16 bp, Homo sapiens
attttctttctatgta

SEQ ID NO: 2279684 - DNA, 18 bp, Homo sapiens
attttctttgaaattcat

SEQ ID NO: 2279685 - DNA, 13 bp, Homo sapiens
attttcttttata

SEQ ID NO: 2279686 - DNA, 16 bp, Homo sapiens
attttcttttatatct

SEQ ID NO: 2279687 - DNA, 20 bp, Homo sapiens
attttcttttatatctgtaa

SEQ ID NO: 2279688 - DNA, 21 bp, Homo sapiens
attttcttttatatctgtaaa

SEQ ID NO: 2279689 - DNA, 22 bp, Homo sapiens
attttcttttatatctgtaaat

SEQ ID NO: 2279690 - DNA, 15 bp, Homo sapiens
attttggctcagagt

SEQ ID NO: 2279691 - DNA, 20 bp, Homo sapiens
attttgggtggccaaagtgt

SEQ ID NO: 2279692 - DNA, 23 bp, Homo sapiens
attttgtagtagttgatgaccaa

SEQ ID NO: 2279693 - DNA, 23 bp, Homo sapiens
attttgtattattgctgttgctt

SEQ ID NO: 2279694 - DNA, 18 bp, Homo sapiens
attttgtcataaaatgct

SEQ ID NO: 2279695 - DNA, 22 bp, Homo sapiens
attttgtggctgatttcaaatg

SEQ ID NO: 2279696 - DNA, 17 bp, Homo sapiens
atttttaaagcaaaaaa

SEQ ID NO: 2279697 - DNA, 12 bp, Homo sapiens
atttttcttgga

SEQ ID NO: 2279698 - DNA, 20 bp, Homo sapiens
atttttgtggcatgttgtaa

SEQ ID NO: 2279699 - DNA, 21 bp, Homo sapiens
attttttactacataattaaa

SEQ ID NO: 2279700 - DNA, 16 bp, Homo sapiens
atttttttttccttca

SEQ ID NO: 2279701 - DNA, 20 bp, Homo sapiens
atttttttttccttcagtgc

SEQ ID NO: 2279702 - DNA, 18 bp, Homo sapiens
caaaaaatattcatctgt

SEQ ID NO: 2279703 - DNA, 20 bp, Homo sapiens
caaaaaatgtgagctataat

SEQ ID NO: 2279704 - DNA, 12 bp, Homo sapiens
caaaaatatttt

SEQ ID NO: 2279705 - DNA, 22 bp, Homo sapiens
caaaaatattttgcaagctctg

SEQ ID NO: 2279706 - DNA, 16 bp, Homo sapiens
caaaacaaagtctttg

SEQ ID NO: 2279707 - DNA, 20 bp, Homo sapiens
caaaactatcggttcaagtt

SEQ ID NO: 2279708 - DNA, 14 bp, Homo sapiens
caaaagctgaaatt

SEQ ID NO: 2279709 - DNA, 22 bp, Homo sapiens
caaaagtcattgctgacagagc

SEQ ID NO: 2279710 - DNA, 18 bp, Homo sapiens
caaaagtccttagaatga

SEQ ID NO: 2279711 - DNA, 19 bp, Homo sapiens
caaaagtccttagaatgag

SEQ ID NO: 2279712 - DNA, 22 bp, Homo sapiens
caaaagtccttagaatgaggga

SEQ ID NO: 2279713 - DNA, 22 bp, Homo sapiens
caaaataaatggactgaagtta

SEQ ID NO: 2279714 - DNA, 15 bp, Homo sapiens
caaaatagtcatgtt

SEQ ID NO: 2279715 - DNA, 16 bp, Homo sapiens
caaaatagttctattt

SEQ ID NO: 2279716 - DNA, 22 bp, Homo sapiens
caaaatagttctatttctatct

SEQ ID NO: 2279717 - DNA, 14 bp, Homo sapiens
caaaatatagttaa

SEQ ID NO: 2279718 - DNA, 14 bp, Homo sapiens
caaaatatttattt

SEQ ID NO: 2279719 - DNA, 21 bp, Homo sapiens
caaaatatttatttgttttgg

SEQ ID NO: 2279720 - DNA, 20 bp, Homo sapiens
caaaatatttctaagcttat

SEQ ID NO: 2279721 - DNA, 12 bp, Homo sapiens
caaaatcattcc

SEQ ID NO: 2279722 - DNA, 11 bp, Homo sapiens
caaaatgaaac

SEQ ID NO: 2279723 - DNA, 11 bp, Homo sapiens
caaaatgcaag

SEQ ID NO: 2279724 - DNA, 21 bp, Homo sapiens
caaaatttaattgtgtaactg

SEQ ID NO: 2279725 - DNA, 22 bp, Homo sapiens
caaacaaaggatttgaaaacac

SEQ ID NO: 2279726 - DNA, 19 bp, Homo sapiens
caaacactgcttaaggaaa

SEQ ID NO: 2279727 - DNA, 14 bp, Homo sapiens
caaacactgtgtat

SEQ ID NO: 2279728 - DNA, 18 bp, Homo sapiens
caaacatttctttttcct

SEQ ID NO: 2279729 - DNA, 14 bp, Homo sapiens
caaaccagtttcac

SEQ ID NO: 2279730 - DNA, 14 bp, Homo sapiens
caaaccatcattga

SEQ ID NO: 2279731 - DNA, 16 bp, Homo sapiens
caaaccatcattgaaa

SEQ ID NO: 2279732 - DNA, 19 bp, Homo sapiens
caaaccatcattgaaatct

SEQ ID NO: 2279733 - DNA, 20 bp, Homo sapiens
caaaccatcatttaatttct

SEQ ID NO: 2279734 - DNA, 20 bp, Homo sapiens
caaacccttcagtgccaaaa

SEQ ID NO: 2279735 - DNA, 20 bp, Homo sapiens
caaactgaaaaatctagaca

SEQ ID NO: 2279736 - DNA, 12 bp, Homo sapiens
caaactgttctg

SEQ ID NO: 2279737 - DNA, 20 bp, Homo sapiens
caaactgttctgagaaggtg

SEQ ID NO: 2279738 - DNA, 19 bp, Homo sapiens
caaagaactccagagtcag

SEQ ID NO: 2279739 - DNA, 16 bp, Homo sapiens
caaagaggcattcagc

SEQ ID NO: 2279740 - DNA, 17 bp, Homo sapiens
caaagcagtgcatgctg

SEQ ID NO: 2279741 - DNA, 23 bp, Homo sapiens
caaagctttcctgtttccagggt

SEQ ID NO: 2279742 - DNA, 17 bp, Homo sapiens
caaagggcgggcctgtt

SEQ ID NO: 2279743 - DNA, 23 bp, Homo sapiens
caaaggggatcataaagttagaa

SEQ ID NO: 2279744 - DNA, 19 bp, Homo sapiens
caaaggggcctctcctttt

SEQ ID NO: 2279745 - DNA, 21 bp, Homo sapiens
caaagtaaaattagagcaaga

SEQ ID NO: 2279746 - DNA, 19 bp, Homo sapiens
caaagtgtacaattttcat

SEQ ID NO: 2279747 - DNA, 14 bp, Homo sapiens
caaataaaacagtg

SEQ ID NO: 2279748 - DNA, 14 bp, Homo sapiens
caaataaaatgttt

SEQ ID NO: 2279749 - DNA, 22 bp, Homo sapiens
caaataaaatgtttacattttc

SEQ ID NO: 2279750 - DNA, 23 bp, Homo sapiens
caaataaaatgtttacattttct

SEQ ID NO: 2279751 - DNA, 15 bp, Homo sapiens
caaataataataata

SEQ ID NO: 2279752 - DNA, 18 bp, Homo sapiens
caaataataataataaca

SEQ ID NO: 2279753 - DNA, 15 bp, Homo sapiens
caaatataaacttgt

SEQ ID NO: 2279754 - DNA, 19 bp, Homo sapiens
caaatatagttgaacaaga

SEQ ID NO: 2279755 - DNA, 20 bp, Homo sapiens
caaatattagccaaagaggc

SEQ ID NO: 2279756 - DNA, 16 bp, Homo sapiens
caaatattcattttga

SEQ ID NO: 2279757 - DNA, 22 bp, Homo sapiens
caaatcctgggcatccccagcc

SEQ ID NO: 2279758 - DNA, 14 bp, Homo sapiens
caaatgaatgcctt

SEQ ID NO: 2279759 - DNA, 22 bp, Homo sapiens
caaatgattcatttttctgtta

SEQ ID NO: 2279760 - DNA, 20 bp, Homo sapiens
caaatgcagtccagtgagaa

SEQ ID NO: 2279761 - DNA, 22 bp, Homo sapiens
caaatgcagtccagtgagaaat

SEQ ID NO: 2279762 - DNA, 16 bp, Homo sapiens
caaatgctaaatgcaa

SEQ ID NO: 2279763 - DNA, 21 bp, Homo sapiens
caaatggaaacagaggaccag

SEQ ID NO: 2279764 - DNA, 17 bp, Homo sapiens
caaatgttgtatttcaa

SEQ ID NO: 2279765 - DNA, 19 bp, Homo sapiens
caaattaacctttcaggaa

SEQ ID NO: 2279766 - DNA, 16 bp, Homo sapiens
caaattattctagtca

SEQ ID NO: 2279767 - DNA, 17 bp, Homo sapiens
caaattattctagtcaa

SEQ ID NO: 2279768 - DNA, 18 bp, Homo sapiens
caacaactccaggaaaac

SEQ ID NO: 2279769 - DNA, 13 bp, Homo sapiens
caacaccctcttc

SEQ ID NO: 2279770 - DNA, 15 bp, Homo sapiens
caacactcactgcct

SEQ ID NO: 2279771 - DNA, 16 bp, Homo sapiens
caacactcactgcctg

SEQ ID NO: 2279772 - DNA, 21 bp, Homo sapiens
caacactcactgcctgcagct

SEQ ID NO: 2279773 - DNA, 17 bp, Homo sapiens
caacagaaacttctcag

SEQ ID NO: 2279774 - DNA, 14 bp, Homo sapiens
caacaggggctgga

SEQ ID NO: 2279775 - DNA, 19 bp, Homo sapiens
caacaggttttcctgaaga

SEQ ID NO: 2279776 - DNA, 13 bp, Homo sapiens
caacatccactct

SEQ ID NO: 2279777 - DNA, 18 bp, Homo sapiens
caacatgcatatgatata

SEQ ID NO: 2279778 - DNA, 20 bp, Homo sapiens
caacatgcatatgatatata

SEQ ID NO: 2279779 - DNA, 14 bp, Homo sapiens
caacattaatttta

SEQ ID NO: 2279780 - DNA, 16 bp, Homo sapiens
caacattatcctgtgt

SEQ ID NO: 2279781 - DNA, 15 bp, Homo sapiens
caaccagagcactgt

SEQ ID NO: 2279782 - DNA, 18 bp, Homo sapiens
caaccagagcactgtata

SEQ ID NO: 2279783 - DNA, 15 bp, Homo sapiens
caaccatagaactgt

SEQ ID NO: 2279784 - DNA, 13 bp, Homo sapiens
caacccaggtctg

SEQ ID NO: 2279785 - DNA, 14 bp, Homo sapiens
cacagctgtgagga

SEQ ID NO: 2279786 - DNA, 16 bp, Homo sapiens
cacaggcaacattaca

SEQ ID NO: 2279787 - DNA, 14 bp, Homo sapiens
cacaggctggtgtg

SEQ ID NO: 2279788 - DNA, 19 bp, Homo sapiens
cacagtagtgttgggtgga

SEQ ID NO: 2279789 - DNA, 16 bp, Homo sapiens
cacagtgattagcctc

SEQ ID NO: 2279790 - DNA, 23 bp, Homo sapiens
cacagtggtcagcgattcctgcc

SEQ ID NO: 2279791 - DNA, 13 bp, Homo sapiens
cacataaatctgt

SEQ ID NO: 2279792 - DNA, 15 bp, Homo sapiens
cacataaatctgtct

SEQ ID NO: 2279793 - DNA, 14 bp, Homo sapiens
cacatatatctgat

SEQ ID NO: 2279794 - DNA, 22 bp, Homo sapiens
cacatcccccgtgtattcagga

SEQ ID NO: 2279795 - DNA, 14 bp, Homo sapiens
cacatctcacttca

SEQ ID NO: 2279796 - DNA, 14 bp, Homo sapiens
cacatctgtatatc

SEQ ID NO: 2279797 - DNA, 15 bp, Homo sapiens
cacatgcactcagtg

SEQ ID NO: 2279798 - DNA, 21 bp, Homo sapiens
cacattctgctgcccccagac

SEQ ID NO: 2279799 - DNA, 22 bp, Homo sapiens
cacattctgctgcccccagacc

SEQ ID NO: 2279800 - DNA, 22 bp, Homo sapiens
cacattgcccacacctgcctct

SEQ ID NO: 2279801 - DNA, 21 bp, Homo sapiens
cacattggtctatctactggc

SEQ ID NO: 2279802 - DNA, 17 bp, Homo sapiens
cacatttagtccaatga

SEQ ID NO: 2279803 - DNA, 15 bp, Homo sapiens
caccaagagtacagg

SEQ ID NO: 2279804 - DNA, 15 bp, Homo sapiens
caccaagggtatctg

SEQ ID NO: 2279805 - DNA, 17 bp, Homo sapiens
caccaagggtatctgct

SEQ ID NO: 2279806 - DNA, 21 bp, Homo sapiens
caccaatatcatgtgtagata

SEQ ID NO: 2279807 - DNA, 22 bp, Homo sapiens
caccaatatcatgtgtagatat

SEQ ID NO: 2279808 - DNA, 17 bp, Homo sapiens
caccaatggctgcatca

SEQ ID NO: 2279809 - DNA, 22 bp, Homo sapiens
caccacaacaaagtgcttcctt

SEQ ID NO: 2279810 - DNA, 23 bp, Homo sapiens
caccacataaggtcagctcagag

SEQ ID NO: 2279811 - DNA, 11 bp, Homo sapiens
caccagcctga

SEQ ID NO: 2279812 - DNA, 15 bp, Homo sapiens
caccagcctgagcca

SEQ ID NO: 2279813 - DNA, 23 bp, Homo sapiens
caccagccttgaactgtggccac

SEQ ID NO: 2279814 - DNA, 16 bp, Homo sapiens
cacccaagcacaaact

SEQ ID NO: 2279815 - DNA, 23 bp, Homo sapiens
cacccaattttaaaaaataacat

SEQ ID NO: 2279816 - DNA, 22 bp, Homo sapiens
cacccacaccccgtctgcccct

SEQ ID NO: 2279817 - DNA, 18 bp, Homo sapiens
cacccagccccagcgagt

SEQ ID NO: 2279818 - DNA, 16 bp, Homo sapiens
cacccaggcaggggct

SEQ ID NO: 2279819 - DNA, 13 bp, Homo sapiens
caccccgctgcct

SEQ ID NO: 2279820 - DNA, 16 bp, Homo sapiens
caccccgctgcctggc

SEQ ID NO: 2279821 - DNA, 17 bp, Homo sapiens
caccccgctgcctggcg

SEQ ID NO: 2279822 - DNA, 18 bp, Homo sapiens
caccccgctgcctggcgg

SEQ ID NO: 2279823 - DNA, 12 bp, Homo sapiens
caccccgtcccg

SEQ ID NO: 2279824 - DNA, 15 bp, Homo sapiens
caccccgtcccggcc

SEQ ID NO: 2279825 - DNA, 18 bp, Homo sapiens
caccccgtcccggccccg

SEQ ID NO: 2279826 - DNA, 19 bp, Homo sapiens
caccccgtcccggccccgc

SEQ ID NO: 2279827 - DNA, 14 bp, Homo sapiens
cacccctcctcctt

SEQ ID NO: 2279828 - DNA, 11 bp, Homo sapiens
cacccgcccca

SEQ ID NO: 2279829 - DNA, 13 bp, Homo sapiens
cacccgccccaga

SEQ ID NO: 2279830 - DNA, 16 bp, Homo sapiens
cacccgccccagagac

SEQ ID NO: 2279831 - DNA, 18 bp, Homo sapiens
cacccgccccagagactg

SEQ ID NO: 2279832 - DNA, 19 bp, Homo sapiens
cacccgcccgcccccgccc

SEQ ID NO: 2279833 - DNA, 13 bp, Homo sapiens
cacccggcagccc

SEQ ID NO: 2279834 - DNA, 14 bp, Homo sapiens
caccctagcctaga

SEQ ID NO: 2279835 - DNA, 13 bp, Homo sapiens
caccctattttca

SEQ ID NO: 2279836 - DNA, 15 bp, Homo sapiens
caccctgcttctgct

SEQ ID NO: 2279837 - DNA, 19 bp, Homo sapiens
caccctgcttctgctgcct

SEQ ID NO: 2279838 - DNA, 20 bp, Homo sapiens
caccctgcttctgctgcctg

SEQ ID NO: 2279839 - DNA, 15 bp, Homo sapiens
caccctgggcctccc

SEQ ID NO: 2279840 - DNA, 22 bp, Homo sapiens
caccgaaaacgtggctgcttca

SEQ ID NO: 2279841 - DNA, 19 bp, Homo sapiens
caccgcaccgggctggcct

SEQ ID NO: 2279842 - DNA, 22 bp, Homo sapiens
caccgcaccgggctggcctgac

SEQ ID NO: 2279843 - DNA, 13 bp, Homo sapiens
caccgccatgcat

SEQ ID NO: 2279844 - DNA, 20 bp, Homo sapiens
caccgccatgcatgatgggt

SEQ ID NO: 2279845 - DNA, 20 bp, Homo sapiens
caccgcccaacccccacctc

SEQ ID NO: 2279846 - DNA, 16 bp, Homo sapiens
caccgcccacccacac

SEQ ID NO: 2279847 - DNA, 16 bp, Homo sapiens
caccgcccctggacag

SEQ ID NO: 2279848 - DNA, 20 bp, Homo sapiens
caccgtggtgtgaggccccc

SEQ ID NO: 2279849 - DNA, 18 bp, Homo sapiens
cacctagaaaggggccca

SEQ ID NO: 2279850 - DNA, 15 bp, Homo sapiens
cacctcactcagcac

SEQ ID NO: 2279851 - DNA, 19 bp, Homo sapiens
cacctcactcagcaccact

SEQ ID NO: 2279852 - DNA, 22 bp, Homo sapiens
cacctcccggtgtatgcagtgg

SEQ ID NO: 2279853 - DNA, 18 bp, Homo sapiens
cacctctaggcctcagtg

SEQ ID NO: 2279854 - DNA, 12 bp, Homo sapiens
cacctcttcctt

SEQ ID NO: 2279855 - DNA, 14 bp, Homo sapiens
cacctgaggcagga

SEQ ID NO: 2279856 - DNA, 15 bp, Homo sapiens
cacctgaggcaggag

SEQ ID NO: 2279857 - DNA, 18 bp, Homo sapiens
cacctgcccagttagccc

SEQ ID NO: 2279858 - DNA, 14 bp, Homo sapiens
cacctgccctctgt

SEQ ID NO: 2279859 - DNA, 15 bp, Homo sapiens
cacctgccgctgctt

SEQ ID NO: 2279860 - DNA, 18 bp, Homo sapiens
cacctgccgctgcttgag

SEQ ID NO: 2279861 - DNA, 20 bp, Homo sapiens
cacctgcctctgaactgctg

SEQ ID NO: 2279862 - DNA, 17 bp, Homo sapiens
cacctgggagatgctgg

SEQ ID NO: 2279863 - DNA, 18 bp, Homo sapiens
cacctgggagatgctggg

SEQ ID NO: 2279864 - DNA, 19 bp, Homo sapiens
caccttcactctccagggt

SEQ ID NO: 2279865 - DNA, 22 bp, Homo sapiens
caccttgtacagaaccagcact

SEQ ID NO: 2279866 - DNA, 22 bp, Homo sapiens
cacctttgtaaatacacaattc

SEQ ID NO: 2279867 - DNA, 20 bp, Homo sapiens
cacgaggccttcagaaaaga

SEQ ID NO: 2279868 - DNA, 21 bp, Homo sapiens
cacgcacttctggggccagcc

SEQ ID NO: 2279869 - DNA, 11 bp, Homo sapiens
cacgcagagcc

SEQ ID NO: 2279870 - DNA, 16 bp, Homo sapiens
cacgcagagccccgga

SEQ ID NO: 2279871 - DNA, 20 bp, Homo sapiens
cacgcagagccccggagcac

SEQ ID NO: 2279872 - DNA, 16 bp, Homo sapiens
cacgccggggctggcc

SEQ ID NO: 2279873 - DNA, 17 bp, Homo sapiens
cacgccggggctggccc

SEQ ID NO: 2279874 - DNA, 15 bp, Homo sapiens
cacgctgcctcctca

SEQ ID NO: 2279875 - DNA, 14 bp, Homo sapiens
cacgcttctggagg

SEQ ID NO: 2279876 - DNA, 14 bp, Homo sapiens
cacggaccctgtgt

SEQ ID NO: 2279877 - DNA, 18 bp, Homo sapiens
cacggaggcctcgagcag

SEQ ID NO: 2279878 - DNA, 18 bp, Homo sapiens
cacggcctctggggagac

SEQ ID NO: 2279879 - DNA, 21 bp, Homo sapiens
cacgggagagcgccacccgcc

SEQ ID NO: 2279880 - DNA, 18 bp, Homo sapiens
cacgggcccgctcaacct

SEQ ID NO: 2279881 - DNA, 20 bp, Homo sapiens
cacgggcccgctcaacctct

SEQ ID NO: 2279882 - DNA, 22 bp, Homo sapiens
cacggggtcgggggaggagcac

SEQ ID NO: 2279883 - DNA, 16 bp, Homo sapiens
cacgtcctcgctcccg

SEQ ID NO: 2279884 - DNA, 19 bp, Homo sapiens
cacgtgctcttctgttctc

SEQ ID NO: 2279885 - DNA, 13 bp, Homo sapiens
cactagaatgaga

SEQ ID NO: 2279886 - DNA, 16 bp, Homo sapiens
cactagaatgagaaat

SEQ ID NO: 2279887 - DNA, 16 bp, Homo sapiens
cactagtagagcaaag

SEQ ID NO: 2279888 - DNA, 16 bp, Homo sapiens
cactcactgcctgcag

SEQ ID NO: 2279889 - DNA, 18 bp, Homo sapiens
cactcacttaattctcat

SEQ ID NO: 2279890 - DNA, 13 bp, Homo sapiens
cactcagcaccac

SEQ ID NO: 2279891 - DNA, 16 bp, Homo sapiens
cactcagcaccactca

SEQ ID NO: 2279892 - DNA, 22 bp, Homo sapiens
cactcagtgtggactgggaagc

SEQ ID NO: 2279893 - DNA, 18 bp, Homo sapiens
cactccgactccccctcc

SEQ ID NO: 2279894 - DNA, 17 bp, Homo sapiens
cactccgggtcaagttg

SEQ ID NO: 2279895 - DNA, 15 bp, Homo sapiens
cactcctgggcccca

SEQ ID NO: 2279896 - DNA, 12 bp, Homo sapiens
cactctccttgg

SEQ ID NO: 2279897 - DNA, 16 bp, Homo sapiens
cactctgttgaccagg

SEQ ID NO: 2279898 - DNA, 19 bp, Homo sapiens
cactctgttgaccaggctg

SEQ ID NO: 2279899 - DNA, 20 bp, Homo sapiens
cactctgttgaccaggctgg

SEQ ID NO: 2279900 - DNA, 20 bp, Homo sapiens
cactgagtctcattcctctg

SEQ ID NO: 2279901 - DNA, 19 bp, Homo sapiens
cactgatatcacgggcccg

SEQ ID NO: 2279902 - DNA, 17 bp, Homo sapiens
cactgatgggtcctgct

SEQ ID NO: 2279903 - DNA, 21 bp, Homo sapiens
cactgatgggtcctgctgctc

SEQ ID NO: 2279904 - DNA, 13 bp, Homo sapiens
cactgcagcctcg

SEQ ID NO: 2279905 - DNA, 14 bp, Homo sapiens
cactgcagcctcga

SEQ ID NO: 2279906 - DNA, 22 bp, Homo sapiens
cactgcagcctcgacctccctg

SEQ ID NO: 2279907 - DNA, 22 bp, Homo sapiens
cactgcatctttctcttcccat

SEQ ID NO: 2279908 - DNA, 14 bp, Homo sapiens
cactggctttacat

SEQ ID NO: 2279909 - DNA, 16 bp, Homo sapiens
cactggggtgggaggg

SEQ ID NO: 2279910 - DNA, 19 bp, Homo sapiens
cactggggtgggagggggc

SEQ ID NO: 2279911 - DNA, 23 bp, Homo sapiens
cactggggtgggagggggcaggg

SEQ ID NO: 2279912 - DNA, 22 bp, Homo sapiens
cactgtataccccgtgaagcat

SEQ ID NO: 2279913 - DNA, 14 bp, Homo sapiens
cactgtggaacact

SEQ ID NO: 2279914 - DNA, 20 bp, Homo sapiens
cactgtggaacactaaagag

SEQ ID NO: 2279915 - DNA, 19 bp, Homo sapiens
cactgtgttgcccaggctg

SEQ ID NO: 2279916 - DNA, 16 bp, Homo sapiens
cactgttaagaataga

SEQ ID NO: 2279917 - DNA, 14 bp, Homo sapiens
cagcctagcacagg

SEQ ID NO: 2279918 - DNA, 18 bp, Homo sapiens
cagcctcacccctgcagg

SEQ ID NO: 2279919 - DNA, 15 bp, Homo sapiens
cagcctcccccaggc

SEQ ID NO: 2279920 - DNA, 18 bp, Homo sapiens
cagcctcccccaggctgc

SEQ ID NO: 2279921 - DNA, 14 bp, Homo sapiens
cagcctcctgagta

SEQ ID NO: 2279922 - DNA, 19 bp, Homo sapiens
cagcctcgacctccctggc

SEQ ID NO: 2279923 - DNA, 22 bp, Homo sapiens
cagcctcgacctccctggcttg

SEQ ID NO: 2279924 - DNA, 24 bp, Homo sapiens
cagcctcgacctccctggcttgag

SEQ ID NO: 2279925 - DNA, 20 bp, Homo sapiens
cagcctgagccacagtgggg

SEQ ID NO: 2279926 - DNA, 11 bp, Homo sapiens
cagcctgagct

SEQ ID NO: 2279927 - DNA, 12 bp, Homo sapiens
cagcctgagctc

SEQ ID NO: 2279928 - DNA, 16 bp, Homo sapiens
cagcctgtggcagggc

SEQ ID NO: 2279929 - DNA, 21 bp, Homo sapiens
cagccttgaactgtggccacc

SEQ ID NO: 2279930 - DNA, 22 bp, Homo sapiens
cagccttgaactgtggccacct

SEQ ID NO: 2279931 - DNA, 16 bp, Homo sapiens
cagcctttgcgctctg

SEQ ID NO: 2279932 - DNA, 17 bp, Homo sapiens
cagcggccccgcacccc

SEQ ID NO: 2279933 - DNA, 12 bp, Homo sapiens
cagcggcccggc

SEQ ID NO: 2279934 - DNA, 18 bp, Homo sapiens
cagcggcccggcccacgc

SEQ ID NO: 2279935 - DNA, 23 bp, Homo sapiens
cagcggcccggcccacgcagagc

SEQ ID NO: 2279936 - DNA, 19 bp, Homo sapiens
cagcgtgcaggagcaaggc

SEQ ID NO: 2279937 - DNA, 16 bp, Homo sapiens
cagcgtggcaacaggc

SEQ ID NO: 2279938 - DNA, 15 bp, Homo sapiens
cagcgtggggctaac

SEQ ID NO: 2279939 - DNA, 18 bp, Homo sapiens
cagcgtgggggtggccac

SEQ ID NO: 2279940 - DNA, 15 bp, Homo sapiens
cagctaacatggaag

SEQ ID NO: 2279941 - DNA, 19 bp, Homo sapiens
cagctaacatggaagtact

SEQ ID NO: 2279942 - DNA, 23 bp, Homo sapiens
cagctagatttgtgtccacacta

SEQ ID NO: 2279943 - DNA, 12 bp, Homo sapiens
cagctagcaagg

SEQ ID NO: 2279944 - DNA, 15 bp, Homo sapiens
cagctcactgcagcc

SEQ ID NO: 2279945 - DNA, 19 bp, Homo sapiens
cagctcagtcccacagccc

SEQ ID NO: 2279946 - DNA, 21 bp, Homo sapiens
cagctcagtcccacagcccct

SEQ ID NO: 2279947 - DNA, 17 bp, Homo sapiens
cagctccaacctggagg

SEQ ID NO: 2279948 - DNA, 18 bp, Homo sapiens
cagctccaacctggaggc

SEQ ID NO: 2279949 - DNA, 20 bp, Homo sapiens
cagctccaacctggaggctg

SEQ ID NO: 2279950 - DNA, 22 bp, Homo sapiens
cagctccaacctggaggctgga

SEQ ID NO: 2279951 - DNA, 14 bp, Homo sapiens
cagctcctgccccg

SEQ ID NO: 2279952 - DNA, 17 bp, Homo sapiens
cagctcctgccccgccg

SEQ ID NO: 2279953 - DNA, 21 bp, Homo sapiens
cagctctcccctgcgcaggcc

SEQ ID NO: 2279954 - DNA, 24 bp, Homo sapiens
cagctgactgaatgcagaacggtt

SEQ ID NO: 2279955 - DNA, 20 bp, Homo sapiens
cagctgagattccagaacgc

SEQ ID NO: 2279956 - DNA, 21 bp, Homo sapiens
cagctgagattccagaacgcc

SEQ ID NO: 2279957 - DNA, 20 bp, Homo sapiens
cagctgagcattctcatttt

SEQ ID NO: 2279958 - DNA, 13 bp, Homo sapiens
cagctggactggg

SEQ ID NO: 2279959 - DNA, 22 bp, Homo sapiens
cagctggactgggtgggcccca

SEQ ID NO: 2279960 - DNA, 18 bp, Homo sapiens
cagctggcagcgcctccc

SEQ ID NO: 2279961 - DNA, 14 bp, Homo sapiens
cagctggctgggtc

SEQ ID NO: 2279962 - DNA, 19 bp, Homo sapiens
cagctgggaagaacatgct

SEQ ID NO: 2279963 - DNA, 23 bp, Homo sapiens
cagcttgtccaacaactccagga

SEQ ID NO: 2279964 - DNA, 15 bp, Homo sapiens
caggaaaactgtttt

SEQ ID NO: 2279965 - DNA, 17 bp, Homo sapiens
caggaaaactgtttttc

SEQ ID NO: 2279966 - DNA, 21 bp, Homo sapiens
caggaaatagtgttcttttta

SEQ ID NO: 2279967 - DNA, 20 bp, Homo sapiens
caggaacacccagccccagc

SEQ ID NO: 2279968 - DNA, 13 bp, Homo sapiens
caggaaccgagga

SEQ ID NO: 2279969 - DNA, 13 bp, Homo sapiens
caggaagaggggc

SEQ ID NO: 2279970 - DNA, 12 bp, Homo sapiens
caggaaggggac

SEQ ID NO: 2279971 - DNA, 20 bp, Homo sapiens
caggaagtccctgagaagcc

SEQ ID NO: 2279972 - DNA, 16 bp, Homo sapiens
caggaccccatctgct

SEQ ID NO: 2279973 - DNA, 19 bp, Homo sapiens
caggaccccatctgctgag

SEQ ID NO: 2279974 - DNA, 17 bp, Homo sapiens
caggacgcagggagacc

SEQ ID NO: 2279975 - DNA, 21 bp, Homo sapiens
caggactcgggctaagtccag

SEQ ID NO: 2279976 - DNA, 17 bp, Homo sapiens
caggactctgccttcca

SEQ ID NO: 2279977 - DNA, 19 bp, Homo sapiens
caggactctgccttccagg

SEQ ID NO: 2279978 - DNA, 16 bp, Homo sapiens
caggagacactggtct

SEQ ID NO: 2279979 - DNA, 19 bp, Homo sapiens
caggagacactggtctcag

SEQ ID NO: 2279980 - DNA, 20 bp, Homo sapiens
caggagacactggtctcaga

SEQ ID NO: 2279981 - DNA, 21 bp, Homo sapiens
caggagacactggtctcagag

SEQ ID NO: 2279982 - DNA, 22 bp, Homo sapiens
caggagacactggtctcagagg

SEQ ID NO: 2279983 - DNA, 23 bp, Homo sapiens
caggagacactggtctcagagga

SEQ ID NO: 2279984 - DNA, 14 bp, Homo sapiens
caggagatggaata

SEQ ID NO: 2279985 - DNA, 19 bp, Homo sapiens
caggagcaaggctgccctg

SEQ ID NO: 2279986 - DNA, 22 bp, Homo sapiens
caggagcaaggctgccctgtcc

SEQ ID NO: 2279987 - DNA, 22 bp, Homo sapiens
caggaggcagtggcttggagca

SEQ ID NO: 2279988 - DNA, 17 bp, Homo sapiens
caggaggccatgcccac

SEQ ID NO: 2279989 - DNA, 16 bp, Homo sapiens
caggaggccattccag

SEQ ID NO: 2279990 - DNA, 13 bp, Homo sapiens
caggaggtgcctg

SEQ ID NO: 2279991 - DNA, 20 bp, Homo sapiens
caggaggtgcctgagagcag

SEQ ID NO: 2279992 - DNA, 14 bp, Homo sapiens
caggaggtgtgaat

SEQ ID NO: 2279993 - DNA, 17 bp, Homo sapiens
caggaggtgtgaatgca

SEQ ID NO: 2279994 - DNA, 21 bp, Homo sapiens
caggagtgggtgggacacaga

SEQ ID NO: 2279995 - DNA, 21 bp, Homo sapiens
caggatgaggaacctcaaact

SEQ ID NO: 2279996 - DNA, 20 bp, Homo sapiens
caggatggcgtgtcccctgc

SEQ ID NO: 2279997 - DNA, 21 bp, Homo sapiens
caggatggcgtgtcccctgcc

SEQ ID NO: 2279998 - DNA, 15 bp, Homo sapiens
caggatggctgtgtg

SEQ ID NO: 2279999 - DNA, 19 bp, Homo sapiens
caggattaatctctaaaat

SEQ ID NO: 2280000 - DNA, 23 bp, Homo sapiens
caggattaatctctaaaattcta

SEQ ID NO: 2280001 - DNA, 15 bp, Homo sapiens
caggattgtctgctg

SEQ ID NO: 2280002 - DNA, 23 bp, Homo sapiens
caggcaacattacaaacaaagga

SEQ ID NO: 2280003 - DNA, 18 bp, Homo sapiens
caggcaatagtgttgagg

SEQ ID NO: 2280004 - DNA, 22 bp, Homo sapiens
caggcagagctcagcacagcct

SEQ ID NO: 2280005 - DNA, 19 bp, Homo sapiens
caggcaggggcttcccaca

SEQ ID NO: 2280006 - DNA, 13 bp, Homo sapiens
caggcagtagcag

SEQ ID NO: 2280007 - DNA, 18 bp, Homo sapiens
caggcagtagcagctgtg

SEQ ID NO: 2280008 - DNA, 15 bp, Homo sapiens
caggcatgaccctgg

SEQ ID NO: 2280009 - DNA, 16 bp, Homo sapiens
caggcatgaccctgga

SEQ ID NO: 2280010 - DNA, 17 bp, Homo sapiens
caggcccatgccctccg

SEQ ID NO: 2280011 - DNA, 16 bp, Homo sapiens
caggccgacaggaggc

SEQ ID NO: 2280012 - DNA, 21 bp, Homo sapiens
caggcgcgcaccgcccaaccc

SEQ ID NO: 2280013 - DNA, 13 bp, Homo sapiens
caggcggaggggc

SEQ ID NO: 2280014 - DNA, 21 bp, Homo sapiens
caggcggaggggcttggagca

SEQ ID NO: 2280015 - DNA, 22 bp, Homo sapiens
caggcggaggggcttggagcag

SEQ ID NO: 2280016 - DNA, 17 bp, Homo sapiens
caggcggtatccagagg

SEQ ID NO: 2280017 - DNA, 20 bp, Homo sapiens
caggcggtatccagaggtga

SEQ ID NO: 2280018 - DNA, 15 bp, Homo sapiens
caggctgccccaccc

SEQ ID NO: 2280019 - DNA, 14 bp, Homo sapiens
caggctgcgcctgc

SEQ ID NO: 2280020 - DNA, 16 bp, Homo sapiens
caggctgcgcctgccc

SEQ ID NO: 2280021 - DNA, 19 bp, Homo sapiens
caggctgcgcctgcccgcc

SEQ ID NO: 2280022 - DNA, 21 bp, Homo sapiens
caggctgcgcctgcccgcccg

SEQ ID NO: 2280023 - DNA, 13 bp, Homo sapiens
caggctggagtga

SEQ ID NO: 2280024 - DNA, 16 bp, Homo sapiens
caggcttcgtctcaga

SEQ ID NO: 2280025 - DNA, 19 bp, Homo sapiens
cagggagaccctgggagag

SEQ ID NO: 2280026 - DNA, 14 bp, Homo sapiens
cagggagctgatgt

SEQ ID NO: 2280027 - DNA, 19 bp, Homo sapiens
cagggcccgagcgcgtgcc

SEQ ID NO: 2280028 - DNA, 19 bp, Homo sapiens
cagggcccgggaagcaaat

SEQ ID NO: 2280029 - DNA, 17 bp, Homo sapiens
cagggccctggggtctc

SEQ ID NO: 2280030 - DNA, 24 bp, Homo sapiens
cagggccctgtggctccaggagca

SEQ ID NO: 2280031 - DNA, 16 bp, Homo sapiens
cagggccgcagggcgc

SEQ ID NO: 2280032 - DNA, 13 bp, Homo sapiens
cagggcgctccgg

SEQ ID NO: 2280033 - DNA, 22 bp, Homo sapiens
cagggcgctccggcagaggcag

SEQ ID NO: 2280034 - DNA, 23 bp, Homo sapiens
cagggcgctccggcagaggcagg

SEQ ID NO: 2280035 - DNA, 22 bp, Homo sapiens
cagggctccacgggggcctagt

SEQ ID NO: 2280036 - DNA, 15 bp, Homo sapiens
cagggctctggcagg

SEQ ID NO: 2280037 - DNA, 16 bp, Homo sapiens
cagggctctggcaggt

SEQ ID NO: 2280038 - DNA, 19 bp, Homo sapiens
cagggctctggcaggtggc

SEQ ID NO: 2280039 - DNA, 18 bp, Homo sapiens
caggggagcgtgttcctg

SEQ ID NO: 2280040 - DNA, 22 bp, Homo sapiens
caggggaggcacaaagggcagg

SEQ ID NO: 2280041 - DNA, 20 bp, Homo sapiens
caggggcacacttccccttg

SEQ ID NO: 2280042 - DNA, 13 bp, Homo sapiens
caggggctgggga

SEQ ID NO: 2280043 - DNA, 16 bp, Homo sapiens
caggggctggggactt

SEQ ID NO: 2280044 - DNA, 17 bp, Homo sapiens
cagggggttctgggacc

SEQ ID NO: 2280045 - DNA, 23 bp, Homo sapiens
caggggtcgcgatgatgggctgg

SEQ ID NO: 2280046 - DNA, 23 bp, Homo sapiens
caggggtctcccaacaagtgctc

SEQ ID NO: 2280047 - DNA, 17 bp, Homo sapiens
cagggtctcactctgtt

SEQ ID NO: 2280048 - DNA, 16 bp, Homo sapiens
catcccggggccatgg

SEQ ID NO: 2280049 - DNA, 17 bp, Homo sapiens
catcccggggccatgga

SEQ ID NO: 2280050 - DNA, 17 bp, Homo sapiens
catcctcccctctcctg

SEQ ID NO: 2280051 - DNA, 15 bp, Homo sapiens
catccttaactgtcc

SEQ ID NO: 2280052 - DNA, 13 bp, Homo sapiens
catccttcccgca

SEQ ID NO: 2280053 - DNA, 14 bp, Homo sapiens
catccttcccgcag

SEQ ID NO: 2280054 - DNA, 15 bp, Homo sapiens
catccttcccgcagc

SEQ ID NO: 2280055 - DNA, 19 bp, Homo sapiens
catccttcccgcagcacca

SEQ ID NO: 2280056 - DNA, 20 bp, Homo sapiens
catccttcccgcagcaccag

SEQ ID NO: 2280057 - DNA, 15 bp, Homo sapiens
catcgcagcccctgt

SEQ ID NO: 2280058 - DNA, 19 bp, Homo sapiens
catcggttcaggaggagac

SEQ ID NO: 2280059 - DNA, 12 bp, Homo sapiens
catctaaaccac

SEQ ID NO: 2280060 - DNA, 16 bp, Homo sapiens
catctaaagcagcagg

SEQ ID NO: 2280061 - DNA, 19 bp, Homo sapiens
catctaaataattcatctt

SEQ ID NO: 2280062 - DNA, 21 bp, Homo sapiens
catctcatcgtcctagaaagc

SEQ ID NO: 2280063 - DNA, 13 bp, Homo sapiens
catctccatgctc

SEQ ID NO: 2280064 - DNA, 14 bp, Homo sapiens
catctccattgcat

SEQ ID NO: 2280065 - DNA, 13 bp, Homo sapiens
catctgaaaagaa

SEQ ID NO: 2280066 - DNA, 14 bp, Homo sapiens
catctgaaaagaaa

SEQ ID NO: 2280067 - DNA, 15 bp, Homo sapiens
catctgaaaagaaat

SEQ ID NO: 2280068 - DNA, 13 bp, Homo sapiens
catctgctcttct

SEQ ID NO: 2280069 - DNA, 18 bp, Homo sapiens
catctgctgagctctgac

SEQ ID NO: 2280070 - DNA, 19 bp, Homo sapiens
catctgctgagctctgacc

SEQ ID NO: 2280071 - DNA, 12 bp, Homo sapiens
catctgctttat

SEQ ID NO: 2280072 - DNA, 16 bp, Homo sapiens
catctgctttattgcc

SEQ ID NO: 2280073 - DNA, 23 bp, Homo sapiens
catctgctttattgcctctgtct

SEQ ID NO: 2280074 - DNA, 12 bp, Homo sapiens
catctggagtcc

SEQ ID NO: 2280075 - DNA, 19 bp, Homo sapiens
catctgtatatcagctcta

SEQ ID NO: 2280076 - DNA, 15 bp, Homo sapiens
catctgtttgataca

SEQ ID NO: 2280077 - DNA, 16 bp, Homo sapiens
catcttaacttggcta

SEQ ID NO: 2280078 - DNA, 19 bp, Homo sapiens
catcttccctttcctccct

SEQ ID NO: 2280079 - DNA, 16 bp, Homo sapiens
catcttgaattgtaag

SEQ ID NO: 2280080 - DNA, 15 bp, Homo sapiens
catctttctcttccc

SEQ ID NO: 2280081 - DNA, 19 bp, Homo sapiens
catgaagaaaaaattttaa

SEQ ID NO: 2280082 - DNA, 14 bp, Homo sapiens
catgacacgaatat

SEQ ID NO: 2280083 - DNA, 16 bp, Homo sapiens
catgactggtgcgttc

SEQ ID NO: 2280084 - DNA, 16 bp, Homo sapiens
catgatagatataaag

SEQ ID NO: 2280085 - DNA, 23 bp, Homo sapiens
catgatgactcttcttatcacac

SEQ ID NO: 2280086 - DNA, 23 bp, Homo sapiens
catgattccaagggcccagaggg

SEQ ID NO: 2280087 - DNA, 17 bp, Homo sapiens
catgatttcaatgattg

SEQ ID NO: 2280088 - DNA, 18 bp, Homo sapiens
catgatttcaatgattgt

SEQ ID NO: 2280089 - DNA, 15 bp, Homo sapiens
catgcaacaccctct

SEQ ID NO: 2280090 - DNA, 17 bp, Homo sapiens
catgcaacaccctcttc

SEQ ID NO: 2280091 - DNA, 14 bp, Homo sapiens
catgcactcagtgt

SEQ ID NO: 2280092 - DNA, 20 bp, Homo sapiens
catgcatatgatatatagtt

SEQ ID NO: 2280093 - DNA, 14 bp, Homo sapiens
catgcatgatgggt

SEQ ID NO: 2280094 - DNA, 14 bp, Homo sapiens
catgcccaccgccc

SEQ ID NO: 2280095 - DNA, 19 bp, Homo sapiens
catgcccaccgcccctgga

SEQ ID NO: 2280096 - DNA, 24 bp, Homo sapiens
catgccgctgtgtctatgaactag

SEQ ID NO: 2280097 - DNA, 16 bp, Homo sapiens
catgcggccggcctgg

SEQ ID NO: 2280098 - DNA, 17 bp, Homo sapiens
catgcggccggcctggg

SEQ ID NO: 2280099 - DNA, 22 bp, Homo sapiens
catgctccttgcctctgctctg

SEQ ID NO: 2280100 - DNA, 14 bp, Homo sapiens
catggaagctggca

SEQ ID NO: 2280101 - DNA, 16 bp, Homo sapiens
catggaccactgtttc

SEQ ID NO: 2280102 - DNA, 20 bp, Homo sapiens
catggccccagctggctggg

SEQ ID NO: 2280103 - DNA, 17 bp, Homo sapiens
catggcttctggtcatg

SEQ ID NO: 2280104 - DNA, 15 bp, Homo sapiens
catgggaatgaatgt

SEQ ID NO: 2280105 - DNA, 15 bp, Homo sapiens
catggtattcttctg

SEQ ID NO: 2280106 - DNA, 15 bp, Homo sapiens
catggtcacagaccc

SEQ ID NO: 2280107 - DNA, 16 bp, Homo sapiens
catggtcctgtgcccc

SEQ ID NO: 2280108 - DNA, 15 bp, Homo sapiens
catgtaagaaataag

SEQ ID NO: 2280109 - DNA, 17 bp, Homo sapiens
catgtaatagtggcttt

SEQ ID NO: 2280110 - DNA, 21 bp, Homo sapiens
catgtaatagtggctttcatt

SEQ ID NO: 2280111 - DNA, 19 bp, Homo sapiens
catgtacaatgatgtaaat

SEQ ID NO: 2280112 - DNA, 18 bp, Homo sapiens
catgtaccttgtgtactt

SEQ ID NO: 2280113 - DNA, 23 bp, Homo sapiens
catgtactacacttctgaaactt

SEQ ID NO: 2280114 - DNA, 15 bp, Homo sapiens
catgtagccagcaga

SEQ ID NO: 2280115 - DNA, 17 bp, Homo sapiens
catgtgatgagaggaaa

SEQ ID NO: 2280116 - DNA, 18 bp, Homo sapiens
catgtgatgagaggaaat

SEQ ID NO: 2280117 - DNA, 15 bp, Homo sapiens
catgtggcaacctgt

SEQ ID NO: 2280118 - DNA, 17 bp, Homo sapiens
catgtggctccccctga

SEQ ID NO: 2280119 - DNA, 17 bp, Homo sapiens
catgtgggctgaaggat

SEQ ID NO: 2280120 - DNA, 19 bp, Homo sapiens
catgtgtacagaaacaact

SEQ ID NO: 2280121 - DNA, 21 bp, Homo sapiens
catgtgttgcaaattattcta

SEQ ID NO: 2280122 - DNA, 24 bp, Homo sapiens
catgtgttgcaaattattctagtc

SEQ ID NO: 2280123 - DNA, 13 bp, Homo sapiens
catgttaaagagg

SEQ ID NO: 2280124 - DNA, 15 bp, Homo sapiens
catgttgcccagaat

SEQ ID NO: 2280125 - DNA, 17 bp, Homo sapiens
catgttgtattagtaaa

SEQ ID NO: 2280126 - DNA, 19 bp, Homo sapiens
catgttttttaggaatcag

SEQ ID NO: 2280127 - DNA, 15 bp, Homo sapiens
cattaaatataaaat

SEQ ID NO: 2280128 - DNA, 19 bp, Homo sapiens
cattaaatataaaatacat

SEQ ID NO: 2280129 - DNA, 17 bp, Homo sapiens
cattaatacttccttat

SEQ ID NO: 2280130 - DNA, 21 bp, Homo sapiens
cattaatacttccttataaaa

SEQ ID NO: 2280131 - DNA, 23 bp, Homo sapiens
cattacaaacaaaggatttgaaa

SEQ ID NO: 2280132 - DNA, 22 bp, Homo sapiens
cattacatcctctgcttgtcat

SEQ ID NO: 2280133 - DNA, 20 bp, Homo sapiens
cattactgcccagatgtttt

SEQ ID NO: 2280134 - DNA, 20 bp, Homo sapiens
cattagactgaatttaacta

SEQ ID NO: 2280135 - DNA, 17 bp, Homo sapiens
cattagtcatatttttg

SEQ ID NO: 2280136 - DNA, 16 bp, Homo sapiens
cattagtttcaggcaa

SEQ ID NO: 2280137 - DNA, 21 bp, Homo sapiens
cattatgaagatgtttttaga

SEQ ID NO: 2280138 - DNA, 17 bp, Homo sapiens
cattatgagtaaaagca

SEQ ID NO: 2280139 - DNA, 13 bp, Homo sapiens
cattattttccca

SEQ ID NO: 2280140 - DNA, 16 bp, Homo sapiens
cattattttgtcataa

SEQ ID NO: 2280141 - DNA, 17 bp, Homo sapiens
cattattttgtcataaa

SEQ ID NO: 2280142 - DNA, 18 bp, Homo sapiens
cattattttgtcataaaa

SEQ ID NO: 2280143 - DNA, 19 bp, Homo sapiens
cattattttgtcataaaat

SEQ ID NO: 2280144 - DNA, 23 bp, Homo sapiens
cattattttgtcataaaatgcta

SEQ ID NO: 2280145 - DNA, 13 bp, Homo sapiens
cattcaaaatagt

SEQ ID NO: 2280146 - DNA, 16 bp, Homo sapiens
cattcaaaatagttct

SEQ ID NO: 2280147 - DNA, 18 bp, Homo sapiens
cattcaaaatagttctat

SEQ ID NO: 2280148 - DNA, 22 bp, Homo sapiens
cattcaaaatagttctatttct

SEQ ID NO: 2280149 - DNA, 12 bp, Homo sapiens
cattcagcagaa

SEQ ID NO: 2280150 - DNA, 23 bp, Homo sapiens
cattcagcagaatgactctggaa

SEQ ID NO: 2280151 - DNA, 18 bp, Homo sapiens
cattcatactaaataaaa

SEQ ID NO: 2280152 - DNA, 22 bp, Homo sapiens
cattcatactaaataaaacaat

SEQ ID NO: 2280153 - DNA, 15 bp, Homo sapiens
cattcatactcaaag

SEQ ID NO: 2280154 - DNA, 17 bp, Homo sapiens
cattcatggaccactgt

SEQ ID NO: 2280155 - DNA, 19 bp, Homo sapiens
cattcatggaccactgttt

SEQ ID NO: 2280156 - DNA, 13 bp, Homo sapiens
cattcatgtacaa

SEQ ID NO: 2280157 - DNA, 23 bp, Homo sapiens
cattcatttacaacttccagatt

SEQ ID NO: 2280158 - DNA, 16 bp, Homo sapiens
cattccacacatttcc

SEQ ID NO: 2280159 - DNA, 14 bp, Homo sapiens
cattccagcgtctg

SEQ ID NO: 2280160 - DNA, 16 bp, Homo sapiens
cattccagcgtctgct

SEQ ID NO: 2280161 - DNA, 23 bp, Homo sapiens
cattctatgactcttgtctcctc

SEQ ID NO: 2280162 - DNA, 22 bp, Homo sapiens
cattctgttgttcagtcctctg

SEQ ID NO: 2280163 - DNA, 20 bp, Homo sapiens
cattctttaacatacatcta

SEQ ID NO: 2280164 - DNA, 23 bp, Homo sapiens
cattctttacagcaaatgttata

SEQ ID NO: 2280165 - DNA, 19 bp, Homo sapiens
cattctttataaaccataa

SEQ ID NO: 2280166 - DNA, 18 bp, Homo sapiens
cattctttctctttgaaa

SEQ ID NO: 2280167 - DNA, 13 bp, Homo sapiens
cattgaaataata

SEQ ID NO: 2280168 - DNA, 16 bp, Homo sapiens
cattgaaataataata

SEQ ID NO: 2280169 - DNA, 17 bp, Homo sapiens
cattgaaataataatat

SEQ ID NO: 2280170 - DNA, 18 bp, Homo sapiens
cattgcagtatcagaggg

SEQ ID NO: 2280171 - DNA, 20 bp, Homo sapiens
cattgcccacacctgcctct

SEQ ID NO: 2280172 - DNA, 17 bp, Homo sapiens
cattgctttagacaaat

SEQ ID NO: 2280173 - DNA, 23 bp, Homo sapiens
catttaaaatagttttctaaatg

SEQ ID NO: 2280174 - DNA, 18 bp, Homo sapiens
catttacaacttccagat

SEQ ID NO: 2280175 - DNA, 22 bp, Homo sapiens
catttagaacctgcatttaaga

SEQ ID NO: 2280176 - DNA, 19 bp, Homo sapiens
catttagttaacacacata

SEQ ID NO: 2280177 - DNA, 17 bp, Homo sapiens
catttatactgtagcaa

SEQ ID NO: 2280178 - DNA, 21 bp, Homo sapiens
catttatactgtagcaatata

SEQ ID NO: 2280179 - DNA, 15 bp, Homo sapiens
catttatttattcat

SEQ ID NO: 2280180 - DNA, 20 bp, Homo sapiens
cccagacgcctgatattgaa

SEQ ID NO: 2280181 - DNA, 16 bp, Homo sapiens
cccagagactgcccac

SEQ ID NO: 2280182 - DNA, 19 bp, Homo sapiens
cccagagactgcccaccct

SEQ ID NO: 2280183 - DNA, 21 bp, Homo sapiens
cccagagactgcccaccctgg

SEQ ID NO: 2280184 - DNA, 11 bp, Homo sapiens
cccagatgttt

SEQ ID NO: 2280185 - DNA, 11 bp, Homo sapiens
cccagccccag

SEQ ID NO: 2280186 - DNA, 14 bp, Homo sapiens
cccagccccagcga

SEQ ID NO: 2280187 - DNA, 14 bp, Homo sapiens
cccagccccatccc

SEQ ID NO: 2280188 - DNA, 18 bp, Homo sapiens
cccagccccctggcccct

SEQ ID NO: 2280189 - DNA, 16 bp, Homo sapiens
cccagcctcccccagg

SEQ ID NO: 2280190 - DNA, 17 bp, Homo sapiens
cccagcctcccccaggc

SEQ ID NO: 2280191 - DNA, 19 bp, Homo sapiens
cccagcctcccccaggctg

SEQ ID NO: 2280192 - DNA, 13 bp, Homo sapiens
cccagcctcctga

SEQ ID NO: 2280193 - DNA, 15 bp, Homo sapiens
cccagcgagtctgga

SEQ ID NO: 2280194 - DNA, 21 bp, Homo sapiens
cccagcgagtctggagaccag

SEQ ID NO: 2280195 - DNA, 15 bp, Homo sapiens
cccagctcactgcag

SEQ ID NO: 2280196 - DNA, 17 bp, Homo sapiens
cccagctcactgcagcc

SEQ ID NO: 2280197 - DNA, 19 bp, Homo sapiens
cccagctcactgcagcctc

SEQ ID NO: 2280198 - DNA, 20 bp, Homo sapiens
cccagctcactgcagcctcg

SEQ ID NO: 2280199 - DNA, 20 bp, Homo sapiens
cccagctggcagcgcctccc

SEQ ID NO: 2280200 - DNA, 12 bp, Homo sapiens
cccagctggctg

SEQ ID NO: 2280201 - DNA, 19 bp, Homo sapiens
cccagctggctgggtcgcc

SEQ ID NO: 2280202 - DNA, 23 bp, Homo sapiens
cccagctggctgggtcgcccctc

SEQ ID NO: 2280203 - DNA, 18 bp, Homo sapiens
cccaggacgcagggagac

SEQ ID NO: 2280204 - DNA, 14 bp, Homo sapiens
cccaggcaatagtg

SEQ ID NO: 2280205 - DNA, 14 bp, Homo sapiens
cccaggcaggggct

SEQ ID NO: 2280206 - DNA, 13 bp, Homo sapiens
cccaggccccagc

SEQ ID NO: 2280207 - DNA, 15 bp, Homo sapiens
cccagggagggggtc

SEQ ID NO: 2280208 - DNA, 13 bp, Homo sapiens
cccagggcccgag

SEQ ID NO: 2280209 - DNA, 14 bp, Homo sapiens
cccagggcccgagc

SEQ ID NO: 2280210 - DNA, 19 bp, Homo sapiens
cccagtgtccccaggggca

SEQ ID NO: 2280211 - DNA, 14 bp, Homo sapiens
cccagttcatccca

SEQ ID NO: 2280212 - DNA, 18 bp, Homo sapiens
cccatccttcccgcagca

SEQ ID NO: 2280213 - DNA, 12 bp, Homo sapiens
cccatggcccca

SEQ ID NO: 2280214 - DNA, 19 bp, Homo sapiens
cccatggccccagctggct

SEQ ID NO: 2280215 - DNA, 17 bp, Homo sapiens
cccatgggctctggccc

SEQ ID NO: 2280216 - DNA, 18 bp, Homo sapiens
cccatgggctctggcccc

SEQ ID NO: 2280217 - DNA, 15 bp, Homo sapiens
cccatggtcacagac

SEQ ID NO: 2280218 - DNA, 17 bp, Homo sapiens
cccatggtcacagaccc

SEQ ID NO: 2280219 - DNA, 18 bp, Homo sapiens
cccatttgtaatgtatct

SEQ ID NO: 2280220 - DNA, 21 bp, Homo sapiens
ccccacacgccggggctggcc

SEQ ID NO: 2280221 - DNA, 12 bp, Homo sapiens
ccccaccctgct

SEQ ID NO: 2280222 - DNA, 13 bp, Homo sapiens
ccccaccctgctt

SEQ ID NO: 2280223 - DNA, 14 bp, Homo sapiens
ccccaccctgcttc

SEQ ID NO: 2280224 - DNA, 16 bp, Homo sapiens
ccccaccctgcttctg

SEQ ID NO: 2280225 - DNA, 14 bp, Homo sapiens
ccccacctgaggca

SEQ ID NO: 2280226 - DNA, 14 bp, Homo sapiens
ccccacgcctccat

SEQ ID NO: 2280227 - DNA, 22 bp, Homo sapiens
ccccactttcgcctcctccagc

SEQ ID NO: 2280228 - DNA, 22 bp, Homo sapiens
ccccagaaatgccgctgtgtcc

SEQ ID NO: 2280229 - DNA, 23 bp, Homo sapiens
ccccagaccccatccagccaggg

SEQ ID NO: 2280230 - DNA, 18 bp, Homo sapiens
ccccagagactgcccacc

SEQ ID NO: 2280231 - DNA, 18 bp, Homo sapiens
ccccagccccctggcccc

SEQ ID NO: 2280232 - DNA, 12 bp, Homo sapiens
ccccagcctccc

SEQ ID NO: 2280233 - DNA, 18 bp, Homo sapiens
ccccagcctcccccaggc

SEQ ID NO: 2280234 - DNA, 13 bp, Homo sapiens
ccccagcctcctg

SEQ ID NO: 2280235 - DNA, 19 bp, Homo sapiens
ccccagcgagtctggagac

SEQ ID NO: 2280236 - DNA, 22 bp, Homo sapiens
ccccagcgtggggctaacgggc

SEQ ID NO: 2280237 - DNA, 16 bp, Homo sapiens
ccccagctggctgggt

SEQ ID NO: 2280238 - DNA, 14 bp, Homo sapiens
ccccaggaccctga

SEQ ID NO: 2280239 - DNA, 23 bp, Homo sapiens
ccccaggcggaggggcttggagc

SEQ ID NO: 2280240 - DNA, 18 bp, Homo sapiens
ccccagtgtccccagggg

SEQ ID NO: 2280241 - DNA, 15 bp, Homo sapiens
ccccatccagccagg

SEQ ID NO: 2280242 - DNA, 13 bp, Homo sapiens
ccccatctgctga

SEQ ID NO: 2280243 - DNA, 17 bp, Homo sapiens
ccccatggtcacagacc

SEQ ID NO: 2280244 - DNA, 17 bp, Homo sapiens
ccccattctgggactgc

SEQ ID NO: 2280245 - DNA, 22 bp, Homo sapiens
cccccagcctcccccaggctgc

SEQ ID NO: 2280246 - DNA, 12 bp, Homo sapiens
cccccaggctgc

SEQ ID NO: 2280247 - DNA, 14 bp, Homo sapiens
cccccaggctgcgc

SEQ ID NO: 2280248 - DNA, 16 bp, Homo sapiens
cccccgccctcgctcc

SEQ ID NO: 2280249 - DNA, 19 bp, Homo sapiens
cccccgctctgccatcagc

SEQ ID NO: 2280250 - DNA, 14 bp, Homo sapiens
cccccggaggcgcc

SEQ ID NO: 2280251 - DNA, 19 bp, Homo sapiens
cccccggaggcgcccacct

SEQ ID NO: 2280252 - DNA, 23 bp, Homo sapiens
cccccggaggcgcccacctgccc

SEQ ID NO: 2280253 - DNA, 22 bp, Homo sapiens
ccccctaaggaatatccagtca

SEQ ID NO: 2280254 - DNA, 18 bp, Homo sapiens
ccccctggcccctcccac

SEQ ID NO: 2280255 - DNA, 22 bp, Homo sapiens
ccccgaccccacctgaggcagg

SEQ ID NO: 2280256 - DNA, 14 bp, Homo sapiens
ccccgcacccctcc

SEQ ID NO: 2280257 - DNA, 16 bp, Homo sapiens
ccccgcagacagacag

SEQ ID NO: 2280258 - DNA, 18 bp, Homo sapiens
ccccgcccgccctcctct

SEQ ID NO: 2280259 - DNA, 14 bp, Homo sapiens
ccccgcctcctccc

SEQ ID NO: 2280260 - DNA, 21 bp, Homo sapiens
ccccgcctcctccctgcctgg

SEQ ID NO: 2280261 - DNA, 16 bp, Homo sapiens
ccccgcgcgtgccccc

SEQ ID NO: 2280262 - DNA, 19 bp, Homo sapiens
ccccgcgcgtgcccccagc

SEQ ID NO: 2280263 - DNA, 23 bp, Homo sapiens
ccccgctctgccatcagcccctg

SEQ ID NO: 2280264 - DNA, 12 bp, Homo sapiens
ccccgctgcctg

SEQ ID NO: 2280265 - DNA, 20 bp, Homo sapiens
ccccgctgcctggcgggcag

SEQ ID NO: 2280266 - DNA, 16 bp, Homo sapiens
ccccggagctgggaag

SEQ ID NO: 2280267 - DNA, 17 bp, Homo sapiens
ccccggaggcgcccacc

SEQ ID NO: 2280268 - DNA, 18 bp, Homo sapiens
ccccggcccaacctcgcc

SEQ ID NO: 2280269 - DNA, 22 bp, Homo sapiens
ccccgtgcggcccgtgcgcagc

SEQ ID NO: 2280270 - DNA, 20 bp, Homo sapiens
cccctcccgcttcctccggc

SEQ ID NO: 2280271 - DNA, 12 bp, Homo sapiens
cccctccctgta

SEQ ID NO: 2280272 - DNA, 20 bp, Homo sapiens
cccctccctgtaatgcactc

SEQ ID NO: 2280273 - DNA, 16 bp, Homo sapiens
cccctccgtccccagg

SEQ ID NO: 2280274 - DNA, 18 bp, Homo sapiens
cccctccgtccccagggt

SEQ ID NO: 2280275 - DNA, 23 bp, Homo sapiens
cccctcttcttgcggcaccgccc

SEQ ID NO: 2280276 - DNA, 22 bp, Homo sapiens
cccctgcaggcggtatccagag

SEQ ID NO: 2280277 - DNA, 12 bp, Homo sapiens
cccctggcccct

SEQ ID NO: 2280278 - DNA, 19 bp, Homo sapiens
cccctggggtacttctgtg

SEQ ID NO: 2280279 - DNA, 17 bp, Homo sapiens
ccccttgaccccacacg

SEQ ID NO: 2280280 - DNA, 20 bp, Homo sapiens
ccccttgggatgggcacagg

SEQ ID NO: 2280281 - DNA, 22 bp, Homo sapiens
cccgaatggagtccagacctgg

SEQ ID NO: 2280282 - DNA, 23 bp, Homo sapiens
cccgaccccacctgaggcaggag

SEQ ID NO: 2280283 - DNA, 18 bp, Homo sapiens
cccgagccgagctctcct

SEQ ID NO: 2280284 - DNA, 19 bp, Homo sapiens
cccgagccgagctctcctg

SEQ ID NO: 2280285 - DNA, 22 bp, Homo sapiens
cccgagccgagctctcctgggc

SEQ ID NO: 2280286 - DNA, 14 bp, Homo sapiens
cccgcagcaccagc

SEQ ID NO: 2280287 - DNA, 16 bp, Homo sapiens
cccgcagcaccagcct

SEQ ID NO: 2280288 - DNA, 21 bp, Homo sapiens
cccgcagcaccagcctgagcc

SEQ ID NO: 2280289 - DNA, 22 bp, Homo sapiens
cccgcagcaccagcctgagcca

SEQ ID NO: 2280290 - DNA, 21 bp, Homo sapiens
cccgccccagagactgcccac

SEQ ID NO: 2280291 - DNA, 15 bp, Homo sapiens
cccgccccagcctcc

SEQ ID NO: 2280292 - DNA, 16 bp, Homo sapiens
cccgccccagcctcct

SEQ ID NO: 2280293 - DNA, 18 bp, Homo sapiens
cccgccgcctcgggccgc

SEQ ID NO: 2280294 - DNA, 15 bp, Homo sapiens
cccgcctcctccctg

SEQ ID NO: 2280295 - DNA, 20 bp, Homo sapiens
cccgcctcctccctgcctgg

SEQ ID NO: 2280296 - DNA, 13 bp, Homo sapiens
cccgcctgcgccc

SEQ ID NO: 2280297 - DNA, 15 bp, Homo sapiens
cccgcctgcgccccc

SEQ ID NO: 2280298 - DNA, 19 bp, Homo sapiens
cccgcgaagtccgaggcct

SEQ ID NO: 2280299 - DNA, 16 bp, Homo sapiens
cccgcgcgtgccccca

SEQ ID NO: 2280300 - DNA, 18 bp, Homo sapiens
cccgctcaacctctcaga

SEQ ID NO: 2280301 - DNA, 14 bp, Homo sapiens
cccgctgcctggcg

SEQ ID NO: 2280302 - DNA, 15 bp, Homo sapiens
cccgctgcctggcgg

SEQ ID NO: 2280303 - DNA, 22 bp, Homo sapiens
cccgcttcctccggctggacct

SEQ ID NO: 2280304 - DNA, 19 bp, Homo sapiens
cccggagcaccacggggtc

SEQ ID NO: 2280305 - DNA, 11 bp, Homo sapiens
cccggagctgg

SEQ ID NO: 2280306 - DNA, 12 bp, Homo sapiens
cccggagctggg

SEQ ID NO: 2280307 - DNA, 18 bp, Homo sapiens
cccggaggcgcccacctg

SEQ ID NO: 2280308 - DNA, 20 bp, Homo sapiens
cccggaggcgcccacctgcc

SEQ ID NO: 2280309 - DNA, 23 bp, Homo sapiens
cccggaggcgcccacctgcccag

SEQ ID NO: 2280310 - DNA, 21 bp, Homo sapiens
cccggatgaactcaatgcatg

SEQ ID NO: 2280311 - DNA, 15 bp, Homo sapiens
cccggcagcccccca

SEQ ID NO: 2280312 - DNA, 15 bp, Homo sapiens
ccggccaaggacact

SEQ ID NO: 2280313 - DNA, 18 bp, Homo sapiens
ccggccaaggacactgat

SEQ ID NO: 2280314 - DNA, 21 bp, Homo sapiens
ccggcccaacctcgccctctc

SEQ ID NO: 2280315 - DNA, 14 bp, Homo sapiens
ccggcccacgcaga

SEQ ID NO: 2280316 - DNA, 17 bp, Homo sapiens
ccggcccacgcagagcc

SEQ ID NO: 2280317 - DNA, 20 bp, Homo sapiens
ccggcccacgcagagccccg

SEQ ID NO: 2280318 - DNA, 22 bp, Homo sapiens
ccggcccacgcagagccccgga

SEQ ID NO: 2280319 - DNA, 15 bp, Homo sapiens
ccggcctgcagccca

SEQ ID NO: 2280320 - DNA, 18 bp, Homo sapiens
ccggctggccggtccacc

SEQ ID NO: 2280321 - DNA, 21 bp, Homo sapiens
ccgggagatccgccctgggct

SEQ ID NO: 2280322 - DNA, 23 bp, Homo sapiens
ccgggagatccgccctgggctct

SEQ ID NO: 2280323 - DNA, 20 bp, Homo sapiens
ccgggagcctgcgtggcctg

SEQ ID NO: 2280324 - DNA, 19 bp, Homo sapiens
ccgggctggcttctccctg

SEQ ID NO: 2280325 - DNA, 20 bp, Homo sapiens
ccgggctggcttctccctgg

SEQ ID NO: 2280326 - DNA, 12 bp, Homo sapiens
ccggggctggcc

SEQ ID NO: 2280327 - DNA, 13 bp, Homo sapiens
ccggggctggccc

SEQ ID NO: 2280328 - DNA, 14 bp, Homo sapiens
ccggggctggccct

SEQ ID NO: 2280329 - DNA, 18 bp, Homo sapiens
ccggggtcctgaggctgg

SEQ ID NO: 2280330 - DNA, 16 bp, Homo sapiens
ccgtatgctttcttca

SEQ ID NO: 2280331 - DNA, 13 bp, Homo sapiens
ccgtccccagggt

SEQ ID NO: 2280332 - DNA, 13 bp, Homo sapiens
ccgtcccggcccc

SEQ ID NO: 2280333 - DNA, 16 bp, Homo sapiens
ccgtcctggcagggca

SEQ ID NO: 2280334 - DNA, 11 bp, Homo sapiens
ccgtctgcccc

SEQ ID NO: 2280335 - DNA, 21 bp, Homo sapiens
ccgtctgccccttgaccccac

SEQ ID NO: 2280336 - DNA, 18 bp, Homo sapiens
ccgtgcacggggccagca

SEQ ID NO: 2280337 - DNA, 15 bp, Homo sapiens
ccgtgcggcccgtgc

SEQ ID NO: 2280338 - DNA, 21 bp, Homo sapiens
ccgtgcggcccgtgcgcagcc

SEQ ID NO: 2280339 - DNA, 22 bp, Homo sapiens
ccgtggtgtgaggcccccggag

SEQ ID NO: 2280340 - DNA, 23 bp, Homo sapiens
ccgtggtgtgaggcccccggagg

SEQ ID NO: 2280341 - DNA, 22 bp, Homo sapiens
ccgtgtcatccgaaagtgagga

SEQ ID NO: 2280342 - DNA, 22 bp, Homo sapiens
cctaaataatatcctgaataac

SEQ ID NO: 2280343 - DNA, 16 bp, Homo sapiens
cctaaatccattttct

SEQ ID NO: 2280344 - DNA, 18 bp, Homo sapiens
cctaaatccattttctaa

SEQ ID NO: 2280345 - DNA, 18 bp, Homo sapiens
cctaaatttcattgtgtt

SEQ ID NO: 2280346 - DNA, 12 bp, Homo sapiens
cctaaccctggc

SEQ ID NO: 2280347 - DNA, 20 bp, Homo sapiens
cctaatcacctttccaaggc

SEQ ID NO: 2280348 - DNA, 13 bp, Homo sapiens
cctacatctgaaa

SEQ ID NO: 2280349 - DNA, 18 bp, Homo sapiens
cctacttcctcctagcaa

SEQ ID NO: 2280350 - DNA, 13 bp, Homo sapiens
cctagaagtcttc

SEQ ID NO: 2280351 - DNA, 17 bp, Homo sapiens
cctagaggcagaggttg

SEQ ID NO: 2280352 - DNA, 17 bp, Homo sapiens
cctagcctatcaagcct

SEQ ID NO: 2280353 - DNA, 19 bp, Homo sapiens
cctaggtctgagaactcag

SEQ ID NO: 2280354 - DNA, 20 bp, Homo sapiens
cctagtaagaacgtactttc

SEQ ID NO: 2280355 - DNA, 18 bp, Homo sapiens
cctagtggcttcagcccc

SEQ ID NO: 2280356 - DNA, 20 bp, Homo sapiens
cctagtggcttcagcccctg

SEQ ID NO: 2280357 - DNA, 22 bp, Homo sapiens
cctattttaggctattataata

SEQ ID NO: 2280358 - DNA, 15 bp, Homo sapiens
cctcaaggaagagcc

SEQ ID NO: 2280359 - DNA, 14 bp, Homo sapiens
cctcacccctgcag

SEQ ID NO: 2280360 - DNA, 15 bp, Homo sapiens
cctcacccctgcagg

SEQ ID NO: 2280361 - DNA, 17 bp, Homo sapiens
cctcactcagcaccact

SEQ ID NO: 2280362 - DNA, 15 bp, Homo sapiens
cctcagaacaccctg

SEQ ID NO: 2280363 - DNA, 18 bp, Homo sapiens
cctcagagtcctgccgac

SEQ ID NO: 2280364 - DNA, 18 bp, Homo sapiens
cctcagtgtcctcatcta

SEQ ID NO: 2280365 - DNA, 14 bp, Homo sapiens
cctcatctccatgc

SEQ ID NO: 2280366 - DNA, 16 bp, Homo sapiens
cctcatgccgctgtgt

SEQ ID NO: 2280367 - DNA, 15 bp, Homo sapiens
cctcatgggagtcag

SEQ ID NO: 2280368 - DNA, 22 bp, Homo sapiens
cctccagactcgagagggctga

SEQ ID NO: 2280369 - DNA, 22 bp, Homo sapiens
cctccagagctgcggtgtctcc

SEQ ID NO: 2280370 - DNA, 13 bp, Homo sapiens
cctccagctcctg

SEQ ID NO: 2280371 - DNA, 17 bp, Homo sapiens
cctccagctcctgcccc

SEQ ID NO: 2280372 - DNA, 18 bp, Homo sapiens
cctccagctcctgccccg

SEQ ID NO: 2280373 - DNA, 20 bp, Homo sapiens
cctccaggaggactgttcta

SEQ ID NO: 2280374 - DNA, 22 bp, Homo sapiens
cctccaggaggactgttctaac

SEQ ID NO: 2280375 - DNA, 19 bp, Homo sapiens
cctccaggccgacaggagg

SEQ ID NO: 2280376 - DNA, 12 bp, Homo sapiens
cctccatccaca

SEQ ID NO: 2280377 - DNA, 22 bp, Homo sapiens
cctccatgattccaagggccca

SEQ ID NO: 2280378 - DNA, 15 bp, Homo sapiens
cctccatgtaccttg

SEQ ID NO: 2280379 - DNA, 11 bp, Homo sapiens
cctcccacatc

SEQ ID NO: 2280380 - DNA, 15 bp, Homo sapiens
cctcccccaggctgc

SEQ ID NO: 2280381 - DNA, 22 bp, Homo sapiens
cctcccccaggctgcgcctgcc

SEQ ID NO: 2280382 - DNA, 13 bp, Homo sapiens
cctcccccgcaga

SEQ ID NO: 2280383 - DNA, 16 bp, Homo sapiens
cctcccccgcagacag

SEQ ID NO: 2280384 - DNA, 15 bp, Homo sapiens
cctccccgcctcctc

SEQ ID NO: 2280385 - DNA, 13 bp, Homo sapiens
cctcccgccgcct

SEQ ID NO: 2280386 - DNA, 19 bp, Homo sapiens
cctcccgcttcctccggct

SEQ ID NO: 2280387 - DNA, 17 bp, Homo sapiens
cctccctgtaatgcact

SEQ ID NO: 2280388 - DNA, 19 bp, Homo sapiens
cctccctgtaatgcactcc

SEQ ID NO: 2280389 - DNA, 18 bp, Homo sapiens
cctccggctggacctggg

SEQ ID NO: 2280390 - DNA, 14 bp, Homo sapiens
cctccgtccccagg

SEQ ID NO: 2280391 - DNA, 16 bp, Homo sapiens
cctccgtccccagggt

SEQ ID NO: 2280392 - DNA, 16 bp, Homo sapiens
cctccgtcctggcagg

SEQ ID NO: 2280393 - DNA, 18 bp, Homo sapiens
cctcctcagcagcctcac

SEQ ID NO: 2280394 - DNA, 18 bp, Homo sapiens
cctcctccagctcctgcc

SEQ ID NO: 2280395 - DNA, 19 bp, Homo sapiens
cctcctcccccacgcctcc

SEQ ID NO: 2280396 - DNA, 19 bp, Homo sapiens
cctcctcgggcgcctgcgc

SEQ ID NO: 2280397 - DNA, 22 bp, Homo sapiens
cctcctcgggcgcctgcgctcc

SEQ ID NO: 2280398 - DNA, 13 bp, Homo sapiens
cctcctctcctcg

SEQ ID NO: 2280399 - DNA, 14 bp, Homo sapiens
cctcctctcctcgt

SEQ ID NO: 2280400 - DNA, 11 bp, Homo sapiens
cctcctctgcc

SEQ ID NO: 2280401 - DNA, 14 bp, Homo sapiens
cctcctgctgagtg

SEQ ID NO: 2280402 - DNA, 18 bp, Homo sapiens
cctccttcctcatccttc

SEQ ID NO: 2280403 - DNA, 16 bp, Homo sapiens
cctccttgctgatttg

SEQ ID NO: 2280404 - DNA, 19 bp, Homo sapiens
cctcgacctccctggcttg

SEQ ID NO: 2280405 - DNA, 14 bp, Homo sapiens
cctcgagcagagag

SEQ ID NO: 2280406 - DNA, 18 bp, Homo sapiens
cctcgcagccacacctag

SEQ ID NO: 2280407 - DNA, 15 bp, Homo sapiens
cctcgccctctctca

SEQ ID NO: 2280408 - DNA, 23 bp, Homo sapiens
cctcgccctctctcaccagcctt

SEQ ID NO: 2280409 - DNA, 14 bp, Homo sapiens
cctcgctccaactc

SEQ ID NO: 2280410 - DNA, 13 bp, Homo sapiens
cctcggccagagc

SEQ ID NO: 2280411 - DNA, 14 bp, Homo sapiens
cctcggccagagct

SEQ ID NO: 2280412 - DNA, 17 bp, Homo sapiens
cctcggccagagctccc

SEQ ID NO: 2280413 - DNA, 21 bp, Homo sapiens
cctcggccagagctcccagga

SEQ ID NO: 2280414 - DNA, 15 bp, Homo sapiens
cctcgggccgcctcc

SEQ ID NO: 2280415 - DNA, 16 bp, Homo sapiens
cctcgggccgcctcct

SEQ ID NO: 2280416 - DNA, 17 bp, Homo sapiens
cctcgggcgcctgcgct

SEQ ID NO: 2280417 - DNA, 20 bp, Homo sapiens
cctcgggcgcctgcgctcct

SEQ ID NO: 2280418 - DNA, 16 bp, Homo sapiens
cctcggggcaggaagt

SEQ ID NO: 2280419 - DNA, 18 bp, Homo sapiens
cctcgtccggcctgcagc

SEQ ID NO: 2280420 - DNA, 14 bp, Homo sapiens
cctctcactttttt

SEQ ID NO: 2280421 - DNA, 18 bp, Homo sapiens
cctctcagatccctcggt

SEQ ID NO: 2280422 - DNA, 13 bp, Homo sapiens
cctctcctagcag

SEQ ID NO: 2280423 - DNA, 21 bp, Homo sapiens
cctctcctcgtccggcctgca

SEQ ID NO: 2280424 - DNA, 19 bp, Homo sapiens
cctctccttttctccactg

SEQ ID NO: 2280425 - DNA, 16 bp, Homo sapiens
cctctctcaccagcct

SEQ ID NO: 2280426 - DNA, 17 bp, Homo sapiens
cctctgaaaatattttt

SEQ ID NO: 2280427 - DNA, 15 bp, Homo sapiens
cctctgcagcctgag

SEQ ID NO: 2280428 - DNA, 17 bp, Homo sapiens
cctctgcagcctgagct

SEQ ID NO: 2280429 - DNA, 11 bp, Homo sapiens
cctctgccccc

SEQ ID NO: 2280430 - DNA, 19 bp, Homo sapiens
cctctgccccctcccccgc

SEQ ID NO: 2280431 - DNA, 17 bp, Homo sapiens
cctctgctgcacagtag

SEQ ID NO: 2280432 - DNA, 22 bp, Homo sapiens
cctctgcttgtcattctgctaa

SEQ ID NO: 2280433 - DNA, 11 bp, Homo sapiens
cctctggggag

SEQ ID NO: 2280434 - DNA, 14 bp, Homo sapiens
cctctggggccctt

SEQ ID NO: 2280435 - DNA, 21 bp, Homo sapiens
cctctgttacccgcagatcct

SEQ ID NO: 2280436 - DNA, 17 bp, Homo sapiens
cctctgttctcatgaag

SEQ ID NO: 2280437 - DNA, 14 bp, Homo sapiens
cctcttcagatcct

SEQ ID NO: 2280438 - DNA, 13 bp, Homo sapiens
cctcttcctcctg

SEQ ID NO: 2280439 - DNA, 21 bp, Homo sapiens
cctcttcttgcggcaccgccc

SEQ ID NO: 2280440 - DNA, 17 bp, Homo sapiens
cctctttccccactgaa

SEQ ID NO: 2280441 - DNA, 19 bp, Homo sapiens
cctgaaatgtttccaggca

SEQ ID NO: 2280442 - DNA, 10 bp, Homo sapiens
cctgaataac

SEQ ID NO: 2280443 - DNA, 19 bp, Homo sapiens
cctgaattttgcttccttt

SEQ ID NO: 2280444 - DNA, 23 bp, Homo sapiens
cctgacacaatggtagctctgaa

SEQ ID NO: 2280445 - DNA, 17 bp, Homo sapiens
cctttcaaacattgaga

SEQ ID NO: 2280446 - DNA, 21 bp, Homo sapiens
cctttcaaacattgagactgc

SEQ ID NO: 2280447 - DNA, 17 bp, Homo sapiens
cctttcttttctttctt

SEQ ID NO: 2280448 - DNA, 16 bp, Homo sapiens
cctttggcatctagat

SEQ ID NO: 2280449 - DNA, 15 bp, Homo sapiens
ccttttgagtgcctt

SEQ ID NO: 2280450 - DNA, 19 bp, Homo sapiens
cctttttcaccctattttc

SEQ ID NO: 2280451 - DNA, 18 bp, Homo sapiens
ccttttttattgaataac

SEQ ID NO: 2280452 - DNA, 18 bp, Homo sapiens
cgaaaacgtggctgcttc

SEQ ID NO: 2280453 - DNA, 18 bp, Homo sapiens
cgaagaccttctgaagat

SEQ ID NO: 2280454 - DNA, 16 bp, Homo sapiens
cgaagtctgctgctgt

SEQ ID NO: 2280455 - DNA, 22 bp, Homo sapiens
cgaataaggtaccaagatcaca

SEQ ID NO: 2280456 - DNA, 11 bp, Homo sapiens
cgaatattgct

SEQ ID NO: 2280457 - DNA, 13 bp, Homo sapiens
cgacagtcccagt

SEQ ID NO: 2280458 - DNA, 20 bp, Homo sapiens
cgacctccctggcttgagtg

SEQ ID NO: 2280459 - DNA, 13 bp, Homo sapiens
cgacggagccact

SEQ ID NO: 2280460 - DNA, 23 bp, Homo sapiens
cgacggagccactggggtgggag

SEQ ID NO: 2280461 - DNA, 19 bp, Homo sapiens
cgacttatatatttgaaag

SEQ ID NO: 2280462 - DNA, 13 bp, Homo sapiens
cgagaccagcctg

SEQ ID NO: 2280463 - DNA, 12 bp, Homo sapiens
cgagagggctga

SEQ ID NO: 2280464 - DNA, 16 bp, Homo sapiens
cgagagggctgagccc

SEQ ID NO: 2280465 - DNA, 19 bp, Homo sapiens
cgagagggctgagcccctc

SEQ ID NO: 2280466 - DNA, 20 bp, Homo sapiens
cgagcataaaataggtgcat

SEQ ID NO: 2280467 - DNA, 19 bp, Homo sapiens
cgagccgagctctcctggg

SEQ ID NO: 2280468 - DNA, 23 bp, Homo sapiens
cgagctctcctgggccagggtct

SEQ ID NO: 2280469 - DNA, 18 bp, Homo sapiens
cgaggactccaggggctg

SEQ ID NO: 2280470 - DNA, 19 bp, Homo sapiens
cgaggcctggctctggagc

SEQ ID NO: 2280471 - DNA, 15 bp, Homo sapiens
cgaggccttcagaaa

SEQ ID NO: 2280472 - DNA, 14 bp, Homo sapiens
cgagtctggagacc

SEQ ID NO: 2280473 - DNA, 15 bp, Homo sapiens
cgagtctggagacca

SEQ ID NO: 2280474 - DNA, 15 bp, Homo sapiens
cgagtgagctaccag

SEQ ID NO: 2280475 - DNA, 18 bp, Homo sapiens
cgagtgagctaccaggaa

SEQ ID NO: 2280476 - DNA, 19 bp, Homo sapiens
cgagtgagctaccaggaag

SEQ ID NO: 2280477 - DNA, 16 bp, Homo sapiens
cgagtgtggagctgct

SEQ ID NO: 2280478 - DNA, 20 bp, Homo sapiens
cgagttaatgatggcagagg

SEQ ID NO: 2280479 - DNA, 14 bp, Homo sapiens
cgataaatgaacat

SEQ ID NO: 2280480 - DNA, 17 bp, Homo sapiens
cgatatatgtaaatata

SEQ ID NO: 2280481 - DNA, 21 bp, Homo sapiens
cgatggatccgtgacagcact

SEQ ID NO: 2280482 - DNA, 13 bp, Homo sapiens
cgattcctgccaa

SEQ ID NO: 2280483 - DNA, 14 bp, Homo sapiens
cgcaaagggcgggc

SEQ ID NO: 2280484 - DNA, 14 bp, Homo sapiens
cgcacccctcctcc

SEQ ID NO: 2280485 - DNA, 12 bp, Homo sapiens
cgcaccctggct

SEQ ID NO: 2280486 - DNA, 13 bp, Homo sapiens
cgcaccgcccaac

SEQ ID NO: 2280487 - DNA, 17 bp, Homo sapiens
cgcacttctggggccag

SEQ ID NO: 2280488 - DNA, 16 bp, Homo sapiens
cgcagagccccggagc

SEQ ID NO: 2280489 - DNA, 17 bp, Homo sapiens
cgcagagccccggagca

SEQ ID NO: 2280490 - DNA, 12 bp, Homo sapiens
cgcagcaccagc

SEQ ID NO: 2280491 - DNA, 16 bp, Homo sapiens
cgcagcaccagcctga

SEQ ID NO: 2280492 - DNA, 18 bp, Homo sapiens
cgcagcaccagcctgagc

SEQ ID NO: 2280493 - DNA, 22 bp, Homo sapiens
cgcagcaccagcctgagccaca

SEQ ID NO: 2280494 - DNA, 21 bp, Homo sapiens
cgcagccccccacgcttctgg

SEQ ID NO: 2280495 - DNA, 15 bp, Homo sapiens
cgcagcccctgttgg

SEQ ID NO: 2280496 - DNA, 19 bp, Homo sapiens
cgcagccgcgctctgcccc

SEQ ID NO: 2280497 - DNA, 13 bp, Homo sapiens
cgcagggcgctcc

SEQ ID NO: 2280498 - DNA, 18 bp, Homo sapiens
cgcagggcgctccggcag

SEQ ID NO: 2280499 - DNA, 22 bp, Homo sapiens
cgcagggcgctccggcagaggc

SEQ ID NO: 2280500 - DNA, 17 bp, Homo sapiens
cgccaagccatcacagg

SEQ ID NO: 2280501 - DNA, 16 bp, Homo sapiens
cgccaaggctcacatg

SEQ ID NO: 2280502 - DNA, 23 bp, Homo sapiens
cgccaaggctcacatgctccttg

SEQ ID NO: 2280503 - DNA, 11 bp, Homo sapiens
cgccacccgcc

SEQ ID NO: 2280504 - DNA, 17 bp, Homo sapiens
cgcccaacccccacctc

SEQ ID NO: 2280505 - DNA, 14 bp, Homo sapiens
cgcccacccacacc

SEQ ID NO: 2280506 - DNA, 10 bp, Homo sapiens
cgcccacccc

SEQ ID NO: 2280507 - DNA, 14 bp, Homo sapiens
cgcccaccccgctg

SEQ ID NO: 2280508 - DNA, 20 bp, Homo sapiens
cgcccaccccgctgcctggc

SEQ ID NO: 2280509 - DNA, 11 bp, Homo sapiens
cgcccacctgc

SEQ ID NO: 2280510 - DNA, 12 bp, Homo sapiens
cgcccacctgcc

SEQ ID NO: 2280511 - DNA, 18 bp, Homo sapiens
cgcccacgggtgtggctc

SEQ ID NO: 2280512 - DNA, 11 bp, Homo sapiens
cgccccagaga

SEQ ID NO: 2280513 - DNA, 18 bp, Homo sapiens
cgccccagagactgccca

SEQ ID NO: 2280514 - DNA, 18 bp, Homo sapiens
cgcccccgccctcgctcc

SEQ ID NO: 2280515 - DNA, 13 bp, Homo sapiens
cgcccgcccaccc

SEQ ID NO: 2280516 - DNA, 16 bp, Homo sapiens
cgcccgccggttggcc

SEQ ID NO: 2280517 - DNA, 21 bp, Homo sapiens
cgcccgccggttggccggctg

SEQ ID NO: 2280518 - DNA, 13 bp, Homo sapiens
cgcccgcggccct

SEQ ID NO: 2280519 - DNA, 10 bp, Homo sapiens
cgccctcctc

SEQ ID NO: 2280520 - DNA, 16 bp, Homo sapiens
cgccctcctctgcccc

SEQ ID NO: 2280521 - DNA, 16 bp, Homo sapiens
cgccctctctcaccag

SEQ ID NO: 2280522 - DNA, 18 bp, Homo sapiens
cgccctctctcaccagcc

SEQ ID NO: 2280523 - DNA, 18 bp, Homo sapiens
cgccctgggctctgggtt

SEQ ID NO: 2280524 - DNA, 14 bp, Homo sapiens
cgccggcgccccgg

SEQ ID NO: 2280525 - DNA, 22 bp, Homo sapiens
cgccggggctggccctgccctc

SEQ ID NO: 2280526 - DNA, 19 bp, Homo sapiens
cgccggttggccggctggc

SEQ ID NO: 2280527 - DNA, 20 bp, Homo sapiens
cgccggttggccggctggcc

SEQ ID NO: 2280528 - DNA, 17 bp, Homo sapiens
cgcctcaaggaagagcc

SEQ ID NO: 2280529 - DNA, 19 bp, Homo sapiens
cgcctcaaggaagagccag

SEQ ID NO: 2280530 - DNA, 22 bp, Homo sapiens
cgcctcaaggaagagccagccg

SEQ ID NO: 2280531 - DNA, 23 bp, Homo sapiens
cgcctcaaggaagagccagccgt

SEQ ID NO: 2280532 - DNA, 15 bp, Homo sapiens
cgcctcccgccgcct

SEQ ID NO: 2280533 - DNA, 16 bp, Homo sapiens
cgcctcccgccgcctc

SEQ ID NO: 2280534 - DNA, 20 bp, Homo sapiens
cgcctcccgccgcctcgggc

SEQ ID NO: 2280535 - DNA, 14 bp, Homo sapiens
cgcctcctccagac

SEQ ID NO: 2280536 - DNA, 15 bp, Homo sapiens
cgcctcctccagctc

SEQ ID NO: 2280537 - DNA, 19 bp, Homo sapiens
cgcctcctccagctcctgc

SEQ ID NO: 2280538 - DNA, 17 bp, Homo sapiens
cgcctcgggccgcctcc

SEQ ID NO: 2280539 - DNA, 22 bp, Homo sapiens
cgcctcgggccgcctcctccag

SEQ ID NO: 2280540 - DNA, 23 bp, Homo sapiens
cgcctcgggccgcctcctccaga

SEQ ID NO: 2280541 - DNA, 12 bp, Homo sapiens
cgcctgcgcccc

SEQ ID NO: 2280542 - DNA, 18 bp, Homo sapiens
cgcctgcgctcctctgca

SEQ ID NO: 2280543 - DNA, 20 bp, Homo sapiens
cgcctgcgctcctctgcagc

SEQ ID NO: 2280544 - DNA, 17 bp, Homo sapiens
cgccttctacctgcagg

SEQ ID NO: 2280545 - DNA, 16 bp, Homo sapiens
cgcgacaatgcaaacc

SEQ ID NO: 2280546 - DNA, 21 bp, Homo sapiens
cgcgatgatgggctggagcag

SEQ ID NO: 2280547 - DNA, 15 bp, Homo sapiens
cgcgcaccgccatgc

SEQ ID NO: 2280548 - DNA, 20 bp, Homo sapiens
cgcgcagcccgggagatccg

SEQ ID NO: 2280549 - DNA, 13 bp, Homo sapiens
cgcgcgtgccccc

SEQ ID NO: 2280550 - DNA, 17 bp, Homo sapiens
cgcgcgtgcccccagcg

SEQ ID NO: 2280551 - DNA, 13 bp, Homo sapiens
cgcgctctgcccc

SEQ ID NO: 2280552 - DNA, 14 bp, Homo sapiens
cgcgctctgcccct

SEQ ID NO: 2280553 - DNA, 16 bp, Homo sapiens
cgcgctctgcccctcc

SEQ ID NO: 2280554 - DNA, 12 bp, Homo sapiens
cgcgtgccccca

SEQ ID NO: 2280555 - DNA, 14 bp, Homo sapiens
cgcgtgcccccagc

SEQ ID NO: 2280556 - DNA, 15 bp, Homo sapiens
cgcgtgcccccagcg

SEQ ID NO: 2280557 - DNA, 13 bp, Homo sapiens
cgcgtgccttccc

SEQ ID NO: 2280558 - DNA, 15 bp, Homo sapiens
cgctccaactccaac

SEQ ID NO: 2280559 - DNA, 15 bp, Homo sapiens
cgctccggcagaggc

SEQ ID NO: 2280560 - DNA, 20 bp, Homo sapiens
cgctcctctgcagcctgagc

SEQ ID NO: 2280561 - DNA, 22 bp, Homo sapiens
cgctcgaagttgatctccccag

SEQ ID NO: 2280562 - DNA, 17 bp, Homo sapiens
cgctctgccatcagccc

SEQ ID NO: 2280563 - DNA, 20 bp, Homo sapiens
cgctctgccatcagcccctg

SEQ ID NO: 2280564 - DNA, 23 bp, Homo sapiens
cgctctgcccctccgtccccagg

SEQ ID NO: 2280565 - DNA, 15 bp, Homo sapiens
cgctgcccccacaga

SEQ ID NO: 2280566 - DNA, 18 bp, Homo sapiens
cgctgcccccacagatcc

SEQ ID NO: 2280567 - DNA, 16 bp, Homo sapiens
cgctgcccccaccctg

SEQ ID NO: 2280568 - DNA, 21 bp, Homo sapiens
cgctgcctggcgggcagcccc

SEQ ID NO: 2280569 - DNA, 22 bp, Homo sapiens
cgctgcctggcgggcagcccct

SEQ ID NO: 2280570 - DNA, 14 bp, Homo sapiens
cgctggtaactgtt

SEQ ID NO: 2280571 - DNA, 10 bp, Homo sapiens
cgcttctgga

SEQ ID NO: 2280572 - DNA, 21 bp, Homo sapiens
cgcttctggaggtggggaggg

SEQ ID NO: 2280573 - DNA, 23 bp, Homo sapiens
cggaaagcagtcagcggagagga

SEQ ID NO: 2280574 - DNA, 18 bp, Homo sapiens
cggaccggagcggctgag

SEQ ID NO: 2280575 - DNA, 14 bp, Homo sapiens
cggacgctggctcg

SEQ ID NO: 2280576 - DNA, 17 bp, Homo sapiens
cggacgggacagcggcc

SEQ ID NO: 2280577 - DNA, 20 bp, Homo sapiens
cggactgaccgaagggacgg

SEQ ID NO: 2280578 - DNA, 19 bp, Homo sapiens
ctaaaggggactagacagt

SEQ ID NO: 2280579 - DNA, 23 bp, Homo sapiens
ctaaagtcctttgagctcctggg

SEQ ID NO: 2280580 - DNA, 19 bp, Homo sapiens
ctaaagttagggcattttt

SEQ ID NO: 2280581 - DNA, 19 bp, Homo sapiens
ctaaataaaacaatgtaat

SEQ ID NO: 2280582 - DNA, 18 bp, Homo sapiens
ctaaataatatcctgaat

SEQ ID NO: 2280583 - DNA, 21 bp, Homo sapiens
ctaaataatatcctgaataac

SEQ ID NO: 2280584 - DNA, 19 bp, Homo sapiens
ctaaatccattttctaaac

SEQ ID NO: 2280585 - DNA, 17 bp, Homo sapiens
ctaaatgcaaacactgt

SEQ ID NO: 2280586 - DNA, 20 bp, Homo sapiens
ctaaatgcaaacactgtgta

SEQ ID NO: 2280587 - DNA, 21 bp, Homo sapiens
ctaaatgcaaacactgtgtat

SEQ ID NO: 2280588 - DNA, 12 bp, Homo sapiens
ctaaatgtttct

SEQ ID NO: 2280589 - DNA, 13 bp, Homo sapiens
ctaaatgtttctt

SEQ ID NO: 2280590 - DNA, 13 bp, Homo sapiens
ctaaatttcacaa

SEQ ID NO: 2280591 - DNA, 16 bp, Homo sapiens
ctaacaaactgaaaaa

SEQ ID NO: 2280592 - DNA, 20 bp, Homo sapiens
ctaacataaagaaacacttt

SEQ ID NO: 2280593 - DNA, 17 bp, Homo sapiens
ctaacatggaagtacta

SEQ ID NO: 2280594 - DNA, 14 bp, Homo sapiens
ctaaccatttctta

SEQ ID NO: 2280595 - DNA, 15 bp, Homo sapiens
ctaaccatttcttat

SEQ ID NO: 2280596 - DNA, 14 bp, Homo sapiens
ctaacgggcgcctt

SEQ ID NO: 2280597 - DNA, 16 bp, Homo sapiens
ctaactagtaatcttg

SEQ ID NO: 2280598 - DNA, 12 bp, Homo sapiens
ctaactggcccc

SEQ ID NO: 2280599 - DNA, 14 bp, Homo sapiens
ctaactggccccag

SEQ ID NO: 2280600 - DNA, 17 bp, Homo sapiens
ctaagacaatcacgctg

SEQ ID NO: 2280601 - DNA, 13 bp, Homo sapiens
ctaagattgtaca

SEQ ID NO: 2280602 - DNA, 15 bp, Homo sapiens
ctaagggatccagag

SEQ ID NO: 2280603 - DNA, 17 bp, Homo sapiens
ctaagggatccagagac

SEQ ID NO: 2280604 - DNA, 20 bp, Homo sapiens
ctaagggatccagagacctg

SEQ ID NO: 2280605 - DNA, 18 bp, Homo sapiens
ctaagtgaggatgaaaaa

SEQ ID NO: 2280606 - DNA, 13 bp, Homo sapiens
ctaagtggaagac

SEQ ID NO: 2280607 - DNA, 21 bp, Homo sapiens
ctaagttgtattttaataaag

SEQ ID NO: 2280608 - DNA, 15 bp, Homo sapiens
ctaatagaaaactgt

SEQ ID NO: 2280609 - DNA, 12 bp, Homo sapiens
ctaatctttaat

SEQ ID NO: 2280610 - DNA, 13 bp, Homo sapiens
ctaatctttaata

SEQ ID NO: 2280611 - DNA, 15 bp, Homo sapiens
ctaatctttaatata

SEQ ID NO: 2280612 - DNA, 20 bp, Homo sapiens
ctaatgaatgcaaaaagata

SEQ ID NO: 2280613 - DNA, 11 bp, Homo sapiens
ctaatgcatta

SEQ ID NO: 2280614 - DNA, 20 bp, Homo sapiens
ctaatggccaagtgtacatt

SEQ ID NO: 2280615 - DNA, 13 bp, Homo sapiens
ctaatttataatc

SEQ ID NO: 2280616 - DNA, 18 bp, Homo sapiens
ctaatttatgaagatagt

SEQ ID NO: 2280617 - DNA, 20 bp, Homo sapiens
ctacactaaaatttaaatca

SEQ ID NO: 2280618 - DNA, 14 bp, Homo sapiens
ctacactgcaatca

SEQ ID NO: 2280619 - DNA, 17 bp, Homo sapiens
ctacacttctgaaactt

SEQ ID NO: 2280620 - DNA, 18 bp, Homo sapiens
ctacagcataaatctgtt

SEQ ID NO: 2280621 - DNA, 14 bp, Homo sapiens
ctacagtacatgac

SEQ ID NO: 2280622 - DNA, 16 bp, Homo sapiens
ctacagtagctgtggg

SEQ ID NO: 2280623 - DNA, 22 bp, Homo sapiens
ctacagtagctgtggggagctg

SEQ ID NO: 2280624 - DNA, 16 bp, Homo sapiens
ctacattaaaagcttt

SEQ ID NO: 2280625 - DNA, 19 bp, Homo sapiens
ctaccaaatataaacttgt

SEQ ID NO: 2280626 - DNA, 21 bp, Homo sapiens
ctaccagtatctccatcctta

SEQ ID NO: 2280627 - DNA, 18 bp, Homo sapiens
ctactaaaaatatgaaat

SEQ ID NO: 2280628 - DNA, 14 bp, Homo sapiens
ctactgccaacctc

SEQ ID NO: 2280629 - DNA, 22 bp, Homo sapiens
ctactgccaacctcgctccaac

SEQ ID NO: 2280630 - DNA, 21 bp, Homo sapiens
ctactggcagctgatacgttt

SEQ ID NO: 2280631 - DNA, 21 bp, Homo sapiens
ctactgtgttacatgttgtat

SEQ ID NO: 2280632 - DNA, 18 bp, Homo sapiens
ctagaagcctaagaactg

SEQ ID NO: 2280633 - DNA, 20 bp, Homo sapiens
ctagaatgagaaatcatgtt

SEQ ID NO: 2280634 - DNA, 23 bp, Homo sapiens
ctagacagttagagactctgtca

SEQ ID NO: 2280635 - DNA, 20 bp, Homo sapiens
ctagagagtgtgatgttcac

SEQ ID NO: 2280636 - DNA, 14 bp, Homo sapiens
ctagatctcctgta

SEQ ID NO: 2280637 - DNA, 17 bp, Homo sapiens
ctagcaaacaaaaatag

SEQ ID NO: 2280638 - DNA, 18 bp, Homo sapiens
ctagcacagctgtgagga

SEQ ID NO: 2280639 - DNA, 16 bp, Homo sapiens
ctagcagtatgtgtgc

SEQ ID NO: 2280640 - DNA, 21 bp, Homo sapiens
ctagcagttgttgaggggagg

SEQ ID NO: 2280641 - DNA, 18 bp, Homo sapiens
ctaggaaagagttgagca

SEQ ID NO: 2280642 - DNA, 22 bp, Homo sapiens
ctaggaaagagttgagcacagg

SEQ ID NO: 2280643 - DNA, 14 bp, Homo sapiens
ctaggcctcagtgt

SEQ ID NO: 2280644 - DNA, 15 bp, Homo sapiens
ctaggctgctgctgt

SEQ ID NO: 2280645 - DNA, 23 bp, Homo sapiens
ctaggggccgagggaaatgctgt

SEQ ID NO: 2280646 - DNA, 14 bp, Homo sapiens
ctaggtcatttgta

SEQ ID NO: 2280647 - DNA, 15 bp, Homo sapiens
ctagtactgtgtact

SEQ ID NO: 2280648 - DNA, 20 bp, Homo sapiens
ctagtactgtgtactgtata

SEQ ID NO: 2280649 - DNA, 23 bp, Homo sapiens
ctagtatttgtatcctggcaaat

SEQ ID NO: 2280650 - DNA, 18 bp, Homo sapiens
ctagtcaactgctgtttt

SEQ ID NO: 2280651 - DNA, 20 bp, Homo sapiens
ctagtcagaaaattggcagt

SEQ ID NO: 2280652 - DNA, 20 bp, Homo sapiens
ctagtcgtgaatcatttctc

SEQ ID NO: 2280653 - DNA, 14 bp, Homo sapiens
ctagtctctgattt

SEQ ID NO: 2280654 - DNA, 17 bp, Homo sapiens
ctagtctctgatttgca

SEQ ID NO: 2280655 - DNA, 18 bp, Homo sapiens
ctagtggcttcagcccct

SEQ ID NO: 2280656 - DNA, 20 bp, Homo sapiens
ctagttagcaggaaatagtg

SEQ ID NO: 2280657 - DNA, 15 bp, Homo sapiens
ctataaaattatgaa

SEQ ID NO: 2280658 - DNA, 22 bp, Homo sapiens
ctataaattcaacacttatttt

SEQ ID NO: 2280659 - DNA, 16 bp, Homo sapiens
ctataagagacaaagt

SEQ ID NO: 2280660 - DNA, 19 bp, Homo sapiens
ctatataattaatattttg

SEQ ID NO: 2280661 - DNA, 13 bp, Homo sapiens
ctatatatacatg

SEQ ID NO: 2280662 - DNA, 15 bp, Homo sapiens
ctatatatacatgta

SEQ ID NO: 2280663 - DNA, 19 bp, Homo sapiens
ctatatatacatgtatagt

SEQ ID NO: 2280664 - DNA, 13 bp, Homo sapiens
ctatatttcatat

SEQ ID NO: 2280665 - DNA, 15 bp, Homo sapiens
ctatatttgctaata

SEQ ID NO: 2280666 - DNA, 17 bp, Homo sapiens
ctatatttggattcaca

SEQ ID NO: 2280667 - DNA, 21 bp, Homo sapiens
ctatctaagacaatcacgctg

SEQ ID NO: 2280668 - DNA, 20 bp, Homo sapiens
ctatctgcaaatagtttcaa

SEQ ID NO: 2280669 - DNA, 12 bp, Homo sapiens
ctatctgtaaga

SEQ ID NO: 2280670 - DNA, 22 bp, Homo sapiens
ctatctgtaagaggtactaaaa

SEQ ID NO: 2280671 - DNA, 18 bp, Homo sapiens
ctatgaactagagactct

SEQ ID NO: 2280672 - DNA, 18 bp, Homo sapiens
ctatgagacctcccccag

SEQ ID NO: 2280673 - DNA, 21 bp, Homo sapiens
ctatgagacctcccccaggga

SEQ ID NO: 2280674 - DNA, 17 bp, Homo sapiens
ctatgcctgtatttcca

SEQ ID NO: 2280675 - DNA, 18 bp, Homo sapiens
ctatgcctgtatttccaa

SEQ ID NO: 2280676 - DNA, 18 bp, Homo sapiens
ctatggaaatacatttag

SEQ ID NO: 2280677 - DNA, 16 bp, Homo sapiens
ctatggctgtattttt

SEQ ID NO: 2280678 - DNA, 22 bp, Homo sapiens
ctatgtaagggctttaaataaa

SEQ ID NO: 2280679 - DNA, 17 bp, Homo sapiens
ctatgtactagtactgt

SEQ ID NO: 2280680 - DNA, 19 bp, Homo sapiens
ctatgtactagtactgtgt

SEQ ID NO: 2280681 - DNA, 14 bp, Homo sapiens
ctatgtagaactgt

SEQ ID NO: 2280682 - DNA, 15 bp, Homo sapiens
ctatgtagaactgtt

SEQ ID NO: 2280683 - DNA, 17 bp, Homo sapiens
ctatgttattttcagtg

SEQ ID NO: 2280684 - DNA, 18 bp, Homo sapiens
ctatgttattttcagtgc

SEQ ID NO: 2280685 - DNA, 20 bp, Homo sapiens
ctatgttattttcagtgctt

SEQ ID NO: 2280686 - DNA, 13 bp, Homo sapiens
ctatgttcataaa

SEQ ID NO: 2280687 - DNA, 15 bp, Homo sapiens
ctattataatataga

SEQ ID NO: 2280688 - DNA, 18 bp, Homo sapiens
ctattgttagtctcttga

SEQ ID NO: 2280689 - DNA, 18 bp, Homo sapiens
ctattgtttataggaaat

SEQ ID NO: 2280690 - DNA, 16 bp, Homo sapiens
ctatttagataacaag

SEQ ID NO: 2280691 - DNA, 21 bp, Homo sapiens
ctatttcggaaatacactaca

SEQ ID NO: 2280692 - DNA, 15 bp, Homo sapiens
ctatttctatctgca

SEQ ID NO: 2280693 - DNA, 17 bp, Homo sapiens
ctattttaaaattcatg

SEQ ID NO: 2280694 - DNA, 11 bp, Homo sapiens
ctattttctat

SEQ ID NO: 2280695 - DNA, 15 bp, Homo sapiens
ctattttgcagcagt

SEQ ID NO: 2280696 - DNA, 19 bp, Homo sapiens
ctcaaagaggccagtactt

SEQ ID NO: 2280697 - DNA, 13 bp, Homo sapiens
ctcaactgatgat

SEQ ID NO: 2280698 - DNA, 21 bp, Homo sapiens
ctcaagaccaaatggaaacag

SEQ ID NO: 2280699 - DNA, 12 bp, Homo sapiens
ctcaagagccct

SEQ ID NO: 2280700 - DNA, 16 bp, Homo sapiens
ctcaaggaagagccag

SEQ ID NO: 2280701 - DNA, 18 bp, Homo sapiens
ctcaaggaagagccagcc

SEQ ID NO: 2280702 - DNA, 19 bp, Homo sapiens
ctcaaggaagagccagccg

SEQ ID NO: 2280703 - DNA, 20 bp, Homo sapiens
ctcaatgcatgatgactctt

SEQ ID NO: 2280704 - DNA, 15 bp, Homo sapiens
ctcaatgcttttcta

SEQ ID NO: 2280705 - DNA, 13 bp, Homo sapiens
ctcacaactgttt

SEQ ID NO: 2280706 - DNA, 14 bp, Homo sapiens
ctcacaagtgaaaa

SEQ ID NO: 2280707 - DNA, 21 bp, Homo sapiens
ctcacaccgcaccgggctggc

SEQ ID NO: 2280708 - DNA, 12 bp, Homo sapiens
ctcacacctgta

SEQ ID NO: 2280709 - DNA, 12 bp, Homo sapiens
ctcaccagcctt

SEQ ID NO: 2280710 - DNA, 15 bp, Homo sapiens
ctcacccctgcaggc

SEQ ID NO: 2280711 - DNA, 24 bp, Homo sapiens
ctcgctccaactccaacatccact

SEQ ID NO: 2280712 - DNA, 14 bp, Homo sapiens
ctcggccagagctc

SEQ ID NO: 2280713 - DNA, 20 bp, Homo sapiens
ctcggccagagctcccagga

SEQ ID NO: 2280714 - DNA, 17 bp, Homo sapiens
ctcgggccgcctcctcc

SEQ ID NO: 2280715 - DNA, 19 bp, Homo sapiens
ctcgggccgcctcctccag

SEQ ID NO: 2280716 - DNA, 22 bp, Homo sapiens
ctcgggccgcctcctccagact

SEQ ID NO: 2280717 - DNA, 22 bp, Homo sapiens
ctcgggcgcctgcgctcctctg

SEQ ID NO: 2280718 - DNA, 22 bp, Homo sapiens
ctcgggctaagtccagctctcc

SEQ ID NO: 2280719 - DNA, 13 bp, Homo sapiens
ctcgggtgcccag

SEQ ID NO: 2280720 - DNA, 14 bp, Homo sapiens
ctcgggtgcccagg

SEQ ID NO: 2280721 - DNA, 22 bp, Homo sapiens
ctcggtgctgaacgacagtccc

SEQ ID NO: 2280722 - DNA, 16 bp, Homo sapiens
ctcgtcaggaggtgcc

SEQ ID NO: 2280723 - DNA, 17 bp, Homo sapiens
ctcgtccggcctgcagc

SEQ ID NO: 2280724 - DNA, 17 bp, Homo sapiens
ctcgtctctttacagaa

SEQ ID NO: 2280725 - DNA, 23 bp, Homo sapiens
ctcgtgttattttaatctcagaa

SEQ ID NO: 2280726 - DNA, 17 bp, Homo sapiens
ctcgtgttcgctggctg

SEQ ID NO: 2280727 - DNA, 13 bp, Homo sapiens
ctctactttcctg

SEQ ID NO: 2280728 - DNA, 21 bp, Homo sapiens
ctctactttcctgatgttgat

SEQ ID NO: 2280729 - DNA, 15 bp, Homo sapiens
ctctaggcctcagtg

SEQ ID NO: 2280730 - DNA, 22 bp, Homo sapiens
ctctaggcctcagtgtcctcat

SEQ ID NO: 2280731 - DNA, 19 bp, Homo sapiens
ctctaggtgtgtccacaga

SEQ ID NO: 2280732 - DNA, 15 bp, Homo sapiens
ctctatatatacatg

SEQ ID NO: 2280733 - DNA, 17 bp, Homo sapiens
ctctatatatacatgta

SEQ ID NO: 2280734 - DNA, 17 bp, Homo sapiens
ctctcacttttttataa

SEQ ID NO: 2280735 - DNA, 20 bp, Homo sapiens
ctctccaggcaccgcctgcc

SEQ ID NO: 2280736 - DNA, 21 bp, Homo sapiens
ctctccaggcaccgcctgccc

SEQ ID NO: 2280737 - DNA, 19 bp, Homo sapiens
ctctccagggagctgatgt

SEQ ID NO: 2280738 - DNA, 13 bp, Homo sapiens
ctctcccagacct

SEQ ID NO: 2280739 - DNA, 12 bp, Homo sapiens
ctctcctcgtcc

SEQ ID NO: 2280740 - DNA, 20 bp, Homo sapiens
ctctcctcgtccggcctgca

SEQ ID NO: 2280741 - DNA, 22 bp, Homo sapiens
ctctcctcgtccggcctgcagc

SEQ ID NO: 2280742 - DNA, 15 bp, Homo sapiens
ctctccttttctcca

SEQ ID NO: 2280743 - DNA, 20 bp, Homo sapiens
ctctctaaacccaaataaat

SEQ ID NO: 2280744 - DNA, 14 bp, Homo sapiens
ctctctcaccagcc

SEQ ID NO: 2280745 - DNA, 15 bp, Homo sapiens
ctctgaaaatatttt

SEQ ID NO: 2280746 - DNA, 21 bp, Homo sapiens
ctctgaaaatatttttttcta

SEQ ID NO: 2280747 - DNA, 16 bp, Homo sapiens
ctctgaactgctgctg

SEQ ID NO: 2280748 - DNA, 17 bp, Homo sapiens
ctctgaactgctgctgg

SEQ ID NO: 2280749 - DNA, 20 bp, Homo sapiens
ctctgaagggaggggaagag

SEQ ID NO: 2280750 - DNA, 23 bp, Homo sapiens
ctctgaatcaaaagctgaaattc

SEQ ID NO: 2280751 - DNA, 12 bp, Homo sapiens
ctctgagaacag

SEQ ID NO: 2280752 - DNA, 13 bp, Homo sapiens
ctctgagaacaga

SEQ ID NO: 2280753 - DNA, 20 bp, Homo sapiens
ctctgagactcgcgacaatg

SEQ ID NO: 2280754 - DNA, 18 bp, Homo sapiens
ctctgcactgggaattta

SEQ ID NO: 2280755 - DNA, 17 bp, Homo sapiens
ctctgccatcagcccct

SEQ ID NO: 2280756 - DNA, 21 bp, Homo sapiens
ctctgccatcagcccctgctg

SEQ ID NO: 2280757 - DNA, 15 bp, Homo sapiens
ctctgccccctcccc

SEQ ID NO: 2280758 - DNA, 16 bp, Homo sapiens
ctctgccccctccccc

SEQ ID NO: 2280759 - DNA, 20 bp, Homo sapiens
ctctgccccctcccccgcag

SEQ ID NO: 2280760 - DNA, 10 bp, Homo sapiens
ctctgcccct

SEQ ID NO: 2280761 - DNA, 15 bp, Homo sapiens
ctctgccctgccctg

SEQ ID NO: 2280762 - DNA, 16 bp, Homo sapiens
ctctgccctgccctgg

SEQ ID NO: 2280763 - DNA, 17 bp, Homo sapiens
ctctgccctgccctggc

SEQ ID NO: 2280764 - DNA, 20 bp, Homo sapiens
ctctgccctgccctggccac

SEQ ID NO: 2280765 - DNA, 16 bp, Homo sapiens
ctctgcctttgtgctc

SEQ ID NO: 2280766 - DNA, 14 bp, Homo sapiens
ctctgctcagggcc

SEQ ID NO: 2280767 - DNA, 15 bp, Homo sapiens
ctctgctgcacagta

SEQ ID NO: 2280768 - DNA, 19 bp, Homo sapiens
ctctggaaccatcctctgt

SEQ ID NO: 2280769 - DNA, 20 bp, Homo sapiens
ctctggaaccatcctctgtt

SEQ ID NO: 2280770 - DNA, 21 bp, Homo sapiens
ctctggaaccatcctctgtta

SEQ ID NO: 2280771 - DNA, 21 bp, Homo sapiens
ctctggcactccagaacaaac

SEQ ID NO: 2280772 - DNA, 16 bp, Homo sapiens
ctctggcaggtggcca

SEQ ID NO: 2280773 - DNA, 16 bp, Homo sapiens
ctctgggttttgggat

SEQ ID NO: 2280774 - DNA, 21 bp, Homo sapiens
ctctgtctggctgtacgtctg

SEQ ID NO: 2280775 - DNA, 21 bp, Homo sapiens
ctctgtcttaaagaatttgaa

SEQ ID NO: 2280776 - DNA, 13 bp, Homo sapiens
ctctgtggggcca

SEQ ID NO: 2280777 - DNA, 19 bp, Homo sapiens
ctctgtgtaatctctgatt

SEQ ID NO: 2280778 - DNA, 20 bp, Homo sapiens
ctctgttacccgcagatcct

SEQ ID NO: 2280779 - DNA, 14 bp, Homo sapiens
ctctgttgaccagg

SEQ ID NO: 2280780 - DNA, 17 bp, Homo sapiens
ctctgtttcccctcaga

SEQ ID NO: 2280781 - DNA, 21 bp, Homo sapiens
ctcttacagtgtttggacagg

SEQ ID NO: 2280782 - DNA, 18 bp, Homo sapiens
ctcttacggctatctagt

SEQ ID NO: 2280783 - DNA, 16 bp, Homo sapiens
ctcttcaaaaactgtt

SEQ ID NO: 2280784 - DNA, 23 bp, Homo sapiens
ctcttcccatgcaacaccctctt

SEQ ID NO: 2280785 - DNA, 21 bp, Homo sapiens
ctcttctcttacgctctctgt

SEQ ID NO: 2280786 - DNA, 15 bp, Homo sapiens
ctcttctgttctcaa

SEQ ID NO: 2280787 - DNA, 14 bp, Homo sapiens
ctcttcttctcaag

SEQ ID NO: 2280788 - DNA, 22 bp, Homo sapiens
ctcttcttgcggcaccgcccac

SEQ ID NO: 2280789 - DNA, 22 bp, Homo sapiens
ctcttgattcataatgacttaa

SEQ ID NO: 2280790 - DNA, 24 bp, Homo sapiens
ctcttgattcataatgacttaagc

SEQ ID NO: 2280791 - DNA, 16 bp, Homo sapiens
ctcttgtaccagccca

SEQ ID NO: 2280792 - DNA, 18 bp, Homo sapiens
ctctttgaaaattcttgt

SEQ ID NO: 2280793 - DNA, 16 bp, Homo sapiens
ctcttttaaatcagat

SEQ ID NO: 2280794 - DNA, 14 bp, Homo sapiens
ctgaaaactgttta

SEQ ID NO: 2280795 - DNA, 11 bp, Homo sapiens
ctgaaaatatt

SEQ ID NO: 2280796 - DNA, 23 bp, Homo sapiens
ctgaaaatatttttttctagcta

SEQ ID NO: 2280797 - DNA, 12 bp, Homo sapiens
ctgaaaatggtg

SEQ ID NO: 2280798 - DNA, 14 bp, Homo sapiens
ctgaaatgtttcca

SEQ ID NO: 2280799 - DNA, 15 bp, Homo sapiens
ctgaaatgtttccag

SEQ ID NO: 2280800 - DNA, 19 bp, Homo sapiens
ctgaaatgtttccaggcat

SEQ ID NO: 2280801 - DNA, 18 bp, Homo sapiens
ctgaaatttgctatataa

SEQ ID NO: 2280802 - DNA, 15 bp, Homo sapiens
ctgaactgctgctgg

SEQ ID NO: 2280803 - DNA, 18 bp, Homo sapiens
ctgaactggactagtgaa

SEQ ID NO: 2280804 - DNA, 19 bp, Homo sapiens
ctgaaggatgggggctcct

SEQ ID NO: 2280805 - DNA, 23 bp, Homo sapiens
ctgaagggactagctatctctgt

SEQ ID NO: 2280806 - DNA, 21 bp, Homo sapiens
ctgaagggaggggaagagaga

SEQ ID NO: 2280807 - DNA, 15 bp, Homo sapiens
ctgaagtatacattt

SEQ ID NO: 2280808 - DNA, 20 bp, Homo sapiens
ctgaagtctttgtacagaca

SEQ ID NO: 2280809 - DNA, 24 bp, Homo sapiens
ctgaagtctttgtacagacaacaa

SEQ ID NO: 2280810 - DNA, 11 bp, Homo sapiens
ctgaagttcag

SEQ ID NO: 2280811 - DNA, 18 bp, Homo sapiens
ctgaatcaaagacatttc

SEQ ID NO: 2280812 - DNA, 23 bp, Homo sapiens
ctgaatggcttgcagttgttcct

SEQ ID NO: 2280813 - DNA, 17 bp, Homo sapiens
ctgaattgtcagatgtg

SEQ ID NO: 2280814 - DNA, 20 bp, Homo sapiens
ctgaattgttatgtaaacat

SEQ ID NO: 2280815 - DNA, 23 bp, Homo sapiens
ctgacacaatggtagctctgaag

SEQ ID NO: 2280816 - DNA, 17 bp, Homo sapiens
ctgacaccccacttagc

SEQ ID NO: 2280817 - DNA, 18 bp, Homo sapiens
ctgacaccccacttagcc

SEQ ID NO: 2280818 - DNA, 14 bp, Homo sapiens
ctgacacctgccgc

SEQ ID NO: 2280819 - DNA, 17 bp, Homo sapiens
ctgacactaaccagagt

SEQ ID NO: 2280820 - DNA, 18 bp, Homo sapiens
ctgacactaaccagagtc

SEQ ID NO: 2280821 - DNA, 13 bp, Homo sapiens
ctgacagagccct

SEQ ID NO: 2280822 - DNA, 14 bp, Homo sapiens
ctgacagagcccta

SEQ ID NO: 2280823 - DNA, 22 bp, Homo sapiens
ctgacagagccctatctatgtc

SEQ ID NO: 2280824 - DNA, 22 bp, Homo sapiens
ctgaccaggccctgctcatcac

SEQ ID NO: 2280825 - DNA, 22 bp, Homo sapiens
ctgacctgcccccgctctgcca

SEQ ID NO: 2280826 - DNA, 12 bp, Homo sapiens
ctgactaaattt

SEQ ID NO: 2280827 - DNA, 18 bp, Homo sapiens
ctgactaaatttggggac

SEQ ID NO: 2280828 - DNA, 12 bp, Homo sapiens
ctgactatttac

SEQ ID NO: 2280829 - DNA, 13 bp, Homo sapiens
ctgactgaatgca

SEQ ID NO: 2280830 - DNA, 14 bp, Homo sapiens
ctgactgaatgcag

SEQ ID NO: 2280831 - DNA, 14 bp, Homo sapiens
ctgacttcccagct

SEQ ID NO: 2280832 - DNA, 15 bp, Homo sapiens
ctgacttcccagctg

SEQ ID NO: 2280833 - DNA, 19 bp, Homo sapiens
ctgacttcccagctggcag

SEQ ID NO: 2280834 - DNA, 16 bp, Homo sapiens
ctgagagagcgcagcc

SEQ ID NO: 2280835 - DNA, 15 bp, Homo sapiens
ctgagagcagaatga

SEQ ID NO: 2280836 - DNA, 14 bp, Homo sapiens
ctgagattccagaa

SEQ ID NO: 2280837 - DNA, 14 bp, Homo sapiens
ctgagcagtgggga

SEQ ID NO: 2280838 - DNA, 17 bp, Homo sapiens
ctgagccacagtggggc

SEQ ID NO: 2280839 - DNA, 21 bp, Homo sapiens
ctgagccacagtggggcccat

SEQ ID NO: 2280840 - DNA, 16 bp, Homo sapiens
ctgagcccctcctctc

SEQ ID NO: 2280841 - DNA, 16 bp, Homo sapiens
ctgagccgatctggtc

SEQ ID NO: 2280842 - DNA, 16 bp, Homo sapiens
ctgagctccaccctcc

SEQ ID NO: 2280843 - DNA, 15 bp, Homo sapiens
ctgctactgccaacc

SEQ ID NO: 2280844 - DNA, 14 bp, Homo sapiens
ctgctagcggctga

SEQ ID NO: 2280845 - DNA, 21 bp, Homo sapiens
ctgctatccaatgatatagga

SEQ ID NO: 2280846 - DNA, 18 bp, Homo sapiens
ctgctcacacgctgcctc

SEQ ID NO: 2280847 - DNA, 19 bp, Homo sapiens
ctgctcagattccccccat

SEQ ID NO: 2280848 - DNA, 15 bp, Homo sapiens
ctgctcaggctcccc

SEQ ID NO: 2280849 - DNA, 13 bp, Homo sapiens
ctgctcgggaagg

SEQ ID NO: 2280850 - DNA, 14 bp, Homo sapiens
ctgctcgggaaggc

SEQ ID NO: 2280851 - DNA, 13 bp, Homo sapiens
ctgctctccatct

SEQ ID NO: 2280852 - DNA, 14 bp, Homo sapiens
ctgctctccatctc

SEQ ID NO: 2280853 - DNA, 15 bp, Homo sapiens
ctgctgcctccaagt

SEQ ID NO: 2280854 - DNA, 15 bp, Homo sapiens
ctgctgcctctgaaa

SEQ ID NO: 2280855 - DNA, 22 bp, Homo sapiens
ctgctgcctgtttggggagggg

SEQ ID NO: 2280856 - DNA, 17 bp, Homo sapiens
ctgctgctcctcggcca

SEQ ID NO: 2280857 - DNA, 22 bp, Homo sapiens
ctgctgctcctcggccagagct

SEQ ID NO: 2280858 - DNA, 18 bp, Homo sapiens
ctgctgctcgggaaggcc

SEQ ID NO: 2280859 - DNA, 14 bp, Homo sapiens
ctgctgctggtcac

SEQ ID NO: 2280860 - DNA, 18 bp, Homo sapiens
ctgctgctggtcaccccc

SEQ ID NO: 2280861 - DNA, 16 bp, Homo sapiens
ctgctgctgtgcagca

SEQ ID NO: 2280862 - DNA, 22 bp, Homo sapiens
ctgctggaccaaggtgcggacc

SEQ ID NO: 2280863 - DNA, 15 bp, Homo sapiens
ctgctggtcaccccc

SEQ ID NO: 2280864 - DNA, 14 bp, Homo sapiens
ctgctgttttatgt

SEQ ID NO: 2280865 - DNA, 16 bp, Homo sapiens
ctgctgttttatgtca

SEQ ID NO: 2280866 - DNA, 13 bp, Homo sapiens
ctgcttaaggaaa

SEQ ID NO: 2280867 - DNA, 16 bp, Homo sapiens
ctgcttaccaaaacat

SEQ ID NO: 2280868 - DNA, 22 bp, Homo sapiens
ctgcttcaaggatcctgagcca

SEQ ID NO: 2280869 - DNA, 23 bp, Homo sapiens
ctgcttcaaggatcctgagccag

SEQ ID NO: 2280870 - DNA, 18 bp, Homo sapiens
ctgcttctgctgcctgtt

SEQ ID NO: 2280871 - DNA, 20 bp, Homo sapiens
ctgcttgagtggacagcagc

SEQ ID NO: 2280872 - DNA, 22 bp, Homo sapiens
ctgcttgagtggacagcagctg

SEQ ID NO: 2280873 - DNA, 18 bp, Homo sapiens
ctgcttggatccatacaa

SEQ ID NO: 2280874 - DNA, 19 bp, Homo sapiens
ctgcttggatccatacaaa

SEQ ID NO: 2280875 - DNA, 22 bp, Homo sapiens
ctgcttggatccatacaaaact

SEQ ID NO: 2280876 - DNA, 18 bp, Homo sapiens
ctgcttgtcattctgcta

SEQ ID NO: 2280877 - DNA, 15 bp, Homo sapiens
ctggaaaactggctg

SEQ ID NO: 2280878 - DNA, 18 bp, Homo sapiens
ctggaaccatcctctgtt

SEQ ID NO: 2280879 - DNA, 22 bp, Homo sapiens
ctggaagaacccttctcagaca

SEQ ID NO: 2280880 - DNA, 21 bp, Homo sapiens
ctggaagagccgagcacctgt

SEQ ID NO: 2280881 - DNA, 16 bp, Homo sapiens
ctggaaggctttattc

SEQ ID NO: 2280882 - DNA, 17 bp, Homo sapiens
ctggaagtgtgtgtttc

SEQ ID NO: 2280883 - DNA, 23 bp, Homo sapiens
ctggaagtgtgtgtttcttgctt

SEQ ID NO: 2280884 - DNA, 18 bp, Homo sapiens
ctggaatgggggccaggc

SEQ ID NO: 2280885 - DNA, 19 bp, Homo sapiens
ctggaatgggggccaggct

SEQ ID NO: 2280886 - DNA, 17 bp, Homo sapiens
ctggaattgttgaatgt

SEQ ID NO: 2280887 - DNA, 21 bp, Homo sapiens
ctggacaggcttcgtctcaga

SEQ ID NO: 2280888 - DNA, 17 bp, Homo sapiens
ctggaccaactgctttg

SEQ ID NO: 2280889 - DNA, 16 bp, Homo sapiens
ctggaccaaggtgcgg

SEQ ID NO: 2280890 - DNA, 22 bp, Homo sapiens
ctggacctggggtcccccctcc

SEQ ID NO: 2280891 - DNA, 21 bp, Homo sapiens
ctggactctgtggggccacac

SEQ ID NO: 2280892 - DNA, 21 bp, Homo sapiens
ctggactgggtgggccccaca

SEQ ID NO: 2280893 - DNA, 14 bp, Homo sapiens
ctggagaccaggac

SEQ ID NO: 2280894 - DNA, 13 bp, Homo sapiens
ctggagcaaagca

SEQ ID NO: 2280895 - DNA, 18 bp, Homo sapiens
ctggagcagtttggggca

SEQ ID NO: 2280896 - DNA, 21 bp, Homo sapiens
ctggagcagtttggggcaggg

SEQ ID NO: 2280897 - DNA, 14 bp, Homo sapiens
ctggagcccggcag

SEQ ID NO: 2280898 - DNA, 18 bp, Homo sapiens
ctggagcccggcagtgca

SEQ ID NO: 2280899 - DNA, 12 bp, Homo sapiens
ctggaggctgga

SEQ ID NO: 2280900 - DNA, 14 bp, Homo sapiens
ctggaggctggacc

SEQ ID NO: 2280901 - DNA, 15 bp, Homo sapiens
ctggagggctgggca

SEQ ID NO: 2280902 - DNA, 21 bp, Homo sapiens
ctggagggctgggcagggccc

SEQ ID NO: 2280903 - DNA, 23 bp, Homo sapiens
ctggagggctgggcagggccctg

SEQ ID NO: 2280904 - DNA, 18 bp, Homo sapiens
ctggaggggcccatgtgg

SEQ ID NO: 2280905 - DNA, 21 bp, Homo sapiens
ctggagtggcatggtcctgtg

SEQ ID NO: 2280906 - DNA, 16 bp, Homo sapiens
ctggatattcatgaaa

SEQ ID NO: 2280907 - DNA, 15 bp, Homo sapiens
ctggcagcgcctccc

SEQ ID NO: 2280908 - DNA, 17 bp, Homo sapiens
ctggcagcgcctcccgc

SEQ ID NO: 2280909 - DNA, 22 bp, Homo sapiens
ctggcagcgcctcccgccgcct

SEQ ID NO: 2280910 - DNA, 23 bp, Homo sapiens
ctggcaggagacactggtctcag

SEQ ID NO: 2280911 - DNA, 13 bp, Homo sapiens
ctggcagggcagg

SEQ ID NO: 2280912 - DNA, 18 bp, Homo sapiens
ctggcagggcaggcagag

SEQ ID NO: 2280913 - DNA, 14 bp, Homo sapiens
ctggcaggtggcca

SEQ ID NO: 2280914 - DNA, 18 bp, Homo sapiens
ctggcaggtggccagggc

SEQ ID NO: 2280915 - DNA, 20 bp, Homo sapiens
ctggcaggtggccagggctc

SEQ ID NO: 2280916 - DNA, 16 bp, Homo sapiens
ctggcatgggaatgaa

SEQ ID NO: 2280917 - DNA, 18 bp, Homo sapiens
ctggcatgggaatgaatg

SEQ ID NO: 2280918 - DNA, 14 bp, Homo sapiens
ctggccactggccc

SEQ ID NO: 2280919 - DNA, 15 bp, Homo sapiens
ctggccactggccct

SEQ ID NO: 2280920 - DNA, 13 bp, Homo sapiens
ctggccccaggcg

SEQ ID NO: 2280921 - DNA, 21 bp, Homo sapiens
ctggccccaggcggaggggct

SEQ ID NO: 2280922 - DNA, 17 bp, Homo sapiens
ctggccctgggccccgc

SEQ ID NO: 2280923 - DNA, 15 bp, Homo sapiens
ctggccctgtttctc

SEQ ID NO: 2280924 - DNA, 15 bp, Homo sapiens
ctggccggtccaccc

SEQ ID NO: 2280925 - DNA, 17 bp, Homo sapiens
ctggccggtccaccccg

SEQ ID NO: 2280926 - DNA, 18 bp, Homo sapiens
ctggccggtccaccccgt

SEQ ID NO: 2280927 - DNA, 17 bp, Homo sapiens
ctggcggccatccccgt

SEQ ID NO: 2280928 - DNA, 20 bp, Homo sapiens
ctggcgggcagcccctgctg

SEQ ID NO: 2280929 - DNA, 14 bp, Homo sapiens
ctggctctggagcc

SEQ ID NO: 2280930 - DNA, 21 bp, Homo sapiens
ctggctgacccctccttgtaa

SEQ ID NO: 2280931 - DNA, 21 bp, Homo sapiens
ctggctgggtcgcccctcctc

SEQ ID NO: 2280932 - DNA, 14 bp, Homo sapiens
ctggctgtccaccc

SEQ ID NO: 2280933 - DNA, 21 bp, Homo sapiens
ctggcttctccctggactctg

SEQ ID NO: 2280934 - DNA, 18 bp, Homo sapiens
ctggcttgagtgatcctc

SEQ ID NO: 2280935 - DNA, 20 bp, Homo sapiens
ctgggaagcattactttgta

SEQ ID NO: 2280936 - DNA, 13 bp, Homo sapiens
ctgggacccactc

SEQ ID NO: 2280937 - DNA, 19 bp, Homo sapiens
ctgggaccctcggggcagg

SEQ ID NO: 2280938 - DNA, 22 bp, Homo sapiens
ctgggactcagttcttggcctg

SEQ ID NO: 2280939 - DNA, 12 bp, Homo sapiens
ctgggagaggtt

SEQ ID NO: 2280940 - DNA, 14 bp, Homo sapiens
ctgggagagtgagg

SEQ ID NO: 2280941 - DNA, 17 bp, Homo sapiens
ctgggagagtgaggtca

SEQ ID NO: 2280942 - DNA, 21 bp, Homo sapiens
ctgggagatgctgggaccctc

SEQ ID NO: 2280943 - DNA, 17 bp, Homo sapiens
ctgggattacaggtgtg

SEQ ID NO: 2280944 - DNA, 12 bp, Homo sapiens
ctgggcagggcc

SEQ ID NO: 2280945 - DNA, 15 bp, Homo sapiens
ctgggcagggccctg

SEQ ID NO: 2280946 - DNA, 17 bp, Homo sapiens
ctgggcagggccctgtg

SEQ ID NO: 2280947 - DNA, 13 bp, Homo sapiens
ctgggcagggccg

SEQ ID NO: 2280948 - DNA, 15 bp, Homo sapiens
ctgggcagggccgca

SEQ ID NO: 2280949 - DNA, 22 bp, Homo sapiens
ctgggcagggccgcagggcgct

SEQ ID NO: 2280950 - DNA, 17 bp, Homo sapiens
ctgggcatccccagccc

SEQ ID NO: 2280951 - DNA, 16 bp, Homo sapiens
ctgggccagggtctcg

SEQ ID NO: 2280952 - DNA, 21 bp, Homo sapiens
ctgggccagggtctcgtcagg

SEQ ID NO: 2280953 - DNA, 14 bp, Homo sapiens
ctgggccccgcctc

SEQ ID NO: 2280954 - DNA, 15 bp, Homo sapiens
ctgggccctggttcc

SEQ ID NO: 2280955 - DNA, 22 bp, Homo sapiens
ctgggcctcccgtccgtccgcc

SEQ ID NO: 2280956 - DNA, 13 bp, Homo sapiens
ctgggctggcggc

SEQ ID NO: 2280957 - DNA, 16 bp, Homo sapiens
ctgggctggcggccat

SEQ ID NO: 2280958 - DNA, 23 bp, Homo sapiens
ctggggacttcgggggcggctct

SEQ ID NO: 2280959 - DNA, 13 bp, Homo sapiens
ctggggccagccc

SEQ ID NO: 2280960 - DNA, 17 bp, Homo sapiens
ctggggccagcccctcc

SEQ ID NO: 2280961 - DNA, 20 bp, Homo sapiens
ctggggccagcccctccccg

SEQ ID NO: 2280962 - DNA, 13 bp, Homo sapiens
ctggggctgccgt

SEQ ID NO: 2280963 - DNA, 11 bp, Homo sapiens
ctgggggaggc

SEQ ID NO: 2280964 - DNA, 18 bp, Homo sapiens
ctggggtacttctgtgtt

SEQ ID NO: 2280965 - DNA, 14 bp, Homo sapiens
ctggggtcccccct

SEQ ID NO: 2280966 - DNA, 21 bp, Homo sapiens
ctggggtctctgagcagtggg

SEQ ID NO: 2280967 - DNA, 14 bp, Homo sapiens
ctggggtgggaggg

SEQ ID NO: 2280968 - DNA, 20 bp, Homo sapiens
ctggggtgggagggggcagg

SEQ ID NO: 2280969 - DNA, 21 bp, Homo sapiens
ctggggtgggagggggcaggg

SEQ ID NO: 2280970 - DNA, 22 bp, Homo sapiens
ctggggtttccacacaggccca

SEQ ID NO: 2280971 - DNA, 20 bp, Homo sapiens
ctgggtaaaagcagggcagc

SEQ ID NO: 2280972 - DNA, 23 bp, Homo sapiens
ctgggtaaaagcagggcagcagg

SEQ ID NO: 2280973 - DNA, 16 bp, Homo sapiens
ctgggtcgcccctcct

SEQ ID NO: 2280974 - DNA, 18 bp, Homo sapiens
ctgggtcgcccctcctcg

SEQ ID NO: 2280975 - DNA, 20 bp, Homo sapiens
cttcccatgcaacaccctct

SEQ ID NO: 2280976 - DNA, 21 bp, Homo sapiens
cttcccatttgtaatgtatct

SEQ ID NO: 2280977 - DNA, 19 bp, Homo sapiens
cttccccgtgcggcccgtg

SEQ ID NO: 2280978 - DNA, 16 bp, Homo sapiens
cttcccgcagcaccag

SEQ ID NO: 2280979 - DNA, 22 bp, Homo sapiens
cttcccgcagcaccagcctgag

SEQ ID NO: 2280980 - DNA, 20 bp, Homo sapiens
cttccctagaagtcttcatg

SEQ ID NO: 2280981 - DNA, 17 bp, Homo sapiens
cttcctaccaaatataa

SEQ ID NO: 2280982 - DNA, 13 bp, Homo sapiens
cttcctcatcctt

SEQ ID NO: 2280983 - DNA, 18 bp, Homo sapiens
cttcctcatctccatgct

SEQ ID NO: 2280984 - DNA, 19 bp, Homo sapiens
cttcctcatctccatgctc

SEQ ID NO: 2280985 - DNA, 20 bp, Homo sapiens
cttcctcatctccatgctct

SEQ ID NO: 2280986 - DNA, 18 bp, Homo sapiens
cttcctccggctggacct

SEQ ID NO: 2280987 - DNA, 22 bp, Homo sapiens
cttcctccggctggacctgggg

SEQ ID NO: 2280988 - DNA, 19 bp, Homo sapiens
cttcctcctgacaccccac

SEQ ID NO: 2280989 - DNA, 23 bp, Homo sapiens
cttcctctcttttttggggggag

SEQ ID NO: 2280990 - DNA, 22 bp, Homo sapiens
cttcctggattttctttctatg

SEQ ID NO: 2280991 - DNA, 17 bp, Homo sapiens
cttccttataaaaattc

SEQ ID NO: 2280992 - DNA, 13 bp, Homo sapiens
cttcgaaaacaga

SEQ ID NO: 2280993 - DNA, 16 bp, Homo sapiens
cttctaaagtgctggg

SEQ ID NO: 2280994 - DNA, 20 bp, Homo sapiens
cttctaagggatccagagac

SEQ ID NO: 2280995 - DNA, 15 bp, Homo sapiens
cttctacctgcagga

SEQ ID NO: 2280996 - DNA, 16 bp, Homo sapiens
cttctatgttcataaa

SEQ ID NO: 2280997 - DNA, 16 bp, Homo sapiens
cttctccctggactct

SEQ ID NO: 2280998 - DNA, 20 bp, Homo sapiens
cttctccctggactctgtgg

SEQ ID NO: 2280999 - DNA, 13 bp, Homo sapiens
cttctgaaactta

SEQ ID NO: 2281000 - DNA, 23 bp, Homo sapiens
cttctgagtgaatgttaacatgc

SEQ ID NO: 2281001 - DNA, 17 bp, Homo sapiens
cttctggaatactgaaa

SEQ ID NO: 2281002 - DNA, 18 bp, Homo sapiens
cttctggaggtggggagg

SEQ ID NO: 2281003 - DNA, 22 bp, Homo sapiens
cttctggaggtggggagggcct

SEQ ID NO: 2281004 - DNA, 15 bp, Homo sapiens
cttctggggccagcc

SEQ ID NO: 2281005 - DNA, 18 bp, Homo sapiens
cttctggggccagcccct

SEQ ID NO: 2281006 - DNA, 20 bp, Homo sapiens
cttctggggccagcccctcc

SEQ ID NO: 2281007 - DNA, 18 bp, Homo sapiens
cttcttgcggcaccgccc

SEQ ID NO: 2281008 - DNA, 18 bp, Homo sapiens
cttctttaaggaagaata

SEQ ID NO: 2281009 - DNA, 22 bp, Homo sapiens
cttgaaaccaattaagcagctt

SEQ ID NO: 2281010 - DNA, 18 bp, Homo sapiens
cttgaactgtggccacct

SEQ ID NO: 2281011 - DNA, 16 bp, Homo sapiens
cttgaagaaggaaaga

SEQ ID NO: 2281012 - DNA, 12 bp, Homo sapiens
cttgaagaatat

SEQ ID NO: 2281013 - DNA, 16 bp, Homo sapiens
cttgaagacttttctt

SEQ ID NO: 2281014 - DNA, 22 bp, Homo sapiens
cttgaattcttttcctctctta

SEQ ID NO: 2281015 - DNA, 22 bp, Homo sapiens
cttgaggacctccacctgggag

SEQ ID NO: 2281016 - DNA, 17 bp, Homo sapiens
cttgagtggacagcagc

SEQ ID NO: 2281017 - DNA, 14 bp, Homo sapiens
cttgatataataat

SEQ ID NO: 2281018 - DNA, 22 bp, Homo sapiens
cttgatataataattacttaat

SEQ ID NO: 2281019 - DNA, 12 bp, Homo sapiens
cttgattcataa

SEQ ID NO: 2281020 - DNA, 15 bp, Homo sapiens
cttgcacttctgtta

SEQ ID NO: 2281021 - DNA, 19 bp, Homo sapiens
cttgcacttctgttatcag

SEQ ID NO: 2281022 - DNA, 21 bp, Homo sapiens
cttgcatattgttggcacaga

SEQ ID NO: 2281023 - DNA, 20 bp, Homo sapiens
cttgcccttctatactttct

SEQ ID NO: 2281024 - DNA, 17 bp, Homo sapiens
cttgcggcaccgcccac

SEQ ID NO: 2281025 - DNA, 19 bp, Homo sapiens
cttgcggcaccgcccaccc

SEQ ID NO: 2281026 - DNA, 19 bp, Homo sapiens
cttgctagtgatacactgt

SEQ ID NO: 2281027 - DNA, 15 bp, Homo sapiens
cttgcttctaaggga

SEQ ID NO: 2281028 - DNA, 16 bp, Homo sapiens
cttgcttgtacctctg

SEQ ID NO: 2281029 - DNA, 23 bp, Homo sapiens
cttgctttcacaaatatagttga

SEQ ID NO: 2281030 - DNA, 23 bp, Homo sapiens
cttggacggggacacggcctctg

SEQ ID NO: 2281031 - DNA, 15 bp, Homo sapiens
cttggagcagagacg

SEQ ID NO: 2281032 - DNA, 15 bp, Homo sapiens
cttggagcagaggtg

SEQ ID NO: 2281033 - DNA, 22 bp, Homo sapiens
cttggctcgcacccccactttc

SEQ ID NO: 2281034 - DNA, 13 bp, Homo sapiens
cttggctctgagg

SEQ ID NO: 2281035 - DNA, 17 bp, Homo sapiens
cttggctttcctgtttc

SEQ ID NO: 2281036 - DNA, 18 bp, Homo sapiens
cttggctttcctgtttct

SEQ ID NO: 2281037 - DNA, 18 bp, Homo sapiens
cttgggatgggcacaggc

SEQ ID NO: 2281038 - DNA, 20 bp, Homo sapiens
cttgggatgggcacaggctg

SEQ ID NO: 2281039 - DNA, 17 bp, Homo sapiens
cttgggcacgggagagc

SEQ ID NO: 2281040 - DNA, 19 bp, Homo sapiens
cttgggcacgggagagcgc

SEQ ID NO: 2281041 - DNA, 18 bp, Homo sapiens
cttggtagagttcctttc

SEQ ID NO: 2281042 - DNA, 17 bp, Homo sapiens
cttgtaaataatgctta

SEQ ID NO: 2281043 - DNA, 18 bp, Homo sapiens
cttgtaatattttgtatt

SEQ ID NO: 2281044 - DNA, 21 bp, Homo sapiens
cttgtacagaaccagcactcc

SEQ ID NO: 2281045 - DNA, 13 bp, Homo sapiens
cttgtaccagccc

SEQ ID NO: 2281046 - DNA, 14 bp, Homo sapiens
cttgtaccagccca

SEQ ID NO: 2281047 - DNA, 20 bp, Homo sapiens
cttgtacctctggctgacta

SEQ ID NO: 2281048 - DNA, 18 bp, Homo sapiens
cttgtctcctcctccagg

SEQ ID NO: 2281049 - DNA, 17 bp, Homo sapiens
cttgtgtactttcttcc

SEQ ID NO: 2281050 - DNA, 13 bp, Homo sapiens
cttgtgtcagggc

SEQ ID NO: 2281051 - DNA, 12 bp, Homo sapiens
cttgtgttgttt

SEQ ID NO: 2281052 - DNA, 15 bp, Homo sapiens
cttgtgttgttttct

SEQ ID NO: 2281053 - DNA, 17 bp, Homo sapiens
cttgtgttgttttctct

SEQ ID NO: 2281054 - DNA, 14 bp, Homo sapiens
cttgttcttacttt

SEQ ID NO: 2281055 - DNA, 22 bp, Homo sapiens
ctttaaaaaggtgcactacagt

SEQ ID NO: 2281056 - DNA, 14 bp, Homo sapiens
ctttaaataaaaga

SEQ ID NO: 2281057 - DNA, 18 bp, Homo sapiens
ctttaatgtctaagaaat

SEQ ID NO: 2281058 - DNA, 13 bp, Homo sapiens
ctttagacaaatt

SEQ ID NO: 2281059 - DNA, 16 bp, Homo sapiens
ctttagattgaaattt

SEQ ID NO: 2281060 - DNA, 18 bp, Homo sapiens
ctttcaataggaaaaact

SEQ ID NO: 2281061 - DNA, 20 bp, Homo sapiens
ctttcaataggaaaaactga

SEQ ID NO: 2281062 - DNA, 12 bp, Homo sapiens
ctttcaccctgc

SEQ ID NO: 2281063 - DNA, 13 bp, Homo sapiens
ctttcacctggga

SEQ ID NO: 2281064 - DNA, 16 bp, Homo sapiens
ctttcagaatacaatt

SEQ ID NO: 2281065 - DNA, 22 bp, Homo sapiens
ctttcagaatattttcaaaata

SEQ ID NO: 2281066 - DNA, 23 bp, Homo sapiens
ctttcagtggaaaccctgagagt

SEQ ID NO: 2281067 - DNA, 12 bp, Homo sapiens
ctttcatttctt

SEQ ID NO: 2281068 - DNA, 19 bp, Homo sapiens
ctttccaaggccccacctt

SEQ ID NO: 2281069 - DNA, 15 bp, Homo sapiens
ctttcctgatgttga

SEQ ID NO: 2281070 - DNA, 16 bp, Homo sapiens
ctttcctgatgttgat

SEQ ID NO: 2281071 - DNA, 16 bp, Homo sapiens
ctttcctgtttccagg

SEQ ID NO: 2281072 - DNA, 14 bp, Homo sapiens
ctttccttcccaat

SEQ ID NO: 2281073 - DNA, 13 bp, Homo sapiens
ctttctatgtaga

SEQ ID NO: 2281074 - DNA, 10 bp, Homo sapiens
ctttctcatg

SEQ ID NO: 2281075 - DNA, 16 bp, Homo sapiens
ctttcttgagcaccag

SEQ ID NO: 2281076 - DNA, 11 bp, Homo sapiens
ctttgcagtga

SEQ ID NO: 2281077 - DNA, 17 bp, Homo sapiens
ctttgcgctctgggttt

SEQ ID NO: 2281078 - DNA, 17 bp, Homo sapiens
ctttgcttaagatgcta

SEQ ID NO: 2281079 - DNA, 13 bp, Homo sapiens
ctttggacagctg

SEQ ID NO: 2281080 - DNA, 23 bp, Homo sapiens
ctttggacagctgactgaatgca

SEQ ID NO: 2281081 - DNA, 21 bp, Homo sapiens
ctttggggcttatcagaactc

SEQ ID NO: 2281082 - DNA, 22 bp, Homo sapiens
ctttggggtctacactgcaatc

SEQ ID NO: 2281083 - DNA, 21 bp, Homo sapiens
ctttggggttggttcctagag

SEQ ID NO: 2281084 - DNA, 17 bp, Homo sapiens
ctttgtccaaaggaaag

SEQ ID NO: 2281085 - DNA, 20 bp, Homo sapiens
ctttgttttggctgctctcc

SEQ ID NO: 2281086 - DNA, 19 bp, Homo sapiens
cttttagcggtttgcaaac

SEQ ID NO: 2281087 - DNA, 12 bp, Homo sapiens
cttttatataac

SEQ ID NO: 2281088 - DNA, 22 bp, Homo sapiens
cttttattgagtaatattacat

SEQ ID NO: 2281089 - DNA, 14 bp, Homo sapiens
cttttattgttata

SEQ ID NO: 2281090 - DNA, 17 bp, Homo sapiens
cttttcagcttgtttct

SEQ ID NO: 2281091 - DNA, 16 bp, Homo sapiens
cttttccatctaaaat

SEQ ID NO: 2281092 - DNA, 20 bp, Homo sapiens
cttttccatttatttattca

SEQ ID NO: 2281093 - DNA, 19 bp, Homo sapiens
cttttccccaattcatgtt

SEQ ID NO: 2281094 - DNA, 16 bp, Homo sapiens
cttttctagcaactgt

SEQ ID NO: 2281095 - DNA, 16 bp, Homo sapiens
cttttctttcagccaa

SEQ ID NO: 2281096 - DNA, 17 bp, Homo sapiens
cttttctttcagccaag

SEQ ID NO: 2281097 - DNA, 16 bp, Homo sapiens
cttttctttttaaatg

SEQ ID NO: 2281098 - DNA, 20 bp, Homo sapiens
cttttgttaaacccttctgt

SEQ ID NO: 2281099 - DNA, 21 bp, Homo sapiens
ctttttaaaaagttgcacatt

SEQ ID NO: 2281100 - DNA, 19 bp, Homo sapiens
ctttttcaccctattttca

SEQ ID NO: 2281101 - DNA, 15 bp, Homo sapiens
ctttttccaaacaat

SEQ ID NO: 2281102 - DNA, 23 bp, Homo sapiens
ctttttccaaacaatttagccag

SEQ ID NO: 2281103 - DNA, 11 bp, Homo sapiens
ctttttctctc

SEQ ID NO: 2281104 - DNA, 15 bp, Homo sapiens
ctttttcttttgtaa

SEQ ID NO: 2281105 - DNA, 17 bp, Homo sapiens
ctttttcttttgtaagt

SEQ ID NO: 2281106 - DNA, 18 bp, Homo sapiens
ctttttcttttgtaagtg

SEQ ID NO: 2281107 - DNA, 15 bp, Homo sapiens
gaataaatgagcatt

SEQ ID NO: 2281108 - DNA, 16 bp, Homo sapiens
gaataattttaacaga

SEQ ID NO: 2281109 - DNA, 20 bp, Homo sapiens
gaatactacagcataaatct

SEQ ID NO: 2281110 - DNA, 23 bp, Homo sapiens
gaatacttcctgaaataaaactg

SEQ ID NO: 2281111 - DNA, 20 bp, Homo sapiens
gaatatacatgtaaaaatgt

SEQ ID NO: 2281112 - DNA, 16 bp, Homo sapiens
gaatatacttagaaaa

SEQ ID NO: 2281113 - DNA, 16 bp, Homo sapiens
gaatatggacaaagaa

SEQ ID NO: 2281114 - DNA, 12 bp, Homo sapiens
gaatattgctga

SEQ ID NO: 2281115 - DNA, 15 bp, Homo sapiens
gaatattgctgatgg

SEQ ID NO: 2281116 - DNA, 23 bp, Homo sapiens
gaatattgctgatggtgcaatga

SEQ ID NO: 2281117 - DNA, 24 bp, Homo sapiens
gaatattgctgatggtgcaatgac

SEQ ID NO: 2281118 - DNA, 14 bp, Homo sapiens
gaatattttcaaaa

SEQ ID NO: 2281119 - DNA, 18 bp, Homo sapiens
gaatcaaaagctgaaatt

SEQ ID NO: 2281120 - DNA, 20 bp, Homo sapiens
gaatccaaactcaacaagtg

SEQ ID NO: 2281121 - DNA, 21 bp, Homo sapiens
gaatcccacttatcaaatcat

SEQ ID NO: 2281122 - DNA, 13 bp, Homo sapiens
gaatcctttgtac

SEQ ID NO: 2281123 - DNA, 21 bp, Homo sapiens
gaatcgcttgaacccaggtgg

SEQ ID NO: 2281124 - DNA, 12 bp, Homo sapiens
gaatctattttc

SEQ ID NO: 2281125 - DNA, 15 bp, Homo sapiens
gaatctattttctat

SEQ ID NO: 2281126 - DNA, 17 bp, Homo sapiens
gaatctattttctatgt

SEQ ID NO: 2281127 - DNA, 21 bp, Homo sapiens
gaatctattttctatgtacta

SEQ ID NO: 2281128 - DNA, 23 bp, Homo sapiens
gaatctattttctatgtactagt

SEQ ID NO: 2281129 - DNA, 12 bp, Homo sapiens
gaatgaaaacaa

SEQ ID NO: 2281130 - DNA, 18 bp, Homo sapiens
gaatgaatgtcagtgtga

SEQ ID NO: 2281131 - DNA, 17 bp, Homo sapiens
gaatgagaaatcatgtt

SEQ ID NO: 2281132 - DNA, 16 bp, Homo sapiens
gaatgatatgctagaa

SEQ ID NO: 2281133 - DNA, 14 bp, Homo sapiens
gaatgatgccatga

SEQ ID NO: 2281134 - DNA, 15 bp, Homo sapiens
gaatgcaaaaagata

SEQ ID NO: 2281135 - DNA, 12 bp, Homo sapiens
gaatgcatgtgt

SEQ ID NO: 2281136 - DNA, 22 bp, Homo sapiens
gaatgcttcaagtttagtgcat

SEQ ID NO: 2281137 - DNA, 11 bp, Homo sapiens
gaatgggaatt

SEQ ID NO: 2281138 - DNA, 22 bp, Homo sapiens
gaatgtacagaaaatagctttt

SEQ ID NO: 2281139 - DNA, 19 bp, Homo sapiens
gaatgtattcttttatata

SEQ ID NO: 2281140 - DNA, 20 bp, Homo sapiens
gaatgtattcttttatataa

SEQ ID NO: 2281141 - DNA, 13 bp, Homo sapiens
gaatgtcagtgtg

SEQ ID NO: 2281142 - DNA, 17 bp, Homo sapiens
gaatgtccccattctat

SEQ ID NO: 2281143 - DNA, 18 bp, Homo sapiens
gaatgtccccattctata

SEQ ID NO: 2281144 - DNA, 17 bp, Homo sapiens
gaatgttatatcatcaa

SEQ ID NO: 2281145 - DNA, 16 bp, Homo sapiens
gaatgttgttaaatgc

SEQ ID NO: 2281146 - DNA, 19 bp, Homo sapiens
gaatgtttcctgtggaaat

SEQ ID NO: 2281147 - DNA, 15 bp, Homo sapiens
gaattaggtaatgga

SEQ ID NO: 2281148 - DNA, 16 bp, Homo sapiens
gaattatgtataacaa

SEQ ID NO: 2281149 - DNA, 13 bp, Homo sapiens
gaattattacact

SEQ ID NO: 2281150 - DNA, 21 bp, Homo sapiens
gaattccagttgtatttgaag

SEQ ID NO: 2281151 - DNA, 20 bp, Homo sapiens
gaattctaagattgtacata

SEQ ID NO: 2281152 - DNA, 17 bp, Homo sapiens
gaattcttttcctctct

SEQ ID NO: 2281153 - DNA, 23 bp, Homo sapiens
gaattgaaccgtcaatgtgaaat

SEQ ID NO: 2281154 - DNA, 22 bp, Homo sapiens
gaattgtaaggaatgattaatt

SEQ ID NO: 2281155 - DNA, 13 bp, Homo sapiens
gaattgttgaatg

SEQ ID NO: 2281156 - DNA, 17 bp, Homo sapiens
gaattgttgaatgtatt

SEQ ID NO: 2281157 - DNA, 22 bp, Homo sapiens
gaatttaactactaagaataaa

SEQ ID NO: 2281158 - DNA, 13 bp, Homo sapiens
gaatttatttatg

SEQ ID NO: 2281159 - DNA, 19 bp, Homo sapiens
gaatttatttatgttctca

SEQ ID NO: 2281160 - DNA, 20 bp, Homo sapiens
gaatttatttatgttctcaa

SEQ ID NO: 2281161 - DNA, 16 bp, Homo sapiens
gaatttcccaaagcag

SEQ ID NO: 2281162 - DNA, 17 bp, Homo sapiens
gaatttgtgaatatatt

SEQ ID NO: 2281163 - DNA, 19 bp, Homo sapiens
gaattttaaaatgcaaata

SEQ ID NO: 2281164 - DNA, 21 bp, Homo sapiens
gacaaaacttataatttccaa

SEQ ID NO: 2281165 - DNA, 21 bp, Homo sapiens
gacaaaatccatcagggaatg

SEQ ID NO: 2281166 - DNA, 17 bp, Homo sapiens
gacaaatatttctttct

SEQ ID NO: 2281167 - DNA, 20 bp, Homo sapiens
gacaaattgttaagagtatc

SEQ ID NO: 2281168 - DNA, 21 bp, Homo sapiens
gacaaggggtggaagggcagg

SEQ ID NO: 2281169 - DNA, 22 bp, Homo sapiens
gacaaggggtggaagggcagga

SEQ ID NO: 2281170 - DNA, 24 bp, Homo sapiens
gacaaggggtggaagggcaggagc

SEQ ID NO: 2281171 - DNA, 16 bp, Homo sapiens
gacaatgcaaaccatc

SEQ ID NO: 2281172 - DNA, 15 bp, Homo sapiens
gacacataaatctgt

SEQ ID NO: 2281173 - DNA, 23 bp, Homo sapiens
gacaccaaattctgtggctgcca

SEQ ID NO: 2281174 - DNA, 17 bp, Homo sapiens
gacacgcacttctgggg

SEQ ID NO: 2281175 - DNA, 23 bp, Homo sapiens
gacacgcacttctggggccagcc

SEQ ID NO: 2281176 - DNA, 15 bp, Homo sapiens
gacacggcctctggg

SEQ ID NO: 2281177 - DNA, 18 bp, Homo sapiens
gacacggcctctggggag

SEQ ID NO: 2281178 - DNA, 17 bp, Homo sapiens
gacactcaagagccctt

SEQ ID NO: 2281179 - DNA, 16 bp, Homo sapiens
gacactgcagcagaaa

SEQ ID NO: 2281180 - DNA, 20 bp, Homo sapiens
gacagaaaaaaataaaaaca

SEQ ID NO: 2281181 - DNA, 12 bp, Homo sapiens
gacagacagacg

SEQ ID NO: 2281182 - DNA, 18 bp, Homo sapiens
gacagacggacgggacag

SEQ ID NO: 2281183 - DNA, 19 bp, Homo sapiens
gacagacggacgggacagc

SEQ ID NO: 2281184 - DNA, 15 bp, Homo sapiens
gacagagatcagaat

SEQ ID NO: 2281185 - DNA, 15 bp, Homo sapiens
gacagagatggcaga

SEQ ID NO: 2281186 - DNA, 16 bp, Homo sapiens
gacagagatggcagag

SEQ ID NO: 2281187 - DNA, 17 bp, Homo sapiens
gacagagatggcagagc

SEQ ID NO: 2281188 - DNA, 18 bp, Homo sapiens
gacagagatggcagagcc

SEQ ID NO: 2281189 - DNA, 20 bp, Homo sapiens
gacagattcagtcttgcctt

SEQ ID NO: 2281190 - DNA, 13 bp, Homo sapiens
gacagcggcccgg

SEQ ID NO: 2281191 - DNA, 18 bp, Homo sapiens
gacagctgactgaatgca

SEQ ID NO: 2281192 - DNA, 20 bp, Homo sapiens
gacagctgactgaatgcaga

SEQ ID NO: 2281193 - DNA, 15 bp, Homo sapiens
gacaggaacacccag

SEQ ID NO: 2281194 - DNA, 22 bp, Homo sapiens
gacaggaacacccagccccagc

SEQ ID NO: 2281195 - DNA, 20 bp, Homo sapiens
gacaggattctgacagagca

SEQ ID NO: 2281196 - DNA, 19 bp, Homo sapiens
gacaggattgtctgctgcc

SEQ ID NO: 2281197 - DNA, 14 bp, Homo sapiens
gacagggtctcact

SEQ ID NO: 2281198 - DNA, 17 bp, Homo sapiens
gacagggtctcactgtg

SEQ ID NO: 2281199 - DNA, 18 bp, Homo sapiens
gacagggtctcactgtgt

SEQ ID NO: 2281200 - DNA, 19 bp, Homo sapiens
gacagggtctcactgtgtt

SEQ ID NO: 2281201 - DNA, 16 bp, Homo sapiens
gacagtaagattttat

SEQ ID NO: 2281202 - DNA, 14 bp, Homo sapiens
gacagtcaggaagc

SEQ ID NO: 2281203 - DNA, 17 bp, Homo sapiens
gacagttgggatccaaa

SEQ ID NO: 2281204 - DNA, 16 bp, Homo sapiens
gacagtttgtaaatgt

SEQ ID NO: 2281205 - DNA, 16 bp, Homo sapiens
gacatcaactgcatca

SEQ ID NO: 2281206 - DNA, 13 bp, Homo sapiens
gacatttaaaata

SEQ ID NO: 2281207 - DNA, 15 bp, Homo sapiens
gaccaatctctgtga

SEQ ID NO: 2281208 - DNA, 19 bp, Homo sapiens
gaccactgtttcttgcttg

SEQ ID NO: 2281209 - DNA, 13 bp, Homo sapiens
gaccagcacactc

SEQ ID NO: 2281210 - DNA, 11 bp, Homo sapiens
gaccagcatag

SEQ ID NO: 2281211 - DNA, 18 bp, Homo sapiens
gaccagcatagttctgca

SEQ ID NO: 2281212 - DNA, 18 bp, Homo sapiens
gaccaggactctgccttc

SEQ ID NO: 2281213 - DNA, 11 bp, Homo sapiens
gaccaggctgg

SEQ ID NO: 2281214 - DNA, 16 bp, Homo sapiens
gaccccacctgaggca

SEQ ID NO: 2281215 - DNA, 18 bp, Homo sapiens
gaccccatccagccaggg

SEQ ID NO: 2281216 - DNA, 20 bp, Homo sapiens
gaccccatccagccaggggt

SEQ ID NO: 2281217 - DNA, 15 bp, Homo sapiens
gaccccatctgctga

SEQ ID NO: 2281218 - DNA, 21 bp, Homo sapiens
gaccccgagcacggttgcctg

SEQ ID NO: 2281219 - DNA, 18 bp, Homo sapiens
gacccctgggggaggctt

SEQ ID NO: 2281220 - DNA, 17 bp, Homo sapiens
gacccgcccgcggccct

SEQ ID NO: 2281221 - DNA, 14 bp, Homo sapiens
gaccctggagcccg

SEQ ID NO: 2281222 - DNA, 21 bp, Homo sapiens
gaccctgggagagtgaggtca

SEQ ID NO: 2281223 - DNA, 16 bp, Homo sapiens
gaccgagtgtggagct

SEQ ID NO: 2281224 - DNA, 22 bp, Homo sapiens
gaccgagtgtggagctgcttcc

SEQ ID NO: 2281225 - DNA, 18 bp, Homo sapiens
gaccggagcggctgagga

SEQ ID NO: 2281226 - DNA, 16 bp, Homo sapiens
gaccggcccgccacct

SEQ ID NO: 2281227 - DNA, 14 bp, Homo sapiens
gaccgggagcctgc

SEQ ID NO: 2281228 - DNA, 17 bp, Homo sapiens
gaccggggtcctgaggc

SEQ ID NO: 2281229 - DNA, 20 bp, Homo sapiens
gaccggggtcctgaggctgg

SEQ ID NO: 2281230 - DNA, 22 bp, Homo sapiens
gacctacatctgaaatctacaa

SEQ ID NO: 2281231 - DNA, 16 bp, Homo sapiens
gacctccacctgggag

SEQ ID NO: 2281232 - DNA, 13 bp, Homo sapiens
gacctcccccagg

SEQ ID NO: 2281233 - DNA, 17 bp, Homo sapiens
gacctctcactttttta

SEQ ID NO: 2281234 - DNA, 20 bp, Homo sapiens
gacctctcacttttttataa

SEQ ID NO: 2281235 - DNA, 11 bp, Homo sapiens
gacctgacacc

SEQ ID NO: 2281236 - DNA, 13 bp, Homo sapiens
gacctgacacctg

SEQ ID NO: 2281237 - DNA, 22 bp, Homo sapiens
gacctgacacctgccgctgctt

SEQ ID NO: 2281238 - DNA, 19 bp, Homo sapiens
gacctgcccccgctctgcc

SEQ ID NO: 2281239 - DNA, 15 bp, Homo sapiens
gagccgagctctcct

SEQ ID NO: 2281240 - DNA, 21 bp, Homo sapiens
gagccgagctctcctgggcca

SEQ ID NO: 2281241 - DNA, 17 bp, Homo sapiens
gagccgcaccctggctg

SEQ ID NO: 2281242 - DNA, 16 bp, Homo sapiens
gagcctgcgtggcctg

SEQ ID NO: 2281243 - DNA, 18 bp, Homo sapiens
gagcctttggtgaataac

SEQ ID NO: 2281244 - DNA, 14 bp, Homo sapiens
gagcgcagccgcct

SEQ ID NO: 2281245 - DNA, 15 bp, Homo sapiens
gagcgcgtgccttcc

SEQ ID NO: 2281246 - DNA, 17 bp, Homo sapiens
gagcgcgtgccttcccc

SEQ ID NO: 2281247 - DNA, 14 bp, Homo sapiens
gagctaccaggaag

SEQ ID NO: 2281248 - DNA, 15 bp, Homo sapiens
gagctaccaggaaga

SEQ ID NO: 2281249 - DNA, 19 bp, Homo sapiens
gagctaccaggaagagggg

SEQ ID NO: 2281250 - DNA, 14 bp, Homo sapiens
gagctcacaccgca

SEQ ID NO: 2281251 - DNA, 23 bp, Homo sapiens
gagctcacaccgcaccgggctgg

SEQ ID NO: 2281252 - DNA, 14 bp, Homo sapiens
gagctcagcacagc

SEQ ID NO: 2281253 - DNA, 18 bp, Homo sapiens
gagctcagcacagcctca

SEQ ID NO: 2281254 - DNA, 22 bp, Homo sapiens
gagctcagcacagcctcacccc

SEQ ID NO: 2281255 - DNA, 22 bp, Homo sapiens
gagctccaccctcccctcttct

SEQ ID NO: 2281256 - DNA, 18 bp, Homo sapiens
gagctctcctgggccagg

SEQ ID NO: 2281257 - DNA, 17 bp, Homo sapiens
gagctctgacctgcccc

SEQ ID NO: 2281258 - DNA, 15 bp, Homo sapiens
gagctcttggcagga

SEQ ID NO: 2281259 - DNA, 17 bp, Homo sapiens
gagctgagtcggctggg

SEQ ID NO: 2281260 - DNA, 20 bp, Homo sapiens
gagctgagtcggctgggcag

SEQ ID NO: 2281261 - DNA, 23 bp, Homo sapiens
gagctgagtcggctgggcagggc

SEQ ID NO: 2281262 - DNA, 17 bp, Homo sapiens
gagctgcttccagttgg

SEQ ID NO: 2281263 - DNA, 24 bp, Homo sapiens
gagctgggactcagttcttggcct

SEQ ID NO: 2281264 - DNA, 22 bp, Homo sapiens
gagctgtcaggcagtagcagct

SEQ ID NO: 2281265 - DNA, 19 bp, Homo sapiens
gaggacacggaccctgtgt

SEQ ID NO: 2281266 - DNA, 20 bp, Homo sapiens
gaggacacggaccctgtgtg

SEQ ID NO: 2281267 - DNA, 19 bp, Homo sapiens
gaggaccccattctgggac

SEQ ID NO: 2281268 - DNA, 20 bp, Homo sapiens
gaggaccccattctgggact

SEQ ID NO: 2281269 - DNA, 17 bp, Homo sapiens
gaggacctccacctggg

SEQ ID NO: 2281270 - DNA, 15 bp, Homo sapiens
gaggacggggagata

SEQ ID NO: 2281271 - DNA, 17 bp, Homo sapiens
gaggacggggcagagct

SEQ ID NO: 2281272 - DNA, 18 bp, Homo sapiens
gaggacggggcagagctg

SEQ ID NO: 2281273 - DNA, 16 bp, Homo sapiens
gaggactccaggggct

SEQ ID NO: 2281274 - DNA, 13 bp, Homo sapiens
gaggactgttcta

SEQ ID NO: 2281275 - DNA, 10 bp, Homo sapiens
gaggagcacc

SEQ ID NO: 2281276 - DNA, 20 bp, Homo sapiens
gaggagcacccccagcctcc

SEQ ID NO: 2281277 - DNA, 23 bp, Homo sapiens
gaggagcacccccagcctccccc

SEQ ID NO: 2281278 - DNA, 20 bp, Homo sapiens
gaggagggatagagacgcag

SEQ ID NO: 2281279 - DNA, 19 bp, Homo sapiens
gaggagttgtctgtcctgg

SEQ ID NO: 2281280 - DNA, 17 bp, Homo sapiens
gaggatggacgagtgag

SEQ ID NO: 2281281 - DNA, 19 bp, Homo sapiens
gaggatttggctcgctgtg

SEQ ID NO: 2281282 - DNA, 20 bp, Homo sapiens
gaggattttgggtggccaaa

SEQ ID NO: 2281283 - DNA, 18 bp, Homo sapiens
gaggcacaaagggcaggc

SEQ ID NO: 2281284 - DNA, 22 bp, Homo sapiens
gaggcacaaagggcaggcctgt

SEQ ID NO: 2281285 - DNA, 12 bp, Homo sapiens
gaggcagggccc

SEQ ID NO: 2281286 - DNA, 13 bp, Homo sapiens
gaggcagggccct

SEQ ID NO: 2281287 - DNA, 16 bp, Homo sapiens
gaggcagtggcttgga

SEQ ID NO: 2281288 - DNA, 21 bp, Homo sapiens
gaggcatgtgatgagaggaaa

SEQ ID NO: 2281289 - DNA, 21 bp, Homo sapiens
gaggccaaacacccaagcaca

SEQ ID NO: 2281290 - DNA, 17 bp, Homo sapiens
gaggcccccggaggcgc

SEQ ID NO: 2281291 - DNA, 18 bp, Homo sapiens
gaggcctcgagcagagag

SEQ ID NO: 2281292 - DNA, 22 bp, Homo sapiens
gaggcctgaaatgtttccaggc

SEQ ID NO: 2281293 - DNA, 16 bp, Homo sapiens
gaggcctggctctgga

SEQ ID NO: 2281294 - DNA, 22 bp, Homo sapiens
gaggcctgggtgtgacctgaca

SEQ ID NO: 2281295 - DNA, 15 bp, Homo sapiens
gaggcgcccacctgc

SEQ ID NO: 2281296 - DNA, 17 bp, Homo sapiens
gaggcgggaaccctctg

SEQ ID NO: 2281297 - DNA, 13 bp, Homo sapiens
gaggcgtcttgta

SEQ ID NO: 2281298 - DNA, 17 bp, Homo sapiens
gaggctggaccaactgc

SEQ ID NO: 2281299 - DNA, 16 bp, Homo sapiens
gaggcttccagctcag

SEQ ID NO: 2281300 - DNA, 23 bp, Homo sapiens
gaggcttccagctcagtcccaca

SEQ ID NO: 2281301 - DNA, 15 bp, Homo sapiens
gagggaagcccaccc

SEQ ID NO: 2281302 - DNA, 12 bp, Homo sapiens
gagggaggcctg

SEQ ID NO: 2281303 - DNA, 16 bp, Homo sapiens
gagggcctctggacag

SEQ ID NO: 2281304 - DNA, 13 bp, Homo sapiens
gagggctgggcag

SEQ ID NO: 2281305 - DNA, 16 bp, Homo sapiens
gagggctgggcagggc

SEQ ID NO: 2281306 - DNA, 20 bp, Homo sapiens
gagggctgggcagggccctg

SEQ ID NO: 2281307 - DNA, 13 bp, Homo sapiens
gaggggcagcttt

SEQ ID NO: 2281308 - DNA, 15 bp, Homo sapiens
gaggggcccatgtgg

SEQ ID NO: 2281309 - DNA, 17 bp, Homo sapiens
gaggggcggggccagga

SEQ ID NO: 2281310 - DNA, 20 bp, Homo sapiens
gaggggcggggccaggatgg

SEQ ID NO: 2281311 - DNA, 17 bp, Homo sapiens
gaggggtataggacaag

SEQ ID NO: 2281312 - DNA, 17 bp, Homo sapiens
gagggtcctcttcctca

SEQ ID NO: 2281313 - DNA, 12 bp, Homo sapiens
gagggtttccac

SEQ ID NO: 2281314 - DNA, 16 bp, Homo sapiens
gaggtcctttggacag

SEQ ID NO: 2281315 - DNA, 14 bp, Homo sapiens
gaggtgcctgagag

SEQ ID NO: 2281316 - DNA, 19 bp, Homo sapiens
gaggtgcctgagagcagaa

SEQ ID NO: 2281317 - DNA, 19 bp, Homo sapiens
gaggtggggagggcctctg

SEQ ID NO: 2281318 - DNA, 16 bp, Homo sapiens
gaggtttagcgtttta

SEQ ID NO: 2281319 - DNA, 17 bp, Homo sapiens
gagtaatattacatttc

SEQ ID NO: 2281320 - DNA, 15 bp, Homo sapiens
gagtatatatgtaca

SEQ ID NO: 2281321 - DNA, 19 bp, Homo sapiens
gagtatatatgtacagtta

SEQ ID NO: 2281322 - DNA, 14 bp, Homo sapiens
gagtcactggaaca

SEQ ID NO: 2281323 - DNA, 16 bp, Homo sapiens
gagtcagggagccctg

SEQ ID NO: 2281324 - DNA, 13 bp, Homo sapiens
gagtcatctcaaa

SEQ ID NO: 2281325 - DNA, 21 bp, Homo sapiens
gagtcatgttgaaggtgccca

SEQ ID NO: 2281326 - DNA, 14 bp, Homo sapiens
gagtcattgttaca

SEQ ID NO: 2281327 - DNA, 21 bp, Homo sapiens
gagtccctcctcccccacgcc

SEQ ID NO: 2281328 - DNA, 22 bp, Homo sapiens
gagtccctcctcccccacgcct

SEQ ID NO: 2281329 - DNA, 21 bp, Homo sapiens
gagtcctgccgacggagccac

SEQ ID NO: 2281330 - DNA, 15 bp, Homo sapiens
gagtctggagaccag

SEQ ID NO: 2281331 - DNA, 19 bp, Homo sapiens
gagtctggagaccaggact

SEQ ID NO: 2281332 - DNA, 21 bp, Homo sapiens
gagtctggagaccaggactct

SEQ ID NO: 2281333 - DNA, 22 bp, Homo sapiens
gagtctggagaccaggactctg

SEQ ID NO: 2281334 - DNA, 15 bp, Homo sapiens
gagtgaacatttcta

SEQ ID NO: 2281335 - DNA, 12 bp, Homo sapiens
gagtgaatgtta

SEQ ID NO: 2281336 - DNA, 19 bp, Homo sapiens
gagtgagctaccaggaaga

SEQ ID NO: 2281337 - DNA, 20 bp, Homo sapiens
gagtgatgggcaaggggcca

SEQ ID NO: 2281338 - DNA, 12 bp, Homo sapiens
gagtgccccaga

SEQ ID NO: 2281339 - DNA, 13 bp, Homo sapiens
gagtgccccagaa

SEQ ID NO: 2281340 - DNA, 22 bp, Homo sapiens
gagtgcccttaaaataatgatt

SEQ ID NO: 2281341 - DNA, 13 bp, Homo sapiens
gagtggacagcag

SEQ ID NO: 2281342 - DNA, 20 bp, Homo sapiens
gagtggtccacattctgctg

SEQ ID NO: 2281343 - DNA, 23 bp, Homo sapiens
gagtggtccacattctgctgccc

SEQ ID NO: 2281344 - DNA, 15 bp, Homo sapiens
gagttacagacaaag

SEQ ID NO: 2281345 - DNA, 19 bp, Homo sapiens
gagttcatcttgaattgta

SEQ ID NO: 2281346 - DNA, 23 bp, Homo sapiens
gagttcatcttgaattgtaagga

SEQ ID NO: 2281347 - DNA, 13 bp, Homo sapiens
gagttcctttctg

SEQ ID NO: 2281348 - DNA, 16 bp, Homo sapiens
gagttcctttctggga

SEQ ID NO: 2281349 - DNA, 19 bp, Homo sapiens
gagttcgagaccagcctga

SEQ ID NO: 2281350 - DNA, 22 bp, Homo sapiens
gagttgagcacaggcaacatta

SEQ ID NO: 2281351 - DNA, 23 bp, Homo sapiens
gagtttaaaaaaataacatctga

SEQ ID NO: 2281352 - DNA, 16 bp, Homo sapiens
gagtttaacagatatt

SEQ ID NO: 2281353 - DNA, 19 bp, Homo sapiens
gagtttctggctgaaaatg

SEQ ID NO: 2281354 - DNA, 14 bp, Homo sapiens
gataaactgaaatt

SEQ ID NO: 2281355 - DNA, 15 bp, Homo sapiens
gataagactggaaaa

SEQ ID NO: 2281356 - DNA, 16 bp, Homo sapiens
gataaggcaacaaaat

SEQ ID NO: 2281357 - DNA, 18 bp, Homo sapiens
gataagtgctcagtattg

SEQ ID NO: 2281358 - DNA, 21 bp, Homo sapiens
gatacagtattatagatataa

SEQ ID NO: 2281359 - DNA, 19 bp, Homo sapiens
gatactgtatatgtcaaaa

SEQ ID NO: 2281360 - DNA, 21 bp, Homo sapiens
gatactttttcttttgtaagt

SEQ ID NO: 2281361 - DNA, 23 bp, Homo sapiens
gatactttttcttttgtaagtgc

SEQ ID NO: 2281362 - DNA, 18 bp, Homo sapiens
gatagacttcgaaaacag

SEQ ID NO: 2281363 - DNA, 19 bp, Homo sapiens
gatagacttcgaaaacaga

SEQ ID NO: 2281364 - DNA, 23 bp, Homo sapiens
gataggggaactcctcaacactc

SEQ ID NO: 2281365 - DNA, 16 bp, Homo sapiens
gatataataattactt

SEQ ID NO: 2281366 - DNA, 21 bp, Homo sapiens
gatataataattacttaatgt

SEQ ID NO: 2281367 - DNA, 13 bp, Homo sapiens
gatataattactt

SEQ ID NO: 2281368 - DNA, 17 bp, Homo sapiens
gatataattacttaatg

SEQ ID NO: 2281369 - DNA, 17 bp, Homo sapiens
gatatacagacctccag

SEQ ID NO: 2281370 - DNA, 16 bp, Homo sapiens
gatataggaaaataca

SEQ ID NO: 2281371 - DNA, 19 bp, Homo sapiens
gcacacttccccttgggat

SEQ ID NO: 2281372 - DNA, 16 bp, Homo sapiens
gcacagaacaggaggt

SEQ ID NO: 2281373 - DNA, 18 bp, Homo sapiens
gcacagctgtgaggacag

SEQ ID NO: 2281374 - DNA, 15 bp, Homo sapiens
gcacaggcaacatta

SEQ ID NO: 2281375 - DNA, 15 bp, Homo sapiens
gcacaggtgtaaata

SEQ ID NO: 2281376 - DNA, 23 bp, Homo sapiens
gcacagtagtgttgggtggagga

SEQ ID NO: 2281377 - DNA, 12 bp, Homo sapiens
gcaccagcctga

SEQ ID NO: 2281378 - DNA, 17 bp, Homo sapiens
gcaccagcctgagccac

SEQ ID NO: 2281379 - DNA, 19 bp, Homo sapiens
gcaccagcctgagccacag

SEQ ID NO: 2281380 - DNA, 21 bp, Homo sapiens
gcacccccactttcgcctcct

SEQ ID NO: 2281381 - DNA, 22 bp, Homo sapiens
gcacccccactttcgcctcctc

SEQ ID NO: 2281382 - DNA, 23 bp, Homo sapiens
gcacccccactttcgcctcctcc

SEQ ID NO: 2281383 - DNA, 13 bp, Homo sapiens
gcacccccagcct

SEQ ID NO: 2281384 - DNA, 14 bp, Homo sapiens
gcacccccagcctc

SEQ ID NO: 2281385 - DNA, 14 bp, Homo sapiens
gcacccctcctcct

SEQ ID NO: 2281386 - DNA, 16 bp, Homo sapiens
gcacccggcagccccc

SEQ ID NO: 2281387 - DNA, 22 bp, Homo sapiens
gcaccgcccaacccccacctcc

SEQ ID NO: 2281388 - DNA, 23 bp, Homo sapiens
gcaccgcccaacccccacctccc

SEQ ID NO: 2281389 - DNA, 19 bp, Homo sapiens
gcaccgcccacccacaccc

SEQ ID NO: 2281390 - DNA, 14 bp, Homo sapiens
gcaccgcctgcccc

SEQ ID NO: 2281391 - DNA, 21 bp, Homo sapiens
gcacctcctcggctggctgtc

SEQ ID NO: 2281392 - DNA, 15 bp, Homo sapiens
gcacctgccctctgt

SEQ ID NO: 2281393 - DNA, 22 bp, Homo sapiens
gcacctgtgcccatggcttctg

SEQ ID NO: 2281394 - DNA, 20 bp, Homo sapiens
gcaccttcactctccagggt

SEQ ID NO: 2281395 - DNA, 18 bp, Homo sapiens
gcaccttgggcacgggag

SEQ ID NO: 2281396 - DNA, 23 bp, Homo sapiens
gcacgaggccttcagaaaagaca

SEQ ID NO: 2281397 - DNA, 13 bp, Homo sapiens
gcacggggccagc

SEQ ID NO: 2281398 - DNA, 19 bp, Homo sapiens
gcactagaatgagaaatca

SEQ ID NO: 2281399 - DNA, 15 bp, Homo sapiens
gcactcccagggccc

SEQ ID NO: 2281400 - DNA, 18 bp, Homo sapiens
gcactcccagggcccgag

SEQ ID NO: 2281401 - DNA, 12 bp, Homo sapiens
gcactcctgccc

SEQ ID NO: 2281402 - DNA, 22 bp, Homo sapiens
gcactcctgccccggcccaacc

SEQ ID NO: 2281403 - DNA, 22 bp, Homo sapiens
gcacttctggggccagcccctc

SEQ ID NO: 2281404 - DNA, 16 bp, Homo sapiens
gcagaatgactctgga

SEQ ID NO: 2281405 - DNA, 14 bp, Homo sapiens
gcagacactcaaga

SEQ ID NO: 2281406 - DNA, 22 bp, Homo sapiens
gcagagacgaggtgtcttcctt

SEQ ID NO: 2281407 - DNA, 18 bp, Homo sapiens
gcagagacggcagcccca

SEQ ID NO: 2281408 - DNA, 23 bp, Homo sapiens
gcagagccatccaccctgaggag

SEQ ID NO: 2281409 - DNA, 17 bp, Homo sapiens
gcagagcccccatggcc

SEQ ID NO: 2281410 - DNA, 11 bp, Homo sapiens
gcagagccccg

SEQ ID NO: 2281411 - DNA, 13 bp, Homo sapiens
gcagagccccgga

SEQ ID NO: 2281412 - DNA, 17 bp, Homo sapiens
gcagagccccggagcac

SEQ ID NO: 2281413 - DNA, 19 bp, Homo sapiens
gcagagccccggagcacca

SEQ ID NO: 2281414 - DNA, 19 bp, Homo sapiens
gcagagctcagcacagcct

SEQ ID NO: 2281415 - DNA, 20 bp, Homo sapiens
gcagaggcagggccctgggg

SEQ ID NO: 2281416 - DNA, 16 bp, Homo sapiens
gcagcaaccagagcac

SEQ ID NO: 2281417 - DNA, 19 bp, Homo sapiens
gcagcaaccagagcactgt

SEQ ID NO: 2281418 - DNA, 14 bp, Homo sapiens
gcagcaccagcctg

SEQ ID NO: 2281419 - DNA, 18 bp, Homo sapiens
gcagcaccagcctgagcc

SEQ ID NO: 2281420 - DNA, 21 bp, Homo sapiens
gcagcaccagcctgagccaca

SEQ ID NO: 2281421 - DNA, 22 bp, Homo sapiens
gcagcaccagcctgagccacag

SEQ ID NO: 2281422 - DNA, 21 bp, Homo sapiens
gcagcagtaccatcccactga

SEQ ID NO: 2281423 - DNA, 15 bp, Homo sapiens
gcagccacacctagg

SEQ ID NO: 2281424 - DNA, 22 bp, Homo sapiens
gcagccccccagtgtccccagg

SEQ ID NO: 2281425 - DNA, 23 bp, Homo sapiens
gcagcccgggagatccgccctgg

SEQ ID NO: 2281426 - DNA, 14 bp, Homo sapiens
gcagccgccttcac

SEQ ID NO: 2281427 - DNA, 16 bp, Homo sapiens
gcagccgcgctctgcc

SEQ ID NO: 2281428 - DNA, 22 bp, Homo sapiens
gcagcctcgacctccctggctt

SEQ ID NO: 2281429 - DNA, 12 bp, Homo sapiens
gcagcctgagct

SEQ ID NO: 2281430 - DNA, 15 bp, Homo sapiens
gcagcctgagctcca

SEQ ID NO: 2281431 - DNA, 20 bp, Homo sapiens
gcagcctgagctccaccctc

SEQ ID NO: 2281432 - DNA, 22 bp, Homo sapiens
gcagcctgagctccaccctccc

SEQ ID NO: 2281433 - DNA, 12 bp, Homo sapiens
gcagcgcctccc

SEQ ID NO: 2281434 - DNA, 18 bp, Homo sapiens
gcagcggccccgcacccc

SEQ ID NO: 2281435 - DNA, 13 bp, Homo sapiens
gcagctccaacct

SEQ ID NO: 2281436 - DNA, 17 bp, Homo sapiens
gcagctccaacctggag

SEQ ID NO: 2281437 - DNA, 22 bp, Homo sapiens
gcagctccaacctggaggctgg

SEQ ID NO: 2281438 - DNA, 23 bp, Homo sapiens
gcagctccaacctggaggctgga

SEQ ID NO: 2281439 - DNA, 20 bp, Homo sapiens
gcagctcccaggtttagaga

SEQ ID NO: 2281440 - DNA, 23 bp, Homo sapiens
gcaggaagtccctgagaagcctc

SEQ ID NO: 2281441 - DNA, 23 bp, Homo sapiens
gcaggagacactggtctcagagg

SEQ ID NO: 2281442 - DNA, 15 bp, Homo sapiens
gcaggagggcatgtg

SEQ ID NO: 2281443 - DNA, 17 bp, Homo sapiens
gcaggagggcatgtgca

SEQ ID NO: 2281444 - DNA, 17 bp, Homo sapiens
gcaggattctgcagctg

SEQ ID NO: 2281445 - DNA, 13 bp, Homo sapiens
gcaggcagagctc

SEQ ID NO: 2281446 - DNA, 22 bp, Homo sapiens
gcaggcagagctcagcacagcc

SEQ ID NO: 2281447 - DNA, 24 bp, Homo sapiens
gcaggcagagctcagcacagcctc

SEQ ID NO: 2281448 - DNA, 22 bp, Homo sapiens
gcaggccctccgcgggggacag

SEQ ID NO: 2281449 - DNA, 21 bp, Homo sapiens
gcaggcgcgcaccgcccaacc

SEQ ID NO: 2281450 - DNA, 18 bp, Homo sapiens
gcaggcggtatccagagg

SEQ ID NO: 2281451 - DNA, 20 bp, Homo sapiens
gcaggcggtatccagaggtg

SEQ ID NO: 2281452 - DNA, 11 bp, Homo sapiens
gcagggccctg

SEQ ID NO: 2281453 - DNA, 17 bp, Homo sapiens
gcagggccctggggtct

SEQ ID NO: 2281454 - DNA, 21 bp, Homo sapiens
gcagggcgctccggcagaggc

SEQ ID NO: 2281455 - DNA, 19 bp, Homo sapiens
gcagggtctcactctgttg

SEQ ID NO: 2281456 - DNA, 13 bp, Homo sapiens
gcaggtggccagg

SEQ ID NO: 2281457 - DNA, 23 bp, Homo sapiens
gcagtaattcccatctgctttat

SEQ ID NO: 2281458 - DNA, 14 bp, Homo sapiens
gcagtaccatccca

SEQ ID NO: 2281459 - DNA, 18 bp, Homo sapiens
gcagtaccatcccactga

SEQ ID NO: 2281460 - DNA, 20 bp, Homo sapiens
gcagtaccatcccactgata

SEQ ID NO: 2281461 - DNA, 16 bp, Homo sapiens
gcagtatgtgtgctct

SEQ ID NO: 2281462 - DNA, 16 bp, Homo sapiens
gcagtcactgggagag

SEQ ID NO: 2281463 - DNA, 20 bp, Homo sapiens
gcagtcactgggagaggtta

SEQ ID NO: 2281464 - DNA, 14 bp, Homo sapiens
gcagtcagcggaga

SEQ ID NO: 2281465 - DNA, 13 bp, Homo sapiens
gcagtctccgctc

SEQ ID NO: 2281466 - DNA, 17 bp, Homo sapiens
gcagtctccgctcccgc

SEQ ID NO: 2281467 - DNA, 21 bp, Homo sapiens
gcagtgaagatgtgtaaataa

SEQ ID NO: 2281468 - DNA, 22 bp, Homo sapiens
gcagtgaagatgtgtaaataag

SEQ ID NO: 2281469 - DNA, 16 bp, Homo sapiens
gcagtgacgtgagtgg

SEQ ID NO: 2281470 - DNA, 18 bp, Homo sapiens
gcagtgacgtgagtgggg

SEQ ID NO: 2281471 - DNA, 19 bp, Homo sapiens
gcagtgcaccccctaaaga

SEQ ID NO: 2281472 - DNA, 16 bp, Homo sapiens
gcagtgcatgctgtcc

SEQ ID NO: 2281473 - DNA, 12 bp, Homo sapiens
gcagtggggagc

SEQ ID NO: 2281474 - DNA, 18 bp, Homo sapiens
gcagttgttgaggggagg

SEQ ID NO: 2281475 - DNA, 19 bp, Homo sapiens
gcataagtggacccagctg

SEQ ID NO: 2281476 - DNA, 14 bp, Homo sapiens
gcatagacaagtgt

SEQ ID NO: 2281477 - DNA, 23 bp, Homo sapiens
gcatatgatatatagttacaaca

SEQ ID NO: 2281478 - DNA, 22 bp, Homo sapiens
gcatccttgaggacctccacct

SEQ ID NO: 2281479 - DNA, 22 bp, Homo sapiens
gcatctctttagatccaaaata

SEQ ID NO: 2281480 - DNA, 15 bp, Homo sapiens
gcatctgatttgcat

SEQ ID NO: 2281481 - DNA, 20 bp, Homo sapiens
gcatctgatttgcatattca

SEQ ID NO: 2281482 - DNA, 16 bp, Homo sapiens
gcatgagattgtacat

SEQ ID NO: 2281483 - DNA, 14 bp, Homo sapiens
gcatgatgactctt

SEQ ID NO: 2281484 - DNA, 22 bp, Homo sapiens
gcatgatgactcttcttatcac

SEQ ID NO: 2281485 - DNA, 13 bp, Homo sapiens
gcatggtcctgtg

SEQ ID NO: 2281486 - DNA, 13 bp, Homo sapiens
gcatgtctactgc

SEQ ID NO: 2281487 - DNA, 14 bp, Homo sapiens
gcatgtctactgct

SEQ ID NO: 2281488 - DNA, 20 bp, Homo sapiens
gcattaaatataaaatacat

SEQ ID NO: 2281489 - DNA, 21 bp, Homo sapiens
gcattagttggagctagaaaa

SEQ ID NO: 2281490 - DNA, 24 bp, Homo sapiens
gcattagttggagctagaaaatga

SEQ ID NO: 2281491 - DNA, 16 bp, Homo sapiens
gcattattttgtcata

SEQ ID NO: 2281492 - DNA, 24 bp, Homo sapiens
gcattcaaaatagttctatttcta

SEQ ID NO: 2281493 - DNA, 13 bp, Homo sapiens
gcattttggcgct

SEQ ID NO: 2281494 - DNA, 21 bp, Homo sapiens
gccaaaaactaaaattcaaca

SEQ ID NO: 2281495 - DNA, 19 bp, Homo sapiens
gccaaaatgtcaattttta

SEQ ID NO: 2281496 - DNA, 20 bp, Homo sapiens
gccaaataaaatgtttacat

SEQ ID NO: 2281497 - DNA, 22 bp, Homo sapiens
gccaaataaaatgtttacattt

SEQ ID NO: 2281498 - DNA, 21 bp, Homo sapiens
gccaaatcctgggcatcccca

SEQ ID NO: 2281499 - DNA, 22 bp, Homo sapiens
gccaaatcctgggcatccccag

SEQ ID NO: 2281500 - DNA, 22 bp, Homo sapiens
gccaacttaaacctgtgctttc

SEQ ID NO: 2281501 - DNA, 14 bp, Homo sapiens
gccaagaattctta

SEQ ID NO: 2281502 - DNA, 15 bp, Homo sapiens
gccctatctatgtcc

SEQ ID NO: 2281503 - DNA, 19 bp, Homo sapiens
gccctatctatgtcctgga

SEQ ID NO: 2281504 - DNA, 10 bp, Homo sapiens
gccctccccc

SEQ ID NO: 2281505 - DNA, 15 bp, Homo sapiens
gccctccgtcctggc

SEQ ID NO: 2281506 - DNA, 17 bp, Homo sapiens
gccctccgtcctggcag

SEQ ID NO: 2281507 - DNA, 19 bp, Homo sapiens
gccctccgtcctggcaggg

SEQ ID NO: 2281508 - DNA, 21 bp, Homo sapiens
gccctccgtcctggcagggca

SEQ ID NO: 2281509 - DNA, 13 bp, Homo sapiens
gccctcctctgcc

SEQ ID NO: 2281510 - DNA, 14 bp, Homo sapiens
gccctcctctgccc

SEQ ID NO: 2281511 - DNA, 16 bp, Homo sapiens
gccctcctctgccccc

SEQ ID NO: 2281512 - DNA, 21 bp, Homo sapiens
gccctcctctgccccctcccc

SEQ ID NO: 2281513 - DNA, 22 bp, Homo sapiens
gccctcctctgccccctccccc

SEQ ID NO: 2281514 - DNA, 17 bp, Homo sapiens
gccctctctcaccagcc

SEQ ID NO: 2281515 - DNA, 18 bp, Homo sapiens
gccctctctcaccagcct

SEQ ID NO: 2281516 - DNA, 19 bp, Homo sapiens
gccctctctcaccagcctt

SEQ ID NO: 2281517 - DNA, 17 bp, Homo sapiens
gccctgccctcccccac

SEQ ID NO: 2281518 - DNA, 12 bp, Homo sapiens
gccctgccctgg

SEQ ID NO: 2281519 - DNA, 14 bp, Homo sapiens
gccctgccctggcc

SEQ ID NO: 2281520 - DNA, 22 bp, Homo sapiens
gccctgccctggccactggccc

SEQ ID NO: 2281521 - DNA, 11 bp, Homo sapiens
gccctggaggg

SEQ ID NO: 2281522 - DNA, 12 bp, Homo sapiens
gccctggagggg

SEQ ID NO: 2281523 - DNA, 15 bp, Homo sapiens
gccctggccactggc

SEQ ID NO: 2281524 - DNA, 16 bp, Homo sapiens
gccctggccactggcc

SEQ ID NO: 2281525 - DNA, 17 bp, Homo sapiens
gccctgggccccgcctc

SEQ ID NO: 2281526 - DNA, 14 bp, Homo sapiens
gccctgggctctgg

SEQ ID NO: 2281527 - DNA, 15 bp, Homo sapiens
gccctgggctctggg

SEQ ID NO: 2281528 - DNA, 17 bp, Homo sapiens
gccctgggctctgggtt

SEQ ID NO: 2281529 - DNA, 12 bp, Homo sapiens
gccctggggtct

SEQ ID NO: 2281530 - DNA, 15 bp, Homo sapiens
gccctggggtctctg

SEQ ID NO: 2281531 - DNA, 19 bp, Homo sapiens
gccctggggtctctgagca

SEQ ID NO: 2281532 - DNA, 20 bp, Homo sapiens
gccctggggtctctgagcag

SEQ ID NO: 2281533 - DNA, 22 bp, Homo sapiens
gccctggggtctctgagcagtg

SEQ ID NO: 2281534 - DNA, 21 bp, Homo sapiens
gccctggggtttccacacagg

SEQ ID NO: 2281535 - DNA, 17 bp, Homo sapiens
gccctggttcccccagg

SEQ ID NO: 2281536 - DNA, 23 bp, Homo sapiens
gccctggttcccccaggaccctg

SEQ ID NO: 2281537 - DNA, 15 bp, Homo sapiens
gccctgtccactctg

SEQ ID NO: 2281538 - DNA, 14 bp, Homo sapiens
gccctgtggctcca

SEQ ID NO: 2281539 - DNA, 17 bp, Homo sapiens
gccctgtggctccagga

SEQ ID NO: 2281540 - DNA, 19 bp, Homo sapiens
gccctgtggctccaggagc

SEQ ID NO: 2281541 - DNA, 17 bp, Homo sapiens
gcccttaaaataatgat

SEQ ID NO: 2281542 - DNA, 14 bp, Homo sapiens
gcccttccaggagt

SEQ ID NO: 2281543 - DNA, 23 bp, Homo sapiens
gcccttgaattcttttcctctct

SEQ ID NO: 2281544 - DNA, 14 bp, Homo sapiens
gccgacaggaggcc

SEQ ID NO: 2281545 - DNA, 15 bp, Homo sapiens
gccgacggagccact

SEQ ID NO: 2281546 - DNA, 17 bp, Homo sapiens
gccgagctctcctgggc

SEQ ID NO: 2281547 - DNA, 20 bp, Homo sapiens
gccgagctctcctgggccag

SEQ ID NO: 2281548 - DNA, 19 bp, Homo sapiens
gccgagggaaatgctgttg

SEQ ID NO: 2281549 - DNA, 23 bp, Homo sapiens
gccgatctggtctcgtgttcgct

SEQ ID NO: 2281550 - DNA, 17 bp, Homo sapiens
gccgcaccctggctgga

SEQ ID NO: 2281551 - DNA, 20 bp, Homo sapiens
gccgcagggcgctccggcag

SEQ ID NO: 2281552 - DNA, 21 bp, Homo sapiens
gccgcagggcgctccggcaga

SEQ ID NO: 2281553 - DNA, 12 bp, Homo sapiens
gccgcctcctcc

SEQ ID NO: 2281554 - DNA, 16 bp, Homo sapiens
gccgcctcgggccgcc

SEQ ID NO: 2281555 - DNA, 20 bp, Homo sapiens
gccgcctcgggccgcctcct

SEQ ID NO: 2281556 - DNA, 22 bp, Homo sapiens
gccgcctcgggccgcctcctcc

SEQ ID NO: 2281557 - DNA, 14 bp, Homo sapiens
gccgcgcaccgcca

SEQ ID NO: 2281558 - DNA, 16 bp, Homo sapiens
gccgcgcaccgccatg

SEQ ID NO: 2281559 - DNA, 13 bp, Homo sapiens
gccgcgctctgcc

SEQ ID NO: 2281560 - DNA, 17 bp, Homo sapiens
gccgcgctctgcccctc

SEQ ID NO: 2281561 - DNA, 22 bp, Homo sapiens
gccgcggccgacatcagcccgg

SEQ ID NO: 2281562 - DNA, 14 bp, Homo sapiens
gccgctgcccccac

SEQ ID NO: 2281563 - DNA, 12 bp, Homo sapiens
gccgctgtgtct

SEQ ID NO: 2281564 - DNA, 23 bp, Homo sapiens
gccggccgcgcaccgccatgcat

SEQ ID NO: 2281565 - DNA, 14 bp, Homo sapiens
gccggcctggggcc

SEQ ID NO: 2281566 - DNA, 12 bp, Homo sapiens
gccggcgccccg

SEQ ID NO: 2281567 - DNA, 16 bp, Homo sapiens
gccggggctggccctg

SEQ ID NO: 2281568 - DNA, 19 bp, Homo sapiens
gccggggctggccctgccc

SEQ ID NO: 2281569 - DNA, 21 bp, Homo sapiens
gccggggctggccctgccctc

SEQ ID NO: 2281570 - DNA, 14 bp, Homo sapiens
gccggtccaccccg

SEQ ID NO: 2281571 - DNA, 18 bp, Homo sapiens
gccggtccaccccgtccc

SEQ ID NO: 2281572 - DNA, 15 bp, Homo sapiens
gccggttggccggct

SEQ ID NO: 2281573 - DNA, 21 bp, Homo sapiens
gccgtaatggggactctccag

SEQ ID NO: 2281574 - DNA, 19 bp, Homo sapiens
gccgtccctgacttcccag

SEQ ID NO: 2281575 - DNA, 16 bp, Homo sapiens
gccgtgcacggggcca

SEQ ID NO: 2281576 - DNA, 13 bp, Homo sapiens
gcctaaatttcac

SEQ ID NO: 2281577 - DNA, 14 bp, Homo sapiens
gcctaaatttcaca

SEQ ID NO: 2281578 - DNA, 16 bp, Homo sapiens
gcctaatgcattattt

SEQ ID NO: 2281579 - DNA, 21 bp, Homo sapiens
gcctcaaggaagagccagccg

SEQ ID NO: 2281580 - DNA, 11 bp, Homo sapiens
gcctcacccct

SEQ ID NO: 2281581 - DNA, 15 bp, Homo sapiens
gcctcacccctgcag

SEQ ID NO: 2281582 - DNA, 18 bp, Homo sapiens
gcctcacccctgcaggcg

SEQ ID NO: 2281583 - DNA, 23 bp, Homo sapiens
gcctcaggaggcagtggcttgga

SEQ ID NO: 2281584 - DNA, 13 bp, Homo sapiens
gcctcatgggagt

SEQ ID NO: 2281585 - DNA, 20 bp, Homo sapiens
gcctcatgggagtcagggag

SEQ ID NO: 2281586 - DNA, 14 bp, Homo sapiens
gcctcattcagcag

SEQ ID NO: 2281587 - DNA, 17 bp, Homo sapiens
gcctccaagtcatggga

SEQ ID NO: 2281588 - DNA, 19 bp, Homo sapiens
gcctccaagtcatgggaga

SEQ ID NO: 2281589 - DNA, 22 bp, Homo sapiens
gcctccaagtcatgggagaaga

SEQ ID NO: 2281590 - DNA, 10 bp, Homo sapiens
gcctccatcc

SEQ ID NO: 2281591 - DNA, 12 bp, Homo sapiens
gcctccatccac

SEQ ID NO: 2281592 - DNA, 14 bp, Homo sapiens
gcctccatccacac

SEQ ID NO: 2281593 - DNA, 18 bp, Homo sapiens
gcctccatccacacacag

SEQ ID NO: 2281594 - DNA, 19 bp, Homo sapiens
gcctccatccacacacagc

SEQ ID NO: 2281595 - DNA, 14 bp, Homo sapiens
gcctcccccaggct

SEQ ID NO: 2281596 - DNA, 23 bp, Homo sapiens
gcctcccccaggctgcgcctgcc

SEQ ID NO: 2281597 - DNA, 15 bp, Homo sapiens
gcctccccgggggtc

SEQ ID NO: 2281598 - DNA, 18 bp, Homo sapiens
gcctccccgggggtcccc

SEQ ID NO: 2281599 - DNA, 21 bp, Homo sapiens
gcctccccgggggtccccgga

SEQ ID NO: 2281600 - DNA, 22 bp, Homo sapiens
gcctccccgggggtccccggac

SEQ ID NO: 2281601 - DNA, 13 bp, Homo sapiens
gcctcccgccgcc

SEQ ID NO: 2281602 - DNA, 21 bp, Homo sapiens
gcctcccgtccgtccgcccgc

SEQ ID NO: 2281603 - DNA, 19 bp, Homo sapiens
gcctccgaggttttgaggc

SEQ ID NO: 2281604 - DNA, 13 bp, Homo sapiens
gcctcctccagac

SEQ ID NO: 2281605 - DNA, 17 bp, Homo sapiens
gcctcctccctgcctgg

SEQ ID NO: 2281606 - DNA, 17 bp, Homo sapiens
gcctcctgagtagctgg

SEQ ID NO: 2281607 - DNA, 20 bp, Homo sapiens
gcctcctgctgagtggtcca

SEQ ID NO: 2281608 - DNA, 16 bp, Homo sapiens
gcctcgacctccctgg

SEQ ID NO: 2281609 - DNA, 20 bp, Homo sapiens
gcctcgacctccctggcttg

SEQ ID NO: 2281610 - DNA, 15 bp, Homo sapiens
gcctcgggccgcctc

SEQ ID NO: 2281611 - DNA, 17 bp, Homo sapiens
gcctcgggccgcctcct

SEQ ID NO: 2281612 - DNA, 19 bp, Homo sapiens
gcctcgggccgcctcctcc

SEQ ID NO: 2281613 - DNA, 13 bp, Homo sapiens
gcctctgaaaata

SEQ ID NO: 2281614 - DNA, 18 bp, Homo sapiens
gcctctgaactgctgctg

SEQ ID NO: 2281615 - DNA, 15 bp, Homo sapiens
gcctctgctctgtgc

SEQ ID NO: 2281616 - DNA, 19 bp, Homo sapiens
gcctgaaatgtttccaggc

SEQ ID NO: 2281617 - DNA, 16 bp, Homo sapiens
gcctgacacaatggta

SEQ ID NO: 2281618 - DNA, 21 bp, Homo sapiens
gcctgacacaatggtagctct

SEQ ID NO: 2281619 - DNA, 13 bp, Homo sapiens
gcctgagagcaga

SEQ ID NO: 2281620 - DNA, 15 bp, Homo sapiens
gcctgagagcagaat

SEQ ID NO: 2281621 - DNA, 17 bp, Homo sapiens
gcctgagagcagaatga

SEQ ID NO: 2281622 - DNA, 14 bp, Homo sapiens
gcctgagccacagt

SEQ ID NO: 2281623 - DNA, 18 bp, Homo sapiens
gcctgagccacagtgggg

SEQ ID NO: 2281624 - DNA, 16 bp, Homo sapiens
gcctgagctccaccct

SEQ ID NO: 2281625 - DNA, 17 bp, Homo sapiens
gcctgagctccaccctc

SEQ ID NO: 2281626 - DNA, 19 bp, Homo sapiens
gcctgagctccaccctccc

SEQ ID NO: 2281627 - DNA, 22 bp, Homo sapiens
gcctgagctccaccctcccctc

SEQ ID NO: 2281628 - DNA, 13 bp, Homo sapiens
gcctgagggaagc

SEQ ID NO: 2281629 - DNA, 18 bp, Homo sapiens
gcctgagggaagcccacc

SEQ ID NO: 2281630 - DNA, 22 bp, Homo sapiens
gcctgagggaagcccacccgcc

SEQ ID NO: 2281631 - DNA, 15 bp, Homo sapiens
gcctgcagcccagaa

SEQ ID NO: 2281632 - DNA, 14 bp, Homo sapiens
gcctgcccccagcg

SEQ ID NO: 2281633 - DNA, 15 bp, Homo sapiens
gcctgcccgcccgcc

SEQ ID NO: 2281634 - DNA, 16 bp, Homo sapiens
gcctgcccgcccgccg

SEQ ID NO: 2281635 - DNA, 15 bp, Homo sapiens
gctcctctgcagcct

SEQ ID NO: 2281636 - DNA, 17 bp, Homo sapiens
gctcctctgcagcctga

SEQ ID NO: 2281637 - DNA, 22 bp, Homo sapiens
gctcctgaaagaaacgctagaa

SEQ ID NO: 2281638 - DNA, 14 bp, Homo sapiens
gctcctggcagtga

SEQ ID NO: 2281639 - DNA, 13 bp, Homo sapiens
gctcgggaaggcc

SEQ ID NO: 2281640 - DNA, 18 bp, Homo sapiens
gctcgggaaggcctgagg

SEQ ID NO: 2281641 - DNA, 14 bp, Homo sapiens
gctctatctgctgg

SEQ ID NO: 2281642 - DNA, 23 bp, Homo sapiens
gctctatttcggaaatacactac

SEQ ID NO: 2281643 - DNA, 17 bp, Homo sapiens
gctctcccctgcgcagg

SEQ ID NO: 2281644 - DNA, 19 bp, Homo sapiens
gctctcccctgcgcaggcc

SEQ ID NO: 2281645 - DNA, 23 bp, Homo sapiens
gctctcccctgcgcaggccctcc

SEQ ID NO: 2281646 - DNA, 19 bp, Homo sapiens
gctctcctgggccagggtc

SEQ ID NO: 2281647 - DNA, 13 bp, Homo sapiens
gctctctgtctgg

SEQ ID NO: 2281648 - DNA, 11 bp, Homo sapiens
gctctgaaggg

SEQ ID NO: 2281649 - DNA, 22 bp, Homo sapiens
gctctgaagggaggggaagaga

SEQ ID NO: 2281650 - DNA, 18 bp, Homo sapiens
gctctgagcagttgttat

SEQ ID NO: 2281651 - DNA, 14 bp, Homo sapiens
gctctgccatcagc

SEQ ID NO: 2281652 - DNA, 17 bp, Homo sapiens
gctctgccatcagcccc

SEQ ID NO: 2281653 - DNA, 18 bp, Homo sapiens
gctctgccatcagcccct

SEQ ID NO: 2281654 - DNA, 12 bp, Homo sapiens
gctctgcccctc

SEQ ID NO: 2281655 - DNA, 14 bp, Homo sapiens
gctctgcccctccg

SEQ ID NO: 2281656 - DNA, 23 bp, Homo sapiens
gctctgcccctccgtccccaggg

SEQ ID NO: 2281657 - DNA, 11 bp, Homo sapiens
gctctggcagg

SEQ ID NO: 2281658 - DNA, 17 bp, Homo sapiens
gctctggcaggtggcca

SEQ ID NO: 2281659 - DNA, 14 bp, Homo sapiens
gctctgggttcggg

SEQ ID NO: 2281660 - DNA, 16 bp, Homo sapiens
gctctgtgcactcacg

SEQ ID NO: 2281661 - DNA, 15 bp, Homo sapiens
gctcttatccccagc

SEQ ID NO: 2281662 - DNA, 17 bp, Homo sapiens
gctcttatccccagctg

SEQ ID NO: 2281663 - DNA, 17 bp, Homo sapiens
gctcttggcaggagtgg

SEQ ID NO: 2281664 - DNA, 15 bp, Homo sapiens
gctctttcaccctgc

SEQ ID NO: 2281665 - DNA, 10 bp, Homo sapiens
gctgaaagca

SEQ ID NO: 2281666 - DNA, 13 bp, Homo sapiens
gctgacagagccc

SEQ ID NO: 2281667 - DNA, 16 bp, Homo sapiens
gctgaccaggccctgc

SEQ ID NO: 2281668 - DNA, 18 bp, Homo sapiens
gctgaccaggccctgctc

SEQ ID NO: 2281669 - DNA, 14 bp, Homo sapiens
gctgactaaatttg

SEQ ID NO: 2281670 - DNA, 13 bp, Homo sapiens
gctgagcccctcc

SEQ ID NO: 2281671 - DNA, 19 bp, Homo sapiens
gctgaggacggggcagagc

SEQ ID NO: 2281672 - DNA, 16 bp, Homo sapiens
gctgaggcagggggat

SEQ ID NO: 2281673 - DNA, 20 bp, Homo sapiens
gctgagtcggctgggcaggg

SEQ ID NO: 2281674 - DNA, 16 bp, Homo sapiens
gctgagtggtccacat

SEQ ID NO: 2281675 - DNA, 15 bp, Homo sapiens
gctgatggtgcaatg

SEQ ID NO: 2281676 - DNA, 18 bp, Homo sapiens
gctgatggtgcaatgacc

SEQ ID NO: 2281677 - DNA, 14 bp, Homo sapiens
gctgatttcaaatg

SEQ ID NO: 2281678 - DNA, 18 bp, Homo sapiens
gctgatttcaaatgcagt

SEQ ID NO: 2281679 - DNA, 13 bp, Homo sapiens
gctgcccccacag

SEQ ID NO: 2281680 - DNA, 16 bp, Homo sapiens
gctgcccccaccctgc

SEQ ID NO: 2281681 - DNA, 17 bp, Homo sapiens
gctgcccccaccctgct

SEQ ID NO: 2281682 - DNA, 21 bp, Homo sapiens
gctgcccccagaccccatcca

SEQ ID NO: 2281683 - DNA, 20 bp, Homo sapiens
gctgccgtgcacggggccag

SEQ ID NO: 2281684 - DNA, 21 bp, Homo sapiens
gctgccgtgcacggggccagc

SEQ ID NO: 2281685 - DNA, 14 bp, Homo sapiens
gctgcctcctcagc

SEQ ID NO: 2281686 - DNA, 19 bp, Homo sapiens
gctgcctctgaaaatattt

SEQ ID NO: 2281687 - DNA, 12 bp, Homo sapiens
gctgcctggcgg

SEQ ID NO: 2281688 - DNA, 17 bp, Homo sapiens
gctgcctggcgggcagc

SEQ ID NO: 2281689 - DNA, 18 bp, Homo sapiens
gctgcctgtttggggagg

SEQ ID NO: 2281690 - DNA, 20 bp, Homo sapiens
gctgcctgtttggggagggg

SEQ ID NO: 2281691 - DNA, 17 bp, Homo sapiens
gctgcgcctgcccgccc

SEQ ID NO: 2281692 - DNA, 20 bp, Homo sapiens
gctgctaagtggaagacaga

SEQ ID NO: 2281693 - DNA, 16 bp, Homo sapiens
gctgctcgggaaggcc

SEQ ID NO: 2281694 - DNA, 21 bp, Homo sapiens
gctgctcgggaaggcctgagg

SEQ ID NO: 2281695 - DNA, 23 bp, Homo sapiens
gctgcttcaaggatcctgagcca

SEQ ID NO: 2281696 - DNA, 16 bp, Homo sapiens
gctgcttgagtggaca

SEQ ID NO: 2281697 - DNA, 22 bp, Homo sapiens
gctgcttgagtggacagcagct

SEQ ID NO: 2281698 - DNA, 23 bp, Homo sapiens
gctgcttgagtggacagcagctg

SEQ ID NO: 2281699 - DNA, 20 bp, Homo sapiens
gctggaatgggggccaggct

SEQ ID NO: 2281700 - DNA, 18 bp, Homo sapiens
gctggaccaactgctttg

SEQ ID NO: 2281701 - DNA, 14 bp, Homo sapiens
gctggacctggggt

SEQ ID NO: 2281702 - DNA, 15 bp, Homo sapiens
gctggacctggggtc

SEQ ID NO: 2281703 - DNA, 21 bp, Homo sapiens
gctggacctggggtcccccct

SEQ ID NO: 2281704 - DNA, 20 bp, Homo sapiens
gctggactgggtgggcccca

SEQ ID NO: 2281705 - DNA, 23 bp, Homo sapiens
gctggactgggtgggccccacag

SEQ ID NO: 2281706 - DNA, 14 bp, Homo sapiens
gctggaggaatcag

SEQ ID NO: 2281707 - DNA, 14 bp, Homo sapiens
gctggagggctggg

SEQ ID NO: 2281708 - DNA, 15 bp, Homo sapiens
gctggagggctgggc

SEQ ID NO: 2281709 - DNA, 17 bp, Homo sapiens
gctggcaaactgtgaat

SEQ ID NO: 2281710 - DNA, 14 bp, Homo sapiens
gctggcagcgcctc

SEQ ID NO: 2281711 - DNA, 23 bp, Homo sapiens
gctggcagcgcctcccgccgcct

SEQ ID NO: 2281712 - DNA, 18 bp, Homo sapiens
gctggcaggagacactgg

SEQ ID NO: 2281713 - DNA, 21 bp, Homo sapiens
gctggcaggagacactggtct

SEQ ID NO: 2281714 - DNA, 15 bp, Homo sapiens
gctggccctgccctc

SEQ ID NO: 2281715 - DNA, 21 bp, Homo sapiens
gctggccctgccctcccccac

SEQ ID NO: 2281716 - DNA, 15 bp, Homo sapiens
gctggcggccatccc

SEQ ID NO: 2281717 - DNA, 22 bp, Homo sapiens
gctgggcagagcctgtgtgaaa

SEQ ID NO: 2281718 - DNA, 21 bp, Homo sapiens
gctgggcagggccctgtggct

SEQ ID NO: 2281719 - DNA, 15 bp, Homo sapiens
gctgggcagggccgc

SEQ ID NO: 2281720 - DNA, 21 bp, Homo sapiens
gctgggcagggccgcagggcg

SEQ ID NO: 2281721 - DNA, 16 bp, Homo sapiens
gctgggccagtggacc

SEQ ID NO: 2281722 - DNA, 15 bp, Homo sapiens
gctgggtcgcccctc

SEQ ID NO: 2281723 - DNA, 15 bp, Homo sapiens
gctggtaactgttaa

SEQ ID NO: 2281724 - DNA, 23 bp, Homo sapiens
gctggtcacccccacccccgggt

SEQ ID NO: 2281725 - DNA, 21 bp, Homo sapiens
gctggtcttgaactcttggcc

SEQ ID NO: 2281726 - DNA, 17 bp, Homo sapiens
gctgtaagacggccttg

SEQ ID NO: 2281727 - DNA, 16 bp, Homo sapiens
gctgtatttttagaga

SEQ ID NO: 2281728 - DNA, 16 bp, Homo sapiens
gctgtcaattacagga

SEQ ID NO: 2281729 - DNA, 17 bp, Homo sapiens
gctgtcaattacaggaa

SEQ ID NO: 2281730 - DNA, 22 bp, Homo sapiens
gctgtcaattacaggaagtact

SEQ ID NO: 2281731 - DNA, 23 bp, Homo sapiens
gctgtcaattacaggaagtactg

SEQ ID NO: 2281732 - DNA, 15 bp, Homo sapiens
gctgtcattttatgc

SEQ ID NO: 2281733 - DNA, 21 bp, Homo sapiens
gctgtcccttacgtgagtcct

SEQ ID NO: 2281734 - DNA, 23 bp, Homo sapiens
gctgtcccttacgtgagtcctgg

SEQ ID NO: 2281735 - DNA, 16 bp, Homo sapiens
gctgtcccttttcctt

SEQ ID NO: 2281736 - DNA, 17 bp, Homo sapiens
gctgttccacttctcta

SEQ ID NO: 2281737 - DNA, 16 bp, Homo sapiens
gctgttgattccactg

SEQ ID NO: 2281738 - DNA, 21 bp, Homo sapiens
gcttaagatgctaatagaaaa

SEQ ID NO: 2281739 - DNA, 15 bp, Homo sapiens
gcttagaggagctct

SEQ ID NO: 2281740 - DNA, 13 bp, Homo sapiens
gcttagctgaaac

SEQ ID NO: 2281741 - DNA, 21 bp, Homo sapiens
gcttatcagaactcctttcta

SEQ ID NO: 2281742 - DNA, 23 bp, Homo sapiens
gcttatcagaactcctttctaag

SEQ ID NO: 2281743 - DNA, 12 bp, Homo sapiens
gcttatgttttt

SEQ ID NO: 2281744 - DNA, 22 bp, Homo sapiens
gcttatttatattcagagatgt

SEQ ID NO: 2281745 - DNA, 11 bp, Homo sapiens
gcttatttcta

SEQ ID NO: 2281746 - DNA, 19 bp, Homo sapiens
gcttcaaggatcctgagcc

SEQ ID NO: 2281747 - DNA, 20 bp, Homo sapiens
gcttcaaggatcctgagcca

SEQ ID NO: 2281748 - DNA, 22 bp, Homo sapiens
gcttcaaggatcctgagccaga

SEQ ID NO: 2281749 - DNA, 13 bp, Homo sapiens
gcttcagcccctg

SEQ ID NO: 2281750 - DNA, 14 bp, Homo sapiens
gcttcatctggagt

SEQ ID NO: 2281751 - DNA, 15 bp, Homo sapiens
gcttcatctggagtc

SEQ ID NO: 2281752 - DNA, 15 bp, Homo sapiens
gcttccagctcagtc

SEQ ID NO: 2281753 - DNA, 20 bp, Homo sapiens
gcttctctgccctgccctgg

SEQ ID NO: 2281754 - DNA, 22 bp, Homo sapiens
gcttctctgccctgccctggcc

SEQ ID NO: 2281755 - DNA, 14 bp, Homo sapiens
gcttgagtggacag

SEQ ID NO: 2281756 - DNA, 16 bp, Homo sapiens
gcttgagtggacagca

SEQ ID NO: 2281757 - DNA, 19 bp, Homo sapiens
gcttgagtggacagcagct

SEQ ID NO: 2281758 - DNA, 22 bp, Homo sapiens
gcttgagtggacagcagctgga

SEQ ID NO: 2281759 - DNA, 14 bp, Homo sapiens
gcttggctcgcacc

SEQ ID NO: 2281760 - DNA, 17 bp, Homo sapiens
gcttggctcgcaccccc

SEQ ID NO: 2281761 - DNA, 11 bp, Homo sapiens
gcttgtttcta

SEQ ID NO: 2281762 - DNA, 16 bp, Homo sapiens
gcttgtttctatactg

SEQ ID NO: 2281763 - DNA, 22 bp, Homo sapiens
gcttgtttctatactgtttgta

SEQ ID NO: 2281764 - DNA, 15 bp, Homo sapiens
gcttgtttgcctgtc

SEQ ID NO: 2281765 - DNA, 21 bp, Homo sapiens
gctttagattgaaatttatga

SEQ ID NO: 2281766 - DNA, 14 bp, Homo sapiens
gctttcacaaatat

SEQ ID NO: 2281767 - DNA, 18 bp, Homo sapiens
ggccctgggccccgcctc

SEQ ID NO: 2281768 - DNA, 12 bp, Homo sapiens
ggccctggggtc

SEQ ID NO: 2281769 - DNA, 20 bp, Homo sapiens
ggccctggggtctctgagca

SEQ ID NO: 2281770 - DNA, 15 bp, Homo sapiens
ggccctggttccccc

SEQ ID NO: 2281771 - DNA, 14 bp, Homo sapiens
ggccgacaggaggc

SEQ ID NO: 2281772 - DNA, 17 bp, Homo sapiens
ggccgacatcagcccgg

SEQ ID NO: 2281773 - DNA, 14 bp, Homo sapiens
ggccgcagggcgct

SEQ ID NO: 2281774 - DNA, 16 bp, Homo sapiens
ggccgcagggcgctcc

SEQ ID NO: 2281775 - DNA, 17 bp, Homo sapiens
ggccgcagggcgctccg

SEQ ID NO: 2281776 - DNA, 14 bp, Homo sapiens
ggccgcctcctcca

SEQ ID NO: 2281777 - DNA, 16 bp, Homo sapiens
ggccgcctcctccaga

SEQ ID NO: 2281778 - DNA, 20 bp, Homo sapiens
ggccgcctcctccagactcg

SEQ ID NO: 2281779 - DNA, 20 bp, Homo sapiens
ggccgcgcaccgccatgcat

SEQ ID NO: 2281780 - DNA, 12 bp, Homo sapiens
ggccggcctggg

SEQ ID NO: 2281781 - DNA, 23 bp, Homo sapiens
ggccggtccaccccgtcccggcc

SEQ ID NO: 2281782 - DNA, 21 bp, Homo sapiens
ggccgtccctgacttcccagc

SEQ ID NO: 2281783 - DNA, 22 bp, Homo sapiens
ggcctagtggcttcagcccctg

SEQ ID NO: 2281784 - DNA, 23 bp, Homo sapiens
ggcctagtggcttcagcccctgg

SEQ ID NO: 2281785 - DNA, 10 bp, Homo sapiens
ggcctccccg

SEQ ID NO: 2281786 - DNA, 22 bp, Homo sapiens
ggcctccccgggggtccccgga

SEQ ID NO: 2281787 - DNA, 20 bp, Homo sapiens
ggcctccctttgtgtgcata

SEQ ID NO: 2281788 - DNA, 12 bp, Homo sapiens
ggcctctggaca

SEQ ID NO: 2281789 - DNA, 24 bp, Homo sapiens
ggcctgaaatgtttccaggcatga

SEQ ID NO: 2281790 - DNA, 17 bp, Homo sapiens
ggcctgagggaagccca

SEQ ID NO: 2281791 - DNA, 18 bp, Homo sapiens
ggcctgagggaagcccac

SEQ ID NO: 2281792 - DNA, 19 bp, Homo sapiens
ggcctgagggaagcccacc

SEQ ID NO: 2281793 - DNA, 17 bp, Homo sapiens
ggcctgcagcccagaac

SEQ ID NO: 2281794 - DNA, 22 bp, Homo sapiens
ggcctggggctgccgtgcacgg

SEQ ID NO: 2281795 - DNA, 13 bp, Homo sapiens
ggcctgttccctg

SEQ ID NO: 2281796 - DNA, 21 bp, Homo sapiens
ggcctgttccctgaggacctg

SEQ ID NO: 2281797 - DNA, 21 bp, Homo sapiens
ggcctgtttggtgaggacctg

SEQ ID NO: 2281798 - DNA, 20 bp, Homo sapiens
ggccttggacggggacacgg

SEQ ID NO: 2281799 - DNA, 20 bp, Homo sapiens
ggcgcacccggcagcccccc

SEQ ID NO: 2281800 - DNA, 22 bp, Homo sapiens
ggcgcaggaaccgaggactcca

SEQ ID NO: 2281801 - DNA, 20 bp, Homo sapiens
ggcgcctgcgctcctctgca

SEQ ID NO: 2281802 - DNA, 21 bp, Homo sapiens
ggcgcctgcgctcctctgcag

SEQ ID NO: 2281803 - DNA, 20 bp, Homo sapiens
ggcgccttctacctgcagga

SEQ ID NO: 2281804 - DNA, 19 bp, Homo sapiens
ggcgcgggacaggacttgt

SEQ ID NO: 2281805 - DNA, 19 bp, Homo sapiens
ggcgctccggcagaggcag

SEQ ID NO: 2281806 - DNA, 20 bp, Homo sapiens
ggcgctccggcagaggcagg

SEQ ID NO: 2281807 - DNA, 21 bp, Homo sapiens
ggcgctccggcagaggcaggg

SEQ ID NO: 2281808 - DNA, 13 bp, Homo sapiens
ggcgctgccccca

SEQ ID NO: 2281809 - DNA, 16 bp, Homo sapiens
ggcgctgcccccacag

SEQ ID NO: 2281810 - DNA, 19 bp, Homo sapiens
ggcgctgcccccacagatc

SEQ ID NO: 2281811 - DNA, 16 bp, Homo sapiens
ggcggaggggcttgga

SEQ ID NO: 2281812 - DNA, 19 bp, Homo sapiens
ggcggaggggcttggagca

SEQ ID NO: 2281813 - DNA, 21 bp, Homo sapiens
ggcggaggttgcggtgagctg

SEQ ID NO: 2281814 - DNA, 11 bp, Homo sapiens
ggcggcagggg

SEQ ID NO: 2281815 - DNA, 19 bp, Homo sapiens
ggcggctcacaagtgaaaa

SEQ ID NO: 2281816 - DNA, 12 bp, Homo sapiens
ggcggctctggg

SEQ ID NO: 2281817 - DNA, 22 bp, Homo sapiens
ggcgggaaccctctggggccct

SEQ ID NO: 2281818 - DNA, 20 bp, Homo sapiens
ggcgggaagggtgggccctg

SEQ ID NO: 2281819 - DNA, 22 bp, Homo sapiens
ggcgggaagggtgggccctgga

SEQ ID NO: 2281820 - DNA, 11 bp, Homo sapiens
ggcgggcagcc

SEQ ID NO: 2281821 - DNA, 12 bp, Homo sapiens
ggcgggcagccc

SEQ ID NO: 2281822 - DNA, 16 bp, Homo sapiens
ggcggggccaggatgg

SEQ ID NO: 2281823 - DNA, 21 bp, Homo sapiens
ggcggggctgtgcgggcgccc

SEQ ID NO: 2281824 - DNA, 15 bp, Homo sapiens
ggcggtatccagagg

SEQ ID NO: 2281825 - DNA, 21 bp, Homo sapiens
ggcgtagggccagggctctgg

SEQ ID NO: 2281826 - DNA, 16 bp, Homo sapiens
ggctaaaaacatttta

SEQ ID NO: 2281827 - DNA, 15 bp, Homo sapiens
ggctaactggcccca

SEQ ID NO: 2281828 - DNA, 18 bp, Homo sapiens
ggctcacacctgtaatcc

SEQ ID NO: 2281829 - DNA, 19 bp, Homo sapiens
ggctcacatgctccttgcc

SEQ ID NO: 2281830 - DNA, 14 bp, Homo sapiens
ggctcattcttttc

SEQ ID NO: 2281831 - DNA, 14 bp, Homo sapiens
ggctcgcaccccca

SEQ ID NO: 2281832 - DNA, 13 bp, Homo sapiens
ggctcgctgtggt

SEQ ID NO: 2281833 - DNA, 18 bp, Homo sapiens
ggctcgctgtggtttctc

SEQ ID NO: 2281834 - DNA, 15 bp, Homo sapiens
ggctcgggtgcccag

SEQ ID NO: 2281835 - DNA, 18 bp, Homo sapiens
ggctctgcgtcccactga

SEQ ID NO: 2281836 - DNA, 23 bp, Homo sapiens
ggctctggagcccgcctgcgccc

SEQ ID NO: 2281837 - DNA, 18 bp, Homo sapiens
ggctctggcaggtggcca

SEQ ID NO: 2281838 - DNA, 18 bp, Homo sapiens
ggctctgggttcgggaag

SEQ ID NO: 2281839 - DNA, 19 bp, Homo sapiens
ggctgagcccctcctctcc

SEQ ID NO: 2281840 - DNA, 19 bp, Homo sapiens
ggctgagccgatctggtct

SEQ ID NO: 2281841 - DNA, 20 bp, Homo sapiens
ggctgaggacggggcagagc

SEQ ID NO: 2281842 - DNA, 12 bp, Homo sapiens
ggctgccctgtc

SEQ ID NO: 2281843 - DNA, 20 bp, Homo sapiens
ggctgcttagatttctagca

SEQ ID NO: 2281844 - DNA, 22 bp, Homo sapiens
ggctgcttcaaggatcctgagc

SEQ ID NO: 2281845 - DNA, 22 bp, Homo sapiens
ggctggaatgggggccaggctg

SEQ ID NO: 2281846 - DNA, 16 bp, Homo sapiens
ggctggaccaactgct

SEQ ID NO: 2281847 - DNA, 22 bp, Homo sapiens
ggctggacctggggtcccccct

SEQ ID NO: 2281848 - DNA, 20 bp, Homo sapiens
ggctggagtgaagtggtgtg

SEQ ID NO: 2281849 - DNA, 16 bp, Homo sapiens
ggctggatgtgctttc

SEQ ID NO: 2281850 - DNA, 13 bp, Homo sapiens
ggctggccctgcc

SEQ ID NO: 2281851 - DNA, 14 bp, Homo sapiens
ggctggccctgccc

SEQ ID NO: 2281852 - DNA, 15 bp, Homo sapiens
ggctggccctgccct

SEQ ID NO: 2281853 - DNA, 18 bp, Homo sapiens
ggctggcttctccctgga

SEQ ID NO: 2281854 - DNA, 14 bp, Homo sapiens
ggctggggacttcg

SEQ ID NO: 2281855 - DNA, 17 bp, Homo sapiens
ggctgggtcgcccctcc

SEQ ID NO: 2281856 - DNA, 23 bp, Homo sapiens
ggctggtcttgaactcttggcct

SEQ ID NO: 2281857 - DNA, 14 bp, Homo sapiens
ggctgtattttctt

SEQ ID NO: 2281858 - DNA, 21 bp, Homo sapiens
ggctgtcctcttaagacacta

SEQ ID NO: 2281859 - DNA, 16 bp, Homo sapiens
ggctgtgcgggcgccc

SEQ ID NO: 2281860 - DNA, 19 bp, Homo sapiens
ggcttccagctcagtccca

SEQ ID NO: 2281861 - DNA, 17 bp, Homo sapiens
ggcttcctttagagacc

SEQ ID NO: 2281862 - DNA, 20 bp, Homo sapiens
ggcttctctgccctgccctg

SEQ ID NO: 2281863 - DNA, 13 bp, Homo sapiens
ggcttcttcaact

SEQ ID NO: 2281864 - DNA, 16 bp, Homo sapiens
ggcttggagcagagac

SEQ ID NO: 2281865 - DNA, 12 bp, Homo sapiens
ggctttaaataa

SEQ ID NO: 2281866 - DNA, 18 bp, Homo sapiens
ggctttcatttcttatta

SEQ ID NO: 2281867 - DNA, 12 bp, Homo sapiens
ggctttctattg

SEQ ID NO: 2281868 - DNA, 23 bp, Homo sapiens
ggctttttccatatagtttgttt

SEQ ID NO: 2281869 - DNA, 16 bp, Homo sapiens
gggaagaatgtctcct

SEQ ID NO: 2281870 - DNA, 14 bp, Homo sapiens
gggaagagtagctg

SEQ ID NO: 2281871 - DNA, 19 bp, Homo sapiens
gggaagatggttcaaagat

SEQ ID NO: 2281872 - DNA, 21 bp, Homo sapiens
gggaagcccacccgccccaga

SEQ ID NO: 2281873 - DNA, 22 bp, Homo sapiens
gggaagcccacccgccccagag

SEQ ID NO: 2281874 - DNA, 14 bp, Homo sapiens
gggaaggcctgagg

SEQ ID NO: 2281875 - DNA, 21 bp, Homo sapiens
gggaaggcctgagggaagccc

SEQ ID NO: 2281876 - DNA, 22 bp, Homo sapiens
gggaaggcctgagggaagccca

SEQ ID NO: 2281877 - DNA, 18 bp, Homo sapiens
gggaagggtgggccctgg

SEQ ID NO: 2281878 - DNA, 16 bp, Homo sapiens
gggaatccatatcagc

SEQ ID NO: 2281879 - DNA, 14 bp, Homo sapiens
gggacacagagacc

SEQ ID NO: 2281880 - DNA, 16 bp, Homo sapiens
gggacacggcctctgg

SEQ ID NO: 2281881 - DNA, 13 bp, Homo sapiens
gggacagcggccc

SEQ ID NO: 2281882 - DNA, 22 bp, Homo sapiens
gggacagcggcccggcccacgc

SEQ ID NO: 2281883 - DNA, 22 bp, Homo sapiens
gggacaggattgtctgctgcct

SEQ ID NO: 2281884 - DNA, 18 bp, Homo sapiens
gggacccactccgactcc

SEQ ID NO: 2281885 - DNA, 20 bp, Homo sapiens
gggacggggcccgccccagg

SEQ ID NO: 2281886 - DNA, 20 bp, Homo sapiens
gggactcagttcttggcctg

SEQ ID NO: 2281887 - DNA, 23 bp, Homo sapiens
gggactgtcttcaaccctgccct

SEQ ID NO: 2281888 - DNA, 22 bp, Homo sapiens
gggacttccctagaagtcttca

SEQ ID NO: 2281889 - DNA, 18 bp, Homo sapiens
gggacttcgggggcggct

SEQ ID NO: 2281890 - DNA, 12 bp, Homo sapiens
gggagaccctgg

SEQ ID NO: 2281891 - DNA, 16 bp, Homo sapiens
gggagaccctgggaga

SEQ ID NO: 2281892 - DNA, 13 bp, Homo sapiens
gggagagcgccac

SEQ ID NO: 2281893 - DNA, 12 bp, Homo sapiens
gggagagtgagg

SEQ ID NO: 2281894 - DNA, 14 bp, Homo sapiens
gggagatccgccct

SEQ ID NO: 2281895 - DNA, 20 bp, Homo sapiens
gggagatccgccctgggctc

SEQ ID NO: 2281896 - DNA, 22 bp, Homo sapiens
gggagatccgccctgggctctg

SEQ ID NO: 2281897 - DNA, 14 bp, Homo sapiens
gggagatgctggga

SEQ ID NO: 2281898 - DNA, 18 bp, Homo sapiens
gggagcctgcgtggcctg

SEQ ID NO: 2281899 - DNA, 22 bp, Homo sapiens
ggtcacagacccctgggggagg

SEQ ID NO: 2281900 - DNA, 23 bp, Homo sapiens
ggtcagcgattcctgccaagtag

SEQ ID NO: 2281901 - DNA, 16 bp, Homo sapiens
ggtccattaatacttc

SEQ ID NO: 2281902 - DNA, 13 bp, Homo sapiens
ggtcccccctccc

SEQ ID NO: 2281903 - DNA, 21 bp, Homo sapiens
ggtcccgaatggagtccagac

SEQ ID NO: 2281904 - DNA, 15 bp, Homo sapiens
ggtcctcttcctcaa

SEQ ID NO: 2281905 - DNA, 21 bp, Homo sapiens
ggtcgcccctcctcgggcgcc

SEQ ID NO: 2281906 - DNA, 15 bp, Homo sapiens
ggtcgggggaggagc

SEQ ID NO: 2281907 - DNA, 21 bp, Homo sapiens
ggtcgggggaggagcaccccc

SEQ ID NO: 2281908 - DNA, 20 bp, Homo sapiens
ggtctctcatacctctggga

SEQ ID NO: 2281909 - DNA, 13 bp, Homo sapiens
ggtctctgagcag

SEQ ID NO: 2281910 - DNA, 19 bp, Homo sapiens
ggtctctgagcagtgggga

SEQ ID NO: 2281911 - DNA, 19 bp, Homo sapiens
ggtgcaatgacctttcaat

SEQ ID NO: 2281912 - DNA, 20 bp, Homo sapiens
ggtgcaatgacctttcaata

SEQ ID NO: 2281913 - DNA, 21 bp, Homo sapiens
ggtgcaggcgcgcaccgccca

SEQ ID NO: 2281914 - DNA, 12 bp, Homo sapiens
ggtgcccaggac

SEQ ID NO: 2281915 - DNA, 20 bp, Homo sapiens
ggtgcggaccggagcggctg

SEQ ID NO: 2281916 - DNA, 20 bp, Homo sapiens
ggtgcgtgaccggcccgcca

SEQ ID NO: 2281917 - DNA, 16 bp, Homo sapiens
ggtggaagggcaggag

SEQ ID NO: 2281918 - DNA, 22 bp, Homo sapiens
ggtggagatgtcagtctgtcca

SEQ ID NO: 2281919 - DNA, 13 bp, Homo sapiens
ggtggccagggct

SEQ ID NO: 2281920 - DNA, 21 bp, Homo sapiens
ggtgggccctggaggggccca

SEQ ID NO: 2281921 - DNA, 12 bp, Homo sapiens
ggtggtggtgca

SEQ ID NO: 2281922 - DNA, 18 bp, Homo sapiens
ggtgtccctttcacactg

SEQ ID NO: 2281923 - DNA, 17 bp, Homo sapiens
ggtgtgagccacagcac

SEQ ID NO: 2281924 - DNA, 14 bp, Homo sapiens
ggtgtgaggagggg

SEQ ID NO: 2281925 - DNA, 19 bp, Homo sapiens
ggtgtgaggaggggcggga

SEQ ID NO: 2281926 - DNA, 20 bp, Homo sapiens
ggtgtgaggcccccggaggc

SEQ ID NO: 2281927 - DNA, 16 bp, Homo sapiens
ggtgtttgcttgaatg

SEQ ID NO: 2281928 - DNA, 22 bp, Homo sapiens
ggttcaaagatacaagaaaaag

SEQ ID NO: 2281929 - DNA, 20 bp, Homo sapiens
ggttctacaggaaatacaga

SEQ ID NO: 2281930 - DNA, 13 bp, Homo sapiens
ggttgcctgaggt

SEQ ID NO: 2281931 - DNA, 22 bp, Homo sapiens
ggttgtctcagccgagcccagg

SEQ ID NO: 2281932 - DNA, 22 bp, Homo sapiens
gtaaagagatgtcaaaatgtga

SEQ ID NO: 2281933 - DNA, 20 bp, Homo sapiens
gtaaataatgattcaatgtg

SEQ ID NO: 2281934 - DNA, 19 bp, Homo sapiens
gtaaatatacagcatgaga

SEQ ID NO: 2281935 - DNA, 23 bp, Homo sapiens
gtaaatcccacgacataagctgg

SEQ ID NO: 2281936 - DNA, 20 bp, Homo sapiens
gtaaatgttatttctgcaaa

SEQ ID NO: 2281937 - DNA, 12 bp, Homo sapiens
gtaaatttaact

SEQ ID NO: 2281938 - DNA, 14 bp, Homo sapiens
gtaactattcttca

SEQ ID NO: 2281939 - DNA, 20 bp, Homo sapiens
gtaactgttaacccagtgtt

SEQ ID NO: 2281940 - DNA, 13 bp, Homo sapiens
gtaactgttcttt

SEQ ID NO: 2281941 - DNA, 16 bp, Homo sapiens
gtaactgttctttgca

SEQ ID NO: 2281942 - DNA, 18 bp, Homo sapiens
gtaactgttctttgcagt

SEQ ID NO: 2281943 - DNA, 19 bp, Homo sapiens
gtaactgttctttgcagtg

SEQ ID NO: 2281944 - DNA, 14 bp, Homo sapiens
gtaagaaatgtata

SEQ ID NO: 2281945 - DNA, 21 bp, Homo sapiens
gtaagaagcccgatccacatt

SEQ ID NO: 2281946 - DNA, 19 bp, Homo sapiens
gtaagaatcactgcactta

SEQ ID NO: 2281947 - DNA, 15 bp, Homo sapiens
gtaagacggccttgg

SEQ ID NO: 2281948 - DNA, 13 bp, Homo sapiens
gtaaggaatgatt

SEQ ID NO: 2281949 - DNA, 18 bp, Homo sapiens
gtaagggctttaaataaa

SEQ ID NO: 2281950 - DNA, 19 bp, Homo sapiens
gtaagttgaagggaaatca

SEQ ID NO: 2281951 - DNA, 22 bp, Homo sapiens
gtaagttgaagggaaatcaatt

SEQ ID NO: 2281952 - DNA, 15 bp, Homo sapiens
gtaatattacatttc

SEQ ID NO: 2281953 - DNA, 19 bp, Homo sapiens
gtaatattttgtattattg

SEQ ID NO: 2281954 - DNA, 24 bp, Homo sapiens
gtaatcatttatcttatctagcaa

SEQ ID NO: 2281955 - DNA, 12 bp, Homo sapiens
gtaatcttttct

SEQ ID NO: 2281956 - DNA, 13 bp, Homo sapiens
gtaatcttttctg

SEQ ID NO: 2281957 - DNA, 17 bp, Homo sapiens
gtaatgcactcctgccc

SEQ ID NO: 2281958 - DNA, 13 bp, Homo sapiens
gtaatggcagagc

SEQ ID NO: 2281959 - DNA, 17 bp, Homo sapiens
gtaatgtgtcaaagaga

SEQ ID NO: 2281960 - DNA, 17 bp, Homo sapiens
gtaattgttacaatttt

SEQ ID NO: 2281961 - DNA, 19 bp, Homo sapiens
gtaattttgtatcacctct

SEQ ID NO: 2281962 - DNA, 23 bp, Homo sapiens
gtacaataagcgttaagggcaga

SEQ ID NO: 2281963 - DNA, 18 bp, Homo sapiens
gtacaatcttagtgaatg

SEQ ID NO: 2281964 - DNA, 22 bp, Homo sapiens
gtacataaagtaataactgtta

SEQ ID NO: 2281965 - DNA, 16 bp, Homo sapiens
gtacatatggaaatcc

SEQ ID NO: 2281966 - DNA, 18 bp, Homo sapiens
gtacatgacccggatgaa

SEQ ID NO: 2281967 - DNA, 23 bp, Homo sapiens
gtacatttgatttgatatacaga

SEQ ID NO: 2281968 - DNA, 16 bp, Homo sapiens
gtaccatatgtagcat

SEQ ID NO: 2281969 - DNA, 13 bp, Homo sapiens
gtaccatcccact

SEQ ID NO: 2281970 - DNA, 19 bp, Homo sapiens
gtaccatcccactgatatc

SEQ ID NO: 2281971 - DNA, 19 bp, Homo sapiens
gtaccatgttgcccagaat

SEQ ID NO: 2281972 - DNA, 18 bp, Homo sapiens
gtactgtatagacagttt

SEQ ID NO: 2281973 - DNA, 11 bp, Homo sapiens
gtactgtattg

SEQ ID NO: 2281974 - DNA, 12 bp, Homo sapiens
gtactgtattgg

SEQ ID NO: 2281975 - DNA, 14 bp, Homo sapiens
gtactgtgtactgt

SEQ ID NO: 2281976 - DNA, 19 bp, Homo sapiens
gtacttacactgaaatcca

SEQ ID NO: 2281977 - DNA, 20 bp, Homo sapiens
gtacttacactgaaatccaa

SEQ ID NO: 2281978 - DNA, 16 bp, Homo sapiens
gtactttcacatctct

SEQ ID NO: 2281979 - DNA, 12 bp, Homo sapiens
gtacttttccat

SEQ ID NO: 2281980 - DNA, 16 bp, Homo sapiens
gtagaaaaaaaaataa

SEQ ID NO: 2281981 - DNA, 23 bp, Homo sapiens
gtagaggctttatgttgcaatta

SEQ ID NO: 2281982 - DNA, 23 bp, Homo sapiens
gtagatacaggggcaaaagtcat

SEQ ID NO: 2281983 - DNA, 16 bp, Homo sapiens
gtagcattaaatataa

SEQ ID NO: 2281984 - DNA, 17 bp, Homo sapiens
gtagctacaagggaagc

SEQ ID NO: 2281985 - DNA, 14 bp, Homo sapiens
gtagctgccacttg

SEQ ID NO: 2281986 - DNA, 20 bp, Homo sapiens
gtagctgggactagaggcac

SEQ ID NO: 2281987 - DNA, 16 bp, Homo sapiens
gtaggctaaaaacatt

SEQ ID NO: 2281988 - DNA, 13 bp, Homo sapiens
gtaggctggttta

SEQ ID NO: 2281989 - DNA, 17 bp, Homo sapiens
gtaggctgtattttctt

SEQ ID NO: 2281990 - DNA, 19 bp, Homo sapiens
gtaggctgtattttctttt

SEQ ID NO: 2281991 - DNA, 17 bp, Homo sapiens
gtagggccagggctctg

SEQ ID NO: 2281992 - DNA, 19 bp, Homo sapiens
gtagtgttgggtggaggat

SEQ ID NO: 2281993 - DNA, 22 bp, Homo sapiens
gtagttgatgaccaatctctgt

SEQ ID NO: 2281994 - DNA, 18 bp, Homo sapiens
gtataacaagccaaacat

SEQ ID NO: 2281995 - DNA, 15 bp, Homo sapiens
gtataccgtgtgctc

SEQ ID NO: 2281996 - DNA, 22 bp, Homo sapiens
gtatactatgtaagggctttaa

SEQ ID NO: 2281997 - DNA, 17 bp, Homo sapiens
gtatactccatagaaac

SEQ ID NO: 2281998 - DNA, 15 bp, Homo sapiens
gtatagacagtttgt

SEQ ID NO: 2281999 - DNA, 12 bp, Homo sapiens
gtatagctttaa

SEQ ID NO: 2282000 - DNA, 12 bp, Homo sapiens
gtataggacaag

SEQ ID NO: 2282001 - DNA, 23 bp, Homo sapiens
gtatagttcacttactcttacac

SEQ ID NO: 2282002 - DNA, 14 bp, Homo sapiens
gtatatcagctcta

SEQ ID NO: 2282003 - DNA, 13 bp, Homo sapiens
gtatccagaggtg

SEQ ID NO: 2282004 - DNA, 14 bp, Homo sapiens
gtatccagaggtga

SEQ ID NO: 2282005 - DNA, 21 bp, Homo sapiens
gtatctgctgcctctgaaaat

SEQ ID NO: 2282006 - DNA, 16 bp, Homo sapiens
gtatcttatttatata

SEQ ID NO: 2282007 - DNA, 18 bp, Homo sapiens
gtatcttatttatatatg

SEQ ID NO: 2282008 - DNA, 20 bp, Homo sapiens
gtatgcaagaagaatataaa

SEQ ID NO: 2282009 - DNA, 12 bp, Homo sapiens
gtattattgctg

SEQ ID NO: 2282010 - DNA, 13 bp, Homo sapiens
gtattcaggaccc

SEQ ID NO: 2282011 - DNA, 17 bp, Homo sapiens
gtattcttttatataac

SEQ ID NO: 2282012 - DNA, 13 bp, Homo sapiens
gtatttatattag

SEQ ID NO: 2282013 - DNA, 22 bp, Homo sapiens
gtatttccaacaaacttactgt

SEQ ID NO: 2282014 - DNA, 19 bp, Homo sapiens
gtatttcttatttgaaagt

SEQ ID NO: 2282015 - DNA, 16 bp, Homo sapiens
gtattttcttcccatt

SEQ ID NO: 2282016 - DNA, 17 bp, Homo sapiens
gtcaaaaatatttttat

SEQ ID NO: 2282017 - DNA, 22 bp, Homo sapiens
gtcaaaaatatttttatgtgaa

SEQ ID NO: 2282018 - DNA, 11 bp, Homo sapiens
gtcaaagcttt

SEQ ID NO: 2282019 - DNA, 15 bp, Homo sapiens
gtcaactgctgtttt

SEQ ID NO: 2282020 - DNA, 19 bp, Homo sapiens
gtcaactgctgttttatgt

SEQ ID NO: 2282021 - DNA, 17 bp, Homo sapiens
gtcaatgaaatatttgc

SEQ ID NO: 2282022 - DNA, 21 bp, Homo sapiens
gtcaatgaaatatttgcttat

SEQ ID NO: 2282023 - DNA, 20 bp, Homo sapiens
gtcaatgaggttatgagaaa

SEQ ID NO: 2282024 - DNA, 20 bp, Homo sapiens
gtcaatgtgaaataaagagt

SEQ ID NO: 2282025 - DNA, 18 bp, Homo sapiens
gtcaattcattaataaaa

SEQ ID NO: 2282026 - DNA, 21 bp, Homo sapiens
gtcacaccctccccattagta

SEQ ID NO: 2282027 - DNA, 20 bp, Homo sapiens
gtcacagaatctccatttct

SEQ ID NO: 2282028 - DNA, 14 bp, Homo sapiens
gtcacagacccctg

SEQ ID NO: 2282029 - DNA, 15 bp, Homo sapiens
gtcacagacccctgg

SEQ ID NO: 2282030 - DNA, 16 bp, Homo sapiens
gtcacctcactcagca

SEQ ID NO: 2282031 - DNA, 19 bp, Homo sapiens
gtgctccagtgttttcttg

SEQ ID NO: 2282032 - DNA, 16 bp, Homo sapiens
gtgctcctgaaagaaa

SEQ ID NO: 2282033 - DNA, 17 bp, Homo sapiens
gtgctcttctgttctca

SEQ ID NO: 2282034 - DNA, 18 bp, Homo sapiens
gtgctgaacgacagtccc

SEQ ID NO: 2282035 - DNA, 20 bp, Homo sapiens
gtgctgggattacaggtgtg

SEQ ID NO: 2282036 - DNA, 19 bp, Homo sapiens
gtgctttcatgtttaagaa

SEQ ID NO: 2282037 - DNA, 14 bp, Homo sapiens
gtgctttgcccttg

SEQ ID NO: 2282038 - DNA, 19 bp, Homo sapiens
gtggaaatatgcaacctgt

SEQ ID NO: 2282039 - DNA, 13 bp, Homo sapiens
gtggaagggcagg

SEQ ID NO: 2282040 - DNA, 23 bp, Homo sapiens
gtggaatttcttgtttctccaga

SEQ ID NO: 2282041 - DNA, 15 bp, Homo sapiens
gtggacagcagctgg

SEQ ID NO: 2282042 - DNA, 20 bp, Homo sapiens
gtggacagcagctggactgg

SEQ ID NO: 2282043 - DNA, 13 bp, Homo sapiens
gtggacccagctg

SEQ ID NO: 2282044 - DNA, 19 bp, Homo sapiens
gtggacccgcccgcggccc

SEQ ID NO: 2282045 - DNA, 16 bp, Homo sapiens
gtggactcgcgagagg

SEQ ID NO: 2282046 - DNA, 18 bp, Homo sapiens
gtggactgggaagcatta

SEQ ID NO: 2282047 - DNA, 13 bp, Homo sapiens
gtggagaccacac

SEQ ID NO: 2282048 - DNA, 15 bp, Homo sapiens
gtggagctcagagga

SEQ ID NO: 2282049 - DNA, 13 bp, Homo sapiens
gtggatatattta

SEQ ID NO: 2282050 - DNA, 12 bp, Homo sapiens
gtggatgctctt

SEQ ID NO: 2282051 - DNA, 14 bp, Homo sapiens
gtggcatggtcctg

SEQ ID NO: 2282052 - DNA, 23 bp, Homo sapiens
gtggccccacccaggcaggggct

SEQ ID NO: 2282053 - DNA, 16 bp, Homo sapiens
gtggcctcattcagca

SEQ ID NO: 2282054 - DNA, 19 bp, Homo sapiens
gtggcgggaagggtgggcc

SEQ ID NO: 2282055 - DNA, 21 bp, Homo sapiens
gtggcgggaagggtgggccct

SEQ ID NO: 2282056 - DNA, 19 bp, Homo sapiens
gtggctgaccaggccctgc

SEQ ID NO: 2282057 - DNA, 12 bp, Homo sapiens
gtggctgcttca

SEQ ID NO: 2282058 - DNA, 15 bp, Homo sapiens
gtggcttcagcccct

SEQ ID NO: 2282059 - DNA, 13 bp, Homo sapiens
gtggcttcttcaa

SEQ ID NO: 2282060 - DNA, 20 bp, Homo sapiens
gtggcttggagcagaggtgg

SEQ ID NO: 2282061 - DNA, 14 bp, Homo sapiens
gtgggacacagaga

SEQ ID NO: 2282062 - DNA, 15 bp, Homo sapiens
gtgggacacagagac

SEQ ID NO: 2282063 - DNA, 12 bp, Homo sapiens
gtgggagggggc

SEQ ID NO: 2282064 - DNA, 16 bp, Homo sapiens
gtgggagggggcaggg

SEQ ID NO: 2282065 - DNA, 13 bp, Homo sapiens
gtgggccccacag

SEQ ID NO: 2282066 - DNA, 15 bp, Homo sapiens
gtgggccccacagtg

SEQ ID NO: 2282067 - DNA, 18 bp, Homo sapiens
gtgggccccacagtggtc

SEQ ID NO: 2282068 - DNA, 15 bp, Homo sapiens
gtggggagcgggggc

SEQ ID NO: 2282069 - DNA, 12 bp, Homo sapiens
gtggggaggaga

SEQ ID NO: 2282070 - DNA, 18 bp, Homo sapiens
gtggggagggcctctgga

SEQ ID NO: 2282071 - DNA, 19 bp, Homo sapiens
gtggggcccatggccccag

SEQ ID NO: 2282072 - DNA, 20 bp, Homo sapiens
gtggggcccatggccccagc

SEQ ID NO: 2282073 - DNA, 21 bp, Homo sapiens
gtgggtatttcttatttgaaa

SEQ ID NO: 2282074 - DNA, 19 bp, Homo sapiens
gtggtccacattctgctgc

SEQ ID NO: 2282075 - DNA, 22 bp, Homo sapiens
gtggtccacattctgctgcccc

SEQ ID NO: 2282076 - DNA, 15 bp, Homo sapiens
gtggtgcagtaacca

SEQ ID NO: 2282077 - DNA, 15 bp, Homo sapiens
gtggtgtgaggcccc

SEQ ID NO: 2282078 - DNA, 17 bp, Homo sapiens
gtgtaaatgtggacaca

SEQ ID NO: 2282079 - DNA, 12 bp, Homo sapiens
gtgtaactgttc

SEQ ID NO: 2282080 - DNA, 16 bp, Homo sapiens
gtgtaatctctgatta

SEQ ID NO: 2282081 - DNA, 20 bp, Homo sapiens
gtgtacagaaacaactgcca

SEQ ID NO: 2282082 - DNA, 14 bp, Homo sapiens
gtgtatgatccaag

SEQ ID NO: 2282083 - DNA, 14 bp, Homo sapiens
gtgtattcaggacc

SEQ ID NO: 2282084 - DNA, 22 bp, Homo sapiens
gtgtatttctattttgcagcag

SEQ ID NO: 2282085 - DNA, 23 bp, Homo sapiens
gtgtatttctattttgcagcagt

SEQ ID NO: 2282086 - DNA, 17 bp, Homo sapiens
gtgtcactaagaatata

SEQ ID NO: 2282087 - DNA, 16 bp, Homo sapiens
gtgtctatgaactaga

SEQ ID NO: 2282088 - DNA, 22 bp, Homo sapiens
gtgtctatgaactagagactct

SEQ ID NO: 2282089 - DNA, 13 bp, Homo sapiens
gtgtctgcacagg

SEQ ID NO: 2282090 - DNA, 14 bp, Homo sapiens
gtgtgaatgcacgt

SEQ ID NO: 2282091 - DNA, 20 bp, Homo sapiens
gtgtgacctgacacctgccg

SEQ ID NO: 2282092 - DNA, 15 bp, Homo sapiens
gtgtgagccacagca

SEQ ID NO: 2282093 - DNA, 12 bp, Homo sapiens
gtgtgaggaggg

SEQ ID NO: 2282094 - DNA, 18 bp, Homo sapiens
gtgtgaggaggggcggga

SEQ ID NO: 2282095 - DNA, 19 bp, Homo sapiens
gtgtgatcccagctcactg

SEQ ID NO: 2282096 - DNA, 22 bp, Homo sapiens
gtgtgctcttatccccagctgt

SEQ ID NO: 2282097 - DNA, 12 bp, Homo sapiens
gtgtggagctgc

SEQ ID NO: 2282098 - DNA, 16 bp, Homo sapiens
gtgtgtttcttgcttt

SEQ ID NO: 2282099 - DNA, 18 bp, Homo sapiens
gtgttatgactccagaat

SEQ ID NO: 2282100 - DNA, 18 bp, Homo sapiens
gtgttattttctttgaaa

SEQ ID NO: 2282101 - DNA, 13 bp, Homo sapiens
gtgttctcagagg

SEQ ID NO: 2282102 - DNA, 16 bp, Homo sapiens
gtgttcttaaaatatt

SEQ ID NO: 2282103 - DNA, 18 bp, Homo sapiens
gtgttcttaaaatattgt

SEQ ID NO: 2282104 - DNA, 12 bp, Homo sapiens
gtgttgaggagg

SEQ ID NO: 2282105 - DNA, 17 bp, Homo sapiens
gtgttgaggaggggagc

SEQ ID NO: 2282106 - DNA, 12 bp, Homo sapiens
gtgttgcaaatt

SEQ ID NO: 2282107 - DNA, 21 bp, Homo sapiens
gtgttgcaaattattctagtc

SEQ ID NO: 2282108 - DNA, 21 bp, Homo sapiens
gtgttggctctgctggtcact

SEQ ID NO: 2282109 - DNA, 13 bp, Homo sapiens
gtgtttattgtca

SEQ ID NO: 2282110 - DNA, 14 bp, Homo sapiens
gtgtttcttgcttt

SEQ ID NO: 2282111 - DNA, 15 bp, Homo sapiens
gtgtttgagtttctg

SEQ ID NO: 2282112 - DNA, 17 bp, Homo sapiens
gtgtttgcttgaatgct

SEQ ID NO: 2282113 - DNA, 16 bp, Homo sapiens
gttaaatgctatggaa

SEQ ID NO: 2282114 - DNA, 17 bp, Homo sapiens
gttaaatgctatggaaa

SEQ ID NO: 2282115 - DNA, 15 bp, Homo sapiens
gttaacccagtgttc

SEQ ID NO: 2282116 - DNA, 12 bp, Homo sapiens
gttaagggcaga

SEQ ID NO: 2282117 - DNA, 14 bp, Homo sapiens
gttaatgtgccaaa

SEQ ID NO: 2282118 - DNA, 23 bp, Homo sapiens
gttacaacattaattttatgaac

SEQ ID NO: 2282119 - DNA, 15 bp, Homo sapiens
gttacagacaaagcg

SEQ ID NO: 2282120 - DNA, 17 bp, Homo sapiens
gttacagacaaagcgtg

SEQ ID NO: 2282121 - DNA, 18 bp, Homo sapiens
gttaccttttataagaca

SEQ ID NO: 2282122 - DNA, 16 bp, Homo sapiens
gttagcattattgcca

SEQ ID NO: 2282123 - DNA, 15 bp, Homo sapiens
gttagggcatttttc

SEQ ID NO: 2282124 - DNA, 15 bp, Homo sapiens
gttatatcatcaata

SEQ ID NO: 2282125 - DNA, 12 bp, Homo sapiens
gttatattcatt

SEQ ID NO: 2282126 - DNA, 23 bp, Homo sapiens
gttatcagggcccaaataacagt

SEQ ID NO: 2282127 - DNA, 21 bp, Homo sapiens
gttatgactccagaatttccc

SEQ ID NO: 2282128 - DNA, 13 bp, Homo sapiens
gttattatgggat

SEQ ID NO: 2282129 - DNA, 13 bp, Homo sapiens
gttcagcatagag

SEQ ID NO: 2282130 - DNA, 14 bp, Homo sapiens
gttcagtcctctgc

SEQ ID NO: 2282131 - DNA, 15 bp, Homo sapiens
gttcagtcctctgca

SEQ ID NO: 2282132 - DNA, 15 bp, Homo sapiens
gttcataaaaaataa

SEQ ID NO: 2282133 - DNA, 18 bp, Homo sapiens
gttcatcttgaattgtaa

SEQ ID NO: 2282134 - DNA, 14 bp, Homo sapiens
gttccacttctcta

SEQ ID NO: 2282135 - DNA, 15 bp, Homo sapiens
gttccagtttcagag

SEQ ID NO: 2282136 - DNA, 20 bp, Homo sapiens
gttcccccaggaccctgagg

SEQ ID NO: 2282137 - DNA, 13 bp, Homo sapiens
gttcgctggctga

SEQ ID NO: 2282138 - DNA, 23 bp, Homo sapiens
gttcgggggaaatagttccattc

SEQ ID NO: 2282139 - DNA, 14 bp, Homo sapiens
gttctatttctatc

SEQ ID NO: 2282140 - DNA, 22 bp, Homo sapiens
gttctatttctatctgcaaata

SEQ ID NO: 2282141 - DNA, 16 bp, Homo sapiens
gttctcatgaaggaga

SEQ ID NO: 2282142 - DNA, 22 bp, Homo sapiens
gttctctacctaatatgttctg

SEQ ID NO: 2282143 - DNA, 16 bp, Homo sapiens
gttctgcaataacagt

SEQ ID NO: 2282144 - DNA, 20 bp, Homo sapiens
gttctgcaataacagtttta

SEQ ID NO: 2282145 - DNA, 18 bp, Homo sapiens
gttctgtgtaaacagaag

SEQ ID NO: 2282146 - DNA, 15 bp, Homo sapiens
gttctgtgtctgctg

SEQ ID NO: 2282147 - DNA, 15 bp, Homo sapiens
gttctttgcagtgaa

SEQ ID NO: 2282148 - DNA, 16 bp, Homo sapiens
gttgaagggaaatcaa

SEQ ID NO: 2282149 - DNA, 13 bp, Homo sapiens
gttgaccaggctg

SEQ ID NO: 2282150 - DNA, 15 bp, Homo sapiens
gttgaccaggctgga

SEQ ID NO: 2282151 - DNA, 18 bp, Homo sapiens
gttgagtgggtatttctt

SEQ ID NO: 2282152 - DNA, 12 bp, Homo sapiens
gttgatgaccaa

SEQ ID NO: 2282153 - DNA, 18 bp, Homo sapiens
gttgcaatgatcagactt

SEQ ID NO: 2282154 - DNA, 14 bp, Homo sapiens
gttgcccaggctgg

SEQ ID NO: 2282155 - DNA, 21 bp, Homo sapiens
gttgctaacctcaatttatgt

SEQ ID NO: 2282156 - DNA, 22 bp, Homo sapiens
gttggaatgttgttaaatgcta

SEQ ID NO: 2282157 - DNA, 15 bp, Homo sapiens
gttggactgtggcct

SEQ ID NO: 2282158 - DNA, 16 bp, Homo sapiens
gttggagctagaaaat

SEQ ID NO: 2282159 - DNA, 11 bp, Homo sapiens
gttggcacaga

SEQ ID NO: 2282160 - DNA, 20 bp, Homo sapiens
gttggccggctggccggtcc

SEQ ID NO: 2282161 - DNA, 21 bp, Homo sapiens
gttggccggctggccggtcca

SEQ ID NO: 2282162 - DNA, 20 bp, Homo sapiens
gttggggggccccacggaga

SEQ ID NO: 2282163 - DNA, 13 bp, Homo sapiens
gttgggtggagga

SEQ ID NO: 2282164 - DNA, 15 bp, Homo sapiens
gttgtctgtcctggt

SEQ ID NO: 2282165 - DNA, 18 bp, Homo sapiens
tacaagcatcatggatca

SEQ ID NO: 2282166 - DNA, 23 bp, Homo sapiens
tacaataagcgttaagggcagag

SEQ ID NO: 2282167 - DNA, 14 bp, Homo sapiens
tacaatgatgtaaa

SEQ ID NO: 2282168 - DNA, 16 bp, Homo sapiens
tacaatgatgtaaata

SEQ ID NO: 2282169 - DNA, 22 bp, Homo sapiens
tacaattcagttttagtttcaa

SEQ ID NO: 2282170 - DNA, 19 bp, Homo sapiens
tacactgcaatcatatgtg

SEQ ID NO: 2282171 - DNA, 20 bp, Homo sapiens
tacactgcaatcatatgtga

SEQ ID NO: 2282172 - DNA, 21 bp, Homo sapiens
tacactgcaatcatatgtgat

SEQ ID NO: 2282173 - DNA, 23 bp, Homo sapiens
tacactgtatctaaaaaataact

SEQ ID NO: 2282174 - DNA, 16 bp, Homo sapiens
tacagaaacaactgcc

SEQ ID NO: 2282175 - DNA, 14 bp, Homo sapiens
tacagatttagttt

SEQ ID NO: 2282176 - DNA, 19 bp, Homo sapiens
tacagatttagtttaccaa

SEQ ID NO: 2282177 - DNA, 20 bp, Homo sapiens
tacagcaaataaaacagtga

SEQ ID NO: 2282178 - DNA, 20 bp, Homo sapiens
tacagcatgagattgtacat

SEQ ID NO: 2282179 - DNA, 22 bp, Homo sapiens
tacagcatgagattgtacattt

SEQ ID NO: 2282180 - DNA, 23 bp, Homo sapiens
tacagcatgagattgtacatttt

SEQ ID NO: 2282181 - DNA, 13 bp, Homo sapiens
tacaggtgtacta

SEQ ID NO: 2282182 - DNA, 16 bp, Homo sapiens
tacaggtgtgagccac

SEQ ID NO: 2282183 - DNA, 23 bp, Homo sapiens
tacaggtgtgagccacagcactc

SEQ ID NO: 2282184 - DNA, 12 bp, Homo sapiens
tacaggttcctt

SEQ ID NO: 2282185 - DNA, 17 bp, Homo sapiens
tacagttatacatacct

SEQ ID NO: 2282186 - DNA, 12 bp, Homo sapiens
tacataaaagaa

SEQ ID NO: 2282187 - DNA, 17 bp, Homo sapiens
tacataaaagaatgtac

SEQ ID NO: 2282188 - DNA, 19 bp, Homo sapiens
tacataaaagaatgtacag

SEQ ID NO: 2282189 - DNA, 20 bp, Homo sapiens
tacataaagtaataactgtt

SEQ ID NO: 2282190 - DNA, 12 bp, Homo sapiens
tacataaattgg

SEQ ID NO: 2282191 - DNA, 15 bp, Homo sapiens
tacataattaaattt

SEQ ID NO: 2282192 - DNA, 18 bp, Homo sapiens
tacatatggaaatcctgt

SEQ ID NO: 2282193 - DNA, 19 bp, Homo sapiens
tacatatggaaatcctgtt

SEQ ID NO: 2282194 - DNA, 15 bp, Homo sapiens
tacatctaagtcagt

SEQ ID NO: 2282195 - DNA, 17 bp, Homo sapiens
tacatctaagtcagttt

SEQ ID NO: 2282196 - DNA, 21 bp, Homo sapiens
tacatctaagtcagtttcaca

SEQ ID NO: 2282197 - DNA, 12 bp, Homo sapiens
tacatctgaaat

SEQ ID NO: 2282198 - DNA, 14 bp, Homo sapiens
tacatctgaaatct

SEQ ID NO: 2282199 - DNA, 22 bp, Homo sapiens
tacatctgaaatctacaacata

SEQ ID NO: 2282200 - DNA, 17 bp, Homo sapiens
tacatgacccggatgaa

SEQ ID NO: 2282201 - DNA, 22 bp, Homo sapiens
tacatgttgtattagtaaatta

SEQ ID NO: 2282202 - DNA, 16 bp, Homo sapiens
tacattaaaagcttta

SEQ ID NO: 2282203 - DNA, 20 bp, Homo sapiens
tacattaaaagctttagatt

SEQ ID NO: 2282204 - DNA, 12 bp, Homo sapiens
tacattgtgttt

SEQ ID NO: 2282205 - DNA, 17 bp, Homo sapiens
tacatttttttaaacaa

SEQ ID NO: 2282206 - DNA, 20 bp, Homo sapiens
taccaaaaaaattacagttt

SEQ ID NO: 2282207 - DNA, 17 bp, Homo sapiens
taccaaatataaacttg

SEQ ID NO: 2282208 - DNA, 16 bp, Homo sapiens
taccaactaagttgta

SEQ ID NO: 2282209 - DNA, 15 bp, Homo sapiens
taccaactatttcaa

SEQ ID NO: 2282210 - DNA, 20 bp, Homo sapiens
taccaatcaacagcatgtct

SEQ ID NO: 2282211 - DNA, 13 bp, Homo sapiens
taccatatgtagc

SEQ ID NO: 2282212 - DNA, 17 bp, Homo sapiens
taccatatgtagcatta

SEQ ID NO: 2282213 - DNA, 18 bp, Homo sapiens
taccatatgtagcattaa

SEQ ID NO: 2282214 - DNA, 22 bp, Homo sapiens
taccatatgtagcattaaatat

SEQ ID NO: 2282215 - DNA, 14 bp, Homo sapiens
taccatgttaaaga

SEQ ID NO: 2282216 - DNA, 13 bp, Homo sapiens
tacctcgcagtgt

SEQ ID NO: 2282217 - DNA, 14 bp, Homo sapiens
tacctgaagtcttt

SEQ ID NO: 2282218 - DNA, 19 bp, Homo sapiens
taccttgtgtactttcttc

SEQ ID NO: 2282219 - DNA, 21 bp, Homo sapiens
taccttgtgtactttcttccc

SEQ ID NO: 2282220 - DNA, 15 bp, Homo sapiens
taccttttataagac

SEQ ID NO: 2282221 - DNA, 21 bp, Homo sapiens
tacggctatctagttgtctga

SEQ ID NO: 2282222 - DNA, 21 bp, Homo sapiens
tacgtaaaggtgcagttgctc

SEQ ID NO: 2282223 - DNA, 14 bp, Homo sapiens
tactaaccatttct

SEQ ID NO: 2282224 - DNA, 16 bp, Homo sapiens
tactaaccatttctta

SEQ ID NO: 2282225 - DNA, 16 bp, Homo sapiens
tactaagaataaataa

SEQ ID NO: 2282226 - DNA, 23 bp, Homo sapiens
tactatggctgtatttttagaga

SEQ ID NO: 2282227 - DNA, 13 bp, Homo sapiens
tactatttagata

SEQ ID NO: 2282228 - DNA, 21 bp, Homo sapiens
tactatttagataacaagaat

SEQ ID NO: 2282229 - DNA, 15 bp, Homo sapiens
tactcaaagaggcca

SEQ ID NO: 2282230 - DNA, 16 bp, Homo sapiens
tactccaaaaagaaat

SEQ ID NO: 2282231 - DNA, 13 bp, Homo sapiens
tactgccaacctc

SEQ ID NO: 2282232 - DNA, 20 bp, Homo sapiens
tactgccgctgcccccaccc

SEQ ID NO: 2282233 - DNA, 15 bp, Homo sapiens
tactggaaataacct

SEQ ID NO: 2282234 - DNA, 14 bp, Homo sapiens
tactggaattcaaa

SEQ ID NO: 2282235 - DNA, 22 bp, Homo sapiens
tactgggtaaaagcagggcagc

SEQ ID NO: 2282236 - DNA, 13 bp, Homo sapiens
tactggttatagt

SEQ ID NO: 2282237 - DNA, 16 bp, Homo sapiens
tactgtagcaatatat

SEQ ID NO: 2282238 - DNA, 18 bp, Homo sapiens
tactgtagcaatatattt

SEQ ID NO: 2282239 - DNA, 19 bp, Homo sapiens
tactgtagcaatatatttg

SEQ ID NO: 2282240 - DNA, 23 bp, Homo sapiens
tactgtagcaatatatttgtagg

SEQ ID NO: 2282241 - DNA, 12 bp, Homo sapiens
tactgtgtactg

SEQ ID NO: 2282242 - DNA, 15 bp, Homo sapiens
tactgtgtactgtat

SEQ ID NO: 2282243 - DNA, 17 bp, Homo sapiens
tactgtttgtaatatac

SEQ ID NO: 2282244 - DNA, 19 bp, Homo sapiens
tactgtttgtaatatacag

SEQ ID NO: 2282245 - DNA, 21 bp, Homo sapiens
tacttaaatagcatctgctct

SEQ ID NO: 2282246 - DNA, 22 bp, Homo sapiens
tacttacactgaaatccaaaat

SEQ ID NO: 2282247 - DNA, 17 bp, Homo sapiens
tacttcactttcatctg

SEQ ID NO: 2282248 - DNA, 19 bp, Homo sapiens
tactttcagaatattttca

SEQ ID NO: 2282249 - DNA, 20 bp, Homo sapiens
tactttcagaatattttcaa

SEQ ID NO: 2282250 - DNA, 13 bp, Homo sapiens
tactttctcacat

SEQ ID NO: 2282251 - DNA, 22 bp, Homo sapiens
tacttttccatttatttattca

SEQ ID NO: 2282252 - DNA, 15 bp, Homo sapiens
tacttttggggagga

SEQ ID NO: 2282253 - DNA, 18 bp, Homo sapiens
tacttttgtgtattctgt

SEQ ID NO: 2282254 - DNA, 18 bp, Homo sapiens
tactttttcttttgtaag

SEQ ID NO: 2282255 - DNA, 16 bp, Homo sapiens
tacttttttaaaattg

SEQ ID NO: 2282256 - DNA, 20 bp, Homo sapiens
tagaaaaggtccaaaactgt

SEQ ID NO: 2282257 - DNA, 23 bp, Homo sapiens
tagaaaatgaactgtatattatt

SEQ ID NO: 2282258 - DNA, 17 bp, Homo sapiens
tagaacaagccagagcc

SEQ ID NO: 2282259 - DNA, 16 bp, Homo sapiens
tagaacatagatgcta

SEQ ID NO: 2282260 - DNA, 17 bp, Homo sapiens
tagaacctgcatttaag

SEQ ID NO: 2282261 - DNA, 19 bp, Homo sapiens
tagaacctgcatttaagaa

SEQ ID NO: 2282262 - DNA, 20 bp, Homo sapiens
tagaactgtcccacaaaata

SEQ ID NO: 2282263 - DNA, 12 bp, Homo sapiens
tagaactgttca

SEQ ID NO: 2282264 - DNA, 14 bp, Homo sapiens
tagaagatgaatca

SEQ ID NO: 2282265 - DNA, 22 bp, Homo sapiens
tagaaggcgtgggggacaagaa

SEQ ID NO: 2282266 - DNA, 12 bp, Homo sapiens
tagaatatataa

SEQ ID NO: 2282267 - DNA, 16 bp, Homo sapiens
tagaatctattttcta

SEQ ID NO: 2282268 - DNA, 22 bp, Homo sapiens
tagaatctattttctatgtact

SEQ ID NO: 2282269 - DNA, 13 bp, Homo sapiens
tagaatgagaaat

SEQ ID NO: 2282270 - DNA, 14 bp, Homo sapiens
tagacaaaatcagt

SEQ ID NO: 2282271 - DNA, 13 bp, Homo sapiens
tagacaaccatag

SEQ ID NO: 2282272 - DNA, 17 bp, Homo sapiens
tagacagttagagactc

SEQ ID NO: 2282273 - DNA, 15 bp, Homo sapiens
tagacagtttgtaaa

SEQ ID NO: 2282274 - DNA, 21 bp, Homo sapiens
tagactcaaggaagaataatt

SEQ ID NO: 2282275 - DNA, 13 bp, Homo sapiens
tagactgaattta

SEQ ID NO: 2282276 - DNA, 16 bp, Homo sapiens
tagactgaatttaact

SEQ ID NO: 2282277 - DNA, 19 bp, Homo sapiens
tagacttcgaaaacagatg

SEQ ID NO: 2282278 - DNA, 21 bp, Homo sapiens
tagacttcgaaaacagatgag

SEQ ID NO: 2282279 - DNA, 19 bp, Homo sapiens
tagactttaattcttctct

SEQ ID NO: 2282280 - DNA, 20 bp, Homo sapiens
tagactttaattcttctctt

SEQ ID NO: 2282281 - DNA, 14 bp, Homo sapiens
tagagactctgtga

SEQ ID NO: 2282282 - DNA, 15 bp, Homo sapiens
tagagactctgtgat

SEQ ID NO: 2282283 - DNA, 15 bp, Homo sapiens
tagagataaatattt

SEQ ID NO: 2282284 - DNA, 14 bp, Homo sapiens
tagagcacatttag

SEQ ID NO: 2282285 - DNA, 21 bp, Homo sapiens
tagaggacacggaccctgtgt

SEQ ID NO: 2282286 - DNA, 22 bp, Homo sapiens
tagagtgagtttccagctgctc

SEQ ID NO: 2282287 - DNA, 20 bp, Homo sapiens
tagagtgcccttaaaataat

SEQ ID NO: 2282288 - DNA, 22 bp, Homo sapiens
tagagtgcccttaaaataatga

SEQ ID NO: 2282289 - DNA, 13 bp, Homo sapiens
tagatataaatat

SEQ ID NO: 2282290 - DNA, 18 bp, Homo sapiens
tagatattcatactttcc

SEQ ID NO: 2282291 - DNA, 22 bp, Homo sapiens
tagatcctctgatatacaatta

SEQ ID NO: 2282292 - DNA, 12 bp, Homo sapiens
tagattgaaatt

SEQ ID NO: 2282293 - DNA, 16 bp, Homo sapiens
tagattgaaatttatg

SEQ ID NO: 2282294 - DNA, 18 bp, Homo sapiens
tagcaaacaaaaatagaa

SEQ ID NO: 2282295 - DNA, 21 bp, Homo sapiens
tagcaatatatttgtaggtat

SEQ ID NO: 2282296 - DNA, 15 bp, Homo sapiens
tagcagagtcattgt

SEQ ID NO: 2282297 - DNA, 19 bp, Homo sapiens
tatcagaactcctttctaa

SEQ ID NO: 2282298 - DNA, 17 bp, Homo sapiens
tatcagagtatgtcagt

SEQ ID NO: 2282299 - DNA, 17 bp, Homo sapiens
tatcagctctaaagcag

SEQ ID NO: 2282300 - DNA, 21 bp, Homo sapiens
tatcagctctaaagcagagat

SEQ ID NO: 2282301 - DNA, 20 bp, Homo sapiens
tatcagggcccaaataacag

SEQ ID NO: 2282302 - DNA, 12 bp, Homo sapiens
tatcagtttgat

SEQ ID NO: 2282303 - DNA, 21 bp, Homo sapiens
tatcatgtgtagatattatgt

SEQ ID NO: 2282304 - DNA, 13 bp, Homo sapiens
tatcatttggccg

SEQ ID NO: 2282305 - DNA, 14 bp, Homo sapiens
tatccaatctcatc

SEQ ID NO: 2282306 - DNA, 14 bp, Homo sapiens
tatccatgtacttt

SEQ ID NO: 2282307 - DNA, 12 bp, Homo sapiens
tatccccagctg

SEQ ID NO: 2282308 - DNA, 17 bp, Homo sapiens
tatcctggcaaataata

SEQ ID NO: 2282309 - DNA, 15 bp, Homo sapiens
tatcctggtgtctag

SEQ ID NO: 2282310 - DNA, 20 bp, Homo sapiens
tatcctggtgtctagtttgc

SEQ ID NO: 2282311 - DNA, 12 bp, Homo sapiens
tatcctgtgcat

SEQ ID NO: 2282312 - DNA, 23 bp, Homo sapiens
tatcctgttaggggaaaatagta

SEQ ID NO: 2282313 - DNA, 16 bp, Homo sapiens
tatctagcaagaagat

SEQ ID NO: 2282314 - DNA, 19 bp, Homo sapiens
tatctagcaagaagattct

SEQ ID NO: 2282315 - DNA, 22 bp, Homo sapiens
tatctagcaagaagattctaaa

SEQ ID NO: 2282316 - DNA, 23 bp, Homo sapiens
tatctagcaagaagattctaaaa

SEQ ID NO: 2282317 - DNA, 23 bp, Homo sapiens
tatctccatccttaactgtccag

SEQ ID NO: 2282318 - DNA, 21 bp, Homo sapiens
tatctgtaagaggtactaaaa

SEQ ID NO: 2282319 - DNA, 21 bp, Homo sapiens
tatctgtaatatataatcaaa

SEQ ID NO: 2282320 - DNA, 13 bp, Homo sapiens
tatctgttactcc

SEQ ID NO: 2282321 - DNA, 17 bp, Homo sapiens
tatcttatccaattcat

SEQ ID NO: 2282322 - DNA, 14 bp, Homo sapiens
tatcttatttatat

SEQ ID NO: 2282323 - DNA, 17 bp, Homo sapiens
tatcttatttatatatg

SEQ ID NO: 2282324 - DNA, 12 bp, Homo sapiens
tatcttgaagaa

SEQ ID NO: 2282325 - DNA, 18 bp, Homo sapiens
tatcttgaagaatattgt

SEQ ID NO: 2282326 - DNA, 15 bp, Homo sapiens
tatcttgaagacttt

SEQ ID NO: 2282327 - DNA, 15 bp, Homo sapiens
tatcttttcttctcc

SEQ ID NO: 2282328 - DNA, 13 bp, Homo sapiens
tatgaaagagaaa

SEQ ID NO: 2282329 - DNA, 19 bp, Homo sapiens
tatgaactagagactctgt

SEQ ID NO: 2282330 - DNA, 21 bp, Homo sapiens
tatgaagacactgtcaatgag

SEQ ID NO: 2282331 - DNA, 16 bp, Homo sapiens
tatgaatatatacata

SEQ ID NO: 2282332 - DNA, 21 bp, Homo sapiens
tatgacctaaatccattttct

SEQ ID NO: 2282333 - DNA, 16 bp, Homo sapiens
tatgactccagaattt

SEQ ID NO: 2282334 - DNA, 19 bp, Homo sapiens
tatgactgaagtaataact

SEQ ID NO: 2282335 - DNA, 15 bp, Homo sapiens
tatgagaaaaaaaca

SEQ ID NO: 2282336 - DNA, 19 bp, Homo sapiens
tatgagaaaaaaacagcag

SEQ ID NO: 2282337 - DNA, 16 bp, Homo sapiens
tatgatctctgctttg

SEQ ID NO: 2282338 - DNA, 16 bp, Homo sapiens
tatgattgaaaagaag

SEQ ID NO: 2282339 - DNA, 19 bp, Homo sapiens
tatgattgaaaagaagaaa

SEQ ID NO: 2282340 - DNA, 16 bp, Homo sapiens
tatgcaagaagaatat

SEQ ID NO: 2282341 - DNA, 19 bp, Homo sapiens
tatgcaagtcgccaggcag

SEQ ID NO: 2282342 - DNA, 23 bp, Homo sapiens
tatgcaagtcgccaggcaggagg

SEQ ID NO: 2282343 - DNA, 18 bp, Homo sapiens
tatgcacttttccccaat

SEQ ID NO: 2282344 - DNA, 20 bp, Homo sapiens
tatgcagcttggagacagga

SEQ ID NO: 2282345 - DNA, 12 bp, Homo sapiens
tatgcctgtatt

SEQ ID NO: 2282346 - DNA, 15 bp, Homo sapiens
tatgctatggaatat

SEQ ID NO: 2282347 - DNA, 15 bp, Homo sapiens
tatggaaatacattt

SEQ ID NO: 2282348 - DNA, 16 bp, Homo sapiens
tatggaaatacattta

SEQ ID NO: 2282349 - DNA, 18 bp, Homo sapiens
tatggaaatacatttaga

SEQ ID NO: 2282350 - DNA, 16 bp, Homo sapiens
tatggaacactctgag

SEQ ID NO: 2282351 - DNA, 19 bp, Homo sapiens
tatggaacactctgagact

SEQ ID NO: 2282352 - DNA, 22 bp, Homo sapiens
tatgtaaatatacagcatgaga

SEQ ID NO: 2282353 - DNA, 21 bp, Homo sapiens
tatgtaagggctttaaataaa

SEQ ID NO: 2282354 - DNA, 18 bp, Homo sapiens
tatgtacagttatacata

SEQ ID NO: 2282355 - DNA, 18 bp, Homo sapiens
tatgtactagtactgtgt

SEQ ID NO: 2282356 - DNA, 23 bp, Homo sapiens
tatgtatagaaaataaaataaat

SEQ ID NO: 2282357 - DNA, 13 bp, Homo sapiens
tatgtcaaaaata

SEQ ID NO: 2282358 - DNA, 23 bp, Homo sapiens
tatgtcaaaaatatttttatgtg

SEQ ID NO: 2282359 - DNA, 21 bp, Homo sapiens
tatgtcaattcattaataaaa

SEQ ID NO: 2282360 - DNA, 14 bp, Homo sapiens
tatgtgatctgtct

SEQ ID NO: 2282361 - DNA, 18 bp, Homo sapiens
tatgtgatctgtcttgta

SEQ ID NO: 2282362 - DNA, 12 bp, Homo sapiens
tatgtgtcatga

SEQ ID NO: 2282363 - DNA, 16 bp, Homo sapiens
tatgtgtcatgatttc

SEQ ID NO: 2282364 - DNA, 18 bp, Homo sapiens
tatgtgttttttaatata

SEQ ID NO: 2282365 - DNA, 14 bp, Homo sapiens
tatgttaacagatg

SEQ ID NO: 2282366 - DNA, 17 bp, Homo sapiens
tatgttattttcagtgc

SEQ ID NO: 2282367 - DNA, 12 bp, Homo sapiens
tatgttctcaac

SEQ ID NO: 2282368 - DNA, 13 bp, Homo sapiens
tatgttgctgaaa

SEQ ID NO: 2282369 - DNA, 22 bp, Homo sapiens
tattaaccaaattaacctttca

SEQ ID NO: 2282370 - DNA, 16 bp, Homo sapiens
tattacactgtaagaa

SEQ ID NO: 2282371 - DNA, 12 bp, Homo sapiens
tattacatttca

SEQ ID NO: 2282372 - DNA, 13 bp, Homo sapiens
tattacatttcat

SEQ ID NO: 2282373 - DNA, 16 bp, Homo sapiens
tattagagtgccctta

SEQ ID NO: 2282374 - DNA, 21 bp, Homo sapiens
tattagagtgcccttaaaata

SEQ ID NO: 2282375 - DNA, 21 bp, Homo sapiens
tattagttaggtgtgccaaac

SEQ ID NO: 2282376 - DNA, 16 bp, Homo sapiens
tattataatatagaaa

SEQ ID NO: 2282377 - DNA, 15 bp, Homo sapiens
tattatagtctgtac

SEQ ID NO: 2282378 - DNA, 21 bp, Homo sapiens
tattatagtctgtacttcagt

SEQ ID NO: 2282379 - DNA, 16 bp, Homo sapiens
tattatatatataata

SEQ ID NO: 2282380 - DNA, 12 bp, Homo sapiens
tattatgaataa

SEQ ID NO: 2282381 - DNA, 12 bp, Homo sapiens
tattatgtatag

SEQ ID NO: 2282382 - DNA, 15 bp, Homo sapiens
tattatgtatagaaa

SEQ ID NO: 2282383 - DNA, 18 bp, Homo sapiens
tattattgctgttgcttg

SEQ ID NO: 2282384 - DNA, 15 bp, Homo sapiens
tattatttgaatgga

SEQ ID NO: 2282385 - DNA, 19 bp, Homo sapiens
tattcagagatgtaccatg

SEQ ID NO: 2282386 - DNA, 20 bp, Homo sapiens
tattcagagatgtaccatgt

SEQ ID NO: 2282387 - DNA, 14 bp, Homo sapiens
tattcatcaaactc

SEQ ID NO: 2282388 - DNA, 14 bp, Homo sapiens
tattcatgtgtaca

SEQ ID NO: 2282389 - DNA, 20 bp, Homo sapiens
tattcatgtgtacagaaaca

SEQ ID NO: 2282390 - DNA, 22 bp, Homo sapiens
tattctagtcaactgctgtttt

SEQ ID NO: 2282391 - DNA, 23 bp, Homo sapiens
tattctgtagccaacttaaacct

SEQ ID NO: 2282392 - DNA, 18 bp, Homo sapiens
tattcttgctttcacaaa

SEQ ID NO: 2282393 - DNA, 19 bp, Homo sapiens
tattcttgctttcacaaat

SEQ ID NO: 2282394 - DNA, 16 bp, Homo sapiens
tattgagtaatattac

SEQ ID NO: 2282395 - DNA, 20 bp, Homo sapiens
tattgagtaatattacattt

SEQ ID NO: 2282396 - DNA, 17 bp, Homo sapiens
tattgcctctgtcttaa

SEQ ID NO: 2282397 - DNA, 14 bp, Homo sapiens
tattgctatatttg

SEQ ID NO: 2282398 - DNA, 15 bp, Homo sapiens
tattgctgttgcttg

SEQ ID NO: 2282399 - DNA, 20 bp, Homo sapiens
tattggcatggatttccttt

SEQ ID NO: 2282400 - DNA, 13 bp, Homo sapiens
tattgtcaaagtg

SEQ ID NO: 2282401 - DNA, 12 bp, Homo sapiens
tatttaaattta

SEQ ID NO: 2282402 - DNA, 18 bp, Homo sapiens
tatttaattatattatga

SEQ ID NO: 2282403 - DNA, 23 bp, Homo sapiens
tatttatattcagagatgtacca

SEQ ID NO: 2282404 - DNA, 12 bp, Homo sapiens
tatttatgcaga

SEQ ID NO: 2282405 - DNA, 13 bp, Homo sapiens
tatttatgttctc

SEQ ID NO: 2282406 - DNA, 14 bp, Homo sapiens
tatttcaataagtg

SEQ ID NO: 2282407 - DNA, 15 bp, Homo sapiens
tatttccaaatattc

SEQ ID NO: 2282408 - DNA, 19 bp, Homo sapiens
tatttccaaatattctaaa

SEQ ID NO: 2282409 - DNA, 20 bp, Homo sapiens
tatttccaaatattctaaaa

SEQ ID NO: 2282410 - DNA, 14 bp, Homo sapiens
tatttccaacaaac

SEQ ID NO: 2282411 - DNA, 20 bp, Homo sapiens
tatttcggaaatacactaca

SEQ ID NO: 2282412 - DNA, 17 bp, Homo sapiens
tatttctatctgcaaat

SEQ ID NO: 2282413 - DNA, 14 bp, Homo sapiens
tatttctgcaaaca

SEQ ID NO: 2282414 - DNA, 22 bp, Homo sapiens
tatttgctaataccaactattt

SEQ ID NO: 2282415 - DNA, 15 bp, Homo sapiens
tatttgcttatttat

SEQ ID NO: 2282416 - DNA, 18 bp, Homo sapiens
tatttgtaggtatactat

SEQ ID NO: 2282417 - DNA, 19 bp, Homo sapiens
tatttgtaggtatactatg

SEQ ID NO: 2282418 - DNA, 20 bp, Homo sapiens
tatttgtaggtatactatgt

SEQ ID NO: 2282419 - DNA, 20 bp, Homo sapiens
tattttagacaaccatagaa

SEQ ID NO: 2282420 - DNA, 22 bp, Homo sapiens
tattttcaataaagaaaaaaat

SEQ ID NO: 2282421 - DNA, 12 bp, Homo sapiens
tattttctatat

SEQ ID NO: 2282422 - DNA, 16 bp, Homo sapiens
tattttctatgtacta

SEQ ID NO: 2282423 - DNA, 14 bp, Homo sapiens
tattttctgaattc

SEQ ID NO: 2282424 - DNA, 22 bp, Homo sapiens
tattttcttttatatctgtaaa

SEQ ID NO: 2282425 - DNA, 21 bp, Homo sapiens
tattttgtcataaaatgctat

SEQ ID NO: 2282426 - DNA, 16 bp, Homo sapiens
tatttttatataatat

SEQ ID NO: 2282427 - DNA, 22 bp, Homo sapiens
tatttttttctagctataacaa

SEQ ID NO: 2282428 - DNA, 22 bp, Homo sapiens
tcaaaaagctgctatccaatga

SEQ ID NO: 2282429 - DNA, 20 bp, Homo sapiens
tcaaaaatatttttatgtga

SEQ ID NO: 2282430 - DNA, 22 bp, Homo sapiens
tcatgggagtcagggagccctg

SEQ ID NO: 2282431 - DNA, 21 bp, Homo sapiens
tcatgtaatagtggctttcat

SEQ ID NO: 2282432 - DNA, 13 bp, Homo sapiens
tcatgtttaagaa

SEQ ID NO: 2282433 - DNA, 20 bp, Homo sapiens
tcatgtttaagaaatgagaa

SEQ ID NO: 2282434 - DNA, 12 bp, Homo sapiens
tcattaataaaa

SEQ ID NO: 2282435 - DNA, 17 bp, Homo sapiens
tcattacagatttagtt

SEQ ID NO: 2282436 - DNA, 19 bp, Homo sapiens
tcattactgcccagatgtt

SEQ ID NO: 2282437 - DNA, 21 bp, Homo sapiens
tcattactgcccagatgtttt

SEQ ID NO: 2282438 - DNA, 12 bp, Homo sapiens
tcattatgaaga

SEQ ID NO: 2282439 - DNA, 20 bp, Homo sapiens
tcattatgtcaattcattaa

SEQ ID NO: 2282440 - DNA, 13 bp, Homo sapiens
tcattatttcatg

SEQ ID NO: 2282441 - DNA, 15 bp, Homo sapiens
tcattcaaaactttc

SEQ ID NO: 2282442 - DNA, 19 bp, Homo sapiens
tcattccacacatttccct

SEQ ID NO: 2282443 - DNA, 15 bp, Homo sapiens
tcattctctagacaa

SEQ ID NO: 2282444 - DNA, 19 bp, Homo sapiens
tcattctgctaatttatga

SEQ ID NO: 2282445 - DNA, 23 bp, Homo sapiens
tcattcttttcagcttgtttcta

SEQ ID NO: 2282446 - DNA, 22 bp, Homo sapiens
tcattgaaatctttttgctttg

SEQ ID NO: 2282447 - DNA, 20 bp, Homo sapiens
tcattgcagtatcagagggt

SEQ ID NO: 2282448 - DNA, 17 bp, Homo sapiens
tcattgctgacagagcc

SEQ ID NO: 2282449 - DNA, 15 bp, Homo sapiens
tcattggttacaaat

SEQ ID NO: 2282450 - DNA, 20 bp, Homo sapiens
tcattggttacaaattttta

SEQ ID NO: 2282451 - DNA, 20 bp, Homo sapiens
tcattgtagagcacatttag

SEQ ID NO: 2282452 - DNA, 22 bp, Homo sapiens
tcattgttacaggtgtactatg

SEQ ID NO: 2282453 - DNA, 23 bp, Homo sapiens
tcattgtttgatttggtcctgcc

SEQ ID NO: 2282454 - DNA, 20 bp, Homo sapiens
tcatttatactgtagcaata

SEQ ID NO: 2282455 - DNA, 14 bp, Homo sapiens
tcatttgtagatat

SEQ ID NO: 2282456 - DNA, 20 bp, Homo sapiens
tcatttgtagatatatattt

SEQ ID NO: 2282457 - DNA, 23 bp, Homo sapiens
tcatttgtagatatatatttcca

SEQ ID NO: 2282458 - DNA, 15 bp, Homo sapiens
tcatttttctgttag

SEQ ID NO: 2282459 - DNA, 12 bp, Homo sapiens
tccaaaacacaa

SEQ ID NO: 2282460 - DNA, 13 bp, Homo sapiens
tccaaaatcattc

SEQ ID NO: 2282461 - DNA, 11 bp, Homo sapiens
tccaaacaatt

SEQ ID NO: 2282462 - DNA, 12 bp, Homo sapiens
tccaaatattct

SEQ ID NO: 2282463 - DNA, 12 bp, Homo sapiens
tccaacctggag

SEQ ID NO: 2282464 - DNA, 14 bp, Homo sapiens
tccaacctggaggc

SEQ ID NO: 2282465 - DNA, 21 bp, Homo sapiens
tccaactccaacatccactct

SEQ ID NO: 2282466 - DNA, 13 bp, Homo sapiens
tccaagggcccag

SEQ ID NO: 2282467 - DNA, 13 bp, Homo sapiens
tccaagtatttta

SEQ ID NO: 2282468 - DNA, 22 bp, Homo sapiens
tccaagtattttatctgtgttg

SEQ ID NO: 2282469 - DNA, 18 bp, Homo sapiens
tccaagtcatgggagaag

SEQ ID NO: 2282470 - DNA, 14 bp, Homo sapiens
tccaatctcatctc

SEQ ID NO: 2282471 - DNA, 17 bp, Homo sapiens
tccaatctcatctcttg

SEQ ID NO: 2282472 - DNA, 21 bp, Homo sapiens
tccaatgaagataaatgcttt

SEQ ID NO: 2282473 - DNA, 22 bp, Homo sapiens
tccaatgatataggaaaataca

SEQ ID NO: 2282474 - DNA, 23 bp, Homo sapiens
tccaatgtaccatgttgcccaga

SEQ ID NO: 2282475 - DNA, 16 bp, Homo sapiens
tccaattaatgattca

SEQ ID NO: 2282476 - DNA, 15 bp, Homo sapiens
tccacacacagcagc

SEQ ID NO: 2282477 - DNA, 16 bp, Homo sapiens
tccacacacagcagct

SEQ ID NO: 2282478 - DNA, 19 bp, Homo sapiens
tccacacacagcagctcca

SEQ ID NO: 2282479 - DNA, 23 bp, Homo sapiens
tccacacacagcagctccaacct

SEQ ID NO: 2282480 - DNA, 12 bp, Homo sapiens
tccacacaggcc

SEQ ID NO: 2282481 - DNA, 22 bp, Homo sapiens
tccacacaggcccatgccctcc

SEQ ID NO: 2282482 - DNA, 12 bp, Homo sapiens
tccacacccgcg

SEQ ID NO: 2282483 - DNA, 15 bp, Homo sapiens
tccacaccctctcct

SEQ ID NO: 2282484 - DNA, 14 bp, Homo sapiens
tccacatcagatgc

SEQ ID NO: 2282485 - DNA, 21 bp, Homo sapiens
tccacattctgctgcccccag

SEQ ID NO: 2282486 - DNA, 23 bp, Homo sapiens
tccaccccaaaggggcctctcct

SEQ ID NO: 2282487 - DNA, 15 bp, Homo sapiens
tccaccctagcctag

SEQ ID NO: 2282488 - DNA, 17 bp, Homo sapiens
tccaccctcccctcttc

SEQ ID NO: 2282489 - DNA, 23 bp, Homo sapiens
tccaccttggcgcgcagcccggg

SEQ ID NO: 2282490 - DNA, 13 bp, Homo sapiens
tccacgtggagag

SEQ ID NO: 2282491 - DNA, 22 bp, Homo sapiens
tccacttatgtagacaaaactt

SEQ ID NO: 2282492 - DNA, 17 bp, Homo sapiens
tccacttctctagagaa

SEQ ID NO: 2282493 - DNA, 21 bp, Homo sapiens
tccagaacaaaagataaaact

SEQ ID NO: 2282494 - DNA, 17 bp, Homo sapiens
tccagaacgccctgtgt

SEQ ID NO: 2282495 - DNA, 18 bp, Homo sapiens
tccagaacgccctgtgtc

SEQ ID NO: 2282496 - DNA, 16 bp, Homo sapiens
tccagaatttcccaaa

SEQ ID NO: 2282497 - DNA, 15 bp, Homo sapiens
tccagacctgggccc

SEQ ID NO: 2282498 - DNA, 19 bp, Homo sapiens
tccagacctgggccctggt

SEQ ID NO: 2282499 - DNA, 22 bp, Homo sapiens
tccagactcgagagggctgagc

SEQ ID NO: 2282500 - DNA, 15 bp, Homo sapiens
tccagagacctgctc

SEQ ID NO: 2282501 - DNA, 20 bp, Homo sapiens
tccagagacctgctccagat

SEQ ID NO: 2282502 - DNA, 23 bp, Homo sapiens
tccagatcctctttccccactga

SEQ ID NO: 2282503 - DNA, 19 bp, Homo sapiens
tccagattattttctatat

SEQ ID NO: 2282504 - DNA, 21 bp, Homo sapiens
tccagcaggggtctcccaaca

SEQ ID NO: 2282505 - DNA, 15 bp, Homo sapiens
tccagcccagacatc

SEQ ID NO: 2282506 - DNA, 14 bp, Homo sapiens
tccagctcagtccc

SEQ ID NO: 2282507 - DNA, 19 bp, Homo sapiens
tccagctcagtcccacagc

SEQ ID NO: 2282508 - DNA, 18 bp, Homo sapiens
tccagctcctgccccgcc

SEQ ID NO: 2282509 - DNA, 14 bp, Homo sapiens
tccagctgaggcag

SEQ ID NO: 2282510 - DNA, 17 bp, Homo sapiens
tccaggcgtagggccag

SEQ ID NO: 2282511 - DNA, 14 bp, Homo sapiens
tccagggtctgagt

SEQ ID NO: 2282512 - DNA, 21 bp, Homo sapiens
tccagggttctcttgttttga

SEQ ID NO: 2282513 - DNA, 15 bp, Homo sapiens
tccagtatcttgaag

SEQ ID NO: 2282514 - DNA, 13 bp, Homo sapiens
tccagtgttttct

SEQ ID NO: 2282515 - DNA, 19 bp, Homo sapiens
tccagtgttttcttgtgtt

SEQ ID NO: 2282516 - DNA, 21 bp, Homo sapiens
tccagttggactgtggcctca

SEQ ID NO: 2282517 - DNA, 20 bp, Homo sapiens
tccatatagtttgttttctt

SEQ ID NO: 2282518 - DNA, 20 bp, Homo sapiens
tccatatcagctctgcataa

SEQ ID NO: 2282519 - DNA, 17 bp, Homo sapiens
tccatccttttgcttca

SEQ ID NO: 2282520 - DNA, 22 bp, Homo sapiens
tccatccttttgcttcatctgg

SEQ ID NO: 2282521 - DNA, 16 bp, Homo sapiens
tccatcttacttgccc

SEQ ID NO: 2282522 - DNA, 15 bp, Homo sapiens
tccatgatacaaaga

SEQ ID NO: 2282523 - DNA, 17 bp, Homo sapiens
tccatgatagatataaa

SEQ ID NO: 2282524 - DNA, 21 bp, Homo sapiens
tccatgattccaagggcccag

SEQ ID NO: 2282525 - DNA, 22 bp, Homo sapiens
tccatgctctttcaccctgcca

SEQ ID NO: 2282526 - DNA, 20 bp, Homo sapiens
tccatgtaccttgtgtactt

SEQ ID NO: 2282527 - DNA, 16 bp, Homo sapiens
tccatgtgaaatttac

SEQ ID NO: 2282528 - DNA, 13 bp, Homo sapiens
tccatgtggcctt

SEQ ID NO: 2282529 - DNA, 23 bp, Homo sapiens
tccatgttagtaatggcagagca

SEQ ID NO: 2282530 - DNA, 16 bp, Homo sapiens
tccattactaaagaca

SEQ ID NO: 2282531 - DNA, 14 bp, Homo sapiens
tccattgcattcat

SEQ ID NO: 2282532 - DNA, 18 bp, Homo sapiens
tcccaaacccttcagtgc

SEQ ID NO: 2282533 - DNA, 17 bp, Homo sapiens
tcccaaagcagtgcatg

SEQ ID NO: 2282534 - DNA, 21 bp, Homo sapiens
tcccaacaagtgctctttcca

SEQ ID NO: 2282535 - DNA, 18 bp, Homo sapiens
tcccaatagaatacctcc

SEQ ID NO: 2282536 - DNA, 16 bp, Homo sapiens
tcccacagccccttgc

SEQ ID NO: 2282537 - DNA, 15 bp, Homo sapiens
tcccaccactccctg

SEQ ID NO: 2282538 - DNA, 16 bp, Homo sapiens
tcccaccactccctgg

SEQ ID NO: 2282539 - DNA, 19 bp, Homo sapiens
tcccactgatatcacgggc

SEQ ID NO: 2282540 - DNA, 19 bp, Homo sapiens
tcccacttatcaaatcatt

SEQ ID NO: 2282541 - DNA, 16 bp, Homo sapiens
tcccagctcactgcag

SEQ ID NO: 2282542 - DNA, 19 bp, Homo sapiens
tcccagctcactgcagcct

SEQ ID NO: 2282543 - DNA, 21 bp, Homo sapiens
tcccagctcactgcagcctcg

SEQ ID NO: 2282544 - DNA, 13 bp, Homo sapiens
tcccagctggcag

SEQ ID NO: 2282545 - DNA, 15 bp, Homo sapiens
tcccagctggcagcg

SEQ ID NO: 2282546 - DNA, 21 bp, Homo sapiens
tcccagctggcagcgcctccc

SEQ ID NO: 2282547 - DNA, 22 bp, Homo sapiens
tcccaggacgcagggagaccct

SEQ ID NO: 2282548 - DNA, 11 bp, Homo sapiens
tcccagggccc

SEQ ID NO: 2282549 - DNA, 15 bp, Homo sapiens
tcccagggcccgagc

SEQ ID NO: 2282550 - DNA, 18 bp, Homo sapiens
tcccatgggctctggccc

SEQ ID NO: 2282551 - DNA, 12 bp, Homo sapiens
tcccatttgtaa

SEQ ID NO: 2282552 - DNA, 20 bp, Homo sapiens
tccccagccccctggcccct

SEQ ID NO: 2282553 - DNA, 22 bp, Homo sapiens
tccccagccccctggcccctcc

SEQ ID NO: 2282554 - DNA, 13 bp, Homo sapiens
tccccattctata

SEQ ID NO: 2282555 - DNA, 17 bp, Homo sapiens
tcccccacggccgtccc

SEQ ID NO: 2282556 - DNA, 20 bp, Homo sapiens
tcccccacggccgtccctga

SEQ ID NO: 2282557 - DNA, 16 bp, Homo sapiens
tcccccaggaccctga

SEQ ID NO: 2282558 - DNA, 19 bp, Homo sapiens
tcccccaggctgcgcctgc

SEQ ID NO: 2282559 - DNA, 22 bp, Homo sapiens
tcccccaggctgcgcctgcccg

SEQ ID NO: 2282560 - DNA, 15 bp, Homo sapiens
tccccgcccgccctc

SEQ ID NO: 2282561 - DNA, 21 bp, Homo sapiens
tccccgcccgccctcctctgc

SEQ ID NO: 2282562 - DNA, 21 bp, Homo sapiens
tcgccctctctcaccagcctt

SEQ ID NO: 2282563 - DNA, 18 bp, Homo sapiens
tcgcctcaggctttttcc

SEQ ID NO: 2282564 - DNA, 12 bp, Homo sapiens
tcgcctcctcca

SEQ ID NO: 2282565 - DNA, 19 bp, Homo sapiens
tcgcgacaatgcaaaccat

SEQ ID NO: 2282566 - DNA, 14 bp, Homo sapiens
tcgctccaactcca

SEQ ID NO: 2282567 - DNA, 20 bp, Homo sapiens
tcggaaatacactacaaatg

SEQ ID NO: 2282568 - DNA, 13 bp, Homo sapiens
tcggccagagctc

SEQ ID NO: 2282569 - DNA, 15 bp, Homo sapiens
tcggccagagctccc

SEQ ID NO: 2282570 - DNA, 16 bp, Homo sapiens
tcggccagagctccca

SEQ ID NO: 2282571 - DNA, 17 bp, Homo sapiens
tcggccagagctcccag

SEQ ID NO: 2282572 - DNA, 14 bp, Homo sapiens
tcggctgggcaggg

SEQ ID NO: 2282573 - DNA, 19 bp, Homo sapiens
tcggctgggcagggccgca

SEQ ID NO: 2282574 - DNA, 15 bp, Homo sapiens
tcgggaaggcctgag

SEQ ID NO: 2282575 - DNA, 20 bp, Homo sapiens
tcgggctaagtccagctctc

SEQ ID NO: 2282576 - DNA, 14 bp, Homo sapiens
tcggggcaggaagt

SEQ ID NO: 2282577 - DNA, 13 bp, Homo sapiens
tcggtcagcaccg

SEQ ID NO: 2282578 - DNA, 21 bp, Homo sapiens
tcggttcaagttgatgtgaca

SEQ ID NO: 2282579 - DNA, 20 bp, Homo sapiens
tcgtcaggaggtgcctgaga

SEQ ID NO: 2282580 - DNA, 18 bp, Homo sapiens
tcgtccggcctgcagccc

SEQ ID NO: 2282581 - DNA, 19 bp, Homo sapiens
tcgtccggcctgcagccca

SEQ ID NO: 2282582 - DNA, 16 bp, Homo sapiens
tcgtttcacatctgta

SEQ ID NO: 2282583 - DNA, 21 bp, Homo sapiens
tctaaaaaagatactgtatat

SEQ ID NO: 2282584 - DNA, 17 bp, Homo sapiens
tctaaaaaataactgtg

SEQ ID NO: 2282585 - DNA, 15 bp, Homo sapiens
tctaaaattctagtc

SEQ ID NO: 2282586 - DNA, 22 bp, Homo sapiens
tctaaacacacttagaatacta

SEQ ID NO: 2282587 - DNA, 15 bp, Homo sapiens
tctaaactgttttca

SEQ ID NO: 2282588 - DNA, 23 bp, Homo sapiens
tctaaagggctatgcctccattt

SEQ ID NO: 2282589 - DNA, 21 bp, Homo sapiens
tctaaagttagggcatttttc

SEQ ID NO: 2282590 - DNA, 23 bp, Homo sapiens
tctaaagttagggcatttttctt

SEQ ID NO: 2282591 - DNA, 13 bp, Homo sapiens
tctaaatgtttct

SEQ ID NO: 2282592 - DNA, 18 bp, Homo sapiens
tctaaatgtttctttttc

SEQ ID NO: 2282593 - DNA, 19 bp, Homo sapiens
tctaaatgtttctttttct

SEQ ID NO: 2282594 - DNA, 20 bp, Homo sapiens
tctaaatgtttctttttctt

SEQ ID NO: 2282595 - DNA, 20 bp, Homo sapiens
tctaagcttatttctaacta

SEQ ID NO: 2282596 - DNA, 17 bp, Homo sapiens
tctaagggatccagaga

SEQ ID NO: 2282597 - DNA, 21 bp, Homo sapiens
tctaagggatccagagacctg

SEQ ID NO: 2282598 - DNA, 17 bp, Homo sapiens
tctaagtcagtttcaca

SEQ ID NO: 2282599 - DNA, 20 bp, Homo sapiens
tctaagtcagtttcacatat

SEQ ID NO: 2282600 - DNA, 15 bp, Homo sapiens
tctacactcacaatc

SEQ ID NO: 2282601 - DNA, 15 bp, Homo sapiens
tctacaggaaataca

SEQ ID NO: 2282602 - DNA, 15 bp, Homo sapiens
tctacctgcaggact

SEQ ID NO: 2282603 - DNA, 13 bp, Homo sapiens
tctactaaaaata

SEQ ID NO: 2282604 - DNA, 23 bp, Homo sapiens
tctactgcttggatccatacaaa

SEQ ID NO: 2282605 - DNA, 17 bp, Homo sapiens
tctactttcctgatgtt

SEQ ID NO: 2282606 - DNA, 23 bp, Homo sapiens
tctagcaactgttggataataac

SEQ ID NO: 2282607 - DNA, 18 bp, Homo sapiens
tctagcaagaagattcta

SEQ ID NO: 2282608 - DNA, 19 bp, Homo sapiens
tctagcagtatgtgtgctc

SEQ ID NO: 2282609 - DNA, 21 bp, Homo sapiens
tctagctataacaactctatt

SEQ ID NO: 2282610 - DNA, 22 bp, Homo sapiens
tctagctataacaactctattt

SEQ ID NO: 2282611 - DNA, 17 bp, Homo sapiens
tctagtcaactgctgtt

SEQ ID NO: 2282612 - DNA, 14 bp, Homo sapiens
tctagtctctgatt

SEQ ID NO: 2282613 - DNA, 16 bp, Homo sapiens
tctataaattgtagaa

SEQ ID NO: 2282614 - DNA, 16 bp, Homo sapiens
tctataagagacaaag

SEQ ID NO: 2282615 - DNA, 12 bp, Homo sapiens
tctatactgttt

SEQ ID NO: 2282616 - DNA, 15 bp, Homo sapiens
tctatatatacatgt

SEQ ID NO: 2282617 - DNA, 22 bp, Homo sapiens
tctatatatacatgtatagtga

SEQ ID NO: 2282618 - DNA, 12 bp, Homo sapiens
tctatatttcat

SEQ ID NO: 2282619 - DNA, 14 bp, Homo sapiens
tctatatttcatat

SEQ ID NO: 2282620 - DNA, 21 bp, Homo sapiens
tctatgaactagagactctgt

SEQ ID NO: 2282621 - DNA, 14 bp, Homo sapiens
tctatgcctgtatt

SEQ ID NO: 2282622 - DNA, 18 bp, Homo sapiens
tctatgtactagtactgt

SEQ ID NO: 2282623 - DNA, 22 bp, Homo sapiens
tctatgtactagtactgtgtac

SEQ ID NO: 2282624 - DNA, 17 bp, Homo sapiens
tctatgtagaactgttc

SEQ ID NO: 2282625 - DNA, 20 bp, Homo sapiens
tctatgtagaactgttcatt

SEQ ID NO: 2282626 - DNA, 13 bp, Homo sapiens
tctatgtcctgga

SEQ ID NO: 2282627 - DNA, 12 bp, Homo sapiens
tctatgttcata

SEQ ID NO: 2282628 - DNA, 17 bp, Homo sapiens
tctatgttcataaaaaa

SEQ ID NO: 2282629 - DNA, 13 bp, Homo sapiens
tctattaaaagcc

SEQ ID NO: 2282630 - DNA, 15 bp, Homo sapiens
tctattatctgggtt

SEQ ID NO: 2282631 - DNA, 16 bp, Homo sapiens
tctattatctgggttt

SEQ ID NO: 2282632 - DNA, 20 bp, Homo sapiens
tctattatctgggttttaga

SEQ ID NO: 2282633 - DNA, 19 bp, Homo sapiens
tctatttcggaaatacact

SEQ ID NO: 2282634 - DNA, 14 bp, Homo sapiens
tctatttctatctg

SEQ ID NO: 2282635 - DNA, 19 bp, Homo sapiens
tctatttctatctgcaaat

SEQ ID NO: 2282636 - DNA, 18 bp, Homo sapiens
tctattttataagggcac

SEQ ID NO: 2282637 - DNA, 19 bp, Homo sapiens
tctattttataagggcact

SEQ ID NO: 2282638 - DNA, 14 bp, Homo sapiens
tctattttctatgt

SEQ ID NO: 2282639 - DNA, 16 bp, Homo sapiens
tctattttctatgtac

SEQ ID NO: 2282640 - DNA, 20 bp, Homo sapiens
tctcaaacactgcttaagga

SEQ ID NO: 2282641 - DNA, 17 bp, Homo sapiens
tctcaacgcagtaattc

SEQ ID NO: 2282642 - DNA, 18 bp, Homo sapiens
tctcaagtttatgtctca

SEQ ID NO: 2282643 - DNA, 15 bp, Homo sapiens
tctcaatgcttttct

SEQ ID NO: 2282644 - DNA, 18 bp, Homo sapiens
tctcacctctaggcctca

SEQ ID NO: 2282645 - DNA, 19 bp, Homo sapiens
tctcacctctaggcctcag

SEQ ID NO: 2282646 - DNA, 21 bp, Homo sapiens
tctcactctgttgaccaggct

SEQ ID NO: 2282647 - DNA, 21 bp, Homo sapiens
tctcactgtgttgcccaggct

SEQ ID NO: 2282648 - DNA, 17 bp, Homo sapiens
tctcatgaaggagagga

SEQ ID NO: 2282649 - DNA, 18 bp, Homo sapiens
tctccaggcaccgcctgc

SEQ ID NO: 2282650 - DNA, 20 bp, Homo sapiens
tctccaggcaccgcctgccc

SEQ ID NO: 2282651 - DNA, 17 bp, Homo sapiens
tctccatccttaactgt

SEQ ID NO: 2282652 - DNA, 21 bp, Homo sapiens
tctccatgctctttcaccctg

SEQ ID NO: 2282653 - DNA, 14 bp, Homo sapiens
tctcccagacctag

SEQ ID NO: 2282654 - DNA, 14 bp, Homo sapiens
tctccctggactct

SEQ ID NO: 2282655 - DNA, 18 bp, Homo sapiens
tctcccttctcctgacct

SEQ ID NO: 2282656 - DNA, 15 bp, Homo sapiens
tctcctcgtccggcc

SEQ ID NO: 2282657 - DNA, 14 bp, Homo sapiens
tctccttgtacttg

SEQ ID NO: 2282658 - DNA, 19 bp, Homo sapiens
tctccttgtacttgaataa

SEQ ID NO: 2282659 - DNA, 22 bp, Homo sapiens
tctcgtgattgataagaacctt

SEQ ID NO: 2282660 - DNA, 13 bp, Homo sapiens
tctcgtgttcgct

SEQ ID NO: 2282661 - DNA, 19 bp, Homo sapiens
tctcgtgttcgctggctga

SEQ ID NO: 2282662 - DNA, 20 bp, Homo sapiens
tctctaatagaagtccatga

SEQ ID NO: 2282663 - DNA, 15 bp, Homo sapiens
tctctactaaaaata

SEQ ID NO: 2282664 - DNA, 15 bp, Homo sapiens
tctctatatatacat

SEQ ID NO: 2282665 - DNA, 19 bp, Homo sapiens
tctctatatatacatgtat

SEQ ID NO: 2282666 - DNA, 14 bp, Homo sapiens
tctctcaccagcct

SEQ ID NO: 2282667 - DNA, 17 bp, Homo sapiens
tctctctatatatacat

SEQ ID NO: 2282668 - DNA, 16 bp, Homo sapiens
tctctgagcagtgggg

SEQ ID NO: 2282669 - DNA, 19 bp, Homo sapiens
tctctgagcagtggggagc

SEQ ID NO: 2282670 - DNA, 14 bp, Homo sapiens
tctctgatttgcaa

SEQ ID NO: 2282671 - DNA, 16 bp, Homo sapiens
tctctgatttgcaaat

SEQ ID NO: 2282672 - DNA, 16 bp, Homo sapiens
tctctgccctgccctg

SEQ ID NO: 2282673 - DNA, 14 bp, Homo sapiens
tctcttccagccca

SEQ ID NO: 2282674 - DNA, 16 bp, Homo sapiens
tctcttgattcataat

SEQ ID NO: 2282675 - DNA, 18 bp, Homo sapiens
tctcttgtaccagcccag

SEQ ID NO: 2282676 - DNA, 22 bp, Homo sapiens
tctgaaaatatttttttctagc

SEQ ID NO: 2282677 - DNA, 17 bp, Homo sapiens
tctgaactgctgctggt

SEQ ID NO: 2282678 - DNA, 20 bp, Homo sapiens
tctgaactggactagtgaaa

SEQ ID NO: 2282679 - DNA, 15 bp, Homo sapiens
tctgaagatctcaga

SEQ ID NO: 2282680 - DNA, 13 bp, Homo sapiens
tctgaagggaggg

SEQ ID NO: 2282681 - DNA, 19 bp, Homo sapiens
tctgaattcataaaaataa

SEQ ID NO: 2282682 - DNA, 22 bp, Homo sapiens
tctgagactcgcgacaatgcaa

SEQ ID NO: 2282683 - DNA, 17 bp, Homo sapiens
tctgagcagttgttata

SEQ ID NO: 2282684 - DNA, 22 bp, Homo sapiens
tctgagtgaatgttaacatgcg

SEQ ID NO: 2282685 - DNA, 21 bp, Homo sapiens
tctgataagactggaaaatag

SEQ ID NO: 2282686 - DNA, 22 bp, Homo sapiens
tctgataagcttcctagaaagt

SEQ ID NO: 2282687 - DNA, 12 bp, Homo sapiens
tctgatagagtt

SEQ ID NO: 2282688 - DNA, 23 bp, Homo sapiens
tctgatagagtttaacagatatt

SEQ ID NO: 2282689 - DNA, 18 bp, Homo sapiens
tctgatcacaacttttct

SEQ ID NO: 2282690 - DNA, 15 bp, Homo sapiens
tctgattaaatttaa

SEQ ID NO: 2282691 - DNA, 14 bp, Homo sapiens
tctgatttgcaaat

SEQ ID NO: 2282692 - DNA, 17 bp, Homo sapiens
tctgatttgcatattca

SEQ ID NO: 2282693 - DNA, 22 bp, Homo sapiens
tctgcaaacaaacaccttctta

SEQ ID NO: 2282694 - DNA, 22 bp, Homo sapiens
tgaaatttttaaatcatttcat

SEQ ID NO: 2282695 - DNA, 15 bp, Homo sapiens
tgaacaagatttccc

SEQ ID NO: 2282696 - DNA, 18 bp, Homo sapiens
tgaacaagatttccctaa

SEQ ID NO: 2282697 - DNA, 16 bp, Homo sapiens
tgaacaccactttgtc

SEQ ID NO: 2282698 - DNA, 13 bp, Homo sapiens
tgaacagaaattt

SEQ ID NO: 2282699 - DNA, 22 bp, Homo sapiens
tgaacaggccgcacatctcact

SEQ ID NO: 2282700 - DNA, 16 bp, Homo sapiens
tgaaccgtcaatgtga

SEQ ID NO: 2282701 - DNA, 20 bp, Homo sapiens
tgaactagagactctgtgat

SEQ ID NO: 2282702 - DNA, 23 bp, Homo sapiens
tgaactagagactctgtgatcta

SEQ ID NO: 2282703 - DNA, 14 bp, Homo sapiens
tgaactcaatgcat

SEQ ID NO: 2282704 - DNA, 14 bp, Homo sapiens
tgaactgctgctgg

SEQ ID NO: 2282705 - DNA, 15 bp, Homo sapiens
tgaactggagagctt

SEQ ID NO: 2282706 - DNA, 17 bp, Homo sapiens
tgaactgtggccaccta

SEQ ID NO: 2282707 - DNA, 23 bp, Homo sapiens
tgaacttggctttcctgtttcta

SEQ ID NO: 2282708 - DNA, 19 bp, Homo sapiens
tgaagaaaaaattttaaaa

SEQ ID NO: 2282709 - DNA, 19 bp, Homo sapiens
tgaagaaggaaagaaccga

SEQ ID NO: 2282710 - DNA, 18 bp, Homo sapiens
tgaagaatggacttaatt

SEQ ID NO: 2282711 - DNA, 17 bp, Homo sapiens
tgaagacactgtcaatg

SEQ ID NO: 2282712 - DNA, 14 bp, Homo sapiens
tgaagacttttctt

SEQ ID NO: 2282713 - DNA, 22 bp, Homo sapiens
tgaagacttttctttcagccaa

SEQ ID NO: 2282714 - DNA, 20 bp, Homo sapiens
tgaagatccccattctttct

SEQ ID NO: 2282715 - DNA, 21 bp, Homo sapiens
tgaagatctcagataaagtga

SEQ ID NO: 2282716 - DNA, 17 bp, Homo sapiens
tgaagattataaaagcc

SEQ ID NO: 2282717 - DNA, 13 bp, Homo sapiens
tgaagctcaactg

SEQ ID NO: 2282718 - DNA, 17 bp, Homo sapiens
tgaaggatgggggctcc

SEQ ID NO: 2282719 - DNA, 20 bp, Homo sapiens
tgaaggatgggggctcctgg

SEQ ID NO: 2282720 - DNA, 21 bp, Homo sapiens
tgaagggaaatcaatttaaag

SEQ ID NO: 2282721 - DNA, 13 bp, Homo sapiens
tgaagtaataact

SEQ ID NO: 2282722 - DNA, 23 bp, Homo sapiens
tgaagtctgcttaccaaaacata

SEQ ID NO: 2282723 - DNA, 10 bp, Homo sapiens
tgaagtcttg

SEQ ID NO: 2282724 - DNA, 12 bp, Homo sapiens
tgaagtcttgta

SEQ ID NO: 2282725 - DNA, 15 bp, Homo sapiens
tgaagttaacagtct

SEQ ID NO: 2282726 - DNA, 21 bp, Homo sapiens
tgaataaaattgttatttcaa

SEQ ID NO: 2282727 - DNA, 21 bp, Homo sapiens
tgaatagcaatagcatggata

SEQ ID NO: 2282728 - DNA, 19 bp, Homo sapiens
tgaatcaaagacatttcat

SEQ ID NO: 2282729 - DNA, 20 bp, Homo sapiens
tgaatcagtatgaagacact

SEQ ID NO: 2282730 - DNA, 15 bp, Homo sapiens
tgaatgcctttcaaa

SEQ ID NO: 2282731 - DNA, 21 bp, Homo sapiens
tgaatgtattcttttatataa

SEQ ID NO: 2282732 - DNA, 22 bp, Homo sapiens
tgaatgtattcttttatataac

SEQ ID NO: 2282733 - DNA, 14 bp, Homo sapiens
tgaatgtcagtgtg

SEQ ID NO: 2282734 - DNA, 19 bp, Homo sapiens
tgaatgtccccattctata

SEQ ID NO: 2282735 - DNA, 20 bp, Homo sapiens
tgaatgtccccattctataa

SEQ ID NO: 2282736 - DNA, 15 bp, Homo sapiens
tgaatgttaacatgc

SEQ ID NO: 2282737 - DNA, 21 bp, Homo sapiens
tgaattattacactgtaagaa

SEQ ID NO: 2282738 - DNA, 15 bp, Homo sapiens
tgaattcataaaaat

SEQ ID NO: 2282739 - DNA, 14 bp, Homo sapiens
tgaattgttatgta

SEQ ID NO: 2282740 - DNA, 18 bp, Homo sapiens
tgacaagccaatgtgaat

SEQ ID NO: 2282741 - DNA, 15 bp, Homo sapiens
tgacaagtcacaccc

SEQ ID NO: 2282742 - DNA, 13 bp, Homo sapiens
tgacacaatggta

SEQ ID NO: 2282743 - DNA, 16 bp, Homo sapiens
tgacacataaatctgt

SEQ ID NO: 2282744 - DNA, 18 bp, Homo sapiens
tgacacataaatctgtct

SEQ ID NO: 2282745 - DNA, 22 bp, Homo sapiens
tgacacataaatctgtctgatt

SEQ ID NO: 2282746 - DNA, 19 bp, Homo sapiens
tgacacgaatattgctgat

SEQ ID NO: 2282747 - DNA, 16 bp, Homo sapiens
tgacactgcagcagaa

SEQ ID NO: 2282748 - DNA, 22 bp, Homo sapiens
tgacagagcaagcgaaagagca

SEQ ID NO: 2282749 - DNA, 12 bp, Homo sapiens
tgacagagccct

SEQ ID NO: 2282750 - DNA, 15 bp, Homo sapiens
tgacataccttgctt

SEQ ID NO: 2282751 - DNA, 23 bp, Homo sapiens
tgacatcaactgcatcaagatgt

SEQ ID NO: 2282752 - DNA, 15 bp, Homo sapiens
tgaccaatctctgtg

SEQ ID NO: 2282753 - DNA, 17 bp, Homo sapiens
tgaccaatctctgtgac

SEQ ID NO: 2282754 - DNA, 19 bp, Homo sapiens
tgaccctcaattcatattt

SEQ ID NO: 2282755 - DNA, 16 bp, Homo sapiens
tgaccctggagcccgg

SEQ ID NO: 2282756 - DNA, 18 bp, Homo sapiens
tgaccggcccgccacctt

SEQ ID NO: 2282757 - DNA, 20 bp, Homo sapiens
tgacctaaatccattttcta

SEQ ID NO: 2282758 - DNA, 21 bp, Homo sapiens
tgacctaaatccattttctaa

SEQ ID NO: 2282759 - DNA, 19 bp, Homo sapiens
tgacctctcacttttttat

SEQ ID NO: 2282760 - DNA, 16 bp, Homo sapiens
tgacctgacacctgcc

SEQ ID NO: 2282761 - DNA, 17 bp, Homo sapiens
tgacctgacacctgccg

SEQ ID NO: 2282762 - DNA, 21 bp, Homo sapiens
tgacctgcccccgctctgcca

SEQ ID NO: 2282763 - DNA, 14 bp, Homo sapiens
tgacctttcaatag

SEQ ID NO: 2282764 - DNA, 18 bp, Homo sapiens
tgacctttcaataggaaa

SEQ ID NO: 2282765 - DNA, 23 bp, Homo sapiens
tgacgacctacatctgaaatcta

SEQ ID NO: 2282766 - DNA, 13 bp, Homo sapiens
tgactaaatttgg

SEQ ID NO: 2282767 - DNA, 15 bp, Homo sapiens
tgactagcaaacaaa

SEQ ID NO: 2282768 - DNA, 21 bp, Homo sapiens
tgactcgcttagctgaaacct

SEQ ID NO: 2282769 - DNA, 13 bp, Homo sapiens
tgactctggaacc

SEQ ID NO: 2282770 - DNA, 22 bp, Homo sapiens
tgactctggaaccatcctctgt

SEQ ID NO: 2282771 - DNA, 23 bp, Homo sapiens
tgactcttcttatcacacttgca

SEQ ID NO: 2282772 - DNA, 21 bp, Homo sapiens
tgactggtatacctatttcat

SEQ ID NO: 2282773 - DNA, 16 bp, Homo sapiens
tgactgtgctggagaa

SEQ ID NO: 2282774 - DNA, 16 bp, Homo sapiens
tgacttcccagctggc

SEQ ID NO: 2282775 - DNA, 22 bp, Homo sapiens
tgacttcccagctggcagcgcc

SEQ ID NO: 2282776 - DNA, 11 bp, Homo sapiens
tgacttctctc

SEQ ID NO: 2282777 - DNA, 21 bp, Homo sapiens
tgacttggtagagttcctttc

SEQ ID NO: 2282778 - DNA, 20 bp, Homo sapiens
tgagaagcctcatgggagtc

SEQ ID NO: 2282779 - DNA, 19 bp, Homo sapiens
tgagactcgcgacaatgca

SEQ ID NO: 2282780 - DNA, 20 bp, Homo sapiens
tgagactttccgactgcttt

SEQ ID NO: 2282781 - DNA, 22 bp, Homo sapiens
tgagagcagagcccccatggcc

SEQ ID NO: 2282782 - DNA, 10 bp, Homo sapiens
tgagagcctc

SEQ ID NO: 2282783 - DNA, 11 bp, Homo sapiens
tgagaggaaat

SEQ ID NO: 2282784 - DNA, 12 bp, Homo sapiens
tgagaggaaatc

SEQ ID NO: 2282785 - DNA, 13 bp, Homo sapiens
tgagagtcatctc

SEQ ID NO: 2282786 - DNA, 14 bp, Homo sapiens
tgagagtcatctca

SEQ ID NO: 2282787 - DNA, 15 bp, Homo sapiens
tgagagtcatctcaa

SEQ ID NO: 2282788 - DNA, 20 bp, Homo sapiens
tgagagtcatctcaaacact

SEQ ID NO: 2282789 - DNA, 15 bp, Homo sapiens
tgagatactttttct

SEQ ID NO: 2282790 - DNA, 20 bp, Homo sapiens
tgagatcagcattcaaaata

SEQ ID NO: 2282791 - DNA, 23 bp, Homo sapiens
tgagattccagaacgccctgtgt

SEQ ID NO: 2282792 - DNA, 16 bp, Homo sapiens
tgagattgtacatttt

SEQ ID NO: 2282793 - DNA, 12 bp, Homo sapiens
tgagatttgtat

SEQ ID NO: 2282794 - DNA, 18 bp, Homo sapiens
tgagcaagtcccatctca

SEQ ID NO: 2282795 - DNA, 13 bp, Homo sapiens
tgagcagtgggga

SEQ ID NO: 2282796 - DNA, 23 bp, Homo sapiens
tgagccacagtggggcccatggc

SEQ ID NO: 2282797 - DNA, 13 bp, Homo sapiens
tgagccagatttc

SEQ ID NO: 2282798 - DNA, 16 bp, Homo sapiens
tgagccagatttcact

SEQ ID NO: 2282799 - DNA, 17 bp, Homo sapiens
tgagccagatttcactc

SEQ ID NO: 2282800 - DNA, 19 bp, Homo sapiens
tgagccagatttcactctc

SEQ ID NO: 2282801 - DNA, 21 bp, Homo sapiens
tgagcccaacactcacttaat

SEQ ID NO: 2282802 - DNA, 17 bp, Homo sapiens
tgagcccctcctctcct

SEQ ID NO: 2282803 - DNA, 14 bp, Homo sapiens
tgagctaccaggaa

SEQ ID NO: 2282804 - DNA, 16 bp, Homo sapiens
tgagctccaccctccc

SEQ ID NO: 2282805 - DNA, 20 bp, Homo sapiens
tgagctccaccctcccctct

SEQ ID NO: 2282806 - DNA, 12 bp, Homo sapiens
tgagctcctggg

SEQ ID NO: 2282807 - DNA, 16 bp, Homo sapiens
tgaggacctccacctg

SEQ ID NO: 2282808 - DNA, 23 bp, Homo sapiens
tgaggacctccacctgggagatg

SEQ ID NO: 2282809 - DNA, 15 bp, Homo sapiens
tgaggacctgcggcc

SEQ ID NO: 2282810 - DNA, 21 bp, Homo sapiens
tgaggacctgcggccttgggt

SEQ ID NO: 2282811 - DNA, 17 bp, Homo sapiens
tgaggacggggcagagc

SEQ ID NO: 2282812 - DNA, 16 bp, Homo sapiens
tgaggaggggagcaag

SEQ ID NO: 2282813 - DNA, 19 bp, Homo sapiens
tgaggcaggagggcatgtg

SEQ ID NO: 2282814 - DNA, 22 bp, Homo sapiens
tgaggcaggagggcatgtgcag

SEQ ID NO: 2282815 - DNA, 13 bp, Homo sapiens
tgaggcagggtct

SEQ ID NO: 2282816 - DNA, 23 bp, Homo sapiens
tgaggcccccggaggcgcccacc

SEQ ID NO: 2282817 - DNA, 15 bp, Homo sapiens
tgaggcgggaaccct

SEQ ID NO: 2282818 - DNA, 12 bp, Homo sapiens
tgagggaagccc

SEQ ID NO: 2282819 - DNA, 20 bp, Homo sapiens
tgagggaagcccacccgccc

SEQ ID NO: 2282820 - DNA, 14 bp, Homo sapiens
tgagggaggcctga

SEQ ID NO: 2282821 - DNA, 18 bp, Homo sapiens
tgagggtcctcttcctca

SEQ ID NO: 2282822 - DNA, 22 bp, Homo sapiens
tgaggtcatcccggggccatgg

SEQ ID NO: 2282823 - DNA, 14 bp, Homo sapiens
tgaggtgggggcag

SEQ ID NO: 2282824 - DNA, 22 bp, Homo sapiens
tgagtagctgggactagaggca

SEQ ID NO: 2282825 - DNA, 19 bp, Homo sapiens
tgagtcctggcatgggaat

SEQ ID NO: 2282826 - DNA, 20 bp, Homo sapiens
tgcccaggctggtcttgaac

SEQ ID NO: 2282827 - DNA, 11 bp, Homo sapiens
tgcccccacag

SEQ ID NO: 2282828 - DNA, 12 bp, Homo sapiens
tgcccccacaga

SEQ ID NO: 2282829 - DNA, 13 bp, Homo sapiens
tgcccccacagat

SEQ ID NO: 2282830 - DNA, 14 bp, Homo sapiens
tgcccccacagatc

SEQ ID NO: 2282831 - DNA, 18 bp, Homo sapiens
tgcccccacagatccatc

SEQ ID NO: 2282832 - DNA, 20 bp, Homo sapiens
tgcccccacagatccatcct

SEQ ID NO: 2282833 - DNA, 16 bp, Homo sapiens
tgcccccaccctgctt

SEQ ID NO: 2282834 - DNA, 20 bp, Homo sapiens
tgccccctcccccgcagaca

SEQ ID NO: 2282835 - DNA, 20 bp, Homo sapiens
tgccccttgaccccacacgc

SEQ ID NO: 2282836 - DNA, 17 bp, Homo sapiens
tgccctccgtcctggca

SEQ ID NO: 2282837 - DNA, 14 bp, Homo sapiens
tgccctgccctggc

SEQ ID NO: 2282838 - DNA, 15 bp, Homo sapiens
tgccctgccctggcc

SEQ ID NO: 2282839 - DNA, 22 bp, Homo sapiens
tgccctggccactggccctgtt

SEQ ID NO: 2282840 - DNA, 14 bp, Homo sapiens
tgcccttaaaataa

SEQ ID NO: 2282841 - DNA, 19 bp, Homo sapiens
tgcccttaaaataatgatt

SEQ ID NO: 2282842 - DNA, 20 bp, Homo sapiens
tgcccttctatactttctca

SEQ ID NO: 2282843 - DNA, 18 bp, Homo sapiens
tgcccttttgcccactgt

SEQ ID NO: 2282844 - DNA, 16 bp, Homo sapiens
tgccgacggagccact

SEQ ID NO: 2282845 - DNA, 15 bp, Homo sapiens
tgccgctgcccccac

SEQ ID NO: 2282846 - DNA, 19 bp, Homo sapiens
tgccgctgcccccaccctg

SEQ ID NO: 2282847 - DNA, 20 bp, Homo sapiens
tgccgctgcccccaccctgc

SEQ ID NO: 2282848 - DNA, 13 bp, Homo sapiens
tgccgctgcttga

SEQ ID NO: 2282849 - DNA, 21 bp, Homo sapiens
tgccgctgcttgagtggacag

SEQ ID NO: 2282850 - DNA, 13 bp, Homo sapiens
tgccgctgtgtcc

SEQ ID NO: 2282851 - DNA, 19 bp, Homo sapiens
tgccgtgcacggggccagc

SEQ ID NO: 2282852 - DNA, 13 bp, Homo sapiens
tgcctaaatttca

SEQ ID NO: 2282853 - DNA, 20 bp, Homo sapiens
tgcctccaagtcatgggaga

SEQ ID NO: 2282854 - DNA, 16 bp, Homo sapiens
tgcctctgtcttaaag

SEQ ID NO: 2282855 - DNA, 19 bp, Homo sapiens
tgcctctgtcttaaagaat

SEQ ID NO: 2282856 - DNA, 14 bp, Homo sapiens
tgcctggcgggcag

SEQ ID NO: 2282857 - DNA, 15 bp, Homo sapiens
tgcctggcgggcagc

SEQ ID NO: 2282858 - DNA, 16 bp, Homo sapiens
tgcctggcgggcagcc

SEQ ID NO: 2282859 - DNA, 19 bp, Homo sapiens
tgcctggcgggcagcccct

SEQ ID NO: 2282860 - DNA, 21 bp, Homo sapiens
tgcctggcgggcagcccctgc

SEQ ID NO: 2282861 - DNA, 23 bp, Homo sapiens
tgcctggcgggcagcccctgctg

SEQ ID NO: 2282862 - DNA, 20 bp, Homo sapiens
tgccttatggaacactctga

SEQ ID NO: 2282863 - DNA, 21 bp, Homo sapiens
tgccttatggaacactctgag

SEQ ID NO: 2282864 - DNA, 13 bp, Homo sapiens
tgccttccaggcg

SEQ ID NO: 2282865 - DNA, 17 bp, Homo sapiens
tgcgccccccagtggac

SEQ ID NO: 2282866 - DNA, 13 bp, Homo sapiens
tgcgctcctctgc

SEQ ID NO: 2282867 - DNA, 16 bp, Homo sapiens
tgcgctcctctgcagc

SEQ ID NO: 2282868 - DNA, 23 bp, Homo sapiens
tgcgctcctctgcagcctgagct

SEQ ID NO: 2282869 - DNA, 14 bp, Homo sapiens
tgcgctctgggttt

SEQ ID NO: 2282870 - DNA, 16 bp, Homo sapiens
tgcggaccggagcggc

SEQ ID NO: 2282871 - DNA, 19 bp, Homo sapiens
tgcggaccggagcggctga

SEQ ID NO: 2282872 - DNA, 23 bp, Homo sapiens
tgcggaccggagcggctgaggac

SEQ ID NO: 2282873 - DNA, 20 bp, Homo sapiens
tgcggatactcttggagagt

SEQ ID NO: 2282874 - DNA, 18 bp, Homo sapiens
tgcggcaccgcccaccca

SEQ ID NO: 2282875 - DNA, 17 bp, Homo sapiens
tgcgtgaccggcccgcc

SEQ ID NO: 2282876 - DNA, 16 bp, Homo sapiens
tgcgtgtgcccactga

SEQ ID NO: 2282877 - DNA, 21 bp, Homo sapiens
tgcgttcctaaactctgaaat

SEQ ID NO: 2282878 - DNA, 22 bp, Homo sapiens
tgcgttcctaaactctgaaatc

SEQ ID NO: 2282879 - DNA, 19 bp, Homo sapiens
tgctaaatgcaaacactgt

SEQ ID NO: 2282880 - DNA, 14 bp, Homo sapiens
tgctaagtggaaga

SEQ ID NO: 2282881 - DNA, 17 bp, Homo sapiens
tgctaataccaactatt

SEQ ID NO: 2282882 - DNA, 20 bp, Homo sapiens
tgctaataccaactatttca

SEQ ID NO: 2282883 - DNA, 22 bp, Homo sapiens
tgctaataccaactatttcaat

SEQ ID NO: 2282884 - DNA, 16 bp, Homo sapiens
tgctaatagaaaactg

SEQ ID NO: 2282885 - DNA, 17 bp, Homo sapiens
tgctaatagaaaactgt

SEQ ID NO: 2282886 - DNA, 13 bp, Homo sapiens
tgctaatgtaatc

SEQ ID NO: 2282887 - DNA, 18 bp, Homo sapiens
tgctaatgtaatcattta

SEQ ID NO: 2282888 - DNA, 20 bp, Homo sapiens
tgctaatttatgaagatagt

SEQ ID NO: 2282889 - DNA, 14 bp, Homo sapiens
tgctacataaattg

SEQ ID NO: 2282890 - DNA, 12 bp, Homo sapiens
tgctacctggtt

SEQ ID NO: 2282891 - DNA, 18 bp, Homo sapiens
tgctacctggttttcatt

SEQ ID NO: 2282892 - DNA, 20 bp, Homo sapiens
tgctagaatagaagaaagag

SEQ ID NO: 2282893 - DNA, 14 bp, Homo sapiens
tgctatccaatgat

SEQ ID NO: 2282894 - DNA, 17 bp, Homo sapiens
tgctatggaaatacatt

SEQ ID NO: 2282895 - DNA, 19 bp, Homo sapiens
tgctattgtttataggaaa

SEQ ID NO: 2282896 - DNA, 21 bp, Homo sapiens
tgctcacacgctgcctcctca

SEQ ID NO: 2282897 - DNA, 16 bp, Homo sapiens
tgctccagtgttttct

SEQ ID NO: 2282898 - DNA, 13 bp, Homo sapiens
tgctcctcggcca

SEQ ID NO: 2282899 - DNA, 19 bp, Homo sapiens
tgctcctcggccagagctc

SEQ ID NO: 2282900 - DNA, 23 bp, Homo sapiens
tgctcctcggccagagctcccag

SEQ ID NO: 2282901 - DNA, 15 bp, Homo sapiens
tgctcttctgttctc

SEQ ID NO: 2282902 - DNA, 19 bp, Homo sapiens
tgctctttcaccctgccac

SEQ ID NO: 2282903 - DNA, 12 bp, Homo sapiens
tgctctttccac

SEQ ID NO: 2282904 - DNA, 17 bp, Homo sapiens
tgctgaacgacagtccc

SEQ ID NO: 2282905 - DNA, 19 bp, Homo sapiens
tgctgaacgacagtcccag

SEQ ID NO: 2282906 - DNA, 14 bp, Homo sapiens
tgctgacagagccc

SEQ ID NO: 2282907 - DNA, 15 bp, Homo sapiens
tgctgatggtgcaat

SEQ ID NO: 2282908 - DNA, 18 bp, Homo sapiens
tgctgatggtgcaatgac

SEQ ID NO: 2282909 - DNA, 20 bp, Homo sapiens
tgctgatggtgcaatgacct

SEQ ID NO: 2282910 - DNA, 15 bp, Homo sapiens
tgctgcacagtagtg

SEQ ID NO: 2282911 - DNA, 15 bp, Homo sapiens
tgctgcctctgaaaa

SEQ ID NO: 2282912 - DNA, 10 bp, Homo sapiens
tgctgcctgt

SEQ ID NO: 2282913 - DNA, 20 bp, Homo sapiens
tgctgcctgtttggggaggg

SEQ ID NO: 2282914 - DNA, 19 bp, Homo sapiens
tgctgctcctcggccagag

SEQ ID NO: 2282915 - DNA, 21 bp, Homo sapiens
tgctggaccaaggtgcggacc

SEQ ID NO: 2282916 - DNA, 19 bp, Homo sapiens
tgctgggattacaggtgtg

SEQ ID NO: 2282917 - DNA, 23 bp, Homo sapiens
tgctgggctggcggccatccccg

SEQ ID NO: 2282918 - DNA, 17 bp, Homo sapiens
tgctgtcattttatgct

SEQ ID NO: 2282919 - DNA, 19 bp, Homo sapiens
tgctgtcccttacgtgagt

SEQ ID NO: 2282920 - DNA, 18 bp, Homo sapiens
tgctgttgcttgaatagc

SEQ ID NO: 2282921 - DNA, 14 bp, Homo sapiens
tgcttaagatgcta

SEQ ID NO: 2282922 - DNA, 16 bp, Homo sapiens
tgcttaccaaaacata

SEQ ID NO: 2282923 - DNA, 13 bp, Homo sapiens
tgcttatttatat

SEQ ID NO: 2282924 - DNA, 14 bp, Homo sapiens
tgcttatttatatt

SEQ ID NO: 2282925 - DNA, 18 bp, Homo sapiens
tgcttcaaggatcctgag

SEQ ID NO: 2282926 - DNA, 19 bp, Homo sapiens
tgcttcaaggatcctgagc

SEQ ID NO: 2282927 - DNA, 17 bp, Homo sapiens
tgcttcattgtttgatt

SEQ ID NO: 2282928 - DNA, 12 bp, Homo sapiens
tgcttccttttc

SEQ ID NO: 2282929 - DNA, 14 bp, Homo sapiens
tgcttccttttcag

SEQ ID NO: 2282930 - DNA, 13 bp, Homo sapiens
tgcttgagtggac

SEQ ID NO: 2282931 - DNA, 16 bp, Homo sapiens
tgcttgagtggacagc

SEQ ID NO: 2282932 - DNA, 21 bp, Homo sapiens
tgcttgagtggacagcagctg

SEQ ID NO: 2282933 - DNA, 20 bp, Homo sapiens
tgcttgatataataattact

SEQ ID NO: 2282934 - DNA, 13 bp, Homo sapiens
tgctttaaatagt

SEQ ID NO: 2282935 - DNA, 16 bp, Homo sapiens
tgctttattgcctctg

SEQ ID NO: 2282936 - DNA, 19 bp, Homo sapiens
tgctttcacaaatatagtt

SEQ ID NO: 2282937 - DNA, 17 bp, Homo sapiens
tgctttcatgtttaaga

SEQ ID NO: 2282938 - DNA, 12 bp, Homo sapiens
tgctttcttcat

SEQ ID NO: 2282939 - DNA, 19 bp, Homo sapiens
tgctttgcggcatctccat

SEQ ID NO: 2282940 - DNA, 16 bp, Homo sapiens
tgctttgtttccttct

SEQ ID NO: 2282941 - DNA, 20 bp, Homo sapiens
tgctttgttttggctgctct

SEQ ID NO: 2282942 - DNA, 18 bp, Homo sapiens
tgcttttccatctaaaat

SEQ ID NO: 2282943 - DNA, 13 bp, Homo sapiens
tggaaatacattt

SEQ ID NO: 2282944 - DNA, 15 bp, Homo sapiens
tggaaatacatttag

SEQ ID NO: 2282945 - DNA, 12 bp, Homo sapiens
tggaacactctg

SEQ ID NO: 2282946 - DNA, 13 bp, Homo sapiens
tggaaccatcctc

SEQ ID NO: 2282947 - DNA, 13 bp, Homo sapiens
tggaactttcata

SEQ ID NO: 2282948 - DNA, 16 bp, Homo sapiens
tggaagacagagatgg

SEQ ID NO: 2282949 - DNA, 22 bp, Homo sapiens
tggaagacagagatggcagagc

SEQ ID NO: 2282950 - DNA, 23 bp, Homo sapiens
tggaagacagagatggcagagcc

SEQ ID NO: 2282951 - DNA, 19 bp, Homo sapiens
tggaagagccgagcacctg

SEQ ID NO: 2282952 - DNA, 15 bp, Homo sapiens
tggaagctggcagga

SEQ ID NO: 2282953 - DNA, 18 bp, Homo sapiens
tggaagggcaggagctca

SEQ ID NO: 2282954 - DNA, 22 bp, Homo sapiens
tggaagtgtgtgtttcttgctt

SEQ ID NO: 2282955 - DNA, 16 bp, Homo sapiens
tggaatgttgttaaat

SEQ ID NO: 2282956 - DNA, 22 bp, Homo sapiens
tggaatttcttgtttctccaga

SEQ ID NO: 2282957 - DNA, 21 bp, Homo sapiens
tggacagatgggtgtcccctg

SEQ ID NO: 2282958 - DNA, 13 bp, Homo sapiens
tggacatgcacag

SEQ ID NO: 2282959 - DNA, 18 bp, Homo sapiens
tggggcccatggccccag

SEQ ID NO: 2282960 - DNA, 23 bp, Homo sapiens
tggggcccatggccccagctggc

SEQ ID NO: 2282961 - DNA, 14 bp, Homo sapiens
tggggccgggctgg

SEQ ID NO: 2282962 - DNA, 16 bp, Homo sapiens
tggggctgccgtgcac

SEQ ID NO: 2282963 - DNA, 21 bp, Homo sapiens
tgggggaggcttccagctcag

SEQ ID NO: 2282964 - DNA, 19 bp, Homo sapiens
tggggtcccccctccctgt

SEQ ID NO: 2282965 - DNA, 19 bp, Homo sapiens
tggggtctacactgcaatc

SEQ ID NO: 2282966 - DNA, 15 bp, Homo sapiens
tggggtctctgagca

SEQ ID NO: 2282967 - DNA, 16 bp, Homo sapiens
tggggtctctgagcag

SEQ ID NO: 2282968 - DNA, 22 bp, Homo sapiens
tggggtctctgagcagtgggga

SEQ ID NO: 2282969 - DNA, 19 bp, Homo sapiens
tggggtttccacacaggcc

SEQ ID NO: 2282970 - DNA, 21 bp, Homo sapiens
tggggtttccacacaggccca

SEQ ID NO: 2282971 - DNA, 18 bp, Homo sapiens
tgggtaaaagcagggcag

SEQ ID NO: 2282972 - DNA, 11 bp, Homo sapiens
tgggtcctgct

SEQ ID NO: 2282973 - DNA, 13 bp, Homo sapiens
tgggtcctgctgc

SEQ ID NO: 2282974 - DNA, 14 bp, Homo sapiens
tgggtcctgctgct

SEQ ID NO: 2282975 - DNA, 16 bp, Homo sapiens
tgggtcctgctgctcg

SEQ ID NO: 2282976 - DNA, 22 bp, Homo sapiens
tgggtcgcccacgggtgtggct

SEQ ID NO: 2282977 - DNA, 17 bp, Homo sapiens
tgggtcgcccctcctcg

SEQ ID NO: 2282978 - DNA, 14 bp, Homo sapiens
tgggttgttgcaga

SEQ ID NO: 2282979 - DNA, 21 bp, Homo sapiens
tgggttttagaaattctataa

SEQ ID NO: 2282980 - DNA, 23 bp, Homo sapiens
tgggtttttaaaaaaaatattct

SEQ ID NO: 2282981 - DNA, 22 bp, Homo sapiens
tggtaaagagatgtcaaaatgt

SEQ ID NO: 2282982 - DNA, 16 bp, Homo sapiens
tggtaatcttttctga

SEQ ID NO: 2282983 - DNA, 19 bp, Homo sapiens
tggtaatgtgtcaaagaga

SEQ ID NO: 2282984 - DNA, 16 bp, Homo sapiens
tggtatggctgcagtc

SEQ ID NO: 2282985 - DNA, 14 bp, Homo sapiens
tggtcacagacccc

SEQ ID NO: 2282986 - DNA, 17 bp, Homo sapiens
tggtcacagacccctgg

SEQ ID NO: 2282987 - DNA, 19 bp, Homo sapiens
tggtcacagacccctgggg

SEQ ID NO: 2282988 - DNA, 21 bp, Homo sapiens
tggtcacagacccctggggga

SEQ ID NO: 2282989 - DNA, 17 bp, Homo sapiens
tggtcagttttcacaga

SEQ ID NO: 2282990 - DNA, 20 bp, Homo sapiens
tggtcagttttcacagaggc

SEQ ID NO: 2282991 - DNA, 15 bp, Homo sapiens
tggtcatgaatagaa

SEQ ID NO: 2282992 - DNA, 20 bp, Homo sapiens
tggtccacattctgctgccc

SEQ ID NO: 2282993 - DNA, 18 bp, Homo sapiens
tggtcctgcctaaatttc

SEQ ID NO: 2282994 - DNA, 12 bp, Homo sapiens
tggtcctgtgcc

SEQ ID NO: 2282995 - DNA, 16 bp, Homo sapiens
tggtcctgtgccccga

SEQ ID NO: 2282996 - DNA, 16 bp, Homo sapiens
tggtctcagaggaggg

SEQ ID NO: 2282997 - DNA, 23 bp, Homo sapiens
tggtctcgtgttcgctggctgat

SEQ ID NO: 2282998 - DNA, 12 bp, Homo sapiens
tggtctcttcca

SEQ ID NO: 2282999 - DNA, 17 bp, Homo sapiens
tggtctcttccagccca

SEQ ID NO: 2283000 - DNA, 15 bp, Homo sapiens
tggtctggtgttcca

SEQ ID NO: 2283001 - DNA, 11 bp, Homo sapiens
tggtgaattat

SEQ ID NO: 2283002 - DNA, 21 bp, Homo sapiens
tggtgagggtcctcttcctca

SEQ ID NO: 2283003 - DNA, 18 bp, Homo sapiens
tggtgatgcctaaaggaa

SEQ ID NO: 2283004 - DNA, 19 bp, Homo sapiens
tggtgcaatgacctttcaa

SEQ ID NO: 2283005 - DNA, 20 bp, Homo sapiens
tggtgtgaggcccccggagg

SEQ ID NO: 2283006 - DNA, 15 bp, Homo sapiens
tggtgtgatcccagc

SEQ ID NO: 2283007 - DNA, 17 bp, Homo sapiens
tggtgtgatcccagctc

SEQ ID NO: 2283008 - DNA, 15 bp, Homo sapiens
tggtgtgcttatgtt

SEQ ID NO: 2283009 - DNA, 13 bp, Homo sapiens
tggttagtgtact

SEQ ID NO: 2283010 - DNA, 21 bp, Homo sapiens
tggttatagttgatatgtaac

SEQ ID NO: 2283011 - DNA, 15 bp, Homo sapiens
tggttcttattcact

SEQ ID NO: 2283012 - DNA, 22 bp, Homo sapiens
tggtttaaccattggaatggac

SEQ ID NO: 2283013 - DNA, 13 bp, Homo sapiens
tggttttcattat

SEQ ID NO: 2283014 - DNA, 19 bp, Homo sapiens
tggttttcttgtgtgttta

SEQ ID NO: 2283015 - DNA, 14 bp, Homo sapiens
tgtaaaattcatag

SEQ ID NO: 2283016 - DNA, 20 bp, Homo sapiens
tgtaaacatcataaatagta

SEQ ID NO: 2283017 - DNA, 23 bp, Homo sapiens
tgtaaatatacagcatgagattg

SEQ ID NO: 2283018 - DNA, 11 bp, Homo sapiens
tgtaaatatag

SEQ ID NO: 2283019 - DNA, 22 bp, Homo sapiens
tgtaaatgttatttctgcaaac

SEQ ID NO: 2283020 - DNA, 17 bp, Homo sapiens
tgtaacagttggtgatt

SEQ ID NO: 2283021 - DNA, 16 bp, Homo sapiens
tgtaacatgtctaaag

SEQ ID NO: 2283022 - DNA, 15 bp, Homo sapiens
tgtaactgttctttg

SEQ ID NO: 2283023 - DNA, 15 bp, Homo sapiens
tgtaagaaatgtata

SEQ ID NO: 2283024 - DNA, 14 bp, Homo sapiens
tgtaagaagcccga

SEQ ID NO: 2283025 - DNA, 14 bp, Homo sapiens
tgtaaggaatgatt

SEQ ID NO: 2283026 - DNA, 15 bp, Homo sapiens
tgtaagggctttaaa

SEQ ID NO: 2283027 - DNA, 16 bp, Homo sapiens
tgtaagtgctacataa

SEQ ID NO: 2283028 - DNA, 21 bp, Homo sapiens
tgtaatcatttatcttatcta

SEQ ID NO: 2283029 - DNA, 22 bp, Homo sapiens
tgtacaattttcatcccacaat

SEQ ID NO: 2283030 - DNA, 18 bp, Homo sapiens
tgtacagaaaatagcttt

SEQ ID NO: 2283031 - DNA, 19 bp, Homo sapiens
tgtacagaaacaactgcca

SEQ ID NO: 2283032 - DNA, 24 bp, Homo sapiens
tgtacagaaccagcactcccaggg

SEQ ID NO: 2283033 - DNA, 14 bp, Homo sapiens
tgtacagttataca

SEQ ID NO: 2283034 - DNA, 17 bp, Homo sapiens
tgtacatatggaaatcc

SEQ ID NO: 2283035 - DNA, 22 bp, Homo sapiens
tgtacatatggaaatcctgtta

SEQ ID NO: 2283036 - DNA, 13 bp, Homo sapiens
tgtaccagcccag

SEQ ID NO: 2283037 - DNA, 15 bp, Homo sapiens
tgtaccagcccaggc

SEQ ID NO: 2283038 - DNA, 17 bp, Homo sapiens
tgtaccatgttaaagag

SEQ ID NO: 2283039 - DNA, 18 bp, Homo sapiens
tgtaccctatgttcactc

SEQ ID NO: 2283040 - DNA, 18 bp, Homo sapiens
tgtactgatgattgtttg

SEQ ID NO: 2283041 - DNA, 17 bp, Homo sapiens
tgtactgtatagacagt

SEQ ID NO: 2283042 - DNA, 18 bp, Homo sapiens
tgtacttcagttctcatc

SEQ ID NO: 2283043 - DNA, 15 bp, Homo sapiens
tgtactttcttccct

SEQ ID NO: 2283044 - DNA, 18 bp, Homo sapiens
tgtagaaacacagcctat

SEQ ID NO: 2283045 - DNA, 18 bp, Homo sapiens
tgtagaacatagatgcta

SEQ ID NO: 2283046 - DNA, 15 bp, Homo sapiens
tgtagatattatgta

SEQ ID NO: 2283047 - DNA, 17 bp, Homo sapiens
tgtagatattatgtata

SEQ ID NO: 2283048 - DNA, 14 bp, Homo sapiens
tgtagcaatatatt

SEQ ID NO: 2283049 - DNA, 15 bp, Homo sapiens
tgtagcaatatattt

SEQ ID NO: 2283050 - DNA, 21 bp, Homo sapiens
tgtagcaatatatttgtaggt

SEQ ID NO: 2283051 - DNA, 17 bp, Homo sapiens
tgtagcaggttctaggc

SEQ ID NO: 2283052 - DNA, 17 bp, Homo sapiens
tgtagttgatgtatcca

SEQ ID NO: 2283053 - DNA, 13 bp, Homo sapiens
tgtatagaaaata

SEQ ID NO: 2283054 - DNA, 23 bp, Homo sapiens
tgtatagaaaataaaataaatta

SEQ ID NO: 2283055 - DNA, 21 bp, Homo sapiens
tgtatagacagtttgtaaatg

SEQ ID NO: 2283056 - DNA, 15 bp, Homo sapiens
tgtatagctttaaca

SEQ ID NO: 2283057 - DNA, 15 bp, Homo sapiens
tgtatatcagctcta

SEQ ID NO: 2283058 - DNA, 16 bp, Homo sapiens
tgtatatcagctctaa

SEQ ID NO: 2283059 - DNA, 16 bp, Homo sapiens
tgtatatgtcaaaaat

SEQ ID NO: 2283060 - DNA, 18 bp, Homo sapiens
tgtatctaaaaaataact

SEQ ID NO: 2283061 - DNA, 23 bp, Homo sapiens
tgtatctaaaaaataactgtgca

SEQ ID NO: 2283062 - DNA, 12 bp, Homo sapiens
tgtatctgttta

SEQ ID NO: 2283063 - DNA, 17 bp, Homo sapiens
tgtatgatttctgttgt

SEQ ID NO: 2283064 - DNA, 12 bp, Homo sapiens
tgtattattgct

SEQ ID NO: 2283065 - DNA, 18 bp, Homo sapiens
tgtattctgtggattcta

SEQ ID NO: 2283066 - DNA, 14 bp, Homo sapiens
tgtattcttttata

SEQ ID NO: 2283067 - DNA, 23 bp, Homo sapiens
tgtatttgaagactgattttaaa

SEQ ID NO: 2283068 - DNA, 14 bp, Homo sapiens
tgtatttttagaga

SEQ ID NO: 2283069 - DNA, 16 bp, Homo sapiens
tgtcaaagtggtgaga

SEQ ID NO: 2283070 - DNA, 19 bp, Homo sapiens
tgtcaaagtggtgagaggc

SEQ ID NO: 2283071 - DNA, 15 bp, Homo sapiens
tgtcaattacaggaa

SEQ ID NO: 2283072 - DNA, 21 bp, Homo sapiens
tgtcaattacaggaagtactg

SEQ ID NO: 2283073 - DNA, 20 bp, Homo sapiens
tgtcaattcattaataaaat

SEQ ID NO: 2283074 - DNA, 20 bp, Homo sapiens
tgtcaatttttaacttatct

SEQ ID NO: 2283075 - DNA, 22 bp, Homo sapiens
tgtcaccagctgccaaaatcgt

SEQ ID NO: 2283076 - DNA, 16 bp, Homo sapiens
tgtcactaagaatata

SEQ ID NO: 2283077 - DNA, 17 bp, Homo sapiens
tgtcactaagaatataa

SEQ ID NO: 2283078 - DNA, 22 bp, Homo sapiens
tgtcactaagaatataaatatt

SEQ ID NO: 2283079 - DNA, 20 bp, Homo sapiens
tgtcaggcagtagcagctgt

SEQ ID NO: 2283080 - DNA, 14 bp, Homo sapiens
tgtcagtctgtcca

SEQ ID NO: 2283081 - DNA, 23 bp, Homo sapiens
tgtcagtctgtccacgtggagag

SEQ ID NO: 2283082 - DNA, 14 bp, Homo sapiens
tgtcagtgtgactg

SEQ ID NO: 2283083 - DNA, 15 bp, Homo sapiens
tgtcagtgtgactga

SEQ ID NO: 2283084 - DNA, 20 bp, Homo sapiens
tgtcagtgtgactgatctct

SEQ ID NO: 2283085 - DNA, 15 bp, Homo sapiens
tgtcataaaatgcta

SEQ ID NO: 2283086 - DNA, 23 bp, Homo sapiens
tgtcataaaatgctattttaaaa

SEQ ID NO: 2283087 - DNA, 13 bp, Homo sapiens
tgtcatactctgt

SEQ ID NO: 2283088 - DNA, 20 bp, Homo sapiens
tgtcatgatttcaatgattg

SEQ ID NO: 2283089 - DNA, 16 bp, Homo sapiens
tgtcattggttacaaa

SEQ ID NO: 2283090 - DNA, 17 bp, Homo sapiens
tgtccacactaccagtt

SEQ ID NO: 2283091 - DNA, 16 bp, Homo sapiens
tgtttgcttgaatgct

SEQ ID NO: 2283092 - DNA, 15 bp, Homo sapiens
tgtttggtgaggacc

SEQ ID NO: 2283093 - DNA, 15 bp, Homo sapiens
tgttttaagaaatgt

SEQ ID NO: 2283094 - DNA, 23 bp, Homo sapiens
tgttttaagaaatgtagttgatg

SEQ ID NO: 2283095 - DNA, 20 bp, Homo sapiens
tgttttatgtcatactctgt

SEQ ID NO: 2283096 - DNA, 16 bp, Homo sapiens
tgttttcctaaacaca

SEQ ID NO: 2283097 - DNA, 20 bp, Homo sapiens
tgttttggctgctctccatc

SEQ ID NO: 2283098 - DNA, 13 bp, Homo sapiens
tgtttttctcaaa

SEQ ID NO: 2283099 - DNA, 13 bp, Homo sapiens
ttaaaaaataaca

SEQ ID NO: 2283100 - DNA, 17 bp, Homo sapiens
ttaaaaagcccaacctc

SEQ ID NO: 2283101 - DNA, 18 bp, Homo sapiens
ttaaaaagttgcacatta

SEQ ID NO: 2283102 - DNA, 18 bp, Homo sapiens
ttaaaaatctacgtcttt

SEQ ID NO: 2283103 - DNA, 19 bp, Homo sapiens
ttaaaaatctacgtcttta

SEQ ID NO: 2283104 - DNA, 22 bp, Homo sapiens
ttaaaaatctttcagaatacaa

SEQ ID NO: 2283105 - DNA, 20 bp, Homo sapiens
ttaaaacttttctgcatttg

SEQ ID NO: 2283106 - DNA, 15 bp, Homo sapiens
ttaaaagctttagat

SEQ ID NO: 2283107 - DNA, 22 bp, Homo sapiens
ttaaaatattgtgtaagaatca

SEQ ID NO: 2283108 - DNA, 19 bp, Homo sapiens
ttaaaatcaacttttgaaa

SEQ ID NO: 2283109 - DNA, 16 bp, Homo sapiens
ttaaacctgtgctttc

SEQ ID NO: 2283110 - DNA, 22 bp, Homo sapiens
ttaaactgatgtatagctttaa

SEQ ID NO: 2283111 - DNA, 17 bp, Homo sapiens
ttaaaggaaagttctat

SEQ ID NO: 2283112 - DNA, 15 bp, Homo sapiens
ttaaatagcatctgc

SEQ ID NO: 2283113 - DNA, 16 bp, Homo sapiens
ttaaatgtgcttcatt

SEQ ID NO: 2283114 - DNA, 21 bp, Homo sapiens
ttaaatttaatatactgcata

SEQ ID NO: 2283115 - DNA, 12 bp, Homo sapiens
ttaaatttagtg

SEQ ID NO: 2283116 - DNA, 18 bp, Homo sapiens
ttaaattttaatgtaaaa

SEQ ID NO: 2283117 - DNA, 14 bp, Homo sapiens
ttaacacacatata

SEQ ID NO: 2283118 - DNA, 17 bp, Homo sapiens
ttaacattttgtttcca

SEQ ID NO: 2283119 - DNA, 19 bp, Homo sapiens
ttaacattttgtttccaaa

SEQ ID NO: 2283120 - DNA, 21 bp, Homo sapiens
ttaacattttgtttccaaagc

SEQ ID NO: 2283121 - DNA, 20 bp, Homo sapiens
ttaaccaaattaacctttca

SEQ ID NO: 2283122 - DNA, 14 bp, Homo sapiens
ttaagaaatgtagt

SEQ ID NO: 2283123 - DNA, 18 bp, Homo sapiens
ttaataaagattccatgg

SEQ ID NO: 2283124 - DNA, 21 bp, Homo sapiens
ttaatacgcaggcatctgatt

SEQ ID NO: 2283125 - DNA, 15 bp, Homo sapiens
ttaatacttccttat

SEQ ID NO: 2283126 - DNA, 18 bp, Homo sapiens
ttaatacttccttataaa

SEQ ID NO: 2283127 - DNA, 15 bp, Homo sapiens
ttaatataactgtct

SEQ ID NO: 2283128 - DNA, 18 bp, Homo sapiens
ttaatatactaaccattt

SEQ ID NO: 2283129 - DNA, 14 bp, Homo sapiens
ttaatatactgcat

SEQ ID NO: 2283130 - DNA, 21 bp, Homo sapiens
ttaatcatatcaacttaattc

SEQ ID NO: 2283131 - DNA, 18 bp, Homo sapiens
ttaatctctaaaattcta

SEQ ID NO: 2283132 - DNA, 20 bp, Homo sapiens
ttaatctctaaaattctagt

SEQ ID NO: 2283133 - DNA, 13 bp, Homo sapiens
ttaatgtaaaatt

SEQ ID NO: 2283134 - DNA, 18 bp, Homo sapiens
ttaatgtaaaattcatag

SEQ ID NO: 2283135 - DNA, 11 bp, Homo sapiens
ttaatgtgcca

SEQ ID NO: 2283136 - DNA, 16 bp, Homo sapiens
ttaatgtgccaaaatg

SEQ ID NO: 2283137 - DNA, 22 bp, Homo sapiens
ttaattatattatgaataaaat

SEQ ID NO: 2283138 - DNA, 17 bp, Homo sapiens
ttaattatgctaacaaa

SEQ ID NO: 2283139 - DNA, 17 bp, Homo sapiens
ttaattctcattatgaa

SEQ ID NO: 2283140 - DNA, 21 bp, Homo sapiens
ttaattctcattatgaagatg

SEQ ID NO: 2283141 - DNA, 13 bp, Homo sapiens
ttaattcttctct

SEQ ID NO: 2283142 - DNA, 14 bp, Homo sapiens
ttaattgtgtaact

SEQ ID NO: 2283143 - DNA, 14 bp, Homo sapiens
ttacaaacaaagga

SEQ ID NO: 2283144 - DNA, 22 bp, Homo sapiens
ttacaaacaaaggatttgaaaa

SEQ ID NO: 2283145 - DNA, 16 bp, Homo sapiens
ttacaaatttttactc

SEQ ID NO: 2283146 - DNA, 13 bp, Homo sapiens
ttacaacattaat

SEQ ID NO: 2283147 - DNA, 16 bp, Homo sapiens
ttacaagctatttttg

SEQ ID NO: 2283148 - DNA, 19 bp, Homo sapiens
ttacacggggttacactgt

SEQ ID NO: 2283149 - DNA, 13 bp, Homo sapiens
ttacactgaaatc

SEQ ID NO: 2283150 - DNA, 21 bp, Homo sapiens
ttacactgaaatccaaaatag

SEQ ID NO: 2283151 - DNA, 16 bp, Homo sapiens
ttacaggaagtactgg

SEQ ID NO: 2283152 - DNA, 18 bp, Homo sapiens
ttacaggaagtactggag

SEQ ID NO: 2283153 - DNA, 17 bp, Homo sapiens
ttacaggtgtactatgg

SEQ ID NO: 2283154 - DNA, 20 bp, Homo sapiens
ttacaggtgtgagccacagc

SEQ ID NO: 2283155 - DNA, 13 bp, Homo sapiens
ttacatccagagt

SEQ ID NO: 2283156 - DNA, 19 bp, Homo sapiens
ttacatttgtatttttcca

SEQ ID NO: 2283157 - DNA, 17 bp, Homo sapiens
ttacattttctttcata

SEQ ID NO: 2283158 - DNA, 17 bp, Homo sapiens
ttaccatagttttctca

SEQ ID NO: 2283159 - DNA, 22 bp, Homo sapiens
ttacccgcagatcctgtcccat

SEQ ID NO: 2283160 - DNA, 19 bp, Homo sapiens
ttacctcatgccgctgtgt

SEQ ID NO: 2283161 - DNA, 17 bp, Homo sapiens
ttaccttttataagaca

SEQ ID NO: 2283162 - DNA, 16 bp, Homo sapiens
ttacgacccaggacaa

SEQ ID NO: 2283163 - DNA, 14 bp, Homo sapiens
ttacgctctctgtc

SEQ ID NO: 2283164 - DNA, 15 bp, Homo sapiens
ttacggaggaacaga

SEQ ID NO: 2283165 - DNA, 13 bp, Homo sapiens
ttacgtgagtcct

SEQ ID NO: 2283166 - DNA, 14 bp, Homo sapiens
ttacgtgagtcctg

SEQ ID NO: 2283167 - DNA, 23 bp, Homo sapiens
ttactacataattaaattttaat

SEQ ID NO: 2283168 - DNA, 17 bp, Homo sapiens
ttactcacattctgttg

SEQ ID NO: 2283169 - DNA, 18 bp, Homo sapiens
ttactccaaaaagaaata

SEQ ID NO: 2283170 - DNA, 22 bp, Homo sapiens
ttacttaaatagcatctgctct

SEQ ID NO: 2283171 - DNA, 16 bp, Homo sapiens
ttactttgtggatata

SEQ ID NO: 2283172 - DNA, 21 bp, Homo sapiens
ttagaaagggaaggaaatccc

SEQ ID NO: 2283173 - DNA, 19 bp, Homo sapiens
ttagaacctgcatttaaga

SEQ ID NO: 2283174 - DNA, 14 bp, Homo sapiens
ttagaatctatttt

SEQ ID NO: 2283175 - DNA, 18 bp, Homo sapiens
ttagaatgagggaaacaa

SEQ ID NO: 2283176 - DNA, 18 bp, Homo sapiens
ttagacaaccatagaact

SEQ ID NO: 2283177 - DNA, 23 bp, Homo sapiens
ttagagataaatatttatgcaga

SEQ ID NO: 2283178 - DNA, 16 bp, Homo sapiens
ttagagattaatttgt

SEQ ID NO: 2283179 - DNA, 17 bp, Homo sapiens
ttagaggggcaaaaata

SEQ ID NO: 2283180 - DNA, 21 bp, Homo sapiens
ttagagtatgcaagaagaata

SEQ ID NO: 2283181 - DNA, 21 bp, Homo sapiens
ttagatattcatactttccaa

SEQ ID NO: 2283182 - DNA, 19 bp, Homo sapiens
ttagattgaaatttatgac

SEQ ID NO: 2283183 - DNA, 22 bp, Homo sapiens
ttagcaggaaatagtgttcttt

SEQ ID NO: 2283184 - DNA, 16 bp, Homo sapiens
ttagcattgaaataat

SEQ ID NO: 2283185 - DNA, 23 bp, Homo sapiens
ttagcccggccaaggacactgat

SEQ ID NO: 2283186 - DNA, 14 bp, Homo sapiens
ttagccgggcccca

SEQ ID NO: 2283187 - DNA, 21 bp, Homo sapiens
ttaggaacagagtatatatgt

SEQ ID NO: 2283188 - DNA, 17 bp, Homo sapiens
ttaggggaaaatagtag

SEQ ID NO: 2283189 - DNA, 19 bp, Homo sapiens
ttaggtttggtttggtttt

SEQ ID NO: 2283190 - DNA, 16 bp, Homo sapiens
ttagtaaattattaga

SEQ ID NO: 2283191 - DNA, 19 bp, Homo sapiens
ttagtaatggcagagcagt

SEQ ID NO: 2283192 - DNA, 23 bp, Homo sapiens
ttagtccaatgaagataaatgct

SEQ ID NO: 2283193 - DNA, 13 bp, Homo sapiens
ttagtgagatttg

SEQ ID NO: 2283194 - DNA, 14 bp, Homo sapiens
ttagtgagatttgt

SEQ ID NO: 2283195 - DNA, 17 bp, Homo sapiens
ttagtgagatttgtatt

SEQ ID NO: 2283196 - DNA, 17 bp, Homo sapiens
ttagtgttttaagaaat

SEQ ID NO: 2283197 - DNA, 20 bp, Homo sapiens
ttagttaaattgaagaaagt

SEQ ID NO: 2283198 - DNA, 21 bp, Homo sapiens
ttagttaacacacatatatct

SEQ ID NO: 2283199 - DNA, 24 bp, Homo sapiens
ttagttggagctagaaaatgaact

SEQ ID NO: 2283200 - DNA, 17 bp, Homo sapiens
ttagtttaccaatcaac

SEQ ID NO: 2283201 - DNA, 15 bp, Homo sapiens
ttagtttcaaaatgt

SEQ ID NO: 2283202 - DNA, 12 bp, Homo sapiens
ttataaatgttt

SEQ ID NO: 2283203 - DNA, 16 bp, Homo sapiens
ttataaattataatgc

SEQ ID NO: 2283204 - DNA, 17 bp, Homo sapiens
ttataatccacagtaaa

SEQ ID NO: 2283205 - DNA, 13 bp, Homo sapiens
ttataatttccaa

SEQ ID NO: 2283206 - DNA, 16 bp, Homo sapiens
ttataatttccaaact

SEQ ID NO: 2283207 - DNA, 18 bp, Homo sapiens
ttataggaaataaatcta

SEQ ID NO: 2283208 - DNA, 15 bp, Homo sapiens
ttatagtctgtactt

SEQ ID NO: 2283209 - DNA, 15 bp, Homo sapiens
ttatatacaaagctg

SEQ ID NO: 2283210 - DNA, 12 bp, Homo sapiens
ttatatatataa

SEQ ID NO: 2283211 - DNA, 14 bp, Homo sapiens
ttatatctgtaaat

SEQ ID NO: 2283212 - DNA, 19 bp, Homo sapiens
ttatattagagtgccctta

SEQ ID NO: 2283213 - DNA, 13 bp, Homo sapiens
ttatattatgaat

SEQ ID NO: 2283214 - DNA, 13 bp, Homo sapiens
ttatcaaatcatt

SEQ ID NO: 2283215 - DNA, 15 bp, Homo sapiens
ttatcaaatcattca

SEQ ID NO: 2283216 - DNA, 18 bp, Homo sapiens
ttatcaaatcattcaaaa

SEQ ID NO: 2283217 - DNA, 20 bp, Homo sapiens
ttatcaaatcattcaaaact

SEQ ID NO: 2283218 - DNA, 21 bp, Homo sapiens
ttatcagggcccaaataacag

SEQ ID NO: 2283219 - DNA, 22 bp, Homo sapiens
ttatccatgtactttccctgtg

SEQ ID NO: 2283220 - DNA, 13 bp, Homo sapiens
ttatctccagcca

SEQ ID NO: 2283221 - DNA, 21 bp, Homo sapiens
ttatctccagccaatttcaaa

SEQ ID NO: 2283222 - DNA, 20 bp, Homo sapiens
ttatctgggttttagaaatt

SEQ ID NO: 2283223 - DNA, 20 bp, Homo sapiens
ttcgaggtttacttattttc

SEQ ID NO: 2283224 - DNA, 16 bp, Homo sapiens
ttcgcagaacatgagt

SEQ ID NO: 2283225 - DNA, 22 bp, Homo sapiens
ttcgcctcctccagctcctgcc

SEQ ID NO: 2283226 - DNA, 14 bp, Homo sapiens
ttcgtctcagaagg

SEQ ID NO: 2283227 - DNA, 16 bp, Homo sapiens
ttctaaaaaagatact

SEQ ID NO: 2283228 - DNA, 14 bp, Homo sapiens
ttctaaactgtttt

SEQ ID NO: 2283229 - DNA, 14 bp, Homo sapiens
ttctaaatgtttct

SEQ ID NO: 2283230 - DNA, 21 bp, Homo sapiens
ttctaaatgtttctttttctt

SEQ ID NO: 2283231 - DNA, 20 bp, Homo sapiens
ttctagtcaactgctgtttt

SEQ ID NO: 2283232 - DNA, 22 bp, Homo sapiens
ttctataaattcaacacttatt

SEQ ID NO: 2283233 - DNA, 20 bp, Homo sapiens
ttctataaattgtagaacat

SEQ ID NO: 2283234 - DNA, 17 bp, Homo sapiens
ttctatctgcaaatagt

SEQ ID NO: 2283235 - DNA, 22 bp, Homo sapiens
ttctatgagacctcccccaggg

SEQ ID NO: 2283236 - DNA, 14 bp, Homo sapiens
ttctatgcctgtat

SEQ ID NO: 2283237 - DNA, 13 bp, Homo sapiens
ttctatgtactag

SEQ ID NO: 2283238 - DNA, 21 bp, Homo sapiens
ttctatgtactagtactgtgt

SEQ ID NO: 2283239 - DNA, 16 bp, Homo sapiens
ttctatgtagaactgt

SEQ ID NO: 2283240 - DNA, 17 bp, Homo sapiens
ttctatgttcataaaaa

SEQ ID NO: 2283241 - DNA, 19 bp, Homo sapiens
ttctattggcatggatttc

SEQ ID NO: 2283242 - DNA, 15 bp, Homo sapiens
ttctatttctatctg

SEQ ID NO: 2283243 - DNA, 16 bp, Homo sapiens
ttctcaatgcttttct

SEQ ID NO: 2283244 - DNA, 12 bp, Homo sapiens
ttctcatcttgt

SEQ ID NO: 2283245 - DNA, 19 bp, Homo sapiens
ttctcattatgaagatgtt

SEQ ID NO: 2283246 - DNA, 19 bp, Homo sapiens
ttctccactgtcataatct

SEQ ID NO: 2283247 - DNA, 22 bp, Homo sapiens
ttctccccacaccctggagtgg

SEQ ID NO: 2283248 - DNA, 17 bp, Homo sapiens
ttctcctctttctcagt

SEQ ID NO: 2283249 - DNA, 14 bp, Homo sapiens
ttctcttcctaaat

SEQ ID NO: 2283250 - DNA, 17 bp, Homo sapiens
ttctgagtgaatgttaa

SEQ ID NO: 2283251 - DNA, 20 bp, Homo sapiens
ttctgataagactggaaaat

SEQ ID NO: 2283252 - DNA, 12 bp, Homo sapiens
ttctgcaaacaa

SEQ ID NO: 2283253 - DNA, 13 bp, Homo sapiens
ttctgcaaagtgt

SEQ ID NO: 2283254 - DNA, 22 bp, Homo sapiens
ttctgcaaagtgtatgtgacca

SEQ ID NO: 2283255 - DNA, 16 bp, Homo sapiens
ttctgcagtattctgt

SEQ ID NO: 2283256 - DNA, 18 bp, Homo sapiens
ttctgcagtattctgtag

SEQ ID NO: 2283257 - DNA, 18 bp, Homo sapiens
ttctgctacctggttttc

SEQ ID NO: 2283258 - DNA, 16 bp, Homo sapiens
ttctgtggattctata

SEQ ID NO: 2283259 - DNA, 19 bp, Homo sapiens
ttctgtggattctatattt

SEQ ID NO: 2283260 - DNA, 12 bp, Homo sapiens
ttcttaaaatat

SEQ ID NO: 2283261 - DNA, 14 bp, Homo sapiens
ttcttatttgaaag

SEQ ID NO: 2283262 - DNA, 16 bp, Homo sapiens
ttcttcaactctgaat

SEQ ID NO: 2283263 - DNA, 22 bp, Homo sapiens
ttcttcaactctgaatcaaaag

SEQ ID NO: 2283264 - DNA, 21 bp, Homo sapiens
ttcttcccacccccttgccct

SEQ ID NO: 2283265 - DNA, 21 bp, Homo sapiens
ttcttcccatttgtaatgtat

SEQ ID NO: 2283266 - DNA, 12 bp, Homo sapiens
ttcttgaataaa

SEQ ID NO: 2283267 - DNA, 21 bp, Homo sapiens
ttcttgcggcaccgcccaccc

SEQ ID NO: 2283268 - DNA, 12 bp, Homo sapiens
ttcttgcttgta

SEQ ID NO: 2283269 - DNA, 18 bp, Homo sapiens
ttcttgtgttgttttctc

SEQ ID NO: 2283270 - DNA, 16 bp, Homo sapiens
ttctttaatcaaaagt

SEQ ID NO: 2283271 - DNA, 17 bp, Homo sapiens
ttctttctatgtagaac

SEQ ID NO: 2283272 - DNA, 13 bp, Homo sapiens
ttctttgcagtga

SEQ ID NO: 2283273 - DNA, 15 bp, Homo sapiens
ttcttttatataact

SEQ ID NO: 2283274 - DNA, 14 bp, Homo sapiens
ttcttttatatctg

SEQ ID NO: 2283275 - DNA, 19 bp, Homo sapiens
ttcttttatatctgtaaat

SEQ ID NO: 2283276 - DNA, 12 bp, Homo sapiens
ttcttttgtaag

SEQ ID NO: 2283277 - DNA, 14 bp, Homo sapiens
ttcttttgtaagtg

SEQ ID NO: 2283278 - DNA, 20 bp, Homo sapiens
ttgaaaaaccattttgctgt

SEQ ID NO: 2283279 - DNA, 14 bp, Homo sapiens
ttgaaaagaagaaa

SEQ ID NO: 2283280 - DNA, 19 bp, Homo sapiens
ttgaaaagaagaaagtcta

SEQ ID NO: 2283281 - DNA, 19 bp, Homo sapiens
ttgaaagatggtaatcttt

SEQ ID NO: 2283282 - DNA, 22 bp, Homo sapiens
ttgaaagatggtaatcttttct

SEQ ID NO: 2283283 - DNA, 16 bp, Homo sapiens
ttgaaagtttccttat

SEQ ID NO: 2283284 - DNA, 23 bp, Homo sapiens
ttgaaccgtcaatgtgaaataaa

SEQ ID NO: 2283285 - DNA, 16 bp, Homo sapiens
ttgaactcttggcctc

SEQ ID NO: 2283286 - DNA, 17 bp, Homo sapiens
ttgaactgtggccacct

SEQ ID NO: 2283287 - DNA, 18 bp, Homo sapiens
ttgaagaagggaaattca

SEQ ID NO: 2283288 - DNA, 18 bp, Homo sapiens
ttgaagaatattgttaaa

SEQ ID NO: 2283289 - DNA, 16 bp, Homo sapiens
ttgaagctcaactgtt

SEQ ID NO: 2283290 - DNA, 13 bp, Homo sapiens
ttgaagtcttgta

SEQ ID NO: 2283291 - DNA, 19 bp, Homo sapiens
ttgaatgtccccattctat

SEQ ID NO: 2283292 - DNA, 12 bp, Homo sapiens
ttgaattacaac

SEQ ID NO: 2283293 - DNA, 16 bp, Homo sapiens
ttgacatcaactgcat

SEQ ID NO: 2283294 - DNA, 11 bp, Homo sapiens
ttgaccaggct

SEQ ID NO: 2283295 - DNA, 13 bp, Homo sapiens
ttgagaataaatg

SEQ ID NO: 2283296 - DNA, 13 bp, Homo sapiens
ttgagactgctag

SEQ ID NO: 2283297 - DNA, 22 bp, Homo sapiens
ttgagagcctctatgtgcaagg

SEQ ID NO: 2283298 - DNA, 22 bp, Homo sapiens
ttgagatactttttcttttgta

SEQ ID NO: 2283299 - DNA, 19 bp, Homo sapiens
ttgagcacaggcaacatta

SEQ ID NO: 2283300 - DNA, 22 bp, Homo sapiens
ttgaggacctccacctgggaga

SEQ ID NO: 2283301 - DNA, 23 bp, Homo sapiens
ttgaggacctccacctgggagat

SEQ ID NO: 2283302 - DNA, 12 bp, Homo sapiens
ttgatatgtaac

SEQ ID NO: 2283303 - DNA, 13 bp, Homo sapiens
ttgatatgtaaca

SEQ ID NO: 2283304 - DNA, 22 bp, Homo sapiens
ttgatgaccaatctctgtgact

SEQ ID NO: 2283305 - DNA, 23 bp, Homo sapiens
ttgatgttctttcacccttttct

SEQ ID NO: 2283306 - DNA, 23 bp, Homo sapiens
ttgattccactgaaacctctgtt

SEQ ID NO: 2283307 - DNA, 12 bp, Homo sapiens
ttgcaaagaact

SEQ ID NO: 2283308 - DNA, 19 bp, Homo sapiens
ttgcaaagaactccagagt

SEQ ID NO: 2283309 - DNA, 22 bp, Homo sapiens
ttgcaaatgaatgcctttcaaa

SEQ ID NO: 2283310 - DNA, 20 bp, Homo sapiens
ttgcaaatgcacatttgtca

SEQ ID NO: 2283311 - DNA, 19 bp, Homo sapiens
ttgcacttctgttatcagg

SEQ ID NO: 2283312 - DNA, 14 bp, Homo sapiens
ttgcagagtaaatc

SEQ ID NO: 2283313 - DNA, 14 bp, Homo sapiens
ttgcagcagtacca

SEQ ID NO: 2283314 - DNA, 15 bp, Homo sapiens
ttgcagtatcagagg

SEQ ID NO: 2283315 - DNA, 14 bp, Homo sapiens
ttgcagtgaagatg

SEQ ID NO: 2283316 - DNA, 13 bp, Homo sapiens
ttgcatattcatt

SEQ ID NO: 2283317 - DNA, 15 bp, Homo sapiens
ttgcattcttttggc

SEQ ID NO: 2283318 - DNA, 20 bp, Homo sapiens
ttgcatttctcttcctaaat

SEQ ID NO: 2283319 - DNA, 17 bp, Homo sapiens
ttgccagacagagatca

SEQ ID NO: 2283320 - DNA, 17 bp, Homo sapiens
ttgcccagttcatccca

SEQ ID NO: 2283321 - DNA, 16 bp, Homo sapiens
ttgcctttggttcccc

SEQ ID NO: 2283322 - DNA, 20 bp, Homo sapiens
ttgctaataccaactatttc

SEQ ID NO: 2283323 - DNA, 23 bp, Homo sapiens
ttgctaataccaactatttcaat

SEQ ID NO: 2283324 - DNA, 23 bp, Homo sapiens
ttgctagtgatacactgtatcta

SEQ ID NO: 2283325 - DNA, 17 bp, Homo sapiens
ttgctattgtttatagg

SEQ ID NO: 2283326 - DNA, 20 bp, Homo sapiens
ttgctcaccaagctgttcca

SEQ ID NO: 2283327 - DNA, 18 bp, Homo sapiens
ttgcttgtacctctggct

SEQ ID NO: 2283328 - DNA, 11 bp, Homo sapiens
ttggaatgttg

SEQ ID NO: 2283329 - DNA, 13 bp, Homo sapiens
ttggaatgttgtt

SEQ ID NO: 2283330 - DNA, 16 bp, Homo sapiens
ttggaatgttgttaaa

SEQ ID NO: 2283331 - DNA, 21 bp, Homo sapiens
ttggacagctgactgaatgca

SEQ ID NO: 2283332 - DNA, 12 bp, Homo sapiens
ttggatcttttt

SEQ ID NO: 2283333 - DNA, 12 bp, Homo sapiens
ttggattcacag

SEQ ID NO: 2283334 - DNA, 16 bp, Homo sapiens
ttggcagtggcagaga

SEQ ID NO: 2283335 - DNA, 21 bp, Homo sapiens
ttggcatggatttcctttgac

SEQ ID NO: 2283336 - DNA, 15 bp, Homo sapiens
ttggccggctggccg

SEQ ID NO: 2283337 - DNA, 14 bp, Homo sapiens
ttggctcagagtcc

SEQ ID NO: 2283338 - DNA, 15 bp, Homo sapiens
ttggctcagagtcca

SEQ ID NO: 2283339 - DNA, 15 bp, Homo sapiens
ttggctcgctgtggt

SEQ ID NO: 2283340 - DNA, 16 bp, Homo sapiens
ttggctcgctgtggtt

SEQ ID NO: 2283341 - DNA, 12 bp, Homo sapiens
ttggctctgagg

SEQ ID NO: 2283342 - DNA, 11 bp, Homo sapiens
ttgggcagagc

SEQ ID NO: 2283343 - DNA, 18 bp, Homo sapiens
ttggtaaaggtatgtaaa

SEQ ID NO: 2283344 - DNA, 16 bp, Homo sapiens
ttggtaatgtgtcaaa

SEQ ID NO: 2283345 - DNA, 21 bp, Homo sapiens
ttggtcctgcctaaatttcac

SEQ ID NO: 2283346 - DNA, 14 bp, Homo sapiens
ttggtgaataacct

SEQ ID NO: 2283347 - DNA, 23 bp, Homo sapiens
ttggtggccgcaaccacttgcta

SEQ ID NO: 2283348 - DNA, 17 bp, Homo sapiens
ttggtgtcgggcatgac

SEQ ID NO: 2283349 - DNA, 18 bp, Homo sapiens
ttggtgtcgggcatgaca

SEQ ID NO: 2283350 - DNA, 19 bp, Homo sapiens
ttggtgtcgggcatgacac

SEQ ID NO: 2283351 - DNA, 20 bp, Homo sapiens
ttgtaaggaatgattaatta

SEQ ID NO: 2283352 - DNA, 21 bp, Homo sapiens
ttgtaagtgctacataaattg

SEQ ID NO: 2283353 - DNA, 15 bp, Homo sapiens
ttgtaatatacagtt

SEQ ID NO: 2283354 - DNA, 17 bp, Homo sapiens
ttgtacatatggaaatc

SEQ ID NO: 2283355 - DNA, 16 bp, Homo sapiens
ttgtaccatatgtagc

SEQ ID NO: 2283356 - DNA, 12 bp, Homo sapiens
tttctgcatttg

SEQ ID NO: 2283357 - DNA, 17 bp, Homo sapiens
tttctgctacctggttt

SEQ ID NO: 2283358 - DNA, 22 bp, Homo sapiens
tttctgtcctcaggtgaataac

SEQ ID NO: 2283359 - DNA, 20 bp, Homo sapiens
tttcttagatggagaagttg

SEQ ID NO: 2283360 - DNA, 16 bp, Homo sapiens
tttcttcccatttgta

SEQ ID NO: 2283361 - DNA, 22 bp, Homo sapiens
tttcttgcttgtacctctggct

SEQ ID NO: 2283362 - DNA, 21 bp, Homo sapiens
tttcttggatctttttgcaga

SEQ ID NO: 2283363 - DNA, 14 bp, Homo sapiens
tttctttctatgta

SEQ ID NO: 2283364 - DNA, 16 bp, Homo sapiens
tttcttttatatctgt

SEQ ID NO: 2283365 - DNA, 13 bp, Homo sapiens
tttctttttctgt

SEQ ID NO: 2283366 - DNA, 19 bp, Homo sapiens
tttcttttttgagtgtgca

SEQ ID NO: 2283367 - DNA, 20 bp, Homo sapiens
tttgaaagaagtcaaatgaa

SEQ ID NO: 2283368 - DNA, 21 bp, Homo sapiens
tttgaagactgattttaaaac

SEQ ID NO: 2283369 - DNA, 14 bp, Homo sapiens
tttgaagtcttgta

SEQ ID NO: 2283370 - DNA, 16 bp, Homo sapiens
tttgaagtcttgtata

SEQ ID NO: 2283371 - DNA, 19 bp, Homo sapiens
tttgactgtgctggagaat

SEQ ID NO: 2283372 - DNA, 13 bp, Homo sapiens
tttgagtgcctta

SEQ ID NO: 2283373 - DNA, 17 bp, Homo sapiens
tttgatttttttgttca

SEQ ID NO: 2283374 - DNA, 14 bp, Homo sapiens
tttgcagtgaagat

SEQ ID NO: 2283375 - DNA, 19 bp, Homo sapiens
tttgcatttctcttcctaa

SEQ ID NO: 2283376 - DNA, 19 bp, Homo sapiens
tttgccatagcagtgctag

SEQ ID NO: 2283377 - DNA, 12 bp, Homo sapiens
tttgcctttggt

SEQ ID NO: 2283378 - DNA, 23 bp, Homo sapiens
tttgctaataccaactatttcaa

SEQ ID NO: 2283379 - DNA, 18 bp, Homo sapiens
tttgcttatttatattca

SEQ ID NO: 2283380 - DNA, 19 bp, Homo sapiens
tttggctcgctgtggtttc

SEQ ID NO: 2283381 - DNA, 11 bp, Homo sapiens
tttgggcagag

SEQ ID NO: 2283382 - DNA, 12 bp, Homo sapiens
tttgggcagagc

SEQ ID NO: 2283383 - DNA, 15 bp, Homo sapiens
tttggggggagaaac

SEQ ID NO: 2283384 - DNA, 15 bp, Homo sapiens
tttggtaatgtgtca

SEQ ID NO: 2283385 - DNA, 13 bp, Homo sapiens
tttggtgaggacc

SEQ ID NO: 2283386 - DNA, 19 bp, Homo sapiens
tttgtaaatgttatttctg

SEQ ID NO: 2283387 - DNA, 18 bp, Homo sapiens
tttgtaactattcttcag

SEQ ID NO: 2283388 - DNA, 21 bp, Homo sapiens
tttgtaagtgctacataaatt

SEQ ID NO: 2283389 - DNA, 18 bp, Homo sapiens
tttgtaatgtatcttatt

SEQ ID NO: 2283390 - DNA, 21 bp, Homo sapiens
tttgtaatgtatcttatttat

SEQ ID NO: 2283391 - DNA, 20 bp, Homo sapiens
tttgtattattgctgttgct

SEQ ID NO: 2283392 - DNA, 23 bp, Homo sapiens
tttgtattattgctgttgcttga

SEQ ID NO: 2283393 - DNA, 18 bp, Homo sapiens
tttgtatttatattagag

SEQ ID NO: 2283394 - DNA, 17 bp, Homo sapiens
tttgtcataaaatgcta

SEQ ID NO: 2283395 - DNA, 23 bp, Homo sapiens
tttgtgtattctgtggattctat

SEQ ID NO: 2283396 - DNA, 15 bp, Homo sapiens
tttgttttctttttc

SEQ ID NO: 2283397 - DNA, 20 bp, Homo sapiens
ttttaaaaaaaatattctgt

SEQ ID NO: 2283398 - DNA, 21 bp, Homo sapiens
ttttaaaaaataacatattct

SEQ ID NO: 2283399 - DNA, 15 bp, Homo sapiens
ttttaaaaataaatg

SEQ ID NO: 2283400 - DNA, 18 bp, Homo sapiens
ttttaaaatgcaaatatt

SEQ ID NO: 2283401 - DNA, 13 bp, Homo sapiens
ttttaatatacta

SEQ ID NO: 2283402 - DNA, 21 bp, Homo sapiens
ttttactcaggctttctattg

SEQ ID NO: 2283403 - DNA, 15 bp, Homo sapiens
ttttactgtctgtaa

SEQ ID NO: 2283404 - DNA, 12 bp, Homo sapiens
ttttagaaattc

SEQ ID NO: 2283405 - DNA, 16 bp, Homo sapiens
ttttagagataaatat

SEQ ID NO: 2283406 - DNA, 20 bp, Homo sapiens
ttttagaggggcaaaaatat

SEQ ID NO: 2283407 - DNA, 13 bp, Homo sapiens
ttttagatttctt

SEQ ID NO: 2283408 - DNA, 17 bp, Homo sapiens
ttttagcggtttgcaaa

SEQ ID NO: 2283409 - DNA, 17 bp, Homo sapiens
ttttagtttcaaaatgt

SEQ ID NO: 2283410 - DNA, 17 bp, Homo sapiens
ttttataaattataatg

SEQ ID NO: 2283411 - DNA, 21 bp, Homo sapiens
ttttataagacaaaatttaat

SEQ ID NO: 2283412 - DNA, 14 bp, Homo sapiens
ttttatatctgtaa

SEQ ID NO: 2283413 - DNA, 21 bp, Homo sapiens
ttttatgtcatactctgtgta

SEQ ID NO: 2283414 - DNA, 23 bp, Homo sapiens
ttttccatttatttattcatgtg

SEQ ID NO: 2283415 - DNA, 22 bp, Homo sapiens
ttttcccgtatgctttcttcat

SEQ ID NO: 2283416 - DNA, 15 bp, Homo sapiens
ttttccttcagtgcc

SEQ ID NO: 2283417 - DNA, 19 bp, Homo sapiens
ttttcgccaaggctcacat

SEQ ID NO: 2283418 - DNA, 16 bp, Homo sapiens
ttttcgtgcatttgtg

SEQ ID NO: 2283419 - DNA, 15 bp, Homo sapiens
ttttctaaactgttt

SEQ ID NO: 2283420 - DNA, 22 bp, Homo sapiens
ttttctaaactgttttcatgtg

SEQ ID NO: 2283421 - DNA, 14 bp, Homo sapiens
ttttctaaatgttt

SEQ ID NO: 2283422 - DNA, 13 bp, Homo sapiens
ttttctactcgag

SEQ ID NO: 2283423 - DNA, 24 bp, Homo sapiens
ttttctagcaactgttggataata

SEQ ID NO: 2283424 - DNA, 15 bp, Homo sapiens
ttttctatatttgga

SEQ ID NO: 2283425 - DNA, 21 bp, Homo sapiens
ttttctatgtactagtactgt

SEQ ID NO: 2283426 - DNA, 18 bp, Homo sapiens
ttttctgctacctggttt

SEQ ID NO: 2283427 - DNA, 13 bp, Homo sapiens
ttttcttatttag

SEQ ID NO: 2283428 - DNA, 20 bp, Homo sapiens
ttttcttcccatttgtaatg

SEQ ID NO: 2283429 - DNA, 22 bp, Homo sapiens
ttttcttgtgtgtttattgtca

SEQ ID NO: 2283430 - DNA, 16 bp, Homo sapiens
ttttctttaatcaaaa

SEQ ID NO: 2283431 - DNA, 15 bp, Homo sapiens
ttttctttctatgta

SEQ ID NO: 2283432 - DNA, 22 bp, Homo sapiens
ttttctttctatgtagaactgt

SEQ ID NO: 2283433 - DNA, 18 bp, Homo sapiens
ttttcttttttgagtgtg

SEQ ID NO: 2283434 - DNA, 20 bp, Homo sapiens
ttttgaaatttaaaaatctt

SEQ ID NO: 2283435 - DNA, 17 bp, Homo sapiens
ttttgagtgccttacac

SEQ ID NO: 2283436 - DNA, 22 bp, Homo sapiens
ttttgcatttctcttcctaaat

SEQ ID NO: 2283437 - DNA, 13 bp, Homo sapiens
ttttgcctttggt

SEQ ID NO: 2283438 - DNA, 12 bp, Homo sapiens
ttttgcttttta

SEQ ID NO: 2283439 - DNA, 14 bp, Homo sapiens
ttttggctcagagt

SEQ ID NO: 2283440 - DNA, 16 bp, Homo sapiens
ttttggctcagagtcc

SEQ ID NO: 2283441 - DNA, 18 bp, Homo sapiens
ttttgtcataaaatgcta

SEQ ID NO: 2283442 - DNA, 22 bp, Homo sapiens
ttttgtcataaaatgctatttt

SEQ ID NO: 2283443 - DNA, 13 bp, Homo sapiens
ttttgtcttcaac

SEQ ID NO: 2283444 - DNA, 21 bp, Homo sapiens
ttttgtggcatgttgtaacat

SEQ ID NO: 2283445 - DNA, 16 bp, Homo sapiens
ttttgtgtattctgtg

SEQ ID NO: 2283446 - DNA, 19 bp, Homo sapiens
tttttaaaaagttgcacat

SEQ ID NO: 2283447 - DNA, 21 bp, Homo sapiens
tttttaaaattgtgttcttaa

SEQ ID NO: 2283448 - DNA, 21 bp, Homo sapiens
tttttaaactgatgtatagct

SEQ ID NO: 2283449 - DNA, 13 bp, Homo sapiens
tttttaaatcatt

SEQ ID NO: 2283450 - DNA, 22 bp, Homo sapiens
tttttactcaggctttctattg

SEQ ID NO: 2283451 - DNA, 14 bp, Homo sapiens
tttttctagctata

SEQ ID NO: 2283452 - DNA, 22 bp, Homo sapiens
tttttgagtgtgcaatatgtaa

SEQ ID NO: 2283453 - DNA, 19 bp, Homo sapiens
tttttgtagagacagggtc

SEQ ID NO: 2283454 - DNA, 12 bp, Homo sapiens
ttttttcaatgt

SEQ ID NO: 2283455 - DNA, 17 bp, Homo sapiens
ttttttccttcagtgcc

SEQ ID NO: 2283456 - DNA, 13 bp, Homo sapiens
tttttttctagct

SEQ ID NO: 2283457 - DNA, 14 bp, Homo sapiens
aaaagttgcacatt

SEQ ID NO: 2283458 - DNA, 16 bp, Homo sapiens
aaaagttgcacattag

SEQ ID NO: 2283459 - DNA, 13 bp, Homo sapiens
aaaataaatgaaa

SEQ ID NO: 2283460 - DNA, 13 bp, Homo sapiens
aaaataaattatg

SEQ ID NO: 2283461 - DNA, 22 bp, Homo sapiens
aaaataacaactgagatgttaa

SEQ ID NO: 2283462 - DNA, 19 bp, Homo sapiens
aaaataacatctgaaaaga

SEQ ID NO: 2283463 - DNA, 14 bp, Homo sapiens
aaaataatgattta

SEQ ID NO: 2283464 - DNA, 18 bp, Homo sapiens
aaaataattagctatatt

SEQ ID NO: 2283465 - DNA, 13 bp, Homo sapiens
aaaataattgggt

SEQ ID NO: 2283466 - DNA, 16 bp, Homo sapiens
aaaataatttagatat

SEQ ID NO: 2283467 - DNA, 20 bp, Homo sapiens
aaaatacataaaagaatgta

SEQ ID NO: 2283468 - DNA, 22 bp, Homo sapiens
aaaatacataaaagaatgtaca

SEQ ID NO: 2283469 - DNA, 16 bp, Homo sapiens
aaaatagaatatataa

SEQ ID NO: 2283470 - DNA, 16 bp, Homo sapiens
aaaataggtgcattgt

SEQ ID NO: 2283471 - DNA, 14 bp, Homo sapiens
aaaatagttctatt

SEQ ID NO: 2283472 - DNA, 18 bp, Homo sapiens
aaaatagttctatttcta

SEQ ID NO: 2283473 - DNA, 19 bp, Homo sapiens
aaaatagtttaaaaatatt

SEQ ID NO: 2283474 - DNA, 14 bp, Homo sapiens
aaaatattctccat

SEQ ID NO: 2283475 - DNA, 11 bp, Homo sapiens
aaaatattctg

SEQ ID NO: 2283476 - DNA, 14 bp, Homo sapiens
aaaatattctgtca

SEQ ID NO: 2283477 - DNA, 16 bp, Homo sapiens
aaaatattgtgtaaga

SEQ ID NO: 2283478 - DNA, 17 bp, Homo sapiens
aaaatatttctaagctt

SEQ ID NO: 2283479 - DNA, 18 bp, Homo sapiens
aaaatatttttatgtgaa

SEQ ID NO: 2283480 - DNA, 21 bp, Homo sapiens
aaaatatttttatgtgaaggt

SEQ ID NO: 2283481 - DNA, 19 bp, Homo sapiens
aaaatatttttttctagct

SEQ ID NO: 2283482 - DNA, 22 bp, Homo sapiens
aaaatctttcagaatacaattc

SEQ ID NO: 2283483 - DNA, 16 bp, Homo sapiens
aaaatgaactgtatat

SEQ ID NO: 2283484 - DNA, 22 bp, Homo sapiens
aaaatgggaagcattagttgga

SEQ ID NO: 2283485 - DNA, 18 bp, Homo sapiens
aaaatgtaggctttcatg

SEQ ID NO: 2283486 - DNA, 16 bp, Homo sapiens
aaaatgtttacatttt

SEQ ID NO: 2283487 - DNA, 13 bp, Homo sapiens
aaaattatgaaaa

SEQ ID NO: 2283488 - DNA, 11 bp, Homo sapiens
aaaattcttgt

SEQ ID NO: 2283489 - DNA, 22 bp, Homo sapiens
aaaattgcatttttacctttca

SEQ ID NO: 2283490 - DNA, 17 bp, Homo sapiens
aaaattgtgttcttaaa

SEQ ID NO: 2283491 - DNA, 22 bp, Homo sapiens
aaaattgtgttcttaaaatatt

SEQ ID NO: 2283492 - DNA, 15 bp, Homo sapiens
aaaattgttatttca

SEQ ID NO: 2283493 - DNA, 18 bp, Homo sapiens
aaaatttaaaaagcccaa

SEQ ID NO: 2283494 - DNA, 19 bp, Homo sapiens
aaaatttaaaaagcccaac

SEQ ID NO: 2283495 - DNA, 20 bp, Homo sapiens
aaaatttaattgtgtaactg

SEQ ID NO: 2283496 - DNA, 17 bp, Homo sapiens
aaacaaaaatagaatat

SEQ ID NO: 2283497 - DNA, 13 bp, Homo sapiens
aaacaaagtcttt

SEQ ID NO: 2283498 - DNA, 18 bp, Homo sapiens
aaacaactgccaaataaa

SEQ ID NO: 2283499 - DNA, 16 bp, Homo sapiens
aaacacccaagcacaa

SEQ ID NO: 2283500 - DNA, 19 bp, Homo sapiens
aaacactgcttaaggaaaa

SEQ ID NO: 2283501 - DNA, 12 bp, Homo sapiens
aaacactgtgta

SEQ ID NO: 2283502 - DNA, 22 bp, Homo sapiens
aaacagaaacgagatttgccaa

SEQ ID NO: 2283503 - DNA, 14 bp, Homo sapiens
aaacataagacgac

SEQ ID NO: 2283504 - DNA, 14 bp, Homo sapiens
aaacataatatctt

SEQ ID NO: 2283505 - DNA, 13 bp, Homo sapiens
aaacattgagact

SEQ ID NO: 2283506 - DNA, 18 bp, Homo sapiens
aaaccaattaagcagctt

SEQ ID NO: 2283507 - DNA, 20 bp, Homo sapiens
aaaccacctgtccccagtta

SEQ ID NO: 2283508 - DNA, 14 bp, Homo sapiens
aaacccttcagtgc

SEQ ID NO: 2283509 - DNA, 22 bp, Homo sapiens
aaacctgtgtctctgagagtag

SEQ ID NO: 2283510 - DNA, 16 bp, Homo sapiens
aaacgagatttgccaa

SEQ ID NO: 2283511 - DNA, 16 bp, Homo sapiens
aaactaaaattcaaca

SEQ ID NO: 2283512 - DNA, 16 bp, Homo sapiens
aaactaaggtcagaag

SEQ ID NO: 2283513 - DNA, 13 bp, Homo sapiens
aaactgaaaaatc

SEQ ID NO: 2283514 - DNA, 15 bp, Homo sapiens
aaactgaaaaatcta

SEQ ID NO: 2283515 - DNA, 13 bp, Homo sapiens
aaactgatgtata

SEQ ID NO: 2283516 - DNA, 13 bp, Homo sapiens
aaactgatttttt

SEQ ID NO: 2283517 - DNA, 21 bp, Homo sapiens
aaactgggtatgcgtttcatg

SEQ ID NO: 2283518 - DNA, 18 bp, Homo sapiens
aaactgtaccctatgttc

SEQ ID NO: 2283519 - DNA, 20 bp, Homo sapiens
aaactgtttatggtattttc

SEQ ID NO: 2283520 - DNA, 15 bp, Homo sapiens
aaactgttttcatgt

SEQ ID NO: 2283521 - DNA, 21 bp, Homo sapiens
aaacttactgtcagagaatat

SEQ ID NO: 2283522 - DNA, 16 bp, Homo sapiens
aaacttataatttcca

SEQ ID NO: 2283523 - DNA, 19 bp, Homo sapiens
aaacttataatttccaaac

SEQ ID NO: 2283524 - DNA, 22 bp, Homo sapiens
aaacttgaacaagaaattggta

SEQ ID NO: 2283525 - DNA, 23 bp, Homo sapiens
aaacttgtacttacactgaaatc

SEQ ID NO: 2283526 - DNA, 19 bp, Homo sapiens
aaacttgtgtatgatccaa

SEQ ID NO: 2283527 - DNA, 15 bp, Homo sapiens
aaagaaaaaaatagt

SEQ ID NO: 2283528 - DNA, 13 bp, Homo sapiens
aaagaaaacagac

SEQ ID NO: 2283529 - DNA, 16 bp, Homo sapiens
aaagaagaaagtctat

SEQ ID NO: 2283530 - DNA, 15 bp, Homo sapiens
aaagaatagaaggat

SEQ ID NO: 2283531 - DNA, 13 bp, Homo sapiens
aaagaatgtacag

SEQ ID NO: 2283532 - DNA, 20 bp, Homo sapiens
aaagacaaatatttctttct

SEQ ID NO: 2283533 - DNA, 16 bp, Homo sapiens
aaagacatttaaaata

SEQ ID NO: 2283534 - DNA, 20 bp, Homo sapiens
aaagacatttaaaatagttt

SEQ ID NO: 2283535 - DNA, 13 bp, Homo sapiens
aaagacatttcat

SEQ ID NO: 2283536 - DNA, 23 bp, Homo sapiens
aaagacatttcatccaccaatat

SEQ ID NO: 2283537 - DNA, 14 bp, Homo sapiens
aaagagaaacacta

SEQ ID NO: 2283538 - DNA, 22 bp, Homo sapiens
aaagaggcgtcttgtattttct

SEQ ID NO: 2283539 - DNA, 18 bp, Homo sapiens
aaagataaggcaacaaaa

SEQ ID NO: 2283540 - DNA, 21 bp, Homo sapiens
aaagatctcggtgctgaacga

SEQ ID NO: 2283541 - DNA, 21 bp, Homo sapiens
aaagatggtaatcttttctga

SEQ ID NO: 2283542 - DNA, 20 bp, Homo sapiens
aaagcagagatgtattatgg

SEQ ID NO: 2283543 - DNA, 13 bp, Homo sapiens
aaagcagggcagc

SEQ ID NO: 2283544 - DNA, 20 bp, Homo sapiens
aaagcccaacctcttcctcc

SEQ ID NO: 2283545 - DNA, 13 bp, Homo sapiens
aaagctgctatcc

SEQ ID NO: 2283546 - DNA, 18 bp, Homo sapiens
aaagctgctatccaatga

SEQ ID NO: 2283547 - DNA, 20 bp, Homo sapiens
aaagctgctatccaatgata

SEQ ID NO: 2283548 - DNA, 15 bp, Homo sapiens
aaagctttagattga

SEQ ID NO: 2283549 - DNA, 21 bp, Homo sapiens
aaaggaaagttctattatctg

SEQ ID NO: 2283550 - DNA, 19 bp, Homo sapiens
aaaggggatcataaagtta

SEQ ID NO: 2283551 - DNA, 20 bp, Homo sapiens
aaaggtcacctcactcagca

SEQ ID NO: 2283552 - DNA, 16 bp, Homo sapiens
aaagtaaaattagagc

SEQ ID NO: 2283553 - DNA, 18 bp, Homo sapiens
aaagtaataactgttaga

SEQ ID NO: 2283554 - DNA, 21 bp, Homo sapiens
aaagtagaaaaaaaaataaca

SEQ ID NO: 2283555 - DNA, 20 bp, Homo sapiens
aaagtatctctactttcctg

SEQ ID NO: 2283556 - DNA, 14 bp, Homo sapiens
aaagtctatgctta

SEQ ID NO: 2283557 - DNA, 23 bp, Homo sapiens
aaagtctttggggtctacactgc

SEQ ID NO: 2283558 - DNA, 14 bp, Homo sapiens
aaagtgctgggatt

SEQ ID NO: 2283559 - DNA, 14 bp, Homo sapiens
aaagtgcttccttt

SEQ ID NO: 2283560 - DNA, 15 bp, Homo sapiens
aaagtggaatttctt

SEQ ID NO: 2283561 - DNA, 22 bp, Homo sapiens
aaagtggaatttcttgtttctc

SEQ ID NO: 2283562 - DNA, 18 bp, Homo sapiens
aaagtgtacaattttcat

SEQ ID NO: 2283563 - DNA, 20 bp, Homo sapiens
aaagttagaatctattttct

SEQ ID NO: 2283564 - DNA, 21 bp, Homo sapiens
aaagtttcattagtcatattt

SEQ ID NO: 2283565 - DNA, 17 bp, Homo sapiens
aaataaaaataattggg

SEQ ID NO: 2283566 - DNA, 20 bp, Homo sapiens
aaataaaaatattctccatg

SEQ ID NO: 2283567 - DNA, 12 bp, Homo sapiens
aaataaaacaat

SEQ ID NO: 2283568 - DNA, 17 bp, Homo sapiens
aaataaagactcttgga

SEQ ID NO: 2283569 - DNA, 13 bp, Homo sapiens
aaataacacttaa

SEQ ID NO: 2283570 - DNA, 15 bp, Homo sapiens
aaataagcgtttaat

SEQ ID NO: 2283571 - DNA, 23 bp, Homo sapiens
aaataatctcatccccaaactgt

SEQ ID NO: 2283572 - DNA, 19 bp, Homo sapiens
aaataatgatcttccaaat

SEQ ID NO: 2283573 - DNA, 17 bp, Homo sapiens
aaataatgattcaatgt

SEQ ID NO: 2283574 - DNA, 15 bp, Homo sapiens
aaatacactacaaat

SEQ ID NO: 2283575 - DNA, 16 bp, Homo sapiens
aaatacactacaaatg

SEQ ID NO: 2283576 - DNA, 17 bp, Homo sapiens
aaatacactacaaatgt

SEQ ID NO: 2283577 - DNA, 18 bp, Homo sapiens
aaatacactacaaatgtt

SEQ ID NO: 2283578 - DNA, 19 bp, Homo sapiens
aaatacataaaagaatgta

SEQ ID NO: 2283579 - DNA, 14 bp, Homo sapiens
aaatactcaccaaa

SEQ ID NO: 2283580 - DNA, 17 bp, Homo sapiens
aaatactggaattcaaa

SEQ ID NO: 2283581 - DNA, 15 bp, Homo sapiens
aaatagatatatttt

SEQ ID NO: 2283582 - DNA, 16 bp, Homo sapiens
aaatagtcatgtttct

SEQ ID NO: 2283583 - DNA, 19 bp, Homo sapiens
aaatagtcatgtttctgca

SEQ ID NO: 2283584 - DNA, 21 bp, Homo sapiens
aaatagtgttctttttaaaaa

SEQ ID NO: 2283585 - DNA, 17 bp, Homo sapiens
aaatagtgttgatcaga

SEQ ID NO: 2283586 - DNA, 18 bp, Homo sapiens
aaatagttccattctatg

SEQ ID NO: 2283587 - DNA, 15 bp, Homo sapiens
aaatagttctatttc

SEQ ID NO: 2283588 - DNA, 16 bp, Homo sapiens
aaatagttctatttct

SEQ ID NO: 2283589 - DNA, 17 bp, Homo sapiens
aaatagttctatttcta

SEQ ID NO: 2283590 - DNA, 18 bp, Homo sapiens
aaatagttctatttctat

SEQ ID NO: 2283591 - DNA, 18 bp, Homo sapiens
aaatagtttcaaatgagt

SEQ ID NO: 2283592 - DNA, 21 bp, Homo sapiens
aaatagtttcaaatgagttta

SEQ ID NO: 2283593 - DNA, 21 bp, Homo sapiens
aaatagttttctaaatgtttc

SEQ ID NO: 2283594 - DNA, 12 bp, Homo sapiens
aaatataaaata

SEQ ID NO: 2283595 - DNA, 15 bp, Homo sapiens
aaatataaaatacat

SEQ ID NO: 2283596 - DNA, 14 bp, Homo sapiens
aaatataaacttgt

SEQ ID NO: 2283597 - DNA, 14 bp, Homo sapiens
aaatatacaaacat

SEQ ID NO: 2283598 - DNA, 15 bp, Homo sapiens
aaatatacagcatga

SEQ ID NO: 2283599 - DNA, 13 bp, Homo sapiens
aaatatagtagca

SEQ ID NO: 2283600 - DNA, 14 bp, Homo sapiens
aaatattatctgaa

SEQ ID NO: 2283601 - DNA, 17 bp, Homo sapiens
aaatattctaaaaaaga

SEQ ID NO: 2283602 - DNA, 19 bp, Homo sapiens
aaatattgctattgtttat

SEQ ID NO: 2283603 - DNA, 20 bp, Homo sapiens
aaatatttcaataacttaga

SEQ ID NO: 2283604 - DNA, 17 bp, Homo sapiens
aaatatttttatgtgaa

SEQ ID NO: 2283605 - DNA, 16 bp, Homo sapiens
aaatatttttttctag

SEQ ID NO: 2283606 - DNA, 18 bp, Homo sapiens
aaatatttttttctagct

SEQ ID NO: 2283607 - DNA, 19 bp, Homo sapiens
aaatatttttttctagcta

SEQ ID NO: 2283608 - DNA, 16 bp, Homo sapiens
aaatcactatgggtga

SEQ ID NO: 2283609 - DNA, 22 bp, Homo sapiens
aaatcatttcatgttagtctta

SEQ ID NO: 2283610 - DNA, 20 bp, Homo sapiens
aaatctggagctggcactgt

SEQ ID NO: 2283611 - DNA, 15 bp, Homo sapiens
aaatctgtctgattc

SEQ ID NO: 2283612 - DNA, 19 bp, Homo sapiens
aaatctgttagcattattg

SEQ ID NO: 2283613 - DNA, 12 bp, Homo sapiens
aaatctttcaga

SEQ ID NO: 2283614 - DNA, 19 bp, Homo sapiens
aaatctttcagaatacaat

SEQ ID NO: 2283615 - DNA, 15 bp, Homo sapiens
aaatctttccatctc

SEQ ID NO: 2283616 - DNA, 15 bp, Homo sapiens
aaatgaactgtatat

SEQ ID NO: 2283617 - DNA, 17 bp, Homo sapiens
aaatgaactgtatatta

SEQ ID NO: 2283618 - DNA, 21 bp, Homo sapiens
aaatgagaaattgtgccaaag

SEQ ID NO: 2283619 - DNA, 20 bp, Homo sapiens
aaatgagggacttccctaga

SEQ ID NO: 2283620 - DNA, 21 bp, Homo sapiens
aaatgagtttaaaaaaataac

SEQ ID NO: 2283621 - DNA, 21 bp, Homo sapiens
aaatgattcatttttctgtta

SEQ ID NO: 2283622 - DNA, 15 bp, Homo sapiens
aaatgcaaacactgt

SEQ ID NO: 2283623 - DNA, 18 bp, Homo sapiens
aaatgcacatttgtcact

SEQ ID NO: 2283624 - DNA, 16 bp, Homo sapiens
aaatgccgctgtgtcc

SEQ ID NO: 2283625 - DNA, 15 bp, Homo sapiens
aaatgctatggaaat

SEQ ID NO: 2283626 - DNA, 18 bp, Homo sapiens
aaatgctatggaaataca

SEQ ID NO: 2283627 - DNA, 19 bp, Homo sapiens
aaatgctatggaaatacat

SEQ ID NO: 2283628 - DNA, 17 bp, Homo sapiens
aaatgctattttaaaat

SEQ ID NO: 2283629 - DNA, 19 bp, Homo sapiens
aaatggacctatctgtaag

SEQ ID NO: 2283630 - DNA, 15 bp, Homo sapiens
aaatggacgtgttat

SEQ ID NO: 2283631 - DNA, 20 bp, Homo sapiens
aaatggacgtgttatgactc

SEQ ID NO: 2283632 - DNA, 22 bp, Homo sapiens
aaatggacgtgttatgactcca

SEQ ID NO: 2283633 - DNA, 20 bp, Homo sapiens
aaatggtagaagatgaatca

SEQ ID NO: 2283634 - DNA, 17 bp, Homo sapiens
aaatgtgagctataatg

SEQ ID NO: 2283635 - DNA, 18 bp, Homo sapiens
aaatgtgcttcattgttt

SEQ ID NO: 2283636 - DNA, 12 bp, Homo sapiens
aaatgtgtaaat

SEQ ID NO: 2283637 - DNA, 15 bp, Homo sapiens
aaatgttatttctgc

SEQ ID NO: 2283638 - DNA, 17 bp, Homo sapiens
aaatgttatttctgcaa

SEQ ID NO: 2283639 - DNA, 13 bp, Homo sapiens
aaatgtttacatt

SEQ ID NO: 2283640 - DNA, 16 bp, Homo sapiens
aaatgtttacattttc

SEQ ID NO: 2283641 - DNA, 13 bp, Homo sapiens
aaatgtttcatga

SEQ ID NO: 2283642 - DNA, 18 bp, Homo sapiens
aaatgtttcatgaagaaa

SEQ ID NO: 2283643 - DNA, 22 bp, Homo sapiens
aaatgtttcatgaagaaaaaat

SEQ ID NO: 2283644 - DNA, 16 bp, Homo sapiens
aaattacaggttcctt

SEQ ID NO: 2283645 - DNA, 19 bp, Homo sapiens
aaattagtgagatttgtat

SEQ ID NO: 2283646 - DNA, 14 bp, Homo sapiens
aaattataaatgtt

SEQ ID NO: 2283647 - DNA, 15 bp, Homo sapiens
aaattataaatgttt

SEQ ID NO: 2283648 - DNA, 17 bp, Homo sapiens
aaattataaatgtttca

SEQ ID NO: 2283649 - DNA, 18 bp, Homo sapiens
aaattataatgcatctaa

SEQ ID NO: 2283650 - DNA, 13 bp, Homo sapiens
aaattattctagt

SEQ ID NO: 2283651 - DNA, 20 bp, Homo sapiens
aaattcaacacttattttct

SEQ ID NO: 2283652 - DNA, 13 bp, Homo sapiens
aaattcatattat

SEQ ID NO: 2283653 - DNA, 12 bp, Homo sapiens
aaattcctgttg

SEQ ID NO: 2283654 - DNA, 14 bp, Homo sapiens
aaattcctgttgtc

SEQ ID NO: 2283655 - DNA, 20 bp, Homo sapiens
aaattctagtctgtttcatt

SEQ ID NO: 2283656 - DNA, 17 bp, Homo sapiens
aaattctataagagaca

SEQ ID NO: 2283657 - DNA, 15 bp, Homo sapiens
aaattcttgaataaa

SEQ ID NO: 2283658 - DNA, 22 bp, Homo sapiens
aaattggcctggtatggctgca

SEQ ID NO: 2283659 - DNA, 14 bp, Homo sapiens
aaattggtgtttct

SEQ ID NO: 2283660 - DNA, 15 bp, Homo sapiens
aaattgttatttcaa

SEQ ID NO: 2283661 - DNA, 18 bp, Homo sapiens
aaattgttcaaaaataac

SEQ ID NO: 2283662 - DNA, 21 bp, Homo sapiens
aaattgtttctataaattgta

SEQ ID NO: 2283663 - DNA, 12 bp, Homo sapiens
aaatttaaaaat

SEQ ID NO: 2283664 - DNA, 14 bp, Homo sapiens
aaatttaaaaatct

SEQ ID NO: 2283665 - DNA, 13 bp, Homo sapiens
aaattttaaaaat

SEQ ID NO: 2283666 - DNA, 18 bp, Homo sapiens
aaattttataatgtcata

SEQ ID NO: 2283667 - DNA, 15 bp, Homo sapiens
aaattttctacagta

SEQ ID NO: 2283668 - DNA, 18 bp, Homo sapiens
aaattttctacagtacat

SEQ ID NO: 2283669 - DNA, 14 bp, Homo sapiens
aaatttttaaatca

SEQ ID NO: 2283670 - DNA, 13 bp, Homo sapiens
aaatttttactca

SEQ ID NO: 2283671 - DNA, 15 bp, Homo sapiens
aaatttttactcagg

SEQ ID NO: 2283672 - DNA, 18 bp, Homo sapiens
aacaaaaagtaatgtata

SEQ ID NO: 2283673 - DNA, 16 bp, Homo sapiens
aacaaaaatagaatat

SEQ ID NO: 2283674 - DNA, 14 bp, Homo sapiens
aacaaaatgatggg

SEQ ID NO: 2283675 - DNA, 21 bp, Homo sapiens
aacaaacagaaacgagatttg

SEQ ID NO: 2283676 - DNA, 15 bp, Homo sapiens
aacaacagaaacttc

SEQ ID NO: 2283677 - DNA, 21 bp, Homo sapiens
aacaactgagatgttaaaata

SEQ ID NO: 2283678 - DNA, 13 bp, Homo sapiens
aacaacttaatgt

SEQ ID NO: 2283679 - DNA, 14 bp, Homo sapiens
aacaagaatacaac

SEQ ID NO: 2283680 - DNA, 20 bp, Homo sapiens
aacaagatttccctaaaaat

SEQ ID NO: 2283681 - DNA, 13 bp, Homo sapiens
aacaagccagagc

SEQ ID NO: 2283682 - DNA, 14 bp, Homo sapiens
aacaaggaaggaca

SEQ ID NO: 2283683 - DNA, 15 bp, Homo sapiens
aacaaggaaggacat

SEQ ID NO: 2283684 - DNA, 16 bp, Homo sapiens
aacaaggcaaggctgt

SEQ ID NO: 2283685 - DNA, 21 bp, Homo sapiens
aacaatttagccagaatgttt

SEQ ID NO: 2283686 - DNA, 23 bp, Homo sapiens
aacaccactgaacagaaatttct

SEQ ID NO: 2283687 - DNA, 15 bp, Homo sapiens
aacaccactttgtct

SEQ ID NO: 2283688 - DNA, 20 bp, Homo sapiens
aacacccaagcacaaactgt

SEQ ID NO: 2283689 - DNA, 15 bp, Homo sapiens
aacacccagccccag

SEQ ID NO: 2283690 - DNA, 21 bp, Homo sapiens
aacaccttcttattatatata

SEQ ID NO: 2283691 - DNA, 22 bp, Homo sapiens
aacaccttcttattatatatat

SEQ ID NO: 2283692 - DNA, 12 bp, Homo sapiens
aacactctgaga

SEQ ID NO: 2283693 - DNA, 14 bp, Homo sapiens
aacactctgagact

SEQ ID NO: 2283694 - DNA, 14 bp, Homo sapiens
aacactgcttaagg

SEQ ID NO: 2283695 - DNA, 16 bp, Homo sapiens
aacactgtgtatttat

SEQ ID NO: 2283696 - DNA, 15 bp, Homo sapiens
aacacttattttctg

SEQ ID NO: 2283697 - DNA, 15 bp, Homo sapiens
aacagaaacttctca

SEQ ID NO: 2283698 - DNA, 16 bp, Homo sapiens
aacagaaacttctcag

SEQ ID NO: 2283699 - DNA, 14 bp, Homo sapiens
aacagacatgtata

SEQ ID NO: 2283700 - DNA, 13 bp, Homo sapiens
aacagaccagcat

SEQ ID NO: 2283701 - DNA, 14 bp, Homo sapiens
aacagagtatatat

SEQ ID NO: 2283702 - DNA, 21 bp, Homo sapiens
aacagagtatatatgtacagt

SEQ ID NO: 2283703 - DNA, 19 bp, Homo sapiens
aacagctaatctttaatat

SEQ ID NO: 2283704 - DNA, 19 bp, Homo sapiens
aacaggaggtgtgaatgca

SEQ ID NO: 2283705 - DNA, 19 bp, Homo sapiens
aacagggcaaccaataaaa

SEQ ID NO: 2283706 - DNA, 14 bp, Homo sapiens
aacaggtgttcctc

SEQ ID NO: 2283707 - DNA, 19 bp, Homo sapiens
aacaggttttcctgaagaa

SEQ ID NO: 2283708 - DNA, 18 bp, Homo sapiens
aacagtaaaacaggctgc

SEQ ID NO: 2283709 - DNA, 21 bp, Homo sapiens
aacagttctcccttcaactgt

SEQ ID NO: 2283710 - DNA, 16 bp, Homo sapiens
aacataaacttgtact

SEQ ID NO: 2283711 - DNA, 12 bp, Homo sapiens
aacatacatcta

SEQ ID NO: 2283712 - DNA, 11 bp, Homo sapiens
aacatattctt

SEQ ID NO: 2283713 - DNA, 22 bp, Homo sapiens
aacatattcttgctttcacaaa

SEQ ID NO: 2283714 - DNA, 14 bp, Homo sapiens
aacatcataaatag

SEQ ID NO: 2283715 - DNA, 14 bp, Homo sapiens
aacatctgaaaaga

SEQ ID NO: 2283716 - DNA, 22 bp, Homo sapiens
aacatctgaaaagaaatgctaa

SEQ ID NO: 2283717 - DNA, 13 bp, Homo sapiens
aacatgtctaaag

SEQ ID NO: 2283718 - DNA, 14 bp, Homo sapiens
aacattaattttat

SEQ ID NO: 2283719 - DNA, 17 bp, Homo sapiens
aacattgagactgctag

SEQ ID NO: 2283720 - DNA, 17 bp, Homo sapiens
aacatttaactagcctt

SEQ ID NO: 2283721 - DNA, 19 bp, Homo sapiens
aacattttgtttccaaagc

SEQ ID NO: 2283722 - DNA, 22 bp, Homo sapiens
aaccaacattttaaaaataaat

SEQ ID NO: 2283723 - DNA, 18 bp, Homo sapiens
aaccactttcacctggga

SEQ ID NO: 2283724 - DNA, 15 bp, Homo sapiens
aaccataaaataaat

SEQ ID NO: 2283725 - DNA, 17 bp, Homo sapiens
aaccataaaataaataa

SEQ ID NO: 2283726 - DNA, 23 bp, Homo sapiens
aaccatatgattgaaaagaagaa

SEQ ID NO: 2283727 - DNA, 19 bp, Homo sapiens
aaccatcattgaaatcttt

SEQ ID NO: 2283728 - DNA, 23 bp, Homo sapiens
aaccatcattgaaatctttttgc

SEQ ID NO: 2283729 - DNA, 16 bp, Homo sapiens
aacccaaataaatgtg

SEQ ID NO: 2283730 - DNA, 15 bp, Homo sapiens
aacccagcttacatt

SEQ ID NO: 2283731 - DNA, 11 bp, Homo sapiens
aacccagtgtt

SEQ ID NO: 2283732 - DNA, 19 bp, Homo sapiens
agcctttggtgaataacct

SEQ ID NO: 2283733 - DNA, 15 bp, Homo sapiens
agcgagtctggagac

SEQ ID NO: 2283734 - DNA, 21 bp, Homo sapiens
agcgcagccgccttcacagca

SEQ ID NO: 2283735 - DNA, 12 bp, Homo sapiens
agcgcctcccgc

SEQ ID NO: 2283736 - DNA, 18 bp, Homo sapiens
agcgcctcccgccgcctc

SEQ ID NO: 2283737 - DNA, 15 bp, Homo sapiens
agcggagaggacccc

SEQ ID NO: 2283738 - DNA, 18 bp, Homo sapiens
agcggcccggcccacgca

SEQ ID NO: 2283739 - DNA, 19 bp, Homo sapiens
agcggcccggcccacgcag

SEQ ID NO: 2283740 - DNA, 22 bp, Homo sapiens
agcggcccggcccacgcagagc

SEQ ID NO: 2283741 - DNA, 23 bp, Homo sapiens
agcggctgaggacggggcagagc

SEQ ID NO: 2283742 - DNA, 22 bp, Homo sapiens
agcgggcgcgggacaggacttg

SEQ ID NO: 2283743 - DNA, 19 bp, Homo sapiens
agcgggggctaactggccc

SEQ ID NO: 2283744 - DNA, 22 bp, Homo sapiens
agcgggggctaactggccccag

SEQ ID NO: 2283745 - DNA, 23 bp, Homo sapiens
agcgggggctaactggccccagg

SEQ ID NO: 2283746 - DNA, 22 bp, Homo sapiens
agcgtgggggtggccactcctg

SEQ ID NO: 2283747 - DNA, 16 bp, Homo sapiens
agctaatctttaatat

SEQ ID NO: 2283748 - DNA, 19 bp, Homo sapiens
agctacctgggaggctgcg

SEQ ID NO: 2283749 - DNA, 22 bp, Homo sapiens
agctaggaaagagttgagcaca

SEQ ID NO: 2283750 - DNA, 14 bp, Homo sapiens
agctcaactgttgc

SEQ ID NO: 2283751 - DNA, 18 bp, Homo sapiens
agctcactgcagcctcga

SEQ ID NO: 2283752 - DNA, 14 bp, Homo sapiens
agctcagcacagcc

SEQ ID NO: 2283753 - DNA, 16 bp, Homo sapiens
agctcagcacagcctc

SEQ ID NO: 2283754 - DNA, 14 bp, Homo sapiens
agctcagtcccaca

SEQ ID NO: 2283755 - DNA, 15 bp, Homo sapiens
agctcagtcccacag

SEQ ID NO: 2283756 - DNA, 15 bp, Homo sapiens
agctccaacctggag

SEQ ID NO: 2283757 - DNA, 17 bp, Homo sapiens
agctccaacctggaggc

SEQ ID NO: 2283758 - DNA, 19 bp, Homo sapiens
agctccaacctggaggctg

SEQ ID NO: 2283759 - DNA, 21 bp, Homo sapiens
agctccaacctggaggctgga

SEQ ID NO: 2283760 - DNA, 14 bp, Homo sapiens
agctccaccctccc

SEQ ID NO: 2283761 - DNA, 16 bp, Homo sapiens
agctccaccctcccct

SEQ ID NO: 2283762 - DNA, 15 bp, Homo sapiens
agctcctattaaatt

SEQ ID NO: 2283763 - DNA, 14 bp, Homo sapiens
agctcctgccccgc

SEQ ID NO: 2283764 - DNA, 15 bp, Homo sapiens
agctcctgccccgcc

SEQ ID NO: 2283765 - DNA, 16 bp, Homo sapiens
agctcctgccccgccg

SEQ ID NO: 2283766 - DNA, 19 bp, Homo sapiens
agctcctgccccgccggcc

SEQ ID NO: 2283767 - DNA, 13 bp, Homo sapiens
agctctaaagcag

SEQ ID NO: 2283768 - DNA, 16 bp, Homo sapiens
agctctcctgggccag

SEQ ID NO: 2283769 - DNA, 16 bp, Homo sapiens
agctctgaagggaggg

SEQ ID NO: 2283770 - DNA, 18 bp, Homo sapiens
agctctgaagggagggga

SEQ ID NO: 2283771 - DNA, 22 bp, Homo sapiens
agctctgcataagattatatac

SEQ ID NO: 2283772 - DNA, 14 bp, Homo sapiens
agctctggaattgt

SEQ ID NO: 2283773 - DNA, 17 bp, Homo sapiens
agctctggaattgttga

SEQ ID NO: 2283774 - DNA, 13 bp, Homo sapiens
agctctgtctgaa

SEQ ID NO: 2283775 - DNA, 15 bp, Homo sapiens
agctgactgaatgca

SEQ ID NO: 2283776 - DNA, 16 bp, Homo sapiens
agctgaggcaggggga

SEQ ID NO: 2283777 - DNA, 19 bp, Homo sapiens
agctgagtcggctgggcag

SEQ ID NO: 2283778 - DNA, 20 bp, Homo sapiens
agctgagtcggctgggcagg

SEQ ID NO: 2283779 - DNA, 17 bp, Homo sapiens
agctgccaaaatcgtag

SEQ ID NO: 2283780 - DNA, 18 bp, Homo sapiens
agctgcggtgtctccctg

SEQ ID NO: 2283781 - DNA, 23 bp, Homo sapiens
agctggactgggtgggccccaca

SEQ ID NO: 2283782 - DNA, 13 bp, Homo sapiens
agctggcagcgcc

SEQ ID NO: 2283783 - DNA, 14 bp, Homo sapiens
agctggcagcgcct

SEQ ID NO: 2283784 - DNA, 15 bp, Homo sapiens
agctggcaggagaca

SEQ ID NO: 2283785 - DNA, 19 bp, Homo sapiens
agctggctgggtcgcccct

SEQ ID NO: 2283786 - DNA, 17 bp, Homo sapiens
agctgggactagaggca

SEQ ID NO: 2283787 - DNA, 14 bp, Homo sapiens
agctggtcagttgc

SEQ ID NO: 2283788 - DNA, 21 bp, Homo sapiens
agctgtagctacaagggaagc

SEQ ID NO: 2283789 - DNA, 15 bp, Homo sapiens
agctgtgaccctcaa

SEQ ID NO: 2283790 - DNA, 22 bp, Homo sapiens
agctgtggctcaacacatgaga

SEQ ID NO: 2283791 - DNA, 17 bp, Homo sapiens
agctgtggggagctggt

SEQ ID NO: 2283792 - DNA, 18 bp, Homo sapiens
agctgtggtgtgaaaatg

SEQ ID NO: 2283793 - DNA, 20 bp, Homo sapiens
agctgtgtttgagtttctgg

SEQ ID NO: 2283794 - DNA, 19 bp, Homo sapiens
agctgttccacttctctag

SEQ ID NO: 2283795 - DNA, 17 bp, Homo sapiens
agctgttggaatgttgt

SEQ ID NO: 2283796 - DNA, 21 bp, Homo sapiens
agctgttggaatgttgttaaa

SEQ ID NO: 2283797 - DNA, 22 bp, Homo sapiens
agctgttggaatgttgttaaat

SEQ ID NO: 2283798 - DNA, 23 bp, Homo sapiens
agcttataaaaataaagggaaga

SEQ ID NO: 2283799 - DNA, 15 bp, Homo sapiens
agcttcaaagttggc

SEQ ID NO: 2283800 - DNA, 12 bp, Homo sapiens
agcttgaatgtc

SEQ ID NO: 2283801 - DNA, 13 bp, Homo sapiens
agcttgaatgtcc

SEQ ID NO: 2283802 - DNA, 15 bp, Homo sapiens
agcttggagacagga

SEQ ID NO: 2283803 - DNA, 18 bp, Homo sapiens
agcttggagacaggattc

SEQ ID NO: 2283804 - DNA, 21 bp, Homo sapiens
agcttggagacaggattctga

SEQ ID NO: 2283805 - DNA, 17 bp, Homo sapiens
agcttgtttgttctagt

SEQ ID NO: 2283806 - DNA, 21 bp, Homo sapiens
agctttagattgaaatttatg

SEQ ID NO: 2283807 - DNA, 16 bp, Homo sapiens
agctttcctgtttcca

SEQ ID NO: 2283808 - DNA, 20 bp, Homo sapiens
agctttcctgtttccagggt

SEQ ID NO: 2283809 - DNA, 21 bp, Homo sapiens
agcttttattgagtaatatta

SEQ ID NO: 2283810 - DNA, 17 bp, Homo sapiens
aggaaaacgtgaacaaa

SEQ ID NO: 2283811 - DNA, 15 bp, Homo sapiens
aggaaaagagaaaca

SEQ ID NO: 2283812 - DNA, 19 bp, Homo sapiens
aggaaagttctattatctg

SEQ ID NO: 2283813 - DNA, 16 bp, Homo sapiens
aggaacaaggcaaggc

SEQ ID NO: 2283814 - DNA, 13 bp, Homo sapiens
aggaacacccagc

SEQ ID NO: 2283815 - DNA, 16 bp, Homo sapiens
aggaacacccagcccc

SEQ ID NO: 2283816 - DNA, 14 bp, Homo sapiens
aggaaccgaggact

SEQ ID NO: 2283817 - DNA, 14 bp, Homo sapiens
aggaagagccagcc

SEQ ID NO: 2283818 - DNA, 22 bp, Homo sapiens
aggaagaggggcgctgccccca

SEQ ID NO: 2283819 - DNA, 15 bp, Homo sapiens
aggaagtactggaga

SEQ ID NO: 2283820 - DNA, 17 bp, Homo sapiens
aggacacggaccctgtg

SEQ ID NO: 2283821 - DNA, 19 bp, Homo sapiens
aggacacggaccctgtgtg

SEQ ID NO: 2283822 - DNA, 20 bp, Homo sapiens
aggacacggaccctgtgtgg

SEQ ID NO: 2283823 - DNA, 17 bp, Homo sapiens
aggacagacagaaggca

SEQ ID NO: 2283824 - DNA, 17 bp, Homo sapiens
aggaccccattctggga

SEQ ID NO: 2283825 - DNA, 20 bp, Homo sapiens
aggaccccattctgggactg

SEQ ID NO: 2283826 - DNA, 20 bp, Homo sapiens
aggacctccacctgggagat

SEQ ID NO: 2283827 - DNA, 20 bp, Homo sapiens
aggacgcagggagaccctgg

SEQ ID NO: 2283828 - DNA, 16 bp, Homo sapiens
aggacggggcagagct

SEQ ID NO: 2283829 - DNA, 14 bp, Homo sapiens
aggacggtctgtgc

SEQ ID NO: 2283830 - DNA, 17 bp, Homo sapiens
aggacggtctgtgcccg

SEQ ID NO: 2283831 - DNA, 16 bp, Homo sapiens
aggactccaggggctg

SEQ ID NO: 2283832 - DNA, 23 bp, Homo sapiens
aggactcgggctaagtccagctc

SEQ ID NO: 2283833 - DNA, 13 bp, Homo sapiens
aggactctgcctt

SEQ ID NO: 2283834 - DNA, 19 bp, Homo sapiens
aggactctgccttccaggc

SEQ ID NO: 2283835 - DNA, 22 bp, Homo sapiens
aggacttcctgctacagtagct

SEQ ID NO: 2283836 - DNA, 23 bp, Homo sapiens
aggacttcctgctacagtagctg

SEQ ID NO: 2283837 - DNA, 23 bp, Homo sapiens
aggacttgtgcgccggcgccccg

SEQ ID NO: 2283838 - DNA, 15 bp, Homo sapiens
aggagataaactgaa

SEQ ID NO: 2283839 - DNA, 17 bp, Homo sapiens
aggagataaactgaaat

SEQ ID NO: 2283840 - DNA, 15 bp, Homo sapiens
aggagatggaatatc

SEQ ID NO: 2283841 - DNA, 13 bp, Homo sapiens
aggagcaccccca

SEQ ID NO: 2283842 - DNA, 14 bp, Homo sapiens
aggagcacccccag

SEQ ID NO: 2283843 - DNA, 17 bp, Homo sapiens
aggagcacccccagcct

SEQ ID NO: 2283844 - DNA, 13 bp, Homo sapiens
aggagcactagaa

SEQ ID NO: 2283845 - DNA, 20 bp, Homo sapiens
aggagcactagaatgagaaa

SEQ ID NO: 2283846 - DNA, 23 bp, Homo sapiens
aggagcccgaagtctgctgctgt

SEQ ID NO: 2283847 - DNA, 16 bp, Homo sapiens
aggaggagacagtcag

SEQ ID NO: 2283848 - DNA, 13 bp, Homo sapiens
acactgtaagaaa

SEQ ID NO: 2283849 - DNA, 16 bp, Homo sapiens
acactgtatctaaaaa

SEQ ID NO: 2283850 - DNA, 15 bp, Homo sapiens
acacttctgaaactt

SEQ ID NO: 2283851 - DNA, 20 bp, Homo sapiens
acacttttctttttaaatgt

SEQ ID NO: 2283852 - DNA, 17 bp, Homo sapiens
acagaaaatagctttta

SEQ ID NO: 2283853 - DNA, 17 bp, Homo sapiens
acagaaacaactgccaa

SEQ ID NO: 2283854 - DNA, 16 bp, Homo sapiens
acagaaacgagatttg

SEQ ID NO: 2283855 - DNA, 19 bp, Homo sapiens
acagaacagcaagtatgaa

SEQ ID NO: 2283856 - DNA, 20 bp, Homo sapiens
acagaacaggaggtgtgaat

SEQ ID NO: 2283857 - DNA, 19 bp, Homo sapiens
acagaaccagcactcccag

SEQ ID NO: 2283858 - DNA, 22 bp, Homo sapiens
acagaaccagcactcccagggc

SEQ ID NO: 2283859 - DNA, 17 bp, Homo sapiens
acagaatgagagagaaa

SEQ ID NO: 2283860 - DNA, 15 bp, Homo sapiens
acagacccctggggg

SEQ ID NO: 2283861 - DNA, 21 bp, Homo sapiens
acagacctcactgctttgtag

SEQ ID NO: 2283862 - DNA, 21 bp, Homo sapiens
acagacctccagattattttc

SEQ ID NO: 2283863 - DNA, 23 bp, Homo sapiens
acagacggacgggacagcggccc

SEQ ID NO: 2283864 - DNA, 18 bp, Homo sapiens
acagagatggcagagcca

SEQ ID NO: 2283865 - DNA, 22 bp, Homo sapiens
acagaggcggttgtaagaggat

SEQ ID NO: 2283866 - DNA, 13 bp, Homo sapiens
acagagtatatat

SEQ ID NO: 2283867 - DNA, 16 bp, Homo sapiens
acagagtatatatgta

SEQ ID NO: 2283868 - DNA, 17 bp, Homo sapiens
acagagtatatatgtac

SEQ ID NO: 2283869 - DNA, 13 bp, Homo sapiens
agatggaatatca

SEQ ID NO: 2283870 - DNA, 22 bp, Homo sapiens
agatggcagagccatccaccct

SEQ ID NO: 2283871 - DNA, 22 bp, Homo sapiens
agatggcgcacccggcagcccc

SEQ ID NO: 2283872 - DNA, 18 bp, Homo sapiens
agatgggcagtaaacagg

SEQ ID NO: 2283873 - DNA, 17 bp, Homo sapiens
agatggttcaaagatac

SEQ ID NO: 2283874 - DNA, 18 bp, Homo sapiens
agatgtcagtctgtccac

SEQ ID NO: 2283875 - DNA, 20 bp, Homo sapiens
agatgtgtaaataagcgttt

SEQ ID NO: 2283876 - DNA, 22 bp, Homo sapiens
agatgtgtccatgtgaaattta

SEQ ID NO: 2283877 - DNA, 14 bp, Homo sapiens
agatgttaaaatag

SEQ ID NO: 2283878 - DNA, 18 bp, Homo sapiens
agatgttttagagataaa

SEQ ID NO: 2283879 - DNA, 13 bp, Homo sapiens
agatgtttttaga

SEQ ID NO: 2283880 - DNA, 21 bp, Homo sapiens
agattattttctatatttgga

SEQ ID NO: 2283881 - DNA, 15 bp, Homo sapiens
agattcagtcttgcc

SEQ ID NO: 2283882 - DNA, 18 bp, Homo sapiens
agattcagtcttgcctta

SEQ ID NO: 2283883 - DNA, 19 bp, Homo sapiens
agattccagaacgccctgt

SEQ ID NO: 2283884 - DNA, 22 bp, Homo sapiens
agattccagaacgccctgtgtc

SEQ ID NO: 2283885 - DNA, 17 bp, Homo sapiens
agattctattaaaagcc

SEQ ID NO: 2283886 - DNA, 15 bp, Homo sapiens
agattgctgcaaaga

SEQ ID NO: 2283887 - DNA, 18 bp, Homo sapiens
agattggctttgccttta

SEQ ID NO: 2283888 - DNA, 19 bp, Homo sapiens
agattgtacatatggaaat

SEQ ID NO: 2283889 - DNA, 14 bp, Homo sapiens
agattgtacatttt

SEQ ID NO: 2283890 - DNA, 19 bp, Homo sapiens
agattgtacattttttact

SEQ ID NO: 2283891 - DNA, 13 bp, Homo sapiens
agattgtgtaaat

SEQ ID NO: 2283892 - DNA, 20 bp, Homo sapiens
agattgtgtaaattcctgtt

SEQ ID NO: 2283893 - DNA, 18 bp, Homo sapiens
agatttccctaaaaattc

SEQ ID NO: 2283894 - DNA, 23 bp, Homo sapiens
agatttctagcagtatgtgtgct

SEQ ID NO: 2283895 - DNA, 24 bp, Homo sapiens
agatttctagcagtatgtgtgctc

SEQ ID NO: 2283896 - DNA, 15 bp, Homo sapiens
agatttgtatttata

SEQ ID NO: 2283897 - DNA, 15 bp, Homo sapiens
agcaaacaaaaatag

SEQ ID NO: 2283898 - DNA, 18 bp, Homo sapiens
agcaaattcttgaataaa

SEQ ID NO: 2283899 - DNA, 16 bp, Homo sapiens
agcaaccagagcactg

SEQ ID NO: 2283900 - DNA, 18 bp, Homo sapiens
agcaaccagagcactgta

SEQ ID NO: 2283901 - DNA, 18 bp, Homo sapiens
agcaagaagattctaaaa

SEQ ID NO: 2283902 - DNA, 19 bp, Homo sapiens
agcaagaagattctaaaac

SEQ ID NO: 2283903 - DNA, 15 bp, Homo sapiens
agcaagcccgtcatc

SEQ ID NO: 2283904 - DNA, 15 bp, Homo sapiens
agcaaggctgctaag

SEQ ID NO: 2283905 - DNA, 20 bp, Homo sapiens
agcaaggctgctaagtggaa

SEQ ID NO: 2283906 - DNA, 18 bp, Homo sapiens
agcaatgtttttctcaaa

SEQ ID NO: 2283907 - DNA, 17 bp, Homo sapiens
agcaattaaagacattt

SEQ ID NO: 2283908 - DNA, 17 bp, Homo sapiens
agcacagataaaaagtg

SEQ ID NO: 2283909 - DNA, 20 bp, Homo sapiens
agcacagataaaaagtggaa

SEQ ID NO: 2283910 - DNA, 15 bp, Homo sapiens
agcacagctgtgagg

SEQ ID NO: 2283911 - DNA, 16 bp, Homo sapiens
agcacaggcaacatta

SEQ ID NO: 2283912 - DNA, 18 bp, Homo sapiens
agcaccactcaagaccaa

SEQ ID NO: 2283913 - DNA, 15 bp, Homo sapiens
agcaccagcctgagc

SEQ ID NO: 2283914 - DNA, 12 bp, Homo sapiens
agcacccccagc

SEQ ID NO: 2283915 - DNA, 13 bp, Homo sapiens
agcacccccagcc

SEQ ID NO: 2283916 - DNA, 16 bp, Homo sapiens
agcacccccagcctcc

SEQ ID NO: 2283917 - DNA, 22 bp, Homo sapiens
agcacccccagcctcccccagg

SEQ ID NO: 2283918 - DNA, 16 bp, Homo sapiens
agcaccgtggtgtgag

SEQ ID NO: 2283919 - DNA, 22 bp, Homo sapiens
agcaccgtggtgtgaggccccc

SEQ ID NO: 2283920 - DNA, 15 bp, Homo sapiens
agcacggtgcctccg

SEQ ID NO: 2283921 - DNA, 14 bp, Homo sapiens
agcacggttgcctg

SEQ ID NO: 2283922 - DNA, 17 bp, Homo sapiens
agcactagaatgagaaa

SEQ ID NO: 2283923 - DNA, 18 bp, Homo sapiens
agcactagaatgagaaat

SEQ ID NO: 2283924 - DNA, 12 bp, Homo sapiens
agcactcccagg

SEQ ID NO: 2283925 - DNA, 16 bp, Homo sapiens
agcactcccagggccc

SEQ ID NO: 2283926 - DNA, 17 bp, Homo sapiens
agcagaatgactctgga

SEQ ID NO: 2283927 - DNA, 17 bp, Homo sapiens
agcagagacggcagccc

SEQ ID NO: 2283928 - DNA, 18 bp, Homo sapiens
agcagagacggcagcccc

SEQ ID NO: 2283929 - DNA, 18 bp, Homo sapiens
agcagagcccccatggcc

SEQ ID NO: 2283930 - DNA, 14 bp, Homo sapiens
agcagctccaacct

SEQ ID NO: 2283931 - DNA, 17 bp, Homo sapiens
agcagctccaacctgga

SEQ ID NO: 2283932 - DNA, 14 bp, Homo sapiens
agcagggcagcagg

SEQ ID NO: 2283933 - DNA, 18 bp, Homo sapiens
agcagtatgtgtgctctt

SEQ ID NO: 2283934 - DNA, 22 bp, Homo sapiens
agcagtcactttgcttaagatg

SEQ ID NO: 2283935 - DNA, 15 bp, Homo sapiens
agcagtctaaacaga

SEQ ID NO: 2283936 - DNA, 21 bp, Homo sapiens
agcagtgctaggataaaccaa

SEQ ID NO: 2283937 - DNA, 22 bp, Homo sapiens
agcagttgttatattcattctt

SEQ ID NO: 2283938 - DNA, 18 bp, Homo sapiens
agcagtttggggcagggg

SEQ ID NO: 2283939 - DNA, 22 bp, Homo sapiens
agcatagttctgcaataacagt

SEQ ID NO: 2283940 - DNA, 13 bp, Homo sapiens
agcatgaaccttt

SEQ ID NO: 2283941 - DNA, 17 bp, Homo sapiens
agcatgagattgtacat

SEQ ID NO: 2283942 - DNA, 18 bp, Homo sapiens
agcattaaatataaaata

SEQ ID NO: 2283943 - DNA, 21 bp, Homo sapiens
agcattcaaaatagttctatt

SEQ ID NO: 2283944 - DNA, 17 bp, Homo sapiens
agcattgaaataataat

SEQ ID NO: 2283945 - DNA, 21 bp, Homo sapiens
agccaaagagaaaagattaaa

SEQ ID NO: 2283946 - DNA, 11 bp, Homo sapiens
agccaaagagg

SEQ ID NO: 2283947 - DNA, 16 bp, Homo sapiens
agccaaggaagttggt

SEQ ID NO: 2283948 - DNA, 14 bp, Homo sapiens
agccacagtggggc

SEQ ID NO: 2283949 - DNA, 22 bp, Homo sapiens
agccactggggtgggagggggc

SEQ ID NO: 2283950 - DNA, 19 bp, Homo sapiens
agccagaatcagcacagat

SEQ ID NO: 2283951 - DNA, 21 bp, Homo sapiens
agccagaatcagcacagataa

SEQ ID NO: 2283952 - DNA, 18 bp, Homo sapiens
agccagagccgcaccctg

SEQ ID NO: 2283953 - DNA, 22 bp, Homo sapiens
agccagagccgcaccctggctg

SEQ ID NO: 2283954 - DNA, 21 bp, Homo sapiens
agccagggcccgggaagcaaa

SEQ ID NO: 2283955 - DNA, 13 bp, Homo sapiens
agccatccaccct

SEQ ID NO: 2283956 - DNA, 16 bp, Homo sapiens
agccatccaccctgag

SEQ ID NO: 2283957 - DNA, 20 bp, Homo sapiens
agccatccaccctgaggagt

SEQ ID NO: 2283958 - DNA, 16 bp, Homo sapiens
agcccaacctcttcct

SEQ ID NO: 2283959 - DNA, 16 bp, Homo sapiens
agcccacccgccccag

SEQ ID NO: 2283960 - DNA, 17 bp, Homo sapiens
agcccagaacgggcctc

SEQ ID NO: 2283961 - DNA, 19 bp, Homo sapiens
agcccagaacgggcctccc

SEQ ID NO: 2283962 - DNA, 15 bp, Homo sapiens
agccccagcgagtct

SEQ ID NO: 2283963 - DNA, 21 bp, Homo sapiens
agccccatccttcccgcagca

SEQ ID NO: 2283964 - DNA, 19 bp, Homo sapiens
agccccccagtgtccccag

SEQ ID NO: 2283965 - DNA, 15 bp, Homo sapiens
agccccctggcccct

SEQ ID NO: 2283966 - DNA, 19 bp, Homo sapiens
agccccggagcaccacggg

SEQ ID NO: 2283967 - DNA, 20 bp, Homo sapiens
agcccctccccgcctcctcc

SEQ ID NO: 2283968 - DNA, 11 bp, Homo sapiens
agcccctcctc

SEQ ID NO: 2283969 - DNA, 14 bp, Homo sapiens
agcccctcctctcc

SEQ ID NO: 2283970 - DNA, 16 bp, Homo sapiens
agcccctgctggacca

SEQ ID NO: 2283971 - DNA, 21 bp, Homo sapiens
agcccctgctggaccaaggtg

SEQ ID NO: 2283972 - DNA, 14 bp, Homo sapiens
agccccttgcttct

SEQ ID NO: 2283973 - DNA, 15 bp, Homo sapiens
agccccttgcttcta

SEQ ID NO: 2283974 - DNA, 17 bp, Homo sapiens
agcccgcctgcgccccc

SEQ ID NO: 2283975 - DNA, 22 bp, Homo sapiens
agcccgcctgcgccccccagtg

SEQ ID NO: 2283976 - DNA, 19 bp, Homo sapiens
agcccggcagtgcaccccc

SEQ ID NO: 2283977 - DNA, 19 bp, Homo sapiens
agcccggccaaggacactg

SEQ ID NO: 2283978 - DNA, 20 bp, Homo sapiens
agcccggccaaggacactga

SEQ ID NO: 2283979 - DNA, 23 bp, Homo sapiens
agcccgtcatcttccctttcctc

SEQ ID NO: 2283980 - DNA, 16 bp, Homo sapiens
agccctacgatgggat

SEQ ID NO: 2283981 - DNA, 23 bp, Homo sapiens
agccctatctatgtcctggaagt

SEQ ID NO: 2283982 - DNA, 16 bp, Homo sapiens
agcccttccaggagtg

SEQ ID NO: 2283983 - DNA, 13 bp, Homo sapiens
agccgagctctcc

SEQ ID NO: 2283984 - DNA, 15 bp, Homo sapiens
agccgatctggtctc

SEQ ID NO: 2283985 - DNA, 20 bp, Homo sapiens
agccgcgctctgcccctccg

SEQ ID NO: 2283986 - DNA, 21 bp, Homo sapiens
agccgggccccatggtcacag

SEQ ID NO: 2283987 - DNA, 16 bp, Homo sapiens
agcctcacccctgcag

SEQ ID NO: 2283988 - DNA, 16 bp, Homo sapiens
agcctcagagtcctgc

SEQ ID NO: 2283989 - DNA, 20 bp, Homo sapiens
agcctcagagtcctgccgac

SEQ ID NO: 2283990 - DNA, 13 bp, Homo sapiens
agcctcccccagg

SEQ ID NO: 2283991 - DNA, 17 bp, Homo sapiens
agcctcccccaggctgc

SEQ ID NO: 2283992 - DNA, 20 bp, Homo sapiens
agaatttgtgaatatatttt

SEQ ID NO: 2283993 - DNA, 15 bp, Homo sapiens
agacaaaacttataa

SEQ ID NO: 2283994 - DNA, 21 bp, Homo sapiens
agacaaaacttataatttcca

SEQ ID NO: 2283995 - DNA, 18 bp, Homo sapiens
agacaaccatagaactgt

SEQ ID NO: 2283996 - DNA, 14 bp, Homo sapiens
agacactcaagagc

SEQ ID NO: 2283997 - DNA, 16 bp, Homo sapiens
agacactcaagagccc

SEQ ID NO: 2283998 - DNA, 16 bp, Homo sapiens
agacacttcaatggga

SEQ ID NO: 2283999 - DNA, 19 bp, Homo sapiens
agacagaatgagagagaaa

SEQ ID NO: 2284000 - DNA, 21 bp, Homo sapiens
agacagaatgagagagaaaag

SEQ ID NO: 2284001 - DNA, 22 bp, Homo sapiens
agacagaatgagagagaaaaga

SEQ ID NO: 2284002 - DNA, 11 bp, Homo sapiens
agacagagatg

SEQ ID NO: 2284003 - DNA, 15 bp, Homo sapiens
agacagggtctcact

SEQ ID NO: 2284004 - DNA, 14 bp, Homo sapiens
agacagtttgtaaa

SEQ ID NO: 2284005 - DNA, 15 bp, Homo sapiens
agacagtttgtaaat

SEQ ID NO: 2284006 - DNA, 19 bp, Homo sapiens
agacagtttgtaaatgtta

SEQ ID NO: 2284007 - DNA, 14 bp, Homo sapiens
agacatttaaaata

SEQ ID NO: 2284008 - DNA, 15 bp, Homo sapiens
agacatttaaaatag

SEQ ID NO: 2284009 - DNA, 21 bp, Homo sapiens
agacatttcatccaccaatat

SEQ ID NO: 2284010 - DNA, 23 bp, Homo sapiens
agaccagcatagttctgcaataa

SEQ ID NO: 2284011 - DNA, 14 bp, Homo sapiens
agaccaggactctg

SEQ ID NO: 2284012 - DNA, 16 bp, Homo sapiens
agaccaggactctgcc

SEQ ID NO: 2284013 - DNA, 17 bp, Homo sapiens
agaccaggactctgcct

SEQ ID NO: 2284014 - DNA, 14 bp, Homo sapiens
agaccccaagcatt

SEQ ID NO: 2284015 - DNA, 19 bp, Homo sapiens
agaccgagtgtggagctgc

SEQ ID NO: 2284016 - DNA, 15 bp, Homo sapiens
agacctcccccaggg

SEQ ID NO: 2284017 - DNA, 16 bp, Homo sapiens
agacctgctccagatc

SEQ ID NO: 2284018 - DNA, 17 bp, Homo sapiens
agacctgctccagatcc

SEQ ID NO: 2284019 - DNA, 23 bp, Homo sapiens
agacgacttatatatttgaaaga

SEQ ID NO: 2284020 - DNA, 18 bp, Homo sapiens
agacgaggtgtcttcctt

SEQ ID NO: 2284021 - DNA, 15 bp, Homo sapiens
agacggacgggacag

SEQ ID NO: 2284022 - DNA, 20 bp, Homo sapiens
agacggacgggacagcggcc

SEQ ID NO: 2284023 - DNA, 23 bp, Homo sapiens
agacggacgggacagcggcccgg

SEQ ID NO: 2284024 - DNA, 14 bp, Homo sapiens
agacggcagcccca

SEQ ID NO: 2284025 - DNA, 19 bp, Homo sapiens
agactagcagctagcaagg

SEQ ID NO: 2284026 - DNA, 20 bp, Homo sapiens
agactatgtgtcatgatttc

SEQ ID NO: 2284027 - DNA, 23 bp, Homo sapiens
agactatgtgtcatgatttcaat

SEQ ID NO: 2284028 - DNA, 19 bp, Homo sapiens
agactcaaggaagaataat

SEQ ID NO: 2284029 - DNA, 20 bp, Homo sapiens
agactcgagagggctgagcc

SEQ ID NO: 2284030 - DNA, 18 bp, Homo sapiens
agactcgcgacaatgcaa

SEQ ID NO: 2284031 - DNA, 13 bp, Homo sapiens
agactctgtgatc

SEQ ID NO: 2284032 - DNA, 23 bp, Homo sapiens
agactgattttaaaacttttctg

SEQ ID NO: 2284033 - DNA, 12 bp, Homo sapiens
agactgcccacc

SEQ ID NO: 2284034 - DNA, 17 bp, Homo sapiens
agacttaatcatatcaa

SEQ ID NO: 2284035 - DNA, 16 bp, Homo sapiens
agacttgatttacaag

SEQ ID NO: 2284036 - DNA, 22 bp, Homo sapiens
agactttaagaagcgaacaaaa

SEQ ID NO: 2284037 - DNA, 17 bp, Homo sapiens
agagaaaatgctttctc

SEQ ID NO: 2284038 - DNA, 20 bp, Homo sapiens
agagaagttgccctccaggc

SEQ ID NO: 2284039 - DNA, 20 bp, Homo sapiens
agagaattctaagattgtac

SEQ ID NO: 2284040 - DNA, 15 bp, Homo sapiens
agagaccccggtaat

SEQ ID NO: 2284041 - DNA, 15 bp, Homo sapiens
agagacctgctccag

SEQ ID NO: 2284042 - DNA, 17 bp, Homo sapiens
agagacctgctccagat

SEQ ID NO: 2284043 - DNA, 14 bp, Homo sapiens
agagacggcagccc

SEQ ID NO: 2284044 - DNA, 12 bp, Homo sapiens
agagactctgtg

SEQ ID NO: 2284045 - DNA, 18 bp, Homo sapiens
agagactctgtgatctaa

SEQ ID NO: 2284046 - DNA, 20 bp, Homo sapiens
agagactctgtgatctaagc

SEQ ID NO: 2284047 - DNA, 16 bp, Homo sapiens
agagactgcccaccct

SEQ ID NO: 2284048 - DNA, 22 bp, Homo sapiens
agagagcgcagccgccttcaca

SEQ ID NO: 2284049 - DNA, 24 bp, Homo sapiens
agagaggcctgggtgtgacctgac

SEQ ID NO: 2284050 - DNA, 13 bp, Homo sapiens
agagataaatatt

SEQ ID NO: 2284051 - DNA, 16 bp, Homo sapiens
agagatggcagagcca

SEQ ID NO: 2284052 - DNA, 17 bp, Homo sapiens
agagatggcagagccat

SEQ ID NO: 2284053 - DNA, 16 bp, Homo sapiens
agagattaatttgtgt

SEQ ID NO: 2284054 - DNA, 15 bp, Homo sapiens
agagcaaagtcatgt

SEQ ID NO: 2284055 - DNA, 17 bp, Homo sapiens
agagcagtctaaacaga

SEQ ID NO: 2284056 - DNA, 19 bp, Homo sapiens
agagccagccgtaatgggg

SEQ ID NO: 2284057 - DNA, 23 bp, Homo sapiens
agagccagccgtaatggggactc

SEQ ID NO: 2284058 - DNA, 13 bp, Homo sapiens
agagccatccacc

SEQ ID NO: 2284059 - DNA, 15 bp, Homo sapiens
agagccatccaccct

SEQ ID NO: 2284060 - DNA, 16 bp, Homo sapiens
agagccatccaccctg

SEQ ID NO: 2284061 - DNA, 17 bp, Homo sapiens
agagccatccaccctga

SEQ ID NO: 2284062 - DNA, 17 bp, Homo sapiens
agagccccggagcacca

SEQ ID NO: 2284063 - DNA, 20 bp, Homo sapiens
agagccctatctatgtcctg

SEQ ID NO: 2284064 - DNA, 22 bp, Homo sapiens
agagccctatctatgtcctgga

SEQ ID NO: 2284065 - DNA, 17 bp, Homo sapiens
agagccgcaccctggct

SEQ ID NO: 2284066 - DNA, 19 bp, Homo sapiens
agagccgcaccctggctgg

SEQ ID NO: 2284067 - DNA, 20 bp, Homo sapiens
agagccgcaccctggctgga

SEQ ID NO: 2284068 - DNA, 19 bp, Homo sapiens
agagcctttggtgaataac

SEQ ID NO: 2284069 - DNA, 19 bp, Homo sapiens
agagcgccacccgcccgcc

SEQ ID NO: 2284070 - DNA, 20 bp, Homo sapiens
agagcgccacccgcccgccc

SEQ ID NO: 2284071 - DNA, 23 bp, Homo sapiens
agagctatatatatatatatatg

SEQ ID NO: 2284072 - DNA, 12 bp, Homo sapiens
agagctcccagg

SEQ ID NO: 2284073 - DNA, 21 bp, Homo sapiens
agagctgagtcggctgggcag

SEQ ID NO: 2284074 - DNA, 15 bp, Homo sapiens
agagctgggactcag

SEQ ID NO: 2284075 - DNA, 12 bp, Homo sapiens
agaggaaatcac

SEQ ID NO: 2284076 - DNA, 19 bp, Homo sapiens
agaggacacggaccctgtg

SEQ ID NO: 2284077 - DNA, 22 bp, Homo sapiens
agaggacacggaccctgtgtgg

SEQ ID NO: 2284078 - DNA, 20 bp, Homo sapiens
agaggaccccattctgggac

SEQ ID NO: 2284079 - DNA, 14 bp, Homo sapiens
agaggcagggccct

SEQ ID NO: 2284080 - DNA, 16 bp, Homo sapiens
agaggcagggccctgg

SEQ ID NO: 2284081 - DNA, 15 bp, Homo sapiens
agaggcgagaggtga

SEQ ID NO: 2284082 - DNA, 23 bp, Homo sapiens
agaggcgagaggtgagctacttt

SEQ ID NO: 2284083 - DNA, 12 bp, Homo sapiens
agagggctgagc

SEQ ID NO: 2284084 - DNA, 13 bp, Homo sapiens
agagggctgagcc

SEQ ID NO: 2284085 - DNA, 15 bp, Homo sapiens
agagggctgagcccc

SEQ ID NO: 2284086 - DNA, 19 bp, Homo sapiens
agagggctgagcccctcct

SEQ ID NO: 2284087 - DNA, 17 bp, Homo sapiens
agaggggaagggcaggg

SEQ ID NO: 2284088 - DNA, 14 bp, Homo sapiens
agaggggcaaaaat

SEQ ID NO: 2284089 - DNA, 16 bp, Homo sapiens
agaggggcaaaaatat

SEQ ID NO: 2284090 - DNA, 15 bp, Homo sapiens
agaggggcggggcca

SEQ ID NO: 2284091 - DNA, 14 bp, Homo sapiens
agagtatatatgta

SEQ ID NO: 2284092 - DNA, 17 bp, Homo sapiens
agagtatatatgtacag

SEQ ID NO: 2284093 - DNA, 15 bp, Homo sapiens
agagtcattgttaca

SEQ ID NO: 2284094 - DNA, 13 bp, Homo sapiens
agagttgagcaca

SEQ ID NO: 2284095 - DNA, 15 bp, Homo sapiens
agagtttaacagata

SEQ ID NO: 2284096 - DNA, 13 bp, Homo sapiens
agataaaaagtgg

SEQ ID NO: 2284097 - DNA, 13 bp, Homo sapiens
agataaactgaaa

SEQ ID NO: 2284098 - DNA, 15 bp, Homo sapiens
agataaactgaaatt

SEQ ID NO: 2284099 - DNA, 13 bp, Homo sapiens
agataaatgcttt

SEQ ID NO: 2284100 - DNA, 20 bp, Homo sapiens
agataattatccaggatgtg

SEQ ID NO: 2284101 - DNA, 14 bp, Homo sapiens
agatacatttgatc

SEQ ID NO: 2284102 - DNA, 19 bp, Homo sapiens
agatacatttgatcttgta

SEQ ID NO: 2284103 - DNA, 23 bp, Homo sapiens
agatactatttagataacaagaa

SEQ ID NO: 2284104 - DNA, 13 bp, Homo sapiens
agatactgtatat

SEQ ID NO: 2284105 - DNA, 15 bp, Homo sapiens
agatactgtatatgt

SEQ ID NO: 2284106 - DNA, 20 bp, Homo sapiens
agatactttttcttttgtaa

SEQ ID NO: 2284107 - DNA, 12 bp, Homo sapiens
agatagcacatg

SEQ ID NO: 2284108 - DNA, 14 bp, Homo sapiens
agatatatatttcc

SEQ ID NO: 2284109 - DNA, 20 bp, Homo sapiens
agatatatatttccaaatat

SEQ ID NO: 2284110 - DNA, 23 bp, Homo sapiens
agatatatatttccaaatattct

SEQ ID NO: 2284111 - DNA, 20 bp, Homo sapiens
agatattatgtatagaaaat

SEQ ID NO: 2284112 - DNA, 18 bp, Homo sapiens
agatattcatactttcca

SEQ ID NO: 2284113 - DNA, 17 bp, Homo sapiens
agatatttaaatttagt

SEQ ID NO: 2284114 - DNA, 14 bp, Homo sapiens
agatcacaaatagt

SEQ ID NO: 2284115 - DNA, 14 bp, Homo sapiens
agatccatcctttt

SEQ ID NO: 2284116 - DNA, 16 bp, Homo sapiens
agatccatccttttgc

SEQ ID NO: 2284117 - DNA, 22 bp, Homo sapiens
agatccatccttttgcttcatc

SEQ ID NO: 2284118 - DNA, 20 bp, Homo sapiens
agatccgccctgggctctgg

SEQ ID NO: 2284119 - DNA, 19 bp, Homo sapiens
agatcctctttccccactg

SEQ ID NO: 2284120 - DNA, 20 bp, Homo sapiens
agatcctctttccccactga

SEQ ID NO: 2284121 - DNA, 22 bp, Homo sapiens
agatcctgtcccatgggctctg

SEQ ID NO: 2284122 - DNA, 15 bp, Homo sapiens
agatctcctgtaatt

SEQ ID NO: 2284123 - DNA, 18 bp, Homo sapiens
agatgaatcagtatgaag

SEQ ID NO: 2284124 - DNA, 22 bp, Homo sapiens
agatgaatcagtatgaagacac

SEQ ID NO: 2284125 - DNA, 21 bp, Homo sapiens
agatgacacataaatctgtct

SEQ ID NO: 2284126 - DNA, 16 bp, Homo sapiens
agatgacatttgcttt

SEQ ID NO: 2284127 - DNA, 16 bp, Homo sapiens
agatgactggaaacaa

SEQ ID NO: 2284128 - DNA, 21 bp, Homo sapiens
agatgaggaaataagactttt

SEQ ID NO: 2284129 - DNA, 22 bp, Homo sapiens
aggcaacattacaaacaaagga

SEQ ID NO: 2284130 - DNA, 18 bp, Homo sapiens
aggcaaggcagctcccag

SEQ ID NO: 2284131 - DNA, 16 bp, Homo sapiens
aggcaaggctgtcaat

SEQ ID NO: 2284132 - DNA, 16 bp, Homo sapiens
aggcaccgcctgcccc

SEQ ID NO: 2284133 - DNA, 20 bp, Homo sapiens
aggcagctcccaggtttaga

SEQ ID NO: 2284134 - DNA, 14 bp, Homo sapiens
aggcaggagggcat

SEQ ID NO: 2284135 - DNA, 17 bp, Homo sapiens
aggcaggagggcatgtg

SEQ ID NO: 2284136 - DNA, 18 bp, Homo sapiens
aggcaggagggcatgtgc

SEQ ID NO: 2284137 - DNA, 11 bp, Homo sapiens
aggcaggggct

SEQ ID NO: 2284138 - DNA, 21 bp, Homo sapiens
aggcagggtctcactctgttg

SEQ ID NO: 2284139 - DNA, 15 bp, Homo sapiens
aggcaggtgggcaga

SEQ ID NO: 2284140 - DNA, 14 bp, Homo sapiens
aggcagtggcttgg

SEQ ID NO: 2284141 - DNA, 20 bp, Homo sapiens
aggcatgaccctggagcccg

SEQ ID NO: 2284142 - DNA, 21 bp, Homo sapiens
aggcatgaccctggagcccgg

SEQ ID NO: 2284143 - DNA, 17 bp, Homo sapiens
aggcatgtgatgagagg

SEQ ID NO: 2284144 - DNA, 20 bp, Homo sapiens
aggcatgtgatgagaggaaa

SEQ ID NO: 2284145 - DNA, 24 bp, Homo sapiens
aggcatgtgatgagaggaaatcac

SEQ ID NO: 2284146 - DNA, 16 bp, Homo sapiens
aggcattcagcaatta

SEQ ID NO: 2284147 - DNA, 19 bp, Homo sapiens
aggccaaacacccaagcac

SEQ ID NO: 2284148 - DNA, 22 bp, Homo sapiens
aggccaatgaaggctgaatcaa

SEQ ID NO: 2284149 - DNA, 14 bp, Homo sapiens
aggccatgcccacc

SEQ ID NO: 2284150 - DNA, 19 bp, Homo sapiens
aggcccccggaggcgccca

SEQ ID NO: 2284151 - DNA, 21 bp, Homo sapiens
aggcccccggaggcgcccacc

SEQ ID NO: 2284152 - DNA, 22 bp, Homo sapiens
aggcccccggaggcgcccacct

SEQ ID NO: 2284153 - DNA, 20 bp, Homo sapiens
aggccgacaggaggccatgc

SEQ ID NO: 2284154 - DNA, 21 bp, Homo sapiens
aggcctgaaatgtttccaggc

SEQ ID NO: 2284155 - DNA, 18 bp, Homo sapiens
aggcctgagggaagccca

SEQ ID NO: 2284156 - DNA, 19 bp, Homo sapiens
aggcctgagggaagcccac

SEQ ID NO: 2284157 - DNA, 22 bp, Homo sapiens
aggcctgagggaagcccacccg

SEQ ID NO: 2284158 - DNA, 16 bp, Homo sapiens
aggcctgttccctgag

SEQ ID NO: 2284159 - DNA, 14 bp, Homo sapiens
aggccttcagaaaa

SEQ ID NO: 2284160 - DNA, 19 bp, Homo sapiens
aggccttcagaaaagacac

SEQ ID NO: 2284161 - DNA, 15 bp, Homo sapiens
aggcgcgcaccgccc

SEQ ID NO: 2284162 - DNA, 19 bp, Homo sapiens
aggcgcgcaccgcccaacc

SEQ ID NO: 2284163 - DNA, 17 bp, Homo sapiens
aggcggtatccagaggt

SEQ ID NO: 2284164 - DNA, 18 bp, Homo sapiens
aggcgtagggccagggct

SEQ ID NO: 2284165 - DNA, 16 bp, Homo sapiens
aggcgtcttgtatttt

SEQ ID NO: 2284166 - DNA, 17 bp, Homo sapiens
aggcgtcttgtattttc

SEQ ID NO: 2284167 - DNA, 17 bp, Homo sapiens
aggctaaaaacatttta

SEQ ID NO: 2284168 - DNA, 19 bp, Homo sapiens
aggctaaaaacattttaaa

SEQ ID NO: 2284169 - DNA, 15 bp, Homo sapiens
aggctaccagaagag

SEQ ID NO: 2284170 - DNA, 16 bp, Homo sapiens
aggctattataatata

SEQ ID NO: 2284171 - DNA, 16 bp, Homo sapiens
aggctcacaactgttt

SEQ ID NO: 2284172 - DNA, 21 bp, Homo sapiens
aggctcacaactgtttttgaa

SEQ ID NO: 2284173 - DNA, 14 bp, Homo sapiens
aggctcacatgctc

SEQ ID NO: 2284174 - DNA, 19 bp, Homo sapiens
aggctctatctgctgggct

SEQ ID NO: 2284175 - DNA, 23 bp, Homo sapiens
aggctctatttcggaaatacact

SEQ ID NO: 2284176 - DNA, 19 bp, Homo sapiens
aggctgaatcaaagacatt

SEQ ID NO: 2284177 - DNA, 21 bp, Homo sapiens
aggctgaatcaaagacatttc

SEQ ID NO: 2284178 - DNA, 14 bp, Homo sapiens
aggctgccccaccc

SEQ ID NO: 2284179 - DNA, 16 bp, Homo sapiens
aggctgcgcctgcccg

SEQ ID NO: 2284180 - DNA, 18 bp, Homo sapiens
aggctgcgcctgcccgcc

SEQ ID NO: 2284181 - DNA, 17 bp, Homo sapiens
aggctgctaagtggaag

SEQ ID NO: 2284182 - DNA, 23 bp, Homo sapiens
aggctgcttagatttctagcagt

SEQ ID NO: 2284183 - DNA, 15 bp, Homo sapiens
aggctggaccaactg

SEQ ID NO: 2284184 - DNA, 17 bp, Homo sapiens
aggctggaccaactgct

SEQ ID NO: 2284185 - DNA, 16 bp, Homo sapiens
aggctggatgtgcttt

SEQ ID NO: 2284186 - DNA, 14 bp, Homo sapiens
aggctgtattttct

SEQ ID NO: 2284187 - DNA, 18 bp, Homo sapiens
aggctgtattttctttta

SEQ ID NO: 2284188 - DNA, 19 bp, Homo sapiens
aggctgtcaattacaggaa

SEQ ID NO: 2284189 - DNA, 21 bp, Homo sapiens
aggcttaatgagcataggtag

SEQ ID NO: 2284190 - DNA, 14 bp, Homo sapiens
aggcttccagctca

SEQ ID NO: 2284191 - DNA, 19 bp, Homo sapiens
aggctttattcttccaagt

SEQ ID NO: 2284192 - DNA, 17 bp, Homo sapiens
aggctttctattggcat

SEQ ID NO: 2284193 - DNA, 23 bp, Homo sapiens
aggctttctattggcatggattt

SEQ ID NO: 2284194 - DNA, 20 bp, Homo sapiens
agggaaaacataatatcttg

SEQ ID NO: 2284195 - DNA, 12 bp, Homo sapiens
agggaaacaaaa

SEQ ID NO: 2284196 - DNA, 13 bp, Homo sapiens
agggaaatgctgt

SEQ ID NO: 2284197 - DNA, 15 bp, Homo sapiens
agggaaatgctgttg

SEQ ID NO: 2284198 - DNA, 15 bp, Homo sapiens
agggaagcccacccg

SEQ ID NO: 2284199 - DNA, 18 bp, Homo sapiens
agggaagcccacccgccc

SEQ ID NO: 2284200 - DNA, 12 bp, Homo sapiens
agggagaaggat

SEQ ID NO: 2284201 - DNA, 12 bp, Homo sapiens
agggagaccctg

SEQ ID NO: 2284202 - DNA, 13 bp, Homo sapiens
agggaggggaaga

SEQ ID NO: 2284203 - DNA, 14 bp, Homo sapiens
agggatccagagac

SEQ ID NO: 2284204 - DNA, 16 bp, Homo sapiens
agggatccagagacct

SEQ ID NO: 2284205 - DNA, 20 bp, Homo sapiens
agggatccagagacctgctc

SEQ ID NO: 2284206 - DNA, 15 bp, Homo sapiens
agggcaggagctcac

SEQ ID NO: 2284207 - DNA, 19 bp, Homo sapiens
agggcaggagctcacaccg

SEQ ID NO: 2284208 - DNA, 14 bp, Homo sapiens
agggcaggcctgtt

SEQ ID NO: 2284209 - DNA, 15 bp, Homo sapiens
agggcatttttcttg

SEQ ID NO: 2284210 - DNA, 13 bp, Homo sapiens
agggccagggctc

SEQ ID NO: 2284211 - DNA, 17 bp, Homo sapiens
agggccagggctctggc

SEQ ID NO: 2284212 - DNA, 23 bp, Homo sapiens
agggccctggggtctctgagcag

SEQ ID NO: 2284213 - DNA, 14 bp, Homo sapiens
agggccgcagggcg

SEQ ID NO: 2284214 - DNA, 13 bp, Homo sapiens
agggcctctggac

SEQ ID NO: 2284215 - DNA, 20 bp, Homo sapiens
agggcgcaggaaccgaggac

SEQ ID NO: 2284216 - DNA, 21 bp, Homo sapiens
agggcgcaggaaccgaggact

SEQ ID NO: 2284217 - DNA, 16 bp, Homo sapiens
agggcgctccggcaga

SEQ ID NO: 2284218 - DNA, 12 bp, Homo sapiens
agggctgagccc

SEQ ID NO: 2284219 - DNA, 13 bp, Homo sapiens
agggctgagcccc

SEQ ID NO: 2284220 - DNA, 14 bp, Homo sapiens
agggctttaaataa

SEQ ID NO: 2284221 - DNA, 18 bp, Homo sapiens
agggctttaaataaaaga

SEQ ID NO: 2284222 - DNA, 21 bp, Homo sapiens
aggggaagagagaggcctggg

SEQ ID NO: 2284223 - DNA, 18 bp, Homo sapiens
aggggagcaaggctgcta

SEQ ID NO: 2284224 - DNA, 19 bp, Homo sapiens
aggggatcataaagttaga

SEQ ID NO: 2284225 - DNA, 15 bp, Homo sapiens
aggggattacagttc

SEQ ID NO: 2284226 - DNA, 16 bp, Homo sapiens
aggggcaaaaatattt

SEQ ID NO: 2284227 - DNA, 22 bp, Homo sapiens
aggggcacacttccccttggga

SEQ ID NO: 2284228 - DNA, 13 bp, Homo sapiens
aggggccaggaag

SEQ ID NO: 2284229 - DNA, 21 bp, Homo sapiens
aggggccaggaaggggacagg

SEQ ID NO: 2284230 - DNA, 16 bp, Homo sapiens
aggggcccatgtgggc

SEQ ID NO: 2284231 - DNA, 23 bp, Homo sapiens
aggggcgctgcccccacagatcc

SEQ ID NO: 2284232 - DNA, 13 bp, Homo sapiens
aggggcgggagtg

SEQ ID NO: 2284233 - DNA, 15 bp, Homo sapiens
aggggcggggccagg

SEQ ID NO: 2284234 - DNA, 22 bp, Homo sapiens
aggggctgactctccagggagc

SEQ ID NO: 2284235 - DNA, 17 bp, Homo sapiens
aggggctggagggctgg

SEQ ID NO: 2284236 - DNA, 17 bp, Homo sapiens
aggggctggggacttcg

SEQ ID NO: 2284237 - DNA, 15 bp, Homo sapiens
aggggcttggagcag

SEQ ID NO: 2284238 - DNA, 18 bp, Homo sapiens
agggggtcagttgggccc

SEQ ID NO: 2284239 - DNA, 18 bp, Homo sapiens
aggggtggaagggcagga

SEQ ID NO: 2284240 - DNA, 15 bp, Homo sapiens
ataataataataaca

SEQ ID NO: 2284241 - DNA, 14 bp, Homo sapiens
ataatatagaaaga

SEQ ID NO: 2284242 - DNA, 18 bp, Homo sapiens
ataatatagaaagaaaat

SEQ ID NO: 2284243 - DNA, 11 bp, Homo sapiens
ataatctcatc

SEQ ID NO: 2284244 - DNA, 16 bp, Homo sapiens
ataatctcatccccaa

SEQ ID NO: 2284245 - DNA, 12 bp, Homo sapiens
ataatgaataat

SEQ ID NO: 2284246 - DNA, 16 bp, Homo sapiens
ataatgatctgaatct

SEQ ID NO: 2284247 - DNA, 15 bp, Homo sapiens
ataatgattcaatgt

SEQ ID NO: 2284248 - DNA, 18 bp, Homo sapiens
ataatgattcaatgtgaa

SEQ ID NO: 2284249 - DNA, 19 bp, Homo sapiens
ataatgattcaatgtgaat

SEQ ID NO: 2284250 - DNA, 11 bp, Homo sapiens
ataatgattta

SEQ ID NO: 2284251 - DNA, 22 bp, Homo sapiens
ataatgtttccctcaagaacaa

SEQ ID NO: 2284252 - DNA, 16 bp, Homo sapiens
ataattacttaatgtg

SEQ ID NO: 2284253 - DNA, 18 bp, Homo sapiens
ataatttacctgaagtct

SEQ ID NO: 2284254 - DNA, 13 bp, Homo sapiens
ataattttaacag

SEQ ID NO: 2284255 - DNA, 22 bp, Homo sapiens
ataatttttgtggcatgttgta

SEQ ID NO: 2284256 - DNA, 22 bp, Homo sapiens
atacaaagctgtcactcacaaa

SEQ ID NO: 2284257 - DNA, 13 bp, Homo sapiens
atacaattcagtt

SEQ ID NO: 2284258 - DNA, 18 bp, Homo sapiens
atacaattcagttttagt

SEQ ID NO: 2284259 - DNA, 14 bp, Homo sapiens
atacactgtatcta

SEQ ID NO: 2284260 - DNA, 16 bp, Homo sapiens
atacatgtaaaaatgt

SEQ ID NO: 2284261 - DNA, 20 bp, Homo sapiens
atacattgtgttttcctaaa

SEQ ID NO: 2284262 - DNA, 12 bp, Homo sapiens
atacatttagtt

SEQ ID NO: 2284263 - DNA, 22 bp, Homo sapiens
atacctccctcatttaagaaaa

SEQ ID NO: 2284264 - DNA, 16 bp, Homo sapiens
atacctctaataacct

SEQ ID NO: 2284265 - DNA, 17 bp, Homo sapiens
atacctgtctcagctgt

SEQ ID NO: 2284266 - DNA, 12 bp, Homo sapiens
atactatgtaag

SEQ ID NO: 2284267 - DNA, 17 bp, Homo sapiens
atactatgtaagggctt

SEQ ID NO: 2284268 - DNA, 20 bp, Homo sapiens
atactatgtaagggctttaa

SEQ ID NO: 2284269 - DNA, 13 bp, Homo sapiens
atactatttagat

SEQ ID NO: 2284270 - DNA, 21 bp, Homo sapiens
atactatttagataacaagaa

SEQ ID NO: 2284271 - DNA, 22 bp, Homo sapiens
atactcaaagaggccagtactt

SEQ ID NO: 2284272 - DNA, 16 bp, Homo sapiens
atactcaccaaaatat

SEQ ID NO: 2284273 - DNA, 17 bp, Homo sapiens
atactcaccaaaatata

SEQ ID NO: 2284274 - DNA, 20 bp, Homo sapiens
atatgattgaaaagaagaaa

SEQ ID NO: 2284275 - DNA, 16 bp, Homo sapiens
atatgcaacctgtgca

SEQ ID NO: 2284276 - DNA, 19 bp, Homo sapiens
atatggaaatcctgttact

SEQ ID NO: 2284277 - DNA, 15 bp, Homo sapiens
atatgtaaatataca

SEQ ID NO: 2284278 - DNA, 22 bp, Homo sapiens
atatgtaacagttggtgatttt

SEQ ID NO: 2284279 - DNA, 15 bp, Homo sapiens
atatgtaacatgtct

SEQ ID NO: 2284280 - DNA, 21 bp, Homo sapiens
atatgtaacatgtctaaagtt

SEQ ID NO: 2284281 - DNA, 19 bp, Homo sapiens
atatgtacagttatacata

SEQ ID NO: 2284282 - DNA, 20 bp, Homo sapiens
atatgtacttttccatttat

SEQ ID NO: 2284283 - DNA, 20 bp, Homo sapiens
atatgtagcattaaatataa

SEQ ID NO: 2284284 - DNA, 22 bp, Homo sapiens
atatgtagcattaaatataaaa

SEQ ID NO: 2284285 - DNA, 16 bp, Homo sapiens
atatgtcaaaaatatt

SEQ ID NO: 2284286 - DNA, 17 bp, Homo sapiens
atatgtcaaaaatattt

SEQ ID NO: 2284287 - DNA, 18 bp, Homo sapiens
atatgtcaaaaatatttt

SEQ ID NO: 2284288 - DNA, 21 bp, Homo sapiens
atatgtgacactgcagcagaa

SEQ ID NO: 2284289 - DNA, 21 bp, Homo sapiens
atatgtggagttcatcttgaa

SEQ ID NO: 2284290 - DNA, 22 bp, Homo sapiens
atatgttagattaggtgtaaga

SEQ ID NO: 2284291 - DNA, 15 bp, Homo sapiens
atatgttatttttgg

SEQ ID NO: 2284292 - DNA, 15 bp, Homo sapiens
atatgttgctgaaac

SEQ ID NO: 2284293 - DNA, 16 bp, Homo sapiens
atattaaaaatataca

SEQ ID NO: 2284294 - DNA, 15 bp, Homo sapiens
atattaatatgtact

SEQ ID NO: 2284295 - DNA, 18 bp, Homo sapiens
atattaatatgtactttt

SEQ ID NO: 2284296 - DNA, 14 bp, Homo sapiens
atattacatttcat

SEQ ID NO: 2284297 - DNA, 16 bp, Homo sapiens
atattagagtgccctt

SEQ ID NO: 2284298 - DNA, 14 bp, Homo sapiens
atattatctgaact

SEQ ID NO: 2284299 - DNA, 22 bp, Homo sapiens
atattatgtatagaaaataaaa

SEQ ID NO: 2284300 - DNA, 18 bp, Homo sapiens
atattattgctatatttg

SEQ ID NO: 2284301 - DNA, 22 bp, Homo sapiens
atattattgctatatttgctaa

SEQ ID NO: 2284302 - DNA, 16 bp, Homo sapiens
atattcatactttcca

SEQ ID NO: 2284303 - DNA, 23 bp, Homo sapiens
atattcatctgttgacaatttgc

SEQ ID NO: 2284304 - DNA, 17 bp, Homo sapiens
atattcattcatggacc

SEQ ID NO: 2284305 - DNA, 19 bp, Homo sapiens
atattctaaaaaagatact

SEQ ID NO: 2284306 - DNA, 12 bp, Homo sapiens
atatttaaaatt

SEQ ID NO: 2284307 - DNA, 22 bp, Homo sapiens
atatttaaatttagtgctcaga

SEQ ID NO: 2284308 - DNA, 19 bp, Homo sapiens
atatttattattttcatat

SEQ ID NO: 2284309 - DNA, 12 bp, Homo sapiens
atatttccaaat

SEQ ID NO: 2284310 - DNA, 14 bp, Homo sapiens
atatttccaaatat

SEQ ID NO: 2284311 - DNA, 18 bp, Homo sapiens
atatttctaagcttattt

SEQ ID NO: 2284312 - DNA, 21 bp, Homo sapiens
atatttctaagcttatttcta

SEQ ID NO: 2284313 - DNA, 15 bp, Homo sapiens
atatttgcttattta

SEQ ID NO: 2284314 - DNA, 17 bp, Homo sapiens
atatttgcttatttata

SEQ ID NO: 2284315 - DNA, 19 bp, Homo sapiens
atatttgcttatttatatt

SEQ ID NO: 2284316 - DNA, 19 bp, Homo sapiens
atatttgtagctagaatat

SEQ ID NO: 2284317 - DNA, 13 bp, Homo sapiens
atattttcaaaat

SEQ ID NO: 2284318 - DNA, 23 bp, Homo sapiens
atatttttatataatatgaatat

SEQ ID NO: 2284319 - DNA, 21 bp, Homo sapiens
atatttttatgtgaaggtgtt

SEQ ID NO: 2284320 - DNA, 22 bp, Homo sapiens
atatttttatgtgaaggtgttt

SEQ ID NO: 2284321 - DNA, 14 bp, Homo sapiens
atatttttttctag

SEQ ID NO: 2284322 - DNA, 23 bp, Homo sapiens
atcaaaagtccttagaatgaggg

SEQ ID NO: 2284323 - DNA, 16 bp, Homo sapiens
atcaaagacatttcat

SEQ ID NO: 2284324 - DNA, 14 bp, Homo sapiens
atcaaatcattcaa

SEQ ID NO: 2284325 - DNA, 17 bp, Homo sapiens
atcaaatcattcaaaac

SEQ ID NO: 2284326 - DNA, 23 bp, Homo sapiens
atcaaatcattcaaaactttcag

SEQ ID NO: 2284327 - DNA, 22 bp, Homo sapiens
atcaaatgattcatttttctgt

SEQ ID NO: 2284328 - DNA, 21 bp, Homo sapiens
atcaacagcatgtctactgct

SEQ ID NO: 2284329 - DNA, 20 bp, Homo sapiens
atcaacttaattctgttaca

SEQ ID NO: 2284330 - DNA, 23 bp, Homo sapiens
atcaacttttgaaatttaaaaat

SEQ ID NO: 2284331 - DNA, 15 bp, Homo sapiens
atcaatacttttgtg

SEQ ID NO: 2284332 - DNA, 12 bp, Homo sapiens
atcacaactttt

SEQ ID NO: 2284333 - DNA, 13 bp, Homo sapiens
atcacacttgcaa

SEQ ID NO: 2284334 - DNA, 17 bp, Homo sapiens
atcacacttgcaaatga

SEQ ID NO: 2284335 - DNA, 18 bp, Homo sapiens
atcacacttgcaaatgaa

SEQ ID NO: 2284336 - DNA, 22 bp, Homo sapiens
atcacaggctctgcatacacat

SEQ ID NO: 2284337 - DNA, 14 bp, Homo sapiens
atcacggcatgttt

SEQ ID NO: 2284338 - DNA, 14 bp, Homo sapiens
atcacgggcccgct

SEQ ID NO: 2284339 - DNA, 15 bp, Homo sapiens
atcacgggcccgctc

SEQ ID NO: 2284340 - DNA, 16 bp, Homo sapiens
atcacgggcccgctca

SEQ ID NO: 2284341 - DNA, 14 bp, Homo sapiens
atcagaaagttggc

SEQ ID NO: 2284342 - DNA, 14 bp, Homo sapiens
atcagaaattttct

SEQ ID NO: 2284343 - DNA, 16 bp, Homo sapiens
atcagatcttacaagt

SEQ ID NO: 2284344 - DNA, 14 bp, Homo sapiens
atcagcccctgctg

SEQ ID NO: 2284345 - DNA, 20 bp, Homo sapiens
atcagcccggtgtgaggagg

SEQ ID NO: 2284346 - DNA, 13 bp, Homo sapiens
atcagctagattt

SEQ ID NO: 2284347 - DNA, 15 bp, Homo sapiens
atcagtatgaagaca

SEQ ID NO: 2284348 - DNA, 21 bp, Homo sapiens
atcagtggttcgggggaaata

SEQ ID NO: 2284349 - DNA, 22 bp, Homo sapiens
atcagttggacagtaagatttt

SEQ ID NO: 2284350 - DNA, 14 bp, Homo sapiens
atcatcaatacttt

SEQ ID NO: 2284351 - DNA, 15 bp, Homo sapiens
atcatcctattgtct

SEQ ID NO: 2284352 - DNA, 14 bp, Homo sapiens
atcatcttctccca

SEQ ID NO: 2284353 - DNA, 23 bp, Homo sapiens
atcatgtaatagtggctttcatt

SEQ ID NO: 2284354 - DNA, 15 bp, Homo sapiens
atcattatttcatga

SEQ ID NO: 2284355 - DNA, 13 bp, Homo sapiens
atcattgaaatct

SEQ ID NO: 2284356 - DNA, 18 bp, Homo sapiens
atcattgccctcttcaag

SEQ ID NO: 2284357 - DNA, 21 bp, Homo sapiens
atcatttatcttatctagcaa

SEQ ID NO: 2284358 - DNA, 15 bp, Homo sapiens
atcatttcccctccc

SEQ ID NO: 2284359 - DNA, 14 bp, Homo sapiens
atccaactttgtag

SEQ ID NO: 2284360 - DNA, 19 bp, Homo sapiens
atccaatgatataggaaaa

SEQ ID NO: 2284361 - DNA, 19 bp, Homo sapiens
atccaattcattatgtcaa

SEQ ID NO: 2284362 - DNA, 13 bp, Homo sapiens
atccacacacagc

SEQ ID NO: 2284363 - DNA, 20 bp, Homo sapiens
atccacacacagcagctcca

SEQ ID NO: 2284364 - DNA, 12 bp, Homo sapiens
atccaccctgag

SEQ ID NO: 2284365 - DNA, 18 bp, Homo sapiens
atccagagacctgctcca

SEQ ID NO: 2284366 - DNA, 20 bp, Homo sapiens
atccagagacctgctccaga

SEQ ID NO: 2284367 - DNA, 23 bp, Homo sapiens
atccagaggtgagggaggcctga

SEQ ID NO: 2284368 - DNA, 21 bp, Homo sapiens
atccagtatcttgaagacttt

SEQ ID NO: 2284369 - DNA, 16 bp, Homo sapiens
atccatacaaaactat

SEQ ID NO: 2284370 - DNA, 15 bp, Homo sapiens
atccatatcagctct

SEQ ID NO: 2284371 - DNA, 16 bp, Homo sapiens
atccatatcagctctg

SEQ ID NO: 2284372 - DNA, 17 bp, Homo sapiens
atccatccttttgcttc

SEQ ID NO: 2284373 - DNA, 21 bp, Homo sapiens
atccatgtactttccctgtgt

SEQ ID NO: 2284374 - DNA, 20 bp, Homo sapiens
atcccaaacccttcagtgcc

SEQ ID NO: 2284375 - DNA, 20 bp, Homo sapiens
atcccacttatcaaatcatt

SEQ ID NO: 2284376 - DNA, 15 bp, Homo sapiens
atcccagctcactgc

SEQ ID NO: 2284377 - DNA, 16 bp, Homo sapiens
atcccagctcactgca

SEQ ID NO: 2284378 - DNA, 22 bp, Homo sapiens
atcccccgtgtattcaggaccc

SEQ ID NO: 2284379 - DNA, 19 bp, Homo sapiens
atccctccccttgccacat

SEQ ID NO: 2284380 - DNA, 12 bp, Homo sapiens
atccgccctggg

SEQ ID NO: 2284381 - DNA, 15 bp, Homo sapiens
atcctataaatgtga

SEQ ID NO: 2284382 - DNA, 19 bp, Homo sapiens
atcctcccgccccagcctc

SEQ ID NO: 2284383 - DNA, 20 bp, Homo sapiens
atcctcccgccccagcctcc

SEQ ID NO: 2284384 - DNA, 19 bp, Homo sapiens
atcctcgcagccacaccta

SEQ ID NO: 2284385 - DNA, 17 bp, Homo sapiens
atcctctttccccactg

SEQ ID NO: 2284386 - DNA, 22 bp, Homo sapiens
atcctctttccccactgaagaa

SEQ ID NO: 2284387 - DNA, 13 bp, Homo sapiens
atcctgagccaga

SEQ ID NO: 2284388 - DNA, 17 bp, Homo sapiens
atcctgagccagatttc

SEQ ID NO: 2284389 - DNA, 23 bp, Homo sapiens
atcctgggcatccccagccccct

SEQ ID NO: 2284390 - DNA, 14 bp, Homo sapiens
atcctggtctgcac

SEQ ID NO: 2284391 - DNA, 23 bp, Homo sapiens
atcctgtaaggtctgtaaatcag

SEQ ID NO: 2284392 - DNA, 20 bp, Homo sapiens
atcctgtgtgattacagcat

SEQ ID NO: 2284393 - DNA, 19 bp, Homo sapiens
atcctgttaggggaaaata

SEQ ID NO: 2284394 - DNA, 17 bp, Homo sapiens
atccttcccgcagcacc

SEQ ID NO: 2284395 - DNA, 19 bp, Homo sapiens
atccttcccgcagcaccag

SEQ ID NO: 2284396 - DNA, 17 bp, Homo sapiens
atccttctaaagtgctg

SEQ ID NO: 2284397 - DNA, 22 bp, Homo sapiens
atccttgaggacctccacctgg

SEQ ID NO: 2284398 - DNA, 18 bp, Homo sapiens
atccttgcacttctgtta

SEQ ID NO: 2284399 - DNA, 23 bp, Homo sapiens
atccttttgcttcatctggagtc

SEQ ID NO: 2284400 - DNA, 20 bp, Homo sapiens
atccttttttattgaataac

SEQ ID NO: 2284401 - DNA, 21 bp, Homo sapiens
atcgcttgaacccaggtggcg

SEQ ID NO: 2284402 - DNA, 17 bp, Homo sapiens
atcggttcaagttgatg

SEQ ID NO: 2284403 - DNA, 17 bp, Homo sapiens
atcgtttcacatctgta

SEQ ID NO: 2284404 - DNA, 16 bp, Homo sapiens
atctaaaaaataactg

SEQ ID NO: 2284405 - DNA, 19 bp, Homo sapiens
atctagcaagaagattcta

SEQ ID NO: 2284406 - DNA, 13 bp, Homo sapiens
atctattttctat

SEQ ID NO: 2284407 - DNA, 16 bp, Homo sapiens
atctattttctatgta

SEQ ID NO: 2284408 - DNA, 17 bp, Homo sapiens
atctcaaacactgctta

SEQ ID NO: 2284409 - DNA, 17 bp, Homo sapiens
atctcacttcagttgtg

SEQ ID NO: 2284410 - DNA, 22 bp, Homo sapiens
atctcacttcagttgtggcctc

SEQ ID NO: 2284411 - DNA, 20 bp, Homo sapiens
atctcatgtctgtttaatac

SEQ ID NO: 2284412 - DNA, 17 bp, Homo sapiens
atctccagccaatttca

SEQ ID NO: 2284413 - DNA, 18 bp, Homo sapiens
atctccagccaatttcaa

SEQ ID NO: 2284414 - DNA, 19 bp, Homo sapiens
atctccatccttaactgtc

SEQ ID NO: 2284415 - DNA, 22 bp, Homo sapiens
atctccatccttaactgtccag

SEQ ID NO: 2284416 - DNA, 13 bp, Homo sapiens
atctccattgcat

SEQ ID NO: 2284417 - DNA, 19 bp, Homo sapiens
atctcctgtaattttgtag

SEQ ID NO: 2284418 - DNA, 16 bp, Homo sapiens
atctctaaaattctag

SEQ ID NO: 2284419 - DNA, 18 bp, Homo sapiens
atctctaaaattctagtc

SEQ ID NO: 2284420 - DNA, 16 bp, Homo sapiens
atctctactttcctga

SEQ ID NO: 2284421 - DNA, 22 bp, Homo sapiens
atctctactttcctgatgttga

SEQ ID NO: 2284422 - DNA, 21 bp, Homo sapiens
atctctgattaaatttaatat

SEQ ID NO: 2284423 - DNA, 20 bp, Homo sapiens
atctcttgtaccagcccagg

SEQ ID NO: 2284424 - DNA, 19 bp, Homo sapiens
atctgatttgcatattcat

SEQ ID NO: 2284425 - DNA, 18 bp, Homo sapiens
atctgcaaatagtttcaa

SEQ ID NO: 2284426 - DNA, 18 bp, Homo sapiens
atctgctgagctctgacc

SEQ ID NO: 2284427 - DNA, 17 bp, Homo sapiens
atctgctgcctctgaaa

SEQ ID NO: 2284428 - DNA, 18 bp, Homo sapiens
atctgctgcctctgaaaa

SEQ ID NO: 2284429 - DNA, 20 bp, Homo sapiens
atctgctgcctctgaaaata

SEQ ID NO: 2284430 - DNA, 15 bp, Homo sapiens
atctgctgggctggc

SEQ ID NO: 2284431 - DNA, 16 bp, Homo sapiens
atctgctttattgcct

SEQ ID NO: 2284432 - DNA, 19 bp, Homo sapiens
atctgctttattgcctctg

SEQ ID NO: 2284433 - DNA, 22 bp, Homo sapiens
atctggagtccctcctccccca

SEQ ID NO: 2284434 - DNA, 21 bp, Homo sapiens
atctgggttttagaaattcta

SEQ ID NO: 2284435 - DNA, 16 bp, Homo sapiens
atctgtaaatttaact

SEQ ID NO: 2284436 - DNA, 23 bp, Homo sapiens
atctgtaaatttaactgcatata

SEQ ID NO: 2284437 - DNA, 21 bp, Homo sapiens
atctgtaagaggtactaaaaa

SEQ ID NO: 2284438 - DNA, 16 bp, Homo sapiens
atctgtatatcagctc

SEQ ID NO: 2284439 - DNA, 18 bp, Homo sapiens
atctgtatatcagctcta

SEQ ID NO: 2284440 - DNA, 17 bp, Homo sapiens
atctgtctgattctatg

SEQ ID NO: 2284441 - DNA, 12 bp, Homo sapiens
atctgtcttgta

SEQ ID NO: 2284442 - DNA, 21 bp, Homo sapiens
atctgtgccatagaacaagat

SEQ ID NO: 2284443 - DNA, 19 bp, Homo sapiens
atctgtgttgtctctctaa

SEQ ID NO: 2284444 - DNA, 23 bp, Homo sapiens
atcttcacaatatccaatgaaga

SEQ ID NO: 2284445 - DNA, 17 bp, Homo sapiens
atcttccatatgctctt

SEQ ID NO: 2284446 - DNA, 16 bp, Homo sapiens
atcttcttactaagct

SEQ ID NO: 2284447 - DNA, 17 bp, Homo sapiens
atcttgaagaatattgt

SEQ ID NO: 2284448 - DNA, 17 bp, Homo sapiens
atcttgaattgtaagga

SEQ ID NO: 2284449 - DNA, 12 bp, Homo sapiens
atcttgtaaata

SEQ ID NO: 2284450 - DNA, 15 bp, Homo sapiens
atcttgtctcactag

SEQ ID NO: 2284451 - DNA, 23 bp, Homo sapiens
atctttaatataatattatactg

SEQ ID NO: 2284452 - DNA, 21 bp, Homo sapiens
atcttttactcacattctgtt

SEQ ID NO: 2284453 - DNA, 13 bp, Homo sapiens
atgaaacaaaaaa

SEQ ID NO: 2284454 - DNA, 13 bp, Homo sapiens
atgaaagagaaaa

SEQ ID NO: 2284455 - DNA, 23 bp, Homo sapiens
atgaacagttctcccttcaactg

SEQ ID NO: 2284456 - DNA, 20 bp, Homo sapiens
atgaaccacatggaacttaa

SEQ ID NO: 2284457 - DNA, 14 bp, Homo sapiens
atgaactcaatgca

SEQ ID NO: 2284458 - DNA, 19 bp, Homo sapiens
atgaactcaatgcatgatg

SEQ ID NO: 2284459 - DNA, 22 bp, Homo sapiens
atgaactcaatgcatgatgact

SEQ ID NO: 2284460 - DNA, 19 bp, Homo sapiens
atgaactgtatattattgc

SEQ ID NO: 2284461 - DNA, 16 bp, Homo sapiens
atgaagataaatgctt

SEQ ID NO: 2284462 - DNA, 18 bp, Homo sapiens
atgaagataaatgcttta

SEQ ID NO: 2284463 - DNA, 22 bp, Homo sapiens
atgaagataaatgctttaaata

SEQ ID NO: 2284464 - DNA, 14 bp, Homo sapiens
atgaagtaagttct

SEQ ID NO: 2284465 - DNA, 22 bp, Homo sapiens
atgaataaaattgttatttcaa

SEQ ID NO: 2284466 - DNA, 22 bp, Homo sapiens
atgaatatatacataaaaattg

SEQ ID NO: 2284467 - DNA, 16 bp, Homo sapiens
atgaatgcctttcaaa

SEQ ID NO: 2284468 - DNA, 17 bp, Homo sapiens
atgaccagtcaagggca

SEQ ID NO: 2284469 - DNA, 17 bp, Homo sapiens
atgacccggatgaactc

SEQ ID NO: 2284470 - DNA, 11 bp, Homo sapiens
atgaccctgga

SEQ ID NO: 2284471 - DNA, 13 bp, Homo sapiens
atgacctttcaat

SEQ ID NO: 2284472 - DNA, 17 bp, Homo sapiens
atgacggggtgttgcca

SEQ ID NO: 2284473 - DNA, 18 bp, Homo sapiens
atgactagcaaacaaaaa

SEQ ID NO: 2284474 - DNA, 19 bp, Homo sapiens
atgactagcaaacaaaaat

SEQ ID NO: 2284475 - DNA, 20 bp, Homo sapiens
atgactagcaaacaaaaata

SEQ ID NO: 2284476 - DNA, 18 bp, Homo sapiens
atgactgaagtaataact

SEQ ID NO: 2284477 - DNA, 15 bp, Homo sapiens
atgactggaaacaag

SEQ ID NO: 2284478 - DNA, 14 bp, Homo sapiens
atgagaaaaaaaca

SEQ ID NO: 2284479 - DNA, 14 bp, Homo sapiens
atgagaaatcatgt

SEQ ID NO: 2284480 - DNA, 18 bp, Homo sapiens
atgagaaattgtgccaaa

SEQ ID NO: 2284481 - DNA, 17 bp, Homo sapiens
atgagacctcccccagg

SEQ ID NO: 2284482 - DNA, 16 bp, Homo sapiens
atgagaggaaatcacc

SEQ ID NO: 2284483 - DNA, 23 bp, Homo sapiens
atgagattgtacattttttactt

SEQ ID NO: 2284484 - DNA, 21 bp, Homo sapiens
atgagcccaacactcacttaa

SEQ ID NO: 2284485 - DNA, 20 bp, Homo sapiens
atgagctctctaatagaagt

SEQ ID NO: 2284486 - DNA, 14 bp, Homo sapiens
atgagggaaacaaa

SEQ ID NO: 2284487 - DNA, 23 bp, Homo sapiens
atgagggacttccctagaagtct

SEQ ID NO: 2284488 - DNA, 12 bp, Homo sapiens
atgagttacctc

SEQ ID NO: 2284489 - DNA, 18 bp, Homo sapiens
atgagtttaaaaaaataa

SEQ ID NO: 2284490 - DNA, 21 bp, Homo sapiens
atgagtttaaaaaaataacat

SEQ ID NO: 2284491 - DNA, 13 bp, Homo sapiens
atgagtttatggg

SEQ ID NO: 2284492 - DNA, 16 bp, Homo sapiens
atgatcagacttgatt

SEQ ID NO: 2284493 - DNA, 15 bp, Homo sapiens
atgatccatttgaac

SEQ ID NO: 2284494 - DNA, 13 bp, Homo sapiens
atgatcttccaaa

SEQ ID NO: 2284495 - DNA, 19 bp, Homo sapiens
atgatcttccaaatattag

SEQ ID NO: 2284496 - DNA, 20 bp, Homo sapiens
atgatgactcttcttatcac

SEQ ID NO: 2284497 - DNA, 17 bp, Homo sapiens
atgatggatgagaaaaa

SEQ ID NO: 2284498 - DNA, 14 bp, Homo sapiens
atgatgggaaagtg

SEQ ID NO: 2284499 - DNA, 16 bp, Homo sapiens
atgatgggaaagtgga

SEQ ID NO: 2284500 - DNA, 14 bp, Homo sapiens
atgatgggctggag

SEQ ID NO: 2284501 - DNA, 17 bp, Homo sapiens
atgatgggctggagcag

SEQ ID NO: 2284502 - DNA, 16 bp, Homo sapiens
atgattcaatgtgaat

SEQ ID NO: 2284503 - DNA, 21 bp, Homo sapiens
atgattcaatgtgaattttaa

SEQ ID NO: 2284504 - DNA, 16 bp, Homo sapiens
atgatttaagcatttt

SEQ ID NO: 2284505 - DNA, 18 bp, Homo sapiens
atgcaaaccatcattgaa

SEQ ID NO: 2284506 - DNA, 13 bp, Homo sapiens
atgcaacctgtgc

SEQ ID NO: 2284507 - DNA, 19 bp, Homo sapiens
atgcaacctgtgcaaaata

SEQ ID NO: 2284508 - DNA, 22 bp, Homo sapiens
atgcaagaagaatataaataaa

SEQ ID NO: 2284509 - DNA, 19 bp, Homo sapiens
atgcactcctgccccggcc

SEQ ID NO: 2284510 - DNA, 20 bp, Homo sapiens
atgcagaaggtatttttgaa

SEQ ID NO: 2284511 - DNA, 13 bp, Homo sapiens
atgcatagacaag

SEQ ID NO: 2284512 - DNA, 21 bp, Homo sapiens
atgcatgatgactcttcttat

SEQ ID NO: 2284513 - DNA, 21 bp, Homo sapiens
atgccatgaggaacaaggcaa

SEQ ID NO: 2284514 - DNA, 21 bp, Homo sapiens
atgcccaccgcccctggacag

SEQ ID NO: 2284515 - DNA, 13 bp, Homo sapiens
atgccgctgtgtc

SEQ ID NO: 2284516 - DNA, 14 bp, Homo sapiens
atgccgctgtgtcc

SEQ ID NO: 2284517 - DNA, 16 bp, Homo sapiens
atgccgctgtgtcccc

SEQ ID NO: 2284518 - DNA, 22 bp, Homo sapiens
atgccgctgtgtctatgaacta

SEQ ID NO: 2284519 - DNA, 19 bp, Homo sapiens
atgccgtcctgcagtcctt

SEQ ID NO: 2284520 - DNA, 15 bp, Homo sapiens
atgcctttcaaacat

SEQ ID NO: 2284521 - DNA, 16 bp, Homo sapiens
atgcggccggcctggg

SEQ ID NO: 2284522 - DNA, 13 bp, Homo sapiens
atgctaaatgcaa

SEQ ID NO: 2284523 - DNA, 19 bp, Homo sapiens
atgctaaatgcaaacactg

SEQ ID NO: 2284524 - DNA, 15 bp, Homo sapiens
atgctaatgtaatca

SEQ ID NO: 2284525 - DNA, 19 bp, Homo sapiens
atgctatggaaatacattt

SEQ ID NO: 2284526 - DNA, 22 bp, Homo sapiens
atgctatggaaatacatttaga

SEQ ID NO: 2284527 - DNA, 19 bp, Homo sapiens
atgctattttaaaattcat

SEQ ID NO: 2284528 - DNA, 17 bp, Homo sapiens
atgctccttgcctctgc

SEQ ID NO: 2284529 - DNA, 18 bp, Homo sapiens
atgctctttcaccctgcc

SEQ ID NO: 2284530 - DNA, 13 bp, Homo sapiens
atgctggcaaagg

SEQ ID NO: 2284531 - DNA, 14 bp, Homo sapiens
atgctgggaccctc

SEQ ID NO: 2284532 - DNA, 23 bp, Homo sapiens
atgctgtcccttacgtgagtcct

SEQ ID NO: 2284533 - DNA, 15 bp, Homo sapiens
atgcttaacataaac

SEQ ID NO: 2284534 - DNA, 24 bp, Homo sapiens
aatatatttgtaggtatactatgt

SEQ ID NO: 2284535 - DNA, 18 bp, Homo sapiens
aatatcatgtgtagatat

SEQ ID NO: 2284536 - DNA, 16 bp, Homo sapiens
aatatccagtcaaaga

SEQ ID NO: 2284537 - DNA, 14 bp, Homo sapiens
aatatcctatactg

SEQ ID NO: 2284538 - DNA, 22 bp, Homo sapiens
aatatcctatactggttatagt

SEQ ID NO: 2284539 - DNA, 17 bp, Homo sapiens
aatatcttgaagaatat

SEQ ID NO: 2284540 - DNA, 18 bp, Homo sapiens
aatatcttgaagaatatt

SEQ ID NO: 2284541 - DNA, 17 bp, Homo sapiens
aatatcttttcttctcc

SEQ ID NO: 2284542 - DNA, 20 bp, Homo sapiens
aatatgaatatatacataaa

SEQ ID NO: 2284543 - DNA, 16 bp, Homo sapiens
aatatgcctgcaggag

SEQ ID NO: 2284544 - DNA, 19 bp, Homo sapiens
aatatgtacttttccattt

SEQ ID NO: 2284545 - DNA, 19 bp, Homo sapiens
aatatgtgttttttaatat

SEQ ID NO: 2284546 - DNA, 13 bp, Homo sapiens
aatattaatatgt

SEQ ID NO: 2284547 - DNA, 20 bp, Homo sapiens
aatattaatatgtacttttc

SEQ ID NO: 2284548 - DNA, 19 bp, Homo sapiens
aatattacatttcatttat

SEQ ID NO: 2284549 - DNA, 21 bp, Homo sapiens
aatattatacttctttattca

SEQ ID NO: 2284550 - DNA, 13 bp, Homo sapiens
aatattctaaaaa

SEQ ID NO: 2284551 - DNA, 10 bp, Homo sapiens
aatattctgt

SEQ ID NO: 2284552 - DNA, 12 bp, Homo sapiens
aatattgctgat

SEQ ID NO: 2284553 - DNA, 18 bp, Homo sapiens
aatattgctgatggtgca

SEQ ID NO: 2284554 - DNA, 22 bp, Homo sapiens
aatattgctgatggtgcaatga

SEQ ID NO: 2284555 - DNA, 15 bp, Homo sapiens
aatattttgtattat

SEQ ID NO: 2284556 - DNA, 19 bp, Homo sapiens
aatattttgtattattgct

SEQ ID NO: 2284557 - DNA, 21 bp, Homo sapiens
aatattttgtattattgctgt

SEQ ID NO: 2284558 - DNA, 15 bp, Homo sapiens
aatatttttttctag

SEQ ID NO: 2284559 - DNA, 17 bp, Homo sapiens
aatatttttttctagct

SEQ ID NO: 2284560 - DNA, 16 bp, Homo sapiens
aatcaaaagctgaaat

SEQ ID NO: 2284561 - DNA, 14 bp, Homo sapiens
aatcaaagacattt

SEQ ID NO: 2284562 - DNA, 23 bp, Homo sapiens
aatcaaatgattcatttttctgt

SEQ ID NO: 2284563 - DNA, 18 bp, Homo sapiens
aatcaacagcatgtctac

SEQ ID NO: 2284564 - DNA, 13 bp, Homo sapiens
aatcactgcactt

SEQ ID NO: 2284565 - DNA, 17 bp, Homo sapiens
aatcagtatgaagacac

SEQ ID NO: 2284566 - DNA, 22 bp, Homo sapiens
aatcatatcaacttaattctgt

SEQ ID NO: 2284567 - DNA, 13 bp, Homo sapiens
aatcatcttctcc

SEQ ID NO: 2284568 - DNA, 15 bp, Homo sapiens
aatcatgggttcctc

SEQ ID NO: 2284569 - DNA, 19 bp, Homo sapiens
aatcatttatcttatctag

SEQ ID NO: 2284570 - DNA, 13 bp, Homo sapiens
aatccatatcagc

SEQ ID NO: 2284571 - DNA, 17 bp, Homo sapiens
aatcccacttatcaaat

SEQ ID NO: 2284572 - DNA, 18 bp, Homo sapiens
aatcccacttatcaaatc

SEQ ID NO: 2284573 - DNA, 19 bp, Homo sapiens
aatcccatcagtgaatcct

SEQ ID NO: 2284574 - DNA, 20 bp, Homo sapiens
aatcctgttacttaaatagc

SEQ ID NO: 2284575 - DNA, 16 bp, Homo sapiens
aatcgacctcactgtc

SEQ ID NO: 2284576 - DNA, 13 bp, Homo sapiens
aatctaaatataa

SEQ ID NO: 2284577 - DNA, 12 bp, Homo sapiens
aatctagacata

SEQ ID NO: 2284578 - DNA, 17 bp, Homo sapiens
aatctattttctatgta

SEQ ID NO: 2284579 - DNA, 21 bp, Homo sapiens
aatctattttctatgtactag

SEQ ID NO: 2284580 - DNA, 13 bp, Homo sapiens
aatctccatttct

SEQ ID NO: 2284581 - DNA, 18 bp, Homo sapiens
aatctctaaaattctagt

SEQ ID NO: 2284582 - DNA, 19 bp, Homo sapiens
aatctctaaaattctagtc

SEQ ID NO: 2284583 - DNA, 12 bp, Homo sapiens
aatctctgatta

SEQ ID NO: 2284584 - DNA, 11 bp, Homo sapiens
aatctctgtga

SEQ ID NO: 2284585 - DNA, 20 bp, Homo sapiens
aatctctgtgactcgcttag

SEQ ID NO: 2284586 - DNA, 20 bp, Homo sapiens
aatctctttccatcttactt

SEQ ID NO: 2284587 - DNA, 14 bp, Homo sapiens
aatctgtctgattc

SEQ ID NO: 2284588 - DNA, 18 bp, Homo sapiens
aatctgtctgattctatg

SEQ ID NO: 2284589 - DNA, 15 bp, Homo sapiens
aatctgttagcatta

SEQ ID NO: 2284590 - DNA, 11 bp, Homo sapiens
aatctgttgcc

SEQ ID NO: 2284591 - DNA, 21 bp, Homo sapiens
aatcttcacaatatccaatga

SEQ ID NO: 2284592 - DNA, 20 bp, Homo sapiens
aatcttggccctattcatta

SEQ ID NO: 2284593 - DNA, 13 bp, Homo sapiens
aatctttaatata

SEQ ID NO: 2284594 - DNA, 14 bp, Homo sapiens
aatctttcagaata

SEQ ID NO: 2284595 - DNA, 21 bp, Homo sapiens
aatctttcagaatacaattca

SEQ ID NO: 2284596 - DNA, 15 bp, Homo sapiens
aatgaactgtatatt

SEQ ID NO: 2284597 - DNA, 17 bp, Homo sapiens
aatgaactgtatattat

SEQ ID NO: 2284598 - DNA, 21 bp, Homo sapiens
aatgaactgtatattattgct

SEQ ID NO: 2284599 - DNA, 23 bp, Homo sapiens
aatgaactgtatattattgctat

SEQ ID NO: 2284600 - DNA, 13 bp, Homo sapiens
aatgaagataaat

SEQ ID NO: 2284601 - DNA, 20 bp, Homo sapiens
aatgaagataaatgctttaa

SEQ ID NO: 2284602 - DNA, 21 bp, Homo sapiens
aatgaagataaatgctttaaa

SEQ ID NO: 2284603 - DNA, 20 bp, Homo sapiens
aatgaatgtcagtgtgactg

SEQ ID NO: 2284604 - DNA, 15 bp, Homo sapiens
aatgagaaatcatgt

SEQ ID NO: 2284605 - DNA, 14 bp, Homo sapiens
aatgagaaattgtg

SEQ ID NO: 2284606 - DNA, 20 bp, Homo sapiens
aatgagaaattgtgccaaag

SEQ ID NO: 2284607 - DNA, 22 bp, Homo sapiens
aatgagaaattgtgccaaagat

SEQ ID NO: 2284608 - DNA, 23 bp, Homo sapiens
aatgagctctctaatagaagtcc

SEQ ID NO: 2284609 - DNA, 18 bp, Homo sapiens
aatgagggaaacaaaata

SEQ ID NO: 2284610 - DNA, 21 bp, Homo sapiens
aatgatataggaaaatacatt

SEQ ID NO: 2284611 - DNA, 15 bp, Homo sapiens
aatgatatgctagaa

SEQ ID NO: 2284612 - DNA, 13 bp, Homo sapiens
aatgatcagactt

SEQ ID NO: 2284613 - DNA, 19 bp, Homo sapiens
aatgatcagacttgattta

SEQ ID NO: 2284614 - DNA, 21 bp, Homo sapiens
aatgatcagacttgatttaca

SEQ ID NO: 2284615 - DNA, 22 bp, Homo sapiens
aatgatcgttctgggtcagctt

SEQ ID NO: 2284616 - DNA, 14 bp, Homo sapiens
aatgatggcagagg

SEQ ID NO: 2284617 - DNA, 14 bp, Homo sapiens
aatgattcaatgtg

SEQ ID NO: 2284618 - DNA, 21 bp, Homo sapiens
aatgattcatttttctgttag

SEQ ID NO: 2284619 - DNA, 18 bp, Homo sapiens
aatgcaattagatagaaa

SEQ ID NO: 2284620 - DNA, 16 bp, Homo sapiens
aatgcactcctgcccc

SEQ ID NO: 2284621 - DNA, 23 bp, Homo sapiens
aatgcatgatgactcttcttatc

SEQ ID NO: 2284622 - DNA, 14 bp, Homo sapiens
aatgcattattttg

SEQ ID NO: 2284623 - DNA, 15 bp, Homo sapiens
aatgcattattttgt

SEQ ID NO: 2284624 - DNA, 12 bp, Homo sapiens
aatgctaaatgc

SEQ ID NO: 2284625 - DNA, 13 bp, Homo sapiens
aatgctaatgtaa

SEQ ID NO: 2284626 - DNA, 17 bp, Homo sapiens
aatgctatggaaataca

SEQ ID NO: 2284627 - DNA, 18 bp, Homo sapiens
aatgctatggaaatacat

SEQ ID NO: 2284628 - DNA, 21 bp, Homo sapiens
aatgctatggaaatacattta

SEQ ID NO: 2284629 - DNA, 13 bp, Homo sapiens
aatgctttctcat

SEQ ID NO: 2284630 - DNA, 18 bp, Homo sapiens
aatgctttctcatgcata

SEQ ID NO: 2284631 - DNA, 17 bp, Homo sapiens
aatgctttctctcctct

SEQ ID NO: 2284632 - DNA, 11 bp, Homo sapiens
aatggcagagc

SEQ ID NO: 2284633 - DNA, 18 bp, Homo sapiens
aatggccaagtgtacatt

SEQ ID NO: 2284634 - DNA, 19 bp, Homo sapiens
aatggccaagtgtacattt

SEQ ID NO: 2284635 - DNA, 19 bp, Homo sapiens
aatgggagtgaacatttct

SEQ ID NO: 2284636 - DNA, 18 bp, Homo sapiens
aatgggctgctgtcattt

SEQ ID NO: 2284637 - DNA, 22 bp, Homo sapiens
aatggtagaagatgaatcagta

SEQ ID NO: 2284638 - DNA, 16 bp, Homo sapiens
aatggtatctgttact

SEQ ID NO: 2284639 - DNA, 22 bp, Homo sapiens
aatggttttcttgtgtgtttat

SEQ ID NO: 2284640 - DNA, 14 bp, Homo sapiens
aatgtaatcattta

SEQ ID NO: 2284641 - DNA, 13 bp, Homo sapiens
aatgtacagaaaa

SEQ ID NO: 2284642 - DNA, 14 bp, Homo sapiens
aatgtacagaaaat

SEQ ID NO: 2284643 - DNA, 19 bp, Homo sapiens
aatgtagttgatgtatcca

SEQ ID NO: 2284644 - DNA, 11 bp, Homo sapiens
aatgtatctta

SEQ ID NO: 2284645 - DNA, 21 bp, Homo sapiens
aatgtatcttatttatatatg

SEQ ID NO: 2284646 - DNA, 20 bp, Homo sapiens
aatgtattcttttatataac

SEQ ID NO: 2284647 - DNA, 15 bp, Homo sapiens
aatgtcaagagtatt

SEQ ID NO: 2284648 - DNA, 15 bp, Homo sapiens
aatgtcagtgtgact

SEQ ID NO: 2284649 - DNA, 16 bp, Homo sapiens
aatgtcagtgtgactg

SEQ ID NO: 2284650 - DNA, 13 bp, Homo sapiens
aatgtctccattg

SEQ ID NO: 2284651 - DNA, 23 bp, Homo sapiens
aatgtgaattttaaaatgcaaat

SEQ ID NO: 2284652 - DNA, 17 bp, Homo sapiens
aatgtgatttttttata

SEQ ID NO: 2284653 - DNA, 11 bp, Homo sapiens
aatgtgccaaa

SEQ ID NO: 2284654 - DNA, 14 bp, Homo sapiens
aatgtgcttttcca

SEQ ID NO: 2284655 - DNA, 12 bp, Homo sapiens
aatgtgtaaatg

SEQ ID NO: 2284656 - DNA, 13 bp, Homo sapiens
aatgtgtaaatgt

SEQ ID NO: 2284657 - DNA, 13 bp, Homo sapiens
aatgttaacaact

SEQ ID NO: 2284658 - DNA, 17 bp, Homo sapiens
aatgttatatcatcaat

SEQ ID NO: 2284659 - DNA, 15 bp, Homo sapiens
aatgttatttctgca

SEQ ID NO: 2284660 - DNA, 19 bp, Homo sapiens
aatgttatttctgcaaaca

SEQ ID NO: 2284661 - DNA, 15 bp, Homo sapiens
aatgttgttaaatgc

SEQ ID NO: 2284662 - DNA, 17 bp, Homo sapiens
aatgttgttaaatgcta

SEQ ID NO: 2284663 - DNA, 16 bp, Homo sapiens
aatgtttcatgaagaa

SEQ ID NO: 2284664 - DNA, 19 bp, Homo sapiens
aatgtttcatgaagaaaaa

SEQ ID NO: 2284665 - DNA, 23 bp, Homo sapiens
aatgtttcatgaagaaaaaattt

SEQ ID NO: 2284666 - DNA, 13 bp, Homo sapiens
aatgtttccaggc

SEQ ID NO: 2284667 - DNA, 20 bp, Homo sapiens
aatgtttcctgtggaaatat

SEQ ID NO: 2284668 - DNA, 22 bp, Homo sapiens
aatgtttccttttagttgttga

SEQ ID NO: 2284669 - DNA, 13 bp, Homo sapiens
aatgtttcttttt

SEQ ID NO: 2284670 - DNA, 14 bp, Homo sapiens
aatgtttttctcaa

SEQ ID NO: 2284671 - DNA, 15 bp, Homo sapiens
aatgtttttctcaaa

SEQ ID NO: 2284672 - DNA, 13 bp, Homo sapiens
aattaacatatat

SEQ ID NO: 2284673 - DNA, 19 bp, Homo sapiens
aattacaaccggttatcag

SEQ ID NO: 2284674 - DNA, 19 bp, Homo sapiens
aattacaggaagtactgga

SEQ ID NO: 2284675 - DNA, 20 bp, Homo sapiens
aattacaggaagtactggag

SEQ ID NO: 2284676 - DNA, 11 bp, Homo sapiens
aattacagttt

SEQ ID NO: 2284677 - DNA, 15 bp, Homo sapiens
aattacttaatgtga

SEQ ID NO: 2284678 - DNA, 13 bp, Homo sapiens
aattactttcaga

SEQ ID NO: 2284679 - DNA, 15 bp, Homo sapiens
aattactttcagaat

SEQ ID NO: 2284680 - DNA, 23 bp, Homo sapiens
aattagctctcgcctcaggcttt

SEQ ID NO: 2284681 - DNA, 16 bp, Homo sapiens
aattaggtaatggata

SEQ ID NO: 2284682 - DNA, 14 bp, Homo sapiens
aattagtgagattt

SEQ ID NO: 2284683 - DNA, 12 bp, Homo sapiens
aattataaatgt

SEQ ID NO: 2284684 - DNA, 15 bp, Homo sapiens
aattataaatgtttc

SEQ ID NO: 2284685 - DNA, 17 bp, Homo sapiens
aattataatgcatctaa

SEQ ID NO: 2284686 - DNA, 15 bp, Homo sapiens
aattatattatgaat

SEQ ID NO: 2284687 - DNA, 11 bp, Homo sapiens
aattatgaaaa

SEQ ID NO: 2284688 - DNA, 19 bp, Homo sapiens
aattatgctaacaaactga

SEQ ID NO: 2284689 - DNA, 19 bp, Homo sapiens
aattattacactgtaagaa

SEQ ID NO: 2284690 - DNA, 21 bp, Homo sapiens
aattattacactgtaagaaat

SEQ ID NO: 2284691 - DNA, 12 bp, Homo sapiens
aattattctagt

SEQ ID NO: 2284692 - DNA, 13 bp, Homo sapiens
aattattctagtc

SEQ ID NO: 2284693 - DNA, 18 bp, Homo sapiens
aattattctagtcaactg

SEQ ID NO: 2284694 - DNA, 19 bp, Homo sapiens
aattattctagtcaactgc

SEQ ID NO: 2284695 - DNA, 12 bp, Homo sapiens
aattcaaagata

SEQ ID NO: 2284696 - DNA, 15 bp, Homo sapiens
aattcaacaaatgat

SEQ ID NO: 2284697 - DNA, 17 bp, Homo sapiens
aattcaacacttatttt

SEQ ID NO: 2284698 - DNA, 22 bp, Homo sapiens
aattcagttttagtttcaaaat

SEQ ID NO: 2284699 - DNA, 17 bp, Homo sapiens
aattcataaaaataacc

SEQ ID NO: 2284700 - DNA, 19 bp, Homo sapiens
aattcatagcatcctgatt

SEQ ID NO: 2284701 - DNA, 17 bp, Homo sapiens
aattcatggaactttca

SEQ ID NO: 2284702 - DNA, 14 bp, Homo sapiens
aattcatttaagaa

SEQ ID NO: 2284703 - DNA, 15 bp, Homo sapiens
aattcatttaagaac

SEQ ID NO: 2284704 - DNA, 24 bp, Homo sapiens
aattccatcaagccaagcctcctg

SEQ ID NO: 2284705 - DNA, 17 bp, Homo sapiens
aattcctggaaaactgg

SEQ ID NO: 2284706 - DNA, 18 bp, Homo sapiens
aattctaagattgtacat

SEQ ID NO: 2284707 - DNA, 21 bp, Homo sapiens
aattctaagattgtacatatg

SEQ ID NO: 2284708 - DNA, 19 bp, Homo sapiens
aattctataagagacaaag

SEQ ID NO: 2284709 - DNA, 14 bp, Homo sapiens
aattctcattatga

SEQ ID NO: 2284710 - DNA, 18 bp, Homo sapiens
aattctcattatgaagat

SEQ ID NO: 2284711 - DNA, 23 bp, Homo sapiens
aattctgtggctgccatcagaaa

SEQ ID NO: 2284712 - DNA, 16 bp, Homo sapiens
aattcttgccaagcaa

SEQ ID NO: 2284713 - DNA, 22 bp, Homo sapiens
aattgaaccgtcaatgtgaaat

SEQ ID NO: 2284714 - DNA, 12 bp, Homo sapiens
aattgtgccaaa

SEQ ID NO: 2284715 - DNA, 15 bp, Homo sapiens
aattgtgccaaagat

SEQ ID NO: 2284716 - DNA, 22 bp, Homo sapiens
aattgtgccaaagatagcagaa

SEQ ID NO: 2284717 - DNA, 15 bp, Homo sapiens
aattgtgtaactgtt

SEQ ID NO: 2284718 - DNA, 13 bp, Homo sapiens
aattgttacaatt

SEQ ID NO: 2284719 - DNA, 17 bp, Homo sapiens
aattgttatgtaaacat

SEQ ID NO: 2284720 - DNA, 14 bp, Homo sapiens
aattgtttcttgac

SEQ ID NO: 2284721 - DNA, 17 bp, Homo sapiens
aatttaaaaatctttca

SEQ ID NO: 2284722 - DNA, 20 bp, Homo sapiens
aatttaactactaagaataa

SEQ ID NO: 2284723 - DNA, 12 bp, Homo sapiens
aatttaactgca

SEQ ID NO: 2284724 - DNA, 16 bp, Homo sapiens
aatttaatatactgca

SEQ ID NO: 2284725 - DNA, 17 bp, Homo sapiens
aatttaatatactgcat

SEQ ID NO: 2284726 - DNA, 18 bp, Homo sapiens
aatttaattgtgtaactg

SEQ ID NO: 2284727 - DNA, 15 bp, Homo sapiens
aatttatgttaacag

SEQ ID NO: 2284728 - DNA, 20 bp, Homo sapiens
aatttatttatgttctcaac

SEQ ID NO: 2284729 - DNA, 15 bp, Homo sapiens
aatttctccaaagct

SEQ ID NO: 2284730 - DNA, 11 bp, Homo sapiens
aatttggggac

SEQ ID NO: 2284731 - DNA, 24 bp, Homo sapiens
aatttggggacagattcagtcttg

SEQ ID NO: 2284732 - DNA, 18 bp, Homo sapiens
aattttaaaaaataacat

SEQ ID NO: 2284733 - DNA, 21 bp, Homo sapiens
aattttaacagacatgtatac

SEQ ID NO: 2284734 - DNA, 13 bp, Homo sapiens
aattttacaaagt

SEQ ID NO: 2284735 - DNA, 16 bp, Homo sapiens
aattttataatgtcat

SEQ ID NO: 2284736 - DNA, 12 bp, Homo sapiens
aattttatgaac

SEQ ID NO: 2284737 - DNA, 13 bp, Homo sapiens
aatttttactcag

SEQ ID NO: 2284738 - DNA, 22 bp, Homo sapiens
aatttttactcaggctttctat

SEQ ID NO: 2284739 - DNA, 19 bp, Homo sapiens
acaaaaaatattcatctgt

SEQ ID NO: 2284740 - DNA, 21 bp, Homo sapiens
acaaaaaatattcatctgttg

SEQ ID NO: 2284741 - DNA, 18 bp, Homo sapiens
acaaaaagtaatgtatat

SEQ ID NO: 2284742 - DNA, 21 bp, Homo sapiens
acaaaaggctggatgtgcttt

SEQ ID NO: 2284743 - DNA, 22 bp, Homo sapiens
acaaaatatttatttgttttgg

SEQ ID NO: 2284744 - DNA, 19 bp, Homo sapiens
acaaaatatttctaagctt

SEQ ID NO: 2284745 - DNA, 11 bp, Homo sapiens
acaaaatgcaa

SEQ ID NO: 2284746 - DNA, 21 bp, Homo sapiens
acaaaatttaattgtgtaact

SEQ ID NO: 2284747 - DNA, 21 bp, Homo sapiens
acaaagcgtggtggacatgca

SEQ ID NO: 2284748 - DNA, 15 bp, Homo sapiens
acaaagtgcttcctt

SEQ ID NO: 2284749 - DNA, 23 bp, Homo sapiens
acaaatagtaggctaaaaacatt

SEQ ID NO: 2284750 - DNA, 22 bp, Homo sapiens
acaaatatagttgaacaagatt

SEQ ID NO: 2284751 - DNA, 22 bp, Homo sapiens
acaaatttttactcaggctttc

SEQ ID NO: 2284752 - DNA, 16 bp, Homo sapiens
acaaccatagaactgt

SEQ ID NO: 2284753 - DNA, 14 bp, Homo sapiens
acaactctattttt

SEQ ID NO: 2284754 - DNA, 16 bp, Homo sapiens
acaactgccaaataaa

SEQ ID NO: 2284755 - DNA, 20 bp, Homo sapiens
acaactgccaaataaaatgt

SEQ ID NO: 2284756 - DNA, 21 bp, Homo sapiens
acaactgccaaataaaatgtt

SEQ ID NO: 2284757 - DNA, 17 bp, Homo sapiens
acaacttccagatttga

SEQ ID NO: 2284758 - DNA, 15 bp, Homo sapiens
acaacttgaattaca

SEQ ID NO: 2284759 - DNA, 17 bp, Homo sapiens
acaagccaatgtgaatt

SEQ ID NO: 2284760 - DNA, 16 bp, Homo sapiens
acaaggcaaggctgtc

SEQ ID NO: 2284761 - DNA, 12 bp, Homo sapiens
acaagtgaaaac

SEQ ID NO: 2284762 - DNA, 14 bp, Homo sapiens
acaagtgaaaactg

SEQ ID NO: 2284763 - DNA, 23 bp, Homo sapiens
acaataagcgttaagggcagagt

SEQ ID NO: 2284764 - DNA, 21 bp, Homo sapiens
acaatatgtgttttttaatat

SEQ ID NO: 2284765 - DNA, 16 bp, Homo sapiens
acaatcctataaatgt

SEQ ID NO: 2284766 - DNA, 19 bp, Homo sapiens
acaatcctataaatgtgat

SEQ ID NO: 2284767 - DNA, 16 bp, Homo sapiens
acaatcttagtgaatg

SEQ ID NO: 2284768 - DNA, 11 bp, Homo sapiens
acaatgcaaac

SEQ ID NO: 2284769 - DNA, 16 bp, Homo sapiens
acaatgcaaaccatca

SEQ ID NO: 2284770 - DNA, 14 bp, Homo sapiens
acaatggtagctct

SEQ ID NO: 2284771 - DNA, 16 bp, Homo sapiens
acaatggtagctctga

SEQ ID NO: 2284772 - DNA, 22 bp, Homo sapiens
acaatgtaattacattaaaatg

SEQ ID NO: 2284773 - DNA, 15 bp, Homo sapiens
acaattcagttttag

SEQ ID NO: 2284774 - DNA, 23 bp, Homo sapiens
acaattcagttttagtttcaaaa

SEQ ID NO: 2284775 - DNA, 19 bp, Homo sapiens
acaattcttttgaaagatg

SEQ ID NO: 2284776 - DNA, 15 bp, Homo sapiens
acaattttcatccca

SEQ ID NO: 2284777 - DNA, 21 bp, Homo sapiens
acaattttctatttaaaaaat

SEQ ID NO: 2284778 - DNA, 12 bp, Homo sapiens
acacacagcagc

SEQ ID NO: 2284779 - DNA, 14 bp, Homo sapiens
acacacagcagctc

SEQ ID NO: 2284780 - DNA, 21 bp, Homo sapiens
acacacttttctttttaaatg

SEQ ID NO: 2284781 - DNA, 22 bp, Homo sapiens
acacacttttctttttaaatgt

SEQ ID NO: 2284782 - DNA, 11 bp, Homo sapiens
acacaggccca

SEQ ID NO: 2284783 - DNA, 16 bp, Homo sapiens
acacaggcccatgccc

SEQ ID NO: 2284784 - DNA, 18 bp, Homo sapiens
acacatgcatcctcccct

SEQ ID NO: 2284785 - DNA, 21 bp, Homo sapiens
acacatgcatcctcccctctc

SEQ ID NO: 2284786 - DNA, 19 bp, Homo sapiens
acacatttccctattttag

SEQ ID NO: 2284787 - DNA, 16 bp, Homo sapiens
acaccactgaacagaa

SEQ ID NO: 2284788 - DNA, 18 bp, Homo sapiens
acaccactgaacagaaat

SEQ ID NO: 2284789 - DNA, 19 bp, Homo sapiens
acaccactttctgctttcc

SEQ ID NO: 2284790 - DNA, 14 bp, Homo sapiens
acacccaagcacaa

SEQ ID NO: 2284791 - DNA, 14 bp, Homo sapiens
acacccagccccag

SEQ ID NO: 2284792 - DNA, 19 bp, Homo sapiens
acaccctggagtggcatgg

SEQ ID NO: 2284793 - DNA, 17 bp, Homo sapiens
acaccgcaccgggctgg

SEQ ID NO: 2284794 - DNA, 18 bp, Homo sapiens
acaccgcaccgggctggc

SEQ ID NO: 2284795 - DNA, 19 bp, Homo sapiens
acacctgcctctgaactgc

SEQ ID NO: 2284796 - DNA, 18 bp, Homo sapiens
acaccttcttattatata

SEQ ID NO: 2284797 - DNA, 19 bp, Homo sapiens
acaccttcttattatatat

SEQ ID NO: 2284798 - DNA, 21 bp, Homo sapiens
acaccttcttattatatatat

SEQ ID NO: 2284799 - DNA, 12 bp, Homo sapiens
acacgaatattg

SEQ ID NO: 2284800 - DNA, 16 bp, Homo sapiens
acacgcacttctgggg

SEQ ID NO: 2284801 - DNA, 15 bp, Homo sapiens
acactaatgaggaaa

SEQ ID NO: 2284802 - DNA, 18 bp, Homo sapiens
acactagtagagcaaaga

SEQ ID NO: 2284803 - DNA, 23 bp, Homo sapiens
acactagtagagcaaagacttaa

SEQ ID NO: 2284804 - DNA, 14 bp, Homo sapiens
acactgaaatccaa

SEQ ID NO: 2284805 - DNA, 23 bp, Homo sapiens
acactgatgggtcctgctgctcg

SEQ ID NO: 2284806 - DNA, 16 bp, Homo sapiens
acactggtctcagagg

SEQ ID NO: 2284807 - DNA, 12 bp, Homo sapiens
acactgtaagaa

SEQ ID NO: 2284808 - DNA, 12 bp, Homo sapiens
aacccagtgttc

SEQ ID NO: 2284809 - DNA, 18 bp, Homo sapiens
aacccagtgttcagcata

SEQ ID NO: 2284810 - DNA, 17 bp, Homo sapiens
aaccccatacctacatt

SEQ ID NO: 2284811 - DNA, 18 bp, Homo sapiens
aacccccacctcccggtg

SEQ ID NO: 2284812 - DNA, 23 bp, Homo sapiens
aaccccgtctctactaaaaatat

SEQ ID NO: 2284813 - DNA, 19 bp, Homo sapiens
aacccgctctcccagacct

SEQ ID NO: 2284814 - DNA, 23 bp, Homo sapiens
aaccgtcaatgtgaaataaagag

SEQ ID NO: 2284815 - DNA, 13 bp, Homo sapiens
aacctcaaactgg

SEQ ID NO: 2284816 - DNA, 15 bp, Homo sapiens
aacctctcagatccc

SEQ ID NO: 2284817 - DNA, 19 bp, Homo sapiens
aacctctcagatccctcgg

SEQ ID NO: 2284818 - DNA, 12 bp, Homo sapiens
aacctcttcctc

SEQ ID NO: 2284819 - DNA, 20 bp, Homo sapiens
aacctgcatttaagaacaga

SEQ ID NO: 2284820 - DNA, 17 bp, Homo sapiens
aacctggaggctggacc

SEQ ID NO: 2284821 - DNA, 22 bp, Homo sapiens
aacctggtaaattttataatgt

SEQ ID NO: 2284822 - DNA, 20 bp, Homo sapiens
aacctgtgcaaaataaaatg

SEQ ID NO: 2284823 - DNA, 16 bp, Homo sapiens
aacctgtgctttcatg

SEQ ID NO: 2284824 - DNA, 20 bp, Homo sapiens
aaccttctatgttcataaaa

SEQ ID NO: 2284825 - DNA, 13 bp, Homo sapiens
aacgagttaatga

SEQ ID NO: 2284826 - DNA, 12 bp, Homo sapiens
aacgccctgtgt

SEQ ID NO: 2284827 - DNA, 13 bp, Homo sapiens
aacgccctgtgtc

SEQ ID NO: 2284828 - DNA, 16 bp, Homo sapiens
aacgtggctgcttcaa

SEQ ID NO: 2284829 - DNA, 19 bp, Homo sapiens
aacgtggctgcttcaagga

SEQ ID NO: 2284830 - DNA, 22 bp, Homo sapiens
aacgtggctgcttcaaggatcc

SEQ ID NO: 2284831 - DNA, 15 bp, Homo sapiens
aactaaactaaaata

SEQ ID NO: 2284832 - DNA, 22 bp, Homo sapiens
aactacattaaaagctttagat

SEQ ID NO: 2284833 - DNA, 16 bp, Homo sapiens
aactacggttgggaga

SEQ ID NO: 2284834 - DNA, 18 bp, Homo sapiens
aactactaagaataaata

SEQ ID NO: 2284835 - DNA, 21 bp, Homo sapiens
aactactaagaataaataaag

SEQ ID NO: 2284836 - DNA, 13 bp, Homo sapiens
aactagagactct

SEQ ID NO: 2284837 - DNA, 21 bp, Homo sapiens
aactagagactctgtgatcta

SEQ ID NO: 2284838 - DNA, 19 bp, Homo sapiens
aactagatctcctgtaatt

SEQ ID NO: 2284839 - DNA, 22 bp, Homo sapiens
aactatggtgtgcttatgtttt

SEQ ID NO: 2284840 - DNA, 23 bp, Homo sapiens
aactcaactgtctattgtcacat

SEQ ID NO: 2284841 - DNA, 16 bp, Homo sapiens
aactcaatgcatgatg

SEQ ID NO: 2284842 - DNA, 22 bp, Homo sapiens
aactcaatgcatgatgactctt

SEQ ID NO: 2284843 - DNA, 16 bp, Homo sapiens
aactccaacatccact

SEQ ID NO: 2284844 - DNA, 13 bp, Homo sapiens
aactccagagtca

SEQ ID NO: 2284845 - DNA, 13 bp, Homo sapiens
aactccaggaaaa

SEQ ID NO: 2284846 - DNA, 16 bp, Homo sapiens
aactcctcaacactca

SEQ ID NO: 2284847 - DNA, 12 bp, Homo sapiens
aactcttggcct

SEQ ID NO: 2284848 - DNA, 20 bp, Homo sapiens
aactgagatgttaaaatagt

SEQ ID NO: 2284849 - DNA, 16 bp, Homo sapiens
aactgatgatagactt

SEQ ID NO: 2284850 - DNA, 17 bp, Homo sapiens
aactgatttttttttcc

SEQ ID NO: 2284851 - DNA, 20 bp, Homo sapiens
aactgatttttttttccttc

SEQ ID NO: 2284852 - DNA, 22 bp, Homo sapiens
aactgatttttttttccttcag

SEQ ID NO: 2284853 - DNA, 12 bp, Homo sapiens
aactgctgctgg

SEQ ID NO: 2284854 - DNA, 23 bp, Homo sapiens
aactgctttgttttggctgctct

SEQ ID NO: 2284855 - DNA, 18 bp, Homo sapiens
aactggaaggctttattc

SEQ ID NO: 2284856 - DNA, 20 bp, Homo sapiens
aactggaaggctttattctt

SEQ ID NO: 2284857 - DNA, 22 bp, Homo sapiens
aactggccccaggcggaggggc

SEQ ID NO: 2284858 - DNA, 23 bp, Homo sapiens
aactggccccaggcggaggggct

SEQ ID NO: 2284859 - DNA, 20 bp, Homo sapiens
aactgtccagtccagtgatg

SEQ ID NO: 2284860 - DNA, 22 bp, Homo sapiens
aactgtccagtccagtgatgtg

SEQ ID NO: 2284861 - DNA, 20 bp, Homo sapiens
aactgtctattgtcacatga

SEQ ID NO: 2284862 - DNA, 14 bp, Homo sapiens
aactgtggccacct

SEQ ID NO: 2284863 - DNA, 13 bp, Homo sapiens
aactgttttcatg

SEQ ID NO: 2284864 - DNA, 14 bp, Homo sapiens
aactgtttttgaag

SEQ ID NO: 2284865 - DNA, 16 bp, Homo sapiens
aacttatctccagcca

SEQ ID NO: 2284866 - DNA, 23 bp, Homo sapiens
aacttgcatattgttggcacaga

SEQ ID NO: 2284867 - DNA, 12 bp, Homo sapiens
aacttggctttc

SEQ ID NO: 2284868 - DNA, 15 bp, Homo sapiens
aacttttctgcattt

SEQ ID NO: 2284869 - DNA, 12 bp, Homo sapiens
aagaaaaaaata

SEQ ID NO: 2284870 - DNA, 12 bp, Homo sapiens
aagaaacacttt

SEQ ID NO: 2284871 - DNA, 20 bp, Homo sapiens
aagaaatattaatatgtact

SEQ ID NO: 2284872 - DNA, 13 bp, Homo sapiens
aagaaatgagaaa

SEQ ID NO: 2284873 - DNA, 14 bp, Homo sapiens
aagaaatgagaaat

SEQ ID NO: 2284874 - DNA, 19 bp, Homo sapiens
aagaaatgctaatgtaatc

SEQ ID NO: 2284875 - DNA, 13 bp, Homo sapiens
aagaacaagagac

SEQ ID NO: 2284876 - DNA, 14 bp, Homo sapiens
aagaacaagtttag

SEQ ID NO: 2284877 - DNA, 21 bp, Homo sapiens
aagaacatgctatccaatctc

SEQ ID NO: 2284878 - DNA, 15 bp, Homo sapiens
aagaactccagagtc

SEQ ID NO: 2284879 - DNA, 21 bp, Homo sapiens
aagaagaaagtctatgcttag

SEQ ID NO: 2284880 - DNA, 19 bp, Homo sapiens
aagaagaggttcatttttc

SEQ ID NO: 2284881 - DNA, 20 bp, Homo sapiens
aagaaggcacaggtgtaaat

SEQ ID NO: 2284882 - DNA, 13 bp, Homo sapiens
aagaatgaaaaca

SEQ ID NO: 2284883 - DNA, 16 bp, Homo sapiens
aagaatgtacagaaaa

SEQ ID NO: 2284884 - DNA, 21 bp, Homo sapiens
aagaatttgaaagtttcctta

SEQ ID NO: 2284885 - DNA, 18 bp, Homo sapiens
aagacaaaatttaattgt

SEQ ID NO: 2284886 - DNA, 22 bp, Homo sapiens
aagacaaaatttaattgtgtaa

SEQ ID NO: 2284887 - DNA, 23 bp, Homo sapiens
aagacaaaatttaattgtgtaac

SEQ ID NO: 2284888 - DNA, 19 bp, Homo sapiens
aagacaaatatttctttct

SEQ ID NO: 2284889 - DNA, 20 bp, Homo sapiens
aagacactagtagagcaaag

SEQ ID NO: 2284890 - DNA, 22 bp, Homo sapiens
aagacacttcaatgggagtgaa

SEQ ID NO: 2284891 - DNA, 20 bp, Homo sapiens
aagacagagatggcagagcc

SEQ ID NO: 2284892 - DNA, 23 bp, Homo sapiens
aagacatttaaaatagttttcta

SEQ ID NO: 2284893 - DNA, 12 bp, Homo sapiens
aagacggccttg

SEQ ID NO: 2284894 - DNA, 21 bp, Homo sapiens
aagacttgacgcagcccccca

SEQ ID NO: 2284895 - DNA, 12 bp, Homo sapiens
aagacttttctt

SEQ ID NO: 2284896 - DNA, 18 bp, Homo sapiens
aagagaaaatgctttctc

SEQ ID NO: 2284897 - DNA, 11 bp, Homo sapiens
aagagaattct

SEQ ID NO: 2284898 - DNA, 21 bp, Homo sapiens
aagagaattctaagattgtac

SEQ ID NO: 2284899 - DNA, 13 bp, Homo sapiens
aagagacaaatag

SEQ ID NO: 2284900 - DNA, 15 bp, Homo sapiens
aagagacaaatagta

SEQ ID NO: 2284901 - DNA, 19 bp, Homo sapiens
aagagattctattaaaagc

SEQ ID NO: 2284902 - DNA, 15 bp, Homo sapiens
aagagctaggaaaga

SEQ ID NO: 2284903 - DNA, 16 bp, Homo sapiens
aagaggccagtacttt

SEQ ID NO: 2284904 - DNA, 13 bp, Homo sapiens
aagaggggcgctg

SEQ ID NO: 2284905 - DNA, 19 bp, Homo sapiens
aagaggggcgctgccccca

SEQ ID NO: 2284906 - DNA, 22 bp, Homo sapiens
aagaggggcgctgcccccacag

SEQ ID NO: 2284907 - DNA, 22 bp, Homo sapiens
aagagttctccttgtacttgaa

SEQ ID NO: 2284908 - DNA, 16 bp, Homo sapiens
aagagttgagcacagg

SEQ ID NO: 2284909 - DNA, 15 bp, Homo sapiens
aagataaatgcttta

SEQ ID NO: 2284910 - DNA, 18 bp, Homo sapiens
aagatacaagaaaaagta

SEQ ID NO: 2284911 - DNA, 16 bp, Homo sapiens
aagatgaatcagtatg

SEQ ID NO: 2284912 - DNA, 20 bp, Homo sapiens
aagatgctaatagaaaactg

SEQ ID NO: 2284913 - DNA, 13 bp, Homo sapiens
aagatggttcaaa

SEQ ID NO: 2284914 - DNA, 16 bp, Homo sapiens
aagatgtgtaaataag

SEQ ID NO: 2284915 - DNA, 16 bp, Homo sapiens
aagattaaaattagtg

SEQ ID NO: 2284916 - DNA, 21 bp, Homo sapiens
aagattatatacaaagctgtc

SEQ ID NO: 2284917 - DNA, 11 bp, Homo sapiens
aagattctaaa

SEQ ID NO: 2284918 - DNA, 13 bp, Homo sapiens
aagattgtacata

SEQ ID NO: 2284919 - DNA, 13 bp, Homo sapiens
aagcacaaactgt

SEQ ID NO: 2284920 - DNA, 21 bp, Homo sapiens
aagcagagagaagtacttttg

SEQ ID NO: 2284921 - DNA, 12 bp, Homo sapiens
aagcagtgcatg

SEQ ID NO: 2284922 - DNA, 20 bp, Homo sapiens
aagcagttgcaatgatcaga

SEQ ID NO: 2284923 - DNA, 19 bp, Homo sapiens
aagccagagccgcaccctg

SEQ ID NO: 2284924 - DNA, 14 bp, Homo sapiens
aagcccacccgccc

SEQ ID NO: 2284925 - DNA, 18 bp, Homo sapiens
aagcccacccgccccaga

SEQ ID NO: 2284926 - DNA, 19 bp, Homo sapiens
aagcccacccgccccagag

SEQ ID NO: 2284927 - DNA, 21 bp, Homo sapiens
aagcccacccgccccagagac

SEQ ID NO: 2284928 - DNA, 23 bp, Homo sapiens
aagcccacccgccccagagactg

SEQ ID NO: 2284929 - DNA, 22 bp, Homo sapiens
aagcccgtcatcttccctttcc

SEQ ID NO: 2284930 - DNA, 18 bp, Homo sapiens
aagccctacgatgggatc

SEQ ID NO: 2284931 - DNA, 17 bp, Homo sapiens
aagcctgcctggaagag

SEQ ID NO: 2284932 - DNA, 16 bp, Homo sapiens
aagcgttaagggcaga

SEQ ID NO: 2284933 - DNA, 18 bp, Homo sapiens
aagcgtttaatggtatct

SEQ ID NO: 2284934 - DNA, 13 bp, Homo sapiens
aagctcaactgtt

SEQ ID NO: 2284935 - DNA, 16 bp, Homo sapiens
aagctctggaattgtt

SEQ ID NO: 2284936 - DNA, 12 bp, Homo sapiens
aagctggcagga

SEQ ID NO: 2284937 - DNA, 17 bp, Homo sapiens
aagctgtgaccctcaat

SEQ ID NO: 2284938 - DNA, 17 bp, Homo sapiens
aagctttcctgtttcca

SEQ ID NO: 2284939 - DNA, 21 bp, Homo sapiens
aagctttcctgtttccagggt

SEQ ID NO: 2284940 - DNA, 23 bp, Homo sapiens
aaggaaagttctattatctgggt

SEQ ID NO: 2284941 - DNA, 15 bp, Homo sapiens
aaggaagagccagcc

SEQ ID NO: 2284942 - DNA, 16 bp, Homo sapiens
aaggaagagccagccg

SEQ ID NO: 2284943 - DNA, 13 bp, Homo sapiens
aaggacactgatg

SEQ ID NO: 2284944 - DNA, 22 bp, Homo sapiens
aaggagaggatttggctcgctg

SEQ ID NO: 2284945 - DNA, 17 bp, Homo sapiens
aaggatcctgagccaga

SEQ ID NO: 2284946 - DNA, 17 bp, Homo sapiens
aaggatctttgttcctc

SEQ ID NO: 2284947 - DNA, 17 bp, Homo sapiens
aaggattcttttttcaa

SEQ ID NO: 2284948 - DNA, 20 bp, Homo sapiens
aaggattcttttttcaatgt

SEQ ID NO: 2284949 - DNA, 17 bp, Homo sapiens
aaggatttgaaaacacc

SEQ ID NO: 2284950 - DNA, 18 bp, Homo sapiens
aaggcaacatttccgaag

SEQ ID NO: 2284951 - DNA, 13 bp, Homo sapiens
aaggcaaggctgt

SEQ ID NO: 2284952 - DNA, 15 bp, Homo sapiens
aaggcattgattgca

SEQ ID NO: 2284953 - DNA, 22 bp, Homo sapiens
aaggcctgagggaagcccaccc

SEQ ID NO: 2284954 - DNA, 18 bp, Homo sapiens
aaggctgaatcaaagaca

SEQ ID NO: 2284955 - DNA, 24 bp, Homo sapiens
aaggctgaatcaaagacatttcat

SEQ ID NO: 2284956 - DNA, 17 bp, Homo sapiens
aaggctggatgtgcttt

SEQ ID NO: 2284957 - DNA, 20 bp, Homo sapiens
aaggctgtcaattacaggaa

SEQ ID NO: 2284958 - DNA, 14 bp, Homo sapiens
aagggaaatcaatt

SEQ ID NO: 2284959 - DNA, 16 bp, Homo sapiens
aagggagtaggctgta

SEQ ID NO: 2284960 - DNA, 21 bp, Homo sapiens
aagggatccagagacctgctc

SEQ ID NO: 2284961 - DNA, 18 bp, Homo sapiens
aagggcaagatgtaaagc

SEQ ID NO: 2284962 - DNA, 15 bp, Homo sapiens
aagggcaggagctca

SEQ ID NO: 2284963 - DNA, 17 bp, Homo sapiens
aagggcaggagctcaca

SEQ ID NO: 2284964 - DNA, 13 bp, Homo sapiens
aagggcaggcctg

SEQ ID NO: 2284965 - DNA, 13 bp, Homo sapiens
aagggcgggcctg

SEQ ID NO: 2284966 - DNA, 13 bp, Homo sapiens
aagggctttaaat

SEQ ID NO: 2284967 - DNA, 13 bp, Homo sapiens
aaggggagagtaa

SEQ ID NO: 2284968 - DNA, 18 bp, Homo sapiens
aaggggcaggattctgca

SEQ ID NO: 2284969 - DNA, 19 bp, Homo sapiens
aaggggccaggaaggggac

SEQ ID NO: 2284970 - DNA, 22 bp, Homo sapiens
aaggggccaggaaggggacagg

SEQ ID NO: 2284971 - DNA, 15 bp, Homo sapiens
aagggtatctgctgc

SEQ ID NO: 2284972 - DNA, 12 bp, Homo sapiens
aagggtgggccc

SEQ ID NO: 2284973 - DNA, 17 bp, Homo sapiens
aagggtgggccctggag

SEQ ID NO: 2284974 - DNA, 19 bp, Homo sapiens
aaggtaggaaggtcaaggt

SEQ ID NO: 2284975 - DNA, 15 bp, Homo sapiens
aaggtcacctcactc

SEQ ID NO: 2284976 - DNA, 17 bp, Homo sapiens
aaggtcacctcactcag

SEQ ID NO: 2284977 - DNA, 18 bp, Homo sapiens
aaggtcacctcactcagc

SEQ ID NO: 2284978 - DNA, 19 bp, Homo sapiens
aaggtcacctcactcagca

SEQ ID NO: 2284979 - DNA, 22 bp, Homo sapiens
aaggtcacctcactcagcacca

SEQ ID NO: 2284980 - DNA, 17 bp, Homo sapiens
aaggtcctgtggggagc

SEQ ID NO: 2284981 - DNA, 14 bp, Homo sapiens
aaggtggcatagcc

SEQ ID NO: 2284982 - DNA, 15 bp, Homo sapiens
aagtacataaagtaa

SEQ ID NO: 2284983 - DNA, 14 bp, Homo sapiens
aagtactataattt

SEQ ID NO: 2284984 - DNA, 21 bp, Homo sapiens
aagtagaaaaaaaaataacac

SEQ ID NO: 2284985 - DNA, 13 bp, Homo sapiens
aagtatacattta

SEQ ID NO: 2284986 - DNA, 14 bp, Homo sapiens
aagtcatgggagaa

SEQ ID NO: 2284987 - DNA, 19 bp, Homo sapiens
aagtcattccacacatttc

SEQ ID NO: 2284988 - DNA, 18 bp, Homo sapiens
aagtcattgctgacagag

SEQ ID NO: 2284989 - DNA, 21 bp, Homo sapiens
aagtcattgctgacagagccc

SEQ ID NO: 2284990 - DNA, 14 bp, Homo sapiens
aagtccacttatgt

SEQ ID NO: 2284991 - DNA, 18 bp, Homo sapiens
aagtcctttgagctcctg

SEQ ID NO: 2284992 - DNA, 20 bp, Homo sapiens
aagtcctttgagctcctggg

SEQ ID NO: 2284993 - DNA, 12 bp, Homo sapiens
aagtctatgctt

SEQ ID NO: 2284994 - DNA, 17 bp, Homo sapiens
aagtctgcttaccaaaa

SEQ ID NO: 2284995 - DNA, 17 bp, Homo sapiens
aagtcttgagcaatgtt

SEQ ID NO: 2284996 - DNA, 9 bp, Homo sapiens
aagtcttgt

SEQ ID NO: 2284997 - DNA, 10 bp, Homo sapiens
aagtcttgta

SEQ ID NO: 2284998 - DNA, 13 bp, Homo sapiens
aagtgaaaactga

SEQ ID NO: 2284999 - DNA, 14 bp, Homo sapiens
aagtgctacataaa

SEQ ID NO: 2285000 - DNA, 17 bp, Homo sapiens
aagtggaagacagagat

SEQ ID NO: 2285001 - DNA, 12 bp, Homo sapiens
aagtggacccag

SEQ ID NO: 2285002 - DNA, 15 bp, Homo sapiens
aagtggatctaaatg

SEQ ID NO: 2285003 - DNA, 22 bp, Homo sapiens
aagtgggggcaggtttggagag

SEQ ID NO: 2285004 - DNA, 20 bp, Homo sapiens
aagtggtgtgatcccagctc

SEQ ID NO: 2285005 - DNA, 21 bp, Homo sapiens
aagtggtgtgatcccagctca

SEQ ID NO: 2285006 - DNA, 12 bp, Homo sapiens
aagtgtacattt

SEQ ID NO: 2285007 - DNA, 21 bp, Homo sapiens
aagtgtacatttgatttgata

SEQ ID NO: 2285008 - DNA, 19 bp, Homo sapiens
aagtgtcactaagaatata

SEQ ID NO: 2285009 - DNA, 21 bp, Homo sapiens
aagtgtcactaagaatataaa

SEQ ID NO: 2285010 - DNA, 21 bp, Homo sapiens
aagtgtgtgtttcttgctttg

SEQ ID NO: 2285011 - DNA, 23 bp, Homo sapiens
aagtgttgtaccatatgtagcat

SEQ ID NO: 2285012 - DNA, 15 bp, Homo sapiens
aagttagaatctatt

SEQ ID NO: 2285013 - DNA, 19 bp, Homo sapiens
aagttatcatcctattgtc

SEQ ID NO: 2285014 - DNA, 15 bp, Homo sapiens
aagttattaacattt

SEQ ID NO: 2285015 - DNA, 20 bp, Homo sapiens
aagttgctaacctcaattta

SEQ ID NO: 2285016 - DNA, 15 bp, Homo sapiens
aagtttaggtcgagg

SEQ ID NO: 2285017 - DNA, 18 bp, Homo sapiens
aagtttccttattttcat

SEQ ID NO: 2285018 - DNA, 15 bp, Homo sapiens
aataaaatgtttaca

SEQ ID NO: 2285019 - DNA, 21 bp, Homo sapiens
aataaaatgtttacattttct

SEQ ID NO: 2285020 - DNA, 23 bp, Homo sapiens
aataaaatgtttacattttcttt

SEQ ID NO: 2285021 - DNA, 17 bp, Homo sapiens
aataaacacacagatct

SEQ ID NO: 2285022 - DNA, 14 bp, Homo sapiens
aataaagaaaaaaa

SEQ ID NO: 2285023 - DNA, 18 bp, Homo sapiens
aataaagaagaaaataac

SEQ ID NO: 2285024 - DNA, 11 bp, Homo sapiens
aataaataatc

SEQ ID NO: 2285025 - DNA, 13 bp, Homo sapiens
aataaatgtgtaa

SEQ ID NO: 2285026 - DNA, 15 bp, Homo sapiens
aataaatgtgtaaat

SEQ ID NO: 2285027 - DNA, 17 bp, Homo sapiens
aataaatgtgtaaatgt

SEQ ID NO: 2285028 - DNA, 12 bp, Homo sapiens
aataacatattc

SEQ ID NO: 2285029 - DNA, 15 bp, Homo sapiens
aataacatattcttg

SEQ ID NO: 2285030 - DNA, 18 bp, Homo sapiens
aataacatattcttgctt

SEQ ID NO: 2285031 - DNA, 14 bp, Homo sapiens
aataacatctgaaa

SEQ ID NO: 2285032 - DNA, 15 bp, Homo sapiens
aataacatctgaaaa

SEQ ID NO: 2285033 - DNA, 17 bp, Homo sapiens
aataacatctgaaaaga

SEQ ID NO: 2285034 - DNA, 15 bp, Homo sapiens
aataactagatctcc

SEQ ID NO: 2285035 - DNA, 20 bp, Homo sapiens
aataactggatattctttat

SEQ ID NO: 2285036 - DNA, 17 bp, Homo sapiens
aataagtgttgtaccat

SEQ ID NO: 2285037 - DNA, 13 bp, Homo sapiens
aataatgaataat

SEQ ID NO: 2285038 - DNA, 16 bp, Homo sapiens
aataatgattcaatgt

SEQ ID NO: 2285039 - DNA, 19 bp, Homo sapiens
aataatgattcaatgtgaa

SEQ ID NO: 2285040 - DNA, 12 bp, Homo sapiens
aataatgattta

SEQ ID NO: 2285041 - DNA, 16 bp, Homo sapiens
aataattagctatatt

SEQ ID NO: 2285042 - DNA, 12 bp, Homo sapiens
aataatttagat

SEQ ID NO: 2285043 - DNA, 16 bp, Homo sapiens
aataatttagatattc

SEQ ID NO: 2285044 - DNA, 23 bp, Homo sapiens
aataatttagatattcatacttt

SEQ ID NO: 2285045 - DNA, 13 bp, Homo sapiens
aataattttaaca

SEQ ID NO: 2285046 - DNA, 17 bp, Homo sapiens
aatacaattcagtttta

SEQ ID NO: 2285047 - DNA, 20 bp, Homo sapiens
aatacataaaagaatgtaca

SEQ ID NO: 2285048 - DNA, 20 bp, Homo sapiens
aatacattgtgttttcctaa

SEQ ID NO: 2285049 - DNA, 18 bp, Homo sapiens
aatactcaccaaaatata

SEQ ID NO: 2285050 - DNA, 22 bp, Homo sapiens
aatacttccttataaaaattct

SEQ ID NO: 2285051 - DNA, 22 bp, Homo sapiens
aatagaaaactgtggttaaaga

SEQ ID NO: 2285052 - DNA, 19 bp, Homo sapiens
aatagcaaaatattatctg

SEQ ID NO: 2285053 - DNA, 15 bp, Homo sapiens
aatagcctttcttat

SEQ ID NO: 2285054 - DNA, 15 bp, Homo sapiens
aataggaaaaactga

SEQ ID NO: 2285055 - DNA, 17 bp, Homo sapiens
aataggaaaaactgatt

SEQ ID NO: 2285056 - DNA, 18 bp, Homo sapiens
aataggaaaaactgattt

SEQ ID NO: 2285057 - DNA, 14 bp, Homo sapiens
aataggtttcaaca

SEQ ID NO: 2285058 - DNA, 23 bp, Homo sapiens
aatagtaggctaaaaacatttta

SEQ ID NO: 2285059 - DNA, 13 bp, Homo sapiens
aatagtcatgttt

SEQ ID NO: 2285060 - DNA, 15 bp, Homo sapiens
aatagtcatgtttct

SEQ ID NO: 2285061 - DNA, 18 bp, Homo sapiens
aatagtcatgtttctgca

SEQ ID NO: 2285062 - DNA, 17 bp, Homo sapiens
aatagtcctccaaaaca

SEQ ID NO: 2285063 - DNA, 22 bp, Homo sapiens
aatagtggctttcatttcttat

SEQ ID NO: 2285064 - DNA, 19 bp, Homo sapiens
aatagttccattctatgac

SEQ ID NO: 2285065 - DNA, 15 bp, Homo sapiens
aatagttctatttct

SEQ ID NO: 2285066 - DNA, 16 bp, Homo sapiens
aatagttctatttcta

SEQ ID NO: 2285067 - DNA, 17 bp, Homo sapiens
aatagttctatttctat

SEQ ID NO: 2285068 - DNA, 15 bp, Homo sapiens
aatagtttaaaaata

SEQ ID NO: 2285069 - DNA, 16 bp, Homo sapiens
aatagtttacttcact

SEQ ID NO: 2285070 - DNA, 16 bp, Homo sapiens
aatagttttacattaa

SEQ ID NO: 2285071 - DNA, 13 bp, Homo sapiens
aatagttttctaa

SEQ ID NO: 2285072 - DNA, 20 bp, Homo sapiens
aatagttttctaaatgtttc

SEQ ID NO: 2285073 - DNA, 14 bp, Homo sapiens
aatataactgtctt

SEQ ID NO: 2285074 - DNA, 14 bp, Homo sapiens
aatatacaaacatg

SEQ ID NO: 2285075 - DNA, 22 bp, Homo sapiens
aatatacagtttttgtaaccat

SEQ ID NO: 2285076 - DNA, 19 bp, Homo sapiens
aatatactaaccatttctt

SEQ ID NO: 2285077 - DNA, 16 bp, Homo sapiens
aatatagaaagaaaat

SEQ ID NO: 2285078 - DNA, 12 bp, Homo sapiens
aatatagttaat

SEQ ID NO: 2285079 - DNA, 14 bp, Homo sapiens
aatatatacataaa

SEQ ID NO: 2285080 - DNA, 10 bp, Homo sapiens
aatatatata

SEQ ID NO: 2285081 - DNA, 19 bp, Homo sapiens
aatatatatatatatcagt

SEQ ID NO: 2285082 - DNA, 17 bp, Homo sapiens
tgaagggaaatcaattt

SEQ ID NO: 2285083 - DNA, 17 bp, Homo sapiens
tgaagtctccttttgtc

SEQ ID NO: 2285084 - DNA, 17 bp, Homo sapiens
tgaagtctttgtacaga

SEQ ID NO: 2285085 - DNA, 20 bp, Homo sapiens
tgaagtctttgtacagacaa

SEQ ID NO: 2285086 - DNA, 22 bp, Homo sapiens
tgaagtggtgtgatcccagctc

SEQ ID NO: 2285087 - DNA, 23 bp, Homo sapiens
tgaagtggtgtgatcccagctca

SEQ ID NO: 2285088 - DNA, 14 bp, Homo sapiens
tgaataataaccac

SEQ ID NO: 2285089 - DNA, 18 bp, Homo sapiens
tgaatatatttttaaagc

SEQ ID NO: 2285090 - DNA, 21 bp, Homo sapiens
tgaatcaaaagctgaaattct

SEQ ID NO: 2285091 - DNA, 14 bp, Homo sapiens
tgaatcaaagacat

SEQ ID NO: 2285092 - DNA, 20 bp, Homo sapiens
tgaatcaaagacatttcatc

SEQ ID NO: 2285093 - DNA, 21 bp, Homo sapiens
tgaatcaaagacatttcatcc

SEQ ID NO: 2285094 - DNA, 19 bp, Homo sapiens
tgaatcagtatgaagacac

SEQ ID NO: 2285095 - DNA, 16 bp, Homo sapiens
tgaatgcaaaaagata

SEQ ID NO: 2285096 - DNA, 15 bp, Homo sapiens
tgaatgcacgtttca

SEQ ID NO: 2285097 - DNA, 15 bp, Homo sapiens
tgaatgcagaacggt

SEQ ID NO: 2285098 - DNA, 12 bp, Homo sapiens
tgaatgcatgtg

SEQ ID NO: 2285099 - DNA, 20 bp, Homo sapiens
tgaatgtattcttttatata

SEQ ID NO: 2285100 - DNA, 19 bp, Homo sapiens
tgaatgtcagtgtgactga

SEQ ID NO: 2285101 - DNA, 17 bp, Homo sapiens
tgaatgtccccattcta

SEQ ID NO: 2285102 - DNA, 19 bp, Homo sapiens
tgaatgttatatcatcaat

SEQ ID NO: 2285103 - DNA, 13 bp, Homo sapiens
tgaattcataaaa

SEQ ID NO: 2285104 - DNA, 14 bp, Homo sapiens
tgaattcttttcct

SEQ ID NO: 2285105 - DNA, 21 bp, Homo sapiens
tgaattgtaaggaatgattaa

SEQ ID NO: 2285106 - DNA, 15 bp, Homo sapiens
tgaattttaaaatgc

SEQ ID NO: 2285107 - DNA, 19 bp, Homo sapiens
tgacacctgccgctgcttg

SEQ ID NO: 2285108 - DNA, 20 bp, Homo sapiens
tgacacctgccgctgcttga

SEQ ID NO: 2285109 - DNA, 19 bp, Homo sapiens
tgacagaatttgtgaatat

SEQ ID NO: 2285110 - DNA, 20 bp, Homo sapiens
tgacagaatttgtgaatata

SEQ ID NO: 2285111 - DNA, 22 bp, Homo sapiens
tgacatttgctttgggcagagg

SEQ ID NO: 2285112 - DNA, 16 bp, Homo sapiens
tgaccaggccctgctc

SEQ ID NO: 2285113 - DNA, 21 bp, Homo sapiens
tgaccaggccctgctcatcac

SEQ ID NO: 2285114 - DNA, 12 bp, Homo sapiens
tgaccaggctgg

SEQ ID NO: 2285115 - DNA, 15 bp, Homo sapiens
tgaccaggctggagt

SEQ ID NO: 2285116 - DNA, 13 bp, Homo sapiens
tgaccccacacgc

SEQ ID NO: 2285117 - DNA, 14 bp, Homo sapiens
tgaccgaagggacg

SEQ ID NO: 2285118 - DNA, 17 bp, Homo sapiens
tgaccggcccgccacct

SEQ ID NO: 2285119 - DNA, 19 bp, Homo sapiens
tgaccggcccgccaccttg

SEQ ID NO: 2285120 - DNA, 14 bp, Homo sapiens
tgaccggggtcctg

SEQ ID NO: 2285121 - DNA, 17 bp, Homo sapiens
tgacctgatttccattt

SEQ ID NO: 2285122 - DNA, 18 bp, Homo sapiens
tgactagcaaacaaaaat

SEQ ID NO: 2285123 - DNA, 21 bp, Homo sapiens
tgactagcaaacaaaaataga

SEQ ID NO: 2285124 - DNA, 19 bp, Homo sapiens
tgactccagaatttcccaa

SEQ ID NO: 2285125 - DNA, 14 bp, Homo sapiens
tgactcttcttatc

SEQ ID NO: 2285126 - DNA, 19 bp, Homo sapiens
tgactcttcttatcacact

SEQ ID NO: 2285127 - DNA, 17 bp, Homo sapiens
tgactgaagtaataact

SEQ ID NO: 2285128 - DNA, 13 bp, Homo sapiens
tgactgaatgcag

SEQ ID NO: 2285129 - DNA, 17 bp, Homo sapiens
tgacttcccagctggca

SEQ ID NO: 2285130 - DNA, 18 bp, Homo sapiens
tgacttcccagctggcag

SEQ ID NO: 2285131 - DNA, 22 bp, Homo sapiens
tgagaaattgtgccaaagatag

SEQ ID NO: 2285132 - DNA, 13 bp, Homo sapiens
tgagaagactagc

SEQ ID NO: 2285133 - DNA, 19 bp, Homo sapiens
tgagaataaaaccagctat

SEQ ID NO: 2285134 - DNA, 21 bp, Homo sapiens
tgagaataaatgagcattttt

SEQ ID NO: 2285135 - DNA, 16 bp, Homo sapiens
tgagacctcccccagg

SEQ ID NO: 2285136 - DNA, 17 bp, Homo sapiens
tgagacctcccccaggg

SEQ ID NO: 2285137 - DNA, 18 bp, Homo sapiens
tgagacctcccccaggga

SEQ ID NO: 2285138 - DNA, 21 bp, Homo sapiens
tgagacctcccccagggaggg

SEQ ID NO: 2285139 - DNA, 23 bp, Homo sapiens
tgagactcgcgacaatgcaaacc

SEQ ID NO: 2285140 - DNA, 14 bp, Homo sapiens
tgagagagaaaaga

SEQ ID NO: 2285141 - DNA, 21 bp, Homo sapiens
tgagagcctttggtgaataac

SEQ ID NO: 2285142 - DNA, 14 bp, Homo sapiens
tgagaggaaatcac

SEQ ID NO: 2285143 - DNA, 17 bp, Homo sapiens
tgagaggaaatcaccga

SEQ ID NO: 2285144 - DNA, 22 bp, Homo sapiens
tgagaggcatccagtatcttga

SEQ ID NO: 2285145 - DNA, 16 bp, Homo sapiens
tgagagtcatctcaaa

SEQ ID NO: 2285146 - DNA, 21 bp, Homo sapiens
tgagatcagcattcaaaatag

SEQ ID NO: 2285147 - DNA, 17 bp, Homo sapiens
tgagattccagaacgcc

SEQ ID NO: 2285148 - DNA, 22 bp, Homo sapiens
tgagattccagaacgccctgtg

SEQ ID NO: 2285149 - DNA, 22 bp, Homo sapiens
tgagattgtacattttttactt

SEQ ID NO: 2285150 - DNA, 19 bp, Homo sapiens
tgagatttgtatttatatt

SEQ ID NO: 2285151 - DNA, 20 bp, Homo sapiens
tgagatttgtatttatatta

SEQ ID NO: 2285152 - DNA, 18 bp, Homo sapiens
tgagcacaggcaacatta

SEQ ID NO: 2285153 - DNA, 21 bp, Homo sapiens
tgagcaccaggtgttaaaaac

SEQ ID NO: 2285154 - DNA, 21 bp, Homo sapiens
tgagcagtggggagcgggggc

SEQ ID NO: 2285155 - DNA, 17 bp, Homo sapiens
tgagcatacctgtctca

SEQ ID NO: 2285156 - DNA, 16 bp, Homo sapiens
ttttctttcagccaag

SEQ ID NO: 2285157 - DNA, 13 bp, Homo sapiens
ttttctttctatg

SEQ ID NO: 2285158 - DNA, 13 bp, Homo sapiens
ttttctttttctg

SEQ ID NO: 2285159 - DNA, 15 bp, Homo sapiens
ttttctttttctgtc

SEQ ID NO: 2285160 - DNA, 16 bp, Homo sapiens
ttttgaaagatggtaa

SEQ ID NO: 2285161 - DNA, 16 bp, Homo sapiens
ttttgaagaagggaaa

SEQ ID NO: 2285162 - DNA, 12 bp, Homo sapiens
ggatccagagac

SEQ ID NO: 2285163 - DNA, 14 bp, Homo sapiens
ggatccagagacct

SEQ ID NO: 2285164 - DNA, 15 bp, Homo sapiens
ggatccagagacctg

SEQ ID NO: 2285165 - DNA, 22 bp, Homo sapiens
ggatccagagacctgctccaga

SEQ ID NO: 2285166 - DNA, 16 bp, Homo sapiens
ggatcctgagccagat

SEQ ID NO: 2285167 - DNA, 15 bp, Homo sapiens
ggatctttagcagta

SEQ ID NO: 2285168 - DNA, 15 bp, Homo sapiens
ggatggacgagtgag

SEQ ID NO: 2285169 - DNA, 23 bp, Homo sapiens
ggatggcgtgtcccctgcctgtg

SEQ ID NO: 2285170 - DNA, 19 bp, Homo sapiens
ggattagtccctggcctct

SEQ ID NO: 2285171 - DNA, 20 bp, Homo sapiens
ggattgtctgctgcctccaa

SEQ ID NO: 2285172 - DNA, 13 bp, Homo sapiens
ggatttcatcact

SEQ ID NO: 2285173 - DNA, 17 bp, Homo sapiens
ggcaaaaaaaaaaatta

SEQ ID NO: 2285174 - DNA, 12 bp, Homo sapiens
ggcaaaaatatt

SEQ ID NO: 2285175 - DNA, 14 bp, Homo sapiens
ggcaaaaatatttt

SEQ ID NO: 2285176 - DNA, 20 bp, Homo sapiens
ggcaaattgttcaaaaataa

SEQ ID NO: 2285177 - DNA, 16 bp, Homo sapiens
ggcaaggggccaggaa

SEQ ID NO: 2285178 - DNA, 22 bp, Homo sapiens
ggcaatagtgttgaggagggga

SEQ ID NO: 2285179 - DNA, 19 bp, Homo sapiens
ggcacaaagggcaggcctg

SEQ ID NO: 2285180 - DNA, 16 bp, Homo sapiens
ggcacaggtgtaaata

SEQ ID NO: 2285181 - DNA, 18 bp, Homo sapiens
ggcacaggtgtaaatata

SEQ ID NO: 2285182 - DNA, 21 bp, Homo sapiens
ggcaccgcccacccacacccc

SEQ ID NO: 2285183 - DNA, 15 bp, Homo sapiens
ggcacgggagagcgc

SEQ ID NO: 2285184 - DNA, 19 bp, Homo sapiens
ggcactgagagagcgcagc

SEQ ID NO: 2285185 - DNA, 20 bp, Homo sapiens
ggcagagctgagtcggctgg

SEQ ID NO: 2285186 - DNA, 17 bp, Homo sapiens
ggcagcatggagagagg

SEQ ID NO: 2285187 - DNA, 21 bp, Homo sapiens
ggcagccccatccttcccgca

SEQ ID NO: 2285188 - DNA, 23 bp, Homo sapiens
ggcagccccatccttcccgcagc

SEQ ID NO: 2285189 - DNA, 17 bp, Homo sapiens
ggcagcgcctcccgccg

SEQ ID NO: 2285190 - DNA, 15 bp, Homo sapiens
ggcaggaagtccctg

SEQ ID NO: 2285191 - DNA, 17 bp, Homo sapiens
ggcaggagggcatgtgc

SEQ ID NO: 2285192 - DNA, 14 bp, Homo sapiens
ggcaggcagagctc

SEQ ID NO: 2285193 - DNA, 21 bp, Homo sapiens
ggcaggcagagctcagcacag

SEQ ID NO: 2285194 - DNA, 20 bp, Homo sapiens
ggcagggccctgtggctcca

SEQ ID NO: 2285195 - DNA, 16 bp, Homo sapiens
ggcaggtttggagagc

SEQ ID NO: 2285196 - DNA, 16 bp, Homo sapiens
ggcagtagcagctgtg

SEQ ID NO: 2285197 - DNA, 16 bp, Homo sapiens
ggcagtgcacccccta

SEQ ID NO: 2285198 - DNA, 20 bp, Homo sapiens
ggcatcatttcccctcccgc

SEQ ID NO: 2285199 - DNA, 22 bp, Homo sapiens
ggcatcatttcccctcccgctt

SEQ ID NO: 2285200 - DNA, 23 bp, Homo sapiens
ggcatcatttcccctcccgcttc

SEQ ID NO: 2285201 - DNA, 17 bp, Homo sapiens
ggcatccccagccccct

SEQ ID NO: 2285202 - DNA, 18 bp, Homo sapiens
ggcatccccagccccctg

SEQ ID NO: 2285203 - DNA, 18 bp, Homo sapiens
ggcatccttgaggacctc

SEQ ID NO: 2285204 - DNA, 19 bp, Homo sapiens
ggcatccttgaggacctcc

SEQ ID NO: 2285205 - DNA, 19 bp, Homo sapiens
ggcatctgatttgcatatt

SEQ ID NO: 2285206 - DNA, 21 bp, Homo sapiens
ggcatgaccctggagcccggc

SEQ ID NO: 2285207 - DNA, 17 bp, Homo sapiens
ggcatgagctcttggca

SEQ ID NO: 2285208 - DNA, 18 bp, Homo sapiens
ggcatgccgagtgcccca

SEQ ID NO: 2285209 - DNA, 19 bp, Homo sapiens
ggcatgccgagtgccccag

SEQ ID NO: 2285210 - DNA, 19 bp, Homo sapiens
ggccactcctgggccccag

SEQ ID NO: 2285211 - DNA, 13 bp, Homo sapiens
ggccactggccct

SEQ ID NO: 2285212 - DNA, 13 bp, Homo sapiens
ggccagagctccc

SEQ ID NO: 2285213 - DNA, 14 bp, Homo sapiens
ggccaggaagggga

SEQ ID NO: 2285214 - DNA, 22 bp, Homo sapiens
ggccaggatggcgtgtcccctg

SEQ ID NO: 2285215 - DNA, 15 bp, Homo sapiens
ggccagggctctggc

SEQ ID NO: 2285216 - DNA, 16 bp, Homo sapiens
ggccagggctctggca

SEQ ID NO: 2285217 - DNA, 17 bp, Homo sapiens
ggccagggctctggcag

SEQ ID NO: 2285218 - DNA, 20 bp, Homo sapiens
ggccatggaagctggcagga

SEQ ID NO: 2285219 - DNA, 21 bp, Homo sapiens
ggcccaaataacagtggcaag

SEQ ID NO: 2285220 - DNA, 17 bp, Homo sapiens
ggcccaacctcgccctc

SEQ ID NO: 2285221 - DNA, 21 bp, Homo sapiens
ggcccaacctcgccctctctc

SEQ ID NO: 2285222 - DNA, 22 bp, Homo sapiens
ggcccacattgcccacacctgc

SEQ ID NO: 2285223 - DNA, 15 bp, Homo sapiens
ggcccacgcagagcc

SEQ ID NO: 2285224 - DNA, 17 bp, Homo sapiens
ggcccacgcagagcccc

SEQ ID NO: 2285225 - DNA, 20 bp, Homo sapiens
ggcccacgcagagccccgga

SEQ ID NO: 2285226 - DNA, 23 bp, Homo sapiens
ggcccagaggggcggggccagga

SEQ ID NO: 2285227 - DNA, 13 bp, Homo sapiens
ggcccatggcccc

SEQ ID NO: 2285228 - DNA, 15 bp, Homo sapiens
ggcccatggccccag

SEQ ID NO: 2285229 - DNA, 21 bp, Homo sapiens
ggcccatggccccagctggct

SEQ ID NO: 2285230 - DNA, 15 bp, Homo sapiens
ggcccattcagcctc

SEQ ID NO: 2285231 - DNA, 13 bp, Homo sapiens
ggccccacggaga

SEQ ID NO: 2285232 - DNA, 16 bp, Homo sapiens
ggccccagaaagcctc

SEQ ID NO: 2285233 - DNA, 12 bp, Homo sapiens
ggccccagctgg

SEQ ID NO: 2285234 - DNA, 18 bp, Homo sapiens
ggccccagctggctgggt

SEQ ID NO: 2285235 - DNA, 13 bp, Homo sapiens
ggccccatggtca

SEQ ID NO: 2285236 - DNA, 20 bp, Homo sapiens
ggcccccggaggcgcccacc

SEQ ID NO: 2285237 - DNA, 22 bp, Homo sapiens
ggcccccggaggcgcccacctg

SEQ ID NO: 2285238 - DNA, 18 bp, Homo sapiens
ggccccgcacccctcctc

SEQ ID NO: 2285239 - DNA, 21 bp, Homo sapiens
ggccccgcacccctcctcctt

SEQ ID NO: 2285240 - DNA, 20 bp, Homo sapiens
ggccccgcgcgtgcccccag

SEQ ID NO: 2285241 - DNA, 15 bp, Homo sapiens
ggcccgagcgcgtgc

SEQ ID NO: 2285242 - DNA, 21 bp, Homo sapiens
ggcccgagcgcgtgccttccc

SEQ ID NO: 2285243 - DNA, 14 bp, Homo sapiens
ggcccgccccaggc

SEQ ID NO: 2285244 - DNA, 21 bp, Homo sapiens
ggcccgccccaggccccagca

SEQ ID NO: 2285245 - DNA, 17 bp, Homo sapiens
ggcccgctcaacctctc

SEQ ID NO: 2285246 - DNA, 19 bp, Homo sapiens
ggcccgctcaacctctcag

SEQ ID NO: 2285247 - DNA, 21 bp, Homo sapiens
ggcccggcccacgcagagccc

SEQ ID NO: 2285248 - DNA, 15 bp, Homo sapiens
ggcccgtgcgcagcc

SEQ ID NO: 2285249 - DNA, 11 bp, Homo sapiens
ggccctgccct

SEQ ID NO: 2285250 - DNA, 13 bp, Homo sapiens
ggccctgccctcc

SEQ ID NO: 2285251 - DNA, 15 bp, Homo sapiens
ggccctgccctcccc

SEQ ID NO: 2285252 - DNA, 23 bp, Homo sapiens
ggccctgccctcccccacggccg

SEQ ID NO: 2285253 - DNA, 19 bp, Homo sapiens
ggccctggaggggcccatg

SEQ ID NO: 2285254 - DNA, 16 bp, Homo sapiens
ggccctggggtctctg

SEQ ID NO: 2285255 - DNA, 18 bp, Homo sapiens
ggccgacatcagcccggt

SEQ ID NO: 2285256 - DNA, 19 bp, Homo sapiens
ggccgcagggcgctccggc

SEQ ID NO: 2285257 - DNA, 22 bp, Homo sapiens
ggccgcagggcgctccggcaga

SEQ ID NO: 2285258 - DNA, 19 bp, Homo sapiens
ggccgcctcctccagactc

SEQ ID NO: 2285259 - DNA, 17 bp, Homo sapiens
ggccgcgcaccgccatg

SEQ ID NO: 2285260 - DNA, 14 bp, Homo sapiens
ggccggcctggggc

SEQ ID NO: 2285261 - DNA, 18 bp, Homo sapiens
ggccggcggcctcagagt

SEQ ID NO: 2285262 - DNA, 14 bp, Homo sapiens
ggccgggctggctt

SEQ ID NO: 2285263 - DNA, 19 bp, Homo sapiens
ggccgtccctgacttccca

SEQ ID NO: 2285264 - DNA, 19 bp, Homo sapiens
ggcctaatcacctttccaa

SEQ ID NO: 2285265 - DNA, 14 bp, Homo sapiens
ggcctagtggcttc

SEQ ID NO: 2285266 - DNA, 20 bp, Homo sapiens
ggcctagtggcttcagcccc

SEQ ID NO: 2285267 - DNA, 14 bp, Homo sapiens
ggcctcattcagca

SEQ ID NO: 2285268 - DNA, 23 bp, Homo sapiens
ggcctccccgggggtccccggac

SEQ ID NO: 2285269 - DNA, 21 bp, Homo sapiens
ggcctgaaatgtttccaggca

SEQ ID NO: 2285270 - DNA, 16 bp, Homo sapiens
ggcctgagggaagccc

SEQ ID NO: 2285271 - DNA, 21 bp, Homo sapiens
ggcctgagggaagcccacccg

SEQ ID NO: 2285272 - DNA, 22 bp, Homo sapiens
ggcctgagggaagcccacccgc

SEQ ID NO: 2285273 - DNA, 23 bp, Homo sapiens
ggcctgagggaagcccacccgcc

SEQ ID NO: 2285274 - DNA, 17 bp, Homo sapiens
ggcctggggccgggctg

SEQ ID NO: 2285275 - DNA, 20 bp, Homo sapiens
ggcctgtttggtgaggacct

SEQ ID NO: 2285276 - DNA, 15 bp, Homo sapiens
ggcgagaggtgagct

SEQ ID NO: 2285277 - DNA, 18 bp, Homo sapiens
ggcgaggacgacttctgc

SEQ ID NO: 2285278 - DNA, 12 bp, Homo sapiens
ggcgcccacctg

SEQ ID NO: 2285279 - DNA, 15 bp, Homo sapiens
ggcgcccacctgccc

SEQ ID NO: 2285280 - DNA, 16 bp, Homo sapiens
ggcgcccacctgccca

SEQ ID NO: 2285281 - DNA, 23 bp, Homo sapiens
ggcgcctgcgctcctctgcagcc

SEQ ID NO: 2285282 - DNA, 13 bp, Homo sapiens
ggcgcgcaccgcc

SEQ ID NO: 2285283 - DNA, 15 bp, Homo sapiens
ggcgcgcaccgccca

SEQ ID NO: 2285284 - DNA, 20 bp, Homo sapiens
ggcgcgcaccgcccaacccc

SEQ ID NO: 2285285 - DNA, 16 bp, Homo sapiens
ggcgctccggcagagg

SEQ ID NO: 2285286 - DNA, 18 bp, Homo sapiens
ggcgctccggcagaggca

SEQ ID NO: 2285287 - DNA, 23 bp, Homo sapiens
ggcgctcgaagttgatctcccca

SEQ ID NO: 2285288 - DNA, 18 bp, Homo sapiens
ggcgctgcccccacagat

SEQ ID NO: 2285289 - DNA, 21 bp, Homo sapiens
ggcggaggggcttggagcaga

SEQ ID NO: 2285290 - DNA, 16 bp, Homo sapiens
ggcggcaggggtcgcg

SEQ ID NO: 2285291 - DNA, 13 bp, Homo sapiens
ggcggctctggga

SEQ ID NO: 2285292 - DNA, 19 bp, Homo sapiens
ggcgggaagggtgggccct

SEQ ID NO: 2285293 - DNA, 14 bp, Homo sapiens
ggcgggcagcccct

SEQ ID NO: 2285294 - DNA, 15 bp, Homo sapiens
ggcgggcagcccctg

SEQ ID NO: 2285295 - DNA, 16 bp, Homo sapiens
ggcgggcagcccctgc

SEQ ID NO: 2285296 - DNA, 22 bp, Homo sapiens
ggcggggctgtgcgggcgcccg

SEQ ID NO: 2285297 - DNA, 13 bp, Homo sapiens
ggcgtagggccag

SEQ ID NO: 2285298 - DNA, 19 bp, Homo sapiens
gacaggcttcgtctcagaa

SEQ ID NO: 2285299 - DNA, 19 bp, Homo sapiens
gacagtcaggaagcctcct

SEQ ID NO: 2285300 - DNA, 23 bp, Homo sapiens
gacagtcaggaagcctcctgctg

SEQ ID NO: 2285301 - DNA, 16 bp, Homo sapiens
gacagtcccagttccc

SEQ ID NO: 2285302 - DNA, 18 bp, Homo sapiens
gacagtttgtaaatgtta

SEQ ID NO: 2285303 - DNA, 20 bp, Homo sapiens
gacagtttgtaaatgttatt

SEQ ID NO: 2285304 - DNA, 22 bp, Homo sapiens
gacatcagcccggtgtgaggag

SEQ ID NO: 2285305 - DNA, 18 bp, Homo sapiens
gacatcggttcaggagga

SEQ ID NO: 2285306 - DNA, 21 bp, Homo sapiens
gacatttaaaatagttttcta

SEQ ID NO: 2285307 - DNA, 22 bp, Homo sapiens
gacattttgggctggataaata

SEQ ID NO: 2285308 - DNA, 13 bp, Homo sapiens
gaccaaatggaaa

SEQ ID NO: 2285309 - DNA, 21 bp, Homo sapiens
gaccaaggtgcggaccggagc

SEQ ID NO: 2285310 - DNA, 13 bp, Homo sapiens
gaccaatctctgt

SEQ ID NO: 2285311 - DNA, 12 bp, Homo sapiens
gaccaccagagg

SEQ ID NO: 2285312 - DNA, 18 bp, Homo sapiens
gaccactgtttcttgctt

SEQ ID NO: 2285313 - DNA, 17 bp, Homo sapiens
gaccagagctatgaatc

SEQ ID NO: 2285314 - DNA, 17 bp, Homo sapiens
gaccaggctcacaactg

SEQ ID NO: 2285315 - DNA, 23 bp, Homo sapiens
gacccattcatactaaataaaac

SEQ ID NO: 2285316 - DNA, 19 bp, Homo sapiens
gaccccacacgccggggct

SEQ ID NO: 2285317 - DNA, 22 bp, Homo sapiens
gaccccacacgccggggctggc

SEQ ID NO: 2285318 - DNA, 14 bp, Homo sapiens
gaccccattctggg

SEQ ID NO: 2285319 - DNA, 13 bp, Homo sapiens
gacccctggggga

SEQ ID NO: 2285320 - DNA, 15 bp, Homo sapiens
gaccctcggggcagg

SEQ ID NO: 2285321 - DNA, 16 bp, Homo sapiens
atgtaatcatttatct

SEQ ID NO: 2285322 - DNA, 19 bp, Homo sapiens
atgtacagaaaatagcttt

SEQ ID NO: 2285323 - DNA, 19 bp, Homo sapiens
atgtaccatgttgcccaga

SEQ ID NO: 2285324 - DNA, 22 bp, Homo sapiens
atgtaccctaccctgcacattg

SEQ ID NO: 2285325 - DNA, 23 bp, Homo sapiens
atgtactaccctcagtctacact

SEQ ID NO: 2285326 - DNA, 21 bp, Homo sapiens
atgtactagtactgtgtactg

SEQ ID NO: 2285327 - DNA, 22 bp, Homo sapiens
atgtactagtactgtgtactgt

SEQ ID NO: 2285328 - DNA, 13 bp, Homo sapiens
atgtactgtattg

SEQ ID NO: 2285329 - DNA, 12 bp, Homo sapiens
atgtagaactgt

SEQ ID NO: 2285330 - DNA, 22 bp, Homo sapiens
atgtagaactgttcatttccac

SEQ ID NO: 2285331 - DNA, 21 bp, Homo sapiens
atgtagacaaaacttataatt

SEQ ID NO: 2285332 - DNA, 15 bp, Homo sapiens
atgtagcattaaata

SEQ ID NO: 2285333 - DNA, 18 bp, Homo sapiens
atgtagcattaaatataa

SEQ ID NO: 2285334 - DNA, 19 bp, Homo sapiens
atgtagccagcagaactga

SEQ ID NO: 2285335 - DNA, 18 bp, Homo sapiens
atgtagttgatgtatcca

SEQ ID NO: 2285336 - DNA, 23 bp, Homo sapiens
atgtataacaagccaaacattct

SEQ ID NO: 2285337 - DNA, 13 bp, Homo sapiens
atgtatagcttta

SEQ ID NO: 2285338 - DNA, 17 bp, Homo sapiens
atgtatagctttaacat

SEQ ID NO: 2285339 - DNA, 19 bp, Homo sapiens
atgtatagctttaacattt

SEQ ID NO: 2285340 - DNA, 20 bp, Homo sapiens
atgtatatctgtaatatata

SEQ ID NO: 2285341 - DNA, 16 bp, Homo sapiens
atgtatcttatttata

SEQ ID NO: 2285342 - DNA, 18 bp, Homo sapiens
atgtatcttatttatata

SEQ ID NO: 2285343 - DNA, 12 bp, Homo sapiens
atgtattctttt

SEQ ID NO: 2285344 - DNA, 15 bp, Homo sapiens
atgtatttaaagaac

SEQ ID NO: 2285345 - DNA, 22 bp, Homo sapiens
atgtattttcaataaagaaaaa

SEQ ID NO: 2285346 - DNA, 12 bp, Homo sapiens
atgtcagtctgt

SEQ ID NO: 2285347 - DNA, 16 bp, Homo sapiens
atgtcagtgtgactga

SEQ ID NO: 2285348 - DNA, 21 bp, Homo sapiens
atgtcatactctgtgtaatct

SEQ ID NO: 2285349 - DNA, 14 bp, Homo sapiens
atgtccaaacctgg

SEQ ID NO: 2285350 - DNA, 16 bp, Homo sapiens
atgtccccattctata

SEQ ID NO: 2285351 - DNA, 21 bp, Homo sapiens
atgtccccattctataaattc

SEQ ID NO: 2285352 - DNA, 19 bp, Homo sapiens
atgtcctggaagtgtgtgt

SEQ ID NO: 2285353 - DNA, 17 bp, Homo sapiens
atgtctgtagttgcttt

SEQ ID NO: 2285354 - DNA, 16 bp, Homo sapiens
atgtgaaggtgtttca

SEQ ID NO: 2285355 - DNA, 19 bp, Homo sapiens
atgtgagctataatgtttc

SEQ ID NO: 2285356 - DNA, 19 bp, Homo sapiens
atgtgatctgtcttgtaat

SEQ ID NO: 2285357 - DNA, 15 bp, Homo sapiens
atgtgatgagaggaa

SEQ ID NO: 2285358 - DNA, 12 bp, Homo sapiens
atgtgcaatttg

SEQ ID NO: 2285359 - DNA, 15 bp, Homo sapiens
atgtgcttcattgtt

SEQ ID NO: 2285360 - DNA, 17 bp, Homo sapiens
atgtgcttcattgtttg

SEQ ID NO: 2285361 - DNA, 21 bp, Homo sapiens
atgtgcttttccatctaaaat

SEQ ID NO: 2285362 - DNA, 14 bp, Homo sapiens
atgtggatgctctt

SEQ ID NO: 2285363 - DNA, 18 bp, Homo sapiens
atgtgggaagttaccttt

SEQ ID NO: 2285364 - DNA, 22 bp, Homo sapiens
atgtgtacagaaacaactgcca

SEQ ID NO: 2285365 - DNA, 23 bp, Homo sapiens
atgtgtacagaaacaactgccaa

SEQ ID NO: 2285366 - DNA, 14 bp, Homo sapiens
atgtgtcaaagaga

SEQ ID NO: 2285367 - DNA, 15 bp, Homo sapiens
atgtgtcatgatttc

SEQ ID NO: 2285368 - DNA, 17 bp, Homo sapiens
atgtgtcatgatttcaa

SEQ ID NO: 2285369 - DNA, 23 bp, Homo sapiens
atgtgtcatgatttcaatgattg

SEQ ID NO: 2285370 - DNA, 16 bp, Homo sapiens
atgtgtccatgtgaaa

SEQ ID NO: 2285371 - DNA, 17 bp, Homo sapiens
atgtgtccatgtgaaat

SEQ ID NO: 2285372 - DNA, 15 bp, Homo sapiens
atgtgtgctcttatc

SEQ ID NO: 2285373 - DNA, 16 bp, Homo sapiens
atgtgtggctcattct

SEQ ID NO: 2285374 - DNA, 19 bp, Homo sapiens
atgtgtggctcattctttt

SEQ ID NO: 2285375 - DNA, 16 bp, Homo sapiens
atgtgttaaatttagt

SEQ ID NO: 2285376 - DNA, 22 bp, Homo sapiens
atgtgttgcaaattattctagt

SEQ ID NO: 2285377 - DNA, 22 bp, Homo sapiens
atgttaacaacttgaattacaa

SEQ ID NO: 2285378 - DNA, 15 bp, Homo sapiens
atgttaacatgcgca

SEQ ID NO: 2285379 - DNA, 17 bp, Homo sapiens
atgttagtaatggcaga

SEQ ID NO: 2285380 - DNA, 22 bp, Homo sapiens
atgttagtaatggcagagcagt

SEQ ID NO: 2285381 - DNA, 22 bp, Homo sapiens
atgttagtgttttaagaaatgt

SEQ ID NO: 2285382 - DNA, 15 bp, Homo sapiens
atgttatttctgcaa

SEQ ID NO: 2285383 - DNA, 13 bp, Homo sapiens
atgttattttcag

SEQ ID NO: 2285384 - DNA, 16 bp, Homo sapiens
atgttattttcagtgc

SEQ ID NO: 2285385 - DNA, 17 bp, Homo sapiens
atgttcagtcacatgtg

SEQ ID NO: 2285386 - DNA, 14 bp, Homo sapiens
atgttcataaaaaa

SEQ ID NO: 2285387 - DNA, 23 bp, Homo sapiens
atgttctaaaatgtcaaggcagt

SEQ ID NO: 2285388 - DNA, 17 bp, Homo sapiens
atgttgataatagtaat

SEQ ID NO: 2285389 - DNA, 13 bp, Homo sapiens
atgttgctgaaac

SEQ ID NO: 2285390 - DNA, 13 bp, Homo sapiens
atgttgttaaatg

SEQ ID NO: 2285391 - DNA, 14 bp, Homo sapiens
atgttgttaaatgc

SEQ ID NO: 2285392 - DNA, 18 bp, Homo sapiens
atgttgttaaatgctatg

SEQ ID NO: 2285393 - DNA, 19 bp, Homo sapiens
atgtttacattttctttca

SEQ ID NO: 2285394 - DNA, 15 bp, Homo sapiens
atgtttcatgaagaa

SEQ ID NO: 2285395 - DNA, 20 bp, Homo sapiens
atgtttcatgaagaaaaaat

SEQ ID NO: 2285396 - DNA, 22 bp, Homo sapiens
atgtttccaggcatgaccctgg

SEQ ID NO: 2285397 - DNA, 23 bp, Homo sapiens
atgtttccaggcatgaccctgga

SEQ ID NO: 2285398 - DNA, 23 bp, Homo sapiens
atgtttcctgtggaaatatgcaa

SEQ ID NO: 2285399 - DNA, 22 bp, Homo sapiens
atgtttctgcagtattctgtag

SEQ ID NO: 2285400 - DNA, 19 bp, Homo sapiens
gcccccggaggcgcccacc

SEQ ID NO: 2285401 - DNA, 20 bp, Homo sapiens
gcccccggaggcgcccacct

SEQ ID NO: 2285402 - DNA, 16 bp, Homo sapiens
gccccctcccccgcag

SEQ ID NO: 2285403 - DNA, 18 bp, Homo sapiens
gccccctcccccgcagac

SEQ ID NO: 2285404 - DNA, 15 bp, Homo sapiens
gccccctggcccctc

SEQ ID NO: 2285405 - DNA, 16 bp, Homo sapiens
gccccctggcccctcc

SEQ ID NO: 2285406 - DNA, 19 bp, Homo sapiens
gccccctggcccctcccac

SEQ ID NO: 2285407 - DNA, 20 bp, Homo sapiens
gccccgaccccacctgaggc

SEQ ID NO: 2285408 - DNA, 23 bp, Homo sapiens
gccccgcctcaaggaagagccag

SEQ ID NO: 2285409 - DNA, 17 bp, Homo sapiens
gccccgcgcgtgccccc

SEQ ID NO: 2285410 - DNA, 14 bp, Homo sapiens
gccccggagcacca

SEQ ID NO: 2285411 - DNA, 12 bp, Homo sapiens
gccccggcccaa

SEQ ID NO: 2285412 - DNA, 15 bp, Homo sapiens
gcccctaggctgctg

SEQ ID NO: 2285413 - DNA, 17 bp, Homo sapiens
gcccctaggctgctgct

SEQ ID NO: 2285414 - DNA, 17 bp, Homo sapiens
gcccctcccacatcccc

SEQ ID NO: 2285415 - DNA, 20 bp, Homo sapiens
gcccctccccgcctcctccc

SEQ ID NO: 2285416 - DNA, 23 bp, Homo sapiens
gcccctccccgcctcctccctgc

SEQ ID NO: 2285417 - DNA, 13 bp, Homo sapiens
gcccctccgtccc

SEQ ID NO: 2285418 - DNA, 17 bp, Homo sapiens
gcccctcctctcctcgt

SEQ ID NO: 2285419 - DNA, 23 bp, Homo sapiens
gcccctcctctcctcgtccggcc

SEQ ID NO: 2285420 - DNA, 15 bp, Homo sapiens
gcccctgctggacca

SEQ ID NO: 2285421 - DNA, 17 bp, Homo sapiens
gccccttgaccccacac

SEQ ID NO: 2285422 - DNA, 19 bp, Homo sapiens
gccccttgaccccacacgc

SEQ ID NO: 2285423 - DNA, 12 bp, Homo sapiens
gcccgccacctt

SEQ ID NO: 2285424 - DNA, 23 bp, Homo sapiens
gcccgccaccttgtacagaacca

SEQ ID NO: 2285425 - DNA, 12 bp, Homo sapiens
gcccgcccaccc

SEQ ID NO: 2285426 - DNA, 13 bp, Homo sapiens
gcccgcccacccc

SEQ ID NO: 2285427 - DNA, 21 bp, Homo sapiens
gcccgcccaccccgctgcctg

SEQ ID NO: 2285428 - DNA, 22 bp, Homo sapiens
gcccgcccaccccgctgcctgg

SEQ ID NO: 2285429 - DNA, 12 bp, Homo sapiens
gcccgccccagg

SEQ ID NO: 2285430 - DNA, 16 bp, Homo sapiens
gcccgcccccgccctc

SEQ ID NO: 2285431 - DNA, 13 bp, Homo sapiens
gcccgccctcctc

SEQ ID NO: 2285432 - DNA, 14 bp, Homo sapiens
gcccgccctcctct

SEQ ID NO: 2285433 - DNA, 20 bp, Homo sapiens
gcccgccggttggccggctg

SEQ ID NO: 2285434 - DNA, 15 bp, Homo sapiens
gcccgcctgcgcccc

SEQ ID NO: 2285435 - DNA, 24 bp, Homo sapiens
gcccgcctgcgccccccagtggac

SEQ ID NO: 2285436 - DNA, 18 bp, Homo sapiens
gcccgctcaacctctcag

SEQ ID NO: 2285437 - DNA, 23 bp, Homo sapiens
gcccgctcaacctctcagatccc

SEQ ID NO: 2285438 - DNA, 17 bp, Homo sapiens
gcccggcagtgcacccc

SEQ ID NO: 2285439 - DNA, 14 bp, Homo sapiens
gcccggccaaggac

SEQ ID NO: 2285440 - DNA, 17 bp, Homo sapiens
gcccggccaaggacact

SEQ ID NO: 2285441 - DNA, 16 bp, Homo sapiens
gcccggcccacgcaga

SEQ ID NO: 2285442 - DNA, 21 bp, Homo sapiens
gcccggcccacgcagagcccc

SEQ ID NO: 2285443 - DNA, 23 bp, Homo sapiens
gcccggcccacgcagagccccgg

SEQ ID NO: 2285444 - DNA, 21 bp, Homo sapiens
gcccgggagatccgccctggg

SEQ ID NO: 2285445 - DNA, 21 bp, Homo sapiens
gcccgtgcgcagccgcgctct

SEQ ID NO: 2285446 - DNA, 24 bp, Homo sapiens
gcccgtgcgcagccgcgctctgcc

SEQ ID NO: 2285447 - DNA, 17 bp, Homo sapiens
gccctaatgtctgacct

SEQ ID NO: 2285448 - DNA, 13 bp, Homo sapiens
gccctcccccacg

SEQ ID NO: 2285449 - DNA, 15 bp, Homo sapiens
gccctcccccacggc

SEQ ID NO: 2285450 - DNA, 23 bp, Homo sapiens
gccctccgcgggggacaggaaca

SEQ ID NO: 2285451 - DNA, 18 bp, Homo sapiens
gccctcctctgccccctc

SEQ ID NO: 2285452 - DNA, 16 bp, Homo sapiens
gccctctctcaccagc

SEQ ID NO: 2285453 - DNA, 20 bp, Homo sapiens
gccctctctcaccagccttg

SEQ ID NO: 2285454 - DNA, 16 bp, Homo sapiens
gccctgcaccttgggc

SEQ ID NO: 2285455 - DNA, 14 bp, Homo sapiens
gccctgccctcccc

SEQ ID NO: 2285456 - DNA, 15 bp, Homo sapiens
gccctgccctccccc

SEQ ID NO: 2285457 - DNA, 20 bp, Homo sapiens
gccctggaggggcccatgtg

SEQ ID NO: 2285458 - DNA, 17 bp, Homo sapiens
gccctggccactggccc

SEQ ID NO: 2285459 - DNA, 18 bp, Homo sapiens
gccctggccactggccct

SEQ ID NO: 2285460 - DNA, 19 bp, Homo sapiens
gccctgggccccgcctcaa

SEQ ID NO: 2285461 - DNA, 13 bp, Homo sapiens
gccctgggctctg

SEQ ID NO: 2285462 - DNA, 16 bp, Homo sapiens
gccctggggtctctga

SEQ ID NO: 2285463 - DNA, 23 bp, Homo sapiens
gccctggggtctctgagcagtgg

SEQ ID NO: 2285464 - DNA, 19 bp, Homo sapiens
gccctgtccactctgctca

SEQ ID NO: 2285465 - DNA, 16 bp, Homo sapiens
gccctgtggctccagg

SEQ ID NO: 2285466 - DNA, 21 bp, Homo sapiens
gccctgtggctccaggagcag

SEQ ID NO: 2285467 - DNA, 20 bp, Homo sapiens
gcccttaaaataatgattta

SEQ ID NO: 2285468 - DNA, 17 bp, Homo sapiens
gcccttttgcccactgt

SEQ ID NO: 2285469 - DNA, 18 bp, Homo sapiens
gccgacaggaggccatgc

SEQ ID NO: 2285470 - DNA, 14 bp, Homo sapiens
gccgacggagccac

SEQ ID NO: 2285471 - DNA, 16 bp, Homo sapiens
gccgagctctcctggg

SEQ ID NO: 2285472 - DNA, 22 bp, Homo sapiens
gccgagctctcctgggccaggg

SEQ ID NO: 2285473 - DNA, 14 bp, Homo sapiens
gccgagtgccccag

SEQ ID NO: 2285474 - DNA, 18 bp, Homo sapiens
gccgcagggcgctccggc

SEQ ID NO: 2285475 - DNA, 13 bp, Homo sapiens
gccgcctcctcca

SEQ ID NO: 2285476 - DNA, 14 bp, Homo sapiens
gccgcctcctccag

SEQ ID NO: 2285477 - DNA, 15 bp, Homo sapiens
gccgccttcacagca

SEQ ID NO: 2285478 - DNA, 15 bp, Homo sapiens
gccgcgctctgcccc

SEQ ID NO: 2285479 - DNA, 16 bp, Homo sapiens
gccgcgctctgcccct

SEQ ID NO: 2285480 - DNA, 19 bp, Homo sapiens
gccgcgctctgcccctccg

SEQ ID NO: 2285481 - DNA, 18 bp, Homo sapiens
gccgcgggcgagaagggc

SEQ ID NO: 2285482 - DNA, 18 bp, Homo sapiens
gccgctgcccccaccctg

SEQ ID NO: 2285483 - DNA, 19 bp, Homo sapiens
gccgctgcccccaccctgc

SEQ ID NO: 2285484 - DNA, 13 bp, Homo sapiens
gccggcgccccgg

SEQ ID NO: 2285485 - DNA, 16 bp, Homo sapiens
gccggctggccggtcc

SEQ ID NO: 2285486 - DNA, 21 bp, Homo sapiens
gccggctggccggtccacccc

SEQ ID NO: 2285487 - DNA, 17 bp, Homo sapiens
gccgggctggcttctcc

SEQ ID NO: 2285488 - DNA, 15 bp, Homo sapiens
gccggggctggccct

SEQ ID NO: 2285489 - DNA, 17 bp, Homo sapiens
gccggggctggccctgc

SEQ ID NO: 2285490 - DNA, 18 bp, Homo sapiens
gccggggctggccctgcc

SEQ ID NO: 2285491 - DNA, 23 bp, Homo sapiens
gccggtccaccccgtcccggccc

SEQ ID NO: 2285492 - DNA, 23 bp, Homo sapiens
gccgtaatggggactctccaggc

SEQ ID NO: 2285493 - DNA, 12 bp, Homo sapiens
gccgtacagttc

SEQ ID NO: 2285494 - DNA, 22 bp, Homo sapiens
gccgtccctgacttcccagctg

SEQ ID NO: 2285495 - DNA, 19 bp, Homo sapiens
gcctagaacaagccagagc

SEQ ID NO: 2285496 - DNA, 20 bp, Homo sapiens
gcctagtggcttcagcccct

SEQ ID NO: 2285497 - DNA, 23 bp, Homo sapiens
gcctcaaggaagagccagccgta

SEQ ID NO: 2285498 - DNA, 19 bp, Homo sapiens
gcctcactgcatctttctc

SEQ ID NO: 2285499 - DNA, 16 bp, Homo sapiens
gcctcattcagcagaa

SEQ ID NO: 2285500 - DNA, 20 bp, Homo sapiens
gcctcattcagcagaatgac

SEQ ID NO: 2285501 - DNA, 18 bp, Homo sapiens
gcctccaagtcatgggag

SEQ ID NO: 2285502 - DNA, 21 bp, Homo sapiens
gcctccaagtcatgggagaag

SEQ ID NO: 2285503 - DNA, 13 bp, Homo sapiens
gcctccatccaca

SEQ ID NO: 2285504 - DNA, 15 bp, Homo sapiens
gcctccatccacaca

SEQ ID NO: 2285505 - DNA, 15 bp, Homo sapiens
gcctcccccaggctg

SEQ ID NO: 2285506 - DNA, 20 bp, Homo sapiens
gcctcccccaggctgcgcct

SEQ ID NO: 2285507 - DNA, 21 bp, Homo sapiens
gcctcctcagcagcctcactg

SEQ ID NO: 2285508 - DNA, 16 bp, Homo sapiens
gcctcctccagactcg

SEQ ID NO: 2285509 - DNA, 12 bp, Homo sapiens
gcctcctccagc

SEQ ID NO: 2285510 - DNA, 15 bp, Homo sapiens
gcctcctccagctcc

SEQ ID NO: 2285511 - DNA, 17 bp, Homo sapiens
gcctcctccagctcctg

SEQ ID NO: 2285512 - DNA, 19 bp, Homo sapiens
gcctcctccagctcctgcc

SEQ ID NO: 2285513 - DNA, 13 bp, Homo sapiens
gcctcctccctgc

SEQ ID NO: 2285514 - DNA, 14 bp, Homo sapiens
gcctcctccctgcc

SEQ ID NO: 2285515 - DNA, 22 bp, Homo sapiens
gcctcctgctgagtggtccaca

SEQ ID NO: 2285516 - DNA, 15 bp, Homo sapiens
gcctcgacctccctg

SEQ ID NO: 2285517 - DNA, 18 bp, Homo sapiens
gcctcgggccgcctcctc

SEQ ID NO: 2285518 - DNA, 14 bp, Homo sapiens
gcctcgtctttcag

SEQ ID NO: 2285519 - DNA, 17 bp, Homo sapiens
gcctctgaactgctgct

SEQ ID NO: 2285520 - DNA, 12 bp, Homo sapiens
gcctctggggag

SEQ ID NO: 2285521 - DNA, 17 bp, Homo sapiens
gcctcttcctccccatg

SEQ ID NO: 2285522 - DNA, 22 bp, Homo sapiens
gcctgaaatgtttccaggcatg

SEQ ID NO: 2285523 - DNA, 17 bp, Homo sapiens
ggcttggctcgcacccc

SEQ ID NO: 2285524 - DNA, 16 bp, Homo sapiens
ggctttaaataaaaga

SEQ ID NO: 2285525 - DNA, 17 bp, Homo sapiens
ggctttaaataaaagag

SEQ ID NO: 2285526 - DNA, 22 bp, Homo sapiens
ggctttcatttcttattaacca

SEQ ID NO: 2285527 - DNA, 19 bp, Homo sapiens
gggaaccctctggggccct

SEQ ID NO: 2285528 - DNA, 21 bp, Homo sapiens
gggaagagagaggcctgggtg

SEQ ID NO: 2285529 - DNA, 16 bp, Homo sapiens
gggaagcccacccgcc

SEQ ID NO: 2285530 - DNA, 23 bp, Homo sapiens
gggaagcccacccgccccagaga

SEQ ID NO: 2285531 - DNA, 13 bp, Homo sapiens
gggaaggcctgag

SEQ ID NO: 2285532 - DNA, 23 bp, Homo sapiens
gggaaggcctgagggaagcccac

SEQ ID NO: 2285533 - DNA, 22 bp, Homo sapiens
gggaagggagcaccagatgaca

SEQ ID NO: 2285534 - DNA, 21 bp, Homo sapiens
gggaagggtgggccctggagg

SEQ ID NO: 2285535 - DNA, 15 bp, Homo sapiens
gggaagttacctttt

SEQ ID NO: 2285536 - DNA, 22 bp, Homo sapiens
gggacagattcagtcttgcctt

SEQ ID NO: 2285537 - DNA, 21 bp, Homo sapiens
gggacaggaacacccagcccc

SEQ ID NO: 2285538 - DNA, 21 bp, Homo sapiens
gggacaggattgtctgctgcc

SEQ ID NO: 2285539 - DNA, 22 bp, Homo sapiens
gggacggggcccgccccaggcc

SEQ ID NO: 2285540 - DNA, 16 bp, Homo sapiens
gggactagaggcacgc

SEQ ID NO: 2285541 - DNA, 21 bp, Homo sapiens
gggactcagttcttggcctgc

SEQ ID NO: 2285542 - DNA, 23 bp, Homo sapiens
gggactctccaggcaccgcctgc

SEQ ID NO: 2285543 - DNA, 21 bp, Homo sapiens
gggactgtcttcaaccctgcc

SEQ ID NO: 2285544 - DNA, 17 bp, Homo sapiens
gggagaccctgggagag

SEQ ID NO: 2285545 - DNA, 19 bp, Homo sapiens
gggagaccgagtgtggagc

SEQ ID NO: 2285546 - DNA, 16 bp, Homo sapiens
gggagatccgccctgg

SEQ ID NO: 2285547 - DNA, 12 bp, Homo sapiens
gggaggagcacc

SEQ ID NO: 2285548 - DNA, 21 bp, Homo sapiens
gggaggagcacccccagcctc

SEQ ID NO: 2285549 - DNA, 19 bp, Homo sapiens
gggaggcttccagctcagt

SEQ ID NO: 2285550 - DNA, 15 bp, Homo sapiens
gggagggggcagggg

SEQ ID NO: 2285551 - DNA, 16 bp, Homo sapiens
gggaggtccaaggtca

SEQ ID NO: 2285552 - DNA, 16 bp, Homo sapiens
gggagtgaacatttct

SEQ ID NO: 2285553 - DNA, 15 bp, Homo sapiens
gggcaaaaatatttt

SEQ ID NO: 2285554 - DNA, 16 bp, Homo sapiens
gggcaaccaataaaag

SEQ ID NO: 2285555 - DNA, 13 bp, Homo sapiens
gggcaaggggcca

SEQ ID NO: 2285556 - DNA, 22 bp, Homo sapiens
gggcacacttccccttgggatg

SEQ ID NO: 2285557 - DNA, 18 bp, Homo sapiens
gggcacgggagagcgcca

SEQ ID NO: 2285558 - DNA, 21 bp, Homo sapiens
gggcagagctgagtcggctgg

SEQ ID NO: 2285559 - DNA, 11 bp, Homo sapiens
gggcagcccct

SEQ ID NO: 2285560 - DNA, 17 bp, Homo sapiens
gggcagcggccccgcac

SEQ ID NO: 2285561 - DNA, 21 bp, Homo sapiens
gggcagcggccccgcacccct

SEQ ID NO: 2285562 - DNA, 22 bp, Homo sapiens
gggcagcggccccgcacccctc

SEQ ID NO: 2285563 - DNA, 13 bp, Homo sapiens
gggcagggccctg

SEQ ID NO: 2285564 - DNA, 14 bp, Homo sapiens
gggcagggccgcag

SEQ ID NO: 2285565 - DNA, 21 bp, Homo sapiens
gggcatagggtttggaagaaa

SEQ ID NO: 2285566 - DNA, 18 bp, Homo sapiens
gggcatccttgaggacct

SEQ ID NO: 2285567 - DNA, 12 bp, Homo sapiens
gggccagcccct

SEQ ID NO: 2285568 - DNA, 14 bp, Homo sapiens
gggccagcccctcc

SEQ ID NO: 2285569 - DNA, 18 bp, Homo sapiens
gggccagcccctccccgc

SEQ ID NO: 2285570 - DNA, 22 bp, Homo sapiens
gggccagcccctccccgcctcc

SEQ ID NO: 2285571 - DNA, 19 bp, Homo sapiens
gggccatggaagctggcag

SEQ ID NO: 2285572 - DNA, 15 bp, Homo sapiens
gggcccatgtgggct

SEQ ID NO: 2285573 - DNA, 17 bp, Homo sapiens
gggcccattcagcctcg

SEQ ID NO: 2285574 - DNA, 16 bp, Homo sapiens
gggccccacggagagt

SEQ ID NO: 2285575 - DNA, 22 bp, Homo sapiens
gggcccccatccctccccttgc

SEQ ID NO: 2285576 - DNA, 11 bp, Homo sapiens
gggccccgcct

SEQ ID NO: 2285577 - DNA, 14 bp, Homo sapiens
gggccccgcctcaa

SEQ ID NO: 2285578 - DNA, 15 bp, Homo sapiens
gggcccgccccaggc

SEQ ID NO: 2285579 - DNA, 17 bp, Homo sapiens
gggcccgctcaacctct

SEQ ID NO: 2285580 - DNA, 12 bp, Homo sapiens
gggccctggagg

SEQ ID NO: 2285581 - DNA, 22 bp, Homo sapiens
gggccctggggtctctgagcag

SEQ ID NO: 2285582 - DNA, 23 bp, Homo sapiens
gggccctggggtctctgagcagt

SEQ ID NO: 2285583 - DNA, 14 bp, Homo sapiens
gggccgcagggcgc

SEQ ID NO: 2285584 - DNA, 15 bp, Homo sapiens
gggccgcagggcgct

SEQ ID NO: 2285585 - DNA, 11 bp, Homo sapiens
gggccgcctcc

SEQ ID NO: 2285586 - DNA, 20 bp, Homo sapiens
gggccgcctcctccagactc

SEQ ID NO: 2285587 - DNA, 22 bp, Homo sapiens
gggccgggctggcttctccctg

SEQ ID NO: 2285588 - DNA, 21 bp, Homo sapiens
gggcctcccgtccgtccgccc

SEQ ID NO: 2285589 - DNA, 22 bp, Homo sapiens
gggcctgtttggtgaggacctg

SEQ ID NO: 2285590 - DNA, 15 bp, Homo sapiens
gggcgagaagggcgc

SEQ ID NO: 2285591 - DNA, 19 bp, Homo sapiens
gggcgagaagggcgcagga

SEQ ID NO: 2285592 - DNA, 19 bp, Homo sapiens
gggcgcaggaaccgaggac

SEQ ID NO: 2285593 - DNA, 14 bp, Homo sapiens
gggcgcccggactg

SEQ ID NO: 2285594 - DNA, 19 bp, Homo sapiens
gggcgcctgcgctcctctg

SEQ ID NO: 2285595 - DNA, 16 bp, Homo sapiens
gggcgctccggcagag

SEQ ID NO: 2285596 - DNA, 18 bp, Homo sapiens
gggcgctccggcagaggc

SEQ ID NO: 2285597 - DNA, 20 bp, Homo sapiens
gggcggtgaggtgggggcag

SEQ ID NO: 2285598 - DNA, 13 bp, Homo sapiens
gggctaactggcc

SEQ ID NO: 2285599 - DNA, 15 bp, Homo sapiens
gggctaactggcccc

SEQ ID NO: 2285600 - DNA, 16 bp, Homo sapiens
gggctaactggcccca

SEQ ID NO: 2285601 - DNA, 18 bp, Homo sapiens
gggctaactggccccagg

SEQ ID NO: 2285602 - DNA, 21 bp, Homo sapiens
gggctaactggccccaggcgg

SEQ ID NO: 2285603 - DNA, 17 bp, Homo sapiens
gggctaagtccagctct

SEQ ID NO: 2285604 - DNA, 15 bp, Homo sapiens
gggctgagcccctcc

SEQ ID NO: 2285605 - DNA, 17 bp, Homo sapiens
ggttggccggctggccg

SEQ ID NO: 2285606 - DNA, 19 bp, Homo sapiens
ggtttccacacaggcccat

SEQ ID NO: 2285607 - DNA, 19 bp, Homo sapiens
ggttttagaaattctataa

SEQ ID NO: 2285608 - DNA, 22 bp, Homo sapiens
gtaaaaatagcaaaatattatc

SEQ ID NO: 2285609 - DNA, 17 bp, Homo sapiens
gtaaaacaggctgctta

SEQ ID NO: 2285610 - DNA, 19 bp, Homo sapiens
gtaaaagcagggcagcagg

SEQ ID NO: 2285611 - DNA, 16 bp, Homo sapiens
gtaaaattagagcaag

SEQ ID NO: 2285612 - DNA, 16 bp, Homo sapiens
gtaaaattcatagcat

SEQ ID NO: 2285613 - DNA, 15 bp, Homo sapiens
gtaaacatctcagag

SEQ ID NO: 2285614 - DNA, 23 bp, Homo sapiens
gtaaataatgattcaatgtgaat

SEQ ID NO: 2285615 - DNA, 15 bp, Homo sapiens
gtaaatgttatttct

SEQ ID NO: 2285616 - DNA, 17 bp, Homo sapiens
gtaaattataaatgttt

SEQ ID NO: 2285617 - DNA, 14 bp, Homo sapiens
gtaaatttaactgc

SEQ ID NO: 2285618 - DNA, 17 bp, Homo sapiens
gtaaattttataatgtc

SEQ ID NO: 2285619 - DNA, 16 bp, Homo sapiens
gtaacatgtctaaagt

SEQ ID NO: 2285620 - DNA, 13 bp, Homo sapiens
gtaacatttcaca

SEQ ID NO: 2285621 - DNA, 17 bp, Homo sapiens
gtaagttgaagggaaat

SEQ ID NO: 2285622 - DNA, 21 bp, Homo sapiens
gtaagttggctcacatcatgt

SEQ ID NO: 2285623 - DNA, 18 bp, Homo sapiens
gtaataactgttagaatt

SEQ ID NO: 2285624 - DNA, 13 bp, Homo sapiens
gtaatagtggctt

SEQ ID NO: 2285625 - DNA, 13 bp, Homo sapiens
gtaatattacatt

SEQ ID NO: 2285626 - DNA, 16 bp, Homo sapiens
gtaatattacatttca

SEQ ID NO: 2285627 - DNA, 13 bp, Homo sapiens
gtaatattttgta

SEQ ID NO: 2285628 - DNA, 23 bp, Homo sapiens
gtaatctctgattaaatttaata

SEQ ID NO: 2285629 - DNA, 19 bp, Homo sapiens
gtaatggggactctccagg

SEQ ID NO: 2285630 - DNA, 18 bp, Homo sapiens
gtaatgtatatctgtaat

SEQ ID NO: 2285631 - DNA, 13 bp, Homo sapiens
gtaatgtatctta

SEQ ID NO: 2285632 - DNA, 14 bp, Homo sapiens
gtaatgtatcttat

SEQ ID NO: 2285633 - DNA, 17 bp, Homo sapiens
gtaatgtatcttattta

SEQ ID NO: 2285634 - DNA, 20 bp, Homo sapiens
gtaattcccatctgctttat

SEQ ID NO: 2285635 - DNA, 18 bp, Homo sapiens
gtacaattttcatcccac

SEQ ID NO: 2285636 - DNA, 19 bp, Homo sapiens
gtacagaaacaactgccaa

SEQ ID NO: 2285637 - DNA, 23 bp, Homo sapiens
gtacagaaccagcactcccaggg

SEQ ID NO: 2285638 - DNA, 16 bp, Homo sapiens
gtacagacaacaaacc

SEQ ID NO: 2285639 - DNA, 20 bp, Homo sapiens
gtacataaagtaataactgt

SEQ ID NO: 2285640 - DNA, 15 bp, Homo sapiens
gtacatatggaaatc

SEQ ID NO: 2285641 - DNA, 22 bp, Homo sapiens
gtacatttgatttgatatacag

SEQ ID NO: 2285642 - DNA, 16 bp, Homo sapiens
gtaccagcccaggcaa

SEQ ID NO: 2285643 - DNA, 14 bp, Homo sapiens
gtaccatatgtagc

SEQ ID NO: 2285644 - DNA, 15 bp, Homo sapiens
gtaccatatgtagca

SEQ ID NO: 2285645 - DNA, 16 bp, Homo sapiens
gtaccatgttgcccag

SEQ ID NO: 2285646 - DNA, 17 bp, Homo sapiens
gtaccatgttgcccaga

SEQ ID NO: 2285647 - DNA, 23 bp, Homo sapiens
gtacccaaccaaagatgcttaaa

SEQ ID NO: 2285648 - DNA, 21 bp, Homo sapiens
gtaccctcgactggcaataat

SEQ ID NO: 2285649 - DNA, 21 bp, Homo sapiens
gtacctctggctgactaaatt

SEQ ID NO: 2285650 - DNA, 19 bp, Homo sapiens
gtactatggctgtattttt

SEQ ID NO: 2285651 - DNA, 20 bp, Homo sapiens
gtactgtatagacagtttgt

SEQ ID NO: 2285652 - DNA, 16 bp, Homo sapiens
gtacttacactgaaat

SEQ ID NO: 2285653 - DNA, 17 bp, Homo sapiens
gtacttcagttctcatc

SEQ ID NO: 2285654 - DNA, 14 bp, Homo sapiens
gtacttttccattt

SEQ ID NO: 2285655 - DNA, 11 bp, Homo sapiens
gtagaaaaaaa

SEQ ID NO: 2285656 - DNA, 14 bp, Homo sapiens
gtagaactgttcat

SEQ ID NO: 2285657 - DNA, 11 bp, Homo sapiens
gtagacaaaac

SEQ ID NO: 2285658 - DNA, 13 bp, Homo sapiens
gtagacaaaactt

SEQ ID NO: 2285659 - DNA, 16 bp, Homo sapiens
gtagagcacatttagt

SEQ ID NO: 2285660 - DNA, 20 bp, Homo sapiens
gtagatattatgtatagaaa

SEQ ID NO: 2285661 - DNA, 22 bp, Homo sapiens
gtagatgtattttcaataaaga

SEQ ID NO: 2285662 - DNA, 21 bp, Homo sapiens
gtagattgtgtaaattcctgt

SEQ ID NO: 2285663 - DNA, 22 bp, Homo sapiens
gtagcaggatgaggaacctcaa

SEQ ID NO: 2285664 - DNA, 17 bp, Homo sapiens
gtagcaggttctaggct

SEQ ID NO: 2285665 - DNA, 23 bp, Homo sapiens
gtagctgccacttgaacaaaatc

SEQ ID NO: 2285666 - DNA, 14 bp, Homo sapiens
gtagctgtggggag

SEQ ID NO: 2285667 - DNA, 22 bp, Homo sapiens
gtaggagtggctgaccaggccc

SEQ ID NO: 2285668 - DNA, 14 bp, Homo sapiens
gtaggctaaaaaca

SEQ ID NO: 2285669 - DNA, 16 bp, Homo sapiens
gtagggccagggctct

SEQ ID NO: 2285670 - DNA, 21 bp, Homo sapiens
gtagggtttagccgggcccca

SEQ ID NO: 2285671 - DNA, 18 bp, Homo sapiens
gtaggtatactatgtaag

SEQ ID NO: 2285672 - DNA, 14 bp, Homo sapiens
gtagtaattgttac

SEQ ID NO: 2285673 - DNA, 23 bp, Homo sapiens
gtagtagttgatgaccaatctct

SEQ ID NO: 2285674 - DNA, 18 bp, Homo sapiens
gtagtgttgggtggagga

SEQ ID NO: 2285675 - DNA, 20 bp, Homo sapiens
gtagttgatgaccaatctct

SEQ ID NO: 2285676 - DNA, 24 bp, Homo sapiens
gtagttgatgaccaatctctgtga

SEQ ID NO: 2285677 - DNA, 20 bp, Homo sapiens
gtataacaagccaaacattc

SEQ ID NO: 2285678 - DNA, 21 bp, Homo sapiens
gtataacaagccaaacattct

SEQ ID NO: 2285679 - DNA, 23 bp, Homo sapiens
gtatagaaaataaaataaattat

SEQ ID NO: 2285680 - DNA, 17 bp, Homo sapiens
gtatagacagtttgtaa

SEQ ID NO: 2285681 - DNA, 23 bp, Homo sapiens
gtatagacagtttgtaaatgtta

SEQ ID NO: 2285682 - DNA, 16 bp, Homo sapiens
gtatagttcacttact

SEQ ID NO: 2285683 - DNA, 13 bp, Homo sapiens
gtatatatgtaca

SEQ ID NO: 2285684 - DNA, 20 bp, Homo sapiens
gtatatcagctctaaagcag

SEQ ID NO: 2285685 - DNA, 17 bp, Homo sapiens
gtatatgtcaaaaatat

SEQ ID NO: 2285686 - DNA, 16 bp, Homo sapiens
gtatattattgctata

SEQ ID NO: 2285687 - DNA, 18 bp, Homo sapiens
gtatatttgttgggaaag

SEQ ID NO: 2285688 - DNA, 15 bp, Homo sapiens
gtatctaaaaaataa

SEQ ID NO: 2285689 - DNA, 14 bp, Homo sapiens
gtatctattttcaa

SEQ ID NO: 2285690 - DNA, 18 bp, Homo sapiens
gtatctgttactccaaaa

SEQ ID NO: 2285691 - DNA, 13 bp, Homo sapiens
gtatcttatttat

SEQ ID NO: 2285692 - DNA, 14 bp, Homo sapiens
gtatgaagacactg

SEQ ID NO: 2285693 - DNA, 17 bp, Homo sapiens
gtattattgctgttgct

SEQ ID NO: 2285694 - DNA, 21 bp, Homo sapiens
gtattcaggaccccatctgct

SEQ ID NO: 2285695 - DNA, 20 bp, Homo sapiens
gtattctgtagccaacttaa

SEQ ID NO: 2285696 - DNA, 18 bp, Homo sapiens
gtattctgtggattctat

SEQ ID NO: 2285697 - DNA, 23 bp, Homo sapiens
gtattgagatactttttcttttg

SEQ ID NO: 2285698 - DNA, 17 bp, Homo sapiens
gtatttaaagaacactg

SEQ ID NO: 2285699 - DNA, 16 bp, Homo sapiens
gtatttatattagagt

SEQ ID NO: 2285700 - DNA, 15 bp, Homo sapiens
gtatttccaacaaac

SEQ ID NO: 2285701 - DNA, 15 bp, Homo sapiens
gtattttaataaaga

SEQ ID NO: 2285702 - DNA, 22 bp, Homo sapiens
gtattttatctgtgttgtctct

SEQ ID NO: 2285703 - DNA, 19 bp, Homo sapiens
gtattttcgtgcatttgtg

SEQ ID NO: 2285704 - DNA, 21 bp, Homo sapiens
gtattttcttcccatttgtaa

SEQ ID NO: 2285705 - DNA, 22 bp, Homo sapiens
gtattttcttttatatctgtaa

SEQ ID NO: 2285706 - DNA, 18 bp, Homo sapiens
gtatttttagagattaat

SEQ ID NO: 2285707 - DNA, 11 bp, Homo sapiens
gtcaaaaatat

SEQ ID NO: 2285708 - DNA, 15 bp, Homo sapiens
gtcaaaaatattttt

SEQ ID NO: 2285709 - DNA, 20 bp, Homo sapiens
gtcaaaaatatttttatgtg

SEQ ID NO: 2285710 - DNA, 19 bp, Homo sapiens
gtcaaagtggtgagaggca

SEQ ID NO: 2285711 - DNA, 21 bp, Homo sapiens
gtcaataattatttgtctcag

SEQ ID NO: 2285712 - DNA, 20 bp, Homo sapiens
gtcaatgaaatatttgctta

SEQ ID NO: 2285713 - DNA, 13 bp, Homo sapiens
gtcaattacagga

SEQ ID NO: 2285714 - DNA, 15 bp, Homo sapiens
gtcaattacaggaag

SEQ ID NO: 2285715 - DNA, 22 bp, Homo sapiens
gtcaattacaggaagtactgga

SEQ ID NO: 2285716 - DNA, 12 bp, Homo sapiens
gtcacagacccc

SEQ ID NO: 2285717 - DNA, 17 bp, Homo sapiens
gtcacagacccctgggg

SEQ ID NO: 2285718 - DNA, 20 bp, Homo sapiens
gtcacagacccctgggggag

SEQ ID NO: 2285719 - DNA, 22 bp, Homo sapiens
gtcacccccacccccgggtgcc

SEQ ID NO: 2285720 - DNA, 13 bp, Homo sapiens
gtcacctcactca

SEQ ID NO: 2285721 - DNA, 19 bp, Homo sapiens
gtcacctcactcagcacca

SEQ ID NO: 2285722 - DNA, 16 bp, Homo sapiens
gtcagaaggagacaga

SEQ ID NO: 2285723 - DNA, 22 bp, Homo sapiens
gtcagcaccgtggtgtgaggcc

SEQ ID NO: 2285724 - DNA, 19 bp, Homo sapiens
gtcagcgattcctgccaag

SEQ ID NO: 2285725 - DNA, 20 bp, Homo sapiens
gtcagctcttgtcaaaaggt

SEQ ID NO: 2285726 - DNA, 15 bp, Homo sapiens
gtcagcttgaatgtc

SEQ ID NO: 2285727 - DNA, 15 bp, Homo sapiens
gtcagggagccctgg

SEQ ID NO: 2285728 - DNA, 15 bp, Homo sapiens
gtcagtgtgactgat

SEQ ID NO: 2285729 - DNA, 16 bp, Homo sapiens
gtcagttgggccccca

SEQ ID NO: 2285730 - DNA, 17 bp, Homo sapiens
gtcagttttcacagagg

SEQ ID NO: 2285731 - DNA, 19 bp, Homo sapiens
gtcagttttcacagaggcg

SEQ ID NO: 2285732 - DNA, 13 bp, Homo sapiens
gtcataaaatgct

SEQ ID NO: 2285733 - DNA, 18 bp, Homo sapiens
gtcataatctctttccat

SEQ ID NO: 2285734 - DNA, 21 bp, Homo sapiens
gtcataatgtgttgtgaaaat

SEQ ID NO: 2285735 - DNA, 21 bp, Homo sapiens
gtcatacgtctttagatgcta

SEQ ID NO: 2285736 - DNA, 22 bp, Homo sapiens
gtcatcccggggccatggaagc

SEQ ID NO: 2285737 - DNA, 19 bp, Homo sapiens
gtcatctcaaacactgctt

SEQ ID NO: 2285738 - DNA, 16 bp, Homo sapiens
gtcattgctgacagag

SEQ ID NO: 2285739 - DNA, 17 bp, Homo sapiens
gtcatttgtagatatat

SEQ ID NO: 2285740 - DNA, 19 bp, Homo sapiens
gtcatttgtagatatatat

SEQ ID NO: 2285741 - DNA, 19 bp, Homo sapiens
gtcctggcagggcaggcag

SEQ ID NO: 2285742 - DNA, 18 bp, Homo sapiens
gtcctggtcagttttcac

SEQ ID NO: 2285743 - DNA, 12 bp, Homo sapiens
gtcctttggaca

SEQ ID NO: 2285744 - DNA, 20 bp, Homo sapiens
gtcgcccctcctcgggcgcc

SEQ ID NO: 2285745 - DNA, 15 bp, Homo sapiens
gtcgcgatgatgggc

SEQ ID NO: 2285746 - DNA, 12 bp, Homo sapiens
gtcggctgggca

SEQ ID NO: 2285747 - DNA, 18 bp, Homo sapiens
gtcggctgggcagggccg

SEQ ID NO: 2285748 - DNA, 18 bp, Homo sapiens
gtcgggggaggagcaccc

SEQ ID NO: 2285749 - DNA, 21 bp, Homo sapiens
gtcgggggaggagcaccccca

SEQ ID NO: 2285750 - DNA, 21 bp, Homo sapiens
gtctaaacacacttagaatac

SEQ ID NO: 2285751 - DNA, 23 bp, Homo sapiens
gtctaaagttagggcatttttct

SEQ ID NO: 2285752 - DNA, 23 bp, Homo sapiens
gtctaacacaccactttctgctt

SEQ ID NO: 2285753 - DNA, 23 bp, Homo sapiens
gtctacactcacaatcatcttct

SEQ ID NO: 2285754 - DNA, 16 bp, Homo sapiens
gtctacactgcaatca

SEQ ID NO: 2285755 - DNA, 19 bp, Homo sapiens
gtctacactgcaatcatat

SEQ ID NO: 2285756 - DNA, 14 bp, Homo sapiens
gtctagtttcctgg

SEQ ID NO: 2285757 - DNA, 15 bp, Homo sapiens
gtctcaaataataat

SEQ ID NO: 2285758 - DNA, 21 bp, Homo sapiens
gtctcagaaggctctatctgc

SEQ ID NO: 2285759 - DNA, 18 bp, Homo sapiens
gtctcagccgagcccagg

SEQ ID NO: 2285760 - DNA, 15 bp, Homo sapiens
gtctccgctcccgca

SEQ ID NO: 2285761 - DNA, 22 bp, Homo sapiens
gtctctactaaaaatatgaaat

SEQ ID NO: 2285762 - DNA, 15 bp, Homo sapiens
gtctctgagcagtgg

SEQ ID NO: 2285763 - DNA, 16 bp, Homo sapiens
gtctcttccagcccag

SEQ ID NO: 2285764 - DNA, 13 bp, Homo sapiens
gtctgagctgctg

SEQ ID NO: 2285765 - DNA, 23 bp, Homo sapiens
gtctgatagagtttaacagatat

SEQ ID NO: 2285766 - DNA, 13 bp, Homo sapiens
gtctgattctatg

SEQ ID NO: 2285767 - DNA, 22 bp, Homo sapiens
gtctgattctatgcctgtattt

SEQ ID NO: 2285768 - DNA, 11 bp, Homo sapiens
gtctgcccctt

SEQ ID NO: 2285769 - DNA, 14 bp, Homo sapiens
gtctgcttaccaaa

SEQ ID NO: 2285770 - DNA, 22 bp, Homo sapiens
gtctggagaccaggactctgcc

SEQ ID NO: 2285771 - DNA, 23 bp, Homo sapiens
gtctggagaccaggactctgcct

SEQ ID NO: 2285772 - DNA, 13 bp, Homo sapiens
gtctggtgttcca

SEQ ID NO: 2285773 - DNA, 23 bp, Homo sapiens
gtctggttttgtcccttccagga

SEQ ID NO: 2285774 - DNA, 12 bp, Homo sapiens
gtctgtcctggt

SEQ ID NO: 2285775 - DNA, 21 bp, Homo sapiens
gtctgtgcccgaggttcctgt

SEQ ID NO: 2285776 - DNA, 18 bp, Homo sapiens
gtcttaaagaatttgaaa

SEQ ID NO: 2285777 - DNA, 16 bp, Homo sapiens
gtcttaggtttccacg

SEQ ID NO: 2285778 - DNA, 23 bp, Homo sapiens
gtcttcaaccctgccctgcacct

SEQ ID NO: 2285779 - DNA, 18 bp, Homo sapiens
gtcttgaactcttggcct

SEQ ID NO: 2285780 - DNA, 19 bp, Homo sapiens
gtcttgtaatattttgtat

SEQ ID NO: 2285781 - DNA, 12 bp, Homo sapiens
gtcttgtatttt

SEQ ID NO: 2285782 - DNA, 13 bp, Homo sapiens
gtcttgtattttc

SEQ ID NO: 2285783 - DNA, 16 bp, Homo sapiens
gtctttgtacagacaa

SEQ ID NO: 2285784 - DNA, 21 bp, Homo sapiens
gtgaaaaatctagtatttgta

SEQ ID NO: 2285785 - DNA, 19 bp, Homo sapiens
gtgaacttggctttcctgt

SEQ ID NO: 2285786 - DNA, 17 bp, Homo sapiens
gtgaagcatccaggcac

SEQ ID NO: 2285787 - DNA, 20 bp, Homo sapiens
gtgaccaggctcacaactgt

SEQ ID NO: 2285788 - DNA, 13 bp, Homo sapiens
gtgacctgacacc

SEQ ID NO: 2285789 - DNA, 17 bp, Homo sapiens
gtgacgtgagtggggag

SEQ ID NO: 2285790 - DNA, 20 bp, Homo sapiens
gtgagccacagcactcggcc

SEQ ID NO: 2285791 - DNA, 16 bp, Homo sapiens
gtgagctaccaggaag

SEQ ID NO: 2285792 - DNA, 20 bp, Homo sapiens
gtgaggcccccggaggcgcc

SEQ ID NO: 2285793 - DNA, 21 bp, Homo sapiens
gtgaggcccccggaggcgccc

SEQ ID NO: 2285794 - DNA, 24 bp, Homo sapiens
gtgaggtcatcccggggccatgga

SEQ ID NO: 2285795 - DNA, 20 bp, Homo sapiens
gtgagtcctggcatgggaat

SEQ ID NO: 2285796 - DNA, 15 bp, Homo sapiens
gtgagtgtggcttag

SEQ ID NO: 2285797 - DNA, 17 bp, Homo sapiens
gtgatacactgtatcta

SEQ ID NO: 2285798 - DNA, 13 bp, Homo sapiens
gtgatcccagctc

SEQ ID NO: 2285799 - DNA, 22 bp, Homo sapiens
gtgatcctcccgccccagcctc

SEQ ID NO: 2285800 - DNA, 13 bp, Homo sapiens
gtgatctgtcttg

SEQ ID NO: 2285801 - DNA, 19 bp, Homo sapiens
gtgatctgtcttgtaatat

SEQ ID NO: 2285802 - DNA, 22 bp, Homo sapiens
gtgatcttaattactttcagaa

SEQ ID NO: 2285803 - DNA, 17 bp, Homo sapiens
gtgattccccggagctg

SEQ ID NO: 2285804 - DNA, 17 bp, Homo sapiens
gtgatttttttatataa

SEQ ID NO: 2285805 - DNA, 18 bp, Homo sapiens
gtgcaatatgtaacatgt

SEQ ID NO: 2285806 - DNA, 13 bp, Homo sapiens
gtgcacacctgta

SEQ ID NO: 2285807 - DNA, 19 bp, Homo sapiens
gtgcacggggccagcatcc

SEQ ID NO: 2285808 - DNA, 21 bp, Homo sapiens
gtgcagacactcaagagccct

SEQ ID NO: 2285809 - DNA, 15 bp, Homo sapiens
gtgcaggagcaaggc

SEQ ID NO: 2285810 - DNA, 19 bp, Homo sapiens
gtgcaggcgcgcaccgccc

SEQ ID NO: 2285811 - DNA, 15 bp, Homo sapiens
gtgcagttgctcatt

SEQ ID NO: 2285812 - DNA, 23 bp, Homo sapiens
gtgccaaaaacaacaacaaaatg

SEQ ID NO: 2285813 - DNA, 21 bp, Homo sapiens
gtgcccaggacggtctgtgcc

SEQ ID NO: 2285814 - DNA, 23 bp, Homo sapiens
gtgcccaggacggtctgtgcccg

SEQ ID NO: 2285815 - DNA, 12 bp, Homo sapiens
gtgcccccagcg

SEQ ID NO: 2285816 - DNA, 18 bp, Homo sapiens
gtgcccccagcgtggggc

SEQ ID NO: 2285817 - DNA, 18 bp, Homo sapiens
gtgccccgaccccacctg

SEQ ID NO: 2285818 - DNA, 22 bp, Homo sapiens
gtgccccgaccccacctgaggc

SEQ ID NO: 2285819 - DNA, 23 bp, Homo sapiens
gtgccccgaccccacctgaggca

SEQ ID NO: 2285820 - DNA, 13 bp, Homo sapiens
gtgccctgcattc

SEQ ID NO: 2285821 - DNA, 23 bp, Homo sapiens
gtgcctgcctgggagacttcctt

SEQ ID NO: 2285822 - DNA, 22 bp, Homo sapiens
gtgcctgtgaccggggtcctga

SEQ ID NO: 2285823 - DNA, 21 bp, Homo sapiens
gtgccttatggaacactctga

SEQ ID NO: 2285824 - DNA, 23 bp, Homo sapiens
gtgccttatggaacactctgaga

SEQ ID NO: 2285825 - DNA, 14 bp, Homo sapiens
gtgccttccccgtg

SEQ ID NO: 2285826 - DNA, 17 bp, Homo sapiens
gtgcgacttcacaaaat

SEQ ID NO: 2285827 - DNA, 20 bp, Homo sapiens
gtgcgcagccgcgctctgcc

SEQ ID NO: 2285828 - DNA, 11 bp, Homo sapiens
gtgcggcccgt

SEQ ID NO: 2285829 - DNA, 19 bp, Homo sapiens
gtgcggcccgtgcgcagcc

SEQ ID NO: 2285830 - DNA, 21 bp, Homo sapiens
gtgcggcccgtgcgcagccgc

SEQ ID NO: 2285831 - DNA, 22 bp, Homo sapiens
gtgcgtgaccggcccgccacct

SEQ ID NO: 2285832 - DNA, 16 bp, Homo sapiens
gtgctactcatcccta

SEQ ID NO: 2285833 - DNA, 15 bp, Homo sapiens
gtgctcccgagagat

SEQ ID NO: 2285834 - DNA, 18 bp, Homo sapiens
gtgctcttatccccagct

SEQ ID NO: 2285835 - DNA, 20 bp, Homo sapiens
gtgctcttatccccagctgt

SEQ ID NO: 2285836 - DNA, 13 bp, Homo sapiens
gtgctttcatgtt

SEQ ID NO: 2285837 - DNA, 15 bp, Homo sapiens
gtgctttgcccttga

SEQ ID NO: 2285838 - DNA, 20 bp, Homo sapiens
gtggaagacagagatggcag

SEQ ID NO: 2285839 - DNA, 17 bp, Homo sapiens
gtggaagggcaggagct

SEQ ID NO: 2285840 - DNA, 19 bp, Homo sapiens
gtggacagcagctggactg

SEQ ID NO: 2285841 - DNA, 19 bp, Homo sapiens
gtggactgggaagcattac

SEQ ID NO: 2285842 - DNA, 13 bp, Homo sapiens
gtggagctgcttc

SEQ ID NO: 2285843 - DNA, 13 bp, Homo sapiens
gtggattctatat

SEQ ID NO: 2285844 - DNA, 20 bp, Homo sapiens
taaaatacataaaagaatgt

SEQ ID NO: 2285845 - DNA, 19 bp, Homo sapiens
taaaatactcaccaaaata

SEQ ID NO: 2285846 - DNA, 18 bp, Homo sapiens
taaaataggtgcattgtc

SEQ ID NO: 2285847 - DNA, 20 bp, Homo sapiens
taaaatagtttaaaaatatt

SEQ ID NO: 2285848 - DNA, 22 bp, Homo sapiens
taaaatagtttaaaaatattcc

SEQ ID NO: 2285849 - DNA, 17 bp, Homo sapiens
taaaatagttttctaaa

SEQ ID NO: 2285850 - DNA, 15 bp, Homo sapiens
taaaatatacaaaca

SEQ ID NO: 2285851 - DNA, 22 bp, Homo sapiens
taaaatattgtgtaagaatcac

SEQ ID NO: 2285852 - DNA, 23 bp, Homo sapiens
taaaatattgtgtaagaatcact

SEQ ID NO: 2285853 - DNA, 18 bp, Homo sapiens
taaaatctttccatctca

SEQ ID NO: 2285854 - DNA, 15 bp, Homo sapiens
taaaatgctatttta

SEQ ID NO: 2285855 - DNA, 20 bp, Homo sapiens
taaaatgctattttaaaatt

SEQ ID NO: 2285856 - DNA, 21 bp, Homo sapiens
taaaatggacctatctgtaag

SEQ ID NO: 2285857 - DNA, 23 bp, Homo sapiens
taaaatggacctatctgtaagag

SEQ ID NO: 2285858 - DNA, 13 bp, Homo sapiens
taaaatgtttaca

SEQ ID NO: 2285859 - DNA, 12 bp, Homo sapiens
taaaattagtga

SEQ ID NO: 2285860 - DNA, 20 bp, Homo sapiens
taaaattagtgagatttgta

SEQ ID NO: 2285861 - DNA, 20 bp, Homo sapiens
taaaattcatggaactttca

SEQ ID NO: 2285862 - DNA, 23 bp, Homo sapiens
taaaattgtgttcttaaaatatt

SEQ ID NO: 2285863 - DNA, 14 bp, Homo sapiens
taaaatttaaatca

SEQ ID NO: 2285864 - DNA, 15 bp, Homo sapiens
taaaccaatcatctt

SEQ ID NO: 2285865 - DNA, 14 bp, Homo sapiens
taaacccaaataaa

SEQ ID NO: 2285866 - DNA, 17 bp, Homo sapiens
taaacccaaataaatgt

SEQ ID NO: 2285867 - DNA, 16 bp, Homo sapiens
taaacctgtgctttca

SEQ ID NO: 2285868 - DNA, 19 bp, Homo sapiens
taaacctgtgctttcatgt

SEQ ID NO: 2285869 - DNA, 20 bp, Homo sapiens
taaacgatatatgtaaatat

SEQ ID NO: 2285870 - DNA, 21 bp, Homo sapiens
taaacgatatatgtaaatata

SEQ ID NO: 2285871 - DNA, 20 bp, Homo sapiens
taaactgatgtatagcttta

SEQ ID NO: 2285872 - DNA, 12 bp, Homo sapiens
taaactgttttc

SEQ ID NO: 2285873 - DNA, 15 bp, Homo sapiens
taaactgttttcatg

SEQ ID NO: 2285874 - DNA, 17 bp, Homo sapiens
taaactgttttcatgtg

SEQ ID NO: 2285875 - DNA, 13 bp, Homo sapiens
taaacttgtgtat

SEQ ID NO: 2285876 - DNA, 18 bp, Homo sapiens
taaagacatttaaaatag

SEQ ID NO: 2285877 - DNA, 14 bp, Homo sapiens
taaagagacaaata

SEQ ID NO: 2285878 - DNA, 17 bp, Homo sapiens
taaagagctaggaaaga

SEQ ID NO: 2285879 - DNA, 18 bp, Homo sapiens
taaagagctaggaaagag

SEQ ID NO: 2285880 - DNA, 19 bp, Homo sapiens
taaagagctaggaaagagt

SEQ ID NO: 2285881 - DNA, 13 bp, Homo sapiens
taaagcaaaaaac

SEQ ID NO: 2285882 - DNA, 16 bp, Homo sapiens
taaaggaaagttctat

SEQ ID NO: 2285883 - DNA, 18 bp, Homo sapiens
taaaggggactagacagt

SEQ ID NO: 2285884 - DNA, 13 bp, Homo sapiens
taaagtgaccagg

SEQ ID NO: 2285885 - DNA, 23 bp, Homo sapiens
taaagtttcattagtcatatttt

SEQ ID NO: 2285886 - DNA, 16 bp, Homo sapiens
taaataaaaataattg

SEQ ID NO: 2285887 - DNA, 23 bp, Homo sapiens
taaataaaagaggtccattaata

SEQ ID NO: 2285888 - DNA, 16 bp, Homo sapiens
taaataaataaaaata

SEQ ID NO: 2285889 - DNA, 16 bp, Homo sapiens
taaataagcgtttaat

SEQ ID NO: 2285890 - DNA, 13 bp, Homo sapiens
taaataatctcat

SEQ ID NO: 2285891 - DNA, 14 bp, Homo sapiens
taaataatctcatc

SEQ ID NO: 2285892 - DNA, 15 bp, Homo sapiens
taaataatgattcaa

SEQ ID NO: 2285893 - DNA, 17 bp, Homo sapiens
taaatagcatctgctct

SEQ ID NO: 2285894 - DNA, 17 bp, Homo sapiens
taaatagtaaataatga

SEQ ID NO: 2285895 - DNA, 17 bp, Homo sapiens
taaatataaaatacata

SEQ ID NO: 2285896 - DNA, 23 bp, Homo sapiens
taaatatacagcatgagattgta

SEQ ID NO: 2285897 - DNA, 14 bp, Homo sapiens
taaatatgaaagcc

SEQ ID NO: 2285898 - DNA, 10 bp, Homo sapiens
taaatattta

SEQ ID NO: 2285899 - DNA, 15 bp, Homo sapiens
taaatatttatgcag

SEQ ID NO: 2285900 - DNA, 12 bp, Homo sapiens
taaatcatttca

SEQ ID NO: 2285901 - DNA, 17 bp, Homo sapiens
taaatccattttctaaa

SEQ ID NO: 2285902 - DNA, 20 bp, Homo sapiens
taaatccattttctaaactg

SEQ ID NO: 2285903 - DNA, 13 bp, Homo sapiens
taaatctaaatat

SEQ ID NO: 2285904 - DNA, 14 bp, Homo sapiens
taaatctaaatata

SEQ ID NO: 2285905 - DNA, 14 bp, Homo sapiens
taaatctgtctgat

SEQ ID NO: 2285906 - DNA, 21 bp, Homo sapiens
taaatctgtctgattctatgc

SEQ ID NO: 2285907 - DNA, 13 bp, Homo sapiens
taaatgagcattt

SEQ ID NO: 2285908 - DNA, 15 bp, Homo sapiens
taaatgagcattttt

SEQ ID NO: 2285909 - DNA, 16 bp, Homo sapiens
taaatgcaaacactgt

SEQ ID NO: 2285910 - DNA, 20 bp, Homo sapiens
taaatgcaaacactgtgtat

SEQ ID NO: 2285911 - DNA, 13 bp, Homo sapiens
taaatgctttaaa

SEQ ID NO: 2285912 - DNA, 14 bp, Homo sapiens
taaatgtgtaaatg

SEQ ID NO: 2285913 - DNA, 15 bp, Homo sapiens
taaatgttatttctg

SEQ ID NO: 2285914 - DNA, 17 bp, Homo sapiens
taaatgtttcatgaaga

SEQ ID NO: 2285915 - DNA, 12 bp, Homo sapiens
taaatgtttctt

SEQ ID NO: 2285916 - DNA, 15 bp, Homo sapiens
taaattataaatgtt

SEQ ID NO: 2285917 - DNA, 15 bp, Homo sapiens
taaattgaagaaagt

SEQ ID NO: 2285918 - DNA, 21 bp, Homo sapiens
taaattggcctggtatggctg

SEQ ID NO: 2285919 - DNA, 16 bp, Homo sapiens
taaattgtagaacata

SEQ ID NO: 2285920 - DNA, 16 bp, Homo sapiens
taaatttaactgcata

SEQ ID NO: 2285921 - DNA, 20 bp, Homo sapiens
taaatttaatatactgcata

SEQ ID NO: 2285922 - DNA, 23 bp, Homo sapiens
taaattttaatgtaaaattcata

SEQ ID NO: 2285923 - DNA, 19 bp, Homo sapiens
taacaaactgaaaaatcta

SEQ ID NO: 2285924 - DNA, 19 bp, Homo sapiens
taacaacaacttaatgtgc

SEQ ID NO: 2285925 - DNA, 22 bp, Homo sapiens
taacaactgagatgttaaaata

SEQ ID NO: 2285926 - DNA, 16 bp, Homo sapiens
taacagacatgtatac

SEQ ID NO: 2285927 - DNA, 13 bp, Homo sapiens
taacagatattta

SEQ ID NO: 2285928 - DNA, 22 bp, Homo sapiens
taacagctaatctttaatataa

SEQ ID NO: 2285929 - DNA, 18 bp, Homo sapiens
taacataaacttgtactt

SEQ ID NO: 2285930 - DNA, 19 bp, Homo sapiens
taacataaagaaacacttt

SEQ ID NO: 2285931 - DNA, 15 bp, Homo sapiens
taacatagcacagta

SEQ ID NO: 2285932 - DNA, 15 bp, Homo sapiens
taacatattcttgct

SEQ ID NO: 2285933 - DNA, 17 bp, Homo sapiens
taacatattcttgcttt

SEQ ID NO: 2285934 - DNA, 14 bp, Homo sapiens
taacatctgaaaag

SEQ ID NO: 2285935 - DNA, 18 bp, Homo sapiens
taacatctgaaaagaaat

SEQ ID NO: 2285936 - DNA, 16 bp, Homo sapiens
taacatgtctaaagtt

SEQ ID NO: 2285937 - DNA, 19 bp, Homo sapiens
taacatttcacagtattta

SEQ ID NO: 2285938 - DNA, 18 bp, Homo sapiens
taacattttgtttccaaa

SEQ ID NO: 2285939 - DNA, 13 bp, Homo sapiens
taaccaacatttt

SEQ ID NO: 2285940 - DNA, 20 bp, Homo sapiens
taaccacgattccaacccag

SEQ ID NO: 2285941 - DNA, 20 bp, Homo sapiens
taaccatatgattgaaaaga

SEQ ID NO: 2285942 - DNA, 19 bp, Homo sapiens
taacctgggttgttgcaga

SEQ ID NO: 2285943 - DNA, 14 bp, Homo sapiens
taactaaaggggac

SEQ ID NO: 2285944 - DNA, 16 bp, Homo sapiens
taactactaagaataa

SEQ ID NO: 2285945 - DNA, 17 bp, Homo sapiens
taactagatctcctgta

SEQ ID NO: 2285946 - DNA, 21 bp, Homo sapiens
taactcactttaaatatgaaa

SEQ ID NO: 2285947 - DNA, 14 bp, Homo sapiens
taactgcatataga

SEQ ID NO: 2285948 - DNA, 14 bp, Homo sapiens
taactggccccagg

SEQ ID NO: 2285949 - DNA, 15 bp, Homo sapiens
taactggccccaggc

SEQ ID NO: 2285950 - DNA, 18 bp, Homo sapiens
taacttatctccagccaa

SEQ ID NO: 2285951 - DNA, 14 bp, Homo sapiens
taacttgatcttgt

SEQ ID NO: 2285952 - DNA, 16 bp, Homo sapiens
taagaaatgagaaatt

SEQ ID NO: 2285953 - DNA, 17 bp, Homo sapiens
taagaataaataaagaa

SEQ ID NO: 2285954 - DNA, 20 bp, Homo sapiens
taagacaaaatttaattgtg

SEQ ID NO: 2285955 - DNA, 22 bp, Homo sapiens
taagacgacttatatatttgaa

SEQ ID NO: 2285956 - DNA, 23 bp, Homo sapiens
taagacgacttatatatttgaaa

SEQ ID NO: 2285957 - DNA, 14 bp, Homo sapiens
taagagaaatggta

SEQ ID NO: 2285958 - DNA, 22 bp, Homo sapiens
taagagaattctaagattgtac

SEQ ID NO: 2285959 - DNA, 19 bp, Homo sapiens
taagagacaaagtttggaa

SEQ ID NO: 2285960 - DNA, 17 bp, Homo sapiens
taagcagttgcaatgat

SEQ ID NO: 2285961 - DNA, 20 bp, Homo sapiens
taagcattttactgtctgta

SEQ ID NO: 2285962 - DNA, 17 bp, Homo sapiens
taagcgttaagggcaga

SEQ ID NO: 2285963 - DNA, 16 bp, Homo sapiens
tactccatagaaacta

SEQ ID NO: 2285964 - DNA, 22 bp, Homo sapiens
tactcttcagaatatggacaaa

SEQ ID NO: 2285965 - DNA, 14 bp, Homo sapiens
tactgaattgttat

SEQ ID NO: 2285966 - DNA, 16 bp, Homo sapiens
tactgccaacctcgct

SEQ ID NO: 2285967 - DNA, 22 bp, Homo sapiens
tactgccgctgcccccaccctg

SEQ ID NO: 2285968 - DNA, 14 bp, Homo sapiens
tactggttatagtt

SEQ ID NO: 2285969 - DNA, 17 bp, Homo sapiens
tactgtagcaatatatt

SEQ ID NO: 2285970 - DNA, 16 bp, Homo sapiens
tactgtatatgtcaaa

SEQ ID NO: 2285971 - DNA, 13 bp, Homo sapiens
tactgtgtactgt

SEQ ID NO: 2285972 - DNA, 15 bp, Homo sapiens
tactgtttgtaatat

SEQ ID NO: 2285973 - DNA, 20 bp, Homo sapiens
tactgtttgtaatatacagt

SEQ ID NO: 2285974 - DNA, 22 bp, Homo sapiens
tactgtttgtaatatacagttt

SEQ ID NO: 2285975 - DNA, 15 bp, Homo sapiens
tacttcactttcatc

SEQ ID NO: 2285976 - DNA, 16 bp, Homo sapiens
tacttcagttctcatc

SEQ ID NO: 2285977 - DNA, 17 bp, Homo sapiens
tacttcctggattttct

SEQ ID NO: 2285978 - DNA, 17 bp, Homo sapiens
tacttccttataaaaat

SEQ ID NO: 2285979 - DNA, 19 bp, Homo sapiens
tacttccttataaaaattc

SEQ ID NO: 2285980 - DNA, 12 bp, Homo sapiens
tacttgagaata

SEQ ID NO: 2285981 - DNA, 18 bp, Homo sapiens
tacttgagaataaatgag

SEQ ID NO: 2285982 - DNA, 19 bp, Homo sapiens
tacttgatataattactta

SEQ ID NO: 2285983 - DNA, 19 bp, Homo sapiens
tacttgctccttgaataag

SEQ ID NO: 2285984 - DNA, 14 bp, Homo sapiens
tactttctcacatg

SEQ ID NO: 2285985 - DNA, 15 bp, Homo sapiens
tactttgaacttcga

SEQ ID NO: 2285986 - DNA, 20 bp, Homo sapiens
tactttgtagatgtattttc

SEQ ID NO: 2285987 - DNA, 23 bp, Homo sapiens
tagaaaaaaaaataacacttaac

SEQ ID NO: 2285988 - DNA, 19 bp, Homo sapiens
tagaaaaatgctgttcaga

SEQ ID NO: 2285989 - DNA, 15 bp, Homo sapiens
tagaaaataaaataa

SEQ ID NO: 2285990 - DNA, 18 bp, Homo sapiens
tagaaaataaaataaatt

SEQ ID NO: 2285991 - DNA, 23 bp, Homo sapiens
tagaaactaaactaaaatagttt

SEQ ID NO: 2285992 - DNA, 14 bp, Homo sapiens
tagaaattctataa

SEQ ID NO: 2285993 - DNA, 20 bp, Homo sapiens
tagaaattctataagagaca

SEQ ID NO: 2285994 - DNA, 18 bp, Homo sapiens
tagaacaagccagagccg

SEQ ID NO: 2285995 - DNA, 21 bp, Homo sapiens
tagaactgtcccacaaaatat

SEQ ID NO: 2285996 - DNA, 22 bp, Homo sapiens
tagaactgtcccacaaaatatt

SEQ ID NO: 2285997 - DNA, 23 bp, Homo sapiens
tagaactgtcccacaaaatattt

SEQ ID NO: 2285998 - DNA, 21 bp, Homo sapiens
tagaactgttcatttccacca

SEQ ID NO: 2285999 - DNA, 19 bp, Homo sapiens
tagaagatgaatcagtatg

SEQ ID NO: 2286000 - DNA, 21 bp, Homo sapiens
tagaagatgaatcagtatgaa

SEQ ID NO: 2286001 - DNA, 13 bp, Homo sapiens
tagaatatataaa

SEQ ID NO: 2286002 - DNA, 18 bp, Homo sapiens
tagaatatcctatactgg

SEQ ID NO: 2286003 - DNA, 13 bp, Homo sapiens
tagaatctatttt

SEQ ID NO: 2286004 - DNA, 15 bp, Homo sapiens
tagaatctattttct

SEQ ID NO: 2286005 - DNA, 20 bp, Homo sapiens
tagaatctattttctatgta

SEQ ID NO: 2286006 - DNA, 15 bp, Homo sapiens
tagaatgagaaatca

SEQ ID NO: 2286007 - DNA, 19 bp, Homo sapiens
tagaatgagaaatcatgtt

SEQ ID NO: 2286008 - DNA, 16 bp, Homo sapiens
tagacaaaacttataa

SEQ ID NO: 2286009 - DNA, 23 bp, Homo sapiens
tagacaaaacttataatttccaa

SEQ ID NO: 2286010 - DNA, 13 bp, Homo sapiens
tagacagtttgta

SEQ ID NO: 2286011 - DNA, 16 bp, Homo sapiens
tagaccccaagcattc

SEQ ID NO: 2286012 - DNA, 14 bp, Homo sapiens
tagacttcgaaaac

SEQ ID NO: 2286013 - DNA, 18 bp, Homo sapiens
tagagactctgtgatcta

SEQ ID NO: 2286014 - DNA, 17 bp, Homo sapiens
tagagataaatatttat

SEQ ID NO: 2286015 - DNA, 20 bp, Homo sapiens
tagagattaatttgtgtaga

SEQ ID NO: 2286016 - DNA, 21 bp, Homo sapiens
tagagcaaagacttaatcata

SEQ ID NO: 2286017 - DNA, 15 bp, Homo sapiens
tagagcacatttagt

SEQ ID NO: 2286018 - DNA, 13 bp, Homo sapiens
tagaggctttatg

SEQ ID NO: 2286019 - DNA, 15 bp, Homo sapiens
tagagttcctttctg

SEQ ID NO: 2286020 - DNA, 16 bp, Homo sapiens
tagataacaagaatac

SEQ ID NO: 2286021 - DNA, 17 bp, Homo sapiens
tagataacaagaataca

SEQ ID NO: 2286022 - DNA, 18 bp, Homo sapiens
tagatattatgtatagaa

SEQ ID NO: 2286023 - DNA, 19 bp, Homo sapiens
tagatattatgtatagaaa

SEQ ID NO: 2286024 - DNA, 16 bp, Homo sapiens
tagatattcatacttt

SEQ ID NO: 2286025 - DNA, 12 bp, Homo sapiens
tagatctcctgt

SEQ ID NO: 2286026 - DNA, 21 bp, Homo sapiens
tagatgtattttcaataaaga

SEQ ID NO: 2286027 - DNA, 15 bp, Homo sapiens
tagattgaaatttat

SEQ ID NO: 2286028 - DNA, 17 bp, Homo sapiens
tagattgaaatttatga

SEQ ID NO: 2286029 - DNA, 13 bp, Homo sapiens
tagcaatatattt

SEQ ID NO: 2286030 - DNA, 18 bp, Homo sapiens
tagcaatatatttgtagg

SEQ ID NO: 2286031 - DNA, 15 bp, Homo sapiens
tagcaggaaatagtg

SEQ ID NO: 2286032 - DNA, 14 bp, Homo sapiens
tagcatcctgatta

SEQ ID NO: 2286033 - DNA, 15 bp, Homo sapiens
tagcatctgctcttc

SEQ ID NO: 2286034 - DNA, 13 bp, Homo sapiens
tagcattaaatat

SEQ ID NO: 2286035 - DNA, 14 bp, Homo sapiens
tagcattaaatata

SEQ ID NO: 2286036 - DNA, 23 bp, Homo sapiens
tagcattaaatataaaatacata

SEQ ID NO: 2286037 - DNA, 18 bp, Homo sapiens
tagccaacttaaacctgt

SEQ ID NO: 2286038 - DNA, 13 bp, Homo sapiens
tagccagaatgtt

SEQ ID NO: 2286039 - DNA, 18 bp, Homo sapiens
tagcccataatctctttg

SEQ ID NO: 2286040 - DNA, 15 bp, Homo sapiens
tagccgggccccatg

SEQ ID NO: 2286041 - DNA, 17 bp, Homo sapiens
tagccgggccccatggt

SEQ ID NO: 2286042 - DNA, 23 bp, Homo sapiens
tagcctagaacaagccagagccg

SEQ ID NO: 2286043 - DNA, 13 bp, Homo sapiens
tagcggtttgcaa

SEQ ID NO: 2286044 - DNA, 13 bp, Homo sapiens
tagctaattagct

SEQ ID NO: 2286045 - DNA, 21 bp, Homo sapiens
tagctctcgcctcaggctttt

SEQ ID NO: 2286046 - DNA, 21 bp, Homo sapiens
tagctgccacttgaacaaaat

SEQ ID NO: 2286047 - DNA, 17 bp, Homo sapiens
tagctgttggaatgttg

SEQ ID NO: 2286048 - DNA, 17 bp, Homo sapiens
taggaaaaactgatttt

SEQ ID NO: 2286049 - DNA, 17 bp, Homo sapiens
taggaaataaatctaaa

SEQ ID NO: 2286050 - DNA, 14 bp, Homo sapiens
taggaagaatcagt

SEQ ID NO: 2286051 - DNA, 21 bp, Homo sapiens
taggagtggctgaccaggccc

SEQ ID NO: 2286052 - DNA, 12 bp, Homo sapiens
taggcatgtgca

SEQ ID NO: 2286053 - DNA, 12 bp, Homo sapiens
taggccaatgaa

SEQ ID NO: 2286054 - DNA, 16 bp, Homo sapiens
taggctgtacatcaga

SEQ ID NO: 2286055 - DNA, 21 bp, Homo sapiens
taggctgtacatcagacagaa

SEQ ID NO: 2286056 - DNA, 23 bp, Homo sapiens
tagggaatggggaacccgctctc

SEQ ID NO: 2286057 - DNA, 14 bp, Homo sapiens
tagggccagggctc

SEQ ID NO: 2286058 - DNA, 19 bp, Homo sapiens
tagggccagggctctggca

SEQ ID NO: 2286059 - DNA, 18 bp, Homo sapiens
tagggtttggaagaaagg

SEQ ID NO: 2286060 - DNA, 15 bp, Homo sapiens
taggtaagttggctc

SEQ ID NO: 2286061 - DNA, 14 bp, Homo sapiens
taggtcatttgtag

SEQ ID NO: 2286062 - DNA, 16 bp, Homo sapiens
taggtcatttgtagat

SEQ ID NO: 2286063 - DNA, 17 bp, Homo sapiens
taggtgaaagaacaagt

SEQ ID NO: 2286064 - DNA, 17 bp, Homo sapiens
taggtttttcttgctat

SEQ ID NO: 2286065 - DNA, 22 bp, Homo sapiens
tagtaaataatgattcaatgtg

SEQ ID NO: 2286066 - DNA, 18 bp, Homo sapiens
tagtaatggcagagcagt

SEQ ID NO: 2286067 - DNA, 14 bp, Homo sapiens
tagtaattgttaca

SEQ ID NO: 2286068 - DNA, 16 bp, Homo sapiens
tagtacatgcagaaat

SEQ ID NO: 2286069 - DNA, 22 bp, Homo sapiens
tagtacccaaccaaagatgctt

SEQ ID NO: 2286070 - DNA, 18 bp, Homo sapiens
tagtactgtgtactgtat

SEQ ID NO: 2286071 - DNA, 18 bp, Homo sapiens
tagtaggctaaaaacatt

SEQ ID NO: 2286072 - DNA, 13 bp, Homo sapiens
tagtatcctgtta

SEQ ID NO: 2286073 - DNA, 20 bp, Homo sapiens
tagtcatatttttgtaaata

SEQ ID NO: 2286074 - DNA, 22 bp, Homo sapiens
tagtcatatttttgtaaatatg

SEQ ID NO: 2286075 - DNA, 17 bp, Homo sapiens
tagtcatgtttctgcag

SEQ ID NO: 2286076 - DNA, 16 bp, Homo sapiens
tagtccaatgaagata

SEQ ID NO: 2286077 - DNA, 20 bp, Homo sapiens
tagtccaatgaagataaatg

SEQ ID NO: 2286078 - DNA, 22 bp, Homo sapiens
tagtccaatgaagataaatgct

SEQ ID NO: 2286079 - DNA, 13 bp, Homo sapiens
tagtctgtacttc

SEQ ID NO: 2286080 - DNA, 15 bp, Homo sapiens
tagtgagatttgtat

SEQ ID NO: 2286081 - DNA, 17 bp, Homo sapiens
tagtgagatttgtattt

SEQ ID NO: 2286082 - DNA, 22 bp, Homo sapiens
tagtgagtgtggcttagtaata

SEQ ID NO: 2286083 - DNA, 14 bp, Homo sapiens
tagtgatacactgt

SEQ ID NO: 2286084 - DNA, 21 bp, Homo sapiens
tagtgatacactgtatctaaa

SEQ ID NO: 2286085 - DNA, 19 bp, Homo sapiens
tagtgcaagctttaacaga

SEQ ID NO: 2286086 - DNA, 19 bp, Homo sapiens
tagtggcttcagcccctgg

SEQ ID NO: 2286087 - DNA, 22 bp, Homo sapiens
tagtggcttcagcccctggggt

SEQ ID NO: 2286088 - DNA, 19 bp, Homo sapiens
tagtgttttaagaaatgta

SEQ ID NO: 2286089 - DNA, 18 bp, Homo sapiens
tagttaattgtggcttta

SEQ ID NO: 2286090 - DNA, 21 bp, Homo sapiens
tagttacaacattaattttat

SEQ ID NO: 2286091 - DNA, 15 bp, Homo sapiens
tagttagcaggaaat

SEQ ID NO: 2286092 - DNA, 21 bp, Homo sapiens
tagttaggtgtgccaaactac

SEQ ID NO: 2286093 - DNA, 16 bp, Homo sapiens
tagttccattctatga

SEQ ID NO: 2286094 - DNA, 15 bp, Homo sapiens
tagttctatttctat

SEQ ID NO: 2286095 - DNA, 12 bp, Homo sapiens
tcacatctgtat

SEQ ID NO: 2286096 - DNA, 18 bp, Homo sapiens
tcacatgactgaagggac

SEQ ID NO: 2286097 - DNA, 17 bp, Homo sapiens
tcacatgctccttgcct

SEQ ID NO: 2286098 - DNA, 20 bp, Homo sapiens
tcacatgctccttgcctctg

SEQ ID NO: 2286099 - DNA, 16 bp, Homo sapiens
tcacattctgttgttc

SEQ ID NO: 2286100 - DNA, 13 bp, Homo sapiens
tcaccctattttc

SEQ ID NO: 2286101 - DNA, 15 bp, Homo sapiens
tcaccctattttcag

SEQ ID NO: 2286102 - DNA, 13 bp, Homo sapiens
tcaccctgccacc

SEQ ID NO: 2286103 - DNA, 19 bp, Homo sapiens
tcaccctgccaccctctgc

SEQ ID NO: 2286104 - DNA, 22 bp, Homo sapiens
tcaccgaaaacgtggctgcttc

SEQ ID NO: 2286105 - DNA, 18 bp, Homo sapiens
tcacctcactcagcacca

SEQ ID NO: 2286106 - DNA, 21 bp, Homo sapiens
tcacctcactcagcaccactc

SEQ ID NO: 2286107 - DNA, 23 bp, Homo sapiens
tcacctcactcagcaccactcaa

SEQ ID NO: 2286108 - DNA, 14 bp, Homo sapiens
tcacgggcccgctc

SEQ ID NO: 2286109 - DNA, 14 bp, Homo sapiens
tcactcagcaccac

SEQ ID NO: 2286110 - DNA, 15 bp, Homo sapiens
tcactcagcaccact

SEQ ID NO: 2286111 - DNA, 16 bp, Homo sapiens
tcactcagcaccactc

SEQ ID NO: 2286112 - DNA, 14 bp, Homo sapiens
tcactctccagggt

SEQ ID NO: 2286113 - DNA, 12 bp, Homo sapiens
tcactctccttg

SEQ ID NO: 2286114 - DNA, 11 bp, Homo sapiens
tcactctgttg

SEQ ID NO: 2286115 - DNA, 21 bp, Homo sapiens
tcactctgttgaccaggctgg

SEQ ID NO: 2286116 - DNA, 23 bp, Homo sapiens
tcactgaataatggaattatgta

SEQ ID NO: 2286117 - DNA, 19 bp, Homo sapiens
tcactgcacttagctgttg

SEQ ID NO: 2286118 - DNA, 13 bp, Homo sapiens
tcactgcagcctc

SEQ ID NO: 2286119 - DNA, 17 bp, Homo sapiens
tcactgcatctttctct

SEQ ID NO: 2286120 - DNA, 20 bp, Homo sapiens
tcactgctcacacgctgcct

SEQ ID NO: 2286121 - DNA, 17 bp, Homo sapiens
tcactgtgttgcccagg

SEQ ID NO: 2286122 - DNA, 18 bp, Homo sapiens
tcactgtgttgcccaggc

SEQ ID NO: 2286123 - DNA, 19 bp, Homo sapiens
tcactgtgttgcccaggct

SEQ ID NO: 2286124 - DNA, 14 bp, Homo sapiens
tcacttgccgtgtc

SEQ ID NO: 2286125 - DNA, 21 bp, Homo sapiens
tcactttaccttcagcagtta

SEQ ID NO: 2286126 - DNA, 17 bp, Homo sapiens
tcacttttttataaatt

SEQ ID NO: 2286127 - DNA, 21 bp, Homo sapiens
tcacttttttataaattataa

SEQ ID NO: 2286128 - DNA, 15 bp, Homo sapiens
tcagaaaagacactt

SEQ ID NO: 2286129 - DNA, 15 bp, Homo sapiens
tcagaaggagacaga

SEQ ID NO: 2286130 - DNA, 17 bp, Homo sapiens
tcagaaggagacagaat

SEQ ID NO: 2286131 - DNA, 19 bp, Homo sapiens
tcagaatattttcaaaata

SEQ ID NO: 2286132 - DNA, 21 bp, Homo sapiens
tcagacttgatttacaagcat

SEQ ID NO: 2286133 - DNA, 14 bp, Homo sapiens
tcagagatgtacca

SEQ ID NO: 2286134 - DNA, 14 bp, Homo sapiens
tcagagattagtct

SEQ ID NO: 2286135 - DNA, 22 bp, Homo sapiens
tcagagtcctgccgacggagcc

SEQ ID NO: 2286136 - DNA, 14 bp, Homo sapiens
tcagagttctctgt

SEQ ID NO: 2286137 - DNA, 18 bp, Homo sapiens
tcagatcttacaagttta

SEQ ID NO: 2286138 - DNA, 20 bp, Homo sapiens
tcagcaaattcttgaataaa

SEQ ID NO: 2286139 - DNA, 14 bp, Homo sapiens
tcagcaattaaaga

SEQ ID NO: 2286140 - DNA, 21 bp, Homo sapiens
tcagcaattaaagacatttaa

SEQ ID NO: 2286141 - DNA, 20 bp, Homo sapiens
tcagcacagataaaaagtgg

SEQ ID NO: 2286142 - DNA, 22 bp, Homo sapiens
tcagcacagataaaaagtggaa

SEQ ID NO: 2286143 - DNA, 22 bp, Homo sapiens
tcagcacagcctcacccctgca

SEQ ID NO: 2286144 - DNA, 17 bp, Homo sapiens
tcagcagttaccgagga

SEQ ID NO: 2286145 - DNA, 14 bp, Homo sapiens
tcagcatagagcta

SEQ ID NO: 2286146 - DNA, 16 bp, Homo sapiens
tcagcatagagctata

SEQ ID NO: 2286147 - DNA, 18 bp, Homo sapiens
tcagcatggtttgcatga

SEQ ID NO: 2286148 - DNA, 14 bp, Homo sapiens
tcagccagaagact

SEQ ID NO: 2286149 - DNA, 20 bp, Homo sapiens
tcagcccggtgtgaggaggg

SEQ ID NO: 2286150 - DNA, 12 bp, Homo sapiens
tcagcgattcct

SEQ ID NO: 2286151 - DNA, 16 bp, Homo sapiens
tcagcgattcctgcca

SEQ ID NO: 2286152 - DNA, 18 bp, Homo sapiens
tcagcgattcctgccaag

SEQ ID NO: 2286153 - DNA, 23 bp, Homo sapiens
tcagctaagccccctactgagaa

SEQ ID NO: 2286154 - DNA, 13 bp, Homo sapiens
tcagctctgcata

SEQ ID NO: 2286155 - DNA, 18 bp, Homo sapiens
tcaggaagcctcctgctg

SEQ ID NO: 2286156 - DNA, 21 bp, Homo sapiens
tcaggaccccatctgctgagc

SEQ ID NO: 2286157 - DNA, 23 bp, Homo sapiens
tcaggaggagacagtcaggaagc

SEQ ID NO: 2286158 - DNA, 19 bp, Homo sapiens
tcaggaggcagtggcttgg

SEQ ID NO: 2286159 - DNA, 21 bp, Homo sapiens
tcaggcagtagcagctgtgtt

SEQ ID NO: 2286160 - DNA, 12 bp, Homo sapiens
tcaggctttcta

SEQ ID NO: 2286161 - DNA, 14 bp, Homo sapiens
tcaggctttttcca

SEQ ID NO: 2286162 - DNA, 13 bp, Homo sapiens
tcaggtgaataac

SEQ ID NO: 2286163 - DNA, 15 bp, Homo sapiens
tcagtcccacagccc

SEQ ID NO: 2286164 - DNA, 13 bp, Homo sapiens
tcagtcctctgca

SEQ ID NO: 2286165 - DNA, 16 bp, Homo sapiens
tcagtcctgggcaaag

SEQ ID NO: 2286166 - DNA, 12 bp, Homo sapiens
tcagtctgtcca

SEQ ID NO: 2286167 - DNA, 20 bp, Homo sapiens
tcagtcttgccttacacaaa

SEQ ID NO: 2286168 - DNA, 12 bp, Homo sapiens
tcagtgccttat

SEQ ID NO: 2286169 - DNA, 18 bp, Homo sapiens
tcagtgccttatggaaca

SEQ ID NO: 2286170 - DNA, 20 bp, Homo sapiens
tcagtgccttatggaacact

SEQ ID NO: 2286171 - DNA, 22 bp, Homo sapiens
tcagtgccttatggaacactct

SEQ ID NO: 2286172 - DNA, 18 bp, Homo sapiens
tcagtgctttgcccttga

SEQ ID NO: 2286173 - DNA, 19 bp, Homo sapiens
tcagtggaaaccctgagag

SEQ ID NO: 2286174 - DNA, 20 bp, Homo sapiens
tcagtggaaaccctgagagt

SEQ ID NO: 2286175 - DNA, 15 bp, Homo sapiens
tcagttctcatcttg

SEQ ID NO: 2286176 - DNA, 20 bp, Homo sapiens
tcagttcttggcctgctagc

SEQ ID NO: 2286177 - DNA, 22 bp, Homo sapiens
tcagttgtggcctcattcagca

SEQ ID NO: 2286178 - DNA, 17 bp, Homo sapiens
tcagttgttagtgtgtc

SEQ ID NO: 2286179 - DNA, 19 bp, Homo sapiens
tcagttgttagtgtgtctt

SEQ ID NO: 2286180 - DNA, 19 bp, Homo sapiens
tcagtttcacatatttgta

SEQ ID NO: 2286181 - DNA, 22 bp, Homo sapiens
tcagttttagtttcaaaatgtt

SEQ ID NO: 2286182 - DNA, 13 bp, Homo sapiens
tcagttttcacag

SEQ ID NO: 2286183 - DNA, 17 bp, Homo sapiens
tcagttttcacagaggc

SEQ ID NO: 2286184 - DNA, 15 bp, Homo sapiens
tcataaaaaataaca

SEQ ID NO: 2286185 - DNA, 14 bp, Homo sapiens
tcataaaaataacc

SEQ ID NO: 2286186 - DNA, 14 bp, Homo sapiens
tcataaaatgctat

SEQ ID NO: 2286187 - DNA, 19 bp, Homo sapiens
tcataaagttagaatctat

SEQ ID NO: 2286188 - DNA, 16 bp, Homo sapiens
tcataaatagtaaata

SEQ ID NO: 2286189 - DNA, 18 bp, Homo sapiens
tcataatctctttccatc

SEQ ID NO: 2286190 - DNA, 14 bp, Homo sapiens
tcataattcattta

SEQ ID NO: 2286191 - DNA, 15 bp, Homo sapiens
tcataattcatttaa

SEQ ID NO: 2286192 - DNA, 17 bp, Homo sapiens
tcataattcatttaaga

SEQ ID NO: 2286193 - DNA, 23 bp, Homo sapiens
tcataattcatttaagaacaaga

SEQ ID NO: 2286194 - DNA, 13 bp, Homo sapiens
tcatactcaaaga

SEQ ID NO: 2286195 - DNA, 14 bp, Homo sapiens
tcatactcaaagag

SEQ ID NO: 2286196 - DNA, 17 bp, Homo sapiens
tcatactgaaattgttt

SEQ ID NO: 2286197 - DNA, 23 bp, Homo sapiens
tcatactttccaacattatcctg

SEQ ID NO: 2286198 - DNA, 18 bp, Homo sapiens
tcatagcatcctgattat

SEQ ID NO: 2286199 - DNA, 23 bp, Homo sapiens
tcatataatttgccagacagaga

SEQ ID NO: 2286200 - DNA, 23 bp, Homo sapiens
tcatattgagatcagcattcaaa

SEQ ID NO: 2286201 - DNA, 21 bp, Homo sapiens
tcatatttttgtaaatatgac

SEQ ID NO: 2286202 - DNA, 23 bp, Homo sapiens
tcatcaatacttttgtgtattct

SEQ ID NO: 2286203 - DNA, 19 bp, Homo sapiens
tcatccaactggaaggctt

SEQ ID NO: 2286204 - DNA, 18 bp, Homo sapiens
tcatcccggggccatgga

SEQ ID NO: 2286205 - DNA, 22 bp, Homo sapiens
tcatccttctaaagtgctggga

SEQ ID NO: 2286206 - DNA, 17 bp, Homo sapiens
tcatctataaaatgagg

SEQ ID NO: 2286207 - DNA, 20 bp, Homo sapiens
tcatctcaaacactgcttaa

SEQ ID NO: 2286208 - DNA, 15 bp, Homo sapiens
tcatctccatgctct

SEQ ID NO: 2286209 - DNA, 15 bp, Homo sapiens
tcatctcttgatgaa

SEQ ID NO: 2286210 - DNA, 18 bp, Homo sapiens
tcatctgagcttttacca

SEQ ID NO: 2286211 - DNA, 15 bp, Homo sapiens
tcatctggagtccct

SEQ ID NO: 2286212 - DNA, 17 bp, Homo sapiens
tcatctggagtccctcc

SEQ ID NO: 2286213 - DNA, 21 bp, Homo sapiens
tcatctggagtccctcctccc

SEQ ID NO: 2286214 - DNA, 23 bp, Homo sapiens
tcatcttccctttcctcccttct

SEQ ID NO: 2286215 - DNA, 19 bp, Homo sapiens
tcatgaaagcacctgccct

SEQ ID NO: 2286216 - DNA, 21 bp, Homo sapiens
tcatgaaagcacctgccctct

SEQ ID NO: 2286217 - DNA, 13 bp, Homo sapiens
tcatgaagaaaaa

SEQ ID NO: 2286218 - DNA, 16 bp, Homo sapiens
tcatgaagaaaaaatt

SEQ ID NO: 2286219 - DNA, 23 bp, Homo sapiens
tcatgaagaaaaaattttaaaaa

SEQ ID NO: 2286220 - DNA, 18 bp, Homo sapiens
tcatgcaaaaaaaaaaat

SEQ ID NO: 2286221 - DNA, 19 bp, Homo sapiens
tcatgcatagacaagtgtt

SEQ ID NO: 2286222 - DNA, 12 bp, Homo sapiens
tcatgcccaaga

SEQ ID NO: 2286223 - DNA, 19 bp, Homo sapiens
tcatggaccactgtttctt

SEQ ID NO: 2286224 - DNA, 13 bp, Homo sapiens
tcatgggttcctc

SEQ ID NO: 2286225 - DNA, 21 bp, Homo sapiens
tcatgtactacacttctgaaa

SEQ ID NO: 2286226 - DNA, 17 bp, Homo sapiens
tcatgtgtacagaaaca

SEQ ID NO: 2286227 - DNA, 18 bp, Homo sapiens
tcatgtgtacagaaacaa

SEQ ID NO: 2286228 - DNA, 23 bp, Homo sapiens
tcatgtgtagatattatgtatag

SEQ ID NO: 2286229 - DNA, 15 bp, Homo sapiens
tcatgtgttgcaaat

SEQ ID NO: 2286230 - DNA, 23 bp, Homo sapiens
tcatgtgttgcaaattattctag

SEQ ID NO: 2286231 - DNA, 15 bp, Homo sapiens
tcatgtttaagaaat

SEQ ID NO: 2286232 - DNA, 22 bp, Homo sapiens
tcatgtttaagaaatgagaaat

SEQ ID NO: 2286233 - DNA, 15 bp, Homo sapiens
tcatgtttctgcagt

SEQ ID NO: 2286234 - DNA, 23 bp, Homo sapiens
tcatgtttctgcagtattctgta

SEQ ID NO: 2286235 - DNA, 18 bp, Homo sapiens
tcattacatcctctgctt

SEQ ID NO: 2286236 - DNA, 18 bp, Homo sapiens
tcattactgcccagatgt

SEQ ID NO: 2286237 - DNA, 13 bp, Homo sapiens
tcattatgaagat

SEQ ID NO: 2286238 - DNA, 15 bp, Homo sapiens
tcattatgaagatgt

SEQ ID NO: 2286239 - DNA, 16 bp, Homo sapiens
tcattatgaagatgtt

SEQ ID NO: 2286240 - DNA, 17 bp, Homo sapiens
tcattatgaagatgttt

SEQ ID NO: 2286241 - DNA, 16 bp, Homo sapiens
tcattatgtcaattca

SEQ ID NO: 2286242 - DNA, 14 bp, Homo sapiens
tcattatttcatga

SEQ ID NO: 2286243 - DNA, 17 bp, Homo sapiens
tcattcaaaactttcag

SEQ ID NO: 2286244 - DNA, 20 bp, Homo sapiens
tcattcatggaccactgttt

SEQ ID NO: 2286245 - DNA, 15 bp, Homo sapiens
tcattccacacattt

SEQ ID NO: 2286246 - DNA, 12 bp, Homo sapiens
tcattgaaatct

SEQ ID NO: 2286247 - DNA, 18 bp, Homo sapiens
tcattgagaaataaagca

SEQ ID NO: 2286248 - DNA, 17 bp, Homo sapiens
tcatttacaacttccag

SEQ ID NO: 2286249 - DNA, 22 bp, Homo sapiens
tcatttccaccaagggtatctg

SEQ ID NO: 2286250 - DNA, 18 bp, Homo sapiens
tcatttcccctcccgctt

SEQ ID NO: 2286251 - DNA, 22 bp, Homo sapiens
tcatttcccctcccgcttcctc

SEQ ID NO: 2286252 - DNA, 22 bp, Homo sapiens
tcatttggccgagtcagcacgt

SEQ ID NO: 2286253 - DNA, 17 bp, Homo sapiens
tccaaatattctaaaaa

SEQ ID NO: 2286254 - DNA, 13 bp, Homo sapiens
tccaacaggggct

SEQ ID NO: 2286255 - DNA, 19 bp, Homo sapiens
tccaacattatcctgtgtg

SEQ ID NO: 2286256 - DNA, 18 bp, Homo sapiens
tccaacccaggtctgctt

SEQ ID NO: 2286257 - DNA, 20 bp, Homo sapiens
tccaacctggaggctggacc

SEQ ID NO: 2286258 - DNA, 12 bp, Homo sapiens
tccaagagaatt

SEQ ID NO: 2286259 - DNA, 14 bp, Homo sapiens
tccaagggcccaga

SEQ ID NO: 2286260 - DNA, 16 bp, Homo sapiens
tccaagggcccagagg

SEQ ID NO: 2286261 - DNA, 17 bp, Homo sapiens
tccaagggcccagaggg

SEQ ID NO: 2286262 - DNA, 15 bp, Homo sapiens
tccaaggtcaaggca

SEQ ID NO: 2286263 - DNA, 16 bp, Homo sapiens
tccaaggtcaaggcac

SEQ ID NO: 2286264 - DNA, 20 bp, Homo sapiens
tccaatgaagataaatgctt

SEQ ID NO: 2286265 - DNA, 23 bp, Homo sapiens
tccaatgatataggaaaatacat

SEQ ID NO: 2286266 - DNA, 18 bp, Homo sapiens
tccaattaatgattcaat

SEQ ID NO: 2286267 - DNA, 19 bp, Homo sapiens
tccaattcattatgtcaat

SEQ ID NO: 2286268 - DNA, 18 bp, Homo sapiens
tccacacacagcagctcc

SEQ ID NO: 2286269 - DNA, 20 bp, Homo sapiens
tccacacacagcagctccaa

SEQ ID NO: 2286270 - DNA, 13 bp, Homo sapiens
tccacaccctctc

SEQ ID NO: 2286271 - DNA, 22 bp, Homo sapiens
tccacattcatgtacaatgatg

SEQ ID NO: 2286272 - DNA, 23 bp, Homo sapiens
tccacattctgctgcccccagac

SEQ ID NO: 2286273 - DNA, 23 bp, Homo sapiens
tccacattgcataagtggaccca

SEQ ID NO: 2286274 - DNA, 20 bp, Homo sapiens
tccaccaagggtatctgctg

SEQ ID NO: 2286275 - DNA, 13 bp, Homo sapiens
tccaccctagcct

SEQ ID NO: 2286276 - DNA, 12 bp, Homo sapiens
tccaccctgagg

SEQ ID NO: 2286277 - DNA, 22 bp, Homo sapiens
tccactctctcttgttcttact

SEQ ID NO: 2286278 - DNA, 19 bp, Homo sapiens
tccactctgctcagggccg

SEQ ID NO: 2286279 - DNA, 23 bp, Homo sapiens
tccactgtcataatctctttcca

SEQ ID NO: 2286280 - DNA, 14 bp, Homo sapiens
tccacttctctaga

SEQ ID NO: 2286281 - DNA, 20 bp, Homo sapiens
tccagaacaaacctctatat

SEQ ID NO: 2286282 - DNA, 20 bp, Homo sapiens
tccagaacgccctgtgtcca

SEQ ID NO: 2286283 - DNA, 15 bp, Homo sapiens
tccagaatttcccaa

SEQ ID NO: 2286284 - DNA, 13 bp, Homo sapiens
tccagacctgggc

SEQ ID NO: 2286285 - DNA, 16 bp, Homo sapiens
tccagactcgagaggg

SEQ ID NO: 2286286 - DNA, 23 bp, Homo sapiens
tccagactcgagagggctgagcc

SEQ ID NO: 2286287 - DNA, 16 bp, Homo sapiens
tccagagacctgctcc

SEQ ID NO: 2286288 - DNA, 19 bp, Homo sapiens
tccagagacctgctccaga

SEQ ID NO: 2286289 - DNA, 22 bp, Homo sapiens
tccagagacctgctccagatcc

SEQ ID NO: 2286290 - DNA, 23 bp, Homo sapiens
tccagagacctgctccagatcct

SEQ ID NO: 2286291 - DNA, 22 bp, Homo sapiens
tccagagttctgtgacacatgc

SEQ ID NO: 2286292 - DNA, 18 bp, Homo sapiens
tccagcctgggcaacaag

SEQ ID NO: 2286293 - DNA, 17 bp, Homo sapiens
tccagcgtctgctgttg

SEQ ID NO: 2286294 - DNA, 18 bp, Homo sapiens
tccagcgtctgctgttga

SEQ ID NO: 2286295 - DNA, 11 bp, Homo sapiens
tccagctcagt

SEQ ID NO: 2286296 - DNA, 12 bp, Homo sapiens
tccagctcagtc

SEQ ID NO: 2286297 - DNA, 18 bp, Homo sapiens
tccagctcagtcccacag

SEQ ID NO: 2286298 - DNA, 15 bp, Homo sapiens
tccagctcctgcccc

SEQ ID NO: 2286299 - DNA, 16 bp, Homo sapiens
tccagctcctgccccg

SEQ ID NO: 2286300 - DNA, 11 bp, Homo sapiens
tccagctgctc

SEQ ID NO: 2286301 - DNA, 15 bp, Homo sapiens
tccaggaaaactgtt

SEQ ID NO: 2286302 - DNA, 16 bp, Homo sapiens
tccaggaaaactgttt

SEQ ID NO: 2286303 - DNA, 16 bp, Homo sapiens
tccaggcatgaccctg

SEQ ID NO: 2286304 - DNA, 17 bp, Homo sapiens
tccaggcatgaccctgg

SEQ ID NO: 2286305 - DNA, 21 bp, Homo sapiens
tccaggcatgaccctggagcc

SEQ ID NO: 2286306 - DNA, 22 bp, Homo sapiens
tccaggcatgaccctggagccc

SEQ ID NO: 2286307 - DNA, 19 bp, Homo sapiens
tccaggccgacaggaggcc

SEQ ID NO: 2286308 - DNA, 14 bp, Homo sapiens
tccaggcgtagggc

SEQ ID NO: 2286309 - DNA, 22 bp, Homo sapiens
tccaggcgtagggccagggctc

SEQ ID NO: 2286310 - DNA, 18 bp, Homo sapiens
tccagggtacatgcttta

SEQ ID NO: 2286311 - DNA, 13 bp, Homo sapiens
tccagggtctgag

SEQ ID NO: 2286312 - DNA, 16 bp, Homo sapiens
tccagtatcttgaaga

SEQ ID NO: 2286313 - DNA, 18 bp, Homo sapiens
tccagtatcttgaagact

SEQ ID NO: 2286314 - DNA, 16 bp, Homo sapiens
tccagtcaaagacgct

SEQ ID NO: 2286315 - DNA, 14 bp, Homo sapiens
tccagtccagtgat

SEQ ID NO: 2286316 - DNA, 14 bp, Homo sapiens
tccagtgagaaatt

SEQ ID NO: 2286317 - DNA, 22 bp, Homo sapiens
tccagttggactgtggcctcag

SEQ ID NO: 2286318 - DNA, 23 bp, Homo sapiens
tccatatagtttgttttcttttt

SEQ ID NO: 2286319 - DNA, 14 bp, Homo sapiens
tccatatcagctct

SEQ ID NO: 2286320 - DNA, 15 bp, Homo sapiens
tccatatcagctctg

SEQ ID NO: 2286321 - DNA, 22 bp, Homo sapiens
tccatccacacacagcagctcc

SEQ ID NO: 2286322 - DNA, 16 bp, Homo sapiens
tccatccttaactgtc

SEQ ID NO: 2286323 - DNA, 17 bp, Homo sapiens
tccatccttaactgtcc

SEQ ID NO: 2286324 - DNA, 15 bp, Homo sapiens
tccatcctttctcct

SEQ ID NO: 2286325 - DNA, 21 bp, Homo sapiens
tccatctaaaatactcaccaa

SEQ ID NO: 2286326 - DNA, 20 bp, Homo sapiens
tccatctcttgcttgttcct

SEQ ID NO: 2286327 - DNA, 20 bp, Homo sapiens
tccatctcttgtaccagccc

SEQ ID NO: 2286328 - DNA, 21 bp, Homo sapiens
tccatctcttgtaccagccca

SEQ ID NO: 2286329 - DNA, 17 bp, Homo sapiens
tccatctgtttgataca

SEQ ID NO: 2286330 - DNA, 18 bp, Homo sapiens
tccatgcggccggcctgg

SEQ ID NO: 2286331 - DNA, 19 bp, Homo sapiens
tccatgcggccggcctggg

SEQ ID NO: 2286332 - DNA, 21 bp, Homo sapiens
tccatgcggccggcctggggc

SEQ ID NO: 2286333 - DNA, 22 bp, Homo sapiens
tccatgcggccggcctggggcc

SEQ ID NO: 2286334 - DNA, 12 bp, Homo sapiens
tccatgctcttt

SEQ ID NO: 2286335 - DNA, 21 bp, Homo sapiens
tccatgggttccagtttcaga

SEQ ID NO: 2286336 - DNA, 20 bp, Homo sapiens
tccatgtactttccctgtgt

SEQ ID NO: 2286337 - DNA, 14 bp, Homo sapiens
tccatgtctgtagt

SEQ ID NO: 2286338 - DNA, 22 bp, Homo sapiens
tccatgttagtaatggcagagc

SEQ ID NO: 2286339 - DNA, 14 bp, Homo sapiens
tccattaatacttc

SEQ ID NO: 2286340 - DNA, 12 bp, Homo sapiens
tccattctatga

SEQ ID NO: 2286341 - DNA, 11 bp, Homo sapiens
tccattttcta

SEQ ID NO: 2286342 - DNA, 18 bp, Homo sapiens
tcccaaagcagtgcatgc

SEQ ID NO: 2286343 - DNA, 22 bp, Homo sapiens
tcccaaattggtgtttctgaat

SEQ ID NO: 2286344 - DNA, 17 bp, Homo sapiens
tcccacaaaatatttct

SEQ ID NO: 2286345 - DNA, 17 bp, Homo sapiens
tcccacatcccccgtgt

SEQ ID NO: 2286346 - DNA, 15 bp, Homo sapiens
tcccactgagtctca

SEQ ID NO: 2286347 - DNA, 18 bp, Homo sapiens
tcccacttatcaaatcat

SEQ ID NO: 2286348 - DNA, 10 bp, Homo sapiens
tcccagctca

SEQ ID NO: 2286349 - DNA, 17 bp, Homo sapiens
tcccagctggcagcgcc

SEQ ID NO: 2286350 - DNA, 23 bp, Homo sapiens
tcccatgggctctggccccaaga

SEQ ID NO: 2286351 - DNA, 14 bp, Homo sapiens
tccccaaaacaaag

SEQ ID NO: 2286352 - DNA, 21 bp, Homo sapiens
tccctgagaagcctcatggga

SEQ ID NO: 2286353 - DNA, 12 bp, Homo sapiens
tccctgaggacc

SEQ ID NO: 2286354 - DNA, 22 bp, Homo sapiens
tccctggactctgtggggccac

SEQ ID NO: 2286355 - DNA, 20 bp, Homo sapiens
tccctgtgtaccctccatgt

SEQ ID NO: 2286356 - DNA, 13 bp, Homo sapiens
tcccttctttcct

SEQ ID NO: 2286357 - DNA, 15 bp, Homo sapiens
tcccttctttcctac

SEQ ID NO: 2286358 - DNA, 12 bp, Homo sapiens
tccctttcacac

SEQ ID NO: 2286359 - DNA, 19 bp, Homo sapiens
tccgaagaccttctgaaga

SEQ ID NO: 2286360 - DNA, 20 bp, Homo sapiens
tccgaggcctggctctggag

SEQ ID NO: 2286361 - DNA, 21 bp, Homo sapiens
tccgaggcctggctctggagc

SEQ ID NO: 2286362 - DNA, 22 bp, Homo sapiens
tccgaggcctggctctggagcc

SEQ ID NO: 2286363 - DNA, 16 bp, Homo sapiens
tccgcccgcccacccc

SEQ ID NO: 2286364 - DNA, 21 bp, Homo sapiens
tccgcccgcccaccccgctgc

SEQ ID NO: 2286365 - DNA, 16 bp, Homo sapiens
tccgctaatctcttct

SEQ ID NO: 2286366 - DNA, 20 bp, Homo sapiens
tccgctcccctgctcctgtc

SEQ ID NO: 2286367 - DNA, 15 bp, Homo sapiens
tccggcctgcagccc

SEQ ID NO: 2286368 - DNA, 18 bp, Homo sapiens
tccggcctgcagcccaga

SEQ ID NO: 2286369 - DNA, 14 bp, Homo sapiens
tccgtccccagggt

SEQ ID NO: 2286370 - DNA, 15 bp, Homo sapiens
tccgtcctggcaggg

SEQ ID NO: 2286371 - DNA, 18 bp, Homo sapiens
tccgtcctggcagggcag

SEQ ID NO: 2286372 - DNA, 12 bp, Homo sapiens
tcctaaacacac

SEQ ID NO: 2286373 - DNA, 19 bp, Homo sapiens
tcctactctgggaagaatg

SEQ ID NO: 2286374 - DNA, 14 bp, Homo sapiens
tcctataaatgtga

SEQ ID NO: 2286375 - DNA, 13 bp, Homo sapiens
tcctatactggtt

SEQ ID NO: 2286376 - DNA, 16 bp, Homo sapiens
tcctcaggtgaataac

SEQ ID NO: 2286377 - DNA, 12 bp, Homo sapiens
tcctccaaaaca

SEQ ID NO: 2286378 - DNA, 23 bp, Homo sapiens
tcctccaaaacacaagggaggat

SEQ ID NO: 2286379 - DNA, 15 bp, Homo sapiens
tcctccagctcctgc

SEQ ID NO: 2286380 - DNA, 18 bp, Homo sapiens
tcctccagctcctgcccc

SEQ ID NO: 2286381 - DNA, 20 bp, Homo sapiens
tcctccaggaggactgttct

SEQ ID NO: 2286382 - DNA, 12 bp, Homo sapiens
tcctcccctctc

SEQ ID NO: 2286383 - DNA, 14 bp, Homo sapiens
tcctccggctggac

SEQ ID NO: 2286384 - DNA, 17 bp, Homo sapiens
tcctccggttgcatact

SEQ ID NO: 2286385 - DNA, 20 bp, Homo sapiens
tcctccggttgcatactgga

SEQ ID NO: 2286386 - DNA, 16 bp, Homo sapiens
tcctcctgacacccca

SEQ ID NO: 2286387 - DNA, 18 bp, Homo sapiens
tcctcctgacaccccact

SEQ ID NO: 2286388 - DNA, 21 bp, Homo sapiens
tcctcctgacaccccacttag

SEQ ID NO: 2286389 - DNA, 15 bp, Homo sapiens
tcctccttcctcatc

SEQ ID NO: 2286390 - DNA, 14 bp, Homo sapiens
tcctccttgctgat

SEQ ID NO: 2286391 - DNA, 16 bp, Homo sapiens
tcctcggccagagctc

SEQ ID NO: 2286392 - DNA, 21 bp, Homo sapiens
tcctcggccagagctcccagg

SEQ ID NO: 2286393 - DNA, 22 bp, Homo sapiens
tcctcggccagagctcccagga

SEQ ID NO: 2286394 - DNA, 15 bp, Homo sapiens
tcctcgggcgcctgc

SEQ ID NO: 2286395 - DNA, 18 bp, Homo sapiens
tcctcgggcgcctgcgct

SEQ ID NO: 2286396 - DNA, 21 bp, Homo sapiens
tcctcgtccggcctgcagccc

SEQ ID NO: 2286397 - DNA, 12 bp, Homo sapiens
tcctctatgtgg

SEQ ID NO: 2286398 - DNA, 14 bp, Homo sapiens
tcctctcctcgtcc

SEQ ID NO: 2286399 - DNA, 23 bp, Homo sapiens
tcctctcctcgtccggcctgcag

SEQ ID NO: 2286400 - DNA, 20 bp, Homo sapiens
tcctctcttaaattcatatc

SEQ ID NO: 2286401 - DNA, 20 bp, Homo sapiens
tcctctcttttttgggggga

SEQ ID NO: 2286402 - DNA, 18 bp, Homo sapiens
tcctctgcagcctgagct

SEQ ID NO: 2286403 - DNA, 15 bp, Homo sapiens
tcctctgccccctcc

SEQ ID NO: 2286404 - DNA, 18 bp, Homo sapiens
tcctctgccccctccccc

SEQ ID NO: 2286405 - DNA, 22 bp, Homo sapiens
tcctctgccccctcccccgcag

SEQ ID NO: 2286406 - DNA, 16 bp, Homo sapiens
tcctctgcttgtcatt

SEQ ID NO: 2286407 - DNA, 22 bp, Homo sapiens
tcctctgtgctctcctagagct

SEQ ID NO: 2286408 - DNA, 18 bp, Homo sapiens
tcctctgttacccgcaga

SEQ ID NO: 2286409 - DNA, 16 bp, Homo sapiens
tcctcttaagacacta

SEQ ID NO: 2286410 - DNA, 18 bp, Homo sapiens
tcctcttaagacactagt

SEQ ID NO: 2286411 - DNA, 15 bp, Homo sapiens
tcctgaagaattgaa

SEQ ID NO: 2286412 - DNA, 14 bp, Homo sapiens
tcctgagtagctgg

SEQ ID NO: 2286413 - DNA, 16 bp, Homo sapiens
tcctgagtagctggga

SEQ ID NO: 2286414 - DNA, 21 bp, Homo sapiens
tcctgattattgaatgttata

SEQ ID NO: 2286415 - DNA, 15 bp, Homo sapiens
tcctgcctaaatttc

SEQ ID NO: 2286416 - DNA, 14 bp, Homo sapiens
tcctgcgtgtgccc

SEQ ID NO: 2286417 - DNA, 19 bp, Homo sapiens
tcctgctgagtggtccaca

SEQ ID NO: 2286418 - DNA, 20 bp, Homo sapiens
tcctgctgagtggtccacat

SEQ ID NO: 2286419 - DNA, 17 bp, Homo sapiens
tcctggagtgaagaaaa

SEQ ID NO: 2286420 - DNA, 19 bp, Homo sapiens
tcctggcagggcaggcaga

SEQ ID NO: 2286421 - DNA, 23 bp, Homo sapiens
tcctggcagggcaggcagagctc

SEQ ID NO: 2286422 - DNA, 16 bp, Homo sapiens
tcctgggcatccccag

SEQ ID NO: 2286423 - DNA, 20 bp, Homo sapiens
tcctggtcagttttcacaga

SEQ ID NO: 2286424 - DNA, 15 bp, Homo sapiens
tcctgtaattttgta

SEQ ID NO: 2286425 - DNA, 22 bp, Homo sapiens
tcctgtcccatgggctctggcc

SEQ ID NO: 2286426 - DNA, 23 bp, Homo sapiens
tcctgtcccatgggctctggccc

SEQ ID NO: 2286427 - DNA, 17 bp, Homo sapiens
tcctgttctgtgtctgc

SEQ ID NO: 2286428 - DNA, 17 bp, Homo sapiens
tcctgtttccagggtct

SEQ ID NO: 2286429 - DNA, 12 bp, Homo sapiens
tccttaactgtc

SEQ ID NO: 2286430 - DNA, 12 bp, Homo sapiens
tccttagaatga

SEQ ID NO: 2286431 - DNA, 13 bp, Homo sapiens
tccttagaatgag

SEQ ID NO: 2286432 - DNA, 15 bp, Homo sapiens
tccttataaaaattc

SEQ ID NO: 2286433 - DNA, 11 bp, Homo sapiens
tccttcagtgc

SEQ ID NO: 2286434 - DNA, 12 bp, Homo sapiens
tccttcccgcag

SEQ ID NO: 2286435 - DNA, 22 bp, Homo sapiens
tccttcccgcagcaccagcctg

SEQ ID NO: 2286436 - DNA, 13 bp, Homo sapiens
tccttcctgttct

SEQ ID NO: 2286437 - DNA, 19 bp, Homo sapiens
tccttgaggacctccacct

SEQ ID NO: 2286438 - DNA, 15 bp, Homo sapiens
tccttgtacttgaat

SEQ ID NO: 2286439 - DNA, 19 bp, Homo sapiens
tcctttctaaggagcacta

SEQ ID NO: 2286440 - DNA, 15 bp, Homo sapiens
tcgacctccctggct

SEQ ID NO: 2286441 - DNA, 13 bp, Homo sapiens
tcgagagggctga

SEQ ID NO: 2286442 - DNA, 14 bp, Homo sapiens
tcgagagggctgag

SEQ ID NO: 2286443 - DNA, 15 bp, Homo sapiens
tcgagagggctgagc

SEQ ID NO: 2286444 - DNA, 16 bp, Homo sapiens
tcgagagggctgagcc

SEQ ID NO: 2286445 - DNA, 19 bp, Homo sapiens
tcgagagggctgagcccct

SEQ ID NO: 2286446 - DNA, 21 bp, Homo sapiens
tcgagagggctgagcccctcc

SEQ ID NO: 2286447 - DNA, 19 bp, Homo sapiens
tcgaggagataaactgaaa

SEQ ID NO: 2286448 - DNA, 15 bp, Homo sapiens
tcgatcgtttcacat

SEQ ID NO: 2286449 - DNA, 16 bp, Homo sapiens
tctacactgcaatcat

SEQ ID NO: 2286450 - DNA, 19 bp, Homo sapiens
tctacactgcaatcatatg

SEQ ID NO: 2286451 - DNA, 20 bp, Homo sapiens
tctacactgcaatcatatgt

SEQ ID NO: 2286452 - DNA, 17 bp, Homo sapiens
tctacaggaaatacaga

SEQ ID NO: 2286453 - DNA, 20 bp, Homo sapiens
tctagatggatattagatgc

SEQ ID NO: 2286454 - DNA, 13 bp, Homo sapiens
tctagcaactgtt

SEQ ID NO: 2286455 - DNA, 17 bp, Homo sapiens
tctagcaagaagattct

SEQ ID NO: 2286456 - DNA, 16 bp, Homo sapiens
tctagtatacagtgat

SEQ ID NO: 2286457 - DNA, 23 bp, Homo sapiens
tctagtatttgtatcctggcaaa

SEQ ID NO: 2286458 - DNA, 18 bp, Homo sapiens
tctagtcaactgctgttt

SEQ ID NO: 2286459 - DNA, 21 bp, Homo sapiens
tctagtcaactgctgttttat

SEQ ID NO: 2286460 - DNA, 22 bp, Homo sapiens
tctagtcaactgctgttttatg

SEQ ID NO: 2286461 - DNA, 12 bp, Homo sapiens
tctagtctctga

SEQ ID NO: 2286462 - DNA, 14 bp, Homo sapiens
tctataaaatgagg

SEQ ID NO: 2286463 - DNA, 14 bp, Homo sapiens
tctataaattgtag

SEQ ID NO: 2286464 - DNA, 23 bp, Homo sapiens
tctataaattgtagaacatagat

SEQ ID NO: 2286465 - DNA, 22 bp, Homo sapiens
tctatactgtttgtaatataca

SEQ ID NO: 2286466 - DNA, 16 bp, Homo sapiens
tctatatttcatattg

SEQ ID NO: 2286467 - DNA, 17 bp, Homo sapiens
tctatatttcatattga

SEQ ID NO: 2286468 - DNA, 21 bp, Homo sapiens
tctatgagacctcccccaggg

SEQ ID NO: 2286469 - DNA, 18 bp, Homo sapiens
tctatgcctgtatttcca

SEQ ID NO: 2286470 - DNA, 14 bp, Homo sapiens
tctatgtagaactg

SEQ ID NO: 2286471 - DNA, 16 bp, Homo sapiens
tctatgtccaaacctg

SEQ ID NO: 2286472 - DNA, 13 bp, Homo sapiens
tctatttctatct

SEQ ID NO: 2286473 - DNA, 15 bp, Homo sapiens
tctattttctatgta

SEQ ID NO: 2286474 - DNA, 21 bp, Homo sapiens
tctcaaaaagctgctatccaa

SEQ ID NO: 2286475 - DNA, 16 bp, Homo sapiens
tctcaaatgctaaatg

SEQ ID NO: 2286476 - DNA, 17 bp, Homo sapiens
tctcaaatgctaaatgc

SEQ ID NO: 2286477 - DNA, 19 bp, Homo sapiens
tctcacatgtggctccccc

SEQ ID NO: 2286478 - DNA, 22 bp, Homo sapiens
tctcacatgtggctccccctga

SEQ ID NO: 2286479 - DNA, 15 bp, Homo sapiens
tctcactctgttgac

SEQ ID NO: 2286480 - DNA, 23 bp, Homo sapiens
tctcactctgttgaccaggctgg

SEQ ID NO: 2286481 - DNA, 19 bp, Homo sapiens
tctcactgtgttgcccagg

SEQ ID NO: 2286482 - DNA, 20 bp, Homo sapiens
tctcacttcagttgtggcct

SEQ ID NO: 2286483 - DNA, 22 bp, Homo sapiens
tctcagcaaattcttgaataaa

SEQ ID NO: 2286484 - DNA, 18 bp, Homo sapiens
tctcagccgagcccaggg

SEQ ID NO: 2286485 - DNA, 18 bp, Homo sapiens
tctcatccccaaactgta

SEQ ID NO: 2286486 - DNA, 12 bp, Homo sapiens
tctcattcttgc

SEQ ID NO: 2286487 - DNA, 12 bp, Homo sapiens
tctccaaagctt

SEQ ID NO: 2286488 - DNA, 17 bp, Homo sapiens
tctccacctgaagtgat

SEQ ID NO: 2286489 - DNA, 16 bp, Homo sapiens
tctccagatttttaat

SEQ ID NO: 2286490 - DNA, 16 bp, Homo sapiens
tctccagccaatttca

SEQ ID NO: 2286491 - DNA, 20 bp, Homo sapiens
tctccagccaatttcaaaga

SEQ ID NO: 2286492 - DNA, 16 bp, Homo sapiens
tctccaggcaccgcct

SEQ ID NO: 2286493 - DNA, 19 bp, Homo sapiens
tctccatccttaactgtcc

SEQ ID NO: 2286494 - DNA, 16 bp, Homo sapiens
tctccatgtctgtagt

SEQ ID NO: 2286495 - DNA, 22 bp, Homo sapiens
tctccatttcacgggcaacact

SEQ ID NO: 2286496 - DNA, 18 bp, Homo sapiens
tctccccacaccctggag

SEQ ID NO: 2286497 - DNA, 17 bp, Homo sapiens
tctcctcgtccggcctg

SEQ ID NO: 2286498 - DNA, 18 bp, Homo sapiens
tctcctcgtccggcctgc

SEQ ID NO: 2286499 - DNA, 21 bp, Homo sapiens
tctcctcgtccggcctgcagc

SEQ ID NO: 2286500 - DNA, 21 bp, Homo sapiens
tctcctgcgtgtgcccactga

SEQ ID NO: 2286501 - DNA, 20 bp, Homo sapiens
tctcctgggccagggtctcg

SEQ ID NO: 2286502 - DNA, 19 bp, Homo sapiens
tctcctgtaattttgtagt

SEQ ID NO: 2286503 - DNA, 23 bp, Homo sapiens
tctccttggtgtcgggcatgaca

SEQ ID NO: 2286504 - DNA, 13 bp, Homo sapiens
tctccttttctcc

SEQ ID NO: 2286505 - DNA, 14 bp, Homo sapiens
tctccttttctcca

SEQ ID NO: 2286506 - DNA, 12 bp, Homo sapiens
tctcgagtccaa

SEQ ID NO: 2286507 - DNA, 19 bp, Homo sapiens
tctcgagtccaaaatcatt

SEQ ID NO: 2286508 - DNA, 15 bp, Homo sapiens
tctcgtactttcaca

SEQ ID NO: 2286509 - DNA, 14 bp, Homo sapiens
tctcgtgattgata

SEQ ID NO: 2286510 - DNA, 20 bp, Homo sapiens
tctcgtgttcgctggctgat

SEQ ID NO: 2286511 - DNA, 14 bp, Homo sapiens
tctctaaaattcta

SEQ ID NO: 2286512 - DNA, 16 bp, Homo sapiens
tctctaaaattctagt

SEQ ID NO: 2286513 - DNA, 17 bp, Homo sapiens
tctctaaaattctagtc

SEQ ID NO: 2286514 - DNA, 13 bp, Homo sapiens
tctctactttcct

SEQ ID NO: 2286515 - DNA, 14 bp, Homo sapiens
tctctactttcctg

SEQ ID NO: 2286516 - DNA, 13 bp, Homo sapiens
tctctagagaaca

SEQ ID NO: 2286517 - DNA, 14 bp, Homo sapiens
tctctagagaacat

SEQ ID NO: 2286518 - DNA, 22 bp, Homo sapiens
tctctaggtgtgtccacagagt

SEQ ID NO: 2286519 - DNA, 22 bp, Homo sapiens
tctctcttgttcttactttcct

SEQ ID NO: 2286520 - DNA, 14 bp, Homo sapiens
tctctgagaacaga

SEQ ID NO: 2286521 - DNA, 15 bp, Homo sapiens
tctctgagcagtggg

SEQ ID NO: 2286522 - DNA, 14 bp, Homo sapiens
tctctgattaaatt

SEQ ID NO: 2286523 - DNA, 15 bp, Homo sapiens
tctctgattaaattt

SEQ ID NO: 2286524 - DNA, 22 bp, Homo sapiens
tctctgattaaatttaatatac

SEQ ID NO: 2286525 - DNA, 20 bp, Homo sapiens
tctctgccctgccctggcca

SEQ ID NO: 2286526 - DNA, 18 bp, Homo sapiens
tctcttccagcccagaca

SEQ ID NO: 2286527 - DNA, 23 bp, Homo sapiens
tctcttcctctcttttttggggg

SEQ ID NO: 2286528 - DNA, 21 bp, Homo sapiens
tctcttgtaaatacatgtccc

SEQ ID NO: 2286529 - DNA, 19 bp, Homo sapiens
tctctttgaaaattcttgt

SEQ ID NO: 2286530 - DNA, 21 bp, Homo sapiens
tctctttttgccccctctcct

SEQ ID NO: 2286531 - DNA, 13 bp, Homo sapiens
tctgaaaactgtt

SEQ ID NO: 2286532 - DNA, 11 bp, Homo sapiens
tctgaaaagaa

SEQ ID NO: 2286533 - DNA, 13 bp, Homo sapiens
tctgaaaatattt

SEQ ID NO: 2286534 - DNA, 20 bp, Homo sapiens
tctgaaaatatttttttcta

SEQ ID NO: 2286535 - DNA, 20 bp, Homo sapiens
tctgaactgctgctggtcac

SEQ ID NO: 2286536 - DNA, 20 bp, Homo sapiens
tctgaaggccttgttaaaat

SEQ ID NO: 2286537 - DNA, 18 bp, Homo sapiens
tctgaattcataaaaata

SEQ ID NO: 2286538 - DNA, 18 bp, Homo sapiens
tctggtctcgtgttcgct

SEQ ID NO: 2286539 - DNA, 22 bp, Homo sapiens
tctgtaaatttaactgcatata

SEQ ID NO: 2286540 - DNA, 21 bp, Homo sapiens
tctgtaggtgaaagaacaagt

SEQ ID NO: 2286541 - DNA, 17 bp, Homo sapiens
tctgtatatcagctcta

SEQ ID NO: 2286542 - DNA, 21 bp, Homo sapiens
tctgtcattggttacaaattt

SEQ ID NO: 2286543 - DNA, 15 bp, Homo sapiens
tctgtccacgtggag

SEQ ID NO: 2286544 - DNA, 20 bp, Homo sapiens
tctgtcttaaagaatttgaa

SEQ ID NO: 2286545 - DNA, 18 bp, Homo sapiens
tctgtgactcgcttagct

SEQ ID NO: 2286546 - DNA, 15 bp, Homo sapiens
tctgtgatctaagca

SEQ ID NO: 2286547 - DNA, 18 bp, Homo sapiens
tctgtgccatagaacaag

SEQ ID NO: 2286548 - DNA, 21 bp, Homo sapiens
tctgtgcccgaggttcctgtc

SEQ ID NO: 2286549 - DNA, 16 bp, Homo sapiens
tctgtggattctatat

SEQ ID NO: 2286550 - DNA, 22 bp, Homo sapiens
tctgtggattctatatttcata

SEQ ID NO: 2286551 - DNA, 15 bp, Homo sapiens
tctgtggggccacac

SEQ ID NO: 2286552 - DNA, 18 bp, Homo sapiens
tctgtgtaatctctgatt

SEQ ID NO: 2286553 - DNA, 12 bp, Homo sapiens
tctgtgtctgct

SEQ ID NO: 2286554 - DNA, 14 bp, Homo sapiens
tctgtgtctgctgt

SEQ ID NO: 2286555 - DNA, 17 bp, Homo sapiens
tctgttacacaatatgt

SEQ ID NO: 2286556 - DNA, 16 bp, Homo sapiens
tctgttactccaaaaa

SEQ ID NO: 2286557 - DNA, 22 bp, Homo sapiens
tctgttactccaaaaagaaata

SEQ ID NO: 2286558 - DNA, 18 bp, Homo sapiens
tctgttgacaatttgcca

SEQ ID NO: 2286559 - DNA, 13 bp, Homo sapiens
tctgttgttattc

SEQ ID NO: 2286560 - DNA, 13 bp, Homo sapiens
tctgttgttcagt

SEQ ID NO: 2286561 - DNA, 18 bp, Homo sapiens
tctgtttacatccagagt

SEQ ID NO: 2286562 - DNA, 14 bp, Homo sapiens
tctgtttctatgtc

SEQ ID NO: 2286563 - DNA, 22 bp, Homo sapiens
tcttaaaatattgtgtaagaat

SEQ ID NO: 2286564 - DNA, 12 bp, Homo sapiens
tcttaaagaatt

SEQ ID NO: 2286565 - DNA, 19 bp, Homo sapiens
tcttaaagaatttgaaagt

SEQ ID NO: 2286566 - DNA, 20 bp, Homo sapiens
tcttactgcttcatgtaatt

SEQ ID NO: 2286567 - DNA, 13 bp, Homo sapiens
tcttagtgaatgg

SEQ ID NO: 2286568 - DNA, 21 bp, Homo sapiens
tcttagtgttgcgtcctgcct

SEQ ID NO: 2286569 - DNA, 15 bp, Homo sapiens
tcttatcacacttgc

SEQ ID NO: 2286570 - DNA, 14 bp, Homo sapiens
tcttatccccagct

SEQ ID NO: 2286571 - DNA, 15 bp, Homo sapiens
tcttatccccagctg

SEQ ID NO: 2286572 - DNA, 16 bp, Homo sapiens
tcttatccccagctgt

SEQ ID NO: 2286573 - DNA, 17 bp, Homo sapiens
tcttatttatatatgaa

SEQ ID NO: 2286574 - DNA, 14 bp, Homo sapiens
tcttatttgaaagt

SEQ ID NO: 2286575 - DNA, 16 bp, Homo sapiens
tcttcaaccctgccct

SEQ ID NO: 2286576 - DNA, 19 bp, Homo sapiens
tcttcaaccctgccctgca

SEQ ID NO: 2286577 - DNA, 20 bp, Homo sapiens
tcttcaaccctgccctgcac

SEQ ID NO: 2286578 - DNA, 16 bp, Homo sapiens
tcttcacaatttagtt

SEQ ID NO: 2286579 - DNA, 18 bp, Homo sapiens
tcttcatggtctcttcca

SEQ ID NO: 2286580 - DNA, 17 bp, Homo sapiens
tcttccaagttcattca

SEQ ID NO: 2286581 - DNA, 13 bp, Homo sapiens
tcttcccatttgt

SEQ ID NO: 2286582 - DNA, 24 bp, Homo sapiens
tcttcccatttgtaatgtatctta

SEQ ID NO: 2286583 - DNA, 22 bp, Homo sapiens
tcttcctaaatttcattgtgtt

SEQ ID NO: 2286584 - DNA, 14 bp, Homo sapiens
tcttcctcaaaggg

SEQ ID NO: 2286585 - DNA, 19 bp, Homo sapiens
tcttcgatgtgcccagggg

SEQ ID NO: 2286586 - DNA, 20 bp, Homo sapiens
tcttctcttacgctctctgt

SEQ ID NO: 2286587 - DNA, 16 bp, Homo sapiens
tcttcttatcacactt

SEQ ID NO: 2286588 - DNA, 23 bp, Homo sapiens
tcttcttatcacacttgcaaatg

SEQ ID NO: 2286589 - DNA, 21 bp, Homo sapiens
tcttctttaaggaagaataaa

SEQ ID NO: 2286590 - DNA, 17 bp, Homo sapiens
tcttgaactcttggcct

SEQ ID NO: 2286591 - DNA, 18 bp, Homo sapiens
tcttgaactcttggcctc

SEQ ID NO: 2286592 - DNA, 13 bp, Homo sapiens
tcttgaagacttt

SEQ ID NO: 2286593 - DNA, 15 bp, Homo sapiens
tcttgagcaatgttt

SEQ ID NO: 2286594 - DNA, 20 bp, Homo sapiens
tcttgcggcaccgcccaccc

SEQ ID NO: 2286595 - DNA, 18 bp, Homo sapiens
tcttgctttcacaaatat

SEQ ID NO: 2286596 - DNA, 16 bp, Homo sapiens
tcttggatctttttgc

SEQ ID NO: 2286597 - DNA, 18 bp, Homo sapiens
tcttggccctattcatta

SEQ ID NO: 2286598 - DNA, 21 bp, Homo sapiens
tcttggcctgctagcggctga

SEQ ID NO: 2286599 - DNA, 22 bp, Homo sapiens
tcttgtaaataatgcttaacat

SEQ ID NO: 2286600 - DNA, 16 bp, Homo sapiens
tcttgtaccagcccag

SEQ ID NO: 2286601 - DNA, 18 bp, Homo sapiens
tcttgtaccagcccaggc

SEQ ID NO: 2286602 - DNA, 14 bp, Homo sapiens
tcttgtattttctt

SEQ ID NO: 2286603 - DNA, 18 bp, Homo sapiens
tcttgtattttcttccca

SEQ ID NO: 2286604 - DNA, 15 bp, Homo sapiens
tcttgtgttgttttc

SEQ ID NO: 2286605 - DNA, 21 bp, Homo sapiens
tcttgtttctccagattttta

SEQ ID NO: 2286606 - DNA, 16 bp, Homo sapiens
tctttaacatacatct

SEQ ID NO: 2286607 - DNA, 23 bp, Homo sapiens
tctttaaggaagaataaaaaaga

SEQ ID NO: 2286608 - DNA, 17 bp, Homo sapiens
tctttaggtctttgcct

SEQ ID NO: 2286609 - DNA, 19 bp, Homo sapiens
tctttattacacaaactat

SEQ ID NO: 2286610 - DNA, 14 bp, Homo sapiens
tctttcaccctgcc

SEQ ID NO: 2286611 - DNA, 21 bp, Homo sapiens
tctttcattaaaaagaataga

SEQ ID NO: 2286612 - DNA, 17 bp, Homo sapiens
tctttcctatttgcaca

SEQ ID NO: 2286613 - DNA, 15 bp, Homo sapiens
tctttccttcccaat

SEQ ID NO: 2286614 - DNA, 16 bp, Homo sapiens
tctttccttcccaata

SEQ ID NO: 2286615 - DNA, 11 bp, Homo sapiens
tctttcttttt

SEQ ID NO: 2286616 - DNA, 14 bp, Homo sapiens
tctttgaaggttta

SEQ ID NO: 2286617 - DNA, 15 bp, Homo sapiens
tctttgtacagacaa

SEQ ID NO: 2286618 - DNA, 21 bp, Homo sapiens
tcttttcagcttgtttctata

SEQ ID NO: 2286619 - DNA, 15 bp, Homo sapiens
tcttttctgaggttt

SEQ ID NO: 2286620 - DNA, 20 bp, Homo sapiens
cggctggccggtccaccccg

SEQ ID NO: 2286621 - DNA, 22 bp, Homo sapiens
cggctggccggtccaccccgtc

SEQ ID NO: 2286622 - DNA, 12 bp, Homo sapiens
cggctgggcagg

SEQ ID NO: 2286623 - DNA, 14 bp, Homo sapiens
cggctgggcagggc

SEQ ID NO: 2286624 - DNA, 17 bp, Homo sapiens
cggctgggcagggccgc

SEQ ID NO: 2286625 - DNA, 15 bp, Homo sapiens
cgggaaccctctggg

SEQ ID NO: 2286626 - DNA, 13 bp, Homo sapiens
cgggaaggcctga

SEQ ID NO: 2286627 - DNA, 20 bp, Homo sapiens
cgggaaggcctgagggaagc

SEQ ID NO: 2286628 - DNA, 19 bp, Homo sapiens
cgggaagggtgggccctgg

SEQ ID NO: 2286629 - DNA, 22 bp, Homo sapiens
cgggaagggtgggccctggagg

SEQ ID NO: 2286630 - DNA, 16 bp, Homo sapiens
cgggacaggacttgtg

SEQ ID NO: 2286631 - DNA, 22 bp, Homo sapiens
cgggactgtcttcaaccctgcc

SEQ ID NO: 2286632 - DNA, 23 bp, Homo sapiens
cgggactgtcttcaaccctgccc

SEQ ID NO: 2286633 - DNA, 14 bp, Homo sapiens
cgggagagcgccac

SEQ ID NO: 2286634 - DNA, 15 bp, Homo sapiens
cgggagagcgccacc

SEQ ID NO: 2286635 - DNA, 20 bp, Homo sapiens
cgggagagcgccacccgccc

SEQ ID NO: 2286636 - DNA, 19 bp, Homo sapiens
cgggagatccgccctgggc

SEQ ID NO: 2286637 - DNA, 19 bp, Homo sapiens
cgggcaacactcactgcct

SEQ ID NO: 2286638 - DNA, 14 bp, Homo sapiens
cgggcagcccctgc

SEQ ID NO: 2286639 - DNA, 17 bp, Homo sapiens
cgggcagcccctgctgg

SEQ ID NO: 2286640 - DNA, 22 bp, Homo sapiens
cgggcagtgacgtgagtgggga

SEQ ID NO: 2286641 - DNA, 17 bp, Homo sapiens
cgggcccgctcaacctc

SEQ ID NO: 2286642 - DNA, 18 bp, Homo sapiens
cgggcccgctcaacctct

SEQ ID NO: 2286643 - DNA, 13 bp, Homo sapiens
cgggccgcctcct

SEQ ID NO: 2286644 - DNA, 17 bp, Homo sapiens
cgggccgcctcctccag

SEQ ID NO: 2286645 - DNA, 18 bp, Homo sapiens
cgggccgcctcctccaga

SEQ ID NO: 2286646 - DNA, 20 bp, Homo sapiens
cgggccgcctcctccagact

SEQ ID NO: 2286647 - DNA, 21 bp, Homo sapiens
cgggccgcctcctccagactc

SEQ ID NO: 2286648 - DNA, 23 bp, Homo sapiens
cgggcctccccgggggtccccgg

SEQ ID NO: 2286649 - DNA, 23 bp, Homo sapiens
cgggcgagaagggcgcaggaacc

SEQ ID NO: 2286650 - DNA, 13 bp, Homo sapiens
cgggcgcccggac

SEQ ID NO: 2286651 - DNA, 16 bp, Homo sapiens
cgggcgcccggactga

SEQ ID NO: 2286652 - DNA, 12 bp, Homo sapiens
cgggcgcctgcg

SEQ ID NO: 2286653 - DNA, 19 bp, Homo sapiens
cgggcgcgggacaggactt

SEQ ID NO: 2286654 - DNA, 19 bp, Homo sapiens
cgggctaagtccagctctc

SEQ ID NO: 2286655 - DNA, 14 bp, Homo sapiens
cggggcagagctga

SEQ ID NO: 2286656 - DNA, 13 bp, Homo sapiens
cggggcaggaagt

SEQ ID NO: 2286657 - DNA, 11 bp, Homo sapiens
cggggctggcc

SEQ ID NO: 2286658 - DNA, 16 bp, Homo sapiens
cggggctggccctgcc

SEQ ID NO: 2286659 - DNA, 20 bp, Homo sapiens
cggggctggccctgccctcc

SEQ ID NO: 2286660 - DNA, 15 bp, Homo sapiens
cgggggaggagcacc

SEQ ID NO: 2286661 - DNA, 16 bp, Homo sapiens
cgggggaggagcaccc

SEQ ID NO: 2286662 - DNA, 23 bp, Homo sapiens
cgggggaggagcacccccagcct

SEQ ID NO: 2286663 - DNA, 16 bp, Homo sapiens
cgggggcggctctggg

SEQ ID NO: 2286664 - DNA, 17 bp, Homo sapiens
cgggggctaactggccc

SEQ ID NO: 2286665 - DNA, 19 bp, Homo sapiens
cgggggctaactggcccca

SEQ ID NO: 2286666 - DNA, 22 bp, Homo sapiens
cgggggctaactggccccaggc

SEQ ID NO: 2286667 - DNA, 22 bp, Homo sapiens
cgggggtccccggacgctggct

SEQ ID NO: 2286668 - DNA, 21 bp, Homo sapiens
cggggtcgggggaggagcacc

SEQ ID NO: 2286669 - DNA, 11 bp, Homo sapiens
cgggtgcctgt

SEQ ID NO: 2286670 - DNA, 12 bp, Homo sapiens
cgggtgtggctc

SEQ ID NO: 2286671 - DNA, 14 bp, Homo sapiens
cggtatccagaggt

SEQ ID NO: 2286672 - DNA, 12 bp, Homo sapiens
cggtgtgaggag

SEQ ID NO: 2286673 - DNA, 13 bp, Homo sapiens
cgtaatggggact

SEQ ID NO: 2286674 - DNA, 12 bp, Homo sapiens
cgtagggccagg

SEQ ID NO: 2286675 - DNA, 15 bp, Homo sapiens
cgtagggccagggct

SEQ ID NO: 2286676 - DNA, 15 bp, Homo sapiens
cgtcaatgtgaaata

SEQ ID NO: 2286677 - DNA, 13 bp, Homo sapiens
cgtcatcttccct

SEQ ID NO: 2286678 - DNA, 11 bp, Homo sapiens
cgtccccaggg

SEQ ID NO: 2286679 - DNA, 19 bp, Homo sapiens
cgtccccagggtgcaggcg

SEQ ID NO: 2286680 - DNA, 12 bp, Homo sapiens
cgtcccggcccc

SEQ ID NO: 2286681 - DNA, 19 bp, Homo sapiens
cgtccgcccgcccaccccg

SEQ ID NO: 2286682 - DNA, 20 bp, Homo sapiens
cgtccgcccgcccaccccgc

SEQ ID NO: 2286683 - DNA, 16 bp, Homo sapiens
cgtccgtccgcccgcc

SEQ ID NO: 2286684 - DNA, 10 bp, Homo sapiens
cgtctgcccc

SEQ ID NO: 2286685 - DNA, 11 bp, Homo sapiens
cgtctgcccct

SEQ ID NO: 2286686 - DNA, 14 bp, Homo sapiens
cgtctgctgttgat

SEQ ID NO: 2286687 - DNA, 17 bp, Homo sapiens
cgtctttagatgctatt

SEQ ID NO: 2286688 - DNA, 14 bp, Homo sapiens
cgtctttttccaaa

SEQ ID NO: 2286689 - DNA, 11 bp, Homo sapiens
cgtgaacaaac

SEQ ID NO: 2286690 - DNA, 16 bp, Homo sapiens
cgtgagtcctggcatg

SEQ ID NO: 2286691 - DNA, 19 bp, Homo sapiens
cgtgcacggggccagcatc

SEQ ID NO: 2286692 - DNA, 17 bp, Homo sapiens
cgtgccaaatcctgggc

SEQ ID NO: 2286693 - DNA, 16 bp, Homo sapiens
cgtgccttccccgtgc

SEQ ID NO: 2286694 - DNA, 22 bp, Homo sapiens
cgtgcgcagccgcgctctgccc

SEQ ID NO: 2286695 - DNA, 19 bp, Homo sapiens
cgtgcggcccgtgcgcagc

SEQ ID NO: 2286696 - DNA, 22 bp, Homo sapiens
cgtgcggcccgtgcgcagccgc

SEQ ID NO: 2286697 - DNA, 12 bp, Homo sapiens
cgtggcctgggg

SEQ ID NO: 2286698 - DNA, 17 bp, Homo sapiens
cgtggctgcttcaagga

SEQ ID NO: 2286699 - DNA, 19 bp, Homo sapiens
cgtggggctaacgggcgcc

SEQ ID NO: 2286700 - DNA, 14 bp, Homo sapiens
cgtggtgtgaggcc

SEQ ID NO: 2286701 - DNA, 15 bp, Homo sapiens
cgtggtgtgaggccc

SEQ ID NO: 2286702 - DNA, 13 bp, Homo sapiens
cgtgtgcccactg

SEQ ID NO: 2286703 - DNA, 22 bp, Homo sapiens
cgtgtgcccactgaacatgctc

SEQ ID NO: 2286704 - DNA, 21 bp, Homo sapiens
cgtgttattttaatctcagaa

SEQ ID NO: 2286705 - DNA, 17 bp, Homo sapiens
cgtgttcgctggctgat

SEQ ID NO: 2286706 - DNA, 14 bp, Homo sapiens
cgttaagggcagag

SEQ ID NO: 2286707 - DNA, 19 bp, Homo sapiens
cgtttaatggtatctgtta

SEQ ID NO: 2286708 - DNA, 15 bp, Homo sapiens
cgtttcacatctgta

SEQ ID NO: 2286709 - DNA, 14 bp, Homo sapiens
ctaaaaaataactg

SEQ ID NO: 2286710 - DNA, 18 bp, Homo sapiens
ctaaaaaataactgtgca

SEQ ID NO: 2286711 - DNA, 16 bp, Homo sapiens
ctaaaaacattttaaa

SEQ ID NO: 2286712 - DNA, 18 bp, Homo sapiens
ctaaaaacattttaaaat

SEQ ID NO: 2286713 - DNA, 21 bp, Homo sapiens
ctaaaatagtttaaaaatatt

SEQ ID NO: 2286714 - DNA, 15 bp, Homo sapiens
ctaaaattcaacaaa

SEQ ID NO: 2286715 - DNA, 17 bp, Homo sapiens
ctaaaattcaacaaatg

SEQ ID NO: 2286716 - DNA, 19 bp, Homo sapiens
ctaaaattcaacaaatgat

SEQ ID NO: 2286717 - DNA, 19 bp, Homo sapiens
ctaaactaaaatagtttaa

SEQ ID NO: 2286718 - DNA, 12 bp, Homo sapiens
ctaaagacagaa

SEQ ID NO: 2286719 - DNA, 13 bp, Homo sapiens
ctaaagcagagat

SEQ ID NO: 2286720 - DNA, 21 bp, Homo sapiens
ctaaataatgatcttccaaat

SEQ ID NO: 2286721 - DNA, 14 bp, Homo sapiens
ctaaatgtttcttt

SEQ ID NO: 2286722 - DNA, 18 bp, Homo sapiens
ctaaatgtttctttttct

SEQ ID NO: 2286723 - DNA, 13 bp, Homo sapiens
ctaaatttgggga

SEQ ID NO: 2286724 - DNA, 18 bp, Homo sapiens
ctaaatttggggacagat

SEQ ID NO: 2286725 - DNA, 15 bp, Homo sapiens
ctaactggccccagg

SEQ ID NO: 2286726 - DNA, 16 bp, Homo sapiens
ctaactggccccaggc

SEQ ID NO: 2286727 - DNA, 13 bp, Homo sapiens
ctaagaataaata

SEQ ID NO: 2286728 - DNA, 16 bp, Homo sapiens
ctaagaataaataaag

SEQ ID NO: 2286729 - DNA, 17 bp, Homo sapiens
ctaagaataaataaaga

SEQ ID NO: 2286730 - DNA, 22 bp, Homo sapiens
ctaagaataaataaagaagaaa

SEQ ID NO: 2286731 - DNA, 15 bp, Homo sapiens
ctaagaatataaata

SEQ ID NO: 2286732 - DNA, 12 bp, Homo sapiens
ctaagattgtac

SEQ ID NO: 2286733 - DNA, 14 bp, Homo sapiens
ctaagattgtacat

SEQ ID NO: 2286734 - DNA, 15 bp, Homo sapiens
ctaagcttatttcta

SEQ ID NO: 2286735 - DNA, 22 bp, Homo sapiens
ctaaggcaggtgggcagacagt

SEQ ID NO: 2286736 - DNA, 14 bp, Homo sapiens
ctaagggatccaga

SEQ ID NO: 2286737 - DNA, 21 bp, Homo sapiens
ctaagtggaagacagagatgg

SEQ ID NO: 2286738 - DNA, 21 bp, Homo sapiens
ctaatacagccccttttccct

SEQ ID NO: 2286739 - DNA, 16 bp, Homo sapiens
ctaataccaactattt

SEQ ID NO: 2286740 - DNA, 18 bp, Homo sapiens
ctaataccaactatttca

SEQ ID NO: 2286741 - DNA, 20 bp, Homo sapiens
ctaataccaactatttcaat

SEQ ID NO: 2286742 - DNA, 22 bp, Homo sapiens
ctaatggccaagtgtacatttg

SEQ ID NO: 2286743 - DNA, 17 bp, Homo sapiens
ctaatgggctgctgtca

SEQ ID NO: 2286744 - DNA, 12 bp, Homo sapiens
ctaatttttcct

SEQ ID NO: 2286745 - DNA, 13 bp, Homo sapiens
ctacaagggaagc

SEQ ID NO: 2286746 - DNA, 18 bp, Homo sapiens
ctacaggaaatacagaga

SEQ ID NO: 2286747 - DNA, 23 bp, Homo sapiens
ctacagtagctgtggggagctgg

SEQ ID NO: 2286748 - DNA, 11 bp, Homo sapiens
ctacagtattt

SEQ ID NO: 2286749 - DNA, 15 bp, Homo sapiens
ctacattaaaagctt

SEQ ID NO: 2286750 - DNA, 18 bp, Homo sapiens
ctaccaaatataaacttg

SEQ ID NO: 2286751 - DNA, 13 bp, Homo sapiens
ctaccaggaagag

SEQ ID NO: 2286752 - DNA, 21 bp, Homo sapiens
ctaccctcagtctacactcac

SEQ ID NO: 2286753 - DNA, 14 bp, Homo sapiens
ctaccctgcacatt

SEQ ID NO: 2286754 - DNA, 19 bp, Homo sapiens
ctacgatgggatcattatt

SEQ ID NO: 2286755 - DNA, 21 bp, Homo sapiens
ctactaagaataaataaagaa

SEQ ID NO: 2286756 - DNA, 19 bp, Homo sapiens
ctactgccaacctcgctcc

SEQ ID NO: 2286757 - DNA, 23 bp, Homo sapiens
ctactgccaacctcgctccaact

SEQ ID NO: 2286758 - DNA, 14 bp, Homo sapiens
ctacttgatataat

SEQ ID NO: 2286759 - DNA, 13 bp, Homo sapiens
ctactttcctgat

SEQ ID NO: 2286760 - DNA, 16 bp, Homo sapiens
ctagaacaagccagag

SEQ ID NO: 2286761 - DNA, 17 bp, Homo sapiens
ctagaacaagccagagc

SEQ ID NO: 2286762 - DNA, 19 bp, Homo sapiens
ctagaacaagccagagccg

SEQ ID NO: 2286763 - DNA, 15 bp, Homo sapiens
ctagaaccaagcact

SEQ ID NO: 2286764 - DNA, 19 bp, Homo sapiens
ctagaagcctaagaactgt

SEQ ID NO: 2286765 - DNA, 21 bp, Homo sapiens
ctagaagtcttcatggtctct

SEQ ID NO: 2286766 - DNA, 14 bp, Homo sapiens
ctagaatgagaaat

SEQ ID NO: 2286767 - DNA, 16 bp, Homo sapiens
ctagaatgagaaatca

SEQ ID NO: 2286768 - DNA, 17 bp, Homo sapiens
ctagaatgagaaatcat

SEQ ID NO: 2286769 - DNA, 19 bp, Homo sapiens
ctagatggatattagatgc

SEQ ID NO: 2286770 - DNA, 22 bp, Homo sapiens
ctagcaaacaaaaatagaatat

SEQ ID NO: 2286771 - DNA, 23 bp, Homo sapiens
ctagcaaacaaaaatagaatata

SEQ ID NO: 2286772 - DNA, 14 bp, Homo sapiens
ctagcaactgttgg

SEQ ID NO: 2286773 - DNA, 17 bp, Homo sapiens
ctagcaagaagattcta

SEQ ID NO: 2286774 - DNA, 13 bp, Homo sapiens
ctagcagccctaa

SEQ ID NO: 2286775 - DNA, 22 bp, Homo sapiens
ctagcctagaacaagccagagc

SEQ ID NO: 2286776 - DNA, 23 bp, Homo sapiens
ctagcctagaacaagccagagcc

SEQ ID NO: 2286777 - DNA, 17 bp, Homo sapiens
ctagctataacaactct

SEQ ID NO: 2286778 - DNA, 23 bp, Homo sapiens
ctaggtgcacatatacatctagc

SEQ ID NO: 2286779 - DNA, 22 bp, Homo sapiens
ctagtactgtgtactgtataga

SEQ ID NO: 2286780 - DNA, 18 bp, Homo sapiens
ctagtagagcaaagactt

SEQ ID NO: 2286781 - DNA, 17 bp, Homo sapiens
ctagtcaactgctgttt

SEQ ID NO: 2286782 - DNA, 13 bp, Homo sapiens
ctagtctctgatt

SEQ ID NO: 2286783 - DNA, 23 bp, Homo sapiens
ctagtctctgatttgcaaatgca

SEQ ID NO: 2286784 - DNA, 21 bp, Homo sapiens
ctagtgatacactgtatctaa

SEQ ID NO: 2286785 - DNA, 19 bp, Homo sapiens
ctagtggcttcagcccctg

SEQ ID NO: 2286786 - DNA, 17 bp, Homo sapiens
ctagttagcaggaaata

SEQ ID NO: 2286787 - DNA, 16 bp, Homo sapiens
ctagtttcctggttcc

SEQ ID NO: 2286788 - DNA, 12 bp, Homo sapiens
ctagtttgcata

SEQ ID NO: 2286789 - DNA, 13 bp, Homo sapiens
ctataaaatgagg

SEQ ID NO: 2286790 - DNA, 21 bp, Homo sapiens
ctataaattcaacacttattt

SEQ ID NO: 2286791 - DNA, 15 bp, Homo sapiens
ctataaattgtagaa

SEQ ID NO: 2286792 - DNA, 18 bp, Homo sapiens
ctataacaactctatttt

SEQ ID NO: 2286793 - DNA, 18 bp, Homo sapiens
ctataagagacaaagttt

SEQ ID NO: 2286794 - DNA, 22 bp, Homo sapiens
ctataagagacaaagtttggaa

SEQ ID NO: 2286795 - DNA, 23 bp, Homo sapiens
ctataagggagtaggctgtattt

SEQ ID NO: 2286796 - DNA, 22 bp, Homo sapiens
ctataatttacctgaagtcttt

SEQ ID NO: 2286797 - DNA, 20 bp, Homo sapiens
ctatatatatatatatatgt

SEQ ID NO: 2286798 - DNA, 16 bp, Homo sapiens
ctatatttcatattga

SEQ ID NO: 2286799 - DNA, 16 bp, Homo sapiens
ctatatttttatataa

SEQ ID NO: 2286800 - DNA, 18 bp, Homo sapiens
ctatatttttatataata

SEQ ID NO: 2286801 - DNA, 16 bp, Homo sapiens
ctatctatgtcctgga

SEQ ID NO: 2286802 - DNA, 12 bp, Homo sapiens
ctatctgctggg

SEQ ID NO: 2286803 - DNA, 16 bp, Homo sapiens
ctatctgctgggctgg

SEQ ID NO: 2286804 - DNA, 13 bp, Homo sapiens
ctatgaactagag

SEQ ID NO: 2286805 - DNA, 19 bp, Homo sapiens
ctatgagacctcccccagg

SEQ ID NO: 2286806 - DNA, 20 bp, Homo sapiens
ctatgagacctcccccaggg

SEQ ID NO: 2286807 - DNA, 22 bp, Homo sapiens
ctatgagacctcccccagggag

SEQ ID NO: 2286808 - DNA, 14 bp, Homo sapiens
ctatgcctccattt

SEQ ID NO: 2286809 - DNA, 19 bp, Homo sapiens
ctatggaaatacatttaga

SEQ ID NO: 2286810 - DNA, 14 bp, Homo sapiens
ctatggtgtgctta

SEQ ID NO: 2286811 - DNA, 18 bp, Homo sapiens
ctatgtaagggctttaaa

SEQ ID NO: 2286812 - DNA, 23 bp, Homo sapiens
ctatgtactagtactgtgtactg

SEQ ID NO: 2286813 - DNA, 19 bp, Homo sapiens
ctatgtagaactgttcatt

SEQ ID NO: 2286814 - DNA, 17 bp, Homo sapiens
ctatgtgtcatgatttc

SEQ ID NO: 2286815 - DNA, 12 bp, Homo sapiens
ctattaaattcc

SEQ ID NO: 2286816 - DNA, 13 bp, Homo sapiens
ctattatctgggt

SEQ ID NO: 2286817 - DNA, 15 bp, Homo sapiens
ctattatctgggttt

SEQ ID NO: 2286818 - DNA, 20 bp, Homo sapiens
ctattatctgggttttagaa

SEQ ID NO: 2286819 - DNA, 22 bp, Homo sapiens
ctattcattacatcctctgctt

SEQ ID NO: 2286820 - DNA, 23 bp, Homo sapiens
ctatttagataacaagaatacaa

SEQ ID NO: 2286821 - DNA, 18 bp, Homo sapiens
ctattttataagggcact

SEQ ID NO: 2286822 - DNA, 20 bp, Homo sapiens
ctcaaagaggccagtacttt

SEQ ID NO: 2286823 - DNA, 15 bp, Homo sapiens
ctcaaataataataa

SEQ ID NO: 2286824 - DNA, 16 bp, Homo sapiens
ctcaaatgctaaatgc

SEQ ID NO: 2286825 - DNA, 12 bp, Homo sapiens
ctcaacctctca

SEQ ID NO: 2286826 - DNA, 13 bp, Homo sapiens
ctcaacctctcag

SEQ ID NO: 2286827 - DNA, 17 bp, Homo sapiens
ctcaaggaagagccagc

SEQ ID NO: 2286828 - DNA, 18 bp, Homo sapiens
ctcaagtttatgtctcag

SEQ ID NO: 2286829 - DNA, 12 bp, Homo sapiens
ctcaatgcatga

SEQ ID NO: 2286830 - DNA, 15 bp, Homo sapiens
ctcaatgcatgatga

SEQ ID NO: 2286831 - DNA, 19 bp, Homo sapiens
ctcaattcatatttatgaa

SEQ ID NO: 2286832 - DNA, 15 bp, Homo sapiens
ctcacaaaaggctgg

SEQ ID NO: 2286833 - DNA, 19 bp, Homo sapiens
ctcacaactgtttttgaag

SEQ ID NO: 2286834 - DNA, 20 bp, Homo sapiens
ctcacaactgtttttgaaga

SEQ ID NO: 2286835 - DNA, 19 bp, Homo sapiens
ctcacaatcatcttctccc

SEQ ID NO: 2286836 - DNA, 20 bp, Homo sapiens
ctcacaatcatcttctccca

SEQ ID NO: 2286837 - DNA, 18 bp, Homo sapiens
ctcacaccgcaccgggct

SEQ ID NO: 2286838 - DNA, 13 bp, Homo sapiens
ctcacatcatgta

SEQ ID NO: 2286839 - DNA, 17 bp, Homo sapiens
ctcacatgctccttgcc

SEQ ID NO: 2286840 - DNA, 14 bp, Homo sapiens
ctcacatgtggctc

SEQ ID NO: 2286841 - DNA, 13 bp, Homo sapiens
ctcacccctgcag

SEQ ID NO: 2286842 - DNA, 13 bp, Homo sapiens
ctcacgctcagca

SEQ ID NO: 2286843 - DNA, 16 bp, Homo sapiens
ctcactagtttttcct

SEQ ID NO: 2286844 - DNA, 21 bp, Homo sapiens
ctcactagtttttcctgtgca

SEQ ID NO: 2286845 - DNA, 16 bp, Homo sapiens
ctcactcagcaccact

SEQ ID NO: 2286846 - DNA, 21 bp, Homo sapiens
ctcactctgttgaccaggctg

SEQ ID NO: 2286847 - DNA, 12 bp, Homo sapiens
ctcactgcagcc

SEQ ID NO: 2286848 - DNA, 13 bp, Homo sapiens
ctcactgcagcct

SEQ ID NO: 2286849 - DNA, 14 bp, Homo sapiens
ctcactgcagcctc

SEQ ID NO: 2286850 - DNA, 19 bp, Homo sapiens
ctcactgcctgcagctgag

SEQ ID NO: 2286851 - DNA, 16 bp, Homo sapiens
ctcactgtgttgccca

SEQ ID NO: 2286852 - DNA, 19 bp, Homo sapiens
ctcactgtgttgcccaggc

SEQ ID NO: 2286853 - DNA, 21 bp, Homo sapiens
ctcactgtgttgcccaggctg

SEQ ID NO: 2286854 - DNA, 11 bp, Homo sapiens
ctcagagtcca

SEQ ID NO: 2286855 - DNA, 15 bp, Homo sapiens
ctcagagtccaatgt

SEQ ID NO: 2286856 - DNA, 22 bp, Homo sapiens
ctcagatccctcggtcagcacc

SEQ ID NO: 2286857 - DNA, 23 bp, Homo sapiens
ctcagatccctcggtcagcaccg

SEQ ID NO: 2286858 - DNA, 18 bp, Homo sapiens
ctcagattccccccatct

SEQ ID NO: 2286859 - DNA, 21 bp, Homo sapiens
ctcagcacacatgcatcctcc

SEQ ID NO: 2286860 - DNA, 12 bp, Homo sapiens
ctcagcacagcc

SEQ ID NO: 2286861 - DNA, 20 bp, Homo sapiens
ctcagcacagcctcacccct

SEQ ID NO: 2286862 - DNA, 21 bp, Homo sapiens
ctcagcacagcctcacccctg

SEQ ID NO: 2286863 - DNA, 13 bp, Homo sapiens
ctcagcaccactc

SEQ ID NO: 2286864 - DNA, 14 bp, Homo sapiens
ctcagcaccactca

SEQ ID NO: 2286865 - DNA, 18 bp, Homo sapiens
ctcagcaccactcaagac

SEQ ID NO: 2286866 - DNA, 15 bp, Homo sapiens
ctcaggcccacattg

SEQ ID NO: 2286867 - DNA, 22 bp, Homo sapiens
ctcaggcccacattgcccacac

SEQ ID NO: 2286868 - DNA, 15 bp, Homo sapiens
ctcaggctccccaag

SEQ ID NO: 2286869 - DNA, 13 bp, Homo sapiens
ctcaggctttttc

SEQ ID NO: 2286870 - DNA, 14 bp, Homo sapiens
ctcaggtgaataac

SEQ ID NO: 2286871 - DNA, 14 bp, Homo sapiens
ctcagtcccacagc

SEQ ID NO: 2286872 - DNA, 16 bp, Homo sapiens
ctcagtcccacagccc

SEQ ID NO: 2286873 - DNA, 19 bp, Homo sapiens
ctcagttcttggcctgcta

SEQ ID NO: 2286874 - DNA, 15 bp, Homo sapiens
ctcagtttttttcct

SEQ ID NO: 2286875 - DNA, 15 bp, Homo sapiens
ctcatccccaaactg

SEQ ID NO: 2286876 - DNA, 22 bp, Homo sapiens
ctcatctagtttgatgactaaa

SEQ ID NO: 2286877 - DNA, 15 bp, Homo sapiens
ctcatgggagtcagg

SEQ ID NO: 2286878 - DNA, 14 bp, Homo sapiens
ctcatgtatttaaa

SEQ ID NO: 2286879 - DNA, 19 bp, Homo sapiens
ctcattacagatttagttt

SEQ ID NO: 2286880 - DNA, 15 bp, Homo sapiens
ctcattatgaagatg

SEQ ID NO: 2286881 - DNA, 18 bp, Homo sapiens
ctcattatgaagatgttt

SEQ ID NO: 2286882 - DNA, 20 bp, Homo sapiens
ctcattatgaagatgttttt

SEQ ID NO: 2286883 - DNA, 20 bp, Homo sapiens
ctcattgtagagcacattta

SEQ ID NO: 2286884 - DNA, 22 bp, Homo sapiens
ctcatttagcattgaaataata

SEQ ID NO: 2286885 - DNA, 11 bp, Homo sapiens
ctccaaagctt

SEQ ID NO: 2286886 - DNA, 15 bp, Homo sapiens
ctccaacctggaggc

SEQ ID NO: 2286887 - DNA, 18 bp, Homo sapiens
ctccaacctggaggctgg

SEQ ID NO: 2286888 - DNA, 19 bp, Homo sapiens
ctccaacctggaggctgga

SEQ ID NO: 2286889 - DNA, 23 bp, Homo sapiens
ctccaacctggaggctggaccaa

SEQ ID NO: 2286890 - DNA, 12 bp, Homo sapiens
ctccaactccaa

SEQ ID NO: 2286891 - DNA, 14 bp, Homo sapiens
ctccaagtcatggg

SEQ ID NO: 2286892 - DNA, 18 bp, Homo sapiens
ctccacctgggagatgct

SEQ ID NO: 2286893 - DNA, 22 bp, Homo sapiens
ctccagaacaaacctctatatg

SEQ ID NO: 2286894 - DNA, 21 bp, Homo sapiens
ctccagaatttcccaaagcag

SEQ ID NO: 2286895 - DNA, 19 bp, Homo sapiens
ctccagactcgagagggct

SEQ ID NO: 2286896 - DNA, 16 bp, Homo sapiens
ctccagatcctctttc

SEQ ID NO: 2286897 - DNA, 15 bp, Homo sapiens
ctccagattattttc

SEQ ID NO: 2286898 - DNA, 18 bp, Homo sapiens
ctccagattattttctat

SEQ ID NO: 2286899 - DNA, 13 bp, Homo sapiens
ctccagcctgggc

SEQ ID NO: 2286900 - DNA, 14 bp, Homo sapiens
ctccagctcctgcc

SEQ ID NO: 2286901 - DNA, 16 bp, Homo sapiens
ctccaggaaaactgtt

SEQ ID NO: 2286902 - DNA, 24 bp, Homo sapiens
ctccaggagcagcgtgcaggagca

SEQ ID NO: 2286903 - DNA, 19 bp, Homo sapiens
ctccaggggctggggactt

SEQ ID NO: 2286904 - DNA, 14 bp, Homo sapiens
ctccagtgttttct

SEQ ID NO: 2286905 - DNA, 17 bp, Homo sapiens
ctccagtgttttcttgt

SEQ ID NO: 2286906 - DNA, 19 bp, Homo sapiens
ctccatctcttgtaccagc

SEQ ID NO: 2286907 - DNA, 20 bp, Homo sapiens
ctccatctcttgtaccagcc

SEQ ID NO: 2286908 - DNA, 23 bp, Homo sapiens
ctccatctcttgtaccagcccag

SEQ ID NO: 2286909 - DNA, 14 bp, Homo sapiens
ctccatgctctttc

SEQ ID NO: 2286910 - DNA, 22 bp, Homo sapiens
ctccatgtaccttgtgtacttt

SEQ ID NO: 2286911 - DNA, 12 bp, Homo sapiens
ctccatgtctgt

SEQ ID NO: 2286912 - DNA, 23 bp, Homo sapiens
ctccatgttagtaatggcagagc

SEQ ID NO: 2286913 - DNA, 19 bp, Homo sapiens
ctcccaagactgctccctt

SEQ ID NO: 2286914 - DNA, 16 bp, Homo sapiens
ctcccaggacgcaggg

SEQ ID NO: 2286915 - DNA, 22 bp, Homo sapiens
ctcccaggacgcagggagaccc

SEQ ID NO: 2286916 - DNA, 23 bp, Homo sapiens
ctcccaggacgcagggagaccct

SEQ ID NO: 2286917 - DNA, 19 bp, Homo sapiens
ctcccagtaatttttctta

SEQ ID NO: 2286918 - DNA, 16 bp, Homo sapiens
ctccccaagacttgac

SEQ ID NO: 2286919 - DNA, 12 bp, Homo sapiens
ctccccacaccc

SEQ ID NO: 2286920 - DNA, 16 bp, Homo sapiens
ctccccacaccctgga

SEQ ID NO: 2286921 - DNA, 17 bp, Homo sapiens
ctccccacaccctggag

SEQ ID NO: 2286922 - DNA, 22 bp, Homo sapiens
ctcccccacggccgtccctgac

SEQ ID NO: 2286923 - DNA, 13 bp, Homo sapiens
ctcccccaggctg

SEQ ID NO: 2286924 - DNA, 21 bp, Homo sapiens
ctccccgcccgccctcctctg

SEQ ID NO: 2286925 - DNA, 14 bp, Homo sapiens
ctccccgcctcctc

SEQ ID NO: 2286926 - DNA, 19 bp, Homo sapiens
ctcccctcttcttgcggca

SEQ ID NO: 2286927 - DNA, 18 bp, Homo sapiens
ctccccttaaaatgtcta

SEQ ID NO: 2286928 - DNA, 16 bp, Homo sapiens
ctcccgccccagcctc

SEQ ID NO: 2286929 - DNA, 19 bp, Homo sapiens
ctcccgccccagcctcctg

SEQ ID NO: 2286930 - DNA, 21 bp, Homo sapiens
ctcccgccccagcctcctgag

SEQ ID NO: 2286931 - DNA, 17 bp, Homo sapiens
ctcccgccgcctcgggc

SEQ ID NO: 2286932 - DNA, 14 bp, Homo sapiens
ctcccgcttcctcc

SEQ ID NO: 2286933 - DNA, 16 bp, Homo sapiens
ctcccgcttcctccgg

SEQ ID NO: 2286934 - DNA, 16 bp, Homo sapiens
ctccctggactctgtg

SEQ ID NO: 2286935 - DNA, 19 bp, Homo sapiens
ctccctgtaatgcactcct

SEQ ID NO: 2286936 - DNA, 23 bp, Homo sapiens
ctccctgtaatgcactcctgccc

SEQ ID NO: 2286937 - DNA, 14 bp, Homo sapiens
ctccgactccccct

SEQ ID NO: 2286938 - DNA, 16 bp, Homo sapiens
ctccgactccccctcc

SEQ ID NO: 2286939 - DNA, 12 bp, Homo sapiens
ctccggcagagg

SEQ ID NO: 2286940 - DNA, 19 bp, Homo sapiens
ctccggcagaggcagggcc

SEQ ID NO: 2286941 - DNA, 20 bp, Homo sapiens
ctccggcagaggcagggccc

SEQ ID NO: 2286942 - DNA, 23 bp, Homo sapiens
ctccggcagaggcagggccctgg

SEQ ID NO: 2286943 - DNA, 21 bp, Homo sapiens
ctccggctggacctggggtcc

SEQ ID NO: 2286944 - DNA, 22 bp, Homo sapiens
ctccgggtgcgtgaccggcccg

SEQ ID NO: 2286945 - DNA, 14 bp, Homo sapiens
ctccgtccccaggg

SEQ ID NO: 2286946 - DNA, 14 bp, Homo sapiens
ctccgtcctggcag

SEQ ID NO: 2286947 - DNA, 17 bp, Homo sapiens
ctcctcagcagcctcac

SEQ ID NO: 2286948 - DNA, 14 bp, Homo sapiens
ctcctccagctcct

SEQ ID NO: 2286949 - DNA, 20 bp, Homo sapiens
ctcctcggctggctgtccac

SEQ ID NO: 2286950 - DNA, 22 bp, Homo sapiens
ctcctcggctggctgtccaccc

SEQ ID NO: 2286951 - DNA, 16 bp, Homo sapiens
ctcctcgggcgcctgc

SEQ ID NO: 2286952 - DNA, 20 bp, Homo sapiens
ctcctcgggcgcctgcgctc

SEQ ID NO: 2286953 - DNA, 21 bp, Homo sapiens
ctcctcgggcgcctgcgctcc

SEQ ID NO: 2286954 - DNA, 15 bp, Homo sapiens
ctcctcgtccggcct

SEQ ID NO: 2286955 - DNA, 18 bp, Homo sapiens
ctcctctgcagcctgagc

SEQ ID NO: 2286956 - DNA, 20 bp, Homo sapiens
ctcctctgcagcctgagctc

SEQ ID NO: 2286957 - DNA, 12 bp, Homo sapiens
ctcctctgcccc

SEQ ID NO: 2286958 - DNA, 16 bp, Homo sapiens
ctcctctgccccctcc

SEQ ID NO: 2286959 - DNA, 22 bp, Homo sapiens
ctcctctgccccctcccccgca

SEQ ID NO: 2286960 - DNA, 15 bp, Homo sapiens
ctcctgacaccccac

SEQ ID NO: 2286961 - DNA, 14 bp, Homo sapiens
ctcctgatttttct

SEQ ID NO: 2286962 - DNA, 15 bp, Homo sapiens
ctcctgccccggccc

SEQ ID NO: 2286963 - DNA, 20 bp, Homo sapiens
ctcctgccccggcccaacct

SEQ ID NO: 2286964 - DNA, 19 bp, Homo sapiens
ctcctgcgtgttctcagag

SEQ ID NO: 2286965 - DNA, 22 bp, Homo sapiens
ctcctgggccccagaaagcctc

SEQ ID NO: 2286966 - DNA, 23 bp, Homo sapiens
ctccttggtgtcgggcatgacac

SEQ ID NO: 2286967 - DNA, 14 bp, Homo sapiens
ctccttgtacttga

SEQ ID NO: 2286968 - DNA, 13 bp, Homo sapiens
ctcctttctaagg

SEQ ID NO: 2286969 - DNA, 21 bp, Homo sapiens
ctcgaagttgatctccccagc

SEQ ID NO: 2286970 - DNA, 14 bp, Homo sapiens
ctcgacctccctgg

SEQ ID NO: 2286971 - DNA, 16 bp, Homo sapiens
ctcgacctccctggct

SEQ ID NO: 2286972 - DNA, 15 bp, Homo sapiens
ctcgagagggctgag

SEQ ID NO: 2286973 - DNA, 16 bp, Homo sapiens
ctcgagagggctgagc

SEQ ID NO: 2286974 - DNA, 14 bp, Homo sapiens
ctcgagcagagaga

SEQ ID NO: 2286975 - DNA, 12 bp, Homo sapiens
ctcgcaccccca

SEQ ID NO: 2286976 - DNA, 22 bp, Homo sapiens
ctcgccctctctcaccagcctt

SEQ ID NO: 2286977 - DNA, 20 bp, Homo sapiens
ctcgcctcaggctttttcca

SEQ ID NO: 2286978 - DNA, 16 bp, Homo sapiens
ctcgctccaactccaa

SEQ ID NO: 2286979 - DNA, 13 bp, Homo sapiens
ctcggccagagct

SEQ ID NO: 2286980 - DNA, 18 bp, Homo sapiens
ctcggccagagctcccag

SEQ ID NO: 2286981 - DNA, 23 bp, Homo sapiens
ctcgggaaggcctgagggaagcc

SEQ ID NO: 2286982 - DNA, 20 bp, Homo sapiens
ctcgggccgcctcctccaga

SEQ ID NO: 2286983 - DNA, 21 bp, Homo sapiens
ctcgggccgcctcctccagac

SEQ ID NO: 2286984 - DNA, 14 bp, Homo sapiens
ctcggtcagcaccg

SEQ ID NO: 2286985 - DNA, 15 bp, Homo sapiens
ctcgtactttcacat

SEQ ID NO: 2286986 - DNA, 13 bp, Homo sapiens
ctcgtccggcctg

SEQ ID NO: 2286987 - DNA, 14 bp, Homo sapiens
ctctaaaattctag

SEQ ID NO: 2286988 - DNA, 22 bp, Homo sapiens
ctctagaaaggggattacagtt

SEQ ID NO: 2286989 - DNA, 13 bp, Homo sapiens
ctctagagaacat

SEQ ID NO: 2286990 - DNA, 17 bp, Homo sapiens
ctctatctgctgggctg

SEQ ID NO: 2286991 - DNA, 14 bp, Homo sapiens
ctctattttttact

SEQ ID NO: 2286992 - DNA, 12 bp, Homo sapiens
ctctcaccagcc

SEQ ID NO: 2286993 - DNA, 14 bp, Homo sapiens
ctctcaccagcctt

SEQ ID NO: 2286994 - DNA, 13 bp, Homo sapiens
ctctcagatccct

SEQ ID NO: 2286995 - DNA, 16 bp, Homo sapiens
ctctccaggcaccgcc

SEQ ID NO: 2286996 - DNA, 22 bp, Homo sapiens
ctctccatctcttgtaccagcc

SEQ ID NO: 2286997 - DNA, 19 bp, Homo sapiens
ctctcccctgcgcaggccc

SEQ ID NO: 2286998 - DNA, 13 bp, Homo sapiens
ctctcctagagct

SEQ ID NO: 2286999 - DNA, 13 bp, Homo sapiens
ctctcctgggcca

SEQ ID NO: 2287000 - DNA, 18 bp, Homo sapiens
ctctcctgggccagggtc

SEQ ID NO: 2287001 - DNA, 22 bp, Homo sapiens
ctctctatatatacatgtatag

SEQ ID NO: 2287002 - DNA, 17 bp, Homo sapiens
ctctctcaccagccttg

SEQ ID NO: 2287003 - DNA, 14 bp, Homo sapiens
ctctctctatatat

SEQ ID NO: 2287004 - DNA, 22 bp, Homo sapiens
ctctctgttcaagtcattccac

SEQ ID NO: 2287005 - DNA, 22 bp, Homo sapiens
ctctgaaaatatttttttctag

SEQ ID NO: 2287006 - DNA, 14 bp, Homo sapiens
ctctgaactgctgc

SEQ ID NO: 2287007 - DNA, 21 bp, Homo sapiens
ctctgaactgctgctggtcac

SEQ ID NO: 2287008 - DNA, 15 bp, Homo sapiens
ctctgaagggagggg

SEQ ID NO: 2287009 - DNA, 23 bp, Homo sapiens
ctctgacctgcccccgctctgcc

SEQ ID NO: 2287010 - DNA, 15 bp, Homo sapiens
ctctgagaccacaga

SEQ ID NO: 2287011 - DNA, 15 bp, Homo sapiens
ctctgagcagtgggg

SEQ ID NO: 2287012 - DNA, 18 bp, Homo sapiens
ctctgagcagtggggagc

SEQ ID NO: 2287013 - DNA, 15 bp, Homo sapiens
ctctgatcacaactt

SEQ ID NO: 2287014 - DNA, 20 bp, Homo sapiens
ctctgatcacaacttttctg

SEQ ID NO: 2287015 - DNA, 19 bp, Homo sapiens
ctctgcactgggaatttat

SEQ ID NO: 2287016 - DNA, 17 bp, Homo sapiens
ctctgcagcctgagctc

SEQ ID NO: 2287017 - DNA, 18 bp, Homo sapiens
ctctgcagcctgagctcc

SEQ ID NO: 2287018 - DNA, 22 bp, Homo sapiens
ctctgccatcagcccctgctgc

SEQ ID NO: 2287019 - DNA, 10 bp, Homo sapiens
ctctgccccc

SEQ ID NO: 2287020 - DNA, 17 bp, Homo sapiens
ctctgccccctcccccg

SEQ ID NO: 2287021 - DNA, 23 bp, Homo sapiens
ctctgcccctccgtccccagggt

SEQ ID NO: 2287022 - DNA, 18 bp, Homo sapiens
ctctgccctgccctggcc

SEQ ID NO: 2287023 - DNA, 13 bp, Homo sapiens
ctctgccttccag

SEQ ID NO: 2287024 - DNA, 21 bp, Homo sapiens
ctctggcaggtggccagggct

SEQ ID NO: 2287025 - DNA, 11 bp, Homo sapiens
ctctgggaaga

SEQ ID NO: 2287026 - DNA, 13 bp, Homo sapiens
ctctgtcttaaag

SEQ ID NO: 2287027 - DNA, 21 bp, Homo sapiens
ctctgtgactcgcttagctga

SEQ ID NO: 2287028 - DNA, 18 bp, Homo sapiens
ctctgtgatctaagcagt

SEQ ID NO: 2287029 - DNA, 18 bp, Homo sapiens
ctctgtgcactcacgctc

SEQ ID NO: 2287030 - DNA, 15 bp, Homo sapiens
ctctgtggggccaca

SEQ ID NO: 2287031 - DNA, 16 bp, Homo sapiens
ctctgtggggccacac

SEQ ID NO: 2287032 - DNA, 13 bp, Homo sapiens
ctctgtgtaatct

SEQ ID NO: 2287033 - DNA, 22 bp, Homo sapiens
ctctgtttcccctcagaacacc

SEQ ID NO: 2287034 - DNA, 14 bp, Homo sapiens
ctcttaagacacta

SEQ ID NO: 2287035 - DNA, 19 bp, Homo sapiens
ctcttacagtgtttggaca

SEQ ID NO: 2287036 - DNA, 18 bp, Homo sapiens
ctcttcctcctgacaccc

SEQ ID NO: 2287037 - DNA, 21 bp, Homo sapiens
ctcttcctcctgacaccccac

SEQ ID NO: 2287038 - DNA, 19 bp, Homo sapiens
ctcttcgatgtgcccaggg

SEQ ID NO: 2287039 - DNA, 16 bp, Homo sapiens
ctcttctgttctcaaa

SEQ ID NO: 2287040 - DNA, 13 bp, Homo sapiens
ctcttcttatcac

SEQ ID NO: 2287041 - DNA, 16 bp, Homo sapiens
ctcttcttatcacact

SEQ ID NO: 2287042 - DNA, 16 bp, Homo sapiens
ctcttcttgcggcacc

SEQ ID NO: 2287043 - DNA, 23 bp, Homo sapiens
ctcttcttgcggcaccgcccacc

SEQ ID NO: 2287044 - DNA, 14 bp, Homo sapiens
ctcttgtaccagcc

SEQ ID NO: 2287045 - DNA, 15 bp, Homo sapiens
ctcttgtaccagccc

SEQ ID NO: 2287046 - DNA, 16 bp, Homo sapiens
ctctttcaccctgcca

SEQ ID NO: 2287047 - DNA, 15 bp, Homo sapiens
ctctttccccactga

SEQ ID NO: 2287048 - DNA, 15 bp, Homo sapiens
ctctttctcattctt

SEQ ID NO: 2287049 - DNA, 14 bp, Homo sapiens
ctctttgaaaaaaa

SEQ ID NO: 2287050 - DNA, 13 bp, Homo sapiens
ctgaaaactgttt

SEQ ID NO: 2287051 - DNA, 19 bp, Homo sapiens
ctgaaaatatttttttcta

SEQ ID NO: 2287052 - DNA, 18 bp, Homo sapiens
ctgaaacacacaggccat

SEQ ID NO: 2287053 - DNA, 13 bp, Homo sapiens
ctgaaacactttt

SEQ ID NO: 2287054 - DNA, 15 bp, Homo sapiens
ctgaaacactttttc

SEQ ID NO: 2287055 - DNA, 14 bp, Homo sapiens
ctgaaacctctgtt

SEQ ID NO: 2287056 - DNA, 15 bp, Homo sapiens
ctgaaacctctgttc

SEQ ID NO: 2287057 - DNA, 13 bp, Homo sapiens
ctgaaatctacaa

SEQ ID NO: 2287058 - DNA, 17 bp, Homo sapiens
ctgaaatttgctatata

SEQ ID NO: 2287059 - DNA, 15 bp, Homo sapiens
ctgaacgacagtccc

SEQ ID NO: 2287060 - DNA, 19 bp, Homo sapiens
ctgaactgaaaggactgtg

SEQ ID NO: 2287061 - DNA, 16 bp, Homo sapiens
ctgaactgctgctggt

SEQ ID NO: 2287062 - DNA, 18 bp, Homo sapiens
ctgaactgctgctggtca

SEQ ID NO: 2287063 - DNA, 17 bp, Homo sapiens
ctgaactggactagtga

SEQ ID NO: 2287064 - DNA, 16 bp, Homo sapiens
ctgaaggatgggggct

SEQ ID NO: 2287065 - DNA, 17 bp, Homo sapiens
ctgaagggaggggaaga

SEQ ID NO: 2287066 - DNA, 19 bp, Homo sapiens
ctgaagggaggggaagaga

SEQ ID NO: 2287067 - DNA, 14 bp, Homo sapiens
ctgaagtaataact

SEQ ID NO: 2287068 - DNA, 19 bp, Homo sapiens
ctgaagtaataactgatga

SEQ ID NO: 2287069 - DNA, 17 bp, Homo sapiens
ctgaagtctttgtacag

SEQ ID NO: 2287070 - DNA, 15 bp, Homo sapiens
ctgaatcaaaagctg

SEQ ID NO: 2287071 - DNA, 15 bp, Homo sapiens
ctgaatcaaagacat

SEQ ID NO: 2287072 - DNA, 19 bp, Homo sapiens
ctgaatcaaagacatttca

SEQ ID NO: 2287073 - DNA, 14 bp, Homo sapiens
ctgaatctgtttct

SEQ ID NO: 2287074 - DNA, 16 bp, Homo sapiens
ctgaatgcagaacggt

SEQ ID NO: 2287075 - DNA, 21 bp, Homo sapiens
ctgaattgtcagatgtggagt

SEQ ID NO: 2287076 - DNA, 23 bp, Homo sapiens
ctgaattgttatgtaaacatcat

SEQ ID NO: 2287077 - DNA, 12 bp, Homo sapiens
ctgaatttaact

SEQ ID NO: 2287078 - DNA, 16 bp, Homo sapiens
ctgaattttgcttcct

SEQ ID NO: 2287079 - DNA, 19 bp, Homo sapiens
ctgaattttgcttcctttg

SEQ ID NO: 2287080 - DNA, 15 bp, Homo sapiens
ctgacacctgccgct

SEQ ID NO: 2287081 - DNA, 21 bp, Homo sapiens
ctgacacctgccgctgcttga

SEQ ID NO: 2287082 - DNA, 19 bp, Homo sapiens
ctgacactaaccagagtca

SEQ ID NO: 2287083 - DNA, 23 bp, Homo sapiens
ctgacagagcaagcgaaagagca

SEQ ID NO: 2287084 - DNA, 15 bp, Homo sapiens
ctgaccaggccctgc

SEQ ID NO: 2287085 - DNA, 15 bp, Homo sapiens
ctgacctgcccccgc

SEQ ID NO: 2287086 - DNA, 15 bp, Homo sapiens
ctgactctccaggga

SEQ ID NO: 2287087 - DNA, 23 bp, Homo sapiens
ctgacttcccagctggcagcgcc

SEQ ID NO: 2287088 - DNA, 15 bp, Homo sapiens
ctgagaagcctcatg

SEQ ID NO: 2287089 - DNA, 19 bp, Homo sapiens
ctgagaagcctcatgggag

SEQ ID NO: 2287090 - DNA, 12 bp, Homo sapiens
ctgagaccacag

SEQ ID NO: 2287091 - DNA, 16 bp, Homo sapiens
ctgagaccacagaggc

SEQ ID NO: 2287092 - DNA, 16 bp, Homo sapiens
ctgagcagtggggagc

SEQ ID NO: 2287093 - DNA, 17 bp, Homo sapiens
ctgagcagttgttatat

SEQ ID NO: 2287094 - DNA, 21 bp, Homo sapiens
ctgagcagttgttatattcat

SEQ ID NO: 2287095 - DNA, 14 bp, Homo sapiens
ctgagccacagtgg

SEQ ID NO: 2287096 - DNA, 16 bp, Homo sapiens
ctgagccacagtgggg

SEQ ID NO: 2287097 - DNA, 20 bp, Homo sapiens
ctgagccagattccccagga

SEQ ID NO: 2287098 - DNA, 17 bp, Homo sapiens
ctgagccagatttcact

SEQ ID NO: 2287099 - DNA, 14 bp, Homo sapiens
ctgagcccctcctc

SEQ ID NO: 2287100 - DNA, 19 bp, Homo sapiens
ctgagcccctcctctcctc

SEQ ID NO: 2287101 - DNA, 17 bp, Homo sapiens
ctgagccgatctggtct

SEQ ID NO: 2287102 - DNA, 22 bp, Homo sapiens
ctgagccgatctggtctcgtgt

SEQ ID NO: 2287103 - DNA, 17 bp, Homo sapiens
ctgagctccaccctccc

SEQ ID NO: 2287104 - DNA, 21 bp, Homo sapiens
ctgaggacggggcagagctga

SEQ ID NO: 2287105 - DNA, 14 bp, Homo sapiens
ctgaggagtgatgg

SEQ ID NO: 2287106 - DNA, 18 bp, Homo sapiens
ctgaggagtgatgggcaa

SEQ ID NO: 2287107 - DNA, 14 bp, Homo sapiens
ctgaggcaggaggg

SEQ ID NO: 2287108 - DNA, 14 bp, Homo sapiens
ctgagggaagccca

SEQ ID NO: 2287109 - DNA, 18 bp, Homo sapiens
ctgagggaagcccacccg

SEQ ID NO: 2287110 - DNA, 20 bp, Homo sapiens
ctgagggtttccaccttggc

SEQ ID NO: 2287111 - DNA, 19 bp, Homo sapiens
ctgagtaacagctaatctt

SEQ ID NO: 2287112 - DNA, 14 bp, Homo sapiens
ctgagtcggctggg

SEQ ID NO: 2287113 - DNA, 20 bp, Homo sapiens
ctgagtcggctgggcagggc

SEQ ID NO: 2287114 - DNA, 18 bp, Homo sapiens
ctgagtggtccacattct

SEQ ID NO: 2287115 - DNA, 22 bp, Homo sapiens
ctgagtggtccacattctgctg

SEQ ID NO: 2287116 - DNA, 14 bp, Homo sapiens
ctgagtgtggcggg

SEQ ID NO: 2287117 - DNA, 17 bp, Homo sapiens
ctgataagactggaaaa

SEQ ID NO: 2287118 - DNA, 21 bp, Homo sapiens
ctgataagcttcctagaaagt

SEQ ID NO: 2287119 - DNA, 21 bp, Homo sapiens
ctgatatcacgggcccgctca

SEQ ID NO: 2287120 - DNA, 16 bp, Homo sapiens
ctgatattgaagtaaa

SEQ ID NO: 2287121 - DNA, 22 bp, Homo sapiens
ctgatgatagacttcgaaaaca

SEQ ID NO: 2287122 - DNA, 14 bp, Homo sapiens
ctgatgggtcctgc

SEQ ID NO: 2287123 - DNA, 15 bp, Homo sapiens
ctgatgggtcctgct

SEQ ID NO: 2287124 - DNA, 16 bp, Homo sapiens
ctgatggtgcaatgac

SEQ ID NO: 2287125 - DNA, 19 bp, Homo sapiens
ctgatggtgcaatgacctt

SEQ ID NO: 2287126 - DNA, 21 bp, Homo sapiens
ctgatggtgcaatgacctttc

SEQ ID NO: 2287127 - DNA, 15 bp, Homo sapiens
ctgatgtatagcttt

SEQ ID NO: 2287128 - DNA, 22 bp, Homo sapiens
ctgattaaatttaatatactgc

SEQ ID NO: 2287129 - DNA, 14 bp, Homo sapiens
ctgattattgaatg

SEQ ID NO: 2287130 - DNA, 14 bp, Homo sapiens
ctgatttcaaatgc

SEQ ID NO: 2287131 - DNA, 15 bp, Homo sapiens
ctgatttcaaatgca

SEQ ID NO: 2287132 - DNA, 18 bp, Homo sapiens
ctgatttcaaatgcagtc

SEQ ID NO: 2287133 - DNA, 14 bp, Homo sapiens
ctgatttctcctgc

SEQ ID NO: 2287134 - DNA, 17 bp, Homo sapiens
ctgatttgcatattcat

SEQ ID NO: 2287135 - DNA, 15 bp, Homo sapiens
ctgattttaaaactt

SEQ ID NO: 2287136 - DNA, 21 bp, Homo sapiens
ctgatttttttttccttcagt

SEQ ID NO: 2287137 - DNA, 14 bp, Homo sapiens
ctgcaaatagtttc

SEQ ID NO: 2287138 - DNA, 17 bp, Homo sapiens
ctgcaaggcaaagtaaa

SEQ ID NO: 2287139 - DNA, 21 bp, Homo sapiens
ctgcaataacagttttaagat

SEQ ID NO: 2287140 - DNA, 17 bp, Homo sapiens
ctgcaatcatatgtgat

SEQ ID NO: 2287141 - DNA, 18 bp, Homo sapiens
ctgcacagtagtgttggg

SEQ ID NO: 2287142 - DNA, 11 bp, Homo sapiens
ctgcaccttgg

SEQ ID NO: 2287143 - DNA, 14 bp, Homo sapiens
ctgcaccttgggca

SEQ ID NO: 2287144 - DNA, 13 bp, Homo sapiens
ctgcagcccagaa

SEQ ID NO: 2287145 - DNA, 15 bp, Homo sapiens
ctgcagcccagaacg

SEQ ID NO: 2287146 - DNA, 23 bp, Homo sapiens
ctgcagcccagaacgggcctccc

SEQ ID NO: 2287147 - DNA, 11 bp, Homo sapiens
ctgcagcctcg

SEQ ID NO: 2287148 - DNA, 16 bp, Homo sapiens
ctgcagcctcgacctc

SEQ ID NO: 2287149 - DNA, 14 bp, Homo sapiens
ctgcagcctgagct

SEQ ID NO: 2287150 - DNA, 21 bp, Homo sapiens
ctgcagcctgagctccaccct

SEQ ID NO: 2287151 - DNA, 19 bp, Homo sapiens
ctgcaggcggtatccagag

SEQ ID NO: 2287152 - DNA, 20 bp, Homo sapiens
ctgcaggcggtatccagagg

SEQ ID NO: 2287153 - DNA, 21 bp, Homo sapiens
ctgcaggcggtatccagaggt

SEQ ID NO: 2287154 - DNA, 13 bp, Homo sapiens
ctgcagtgttatt

SEQ ID NO: 2287155 - DNA, 13 bp, Homo sapiens
ctgcatttaagaa

SEQ ID NO: 2287156 - DNA, 17 bp, Homo sapiens
ctgcatttaagaacaga

SEQ ID NO: 2287157 - DNA, 15 bp, Homo sapiens
ctgccaaataaaatg

SEQ ID NO: 2287158 - DNA, 17 bp, Homo sapiens
ctgccaaataaaatgtt

SEQ ID NO: 2287159 - DNA, 21 bp, Homo sapiens
ctgccaaataaaatgtttaca

SEQ ID NO: 2287160 - DNA, 22 bp, Homo sapiens
ctgccaaataaaatgtttacat

SEQ ID NO: 2287161 - DNA, 21 bp, Homo sapiens
ctgccaacctcgctccaactc

SEQ ID NO: 2287162 - DNA, 17 bp, Homo sapiens
ctgccaccctctgctgc

SEQ ID NO: 2287163 - DNA, 18 bp, Homo sapiens
ctgccaccctctgctgca

SEQ ID NO: 2287164 - DNA, 19 bp, Homo sapiens
ctgccaccctctgctgcac

SEQ ID NO: 2287165 - DNA, 19 bp, Homo sapiens
ctgccatcagaaattttct

SEQ ID NO: 2287166 - DNA, 22 bp, Homo sapiens
ctgccatcagaaattttctaca

SEQ ID NO: 2287167 - DNA, 17 bp, Homo sapiens
ctgccatcagcccctgc

SEQ ID NO: 2287168 - DNA, 19 bp, Homo sapiens
ctgccatcagcccctgctg

SEQ ID NO: 2287169 - DNA, 22 bp, Homo sapiens
ctgccatcagcccctgctgctc

SEQ ID NO: 2287170 - DNA, 12 bp, Homo sapiens
ctgcccaccctg

SEQ ID NO: 2287171 - DNA, 22 bp, Homo sapiens
ctgcccagatgttttagagata

SEQ ID NO: 2287172 - DNA, 20 bp, Homo sapiens
ctgcccagttagcccggcca

SEQ ID NO: 2287173 - DNA, 17 bp, Homo sapiens
ctgcccccacagatcca

SEQ ID NO: 2287174 - DNA, 15 bp, Homo sapiens
ctgcccccagacccc

SEQ ID NO: 2287175 - DNA, 23 bp, Homo sapiens
ctgcccccgctctgccatcagcc

SEQ ID NO: 2287176 - DNA, 18 bp, Homo sapiens
ctgcccctccgtccccag

SEQ ID NO: 2287177 - DNA, 13 bp, Homo sapiens
ctgcccctgcccc

SEQ ID NO: 2287178 - DNA, 22 bp, Homo sapiens
ctgccctccacacccgcgcccc

SEQ ID NO: 2287179 - DNA, 12 bp, Homo sapiens
ctgccctccccc

SEQ ID NO: 2287180 - DNA, 16 bp, Homo sapiens
ctgccctcccccacgg

SEQ ID NO: 2287181 - DNA, 17 bp, Homo sapiens
ctgccctcccccacggc

SEQ ID NO: 2287182 - DNA, 17 bp, Homo sapiens
ctgccctgccctggcca

SEQ ID NO: 2287183 - DNA, 20 bp, Homo sapiens
ctgccctggccactggccct

SEQ ID NO: 2287184 - DNA, 12 bp, Homo sapiens
ctgccgctgccc

SEQ ID NO: 2287185 - DNA, 14 bp, Homo sapiens
ctgccgctgccccc

SEQ ID NO: 2287186 - DNA, 15 bp, Homo sapiens
ctgccgctgccccca

SEQ ID NO: 2287187 - DNA, 18 bp, Homo sapiens
ctgccgctgcccccaccc

SEQ ID NO: 2287188 - DNA, 19 bp, Homo sapiens
ctgccgctgcccccaccct

SEQ ID NO: 2287189 - DNA, 15 bp, Homo sapiens
ctgccgctgcttgag

SEQ ID NO: 2287190 - DNA, 21 bp, Homo sapiens
ctgccgtgcacggggccagca

SEQ ID NO: 2287191 - DNA, 14 bp, Homo sapiens
ctgcctaaatttca

SEQ ID NO: 2287192 - DNA, 16 bp, Homo sapiens
ctgcctaaatttcaca

SEQ ID NO: 2287193 - DNA, 17 bp, Homo sapiens
ctgcctccaagtcatgg

SEQ ID NO: 2287194 - DNA, 13 bp, Homo sapiens
ctgcctctgaaaa

SEQ ID NO: 2287195 - DNA, 17 bp, Homo sapiens
ctgcctctgaaaatatt

SEQ ID NO: 2287196 - DNA, 18 bp, Homo sapiens
ctgcctctgaaaatattt

SEQ ID NO: 2287197 - DNA, 15 bp, Homo sapiens
ctgcctgcagctgag

SEQ ID NO: 2287198 - DNA, 17 bp, Homo sapiens
ctgcctggcggcagggg

SEQ ID NO: 2287199 - DNA, 14 bp, Homo sapiens
ctgcctggcgggca

SEQ ID NO: 2287200 - DNA, 21 bp, Homo sapiens
ctgcctggcgggcagcccctg

SEQ ID NO: 2287201 - DNA, 22 bp, Homo sapiens
ctgcctggcgggcagcccctgc

SEQ ID NO: 2287202 - DNA, 18 bp, Homo sapiens
ctgcctgtttggggaggg

SEQ ID NO: 2287203 - DNA, 17 bp, Homo sapiens
ctgcgccccccagtgga

SEQ ID NO: 2287204 - DNA, 21 bp, Homo sapiens
ctgcgccccccagtggactcg

SEQ ID NO: 2287205 - DNA, 13 bp, Homo sapiens
ctgcgcctgcccg

SEQ ID NO: 2287206 - DNA, 14 bp, Homo sapiens
ctgcgctcctctgc

SEQ ID NO: 2287207 - DNA, 20 bp, Homo sapiens
ctgcgctcctctgcagcctg

SEQ ID NO: 2287208 - DNA, 21 bp, Homo sapiens
ctgcgctcctctgcagcctga

SEQ ID NO: 2287209 - DNA, 15 bp, Homo sapiens
ctgcgtggcctgggg

SEQ ID NO: 2287210 - DNA, 16 bp, Homo sapiens
ctgcgtggcctggggc

SEQ ID NO: 2287211 - DNA, 22 bp, Homo sapiens
ctgctaaggattagtccctggc

SEQ ID NO: 2287212 - DNA, 17 bp, Homo sapiens
ctgctaagtggaagaca

SEQ ID NO: 2287213 - DNA, 18 bp, Homo sapiens
ctgctaagtggaagacag

SEQ ID NO: 2287214 - DNA, 19 bp, Homo sapiens
ctgctaagtggaagacaga

SEQ ID NO: 2287215 - DNA, 20 bp, Homo sapiens
ctgctaagtggaagacagag

SEQ ID NO: 2287216 - DNA, 18 bp, Homo sapiens
ctgctacagtagctgtgg

SEQ ID NO: 2287217 - DNA, 16 bp, Homo sapiens
ctgctacctggttttc

SEQ ID NO: 2287218 - DNA, 19 bp, Homo sapiens
ctgctacctggttttcatt

SEQ ID NO: 2287219 - DNA, 12 bp, Homo sapiens
ctgctactgcca

SEQ ID NO: 2287220 - DNA, 17 bp, Homo sapiens
ctgctactgccaacctc

SEQ ID NO: 2287221 - DNA, 13 bp, Homo sapiens
ctgctagcggctg

SEQ ID NO: 2287222 - DNA, 22 bp, Homo sapiens
ctgctcagattccccccatctc

SEQ ID NO: 2287223 - DNA, 13 bp, Homo sapiens
ctgctcagggccg

SEQ ID NO: 2287224 - DNA, 14 bp, Homo sapiens
ctgctcctcggcca

SEQ ID NO: 2287225 - DNA, 17 bp, Homo sapiens
ctgctcgggaaggcctg

SEQ ID NO: 2287226 - DNA, 11 bp, Homo sapiens
ctgctctccat

SEQ ID NO: 2287227 - DNA, 15 bp, Homo sapiens
ctgctctccatctct

SEQ ID NO: 2287228 - DNA, 15 bp, Homo sapiens
ctgctgagctctgac

SEQ ID NO: 2287229 - DNA, 23 bp, Homo sapiens
ctgctgctcctcggccagagctc

SEQ ID NO: 2287230 - DNA, 19 bp, Homo sapiens
ctgctgctcgggaaggcct

SEQ ID NO: 2287231 - DNA, 13 bp, Homo sapiens
ctgctgctggtca

SEQ ID NO: 2287232 - DNA, 19 bp, Homo sapiens
ctgctgtaagacggccttg

SEQ ID NO: 2287233 - DNA, 14 bp, Homo sapiens
ctgctgtcatttta

SEQ ID NO: 2287234 - DNA, 15 bp, Homo sapiens
ctgctgtcattttat

SEQ ID NO: 2287235 - DNA, 16 bp, Homo sapiens
ctgctgtgcagcatgg

SEQ ID NO: 2287236 - DNA, 15 bp, Homo sapiens
ctgctgttgattcca

SEQ ID NO: 2287237 - DNA, 24 bp, Homo sapiens
ctgctgttttatgtcatactctgt

SEQ ID NO: 2287238 - DNA, 13 bp, Homo sapiens
ctgcttaccaaaa

SEQ ID NO: 2287239 - DNA, 17 bp, Homo sapiens
ctgcttaccaaaacata

SEQ ID NO: 2287240 - DNA, 12 bp, Homo sapiens
ctgcttcaagga

SEQ ID NO: 2287241 - DNA, 14 bp, Homo sapiens
ctgcttcaaggatc

SEQ ID NO: 2287242 - DNA, 19 bp, Homo sapiens
ctgcttcaaggatcctgag

SEQ ID NO: 2287243 - DNA, 20 bp, Homo sapiens
ctgcttcaaggatcctgagc

SEQ ID NO: 2287244 - DNA, 22 bp, Homo sapiens
ctgcttccagttggactgtggc

SEQ ID NO: 2287245 - DNA, 15 bp, Homo sapiens
ctgcttctgctgcct

SEQ ID NO: 2287246 - DNA, 16 bp, Homo sapiens
ctgcttctgctgcctg

SEQ ID NO: 2287247 - DNA, 16 bp, Homo sapiens
ctgcttgagtggacag

SEQ ID NO: 2287248 - DNA, 23 bp, Homo sapiens
ctgcttgagtggacagcagctgg

SEQ ID NO: 2287249 - DNA, 13 bp, Homo sapiens
ctgcttggatcca

SEQ ID NO: 2287250 - DNA, 21 bp, Homo sapiens
ctgcttggcttatgaaaacac

SEQ ID NO: 2287251 - DNA, 19 bp, Homo sapiens
ctgctttgttttggctgct

SEQ ID NO: 2287252 - DNA, 21 bp, Homo sapiens
ctgctttgttttggctgctct

SEQ ID NO: 2287253 - DNA, 23 bp, Homo sapiens
ctgctttgttttggctgctctcc

SEQ ID NO: 2287254 - DNA, 19 bp, Homo sapiens
ctggaaaatagtcctccaa

SEQ ID NO: 2287255 - DNA, 17 bp, Homo sapiens
ctggaacactaatgagg

SEQ ID NO: 2287256 - DNA, 18 bp, Homo sapiens
ctggaagaacccttctca

SEQ ID NO: 2287257 - DNA, 14 bp, Homo sapiens
ctggaatactgaaa

SEQ ID NO: 2287258 - DNA, 15 bp, Homo sapiens
ctggaatactgaaaa

SEQ ID NO: 2287259 - DNA, 21 bp, Homo sapiens
ctggacagatgggtgtcccct

SEQ ID NO: 2287260 - DNA, 12 bp, Homo sapiens
ctggacaggctt

SEQ ID NO: 2287261 - DNA, 22 bp, Homo sapiens
ctggaccaaggtgcggaccgga

SEQ ID NO: 2287262 - DNA, 14 bp, Homo sapiens
ctggacctggggtc

SEQ ID NO: 2287263 - DNA, 15 bp, Homo sapiens
ctggacctggggtcc

SEQ ID NO: 2287264 - DNA, 17 bp, Homo sapiens
ctggactagtgaaaaat

SEQ ID NO: 2287265 - DNA, 23 bp, Homo sapiens
ctggactcttcaaaaactgtttt

SEQ ID NO: 2287266 - DNA, 19 bp, Homo sapiens
ctggactgggtgggcccca

SEQ ID NO: 2287267 - DNA, 14 bp, Homo sapiens
ctggagaaaatgga

SEQ ID NO: 2287268 - DNA, 18 bp, Homo sapiens
ctggagaccaggactctg

SEQ ID NO: 2287269 - DNA, 20 bp, Homo sapiens
ctggagaccaggactctgcc

SEQ ID NO: 2287270 - DNA, 15 bp, Homo sapiens
ctggagagctttact

SEQ ID NO: 2287271 - DNA, 19 bp, Homo sapiens
ctggagcagtttggggcag

SEQ ID NO: 2287272 - DNA, 19 bp, Homo sapiens
ctggaggctggaccaactg

SEQ ID NO: 2287273 - DNA, 17 bp, Homo sapiens
ctggagggctgggcagg

SEQ ID NO: 2287274 - DNA, 22 bp, Homo sapiens
ctggaggtggggagggcctctg

SEQ ID NO: 2287275 - DNA, 19 bp, Homo sapiens
ctggagtggcatggtcctg

SEQ ID NO: 2287276 - DNA, 22 bp, Homo sapiens
ctggagtggcatggtcctgtgc

SEQ ID NO: 2287277 - DNA, 23 bp, Homo sapiens
ctggagtggcatggtcctgtgcc

SEQ ID NO: 2287278 - DNA, 13 bp, Homo sapiens
ctggatgtgcttt

SEQ ID NO: 2287279 - DNA, 17 bp, Homo sapiens
ctggattttctttctat

SEQ ID NO: 2287280 - DNA, 19 bp, Homo sapiens
ctggattttctttctatgt

SEQ ID NO: 2287281 - DNA, 18 bp, Homo sapiens
ctggcactccagaacaaa

SEQ ID NO: 2287282 - DNA, 14 bp, Homo sapiens
ctggcagcgcctcc

SEQ ID NO: 2287283 - DNA, 16 bp, Homo sapiens
ctggcaggagacactg

SEQ ID NO: 2287284 - DNA, 13 bp, Homo sapiens
ctggcattgaaat

SEQ ID NO: 2287285 - DNA, 18 bp, Homo sapiens
ctggccactggccctgtt

SEQ ID NO: 2287286 - DNA, 21 bp, Homo sapiens
ctggccactggccctgtttct

SEQ ID NO: 2287287 - DNA, 15 bp, Homo sapiens
ctggccccaggcgga

SEQ ID NO: 2287288 - DNA, 22 bp, Homo sapiens
ctggcccctaggctgctgctgt

SEQ ID NO: 2287289 - DNA, 14 bp, Homo sapiens
ctggcccctcccac

SEQ ID NO: 2287290 - DNA, 14 bp, Homo sapiens
ctggccctgccctc

SEQ ID NO: 2287291 - DNA, 19 bp, Homo sapiens
ctggccctgccctccccca

SEQ ID NO: 2287292 - DNA, 21 bp, Homo sapiens
ctggccctgggccccgcctca

SEQ ID NO: 2287293 - DNA, 16 bp, Homo sapiens
ctggccggtccacccc

SEQ ID NO: 2287294 - DNA, 13 bp, Homo sapiens
ctggcgggcagcc

SEQ ID NO: 2287295 - DNA, 14 bp, Homo sapiens
ctggcgggcagccc

SEQ ID NO: 2287296 - DNA, 16 bp, Homo sapiens
ctggcgggcagcccct

SEQ ID NO: 2287297 - DNA, 21 bp, Homo sapiens
ctggcgggcagcccctgctgg

SEQ ID NO: 2287298 - DNA, 22 bp, Homo sapiens
ctggcgggcagcccctgctgga

SEQ ID NO: 2287299 - DNA, 13 bp, Homo sapiens
ctggctctggagc

SEQ ID NO: 2287300 - DNA, 13 bp, Homo sapiens
ctggctgaaaatg

SEQ ID NO: 2287301 - DNA, 20 bp, Homo sapiens
ctggctgatcattgcagtat

SEQ ID NO: 2287302 - DNA, 22 bp, Homo sapiens
ctggctttcaactgtttctaga

SEQ ID NO: 2287303 - DNA, 15 bp, Homo sapiens
ctgggacccactccg

SEQ ID NO: 2287304 - DNA, 23 bp, Homo sapiens
ctgggaccctcggggcaggaagt

SEQ ID NO: 2287305 - DNA, 19 bp, Homo sapiens
ctgggactcagttcttggc

SEQ ID NO: 2287306 - DNA, 23 bp, Homo sapiens
ctgggactcagttcttggcctgc

SEQ ID NO: 2287307 - DNA, 19 bp, Homo sapiens
ctgggactgctcaggctcc

SEQ ID NO: 2287308 - DNA, 13 bp, Homo sapiens
ctgggcagggccc

SEQ ID NO: 2287309 - DNA, 19 bp, Homo sapiens
ctgggcatccccagccccc

SEQ ID NO: 2287310 - DNA, 21 bp, Homo sapiens
ctgggcatccccagccccctg

SEQ ID NO: 2287311 - DNA, 22 bp, Homo sapiens
ctgggcatccccagccccctgg

SEQ ID NO: 2287312 - DNA, 14 bp, Homo sapiens
ctgggccagggtct

SEQ ID NO: 2287313 - DNA, 18 bp, Homo sapiens
ctgggccagtggacccgc

SEQ ID NO: 2287314 - DNA, 12 bp, Homo sapiens
ctgggccccaga

SEQ ID NO: 2287315 - DNA, 21 bp, Homo sapiens
ctgggccccagaaagcctcag

SEQ ID NO: 2287316 - DNA, 14 bp, Homo sapiens
ctgggccctggttc

SEQ ID NO: 2287317 - DNA, 20 bp, Homo sapiens
ctgggccctggttcccccag

SEQ ID NO: 2287318 - DNA, 21 bp, Homo sapiens
ctgggccctggttcccccagg

SEQ ID NO: 2287319 - DNA, 12 bp, Homo sapiens
ctgggcctcccg

SEQ ID NO: 2287320 - DNA, 15 bp, Homo sapiens
ctggggagaccgagt

SEQ ID NO: 2287321 - DNA, 14 bp, Homo sapiens
ctggggccagcccc

SEQ ID NO: 2287322 - DNA, 13 bp, Homo sapiens
ctggggccgggct

SEQ ID NO: 2287323 - DNA, 14 bp, Homo sapiens
ctggggctgccgtg

SEQ ID NO: 2287324 - DNA, 19 bp, Homo sapiens
ctggggcttttgtgccagg

SEQ ID NO: 2287325 - DNA, 22 bp, Homo sapiens
ctggggcttttgtgccaggagt

SEQ ID NO: 2287326 - DNA, 17 bp, Homo sapiens
ctgggggaggcttccag

SEQ ID NO: 2287327 - DNA, 23 bp, Homo sapiens
ctgggggaggcttccagctcagt

SEQ ID NO: 2287328 - DNA, 13 bp, Homo sapiens
ctggggtcccccc

SEQ ID NO: 2287329 - DNA, 15 bp, Homo sapiens
ctggggtcccccctc

SEQ ID NO: 2287330 - DNA, 23 bp, Homo sapiens
ctggggtctctgagcagtgggga

SEQ ID NO: 2287331 - DNA, 13 bp, Homo sapiens
ctggggtgggagg

SEQ ID NO: 2287332 - DNA, 19 bp, Homo sapiens
ctggggtttccacacaggc

SEQ ID NO: 2287333 - DNA, 20 bp, Homo sapiens
ctggggtttccacacaggcc

SEQ ID NO: 2287334 - DNA, 21 bp, Homo sapiens
ctggggtttccacacaggccc

SEQ ID NO: 2287335 - DNA, 17 bp, Homo sapiens
ctgggtcgcccctcctc

SEQ ID NO: 2287336 - DNA, 19 bp, Homo sapiens
ctgggtggattataaacaa

SEQ ID NO: 2287337 - DNA, 14 bp, Homo sapiens
ctgggtgggcccca

SEQ ID NO: 2287338 - DNA, 16 bp, Homo sapiens
ctgggtgggccccaca

SEQ ID NO: 2287339 - DNA, 17 bp, Homo sapiens
ctgggtgggccccacag

SEQ ID NO: 2287340 - DNA, 17 bp, Homo sapiens
ctgggtgtgacctgaca

SEQ ID NO: 2287341 - DNA, 21 bp, Homo sapiens
ctgggtgtgacctgacacctg

SEQ ID NO: 2287342 - DNA, 15 bp, Homo sapiens
ctgggttttagaaat

SEQ ID NO: 2287343 - DNA, 13 bp, Homo sapiens
ctggtaagttgga

SEQ ID NO: 2287344 - DNA, 13 bp, Homo sapiens
ctggtatggctgc

SEQ ID NO: 2287345 - DNA, 16 bp, Homo sapiens
ctggtatggctgcagt

SEQ ID NO: 2287346 - DNA, 18 bp, Homo sapiens
ctggtatggctgcagtcc

SEQ ID NO: 2287347 - DNA, 16 bp, Homo sapiens
ctggtcacccccaccc

SEQ ID NO: 2287348 - DNA, 19 bp, Homo sapiens
ctggtcagttttcacagag

SEQ ID NO: 2287349 - DNA, 21 bp, Homo sapiens
ctggtcagttttcacagaggc

SEQ ID NO: 2287350 - DNA, 22 bp, Homo sapiens
ctggtcagttttcacagaggcg

SEQ ID NO: 2287351 - DNA, 22 bp, Homo sapiens
ctggtcgtaaacatctcagaga

SEQ ID NO: 2287352 - DNA, 21 bp, Homo sapiens
ctggtctcgtgttcgctggct

SEQ ID NO: 2287353 - DNA, 22 bp, Homo sapiens
ctggtctcgtgttcgctggctg

SEQ ID NO: 2287354 - DNA, 12 bp, Homo sapiens
ctggtgcccctc

SEQ ID NO: 2287355 - DNA, 15 bp, Homo sapiens
ctggtgggggcatcc

SEQ ID NO: 2287356 - DNA, 15 bp, Homo sapiens
ctggttcccccagga

SEQ ID NO: 2287357 - DNA, 17 bp, Homo sapiens
ctggttcccccaggacc

SEQ ID NO: 2287358 - DNA, 13 bp, Homo sapiens
ctgttatcaagct

SEQ ID NO: 2287359 - DNA, 13 bp, Homo sapiens
ctgttcatttcca

SEQ ID NO: 2287360 - DNA, 19 bp, Homo sapiens
ctgttccctgaggacctgc

SEQ ID NO: 2287361 - DNA, 12 bp, Homo sapiens
ctgttctcaaat

SEQ ID NO: 2287362 - DNA, 14 bp, Homo sapiens
ctgttctcaaatgc

SEQ ID NO: 2287363 - DNA, 12 bp, Homo sapiens
ctgttctgtgtc

SEQ ID NO: 2287364 - DNA, 16 bp, Homo sapiens
ctgttctttgcagtga

SEQ ID NO: 2287365 - DNA, 18 bp, Homo sapiens
ctgttctttgcagtgaag

SEQ ID NO: 2287366 - DNA, 14 bp, Homo sapiens
ctgttgaccaggct

SEQ ID NO: 2287367 - DNA, 18 bp, Homo sapiens
ctgttggaatgttgttaa

SEQ ID NO: 2287368 - DNA, 20 bp, Homo sapiens
ctgttggaatgttgttaaat

SEQ ID NO: 2287369 - DNA, 14 bp, Homo sapiens
ctgtttccagggtc

SEQ ID NO: 2287370 - DNA, 15 bp, Homo sapiens
ctgtttcccctcaga

SEQ ID NO: 2287371 - DNA, 21 bp, Homo sapiens
ctgtttctatgtccaaacctg

SEQ ID NO: 2287372 - DNA, 14 bp, Homo sapiens
ctgtttcttgcttg

SEQ ID NO: 2287373 - DNA, 17 bp, Homo sapiens
ctgtttgctaagtgagg

SEQ ID NO: 2287374 - DNA, 14 bp, Homo sapiens
ctgtttggggaggg

SEQ ID NO: 2287375 - DNA, 15 bp, Homo sapiens
ctgtttggggagggg

SEQ ID NO: 2287376 - DNA, 12 bp, Homo sapiens
cttaaaatattg

SEQ ID NO: 2287377 - DNA, 15 bp, Homo sapiens
cttaaacctgtgctt

SEQ ID NO: 2287378 - DNA, 22 bp, Homo sapiens
cttaaacctgtgctttcatgtt

SEQ ID NO: 2287379 - DNA, 13 bp, Homo sapiens
cttaaagcttgtt

SEQ ID NO: 2287380 - DNA, 17 bp, Homo sapiens
cttaacataaacttgta

SEQ ID NO: 2287381 - DNA, 22 bp, Homo sapiens
cttaacataaacttgtacttac

SEQ ID NO: 2287382 - DNA, 18 bp, Homo sapiens
cttaagatgctaatagaa

SEQ ID NO: 2287383 - DNA, 17 bp, Homo sapiens
cttaattactttcagaa

SEQ ID NO: 2287384 - DNA, 22 bp, Homo sapiens
cttaattctcattatgaagatg

SEQ ID NO: 2287385 - DNA, 13 bp, Homo sapiens
cttacacaaaggg

SEQ ID NO: 2287386 - DNA, 18 bp, Homo sapiens
cttacacaaaggggatca

SEQ ID NO: 2287387 - DNA, 20 bp, Homo sapiens
cttacagtaactgagtgtgg

SEQ ID NO: 2287388 - DNA, 17 bp, Homo sapiens
cttaccaaaacataaga

SEQ ID NO: 2287389 - DNA, 18 bp, Homo sapiens
cttactttcctgaaaata

SEQ ID NO: 2287390 - DNA, 14 bp, Homo sapiens
cttagaaagggaag

SEQ ID NO: 2287391 - DNA, 15 bp, Homo sapiens
cttagaaagggaagg

SEQ ID NO: 2287392 - DNA, 17 bp, Homo sapiens
cttagctgttggaatgt

SEQ ID NO: 2287393 - DNA, 13 bp, Homo sapiens
cttaggagcaaaa

SEQ ID NO: 2287394 - DNA, 21 bp, Homo sapiens
cttataaaaataaagggaaga

SEQ ID NO: 2287395 - DNA, 14 bp, Homo sapiens
cttataatttccaa

SEQ ID NO: 2287396 - DNA, 14 bp, Homo sapiens
cttatcaaatcatt

SEQ ID NO: 2287397 - DNA, 15 bp, Homo sapiens
cttatcaaatcattc

SEQ ID NO: 2287398 - DNA, 17 bp, Homo sapiens
cttatcacacttgcaaa

SEQ ID NO: 2287399 - DNA, 22 bp, Homo sapiens
cttatcacacttgcaaatgaat

SEQ ID NO: 2287400 - DNA, 14 bp, Homo sapiens
cttatccccagctg

SEQ ID NO: 2287401 - DNA, 22 bp, Homo sapiens
cttatctagcaagaagattcta

SEQ ID NO: 2287402 - DNA, 21 bp, Homo sapiens
cttatggaacactctgagact

SEQ ID NO: 2287403 - DNA, 23 bp, Homo sapiens
cttgggcacgggagagcgccacc

SEQ ID NO: 2287404 - DNA, 21 bp, Homo sapiens
cttgggccgtccccatttgca

SEQ ID NO: 2287405 - DNA, 21 bp, Homo sapiens
cttgtaaataatgcttaacat

SEQ ID NO: 2287406 - DNA, 16 bp, Homo sapiens
cttgtaccagcccagg

SEQ ID NO: 2287407 - DNA, 18 bp, Homo sapiens
cttgtacctctggctgac

SEQ ID NO: 2287408 - DNA, 19 bp, Homo sapiens
cttgtattttcttcccatt

SEQ ID NO: 2287409 - DNA, 16 bp, Homo sapiens
cttgtcattctgctaa

SEQ ID NO: 2287410 - DNA, 20 bp, Homo sapiens
cttgtgtgtttattgtcaaa

SEQ ID NO: 2287411 - DNA, 16 bp, Homo sapiens
cttgtgttgttttctc

SEQ ID NO: 2287412 - DNA, 16 bp, Homo sapiens
cttgtttctatactgt

SEQ ID NO: 2287413 - DNA, 17 bp, Homo sapiens
cttgtttctatactgtt

SEQ ID NO: 2287414 - DNA, 24 bp, Homo sapiens
ctttaaataaaagaggtccattaa

SEQ ID NO: 2287415 - DNA, 21 bp, Homo sapiens
ctttaacattttgtttccaaa

SEQ ID NO: 2287416 - DNA, 15 bp, Homo sapiens
ctttaaggaagaata

SEQ ID NO: 2287417 - DNA, 14 bp, Homo sapiens
ctttaatcaaaagt

SEQ ID NO: 2287418 - DNA, 12 bp, Homo sapiens
ctttagatgcta

SEQ ID NO: 2287419 - DNA, 18 bp, Homo sapiens
ctttagattgaaatttat

SEQ ID NO: 2287420 - DNA, 18 bp, Homo sapiens
ctttataaaccataaaat

SEQ ID NO: 2287421 - DNA, 17 bp, Homo sapiens
ctttattcttccaagtt

SEQ ID NO: 2287422 - DNA, 15 bp, Homo sapiens
ctttcaataggaaaa

SEQ ID NO: 2287423 - DNA, 23 bp, Homo sapiens
ctttcaataggaaaaactgattt

SEQ ID NO: 2287424 - DNA, 20 bp, Homo sapiens
ctttcacactgtggtgtctc

SEQ ID NO: 2287425 - DNA, 17 bp, Homo sapiens
ctttcacatctctgtag

SEQ ID NO: 2287426 - DNA, 14 bp, Homo sapiens
ctttcaccctgcca

SEQ ID NO: 2287427 - DNA, 14 bp, Homo sapiens
ctttcacccttttc

SEQ ID NO: 2287428 - DNA, 20 bp, Homo sapiens
ctttcacccttttctgtttg

SEQ ID NO: 2287429 - DNA, 15 bp, Homo sapiens
ctttcagaatacaat

SEQ ID NO: 2287430 - DNA, 20 bp, Homo sapiens
ctttcagccaagaattctta

SEQ ID NO: 2287431 - DNA, 22 bp, Homo sapiens
ctttcaggaaagtatctctact

SEQ ID NO: 2287432 - DNA, 19 bp, Homo sapiens
ctttcatacgtaaaggtgc

SEQ ID NO: 2287433 - DNA, 18 bp, Homo sapiens
ctttcatgttgcaaagaa

SEQ ID NO: 2287434 - DNA, 19 bp, Homo sapiens
ctttcatgtttaagaaatg

SEQ ID NO: 2287435 - DNA, 20 bp, Homo sapiens
ctttccccacctcttacagt

SEQ ID NO: 2287436 - DNA, 12 bp, Homo sapiens
ctttcctgatgt

SEQ ID NO: 2287437 - DNA, 13 bp, Homo sapiens
ctttcctgatgtt

SEQ ID NO: 2287438 - DNA, 24 bp, Homo sapiens
ctttcctgtactcactgagtaaca

SEQ ID NO: 2287439 - DNA, 13 bp, Homo sapiens
ctttcctgtttcc

SEQ ID NO: 2287440 - DNA, 17 bp, Homo sapiens
ctttcctgtttccaggg

SEQ ID NO: 2287441 - DNA, 14 bp, Homo sapiens
ctttcgcctcctcc

SEQ ID NO: 2287442 - DNA, 17 bp, Homo sapiens
ctttcgcctcctccagc

SEQ ID NO: 2287443 - DNA, 18 bp, Homo sapiens
ctttcgcctcctccagct

SEQ ID NO: 2287444 - DNA, 21 bp, Homo sapiens
ctttcgcctcctccagctcct

SEQ ID NO: 2287445 - DNA, 19 bp, Homo sapiens
ctttctatgtagaactgtt

SEQ ID NO: 2287446 - DNA, 13 bp, Homo sapiens
ctttcttcatgtt

SEQ ID NO: 2287447 - DNA, 17 bp, Homo sapiens
ctttcttgagcaccagg

SEQ ID NO: 2287448 - DNA, 17 bp, Homo sapiens
ctttgaacttcgatgtt

SEQ ID NO: 2287449 - DNA, 15 bp, Homo sapiens
ctttgaatgcatgtg

SEQ ID NO: 2287450 - DNA, 20 bp, Homo sapiens
ctttgactgtgctggagaat

SEQ ID NO: 2287451 - DNA, 22 bp, Homo sapiens
ctttgagttactgatcttcctt

SEQ ID NO: 2287452 - DNA, 17 bp, Homo sapiens
ctttgattgtgaaacag

SEQ ID NO: 2287453 - DNA, 19 bp, Homo sapiens
ctttgcccagttcatccca

SEQ ID NO: 2287454 - DNA, 16 bp, Homo sapiens
ctttgcgctctgggtt

SEQ ID NO: 2287455 - DNA, 17 bp, Homo sapiens
ctttgggagctcattct

SEQ ID NO: 2287456 - DNA, 23 bp, Homo sapiens
ctttggggtctacactgcaatca

SEQ ID NO: 2287457 - DNA, 20 bp, Homo sapiens
ctttggtaatgtgtcaaaga

SEQ ID NO: 2287458 - DNA, 14 bp, Homo sapiens
ctttggtgaataac

SEQ ID NO: 2287459 - DNA, 22 bp, Homo sapiens
ctttgtgagccaaagcttatgt

SEQ ID NO: 2287460 - DNA, 18 bp, Homo sapiens
cttttagcggtttgcaaa

SEQ ID NO: 2287461 - DNA, 15 bp, Homo sapiens
cttttataagacaaa

SEQ ID NO: 2287462 - DNA, 18 bp, Homo sapiens
cttttataagacaaaatt

SEQ ID NO: 2287463 - DNA, 14 bp, Homo sapiens
cttttatatctgta

SEQ ID NO: 2287464 - DNA, 15 bp, Homo sapiens
cttttcagcatggtt

SEQ ID NO: 2287465 - DNA, 18 bp, Homo sapiens
cttttcagcttgtttcta

SEQ ID NO: 2287466 - DNA, 20 bp, Homo sapiens
cttttcagcttgtttctata

SEQ ID NO: 2287467 - DNA, 22 bp, Homo sapiens
cttttcccgtatgctttcttca

SEQ ID NO: 2287468 - DNA, 21 bp, Homo sapiens
cttttcgccaaggctcacatg

SEQ ID NO: 2287469 - DNA, 15 bp, Homo sapiens
cttttctgcatttgg

SEQ ID NO: 2287470 - DNA, 18 bp, Homo sapiens
cttttgaagctcaactgt

SEQ ID NO: 2287471 - DNA, 19 bp, Homo sapiens
cttttggagcaaagtggtt

SEQ ID NO: 2287472 - DNA, 15 bp, Homo sapiens
cttttggggaggagt

SEQ ID NO: 2287473 - DNA, 15 bp, Homo sapiens
cttttgtgccaggag

SEQ ID NO: 2287474 - DNA, 16 bp, Homo sapiens
cttttgtgccaggagt

SEQ ID NO: 2287475 - DNA, 15 bp, Homo sapiens
cttttgtgtattctg

SEQ ID NO: 2287476 - DNA, 23 bp, Homo sapiens
ctttttcaccctattttcagata

SEQ ID NO: 2287477 - DNA, 13 bp, Homo sapiens
ctttttccaaaca

SEQ ID NO: 2287478 - DNA, 16 bp, Homo sapiens
ctttttcttttgtaag

SEQ ID NO: 2287479 - DNA, 19 bp, Homo sapiens
ctttttcttttttgagtgt

SEQ ID NO: 2287480 - DNA, 22 bp, Homo sapiens
cttttttcaatgtactgtattg

SEQ ID NO: 2287481 - DNA, 23 bp, Homo sapiens
ctttttttttcacctgaaacact

SEQ ID NO: 2287482 - DNA, 13 bp, Homo sapiens
gaaaaaaacagca

SEQ ID NO: 2287483 - DNA, 15 bp, Homo sapiens
gaaaaagtagaaaaa

SEQ ID NO: 2287484 - DNA, 17 bp, Homo sapiens
gaaaaatgctgttcaga

SEQ ID NO: 2287485 - DNA, 20 bp, Homo sapiens
gaaaacaccaagagtacagg

SEQ ID NO: 2287486 - DNA, 13 bp, Homo sapiens
gaaaacctgttca

SEQ ID NO: 2287487 - DNA, 21 bp, Homo sapiens
gaaaactgggtatgcgtttca

SEQ ID NO: 2287488 - DNA, 23 bp, Homo sapiens
gaaaactgtttatggtattttcg

SEQ ID NO: 2287489 - DNA, 19 bp, Homo sapiens
gaaaagaagaaagtctatg

SEQ ID NO: 2287490 - DNA, 15 bp, Homo sapiens
gaaaagagaaacact

SEQ ID NO: 2287491 - DNA, 20 bp, Homo sapiens
gaaaatagtcctccaaaaca

SEQ ID NO: 2287492 - DNA, 18 bp, Homo sapiens
gaaaatatttttttctag

SEQ ID NO: 2287493 - DNA, 13 bp, Homo sapiens
gaaaatgctttct

SEQ ID NO: 2287494 - DNA, 19 bp, Homo sapiens
gaaaatggacgtgttatga

SEQ ID NO: 2287495 - DNA, 21 bp, Homo sapiens
gaaaattggcagtggcagaga

SEQ ID NO: 2287496 - DNA, 22 bp, Homo sapiens
gaaacaaaaaatattcatctgt

SEQ ID NO: 2287497 - DNA, 14 bp, Homo sapiens
gaaacaactgccaa

SEQ ID NO: 2287498 - DNA, 12 bp, Homo sapiens
gaaacaaggaag

SEQ ID NO: 2287499 - DNA, 21 bp, Homo sapiens
gaaacaaggattctacctgaa

SEQ ID NO: 2287500 - DNA, 21 bp, Homo sapiens
gaaacagaggaccagcacact

SEQ ID NO: 2287501 - DNA, 16 bp, Homo sapiens
gaaacgagatttgcca

SEQ ID NO: 2287502 - DNA, 13 bp, Homo sapiens
gaaacggacagct

SEQ ID NO: 2287503 - DNA, 20 bp, Homo sapiens
gaaactaaactaaaatagtt

SEQ ID NO: 2287504 - DNA, 23 bp, Homo sapiens
gaaagagaaaatgctttctcatg

SEQ ID NO: 2287505 - DNA, 13 bp, Homo sapiens
gaaagatggtaat

SEQ ID NO: 2287506 - DNA, 17 bp, Homo sapiens
gaaaggaaaagaggccc

SEQ ID NO: 2287507 - DNA, 14 bp, Homo sapiens
gaaagggagagggg

SEQ ID NO: 2287508 - DNA, 14 bp, Homo sapiens
gaaaggtcacctca

SEQ ID NO: 2287509 - DNA, 16 bp, Homo sapiens
gaaaggtcacctcact

SEQ ID NO: 2287510 - DNA, 19 bp, Homo sapiens
gaaaggtcctgtggggagc

SEQ ID NO: 2287511 - DNA, 13 bp, Homo sapiens
gaaagtatctcta

SEQ ID NO: 2287512 - DNA, 13 bp, Homo sapiens
gaaataaatctaa

SEQ ID NO: 2287513 - DNA, 15 bp, Homo sapiens
gaaataagactttta

SEQ ID NO: 2287514 - DNA, 18 bp, Homo sapiens
gaaatacactacaaatgt

SEQ ID NO: 2287515 - DNA, 15 bp, Homo sapiens
gaaatagtgttcttt

SEQ ID NO: 2287516 - DNA, 21 bp, Homo sapiens
gaaatagtgttctttttaaaa

SEQ ID NO: 2287517 - DNA, 13 bp, Homo sapiens
gaaatcctgttac

SEQ ID NO: 2287518 - DNA, 14 bp, Homo sapiens
gaaatgctgttggt

SEQ ID NO: 2287519 - DNA, 18 bp, Homo sapiens
gaaatgctgttggtgaga

SEQ ID NO: 2287520 - DNA, 17 bp, Homo sapiens
gaaatgtggatgctctt

SEQ ID NO: 2287521 - DNA, 15 bp, Homo sapiens
gaaattcacactgtg

SEQ ID NO: 2287522 - DNA, 14 bp, Homo sapiens
gaaattgtgccaaa

SEQ ID NO: 2287523 - DNA, 19 bp, Homo sapiens
gaaatttaaaaatctttca

SEQ ID NO: 2287524 - DNA, 16 bp, Homo sapiens
gaaattttctacagta

SEQ ID NO: 2287525 - DNA, 16 bp, Homo sapiens
gaacaagccagagccg

SEQ ID NO: 2287526 - DNA, 18 bp, Homo sapiens
gaacaaggcaaggctgtc

SEQ ID NO: 2287527 - DNA, 17 bp, Homo sapiens
gaacacccagccccagc

SEQ ID NO: 2287528 - DNA, 19 bp, Homo sapiens
gaacactaaagagctagga

SEQ ID NO: 2287529 - DNA, 14 bp, Homo sapiens
gaacactctgagac

SEQ ID NO: 2287530 - DNA, 21 bp, Homo sapiens
gaacaggaggtgtgaatgcac

SEQ ID NO: 2287531 - DNA, 14 bp, Homo sapiens
gaacatagatgcta

SEQ ID NO: 2287532 - DNA, 21 bp, Homo sapiens
gaacatgagtttatgggaatg

SEQ ID NO: 2287533 - DNA, 22 bp, Homo sapiens
gaacatttctaactaaggacag

SEQ ID NO: 2287534 - DNA, 16 bp, Homo sapiens
gaaccaagcactacca

SEQ ID NO: 2287535 - DNA, 13 bp, Homo sapiens
gaaccagcactcc

SEQ ID NO: 2287536 - DNA, 14 bp, Homo sapiens
gaaccagcactccc

SEQ ID NO: 2287537 - DNA, 15 bp, Homo sapiens
gaaccagcactccca

SEQ ID NO: 2287538 - DNA, 18 bp, Homo sapiens
gaaccagcactcccaggg

SEQ ID NO: 2287539 - DNA, 12 bp, Homo sapiens
gagcaaggctgc

SEQ ID NO: 2287540 - DNA, 19 bp, Homo sapiens
gagcaaggctgctaagtgg

SEQ ID NO: 2287541 - DNA, 17 bp, Homo sapiens
gagcaagtcccatctca

SEQ ID NO: 2287542 - DNA, 15 bp, Homo sapiens
gagcaccacggggtc

SEQ ID NO: 2287543 - DNA, 17 bp, Homo sapiens
gagcaccacggggtcgg

SEQ ID NO: 2287544 - DNA, 22 bp, Homo sapiens
gagcaccacggggtcgggggag

SEQ ID NO: 2287545 - DNA, 14 bp, Homo sapiens
gagcaccaggtgtt

SEQ ID NO: 2287546 - DNA, 19 bp, Homo sapiens
gagcacccccagcctcccc

SEQ ID NO: 2287547 - DNA, 20 bp, Homo sapiens
gagcacggttgcctgaggtc

SEQ ID NO: 2287548 - DNA, 21 bp, Homo sapiens
gagcactagaatgagaaatca

SEQ ID NO: 2287549 - DNA, 22 bp, Homo sapiens
gagcactagaatgagaaatcat

SEQ ID NO: 2287550 - DNA, 18 bp, Homo sapiens
gagcagagacggcagccc

SEQ ID NO: 2287551 - DNA, 18 bp, Homo sapiens
gagcagcgtgcaggagca

SEQ ID NO: 2287552 - DNA, 11 bp, Homo sapiens
gagcagtgggg

SEQ ID NO: 2287553 - DNA, 13 bp, Homo sapiens
gagcagtggggag

SEQ ID NO: 2287554 - DNA, 17 bp, Homo sapiens
gagcagtttggggcagg

SEQ ID NO: 2287555 - DNA, 14 bp, Homo sapiens
gagccacagtgggg

SEQ ID NO: 2287556 - DNA, 22 bp, Homo sapiens
gagccacagtggggcccatggc

SEQ ID NO: 2287557 - DNA, 16 bp, Homo sapiens
gagccactggggtggg

SEQ ID NO: 2287558 - DNA, 23 bp, Homo sapiens
gagccagatttcactctccttgg

SEQ ID NO: 2287559 - DNA, 17 bp, Homo sapiens
gagccatccaccctgag

SEQ ID NO: 2287560 - DNA, 19 bp, Homo sapiens
gagcccaggggaggcacaa

SEQ ID NO: 2287561 - DNA, 14 bp, Homo sapiens
gagcccctcctctc

SEQ ID NO: 2287562 - DNA, 21 bp, Homo sapiens
gagcccgcctgcgccccccag

SEQ ID NO: 2287563 - DNA, 13 bp, Homo sapiens
gagcccttccagg

SEQ ID NO: 2287564 - DNA, 22 bp, Homo sapiens
gagccgagctctcctgggccag

SEQ ID NO: 2287565 - DNA, 13 bp, Homo sapiens
gagcgccacccgc

SEQ ID NO: 2287566 - DNA, 14 bp, Homo sapiens
gagcgccacccgcc

SEQ ID NO: 2287567 - DNA, 16 bp, Homo sapiens
gagcgccacccgcccg

SEQ ID NO: 2287568 - DNA, 23 bp, Homo sapiens
gagcgccacccgcccgcccccgc

SEQ ID NO: 2287569 - DNA, 13 bp, Homo sapiens
gagcggctgagga

SEQ ID NO: 2287570 - DNA, 14 bp, Homo sapiens
gagcggctgaggac

SEQ ID NO: 2287571 - DNA, 23 bp, Homo sapiens
gagcggctgaggacggggcagag

SEQ ID NO: 2287572 - DNA, 21 bp, Homo sapiens
gagcgggggctaactggcccc

SEQ ID NO: 2287573 - DNA, 19 bp, Homo sapiens
gagctcagaggacggggag

SEQ ID NO: 2287574 - DNA, 17 bp, Homo sapiens
gagctcagcacagcctc

SEQ ID NO: 2287575 - DNA, 19 bp, Homo sapiens
gagctcagcacagcctcac

SEQ ID NO: 2287576 - DNA, 14 bp, Homo sapiens
gagctcccaggacg

SEQ ID NO: 2287577 - DNA, 16 bp, Homo sapiens
gagctctcctgggcca

SEQ ID NO: 2287578 - DNA, 17 bp, Homo sapiens
gagctctcctgggccag

SEQ ID NO: 2287579 - DNA, 22 bp, Homo sapiens
gagctctcctgggccagggtct

SEQ ID NO: 2287580 - DNA, 18 bp, Homo sapiens
gagcttcaactacttctc

SEQ ID NO: 2287581 - DNA, 22 bp, Homo sapiens
gagcttcccctaacctgggttg

SEQ ID NO: 2287582 - DNA, 13 bp, Homo sapiens
gaggaatgtgctt

SEQ ID NO: 2287583 - DNA, 18 bp, Homo sapiens
gaggaatgtgcttttcca

SEQ ID NO: 2287584 - DNA, 18 bp, Homo sapiens
gaggacacggaccctgtg

SEQ ID NO: 2287585 - DNA, 21 bp, Homo sapiens
gaggacaggccagtaggggga

SEQ ID NO: 2287586 - DNA, 14 bp, Homo sapiens
gaggaccagcacac

SEQ ID NO: 2287587 - DNA, 21 bp, Homo sapiens
gaggaccccattctgggactg

SEQ ID NO: 2287588 - DNA, 21 bp, Homo sapiens
gaggactgttctaactagtaa

SEQ ID NO: 2287589 - DNA, 17 bp, Homo sapiens
gaggagactcaggccca

SEQ ID NO: 2287590 - DNA, 16 bp, Homo sapiens
gaggagcacccccagc

SEQ ID NO: 2287591 - DNA, 18 bp, Homo sapiens
gaggagcacccccagcct

SEQ ID NO: 2287592 - DNA, 21 bp, Homo sapiens
gaggagcacccccagcctccc

SEQ ID NO: 2287593 - DNA, 20 bp, Homo sapiens
gaggagggtttgggcagagc

SEQ ID NO: 2287594 - DNA, 22 bp, Homo sapiens
gaggatgtataaaatggtcatg

SEQ ID NO: 2287595 - DNA, 21 bp, Homo sapiens
gaggatttggctcgctgtggt

SEQ ID NO: 2287596 - DNA, 17 bp, Homo sapiens
gaggcacaaagggcagg

SEQ ID NO: 2287597 - DNA, 21 bp, Homo sapiens
gaggcacaaagggcaggcctg

SEQ ID NO: 2287598 - DNA, 13 bp, Homo sapiens
gaggcagggtctc

SEQ ID NO: 2287599 - DNA, 23 bp, Homo sapiens
gaggcagggtctcactctgttga

SEQ ID NO: 2287600 - DNA, 21 bp, Homo sapiens
gaggcagtggcttggagcaga

SEQ ID NO: 2287601 - DNA, 22 bp, Homo sapiens
gaggcatgtgatgagaggaaat

SEQ ID NO: 2287602 - DNA, 21 bp, Homo sapiens
gaggcattcagcaattaaaga

SEQ ID NO: 2287603 - DNA, 23 bp, Homo sapiens
gaggccaaacacccaagcacaaa

SEQ ID NO: 2287604 - DNA, 17 bp, Homo sapiens
gaggccagtactttgcc

SEQ ID NO: 2287605 - DNA, 20 bp, Homo sapiens
gaggcccccggaggcgccca

SEQ ID NO: 2287606 - DNA, 20 bp, Homo sapiens
gaggccttcagaaaagacac

SEQ ID NO: 2287607 - DNA, 21 bp, Homo sapiens
gaggccttcagaaaagacact

SEQ ID NO: 2287608 - DNA, 12 bp, Homo sapiens
gaggcgcccacc

SEQ ID NO: 2287609 - DNA, 16 bp, Homo sapiens
gaggcgtcttgtattt

SEQ ID NO: 2287610 - DNA, 13 bp, Homo sapiens
gaggcttccagct

SEQ ID NO: 2287611 - DNA, 14 bp, Homo sapiens
gaggcttccagctc

SEQ ID NO: 2287612 - DNA, 15 bp, Homo sapiens
gaggcttccagctca

SEQ ID NO: 2287613 - DNA, 20 bp, Homo sapiens
gaggcttccagctcagtccc

SEQ ID NO: 2287614 - DNA, 22 bp, Homo sapiens
gaggcttcctactataaaatgt

SEQ ID NO: 2287615 - DNA, 20 bp, Homo sapiens
gagggaagcccacccgcccc

SEQ ID NO: 2287616 - DNA, 22 bp, Homo sapiens
gagggaagcccacccgccccag

SEQ ID NO: 2287617 - DNA, 23 bp, Homo sapiens
gagggaagcccacccgccccaga

SEQ ID NO: 2287618 - DNA, 22 bp, Homo sapiens
gagggaatccatatcagctctg

SEQ ID NO: 2287619 - DNA, 17 bp, Homo sapiens
gagggatagagacgcag

SEQ ID NO: 2287620 - DNA, 15 bp, Homo sapiens
gagggctgagcccct

SEQ ID NO: 2287621 - DNA, 17 bp, Homo sapiens
gagggctgagcccctcc

SEQ ID NO: 2287622 - DNA, 17 bp, Homo sapiens
gagggctgggcagggcc

SEQ ID NO: 2287623 - DNA, 19 bp, Homo sapiens
gagggctgggcagggccct

SEQ ID NO: 2287624 - DNA, 17 bp, Homo sapiens
gaggggaagagagaggc

SEQ ID NO: 2287625 - DNA, 14 bp, Homo sapiens
gaggggagcaaggc

SEQ ID NO: 2287626 - DNA, 15 bp, Homo sapiens
gaggggcttggagca

SEQ ID NO: 2287627 - DNA, 17 bp, Homo sapiens
gaggggcttggagcaga

SEQ ID NO: 2287628 - DNA, 12 bp, Homo sapiens
gagggggcaggg

SEQ ID NO: 2287629 - DNA, 15 bp, Homo sapiens
gagggggcagggggc

SEQ ID NO: 2287630 - DNA, 13 bp, Homo sapiens
gaggggggcggtg

SEQ ID NO: 2287631 - DNA, 24 bp, Homo sapiens
gagggtgccgcgggcgagaagggc

SEQ ID NO: 2287632 - DNA, 17 bp, Homo sapiens
gagggtttgggcagagc

SEQ ID NO: 2287633 - DNA, 14 bp, Homo sapiens
gaggtcactggctg

SEQ ID NO: 2287634 - DNA, 20 bp, Homo sapiens
gaggtgggcgtatcacctga

SEQ ID NO: 2287635 - DNA, 17 bp, Homo sapiens
gaggtggggagggcctc

SEQ ID NO: 2287636 - DNA, 14 bp, Homo sapiens
gaggttcatttttc

SEQ ID NO: 2287637 - DNA, 13 bp, Homo sapiens
gagtaatattaca

SEQ ID NO: 2287638 - DNA, 21 bp, Homo sapiens
gagtagataagtgctcagtat

SEQ ID NO: 2287639 - DNA, 14 bp, Homo sapiens
gagtagctgggact

SEQ ID NO: 2287640 - DNA, 15 bp, Homo sapiens
gagtaggctgtattt

SEQ ID NO: 2287641 - DNA, 17 bp, Homo sapiens
gagtatatatgtacagt

SEQ ID NO: 2287642 - DNA, 22 bp, Homo sapiens
gagtatgcaagaagaatataaa

SEQ ID NO: 2287643 - DNA, 14 bp, Homo sapiens
gagtcaacaggtca

SEQ ID NO: 2287644 - DNA, 19 bp, Homo sapiens
gagtcagggagccctgggg

SEQ ID NO: 2287645 - DNA, 18 bp, Homo sapiens
gagtccaaaatcattccc

SEQ ID NO: 2287646 - DNA, 13 bp, Homo sapiens
gagtccagacctg

SEQ ID NO: 2287647 - DNA, 20 bp, Homo sapiens
gagtccagacctgggccctg

SEQ ID NO: 2287648 - DNA, 23 bp, Homo sapiens
gagtccctcctcccccacgcctc

SEQ ID NO: 2287649 - DNA, 18 bp, Homo sapiens
gagtcggctgggcagggc

SEQ ID NO: 2287650 - DNA, 23 bp, Homo sapiens
gagtcggctgggcagggccgcag

SEQ ID NO: 2287651 - DNA, 16 bp, Homo sapiens
gagtctcattcctctg

SEQ ID NO: 2287652 - DNA, 16 bp, Homo sapiens
gagtctgattgcagga

SEQ ID NO: 2287653 - DNA, 12 bp, Homo sapiens
gagtctggagac

SEQ ID NO: 2287654 - DNA, 18 bp, Homo sapiens
gagtctggagaccaggac

SEQ ID NO: 2287655 - DNA, 21 bp, Homo sapiens
gagtgaatgttaacatgcgca

SEQ ID NO: 2287656 - DNA, 20 bp, Homo sapiens
gagtgagctaccaggaagag

SEQ ID NO: 2287657 - DNA, 16 bp, Homo sapiens
gagtgaggtcatcccg

SEQ ID NO: 2287658 - DNA, 20 bp, Homo sapiens
gagtgaggtcatcccggggc

SEQ ID NO: 2287659 - DNA, 22 bp, Homo sapiens
gagtgatcctcccgccccagcc

SEQ ID NO: 2287660 - DNA, 23 bp, Homo sapiens
gagtgatcctcccgccccagcct

SEQ ID NO: 2287661 - DNA, 13 bp, Homo sapiens
gagtgatgggcaa

SEQ ID NO: 2287662 - DNA, 22 bp, Homo sapiens
gagtgatgggcaaggggccagg

SEQ ID NO: 2287663 - DNA, 23 bp, Homo sapiens
gagtgatgggcaaggggccagga

SEQ ID NO: 2287664 - DNA, 17 bp, Homo sapiens
gagtgccccagaaatgc

SEQ ID NO: 2287665 - DNA, 20 bp, Homo sapiens
gagtggcatggtcctgtgcc

SEQ ID NO: 2287666 - DNA, 15 bp, Homo sapiens
gagtgggctctgagc

SEQ ID NO: 2287667 - DNA, 17 bp, Homo sapiens
gagtgggtgggacacag

SEQ ID NO: 2287668 - DNA, 17 bp, Homo sapiens
gagtggtccacattctg

SEQ ID NO: 2287669 - DNA, 22 bp, Homo sapiens
gagtgtggcgggaagggtgggc

SEQ ID NO: 2287670 - DNA, 12 bp, Homo sapiens
gagttacagaca

SEQ ID NO: 2287671 - DNA, 19 bp, Homo sapiens
gagttctccttgtacttga

SEQ ID NO: 2287672 - DNA, 14 bp, Homo sapiens
gagttgagcacagg

SEQ ID NO: 2287673 - DNA, 15 bp, Homo sapiens
gagttgtctgtcctg

SEQ ID NO: 2287674 - DNA, 16 bp, Homo sapiens
gataaaatcttcaact

SEQ ID NO: 2287675 - DNA, 15 bp, Homo sapiens
gataaagtgaccagg

SEQ ID NO: 2287676 - DNA, 12 bp, Homo sapiens
gataaatgaaca

SEQ ID NO: 2287677 - DNA, 14 bp, Homo sapiens
gataaatgctttaa

SEQ ID NO: 2287678 - DNA, 16 bp, Homo sapiens
gataaatgctttaaat

SEQ ID NO: 2287679 - DNA, 15 bp, Homo sapiens
gataataactagatc

SEQ ID NO: 2287680 - DNA, 19 bp, Homo sapiens
gataatagtaatggttcta

SEQ ID NO: 2287681 - DNA, 23 bp, Homo sapiens
gataatgatctgaatctgtttct

SEQ ID NO: 2287682 - DNA, 19 bp, Homo sapiens
gatactatttagataacaa

SEQ ID NO: 2287683 - DNA, 15 bp, Homo sapiens
gatacttttattgtt

SEQ ID NO: 2287684 - DNA, 16 bp, Homo sapiens
gatagagtttaacaga

SEQ ID NO: 2287685 - DNA, 14 bp, Homo sapiens
gatataattactta

SEQ ID NO: 2287686 - DNA, 18 bp, Homo sapiens
gatataattacttaatgt

SEQ ID NO: 2287687 - DNA, 20 bp, Homo sapiens
gatatacaattagagatatt

SEQ ID NO: 2287688 - DNA, 20 bp, Homo sapiens
gatatacagacctccagatt

SEQ ID NO: 2287689 - DNA, 21 bp, Homo sapiens
gatatatatttccaaatattc

SEQ ID NO: 2287690 - DNA, 16 bp, Homo sapiens
gatatatgtaaatata

SEQ ID NO: 2287691 - DNA, 15 bp, Homo sapiens
gatatgaaagagaaa

SEQ ID NO: 2287692 - DNA, 18 bp, Homo sapiens
gatattcatactttccaa

SEQ ID NO: 2287693 - DNA, 14 bp, Homo sapiens
gatatttaaattta

SEQ ID NO: 2287694 - DNA, 15 bp, Homo sapiens
gatatttaaatttag

SEQ ID NO: 2287695 - DNA, 14 bp, Homo sapiens
gatcacaacttttc

SEQ ID NO: 2287696 - DNA, 16 bp, Homo sapiens
gatcacaacttttctg

SEQ ID NO: 2287697 - DNA, 15 bp, Homo sapiens
gatcacactatttta

SEQ ID NO: 2287698 - DNA, 22 bp, Homo sapiens
gatcagacttgatttacaagca

SEQ ID NO: 2287699 - DNA, 16 bp, Homo sapiens
gatcatgctgcagtgg

SEQ ID NO: 2287700 - DNA, 19 bp, Homo sapiens
gatcattgcagtatcagag

SEQ ID NO: 2287701 - DNA, 18 bp, Homo sapiens
gatccagagacctgctcc

SEQ ID NO: 2287702 - DNA, 19 bp, Homo sapiens
gatccagagacctgctcca

SEQ ID NO: 2287703 - DNA, 20 bp, Homo sapiens
gatcccagctcactgcagcc

SEQ ID NO: 2287704 - DNA, 22 bp, Homo sapiens
gatcccagctcactgcagcctc

SEQ ID NO: 2287705 - DNA, 23 bp, Homo sapiens
gatcccagctcactgcagcctcg

SEQ ID NO: 2287706 - DNA, 19 bp, Homo sapiens
gatcctccttcctcatcct

SEQ ID NO: 2287707 - DNA, 21 bp, Homo sapiens
gatcctctttccccactgaag

SEQ ID NO: 2287708 - DNA, 22 bp, Homo sapiens
gatcctgagccagatttcactc

SEQ ID NO: 2287709 - DNA, 21 bp, Homo sapiens
gatcctgtcccatgggctctg

SEQ ID NO: 2287710 - DNA, 22 bp, Homo sapiens
gatcctgtcccatgggctctgg

SEQ ID NO: 2287711 - DNA, 21 bp, Homo sapiens
gatctcagataaagtgaccag

SEQ ID NO: 2287712 - DNA, 13 bp, Homo sapiens
gatctcctgtaat

SEQ ID NO: 2287713 - DNA, 13 bp, Homo sapiens
gatctcggtgctg

SEQ ID NO: 2287714 - DNA, 22 bp, Homo sapiens
gatctgtcttgtaatattttgt

SEQ ID NO: 2287715 - DNA, 23 bp, Homo sapiens
gatgaactcaatgcatgatgact

SEQ ID NO: 2287716 - DNA, 22 bp, Homo sapiens
gatgaatcagtatgaagacact

SEQ ID NO: 2287717 - DNA, 18 bp, Homo sapiens
gatgacacataaatctgt

SEQ ID NO: 2287718 - DNA, 20 bp, Homo sapiens
gatgaccttgaatgatgcca

SEQ ID NO: 2287719 - DNA, 14 bp, Homo sapiens
gatgactcttctta

SEQ ID NO: 2287720 - DNA, 13 bp, Homo sapiens
gatgactggaaac

SEQ ID NO: 2287721 - DNA, 14 bp, Homo sapiens
gatgagaggaaatc

SEQ ID NO: 2287722 - DNA, 13 bp, Homo sapiens
gatgcaataaaca

SEQ ID NO: 2287723 - DNA, 18 bp, Homo sapiens
gatgcgggcatggcagcc

SEQ ID NO: 2287724 - DNA, 20 bp, Homo sapiens
gatgctattaaagtttcatt

SEQ ID NO: 2287725 - DNA, 13 bp, Homo sapiens
gatggcagagcca

SEQ ID NO: 2287726 - DNA, 15 bp, Homo sapiens
gatggcagaggagct

SEQ ID NO: 2287727 - DNA, 15 bp, Homo sapiens
gatggcccgagagct

SEQ ID NO: 2287728 - DNA, 21 bp, Homo sapiens
gatggcccgagagctgggact

SEQ ID NO: 2287729 - DNA, 15 bp, Homo sapiens
gatggcgcacccggc

SEQ ID NO: 2287730 - DNA, 21 bp, Homo sapiens
gatggcgcacccggcagcccc

SEQ ID NO: 2287731 - DNA, 17 bp, Homo sapiens
gatggcgtgtcccctgc

SEQ ID NO: 2287732 - DNA, 22 bp, Homo sapiens
gatggcgtgtcccctgcctgtg

SEQ ID NO: 2287733 - DNA, 12 bp, Homo sapiens
gatgggcacagg

SEQ ID NO: 2287734 - DNA, 13 bp, Homo sapiens
gatgggcacaggc

SEQ ID NO: 2287735 - DNA, 18 bp, Homo sapiens
gatgggcacaggctgccc

SEQ ID NO: 2287736 - DNA, 18 bp, Homo sapiens
gatgggggctcctggcag

SEQ ID NO: 2287737 - DNA, 20 bp, Homo sapiens
gatgggggctcctggcagtg

SEQ ID NO: 2287738 - DNA, 21 bp, Homo sapiens
gatgtatagctttaacatttt

SEQ ID NO: 2287739 - DNA, 20 bp, Homo sapiens
gatgtattttcaataaagaa

SEQ ID NO: 2287740 - DNA, 20 bp, Homo sapiens
gattaaatttaatatactgc

SEQ ID NO: 2287741 - DNA, 23 bp, Homo sapiens
gattaatttgtgtagattgtgta

SEQ ID NO: 2287742 - DNA, 21 bp, Homo sapiens
gattacaggtgtgagccacag

SEQ ID NO: 2287743 - DNA, 18 bp, Homo sapiens
gattatatacaaagctgt

SEQ ID NO: 2287744 - DNA, 13 bp, Homo sapiens
gattattgaatgt

SEQ ID NO: 2287745 - DNA, 14 bp, Homo sapiens
gattattttctata

SEQ ID NO: 2287746 - DNA, 19 bp, Homo sapiens
gattcaacaggttttcctg

SEQ ID NO: 2287747 - DNA, 11 bp, Homo sapiens
gattcaatgtg

SEQ ID NO: 2287748 - DNA, 17 bp, Homo sapiens
gattcagtcttgcctta

SEQ ID NO: 2287749 - DNA, 18 bp, Homo sapiens
gattcagtcttgccttac

SEQ ID NO: 2287750 - DNA, 20 bp, Homo sapiens
gattcatttcatcttgcaaa

SEQ ID NO: 2287751 - DNA, 16 bp, Homo sapiens
gattccaagggcccag

SEQ ID NO: 2287752 - DNA, 21 bp, Homo sapiens
gattccactgaaacctctgtt

SEQ ID NO: 2287753 - DNA, 22 bp, Homo sapiens
gattccactgaaacctctgttc

SEQ ID NO: 2287754 - DNA, 21 bp, Homo sapiens
gattccagaacgccctgtgtc

SEQ ID NO: 2287755 - DNA, 15 bp, Homo sapiens
gattccccggagctg

SEQ ID NO: 2287756 - DNA, 16 bp, Homo sapiens
gattccccggagctgg

SEQ ID NO: 2287757 - DNA, 18 bp, Homo sapiens
gattccccggagctggga

SEQ ID NO: 2287758 - DNA, 16 bp, Homo sapiens
gattcctgccaagtag

SEQ ID NO: 2287759 - DNA, 14 bp, Homo sapiens
gattctaaaacatt

SEQ ID NO: 2287760 - DNA, 19 bp, Homo sapiens
gattctaaaacattcttta

SEQ ID NO: 2287761 - DNA, 20 bp, Homo sapiens
gattctaaaacattctttaa

SEQ ID NO: 2287762 - DNA, 14 bp, Homo sapiens
gattctatatttca

SEQ ID NO: 2287763 - DNA, 21 bp, Homo sapiens
gattctatgcctgtatttcca

SEQ ID NO: 2287764 - DNA, 15 bp, Homo sapiens
gattctgcagctgct

SEQ ID NO: 2287765 - DNA, 22 bp, Homo sapiens
gattcttttttcaatgtactgt

SEQ ID NO: 2287766 - DNA, 16 bp, Homo sapiens
gattgaaaagaagaaa

SEQ ID NO: 2287767 - DNA, 20 bp, Homo sapiens
gatttcaatgattgtttaat

SEQ ID NO: 2287768 - DNA, 17 bp, Homo sapiens
gatttcactctccttgg

SEQ ID NO: 2287769 - DNA, 15 bp, Homo sapiens
gatttccatttgcaa

SEQ ID NO: 2287770 - DNA, 18 bp, Homo sapiens
gatttcctttgacctctc

SEQ ID NO: 2287771 - DNA, 11 bp, Homo sapiens
gatttctttcc

SEQ ID NO: 2287772 - DNA, 23 bp, Homo sapiens
gatttctttccttcccaataggt

SEQ ID NO: 2287773 - DNA, 20 bp, Homo sapiens
gatttgatatacagacctcc

SEQ ID NO: 2287774 - DNA, 22 bp, Homo sapiens
gatttgatatacagacctccag

SEQ ID NO: 2287775 - DNA, 19 bp, Homo sapiens
gatttgcatattcattcat

SEQ ID NO: 2287776 - DNA, 11 bp, Homo sapiens
gatttggctcg

SEQ ID NO: 2287777 - DNA, 22 bp, Homo sapiens
gatttgtatttatattagagtg

SEQ ID NO: 2287778 - DNA, 17 bp, Homo sapiens
gatttttttttccttca

SEQ ID NO: 2287779 - DNA, 18 bp, Homo sapiens
gcaaaaataaaatggaca

SEQ ID NO: 2287780 - DNA, 12 bp, Homo sapiens
gcaaaaatattt

SEQ ID NO: 2287781 - DNA, 13 bp, Homo sapiens
gcaaaaatatttt

SEQ ID NO: 2287782 - DNA, 17 bp, Homo sapiens
gcaaaaatattttgcaa

SEQ ID NO: 2287783 - DNA, 20 bp, Homo sapiens
gcaaacatttctttttcctt

SEQ ID NO: 2287784 - DNA, 12 bp, Homo sapiens
gcaaaccatcat

SEQ ID NO: 2287785 - DNA, 20 bp, Homo sapiens
gcaaaccatcattgaaatct

SEQ ID NO: 2287786 - DNA, 21 bp, Homo sapiens
gcaaaccatcattgaaatctt

SEQ ID NO: 2287787 - DNA, 17 bp, Homo sapiens
gcaaaggctggctgtgt

SEQ ID NO: 2287788 - DNA, 16 bp, Homo sapiens
gcaaagggcgggcctg

SEQ ID NO: 2287789 - DNA, 17 bp, Homo sapiens
gcaaagtaaaattagag

SEQ ID NO: 2287790 - DNA, 14 bp, Homo sapiens
gcaaagtttccatg

SEQ ID NO: 2287791 - DNA, 18 bp, Homo sapiens
gcaaatgcacatttgtca

SEQ ID NO: 2287792 - DNA, 15 bp, Homo sapiens
gcaaattattctagt

SEQ ID NO: 2287793 - DNA, 17 bp, Homo sapiens
gcaaattcttgaataaa

SEQ ID NO: 2287794 - DNA, 14 bp, Homo sapiens
gcaacaccctcttc

SEQ ID NO: 2287795 - DNA, 21 bp, Homo sapiens
gcaacactcactgcctgcagc

SEQ ID NO: 2287796 - DNA, 20 bp, Homo sapiens
gcaaccaataaaagtgtcac

SEQ ID NO: 2287797 - DNA, 18 bp, Homo sapiens
gcaaccaccaccaaccac

SEQ ID NO: 2287798 - DNA, 16 bp, Homo sapiens
gcaaccagagcactgt

SEQ ID NO: 2287799 - DNA, 19 bp, Homo sapiens
gcaaccagagcactgtata

SEQ ID NO: 2287800 - DNA, 15 bp, Homo sapiens
gcaagaagattctaa

SEQ ID NO: 2287801 - DNA, 16 bp, Homo sapiens
gcaagaagattctaaa

SEQ ID NO: 2287802 - DNA, 21 bp, Homo sapiens
gcaagaagattctaaaacatt

SEQ ID NO: 2287803 - DNA, 17 bp, Homo sapiens
gcaagcgaaagagcaaa

SEQ ID NO: 2287804 - DNA, 18 bp, Homo sapiens
gcaagcgaaagagcaaag

SEQ ID NO: 2287805 - DNA, 15 bp, Homo sapiens
gcaaggcagctccca

SEQ ID NO: 2287806 - DNA, 14 bp, Homo sapiens
gcaaggctgccctg

SEQ ID NO: 2287807 - DNA, 17 bp, Homo sapiens
gcaaggctgccctgtcc

SEQ ID NO: 2287808 - DNA, 11 bp, Homo sapiens
gcaaggctgtc

SEQ ID NO: 2287809 - DNA, 13 bp, Homo sapiens
gcaaggctgtcaa

SEQ ID NO: 2287810 - DNA, 13 bp, Homo sapiens
actgtgcactata

SEQ ID NO: 2287811 - DNA, 18 bp, Homo sapiens
actgtgcgttttagagta

SEQ ID NO: 2287812 - DNA, 13 bp, Homo sapiens
actgtggcctcag

SEQ ID NO: 2287813 - DNA, 15 bp, Homo sapiens
actgtgttacatgtt

SEQ ID NO: 2287814 - DNA, 17 bp, Homo sapiens
actgtgttgcccaggct

SEQ ID NO: 2287815 - DNA, 15 bp, Homo sapiens
tctcattcctctgtc

SEQ ID NO: 2287816 - DNA, 20 bp, Homo sapiens
tctcattttgcttttctcta

SEQ ID NO: 2287817 - DNA, 21 bp, Homo sapiens
tctccaaagcttgccactttc

SEQ ID NO: 2287818 - DNA, 16 bp, Homo sapiens
tctccacctgaagtga

SEQ ID NO: 2287819 - DNA, 14 bp, Homo sapiens
tctccagattttta

SEQ ID NO: 2287820 - DNA, 15 bp, Homo sapiens
tctccaggcaccgcc

SEQ ID NO: 2287821 - DNA, 24 bp, Homo sapiens
tctccataggagggaaggagcagt

SEQ ID NO: 2287822 - DNA, 13 bp, Homo sapiens
tctccatgctctt

SEQ ID NO: 2287823 - DNA, 17 bp, Homo sapiens
tctccatttcacgggca

SEQ ID NO: 2287824 - DNA, 17 bp, Homo sapiens
tctcccagacctaggga

SEQ ID NO: 2287825 - DNA, 17 bp, Homo sapiens
tctcccctgcgcaggcc

SEQ ID NO: 2287826 - DNA, 19 bp, Homo sapiens
tctcctgcgtgttctcaga

SEQ ID NO: 2287827 - DNA, 12 bp, Homo sapiens
tctcctgggcca

SEQ ID NO: 2287828 - DNA, 13 bp, Homo sapiens
tctcctgggccag

SEQ ID NO: 2287829 - DNA, 16 bp, Homo sapiens
tctcctgtaattttgt

SEQ ID NO: 2287830 - DNA, 12 bp, Homo sapiens
tctccttgtact

SEQ ID NO: 2287831 - DNA, 22 bp, Homo sapiens
tctccttgtcacagaatctcca

SEQ ID NO: 2287832 - DNA, 16 bp, Homo sapiens
tctccttttctccact

SEQ ID NO: 2287833 - DNA, 21 bp, Homo sapiens
tctcgtactttcacatctctg

SEQ ID NO: 2287834 - DNA, 23 bp, Homo sapiens
tctcgtgttattttaatctcaga

SEQ ID NO: 2287835 - DNA, 14 bp, Homo sapiens
tctctaaacccaaa

SEQ ID NO: 2287836 - DNA, 14 bp, Homo sapiens
tctctaatagaagt

SEQ ID NO: 2287837 - DNA, 15 bp, Homo sapiens
tctctactttcctga

SEQ ID NO: 2287838 - DNA, 12 bp, Homo sapiens
tctctagagaac

SEQ ID NO: 2287839 - DNA, 21 bp, Homo sapiens
tctctatatatacatgtatag

SEQ ID NO: 2287840 - DNA, 14 bp, Homo sapiens
tctctctatatata

SEQ ID NO: 2287841 - DNA, 19 bp, Homo sapiens
tctctgagaccacagaggc

SEQ ID NO: 2287842 - DNA, 20 bp, Homo sapiens
tctctgatcacaacttttct

SEQ ID NO: 2287843 - DNA, 17 bp, Homo sapiens
tctctgccctgccctgg

SEQ ID NO: 2287844 - DNA, 19 bp, Homo sapiens
tctctgccctgccctggcc

SEQ ID NO: 2287845 - DNA, 20 bp, Homo sapiens
tctctgtgactcgcttagct

SEQ ID NO: 2287846 - DNA, 19 bp, Homo sapiens
tctcttacgctctctgtct

SEQ ID NO: 2287847 - DNA, 17 bp, Homo sapiens
tctcttctgcacagctc

SEQ ID NO: 2287848 - DNA, 21 bp, Homo sapiens
tctcttggggaaggatctccc

SEQ ID NO: 2287849 - DNA, 23 bp, Homo sapiens
tctcttggggaaggatctccccg

SEQ ID NO: 2287850 - DNA, 15 bp, Homo sapiens
tctcttgtaccagcc

SEQ ID NO: 2287851 - DNA, 17 bp, Homo sapiens
tctcttgtaccagccca

SEQ ID NO: 2287852 - DNA, 13 bp, Homo sapiens
tctctttccatct

SEQ ID NO: 2287853 - DNA, 16 bp, Homo sapiens
tctcttttttgggggg

SEQ ID NO: 2287854 - DNA, 14 bp, Homo sapiens
tctgaaaactgttt

SEQ ID NO: 2287855 - DNA, 18 bp, Homo sapiens
tctgaaaagaaatgctaa

SEQ ID NO: 2287856 - DNA, 19 bp, Homo sapiens
tctgaagggaggggaagag

SEQ ID NO: 2287857 - DNA, 18 bp, Homo sapiens
tctgaaggtccaaagagt

SEQ ID NO: 2287858 - DNA, 18 bp, Homo sapiens
tctgaatcaaaagctgaa

SEQ ID NO: 2287859 - DNA, 23 bp, Homo sapiens
tctgacctgcccccgctctgcca

SEQ ID NO: 2287860 - DNA, 15 bp, Homo sapiens
tctgagtgaatgtta

SEQ ID NO: 2287861 - DNA, 22 bp, Homo sapiens
tctgataagactggaaaatagt

SEQ ID NO: 2287862 - DNA, 15 bp, Homo sapiens
tctgatcacaacttt

SEQ ID NO: 2287863 - DNA, 13 bp, Homo sapiens
tctgattctatgc

SEQ ID NO: 2287864 - DNA, 22 bp, Homo sapiens
tctgattctatgcctgtatttc

SEQ ID NO: 2287865 - DNA, 16 bp, Homo sapiens
tctgcaaacaaacacc

SEQ ID NO: 2287866 - DNA, 14 bp, Homo sapiens
tctgcacagggtcc

SEQ ID NO: 2287867 - DNA, 14 bp, Homo sapiens
tctgcagcctgagc

SEQ ID NO: 2287868 - DNA, 18 bp, Homo sapiens
tctgcagctgcttttgca

SEQ ID NO: 2287869 - DNA, 15 bp, Homo sapiens
tctgcagtattctgt

SEQ ID NO: 2287870 - DNA, 16 bp, Homo sapiens
tctgcagtattctgta

SEQ ID NO: 2287871 - DNA, 13 bp, Homo sapiens
tctgcatttggta

SEQ ID NO: 2287872 - DNA, 16 bp, Homo sapiens
tctgccatcagcccct

SEQ ID NO: 2287873 - DNA, 23 bp, Homo sapiens
tctgccatcagcccctgctgctc

SEQ ID NO: 2287874 - DNA, 9 bp, Homo sapiens
tctgccccc

SEQ ID NO: 2287875 - DNA, 15 bp, Homo sapiens
tctgccccctccccc

SEQ ID NO: 2287876 - DNA, 19 bp, Homo sapiens
tctgccccctcccccgcag

SEQ ID NO: 2287877 - DNA, 15 bp, Homo sapiens
tctgccctgccctgg

SEQ ID NO: 2287878 - DNA, 16 bp, Homo sapiens
tctgccctgccctggc

SEQ ID NO: 2287879 - DNA, 14 bp, Homo sapiens
tctgccttccaggc

SEQ ID NO: 2287880 - DNA, 13 bp, Homo sapiens
tctgcgtcccact

SEQ ID NO: 2287881 - DNA, 15 bp, Homo sapiens
tctgctacctggttt

SEQ ID NO: 2287882 - DNA, 21 bp, Homo sapiens
tctgctctgttttgcatggag

SEQ ID NO: 2287883 - DNA, 13 bp, Homo sapiens
tctgctgccccca

SEQ ID NO: 2287884 - DNA, 15 bp, Homo sapiens
tctgctgcctctgaa

SEQ ID NO: 2287885 - DNA, 20 bp, Homo sapiens
tctgctgcctctgaaaatat

SEQ ID NO: 2287886 - DNA, 21 bp, Homo sapiens
tctgctgcctctgaaaatatt

SEQ ID NO: 2287887 - DNA, 21 bp, Homo sapiens
tctgctgcctgtttggggagg

SEQ ID NO: 2287888 - DNA, 13 bp, Homo sapiens
tctgctgggctgg

SEQ ID NO: 2287889 - DNA, 18 bp, Homo sapiens
tctgcttaccaaaacata

SEQ ID NO: 2287890 - DNA, 23 bp, Homo sapiens
tctgctttggggcttatcagaac

SEQ ID NO: 2287891 - DNA, 18 bp, Homo sapiens
tctggaatactgaaaaag

SEQ ID NO: 2287892 - DNA, 20 bp, Homo sapiens
tctggagaccaggactctgc

SEQ ID NO: 2287893 - DNA, 23 bp, Homo sapiens
tctggagaccaggactctgcctt

SEQ ID NO: 2287894 - DNA, 22 bp, Homo sapiens
tctggagcccgcctgcgccccc

SEQ ID NO: 2287895 - DNA, 17 bp, Homo sapiens
tctggcagtctggagca

SEQ ID NO: 2287896 - DNA, 17 bp, Homo sapiens
tctggctgaaaatggtg

SEQ ID NO: 2287897 - DNA, 13 bp, Homo sapiens
tctggggccagcc

SEQ ID NO: 2287898 - DNA, 16 bp, Homo sapiens
tctggggccagcccct

SEQ ID NO: 2287899 - DNA, 20 bp, Homo sapiens
tctggggccagcccctcccc

SEQ ID NO: 2287900 - DNA, 12 bp, Homo sapiens
tctggggccctt

SEQ ID NO: 2287901 - DNA, 24 bp, Homo sapiens
tctggtctcgtgttcgctggctga

SEQ ID NO: 2287902 - DNA, 16 bp, Homo sapiens
tctggtggtttaatac

SEQ ID NO: 2287903 - DNA, 16 bp, Homo sapiens
tctggtgttctcaatg

SEQ ID NO: 2287904 - DNA, 15 bp, Homo sapiens
tctgtaaatttaact

SEQ ID NO: 2287905 - DNA, 19 bp, Homo sapiens
tctgtaaatttaactgcat

SEQ ID NO: 2287906 - DNA, 23 bp, Homo sapiens
tctgtacttcagttctcatcttg

SEQ ID NO: 2287907 - DNA, 15 bp, Homo sapiens
tctgtagttgctttg

SEQ ID NO: 2287908 - DNA, 18 bp, Homo sapiens
tctgtatatcagctctaa

SEQ ID NO: 2287909 - DNA, 14 bp, Homo sapiens
tctgtctgattcta

SEQ ID NO: 2287910 - DNA, 16 bp, Homo sapiens
tctgtctgattctatg

SEQ ID NO: 2287911 - DNA, 17 bp, Homo sapiens
tctgtctgattctatgc

SEQ ID NO: 2287912 - DNA, 18 bp, Homo sapiens
tctgtctggctgtacgtc

SEQ ID NO: 2287913 - DNA, 16 bp, Homo sapiens
tctgtcttaaagaatt

SEQ ID NO: 2287914 - DNA, 14 bp, Homo sapiens
tctgtcttgtaata

SEQ ID NO: 2287915 - DNA, 14 bp, Homo sapiens
tctgtggattctat

SEQ ID NO: 2287916 - DNA, 21 bp, Homo sapiens
tctgtggctgccatcagaaat

SEQ ID NO: 2287917 - DNA, 14 bp, Homo sapiens
tctgtggggccaca

SEQ ID NO: 2287918 - DNA, 14 bp, Homo sapiens
tctgtgtaaacaga

SEQ ID NO: 2287919 - DNA, 16 bp, Homo sapiens
tctgtgtaatctctga

SEQ ID NO: 2287920 - DNA, 17 bp, Homo sapiens
tctgtgtaatctctgat

SEQ ID NO: 2287921 - DNA, 19 bp, Homo sapiens
tctgttacacaatatgtgt

SEQ ID NO: 2287922 - DNA, 14 bp, Homo sapiens
tctgttactccaaa

SEQ ID NO: 2287923 - DNA, 21 bp, Homo sapiens
tctgttagcattattgccaaa

SEQ ID NO: 2287924 - DNA, 19 bp, Homo sapiens
tctgttgttcagtcctctg

SEQ ID NO: 2287925 - DNA, 17 bp, Homo sapiens
tcttaaagaatttgaaa

SEQ ID NO: 2287926 - DNA, 18 bp, Homo sapiens
tcttaaagaatttgaaag

SEQ ID NO: 2287927 - DNA, 12 bp, Homo sapiens
tcttaagacact

SEQ ID NO: 2287928 - DNA, 19 bp, Homo sapiens
tcttacagtgtttggacag

SEQ ID NO: 2287929 - DNA, 19 bp, Homo sapiens
tcttactttcctgaaaata

SEQ ID NO: 2287930 - DNA, 16 bp, Homo sapiens
tcttaggtttccacgt

SEQ ID NO: 2287931 - DNA, 16 bp, Homo sapiens
tcttatcacacttgca

SEQ ID NO: 2287932 - DNA, 22 bp, Homo sapiens
tcttatccaattcattatgtca

SEQ ID NO: 2287933 - DNA, 23 bp, Homo sapiens
tcttatctagcaagaagattcta

SEQ ID NO: 2287934 - DNA, 16 bp, Homo sapiens
tcttattaaccaaatt

SEQ ID NO: 2287935 - DNA, 17 bp, Homo sapiens
tcttattcactgagtct

SEQ ID NO: 2287936 - DNA, 16 bp, Homo sapiens
tcttcaaaaactgttt

SEQ ID NO: 2287937 - DNA, 17 bp, Homo sapiens
tcttcaaccctgccctg

SEQ ID NO: 2287938 - DNA, 23 bp, Homo sapiens
tcttcacaatatccaatgaagaa

SEQ ID NO: 2287939 - DNA, 20 bp, Homo sapiens
tcttccaagttcattcatac

SEQ ID NO: 2287940 - DNA, 15 bp, Homo sapiens
tcttcccatttgtaa

SEQ ID NO: 2287941 - DNA, 23 bp, Homo sapiens
tcttccctttcctcccttctgat

SEQ ID NO: 2287942 - DNA, 22 bp, Homo sapiens
tcttcctaccaaatataaactt

SEQ ID NO: 2287943 - DNA, 14 bp, Homo sapiens
tcttcctcctgaca

SEQ ID NO: 2287944 - DNA, 18 bp, Homo sapiens
tcttctgagtgaatgtta

SEQ ID NO: 2287945 - DNA, 13 bp, Homo sapiens
tcttctgttctca

SEQ ID NO: 2287946 - DNA, 14 bp, Homo sapiens
tcttctgttctcaa

SEQ ID NO: 2287947 - DNA, 24 bp, Homo sapiens
tcttcttatcacacttgcaaatga

SEQ ID NO: 2287948 - DNA, 11 bp, Homo sapiens
tcttgaagaat

SEQ ID NO: 2287949 - DNA, 13 bp, Homo sapiens
tcttgaagaatat

SEQ ID NO: 2287950 - DNA, 14 bp, Homo sapiens
tcttgaagaatatt

SEQ ID NO: 2287951 - DNA, 16 bp, Homo sapiens
tcttgaggcagggtct

SEQ ID NO: 2287952 - DNA, 16 bp, Homo sapiens
gcatggtcctgtgccc

SEQ ID NO: 2287953 - DNA, 17 bp, Homo sapiens
gcatggtttgcatgact

SEQ ID NO: 2287954 - DNA, 18 bp, Homo sapiens
gcatgtgatgagaggaaa

SEQ ID NO: 2287955 - DNA, 19 bp, Homo sapiens
gcatgtgatgagaggaaat

SEQ ID NO: 2287956 - DNA, 14 bp, Homo sapiens
gcattattgccaaa

SEQ ID NO: 2287957 - DNA, 22 bp, Homo sapiens
gcattcaaaatagttctatttc

SEQ ID NO: 2287958 - DNA, 20 bp, Homo sapiens
gcattcacagctacgtgtgc

SEQ ID NO: 2287959 - DNA, 18 bp, Homo sapiens
gcattccagcgtctgctg

SEQ ID NO: 2287960 - DNA, 11 bp, Homo sapiens
gcattgtcctt

SEQ ID NO: 2287961 - DNA, 18 bp, Homo sapiens
gcatttctcttcctaaat

SEQ ID NO: 2287962 - DNA, 19 bp, Homo sapiens
gcatttgtgagccaaagag

SEQ ID NO: 2287963 - DNA, 15 bp, Homo sapiens
gccaaaatgtcaatt

SEQ ID NO: 2287964 - DNA, 15 bp, Homo sapiens
gccaaagatagcaga

SEQ ID NO: 2287965 - DNA, 16 bp, Homo sapiens
gccaaatcctgggcat

SEQ ID NO: 2287966 - DNA, 15 bp, Homo sapiens
gccaaccagcttgtc

SEQ ID NO: 2287967 - DNA, 15 bp, Homo sapiens
gccaacctcgctcca

SEQ ID NO: 2287968 - DNA, 13 bp, Homo sapiens
gccaacttaaacc

SEQ ID NO: 2287969 - DNA, 23 bp, Homo sapiens
gccaatgaaggctgaatcaaaga

SEQ ID NO: 2287970 - DNA, 17 bp, Homo sapiens
gccacagcactcggcct

SEQ ID NO: 2287971 - DNA, 13 bp, Homo sapiens
gccacagtggggc

SEQ ID NO: 2287972 - DNA, 15 bp, Homo sapiens
gccaccctctgctgc

SEQ ID NO: 2287973 - DNA, 16 bp, Homo sapiens
gccaccctctgctgca

SEQ ID NO: 2287974 - DNA, 22 bp, Homo sapiens
gccacctagaaaggggcccatt

SEQ ID NO: 2287975 - DNA, 23 bp, Homo sapiens
gccacctagaaaggggcccattc

SEQ ID NO: 2287976 - DNA, 20 bp, Homo sapiens
gccactattgttagtctctt

SEQ ID NO: 2287977 - DNA, 18 bp, Homo sapiens
gccactcctgggccccag

SEQ ID NO: 2287978 - DNA, 15 bp, Homo sapiens
gccactggccctgtt

SEQ ID NO: 2287979 - DNA, 21 bp, Homo sapiens
gccacttgaacaaaatctgtt

SEQ ID NO: 2287980 - DNA, 22 bp, Homo sapiens
gccacttgaacaaaatctgttg

SEQ ID NO: 2287981 - DNA, 17 bp, Homo sapiens
gccagacagagatcaga

SEQ ID NO: 2287982 - DNA, 16 bp, Homo sapiens
gccagagctcccagga

SEQ ID NO: 2287983 - DNA, 18 bp, Homo sapiens
gccagagctcccaggacg

SEQ ID NO: 2287984 - DNA, 21 bp, Homo sapiens
gccagatttcactctccttgg

SEQ ID NO: 2287985 - DNA, 18 bp, Homo sapiens
gccagcccctccccgcct

SEQ ID NO: 2287986 - DNA, 13 bp, Homo sapiens
gccaggaagggga

SEQ ID NO: 2287987 - DNA, 20 bp, Homo sapiens
gccaggaaggggacaggatt

SEQ ID NO: 2287988 - DNA, 19 bp, Homo sapiens
gccaggaccttggtgagat

SEQ ID NO: 2287989 - DNA, 16 bp, Homo sapiens
gccaggagtgggtggg

SEQ ID NO: 2287990 - DNA, 19 bp, Homo sapiens
gccagtgaacttggctttc

SEQ ID NO: 2287991 - DNA, 16 bp, Homo sapiens
gccatcagaaattttc

SEQ ID NO: 2287992 - DNA, 18 bp, Homo sapiens
gccatcagcccctgctgc

SEQ ID NO: 2287993 - DNA, 12 bp, Homo sapiens
gccatccacacc

SEQ ID NO: 2287994 - DNA, 22 bp, Homo sapiens
gccatgcatgatgggtaaagca

SEQ ID NO: 2287995 - DNA, 16 bp, Homo sapiens
gccatgcccaccgccc

SEQ ID NO: 2287996 - DNA, 16 bp, Homo sapiens
gccatggaagctggca

SEQ ID NO: 2287997 - DNA, 23 bp, Homo sapiens
gccatggaagctggcaggagaca

SEQ ID NO: 2287998 - DNA, 22 bp, Homo sapiens
gccattagactgaatttaacta

SEQ ID NO: 2287999 - DNA, 22 bp, Homo sapiens
gccattcatttacaacttccag

SEQ ID NO: 2288000 - DNA, 22 bp, Homo sapiens
gccatttcattgagggaaaaca

SEQ ID NO: 2288001 - DNA, 14 bp, Homo sapiens
gcccaaataacagt

SEQ ID NO: 2288002 - DNA, 21 bp, Homo sapiens
gcccaaataacagtggcaagc

SEQ ID NO: 2288003 - DNA, 16 bp, Homo sapiens
gcccaacccccacctc

SEQ ID NO: 2288004 - DNA, 17 bp, Homo sapiens
gcccaacccccacctcc

SEQ ID NO: 2288005 - DNA, 19 bp, Homo sapiens
gcccaacccccacctcccg

SEQ ID NO: 2288006 - DNA, 19 bp, Homo sapiens
gcccaacctcgccctctct

SEQ ID NO: 2288007 - DNA, 23 bp, Homo sapiens
gcccaacctcgccctctctcacc

SEQ ID NO: 2288008 - DNA, 15 bp, Homo sapiens
gcccaacctcttcct

SEQ ID NO: 2288009 - DNA, 23 bp, Homo sapiens
gcccaacctcttcctcctgacac

SEQ ID NO: 2288010 - DNA, 21 bp, Homo sapiens
gcccacccacaccccgtctgc

SEQ ID NO: 2288011 - DNA, 13 bp, Homo sapiens
gcccacccgcccc

SEQ ID NO: 2288012 - DNA, 20 bp, Homo sapiens
gcccacccgccccagagact

SEQ ID NO: 2288013 - DNA, 14 bp, Homo sapiens
gcccaccctgggcc

SEQ ID NO: 2288014 - DNA, 15 bp, Homo sapiens
gcccaccctgggcct

SEQ ID NO: 2288015 - DNA, 17 bp, Homo sapiens
gcccaccctgggcctcc

SEQ ID NO: 2288016 - DNA, 18 bp, Homo sapiens
gcccaccctgggcctccc

SEQ ID NO: 2288017 - DNA, 15 bp, Homo sapiens
gcccaccgcccctgg

SEQ ID NO: 2288018 - DNA, 17 bp, Homo sapiens
gcccaccgcccctggac

SEQ ID NO: 2288019 - DNA, 13 bp, Homo sapiens
gcccacctgccca

SEQ ID NO: 2288020 - DNA, 17 bp, Homo sapiens
gcccacgcagagccccg

SEQ ID NO: 2288021 - DNA, 18 bp, Homo sapiens
gcccacgcagagccccgg

SEQ ID NO: 2288022 - DNA, 19 bp, Homo sapiens
gcccacgcagagccccgga

SEQ ID NO: 2288023 - DNA, 17 bp, Homo sapiens
gcccagaacgggcctcc

SEQ ID NO: 2288024 - DNA, 22 bp, Homo sapiens
gcccagaacgggcctccccggg

SEQ ID NO: 2288025 - DNA, 22 bp, Homo sapiens
gcccagaggggcggggccagga

SEQ ID NO: 2288026 - DNA, 16 bp, Homo sapiens
gcccaggctggtcttg

SEQ ID NO: 2288027 - DNA, 15 bp, Homo sapiens
gcccagttagcccgg

SEQ ID NO: 2288028 - DNA, 15 bp, Homo sapiens
gcccagttcatccca

SEQ ID NO: 2288029 - DNA, 15 bp, Homo sapiens
gcccatggccccagc

SEQ ID NO: 2288030 - DNA, 21 bp, Homo sapiens
gcccatggccccagctggctg

SEQ ID NO: 2288031 - DNA, 12 bp, Homo sapiens
gcccattcagcc

SEQ ID NO: 2288032 - DNA, 15 bp, Homo sapiens
gcccattcagcctcg

SEQ ID NO: 2288033 - DNA, 17 bp, Homo sapiens
gcccattcagcctcgtc

SEQ ID NO: 2288034 - DNA, 18 bp, Homo sapiens
gccccagaaatgccgctg

SEQ ID NO: 2288035 - DNA, 19 bp, Homo sapiens
gccccagaaatgccgctgt

SEQ ID NO: 2288036 - DNA, 24 bp, Homo sapiens
gccccagaaatgccgctgtgtccc

SEQ ID NO: 2288037 - DNA, 12 bp, Homo sapiens
gccccagagact

SEQ ID NO: 2288038 - DNA, 13 bp, Homo sapiens
gccccagagactg

SEQ ID NO: 2288039 - DNA, 18 bp, Homo sapiens
gccccagagactgcccac

SEQ ID NO: 2288040 - DNA, 19 bp, Homo sapiens
gccccagagactgcccacc

SEQ ID NO: 2288041 - DNA, 20 bp, Homo sapiens
gccccagagactgcccaccc

SEQ ID NO: 2288042 - DNA, 23 bp, Homo sapiens
gccccagcctcctgagtagctgg

SEQ ID NO: 2288043 - DNA, 21 bp, Homo sapiens
gccccagcgagtctggagacc

SEQ ID NO: 2288044 - DNA, 22 bp, Homo sapiens
gccccaggcggaggggcttgga

SEQ ID NO: 2288045 - DNA, 11 bp, Homo sapiens
gccccatcctt

SEQ ID NO: 2288046 - DNA, 22 bp, Homo sapiens
gccccatccttcccgcagcacc

SEQ ID NO: 2288047 - DNA, 19 bp, Homo sapiens
gcccccaccctgcttctgc

SEQ ID NO: 2288048 - DNA, 14 bp, Homo sapiens
gcccccagacccca

SEQ ID NO: 2288049 - DNA, 19 bp, Homo sapiens
gccccccacgcttctggag

SEQ ID NO: 2288050 - DNA, 22 bp, Homo sapiens
gccccccagtgtccccaggggc

SEQ ID NO: 2288051 - DNA, 16 bp, Homo sapiens
gcccccgccctcgctc

SEQ ID NO: 2288052 - DNA, 17 bp, Homo sapiens
gcccccggaggcgccca

SEQ ID NO: 2288053 - DNA, 22 bp, Homo sapiens
gcccccggaggcgcccacctgc

SEQ ID NO: 2288054 - DNA, 13 bp, Homo sapiens
gccccctcccccg

SEQ ID NO: 2288055 - DNA, 20 bp, Homo sapiens
gccccctcccccgcagacag

SEQ ID NO: 2288056 - DNA, 22 bp, Homo sapiens
gccccgaaaggtcacctcactc

SEQ ID NO: 2288057 - DNA, 23 bp, Homo sapiens
gccccgaccccacctgaggcagg

SEQ ID NO: 2288058 - DNA, 14 bp, Homo sapiens
gccccgcacccctc

SEQ ID NO: 2288059 - DNA, 16 bp, Homo sapiens
gccccgcacccctcct

SEQ ID NO: 2288060 - DNA, 12 bp, Homo sapiens
gccccgccggcc

SEQ ID NO: 2288061 - DNA, 15 bp, Homo sapiens
gccccgccggccgcg

SEQ ID NO: 2288062 - DNA, 15 bp, Homo sapiens
gccccgcgcgtgccc

SEQ ID NO: 2288063 - DNA, 19 bp, Homo sapiens
gccccgcgcgtgcccccag

SEQ ID NO: 2288064 - DNA, 21 bp, Homo sapiens
gccccgcgcgtgcccccagcg

SEQ ID NO: 2288065 - DNA, 13 bp, Homo sapiens
gccccggagcacc

SEQ ID NO: 2288066 - DNA, 14 bp, Homo sapiens
gccccggcccaacc

SEQ ID NO: 2288067 - DNA, 21 bp, Homo sapiens
gccccggcccaacctcgccct

SEQ ID NO: 2288068 - DNA, 13 bp, Homo sapiens
gcccctccccgcc

SEQ ID NO: 2288069 - DNA, 19 bp, Homo sapiens
gcccctcctcgggcgcctg

SEQ ID NO: 2288070 - DNA, 15 bp, Homo sapiens
gcccctcctctcctc

SEQ ID NO: 2288071 - DNA, 17 bp, Homo sapiens
gcccctgctactgccaa

SEQ ID NO: 2288072 - DNA, 14 bp, Homo sapiens
gcccctgctggacc

SEQ ID NO: 2288073 - DNA, 14 bp, Homo sapiens
gccccttgacccca

SEQ ID NO: 2288074 - DNA, 19 bp, Homo sapiens
gcccgaagtctgctgctgt

SEQ ID NO: 2288075 - DNA, 14 bp, Homo sapiens
gcccgagagctggg

SEQ ID NO: 2288076 - DNA, 17 bp, Homo sapiens
gcccgagagctgggact

SEQ ID NO: 2288077 - DNA, 23 bp, Homo sapiens
gcccgagcgcgtgccttccccgt

SEQ ID NO: 2288078 - DNA, 16 bp, Homo sapiens
gcccgaggttcctgtc

SEQ ID NO: 2288079 - DNA, 15 bp, Homo sapiens
gcccgcccaccccgc

SEQ ID NO: 2288080 - DNA, 12 bp, Homo sapiens
gcccgcccccgc

SEQ ID NO: 2288081 - DNA, 17 bp, Homo sapiens
gcccgcccccgccctcg

SEQ ID NO: 2288082 - DNA, 14 bp, Homo sapiens
gcccgcccgccggt

SEQ ID NO: 2288083 - DNA, 17 bp, Homo sapiens
gcccgccctcctctgcc

SEQ ID NO: 2288084 - DNA, 17 bp, Homo sapiens
gcccgccggttggccgg

SEQ ID NO: 2288085 - DNA, 15 bp, Homo sapiens
gcccgctcaacctct

SEQ ID NO: 2288086 - DNA, 13 bp, Homo sapiens
gcccggcccacgc

SEQ ID NO: 2288087 - DNA, 22 bp, Homo sapiens
gcccggcccacgcagagccccg

SEQ ID NO: 2288088 - DNA, 18 bp, Homo sapiens
tcctgcctaaatttcaca

SEQ ID NO: 2288089 - DNA, 21 bp, Homo sapiens
tcctgctacagtagctgtggg

SEQ ID NO: 2288090 - DNA, 14 bp, Homo sapiens
tcctgctgcctgca

SEQ ID NO: 2288091 - DNA, 16 bp, Homo sapiens
tcctgctgctcgggaa

SEQ ID NO: 2288092 - DNA, 19 bp, Homo sapiens
tcctgctgctcgggaaggc

SEQ ID NO: 2288093 - DNA, 14 bp, Homo sapiens
tcctggattttctt

SEQ ID NO: 2288094 - DNA, 20 bp, Homo sapiens
tcctggattttctttctatg

SEQ ID NO: 2288095 - DNA, 21 bp, Homo sapiens
tcctggattttctttctatgt

SEQ ID NO: 2288096 - DNA, 16 bp, Homo sapiens
tcctggcaaataatac

SEQ ID NO: 2288097 - DNA, 17 bp, Homo sapiens
tcctggcaaataatact

SEQ ID NO: 2288098 - DNA, 22 bp, Homo sapiens
tcctggcagggcaggcagagct

SEQ ID NO: 2288099 - DNA, 17 bp, Homo sapiens
tcctgggcatccccagc

SEQ ID NO: 2288100 - DNA, 14 bp, Homo sapiens
tcctgggccagggt

SEQ ID NO: 2288101 - DNA, 23 bp, Homo sapiens
tcctgggccagggtctcgtcagg

SEQ ID NO: 2288102 - DNA, 19 bp, Homo sapiens
tcctgggccccagaaagcc

SEQ ID NO: 2288103 - DNA, 16 bp, Homo sapiens
tcctggtgtctagttt

SEQ ID NO: 2288104 - DNA, 16 bp, Homo sapiens
tcctgtcccatgggct

SEQ ID NO: 2288105 - DNA, 18 bp, Homo sapiens
tcctgtcccatgggctct

SEQ ID NO: 2288106 - DNA, 20 bp, Homo sapiens
tcctgtcccatgggctctgg

SEQ ID NO: 2288107 - DNA, 11 bp, Homo sapiens
tcctgtgcccc

SEQ ID NO: 2288108 - DNA, 18 bp, Homo sapiens
tcctgtgccccgacccca

SEQ ID NO: 2288109 - DNA, 14 bp, Homo sapiens
tcctgtggaaatat

SEQ ID NO: 2288110 - DNA, 17 bp, Homo sapiens
tcctgtggaaatatgca

SEQ ID NO: 2288111 - DNA, 18 bp, Homo sapiens
tcctgtggaaatatgcaa

SEQ ID NO: 2288112 - DNA, 15 bp, Homo sapiens
tcctgtttccagggt

SEQ ID NO: 2288113 - DNA, 14 bp, Homo sapiens
tccttaactgtcca

SEQ ID NO: 2288114 - DNA, 14 bp, Homo sapiens
tccttcagtgcctt

SEQ ID NO: 2288115 - DNA, 15 bp, Homo sapiens
tccttcagtgcctta

SEQ ID NO: 2288116 - DNA, 17 bp, Homo sapiens
tccttcagtgccttatg

SEQ ID NO: 2288117 - DNA, 20 bp, Homo sapiens
tccttcagtgccttatggaa

SEQ ID NO: 2288118 - DNA, 18 bp, Homo sapiens
tccttcccgcagcaccag

SEQ ID NO: 2288119 - DNA, 23 bp, Homo sapiens
tccttcccgcagcaccagcctga

SEQ ID NO: 2288120 - DNA, 20 bp, Homo sapiens
tccttcctgttctgtgtctg

SEQ ID NO: 2288121 - DNA, 16 bp, Homo sapiens
tccttgaggacctcca

SEQ ID NO: 2288122 - DNA, 23 bp, Homo sapiens
tccttgaggacctccacctggga

SEQ ID NO: 2288123 - DNA, 16 bp, Homo sapiens
tccttgcctctgctct

SEQ ID NO: 2288124 - DNA, 22 bp, Homo sapiens
tccttggtgtcgggcatgacac

SEQ ID NO: 2288125 - DNA, 14 bp, Homo sapiens
tccttgtaatgtag

SEQ ID NO: 2288126 - DNA, 17 bp, Homo sapiens
tccttgtacttgaataa

SEQ ID NO: 2288127 - DNA, 17 bp, Homo sapiens
tcctttgactgtgctgg

SEQ ID NO: 2288128 - DNA, 12 bp, Homo sapiens
tccttttctcca

SEQ ID NO: 2288129 - DNA, 14 bp, Homo sapiens
tccttttctccact

SEQ ID NO: 2288130 - DNA, 23 bp, Homo sapiens
tccttttcttttcttgaggcagg

SEQ ID NO: 2288131 - DNA, 14 bp, Homo sapiens
tcgaaaacagatga

SEQ ID NO: 2288132 - DNA, 20 bp, Homo sapiens
tcgaaaacagatgagaagac

SEQ ID NO: 2288133 - DNA, 22 bp, Homo sapiens
tcgagagggctgagcccctcct

SEQ ID NO: 2288134 - DNA, 18 bp, Homo sapiens
tcgaggagataaactgaa

SEQ ID NO: 2288135 - DNA, 13 bp, Homo sapiens
tcgcacccccact

SEQ ID NO: 2288136 - DNA, 14 bp, Homo sapiens
tcgcacccccactt

SEQ ID NO: 2288137 - DNA, 10 bp, Homo sapiens
tcgcagcccc

SEQ ID NO: 2288138 - DNA, 20 bp, Homo sapiens
tcgccaagccatcacaggct

SEQ ID NO: 2288139 - DNA, 12 bp, Homo sapiens
tcgcccctcctc

SEQ ID NO: 2288140 - DNA, 23 bp, Homo sapiens
tcgccctctctcaccagccttga

SEQ ID NO: 2288141 - DNA, 13 bp, Homo sapiens
tcgcctcctccag

SEQ ID NO: 2288142 - DNA, 14 bp, Homo sapiens
tcgcctcctccagc

SEQ ID NO: 2288143 - DNA, 14 bp, Homo sapiens
tcgcgacaatgcaa

SEQ ID NO: 2288144 - DNA, 14 bp, Homo sapiens
tcgcgatgatgggc

SEQ ID NO: 2288145 - DNA, 20 bp, Homo sapiens
tcgcgatgatgggctggagc

SEQ ID NO: 2288146 - DNA, 21 bp, Homo sapiens
tcgcgatgatgggctggagca

SEQ ID NO: 2288147 - DNA, 11 bp, Homo sapiens
tcgctgaaagc

SEQ ID NO: 2288148 - DNA, 17 bp, Homo sapiens
tcgctgtggtttctcgt

SEQ ID NO: 2288149 - DNA, 19 bp, Homo sapiens
tcggccagagctcccagga

SEQ ID NO: 2288150 - DNA, 13 bp, Homo sapiens
tcggctgggcagg

SEQ ID NO: 2288151 - DNA, 16 bp, Homo sapiens
tcggctgggcagggcc

SEQ ID NO: 2288152 - DNA, 17 bp, Homo sapiens
tcggctgggcagggccg

SEQ ID NO: 2288153 - DNA, 12 bp, Homo sapiens
tcgggcatgaca

SEQ ID NO: 2288154 - DNA, 15 bp, Homo sapiens
tcgggccgcctcctc

SEQ ID NO: 2288155 - DNA, 17 bp, Homo sapiens
tcgggccgcctcctcca

SEQ ID NO: 2288156 - DNA, 20 bp, Homo sapiens
tcgggccgcctcctccagac

SEQ ID NO: 2288157 - DNA, 22 bp, Homo sapiens
tcgggcgcctgcgctcctctgc

SEQ ID NO: 2288158 - DNA, 16 bp, Homo sapiens
tcgggggaggagcacc

SEQ ID NO: 2288159 - DNA, 18 bp, Homo sapiens
tcgggggaggagcacccc

SEQ ID NO: 2288160 - DNA, 21 bp, Homo sapiens
tcgggggaggagcacccccag

SEQ ID NO: 2288161 - DNA, 16 bp, Homo sapiens
tcgggggcggctctgg

SEQ ID NO: 2288162 - DNA, 18 bp, Homo sapiens
tcgggggcggctctggga

SEQ ID NO: 2288163 - DNA, 14 bp, Homo sapiens
tcgggtgcccagga

SEQ ID NO: 2288164 - DNA, 14 bp, Homo sapiens
tcggttcaggagga

SEQ ID NO: 2288165 - DNA, 19 bp, Homo sapiens
tcggttgtaggactaaata

SEQ ID NO: 2288166 - DNA, 17 bp, Homo sapiens
tcgtaaacatctcagag

SEQ ID NO: 2288167 - DNA, 20 bp, Homo sapiens
tcgtccggcctgcagcccag

SEQ ID NO: 2288168 - DNA, 16 bp, Homo sapiens
tcgtgattgataagaa

SEQ ID NO: 2288169 - DNA, 14 bp, Homo sapiens
tcgtgcatttgtga

SEQ ID NO: 2288170 - DNA, 15 bp, Homo sapiens
tcgttacccatttct

SEQ ID NO: 2288171 - DNA, 14 bp, Homo sapiens
tctaaaaaataact

SEQ ID NO: 2288172 - DNA, 14 bp, Homo sapiens
tctaaaattctagt

SEQ ID NO: 2288173 - DNA, 18 bp, Homo sapiens
tctaaacacacttagaat

SEQ ID NO: 2288174 - DNA, 23 bp, Homo sapiens
tctaaacccaaataaatgtgtaa

SEQ ID NO: 2288175 - DNA, 12 bp, Homo sapiens
tctaaactgttt

SEQ ID NO: 2288176 - DNA, 20 bp, Homo sapiens
tctaagcagttgcaatgatc

SEQ ID NO: 2288177 - DNA, 18 bp, Homo sapiens
tctaagcttatttctaac

SEQ ID NO: 2288178 - DNA, 19 bp, Homo sapiens
tctaagcttatttctaact

SEQ ID NO: 2288179 - DNA, 15 bp, Homo sapiens
tctaagtcagtttca

SEQ ID NO: 2288180 - DNA, 17 bp, Homo sapiens
tctaagtccacttaaat

SEQ ID NO: 2288181 - DNA, 12 bp, Homo sapiens
tctaatttcaag

SEQ ID NO: 2288182 - DNA, 14 bp, Homo sapiens
tctacaacataatg

SEQ ID NO: 2288183 - DNA, 16 bp, Homo sapiens
tctacctgcaggactc

SEQ ID NO: 2288184 - DNA, 12 bp, Homo sapiens
tctactttcctg

SEQ ID NO: 2288185 - DNA, 17 bp, Homo sapiens
tctagaaggatgaacag

SEQ ID NO: 2288186 - DNA, 22 bp, Homo sapiens
tctagcaagaagattctaaaac

SEQ ID NO: 2288187 - DNA, 22 bp, Homo sapiens
tctagcacagctgtgaggacag

SEQ ID NO: 2288188 - DNA, 20 bp, Homo sapiens
tctagcagtatgtgtgctct

SEQ ID NO: 2288189 - DNA, 12 bp, Homo sapiens
tctagctataac

SEQ ID NO: 2288190 - DNA, 23 bp, Homo sapiens
tctagctataacaactctatttt

SEQ ID NO: 2288191 - DNA, 17 bp, Homo sapiens
tctagtctgtttcatta

SEQ ID NO: 2288192 - DNA, 18 bp, Homo sapiens
tctagttagcaggaaata

SEQ ID NO: 2288193 - DNA, 13 bp, Homo sapiens
tctagtttgcata

SEQ ID NO: 2288194 - DNA, 17 bp, Homo sapiens
tctatactgtttgtaat

SEQ ID NO: 2288195 - DNA, 14 bp, Homo sapiens
tctatactttctca

SEQ ID NO: 2288196 - DNA, 21 bp, Homo sapiens
tctatatatacatgtatagtg

SEQ ID NO: 2288197 - DNA, 11 bp, Homo sapiens
tctatatttca

SEQ ID NO: 2288198 - DNA, 15 bp, Homo sapiens
tctatatttcatatt

SEQ ID NO: 2288199 - DNA, 12 bp, Homo sapiens
tctatctgctgg

SEQ ID NO: 2288200 - DNA, 23 bp, Homo sapiens
tctatctttcattaaaaagaata

SEQ ID NO: 2288201 - DNA, 15 bp, Homo sapiens
tctatgagacctccc

SEQ ID NO: 2288202 - DNA, 23 bp, Homo sapiens
tctattatctgggttttagaaat

SEQ ID NO: 2288203 - DNA, 15 bp, Homo sapiens
tctatttaaaaaatg

SEQ ID NO: 2288204 - DNA, 16 bp, Homo sapiens
tctatttctatctgca

SEQ ID NO: 2288205 - DNA, 18 bp, Homo sapiens
tctattttctatgtacta

SEQ ID NO: 2288206 - DNA, 15 bp, Homo sapiens
tctattttgcagcag

SEQ ID NO: 2288207 - DNA, 14 bp, Homo sapiens
tctattttttacta

SEQ ID NO: 2288208 - DNA, 16 bp, Homo sapiens
tctattttttactaca

SEQ ID NO: 2288209 - DNA, 12 bp, Homo sapiens
tctcaccagcct

SEQ ID NO: 2288210 - DNA, 13 bp, Homo sapiens
tctcaccagcctt

SEQ ID NO: 2288211 - DNA, 14 bp, Homo sapiens
tctcactctgttga

SEQ ID NO: 2288212 - DNA, 23 bp, Homo sapiens
tctcactgtgttgcccaggctgg

SEQ ID NO: 2288213 - DNA, 15 bp, Homo sapiens
tctcacttcagttgt

SEQ ID NO: 2288214 - DNA, 21 bp, Homo sapiens
tctcacttcagttgtggcctc

SEQ ID NO: 2288215 - DNA, 18 bp, Homo sapiens
tctcagataaagtgacca

SEQ ID NO: 2288216 - DNA, 16 bp, Homo sapiens
tctcagatccctcggt

SEQ ID NO: 2288217 - DNA, 16 bp, Homo sapiens
tctcagccgagcccag

SEQ ID NO: 2288218 - DNA, 21 bp, Homo sapiens
tctcagccgagcccaggggag

SEQ ID NO: 2288219 - DNA, 13 bp, Homo sapiens
tctcatacctctg

SEQ ID NO: 2288220 - DNA, 23 bp, Homo sapiens
tctcatcttgtaaataatgctta

SEQ ID NO: 2288221 - DNA, 18 bp, Homo sapiens
tctcatgcatagacaagt

SEQ ID NO: 2288222 - DNA, 21 bp, Homo sapiens
tctcatgcatagacaagtgtt

SEQ ID NO: 2288223 - DNA, 16 bp, Homo sapiens
tctcattatgaagatg

SEQ ID NO: 2288224 - DNA, 21 bp, Homo sapiens
tctcattatgaagatgttttt

SEQ ID NO: 2288225 - DNA, 13 bp, Homo sapiens
tctcattcctctg

SEQ ID NO: 2288226 - DNA, 17 bp, Homo sapiens
tcaaagacatttcatcc

SEQ ID NO: 2288227 - DNA, 19 bp, Homo sapiens
tcaaagagatgaggaaata

SEQ ID NO: 2288228 - DNA, 15 bp, Homo sapiens
tcaaagatacaagaa

SEQ ID NO: 2288229 - DNA, 16 bp, Homo sapiens
tcaaagatacaagaaa

SEQ ID NO: 2288230 - DNA, 20 bp, Homo sapiens
tcaaagctttcctgtttcca

SEQ ID NO: 2288231 - DNA, 23 bp, Homo sapiens
tcaaagctttcctgtttccaggg

SEQ ID NO: 2288232 - DNA, 15 bp, Homo sapiens
tcaaagggtaaatta

SEQ ID NO: 2288233 - DNA, 16 bp, Homo sapiens
tcaaagggtaaattat

SEQ ID NO: 2288234 - DNA, 13 bp, Homo sapiens
tcaaatcattcaa

SEQ ID NO: 2288235 - DNA, 17 bp, Homo sapiens
tcaaatgagtttaaaaa

SEQ ID NO: 2288236 - DNA, 17 bp, Homo sapiens
tcaaatgctaaatgcaa

SEQ ID NO: 2288237 - DNA, 16 bp, Homo sapiens
tcaacacttattttct

SEQ ID NO: 2288238 - DNA, 17 bp, Homo sapiens
tcaacacttattttctg

SEQ ID NO: 2288239 - DNA, 20 bp, Homo sapiens
tcaacacttattttctgaat

SEQ ID NO: 2288240 - DNA, 16 bp, Homo sapiens
tcaacagcatgtctac

SEQ ID NO: 2288241 - DNA, 16 bp, Homo sapiens
tcaacaggttttcctg

SEQ ID NO: 2288242 - DNA, 19 bp, Homo sapiens
tcaactacggttgggagaa

SEQ ID NO: 2288243 - DNA, 17 bp, Homo sapiens
tcaactgctgttttatg

SEQ ID NO: 2288244 - DNA, 13 bp, Homo sapiens
tcaagaccaaatg

SEQ ID NO: 2288245 - DNA, 23 bp, Homo sapiens
tcaaggaagaataattttaacag

SEQ ID NO: 2288246 - DNA, 15 bp, Homo sapiens
tcaaggaagagccag

SEQ ID NO: 2288247 - DNA, 22 bp, Homo sapiens
tcaagtcattccacacatttcc

SEQ ID NO: 2288248 - DNA, 16 bp, Homo sapiens
tcaagttgtgataaat

SEQ ID NO: 2288249 - DNA, 21 bp, Homo sapiens
tcaataaagaaaaaaatagtt

SEQ ID NO: 2288250 - DNA, 23 bp, Homo sapiens
tcaataagtgttgtaccatatgt

SEQ ID NO: 2288251 - DNA, 22 bp, Homo sapiens
tcaatacttttgtgtattctgt

SEQ ID NO: 2288252 - DNA, 19 bp, Homo sapiens
tcaataggaaaaactgatt

SEQ ID NO: 2288253 - DNA, 22 bp, Homo sapiens
tcaataggaaaaactgattttt

SEQ ID NO: 2288254 - DNA, 14 bp, Homo sapiens
tcaatcatgaatga

SEQ ID NO: 2288255 - DNA, 23 bp, Homo sapiens
tcaatgaaatatttgcttattta

SEQ ID NO: 2288256 - DNA, 17 bp, Homo sapiens
tcaatgcatgatgactc

SEQ ID NO: 2288257 - DNA, 19 bp, Homo sapiens
tcaatgcatgatgactctt

SEQ ID NO: 2288258 - DNA, 23 bp, Homo sapiens
tcaatgcatgatgactcttctta

SEQ ID NO: 2288259 - DNA, 13 bp, Homo sapiens
tcaatgcttttct

SEQ ID NO: 2288260 - DNA, 20 bp, Homo sapiens
tcaatgggagtgaacatttc

SEQ ID NO: 2288261 - DNA, 21 bp, Homo sapiens
tcaatgggagtgaacatttct

SEQ ID NO: 2288262 - DNA, 12 bp, Homo sapiens
tcaatgtactgt

SEQ ID NO: 2288263 - DNA, 13 bp, Homo sapiens
tcaatgtactgta

SEQ ID NO: 2288264 - DNA, 18 bp, Homo sapiens
tcaattacaggaagtact

SEQ ID NO: 2288265 - DNA, 20 bp, Homo sapiens
tcaattacaggaagtactgg

SEQ ID NO: 2288266 - DNA, 15 bp, Homo sapiens
tcaatttttaactta

SEQ ID NO: 2288267 - DNA, 21 bp, Homo sapiens
tcacaactgtttttgaagaag

SEQ ID NO: 2288268 - DNA, 17 bp, Homo sapiens
tcacaagtgaaaactga

SEQ ID NO: 2288269 - DNA, 19 bp, Homo sapiens
tcacaatcatcttctccca

SEQ ID NO: 2288270 - DNA, 14 bp, Homo sapiens
tcacacctgtaatc

SEQ ID NO: 2288271 - DNA, 20 bp, Homo sapiens
tcacactgtggaacactaaa

SEQ ID NO: 2288272 - DNA, 17 bp, Homo sapiens
tcacacttgcaaatgaa

SEQ ID NO: 2288273 - DNA, 16 bp, Homo sapiens
tcacagaatctccatt

SEQ ID NO: 2288274 - DNA, 23 bp, Homo sapiens
tcacagaggcggttgtaagagga

SEQ ID NO: 2288275 - DNA, 12 bp, Homo sapiens
tcacatatttgt

SEQ ID NO: 2288276 - DNA, 15 bp, Homo sapiens
tcacatctctgtaga

SEQ ID NO: 2288277 - DNA, 16 bp, Homo sapiens
tcacatctctgtagat

SEQ ID NO: 2288278 - DNA, 14 bp, Homo sapiens
tcacatctgtatat

SEQ ID NO: 2288279 - DNA, 13 bp, Homo sapiens
tcacatgtgctct

SEQ ID NO: 2288280 - DNA, 18 bp, Homo sapiens
tcacatgtggctccccct

SEQ ID NO: 2288281 - DNA, 19 bp, Homo sapiens
tcacatgtggctccccctg

SEQ ID NO: 2288282 - DNA, 20 bp, Homo sapiens
tcacatgtggctccccctga

SEQ ID NO: 2288283 - DNA, 11 bp, Homo sapiens
tcaccagcctt

SEQ ID NO: 2288284 - DNA, 20 bp, Homo sapiens
tcaccagctgccaaaatcgt

SEQ ID NO: 2288285 - DNA, 18 bp, Homo sapiens
tcacccactgctgcacct

SEQ ID NO: 2288286 - DNA, 22 bp, Homo sapiens
tcaccctgccaccctctgctgc

SEQ ID NO: 2288287 - DNA, 12 bp, Homo sapiens
tcacccttttct

SEQ ID NO: 2288288 - DNA, 23 bp, Homo sapiens
tcaccgaaaacgtggctgcttca

SEQ ID NO: 2288289 - DNA, 16 bp, Homo sapiens
tcacctcactcagcac

SEQ ID NO: 2288290 - DNA, 13 bp, Homo sapiens
tcacggcatgttt

SEQ ID NO: 2288291 - DNA, 20 bp, Homo sapiens
tcactagtttttcctgtgca

SEQ ID NO: 2288292 - DNA, 17 bp, Homo sapiens
tcactatgggtgagcat

SEQ ID NO: 2288293 - DNA, 13 bp, Homo sapiens
tcactcagcacca

SEQ ID NO: 2288294 - DNA, 17 bp, Homo sapiens
tcactcagcaccactca

SEQ ID NO: 2288295 - DNA, 15 bp, Homo sapiens
tcactctccagggta

SEQ ID NO: 2288296 - DNA, 14 bp, Homo sapiens
tcactgcagcctcg

SEQ ID NO: 2288297 - DNA, 15 bp, Homo sapiens
tcactgcagcctcga

SEQ ID NO: 2288298 - DNA, 14 bp, Homo sapiens
tcactgcctgcagc

SEQ ID NO: 2288299 - DNA, 13 bp, Homo sapiens
tcactgctcacac

SEQ ID NO: 2288300 - DNA, 11 bp, Homo sapiens
tcactgctttg

SEQ ID NO: 2288301 - DNA, 21 bp, Homo sapiens
tcactgtgttgcccaggctgg

SEQ ID NO: 2288302 - DNA, 15 bp, Homo sapiens
tcacttcagttgtgg

SEQ ID NO: 2288303 - DNA, 20 bp, Homo sapiens
tcacttcagttgtggcctca

SEQ ID NO: 2288304 - DNA, 15 bp, Homo sapiens
tcacttgccgtgtca

SEQ ID NO: 2288305 - DNA, 14 bp, Homo sapiens
tcactttcatctga

SEQ ID NO: 2288306 - DNA, 14 bp, Homo sapiens
tcagaaaagacact

SEQ ID NO: 2288307 - DNA, 16 bp, Homo sapiens
tcagaaaattggcagt

SEQ ID NO: 2288308 - DNA, 16 bp, Homo sapiens
tcagaaattttctaca

SEQ ID NO: 2288309 - DNA, 16 bp, Homo sapiens
tcagaaggagacagaa

SEQ ID NO: 2288310 - DNA, 18 bp, Homo sapiens
tcagaaggagacagaatg

SEQ ID NO: 2288311 - DNA, 20 bp, Homo sapiens
tcagaaggagacagaatgag

SEQ ID NO: 2288312 - DNA, 22 bp, Homo sapiens
tcagaattgaaccgtcaatgtg

SEQ ID NO: 2288313 - DNA, 21 bp, Homo sapiens
tcagacagaagggtaatgcgt

SEQ ID NO: 2288314 - DNA, 16 bp, Homo sapiens
tcagacttgatttaca

SEQ ID NO: 2288315 - DNA, 18 bp, Homo sapiens
tcagagatgtaccatgtt

SEQ ID NO: 2288316 - DNA, 13 bp, Homo sapiens
tcagagtcctgcc

SEQ ID NO: 2288317 - DNA, 17 bp, Homo sapiens
tcagataaagtgaccag

SEQ ID NO: 2288318 - DNA, 12 bp, Homo sapiens
tcagatccctcg

SEQ ID NO: 2288319 - DNA, 16 bp, Homo sapiens
tcagatccctcggtca

SEQ ID NO: 2288320 - DNA, 21 bp, Homo sapiens
tcagattccccccatctccat

SEQ ID NO: 2288321 - DNA, 15 bp, Homo sapiens
tcagcaaattcttga

SEQ ID NO: 2288322 - DNA, 15 bp, Homo sapiens
tcagcaccactcaag

SEQ ID NO: 2288323 - DNA, 20 bp, Homo sapiens
tcagcaccactcaagaccaa

SEQ ID NO: 2288324 - DNA, 21 bp, Homo sapiens
tcagcaccactcaagaccaaa

SEQ ID NO: 2288325 - DNA, 21 bp, Homo sapiens
tcagcaccgtggtgtgaggcc

SEQ ID NO: 2288326 - DNA, 15 bp, Homo sapiens
tcagcagaatgactc

SEQ ID NO: 2288327 - DNA, 19 bp, Homo sapiens
tcagcagcctcactgcatc

SEQ ID NO: 2288328 - DNA, 19 bp, Homo sapiens
tcagcatagagctatatat

SEQ ID NO: 2288329 - DNA, 20 bp, Homo sapiens
tcagcattcaaaatagttct

SEQ ID NO: 2288330 - DNA, 18 bp, Homo sapiens
tcagcccctgctgctcct

SEQ ID NO: 2288331 - DNA, 21 bp, Homo sapiens
tcagcccctgctgctcctcgg

SEQ ID NO: 2288332 - DNA, 17 bp, Homo sapiens
tcagcccggtgtgagga

SEQ ID NO: 2288333 - DNA, 16 bp, Homo sapiens
tcagccgagcccaggg

SEQ ID NO: 2288334 - DNA, 17 bp, Homo sapiens
tcagcgattcctgccaa

SEQ ID NO: 2288335 - DNA, 15 bp, Homo sapiens
tcagctctaaagcag

SEQ ID NO: 2288336 - DNA, 20 bp, Homo sapiens
tcagctctaaagcagagatg

SEQ ID NO: 2288337 - DNA, 22 bp, Homo sapiens
tcagctctaaagcagagatgta

SEQ ID NO: 2288338 - DNA, 14 bp, Homo sapiens
tcagctctgcataa

SEQ ID NO: 2288339 - DNA, 21 bp, Homo sapiens
tcagctcttgtcaaaaggtct

SEQ ID NO: 2288340 - DNA, 14 bp, Homo sapiens
tcagcttgtttcta

SEQ ID NO: 2288341 - DNA, 20 bp, Homo sapiens
tcagcttgtttctatactgt

SEQ ID NO: 2288342 - DNA, 20 bp, Homo sapiens
tcaggaagcctcctgctgag

SEQ ID NO: 2288343 - DNA, 19 bp, Homo sapiens
tcaggaccccatctgctga

SEQ ID NO: 2288344 - DNA, 18 bp, Homo sapiens
tcaggaggagacagtcag

SEQ ID NO: 2288345 - DNA, 13 bp, Homo sapiens
tcaggaggcagtg

SEQ ID NO: 2288346 - DNA, 21 bp, Homo sapiens
tcaggaggtgcctgagagcag

SEQ ID NO: 2288347 - DNA, 14 bp, Homo sapiens
tcaggcaaggcagc

SEQ ID NO: 2288348 - DNA, 16 bp, Homo sapiens
tcaggcaaggcagctc

SEQ ID NO: 2288349 - DNA, 16 bp, Homo sapiens
tcaggcagtagcagct

SEQ ID NO: 2288350 - DNA, 20 bp, Homo sapiens
tcaggcccacattgcccaca

SEQ ID NO: 2288351 - DNA, 15 bp, Homo sapiens
tcaggctccccaaga

SEQ ID NO: 2288352 - DNA, 13 bp, Homo sapiens
tcagggagccctg

SEQ ID NO: 2288353 - DNA, 15 bp, Homo sapiens
tcagggagccctggg

SEQ ID NO: 2288354 - DNA, 19 bp, Homo sapiens
tcagtacacccaattttaa

SEQ ID NO: 2288355 - DNA, 19 bp, Homo sapiens
tcagtatgaagacactgtc

SEQ ID NO: 2288356 - DNA, 15 bp, Homo sapiens
tcagtcatcatctca

SEQ ID NO: 2288357 - DNA, 15 bp, Homo sapiens
tcagtctgtccacgt

SEQ ID NO: 2288358 - DNA, 12 bp, Homo sapiens
tcagtcttgcct

SEQ ID NO: 2288359 - DNA, 13 bp, Homo sapiens
tcagtcttgcctt

SEQ ID NO: 2288360 - DNA, 10 bp, Homo sapiens
tcagtgcctt

SEQ ID NO: 2288361 - DNA, 15 bp, Homo sapiens
tcagtgccttatgga

SEQ ID NO: 2288362 - DNA, 16 bp, Homo sapiens
tcagtgccttatggaa

SEQ ID NO: 2288363 - DNA, 23 bp, Homo sapiens
tcagtgccttatggaacactctg

SEQ ID NO: 2288364 - DNA, 18 bp, Homo sapiens
tcagtgtacactctgagt

SEQ ID NO: 2288365 - DNA, 16 bp, Homo sapiens
tcagtgtcctcatcta

SEQ ID NO: 2288366 - DNA, 19 bp, Homo sapiens
tcagtgtggactgggaagc

SEQ ID NO: 2288367 - DNA, 16 bp, Homo sapiens
tcagttctcatcttgt

SEQ ID NO: 2288368 - DNA, 19 bp, Homo sapiens
tcagttctcatcttgtaaa

SEQ ID NO: 2288369 - DNA, 16 bp, Homo sapiens
tcagttcttggcctgc

SEQ ID NO: 2288370 - DNA, 19 bp, Homo sapiens
tcagttgctctctgttcaa

SEQ ID NO: 2288371 - DNA, 18 bp, Homo sapiens
tcagttggaattgaagac

SEQ ID NO: 2288372 - DNA, 14 bp, Homo sapiens
tcagttggacagta

SEQ ID NO: 2288373 - DNA, 19 bp, Homo sapiens
tcagttgtggcctcattca

SEQ ID NO: 2288374 - DNA, 20 bp, Homo sapiens
tcataaaaaataacaactga

SEQ ID NO: 2288375 - DNA, 13 bp, Homo sapiens
tcataaaaataac

SEQ ID NO: 2288376 - DNA, 17 bp, Homo sapiens
tcataaaatgctatttt

SEQ ID NO: 2288377 - DNA, 23 bp, Homo sapiens
tcataaagttagaatctattttc

SEQ ID NO: 2288378 - DNA, 14 bp, Homo sapiens
tcataactcacttt

SEQ ID NO: 2288379 - DNA, 12 bp, Homo sapiens
tcataatgactt

SEQ ID NO: 2288380 - DNA, 13 bp, Homo sapiens
tcataatgactta

SEQ ID NO: 2288381 - DNA, 17 bp, Homo sapiens
tcataatgcaattagat

SEQ ID NO: 2288382 - DNA, 15 bp, Homo sapiens
tcatacgtctttaga

SEQ ID NO: 2288383 - DNA, 20 bp, Homo sapiens
tcatacgtctttagatgcta

SEQ ID NO: 2288384 - DNA, 14 bp, Homo sapiens
tcatactaaataaa

SEQ ID NO: 2288385 - DNA, 16 bp, Homo sapiens
tcatactctgtgtaat

SEQ ID NO: 2288386 - DNA, 15 bp, Homo sapiens
tcatataatttgcca

SEQ ID NO: 2288387 - DNA, 22 bp, Homo sapiens
tcatataatttgccagacagag

SEQ ID NO: 2288388 - DNA, 15 bp, Homo sapiens
tcatatgtgatctgt

SEQ ID NO: 2288389 - DNA, 22 bp, Homo sapiens
tcatatgtgatctgtcttgtaa

SEQ ID NO: 2288390 - DNA, 14 bp, Homo sapiens
tcatatttttgtaa

SEQ ID NO: 2288391 - DNA, 15 bp, Homo sapiens
tcatatttttgtaaa

SEQ ID NO: 2288392 - DNA, 12 bp, Homo sapiens
tcatcaccactg

SEQ ID NO: 2288393 - DNA, 16 bp, Homo sapiens
tcatccaccaatatca

SEQ ID NO: 2288394 - DNA, 17 bp, Homo sapiens
tcatccaccaatatcat

SEQ ID NO: 2288395 - DNA, 16 bp, Homo sapiens
tcatcccggggccatg

SEQ ID NO: 2288396 - DNA, 18 bp, Homo sapiens
tcatctcaaacactgctt

SEQ ID NO: 2288397 - DNA, 21 bp, Homo sapiens
tcatctgagcttttaccacta

SEQ ID NO: 2288398 - DNA, 23 bp, Homo sapiens
tcatgaaggagaggatttggctc

SEQ ID NO: 2288399 - DNA, 22 bp, Homo sapiens
tcatgactggtgcgttcctaaa

SEQ ID NO: 2288400 - DNA, 13 bp, Homo sapiens
tcatgatgctcat

SEQ ID NO: 2288401 - DNA, 15 bp, Homo sapiens
tcatgcatagacaag

SEQ ID NO: 2288402 - DNA, 23 bp, Homo sapiens
tcatggaccactgtttcttgctt

SEQ ID NO: 2288403 - DNA, 17 bp, Homo sapiens
tcatgggagaagagggg

SEQ ID NO: 2288404 - DNA, 18 bp, Homo sapiens
tcatgggagtcagggagc

SEQ ID NO: 2288405 - DNA, 15 bp, Homo sapiens
tcatgggtctgccct

SEQ ID NO: 2288406 - DNA, 13 bp, Homo sapiens
tcatggtctcttc

SEQ ID NO: 2288407 - DNA, 21 bp, Homo sapiens
tcatgtagccagcagaactga

SEQ ID NO: 2288408 - DNA, 20 bp, Homo sapiens
tcatgtcagaaggagacaga

SEQ ID NO: 2288409 - DNA, 15 bp, Homo sapiens
tcatgtgtacagaaa

SEQ ID NO: 2288410 - DNA, 13 bp, Homo sapiens
tcatgtgtagata

SEQ ID NO: 2288411 - DNA, 14 bp, Homo sapiens
tcatgtgtagatat

SEQ ID NO: 2288412 - DNA, 15 bp, Homo sapiens
tcatgtgtagatatt

SEQ ID NO: 2288413 - DNA, 14 bp, Homo sapiens
tcatgtttctgcag

SEQ ID NO: 2288414 - DNA, 14 bp, Homo sapiens
tcattaaacaaaca

SEQ ID NO: 2288415 - DNA, 14 bp, Homo sapiens
tcattaataaaata

SEQ ID NO: 2288416 - DNA, 20 bp, Homo sapiens
tcattactgcccagatgttt

SEQ ID NO: 2288417 - DNA, 18 bp, Homo sapiens
tcattatgaagatgtttt

SEQ ID NO: 2288418 - DNA, 13 bp, Homo sapiens
tcattatgtcaat

SEQ ID NO: 2288419 - DNA, 13 bp, Homo sapiens
tcattattttccc

SEQ ID NO: 2288420 - DNA, 11 bp, Homo sapiens
tcattcaaaac

SEQ ID NO: 2288421 - DNA, 13 bp, Homo sapiens
tcattcaaaactt

SEQ ID NO: 2288422 - DNA, 12 bp, Homo sapiens
tcattcagcaga

SEQ ID NO: 2288423 - DNA, 15 bp, Homo sapiens
tcattcatactcaaa

SEQ ID NO: 2288424 - DNA, 16 bp, Homo sapiens
tcattcatactcaaag

SEQ ID NO: 2288425 - DNA, 21 bp, Homo sapiens
tcattctgctaatttatgaag

SEQ ID NO: 2288426 - DNA, 20 bp, Homo sapiens
tcattcttgccctttgagaa

SEQ ID NO: 2288427 - DNA, 22 bp, Homo sapiens
tcattctttataaaccataaaa

SEQ ID NO: 2288428 - DNA, 11 bp, Homo sapiens
tcattcttttc

SEQ ID NO: 2288429 - DNA, 15 bp, Homo sapiens
tcattcttttcagct

SEQ ID NO: 2288430 - DNA, 20 bp, Homo sapiens
tcattcttttcagcttgttt

SEQ ID NO: 2288431 - DNA, 13 bp, Homo sapiens
tcattgaaatctt

SEQ ID NO: 2288432 - DNA, 18 bp, Homo sapiens
tcattgagggaaaacata

SEQ ID NO: 2288433 - DNA, 23 bp, Homo sapiens
tcattgagggaaaacataatatc

SEQ ID NO: 2288434 - DNA, 18 bp, Homo sapiens
tcattgctgacagagccc

SEQ ID NO: 2288435 - DNA, 16 bp, Homo sapiens
tcattggttacaaatt

SEQ ID NO: 2288436 - DNA, 21 bp, Homo sapiens
tcattgtagagcacatttagt

SEQ ID NO: 2288437 - DNA, 21 bp, Homo sapiens
tcattgttacaggtgtactat

SEQ ID NO: 2288438 - DNA, 20 bp, Homo sapiens
tcatttacctcgcagtgtgt

SEQ ID NO: 2288439 - DNA, 17 bp, Homo sapiens
tcatttcccctcccgct

SEQ ID NO: 2288440 - DNA, 19 bp, Homo sapiens
tcatttgtagatatatatt

SEQ ID NO: 2288441 - DNA, 13 bp, Homo sapiens
tcattttgcacgt

SEQ ID NO: 2288442 - DNA, 12 bp, Homo sapiens
tccaaaataaat

SEQ ID NO: 2288443 - DNA, 20 bp, Homo sapiens
tccaaactgttctgagaagg

SEQ ID NO: 2288444 - DNA, 14 bp, Homo sapiens
tccaaatattctaa

SEQ ID NO: 2288445 - DNA, 18 bp, Homo sapiens
tccaaatattctaaaaaa

SEQ ID NO: 2288446 - DNA, 20 bp, Homo sapiens
tccaaatattctaaaaaaga

SEQ ID NO: 2288447 - DNA, 14 bp, Homo sapiens
tccaaattctctga

SEQ ID NO: 2288448 - DNA, 19 bp, Homo sapiens
tccaacaactccaggaaaa

SEQ ID NO: 2288449 - DNA, 20 bp, Homo sapiens
tccaacaactccaggaaaac

SEQ ID NO: 2288450 - DNA, 19 bp, Homo sapiens
tccaacaggggctggaggg

SEQ ID NO: 2288451 - DNA, 15 bp, Homo sapiens
tccaacatccactct

SEQ ID NO: 2288452 - DNA, 18 bp, Homo sapiens
tccaacctggaggctgga

SEQ ID NO: 2288453 - DNA, 19 bp, Homo sapiens
tccaactccaacatccact

SEQ ID NO: 2288454 - DNA, 17 bp, Homo sapiens
tccaactttcaggggct

SEQ ID NO: 2288455 - DNA, 18 bp, Homo sapiens
tccaaggccccaccttct

SEQ ID NO: 2288456 - DNA, 17 bp, Homo sapiens
tccaagtattttatctg

SEQ ID NO: 2288457 - DNA, 16 bp, Homo sapiens
tccaagtcatgggaga

SEQ ID NO: 2288458 - DNA, 19 bp, Homo sapiens
tccaagtcatgggagaaga

SEQ ID NO: 2288459 - DNA, 21 bp, Homo sapiens
tccaagtcatgggagaagagg

SEQ ID NO: 2288460 - DNA, 16 bp, Homo sapiens
tccaagttcattcata

SEQ ID NO: 2288461 - DNA, 18 bp, Homo sapiens
tccaagttcattcatact

SEQ ID NO: 2288462 - DNA, 13 bp, Homo sapiens
tccaatgaagata

SEQ ID NO: 2288463 - DNA, 19 bp, Homo sapiens
tccaatgaagataaatgct

SEQ ID NO: 2288464 - DNA, 22 bp, Homo sapiens
tccaattcattatgtcaattca

SEQ ID NO: 2288465 - DNA, 17 bp, Homo sapiens
tccacacacagcagctc

SEQ ID NO: 2288466 - DNA, 21 bp, Homo sapiens
tccacacacagcagctccaac

SEQ ID NO: 2288467 - DNA, 22 bp, Homo sapiens
tccacacacagcagctccaacc

SEQ ID NO: 2288468 - DNA, 13 bp, Homo sapiens
tccacacaggccc

SEQ ID NO: 2288469 - DNA, 23 bp, Homo sapiens
tccacacaggcccatgccctccg

SEQ ID NO: 2288470 - DNA, 17 bp, Homo sapiens
tccacaccctctccttg

SEQ ID NO: 2288471 - DNA, 21 bp, Homo sapiens
tccacattcatgtacaatgat

SEQ ID NO: 2288472 - DNA, 14 bp, Homo sapiens
tccacattctgctg

SEQ ID NO: 2288473 - DNA, 15 bp, Homo sapiens
tccacattctgctgc

SEQ ID NO: 2288474 - DNA, 18 bp, Homo sapiens
tccacattctgctgcccc

SEQ ID NO: 2288475 - DNA, 19 bp, Homo sapiens
tccacattctgctgccccc

SEQ ID NO: 2288476 - DNA, 20 bp, Homo sapiens
tccacattctgctgccccca

SEQ ID NO: 2288477 - DNA, 16 bp, Homo sapiens
tccaccaggattaatc

SEQ ID NO: 2288478 - DNA, 15 bp, Homo sapiens
tccaccctgaggagt

SEQ ID NO: 2288479 - DNA, 17 bp, Homo sapiens
tccaccctgaggagtga

SEQ ID NO: 2288480 - DNA, 17 bp, Homo sapiens
tccacctgggagatgct

SEQ ID NO: 2288481 - DNA, 20 bp, Homo sapiens
tccacctgggagatgctggg

SEQ ID NO: 2288482 - DNA, 21 bp, Homo sapiens
tccacctgggagatgctggga

SEQ ID NO: 2288483 - DNA, 23 bp, Homo sapiens
tccacctgggagatgctgggacc

SEQ ID NO: 2288484 - DNA, 17 bp, Homo sapiens
tccactgaaacctctgt

SEQ ID NO: 2288485 - DNA, 20 bp, Homo sapiens
tccactgaaacctctgttct

SEQ ID NO: 2288486 - DNA, 20 bp, Homo sapiens
tccactttggtaatgtgtca

SEQ ID NO: 2288487 - DNA, 16 bp, Homo sapiens
tccagaacaaaagata

SEQ ID NO: 2288488 - DNA, 19 bp, Homo sapiens
tccagaacgccctgtgtcc

SEQ ID NO: 2288489 - DNA, 20 bp, Homo sapiens
tccagaatttcccaaagcag

SEQ ID NO: 2288490 - DNA, 17 bp, Homo sapiens
tccagagacctgctcca

SEQ ID NO: 2288491 - DNA, 18 bp, Homo sapiens
tccagagacctgctccag

SEQ ID NO: 2288492 - DNA, 17 bp, Homo sapiens
tccagattattttctat

SEQ ID NO: 2288493 - DNA, 16 bp, Homo sapiens
tccagcaggggtctcc

SEQ ID NO: 2288494 - DNA, 20 bp, Homo sapiens
tccagcaggggtctcccaac

SEQ ID NO: 2288495 - DNA, 20 bp, Homo sapiens
tccagctcagtcccacagcc

SEQ ID NO: 2288496 - DNA, 21 bp, Homo sapiens
tccagctcagtcccacagccc

SEQ ID NO: 2288497 - DNA, 22 bp, Homo sapiens
tccagctcagtcccacagcccc

SEQ ID NO: 2288498 - DNA, 23 bp, Homo sapiens
tccagctcagtcccacagcccct

SEQ ID NO: 2288499 - DNA, 15 bp, Homo sapiens
tccagctctcccctg

SEQ ID NO: 2288500 - DNA, 14 bp, Homo sapiens
tccaggcaccgcct

SEQ ID NO: 2288501 - DNA, 17 bp, Homo sapiens
tccaggcaccgcctgcc

SEQ ID NO: 2288502 - DNA, 22 bp, Homo sapiens
tccaggcaccgcctgcccccag

SEQ ID NO: 2288503 - DNA, 23 bp, Homo sapiens
tccaggcaccgcctgcccccagc

SEQ ID NO: 2288504 - DNA, 16 bp, Homo sapiens
tccaggcgtagggcca

SEQ ID NO: 2288505 - DNA, 14 bp, Homo sapiens
tccagtgttttctt

SEQ ID NO: 2288506 - DNA, 17 bp, Homo sapiens
tccagttggactgtggc

SEQ ID NO: 2288507 - DNA, 22 bp, Homo sapiens
tccataggagggaaggagcagt

SEQ ID NO: 2288508 - DNA, 16 bp, Homo sapiens
tccatatagtttgttt

SEQ ID NO: 2288509 - DNA, 19 bp, Homo sapiens
tccatatagtttgttttct

SEQ ID NO: 2288510 - DNA, 19 bp, Homo sapiens
tccatatcagctctgcata

SEQ ID NO: 2288511 - DNA, 18 bp, Homo sapiens
tccatccacacacagcag

SEQ ID NO: 2288512 - DNA, 23 bp, Homo sapiens
tccatccacacacagcagctcca

SEQ ID NO: 2288513 - DNA, 20 bp, Homo sapiens
tccatccttttgcttcatct

SEQ ID NO: 2288514 - DNA, 20 bp, Homo sapiens
tccatgattccaagggccca

SEQ ID NO: 2288515 - DNA, 22 bp, Homo sapiens
tccatgattccaagggcccaga

SEQ ID NO: 2288516 - DNA, 19 bp, Homo sapiens
tccatgctctttcaccctg

SEQ ID NO: 2288517 - DNA, 21 bp, Homo sapiens
tccatgtctgtagttgctttg

SEQ ID NO: 2288518 - DNA, 20 bp, Homo sapiens
tccatgttagtaatggcaga

SEQ ID NO: 2288519 - DNA, 16 bp, Homo sapiens
tccatttatttattca

SEQ ID NO: 2288520 - DNA, 12 bp, Homo sapiens
tccattttctaa

SEQ ID NO: 2288521 - DNA, 16 bp, Homo sapiens
tccattttctaaactg

SEQ ID NO: 2288522 - DNA, 17 bp, Homo sapiens
tccattttctaaactgt

SEQ ID NO: 2288523 - DNA, 16 bp, Homo sapiens
tcccaaagcagtgcat

SEQ ID NO: 2288524 - DNA, 12 bp, Homo sapiens
tcccacaaaata

SEQ ID NO: 2288525 - DNA, 13 bp, Homo sapiens
tcccacaaaatat

SEQ ID NO: 2288526 - DNA, 16 bp, Homo sapiens
tcccacaattcttttg

SEQ ID NO: 2288527 - DNA, 19 bp, Homo sapiens
tcccacaattcttttgaaa

SEQ ID NO: 2288528 - DNA, 17 bp, Homo sapiens
tcccacagcctcttcct

SEQ ID NO: 2288529 - DNA, 13 bp, Homo sapiens
tcccacatccccc

SEQ ID NO: 2288530 - DNA, 19 bp, Homo sapiens
tcccacgacataagctggt

SEQ ID NO: 2288531 - DNA, 13 bp, Homo sapiens
tcccagacctagg

SEQ ID NO: 2288532 - DNA, 17 bp, Homo sapiens
tcccagctacctgggag

SEQ ID NO: 2288533 - DNA, 15 bp, Homo sapiens
tcccagctcactgca

SEQ ID NO: 2288534 - DNA, 18 bp, Homo sapiens
tcccagctggcagcgcct

SEQ ID NO: 2288535 - DNA, 20 bp, Homo sapiens
tcccagctggcagcgcctcc

SEQ ID NO: 2288536 - DNA, 22 bp, Homo sapiens
tcccagctggcagcgcctcccg

SEQ ID NO: 2288537 - DNA, 23 bp, Homo sapiens
tcccagggcccgagcgcgtgcct

SEQ ID NO: 2288538 - DNA, 19 bp, Homo sapiens
tcccatgcaacaccctctt

SEQ ID NO: 2288539 - DNA, 15 bp, Homo sapiens
tcccatgggctctgg

SEQ ID NO: 2288540 - DNA, 19 bp, Homo sapiens
tcccatgggctctggcccc

SEQ ID NO: 2288541 - DNA, 21 bp, Homo sapiens
tcccatgtggcttgtttgcct

SEQ ID NO: 2288542 - DNA, 17 bp, Homo sapiens
tcccatttgtaatgtat

SEQ ID NO: 2288543 - DNA, 17 bp, Homo sapiens
tccccacaccctggagt

SEQ ID NO: 2288544 - DNA, 19 bp, Homo sapiens
tccccacaccctggagtgg

SEQ ID NO: 2288545 - DNA, 12 bp, Homo sapiens
tccccagccccc

SEQ ID NO: 2288546 - DNA, 17 bp, Homo sapiens
tccccagccccctggcc

SEQ ID NO: 2288547 - DNA, 13 bp, Homo sapiens
tccccaggggcac

SEQ ID NO: 2288548 - DNA, 17 bp, Homo sapiens
tccccattctataaatt

SEQ ID NO: 2288549 - DNA, 17 bp, Homo sapiens
tcccccaggctgcgcct

SEQ ID NO: 2288550 - DNA, 18 bp, Homo sapiens
tcccccaggctgcgcctg

SEQ ID NO: 2288551 - DNA, 14 bp, Homo sapiens
tccccccatctcca

SEQ ID NO: 2288552 - DNA, 11 bp, Homo sapiens
tcccccctccc

SEQ ID NO: 2288553 - DNA, 13 bp, Homo sapiens
tcccccctccctg

SEQ ID NO: 2288554 - DNA, 19 bp, Homo sapiens
tcccccgcagacagacaga

SEQ ID NO: 2288555 - DNA, 20 bp, Homo sapiens
tccccgcccgccctcctctg

SEQ ID NO: 2288556 - DNA, 13 bp, Homo sapiens
tccccgcctcctc

SEQ ID NO: 2288557 - DNA, 19 bp, Homo sapiens
tccccgcctcctccctgcc

SEQ ID NO: 2288558 - DNA, 15 bp, Homo sapiens
tccccggagctggga

SEQ ID NO: 2288559 - DNA, 13 bp, Homo sapiens
tcccctcccgctt

SEQ ID NO: 2288560 - DNA, 19 bp, Homo sapiens
tcccctctcctgcgtgtgc

SEQ ID NO: 2288561 - DNA, 15 bp, Homo sapiens
tcccctggtgcccct

SEQ ID NO: 2288562 - DNA, 16 bp, Homo sapiens
tccccttgccacatcg

SEQ ID NO: 2288563 - DNA, 20 bp, Homo sapiens
tccccttgggatgggcacag

SEQ ID NO: 2288564 - DNA, 19 bp, Homo sapiens
tcccgcagcaccagcctga

SEQ ID NO: 2288565 - DNA, 15 bp, Homo sapiens
tcccgccgcctcggg

SEQ ID NO: 2288566 - DNA, 23 bp, Homo sapiens
tcccgcttcctccggctggacct

SEQ ID NO: 2288567 - DNA, 14 bp, Homo sapiens
tcccggccccgcgc

SEQ ID NO: 2288568 - DNA, 23 bp, Homo sapiens
tcccggccccgcgcgtgccccca

SEQ ID NO: 2288569 - DNA, 13 bp, Homo sapiens
tcccggggccatg

SEQ ID NO: 2288570 - DNA, 16 bp, Homo sapiens
tcccgtatgctttctt

SEQ ID NO: 2288571 - DNA, 18 bp, Homo sapiens
tcccgtccgtccgcccgc

SEQ ID NO: 2288572 - DNA, 23 bp, Homo sapiens
tcccgtccgtccgcccgcccacc

SEQ ID NO: 2288573 - DNA, 15 bp, Homo sapiens
tccctcctcccccac

SEQ ID NO: 2288574 - DNA, 12 bp, Homo sapiens
tccctcggtcag

SEQ ID NO: 2288575 - DNA, 16 bp, Homo sapiens
tccctcggtcagcacc

SEQ ID NO: 2288576 - DNA, 17 bp, Homo sapiens
tccctcggtcagcaccg

SEQ ID NO: 2288577 - DNA, 13 bp, Homo sapiens
tccctgacttccc

SEQ ID NO: 2288578 - DNA, 22 bp, Homo sapiens
tccctgacttcccagctggcag

SEQ ID NO: 2288579 - DNA, 11 bp, Homo sapiens
tccctgcctgg

SEQ ID NO: 2288580 - DNA, 13 bp, Homo sapiens
tccctgcctggcg

SEQ ID NO: 2288581 - DNA, 20 bp, Homo sapiens
tccctgcttggcttatgaaa

SEQ ID NO: 2288582 - DNA, 20 bp, Homo sapiens
tccctggcttgagtgatcct

SEQ ID NO: 2288583 - DNA, 21 bp, Homo sapiens
tccctgtaatgcactcctgcc

SEQ ID NO: 2288584 - DNA, 18 bp, Homo sapiens
tcccttacgtgagtcctg

SEQ ID NO: 2288585 - DNA, 22 bp, Homo sapiens
tcccttacgtgagtcctggcat

SEQ ID NO: 2288586 - DNA, 15 bp, Homo sapiens
tcccttcaactgtat

SEQ ID NO: 2288587 - DNA, 21 bp, Homo sapiens
tcccttcccactggaggcatg

SEQ ID NO: 2288588 - DNA, 22 bp, Homo sapiens
tcccttctgataagactggaaa

SEQ ID NO: 2288589 - DNA, 15 bp, Homo sapiens
tccctttcacactgt

SEQ ID NO: 2288590 - DNA, 12 bp, Homo sapiens
tcccttttcctt

SEQ ID NO: 2288591 - DNA, 14 bp, Homo sapiens
tccgactccccctc

SEQ ID NO: 2288592 - DNA, 15 bp, Homo sapiens
tccgcccgcccaccc

SEQ ID NO: 2288593 - DNA, 14 bp, Homo sapiens
tccgccctgggctc

SEQ ID NO: 2288594 - DNA, 18 bp, Homo sapiens
tccgctaatctcttctag

SEQ ID NO: 2288595 - DNA, 14 bp, Homo sapiens
tccggcagaggcag

SEQ ID NO: 2288596 - DNA, 18 bp, Homo sapiens
tccggcagaggcagggcc

SEQ ID NO: 2288597 - DNA, 13 bp, Homo sapiens
tccggcctgcagc

SEQ ID NO: 2288598 - DNA, 14 bp, Homo sapiens
tccggcctgcagcc

SEQ ID NO: 2288599 - DNA, 20 bp, Homo sapiens
tccggcctgcagcccagaac

SEQ ID NO: 2288600 - DNA, 21 bp, Homo sapiens
tccgggacgtggcacctcctc

SEQ ID NO: 2288601 - DNA, 22 bp, Homo sapiens
tccgggtgcgtgaccggcccgc

SEQ ID NO: 2288602 - DNA, 22 bp, Homo sapiens
tccgtccccagggtgcaggcgc

SEQ ID NO: 2288603 - DNA, 12 bp, Homo sapiens
tccgtccgcccg

SEQ ID NO: 2288604 - DNA, 18 bp, Homo sapiens
tccgtccgcccgcccacc

SEQ ID NO: 2288605 - DNA, 13 bp, Homo sapiens
tcctaaccctggc

SEQ ID NO: 2288606 - DNA, 16 bp, Homo sapiens
tcctaccaaatataaa

SEQ ID NO: 2288607 - DNA, 20 bp, Homo sapiens
tcctactctgggaagaatgt

SEQ ID NO: 2288608 - DNA, 23 bp, Homo sapiens
tcctagtaagaacgtactttctg

SEQ ID NO: 2288609 - DNA, 19 bp, Homo sapiens
tcctcacatgactgaaggg

SEQ ID NO: 2288610 - DNA, 15 bp, Homo sapiens
tcctcagcacggtgc

SEQ ID NO: 2288611 - DNA, 20 bp, Homo sapiens
tcctcatgcccaagagatct

SEQ ID NO: 2288612 - DNA, 15 bp, Homo sapiens
tcctccaaaacacaa

SEQ ID NO: 2288613 - DNA, 22 bp, Homo sapiens
tcctccagactcgagagggctg

SEQ ID NO: 2288614 - DNA, 16 bp, Homo sapiens
tcctccagctcctgcc

SEQ ID NO: 2288615 - DNA, 17 bp, Homo sapiens
tcctccagctcctgccc

SEQ ID NO: 2288616 - DNA, 21 bp, Homo sapiens
tcctccaggaggactgttcta

SEQ ID NO: 2288617 - DNA, 23 bp, Homo sapiens
tcctcccccacgcctccatccac

SEQ ID NO: 2288618 - DNA, 14 bp, Homo sapiens
tcctcccctctcct

SEQ ID NO: 2288619 - DNA, 19 bp, Homo sapiens
tcctcccgccccagcctcc

SEQ ID NO: 2288620 - DNA, 15 bp, Homo sapiens
tcctccggctggacc

SEQ ID NO: 2288621 - DNA, 14 bp, Homo sapiens
tcctccttcctcat

SEQ ID NO: 2288622 - DNA, 15 bp, Homo sapiens
tcctcggccagagct

SEQ ID NO: 2288623 - DNA, 22 bp, Homo sapiens
tcctcgggcgcctgcgctcctc

SEQ ID NO: 2288624 - DNA, 19 bp, Homo sapiens
tcctcgtccggcctgcagc

SEQ ID NO: 2288625 - DNA, 22 bp, Homo sapiens
tcctcgtccggcctgcagccca

SEQ ID NO: 2288626 - DNA, 17 bp, Homo sapiens
tcctctgcagcctgagc

SEQ ID NO: 2288627 - DNA, 12 bp, Homo sapiens
tcctctgccccc

SEQ ID NO: 2288628 - DNA, 21 bp, Homo sapiens
tcctctgccccctcccccgca

SEQ ID NO: 2288629 - DNA, 13 bp, Homo sapiens
tcctgaatgtaat

SEQ ID NO: 2288630 - DNA, 16 bp, Homo sapiens
tcctgacaccccactt

SEQ ID NO: 2288631 - DNA, 20 bp, Homo sapiens
tcctgagagggagagactgc

SEQ ID NO: 2288632 - DNA, 17 bp, Homo sapiens
tcctgagccagatttca

SEQ ID NO: 2288633 - DNA, 17 bp, Homo sapiens
tcctgagtagctgggac

SEQ ID NO: 2288634 - DNA, 10 bp, Homo sapiens
tcctgcctaa

SEQ ID NO: 2288635 - DNA, 13 bp, Homo sapiens
tcctgcctaaatt

SEQ ID NO: 2288636 - DNA, 16 bp, Homo sapiens
tgctagaatagaagaa

SEQ ID NO: 2288637 - DNA, 13 bp, Homo sapiens
tgctagtgataca

SEQ ID NO: 2288638 - DNA, 22 bp, Homo sapiens
tgctagtgatacactgtatcta

SEQ ID NO: 2288639 - DNA, 16 bp, Homo sapiens
tgctatccaatgatat

SEQ ID NO: 2288640 - DNA, 20 bp, Homo sapiens
tgctatccaatgatatagga

SEQ ID NO: 2288641 - DNA, 15 bp, Homo sapiens
tgctatggaaataca

SEQ ID NO: 2288642 - DNA, 16 bp, Homo sapiens
tgctatggaaatacat

SEQ ID NO: 2288643 - DNA, 18 bp, Homo sapiens
tgctatggaaatacattt

SEQ ID NO: 2288644 - DNA, 21 bp, Homo sapiens
tgctatggaaatacatttaga

SEQ ID NO: 2288645 - DNA, 22 bp, Homo sapiens
tgctatgttattttcagtgctt

SEQ ID NO: 2288646 - DNA, 22 bp, Homo sapiens
tgctattgtttataggaaataa

SEQ ID NO: 2288647 - DNA, 18 bp, Homo sapiens
tgctattttaaaattcat

SEQ ID NO: 2288648 - DNA, 21 bp, Homo sapiens
tgctattttaaaattcatgga

SEQ ID NO: 2288649 - DNA, 21 bp, Homo sapiens
tgctcagattccccccatctc

SEQ ID NO: 2288650 - DNA, 18 bp, Homo sapiens
tgctcaggctccccaaga

SEQ ID NO: 2288651 - DNA, 23 bp, Homo sapiens
tgctcaggctccccaagacttga

SEQ ID NO: 2288652 - DNA, 12 bp, Homo sapiens
tgctccagatcc

SEQ ID NO: 2288653 - DNA, 13 bp, Homo sapiens
tgctccagatcct

SEQ ID NO: 2288654 - DNA, 20 bp, Homo sapiens
tgctccagatcctctttccc

SEQ ID NO: 2288655 - DNA, 15 bp, Homo sapiens
tgctcctcggccaga

SEQ ID NO: 2288656 - DNA, 15 bp, Homo sapiens
tgctccttgcctctg

SEQ ID NO: 2288657 - DNA, 14 bp, Homo sapiens
tgctctccatctct

SEQ ID NO: 2288658 - DNA, 18 bp, Homo sapiens
tgctctgttttgcatgga

SEQ ID NO: 2288659 - DNA, 13 bp, Homo sapiens
tgctcttctctta

SEQ ID NO: 2288660 - DNA, 15 bp, Homo sapiens
tgctctttcaccctg

SEQ ID NO: 2288661 - DNA, 13 bp, Homo sapiens
tgctctttccacc

SEQ ID NO: 2288662 - DNA, 14 bp, Homo sapiens
tgctcttttcccag

SEQ ID NO: 2288663 - DNA, 23 bp, Homo sapiens
tgctgaaacacacaggccatttc

SEQ ID NO: 2288664 - DNA, 13 bp, Homo sapiens
tgctgacagagcc

SEQ ID NO: 2288665 - DNA, 21 bp, Homo sapiens
tgctgagagacggtgggaaaa

SEQ ID NO: 2288666 - DNA, 22 bp, Homo sapiens
tgctgcctagaaacagacctgc

SEQ ID NO: 2288667 - DNA, 13 bp, Homo sapiens
tgctgcctccaag

SEQ ID NO: 2288668 - DNA, 22 bp, Homo sapiens
tgctgcctccaagtcatgggag

SEQ ID NO: 2288669 - DNA, 14 bp, Homo sapiens
tgctgcctctgaaa

SEQ ID NO: 2288670 - DNA, 16 bp, Homo sapiens
tgctgcctgtttgggg

SEQ ID NO: 2288671 - DNA, 21 bp, Homo sapiens
tgctgctcctcggccagagct

SEQ ID NO: 2288672 - DNA, 20 bp, Homo sapiens
tgctgctcgggaaggcctga

SEQ ID NO: 2288673 - DNA, 18 bp, Homo sapiens
tgctgctgtgcagcatgg

SEQ ID NO: 2288674 - DNA, 15 bp, Homo sapiens
tgctgggaccctcgg

SEQ ID NO: 2288675 - DNA, 20 bp, Homo sapiens
tgctgggattacaggtgtga

SEQ ID NO: 2288676 - DNA, 11 bp, Homo sapiens
tgctgtcattt

SEQ ID NO: 2288677 - DNA, 15 bp, Homo sapiens
tgctgtcccttttcc

SEQ ID NO: 2288678 - DNA, 15 bp, Homo sapiens
tgctgttttatgtca

SEQ ID NO: 2288679 - DNA, 14 bp, Homo sapiens
tgcttaccaaaaca

SEQ ID NO: 2288680 - DNA, 15 bp, Homo sapiens
tgcttaccaaaacat

SEQ ID NO: 2288681 - DNA, 13 bp, Homo sapiens
tgcttagatttct

SEQ ID NO: 2288682 - DNA, 23 bp, Homo sapiens
tgcttcaaggatcctgagccaga

SEQ ID NO: 2288683 - DNA, 15 bp, Homo sapiens
tgcttcatctggagt

SEQ ID NO: 2288684 - DNA, 21 bp, Homo sapiens
tgcttccagttggactgtggc

SEQ ID NO: 2288685 - DNA, 13 bp, Homo sapiens
tgcttccttttca

SEQ ID NO: 2288686 - DNA, 22 bp, Homo sapiens
tgcttctaagggatccagagac

SEQ ID NO: 2288687 - DNA, 23 bp, Homo sapiens
tgcttgagtggacagcagctgga

SEQ ID NO: 2288688 - DNA, 13 bp, Homo sapiens
tgcttgatataat

SEQ ID NO: 2288689 - DNA, 20 bp, Homo sapiens
tgcttggatccatacaaaac

SEQ ID NO: 2288690 - DNA, 21 bp, Homo sapiens
tgcttggatccatacaaaact

SEQ ID NO: 2288691 - DNA, 18 bp, Homo sapiens
tgcttgtacctctggctg

SEQ ID NO: 2288692 - DNA, 22 bp, Homo sapiens
tgcttgtacctctggctgacta

SEQ ID NO: 2288693 - DNA, 18 bp, Homo sapiens
tgcttgtcattctgctaa

SEQ ID NO: 2288694 - DNA, 15 bp, Homo sapiens
tgctttagacaaatt

SEQ ID NO: 2288695 - DNA, 12 bp, Homo sapiens
tgctttattgcc

SEQ ID NO: 2288696 - DNA, 17 bp, Homo sapiens
tgctttattgcctctgt

SEQ ID NO: 2288697 - DNA, 18 bp, Homo sapiens
tgctttcatgtttaagaa

SEQ ID NO: 2288698 - DNA, 20 bp, Homo sapiens
tgctttcatgtttaagaaat

SEQ ID NO: 2288699 - DNA, 20 bp, Homo sapiens
tgctttgaatgcatgtgtga

SEQ ID NO: 2288700 - DNA, 23 bp, Homo sapiens
tgctttgcggcatctccatttca

SEQ ID NO: 2288701 - DNA, 19 bp, Homo sapiens
tgctttgttttggctgctc

SEQ ID NO: 2288702 - DNA, 12 bp, Homo sapiens
tgcttttccatc

SEQ ID NO: 2288703 - DNA, 20 bp, Homo sapiens
tgctttttaaactgatgtat

SEQ ID NO: 2288704 - DNA, 16 bp, Homo sapiens
tggaaaaatgtatcca

SEQ ID NO: 2288705 - DNA, 20 bp, Homo sapiens
tggaaacaaggaaggacatt

SEQ ID NO: 2288706 - DNA, 18 bp, Homo sapiens
tggaaacagaggaccagc

SEQ ID NO: 2288707 - DNA, 17 bp, Homo sapiens
tggaaaccctgagagtc

SEQ ID NO: 2288708 - DNA, 17 bp, Homo sapiens
tggaaatacatttagaa

SEQ ID NO: 2288709 - DNA, 18 bp, Homo sapiens
tggaaatatgcaacctgt

SEQ ID NO: 2288710 - DNA, 22 bp, Homo sapiens
tggaaatcctgttacttaaata

SEQ ID NO: 2288711 - DNA, 14 bp, Homo sapiens
tggaacactctgag

SEQ ID NO: 2288712 - DNA, 18 bp, Homo sapiens
tggaaccatcctctgtta

SEQ ID NO: 2288713 - DNA, 16 bp, Homo sapiens
tggaagaaagggagaa

SEQ ID NO: 2288714 - DNA, 16 bp, Homo sapiens
tggaagaacccttctc

SEQ ID NO: 2288715 - DNA, 15 bp, Homo sapiens
tggaagggcaggagc

SEQ ID NO: 2288716 - DNA, 20 bp, Homo sapiens
tggaagggcaggagctcaca

SEQ ID NO: 2288717 - DNA, 18 bp, Homo sapiens
tggaagtactataattta

SEQ ID NO: 2288718 - DNA, 14 bp, Homo sapiens
tggaatactgaaaa

SEQ ID NO: 2288719 - DNA, 13 bp, Homo sapiens
tggaatatcaatg

SEQ ID NO: 2288720 - DNA, 18 bp, Homo sapiens
tggaatcccacttatcaa

SEQ ID NO: 2288721 - DNA, 20 bp, Homo sapiens
tggaatcccacttatcaaat

SEQ ID NO: 2288722 - DNA, 20 bp, Homo sapiens
tggaatgttgttaaatgcta

SEQ ID NO: 2288723 - DNA, 15 bp, Homo sapiens
tggaattatgtataa

SEQ ID NO: 2288724 - DNA, 17 bp, Homo sapiens
tggaatttcttgtttct

SEQ ID NO: 2288725 - DNA, 22 bp, Homo sapiens
tggacagatgggtgtcccctgg

SEQ ID NO: 2288726 - DNA, 21 bp, Homo sapiens
tggacaggcttcgtctcagaa

SEQ ID NO: 2288727 - DNA, 15 bp, Homo sapiens
tggacagtaagattt

SEQ ID NO: 2288728 - DNA, 22 bp, Homo sapiens
tggaccactgtttcttgcttgt

SEQ ID NO: 2288729 - DNA, 20 bp, Homo sapiens
tggacccgcccgcggccctc

SEQ ID NO: 2288730 - DNA, 21 bp, Homo sapiens
tggacgagtgagctaccagga

SEQ ID NO: 2288731 - DNA, 17 bp, Homo sapiens
tggactcgcgagagggt

SEQ ID NO: 2288732 - DNA, 18 bp, Homo sapiens
tggactcgcgagagggtg

SEQ ID NO: 2288733 - DNA, 17 bp, Homo sapiens
tggactctgtggggcca

SEQ ID NO: 2288734 - DNA, 19 bp, Homo sapiens
tggactctgtggggccaca

SEQ ID NO: 2288735 - DNA, 17 bp, Homo sapiens
tggagaagttgtgaaag

SEQ ID NO: 2288736 - DNA, 18 bp, Homo sapiens
tggagagaagttgccctc

SEQ ID NO: 2288737 - DNA, 24 bp, Homo sapiens
tggagagaagttgccctccaggcc

SEQ ID NO: 2288738 - DNA, 20 bp, Homo sapiens
tggagatgtcagtctgtcca

SEQ ID NO: 2288739 - DNA, 18 bp, Homo sapiens
tggagcagagacggcagc

SEQ ID NO: 2288740 - DNA, 18 bp, Homo sapiens
tggagcagtttggggcag

SEQ ID NO: 2288741 - DNA, 21 bp, Homo sapiens
tggagcagtttggggcagggg

SEQ ID NO: 2288742 - DNA, 18 bp, Homo sapiens
tggagcccggcagtgcac

SEQ ID NO: 2288743 - DNA, 21 bp, Homo sapiens
tggaggagggtttgggcagag

SEQ ID NO: 2288744 - DNA, 15 bp, Homo sapiens
tggaggatggacgag

SEQ ID NO: 2288745 - DNA, 17 bp, Homo sapiens
tggaggatggacgagtg

SEQ ID NO: 2288746 - DNA, 19 bp, Homo sapiens
tggaggatggacgagtgag

SEQ ID NO: 2288747 - DNA, 23 bp, Homo sapiens
tggaggctggaccaactgctttg

SEQ ID NO: 2288748 - DNA, 21 bp, Homo sapiens
tggaggggcccatgtgggctg

SEQ ID NO: 2288749 - DNA, 14 bp, Homo sapiens
tggaggtggggagg

SEQ ID NO: 2288750 - DNA, 15 bp, Homo sapiens
tggaggtggggaggg

SEQ ID NO: 2288751 - DNA, 19 bp, Homo sapiens
tggagtattattattttaa

SEQ ID NO: 2288752 - DNA, 19 bp, Homo sapiens
tggagtccagacctgggcc

SEQ ID NO: 2288753 - DNA, 14 bp, Homo sapiens
tggagtgaagaaaa

SEQ ID NO: 2288754 - DNA, 16 bp, Homo sapiens
tggagttcatcttgaa

SEQ ID NO: 2288755 - DNA, 17 bp, Homo sapiens
tggagttcatcttgaat

SEQ ID NO: 2288756 - DNA, 20 bp, Homo sapiens
tggagttcatcttgaattgt

SEQ ID NO: 2288757 - DNA, 16 bp, Homo sapiens
tggatagaaaaatgct

SEQ ID NO: 2288758 - DNA, 13 bp, Homo sapiens
tggatcaaccaag

SEQ ID NO: 2288759 - DNA, 18 bp, Homo sapiens
tggatcaaccaagttaca

SEQ ID NO: 2288760 - DNA, 13 bp, Homo sapiens
tggatgtgctttc

SEQ ID NO: 2288761 - DNA, 15 bp, Homo sapiens
tggattctatatttc

SEQ ID NO: 2288762 - DNA, 21 bp, Homo sapiens
tggattctatatttcatattg

SEQ ID NO: 2288763 - DNA, 23 bp, Homo sapiens
tggatttcctttgacctctcact

SEQ ID NO: 2288764 - DNA, 17 bp, Homo sapiens
tggattttctttctatg

SEQ ID NO: 2288765 - DNA, 21 bp, Homo sapiens
tggattttctttctatgtaga

SEQ ID NO: 2288766 - DNA, 13 bp, Homo sapiens
tggcaaataatac

SEQ ID NO: 2288767 - DNA, 20 bp, Homo sapiens
tggcaaataatactaattta

SEQ ID NO: 2288768 - DNA, 17 bp, Homo sapiens
tggcagagccatccacc

SEQ ID NO: 2288769 - DNA, 20 bp, Homo sapiens
tggcaggagacactggtctc

SEQ ID NO: 2288770 - DNA, 22 bp, Homo sapiens
tggcaggagacactggtctcag

SEQ ID NO: 2288771 - DNA, 15 bp, Homo sapiens
tggcagtggcagaga

SEQ ID NO: 2288772 - DNA, 12 bp, Homo sapiens
tggcatgggaat

SEQ ID NO: 2288773 - DNA, 15 bp, Homo sapiens
tggcatgggaatgaa

SEQ ID NO: 2288774 - DNA, 20 bp, Homo sapiens
tggcatggtcctgtgccccg

SEQ ID NO: 2288775 - DNA, 15 bp, Homo sapiens
tggcattttggctca

SEQ ID NO: 2288776 - DNA, 16 bp, Homo sapiens
tggccaaagtgtacaa

SEQ ID NO: 2288777 - DNA, 14 bp, Homo sapiens
tggccactggccct

SEQ ID NO: 2288778 - DNA, 16 bp, Homo sapiens
tggccagggctccacg

SEQ ID NO: 2288779 - DNA, 17 bp, Homo sapiens
tggccagggctccacgg

SEQ ID NO: 2288780 - DNA, 19 bp, Homo sapiens
tggccccagctggctgggt

SEQ ID NO: 2288781 - DNA, 16 bp, Homo sapiens
tggccggtccaccccg

SEQ ID NO: 2288782 - DNA, 15 bp, Homo sapiens
tggcctaatcacctt

SEQ ID NO: 2288783 - DNA, 19 bp, Homo sapiens
tggcctaatcacctttcca

SEQ ID NO: 2288784 - DNA, 14 bp, Homo sapiens
tggcctcaggaggc

SEQ ID NO: 2288785 - DNA, 17 bp, Homo sapiens
tggcctgacacaatggt

SEQ ID NO: 2288786 - DNA, 15 bp, Homo sapiens
tggcgcacccggcag

SEQ ID NO: 2288787 - DNA, 15 bp, Homo sapiens
tggcgcgcagcccgg

SEQ ID NO: 2288788 - DNA, 20 bp, Homo sapiens
tggcgggaagggtgggccct

SEQ ID NO: 2288789 - DNA, 12 bp, Homo sapiens
tggcgggcagcc

SEQ ID NO: 2288790 - DNA, 17 bp, Homo sapiens
tggcgggcagcccctgc

SEQ ID NO: 2288791 - DNA, 15 bp, Homo sapiens
tggctaacatagcac

SEQ ID NO: 2288792 - DNA, 17 bp, Homo sapiens
tggctcacatcatgtaa

SEQ ID NO: 2288793 - DNA, 14 bp, Homo sapiens
tggctcagagtcca

SEQ ID NO: 2288794 - DNA, 20 bp, Homo sapiens
tggctcgctgtggtttctcg

SEQ ID NO: 2288795 - DNA, 15 bp, Homo sapiens
tggctgaaaatggtg

SEQ ID NO: 2288796 - DNA, 16 bp, Homo sapiens
tggctgaccaggccct

SEQ ID NO: 2288797 - DNA, 18 bp, Homo sapiens
tggctgaccaggccctgc

SEQ ID NO: 2288798 - DNA, 21 bp, Homo sapiens
tggctgaccaggccctgctca

SEQ ID NO: 2288799 - DNA, 15 bp, Homo sapiens
tggctgactaaattt

SEQ ID NO: 2288800 - DNA, 23 bp, Homo sapiens
tggctgactaaatttggggacag

SEQ ID NO: 2288801 - DNA, 22 bp, Homo sapiens
tggctggaatgggggccaggct

SEQ ID NO: 2288802 - DNA, 16 bp, Homo sapiens
tggctgggtcgcccct

SEQ ID NO: 2288803 - DNA, 19 bp, Homo sapiens
tggctgggtcgcccctcct

SEQ ID NO: 2288804 - DNA, 20 bp, Homo sapiens
tggcttctctgccctgccct

SEQ ID NO: 2288805 - DNA, 22 bp, Homo sapiens
tggcttctctgccctgccctgg

SEQ ID NO: 2288806 - DNA, 12 bp, Homo sapiens
tggcttggagca

SEQ ID NO: 2288807 - DNA, 12 bp, Homo sapiens
tggctttcattt

SEQ ID NO: 2288808 - DNA, 15 bp, Homo sapiens
tgggaagttaccttt

SEQ ID NO: 2288809 - DNA, 18 bp, Homo sapiens
tgggaatttatttatgtt

SEQ ID NO: 2288810 - DNA, 13 bp, Homo sapiens
tgggacacagaga

SEQ ID NO: 2288811 - DNA, 14 bp, Homo sapiens
tgggacccactccg

SEQ ID NO: 2288812 - DNA, 15 bp, Homo sapiens
tgggactcagttctt

SEQ ID NO: 2288813 - DNA, 18 bp, Homo sapiens
tgggactcagttcttggc

SEQ ID NO: 2288814 - DNA, 21 bp, Homo sapiens
tgggactgctcaggctcccca

SEQ ID NO: 2288815 - DNA, 15 bp, Homo sapiens
tgggagattggcttt

SEQ ID NO: 2288816 - DNA, 13 bp, Homo sapiens
tgggagggggcag

SEQ ID NO: 2288817 - DNA, 15 bp, Homo sapiens
tgggagtcagggagc

SEQ ID NO: 2288818 - DNA, 17 bp, Homo sapiens
tgggagtgaacatttct

SEQ ID NO: 2288819 - DNA, 14 bp, Homo sapiens
tgggatgggcacag

SEQ ID NO: 2288820 - DNA, 17 bp, Homo sapiens
tgggatgggcacaggct

SEQ ID NO: 2288821 - DNA, 15 bp, Homo sapiens
tgggcaaggggccag

SEQ ID NO: 2288822 - DNA, 18 bp, Homo sapiens
tgggcaaggggccaggaa

SEQ ID NO: 2288823 - DNA, 13 bp, Homo sapiens
tgggcacaggctg

SEQ ID NO: 2288824 - DNA, 18 bp, Homo sapiens
tgggcacgggagagcgcc

SEQ ID NO: 2288825 - DNA, 12 bp, Homo sapiens
tgggcagggccc

SEQ ID NO: 2288826 - DNA, 16 bp, Homo sapiens
tgggcagggccctgtg

SEQ ID NO: 2288827 - DNA, 19 bp, Homo sapiens
tgggcagggccctgtggct

SEQ ID NO: 2288828 - DNA, 18 bp, Homo sapiens
tgggcagggccgcagggc

SEQ ID NO: 2288829 - DNA, 16 bp, Homo sapiens
tgggcatccccagccc

SEQ ID NO: 2288830 - DNA, 21 bp, Homo sapiens
tgggcatccccagccccctgg

SEQ ID NO: 2288831 - DNA, 21 bp, Homo sapiens
tgggccagggtctcgtcagga

SEQ ID NO: 2288832 - DNA, 19 bp, Homo sapiens
tgggccccacagtggtcag

SEQ ID NO: 2288833 - DNA, 16 bp, Homo sapiens
tgggccccgcctcaag

SEQ ID NO: 2288834 - DNA, 14 bp, Homo sapiens
tgggccctggttcc

SEQ ID NO: 2288835 - DNA, 14 bp, Homo sapiens
tgggctctgcgtcc

SEQ ID NO: 2288836 - DNA, 20 bp, Homo sapiens
tgggctggcggccatccccg

SEQ ID NO: 2288837 - DNA, 19 bp, Homo sapiens
tggggacagattcagtctt

SEQ ID NO: 2288838 - DNA, 23 bp, Homo sapiens
tggggagcgggggctaactggcc

SEQ ID NO: 2288839 - DNA, 18 bp, Homo sapiens
tggggagggcctctggac

SEQ ID NO: 2288840 - DNA, 20 bp, Homo sapiens
tggggcagggggttctggga

SEQ ID NO: 2288841 - DNA, 16 bp, Homo sapiens
tggggccagcccctcc

SEQ ID NO: 2288842 - DNA, 15 bp, Homo sapiens
tggggcccatggccc

SEQ ID NO: 2288843 - DNA, 16 bp, Homo sapiens
tggggcccatggcccc

SEQ ID NO: 2288844 - DNA, 20 bp, Homo sapiens
tggggcccatggccccagct

SEQ ID NO: 2288845 - DNA, 14 bp, Homo sapiens
tggggcttatcaga

SEQ ID NO: 2288846 - DNA, 20 bp, Homo sapiens
tgggggaggcttccagctca

SEQ ID NO: 2288847 - DNA, 18 bp, Homo sapiens
tgggggccaggctgagcc

SEQ ID NO: 2288848 - DNA, 13 bp, Homo sapiens
tgggggctcctgg

SEQ ID NO: 2288849 - DNA, 15 bp, Homo sapiens
tgggggctcctggca

SEQ ID NO: 2288850 - DNA, 13 bp, Homo sapiens
tggggggagaaac

SEQ ID NO: 2288851 - DNA, 19 bp, Homo sapiens
tgggggtggccactcctgg

SEQ ID NO: 2288852 - DNA, 20 bp, Homo sapiens
tggggtaagttgaagggaaa

SEQ ID NO: 2288853 - DNA, 12 bp, Homo sapiens
tggggtcccccc

SEQ ID NO: 2288854 - DNA, 21 bp, Homo sapiens
tggggtgggagggggcagggg

SEQ ID NO: 2288855 - DNA, 21 bp, Homo sapiens
tggggtttgcttttgttttgt

SEQ ID NO: 2288856 - DNA, 19 bp, Homo sapiens
tgggtaaaagcagggcagc

SEQ ID NO: 2288857 - DNA, 22 bp, Homo sapiens
tgggtagctgccacttgaacaa

SEQ ID NO: 2288858 - DNA, 21 bp, Homo sapiens
tgggtatttcttatttgaaag

SEQ ID NO: 2288859 - DNA, 15 bp, Homo sapiens
tgggtcgcccctcct

SEQ ID NO: 2288860 - DNA, 13 bp, Homo sapiens
tgggtgggacaca

SEQ ID NO: 2288861 - DNA, 14 bp, Homo sapiens
tgggtgggacacag

SEQ ID NO: 2288862 - DNA, 20 bp, Homo sapiens
tgggtgggccccacagtggt

SEQ ID NO: 2288863 - DNA, 15 bp, Homo sapiens
tgggtgtcccctggt

SEQ ID NO: 2288864 - DNA, 14 bp, Homo sapiens
tggtaaagagatgt

SEQ ID NO: 2288865 - DNA, 18 bp, Homo sapiens
tggtaatgtgtcaaagag

SEQ ID NO: 2288866 - DNA, 18 bp, Homo sapiens
tggtagagttcctttctg

SEQ ID NO: 2288867 - DNA, 19 bp, Homo sapiens
tggtagctctgaagggagg

SEQ ID NO: 2288868 - DNA, 22 bp, Homo sapiens
tggtagctctgaagggagggga

SEQ ID NO: 2288869 - DNA, 16 bp, Homo sapiens
tggtatacctatttca

SEQ ID NO: 2288870 - DNA, 20 bp, Homo sapiens
tggtattttcgtgcatttgt

SEQ ID NO: 2288871 - DNA, 23 bp, Homo sapiens
tggtattttggcattttggctca

SEQ ID NO: 2288872 - DNA, 19 bp, Homo sapiens
tggtcagcgattcctgcca

SEQ ID NO: 2288873 - DNA, 18 bp, Homo sapiens
tggtcagttttcacagag

SEQ ID NO: 2288874 - DNA, 18 bp, Homo sapiens
tggtccacattctgctgc

SEQ ID NO: 2288875 - DNA, 19 bp, Homo sapiens
tggtcctgcctaaatttca

SEQ ID NO: 2288876 - DNA, 13 bp, Homo sapiens
tggtcctgtgccc

SEQ ID NO: 2288877 - DNA, 16 bp, Homo sapiens
tggtctcgtgttcgct

SEQ ID NO: 2288878 - DNA, 17 bp, Homo sapiens
tggtctcgtgttcgctg

SEQ ID NO: 2288879 - DNA, 20 bp, Homo sapiens
tggtcttgaactcttggcct

SEQ ID NO: 2288880 - DNA, 14 bp, Homo sapiens
tggtgcaatgacct

SEQ ID NO: 2288881 - DNA, 21 bp, Homo sapiens
tggtgcaatgacctttcaata

SEQ ID NO: 2288882 - DNA, 14 bp, Homo sapiens
tggtgcagtaacca

SEQ ID NO: 2288883 - DNA, 21 bp, Homo sapiens
tggtggcagtgcagcaaccag

SEQ ID NO: 2288884 - DNA, 18 bp, Homo sapiens
tggtgtgaggcccccgga

SEQ ID NO: 2288885 - DNA, 20 bp, Homo sapiens
tggttattttctccatgtct

SEQ ID NO: 2288886 - DNA, 20 bp, Homo sapiens
tggttcccccaggaccctga

SEQ ID NO: 2288887 - DNA, 13 bp, Homo sapiens
tgtaaaattcata

SEQ ID NO: 2288888 - DNA, 17 bp, Homo sapiens
tgtaaacatcataaata

SEQ ID NO: 2288889 - DNA, 14 bp, Homo sapiens
tgtaaataatgctt

SEQ ID NO: 2288890 - DNA, 15 bp, Homo sapiens
tgtaaataatgctta

SEQ ID NO: 2288891 - DNA, 21 bp, Homo sapiens
tgtaaatacatgtccccctgt

SEQ ID NO: 2288892 - DNA, 22 bp, Homo sapiens
tgtaaatatacagcatgagatt

SEQ ID NO: 2288893 - DNA, 16 bp, Homo sapiens
tgtaaatgttatttct

SEQ ID NO: 2288894 - DNA, 17 bp, Homo sapiens
tgtaaatgttatttctg

SEQ ID NO: 2288895 - DNA, 18 bp, Homo sapiens
tgtaaatttaactgcata

SEQ ID NO: 2288896 - DNA, 19 bp, Homo sapiens
tgtaacagttggtgatttt

SEQ ID NO: 2288897 - DNA, 15 bp, Homo sapiens
tgtaaccatatgatt

SEQ ID NO: 2288898 - DNA, 16 bp, Homo sapiens
tgtaactgttctttgc

SEQ ID NO: 2288899 - DNA, 21 bp, Homo sapiens
tgtaactgttctttgcagtga

SEQ ID NO: 2288900 - DNA, 23 bp, Homo sapiens
tgtaagaggtactaaaaacactg

SEQ ID NO: 2288901 - DNA, 19 bp, Homo sapiens
tgtaagggctttaaataaa

SEQ ID NO: 2288902 - DNA, 17 bp, Homo sapiens
tgtaatatataatcaaa

SEQ ID NO: 2288903 - DNA, 14 bp, Homo sapiens
tgtaatattttgta

SEQ ID NO: 2288904 - DNA, 13 bp, Homo sapiens
tgtaatcatttat

SEQ ID NO: 2288905 - DNA, 14 bp, Homo sapiens
tgtaatgtatctta

SEQ ID NO: 2288906 - DNA, 21 bp, Homo sapiens
tgtaatgtatcttatttatat

SEQ ID NO: 2288907 - DNA, 19 bp, Homo sapiens
tgtacagaaaatagctttt

SEQ ID NO: 2288908 - DNA, 15 bp, Homo sapiens
tgcaaattattctag

SEQ ID NO: 2288909 - DNA, 13 bp, Homo sapiens
tgcaacctgtgca

SEQ ID NO: 2288910 - DNA, 14 bp, Homo sapiens
tgcaacctgtgcaa

SEQ ID NO: 2288911 - DNA, 15 bp, Homo sapiens
tgcaacctgtgcaaa

SEQ ID NO: 2288912 - DNA, 18 bp, Homo sapiens
tgcaacctgtgcaaaata

SEQ ID NO: 2288913 - DNA, 16 bp, Homo sapiens
tgcaaggcaaagtaaa

SEQ ID NO: 2288914 - DNA, 17 bp, Homo sapiens
tgcaatatgtaacatgt

SEQ ID NO: 2288915 - DNA, 22 bp, Homo sapiens
tgcaatcatatgtgatctgtct

SEQ ID NO: 2288916 - DNA, 23 bp, Homo sapiens
tgcaatgacctttcaataggaaa

SEQ ID NO: 2288917 - DNA, 13 bp, Homo sapiens
tgcaatgatcaga

SEQ ID NO: 2288918 - DNA, 16 bp, Homo sapiens
tgcacacctgtaatcc

SEQ ID NO: 2288919 - DNA, 20 bp, Homo sapiens
tgcacagctaacatggaagt

SEQ ID NO: 2288920 - DNA, 19 bp, Homo sapiens
tgcacagtagtgttgggtg

SEQ ID NO: 2288921 - DNA, 14 bp, Homo sapiens
tgcacatatacatc

SEQ ID NO: 2288922 - DNA, 13 bp, Homo sapiens
tgcacggggccag

SEQ ID NO: 2288923 - DNA, 20 bp, Homo sapiens
tgcacgtgctcttctgttct

SEQ ID NO: 2288924 - DNA, 18 bp, Homo sapiens
tgcacttctgttatcagg

SEQ ID NO: 2288925 - DNA, 18 bp, Homo sapiens
tgcacttgtgatcctaaa

SEQ ID NO: 2288926 - DNA, 16 bp, Homo sapiens
tgcagcaaccagagca

SEQ ID NO: 2288927 - DNA, 17 bp, Homo sapiens
tgcagcaaccagagcac

SEQ ID NO: 2288928 - DNA, 19 bp, Homo sapiens
tgcagcaaccagagcactg

SEQ ID NO: 2288929 - DNA, 20 bp, Homo sapiens
tgcagcagaaaggctctgaa

SEQ ID NO: 2288930 - DNA, 22 bp, Homo sapiens
tgcagcagtaccatcccactga

SEQ ID NO: 2288931 - DNA, 11 bp, Homo sapiens
tgcagcccaga

SEQ ID NO: 2288932 - DNA, 19 bp, Homo sapiens
tgcagcctcgacctccctg

SEQ ID NO: 2288933 - DNA, 23 bp, Homo sapiens
tgcagcctcgacctccctggctt

SEQ ID NO: 2288934 - DNA, 13 bp, Homo sapiens
tgcagcctgagct

SEQ ID NO: 2288935 - DNA, 16 bp, Homo sapiens
tgcagcctgagctcca

SEQ ID NO: 2288936 - DNA, 20 bp, Homo sapiens
tgcagcctgagctccaccct

SEQ ID NO: 2288937 - DNA, 21 bp, Homo sapiens
tgcaggcgcgcaccgcccaac

SEQ ID NO: 2288938 - DNA, 22 bp, Homo sapiens
tgcaggcggtatccagaggtga

SEQ ID NO: 2288939 - DNA, 23 bp, Homo sapiens
tgcaggcggtatccagaggtgag

SEQ ID NO: 2288940 - DNA, 24 bp, Homo sapiens
tgcaggcggtatccagaggtgagg

SEQ ID NO: 2288941 - DNA, 16 bp, Homo sapiens
tgcagtatcagagggt

SEQ ID NO: 2288942 - DNA, 19 bp, Homo sapiens
tgcagttcctgctgcctgc

SEQ ID NO: 2288943 - DNA, 15 bp, Homo sapiens
tgcataaatgttata

SEQ ID NO: 2288944 - DNA, 22 bp, Homo sapiens
tgcatacacatgcactcagtgt

SEQ ID NO: 2288945 - DNA, 20 bp, Homo sapiens
tgcatactggactcttcaaa

SEQ ID NO: 2288946 - DNA, 17 bp, Homo sapiens
tgcatagacaagtgttt

SEQ ID NO: 2288947 - DNA, 14 bp, Homo sapiens
tgcatcaaatgcat

SEQ ID NO: 2288948 - DNA, 14 bp, Homo sapiens
tgcatcaagatgtg

SEQ ID NO: 2288949 - DNA, 14 bp, Homo sapiens
tgcatcctcccctc

SEQ ID NO: 2288950 - DNA, 13 bp, Homo sapiens
tgcatctttctct

SEQ ID NO: 2288951 - DNA, 15 bp, Homo sapiens
tgcatctttctcttc

SEQ ID NO: 2288952 - DNA, 16 bp, Homo sapiens
tgcatctttctcttcc

SEQ ID NO: 2288953 - DNA, 16 bp, Homo sapiens
tgcatgatgactcttc

SEQ ID NO: 2288954 - DNA, 17 bp, Homo sapiens
tgcatgatgactcttct

SEQ ID NO: 2288955 - DNA, 22 bp, Homo sapiens
tgcatgatgactcttcttatca

SEQ ID NO: 2288956 - DNA, 18 bp, Homo sapiens
tgcatgctgtcccttacg

SEQ ID NO: 2288957 - DNA, 21 bp, Homo sapiens
tgcatgctgtcccttacgtga

SEQ ID NO: 2288958 - DNA, 20 bp, Homo sapiens
tgcattccagcgtctgctgt

SEQ ID NO: 2288959 - DNA, 21 bp, Homo sapiens
tgcatttaagaacagaacagc

SEQ ID NO: 2288960 - DNA, 17 bp, Homo sapiens
tgccaaaaactaaaatt

SEQ ID NO: 2288961 - DNA, 19 bp, Homo sapiens
tgccaaaaactaaaattca

SEQ ID NO: 2288962 - DNA, 18 bp, Homo sapiens
tgccaaaatgtcaatttt

SEQ ID NO: 2288963 - DNA, 17 bp, Homo sapiens
tgccaaagatagcagaa

SEQ ID NO: 2288964 - DNA, 14 bp, Homo sapiens
tgccaaataaaatg

SEQ ID NO: 2288965 - DNA, 16 bp, Homo sapiens
tgccaaataaaatgtt

SEQ ID NO: 2288966 - DNA, 17 bp, Homo sapiens
tgccaaataaaatgttt

SEQ ID NO: 2288967 - DNA, 21 bp, Homo sapiens
tgccaaataaaatgtttacat

SEQ ID NO: 2288968 - DNA, 15 bp, Homo sapiens
tgccaaatcctgggc

SEQ ID NO: 2288969 - DNA, 15 bp, Homo sapiens
tgccaacctcgctcc

SEQ ID NO: 2288970 - DNA, 22 bp, Homo sapiens
tgccaagagtcaacaggtcact

SEQ ID NO: 2288971 - DNA, 21 bp, Homo sapiens
tgccacccaggtgatgttagt

SEQ ID NO: 2288972 - DNA, 18 bp, Homo sapiens
tgccactcctcaactgat

SEQ ID NO: 2288973 - DNA, 19 bp, Homo sapiens
tgccacttgaacaaaatct

SEQ ID NO: 2288974 - DNA, 16 bp, Homo sapiens
tgccagacagagatca

SEQ ID NO: 2288975 - DNA, 21 bp, Homo sapiens
tgccaggagtgggtgggacac

SEQ ID NO: 2288976 - DNA, 13 bp, Homo sapiens
tgccatcagcccc

SEQ ID NO: 2288977 - DNA, 16 bp, Homo sapiens
tgccatcagcccctgc

SEQ ID NO: 2288978 - DNA, 19 bp, Homo sapiens
tgcccaccctgggcctccc

SEQ ID NO: 2288979 - DNA, 19 bp, Homo sapiens
tgcccaccgcccctggaca

SEQ ID NO: 2288980 - DNA, 21 bp, Homo sapiens
tgcccaggacggtctgtgccc

SEQ ID NO: 2288981 - DNA, 22 bp, Homo sapiens
tgcccaggacggtctgtgcccg

SEQ ID NO: 2288982 - DNA, 18 bp, Homo sapiens
tgcccagttcatcccaat

SEQ ID NO: 2288983 - DNA, 23 bp, Homo sapiens
tgcccatggcttctggtcatgaa

SEQ ID NO: 2288984 - DNA, 13 bp, Homo sapiens
tgccccacccctc

SEQ ID NO: 2288985 - DNA, 16 bp, Homo sapiens
tgcccccacagatcca

SEQ ID NO: 2288986 - DNA, 14 bp, Homo sapiens
tgcccccaccctgc

SEQ ID NO: 2288987 - DNA, 20 bp, Homo sapiens
tgcccccaccctgcttctgc

SEQ ID NO: 2288988 - DNA, 15 bp, Homo sapiens
tgcccccagcgtggg

SEQ ID NO: 2288989 - DNA, 23 bp, Homo sapiens
tgcccccgctctgccatcagccc

SEQ ID NO: 2288990 - DNA, 16 bp, Homo sapiens
tgccccctcccccgca

SEQ ID NO: 2288991 - DNA, 19 bp, Homo sapiens
tgcccctccgtccccaggg

SEQ ID NO: 2288992 - DNA, 17 bp, Homo sapiens
tgccctcccccacggcc

SEQ ID NO: 2288993 - DNA, 15 bp, Homo sapiens
tgccctctgtttccc

SEQ ID NO: 2288994 - DNA, 12 bp, Homo sapiens
tgccctgcacct

SEQ ID NO: 2288995 - DNA, 16 bp, Homo sapiens
tgccctgccctggcca

SEQ ID NO: 2288996 - DNA, 15 bp, Homo sapiens
tgccctggccactgg

SEQ ID NO: 2288997 - DNA, 20 bp, Homo sapiens
tgccctggccactggccctg

SEQ ID NO: 2288998 - DNA, 16 bp, Homo sapiens
tgcccttttgcccact

SEQ ID NO: 2288999 - DNA, 18 bp, Homo sapiens
tgccgacggagccactgg

SEQ ID NO: 2289000 - DNA, 22 bp, Homo sapiens
tgccgctgcccccaccctgctt

SEQ ID NO: 2289001 - DNA, 23 bp, Homo sapiens
tgccgctgcttgagtggacagca

SEQ ID NO: 2289002 - DNA, 22 bp, Homo sapiens
tgccgctgtgtccccgcgggca

SEQ ID NO: 2289003 - DNA, 18 bp, Homo sapiens
tgccgtgcacggggccag

SEQ ID NO: 2289004 - DNA, 21 bp, Homo sapiens
tgccgtgcacggggccagcat

SEQ ID NO: 2289005 - DNA, 17 bp, Homo sapiens
tgcctctgaactgctgc

SEQ ID NO: 2289006 - DNA, 20 bp, Homo sapiens
tgcctctgaactgctgctgg

SEQ ID NO: 2289007 - DNA, 12 bp, Homo sapiens
tgcctgcagctg

SEQ ID NO: 2289008 - DNA, 23 bp, Homo sapiens
tgcctggaagagccgagcacctg

SEQ ID NO: 2289009 - DNA, 16 bp, Homo sapiens
tgcctggcggcagggg

SEQ ID NO: 2289010 - DNA, 17 bp, Homo sapiens
tgcctggcgggcagccc

SEQ ID NO: 2289011 - DNA, 18 bp, Homo sapiens
tgcctggcgggcagcccc

SEQ ID NO: 2289012 - DNA, 20 bp, Homo sapiens
tgcctggcgggcagcccctg

SEQ ID NO: 2289013 - DNA, 22 bp, Homo sapiens
tgcctggcgggcagcccctgct

SEQ ID NO: 2289014 - DNA, 23 bp, Homo sapiens
tgcctgtgaccggggtcctgagg

SEQ ID NO: 2289015 - DNA, 14 bp, Homo sapiens
tgccttacacaaag

SEQ ID NO: 2289016 - DNA, 23 bp, Homo sapiens
tgccttcaaaaatgtgctgccta

SEQ ID NO: 2289017 - DNA, 23 bp, Homo sapiens
tgccttccaggcgtagggccagg

SEQ ID NO: 2289018 - DNA, 18 bp, Homo sapiens
tgcctttagcgtgtaaat

SEQ ID NO: 2289019 - DNA, 14 bp, Homo sapiens
tgcctttggttccc

SEQ ID NO: 2289020 - DNA, 23 bp, Homo sapiens
tgcgcaaagggcgggcctgtttg

SEQ ID NO: 2289021 - DNA, 23 bp, Homo sapiens
tgcgcaggccctccgcgggggac

SEQ ID NO: 2289022 - DNA, 16 bp, Homo sapiens
tgcgccccccagtgga

SEQ ID NO: 2289023 - DNA, 14 bp, Homo sapiens
tgcgcctgcccgcc

SEQ ID NO: 2289024 - DNA, 18 bp, Homo sapiens
tgcgcctgcccgcccgcc

SEQ ID NO: 2289025 - DNA, 14 bp, Homo sapiens
tgcgctcctctgca

SEQ ID NO: 2289026 - DNA, 15 bp, Homo sapiens
tgcgctcctctgcag

SEQ ID NO: 2289027 - DNA, 19 bp, Homo sapiens
tgcgctcctctgcagcctg

SEQ ID NO: 2289028 - DNA, 20 bp, Homo sapiens
tgcgctcctctgcagcctga

SEQ ID NO: 2289029 - DNA, 20 bp, Homo sapiens
tgcggcaccgcccacccaca

SEQ ID NO: 2289030 - DNA, 23 bp, Homo sapiens
tgcggcccgtgcgcagccgcgct

SEQ ID NO: 2289031 - DNA, 22 bp, Homo sapiens
tgcgtgaccggcccgccacctt

SEQ ID NO: 2289032 - DNA, 13 bp, Homo sapiens
tgcgtggcctggg

SEQ ID NO: 2289033 - DNA, 15 bp, Homo sapiens
tgcgtgttctcagag

SEQ ID NO: 2289034 - DNA, 23 bp, Homo sapiens
tgctaacctcaatttatgttaac

SEQ ID NO: 2289035 - DNA, 17 bp, Homo sapiens
tgctaagtggaagacag

SEQ ID NO: 2289036 - DNA, 19 bp, Homo sapiens
tgctaataccaactatttc

SEQ ID NO: 2289037 - DNA, 21 bp, Homo sapiens
tgctaataccaactatttcaa

SEQ ID NO: 2289038 - DNA, 19 bp, Homo sapiens
tgctaatgggctgctgtca

SEQ ID NO: 2289039 - DNA, 14 bp, Homo sapiens
tgctacctggtttt

SEQ ID NO: 2289040 - DNA, 17 bp, Homo sapiens
tgctacctggttttcat

SEQ ID NO: 2289041 - DNA, 22 bp, Homo sapiens
tgctacctggttttcattattt

SEQ ID NO: 2289042 - DNA, 16 bp, Homo sapiens
tgctactgccaacctc

SEQ ID NO: 2289043 - DNA, 20 bp, Homo sapiens
tgactccagaatttcccaaa

SEQ ID NO: 2289044 - DNA, 15 bp, Homo sapiens
tgactctccagggag

SEQ ID NO: 2289045 - DNA, 23 bp, Homo sapiens
tgactctggaaccatcctctgtt

SEQ ID NO: 2289046 - DNA, 14 bp, Homo sapiens
tgactgaagggact

SEQ ID NO: 2289047 - DNA, 12 bp, Homo sapiens
tgactgaatgca

SEQ ID NO: 2289048 - DNA, 13 bp, Homo sapiens
tgactggaaacaa

SEQ ID NO: 2289049 - DNA, 15 bp, Homo sapiens
tgagaaaaaaacagc

SEQ ID NO: 2289050 - DNA, 20 bp, Homo sapiens
tgagaaatcatgttgttcga

SEQ ID NO: 2289051 - DNA, 20 bp, Homo sapiens
tgagaaattacaggttcctt

SEQ ID NO: 2289052 - DNA, 17 bp, Homo sapiens
tgagaaattgtgccaaa

SEQ ID NO: 2289053 - DNA, 18 bp, Homo sapiens
tgagaaattgtgccaaag

SEQ ID NO: 2289054 - DNA, 21 bp, Homo sapiens
tgagaagaagcacgaagcagt

SEQ ID NO: 2289055 - DNA, 17 bp, Homo sapiens
tgagaagactagcagct

SEQ ID NO: 2289056 - DNA, 13 bp, Homo sapiens
tgagaagataaaa

SEQ ID NO: 2289057 - DNA, 19 bp, Homo sapiens
tgagacctcccccagggag

SEQ ID NO: 2289058 - DNA, 20 bp, Homo sapiens
tgagactcgcgacaatgcaa

SEQ ID NO: 2289059 - DNA, 21 bp, Homo sapiens
tgagactcgcgacaatgcaaa

SEQ ID NO: 2289060 - DNA, 22 bp, Homo sapiens
tgagactcgcgacaatgcaaac

SEQ ID NO: 2289061 - DNA, 21 bp, Homo sapiens
tgagactttccgactgctttt

SEQ ID NO: 2289062 - DNA, 13 bp, Homo sapiens
tgagagagaaaag

SEQ ID NO: 2289063 - DNA, 10 bp, Homo sapiens
tgagaggaaa

SEQ ID NO: 2289064 - DNA, 17 bp, Homo sapiens
tgagagtagagtcactg

SEQ ID NO: 2289065 - DNA, 20 bp, Homo sapiens
tgagataagtaggctggttt

SEQ ID NO: 2289066 - DNA, 13 bp, Homo sapiens
tgagatacatttg

SEQ ID NO: 2289067 - DNA, 21 bp, Homo sapiens
tgagatacatttgatcttgta

SEQ ID NO: 2289068 - DNA, 21 bp, Homo sapiens
tgagatactttttcttttgta

SEQ ID NO: 2289069 - DNA, 23 bp, Homo sapiens
tgagatactttttcttttgtaag

SEQ ID NO: 2289070 - DNA, 16 bp, Homo sapiens
tgagatcagcattcaa

SEQ ID NO: 2289071 - DNA, 18 bp, Homo sapiens
tgagatcagcattcaaaa

SEQ ID NO: 2289072 - DNA, 21 bp, Homo sapiens
tgagattccagaacgccctgt

SEQ ID NO: 2289073 - DNA, 14 bp, Homo sapiens
tgagatttgtattt

SEQ ID NO: 2289074 - DNA, 15 bp, Homo sapiens
tgagcaagtcccatc

SEQ ID NO: 2289075 - DNA, 13 bp, Homo sapiens
tgagcaatgtttt

SEQ ID NO: 2289076 - DNA, 14 bp, Homo sapiens
tgagcaatgttttt

SEQ ID NO: 2289077 - DNA, 15 bp, Homo sapiens
tgagcagtggggagc

SEQ ID NO: 2289078 - DNA, 12 bp, Homo sapiens
tgagccacagca

SEQ ID NO: 2289079 - DNA, 16 bp, Homo sapiens
tgagccacagcactcg

SEQ ID NO: 2289080 - DNA, 21 bp, Homo sapiens
tgagccagatttcactctcct

SEQ ID NO: 2289081 - DNA, 12 bp, Homo sapiens
tgagcccctcct

SEQ ID NO: 2289082 - DNA, 15 bp, Homo sapiens
tgagcccctcctctc

SEQ ID NO: 2289083 - DNA, 15 bp, Homo sapiens
tgagctaccaggaag

SEQ ID NO: 2289084 - DNA, 19 bp, Homo sapiens
tgagctaccaggaagaggg

SEQ ID NO: 2289085 - DNA, 14 bp, Homo sapiens
tgagctccaccctc

SEQ ID NO: 2289086 - DNA, 15 bp, Homo sapiens
tgagctccaccctcc

SEQ ID NO: 2289087 - DNA, 17 bp, Homo sapiens
tgagctctctaatagaa

SEQ ID NO: 2289088 - DNA, 19 bp, Homo sapiens
tgagctctctaatagaagt

SEQ ID NO: 2289089 - DNA, 15 bp, Homo sapiens
tgagctcttggcagg

SEQ ID NO: 2289090 - DNA, 17 bp, Homo sapiens
tgagcttttaccactag

SEQ ID NO: 2289091 - DNA, 16 bp, Homo sapiens
tgaggaacctcaaact

SEQ ID NO: 2289092 - DNA, 18 bp, Homo sapiens
tgaggaacctcaaactgg

SEQ ID NO: 2289093 - DNA, 13 bp, Homo sapiens
tgaggacagacag

SEQ ID NO: 2289094 - DNA, 17 bp, Homo sapiens
tgaggacagacagaagg

SEQ ID NO: 2289095 - DNA, 17 bp, Homo sapiens
tgaggacctccacctgg

SEQ ID NO: 2289096 - DNA, 20 bp, Homo sapiens
tgaggacctccacctgggag

SEQ ID NO: 2289097 - DNA, 18 bp, Homo sapiens
tgaggaggggagcaaggc

SEQ ID NO: 2289098 - DNA, 15 bp, Homo sapiens
tgaggaggggcggga

SEQ ID NO: 2289099 - DNA, 20 bp, Homo sapiens
tgaggcagggtctcactctg

SEQ ID NO: 2289100 - DNA, 22 bp, Homo sapiens
tgaggcagggtctcactctgtt

SEQ ID NO: 2289101 - DNA, 23 bp, Homo sapiens
tgaggcagggtctcactctgttg

SEQ ID NO: 2289102 - DNA, 17 bp, Homo sapiens
tgagggaagagtagctg

SEQ ID NO: 2289103 - DNA, 21 bp, Homo sapiens
tgagggaagcccacccgcccc

SEQ ID NO: 2289104 - DNA, 13 bp, Homo sapiens
tgaggtcatcccg

SEQ ID NO: 2289105 - DNA, 23 bp, Homo sapiens
tgaggtcatcccggggccatgga

SEQ ID NO: 2289106 - DNA, 12 bp, Homo sapiens
tgaggtgggggc

SEQ ID NO: 2289107 - DNA, 22 bp, Homo sapiens
tgaggtgggggcagcggccccg

SEQ ID NO: 2289108 - DNA, 21 bp, Homo sapiens
tgaggttatgagaaaaaaaca

SEQ ID NO: 2289109 - DNA, 23 bp, Homo sapiens
tgagtaatattacatttcattta

SEQ ID NO: 2289110 - DNA, 17 bp, Homo sapiens
tgagtcatgtctttcct

SEQ ID NO: 2289111 - DNA, 16 bp, Homo sapiens
tgagtcggctgggcag

SEQ ID NO: 2289112 - DNA, 21 bp, Homo sapiens
tgagtcggctgggcagggccg

SEQ ID NO: 2289113 - DNA, 16 bp, Homo sapiens
tgagtgccttacacaa

SEQ ID NO: 2289114 - DNA, 15 bp, Homo sapiens
tgagtggacagcagc

SEQ ID NO: 2289115 - DNA, 21 bp, Homo sapiens
tgagtggacagcagctggact

SEQ ID NO: 2289116 - DNA, 22 bp, Homo sapiens
tgagtggacagcagctggactg

SEQ ID NO: 2289117 - DNA, 18 bp, Homo sapiens
tgagtggtccacattctg

SEQ ID NO: 2289118 - DNA, 12 bp, Homo sapiens
tgagtttatggg

SEQ ID NO: 2289119 - DNA, 20 bp, Homo sapiens
tgataagaaccttttgagtg

SEQ ID NO: 2289120 - DNA, 11 bp, Homo sapiens
tgatacaaaga

SEQ ID NO: 2289121 - DNA, 19 bp, Homo sapiens
tgatacactgtatctaaaa

SEQ ID NO: 2289122 - DNA, 18 bp, Homo sapiens
tgatacttttattgttat

SEQ ID NO: 2289123 - DNA, 22 bp, Homo sapiens
tgatagaactttgatggatttt

SEQ ID NO: 2289124 - DNA, 17 bp, Homo sapiens
tgatagagtttaacaga

SEQ ID NO: 2289125 - DNA, 21 bp, Homo sapiens
tgatataataattacttaatg

SEQ ID NO: 2289126 - DNA, 15 bp, Homo sapiens
tgatataattactta

SEQ ID NO: 2289127 - DNA, 17 bp, Homo sapiens
tgatatacagacctcca

SEQ ID NO: 2289128 - DNA, 17 bp, Homo sapiens
tgatataggaaaataca

SEQ ID NO: 2289129 - DNA, 18 bp, Homo sapiens
tgatataggaaaatacat

SEQ ID NO: 2289130 - DNA, 20 bp, Homo sapiens
tgatataggaaaatacattg

SEQ ID NO: 2289131 - DNA, 21 bp, Homo sapiens
tgatatggttcttattcactg

SEQ ID NO: 2289132 - DNA, 16 bp, Homo sapiens
tgatcacaacttttct

SEQ ID NO: 2289133 - DNA, 18 bp, Homo sapiens
tgatcagacattcagaga

SEQ ID NO: 2289134 - DNA, 19 bp, Homo sapiens
tgatcagacttgatttaca

SEQ ID NO: 2289135 - DNA, 19 bp, Homo sapiens
tgatcagatcttacaagtt

SEQ ID NO: 2289136 - DNA, 21 bp, Homo sapiens
tgatcagttgctctctgttca

SEQ ID NO: 2289137 - DNA, 23 bp, Homo sapiens
tgatcccagctcactgcagcctc

SEQ ID NO: 2289138 - DNA, 19 bp, Homo sapiens
tgatcctcccgccccagcc

SEQ ID NO: 2289139 - DNA, 18 bp, Homo sapiens
tgatctaagcagttgcaa

SEQ ID NO: 2289140 - DNA, 19 bp, Homo sapiens
tgatctaagcagttgcaat

SEQ ID NO: 2289141 - DNA, 18 bp, Homo sapiens
tgatctgaatctgtttct

SEQ ID NO: 2289142 - DNA, 15 bp, Homo sapiens
tgatctgtcttgtaa

SEQ ID NO: 2289143 - DNA, 18 bp, Homo sapiens
tgatgaccaatctctgtg

SEQ ID NO: 2289144 - DNA, 19 bp, Homo sapiens
tgatgaccaatctctgtga

SEQ ID NO: 2289145 - DNA, 15 bp, Homo sapiens
tgatgactcttctta

SEQ ID NO: 2289146 - DNA, 18 bp, Homo sapiens
tgatgactcttcttatca

SEQ ID NO: 2289147 - DNA, 14 bp, Homo sapiens
tgatgagaggaaat

SEQ ID NO: 2289148 - DNA, 14 bp, Homo sapiens
tgatgccatgagga

SEQ ID NO: 2289149 - DNA, 16 bp, Homo sapiens
tgatggatgagaaaaa

SEQ ID NO: 2289150 - DNA, 13 bp, Homo sapiens
tgatggcagagga

SEQ ID NO: 2289151 - DNA, 22 bp, Homo sapiens
tgatgggcaaggggccaggaag

SEQ ID NO: 2289152 - DNA, 16 bp, Homo sapiens
tgatgggtcctgctgc

SEQ ID NO: 2289153 - DNA, 13 bp, Homo sapiens
tgatggtgcaatg

SEQ ID NO: 2289154 - DNA, 22 bp, Homo sapiens
tgatgtatagctttaacatttt

SEQ ID NO: 2289155 - DNA, 13 bp, Homo sapiens
tgattattgaatg

SEQ ID NO: 2289156 - DNA, 23 bp, Homo sapiens
tgattattttcctggagtgaaga

SEQ ID NO: 2289157 - DNA, 11 bp, Homo sapiens
tgattcaatgt

SEQ ID NO: 2289158 - DNA, 12 bp, Homo sapiens
tgattcaatgtg

SEQ ID NO: 2289159 - DNA, 15 bp, Homo sapiens
tgattcaatgtgaat

SEQ ID NO: 2289160 - DNA, 15 bp, Homo sapiens
tgattcataatgact

SEQ ID NO: 2289161 - DNA, 17 bp, Homo sapiens
tgattccaagggcccag

SEQ ID NO: 2289162 - DNA, 17 bp, Homo sapiens
tgattccccggagctgg

SEQ ID NO: 2289163 - DNA, 15 bp, Homo sapiens
tgatttaagcatttt

SEQ ID NO: 2289164 - DNA, 18 bp, Homo sapiens
tgatttaagcattttact

SEQ ID NO: 2289165 - DNA, 20 bp, Homo sapiens
tgatttacaagcatcatgga

SEQ ID NO: 2289166 - DNA, 15 bp, Homo sapiens
tgatttcaatgattg

SEQ ID NO: 2289167 - DNA, 19 bp, Homo sapiens
tgatttctttccttcccaa

SEQ ID NO: 2289168 - DNA, 14 bp, Homo sapiens
tgatttgatataca

SEQ ID NO: 2289169 - DNA, 16 bp, Homo sapiens
tgattttagatttctt

SEQ ID NO: 2289170 - DNA, 19 bp, Homo sapiens
tgatttttttttccttcag

SEQ ID NO: 2289171 - DNA, 20 bp, Homo sapiens
tgatttttttttccttcagt

SEQ ID NO: 2289172 - DNA, 23 bp, Homo sapiens
tgatttttttttccttcagtgcc

SEQ ID NO: 2289173 - DNA, 19 bp, Homo sapiens
tgcaaaaaaaaaaatgtca

SEQ ID NO: 2289174 - DNA, 21 bp, Homo sapiens
tgcaaaaaaaaaaatgtcaag

SEQ ID NO: 2289175 - DNA, 12 bp, Homo sapiens
tgcaaaaagata

SEQ ID NO: 2289176 - DNA, 15 bp, Homo sapiens
tgcaaacactgtgta

SEQ ID NO: 2289177 - DNA, 19 bp, Homo sapiens
tgcaaatagtttcaaatga

SEQ ID NO: 2289178 - DNA, 15 bp, Homo sapiens
tgcaaatgaatgcct

SEQ ID NO: 2289179 - DNA, 13 bp, Homo sapiens
tcttgattcataa

SEQ ID NO: 2289180 - DNA, 12 bp, Homo sapiens
tcttgcttgtac

SEQ ID NO: 2289181 - DNA, 15 bp, Homo sapiens
tcttgcttgtacctc

SEQ ID NO: 2289182 - DNA, 17 bp, Homo sapiens
tcttgcttgtacctctg

SEQ ID NO: 2289183 - DNA, 22 bp, Homo sapiens
tcttgcttgtacctctggctga

SEQ ID NO: 2289184 - DNA, 13 bp, Homo sapiens
tcttgctttcaca

SEQ ID NO: 2289185 - DNA, 14 bp, Homo sapiens
tcttgctttcacaa

SEQ ID NO: 2289186 - DNA, 17 bp, Homo sapiens
tcttgctttgaatgcat

SEQ ID NO: 2289187 - DNA, 14 bp, Homo sapiens
tcttggcctgctag

SEQ ID NO: 2289188 - DNA, 20 bp, Homo sapiens
tcttgtaaaaatagcaaaat

SEQ ID NO: 2289189 - DNA, 17 bp, Homo sapiens
tcttgtaatattttgta

SEQ ID NO: 2289190 - DNA, 16 bp, Homo sapiens
tcttgtgtgtttattg

SEQ ID NO: 2289191 - DNA, 20 bp, Homo sapiens
tcttgtgttgttttctctga

SEQ ID NO: 2289192 - DNA, 13 bp, Homo sapiens
tcttgtttctcca

SEQ ID NO: 2289193 - DNA, 17 bp, Homo sapiens
tctttaacatacatcta

SEQ ID NO: 2289194 - DNA, 19 bp, Homo sapiens
tctttactgggtctaaagg

SEQ ID NO: 2289195 - DNA, 16 bp, Homo sapiens
tctttcagccaagaat

SEQ ID NO: 2289196 - DNA, 20 bp, Homo sapiens
tctttcagccaagaattctt

SEQ ID NO: 2289197 - DNA, 18 bp, Homo sapiens
tctttccatctcattaca

SEQ ID NO: 2289198 - DNA, 14 bp, Homo sapiens
tctttccccactga

SEQ ID NO: 2289199 - DNA, 16 bp, Homo sapiens
tctttccccactgaag

SEQ ID NO: 2289200 - DNA, 14 bp, Homo sapiens
tctttccttcccaa

SEQ ID NO: 2289201 - DNA, 12 bp, Homo sapiens
tctttctatgta

SEQ ID NO: 2289202 - DNA, 12 bp, Homo sapiens
tctttgcagtga

SEQ ID NO: 2289203 - DNA, 13 bp, Homo sapiens
tctttgcagtgaa

SEQ ID NO: 2289204 - DNA, 17 bp, Homo sapiens
tctttggggtctacact

SEQ ID NO: 2289205 - DNA, 12 bp, Homo sapiens
tcttttatataa

SEQ ID NO: 2289206 - DNA, 13 bp, Homo sapiens
tcttttatataac

SEQ ID NO: 2289207 - DNA, 15 bp, Homo sapiens
tcttttatataacta

SEQ ID NO: 2289208 - DNA, 17 bp, Homo sapiens
tcttttatatctgtaaa

SEQ ID NO: 2289209 - DNA, 16 bp, Homo sapiens
tcttttcagcttgttt

SEQ ID NO: 2289210 - DNA, 14 bp, Homo sapiens
tcttttctgaggtt

SEQ ID NO: 2289211 - DNA, 21 bp, Homo sapiens
tctttttaaaaagttgcacat

SEQ ID NO: 2289212 - DNA, 14 bp, Homo sapiens
tcttttttcaatgt

SEQ ID NO: 2289213 - DNA, 20 bp, Homo sapiens
tcttttttcaatgtactgta

SEQ ID NO: 2289214 - DNA, 15 bp, Homo sapiens
tgaaaaagaatgaaa

SEQ ID NO: 2289215 - DNA, 20 bp, Homo sapiens
tgaaaaatctagtatttgta

SEQ ID NO: 2289216 - DNA, 17 bp, Homo sapiens
tgaaaactgatttccca

SEQ ID NO: 2289217 - DNA, 12 bp, Homo sapiens
tgaaaagaagaa

SEQ ID NO: 2289218 - DNA, 21 bp, Homo sapiens
tgaaaagaagaaagtctatgc

SEQ ID NO: 2289219 - DNA, 20 bp, Homo sapiens
tgaaaatactggaattcaaa

SEQ ID NO: 2289220 - DNA, 16 bp, Homo sapiens
tgaaaatatcggggag

SEQ ID NO: 2289221 - DNA, 21 bp, Homo sapiens
tgaaaatatttttttctagct

SEQ ID NO: 2289222 - DNA, 22 bp, Homo sapiens
tgaaaatatttttttctagcta

SEQ ID NO: 2289223 - DNA, 22 bp, Homo sapiens
tgaaactggttttaagtgcttt

SEQ ID NO: 2289224 - DNA, 22 bp, Homo sapiens
tgaaagaagtcaaatgaatgag

SEQ ID NO: 2289225 - DNA, 11 bp, Homo sapiens
tgaaagagaaa

SEQ ID NO: 2289226 - DNA, 14 bp, Homo sapiens
tgaaagagaaaatg

SEQ ID NO: 2289227 - DNA, 21 bp, Homo sapiens
tgaaagagaaaatgctttctc

SEQ ID NO: 2289228 - DNA, 20 bp, Homo sapiens
tgaaagcctagtccagaaat

SEQ ID NO: 2289229 - DNA, 15 bp, Homo sapiens
tgaaagtttccttat

SEQ ID NO: 2289230 - DNA, 18 bp, Homo sapiens
tgaaataaagagttctcc

SEQ ID NO: 2289231 - DNA, 18 bp, Homo sapiens
tgaaatatttgcttattt

SEQ ID NO: 2289232 - DNA, 15 bp, Homo sapiens
tgaaatccaaaatag

SEQ ID NO: 2289233 - DNA, 13 bp, Homo sapiens
tgaaatctacaac

SEQ ID NO: 2289234 - DNA, 20 bp, Homo sapiens
tgaaatctacaacataatga

SEQ ID NO: 2289235 - DNA, 15 bp, Homo sapiens
tgaaattagccaggg

SEQ ID NO: 2289236 - DNA, 15 bp, Homo sapiens
tgaaattctcagaat

SEQ ID NO: 2289237 - DNA, 22 bp, Homo sapiens
tgaaatttaaaaatctttcaga

SEQ ID NO: 2289238 - DNA, 14 bp, Homo sapiens
tgaaatttgctata

SEQ ID NO: 2289239 - DNA, 14 bp, Homo sapiens
tgaacaaaatctgt

SEQ ID NO: 2289240 - DNA, 14 bp, Homo sapiens
tgaacaagaaattg

SEQ ID NO: 2289241 - DNA, 20 bp, Homo sapiens
tgaacaagccacgttgcaga

SEQ ID NO: 2289242 - DNA, 23 bp, Homo sapiens
tgaacaccactttgtctctgaga

SEQ ID NO: 2289243 - DNA, 18 bp, Homo sapiens
tgaacagttctcccttca

SEQ ID NO: 2289244 - DNA, 24 bp, Homo sapiens
tgaacagttggctgtatgactgaa

SEQ ID NO: 2289245 - DNA, 18 bp, Homo sapiens
tgaaccgtcaatgtgaaa

SEQ ID NO: 2289246 - DNA, 22 bp, Homo sapiens
tgaaccgtcaatgtgaaataaa

SEQ ID NO: 2289247 - DNA, 18 bp, Homo sapiens
tgaactagagactctgtg

SEQ ID NO: 2289248 - DNA, 16 bp, Homo sapiens
tgaactcaatgcatga

SEQ ID NO: 2289249 - DNA, 18 bp, Homo sapiens
tgaactcaatgcatgatg

SEQ ID NO: 2289250 - DNA, 15 bp, Homo sapiens
tgaactcttggcctc

SEQ ID NO: 2289251 - DNA, 23 bp, Homo sapiens
tgaactgcaggataaaatggtac

SEQ ID NO: 2289252 - DNA, 16 bp, Homo sapiens
tgaactgtggccacct

SEQ ID NO: 2289253 - DNA, 14 bp, Homo sapiens
tgaacttggctttc

SEQ ID NO: 2289254 - DNA, 12 bp, Homo sapiens
tgaagaaaaaat

SEQ ID NO: 2289255 - DNA, 22 bp, Homo sapiens
tgaagaaaaaattttaaaaatc

SEQ ID NO: 2289256 - DNA, 15 bp, Homo sapiens
tgaagaagggaaatt

SEQ ID NO: 2289257 - DNA, 11 bp, Homo sapiens
tgaagaatatt

SEQ ID NO: 2289258 - DNA, 13 bp, Homo sapiens
tgaagataaatgc

SEQ ID NO: 2289259 - DNA, 14 bp, Homo sapiens
tgaagataaatgct

SEQ ID NO: 2289260 - DNA, 19 bp, Homo sapiens
tgaagataaatgctttaaa

SEQ ID NO: 2289261 - DNA, 20 bp, Homo sapiens
tgaagataaatgctttaaat

SEQ ID NO: 2289262 - DNA, 13 bp, Homo sapiens
tgaagatgtgtaa

SEQ ID NO: 2289263 - DNA, 18 bp, Homo sapiens
tgaagatgtttttagagg

SEQ ID NO: 2289264 - DNA, 15 bp, Homo sapiens
tgaagcatccaggca

SEQ ID NO: 2289265 - DNA, 18 bp, Homo sapiens
tgaaggatgggggctcct

SEQ ID NO: 2289266 - DNA, 21 bp, Homo sapiens
tgaaggatgggggctcctggc

SEQ ID NO: 2289267 - DNA, 18 bp, Homo sapiens
tgaagggaggggaagaga

SEQ ID NO: 2289268 - DNA, 17 bp, Homo sapiens
tgaagtaagttctgaaa

SEQ ID NO: 2289269 - DNA, 14 bp, Homo sapiens
tgaagtaataactg

SEQ ID NO: 2289270 - DNA, 18 bp, Homo sapiens
tgaagtatacatttagtt

SEQ ID NO: 2289271 - DNA, 20 bp, Homo sapiens
tgaagtccacttatgtagac

SEQ ID NO: 2289272 - DNA, 20 bp, Homo sapiens
tgaagtctccttttgtctga

SEQ ID NO: 2289273 - DNA, 18 bp, Homo sapiens
tgaagtctgcttaccaaa

SEQ ID NO: 2289274 - DNA, 22 bp, Homo sapiens
tgaagtctgcttaccaaaacat

SEQ ID NO: 2289275 - DNA, 14 bp, Homo sapiens
tgaagtcttgtata

SEQ ID NO: 2289276 - DNA, 20 bp, Homo sapiens
tgaataaaattgttatttca

SEQ ID NO: 2289277 - DNA, 17 bp, Homo sapiens
tgaatatatttttaaag

SEQ ID NO: 2289278 - DNA, 21 bp, Homo sapiens
tgaatatatttttaaagcaaa

SEQ ID NO: 2289279 - DNA, 18 bp, Homo sapiens
tgaatcaaagacatttca

SEQ ID NO: 2289280 - DNA, 22 bp, Homo sapiens
tgaatcaaagacatttcatcca

SEQ ID NO: 2289281 - DNA, 23 bp, Homo sapiens
tgaatgtattcttttatataact

SEQ ID NO: 2289282 - DNA, 22 bp, Homo sapiens
tgaatgtccccattctataaat

SEQ ID NO: 2289283 - DNA, 16 bp, Homo sapiens
tgaatgttatatcatc

SEQ ID NO: 2289284 - DNA, 19 bp, Homo sapiens
tgaattcataaaaataacc

SEQ ID NO: 2289285 - DNA, 19 bp, Homo sapiens
tgaattcttttcctctctt

SEQ ID NO: 2289286 - DNA, 13 bp, Homo sapiens
tgaattgtaagga

SEQ ID NO: 2289287 - DNA, 20 bp, Homo sapiens
tgaattgttatgtaaacatc

SEQ ID NO: 2289288 - DNA, 18 bp, Homo sapiens
tgaattttaaaatgcaaa

SEQ ID NO: 2289289 - DNA, 17 bp, Homo sapiens
tgacacaatggtagctc

SEQ ID NO: 2289290 - DNA, 18 bp, Homo sapiens
tgacacaatggtagctct

SEQ ID NO: 2289291 - DNA, 22 bp, Homo sapiens
tgacacaatggtagctctgaag

SEQ ID NO: 2289292 - DNA, 15 bp, Homo sapiens
tgacacataaatctg

SEQ ID NO: 2289293 - DNA, 23 bp, Homo sapiens
tgacagagcaagcgaaagagcaa

SEQ ID NO: 2289294 - DNA, 20 bp, Homo sapiens
tgacagagccatatgtaccc

SEQ ID NO: 2289295 - DNA, 13 bp, Homo sapiens
tgacatgttttat

SEQ ID NO: 2289296 - DNA, 16 bp, Homo sapiens
tgaccaatctctgtga

SEQ ID NO: 2289297 - DNA, 13 bp, Homo sapiens
tgaccaggccctg

SEQ ID NO: 2289298 - DNA, 19 bp, Homo sapiens
tgaccaggctggagtgaag

SEQ ID NO: 2289299 - DNA, 14 bp, Homo sapiens
tgaccagtcaaggg

SEQ ID NO: 2289300 - DNA, 18 bp, Homo sapiens
tgaccatcatttcccagg

SEQ ID NO: 2289301 - DNA, 14 bp, Homo sapiens
tgaccccacacgcc

SEQ ID NO: 2289302 - DNA, 19 bp, Homo sapiens
tgaccccacacgccggggc

SEQ ID NO: 2289303 - DNA, 18 bp, Homo sapiens
tgaccctggagcccggca

SEQ ID NO: 2289304 - DNA, 21 bp, Homo sapiens
tgaccggcccgccaccttgta

SEQ ID NO: 2289305 - DNA, 20 bp, Homo sapiens
tgaccggggtcctgaggctg

SEQ ID NO: 2289306 - DNA, 18 bp, Homo sapiens
tgacctaaatccattttc

SEQ ID NO: 2289307 - DNA, 21 bp, Homo sapiens
tgacctctcacttttttataa

SEQ ID NO: 2289308 - DNA, 12 bp, Homo sapiens
tgacctgacacc

SEQ ID NO: 2289309 - DNA, 12 bp, Homo sapiens
tgacctttcaat

SEQ ID NO: 2289310 - DNA, 13 bp, Homo sapiens
tgacctttcaata

SEQ ID NO: 2289311 - DNA, 15 bp, Homo sapiens
tgacctttcaatagg

SEQ ID NO: 2289312 - DNA, 21 bp, Homo sapiens
tgacgacctacatctgaaatc

SEQ ID NO: 2289313 - DNA, 16 bp, Homo sapiens
tgactaaatttgggga

SEQ ID NO: 2289314 - DNA, 17 bp, Homo sapiens
tgactatttacagtagt

SEQ ID NO: 2289315 - DNA, 17 bp, Homo sapiens
tgactccagaatttccc

SEQ ID NO: 2289316 - DNA, 16 bp, Homo sapiens
ttgagtgtgcaatatg

SEQ ID NO: 2289317 - DNA, 23 bp, Homo sapiens
ttgataatagtaatggttctaga

SEQ ID NO: 2289318 - DNA, 17 bp, Homo sapiens
ttgatagatgcaagaga

SEQ ID NO: 2289319 - DNA, 14 bp, Homo sapiens
ttgatataataatt

SEQ ID NO: 2289320 - DNA, 18 bp, Homo sapiens
ttgatataataattactt

SEQ ID NO: 2289321 - DNA, 14 bp, Homo sapiens
ttgatataattact

SEQ ID NO: 2289322 - DNA, 13 bp, Homo sapiens
ttgatatacagac

SEQ ID NO: 2289323 - DNA, 14 bp, Homo sapiens
ttgatcacactatt

SEQ ID NO: 2289324 - DNA, 17 bp, Homo sapiens
ttgatcttgtaaaaata

SEQ ID NO: 2289325 - DNA, 18 bp, Homo sapiens
ttgatcttgtaaaaatag

SEQ ID NO: 2289326 - DNA, 19 bp, Homo sapiens
ttgatgaccaatctctgtg

SEQ ID NO: 2289327 - DNA, 19 bp, Homo sapiens
ttgatgagaatcctgacca

SEQ ID NO: 2289328 - DNA, 13 bp, Homo sapiens
ttgattcataatg

SEQ ID NO: 2289329 - DNA, 13 bp, Homo sapiens
ttgcacttctgtt

SEQ ID NO: 2289330 - DNA, 13 bp, Homo sapiens
ttgcagaaaaaga

SEQ ID NO: 2289331 - DNA, 23 bp, Homo sapiens
ttgcaggtaagtctggttttgtc

SEQ ID NO: 2289332 - DNA, 16 bp, Homo sapiens
ttgcagtatcagaggg

SEQ ID NO: 2289333 - DNA, 17 bp, Homo sapiens
ttgcattccagcgtctg

SEQ ID NO: 2289334 - DNA, 19 bp, Homo sapiens
ttgcatttctcttcctaaa

SEQ ID NO: 2289335 - DNA, 19 bp, Homo sapiens
ttgcccacacctgcctctg

SEQ ID NO: 2289336 - DNA, 14 bp, Homo sapiens
ttgcctctgtctta

SEQ ID NO: 2289337 - DNA, 22 bp, Homo sapiens
ttgcctgcctggaaacagcctg

SEQ ID NO: 2289338 - DNA, 23 bp, Homo sapiens
ttgccttcaaaaatgtgctgcct

SEQ ID NO: 2289339 - DNA, 13 bp, Homo sapiens
ttgcgctctgggt

SEQ ID NO: 2289340 - DNA, 20 bp, Homo sapiens
ttgctaagtgaggatgaaaa

SEQ ID NO: 2289341 - DNA, 22 bp, Homo sapiens
ttgctaataccaactatttcaa

SEQ ID NO: 2289342 - DNA, 17 bp, Homo sapiens
ttgctatatttgctaat

SEQ ID NO: 2289343 - DNA, 21 bp, Homo sapiens
ttgctcaccaagctgttccac

SEQ ID NO: 2289344 - DNA, 16 bp, Homo sapiens
ttgctctctgttcaag

SEQ ID NO: 2289345 - DNA, 12 bp, Homo sapiens
ttgctgaaacac

SEQ ID NO: 2289346 - DNA, 15 bp, Homo sapiens
ttgctgacagagccc

SEQ ID NO: 2289347 - DNA, 16 bp, Homo sapiens
ttgctgacagagccct

SEQ ID NO: 2289348 - DNA, 17 bp, Homo sapiens
ttgctgatggtgcaatg

SEQ ID NO: 2289349 - DNA, 19 bp, Homo sapiens
ttgctgatggtgcaatgac

SEQ ID NO: 2289350 - DNA, 17 bp, Homo sapiens
ttgctgggccttttgtt

SEQ ID NO: 2289351 - DNA, 16 bp, Homo sapiens
ttgctgtcccttttcc

SEQ ID NO: 2289352 - DNA, 18 bp, Homo sapiens
ttgctgtcccttttcctt

SEQ ID NO: 2289353 - DNA, 14 bp, Homo sapiens
ttgctgttgcttga

SEQ ID NO: 2289354 - DNA, 15 bp, Homo sapiens
ttgcttaagatgcta

SEQ ID NO: 2289355 - DNA, 16 bp, Homo sapiens
ttgcttatttatattc

SEQ ID NO: 2289356 - DNA, 15 bp, Homo sapiens
ttgcttcatctggag

SEQ ID NO: 2289357 - DNA, 17 bp, Homo sapiens
ttgcttcttcaccagtt

SEQ ID NO: 2289358 - DNA, 17 bp, Homo sapiens
ttgctttttaaactgat

SEQ ID NO: 2289359 - DNA, 19 bp, Homo sapiens
ttgctttttaaactgatgt

SEQ ID NO: 2289360 - DNA, 21 bp, Homo sapiens
ttgctttttaaactgatgtat

SEQ ID NO: 2289361 - DNA, 23 bp, Homo sapiens
ttggaacagacctcactgctttg

SEQ ID NO: 2289362 - DNA, 20 bp, Homo sapiens
ttggaatgttgttaaatgct

SEQ ID NO: 2289363 - DNA, 22 bp, Homo sapiens
ttggaatgttgttaaatgctat

SEQ ID NO: 2289364 - DNA, 14 bp, Homo sapiens
ttggcacagaacag

SEQ ID NO: 2289365 - DNA, 19 bp, Homo sapiens
ttggcattttggctcagag

SEQ ID NO: 2289366 - DNA, 20 bp, Homo sapiens
ttggcattttggctcagagt

SEQ ID NO: 2289367 - DNA, 13 bp, Homo sapiens
ttggccggctggc

SEQ ID NO: 2289368 - DNA, 14 bp, Homo sapiens
ttggccggctggcc

SEQ ID NO: 2289369 - DNA, 16 bp, Homo sapiens
ttggctaacatagcac

SEQ ID NO: 2289370 - DNA, 13 bp, Homo sapiens
ttggcttatgaaa

SEQ ID NO: 2289371 - DNA, 17 bp, Homo sapiens
ttgggaggtccaaggtc

SEQ ID NO: 2289372 - DNA, 20 bp, Homo sapiens
ttgggcacgggagagcgcca

SEQ ID NO: 2289373 - DNA, 22 bp, Homo sapiens
ttggtaaaggtatgtaaacttt

SEQ ID NO: 2289374 - DNA, 20 bp, Homo sapiens
ttggtatggtaaagagatgt

SEQ ID NO: 2289375 - DNA, 23 bp, Homo sapiens
ttggttacaaatttttactcagg

SEQ ID NO: 2289376 - DNA, 19 bp, Homo sapiens
ttgtaaataatgcttaaca

SEQ ID NO: 2289377 - DNA, 18 bp, Homo sapiens
ttgtaatattttgtatta

SEQ ID NO: 2289378 - DNA, 18 bp, Homo sapiens
ttgtaatgtatcttattt

SEQ ID NO: 2289379 - DNA, 12 bp, Homo sapiens
ttgtacagacaa

SEQ ID NO: 2289380 - DNA, 18 bp, Homo sapiens
ttgtacttacactgaaat

SEQ ID NO: 2289381 - DNA, 14 bp, Homo sapiens
ttgtacttgaataa

SEQ ID NO: 2289382 - DNA, 20 bp, Homo sapiens
ttgtagagacagggtctcac

SEQ ID NO: 2289383 - DNA, 23 bp, Homo sapiens
ttgtagagacagggtctcactgt

SEQ ID NO: 2289384 - DNA, 13 bp, Homo sapiens
ttgtagatatata

SEQ ID NO: 2289385 - DNA, 15 bp, Homo sapiens
ttgtagatatatatt

SEQ ID NO: 2289386 - DNA, 14 bp, Homo sapiens
ttgtagctagaata

SEQ ID NO: 2289387 - DNA, 18 bp, Homo sapiens
ttgtaggactaaataatg

SEQ ID NO: 2289388 - DNA, 22 bp, Homo sapiens
ttgtatcctggcaaataatact

SEQ ID NO: 2289389 - DNA, 22 bp, Homo sapiens
ttgtattattgctgttgcttga

SEQ ID NO: 2289390 - DNA, 22 bp, Homo sapiens
ttgtattttcttcccatttgta

SEQ ID NO: 2289391 - DNA, 13 bp, Homo sapiens
ttgtcactgaata

SEQ ID NO: 2289392 - DNA, 15 bp, Homo sapiens
ttgtcattctgctaa

SEQ ID NO: 2289393 - DNA, 11 bp, Homo sapiens
ttgtctcagat

SEQ ID NO: 2289394 - DNA, 17 bp, Homo sapiens
ttgtctgtcctggtcag

SEQ ID NO: 2289395 - DNA, 16 bp, Homo sapiens
ttgtgagccaaagaga

SEQ ID NO: 2289396 - DNA, 13 bp, Homo sapiens
ttgtgatcctaaa

SEQ ID NO: 2289397 - DNA, 14 bp, Homo sapiens
ttgtgccaaagata

SEQ ID NO: 2289398 - DNA, 19 bp, Homo sapiens
ttgtgccaaagatagcaga

SEQ ID NO: 2289399 - DNA, 20 bp, Homo sapiens
ttgtgcgccggcgccccgga

SEQ ID NO: 2289400 - DNA, 18 bp, Homo sapiens
ttgtgtaagaatcactgc

SEQ ID NO: 2289401 - DNA, 20 bp, Homo sapiens
ttgtgtagattgtgtaaatt

SEQ ID NO: 2289402 - DNA, 23 bp, Homo sapiens
ttgtgttgttttctctgatcaca

SEQ ID NO: 2289403 - DNA, 12 bp, Homo sapiens
ttgttaaatgct

SEQ ID NO: 2289404 - DNA, 17 bp, Homo sapiens
ttgttacaggtgtacta

SEQ ID NO: 2289405 - DNA, 22 bp, Homo sapiens
ttgttatgtaaacatcataaat

SEQ ID NO: 2289406 - DNA, 23 bp, Homo sapiens
ttgttcgatcgtttcacatctgt

SEQ ID NO: 2289407 - DNA, 21 bp, Homo sapiens
ttgttgaatgtattcttttat

SEQ ID NO: 2289408 - DNA, 13 bp, Homo sapiens
ttgtttaattgta

SEQ ID NO: 2289409 - DNA, 14 bp, Homo sapiens
ttgtttaattgtag

SEQ ID NO: 2289410 - DNA, 12 bp, Homo sapiens
ttgtttctatac

SEQ ID NO: 2289411 - DNA, 15 bp, Homo sapiens
ttgtttgtgtccata

SEQ ID NO: 2289412 - DNA, 23 bp, Homo sapiens
tttaaaaaaataacatctgaaaa

SEQ ID NO: 2289413 - DNA, 11 bp, Homo sapiens
tttaaaaatat

SEQ ID NO: 2289414 - DNA, 19 bp, Homo sapiens
tttaaaaatctttcagaat

SEQ ID NO: 2289415 - DNA, 16 bp, Homo sapiens
tttaaaattcatggaa

SEQ ID NO: 2289416 - DNA, 21 bp, Homo sapiens
tttaaactgatgtatagcttt

SEQ ID NO: 2289417 - DNA, 21 bp, Homo sapiens
tttaaagggagccatgctctt

SEQ ID NO: 2289418 - DNA, 16 bp, Homo sapiens
tttaaatcagatacct

SEQ ID NO: 2289419 - DNA, 11 bp, Homo sapiens
tttaaatcatt

SEQ ID NO: 2289420 - DNA, 14 bp, Homo sapiens
tttaaatcatttca

SEQ ID NO: 2289421 - DNA, 18 bp, Homo sapiens
tttaacagacatgtatac

SEQ ID NO: 2289422 - DNA, 22 bp, Homo sapiens
tttaacagatatttaaatttag

SEQ ID NO: 2289423 - DNA, 15 bp, Homo sapiens
tttaacatacatcta

SEQ ID NO: 2289424 - DNA, 18 bp, Homo sapiens
tttaagaaatgagaaatt

SEQ ID NO: 2289425 - DNA, 15 bp, Homo sapiens
tttaatatactgcat

SEQ ID NO: 2289426 - DNA, 19 bp, Homo sapiens
tttaatggtatctgttact

SEQ ID NO: 2289427 - DNA, 22 bp, Homo sapiens
tttacctgaagtctttgtacag

SEQ ID NO: 2289428 - DNA, 16 bp, Homo sapiens
tttaccttcagcagtt

SEQ ID NO: 2289429 - DNA, 14 bp, Homo sapiens
tttactcaggcttt

SEQ ID NO: 2289430 - DNA, 13 bp, Homo sapiens
tttactgtctgta

SEQ ID NO: 2289431 - DNA, 14 bp, Homo sapiens
tttacttttttaaa

SEQ ID NO: 2289432 - DNA, 21 bp, Homo sapiens
tttacttttttaaaattgtgt

SEQ ID NO: 2289433 - DNA, 21 bp, Homo sapiens
tttagacaaccatagaactgt

SEQ ID NO: 2289434 - DNA, 23 bp, Homo sapiens
tttagacaaccatagaactgtcc

SEQ ID NO: 2289435 - DNA, 14 bp, Homo sapiens
tttagagataaata

SEQ ID NO: 2289436 - DNA, 16 bp, Homo sapiens
tttagagataaatatt

SEQ ID NO: 2289437 - DNA, 20 bp, Homo sapiens
tttagaggggcaaaaatatt

SEQ ID NO: 2289438 - DNA, 23 bp, Homo sapiens
tttagagtatgcaagaagaatat

SEQ ID NO: 2289439 - DNA, 13 bp, Homo sapiens
tttagattgaaat

SEQ ID NO: 2289440 - DNA, 20 bp, Homo sapiens
tttagccagaatgtttcctg

SEQ ID NO: 2289441 - DNA, 15 bp, Homo sapiens
tttagcggtttgcaa

SEQ ID NO: 2289442 - DNA, 17 bp, Homo sapiens
tttaggctattataata

SEQ ID NO: 2289443 - DNA, 20 bp, Homo sapiens
tttaggctattataatatag

SEQ ID NO: 2289444 - DNA, 15 bp, Homo sapiens
tttatactgtagcaa

SEQ ID NO: 2289445 - DNA, 16 bp, Homo sapiens
tttatactgtagcaat

SEQ ID NO: 2289446 - DNA, 18 bp, Homo sapiens
tttatactgtagcaatat

SEQ ID NO: 2289447 - DNA, 17 bp, Homo sapiens
tttatataactacatta

SEQ ID NO: 2289448 - DNA, 17 bp, Homo sapiens
tttatataagttaaaga

SEQ ID NO: 2289449 - DNA, 18 bp, Homo sapiens
tttatcacttgccgtgtc

SEQ ID NO: 2289450 - DNA, 20 bp, Homo sapiens
tttatcttccatatgctctt

SEQ ID NO: 2289451 - DNA, 14 bp, Homo sapiens
tttatgaagatagt

SEQ ID NO: 2289452 - DNA, 23 bp, Homo sapiens
tttatgactagcaaacaaaaata

SEQ ID NO: 2289453 - DNA, 17 bp, Homo sapiens
tttatgcagaaggtatt

SEQ ID NO: 2289454 - DNA, 20 bp, Homo sapiens
tttatgtagaggctttatgt

SEQ ID NO: 2289455 - DNA, 16 bp, Homo sapiens
tttatgtgaaggtgtt

SEQ ID NO: 2289456 - DNA, 13 bp, Homo sapiens
tttattattttca

SEQ ID NO: 2289457 - DNA, 22 bp, Homo sapiens
tttattcatgtgtacagaaaca

SEQ ID NO: 2289458 - DNA, 20 bp, Homo sapiens
tttattgagtaatattacat

SEQ ID NO: 2289459 - DNA, 13 bp, Homo sapiens
tttattgcctctg

SEQ ID NO: 2289460 - DNA, 14 bp, Homo sapiens
tttattgtcaaagt

SEQ ID NO: 2289461 - DNA, 16 bp, Homo sapiens
tttattgtcaaagtgg

SEQ ID NO: 2289462 - DNA, 11 bp, Homo sapiens
tttatttatgt

SEQ ID NO: 2289463 - DNA, 13 bp, Homo sapiens
tttatttatgttc

SEQ ID NO: 2289464 - DNA, 13 bp, Homo sapiens
tttcaaaataatt

SEQ ID NO: 2289465 - DNA, 12 bp, Homo sapiens
tttcaatgattg

SEQ ID NO: 2289466 - DNA, 21 bp, Homo sapiens
tttcaatgattgtttaattgt

SEQ ID NO: 2289467 - DNA, 17 bp, Homo sapiens
tttcacatctctgtaga

SEQ ID NO: 2289468 - DNA, 14 bp, Homo sapiens
tttcacatctgtat

SEQ ID NO: 2289469 - DNA, 15 bp, Homo sapiens
tttcaccctattttc

SEQ ID NO: 2289470 - DNA, 18 bp, Homo sapiens
tttcaccctattttcaga

SEQ ID NO: 2289471 - DNA, 18 bp, Homo sapiens
tttcacctgaaacacttt

SEQ ID NO: 2289472 - DNA, 14 bp, Homo sapiens
tttcactctccttg

SEQ ID NO: 2289473 - DNA, 19 bp, Homo sapiens
tttcagaatacaattcagt

SEQ ID NO: 2289474 - DNA, 20 bp, Homo sapiens
tttcagaatattttcaaaat

SEQ ID NO: 2289475 - DNA, 17 bp, Homo sapiens
tttcagccaagaattct

SEQ ID NO: 2289476 - DNA, 16 bp, Homo sapiens
tttcagtggaaaccct

SEQ ID NO: 2289477 - DNA, 12 bp, Homo sapiens
tttcataattca

SEQ ID NO: 2289478 - DNA, 18 bp, Homo sapiens
tttcataattcatttaag

SEQ ID NO: 2289479 - DNA, 20 bp, Homo sapiens
tttcatgtgttgcaaattat

SEQ ID NO: 2289480 - DNA, 23 bp, Homo sapiens
tttcatgtgttgcaaattattct

SEQ ID NO: 2289481 - DNA, 14 bp, Homo sapiens
tttcatgtttaaga

SEQ ID NO: 2289482 - DNA, 23 bp, Homo sapiens
tttcattgagggaaaacataata

SEQ ID NO: 2289483 - DNA, 16 bp, Homo sapiens
tttcatttatactgta

SEQ ID NO: 2289484 - DNA, 22 bp, Homo sapiens
tttcatttatactgtagcaata

SEQ ID NO: 2289485 - DNA, 22 bp, Homo sapiens
tttccaaacaatttagccagaa

SEQ ID NO: 2289486 - DNA, 18 bp, Homo sapiens
tttccaaagctgaagatc

SEQ ID NO: 2289487 - DNA, 22 bp, Homo sapiens
tttccaccaagggtatctgctg

SEQ ID NO: 2289488 - DNA, 14 bp, Homo sapiens
tttccatatagttt

SEQ ID NO: 2289489 - DNA, 14 bp, Homo sapiens
tttccatctaaaat

SEQ ID NO: 2289490 - DNA, 15 bp, Homo sapiens
tttccatgtggcctt

SEQ ID NO: 2289491 - DNA, 13 bp, Homo sapiens
tttccccactgaa

SEQ ID NO: 2289492 - DNA, 12 bp, Homo sapiens
tttcccctcccg

SEQ ID NO: 2289493 - DNA, 20 bp, Homo sapiens
tttccctattttaggctatt

SEQ ID NO: 2289494 - DNA, 20 bp, Homo sapiens
tttccgtgagagtcatctca

SEQ ID NO: 2289495 - DNA, 17 bp, Homo sapiens
tttcctcccttctgata

SEQ ID NO: 2289496 - DNA, 15 bp, Homo sapiens
tttcctgtttccagg

SEQ ID NO: 2289497 - DNA, 17 bp, Homo sapiens
tttcctgtttccagggt

SEQ ID NO: 2289498 - DNA, 18 bp, Homo sapiens
tttccttcagtgccttat

SEQ ID NO: 2289499 - DNA, 18 bp, Homo sapiens
tttcgccaaggctcacat

SEQ ID NO: 2289500 - DNA, 12 bp, Homo sapiens
tttcgcctcctc

SEQ ID NO: 2289501 - DNA, 15 bp, Homo sapiens
tttcgtgcatttgtg

SEQ ID NO: 2289502 - DNA, 15 bp, Homo sapiens
tttctaaactgtttt

SEQ ID NO: 2289503 - DNA, 18 bp, Homo sapiens
tttctaaactgttttcat

SEQ ID NO: 2289504 - DNA, 16 bp, Homo sapiens
tttctaaatgtttctt

SEQ ID NO: 2289505 - DNA, 16 bp, Homo sapiens
tttctacagtacatga

SEQ ID NO: 2289506 - DNA, 23 bp, Homo sapiens
tttctactcgagttacagacaaa

SEQ ID NO: 2289507 - DNA, 17 bp, Homo sapiens
tttctagcagtatgtgt

SEQ ID NO: 2289508 - DNA, 20 bp, Homo sapiens
tttctagcagtatgtgtgct

SEQ ID NO: 2289509 - DNA, 17 bp, Homo sapiens
tttctatactgtttgta

SEQ ID NO: 2289510 - DNA, 22 bp, Homo sapiens
tttctatgtactagtactgtgt

SEQ ID NO: 2289511 - DNA, 17 bp, Homo sapiens
tttctatgtagaactgt

SEQ ID NO: 2289512 - DNA, 17 bp, Homo sapiens
tttctccatgtctgtag

SEQ ID NO: 2289513 - DNA, 23 bp, Homo sapiens
tttctcctggaaaacctcagcat

SEQ ID NO: 2289514 - DNA, 12 bp, Homo sapiens
tttctctcctct

SEQ ID NO: 2289515 - DNA, 14 bp, Homo sapiens
tttctcttcctaaa

SEQ ID NO: 2289516 - DNA, 15 bp, Homo sapiens
tttctcttcctaaat

SEQ ID NO: 2289517 - DNA, 19 bp, Homo sapiens
tttctgaggtttagcgttt

SEQ ID NO: 2289518 - DNA, 21 bp, Homo sapiens
tttctgctacctggttttcat

SEQ ID NO: 2289519 - DNA, 23 bp, Homo sapiens
tttctgctacctggttttcatta

SEQ ID NO: 2289520 - DNA, 17 bp, Homo sapiens
tttctgttgttattcct

SEQ ID NO: 2289521 - DNA, 17 bp, Homo sapiens
tttcttattaaccaaat

SEQ ID NO: 2289522 - DNA, 20 bp, Homo sapiens
tttcttcaactctgaatcaa

SEQ ID NO: 2289523 - DNA, 15 bp, Homo sapiens
tttcttccacaaaca

SEQ ID NO: 2289524 - DNA, 12 bp, Homo sapiens
tttcttgcttgt

SEQ ID NO: 2289525 - DNA, 14 bp, Homo sapiens
tttcttgcttgtac

SEQ ID NO: 2289526 - DNA, 15 bp, Homo sapiens
tttcttgcttgtacc

SEQ ID NO: 2289527 - DNA, 21 bp, Homo sapiens
tttcttgtgttgttttctctg

SEQ ID NO: 2289528 - DNA, 22 bp, Homo sapiens
tttcttgtgttgttttctctga

SEQ ID NO: 2289529 - DNA, 13 bp, Homo sapiens
tttctttctatgt

SEQ ID NO: 2289530 - DNA, 14 bp, Homo sapiens
tttcttttatatct

SEQ ID NO: 2289531 - DNA, 15 bp, Homo sapiens
tttctttttaaatgt

SEQ ID NO: 2289532 - DNA, 16 bp, Homo sapiens
tttctttttaaatgtg

SEQ ID NO: 2289533 - DNA, 18 bp, Homo sapiens
tttctttttaaatgtgct

SEQ ID NO: 2289534 - DNA, 20 bp, Homo sapiens
tttcttttttgagtgtgcaa

SEQ ID NO: 2289535 - DNA, 19 bp, Homo sapiens
tttgaaagaagtcaaatga

SEQ ID NO: 2289536 - DNA, 16 bp, Homo sapiens
tttgaaagtttcctta

SEQ ID NO: 2289537 - DNA, 17 bp, Homo sapiens
tttgaaagtttccttat

SEQ ID NO: 2289538 - DNA, 19 bp, Homo sapiens
tttgaaagtttccttattt

SEQ ID NO: 2289539 - DNA, 14 bp, Homo sapiens
tttgaacagttggc

SEQ ID NO: 2289540 - DNA, 17 bp, Homo sapiens
tttgaagctcaactgtt

SEQ ID NO: 2289541 - DNA, 15 bp, Homo sapiens
tttgaagtcttgtat

SEQ ID NO: 2289542 - DNA, 23 bp, Homo sapiens
tttgagagcctttggtgaataac

SEQ ID NO: 2289543 - DNA, 21 bp, Homo sapiens
tttgagtgccttacacaatgg

SEQ ID NO: 2289544 - DNA, 21 bp, Homo sapiens
tttgatatacagacctccaga

SEQ ID NO: 2289545 - DNA, 19 bp, Homo sapiens
tttgcacacattggccgct

SEQ ID NO: 2289546 - DNA, 17 bp, Homo sapiens
tttgcagtgaagatgtg

SEQ ID NO: 2289547 - DNA, 21 bp, Homo sapiens
tttgcatacttcctggatttt

SEQ ID NO: 2289548 - DNA, 20 bp, Homo sapiens
tttgcatttctcttcctaaa

SEQ ID NO: 2289549 - DNA, 15 bp, Homo sapiens
tttggcattttggct

SEQ ID NO: 2289550 - DNA, 15 bp, Homo sapiens
tttggctcagagtcc

SEQ ID NO: 2289551 - DNA, 15 bp, Homo sapiens
tttggctcgctgtgg

SEQ ID NO: 2289552 - DNA, 22 bp, Homo sapiens
tttgggaggtcgaggtgggcgt

SEQ ID NO: 2289553 - DNA, 23 bp, Homo sapiens
tttggggaggagttgtctgtcct

SEQ ID NO: 2289554 - DNA, 21 bp, Homo sapiens
tttggtgaggacctgcggcct

SEQ ID NO: 2289555 - DNA, 12 bp, Homo sapiens
tttgtaaatgtt

SEQ ID NO: 2289556 - DNA, 14 bp, Homo sapiens
tttgtaaatgttat

SEQ ID NO: 2289557 - DNA, 18 bp, Homo sapiens
tttgtaaatgttatttct

SEQ ID NO: 2289558 - DNA, 17 bp, Homo sapiens
tttgtaactattcttca

SEQ ID NO: 2289559 - DNA, 14 bp, Homo sapiens
tttgtacagacaac

SEQ ID NO: 2289560 - DNA, 16 bp, Homo sapiens
tttgtagatatatatt

SEQ ID NO: 2289561 - DNA, 20 bp, Homo sapiens
tttgtagatatatatttcca

SEQ ID NO: 2289562 - DNA, 16 bp, Homo sapiens
tttgtaggtatactat

SEQ ID NO: 2289563 - DNA, 19 bp, Homo sapiens
tttgtaggtatactatgta

SEQ ID NO: 2289564 - DNA, 10 bp, Homo sapiens
tttgtattta

SEQ ID NO: 2289565 - DNA, 13 bp, Homo sapiens
tttgtatttatat

SEQ ID NO: 2289566 - DNA, 13 bp, Homo sapiens
tttgtcactgaat

SEQ ID NO: 2289567 - DNA, 18 bp, Homo sapiens
tttgtcataaaatgctat

SEQ ID NO: 2289568 - DNA, 19 bp, Homo sapiens
tttgtcataaaatgctatt

SEQ ID NO: 2289569 - DNA, 18 bp, Homo sapiens
tttgtgagccaaagagaa

SEQ ID NO: 2289570 - DNA, 14 bp, Homo sapiens
tttgtttccaaagc

SEQ ID NO: 2289571 - DNA, 21 bp, Homo sapiens
tttgtttccaaagctgaagat

SEQ ID NO: 2289572 - DNA, 19 bp, Homo sapiens
ttttaaaaaaaatattctg

SEQ ID NO: 2289573 - DNA, 23 bp, Homo sapiens
ttttaaaaaataacatattcttg

SEQ ID NO: 2289574 - DNA, 15 bp, Homo sapiens
ttttaaaatcaactt

SEQ ID NO: 2289575 - DNA, 14 bp, Homo sapiens
ttttaaactgatgt

SEQ ID NO: 2289576 - DNA, 16 bp, Homo sapiens
ttttaaactgatgtat

SEQ ID NO: 2289577 - DNA, 22 bp, Homo sapiens
ttttaaagggagccatgctctt

SEQ ID NO: 2289578 - DNA, 17 bp, Homo sapiens
ttttaacagacatgtat

SEQ ID NO: 2289579 - DNA, 13 bp, Homo sapiens
ttttaagaaatgt

SEQ ID NO: 2289580 - DNA, 14 bp, Homo sapiens
ttttaagaaatgta

SEQ ID NO: 2289581 - DNA, 16 bp, Homo sapiens
ttttaagaaatgtagt

SEQ ID NO: 2289582 - DNA, 18 bp, Homo sapiens
ttttactcaggctttcta

SEQ ID NO: 2289583 - DNA, 19 bp, Homo sapiens
ttttactcaggctttctat

SEQ ID NO: 2289584 - DNA, 15 bp, Homo sapiens
ttttagagataaata

SEQ ID NO: 2289585 - DNA, 21 bp, Homo sapiens
ttttagagattaatttgtgta

SEQ ID NO: 2289586 - DNA, 23 bp, Homo sapiens
ttttagagattaatttgtgtaga

SEQ ID NO: 2289587 - DNA, 18 bp, Homo sapiens
ttttaggctattataata

SEQ ID NO: 2289588 - DNA, 14 bp, Homo sapiens
ttttagtttcaaaa

SEQ ID NO: 2289589 - DNA, 22 bp, Homo sapiens
ttttatatagaccccaagcatt

SEQ ID NO: 2289590 - DNA, 22 bp, Homo sapiens
ttccaccaggattaatctctaa

SEQ ID NO: 2289591 - DNA, 22 bp, Homo sapiens
ttccactataattttacaaagt

SEQ ID NO: 2289592 - DNA, 18 bp, Homo sapiens
ttccactgaaacctctgt

SEQ ID NO: 2289593 - DNA, 22 bp, Homo sapiens
ttccactgaaacctctgttctc

SEQ ID NO: 2289594 - DNA, 22 bp, Homo sapiens
ttccagctcagtcccacagccc

SEQ ID NO: 2289595 - DNA, 22 bp, Homo sapiens
ttccaggcgtagggccagggct

SEQ ID NO: 2289596 - DNA, 18 bp, Homo sapiens
ttccagttgtatttgaag

SEQ ID NO: 2289597 - DNA, 21 bp, Homo sapiens
ttccatatagtttgttttctt

SEQ ID NO: 2289598 - DNA, 15 bp, Homo sapiens
ttccatctaaaatac

SEQ ID NO: 2289599 - DNA, 15 bp, Homo sapiens
ttccatctcattaca

SEQ ID NO: 2289600 - DNA, 17 bp, Homo sapiens
ttccatgggttgaacaa

SEQ ID NO: 2289601 - DNA, 15 bp, Homo sapiens
ttccattctatgact

SEQ ID NO: 2289602 - DNA, 19 bp, Homo sapiens
ttcccacaattcttttgaa

SEQ ID NO: 2289603 - DNA, 20 bp, Homo sapiens
ttcccacaattcttttgaaa

SEQ ID NO: 2289604 - DNA, 13 bp, Homo sapiens
ttcccagctggca

SEQ ID NO: 2289605 - DNA, 15 bp, Homo sapiens
ttcccatttgtaatg

SEQ ID NO: 2289606 - DNA, 22 bp, Homo sapiens
ttccccgcgaagtccgaggcct

SEQ ID NO: 2289607 - DNA, 15 bp, Homo sapiens
ttcccgcagcaccag

SEQ ID NO: 2289608 - DNA, 19 bp, Homo sapiens
ttcccgcagcaccagcctg

SEQ ID NO: 2289609 - DNA, 19 bp, Homo sapiens
ttccctattttaggctatt

SEQ ID NO: 2289610 - DNA, 16 bp, Homo sapiens
ttcctactctgggaag

SEQ ID NO: 2289611 - DNA, 21 bp, Homo sapiens
ttcctactctgggaagaatgt

SEQ ID NO: 2289612 - DNA, 19 bp, Homo sapiens
ttcctagaggcagaggttg

SEQ ID NO: 2289613 - DNA, 20 bp, Homo sapiens
ttcctgatgttgataatagt

SEQ ID NO: 2289614 - DNA, 22 bp, Homo sapiens
ttcctgctacagtagctgtggg

SEQ ID NO: 2289615 - DNA, 15 bp, Homo sapiens
ttcctggaaaactgg

SEQ ID NO: 2289616 - DNA, 18 bp, Homo sapiens
ttcctgtggaaatatgca

SEQ ID NO: 2289617 - DNA, 16 bp, Homo sapiens
ttcctgttctgtgtct

SEQ ID NO: 2289618 - DNA, 14 bp, Homo sapiens
ttcctgttgtctga

SEQ ID NO: 2289619 - DNA, 14 bp, Homo sapiens
ttccttataaaaat

SEQ ID NO: 2289620 - DNA, 17 bp, Homo sapiens
ttccttataaaaattct

SEQ ID NO: 2289621 - DNA, 12 bp, Homo sapiens
ttccttattttc

SEQ ID NO: 2289622 - DNA, 18 bp, Homo sapiens
ttccttattttcataatt

SEQ ID NO: 2289623 - DNA, 14 bp, Homo sapiens
ttccttcagtgcct

SEQ ID NO: 2289624 - DNA, 19 bp, Homo sapiens
ttccttcagtgccttatgg

SEQ ID NO: 2289625 - DNA, 22 bp, Homo sapiens
ttcctttgacctctcacttttt

SEQ ID NO: 2289626 - DNA, 22 bp, Homo sapiens
ttcgatcgtttcacatctgtat

SEQ ID NO: 2289627 - DNA, 20 bp, Homo sapiens
ttcgatgtgcccaggggagc

SEQ ID NO: 2289628 - DNA, 21 bp, Homo sapiens
ttcgcctcctccagctcctgc

SEQ ID NO: 2289629 - DNA, 17 bp, Homo sapiens
ttcgtgcatttgtgagc

SEQ ID NO: 2289630 - DNA, 15 bp, Homo sapiens
ttctaaactgttttc

SEQ ID NO: 2289631 - DNA, 16 bp, Homo sapiens
ttctaagattgtacat

SEQ ID NO: 2289632 - DNA, 17 bp, Homo sapiens
ttctaagattgtacata

SEQ ID NO: 2289633 - DNA, 22 bp, Homo sapiens
ttctaagattgtacatatggaa

SEQ ID NO: 2289634 - DNA, 14 bp, Homo sapiens
ttctaagcttattt

SEQ ID NO: 2289635 - DNA, 20 bp, Homo sapiens
ttctaagggatccagagacc

SEQ ID NO: 2289636 - DNA, 16 bp, Homo sapiens
ttctaatttcaagtta

SEQ ID NO: 2289637 - DNA, 14 bp, Homo sapiens
ttctacctgcagga

SEQ ID NO: 2289638 - DNA, 23 bp, Homo sapiens
ttctagaaggatgaacagttctc

SEQ ID NO: 2289639 - DNA, 21 bp, Homo sapiens
ttctagcagtatgtgtgctct

SEQ ID NO: 2289640 - DNA, 23 bp, Homo sapiens
ttctagctataacaactctattt

SEQ ID NO: 2289641 - DNA, 16 bp, Homo sapiens
ttctagtcaactgctg

SEQ ID NO: 2289642 - DNA, 19 bp, Homo sapiens
ttctagtcaactgctgttt

SEQ ID NO: 2289643 - DNA, 13 bp, Homo sapiens
ttctagtctctga

SEQ ID NO: 2289644 - DNA, 15 bp, Homo sapiens
ttctagtctgtttca

SEQ ID NO: 2289645 - DNA, 18 bp, Homo sapiens
ttctagtctgtttcatta

SEQ ID NO: 2289646 - DNA, 19 bp, Homo sapiens
ttctagttagcaggaaata

SEQ ID NO: 2289647 - DNA, 12 bp, Homo sapiens
ttctatactgtt

SEQ ID NO: 2289648 - DNA, 19 bp, Homo sapiens
ttctatgcctgtatttcca

SEQ ID NO: 2289649 - DNA, 15 bp, Homo sapiens
ttctatgtactagta

SEQ ID NO: 2289650 - DNA, 24 bp, Homo sapiens
ttctatgtactagtactgtgtact

SEQ ID NO: 2289651 - DNA, 18 bp, Homo sapiens
ttctatgtccaaacctgg

SEQ ID NO: 2289652 - DNA, 13 bp, Homo sapiens
ttctattatctgg

SEQ ID NO: 2289653 - DNA, 17 bp, Homo sapiens
ttctattatctgggttt

SEQ ID NO: 2289654 - DNA, 16 bp, Homo sapiens
ttctatttctatctgc

SEQ ID NO: 2289655 - DNA, 18 bp, Homo sapiens
ttctcaaatgctaaatgc

SEQ ID NO: 2289656 - DNA, 17 bp, Homo sapiens
ttctcaacgcagtaatt

SEQ ID NO: 2289657 - DNA, 18 bp, Homo sapiens
ttctcattatgaagatgt

SEQ ID NO: 2289658 - DNA, 17 bp, Homo sapiens
ttctccagatttttaat

SEQ ID NO: 2289659 - DNA, 17 bp, Homo sapiens
ttctcctgacctacttc

SEQ ID NO: 2289660 - DNA, 20 bp, Homo sapiens
ttctcctgcgtgttctcaga

SEQ ID NO: 2289661 - DNA, 13 bp, Homo sapiens
ttctcgagtccaa

SEQ ID NO: 2289662 - DNA, 22 bp, Homo sapiens
ttctctgatcacaacttttctg

SEQ ID NO: 2289663 - DNA, 18 bp, Homo sapiens
ttctctgccctgccctgg

SEQ ID NO: 2289664 - DNA, 14 bp, Homo sapiens
ttctgaaaactgtt

SEQ ID NO: 2289665 - DNA, 15 bp, Homo sapiens
ttctgaaaactgttt

SEQ ID NO: 2289666 - DNA, 15 bp, Homo sapiens
ttctgagtgaatgtt

SEQ ID NO: 2289667 - DNA, 11 bp, Homo sapiens
ttctgcaataa

SEQ ID NO: 2289668 - DNA, 15 bp, Homo sapiens
ttctgcaataacagt

SEQ ID NO: 2289669 - DNA, 14 bp, Homo sapiens
ttctgcagtattct

SEQ ID NO: 2289670 - DNA, 15 bp, Homo sapiens
ttctgctgcccccag

SEQ ID NO: 2289671 - DNA, 14 bp, Homo sapiens
ttctgctgcctgtt

SEQ ID NO: 2289672 - DNA, 18 bp, Homo sapiens
ttctggaatactgaaaaa

SEQ ID NO: 2289673 - DNA, 16 bp, Homo sapiens
ttctggaggtggggag

SEQ ID NO: 2289674 - DNA, 21 bp, Homo sapiens
ttctggaggtggggagggcct

SEQ ID NO: 2289675 - DNA, 22 bp, Homo sapiens
ttctgtcattggttacaaattt

SEQ ID NO: 2289676 - DNA, 14 bp, Homo sapiens
ttctgtctctccct

SEQ ID NO: 2289677 - DNA, 14 bp, Homo sapiens
ttctgtgcataaaa

SEQ ID NO: 2289678 - DNA, 14 bp, Homo sapiens
ttctgtggattcta

SEQ ID NO: 2289679 - DNA, 15 bp, Homo sapiens
ttctgtggattctat

SEQ ID NO: 2289680 - DNA, 13 bp, Homo sapiens
ttcttaaaatatt

SEQ ID NO: 2289681 - DNA, 13 bp, Homo sapiens
ttcttattaacca

SEQ ID NO: 2289682 - DNA, 17 bp, Homo sapiens
ttcttatttgaaagtgt

SEQ ID NO: 2289683 - DNA, 23 bp, Homo sapiens
ttcttgagcaccaggtgttaaaa

SEQ ID NO: 2289684 - DNA, 22 bp, Homo sapiens
ttcttgcttgtacctctggctg

SEQ ID NO: 2289685 - DNA, 14 bp, Homo sapiens
ttcttgtgtgttta

SEQ ID NO: 2289686 - DNA, 20 bp, Homo sapiens
ttctttaacatacatctaag

SEQ ID NO: 2289687 - DNA, 14 bp, Homo sapiens
ttctttaaggaaga

SEQ ID NO: 2289688 - DNA, 17 bp, Homo sapiens
ttctttaatcaaaagtc

SEQ ID NO: 2289689 - DNA, 12 bp, Homo sapiens
ttctttcagcca

SEQ ID NO: 2289690 - DNA, 14 bp, Homo sapiens
ttctttctctttga

SEQ ID NO: 2289691 - DNA, 15 bp, Homo sapiens
ttctttgcagtgaag

SEQ ID NO: 2289692 - DNA, 15 bp, Homo sapiens
ttcttttatatctgt

SEQ ID NO: 2289693 - DNA, 22 bp, Homo sapiens
ttcttttcagcttgtttctata

SEQ ID NO: 2289694 - DNA, 23 bp, Homo sapiens
ttcttttcagcttgtttctatac

SEQ ID NO: 2289695 - DNA, 22 bp, Homo sapiens
ttctttttaaaaagttgcacat

SEQ ID NO: 2289696 - DNA, 16 bp, Homo sapiens
ttctttttaaatgtgc

SEQ ID NO: 2289697 - DNA, 22 bp, Homo sapiens
ttcttttttcaatgtactgtat

SEQ ID NO: 2289698 - DNA, 11 bp, Homo sapiens
ttgaaaacacc

SEQ ID NO: 2289699 - DNA, 18 bp, Homo sapiens
ttgaaaacaccaagagta

SEQ ID NO: 2289700 - DNA, 17 bp, Homo sapiens
ttgaaagaagtcaaatg

SEQ ID NO: 2289701 - DNA, 15 bp, Homo sapiens
ttgaaatttttaaat

SEQ ID NO: 2289702 - DNA, 20 bp, Homo sapiens
ttgaaatttttaaatcattt

SEQ ID NO: 2289703 - DNA, 17 bp, Homo sapiens
ttgaacaaaatctgttg

SEQ ID NO: 2289704 - DNA, 16 bp, Homo sapiens
ttgaaccgtcaatgtg

SEQ ID NO: 2289705 - DNA, 20 bp, Homo sapiens
ttgaagctcaactgttgcca

SEQ ID NO: 2289706 - DNA, 15 bp, Homo sapiens
ttgaagggaaatcaa

SEQ ID NO: 2289707 - DNA, 17 bp, Homo sapiens
ttgaagggaaatcaatt

SEQ ID NO: 2289708 - DNA, 22 bp, Homo sapiens
ttgaataaactccccagcgtat

SEQ ID NO: 2289709 - DNA, 21 bp, Homo sapiens
ttgaatgtccccattctataa

SEQ ID NO: 2289710 - DNA, 15 bp, Homo sapiens
ttgaatgttatatca

SEQ ID NO: 2289711 - DNA, 14 bp, Homo sapiens
ttgaattgtaagga

SEQ ID NO: 2289712 - DNA, 17 bp, Homo sapiens
ttgactgtgctggagaa

SEQ ID NO: 2289713 - DNA, 20 bp, Homo sapiens
ttgagaataaatgagcattt

SEQ ID NO: 2289714 - DNA, 16 bp, Homo sapiens
ttgagcaagtcccatc

SEQ ID NO: 2289715 - DNA, 14 bp, Homo sapiens
ttgagcaatgtttt

SEQ ID NO: 2289716 - DNA, 21 bp, Homo sapiens
ttgagcaatgtttttctcaaa

SEQ ID NO: 2289717 - DNA, 23 bp, Homo sapiens
ttgagcacaggcaacattacaaa

SEQ ID NO: 2289718 - DNA, 21 bp, Homo sapiens
ttgaggacctccacctgggag

SEQ ID NO: 2289719 - DNA, 21 bp, Homo sapiens
ttgaggcgggaaccctctggg

SEQ ID NO: 2289720 - DNA, 18 bp, Homo sapiens
ttgagggaaaacataata

SEQ ID NO: 2289721 - DNA, 16 bp, Homo sapiens
ttgagtaatattacat

SEQ ID NO: 2289722 - DNA, 21 bp, Homo sapiens
ttgagtaatattacatttcat

SEQ ID NO: 2289723 - DNA, 23 bp, Homo sapiens
ttgagtgatcctcccgccccagc

SEQ ID NO: 2289724 - DNA, 11 bp, Homo sapiens
ttgagtgcctt

SEQ ID NO: 2289725 - DNA, 13 bp, Homo sapiens
ttgagtggacagc

SEQ ID NO: 2289726 - DNA, 13 bp, Homo sapiens
tgtggcagggcgt

SEQ ID NO: 2289727 - DNA, 19 bp, Homo sapiens
tgtggcgggaagggtgggc

SEQ ID NO: 2289728 - DNA, 14 bp, Homo sapiens
tgtggctccaagct

SEQ ID NO: 2289729 - DNA, 23 bp, Homo sapiens
tgtggctccaagctcaggtgcct

SEQ ID NO: 2289730 - DNA, 18 bp, Homo sapiens
tgtggctcgggtgcccag

SEQ ID NO: 2289731 - DNA, 13 bp, Homo sapiens
tgtggggagctgg

SEQ ID NO: 2289732 - DNA, 14 bp, Homo sapiens
tgtggggtaagttg

SEQ ID NO: 2289733 - DNA, 23 bp, Homo sapiens
tgtggtattttggcattttggct

SEQ ID NO: 2289734 - DNA, 9 bp, Homo sapiens
tgtgtaaat

SEQ ID NO: 2289735 - DNA, 15 bp, Homo sapiens
tgtgtaactgttctt

SEQ ID NO: 2289736 - DNA, 19 bp, Homo sapiens
tgtgtaactgttctttgca

SEQ ID NO: 2289737 - DNA, 21 bp, Homo sapiens
tgtgtacagaaacaactgcca

SEQ ID NO: 2289738 - DNA, 20 bp, Homo sapiens
tgtgtactgtatagacagtt

SEQ ID NO: 2289739 - DNA, 14 bp, Homo sapiens
tgtgtatgatccaa

SEQ ID NO: 2289740 - DNA, 20 bp, Homo sapiens
tgtgtattctgtggattcta

SEQ ID NO: 2289741 - DNA, 21 bp, Homo sapiens
tgtgtattctgtggattctat

SEQ ID NO: 2289742 - DNA, 12 bp, Homo sapiens
tgtgtctgctgt

SEQ ID NO: 2289743 - DNA, 14 bp, Homo sapiens
tgtgtgattacagc

SEQ ID NO: 2289744 - DNA, 18 bp, Homo sapiens
tgtgtgtttcttgctttg

SEQ ID NO: 2289745 - DNA, 15 bp, Homo sapiens
tgtgttcttaaaata

SEQ ID NO: 2289746 - DNA, 18 bp, Homo sapiens
tgtgttgatttctttcct

SEQ ID NO: 2289747 - DNA, 21 bp, Homo sapiens
tgtgttgcaaattattctagt

SEQ ID NO: 2289748 - DNA, 23 bp, Homo sapiens
tgttaaaaaccattataaaatct

SEQ ID NO: 2289749 - DNA, 19 bp, Homo sapiens
tgttactccaaaaagaaat

SEQ ID NO: 2289750 - DNA, 12 bp, Homo sapiens
tgttacttaaat

SEQ ID NO: 2289751 - DNA, 11 bp, Homo sapiens
tgttagaatta

SEQ ID NO: 2289752 - DNA, 16 bp, Homo sapiens
tgttaggggaaaatag

SEQ ID NO: 2289753 - DNA, 18 bp, Homo sapiens
tgttagtaatggcagagc

SEQ ID NO: 2289754 - DNA, 14 bp, Homo sapiens
tgttagtcttaccg

SEQ ID NO: 2289755 - DNA, 19 bp, Homo sapiens
tgttattttaatctcagaa

SEQ ID NO: 2289756 - DNA, 16 bp, Homo sapiens
tgttattttcagtgct

SEQ ID NO: 2289757 - DNA, 19 bp, Homo sapiens
tgttattttcagtgctttg

SEQ ID NO: 2289758 - DNA, 12 bp, Homo sapiens
tgttcagcatag

SEQ ID NO: 2289759 - DNA, 14 bp, Homo sapiens
tgttcagtcctctg

SEQ ID NO: 2289760 - DNA, 18 bp, Homo sapiens
tgttctcaatgcttttct

SEQ ID NO: 2289761 - DNA, 18 bp, Homo sapiens
tgttctgtgtctgctgta

SEQ ID NO: 2289762 - DNA, 20 bp, Homo sapiens
tgttcttaaaatattgtgta

SEQ ID NO: 2289763 - DNA, 23 bp, Homo sapiens
tgttctttgcagtgaagatgtgt

SEQ ID NO: 2289764 - DNA, 13 bp, Homo sapiens
tgttgaatgtatt

SEQ ID NO: 2289765 - DNA, 13 bp, Homo sapiens
tgttgaccaggct

SEQ ID NO: 2289766 - DNA, 15 bp, Homo sapiens
tgttgattccactga

SEQ ID NO: 2289767 - DNA, 18 bp, Homo sapiens
tgttgcaaattattctag

SEQ ID NO: 2289768 - DNA, 20 bp, Homo sapiens
tgttgcaaattattctagtc

SEQ ID NO: 2289769 - DNA, 11 bp, Homo sapiens
tgttgcccaga

SEQ ID NO: 2289770 - DNA, 22 bp, Homo sapiens
tgttgcccagaatttcatactt

SEQ ID NO: 2289771 - DNA, 13 bp, Homo sapiens
tgttgcccaggct

SEQ ID NO: 2289772 - DNA, 23 bp, Homo sapiens
tgttgcttgaatagcaatagcat

SEQ ID NO: 2289773 - DNA, 15 bp, Homo sapiens
tgttgtaccatatgt

SEQ ID NO: 2289774 - DNA, 14 bp, Homo sapiens
tgttgttttctctg

SEQ ID NO: 2289775 - DNA, 20 bp, Homo sapiens
tgtttcaaagggtaaattat

SEQ ID NO: 2289776 - DNA, 12 bp, Homo sapiens
tgtttccaggca

SEQ ID NO: 2289777 - DNA, 21 bp, Homo sapiens
tgtttccaggcatgaccctgg

SEQ ID NO: 2289778 - DNA, 13 bp, Homo sapiens
tgtttccagggtc

SEQ ID NO: 2289779 - DNA, 17 bp, Homo sapiens
tgtttcccctcagaaca

SEQ ID NO: 2289780 - DNA, 14 bp, Homo sapiens
tgtttctatactgt

SEQ ID NO: 2289781 - DNA, 12 bp, Homo sapiens
tgtttctcccca

SEQ ID NO: 2289782 - DNA, 19 bp, Homo sapiens
tgtttctgcagtattctgt

SEQ ID NO: 2289783 - DNA, 12 bp, Homo sapiens
tgtttcttgctt

SEQ ID NO: 2289784 - DNA, 17 bp, Homo sapiens
tgtttcttgcttgtacc

SEQ ID NO: 2289785 - DNA, 14 bp, Homo sapiens
tgtttgagtttctg

SEQ ID NO: 2289786 - DNA, 20 bp, Homo sapiens
tgtttgcttgaatgctggta

SEQ ID NO: 2289787 - DNA, 14 bp, Homo sapiens
tgtttggtgaggac

SEQ ID NO: 2289788 - DNA, 14 bp, Homo sapiens
tgtttgtgtccata

SEQ ID NO: 2289789 - DNA, 19 bp, Homo sapiens
tgtttgtgtccataagaga

SEQ ID NO: 2289790 - DNA, 16 bp, Homo sapiens
tgttttaagaaatgta

SEQ ID NO: 2289791 - DNA, 12 bp, Homo sapiens
tgttttatgtca

SEQ ID NO: 2289792 - DNA, 21 bp, Homo sapiens
tgttttatgtcatactctgtg

SEQ ID NO: 2289793 - DNA, 23 bp, Homo sapiens
tgttttcttgtgttgttttctct

SEQ ID NO: 2289794 - DNA, 17 bp, Homo sapiens
tgttttttaatatacta

SEQ ID NO: 2289795 - DNA, 21 bp, Homo sapiens
ttaaaaaaaatattctgtcat

SEQ ID NO: 2289796 - DNA, 14 bp, Homo sapiens
ttaaaaaaataaca

SEQ ID NO: 2289797 - DNA, 15 bp, Homo sapiens
ttaaaaaaataacat

SEQ ID NO: 2289798 - DNA, 11 bp, Homo sapiens
ttaaaaaataa

SEQ ID NO: 2289799 - DNA, 14 bp, Homo sapiens
ttaaaaaataacat

SEQ ID NO: 2289800 - DNA, 20 bp, Homo sapiens
ttaaaaaataacatattctt

SEQ ID NO: 2289801 - DNA, 13 bp, Homo sapiens
ttaaaaatctttc

SEQ ID NO: 2289802 - DNA, 13 bp, Homo sapiens
ttaaaaattgcat

SEQ ID NO: 2289803 - DNA, 16 bp, Homo sapiens
ttaaaatagttttcta

SEQ ID NO: 2289804 - DNA, 23 bp, Homo sapiens
ttaaaatagttttctaaatgttt

SEQ ID NO: 2289805 - DNA, 14 bp, Homo sapiens
ttaaaatattgtgt

SEQ ID NO: 2289806 - DNA, 15 bp, Homo sapiens
ttaaaattagtgaga

SEQ ID NO: 2289807 - DNA, 18 bp, Homo sapiens
ttaaacctgtgctttcat

SEQ ID NO: 2289808 - DNA, 20 bp, Homo sapiens
ttaaacctgtgctttcatgt

SEQ ID NO: 2289809 - DNA, 16 bp, Homo sapiens
ttaaactgatgtatag

SEQ ID NO: 2289810 - DNA, 17 bp, Homo sapiens
ttaaagacatttaaaat

SEQ ID NO: 2289811 - DNA, 19 bp, Homo sapiens
ttaaagacatttaaaatag

SEQ ID NO: 2289812 - DNA, 16 bp, Homo sapiens
ttaaagagacaaatag

SEQ ID NO: 2289813 - DNA, 22 bp, Homo sapiens
ttaaagaggcgtcttgtatttt

SEQ ID NO: 2289814 - DNA, 23 bp, Homo sapiens
ttaaagaggcgtcttgtattttc

SEQ ID NO: 2289815 - DNA, 16 bp, Homo sapiens
ttaaagcaaaaaactt

SEQ ID NO: 2289816 - DNA, 16 bp, Homo sapiens
ttaaagtttcattagt

SEQ ID NO: 2289817 - DNA, 23 bp, Homo sapiens
ttaaataaaagaggtccattaat

SEQ ID NO: 2289818 - DNA, 14 bp, Homo sapiens
ttaaataatcctct

SEQ ID NO: 2289819 - DNA, 20 bp, Homo sapiens
ttaaatagcatctgctcttc

SEQ ID NO: 2289820 - DNA, 23 bp, Homo sapiens
ttaaatagcatctgctcttctct

SEQ ID NO: 2289821 - DNA, 21 bp, Homo sapiens
ttaaatagtttacttcacttt

SEQ ID NO: 2289822 - DNA, 17 bp, Homo sapiens
ttaaatataaaatacat

SEQ ID NO: 2289823 - DNA, 13 bp, Homo sapiens
ttaaatcatttca

SEQ ID NO: 2289824 - DNA, 21 bp, Homo sapiens
ttaaatgctatggaaatacat

SEQ ID NO: 2289825 - DNA, 23 bp, Homo sapiens
ttaaatgctatggaaatacattt

SEQ ID NO: 2289826 - DNA, 14 bp, Homo sapiens
ttaaatgtgcttca

SEQ ID NO: 2289827 - DNA, 23 bp, Homo sapiens
ttaaatttagtgctcagaatcca

SEQ ID NO: 2289828 - DNA, 20 bp, Homo sapiens
ttaacaacttgaattacaac

SEQ ID NO: 2289829 - DNA, 14 bp, Homo sapiens
ttaacagacatgta

SEQ ID NO: 2289830 - DNA, 18 bp, Homo sapiens
ttaacagatatttaaatt

SEQ ID NO: 2289831 - DNA, 22 bp, Homo sapiens
ttaacagatatttaaatttagt

SEQ ID NO: 2289832 - DNA, 19 bp, Homo sapiens
ttaacagatgatccatttg

SEQ ID NO: 2289833 - DNA, 19 bp, Homo sapiens
ttaacataaacttgtactt

SEQ ID NO: 2289834 - DNA, 18 bp, Homo sapiens
ttaacattttgtttccaa

SEQ ID NO: 2289835 - DNA, 22 bp, Homo sapiens
ttaacccagtgttcagcataga

SEQ ID NO: 2289836 - DNA, 17 bp, Homo sapiens
ttaactactaagaataa

SEQ ID NO: 2289837 - DNA, 18 bp, Homo sapiens
ttaagaagcgaacaaaaa

SEQ ID NO: 2289838 - DNA, 18 bp, Homo sapiens
ttaagcattttactgtct

SEQ ID NO: 2289839 - DNA, 21 bp, Homo sapiens
ttaagcattttactgtctgta

SEQ ID NO: 2289840 - DNA, 20 bp, Homo sapiens
ttaaggaagaataaaaaaga

SEQ ID NO: 2289841 - DNA, 19 bp, Homo sapiens
ttaataaatcctacagtat

SEQ ID NO: 2289842 - DNA, 17 bp, Homo sapiens
ttaatatactaaccatt

SEQ ID NO: 2289843 - DNA, 20 bp, Homo sapiens
ttaatatactgcatatcctg

SEQ ID NO: 2289844 - DNA, 16 bp, Homo sapiens
ttaatatgtacttttc

SEQ ID NO: 2289845 - DNA, 12 bp, Homo sapiens
ttaatctctaaa

SEQ ID NO: 2289846 - DNA, 18 bp, Homo sapiens
ttaatggtatctgttact

SEQ ID NO: 2289847 - DNA, 15 bp, Homo sapiens
ttaattgtggcttta

SEQ ID NO: 2289848 - DNA, 18 bp, Homo sapiens
ttaattgtggctttatga

SEQ ID NO: 2289849 - DNA, 17 bp, Homo sapiens
ttaattgtgtaactgtt

SEQ ID NO: 2289850 - DNA, 18 bp, Homo sapiens
ttaattgtgtaactgttc

SEQ ID NO: 2289851 - DNA, 17 bp, Homo sapiens
ttacaaacaaaggattt

SEQ ID NO: 2289852 - DNA, 15 bp, Homo sapiens
ttacaaatttttact

SEQ ID NO: 2289853 - DNA, 19 bp, Homo sapiens
ttacaaatttttactcagg

SEQ ID NO: 2289854 - DNA, 13 bp, Homo sapiens
ttacaacttccag

SEQ ID NO: 2289855 - DNA, 17 bp, Homo sapiens
ttacacctttatctcaa

SEQ ID NO: 2289856 - DNA, 18 bp, Homo sapiens
ttacactgaaatccaaaa

SEQ ID NO: 2289857 - DNA, 15 bp, Homo sapiens
ttacaggaaatgcaa

SEQ ID NO: 2289858 - DNA, 14 bp, Homo sapiens
ttacaggaagtact

SEQ ID NO: 2289859 - DNA, 15 bp, Homo sapiens
ttacaggaagtactg

SEQ ID NO: 2289860 - DNA, 22 bp, Homo sapiens
ttacaggaagtactggagaaaa

SEQ ID NO: 2289861 - DNA, 14 bp, Homo sapiens
ttacatcctctgct

SEQ ID NO: 2289862 - DNA, 21 bp, Homo sapiens
ttacatcctctgcttgtcatt

SEQ ID NO: 2289863 - DNA, 12 bp, Homo sapiens
ttacatttcatt

SEQ ID NO: 2289864 - DNA, 17 bp, Homo sapiens
ttacatttcatttatac

SEQ ID NO: 2289865 - DNA, 15 bp, Homo sapiens
ttacattttctttca

SEQ ID NO: 2289866 - DNA, 14 bp, Homo sapiens
ttacccctctacca

SEQ ID NO: 2289867 - DNA, 16 bp, Homo sapiens
ttacggaggaacagat

SEQ ID NO: 2289868 - DNA, 23 bp, Homo sapiens
ttactgatatggttcttattcac

SEQ ID NO: 2289869 - DNA, 16 bp, Homo sapiens
ttacttaaagcttgtt

SEQ ID NO: 2289870 - DNA, 14 bp, Homo sapiens
ttacttaaatagca

SEQ ID NO: 2289871 - DNA, 14 bp, Homo sapiens
ttacttaacagttg

SEQ ID NO: 2289872 - DNA, 17 bp, Homo sapiens
ttacttcactttcatct

SEQ ID NO: 2289873 - DNA, 17 bp, Homo sapiens
ttacttttttaaaattg

SEQ ID NO: 2289874 - DNA, 15 bp, Homo sapiens
ttagaaattctataa

SEQ ID NO: 2289875 - DNA, 15 bp, Homo sapiens
ttagaatctattttc

SEQ ID NO: 2289876 - DNA, 21 bp, Homo sapiens
ttagaatctattttctatgta

SEQ ID NO: 2289877 - DNA, 21 bp, Homo sapiens
ttagaatgcttcaagtttagt

SEQ ID NO: 2289878 - DNA, 20 bp, Homo sapiens
ttagacaaccatagaactgt

SEQ ID NO: 2289879 - DNA, 15 bp, Homo sapiens
ttagagataaatatt

SEQ ID NO: 2289880 - DNA, 13 bp, Homo sapiens
ttagatagaaaag

SEQ ID NO: 2289881 - DNA, 15 bp, Homo sapiens
ttagatgctattaaa

SEQ ID NO: 2289882 - DNA, 14 bp, Homo sapiens
ttagattgaaattt

SEQ ID NO: 2289883 - DNA, 18 bp, Homo sapiens
ttagattgaaatttatga

SEQ ID NO: 2289884 - DNA, 20 bp, Homo sapiens
ttagattgaaatttatgact

SEQ ID NO: 2289885 - DNA, 18 bp, Homo sapiens
ttagcattattgccaaat

SEQ ID NO: 2289886 - DNA, 21 bp, Homo sapiens
ttagccagaatgtttcctgtg

SEQ ID NO: 2289887 - DNA, 12 bp, Homo sapiens
ttagcctcgtct

SEQ ID NO: 2289888 - DNA, 16 bp, Homo sapiens
ttagcggtttgcaaac

SEQ ID NO: 2289889 - DNA, 22 bp, Homo sapiens
ttagctctcgcctcaggctttt

SEQ ID NO: 2289890 - DNA, 16 bp, Homo sapiens
ttaggggaaaatagta

SEQ ID NO: 2289891 - DNA, 14 bp, Homo sapiens
ttaggtttccacgt

SEQ ID NO: 2289892 - DNA, 12 bp, Homo sapiens
ttagtaatagat

SEQ ID NO: 2289893 - DNA, 14 bp, Homo sapiens
ttagtgaatgggaa

SEQ ID NO: 2289894 - DNA, 14 bp, Homo sapiens
ttagtttcaaaatg

SEQ ID NO: 2289895 - DNA, 18 bp, Homo sapiens
ttataaaaataaagggaa

SEQ ID NO: 2289896 - DNA, 21 bp, Homo sapiens
ttataaaaataaagggaagaa

SEQ ID NO: 2289897 - DNA, 16 bp, Homo sapiens
ttataaaatctttcca

SEQ ID NO: 2289898 - DNA, 18 bp, Homo sapiens
ttataaatgtttcatgaa

SEQ ID NO: 2289899 - DNA, 17 bp, Homo sapiens
ttataagacaaaattta

SEQ ID NO: 2289900 - DNA, 16 bp, Homo sapiens
ttataatgcatctaaa

SEQ ID NO: 2289901 - DNA, 19 bp, Homo sapiens
ttataatttccaaactgtt

SEQ ID NO: 2289902 - DNA, 14 bp, Homo sapiens
ttatactaattcag

SEQ ID NO: 2289903 - DNA, 17 bp, Homo sapiens
ttatactgtagcaatat

SEQ ID NO: 2289904 - DNA, 23 bp, Homo sapiens
ttatactgtagcaatatatttgt

SEQ ID NO: 2289905 - DNA, 18 bp, Homo sapiens
ttatagtctgtacttcag

SEQ ID NO: 2289906 - DNA, 17 bp, Homo sapiens
ttatagttgatatgtaa

SEQ ID NO: 2289907 - DNA, 13 bp, Homo sapiens
ttatataactaca

SEQ ID NO: 2289908 - DNA, 19 bp, Homo sapiens
ttatatacaaagctgtcac

SEQ ID NO: 2289909 - DNA, 15 bp, Homo sapiens
ttatatatttgaaag

SEQ ID NO: 2289910 - DNA, 16 bp, Homo sapiens
ttatattatgaataaa

SEQ ID NO: 2289911 - DNA, 20 bp, Homo sapiens
ttatattatgaataaaattg

SEQ ID NO: 2289912 - DNA, 23 bp, Homo sapiens
ttatattcagagatgtaccatgt

SEQ ID NO: 2289913 - DNA, 14 bp, Homo sapiens
ttatcaaatcattc

SEQ ID NO: 2289914 - DNA, 14 bp, Homo sapiens
ttatccccagctgt

SEQ ID NO: 2289915 - DNA, 14 bp, Homo sapiens
ttatctagcaagaa

SEQ ID NO: 2289916 - DNA, 22 bp, Homo sapiens
ttatctccagccaatttcaaag

SEQ ID NO: 2289917 - DNA, 23 bp, Homo sapiens
ttatctccagccaatttcaaaga

SEQ ID NO: 2289918 - DNA, 14 bp, Homo sapiens
ttatgaagatgttt

SEQ ID NO: 2289919 - DNA, 16 bp, Homo sapiens
ttatgaagatgttttt

SEQ ID NO: 2289920 - DNA, 13 bp, Homo sapiens
ttatgaataaaat

SEQ ID NO: 2289921 - DNA, 21 bp, Homo sapiens
ttatgactagcaaacaaaaat

SEQ ID NO: 2289922 - DNA, 22 bp, Homo sapiens
ttatgactagcaaacaaaaata

SEQ ID NO: 2289923 - DNA, 11 bp, Homo sapiens
ttatgactcca

SEQ ID NO: 2289924 - DNA, 18 bp, Homo sapiens
ttatggaacactctgaga

SEQ ID NO: 2289925 - DNA, 17 bp, Homo sapiens
ttatggagtgtcaccag

SEQ ID NO: 2289926 - DNA, 18 bp, Homo sapiens
ttatgggaatgccttttc

SEQ ID NO: 2289927 - DNA, 14 bp, Homo sapiens
ttatggtattttcg

SEQ ID NO: 2289928 - DNA, 22 bp, Homo sapiens
ttatggtattttcgtgcatttg

SEQ ID NO: 2289929 - DNA, 11 bp, Homo sapiens
ttatgtcatac

SEQ ID NO: 2289930 - DNA, 13 bp, Homo sapiens
ttatgtcatactc

SEQ ID NO: 2289931 - DNA, 14 bp, Homo sapiens
ttattatagtctgt

SEQ ID NO: 2289932 - DNA, 15 bp, Homo sapiens
ttattatatatataa

SEQ ID NO: 2289933 - DNA, 17 bp, Homo sapiens
ttattgcctctgtctta

SEQ ID NO: 2289934 - DNA, 18 bp, Homo sapiens
ttatttatattcagagat

SEQ ID NO: 2289935 - DNA, 11 bp, Homo sapiens
ttatttcatga

SEQ ID NO: 2289936 - DNA, 13 bp, Homo sapiens
ttatttctaacta

SEQ ID NO: 2289937 - DNA, 17 bp, Homo sapiens
ttatttctgcaaacaaa

SEQ ID NO: 2289938 - DNA, 13 bp, Homo sapiens
ttattttcataat

SEQ ID NO: 2289939 - DNA, 13 bp, Homo sapiens
ttattttctgaat

SEQ ID NO: 2289940 - DNA, 17 bp, Homo sapiens
ttattttgtcataaaat

SEQ ID NO: 2289941 - DNA, 20 bp, Homo sapiens
ttattttgtcataaaatgct

SEQ ID NO: 2289942 - DNA, 21 bp, Homo sapiens
ttcaaaaactgttttgggtag

SEQ ID NO: 2289943 - DNA, 17 bp, Homo sapiens
ttcaaaatagttctatt

SEQ ID NO: 2289944 - DNA, 16 bp, Homo sapiens
ttcaaacattgagact

SEQ ID NO: 2289945 - DNA, 17 bp, Homo sapiens
ttcaaacctgcaaggca

SEQ ID NO: 2289946 - DNA, 22 bp, Homo sapiens
ttcaaagatacaagaaaaagta

SEQ ID NO: 2289947 - DNA, 18 bp, Homo sapiens
ttcaaagggtaaattata

SEQ ID NO: 2289948 - DNA, 20 bp, Homo sapiens
ttcaaagggtaaattataaa

SEQ ID NO: 2289949 - DNA, 15 bp, Homo sapiens
ttcaacacttatttt

SEQ ID NO: 2289950 - DNA, 14 bp, Homo sapiens
ttcaaccctgccct

SEQ ID NO: 2289951 - DNA, 17 bp, Homo sapiens
ttcaactctgaatcaaa

SEQ ID NO: 2289952 - DNA, 14 bp, Homo sapiens
ttcaactgtatacc

SEQ ID NO: 2289953 - DNA, 16 bp, Homo sapiens
ttcaaggatcctgagc

SEQ ID NO: 2289954 - DNA, 21 bp, Homo sapiens
ttcaaggatcctgagccagat

SEQ ID NO: 2289955 - DNA, 19 bp, Homo sapiens
ttcaagtttagtgcatgca

SEQ ID NO: 2289956 - DNA, 15 bp, Homo sapiens
ttcaataggaaaaac

SEQ ID NO: 2289957 - DNA, 15 bp, Homo sapiens
ttcaatgtactgtat

SEQ ID NO: 2289958 - DNA, 16 bp, Homo sapiens
ttcaatgtactgtatt

SEQ ID NO: 2289959 - DNA, 17 bp, Homo sapiens
ttcaatgtactgtattg

SEQ ID NO: 2289960 - DNA, 14 bp, Homo sapiens
ttcacaaaatgcaa

SEQ ID NO: 2289961 - DNA, 14 bp, Homo sapiens
ttcacaaatatagt

SEQ ID NO: 2289962 - DNA, 17 bp, Homo sapiens
ttcacagagactgtttg

SEQ ID NO: 2289963 - DNA, 13 bp, Homo sapiens
ttcacatctgtat

SEQ ID NO: 2289964 - DNA, 14 bp, Homo sapiens
ttcacccaccatgc

SEQ ID NO: 2289965 - DNA, 13 bp, Homo sapiens
ttcacccttttct

SEQ ID NO: 2289966 - DNA, 17 bp, Homo sapiens
ttcacctgaaacacttt

SEQ ID NO: 2289967 - DNA, 12 bp, Homo sapiens
ttcacctgggat

SEQ ID NO: 2289968 - DNA, 14 bp, Homo sapiens
ttcacttactctta

SEQ ID NO: 2289969 - DNA, 19 bp, Homo sapiens
ttcagaaaagacacttcaa

SEQ ID NO: 2289970 - DNA, 19 bp, Homo sapiens
ttcagaaatctggagctgg

SEQ ID NO: 2289971 - DNA, 20 bp, Homo sapiens
ttcagcatctaaagcagcag

SEQ ID NO: 2289972 - DNA, 13 bp, Homo sapiens
ttcagcatggttt

SEQ ID NO: 2289973 - DNA, 19 bp, Homo sapiens
ttcagccaagaattcttaa

SEQ ID NO: 2289974 - DNA, 11 bp, Homo sapiens
ttcagcccctg

SEQ ID NO: 2289975 - DNA, 15 bp, Homo sapiens
ttcagcttgtttcta

SEQ ID NO: 2289976 - DNA, 19 bp, Homo sapiens
ttcagcttgtttctatact

SEQ ID NO: 2289977 - DNA, 11 bp, Homo sapiens
ttcaggaaagt

SEQ ID NO: 2289978 - DNA, 19 bp, Homo sapiens
ttcaggaggagacagtcag

SEQ ID NO: 2289979 - DNA, 20 bp, Homo sapiens
ttcaggaggagacagtcagg

SEQ ID NO: 2289980 - DNA, 19 bp, Homo sapiens
ttcagtcctgggcaaaggt

SEQ ID NO: 2289981 - DNA, 18 bp, Homo sapiens
ttcagtgccttatggaac

SEQ ID NO: 2289982 - DNA, 12 bp, Homo sapiens
ttcataaaaaat

SEQ ID NO: 2289983 - DNA, 15 bp, Homo sapiens
ttcatactcaaagag

SEQ ID NO: 2289984 - DNA, 13 bp, Homo sapiens
ttcatataatttg

SEQ ID NO: 2289985 - DNA, 15 bp, Homo sapiens
ttcatattgagatca

SEQ ID NO: 2289986 - DNA, 23 bp, Homo sapiens
ttcatgaagaaaaaattttaaaa

SEQ ID NO: 2289987 - DNA, 20 bp, Homo sapiens
ttcatggaccactgtttctt

SEQ ID NO: 2289988 - DNA, 14 bp, Homo sapiens
ttcatgtacaatga

SEQ ID NO: 2289989 - DNA, 16 bp, Homo sapiens
ttcatgtactaccctc

SEQ ID NO: 2289990 - DNA, 14 bp, Homo sapiens
ttcattaataaaat

SEQ ID NO: 2289991 - DNA, 14 bp, Homo sapiens
ttcattattttccc

SEQ ID NO: 2289992 - DNA, 13 bp, Homo sapiens
ttcatttaagaac

SEQ ID NO: 2289993 - DNA, 20 bp, Homo sapiens
ttcatttacaacttccagat

SEQ ID NO: 2289994 - DNA, 17 bp, Homo sapiens
ttccaaactgttgtcta

SEQ ID NO: 2289995 - DNA, 14 bp, Homo sapiens
ttccaaatattcta

SEQ ID NO: 2289996 - DNA, 15 bp, Homo sapiens
ttccaaatattctaa

SEQ ID NO: 2289997 - DNA, 13 bp, Homo sapiens
ttccaagggccca

SEQ ID NO: 2289998 - DNA, 18 bp, Homo sapiens
ttccaagggcccagaggg

SEQ ID NO: 2289999 - DNA, 13 bp, Homo sapiens
ttccacacaggcc

SEQ ID NO: 2290000 - DNA, 16 bp, Homo sapiens
ttccacacaggcccat

SEQ ID NO: 2290001 - DNA, 16 bp, Homo sapiens
ttccacacatttccct

SEQ ID NO: 2290002 - DNA, 22 bp, Homo sapiens
tgtacagaaaatagcttttatt

SEQ ID NO: 2290003 - DNA, 23 bp, Homo sapiens
tgtacagaaccagcactcccagg

SEQ ID NO: 2290004 - DNA, 15 bp, Homo sapiens
tgtacagttatacat

SEQ ID NO: 2290005 - DNA, 19 bp, Homo sapiens
tgtacatcagacagaaggg

SEQ ID NO: 2290006 - DNA, 16 bp, Homo sapiens
tgtaccagcccaggca

SEQ ID NO: 2290007 - DNA, 17 bp, Homo sapiens
tgtaccatgttgcccag

SEQ ID NO: 2290008 - DNA, 18 bp, Homo sapiens
tgtaccctccatgtacct

SEQ ID NO: 2290009 - DNA, 14 bp, Homo sapiens
tgtacgtctggtgt

SEQ ID NO: 2290010 - DNA, 20 bp, Homo sapiens
tgtactacacttctgaaact

SEQ ID NO: 2290011 - DNA, 17 bp, Homo sapiens
tgtactaccctcagtct

SEQ ID NO: 2290012 - DNA, 18 bp, Homo sapiens
tgtactagtactgtgtac

SEQ ID NO: 2290013 - DNA, 19 bp, Homo sapiens
tgtactagtactgtgtact

SEQ ID NO: 2290014 - DNA, 17 bp, Homo sapiens
tgtactcactgagtaac

SEQ ID NO: 2290015 - DNA, 23 bp, Homo sapiens
tgtacttacactgaaatccaaaa

SEQ ID NO: 2290016 - DNA, 16 bp, Homo sapiens
tgtacttcagttctca

SEQ ID NO: 2290017 - DNA, 24 bp, Homo sapiens
tgtacttcagttctcatcttgtaa

SEQ ID NO: 2290018 - DNA, 14 bp, Homo sapiens
tgtacttgaataat

SEQ ID NO: 2290019 - DNA, 16 bp, Homo sapiens
tgtacttgaataataa

SEQ ID NO: 2290020 - DNA, 17 bp, Homo sapiens
tgtacttttccatttat

SEQ ID NO: 2290021 - DNA, 22 bp, Homo sapiens
tgtagaactgttcatttccacc

SEQ ID NO: 2290022 - DNA, 23 bp, Homo sapiens
tgtagagacagggtctcactgtg

SEQ ID NO: 2290023 - DNA, 19 bp, Homo sapiens
tgtagatatatatttccaa

SEQ ID NO: 2290024 - DNA, 20 bp, Homo sapiens
tgtagatattatgtatagaa

SEQ ID NO: 2290025 - DNA, 18 bp, Homo sapiens
tgtagcattaaatataaa

SEQ ID NO: 2290026 - DNA, 20 bp, Homo sapiens
tgtagcattaaatataaaat

SEQ ID NO: 2290027 - DNA, 18 bp, Homo sapiens
tgtaggtaagttggctca

SEQ ID NO: 2290028 - DNA, 16 bp, Homo sapiens
tgtaggtatactatgt

SEQ ID NO: 2290029 - DNA, 17 bp, Homo sapiens
tgtaggtatactatgta

SEQ ID NO: 2290030 - DNA, 18 bp, Homo sapiens
tgtaggtcaatgaaatat

SEQ ID NO: 2290031 - DNA, 21 bp, Homo sapiens
tgtaggtcaatgaaatatttg

SEQ ID NO: 2290032 - DNA, 14 bp, Homo sapiens
tgtagtaattgtta

SEQ ID NO: 2290033 - DNA, 15 bp, Homo sapiens
tgtagtagttgatga

SEQ ID NO: 2290034 - DNA, 20 bp, Homo sapiens
tgtatagtgagtgtggctta

SEQ ID NO: 2290035 - DNA, 11 bp, Homo sapiens
tgtatatcagc

SEQ ID NO: 2290036 - DNA, 19 bp, Homo sapiens
tgtatatcagctctaaagc

SEQ ID NO: 2290037 - DNA, 23 bp, Homo sapiens
tgtatatcagctctaaagcagag

SEQ ID NO: 2290038 - DNA, 14 bp, Homo sapiens
tgtatatgtcaaaa

SEQ ID NO: 2290039 - DNA, 16 bp, Homo sapiens
tgtatattattgctat

SEQ ID NO: 2290040 - DNA, 19 bp, Homo sapiens
tgtatcctggcaaataata

SEQ ID NO: 2290041 - DNA, 16 bp, Homo sapiens
tgtatctaaaaaataa

SEQ ID NO: 2290042 - DNA, 17 bp, Homo sapiens
tgtatcttatttatata

SEQ ID NO: 2290043 - DNA, 19 bp, Homo sapiens
tgtatgactgaagtaataa

SEQ ID NO: 2290044 - DNA, 18 bp, Homo sapiens
tgtattattgctgttgct

SEQ ID NO: 2290045 - DNA, 20 bp, Homo sapiens
tgtattcttttatataacta

SEQ ID NO: 2290046 - DNA, 15 bp, Homo sapiens
tgtatttatattaga

SEQ ID NO: 2290047 - DNA, 15 bp, Homo sapiens
tgtatttccaacaaa

SEQ ID NO: 2290048 - DNA, 19 bp, Homo sapiens
tgtatttgaagactgattt

SEQ ID NO: 2290049 - DNA, 20 bp, Homo sapiens
tgtatttgaagactgatttt

SEQ ID NO: 2290050 - DNA, 20 bp, Homo sapiens
tgtattttcaataaagaaaa

SEQ ID NO: 2290051 - DNA, 22 bp, Homo sapiens
tgtattttcttcccatttgtaa

SEQ ID NO: 2290052 - DNA, 21 bp, Homo sapiens
tgtattttcttttatatctgt

SEQ ID NO: 2290053 - DNA, 14 bp, Homo sapiens
tgtcaaaaatattt

SEQ ID NO: 2290054 - DNA, 17 bp, Homo sapiens
tgtcaattacaggaagt

SEQ ID NO: 2290055 - DNA, 17 bp, Homo sapiens
tgtcaccagctgccaaa

SEQ ID NO: 2290056 - DNA, 18 bp, Homo sapiens
tgtcaccagctgccaaaa

SEQ ID NO: 2290057 - DNA, 19 bp, Homo sapiens
tgtcagcgtttctccacct

SEQ ID NO: 2290058 - DNA, 13 bp, Homo sapiens
tgtcagtctgtcc

SEQ ID NO: 2290059 - DNA, 15 bp, Homo sapiens
tgtcagtctgtccac

SEQ ID NO: 2290060 - DNA, 12 bp, Homo sapiens
tgtcagtgtgac

SEQ ID NO: 2290061 - DNA, 17 bp, Homo sapiens
tgtcataaaatgctatt

SEQ ID NO: 2290062 - DNA, 20 bp, Homo sapiens
tgtcataaaatgctatttta

SEQ ID NO: 2290063 - DNA, 19 bp, Homo sapiens
tgtcataatctctttccat

SEQ ID NO: 2290064 - DNA, 19 bp, Homo sapiens
tgtcatgatttcaatgatt

SEQ ID NO: 2290065 - DNA, 14 bp, Homo sapiens
tgtcattctgctaa

SEQ ID NO: 2290066 - DNA, 16 bp, Homo sapiens
tgtcattctgctaatt

SEQ ID NO: 2290067 - DNA, 22 bp, Homo sapiens
tgtcattggttacaaattttta

SEQ ID NO: 2290068 - DNA, 16 bp, Homo sapiens
tgtcattttatgctaa

SEQ ID NO: 2290069 - DNA, 14 bp, Homo sapiens
tgtccacgtggaga

SEQ ID NO: 2290070 - DNA, 21 bp, Homo sapiens
tgtccactctgctcagggccg

SEQ ID NO: 2290071 - DNA, 15 bp, Homo sapiens
tgtccagtccagtga

SEQ ID NO: 2290072 - DNA, 17 bp, Homo sapiens
tgtccataagagaaatg

SEQ ID NO: 2290073 - DNA, 16 bp, Homo sapiens
tgtccatgtgaaattt

SEQ ID NO: 2290074 - DNA, 15 bp, Homo sapiens
tgtcccatgggctct

SEQ ID NO: 2290075 - DNA, 20 bp, Homo sapiens
tgtcccatgggctctggccc

SEQ ID NO: 2290076 - DNA, 17 bp, Homo sapiens
tgtccccaggggcacac

SEQ ID NO: 2290077 - DNA, 13 bp, Homo sapiens
tgtcccctgcctg

SEQ ID NO: 2290078 - DNA, 18 bp, Homo sapiens
tgtcccctggtgcccctc

SEQ ID NO: 2290079 - DNA, 19 bp, Homo sapiens
tgtcccttacgtgagtcct

SEQ ID NO: 2290080 - DNA, 13 bp, Homo sapiens
tgtccctttcaca

SEQ ID NO: 2290081 - DNA, 20 bp, Homo sapiens
tgtcctcatctataaaatga

SEQ ID NO: 2290082 - DNA, 22 bp, Homo sapiens
tgtcctggaagtgtgtgtttct

SEQ ID NO: 2290083 - DNA, 20 bp, Homo sapiens
tgtcctggtcagttttcaca

SEQ ID NO: 2290084 - DNA, 17 bp, Homo sapiens
tgtcgtctttttccaaa

SEQ ID NO: 2290085 - DNA, 13 bp, Homo sapiens
tgtctactgcttg

SEQ ID NO: 2290086 - DNA, 15 bp, Homo sapiens
tgtctagtttgcata

SEQ ID NO: 2290087 - DNA, 15 bp, Homo sapiens
tgtctatgaactaga

SEQ ID NO: 2290088 - DNA, 14 bp, Homo sapiens
tgtctcttccatgc

SEQ ID NO: 2290089 - DNA, 12 bp, Homo sapiens
tgtctgattcta

SEQ ID NO: 2290090 - DNA, 13 bp, Homo sapiens
tgtctgattctat

SEQ ID NO: 2290091 - DNA, 14 bp, Homo sapiens
tgtctgattctatg

SEQ ID NO: 2290092 - DNA, 15 bp, Homo sapiens
tgtctgattctatgc

SEQ ID NO: 2290093 - DNA, 15 bp, Homo sapiens
tgtctgcacagggtc

SEQ ID NO: 2290094 - DNA, 17 bp, Homo sapiens
tgtctgctaccagggct

SEQ ID NO: 2290095 - DNA, 19 bp, Homo sapiens
tgtctgttctaagtccact

SEQ ID NO: 2290096 - DNA, 14 bp, Homo sapiens
tgtcttaaagaatt

SEQ ID NO: 2290097 - DNA, 19 bp, Homo sapiens
tgtcttcaaccctgccctg

SEQ ID NO: 2290098 - DNA, 21 bp, Homo sapiens
tgtcttcaaccctgccctgca

SEQ ID NO: 2290099 - DNA, 22 bp, Homo sapiens
tgtcttcaaccctgccctgcac

SEQ ID NO: 2290100 - DNA, 23 bp, Homo sapiens
tgtcttcaaccctgccctgcacc

SEQ ID NO: 2290101 - DNA, 14 bp, Homo sapiens
tgtcttgtaggtaa

SEQ ID NO: 2290102 - DNA, 23 bp, Homo sapiens
tgtcttgtaggtaagttggctca

SEQ ID NO: 2290103 - DNA, 18 bp, Homo sapiens
tgtgaagtccacttatgt

SEQ ID NO: 2290104 - DNA, 20 bp, Homo sapiens
tgtgaattttaaaatgcaaa

SEQ ID NO: 2290105 - DNA, 21 bp, Homo sapiens
tgtgaattttaaaatgcaaat

SEQ ID NO: 2290106 - DNA, 13 bp, Homo sapiens
tgtgacaagccaa

SEQ ID NO: 2290107 - DNA, 17 bp, Homo sapiens
tgtgaccctcaattcat

SEQ ID NO: 2290108 - DNA, 15 bp, Homo sapiens
tgtgacctgacacct

SEQ ID NO: 2290109 - DNA, 21 bp, Homo sapiens
tgtgacctgacacctgccgct

SEQ ID NO: 2290110 - DNA, 16 bp, Homo sapiens
tgtgactgatctctcg

SEQ ID NO: 2290111 - DNA, 19 bp, Homo sapiens
tgtgagccaaagagaaaag

SEQ ID NO: 2290112 - DNA, 16 bp, Homo sapiens
tgtgagccacagcact

SEQ ID NO: 2290113 - DNA, 13 bp, Homo sapiens
tgtgatcccagct

SEQ ID NO: 2290114 - DNA, 14 bp, Homo sapiens
tgtgatcccagctc

SEQ ID NO: 2290115 - DNA, 19 bp, Homo sapiens
tgtgatctaagcagttgca

SEQ ID NO: 2290116 - DNA, 14 bp, Homo sapiens
tgtgatctgtcttg

SEQ ID NO: 2290117 - DNA, 20 bp, Homo sapiens
tgtgatctgtcttgtaatat

SEQ ID NO: 2290118 - DNA, 19 bp, Homo sapiens
tgtgatgagaggaaatcac

SEQ ID NO: 2290119 - DNA, 19 bp, Homo sapiens
tgtgcaaaataaaatgagt

SEQ ID NO: 2290120 - DNA, 19 bp, Homo sapiens
tgtgcaatatgtaacatgt

SEQ ID NO: 2290121 - DNA, 12 bp, Homo sapiens
tgtgcagacact

SEQ ID NO: 2290122 - DNA, 21 bp, Homo sapiens
tgtgcagacactcaagagccc

SEQ ID NO: 2290123 - DNA, 22 bp, Homo sapiens
tgtgccaggagtgggtgggaca

SEQ ID NO: 2290124 - DNA, 14 bp, Homo sapiens
tgtgctagaagctc

SEQ ID NO: 2290125 - DNA, 22 bp, Homo sapiens
tgtgctccagtgttttcttgtg

SEQ ID NO: 2290126 - DNA, 23 bp, Homo sapiens
tgtgctctcctagagctctgtct

SEQ ID NO: 2290127 - DNA, 19 bp, Homo sapiens
tgtgctcttatccccagct

SEQ ID NO: 2290128 - DNA, 13 bp, Homo sapiens
tgtgcttatgttt

SEQ ID NO: 2290129 - DNA, 14 bp, Homo sapiens
tgtgctttcatgtt

SEQ ID NO: 2290130 - DNA, 17 bp, Homo sapiens
tgtggaaatatgcaacc

SEQ ID NO: 2290131 - DNA, 23 bp, Homo sapiens
tgtggaaatgggacggaggtcct

SEQ ID NO: 2290132 - DNA, 15 bp, Homo sapiens
tgtggaacactaaag

SEQ ID NO: 2290133 - DNA, 20 bp, Homo sapiens
tgtggaacactaaagagcta

SEQ ID NO: 2290134 - DNA, 19 bp, Homo sapiens
tgtggagctgcttccagtt

SEQ ID NO: 2290135 - DNA, 13 bp, Homo sapiens
tgtggatgctctt

SEQ ID NO: 2290136 - DNA, 13 bp, Homo sapiens
tgtggattctata

SEQ ID NO: 2290137 - DNA, 18 bp, Homo sapiens
tgtggattctatatttca

SEQ ID NO: 2290138 - DNA, 15 bp, Homo sapiens
ttttatatctgtaaa

SEQ ID NO: 2290139 - DNA, 17 bp, Homo sapiens
ttttatgtcatactctg

SEQ ID NO: 2290140 - DNA, 23 bp, Homo sapiens
ttttcaataaagaaaaaaatagt

SEQ ID NO: 2290141 - DNA, 18 bp, Homo sapiens
ttttcaatgtactgtatt

SEQ ID NO: 2290142 - DNA, 21 bp, Homo sapiens
ttttcagcttgtttctatact

SEQ ID NO: 2290143 - DNA, 15 bp, Homo sapiens
ttttcataattcatt

SEQ ID NO: 2290144 - DNA, 17 bp, Homo sapiens
ttttcataattcattta

SEQ ID NO: 2290145 - DNA, 22 bp, Homo sapiens
ttttccatatagtttgttttct

SEQ ID NO: 2290146 - DNA, 15 bp, Homo sapiens
ttttccatctaaaat

SEQ ID NO: 2290147 - DNA, 14 bp, Homo sapiens
ttttcgtgcatttg

SEQ ID NO: 2290148 - DNA, 12 bp, Homo sapiens
ttttctaaactg

SEQ ID NO: 2290149 - DNA, 13 bp, Homo sapiens
ttttctacagctt

SEQ ID NO: 2290150 - DNA, 23 bp, Homo sapiens
ttttctactcgagttacagacaa

SEQ ID NO: 2290151 - DNA, 21 bp, Homo sapiens
ttttctagctataacaactct

SEQ ID NO: 2290152 - DNA, 14 bp, Homo sapiens
ttttctatatttgg

SEQ ID NO: 2290153 - DNA, 18 bp, Homo sapiens
ttttctatgtactagtac

SEQ ID NO: 2290154 - DNA, 13 bp, Homo sapiens
ttttctcaaaaag

SEQ ID NO: 2290155 - DNA, 17 bp, Homo sapiens
ttttctcaaaaagctgc

SEQ ID NO: 2290156 - DNA, 21 bp, Homo sapiens
ttttctcgagtccaaaatcat

SEQ ID NO: 2290157 - DNA, 22 bp, Homo sapiens
ttttctcgagtccaaaatcatt

SEQ ID NO: 2290158 - DNA, 13 bp, Homo sapiens
ttttctctgatca

SEQ ID NO: 2290159 - DNA, 19 bp, Homo sapiens
ttttctctgatcacaactt

SEQ ID NO: 2290160 - DNA, 22 bp, Homo sapiens
ttttcttgtgttgttttctctg

SEQ ID NO: 2290161 - DNA, 14 bp, Homo sapiens
ttttctttctatgt

SEQ ID NO: 2290162 - DNA, 18 bp, Homo sapiens
ttttctttctatgtagaa

SEQ ID NO: 2290163 - DNA, 16 bp, Homo sapiens
ttttcttttatatctg

SEQ ID NO: 2290164 - DNA, 17 bp, Homo sapiens
ttttcttttatatctgt

SEQ ID NO: 2290165 - DNA, 16 bp, Homo sapiens
ttttgaaatttaaaaa

SEQ ID NO: 2290166 - DNA, 18 bp, Homo sapiens
ttttgaagaagggaaatt

SEQ ID NO: 2290167 - DNA, 20 bp, Homo sapiens
ttttgaagaagggaaattca

SEQ ID NO: 2290168 - DNA, 15 bp, Homo sapiens
ttttgaagtcttgta

SEQ ID NO: 2290169 - DNA, 21 bp, Homo sapiens
ttttgagtgtgcaatatgtaa

SEQ ID NO: 2290170 - DNA, 20 bp, Homo sapiens
ttttgcatttctcttcctaa

SEQ ID NO: 2290171 - DNA, 13 bp, Homo sapiens
ttttgtaaccata

SEQ ID NO: 2290172 - DNA, 23 bp, Homo sapiens
ttttgtaaccatatgattgaaaa

SEQ ID NO: 2290173 - DNA, 21 bp, Homo sapiens
ttttgtagtagttgatgacca

SEQ ID NO: 2290174 - DNA, 23 bp, Homo sapiens
ttttgtcataaaatgctatttta

SEQ ID NO: 2290175 - DNA, 20 bp, Homo sapiens
ttttgtggctgatttcaaat

SEQ ID NO: 2290176 - DNA, 13 bp, Homo sapiens
ttttgtgtattct

SEQ ID NO: 2290177 - DNA, 11 bp, Homo sapiens
tttttaaatgt

SEQ ID NO: 2290178 - DNA, 16 bp, Homo sapiens
tttttactcaggcttt

SEQ ID NO: 2290179 - DNA, 19 bp, Homo sapiens
tttttagagattaatttgt

SEQ ID NO: 2290180 - DNA, 21 bp, Homo sapiens
tttttatataatatgaatata

SEQ ID NO: 2290181 - DNA, 16 bp, Homo sapiens
tttttcaccctatttt

SEQ ID NO: 2290182 - DNA, 13 bp, Homo sapiens
tttttcttttgta

SEQ ID NO: 2290183 - DNA, 21 bp, Homo sapiens
tttttgaagaagggaaattca

SEQ ID NO: 2290184 - DNA, 20 bp, Homo sapiens
tttttgaagtctccttttgt

SEQ ID NO: 2290185 - DNA, 18 bp, Homo sapiens
tttttggtatggtaaaga

SEQ ID NO: 2290186 - DNA, 13 bp, Homo sapiens
ttttttaaaattg

SEQ ID NO: 2290187 - DNA, 13 bp, Homo sapiens
ttttttcaatgta

SEQ ID NO: 2290188 - DNA, 10 bp, Homo sapiens
ttttttgaag

SEQ ID NO: 2290189 - DNA, 23 bp, Homo sapiens
gctgcctccaagtcatgggagaa

SEQ ID NO: 2290190 - DNA, 14 bp, Homo sapiens
gctgcctctgaaaa

SEQ ID NO: 2290191 - DNA, 11 bp, Homo sapiens
gctgcctggcg

SEQ ID NO: 2290192 - DNA, 15 bp, Homo sapiens
gctgcctggcgggca

SEQ ID NO: 2290193 - DNA, 16 bp, Homo sapiens
gctgcctggcgggcag

SEQ ID NO: 2290194 - DNA, 21 bp, Homo sapiens
gctgcctggcgggcagcccct

SEQ ID NO: 2290195 - DNA, 22 bp, Homo sapiens
gctgcctggcgggcagcccctg

SEQ ID NO: 2290196 - DNA, 15 bp, Homo sapiens
gctgctcatttcact

SEQ ID NO: 2290197 - DNA, 19 bp, Homo sapiens
gctgctcctcggccagagc

SEQ ID NO: 2290198 - DNA, 18 bp, Homo sapiens
gctgctcgggaaggcctg

SEQ ID NO: 2290199 - DNA, 14 bp, Homo sapiens
gctgctctccatct

SEQ ID NO: 2290200 - DNA, 20 bp, Homo sapiens
gctgctggtcacccccaccc

SEQ ID NO: 2290201 - DNA, 21 bp, Homo sapiens
gctgcttcaaggatcctgagc

SEQ ID NO: 2290202 - DNA, 18 bp, Homo sapiens
gctggaagaacccttctc

SEQ ID NO: 2290203 - DNA, 19 bp, Homo sapiens
gctggaatgggggccaggc

SEQ ID NO: 2290204 - DNA, 22 bp, Homo sapiens
gctggactgggtgggccccaca

SEQ ID NO: 2290205 - DNA, 22 bp, Homo sapiens
gctggagcagtttggggcaggg

SEQ ID NO: 2290206 - DNA, 23 bp, Homo sapiens
gctggagcagtttggggcagggg

SEQ ID NO: 2290207 - DNA, 20 bp, Homo sapiens
gctggagtgaagtggtgtga

SEQ ID NO: 2290208 - DNA, 13 bp, Homo sapiens
gctggcagcgcct

SEQ ID NO: 2290209 - DNA, 19 bp, Homo sapiens
gctggcagcgcctcccgcc

SEQ ID NO: 2290210 - DNA, 16 bp, Homo sapiens
gctggccctgccctcc

SEQ ID NO: 2290211 - DNA, 18 bp, Homo sapiens
gctggccctgccctcccc

SEQ ID NO: 2290212 - DNA, 19 bp, Homo sapiens
gctggccggtccaccccgt

SEQ ID NO: 2290213 - DNA, 22 bp, Homo sapiens
gctggccggtccaccccgtccc

SEQ ID NO: 2290214 - DNA, 19 bp, Homo sapiens
gctggcggccatccccgtg

SEQ ID NO: 2290215 - DNA, 12 bp, Homo sapiens
gctggctgatca

SEQ ID NO: 2290216 - DNA, 16 bp, Homo sapiens
gctgggactagaggca

SEQ ID NO: 2290217 - DNA, 17 bp, Homo sapiens
gctgggactagaggcac

SEQ ID NO: 2290218 - DNA, 14 bp, Homo sapiens
gctgggcagggccc

SEQ ID NO: 2290219 - DNA, 16 bp, Homo sapiens
gctgggcagggccctg

SEQ ID NO: 2290220 - DNA, 23 bp, Homo sapiens
gctgggcagggccgcagggcgct

SEQ ID NO: 2290221 - DNA, 15 bp, Homo sapiens
gctgggccagtggac

SEQ ID NO: 2290222 - DNA, 19 bp, Homo sapiens
gctgggtcgcccctcctcg

SEQ ID NO: 2290223 - DNA, 23 bp, Homo sapiens
gctggtcgtaaacatctcagaga

SEQ ID NO: 2290224 - DNA, 22 bp, Homo sapiens
gctggtcttgaactcttggcct

SEQ ID NO: 2290225 - DNA, 23 bp, Homo sapiens
gctggtgggggcatccttgagga

SEQ ID NO: 2290226 - DNA, 14 bp, Homo sapiens
gctggttgtcttta

SEQ ID NO: 2290227 - DNA, 13 bp, Homo sapiens
gctgtacatcaga

SEQ ID NO: 2290228 - DNA, 21 bp, Homo sapiens
gctgtattttcttttatatct

SEQ ID NO: 2290229 - DNA, 22 bp, Homo sapiens
gctgtattttcttttatatctg

SEQ ID NO: 2290230 - DNA, 18 bp, Homo sapiens
gctgtatttttgaaatac

SEQ ID NO: 2290231 - DNA, 23 bp, Homo sapiens
gctgtgacaagccaatgtgaatt

SEQ ID NO: 2290232 - DNA, 19 bp, Homo sapiens
gctgtgaccctcaattcat

SEQ ID NO: 2290233 - DNA, 18 bp, Homo sapiens
gctgttccacttctctag

SEQ ID NO: 2290234 - DNA, 14 bp, Homo sapiens
gcttaacataaact

SEQ ID NO: 2290235 - DNA, 21 bp, Homo sapiens
gcttaaggaaaagagaaacac

SEQ ID NO: 2290236 - DNA, 22 bp, Homo sapiens
gcttatcagaactcctttctaa

SEQ ID NO: 2290237 - DNA, 12 bp, Homo sapiens
gcttatttctaa

SEQ ID NO: 2290238 - DNA, 17 bp, Homo sapiens
gcttccagctcagtccc

SEQ ID NO: 2290239 - DNA, 20 bp, Homo sapiens
gcttcccctaacctgggttg

SEQ ID NO: 2290240 - DNA, 21 bp, Homo sapiens
gcttcctagaaagttctgtgt

SEQ ID NO: 2290241 - DNA, 19 bp, Homo sapiens
gcttcctccggctggacct

SEQ ID NO: 2290242 - DNA, 17 bp, Homo sapiens
gcttccttttcagcatg

SEQ ID NO: 2290243 - DNA, 22 bp, Homo sapiens
gcttctaagggatccagagacc

SEQ ID NO: 2290244 - DNA, 22 bp, Homo sapiens
gcttctccctggactctgtggg

SEQ ID NO: 2290245 - DNA, 22 bp, Homo sapiens
gcttgaatgtccccattctata

SEQ ID NO: 2290246 - DNA, 15 bp, Homo sapiens
gcttgagtggacagc

SEQ ID NO: 2290247 - DNA, 18 bp, Homo sapiens
gcttgagtggacagcagc

SEQ ID NO: 2290248 - DNA, 15 bp, Homo sapiens
gcttgatataataat

SEQ ID NO: 2290249 - DNA, 11 bp, Homo sapiens
gcttggagcag

SEQ ID NO: 2290250 - DNA, 15 bp, Homo sapiens
gcttggagcagagac

SEQ ID NO: 2290251 - DNA, 20 bp, Homo sapiens
gcttggagcagagacggcag

SEQ ID NO: 2290252 - DNA, 21 bp, Homo sapiens
gcttggagcagagacggcagc

SEQ ID NO: 2290253 - DNA, 23 bp, Homo sapiens
gcttggagcagagacggcagccc

SEQ ID NO: 2290254 - DNA, 16 bp, Homo sapiens
gcttggagcagaggtg

SEQ ID NO: 2290255 - DNA, 19 bp, Homo sapiens
gcttggcttatgaaaacac

SEQ ID NO: 2290256 - DNA, 18 bp, Homo sapiens
gcttgtacctctggctga

SEQ ID NO: 2290257 - DNA, 22 bp, Homo sapiens
gcttgtacctctggctgactaa

SEQ ID NO: 2290258 - DNA, 21 bp, Homo sapiens
gcttgtccaacaactccagga

SEQ ID NO: 2290259 - DNA, 21 bp, Homo sapiens
gcttgtggtcacactgtggaa

SEQ ID NO: 2290260 - DNA, 13 bp, Homo sapiens
gcttgtttctata

SEQ ID NO: 2290261 - DNA, 23 bp, Homo sapiens
gctttagattgaaatttatgact

SEQ ID NO: 2290262 - DNA, 15 bp, Homo sapiens
gctttataacaaatg

SEQ ID NO: 2290263 - DNA, 17 bp, Homo sapiens
gctttatgaagttaaca

SEQ ID NO: 2290264 - DNA, 19 bp, Homo sapiens
gctttatgcaggattctct

SEQ ID NO: 2290265 - DNA, 18 bp, Homo sapiens
gctttattgcctctgtct

SEQ ID NO: 2290266 - DNA, 22 bp, Homo sapiens
gctttattgcctctgtcttaaa

SEQ ID NO: 2290267 - DNA, 13 bp, Homo sapiens
gctttcacaaata

SEQ ID NO: 2290268 - DNA, 19 bp, Homo sapiens
gctttcatccaactggaag

SEQ ID NO: 2290269 - DNA, 15 bp, Homo sapiens
gctttcctgtttcca

SEQ ID NO: 2290270 - DNA, 21 bp, Homo sapiens
gcttttattgagtaatattac

SEQ ID NO: 2290271 - DNA, 21 bp, Homo sapiens
gctttttccatatagtttgtt

SEQ ID NO: 2290272 - DNA, 15 bp, Homo sapiens
ggaaacagaggacca

SEQ ID NO: 2290273 - DNA, 17 bp, Homo sapiens
ggaaacagaggaccagc

SEQ ID NO: 2290274 - DNA, 14 bp, Homo sapiens
ggaaagggagaggg

SEQ ID NO: 2290275 - DNA, 21 bp, Homo sapiens
ggaaatacactacaaatgtta

SEQ ID NO: 2290276 - DNA, 23 bp, Homo sapiens
ggaaatcaccgaaaacgtggctg

SEQ ID NO: 2290277 - DNA, 13 bp, Homo sapiens
ggaaatcctgtta

SEQ ID NO: 2290278 - DNA, 21 bp, Homo sapiens
ggaaatgcaaaccatcattta

SEQ ID NO: 2290279 - DNA, 15 bp, Homo sapiens
ggaacaaggcaaggc

SEQ ID NO: 2290280 - DNA, 17 bp, Homo sapiens
ggaacaaggcaaggctg

SEQ ID NO: 2290281 - DNA, 23 bp, Homo sapiens
ggaacaaggcaaggctgtcaatt

SEQ ID NO: 2290282 - DNA, 16 bp, Homo sapiens
ggaacacccagcccca

SEQ ID NO: 2290283 - DNA, 18 bp, Homo sapiens
ggaacagagtatatatgt

SEQ ID NO: 2290284 - DNA, 15 bp, Homo sapiens
ggaaccgaggactcc

SEQ ID NO: 2290285 - DNA, 12 bp, Homo sapiens
ggaagacagaga

SEQ ID NO: 2290286 - DNA, 15 bp, Homo sapiens
ggaagacgcagagca

SEQ ID NO: 2290287 - DNA, 14 bp, Homo sapiens
ggaagagagaggcc

SEQ ID NO: 2290288 - DNA, 15 bp, Homo sapiens
ggaagagagaggcct

SEQ ID NO: 2290289 - DNA, 17 bp, Homo sapiens
ggaagagagaggcctgg

SEQ ID NO: 2290290 - DNA, 18 bp, Homo sapiens
ggaagagagaggcctggg

SEQ ID NO: 2290291 - DNA, 15 bp, Homo sapiens
ggaagagatgctcta

SEQ ID NO: 2290292 - DNA, 15 bp, Homo sapiens
ggaagagccagccgt

SEQ ID NO: 2290293 - DNA, 21 bp, Homo sapiens
ggaagaggggcgctgccccca

SEQ ID NO: 2290294 - DNA, 23 bp, Homo sapiens
ggaagcactgccattagactgaa

SEQ ID NO: 2290295 - DNA, 12 bp, Homo sapiens
ggaagcccaccc

SEQ ID NO: 2290296 - DNA, 14 bp, Homo sapiens
ggaagcccacccgc

SEQ ID NO: 2290297 - DNA, 15 bp, Homo sapiens
ggaagcccacccgcc

SEQ ID NO: 2290298 - DNA, 17 bp, Homo sapiens
ggaagcccacccgcccc

SEQ ID NO: 2290299 - DNA, 22 bp, Homo sapiens
ggaagcccacccgccccagaga

SEQ ID NO: 2290300 - DNA, 15 bp, Homo sapiens
ggaagctgcctggtg

SEQ ID NO: 2290301 - DNA, 22 bp, Homo sapiens
ggaagctggcaggagacactgg

SEQ ID NO: 2290302 - DNA, 21 bp, Homo sapiens
ggaaggaaatcccatcagtga

SEQ ID NO: 2290303 - DNA, 16 bp, Homo sapiens
ggaaggcctgagggaa

SEQ ID NO: 2290304 - DNA, 22 bp, Homo sapiens
ggaaggcctgagggaagcccac

SEQ ID NO: 2290305 - DNA, 13 bp, Homo sapiens
ggaaggctttatt

SEQ ID NO: 2290306 - DNA, 15 bp, Homo sapiens
ggaagggcaggagct

SEQ ID NO: 2290307 - DNA, 19 bp, Homo sapiens
ggaagggcaggagctcaca

SEQ ID NO: 2290308 - DNA, 19 bp, Homo sapiens
ggaagggtccaccctagcc

SEQ ID NO: 2290309 - DNA, 22 bp, Homo sapiens
ggaatatacatgtaaaaatgtt

SEQ ID NO: 2290310 - DNA, 21 bp, Homo sapiens
ggaatcccacttatcaaatca

SEQ ID NO: 2290311 - DNA, 14 bp, Homo sapiens
ggaatgattaatta

SEQ ID NO: 2290312 - DNA, 24 bp, Homo sapiens
ggaatgattaattaaaacacaaca

SEQ ID NO: 2290313 - DNA, 18 bp, Homo sapiens
ggaatgggggccaggctg

SEQ ID NO: 2290314 - DNA, 19 bp, Homo sapiens
ggaatgttgttaaatgcta

SEQ ID NO: 2290315 - DNA, 16 bp, Homo sapiens
ggaatttcttgtttct

SEQ ID NO: 2290316 - DNA, 22 bp, Homo sapiens
ggacaccaatggctgcatcaaa

SEQ ID NO: 2290317 - DNA, 19 bp, Homo sapiens
ggacacggcctctggggag

SEQ ID NO: 2290318 - DNA, 23 bp, Homo sapiens
ggacactgatgggtcctgctgct

SEQ ID NO: 2290319 - DNA, 24 bp, Homo sapiens
ggacactgatgggtcctgctgctc

SEQ ID NO: 2290320 - DNA, 17 bp, Homo sapiens
ggacagatgggtgtccc

SEQ ID NO: 2290321 - DNA, 23 bp, Homo sapiens
ggacagatgggtgtcccctggtg

SEQ ID NO: 2290322 - DNA, 16 bp, Homo sapiens
ggacagattcagtctt

SEQ ID NO: 2290323 - DNA, 12 bp, Homo sapiens
ggacagcagctg

SEQ ID NO: 2290324 - DNA, 23 bp, Homo sapiens
ggacagcagctggactgggtggg

SEQ ID NO: 2290325 - DNA, 15 bp, Homo sapiens
ggacagcggcccggc

SEQ ID NO: 2290326 - DNA, 17 bp, Homo sapiens
ggacagcggcccggccc

SEQ ID NO: 2290327 - DNA, 23 bp, Homo sapiens
ggacaggaacacccagccccagc

SEQ ID NO: 2290328 - DNA, 24 bp, Homo sapiens
ggacaggattgtctgctgcctcca

SEQ ID NO: 2290329 - DNA, 17 bp, Homo sapiens
ggacagtaagattttat

SEQ ID NO: 2290330 - DNA, 22 bp, Homo sapiens
ggaccaaggtgcggaccggagc

SEQ ID NO: 2290331 - DNA, 19 bp, Homo sapiens
ggaccactgtttcttgctt

SEQ ID NO: 2290332 - DNA, 15 bp, Homo sapiens
ggacccactccgact

SEQ ID NO: 2290333 - DNA, 20 bp, Homo sapiens
ggacccactccgactccccc

SEQ ID NO: 2290334 - DNA, 23 bp, Homo sapiens
ggacccactccgactccccctcc

SEQ ID NO: 2290335 - DNA, 23 bp, Homo sapiens
ggaccccatctgctgagctctga

SEQ ID NO: 2290336 - DNA, 17 bp, Homo sapiens
ggaccccattctgggac

SEQ ID NO: 2290337 - DNA, 19 bp, Homo sapiens
ggaccccattctgggactg

SEQ ID NO: 2290338 - DNA, 22 bp, Homo sapiens
ggaccggagcggctgaggacgg

SEQ ID NO: 2290339 - DNA, 17 bp, Homo sapiens
ggacctccacctgggag

SEQ ID NO: 2290340 - DNA, 13 bp, Homo sapiens
ggacctgcggcct

SEQ ID NO: 2290341 - DNA, 12 bp, Homo sapiens
ggacctggggtc

SEQ ID NO: 2290342 - DNA, 12 bp, Homo sapiens
ggacgctggctc

SEQ ID NO: 2290343 - DNA, 16 bp, Homo sapiens
ggacggggcagagctg

SEQ ID NO: 2290344 - DNA, 20 bp, Homo sapiens
ggacgtgttatgactccaga

SEQ ID NO: 2290345 - DNA, 20 bp, Homo sapiens
ggactctccaggcaccgcct

SEQ ID NO: 2290346 - DNA, 16 bp, Homo sapiens
ggactctgccttccag

SEQ ID NO: 2290347 - DNA, 18 bp, Homo sapiens
ggactgaccgaagggacg

SEQ ID NO: 2290348 - DNA, 13 bp, Homo sapiens
ggactgctcaggc

SEQ ID NO: 2290349 - DNA, 16 bp, Homo sapiens
ggactgctcaggctcc

SEQ ID NO: 2290350 - DNA, 17 bp, Homo sapiens
ggactgggtgggcccca

SEQ ID NO: 2290351 - DNA, 20 bp, Homo sapiens
ggactgggtgggccccacag

SEQ ID NO: 2290352 - DNA, 21 bp, Homo sapiens
ggactgggtgggccccacagt

SEQ ID NO: 2290353 - DNA, 23 bp, Homo sapiens
ggactgtcttcaaccctgccctg

SEQ ID NO: 2290354 - DNA, 11 bp, Homo sapiens
ggactgtggcc

SEQ ID NO: 2290355 - DNA, 22 bp, Homo sapiens
ggacttcctgctacagtagctg

SEQ ID NO: 2290356 - DNA, 20 bp, Homo sapiens
ggacttcgggggcggctctg

SEQ ID NO: 2290357 - DNA, 19 bp, Homo sapiens
ggagaagaggggtatagga

SEQ ID NO: 2290358 - DNA, 20 bp, Homo sapiens
ggagaatcgcttgaacccag

SEQ ID NO: 2290359 - DNA, 15 bp, Homo sapiens
ggagaccaggactct

SEQ ID NO: 2290360 - DNA, 16 bp, Homo sapiens
ggagaccaggactctg

SEQ ID NO: 2290361 - DNA, 23 bp, Homo sapiens
ggagaccaggactctgccttcca

SEQ ID NO: 2290362 - DNA, 19 bp, Homo sapiens
ggagaccctgggagagtga

SEQ ID NO: 2290363 - DNA, 14 bp, Homo sapiens
ggagactcaggccc

SEQ ID NO: 2290364 - DNA, 21 bp, Homo sapiens
ggagagtgaggtcatcccggg

SEQ ID NO: 2290365 - DNA, 16 bp, Homo sapiens
ggagatccgccctggg

SEQ ID NO: 2290366 - DNA, 22 bp, Homo sapiens
ggagatccgccctgggctctgg

SEQ ID NO: 2290367 - DNA, 23 bp, Homo sapiens
ggagatccgccctgggctctggg

SEQ ID NO: 2290368 - DNA, 19 bp, Homo sapiens
ggagatgacatttgctttg

SEQ ID NO: 2290369 - DNA, 15 bp, Homo sapiens
ggagcaaggctgcta

SEQ ID NO: 2290370 - DNA, 15 bp, Homo sapiens
ggagcacccccagcc

SEQ ID NO: 2290371 - DNA, 18 bp, Homo sapiens
ggagcacccccagcctcc

SEQ ID NO: 2290372 - DNA, 20 bp, Homo sapiens
ggagcacccccagcctcccc

SEQ ID NO: 2290373 - DNA, 22 bp, Homo sapiens
ggagcacccccagcctccccca

SEQ ID NO: 2290374 - DNA, 20 bp, Homo sapiens
ggagcactagaatgagaaat

SEQ ID NO: 2290375 - DNA, 18 bp, Homo sapiens
ggagcagagacggcagcc

SEQ ID NO: 2290376 - DNA, 19 bp, Homo sapiens
ggagcagcgtgcaggagca

SEQ ID NO: 2290377 - DNA, 17 bp, Homo sapiens
ggagcagtttggggcag

SEQ ID NO: 2290378 - DNA, 21 bp, Homo sapiens
ggagcagtttggggcaggggg

SEQ ID NO: 2290379 - DNA, 17 bp, Homo sapiens
ggagccactggggtggg

SEQ ID NO: 2290380 - DNA, 18 bp, Homo sapiens
ggagccactggggtggga

SEQ ID NO: 2290381 - DNA, 22 bp, Homo sapiens
ggagccactggggtgggagggg

SEQ ID NO: 2290382 - DNA, 18 bp, Homo sapiens
ggagcctgcgtggcctgg

SEQ ID NO: 2290383 - DNA, 13 bp, Homo sapiens
ggagcggctgagg

SEQ ID NO: 2290384 - DNA, 22 bp, Homo sapiens
ggagcggctgaggacggggcag

SEQ ID NO: 2290385 - DNA, 23 bp, Homo sapiens
ggagctcacaccgcaccgggctg

SEQ ID NO: 2290386 - DNA, 13 bp, Homo sapiens
ggagctgggaagg

SEQ ID NO: 2290387 - DNA, 18 bp, Homo sapiens
ggagctgggaaggtcccg

SEQ ID NO: 2290388 - DNA, 12 bp, Homo sapiens
ggagctggtggg

SEQ ID NO: 2290389 - DNA, 16 bp, Homo sapiens
ggaggagactcaggcc

SEQ ID NO: 2290390 - DNA, 13 bp, Homo sapiens
ggaggagcacccc

SEQ ID NO: 2290391 - DNA, 18 bp, Homo sapiens
ggaggagcacccccagcc

SEQ ID NO: 2290392 - DNA, 19 bp, Homo sapiens
ggaggagcacccccagcct

SEQ ID NO: 2290393 - DNA, 12 bp, Homo sapiens
ggaggatggacg

SEQ ID NO: 2290394 - DNA, 22 bp, Homo sapiens
ggaggcacaaagggcaggcctg

SEQ ID NO: 2290395 - DNA, 23 bp, Homo sapiens
ggaggcagcatggagagaggcct

SEQ ID NO: 2290396 - DNA, 17 bp, Homo sapiens
ggaggcagtggcttgga

SEQ ID NO: 2290397 - DNA, 16 bp, Homo sapiens
ggaggcctcgagcaga

SEQ ID NO: 2290398 - DNA, 14 bp, Homo sapiens
ggaggcctgaaatg

SEQ ID NO: 2290399 - DNA, 12 bp, Homo sapiens
ggaggcgcccac

SEQ ID NO: 2290400 - DNA, 14 bp, Homo sapiens
ggaggcgcccacct

SEQ ID NO: 2290401 - DNA, 23 bp, Homo sapiens
ggaggcgcccacctgcccagtta

SEQ ID NO: 2290402 - DNA, 15 bp, Homo sapiens
ggagggcctctggac

SEQ ID NO: 2290403 - DNA, 14 bp, Homo sapiens
ggagggctgggcag

SEQ ID NO: 2290404 - DNA, 20 bp, Homo sapiens
ggagggctgggcagggccct

SEQ ID NO: 2290405 - DNA, 14 bp, Homo sapiens
ggaggggaagagag

SEQ ID NO: 2290406 - DNA, 20 bp, Homo sapiens
ggaggggcttggagcagaga

SEQ ID NO: 2290407 - DNA, 15 bp, Homo sapiens
ggagggggcaggggg

SEQ ID NO: 2290408 - DNA, 22 bp, Homo sapiens
ggaggtccaaggtcaaggcacc

SEQ ID NO: 2290409 - DNA, 19 bp, Homo sapiens
ggaggtcctttggacagct

SEQ ID NO: 2290410 - DNA, 13 bp, Homo sapiens
ggaggtgtgaatg

SEQ ID NO: 2290411 - DNA, 19 bp, Homo sapiens
ggaggtgtgaatgcacgtt

SEQ ID NO: 2290412 - DNA, 23 bp, Homo sapiens
ggagtccagacctgggccctggt

SEQ ID NO: 2290413 - DNA, 16 bp, Homo sapiens
ggagtgaagtggtgtg

SEQ ID NO: 2290414 - DNA, 21 bp, Homo sapiens
ggagtggcatggtcctgtgcc

SEQ ID NO: 2290415 - DNA, 13 bp, Homo sapiens
ggagtgggtcgcc

SEQ ID NO: 2290416 - DNA, 23 bp, Homo sapiens
ggagtgggtcgcccacgggtgtg

SEQ ID NO: 2290417 - DNA, 18 bp, Homo sapiens
ggagttgtctgtcctggt

SEQ ID NO: 2290418 - DNA, 18 bp, Homo sapiens
ggatccagagacctgctc

SEQ ID NO: 2290419 - DNA, 13 bp, Homo sapiens
ggatcctgagcca

SEQ ID NO: 2290420 - DNA, 19 bp, Homo sapiens
ggatcctgagccagatttc

SEQ ID NO: 2290421 - DNA, 12 bp, Homo sapiens
ggatgggcacag

SEQ ID NO: 2290422 - DNA, 15 bp, Homo sapiens
ggatgggcacaggct

SEQ ID NO: 2290423 - DNA, 18 bp, Homo sapiens
ggatgggggctcctggca

SEQ ID NO: 2290424 - DNA, 18 bp, Homo sapiens
ggatggggttgggctctg

SEQ ID NO: 2290425 - DNA, 18 bp, Homo sapiens
ggcaacactcactgcctg

SEQ ID NO: 2290426 - DNA, 22 bp, Homo sapiens
ggcaaggcagctcccaggttta

SEQ ID NO: 2290427 - DNA, 15 bp, Homo sapiens
ggcaaggctgtcaat

SEQ ID NO: 2290428 - DNA, 15 bp, Homo sapiens
ggcaaggggccagga

SEQ ID NO: 2290429 - DNA, 17 bp, Homo sapiens
ggcaaggggccaggaag

SEQ ID NO: 2290430 - DNA, 22 bp, Homo sapiens
ggcaattcagtcctgggcaaag

SEQ ID NO: 2290431 - DNA, 14 bp, Homo sapiens
ggcacaggctgccc

SEQ ID NO: 2290432 - DNA, 21 bp, Homo sapiens
ggcacaggctgccccacccct

SEQ ID NO: 2290433 - DNA, 20 bp, Homo sapiens
ggcacccttgactgttggga

SEQ ID NO: 2290434 - DNA, 13 bp, Homo sapiens
ggcaccgcccacc

SEQ ID NO: 2290435 - DNA, 15 bp, Homo sapiens
ggcaccgcccaccca

SEQ ID NO: 2290436 - DNA, 17 bp, Homo sapiens
ggcaccgcccacccaca

SEQ ID NO: 2290437 - DNA, 17 bp, Homo sapiens
ggcaccgcctgccccca

SEQ ID NO: 2290438 - DNA, 18 bp, Homo sapiens
ggcaccgcctgcccccag

SEQ ID NO: 2290439 - DNA, 22 bp, Homo sapiens
ggcagagccatccaccctgagg

SEQ ID NO: 2290440 - DNA, 24 bp, Homo sapiens
ggcagagccatccaccctgaggag

SEQ ID NO: 2290441 - DNA, 22 bp, Homo sapiens
ggcagagctgagtcggctgggc

SEQ ID NO: 2290442 - DNA, 13 bp, Homo sapiens
ggcagaggcaggg

SEQ ID NO: 2290443 - DNA, 15 bp, Homo sapiens
ggcagaggcagggcc

SEQ ID NO: 2290444 - DNA, 15 bp, Homo sapiens
ggcagcatggagaga

SEQ ID NO: 2290445 - DNA, 13 bp, Homo sapiens
ggcagccccatcc

SEQ ID NO: 2290446 - DNA, 12 bp, Homo sapiens
ggcagcggcccc

SEQ ID NO: 2290447 - DNA, 15 bp, Homo sapiens
ggcagcggccccgca

SEQ ID NO: 2290448 - DNA, 16 bp, Homo sapiens
ggcagcggccccgcac

SEQ ID NO: 2290449 - DNA, 17 bp, Homo sapiens
ggcagcggccccgcacc

SEQ ID NO: 2290450 - DNA, 22 bp, Homo sapiens
ggcagcggccccgcacccctcc

SEQ ID NO: 2290451 - DNA, 23 bp, Homo sapiens
ggcagcggccccgcacccctcct

SEQ ID NO: 2290452 - DNA, 16 bp, Homo sapiens
ggcaggaagtccctga

SEQ ID NO: 2290453 - DNA, 15 bp, Homo sapiens
ggcaggagacactgg

SEQ ID NO: 2290454 - DNA, 13 bp, Homo sapiens
ggcaggagctcac

SEQ ID NO: 2290455 - DNA, 14 bp, Homo sapiens
ggcaggagctcaca

SEQ ID NO: 2290456 - DNA, 18 bp, Homo sapiens
ggcaggagctcacaccgc

SEQ ID NO: 2290457 - DNA, 18 bp, Homo sapiens
ggcaggaggccattccag

SEQ ID NO: 2290458 - DNA, 20 bp, Homo sapiens
ggcaggagtgggctctgagc

SEQ ID NO: 2290459 - DNA, 15 bp, Homo sapiens
ggcagggcaggcaga

SEQ ID NO: 2290460 - DNA, 16 bp, Homo sapiens
ggcagggccgcagggc

SEQ ID NO: 2290461 - DNA, 17 bp, Homo sapiens
ggcagggggttctggga

SEQ ID NO: 2290462 - DNA, 22 bp, Homo sapiens
ggcaggggtcgcgatgatgggc

SEQ ID NO: 2290463 - DNA, 16 bp, Homo sapiens
ggcagtgcagcaacca

SEQ ID NO: 2290464 - DNA, 14 bp, Homo sapiens
ggcagtggcagaga

SEQ ID NO: 2290465 - DNA, 20 bp, Homo sapiens
ggcagtggcttggagcagag

SEQ ID NO: 2290466 - DNA, 23 bp, Homo sapiens
ggcagtggcttggagcagaggtg

SEQ ID NO: 2290467 - DNA, 18 bp, Homo sapiens
ggcatccagtatcttgaa

SEQ ID NO: 2290468 - DNA, 19 bp, Homo sapiens
ggcatccccagccccctgg

SEQ ID NO: 2290469 - DNA, 20 bp, Homo sapiens
ggcatgaccctggagcccgg

SEQ ID NO: 2290470 - DNA, 18 bp, Homo sapiens
ggcatgggaatgaatgtc

SEQ ID NO: 2290471 - DNA, 13 bp, Homo sapiens
ggcatggtcctgt

SEQ ID NO: 2290472 - DNA, 14 bp, Homo sapiens
ggcatggtcctgtg

SEQ ID NO: 2290473 - DNA, 20 bp, Homo sapiens
ggcatggtcctgtgccccga

SEQ ID NO: 2290474 - DNA, 18 bp, Homo sapiens
ggcatgtgatgagaggaa

SEQ ID NO: 2290475 - DNA, 19 bp, Homo sapiens
ggcatgttgtaacatttca

SEQ ID NO: 2290476 - DNA, 18 bp, Homo sapiens
ggcattagtttcaggcaa

SEQ ID NO: 2290477 - DNA, 22 bp, Homo sapiens
ggcattagtttcaggcaaggca

SEQ ID NO: 2290478 - DNA, 18 bp, Homo sapiens
ggcattttggctcagagt

SEQ ID NO: 2290479 - DNA, 19 bp, Homo sapiens
ggccaaacacccaagcaca

SEQ ID NO: 2290480 - DNA, 17 bp, Homo sapiens
ggccactggccctgttt

SEQ ID NO: 2290481 - DNA, 18 bp, Homo sapiens
ggccactggccctgtttc

SEQ ID NO: 2290482 - DNA, 22 bp, Homo sapiens
ggccagcatccatgcggccggc

SEQ ID NO: 2290483 - DNA, 14 bp, Homo sapiens
ggccagcccctccc

SEQ ID NO: 2290484 - DNA, 16 bp, Homo sapiens
ggccagcccctccccg

SEQ ID NO: 2290485 - DNA, 19 bp, Homo sapiens
ggccagcccctccccgcct

SEQ ID NO: 2290486 - DNA, 15 bp, Homo sapiens
ggccaggctgagccg

SEQ ID NO: 2290487 - DNA, 19 bp, Homo sapiens
ggccagggtctcgtcagga

SEQ ID NO: 2290488 - DNA, 21 bp, Homo sapiens
ggccatgcccaccgcccctgg

SEQ ID NO: 2290489 - DNA, 14 bp, Homo sapiens
ggcccaaataacag

SEQ ID NO: 2290490 - DNA, 20 bp, Homo sapiens
ggcccaacctcgccctctct

SEQ ID NO: 2290491 - DNA, 14 bp, Homo sapiens
ggcccacgcagagc

SEQ ID NO: 2290492 - DNA, 18 bp, Homo sapiens
ggcccacgcagagccccg

SEQ ID NO: 2290493 - DNA, 22 bp, Homo sapiens
ggcccatgccctccgtcctggc

SEQ ID NO: 2290494 - DNA, 20 bp, Homo sapiens
ggcccatggccccagctggc

SEQ ID NO: 2290495 - DNA, 17 bp, Homo sapiens
ggccccaagatgttggg

SEQ ID NO: 2290496 - DNA, 14 bp, Homo sapiens
ggccccagctggct

SEQ ID NO: 2290497 - DNA, 16 bp, Homo sapiens
ggccccagctggctgg

SEQ ID NO: 2290498 - DNA, 22 bp, Homo sapiens
ggccccgcacccctcctccttg

SEQ ID NO: 2290499 - DNA, 18 bp, Homo sapiens
ggccccgcgcgtgccccc

SEQ ID NO: 2290500 - DNA, 20 bp, Homo sapiens
ggcccctaggctgctgctgt

SEQ ID NO: 2290501 - DNA, 18 bp, Homo sapiens
ggcccgagagctgggact

SEQ ID NO: 2290502 - DNA, 22 bp, Homo sapiens
ggcccgagcgcgtgccttcccc

SEQ ID NO: 2290503 - DNA, 22 bp, Homo sapiens
ggcccgctcaacctctcagatc

SEQ ID NO: 2290504 - DNA, 13 bp, Homo sapiens
ggcccggcccacg

SEQ ID NO: 2290505 - DNA, 16 bp, Homo sapiens
ggcccggcccacgcag

SEQ ID NO: 2290506 - DNA, 19 bp, Homo sapiens
ggcccggcccacgcagagc

SEQ ID NO: 2290507 - DNA, 22 bp, Homo sapiens
ggcccggcccacgcagagcccc

SEQ ID NO: 2290508 - DNA, 18 bp, Homo sapiens
ggcccgtgcgcagccgcg

SEQ ID NO: 2290509 - DNA, 20 bp, Homo sapiens
ggcccgtgcgcagccgcgct

SEQ ID NO: 2290510 - DNA, 16 bp, Homo sapiens
ggccctccgcggggga

SEQ ID NO: 2290511 - DNA, 16 bp, Homo sapiens
ggccctgccctccccc

SEQ ID NO: 2290512 - DNA, 17 bp, Homo sapiens
ggccctggggtctctga

SEQ ID NO: 2290513 - DNA, 19 bp, Homo sapiens
ggccctggggtctctgagc

SEQ ID NO: 2290514 - DNA, 21 bp, Homo sapiens
ggccctggggtctctgagcag

SEQ ID NO: 2290515 - DNA, 17 bp, Homo sapiens
ggccctgtggctccagg

SEQ ID NO: 2290516 - DNA, 12 bp, Homo sapiens
ggccgcagggcg

SEQ ID NO: 2290517 - DNA, 18 bp, Homo sapiens
ggccgcagggcgctccgg

SEQ ID NO: 2290518 - DNA, 20 bp, Homo sapiens
ggccgcagggcgctccggca

SEQ ID NO: 2290519 - DNA, 13 bp, Homo sapiens
ggccgcctcctcc

SEQ ID NO: 2290520 - DNA, 15 bp, Homo sapiens
ggccgcctcctccag

SEQ ID NO: 2290521 - DNA, 18 bp, Homo sapiens
ggccgcctcctccagact

SEQ ID NO: 2290522 - DNA, 20 bp, Homo sapiens
ggccgcttcagacacgcact

SEQ ID NO: 2290523 - DNA, 15 bp, Homo sapiens
ggccgggctggcttc

SEQ ID NO: 2290524 - DNA, 12 bp, Homo sapiens
ggccgtccctga

SEQ ID NO: 2290525 - DNA, 23 bp, Homo sapiens
ggccgtccctgacttcccagctg

SEQ ID NO: 2290526 - DNA, 18 bp, Homo sapiens
ggcctcagtgtcctcatc

SEQ ID NO: 2290527 - DNA, 16 bp, Homo sapiens
ggcctcattcagcaga

SEQ ID NO: 2290528 - DNA, 17 bp, Homo sapiens
ggcctgaaatgtttcca

SEQ ID NO: 2290529 - DNA, 15 bp, Homo sapiens
ggcctgagggaagcc

SEQ ID NO: 2290530 - DNA, 14 bp, Homo sapiens
ggcctgcagcccag

SEQ ID NO: 2290531 - DNA, 14 bp, Homo sapiens
ggcctggctctgga

SEQ ID NO: 2290532 - DNA, 22 bp, Homo sapiens
ggcctggggccgggctggcttc

SEQ ID NO: 2290533 - DNA, 19 bp, Homo sapiens
ggcctgggtgtgacctgac

SEQ ID NO: 2290534 - DNA, 17 bp, Homo sapiens
ggcctgttccctgagga

SEQ ID NO: 2290535 - DNA, 18 bp, Homo sapiens
ggcctgttccctgaggac

SEQ ID NO: 2290536 - DNA, 18 bp, Homo sapiens
ggcctgtttggtgaggac

SEQ ID NO: 2290537 - DNA, 23 bp, Homo sapiens
ggccttttgttaaacccttctgt

SEQ ID NO: 2290538 - DNA, 18 bp, Homo sapiens
ggcgcaggaaccgaggac

SEQ ID NO: 2290539 - DNA, 13 bp, Homo sapiens
ggcgccccggacg

SEQ ID NO: 2290540 - DNA, 17 bp, Homo sapiens
ggcgccccggacgccgc

SEQ ID NO: 2290541 - DNA, 17 bp, Homo sapiens
ggcgcctgcgctcctct

SEQ ID NO: 2290542 - DNA, 19 bp, Homo sapiens
ggcgcctgcgctcctctgc

SEQ ID NO: 2290543 - DNA, 19 bp, Homo sapiens
ggcgccttctacctgcagg

SEQ ID NO: 2290544 - DNA, 15 bp, Homo sapiens
ggcgcgcagcccggg

SEQ ID NO: 2290545 - DNA, 18 bp, Homo sapiens
ggcgcgggacaggacttg

SEQ ID NO: 2290546 - DNA, 21 bp, Homo sapiens
ggcgctgcccccacagatcca

SEQ ID NO: 2290547 - DNA, 15 bp, Homo sapiens
ggcggaggggcttgg

SEQ ID NO: 2290548 - DNA, 20 bp, Homo sapiens
ggcggaggggcttggagcag

SEQ ID NO: 2290549 - DNA, 12 bp, Homo sapiens
ggcggcaggggt

SEQ ID NO: 2290550 - DNA, 17 bp, Homo sapiens
ggcgggaaccctctggg

SEQ ID NO: 2290551 - DNA, 15 bp, Homo sapiens
ggcgggaagggtggg

SEQ ID NO: 2290552 - DNA, 16 bp, Homo sapiens
ggcgggaagggtgggc

SEQ ID NO: 2290553 - DNA, 18 bp, Homo sapiens
ggcgggcagcccctgctg

SEQ ID NO: 2290554 - DNA, 22 bp, Homo sapiens
ggcgggcagcccctgctggacc

SEQ ID NO: 2290555 - DNA, 12 bp, Homo sapiens
ggcgggcctgtt

SEQ ID NO: 2290556 - DNA, 21 bp, Homo sapiens
ggcgggcctgtttggtgagga

SEQ ID NO: 2290557 - DNA, 13 bp, Homo sapiens
ggcggggccagga

SEQ ID NO: 2290558 - DNA, 17 bp, Homo sapiens
ggcggtatccagaggtg

SEQ ID NO: 2290559 - DNA, 21 bp, Homo sapiens
ggcggtatccagaggtgaggg

SEQ ID NO: 2290560 - DNA, 14 bp, Homo sapiens
ggcggtgaggtggg

SEQ ID NO: 2290561 - DNA, 17 bp, Homo sapiens
ggcggtgaggtgggggc

SEQ ID NO: 2290562 - DNA, 14 bp, Homo sapiens
ggcgtagggccagg

SEQ ID NO: 2290563 - DNA, 20 bp, Homo sapiens
ggcgtagggccagggctctg

SEQ ID NO: 2290564 - DNA, 16 bp, Homo sapiens
ggctaactggccccag

SEQ ID NO: 2290565 - DNA, 18 bp, Homo sapiens
ggctaactggccccaggc

SEQ ID NO: 2290566 - DNA, 17 bp, Homo sapiens
ggctaagtccagctctc

SEQ ID NO: 2290567 - DNA, 12 bp, Homo sapiens
ggctcacacctg

SEQ ID NO: 2290568 - DNA, 21 bp, Homo sapiens
ggctcacacttggctctgagg

SEQ ID NO: 2290569 - DNA, 15 bp, Homo sapiens
ggctccacgggggcc

SEQ ID NO: 2290570 - DNA, 19 bp, Homo sapiens
ggctccccaagacttgacg

SEQ ID NO: 2290571 - DNA, 12 bp, Homo sapiens
ggctcctggcag

SEQ ID NO: 2290572 - DNA, 16 bp, Homo sapiens
ggctcgggtgcccagg

SEQ ID NO: 2290573 - DNA, 17 bp, Homo sapiens
ggctcgggtgcccagga

SEQ ID NO: 2290574 - DNA, 16 bp, Homo sapiens
ggctctatctgctggg

SEQ ID NO: 2290575 - DNA, 18 bp, Homo sapiens
ggctctatctgctgggct

SEQ ID NO: 2290576 - DNA, 17 bp, Homo sapiens
ggctctgcgtcccactg

SEQ ID NO: 2290577 - DNA, 23 bp, Homo sapiens
ggctctggcaggtggccagggct

SEQ ID NO: 2290578 - DNA, 14 bp, Homo sapiens
ggctgaaggatggg

SEQ ID NO: 2290579 - DNA, 20 bp, Homo sapiens
ggctgaccaggccctgctca

SEQ ID NO: 2290580 - DNA, 17 bp, Homo sapiens
ggctgactctccaggga

SEQ ID NO: 2290581 - DNA, 12 bp, Homo sapiens
ggctgagcccct

SEQ ID NO: 2290582 - DNA, 15 bp, Homo sapiens
ggctgagcccctcct

SEQ ID NO: 2290583 - DNA, 20 bp, Homo sapiens
ggctgagccgatctggtctc

SEQ ID NO: 2290584 - DNA, 22 bp, Homo sapiens
ggctgagccgatctggtctcgt

SEQ ID NO: 2290585 - DNA, 21 bp, Homo sapiens
ggctgaggacggggcagagct

SEQ ID NO: 2290586 - DNA, 22 bp, Homo sapiens
ggctgaggacggggcagagctg

SEQ ID NO: 2290587 - DNA, 19 bp, Homo sapiens
ggctgcatcaaatgcatgc

SEQ ID NO: 2290588 - DNA, 15 bp, Homo sapiens
ggctgccccacccct

SEQ ID NO: 2290589 - DNA, 20 bp, Homo sapiens
ggctgccgtgcacggggcca

SEQ ID NO: 2290590 - DNA, 14 bp, Homo sapiens
ggctgcgcctgccc

SEQ ID NO: 2290591 - DNA, 12 bp, Homo sapiens
ggctgcttcaag

SEQ ID NO: 2290592 - DNA, 14 bp, Homo sapiens
ggctggagggctgg

SEQ ID NO: 2290593 - DNA, 23 bp, Homo sapiens
ggctggagggctgggcagggccc

SEQ ID NO: 2290594 - DNA, 12 bp, Homo sapiens
ggctggccctgc

SEQ ID NO: 2290595 - DNA, 17 bp, Homo sapiens
gcccgggagatccgccc

SEQ ID NO: 2290596 - DNA, 15 bp, Homo sapiens
gcccggtgtgaggag

SEQ ID NO: 2290597 - DNA, 14 bp, Homo sapiens
gcccgtgcgcagcc

SEQ ID NO: 2290598 - DNA, 23 bp, Homo sapiens
gcccgtgcgcagccgcgctctgc

SEQ ID NO: 2290599 - DNA, 18 bp, Homo sapiens
gccctatctatgtcctgg

SEQ ID NO: 2290600 - DNA, 15 bp, Homo sapiens
gccctccacacccgc

SEQ ID NO: 2290601 - DNA, 22 bp, Homo sapiens
gccctccaggccgacaggaggc

SEQ ID NO: 2290602 - DNA, 14 bp, Homo sapiens
gccctcccccacgg

SEQ ID NO: 2290603 - DNA, 22 bp, Homo sapiens
gccctccgcgggggacaggaac

SEQ ID NO: 2290604 - DNA, 18 bp, Homo sapiens
gccctccgtcctggcagg

SEQ ID NO: 2290605 - DNA, 15 bp, Homo sapiens
gccctcctctgcccc

SEQ ID NO: 2290606 - DNA, 17 bp, Homo sapiens
gccctcctctgccccct

SEQ ID NO: 2290607 - DNA, 13 bp, Homo sapiens
gccctctctcacc

SEQ ID NO: 2290608 - DNA, 15 bp, Homo sapiens
gccctctctcaccag

SEQ ID NO: 2290609 - DNA, 21 bp, Homo sapiens
gccctctctcaccagccttga

SEQ ID NO: 2290610 - DNA, 17 bp, Homo sapiens
gccctcttcttctcaag

SEQ ID NO: 2290611 - DNA, 12 bp, Homo sapiens
gccctgccctcc

SEQ ID NO: 2290612 - DNA, 16 bp, Homo sapiens
gccctgccctccccca

SEQ ID NO: 2290613 - DNA, 15 bp, Homo sapiens
gccctgccctggcca

SEQ ID NO: 2290614 - DNA, 23 bp, Homo sapiens
gccctgccctggccactggccct

SEQ ID NO: 2290615 - DNA, 10 bp, Homo sapiens
gccctggagg

SEQ ID NO: 2290616 - DNA, 14 bp, Homo sapiens
gccctggccactgg

SEQ ID NO: 2290617 - DNA, 19 bp, Homo sapiens
gccctggccactggccctg

SEQ ID NO: 2290618 - DNA, 15 bp, Homo sapiens
gccctgggccccgcc

SEQ ID NO: 2290619 - DNA, 20 bp, Homo sapiens
gccctgggccccgcctcaag

SEQ ID NO: 2290620 - DNA, 17 bp, Homo sapiens
gccctggggtctctgag

SEQ ID NO: 2290621 - DNA, 18 bp, Homo sapiens
gccctggggtctctgagc

SEQ ID NO: 2290622 - DNA, 21 bp, Homo sapiens
gccctggttcccccaggaccc

SEQ ID NO: 2290623 - DNA, 21 bp, Homo sapiens
gccctgtccactctgctcagg

SEQ ID NO: 2290624 - DNA, 13 bp, Homo sapiens
gccctgtggctcc

SEQ ID NO: 2290625 - DNA, 18 bp, Homo sapiens
gccctgtgtccacagtga

SEQ ID NO: 2290626 - DNA, 16 bp, Homo sapiens
gccgacaggaggccat

SEQ ID NO: 2290627 - DNA, 16 bp, Homo sapiens
gccgacggagccactg

SEQ ID NO: 2290628 - DNA, 19 bp, Homo sapiens
gccgagctctcctgggcca

SEQ ID NO: 2290629 - DNA, 21 bp, Homo sapiens
gccgagctctcctgggccagg

SEQ ID NO: 2290630 - DNA, 13 bp, Homo sapiens
gccgagggaaatg

SEQ ID NO: 2290631 - DNA, 15 bp, Homo sapiens
gccgagtgccccaga

SEQ ID NO: 2290632 - DNA, 23 bp, Homo sapiens
gccgcagggcgctccggcagagg

SEQ ID NO: 2290633 - DNA, 15 bp, Homo sapiens
gccgcctcctccaga

SEQ ID NO: 2290634 - DNA, 23 bp, Homo sapiens
gccgcctcgggccgcctcctcca

SEQ ID NO: 2290635 - DNA, 14 bp, Homo sapiens
gccgcgctctgccc

SEQ ID NO: 2290636 - DNA, 13 bp, Homo sapiens
gccgctgccccca

SEQ ID NO: 2290637 - DNA, 15 bp, Homo sapiens
gccgctgcccccacc

SEQ ID NO: 2290638 - DNA, 16 bp, Homo sapiens
gccgctgcccccaccc

SEQ ID NO: 2290639 - DNA, 17 bp, Homo sapiens
gccggccgcgcaccgcc

SEQ ID NO: 2290640 - DNA, 14 bp, Homo sapiens
gccgggccccatgg

SEQ ID NO: 2290641 - DNA, 20 bp, Homo sapiens
gccgggccccatggtcacag

SEQ ID NO: 2290642 - DNA, 20 bp, Homo sapiens
gccgggctggcttctccctg

SEQ ID NO: 2290643 - DNA, 13 bp, Homo sapiens
gccggggctggcc

SEQ ID NO: 2290644 - DNA, 13 bp, Homo sapiens
gccggtccacccc

SEQ ID NO: 2290645 - DNA, 19 bp, Homo sapiens
gccggttggccggctggcc

SEQ ID NO: 2290646 - DNA, 20 bp, Homo sapiens
gccggttggccggctggccg

SEQ ID NO: 2290647 - DNA, 17 bp, Homo sapiens
gccgtgcacggggccag

SEQ ID NO: 2290648 - DNA, 19 bp, Homo sapiens
gccgtgcacggggccagca

SEQ ID NO: 2290649 - DNA, 20 bp, Homo sapiens
gccgtgcacggggccagcat

SEQ ID NO: 2290650 - DNA, 23 bp, Homo sapiens
gcctaaataggtttttcttgcta

SEQ ID NO: 2290651 - DNA, 19 bp, Homo sapiens
gcctaatgcattattttgt

SEQ ID NO: 2290652 - DNA, 17 bp, Homo sapiens
gcctagaacaagccaga

SEQ ID NO: 2290653 - DNA, 21 bp, Homo sapiens
gcctagaacaagccagagccg

SEQ ID NO: 2290654 - DNA, 18 bp, Homo sapiens
gcctagtggcttcagccc

SEQ ID NO: 2290655 - DNA, 22 bp, Homo sapiens
gcctagtggcttcagcccctgg

SEQ ID NO: 2290656 - DNA, 15 bp, Homo sapiens
gcctcaagcgatcct

SEQ ID NO: 2290657 - DNA, 19 bp, Homo sapiens
gcctcaaggaagagccagc

SEQ ID NO: 2290658 - DNA, 22 bp, Homo sapiens
gcctcaaggaagagccagccgt

SEQ ID NO: 2290659 - DNA, 14 bp, Homo sapiens
gcctcacccctgca

SEQ ID NO: 2290660 - DNA, 17 bp, Homo sapiens
gcctcacccctgcaggc

SEQ ID NO: 2290661 - DNA, 18 bp, Homo sapiens
gcctcactgcatctttct

SEQ ID NO: 2290662 - DNA, 16 bp, Homo sapiens
gcctcagagtcctgcc

SEQ ID NO: 2290663 - DNA, 16 bp, Homo sapiens
gcctcaggaggcagtg

SEQ ID NO: 2290664 - DNA, 17 bp, Homo sapiens
gcctcaggctttttcca

SEQ ID NO: 2290665 - DNA, 21 bp, Homo sapiens
gcctcagtgtcctcatctata

SEQ ID NO: 2290666 - DNA, 22 bp, Homo sapiens
gcctcagtgtcctcatctataa

SEQ ID NO: 2290667 - DNA, 21 bp, Homo sapiens
gcctcatgggagtcagggagc

SEQ ID NO: 2290668 - DNA, 21 bp, Homo sapiens
gcctccatccacacacagcag

SEQ ID NO: 2290669 - DNA, 15 bp, Homo sapiens
gcctcccgccgcctc

SEQ ID NO: 2290670 - DNA, 16 bp, Homo sapiens
gcctcccgtccgtccg

SEQ ID NO: 2290671 - DNA, 14 bp, Homo sapiens
gcctcctccagact

SEQ ID NO: 2290672 - DNA, 13 bp, Homo sapiens
gcctcctccagct

SEQ ID NO: 2290673 - DNA, 14 bp, Homo sapiens
gcctcctccagctc

SEQ ID NO: 2290674 - DNA, 20 bp, Homo sapiens
gcctcctccagctcctgccc

SEQ ID NO: 2290675 - DNA, 21 bp, Homo sapiens
gcctcctccagctcctgcccc

SEQ ID NO: 2290676 - DNA, 11 bp, Homo sapiens
gcctcctccct

SEQ ID NO: 2290677 - DNA, 13 bp, Homo sapiens
gcctcctgctgag

SEQ ID NO: 2290678 - DNA, 17 bp, Homo sapiens
gcctcgacctccctggc

SEQ ID NO: 2290679 - DNA, 19 bp, Homo sapiens
gcctcgacctccctggctt

SEQ ID NO: 2290680 - DNA, 19 bp, Homo sapiens
gcctctccttttctccact

SEQ ID NO: 2290681 - DNA, 12 bp, Homo sapiens
gcctctgaactg

SEQ ID NO: 2290682 - DNA, 20 bp, Homo sapiens
gcctctgaactgctgctggt

SEQ ID NO: 2290683 - DNA, 21 bp, Homo sapiens
gcctctgaactgctgctggtc

SEQ ID NO: 2290684 - DNA, 21 bp, Homo sapiens
gcctctggacagatgggtgtc

SEQ ID NO: 2290685 - DNA, 23 bp, Homo sapiens
gcctctggacagatgggtgtccc

SEQ ID NO: 2290686 - DNA, 23 bp, Homo sapiens
gcctgacacaatggtagctctga

SEQ ID NO: 2290687 - DNA, 22 bp, Homo sapiens
gcctgagccacagtggggccca

SEQ ID NO: 2290688 - DNA, 18 bp, Homo sapiens
gcctgagctccaccctcc

SEQ ID NO: 2290689 - DNA, 23 bp, Homo sapiens
gcctgagctccaccctcccctct

SEQ ID NO: 2290690 - DNA, 12 bp, Homo sapiens
gcctgcagccca

SEQ ID NO: 2290691 - DNA, 13 bp, Homo sapiens
gcctgcagctgag

SEQ ID NO: 2290692 - DNA, 14 bp, Homo sapiens
gcctgcagctgaga

SEQ ID NO: 2290693 - DNA, 13 bp, Homo sapiens
gcctgcccgcccg

SEQ ID NO: 2290694 - DNA, 16 bp, Homo sapiens
gcctgcgccccccagt

SEQ ID NO: 2290695 - DNA, 19 bp, Homo sapiens
gcctgcgctcctctgcagc

SEQ ID NO: 2290696 - DNA, 22 bp, Homo sapiens
gcctgcgctcctctgcagcctg

SEQ ID NO: 2290697 - DNA, 23 bp, Homo sapiens
gcctgcgctcctctgcagcctga

SEQ ID NO: 2290698 - DNA, 14 bp, Homo sapiens
gcctgcgtggcctg

SEQ ID NO: 2290699 - DNA, 16 bp, Homo sapiens
gcctgctagcggctga

SEQ ID NO: 2290700 - DNA, 15 bp, Homo sapiens
gcctggcgggcagcc

SEQ ID NO: 2290701 - DNA, 17 bp, Homo sapiens
gcctggcgggcagcccc

SEQ ID NO: 2290702 - DNA, 18 bp, Homo sapiens
gcctggcgggcagcccct

SEQ ID NO: 2290703 - DNA, 19 bp, Homo sapiens
gcctggcgggcagcccctg

SEQ ID NO: 2290704 - DNA, 14 bp, Homo sapiens
gcctgttccctgag

SEQ ID NO: 2290705 - DNA, 19 bp, Homo sapiens
gcctgtttggggagggggg

SEQ ID NO: 2290706 - DNA, 14 bp, Homo sapiens
gcctgtttggtgag

SEQ ID NO: 2290707 - DNA, 17 bp, Homo sapiens
gcctgtttggtgaggac

SEQ ID NO: 2290708 - DNA, 19 bp, Homo sapiens
gcctgtttggtgaggacct

SEQ ID NO: 2290709 - DNA, 10 bp, Homo sapiens
gccttatgga

SEQ ID NO: 2290710 - DNA, 21 bp, Homo sapiens
gccttcaaaaatgtgctgcct

SEQ ID NO: 2290711 - DNA, 18 bp, Homo sapiens
gccttcagaaaagacact

SEQ ID NO: 2290712 - DNA, 17 bp, Homo sapiens
gccttctacctgcagga

SEQ ID NO: 2290713 - DNA, 21 bp, Homo sapiens
gccttgaactgtggccaccta

SEQ ID NO: 2290714 - DNA, 23 bp, Homo sapiens
gccttgtctgtgtatttctattt

SEQ ID NO: 2290715 - DNA, 21 bp, Homo sapiens
gcgaagtccgaggcctggctc

SEQ ID NO: 2290716 - DNA, 19 bp, Homo sapiens
gcgagaggtgagctacttt

SEQ ID NO: 2290717 - DNA, 12 bp, Homo sapiens
gcgagtctggag

SEQ ID NO: 2290718 - DNA, 12 bp, Homo sapiens
gcgatgatgggc

SEQ ID NO: 2290719 - DNA, 15 bp, Homo sapiens
gcgcacccggcagcc

SEQ ID NO: 2290720 - DNA, 21 bp, Homo sapiens
gcgcacccggcagccccccag

SEQ ID NO: 2290721 - DNA, 23 bp, Homo sapiens
gcgcagccgcgctctgcccctcc

SEQ ID NO: 2290722 - DNA, 12 bp, Homo sapiens
gcgcaggccctc

SEQ ID NO: 2290723 - DNA, 15 bp, Homo sapiens
gcgcaggccctccgc

SEQ ID NO: 2290724 - DNA, 15 bp, Homo sapiens
gcgcccacctgccca

SEQ ID NO: 2290725 - DNA, 16 bp, Homo sapiens
gcgccccccagtggac

SEQ ID NO: 2290726 - DNA, 15 bp, Homo sapiens
gcgccggcgccccgg

SEQ ID NO: 2290727 - DNA, 16 bp, Homo sapiens
gcgcctcccgccgcct

SEQ ID NO: 2290728 - DNA, 21 bp, Homo sapiens
gcgcctcccgccgcctcgggc

SEQ ID NO: 2290729 - DNA, 14 bp, Homo sapiens
gcgcctgcccgccc

SEQ ID NO: 2290730 - DNA, 17 bp, Homo sapiens
gcgcctgcccgcccgcc

SEQ ID NO: 2290731 - DNA, 16 bp, Homo sapiens
gcgcctgcgctcctct

SEQ ID NO: 2290732 - DNA, 12 bp, Homo sapiens
gaaatttatgac

SEQ ID NO: 2290733 - DNA, 13 bp, Homo sapiens
gaaatttatgact

SEQ ID NO: 2290734 - DNA, 24 bp, Homo sapiens
gaaatttcaaagtatgtttcatta

SEQ ID NO: 2290735 - DNA, 15 bp, Homo sapiens
gaacaaaatctgttg

SEQ ID NO: 2290736 - DNA, 15 bp, Homo sapiens
gaacaagatttccct

SEQ ID NO: 2290737 - DNA, 14 bp, Homo sapiens
gaacaagccagagc

SEQ ID NO: 2290738 - DNA, 21 bp, Homo sapiens
gaacaaggcaaggctgtcaat

SEQ ID NO: 2290739 - DNA, 16 bp, Homo sapiens
gaacacccagccccag

SEQ ID NO: 2290740 - DNA, 18 bp, Homo sapiens
gaacactgcagtgttatt

SEQ ID NO: 2290741 - DNA, 23 bp, Homo sapiens
gaacactgcagtgttattttctt

SEQ ID NO: 2290742 - DNA, 21 bp, Homo sapiens
gaacagagtatatatgtacag

SEQ ID NO: 2290743 - DNA, 20 bp, Homo sapiens
gaacaggaggtgtgaatgca

SEQ ID NO: 2290744 - DNA, 22 bp, Homo sapiens
gaacaggaggtgtgaatgcacg

SEQ ID NO: 2290745 - DNA, 18 bp, Homo sapiens
gaacaggtgttcctcctc

SEQ ID NO: 2290746 - DNA, 21 bp, Homo sapiens
gaaccacatggaacttaaaac

SEQ ID NO: 2290747 - DNA, 14 bp, Homo sapiens
gaaccatcctctgt

SEQ ID NO: 2290748 - DNA, 13 bp, Homo sapiens
gaaccgaggactc

SEQ ID NO: 2290749 - DNA, 14 bp, Homo sapiens
gaacctcaaactgg

SEQ ID NO: 2290750 - DNA, 14 bp, Homo sapiens
gaacgggcctcccc

SEQ ID NO: 2290751 - DNA, 18 bp, Homo sapiens
gaactagagactctgtga

SEQ ID NO: 2290752 - DNA, 14 bp, Homo sapiens
gaactcaatgcatg

SEQ ID NO: 2290753 - DNA, 18 bp, Homo sapiens
gaactcaatgcatgatga

SEQ ID NO: 2290754 - DNA, 21 bp, Homo sapiens
gaactcaatgcatgatgactc

SEQ ID NO: 2290755 - DNA, 15 bp, Homo sapiens
gaactcttggcctca

SEQ ID NO: 2290756 - DNA, 14 bp, Homo sapiens
gaactgctgctggt

SEQ ID NO: 2290757 - DNA, 22 bp, Homo sapiens
gaactgctgctggtcaccccca

SEQ ID NO: 2290758 - DNA, 18 bp, Homo sapiens
gaactgtcccacaaaata

SEQ ID NO: 2290759 - DNA, 21 bp, Homo sapiens
gaacttggctttcctgtttct

SEQ ID NO: 2290760 - DNA, 13 bp, Homo sapiens
gaagaaaaaattt

SEQ ID NO: 2290761 - DNA, 14 bp, Homo sapiens
gaagaagggaaatt

SEQ ID NO: 2290762 - DNA, 22 bp, Homo sapiens
gaagaagggaaattcacactgt

SEQ ID NO: 2290763 - DNA, 14 bp, Homo sapiens
gaagaatgtctcct

SEQ ID NO: 2290764 - DNA, 15 bp, Homo sapiens
gaagacagagatggc

SEQ ID NO: 2290765 - DNA, 22 bp, Homo sapiens
gaagactgattttaaaactttt

SEQ ID NO: 2290766 - DNA, 20 bp, Homo sapiens
gaagacttttctttcagcca

SEQ ID NO: 2290767 - DNA, 17 bp, Homo sapiens
gaagagagaggcctggg

SEQ ID NO: 2290768 - DNA, 19 bp, Homo sapiens
gaagagagaggcctgggtg

SEQ ID NO: 2290769 - DNA, 13 bp, Homo sapiens
gaagagccagccg

SEQ ID NO: 2290770 - DNA, 16 bp, Homo sapiens
gaagagccgagcacct

SEQ ID NO: 2290771 - DNA, 14 bp, Homo sapiens
gaagaggggcagct

SEQ ID NO: 2290772 - DNA, 20 bp, Homo sapiens
gaagaggggcagctttttca

SEQ ID NO: 2290773 - DNA, 13 bp, Homo sapiens
gaagataaatgct

SEQ ID NO: 2290774 - DNA, 16 bp, Homo sapiens
gaagataaatgcttta

SEQ ID NO: 2290775 - DNA, 21 bp, Homo sapiens
gaagataaatgctttaaatag

SEQ ID NO: 2290776 - DNA, 14 bp, Homo sapiens
gaagccagggcccg

SEQ ID NO: 2290777 - DNA, 11 bp, Homo sapiens
gaagcccaccc

SEQ ID NO: 2290778 - DNA, 12 bp, Homo sapiens
gaagcccacccg

SEQ ID NO: 2290779 - DNA, 15 bp, Homo sapiens
gaagcccacccgccc

SEQ ID NO: 2290780 - DNA, 17 bp, Homo sapiens
gaagcccacccgcccca

SEQ ID NO: 2290781 - DNA, 20 bp, Homo sapiens
gaagcccacccgccccagag

SEQ ID NO: 2290782 - DNA, 23 bp, Homo sapiens
gaagcccacccgccccagagact

SEQ ID NO: 2290783 - DNA, 14 bp, Homo sapiens
gaagcctcctgctg

SEQ ID NO: 2290784 - DNA, 15 bp, Homo sapiens
gaagctggcaggaga

SEQ ID NO: 2290785 - DNA, 22 bp, Homo sapiens
gaaggatgggggctcctggcag

SEQ ID NO: 2290786 - DNA, 18 bp, Homo sapiens
gaaggcacaggtgtaaat

SEQ ID NO: 2290787 - DNA, 12 bp, Homo sapiens
gaaggcctgagg

SEQ ID NO: 2290788 - DNA, 17 bp, Homo sapiens
gaaggcctgagggaagc

SEQ ID NO: 2290789 - DNA, 21 bp, Homo sapiens
gaaggcctgagggaagcccac

SEQ ID NO: 2290790 - DNA, 22 bp, Homo sapiens
gaaggcctgagggaagcccacc

SEQ ID NO: 2290791 - DNA, 14 bp, Homo sapiens
gaaggctttattct

SEQ ID NO: 2290792 - DNA, 18 bp, Homo sapiens
gaagggaaatcaatttaa

SEQ ID NO: 2290793 - DNA, 12 bp, Homo sapiens
gaagggcaggag

SEQ ID NO: 2290794 - DNA, 12 bp, Homo sapiens
gaaggggacagg

SEQ ID NO: 2290795 - DNA, 16 bp, Homo sapiens
gaagggtgggccctgg

SEQ ID NO: 2290796 - DNA, 18 bp, Homo sapiens
gaagggtgggccctggag

SEQ ID NO: 2290797 - DNA, 14 bp, Homo sapiens
gaaggtgtttcaaa

SEQ ID NO: 2290798 - DNA, 15 bp, Homo sapiens
gaaggtgtttcaaag

SEQ ID NO: 2290799 - DNA, 22 bp, Homo sapiens
gaagtaagttctgaaaactgtt

SEQ ID NO: 2290800 - DNA, 18 bp, Homo sapiens
gaagtactataatttacc

SEQ ID NO: 2290801 - DNA, 21 bp, Homo sapiens
gaagtattcccttctttccta

SEQ ID NO: 2290802 - DNA, 14 bp, Homo sapiens
gaagtccgaggcct

SEQ ID NO: 2290803 - DNA, 16 bp, Homo sapiens
gaagtctttgtacaga

SEQ ID NO: 2290804 - DNA, 18 bp, Homo sapiens
gaagtctttgtacagaca

SEQ ID NO: 2290805 - DNA, 21 bp, Homo sapiens
gaagtggtgtgatcccagctc

SEQ ID NO: 2290806 - DNA, 14 bp, Homo sapiens
gaagtgtgctgtga

SEQ ID NO: 2290807 - DNA, 18 bp, Homo sapiens
gaagttaacagtctcatt

SEQ ID NO: 2290808 - DNA, 16 bp, Homo sapiens
gaagttgatctcccca

SEQ ID NO: 2290809 - DNA, 15 bp, Homo sapiens
gaataaacacacaga

SEQ ID NO: 2290810 - DNA, 18 bp, Homo sapiens
gaataattttaacagaca

SEQ ID NO: 2290811 - DNA, 19 bp, Homo sapiens
gaatacaattcagttttag

SEQ ID NO: 2290812 - DNA, 23 bp, Homo sapiens
gaatactacagcataaatctgtt

SEQ ID NO: 2290813 - DNA, 15 bp, Homo sapiens
gaatacttcctgaaa

SEQ ID NO: 2290814 - DNA, 17 bp, Homo sapiens
gaatagtacatgcagaa

SEQ ID NO: 2290815 - DNA, 23 bp, Homo sapiens
gaatatataaacgatatatgtaa

SEQ ID NO: 2290816 - DNA, 13 bp, Homo sapiens
gaatatggacaaa

SEQ ID NO: 2290817 - DNA, 13 bp, Homo sapiens
gaatattgctgat

SEQ ID NO: 2290818 - DNA, 14 bp, Homo sapiens
gaatattgttaaaa

SEQ ID NO: 2290819 - DNA, 12 bp, Homo sapiens
gaatcaaagaca

SEQ ID NO: 2290820 - DNA, 17 bp, Homo sapiens
gaatcaaagacatttca

SEQ ID NO: 2290821 - DNA, 23 bp, Homo sapiens
gaatcatgcaaaaaaaaaaatgt

SEQ ID NO: 2290822 - DNA, 18 bp, Homo sapiens
gaatcattgagaaataaa

SEQ ID NO: 2290823 - DNA, 18 bp, Homo sapiens
gaatccatatcagctctg

SEQ ID NO: 2290824 - DNA, 18 bp, Homo sapiens
gaatcgacctcactgtca

SEQ ID NO: 2290825 - DNA, 19 bp, Homo sapiens
gaatctattttctatgtac

SEQ ID NO: 2290826 - DNA, 20 bp, Homo sapiens
gaatctccatttctgctcag

SEQ ID NO: 2290827 - DNA, 14 bp, Homo sapiens
gaatgaatgtcagt

SEQ ID NO: 2290828 - DNA, 22 bp, Homo sapiens
gaatgacatcaacattccccca

SEQ ID NO: 2290829 - DNA, 16 bp, Homo sapiens
gaatgagagagaaaag

SEQ ID NO: 2290830 - DNA, 14 bp, Homo sapiens
gaatgagctctcta

SEQ ID NO: 2290831 - DNA, 13 bp, Homo sapiens
gaatgcctttcaa

SEQ ID NO: 2290832 - DNA, 14 bp, Homo sapiens
gaatggatgctgct

SEQ ID NO: 2290833 - DNA, 17 bp, Homo sapiens
gaatgggggccaggctg

SEQ ID NO: 2290834 - DNA, 20 bp, Homo sapiens
gaatgggggtatcctgtgca

SEQ ID NO: 2290835 - DNA, 17 bp, Homo sapiens
gaatgtattcttttata

SEQ ID NO: 2290836 - DNA, 20 bp, Homo sapiens
gaatgtcagtgtgactgatc

SEQ ID NO: 2290837 - DNA, 20 bp, Homo sapiens
gaatgtccccattctataaa

SEQ ID NO: 2290838 - DNA, 17 bp, Homo sapiens
gaatgtgcttttccatc

SEQ ID NO: 2290839 - DNA, 22 bp, Homo sapiens
gaatgtgcttttccatctaaaa

SEQ ID NO: 2290840 - DNA, 22 bp, Homo sapiens
gaattattacactgtaagaaat

SEQ ID NO: 2290841 - DNA, 18 bp, Homo sapiens
gaattcataaaaataacc

SEQ ID NO: 2290842 - DNA, 16 bp, Homo sapiens
gaattcttttcctctc

SEQ ID NO: 2290843 - DNA, 15 bp, Homo sapiens
gaattgtaaggaatg

SEQ ID NO: 2290844 - DNA, 22 bp, Homo sapiens
gaattgtgcgacttcacaaaat

SEQ ID NO: 2290845 - DNA, 22 bp, Homo sapiens
gaattgttatgtaaacatcata

SEQ ID NO: 2290846 - DNA, 17 bp, Homo sapiens
gaatttatttatgttct

SEQ ID NO: 2290847 - DNA, 18 bp, Homo sapiens
gaatttgtgaatatattt

SEQ ID NO: 2290848 - DNA, 11 bp, Homo sapiens
gacaaaattta

SEQ ID NO: 2290849 - DNA, 18 bp, Homo sapiens
gacaatgcaaaccatcat

SEQ ID NO: 2290850 - DNA, 19 bp, Homo sapiens
gacacaatggtagctctga

SEQ ID NO: 2290851 - DNA, 20 bp, Homo sapiens
gacacataaatctgtctgat

SEQ ID NO: 2290852 - DNA, 14 bp, Homo sapiens
gacacatttggacc

SEQ ID NO: 2290853 - DNA, 15 bp, Homo sapiens
gacaccccacttagc

SEQ ID NO: 2290854 - DNA, 17 bp, Homo sapiens
gacacgaatattgctga

SEQ ID NO: 2290855 - DNA, 23 bp, Homo sapiens
gacactagtagagcaaagactta

SEQ ID NO: 2290856 - DNA, 21 bp, Homo sapiens
gacactgatgggtcctgctgc

SEQ ID NO: 2290857 - DNA, 22 bp, Homo sapiens
gacactgatgggtcctgctgct

SEQ ID NO: 2290858 - DNA, 13 bp, Homo sapiens
gacactggtctca

SEQ ID NO: 2290859 - DNA, 17 bp, Homo sapiens
gacagaaggcaaagttt

SEQ ID NO: 2290860 - DNA, 20 bp, Homo sapiens
gacagaaggcaaagtttcca

SEQ ID NO: 2290861 - DNA, 21 bp, Homo sapiens
gacagatgggtgtcccctggt

SEQ ID NO: 2290862 - DNA, 13 bp, Homo sapiens
gacagcagctgga

SEQ ID NO: 2290863 - DNA, 22 bp, Homo sapiens
gacagcagctggactgggtggg

SEQ ID NO: 2290864 - DNA, 18 bp, Homo sapiens
gacagcggcccggcccac

SEQ ID NO: 2290865 - DNA, 19 bp, Homo sapiens
gacagctgactgaatgcag

SEQ ID NO: 2290866 - DNA, 21 bp, Homo sapiens
gacaggaacacccagccccag

SEQ ID NO: 2290867 - DNA, 18 bp, Homo sapiens
gacaggcttcgtctcaga

SEQ ID NO: 2290868 - DNA, 13 bp, Homo sapiens
gacagtttgtaaa

SEQ ID NO: 2290869 - DNA, 15 bp, Homo sapiens
gacagtttgtaaatg

SEQ ID NO: 2290870 - DNA, 17 bp, Homo sapiens
gacagtttgtaaatgtt

SEQ ID NO: 2290871 - DNA, 23 bp, Homo sapiens
gacataagctggtatcagtggtt

SEQ ID NO: 2290872 - DNA, 15 bp, Homo sapiens
gacatcggttcagga

SEQ ID NO: 2290873 - DNA, 14 bp, Homo sapiens
gacatgagattcca

SEQ ID NO: 2290874 - DNA, 19 bp, Homo sapiens
gacatggcaacaaaggatg

SEQ ID NO: 2290875 - DNA, 13 bp, Homo sapiens
gacattcagagat

SEQ ID NO: 2290876 - DNA, 18 bp, Homo sapiens
gacatttaaaatagtttt

SEQ ID NO: 2290877 - DNA, 22 bp, Homo sapiens
gacatttaaaatagttttctaa

SEQ ID NO: 2290878 - DNA, 19 bp, Homo sapiens
gacatttcatccaccaata

SEQ ID NO: 2290879 - DNA, 23 bp, Homo sapiens
gacatttcatccaccaatatcat

SEQ ID NO: 2290880 - DNA, 21 bp, Homo sapiens
gaccaaatggaaacagaggac

SEQ ID NO: 2290881 - DNA, 14 bp, Homo sapiens
gaccaatctctgtg

SEQ ID NO: 2290882 - DNA, 16 bp, Homo sapiens
gaccactgtttcttgc

SEQ ID NO: 2290883 - DNA, 20 bp, Homo sapiens
gaccactgtttcttgcttgt

SEQ ID NO: 2290884 - DNA, 14 bp, Homo sapiens
gaccagcacactcc

SEQ ID NO: 2290885 - DNA, 18 bp, Homo sapiens
gaccagcacactcccgag

SEQ ID NO: 2290886 - DNA, 13 bp, Homo sapiens
gaccaggccctgc

SEQ ID NO: 2290887 - DNA, 14 bp, Homo sapiens
gaccaggccctgct

SEQ ID NO: 2290888 - DNA, 18 bp, Homo sapiens
gaccaggctcacaactgt

SEQ ID NO: 2290889 - DNA, 20 bp, Homo sapiens
gaccaggctcacaactgttt

SEQ ID NO: 2290890 - DNA, 13 bp, Homo sapiens
gaccaggctggag

SEQ ID NO: 2290891 - DNA, 23 bp, Homo sapiens
gacccactccgactccccctccc

SEQ ID NO: 2290892 - DNA, 10 bp, Homo sapiens
gaccccacac

SEQ ID NO: 2290893 - DNA, 13 bp, Homo sapiens
gaccccacacgcc

SEQ ID NO: 2290894 - DNA, 20 bp, Homo sapiens
gaccccacacgccggggctg

SEQ ID NO: 2290895 - DNA, 21 bp, Homo sapiens
gaccccatccagccaggggtg

SEQ ID NO: 2290896 - DNA, 14 bp, Homo sapiens
gaccccatctgctg

SEQ ID NO: 2290897 - DNA, 19 bp, Homo sapiens
gaccccatctgctgagctc

SEQ ID NO: 2290898 - DNA, 16 bp, Homo sapiens
gaccccattctgggac

SEQ ID NO: 2290899 - DNA, 19 bp, Homo sapiens
gaccccattctgggactgc

SEQ ID NO: 2290900 - DNA, 20 bp, Homo sapiens
gacccctccttgtaatgtag

SEQ ID NO: 2290901 - DNA, 22 bp, Homo sapiens
gacccctgggggaggcttccag

SEQ ID NO: 2290902 - DNA, 15 bp, Homo sapiens
gacccgcaacaagta

SEQ ID NO: 2290903 - DNA, 16 bp, Homo sapiens
gaccctcggggcagga

SEQ ID NO: 2290904 - DNA, 16 bp, Homo sapiens
gaccctggagcccggc

SEQ ID NO: 2290905 - DNA, 19 bp, Homo sapiens
gaccggagcggctgaggac

SEQ ID NO: 2290906 - DNA, 11 bp, Homo sapiens
gaccggcccgc

SEQ ID NO: 2290907 - DNA, 18 bp, Homo sapiens
gacctaaatccattttct

SEQ ID NO: 2290908 - DNA, 20 bp, Homo sapiens
gacctaaatccattttctaa

SEQ ID NO: 2290909 - DNA, 18 bp, Homo sapiens
gacctccacctgggagat

SEQ ID NO: 2290910 - DNA, 20 bp, Homo sapiens
gacctccacctgggagatgc

SEQ ID NO: 2290911 - DNA, 20 bp, Homo sapiens
gacctccagattattttcta

SEQ ID NO: 2290912 - DNA, 23 bp, Homo sapiens
gacctccagattattttctatat

SEQ ID NO: 2290913 - DNA, 14 bp, Homo sapiens
gacctcccccaggg

SEQ ID NO: 2290914 - DNA, 15 bp, Homo sapiens
gacctcccccaggga

SEQ ID NO: 2290915 - DNA, 17 bp, Homo sapiens
gacctcccccagggagg

SEQ ID NO: 2290916 - DNA, 17 bp, Homo sapiens
gacctccctggcttgag

SEQ ID NO: 2290917 - DNA, 16 bp, Homo sapiens
gacctgacacctgccg

SEQ ID NO: 2290918 - DNA, 20 bp, Homo sapiens
gacctgcccccgctctgcca

SEQ ID NO: 2290919 - DNA, 15 bp, Homo sapiens
gacctgggccctggt

SEQ ID NO: 2290920 - DNA, 20 bp, Homo sapiens
gacctggggtcccccctccc

SEQ ID NO: 2290921 - DNA, 18 bp, Homo sapiens
gaccttctgaagatctca

SEQ ID NO: 2290922 - DNA, 11 bp, Homo sapiens
gacctttcaat

SEQ ID NO: 2290923 - DNA, 19 bp, Homo sapiens
gacctttcaataggaaaaa

SEQ ID NO: 2290924 - DNA, 20 bp, Homo sapiens
gacctttcaataggaaaaac

SEQ ID NO: 2290925 - DNA, 15 bp, Homo sapiens
gacctttttctctct

SEQ ID NO: 2290926 - DNA, 17 bp, Homo sapiens
gacgcagccccccacgc

SEQ ID NO: 2290927 - DNA, 20 bp, Homo sapiens
gacgcagggagaccctggga

SEQ ID NO: 2290928 - DNA, 14 bp, Homo sapiens
gacgctggtaactg

SEQ ID NO: 2290929 - DNA, 15 bp, Homo sapiens
gacggacgggacagc

SEQ ID NO: 2290930 - DNA, 19 bp, Homo sapiens
gacggacgggacagcggcc

SEQ ID NO: 2290931 - DNA, 22 bp, Homo sapiens
gacggcactgagagagcgcagc

SEQ ID NO: 2290932 - DNA, 12 bp, Homo sapiens
gacggcagcccc

SEQ ID NO: 2290933 - DNA, 12 bp, Homo sapiens
gacgggacagcg

SEQ ID NO: 2290934 - DNA, 22 bp, Homo sapiens
gacggggcagagctgagtcggc

SEQ ID NO: 2290935 - DNA, 19 bp, Homo sapiens
gacgtgagtggggaggaga

SEQ ID NO: 2290936 - DNA, 14 bp, Homo sapiens
gacgtggcacctcc

SEQ ID NO: 2290937 - DNA, 15 bp, Homo sapiens
gacgtgttatgactc

SEQ ID NO: 2290938 - DNA, 19 bp, Homo sapiens
gactagcaaacaaaaatag

SEQ ID NO: 2290939 - DNA, 15 bp, Homo sapiens
gactagctatctctg

SEQ ID NO: 2290940 - DNA, 19 bp, Homo sapiens
gactatgcagctcatcacc

SEQ ID NO: 2290941 - DNA, 22 bp, Homo sapiens
gactatgcagcttggagacagg

SEQ ID NO: 2290942 - DNA, 13 bp, Homo sapiens
gactcaggcccac

SEQ ID NO: 2290943 - DNA, 23 bp, Homo sapiens
gactcaggcccacattgcccaca

SEQ ID NO: 2290944 - DNA, 17 bp, Homo sapiens
gactcagttcttggcct

SEQ ID NO: 2290945 - DNA, 22 bp, Homo sapiens
gactccccgcccgccctcctct

SEQ ID NO: 2290946 - DNA, 23 bp, Homo sapiens
gactccccgcccgccctcctctg

SEQ ID NO: 2290947 - DNA, 21 bp, Homo sapiens
gactcgggctaagtccagctc

SEQ ID NO: 2290948 - DNA, 18 bp, Homo sapiens
gactctccaggcaccgcc

SEQ ID NO: 2290949 - DNA, 19 bp, Homo sapiens
gactctccaggcaccgcct

SEQ ID NO: 2290950 - DNA, 17 bp, Homo sapiens
gactctgccttccaggc

SEQ ID NO: 2290951 - DNA, 18 bp, Homo sapiens
gactctgtgatctaagca

SEQ ID NO: 2290952 - DNA, 16 bp, Homo sapiens
gactctgtggggccac

SEQ ID NO: 2290953 - DNA, 18 bp, Homo sapiens
gactctgtggggccacac

SEQ ID NO: 2290954 - DNA, 19 bp, Homo sapiens
gactcttcttatcacactt

SEQ ID NO: 2290955 - DNA, 12 bp, Homo sapiens
gactcttggact

SEQ ID NO: 2290956 - DNA, 22 bp, Homo sapiens
gactgaatttaactactaagaa

SEQ ID NO: 2290957 - DNA, 12 bp, Homo sapiens
gactgcccaccc

SEQ ID NO: 2290958 - DNA, 14 bp, Homo sapiens
gactgcccaccctg

SEQ ID NO: 2290959 - DNA, 19 bp, Homo sapiens
gactgcccaccctgggcct

SEQ ID NO: 2290960 - DNA, 20 bp, Homo sapiens
gactgcccaccctgggcctc

SEQ ID NO: 2290961 - DNA, 21 bp, Homo sapiens
gactgcccaccctgggcctcc

SEQ ID NO: 2290962 - DNA, 22 bp, Homo sapiens
gactgcccaccctgggcctccc

SEQ ID NO: 2290963 - DNA, 16 bp, Homo sapiens
gactgctcaggctccc

SEQ ID NO: 2290964 - DNA, 18 bp, Homo sapiens
gactgctcaggctcccca

SEQ ID NO: 2290965 - DNA, 19 bp, Homo sapiens
gactgggtgggccccacag

SEQ ID NO: 2290966 - DNA, 20 bp, Homo sapiens
gactgtcttcaaccctgccc

SEQ ID NO: 2290967 - DNA, 12 bp, Homo sapiens
gacttcacaaaa

SEQ ID NO: 2290968 - DNA, 13 bp, Homo sapiens
gacttcccagctg

SEQ ID NO: 2290969 - DNA, 23 bp, Homo sapiens
gacttcccagctggcagcgcctc

SEQ ID NO: 2290970 - DNA, 24 bp, Homo sapiens
gacttcccagctggcagcgcctcc

SEQ ID NO: 2290971 - DNA, 21 bp, Homo sapiens
gacttcctgctacagtagctg

SEQ ID NO: 2290972 - DNA, 21 bp, Homo sapiens
gacttccttgtgtcagggcag

SEQ ID NO: 2290973 - DNA, 23 bp, Homo sapiens
gacttgacgcagccccccacgct

SEQ ID NO: 2290974 - DNA, 14 bp, Homo sapiens
gagaaaagattaaa

SEQ ID NO: 2290975 - DNA, 18 bp, Homo sapiens
gagaaattacaggttcct

SEQ ID NO: 2290976 - DNA, 16 bp, Homo sapiens
gagaaattgtgccaaa

SEQ ID NO: 2290977 - DNA, 21 bp, Homo sapiens
gagaagaggggtataggacaa

SEQ ID NO: 2290978 - DNA, 17 bp, Homo sapiens
gagaaggattctttttt

SEQ ID NO: 2290979 - DNA, 14 bp, Homo sapiens
gagaagtacttttg

SEQ ID NO: 2290980 - DNA, 15 bp, Homo sapiens
gagaagtacttttga

SEQ ID NO: 2290981 - DNA, 18 bp, Homo sapiens
gagaatcgacctcactgt

SEQ ID NO: 2290982 - DNA, 23 bp, Homo sapiens
gagaattccagttgtatttgaag

SEQ ID NO: 2290983 - DNA, 21 bp, Homo sapiens
gagacagggtctcactgtgtt

SEQ ID NO: 2290984 - DNA, 18 bp, Homo sapiens
gagaccctgggagagtga

SEQ ID NO: 2290985 - DNA, 21 bp, Homo sapiens
gagaccgagtgtggagctgct

SEQ ID NO: 2290986 - DNA, 16 bp, Homo sapiens
gagacctcccccaggg

SEQ ID NO: 2290987 - DNA, 18 bp, Homo sapiens
gagacctcccccagggag

SEQ ID NO: 2290988 - DNA, 19 bp, Homo sapiens
gagacctcccccagggagg

SEQ ID NO: 2290989 - DNA, 18 bp, Homo sapiens
gagacctgctccagatcc

SEQ ID NO: 2290990 - DNA, 15 bp, Homo sapiens
gagacggcagcccca

SEQ ID NO: 2290991 - DNA, 15 bp, Homo sapiens
gagactatgtgtcat

SEQ ID NO: 2290992 - DNA, 16 bp, Homo sapiens
gagactcaggcccaca

SEQ ID NO: 2290993 - DNA, 18 bp, Homo sapiens
gagactcgcgacaatgca

SEQ ID NO: 2290994 - DNA, 11 bp, Homo sapiens
gagactgccca

SEQ ID NO: 2290995 - DNA, 12 bp, Homo sapiens
gagactgcccac

SEQ ID NO: 2290996 - DNA, 15 bp, Homo sapiens
gagactgcccaccct

SEQ ID NO: 2290997 - DNA, 17 bp, Homo sapiens
gagactgcccaccctgg

SEQ ID NO: 2290998 - DNA, 13 bp, Homo sapiens
gagagcagaatga

SEQ ID NO: 2290999 - DNA, 20 bp, Homo sapiens
gagagcctttggtgaataac

SEQ ID NO: 2291000 - DNA, 15 bp, Homo sapiens
gagagcgccacccgc

SEQ ID NO: 2291001 - DNA, 12 bp, Homo sapiens
gagaggaaatca

SEQ ID NO: 2291002 - DNA, 11 bp, Homo sapiens
gagagggctga

SEQ ID NO: 2291003 - DNA, 20 bp, Homo sapiens
gagagggctgagcccctcct

SEQ ID NO: 2291004 - DNA, 22 bp, Homo sapiens
gagagggctgagcccctcctct

SEQ ID NO: 2291005 - DNA, 17 bp, Homo sapiens
ggctggccctgccctcc

SEQ ID NO: 2291006 - DNA, 21 bp, Homo sapiens
ggctggccctgccctccccca

SEQ ID NO: 2291007 - DNA, 16 bp, Homo sapiens
ggctggccggtccacc

SEQ ID NO: 2291008 - DNA, 18 bp, Homo sapiens
ggctggccggtccacccc

SEQ ID NO: 2291009 - DNA, 16 bp, Homo sapiens
ggctggcttctccctg

SEQ ID NO: 2291010 - DNA, 13 bp, Homo sapiens
ggctgggcagggc

SEQ ID NO: 2291011 - DNA, 17 bp, Homo sapiens
ggctgggcagggccctg

SEQ ID NO: 2291012 - DNA, 15 bp, Homo sapiens
ggctgggcagggccg

SEQ ID NO: 2291013 - DNA, 16 bp, Homo sapiens
ggctgggtcgcccctc

SEQ ID NO: 2291014 - DNA, 22 bp, Homo sapiens
ggctggtttaaccattggaatg

SEQ ID NO: 2291015 - DNA, 18 bp, Homo sapiens
ggctgtacatcagacaga

SEQ ID NO: 2291016 - DNA, 16 bp, Homo sapiens
ggctgtattttctttt

SEQ ID NO: 2291017 - DNA, 22 bp, Homo sapiens
ggctgtatttttgaaatactct

SEQ ID NO: 2291018 - DNA, 14 bp, Homo sapiens
ggctgtccacccgc

SEQ ID NO: 2291019 - DNA, 16 bp, Homo sapiens
ggcttatcagaactcc

SEQ ID NO: 2291020 - DNA, 12 bp, Homo sapiens
ggcttcagcccc

SEQ ID NO: 2291021 - DNA, 22 bp, Homo sapiens
ggcttcccacagcctcttcctc

SEQ ID NO: 2291022 - DNA, 17 bp, Homo sapiens
ggcttctccctggactc

SEQ ID NO: 2291023 - DNA, 20 bp, Homo sapiens
ggcttctccctggactctgt

SEQ ID NO: 2291024 - DNA, 23 bp, Homo sapiens
ggcttggagcagagacggcagcc

SEQ ID NO: 2291025 - DNA, 22 bp, Homo sapiens
ggctttatgcaggattctcttt

SEQ ID NO: 2291026 - DNA, 21 bp, Homo sapiens
gggaaactaaggtcagaaggg

SEQ ID NO: 2291027 - DNA, 18 bp, Homo sapiens
gggaagagagaggcctgg

SEQ ID NO: 2291028 - DNA, 15 bp, Homo sapiens
gggaagcccacccgc

SEQ ID NO: 2291029 - DNA, 19 bp, Homo sapiens
gggaagcccacccgcccca

SEQ ID NO: 2291030 - DNA, 20 bp, Homo sapiens
gggaagcccacccgccccag

SEQ ID NO: 2291031 - DNA, 19 bp, Homo sapiens
gggaaggcctgagggaagc

SEQ ID NO: 2291032 - DNA, 13 bp, Homo sapiens
gggaagggtgggc

SEQ ID NO: 2291033 - DNA, 15 bp, Homo sapiens
gggaagggtgggccc

SEQ ID NO: 2291034 - DNA, 16 bp, Homo sapiens
gggaagggtgggccct

SEQ ID NO: 2291035 - DNA, 22 bp, Homo sapiens
gggacccactccgactccccct

SEQ ID NO: 2291036 - DNA, 14 bp, Homo sapiens
gggactctccaggc

SEQ ID NO: 2291037 - DNA, 22 bp, Homo sapiens
gggacttcgggggcggctctgg

SEQ ID NO: 2291038 - DNA, 18 bp, Homo sapiens
gggagagcgccacccgcc

SEQ ID NO: 2291039 - DNA, 13 bp, Homo sapiens
gggagagtgaggt

SEQ ID NO: 2291040 - DNA, 18 bp, Homo sapiens
gggagagtgaggtcatcc

SEQ ID NO: 2291041 - DNA, 23 bp, Homo sapiens
gggagatccgccctgggctctgg

SEQ ID NO: 2291042 - DNA, 15 bp, Homo sapiens
gggagccatgctctt

SEQ ID NO: 2291043 - DNA, 15 bp, Homo sapiens
gggaggagactcagg

SEQ ID NO: 2291044 - DNA, 19 bp, Homo sapiens
gggaggagcacccccagcc

SEQ ID NO: 2291045 - DNA, 12 bp, Homo sapiens
gggaggggaaga

SEQ ID NO: 2291046 - DNA, 15 bp, Homo sapiens
gggatccagagacct

SEQ ID NO: 2291047 - DNA, 13 bp, Homo sapiens
gggatgggcacag

SEQ ID NO: 2291048 - DNA, 17 bp, Homo sapiens
gggatgggcacaggctg

SEQ ID NO: 2291049 - DNA, 13 bp, Homo sapiens
gggcacgggagag

SEQ ID NO: 2291050 - DNA, 17 bp, Homo sapiens
gggcacgggagagcgcc

SEQ ID NO: 2291051 - DNA, 20 bp, Homo sapiens
gggcagagctgagtcggctg

SEQ ID NO: 2291052 - DNA, 12 bp, Homo sapiens
gggcagcccctg

SEQ ID NO: 2291053 - DNA, 13 bp, Homo sapiens
gggcagcccctgc

SEQ ID NO: 2291054 - DNA, 20 bp, Homo sapiens
gggcagcccctgctggacca

SEQ ID NO: 2291055 - DNA, 15 bp, Homo sapiens
gggcagcggccccgc

SEQ ID NO: 2291056 - DNA, 22 bp, Homo sapiens
gggcaggacaggtcctccctgc

SEQ ID NO: 2291057 - DNA, 15 bp, Homo sapiens
gggcaggcagagctc

SEQ ID NO: 2291058 - DNA, 23 bp, Homo sapiens
gggcagggggcttggctcgcacc

SEQ ID NO: 2291059 - DNA, 20 bp, Homo sapiens
gggcagggggttctgggacc

SEQ ID NO: 2291060 - DNA, 16 bp, Homo sapiens
gggcatccccagcccc

SEQ ID NO: 2291061 - DNA, 15 bp, Homo sapiens
gggccagcccctccc

SEQ ID NO: 2291062 - DNA, 12 bp, Homo sapiens
gggccaggctga

SEQ ID NO: 2291063 - DNA, 12 bp, Homo sapiens
gggccagggctc

SEQ ID NO: 2291064 - DNA, 15 bp, Homo sapiens
gggcccatggcccca

SEQ ID NO: 2291065 - DNA, 16 bp, Homo sapiens
gggcccatggccccag

SEQ ID NO: 2291066 - DNA, 19 bp, Homo sapiens
gggcccatggccccagctg

SEQ ID NO: 2291067 - DNA, 17 bp, Homo sapiens
gggccccatggtcacag

SEQ ID NO: 2291068 - DNA, 23 bp, Homo sapiens
gggccccatggtcacagacccct

SEQ ID NO: 2291069 - DNA, 21 bp, Homo sapiens
gggccctggggtctctgagca

SEQ ID NO: 2291070 - DNA, 22 bp, Homo sapiens
gggccctggttcccccaggacc

SEQ ID NO: 2291071 - DNA, 17 bp, Homo sapiens
gggccgcctcctccaga

SEQ ID NO: 2291072 - DNA, 15 bp, Homo sapiens
gggcgcctgcgctcc

SEQ ID NO: 2291073 - DNA, 23 bp, Homo sapiens
gggcgctccggcagaggcagggc

SEQ ID NO: 2291074 - DNA, 16 bp, Homo sapiens
gggcgctgcccccaca

SEQ ID NO: 2291075 - DNA, 17 bp, Homo sapiens
gggctaactggccccag

SEQ ID NO: 2291076 - DNA, 19 bp, Homo sapiens
gggctaactggccccaggc

SEQ ID NO: 2291077 - DNA, 16 bp, Homo sapiens
gggctcctggcagtga

SEQ ID NO: 2291078 - DNA, 13 bp, Homo sapiens
gggctctgcgtcc

SEQ ID NO: 2291079 - DNA, 14 bp, Homo sapiens
gggctctggcccca

SEQ ID NO: 2291080 - DNA, 14 bp, Homo sapiens
gggctgagcccctc

SEQ ID NO: 2291081 - DNA, 22 bp, Homo sapiens
gggctgccgtgcacggggccag

SEQ ID NO: 2291082 - DNA, 14 bp, Homo sapiens
gggctggagggctg

SEQ ID NO: 2291083 - DNA, 23 bp, Homo sapiens
gggctggccctgccctcccccac

SEQ ID NO: 2291084 - DNA, 17 bp, Homo sapiens
gggctgggcagggccct

SEQ ID NO: 2291085 - DNA, 23 bp, Homo sapiens
gggcttatcagaactcctttcta

SEQ ID NO: 2291086 - DNA, 21 bp, Homo sapiens
gggcttcccacagcctcttcc

SEQ ID NO: 2291087 - DNA, 17 bp, Homo sapiens
gggcttggctcgcaccc

SEQ ID NO: 2291088 - DNA, 14 bp, Homo sapiens
ggggaagagagagg

SEQ ID NO: 2291089 - DNA, 19 bp, Homo sapiens
ggggaagagagaggcctgg

SEQ ID NO: 2291090 - DNA, 21 bp, Homo sapiens
ggggagaccgagtgtggagct

SEQ ID NO: 2291091 - DNA, 14 bp, Homo sapiens
ggggagcaaggctg

SEQ ID NO: 2291092 - DNA, 16 bp, Homo sapiens
ggggagggcctctgga

SEQ ID NO: 2291093 - DNA, 13 bp, Homo sapiens
ggggcagagctga

SEQ ID NO: 2291094 - DNA, 23 bp, Homo sapiens
ggggcaggaagtccctgagaagc

SEQ ID NO: 2291095 - DNA, 18 bp, Homo sapiens
ggggcatccttgaggacc

SEQ ID NO: 2291096 - DNA, 22 bp, Homo sapiens
ggggccagcccctccccgcctc

SEQ ID NO: 2291097 - DNA, 20 bp, Homo sapiens
ggggccaggatggcgtgtcc

SEQ ID NO: 2291098 - DNA, 14 bp, Homo sapiens
ggggccatggaagc

SEQ ID NO: 2291099 - DNA, 15 bp, Homo sapiens
ggggcccatggcccc

SEQ ID NO: 2291100 - DNA, 18 bp, Homo sapiens
ggggcccatggccccagc

SEQ ID NO: 2291101 - DNA, 18 bp, Homo sapiens
ggggcccatgtgggctga

SEQ ID NO: 2291102 - DNA, 18 bp, Homo sapiens
ggggcccattcagcctcg

SEQ ID NO: 2291103 - DNA, 15 bp, Homo sapiens
ggggcggctctggga

SEQ ID NO: 2291104 - DNA, 16 bp, Homo sapiens
ggggctaactggcccc

SEQ ID NO: 2291105 - DNA, 18 bp, Homo sapiens
ggggctaactggccccag

SEQ ID NO: 2291106 - DNA, 11 bp, Homo sapiens
ggggctggccc

SEQ ID NO: 2291107 - DNA, 13 bp, Homo sapiens
ggggctggccctg

SEQ ID NO: 2291108 - DNA, 18 bp, Homo sapiens
ggggctggccctgccctc

SEQ ID NO: 2291109 - DNA, 22 bp, Homo sapiens
ggggctggccctgccctccccc

SEQ ID NO: 2291110 - DNA, 13 bp, Homo sapiens
ggggcttggagca

SEQ ID NO: 2291111 - DNA, 18 bp, Homo sapiens
ggggcttggagcagagac

SEQ ID NO: 2291112 - DNA, 14 bp, Homo sapiens
gggggaggagcacc

SEQ ID NO: 2291113 - DNA, 16 bp, Homo sapiens
gggggctaactggccc

SEQ ID NO: 2291114 - DNA, 19 bp, Homo sapiens
gggggctaactggccccag

SEQ ID NO: 2291115 - DNA, 16 bp, Homo sapiens
gggggcttggctcgca

SEQ ID NO: 2291116 - DNA, 15 bp, Homo sapiens
ggggtcccccctccc

SEQ ID NO: 2291117 - DNA, 18 bp, Homo sapiens
ggggtttccacacaggcc

SEQ ID NO: 2291118 - DNA, 16 bp, Homo sapiens
gggtatgcgtttcatg

SEQ ID NO: 2291119 - DNA, 15 bp, Homo sapiens
gggtcagttgggccc

SEQ ID NO: 2291120 - DNA, 16 bp, Homo sapiens
gggtcagttgggcccc

SEQ ID NO: 2291121 - DNA, 20 bp, Homo sapiens
gggtccccggacgctggctc

SEQ ID NO: 2291122 - DNA, 22 bp, Homo sapiens
gggtcggcgccttctacctgca

SEQ ID NO: 2291123 - DNA, 21 bp, Homo sapiens
gggtcgggggaggagcacccc

SEQ ID NO: 2291124 - DNA, 13 bp, Homo sapiens
gggtctcactgtg

SEQ ID NO: 2291125 - DNA, 14 bp, Homo sapiens
gggtctctgagcag

SEQ ID NO: 2291126 - DNA, 15 bp, Homo sapiens
gggtgcaggcgcgca

SEQ ID NO: 2291127 - DNA, 20 bp, Homo sapiens
gggtgcgtgaccggcccgcc

SEQ ID NO: 2291128 - DNA, 23 bp, Homo sapiens
gggtgcgtgaccggcccgccacc

SEQ ID NO: 2291129 - DNA, 14 bp, Homo sapiens
gggtggaagggcag

SEQ ID NO: 2291130 - DNA, 15 bp, Homo sapiens
gggtggaagggcagg

SEQ ID NO: 2291131 - DNA, 18 bp, Homo sapiens
gggtggaagggcaggagc

SEQ ID NO: 2291132 - DNA, 13 bp, Homo sapiens
gggtgggacacag

SEQ ID NO: 2291133 - DNA, 16 bp, Homo sapiens
gggtgggacacagaga

SEQ ID NO: 2291134 - DNA, 22 bp, Homo sapiens
gggtgggccccacagtggtcag

SEQ ID NO: 2291135 - DNA, 13 bp, Homo sapiens
gggtgtcccctgg

SEQ ID NO: 2291136 - DNA, 14 bp, Homo sapiens
gggtgtcccctggt

SEQ ID NO: 2291137 - DNA, 19 bp, Homo sapiens
gggtgtcccctggtgcccc

SEQ ID NO: 2291138 - DNA, 21 bp, Homo sapiens
gggttgtctcagccgagccca

SEQ ID NO: 2291139 - DNA, 17 bp, Homo sapiens
gggtttccacacaggcc

SEQ ID NO: 2291140 - DNA, 13 bp, Homo sapiens
ggtaaagagatgt

SEQ ID NO: 2291141 - DNA, 16 bp, Homo sapiens
ggtaaattataaatgt

SEQ ID NO: 2291142 - DNA, 19 bp, Homo sapiens
ggtaagtttcagtggagct

SEQ ID NO: 2291143 - DNA, 21 bp, Homo sapiens
ggtacttctgtgttgtgattc

SEQ ID NO: 2291144 - DNA, 14 bp, Homo sapiens
ggtagctctgaagg

SEQ ID NO: 2291145 - DNA, 21 bp, Homo sapiens
ggtagctctgaagggagggga

SEQ ID NO: 2291146 - DNA, 14 bp, Homo sapiens
ggtatccagaggtg

SEQ ID NO: 2291147 - DNA, 18 bp, Homo sapiens
ggtattttcgtgcatttg

SEQ ID NO: 2291148 - DNA, 22 bp, Homo sapiens
ggtcacctcactcagcaccact

SEQ ID NO: 2291149 - DNA, 19 bp, Homo sapiens
ggtcagcgattcctgccaa

SEQ ID NO: 2291150 - DNA, 18 bp, Homo sapiens
ggtcagttgggcccccat

SEQ ID NO: 2291151 - DNA, 18 bp, Homo sapiens
ggtcagttttcacagagg

SEQ ID NO: 2291152 - DNA, 19 bp, Homo sapiens
ggtcagttttcacagaggc

SEQ ID NO: 2291153 - DNA, 19 bp, Homo sapiens
ggtcatcccggggccatgg

SEQ ID NO: 2291154 - DNA, 23 bp, Homo sapiens
ggtcatttgtagatatatatttc

SEQ ID NO: 2291155 - DNA, 18 bp, Homo sapiens
ggtccaaggtcaaggcac

SEQ ID NO: 2291156 - DNA, 10 bp, Homo sapiens
ggtccacatt

SEQ ID NO: 2291157 - DNA, 17 bp, Homo sapiens
ggtccacattctgctgc

SEQ ID NO: 2291158 - DNA, 20 bp, Homo sapiens
ggtccaccccgtcccggccc

SEQ ID NO: 2291159 - DNA, 15 bp, Homo sapiens
ggtccaccctagcct

SEQ ID NO: 2291160 - DNA, 21 bp, Homo sapiens
ggtccattaatacttccttat

SEQ ID NO: 2291161 - DNA, 21 bp, Homo sapiens
ggtccccatccccagctggga

SEQ ID NO: 2291162 - DNA, 19 bp, Homo sapiens
ggtccccggacgctggctc

SEQ ID NO: 2291163 - DNA, 13 bp, Homo sapiens
ggtcctgctgctc

SEQ ID NO: 2291164 - DNA, 14 bp, Homo sapiens
ggtcctgctgctcg

SEQ ID NO: 2291165 - DNA, 21 bp, Homo sapiens
ggtcctgctgctcgggaaggc

SEQ ID NO: 2291166 - DNA, 12 bp, Homo sapiens
ggtcctgtgccc

SEQ ID NO: 2291167 - DNA, 12 bp, Homo sapiens
ggtcgcccctcc

SEQ ID NO: 2291168 - DNA, 18 bp, Homo sapiens
ggtcgcgatgatgggctg

SEQ ID NO: 2291169 - DNA, 18 bp, Homo sapiens
ggtcgggggaggagcacc

SEQ ID NO: 2291170 - DNA, 14 bp, Homo sapiens
ggtctagaagaaca

SEQ ID NO: 2291171 - DNA, 13 bp, Homo sapiens
ggtctcactgtgt

SEQ ID NO: 2291172 - DNA, 21 bp, Homo sapiens
ggtctcactgtgttgcccagg

SEQ ID NO: 2291173 - DNA, 15 bp, Homo sapiens
ggtctcagaggaggg

SEQ ID NO: 2291174 - DNA, 19 bp, Homo sapiens
ggtctcgtgttcgctggct

SEQ ID NO: 2291175 - DNA, 21 bp, Homo sapiens
ggtctcgtgttcgctggctga

SEQ ID NO: 2291176 - DNA, 14 bp, Homo sapiens
ggtctgtgcccgag

SEQ ID NO: 2291177 - DNA, 15 bp, Homo sapiens
ggtctgtgcccgagg

SEQ ID NO: 2291178 - DNA, 23 bp, Homo sapiens
ggtctgtgcccgaggttcctgtc

SEQ ID NO: 2291179 - DNA, 20 bp, Homo sapiens
ggtcttctttaaggaagaat

SEQ ID NO: 2291180 - DNA, 13 bp, Homo sapiens
ggtgagggaggcc

SEQ ID NO: 2291181 - DNA, 16 bp, Homo sapiens
ggtgaggtgggggcag

SEQ ID NO: 2291182 - DNA, 21 bp, Homo sapiens
ggtgatactccaaggtggcat

SEQ ID NO: 2291183 - DNA, 12 bp, Homo sapiens
ggtgcaatgacc

SEQ ID NO: 2291184 - DNA, 18 bp, Homo sapiens
ggtgcagttgctcattgt

SEQ ID NO: 2291185 - DNA, 12 bp, Homo sapiens
ggtgccctgcat

SEQ ID NO: 2291186 - DNA, 16 bp, Homo sapiens
ggtgcggaccggagcg

SEQ ID NO: 2291187 - DNA, 24 bp, Homo sapiens
ggtgcggaccggagcggctgagga

SEQ ID NO: 2291188 - DNA, 22 bp, Homo sapiens
ggtgctgaacgacagtcccagt

SEQ ID NO: 2291189 - DNA, 17 bp, Homo sapiens
ggtggaagggcaggagc

SEQ ID NO: 2291190 - DNA, 18 bp, Homo sapiens
ggtggagatgtcagtctg

SEQ ID NO: 2291191 - DNA, 12 bp, Homo sapiens
ggtggaggatgg

SEQ ID NO: 2291192 - DNA, 14 bp, Homo sapiens
ggtgggacacagag

SEQ ID NO: 2291193 - DNA, 12 bp, Homo sapiens
ggtgggaggggg

SEQ ID NO: 2291194 - DNA, 18 bp, Homo sapiens
ggtgggccccacagtggt

SEQ ID NO: 2291195 - DNA, 20 bp, Homo sapiens
ggtgggccctggaggggccc

SEQ ID NO: 2291196 - DNA, 20 bp, Homo sapiens
ggtggggagggcctctggac

SEQ ID NO: 2291197 - DNA, 19 bp, Homo sapiens
ggtgtcccctggtgcccct

SEQ ID NO: 2291198 - DNA, 21 bp, Homo sapiens
ggtgtcccctggtgcccctcc

SEQ ID NO: 2291199 - DNA, 16 bp, Homo sapiens
ggtgtcgggcatgaca

SEQ ID NO: 2291200 - DNA, 19 bp, Homo sapiens
ggtgtgacctgacacctgc

SEQ ID NO: 2291201 - DNA, 11 bp, Homo sapiens
ggtgtgaggag

SEQ ID NO: 2291202 - DNA, 15 bp, Homo sapiens
ggtgtgccaaactac

SEQ ID NO: 2291203 - DNA, 13 bp, Homo sapiens
ggttcccccagga

SEQ ID NO: 2291204 - DNA, 17 bp, Homo sapiens
ggttcccccaggaccct

SEQ ID NO: 2291205 - DNA, 14 bp, Homo sapiens
ggttcttattcact

SEQ ID NO: 2291206 - DNA, 14 bp, Homo sapiens
ggttgggctctgcg

SEQ ID NO: 2291207 - DNA, 19 bp, Homo sapiens
ggttgtaggactaaataat

SEQ ID NO: 2291208 - DNA, 17 bp, Homo sapiens
ggtttagccgggcccca

SEQ ID NO: 2291209 - DNA, 18 bp, Homo sapiens
ggtttccacacaggccca

SEQ ID NO: 2291210 - DNA, 20 bp, Homo sapiens
ggtttccacacaggcccatg

SEQ ID NO: 2291211 - DNA, 21 bp, Homo sapiens
ggtttcctctgccccctcctt

SEQ ID NO: 2291212 - DNA, 21 bp, Homo sapiens
ggtttctcagccttagcacta

SEQ ID NO: 2291213 - DNA, 16 bp, Homo sapiens
gtaaaacaggctgctt

SEQ ID NO: 2291214 - DNA, 17 bp, Homo sapiens
gtaaaacctgttctcca

SEQ ID NO: 2291215 - DNA, 18 bp, Homo sapiens
gtaaacatcataaatagt

SEQ ID NO: 2291216 - DNA, 22 bp, Homo sapiens
gtaaacatcataaatagtaaat

SEQ ID NO: 2291217 - DNA, 23 bp, Homo sapiens
gtaaacatcataaatagtaaata

SEQ ID NO: 2291218 - DNA, 16 bp, Homo sapiens
gtaaagagatgtcaaa

SEQ ID NO: 2291219 - DNA, 20 bp, Homo sapiens
gtaaagagatgtcaaaatgt

SEQ ID NO: 2291220 - DNA, 19 bp, Homo sapiens
gtaaataatgattcaatgt

SEQ ID NO: 2291221 - DNA, 22 bp, Homo sapiens
gtaaatatgacagaatttgtga

SEQ ID NO: 2291222 - DNA, 22 bp, Homo sapiens
gtaaatcccacgacataagctg

SEQ ID NO: 2291223 - DNA, 13 bp, Homo sapiens
gtaaatgttattt

SEQ ID NO: 2291224 - DNA, 16 bp, Homo sapiens
gtaaatgttatttctg

SEQ ID NO: 2291225 - DNA, 18 bp, Homo sapiens
gtaaatgttatttctgca

SEQ ID NO: 2291226 - DNA, 16 bp, Homo sapiens
gtaaattataaatgtt

SEQ ID NO: 2291227 - DNA, 15 bp, Homo sapiens
gtaaattttataatg

SEQ ID NO: 2291228 - DNA, 16 bp, Homo sapiens
gtaacagttggtgatt

SEQ ID NO: 2291229 - DNA, 22 bp, Homo sapiens
gtaactgttaacccagtgttca

SEQ ID NO: 2291230 - DNA, 12 bp, Homo sapiens
gtaactgttctt

SEQ ID NO: 2291231 - DNA, 18 bp, Homo sapiens
gtaagtatatctcagttt

SEQ ID NO: 2291232 - DNA, 16 bp, Homo sapiens
gtaagtgctacataaa

SEQ ID NO: 2291233 - DNA, 14 bp, Homo sapiens
gtaatcacttttca

SEQ ID NO: 2291234 - DNA, 17 bp, Homo sapiens
gtaatcatttatcttat

SEQ ID NO: 2291235 - DNA, 17 bp, Homo sapiens
gtaatggatatgaaaga

SEQ ID NO: 2291236 - DNA, 21 bp, Homo sapiens
gtaatggatatgaaagagaaa

SEQ ID NO: 2291237 - DNA, 16 bp, Homo sapiens
gtaatggcagagcagt

SEQ ID NO: 2291238 - DNA, 12 bp, Homo sapiens
gtaatgtatctt

SEQ ID NO: 2291239 - DNA, 19 bp, Homo sapiens
gtaatgtatcttatttata

SEQ ID NO: 2291240 - DNA, 17 bp, Homo sapiens
gtaattcccatctgctt

SEQ ID NO: 2291241 - DNA, 17 bp, Homo sapiens
gtacacccaattttaaa

SEQ ID NO: 2291242 - DNA, 20 bp, Homo sapiens
gtacacccaattttaaaaaa

SEQ ID NO: 2291243 - DNA, 20 bp, Homo sapiens
gtacagaaaatagcttttat

SEQ ID NO: 2291244 - DNA, 17 bp, Homo sapiens
gtacagaaccagcactc

SEQ ID NO: 2291245 - DNA, 20 bp, Homo sapiens
gtacagaaccagcactccca

SEQ ID NO: 2291246 - DNA, 21 bp, Homo sapiens
gtacataaagtaataactgtt

SEQ ID NO: 2291247 - DNA, 19 bp, Homo sapiens
gtacatatggaaatcctgt

SEQ ID NO: 2291248 - DNA, 21 bp, Homo sapiens
gtacatgacccggatgaactc

SEQ ID NO: 2291249 - DNA, 20 bp, Homo sapiens
gtaccaagatcacaaatagt

SEQ ID NO: 2291250 - DNA, 13 bp, Homo sapiens
gtaccagcccagg

SEQ ID NO: 2291251 - DNA, 17 bp, Homo sapiens
gtaccatcccactgata

SEQ ID NO: 2291252 - DNA, 16 bp, Homo sapiens
gtaccctatgttcact

SEQ ID NO: 2291253 - DNA, 15 bp, Homo sapiens
gtacctctggctgac

SEQ ID NO: 2291254 - DNA, 17 bp, Homo sapiens
gtactgtatagacagtt

SEQ ID NO: 2291255 - DNA, 21 bp, Homo sapiens
gtacttacactgaaatccaaa

SEQ ID NO: 2291256 - DNA, 20 bp, Homo sapiens
gtacttgagaataaatgagc

SEQ ID NO: 2291257 - DNA, 18 bp, Homo sapiens
gtactttcacatctctgt

SEQ ID NO: 2291258 - DNA, 21 bp, Homo sapiens
gtactttcacatctctgtaga

SEQ ID NO: 2291259 - DNA, 13 bp, Homo sapiens
gtactttcttccc

SEQ ID NO: 2291260 - DNA, 18 bp, Homo sapiens
gtagaaaaaaaaataaca

SEQ ID NO: 2291261 - DNA, 16 bp, Homo sapiens
gtagaactgttcattt

SEQ ID NO: 2291262 - DNA, 17 bp, Homo sapiens
gtagagacagggtctca

SEQ ID NO: 2291263 - DNA, 19 bp, Homo sapiens
gtagagttcctttctggga

SEQ ID NO: 2291264 - DNA, 14 bp, Homo sapiens
gtagatatatattt

SEQ ID NO: 2291265 - DNA, 19 bp, Homo sapiens
gtagatattatgtatagaa

SEQ ID NO: 2291266 - DNA, 17 bp, Homo sapiens
gtagattgtgtaaattc

SEQ ID NO: 2291267 - DNA, 18 bp, Homo sapiens
gtagcagagtcattgtta

SEQ ID NO: 2291268 - DNA, 14 bp, Homo sapiens
gtagcattaaatat

SEQ ID NO: 2291269 - DNA, 22 bp, Homo sapiens
gtagcccacaataatgaataat

SEQ ID NO: 2291270 - DNA, 15 bp, Homo sapiens
gtagctgtggggagc

SEQ ID NO: 2291271 - DNA, 16 bp, Homo sapiens
gtagctgtggggagct

SEQ ID NO: 2291272 - DNA, 18 bp, Homo sapiens
gtagctgtggggagctgg

SEQ ID NO: 2291273 - DNA, 19 bp, Homo sapiens
gtagctgtggggagctggt

SEQ ID NO: 2291274 - DNA, 13 bp, Homo sapiens
gtaggctgtattt

SEQ ID NO: 2291275 - DNA, 15 bp, Homo sapiens
gtaggctgtattttc

SEQ ID NO: 2291276 - DNA, 15 bp, Homo sapiens
gtagggccagggctc

SEQ ID NO: 2291277 - DNA, 19 bp, Homo sapiens
gtagggtgagggaggacag

SEQ ID NO: 2291278 - DNA, 17 bp, Homo sapiens
gtagtagttgatgacca

SEQ ID NO: 2291279 - DNA, 13 bp, Homo sapiens
gtagttgctttgc

SEQ ID NO: 2291280 - DNA, 20 bp, Homo sapiens
gtagttgctttgcggcatct

SEQ ID NO: 2291281 - DNA, 14 bp, Homo sapiens
gtatacatttagtt

SEQ ID NO: 2291282 - DNA, 15 bp, Homo sapiens
gtatacctatttcat

SEQ ID NO: 2291283 - DNA, 19 bp, Homo sapiens
gtatactccatagaaacta

SEQ ID NO: 2291284 - DNA, 19 bp, Homo sapiens
gtatagacagtttgtaaat

SEQ ID NO: 2291285 - DNA, 16 bp, Homo sapiens
gtataggacaaggggt

SEQ ID NO: 2291286 - DNA, 12 bp, Homo sapiens
gtatatatgtac

SEQ ID NO: 2291287 - DNA, 14 bp, Homo sapiens
gtatatatttatta

SEQ ID NO: 2291288 - DNA, 22 bp, Homo sapiens
gtatattattgctatatttgct

SEQ ID NO: 2291289 - DNA, 17 bp, Homo sapiens
gtatcagagggtggaga

SEQ ID NO: 2291290 - DNA, 21 bp, Homo sapiens
gtatcattttgcacgtgctct

SEQ ID NO: 2291291 - DNA, 16 bp, Homo sapiens
gtatccagaggtgagg

SEQ ID NO: 2291292 - DNA, 12 bp, Homo sapiens
gtatcctgtgca

SEQ ID NO: 2291293 - DNA, 16 bp, Homo sapiens
gtatctaaaaaataac

SEQ ID NO: 2291294 - DNA, 21 bp, Homo sapiens
gtatctccatccttaactgtc

SEQ ID NO: 2291295 - DNA, 16 bp, Homo sapiens
gtatgatttctgttgt

SEQ ID NO: 2291296 - DNA, 17 bp, Homo sapiens
gtatgcaagaagaatat

SEQ ID NO: 2291297 - DNA, 15 bp, Homo sapiens
gtatgctttcttcat

SEQ ID NO: 2291298 - DNA, 14 bp, Homo sapiens
gtattattgctgtt

SEQ ID NO: 2291299 - DNA, 20 bp, Homo sapiens
gtattattgctgttgcttga

SEQ ID NO: 2291300 - DNA, 14 bp, Homo sapiens
gtattgagatactt

SEQ ID NO: 2291301 - DNA, 23 bp, Homo sapiens
gtattttaataaagattccatgg

SEQ ID NO: 2291302 - DNA, 16 bp, Homo sapiens
gtattttcaataaaga

SEQ ID NO: 2291303 - DNA, 18 bp, Homo sapiens
gtattttcgtgcatttgt

SEQ ID NO: 2291304 - DNA, 19 bp, Homo sapiens
gtattttcttcccatttgt

SEQ ID NO: 2291305 - DNA, 22 bp, Homo sapiens
gtattttcttcccatttgtaat

SEQ ID NO: 2291306 - DNA, 23 bp, Homo sapiens
gtattttcttcccatttgtaatg

SEQ ID NO: 2291307 - DNA, 14 bp, Homo sapiens
gtatttttagagat

SEQ ID NO: 2291308 - DNA, 12 bp, Homo sapiens
gtcaaaaatatt

SEQ ID NO: 2291309 - DNA, 14 bp, Homo sapiens
gtcaaaaatatttt

SEQ ID NO: 2291310 - DNA, 16 bp, Homo sapiens
gtcaaaaatattttta

SEQ ID NO: 2291311 - DNA, 22 bp, Homo sapiens
gtcaaagacgctgagtgggagc

SEQ ID NO: 2291312 - DNA, 16 bp, Homo sapiens
gtcaactgctgtttta

SEQ ID NO: 2291313 - DNA, 12 bp, Homo sapiens
gtcaatgtgaaa

SEQ ID NO: 2291314 - DNA, 18 bp, Homo sapiens
gtcaatgtgaaataaaga

SEQ ID NO: 2291315 - DNA, 20 bp, Homo sapiens
gtcaattcattaataaaata

SEQ ID NO: 2291316 - DNA, 15 bp, Homo sapiens
gtcacctcactcagc

SEQ ID NO: 2291317 - DNA, 19 bp, Homo sapiens
gtcactaagaatataaata

SEQ ID NO: 2291318 - DNA, 23 bp, Homo sapiens
gtcactcacaaaaggctggatgt

SEQ ID NO: 2291319 - DNA, 21 bp, Homo sapiens
gtcacttgatcatgctgcagt

SEQ ID NO: 2291320 - DNA, 17 bp, Homo sapiens
gtcagcggagaggaccc

SEQ ID NO: 2291321 - DNA, 22 bp, Homo sapiens
gtcagcggagaggaccccattc

SEQ ID NO: 2291322 - DNA, 20 bp, Homo sapiens
gtcaggaggtgcctgagagc

SEQ ID NO: 2291323 - DNA, 12 bp, Homo sapiens
gtcagtctgtcc

SEQ ID NO: 2291324 - DNA, 16 bp, Homo sapiens
gtcagttttcacagag

SEQ ID NO: 2291325 - DNA, 16 bp, Homo sapiens
gtcatcccggggccat

SEQ ID NO: 2291326 - DNA, 18 bp, Homo sapiens
gtcatccgaaagtgagga

SEQ ID NO: 2291327 - DNA, 18 bp, Homo sapiens
gtcattgctgacagagcc

SEQ ID NO: 2291328 - DNA, 17 bp, Homo sapiens
gtcattggttacaaatt

SEQ ID NO: 2291329 - DNA, 21 bp, Homo sapiens
gtcattggttacaaattttta

SEQ ID NO: 2291330 - DNA, 23 bp, Homo sapiens
gtccacagtgattagcctcgtct

SEQ ID NO: 2291331 - DNA, 15 bp, Homo sapiens
gtccacattctgctg

SEQ ID NO: 2291332 - DNA, 14 bp, Homo sapiens
gtccaccctagcct

SEQ ID NO: 2291333 - DNA, 17 bp, Homo sapiens
gtccactctgctcaggg

SEQ ID NO: 2291334 - DNA, 19 bp, Homo sapiens
gtccactctgctcagggcc

SEQ ID NO: 2291335 - DNA, 20 bp, Homo sapiens
gtccactctgctcagggccg

SEQ ID NO: 2291336 - DNA, 15 bp, Homo sapiens
gtccacttatgtaga

SEQ ID NO: 2291337 - DNA, 17 bp, Homo sapiens
gtccagaacaaaagata

SEQ ID NO: 2291338 - DNA, 18 bp, Homo sapiens
gtccagacctgggccctg

SEQ ID NO: 2291339 - DNA, 12 bp, Homo sapiens
gtccagctctcc

SEQ ID NO: 2291340 - DNA, 20 bp, Homo sapiens
gtccagctctcccctgcgca

SEQ ID NO: 2291341 - DNA, 14 bp, Homo sapiens
gtccagtccagtga

SEQ ID NO: 2291342 - DNA, 15 bp, Homo sapiens
gtccagtgagaaatt

SEQ ID NO: 2291343 - DNA, 15 bp, Homo sapiens
gtccataagagaaat

SEQ ID NO: 2291344 - DNA, 18 bp, Homo sapiens
gtccatgtgaaatttaca

SEQ ID NO: 2291345 - DNA, 14 bp, Homo sapiens
gtcccacagcccct

SEQ ID NO: 2291346 - DNA, 17 bp, Homo sapiens
gtcccatgggctctggc

SEQ ID NO: 2291347 - DNA, 23 bp, Homo sapiens
gtccccaggggcacacttcccct

SEQ ID NO: 2291348 - DNA, 16 bp, Homo sapiens
gtccccggacgctggc

SEQ ID NO: 2291349 - DNA, 17 bp, Homo sapiens
gtccccggacgctggct

SEQ ID NO: 2291350 - DNA, 17 bp, Homo sapiens
gtcccctggtgcccctc

SEQ ID NO: 2291351 - DNA, 18 bp, Homo sapiens
gtccctgacttcccagct

SEQ ID NO: 2291352 - DNA, 20 bp, Homo sapiens
gtccctttcacactgtggtg

SEQ ID NO: 2291353 - DNA, 23 bp, Homo sapiens
gtccgatggcccgagagctggga

SEQ ID NO: 2291354 - DNA, 15 bp, Homo sapiens
gtccgcccgcccacc

SEQ ID NO: 2291355 - DNA, 17 bp, Homo sapiens
gtccgcccgcccacccc

SEQ ID NO: 2291356 - DNA, 18 bp, Homo sapiens
gtccggcctgcagcccag

SEQ ID NO: 2291357 - DNA, 15 bp, Homo sapiens
gtccgtccgcccgcc

SEQ ID NO: 2291358 - DNA, 19 bp, Homo sapiens
gtccgtccgcccgcccacc

SEQ ID NO: 2291359 - DNA, 23 bp, Homo sapiens
gtccgtccgcccgcccaccccgc

SEQ ID NO: 2291360 - DNA, 13 bp, Homo sapiens
gtcctccaaaaca

SEQ ID NO: 2291361 - DNA, 23 bp, Homo sapiens
gtcctctgcactgggaatttatt

SEQ ID NO: 2291362 - DNA, 19 bp, Homo sapiens
gtcctgccgacggagccac

SEQ ID NO: 2291363 - DNA, 22 bp, Homo sapiens
gtcctgctgctcgggaaggcct

SEQ ID NO: 2291364 - DNA, 17 bp, Homo sapiens
gtcctggcatgggaatg

SEQ ID NO: 2291365 - DNA, 11 bp, Homo sapiens
gtcctgtgccc

SEQ ID NO: 2291366 - DNA, 15 bp, Homo sapiens
gtcctgtgccccgac

SEQ ID NO: 2291367 - DNA, 11 bp, Homo sapiens
gtcgcccctcc

SEQ ID NO: 2291368 - DNA, 14 bp, Homo sapiens
gtcgcgatgatggg

SEQ ID NO: 2291369 - DNA, 15 bp, Homo sapiens
gtcggctgggcaggg

SEQ ID NO: 2291370 - DNA, 23 bp, Homo sapiens
gtcggctgggcagggccgcaggg

SEQ ID NO: 2291371 - DNA, 14 bp, Homo sapiens
gtcgggggaggagc

SEQ ID NO: 2291372 - DNA, 18 bp, Homo sapiens
gtctaaagttagggcatt

SEQ ID NO: 2291373 - DNA, 23 bp, Homo sapiens
gtctagcatgctgagtcatgtct

SEQ ID NO: 2291374 - DNA, 22 bp, Homo sapiens
gtctatgaactagagactctgt

SEQ ID NO: 2291375 - DNA, 21 bp, Homo sapiens
gtctattttataagggcacta

SEQ ID NO: 2291376 - DNA, 19 bp, Homo sapiens
gtctcactgtgttgcccag

SEQ ID NO: 2291377 - DNA, 22 bp, Homo sapiens
gtctcactgtgttgcccaggct

SEQ ID NO: 2291378 - DNA, 15 bp, Homo sapiens
gtctcccaacaagtg

SEQ ID NO: 2291379 - DNA, 21 bp, Homo sapiens
gtctccgctcccgcagcgggc

SEQ ID NO: 2291380 - DNA, 14 bp, Homo sapiens
gtctcctcctccag

SEQ ID NO: 2291381 - DNA, 16 bp, Homo sapiens
gtctccttttgtctga

SEQ ID NO: 2291382 - DNA, 15 bp, Homo sapiens
gtctcgtcaggaggt

SEQ ID NO: 2291383 - DNA, 18 bp, Homo sapiens
gtctcgtcaggaggtgcc

SEQ ID NO: 2291384 - DNA, 12 bp, Homo sapiens
gtctctgagaac

SEQ ID NO: 2291385 - DNA, 13 bp, Homo sapiens
gtctctgagcagt

SEQ ID NO: 2291386 - DNA, 14 bp, Homo sapiens
gtctctgagcagtg

SEQ ID NO: 2291387 - DNA, 24 bp, Homo sapiens
gtctgatagagtttaacagatatt

SEQ ID NO: 2291388 - DNA, 12 bp, Homo sapiens
gtctgattctat

SEQ ID NO: 2291389 - DNA, 9 bp, Homo sapiens
gtctgcccc

SEQ ID NO: 2291390 - DNA, 21 bp, Homo sapiens
gtctgccccttgaccccacac

SEQ ID NO: 2291391 - DNA, 12 bp, Homo sapiens
gtctgctgctgt

SEQ ID NO: 2291392 - DNA, 14 bp, Homo sapiens
gtctgtgcccgagg

SEQ ID NO: 2291393 - DNA, 23 bp, Homo sapiens
gtcttaccgaataaggtaccaag

SEQ ID NO: 2291394 - DNA, 21 bp, Homo sapiens
gtcttcaaccctgccctgcac

SEQ ID NO: 2291395 - DNA, 22 bp, Homo sapiens
gtcttcctcctcagtcttctca

SEQ ID NO: 2291396 - DNA, 18 bp, Homo sapiens
gtcttgagcaatgttttt

SEQ ID NO: 2291397 - DNA, 22 bp, Homo sapiens
gtcttgagcaatgtttttctca

SEQ ID NO: 2291398 - DNA, 20 bp, Homo sapiens
gtctttagtgatgcaataaa

SEQ ID NO: 2291399 - DNA, 15 bp, Homo sapiens
gtctttgtacagaca

SEQ ID NO: 2291400 - DNA, 13 bp, Homo sapiens
gtctttttccaaa

SEQ ID NO: 2291401 - DNA, 15 bp, Homo sapiens
gtctttttccaaaca

SEQ ID NO: 2291402 - DNA, 12 bp, Homo sapiens
gtgaacatttct

SEQ ID NO: 2291403 - DNA, 15 bp, Homo sapiens
gtgaagcatccaggc

SEQ ID NO: 2291404 - DNA, 15 bp, Homo sapiens
gtgaatgttaacatg

SEQ ID NO: 2291405 - DNA, 16 bp, Homo sapiens
gtgaccggcccgccac

SEQ ID NO: 2291406 - DNA, 21 bp, Homo sapiens
gtgaccggcccgccaccttgt

SEQ ID NO: 2291407 - DNA, 15 bp, Homo sapiens
gtgacctgacacctg

SEQ ID NO: 2291408 - DNA, 16 bp, Homo sapiens
gtgacctgacacctgc

SEQ ID NO: 2291409 - DNA, 17 bp, Homo sapiens
gtgactgatctctcgtg

SEQ ID NO: 2291410 - DNA, 21 bp, Homo sapiens
gtgagaaattacaggttcctt

SEQ ID NO: 2291411 - DNA, 14 bp, Homo sapiens
gtgagatacaaagc

SEQ ID NO: 2291412 - DNA, 14 bp, Homo sapiens
gtgagatttgtatt

SEQ ID NO: 2291413 - DNA, 16 bp, Homo sapiens
gtgagatttgtattta

SEQ ID NO: 2291414 - DNA, 15 bp, Homo sapiens
gtgagccaaagagaa

SEQ ID NO: 2291415 - DNA, 13 bp, Homo sapiens
tacactgtaagaa

SEQ ID NO: 2291416 - DNA, 16 bp, Homo sapiens
tacactgtatctaaaa

SEQ ID NO: 2291417 - DNA, 16 bp, Homo sapiens
tacacttctgaaactt

SEQ ID NO: 2291418 - DNA, 14 bp, Homo sapiens
tacagaaaatagct

SEQ ID NO: 2291419 - DNA, 17 bp, Homo sapiens
tacagaaacaactgcca

SEQ ID NO: 2291420 - DNA, 18 bp, Homo sapiens
tacagaaccagcactccc

SEQ ID NO: 2291421 - DNA, 23 bp, Homo sapiens
tacagaaccagcactcccagggc

SEQ ID NO: 2291422 - DNA, 15 bp, Homo sapiens
tacagacaaagcgtg

SEQ ID NO: 2291423 - DNA, 19 bp, Homo sapiens
tacagcaaataaaacagtg

SEQ ID NO: 2291424 - DNA, 18 bp, Homo sapiens
tacagcatgagattgtac

SEQ ID NO: 2291425 - DNA, 19 bp, Homo sapiens
tacagcatgagattgtaca

SEQ ID NO: 2291426 - DNA, 14 bp, Homo sapiens
tacaggaagtactg

SEQ ID NO: 2291427 - DNA, 16 bp, Homo sapiens
tacaggtcttctttaa

SEQ ID NO: 2291428 - DNA, 17 bp, Homo sapiens
tacaggtgtgagccaca

SEQ ID NO: 2291429 - DNA, 23 bp, Homo sapiens
tacagtaactgagtgtggcggga

SEQ ID NO: 2291430 - DNA, 22 bp, Homo sapiens
tacagtagctgtggggagctgg

SEQ ID NO: 2291431 - DNA, 16 bp, Homo sapiens
tacagtgtttggacag

SEQ ID NO: 2291432 - DNA, 20 bp, Homo sapiens
tacataaaaattgtttctat

SEQ ID NO: 2291433 - DNA, 16 bp, Homo sapiens
tacataaaagaatgta

SEQ ID NO: 2291434 - DNA, 16 bp, Homo sapiens
tacataaattggcctg

SEQ ID NO: 2291435 - DNA, 14 bp, Homo sapiens
tacataattaaatt

SEQ ID NO: 2291436 - DNA, 17 bp, Homo sapiens
tacataattaaatttta

SEQ ID NO: 2291437 - DNA, 14 bp, Homo sapiens
tacatatggaaatc

SEQ ID NO: 2291438 - DNA, 13 bp, Homo sapiens
tacatcctctgct

SEQ ID NO: 2291439 - DNA, 20 bp, Homo sapiens
tacatcctctgcttgtcatt

SEQ ID NO: 2291440 - DNA, 14 bp, Homo sapiens
tacatctaagtcag

SEQ ID NO: 2291441 - DNA, 22 bp, Homo sapiens
tacatctagcacagctgtgagg

SEQ ID NO: 2291442 - DNA, 16 bp, Homo sapiens
tacatgtaaaaatgtt

SEQ ID NO: 2291443 - DNA, 14 bp, Homo sapiens
tacatgttgtatta

SEQ ID NO: 2291444 - DNA, 22 bp, Homo sapiens
tacattatgcccttgagtctag

SEQ ID NO: 2291445 - DNA, 22 bp, Homo sapiens
tacattctgaaggccttgttaa

SEQ ID NO: 2291446 - DNA, 18 bp, Homo sapiens
tacatttgtatttttcca

SEQ ID NO: 2291447 - DNA, 15 bp, Homo sapiens
tacattttctttcat

SEQ ID NO: 2291448 - DNA, 14 bp, Homo sapiens
taccaaatataaac

SEQ ID NO: 2291449 - DNA, 14 bp, Homo sapiens
taccaactatttca

SEQ ID NO: 2291450 - DNA, 23 bp, Homo sapiens
taccaactatttcaataagtgtt

SEQ ID NO: 2291451 - DNA, 16 bp, Homo sapiens
taccagcagaaaacct

SEQ ID NO: 2291452 - DNA, 23 bp, Homo sapiens
taccagcggggacaccaatggct

SEQ ID NO: 2291453 - DNA, 22 bp, Homo sapiens
taccaggaagaggggcgctgcc

SEQ ID NO: 2291454 - DNA, 19 bp, Homo sapiens
tacccaaccaaagatgctt

SEQ ID NO: 2291455 - DNA, 17 bp, Homo sapiens
taccctcagtctacact

SEQ ID NO: 2291456 - DNA, 18 bp, Homo sapiens
taccgaggagctaaacat

SEQ ID NO: 2291457 - DNA, 18 bp, Homo sapiens
taccgataaatgaacatt

SEQ ID NO: 2291458 - DNA, 22 bp, Homo sapiens
taccttgtgtactttcttccct

SEQ ID NO: 2291459 - DNA, 22 bp, Homo sapiens
tacctttaaaaaataatttaga

SEQ ID NO: 2291460 - DNA, 18 bp, Homo sapiens
tacgtcttgatcagacat

SEQ ID NO: 2291461 - DNA, 13 bp, Homo sapiens
tacgtgagtcctg

SEQ ID NO: 2291462 - DNA, 16 bp, Homo sapiens
tactaaaaatatgaaa

SEQ ID NO: 2291463 - DNA, 14 bp, Homo sapiens
tactagtactgtgt

SEQ ID NO: 2291464 - DNA, 16 bp, Homo sapiens
tactagtactgtgtac

SEQ ID NO: 2291465 - DNA, 17 bp, Homo sapiens
tactagtactgtgtact

SEQ ID NO: 2291466 - DNA, 21 bp, Homo sapiens
tactagtactgtgtactgtat

SEQ ID NO: 2291467 - DNA, 12 bp, Homo sapiens
tactatgtaagg

SEQ ID NO: 2291468 - DNA, 16 bp, Homo sapiens
tactcaggctttctat

SEQ ID NO: 2291469 - DNA, 18 bp, Homo sapiens
tactcgagttacagacaa

SEQ ID NO: 2291470 - DNA, 21 bp, Homo sapiens
tactcttcagaatatggacaa

SEQ ID NO: 2291471 - DNA, 19 bp, Homo sapiens
tactgccaacctcgctcca

SEQ ID NO: 2291472 - DNA, 23 bp, Homo sapiens
tactgccaacctcgctccaactc

SEQ ID NO: 2291473 - DNA, 18 bp, Homo sapiens
tactgcccagatgtttta

SEQ ID NO: 2291474 - DNA, 20 bp, Homo sapiens
tactgcccagatgttttaga

SEQ ID NO: 2291475 - DNA, 22 bp, Homo sapiens
tactgcttggatccatacaaaa

SEQ ID NO: 2291476 - DNA, 23 bp, Homo sapiens
tactggttatagttgatatgtaa

SEQ ID NO: 2291477 - DNA, 17 bp, Homo sapiens
tactgtatagacagttt

SEQ ID NO: 2291478 - DNA, 20 bp, Homo sapiens
tactgtatagacagtttgta

SEQ ID NO: 2291479 - DNA, 22 bp, Homo sapiens
tactgtatagacagtttgtaaa

SEQ ID NO: 2291480 - DNA, 15 bp, Homo sapiens
tactgtatatgtcaa

SEQ ID NO: 2291481 - DNA, 16 bp, Homo sapiens
tactgtcagagaatat

SEQ ID NO: 2291482 - DNA, 18 bp, Homo sapiens
tactgtgtactgtataga

SEQ ID NO: 2291483 - DNA, 13 bp, Homo sapiens
tacttaaagcttg

SEQ ID NO: 2291484 - DNA, 18 bp, Homo sapiens
tacttacactgaaatcca

SEQ ID NO: 2291485 - DNA, 16 bp, Homo sapiens
tacttcactttcatct

SEQ ID NO: 2291486 - DNA, 19 bp, Homo sapiens
tacttcagttctcatcttg

SEQ ID NO: 2291487 - DNA, 18 bp, Homo sapiens
tacttccttataaaaatt

SEQ ID NO: 2291488 - DNA, 17 bp, Homo sapiens
tactttcacatctctgt

SEQ ID NO: 2291489 - DNA, 22 bp, Homo sapiens
tactttcagaatattttcaaaa

SEQ ID NO: 2291490 - DNA, 23 bp, Homo sapiens
tactttcagaatattttcaaaat

SEQ ID NO: 2291491 - DNA, 20 bp, Homo sapiens
tactttccaacattatcctg

SEQ ID NO: 2291492 - DNA, 17 bp, Homo sapiens
tactttcctgatgttga

SEQ ID NO: 2291493 - DNA, 15 bp, Homo sapiens
tactttctcacatgt

SEQ ID NO: 2291494 - DNA, 16 bp, Homo sapiens
tacttttgtgtattct

SEQ ID NO: 2291495 - DNA, 14 bp, Homo sapiens
tacttttttaaaat

SEQ ID NO: 2291496 - DNA, 17 bp, Homo sapiens
tagaaaaaaaaataaca

SEQ ID NO: 2291497 - DNA, 12 bp, Homo sapiens
tagaaaatgaac

SEQ ID NO: 2291498 - DNA, 17 bp, Homo sapiens
tagaaaatgaactgtat

SEQ ID NO: 2291499 - DNA, 19 bp, Homo sapiens
tagaaaatgaactgtatat

SEQ ID NO: 2291500 - DNA, 13 bp, Homo sapiens
tagaaattctata

SEQ ID NO: 2291501 - DNA, 16 bp, Homo sapiens
tagaaattctataaga

SEQ ID NO: 2291502 - DNA, 23 bp, Homo sapiens
tagaaattctataagagacaaag

SEQ ID NO: 2291503 - DNA, 15 bp, Homo sapiens
tagaacatagatgct

SEQ ID NO: 2291504 - DNA, 22 bp, Homo sapiens
tagaacctgcatttaagaacag

SEQ ID NO: 2291505 - DNA, 19 bp, Homo sapiens
tagaactgttcatttccac

SEQ ID NO: 2291506 - DNA, 18 bp, Homo sapiens
tagaagatgaatcagtat

SEQ ID NO: 2291507 - DNA, 17 bp, Homo sapiens
tagaatatcctatactg

SEQ ID NO: 2291508 - DNA, 19 bp, Homo sapiens
tagaatccaaattctctga

SEQ ID NO: 2291509 - DNA, 18 bp, Homo sapiens
tagaatctattttctatg

SEQ ID NO: 2291510 - DNA, 14 bp, Homo sapiens
tagaatgagaaatc

SEQ ID NO: 2291511 - DNA, 18 bp, Homo sapiens
tagaattaggtaatggat

SEQ ID NO: 2291512 - DNA, 19 bp, Homo sapiens
tagacaaccatagaactgt

SEQ ID NO: 2291513 - DNA, 12 bp, Homo sapiens
tagacaagtgtt

SEQ ID NO: 2291514 - DNA, 16 bp, Homo sapiens
tagacagactttgtat

SEQ ID NO: 2291515 - DNA, 22 bp, Homo sapiens
tagactcaaggaagaataattt

SEQ ID NO: 2291516 - DNA, 18 bp, Homo sapiens
tagagaataatttttgtg

SEQ ID NO: 2291517 - DNA, 14 bp, Homo sapiens
tagagacagggtct

SEQ ID NO: 2291518 - DNA, 19 bp, Homo sapiens
tagagacagggtctcactg

SEQ ID NO: 2291519 - DNA, 17 bp, Homo sapiens
tagagactctgtgatct

SEQ ID NO: 2291520 - DNA, 22 bp, Homo sapiens
tagagactctgtgatctaagca

SEQ ID NO: 2291521 - DNA, 11 bp, Homo sapiens
tagagataaat

SEQ ID NO: 2291522 - DNA, 19 bp, Homo sapiens
tagagataaatatttatgc

SEQ ID NO: 2291523 - DNA, 15 bp, Homo sapiens
tagagattaatttgt

SEQ ID NO: 2291524 - DNA, 19 bp, Homo sapiens
tagaggggcaaaaatattt

SEQ ID NO: 2291525 - DNA, 19 bp, Homo sapiens
tagataacaagaatacaac

SEQ ID NO: 2291526 - DNA, 13 bp, Homo sapiens
tagatatatattt

SEQ ID NO: 2291527 - DNA, 15 bp, Homo sapiens
tagatattatgtata

SEQ ID NO: 2291528 - DNA, 17 bp, Homo sapiens
tagatattatgtataga

SEQ ID NO: 2291529 - DNA, 17 bp, Homo sapiens
tagatattcatactttc

SEQ ID NO: 2291530 - DNA, 20 bp, Homo sapiens
tagatctcctgtaattttgt

SEQ ID NO: 2291531 - DNA, 23 bp, Homo sapiens
tagatctcctgtaattttgtagt

SEQ ID NO: 2291532 - DNA, 22 bp, Homo sapiens
tagatgctattaaagtttcatt

SEQ ID NO: 2291533 - DNA, 13 bp, Homo sapiens
tagattgaaattt

SEQ ID NO: 2291534 - DNA, 13 bp, Homo sapiens
tagatttctagca

SEQ ID NO: 2291535 - DNA, 19 bp, Homo sapiens
tagcaaaatattatctgaa

SEQ ID NO: 2291536 - DNA, 23 bp, Homo sapiens
tagcaaacaaaaatagaatatat

SEQ ID NO: 2291537 - DNA, 19 bp, Homo sapiens
tagcagagtcattgttaca

SEQ ID NO: 2291538 - DNA, 19 bp, Homo sapiens
tagcagtatgtgtgctctt

SEQ ID NO: 2291539 - DNA, 12 bp, Homo sapiens
tagcagtgctag

SEQ ID NO: 2291540 - DNA, 21 bp, Homo sapiens
tagcagtgctaggataaacca

SEQ ID NO: 2291541 - DNA, 19 bp, Homo sapiens
tagcatcctgattattgaa

SEQ ID NO: 2291542 - DNA, 23 bp, Homo sapiens
tagcatcctgattattgaatgtt

SEQ ID NO: 2291543 - DNA, 17 bp, Homo sapiens
tagcatggatagagtat

SEQ ID NO: 2291544 - DNA, 18 bp, Homo sapiens
tagcattaaatataaaat

SEQ ID NO: 2291545 - DNA, 11 bp, Homo sapiens
tagccaaagag

SEQ ID NO: 2291546 - DNA, 17 bp, Homo sapiens
tagccagaatgtttcct

SEQ ID NO: 2291547 - DNA, 23 bp, Homo sapiens
tagccagaatgtttcctgtggaa

SEQ ID NO: 2291548 - DNA, 21 bp, Homo sapiens
tagcccacaataatgaataat

SEQ ID NO: 2291549 - DNA, 15 bp, Homo sapiens
tagcctgcaaagctg

SEQ ID NO: 2291550 - DNA, 17 bp, Homo sapiens
tagctagaatatcctat

SEQ ID NO: 2291551 - DNA, 20 bp, Homo sapiens
tagctctcgcctcaggcttt

SEQ ID NO: 2291552 - DNA, 15 bp, Homo sapiens
tagctgccacttgaa

SEQ ID NO: 2291553 - DNA, 17 bp, Homo sapiens
tagctgtggggagctgg

SEQ ID NO: 2291554 - DNA, 18 bp, Homo sapiens
tagctgtggggagctggt

SEQ ID NO: 2291555 - DNA, 16 bp, Homo sapiens
tagctgttggaatgtt

SEQ ID NO: 2291556 - DNA, 20 bp, Homo sapiens
tagctgttggaatgttgtta

SEQ ID NO: 2291557 - DNA, 22 bp, Homo sapiens
tagctgttggaatgttgttaaa

SEQ ID NO: 2291558 - DNA, 22 bp, Homo sapiens
tagcttttattgagtaatatta

SEQ ID NO: 2291559 - DNA, 13 bp, Homo sapiens
taggaaaaactga

SEQ ID NO: 2291560 - DNA, 16 bp, Homo sapiens
taggaaaaactgattt

SEQ ID NO: 2291561 - DNA, 16 bp, Homo sapiens
taggaaaatacattgt

SEQ ID NO: 2291562 - DNA, 18 bp, Homo sapiens
taggaacagagtatatat

SEQ ID NO: 2291563 - DNA, 14 bp, Homo sapiens
taggacaaggggtg

SEQ ID NO: 2291564 - DNA, 18 bp, Homo sapiens
taggaggctgtgggtttt

SEQ ID NO: 2291565 - DNA, 14 bp, Homo sapiens
taggagtggctgac

SEQ ID NO: 2291566 - DNA, 20 bp, Homo sapiens
taggagtggctgaccaggcc

SEQ ID NO: 2291567 - DNA, 16 bp, Homo sapiens
taggcctcagtgtcct

SEQ ID NO: 2291568 - DNA, 15 bp, Homo sapiens
taggctaaaaacatt

SEQ ID NO: 2291569 - DNA, 13 bp, Homo sapiens
taggctattataa

SEQ ID NO: 2291570 - DNA, 17 bp, Homo sapiens
tagggcatttttcttgg

SEQ ID NO: 2291571 - DNA, 18 bp, Homo sapiens
taggggccgagggaaatg

SEQ ID NO: 2291572 - DNA, 15 bp, Homo sapiens
taggtcaatgaaata

SEQ ID NO: 2291573 - DNA, 14 bp, Homo sapiens
taggtgtgccaaac

SEQ ID NO: 2291574 - DNA, 21 bp, Homo sapiens
tagtaaataatgattcaatgt

SEQ ID NO: 2291575 - DNA, 13 bp, Homo sapiens
tagtaatggcaga

SEQ ID NO: 2291576 - DNA, 21 bp, Homo sapiens
tagtacccaaccaaagatgct

SEQ ID NO: 2291577 - DNA, 16 bp, Homo sapiens
tagtagagcaaagact

SEQ ID NO: 2291578 - DNA, 22 bp, Homo sapiens
tagtagcagagtcattgttaca

SEQ ID NO: 2291579 - DNA, 17 bp, Homo sapiens
tagtaggctaaaaacat

SEQ ID NO: 2291580 - DNA, 22 bp, Homo sapiens
tagtagttgatgaccaatctct

SEQ ID NO: 2291581 - DNA, 12 bp, Homo sapiens
tagtccaatgaa

SEQ ID NO: 2291582 - DNA, 19 bp, Homo sapiens
tagtctgtttcattactgc

SEQ ID NO: 2291583 - DNA, 18 bp, Homo sapiens
tagtgatacactgtatct

SEQ ID NO: 2291584 - DNA, 16 bp, Homo sapiens
tagtggcttcagcccc

SEQ ID NO: 2291585 - DNA, 17 bp, Homo sapiens
tagtgttgggtggagga

SEQ ID NO: 2291586 - DNA, 18 bp, Homo sapiens
tagttagcaggaaatagt

SEQ ID NO: 2291587 - DNA, 12 bp, Homo sapiens
tagttctatttc

SEQ ID NO: 2291588 - DNA, 11 bp, Homo sapiens
tagttctgcaa

SEQ ID NO: 2291589 - DNA, 20 bp, Homo sapiens
tagttgaacaagatttccct

SEQ ID NO: 2291590 - DNA, 21 bp, Homo sapiens
tagttgaacaagatttcccta

SEQ ID NO: 2291591 - DNA, 23 bp, Homo sapiens
tagttggagctagaaaatgaact

SEQ ID NO: 2291592 - DNA, 22 bp, Homo sapiens
tagtttattatagtctgtactt

SEQ ID NO: 2291593 - DNA, 14 bp, Homo sapiens
tagtttgttttctt

SEQ ID NO: 2291594 - DNA, 20 bp, Homo sapiens
tagtttgttttctttttctg

SEQ ID NO: 2291595 - DNA, 16 bp, Homo sapiens
tagttttctaaatgtt

SEQ ID NO: 2291596 - DNA, 17 bp, Homo sapiens
tagttttctaaatgttt

SEQ ID NO: 2291597 - DNA, 17 bp, Homo sapiens
tagtttttcctgtgcaa

SEQ ID NO: 2291598 - DNA, 13 bp, Homo sapiens
tataaaaattcta

SEQ ID NO: 2291599 - DNA, 12 bp, Homo sapiens
tataaaatacat

SEQ ID NO: 2291600 - DNA, 14 bp, Homo sapiens
tataaaatacataa

SEQ ID NO: 2291601 - DNA, 23 bp, Homo sapiens
tataaaatacataaaagaatgta

SEQ ID NO: 2291602 - DNA, 18 bp, Homo sapiens
tataaacgatatatgtaa

SEQ ID NO: 2291603 - DNA, 14 bp, Homo sapiens
tataaacttgtgta

SEQ ID NO: 2291604 - DNA, 17 bp, Homo sapiens
tataacaactctatttt

SEQ ID NO: 2291605 - DNA, 18 bp, Homo sapiens
tataacaagccaaacatt

SEQ ID NO: 2291606 - DNA, 22 bp, Homo sapiens
tataagagacaaagtttggaag

SEQ ID NO: 2291607 - DNA, 13 bp, Homo sapiens
tataagttaaaga

SEQ ID NO: 2291608 - DNA, 22 bp, Homo sapiens
tataagttaaagagacaaatag

SEQ ID NO: 2291609 - DNA, 18 bp, Homo sapiens
tataataattacttaatg

SEQ ID NO: 2291610 - DNA, 20 bp, Homo sapiens
tataatatatatatatatca

SEQ ID NO: 2291611 - DNA, 15 bp, Homo sapiens
tataatatgaatata

SEQ ID NO: 2291612 - DNA, 15 bp, Homo sapiens
tataattacttaatg

SEQ ID NO: 2291613 - DNA, 18 bp, Homo sapiens
tataatttacctgaagtc

SEQ ID NO: 2291614 - DNA, 18 bp, Homo sapiens
tataatttccaaactgtt

SEQ ID NO: 2291615 - DNA, 15 bp, Homo sapiens
tatacaaacatgtgg

SEQ ID NO: 2291616 - DNA, 11 bp, Homo sapiens
tatacagacct

SEQ ID NO: 2291617 - DNA, 17 bp, Homo sapiens
tatacagcatgagattg

SEQ ID NO: 2291618 - DNA, 19 bp, Homo sapiens
tatacagcatgagattgta

SEQ ID NO: 2291619 - DNA, 22 bp, Homo sapiens
tatacagtgatcagttgctctc

SEQ ID NO: 2291620 - DNA, 18 bp, Homo sapiens
tatacatacctctctcta

SEQ ID NO: 2291621 - DNA, 17 bp, Homo sapiens
tatacatctagcacagc

SEQ ID NO: 2291622 - DNA, 17 bp, Homo sapiens
tatacatgtaaaaatgt

SEQ ID NO: 2291623 - DNA, 14 bp, Homo sapiens
tatacatgtatagt

SEQ ID NO: 2291624 - DNA, 11 bp, Homo sapiens
tatactgcata

SEQ ID NO: 2291625 - DNA, 19 bp, Homo sapiens
tatactggttatagttgat

SEQ ID NO: 2291626 - DNA, 24 bp, Homo sapiens
tatactggttatagttgatatgta

SEQ ID NO: 2291627 - DNA, 13 bp, Homo sapiens
tatactgtagcaa

SEQ ID NO: 2291628 - DNA, 21 bp, Homo sapiens
tatactgtagcaatatatttg

SEQ ID NO: 2291629 - DNA, 19 bp, Homo sapiens
tatactgtttgtaatatac

SEQ ID NO: 2291630 - DNA, 13 bp, Homo sapiens
tatactttctcac

SEQ ID NO: 2291631 - DNA, 13 bp, Homo sapiens
tatagaaagaaaa

SEQ ID NO: 2291632 - DNA, 15 bp, Homo sapiens
tatagacagtttgta

SEQ ID NO: 2291633 - DNA, 14 bp, Homo sapiens
tatagatataaata

SEQ ID NO: 2291634 - DNA, 15 bp, Homo sapiens
tatagtctgtacttc

SEQ ID NO: 2291635 - DNA, 20 bp, Homo sapiens
tatataaacgatatatgtaa

SEQ ID NO: 2291636 - DNA, 15 bp, Homo sapiens
tatataactacatta

SEQ ID NO: 2291637 - DNA, 21 bp, Homo sapiens
tatataagttaaagagacaaa

SEQ ID NO: 2291638 - DNA, 18 bp, Homo sapiens
tatatacaaagctgtcac

SEQ ID NO: 2291639 - DNA, 13 bp, Homo sapiens
tatatacataaaa

SEQ ID NO: 2291640 - DNA, 13 bp, Homo sapiens
tatatacatgtat

SEQ ID NO: 2291641 - DNA, 16 bp, Homo sapiens
tatatacatgtatagt

SEQ ID NO: 2291642 - DNA, 18 bp, Homo sapiens
tatatacatgtatagtga

SEQ ID NO: 2291643 - DNA, 15 bp, Homo sapiens
tatatatataatata

SEQ ID NO: 2291644 - DNA, 14 bp, Homo sapiens
tatatatcagtttg

SEQ ID NO: 2291645 - DNA, 16 bp, Homo sapiens
tatatatcagtttgat

SEQ ID NO: 2291646 - DNA, 17 bp, Homo sapiens
tatatatcagtttgatc

SEQ ID NO: 2291647 - DNA, 14 bp, Homo sapiens
tatatatgtacagt

SEQ ID NO: 2291648 - DNA, 20 bp, Homo sapiens
tatatatttattattttcat

SEQ ID NO: 2291649 - DNA, 13 bp, Homo sapiens
tatatatttgaaa

SEQ ID NO: 2291650 - DNA, 14 bp, Homo sapiens
tatatcagtttgat

SEQ ID NO: 2291651 - DNA, 12 bp, Homo sapiens
tatatctgtaaa

SEQ ID NO: 2291652 - DNA, 22 bp, Homo sapiens
tatatgtgacactgcagcagaa

SEQ ID NO: 2291653 - DNA, 14 bp, Homo sapiens
tatattatgaataa

SEQ ID NO: 2291654 - DNA, 13 bp, Homo sapiens
tatattcattctt

SEQ ID NO: 2291655 - DNA, 15 bp, Homo sapiens
tatatttcatattga

SEQ ID NO: 2291656 - DNA, 17 bp, Homo sapiens
tatatttccaaatattc

SEQ ID NO: 2291657 - DNA, 21 bp, Homo sapiens
tatatttgtaggtatactatg

SEQ ID NO: 2291658 - DNA, 13 bp, Homo sapiens
tatcaaatcattc

SEQ ID NO: 2291659 - DNA, 14 bp, Homo sapiens
tatcaaatcattca

SEQ ID NO: 2291660 - DNA, 19 bp, Homo sapiens
tatcacacttgcaaatgaa

SEQ ID NO: 2291661 - DNA, 16 bp, Homo sapiens
tatcagctctgcataa

SEQ ID NO: 2291662 - DNA, 22 bp, Homo sapiens
tatcagctctgcataagattat

SEQ ID NO: 2291663 - DNA, 21 bp, Homo sapiens
tatcagggcccaaataacagt

SEQ ID NO: 2291664 - DNA, 22 bp, Homo sapiens
tatcagtggttcgggggaaata

SEQ ID NO: 2291665 - DNA, 14 bp, Homo sapiens
tatcagttggacag

SEQ ID NO: 2291666 - DNA, 15 bp, Homo sapiens
tatcagttggacagt

SEQ ID NO: 2291667 - DNA, 22 bp, Homo sapiens
tatcagtttgatcacactattt

SEQ ID NO: 2291668 - DNA, 23 bp, Homo sapiens
tatcatttggccgagtcagcacg

SEQ ID NO: 2291669 - DNA, 15 bp, Homo sapiens
tatccagtcaaagac

SEQ ID NO: 2291670 - DNA, 16 bp, Homo sapiens
tatccagtcaaagacg

SEQ ID NO: 2291671 - DNA, 16 bp, Homo sapiens
tatccatgtactttcc

SEQ ID NO: 2291672 - DNA, 15 bp, Homo sapiens
tatccctttctcttc

SEQ ID NO: 2291673 - DNA, 16 bp, Homo sapiens
tatcctggtgtctagt

SEQ ID NO: 2291674 - DNA, 18 bp, Homo sapiens
tatcctggtgtctagttt

SEQ ID NO: 2291675 - DNA, 18 bp, Homo sapiens
tatctaaaaaataactgt

SEQ ID NO: 2291676 - DNA, 19 bp, Homo sapiens
tatctaaaaaataactgtg

SEQ ID NO: 2291677 - DNA, 15 bp, Homo sapiens
tatctagcaagaaga

SEQ ID NO: 2291678 - DNA, 20 bp, Homo sapiens
tatctagcaagaagattcta

SEQ ID NO: 2291679 - DNA, 13 bp, Homo sapiens
tatctcaagatag

SEQ ID NO: 2291680 - DNA, 22 bp, Homo sapiens
tatctccatccttaactgtcca

SEQ ID NO: 2291681 - DNA, 22 bp, Homo sapiens
tatctgcaaatagtttcaaatg

SEQ ID NO: 2291682 - DNA, 16 bp, Homo sapiens
tatctgggttttagaa

SEQ ID NO: 2291683 - DNA, 18 bp, Homo sapiens
tatctgtaaatttaactg

SEQ ID NO: 2291684 - DNA, 21 bp, Homo sapiens
tatctgtaaatttaactgcat

SEQ ID NO: 2291685 - DNA, 12 bp, Homo sapiens
tatcttatttat

SEQ ID NO: 2291686 - DNA, 13 bp, Homo sapiens
tatcttgaagaat

SEQ ID NO: 2291687 - DNA, 16 bp, Homo sapiens
tatcttggaatcatgc

SEQ ID NO: 2291688 - DNA, 14 bp, Homo sapiens
tatgaaagagaaaa

SEQ ID NO: 2291689 - DNA, 22 bp, Homo sapiens
tatgaaagagaaaatgctttct

SEQ ID NO: 2291690 - DNA, 15 bp, Homo sapiens
tatgaaagaggcagc

SEQ ID NO: 2291691 - DNA, 13 bp, Homo sapiens
tatgaagtaagtt

SEQ ID NO: 2291692 - DNA, 20 bp, Homo sapiens
tatgactagcaaacaaaaat

SEQ ID NO: 2291693 - DNA, 16 bp, Homo sapiens
tatgagaaaaaaacag

SEQ ID NO: 2291694 - DNA, 15 bp, Homo sapiens
tatgattgaaaagaa

SEQ ID NO: 2291695 - DNA, 17 bp, Homo sapiens
tatgcaagaagaatata

SEQ ID NO: 2291696 - DNA, 21 bp, Homo sapiens
tatgcagcttggagacaggat

SEQ ID NO: 2291697 - DNA, 16 bp, Homo sapiens
tatgcctccatttcag

SEQ ID NO: 2291698 - DNA, 15 bp, Homo sapiens
tatgctttcttcatg

SEQ ID NO: 2291699 - DNA, 14 bp, Homo sapiens
tatggaaatacatt

SEQ ID NO: 2291700 - DNA, 17 bp, Homo sapiens
tatggaacactctgaga

SEQ ID NO: 2291701 - DNA, 18 bp, Homo sapiens
tatggaacactctgagac

SEQ ID NO: 2291702 - DNA, 17 bp, Homo sapiens
tatggagatactattta

SEQ ID NO: 2291703 - DNA, 16 bp, Homo sapiens
tatggctgcagtcctc

SEQ ID NO: 2291704 - DNA, 13 bp, Homo sapiens
tatggctgtattt

SEQ ID NO: 2291705 - DNA, 15 bp, Homo sapiens
tatggctgtattttt

SEQ ID NO: 2291706 - DNA, 20 bp, Homo sapiens
tatggctgtatttttagaga

SEQ ID NO: 2291707 - DNA, 22 bp, Homo sapiens
tatgggtgtgaagtccacttat

SEQ ID NO: 2291708 - DNA, 16 bp, Homo sapiens
tatggtgatactccaa

SEQ ID NO: 2291709 - DNA, 17 bp, Homo sapiens
tatggtgatactccaag

SEQ ID NO: 2291710 - DNA, 13 bp, Homo sapiens
tatgtaaacatca

SEQ ID NO: 2291711 - DNA, 14 bp, Homo sapiens
tatgtaaatataca

SEQ ID NO: 2291712 - DNA, 18 bp, Homo sapiens
tatgtaaatatacagcat

SEQ ID NO: 2291713 - DNA, 13 bp, Homo sapiens
tatgtaacatgtc

SEQ ID NO: 2291714 - DNA, 14 bp, Homo sapiens
tatgtaacatgtct

SEQ ID NO: 2291715 - DNA, 17 bp, Homo sapiens
tatgtaacatgtctaaa

SEQ ID NO: 2291716 - DNA, 14 bp, Homo sapiens
tatgtacagttata

SEQ ID NO: 2291717 - DNA, 17 bp, Homo sapiens
tatgtacagttatacat

SEQ ID NO: 2291718 - DNA, 17 bp, Homo sapiens
tatgtactagtactgtg

SEQ ID NO: 2291719 - DNA, 23 bp, Homo sapiens
tatgtactagtactgtgtactgt

SEQ ID NO: 2291720 - DNA, 16 bp, Homo sapiens
tatgtacttttccatt

SEQ ID NO: 2291721 - DNA, 14 bp, Homo sapiens
tatgtagaactgtt

SEQ ID NO: 2291722 - DNA, 15 bp, Homo sapiens
tatgtagcattaaat

SEQ ID NO: 2291723 - DNA, 14 bp, Homo sapiens
tatgtatagaaaat

SEQ ID NO: 2291724 - DNA, 15 bp, Homo sapiens
tatgtatagaaaata

SEQ ID NO: 2291725 - DNA, 16 bp, Homo sapiens
tatgtcaaaaatattt

SEQ ID NO: 2291726 - DNA, 18 bp, Homo sapiens
tatgtcaattcattaata

SEQ ID NO: 2291727 - DNA, 20 bp, Homo sapiens
tatgtcagtccaataaatta

SEQ ID NO: 2291728 - DNA, 19 bp, Homo sapiens
tatgtgaaggtgtttcaaa

SEQ ID NO: 2291729 - DNA, 16 bp, Homo sapiens
tatgttcataaaaaat

SEQ ID NO: 2291730 - DNA, 22 bp, Homo sapiens
tattaatttagcctttaataat

SEQ ID NO: 2291731 - DNA, 14 bp, Homo sapiens
tattacatttcatt

SEQ ID NO: 2291732 - DNA, 16 bp, Homo sapiens
tattacatttcattta

SEQ ID NO: 2291733 - DNA, 20 bp, Homo sapiens
tattaccgataaatgaacat

SEQ ID NO: 2291734 - DNA, 24 bp, Homo sapiens
tattagagtgcccttaaaataatg

SEQ ID NO: 2291735 - DNA, 19 bp, Homo sapiens
tattagccaaagaggcatt

SEQ ID NO: 2291736 - DNA, 15 bp, Homo sapiens
tattatagatataaa

SEQ ID NO: 2291737 - DNA, 14 bp, Homo sapiens
tattatagtctgta

SEQ ID NO: 2291738 - DNA, 13 bp, Homo sapiens
tattatgaataaa

SEQ ID NO: 2291739 - DNA, 19 bp, Homo sapiens
tattatgatctctgctttg

SEQ ID NO: 2291740 - DNA, 22 bp, Homo sapiens
tattatggtgatactccaaggt

SEQ ID NO: 2291741 - DNA, 14 bp, Homo sapiens
tattatgtatagaa

SEQ ID NO: 2291742 - DNA, 19 bp, Homo sapiens
tattattgctgttgcttga

SEQ ID NO: 2291743 - DNA, 13 bp, Homo sapiens
tattcaggacccc

SEQ ID NO: 2291744 - DNA, 15 bp, Homo sapiens
tattcatactttcca

SEQ ID NO: 2291745 - DNA, 11 bp, Homo sapiens
tattcatctgt

SEQ ID NO: 2291746 - DNA, 18 bp, Homo sapiens
tattcatgtgtacagaaa

SEQ ID NO: 2291747 - DNA, 11 bp, Homo sapiens
tattcccttct

SEQ ID NO: 2291748 - DNA, 18 bp, Homo sapiens
tattctagtcaactgctg

SEQ ID NO: 2291749 - DNA, 19 bp, Homo sapiens
tattctagtcaactgctgt

SEQ ID NO: 2291750 - DNA, 11 bp, Homo sapiens
tattctccatg

SEQ ID NO: 2291751 - DNA, 19 bp, Homo sapiens
tattctgtagccaacttaa

SEQ ID NO: 2291752 - DNA, 19 bp, Homo sapiens
tattctgtggattctatat

SEQ ID NO: 2291753 - DNA, 16 bp, Homo sapiens
tattcttttatataac

SEQ ID NO: 2291754 - DNA, 21 bp, Homo sapiens
tattgacgacctacatctgaa

SEQ ID NO: 2291755 - DNA, 23 bp, Homo sapiens
tattgacgacctacatctgaaat

SEQ ID NO: 2291756 - DNA, 17 bp, Homo sapiens
tattgctgatggtgcaa

SEQ ID NO: 2291757 - DNA, 23 bp, Homo sapiens
tattgctgatggtgcaatgacct

SEQ ID NO: 2291758 - DNA, 17 bp, Homo sapiens
tattgctgttgcttgaa

SEQ ID NO: 2291759 - DNA, 22 bp, Homo sapiens
tatttaaaaaatgaatagtaca

SEQ ID NO: 2291760 - DNA, 14 bp, Homo sapiens
tatttaaaattcat

SEQ ID NO: 2291761 - DNA, 16 bp, Homo sapiens
tatttaaatttagtgc

SEQ ID NO: 2291762 - DNA, 21 bp, Homo sapiens
tatttaattatattatgaata

SEQ ID NO: 2291763 - DNA, 19 bp, Homo sapiens
tatttagataacaagaata

SEQ ID NO: 2291764 - DNA, 15 bp, Homo sapiens
tatttatattagagt

SEQ ID NO: 2291765 - DNA, 18 bp, Homo sapiens
tatttatgcagaaggtat

SEQ ID NO: 2291766 - DNA, 14 bp, Homo sapiens
tatttatgttctca

SEQ ID NO: 2291767 - DNA, 16 bp, Homo sapiens
tatttcaataagtgtt

SEQ ID NO: 2291768 - DNA, 18 bp, Homo sapiens
tatttccaaatattctaa

SEQ ID NO: 2291769 - DNA, 17 bp, Homo sapiens
tatttcggaaatacact

SEQ ID NO: 2291770 - DNA, 14 bp, Homo sapiens
tatttctaagctta

SEQ ID NO: 2291771 - DNA, 20 bp, Homo sapiens
tatttctaagcttatttcta

SEQ ID NO: 2291772 - DNA, 13 bp, Homo sapiens
tatttctatctgc

SEQ ID NO: 2291773 - DNA, 14 bp, Homo sapiens
tatttgcttattta

SEQ ID NO: 2291774 - DNA, 20 bp, Homo sapiens
tatttggattcacagccttt

SEQ ID NO: 2291775 - DNA, 17 bp, Homo sapiens
tatttgtagctagaata

SEQ ID NO: 2291776 - DNA, 22 bp, Homo sapiens
tatttgtagctagaatatccta

SEQ ID NO: 2291777 - DNA, 13 bp, Homo sapiens
tattttcaaaata

SEQ ID NO: 2291778 - DNA, 16 bp, Homo sapiens
tattttcaataaagaa

SEQ ID NO: 2291779 - DNA, 14 bp, Homo sapiens
tattttcataattc

SEQ ID NO: 2291780 - DNA, 13 bp, Homo sapiens
tattttcgtgcat

SEQ ID NO: 2291781 - DNA, 18 bp, Homo sapiens
tattttcgtgcatttgtg

SEQ ID NO: 2291782 - DNA, 23 bp, Homo sapiens
tattttcgtgcatttgtgagcca

SEQ ID NO: 2291783 - DNA, 14 bp, Homo sapiens
tattttctatgtac

SEQ ID NO: 2291784 - DNA, 21 bp, Homo sapiens
tattttctatgtactagtact

SEQ ID NO: 2291785 - DNA, 18 bp, Homo sapiens
tattttctccatgtctgt

SEQ ID NO: 2291786 - DNA, 12 bp, Homo sapiens
tattttctgaat

SEQ ID NO: 2291787 - DNA, 19 bp, Homo sapiens
tattttctgaattcataaa

SEQ ID NO: 2291788 - DNA, 18 bp, Homo sapiens
tattttcttacagtattt

SEQ ID NO: 2291789 - DNA, 19 bp, Homo sapiens
tattttgtattattgctgt

SEQ ID NO: 2291790 - DNA, 14 bp, Homo sapiens
tattttgtcataaa

SEQ ID NO: 2291791 - DNA, 19 bp, Homo sapiens
tattttgtcataaaatgct

SEQ ID NO: 2291792 - DNA, 20 bp, Homo sapiens
tattttgtcataaaatgcta

SEQ ID NO: 2291793 - DNA, 12 bp, Homo sapiens
tatttttagaga

SEQ ID NO: 2291794 - DNA, 13 bp, Homo sapiens
tatttttagagat

SEQ ID NO: 2291795 - DNA, 23 bp, Homo sapiens
tatttttagagattaatttgtgt

SEQ ID NO: 2291796 - DNA, 15 bp, Homo sapiens
tatttttatatagac

SEQ ID NO: 2291797 - DNA, 22 bp, Homo sapiens
tatttttgaagtctccttttgt

SEQ ID NO: 2291798 - DNA, 14 bp, Homo sapiens
tatttttttctagc

SEQ ID NO: 2291799 - DNA, 13 bp, Homo sapiens
tcaaaaactgttt

SEQ ID NO: 2291800 - DNA, 13 bp, Homo sapiens
tcaaaagctgaaa

SEQ ID NO: 2291801 - DNA, 23 bp, Homo sapiens
tcaaaatagttctatttctatct

SEQ ID NO: 2291802 - DNA, 18 bp, Homo sapiens
tcaaacattgagactgct

SEQ ID NO: 2291803 - DNA, 18 bp, Homo sapiens
tcaaacctgcaaggcaaa

SEQ ID NO: 2291804 - DNA, 21 bp, Homo sapiens
tcaaactctttgcccagttca

SEQ ID NO: 2291805 - DNA, 12 bp, Homo sapiens
tcaaagacattt

SEQ ID NO: 2291806 - DNA, 14 bp, Homo sapiens
tcaaagacatttca

SEQ ID NO: 2291807 - DNA, 20 bp, Homo sapiens
gcgcctgcgctcctctgcag

SEQ ID NO: 2291808 - DNA, 21 bp, Homo sapiens
gcgcctgcgctcctctgcagc

SEQ ID NO: 2291809 - DNA, 23 bp, Homo sapiens
gcgcctgcgctcctctgcagcct

SEQ ID NO: 2291810 - DNA, 13 bp, Homo sapiens
gcgcgcaccgccc

SEQ ID NO: 2291811 - DNA, 22 bp, Homo sapiens
gcgcgcaccgcccaacccccac

SEQ ID NO: 2291812 - DNA, 14 bp, Homo sapiens
gcgcgtgcccccag

SEQ ID NO: 2291813 - DNA, 16 bp, Homo sapiens
gcgcgtgcccccagcg

SEQ ID NO: 2291814 - DNA, 13 bp, Homo sapiens
gcgcgtgccttcc

SEQ ID NO: 2291815 - DNA, 13 bp, Homo sapiens
gcgctcctctgca

SEQ ID NO: 2291816 - DNA, 15 bp, Homo sapiens
gcgctcctctgcagc

SEQ ID NO: 2291817 - DNA, 17 bp, Homo sapiens
gcgctcctctgcagcct

SEQ ID NO: 2291818 - DNA, 18 bp, Homo sapiens
gcgctcctctgcagcctg

SEQ ID NO: 2291819 - DNA, 15 bp, Homo sapiens
gcgctctgcccctcc

SEQ ID NO: 2291820 - DNA, 14 bp, Homo sapiens
gcggagaggacccc

SEQ ID NO: 2291821 - DNA, 20 bp, Homo sapiens
gcggaggggcttggagcaga

SEQ ID NO: 2291822 - DNA, 12 bp, Homo sapiens
gcggcaccgccc

SEQ ID NO: 2291823 - DNA, 17 bp, Homo sapiens
gcggccccgcacccctc

SEQ ID NO: 2291824 - DNA, 13 bp, Homo sapiens
gcggcccggccca

SEQ ID NO: 2291825 - DNA, 14 bp, Homo sapiens
gcggcccggcccac

SEQ ID NO: 2291826 - DNA, 22 bp, Homo sapiens
gcggcccggcccacgcagagcc

SEQ ID NO: 2291827 - DNA, 23 bp, Homo sapiens
gcggcccggcccacgcagagccc

SEQ ID NO: 2291828 - DNA, 15 bp, Homo sapiens
gcggcccgtgcgcag

SEQ ID NO: 2291829 - DNA, 18 bp, Homo sapiens
gcggccggcctggggccg

SEQ ID NO: 2291830 - DNA, 12 bp, Homo sapiens
gcggctgaggac

SEQ ID NO: 2291831 - DNA, 22 bp, Homo sapiens
gcggctgaggacggggcagagc

SEQ ID NO: 2291832 - DNA, 16 bp, Homo sapiens
gcgggaaccctctggg

SEQ ID NO: 2291833 - DNA, 17 bp, Homo sapiens
gcgggaagggtgggccc

SEQ ID NO: 2291834 - DNA, 20 bp, Homo sapiens
gcgggaagggtgggccctgg

SEQ ID NO: 2291835 - DNA, 23 bp, Homo sapiens
gcgggaagggtgggccctggagg

SEQ ID NO: 2291836 - DNA, 13 bp, Homo sapiens
gcgggcagcccct

SEQ ID NO: 2291837 - DNA, 14 bp, Homo sapiens
gcgggcagcccctg

SEQ ID NO: 2291838 - DNA, 18 bp, Homo sapiens
gcgggcagcccctgctgg

SEQ ID NO: 2291839 - DNA, 19 bp, Homo sapiens
gcgggcagtgacgtgagtg

SEQ ID NO: 2291840 - DNA, 23 bp, Homo sapiens
gcgggggctaactggccccaggc

SEQ ID NO: 2291841 - DNA, 13 bp, Homo sapiens
gcggtatccagag

SEQ ID NO: 2291842 - DNA, 15 bp, Homo sapiens
gcggtgagctgagat

SEQ ID NO: 2291843 - DNA, 20 bp, Homo sapiens
gcgtagggccagggctctgg

SEQ ID NO: 2291844 - DNA, 22 bp, Homo sapiens
gcgtgccttccccgtgcggccc

SEQ ID NO: 2291845 - DNA, 17 bp, Homo sapiens
gcgtggcaacaggcggg

SEQ ID NO: 2291846 - DNA, 17 bp, Homo sapiens
gcgtggcctggggctgc

SEQ ID NO: 2291847 - DNA, 16 bp, Homo sapiens
gcgtgggggacaagaa

SEQ ID NO: 2291848 - DNA, 13 bp, Homo sapiens
gcgtgggggtggc

SEQ ID NO: 2291849 - DNA, 12 bp, Homo sapiens
gctaaaaacatt

SEQ ID NO: 2291850 - DNA, 12 bp, Homo sapiens
gctaaatgcaaa

SEQ ID NO: 2291851 - DNA, 20 bp, Homo sapiens
gctaaatgcaaacactgtgt

SEQ ID NO: 2291852 - DNA, 21 bp, Homo sapiens
gctaaatgcaaacactgtgta

SEQ ID NO: 2291853 - DNA, 13 bp, Homo sapiens
gctaacgggcgcc

SEQ ID NO: 2291854 - DNA, 15 bp, Homo sapiens
gctaagtccagctct

SEQ ID NO: 2291855 - DNA, 21 bp, Homo sapiens
gctaataccaactatttcaat

SEQ ID NO: 2291856 - DNA, 18 bp, Homo sapiens
gctaatgggctgctgtca

SEQ ID NO: 2291857 - DNA, 22 bp, Homo sapiens
gctaatgggctgctgtcatttt

SEQ ID NO: 2291858 - DNA, 18 bp, Homo sapiens
gctacagtagctgtgggg

SEQ ID NO: 2291859 - DNA, 23 bp, Homo sapiens
gctacataaattggcctggtatg

SEQ ID NO: 2291860 - DNA, 17 bp, Homo sapiens
gctaccagggctcaccc

SEQ ID NO: 2291861 - DNA, 23 bp, Homo sapiens
gctagaaaatgaactgtatatta

SEQ ID NO: 2291862 - DNA, 20 bp, Homo sapiens
gctagaatatcctatactgg

SEQ ID NO: 2291863 - DNA, 12 bp, Homo sapiens
gctagcggctga

SEQ ID NO: 2291864 - DNA, 18 bp, Homo sapiens
gctataacaactctattt

SEQ ID NO: 2291865 - DNA, 22 bp, Homo sapiens
gctataatgtttccctcaagaa

SEQ ID NO: 2291866 - DNA, 19 bp, Homo sapiens
gctatccaatctcatctct

SEQ ID NO: 2291867 - DNA, 21 bp, Homo sapiens
gctatgttattttcagtgctt

SEQ ID NO: 2291868 - DNA, 22 bp, Homo sapiens
gctatgttattttcagtgcttt

SEQ ID NO: 2291869 - DNA, 20 bp, Homo sapiens
gctcaacctctcagatccct

SEQ ID NO: 2291870 - DNA, 21 bp, Homo sapiens
gctcaacctctcagatccctc

SEQ ID NO: 2291871 - DNA, 14 bp, Homo sapiens
gctcacaactgttt

SEQ ID NO: 2291872 - DNA, 19 bp, Homo sapiens
gctcacacgctgcctcctc

SEQ ID NO: 2291873 - DNA, 16 bp, Homo sapiens
gctcagagtccaatgt

SEQ ID NO: 2291874 - DNA, 18 bp, Homo sapiens
gctcagattccccccatc

SEQ ID NO: 2291875 - DNA, 14 bp, Homo sapiens
gctcagcacagcct

SEQ ID NO: 2291876 - DNA, 21 bp, Homo sapiens
gctcagcacagcctcacccct

SEQ ID NO: 2291877 - DNA, 17 bp, Homo sapiens
gctcaggctccccaaga

SEQ ID NO: 2291878 - DNA, 17 bp, Homo sapiens
gctcagtcccacagccc

SEQ ID NO: 2291879 - DNA, 13 bp, Homo sapiens
gctcattcttttc

SEQ ID NO: 2291880 - DNA, 22 bp, Homo sapiens
gctcattgtagagcacatttag

SEQ ID NO: 2291881 - DNA, 15 bp, Homo sapiens
gctccaacctggagg

SEQ ID NO: 2291882 - DNA, 16 bp, Homo sapiens
gctccaacctggaggc

SEQ ID NO: 2291883 - DNA, 13 bp, Homo sapiens
gctccaccctccc

SEQ ID NO: 2291884 - DNA, 14 bp, Homo sapiens
gctccaccctcccc

SEQ ID NO: 2291885 - DNA, 15 bp, Homo sapiens
gctccaccctcccct

SEQ ID NO: 2291886 - DNA, 16 bp, Homo sapiens
gctccaccctcccctc

SEQ ID NO: 2291887 - DNA, 20 bp, Homo sapiens
gctccacgggggcctagtgg

SEQ ID NO: 2291888 - DNA, 21 bp, Homo sapiens
gctccacgggggcctagtggc

SEQ ID NO: 2291889 - DNA, 15 bp, Homo sapiens
gctccagatcctctt

SEQ ID NO: 2291890 - DNA, 21 bp, Homo sapiens
gctccaggagcagcgtgcagg

SEQ ID NO: 2291891 - DNA, 14 bp, Homo sapiens
gctccagtgttttc

SEQ ID NO: 2291892 - DNA, 15 bp, Homo sapiens
gctccagtgttttct

SEQ ID NO: 2291893 - DNA, 16 bp, Homo sapiens
gctccagtgttttctt

SEQ ID NO: 2291894 - DNA, 14 bp, Homo sapiens
gctccccagcccca

SEQ ID NO: 2291895 - DNA, 21 bp, Homo sapiens
gctccccctgaattttgcttc

SEQ ID NO: 2291896 - DNA, 17 bp, Homo sapiens
gctccggcagaggcagg

SEQ ID NO: 2291897 - DNA, 19 bp, Homo sapiens
gctccggcagaggcagggc

SEQ ID NO: 2291898 - DNA, 17 bp, Homo sapiens
gctcctcggccagagct

SEQ ID NO: 2291899 - DNA, 21 bp, Homo sapiens
gctcctcggccagagctccca

SEQ ID NO: 2291900 - DNA, 19 bp, Homo sapiens
gctcctctgcagcctgagc

SEQ ID NO: 2291901 - DNA, 20 bp, Homo sapiens
gctcctctgcctttgtgctc

SEQ ID NO: 2291902 - DNA, 14 bp, Homo sapiens
gctccttgaataag

SEQ ID NO: 2291903 - DNA, 13 bp, Homo sapiens
gctcgcaccccca

SEQ ID NO: 2291904 - DNA, 14 bp, Homo sapiens
gctcgggtgcccag

SEQ ID NO: 2291905 - DNA, 19 bp, Homo sapiens
gctctatctgctgggctgg

SEQ ID NO: 2291906 - DNA, 14 bp, Homo sapiens
gctctcccctgcgc

SEQ ID NO: 2291907 - DNA, 11 bp, Homo sapiens
gctctctgtct

SEQ ID NO: 2291908 - DNA, 18 bp, Homo sapiens
gctctgaagggaggggaa

SEQ ID NO: 2291909 - DNA, 20 bp, Homo sapiens
gctctgaagggaggggaaga

SEQ ID NO: 2291910 - DNA, 21 bp, Homo sapiens
gctctgaaggtccaaagagtt

SEQ ID NO: 2291911 - DNA, 18 bp, Homo sapiens
gctctgacctgcccccgc

SEQ ID NO: 2291912 - DNA, 19 bp, Homo sapiens
gctctgccatcagcccctg

SEQ ID NO: 2291913 - DNA, 11 bp, Homo sapiens
gctctgcccct

SEQ ID NO: 2291914 - DNA, 18 bp, Homo sapiens
gctctgcccctccgtccc

SEQ ID NO: 2291915 - DNA, 17 bp, Homo sapiens
gctctggccccaagatg

SEQ ID NO: 2291916 - DNA, 20 bp, Homo sapiens
gctcttctgttctcaaatgc

SEQ ID NO: 2291917 - DNA, 23 bp, Homo sapiens
gctcttctgttctcaaatgctaa

SEQ ID NO: 2291918 - DNA, 18 bp, Homo sapiens
gctctttcaccctgccac

SEQ ID NO: 2291919 - DNA, 22 bp, Homo sapiens
gctctttcaccctgccaccctc

SEQ ID NO: 2291920 - DNA, 18 bp, Homo sapiens
gctgaacgacagtcccag

SEQ ID NO: 2291921 - DNA, 19 bp, Homo sapiens
gctgaacgacagtcccagt

SEQ ID NO: 2291922 - DNA, 20 bp, Homo sapiens
gctgaagatccccattcttt

SEQ ID NO: 2291923 - DNA, 21 bp, Homo sapiens
gctgaaggatgggggctcctg

SEQ ID NO: 2291924 - DNA, 15 bp, Homo sapiens
gctgaatcaaagaca

SEQ ID NO: 2291925 - DNA, 17 bp, Homo sapiens
gctgaatcaaagacatt

SEQ ID NO: 2291926 - DNA, 14 bp, Homo sapiens
gctgacagagccct

SEQ ID NO: 2291927 - DNA, 14 bp, Homo sapiens
gctgaccaggccct

SEQ ID NO: 2291928 - DNA, 14 bp, Homo sapiens
gctgactgaatgca

SEQ ID NO: 2291929 - DNA, 14 bp, Homo sapiens
gctgagcccctcct

SEQ ID NO: 2291930 - DNA, 19 bp, Homo sapiens
gctgagccgatctggtctc

SEQ ID NO: 2291931 - DNA, 16 bp, Homo sapiens
gctgagctctgacctg

SEQ ID NO: 2291932 - DNA, 19 bp, Homo sapiens
gctgagctctgacctgccc

SEQ ID NO: 2291933 - DNA, 20 bp, Homo sapiens
gctgaggacggggcagagct

SEQ ID NO: 2291934 - DNA, 22 bp, Homo sapiens
gctgaggacggggcagagctga

SEQ ID NO: 2291935 - DNA, 23 bp, Homo sapiens
gctgaggacggggcagagctgag

SEQ ID NO: 2291936 - DNA, 22 bp, Homo sapiens
gctgagtcggctgggcagggcc

SEQ ID NO: 2291937 - DNA, 15 bp, Homo sapiens
gctgagtggtccaca

SEQ ID NO: 2291938 - DNA, 14 bp, Homo sapiens
gctgccccacccct

SEQ ID NO: 2291939 - DNA, 19 bp, Homo sapiens
gctgcccccacagatccat

SEQ ID NO: 2291940 - DNA, 13 bp, Homo sapiens
gctgcccccaccc

SEQ ID NO: 2291941 - DNA, 15 bp, Homo sapiens
gctgcccccaccctg

SEQ ID NO: 2291942 - DNA, 21 bp, Homo sapiens
gctgcctccaagtcatgggag

SEQ ID NO: 2291943 - DNA, 12 bp, Homo sapiens
gagagtctgaga

SEQ ID NO: 2291944 - DNA, 18 bp, Homo sapiens
gagatactttttcttttg

SEQ ID NO: 2291945 - DNA, 17 bp, Homo sapiens
gagatagaactgtggca

SEQ ID NO: 2291946 - DNA, 14 bp, Homo sapiens
gagatcagcattca

SEQ ID NO: 2291947 - DNA, 23 bp, Homo sapiens
gagatccgccctgggctctgggt

SEQ ID NO: 2291948 - DNA, 16 bp, Homo sapiens
gagatgctgggaccct

SEQ ID NO: 2291949 - DNA, 18 bp, Homo sapiens
gagatgctgggaccctcg

SEQ ID NO: 2291950 - DNA, 18 bp, Homo sapiens
gagatgtcagtctgtcca

SEQ ID NO: 2291951 - DNA, 21 bp, Homo sapiens
gagattccagaacgccctgtg

SEQ ID NO: 2291952 - DNA, 21 bp, Homo sapiens
gagatttgtatttatattaga

SEQ ID NO: 2291953 - DNA, 15 bp, Homo sapiens
gagcaaggctgccct

SEQ ID NO: 2291954 - DNA, 16 bp, Homo sapiens
gagcaaggctgccctg

SEQ ID NO: 2291955 - DNA, 13 bp, Homo sapiens
gagcaaggctgct

SEQ ID NO: 2291956 - DNA, 21 bp, Homo sapiens
gagcaaggctgctaagtggaa

SEQ ID NO: 2291957 - DNA, 22 bp, Homo sapiens
gagcaaggctgctaagtggaag

SEQ ID NO: 2291958 - DNA, 21 bp, Homo sapiens
gagcacaagaagtttcttcag

SEQ ID NO: 2291959 - DNA, 13 bp, Homo sapiens
gagcacccccagc

SEQ ID NO: 2291960 - DNA, 14 bp, Homo sapiens
gagcacccccagcc

SEQ ID NO: 2291961 - DNA, 22 bp, Homo sapiens
gagcacccccagcctcccccag

SEQ ID NO: 2291962 - DNA, 18 bp, Homo sapiens
gagcactagaatgagaaa

SEQ ID NO: 2291963 - DNA, 20 bp, Homo sapiens
gagcagagacggcagcccca

SEQ ID NO: 2291964 - DNA, 21 bp, Homo sapiens
gagcagagacggcagccccat

SEQ ID NO: 2291965 - DNA, 24 bp, Homo sapiens
gagcagagacggcagccccatcct

SEQ ID NO: 2291966 - DNA, 15 bp, Homo sapiens
gagcagagcccccat

SEQ ID NO: 2291967 - DNA, 16 bp, Homo sapiens
gagcagcgtgcaggag

SEQ ID NO: 2291968 - DNA, 18 bp, Homo sapiens
gagccacagcactcggcc

SEQ ID NO: 2291969 - DNA, 20 bp, Homo sapiens
gagccacagtggggcccatg

SEQ ID NO: 2291970 - DNA, 23 bp, Homo sapiens
gagccacagtggggcccatggcc

SEQ ID NO: 2291971 - DNA, 18 bp, Homo sapiens
gagccagatttcactctc

SEQ ID NO: 2291972 - DNA, 20 bp, Homo sapiens
gagccagatttcactctcct

SEQ ID NO: 2291973 - DNA, 15 bp, Homo sapiens
gagccatccaccctg

SEQ ID NO: 2291974 - DNA, 13 bp, Homo sapiens
gagccatgctctt

SEQ ID NO: 2291975 - DNA, 14 bp, Homo sapiens
gagccatgctctta

SEQ ID NO: 2291976 - DNA, 12 bp, Homo sapiens
gagccccggagc

SEQ ID NO: 2291977 - DNA, 14 bp, Homo sapiens
gagccccggagcac

SEQ ID NO: 2291978 - DNA, 16 bp, Homo sapiens
gagccccggagcacca

SEQ ID NO: 2291979 - DNA, 13 bp, Homo sapiens
gagcccctcctct

SEQ ID NO: 2291980 - DNA, 15 bp, Homo sapiens
gagcccctcctctcc

SEQ ID NO: 2291981 - DNA, 17 bp, Homo sapiens
gagcccctcctctcctc

SEQ ID NO: 2291982 - DNA, 18 bp, Homo sapiens
gagcccctcctctcctcg

SEQ ID NO: 2291983 - DNA, 20 bp, Homo sapiens
gagcccgcctgcgcccccca

SEQ ID NO: 2291984 - DNA, 20 bp, Homo sapiens
gagccctatctatgtcctgg

SEQ ID NO: 2291985 - DNA, 13 bp, Homo sapiens
gagccctggggtt

SEQ ID NO: 2291986 - DNA, 22 bp, Homo sapiens
gagccctggggtttccacacag

SEQ ID NO: 2291987 - DNA, 15 bp, Homo sapiens
gagccgcaccctggc

SEQ ID NO: 2291988 - DNA, 16 bp, Homo sapiens
gagccgcaccctggct

SEQ ID NO: 2291989 - DNA, 18 bp, Homo sapiens
gagccgcaccctggctgg

SEQ ID NO: 2291990 - DNA, 17 bp, Homo sapiens
gagcctgcgtggcctgg

SEQ ID NO: 2291991 - DNA, 22 bp, Homo sapiens
gagcgcagccgccttcacagca

SEQ ID NO: 2291992 - DNA, 20 bp, Homo sapiens
gagcgggggctaactggccc

SEQ ID NO: 2291993 - DNA, 22 bp, Homo sapiens
gagcgggggctaactggcccca

SEQ ID NO: 2291994 - DNA, 13 bp, Homo sapiens
gagctaccaggaa

SEQ ID NO: 2291995 - DNA, 12 bp, Homo sapiens
gagctagaaaat

SEQ ID NO: 2291996 - DNA, 13 bp, Homo sapiens
gagctccaccctc

SEQ ID NO: 2291997 - DNA, 15 bp, Homo sapiens
gagctccaccctccc

SEQ ID NO: 2291998 - DNA, 18 bp, Homo sapiens
gagctccaccctcccctc

SEQ ID NO: 2291999 - DNA, 13 bp, Homo sapiens
gagctcccaggac

SEQ ID NO: 2292000 - DNA, 15 bp, Homo sapiens
gagctcccaggacgc

SEQ ID NO: 2292001 - DNA, 20 bp, Homo sapiens
gagctcccaggacgcaggga

SEQ ID NO: 2292002 - DNA, 21 bp, Homo sapiens
gagctctcctgggccagggtc

SEQ ID NO: 2292003 - DNA, 21 bp, Homo sapiens
gagctgagtcggctgggcagg

SEQ ID NO: 2292004 - DNA, 14 bp, Homo sapiens
gagctgtcaggcag

SEQ ID NO: 2292005 - DNA, 14 bp, Homo sapiens
gaggaacaaggcaa

SEQ ID NO: 2292006 - DNA, 17 bp, Homo sapiens
gaggaacctcaaactgg

SEQ ID NO: 2292007 - DNA, 14 bp, Homo sapiens
gaggaagtggtgtt

SEQ ID NO: 2292008 - DNA, 13 bp, Homo sapiens
gaggaccagcaca

SEQ ID NO: 2292009 - DNA, 23 bp, Homo sapiens
gaggaccccattctgggactgct

SEQ ID NO: 2292010 - DNA, 22 bp, Homo sapiens
gaggacctccacctgggagatg

SEQ ID NO: 2292011 - DNA, 18 bp, Homo sapiens
gaggacctgcggccttgg

SEQ ID NO: 2292012 - DNA, 16 bp, Homo sapiens
gaggacggggcagagc

SEQ ID NO: 2292013 - DNA, 15 bp, Homo sapiens
gaggactccaggggc

SEQ ID NO: 2292014 - DNA, 18 bp, Homo sapiens
gaggagactcaggcccac

SEQ ID NO: 2292015 - DNA, 22 bp, Homo sapiens
gaggagactcaggcccacattg

SEQ ID NO: 2292016 - DNA, 11 bp, Homo sapiens
gaggagcaccc

SEQ ID NO: 2292017 - DNA, 15 bp, Homo sapiens
gaggagcacccccag

SEQ ID NO: 2292018 - DNA, 17 bp, Homo sapiens
gaggagcacccccagcc

SEQ ID NO: 2292019 - DNA, 19 bp, Homo sapiens
gaggagcacccccagcctc

SEQ ID NO: 2292020 - DNA, 17 bp, Homo sapiens
gaggaggcctgcacagg

SEQ ID NO: 2292021 - DNA, 15 bp, Homo sapiens
gaggaggggagcaag

SEQ ID NO: 2292022 - DNA, 16 bp, Homo sapiens
gaggaggggcgggagt

SEQ ID NO: 2292023 - DNA, 18 bp, Homo sapiens
gaggagtgatgggcaagg

SEQ ID NO: 2292024 - DNA, 23 bp, Homo sapiens
gaggagtgatgggcaaggggcca

SEQ ID NO: 2292025 - DNA, 21 bp, Homo sapiens
gaggagttgtctgtcctggtc

SEQ ID NO: 2292026 - DNA, 22 bp, Homo sapiens
gaggagttgtctgtcctggtca

SEQ ID NO: 2292027 - DNA, 13 bp, Homo sapiens
gaggatggacgag

SEQ ID NO: 2292028 - DNA, 17 bp, Homo sapiens
gaggatttggctcgctg

SEQ ID NO: 2292029 - DNA, 14 bp, Homo sapiens
gaggcagggccctg

SEQ ID NO: 2292030 - DNA, 15 bp, Homo sapiens
gaggcagggccctgg

SEQ ID NO: 2292031 - DNA, 16 bp, Homo sapiens
gaggcagggccctggg

SEQ ID NO: 2292032 - DNA, 17 bp, Homo sapiens
gaggcagggccctgggg

SEQ ID NO: 2292033 - DNA, 20 bp, Homo sapiens
gaggcatgtgatgagaggaa

SEQ ID NO: 2292034 - DNA, 19 bp, Homo sapiens
gaggccaaacacccaagca

SEQ ID NO: 2292035 - DNA, 22 bp, Homo sapiens
gaggccaaacacccaagcacaa

SEQ ID NO: 2292036 - DNA, 19 bp, Homo sapiens
gaggcccccggaggcgccc

SEQ ID NO: 2292037 - DNA, 14 bp, Homo sapiens
gaggcctgcacagg

SEQ ID NO: 2292038 - DNA, 17 bp, Homo sapiens
gaggcctggctctggag

SEQ ID NO: 2292039 - DNA, 16 bp, Homo sapiens
gaggcgcccacctgcc

SEQ ID NO: 2292040 - DNA, 23 bp, Homo sapiens
gaggcgggaaccctctggggccc

SEQ ID NO: 2292041 - DNA, 16 bp, Homo sapiens
gaggctggaccaactg

SEQ ID NO: 2292042 - DNA, 14 bp, Homo sapiens
gagggcatgtgcag

SEQ ID NO: 2292043 - DNA, 13 bp, Homo sapiens
gagggcctctgga

SEQ ID NO: 2292044 - DNA, 15 bp, Homo sapiens
gagggcctctggaca

SEQ ID NO: 2292045 - DNA, 18 bp, Homo sapiens
gagggctgagcccctcct

SEQ ID NO: 2292046 - DNA, 20 bp, Homo sapiens
gagggctgagcccctcctct

SEQ ID NO: 2292047 - DNA, 21 bp, Homo sapiens
gagggctgagcccctcctctc

SEQ ID NO: 2292048 - DNA, 18 bp, Homo sapiens
gagggctgggcagggccc

SEQ ID NO: 2292049 - DNA, 14 bp, Homo sapiens
gaggggaagagaga

SEQ ID NO: 2292050 - DNA, 16 bp, Homo sapiens
gaggggaagagagagg

SEQ ID NO: 2292051 - DNA, 18 bp, Homo sapiens
gaggggcgctgcccccac

SEQ ID NO: 2292052 - DNA, 16 bp, Homo sapiens
gaggggcttggagcag

SEQ ID NO: 2292053 - DNA, 21 bp, Homo sapiens
gaggggcttggagcagagacg

SEQ ID NO: 2292054 - DNA, 13 bp, Homo sapiens
gagggggcagggg

SEQ ID NO: 2292055 - DNA, 14 bp, Homo sapiens
gagggggcaggggg

SEQ ID NO: 2292056 - DNA, 23 bp, Homo sapiens
gaggggtataggacaaggggtgg

SEQ ID NO: 2292057 - DNA, 19 bp, Homo sapiens
gagggtatggtgctgctct

SEQ ID NO: 2292058 - DNA, 14 bp, Homo sapiens
gagggtttgggcag

SEQ ID NO: 2292059 - DNA, 16 bp, Homo sapiens
gagggtttgggcagag

SEQ ID NO: 2292060 - DNA, 17 bp, Homo sapiens
gaggtcactggctgacc

SEQ ID NO: 2292061 - DNA, 22 bp, Homo sapiens
gaggtcatcccggggccatgga

SEQ ID NO: 2292062 - DNA, 18 bp, Homo sapiens
gaggtcctttggacagct

SEQ ID NO: 2292063 - DNA, 20 bp, Homo sapiens
gaggtggggagggcctctgg

SEQ ID NO: 2292064 - DNA, 17 bp, Homo sapiens
gaggttaggaacccggc

SEQ ID NO: 2292065 - DNA, 16 bp, Homo sapiens
gaggttttctccccca

SEQ ID NO: 2292066 - DNA, 18 bp, Homo sapiens
gagtaatattacatttca

SEQ ID NO: 2292067 - DNA, 19 bp, Homo sapiens
gagtaggctgtattttctt

SEQ ID NO: 2292068 - DNA, 11 bp, Homo sapiens
gagtatatatg

SEQ ID NO: 2292069 - DNA, 21 bp, Homo sapiens
gagtcactggaacactaatga

SEQ ID NO: 2292070 - DNA, 13 bp, Homo sapiens
gagtcagcacagg

SEQ ID NO: 2292071 - DNA, 17 bp, Homo sapiens
gagtcagggagccctgg

SEQ ID NO: 2292072 - DNA, 18 bp, Homo sapiens
gagtcagggagccctggg

SEQ ID NO: 2292073 - DNA, 14 bp, Homo sapiens
gagtccaaaatcat

SEQ ID NO: 2292074 - DNA, 18 bp, Homo sapiens
gagtccagacctgggccc

SEQ ID NO: 2292075 - DNA, 21 bp, Homo sapiens
gagtccagacctgggccctgg

SEQ ID NO: 2292076 - DNA, 12 bp, Homo sapiens
gagtcggctggg

SEQ ID NO: 2292077 - DNA, 14 bp, Homo sapiens
gagtcggctgggca

SEQ ID NO: 2292078 - DNA, 16 bp, Homo sapiens
gagtcggctgggcagg

SEQ ID NO: 2292079 - DNA, 17 bp, Homo sapiens
gagtcggctgggcaggg

SEQ ID NO: 2292080 - DNA, 20 bp, Homo sapiens
gagtcggctgggcagggccg

SEQ ID NO: 2292081 - DNA, 17 bp, Homo sapiens
gagtctcattcctctgt

SEQ ID NO: 2292082 - DNA, 20 bp, Homo sapiens
gagtctggagaccaggactc

SEQ ID NO: 2292083 - DNA, 18 bp, Homo sapiens
gagtgagctaccaggaag

SEQ ID NO: 2292084 - DNA, 15 bp, Homo sapiens
gagtgatgggcaagg

SEQ ID NO: 2292085 - DNA, 21 bp, Homo sapiens
gagtgatgggcaaggggccag

SEQ ID NO: 2292086 - DNA, 18 bp, Homo sapiens
gagtgccttacacaatgg

SEQ ID NO: 2292087 - DNA, 12 bp, Homo sapiens
gagtggacagca

SEQ ID NO: 2292088 - DNA, 14 bp, Homo sapiens
gagtggacagcagc

SEQ ID NO: 2292089 - DNA, 16 bp, Homo sapiens
gagtggacagcagctg

SEQ ID NO: 2292090 - DNA, 17 bp, Homo sapiens
gagtggacagcagctgg

SEQ ID NO: 2292091 - DNA, 20 bp, Homo sapiens
gagtggacagcagctggact

SEQ ID NO: 2292092 - DNA, 22 bp, Homo sapiens
gagtggacagcagctggactgg

SEQ ID NO: 2292093 - DNA, 11 bp, Homo sapiens
gagtggctgac

SEQ ID NO: 2292094 - DNA, 20 bp, Homo sapiens
gagtggctgaccaggccctg

SEQ ID NO: 2292095 - DNA, 19 bp, Homo sapiens
gagttaatgatggcagagg

SEQ ID NO: 2292096 - DNA, 13 bp, Homo sapiens
gagttacagacaa

SEQ ID NO: 2292097 - DNA, 14 bp, Homo sapiens
gagttcatcttgaa

SEQ ID NO: 2292098 - DNA, 14 bp, Homo sapiens
gagttgtctgtcct

SEQ ID NO: 2292099 - DNA, 16 bp, Homo sapiens
gagttgtctgtcctgg

SEQ ID NO: 2292100 - DNA, 17 bp, Homo sapiens
gagttgtctgtcctggt

SEQ ID NO: 2292101 - DNA, 19 bp, Homo sapiens
gagtttaaaaaaataacat

SEQ ID NO: 2292102 - DNA, 22 bp, Homo sapiens
gagtttaacagatatttaaatt

SEQ ID NO: 2292103 - DNA, 18 bp, Homo sapiens
gagtttctggctgaaaat

SEQ ID NO: 2292104 - DNA, 14 bp, Homo sapiens
gataaagtgaccag

SEQ ID NO: 2292105 - DNA, 19 bp, Homo sapiens
gataaatgaacatttaact

SEQ ID NO: 2292106 - DNA, 22 bp, Homo sapiens
gataagaaccttttgagtgcct

SEQ ID NO: 2292107 - DNA, 17 bp, Homo sapiens
gataataactagatctc

SEQ ID NO: 2292108 - DNA, 18 bp, Homo sapiens
gataatagtaatggttct

SEQ ID NO: 2292109 - DNA, 22 bp, Homo sapiens
gatacactgtatctaaaaaata

SEQ ID NO: 2292110 - DNA, 21 bp, Homo sapiens
gatactgaattgttatgtaaa

SEQ ID NO: 2292111 - DNA, 20 bp, Homo sapiens
gatactttttcttttgtaag

SEQ ID NO: 2292112 - DNA, 11 bp, Homo sapiens
gatagacaaaa

SEQ ID NO: 2292113 - DNA, 15 bp, Homo sapiens
gatagagtttaacag

SEQ ID NO: 2292114 - DNA, 13 bp, Homo sapiens
gatagtttattat

SEQ ID NO: 2292115 - DNA, 17 bp, Homo sapiens
gatataataattactta

SEQ ID NO: 2292116 - DNA, 20 bp, Homo sapiens
gatataataattacttaatg

SEQ ID NO: 2292117 - DNA, 13 bp, Homo sapiens
gatataggaaaat

SEQ ID NO: 2292118 - DNA, 17 bp, Homo sapiens
gatataggaaaatacat

SEQ ID NO: 2292119 - DNA, 18 bp, Homo sapiens
gatataggaaaatacatt

SEQ ID NO: 2292120 - DNA, 16 bp, Homo sapiens
gatatatatttccaaa

SEQ ID NO: 2292121 - DNA, 18 bp, Homo sapiens
gatatatatttccaaata

SEQ ID NO: 2292122 - DNA, 14 bp, Homo sapiens
gatatatgtaaata

SEQ ID NO: 2292123 - DNA, 23 bp, Homo sapiens
gatatgaaagagaaaatgctttc

SEQ ID NO: 2292124 - DNA, 19 bp, Homo sapiens
gatatttaaatttagtgct

SEQ ID NO: 2292125 - DNA, 15 bp, Homo sapiens
gatcagcattcaaaa

SEQ ID NO: 2292126 - DNA, 12 bp, Homo sapiens
gatcattatttc

SEQ ID NO: 2292127 - DNA, 11 bp, Homo sapiens
gatcccagctc

SEQ ID NO: 2292128 - DNA, 20 bp, Homo sapiens
gatccctcggtcagcaccgt

SEQ ID NO: 2292129 - DNA, 13 bp, Homo sapiens
gatccgccctggg

SEQ ID NO: 2292130 - DNA, 19 bp, Homo sapiens
gatcctaaaataagcttca

SEQ ID NO: 2292131 - DNA, 19 bp, Homo sapiens
gatcctcccgccccagcct

SEQ ID NO: 2292132 - DNA, 13 bp, Homo sapiens
gatcctgagccag

SEQ ID NO: 2292133 - DNA, 19 bp, Homo sapiens
gatcctgagccagatttca

SEQ ID NO: 2292134 - DNA, 20 bp, Homo sapiens
gatcctggtctgcacctcta

SEQ ID NO: 2292135 - DNA, 14 bp, Homo sapiens
gatcctgtcccatg

SEQ ID NO: 2292136 - DNA, 20 bp, Homo sapiens
gatcctgtcccatgggctct

SEQ ID NO: 2292137 - DNA, 22 bp, Homo sapiens
gatcgtttcacatctgtatatc

SEQ ID NO: 2292138 - DNA, 20 bp, Homo sapiens
gatctcagataaagtgacca

SEQ ID NO: 2292139 - DNA, 16 bp, Homo sapiens
gatctccccgaatctc

SEQ ID NO: 2292140 - DNA, 18 bp, Homo sapiens
gatctctgagaccacaga

SEQ ID NO: 2292141 - DNA, 24 bp, Homo sapiens
gatctctgagaccacagaggctca

SEQ ID NO: 2292142 - DNA, 17 bp, Homo sapiens
gatctgcatctgataga

SEQ ID NO: 2292143 - DNA, 16 bp, Homo sapiens
gatctggtctcgtgtt

SEQ ID NO: 2292144 - DNA, 12 bp, Homo sapiens
gatctgtcttgt

SEQ ID NO: 2292145 - DNA, 15 bp, Homo sapiens
gatcttccaaatatt

SEQ ID NO: 2292146 - DNA, 14 bp, Homo sapiens
gatctttgttcctc

SEQ ID NO: 2292147 - DNA, 16 bp, Homo sapiens
gatgaactcaatgcat

SEQ ID NO: 2292148 - DNA, 18 bp, Homo sapiens
gatgaactcaatgcatga

SEQ ID NO: 2292149 - DNA, 21 bp, Homo sapiens
gatgaattctgaccagagcta

SEQ ID NO: 2292150 - DNA, 17 bp, Homo sapiens
gatgaccaatctctgtg

SEQ ID NO: 2292151 - DNA, 19 bp, Homo sapiens
gatggcccgagagctggga

SEQ ID NO: 2292152 - DNA, 20 bp, Homo sapiens
gatggcccgagagctgggac

SEQ ID NO: 2292153 - DNA, 19 bp, Homo sapiens
gatggcgtgtcccctgcct

SEQ ID NO: 2292154 - DNA, 19 bp, Homo sapiens
gatgggcacaggctgcccc

SEQ ID NO: 2292155 - DNA, 15 bp, Homo sapiens
gatgggctggagcag

SEQ ID NO: 2292156 - DNA, 15 bp, Homo sapiens
gatgggggctcctgg

SEQ ID NO: 2292157 - DNA, 17 bp, Homo sapiens
gatggggttgggctctg

SEQ ID NO: 2292158 - DNA, 16 bp, Homo sapiens
gatgggtcctgctgct

SEQ ID NO: 2292159 - DNA, 17 bp, Homo sapiens
gatggtaatcttttctg

SEQ ID NO: 2292160 - DNA, 16 bp, Homo sapiens
gatggtgcaatgacct

SEQ ID NO: 2292161 - DNA, 23 bp, Homo sapiens
gatggtgcaatgacctttcaata

SEQ ID NO: 2292162 - DNA, 17 bp, Homo sapiens
gatgtaagaagcccgat

SEQ ID NO: 2292163 - DNA, 19 bp, Homo sapiens
gatgtaccatgttaaagag

SEQ ID NO: 2292164 - DNA, 21 bp, Homo sapiens
gatgttctttcacccttttct

SEQ ID NO: 2292165 - DNA, 21 bp, Homo sapiens
gattaatctctaaaattctag

SEQ ID NO: 2292166 - DNA, 14 bp, Homo sapiens
gattaatttgtgta

SEQ ID NO: 2292167 - DNA, 16 bp, Homo sapiens
gattaatttgtgtaga

SEQ ID NO: 2292168 - DNA, 22 bp, Homo sapiens
gattacaggtgtgagccacagc

SEQ ID NO: 2292169 - DNA, 15 bp, Homo sapiens
gattattttctatat

SEQ ID NO: 2292170 - DNA, 11 bp, Homo sapiens
gattcagtctt

SEQ ID NO: 2292171 - DNA, 14 bp, Homo sapiens
gattcagtcttgcc

SEQ ID NO: 2292172 - DNA, 23 bp, Homo sapiens
gattccactgaaacctctgttct

SEQ ID NO: 2292173 - DNA, 18 bp, Homo sapiens
gattccagaacgccctgt

SEQ ID NO: 2292174 - DNA, 21 bp, Homo sapiens
gattccccggagctgggaagg

SEQ ID NO: 2292175 - DNA, 16 bp, Homo sapiens
gattctaaaacattct

SEQ ID NO: 2292176 - DNA, 18 bp, Homo sapiens
gattctatatttcatatt

SEQ ID NO: 2292177 - DNA, 13 bp, Homo sapiens
gattctcttctca

SEQ ID NO: 2292178 - DNA, 22 bp, Homo sapiens
gattctgcagctgcttttgcat

SEQ ID NO: 2292179 - DNA, 16 bp, Homo sapiens
gattcttttttcaatg

SEQ ID NO: 2292180 - DNA, 17 bp, Homo sapiens
gattcttttttcaatgt

SEQ ID NO: 2292181 - DNA, 17 bp, Homo sapiens
gattgaaatttatgact

SEQ ID NO: 2292182 - DNA, 18 bp, Homo sapiens
gattggaagaaacacgtg

SEQ ID NO: 2292183 - DNA, 13 bp, Homo sapiens
gattgtacatttt

SEQ ID NO: 2292184 - DNA, 14 bp, Homo sapiens
gattgtctgctgcc

SEQ ID NO: 2292185 - DNA, 16 bp, Homo sapiens
gatttcactctccttg

SEQ ID NO: 2292186 - DNA, 22 bp, Homo sapiens
gatttctagcagtatgtgtgct

SEQ ID NO: 2292187 - DNA, 19 bp, Homo sapiens
gatttctttccttcccaat

SEQ ID NO: 2292188 - DNA, 15 bp, Homo sapiens
gatttgccaaaaact

SEQ ID NO: 2292189 - DNA, 23 bp, Homo sapiens
gatttgccaaaaactaaaattca

SEQ ID NO: 2292190 - DNA, 15 bp, Homo sapiens
gatttggctcgctgt

SEQ ID NO: 2292191 - DNA, 22 bp, Homo sapiens
gatttggtcctgcctaaatttc

SEQ ID NO: 2292192 - DNA, 13 bp, Homo sapiens
gatttgtatttat

SEQ ID NO: 2292193 - DNA, 17 bp, Homo sapiens
gatttgtatttatatta

SEQ ID NO: 2292194 - DNA, 13 bp, Homo sapiens
gattttctttcta

SEQ ID NO: 2292195 - DNA, 15 bp, Homo sapiens
gattttctttctatg

SEQ ID NO: 2292196 - DNA, 17 bp, Homo sapiens
gattttctttctatgta

SEQ ID NO: 2292197 - DNA, 15 bp, Homo sapiens
gatttttttgttcat

SEQ ID NO: 2292198 - DNA, 16 bp, Homo sapiens
gatttttttttccttc

SEQ ID NO: 2292199 - DNA, 18 bp, Homo sapiens
gatttttttttccttcag

SEQ ID NO: 2292200 - DNA, 21 bp, Homo sapiens
gatttttttttccttcagtgc

SEQ ID NO: 2292201 - DNA, 16 bp, Homo sapiens
gcaaaaaaaaaaatgt

SEQ ID NO: 2292202 - DNA, 14 bp, Homo sapiens
gcaaaataaaatga

SEQ ID NO: 2292203 - DNA, 23 bp, Homo sapiens
gcaaacaaaaatagaatatataa

SEQ ID NO: 2292204 - DNA, 19 bp, Homo sapiens
gcaaacaaaatgatgggaa

SEQ ID NO: 2292205 - DNA, 14 bp, Homo sapiens
gcaaacactgtgta

SEQ ID NO: 2292206 - DNA, 19 bp, Homo sapiens
gcaaacactgtgtatttat

SEQ ID NO: 2292207 - DNA, 15 bp, Homo sapiens
gcaaaccatcattga

SEQ ID NO: 2292208 - DNA, 17 bp, Homo sapiens
gcaaaccatcattgaaa

SEQ ID NO: 2292209 - DNA, 18 bp, Homo sapiens
gcaaaccatcatttaatt

SEQ ID NO: 2292210 - DNA, 16 bp, Homo sapiens
gcaaagtaaaattaga

SEQ ID NO: 2292211 - DNA, 21 bp, Homo sapiens
gcaaccaataaaagtgtcact

SEQ ID NO: 2292212 - DNA, 16 bp, Homo sapiens
gcaaccaccaccaacc

SEQ ID NO: 2292213 - DNA, 20 bp, Homo sapiens
gcaacctgttcttcctacca

SEQ ID NO: 2292214 - DNA, 18 bp, Homo sapiens
gcaagaagattctaaaac

SEQ ID NO: 2292215 - DNA, 17 bp, Homo sapiens
gcaaggcagctcccagg

SEQ ID NO: 2292216 - DNA, 15 bp, Homo sapiens
gcaaggctgccctgt

SEQ ID NO: 2292217 - DNA, 14 bp, Homo sapiens
gcaaggctgctaag

SEQ ID NO: 2292218 - DNA, 13 bp, Homo sapiens
gcaaggggccagg

SEQ ID NO: 2292219 - DNA, 21 bp, Homo sapiens
gcaaggggccaggaaggggac

SEQ ID NO: 2292220 - DNA, 23 bp, Homo sapiens
gcaagggtgcttgtggtcacact

SEQ ID NO: 2292221 - DNA, 22 bp, Homo sapiens
gcaatagtgttgaggaggggag

SEQ ID NO: 2292222 - DNA, 22 bp, Homo sapiens
gcaatgacctttcaataggaaa

SEQ ID NO: 2292223 - DNA, 22 bp, Homo sapiens
gcaatgtttttctcaaaaagct

SEQ ID NO: 2292224 - DNA, 18 bp, Homo sapiens
gcacagaacaggaggtgt

SEQ ID NO: 2292225 - DNA, 13 bp, Homo sapiens
gcacagctcctcc

SEQ ID NO: 2292226 - DNA, 16 bp, Homo sapiens
gcacaggtgtaaatat

SEQ ID NO: 2292227 - DNA, 16 bp, Homo sapiens
gcacagtagtgttggg

SEQ ID NO: 2292228 - DNA, 15 bp, Homo sapiens
gcacatatacatcta

SEQ ID NO: 2292229 - DNA, 15 bp, Homo sapiens
gcaccacggggtcgg

SEQ ID NO: 2292230 - DNA, 14 bp, Homo sapiens
gcaccagcctgagc

SEQ ID NO: 2292231 - DNA, 18 bp, Homo sapiens
gcaccagcctgagccaca

SEQ ID NO: 2292232 - DNA, 16 bp, Homo sapiens
gcacccccagcctccc

SEQ ID NO: 2292233 - DNA, 22 bp, Homo sapiens
gcacccccagcctcccccaggc

SEQ ID NO: 2292234 - DNA, 15 bp, Homo sapiens
gcacccggcagcccc

SEQ ID NO: 2292235 - DNA, 21 bp, Homo sapiens
gcacccggcagccccccagtg

SEQ ID NO: 2292236 - DNA, 12 bp, Homo sapiens
gcaccctggctg

SEQ ID NO: 2292237 - DNA, 13 bp, Homo sapiens
gcaccctggctgg

SEQ ID NO: 2292238 - DNA, 18 bp, Homo sapiens
gcacccttgactgttggg

SEQ ID NO: 2292239 - DNA, 14 bp, Homo sapiens
gcaccgccatgcat

SEQ ID NO: 2292240 - DNA, 21 bp, Homo sapiens
gcaccgccatgcatgatgggt

SEQ ID NO: 2292241 - DNA, 21 bp, Homo sapiens
gcaccgcccaacccccacctc

SEQ ID NO: 2292242 - DNA, 13 bp, Homo sapiens
gcaccgcccaccc

SEQ ID NO: 2292243 - DNA, 14 bp, Homo sapiens
gcaccgcccaccca

SEQ ID NO: 2292244 - DNA, 17 bp, Homo sapiens
gcaccgcccacccacac

SEQ ID NO: 2292245 - DNA, 15 bp, Homo sapiens
gcaccgggctggcct

SEQ ID NO: 2292246 - DNA, 17 bp, Homo sapiens
gcaccgtggtgtgaggc

SEQ ID NO: 2292247 - DNA, 20 bp, Homo sapiens
gcaccgtggtgtgaggcccc

SEQ ID NO: 2292248 - DNA, 11 bp, Homo sapiens
gcacctcctcg

SEQ ID NO: 2292249 - DNA, 22 bp, Homo sapiens
gcacgtagtttgcattccagcg

SEQ ID NO: 2292250 - DNA, 15 bp, Homo sapiens
gcactagaatgagaa

SEQ ID NO: 2292251 - DNA, 17 bp, Homo sapiens
gcactagaatgagaaat

SEQ ID NO: 2292252 - DNA, 21 bp, Homo sapiens
gcactatggacattttgggct

SEQ ID NO: 2292253 - DNA, 17 bp, Homo sapiens
gcactccagcctgggca

SEQ ID NO: 2292254 - DNA, 16 bp, Homo sapiens
gcactcccagggcccg

SEQ ID NO: 2292255 - DNA, 20 bp, Homo sapiens
gcactcctgccccggcccaa

SEQ ID NO: 2292256 - DNA, 19 bp, Homo sapiens
gcactgttttattttaatt

SEQ ID NO: 2292257 - DNA, 19 bp, Homo sapiens
gcacttagctgttggaatg

SEQ ID NO: 2292258 - DNA, 16 bp, Homo sapiens
gcacttctggggccag

SEQ ID NO: 2292259 - DNA, 19 bp, Homo sapiens
gcacttgtgatcctaaaat

SEQ ID NO: 2292260 - DNA, 20 bp, Homo sapiens
gcagaaatgtggatgctctt

SEQ ID NO: 2292261 - DNA, 19 bp, Homo sapiens
gcagacactcaagagccct

SEQ ID NO: 2292262 - DNA, 17 bp, Homo sapiens
gcagacagacagacaga

SEQ ID NO: 2292263 - DNA, 14 bp, Homo sapiens
gcagagatgtatta

SEQ ID NO: 2292264 - DNA, 16 bp, Homo sapiens
gcagagccccggagca

SEQ ID NO: 2292265 - DNA, 22 bp, Homo sapiens
gcagagctgagtcggctgggca

SEQ ID NO: 2292266 - DNA, 11 bp, Homo sapiens
gcagaggcagg

SEQ ID NO: 2292267 - DNA, 14 bp, Homo sapiens
gcagaggcagggcc

SEQ ID NO: 2292268 - DNA, 17 bp, Homo sapiens
gcagaggcagggccctg

SEQ ID NO: 2292269 - DNA, 23 bp, Homo sapiens
gcagatttcagatgtaagaagcc

SEQ ID NO: 2292270 - DNA, 20 bp, Homo sapiens
gcagcaaccagagcactgta

SEQ ID NO: 2292271 - DNA, 16 bp, Homo sapiens
gcagcagtaccatccc

SEQ ID NO: 2292272 - DNA, 20 bp, Homo sapiens
gcagcagtaccatcccactg

SEQ ID NO: 2292273 - DNA, 14 bp, Homo sapiens
gcagccactattgt

SEQ ID NO: 2292274 - DNA, 20 bp, Homo sapiens
gcagcccagaacgggcctcc

SEQ ID NO: 2292275 - DNA, 13 bp, Homo sapiens
gcagccccccacg

SEQ ID NO: 2292276 - DNA, 14 bp, Homo sapiens
gcagccgcgctctg

SEQ ID NO: 2292277 - DNA, 19 bp, Homo sapiens
gcagccgcgctctgcccct

SEQ ID NO: 2292278 - DNA, 20 bp, Homo sapiens
gcagccgcgctctgcccctc

SEQ ID NO: 2292279 - DNA, 20 bp, Homo sapiens
gcagcctcgacctccctggc

SEQ ID NO: 2292280 - DNA, 23 bp, Homo sapiens
gcagcctcgacctccctggcttg

SEQ ID NO: 2292281 - DNA, 13 bp, Homo sapiens
gcagcctgagctc

SEQ ID NO: 2292282 - DNA, 19 bp, Homo sapiens
gcagcctgagctccaccct

SEQ ID NO: 2292283 - DNA, 14 bp, Homo sapiens
gcagcggccccgca

SEQ ID NO: 2292284 - DNA, 19 bp, Homo sapiens
gcagcggccccgcacccct

SEQ ID NO: 2292285 - DNA, 16 bp, Homo sapiens
gcagctccaacctgga

SEQ ID NO: 2292286 - DNA, 18 bp, Homo sapiens
gcagctccaacctggagg

SEQ ID NO: 2292287 - DNA, 19 bp, Homo sapiens
gcagctccaacctggaggc

SEQ ID NO: 2292288 - DNA, 11 bp, Homo sapiens
gcaggaaatag

SEQ ID NO: 2292289 - DNA, 17 bp, Homo sapiens
gcaggaaccgaggactc

SEQ ID NO: 2292290 - DNA, 22 bp, Homo sapiens
gcaggaaccgaggactccaggg

SEQ ID NO: 2292291 - DNA, 14 bp, Homo sapiens
gcaggaagtccctg

SEQ ID NO: 2292292 - DNA, 19 bp, Homo sapiens
gcaggagcaaggctgccct

SEQ ID NO: 2292293 - DNA, 18 bp, Homo sapiens
gcaggagctcacaccgca

SEQ ID NO: 2292294 - DNA, 16 bp, Homo sapiens
gcaggaggccattcca

SEQ ID NO: 2292295 - DNA, 19 bp, Homo sapiens
gcaggagtgggctctgagc

SEQ ID NO: 2292296 - DNA, 18 bp, Homo sapiens
gcaggcagagctcagcac

SEQ ID NO: 2292297 - DNA, 21 bp, Homo sapiens
gcaggcagagctcagcacagc

SEQ ID NO: 2292298 - DNA, 23 bp, Homo sapiens
gcaggcagagctcagcacagcct

SEQ ID NO: 2292299 - DNA, 14 bp, Homo sapiens
gcaggcatctgatt

SEQ ID NO: 2292300 - DNA, 18 bp, Homo sapiens
gcaggcctgttccctgag

SEQ ID NO: 2292301 - DNA, 19 bp, Homo sapiens
gcaggcctgttccctgagg

SEQ ID NO: 2292302 - DNA, 21 bp, Homo sapiens
gcaggcctgttccctgaggac

SEQ ID NO: 2292303 - DNA, 15 bp, Homo sapiens
gcaggcggtatccag

SEQ ID NO: 2292304 - DNA, 19 bp, Homo sapiens
gcaggcggtatccagaggt

SEQ ID NO: 2292305 - DNA, 12 bp, Homo sapiens
gcagggcagcag

SEQ ID NO: 2292306 - DNA, 18 bp, Homo sapiens
gcagggcaggcagagctc

SEQ ID NO: 2292307 - DNA, 15 bp, Homo sapiens
gcagggccctggggt

SEQ ID NO: 2292308 - DNA, 21 bp, Homo sapiens
gcagggccctggggtctctga

SEQ ID NO: 2292309 - DNA, 23 bp, Homo sapiens
gcagggccctggggtctctgagc

SEQ ID NO: 2292310 - DNA, 21 bp, Homo sapiens
gcagggccctgtggctccagg

SEQ ID NO: 2292311 - DNA, 13 bp, Homo sapiens
gcagggccgcagg

SEQ ID NO: 2292312 - DNA, 17 bp, Homo sapiens
gcagggccgcagggcgc

SEQ ID NO: 2292313 - DNA, 19 bp, Homo sapiens
gcagggcgctccggcagag

SEQ ID NO: 2292314 - DNA, 10 bp, Homo sapiens
gcagggggct

SEQ ID NO: 2292315 - DNA, 16 bp, Homo sapiens
gcagggggtccccatc

SEQ ID NO: 2292316 - DNA, 16 bp, Homo sapiens
gcagggggttctggga

SEQ ID NO: 2292317 - DNA, 12 bp, Homo sapiens
gcaggtggccag

SEQ ID NO: 2292318 - DNA, 15 bp, Homo sapiens
gcaggtggccagggc

SEQ ID NO: 2292319 - DNA, 15 bp, Homo sapiens
gcagtagcagctgtg

SEQ ID NO: 2292320 - DNA, 15 bp, Homo sapiens
gcagtatcagagggt

SEQ ID NO: 2292321 - DNA, 14 bp, Homo sapiens
gcagtatgtgtgct

SEQ ID NO: 2292322 - DNA, 15 bp, Homo sapiens
gcagtccagtgagaa

SEQ ID NO: 2292323 - DNA, 22 bp, Homo sapiens
gcagtctaaacagagtccggga

SEQ ID NO: 2292324 - DNA, 14 bp, Homo sapiens
gcagtctccgctcc

SEQ ID NO: 2292325 - DNA, 19 bp, Homo sapiens
gcagtgaagatgtgtaaat

SEQ ID NO: 2292326 - DNA, 22 bp, Homo sapiens
gcagtgcagcaaccagagcact

SEQ ID NO: 2292327 - DNA, 21 bp, Homo sapiens
gcagttaccgaggagctaaac

SEQ ID NO: 2292328 - DNA, 14 bp, Homo sapiens
gcagttcctgctgc

SEQ ID NO: 2292329 - DNA, 12 bp, Homo sapiens
gcataaaagtta

SEQ ID NO: 2292330 - DNA, 16 bp, Homo sapiens
gcataagtggacccag

SEQ ID NO: 2292331 - DNA, 14 bp, Homo sapiens
gcatacacatgcac

SEQ ID NO: 2292332 - DNA, 14 bp, Homo sapiens
gcataccacttgaa

SEQ ID NO: 2292333 - DNA, 22 bp, Homo sapiens
gcatagggtccactttggtaat

SEQ ID NO: 2292334 - DNA, 16 bp, Homo sapiens
gcatagggtttggaag

SEQ ID NO: 2292335 - DNA, 20 bp, Homo sapiens
gcatagggtttggaagaaag

SEQ ID NO: 2292336 - DNA, 20 bp, Homo sapiens
gcatagttctgcaataacag

SEQ ID NO: 2292337 - DNA, 21 bp, Homo sapiens
gcatattagcatcatgtcttt

SEQ ID NO: 2292338 - DNA, 18 bp, Homo sapiens
gcatattgttggcacaga

SEQ ID NO: 2292339 - DNA, 19 bp, Homo sapiens
gcatattgttggcacagaa

SEQ ID NO: 2292340 - DNA, 17 bp, Homo sapiens
gcatcatggatcaacca

SEQ ID NO: 2292341 - DNA, 15 bp, Homo sapiens
gcatcatttcccctc

SEQ ID NO: 2292342 - DNA, 23 bp, Homo sapiens
gcatcatttcccctcccgcttcc

SEQ ID NO: 2292343 - DNA, 14 bp, Homo sapiens
gcatccagtatctt

SEQ ID NO: 2292344 - DNA, 18 bp, Homo sapiens
gcatccccagccccctgg

SEQ ID NO: 2292345 - DNA, 15 bp, Homo sapiens
gcatccttgaggacc

SEQ ID NO: 2292346 - DNA, 19 bp, Homo sapiens
gcatctccatttcacgggc

SEQ ID NO: 2292347 - DNA, 21 bp, Homo sapiens
gcatctgatttgcatattcat

SEQ ID NO: 2292348 - DNA, 22 bp, Homo sapiens
gcatgacacgaatattgctgat

SEQ ID NO: 2292349 - DNA, 11 bp, Homo sapiens
gcatgaccctg

SEQ ID NO: 2292350 - DNA, 13 bp, Homo sapiens
gcatgaccctgga

SEQ ID NO: 2292351 - DNA, 16 bp, Homo sapiens
gcatgaccctggagcc

SEQ ID NO: 2292352 - DNA, 19 bp, Homo sapiens
gcatgccgagtgccccaga

SEQ ID NO: 2292353 - DNA, 13 bp, Homo sapiens
gcatgggaatgaa

SEQ ID NO: 2292354 - DNA, 19 bp, Homo sapiens
cttgatataattacttaat

SEQ ID NO: 2292355 - DNA, 21 bp, Homo sapiens
cttgatataattacttaatgt

SEQ ID NO: 2292356 - DNA, 21 bp, Homo sapiens
cttgatcagacattcagagat

SEQ ID NO: 2292357 - DNA, 14 bp, Homo sapiens
cttgatttacaagc

SEQ ID NO: 2292358 - DNA, 14 bp, Homo sapiens
cttgcaaatgaatg

SEQ ID NO: 2292359 - DNA, 21 bp, Homo sapiens
cttgcggcaccgcccacccac

SEQ ID NO: 2292360 - DNA, 22 bp, Homo sapiens
cttgcggcaccgcccacccaca

SEQ ID NO: 2292361 - DNA, 12 bp, Homo sapiens
cttgcttgtacc

SEQ ID NO: 2292362 - DNA, 16 bp, Homo sapiens
cttgctttcacaaata

SEQ ID NO: 2292363 - DNA, 17 bp, Homo sapiens
cttgctttcacaaatat

SEQ ID NO: 2292364 - DNA, 21 bp, Homo sapiens
cttgctttgaatgcatgtgtg

SEQ ID NO: 2292365 - DNA, 22 bp, Homo sapiens
cttggagcagagacggcagccc

SEQ ID NO: 2292366 - DNA, 23 bp, Homo sapiens
cttggagcagagacggcagcccc

SEQ ID NO: 2292367 - DNA, 14 bp, Homo sapiens
cttggatctttttg

SEQ ID NO: 2292368 - DNA, 21 bp, Homo sapiens
cttggcaggagtgggctctga

SEQ ID NO: 2292369 - DNA, 22 bp, Homo sapiens
cttggctaacatagcacagtat

SEQ ID NO: 2292370 - DNA, 18 bp, Homo sapiens
cttggctcgcacccccac

SEQ ID NO: 2292371 - DNA, 16 bp, Homo sapiens
cttgggatgggcacag

SEQ ID NO: 2292372 - DNA, 17 bp, Homo sapiens
cttgggatgggcacagg

SEQ ID NO: 2292373 - DNA, 20 bp, Homo sapiens
cttgggcacgggagagcgcc

SEQ ID NO: 2292374 - DNA, 21 bp, Homo sapiens
cttgggcacgggagagcgcca

SEQ ID NO: 2292375 - DNA, 22 bp, Homo sapiens
cttgggcacgggagagcgccac

SEQ ID NO: 2292376 - DNA, 20 bp, Homo sapiens
cttggtgtcgggcatgacac

SEQ ID NO: 2292377 - DNA, 21 bp, Homo sapiens
cttgtaaaaatagcaaaatat

SEQ ID NO: 2292378 - DNA, 14 bp, Homo sapiens
cttgtacagaacca

SEQ ID NO: 2292379 - DNA, 15 bp, Homo sapiens
cttgtaccagcccag

SEQ ID NO: 2292380 - DNA, 20 bp, Homo sapiens
cttgtacttacactgaaatc

SEQ ID NO: 2292381 - DNA, 19 bp, Homo sapiens
cttgtcccatgtggcttgt

SEQ ID NO: 2292382 - DNA, 19 bp, Homo sapiens
cttgtctcctcctccagga

SEQ ID NO: 2292383 - DNA, 16 bp, Homo sapiens
cttgtctgtgtatttc

SEQ ID NO: 2292384 - DNA, 14 bp, Homo sapiens
cttgtgatcctaaa

SEQ ID NO: 2292385 - DNA, 10 bp, Homo sapiens
cttgtgtatg

SEQ ID NO: 2292386 - DNA, 15 bp, Homo sapiens
cttgtgtcagggcag

SEQ ID NO: 2292387 - DNA, 20 bp, Homo sapiens
cttgtgttgttttctctgat

SEQ ID NO: 2292388 - DNA, 18 bp, Homo sapiens
cttgtttctatactgttt

SEQ ID NO: 2292389 - DNA, 23 bp, Homo sapiens
cttgtttctatactgtttgtaat

SEQ ID NO: 2292390 - DNA, 14 bp, Homo sapiens
cttgtttgttctag

SEQ ID NO: 2292391 - DNA, 21 bp, Homo sapiens
ctttaaatagtttacttcact

SEQ ID NO: 2292392 - DNA, 20 bp, Homo sapiens
ctttaagaagcgaacaaaaa

SEQ ID NO: 2292393 - DNA, 15 bp, Homo sapiens
ctttagattgaaatt

SEQ ID NO: 2292394 - DNA, 22 bp, Homo sapiens
ctttagattgaaatttatgact

SEQ ID NO: 2292395 - DNA, 21 bp, Homo sapiens
ctttcaaacattgagactgct

SEQ ID NO: 2292396 - DNA, 14 bp, Homo sapiens
ctttcaataggaaa

SEQ ID NO: 2292397 - DNA, 17 bp, Homo sapiens
ctttcaataggaaaaac

SEQ ID NO: 2292398 - DNA, 22 bp, Homo sapiens
ctttcaataggaaaaactgatt

SEQ ID NO: 2292399 - DNA, 14 bp, Homo sapiens
ctttcacatctctg

SEQ ID NO: 2292400 - DNA, 15 bp, Homo sapiens
ctttcacatctctgt

SEQ ID NO: 2292401 - DNA, 21 bp, Homo sapiens
ctttcagaatattttcaaaat

SEQ ID NO: 2292402 - DNA, 21 bp, Homo sapiens
ctttcatctgagcttttacca

SEQ ID NO: 2292403 - DNA, 18 bp, Homo sapiens
ctttcatgtttaagaaat

SEQ ID NO: 2292404 - DNA, 16 bp, Homo sapiens
ctttcctcccttctga

SEQ ID NO: 2292405 - DNA, 18 bp, Homo sapiens
ctttcctgtttccagggt

SEQ ID NO: 2292406 - DNA, 20 bp, Homo sapiens
ctttcctgtttccagggtct

SEQ ID NO: 2292407 - DNA, 15 bp, Homo sapiens
ctttccttcccaata

SEQ ID NO: 2292408 - DNA, 13 bp, Homo sapiens
ctttcgcctcctc

SEQ ID NO: 2292409 - DNA, 16 bp, Homo sapiens
ctttcgcctcctccag

SEQ ID NO: 2292410 - DNA, 19 bp, Homo sapiens
ctttcgcctcctccagctc

SEQ ID NO: 2292411 - DNA, 18 bp, Homo sapiens
ctttctaagctttcttac

SEQ ID NO: 2292412 - DNA, 20 bp, Homo sapiens
ctttctatgtagaactgttc

SEQ ID NO: 2292413 - DNA, 13 bp, Homo sapiens
ctttctattggca

SEQ ID NO: 2292414 - DNA, 23 bp, Homo sapiens
ctttctcacatgtggctccccct

SEQ ID NO: 2292415 - DNA, 15 bp, Homo sapiens
ctttctgttatcaag

SEQ ID NO: 2292416 - DNA, 16 bp, Homo sapiens
ctttctttctttcttt

SEQ ID NO: 2292417 - DNA, 10 bp, Homo sapiens
ctttcttttt

SEQ ID NO: 2292418 - DNA, 16 bp, Homo sapiens
ctttgggaaagctctt

SEQ ID NO: 2292419 - DNA, 16 bp, Homo sapiens
ctttggtaatgtgtca

SEQ ID NO: 2292420 - DNA, 23 bp, Homo sapiens
ctttgtagatgtattttcaataa

SEQ ID NO: 2292421 - DNA, 23 bp, Homo sapiens
ctttgtggatatatttaaaattc

SEQ ID NO: 2292422 - DNA, 14 bp, Homo sapiens
cttttataagacaa

SEQ ID NO: 2292423 - DNA, 18 bp, Homo sapiens
cttttatataactacatt

SEQ ID NO: 2292424 - DNA, 13 bp, Homo sapiens
cttttatatctgt

SEQ ID NO: 2292425 - DNA, 17 bp, Homo sapiens
cttttattgagtaatat

SEQ ID NO: 2292426 - DNA, 20 bp, Homo sapiens
cttttattgagtaatattac

SEQ ID NO: 2292427 - DNA, 20 bp, Homo sapiens
cttttcagcatggtttgcat

SEQ ID NO: 2292428 - DNA, 19 bp, Homo sapiens
cttttcagcttgtttctat

SEQ ID NO: 2292429 - DNA, 14 bp, Homo sapiens
cttttcatttttgc

SEQ ID NO: 2292430 - DNA, 18 bp, Homo sapiens
cttttccataaccaacat

SEQ ID NO: 2292431 - DNA, 22 bp, Homo sapiens
cttttctttttaaatgtgcttc

SEQ ID NO: 2292432 - DNA, 20 bp, Homo sapiens
cttttgaagctcaactgttg

SEQ ID NO: 2292433 - DNA, 21 bp, Homo sapiens
cttttgagtgccttacacaat

SEQ ID NO: 2292434 - DNA, 19 bp, Homo sapiens
cttttggcagttctgataa

SEQ ID NO: 2292435 - DNA, 14 bp, Homo sapiens
cttttggggaggag

SEQ ID NO: 2292436 - DNA, 22 bp, Homo sapiens
cttttggggaggagttgtctgt

SEQ ID NO: 2292437 - DNA, 15 bp, Homo sapiens
ctttttaaatgtgct

SEQ ID NO: 2292438 - DNA, 18 bp, Homo sapiens
ctttttcaccctattttc

SEQ ID NO: 2292439 - DNA, 22 bp, Homo sapiens
ctttttccatatagtttgtttt

SEQ ID NO: 2292440 - DNA, 21 bp, Homo sapiens
ctttttctcgagtccaaaatc

SEQ ID NO: 2292441 - DNA, 22 bp, Homo sapiens
cttttttaaaattgtgttctta

SEQ ID NO: 2292442 - DNA, 13 bp, Homo sapiens
cttttttgggggg

SEQ ID NO: 2292443 - DNA, 22 bp, Homo sapiens
cttttttggggggagaaacctc

SEQ ID NO: 2292444 - DNA, 16 bp, Homo sapiens
gaaaaaaatagtttta

SEQ ID NO: 2292445 - DNA, 15 bp, Homo sapiens
gaaaacgtggctgct

SEQ ID NO: 2292446 - DNA, 16 bp, Homo sapiens
gaaaacgtggctgctt

SEQ ID NO: 2292447 - DNA, 19 bp, Homo sapiens
gaaaacgtggctgcttcaa

SEQ ID NO: 2292448 - DNA, 22 bp, Homo sapiens
gaaaacgtggctgcttcaagga

SEQ ID NO: 2292449 - DNA, 12 bp, Homo sapiens
gaaaagaagaaa

SEQ ID NO: 2292450 - DNA, 23 bp, Homo sapiens
gaaaagtcattcagttatcacta

SEQ ID NO: 2292451 - DNA, 12 bp, Homo sapiens
gaaaataaaata

SEQ ID NO: 2292452 - DNA, 20 bp, Homo sapiens
gaaaatgaactgtatattat

SEQ ID NO: 2292453 - DNA, 23 bp, Homo sapiens
gaaaatgtatggatgaattctga

SEQ ID NO: 2292454 - DNA, 13 bp, Homo sapiens
gaaacaaggaagg

SEQ ID NO: 2292455 - DNA, 23 bp, Homo sapiens
gaaacagaggaccagcacactcc

SEQ ID NO: 2292456 - DNA, 17 bp, Homo sapiens
gaaacgagatttgccaa

SEQ ID NO: 2292457 - DNA, 18 bp, Homo sapiens
gaaactggccccggaaaa

SEQ ID NO: 2292458 - DNA, 16 bp, Homo sapiens
gaaagaagtcaaatga

SEQ ID NO: 2292459 - DNA, 22 bp, Homo sapiens
gaaagagcaaagtcatgtcaga

SEQ ID NO: 2292460 - DNA, 17 bp, Homo sapiens
gaaagatggtaatcttt

SEQ ID NO: 2292461 - DNA, 18 bp, Homo sapiens
gaaagatggtaatctttt

SEQ ID NO: 2292462 - DNA, 19 bp, Homo sapiens
gaaagatggtaatcttttc

SEQ ID NO: 2292463 - DNA, 14 bp, Homo sapiens
gaaagcctagtcca

SEQ ID NO: 2292464 - DNA, 13 bp, Homo sapiens
gaaagctgtggct

SEQ ID NO: 2292465 - DNA, 21 bp, Homo sapiens
gaaaggggcccattcagcctc

SEQ ID NO: 2292466 - DNA, 23 bp, Homo sapiens
gaaaggggcccattcagcctcgt

SEQ ID NO: 2292467 - DNA, 13 bp, Homo sapiens
gaaagttctatta

SEQ ID NO: 2292468 - DNA, 20 bp, Homo sapiens
gaaagtttcttcaactctga

SEQ ID NO: 2292469 - DNA, 20 bp, Homo sapiens
gaaataaagactcttggact

SEQ ID NO: 2292470 - DNA, 14 bp, Homo sapiens
gaaatacactacaa

SEQ ID NO: 2292471 - DNA, 12 bp, Homo sapiens
gaaatacattta

SEQ ID NO: 2292472 - DNA, 20 bp, Homo sapiens
gaaatagttccattctatga

SEQ ID NO: 2292473 - DNA, 19 bp, Homo sapiens
gaaatattaatatgtactt

SEQ ID NO: 2292474 - DNA, 15 bp, Homo sapiens
gaaatatttgcttat

SEQ ID NO: 2292475 - DNA, 20 bp, Homo sapiens
gaaatatttgcttatttata

SEQ ID NO: 2292476 - DNA, 15 bp, Homo sapiens
gaaatcaatttaaag

SEQ ID NO: 2292477 - DNA, 19 bp, Homo sapiens
gaaatcaatttaaaggaaa

SEQ ID NO: 2292478 - DNA, 17 bp, Homo sapiens
gaaatcaccgaaaacgt

SEQ ID NO: 2292479 - DNA, 14 bp, Homo sapiens
gaaatcctgttact

SEQ ID NO: 2292480 - DNA, 14 bp, Homo sapiens
gaaatgagaaattg

SEQ ID NO: 2292481 - DNA, 15 bp, Homo sapiens
gaaatgctaatgtaa

SEQ ID NO: 2292482 - DNA, 16 bp, Homo sapiens
gaaatgggacggaggt

SEQ ID NO: 2292483 - DNA, 13 bp, Homo sapiens
gaaatgtttccag

SEQ ID NO: 2292484 - DNA, 13 bp, Homo sapiens
gaaattcacactg

SEQ ID NO: 2292485 - DNA, 12 bp, Homo sapiens
gaaattctataa

SEQ ID NO: 2292486 - DNA, 19 bp, Homo sapiens
gaaattctataagagacaa

SEQ ID NO: 2292487 - DNA, 22 bp, Homo sapiens
gaaattctataagagacaaagt

SEQ ID NO: 2292488 - DNA, 15 bp, Homo sapiens
gaaattgtgccaaag

SEQ ID NO: 2292489 - DNA, 18 bp, Homo sapiens
gaaatttacagttactgc

SEQ ID NO: 2292490 - DNA, 17 bp, Homo sapiens
ctggagaccaggactct

SEQ ID NO: 2292491 - DNA, 12 bp, Homo sapiens
ctggagcaaagc

SEQ ID NO: 2292492 - DNA, 20 bp, Homo sapiens
ctggagcagtttggggcagg

SEQ ID NO: 2292493 - DNA, 22 bp, Homo sapiens
ctggagcagtttggggcagggg

SEQ ID NO: 2292494 - DNA, 16 bp, Homo sapiens
ctggagctggcactgt

SEQ ID NO: 2292495 - DNA, 23 bp, Homo sapiens
ctggaggagggtttgggcagagc

SEQ ID NO: 2292496 - DNA, 20 bp, Homo sapiens
ctggaggctggaccaactgc

SEQ ID NO: 2292497 - DNA, 14 bp, Homo sapiens
ctggagggctgggc

SEQ ID NO: 2292498 - DNA, 18 bp, Homo sapiens
ctggagggctgggcaggg

SEQ ID NO: 2292499 - DNA, 17 bp, Homo sapiens
ctggaggtggggagggc

SEQ ID NO: 2292500 - DNA, 23 bp, Homo sapiens
ctggagtccctcctcccccacgc

SEQ ID NO: 2292501 - DNA, 15 bp, Homo sapiens
ctggagtggcatggt

SEQ ID NO: 2292502 - DNA, 18 bp, Homo sapiens
ctggagtggcatggtcct

SEQ ID NO: 2292503 - DNA, 14 bp, Homo sapiens
ctggatagaaaaat

SEQ ID NO: 2292504 - DNA, 12 bp, Homo sapiens
ctggattttctt

SEQ ID NO: 2292505 - DNA, 20 bp, Homo sapiens
ctggattttctttctatgta

SEQ ID NO: 2292506 - DNA, 23 bp, Homo sapiens
ctggcaaaggctggctgtgtata

SEQ ID NO: 2292507 - DNA, 16 bp, Homo sapiens
ctggcagcgcctcccg

SEQ ID NO: 2292508 - DNA, 14 bp, Homo sapiens
ctggcaggagacac

SEQ ID NO: 2292509 - DNA, 17 bp, Homo sapiens
ctggcaggagacactgg

SEQ ID NO: 2292510 - DNA, 21 bp, Homo sapiens
ctggcaggagacactggtctc

SEQ ID NO: 2292511 - DNA, 15 bp, Homo sapiens
ctggcagggcaggca

SEQ ID NO: 2292512 - DNA, 17 bp, Homo sapiens
ctggcagggcaggcaga

SEQ ID NO: 2292513 - DNA, 20 bp, Homo sapiens
ctggcagggcaggcagagct

SEQ ID NO: 2292514 - DNA, 22 bp, Homo sapiens
ctggcagggcaggcagagctca

SEQ ID NO: 2292515 - DNA, 18 bp, Homo sapiens
ctggcagtctggagcaaa

SEQ ID NO: 2292516 - DNA, 19 bp, Homo sapiens
ctggcatgggaatgaatgt

SEQ ID NO: 2292517 - DNA, 24 bp, Homo sapiens
ctggcatgggaatgaatgtcagtg

SEQ ID NO: 2292518 - DNA, 13 bp, Homo sapiens
ctggccactggcc

SEQ ID NO: 2292519 - DNA, 16 bp, Homo sapiens
ctggccactggccctg

SEQ ID NO: 2292520 - DNA, 22 bp, Homo sapiens
ctggccactggccctgtttctc

SEQ ID NO: 2292521 - DNA, 11 bp, Homo sapiens
ctggccccagg

SEQ ID NO: 2292522 - DNA, 15 bp, Homo sapiens
ctggcccctcccaca

SEQ ID NO: 2292523 - DNA, 18 bp, Homo sapiens
ctggcccctcccacatcc

SEQ ID NO: 2292524 - DNA, 16 bp, Homo sapiens
ctggccctgccctccc

SEQ ID NO: 2292525 - DNA, 15 bp, Homo sapiens
ctggcctcttctaga

SEQ ID NO: 2292526 - DNA, 15 bp, Homo sapiens
ctggcgggcagcccc

SEQ ID NO: 2292527 - DNA, 23 bp, Homo sapiens
ctggctcacacttggctctgagg

SEQ ID NO: 2292528 - DNA, 19 bp, Homo sapiens
ctggctgggtcgcccctcc

SEQ ID NO: 2292529 - DNA, 19 bp, Homo sapiens
ctggcttctccctggactc

SEQ ID NO: 2292530 - DNA, 20 bp, Homo sapiens
ctggcttctccctggactct

SEQ ID NO: 2292531 - DNA, 18 bp, Homo sapiens
ctgggaatttatttatgt

SEQ ID NO: 2292532 - DNA, 16 bp, Homo sapiens
ctgggaccctcggggc

SEQ ID NO: 2292533 - DNA, 22 bp, Homo sapiens
ctgggaccctcggggcaggaag

SEQ ID NO: 2292534 - DNA, 13 bp, Homo sapiens
ctgggagagtgag

SEQ ID NO: 2292535 - DNA, 16 bp, Homo sapiens
ctgggagatgctggga

SEQ ID NO: 2292536 - DNA, 11 bp, Homo sapiens
ctgggcagggc

SEQ ID NO: 2292537 - DNA, 19 bp, Homo sapiens
ctgggcagggccctgtggc

SEQ ID NO: 2292538 - DNA, 15 bp, Homo sapiens
ctgggcatccccagc

SEQ ID NO: 2292539 - DNA, 20 bp, Homo sapiens
ctgggcatccccagccccct

SEQ ID NO: 2292540 - DNA, 13 bp, Homo sapiens
ctgggccagggtc

SEQ ID NO: 2292541 - DNA, 16 bp, Homo sapiens
ctgggccccgcctcaa

SEQ ID NO: 2292542 - DNA, 12 bp, Homo sapiens
ctgggccctggt

SEQ ID NO: 2292543 - DNA, 21 bp, Homo sapiens
ctgggcctcccgtccgtccgc

SEQ ID NO: 2292544 - DNA, 23 bp, Homo sapiens
ctgggctggcggccatccccgtg

SEQ ID NO: 2292545 - DNA, 15 bp, Homo sapiens
ctggggccagcccct

SEQ ID NO: 2292546 - DNA, 16 bp, Homo sapiens
ctggggccagcccctc

SEQ ID NO: 2292547 - DNA, 18 bp, Homo sapiens
ctggggccagcccctccc

SEQ ID NO: 2292548 - DNA, 21 bp, Homo sapiens
ctggggccagcccctccccgc

SEQ ID NO: 2292549 - DNA, 20 bp, Homo sapiens
ctggggcttttgtgccagga

SEQ ID NO: 2292550 - DNA, 17 bp, Homo sapiens
ctggggtcccccctccc

SEQ ID NO: 2292551 - DNA, 20 bp, Homo sapiens
ctggggtcccccctccctgt

SEQ ID NO: 2292552 - DNA, 16 bp, Homo sapiens
ctggggtctctgagca

SEQ ID NO: 2292553 - DNA, 18 bp, Homo sapiens
ctggggtctctgagcagt

SEQ ID NO: 2292554 - DNA, 20 bp, Homo sapiens
ctggggtctctgagcagtgg

SEQ ID NO: 2292555 - DNA, 16 bp, Homo sapiens
ctgggtatgcgtttca

SEQ ID NO: 2292556 - DNA, 16 bp, Homo sapiens
ctgggtcagcttgaat

SEQ ID NO: 2292557 - DNA, 14 bp, Homo sapiens
ctgggtcgcccctc

SEQ ID NO: 2292558 - DNA, 15 bp, Homo sapiens
ctgggtcgcccctcc

SEQ ID NO: 2292559 - DNA, 22 bp, Homo sapiens
ctgggtcgcccctcctcgggcg

SEQ ID NO: 2292560 - DNA, 15 bp, Homo sapiens
ctgggtgggccccac

SEQ ID NO: 2292561 - DNA, 21 bp, Homo sapiens
ctgggtgggccccacagtggt

SEQ ID NO: 2292562 - DNA, 23 bp, Homo sapiens
ctgggtgtgacctgacacctgcc

SEQ ID NO: 2292563 - DNA, 18 bp, Homo sapiens
ctgggtgtgactgattcc

SEQ ID NO: 2292564 - DNA, 15 bp, Homo sapiens
ctgggttgttgcaga

SEQ ID NO: 2292565 - DNA, 17 bp, Homo sapiens
ctggtatggctgcagtc

SEQ ID NO: 2292566 - DNA, 21 bp, Homo sapiens
ctggtcgtaaacatctcagag

SEQ ID NO: 2292567 - DNA, 23 bp, Homo sapiens
ctggtctcgtgttcgctggctga

SEQ ID NO: 2292568 - DNA, 13 bp, Homo sapiens
ctggtctgcacct

SEQ ID NO: 2292569 - DNA, 13 bp, Homo sapiens
ctggtcttgaact

SEQ ID NO: 2292570 - DNA, 22 bp, Homo sapiens
ctggtcttgaactcttggcctc

SEQ ID NO: 2292571 - DNA, 23 bp, Homo sapiens
ctggtgcgttcctaaactctgaa

SEQ ID NO: 2292572 - DNA, 13 bp, Homo sapiens
ctggtgtctagtt

SEQ ID NO: 2292573 - DNA, 17 bp, Homo sapiens
ctggttcttggcttcct

SEQ ID NO: 2292574 - DNA, 18 bp, Homo sapiens
ctggttcttggcttcctt

SEQ ID NO: 2292575 - DNA, 16 bp, Homo sapiens
ctgtaaatttaactgc

SEQ ID NO: 2292576 - DNA, 12 bp, Homo sapiens
ctgtaatgcagg

SEQ ID NO: 2292577 - DNA, 15 bp, Homo sapiens
ctgtaattttgtagt

SEQ ID NO: 2292578 - DNA, 17 bp, Homo sapiens
ctgtaccctatgttcac

SEQ ID NO: 2292579 - DNA, 16 bp, Homo sapiens
ctgtagcaatatattt

SEQ ID NO: 2292580 - DNA, 17 bp, Homo sapiens
ctgtagtaattgttaca

SEQ ID NO: 2292581 - DNA, 18 bp, Homo sapiens
ctgtatagacagtttgta

SEQ ID NO: 2292582 - DNA, 20 bp, Homo sapiens
ctgtatagacagtttgtaaa

SEQ ID NO: 2292583 - DNA, 21 bp, Homo sapiens
ctgtatagacagtttgtaaat

SEQ ID NO: 2292584 - DNA, 16 bp, Homo sapiens
ctgtatatcagctcta

SEQ ID NO: 2292585 - DNA, 21 bp, Homo sapiens
ctgtatctaaaaaataactgt

SEQ ID NO: 2292586 - DNA, 12 bp, Homo sapiens
ctgtattttctt

SEQ ID NO: 2292587 - DNA, 20 bp, Homo sapiens
ctgtattttcttttatatct

SEQ ID NO: 2292588 - DNA, 23 bp, Homo sapiens
ctgtattttcttttatatctgta

SEQ ID NO: 2292589 - DNA, 15 bp, Homo sapiens
ctgtcaattacagga

SEQ ID NO: 2292590 - DNA, 16 bp, Homo sapiens
ctgtcaattacaggaa

SEQ ID NO: 2292591 - DNA, 23 bp, Homo sapiens
ctgtcaattacaggaagtactgg

SEQ ID NO: 2292592 - DNA, 19 bp, Homo sapiens
ctgtcactcacaaaaggct

SEQ ID NO: 2292593 - DNA, 21 bp, Homo sapiens
ctgtccagcaggggtctccca

SEQ ID NO: 2292594 - DNA, 21 bp, Homo sapiens
ctgtcccacaaaatatttcta

SEQ ID NO: 2292595 - DNA, 22 bp, Homo sapiens
ctgtcccacaaaatatttctaa

SEQ ID NO: 2292596 - DNA, 18 bp, Homo sapiens
ctgtcccatgggctctgg

SEQ ID NO: 2292597 - DNA, 21 bp, Homo sapiens
ctgtcccatgggctctggccc

SEQ ID NO: 2292598 - DNA, 22 bp, Homo sapiens
ctgtcccatgggctctggcccc

SEQ ID NO: 2292599 - DNA, 18 bp, Homo sapiens
ctgtcctcttaagacact

SEQ ID NO: 2292600 - DNA, 21 bp, Homo sapiens
ctgtcctcttaagacactagt

SEQ ID NO: 2292601 - DNA, 16 bp, Homo sapiens
ctgtctattgtcacat

SEQ ID NO: 2292602 - DNA, 15 bp, Homo sapiens
ctgtcttcaaccctg

SEQ ID NO: 2292603 - DNA, 16 bp, Homo sapiens
ctgtcttcaaccctgc

SEQ ID NO: 2292604 - DNA, 21 bp, Homo sapiens
ctgtcttcaaccctgccctgc

SEQ ID NO: 2292605 - DNA, 22 bp, Homo sapiens
ctgtcttcaaccctgccctgca

SEQ ID NO: 2292606 - DNA, 12 bp, Homo sapiens
ctgtcttgtaat

SEQ ID NO: 2292607 - DNA, 18 bp, Homo sapiens
ctgtcttgtaatattttg

SEQ ID NO: 2292608 - DNA, 22 bp, Homo sapiens
ctgtcttgtaatattttgtatt

SEQ ID NO: 2292609 - DNA, 14 bp, Homo sapiens
ctgtgaccggggtc

SEQ ID NO: 2292610 - DNA, 23 bp, Homo sapiens
ctgtgaccggggtcctgaggctg

SEQ ID NO: 2292611 - DNA, 20 bp, Homo sapiens
ctgtgactcgcttagctgaa

SEQ ID NO: 2292612 - DNA, 18 bp, Homo sapiens
ctgtgagcaaagtgcagg

SEQ ID NO: 2292613 - DNA, 13 bp, Homo sapiens
ctgtgatctaagc

SEQ ID NO: 2292614 - DNA, 16 bp, Homo sapiens
ctgtgatctaagcagt

SEQ ID NO: 2292615 - DNA, 18 bp, Homo sapiens
ctgtgatctaagcagttg

SEQ ID NO: 2292616 - DNA, 22 bp, Homo sapiens
ctgtgatgtcatgaaagcacct

SEQ ID NO: 2292617 - DNA, 19 bp, Homo sapiens
ctgtgcccatggcttctgg

SEQ ID NO: 2292618 - DNA, 19 bp, Homo sapiens
ctgtgccccgaccccacct

SEQ ID NO: 2292619 - DNA, 16 bp, Homo sapiens
ctgtgcgttttagagt

SEQ ID NO: 2292620 - DNA, 23 bp, Homo sapiens
ctgtgctaatgggctgctgtcat

SEQ ID NO: 2292621 - DNA, 14 bp, Homo sapiens
ctgtgctagaagct

SEQ ID NO: 2292622 - DNA, 17 bp, Homo sapiens
ctgtgctagaagctcca

SEQ ID NO: 2292623 - DNA, 19 bp, Homo sapiens
ctgtgctctcctagagctc

SEQ ID NO: 2292624 - DNA, 17 bp, Homo sapiens
ctgtggaaatatgcaac

SEQ ID NO: 2292625 - DNA, 14 bp, Homo sapiens
ctgtggaacactaa

SEQ ID NO: 2292626 - DNA, 12 bp, Homo sapiens
ctgtggattcta

SEQ ID NO: 2292627 - DNA, 13 bp, Homo sapiens
ctgtggattctat

SEQ ID NO: 2292628 - DNA, 13 bp, Homo sapiens
ctgtggccaccta

SEQ ID NO: 2292629 - DNA, 15 bp, Homo sapiens
ctgtggctccaggag

SEQ ID NO: 2292630 - DNA, 13 bp, Homo sapiens
ctgtggctgccat

SEQ ID NO: 2292631 - DNA, 14 bp, Homo sapiens
ctgtggctgccatc

SEQ ID NO: 2292632 - DNA, 15 bp, Homo sapiens
ctgtggggagctggt

SEQ ID NO: 2292633 - DNA, 17 bp, Homo sapiens
ctgtggggagctggtgg

SEQ ID NO: 2292634 - DNA, 13 bp, Homo sapiens
ctgtggggccaca

SEQ ID NO: 2292635 - DNA, 19 bp, Homo sapiens
ctgtggtcggtgccagagg

SEQ ID NO: 2292636 - DNA, 20 bp, Homo sapiens
ctgtggtctggtgttccagc

SEQ ID NO: 2292637 - DNA, 17 bp, Homo sapiens
ctgtgtaatctctgatt

SEQ ID NO: 2292638 - DNA, 18 bp, Homo sapiens
ctgtgtactgtatagaca

SEQ ID NO: 2292639 - DNA, 16 bp, Homo sapiens
ctgtgtctatgaacta

SEQ ID NO: 2292640 - DNA, 13 bp, Homo sapiens
ctgtgtctgctgt

SEQ ID NO: 2292641 - DNA, 14 bp, Homo sapiens
ctgtgttgcccagg

SEQ ID NO: 2292642 - DNA, 17 bp, Homo sapiens
ctgtgtttcaaacctgc

SEQ ID NO: 2292643 - DNA, 17 bp, Homo sapiens
ctgttaacccagtgttc

SEQ ID NO: 2292644 - DNA, 17 bp, Homo sapiens
ctgttagaattaggtaa

SEQ ID NO: 2292645 - DNA, 12 bp, Homo sapiens
ctgttagcatta

SEQ ID NO: 2292646 - DNA, 18 bp, Homo sapiens
ctgttagcattattgcca

SEQ ID NO: 2292647 - DNA, 23 bp, Homo sapiens
ctgttcatttccaccaagggtat

SEQ ID NO: 2292648 - DNA, 17 bp, Homo sapiens
ctgttccctgaggacct

SEQ ID NO: 2292649 - DNA, 18 bp, Homo sapiens
ctgttcctgtccagcagg

SEQ ID NO: 2292650 - DNA, 19 bp, Homo sapiens
ctgttctaactagtaatct

SEQ ID NO: 2292651 - DNA, 17 bp, Homo sapiens
ctgttctgtgtctgctg

SEQ ID NO: 2292652 - DNA, 19 bp, Homo sapiens
ctgttgacaatttgccata

SEQ ID NO: 2292653 - DNA, 16 bp, Homo sapiens
ctgttgaccaggctgg

SEQ ID NO: 2292654 - DNA, 15 bp, Homo sapiens
ctgttgattccactg

SEQ ID NO: 2292655 - DNA, 15 bp, Homo sapiens
ctgttgcttgaatag

SEQ ID NO: 2292656 - DNA, 22 bp, Homo sapiens
ctgttggaatgttgttaaatgc

SEQ ID NO: 2292657 - DNA, 19 bp, Homo sapiens
ctgttgtctagtatacagt

SEQ ID NO: 2292658 - DNA, 15 bp, Homo sapiens
ctgtttccagggtct

SEQ ID NO: 2292659 - DNA, 12 bp, Homo sapiens
ctgtttctatgt

SEQ ID NO: 2292660 - DNA, 15 bp, Homo sapiens
ctgtttcttgcttgt

SEQ ID NO: 2292661 - DNA, 16 bp, Homo sapiens
ctgtttcttgcttgta

SEQ ID NO: 2292662 - DNA, 16 bp, Homo sapiens
ctgtttggtgaggacc

SEQ ID NO: 2292663 - DNA, 22 bp, Homo sapiens
ctgttttatgtcatactctgtg

SEQ ID NO: 2292664 - DNA, 22 bp, Homo sapiens
ctgtttttgaagaagggaaatt

SEQ ID NO: 2292665 - DNA, 21 bp, Homo sapiens
cttaaaaaccttctatgttca

SEQ ID NO: 2292666 - DNA, 17 bp, Homo sapiens
cttaaaataatgattta

SEQ ID NO: 2292667 - DNA, 15 bp, Homo sapiens
cttaaagaatttgaa

SEQ ID NO: 2292668 - DNA, 21 bp, Homo sapiens
cttaacataaacttgtactta

SEQ ID NO: 2292669 - DNA, 13 bp, Homo sapiens
cttaagacactag

SEQ ID NO: 2292670 - DNA, 20 bp, Homo sapiens
cttaagatgctaatagaaaa

SEQ ID NO: 2292671 - DNA, 17 bp, Homo sapiens
cttaatcatatcaactt

SEQ ID NO: 2292672 - DNA, 16 bp, Homo sapiens
cttaattatgctaaca

SEQ ID NO: 2292673 - DNA, 19 bp, Homo sapiens
cttacaagtttatgtggca

SEQ ID NO: 2292674 - DNA, 18 bp, Homo sapiens
cttacactgaaatccaaa

SEQ ID NO: 2292675 - DNA, 21 bp, Homo sapiens
cttacagtattttctatgtaa

SEQ ID NO: 2292676 - DNA, 14 bp, Homo sapiens
cttaccaaaacata

SEQ ID NO: 2292677 - DNA, 12 bp, Homo sapiens
cttacgctctct

SEQ ID NO: 2292678 - DNA, 22 bp, Homo sapiens
cttagatggagaagttgtgaaa

SEQ ID NO: 2292679 - DNA, 14 bp, Homo sapiens
cttagcctttcttt

SEQ ID NO: 2292680 - DNA, 13 bp, Homo sapiens
cttataatttcca

SEQ ID NO: 2292681 - DNA, 12 bp, Homo sapiens
cttatagaaagt

SEQ ID NO: 2292682 - DNA, 15 bp, Homo sapiens
cttatatatttgaaa

SEQ ID NO: 2292683 - DNA, 13 bp, Homo sapiens
cttatcaaatcat

SEQ ID NO: 2292684 - DNA, 16 bp, Homo sapiens
cttatccccagctgtt

SEQ ID NO: 2292685 - DNA, 14 bp, Homo sapiens
cttatctccagcca

SEQ ID NO: 2292686 - DNA, 13 bp, Homo sapiens
cttatggaacact

SEQ ID NO: 2292687 - DNA, 16 bp, Homo sapiens
cttatggaacactctg

SEQ ID NO: 2292688 - DNA, 17 bp, Homo sapiens
cttatggaacactctga

SEQ ID NO: 2292689 - DNA, 20 bp, Homo sapiens
cttatggaacactctgagac

SEQ ID NO: 2292690 - DNA, 22 bp, Homo sapiens
cttattaaccaaattaaccttt

SEQ ID NO: 2292691 - DNA, 13 bp, Homo sapiens
cttatttatatat

SEQ ID NO: 2292692 - DNA, 23 bp, Homo sapiens
cttatttatattcagagatgtac

SEQ ID NO: 2292693 - DNA, 12 bp, Homo sapiens
cttatttgaaag

SEQ ID NO: 2292694 - DNA, 16 bp, Homo sapiens
cttatttgaaagtgtt

SEQ ID NO: 2292695 - DNA, 14 bp, Homo sapiens
cttcaactacttct

SEQ ID NO: 2292696 - DNA, 13 bp, Homo sapiens
cttcaaggatcct

SEQ ID NO: 2292697 - DNA, 16 bp, Homo sapiens
cttcaaggatcctgag

SEQ ID NO: 2292698 - DNA, 19 bp, Homo sapiens
cttcaaggatcctgagcca

SEQ ID NO: 2292699 - DNA, 21 bp, Homo sapiens
cttcaaggatcctgagccaga

SEQ ID NO: 2292700 - DNA, 14 bp, Homo sapiens
cttcacaaaatgca

SEQ ID NO: 2292701 - DNA, 18 bp, Homo sapiens
cttcactctccagggtac

SEQ ID NO: 2292702 - DNA, 15 bp, Homo sapiens
cttcagaaaagacac

SEQ ID NO: 2292703 - DNA, 18 bp, Homo sapiens
cttcagagttctctgtaa

SEQ ID NO: 2292704 - DNA, 14 bp, Homo sapiens
cttcagtgccaaaa

SEQ ID NO: 2292705 - DNA, 11 bp, Homo sapiens
cttcagtgcct

SEQ ID NO: 2292706 - DNA, 17 bp, Homo sapiens
cttcagttctcatcttg

SEQ ID NO: 2292707 - DNA, 14 bp, Homo sapiens
cttcagttgtggcc

SEQ ID NO: 2292708 - DNA, 21 bp, Homo sapiens
cttcagttgtggcctcattca

SEQ ID NO: 2292709 - DNA, 18 bp, Homo sapiens
cttcatcgcattttgatt

SEQ ID NO: 2292710 - DNA, 13 bp, Homo sapiens
cttcatctggagt

SEQ ID NO: 2292711 - DNA, 18 bp, Homo sapiens
cttccagcccagacatcc

SEQ ID NO: 2292712 - DNA, 16 bp, Homo sapiens
cttccagctcagtccc

SEQ ID NO: 2292713 - DNA, 19 bp, Homo sapiens
cttccagctcagtcccaca

SEQ ID NO: 2292714 - DNA, 22 bp, Homo sapiens
cttccaggcgtagggccagggc

SEQ ID NO: 2292715 - DNA, 22 bp, Homo sapiens
cttccatgatagatataaagga

SEQ ID NO: 2292716 - DNA, 16 bp, Homo sapiens
cttcccagctggcagc

SEQ ID NO: 2292717 - DNA, 21 bp, Homo sapiens
cttcccagctggcagcgcctc

SEQ ID NO: 2292718 - DNA, 16 bp, Homo sapiens
cttccccgtgcggccc

SEQ ID NO: 2292719 - DNA, 22 bp, Homo sapiens
cttccccttgggatgggcacag

SEQ ID NO: 2292720 - DNA, 13 bp, Homo sapiens
cttcccgcagcac

SEQ ID NO: 2292721 - DNA, 15 bp, Homo sapiens
cttcccgcagcacca

SEQ ID NO: 2292722 - DNA, 18 bp, Homo sapiens
cttcccgcagcaccagcc

SEQ ID NO: 2292723 - DNA, 22 bp, Homo sapiens
cttcctaccaaatataaacttg

SEQ ID NO: 2292724 - DNA, 23 bp, Homo sapiens
cttcctccggctggacctggggt

SEQ ID NO: 2292725 - DNA, 18 bp, Homo sapiens
cttcctcctgacacccca

SEQ ID NO: 2292726 - DNA, 19 bp, Homo sapiens
cttcctgctacagtagctg

SEQ ID NO: 2292727 - DNA, 16 bp, Homo sapiens
cttcctgttctgtgtc

SEQ ID NO: 2292728 - DNA, 21 bp, Homo sapiens
cttcctgttctgtgtctgctg

SEQ ID NO: 2292729 - DNA, 23 bp, Homo sapiens
cttcctgttctgtgtctgctgta

SEQ ID NO: 2292730 - DNA, 16 bp, Homo sapiens
cttcgaaaacagatga

SEQ ID NO: 2292731 - DNA, 21 bp, Homo sapiens
cttcgaaaacagatgagaaga

SEQ ID NO: 2292732 - DNA, 20 bp, Homo sapiens
cttcgaggagataaactgaa

SEQ ID NO: 2292733 - DNA, 22 bp, Homo sapiens
cttcgaggagataaactgaaat

SEQ ID NO: 2292734 - DNA, 17 bp, Homo sapiens
cttcgtctcagaaggct

SEQ ID NO: 2292735 - DNA, 17 bp, Homo sapiens
cttctaaagtgctggga

SEQ ID NO: 2292736 - DNA, 21 bp, Homo sapiens
cttctaagggatccagagacc

SEQ ID NO: 2292737 - DNA, 18 bp, Homo sapiens
cttctatactttctcaca

SEQ ID NO: 2292738 - DNA, 18 bp, Homo sapiens
cttctctgccctgccctg

SEQ ID NO: 2292739 - DNA, 20 bp, Homo sapiens
cttctctgccctgccctggc

SEQ ID NO: 2292740 - DNA, 17 bp, Homo sapiens
cttctgagtgaatgtta

SEQ ID NO: 2292741 - DNA, 23 bp, Homo sapiens
cttctgataagactggaaaatag

SEQ ID NO: 2292742 - DNA, 12 bp, Homo sapiens
cttctggggcca

SEQ ID NO: 2292743 - DNA, 19 bp, Homo sapiens
cttctggggccagcccctc

SEQ ID NO: 2292744 - DNA, 12 bp, Homo sapiens
cttctgttctca

SEQ ID NO: 2292745 - DNA, 14 bp, Homo sapiens
cttcttagaatgtt

SEQ ID NO: 2292746 - DNA, 16 bp, Homo sapiens
cttcttattatatata

SEQ ID NO: 2292747 - DNA, 22 bp, Homo sapiens
cttcttgcggcaccgcccaccc

SEQ ID NO: 2292748 - DNA, 15 bp, Homo sapiens
cttcttttcaaaata

SEQ ID NO: 2292749 - DNA, 14 bp, Homo sapiens
cttgaagaatattg

SEQ ID NO: 2292750 - DNA, 20 bp, Homo sapiens
cttgaatgatgccatgagga

SEQ ID NO: 2292751 - DNA, 10 bp, Homo sapiens
cttgaatgtc

SEQ ID NO: 2292752 - DNA, 20 bp, Homo sapiens
cttgaatgtccccattctat

SEQ ID NO: 2292753 - DNA, 19 bp, Homo sapiens
cttgaattgtaaggaatga

SEQ ID NO: 2292754 - DNA, 16 bp, Homo sapiens
cttgacatcaactgca

SEQ ID NO: 2292755 - DNA, 14 bp, Homo sapiens
cttgaccccacacg

SEQ ID NO: 2292756 - DNA, 24 bp, Homo sapiens
cttgaggacctccacctgggagat

SEQ ID NO: 2292757 - DNA, 15 bp, Homo sapiens
cttgaggcagggtct

SEQ ID NO: 2292758 - DNA, 18 bp, Homo sapiens
cttgagtggacagcagct

SEQ ID NO: 2292759 - DNA, 19 bp, Homo sapiens
cttgagtggacagcagctg

SEQ ID NO: 2292760 - DNA, 22 bp, Homo sapiens
cttgagtggacagcagctggac

SEQ ID NO: 2292761 - DNA, 17 bp, Homo sapiens
cttgatataattactta

SEQ ID NO: 2292762 - DNA, 20 bp, Homo sapiens
ctcgtccggcctgcagccca

SEQ ID NO: 2292763 - DNA, 22 bp, Homo sapiens
ctcgtccggcctgcagcccaga

SEQ ID NO: 2292764 - DNA, 14 bp, Homo sapiens
ctcgtctttcagcg

SEQ ID NO: 2292765 - DNA, 14 bp, Homo sapiens
ctcgtgttcgctgg

SEQ ID NO: 2292766 - DNA, 18 bp, Homo sapiens
ctcgtgttcgctggctga

SEQ ID NO: 2292767 - DNA, 16 bp, Homo sapiens
ctctaaaattctagtc

SEQ ID NO: 2292768 - DNA, 19 bp, Homo sapiens
ctctaaacccaaataaatg

SEQ ID NO: 2292769 - DNA, 18 bp, Homo sapiens
ctctaatagaagtccatg

SEQ ID NO: 2292770 - DNA, 14 bp, Homo sapiens
ctctaggcctcagt

SEQ ID NO: 2292771 - DNA, 13 bp, Homo sapiens
ctctatatataca

SEQ ID NO: 2292772 - DNA, 20 bp, Homo sapiens
ctctatatatacatgtatag

SEQ ID NO: 2292773 - DNA, 21 bp, Homo sapiens
ctctatatatacatgtatagt

SEQ ID NO: 2292774 - DNA, 13 bp, Homo sapiens
ctctatctgctgg

SEQ ID NO: 2292775 - DNA, 14 bp, Homo sapiens
ctctatctgctggg

SEQ ID NO: 2292776 - DNA, 15 bp, Homo sapiens
ctctatctgctgggc

SEQ ID NO: 2292777 - DNA, 18 bp, Homo sapiens
ctctatctgctgggctgg

SEQ ID NO: 2292778 - DNA, 13 bp, Homo sapiens
ctctcaccagcct

SEQ ID NO: 2292779 - DNA, 22 bp, Homo sapiens
ctctcagatccctcggtcagca

SEQ ID NO: 2292780 - DNA, 23 bp, Homo sapiens
ctctcagatccctcggtcagcac

SEQ ID NO: 2292781 - DNA, 17 bp, Homo sapiens
ctctccaggcaccgcct

SEQ ID NO: 2292782 - DNA, 19 bp, Homo sapiens
ctctccaggcaccgcctgc

SEQ ID NO: 2292783 - DNA, 20 bp, Homo sapiens
ctctcccctgcgcaggccct

SEQ ID NO: 2292784 - DNA, 17 bp, Homo sapiens
ctctcctcgtccggcct

SEQ ID NO: 2292785 - DNA, 22 bp, Homo sapiens
ctctcctgcgtgtgcccactga

SEQ ID NO: 2292786 - DNA, 17 bp, Homo sapiens
ctctcctgggccagggt

SEQ ID NO: 2292787 - DNA, 11 bp, Homo sapiens
ctctccttttc

SEQ ID NO: 2292788 - DNA, 21 bp, Homo sapiens
ctctcgcctcaggctttttcc

SEQ ID NO: 2292789 - DNA, 16 bp, Homo sapiens
ctctctatatatacat

SEQ ID NO: 2292790 - DNA, 20 bp, Homo sapiens
ctctctctatatatacatgt

SEQ ID NO: 2292791 - DNA, 22 bp, Homo sapiens
ctctcttctgcacagctcctcc

SEQ ID NO: 2292792 - DNA, 15 bp, Homo sapiens
ctctcttttttgggg

SEQ ID NO: 2292793 - DNA, 15 bp, Homo sapiens
ctctgaactgctgct

SEQ ID NO: 2292794 - DNA, 19 bp, Homo sapiens
ctctgaactgctgctggtc

SEQ ID NO: 2292795 - DNA, 13 bp, Homo sapiens
ctctgaagggagg

SEQ ID NO: 2292796 - DNA, 12 bp, Homo sapiens
ctctgagcagtg

SEQ ID NO: 2292797 - DNA, 22 bp, Homo sapiens
ctctgatatacaattagagata

SEQ ID NO: 2292798 - DNA, 19 bp, Homo sapiens
ctctgatcacaacttttct

SEQ ID NO: 2292799 - DNA, 14 bp, Homo sapiens
ctctgcagcctgag

SEQ ID NO: 2292800 - DNA, 15 bp, Homo sapiens
ctctgcagcctgagc

SEQ ID NO: 2292801 - DNA, 23 bp, Homo sapiens
ctctgcataagattatatacaaa

SEQ ID NO: 2292802 - DNA, 13 bp, Homo sapiens
ctctgccatcagc

SEQ ID NO: 2292803 - DNA, 14 bp, Homo sapiens
ctctgccatcagcc

SEQ ID NO: 2292804 - DNA, 16 bp, Homo sapiens
ctctgccatcagcccc

SEQ ID NO: 2292805 - DNA, 21 bp, Homo sapiens
ctctgccccctcccccgcaga

SEQ ID NO: 2292806 - DNA, 13 bp, Homo sapiens
ctctgcccctccg

SEQ ID NO: 2292807 - DNA, 21 bp, Homo sapiens
ctctgcccctccgtccccagg

SEQ ID NO: 2292808 - DNA, 22 bp, Homo sapiens
ctctgcccctccgtccccaggg

SEQ ID NO: 2292809 - DNA, 14 bp, Homo sapiens
ctctgccttccagg

SEQ ID NO: 2292810 - DNA, 17 bp, Homo sapiens
ctctgccttccaggcgt

SEQ ID NO: 2292811 - DNA, 17 bp, Homo sapiens
ctctgcgtcccactgag

SEQ ID NO: 2292812 - DNA, 15 bp, Homo sapiens
ctctgctcagggccg

SEQ ID NO: 2292813 - DNA, 16 bp, Homo sapiens
ctctgctcagggccgc

SEQ ID NO: 2292814 - DNA, 23 bp, Homo sapiens
ctctggaaccatcctctgttacc

SEQ ID NO: 2292815 - DNA, 19 bp, Homo sapiens
ctctggaattgttgaatgt

SEQ ID NO: 2292816 - DNA, 23 bp, Homo sapiens
ctctggcaggtggccagggctcc

SEQ ID NO: 2292817 - DNA, 19 bp, Homo sapiens
ctctggctgactaaatttg

SEQ ID NO: 2292818 - DNA, 21 bp, Homo sapiens
ctctgggttttgggatttggg

SEQ ID NO: 2292819 - DNA, 19 bp, Homo sapiens
ctctgtgactcgcttagct

SEQ ID NO: 2292820 - DNA, 22 bp, Homo sapiens
ctctgttgaccaggctggagtg

SEQ ID NO: 2292821 - DNA, 13 bp, Homo sapiens
ctcttaagacact

SEQ ID NO: 2292822 - DNA, 17 bp, Homo sapiens
ctcttatccccagctgt

SEQ ID NO: 2292823 - DNA, 23 bp, Homo sapiens
ctcttcagaatatggacaaagaa

SEQ ID NO: 2292824 - DNA, 14 bp, Homo sapiens
ctcttccagcccag

SEQ ID NO: 2292825 - DNA, 23 bp, Homo sapiens
ctcttcctcctgacaccccactt

SEQ ID NO: 2292826 - DNA, 16 bp, Homo sapiens
ctcttctccctttcct

SEQ ID NO: 2292827 - DNA, 13 bp, Homo sapiens
ctcttcttagcct

SEQ ID NO: 2292828 - DNA, 14 bp, Homo sapiens
ctcttcttatcaca

SEQ ID NO: 2292829 - DNA, 12 bp, Homo sapiens
ctcttggacttg

SEQ ID NO: 2292830 - DNA, 14 bp, Homo sapiens
ctcttggcaggagt

SEQ ID NO: 2292831 - DNA, 11 bp, Homo sapiens
ctcttggcctc

SEQ ID NO: 2292832 - DNA, 12 bp, Homo sapiens
ctcttggcctca

SEQ ID NO: 2292833 - DNA, 21 bp, Homo sapiens
ctcttggggaaggatctcccc

SEQ ID NO: 2292834 - DNA, 17 bp, Homo sapiens
ctctttctcattcttgc

SEQ ID NO: 2292835 - DNA, 17 bp, Homo sapiens
ctctttgaaaattcttg

SEQ ID NO: 2292836 - DNA, 16 bp, Homo sapiens
ctcttttttgggggga

SEQ ID NO: 2292837 - DNA, 23 bp, Homo sapiens
ctgaaaacagtaaaacaggctgc

SEQ ID NO: 2292838 - DNA, 24 bp, Homo sapiens
ctgaaaacagtaaaacaggctgct

SEQ ID NO: 2292839 - DNA, 20 bp, Homo sapiens
ctgaaaatatttttttctag

SEQ ID NO: 2292840 - DNA, 12 bp, Homo sapiens
ctgaaacacttt

SEQ ID NO: 2292841 - DNA, 22 bp, Homo sapiens
ctgaaactggttttaagtgctt

SEQ ID NO: 2292842 - DNA, 13 bp, Homo sapiens
ctgaaataaaact

SEQ ID NO: 2292843 - DNA, 15 bp, Homo sapiens
ctgaaatttgctata

SEQ ID NO: 2292844 - DNA, 18 bp, Homo sapiens
ctgaacgacagtcccagt

SEQ ID NO: 2292845 - DNA, 20 bp, Homo sapiens
ctgaacgacagtcccagttc

SEQ ID NO: 2292846 - DNA, 19 bp, Homo sapiens
ctgaagaattgaaaaacca

SEQ ID NO: 2292847 - DNA, 12 bp, Homo sapiens
ctgaagatctca

SEQ ID NO: 2292848 - DNA, 23 bp, Homo sapiens
ctgaaggaattctggagtgagtt

SEQ ID NO: 2292849 - DNA, 16 bp, Homo sapiens
ctgaagggaggggaag

SEQ ID NO: 2292850 - DNA, 20 bp, Homo sapiens
ctgaatcaaagacatttcat

SEQ ID NO: 2292851 - DNA, 21 bp, Homo sapiens
ctgaatcaaagacatttcatc

SEQ ID NO: 2292852 - DNA, 22 bp, Homo sapiens
ctgaatcaaagacatttcatcc

SEQ ID NO: 2292853 - DNA, 15 bp, Homo sapiens
ctgaattgttatgta

SEQ ID NO: 2292854 - DNA, 15 bp, Homo sapiens
ctgaatttaactact

SEQ ID NO: 2292855 - DNA, 11 bp, Homo sapiens
ctgacaaagtc

SEQ ID NO: 2292856 - DNA, 14 bp, Homo sapiens
ctgacaccccactt

SEQ ID NO: 2292857 - DNA, 13 bp, Homo sapiens
ctgacacctgccg

SEQ ID NO: 2292858 - DNA, 12 bp, Homo sapiens
ctgacagagccc

SEQ ID NO: 2292859 - DNA, 23 bp, Homo sapiens
ctgaccaaaggaaggcacccttg

SEQ ID NO: 2292860 - DNA, 14 bp, Homo sapiens
ctgacctacttcct

SEQ ID NO: 2292861 - DNA, 13 bp, Homo sapiens
ctgacctgccccc

SEQ ID NO: 2292862 - DNA, 24 bp, Homo sapiens
ctgacctgcccccgctctgccatc

SEQ ID NO: 2292863 - DNA, 13 bp, Homo sapiens
ctgacttcccagc

SEQ ID NO: 2292864 - DNA, 18 bp, Homo sapiens
ctgacttcccagctggca

SEQ ID NO: 2292865 - DNA, 22 bp, Homo sapiens
ctgacttcccagctggcagcgc

SEQ ID NO: 2292866 - DNA, 24 bp, Homo sapiens
ctgacttcccagctggcagcgcct

SEQ ID NO: 2292867 - DNA, 14 bp, Homo sapiens
ctgagaccacagag

SEQ ID NO: 2292868 - DNA, 21 bp, Homo sapiens
ctgagactcgcgacaatgcaa

SEQ ID NO: 2292869 - DNA, 22 bp, Homo sapiens
ctgagactcgcgacaatgcaaa

SEQ ID NO: 2292870 - DNA, 17 bp, Homo sapiens
ctgagagtagagtcact

SEQ ID NO: 2292871 - DNA, 21 bp, Homo sapiens
ctgagataagtaggctggttt

SEQ ID NO: 2292872 - DNA, 19 bp, Homo sapiens
ctgagccagatttcactct

SEQ ID NO: 2292873 - DNA, 20 bp, Homo sapiens
ctgagccagatttcactctc

SEQ ID NO: 2292874 - DNA, 21 bp, Homo sapiens
ctgagccagatttcactctcc

SEQ ID NO: 2292875 - DNA, 14 bp, Homo sapiens
ctgagctccaccct

SEQ ID NO: 2292876 - DNA, 15 bp, Homo sapiens
ctgagctccaccctc

SEQ ID NO: 2292877 - DNA, 13 bp, Homo sapiens
ctgagctctgacc

SEQ ID NO: 2292878 - DNA, 15 bp, Homo sapiens
ctgaggacggggcag

SEQ ID NO: 2292879 - DNA, 19 bp, Homo sapiens
ctgaggacggggcagagct

SEQ ID NO: 2292880 - DNA, 15 bp, Homo sapiens
ctgaggagtgatggg

SEQ ID NO: 2292881 - DNA, 20 bp, Homo sapiens
ctgaggagtgatgggcaagg

SEQ ID NO: 2292882 - DNA, 15 bp, Homo sapiens
ctgaggcaggagggc

SEQ ID NO: 2292883 - DNA, 17 bp, Homo sapiens
ctgaggcaggagggcat

SEQ ID NO: 2292884 - DNA, 13 bp, Homo sapiens
ctgaggctggggc

SEQ ID NO: 2292885 - DNA, 14 bp, Homo sapiens
ctgaggctggggct

SEQ ID NO: 2292886 - DNA, 19 bp, Homo sapiens
ctgagggaagagtagctgt

SEQ ID NO: 2292887 - DNA, 17 bp, Homo sapiens
ctgagggaagcccaccc

SEQ ID NO: 2292888 - DNA, 20 bp, Homo sapiens
ctgagggaagcccacccgcc

SEQ ID NO: 2292889 - DNA, 23 bp, Homo sapiens
ctgaggtccgatggcccgagagc

SEQ ID NO: 2292890 - DNA, 16 bp, Homo sapiens
ctgagtagctgggact

SEQ ID NO: 2292891 - DNA, 16 bp, Homo sapiens
ctgagtcggctgggca

SEQ ID NO: 2292892 - DNA, 22 bp, Homo sapiens
ctgagtcggctgggcagggccg

SEQ ID NO: 2292893 - DNA, 17 bp, Homo sapiens
ctgagtggtccacattc

SEQ ID NO: 2292894 - DNA, 17 bp, Homo sapiens
ctgatctctcgtgattg

SEQ ID NO: 2292895 - DNA, 18 bp, Homo sapiens
ctgatctctcgtgattga

SEQ ID NO: 2292896 - DNA, 14 bp, Homo sapiens
ctgatgagatacat

SEQ ID NO: 2292897 - DNA, 18 bp, Homo sapiens
ctgatgagatacatttga

SEQ ID NO: 2292898 - DNA, 16 bp, Homo sapiens
ctgatgatataaacaa

SEQ ID NO: 2292899 - DNA, 16 bp, Homo sapiens
ctgatgggtcctgctg

SEQ ID NO: 2292900 - DNA, 14 bp, Homo sapiens
ctgatggtgcaatg

SEQ ID NO: 2292901 - DNA, 17 bp, Homo sapiens
ctgatggtgcaatgacc

SEQ ID NO: 2292902 - DNA, 20 bp, Homo sapiens
ctgatggtgcaatgaccttt

SEQ ID NO: 2292903 - DNA, 18 bp, Homo sapiens
ctgatgtatagctttaac

SEQ ID NO: 2292904 - DNA, 22 bp, Homo sapiens
ctgatgtatagctttaacattt

SEQ ID NO: 2292905 - DNA, 13 bp, Homo sapiens
ctgattctatgcc

SEQ ID NO: 2292906 - DNA, 21 bp, Homo sapiens
ctgattctatgcctgtatttc

SEQ ID NO: 2292907 - DNA, 16 bp, Homo sapiens
ctgatttcaaatgcag

SEQ ID NO: 2292908 - DNA, 16 bp, Homo sapiens
ctgatttgcaaatgca

SEQ ID NO: 2292909 - DNA, 16 bp, Homo sapiens
ctgattttaaaacttt

SEQ ID NO: 2292910 - DNA, 18 bp, Homo sapiens
ctgcaaacaaacaccttc

SEQ ID NO: 2292911 - DNA, 15 bp, Homo sapiens
ctgcaaggcaaagta

SEQ ID NO: 2292912 - DNA, 12 bp, Homo sapiens
ctgcaataacag

SEQ ID NO: 2292913 - DNA, 13 bp, Homo sapiens
ctgcaataacagt

SEQ ID NO: 2292914 - DNA, 14 bp, Homo sapiens
ctgcaataacagtt

SEQ ID NO: 2292915 - DNA, 16 bp, Homo sapiens
ctgcaataacagtttt

SEQ ID NO: 2292916 - DNA, 12 bp, Homo sapiens
ctgcacagggtc

SEQ ID NO: 2292917 - DNA, 20 bp, Homo sapiens
ctgcacctctcttctgcaca

SEQ ID NO: 2292918 - DNA, 22 bp, Homo sapiens
ctgcaccttcactctccagggt

SEQ ID NO: 2292919 - DNA, 22 bp, Homo sapiens
ctgcactgggaatttatttatg

SEQ ID NO: 2292920 - DNA, 23 bp, Homo sapiens
ctgcactgggaatttatttatgt

SEQ ID NO: 2292921 - DNA, 22 bp, Homo sapiens
ctgcagcccagaacgggcctcc

SEQ ID NO: 2292922 - DNA, 18 bp, Homo sapiens
ctgcagcctcgacctccc

SEQ ID NO: 2292923 - DNA, 22 bp, Homo sapiens
ctgcagcctcgacctccctggc

SEQ ID NO: 2292924 - DNA, 23 bp, Homo sapiens
ctgcagcctcgacctccctggct

SEQ ID NO: 2292925 - DNA, 22 bp, Homo sapiens
ctgcagcctgagctccaccctc

SEQ ID NO: 2292926 - DNA, 21 bp, Homo sapiens
ctgcagtattctgtagccaac

SEQ ID NO: 2292927 - DNA, 14 bp, Homo sapiens
ctgcagtgttattt

SEQ ID NO: 2292928 - DNA, 20 bp, Homo sapiens
ctgcatatcctggtgtctag

SEQ ID NO: 2292929 - DNA, 14 bp, Homo sapiens
ctgcatttaagaac

SEQ ID NO: 2292930 - DNA, 18 bp, Homo sapiens
ctgcatttaagaacagaa

SEQ ID NO: 2292931 - DNA, 20 bp, Homo sapiens
ctgccaaataaaatgtttac

SEQ ID NO: 2292932 - DNA, 20 bp, Homo sapiens
ctgccaccctctgctgcaca

SEQ ID NO: 2292933 - DNA, 16 bp, Homo sapiens
ctgccacttgaacaaa

SEQ ID NO: 2292934 - DNA, 16 bp, Homo sapiens
ctgccatcagaaattt

SEQ ID NO: 2292935 - DNA, 16 bp, Homo sapiens
ctgcccaccctgggcc

SEQ ID NO: 2292936 - DNA, 23 bp, Homo sapiens
ctgcccaccctgggcctcccgtc

SEQ ID NO: 2292937 - DNA, 16 bp, Homo sapiens
ctgcccagatgtttta

SEQ ID NO: 2292938 - DNA, 14 bp, Homo sapiens
ctgcccagttagcc

SEQ ID NO: 2292939 - DNA, 21 bp, Homo sapiens
ctgcccagttagcccggccaa

SEQ ID NO: 2292940 - DNA, 15 bp, Homo sapiens
ctgcccccacagatc

SEQ ID NO: 2292941 - DNA, 18 bp, Homo sapiens
ctgcccccacagatccat

SEQ ID NO: 2292942 - DNA, 14 bp, Homo sapiens
ctgcccccaccctg

SEQ ID NO: 2292943 - DNA, 17 bp, Homo sapiens
ctgcccccaccctgctt

SEQ ID NO: 2292944 - DNA, 22 bp, Homo sapiens
ctgcccccagcgtgggggtggc

SEQ ID NO: 2292945 - DNA, 12 bp, Homo sapiens
ctgccccctccc

SEQ ID NO: 2292946 - DNA, 13 bp, Homo sapiens
ctgccccctcctt

SEQ ID NO: 2292947 - DNA, 17 bp, Homo sapiens
ctgccccggcccaacct

SEQ ID NO: 2292948 - DNA, 19 bp, Homo sapiens
ctgcccctccgtccccagg

SEQ ID NO: 2292949 - DNA, 18 bp, Homo sapiens
ctgcccctgctactgcca

SEQ ID NO: 2292950 - DNA, 17 bp, Homo sapiens
ctgccccttgaccccac

SEQ ID NO: 2292951 - DNA, 22 bp, Homo sapiens
ctgccccttgaccccacacgcc

SEQ ID NO: 2292952 - DNA, 15 bp, Homo sapiens
ctgccctcccccacg

SEQ ID NO: 2292953 - DNA, 18 bp, Homo sapiens
ctgccctcccccacggcc

SEQ ID NO: 2292954 - DNA, 12 bp, Homo sapiens
ctgccctgccct

SEQ ID NO: 2292955 - DNA, 14 bp, Homo sapiens
ctgccctgccctgg

SEQ ID NO: 2292956 - DNA, 18 bp, Homo sapiens
ctgccctggccactggcc

SEQ ID NO: 2292957 - DNA, 17 bp, Homo sapiens
ctgccgacggagccact

SEQ ID NO: 2292958 - DNA, 16 bp, Homo sapiens
ctgccgctgcccccac

SEQ ID NO: 2292959 - DNA, 18 bp, Homo sapiens
ctgccgtgcacggggcca

SEQ ID NO: 2292960 - DNA, 22 bp, Homo sapiens
ctgcctagaaacagacctgcat

SEQ ID NO: 2292961 - DNA, 12 bp, Homo sapiens
ctgcctccaagt

SEQ ID NO: 2292962 - DNA, 14 bp, Homo sapiens
ctgcctcctcagca

SEQ ID NO: 2292963 - DNA, 16 bp, Homo sapiens
ctgcctctgaaaatat

SEQ ID NO: 2292964 - DNA, 22 bp, Homo sapiens
ctgcctctgaactgctgctggt

SEQ ID NO: 2292965 - DNA, 13 bp, Homo sapiens
ctgcctgcagctg

SEQ ID NO: 2292966 - DNA, 16 bp, Homo sapiens
ctgcctgcagctgaga

SEQ ID NO: 2292967 - DNA, 18 bp, Homo sapiens
ctgcctgcagctgagatt

SEQ ID NO: 2292968 - DNA, 16 bp, Homo sapiens
ctgcctggcggcaggg

SEQ ID NO: 2292969 - DNA, 16 bp, Homo sapiens
ctgcctggcgggcagc

SEQ ID NO: 2292970 - DNA, 20 bp, Homo sapiens
ctgcctggcgggcagcccct

SEQ ID NO: 2292971 - DNA, 16 bp, Homo sapiens
ctgcctgtgagtgaca

SEQ ID NO: 2292972 - DNA, 22 bp, Homo sapiens
ctgcctgtttggggaggggggc

SEQ ID NO: 2292973 - DNA, 13 bp, Homo sapiens
ctgccttccaggc

SEQ ID NO: 2292974 - DNA, 18 bp, Homo sapiens
ctgcctttgtgctctgtt

SEQ ID NO: 2292975 - DNA, 19 bp, Homo sapiens
ctgcgaccacaagaaggat

SEQ ID NO: 2292976 - DNA, 19 bp, Homo sapiens
ctgcgcaaagggcgggcct

SEQ ID NO: 2292977 - DNA, 22 bp, Homo sapiens
ctgcgcaaagggcgggcctgtt

SEQ ID NO: 2292978 - DNA, 23 bp, Homo sapiens
ctgcggaatcttcttactaagct

SEQ ID NO: 2292979 - DNA, 20 bp, Homo sapiens
ctgcggatactcttggagag

SEQ ID NO: 2292980 - DNA, 13 bp, Homo sapiens
ctgcgtggcctgg

SEQ ID NO: 2292981 - DNA, 21 bp, Homo sapiens
ctgctaagtggaagacagaga

SEQ ID NO: 2292982 - DNA, 20 bp, Homo sapiens
ctgctacctggttttcatta

SEQ ID NO: 2292983 - DNA, 22 bp, Homo sapiens
ctgctacctggttttcattatt

SEQ ID NO: 2292984 - DNA, 21 bp, Homo sapiens
ctgctcaggctccccaagact

SEQ ID NO: 2292985 - DNA, 14 bp, Homo sapiens
ctgctcagggccgc

SEQ ID NO: 2292986 - DNA, 13 bp, Homo sapiens
ctgctccagatcc

SEQ ID NO: 2292987 - DNA, 14 bp, Homo sapiens
ctgctccagatcct

SEQ ID NO: 2292988 - DNA, 17 bp, Homo sapiens
ctgctcctcggccagag

SEQ ID NO: 2292989 - DNA, 20 bp, Homo sapiens
ctgctcctcggccagagctc

SEQ ID NO: 2292990 - DNA, 23 bp, Homo sapiens
ctgctcctcggccagagctccca

SEQ ID NO: 2292991 - DNA, 15 bp, Homo sapiens
ctgctcctgtggcct

SEQ ID NO: 2292992 - DNA, 15 bp, Homo sapiens
ctgctcgggaaggcc

SEQ ID NO: 2292993 - DNA, 20 bp, Homo sapiens
ctgctcgggaaggcctgagg

SEQ ID NO: 2292994 - DNA, 21 bp, Homo sapiens
ctgctcgggaaggcctgaggg

SEQ ID NO: 2292995 - DNA, 17 bp, Homo sapiens
ctgctctgtgcactcac

SEQ ID NO: 2292996 - DNA, 17 bp, Homo sapiens
ctgctgcacagtagtgt

SEQ ID NO: 2292997 - DNA, 20 bp, Homo sapiens
ctgctgcacagtagtgttgg

SEQ ID NO: 2292998 - DNA, 21 bp, Homo sapiens
ctgctgcccccagaccccatc

SEQ ID NO: 2292999 - DNA, 12 bp, Homo sapiens
ctgctgcctcca

SEQ ID NO: 2293000 - DNA, 13 bp, Homo sapiens
ctgctgcctccaa

SEQ ID NO: 2293001 - DNA, 14 bp, Homo sapiens
ctgctgcctccaag

SEQ ID NO: 2293002 - DNA, 20 bp, Homo sapiens
ctgctgcctgtttggggagg

SEQ ID NO: 2293003 - DNA, 14 bp, Homo sapiens
ctgctgctcctcgg

SEQ ID NO: 2293004 - DNA, 18 bp, Homo sapiens
ctgctgctcctcggccag

SEQ ID NO: 2293005 - DNA, 20 bp, Homo sapiens
ctgctgctcctcggccagag

SEQ ID NO: 2293006 - DNA, 21 bp, Homo sapiens
ctgctgctcgggaaggcctga

SEQ ID NO: 2293007 - DNA, 22 bp, Homo sapiens
ctgctgctcgggaaggcctgag

SEQ ID NO: 2293008 - DNA, 19 bp, Homo sapiens
ctgctggaccaaggtgcgg

SEQ ID NO: 2293009 - DNA, 14 bp, Homo sapiens
ctgctgggctggcg

SEQ ID NO: 2293010 - DNA, 20 bp, Homo sapiens
ctgctgtaagacggccttgg

SEQ ID NO: 2293011 - DNA, 21 bp, Homo sapiens
ctgctgtaagacggccttgga

SEQ ID NO: 2293012 - DNA, 22 bp, Homo sapiens
ctgctgtaagacggccttggac

SEQ ID NO: 2293013 - DNA, 18 bp, Homo sapiens
ctgctgtagcaacagagc

SEQ ID NO: 2293014 - DNA, 17 bp, Homo sapiens
ctgctgttttatgtcat

SEQ ID NO: 2293015 - DNA, 16 bp, Homo sapiens
ctgcttcaaggatcct

SEQ ID NO: 2293016 - DNA, 14 bp, Homo sapiens
ctgcttccagtgga

SEQ ID NO: 2293017 - DNA, 13 bp, Homo sapiens
ctgcttcctagta

SEQ ID NO: 2293018 - DNA, 18 bp, Homo sapiens
ctgcttgagtggacagca

SEQ ID NO: 2293019 - DNA, 17 bp, Homo sapiens
ctgctttattgcctctg

SEQ ID NO: 2293020 - DNA, 12 bp, Homo sapiens
ctgcttttgcat

SEQ ID NO: 2293021 - DNA, 16 bp, Homo sapiens
ctggaaccatcctctg

SEQ ID NO: 2293022 - DNA, 16 bp, Homo sapiens
ctggaagaacccttct

SEQ ID NO: 2293023 - DNA, 16 bp, Homo sapiens
ctggaattgttgaatg

SEQ ID NO: 2293024 - DNA, 19 bp, Homo sapiens
ctggaattgttgaatgtat

SEQ ID NO: 2293025 - DNA, 22 bp, Homo sapiens
ctggacaggcttcgtctcagaa

SEQ ID NO: 2293026 - DNA, 16 bp, Homo sapiens
ctggacctggggtccc

SEQ ID NO: 2293027 - DNA, 20 bp, Homo sapiens
ctggacctggggtcccccct

SEQ ID NO: 2293028 - DNA, 21 bp, Homo sapiens
ctggacctggggtcccccctc

SEQ ID NO: 2293029 - DNA, 17 bp, Homo sapiens
ctggactctgtggggcc

SEQ ID NO: 2293030 - DNA, 18 bp, Homo sapiens
ctggactctgtggggcca

SEQ ID NO: 2293031 - DNA, 22 bp, Homo sapiens
ctggactgggtgggccccacag

SEQ ID NO: 2293032 - DNA, 21 bp, Homo sapiens
ctggagaaaatggacgtgtta

SEQ ID NO: 2293033 - DNA, 15 bp, Homo sapiens
ctggagaccaggact

SEQ ID NO: 2293034 - DNA, 24 bp, Homo sapiens
ctcaccagccttgaactgtggcca

SEQ ID NO: 2293035 - DNA, 18 bp, Homo sapiens
ctcacctctaggcctcag

SEQ ID NO: 2293036 - DNA, 14 bp, Homo sapiens
ctcactcagcacca

SEQ ID NO: 2293037 - DNA, 18 bp, Homo sapiens
ctcactcagcaccactca

SEQ ID NO: 2293038 - DNA, 20 bp, Homo sapiens
ctcactctgttgaccaggct

SEQ ID NO: 2293039 - DNA, 17 bp, Homo sapiens
ctcactgcctgcagctg

SEQ ID NO: 2293040 - DNA, 18 bp, Homo sapiens
ctcactgtgttgcccagg

SEQ ID NO: 2293041 - DNA, 17 bp, Homo sapiens
ctcacttaattctcatt

SEQ ID NO: 2293042 - DNA, 21 bp, Homo sapiens
ctcacttaattctcattatga

SEQ ID NO: 2293043 - DNA, 19 bp, Homo sapiens
ctcacttcagttgtggcct

SEQ ID NO: 2293044 - DNA, 20 bp, Homo sapiens
ctcacttcagttgtggcctc

SEQ ID NO: 2293045 - DNA, 21 bp, Homo sapiens
ctcacttcagttgtggcctca

SEQ ID NO: 2293046 - DNA, 15 bp, Homo sapiens
ctcagattcccccca

SEQ ID NO: 2293047 - DNA, 19 bp, Homo sapiens
ctcagattccccccatctc

SEQ ID NO: 2293048 - DNA, 21 bp, Homo sapiens
ctcagattccccccatctcca

SEQ ID NO: 2293049 - DNA, 23 bp, Homo sapiens
ctcagcaaattcttgaataaact

SEQ ID NO: 2293050 - DNA, 21 bp, Homo sapiens
ctcagcaccactcaagaccaa

SEQ ID NO: 2293051 - DNA, 22 bp, Homo sapiens
ctcagcaccactcaagaccaaa

SEQ ID NO: 2293052 - DNA, 21 bp, Homo sapiens
ctcagccgagcccaggggagg

SEQ ID NO: 2293053 - DNA, 18 bp, Homo sapiens
ctcaggctccccaagact

SEQ ID NO: 2293054 - DNA, 15 bp, Homo sapiens
ctcaggctttttcca

SEQ ID NO: 2293055 - DNA, 13 bp, Homo sapiens
ctcagtagaaagg

SEQ ID NO: 2293056 - DNA, 17 bp, Homo sapiens
ctcagtctcaaataata

SEQ ID NO: 2293057 - DNA, 20 bp, Homo sapiens
ctcagttcttggcctgctag

SEQ ID NO: 2293058 - DNA, 19 bp, Homo sapiens
ctcatatacttgaatatta

SEQ ID NO: 2293059 - DNA, 20 bp, Homo sapiens
ctcatccttctaaagtgctg

SEQ ID NO: 2293060 - DNA, 22 bp, Homo sapiens
ctcatccttctaaagtgctggg

SEQ ID NO: 2293061 - DNA, 15 bp, Homo sapiens
ctcatctccatgctc

SEQ ID NO: 2293062 - DNA, 22 bp, Homo sapiens
ctcatggtcatgggtctgccct

SEQ ID NO: 2293063 - DNA, 13 bp, Homo sapiens
ctcattcagcaga

SEQ ID NO: 2293064 - DNA, 22 bp, Homo sapiens
ctcattcagcagaatgactctg

SEQ ID NO: 2293065 - DNA, 22 bp, Homo sapiens
ctcattcctctgtccccgagcc

SEQ ID NO: 2293066 - DNA, 22 bp, Homo sapiens
ctcatttgttgttgtttttcct

SEQ ID NO: 2293067 - DNA, 14 bp, Homo sapiens
ctccaaaaagaaat

SEQ ID NO: 2293068 - DNA, 14 bp, Homo sapiens
ctccaacctggagg

SEQ ID NO: 2293069 - DNA, 14 bp, Homo sapiens
ctccaccctcccct

SEQ ID NO: 2293070 - DNA, 13 bp, Homo sapiens
ctccacctgggag

SEQ ID NO: 2293071 - DNA, 21 bp, Homo sapiens
ctccacctgggagatgctggg

SEQ ID NO: 2293072 - DNA, 22 bp, Homo sapiens
ctccacctgggagatgctggga

SEQ ID NO: 2293073 - DNA, 23 bp, Homo sapiens
ctccactgtcataatctctttcc

SEQ ID NO: 2293074 - DNA, 15 bp, Homo sapiens
ctccagaatttccca

SEQ ID NO: 2293075 - DNA, 18 bp, Homo sapiens
ctccagaatttcccaaag

SEQ ID NO: 2293076 - DNA, 18 bp, Homo sapiens
ctccagactcgagagggc

SEQ ID NO: 2293077 - DNA, 23 bp, Homo sapiens
ctccagactcgagagggctgagc

SEQ ID NO: 2293078 - DNA, 22 bp, Homo sapiens
ctccagatcctctttccccact

SEQ ID NO: 2293079 - DNA, 14 bp, Homo sapiens
ctccagattatttt

SEQ ID NO: 2293080 - DNA, 16 bp, Homo sapiens
ctccagattattttct

SEQ ID NO: 2293081 - DNA, 17 bp, Homo sapiens
ctccagattattttcta

SEQ ID NO: 2293082 - DNA, 21 bp, Homo sapiens
ctccagattattttctatatt

SEQ ID NO: 2293083 - DNA, 23 bp, Homo sapiens
ctccagattattttctatatttg

SEQ ID NO: 2293084 - DNA, 14 bp, Homo sapiens
ctccagatttttaa

SEQ ID NO: 2293085 - DNA, 16 bp, Homo sapiens
ctccagatttttaata

SEQ ID NO: 2293086 - DNA, 21 bp, Homo sapiens
ctccagccaatttcaaagaaa

SEQ ID NO: 2293087 - DNA, 16 bp, Homo sapiens
ctccagctcctgcccc

SEQ ID NO: 2293088 - DNA, 19 bp, Homo sapiens
ctccagctcctgccccgcc

SEQ ID NO: 2293089 - DNA, 19 bp, Homo sapiens
ctccaggaggactgttcta

SEQ ID NO: 2293090 - DNA, 18 bp, Homo sapiens
ctccaggcaccgcctgcc

SEQ ID NO: 2293091 - DNA, 17 bp, Homo sapiens
ctccaggggctggggac

SEQ ID NO: 2293092 - DNA, 16 bp, Homo sapiens
ctccagggtacatgct

SEQ ID NO: 2293093 - DNA, 17 bp, Homo sapiens
ctccataggagggaagg

SEQ ID NO: 2293094 - DNA, 13 bp, Homo sapiens
ctccatccacaca

SEQ ID NO: 2293095 - DNA, 21 bp, Homo sapiens
ctccatctcttgtaccagccc

SEQ ID NO: 2293096 - DNA, 22 bp, Homo sapiens
ctccatctcttgtaccagccca

SEQ ID NO: 2293097 - DNA, 22 bp, Homo sapiens
ctccatgctctttcaccctgcc

SEQ ID NO: 2293098 - DNA, 12 bp, Homo sapiens
ctcccagggccc

SEQ ID NO: 2293099 - DNA, 16 bp, Homo sapiens
ctcccagggcccgagc

SEQ ID NO: 2293100 - DNA, 23 bp, Homo sapiens
ctcccagggcccgagcgcgtgcc

SEQ ID NO: 2293101 - DNA, 16 bp, Homo sapiens
ctcccccaggctgcgc

SEQ ID NO: 2293102 - DNA, 13 bp, Homo sapiens
ctcccccagggag

SEQ ID NO: 2293103 - DNA, 15 bp, Homo sapiens
ctcccccgcagacag

SEQ ID NO: 2293104 - DNA, 19 bp, Homo sapiens
ctccccgcccgccctcctc

SEQ ID NO: 2293105 - DNA, 22 bp, Homo sapiens
ctccccgcccgccctcctctgc

SEQ ID NO: 2293106 - DNA, 23 bp, Homo sapiens
ctccccgccgtacagttctccag

SEQ ID NO: 2293107 - DNA, 17 bp, Homo sapiens
ctccccgcctcctccct

SEQ ID NO: 2293108 - DNA, 18 bp, Homo sapiens
ctccccgcctcctccctg

SEQ ID NO: 2293109 - DNA, 17 bp, Homo sapiens
ctcccgccccagcctcc

SEQ ID NO: 2293110 - DNA, 18 bp, Homo sapiens
ctcccgccccagcctcct

SEQ ID NO: 2293111 - DNA, 22 bp, Homo sapiens
ctcccgccgcctcgggccgcct

SEQ ID NO: 2293112 - DNA, 17 bp, Homo sapiens
ctcccgcttcctccggc

SEQ ID NO: 2293113 - DNA, 19 bp, Homo sapiens
ctcccgcttcctccggctg

SEQ ID NO: 2293114 - DNA, 20 bp, Homo sapiens
ctcccgcttcctccggctgg

SEQ ID NO: 2293115 - DNA, 19 bp, Homo sapiens
ctcccggtgtatgcagtgg

SEQ ID NO: 2293116 - DNA, 13 bp, Homo sapiens
ctccctgcctggc

SEQ ID NO: 2293117 - DNA, 22 bp, Homo sapiens
ctccctggactctgtggggcca

SEQ ID NO: 2293118 - DNA, 22 bp, Homo sapiens
ctccctttcctttcccagaaaa

SEQ ID NO: 2293119 - DNA, 17 bp, Homo sapiens
ctccgactccccctccc

SEQ ID NO: 2293120 - DNA, 14 bp, Homo sapiens
ctccggcagaggca

SEQ ID NO: 2293121 - DNA, 17 bp, Homo sapiens
ctccggcagaggcaggg

SEQ ID NO: 2293122 - DNA, 21 bp, Homo sapiens
ctccggcagaggcagggccct

SEQ ID NO: 2293123 - DNA, 15 bp, Homo sapiens
ctccgtccccagggt

SEQ ID NO: 2293124 - DNA, 19 bp, Homo sapiens
ctcctagcaaccaacttta

SEQ ID NO: 2293125 - DNA, 21 bp, Homo sapiens
ctcctccagactcgagagggc

SEQ ID NO: 2293126 - DNA, 19 bp, Homo sapiens
ctcctccagctcctgcccc

SEQ ID NO: 2293127 - DNA, 14 bp, Homo sapiens
ctcctcccccacgc

SEQ ID NO: 2293128 - DNA, 18 bp, Homo sapiens
ctcctcccccacgcctcc

SEQ ID NO: 2293129 - DNA, 15 bp, Homo sapiens
ctcctcccctctcct

SEQ ID NO: 2293130 - DNA, 17 bp, Homo sapiens
ctcctcccctgctacct

SEQ ID NO: 2293131 - DNA, 13 bp, Homo sapiens
ctcctcggccaga

SEQ ID NO: 2293132 - DNA, 15 bp, Homo sapiens
ctcctcggccagagc

SEQ ID NO: 2293133 - DNA, 19 bp, Homo sapiens
ctcctcggctggctgtcca

SEQ ID NO: 2293134 - DNA, 23 bp, Homo sapiens
ctcctcgggcgcctgcgctcctc

SEQ ID NO: 2293135 - DNA, 17 bp, Homo sapiens
ctcctcgtccggcctgc

SEQ ID NO: 2293136 - DNA, 19 bp, Homo sapiens
ctcctcgtccggcctgcag

SEQ ID NO: 2293137 - DNA, 21 bp, Homo sapiens
ctcctcgtccggcctgcagcc

SEQ ID NO: 2293138 - DNA, 21 bp, Homo sapiens
ctcctctcctcgtccggcctg

SEQ ID NO: 2293139 - DNA, 16 bp, Homo sapiens
ctcctgacaccccact

SEQ ID NO: 2293140 - DNA, 18 bp, Homo sapiens
ctcctgagtagctgggac

SEQ ID NO: 2293141 - DNA, 20 bp, Homo sapiens
ctcctgagtagctgggacta

SEQ ID NO: 2293142 - DNA, 13 bp, Homo sapiens
ctcctgccccgcc

SEQ ID NO: 2293143 - DNA, 16 bp, Homo sapiens
ctcctgggccagggtc

SEQ ID NO: 2293144 - DNA, 17 bp, Homo sapiens
ctcctgggccagggtct

SEQ ID NO: 2293145 - DNA, 23 bp, Homo sapiens
ctcctgggccccagaaagcctca

SEQ ID NO: 2293146 - DNA, 18 bp, Homo sapiens
ctcctgtaattttgtagt

SEQ ID NO: 2293147 - DNA, 13 bp, Homo sapiens
ctccttgctgatt

SEQ ID NO: 2293148 - DNA, 22 bp, Homo sapiens
ctccttgtcacagaatctccat

SEQ ID NO: 2293149 - DNA, 17 bp, Homo sapiens
ctcgacctccctggctt

SEQ ID NO: 2293150 - DNA, 18 bp, Homo sapiens
ctcgagagggctgagccc

SEQ ID NO: 2293151 - DNA, 21 bp, Homo sapiens
ctcgagagggctgagcccctc

SEQ ID NO: 2293152 - DNA, 22 bp, Homo sapiens
ctcgagagggctgagcccctcc

SEQ ID NO: 2293153 - DNA, 21 bp, Homo sapiens
ctcgccctctctcaccagcct

SEQ ID NO: 2293154 - DNA, 18 bp, Homo sapiens
ctcgcctcaggctttttc

SEQ ID NO: 2293155 - DNA, 13 bp, Homo sapiens
ctcgcctgaggga

SEQ ID NO: 2293156 - DNA, 16 bp, Homo sapiens
ctcggccagagctccc

SEQ ID NO: 2293157 - DNA, 19 bp, Homo sapiens
ctcggccagagctcccagg

SEQ ID NO: 2293158 - DNA, 24 bp, Homo sapiens
ctcggccagagctcccaggacgca

SEQ ID NO: 2293159 - DNA, 15 bp, Homo sapiens
ctcgggaaggcctga

SEQ ID NO: 2293160 - DNA, 14 bp, Homo sapiens
ctcgggcgcctgcg

SEQ ID NO: 2293161 - DNA, 16 bp, Homo sapiens
ctcgggcgcctgcgct

SEQ ID NO: 2293162 - DNA, 15 bp, Homo sapiens
ctcggggcaggaagt

SEQ ID NO: 2293163 - DNA, 21 bp, Homo sapiens
ctcggggcaggaagtccctga

SEQ ID NO: 2293164 - DNA, 15 bp, Homo sapiens
ctcgggtgcccagga

SEQ ID NO: 2293165 - DNA, 14 bp, Homo sapiens
ctcgtccggcctgc

SEQ ID NO: 2293166 - DNA, 15 bp, Homo sapiens
ctcgtccggcctgca

SEQ ID NO: 2293167 - DNA, 16 bp, Homo sapiens
ctcgtccggcctgcag

SEQ ID NO: 2293168 - DNA, 16 bp, Homo sapiens
cagttaatgtgccaaa

SEQ ID NO: 2293169 - DNA, 17 bp, Homo sapiens
cagttaatgtgccaaaa

SEQ ID NO: 2293170 - DNA, 18 bp, Homo sapiens
cagttagcccggccaagg

SEQ ID NO: 2293171 - DNA, 13 bp, Homo sapiens
cagttcatcccaa

SEQ ID NO: 2293172 - DNA, 16 bp, Homo sapiens
cagttctcatcttgta

SEQ ID NO: 2293173 - DNA, 17 bp, Homo sapiens
cagttcttggcctgcta

SEQ ID NO: 2293174 - DNA, 14 bp, Homo sapiens
cagttgctcattgt

SEQ ID NO: 2293175 - DNA, 17 bp, Homo sapiens
cagttgctcattgtaga

SEQ ID NO: 2293176 - DNA, 17 bp, Homo sapiens
cagttgctctctgttca

SEQ ID NO: 2293177 - DNA, 14 bp, Homo sapiens
cagttggacagtaa

SEQ ID NO: 2293178 - DNA, 19 bp, Homo sapiens
cagttgtggcctcattcag

SEQ ID NO: 2293179 - DNA, 21 bp, Homo sapiens
cagttgtggcctcattcagca

SEQ ID NO: 2293180 - DNA, 17 bp, Homo sapiens
cagttgttagtgtgtct

SEQ ID NO: 2293181 - DNA, 21 bp, Homo sapiens
cagttgttatattcattcttt

SEQ ID NO: 2293182 - DNA, 16 bp, Homo sapiens
cagtttgatattttga

SEQ ID NO: 2293183 - DNA, 15 bp, Homo sapiens
cagtttggggcaggg

SEQ ID NO: 2293184 - DNA, 14 bp, Homo sapiens
cagtttgtaaatgt

SEQ ID NO: 2293185 - DNA, 17 bp, Homo sapiens
cagtttgtaaatgttat

SEQ ID NO: 2293186 - DNA, 21 bp, Homo sapiens
cagtttgtaaatgttatttct

SEQ ID NO: 2293187 - DNA, 17 bp, Homo sapiens
cagttttcacagaggcg

SEQ ID NO: 2293188 - DNA, 14 bp, Homo sapiens
cataaaagaatgta

SEQ ID NO: 2293189 - DNA, 23 bp, Homo sapiens
cataaaagaatgtacagaaaata

SEQ ID NO: 2293190 - DNA, 17 bp, Homo sapiens
cataaaatatacaaaca

SEQ ID NO: 2293191 - DNA, 12 bp, Homo sapiens
cataaaatgcta

SEQ ID NO: 2293192 - DNA, 22 bp, Homo sapiens
cataaagtaataactgttagaa

SEQ ID NO: 2293193 - DNA, 15 bp, Homo sapiens
cataagagaaatggt

SEQ ID NO: 2293194 - DNA, 16 bp, Homo sapiens
cataagtggacccagc

SEQ ID NO: 2293195 - DNA, 17 bp, Homo sapiens
cataatatcttgaagaa

SEQ ID NO: 2293196 - DNA, 20 bp, Homo sapiens
cataatatcttgaagaatat

SEQ ID NO: 2293197 - DNA, 19 bp, Homo sapiens
cataatgatactgaattgt

SEQ ID NO: 2293198 - DNA, 22 bp, Homo sapiens
cataatgatactgaattgttat

SEQ ID NO: 2293199 - DNA, 17 bp, Homo sapiens
cataattaaattttaat

SEQ ID NO: 2293200 - DNA, 18 bp, Homo sapiens
cataattaaattttaatg

SEQ ID NO: 2293201 - DNA, 22 bp, Homo sapiens
catacctctctctatatataca

SEQ ID NO: 2293202 - DNA, 13 bp, Homo sapiens
catactctgtgta

SEQ ID NO: 2293203 - DNA, 23 bp, Homo sapiens
catactctgtgtaatctctgatt

SEQ ID NO: 2293204 - DNA, 13 bp, Homo sapiens
catactttccaac

SEQ ID NO: 2293205 - DNA, 22 bp, Homo sapiens
catactttccaacattatcctg

SEQ ID NO: 2293206 - DNA, 15 bp, Homo sapiens
catagacaagtgttt

SEQ ID NO: 2293207 - DNA, 13 bp, Homo sapiens
catagttctgcaa

SEQ ID NO: 2293208 - DNA, 20 bp, Homo sapiens
catataatttgccagacaga

SEQ ID NO: 2293209 - DNA, 19 bp, Homo sapiens
catatacatctagcacagc

SEQ ID NO: 2293210 - DNA, 17 bp, Homo sapiens
catatagtttgttttct

SEQ ID NO: 2293211 - DNA, 23 bp, Homo sapiens
catatatgagggagtatgacgtt

SEQ ID NO: 2293212 - DNA, 21 bp, Homo sapiens
catatgattgaaaagaagaaa

SEQ ID NO: 2293213 - DNA, 15 bp, Homo sapiens
catatgtgatctgtc

SEQ ID NO: 2293214 - DNA, 20 bp, Homo sapiens
catatgtgatctgtcttgta

SEQ ID NO: 2293215 - DNA, 22 bp, Homo sapiens
catatgtgatctgtcttgtaat

SEQ ID NO: 2293216 - DNA, 21 bp, Homo sapiens
catattcttgctttcacaaat

SEQ ID NO: 2293217 - DNA, 22 bp, Homo sapiens
catattgagatcagcattcaaa

SEQ ID NO: 2293218 - DNA, 18 bp, Homo sapiens
catattgttggcacagaa

SEQ ID NO: 2293219 - DNA, 22 bp, Homo sapiens
catattgttggcacagaacagg

SEQ ID NO: 2293220 - DNA, 14 bp, Homo sapiens
catatttgtagcta

SEQ ID NO: 2293221 - DNA, 16 bp, Homo sapiens
catatttttgtaaata

SEQ ID NO: 2293222 - DNA, 14 bp, Homo sapiens
catcaaatgcatgc

SEQ ID NO: 2293223 - DNA, 15 bp, Homo sapiens
catcaaatgcatgcg

SEQ ID NO: 2293224 - DNA, 14 bp, Homo sapiens
catcagaaattttc

SEQ ID NO: 2293225 - DNA, 15 bp, Homo sapiens
catcagaaattttct

SEQ ID NO: 2293226 - DNA, 13 bp, Homo sapiens
catcattgaaatc

SEQ ID NO: 2293227 - DNA, 21 bp, Homo sapiens
catcattgaaatctttttgct

SEQ ID NO: 2293228 - DNA, 14 bp, Homo sapiens
catcatttcccagg

SEQ ID NO: 2293229 - DNA, 23 bp, Homo sapiens
catccaactggaaggctttattc

SEQ ID NO: 2293230 - DNA, 16 bp, Homo sapiens
catccacaccctctcc

SEQ ID NO: 2293231 - DNA, 19 bp, Homo sapiens
catcccaaacccttcagtg

SEQ ID NO: 2293232 - DNA, 13 bp, Homo sapiens
catcccactgata

SEQ ID NO: 2293233 - DNA, 22 bp, Homo sapiens
catccccgtgttgggtggaccc

SEQ ID NO: 2293234 - DNA, 22 bp, Homo sapiens
catcccggggccatggaagctg

SEQ ID NO: 2293235 - DNA, 11 bp, Homo sapiens
catcctctgtt

SEQ ID NO: 2293236 - DNA, 20 bp, Homo sapiens
catcctgattattgaatgtt

SEQ ID NO: 2293237 - DNA, 16 bp, Homo sapiens
catccttaactgtcca

SEQ ID NO: 2293238 - DNA, 18 bp, Homo sapiens
catccttctaaagtgctg

SEQ ID NO: 2293239 - DNA, 16 bp, Homo sapiens
catccttttgcttcat

SEQ ID NO: 2293240 - DNA, 15 bp, Homo sapiens
catcggttcaggagg

SEQ ID NO: 2293241 - DNA, 13 bp, Homo sapiens
catctagcacagc

SEQ ID NO: 2293242 - DNA, 15 bp, Homo sapiens
catctagcacagctg

SEQ ID NO: 2293243 - DNA, 16 bp, Homo sapiens
catctcaaacactgct

SEQ ID NO: 2293244 - DNA, 20 bp, Homo sapiens
catctcacctctaggcctca

SEQ ID NO: 2293245 - DNA, 15 bp, Homo sapiens
catctcacttcagtt

SEQ ID NO: 2293246 - DNA, 18 bp, Homo sapiens
catctccatttcacgggc

SEQ ID NO: 2293247 - DNA, 19 bp, Homo sapiens
catctccatttcacgggca

SEQ ID NO: 2293248 - DNA, 22 bp, Homo sapiens
catctctgtagatacaggggca

SEQ ID NO: 2293249 - DNA, 12 bp, Homo sapiens
catctgaaatct

SEQ ID NO: 2293250 - DNA, 21 bp, Homo sapiens
catctgaaatctacaacataa

SEQ ID NO: 2293251 - DNA, 14 bp, Homo sapiens
catctgctcttctc

SEQ ID NO: 2293252 - DNA, 20 bp, Homo sapiens
catctgctttattgcctctg

SEQ ID NO: 2293253 - DNA, 19 bp, Homo sapiens
catctggagtccctcctcc

SEQ ID NO: 2293254 - DNA, 18 bp, Homo sapiens
catctgtatatcagctct

SEQ ID NO: 2293255 - DNA, 19 bp, Homo sapiens
catctgttgacaatttgcc

SEQ ID NO: 2293256 - DNA, 14 bp, Homo sapiens
catcttaacttggc

SEQ ID NO: 2293257 - DNA, 21 bp, Homo sapiens
catcttgaattgtaaggaatg

SEQ ID NO: 2293258 - DNA, 18 bp, Homo sapiens
catcttgtaaataatgct

SEQ ID NO: 2293259 - DNA, 20 bp, Homo sapiens
catgaagaaaaaattttaaa

SEQ ID NO: 2293260 - DNA, 17 bp, Homo sapiens
catgacacgaatattgc

SEQ ID NO: 2293261 - DNA, 18 bp, Homo sapiens
catgacacgaatattgct

SEQ ID NO: 2293262 - DNA, 21 bp, Homo sapiens
catgacacgaatattgctgat

SEQ ID NO: 2293263 - DNA, 14 bp, Homo sapiens
catgaccctggagc

SEQ ID NO: 2293264 - DNA, 14 bp, Homo sapiens
catgagattgtaca

SEQ ID NO: 2293265 - DNA, 16 bp, Homo sapiens
catgagattgtacatt

SEQ ID NO: 2293266 - DNA, 18 bp, Homo sapiens
catgatgctcatgactta

SEQ ID NO: 2293267 - DNA, 15 bp, Homo sapiens
catgattccaagggc

SEQ ID NO: 2293268 - DNA, 21 bp, Homo sapiens
catgattccaagggcccagag

SEQ ID NO: 2293269 - DNA, 22 bp, Homo sapiens
catgattccaagggcccagagg

SEQ ID NO: 2293270 - DNA, 15 bp, Homo sapiens
catgcatcctcccct

SEQ ID NO: 2293271 - DNA, 23 bp, Homo sapiens
catgcatgatgggtaaagcaata

SEQ ID NO: 2293272 - DNA, 18 bp, Homo sapiens
catgccgagtgccccaga

SEQ ID NO: 2293273 - DNA, 22 bp, Homo sapiens
catgccgagtgccccagaaatg

SEQ ID NO: 2293274 - DNA, 14 bp, Homo sapiens
catgccgctgtgtc

SEQ ID NO: 2293275 - DNA, 16 bp, Homo sapiens
catgccgctgtgtcta

SEQ ID NO: 2293276 - DNA, 12 bp, Homo sapiens
catgcctagtta

SEQ ID NO: 2293277 - DNA, 18 bp, Homo sapiens
catgcggccggcctgggg

SEQ ID NO: 2293278 - DNA, 22 bp, Homo sapiens
catgctcatgtgtacacacgct

SEQ ID NO: 2293279 - DNA, 10 bp, Homo sapiens
catgctcttt

SEQ ID NO: 2293280 - DNA, 18 bp, Homo sapiens
catgctgagtcatgtctt

SEQ ID NO: 2293281 - DNA, 13 bp, Homo sapiens
catgctgcagtgg

SEQ ID NO: 2293282 - DNA, 15 bp, Homo sapiens
catgctgtcccttac

SEQ ID NO: 2293283 - DNA, 17 bp, Homo sapiens
catggaacttaaaacat

SEQ ID NO: 2293284 - DNA, 13 bp, Homo sapiens
catggaactttca

SEQ ID NO: 2293285 - DNA, 12 bp, Homo sapiens
catggaagctgg

SEQ ID NO: 2293286 - DNA, 18 bp, Homo sapiens
catggaagctggcaggag

SEQ ID NO: 2293287 - DNA, 20 bp, Homo sapiens
catggaagtactataattta

SEQ ID NO: 2293288 - DNA, 21 bp, Homo sapiens
catggaccactgtttcttgct

SEQ ID NO: 2293289 - DNA, 23 bp, Homo sapiens
catggaccactgtttcttgcttg

SEQ ID NO: 2293290 - DNA, 16 bp, Homo sapiens
catggatttcctttga

SEQ ID NO: 2293291 - DNA, 23 bp, Homo sapiens
catggatttcctttgacctctca

SEQ ID NO: 2293292 - DNA, 15 bp, Homo sapiens
catggcagccctcgg

SEQ ID NO: 2293293 - DNA, 14 bp, Homo sapiens
catggccccagctg

SEQ ID NO: 2293294 - DNA, 15 bp, Homo sapiens
catggccccagctgg

SEQ ID NO: 2293295 - DNA, 17 bp, Homo sapiens
catggccccagctggct

SEQ ID NO: 2293296 - DNA, 18 bp, Homo sapiens
catggccccagctggctg

SEQ ID NO: 2293297 - DNA, 19 bp, Homo sapiens
catggcctaatcacctttc

SEQ ID NO: 2293298 - DNA, 14 bp, Homo sapiens
catgggaatgaatg

SEQ ID NO: 2293299 - DNA, 18 bp, Homo sapiens
catgggaatgaatgtcag

SEQ ID NO: 2293300 - DNA, 15 bp, Homo sapiens
catgggagaagaggg

SEQ ID NO: 2293301 - DNA, 20 bp, Homo sapiens
catgggagtcagggagccct

SEQ ID NO: 2293302 - DNA, 23 bp, Homo sapiens
catgggagtcagggagccctggg

SEQ ID NO: 2293303 - DNA, 13 bp, Homo sapiens
catggtcacagac

SEQ ID NO: 2293304 - DNA, 14 bp, Homo sapiens
catggtcacagacc

SEQ ID NO: 2293305 - DNA, 16 bp, Homo sapiens
catggtcacagacccc

SEQ ID NO: 2293306 - DNA, 17 bp, Homo sapiens
catggtcacagacccct

SEQ ID NO: 2293307 - DNA, 18 bp, Homo sapiens
catggtcacagacccctg

SEQ ID NO: 2293308 - DNA, 13 bp, Homo sapiens
catggtcctgtgc

SEQ ID NO: 2293309 - DNA, 18 bp, Homo sapiens
catggtcctgtgccccga

SEQ ID NO: 2293310 - DNA, 14 bp, Homo sapiens
catggtctcttcca

SEQ ID NO: 2293311 - DNA, 18 bp, Homo sapiens
catgtaatagtggctttc

SEQ ID NO: 2293312 - DNA, 16 bp, Homo sapiens
catgtactacacttct

SEQ ID NO: 2293313 - DNA, 20 bp, Homo sapiens
catgtagccagcagaactga

SEQ ID NO: 2293314 - DNA, 13 bp, Homo sapiens
catgtatagtgag

SEQ ID NO: 2293315 - DNA, 21 bp, Homo sapiens
catgtatagtgagtgtggctt

SEQ ID NO: 2293316 - DNA, 18 bp, Homo sapiens
catgtatgatttctgttg

SEQ ID NO: 2293317 - DNA, 22 bp, Homo sapiens
catgtcaacaatccacatcaga

SEQ ID NO: 2293318 - DNA, 12 bp, Homo sapiens
catgtctgtagt

SEQ ID NO: 2293319 - DNA, 15 bp, Homo sapiens
catgtctttcctatt

SEQ ID NO: 2293320 - DNA, 15 bp, Homo sapiens
catgtgatgagagga

SEQ ID NO: 2293321 - DNA, 20 bp, Homo sapiens
catgtgatgagaggaaatca

SEQ ID NO: 2293322 - DNA, 16 bp, Homo sapiens
catgtggctccccctg

SEQ ID NO: 2293323 - DNA, 17 bp, Homo sapiens
catgtgtacagaaacaa

SEQ ID NO: 2293324 - DNA, 21 bp, Homo sapiens
catgtgtagatattatgtata

SEQ ID NO: 2293325 - DNA, 24 bp, Homo sapiens
catgtgtagatattatgtatagaa

SEQ ID NO: 2293326 - DNA, 20 bp, Homo sapiens
catgtgttgcaaattattct

SEQ ID NO: 2293327 - DNA, 22 bp, Homo sapiens
catgttaaagaggcgtcttgta

SEQ ID NO: 2293328 - DNA, 22 bp, Homo sapiens
catgttgcaaagaactccagag

SEQ ID NO: 2293329 - DNA, 23 bp, Homo sapiens
catgttgcaaagaactccagagt

SEQ ID NO: 2293330 - DNA, 12 bp, Homo sapiens
catgtttaagaa

SEQ ID NO: 2293331 - DNA, 16 bp, Homo sapiens
catgtttaagaaatga

SEQ ID NO: 2293332 - DNA, 18 bp, Homo sapiens
catgtttaagaaatgaga

SEQ ID NO: 2293333 - DNA, 21 bp, Homo sapiens
catgtttaagaaatgagaaat

SEQ ID NO: 2293334 - DNA, 19 bp, Homo sapiens
catgtttatccatgtactt

SEQ ID NO: 2293335 - DNA, 20 bp, Homo sapiens
cattaaaagctttagattga

SEQ ID NO: 2293336 - DNA, 22 bp, Homo sapiens
cattaaaagctttagattgaaa

SEQ ID NO: 2293337 - DNA, 17 bp, Homo sapiens
cattaagaacaaggaat

SEQ ID NO: 2293338 - DNA, 11 bp, Homo sapiens
cattagtatcc

SEQ ID NO: 2293339 - DNA, 21 bp, Homo sapiens
cattagtcatatttttgtaaa

SEQ ID NO: 2293340 - DNA, 15 bp, Homo sapiens
cattatcctgtgtga

SEQ ID NO: 2293341 - DNA, 13 bp, Homo sapiens
cattatgaagatg

SEQ ID NO: 2293342 - DNA, 18 bp, Homo sapiens
cattatgagtaaaagcag

SEQ ID NO: 2293343 - DNA, 21 bp, Homo sapiens
cattatgcccttgagtctaga

SEQ ID NO: 2293344 - DNA, 12 bp, Homo sapiens
cattatgtcaat

SEQ ID NO: 2293345 - DNA, 21 bp, Homo sapiens
cattatgtcaattcattaata

SEQ ID NO: 2293346 - DNA, 12 bp, Homo sapiens
cattattttccc

SEQ ID NO: 2293347 - DNA, 22 bp, Homo sapiens
cattattttcccacaattcttt

SEQ ID NO: 2293348 - DNA, 20 bp, Homo sapiens
cattattttgtcataaaatg

SEQ ID NO: 2293349 - DNA, 15 bp, Homo sapiens
cattcagcagaatga

SEQ ID NO: 2293350 - DNA, 22 bp, Homo sapiens
cattcatgtactaccctcagtc

SEQ ID NO: 2293351 - DNA, 14 bp, Homo sapiens
cattcatttacaac

SEQ ID NO: 2293352 - DNA, 20 bp, Homo sapiens
cattctgaaggccttgttaa

SEQ ID NO: 2293353 - DNA, 15 bp, Homo sapiens
cattcttattttaga

SEQ ID NO: 2293354 - DNA, 22 bp, Homo sapiens
cattcttttcagcttgtttcta

SEQ ID NO: 2293355 - DNA, 17 bp, Homo sapiens
cattgaaaaatgtccac

SEQ ID NO: 2293356 - DNA, 22 bp, Homo sapiens
cattgcaggaagagatgctcta

SEQ ID NO: 2293357 - DNA, 15 bp, Homo sapiens
cattgctgacagagc

SEQ ID NO: 2293358 - DNA, 16 bp, Homo sapiens
cattgctgacagagcc

SEQ ID NO: 2293359 - DNA, 18 bp, Homo sapiens
cattgctgacagagccct

SEQ ID NO: 2293360 - DNA, 18 bp, Homo sapiens
catttaaaatagttttct

SEQ ID NO: 2293361 - DNA, 19 bp, Homo sapiens
catttaaaatagttttcta

SEQ ID NO: 2293362 - DNA, 13 bp, Homo sapiens
catttaagaacag

SEQ ID NO: 2293363 - DNA, 12 bp, Homo sapiens
catttatactgt

SEQ ID NO: 2293364 - DNA, 14 bp, Homo sapiens
catttatttattca

SEQ ID NO: 2293365 - DNA, 21 bp, Homo sapiens
catttatttattcatgtgtac

SEQ ID NO: 2293366 - DNA, 22 bp, Homo sapiens
catttccaccaagggtatctgc

SEQ ID NO: 2293367 - DNA, 14 bp, Homo sapiens
catttgatttgata

SEQ ID NO: 2293368 - DNA, 23 bp, Homo sapiens
catttgtaatgtatcttatttat

SEQ ID NO: 2293369 - DNA, 17 bp, Homo sapiens
catttgtagatatatat

SEQ ID NO: 2293370 - DNA, 23 bp, Homo sapiens
catttgtagatatatatttccaa

SEQ ID NO: 2293371 - DNA, 18 bp, Homo sapiens
cattttctaaactgtttt

SEQ ID NO: 2293372 - DNA, 20 bp, Homo sapiens
cattttgatttttttgttca

SEQ ID NO: 2293373 - DNA, 19 bp, Homo sapiens
cattttggcgctcgaagtt

SEQ ID NO: 2293374 - DNA, 12 bp, Homo sapiens
catttttctggc

SEQ ID NO: 2293375 - DNA, 13 bp, Homo sapiens
catttttctgtta

SEQ ID NO: 2293376 - DNA, 12 bp, Homo sapiens
ccaaaatcattc

SEQ ID NO: 2293377 - DNA, 15 bp, Homo sapiens
ccaaaccccggggct

SEQ ID NO: 2293378 - DNA, 16 bp, Homo sapiens
ccaaagagaaaagatt

SEQ ID NO: 2293379 - DNA, 19 bp, Homo sapiens
ccaaagaggcattcagcaa

SEQ ID NO: 2293380 - DNA, 15 bp, Homo sapiens
ccaaagctgaagatc

SEQ ID NO: 2293381 - DNA, 18 bp, Homo sapiens
ccaaagcttgccactttc

SEQ ID NO: 2293382 - DNA, 21 bp, Homo sapiens
ccaaaggaaggcacccttgac

SEQ ID NO: 2293383 - DNA, 19 bp, Homo sapiens
ccaaaggggcctctccttt

SEQ ID NO: 2293384 - DNA, 20 bp, Homo sapiens
ccaaaggggcctctcctttt

SEQ ID NO: 2293385 - DNA, 13 bp, Homo sapiens
ccaaataaaatgt

SEQ ID NO: 2293386 - DNA, 24 bp, Homo sapiens
ccaaataaaatgtttacattttct

SEQ ID NO: 2293387 - DNA, 15 bp, Homo sapiens
ccaaataagacagtt

SEQ ID NO: 2293388 - DNA, 21 bp, Homo sapiens
ccaaatcctgggcatccccag

SEQ ID NO: 2293389 - DNA, 21 bp, Homo sapiens
ccaaatggaaacagaggacca

SEQ ID NO: 2293390 - DNA, 23 bp, Homo sapiens
ccaaattaacctttcaggaaagt

SEQ ID NO: 2293391 - DNA, 19 bp, Homo sapiens
ccaaattctgtggctgcca

SEQ ID NO: 2293392 - DNA, 21 bp, Homo sapiens
ccaaattttccttcctgttct

SEQ ID NO: 2293393 - DNA, 21 bp, Homo sapiens
ccaacagggcaaccaataaaa

SEQ ID NO: 2293394 - DNA, 18 bp, Homo sapiens
ccaacaggggctggaggg

SEQ ID NO: 2293395 - DNA, 14 bp, Homo sapiens
ccaacatccactct

SEQ ID NO: 2293396 - DNA, 15 bp, Homo sapiens
ccaacatccactctc

SEQ ID NO: 2293397 - DNA, 20 bp, Homo sapiens
ccaacattatcctgtgtgat

SEQ ID NO: 2293398 - DNA, 16 bp, Homo sapiens
ccaacccccacctccc

SEQ ID NO: 2293399 - DNA, 17 bp, Homo sapiens
ccaacccccacctcccg

SEQ ID NO: 2293400 - DNA, 12 bp, Homo sapiens
ccaacctggagg

SEQ ID NO: 2293401 - DNA, 17 bp, Homo sapiens
ccaactaagttgtattt

SEQ ID NO: 2293402 - DNA, 16 bp, Homo sapiens
ccaactccaacatcca

SEQ ID NO: 2293403 - DNA, 17 bp, Homo sapiens
ccaactccaacatccac

SEQ ID NO: 2293404 - DNA, 18 bp, Homo sapiens
ccaactccaacatccact

SEQ ID NO: 2293405 - DNA, 15 bp, Homo sapiens
ccaactggaaggctt

SEQ ID NO: 2293406 - DNA, 18 bp, Homo sapiens
ccaagactgctccctttt

SEQ ID NO: 2293407 - DNA, 15 bp, Homo sapiens
ccaagcacaaactgt

SEQ ID NO: 2293408 - DNA, 21 bp, Homo sapiens
ccaagctgttccacttctcta

SEQ ID NO: 2293409 - DNA, 15 bp, Homo sapiens
ccaaggacactgatg

SEQ ID NO: 2293410 - DNA, 20 bp, Homo sapiens
ccaagggtatctgctgcctc

SEQ ID NO: 2293411 - DNA, 20 bp, Homo sapiens
ccaagtattttatctgtgtt

SEQ ID NO: 2293412 - DNA, 12 bp, Homo sapiens
ccaagtcatggg

SEQ ID NO: 2293413 - DNA, 16 bp, Homo sapiens
ccaagtgcaaaagaaa

SEQ ID NO: 2293414 - DNA, 17 bp, Homo sapiens
ccaagtgtacatttgat

SEQ ID NO: 2293415 - DNA, 14 bp, Homo sapiens
ccaatacagtctag

SEQ ID NO: 2293416 - DNA, 22 bp, Homo sapiens
ccaatcaacagcatgtctactg

SEQ ID NO: 2293417 - DNA, 23 bp, Homo sapiens
ccaatcaacagcatgtctactgc

SEQ ID NO: 2293418 - DNA, 11 bp, Homo sapiens
ccaatctctgt

SEQ ID NO: 2293419 - DNA, 13 bp, Homo sapiens
ccaatctctgtga

SEQ ID NO: 2293420 - DNA, 18 bp, Homo sapiens
ccaatgaagataaatgct

SEQ ID NO: 2293421 - DNA, 23 bp, Homo sapiens
ccaatgatataggaaaatacatt

SEQ ID NO: 2293422 - DNA, 17 bp, Homo sapiens
ccaatgtaccatgttgc

SEQ ID NO: 2293423 - DNA, 20 bp, Homo sapiens
ccaattttaaaaaataacat

SEQ ID NO: 2293424 - DNA, 22 bp, Homo sapiens
ccacaacaaagtgcttcctttt

SEQ ID NO: 2293425 - DNA, 13 bp, Homo sapiens
ccacaattctttt

SEQ ID NO: 2293426 - DNA, 13 bp, Homo sapiens
ccacacacagcag

SEQ ID NO: 2293427 - DNA, 15 bp, Homo sapiens
ccacacacagcagct

SEQ ID NO: 2293428 - DNA, 18 bp, Homo sapiens
ccacacacagcagctcca

SEQ ID NO: 2293429 - DNA, 12 bp, Homo sapiens
ccacacatttcc

SEQ ID NO: 2293430 - DNA, 20 bp, Homo sapiens
ccacaccctggagtggcatg

SEQ ID NO: 2293431 - DNA, 21 bp, Homo sapiens
ccacacgccggggctggccct

SEQ ID NO: 2293432 - DNA, 16 bp, Homo sapiens
ccacagcatgaacctt

SEQ ID NO: 2293433 - DNA, 16 bp, Homo sapiens
ccacagcctcttcctc

SEQ ID NO: 2293434 - DNA, 15 bp, Homo sapiens
ccacagtggggccca

SEQ ID NO: 2293435 - DNA, 17 bp, Homo sapiens
ccacattctgctgcccc

SEQ ID NO: 2293436 - DNA, 23 bp, Homo sapiens
ccacattctgctgcccccagacc

SEQ ID NO: 2293437 - DNA, 15 bp, Homo sapiens
ccacattgcccacac

SEQ ID NO: 2293438 - DNA, 21 bp, Homo sapiens
ccacccacaccccgtctgccc

SEQ ID NO: 2293439 - DNA, 15 bp, Homo sapiens
ccaccccgctgcctg

SEQ ID NO: 2293440 - DNA, 16 bp, Homo sapiens
ccatcagtgaaagaaa

SEQ ID NO: 2293441 - DNA, 19 bp, Homo sapiens
ccatcagtgaaagaaactg

SEQ ID NO: 2293442 - DNA, 14 bp, Homo sapiens
ccatcattgaaatc

SEQ ID NO: 2293443 - DNA, 16 bp, Homo sapiens
ccatcattgaaatctt

SEQ ID NO: 2293444 - DNA, 11 bp, Homo sapiens
ccatccacacc

SEQ ID NO: 2293445 - DNA, 12 bp, Homo sapiens
ccatccaccctg

SEQ ID NO: 2293446 - DNA, 19 bp, Homo sapiens
ccatccatggagcacgagg

SEQ ID NO: 2293447 - DNA, 23 bp, Homo sapiens
ccatcccaaacccttcagtgcca

SEQ ID NO: 2293448 - DNA, 14 bp, Homo sapiens
ccatcccactgata

SEQ ID NO: 2293449 - DNA, 16 bp, Homo sapiens
ccatccttaactgtcc

SEQ ID NO: 2293450 - DNA, 18 bp, Homo sapiens
ccatccttaactgtccag

SEQ ID NO: 2293451 - DNA, 15 bp, Homo sapiens
ccatccttcccgcag

SEQ ID NO: 2293452 - DNA, 16 bp, Homo sapiens
ccatccttcccgcagc

SEQ ID NO: 2293453 - DNA, 18 bp, Homo sapiens
ccatccttcccgcagcac

SEQ ID NO: 2293454 - DNA, 11 bp, Homo sapiens
ccatctgctga

SEQ ID NO: 2293455 - DNA, 17 bp, Homo sapiens
ccatgaggaacaaggca

SEQ ID NO: 2293456 - DNA, 18 bp, Homo sapiens
ccatgaggaacaaggcaa

SEQ ID NO: 2293457 - DNA, 23 bp, Homo sapiens
ccatgaggaacaaggcaaggctg

SEQ ID NO: 2293458 - DNA, 13 bp, Homo sapiens
ccatgagttgagt

SEQ ID NO: 2293459 - DNA, 20 bp, Homo sapiens
ccatgattccaagggcccag

SEQ ID NO: 2293460 - DNA, 22 bp, Homo sapiens
ccatgattccaagggcccagag

SEQ ID NO: 2293461 - DNA, 15 bp, Homo sapiens
ccatgcatgatgggt

SEQ ID NO: 2293462 - DNA, 14 bp, Homo sapiens
ccatgcatttctcg

SEQ ID NO: 2293463 - DNA, 20 bp, Homo sapiens
ccatgcccaccgcccctgga

SEQ ID NO: 2293464 - DNA, 13 bp, Homo sapiens
ccatggaagctgg

SEQ ID NO: 2293465 - DNA, 16 bp, Homo sapiens
ccatggaagctggcag

SEQ ID NO: 2293466 - DNA, 18 bp, Homo sapiens
ccatggaagctggcagga

SEQ ID NO: 2293467 - DNA, 14 bp, Homo sapiens
ccatggccccagct

SEQ ID NO: 2293468 - DNA, 15 bp, Homo sapiens
ccatggccccagctg

SEQ ID NO: 2293469 - DNA, 16 bp, Homo sapiens
ccatggtcacagaccc

SEQ ID NO: 2293470 - DNA, 11 bp, Homo sapiens
ccatgtctgta

SEQ ID NO: 2293471 - DNA, 13 bp, Homo sapiens
ccatgtggccttg

SEQ ID NO: 2293472 - DNA, 21 bp, Homo sapiens
ccatgttagtaatggcagagc

SEQ ID NO: 2293473 - DNA, 15 bp, Homo sapiens
ccatgttgcccagaa

SEQ ID NO: 2293474 - DNA, 18 bp, Homo sapiens
ccattactaaagacagaa

SEQ ID NO: 2293475 - DNA, 13 bp, Homo sapiens
ccattcagcctcg

SEQ ID NO: 2293476 - DNA, 15 bp, Homo sapiens
ccattcagcctcgtc

SEQ ID NO: 2293477 - DNA, 16 bp, Homo sapiens
ccattctataaattca

SEQ ID NO: 2293478 - DNA, 12 bp, Homo sapiens
ccattgttctga

SEQ ID NO: 2293479 - DNA, 14 bp, Homo sapiens
ccattttaaagaag

SEQ ID NO: 2293480 - DNA, 16 bp, Homo sapiens
cccaaagcagtgcatg

SEQ ID NO: 2293481 - DNA, 17 bp, Homo sapiens
cccaaaggtaggaaggt

SEQ ID NO: 2293482 - DNA, 12 bp, Homo sapiens
cccaaataacag

SEQ ID NO: 2293483 - DNA, 17 bp, Homo sapiens
cccaaattggtgtttct

SEQ ID NO: 2293484 - DNA, 19 bp, Homo sapiens
cccaacctcttcctcctga

SEQ ID NO: 2293485 - DNA, 18 bp, Homo sapiens
cccacaccccgtctgccc

SEQ ID NO: 2293486 - DNA, 20 bp, Homo sapiens
cccacaccccgtctgcccct

SEQ ID NO: 2293487 - DNA, 22 bp, Homo sapiens
cccacaccccgtctgccccttg

SEQ ID NO: 2293488 - DNA, 17 bp, Homo sapiens
cccacaccctggagtgg

SEQ ID NO: 2293489 - DNA, 16 bp, Homo sapiens
cccacacgccggggct

SEQ ID NO: 2293490 - DNA, 22 bp, Homo sapiens
cccacacgccggggctggccct

SEQ ID NO: 2293491 - DNA, 16 bp, Homo sapiens
cccacagatccatcct

SEQ ID NO: 2293492 - DNA, 21 bp, Homo sapiens
cccacccacaccccgtctgcc

SEQ ID NO: 2293493 - DNA, 14 bp, Homo sapiens
cccacccccgggtg

SEQ ID NO: 2293494 - DNA, 18 bp, Homo sapiens
cccacccgccccagagac

SEQ ID NO: 2293495 - DNA, 18 bp, Homo sapiens
cccaccctgcttctgctg

SEQ ID NO: 2293496 - DNA, 21 bp, Homo sapiens
cccaccctgcttctgctgcct

SEQ ID NO: 2293497 - DNA, 14 bp, Homo sapiens
cccaccgcccctgg

SEQ ID NO: 2293498 - DNA, 14 bp, Homo sapiens
cccacctcccggtg

SEQ ID NO: 2293499 - DNA, 15 bp, Homo sapiens
cccacctcccggtgt

SEQ ID NO: 2293500 - DNA, 13 bp, Homo sapiens
cccacctgcccag

SEQ ID NO: 2293501 - DNA, 16 bp, Homo sapiens
cccacctgcccagtta

SEQ ID NO: 2293502 - DNA, 14 bp, Homo sapiens
cccacgcagagccc

SEQ ID NO: 2293503 - DNA, 15 bp, Homo sapiens
cccacgcagagcccc

SEQ ID NO: 2293504 - DNA, 18 bp, Homo sapiens
cccacgcagagccccgga

SEQ ID NO: 2293505 - DNA, 23 bp, Homo sapiens
cccacgcagagccccggagcacc

SEQ ID NO: 2293506 - DNA, 13 bp, Homo sapiens
cccacgcctccat

SEQ ID NO: 2293507 - DNA, 17 bp, Homo sapiens
cccacgcttctggaggt

SEQ ID NO: 2293508 - DNA, 23 bp, Homo sapiens
cccacggccgtccctgacttccc

SEQ ID NO: 2293509 - DNA, 18 bp, Homo sapiens
cccactccgactccccct

SEQ ID NO: 2293510 - DNA, 17 bp, Homo sapiens
cccactttcgcctcctc

SEQ ID NO: 2293511 - DNA, 20 bp, Homo sapiens
cccactttcgcctcctccag

SEQ ID NO: 2293512 - DNA, 17 bp, Homo sapiens
cccagaaagcctcagag

SEQ ID NO: 2293513 - DNA, 16 bp, Homo sapiens
cccagaaatgccgctg

SEQ ID NO: 2293514 - DNA, 17 bp, Homo sapiens
cccagaaatgccgctgt

SEQ ID NO: 2293515 - DNA, 20 bp, Homo sapiens
cccagaaatgccgctgtgtc

SEQ ID NO: 2293516 - DNA, 13 bp, Homo sapiens
cccagaacgggcc

SEQ ID NO: 2293517 - DNA, 14 bp, Homo sapiens
cccagaacgggcct

SEQ ID NO: 2293518 - DNA, 20 bp, Homo sapiens
cccagaacgggcctccccgg

SEQ ID NO: 2293519 - DNA, 13 bp, Homo sapiens
cccagagactgcc

SEQ ID NO: 2293520 - DNA, 22 bp, Homo sapiens
cccagagactgcccaccctggg

SEQ ID NO: 2293521 - DNA, 13 bp, Homo sapiens
cccagccccctgg

SEQ ID NO: 2293522 - DNA, 12 bp, Homo sapiens
cccagcctcccc

SEQ ID NO: 2293523 - DNA, 23 bp, Homo sapiens
cccagcgtgggggtggccactcc

SEQ ID NO: 2293524 - DNA, 16 bp, Homo sapiens
cccagctggcagcgcc

SEQ ID NO: 2293525 - DNA, 17 bp, Homo sapiens
cccagctggcagcgcct

SEQ ID NO: 2293526 - DNA, 18 bp, Homo sapiens
cccagctggcagcgcctc

SEQ ID NO: 2293527 - DNA, 15 bp, Homo sapiens
cccagctggctgggt

SEQ ID NO: 2293528 - DNA, 13 bp, Homo sapiens
cccaggacgcagg

SEQ ID NO: 2293529 - DNA, 15 bp, Homo sapiens
cccaggacgcaggga

SEQ ID NO: 2293530 - DNA, 16 bp, Homo sapiens
cccaggcggaggggct

SEQ ID NO: 2293531 - DNA, 23 bp, Homo sapiens
cccaggcggaggggcttggagca

SEQ ID NO: 2293532 - DNA, 16 bp, Homo sapiens
cccaggctgcgcctgc

SEQ ID NO: 2293533 - DNA, 21 bp, Homo sapiens
cccaggctgcgcctgcccgcc

SEQ ID NO: 2293534 - DNA, 16 bp, Homo sapiens
cccagggagggggtca

SEQ ID NO: 2293535 - DNA, 16 bp, Homo sapiens
cccagtgtccccaggg

SEQ ID NO: 2293536 - DNA, 12 bp, Homo sapiens
cccatctccatt

SEQ ID NO: 2293537 - DNA, 14 bp, Homo sapiens
cccatggccccagc

SEQ ID NO: 2293538 - DNA, 18 bp, Homo sapiens
cccatggccccagctggc

SEQ ID NO: 2293539 - DNA, 14 bp, Homo sapiens
cccatgggctctgg

SEQ ID NO: 2293540 - DNA, 15 bp, Homo sapiens
cccatgggctctggc

SEQ ID NO: 2293541 - DNA, 16 bp, Homo sapiens
cccatgggctctggcc

SEQ ID NO: 2293542 - DNA, 22 bp, Homo sapiens
cccatgggctctggccccaaga

SEQ ID NO: 2293543 - DNA, 16 bp, Homo sapiens
cccatggtcacagacc

SEQ ID NO: 2293544 - DNA, 20 bp, Homo sapiens
cccatggtcacagacccctg

SEQ ID NO: 2293545 - DNA, 15 bp, Homo sapiens
cccattcatactaaa

SEQ ID NO: 2293546 - DNA, 14 bp, Homo sapiens
cccattctgggact

SEQ ID NO: 2293547 - DNA, 23 bp, Homo sapiens
ccccaaaggggcctctccttttc

SEQ ID NO: 2293548 - DNA, 16 bp, Homo sapiens
ccccaagatgttgggg

SEQ ID NO: 2293549 - DNA, 14 bp, Homo sapiens
ccccaattcatgtt

SEQ ID NO: 2293550 - DNA, 23 bp, Homo sapiens
ccccacccccgggtgcctgtgac

SEQ ID NO: 2293551 - DNA, 12 bp, Homo sapiens
ccccacccctcc

SEQ ID NO: 2293552 - DNA, 13 bp, Homo sapiens
ccccacccctcca

SEQ ID NO: 2293553 - DNA, 11 bp, Homo sapiens
ccccaccctgc

SEQ ID NO: 2293554 - DNA, 22 bp, Homo sapiens
ccccaccctgcttctgctgcct

SEQ ID NO: 2293555 - DNA, 16 bp, Homo sapiens
ccccacggccgtccct

SEQ ID NO: 2293556 - DNA, 13 bp, Homo sapiens
ccccactgaagaa

SEQ ID NO: 2293557 - DNA, 18 bp, Homo sapiens
ccccactttcgcctcctc

SEQ ID NO: 2293558 - DNA, 21 bp, Homo sapiens
ccccactttcgcctcctccag

SEQ ID NO: 2293559 - DNA, 15 bp, Homo sapiens
ccccagaaagcctca

SEQ ID NO: 2293560 - DNA, 21 bp, Homo sapiens
ccccagagactgcccaccctg

SEQ ID NO: 2293561 - DNA, 17 bp, Homo sapiens
ccccagccccctggccc

SEQ ID NO: 2293562 - DNA, 13 bp, Homo sapiens
ccccagcctcccc

SEQ ID NO: 2293563 - DNA, 23 bp, Homo sapiens
ccccagcctcccccaggctgcgc

SEQ ID NO: 2293564 - DNA, 21 bp, Homo sapiens
ccccaggcggaggggcttgga

SEQ ID NO: 2293565 - DNA, 14 bp, Homo sapiens
ccccaggctgcgcc

SEQ ID NO: 2293566 - DNA, 20 bp, Homo sapiens
ccccaggctgcgcctgcccg

SEQ ID NO: 2293567 - DNA, 19 bp, Homo sapiens
ccccagttaatgtgccaaa

SEQ ID NO: 2293568 - DNA, 13 bp, Homo sapiens
ccccatctccatt

SEQ ID NO: 2293569 - DNA, 12 bp, Homo sapiens
ccccatctgctg

SEQ ID NO: 2293570 - DNA, 14 bp, Homo sapiens
cccccacagatcca

SEQ ID NO: 2293571 - DNA, 14 bp, Homo sapiens
cccccacctcccgg

SEQ ID NO: 2293572 - DNA, 18 bp, Homo sapiens
cccccacgcttctggagg

SEQ ID NO: 2293573 - DNA, 12 bp, Homo sapiens
cccccacggccg

SEQ ID NO: 2293574 - DNA, 18 bp, Homo sapiens
cccccagcctcccccagg

SEQ ID NO: 2293575 - DNA, 19 bp, Homo sapiens
cccccaggctgcgcctgcc

SEQ ID NO: 2293576 - DNA, 14 bp, Homo sapiens
cccccagggagggg

SEQ ID NO: 2293577 - DNA, 13 bp, Homo sapiens
cccccgctctgcc

SEQ ID NO: 2293578 - DNA, 20 bp, Homo sapiens
cccccggaggcgcccacctg

SEQ ID NO: 2293579 - DNA, 13 bp, Homo sapiens
ccacccgccccag

SEQ ID NO: 2293580 - DNA, 15 bp, Homo sapiens
ccacccgccccagag

SEQ ID NO: 2293581 - DNA, 18 bp, Homo sapiens
ccacccgccccagagact

SEQ ID NO: 2293582 - DNA, 16 bp, Homo sapiens
ccacccgcccctgccc

SEQ ID NO: 2293583 - DNA, 12 bp, Homo sapiens
ccacccgcccgc

SEQ ID NO: 2293584 - DNA, 21 bp, Homo sapiens
ccacccgcccgcccccgccct

SEQ ID NO: 2293585 - DNA, 22 bp, Homo sapiens
ccaccctgcttctgctgcctgt

SEQ ID NO: 2293586 - DNA, 16 bp, Homo sapiens
ccaccctgggcctccc

SEQ ID NO: 2293587 - DNA, 15 bp, Homo sapiens
ccacctgaggcagga

SEQ ID NO: 2293588 - DNA, 16 bp, Homo sapiens
ccacctgaggcaggag

SEQ ID NO: 2293589 - DNA, 17 bp, Homo sapiens
ccacctgaggcaggagg

SEQ ID NO: 2293590 - DNA, 18 bp, Homo sapiens
ccacctgaggcaggaggg

SEQ ID NO: 2293591 - DNA, 22 bp, Homo sapiens
ccacctgaggcaggagggcatg

SEQ ID NO: 2293592 - DNA, 24 bp, Homo sapiens
ccacctggagaaggaagctgcctg

SEQ ID NO: 2293593 - DNA, 23 bp, Homo sapiens
ccaccttgtacagaaccagcact

SEQ ID NO: 2293594 - DNA, 13 bp, Homo sapiens
ccacgcagagccc

SEQ ID NO: 2293595 - DNA, 15 bp, Homo sapiens
ccacgcttctggagg

SEQ ID NO: 2293596 - DNA, 23 bp, Homo sapiens
ccacgcttctggaggtggggagg

SEQ ID NO: 2293597 - DNA, 16 bp, Homo sapiens
ccacggccgtccctga

SEQ ID NO: 2293598 - DNA, 14 bp, Homo sapiens
ccacgtggagagaa

SEQ ID NO: 2293599 - DNA, 22 bp, Homo sapiens
ccacgttgcagaaaaagagctt

SEQ ID NO: 2293600 - DNA, 17 bp, Homo sapiens
ccactcaagaccaaatg

SEQ ID NO: 2293601 - DNA, 20 bp, Homo sapiens
ccactcaagaccaaatggaa

SEQ ID NO: 2293602 - DNA, 11 bp, Homo sapiens
ccactcctggg

SEQ ID NO: 2293603 - DNA, 22 bp, Homo sapiens
ccactctctcttgttcttactt

SEQ ID NO: 2293604 - DNA, 16 bp, Homo sapiens
ccactctgctcagggc

SEQ ID NO: 2293605 - DNA, 17 bp, Homo sapiens
ccactgaaacctctgtt

SEQ ID NO: 2293606 - DNA, 20 bp, Homo sapiens
ccactgaaacctctgttctc

SEQ ID NO: 2293607 - DNA, 23 bp, Homo sapiens
ccactgatatcacgggcccgctc

SEQ ID NO: 2293608 - DNA, 24 bp, Homo sapiens
ccactgatatcacgggcccgctca

SEQ ID NO: 2293609 - DNA, 16 bp, Homo sapiens
ccactgcgaccacaag

SEQ ID NO: 2293610 - DNA, 14 bp, Homo sapiens
ccactgctgcacct

SEQ ID NO: 2293611 - DNA, 23 bp, Homo sapiens
ccactgtcataatctctttccat

SEQ ID NO: 2293612 - DNA, 18 bp, Homo sapiens
ccactgtttcttgcttgt

SEQ ID NO: 2293613 - DNA, 17 bp, Homo sapiens
ccactttcgcctcctcc

SEQ ID NO: 2293614 - DNA, 18 bp, Homo sapiens
ccactttcgcctcctcca

SEQ ID NO: 2293615 - DNA, 22 bp, Homo sapiens
ccactttcgcctcctccagctc

SEQ ID NO: 2293616 - DNA, 16 bp, Homo sapiens
ccagaacgccctgtgt

SEQ ID NO: 2293617 - DNA, 18 bp, Homo sapiens
ccagaacgccctgtgtcc

SEQ ID NO: 2293618 - DNA, 15 bp, Homo sapiens
ccagaacgggcctcc

SEQ ID NO: 2293619 - DNA, 17 bp, Homo sapiens
ccagaacgggcctcccc

SEQ ID NO: 2293620 - DNA, 18 bp, Homo sapiens
ccagaacgggcctccccg

SEQ ID NO: 2293621 - DNA, 20 bp, Homo sapiens
ccagaacgggcctccccggg

SEQ ID NO: 2293622 - DNA, 18 bp, Homo sapiens
ccagaatttcccaaagca

SEQ ID NO: 2293623 - DNA, 21 bp, Homo sapiens
ccagaatttcccaaagcagtg

SEQ ID NO: 2293624 - DNA, 19 bp, Homo sapiens
ccagaccccatccagccag

SEQ ID NO: 2293625 - DNA, 16 bp, Homo sapiens
ccagacctgggccctg

SEQ ID NO: 2293626 - DNA, 19 bp, Homo sapiens
ccagacgcctgatattgaa

SEQ ID NO: 2293627 - DNA, 22 bp, Homo sapiens
ccagactcgagagggctgagcc

SEQ ID NO: 2293628 - DNA, 14 bp, Homo sapiens
ccagagacctgctc

SEQ ID NO: 2293629 - DNA, 22 bp, Homo sapiens
ccagagacctgctccagatcct

SEQ ID NO: 2293630 - DNA, 15 bp, Homo sapiens
ccagagactgcccac

SEQ ID NO: 2293631 - DNA, 21 bp, Homo sapiens
ccagagactgcccaccctggg

SEQ ID NO: 2293632 - DNA, 11 bp, Homo sapiens
ccagagcactg

SEQ ID NO: 2293633 - DNA, 13 bp, Homo sapiens
ccagagcactgta

SEQ ID NO: 2293634 - DNA, 16 bp, Homo sapiens
ccagagcactgtatac

SEQ ID NO: 2293635 - DNA, 20 bp, Homo sapiens
ccagagccgcaccctggctg

SEQ ID NO: 2293636 - DNA, 21 bp, Homo sapiens
ccagagccgcaccctggctgg

SEQ ID NO: 2293637 - DNA, 21 bp, Homo sapiens
ccagagcgtgcacttgtgatc

SEQ ID NO: 2293638 - DNA, 17 bp, Homo sapiens
ccagaggggcggggcca

SEQ ID NO: 2293639 - DNA, 20 bp, Homo sapiens
ccagaggggcggggccagga

SEQ ID NO: 2293640 - DNA, 21 bp, Homo sapiens
ccagaggggcggggccaggat

SEQ ID NO: 2293641 - DNA, 16 bp, Homo sapiens
ccagaggtgagggagg

SEQ ID NO: 2293642 - DNA, 20 bp, Homo sapiens
ccagatgacacataaatctg

SEQ ID NO: 2293643 - DNA, 14 bp, Homo sapiens
ccagatttcactct

SEQ ID NO: 2293644 - DNA, 17 bp, Homo sapiens
ccagcactcccagggcc

SEQ ID NO: 2293645 - DNA, 20 bp, Homo sapiens
ccagcatagttctgcaataa

SEQ ID NO: 2293646 - DNA, 18 bp, Homo sapiens
ccagcccctccccgcctc

SEQ ID NO: 2293647 - DNA, 17 bp, Homo sapiens
ccagccgtaatggggac

SEQ ID NO: 2293648 - DNA, 18 bp, Homo sapiens
ccagccgtaatggggact

SEQ ID NO: 2293649 - DNA, 20 bp, Homo sapiens
ccagccgtaatggggactct

SEQ ID NO: 2293650 - DNA, 18 bp, Homo sapiens
ccagcctcccccaggctg

SEQ ID NO: 2293651 - DNA, 14 bp, Homo sapiens
ccagcctgagccac

SEQ ID NO: 2293652 - DNA, 16 bp, Homo sapiens
ccagcctgagccacag

SEQ ID NO: 2293653 - DNA, 20 bp, Homo sapiens
ccagccttgaactgtggcca

SEQ ID NO: 2293654 - DNA, 17 bp, Homo sapiens
ccagcgagtctggagac

SEQ ID NO: 2293655 - DNA, 12 bp, Homo sapiens
ccagctcactgc

SEQ ID NO: 2293656 - DNA, 16 bp, Homo sapiens
ccagctcactgcagcc

SEQ ID NO: 2293657 - DNA, 18 bp, Homo sapiens
ccagctcactgcagcctc

SEQ ID NO: 2293658 - DNA, 19 bp, Homo sapiens
ccagctcagtcccacagcc

SEQ ID NO: 2293659 - DNA, 15 bp, Homo sapiens
ccagctcctgccccg

SEQ ID NO: 2293660 - DNA, 18 bp, Homo sapiens
ccagctggcagcgcctcc

SEQ ID NO: 2293661 - DNA, 20 bp, Homo sapiens
ccagctggcagcgcctcccg

SEQ ID NO: 2293662 - DNA, 23 bp, Homo sapiens
ccagctggctgggtcgcccctcc

SEQ ID NO: 2293663 - DNA, 16 bp, Homo sapiens
ccaggaaaactgtttt

SEQ ID NO: 2293664 - DNA, 15 bp, Homo sapiens
ccaggaagaggggcg

SEQ ID NO: 2293665 - DNA, 15 bp, Homo sapiens
ccaggaaggggacag

SEQ ID NO: 2293666 - DNA, 16 bp, Homo sapiens
ccaggaaggggacagg

SEQ ID NO: 2293667 - DNA, 13 bp, Homo sapiens
ccaggaccctgag

SEQ ID NO: 2293668 - DNA, 21 bp, Homo sapiens
ccaggacgcagggagaccctg

SEQ ID NO: 2293669 - DNA, 18 bp, Homo sapiens
ccaggacggtctgtgccc

SEQ ID NO: 2293670 - DNA, 18 bp, Homo sapiens
ccaggagtgggtgggaca

SEQ ID NO: 2293671 - DNA, 20 bp, Homo sapiens
ccaggattaatctctaaaat

SEQ ID NO: 2293672 - DNA, 16 bp, Homo sapiens
ccaggcacccaaaccc

SEQ ID NO: 2293673 - DNA, 21 bp, Homo sapiens
ccaggcaggaggccattccag

SEQ ID NO: 2293674 - DNA, 16 bp, Homo sapiens
ccaggcatgaccctgg

SEQ ID NO: 2293675 - DNA, 17 bp, Homo sapiens
ccaggcatgaccctgga

SEQ ID NO: 2293676 - DNA, 17 bp, Homo sapiens
ccaggccgacaggaggc

SEQ ID NO: 2293677 - DNA, 18 bp, Homo sapiens
ccaggccgacaggaggcc

SEQ ID NO: 2293678 - DNA, 22 bp, Homo sapiens
ccaggcggaggggcttggagca

SEQ ID NO: 2293679 - DNA, 18 bp, Homo sapiens
ccaggcgtagggccaggg

SEQ ID NO: 2293680 - DNA, 17 bp, Homo sapiens
ccaggctcacaactgtt

SEQ ID NO: 2293681 - DNA, 12 bp, Homo sapiens
ccaggctgagcc

SEQ ID NO: 2293682 - DNA, 22 bp, Homo sapiens
ccaggctgagccgatctggtct

SEQ ID NO: 2293683 - DNA, 17 bp, Homo sapiens
ccaggctgcgcctgccc

SEQ ID NO: 2293684 - DNA, 18 bp, Homo sapiens
ccaggctgcgcctgcccg

SEQ ID NO: 2293685 - DNA, 20 bp, Homo sapiens
ccaggctgcgcctgcccgcc

SEQ ID NO: 2293686 - DNA, 23 bp, Homo sapiens
ccagggctccacgggggcctagt

SEQ ID NO: 2293687 - DNA, 12 bp, Homo sapiens
ccagggctctgg

SEQ ID NO: 2293688 - DNA, 13 bp, Homo sapiens
ccaggggtgggga

SEQ ID NO: 2293689 - DNA, 17 bp, Homo sapiens
ccagggtctcgtcagga

SEQ ID NO: 2293690 - DNA, 20 bp, Homo sapiens
ccagggtctcgtcaggaggt

SEQ ID NO: 2293691 - DNA, 16 bp, Homo sapiens
ccagggtgcaggcgcg

SEQ ID NO: 2293692 - DNA, 22 bp, Homo sapiens
ccagggtggtggtgcacacctg

SEQ ID NO: 2293693 - DNA, 23 bp, Homo sapiens
ccaggtgttaaaaaccattataa

SEQ ID NO: 2293694 - DNA, 23 bp, Homo sapiens
ccagtatctccatccttaactgt

SEQ ID NO: 2293695 - DNA, 15 bp, Homo sapiens
ccagtctgaagatgt

SEQ ID NO: 2293696 - DNA, 14 bp, Homo sapiens
ccagtggactcgcg

SEQ ID NO: 2293697 - DNA, 19 bp, Homo sapiens
ccagtggactcgcgagagg

SEQ ID NO: 2293698 - DNA, 17 bp, Homo sapiens
ccagtgtccccaggggc

SEQ ID NO: 2293699 - DNA, 18 bp, Homo sapiens
ccagtgtccccaggggca

SEQ ID NO: 2293700 - DNA, 16 bp, Homo sapiens
ccagttagcccggcca

SEQ ID NO: 2293701 - DNA, 21 bp, Homo sapiens
ccagttagcccggccaaggac

SEQ ID NO: 2293702 - DNA, 23 bp, Homo sapiens
ccagttagcccggccaaggacac

SEQ ID NO: 2293703 - DNA, 23 bp, Homo sapiens
ccagttggactgtggcctcagga

SEQ ID NO: 2293704 - DNA, 14 bp, Homo sapiens
ccataaaataaata

SEQ ID NO: 2293705 - DNA, 17 bp, Homo sapiens
ccataaccaacatttta

SEQ ID NO: 2293706 - DNA, 13 bp, Homo sapiens
ccatatgtagcat

SEQ ID NO: 2293707 - DNA, 19 bp, Homo sapiens
ccatatgtagcattaaata

SEQ ID NO: 2293708 - DNA, 19 bp, Homo sapiens
ccatcagaaattttctaca

SEQ ID NO: 2293709 - DNA, 13 bp, Homo sapiens
ccatcagcccctg

SEQ ID NO: 2293710 - DNA, 16 bp, Homo sapiens
ccatcagcccctgctg

SEQ ID NO: 2293711 - DNA, 17 bp, Homo sapiens
ccatcagcccctgctgc

SEQ ID NO: 2293712 - DNA, 19 bp, Homo sapiens
ccatcagcccctgctgctc

SEQ ID NO: 2293713 - DNA, 15 bp, Homo sapiens
ccatcagtgaaagaa

SEQ ID NO: 2293714 - DNA, 21 bp, Homo sapiens
cccccggaggcgcccacctgc

SEQ ID NO: 2293715 - DNA, 23 bp, Homo sapiens
cccccgtgccaaatcctgggcat

SEQ ID NO: 2293716 - DNA, 20 bp, Homo sapiens
ccccgagccgagctctcctg

SEQ ID NO: 2293717 - DNA, 20 bp, Homo sapiens
ccccgcccgccctcctctgc

SEQ ID NO: 2293718 - DNA, 15 bp, Homo sapiens
ccccgccctcgctcc

SEQ ID NO: 2293719 - DNA, 12 bp, Homo sapiens
ccccgcctcctc

SEQ ID NO: 2293720 - DNA, 12 bp, Homo sapiens
ccccgctctgcc

SEQ ID NO: 2293721 - DNA, 13 bp, Homo sapiens
ccccggacgccgc

SEQ ID NO: 2293722 - DNA, 17 bp, Homo sapiens
ccccggacgctggctcg

SEQ ID NO: 2293723 - DNA, 20 bp, Homo sapiens
ccccggagcaccacggggtc

SEQ ID NO: 2293724 - DNA, 12 bp, Homo sapiens
ccccggagctgg

SEQ ID NO: 2293725 - DNA, 13 bp, Homo sapiens
ccccgtctgcccc

SEQ ID NO: 2293726 - DNA, 14 bp, Homo sapiens
ccccgtctgcccct

SEQ ID NO: 2293727 - DNA, 13 bp, Homo sapiens
ccccgtgcggccc

SEQ ID NO: 2293728 - DNA, 14 bp, Homo sapiens
ccccgtgcggcccg

SEQ ID NO: 2293729 - DNA, 19 bp, Homo sapiens
ccccgtgtattcaggaccc

SEQ ID NO: 2293730 - DNA, 15 bp, Homo sapiens
cccctcccccgcaga

SEQ ID NO: 2293731 - DNA, 18 bp, Homo sapiens
cccctcccccgcagacag

SEQ ID NO: 2293732 - DNA, 12 bp, Homo sapiens
cccctccccgcc

SEQ ID NO: 2293733 - DNA, 12 bp, Homo sapiens
cccctccccggc

SEQ ID NO: 2293734 - DNA, 15 bp, Homo sapiens
cccctcccgcttcct

SEQ ID NO: 2293735 - DNA, 13 bp, Homo sapiens
cccctcctccttg

SEQ ID NO: 2293736 - DNA, 10 bp, Homo sapiens
cccctcctcg

SEQ ID NO: 2293737 - DNA, 21 bp, Homo sapiens
cccctcctcgggcgcctgcgc

SEQ ID NO: 2293738 - DNA, 15 bp, Homo sapiens
cccctgcgcaggccc

SEQ ID NO: 2293739 - DNA, 15 bp, Homo sapiens
cccctgctactgcca

SEQ ID NO: 2293740 - DNA, 23 bp, Homo sapiens
cccctgctgctcctcggccagag

SEQ ID NO: 2293741 - DNA, 14 bp, Homo sapiens
cccctgctggacca

SEQ ID NO: 2293742 - DNA, 16 bp, Homo sapiens
cccctggacaggcttc

SEQ ID NO: 2293743 - DNA, 15 bp, Homo sapiens
ccccttgaccccaca

SEQ ID NO: 2293744 - DNA, 22 bp, Homo sapiens
ccccttgccacatcgcagcccc

SEQ ID NO: 2293745 - DNA, 13 bp, Homo sapiens
ccccttgcttcta

SEQ ID NO: 2293746 - DNA, 16 bp, Homo sapiens
cccgagagctgggact

SEQ ID NO: 2293747 - DNA, 18 bp, Homo sapiens
cccgagcgcgtgccttcc

SEQ ID NO: 2293748 - DNA, 15 bp, Homo sapiens
cccgcagacagacag

SEQ ID NO: 2293749 - DNA, 16 bp, Homo sapiens
cccgcagacagacaga

SEQ ID NO: 2293750 - DNA, 12 bp, Homo sapiens
cccgcagcacca

SEQ ID NO: 2293751 - DNA, 12 bp, Homo sapiens
cccgccccagag

SEQ ID NO: 2293752 - DNA, 13 bp, Homo sapiens
cccgccccagaga

SEQ ID NO: 2293753 - DNA, 15 bp, Homo sapiens
cccgcccgccctcct

SEQ ID NO: 2293754 - DNA, 15 bp, Homo sapiens
cccgccctcctctgc

SEQ ID NO: 2293755 - DNA, 16 bp, Homo sapiens
cccgccctcctctgcc

SEQ ID NO: 2293756 - DNA, 17 bp, Homo sapiens
cccgccctcctctgccc

SEQ ID NO: 2293757 - DNA, 22 bp, Homo sapiens
cccgccggccgcgcaccgccat

SEQ ID NO: 2293758 - DNA, 21 bp, Homo sapiens
cccgccggttggccggctggc

SEQ ID NO: 2293759 - DNA, 22 bp, Homo sapiens
cccgcctcaaggaagagccagc

SEQ ID NO: 2293760 - DNA, 17 bp, Homo sapiens
cccgcctcctccctgcc

SEQ ID NO: 2293761 - DNA, 19 bp, Homo sapiens
cccgcctcctccctgcctg

SEQ ID NO: 2293762 - DNA, 15 bp, Homo sapiens
cccgcgcgtgccccc

SEQ ID NO: 2293763 - DNA, 18 bp, Homo sapiens
cccgcgcgtgcccccagc

SEQ ID NO: 2293764 - DNA, 19 bp, Homo sapiens
cccgcgcgtgcccccagcg

SEQ ID NO: 2293765 - DNA, 23 bp, Homo sapiens
cccgctcaacctctcagatccct

SEQ ID NO: 2293766 - DNA, 11 bp, Homo sapiens
cccgctctccc

SEQ ID NO: 2293767 - DNA, 20 bp, Homo sapiens
cccgctgcctggcgggcagc

SEQ ID NO: 2293768 - DNA, 17 bp, Homo sapiens
cccggaggcgcccacct

SEQ ID NO: 2293769 - DNA, 21 bp, Homo sapiens
cccggaggcgcccacctgccc

SEQ ID NO: 2293770 - DNA, 22 bp, Homo sapiens
cccggatagaggacacggaccc

SEQ ID NO: 2293771 - DNA, 12 bp, Homo sapiens
cccggcagcccc

SEQ ID NO: 2293772 - DNA, 19 bp, Homo sapiens
cccggcatcatttcccctc

SEQ ID NO: 2293773 - DNA, 13 bp, Homo sapiens
cccggcccacgca

SEQ ID NO: 2293774 - DNA, 15 bp, Homo sapiens
cccggcccacgcaga

SEQ ID NO: 2293775 - DNA, 17 bp, Homo sapiens
cccggcccacgcagagc

SEQ ID NO: 2293776 - DNA, 13 bp, Homo sapiens
cccggccccgcgc

SEQ ID NO: 2293777 - DNA, 20 bp, Homo sapiens
cccggccccgcgcgtgcccc

SEQ ID NO: 2293778 - DNA, 18 bp, Homo sapiens
cccgtccgtccgcccgcc

SEQ ID NO: 2293779 - DNA, 12 bp, Homo sapiens
cccgtctgcccc

SEQ ID NO: 2293780 - DNA, 13 bp, Homo sapiens
cccgtctgcccct

SEQ ID NO: 2293781 - DNA, 16 bp, Homo sapiens
cccgtgcgcagccgcg

SEQ ID NO: 2293782 - DNA, 21 bp, Homo sapiens
ccctaaagatggcgcacccgg

SEQ ID NO: 2293783 - DNA, 21 bp, Homo sapiens
ccctaagttcctatttcattt

SEQ ID NO: 2293784 - DNA, 14 bp, Homo sapiens
ccctactgagaaac

SEQ ID NO: 2293785 - DNA, 18 bp, Homo sapiens
ccctatctatgtcctgga

SEQ ID NO: 2293786 - DNA, 12 bp, Homo sapiens
ccctcagtctac

SEQ ID NO: 2293787 - DNA, 19 bp, Homo sapiens
ccctccaggccgacaggag

SEQ ID NO: 2293788 - DNA, 16 bp, Homo sapiens
ccctccccgcctcctc

SEQ ID NO: 2293789 - DNA, 14 bp, Homo sapiens
ccctcccgcttcct

SEQ ID NO: 2293790 - DNA, 20 bp, Homo sapiens
ccctcccgcttcctccggct

SEQ ID NO: 2293791 - DNA, 15 bp, Homo sapiens
ccctccgtccccagg

SEQ ID NO: 2293792 - DNA, 17 bp, Homo sapiens
ccctccgtcctggcagg

SEQ ID NO: 2293793 - DNA, 14 bp, Homo sapiens
ccctcctcccccac

SEQ ID NO: 2293794 - DNA, 20 bp, Homo sapiens
ccctcctccttgctgatttg

SEQ ID NO: 2293795 - DNA, 21 bp, Homo sapiens
ccctcctcgggcgcctgcgct

SEQ ID NO: 2293796 - DNA, 15 bp, Homo sapiens
ccctcctctcctcgt

SEQ ID NO: 2293797 - DNA, 12 bp, Homo sapiens
ccctcctctgcc

SEQ ID NO: 2293798 - DNA, 13 bp, Homo sapiens
ccctcctctgccc

SEQ ID NO: 2293799 - DNA, 17 bp, Homo sapiens
ccctcggggcaggaagt

SEQ ID NO: 2293800 - DNA, 17 bp, Homo sapiens
ccctctcctgcgtgtgc

SEQ ID NO: 2293801 - DNA, 13 bp, Homo sapiens
ccctctctcacca

SEQ ID NO: 2293802 - DNA, 14 bp, Homo sapiens
ccctctgctgcaca

SEQ ID NO: 2293803 - DNA, 19 bp, Homo sapiens
ccctctgtttcccctcaga

SEQ ID NO: 2293804 - DNA, 19 bp, Homo sapiens
ccctgacttcccagctggc

SEQ ID NO: 2293805 - DNA, 20 bp, Homo sapiens
ccctgacttcccagctggca

SEQ ID NO: 2293806 - DNA, 15 bp, Homo sapiens
ccctgcaccttgggc

SEQ ID NO: 2293807 - DNA, 23 bp, Homo sapiens
ccctgccaccctctgctgcacag

SEQ ID NO: 2293808 - DNA, 12 bp, Homo sapiens
ccctgccctccc

SEQ ID NO: 2293809 - DNA, 16 bp, Homo sapiens
ccctgccctggccact

SEQ ID NO: 2293810 - DNA, 21 bp, Homo sapiens
ccctgccctggccactggccc

SEQ ID NO: 2293811 - DNA, 19 bp, Homo sapiens
ccctgcctggcggcagggg

SEQ ID NO: 2293812 - DNA, 15 bp, Homo sapiens
ccctgcgcaggccct

SEQ ID NO: 2293813 - DNA, 22 bp, Homo sapiens
ccctgctacctgctgagccaga

SEQ ID NO: 2293814 - DNA, 23 bp, Homo sapiens
ccctgctcatcacccggatagag

SEQ ID NO: 2293815 - DNA, 13 bp, Homo sapiens
ccctgctggacca

SEQ ID NO: 2293816 - DNA, 14 bp, Homo sapiens
ccctggagcccggc

SEQ ID NO: 2293817 - DNA, 10 bp, Homo sapiens
ccctggaggg

SEQ ID NO: 2293818 - DNA, 11 bp, Homo sapiens
ccctggagggg

SEQ ID NO: 2293819 - DNA, 12 bp, Homo sapiens
ccctggaggggc

SEQ ID NO: 2293820 - DNA, 15 bp, Homo sapiens
ccctggaggggccca

SEQ ID NO: 2293821 - DNA, 15 bp, Homo sapiens
ccctggagtggcatg

SEQ ID NO: 2293822 - DNA, 16 bp, Homo sapiens
ccctggagtggcatgg

SEQ ID NO: 2293823 - DNA, 22 bp, Homo sapiens
ccctggagtggcatggtcctgt

SEQ ID NO: 2293824 - DNA, 23 bp, Homo sapiens
ccctggagtggcatggtcctgtg

SEQ ID NO: 2293825 - DNA, 18 bp, Homo sapiens
ccctggccactggccctg

SEQ ID NO: 2293826 - DNA, 20 bp, Homo sapiens
ccctggccactggccctgtt

SEQ ID NO: 2293827 - DNA, 11 bp, Homo sapiens
ccctgggagag

SEQ ID NO: 2293828 - DNA, 14 bp, Homo sapiens
ccctggggtctctg

SEQ ID NO: 2293829 - DNA, 19 bp, Homo sapiens
ccctggggtctctgagcag

SEQ ID NO: 2293830 - DNA, 21 bp, Homo sapiens
ccctggggtctctgagcagtg

SEQ ID NO: 2293831 - DNA, 20 bp, Homo sapiens
ccctggggtttccacacagg

SEQ ID NO: 2293832 - DNA, 22 bp, Homo sapiens
ccctggggtttccacacaggcc

SEQ ID NO: 2293833 - DNA, 13 bp, Homo sapiens
ccctgtctaatga

SEQ ID NO: 2293834 - DNA, 16 bp, Homo sapiens
ccctgtttctccccac

SEQ ID NO: 2293835 - DNA, 15 bp, Homo sapiens
cccttacgtgagtcc

SEQ ID NO: 2293836 - DNA, 17 bp, Homo sapiens
cccttacgtgagtcctg

SEQ ID NO: 2293837 - DNA, 11 bp, Homo sapiens
cccttccagga

SEQ ID NO: 2293838 - DNA, 13 bp, Homo sapiens
cccttccaggagt

SEQ ID NO: 2293839 - DNA, 15 bp, Homo sapiens
cccttgactgttggg

SEQ ID NO: 2293840 - DNA, 12 bp, Homo sapiens
cccttgcttcta

SEQ ID NO: 2293841 - DNA, 23 bp, Homo sapiens
cccttgcttctaagggatccaga

SEQ ID NO: 2293842 - DNA, 17 bp, Homo sapiens
cccttgggatgggcaca

SEQ ID NO: 2293843 - DNA, 22 bp, Homo sapiens
cccttgggatgggcacaggctg

SEQ ID NO: 2293844 - DNA, 18 bp, Homo sapiens
ccctttcacactgtggtg

SEQ ID NO: 2293845 - DNA, 17 bp, Homo sapiens
ccgaaaacgtggctgct

SEQ ID NO: 2293846 - DNA, 18 bp, Homo sapiens
ccgaaaggtcacctcact

SEQ ID NO: 2293847 - DNA, 23 bp, Homo sapiens
ccgaagaccttctgaagatctca

SEQ ID NO: 2293848 - DNA, 17 bp, Homo sapiens
ccgaagagcaaacaaaa

SEQ ID NO: 2293849 - DNA, 15 bp, Homo sapiens
ccgactccccctccc

SEQ ID NO: 2293850 - DNA, 19 bp, Homo sapiens
ccgactccccctccccggc

SEQ ID NO: 2293851 - DNA, 20 bp, Homo sapiens
ccgactccccctccccggca

SEQ ID NO: 2293852 - DNA, 14 bp, Homo sapiens
ccgagcccagggga

SEQ ID NO: 2293853 - DNA, 13 bp, Homo sapiens
ccgagccgagctc

SEQ ID NO: 2293854 - DNA, 17 bp, Homo sapiens
ccgagctctcctgggcc

SEQ ID NO: 2293855 - DNA, 18 bp, Homo sapiens
ccgagctctcctgggcca

SEQ ID NO: 2293856 - DNA, 22 bp, Homo sapiens
ccgagctctcctgggccagggt

SEQ ID NO: 2293857 - DNA, 14 bp, Homo sapiens
ccgaggttcctgtc

SEQ ID NO: 2293858 - DNA, 18 bp, Homo sapiens
ccgatggcccgagagctg

SEQ ID NO: 2293859 - DNA, 15 bp, Homo sapiens
ccgcaaccacttgct

SEQ ID NO: 2293860 - DNA, 13 bp, Homo sapiens
ccgcacccctcct

SEQ ID NO: 2293861 - DNA, 14 bp, Homo sapiens
ccgcacccctcctc

SEQ ID NO: 2293862 - DNA, 18 bp, Homo sapiens
ccgcacccctcctccttg

SEQ ID NO: 2293863 - DNA, 23 bp, Homo sapiens
ccgcagatcctgtcccatgggct

SEQ ID NO: 2293864 - DNA, 15 bp, Homo sapiens
ccgcagcaccagcct

SEQ ID NO: 2293865 - DNA, 17 bp, Homo sapiens
ccgcagcaccagcctga

SEQ ID NO: 2293866 - DNA, 21 bp, Homo sapiens
ccgcagcaccagcctgagcca

SEQ ID NO: 2293867 - DNA, 16 bp, Homo sapiens
ccgcccaccccgctgc

SEQ ID NO: 2293868 - DNA, 10 bp, Homo sapiens
ccgccccaga

SEQ ID NO: 2293869 - DNA, 12 bp, Homo sapiens
ccgccccagaga

SEQ ID NO: 2293870 - DNA, 13 bp, Homo sapiens
ccgccccagagac

SEQ ID NO: 2293871 - DNA, 14 bp, Homo sapiens
ccgccccagagact

SEQ ID NO: 2293872 - DNA, 22 bp, Homo sapiens
ccgccccagagactgcccaccc

SEQ ID NO: 2293873 - DNA, 14 bp, Homo sapiens
ccgccccagcctcc

SEQ ID NO: 2293874 - DNA, 16 bp, Homo sapiens
ccgccccagcctcctg

SEQ ID NO: 2293875 - DNA, 14 bp, Homo sapiens
ccgcccccgccctc

SEQ ID NO: 2293876 - DNA, 14 bp, Homo sapiens
ccgcccgcccaccc

SEQ ID NO: 2293877 - DNA, 14 bp, Homo sapiens
ccgcccgccctcct

SEQ ID NO: 2293878 - DNA, 22 bp, Homo sapiens
ccgccggttggccggctggccg

SEQ ID NO: 2293879 - DNA, 20 bp, Homo sapiens
ccgcctcaaggaagagccag

SEQ ID NO: 2293880 - DNA, 13 bp, Homo sapiens
ccgcctcctccag

SEQ ID NO: 2293881 - DNA, 14 bp, Homo sapiens
ccgcctcctccaga

SEQ ID NO: 2293882 - DNA, 15 bp, Homo sapiens
ccgcctcctccagac

SEQ ID NO: 2293883 - DNA, 18 bp, Homo sapiens
ccgcctcctccctgcctg

SEQ ID NO: 2293884 - DNA, 19 bp, Homo sapiens
ccgcctcctccctgcctgg

SEQ ID NO: 2293885 - DNA, 15 bp, Homo sapiens
ccgcctcgggccgcc

SEQ ID NO: 2293886 - DNA, 21 bp, Homo sapiens
ccgcctcgggccgcctcctcc

SEQ ID NO: 2293887 - DNA, 18 bp, Homo sapiens
ccgcgaagtccgaggcct

SEQ ID NO: 2293888 - DNA, 13 bp, Homo sapiens
ccgcgcaccgcca

SEQ ID NO: 2293889 - DNA, 15 bp, Homo sapiens
ccgcgcgtgccccca

SEQ ID NO: 2293890 - DNA, 15 bp, Homo sapiens
ccgcgctctgcccct

SEQ ID NO: 2293891 - DNA, 16 bp, Homo sapiens
ccgcggccctcctcag

SEQ ID NO: 2293892 - DNA, 15 bp, Homo sapiens
ccgctcaacctctca

SEQ ID NO: 2293893 - DNA, 19 bp, Homo sapiens
ccgctcccgcagcgggcgc

SEQ ID NO: 2293894 - DNA, 18 bp, Homo sapiens
ccgctctcccagacctag

SEQ ID NO: 2293895 - DNA, 19 bp, Homo sapiens
ccgctctgccatcagcccc

SEQ ID NO: 2293896 - DNA, 14 bp, Homo sapiens
ccgctgcccccacc

SEQ ID NO: 2293897 - DNA, 17 bp, Homo sapiens
ccgctgcccccaccctg

SEQ ID NO: 2293898 - DNA, 12 bp, Homo sapiens
ccgctgcctggc

SEQ ID NO: 2293899 - DNA, 21 bp, Homo sapiens
ccgctgcctggcgggcagccc

SEQ ID NO: 2293900 - DNA, 19 bp, Homo sapiens
ccgctgcttgagtggacag

SEQ ID NO: 2293901 - DNA, 18 bp, Homo sapiens
ccgcttcagacacgcact

SEQ ID NO: 2293902 - DNA, 15 bp, Homo sapiens
ccgcttcctccggct

SEQ ID NO: 2293903 - DNA, 13 bp, Homo sapiens
ccggacgctggct

SEQ ID NO: 2293904 - DNA, 14 bp, Homo sapiens
ccggacgctggctc

SEQ ID NO: 2293905 - DNA, 18 bp, Homo sapiens
ccggactgaccgaaggga

SEQ ID NO: 2293906 - DNA, 10 bp, Homo sapiens
ccggagctgg

SEQ ID NO: 2293907 - DNA, 15 bp, Homo sapiens
ccggagctgggaagg

SEQ ID NO: 2293908 - DNA, 20 bp, Homo sapiens
ccggaggcgcccacctgccc

SEQ ID NO: 2293909 - DNA, 22 bp, Homo sapiens
ccggaggcgcccacctgcccag

SEQ ID NO: 2293910 - DNA, 17 bp, Homo sapiens
ccggagtccctgcaggt

SEQ ID NO: 2293911 - DNA, 17 bp, Homo sapiens
ccggcagaggcagggcc

SEQ ID NO: 2293912 - DNA, 18 bp, Homo sapiens
ccggcagaggcagggccc

SEQ ID NO: 2293913 - DNA, 19 bp, Homo sapiens
ccggcagaggcagggccct

SEQ ID NO: 2293914 - DNA, 17 bp, Homo sapiens
ccggccaaggacactga

SEQ ID NO: 2293915 - DNA, 17 bp, Homo sapiens
ccggcccaacctcgccc

SEQ ID NO: 2293916 - DNA, 18 bp, Homo sapiens
ccggcccaacctcgccct

SEQ ID NO: 2293917 - DNA, 19 bp, Homo sapiens
ccggcccaacctcgccctc

SEQ ID NO: 2293918 - DNA, 18 bp, Homo sapiens
ccggcccacgcagagccc

SEQ ID NO: 2293919 - DNA, 19 bp, Homo sapiens
ccggcccacgcagagcccc

SEQ ID NO: 2293920 - DNA, 21 bp, Homo sapiens
ccggccgcgcaccgccatgca

SEQ ID NO: 2293921 - DNA, 12 bp, Homo sapiens
ccggcctgcagc

SEQ ID NO: 2293922 - DNA, 13 bp, Homo sapiens
ccggcctgcagcc

SEQ ID NO: 2293923 - DNA, 16 bp, Homo sapiens
ccggcctgcagcccag

SEQ ID NO: 2293924 - DNA, 15 bp, Homo sapiens
ccggctggacctggg

SEQ ID NO: 2293925 - DNA, 14 bp, Homo sapiens
ccgggaagcaaatg

SEQ ID NO: 2293926 - DNA, 20 bp, Homo sapiens
ccgggagatccgccctgggc

SEQ ID NO: 2293927 - DNA, 23 bp, Homo sapiens
ccgggcacggtggctcacacctg

SEQ ID NO: 2293928 - DNA, 18 bp, Homo sapiens
ccgggccccatggtcaca

SEQ ID NO: 2293929 - DNA, 18 bp, Homo sapiens
ccgggctggcctgacaca

SEQ ID NO: 2293930 - DNA, 18 bp, Homo sapiens
ccggggccatggaagctg

SEQ ID NO: 2293931 - DNA, 19 bp, Homo sapiens
ccggggccatggaagctgg

SEQ ID NO: 2293932 - DNA, 15 bp, Homo sapiens
ccggggctggccctg

SEQ ID NO: 2293933 - DNA, 19 bp, Homo sapiens
ccgggtgcgtgaccggccc

SEQ ID NO: 2293934 - DNA, 21 bp, Homo sapiens
ccgggtgcgtgaccggcccgc

SEQ ID NO: 2293935 - DNA, 13 bp, Homo sapiens
ccggtccaccccg

SEQ ID NO: 2293936 - DNA, 12 bp, Homo sapiens
ccgtccccaggg

SEQ ID NO: 2293937 - DNA, 14 bp, Homo sapiens
ccgtcccggccccg

SEQ ID NO: 2293938 - DNA, 22 bp, Homo sapiens
ccgtccctgacttcccagctgg

SEQ ID NO: 2293939 - DNA, 12 bp, Homo sapiens
ccgtccgcccgc

SEQ ID NO: 2293940 - DNA, 18 bp, Homo sapiens
ccgtcctggcagggcagg

SEQ ID NO: 2293941 - DNA, 19 bp, Homo sapiens
ccgtgccaaatcctgggca

SEQ ID NO: 2293942 - DNA, 13 bp, Homo sapiens
ccgtgcgcagccg

SEQ ID NO: 2293943 - DNA, 14 bp, Homo sapiens
ccgtgcggcccgtg

SEQ ID NO: 2293944 - DNA, 19 bp, Homo sapiens
ccgtgcggcccgtgcgcag

SEQ ID NO: 2293945 - DNA, 20 bp, Homo sapiens
ccgtgcggcccgtgcgcagc

SEQ ID NO: 2293946 - DNA, 18 bp, Homo sapiens
ccgtggtgtgaggccccc

SEQ ID NO: 2293947 - DNA, 21 bp, Homo sapiens
ccgtggtgtgaggcccccgga

SEQ ID NO: 2293948 - DNA, 21 bp, Homo sapiens
cctaaataggtttttcttgct

SEQ ID NO: 2293949 - DNA, 12 bp, Homo sapiens
cctacatctgaa

SEQ ID NO: 2293950 - DNA, 14 bp, Homo sapiens
cctaccaaatataa

SEQ ID NO: 2293951 - DNA, 18 bp, Homo sapiens
cctaccaaatataaactt

SEQ ID NO: 2293952 - DNA, 16 bp, Homo sapiens
cctaggctgctgctgt

SEQ ID NO: 2293953 - DNA, 18 bp, Homo sapiens
cctatactggttatagtt

SEQ ID NO: 2293954 - DNA, 22 bp, Homo sapiens
cctatctgtaagaggtactaaa

SEQ ID NO: 2293955 - DNA, 17 bp, Homo sapiens
cctcaagcgatcctcct

SEQ ID NO: 2293956 - DNA, 17 bp, Homo sapiens
cctcaaggaagagccag

SEQ ID NO: 2293957 - DNA, 18 bp, Homo sapiens
cctcaaggaagagccagc

SEQ ID NO: 2293958 - DNA, 20 bp, Homo sapiens
cctcaaggaagagccagccg

SEQ ID NO: 2293959 - DNA, 16 bp, Homo sapiens
cctcacccctgcaggc

SEQ ID NO: 2293960 - DNA, 19 bp, Homo sapiens
cctcactgtagcaggttct

SEQ ID NO: 2293961 - DNA, 15 bp, Homo sapiens
cctcatctccatgct

SEQ ID NO: 2293962 - DNA, 14 bp, Homo sapiens
cctcatgggagtca

SEQ ID NO: 2293963 - DNA, 23 bp, Homo sapiens
cctcattcagcagaatgactctg

SEQ ID NO: 2293964 - DNA, 16 bp, Homo sapiens
cctccacctgggagat

SEQ ID NO: 2293965 - DNA, 17 bp, Homo sapiens
cctccacctgggagatg

SEQ ID NO: 2293966 - DNA, 12 bp, Homo sapiens
cctccagctcct

SEQ ID NO: 2293967 - DNA, 15 bp, Homo sapiens
cctccagctcctgcc

SEQ ID NO: 2293968 - DNA, 21 bp, Homo sapiens
cctccagctcctgccccgccg

SEQ ID NO: 2293969 - DNA, 18 bp, Homo sapiens
cctccatccacacacagc

SEQ ID NO: 2293970 - DNA, 17 bp, Homo sapiens
cctccatgattccaagg

SEQ ID NO: 2293971 - DNA, 21 bp, Homo sapiens
cctccatgtaccttgtgtact

SEQ ID NO: 2293972 - DNA, 12 bp, Homo sapiens
cctcccccaggc

SEQ ID NO: 2293973 - DNA, 12 bp, Homo sapiens
cctccccgcctc

SEQ ID NO: 2293974 - DNA, 14 bp, Homo sapiens
cctccccgcctcct

SEQ ID NO: 2293975 - DNA, 16 bp, Homo sapiens
cctccccgcctcctcc

SEQ ID NO: 2293976 - DNA, 16 bp, Homo sapiens
cctccccggcatcatt

SEQ ID NO: 2293977 - DNA, 22 bp, Homo sapiens
cctcccctcttcttgcggcacc

SEQ ID NO: 2293978 - DNA, 21 bp, Homo sapiens
cctcccctgctacctgctgag

SEQ ID NO: 2293979 - DNA, 14 bp, Homo sapiens
cctcccgccgcctc

SEQ ID NO: 2293980 - DNA, 12 bp, Homo sapiens
cctccctggctt

SEQ ID NO: 2293981 - DNA, 13 bp, Homo sapiens
cctccggctggac

SEQ ID NO: 2293982 - DNA, 15 bp, Homo sapiens
cctccggctggacct

SEQ ID NO: 2293983 - DNA, 19 bp, Homo sapiens
cctccggttgcatactgga

SEQ ID NO: 2293984 - DNA, 15 bp, Homo sapiens
cctccgtccccaggg

SEQ ID NO: 2293985 - DNA, 20 bp, Homo sapiens
cctcctcccccacgcctcca

SEQ ID NO: 2293986 - DNA, 21 bp, Homo sapiens
cctcctcccccacgcctccat

SEQ ID NO: 2293987 - DNA, 16 bp, Homo sapiens
cctcctccttgctgat

SEQ ID NO: 2293988 - DNA, 20 bp, Homo sapiens
cctcctcgggcgcctgcgct

SEQ ID NO: 2293989 - DNA, 21 bp, Homo sapiens
cctcctcgggcgcctgcgctc

SEQ ID NO: 2293990 - DNA, 23 bp, Homo sapiens
cctcctcgggcgcctgcgctcct

SEQ ID NO: 2293991 - DNA, 23 bp, Homo sapiens
cctcctctcctcgtccggcctgc

SEQ ID NO: 2293992 - DNA, 12 bp, Homo sapiens
cctcctctgccc

SEQ ID NO: 2293993 - DNA, 17 bp, Homo sapiens
cctcgacctccctggct

SEQ ID NO: 2293994 - DNA, 18 bp, Homo sapiens
cctcggccagagctccca

SEQ ID NO: 2293995 - DNA, 22 bp, Homo sapiens
cctcggccagagctcccaggac

SEQ ID NO: 2293996 - DNA, 17 bp, Homo sapiens
cctcgggccgcctcctc

SEQ ID NO: 2293997 - DNA, 22 bp, Homo sapiens
cctcgggccgcctcctccagac

SEQ ID NO: 2293998 - DNA, 18 bp, Homo sapiens
cctcgggcgcctgcgctc

SEQ ID NO: 2293999 - DNA, 19 bp, Homo sapiens
cctcggggcaggaagtccc

SEQ ID NO: 2294000 - DNA, 22 bp, Homo sapiens
cctcggggcaggaagtccctga

SEQ ID NO: 2294001 - DNA, 14 bp, Homo sapiens
cctcggtcagcacc

SEQ ID NO: 2294002 - DNA, 18 bp, Homo sapiens
cctcggtcagcaccgtgg

SEQ ID NO: 2294003 - DNA, 19 bp, Homo sapiens
cctcgtccggcctgcagcc

SEQ ID NO: 2294004 - DNA, 21 bp, Homo sapiens
cctcgtccggcctgcagccca

SEQ ID NO: 2294005 - DNA, 14 bp, Homo sapiens
cctctaccaagctg

SEQ ID NO: 2294006 - DNA, 15 bp, Homo sapiens
cctctaggcctcagt

SEQ ID NO: 2294007 - DNA, 17 bp, Homo sapiens
cctctaggcctcagtgt

SEQ ID NO: 2294008 - DNA, 19 bp, Homo sapiens
cctctcctcgtccggcctg

SEQ ID NO: 2294009 - DNA, 15 bp, Homo sapiens
cctctccttgtcaca

SEQ ID NO: 2294010 - DNA, 16 bp, Homo sapiens
cctctccttttctcca

SEQ ID NO: 2294011 - DNA, 22 bp, Homo sapiens
cctctcgccaagccatcacagg

SEQ ID NO: 2294012 - DNA, 12 bp, Homo sapiens
cctctctcacca

SEQ ID NO: 2294013 - DNA, 14 bp, Homo sapiens
cctctctcaccagc

SEQ ID NO: 2294014 - DNA, 18 bp, Homo sapiens
cctctctcaccagccttg

SEQ ID NO: 2294015 - DNA, 22 bp, Homo sapiens
cctctgaaaatatttttttcta

SEQ ID NO: 2294016 - DNA, 17 bp, Homo sapiens
cctctgaactgctgctg

SEQ ID NO: 2294017 - DNA, 19 bp, Homo sapiens
cctctgaactgctgctggt

SEQ ID NO: 2294018 - DNA, 12 bp, Homo sapiens
cctctgcagcct

SEQ ID NO: 2294019 - DNA, 15 bp, Homo sapiens
cctctgccccctccc

SEQ ID NO: 2294020 - DNA, 16 bp, Homo sapiens
cctctgccccctcccc

SEQ ID NO: 2294021 - DNA, 21 bp, Homo sapiens
cctctgccccctcccccgcag

SEQ ID NO: 2294022 - DNA, 17 bp, Homo sapiens
cctcttcctccccatgt

SEQ ID NO: 2294023 - DNA, 16 bp, Homo sapiens
cctcttcctcctgaca

SEQ ID NO: 2294024 - DNA, 14 bp, Homo sapiens
cctctttccccact

SEQ ID NO: 2294025 - DNA, 15 bp, Homo sapiens
cctctttccccactg

SEQ ID NO: 2294026 - DNA, 12 bp, Homo sapiens
cctgaaaatatc

SEQ ID NO: 2294027 - DNA, 13 bp, Homo sapiens
cctgaaacacttt

SEQ ID NO: 2294028 - DNA, 22 bp, Homo sapiens
cctgacacaatggtagctctga

SEQ ID NO: 2294029 - DNA, 14 bp, Homo sapiens
cctgacaccccact

SEQ ID NO: 2294030 - DNA, 13 bp, Homo sapiens
cctgacttcccag

SEQ ID NO: 2294031 - DNA, 14 bp, Homo sapiens
cctgacttcccagc

SEQ ID NO: 2294032 - DNA, 15 bp, Homo sapiens
cctgacttcccagct

SEQ ID NO: 2294033 - DNA, 16 bp, Homo sapiens
cctgacttcccagctg

SEQ ID NO: 2294034 - DNA, 15 bp, Homo sapiens
cctgagagcagaatg

SEQ ID NO: 2294035 - DNA, 18 bp, Homo sapiens
cctgagagggagagactg

SEQ ID NO: 2294036 - DNA, 18 bp, Homo sapiens
cctgagccagatttcact

SEQ ID NO: 2294037 - DNA, 22 bp, Homo sapiens
cctgaggcaggagggcatgtgc

SEQ ID NO: 2294038 - DNA, 14 bp, Homo sapiens
cctgaggctggggc

SEQ ID NO: 2294039 - DNA, 15 bp, Homo sapiens
cctgagggaagccca

SEQ ID NO: 2294040 - DNA, 16 bp, Homo sapiens
cctgagggaagcccac

SEQ ID NO: 2294041 - DNA, 17 bp, Homo sapiens
cctgagggaagcccacc

SEQ ID NO: 2294042 - DNA, 22 bp, Homo sapiens
cctgagggaagcccacccgccc

SEQ ID NO: 2294043 - DNA, 17 bp, Homo sapiens
cctgagggtttccacct

SEQ ID NO: 2294044 - DNA, 20 bp, Homo sapiens
cctgaggtccgatggcccga

SEQ ID NO: 2294045 - DNA, 18 bp, Homo sapiens
cctgattattgaatgtta

SEQ ID NO: 2294046 - DNA, 13 bp, Homo sapiens
cctgcagcccaga

SEQ ID NO: 2294047 - DNA, 18 bp, Homo sapiens
cctgcagctcctctgcct

SEQ ID NO: 2294048 - DNA, 20 bp, Homo sapiens
cctgcagctcctctgccttt

SEQ ID NO: 2294049 - DNA, 22 bp, Homo sapiens
cctgcaggcggtatccagaggt

SEQ ID NO: 2294050 - DNA, 17 bp, Homo sapiens
cctgcattcacagctac

SEQ ID NO: 2294051 - DNA, 18 bp, Homo sapiens
cctgcatttaagaacaga

SEQ ID NO: 2294052 - DNA, 15 bp, Homo sapiens
cctgccaccctctgc

SEQ ID NO: 2294053 - DNA, 19 bp, Homo sapiens
cctgccaccctctgctgca

SEQ ID NO: 2294054 - DNA, 20 bp, Homo sapiens
cctgccaccctctgctgcac

SEQ ID NO: 2294055 - DNA, 23 bp, Homo sapiens
cctgccccgccggccgcgcaccg

SEQ ID NO: 2294056 - DNA, 18 bp, Homo sapiens
cctgccccggcccaacct

SEQ ID NO: 2294057 - DNA, 17 bp, Homo sapiens
cctgccctcccccacgg

SEQ ID NO: 2294058 - DNA, 14 bp, Homo sapiens
cctgccctgcacct

SEQ ID NO: 2294059 - DNA, 17 bp, Homo sapiens
cctgccctggccactgg

SEQ ID NO: 2294060 - DNA, 16 bp, Homo sapiens
cctgccgacggagcca

SEQ ID NO: 2294061 - DNA, 15 bp, Homo sapiens
cctgccgctgcttga

SEQ ID NO: 2294062 - DNA, 15 bp, Homo sapiens
cctgcctaaatttca

SEQ ID NO: 2294063 - DNA, 21 bp, Homo sapiens
cctgcctctgaactgctgctg

SEQ ID NO: 2294064 - DNA, 13 bp, Homo sapiens
cctgcgcaggccc

SEQ ID NO: 2294065 - DNA, 15 bp, Homo sapiens
cctgcgcaggccctc

SEQ ID NO: 2294066 - DNA, 20 bp, Homo sapiens
cctgcgctcctctgcagcct

SEQ ID NO: 2294067 - DNA, 16 bp, Homo sapiens
cctgctgagtggtcca

SEQ ID NO: 2294068 - DNA, 21 bp, Homo sapiens
cctgctgctcctcggccagag

SEQ ID NO: 2294069 - DNA, 22 bp, Homo sapiens
cctgctgctcctcggccagagc

SEQ ID NO: 2294070 - DNA, 19 bp, Homo sapiens
cctgctgctcgggaaggcc

SEQ ID NO: 2294071 - DNA, 20 bp, Homo sapiens
cctgctgctcgggaaggcct

SEQ ID NO: 2294072 - DNA, 22 bp, Homo sapiens
cctggaagagccgagcacctgt

SEQ ID NO: 2294073 - DNA, 20 bp, Homo sapiens
cctggagaaggaagctgcct

SEQ ID NO: 2294074 - DNA, 14 bp, Homo sapiens
cctggaggctggac

SEQ ID NO: 2294075 - DNA, 13 bp, Homo sapiens
cctggaggggccc

SEQ ID NO: 2294076 - DNA, 13 bp, Homo sapiens
cctggatgttata

SEQ ID NO: 2294077 - DNA, 18 bp, Homo sapiens
cctggcagggcaggcaga

SEQ ID NO: 2294078 - DNA, 21 bp, Homo sapiens
cctggcagggcaggcagagct

SEQ ID NO: 2294079 - DNA, 14 bp, Homo sapiens
cctggcagtgacct

SEQ ID NO: 2294080 - DNA, 16 bp, Homo sapiens
cctggcatgggaatga

SEQ ID NO: 2294081 - DNA, 23 bp, Homo sapiens
cctggcatgggaatgaatgtcag

SEQ ID NO: 2294082 - DNA, 15 bp, Homo sapiens
cctggccactggccc

SEQ ID NO: 2294083 - DNA, 16 bp, Homo sapiens
cctggccactggccct

SEQ ID NO: 2294084 - DNA, 21 bp, Homo sapiens
cctggccctgggccccgcctc

SEQ ID NO: 2294085 - DNA, 14 bp, Homo sapiens
cctggcggcagggg

SEQ ID NO: 2294086 - DNA, 13 bp, Homo sapiens
cctggctctggag

SEQ ID NO: 2294087 - DNA, 13 bp, Homo sapiens
cctggcttgagtg

SEQ ID NO: 2294088 - DNA, 14 bp, Homo sapiens
cctgggagagtgag

SEQ ID NO: 2294089 - DNA, 14 bp, Homo sapiens
cctgggagatgctg

SEQ ID NO: 2294090 - DNA, 22 bp, Homo sapiens
cctgggagatgctgggaccctc

SEQ ID NO: 2294091 - DNA, 19 bp, Homo sapiens
cctgggcatccccagcccc

SEQ ID NO: 2294092 - DNA, 22 bp, Homo sapiens
cctgggcatccccagccccctg

SEQ ID NO: 2294093 - DNA, 14 bp, Homo sapiens
cctgggccagggtc

SEQ ID NO: 2294094 - DNA, 21 bp, Homo sapiens
cctgggccagggtctcgtcag

SEQ ID NO: 2294095 - DNA, 14 bp, Homo sapiens
cctgggccccgcct

SEQ ID NO: 2294096 - DNA, 20 bp, Homo sapiens
cctgggggaggcttccagct

SEQ ID NO: 2294097 - DNA, 21 bp, Homo sapiens
cctgggggaggcttccagctc

SEQ ID NO: 2294098 - DNA, 16 bp, Homo sapiens
cctggggtacttctgt

SEQ ID NO: 2294099 - DNA, 15 bp, Homo sapiens
cctggggtcccccct

SEQ ID NO: 2294100 - DNA, 21 bp, Homo sapiens
cctggggtcccccctccctgt

SEQ ID NO: 2294101 - DNA, 20 bp, Homo sapiens
cctggggtctctgagcagtg

SEQ ID NO: 2294102 - DNA, 17 bp, Homo sapiens
cctggggtttccacaca

SEQ ID NO: 2294103 - DNA, 20 bp, Homo sapiens
cctggggtttccacacaggc

SEQ ID NO: 2294104 - DNA, 23 bp, Homo sapiens
cctggggtttccacacaggccca

SEQ ID NO: 2294105 - DNA, 20 bp, Homo sapiens
cctgggtgtgacctgacacc

SEQ ID NO: 2294106 - DNA, 22 bp, Homo sapiens
cctggtcagttttcacagaggc

SEQ ID NO: 2294107 - DNA, 17 bp, Homo sapiens
cctggtctgcacctcta

SEQ ID NO: 2294108 - DNA, 16 bp, Homo sapiens
cctggttcccccagga

SEQ ID NO: 2294109 - DNA, 19 bp, Homo sapiens
cctgtccactctgctcagg

SEQ ID NO: 2294110 - DNA, 21 bp, Homo sapiens
cctgtccactctgctcagggc

SEQ ID NO: 2294111 - DNA, 17 bp, Homo sapiens
cctgtcccatgggctct

SEQ ID NO: 2294112 - DNA, 20 bp, Homo sapiens
cctgtcccatgggctctggc

SEQ ID NO: 2294113 - DNA, 23 bp, Homo sapiens
cctgtcccatgggctctggcccc

SEQ ID NO: 2294114 - DNA, 19 bp, Homo sapiens
cctgtgaccggggtcctga

SEQ ID NO: 2294115 - DNA, 23 bp, Homo sapiens
cctgtgaccggggtcctgaggct

SEQ ID NO: 2294116 - DNA, 19 bp, Homo sapiens
cctgtgcaaaataaaatga

SEQ ID NO: 2294117 - DNA, 21 bp, Homo sapiens
cctgtgccccgaccccacctg

SEQ ID NO: 2294118 - DNA, 16 bp, Homo sapiens
cctgtgctagaagctc

SEQ ID NO: 2294119 - DNA, 21 bp, Homo sapiens
cctgtgctagaagctccatgg

SEQ ID NO: 2294120 - DNA, 13 bp, Homo sapiens
cctgtgctttcat

SEQ ID NO: 2294121 - DNA, 17 bp, Homo sapiens
cctgtggaaatatgcaa

SEQ ID NO: 2294122 - DNA, 21 bp, Homo sapiens
cctgtggaaatatgcaacctg

SEQ ID NO: 2294123 - DNA, 20 bp, Homo sapiens
cctgtggctccaggagcagc

SEQ ID NO: 2294124 - DNA, 13 bp, Homo sapiens
cctgtgtccacag

SEQ ID NO: 2294125 - DNA, 17 bp, Homo sapiens
cctgttacttaaatagc

SEQ ID NO: 2294126 - DNA, 22 bp, Homo sapiens
cctgttacttaaatagcatctg

SEQ ID NO: 2294127 - DNA, 24 bp, Homo sapiens
cctgttacttaaatagcatctgct

SEQ ID NO: 2294128 - DNA, 18 bp, Homo sapiens
cctgttaggggaaaatag

SEQ ID NO: 2294129 - DNA, 12 bp, Homo sapiens
cctgttgcactg

SEQ ID NO: 2294130 - DNA, 13 bp, Homo sapiens
cctgtttccaggg

SEQ ID NO: 2294131 - DNA, 16 bp, Homo sapiens
cctgtttctgcagcca

SEQ ID NO: 2294132 - DNA, 14 bp, Homo sapiens
cctgtttggggagg

SEQ ID NO: 2294133 - DNA, 16 bp, Homo sapiens
cctgtttggtgaggac

SEQ ID NO: 2294134 - DNA, 14 bp, Homo sapiens
ccttatggaacact

SEQ ID NO: 2294135 - DNA, 20 bp, Homo sapiens
ccttatggaacactctgaga

SEQ ID NO: 2294136 - DNA, 22 bp, Homo sapiens
ccttatggaacactctgagact

SEQ ID NO: 2294137 - DNA, 18 bp, Homo sapiens
ccttcactctccagggta

SEQ ID NO: 2294138 - DNA, 14 bp, Homo sapiens
ccttcagtgccaaa

SEQ ID NO: 2294139 - DNA, 22 bp, Homo sapiens
ccttccaggcgtagggccaggg

SEQ ID NO: 2294140 - DNA, 15 bp, Homo sapiens
ccttcccgcagcacc

SEQ ID NO: 2294141 - DNA, 21 bp, Homo sapiens
ccttcctgttctgtgtctgct

SEQ ID NO: 2294142 - DNA, 22 bp, Homo sapiens
ccttcgcgtatttcaggattct

SEQ ID NO: 2294143 - DNA, 18 bp, Homo sapiens
ccttctaaagtgctggga

SEQ ID NO: 2294144 - DNA, 16 bp, Homo sapiens
ccttctacctgcagga

SEQ ID NO: 2294145 - DNA, 21 bp, Homo sapiens
ccttctatactttctcacatg

SEQ ID NO: 2294146 - DNA, 16 bp, Homo sapiens
ccttgaactgtggcca

SEQ ID NO: 2294147 - DNA, 17 bp, Homo sapiens
ccttgaatgatgccatg

SEQ ID NO: 2294148 - DNA, 14 bp, Homo sapiens
ccttgaccccacac

SEQ ID NO: 2294149 - DNA, 22 bp, Homo sapiens
ccttggacggggacacggcctc

SEQ ID NO: 2294150 - DNA, 19 bp, Homo sapiens
ccttggattaggagaacag

SEQ ID NO: 2294151 - DNA, 19 bp, Homo sapiens
ccttgggatgggcacaggc

SEQ ID NO: 2294152 - DNA, 20 bp, Homo sapiens
ccttgggatgggcacaggct

SEQ ID NO: 2294153 - DNA, 11 bp, Homo sapiens
ccttgtacttg

SEQ ID NO: 2294154 - DNA, 19 bp, Homo sapiens
ccttgtgtactttcttccc

SEQ ID NO: 2294155 - DNA, 23 bp, Homo sapiens
cctttaaaggtaacttctccctt

SEQ ID NO: 2294156 - DNA, 22 bp, Homo sapiens
cctttagaacagggtttctcag

SEQ ID NO: 2294157 - DNA, 15 bp, Homo sapiens
cctttcaaacattga

SEQ ID NO: 2294158 - DNA, 16 bp, Homo sapiens
cctttgcgctctgggt

SEQ ID NO: 2294159 - DNA, 19 bp, Homo sapiens
cctttggttccccgcgaag

SEQ ID NO: 2294160 - DNA, 20 bp, Homo sapiens
ccttttgcttcatctggagt

SEQ ID NO: 2294161 - DNA, 19 bp, Homo sapiens
cgaaaacgtggctgcttca

SEQ ID NO: 2294162 - DNA, 16 bp, Homo sapiens
cgaaaggtcacctcac

SEQ ID NO: 2294163 - DNA, 12 bp, Homo sapiens
cgaatattgctg

SEQ ID NO: 2294164 - DNA, 14 bp, Homo sapiens
cgaatattgctgat

SEQ ID NO: 2294165 - DNA, 15 bp, Homo sapiens
cgaatattgctgatg

SEQ ID NO: 2294166 - DNA, 12 bp, Homo sapiens
cgacaatgcaaa

SEQ ID NO: 2294167 - DNA, 13 bp, Homo sapiens
cgacaatgcaaac

SEQ ID NO: 2294168 - DNA, 23 bp, Homo sapiens
cgacatcagcccggtgtgaggag

SEQ ID NO: 2294169 - DNA, 17 bp, Homo sapiens
cgaccccacctgaggca

SEQ ID NO: 2294170 - DNA, 15 bp, Homo sapiens
cgacctccctggctt

SEQ ID NO: 2294171 - DNA, 19 bp, Homo sapiens
cgacggagccactggggtg

SEQ ID NO: 2294172 - DNA, 21 bp, Homo sapiens
cgacggagccactggggtggg

SEQ ID NO: 2294173 - DNA, 16 bp, Homo sapiens
cgactccccctccccg

SEQ ID NO: 2294174 - DNA, 14 bp, Homo sapiens
cgagaccagcctga

SEQ ID NO: 2294175 - DNA, 16 bp, Homo sapiens
cgagacggcactgaga

SEQ ID NO: 2294176 - DNA, 20 bp, Homo sapiens
cgagagggctgagcccctcc

SEQ ID NO: 2294177 - DNA, 18 bp, Homo sapiens
cgagaggtgagctacttt

SEQ ID NO: 2294178 - DNA, 22 bp, Homo sapiens
cgagaggtgagctactttgtga

SEQ ID NO: 2294179 - DNA, 16 bp, Homo sapiens
cgagcacggttgcctg

SEQ ID NO: 2294180 - DNA, 16 bp, Homo sapiens
cgagccgagctctcct

SEQ ID NO: 2294181 - DNA, 20 bp, Homo sapiens
cgagccgagctctcctgggc

SEQ ID NO: 2294182 - DNA, 17 bp, Homo sapiens
cgagcgcgtgccttccc

SEQ ID NO: 2294183 - DNA, 14 bp, Homo sapiens
cgagctctcctggg

SEQ ID NO: 2294184 - DNA, 15 bp, Homo sapiens
cgagctctcctgggc

SEQ ID NO: 2294185 - DNA, 17 bp, Homo sapiens
cgagctctcctgggcca

SEQ ID NO: 2294186 - DNA, 18 bp, Homo sapiens
cgagctctcctgggccag

SEQ ID NO: 2294187 - DNA, 21 bp, Homo sapiens
cgagctctcctgggccagggt

SEQ ID NO: 2294188 - DNA, 13 bp, Homo sapiens
cgaggcctggctc

SEQ ID NO: 2294189 - DNA, 15 bp, Homo sapiens
cgaggcctggctctg

SEQ ID NO: 2294190 - DNA, 23 bp, Homo sapiens
cgaggtttacttattttccactt

SEQ ID NO: 2294191 - DNA, 18 bp, Homo sapiens
cgaggttttgaggcggga

SEQ ID NO: 2294192 - DNA, 15 bp, Homo sapiens
cgagtccaaaatcat

SEQ ID NO: 2294193 - DNA, 20 bp, Homo sapiens
cgagtctggagaccaggact

SEQ ID NO: 2294194 - DNA, 20 bp, Homo sapiens
cgagtgagctaccaggaaga

SEQ ID NO: 2294195 - DNA, 21 bp, Homo sapiens
cgagtgtggagctgcttccag

SEQ ID NO: 2294196 - DNA, 18 bp, Homo sapiens
cgagttacagacaaagcg

SEQ ID NO: 2294197 - DNA, 11 bp, Homo sapiens
cgatgatgggc

SEQ ID NO: 2294198 - DNA, 16 bp, Homo sapiens
cgatgatgggctggag

SEQ ID NO: 2294199 - DNA, 13 bp, Homo sapiens
cgcacccccactt

SEQ ID NO: 2294200 - DNA, 15 bp, Homo sapiens
cgcacccctcctcct

SEQ ID NO: 2294201 - DNA, 18 bp, Homo sapiens
cgcacccggcagcccccc

SEQ ID NO: 2294202 - DNA, 13 bp, Homo sapiens
cgcaccctggctg

SEQ ID NO: 2294203 - DNA, 16 bp, Homo sapiens
cgcaccgccatgcatg

SEQ ID NO: 2294204 - DNA, 17 bp, Homo sapiens
cgcaccgccatgcatga

SEQ ID NO: 2294205 - DNA, 22 bp, Homo sapiens
cgcaccgccatgcatgatgggt

SEQ ID NO: 2294206 - DNA, 14 bp, Homo sapiens
cgcaccgggctggc

SEQ ID NO: 2294207 - DNA, 20 bp, Homo sapiens
cgcaccgggctggcctgaca

SEQ ID NO: 2294208 - DNA, 16 bp, Homo sapiens
cgcacttctggggcca

SEQ ID NO: 2294209 - DNA, 19 bp, Homo sapiens
cgcacttctggggccagcc

SEQ ID NO: 2294210 - DNA, 22 bp, Homo sapiens
cgcacttctggggccagcccct

SEQ ID NO: 2294211 - DNA, 19 bp, Homo sapiens
cgcagagccccggagcacc

SEQ ID NO: 2294212 - DNA, 20 bp, Homo sapiens
cgcagagccccggagcacca

SEQ ID NO: 2294213 - DNA, 12 bp, Homo sapiens
cgcagatcctgt

SEQ ID NO: 2294214 - DNA, 16 bp, Homo sapiens
cgcagatcctgtccca

SEQ ID NO: 2294215 - DNA, 22 bp, Homo sapiens
cgcagccgcgctctgcccctcc

SEQ ID NO: 2294216 - DNA, 21 bp, Homo sapiens
cgcagcgggcgcgggacagga

SEQ ID NO: 2294217 - DNA, 19 bp, Homo sapiens
cgcaggaaccgaggactcc

SEQ ID NO: 2294218 - DNA, 23 bp, Homo sapiens
cgcagggcgctccggcagaggca

SEQ ID NO: 2294219 - DNA, 23 bp, Homo sapiens
cgccaagccatcacaggctctgc

SEQ ID NO: 2294220 - DNA, 15 bp, Homo sapiens
cgcccacccacaccc

SEQ ID NO: 2294221 - DNA, 17 bp, Homo sapiens
cgcccaccccgctgcct

SEQ ID NO: 2294222 - DNA, 18 bp, Homo sapiens
cgcccaccccgctgcctg

SEQ ID NO: 2294223 - DNA, 19 bp, Homo sapiens
cgcccaccccgctgcctgg

SEQ ID NO: 2294224 - DNA, 14 bp, Homo sapiens
cgcccacctgccca

SEQ ID NO: 2294225 - DNA, 15 bp, Homo sapiens
cgcccacctgcccag

SEQ ID NO: 2294226 - DNA, 17 bp, Homo sapiens
cgcccacctgcccagtt

SEQ ID NO: 2294227 - DNA, 18 bp, Homo sapiens
cgcccacctgcccagtta

SEQ ID NO: 2294228 - DNA, 13 bp, Homo sapiens
cgccccagagact

SEQ ID NO: 2294229 - DNA, 14 bp, Homo sapiens
cgccccagagactg

SEQ ID NO: 2294230 - DNA, 17 bp, Homo sapiens
cgccccagagactgccc

SEQ ID NO: 2294231 - DNA, 21 bp, Homo sapiens
cgccccagagactgcccaccc

SEQ ID NO: 2294232 - DNA, 22 bp, Homo sapiens
cgccccagagactgcccaccct

SEQ ID NO: 2294233 - DNA, 16 bp, Homo sapiens
cgccccagcctcctga

SEQ ID NO: 2294234 - DNA, 10 bp, Homo sapiens
cgccccaggc

SEQ ID NO: 2294235 - DNA, 14 bp, Homo sapiens
cgccccaggcccca

SEQ ID NO: 2294236 - DNA, 18 bp, Homo sapiens
cgccccaggccccagcag

SEQ ID NO: 2294237 - DNA, 19 bp, Homo sapiens
cgccccaggccccagcagt

SEQ ID NO: 2294238 - DNA, 12 bp, Homo sapiens
cgcccctcctcg

SEQ ID NO: 2294239 - DNA, 22 bp, Homo sapiens
cgcccgcccaccccgctgcctg

SEQ ID NO: 2294240 - DNA, 23 bp, Homo sapiens
cgcccgcccaccccgctgcctgg

SEQ ID NO: 2294241 - DNA, 15 bp, Homo sapiens
cgcccgccctcctct

SEQ ID NO: 2294242 - DNA, 22 bp, Homo sapiens
cgcccgccctcctctgccccct

SEQ ID NO: 2294243 - DNA, 12 bp, Homo sapiens
cgccctcctctg

SEQ ID NO: 2294244 - DNA, 15 bp, Homo sapiens
cgccctcctctgccc

SEQ ID NO: 2294245 - DNA, 23 bp, Homo sapiens
cgccctcctctgccccctccccc

SEQ ID NO: 2294246 - DNA, 13 bp, Homo sapiens
cgccctctctcac

SEQ ID NO: 2294247 - DNA, 11 bp, Homo sapiens
cgccctgtgtc

SEQ ID NO: 2294248 - DNA, 15 bp, Homo sapiens
cgccctgtgtccaca

SEQ ID NO: 2294249 - DNA, 16 bp, Homo sapiens
cgccgcctcgggccgc

SEQ ID NO: 2294250 - DNA, 15 bp, Homo sapiens
cgccggggctggccc

SEQ ID NO: 2294251 - DNA, 17 bp, Homo sapiens
cgccggggctggccctg

SEQ ID NO: 2294252 - DNA, 16 bp, Homo sapiens
cgccggttggccggct

SEQ ID NO: 2294253 - DNA, 18 bp, Homo sapiens
cgcctcaaggaagagcca

SEQ ID NO: 2294254 - DNA, 14 bp, Homo sapiens
cgcctcccgccgcc

SEQ ID NO: 2294255 - DNA, 10 bp, Homo sapiens
cgcctcctcc

SEQ ID NO: 2294256 - DNA, 13 bp, Homo sapiens
cgcctcctccaga

SEQ ID NO: 2294257 - DNA, 14 bp, Homo sapiens
cgcctcctccagct

SEQ ID NO: 2294258 - DNA, 11 bp, Homo sapiens
cgcctcctccc

SEQ ID NO: 2294259 - DNA, 20 bp, Homo sapiens
cgcctcgggccgcctcctcc

SEQ ID NO: 2294260 - DNA, 13 bp, Homo sapiens
cgcctgcccccag

SEQ ID NO: 2294261 - DNA, 21 bp, Homo sapiens
cgcctgcccccagcgtggggg

SEQ ID NO: 2294262 - DNA, 21 bp, Homo sapiens
cgcctgcgccccccagtggac

SEQ ID NO: 2294263 - DNA, 19 bp, Homo sapiens
cgcctgcgctcctctgcag

SEQ ID NO: 2294264 - DNA, 13 bp, Homo sapiens
cgccttcacagca

SEQ ID NO: 2294265 - DNA, 21 bp, Homo sapiens
cgcgcaccgcccaacccccac

SEQ ID NO: 2294266 - DNA, 20 bp, Homo sapiens
cgcgccccgaaaggtcacct

SEQ ID NO: 2294267 - DNA, 15 bp, Homo sapiens
cgcgcgtgcccccag

SEQ ID NO: 2294268 - DNA, 16 bp, Homo sapiens
cgcgcgtgcccccagc

SEQ ID NO: 2294269 - DNA, 17 bp, Homo sapiens
cgcgctctgcccctccg

SEQ ID NO: 2294270 - DNA, 22 bp, Homo sapiens
cgcgggcagtgacgtgagtggg

SEQ ID NO: 2294271 - DNA, 21 bp, Homo sapiens
cgcgtgccttccccgtgcggc

SEQ ID NO: 2294272 - DNA, 14 bp, Homo sapiens
cgctccggcagagg

SEQ ID NO: 2294273 - DNA, 24 bp, Homo sapiens
cgctccggcagaggcagggccctg

SEQ ID NO: 2294274 - DNA, 23 bp, Homo sapiens
cgctccgggtgcgtgaccggccc

SEQ ID NO: 2294275 - DNA, 13 bp, Homo sapiens
cgctcctctgcag

SEQ ID NO: 2294276 - DNA, 16 bp, Homo sapiens
cgctcctctgcagcct

SEQ ID NO: 2294277 - DNA, 17 bp, Homo sapiens
cgctcctctgcagcctg

SEQ ID NO: 2294278 - DNA, 19 bp, Homo sapiens
cgctcctctgcagcctgag

SEQ ID NO: 2294279 - DNA, 14 bp, Homo sapiens
cgctctgcccctcc

SEQ ID NO: 2294280 - DNA, 20 bp, Homo sapiens
cgctctgcccctccgtcccc

SEQ ID NO: 2294281 - DNA, 22 bp, Homo sapiens
cgctctgcccctccgtccccag

SEQ ID NO: 2294282 - DNA, 10 bp, Homo sapiens
cgctgcctgg

SEQ ID NO: 2294283 - DNA, 19 bp, Homo sapiens
cgctgcctggcgggcagcc

SEQ ID NO: 2294284 - DNA, 23 bp, Homo sapiens
cgctgcctggcgggcagcccctg

SEQ ID NO: 2294285 - DNA, 22 bp, Homo sapiens
cgctgcttgagtggacagcagc

SEQ ID NO: 2294286 - DNA, 21 bp, Homo sapiens
cgctggaagaacccttctcag

SEQ ID NO: 2294287 - DNA, 11 bp, Homo sapiens
cgctggctgat

SEQ ID NO: 2294288 - DNA, 14 bp, Homo sapiens
cgctgtgtccccgc

SEQ ID NO: 2294289 - DNA, 20 bp, Homo sapiens
cgcttcagacacgcacttct

SEQ ID NO: 2294290 - DNA, 22 bp, Homo sapiens
cgcttctggaggtggggagggc

SEQ ID NO: 2294291 - DNA, 20 bp, Homo sapiens
cggaccggagcggctgagga

SEQ ID NO: 2294292 - DNA, 13 bp, Homo sapiens
cggacgctggctc

SEQ ID NO: 2294293 - DNA, 18 bp, Homo sapiens
cggacgggacagcggccc

SEQ ID NO: 2294294 - DNA, 12 bp, Homo sapiens
cggagaggaccc

SEQ ID NO: 2294295 - DNA, 15 bp, Homo sapiens
cggagaggaccccat

SEQ ID NO: 2294296 - DNA, 13 bp, Homo sapiens
cggaggaacagat

SEQ ID NO: 2294297 - DNA, 20 bp, Homo sapiens
cggaggcctcgagcagagag

SEQ ID NO: 2294298 - DNA, 22 bp, Homo sapiens
cggaggcgcccacctgcccagt

SEQ ID NO: 2294299 - DNA, 19 bp, Homo sapiens
cggaggggcttggagcaga

SEQ ID NO: 2294300 - DNA, 20 bp, Homo sapiens
cggatgaactcaatgcatga

SEQ ID NO: 2294301 - DNA, 16 bp, Homo sapiens
cggcaacccctgcagc

SEQ ID NO: 2294302 - DNA, 15 bp, Homo sapiens
cggcaccgcccaccc

SEQ ID NO: 2294303 - DNA, 21 bp, Homo sapiens
cggcaccgcccacccacaccc

SEQ ID NO: 2294304 - DNA, 19 bp, Homo sapiens
cggcagaggcagggccctg

SEQ ID NO: 2294305 - DNA, 12 bp, Homo sapiens
cggcagccccat

SEQ ID NO: 2294306 - DNA, 12 bp, Homo sapiens
cggcagcccccc

SEQ ID NO: 2294307 - DNA, 18 bp, Homo sapiens
cggcagccccccagtgtc

SEQ ID NO: 2294308 - DNA, 22 bp, Homo sapiens
cggcagccccccagtgtcccca

SEQ ID NO: 2294309 - DNA, 16 bp, Homo sapiens
cggcagtgcaccccct

SEQ ID NO: 2294310 - DNA, 19 bp, Homo sapiens
cggcatcatttcccctccc

SEQ ID NO: 2294311 - DNA, 16 bp, Homo sapiens
cggccagagctcccag

SEQ ID NO: 2294312 - DNA, 15 bp, Homo sapiens
cggcccacgcagagc

SEQ ID NO: 2294313 - DNA, 17 bp, Homo sapiens
cggcccacgcagagccc

SEQ ID NO: 2294314 - DNA, 22 bp, Homo sapiens
cggcccacgcagagccccggag

SEQ ID NO: 2294315 - DNA, 15 bp, Homo sapiens
cggccccgcacccct

SEQ ID NO: 2294316 - DNA, 15 bp, Homo sapiens
cggcccggcccacgc

SEQ ID NO: 2294317 - DNA, 15 bp, Homo sapiens
cggccctcctcagca

SEQ ID NO: 2294318 - DNA, 15 bp, Homo sapiens
cggccgtccctgact

SEQ ID NO: 2294319 - DNA, 20 bp, Homo sapiens
cggcctggggccgggctggc

SEQ ID NO: 2294320 - DNA, 22 bp, Homo sapiens
cggcctggggccgggctggctt

SEQ ID NO: 2294321 - DNA, 21 bp, Homo sapiens
cggcgccttctacctgcagga

SEQ ID NO: 2294322 - DNA, 19 bp, Homo sapiens
cggctcacaagtgaaaact

SEQ ID NO: 2294323 - DNA, 22 bp, Homo sapiens
cggctgaggacggggcagagct

SEQ ID NO: 2294324 - DNA, 17 bp, Homo sapiens
cggctggacctggggtc

SEQ ID NO: 2294325 - DNA, 20 bp, Homo sapiens
cggctgggcagggccgcagg

SEQ ID NO: 2294326 - DNA, 15 bp, Homo sapiens
cgggaagggtgggcc

SEQ ID NO: 2294327 - DNA, 18 bp, Homo sapiens
cgggaagggtgggccctg

SEQ ID NO: 2294328 - DNA, 13 bp, Homo sapiens
cgggacagcggcc

SEQ ID NO: 2294329 - DNA, 18 bp, Homo sapiens
cgggacagcggcccggcc

SEQ ID NO: 2294330 - DNA, 13 bp, Homo sapiens
cgggacaggactt

SEQ ID NO: 2294331 - DNA, 14 bp, Homo sapiens
cgggacaggacttg

SEQ ID NO: 2294332 - DNA, 17 bp, Homo sapiens
cgggagagcgccacccg

SEQ ID NO: 2294333 - DNA, 15 bp, Homo sapiens
cgggagatccgccct

SEQ ID NO: 2294334 - DNA, 17 bp, Homo sapiens
cgggagatccgccctgg

SEQ ID NO: 2294335 - DNA, 15 bp, Homo sapiens
cgggcagcccctgct

SEQ ID NO: 2294336 - DNA, 20 bp, Homo sapiens
cgggcagtgacgtgagtggg

SEQ ID NO: 2294337 - DNA, 15 bp, Homo sapiens
cgggcatgacacgaa

SEQ ID NO: 2294338 - DNA, 22 bp, Homo sapiens
cgggccccatggtcacagaccc

SEQ ID NO: 2294339 - DNA, 14 bp, Homo sapiens
cgggccgcctcctc

SEQ ID NO: 2294340 - DNA, 19 bp, Homo sapiens
cgggcctgtttggtgagga

SEQ ID NO: 2294341 - DNA, 20 bp, Homo sapiens
cgggcctgtttggtgaggac

SEQ ID NO: 2294342 - DNA, 23 bp, Homo sapiens
cgggcctgtttggtgaggacctg

SEQ ID NO: 2294343 - DNA, 18 bp, Homo sapiens
cgggcgcctgcgctcctc

SEQ ID NO: 2294344 - DNA, 20 bp, Homo sapiens
cgggcgcctgcgctcctctg

SEQ ID NO: 2294345 - DNA, 17 bp, Homo sapiens
cggggacacggcctctg

SEQ ID NO: 2294346 - DNA, 13 bp, Homo sapiens
cggggcagagctg

SEQ ID NO: 2294347 - DNA, 14 bp, Homo sapiens
cggggccaggatgg

SEQ ID NO: 2294348 - DNA, 11 bp, Homo sapiens
cggggccatgg

SEQ ID NO: 2294349 - DNA, 19 bp, Homo sapiens
cggggcccgccccaggccc

SEQ ID NO: 2294350 - DNA, 20 bp, Homo sapiens
cggggcccgccccaggcccc

SEQ ID NO: 2294351 - DNA, 23 bp, Homo sapiens
cggggctggccctgccctccccc

SEQ ID NO: 2294352 - DNA, 19 bp, Homo sapiens
cgggggaggagcaccccca

SEQ ID NO: 2294353 - DNA, 22 bp, Homo sapiens
cgggggaggagcacccccagcc

SEQ ID NO: 2294354 - DNA, 15 bp, Homo sapiens
cgggggcctagtggc

SEQ ID NO: 2294355 - DNA, 18 bp, Homo sapiens
cgggggctaactggcccc

SEQ ID NO: 2294356 - DNA, 23 bp, Homo sapiens
cgggggctaactggccccaggcg

SEQ ID NO: 2294357 - DNA, 19 bp, Homo sapiens
cggggtcctgaggctgggg

SEQ ID NO: 2294358 - DNA, 15 bp, Homo sapiens
cggggtcgggggagg

SEQ ID NO: 2294359 - DNA, 20 bp, Homo sapiens
cgggtgcccaggacggtctg

SEQ ID NO: 2294360 - DNA, 22 bp, Homo sapiens
cgggtgcctgtgaccggggtcc

SEQ ID NO: 2294361 - DNA, 19 bp, Homo sapiens
cgggtgcgtgaccggcccg

SEQ ID NO: 2294362 - DNA, 21 bp, Homo sapiens
cgggtgcgtgaccggcccgcc

SEQ ID NO: 2294363 - DNA, 12 bp, Homo sapiens
cggtccaccccg

SEQ ID NO: 2294364 - DNA, 13 bp, Homo sapiens
cggtctgtgcccg

SEQ ID NO: 2294365 - DNA, 15 bp, Homo sapiens
cggtgcctccgaggt

SEQ ID NO: 2294366 - DNA, 20 bp, Homo sapiens
cggtggctcacacctgtaat

SEQ ID NO: 2294367 - DNA, 17 bp, Homo sapiens
cggttggccggctggcc

SEQ ID NO: 2294368 - DNA, 18 bp, Homo sapiens
cggttggccggctggccg

SEQ ID NO: 2294369 - DNA, 21 bp, Homo sapiens
cgtaaaggtgcagttgctcat

SEQ ID NO: 2294370 - DNA, 13 bp, Homo sapiens
cgtactttcacat

SEQ ID NO: 2294371 - DNA, 15 bp, Homo sapiens
cgtactttcacatct

SEQ ID NO: 2294372 - DNA, 20 bp, Homo sapiens
cgtactttcacatctctgta

SEQ ID NO: 2294373 - DNA, 16 bp, Homo sapiens
cgtagtttgcattcca

SEQ ID NO: 2294374 - DNA, 12 bp, Homo sapiens
cgtcaatgtgaa

SEQ ID NO: 2294375 - DNA, 13 bp, Homo sapiens
cgtcaatgtgaaa

SEQ ID NO: 2294376 - DNA, 15 bp, Homo sapiens
cgtcaggaggtgcct

SEQ ID NO: 2294377 - DNA, 17 bp, Homo sapiens
cgtcatcttccctttcc

SEQ ID NO: 2294378 - DNA, 14 bp, Homo sapiens
cgtccccagggtgc

SEQ ID NO: 2294379 - DNA, 17 bp, Homo sapiens
cgtccctgacttcccag

SEQ ID NO: 2294380 - DNA, 18 bp, Homo sapiens
cgtccctgacttcccagc

SEQ ID NO: 2294381 - DNA, 20 bp, Homo sapiens
cgtccctgacttcccagctg

SEQ ID NO: 2294382 - DNA, 16 bp, Homo sapiens
cgtccggcctgcagcc

SEQ ID NO: 2294383 - DNA, 18 bp, Homo sapiens
cgtccggcctgcagccca

SEQ ID NO: 2294384 - DNA, 15 bp, Homo sapiens
cgtcctggcagggca

SEQ ID NO: 2294385 - DNA, 23 bp, Homo sapiens
cgtctgctgttgattccactgaa

SEQ ID NO: 2294386 - DNA, 12 bp, Homo sapiens
cgtcttgtattt

SEQ ID NO: 2294387 - DNA, 13 bp, Homo sapiens
cgtcttgtatttt

SEQ ID NO: 2294388 - DNA, 15 bp, Homo sapiens
cgtcttgtattttct

SEQ ID NO: 2294389 - DNA, 15 bp, Homo sapiens
cgtgaccggcccgcc

SEQ ID NO: 2294390 - DNA, 22 bp, Homo sapiens
cgtgaccggcccgccaccttgt

SEQ ID NO: 2294391 - DNA, 17 bp, Homo sapiens
cgtgagtcctggcatgg

SEQ ID NO: 2294392 - DNA, 12 bp, Homo sapiens
cgtgcatttgtg

SEQ ID NO: 2294393 - DNA, 13 bp, Homo sapiens
cgtgcatttgtga

SEQ ID NO: 2294394 - DNA, 13 bp, Homo sapiens
cgtgccttccccg

SEQ ID NO: 2294395 - DNA, 22 bp, Homo sapiens
cgtgccttccccgtgcggcccg

SEQ ID NO: 2294396 - DNA, 13 bp, Homo sapiens
cgtgcgcagccgc

SEQ ID NO: 2294397 - DNA, 20 bp, Homo sapiens
cgtgcgcagccgcgctctgc

SEQ ID NO: 2294398 - DNA, 21 bp, Homo sapiens
cgtgcgcagccgcgctctgcc

SEQ ID NO: 2294399 - DNA, 17 bp, Homo sapiens
cgtgggggtggccactc

SEQ ID NO: 2294400 - DNA, 17 bp, Homo sapiens
cgtggtcatgaatagaa

SEQ ID NO: 2294401 - DNA, 13 bp, Homo sapiens
cgtgtattcagga

SEQ ID NO: 2294402 - DNA, 19 bp, Homo sapiens
cgtgtgctccagtgttttc

SEQ ID NO: 2294403 - DNA, 14 bp, Homo sapiens
cgtgttcgctggct

SEQ ID NO: 2294404 - DNA, 13 bp, Homo sapiens
cgtgttctcagag

SEQ ID NO: 2294405 - DNA, 13 bp, Homo sapiens
cgttaagggcaga

SEQ ID NO: 2294406 - DNA, 23 bp, Homo sapiens
cgttctgggtcagcttgaatgtc

SEQ ID NO: 2294407 - DNA, 19 bp, Homo sapiens
cgtttcaaagctttcctgt

SEQ ID NO: 2294408 - DNA, 12 bp, Homo sapiens
cgttttaagccc

SEQ ID NO: 2294409 - DNA, 13 bp, Homo sapiens
ctaaaaaataact

SEQ ID NO: 2294410 - DNA, 22 bp, Homo sapiens
ctaaaaaataactgtgcactat

SEQ ID NO: 2294411 - DNA, 14 bp, Homo sapiens
ctaaaaacatttta

SEQ ID NO: 2294412 - DNA, 15 bp, Homo sapiens
ctaaaaacattttaa

SEQ ID NO: 2294413 - DNA, 21 bp, Homo sapiens
ctaaaaacattttaaaatcaa

SEQ ID NO: 2294414 - DNA, 23 bp, Homo sapiens
ctaaaacattctttaacatacat

SEQ ID NO: 2294415 - DNA, 17 bp, Homo sapiens
ctaaaatactcaccaaa

SEQ ID NO: 2294416 - DNA, 21 bp, Homo sapiens
ctaaaatactcaccaaaatat

SEQ ID NO: 2294417 - DNA, 22 bp, Homo sapiens
ctaaaatactcaccaaaatata

SEQ ID NO: 2294418 - DNA, 12 bp, Homo sapiens
ctaaaattctag

SEQ ID NO: 2294419 - DNA, 14 bp, Homo sapiens
ctaaaattctagtc

SEQ ID NO: 2294420 - DNA, 14 bp, Homo sapiens
ctaaactgttttca

SEQ ID NO: 2294421 - DNA, 14 bp, Homo sapiens
ctaaagacagaaaa

SEQ ID NO: 2294422 - DNA, 22 bp, Homo sapiens
ctaaagatggcgcacccggcag

SEQ ID NO: 2294423 - DNA, 14 bp, Homo sapiens
ctaaagcagagatg

SEQ ID NO: 2294424 - DNA, 16 bp, Homo sapiens
ctaaagcagagatgta

SEQ ID NO: 2294425 - DNA, 22 bp, Homo sapiens
ctaaagggctatgcctccattt

SEQ ID NO: 2294426 - DNA, 16 bp, Homo sapiens
ctaaatccattttcta

SEQ ID NO: 2294427 - DNA, 23 bp, Homo sapiens
ctaaatccattttctaaactgtt

SEQ ID NO: 2294428 - DNA, 24 bp, Homo sapiens
ctaacagcatccccaaaacaaagt

SEQ ID NO: 2294429 - DNA, 16 bp, Homo sapiens
ctaacatagcacagta

SEQ ID NO: 2294430 - DNA, 13 bp, Homo sapiens
ctaactggcccca

SEQ ID NO: 2294431 - DNA, 20 bp, Homo sapiens
ctaagaataaataaagaaga

SEQ ID NO: 2294432 - DNA, 21 bp, Homo sapiens
ctaagaataaataaagaagaa

SEQ ID NO: 2294433 - DNA, 15 bp, Homo sapiens
ctaagattgtacata

SEQ ID NO: 2294434 - DNA, 17 bp, Homo sapiens
ctaagcagttgcaatga

SEQ ID NO: 2294435 - DNA, 14 bp, Homo sapiens
ctaagctgcggaat

SEQ ID NO: 2294436 - DNA, 12 bp, Homo sapiens
ctaagcttattt

SEQ ID NO: 2294437 - DNA, 16 bp, Homo sapiens
ctaagcttatttctaa

SEQ ID NO: 2294438 - DNA, 23 bp, Homo sapiens
ctaaggagcactagaatgagaaa

SEQ ID NO: 2294439 - DNA, 16 bp, Homo sapiens
ctaaggagcctgggat

SEQ ID NO: 2294440 - DNA, 22 bp, Homo sapiens
ctaaggatggaaaggtgacagt

SEQ ID NO: 2294441 - DNA, 19 bp, Homo sapiens
ctaaggattagtccctggc

SEQ ID NO: 2294442 - DNA, 16 bp, Homo sapiens
ctaagggatccagaga

SEQ ID NO: 2294443 - DNA, 18 bp, Homo sapiens
ctaagggatccagagacc

SEQ ID NO: 2294444 - DNA, 19 bp, Homo sapiens
ctaagggatccagagacct

SEQ ID NO: 2294445 - DNA, 14 bp, Homo sapiens
ctaagtccagctct

SEQ ID NO: 2294446 - DNA, 18 bp, Homo sapiens
ctaagtggaagacagaga

SEQ ID NO: 2294447 - DNA, 17 bp, Homo sapiens
ctaagttgtattttaat

SEQ ID NO: 2294448 - DNA, 22 bp, Homo sapiens
ctaagttgtattttaataaaga

SEQ ID NO: 2294449 - DNA, 21 bp, Homo sapiens
ctaagtttgtctacactaaaa

SEQ ID NO: 2294450 - DNA, 15 bp, Homo sapiens
ctaataccaactatt

SEQ ID NO: 2294451 - DNA, 22 bp, Homo sapiens
ctaatagaagtccatgagttga

SEQ ID NO: 2294452 - DNA, 21 bp, Homo sapiens
ctaatctttaatataatatta

SEQ ID NO: 2294453 - DNA, 21 bp, Homo sapiens
ctaatgcattattttgtcata

SEQ ID NO: 2294454 - DNA, 21 bp, Homo sapiens
ctaatgtaatcatttatctta

SEQ ID NO: 2294455 - DNA, 19 bp, Homo sapiens
ctacaagaaagctgtggct

SEQ ID NO: 2294456 - DNA, 23 bp, Homo sapiens
ctacagcataaatctgttagcat

SEQ ID NO: 2294457 - DNA, 15 bp, Homo sapiens
ctacagtagctgtgg

SEQ ID NO: 2294458 - DNA, 16 bp, Homo sapiens
ctacagtattttttat

SEQ ID NO: 2294459 - DNA, 12 bp, Homo sapiens
ctacataaattg

SEQ ID NO: 2294460 - DNA, 22 bp, Homo sapiens
ctacataattaaattttaatgt

SEQ ID NO: 2294461 - DNA, 15 bp, Homo sapiens
ctacatctgaaatct

SEQ ID NO: 2294462 - DNA, 20 bp, Homo sapiens
ctacatctgaaatctacaac

SEQ ID NO: 2294463 - DNA, 14 bp, Homo sapiens
ctaccaggaagagg

SEQ ID NO: 2294464 - DNA, 21 bp, Homo sapiens
ctaccaggaagaggggcgctg

SEQ ID NO: 2294465 - DNA, 22 bp, Homo sapiens
ctaccagggctcacccactgct

SEQ ID NO: 2294466 - DNA, 11 bp, Homo sapiens
ctacctgcagg

SEQ ID NO: 2294467 - DNA, 15 bp, Homo sapiens
ctacctgcaggactc

SEQ ID NO: 2294468 - DNA, 23 bp, Homo sapiens
ctacctggttttcattattttcc

SEQ ID NO: 2294469 - DNA, 13 bp, Homo sapiens
ctactaagaataa

SEQ ID NO: 2294470 - DNA, 14 bp, Homo sapiens
ctactgagaaactt

SEQ ID NO: 2294471 - DNA, 18 bp, Homo sapiens
ctactttcctgatgttga

SEQ ID NO: 2294472 - DNA, 22 bp, Homo sapiens
ctagaaaatgaactgtatatta

SEQ ID NO: 2294473 - DNA, 20 bp, Homo sapiens
ctagaacaagccagagccgc

SEQ ID NO: 2294474 - DNA, 15 bp, Homo sapiens
ctagagactctgtga

SEQ ID NO: 2294475 - DNA, 21 bp, Homo sapiens
ctagatctcctgtaattttgt

SEQ ID NO: 2294476 - DNA, 17 bp, Homo sapiens
ctagatggatattagat

SEQ ID NO: 2294477 - DNA, 13 bp, Homo sapiens
ctagcaagaagat

SEQ ID NO: 2294478 - DNA, 18 bp, Homo sapiens
ctagcaagaagattctaa

SEQ ID NO: 2294479 - DNA, 21 bp, Homo sapiens
ctagcaagaagattctaaaac

SEQ ID NO: 2294480 - DNA, 22 bp, Homo sapiens
ctagctataacaactctatttt

SEQ ID NO: 2294481 - DNA, 17 bp, Homo sapiens
ctagtactgtgtactgt

SEQ ID NO: 2294482 - DNA, 18 bp, Homo sapiens
ctagtctctgatttgcaa

SEQ ID NO: 2294483 - DNA, 16 bp, Homo sapiens
ctagttagcaggaaat

SEQ ID NO: 2294484 - DNA, 20 bp, Homo sapiens
ctagtttgcatacttcctgg

SEQ ID NO: 2294485 - DNA, 17 bp, Homo sapiens
ctagtttttcctgtgca

SEQ ID NO: 2294486 - DNA, 14 bp, Homo sapiens
ctataaaagtgata

SEQ ID NO: 2294487 - DNA, 17 bp, Homo sapiens
ctataaaattatgaaaa

SEQ ID NO: 2294488 - DNA, 21 bp, Homo sapiens
ctataaattgtagaacataga

SEQ ID NO: 2294489 - DNA, 17 bp, Homo sapiens
ctataacaactctattt

SEQ ID NO: 2294490 - DNA, 15 bp, Homo sapiens
ctataagagacaaag

SEQ ID NO: 2294491 - DNA, 22 bp, Homo sapiens
ctataagggagtaggctgtatt

SEQ ID NO: 2294492 - DNA, 17 bp, Homo sapiens
ctataattttacaaagt

SEQ ID NO: 2294493 - DNA, 17 bp, Homo sapiens
ctatatatacatgtata

SEQ ID NO: 2294494 - DNA, 18 bp, Homo sapiens
ctatatatacatgtatag

SEQ ID NO: 2294495 - DNA, 16 bp, Homo sapiens
ctatatttaaaaagct

SEQ ID NO: 2294496 - DNA, 22 bp, Homo sapiens
ctatatttggattcacagcctt

SEQ ID NO: 2294497 - DNA, 22 bp, Homo sapiens
ctatccttttttattgaataac

SEQ ID NO: 2294498 - DNA, 20 bp, Homo sapiens
ctatctgctgggctggcggc

SEQ ID NO: 2294499 - DNA, 16 bp, Homo sapiens
ctatgagacctccccc

SEQ ID NO: 2294500 - DNA, 14 bp, Homo sapiens
ctatgcagcttgga

SEQ ID NO: 2294501 - DNA, 16 bp, Homo sapiens
ctatgcctgtatttcc

SEQ ID NO: 2294502 - DNA, 15 bp, Homo sapiens
ctatggaaatacatt

SEQ ID NO: 2294503 - DNA, 16 bp, Homo sapiens
ctatggaaatacattt

SEQ ID NO: 2294504 - DNA, 13 bp, Homo sapiens
ctatggacatttt

SEQ ID NO: 2294505 - DNA, 15 bp, Homo sapiens
ctatggctgtatttt

SEQ ID NO: 2294506 - DNA, 21 bp, Homo sapiens
ctatggctgtatttttagaga

SEQ ID NO: 2294507 - DNA, 21 bp, Homo sapiens
ctatggtgtgcttatgttttt

SEQ ID NO: 2294508 - DNA, 23 bp, Homo sapiens
ctatgtaagggctttaaataaaa

SEQ ID NO: 2294509 - DNA, 12 bp, Homo sapiens
ctatgtgcaagg

SEQ ID NO: 2294510 - DNA, 21 bp, Homo sapiens
ctatgtgtcatgatttcaatg

SEQ ID NO: 2294511 - DNA, 16 bp, Homo sapiens
ctattataatatagaa

SEQ ID NO: 2294512 - DNA, 16 bp, Homo sapiens
ctattcattacatcct

SEQ ID NO: 2294513 - DNA, 18 bp, Homo sapiens
ctattcattacatcctct

SEQ ID NO: 2294514 - DNA, 21 bp, Homo sapiens
ctattggcatggatttccttt

SEQ ID NO: 2294515 - DNA, 13 bp, Homo sapiens
ctatttaaaaaat

SEQ ID NO: 2294516 - DNA, 15 bp, Homo sapiens
ctatttaaaaaatga

SEQ ID NO: 2294517 - DNA, 12 bp, Homo sapiens
ctatttctatct

SEQ ID NO: 2294518 - DNA, 12 bp, Homo sapiens
ctattttcagat

SEQ ID NO: 2294519 - DNA, 17 bp, Homo sapiens
ctcaaatagcctttctt

SEQ ID NO: 2294520 - DNA, 17 bp, Homo sapiens
ctcaaatgctaaatgca

SEQ ID NO: 2294521 - DNA, 18 bp, Homo sapiens
ctcaaatgctaaatgcaa

SEQ ID NO: 2294522 - DNA, 24 bp, Homo sapiens
ctcaaatgctaaatgcaaacactg

SEQ ID NO: 2294523 - DNA, 19 bp, Homo sapiens
ctcaactgttgccaggaga

SEQ ID NO: 2294524 - DNA, 17 bp, Homo sapiens
ctcaagaacaaacagaa

SEQ ID NO: 2294525 - DNA, 18 bp, Homo sapiens
ctcaagaccaaatggaaa

SEQ ID NO: 2294526 - DNA, 17 bp, Homo sapiens
ctcaagcgatcctcctt

SEQ ID NO: 2294527 - DNA, 20 bp, Homo sapiens
ctcaaggaagagccagccgt

SEQ ID NO: 2294528 - DNA, 22 bp, Homo sapiens
ctcaatgcatgatgactcttct

SEQ ID NO: 2294529 - DNA, 14 bp, Homo sapiens
ctcaatgcttttct

SEQ ID NO: 2294530 - DNA, 23 bp, Homo sapiens
ctcaattattttgcattttttct

SEQ ID NO: 2294531 - DNA, 14 bp, Homo sapiens
ctcaatttctctat

SEQ ID NO: 2294532 - DNA, 13 bp, Homo sapiens
ctcacaaaaggct

SEQ ID NO: 2294533 - DNA, 23 bp, Homo sapiens
ctcacaaaaggctggatgtgctt

SEQ ID NO: 2294534 - DNA, 14 bp, Homo sapiens
ctcaccaaaatata

SEQ ID NO: 2294535 - DNA, 21 bp, Homo sapiens
ctcaccaaaatatagttaatt

SEQ ID NO: 2294536 - DNA, 13 bp, Homo sapiens
ctcaccagccttg

SEQ ID NO: 2294537 - DNA, 23 bp, Homo sapiens
caaggctgtcaattacaggaagt

SEQ ID NO: 2294538 - DNA, 23 bp, Homo sapiens
caagggactgaagtatacattta

SEQ ID NO: 2294539 - DNA, 13 bp, Homo sapiens
caagggcccagag

SEQ ID NO: 2294540 - DNA, 13 bp, Homo sapiens
caaggggccagga

SEQ ID NO: 2294541 - DNA, 15 bp, Homo sapiens
caaggggccaggaag

SEQ ID NO: 2294542 - DNA, 15 bp, Homo sapiens
caagtcgccaggcag

SEQ ID NO: 2294543 - DNA, 20 bp, Homo sapiens
caagtcttgagcaatgtttt

SEQ ID NO: 2294544 - DNA, 12 bp, Homo sapiens
caagtgaaaact

SEQ ID NO: 2294545 - DNA, 12 bp, Homo sapiens
caagtgtacatt

SEQ ID NO: 2294546 - DNA, 13 bp, Homo sapiens
caataaagaaaaa

SEQ ID NO: 2294547 - DNA, 21 bp, Homo sapiens
caataaagaaaaaaatagttt

SEQ ID NO: 2294548 - DNA, 13 bp, Homo sapiens
caataacagtttt

SEQ ID NO: 2294549 - DNA, 14 bp, Homo sapiens
caataacagtttta

SEQ ID NO: 2294550 - DNA, 14 bp, Homo sapiens
caataatgaataat

SEQ ID NO: 2294551 - DNA, 19 bp, Homo sapiens
caatacttttgtgtattct

SEQ ID NO: 2294552 - DNA, 21 bp, Homo sapiens
caatacttttgtgtattctgt

SEQ ID NO: 2294553 - DNA, 16 bp, Homo sapiens
caataggaaaaactga

SEQ ID NO: 2294554 - DNA, 21 bp, Homo sapiens
caataggaaaaactgattttt

SEQ ID NO: 2294555 - DNA, 15 bp, Homo sapiens
caatatatttgtagg

SEQ ID NO: 2294556 - DNA, 23 bp, Homo sapiens
caatatcatgtgtagatattatg

SEQ ID NO: 2294557 - DNA, 19 bp, Homo sapiens
caatcaacagcatgtctac

SEQ ID NO: 2294558 - DNA, 22 bp, Homo sapiens
caatcaacagcatgtctactgc

SEQ ID NO: 2294559 - DNA, 13 bp, Homo sapiens
caatcatatgtga

SEQ ID NO: 2294560 - DNA, 17 bp, Homo sapiens
caatcatatgtgatctg

SEQ ID NO: 2294561 - DNA, 20 bp, Homo sapiens
caatctctgtgactcgctta

SEQ ID NO: 2294562 - DNA, 20 bp, Homo sapiens
caatgaaatatttgcttatt

SEQ ID NO: 2294563 - DNA, 22 bp, Homo sapiens
caatgaaatatttgcttattta

SEQ ID NO: 2294564 - DNA, 16 bp, Homo sapiens
caatgaagataaatgc

SEQ ID NO: 2294565 - DNA, 23 bp, Homo sapiens
caatgacctttcaataggaaaaa

SEQ ID NO: 2294566 - DNA, 17 bp, Homo sapiens
caatgactttcctagac

SEQ ID NO: 2294567 - DNA, 15 bp, Homo sapiens
caatgatcagacttg

SEQ ID NO: 2294568 - DNA, 17 bp, Homo sapiens
caatgcaaaccatcatt

SEQ ID NO: 2294569 - DNA, 18 bp, Homo sapiens
caatgcaaaccatcattg

SEQ ID NO: 2294570 - DNA, 20 bp, Homo sapiens
caatgcaaaccatcattgaa

SEQ ID NO: 2294571 - DNA, 21 bp, Homo sapiens
caatgcaaaccatcattgaaa

SEQ ID NO: 2294572 - DNA, 14 bp, Homo sapiens
caatgcatgatgac

SEQ ID NO: 2294573 - DNA, 15 bp, Homo sapiens
caatggtagctctga

SEQ ID NO: 2294574 - DNA, 19 bp, Homo sapiens
caatggtagctctgaaggg

SEQ ID NO: 2294575 - DNA, 18 bp, Homo sapiens
caatggttttcttgtgtg

SEQ ID NO: 2294576 - DNA, 20 bp, Homo sapiens
caatgtaccatgttgcccag

SEQ ID NO: 2294577 - DNA, 14 bp, Homo sapiens
caattaacatatat

SEQ ID NO: 2294578 - DNA, 17 bp, Homo sapiens
caattacaggaagtact

SEQ ID NO: 2294579 - DNA, 22 bp, Homo sapiens
caattcagttttagtttcaaaa

SEQ ID NO: 2294580 - DNA, 17 bp, Homo sapiens
caattcattatgtcaat

SEQ ID NO: 2294581 - DNA, 14 bp, Homo sapiens
caattcttttgaaa

SEQ ID NO: 2294582 - DNA, 17 bp, Homo sapiens
caattggacaattattt

SEQ ID NO: 2294583 - DNA, 14 bp, Homo sapiens
caattgttcttaaa

SEQ ID NO: 2294584 - DNA, 21 bp, Homo sapiens
caatttttaacttatctccag

SEQ ID NO: 2294585 - DNA, 14 bp, Homo sapiens
cacaaaatatttct

SEQ ID NO: 2294586 - DNA, 15 bp, Homo sapiens
cacaaaatatttcta

SEQ ID NO: 2294587 - DNA, 12 bp, Homo sapiens
cacaaaatgcaa

SEQ ID NO: 2294588 - DNA, 20 bp, Homo sapiens
cacaagctaggccaatgaag

SEQ ID NO: 2294589 - DNA, 18 bp, Homo sapiens
cacaatcatcttctccca

SEQ ID NO: 2294590 - DNA, 15 bp, Homo sapiens
cacacacagcagctc

SEQ ID NO: 2294591 - DNA, 17 bp, Homo sapiens
cacacacagcagctcca

SEQ ID NO: 2294592 - DNA, 13 bp, Homo sapiens
cacacagcagctc

SEQ ID NO: 2294593 - DNA, 14 bp, Homo sapiens
cacaccccgtctgc

SEQ ID NO: 2294594 - DNA, 21 bp, Homo sapiens
cacaccccgtctgccccttga

SEQ ID NO: 2294595 - DNA, 21 bp, Homo sapiens
cacactcccgagacggcactg

SEQ ID NO: 2294596 - DNA, 15 bp, Homo sapiens
cacacttgcaaatga

SEQ ID NO: 2294597 - DNA, 17 bp, Homo sapiens
cacacttgcaaatgaat

SEQ ID NO: 2294598 - DNA, 17 bp, Homo sapiens
cacagacccctggggga

SEQ ID NO: 2294599 - DNA, 10 bp, Homo sapiens
cacagagacc

SEQ ID NO: 2294600 - DNA, 14 bp, Homo sapiens
cacagagactgttt

SEQ ID NO: 2294601 - DNA, 15 bp, Homo sapiens
cacagataaaaagtg

SEQ ID NO: 2294602 - DNA, 17 bp, Homo sapiens
cacagatctgcatctga

SEQ ID NO: 2294603 - DNA, 15 bp, Homo sapiens
cacagcctcacccct

SEQ ID NO: 2294604 - DNA, 19 bp, Homo sapiens
cacagcctcacccctgcag

SEQ ID NO: 2294605 - DNA, 20 bp, Homo sapiens
cacagcctcacccctgcagg

SEQ ID NO: 2294606 - DNA, 18 bp, Homo sapiens
cacagctgtgaggacaga

SEQ ID NO: 2294607 - DNA, 20 bp, Homo sapiens
cacaggcaacattacaaaca

SEQ ID NO: 2294608 - DNA, 14 bp, Homo sapiens
cacaggctgcccca

SEQ ID NO: 2294609 - DNA, 14 bp, Homo sapiens
cacagtggggccca

SEQ ID NO: 2294610 - DNA, 21 bp, Homo sapiens
cacatatacatctagcacagc

SEQ ID NO: 2294611 - DNA, 13 bp, Homo sapiens
cacatgcatcctc

SEQ ID NO: 2294612 - DNA, 20 bp, Homo sapiens
cacatgtggctccccctgaa

SEQ ID NO: 2294613 - DNA, 18 bp, Homo sapiens
cacattctgctgccccca

SEQ ID NO: 2294614 - DNA, 17 bp, Homo sapiens
cacattgcccacacctg

SEQ ID NO: 2294615 - DNA, 21 bp, Homo sapiens
cacattgcccacacctgcctc

SEQ ID NO: 2294616 - DNA, 20 bp, Homo sapiens
caccaaaggaaacccaattc

SEQ ID NO: 2294617 - DNA, 14 bp, Homo sapiens
caccaagctgttcc

SEQ ID NO: 2294618 - DNA, 22 bp, Homo sapiens
caccagcctgagccacagtggg

SEQ ID NO: 2294619 - DNA, 11 bp, Homo sapiens
caccagccttg

SEQ ID NO: 2294620 - DNA, 15 bp, Homo sapiens
cacccaaaccccggg

SEQ ID NO: 2294621 - DNA, 23 bp, Homo sapiens
cacccaagcacaaactgtcgtct

SEQ ID NO: 2294622 - DNA, 15 bp, Homo sapiens
cacccaattttaaaa

SEQ ID NO: 2294623 - DNA, 19 bp, Homo sapiens
cacccaattttaaaaaata

SEQ ID NO: 2294624 - DNA, 14 bp, Homo sapiens
cacccagccccagc

SEQ ID NO: 2294625 - DNA, 23 bp, Homo sapiens
cacccagccccagcgagtctgga

SEQ ID NO: 2294626 - DNA, 23 bp, Homo sapiens
caccccaaaggggcctctccttt

SEQ ID NO: 2294627 - DNA, 10 bp, Homo sapiens
cacccccagc

SEQ ID NO: 2294628 - DNA, 12 bp, Homo sapiens
cacccccagcct

SEQ ID NO: 2294629 - DNA, 13 bp, Homo sapiens
cacccccagcctc

SEQ ID NO: 2294630 - DNA, 17 bp, Homo sapiens
cacccccagcctccccc

SEQ ID NO: 2294631 - DNA, 13 bp, Homo sapiens
cacccctcctcct

SEQ ID NO: 2294632 - DNA, 20 bp, Homo sapiens
cacccctcctccttgctgat

SEQ ID NO: 2294633 - DNA, 14 bp, Homo sapiens
cacccgccccagag

SEQ ID NO: 2294634 - DNA, 19 bp, Homo sapiens
cacccgccccagagactgc

SEQ ID NO: 2294635 - DNA, 22 bp, Homo sapiens
cacccgccccagagactgccca

SEQ ID NO: 2294636 - DNA, 14 bp, Homo sapiens
caccctcccctctt

SEQ ID NO: 2294637 - DNA, 17 bp, Homo sapiens
caccctctgctgcacag

SEQ ID NO: 2294638 - DNA, 18 bp, Homo sapiens
caccctctgctgcacagt

SEQ ID NO: 2294639 - DNA, 18 bp, Homo sapiens
caccctgaggagtgatgg

SEQ ID NO: 2294640 - DNA, 12 bp, Homo sapiens
caccctgccacc

SEQ ID NO: 2294641 - DNA, 15 bp, Homo sapiens
caccctgccaccctc

SEQ ID NO: 2294642 - DNA, 14 bp, Homo sapiens
caccctgcttctgc

SEQ ID NO: 2294643 - DNA, 22 bp, Homo sapiens
caccctgcttctgctgcctgtt

SEQ ID NO: 2294644 - DNA, 23 bp, Homo sapiens
caccctggagtggcatggtcctg

SEQ ID NO: 2294645 - DNA, 21 bp, Homo sapiens
caccgaaaacgtggctgcttc

SEQ ID NO: 2294646 - DNA, 12 bp, Homo sapiens
caccgccatgca

SEQ ID NO: 2294647 - DNA, 15 bp, Homo sapiens
caccgcccaaccccc

SEQ ID NO: 2294648 - DNA, 22 bp, Homo sapiens
caccgcccaacccccacctccc

SEQ ID NO: 2294649 - DNA, 22 bp, Homo sapiens
caccgcccacccacaccccgtc

SEQ ID NO: 2294650 - DNA, 21 bp, Homo sapiens
caccgcccctggacaggcttc

SEQ ID NO: 2294651 - DNA, 16 bp, Homo sapiens
caccgcctgcccccag

SEQ ID NO: 2294652 - DNA, 20 bp, Homo sapiens
caccgcctgcccccagcgtg

SEQ ID NO: 2294653 - DNA, 16 bp, Homo sapiens
cacctcactcagcacc

SEQ ID NO: 2294654 - DNA, 21 bp, Homo sapiens
cacctcactcagcaccactca

SEQ ID NO: 2294655 - DNA, 23 bp, Homo sapiens
cacctcccggtgtatgcagtggt

SEQ ID NO: 2294656 - DNA, 14 bp, Homo sapiens
cacctctaggcctc

SEQ ID NO: 2294657 - DNA, 14 bp, Homo sapiens
cacctgaaacactt

SEQ ID NO: 2294658 - DNA, 12 bp, Homo sapiens
cacctgcccagt

SEQ ID NO: 2294659 - DNA, 22 bp, Homo sapiens
cacctgcccagttagcccggcc

SEQ ID NO: 2294660 - DNA, 14 bp, Homo sapiens
cacctgccgctgct

SEQ ID NO: 2294661 - DNA, 22 bp, Homo sapiens
cacctgccgctgcttgagtgga

SEQ ID NO: 2294662 - DNA, 13 bp, Homo sapiens
cacctgcctctga

SEQ ID NO: 2294663 - DNA, 17 bp, Homo sapiens
cacctgcctctgaactg

SEQ ID NO: 2294664 - DNA, 21 bp, Homo sapiens
cacctgcctctgaactgctgc

SEQ ID NO: 2294665 - DNA, 20 bp, Homo sapiens
caccttggcgcgcagcccgg

SEQ ID NO: 2294666 - DNA, 23 bp, Homo sapiens
caccttgggcacgggagagcgcc

SEQ ID NO: 2294667 - DNA, 21 bp, Homo sapiens
caccttgtacagaaccagcac

SEQ ID NO: 2294668 - DNA, 23 bp, Homo sapiens
caccttgtacagaaccagcactc

SEQ ID NO: 2294669 - DNA, 18 bp, Homo sapiens
cacctttatctcaagata

SEQ ID NO: 2294670 - DNA, 15 bp, Homo sapiens
cacctttccaaggcc

SEQ ID NO: 2294671 - DNA, 17 bp, Homo sapiens
cacgacataagctggta

SEQ ID NO: 2294672 - DNA, 20 bp, Homo sapiens
cacgattccaacccaggtct

SEQ ID NO: 2294673 - DNA, 18 bp, Homo sapiens
cacgcacttctggggcca

SEQ ID NO: 2294674 - DNA, 15 bp, Homo sapiens
atgcactcctgcccc

SEQ ID NO: 2294675 - DNA, 17 bp, Homo sapiens
atgcactcctgccccgg

SEQ ID NO: 2294676 - DNA, 21 bp, Homo sapiens
atgcactcctgccccggccca

SEQ ID NO: 2294677 - DNA, 13 bp, Homo sapiens
atgcagaaggtat

SEQ ID NO: 2294678 - DNA, 18 bp, Homo sapiens
atgcagcttggagacagg

SEQ ID NO: 2294679 - DNA, 14 bp, Homo sapiens
atgcagtccagtga

SEQ ID NO: 2294680 - DNA, 17 bp, Homo sapiens
atgcatagacaagtgtt

SEQ ID NO: 2294681 - DNA, 18 bp, Homo sapiens
atgcatagacaagtgttt

SEQ ID NO: 2294682 - DNA, 19 bp, Homo sapiens
atgcatatgatatatagtt

SEQ ID NO: 2294683 - DNA, 14 bp, Homo sapiens
atgcatgatgactc

SEQ ID NO: 2294684 - DNA, 19 bp, Homo sapiens
atgcatgatgactcttctt

SEQ ID NO: 2294685 - DNA, 22 bp, Homo sapiens
atgcatgatgactcttcttatc

SEQ ID NO: 2294686 - DNA, 21 bp, Homo sapiens
atgcattattttgtcataaaa

SEQ ID NO: 2294687 - DNA, 23 bp, Homo sapiens
atgccgctgtgtctatgaactag

SEQ ID NO: 2294688 - DNA, 15 bp, Homo sapiens
atgcctgtatttcca

SEQ ID NO: 2294689 - DNA, 19 bp, Homo sapiens
atgcctgtatttccaacaa

SEQ ID NO: 2294690 - DNA, 12 bp, Homo sapiens
atgcctttcaaa

SEQ ID NO: 2294691 - DNA, 15 bp, Homo sapiens
atgcggccggcctgg

SEQ ID NO: 2294692 - DNA, 21 bp, Homo sapiens
atgcgtgcagttcctgctgcc

SEQ ID NO: 2294693 - DNA, 15 bp, Homo sapiens
atgctaacaaactga

SEQ ID NO: 2294694 - DNA, 18 bp, Homo sapiens
atgctaatagaaaactgt

SEQ ID NO: 2294695 - DNA, 14 bp, Homo sapiens
atgctatggaaata

SEQ ID NO: 2294696 - DNA, 18 bp, Homo sapiens
atgctatggaaatacatt

SEQ ID NO: 2294697 - DNA, 11 bp, Homo sapiens
atgctatttta

SEQ ID NO: 2294698 - DNA, 12 bp, Homo sapiens
atgctgcagtgg

SEQ ID NO: 2294699 - DNA, 21 bp, Homo sapiens
atgctggtactattgtgacca

SEQ ID NO: 2294700 - DNA, 17 bp, Homo sapiens
atgcttgatataataat

SEQ ID NO: 2294701 - DNA, 19 bp, Homo sapiens
atgctttaaatagtttact

SEQ ID NO: 2294702 - DNA, 10 bp, Homo sapiens
atgctttctc

SEQ ID NO: 2294703 - DNA, 13 bp, Homo sapiens
atgctttcttcat

SEQ ID NO: 2294704 - DNA, 16 bp, Homo sapiens
atgctttcttcatgtt

SEQ ID NO: 2294705 - DNA, 17 bp, Homo sapiens
atgctttcttcatgttc

SEQ ID NO: 2294706 - DNA, 18 bp, Homo sapiens
atggaaacagaggaccag

SEQ ID NO: 2294707 - DNA, 20 bp, Homo sapiens
atggaaacagaggaccagca

SEQ ID NO: 2294708 - DNA, 18 bp, Homo sapiens
atggaaaggtcctgtggg

SEQ ID NO: 2294709 - DNA, 13 bp, Homo sapiens
atggaaatacatt

SEQ ID NO: 2294710 - DNA, 15 bp, Homo sapiens
atggaaatacattta

SEQ ID NO: 2294711 - DNA, 18 bp, Homo sapiens
atggaaatacatttagaa

SEQ ID NO: 2294712 - DNA, 17 bp, Homo sapiens
atggaacactctgagac

SEQ ID NO: 2294713 - DNA, 15 bp, Homo sapiens
atggaacttaaaaca

SEQ ID NO: 2294714 - DNA, 21 bp, Homo sapiens
atggaagtactataatttacc

SEQ ID NO: 2294715 - DNA, 15 bp, Homo sapiens
atggaccactgtttc

SEQ ID NO: 2294716 - DNA, 16 bp, Homo sapiens
atggaccactgtttct

SEQ ID NO: 2294717 - DNA, 18 bp, Homo sapiens
atggaccactgtttcttg

SEQ ID NO: 2294718 - DNA, 19 bp, Homo sapiens
atggacgtgttatgactcc

SEQ ID NO: 2294719 - DNA, 20 bp, Homo sapiens
atggacttaattatgctaac

SEQ ID NO: 2294720 - DNA, 22 bp, Homo sapiens
atggagcacgaggccttcagaa

SEQ ID NO: 2294721 - DNA, 22 bp, Homo sapiens
atggagtccagacctgggccct

SEQ ID NO: 2294722 - DNA, 18 bp, Homo sapiens
atggatattagatgcccg

SEQ ID NO: 2294723 - DNA, 17 bp, Homo sapiens
atggcagagccatccac

SEQ ID NO: 2294724 - DNA, 15 bp, Homo sapiens
atggcagaggagctt

SEQ ID NO: 2294725 - DNA, 15 bp, Homo sapiens
atggccaagtgtaca

SEQ ID NO: 2294726 - DNA, 15 bp, Homo sapiens
atggccccagctggc

SEQ ID NO: 2294727 - DNA, 17 bp, Homo sapiens
atggccccagctggctg

SEQ ID NO: 2294728 - DNA, 13 bp, Homo sapiens
atggcgcacccgg

SEQ ID NO: 2294729 - DNA, 22 bp, Homo sapiens
atggcgcacccggcagcccccc

SEQ ID NO: 2294730 - DNA, 12 bp, Homo sapiens
atggctgtattt

SEQ ID NO: 2294731 - DNA, 15 bp, Homo sapiens
atgggaagcattagt

SEQ ID NO: 2294732 - DNA, 21 bp, Homo sapiens
atgggagtcagggagccctgg

SEQ ID NO: 2294733 - DNA, 21 bp, Homo sapiens
atgggcacaggctgccccacc

SEQ ID NO: 2294734 - DNA, 22 bp, Homo sapiens
atggggaacccgctctcccaga

SEQ ID NO: 2294735 - DNA, 15 bp, Homo sapiens
atggggactctccag

SEQ ID NO: 2294736 - DNA, 16 bp, Homo sapiens
atggggactctccagg

SEQ ID NO: 2294737 - DNA, 19 bp, Homo sapiens
atggggactctccaggcac

SEQ ID NO: 2294738 - DNA, 19 bp, Homo sapiens
atgggggccaggctgagcc

SEQ ID NO: 2294739 - DNA, 19 bp, Homo sapiens
atgggggctcctggcagtg

SEQ ID NO: 2294740 - DNA, 18 bp, Homo sapiens
atggggttgggctctgcg

SEQ ID NO: 2294741 - DNA, 20 bp, Homo sapiens
atgggtgtcccctggtgccc

SEQ ID NO: 2294742 - DNA, 21 bp, Homo sapiens
atggtagaagatgaatcagta

SEQ ID NO: 2294743 - DNA, 16 bp, Homo sapiens
atggtatctgttactc

SEQ ID NO: 2294744 - DNA, 20 bp, Homo sapiens
atggtatctgttactccaaa

SEQ ID NO: 2294745 - DNA, 19 bp, Homo sapiens
atggtattttcgtgcattt

SEQ ID NO: 2294746 - DNA, 20 bp, Homo sapiens
atggtattttcgtgcatttg

SEQ ID NO: 2294747 - DNA, 20 bp, Homo sapiens
atggtcaaaaagtgatggct

SEQ ID NO: 2294748 - DNA, 13 bp, Homo sapiens
atggtcacagacc

SEQ ID NO: 2294749 - DNA, 20 bp, Homo sapiens
atggtcacagacccctgggg

SEQ ID NO: 2294750 - DNA, 12 bp, Homo sapiens
atggtcctgtgc

SEQ ID NO: 2294751 - DNA, 13 bp, Homo sapiens
atggtcctgtgcc

SEQ ID NO: 2294752 - DNA, 16 bp, Homo sapiens
atggtgcaatgacctt

SEQ ID NO: 2294753 - DNA, 18 bp, Homo sapiens
atggtgtgcttatgtttt

SEQ ID NO: 2294754 - DNA, 17 bp, Homo sapiens
atggttcaaagatacaa

SEQ ID NO: 2294755 - DNA, 14 bp, Homo sapiens
atgtaagaaataag

SEQ ID NO: 2294756 - DNA, 18 bp, Homo sapiens
atgtaagggctttaaata

SEQ ID NO: 2294757 - DNA, 18 bp, Homo sapiens
atgtacagaaaatagctt

SEQ ID NO: 2294758 - DNA, 21 bp, Homo sapiens
atgtacagaaaatagctttta

SEQ ID NO: 2294759 - DNA, 18 bp, Homo sapiens
atgtaccatgttgcccag

SEQ ID NO: 2294760 - DNA, 15 bp, Homo sapiens
atgtactagtactgt

SEQ ID NO: 2294761 - DNA, 12 bp, Homo sapiens
atgtactgtatt

SEQ ID NO: 2294762 - DNA, 14 bp, Homo sapiens
atgtacttttccat

SEQ ID NO: 2294763 - DNA, 16 bp, Homo sapiens
atgtacttttccattt

SEQ ID NO: 2294764 - DNA, 17 bp, Homo sapiens
atgtagaactgttcatt

SEQ ID NO: 2294765 - DNA, 21 bp, Homo sapiens
atgtagaactgttcatttcca

SEQ ID NO: 2294766 - DNA, 16 bp, Homo sapiens
atgtagacaaaactta

SEQ ID NO: 2294767 - DNA, 22 bp, Homo sapiens
atgtagacaaaacttataattt

SEQ ID NO: 2294768 - DNA, 14 bp, Homo sapiens
atgtagcattaaat

SEQ ID NO: 2294769 - DNA, 16 bp, Homo sapiens
atgtagcattaaatat

SEQ ID NO: 2294770 - DNA, 21 bp, Homo sapiens
atgtagcattaaatataaaat

SEQ ID NO: 2294771 - DNA, 22 bp, Homo sapiens
atgtagcattaaatataaaata

SEQ ID NO: 2294772 - DNA, 17 bp, Homo sapiens
atgtagccagcagaact

SEQ ID NO: 2294773 - DNA, 19 bp, Homo sapiens
atgtatagaaaataaaata

SEQ ID NO: 2294774 - DNA, 22 bp, Homo sapiens
atgtatagaaaataaaataaat

SEQ ID NO: 2294775 - DNA, 23 bp, Homo sapiens
atgtatatctgtaatatataatc

SEQ ID NO: 2294776 - DNA, 13 bp, Homo sapiens
atgtatcttattt

SEQ ID NO: 2294777 - DNA, 20 bp, Homo sapiens
atgtatcttatttatatatg

SEQ ID NO: 2294778 - DNA, 17 bp, Homo sapiens
atgtattcttttatata

SEQ ID NO: 2294779 - DNA, 19 bp, Homo sapiens
atgtattcttttatataac

SEQ ID NO: 2294780 - DNA, 20 bp, Homo sapiens
atgtattcttttatataact

SEQ ID NO: 2294781 - DNA, 16 bp, Homo sapiens
atgtatttaaagaaca

SEQ ID NO: 2294782 - DNA, 15 bp, Homo sapiens
atgtattttcaataa

SEQ ID NO: 2294783 - DNA, 16 bp, Homo sapiens
atgtcaaaaatatttt

SEQ ID NO: 2294784 - DNA, 18 bp, Homo sapiens
atgtcagaaggagacaga

SEQ ID NO: 2294785 - DNA, 12 bp, Homo sapiens
atgtcagtgtga

SEQ ID NO: 2294786 - DNA, 15 bp, Homo sapiens
atgtcagtgtgactg

SEQ ID NO: 2294787 - DNA, 22 bp, Homo sapiens
atgtcctggaagtgtgtgtttc

SEQ ID NO: 2294788 - DNA, 13 bp, Homo sapiens
atgtctactgctt

SEQ ID NO: 2294789 - DNA, 16 bp, Homo sapiens
atgtctgttctaagtc

SEQ ID NO: 2294790 - DNA, 12 bp, Homo sapiens
atgtctttccta

SEQ ID NO: 2294791 - DNA, 19 bp, Homo sapiens
atgtgaaataaagagttct

SEQ ID NO: 2294792 - DNA, 18 bp, Homo sapiens
atgtgaaggtgtttcaaa

SEQ ID NO: 2294793 - DNA, 14 bp, Homo sapiens
atgtgagctataat

SEQ ID NO: 2294794 - DNA, 16 bp, Homo sapiens
atgtgatctgtcttgt

SEQ ID NO: 2294795 - DNA, 16 bp, Homo sapiens
atgtgatgagaggaaa

SEQ ID NO: 2294796 - DNA, 23 bp, Homo sapiens
atgtgcagacactcaagagccct

SEQ ID NO: 2294797 - DNA, 15 bp, Homo sapiens
atgtgctttcatcca

SEQ ID NO: 2294798 - DNA, 17 bp, Homo sapiens
atgtggccttgagcaag

SEQ ID NO: 2294799 - DNA, 22 bp, Homo sapiens
atgtgggaagttaccttttata

SEQ ID NO: 2294800 - DNA, 16 bp, Homo sapiens
atgtgggctgaaggat

SEQ ID NO: 2294801 - DNA, 19 bp, Homo sapiens
atgtgtaaatgtggacaca

SEQ ID NO: 2294802 - DNA, 18 bp, Homo sapiens
atgtgtacagaaacaact

SEQ ID NO: 2294803 - DNA, 12 bp, Homo sapiens
atgtgtagatat

SEQ ID NO: 2294804 - DNA, 21 bp, Homo sapiens
atgtgtagatattatgtatag

SEQ ID NO: 2294805 - DNA, 20 bp, Homo sapiens
atgtgtcaaagagatgagga

SEQ ID NO: 2294806 - DNA, 18 bp, Homo sapiens
atgtgtcatgatttcaat

SEQ ID NO: 2294807 - DNA, 21 bp, Homo sapiens
atgtgtccatgtgaaatttac

SEQ ID NO: 2294808 - DNA, 21 bp, Homo sapiens
atgtgtgctcttatccccagc

SEQ ID NO: 2294809 - DNA, 20 bp, Homo sapiens
atgtgtggctcattcttttc

SEQ ID NO: 2294810 - DNA, 17 bp, Homo sapiens
atgtgttaaatttagtg

SEQ ID NO: 2294811 - DNA, 18 bp, Homo sapiens
attgtctgctgcctccaa

SEQ ID NO: 2294812 - DNA, 12 bp, Homo sapiens
attgtgccaaag

SEQ ID NO: 2294813 - DNA, 15 bp, Homo sapiens
attgtgccaaagata

SEQ ID NO: 2294814 - DNA, 19 bp, Homo sapiens
attgtgtaagaatcactgc

SEQ ID NO: 2294815 - DNA, 15 bp, Homo sapiens
attgtgttcttaaaa

SEQ ID NO: 2294816 - DNA, 20 bp, Homo sapiens
attgtgttcttaaaatattg

SEQ ID NO: 2294817 - DNA, 19 bp, Homo sapiens
attgttaaaaccttactta

SEQ ID NO: 2294818 - DNA, 12 bp, Homo sapiens
attgttatgtaa

SEQ ID NO: 2294819 - DNA, 20 bp, Homo sapiens
atttaaaaaatgaatagtac

SEQ ID NO: 2294820 - DNA, 15 bp, Homo sapiens
atttaaaaagcccaa

SEQ ID NO: 2294821 - DNA, 16 bp, Homo sapiens
atttaaaaatctttca

SEQ ID NO: 2294822 - DNA, 17 bp, Homo sapiens
atttaaaatagttttct

SEQ ID NO: 2294823 - DNA, 11 bp, Homo sapiens
atttaaaattc

SEQ ID NO: 2294824 - DNA, 14 bp, Homo sapiens
atttaaaattcata

SEQ ID NO: 2294825 - DNA, 21 bp, Homo sapiens
atttaaaggaaagttctatta

SEQ ID NO: 2294826 - DNA, 20 bp, Homo sapiens
atttaaatcagactagagaa

SEQ ID NO: 2294827 - DNA, 18 bp, Homo sapiens
atttaactactaagaata

SEQ ID NO: 2294828 - DNA, 22 bp, Homo sapiens
atttaactactaagaataaata

SEQ ID NO: 2294829 - DNA, 14 bp, Homo sapiens
atttaactgcatat

SEQ ID NO: 2294830 - DNA, 16 bp, Homo sapiens
atttaatatactgcat

SEQ ID NO: 2294831 - DNA, 18 bp, Homo sapiens
atttaatatactgcatat

SEQ ID NO: 2294832 - DNA, 16 bp, Homo sapiens
atttaattgtgtaact

SEQ ID NO: 2294833 - DNA, 19 bp, Homo sapiens
atttaattgtgtaactgtt

SEQ ID NO: 2294834 - DNA, 16 bp, Homo sapiens
atttacagttactgcc

SEQ ID NO: 2294835 - DNA, 17 bp, Homo sapiens
atttacagttactgcct

SEQ ID NO: 2294836 - DNA, 15 bp, Homo sapiens
atttagataacaaga

SEQ ID NO: 2294837 - DNA, 18 bp, Homo sapiens
atttagatattcatactt

SEQ ID NO: 2294838 - DNA, 18 bp, Homo sapiens
atttagtccaatgaagat

SEQ ID NO: 2294839 - DNA, 16 bp, Homo sapiens
atttatactgtagcaa

SEQ ID NO: 2294840 - DNA, 17 bp, Homo sapiens
atttatactgtagcaat

SEQ ID NO: 2294841 - DNA, 15 bp, Homo sapiens
atttatgaagatagt

SEQ ID NO: 2294842 - DNA, 22 bp, Homo sapiens
atttatgactagcaaacaaaaa

SEQ ID NO: 2294843 - DNA, 15 bp, Homo sapiens
atttattcatgtgta

SEQ ID NO: 2294844 - DNA, 15 bp, Homo sapiens
atttatttatgttct

SEQ ID NO: 2294845 - DNA, 17 bp, Homo sapiens
atttcaaaccagtttca

SEQ ID NO: 2294846 - DNA, 20 bp, Homo sapiens
atttcaaagaaaacagacca

SEQ ID NO: 2294847 - DNA, 12 bp, Homo sapiens
atttcaaatgca

SEQ ID NO: 2294848 - DNA, 23 bp, Homo sapiens
atttcaataagtgttgtaccata

SEQ ID NO: 2294849 - DNA, 21 bp, Homo sapiens
atttcaatagtacccaaccaa

SEQ ID NO: 2294850 - DNA, 14 bp, Homo sapiens
atttcacagtattt

SEQ ID NO: 2294851 - DNA, 12 bp, Homo sapiens
atttcactctcc

SEQ ID NO: 2294852 - DNA, 14 bp, Homo sapiens
atttcactctcctt

SEQ ID NO: 2294853 - DNA, 22 bp, Homo sapiens
atttcatcttgcaaatgttgta

SEQ ID NO: 2294854 - DNA, 22 bp, Homo sapiens
atttcatttatactgtagcaat

SEQ ID NO: 2294855 - DNA, 23 bp, Homo sapiens
atttcatttatactgtagcaata

SEQ ID NO: 2294856 - DNA, 14 bp, Homo sapiens
atttccaaatattc

SEQ ID NO: 2294857 - DNA, 17 bp, Homo sapiens
atttccaaatattctaa

SEQ ID NO: 2294858 - DNA, 18 bp, Homo sapiens
atttccaaatattctaaa

SEQ ID NO: 2294859 - DNA, 21 bp, Homo sapiens
atttccaccaagggtatctgc

SEQ ID NO: 2294860 - DNA, 21 bp, Homo sapiens
atttctagcagtatgtgtgct

SEQ ID NO: 2294861 - DNA, 23 bp, Homo sapiens
atttctagcagtatgtgtgctct

SEQ ID NO: 2294862 - DNA, 16 bp, Homo sapiens
atttctatctgcaaat

SEQ ID NO: 2294863 - DNA, 15 bp, Homo sapiens
atttctcctctttct

SEQ ID NO: 2294864 - DNA, 20 bp, Homo sapiens
atttctcctgcgtgttctca

SEQ ID NO: 2294865 - DNA, 15 bp, Homo sapiens
atttctcttcctaaa

SEQ ID NO: 2294866 - DNA, 22 bp, Homo sapiens
atttctgctcagattcccccca

SEQ ID NO: 2294867 - DNA, 14 bp, Homo sapiens
atttctttgattgt

SEQ ID NO: 2294868 - DNA, 15 bp, Homo sapiens
atttctttgattgtg

SEQ ID NO: 2294869 - DNA, 17 bp, Homo sapiens
atttctttgattgtgaa

SEQ ID NO: 2294870 - DNA, 21 bp, Homo sapiens
atttgaaagaagtcaaatgaa

SEQ ID NO: 2294871 - DNA, 18 bp, Homo sapiens
atttgatatacagacctc

SEQ ID NO: 2294872 - DNA, 20 bp, Homo sapiens
atttgatatacagacctcca

SEQ ID NO: 2294873 - DNA, 19 bp, Homo sapiens
atttgatcttgtaaaaata

SEQ ID NO: 2294874 - DNA, 17 bp, Homo sapiens
atttgccagacagagat

SEQ ID NO: 2294875 - DNA, 18 bp, Homo sapiens
atttgccagacagagatc

SEQ ID NO: 2294876 - DNA, 15 bp, Homo sapiens
atttgctatataatt

SEQ ID NO: 2294877 - DNA, 15 bp, Homo sapiens
atttgcttatttata

SEQ ID NO: 2294878 - DNA, 22 bp, Homo sapiens
atttggccgagtcagcacgtag

SEQ ID NO: 2294879 - DNA, 15 bp, Homo sapiens
atttggctcgctgtg

SEQ ID NO: 2294880 - DNA, 22 bp, Homo sapiens
atttggtcctgcctaaatttca

SEQ ID NO: 2294881 - DNA, 23 bp, Homo sapiens
atttgtaatgtatcttatttata

SEQ ID NO: 2294882 - DNA, 20 bp, Homo sapiens
atttgtaggtatactatgta

SEQ ID NO: 2294883 - DNA, 13 bp, Homo sapiens
atttgtatttata

SEQ ID NO: 2294884 - DNA, 16 bp, Homo sapiens
atttgtatttatatta

SEQ ID NO: 2294885 - DNA, 22 bp, Homo sapiens
atttgtcttcttttcaaaataa

SEQ ID NO: 2294886 - DNA, 15 bp, Homo sapiens
atttgtgatacttcc

SEQ ID NO: 2294887 - DNA, 18 bp, Homo sapiens
atttgtgtagattgtgta

SEQ ID NO: 2294888 - DNA, 22 bp, Homo sapiens
attttaaaaaataacatattct

SEQ ID NO: 2294889 - DNA, 13 bp, Homo sapiens
attttaaaaataa

SEQ ID NO: 2294890 - DNA, 20 bp, Homo sapiens
attttaaaatcaacttttga

SEQ ID NO: 2294891 - DNA, 19 bp, Homo sapiens
attttaaaatgcaaatatt

SEQ ID NO: 2294892 - DNA, 24 bp, Homo sapiens
attttaaaatgcaaatattgctat

SEQ ID NO: 2294893 - DNA, 15 bp, Homo sapiens
attttaaaattcatg

SEQ ID NO: 2294894 - DNA, 16 bp, Homo sapiens
attttaacagacatgt

SEQ ID NO: 2294895 - DNA, 18 bp, Homo sapiens
attttaacagacatgtat

SEQ ID NO: 2294896 - DNA, 12 bp, Homo sapiens
attttaatgtaa

SEQ ID NO: 2294897 - DNA, 18 bp, Homo sapiens
attttactgtctgtaaga

SEQ ID NO: 2294898 - DNA, 16 bp, Homo sapiens
attttagacaaccata

SEQ ID NO: 2294899 - DNA, 14 bp, Homo sapiens
attttagatttctt

SEQ ID NO: 2294900 - DNA, 15 bp, Homo sapiens
attttaggctattat

SEQ ID NO: 2294901 - DNA, 21 bp, Homo sapiens
attttatccctttctcttctg

SEQ ID NO: 2294902 - DNA, 16 bp, Homo sapiens
attttcaataaagaaa

SEQ ID NO: 2294903 - DNA, 17 bp, Homo sapiens
attttcaataaagaaaa

SEQ ID NO: 2294904 - DNA, 16 bp, Homo sapiens
attttcataattcatt

SEQ ID NO: 2294905 - DNA, 18 bp, Homo sapiens
attttcataattcattta

SEQ ID NO: 2294906 - DNA, 21 bp, Homo sapiens
attttcataattcatttaaga

SEQ ID NO: 2294907 - DNA, 13 bp, Homo sapiens
attttcatcccac

SEQ ID NO: 2294908 - DNA, 14 bp, Homo sapiens
attttcgtgcattt

SEQ ID NO: 2294909 - DNA, 13 bp, Homo sapiens
attttctaaactg

SEQ ID NO: 2294910 - DNA, 14 bp, Homo sapiens
attttctaaactgt

SEQ ID NO: 2294911 - DNA, 19 bp, Homo sapiens
attttctgaattcataaaa

SEQ ID NO: 2294912 - DNA, 15 bp, Homo sapiens
attttcttcccattt

SEQ ID NO: 2294913 - DNA, 16 bp, Homo sapiens
attttcttcccatttg

SEQ ID NO: 2294914 - DNA, 18 bp, Homo sapiens
attttcttcccatttgta

SEQ ID NO: 2294915 - DNA, 14 bp, Homo sapiens
attttctttctatg

SEQ ID NO: 2294916 - DNA, 15 bp, Homo sapiens
attttctttctatgt

SEQ ID NO: 2294917 - DNA, 17 bp, Homo sapiens
attttcttttatatctg

SEQ ID NO: 2294918 - DNA, 21 bp, Homo sapiens
attttgatttttttgttcatt

SEQ ID NO: 2294919 - DNA, 12 bp, Homo sapiens
attttggctcag

SEQ ID NO: 2294920 - DNA, 16 bp, Homo sapiens
attttgtattattgct

SEQ ID NO: 2294921 - DNA, 19 bp, Homo sapiens
attttgtattattgctgtt

SEQ ID NO: 2294922 - DNA, 22 bp, Homo sapiens
attttgtattattgctgttgct

SEQ ID NO: 2294923 - DNA, 19 bp, Homo sapiens
attttgtcataaaatgcta

SEQ ID NO: 2294924 - DNA, 14 bp, Homo sapiens
attttgtttccaaa

SEQ ID NO: 2294925 - DNA, 14 bp, Homo sapiens
atttttaaatcatt

SEQ ID NO: 2294926 - DNA, 19 bp, Homo sapiens
atttttaacttatctccag

SEQ ID NO: 2294927 - DNA, 21 bp, Homo sapiens
atttttaccccctaaggaata

SEQ ID NO: 2294928 - DNA, 18 bp, Homo sapiens
atttttactcaggctttc

SEQ ID NO: 2294929 - DNA, 20 bp, Homo sapiens
atttttactcaggctttcta

SEQ ID NO: 2294930 - DNA, 16 bp, Homo sapiens
atttttagagattaat

SEQ ID NO: 2294931 - DNA, 20 bp, Homo sapiens
atttttatataatatgaata

SEQ ID NO: 2294932 - DNA, 22 bp, Homo sapiens
atttttcttggatctttttgca

SEQ ID NO: 2294933 - DNA, 15 bp, Homo sapiens
attttttatttaatt

SEQ ID NO: 2294934 - DNA, 22 bp, Homo sapiens
atttttttatataagttaaaga

SEQ ID NO: 2294935 - DNA, 22 bp, Homo sapiens
atttttttctagctataacaac

SEQ ID NO: 2294936 - DNA, 17 bp, Homo sapiens
atttttttttccttcag

SEQ ID NO: 2294937 - DNA, 18 bp, Homo sapiens
atttttttttccttcagt

SEQ ID NO: 2294938 - DNA, 23 bp, Homo sapiens
atttttttttccttcagtgcctt

SEQ ID NO: 2294939 - DNA, 13 bp, Homo sapiens
caaaaactgtttt

SEQ ID NO: 2294940 - DNA, 14 bp, Homo sapiens
caaaaatagaatat

SEQ ID NO: 2294941 - DNA, 11 bp, Homo sapiens
caaaaatattt

SEQ ID NO: 2294942 - DNA, 19 bp, Homo sapiens
caaaactatcggttcaagt

SEQ ID NO: 2294943 - DNA, 14 bp, Homo sapiens
caaaagataaaact

SEQ ID NO: 2294944 - DNA, 23 bp, Homo sapiens
caaaaggctggatgtgctttcat

SEQ ID NO: 2294945 - DNA, 15 bp, Homo sapiens
caaaagtcattgctg

SEQ ID NO: 2294946 - DNA, 11 bp, Homo sapiens
caaaataaaat

SEQ ID NO: 2294947 - DNA, 21 bp, Homo sapiens
caaaataattagctatatttt

SEQ ID NO: 2294948 - DNA, 18 bp, Homo sapiens
caaaatagtcatgtttct

SEQ ID NO: 2294949 - DNA, 22 bp, Homo sapiens
caaaatagtcatgtttctgcag

SEQ ID NO: 2294950 - DNA, 13 bp, Homo sapiens
caaaatagttcta

SEQ ID NO: 2294951 - DNA, 18 bp, Homo sapiens
caaaatagttctatttct

SEQ ID NO: 2294952 - DNA, 19 bp, Homo sapiens
caaaatagttctatttcta

SEQ ID NO: 2294953 - DNA, 20 bp, Homo sapiens
caaaatagttctatttctat

SEQ ID NO: 2294954 - DNA, 23 bp, Homo sapiens
caaaatagttctatttctatctg

SEQ ID NO: 2294955 - DNA, 24 bp, Homo sapiens
caaaatagttctatttctatctgc

SEQ ID NO: 2294956 - DNA, 19 bp, Homo sapiens
caaaatatttatttgtttt

SEQ ID NO: 2294957 - DNA, 21 bp, Homo sapiens
caaaatatttctaagcttatt

SEQ ID NO: 2294958 - DNA, 22 bp, Homo sapiens
caaaatatttctaagcttattt

SEQ ID NO: 2294959 - DNA, 16 bp, Homo sapiens
caaaatgttaacaact

SEQ ID NO: 2294960 - DNA, 14 bp, Homo sapiens
caaaatttaattgt

SEQ ID NO: 2294961 - DNA, 23 bp, Homo sapiens
caaaatttaattgtgtaactgtt

SEQ ID NO: 2294962 - DNA, 23 bp, Homo sapiens
caaacaaaaatagaatatataaa

SEQ ID NO: 2294963 - DNA, 20 bp, Homo sapiens
caaacaaaggatttgaaaac

SEQ ID NO: 2294964 - DNA, 21 bp, Homo sapiens
caaacaatttagccagaatgt

SEQ ID NO: 2294965 - DNA, 22 bp, Homo sapiens
caaacacccaagcacaaactgt

SEQ ID NO: 2294966 - DNA, 20 bp, Homo sapiens
caaacaccttcttattatat

SEQ ID NO: 2294967 - DNA, 23 bp, Homo sapiens
caaacagaaacgagatttgccaa

SEQ ID NO: 2294968 - DNA, 11 bp, Homo sapiens
caaacatgtgg

SEQ ID NO: 2294969 - DNA, 15 bp, Homo sapiens
caaacattcttattt

SEQ ID NO: 2294970 - DNA, 16 bp, Homo sapiens
caaacattgagactgc

SEQ ID NO: 2294971 - DNA, 21 bp, Homo sapiens
caaaccatcattgaaatcttt

SEQ ID NO: 2294972 - DNA, 17 bp, Homo sapiens
caaacctgcaaggcaaa

SEQ ID NO: 2294973 - DNA, 17 bp, Homo sapiens
caaactatggtgtgctt

SEQ ID NO: 2294974 - DNA, 22 bp, Homo sapiens
caaactatggtgtgcttatgtt

SEQ ID NO: 2294975 - DNA, 19 bp, Homo sapiens
caaactgtagtaattgtta

SEQ ID NO: 2294976 - DNA, 23 bp, Homo sapiens
caaactgtagtaattgttacaat

SEQ ID NO: 2294977 - DNA, 14 bp, Homo sapiens
caaacttactgtca

SEQ ID NO: 2294978 - DNA, 13 bp, Homo sapiens
caaagaaaacaga

SEQ ID NO: 2294979 - DNA, 22 bp, Homo sapiens
caaagaaggcacaggtgtaaat

SEQ ID NO: 2294980 - DNA, 23 bp, Homo sapiens
caaagaaggcacaggtgtaaata

SEQ ID NO: 2294981 - DNA, 15 bp, Homo sapiens
caaagacatttcatc

SEQ ID NO: 2294982 - DNA, 18 bp, Homo sapiens
caaagaggcattcagcaa

SEQ ID NO: 2294983 - DNA, 17 bp, Homo sapiens
caaagaggccagtactt

SEQ ID NO: 2294984 - DNA, 18 bp, Homo sapiens
caaagaggccagtacttt

SEQ ID NO: 2294985 - DNA, 20 bp, Homo sapiens
caaagaggccagtactttgc

SEQ ID NO: 2294986 - DNA, 13 bp, Homo sapiens
caaagatagcaga

SEQ ID NO: 2294987 - DNA, 15 bp, Homo sapiens
caaagcagtgcatgc

SEQ ID NO: 2294988 - DNA, 22 bp, Homo sapiens
caaagcagtgcatgctgtccct

SEQ ID NO: 2294989 - DNA, 18 bp, Homo sapiens
caaagctttcctgtttcc

SEQ ID NO: 2294990 - DNA, 14 bp, Homo sapiens
caaagggcaggcct

SEQ ID NO: 2294991 - DNA, 17 bp, Homo sapiens
caaagggcaggcctgtt

SEQ ID NO: 2294992 - DNA, 19 bp, Homo sapiens
caaaggggatcataaagtt

SEQ ID NO: 2294993 - DNA, 20 bp, Homo sapiens
caaaggggatcataaagtta

SEQ ID NO: 2294994 - DNA, 17 bp, Homo sapiens
caaaggggcctctcctt

SEQ ID NO: 2294995 - DNA, 16 bp, Homo sapiens
caaagggtaaattata

SEQ ID NO: 2294996 - DNA, 16 bp, Homo sapiens
caaagtcatgtcagaa

SEQ ID NO: 2294997 - DNA, 14 bp, Homo sapiens
caaagtttggaagt

SEQ ID NO: 2294998 - DNA, 23 bp, Homo sapiens
caaataaaacagtgaaagccctg

SEQ ID NO: 2294999 - DNA, 15 bp, Homo sapiens
caaataaaatgttta

SEQ ID NO: 2295000 - DNA, 17 bp, Homo sapiens
caaataaaatgtttaca

SEQ ID NO: 2295001 - DNA, 12 bp, Homo sapiens
caaataaatgtg

SEQ ID NO: 2295002 - DNA, 13 bp, Homo sapiens
caaataaatgtgt

SEQ ID NO: 2295003 - DNA, 14 bp, Homo sapiens
caaataaatgtgta

SEQ ID NO: 2295004 - DNA, 17 bp, Homo sapiens
caaataaatgtgtaaat

SEQ ID NO: 2295005 - DNA, 18 bp, Homo sapiens
caaataaatgtgtaaatg

SEQ ID NO: 2295006 - DNA, 21 bp, Homo sapiens
caaataagatatttttcagct

SEQ ID NO: 2295007 - DNA, 12 bp, Homo sapiens
caaatataaact

SEQ ID NO: 2295008 - DNA, 13 bp, Homo sapiens
caaatataaactt

SEQ ID NO: 2295009 - DNA, 14 bp, Homo sapiens
caaatataaacttg

SEQ ID NO: 2295010 - DNA, 15 bp, Homo sapiens
caaatattagccaaa

SEQ ID NO: 2295011 - DNA, 14 bp, Homo sapiens
caaatattctaaaa

SEQ ID NO: 2295012 - DNA, 18 bp, Homo sapiens
caaatattctaaaaaaga

SEQ ID NO: 2295013 - DNA, 20 bp, Homo sapiens
caaatattctaaaaaagata

SEQ ID NO: 2295014 - DNA, 18 bp, Homo sapiens
caaatgaatgcctttcaa

SEQ ID NO: 2295015 - DNA, 23 bp, Homo sapiens
caaatgagtttaaaaaaataaca

SEQ ID NO: 2295016 - DNA, 18 bp, Homo sapiens
caaatgcacatttgtcac

SEQ ID NO: 2295017 - DNA, 14 bp, Homo sapiens
caaatgctaaatgc

SEQ ID NO: 2295018 - DNA, 20 bp, Homo sapiens
caaatggaaacagaggacca

SEQ ID NO: 2295019 - DNA, 16 bp, Homo sapiens
caaattaacctttcag

SEQ ID NO: 2295020 - DNA, 14 bp, Homo sapiens
caaattattctagt

SEQ ID NO: 2295021 - DNA, 13 bp, Homo sapiens
caaatttaacagg

SEQ ID NO: 2295022 - DNA, 18 bp, Homo sapiens
caaattttccttcctgtt

SEQ ID NO: 2295023 - DNA, 15 bp, Homo sapiens
caaatttttactcag

SEQ ID NO: 2295024 - DNA, 23 bp, Homo sapiens
caacaaacctgtttctgcagcca

SEQ ID NO: 2295025 - DNA, 17 bp, Homo sapiens
caacaaagtgcttcctt

SEQ ID NO: 2295026 - DNA, 14 bp, Homo sapiens
caacaacttaatgt

SEQ ID NO: 2295027 - DNA, 19 bp, Homo sapiens
caacagcatgtctactgct

SEQ ID NO: 2295028 - DNA, 16 bp, Homo sapiens
caacaggtcacttgat

SEQ ID NO: 2295029 - DNA, 14 bp, Homo sapiens
caacatccactctc

SEQ ID NO: 2295030 - DNA, 15 bp, Homo sapiens
caacattatcctgtg

SEQ ID NO: 2295031 - DNA, 19 bp, Homo sapiens
caacattcccccaacatta

SEQ ID NO: 2295032 - DNA, 16 bp, Homo sapiens
caaccaaagatgctta

SEQ ID NO: 2295033 - DNA, 14 bp, Homo sapiens
caaccaataaaagt

SEQ ID NO: 2295034 - DNA, 15 bp, Homo sapiens
caaccaataaaagtg

SEQ ID NO: 2295035 - DNA, 13 bp, Homo sapiens
caaccacttgcta

SEQ ID NO: 2295036 - DNA, 14 bp, Homo sapiens
caaccatagaactg

SEQ ID NO: 2295037 - DNA, 12 bp, Homo sapiens
caaccctgccct

SEQ ID NO: 2295038 - DNA, 16 bp, Homo sapiens
caacctctcagatccc

SEQ ID NO: 2295039 - DNA, 14 bp, Homo sapiens
caacctcttcctcc

SEQ ID NO: 2295040 - DNA, 15 bp, Homo sapiens
caacctggaggctgg

SEQ ID NO: 2295041 - DNA, 18 bp, Homo sapiens
caacctggaggctggacc

SEQ ID NO: 2295042 - DNA, 14 bp, Homo sapiens
caacctgtgcaaaa

SEQ ID NO: 2295043 - DNA, 19 bp, Homo sapiens
caacctgtgcaaaataaaa

SEQ ID NO: 2295044 - DNA, 14 bp, Homo sapiens
caactatttcaata

SEQ ID NO: 2295045 - DNA, 15 bp, Homo sapiens
caactatttcaataa

SEQ ID NO: 2295046 - DNA, 19 bp, Homo sapiens
caactccaggaaaactgtt

SEQ ID NO: 2295047 - DNA, 19 bp, Homo sapiens
caactgagatgttaaaata

SEQ ID NO: 2295048 - DNA, 23 bp, Homo sapiens
caactgcatcaagatgtgacatg

SEQ ID NO: 2295049 - DNA, 18 bp, Homo sapiens
caactgccaaataaaatg

SEQ ID NO: 2295050 - DNA, 23 bp, Homo sapiens
caactgccaaataaaatgtttac

SEQ ID NO: 2295051 - DNA, 23 bp, Homo sapiens
caactgctttgttttggctgctc

SEQ ID NO: 2295052 - DNA, 18 bp, Homo sapiens
caactggaaggctttatt

SEQ ID NO: 2295053 - DNA, 17 bp, Homo sapiens
caactgttgccaggaga

SEQ ID NO: 2295054 - DNA, 19 bp, Homo sapiens
caactgttggataataact

SEQ ID NO: 2295055 - DNA, 17 bp, Homo sapiens
caacttttctgctacct

SEQ ID NO: 2295056 - DNA, 16 bp, Homo sapiens
caagaaaaagtagaaa

SEQ ID NO: 2295057 - DNA, 13 bp, Homo sapiens
caagaagaatata

SEQ ID NO: 2295058 - DNA, 15 bp, Homo sapiens
caagaagattctaaa

SEQ ID NO: 2295059 - DNA, 17 bp, Homo sapiens
caagaaggatgattcaa

SEQ ID NO: 2295060 - DNA, 15 bp, Homo sapiens
caagaccaaatggaa

SEQ ID NO: 2295061 - DNA, 15 bp, Homo sapiens
caagagaattcactt

SEQ ID NO: 2295062 - DNA, 20 bp, Homo sapiens
caagagtacaggtcttcttt

SEQ ID NO: 2295063 - DNA, 18 bp, Homo sapiens
caagatttccctaaaaat

SEQ ID NO: 2295064 - DNA, 15 bp, Homo sapiens
caagcacaaactgtc

SEQ ID NO: 2295065 - DNA, 17 bp, Homo sapiens
caagcatcatggatcaa

SEQ ID NO: 2295066 - DNA, 15 bp, Homo sapiens
caagccaaacattct

SEQ ID NO: 2295067 - DNA, 19 bp, Homo sapiens
caagccaaacattcttatt

SEQ ID NO: 2295068 - DNA, 21 bp, Homo sapiens
caagccaaacattcttatttt

SEQ ID NO: 2295069 - DNA, 13 bp, Homo sapiens
caagccagagccg

SEQ ID NO: 2295070 - DNA, 23 bp, Homo sapiens
caagccagagccgcaccctggct

SEQ ID NO: 2295071 - DNA, 13 bp, Homo sapiens
caagccatcacag

SEQ ID NO: 2295072 - DNA, 14 bp, Homo sapiens
caaggaagagccag

SEQ ID NO: 2295073 - DNA, 16 bp, Homo sapiens
caaggaagagccagcc

SEQ ID NO: 2295074 - DNA, 18 bp, Homo sapiens
caaggaagagccagccgt

SEQ ID NO: 2295075 - DNA, 13 bp, Homo sapiens
caaggaaggacat

SEQ ID NO: 2295076 - DNA, 18 bp, Homo sapiens
caaggatcctgagccaga

SEQ ID NO: 2295077 - DNA, 19 bp, Homo sapiens
caaggatcctgagccagat

SEQ ID NO: 2295078 - DNA, 20 bp, Homo sapiens
caaggatcctgagccagatt

SEQ ID NO: 2295079 - DNA, 18 bp, Homo sapiens
caaggcaaggctgtcaat

SEQ ID NO: 2295080 - DNA, 12 bp, Homo sapiens
caaggctgccct

SEQ ID NO: 2295081 - DNA, 22 bp, Homo sapiens
caaggctgccctgtccactctg

SEQ ID NO: 2295082 - DNA, 21 bp, Homo sapiens
caaggctgctaagtggaagac

SEQ ID NO: 2295083 - DNA, 13 bp, Homo sapiens
caaggctgtcaat

SEQ ID NO: 2295084 - DNA, 14 bp, Homo sapiens
caaggctgtcaatt

SEQ ID NO: 2295085 - DNA, 19 bp, Homo sapiens
cacgcacttctggggccag

SEQ ID NO: 2295086 - DNA, 20 bp, Homo sapiens
cacgcacttctggggccagc

SEQ ID NO: 2295087 - DNA, 12 bp, Homo sapiens
cacgcagagccc

SEQ ID NO: 2295088 - DNA, 18 bp, Homo sapiens
cacgcagagccccggagc

SEQ ID NO: 2295089 - DNA, 20 bp, Homo sapiens
cacgccggggctggccctgc

SEQ ID NO: 2295090 - DNA, 13 bp, Homo sapiens
cacgcctccatcc

SEQ ID NO: 2295091 - DNA, 18 bp, Homo sapiens
cacgcctccatccacaca

SEQ ID NO: 2295092 - DNA, 22 bp, Homo sapiens
cacgcttctggaggtggggagg

SEQ ID NO: 2295093 - DNA, 15 bp, Homo sapiens
cacggaccctgtgtg

SEQ ID NO: 2295094 - DNA, 19 bp, Homo sapiens
cacggaggcctcgagcaga

SEQ ID NO: 2295095 - DNA, 22 bp, Homo sapiens
cacggaggcctcgagcagagag

SEQ ID NO: 2295096 - DNA, 17 bp, Homo sapiens
cacggcaacccctgcag

SEQ ID NO: 2295097 - DNA, 13 bp, Homo sapiens
cacggccgtccct

SEQ ID NO: 2295098 - DNA, 16 bp, Homo sapiens
cacggccgtccctgac

SEQ ID NO: 2295099 - DNA, 12 bp, Homo sapiens
cacggcctctgg

SEQ ID NO: 2295100 - DNA, 13 bp, Homo sapiens
cacggcctctggg

SEQ ID NO: 2295101 - DNA, 16 bp, Homo sapiens
cacggcctctggggag

SEQ ID NO: 2295102 - DNA, 15 bp, Homo sapiens
cacgggagagcgcca

SEQ ID NO: 2295103 - DNA, 16 bp, Homo sapiens
cacgggagagcgccac

SEQ ID NO: 2295104 - DNA, 22 bp, Homo sapiens
cacgggagagcgccacccgccc

SEQ ID NO: 2295105 - DNA, 19 bp, Homo sapiens
cacggggtcgggggaggag

SEQ ID NO: 2295106 - DNA, 14 bp, Homo sapiens
cacggtctaaacac

SEQ ID NO: 2295107 - DNA, 24 bp, Homo sapiens
cacgtagtttgcattccagcgtct

SEQ ID NO: 2295108 - DNA, 22 bp, Homo sapiens
cacgtggagagaagttgccctc

SEQ ID NO: 2295109 - DNA, 14 bp, Homo sapiens
cacgttgcagaaaa

SEQ ID NO: 2295110 - DNA, 22 bp, Homo sapiens
cactaatggccaagtgtacatt

SEQ ID NO: 2295111 - DNA, 19 bp, Homo sapiens
cactagatgccaatgacat

SEQ ID NO: 2295112 - DNA, 17 bp, Homo sapiens
cactatgggtgagcata

SEQ ID NO: 2295113 - DNA, 12 bp, Homo sapiens
cactattttaga

SEQ ID NO: 2295114 - DNA, 22 bp, Homo sapiens
cactcaagaccaaatggaaaca

SEQ ID NO: 2295115 - DNA, 19 bp, Homo sapiens
cactcacaatcatcttctc

SEQ ID NO: 2295116 - DNA, 18 bp, Homo sapiens
cactcacgctcagcacac

SEQ ID NO: 2295117 - DNA, 18 bp, Homo sapiens
cactcactgcctgcagct

SEQ ID NO: 2295118 - DNA, 20 bp, Homo sapiens
cactcagtgggccaattgtt

SEQ ID NO: 2295119 - DNA, 22 bp, Homo sapiens
cactcccgagacggcactgaga

SEQ ID NO: 2295120 - DNA, 15 bp, Homo sapiens
cactccgactccccc

SEQ ID NO: 2295121 - DNA, 17 bp, Homo sapiens
cactccgactccccctc

SEQ ID NO: 2295122 - DNA, 19 bp, Homo sapiens
cactccgactccccctccc

SEQ ID NO: 2295123 - DNA, 14 bp, Homo sapiens
cactctctcttgtt

SEQ ID NO: 2295124 - DNA, 17 bp, Homo sapiens
cactctgctcagggccg

SEQ ID NO: 2295125 - DNA, 14 bp, Homo sapiens
cactgaaacctctg

SEQ ID NO: 2295126 - DNA, 20 bp, Homo sapiens
cactgaaacctctgttctca

SEQ ID NO: 2295127 - DNA, 23 bp, Homo sapiens
cactgaaacctctgttctcatga

SEQ ID NO: 2295128 - DNA, 15 bp, Homo sapiens
cactgaacatgctca

SEQ ID NO: 2295129 - DNA, 22 bp, Homo sapiens
cactgaataatggaattatgta

SEQ ID NO: 2295130 - DNA, 16 bp, Homo sapiens
cactgagtctcattcc

SEQ ID NO: 2295131 - DNA, 18 bp, Homo sapiens
cactgatatcacgggccc

SEQ ID NO: 2295132 - DNA, 21 bp, Homo sapiens
cactgatatcacgggcccgct

SEQ ID NO: 2295133 - DNA, 16 bp, Homo sapiens
cactgatgggtcctgc

SEQ ID NO: 2295134 - DNA, 20 bp, Homo sapiens
cactgatgggtcctgctgct

SEQ ID NO: 2295135 - DNA, 22 bp, Homo sapiens
cactgatgggtcctgctgctcg

SEQ ID NO: 2295136 - DNA, 18 bp, Homo sapiens
cactgcaatcatatgtga

SEQ ID NO: 2295137 - DNA, 17 bp, Homo sapiens
cactgcagcagaaaggc

SEQ ID NO: 2295138 - DNA, 21 bp, Homo sapiens
cactgccattagactgaattt

SEQ ID NO: 2295139 - DNA, 23 bp, Homo sapiens
cactgcctgcagctgagattcca

SEQ ID NO: 2295140 - DNA, 15 bp, Homo sapiens
cactggccctgtttc

SEQ ID NO: 2295141 - DNA, 21 bp, Homo sapiens
cactggggtgggagggggcag

SEQ ID NO: 2295142 - DNA, 16 bp, Homo sapiens
cactggtctcagagga

SEQ ID NO: 2295143 - DNA, 18 bp, Homo sapiens
cactggtctcagaggagg

SEQ ID NO: 2295144 - DNA, 20 bp, Homo sapiens
cactggtctcagaggaggga

SEQ ID NO: 2295145 - DNA, 14 bp, Homo sapiens
cactgtagcaggtt

SEQ ID NO: 2295146 - DNA, 22 bp, Homo sapiens
cactgtatctaaaaaataactg

SEQ ID NO: 2295147 - DNA, 18 bp, Homo sapiens
cactgtcataatctcttt

SEQ ID NO: 2295148 - DNA, 18 bp, Homo sapiens
cactgtgcgttttagagt

SEQ ID NO: 2295149 - DNA, 16 bp, Homo sapiens
cactgtgttgcccagg

SEQ ID NO: 2295150 - DNA, 21 bp, Homo sapiens
cactgttaatcatgggttcct

SEQ ID NO: 2295151 - DNA, 22 bp, Homo sapiens
cactgttaatcatgggttcctc

SEQ ID NO: 2295152 - DNA, 24 bp, Homo sapiens
cactgtttcttgcttgtacctctg

SEQ ID NO: 2295153 - DNA, 19 bp, Homo sapiens
cacttaattctcattatga

SEQ ID NO: 2295154 - DNA, 20 bp, Homo sapiens
cacttaattctcattatgaa

SEQ ID NO: 2295155 - DNA, 14 bp, Homo sapiens
cacttactcttaca

SEQ ID NO: 2295156 - DNA, 18 bp, Homo sapiens
cacttattttctgaattc

SEQ ID NO: 2295157 - DNA, 18 bp, Homo sapiens
cacttcagttgtggcctc

SEQ ID NO: 2295158 - DNA, 23 bp, Homo sapiens
cacttccccttgggatgggcaca

SEQ ID NO: 2295159 - DNA, 12 bp, Homo sapiens
cacttctctaga

SEQ ID NO: 2295160 - DNA, 18 bp, Homo sapiens
cacttctggggccagccc

SEQ ID NO: 2295161 - DNA, 12 bp, Homo sapiens
cacttctgttat

SEQ ID NO: 2295162 - DNA, 18 bp, Homo sapiens
cacttgaacaaaatctgt

SEQ ID NO: 2295163 - DNA, 16 bp, Homo sapiens
cacttgacatcaactg

SEQ ID NO: 2295164 - DNA, 15 bp, Homo sapiens
cacttgcaaatgaat

SEQ ID NO: 2295165 - DNA, 17 bp, Homo sapiens
cacttgcaaatgaatgc

SEQ ID NO: 2295166 - DNA, 14 bp, Homo sapiens
cactttcgcctcct

SEQ ID NO: 2295167 - DNA, 17 bp, Homo sapiens
cactttcgcctcctcca

SEQ ID NO: 2295168 - DNA, 20 bp, Homo sapiens
cactttcgcctcctccagct

SEQ ID NO: 2295169 - DNA, 19 bp, Homo sapiens
cactttgcttaagatgcta

SEQ ID NO: 2295170 - DNA, 13 bp, Homo sapiens
cactttttctcga

SEQ ID NO: 2295171 - DNA, 17 bp, Homo sapiens
cagaaaaagagcttccc

SEQ ID NO: 2295172 - DNA, 15 bp, Homo sapiens
cagaaaacctgttca

SEQ ID NO: 2295173 - DNA, 13 bp, Homo sapiens
cagaaaagacact

SEQ ID NO: 2295174 - DNA, 13 bp, Homo sapiens
cagaaacaactgc

SEQ ID NO: 2295175 - DNA, 14 bp, Homo sapiens
cagaaaggctctga

SEQ ID NO: 2295176 - DNA, 22 bp, Homo sapiens
cagaaatgccgctgtgtccccg

SEQ ID NO: 2295177 - DNA, 12 bp, Homo sapiens
cagaaattttct

SEQ ID NO: 2295178 - DNA, 19 bp, Homo sapiens
cagaacaaaagataaaact

SEQ ID NO: 2295179 - DNA, 17 bp, Homo sapiens
cagaacaggaggtgtga

SEQ ID NO: 2295180 - DNA, 19 bp, Homo sapiens
cagaacaggaggtgtgaat

SEQ ID NO: 2295181 - DNA, 23 bp, Homo sapiens
cagaacaggaggtgtgaatgcac

SEQ ID NO: 2295182 - DNA, 16 bp, Homo sapiens
cagaaccagcactccc

SEQ ID NO: 2295183 - DNA, 19 bp, Homo sapiens
cagaaccagcactcccagg

SEQ ID NO: 2295184 - DNA, 21 bp, Homo sapiens
cagaaccagcactcccagggc

SEQ ID NO: 2295185 - DNA, 14 bp, Homo sapiens
cagaacgccctgtg

SEQ ID NO: 2295186 - DNA, 16 bp, Homo sapiens
cagaacgccctgtgtc

SEQ ID NO: 2295187 - DNA, 17 bp, Homo sapiens
cagaacgccctgtgtcc

SEQ ID NO: 2295188 - DNA, 14 bp, Homo sapiens
cagaacgggcctcc

SEQ ID NO: 2295189 - DNA, 16 bp, Homo sapiens
cagaactcctttctaa

SEQ ID NO: 2295190 - DNA, 17 bp, Homo sapiens
cagaagaggggcagctt

SEQ ID NO: 2295191 - DNA, 22 bp, Homo sapiens
cagaagaggggcagctttttca

SEQ ID NO: 2295192 - DNA, 18 bp, Homo sapiens
cagaaggcaaagtttcca

SEQ ID NO: 2295193 - DNA, 21 bp, Homo sapiens
cagaaggctctatctgctggg

SEQ ID NO: 2295194 - DNA, 20 bp, Homo sapiens
cagaatacaattcagtttta

SEQ ID NO: 2295195 - DNA, 16 bp, Homo sapiens
cagaatcagcacagat

SEQ ID NO: 2295196 - DNA, 18 bp, Homo sapiens
cagaatgagagagaaaag

SEQ ID NO: 2295197 - DNA, 19 bp, Homo sapiens
cagaatgggggtatcctgt

SEQ ID NO: 2295198 - DNA, 14 bp, Homo sapiens
cagaatgtttcctg

SEQ ID NO: 2295199 - DNA, 21 bp, Homo sapiens
cagaattacaggaaatgcaaa

SEQ ID NO: 2295200 - DNA, 18 bp, Homo sapiens
cagaatttcccaaagcag

SEQ ID NO: 2295201 - DNA, 19 bp, Homo sapiens
cagaatttcccaaagcagt

SEQ ID NO: 2295202 - DNA, 24 bp, Homo sapiens
cagaatttcccaaagcagtgcatg

SEQ ID NO: 2295203 - DNA, 12 bp, Homo sapiens
cagacaaagcgt

SEQ ID NO: 2295204 - DNA, 16 bp, Homo sapiens
cagacaacaaacctgt

SEQ ID NO: 2295205 - DNA, 20 bp, Homo sapiens
cagacacgcacttctggggc

SEQ ID NO: 2295206 - DNA, 13 bp, Homo sapiens
cagacactcaaga

SEQ ID NO: 2295207 - DNA, 16 bp, Homo sapiens
cagacactcaagagcc

SEQ ID NO: 2295208 - DNA, 17 bp, Homo sapiens
cagacactcaagagccc

SEQ ID NO: 2295209 - DNA, 21 bp, Homo sapiens
cagacagaagggtaatgcgtg

SEQ ID NO: 2295210 - DNA, 17 bp, Homo sapiens
cagacagagatcagaat

SEQ ID NO: 2295211 - DNA, 12 bp, Homo sapiens
cagacatcctgt

SEQ ID NO: 2295212 - DNA, 13 bp, Homo sapiens
cagacctgggccc

SEQ ID NO: 2295213 - DNA, 13 bp, Homo sapiens
cagactatgcagc

SEQ ID NO: 2295214 - DNA, 19 bp, Homo sapiens
cagactcgagagggctgag

SEQ ID NO: 2295215 - DNA, 15 bp, Homo sapiens
cagagacccccgtgc

SEQ ID NO: 2295216 - DNA, 15 bp, Homo sapiens
cagagacctgctcca

SEQ ID NO: 2295217 - DNA, 14 bp, Homo sapiens
cagagacggcagcc

SEQ ID NO: 2295218 - DNA, 17 bp, Homo sapiens
cagagacggcagcccca

SEQ ID NO: 2295219 - DNA, 21 bp, Homo sapiens
cagagacggcagccccatcct

SEQ ID NO: 2295220 - DNA, 17 bp, Homo sapiens
cagagactgcccaccct

SEQ ID NO: 2295221 - DNA, 18 bp, Homo sapiens
cagagactgcccaccctg

SEQ ID NO: 2295222 - DNA, 20 bp, Homo sapiens
cagagactgcccaccctggg

SEQ ID NO: 2295223 - DNA, 22 bp, Homo sapiens
cagagactgcccaccctgggcc

SEQ ID NO: 2295224 - DNA, 13 bp, Homo sapiens
cagagatggcaga

SEQ ID NO: 2295225 - DNA, 16 bp, Homo sapiens
cagagatggcagagcc

SEQ ID NO: 2295226 - DNA, 21 bp, Homo sapiens
cagagcaagcgaaagagcaaa

SEQ ID NO: 2295227 - DNA, 14 bp, Homo sapiens
cagagccatccacc

SEQ ID NO: 2295228 - DNA, 18 bp, Homo sapiens
cagagccatccaccctga

SEQ ID NO: 2295229 - DNA, 14 bp, Homo sapiens
cagagccccggagc

SEQ ID NO: 2295230 - DNA, 16 bp, Homo sapiens
cagagccccggagcac

SEQ ID NO: 2295231 - DNA, 23 bp, Homo sapiens
cagagccctatctatgtcctgga

SEQ ID NO: 2295232 - DNA, 13 bp, Homo sapiens
cagagctcagcac

SEQ ID NO: 2295233 - DNA, 16 bp, Homo sapiens
cagagctcccaggacg

SEQ ID NO: 2295234 - DNA, 17 bp, Homo sapiens
cagagctcccaggacgc

SEQ ID NO: 2295235 - DNA, 22 bp, Homo sapiens
cagagctgagtcggctgggcag

SEQ ID NO: 2295236 - DNA, 13 bp, Homo sapiens
cagaggaccagca

SEQ ID NO: 2295237 - DNA, 22 bp, Homo sapiens
cagaggagggatagagacgcag

SEQ ID NO: 2295238 - DNA, 14 bp, Homo sapiens
cagaggcagggccc

SEQ ID NO: 2295239 - DNA, 16 bp, Homo sapiens
cagaggcagggccctg

SEQ ID NO: 2295240 - DNA, 20 bp, Homo sapiens
cagaggggcggggccaggat

SEQ ID NO: 2295241 - DNA, 23 bp, Homo sapiens
cagagggtggagatgtcagtctg

SEQ ID NO: 2295242 - DNA, 14 bp, Homo sapiens
cagagtatatatgt

SEQ ID NO: 2295243 - DNA, 15 bp, Homo sapiens
cagagtatatatgta

SEQ ID NO: 2295244 - DNA, 15 bp, Homo sapiens
cagagtcagcacagg

SEQ ID NO: 2295245 - DNA, 14 bp, Homo sapiens
cagagtcattgtta

SEQ ID NO: 2295246 - DNA, 13 bp, Homo sapiens
cagagtcctgccg

SEQ ID NO: 2295247 - DNA, 14 bp, Homo sapiens
cagatatttaaatt

SEQ ID NO: 2295248 - DNA, 21 bp, Homo sapiens
cagatcctctttccccactga

SEQ ID NO: 2295249 - DNA, 18 bp, Homo sapiens
cagatcctggtctgcacc

SEQ ID NO: 2295250 - DNA, 13 bp, Homo sapiens
cagatctgcatct

SEQ ID NO: 2295251 - DNA, 18 bp, Homo sapiens
cagatcttacaagtttat

SEQ ID NO: 2295252 - DNA, 14 bp, Homo sapiens
cagatgttttagag

SEQ ID NO: 2295253 - DNA, 19 bp, Homo sapiens
cagattattttctatattt

SEQ ID NO: 2295254 - DNA, 14 bp, Homo sapiens
cagattcagtcttg

SEQ ID NO: 2295255 - DNA, 17 bp, Homo sapiens
cagattcagtcttgcct

SEQ ID NO: 2295256 - DNA, 18 bp, Homo sapiens
cagattcagtcttgcctt

SEQ ID NO: 2295257 - DNA, 13 bp, Homo sapiens
cagatttcactct

SEQ ID NO: 2295258 - DNA, 15 bp, Homo sapiens
cagatttcactctcc

SEQ ID NO: 2295259 - DNA, 19 bp, Homo sapiens
cagcaaattcttgaataaa

SEQ ID NO: 2295260 - DNA, 21 bp, Homo sapiens
cagcaaattcttgaataaact

SEQ ID NO: 2295261 - DNA, 19 bp, Homo sapiens
cagcaaccagagcactgta

SEQ ID NO: 2295262 - DNA, 20 bp, Homo sapiens
cagcaagataaacacaattt

SEQ ID NO: 2295263 - DNA, 21 bp, Homo sapiens
cagcacagataaaaagtggaa

SEQ ID NO: 2295264 - DNA, 14 bp, Homo sapiens
cagcacagcctcac

SEQ ID NO: 2295265 - DNA, 14 bp, Homo sapiens
cagcaccactcaag

SEQ ID NO: 2295266 - DNA, 22 bp, Homo sapiens
cagcaccactcaagaccaaatg

SEQ ID NO: 2295267 - DNA, 13 bp, Homo sapiens
cagcaccagcctg

SEQ ID NO: 2295268 - DNA, 14 bp, Homo sapiens
cagcaccagcctga

SEQ ID NO: 2295269 - DNA, 19 bp, Homo sapiens
cagcaccagcctgagccac

SEQ ID NO: 2295270 - DNA, 21 bp, Homo sapiens
cagcaccgtggtgtgaggccc

SEQ ID NO: 2295271 - DNA, 24 bp, Homo sapiens
cagcagaactgaagtgtgctgtga

SEQ ID NO: 2295272 - DNA, 18 bp, Homo sapiens
cagcagaatgactctgga

SEQ ID NO: 2295273 - DNA, 21 bp, Homo sapiens
cagcagaatgactctggaacc

SEQ ID NO: 2295274 - DNA, 13 bp, Homo sapiens
cagcagctccaac

SEQ ID NO: 2295275 - DNA, 19 bp, Homo sapiens
cagcagctccaacctggag

SEQ ID NO: 2295276 - DNA, 12 bp, Homo sapiens
cagcagctggac

SEQ ID NO: 2295277 - DNA, 14 bp, Homo sapiens
cagcagctggactg

SEQ ID NO: 2295278 - DNA, 18 bp, Homo sapiens
cagcagctggactgggtg

SEQ ID NO: 2295279 - DNA, 16 bp, Homo sapiens
cagcagtaccatccca

SEQ ID NO: 2295280 - DNA, 18 bp, Homo sapiens
cagcagtaccatcccact

SEQ ID NO: 2295281 - DNA, 20 bp, Homo sapiens
cagcagtaccatcccactga

SEQ ID NO: 2295282 - DNA, 22 bp, Homo sapiens
cagcataaatctgttagcatta

SEQ ID NO: 2295283 - DNA, 16 bp, Homo sapiens
cagcatagttctgcaa

SEQ ID NO: 2295284 - DNA, 17 bp, Homo sapiens
cagcatagttctgcaat

SEQ ID NO: 2295285 - DNA, 21 bp, Homo sapiens
cagcatagttctgcaataaca

SEQ ID NO: 2295286 - DNA, 21 bp, Homo sapiens
cagcatctaaagcagcaggtc

SEQ ID NO: 2295287 - DNA, 18 bp, Homo sapiens
cagcattactaaggcagg

SEQ ID NO: 2295288 - DNA, 15 bp, Homo sapiens
cagcattcaaaatag

SEQ ID NO: 2295289 - DNA, 21 bp, Homo sapiens
cagcattcaaaatagttctat

SEQ ID NO: 2295290 - DNA, 15 bp, Homo sapiens
cagccaatttcaaag

SEQ ID NO: 2295291 - DNA, 21 bp, Homo sapiens
cagccacacctaggtctgaga

SEQ ID NO: 2295292 - DNA, 19 bp, Homo sapiens
cagcccagaacgggcctcc

SEQ ID NO: 2295293 - DNA, 16 bp, Homo sapiens
cagcccagacatcctg

SEQ ID NO: 2295294 - DNA, 23 bp, Homo sapiens
cagccccagcgagtctggagacc

SEQ ID NO: 2295295 - DNA, 21 bp, Homo sapiens
cagccccatccttcccgcagc

SEQ ID NO: 2295296 - DNA, 15 bp, Homo sapiens
cagcccctccccgcc

SEQ ID NO: 2295297 - DNA, 19 bp, Homo sapiens
cagcccctccccgcctcct

SEQ ID NO: 2295298 - DNA, 22 bp, Homo sapiens
cagcccctccccgcctcctccc

SEQ ID NO: 2295299 - DNA, 14 bp, Homo sapiens
cagcccctgctgct

SEQ ID NO: 2295300 - DNA, 15 bp, Homo sapiens
cagcccctgctgctc

SEQ ID NO: 2295301 - DNA, 13 bp, Homo sapiens
cagcccctggggt

SEQ ID NO: 2295302 - DNA, 16 bp, Homo sapiens
cagccccttgcttcta

SEQ ID NO: 2295303 - DNA, 20 bp, Homo sapiens
cagccccttgcttctaaggg

SEQ ID NO: 2295304 - DNA, 14 bp, Homo sapiens
cagccgagcccagg

SEQ ID NO: 2295305 - DNA, 16 bp, Homo sapiens
cagccgagcccagggg

SEQ ID NO: 2295306 - DNA, 17 bp, Homo sapiens
cagccgagcccagggga

SEQ ID NO: 2295307 - DNA, 19 bp, Homo sapiens
cagccgagcccaggggagg

SEQ ID NO: 2295308 - DNA, 18 bp, Homo sapiens
cagccgccttcacagcag

SEQ ID NO: 2295309 - DNA, 20 bp, Homo sapiens
cagccgccttcacagcagtc

SEQ ID NO: 2295310 - DNA, 19 bp, Homo sapiens
cagccgcgctctgcccctc

SEQ ID NO: 2295311 - DNA, 22 bp, Homo sapiens
cagccgcgctctgcccctccgt

SEQ ID NO: 2295312 - DNA, 12 bp, Homo sapiens
cagcctccccca

SEQ ID NO: 2295313 - DNA, 13 bp, Homo sapiens
cagcctcccccag

SEQ ID NO: 2295314 - DNA, 14 bp, Homo sapiens
cagcctcccccagg

SEQ ID NO: 2295315 - DNA, 16 bp, Homo sapiens
cagcctcccccaggct

SEQ ID NO: 2295316 - DNA, 18 bp, Homo sapiens
cagcctcctgagtagctg

SEQ ID NO: 2295317 - DNA, 18 bp, Homo sapiens
cagcctcgacctccctgg

SEQ ID NO: 2295318 - DNA, 21 bp, Homo sapiens
cagcctcgacctccctggctt

SEQ ID NO: 2295319 - DNA, 15 bp, Homo sapiens
cagcctgagctccac

SEQ ID NO: 2295320 - DNA, 21 bp, Homo sapiens
cagcctgagctccaccctccc

SEQ ID NO: 2295321 - DNA, 21 bp, Homo sapiens
cagccttagcactatggacat

SEQ ID NO: 2295322 - DNA, 20 bp, Homo sapiens
cagccttgaactgtggccac

SEQ ID NO: 2295323 - DNA, 20 bp, Homo sapiens
cagcgagtctggagaccagg

SEQ ID NO: 2295324 - DNA, 23 bp, Homo sapiens
cagcgattcctgccaagtagggt

SEQ ID NO: 2295325 - DNA, 17 bp, Homo sapiens
cagcgcctcccgccgcc

SEQ ID NO: 2295326 - DNA, 21 bp, Homo sapiens
cagcgcctcccgccgcctcgg

SEQ ID NO: 2295327 - DNA, 23 bp, Homo sapiens
cagcgcctcccgccgcctcgggc

SEQ ID NO: 2295328 - DNA, 15 bp, Homo sapiens
cagcggagaggaccc

SEQ ID NO: 2295329 - DNA, 18 bp, Homo sapiens
cagcggccccgcacccct

SEQ ID NO: 2295330 - DNA, 22 bp, Homo sapiens
cagcggccccgcacccctcctc

SEQ ID NO: 2295331 - DNA, 19 bp, Homo sapiens
cagcggcccggcccacgca

SEQ ID NO: 2295332 - DNA, 23 bp, Homo sapiens
cagcgggcgcgggacaggacttg

SEQ ID NO: 2295333 - DNA, 13 bp, Homo sapiens
cagcgtgggggtg

SEQ ID NO: 2295334 - DNA, 21 bp, Homo sapiens
cagcgtgggggtggccactcc

SEQ ID NO: 2295335 - DNA, 14 bp, Homo sapiens
cagctcactgcagc

SEQ ID NO: 2295336 - DNA, 18 bp, Homo sapiens
cagctcactgcagcctcg

SEQ ID NO: 2295337 - DNA, 16 bp, Homo sapiens
cagctcagtcccacag

SEQ ID NO: 2295338 - DNA, 18 bp, Homo sapiens
cagctcagtcccacagcc

SEQ ID NO: 2295339 - DNA, 16 bp, Homo sapiens
cagctccaacctggag

SEQ ID NO: 2295340 - DNA, 19 bp, Homo sapiens
cagctccaacctggaggct

SEQ ID NO: 2295341 - DNA, 23 bp, Homo sapiens
cagctccaacctggaggctggac

SEQ ID NO: 2295342 - DNA, 21 bp, Homo sapiens
cagctctaaagcagagatgta

SEQ ID NO: 2295343 - DNA, 15 bp, Homo sapiens
cagctgcttttgcat

SEQ ID NO: 2295344 - DNA, 16 bp, Homo sapiens
cagctggactgggtgg

SEQ ID NO: 2295345 - DNA, 23 bp, Homo sapiens
cagctggagtggggtttgctttt

SEQ ID NO: 2295346 - DNA, 17 bp, Homo sapiens
cagctggcagcgcctcc

SEQ ID NO: 2295347 - DNA, 23 bp, Homo sapiens
cagctggcagcgcctcccgccgc

SEQ ID NO: 2295348 - DNA, 23 bp, Homo sapiens
cagctggctgggtcgcccctcct

SEQ ID NO: 2295349 - DNA, 15 bp, Homo sapiens
cagcttggagacagg

SEQ ID NO: 2295350 - DNA, 13 bp, Homo sapiens
cagcttgtccaac

SEQ ID NO: 2295351 - DNA, 13 bp, Homo sapiens
cagcttgtttcta

SEQ ID NO: 2295352 - DNA, 19 bp, Homo sapiens
cagctttataacaaatgtg

SEQ ID NO: 2295353 - DNA, 14 bp, Homo sapiens
caggaaaactgttt

SEQ ID NO: 2295354 - DNA, 16 bp, Homo sapiens
caggaaccgaggactc

SEQ ID NO: 2295355 - DNA, 21 bp, Homo sapiens
caggaagaggggcgctgcccc

SEQ ID NO: 2295356 - DNA, 14 bp, Homo sapiens
caggaagcctcctg

SEQ ID NO: 2295357 - DNA, 22 bp, Homo sapiens
caggaagcctcctgctgagtgg

SEQ ID NO: 2295358 - DNA, 17 bp, Homo sapiens
caggaagtactggagaa

SEQ ID NO: 2295359 - DNA, 17 bp, Homo sapiens
caggaccccatctgctg

SEQ ID NO: 2295360 - DNA, 20 bp, Homo sapiens
caggaccccatctgctgagc

SEQ ID NO: 2295361 - DNA, 22 bp, Homo sapiens
caggaccccatctgctgagctc

SEQ ID NO: 2295362 - DNA, 16 bp, Homo sapiens
caggacgcagggagac

SEQ ID NO: 2295363 - DNA, 20 bp, Homo sapiens
caggacgcagggagaccctg

SEQ ID NO: 2295364 - DNA, 16 bp, Homo sapiens
caggacggtctgtgcc

SEQ ID NO: 2295365 - DNA, 18 bp, Homo sapiens
caggactctgccttccag

SEQ ID NO: 2295366 - DNA, 15 bp, Homo sapiens
caggacttgtgcgcc

SEQ ID NO: 2295367 - DNA, 17 bp, Homo sapiens
caggagacactggtctc

SEQ ID NO: 2295368 - DNA, 20 bp, Homo sapiens
caggagagaaaactgcctga

SEQ ID NO: 2295369 - DNA, 21 bp, Homo sapiens
caggagcaaggctgccctgtc

SEQ ID NO: 2295370 - DNA, 17 bp, Homo sapiens
caggaggactgttctaa

SEQ ID NO: 2295371 - DNA, 14 bp, Homo sapiens
caggaggcagtggc

SEQ ID NO: 2295372 - DNA, 19 bp, Homo sapiens
caggaggcagtggcttgga

SEQ ID NO: 2295373 - DNA, 15 bp, Homo sapiens
caggaggccatgccc

SEQ ID NO: 2295374 - DNA, 15 bp, Homo sapiens
caggagggcatgtgc

SEQ ID NO: 2295375 - DNA, 22 bp, Homo sapiens
caggagggtatggtgctgctct

SEQ ID NO: 2295376 - DNA, 14 bp, Homo sapiens
caggaggtgcctga

SEQ ID NO: 2295377 - DNA, 18 bp, Homo sapiens
caggagtgggctctgagc

SEQ ID NO: 2295378 - DNA, 19 bp, Homo sapiens
caggatggcgtgtcccctg

SEQ ID NO: 2295379 - DNA, 18 bp, Homo sapiens
caggattctgacagagca

SEQ ID NO: 2295380 - DNA, 12 bp, Homo sapiens
caggattctgca

SEQ ID NO: 2295381 - DNA, 16 bp, Homo sapiens
caggattgtctgctgc

SEQ ID NO: 2295382 - DNA, 22 bp, Homo sapiens
caggattgtctgctgcctccaa

SEQ ID NO: 2295383 - DNA, 19 bp, Homo sapiens
caggcaaggcagctcccag

SEQ ID NO: 2295384 - DNA, 12 bp, Homo sapiens
caggcaccgcct

SEQ ID NO: 2295385 - DNA, 16 bp, Homo sapiens
caggcaccgcctgccc

SEQ ID NO: 2295386 - DNA, 18 bp, Homo sapiens
caggcaccgcctgccccc

SEQ ID NO: 2295387 - DNA, 17 bp, Homo sapiens
caggcagagctcagcac

SEQ ID NO: 2295388 - DNA, 19 bp, Homo sapiens
caggcagagctcagcacag

SEQ ID NO: 2295389 - DNA, 15 bp, Homo sapiens
caggcatctgatttg

SEQ ID NO: 2295390 - DNA, 14 bp, Homo sapiens
caggcatgaccctg

SEQ ID NO: 2295391 - DNA, 20 bp, Homo sapiens
caggcatgaccctggagccc

SEQ ID NO: 2295392 - DNA, 12 bp, Homo sapiens
caggcccacatt

SEQ ID NO: 2295393 - DNA, 18 bp, Homo sapiens
caggcccatgccctccgt

SEQ ID NO: 2295394 - DNA, 17 bp, Homo sapiens
caggccgacaggaggcc

SEQ ID NO: 2295395 - DNA, 19 bp, Homo sapiens
caggccgacaggaggccat

SEQ ID NO: 2295396 - DNA, 15 bp, Homo sapiens
caggcgcgcaccgcc

SEQ ID NO: 2295397 - DNA, 15 bp, Homo sapiens
caggcggaggggctt

SEQ ID NO: 2295398 - DNA, 17 bp, Homo sapiens
caggcggaggggcttgg

SEQ ID NO: 2295399 - DNA, 21 bp, Homo sapiens
caggcgtagggccagggctct

SEQ ID NO: 2295400 - DNA, 18 bp, Homo sapiens
caggctccccaagacttg

SEQ ID NO: 2295401 - DNA, 20 bp, Homo sapiens
caggctcgggctccccagcc

SEQ ID NO: 2295402 - DNA, 20 bp, Homo sapiens
caggctgagccgatctggtc

SEQ ID NO: 2295403 - DNA, 22 bp, Homo sapiens
caggctgagccgatctggtctc

SEQ ID NO: 2295404 - DNA, 11 bp, Homo sapiens
caggctgcccc

SEQ ID NO: 2295405 - DNA, 13 bp, Homo sapiens
caggctgccccac

SEQ ID NO: 2295406 - DNA, 18 bp, Homo sapiens
caggctgccccacccctc

SEQ ID NO: 2295407 - DNA, 15 bp, Homo sapiens
caggctgcgcctgcc

SEQ ID NO: 2295408 - DNA, 20 bp, Homo sapiens
caggctgcgcctgcccgccc

SEQ ID NO: 2295409 - DNA, 15 bp, Homo sapiens
caggctggcagttgg

SEQ ID NO: 2295410 - DNA, 17 bp, Homo sapiens
caggcttcgtctcagaa

SEQ ID NO: 2295411 - DNA, 11 bp, Homo sapiens
caggctttcta

SEQ ID NO: 2295412 - DNA, 14 bp, Homo sapiens
caggctttctattg

SEQ ID NO: 2295413 - DNA, 14 bp, Homo sapiens
cagggagaccctgg

SEQ ID NO: 2295414 - DNA, 13 bp, Homo sapiens
cagggagccctgg

SEQ ID NO: 2295415 - DNA, 20 bp, Homo sapiens
cagggagctatgagagatgt

SEQ ID NO: 2295416 - DNA, 19 bp, Homo sapiens
cagggcagcagggaacaaa

SEQ ID NO: 2295417 - DNA, 22 bp, Homo sapiens
cagggcagcagggaacaaaact

SEQ ID NO: 2295418 - DNA, 17 bp, Homo sapiens
cagggcaggcagagctc

SEQ ID NO: 2295419 - DNA, 17 bp, Homo sapiens
cagggcccaaataacag

SEQ ID NO: 2295420 - DNA, 12 bp, Homo sapiens
cagggcccgagc

SEQ ID NO: 2295421 - DNA, 10 bp, Homo sapiens
cagggccctg

SEQ ID NO: 2295422 - DNA, 12 bp, Homo sapiens
cagggccctgtg

SEQ ID NO: 2295423 - DNA, 14 bp, Homo sapiens
cagggccgcagggc

SEQ ID NO: 2295424 - DNA, 14 bp, Homo sapiens
cagggcgctccggc

SEQ ID NO: 2295425 - DNA, 17 bp, Homo sapiens
cagggcgctccggcaga

SEQ ID NO: 2295426 - DNA, 20 bp, Homo sapiens
cagggcgctccggcagaggc

SEQ ID NO: 2295427 - DNA, 21 bp, Homo sapiens
cagggcgctccggcagaggca

SEQ ID NO: 2295428 - DNA, 21 bp, Homo sapiens
cagggctccacgggggcctag

SEQ ID NO: 2295429 - DNA, 23 bp, Homo sapiens
cagggctccacgggggcctagtg

SEQ ID NO: 2295430 - DNA, 22 bp, Homo sapiens
caggggctgactctccagggag

SEQ ID NO: 2295431 - DNA, 13 bp, Homo sapiens
caggggctggagg

SEQ ID NO: 2295432 - DNA, 22 bp, Homo sapiens
caggggcttcccacagcctctt

SEQ ID NO: 2295433 - DNA, 16 bp, Homo sapiens
cagggtcctcagctca

SEQ ID NO: 2295434 - DNA, 15 bp, Homo sapiens
cagggtctcactctg

SEQ ID NO: 2295435 - DNA, 16 bp, Homo sapiens
cagggtctcactctgt

SEQ ID NO: 2295436 - DNA, 17 bp, Homo sapiens
cagggtctcactgtgtt

SEQ ID NO: 2295437 - DNA, 23 bp, Homo sapiens
cagggtctcactgtgttgcccag

SEQ ID NO: 2295438 - DNA, 21 bp, Homo sapiens
cagggtggtggtgcacacctg

SEQ ID NO: 2295439 - DNA, 14 bp, Homo sapiens
caggtcctccctgc

SEQ ID NO: 2295440 - DNA, 12 bp, Homo sapiens
caggtgaataac

SEQ ID NO: 2295441 - DNA, 14 bp, Homo sapiens
caggtggccagggc

SEQ ID NO: 2295442 - DNA, 21 bp, Homo sapiens
caggtggccagggctccacgg

SEQ ID NO: 2295443 - DNA, 21 bp, Homo sapiens
caggtgtactatggctgtatt

SEQ ID NO: 2295444 - DNA, 14 bp, Homo sapiens
caggtgtgagccac

SEQ ID NO: 2295445 - DNA, 21 bp, Homo sapiens
caggtgttcctcctcccctct

SEQ ID NO: 2295446 - DNA, 18 bp, Homo sapiens
cagtaaaacaggctgctt

SEQ ID NO: 2295447 - DNA, 17 bp, Homo sapiens
cagtaactgagtgtggc

SEQ ID NO: 2295448 - DNA, 18 bp, Homo sapiens
cagtaactgagtgtggcg

SEQ ID NO: 2295449 - DNA, 13 bp, Homo sapiens
cagtaccatccca

SEQ ID NO: 2295450 - DNA, 15 bp, Homo sapiens
cagtaccatcccact

SEQ ID NO: 2295451 - DNA, 21 bp, Homo sapiens
cagtagctgtggggagctggt

SEQ ID NO: 2295452 - DNA, 14 bp, Homo sapiens
cagtagggggaggg

SEQ ID NO: 2295453 - DNA, 20 bp, Homo sapiens
cagtagtgttgggtggagga

SEQ ID NO: 2295454 - DNA, 24 bp, Homo sapiens
cagtagtgttgggtggaggatgga

SEQ ID NO: 2295455 - DNA, 14 bp, Homo sapiens
cagtatcagagggt

SEQ ID NO: 2295456 - DNA, 17 bp, Homo sapiens
cagtatctccatcctta

SEQ ID NO: 2295457 - DNA, 18 bp, Homo sapiens
cagtatcttgaagacttt

SEQ ID NO: 2295458 - DNA, 16 bp, Homo sapiens
cagtatgaagacactg

SEQ ID NO: 2295459 - DNA, 21 bp, Homo sapiens
cagtattatagatataaatat

SEQ ID NO: 2295460 - DNA, 21 bp, Homo sapiens
cagtattgacgacctacatct

SEQ ID NO: 2295461 - DNA, 22 bp, Homo sapiens
cagtattgacgacctacatctg

SEQ ID NO: 2295462 - DNA, 19 bp, Homo sapiens
cagtcaaagacgctgagtg

SEQ ID NO: 2295463 - DNA, 21 bp, Homo sapiens
cagtcaggaagcctcctgctg

SEQ ID NO: 2295464 - DNA, 22 bp, Homo sapiens
cagtcaggaagcctcctgctga

SEQ ID NO: 2295465 - DNA, 15 bp, Homo sapiens
cagtccagtgagaaa

SEQ ID NO: 2295466 - DNA, 16 bp, Homo sapiens
cagtcccacagcccct

SEQ ID NO: 2295467 - DNA, 20 bp, Homo sapiens
cagtcctccggttgcatact

SEQ ID NO: 2295468 - DNA, 16 bp, Homo sapiens
cagtcctgggcaaagg

SEQ ID NO: 2295469 - DNA, 15 bp, Homo sapiens
cagtctacactcaca

SEQ ID NO: 2295470 - DNA, 19 bp, Homo sapiens
cagtcttgccttacacaaa

SEQ ID NO: 2295471 - DNA, 14 bp, Homo sapiens
cagtgaaagccctg

SEQ ID NO: 2295472 - DNA, 17 bp, Homo sapiens
cagtgaagatgtgtaaa

SEQ ID NO: 2295473 - DNA, 19 bp, Homo sapiens
cagtgaagatgtgtaaata

SEQ ID NO: 2295474 - DNA, 20 bp, Homo sapiens
cagtgaagatgtgtaaataa

SEQ ID NO: 2295475 - DNA, 21 bp, Homo sapiens
cagtgaagatgtgtaaataag

SEQ ID NO: 2295476 - DNA, 18 bp, Homo sapiens
cagtgagaaattacaggt

SEQ ID NO: 2295477 - DNA, 22 bp, Homo sapiens
cagtgagaaattacaggttcct

SEQ ID NO: 2295478 - DNA, 18 bp, Homo sapiens
cagtgcaccccctaaaga

SEQ ID NO: 2295479 - DNA, 20 bp, Homo sapiens
cagtgcagcaaccagagcac

SEQ ID NO: 2295480 - DNA, 13 bp, Homo sapiens
cagtgcatgctgt

SEQ ID NO: 2295481 - DNA, 13 bp, Homo sapiens
cagtgccttatgg

SEQ ID NO: 2295482 - DNA, 22 bp, Homo sapiens
cagtgccttatggaacactctg

SEQ ID NO: 2295483 - DNA, 23 bp, Homo sapiens
cagtgccttatggaacactctga

SEQ ID NO: 2295484 - DNA, 18 bp, Homo sapiens
cagtggcagagaatccaa

SEQ ID NO: 2295485 - DNA, 17 bp, Homo sapiens
cagtggcttggagcaga

SEQ ID NO: 2295486 - DNA, 14 bp, Homo sapiens
cagtggtgatgcct

SEQ ID NO: 2295487 - DNA, 17 bp, Homo sapiens
cagtgtccccaggggca

SEQ ID NO: 2295488 - DNA, 20 bp, Homo sapiens
cagtgtccccaggggcacac

SEQ ID NO: 2295489 - DNA, 18 bp, Homo sapiens
cagtgtcctcatctataa

SEQ ID NO: 2295490 - DNA, 12 bp, Homo sapiens
cagtgtgactga

SEQ ID NO: 2295491 - DNA, 11 bp, Homo sapiens
cagtgttattt

SEQ ID NO: 2295492 - DNA, 17 bp, Homo sapiens
cagtgttattttctttg

SEQ ID NO: 2295493 - DNA, 14 bp, Homo sapiens
atgtgttgcaaatt

SEQ ID NO: 2295494 - DNA, 23 bp, Homo sapiens
atgtgttgcaaattattctagtc

SEQ ID NO: 2295495 - DNA, 20 bp, Homo sapiens
atgttagattaggtgtaaga

SEQ ID NO: 2295496 - DNA, 17 bp, Homo sapiens
atgttatttctgcaaac

SEQ ID NO: 2295497 - DNA, 18 bp, Homo sapiens
atgttatttctgcaaaca

SEQ ID NO: 2295498 - DNA, 18 bp, Homo sapiens
atgttcataaaaaataac

SEQ ID NO: 2295499 - DNA, 11 bp, Homo sapiens
atgttctcaac

SEQ ID NO: 2295500 - DNA, 15 bp, Homo sapiens
atgttgttaaatgct

SEQ ID NO: 2295501 - DNA, 16 bp, Homo sapiens
atgttgttaaatgcta

SEQ ID NO: 2295502 - DNA, 22 bp, Homo sapiens
atgttgttcgatcgtttcacat

SEQ ID NO: 2295503 - DNA, 20 bp, Homo sapiens
atgtttaagaaatgagaaat

SEQ ID NO: 2295504 - DNA, 15 bp, Homo sapiens
atgtttacattttct

SEQ ID NO: 2295505 - DNA, 22 bp, Homo sapiens
atgtttcccgctccaagagaat

SEQ ID NO: 2295506 - DNA, 15 bp, Homo sapiens
atgtttctttttctt

SEQ ID NO: 2295507 - DNA, 18 bp, Homo sapiens
atgttttagagataaata

SEQ ID NO: 2295508 - DNA, 14 bp, Homo sapiens
atgtttttctcaaa

SEQ ID NO: 2295509 - DNA, 13 bp, Homo sapiens
attaaaagcttta

SEQ ID NO: 2295510 - DNA, 21 bp, Homo sapiens
attaaaagctttagattgaaa

SEQ ID NO: 2295511 - DNA, 18 bp, Homo sapiens
attaaagacatttaaaat

SEQ ID NO: 2295512 - DNA, 13 bp, Homo sapiens
attaagcagcttg

SEQ ID NO: 2295513 - DNA, 20 bp, Homo sapiens
attaagcttttgtctgtagg

SEQ ID NO: 2295514 - DNA, 13 bp, Homo sapiens
attaataaaatac

SEQ ID NO: 2295515 - DNA, 16 bp, Homo sapiens
attaatacttccttat

SEQ ID NO: 2295516 - DNA, 14 bp, Homo sapiens
attaatatgtactt

SEQ ID NO: 2295517 - DNA, 19 bp, Homo sapiens
attaatatgtacttttcca

SEQ ID NO: 2295518 - DNA, 20 bp, Homo sapiens
attacaaccggttatcagtt

SEQ ID NO: 2295519 - DNA, 14 bp, Homo sapiens
attacactgtaaga

SEQ ID NO: 2295520 - DNA, 16 bp, Homo sapiens
attacaggaaatgcaa

SEQ ID NO: 2295521 - DNA, 17 bp, Homo sapiens
attacaggaagtactgg

SEQ ID NO: 2295522 - DNA, 14 bp, Homo sapiens
attacaggttcctt

SEQ ID NO: 2295523 - DNA, 21 bp, Homo sapiens
attacaggttccttttgaagc

SEQ ID NO: 2295524 - DNA, 18 bp, Homo sapiens
attactaaagacagaaaa

SEQ ID NO: 2295525 - DNA, 16 bp, Homo sapiens
attactttgtagatgt

SEQ ID NO: 2295526 - DNA, 17 bp, Homo sapiens
attactttgtagatgta

SEQ ID NO: 2295527 - DNA, 20 bp, Homo sapiens
attagaatccaattaatgat

SEQ ID NO: 2295528 - DNA, 12 bp, Homo sapiens
attagagatatt

SEQ ID NO: 2295529 - DNA, 14 bp, Homo sapiens
attagccaaagagg

SEQ ID NO: 2295530 - DNA, 21 bp, Homo sapiens
attagcctcgtctttcagcga

SEQ ID NO: 2295531 - DNA, 23 bp, Homo sapiens
attagctatatttttatataata

SEQ ID NO: 2295532 - DNA, 21 bp, Homo sapiens
attaggaacagagtatatatg

SEQ ID NO: 2295533 - DNA, 22 bp, Homo sapiens
attagggttgcctcactgtagc

SEQ ID NO: 2295534 - DNA, 14 bp, Homo sapiens
attagtatcctgtt

SEQ ID NO: 2295535 - DNA, 17 bp, Homo sapiens
attagtgagatttgtat

SEQ ID NO: 2295536 - DNA, 19 bp, Homo sapiens
attagtgagatttgtattt

SEQ ID NO: 2295537 - DNA, 19 bp, Homo sapiens
attataaatgtttcatgaa

SEQ ID NO: 2295538 - DNA, 17 bp, Homo sapiens
attataatatagaaaga

SEQ ID NO: 2295539 - DNA, 15 bp, Homo sapiens
attatacttctttat

SEQ ID NO: 2295540 - DNA, 18 bp, Homo sapiens
attatacttctttattca

SEQ ID NO: 2295541 - DNA, 20 bp, Homo sapiens
attatagctcctattaaatt

SEQ ID NO: 2295542 - DNA, 14 bp, Homo sapiens
attatatacaaagc

SEQ ID NO: 2295543 - DNA, 12 bp, Homo sapiens
attatatatata

SEQ ID NO: 2295544 - DNA, 14 bp, Homo sapiens
attatatatataat

SEQ ID NO: 2295545 - DNA, 15 bp, Homo sapiens
attatcctgtgtgat

SEQ ID NO: 2295546 - DNA, 23 bp, Homo sapiens
attatctgggttttagaaattct

SEQ ID NO: 2295547 - DNA, 21 bp, Homo sapiens
attatgaaaatgtaagttatg

SEQ ID NO: 2295548 - DNA, 16 bp, Homo sapiens
attatgaagatgtttt

SEQ ID NO: 2295549 - DNA, 13 bp, Homo sapiens
attatgaataaaa

SEQ ID NO: 2295550 - DNA, 18 bp, Homo sapiens
attatgaataaaattgtt

SEQ ID NO: 2295551 - DNA, 14 bp, Homo sapiens
attatgtataacaa

SEQ ID NO: 2295552 - DNA, 23 bp, Homo sapiens
attattagaatccaattaatgat

SEQ ID NO: 2295553 - DNA, 22 bp, Homo sapiens
attattctagtcaactgctgtt

SEQ ID NO: 2295554 - DNA, 14 bp, Homo sapiens
attattttctatat

SEQ ID NO: 2295555 - DNA, 14 bp, Homo sapiens
attcaaaactttca

SEQ ID NO: 2295556 - DNA, 22 bp, Homo sapiens
attcaaaatagttctatttcta

SEQ ID NO: 2295557 - DNA, 22 bp, Homo sapiens
attcactttaccttcagcagtt

SEQ ID NO: 2295558 - DNA, 15 bp, Homo sapiens
attcaggaccccatc

SEQ ID NO: 2295559 - DNA, 20 bp, Homo sapiens
attcaggaccccatctgctg

SEQ ID NO: 2295560 - DNA, 15 bp, Homo sapiens
attcagtcttgcctt

SEQ ID NO: 2295561 - DNA, 16 bp, Homo sapiens
attcagtcttgcctta

SEQ ID NO: 2295562 - DNA, 16 bp, Homo sapiens
attcagttatcactac

SEQ ID NO: 2295563 - DNA, 21 bp, Homo sapiens
attcagttttagtttcaaaat

SEQ ID NO: 2295564 - DNA, 14 bp, Homo sapiens
attcataaaaataa

SEQ ID NO: 2295565 - DNA, 23 bp, Homo sapiens
attcataaaaataaccaaaaaat

SEQ ID NO: 2295566 - DNA, 14 bp, Homo sapiens
attcatactcaaag

SEQ ID NO: 2295567 - DNA, 16 bp, Homo sapiens
attcatcaaactcttt

SEQ ID NO: 2295568 - DNA, 17 bp, Homo sapiens
attcatgtgtacagaaa

SEQ ID NO: 2295569 - DNA, 16 bp, Homo sapiens
attcattaataaaata

SEQ ID NO: 2295570 - DNA, 14 bp, Homo sapiens
attcattatgtcaa

SEQ ID NO: 2295571 - DNA, 18 bp, Homo sapiens
attcattatgtcaattca

SEQ ID NO: 2295572 - DNA, 19 bp, Homo sapiens
attcattatgtcaattcat

SEQ ID NO: 2295573 - DNA, 13 bp, Homo sapiens
attcatttaagaa

SEQ ID NO: 2295574 - DNA, 17 bp, Homo sapiens
attcatttaagaacaag

SEQ ID NO: 2295575 - DNA, 15 bp, Homo sapiens
attccacacatttcc

SEQ ID NO: 2295576 - DNA, 20 bp, Homo sapiens
attccactgaaacctctgtt

SEQ ID NO: 2295577 - DNA, 22 bp, Homo sapiens
attccagaacgccctgtgtcca

SEQ ID NO: 2295578 - DNA, 20 bp, Homo sapiens
attccaggagtgggattatt

SEQ ID NO: 2295579 - DNA, 22 bp, Homo sapiens
attccatgggttgaacaagcca

SEQ ID NO: 2295580 - DNA, 15 bp, Homo sapiens
attcccatctgcttt

SEQ ID NO: 2295581 - DNA, 17 bp, Homo sapiens
attccccccatctccat

SEQ ID NO: 2295582 - DNA, 14 bp, Homo sapiens
attcctctgtcccc

SEQ ID NO: 2295583 - DNA, 13 bp, Homo sapiens
attctaaaaaaga

SEQ ID NO: 2295584 - DNA, 23 bp, Homo sapiens
attctaaaaaagatactgtatat

SEQ ID NO: 2295585 - DNA, 18 bp, Homo sapiens
attctaaaacattcttta

SEQ ID NO: 2295586 - DNA, 15 bp, Homo sapiens
attctaagattgtac

SEQ ID NO: 2295587 - DNA, 18 bp, Homo sapiens
attctaagattgtacata

SEQ ID NO: 2295588 - DNA, 17 bp, Homo sapiens
attctagtcaactgctg

SEQ ID NO: 2295589 - DNA, 21 bp, Homo sapiens
attctagtctctgatttgcaa

SEQ ID NO: 2295590 - DNA, 17 bp, Homo sapiens
attctagtctgtttcat

SEQ ID NO: 2295591 - DNA, 15 bp, Homo sapiens
attctataaattcaa

SEQ ID NO: 2295592 - DNA, 17 bp, Homo sapiens
attctataaattcaaca

SEQ ID NO: 2295593 - DNA, 14 bp, Homo sapiens
attctatatttcat

SEQ ID NO: 2295594 - DNA, 16 bp, Homo sapiens
attctatatttcatat

SEQ ID NO: 2295595 - DNA, 17 bp, Homo sapiens
attctatgcctgtattt

SEQ ID NO: 2295596 - DNA, 15 bp, Homo sapiens
attctattaaaagcc

SEQ ID NO: 2295597 - DNA, 17 bp, Homo sapiens
attctcattatgaagat

SEQ ID NO: 2295598 - DNA, 22 bp, Homo sapiens
attctgtcattggttacaaatt

SEQ ID NO: 2295599 - DNA, 22 bp, Homo sapiens
attctgtggctgccatcagaaa

SEQ ID NO: 2295600 - DNA, 13 bp, Homo sapiens
attcttgaataaa

SEQ ID NO: 2295601 - DNA, 19 bp, Homo sapiens
attcttgctttcacaaata

SEQ ID NO: 2295602 - DNA, 13 bp, Homo sapiens
attcttttatata

SEQ ID NO: 2295603 - DNA, 19 bp, Homo sapiens
attcttttatataactaca

SEQ ID NO: 2295604 - DNA, 14 bp, Homo sapiens
attcttttgaaaga

SEQ ID NO: 2295605 - DNA, 16 bp, Homo sapiens
attcttttttcaatgt

SEQ ID NO: 2295606 - DNA, 17 bp, Homo sapiens
attcttttttcaatgta

SEQ ID NO: 2295607 - DNA, 21 bp, Homo sapiens
attgaaaagaagaaagtctat

SEQ ID NO: 2295608 - DNA, 22 bp, Homo sapiens
attgaaaagaagaaagtctatg

SEQ ID NO: 2295609 - DNA, 12 bp, Homo sapiens
attgaaatcttt

SEQ ID NO: 2295610 - DNA, 17 bp, Homo sapiens
attgaaatctttttgct

SEQ ID NO: 2295611 - DNA, 20 bp, Homo sapiens
attgaaccgtcaatgtgaaa

SEQ ID NO: 2295612 - DNA, 21 bp, Homo sapiens
attgaatgttatatcatcaat

SEQ ID NO: 2295613 - DNA, 19 bp, Homo sapiens
attgagactgctagaacca

SEQ ID NO: 2295614 - DNA, 22 bp, Homo sapiens
attgagatactttttcttttgt

SEQ ID NO: 2295615 - DNA, 16 bp, Homo sapiens
attgaggttaggaacc

SEQ ID NO: 2295616 - DNA, 21 bp, Homo sapiens
attgagtaatattacatttca

SEQ ID NO: 2295617 - DNA, 20 bp, Homo sapiens
attgcactccagcctgggca

SEQ ID NO: 2295618 - DNA, 17 bp, Homo sapiens
attgcatttttaccttt

SEQ ID NO: 2295619 - DNA, 21 bp, Homo sapiens
attgcccacacctgcctctga

SEQ ID NO: 2295620 - DNA, 22 bp, Homo sapiens
attgcccacacctgcctctgaa

SEQ ID NO: 2295621 - DNA, 19 bp, Homo sapiens
attgctattgtttatagga

SEQ ID NO: 2295622 - DNA, 18 bp, Homo sapiens
attgctgatggtgcaatg

SEQ ID NO: 2295623 - DNA, 15 bp, Homo sapiens
attgctgttgcttga

SEQ ID NO: 2295624 - DNA, 17 bp, Homo sapiens
attgctgttgcttgaat

SEQ ID NO: 2295625 - DNA, 20 bp, Homo sapiens
attggttacaaatttttact

SEQ ID NO: 2295626 - DNA, 16 bp, Homo sapiens
attgtaacttatttca

SEQ ID NO: 2295627 - DNA, 19 bp, Homo sapiens
attgtagagcacatttagt

SEQ ID NO: 2295628 - DNA, 17 bp, Homo sapiens
attgtctgctgcctcca

SEQ ID NO: 2295629 - DNA, 21 bp, Homo sapiens
atccttcccgcagcaccagcc

SEQ ID NO: 2295630 - DNA, 22 bp, Homo sapiens
atccttcccgcagcaccagcct

SEQ ID NO: 2295631 - DNA, 15 bp, Homo sapiens
atcgacctcactgtc

SEQ ID NO: 2295632 - DNA, 13 bp, Homo sapiens
atctaaaaaataa

SEQ ID NO: 2295633 - DNA, 15 bp, Homo sapiens
atctaaaaaataact

SEQ ID NO: 2295634 - DNA, 17 bp, Homo sapiens
atctaagacaatcacgc

SEQ ID NO: 2295635 - DNA, 16 bp, Homo sapiens
atctaagcagttgcaa

SEQ ID NO: 2295636 - DNA, 16 bp, Homo sapiens
atctacgtctttatta

SEQ ID NO: 2295637 - DNA, 15 bp, Homo sapiens
atctagcaagaagat

SEQ ID NO: 2295638 - DNA, 22 bp, Homo sapiens
atctagcaagaagattctaaaa

SEQ ID NO: 2295639 - DNA, 17 bp, Homo sapiens
atctagcacagctgtga

SEQ ID NO: 2295640 - DNA, 14 bp, Homo sapiens
atctataaaatgag

SEQ ID NO: 2295641 - DNA, 14 bp, Homo sapiens
atctattttctatg

SEQ ID NO: 2295642 - DNA, 20 bp, Homo sapiens
atctattttctatgtactag

SEQ ID NO: 2295643 - DNA, 22 bp, Homo sapiens
atctattttctatgtactagta

SEQ ID NO: 2295644 - DNA, 18 bp, Homo sapiens
atctcacagatcttcaac

SEQ ID NO: 2295645 - DNA, 18 bp, Homo sapiens
atctcacctctaggcctc

SEQ ID NO: 2295646 - DNA, 20 bp, Homo sapiens
atctcagataaagtgaccag

SEQ ID NO: 2295647 - DNA, 21 bp, Homo sapiens
atctccagccaatttcaaaga

SEQ ID NO: 2295648 - DNA, 18 bp, Homo sapiens
atctccatccttaactgt

SEQ ID NO: 2295649 - DNA, 21 bp, Homo sapiens
atctccatccttaactgtcca

SEQ ID NO: 2295650 - DNA, 22 bp, Homo sapiens
atctccatgctctttcaccctg

SEQ ID NO: 2295651 - DNA, 18 bp, Homo sapiens
atctccccgaatctcaat

SEQ ID NO: 2295652 - DNA, 20 bp, Homo sapiens
atctcctgtaattttgtagt

SEQ ID NO: 2295653 - DNA, 15 bp, Homo sapiens
atctctaaaattcta

SEQ ID NO: 2295654 - DNA, 19 bp, Homo sapiens
atctctaaaattctagtct

SEQ ID NO: 2295655 - DNA, 20 bp, Homo sapiens
atctctgtagatacaggggc

SEQ ID NO: 2295656 - DNA, 22 bp, Homo sapiens
atctctgtgactcgcttagctg

SEQ ID NO: 2295657 - DNA, 18 bp, Homo sapiens
atctcttgtaccagccca

SEQ ID NO: 2295658 - DNA, 12 bp, Homo sapiens
atctgaaaagaa

SEQ ID NO: 2295659 - DNA, 19 bp, Homo sapiens
atctgaaaagaaatgctaa

SEQ ID NO: 2295660 - DNA, 13 bp, Homo sapiens
atctgcaaatagt

SEQ ID NO: 2295661 - DNA, 23 bp, Homo sapiens
atctgcaaatagtttcaaatgag

SEQ ID NO: 2295662 - DNA, 23 bp, Homo sapiens
atctgctcgcctgagggaagagt

SEQ ID NO: 2295663 - DNA, 15 bp, Homo sapiens
atctgctgcctctga

SEQ ID NO: 2295664 - DNA, 14 bp, Homo sapiens
atctgctttattgc

SEQ ID NO: 2295665 - DNA, 21 bp, Homo sapiens
atctgtaaatttaactgcata

SEQ ID NO: 2295666 - DNA, 15 bp, Homo sapiens
atctgtatatcagct

SEQ ID NO: 2295667 - DNA, 12 bp, Homo sapiens
atctgtctgatt

SEQ ID NO: 2295668 - DNA, 13 bp, Homo sapiens
atctgtctgattc

SEQ ID NO: 2295669 - DNA, 18 bp, Homo sapiens
atctgtctgattctatgc

SEQ ID NO: 2295670 - DNA, 15 bp, Homo sapiens
atctgtcttgtaata

SEQ ID NO: 2295671 - DNA, 16 bp, Homo sapiens
atctgtcttgtaatat

SEQ ID NO: 2295672 - DNA, 21 bp, Homo sapiens
atctgtcttgtaatattttgt

SEQ ID NO: 2295673 - DNA, 16 bp, Homo sapiens
atctgttactccaaaa

SEQ ID NO: 2295674 - DNA, 20 bp, Homo sapiens
atctgttagcattattgcca

SEQ ID NO: 2295675 - DNA, 20 bp, Homo sapiens
atctgttgacaatttgccat

SEQ ID NO: 2295676 - DNA, 19 bp, Homo sapiens
atcttaacttggctaacat

SEQ ID NO: 2295677 - DNA, 21 bp, Homo sapiens
atcttccaaatattagccaaa

SEQ ID NO: 2295678 - DNA, 14 bp, Homo sapiens
atcttgaagaatat

SEQ ID NO: 2295679 - DNA, 11 bp, Homo sapiens
atcttgattaa

SEQ ID NO: 2295680 - DNA, 18 bp, Homo sapiens
atcttgcaaatgttgtat

SEQ ID NO: 2295681 - DNA, 15 bp, Homo sapiens
atcttgtaaaaatag

SEQ ID NO: 2295682 - DNA, 22 bp, Homo sapiens
atcttgtaaataatgcttaaca

SEQ ID NO: 2295683 - DNA, 16 bp, Homo sapiens
atcttgtctcactagt

SEQ ID NO: 2295684 - DNA, 19 bp, Homo sapiens
atctttcagaatacaattc

SEQ ID NO: 2295685 - DNA, 16 bp, Homo sapiens
atctttccatctcatt

SEQ ID NO: 2295686 - DNA, 19 bp, Homo sapiens
atctttccatctcattaca

SEQ ID NO: 2295687 - DNA, 20 bp, Homo sapiens
atctttccatctcattacag

SEQ ID NO: 2295688 - DNA, 15 bp, Homo sapiens
atctttctcttccca

SEQ ID NO: 2295689 - DNA, 15 bp, Homo sapiens
atcttttctgaggtt

SEQ ID NO: 2295690 - DNA, 11 bp, Homo sapiens
atgaaaacacc

SEQ ID NO: 2295691 - DNA, 12 bp, Homo sapiens
atgaaagagaaa

SEQ ID NO: 2295692 - DNA, 22 bp, Homo sapiens
atgaaagagaaaatgctttctc

SEQ ID NO: 2295693 - DNA, 15 bp, Homo sapiens
atgaaatatttgctt

SEQ ID NO: 2295694 - DNA, 20 bp, Homo sapiens
atgaactagagactctgtga

SEQ ID NO: 2295695 - DNA, 16 bp, Homo sapiens
atgaactcaatgcatg

SEQ ID NO: 2295696 - DNA, 15 bp, Homo sapiens
atgaagaaaaaattt

SEQ ID NO: 2295697 - DNA, 21 bp, Homo sapiens
atgaagaaaaaattttaaaaa

SEQ ID NO: 2295698 - DNA, 12 bp, Homo sapiens
atgaagataaat

SEQ ID NO: 2295699 - DNA, 14 bp, Homo sapiens
atgaagataaatgc

SEQ ID NO: 2295700 - DNA, 17 bp, Homo sapiens
atgaagataaatgcttt

SEQ ID NO: 2295701 - DNA, 21 bp, Homo sapiens
atgaagataaatgctttaaat

SEQ ID NO: 2295702 - DNA, 12 bp, Homo sapiens
atgaagatgttt

SEQ ID NO: 2295703 - DNA, 18 bp, Homo sapiens
atgaagatgtttttagag

SEQ ID NO: 2295704 - DNA, 19 bp, Homo sapiens
atgaaggctgaatcaaaga

SEQ ID NO: 2295705 - DNA, 22 bp, Homo sapiens
atgaaggctgaatcaaagacat

SEQ ID NO: 2295706 - DNA, 19 bp, Homo sapiens
atgaatcagtatgaagaca

SEQ ID NO: 2295707 - DNA, 15 bp, Homo sapiens
atgaatgcctttcaa

SEQ ID NO: 2295708 - DNA, 17 bp, Homo sapiens
atgaatgcctttcaaac

SEQ ID NO: 2295709 - DNA, 16 bp, Homo sapiens
atgacacataaatctg

SEQ ID NO: 2295710 - DNA, 15 bp, Homo sapiens
atgaccaatctctgt

SEQ ID NO: 2295711 - DNA, 18 bp, Homo sapiens
atgacctttcaataggaa

SEQ ID NO: 2295712 - DNA, 16 bp, Homo sapiens
atgactccagaatttc

SEQ ID NO: 2295713 - DNA, 22 bp, Homo sapiens
atgactcttcttatcacacttg

SEQ ID NO: 2295714 - DNA, 14 bp, Homo sapiens
atgactggaaacaa

SEQ ID NO: 2295715 - DNA, 21 bp, Homo sapiens
atgactggaaacaaggaagga

SEQ ID NO: 2295716 - DNA, 15 bp, Homo sapiens
atgactggtgcgttc

SEQ ID NO: 2295717 - DNA, 19 bp, Homo sapiens
atgactggtgcgttcctaa

SEQ ID NO: 2295718 - DNA, 20 bp, Homo sapiens
atgactggtgcgttcctaaa

SEQ ID NO: 2295719 - DNA, 22 bp, Homo sapiens
atgacttaagcacacttgacat

SEQ ID NO: 2295720 - DNA, 12 bp, Homo sapiens
atgagaaaaaaa

SEQ ID NO: 2295721 - DNA, 18 bp, Homo sapiens
atgagaaaaaaacagcag

SEQ ID NO: 2295722 - DNA, 12 bp, Homo sapiens
atgagaaaaaac

SEQ ID NO: 2295723 - DNA, 12 bp, Homo sapiens
atgagaaattgt

SEQ ID NO: 2295724 - DNA, 17 bp, Homo sapiens
atgagaaattgtgccaa

SEQ ID NO: 2295725 - DNA, 15 bp, Homo sapiens
atgagacctccccca

SEQ ID NO: 2295726 - DNA, 19 bp, Homo sapiens
atgagacctcccccaggga

SEQ ID NO: 2295727 - DNA, 13 bp, Homo sapiens
atgagagagaaaa

SEQ ID NO: 2295728 - DNA, 13 bp, Homo sapiens
atgagaggaaatc

SEQ ID NO: 2295729 - DNA, 15 bp, Homo sapiens
atgagaggaaatcac

SEQ ID NO: 2295730 - DNA, 14 bp, Homo sapiens
atgagatacatttg

SEQ ID NO: 2295731 - DNA, 22 bp, Homo sapiens
atgagatacatttgatcttgta

SEQ ID NO: 2295732 - DNA, 16 bp, Homo sapiens
atgagattgtacattt

SEQ ID NO: 2295733 - DNA, 22 bp, Homo sapiens
atgagcccaacactcacttaat

SEQ ID NO: 2295734 - DNA, 15 bp, Homo sapiens
atgaggaacctcaaa

SEQ ID NO: 2295735 - DNA, 22 bp, Homo sapiens
atgaggaacctcaaactgggta

SEQ ID NO: 2295736 - DNA, 19 bp, Homo sapiens
atgagtttaaaaaaataac

SEQ ID NO: 2295737 - DNA, 15 bp, Homo sapiens
atgatactgaattgt

SEQ ID NO: 2295738 - DNA, 22 bp, Homo sapiens
atgatagacttcgaaaacagat

SEQ ID NO: 2295739 - DNA, 12 bp, Homo sapiens
atgatataaaca

SEQ ID NO: 2295740 - DNA, 15 bp, Homo sapiens
atgatataggaaaat

SEQ ID NO: 2295741 - DNA, 20 bp, Homo sapiens
atgatataggaaaatacatt

SEQ ID NO: 2295742 - DNA, 20 bp, Homo sapiens
atgatcagacttgatttaca

SEQ ID NO: 2295743 - DNA, 17 bp, Homo sapiens
atgatcttccaaatatt

SEQ ID NO: 2295744 - DNA, 16 bp, Homo sapiens
atgatgactcttctta

SEQ ID NO: 2295745 - DNA, 13 bp, Homo sapiens
atgatggcagagg

SEQ ID NO: 2295746 - DNA, 14 bp, Homo sapiens
atgattcaatgtga

SEQ ID NO: 2295747 - DNA, 13 bp, Homo sapiens
atgattcattttt

SEQ ID NO: 2295748 - DNA, 14 bp, Homo sapiens
atgattgaaaagaa

SEQ ID NO: 2295749 - DNA, 20 bp, Homo sapiens
atgattgaaaagaagaaagt

SEQ ID NO: 2295750 - DNA, 20 bp, Homo sapiens
atgattgtttaattgtaggt

SEQ ID NO: 2295751 - DNA, 21 bp, Homo sapiens
atgatttaagcattttactgt

SEQ ID NO: 2295752 - DNA, 18 bp, Homo sapiens
atgcaaaaaaaaaaatgt

SEQ ID NO: 2295753 - DNA, 13 bp, Homo sapiens
atgcaaacactgt

SEQ ID NO: 2295754 - DNA, 16 bp, Homo sapiens
atgcaaaccatcattg

SEQ ID NO: 2295755 - DNA, 21 bp, Homo sapiens
atgcaaaccatcattgaaatc

SEQ ID NO: 2295756 - DNA, 20 bp, Homo sapiens
atgcaaaccatcatttaatt

SEQ ID NO: 2295757 - DNA, 16 bp, Homo sapiens
atgcaaatattgctat

SEQ ID NO: 2295758 - DNA, 15 bp, Homo sapiens
atgcaacctgtgcaa

SEQ ID NO: 2295759 - DNA, 15 bp, Homo sapiens
atgcaagaagaatat

SEQ ID NO: 2295760 - DNA, 20 bp, Homo sapiens
atgcaagtcgccaggcagga

SEQ ID NO: 2295761 - DNA, 17 bp, Homo sapiens
atgcacacccattcaca

SEQ ID NO: 2295762 - DNA, 21 bp, Homo sapiens
atgcacagctaacatggaagt

SEQ ID NO: 2295763 - DNA, 23 bp, Homo sapiens
atgcacgtttcaaagctttcctg

SEQ ID NO: 2295764 - DNA, 12 bp, Homo sapiens
atgcactcctgc

SEQ ID NO: 2295765 - DNA, 13 bp, Homo sapiens
atgcactcctgcc

SEQ ID NO: 2295766 - DNA, 19 bp, Homo sapiens
atatatttgaaagaagtca

SEQ ID NO: 2295767 - DNA, 16 bp, Homo sapiens
atatatttttaaagca

SEQ ID NO: 2295768 - DNA, 22 bp, Homo sapiens
atatcagctctaaagcagagat

SEQ ID NO: 2295769 - DNA, 16 bp, Homo sapiens
atatcatgtgtagata

SEQ ID NO: 2295770 - DNA, 16 bp, Homo sapiens
atatccagtcaaagac

SEQ ID NO: 2295771 - DNA, 14 bp, Homo sapiens
atatcctatactgg

SEQ ID NO: 2295772 - DNA, 16 bp, Homo sapiens
atatcctatactggtt

SEQ ID NO: 2295773 - DNA, 14 bp, Homo sapiens
atatcctgaataac

SEQ ID NO: 2295774 - DNA, 17 bp, Homo sapiens
atatcctggtgtctagt

SEQ ID NO: 2295775 - DNA, 12 bp, Homo sapiens
atatcttgaaga

SEQ ID NO: 2295776 - DNA, 14 bp, Homo sapiens
atatcttgaagaat

SEQ ID NO: 2295777 - DNA, 16 bp, Homo sapiens
atatcttgaagaatat

SEQ ID NO: 2295778 - DNA, 17 bp, Homo sapiens
atatcttgaagaatatt

SEQ ID NO: 2295779 - DNA, 16 bp, Homo sapiens
atatgaaagagaaaat

SEQ ID NO: 2295780 - DNA, 14 bp, Homo sapiens
atatgaactgcagg

SEQ ID NO: 2295781 - DNA, 21 bp, Homo sapiens
atatgaagtaagttctgaaaa

SEQ ID NO: 2295782 - DNA, 22 bp, Homo sapiens
atatgaatatatacataaaaat

SEQ ID NO: 2295783 - DNA, 13 bp, Homo sapiens
atatgcaacctgt

SEQ ID NO: 2295784 - DNA, 16 bp, Homo sapiens
atatggaaatcctgtt

SEQ ID NO: 2295785 - DNA, 13 bp, Homo sapiens
atatgtaaatata

SEQ ID NO: 2295786 - DNA, 12 bp, Homo sapiens
atatgtacagtt

SEQ ID NO: 2295787 - DNA, 10 bp, Homo sapiens
atatgtactt

SEQ ID NO: 2295788 - DNA, 12 bp, Homo sapiens
atatgtagcatt

SEQ ID NO: 2295789 - DNA, 14 bp, Homo sapiens
atatgtagcattaa

SEQ ID NO: 2295790 - DNA, 21 bp, Homo sapiens
atatgtgatctgtcttgtaat

SEQ ID NO: 2295791 - DNA, 16 bp, Homo sapiens
atatgtggagttcatc

SEQ ID NO: 2295792 - DNA, 13 bp, Homo sapiens
atatgttgctgaa

SEQ ID NO: 2295793 - DNA, 12 bp, Homo sapiens
atattatctgaa

SEQ ID NO: 2295794 - DNA, 13 bp, Homo sapiens
atattatctgaac

SEQ ID NO: 2295795 - DNA, 13 bp, Homo sapiens
atattatgaataa

SEQ ID NO: 2295796 - DNA, 14 bp, Homo sapiens
atattatgtataga

SEQ ID NO: 2295797 - DNA, 15 bp, Homo sapiens
atattatgtatagaa

SEQ ID NO: 2295798 - DNA, 17 bp, Homo sapiens
atattatgtatagaaaa

SEQ ID NO: 2295799 - DNA, 20 bp, Homo sapiens
atattatgtatagaaaataa

SEQ ID NO: 2295800 - DNA, 14 bp, Homo sapiens
atattcatactttc

SEQ ID NO: 2295801 - DNA, 22 bp, Homo sapiens
atattcatgaaagctgaaagaa

SEQ ID NO: 2295802 - DNA, 10 bp, Homo sapiens
atattctgtc

SEQ ID NO: 2295803 - DNA, 16 bp, Homo sapiens
atattctttatatact

SEQ ID NO: 2295804 - DNA, 20 bp, Homo sapiens
atattgctattgtttatagg

SEQ ID NO: 2295805 - DNA, 24 bp, Homo sapiens
atattgctattgtttataggaaat

SEQ ID NO: 2295806 - DNA, 21 bp, Homo sapiens
atattgctgatggtgcaatga

SEQ ID NO: 2295807 - DNA, 17 bp, Homo sapiens
atattgttggcacagaa

SEQ ID NO: 2295808 - DNA, 21 bp, Homo sapiens
atattgttggcacagaacagg

SEQ ID NO: 2295809 - DNA, 14 bp, Homo sapiens
atatttaaaattca

SEQ ID NO: 2295810 - DNA, 15 bp, Homo sapiens
atatttaaaattcat

SEQ ID NO: 2295811 - DNA, 21 bp, Homo sapiens
atatttatgcagaaggtattt

SEQ ID NO: 2295812 - DNA, 15 bp, Homo sapiens
atatttccaaatatt

SEQ ID NO: 2295813 - DNA, 11 bp, Homo sapiens
atatttgaaag

SEQ ID NO: 2295814 - DNA, 21 bp, Homo sapiens
atatttgctaataccaactat

SEQ ID NO: 2295815 - DNA, 16 bp, Homo sapiens
atatttgcttatttat

SEQ ID NO: 2295816 - DNA, 20 bp, Homo sapiens
atatttgcttatttatattc

SEQ ID NO: 2295817 - DNA, 16 bp, Homo sapiens
atatttggattcacag

SEQ ID NO: 2295818 - DNA, 18 bp, Homo sapiens
atatttgtagctagaata

SEQ ID NO: 2295819 - DNA, 16 bp, Homo sapiens
atatttgtaggtatac

SEQ ID NO: 2295820 - DNA, 19 bp, Homo sapiens
atatttgtaggtatactat

SEQ ID NO: 2295821 - DNA, 23 bp, Homo sapiens
atatttgtaggtatactatgtaa

SEQ ID NO: 2295822 - DNA, 22 bp, Homo sapiens
atattttgtattattgctgttg

SEQ ID NO: 2295823 - DNA, 22 bp, Homo sapiens
atatttttgtaaatatgacaga

SEQ ID NO: 2295824 - DNA, 23 bp, Homo sapiens
atcaaactctttgcccagttcat

SEQ ID NO: 2295825 - DNA, 16 bp, Homo sapiens
atcaaatcattcaaaa

SEQ ID NO: 2295826 - DNA, 23 bp, Homo sapiens
atcaatacttttgtgtattctgt

SEQ ID NO: 2295827 - DNA, 14 bp, Homo sapiens
atcacaacttttct

SEQ ID NO: 2295828 - DNA, 15 bp, Homo sapiens
atcacaacttttctg

SEQ ID NO: 2295829 - DNA, 16 bp, Homo sapiens
atcacactattttaga

SEQ ID NO: 2295830 - DNA, 14 bp, Homo sapiens
atcaccgaaaacgt

SEQ ID NO: 2295831 - DNA, 21 bp, Homo sapiens
atcaccgaaaacgtggctgct

SEQ ID NO: 2295832 - DNA, 18 bp, Homo sapiens
atcagaaattttctacag

SEQ ID NO: 2295833 - DNA, 16 bp, Homo sapiens
atcagaactcctttct

SEQ ID NO: 2295834 - DNA, 19 bp, Homo sapiens
atcagaactcctttctaag

SEQ ID NO: 2295835 - DNA, 16 bp, Homo sapiens
atcagacattcagaga

SEQ ID NO: 2295836 - DNA, 19 bp, Homo sapiens
atcagactagagaataatt

SEQ ID NO: 2295837 - DNA, 13 bp, Homo sapiens
atcagacttgatt

SEQ ID NO: 2295838 - DNA, 14 bp, Homo sapiens
atcagacttgattt

SEQ ID NO: 2295839 - DNA, 16 bp, Homo sapiens
atcagacttgatttac

SEQ ID NO: 2295840 - DNA, 19 bp, Homo sapiens
atcagacttgatttacaag

SEQ ID NO: 2295841 - DNA, 22 bp, Homo sapiens
atcagcacagataaaaagtgga

SEQ ID NO: 2295842 - DNA, 15 bp, Homo sapiens
atcagcccctgctgc

SEQ ID NO: 2295843 - DNA, 17 bp, Homo sapiens
atcagcccctgctgctc

SEQ ID NO: 2295844 - DNA, 21 bp, Homo sapiens
atcagcccggtgtgaggaggg

SEQ ID NO: 2295845 - DNA, 15 bp, Homo sapiens
atcagctctgcataa

SEQ ID NO: 2295846 - DNA, 17 bp, Homo sapiens
atcagtatgaagacact

SEQ ID NO: 2295847 - DNA, 20 bp, Homo sapiens
atcagttgctctctgttcaa

SEQ ID NO: 2295848 - DNA, 15 bp, Homo sapiens
atcataaagttagaa

SEQ ID NO: 2295849 - DNA, 17 bp, Homo sapiens
atcatgctgcagtgggt

SEQ ID NO: 2295850 - DNA, 14 bp, Homo sapiens
atcatgggttcctc

SEQ ID NO: 2295851 - DNA, 13 bp, Homo sapiens
atcatgtaatagt

SEQ ID NO: 2295852 - DNA, 20 bp, Homo sapiens
atcatgtaatagtggctttc

SEQ ID NO: 2295853 - DNA, 16 bp, Homo sapiens
atcatgtgtagatatt

SEQ ID NO: 2295854 - DNA, 12 bp, Homo sapiens
atcattgaaatc

SEQ ID NO: 2295855 - DNA, 14 bp, Homo sapiens
atcattgaaatctt

SEQ ID NO: 2295856 - DNA, 20 bp, Homo sapiens
atcattgaaatctttttgct

SEQ ID NO: 2295857 - DNA, 19 bp, Homo sapiens
atcattgcagtatcagagg

SEQ ID NO: 2295858 - DNA, 14 bp, Homo sapiens
atcatttaatttct

SEQ ID NO: 2295859 - DNA, 14 bp, Homo sapiens
atccaactggaagg

SEQ ID NO: 2295860 - DNA, 16 bp, Homo sapiens
atccaactggaaggct

SEQ ID NO: 2295861 - DNA, 18 bp, Homo sapiens
atccaattaatgattcaa

SEQ ID NO: 2295862 - DNA, 16 bp, Homo sapiens
atccacaaattcctcc

SEQ ID NO: 2295863 - DNA, 21 bp, Homo sapiens
atccacaagtcacggtctaaa

SEQ ID NO: 2295864 - DNA, 14 bp, Homo sapiens
atccacacacagca

SEQ ID NO: 2295865 - DNA, 11 bp, Homo sapiens
atccaccctga

SEQ ID NO: 2295866 - DNA, 14 bp, Homo sapiens
atccaccctgagga

SEQ ID NO: 2295867 - DNA, 14 bp, Homo sapiens
atccagagacctgc

SEQ ID NO: 2295868 - DNA, 24 bp, Homo sapiens
atccagagacctgctccagatcct

SEQ ID NO: 2295869 - DNA, 15 bp, Homo sapiens
atccagccaggggtg

SEQ ID NO: 2295870 - DNA, 21 bp, Homo sapiens
atccaggcacccaaaccccgg

SEQ ID NO: 2295871 - DNA, 15 bp, Homo sapiens
atccagtatcttgaa

SEQ ID NO: 2295872 - DNA, 11 bp, Homo sapiens
atccatacaaa

SEQ ID NO: 2295873 - DNA, 16 bp, Homo sapiens
atccatgtactttccc

SEQ ID NO: 2295874 - DNA, 17 bp, Homo sapiens
atccatgtactttccct

SEQ ID NO: 2295875 - DNA, 19 bp, Homo sapiens
atccatgtactttccctgt

SEQ ID NO: 2295876 - DNA, 15 bp, Homo sapiens
atccatttgaacagt

SEQ ID NO: 2295877 - DNA, 20 bp, Homo sapiens
atccattttctaaactgttt

SEQ ID NO: 2295878 - DNA, 19 bp, Homo sapiens
atcccaaacccttcagtgc

SEQ ID NO: 2295879 - DNA, 19 bp, Homo sapiens
atcccaatagaatacctcc

SEQ ID NO: 2295880 - DNA, 20 bp, Homo sapiens
atcccagctcactgcagcct

SEQ ID NO: 2295881 - DNA, 21 bp, Homo sapiens
atcccagctcactgcagcctc

SEQ ID NO: 2295882 - DNA, 22 bp, Homo sapiens
atcccagctcactgcagcctcg

SEQ ID NO: 2295883 - DNA, 11 bp, Homo sapiens
atcccatcagt

SEQ ID NO: 2295884 - DNA, 23 bp, Homo sapiens
atccccagccccctggcccctcc

SEQ ID NO: 2295885 - DNA, 15 bp, Homo sapiens
atcccggggccatgg

SEQ ID NO: 2295886 - DNA, 22 bp, Homo sapiens
atcccggggccatggaagctgg

SEQ ID NO: 2295887 - DNA, 17 bp, Homo sapiens
atccctcggtcagcacc

SEQ ID NO: 2295888 - DNA, 14 bp, Homo sapiens
atccgccctgggct

SEQ ID NO: 2295889 - DNA, 17 bp, Homo sapiens
atccgccctgggctctg

SEQ ID NO: 2295890 - DNA, 19 bp, Homo sapiens
atccgccctgggctctggg

SEQ ID NO: 2295891 - DNA, 20 bp, Homo sapiens
atccgccctgggctctgggt

SEQ ID NO: 2295892 - DNA, 18 bp, Homo sapiens
atcctcccgccccagcct

SEQ ID NO: 2295893 - DNA, 23 bp, Homo sapiens
atcctctcgccaagccatcacag

SEQ ID NO: 2295894 - DNA, 23 bp, Homo sapiens
atcctctgatatacaattagaga

SEQ ID NO: 2295895 - DNA, 23 bp, Homo sapiens
atcctctgcttgtcattctgcta

SEQ ID NO: 2295896 - DNA, 20 bp, Homo sapiens
atcctgaccaaaggaaggca

SEQ ID NO: 2295897 - DNA, 11 bp, Homo sapiens
atcctgagcca

SEQ ID NO: 2295898 - DNA, 14 bp, Homo sapiens
atcctgagccagat

SEQ ID NO: 2295899 - DNA, 15 bp, Homo sapiens
atcctgagccagatt

SEQ ID NO: 2295900 - DNA, 18 bp, Homo sapiens
atcctgattattgaatgt

SEQ ID NO: 2295901 - DNA, 16 bp, Homo sapiens
atcctggcaaataata

SEQ ID NO: 2295902 - DNA, 22 bp, Homo sapiens
atcctgggcatccccagccccc

SEQ ID NO: 2295903 - DNA, 18 bp, Homo sapiens
atccttcccgcagcacca

SEQ ID NO: 2295904 - DNA, 21 bp, Homo sapiens
ataactagatctcctgtaatt

SEQ ID NO: 2295905 - DNA, 22 bp, Homo sapiens
ataactagatctcctgtaattt

SEQ ID NO: 2295906 - DNA, 18 bp, Homo sapiens
ataactggatattcttta

SEQ ID NO: 2295907 - DNA, 13 bp, Homo sapiens
ataacttagaatg

SEQ ID NO: 2295908 - DNA, 22 bp, Homo sapiens
ataagaaccttttgagtgcctt

SEQ ID NO: 2295909 - DNA, 13 bp, Homo sapiens
ataagacaaaatt

SEQ ID NO: 2295910 - DNA, 12 bp, Homo sapiens
ataagagaaatg

SEQ ID NO: 2295911 - DNA, 15 bp, Homo sapiens
ataagagacaaagtt

SEQ ID NO: 2295912 - DNA, 17 bp, Homo sapiens
ataagagacaaagtttg

SEQ ID NO: 2295913 - DNA, 18 bp, Homo sapiens
ataagagttacttccctt

SEQ ID NO: 2295914 - DNA, 18 bp, Homo sapiens
ataagattatatacaaag

SEQ ID NO: 2295915 - DNA, 13 bp, Homo sapiens
ataaggtaccaag

SEQ ID NO: 2295916 - DNA, 19 bp, Homo sapiens
ataagttaaagagacaaat

SEQ ID NO: 2295917 - DNA, 15 bp, Homo sapiens
ataataactagatct

SEQ ID NO: 2295918 - DNA, 17 bp, Homo sapiens
ataataactagatctcc

SEQ ID NO: 2295919 - DNA, 14 bp, Homo sapiens
ataataattactta

SEQ ID NO: 2295920 - DNA, 17 bp, Homo sapiens
ataatatcctgaataac

SEQ ID NO: 2295921 - DNA, 18 bp, Homo sapiens
ataatatcctgaataact

SEQ ID NO: 2295922 - DNA, 13 bp, Homo sapiens
ataatatgaatat

SEQ ID NO: 2295923 - DNA, 20 bp, Homo sapiens
ataatatttaggcatgagct

SEQ ID NO: 2295924 - DNA, 15 bp, Homo sapiens
ataatgatactgaat

SEQ ID NO: 2295925 - DNA, 16 bp, Homo sapiens
ataatgattcaatgtg

SEQ ID NO: 2295926 - DNA, 14 bp, Homo sapiens
ataatgcatctaaa

SEQ ID NO: 2295927 - DNA, 20 bp, Homo sapiens
ataatgcttaacataaactt

SEQ ID NO: 2295928 - DNA, 22 bp, Homo sapiens
ataatgcttaacataaacttgt

SEQ ID NO: 2295929 - DNA, 19 bp, Homo sapiens
ataattatttgtctcagat

SEQ ID NO: 2295930 - DNA, 13 bp, Homo sapiens
ataattcatttaa

SEQ ID NO: 2295931 - DNA, 16 bp, Homo sapiens
ataattcatttaagaa

SEQ ID NO: 2295932 - DNA, 18 bp, Homo sapiens
ataattcatttaagaaca

SEQ ID NO: 2295933 - DNA, 12 bp, Homo sapiens
ataatttccaaa

SEQ ID NO: 2295934 - DNA, 21 bp, Homo sapiens
ataatttccatgatacaaaga

SEQ ID NO: 2295935 - DNA, 21 bp, Homo sapiens
ataattttaacagacatgtat

SEQ ID NO: 2295936 - DNA, 16 bp, Homo sapiens
atacaaacatgtggca

SEQ ID NO: 2295937 - DNA, 20 bp, Homo sapiens
atacaaagctgtcactcaca

SEQ ID NO: 2295938 - DNA, 19 bp, Homo sapiens
atacaagaaaaagtagaaa

SEQ ID NO: 2295939 - DNA, 20 bp, Homo sapiens
atacaagaaaaagtagaaaa

SEQ ID NO: 2295940 - DNA, 13 bp, Homo sapiens
atacactacaaat

SEQ ID NO: 2295941 - DNA, 15 bp, Homo sapiens
atacactacaaatgt

SEQ ID NO: 2295942 - DNA, 23 bp, Homo sapiens
atacactgtatctaaaaaataac

SEQ ID NO: 2295943 - DNA, 20 bp, Homo sapiens
atacagcatgagattgtaca

SEQ ID NO: 2295944 - DNA, 15 bp, Homo sapiens
atacagtttttgtaa

SEQ ID NO: 2295945 - DNA, 12 bp, Homo sapiens
atacataaaaat

SEQ ID NO: 2295946 - DNA, 17 bp, Homo sapiens
atacataaaagaatgta

SEQ ID NO: 2295947 - DNA, 21 bp, Homo sapiens
atacataaaagaatgtacaga

SEQ ID NO: 2295948 - DNA, 23 bp, Homo sapiens
atacataaaagaatgtacagaaa

SEQ ID NO: 2295949 - DNA, 23 bp, Homo sapiens
atacatctaagtcagtttcacat

SEQ ID NO: 2295950 - DNA, 14 bp, Homo sapiens
atacatgtccccct

SEQ ID NO: 2295951 - DNA, 18 bp, Homo sapiens
atacattgtgttttccta

SEQ ID NO: 2295952 - DNA, 20 bp, Homo sapiens
atacctctctctatatatac

SEQ ID NO: 2295953 - DNA, 21 bp, Homo sapiens
atacctctctctatatataca

SEQ ID NO: 2295954 - DNA, 16 bp, Homo sapiens
ataccttgcttcttca

SEQ ID NO: 2295955 - DNA, 13 bp, Homo sapiens
atactaaataaaa

SEQ ID NO: 2295956 - DNA, 18 bp, Homo sapiens
atactacagcataaatct

SEQ ID NO: 2295957 - DNA, 17 bp, Homo sapiens
atactccaaggtggcat

SEQ ID NO: 2295958 - DNA, 22 bp, Homo sapiens
atactccaaggtggcatagcca

SEQ ID NO: 2295959 - DNA, 22 bp, Homo sapiens
atactctgtgtaatctctgatt

SEQ ID NO: 2295960 - DNA, 21 bp, Homo sapiens
atactgaaaaagaatgaaaac

SEQ ID NO: 2295961 - DNA, 19 bp, Homo sapiens
atactgaattgttatgtaa

SEQ ID NO: 2295962 - DNA, 20 bp, Homo sapiens
atactgccgctgcccccacc

SEQ ID NO: 2295963 - DNA, 22 bp, Homo sapiens
atactggaaataacctgtgaat

SEQ ID NO: 2295964 - DNA, 21 bp, Homo sapiens
atactggttatagttgatatg

SEQ ID NO: 2295965 - DNA, 16 bp, Homo sapiens
atactgtagcaatata

SEQ ID NO: 2295966 - DNA, 19 bp, Homo sapiens
atactgtatatgtcaaaaa

SEQ ID NO: 2295967 - DNA, 13 bp, Homo sapiens
atactgtttgtaa

SEQ ID NO: 2295968 - DNA, 17 bp, Homo sapiens
atacttccttataaaaa

SEQ ID NO: 2295969 - DNA, 12 bp, Homo sapiens
atactttccaac

SEQ ID NO: 2295970 - DNA, 17 bp, Homo sapiens
atacttttgtgtattct

SEQ ID NO: 2295971 - DNA, 18 bp, Homo sapiens
atacttttgtgtattctg

SEQ ID NO: 2295972 - DNA, 19 bp, Homo sapiens
atacttttgtgtattctgt

SEQ ID NO: 2295973 - DNA, 15 bp, Homo sapiens
atactttttcttttg

SEQ ID NO: 2295974 - DNA, 17 bp, Homo sapiens
atactttttcttttgta

SEQ ID NO: 2295975 - DNA, 18 bp, Homo sapiens
atactttttcttttgtaa

SEQ ID NO: 2295976 - DNA, 18 bp, Homo sapiens
atagaaaataaaataaat

SEQ ID NO: 2295977 - DNA, 20 bp, Homo sapiens
atagaaactaaactaaaata

SEQ ID NO: 2295978 - DNA, 13 bp, Homo sapiens
atagaatacctcc

SEQ ID NO: 2295979 - DNA, 22 bp, Homo sapiens
atagaatatataaacgatatat

SEQ ID NO: 2295980 - DNA, 13 bp, Homo sapiens
atagacagtttgt

SEQ ID NO: 2295981 - DNA, 16 bp, Homo sapiens
atagacagtttgtaaa

SEQ ID NO: 2295982 - DNA, 13 bp, Homo sapiens
atagacttcgaaa

SEQ ID NO: 2295983 - DNA, 14 bp, Homo sapiens
atagagtttaacag

SEQ ID NO: 2295984 - DNA, 18 bp, Homo sapiens
atagatgctacagtattt

SEQ ID NO: 2295985 - DNA, 16 bp, Homo sapiens
ataggaaataaatcta

SEQ ID NO: 2295986 - DNA, 17 bp, Homo sapiens
ataggaaataaatctaa

SEQ ID NO: 2295987 - DNA, 15 bp, Homo sapiens
atagggtttggaaga

SEQ ID NO: 2295988 - DNA, 17 bp, Homo sapiens
atagggtttggaagaaa

SEQ ID NO: 2295989 - DNA, 19 bp, Homo sapiens
atagggtttggaagaaagg

SEQ ID NO: 2295990 - DNA, 18 bp, Homo sapiens
atagtaatggttctagaa

SEQ ID NO: 2295991 - DNA, 16 bp, Homo sapiens
atagtagcagagtcat

SEQ ID NO: 2295992 - DNA, 20 bp, Homo sapiens
atagtagcagagtcattgtt

SEQ ID NO: 2295993 - DNA, 23 bp, Homo sapiens
atagtcatgtttctgcagtattc

SEQ ID NO: 2295994 - DNA, 12 bp, Homo sapiens
atagttccattc

SEQ ID NO: 2295995 - DNA, 15 bp, Homo sapiens
atagttctatttcta

SEQ ID NO: 2295996 - DNA, 16 bp, Homo sapiens
atagttctatttctat

SEQ ID NO: 2295997 - DNA, 12 bp, Homo sapiens
atagttctgcaa

SEQ ID NO: 2295998 - DNA, 20 bp, Homo sapiens
atagttgatatgtaacagtt

SEQ ID NO: 2295999 - DNA, 19 bp, Homo sapiens
atagtttgttttctttttc

SEQ ID NO: 2296000 - DNA, 18 bp, Homo sapiens
atagttttacattaacat

SEQ ID NO: 2296001 - DNA, 21 bp, Homo sapiens
atagttttctaaatgtttctt

SEQ ID NO: 2296002 - DNA, 19 bp, Homo sapiens
atataaaatacataaaaga

SEQ ID NO: 2296003 - DNA, 14 bp, Homo sapiens
atataaacgatata

SEQ ID NO: 2296004 - DNA, 17 bp, Homo sapiens
atataaacgatatatgt

SEQ ID NO: 2296005 - DNA, 22 bp, Homo sapiens
atataaacgatatatgtaaata

SEQ ID NO: 2296006 - DNA, 16 bp, Homo sapiens
atataaacttgtgtat

SEQ ID NO: 2296007 - DNA, 16 bp, Homo sapiens
atataactacattaaa

SEQ ID NO: 2296008 - DNA, 18 bp, Homo sapiens
atataagttaaagagaca

SEQ ID NO: 2296009 - DNA, 16 bp, Homo sapiens
atataataattactta

SEQ ID NO: 2296010 - DNA, 20 bp, Homo sapiens
atataatatatatatatatc

SEQ ID NO: 2296011 - DNA, 23 bp, Homo sapiens
atataatatatatatatatcagt

SEQ ID NO: 2296012 - DNA, 21 bp, Homo sapiens
atataatcaaatgattcattt

SEQ ID NO: 2296013 - DNA, 21 bp, Homo sapiens
atataattacttaatgtgatg

SEQ ID NO: 2296014 - DNA, 15 bp, Homo sapiens
atatacaaacatgtg

SEQ ID NO: 2296015 - DNA, 11 bp, Homo sapiens
atatacaatta

SEQ ID NO: 2296016 - DNA, 17 bp, Homo sapiens
atatacatctagcacag

SEQ ID NO: 2296017 - DNA, 18 bp, Homo sapiens
atatacatgtaaaaatgt

SEQ ID NO: 2296018 - DNA, 14 bp, Homo sapiens
atatacatgtatag

SEQ ID NO: 2296019 - DNA, 14 bp, Homo sapiens
atatactgcatatc

SEQ ID NO: 2296020 - DNA, 15 bp, Homo sapiens
atatagaaagaaaat

SEQ ID NO: 2296021 - DNA, 21 bp, Homo sapiens
atatagttaattgtggcttta

SEQ ID NO: 2296022 - DNA, 20 bp, Homo sapiens
atatagtttgttttcttttt

SEQ ID NO: 2296023 - DNA, 13 bp, Homo sapiens
atatataatcaaa

SEQ ID NO: 2296024 - DNA, 17 bp, Homo sapiens
atatataatcaaatgat

SEQ ID NO: 2296025 - DNA, 13 bp, Homo sapiens
atatatatatatc

SEQ ID NO: 2296026 - DNA, 14 bp, Homo sapiens
atatatatatcagt

SEQ ID NO: 2296027 - DNA, 14 bp, Homo sapiens
atatatatcagttt

SEQ ID NO: 2296028 - DNA, 15 bp, Homo sapiens
atatatatcagtttg

SEQ ID NO: 2296029 - DNA, 13 bp, Homo sapiens
atatatatttcca

SEQ ID NO: 2296030 - DNA, 14 bp, Homo sapiens
atatatatttccaa

SEQ ID NO: 2296031 - DNA, 17 bp, Homo sapiens
atatatatttccaaata

SEQ ID NO: 2296032 - DNA, 18 bp, Homo sapiens
atatatatttccaaatat

SEQ ID NO: 2296033 - DNA, 19 bp, Homo sapiens
atatatatttccaaatatt

SEQ ID NO: 2296034 - DNA, 14 bp, Homo sapiens
atatatcagtttga

SEQ ID NO: 2296035 - DNA, 20 bp, Homo sapiens
atatatttaaaattcatatt

SEQ ID NO: 2296036 - DNA, 15 bp, Homo sapiens
atatatttattattt

SEQ ID NO: 2296037 - DNA, 19 bp, Homo sapiens
atatatttattattttcat

SEQ ID NO: 2296038 - DNA, 18 bp, Homo sapiens
atatatttccaaatattc

SEQ ID NO: 2296039 - DNA, 23 bp, Homo sapiens
atatatttccaaatattctaaaa

SEQ ID NO: 2296040 - DNA, 12 bp, Homo sapiens
atatatttgaaa

SEQ ID NO: 2296041 - DNA, 21 bp, Homo sapiens
agtgatcctcccgccccagcc

SEQ ID NO: 2296042 - DNA, 21 bp, Homo sapiens
agtgatgtgggaagttacctt

SEQ ID NO: 2296043 - DNA, 15 bp, Homo sapiens
agtgcagcaaccaga

SEQ ID NO: 2296044 - DNA, 16 bp, Homo sapiens
agtgcatgctgtccct

SEQ ID NO: 2296045 - DNA, 20 bp, Homo sapiens
agtgcatttagttttgtctt

SEQ ID NO: 2296046 - DNA, 17 bp, Homo sapiens
agtgccttacacaatgg

SEQ ID NO: 2296047 - DNA, 16 bp, Homo sapiens
agtgccttatggaaca

SEQ ID NO: 2296048 - DNA, 20 bp, Homo sapiens
agtgctgggattacaggtgt

SEQ ID NO: 2296049 - DNA, 21 bp, Homo sapiens
agtgctgggattacaggtgtg

SEQ ID NO: 2296050 - DNA, 13 bp, Homo sapiens
agtggaagacaga

SEQ ID NO: 2296051 - DNA, 18 bp, Homo sapiens
agtggaagacagagatgg

SEQ ID NO: 2296052 - DNA, 21 bp, Homo sapiens
agtggaagacagagatggcag

SEQ ID NO: 2296053 - DNA, 11 bp, Homo sapiens
agtggaatcat

SEQ ID NO: 2296054 - DNA, 17 bp, Homo sapiens
agtggaatttcttgttt

SEQ ID NO: 2296055 - DNA, 12 bp, Homo sapiens
agtggacagcag

SEQ ID NO: 2296056 - DNA, 19 bp, Homo sapiens
agtggacagcagctggact

SEQ ID NO: 2296057 - DNA, 14 bp, Homo sapiens
agtggacccagctg

SEQ ID NO: 2296058 - DNA, 21 bp, Homo sapiens
agtggacccgcccgcggccct

SEQ ID NO: 2296059 - DNA, 15 bp, Homo sapiens
agtggcatggtcctg

SEQ ID NO: 2296060 - DNA, 19 bp, Homo sapiens
agtggcatggtcctgtgcc

SEQ ID NO: 2296061 - DNA, 22 bp, Homo sapiens
agtggcatggtcctgtgccccg

SEQ ID NO: 2296062 - DNA, 16 bp, Homo sapiens
agtggctgaccaggcc

SEQ ID NO: 2296063 - DNA, 15 bp, Homo sapiens
agtggcttcagcccc

SEQ ID NO: 2296064 - DNA, 16 bp, Homo sapiens
agtggcttcagcccct

SEQ ID NO: 2296065 - DNA, 17 bp, Homo sapiens
agtggcttcagcccctg

SEQ ID NO: 2296066 - DNA, 15 bp, Homo sapiens
agtggcttggagcag

SEQ ID NO: 2296067 - DNA, 19 bp, Homo sapiens
agtggggcccatggcccca

SEQ ID NO: 2296068 - DNA, 19 bp, Homo sapiens
agtgtacaattttcatccc

SEQ ID NO: 2296069 - DNA, 20 bp, Homo sapiens
agtgtacaattttcatccca

SEQ ID NO: 2296070 - DNA, 13 bp, Homo sapiens
agtgtccccaggg

SEQ ID NO: 2296071 - DNA, 14 bp, Homo sapiens
agtgtcctcatcta

SEQ ID NO: 2296072 - DNA, 19 bp, Homo sapiens
agtgtggagctgcttccag

SEQ ID NO: 2296073 - DNA, 20 bp, Homo sapiens
agtgtggcgggaagggtggg

SEQ ID NO: 2296074 - DNA, 21 bp, Homo sapiens
agtgtgtagaaacacagccta

SEQ ID NO: 2296075 - DNA, 17 bp, Homo sapiens
agtgttgaggaggggag

SEQ ID NO: 2296076 - DNA, 21 bp, Homo sapiens
agtgttgaggaggggagcaag

SEQ ID NO: 2296077 - DNA, 21 bp, Homo sapiens
agtgttgatcagatcttacaa

SEQ ID NO: 2296078 - DNA, 14 bp, Homo sapiens
agtgttgggtggag

SEQ ID NO: 2296079 - DNA, 17 bp, Homo sapiens
agtgttttaagaaatgt

SEQ ID NO: 2296080 - DNA, 22 bp, Homo sapiens
agtgttttcttgtgttgttttc

SEQ ID NO: 2296081 - DNA, 22 bp, Homo sapiens
agtgtttttctttaatcaaaag

SEQ ID NO: 2296082 - DNA, 19 bp, Homo sapiens
agttaaagagacaaatagt

SEQ ID NO: 2296083 - DNA, 18 bp, Homo sapiens
agttaatgatggcagagg

SEQ ID NO: 2296084 - DNA, 13 bp, Homo sapiens
agttaatgtgcca

SEQ ID NO: 2296085 - DNA, 14 bp, Homo sapiens
agttacagacaaag

SEQ ID NO: 2296086 - DNA, 17 bp, Homo sapiens
agttacagacaaagcgt

SEQ ID NO: 2296087 - DNA, 18 bp, Homo sapiens
agttagcaggaaatagtg

SEQ ID NO: 2296088 - DNA, 16 bp, Homo sapiens
agttagcccggccaag

SEQ ID NO: 2296089 - DNA, 21 bp, Homo sapiens
agttagcccggccaaggacac

SEQ ID NO: 2296090 - DNA, 23 bp, Homo sapiens
agttagcccggccaaggacactg

SEQ ID NO: 2296091 - DNA, 21 bp, Homo sapiens
agttagggcatttttcttgga

SEQ ID NO: 2296092 - DNA, 17 bp, Homo sapiens
agttatcatcctattgt

SEQ ID NO: 2296093 - DNA, 12 bp, Homo sapiens
agttcatcccaa

SEQ ID NO: 2296094 - DNA, 23 bp, Homo sapiens
agttcattcatactcaaagaggc

SEQ ID NO: 2296095 - DNA, 16 bp, Homo sapiens
agttccattctatgac

SEQ ID NO: 2296096 - DNA, 17 bp, Homo sapiens
agttcgagaccagcctg

SEQ ID NO: 2296097 - DNA, 16 bp, Homo sapiens
agttctattatctggg

SEQ ID NO: 2296098 - DNA, 14 bp, Homo sapiens
agttctatttctat

SEQ ID NO: 2296099 - DNA, 17 bp, Homo sapiens
agttctcccttcaactg

SEQ ID NO: 2296100 - DNA, 12 bp, Homo sapiens
agttctgaaaac

SEQ ID NO: 2296101 - DNA, 13 bp, Homo sapiens
agttctgaaaact

SEQ ID NO: 2296102 - DNA, 17 bp, Homo sapiens
agttctgaaaactgttt

SEQ ID NO: 2296103 - DNA, 19 bp, Homo sapiens
agttctgaaaactgtttat

SEQ ID NO: 2296104 - DNA, 16 bp, Homo sapiens
agttctgcaataacag

SEQ ID NO: 2296105 - DNA, 16 bp, Homo sapiens
agttctgggctgattt

SEQ ID NO: 2296106 - DNA, 14 bp, Homo sapiens
agttcttggcctgc

SEQ ID NO: 2296107 - DNA, 13 bp, Homo sapiens
agttgagcacagg

SEQ ID NO: 2296108 - DNA, 22 bp, Homo sapiens
agttgagtgggtatttcttatt

SEQ ID NO: 2296109 - DNA, 16 bp, Homo sapiens
agttgccctccaggcc

SEQ ID NO: 2296110 - DNA, 20 bp, Homo sapiens
agttgctactcttcagaata

SEQ ID NO: 2296111 - DNA, 18 bp, Homo sapiens
agttggactgtggcctca

SEQ ID NO: 2296112 - DNA, 19 bp, Homo sapiens
agttggactgtggcctcag

SEQ ID NO: 2296113 - DNA, 19 bp, Homo sapiens
agttggagctagaaaatga

SEQ ID NO: 2296114 - DNA, 12 bp, Homo sapiens
agttgtctgtcc

SEQ ID NO: 2296115 - DNA, 19 bp, Homo sapiens
agttgtctgtcctggtcag

SEQ ID NO: 2296116 - DNA, 22 bp, Homo sapiens
agttgtggcctcattcagcaga

SEQ ID NO: 2296117 - DNA, 15 bp, Homo sapiens
agtttaacagatatt

SEQ ID NO: 2296118 - DNA, 14 bp, Homo sapiens
agtttaccaatcaa

SEQ ID NO: 2296119 - DNA, 22 bp, Homo sapiens
agtttacttcactttcatctga

SEQ ID NO: 2296120 - DNA, 22 bp, Homo sapiens
agtttatgtggcacacaatcct

SEQ ID NO: 2296121 - DNA, 20 bp, Homo sapiens
agtttattatagtctgtact

SEQ ID NO: 2296122 - DNA, 21 bp, Homo sapiens
agtttattatagtctgtactt

SEQ ID NO: 2296123 - DNA, 16 bp, Homo sapiens
agtttcaaaatgttaa

SEQ ID NO: 2296124 - DNA, 19 bp, Homo sapiens
agtttcaaaatgttaacaa

SEQ ID NO: 2296125 - DNA, 12 bp, Homo sapiens
agtttcaggcaa

SEQ ID NO: 2296126 - DNA, 15 bp, Homo sapiens
agtttccagctgctc

SEQ ID NO: 2296127 - DNA, 18 bp, Homo sapiens
agtttccttattttcata

SEQ ID NO: 2296128 - DNA, 17 bp, Homo sapiens
agtttctggctgaaaat

SEQ ID NO: 2296129 - DNA, 18 bp, Homo sapiens
agtttctggctgaaaatg

SEQ ID NO: 2296130 - DNA, 21 bp, Homo sapiens
agtttctggctgaaaatggtg

SEQ ID NO: 2296131 - DNA, 15 bp, Homo sapiens
agtttggggcagggg

SEQ ID NO: 2296132 - DNA, 15 bp, Homo sapiens
agtttgtaaatgtta

SEQ ID NO: 2296133 - DNA, 17 bp, Homo sapiens
agtttgtaaatgttatt

SEQ ID NO: 2296134 - DNA, 12 bp, Homo sapiens
agtttgttttct

SEQ ID NO: 2296135 - DNA, 13 bp, Homo sapiens
agtttgttttctt

SEQ ID NO: 2296136 - DNA, 16 bp, Homo sapiens
agttttgttcatgaaa

SEQ ID NO: 2296137 - DNA, 17 bp, Homo sapiens
ataaaaaataacaactg

SEQ ID NO: 2296138 - DNA, 21 bp, Homo sapiens
ataaaaattgtttctataaat

SEQ ID NO: 2296139 - DNA, 18 bp, Homo sapiens
ataaaactctagcagttg

SEQ ID NO: 2296140 - DNA, 14 bp, Homo sapiens
ataaaagaatgtac

SEQ ID NO: 2296141 - DNA, 19 bp, Homo sapiens
ataaaagaggtccattaat

SEQ ID NO: 2296142 - DNA, 13 bp, Homo sapiens
ataaaagttaaca

SEQ ID NO: 2296143 - DNA, 13 bp, Homo sapiens
ataaaataaataa

SEQ ID NO: 2296144 - DNA, 15 bp, Homo sapiens
ataaaataaattatg

SEQ ID NO: 2296145 - DNA, 15 bp, Homo sapiens
ataaaatcttcaact

SEQ ID NO: 2296146 - DNA, 13 bp, Homo sapiens
ataaaatgtttac

SEQ ID NO: 2296147 - DNA, 15 bp, Homo sapiens
ataaaatgtttacat

SEQ ID NO: 2296148 - DNA, 17 bp, Homo sapiens
ataaaatgtttacattt

SEQ ID NO: 2296149 - DNA, 22 bp, Homo sapiens
ataaacaacagaaacttctcag

SEQ ID NO: 2296150 - DNA, 12 bp, Homo sapiens
ataaactgaaat

SEQ ID NO: 2296151 - DNA, 15 bp, Homo sapiens
ataaacttgtactta

SEQ ID NO: 2296152 - DNA, 16 bp, Homo sapiens
ataaagaaacactttc

SEQ ID NO: 2296153 - DNA, 12 bp, Homo sapiens
ataaagaagaaa

SEQ ID NO: 2296154 - DNA, 15 bp, Homo sapiens
ataaagaagaaaata

SEQ ID NO: 2296155 - DNA, 18 bp, Homo sapiens
ataaagaagaaaataacc

SEQ ID NO: 2296156 - DNA, 12 bp, Homo sapiens
ataaagttagaa

SEQ ID NO: 2296157 - DNA, 22 bp, Homo sapiens
ataaagttagaatctattttct

SEQ ID NO: 2296158 - DNA, 16 bp, Homo sapiens
ataaataaaaataatt

SEQ ID NO: 2296159 - DNA, 18 bp, Homo sapiens
ataaataaaaatattctc

SEQ ID NO: 2296160 - DNA, 18 bp, Homo sapiens
ataaataaagaagaaaat

SEQ ID NO: 2296161 - DNA, 20 bp, Homo sapiens
ataaataaagaagaaaataa

SEQ ID NO: 2296162 - DNA, 21 bp, Homo sapiens
ataaataaagaagaaaataac

SEQ ID NO: 2296163 - DNA, 13 bp, Homo sapiens
ataaataatctca

SEQ ID NO: 2296164 - DNA, 22 bp, Homo sapiens
ataaatctgtctgattctatgc

SEQ ID NO: 2296165 - DNA, 14 bp, Homo sapiens
ataaatgaacattt

SEQ ID NO: 2296166 - DNA, 16 bp, Homo sapiens
ataaatgctttaaata

SEQ ID NO: 2296167 - DNA, 13 bp, Homo sapiens
ataaatgtttcat

SEQ ID NO: 2296168 - DNA, 13 bp, Homo sapiens
ataaattataatg

SEQ ID NO: 2296169 - DNA, 21 bp, Homo sapiens
ataaattataatgcatctaaa

SEQ ID NO: 2296170 - DNA, 16 bp, Homo sapiens
ataacaacaacttaat

SEQ ID NO: 2296171 - DNA, 17 bp, Homo sapiens
ataacaacaacttaatg

SEQ ID NO: 2296172 - DNA, 13 bp, Homo sapiens
ataacaactctat

SEQ ID NO: 2296173 - DNA, 22 bp, Homo sapiens
ataacaagccaaacattcttat

SEQ ID NO: 2296174 - DNA, 14 bp, Homo sapiens
ataaccaaaaaatg

SEQ ID NO: 2296175 - DNA, 17 bp, Homo sapiens
ataaccaagaatgtctc

SEQ ID NO: 2296176 - DNA, 19 bp, Homo sapiens
ataactacattaaaagctt

SEQ ID NO: 2296177 - DNA, 20 bp, Homo sapiens
ataactacattaaaagcttt

SEQ ID NO: 2296178 - DNA, 16 bp, Homo sapiens
ccagagactgcccacc

SEQ ID NO: 2296179 - DNA, 17 bp, Homo sapiens
ccagagactgcccaccc

SEQ ID NO: 2296180 - DNA, 18 bp, Homo sapiens
ccagagactgcccaccct

SEQ ID NO: 2296181 - DNA, 22 bp, Homo sapiens
ccagagactgcccaccctgggc

SEQ ID NO: 2296182 - DNA, 14 bp, Homo sapiens
ccagagcactgtat

SEQ ID NO: 2296183 - DNA, 18 bp, Homo sapiens
ccagagccgcaccctggc

SEQ ID NO: 2296184 - DNA, 13 bp, Homo sapiens
ccagagctcccag

SEQ ID NO: 2296185 - DNA, 16 bp, Homo sapiens
ccagagctcccaggac

SEQ ID NO: 2296186 - DNA, 18 bp, Homo sapiens
ccagaggggcggggccag

SEQ ID NO: 2296187 - DNA, 19 bp, Homo sapiens
ccagaggggcggggccagg

SEQ ID NO: 2296188 - DNA, 19 bp, Homo sapiens
ccagaggtgagggaggcct

SEQ ID NO: 2296189 - DNA, 20 bp, Homo sapiens
ccagaggtgagggaggcctg

SEQ ID NO: 2296190 - DNA, 21 bp, Homo sapiens
ccagaggtgagggaggcctga

SEQ ID NO: 2296191 - DNA, 23 bp, Homo sapiens
ccagatcctctttccccactgaa

SEQ ID NO: 2296192 - DNA, 14 bp, Homo sapiens
ccagatgttttaga

SEQ ID NO: 2296193 - DNA, 19 bp, Homo sapiens
ccagatgttttagagataa

SEQ ID NO: 2296194 - DNA, 18 bp, Homo sapiens
ccagatttcactctcctt

SEQ ID NO: 2296195 - DNA, 17 bp, Homo sapiens
ccagcacactcccgaga

SEQ ID NO: 2296196 - DNA, 15 bp, Homo sapiens
ccagcacatctctga

SEQ ID NO: 2296197 - DNA, 15 bp, Homo sapiens
ccagcactcccaggg

SEQ ID NO: 2296198 - DNA, 18 bp, Homo sapiens
ccagcactcccagggccc

SEQ ID NO: 2296199 - DNA, 21 bp, Homo sapiens
ccagcactcccagggcccgag

SEQ ID NO: 2296200 - DNA, 13 bp, Homo sapiens
ccagcagaactga

SEQ ID NO: 2296201 - DNA, 14 bp, Homo sapiens
ccagcagaactgaa

SEQ ID NO: 2296202 - DNA, 14 bp, Homo sapiens
ccagcatagttctg

SEQ ID NO: 2296203 - DNA, 17 bp, Homo sapiens
ccagcatagttctgcaa

SEQ ID NO: 2296204 - DNA, 18 bp, Homo sapiens
ccagcatagttctgcaat

SEQ ID NO: 2296205 - DNA, 12 bp, Homo sapiens
ccagcccctccc

SEQ ID NO: 2296206 - DNA, 23 bp, Homo sapiens
ccagcccctccccgcctcctccc

SEQ ID NO: 2296207 - DNA, 16 bp, Homo sapiens
ccagccgtaatgggga

SEQ ID NO: 2296208 - DNA, 19 bp, Homo sapiens
ccagccgtaatggggactc

SEQ ID NO: 2296209 - DNA, 13 bp, Homo sapiens
ccagcctccccca

SEQ ID NO: 2296210 - DNA, 13 bp, Homo sapiens
ccagcctgagcca

SEQ ID NO: 2296211 - DNA, 17 bp, Homo sapiens
ccagcctgagccacagt

SEQ ID NO: 2296212 - DNA, 22 bp, Homo sapiens
ccagccttgaactgtggccacc

SEQ ID NO: 2296213 - DNA, 23 bp, Homo sapiens
ccagccttgaactgtggccacct

SEQ ID NO: 2296214 - DNA, 14 bp, Homo sapiens
ccagcgtctgctgt

SEQ ID NO: 2296215 - DNA, 15 bp, Homo sapiens
ccagcgtctgctgtt

SEQ ID NO: 2296216 - DNA, 12 bp, Homo sapiens
ccagcgtggggc

SEQ ID NO: 2296217 - DNA, 17 bp, Homo sapiens
ccagctcactgcagcct

SEQ ID NO: 2296218 - DNA, 19 bp, Homo sapiens
ccagctcactgcagcctcg

SEQ ID NO: 2296219 - DNA, 20 bp, Homo sapiens
ccagctcagtcccacagccc

SEQ ID NO: 2296220 - DNA, 13 bp, Homo sapiens
ccagctctcccct

SEQ ID NO: 2296221 - DNA, 15 bp, Homo sapiens
ccagctggcagcgcc

SEQ ID NO: 2296222 - DNA, 17 bp, Homo sapiens
ccagctggcagcgcctc

SEQ ID NO: 2296223 - DNA, 19 bp, Homo sapiens
ccagctggcagcgcctccc

SEQ ID NO: 2296224 - DNA, 13 bp, Homo sapiens
ccagctggctggg

SEQ ID NO: 2296225 - DNA, 23 bp, Homo sapiens
ccaggaagaggggcgctgccccc

SEQ ID NO: 2296226 - DNA, 13 bp, Homo sapiens
ccaggaaggggac

SEQ ID NO: 2296227 - DNA, 13 bp, Homo sapiens
ccaggacggtctg

SEQ ID NO: 2296228 - DNA, 17 bp, Homo sapiens
ccaggacggtctgtgcc

SEQ ID NO: 2296229 - DNA, 13 bp, Homo sapiens
ccaggactctgcc

SEQ ID NO: 2296230 - DNA, 20 bp, Homo sapiens
ccaggcaatagtgttgagga

SEQ ID NO: 2296231 - DNA, 22 bp, Homo sapiens
ccaggcaccgcctgcccccagc

SEQ ID NO: 2296232 - DNA, 22 bp, Homo sapiens
ccaggcacttaaagccttttcc

SEQ ID NO: 2296233 - DNA, 22 bp, Homo sapiens
ccaggcatgaccctggagcccg

SEQ ID NO: 2296234 - DNA, 15 bp, Homo sapiens
ccaggccgacaggag

SEQ ID NO: 2296235 - DNA, 20 bp, Homo sapiens
ccaggcggaggggcttggag

SEQ ID NO: 2296236 - DNA, 16 bp, Homo sapiens
ccaggcgtagggccag

SEQ ID NO: 2296237 - DNA, 20 bp, Homo sapiens
ccaggcgtagggccagggct

SEQ ID NO: 2296238 - DNA, 13 bp, Homo sapiens
ccaggctgagccg

SEQ ID NO: 2296239 - DNA, 12 bp, Homo sapiens
ccaggctgcgcc

SEQ ID NO: 2296240 - DNA, 13 bp, Homo sapiens
ccaggctgcgcct

SEQ ID NO: 2296241 - DNA, 15 bp, Homo sapiens
ccaggctgcgcctgc

SEQ ID NO: 2296242 - DNA, 12 bp, Homo sapiens
ccaggctggtct

SEQ ID NO: 2296243 - DNA, 13 bp, Homo sapiens
ccagggagggggt

SEQ ID NO: 2296244 - DNA, 22 bp, Homo sapiens
ccagggcccgagcgcgtgcctt

SEQ ID NO: 2296245 - DNA, 16 bp, Homo sapiens
ccagggcccgggaagc

SEQ ID NO: 2296246 - DNA, 15 bp, Homo sapiens
ccagggctctggcag

SEQ ID NO: 2296247 - DNA, 17 bp, Homo sapiens
ccagggctctggcaggt

SEQ ID NO: 2296248 - DNA, 17 bp, Homo sapiens
ccaggggcacacttccc

SEQ ID NO: 2296249 - DNA, 15 bp, Homo sapiens
ccaggggctggggac

SEQ ID NO: 2296250 - DNA, 19 bp, Homo sapiens
ccaggtaaagtcaaagctt

SEQ ID NO: 2296251 - DNA, 13 bp, Homo sapiens
ccagtaatttttc

SEQ ID NO: 2296252 - DNA, 22 bp, Homo sapiens
ccagtatctccatccttaactg

SEQ ID NO: 2296253 - DNA, 13 bp, Homo sapiens
ccagtatcttgaa

SEQ ID NO: 2296254 - DNA, 22 bp, Homo sapiens
ccagtatcttgaagacttttct

SEQ ID NO: 2296255 - DNA, 20 bp, Homo sapiens
ccagtgatgtgggaagttac

SEQ ID NO: 2296256 - DNA, 14 bp, Homo sapiens
ccagtgtccccagg

SEQ ID NO: 2296257 - DNA, 20 bp, Homo sapiens
ccagtgtccccaggggcaca

SEQ ID NO: 2296258 - DNA, 17 bp, Homo sapiens
ccagttaatgtgccaaa

SEQ ID NO: 2296259 - DNA, 19 bp, Homo sapiens
ccagttagcccggccaagg

SEQ ID NO: 2296260 - DNA, 15 bp, Homo sapiens
ccagttgtatttgaa

SEQ ID NO: 2296261 - DNA, 16 bp, Homo sapiens
ccataagagaaatggt

SEQ ID NO: 2296262 - DNA, 21 bp, Homo sapiens
ccatatagtttgttttctttt

SEQ ID NO: 2296263 - DNA, 14 bp, Homo sapiens
ccatatcagctctg

SEQ ID NO: 2296264 - DNA, 12 bp, Homo sapiens
ccatatgctctt

SEQ ID NO: 2296265 - DNA, 20 bp, Homo sapiens
ccatatgtagcattaaatat

SEQ ID NO: 2296266 - DNA, 12 bp, Homo sapiens
ccatcattgaaa

SEQ ID NO: 2296267 - DNA, 17 bp, Homo sapiens
ccatcattgaaatcttt

SEQ ID NO: 2296268 - DNA, 22 bp, Homo sapiens
ccatcattgaaatctttttgct

SEQ ID NO: 2296269 - DNA, 19 bp, Homo sapiens
ccatccacaccctctcctt

SEQ ID NO: 2296270 - DNA, 16 bp, Homo sapiens
ccatccaccctgagga

SEQ ID NO: 2296271 - DNA, 17 bp, Homo sapiens
ccatccaccctgaggag

SEQ ID NO: 2296272 - DNA, 18 bp, Homo sapiens
ccatccaccctgaggagt

SEQ ID NO: 2296273 - DNA, 16 bp, Homo sapiens
ccatccagccaggggt

SEQ ID NO: 2296274 - DNA, 20 bp, Homo sapiens
ccatcccaaacccttcagtg

SEQ ID NO: 2296275 - DNA, 13 bp, Homo sapiens
ccatcctctgtta

SEQ ID NO: 2296276 - DNA, 21 bp, Homo sapiens
ccatccttcccgcagcaccag

SEQ ID NO: 2296277 - DNA, 18 bp, Homo sapiens
ccatctgctgagctctga

SEQ ID NO: 2296278 - DNA, 16 bp, Homo sapiens
ccatgattccaagggc

SEQ ID NO: 2296279 - DNA, 19 bp, Homo sapiens
ccatgattccaagggccca

SEQ ID NO: 2296280 - DNA, 22 bp, Homo sapiens
ccatgccctccgtcctggcagg

SEQ ID NO: 2296281 - DNA, 20 bp, Homo sapiens
ccatgctctttcaccctgcc

SEQ ID NO: 2296282 - DNA, 23 bp, Homo sapiens
ccatgctctttcaccctgccacc

SEQ ID NO: 2296283 - DNA, 15 bp, Homo sapiens
ccatggaagctggca

SEQ ID NO: 2296284 - DNA, 17 bp, Homo sapiens
ccatggaagctggcagg

SEQ ID NO: 2296285 - DNA, 22 bp, Homo sapiens
ccatggaagctggcaggagaca

SEQ ID NO: 2296286 - DNA, 18 bp, Homo sapiens
ccatggccccagctggct

SEQ ID NO: 2296287 - DNA, 21 bp, Homo sapiens
ccatggccccagctggctggg

SEQ ID NO: 2296288 - DNA, 13 bp, Homo sapiens
ccatggcttctgg

SEQ ID NO: 2296289 - DNA, 16 bp, Homo sapiens
ccatgggctctggccc

SEQ ID NO: 2296290 - DNA, 17 bp, Homo sapiens
ccatgggctctggcccc

SEQ ID NO: 2296291 - DNA, 14 bp, Homo sapiens
ccatggtcacagac

SEQ ID NO: 2296292 - DNA, 15 bp, Homo sapiens
ccatggtcacagacc

SEQ ID NO: 2296293 - DNA, 13 bp, Homo sapiens
ccatgttgcccag

SEQ ID NO: 2296294 - DNA, 23 bp, Homo sapiens
ccattaatacttccttataaaaa

SEQ ID NO: 2296295 - DNA, 12 bp, Homo sapiens
ccattcagcctc

SEQ ID NO: 2296296 - DNA, 17 bp, Homo sapiens
ccattcagcctcgtctc

SEQ ID NO: 2296297 - DNA, 19 bp, Homo sapiens
ccattcatactaaataaaa

SEQ ID NO: 2296298 - DNA, 16 bp, Homo sapiens
ccattcatttacaact

SEQ ID NO: 2296299 - DNA, 16 bp, Homo sapiens
ccattttctaaactgt

SEQ ID NO: 2296300 - DNA, 22 bp, Homo sapiens
ccattttctaaactgttttcat

SEQ ID NO: 2296301 - DNA, 20 bp, Homo sapiens
ccattttgctgtcccttttc

SEQ ID NO: 2296302 - DNA, 23 bp, Homo sapiens
cccaacagggcaaccaataaaag

SEQ ID NO: 2296303 - DNA, 12 bp, Homo sapiens
cccaacccccac

SEQ ID NO: 2296304 - DNA, 15 bp, Homo sapiens
cccaacccccacctc

SEQ ID NO: 2296305 - DNA, 14 bp, Homo sapiens
cattgcattcatgt

SEQ ID NO: 2296306 - DNA, 16 bp, Homo sapiens
aaacaaaaatagaata

SEQ ID NO: 2296307 - DNA, 13 bp, Homo sapiens
aaacaaaatgatg

SEQ ID NO: 2296308 - DNA, 21 bp, Homo sapiens
aaacaaaggatttgaaaacac

SEQ ID NO: 2296309 - DNA, 14 bp, Homo sapiens
aaacaactgccaaa

SEQ ID NO: 2296310 - DNA, 20 bp, Homo sapiens
aaacaaggattctacctgaa

SEQ ID NO: 2296311 - DNA, 17 bp, Homo sapiens
aaacacacttagaatac

SEQ ID NO: 2296312 - DNA, 15 bp, Homo sapiens
aaacaccaagagtac

SEQ ID NO: 2296313 - DNA, 18 bp, Homo sapiens
aaacacccaagcacaaac

SEQ ID NO: 2296314 - DNA, 22 bp, Homo sapiens
aaacacgtggtcatgaatagaa

SEQ ID NO: 2296315 - DNA, 22 bp, Homo sapiens
aaacactggattcatttcatct

SEQ ID NO: 2296316 - DNA, 13 bp, Homo sapiens
aaacactgtgtat

SEQ ID NO: 2296317 - DNA, 14 bp, Homo sapiens
aaacagaaacgaga

SEQ ID NO: 2296318 - DNA, 13 bp, Homo sapiens
aaacagaggacca

SEQ ID NO: 2296319 - DNA, 16 bp, Homo sapiens
aaacagaggaccagca

SEQ ID NO: 2296320 - DNA, 14 bp, Homo sapiens
aaacaggctgctta

SEQ ID NO: 2296321 - DNA, 18 bp, Homo sapiens
aaacataagacgacttat

SEQ ID NO: 2296322 - DNA, 20 bp, Homo sapiens
aaacataatatcttgaagaa

SEQ ID NO: 2296323 - DNA, 13 bp, Homo sapiens
aaacatctcagag

SEQ ID NO: 2296324 - DNA, 13 bp, Homo sapiens
aaacattcttatt

SEQ ID NO: 2296325 - DNA, 14 bp, Homo sapiens
aaacattcttattt

SEQ ID NO: 2296326 - DNA, 16 bp, Homo sapiens
aaacattgagactgct

SEQ ID NO: 2296327 - DNA, 21 bp, Homo sapiens
aaacattttaaaatcaacttt

SEQ ID NO: 2296328 - DNA, 15 bp, Homo sapiens
aaaccaatcatctta

SEQ ID NO: 2296329 - DNA, 21 bp, Homo sapiens
aaaccataaaataaataatct

SEQ ID NO: 2296330 - DNA, 17 bp, Homo sapiens
aaacccaaataaatgtg

SEQ ID NO: 2296331 - DNA, 23 bp, Homo sapiens
aaacccaaataaatgtgtaaatg

SEQ ID NO: 2296332 - DNA, 20 bp, Homo sapiens
aaacctaaggcaacatttcc

SEQ ID NO: 2296333 - DNA, 16 bp, Homo sapiens
aaacctgtgctttcat

SEQ ID NO: 2296334 - DNA, 17 bp, Homo sapiens
aaaccttctatgttcat

SEQ ID NO: 2296335 - DNA, 23 bp, Homo sapiens
aaacgagttaatgatggcagagg

SEQ ID NO: 2296336 - DNA, 15 bp, Homo sapiens
aaacgatatatgtaa

SEQ ID NO: 2296337 - DNA, 13 bp, Homo sapiens
aaacgtgaacaaa

SEQ ID NO: 2296338 - DNA, 16 bp, Homo sapiens
aaacgtggctgcttca

SEQ ID NO: 2296339 - DNA, 22 bp, Homo sapiens
aaactaaaattcaacaaatgat

SEQ ID NO: 2296340 - DNA, 16 bp, Homo sapiens
aaactctagcagttgt

SEQ ID NO: 2296341 - DNA, 16 bp, Homo sapiens
aaactgaaatttgcta

SEQ ID NO: 2296342 - DNA, 19 bp, Homo sapiens
aaactgatttttttttcct

SEQ ID NO: 2296343 - DNA, 20 bp, Homo sapiens
aaactggatagaaaaatgct

SEQ ID NO: 2296344 - DNA, 14 bp, Homo sapiens
aaactgtggttaaa

SEQ ID NO: 2296345 - DNA, 16 bp, Homo sapiens
aaactgtttatggtat

SEQ ID NO: 2296346 - DNA, 20 bp, Homo sapiens
aaactgttttgggtagctgc

SEQ ID NO: 2296347 - DNA, 17 bp, Homo sapiens
aaacttaacgtgatcat

SEQ ID NO: 2296348 - DNA, 14 bp, Homo sapiens
aaacttactgtcag

SEQ ID NO: 2296349 - DNA, 23 bp, Homo sapiens
aaacttactgtcagagaatatga

SEQ ID NO: 2296350 - DNA, 20 bp, Homo sapiens
aaacttgtacttacactgaa

SEQ ID NO: 2296351 - DNA, 17 bp, Homo sapiens
aaagaaaaaaatagttt

SEQ ID NO: 2296352 - DNA, 14 bp, Homo sapiens
aaagaaacactttc

SEQ ID NO: 2296353 - DNA, 15 bp, Homo sapiens
aaagaaacactttct

SEQ ID NO: 2296354 - DNA, 21 bp, Homo sapiens
aaagaaatgctaatgtaatca

SEQ ID NO: 2296355 - DNA, 13 bp, Homo sapiens
aaagaagaaagtc

SEQ ID NO: 2296356 - DNA, 17 bp, Homo sapiens
aaagaagaaagtctatg

SEQ ID NO: 2296357 - DNA, 17 bp, Homo sapiens
aaagaatgaaaacaata

SEQ ID NO: 2296358 - DNA, 12 bp, Homo sapiens
aaagaatgtaca

SEQ ID NO: 2296359 - DNA, 13 bp, Homo sapiens
aaagacacttcaa

SEQ ID NO: 2296360 - DNA, 23 bp, Homo sapiens
aaagacatttaaaatagttttct

SEQ ID NO: 2296361 - DNA, 23 bp, Homo sapiens
aaagagctaggaaagagttgagc

SEQ ID NO: 2296362 - DNA, 18 bp, Homo sapiens
aaagaggcgtcttgtatt

SEQ ID NO: 2296363 - DNA, 21 bp, Homo sapiens
aaagaggcgtcttgtattttc

SEQ ID NO: 2296364 - DNA, 15 bp, Homo sapiens
aaagagttgagcaca

SEQ ID NO: 2296365 - DNA, 17 bp, Homo sapiens
aaagatacaagaaaaag

SEQ ID NO: 2296366 - DNA, 13 bp, Homo sapiens
aaagatagcagaa

SEQ ID NO: 2296367 - DNA, 15 bp, Homo sapiens
aaagatgcttaaaaa

SEQ ID NO: 2296368 - DNA, 16 bp, Homo sapiens
aaagatggtaatcttt

SEQ ID NO: 2296369 - DNA, 20 bp, Homo sapiens
aaagatggtaatcttttctg

SEQ ID NO: 2296370 - DNA, 18 bp, Homo sapiens
aaagattgacaccaggtt

SEQ ID NO: 2296371 - DNA, 14 bp, Homo sapiens
aaagcagagagaag

SEQ ID NO: 2296372 - DNA, 18 bp, Homo sapiens
aaagcagagatgtattat

SEQ ID NO: 2296373 - DNA, 19 bp, Homo sapiens
aaagcagggcagcagggaa

SEQ ID NO: 2296374 - DNA, 17 bp, Homo sapiens
aaagcagtgcatgctgt

SEQ ID NO: 2296375 - DNA, 21 bp, Homo sapiens
aaagcagtgcatgctgtccct

SEQ ID NO: 2296376 - DNA, 22 bp, Homo sapiens
aaagcagtgcatgctgtccctt

SEQ ID NO: 2296377 - DNA, 22 bp, Homo sapiens
aaagcccaacctcttcctcctg

SEQ ID NO: 2296378 - DNA, 19 bp, Homo sapiens
aaagcctagtccagaaatc

SEQ ID NO: 2296379 - DNA, 13 bp, Homo sapiens
aaagctgaagatc

SEQ ID NO: 2296380 - DNA, 17 bp, Homo sapiens
aaagctgtggctcaaca

SEQ ID NO: 2296381 - DNA, 19 bp, Homo sapiens
aaagctttagattgaaatt

SEQ ID NO: 2296382 - DNA, 21 bp, Homo sapiens
aaagctttcctgtttccaggg

SEQ ID NO: 2296383 - DNA, 23 bp, Homo sapiens
aaagctttcctgtttccagggtc

SEQ ID NO: 2296384 - DNA, 15 bp, Homo sapiens
aaaggatctctgaga

SEQ ID NO: 2296385 - DNA, 13 bp, Homo sapiens
aaaggatttgaaa

SEQ ID NO: 2296386 - DNA, 18 bp, Homo sapiens
aaaggctggatgtgcttt

SEQ ID NO: 2296387 - DNA, 10 bp, Homo sapiens
aaagggagag

SEQ ID NO: 2296388 - DNA, 18 bp, Homo sapiens
aaagggagccatgctctt

SEQ ID NO: 2296389 - DNA, 13 bp, Homo sapiens
aaagggtaaatta

SEQ ID NO: 2296390 - DNA, 15 bp, Homo sapiens
aaagggtaaattata

SEQ ID NO: 2296391 - DNA, 18 bp, Homo sapiens
aaagggtaaattataaat

SEQ ID NO: 2296392 - DNA, 20 bp, Homo sapiens
aaagggtaaattataaatgt

SEQ ID NO: 2296393 - DNA, 21 bp, Homo sapiens
aaaggtaacttctcccttctc

SEQ ID NO: 2296394 - DNA, 19 bp, Homo sapiens
aaaggtcacctcactcagc

SEQ ID NO: 2296395 - DNA, 17 bp, Homo sapiens
aaaggtccaaaactgta

SEQ ID NO: 2296396 - DNA, 17 bp, Homo sapiens
aaagtatctctactttc

SEQ ID NO: 2296397 - DNA, 19 bp, Homo sapiens
aaagtatctctactttcct

SEQ ID NO: 2296398 - DNA, 14 bp, Homo sapiens
aaagtcatgtcaga

SEQ ID NO: 2296399 - DNA, 22 bp, Homo sapiens
aaagtcattgctgacagagccc

SEQ ID NO: 2296400 - DNA, 13 bp, Homo sapiens
aaagtctatgctt

SEQ ID NO: 2296401 - DNA, 23 bp, Homo sapiens
aaagtgaccaggctcacaactgt

SEQ ID NO: 2296402 - DNA, 14 bp, Homo sapiens
aaagtgtttttctt

SEQ ID NO: 2296403 - DNA, 15 bp, Homo sapiens
aaagttaacattagg

SEQ ID NO: 2296404 - DNA, 17 bp, Homo sapiens
aaagttagggcattttt

SEQ ID NO: 2296405 - DNA, 19 bp, Homo sapiens
aaagttctattatctgggt

SEQ ID NO: 2296406 - DNA, 19 bp, Homo sapiens
aaagttctgtgtaaacaga

SEQ ID NO: 2296407 - DNA, 19 bp, Homo sapiens
aaataaaatgtttacattt

SEQ ID NO: 2296408 - DNA, 16 bp, Homo sapiens
aaataaagaagaaaat

SEQ ID NO: 2296409 - DNA, 19 bp, Homo sapiens
aaataaagaagaaaataac

SEQ ID NO: 2296410 - DNA, 24 bp, Homo sapiens
aaataaagagttctccttgtactt

SEQ ID NO: 2296411 - DNA, 19 bp, Homo sapiens
aaataaagggaagaaagga

SEQ ID NO: 2296412 - DNA, 15 bp, Homo sapiens
aaataaataatctca

SEQ ID NO: 2296413 - DNA, 19 bp, Homo sapiens
aaataaataatctcatccc

SEQ ID NO: 2296414 - DNA, 13 bp, Homo sapiens
aaataaatctaaa

SEQ ID NO: 2296415 - DNA, 11 bp, Homo sapiens
aaataaatgtg

SEQ ID NO: 2296416 - DNA, 15 bp, Homo sapiens
aaataaatgtgtaaa

SEQ ID NO: 2296417 - DNA, 22 bp, Homo sapiens
aaataacaactgagatgttaaa

SEQ ID NO: 2296418 - DNA, 17 bp, Homo sapiens
aaataacatattcttgc

SEQ ID NO: 2296419 - DNA, 20 bp, Homo sapiens
aaataacatattcttgcttt

SEQ ID NO: 2296420 - DNA, 12 bp, Homo sapiens
aaataactgtgc

SEQ ID NO: 2296421 - DNA, 16 bp, Homo sapiens
aaataatcctctatgt

SEQ ID NO: 2296422 - DNA, 22 bp, Homo sapiens
aaataatgatttaagcatttta

SEQ ID NO: 2296423 - DNA, 23 bp, Homo sapiens
aaataatgcttaacataaacttg

SEQ ID NO: 2296424 - DNA, 19 bp, Homo sapiens
aaataattagctatatttt

SEQ ID NO: 2296425 - DNA, 14 bp, Homo sapiens
aaataattgggtga

SEQ ID NO: 2296426 - DNA, 15 bp, Homo sapiens
aaatacataaaagaa

SEQ ID NO: 2296427 - DNA, 21 bp, Homo sapiens
aaatacataaaagaatgtaca

SEQ ID NO: 2296428 - DNA, 14 bp, Homo sapiens
aaatacatttagaa

SEQ ID NO: 2296429 - DNA, 16 bp, Homo sapiens
aaatagatgaagtgag

SEQ ID NO: 2296430 - DNA, 13 bp, Homo sapiens
aaatagtcatgtt

SEQ ID NO: 2296431 - DNA, 17 bp, Homo sapiens
aaatagtgttcttttta

SEQ ID NO: 2296432 - DNA, 18 bp, Homo sapiens
aaatagtttaaaaatatt

SEQ ID NO: 2296433 - DNA, 12 bp, Homo sapiens
aaatagttttac

SEQ ID NO: 2296434 - DNA, 13 bp, Homo sapiens
aaatagttttcta

SEQ ID NO: 2296435 - DNA, 11 bp, Homo sapiens
aaatataaact

SEQ ID NO: 2296436 - DNA, 13 bp, Homo sapiens
aaatataaacttg

SEQ ID NO: 2296437 - DNA, 21 bp, Homo sapiens
aaatatagttgaacaagattt

SEQ ID NO: 2296438 - DNA, 23 bp, Homo sapiens
aaatatattacggaggaacagat

SEQ ID NO: 2296439 - DNA, 14 bp, Homo sapiens
aaccaaagatgctt

SEQ ID NO: 2296440 - DNA, 18 bp, Homo sapiens
aaccaagcactaccagta

SEQ ID NO: 2296441 - DNA, 18 bp, Homo sapiens
aaccagagcactgtatac

SEQ ID NO: 2296442 - DNA, 16 bp, Homo sapiens
aaccagcactcccagg

SEQ ID NO: 2296443 - DNA, 18 bp, Homo sapiens
aaccagcactcccagggc

SEQ ID NO: 2296444 - DNA, 20 bp, Homo sapiens
aaccagcactcccagggccc

SEQ ID NO: 2296445 - DNA, 14 bp, Homo sapiens
aaccagtttcacat

SEQ ID NO: 2296446 - DNA, 18 bp, Homo sapiens
aaccatatgattgaaaag

SEQ ID NO: 2296447 - DNA, 19 bp, Homo sapiens
aaccatatgattgaaaaga

SEQ ID NO: 2296448 - DNA, 20 bp, Homo sapiens
aaccatatgattgaaaagaa

SEQ ID NO: 2296449 - DNA, 18 bp, Homo sapiens
aaccatcattgaaatctt

SEQ ID NO: 2296450 - DNA, 13 bp, Homo sapiens
aaccatttcttat

SEQ ID NO: 2296451 - DNA, 22 bp, Homo sapiens
aacccaaataaatgtgtaaatg

SEQ ID NO: 2296452 - DNA, 17 bp, Homo sapiens
aacccaagtggaatcat

SEQ ID NO: 2296453 - DNA, 13 bp, Homo sapiens
aacccagtgttca

SEQ ID NO: 2296454 - DNA, 11 bp, Homo sapiens
aacccccacct

SEQ ID NO: 2296455 - DNA, 11 bp, Homo sapiens
aaccctgccct

SEQ ID NO: 2296456 - DNA, 14 bp, Homo sapiens
aaccctgccctgca

SEQ ID NO: 2296457 - DNA, 14 bp, Homo sapiens
aaccggttatcagt

SEQ ID NO: 2296458 - DNA, 15 bp, Homo sapiens
aaccgtcaatgtgaa

SEQ ID NO: 2296459 - DNA, 16 bp, Homo sapiens
aaccgtcaatgtgaaa

SEQ ID NO: 2296460 - DNA, 22 bp, Homo sapiens
aacctaaggcaacatttccgaa

SEQ ID NO: 2296461 - DNA, 18 bp, Homo sapiens
aacctgcaaggcaaagta

SEQ ID NO: 2296462 - DNA, 14 bp, Homo sapiens
aacctgcatttaag

SEQ ID NO: 2296463 - DNA, 15 bp, Homo sapiens
aacctggaggctgga

SEQ ID NO: 2296464 - DNA, 18 bp, Homo sapiens
aacctgtgcaaaataaaa

SEQ ID NO: 2296465 - DNA, 18 bp, Homo sapiens
aacctgtgctttcatgtt

SEQ ID NO: 2296466 - DNA, 22 bp, Homo sapiens
aacctttcaggaaagtatctct

SEQ ID NO: 2296467 - DNA, 23 bp, Homo sapiens
aaccttttgagtgccttacacaa

SEQ ID NO: 2296468 - DNA, 20 bp, Homo sapiens
aacgagatttgccaaaaact

SEQ ID NO: 2296469 - DNA, 22 bp, Homo sapiens
aacgagttaatgatggcagagg

SEQ ID NO: 2296470 - DNA, 11 bp, Homo sapiens
aacgatatatg

SEQ ID NO: 2296471 - DNA, 13 bp, Homo sapiens
aacgatatatgta

SEQ ID NO: 2296472 - DNA, 16 bp, Homo sapiens
aacgatatatgtaaat

SEQ ID NO: 2296473 - DNA, 19 bp, Homo sapiens
aacgatatatgtaaatata

SEQ ID NO: 2296474 - DNA, 20 bp, Homo sapiens
aacgatatatgtaaatatac

SEQ ID NO: 2296475 - DNA, 12 bp, Homo sapiens
aacgtggctgct

SEQ ID NO: 2296476 - DNA, 23 bp, Homo sapiens
aacgtggctgcttcaaggatcct

SEQ ID NO: 2296477 - DNA, 12 bp, Homo sapiens
aactaaaatagt

SEQ ID NO: 2296478 - DNA, 14 bp, Homo sapiens
aactaaggacagga

SEQ ID NO: 2296479 - DNA, 14 bp, Homo sapiens
aactacattaaaag

SEQ ID NO: 2296480 - DNA, 17 bp, Homo sapiens
aactacattaaaagctt

SEQ ID NO: 2296481 - DNA, 16 bp, Homo sapiens
aactagagactctgtg

SEQ ID NO: 2296482 - DNA, 17 bp, Homo sapiens
aactagagactctgtga

SEQ ID NO: 2296483 - DNA, 19 bp, Homo sapiens
aactagagactctgtgatc

SEQ ID NO: 2296484 - DNA, 16 bp, Homo sapiens
aactagatctcctgta

SEQ ID NO: 2296485 - DNA, 21 bp, Homo sapiens
aactagatctcctgtaatttt

SEQ ID NO: 2296486 - DNA, 16 bp, Homo sapiens
aactatcggttcaagt

SEQ ID NO: 2296487 - DNA, 19 bp, Homo sapiens
aactatttcaataagtgtt

SEQ ID NO: 2296488 - DNA, 18 bp, Homo sapiens
aactcaatgcatgatgac

SEQ ID NO: 2296489 - DNA, 20 bp, Homo sapiens
aactcaatgcatgatgactc

SEQ ID NO: 2296490 - DNA, 20 bp, Homo sapiens
aactcagtctcaaataataa

SEQ ID NO: 2296491 - DNA, 15 bp, Homo sapiens
aactctattttttac

SEQ ID NO: 2296492 - DNA, 18 bp, Homo sapiens
aactctgaaatcagcctt

SEQ ID NO: 2296493 - DNA, 19 bp, Homo sapiens
aactgatgtatagctttaa

SEQ ID NO: 2296494 - DNA, 21 bp, Homo sapiens
aactgatttttttttccttca

SEQ ID NO: 2296495 - DNA, 21 bp, Homo sapiens
aactgccaaataaaatgttta

SEQ ID NO: 2296496 - DNA, 15 bp, Homo sapiens
aactgtaatgcagga

SEQ ID NO: 2296497 - DNA, 20 bp, Homo sapiens
aactgtatattattgctata

SEQ ID NO: 2296498 - DNA, 23 bp, Homo sapiens
aactgtcccacaaaatatttcta

SEQ ID NO: 2296499 - DNA, 15 bp, Homo sapiens
aactgtcgtcttttt

SEQ ID NO: 2296500 - DNA, 19 bp, Homo sapiens
aactgtcgtctttttccaa

SEQ ID NO: 2296501 - DNA, 17 bp, Homo sapiens
aactgttctttgcagtg

SEQ ID NO: 2296502 - DNA, 21 bp, Homo sapiens
aactgttttgggtagctgcca

SEQ ID NO: 2296503 - DNA, 15 bp, Homo sapiens
aactgtttttgaaga

SEQ ID NO: 2296504 - DNA, 12 bp, Homo sapiens
aacttaaaacat

SEQ ID NO: 2296505 - DNA, 15 bp, Homo sapiens
aacttaaaacatatg

SEQ ID NO: 2296506 - DNA, 17 bp, Homo sapiens
aacttaaacctgtgctt

SEQ ID NO: 2296507 - DNA, 12 bp, Homo sapiens
aacttaatgtgc

SEQ ID NO: 2296508 - DNA, 15 bp, Homo sapiens
aacttaattctgtta

SEQ ID NO: 2296509 - DNA, 20 bp, Homo sapiens
aacttactgtcagagaatat

SEQ ID NO: 2296510 - DNA, 18 bp, Homo sapiens
aacttataatttccaaac

SEQ ID NO: 2296511 - DNA, 13 bp, Homo sapiens
aacttgaattaca

SEQ ID NO: 2296512 - DNA, 14 bp, Homo sapiens
aacttgatactttt

SEQ ID NO: 2296513 - DNA, 20 bp, Homo sapiens
aacttggctttcctgtttct

SEQ ID NO: 2296514 - DNA, 12 bp, Homo sapiens
aacttgtactta

SEQ ID NO: 2296515 - DNA, 20 bp, Homo sapiens
aacttgtacttacactgaaa

SEQ ID NO: 2296516 - DNA, 16 bp, Homo sapiens
aagaaaaagtagaaaa

SEQ ID NO: 2296517 - DNA, 13 bp, Homo sapiens
aagaaagctgtgg

SEQ ID NO: 2296518 - DNA, 15 bp, Homo sapiens
aagaaagctgtggct

SEQ ID NO: 2296519 - DNA, 17 bp, Homo sapiens
aagaaagggagaaggat

SEQ ID NO: 2296520 - DNA, 15 bp, Homo sapiens
aagaaagtctatgct

SEQ ID NO: 2296521 - DNA, 16 bp, Homo sapiens
aagaaagtctatgctt

SEQ ID NO: 2296522 - DNA, 23 bp, Homo sapiens
aagaaatgagaaattgtgccaaa

SEQ ID NO: 2296523 - DNA, 13 bp, Homo sapiens
aagaaatgctaat

SEQ ID NO: 2296524 - DNA, 16 bp, Homo sapiens
aagaaatgctaatgta

SEQ ID NO: 2296525 - DNA, 13 bp, Homo sapiens
aagaacccttctc

SEQ ID NO: 2296526 - DNA, 12 bp, Homo sapiens
aagaagaatata

SEQ ID NO: 2296527 - DNA, 16 bp, Homo sapiens
aagaagcgaacaaaaa

SEQ ID NO: 2296528 - DNA, 13 bp, Homo sapiens
aagaaggaaagaa

SEQ ID NO: 2296529 - DNA, 15 bp, Homo sapiens
aagaagggaaattca

SEQ ID NO: 2296530 - DNA, 19 bp, Homo sapiens
aagaagggaaattcacact

SEQ ID NO: 2296531 - DNA, 21 bp, Homo sapiens
aagaagggaaattcacactgt

SEQ ID NO: 2296532 - DNA, 17 bp, Homo sapiens
aagaagtcaaatgaatg

SEQ ID NO: 2296533 - DNA, 17 bp, Homo sapiens
aagaataaataaagaag

SEQ ID NO: 2296534 - DNA, 13 bp, Homo sapiens
aagaataatttta

SEQ ID NO: 2296535 - DNA, 14 bp, Homo sapiens
aagaataattttaa

SEQ ID NO: 2296536 - DNA, 15 bp, Homo sapiens
aagaatagcttatct

SEQ ID NO: 2296537 - DNA, 13 bp, Homo sapiens
aagaatataaata

SEQ ID NO: 2296538 - DNA, 12 bp, Homo sapiens
aagaatattgtt

SEQ ID NO: 2296539 - DNA, 15 bp, Homo sapiens
aagaatgaaaacaat

SEQ ID NO: 2296540 - DNA, 24 bp, Homo sapiens
aagacactgtcaatgaggttatga

SEQ ID NO: 2296541 - DNA, 19 bp, Homo sapiens
aagactgattttaaaactt

SEQ ID NO: 2296542 - DNA, 21 bp, Homo sapiens
aagacttaatcatatcaactt

SEQ ID NO: 2296543 - DNA, 22 bp, Homo sapiens
aagagaaaatgctttctcatgc

SEQ ID NO: 2296544 - DNA, 18 bp, Homo sapiens
aagagaaacactaatggc

SEQ ID NO: 2296545 - DNA, 19 bp, Homo sapiens
aagagatgaggaaataaga

SEQ ID NO: 2296546 - DNA, 17 bp, Homo sapiens
aagagatgtcaaaatgt

SEQ ID NO: 2296547 - DNA, 17 bp, Homo sapiens
aagaggggtataggaca

SEQ ID NO: 2296548 - DNA, 18 bp, Homo sapiens
aagaggtactaaaaacac

SEQ ID NO: 2296549 - DNA, 19 bp, Homo sapiens
aagaggtactaaaaacact

SEQ ID NO: 2296550 - DNA, 21 bp, Homo sapiens
aagataaaaactgcccattgt

SEQ ID NO: 2296551 - DNA, 13 bp, Homo sapiens
aagataaatgctt

SEQ ID NO: 2296552 - DNA, 23 bp, Homo sapiens
aagatactgtatatgtcaaaaat

SEQ ID NO: 2296553 - DNA, 20 bp, Homo sapiens
aagatagcagaagagtagat

SEQ ID NO: 2296554 - DNA, 15 bp, Homo sapiens
aagatagtttattat

SEQ ID NO: 2296555 - DNA, 13 bp, Homo sapiens
aagatcacaaata

SEQ ID NO: 2296556 - DNA, 16 bp, Homo sapiens
aagatcacaaatagtg

SEQ ID NO: 2296557 - DNA, 21 bp, Homo sapiens
aagatggttcaaagatacaag

SEQ ID NO: 2296558 - DNA, 14 bp, Homo sapiens
aagatgtgacatgt

SEQ ID NO: 2296559 - DNA, 18 bp, Homo sapiens
aagattaaaattagtgag

SEQ ID NO: 2296560 - DNA, 20 bp, Homo sapiens
aagattatatacaaagctgt

SEQ ID NO: 2296561 - DNA, 18 bp, Homo sapiens
aagattctaaaacattct

SEQ ID NO: 2296562 - DNA, 16 bp, Homo sapiens
aagcacacttgacatc

SEQ ID NO: 2296563 - DNA, 15 bp, Homo sapiens
aagcagggcagcagg

SEQ ID NO: 2296564 - DNA, 22 bp, Homo sapiens
aagcagggcagcagggaacaaa

SEQ ID NO: 2296565 - DNA, 20 bp, Homo sapiens
aagcagtgcatgctgtccct

SEQ ID NO: 2296566 - DNA, 21 bp, Homo sapiens
aagcattctgtgcataaaagt

SEQ ID NO: 2296567 - DNA, 21 bp, Homo sapiens
aagcattttactgtctgtaag

SEQ ID NO: 2296568 - DNA, 22 bp, Homo sapiens
aagcattttactgtctgtaaga

SEQ ID NO: 2296569 - DNA, 23 bp, Homo sapiens
aagccaaccactttcacctggga

SEQ ID NO: 2296570 - DNA, 19 bp, Homo sapiens
aagccacgttgcagaaaaa

SEQ ID NO: 2296571 - DNA, 12 bp, Homo sapiens
aagcccaacctc

SEQ ID NO: 2296572 - DNA, 12 bp, Homo sapiens
aatagttttcta

SEQ ID NO: 2296573 - DNA, 16 bp, Homo sapiens
aatagttttctaaatg

SEQ ID NO: 2296574 - DNA, 18 bp, Homo sapiens
aatagttttctaaatgtt

SEQ ID NO: 2296575 - DNA, 13 bp, Homo sapiens
aatataaaataca

SEQ ID NO: 2296576 - DNA, 14 bp, Homo sapiens
aatataaaatacat

SEQ ID NO: 2296577 - DNA, 15 bp, Homo sapiens
aatataaaatacata

SEQ ID NO: 2296578 - DNA, 18 bp, Homo sapiens
aatataaaatacataaaa

SEQ ID NO: 2296579 - DNA, 15 bp, Homo sapiens
aatatacaaacatgt

SEQ ID NO: 2296580 - DNA, 17 bp, Homo sapiens
aatatactaaccatttc

SEQ ID NO: 2296581 - DNA, 22 bp, Homo sapiens
aatatactaaccatttcttatg

SEQ ID NO: 2296582 - DNA, 13 bp, Homo sapiens
aatatagttgaac

SEQ ID NO: 2296583 - DNA, 13 bp, Homo sapiens
aatatataaacga

SEQ ID NO: 2296584 - DNA, 19 bp, Homo sapiens
aatatataatcaaatgatt

SEQ ID NO: 2296585 - DNA, 23 bp, Homo sapiens
aatatatatatatatcagtttga

SEQ ID NO: 2296586 - DNA, 19 bp, Homo sapiens
aatatatttgtaggtatac

SEQ ID NO: 2296587 - DNA, 18 bp, Homo sapiens
aatatatttttaaagcaa

SEQ ID NO: 2296588 - DNA, 16 bp, Homo sapiens
aatatccaatgaagaa

SEQ ID NO: 2296589 - DNA, 23 bp, Homo sapiens
aatatcctatactggttatagtt

SEQ ID NO: 2296590 - DNA, 13 bp, Homo sapiens
aatatcctcaatt

SEQ ID NO: 2296591 - DNA, 13 bp, Homo sapiens
aatatcttgaaga

SEQ ID NO: 2296592 - DNA, 21 bp, Homo sapiens
aatatgaaagcctagtccaga

SEQ ID NO: 2296593 - DNA, 17 bp, Homo sapiens
aatatgacctaaatcca

SEQ ID NO: 2296594 - DNA, 15 bp, Homo sapiens
aatatgcaacctgtg

SEQ ID NO: 2296595 - DNA, 16 bp, Homo sapiens
aatatgtaacatgtct

SEQ ID NO: 2296596 - DNA, 18 bp, Homo sapiens
aatatgtacttttccatt

SEQ ID NO: 2296597 - DNA, 15 bp, Homo sapiens
aatattaatatgtac

SEQ ID NO: 2296598 - DNA, 13 bp, Homo sapiens
aatattacatttc

SEQ ID NO: 2296599 - DNA, 15 bp, Homo sapiens
aatattacatttcat

SEQ ID NO: 2296600 - DNA, 16 bp, Homo sapiens
aatattacatttcatt

SEQ ID NO: 2296601 - DNA, 17 bp, Homo sapiens
aatattacatttcattt

SEQ ID NO: 2296602 - DNA, 21 bp, Homo sapiens
aatattacatttcatttatac

SEQ ID NO: 2296603 - DNA, 14 bp, Homo sapiens
aatattctaaaaaa

SEQ ID NO: 2296604 - DNA, 23 bp, Homo sapiens
aatattgctattgtttataggaa

SEQ ID NO: 2296605 - DNA, 11 bp, Homo sapiens
aatattgctga

SEQ ID NO: 2296606 - DNA, 20 bp, Homo sapiens
aatatttcaataacttagaa

SEQ ID NO: 2296607 - DNA, 18 bp, Homo sapiens
aatatttttttctagcta

SEQ ID NO: 2296608 - DNA, 19 bp, Homo sapiens
aatatttttttctagctat

SEQ ID NO: 2296609 - DNA, 15 bp, Homo sapiens
aatcaaaagctgaaa

SEQ ID NO: 2296610 - DNA, 16 bp, Homo sapiens
aatcaaagacatttca

SEQ ID NO: 2296611 - DNA, 16 bp, Homo sapiens
aatcaatttaaaggaa

SEQ ID NO: 2296612 - DNA, 14 bp, Homo sapiens
aatcaccgaaaacg

SEQ ID NO: 2296613 - DNA, 15 bp, Homo sapiens
aatcaccgaaaacgt

SEQ ID NO: 2296614 - DNA, 20 bp, Homo sapiens
aatcagcacagataaaaagt

SEQ ID NO: 2296615 - DNA, 12 bp, Homo sapiens
aatcattcaaaa

SEQ ID NO: 2296616 - DNA, 14 bp, Homo sapiens
aatcatttatctta

SEQ ID NO: 2296617 - DNA, 17 bp, Homo sapiens
aatcatttatcttatct

SEQ ID NO: 2296618 - DNA, 16 bp, Homo sapiens
aatccaattaatgatt

SEQ ID NO: 2296619 - DNA, 13 bp, Homo sapiens
aatccattttcta

SEQ ID NO: 2296620 - DNA, 19 bp, Homo sapiens
aatccattttctaaactgt

SEQ ID NO: 2296621 - DNA, 17 bp, Homo sapiens
aatcctctatgtggttg

SEQ ID NO: 2296622 - DNA, 12 bp, Homo sapiens
aatcctttgtac

SEQ ID NO: 2296623 - DNA, 15 bp, Homo sapiens
aatctagtatttgta

SEQ ID NO: 2296624 - DNA, 23 bp, Homo sapiens
aatctagtatttgtatcctggca

SEQ ID NO: 2296625 - DNA, 13 bp, Homo sapiens
aatctattttcta

SEQ ID NO: 2296626 - DNA, 13 bp, Homo sapiens
aatctctttccat

SEQ ID NO: 2296627 - DNA, 17 bp, Homo sapiens
aatctgtctgattctat

SEQ ID NO: 2296628 - DNA, 15 bp, Homo sapiens
aatctgtttctatgt

SEQ ID NO: 2296629 - DNA, 13 bp, Homo sapiens
aatctttcagaat

SEQ ID NO: 2296630 - DNA, 13 bp, Homo sapiens
aatgaaaacaata

SEQ ID NO: 2296631 - DNA, 17 bp, Homo sapiens
aatgaaacctgtgtctc

SEQ ID NO: 2296632 - DNA, 15 bp, Homo sapiens
aatgaaatatttgct

SEQ ID NO: 2296633 - DNA, 16 bp, Homo sapiens
aatgaactgtatatta

SEQ ID NO: 2296634 - DNA, 20 bp, Homo sapiens
aatgaactgtatattattgc

SEQ ID NO: 2296635 - DNA, 14 bp, Homo sapiens
aatgaagataaatg

SEQ ID NO: 2296636 - DNA, 16 bp, Homo sapiens
aatgaagataaatgct

SEQ ID NO: 2296637 - DNA, 19 bp, Homo sapiens
aatgaagataaatgcttta

SEQ ID NO: 2296638 - DNA, 22 bp, Homo sapiens
aatgaagataaatgctttaaat

SEQ ID NO: 2296639 - DNA, 23 bp, Homo sapiens
aatgaaggctgaatcaaagacat

SEQ ID NO: 2296640 - DNA, 14 bp, Homo sapiens
aatgaatgtcagtg

SEQ ID NO: 2296641 - DNA, 22 bp, Homo sapiens
aatgaatgtcagtgtgactgat

SEQ ID NO: 2296642 - DNA, 17 bp, Homo sapiens
aatgacataccttgctt

SEQ ID NO: 2296643 - DNA, 16 bp, Homo sapiens
aatgacctttcaatag

SEQ ID NO: 2296644 - DNA, 18 bp, Homo sapiens
aatgacctttcaatagga

SEQ ID NO: 2296645 - DNA, 20 bp, Homo sapiens
aatgacctttcaataggaaa

SEQ ID NO: 2296646 - DNA, 21 bp, Homo sapiens
aatgacctttcaataggaaaa

SEQ ID NO: 2296647 - DNA, 12 bp, Homo sapiens
aatgagaaatca

SEQ ID NO: 2296648 - DNA, 19 bp, Homo sapiens
aatgagaaattgtgccaaa

SEQ ID NO: 2296649 - DNA, 13 bp, Homo sapiens
aatgagcattttt

SEQ ID NO: 2296650 - DNA, 14 bp, Homo sapiens
aatgagggaaacaa

SEQ ID NO: 2296651 - DNA, 15 bp, Homo sapiens
aatgaggttatgaga

SEQ ID NO: 2296652 - DNA, 18 bp, Homo sapiens
aatgaggttatgagaaaa

SEQ ID NO: 2296653 - DNA, 19 bp, Homo sapiens
aatgaggttatgagaaaaa

SEQ ID NO: 2296654 - DNA, 21 bp, Homo sapiens
aatgaggttatgagaaaaaaa

SEQ ID NO: 2296655 - DNA, 12 bp, Homo sapiens
aatgagttacct

SEQ ID NO: 2296656 - DNA, 18 bp, Homo sapiens
aatgagtttaaaaaaata

SEQ ID NO: 2296657 - DNA, 17 bp, Homo sapiens
aatgatactgaattgtt

SEQ ID NO: 2296658 - DNA, 14 bp, Homo sapiens
aatgatcttccaaa

SEQ ID NO: 2296659 - DNA, 19 bp, Homo sapiens
aatgatcttccaaatatta

SEQ ID NO: 2296660 - DNA, 12 bp, Homo sapiens
aatgattaatta

SEQ ID NO: 2296661 - DNA, 13 bp, Homo sapiens
aatgattaattaa

SEQ ID NO: 2296662 - DNA, 15 bp, Homo sapiens
aatgattcaatgtga

SEQ ID NO: 2296663 - DNA, 16 bp, Homo sapiens
aatgattcaatgtgaa

SEQ ID NO: 2296664 - DNA, 18 bp, Homo sapiens
aatgattgtttaattgta

SEQ ID NO: 2296665 - DNA, 18 bp, Homo sapiens
aatgatttaagcatttta

SEQ ID NO: 2296666 - DNA, 20 bp, Homo sapiens
aatgatttaagcattttact

SEQ ID NO: 2296667 - DNA, 18 bp, Homo sapiens
aatgcaaacactgtgtat

SEQ ID NO: 2296668 - DNA, 14 bp, Homo sapiens
aatgcaaaccatca

SEQ ID NO: 2296669 - DNA, 16 bp, Homo sapiens
aatgcaaatattgcta

SEQ ID NO: 2296670 - DNA, 12 bp, Homo sapiens
aatgcaattaga

SEQ ID NO: 2296671 - DNA, 24 bp, Homo sapiens
aatgcacatttgtcactgaataat

SEQ ID NO: 2296672 - DNA, 18 bp, Homo sapiens
aatgcacgtttcaaagct

SEQ ID NO: 2296673 - DNA, 21 bp, Homo sapiens
aatgcagtccagtgagaaatt

SEQ ID NO: 2296674 - DNA, 24 bp, Homo sapiens
aatgcatgatgactcttcttatca

SEQ ID NO: 2296675 - DNA, 11 bp, Homo sapiens
aatgcatgtgt

SEQ ID NO: 2296676 - DNA, 21 bp, Homo sapiens
aatgcattattttgtcataaa

SEQ ID NO: 2296677 - DNA, 22 bp, Homo sapiens
aatgcattattttgtcataaaa

SEQ ID NO: 2296678 - DNA, 21 bp, Homo sapiens
aatgcccaacagggcaaccaa

SEQ ID NO: 2296679 - DNA, 13 bp, Homo sapiens
aatgcctttcaaa

SEQ ID NO: 2296680 - DNA, 16 bp, Homo sapiens
aatgcctttcaaacat

SEQ ID NO: 2296681 - DNA, 18 bp, Homo sapiens
aatgcctttcaaacattg

SEQ ID NO: 2296682 - DNA, 14 bp, Homo sapiens
aatgctatggaaat

SEQ ID NO: 2296683 - DNA, 20 bp, Homo sapiens
aatgctatggaaatacattt

SEQ ID NO: 2296684 - DNA, 22 bp, Homo sapiens
aatgctatggaaatacatttag

SEQ ID NO: 2296685 - DNA, 17 bp, Homo sapiens
aatgctttaaatagttt

SEQ ID NO: 2296686 - DNA, 11 bp, Homo sapiens
aatgctttctc

SEQ ID NO: 2296687 - DNA, 12 bp, Homo sapiens
aatgctttctca

SEQ ID NO: 2296688 - DNA, 14 bp, Homo sapiens
aatgctttctcatg

SEQ ID NO: 2296689 - DNA, 14 bp, Homo sapiens
aatgcttttctagc

SEQ ID NO: 2296690 - DNA, 17 bp, Homo sapiens
aatggaagcactgccat

SEQ ID NO: 2296691 - DNA, 20 bp, Homo sapiens
aatggacctatctgtaagag

SEQ ID NO: 2296692 - DNA, 19 bp, Homo sapiens
aatggatatgaaagagaaa

SEQ ID NO: 2296693 - DNA, 14 bp, Homo sapiens
aatggccaagtgta

SEQ ID NO: 2296694 - DNA, 21 bp, Homo sapiens
aatgggctgctgtcattttat

SEQ ID NO: 2296695 - DNA, 17 bp, Homo sapiens
aatggggactctccagg

SEQ ID NO: 2296696 - DNA, 18 bp, Homo sapiens
aatggggactctccaggc

SEQ ID NO: 2296697 - DNA, 19 bp, Homo sapiens
aatgggggtatcctgtgca

SEQ ID NO: 2296698 - DNA, 14 bp, Homo sapiens
aatgtaaaattcat

SEQ ID NO: 2296699 - DNA, 15 bp, Homo sapiens
aatgtaaaattcata

SEQ ID NO: 2296700 - DNA, 17 bp, Homo sapiens
aatgtaaaattcatagc

SEQ ID NO: 2296701 - DNA, 15 bp, Homo sapiens
aatgtacagaaaata

SEQ ID NO: 2296702 - DNA, 18 bp, Homo sapiens
aatgtacagaaaatagct

SEQ ID NO: 2296703 - DNA, 22 bp, Homo sapiens
aatgtacagaaaatagctttta

SEQ ID NO: 2296704 - DNA, 18 bp, Homo sapiens
aatgtagttgatgtatcc

SEQ ID NO: 2296705 - DNA, 16 bp, Homo sapiens
aatgtatcttatttat

SEQ ID NO: 2296706 - DNA, 15 bp, Homo sapiens
acacggaccctgtgt

SEQ ID NO: 2296707 - DNA, 14 bp, Homo sapiens
acacggcctctggg

SEQ ID NO: 2296708 - DNA, 16 bp, Homo sapiens
acactaaaatttaaat

SEQ ID NO: 2296709 - DNA, 23 bp, Homo sapiens
acactaaaatttaaatcagacta

SEQ ID NO: 2296710 - DNA, 14 bp, Homo sapiens
acactaaagagcta

SEQ ID NO: 2296711 - DNA, 21 bp, Homo sapiens
acactaaagagctaggaaaga

SEQ ID NO: 2296712 - DNA, 15 bp, Homo sapiens
acactagccaaggaa

SEQ ID NO: 2296713 - DNA, 15 bp, Homo sapiens
acactcactgcctgc

SEQ ID NO: 2296714 - DNA, 18 bp, Homo sapiens
acactcactgcctgcagc

SEQ ID NO: 2296715 - DNA, 20 bp, Homo sapiens
acactcagtgggccaattgt

SEQ ID NO: 2296716 - DNA, 11 bp, Homo sapiens
acactctgaga

SEQ ID NO: 2296717 - DNA, 13 bp, Homo sapiens
acactctgagact

SEQ ID NO: 2296718 - DNA, 13 bp, Homo sapiens
acactgaaatcca

SEQ ID NO: 2296719 - DNA, 16 bp, Homo sapiens
acactgatgggtcctg

SEQ ID NO: 2296720 - DNA, 20 bp, Homo sapiens
acactgatgggtcctgctgc

SEQ ID NO: 2296721 - DNA, 20 bp, Homo sapiens
acactgcaatcatatgtgat

SEQ ID NO: 2296722 - DNA, 14 bp, Homo sapiens
acactgcttaagga

SEQ ID NO: 2296723 - DNA, 15 bp, Homo sapiens
acactggctttacat

SEQ ID NO: 2296724 - DNA, 14 bp, Homo sapiens
acactgtatctaaa

SEQ ID NO: 2296725 - DNA, 21 bp, Homo sapiens
acactgtggaacactaaagag

SEQ ID NO: 2296726 - DNA, 23 bp, Homo sapiens
acactgttaatcatgggttcctc

SEQ ID NO: 2296727 - DNA, 13 bp, Homo sapiens
acacttaactaaa

SEQ ID NO: 2296728 - DNA, 17 bp, Homo sapiens
acacttattttctgaat

SEQ ID NO: 2296729 - DNA, 18 bp, Homo sapiens
acacttgcaaatgaatgc

SEQ ID NO: 2296730 - DNA, 19 bp, Homo sapiens
acagaaaatagcttttatt

SEQ ID NO: 2296731 - DNA, 16 bp, Homo sapiens
acagaaacaactgcca

SEQ ID NO: 2296732 - DNA, 14 bp, Homo sapiens
acagaaatttctcc

SEQ ID NO: 2296733 - DNA, 14 bp, Homo sapiens
acagaacaggaggt

SEQ ID NO: 2296734 - DNA, 14 bp, Homo sapiens
acagaaccagcact

SEQ ID NO: 2296735 - DNA, 23 bp, Homo sapiens
acagaatgggggtatcctgtgca

SEQ ID NO: 2296736 - DNA, 13 bp, Homo sapiens
acagacaaagcgt

SEQ ID NO: 2296737 - DNA, 14 bp, Homo sapiens
acagacaaagcgtg

SEQ ID NO: 2296738 - DNA, 16 bp, Homo sapiens
acagaccagcatagtt

SEQ ID NO: 2296739 - DNA, 18 bp, Homo sapiens
acagacctccagattatt

SEQ ID NO: 2296740 - DNA, 22 bp, Homo sapiens
acagacctccagattattttct

SEQ ID NO: 2296741 - DNA, 18 bp, Homo sapiens
acagacggacgggacagc

SEQ ID NO: 2296742 - DNA, 17 bp, Homo sapiens
acagagatgaacaactt

SEQ ID NO: 2296743 - DNA, 14 bp, Homo sapiens
acagagcaagcgaa

SEQ ID NO: 2296744 - DNA, 15 bp, Homo sapiens
acagagcaagcgaaa

SEQ ID NO: 2296745 - DNA, 19 bp, Homo sapiens
acagagccctatctatgtc

SEQ ID NO: 2296746 - DNA, 20 bp, Homo sapiens
acagagccctatctatgtcc

SEQ ID NO: 2296747 - DNA, 14 bp, Homo sapiens
acagaggaccagca

SEQ ID NO: 2296748 - DNA, 16 bp, Homo sapiens
acagagtccgggagaa

SEQ ID NO: 2296749 - DNA, 12 bp, Homo sapiens
acagatatttaa

SEQ ID NO: 2296750 - DNA, 12 bp, Homo sapiens
acagatccatcc

SEQ ID NO: 2296751 - DNA, 21 bp, Homo sapiens
acagatgagaagactagcagc

SEQ ID NO: 2296752 - DNA, 19 bp, Homo sapiens
acagatgggtgtcccctgg

SEQ ID NO: 2296753 - DNA, 15 bp, Homo sapiens
acagattcagtcttg

SEQ ID NO: 2296754 - DNA, 19 bp, Homo sapiens
acagattcagtcttgcctt

SEQ ID NO: 2296755 - DNA, 10 bp, Homo sapiens
acagcagctc

SEQ ID NO: 2296756 - DNA, 14 bp, Homo sapiens
acagcagctccaac

SEQ ID NO: 2296757 - DNA, 19 bp, Homo sapiens
acagcagctccaacctgga

SEQ ID NO: 2296758 - DNA, 13 bp, Homo sapiens
acagcagctggac

SEQ ID NO: 2296759 - DNA, 21 bp, Homo sapiens
acagcataaatctgttagcat

SEQ ID NO: 2296760 - DNA, 18 bp, Homo sapiens
acagcatgagattgtaca

SEQ ID NO: 2296761 - DNA, 21 bp, Homo sapiens
acagcatgagattgtacattt

SEQ ID NO: 2296762 - DNA, 22 bp, Homo sapiens
acagccccttgcttctaaggga

SEQ ID NO: 2296763 - DNA, 12 bp, Homo sapiens
acagcctcttcc

SEQ ID NO: 2296764 - DNA, 20 bp, Homo sapiens
acagcctttgcgctctgggt

SEQ ID NO: 2296765 - DNA, 16 bp, Homo sapiens
acagcggcccggccca

SEQ ID NO: 2296766 - DNA, 18 bp, Homo sapiens
acagcggcccggcccacg

SEQ ID NO: 2296767 - DNA, 22 bp, Homo sapiens
acagctgactgaatgcagaacg

SEQ ID NO: 2296768 - DNA, 20 bp, Homo sapiens
acagctgtgaggacagacag

SEQ ID NO: 2296769 - DNA, 21 bp, Homo sapiens
acagctgtgaggacagacaga

SEQ ID NO: 2296770 - DNA, 18 bp, Homo sapiens
acagcttgaggaaagagc

SEQ ID NO: 2296771 - DNA, 14 bp, Homo sapiens
acaggaaatgcaaa

SEQ ID NO: 2296772 - DNA, 17 bp, Homo sapiens
acaggaacacccagccc

SEQ ID NO: 2296773 - DNA, 20 bp, Homo sapiens
acaggaacacccagccccag

SEQ ID NO: 2296774 - DNA, 18 bp, Homo sapiens
acaggaggtgtgaatgca

SEQ ID NO: 2296775 - DNA, 19 bp, Homo sapiens
acaggaggtgtgaatgcac

SEQ ID NO: 2296776 - DNA, 14 bp, Homo sapiens
acaggattctgaca

SEQ ID NO: 2296777 - DNA, 16 bp, Homo sapiens
acaggattctgacaga

SEQ ID NO: 2296778 - DNA, 16 bp, Homo sapiens
acaggcaacattacaa

SEQ ID NO: 2296779 - DNA, 17 bp, Homo sapiens
acaggcaacattacaaa

SEQ ID NO: 2296780 - DNA, 19 bp, Homo sapiens
acaggccagtagggggagg

SEQ ID NO: 2296781 - DNA, 20 bp, Homo sapiens
acaggctgccccacccctcc

SEQ ID NO: 2296782 - DNA, 19 bp, Homo sapiens
acaggcttcgtctcagaag

SEQ ID NO: 2296783 - DNA, 16 bp, Homo sapiens
acaggggctggagggc

SEQ ID NO: 2296784 - DNA, 21 bp, Homo sapiens
acaggtacatagctctcatgt

SEQ ID NO: 2296785 - DNA, 21 bp, Homo sapiens
acaggtcttctttaaggaaga

SEQ ID NO: 2296786 - DNA, 22 bp, Homo sapiens
acagtaactgagtgtggcggga

SEQ ID NO: 2296787 - DNA, 13 bp, Homo sapiens
acagtagctgtgg

SEQ ID NO: 2296788 - DNA, 19 bp, Homo sapiens
acagtagtgttgggtggag

SEQ ID NO: 2296789 - DNA, 18 bp, Homo sapiens
acagtccaaactgttctg

SEQ ID NO: 2296790 - DNA, 17 bp, Homo sapiens
acagtgattagcctcgt

SEQ ID NO: 2296791 - DNA, 15 bp, Homo sapiens
acagtggcaagctac

SEQ ID NO: 2296792 - DNA, 17 bp, Homo sapiens
acagtggcaagctacca

SEQ ID NO: 2296793 - DNA, 16 bp, Homo sapiens
acagtggggcccatgg

SEQ ID NO: 2296794 - DNA, 21 bp, Homo sapiens
acagtggggcccatggcccca

SEQ ID NO: 2296795 - DNA, 20 bp, Homo sapiens
acagtgtttggacaggaggg

SEQ ID NO: 2296796 - DNA, 16 bp, Homo sapiens
acagtttgtaaatgtt

SEQ ID NO: 2296797 - DNA, 16 bp, Homo sapiens
acataaacttgtactt

SEQ ID NO: 2296798 - DNA, 23 bp, Homo sapiens
acataaacttgtacttacactga

SEQ ID NO: 2296799 - DNA, 17 bp, Homo sapiens
acataaagaaacacttt

SEQ ID NO: 2296800 - DNA, 19 bp, Homo sapiens
acataaagaaacactttct

SEQ ID NO: 2296801 - DNA, 18 bp, Homo sapiens
acataaagtaataactgt

SEQ ID NO: 2296802 - DNA, 17 bp, Homo sapiens
acataaatctgtctgat

SEQ ID NO: 2296803 - DNA, 20 bp, Homo sapiens
acataaatctgtctgattct

SEQ ID NO: 2296804 - DNA, 22 bp, Homo sapiens
acataaatctgtctgattctat

SEQ ID NO: 2296805 - DNA, 22 bp, Homo sapiens
acataagctggtatcagtggtt

SEQ ID NO: 2296806 - DNA, 17 bp, Homo sapiens
acataatatcttgaaga

SEQ ID NO: 2296807 - DNA, 19 bp, Homo sapiens
acataatatcttgaagaat

SEQ ID NO: 2296808 - DNA, 22 bp, Homo sapiens
acataatatcttgaagaatatt

SEQ ID NO: 2296809 - DNA, 15 bp, Homo sapiens
acatacatctaagtc

SEQ ID NO: 2296810 - DNA, 21 bp, Homo sapiens
acatagatcctctgatataca

SEQ ID NO: 2296811 - DNA, 22 bp, Homo sapiens
acatagcacagtatttactgtg

SEQ ID NO: 2296812 - DNA, 22 bp, Homo sapiens
acatatttgtagctagaatatc

SEQ ID NO: 2296813 - DNA, 13 bp, Homo sapiens
acatccactctct

SEQ ID NO: 2296814 - DNA, 11 bp, Homo sapiens
acatcctgtga

SEQ ID NO: 2296815 - DNA, 14 bp, Homo sapiens
acatcggttcagga

SEQ ID NO: 2296816 - DNA, 21 bp, Homo sapiens
acatcggttcaggaggagaca

SEQ ID NO: 2296817 - DNA, 17 bp, Homo sapiens
acatctaagtcagtttc

SEQ ID NO: 2296818 - DNA, 22 bp, Homo sapiens
acatctaagtcagtttcacata

SEQ ID NO: 2296819 - DNA, 12 bp, Homo sapiens
acatctgtatat

SEQ ID NO: 2296820 - DNA, 22 bp, Homo sapiens
acatctgtatatcagctctaaa

SEQ ID NO: 2296821 - DNA, 11 bp, Homo sapiens
acatgaaagcg

SEQ ID NO: 2296822 - DNA, 17 bp, Homo sapiens
acatgactgaagggact

SEQ ID NO: 2296823 - DNA, 23 bp, Homo sapiens
acatgcacagctaacatggaagt

SEQ ID NO: 2296824 - DNA, 16 bp, Homo sapiens
acatgcactcagtgtg

SEQ ID NO: 2296825 - DNA, 20 bp, Homo sapiens
acatgcagaaattgacctga

SEQ ID NO: 2296826 - DNA, 21 bp, Homo sapiens
acatgcagaaattgacctgat

SEQ ID NO: 2296827 - DNA, 16 bp, Homo sapiens
acatgcatcctcccct

SEQ ID NO: 2296828 - DNA, 14 bp, Homo sapiens
acatggaagtacta

SEQ ID NO: 2296829 - DNA, 18 bp, Homo sapiens
acattacaaacaaaggat

SEQ ID NO: 2296830 - DNA, 13 bp, Homo sapiens
acattatcctgtg

SEQ ID NO: 2296831 - DNA, 12 bp, Homo sapiens
acattctgctgc

SEQ ID NO: 2296832 - DNA, 21 bp, Homo sapiens
acattctgctgcccccagacc

SEQ ID NO: 2296833 - DNA, 18 bp, Homo sapiens
acattctttaacatacat

SEQ ID NO: 2296834 - DNA, 22 bp, Homo sapiens
acattgagactgctagaaccaa

SEQ ID NO: 2296835 - DNA, 17 bp, Homo sapiens
acattgtgttttcctaa

SEQ ID NO: 2296836 - DNA, 22 bp, Homo sapiens
acattgttatgcacttttcccc

SEQ ID NO: 2296837 - DNA, 22 bp, Homo sapiens
acatttaaaatagttttctaaa

SEQ ID NO: 2296838 - DNA, 21 bp, Homo sapiens
acctggaggctggaccaactg

SEQ ID NO: 2296839 - DNA, 17 bp, Homo sapiens
acctgggagatgctggg

SEQ ID NO: 2296840 - DNA, 18 bp, Homo sapiens
acctggggtcccccctcc

SEQ ID NO: 2296841 - DNA, 17 bp, Homo sapiens
acctgtgcaaaataaaa

SEQ ID NO: 2296842 - DNA, 13 bp, Homo sapiens
acctgtgctttca

SEQ ID NO: 2296843 - DNA, 22 bp, Homo sapiens
acctgtgctttcatgtttaaga

SEQ ID NO: 2296844 - DNA, 20 bp, Homo sapiens
accttacttaaagcttgttt

SEQ ID NO: 2296845 - DNA, 16 bp, Homo sapiens
accttctatgttcata

SEQ ID NO: 2296846 - DNA, 15 bp, Homo sapiens
accttcttattatat

SEQ ID NO: 2296847 - DNA, 22 bp, Homo sapiens
acctttaaaaaataatttagat

SEQ ID NO: 2296848 - DNA, 21 bp, Homo sapiens
acctttcaataggaaaaactg

SEQ ID NO: 2296849 - DNA, 14 bp, Homo sapiens
accttttataagac

SEQ ID NO: 2296850 - DNA, 17 bp, Homo sapiens
accttttgagtgcctta

SEQ ID NO: 2296851 - DNA, 15 bp, Homo sapiens
acgacataagctggt

SEQ ID NO: 2296852 - DNA, 19 bp, Homo sapiens
acgacttatatatttgaaa

SEQ ID NO: 2296853 - DNA, 15 bp, Homo sapiens
acgaggccttcagaa

SEQ ID NO: 2296854 - DNA, 16 bp, Homo sapiens
acgaggccttcagaaa

SEQ ID NO: 2296855 - DNA, 21 bp, Homo sapiens
acgagttaatgatggcagagg

SEQ ID NO: 2296856 - DNA, 15 bp, Homo sapiens
acgatatatgtaaat

SEQ ID NO: 2296857 - DNA, 19 bp, Homo sapiens
acgatatatgtaaatatac

SEQ ID NO: 2296858 - DNA, 21 bp, Homo sapiens
acgcacttctggggccagccc

SEQ ID NO: 2296859 - DNA, 18 bp, Homo sapiens
acgcagagccccggagca

SEQ ID NO: 2296860 - DNA, 23 bp, Homo sapiens
acgcagccccccacgcttctgga

SEQ ID NO: 2296861 - DNA, 22 bp, Homo sapiens
acgccattgcactccagcctgg

SEQ ID NO: 2296862 - DNA, 14 bp, Homo sapiens
acgccctgtgtcca

SEQ ID NO: 2296863 - DNA, 18 bp, Homo sapiens
acgccggggctggccctg

SEQ ID NO: 2296864 - DNA, 19 bp, Homo sapiens
acgccggggctggccctgc

SEQ ID NO: 2296865 - DNA, 20 bp, Homo sapiens
acgccggggctggccctgcc

SEQ ID NO: 2296866 - DNA, 12 bp, Homo sapiens
acgctctctgtc

SEQ ID NO: 2296867 - DNA, 15 bp, Homo sapiens
acgctctctgtctgg

SEQ ID NO: 2296868 - DNA, 20 bp, Homo sapiens
acgctctctgtctggctgta

SEQ ID NO: 2296869 - DNA, 14 bp, Homo sapiens
acggacgggacagc

SEQ ID NO: 2296870 - DNA, 19 bp, Homo sapiens
acggaggtcctttggacag

SEQ ID NO: 2296871 - DNA, 17 bp, Homo sapiens
acggcaacccctgcagc

SEQ ID NO: 2296872 - DNA, 15 bp, Homo sapiens
acggcagccccatcc

SEQ ID NO: 2296873 - DNA, 14 bp, Homo sapiens
acgggacagcggcc

SEQ ID NO: 2296874 - DNA, 18 bp, Homo sapiens
acgggcaacactcactgc

SEQ ID NO: 2296875 - DNA, 22 bp, Homo sapiens
acgggcccgctcaacctctcag

SEQ ID NO: 2296876 - DNA, 23 bp, Homo sapiens
acgggcccgctcaacctctcaga

SEQ ID NO: 2296877 - DNA, 23 bp, Homo sapiens
acgggcggggctgtgcgggcgcc

SEQ ID NO: 2296878 - DNA, 14 bp, Homo sapiens
acggggcagagctg

SEQ ID NO: 2296879 - DNA, 17 bp, Homo sapiens
acggggccagcatccat

SEQ ID NO: 2296880 - DNA, 21 bp, Homo sapiens
acggggtcgggggaggagcac

SEQ ID NO: 2296881 - DNA, 12 bp, Homo sapiens
acgggtgtggct

SEQ ID NO: 2296882 - DNA, 18 bp, Homo sapiens
acgtctggtgttctcaat

SEQ ID NO: 2296883 - DNA, 13 bp, Homo sapiens
acgtggcacctcc

SEQ ID NO: 2296884 - DNA, 14 bp, Homo sapiens
acgtggctgcttca

SEQ ID NO: 2296885 - DNA, 18 bp, Homo sapiens
acgtggctgcttcaagga

SEQ ID NO: 2296886 - DNA, 15 bp, Homo sapiens
actaaaaatatgaaa

SEQ ID NO: 2296887 - DNA, 14 bp, Homo sapiens
actaaaatagttta

SEQ ID NO: 2296888 - DNA, 23 bp, Homo sapiens
actaaaatagtttaaaaatattc

SEQ ID NO: 2296889 - DNA, 14 bp, Homo sapiens
actaaaattcaaca

SEQ ID NO: 2296890 - DNA, 20 bp, Homo sapiens
actaaaattcaacaaatgat

SEQ ID NO: 2296891 - DNA, 22 bp, Homo sapiens
actaaaattcaacaaatgatgt

SEQ ID NO: 2296892 - DNA, 17 bp, Homo sapiens
actaaactaaaatagtt

SEQ ID NO: 2296893 - DNA, 16 bp, Homo sapiens
actaaataatgatctt

SEQ ID NO: 2296894 - DNA, 21 bp, Homo sapiens
actaaatttggggacagattc

SEQ ID NO: 2296895 - DNA, 21 bp, Homo sapiens
actaacataaagaaacacttt

SEQ ID NO: 2296896 - DNA, 13 bp, Homo sapiens
actaaccatttct

SEQ ID NO: 2296897 - DNA, 17 bp, Homo sapiens
actaagaggtgggagga

SEQ ID NO: 2296898 - DNA, 17 bp, Homo sapiens
actaaggacaggatggc

SEQ ID NO: 2296899 - DNA, 22 bp, Homo sapiens
actaagttgctaacctcaattt

SEQ ID NO: 2296900 - DNA, 24 bp, Homo sapiens
actaatggccaagtgtacatttga

SEQ ID NO: 2296901 - DNA, 14 bp, Homo sapiens
actacagcataaat

SEQ ID NO: 2296902 - DNA, 22 bp, Homo sapiens
actacataattaaattttaatg

SEQ ID NO: 2296903 - DNA, 21 bp, Homo sapiens
actacattaaaagctttagat

SEQ ID NO: 2296904 - DNA, 14 bp, Homo sapiens
actactaagaataa

SEQ ID NO: 2296905 - DNA, 14 bp, Homo sapiens
actagaatgagaaa

SEQ ID NO: 2296906 - DNA, 15 bp, Homo sapiens
actagactcaaggaa

SEQ ID NO: 2296907 - DNA, 19 bp, Homo sapiens
actagagactctgtgatct

SEQ ID NO: 2296908 - DNA, 13 bp, Homo sapiens
actagatctcctg

SEQ ID NO: 2296909 - DNA, 18 bp, Homo sapiens
actagatctcctgtaatt

SEQ ID NO: 2296910 - DNA, 16 bp, Homo sapiens
actagcaaacaaaaat

SEQ ID NO: 2296911 - DNA, 18 bp, Homo sapiens
actagcaaacaaaaatag

SEQ ID NO: 2296912 - DNA, 20 bp, Homo sapiens
actagcaaacaaaaatagaa

SEQ ID NO: 2296913 - DNA, 22 bp, Homo sapiens
actagtactgtgtactgtatag

SEQ ID NO: 2296914 - DNA, 15 bp, Homo sapiens
actagtgaaaaatct

SEQ ID NO: 2296915 - DNA, 15 bp, Homo sapiens
actatgtaagggctt

SEQ ID NO: 2296916 - DNA, 21 bp, Homo sapiens
actatgtaagggctttaaata

SEQ ID NO: 2296917 - DNA, 15 bp, Homo sapiens
actatgtgtcatgat

SEQ ID NO: 2296918 - DNA, 16 bp, Homo sapiens
actatgtgtcatgatt

SEQ ID NO: 2296919 - DNA, 19 bp, Homo sapiens
actatttagataacaagaa

SEQ ID NO: 2296920 - DNA, 15 bp, Homo sapiens
actatttcaataagt

SEQ ID NO: 2296921 - DNA, 19 bp, Homo sapiens
actcaaagaggccagtact

SEQ ID NO: 2296922 - DNA, 19 bp, Homo sapiens
actcaaggaagaataattt

SEQ ID NO: 2296923 - DNA, 15 bp, Homo sapiens
actcacaaaaggctg

SEQ ID NO: 2296924 - DNA, 16 bp, Homo sapiens
actcacattctgttgt

SEQ ID NO: 2296925 - DNA, 14 bp, Homo sapiens
actcagcaccactc

SEQ ID NO: 2296926 - DNA, 17 bp, Homo sapiens
actcagcaccactcaag

SEQ ID NO: 2296927 - DNA, 21 bp, Homo sapiens
actcagcaccactcaagacca

SEQ ID NO: 2296928 - DNA, 17 bp, Homo sapiens
actcagcctagcacagg

SEQ ID NO: 2296929 - DNA, 15 bp, Homo sapiens
actcaggcccacatt

SEQ ID NO: 2296930 - DNA, 14 bp, Homo sapiens
actcaggctttcta

SEQ ID NO: 2296931 - DNA, 15 bp, Homo sapiens
actcaggctttctat

SEQ ID NO: 2296932 - DNA, 19 bp, Homo sapiens
actcagtctcaaataataa

SEQ ID NO: 2296933 - DNA, 21 bp, Homo sapiens
actcagtgtggactgggaagc

SEQ ID NO: 2296934 - DNA, 17 bp, Homo sapiens
actccaaaaagaaatat

SEQ ID NO: 2296935 - DNA, 17 bp, Homo sapiens
actccaacatccactct

SEQ ID NO: 2296936 - DNA, 18 bp, Homo sapiens
actccaacatccactctc

SEQ ID NO: 2296937 - DNA, 17 bp, Homo sapiens
actccacctcttccttt

SEQ ID NO: 2296938 - DNA, 11 bp, Homo sapiens
actcccagggc

SEQ ID NO: 2296939 - DNA, 13 bp, Homo sapiens
actcccagggccc

SEQ ID NO: 2296940 - DNA, 14 bp, Homo sapiens
actccccctccccg

SEQ ID NO: 2296941 - DNA, 22 bp, Homo sapiens
actccccgcccgccctcctctg

SEQ ID NO: 2296942 - DNA, 19 bp, Homo sapiens
actccccgccgtacagttc

SEQ ID NO: 2296943 - DNA, 21 bp, Homo sapiens
actcccgagacggcactgaga

SEQ ID NO: 2296944 - DNA, 20 bp, Homo sapiens
actccgactccccctccccg

SEQ ID NO: 2296945 - DNA, 12 bp, Homo sapiens
actcctgccccg

SEQ ID NO: 2296946 - DNA, 20 bp, Homo sapiens
actcgggctaagtccagctc

SEQ ID NO: 2296947 - DNA, 21 bp, Homo sapiens
actcgggctaagtccagctct

SEQ ID NO: 2296948 - DNA, 22 bp, Homo sapiens
actctattttttactacataat

SEQ ID NO: 2296949 - DNA, 11 bp, Homo sapiens
actctccaggg

SEQ ID NO: 2296950 - DNA, 16 bp, Homo sapiens
actctccttggtgtcg

SEQ ID NO: 2296951 - DNA, 18 bp, Homo sapiens
actctgccttccaggcgt

SEQ ID NO: 2296952 - DNA, 16 bp, Homo sapiens
actctgctcagggccg

SEQ ID NO: 2296953 - DNA, 16 bp, Homo sapiens
actctgggaagaatgt

SEQ ID NO: 2296954 - DNA, 20 bp, Homo sapiens
actctgtgatctaagcagtt

SEQ ID NO: 2296955 - DNA, 21 bp, Homo sapiens
actctgtgtaatctctgatta

SEQ ID NO: 2296956 - DNA, 13 bp, Homo sapiens
actcttggcctca

SEQ ID NO: 2296957 - DNA, 16 bp, Homo sapiens
actcttggcctcaagc

SEQ ID NO: 2296958 - DNA, 20 bp, Homo sapiens
actgaaaaagaatgaaaaca

SEQ ID NO: 2296959 - DNA, 22 bp, Homo sapiens
actgaaaaagaatgaaaacaat

SEQ ID NO: 2296960 - DNA, 18 bp, Homo sapiens
actgaaacctctgttctc

SEQ ID NO: 2296961 - DNA, 15 bp, Homo sapiens
actgaaaggactgtg

SEQ ID NO: 2296962 - DNA, 19 bp, Homo sapiens
actgaaattgtttaaaagc

SEQ ID NO: 2296963 - DNA, 11 bp, Homo sapiens
actgaatgcag

SEQ ID NO: 2296964 - DNA, 22 bp, Homo sapiens
actgaattgtcagatgtggagt

SEQ ID NO: 2296965 - DNA, 15 bp, Homo sapiens
actgagatgttaaaa

SEQ ID NO: 2296966 - DNA, 19 bp, Homo sapiens
actgatatcacgggcccgc

SEQ ID NO: 2296967 - DNA, 22 bp, Homo sapiens
actgatatcacgggcccgctca

SEQ ID NO: 2296968 - DNA, 13 bp, Homo sapiens
actgatcttcctt

SEQ ID NO: 2296969 - DNA, 19 bp, Homo sapiens
actgatgatagacttcgaa

SEQ ID NO: 2296970 - DNA, 22 bp, Homo sapiens
agaaagggagaaggattctttt

SEQ ID NO: 2296971 - DNA, 14 bp, Homo sapiens
agaaagtaggagtg

SEQ ID NO: 2296972 - DNA, 13 bp, Homo sapiens
agaaagtctatgc

SEQ ID NO: 2296973 - DNA, 15 bp, Homo sapiens
agaaagtctatgctt

SEQ ID NO: 2296974 - DNA, 17 bp, Homo sapiens
agaaatattaatatgta

SEQ ID NO: 2296975 - DNA, 18 bp, Homo sapiens
agaaatattaatatgtac

SEQ ID NO: 2296976 - DNA, 12 bp, Homo sapiens
agaaatcatgtt

SEQ ID NO: 2296977 - DNA, 16 bp, Homo sapiens
agaaatgagaaattgt

SEQ ID NO: 2296978 - DNA, 12 bp, Homo sapiens
agaaatgctaat

SEQ ID NO: 2296979 - DNA, 23 bp, Homo sapiens
agaaattgacctgatttccattt

SEQ ID NO: 2296980 - DNA, 22 bp, Homo sapiens
agaaattggtattatcaaagca

SEQ ID NO: 2296981 - DNA, 18 bp, Homo sapiens
agaaattgtgccaaagat

SEQ ID NO: 2296982 - DNA, 19 bp, Homo sapiens
agaaattgtgccaaagata

SEQ ID NO: 2296983 - DNA, 16 bp, Homo sapiens
agaaattttctacagt

SEQ ID NO: 2296984 - DNA, 15 bp, Homo sapiens
agaacaaacctctat

SEQ ID NO: 2296985 - DNA, 17 bp, Homo sapiens
agaacaaggaattgctt

SEQ ID NO: 2296986 - DNA, 20 bp, Homo sapiens
agaacagcaagtatgaacca

SEQ ID NO: 2296987 - DNA, 18 bp, Homo sapiens
agaacaggaggtgtgaat

SEQ ID NO: 2296988 - DNA, 18 bp, Homo sapiens
agaacagggtttctcagc

SEQ ID NO: 2296989 - DNA, 19 bp, Homo sapiens
agaaccagcactcccaggg

SEQ ID NO: 2296990 - DNA, 20 bp, Homo sapiens
agaacctgcatttaagaaca

SEQ ID NO: 2296991 - DNA, 22 bp, Homo sapiens
agaacctgcatttaagaacaga

SEQ ID NO: 2296992 - DNA, 19 bp, Homo sapiens
agaaccttttgagtgcctt

SEQ ID NO: 2296993 - DNA, 12 bp, Homo sapiens
agaacgccctgt

SEQ ID NO: 2296994 - DNA, 14 bp, Homo sapiens
agaacgccctgtgt

SEQ ID NO: 2296995 - DNA, 15 bp, Homo sapiens
agaacgccctgtgtc

SEQ ID NO: 2296996 - DNA, 17 bp, Homo sapiens
agaacgccctgtgtcca

SEQ ID NO: 2296997 - DNA, 13 bp, Homo sapiens
agaacgggcctcc

SEQ ID NO: 2296998 - DNA, 23 bp, Homo sapiens
agaacggtttttggatctggcat

SEQ ID NO: 2296999 - DNA, 17 bp, Homo sapiens
agaactcctttctaagg

SEQ ID NO: 2297000 - DNA, 22 bp, Homo sapiens
agaactgtggcacttaggggag

SEQ ID NO: 2297001 - DNA, 17 bp, Homo sapiens
agaactgttcatttcca

SEQ ID NO: 2297002 - DNA, 16 bp, Homo sapiens
agaagaaagtctatgc

SEQ ID NO: 2297003 - DNA, 13 bp, Homo sapiens
agaagaatataaa

SEQ ID NO: 2297004 - DNA, 15 bp, Homo sapiens
agaagactagcagct

SEQ ID NO: 2297005 - DNA, 21 bp, Homo sapiens
agaagaggttcatttttctgg

SEQ ID NO: 2297006 - DNA, 19 bp, Homo sapiens
agaagcctcatgggagtca

SEQ ID NO: 2297007 - DNA, 14 bp, Homo sapiens
agaagcctgtttca

SEQ ID NO: 2297008 - DNA, 15 bp, Homo sapiens
agaaggagacagaat

SEQ ID NO: 2297009 - DNA, 14 bp, Homo sapiens
agaaggatacaagg

SEQ ID NO: 2297010 - DNA, 19 bp, Homo sapiens
agaaggattcttttttcaa

SEQ ID NO: 2297011 - DNA, 22 bp, Homo sapiens
agaaggattcttttttcaatgt

SEQ ID NO: 2297012 - DNA, 22 bp, Homo sapiens
agaaggcacaggtgtaaatata

SEQ ID NO: 2297013 - DNA, 19 bp, Homo sapiens
agaaggctctatctgctgg

SEQ ID NO: 2297014 - DNA, 20 bp, Homo sapiens
agaagggaaattcacactgt

SEQ ID NO: 2297015 - DNA, 22 bp, Homo sapiens
agaagggaaattcacactgtgc

SEQ ID NO: 2297016 - DNA, 15 bp, Homo sapiens
agaaggtatttttga

SEQ ID NO: 2297017 - DNA, 14 bp, Homo sapiens
agaagtaactcccc

SEQ ID NO: 2297018 - DNA, 18 bp, Homo sapiens
agaagtcaaatgaatgag

SEQ ID NO: 2297019 - DNA, 22 bp, Homo sapiens
agaagtcttcatggtctcttcc

SEQ ID NO: 2297020 - DNA, 15 bp, Homo sapiens
agaatacaattcagt

SEQ ID NO: 2297021 - DNA, 19 bp, Homo sapiens
agaatacaattcagtttta

SEQ ID NO: 2297022 - DNA, 22 bp, Homo sapiens
agaatatataaacgatatatgt

SEQ ID NO: 2297023 - DNA, 19 bp, Homo sapiens
agaatatcctatactggtt

SEQ ID NO: 2297024 - DNA, 21 bp, Homo sapiens
agaatatgacctaaatccatt

SEQ ID NO: 2297025 - DNA, 22 bp, Homo sapiens
agaatcactgcacttagctgtt

SEQ ID NO: 2297026 - DNA, 22 bp, Homo sapiens
agaatcagcacagataaaaagt

SEQ ID NO: 2297027 - DNA, 15 bp, Homo sapiens
agaatctattttcta

SEQ ID NO: 2297028 - DNA, 12 bp, Homo sapiens
agaatgaaaaca

SEQ ID NO: 2297029 - DNA, 14 bp, Homo sapiens
agaatgaaaacaat

SEQ ID NO: 2297030 - DNA, 17 bp, Homo sapiens
agaatgaaaacaatatg

SEQ ID NO: 2297031 - DNA, 13 bp, Homo sapiens
agaatgagaaatc

SEQ ID NO: 2297032 - DNA, 16 bp, Homo sapiens
agaatgagagagaaaa

SEQ ID NO: 2297033 - DNA, 17 bp, Homo sapiens
agaatgctggcaaaggc

SEQ ID NO: 2297034 - DNA, 21 bp, Homo sapiens
agaatgggggtatcctgtgca

SEQ ID NO: 2297035 - DNA, 12 bp, Homo sapiens
agaatgtacaga

SEQ ID NO: 2297036 - DNA, 12 bp, Homo sapiens
agaatgtttcct

SEQ ID NO: 2297037 - DNA, 18 bp, Homo sapiens
agaatgtttcctgtggaa

SEQ ID NO: 2297038 - DNA, 22 bp, Homo sapiens
agaattaggtaatggatatgaa

SEQ ID NO: 2297039 - DNA, 21 bp, Homo sapiens
agaattgaaccgtcaatgtga

SEQ ID NO: 2297040 - DNA, 21 bp, Homo sapiens
agaattgtgcgacttcacaaa

SEQ ID NO: 2297041 - DNA, 23 bp, Homo sapiens
agaatttcccaaagcagtgcatg

SEQ ID NO: 2297042 - DNA, 22 bp, Homo sapiens
agaatttgaaagtttccttatt

SEQ ID NO: 2297043 - DNA, 14 bp, Homo sapiens
agaatttgtgaata

SEQ ID NO: 2297044 - DNA, 19 bp, Homo sapiens
agaatttgtgaatatattt

SEQ ID NO: 2297045 - DNA, 19 bp, Homo sapiens
agacaaaacttataatttc

SEQ ID NO: 2297046 - DNA, 14 bp, Homo sapiens
agacacgcacttct

SEQ ID NO: 2297047 - DNA, 18 bp, Homo sapiens
agacactcaagagccctt

SEQ ID NO: 2297048 - DNA, 19 bp, Homo sapiens
agacactggtctcagagga

SEQ ID NO: 2297049 - DNA, 12 bp, Homo sapiens
agacagaaggca

SEQ ID NO: 2297050 - DNA, 20 bp, Homo sapiens
agacagacggacgggacagc

SEQ ID NO: 2297051 - DNA, 15 bp, Homo sapiens
agacaggattctgac

SEQ ID NO: 2297052 - DNA, 17 bp, Homo sapiens
agacagggtctcactgt

SEQ ID NO: 2297053 - DNA, 18 bp, Homo sapiens
agacagggtctcactgtg

SEQ ID NO: 2297054 - DNA, 24 bp, Homo sapiens
agacatcctgtgatgtcatgaaag

SEQ ID NO: 2297055 - DNA, 12 bp, Homo sapiens
agacattcagag

SEQ ID NO: 2297056 - DNA, 21 bp, Homo sapiens
agacatttaaaatagttttct

SEQ ID NO: 2297057 - DNA, 16 bp, Homo sapiens
agaccacagaggctca

SEQ ID NO: 2297058 - DNA, 18 bp, Homo sapiens
agaccagcatagttctgc

SEQ ID NO: 2297059 - DNA, 22 bp, Homo sapiens
agaccaggactctgccttccag

SEQ ID NO: 2297060 - DNA, 23 bp, Homo sapiens
agaccaggactctgccttccagg

SEQ ID NO: 2297061 - DNA, 12 bp, Homo sapiens
agacccctgggg

SEQ ID NO: 2297062 - DNA, 18 bp, Homo sapiens
agaccgagtgtggagctg

SEQ ID NO: 2297063 - DNA, 15 bp, Homo sapiens
agacctccagattat

SEQ ID NO: 2297064 - DNA, 23 bp, Homo sapiens
agacctccagattattttctata

SEQ ID NO: 2297065 - DNA, 13 bp, Homo sapiens
agacctgctccag

SEQ ID NO: 2297066 - DNA, 15 bp, Homo sapiens
agacctgctccagat

SEQ ID NO: 2297067 - DNA, 13 bp, Homo sapiens
agacctgggccct

SEQ ID NO: 2297068 - DNA, 14 bp, Homo sapiens
agacctgggccctg

SEQ ID NO: 2297069 - DNA, 15 bp, Homo sapiens
agacgacagcccctg

SEQ ID NO: 2297070 - DNA, 21 bp, Homo sapiens
agacgacttatatatttgaaa

SEQ ID NO: 2297071 - DNA, 17 bp, Homo sapiens
agacgttaccaattatg

SEQ ID NO: 2297072 - DNA, 14 bp, Homo sapiens
agactaagttgcta

SEQ ID NO: 2297073 - DNA, 23 bp, Homo sapiens
agactaatgaatgcaaaaagata

SEQ ID NO: 2297074 - DNA, 18 bp, Homo sapiens
agactagagaataatttt

SEQ ID NO: 2297075 - DNA, 19 bp, Homo sapiens
agactagctaattagctct

SEQ ID NO: 2297076 - DNA, 20 bp, Homo sapiens
agactcaggcccacattgcc

SEQ ID NO: 2297077 - DNA, 20 bp, Homo sapiens
agactcgcgacaatgcaaac

SEQ ID NO: 2297078 - DNA, 12 bp, Homo sapiens
agactctgtgat

SEQ ID NO: 2297079 - DNA, 15 bp, Homo sapiens
agactctgtgatcta

SEQ ID NO: 2297080 - DNA, 13 bp, Homo sapiens
agactgcccaccc

SEQ ID NO: 2297081 - DNA, 16 bp, Homo sapiens
agactgcccaccctgg

SEQ ID NO: 2297082 - DNA, 14 bp, Homo sapiens
agacttaatcatat

SEQ ID NO: 2297083 - DNA, 20 bp, Homo sapiens
agagaaacactaatggccaa

SEQ ID NO: 2297084 - DNA, 15 bp, Homo sapiens
agagaagtacttttg

SEQ ID NO: 2297085 - DNA, 14 bp, Homo sapiens
agagaattctaaga

SEQ ID NO: 2297086 - DNA, 21 bp, Homo sapiens
agagaattctaagattgtaca

SEQ ID NO: 2297087 - DNA, 18 bp, Homo sapiens
agagacaaatagtaggct

SEQ ID NO: 2297088 - DNA, 21 bp, Homo sapiens
agagacagggtctcactgtgt

SEQ ID NO: 2297089 - DNA, 20 bp, Homo sapiens
agagacctgctccagatcct

SEQ ID NO: 2297090 - DNA, 13 bp, Homo sapiens
agagacggcagcc

SEQ ID NO: 2297091 - DNA, 13 bp, Homo sapiens
agagactctgtga

SEQ ID NO: 2297092 - DNA, 12 bp, Homo sapiens
agagactgccca

SEQ ID NO: 2297093 - DNA, 13 bp, Homo sapiens
agagactgcccac

SEQ ID NO: 2297094 - DNA, 19 bp, Homo sapiens
agagactgcccaccctggg

SEQ ID NO: 2297095 - DNA, 20 bp, Homo sapiens
agagactgcccaccctgggc

SEQ ID NO: 2297096 - DNA, 13 bp, Homo sapiens
agagagaggcctg

SEQ ID NO: 2297097 - DNA, 14 bp, Homo sapiens
agagagaggcctgg

SEQ ID NO: 2297098 - DNA, 15 bp, Homo sapiens
agagagaggcctggg

SEQ ID NO: 2297099 - DNA, 14 bp, Homo sapiens
agagatggcagagc

SEQ ID NO: 2297100 - DNA, 15 bp, Homo sapiens
agagatggcagagcc

SEQ ID NO: 2297101 - DNA, 19 bp, Homo sapiens
agagattaatttgtgtaga

SEQ ID NO: 2297102 - DNA, 16 bp, Homo sapiens
agcagagatgtattat

SEQ ID NO: 2297103 - DNA, 13 bp, Homo sapiens
agcagagccccca

SEQ ID NO: 2297104 - DNA, 15 bp, Homo sapiens
agcagcctcactgca

SEQ ID NO: 2297105 - DNA, 18 bp, Homo sapiens
agcagctccaacctggag

SEQ ID NO: 2297106 - DNA, 21 bp, Homo sapiens
agcagctccaacctggaggct

SEQ ID NO: 2297107 - DNA, 12 bp, Homo sapiens
agcaggggtctc

SEQ ID NO: 2297108 - DNA, 15 bp, Homo sapiens
agcagtaccatccca

SEQ ID NO: 2297109 - DNA, 19 bp, Homo sapiens
agcagtaccatcccactga

SEQ ID NO: 2297110 - DNA, 21 bp, Homo sapiens
agcagtaccatcccactgata

SEQ ID NO: 2297111 - DNA, 16 bp, Homo sapiens
agcagtaccctagcct

SEQ ID NO: 2297112 - DNA, 14 bp, Homo sapiens
agcagtcactggga

SEQ ID NO: 2297113 - DNA, 17 bp, Homo sapiens
agcagtgcatgctgtcc

SEQ ID NO: 2297114 - DNA, 19 bp, Homo sapiens
agcagtgcatgctgtccct

SEQ ID NO: 2297115 - DNA, 20 bp, Homo sapiens
agcagtgcatgctgtccctt

SEQ ID NO: 2297116 - DNA, 17 bp, Homo sapiens
agcagttaggctgtaca

SEQ ID NO: 2297117 - DNA, 17 bp, Homo sapiens
agcagttgcaatgatca

SEQ ID NO: 2297118 - DNA, 19 bp, Homo sapiens
agcataaatctgttagcat

SEQ ID NO: 2297119 - DNA, 20 bp, Homo sapiens
agcataaatctgttagcatt

SEQ ID NO: 2297120 - DNA, 15 bp, Homo sapiens
agcatagttctgcaa

SEQ ID NO: 2297121 - DNA, 21 bp, Homo sapiens
agcatagttctgcaataacag

SEQ ID NO: 2297122 - DNA, 22 bp, Homo sapiens
agcatccatgcggccggcctgg

SEQ ID NO: 2297123 - DNA, 19 bp, Homo sapiens
agcatccccaaaacaaagt

SEQ ID NO: 2297124 - DNA, 21 bp, Homo sapiens
agcatcctgattattgaatgt

SEQ ID NO: 2297125 - DNA, 18 bp, Homo sapiens
agcatctgctcttctctt

SEQ ID NO: 2297126 - DNA, 21 bp, Homo sapiens
agcatgagattgtacattttt

SEQ ID NO: 2297127 - DNA, 16 bp, Homo sapiens
agcattaaatataaaa

SEQ ID NO: 2297128 - DNA, 12 bp, Homo sapiens
agcattattgcc

SEQ ID NO: 2297129 - DNA, 13 bp, Homo sapiens
agcattcaaaata

SEQ ID NO: 2297130 - DNA, 17 bp, Homo sapiens
agcattttactgtctgt

SEQ ID NO: 2297131 - DNA, 19 bp, Homo sapiens
agcattttactgtctgtaa

SEQ ID NO: 2297132 - DNA, 13 bp, Homo sapiens
agccaaagagaaa

SEQ ID NO: 2297133 - DNA, 20 bp, Homo sapiens
agccaaagagaaaagattaa

SEQ ID NO: 2297134 - DNA, 21 bp, Homo sapiens
agccaacttaaacctgtgctt

SEQ ID NO: 2297135 - DNA, 16 bp, Homo sapiens
agccaatttcaaagaa

SEQ ID NO: 2297136 - DNA, 13 bp, Homo sapiens
agccacagtgggg

SEQ ID NO: 2297137 - DNA, 20 bp, Homo sapiens
agccacagtggggcccatgg

SEQ ID NO: 2297138 - DNA, 18 bp, Homo sapiens
agccacgttgcagaaaaa

SEQ ID NO: 2297139 - DNA, 14 bp, Homo sapiens
agccactttcctct

SEQ ID NO: 2297140 - DNA, 19 bp, Homo sapiens
agccagggcccgggaagca

SEQ ID NO: 2297141 - DNA, 17 bp, Homo sapiens
agcccacccgccccaga

SEQ ID NO: 2297142 - DNA, 19 bp, Homo sapiens
agcccacccgccccagaga

SEQ ID NO: 2297143 - DNA, 20 bp, Homo sapiens
agcccacccgccccagagac

SEQ ID NO: 2297144 - DNA, 21 bp, Homo sapiens
agcccacccgccccagagact

SEQ ID NO: 2297145 - DNA, 20 bp, Homo sapiens
agcccagaacgggcctcccc

SEQ ID NO: 2297146 - DNA, 17 bp, Homo sapiens
agcccatcctctcgcca

SEQ ID NO: 2297147 - DNA, 18 bp, Homo sapiens
agccccagcgagtctgga

SEQ ID NO: 2297148 - DNA, 21 bp, Homo sapiens
agccccagcgagtctggagac

SEQ ID NO: 2297149 - DNA, 16 bp, Homo sapiens
agccccatccttcccg

SEQ ID NO: 2297150 - DNA, 12 bp, Homo sapiens
agccccctggcc

SEQ ID NO: 2297151 - DNA, 21 bp, Homo sapiens
agccccctggcccctcccaca

SEQ ID NO: 2297152 - DNA, 12 bp, Homo sapiens
agcccctccccg

SEQ ID NO: 2297153 - DNA, 14 bp, Homo sapiens
agcccctccccgcc

SEQ ID NO: 2297154 - DNA, 16 bp, Homo sapiens
agcccctccccgcctc

SEQ ID NO: 2297155 - DNA, 12 bp, Homo sapiens
agcccctcctct

SEQ ID NO: 2297156 - DNA, 16 bp, Homo sapiens
agcccctgctgctcct

SEQ ID NO: 2297157 - DNA, 12 bp, Homo sapiens
agcccctgctgg

SEQ ID NO: 2297158 - DNA, 17 bp, Homo sapiens
agcccgatccacattgc

SEQ ID NO: 2297159 - DNA, 10 bp, Homo sapiens
agcccggcca

SEQ ID NO: 2297160 - DNA, 15 bp, Homo sapiens
agcccggccaaggac

SEQ ID NO: 2297161 - DNA, 24 bp, Homo sapiens
agcccgggagatccgccctgggct

SEQ ID NO: 2297162 - DNA, 16 bp, Homo sapiens
agcccggtgtgaggag

SEQ ID NO: 2297163 - DNA, 20 bp, Homo sapiens
agcccggtgtgaggaggggc

SEQ ID NO: 2297164 - DNA, 17 bp, Homo sapiens
agccctatctatgtcct

SEQ ID NO: 2297165 - DNA, 22 bp, Homo sapiens
agccctggggtttccacacagg

SEQ ID NO: 2297166 - DNA, 19 bp, Homo sapiens
agcccttccaggagtgggt

SEQ ID NO: 2297167 - DNA, 15 bp, Homo sapiens
agccgagctctcctg

SEQ ID NO: 2297168 - DNA, 21 bp, Homo sapiens
agccgagctctcctgggccag

SEQ ID NO: 2297169 - DNA, 19 bp, Homo sapiens
agccgatctggtctcgtgt

SEQ ID NO: 2297170 - DNA, 16 bp, Homo sapiens
agccgcaccctggctg

SEQ ID NO: 2297171 - DNA, 16 bp, Homo sapiens
agccgcgctctgcccc

SEQ ID NO: 2297172 - DNA, 18 bp, Homo sapiens
agcctcacccctgcaggc

SEQ ID NO: 2297173 - DNA, 11 bp, Homo sapiens
agcctccccca

SEQ ID NO: 2297174 - DNA, 14 bp, Homo sapiens
agcctcccccaggc

SEQ ID NO: 2297175 - DNA, 15 bp, Homo sapiens
agcctcccccaggct

SEQ ID NO: 2297176 - DNA, 18 bp, Homo sapiens
agcctcctgagtagctgg

SEQ ID NO: 2297177 - DNA, 14 bp, Homo sapiens
agcctcctgctgag

SEQ ID NO: 2297178 - DNA, 11 bp, Homo sapiens
agcctgagcca

SEQ ID NO: 2297179 - DNA, 16 bp, Homo sapiens
agcctgagctccaccc

SEQ ID NO: 2297180 - DNA, 17 bp, Homo sapiens
agcctgcaaagctggtt

SEQ ID NO: 2297181 - DNA, 21 bp, Homo sapiens
agcctgcgtggcctggggctg

SEQ ID NO: 2297182 - DNA, 15 bp, Homo sapiens
agcctgtgtgaaaat

SEQ ID NO: 2297183 - DNA, 20 bp, Homo sapiens
agccttgaactgtggccacc

SEQ ID NO: 2297184 - DNA, 15 bp, Homo sapiens
agcctttcttttctt

SEQ ID NO: 2297185 - DNA, 17 bp, Homo sapiens
agcctttggtgaataac

SEQ ID NO: 2297186 - DNA, 18 bp, Homo sapiens
agcgagtctggagaccag

SEQ ID NO: 2297187 - DNA, 16 bp, Homo sapiens
agcgatcctccttcct

SEQ ID NO: 2297188 - DNA, 19 bp, Homo sapiens
agcgattcctgccaagtag

SEQ ID NO: 2297189 - DNA, 15 bp, Homo sapiens
agcgcctcccgccgc

SEQ ID NO: 2297190 - DNA, 17 bp, Homo sapiens
agcgcctcccgccgcct

SEQ ID NO: 2297191 - DNA, 15 bp, Homo sapiens
agcgcgtgccttccc

SEQ ID NO: 2297192 - DNA, 20 bp, Homo sapiens
agcggccccgcacccctcct

SEQ ID NO: 2297193 - DNA, 23 bp, Homo sapiens
agcggccccgcacccctcctcct

SEQ ID NO: 2297194 - DNA, 15 bp, Homo sapiens
agcggcccggcccac

SEQ ID NO: 2297195 - DNA, 21 bp, Homo sapiens
agcggcccggcccacgcagag

SEQ ID NO: 2297196 - DNA, 21 bp, Homo sapiens
agcggctgaggacggggcaga

SEQ ID NO: 2297197 - DNA, 20 bp, Homo sapiens
agcgggggctaactggcccc

SEQ ID NO: 2297198 - DNA, 15 bp, Homo sapiens
agcgtctgctgttga

SEQ ID NO: 2297199 - DNA, 20 bp, Homo sapiens
agcgtggtggacatgcacag

SEQ ID NO: 2297200 - DNA, 15 bp, Homo sapiens
agcgttaagggcaga

SEQ ID NO: 2297201 - DNA, 20 bp, Homo sapiens
agctaacatggaagtactat

SEQ ID NO: 2297202 - DNA, 15 bp, Homo sapiens
agctacaagggaagc

SEQ ID NO: 2297203 - DNA, 12 bp, Homo sapiens
agctaccaggaa

SEQ ID NO: 2297204 - DNA, 15 bp, Homo sapiens
agctaccaggaagag

SEQ ID NO: 2297205 - DNA, 22 bp, Homo sapiens
agctagaaaatgaactgtatat

SEQ ID NO: 2297206 - DNA, 17 bp, Homo sapiens
agctataacaactctat

SEQ ID NO: 2297207 - DNA, 18 bp, Homo sapiens
agctataacaactctatt

SEQ ID NO: 2297208 - DNA, 23 bp, Homo sapiens
agctatatatatatatatatgta

SEQ ID NO: 2297209 - DNA, 14 bp, Homo sapiens
agctatctctgtgg

SEQ ID NO: 2297210 - DNA, 15 bp, Homo sapiens
agctatgagagatgt

SEQ ID NO: 2297211 - DNA, 12 bp, Homo sapiens
agctcaactgtt

SEQ ID NO: 2297212 - DNA, 17 bp, Homo sapiens
agctcaactgttgccag

SEQ ID NO: 2297213 - DNA, 21 bp, Homo sapiens
agctcaactgttgccaggaga

SEQ ID NO: 2297214 - DNA, 16 bp, Homo sapiens
agctcagtcccacagc

SEQ ID NO: 2297215 - DNA, 20 bp, Homo sapiens
agctcagtcccacagcccct

SEQ ID NO: 2297216 - DNA, 23 bp, Homo sapiens
agctccaacctggaggctggacc

SEQ ID NO: 2297217 - DNA, 17 bp, Homo sapiens
agctccaccctcccctc

SEQ ID NO: 2297218 - DNA, 21 bp, Homo sapiens
agctcccaggacgcagggaga

SEQ ID NO: 2297219 - DNA, 14 bp, Homo sapiens
agctcctattaaat

SEQ ID NO: 2297220 - DNA, 13 bp, Homo sapiens
agctcctgccccg

SEQ ID NO: 2297221 - DNA, 15 bp, Homo sapiens
agctctaaagcagag

SEQ ID NO: 2297222 - DNA, 16 bp, Homo sapiens
agctctaaagcagaga

SEQ ID NO: 2297223 - DNA, 19 bp, Homo sapiens
agctctcccctgcgcaggc

SEQ ID NO: 2297224 - DNA, 20 bp, Homo sapiens
agctctcccctgcgcaggcc

SEQ ID NO: 2297225 - DNA, 21 bp, Homo sapiens
agctctcccctgcgcaggccc

SEQ ID NO: 2297226 - DNA, 22 bp, Homo sapiens
agctctcctgggccagggtctc

SEQ ID NO: 2297227 - DNA, 21 bp, Homo sapiens
agctctcgcctcaggcttttt

SEQ ID NO: 2297228 - DNA, 15 bp, Homo sapiens
agctctgaagggagg

SEQ ID NO: 2297229 - DNA, 22 bp, Homo sapiens
agctctgaagggaggggaagag

SEQ ID NO: 2297230 - DNA, 14 bp, Homo sapiens
agctctgcataaga

SEQ ID NO: 2297231 - DNA, 18 bp, Homo sapiens
agctctgcataagattat

SEQ ID NO: 2297232 - DNA, 19 bp, Homo sapiens
agctctggaattgttgaat

SEQ ID NO: 2297233 - DNA, 20 bp, Homo sapiens
agctctggaattgttgaatg

SEQ ID NO: 2297234 - DNA, 16 bp, Homo sapiens
aggcttccagctcagt

SEQ ID NO: 2297235 - DNA, 15 bp, Homo sapiens
agggaaatcaattta

SEQ ID NO: 2297236 - DNA, 21 bp, Homo sapiens
agggaaatcaatttaaaggaa

SEQ ID NO: 2297237 - DNA, 23 bp, Homo sapiens
agggaaatcaatttaaaggaaag

SEQ ID NO: 2297238 - DNA, 14 bp, Homo sapiens
agggaagcccaccc

SEQ ID NO: 2297239 - DNA, 20 bp, Homo sapiens
agggaatccatatcagctct

SEQ ID NO: 2297240 - DNA, 21 bp, Homo sapiens
agggaatggggaacccgctct

SEQ ID NO: 2297241 - DNA, 17 bp, Homo sapiens
agggaccgggagcctgc

SEQ ID NO: 2297242 - DNA, 21 bp, Homo sapiens
agggacggggcccgccccagg

SEQ ID NO: 2297243 - DNA, 14 bp, Homo sapiens
agggagaccctggg

SEQ ID NO: 2297244 - DNA, 15 bp, Homo sapiens
agggagaggggaagg

SEQ ID NO: 2297245 - DNA, 22 bp, Homo sapiens
agggagtaggctgtattttctt

SEQ ID NO: 2297246 - DNA, 16 bp, Homo sapiens
agggatagagacgcag

SEQ ID NO: 2297247 - DNA, 13 bp, Homo sapiens
agggatccagaga

SEQ ID NO: 2297248 - DNA, 13 bp, Homo sapiens
agggcaaccaata

SEQ ID NO: 2297249 - DNA, 16 bp, Homo sapiens
agggcactaaccccat

SEQ ID NO: 2297250 - DNA, 13 bp, Homo sapiens
agggcatgtgcag

SEQ ID NO: 2297251 - DNA, 16 bp, Homo sapiens
agggcatttttcttgg

SEQ ID NO: 2297252 - DNA, 18 bp, Homo sapiens
agggcatttttcttggat

SEQ ID NO: 2297253 - DNA, 19 bp, Homo sapiens
agggccagttggtgttcct

SEQ ID NO: 2297254 - DNA, 17 bp, Homo sapiens
agggcccaaataacagt

SEQ ID NO: 2297255 - DNA, 13 bp, Homo sapiens
agggcccagaggg

SEQ ID NO: 2297256 - DNA, 21 bp, Homo sapiens
agggcccagaggggcggggcc

SEQ ID NO: 2297257 - DNA, 22 bp, Homo sapiens
agggccctgtggctccaggagc

SEQ ID NO: 2297258 - DNA, 16 bp, Homo sapiens
agggccgcagggcgct

SEQ ID NO: 2297259 - DNA, 12 bp, Homo sapiens
agggcctctgga

SEQ ID NO: 2297260 - DNA, 14 bp, Homo sapiens
agggcctctggaca

SEQ ID NO: 2297261 - DNA, 15 bp, Homo sapiens
agggcgctccggcag

SEQ ID NO: 2297262 - DNA, 18 bp, Homo sapiens
agggcgctccggcagagg

SEQ ID NO: 2297263 - DNA, 20 bp, Homo sapiens
agggcgctccggcagaggca

SEQ ID NO: 2297264 - DNA, 23 bp, Homo sapiens
agggcgctccggcagaggcaggg

SEQ ID NO: 2297265 - DNA, 20 bp, Homo sapiens
agggctccacgggggcctag

SEQ ID NO: 2297266 - DNA, 14 bp, Homo sapiens
agggctgagcccct

SEQ ID NO: 2297267 - DNA, 16 bp, Homo sapiens
agggctgagcccctcc

SEQ ID NO: 2297268 - DNA, 18 bp, Homo sapiens
agggctgagcccctcctc

SEQ ID NO: 2297269 - DNA, 19 bp, Homo sapiens
agggctgagcccctcctct

SEQ ID NO: 2297270 - DNA, 20 bp, Homo sapiens
agggctgagcccctcctctc

SEQ ID NO: 2297271 - DNA, 16 bp, Homo sapiens
agggctgggcagggcc

SEQ ID NO: 2297272 - DNA, 17 bp, Homo sapiens
agggctgggcagggccc

SEQ ID NO: 2297273 - DNA, 20 bp, Homo sapiens
agggctgggcagggccctgt

SEQ ID NO: 2297274 - DNA, 22 bp, Homo sapiens
agggctgggcagggccctgtgg

SEQ ID NO: 2297275 - DNA, 13 bp, Homo sapiens
agggctttaaata

SEQ ID NO: 2297276 - DNA, 16 bp, Homo sapiens
agggctttaaataaaa

SEQ ID NO: 2297277 - DNA, 15 bp, Homo sapiens
aggggaagagagagg

SEQ ID NO: 2297278 - DNA, 18 bp, Homo sapiens
aggggaagagagaggcct

SEQ ID NO: 2297279 - DNA, 16 bp, Homo sapiens
aggggagcgtgttcct

SEQ ID NO: 2297280 - DNA, 15 bp, Homo sapiens
aggggcaaaaatatt

SEQ ID NO: 2297281 - DNA, 17 bp, Homo sapiens
aggggccaggaagggga

SEQ ID NO: 2297282 - DNA, 18 bp, Homo sapiens
aggggcccattcagcctc

SEQ ID NO: 2297283 - DNA, 19 bp, Homo sapiens
aggggcccattcagcctcg

SEQ ID NO: 2297284 - DNA, 22 bp, Homo sapiens
aggggcgctgcccccacagatc

SEQ ID NO: 2297285 - DNA, 20 bp, Homo sapiens
aggggctgactctccaggga

SEQ ID NO: 2297286 - DNA, 13 bp, Homo sapiens
aggggctggaggg

SEQ ID NO: 2297287 - DNA, 17 bp, Homo sapiens
aggggcttggagcagag

SEQ ID NO: 2297288 - DNA, 20 bp, Homo sapiens
aggggcttggagcagagacg

SEQ ID NO: 2297289 - DNA, 12 bp, Homo sapiens
agggggcagggg

SEQ ID NO: 2297290 - DNA, 21 bp, Homo sapiens
agggggtcagttgggccccca

SEQ ID NO: 2297291 - DNA, 19 bp, Homo sapiens
aggggtcgcgatgatgggc

SEQ ID NO: 2297292 - DNA, 21 bp, Homo sapiens
aggggtggaagggcaggagct

SEQ ID NO: 2297293 - DNA, 22 bp, Homo sapiens
agggtatctgctgcctctgaaa

SEQ ID NO: 2297294 - DNA, 18 bp, Homo sapiens
agggtctcactctgttga

SEQ ID NO: 2297295 - DNA, 16 bp, Homo sapiens
agggtctcactgtgtt

SEQ ID NO: 2297296 - DNA, 22 bp, Homo sapiens
agggtctcactgtgttgcccag

SEQ ID NO: 2297297 - DNA, 23 bp, Homo sapiens
agggtctcactgtgttgcccagg

SEQ ID NO: 2297298 - DNA, 22 bp, Homo sapiens
agggtctcgtcaggaggtgcct

SEQ ID NO: 2297299 - DNA, 23 bp, Homo sapiens
agggtctcgtcaggaggtgcctg

SEQ ID NO: 2297300 - DNA, 18 bp, Homo sapiens
agggtgcaggcgcgcacc

SEQ ID NO: 2297301 - DNA, 20 bp, Homo sapiens
agggtggagatgtcagtctg

SEQ ID NO: 2297302 - DNA, 13 bp, Homo sapiens
agggtgggccctg

SEQ ID NO: 2297303 - DNA, 15 bp, Homo sapiens
agggtgggccctgga

SEQ ID NO: 2297304 - DNA, 16 bp, Homo sapiens
agggtgggccctggag

SEQ ID NO: 2297305 - DNA, 17 bp, Homo sapiens
agggtgggccctggagg

SEQ ID NO: 2297306 - DNA, 18 bp, Homo sapiens
agggtgggccctggaggg

SEQ ID NO: 2297307 - DNA, 17 bp, Homo sapiens
agggtttccaccttggc

SEQ ID NO: 2297308 - DNA, 16 bp, Homo sapiens
agggtttgggcagagc

SEQ ID NO: 2297309 - DNA, 13 bp, Homo sapiens
aggtatactatgt

SEQ ID NO: 2297310 - DNA, 14 bp, Homo sapiens
aggtatactatgta

SEQ ID NO: 2297311 - DNA, 15 bp, Homo sapiens
aggtatttttgaagt

SEQ ID NO: 2297312 - DNA, 14 bp, Homo sapiens
aggtcaaggtcatt

SEQ ID NO: 2297313 - DNA, 18 bp, Homo sapiens
aggtcaatgaaatatttg

SEQ ID NO: 2297314 - DNA, 23 bp, Homo sapiens
aggtcacctcactcagcaccact

SEQ ID NO: 2297315 - DNA, 15 bp, Homo sapiens
aggtcagctcagagc

SEQ ID NO: 2297316 - DNA, 17 bp, Homo sapiens
aggtcatcccggggcca

SEQ ID NO: 2297317 - DNA, 16 bp, Homo sapiens
aggtcatttgtagata

SEQ ID NO: 2297318 - DNA, 18 bp, Homo sapiens
aggtcccgaatggagtcc

SEQ ID NO: 2297319 - DNA, 15 bp, Homo sapiens
aggtccgatggcccg

SEQ ID NO: 2297320 - DNA, 22 bp, Homo sapiens
aggtccgatggcccgagagctg

SEQ ID NO: 2297321 - DNA, 13 bp, Homo sapiens
aggtcctgtgagc

SEQ ID NO: 2297322 - DNA, 21 bp, Homo sapiens
aggtcctttggacagctgact

SEQ ID NO: 2297323 - DNA, 11 bp, Homo sapiens
aggtgaataac

SEQ ID NO: 2297324 - DNA, 13 bp, Homo sapiens
aggtgagctactt

SEQ ID NO: 2297325 - DNA, 15 bp, Homo sapiens
aggtgagggaggcct

SEQ ID NO: 2297326 - DNA, 16 bp, Homo sapiens
aggtgagggaggcctg

SEQ ID NO: 2297327 - DNA, 10 bp, Homo sapiens
aggtgatctt

SEQ ID NO: 2297328 - DNA, 21 bp, Homo sapiens
aggtgcctgagagcagaatga

SEQ ID NO: 2297329 - DNA, 17 bp, Homo sapiens
aggtggccagggctcca

SEQ ID NO: 2297330 - DNA, 15 bp, Homo sapiens
aggtggggagggcct

SEQ ID NO: 2297331 - DNA, 21 bp, Homo sapiens
aggtggggagggcctctggac

SEQ ID NO: 2297332 - DNA, 12 bp, Homo sapiens
aggtgggggcag

SEQ ID NO: 2297333 - DNA, 14 bp, Homo sapiens
aggtgggggcagcg

SEQ ID NO: 2297334 - DNA, 15 bp, Homo sapiens
aggtgggggcagcgg

SEQ ID NO: 2297335 - DNA, 18 bp, Homo sapiens
aggtgggggtcggcgcct

SEQ ID NO: 2297336 - DNA, 14 bp, Homo sapiens
aggtgtgaatgcac

SEQ ID NO: 2297337 - DNA, 20 bp, Homo sapiens
aggtgtgaatgcacgtttca

SEQ ID NO: 2297338 - DNA, 13 bp, Homo sapiens
aggtgtgccaaac

SEQ ID NO: 2297339 - DNA, 17 bp, Homo sapiens
aggtgttaaaaaccatt

SEQ ID NO: 2297340 - DNA, 15 bp, Homo sapiens
aggttatgagaaaaa

SEQ ID NO: 2297341 - DNA, 12 bp, Homo sapiens
aggttcattttt

SEQ ID NO: 2297342 - DNA, 14 bp, Homo sapiens
aggttttctccccc

SEQ ID NO: 2297343 - DNA, 21 bp, Homo sapiens
agtaaataatgattcaatgtg

SEQ ID NO: 2297344 - DNA, 17 bp, Homo sapiens
agtaaatcccacgacat

SEQ ID NO: 2297345 - DNA, 14 bp, Homo sapiens
agtaaccatttaat

SEQ ID NO: 2297346 - DNA, 17 bp, Homo sapiens
agtaaccatttaatgtc

SEQ ID NO: 2297347 - DNA, 22 bp, Homo sapiens
agtaagattttatccctttctc

SEQ ID NO: 2297348 - DNA, 20 bp, Homo sapiens
agtaagttctgaaaactgtt

SEQ ID NO: 2297349 - DNA, 21 bp, Homo sapiens
agtaagttctgaaaactgttt

SEQ ID NO: 2297350 - DNA, 14 bp, Homo sapiens
agtaatattacatt

SEQ ID NO: 2297351 - DNA, 18 bp, Homo sapiens
agtaatattacatttcat

SEQ ID NO: 2297352 - DNA, 15 bp, Homo sapiens
agtaatgtatatctg

SEQ ID NO: 2297353 - DNA, 20 bp, Homo sapiens
agtaattcccatctgcttta

SEQ ID NO: 2297354 - DNA, 15 bp, Homo sapiens
agtaattgttacaat

SEQ ID NO: 2297355 - DNA, 17 bp, Homo sapiens
agtaccatcccactgat

SEQ ID NO: 2297356 - DNA, 13 bp, Homo sapiens
agtagctgtgggg

SEQ ID NO: 2297357 - DNA, 16 bp, Homo sapiens
agtaggagtggctgac

SEQ ID NO: 2297358 - DNA, 20 bp, Homo sapiens
agtaggagtggctgaccagg

SEQ ID NO: 2297359 - DNA, 23 bp, Homo sapiens
agtaggagtggctgaccaggccc

SEQ ID NO: 2297360 - DNA, 15 bp, Homo sapiens
agtaggctaaaaaca

SEQ ID NO: 2297361 - DNA, 16 bp, Homo sapiens
agtaggctaaaaacat

SEQ ID NO: 2297362 - DNA, 21 bp, Homo sapiens
agtaggctgtattttctttta

SEQ ID NO: 2297363 - DNA, 19 bp, Homo sapiens
agtagtgttgggtggagga

SEQ ID NO: 2297364 - DNA, 20 bp, Homo sapiens
agtagtgttgggtggaggat

SEQ ID NO: 2297365 - DNA, 22 bp, Homo sapiens
agtagtgttgggtggaggatgg

SEQ ID NO: 2297366 - DNA, 23 bp, Homo sapiens
agtagtgttgggtggaggatgga

SEQ ID NO: 2297367 - DNA, 11 bp, Homo sapiens
agttgtctgtc

SEQ ID NO: 2297368 - DNA, 22 bp, Homo sapiens
agttgttagtgtgtcttagtgt

SEQ ID NO: 2297369 - DNA, 14 bp, Homo sapiens
agtttaaaaaaata

SEQ ID NO: 2297370 - DNA, 16 bp, Homo sapiens
agtttaaaaaaataac

SEQ ID NO: 2297371 - DNA, 17 bp, Homo sapiens
agtttaaaaaaataaca

SEQ ID NO: 2297372 - DNA, 13 bp, Homo sapiens
agtttaaaaatat

SEQ ID NO: 2297373 - DNA, 15 bp, Homo sapiens
agtttaaaaatattc

SEQ ID NO: 2297374 - DNA, 17 bp, Homo sapiens
agtttaacagatattta

SEQ ID NO: 2297375 - DNA, 22 bp, Homo sapiens
agtttaacagatatttaaattt

SEQ ID NO: 2297376 - DNA, 17 bp, Homo sapiens
agtttatgtctcagttt

SEQ ID NO: 2297377 - DNA, 13 bp, Homo sapiens
agtttcaaatgag

SEQ ID NO: 2297378 - DNA, 16 bp, Homo sapiens
agtttcagagttctca

SEQ ID NO: 2297379 - DNA, 20 bp, Homo sapiens
agtttcaggcaaggcagctc

SEQ ID NO: 2297380 - DNA, 21 bp, Homo sapiens
agtttctatagcgagacatag

SEQ ID NO: 2297381 - DNA, 20 bp, Homo sapiens
agtttctggctgaaaatggt

SEQ ID NO: 2297382 - DNA, 19 bp, Homo sapiens
agtttgcattccagcgtct

SEQ ID NO: 2297383 - DNA, 14 bp, Homo sapiens
agtttgtaaatgtt

SEQ ID NO: 2297384 - DNA, 15 bp, Homo sapiens
agttttagtttcaaa

SEQ ID NO: 2297385 - DNA, 14 bp, Homo sapiens
agttttcacagagg

SEQ ID NO: 2297386 - DNA, 13 bp, Homo sapiens
agttttctaaatg

SEQ ID NO: 2297387 - DNA, 15 bp, Homo sapiens
agttttctaaatgtt

SEQ ID NO: 2297388 - DNA, 19 bp, Homo sapiens
agttttctaaatgtttctt

SEQ ID NO: 2297389 - DNA, 20 bp, Homo sapiens
ataaaagaggtccattaata

SEQ ID NO: 2297390 - DNA, 19 bp, Homo sapiens
ataaaagtgatattcctat

SEQ ID NO: 2297391 - DNA, 13 bp, Homo sapiens
ataaaagtgtcac

SEQ ID NO: 2297392 - DNA, 17 bp, Homo sapiens
ataaaatacataaaaga

SEQ ID NO: 2297393 - DNA, 14 bp, Homo sapiens
ataaaatcttcaac

SEQ ID NO: 2297394 - DNA, 23 bp, Homo sapiens
ataaaatcttcaactaatttttg

SEQ ID NO: 2297395 - DNA, 18 bp, Homo sapiens
ataaaatctttccatctc

SEQ ID NO: 2297396 - DNA, 19 bp, Homo sapiens
ataaaatctttccatctca

SEQ ID NO: 2297397 - DNA, 12 bp, Homo sapiens
ataaaatgaggg

SEQ ID NO: 2297398 - DNA, 21 bp, Homo sapiens
ataaaatgtttacattttctt

SEQ ID NO: 2297399 - DNA, 15 bp, Homo sapiens
ataaaattatgaaaa

SEQ ID NO: 2297400 - DNA, 18 bp, Homo sapiens
ataaaattgttatttcaa

SEQ ID NO: 2297401 - DNA, 16 bp, Homo sapiens
ataaaccaatcatctt

SEQ ID NO: 2297402 - DNA, 19 bp, Homo sapiens
ataaacgatatatgtaaat

SEQ ID NO: 2297403 - DNA, 20 bp, Homo sapiens
ataaacgatatatgtaaata

SEQ ID NO: 2297404 - DNA, 13 bp, Homo sapiens
ataaacttgtact

SEQ ID NO: 2297405 - DNA, 14 bp, Homo sapiens
ataaacttgtactt

SEQ ID NO: 2297406 - DNA, 15 bp, Homo sapiens
ataaacttgtgtatg

SEQ ID NO: 2297407 - DNA, 17 bp, Homo sapiens
ataaagaagaaaataac

SEQ ID NO: 2297408 - DNA, 22 bp, Homo sapiens
ataaagagttctccttgtactt

SEQ ID NO: 2297409 - DNA, 13 bp, Homo sapiens
ataaagggaagaa

SEQ ID NO: 2297410 - DNA, 18 bp, Homo sapiens
ataaagtaataactgtta

SEQ ID NO: 2297411 - DNA, 14 bp, Homo sapiens
ataaataaaaatat

SEQ ID NO: 2297412 - DNA, 14 bp, Homo sapiens
ataaataaagaaga

SEQ ID NO: 2297413 - DNA, 15 bp, Homo sapiens
ataaataaagaagaa

SEQ ID NO: 2297414 - DNA, 16 bp, Homo sapiens
ataaataaagaagaaa

SEQ ID NO: 2297415 - DNA, 15 bp, Homo sapiens
ataaatatttatgca

SEQ ID NO: 2297416 - DNA, 22 bp, Homo sapiens
ataaatatttatgcagaaggta

SEQ ID NO: 2297417 - DNA, 13 bp, Homo sapiens
ataaatctaaata

SEQ ID NO: 2297418 - DNA, 12 bp, Homo sapiens
ataaatctgtct

SEQ ID NO: 2297419 - DNA, 17 bp, Homo sapiens
ataaatctgtctgattc

SEQ ID NO: 2297420 - DNA, 20 bp, Homo sapiens
ataaatctgttagcattatt

SEQ ID NO: 2297421 - DNA, 13 bp, Homo sapiens
ataaatgtgtaaa

SEQ ID NO: 2297422 - DNA, 21 bp, Homo sapiens
ataaatttgatcccaatagaa

SEQ ID NO: 2297423 - DNA, 15 bp, Homo sapiens
ataacaactctattt

SEQ ID NO: 2297424 - DNA, 19 bp, Homo sapiens
ataacaactgagatgttaa

SEQ ID NO: 2297425 - DNA, 13 bp, Homo sapiens
ataacagtggcaa

SEQ ID NO: 2297426 - DNA, 16 bp, Homo sapiens
ataacagttttaagat

SEQ ID NO: 2297427 - DNA, 20 bp, Homo sapiens
ataactagatctcctgtaat

SEQ ID NO: 2297428 - DNA, 14 bp, Homo sapiens
ataagacaaaattt

SEQ ID NO: 2297429 - DNA, 21 bp, Homo sapiens
ataagactggaaaatagtcct

SEQ ID NO: 2297430 - DNA, 16 bp, Homo sapiens
ataagattatatacaa

SEQ ID NO: 2297431 - DNA, 18 bp, Homo sapiens
ataagcgttaagggcaga

SEQ ID NO: 2297432 - DNA, 20 bp, Homo sapiens
ataagcgttaagggcagagt

SEQ ID NO: 2297433 - DNA, 21 bp, Homo sapiens
ataagctggtatcagtggttc

SEQ ID NO: 2297434 - DNA, 21 bp, Homo sapiens
ataaggtaccaagatcacaaa

SEQ ID NO: 2297435 - DNA, 18 bp, Homo sapiens
ataagtgctcagtattga

SEQ ID NO: 2297436 - DNA, 20 bp, Homo sapiens
ataagtgttgtaccatatgt

SEQ ID NO: 2297437 - DNA, 22 bp, Homo sapiens
ataagtgttgtaccatatgtag

SEQ ID NO: 2297438 - DNA, 14 bp, Homo sapiens
ataagttaaagaga

SEQ ID NO: 2297439 - DNA, 18 bp, Homo sapiens
ataagttaaagagacaaa

SEQ ID NO: 2297440 - DNA, 22 bp, Homo sapiens
ataataacaacaacttaatgtg

SEQ ID NO: 2297441 - DNA, 16 bp, Homo sapiens
ataataactagatctc

SEQ ID NO: 2297442 - DNA, 18 bp, Homo sapiens
ataatagtaatggttcta

SEQ ID NO: 2297443 - DNA, 15 bp, Homo sapiens
ataatatagaaagaa

SEQ ID NO: 2297444 - DNA, 13 bp, Homo sapiens
ataatatatatat

SEQ ID NO: 2297445 - DNA, 15 bp, Homo sapiens
ataatatatatatat

SEQ ID NO: 2297446 - DNA, 16 bp, Homo sapiens
ataatatcctgaataa

SEQ ID NO: 2297447 - DNA, 19 bp, Homo sapiens
ataatatgaatatatacat

SEQ ID NO: 2297448 - DNA, 19 bp, Homo sapiens
ataatgatttaagcatttt

SEQ ID NO: 2297449 - DNA, 23 bp, Homo sapiens
ataatgtttccctcaagaacaaa

SEQ ID NO: 2297450 - DNA, 18 bp, Homo sapiens
ataattaaattttaatgt

SEQ ID NO: 2297451 - DNA, 19 bp, Homo sapiens
ataattaaattttaatgta

SEQ ID NO: 2297452 - DNA, 14 bp, Homo sapiens
ataattacttaatg

SEQ ID NO: 2297453 - DNA, 15 bp, Homo sapiens
ataattagctatatt

SEQ ID NO: 2297454 - DNA, 14 bp, Homo sapiens
ataattcatttaag

SEQ ID NO: 2297455 - DNA, 20 bp, Homo sapiens
ataattcatttaagaacaag

SEQ ID NO: 2297456 - DNA, 17 bp, Homo sapiens
ataattttaacagacat

SEQ ID NO: 2297457 - DNA, 20 bp, Homo sapiens
ataattttaacagacatgta

SEQ ID NO: 2297458 - DNA, 13 bp, Homo sapiens
atacaaagctgtc

SEQ ID NO: 2297459 - DNA, 19 bp, Homo sapiens
atacaacttgatactttta

SEQ ID NO: 2297460 - DNA, 21 bp, Homo sapiens
atacaacttgatacttttatt

SEQ ID NO: 2297461 - DNA, 12 bp, Homo sapiens
atacaagaaaaa

SEQ ID NO: 2297462 - DNA, 17 bp, Homo sapiens
atacaattcagttttag

SEQ ID NO: 2297463 - DNA, 23 bp, Homo sapiens
atacaattcagttttagtttcaa

SEQ ID NO: 2297464 - DNA, 19 bp, Homo sapiens
atacactacaaatgttaaa

SEQ ID NO: 2297465 - DNA, 16 bp, Homo sapiens
atacactgtatctaaa

SEQ ID NO: 2297466 - DNA, 15 bp, Homo sapiens
atacagacctccaga

SEQ ID NO: 2297467 - DNA, 20 bp, Homo sapiens
atacagacctccagattatt

SEQ ID NO: 2297468 - DNA, 14 bp, Homo sapiens
atacataaaagaat

SEQ ID NO: 2297469 - DNA, 13 bp, Homo sapiens
atacctatttcat

SEQ ID NO: 2297470 - DNA, 14 bp, Homo sapiens
atacctctctctat

SEQ ID NO: 2297471 - DNA, 18 bp, Homo sapiens
atacctctctctatatat

SEQ ID NO: 2297472 - DNA, 15 bp, Homo sapiens
atactaaataaaaca

SEQ ID NO: 2297473 - DNA, 16 bp, Homo sapiens
atactaaataaaacaa

SEQ ID NO: 2297474 - DNA, 15 bp, Homo sapiens
atactaaccatttct

SEQ ID NO: 2297475 - DNA, 21 bp, Homo sapiens
atactatgtaagggctttaaa

SEQ ID NO: 2297476 - DNA, 22 bp, Homo sapiens
atactatgtaagggctttaaat

SEQ ID NO: 2297477 - DNA, 12 bp, Homo sapiens
atactatttaga

SEQ ID NO: 2297478 - DNA, 21 bp, Homo sapiens
atactctgtgtaatctctgat

SEQ ID NO: 2297479 - DNA, 23 bp, Homo sapiens
atactgccgctgcccccaccctg

SEQ ID NO: 2297480 - DNA, 16 bp, Homo sapiens
atactggaaataacct

SEQ ID NO: 2297481 - DNA, 21 bp, Homo sapiens
atactggactcttcaaaaact

SEQ ID NO: 2297482 - DNA, 12 bp, Homo sapiens
atactgtagcaa

SEQ ID NO: 2297483 - DNA, 16 bp, Homo sapiens
atactgtttgtaatat

SEQ ID NO: 2297484 - DNA, 18 bp, Homo sapiens
atactgtttgtaatatac

SEQ ID NO: 2297485 - DNA, 19 bp, Homo sapiens
atactgtttgtaatataca

SEQ ID NO: 2297486 - DNA, 12 bp, Homo sapiens
atacttcctgga

SEQ ID NO: 2297487 - DNA, 22 bp, Homo sapiens
atacttcctggattttctttct

SEQ ID NO: 2297488 - DNA, 23 bp, Homo sapiens
atacttccttataaaaattctag

SEQ ID NO: 2297489 - DNA, 20 bp, Homo sapiens
atacttgctccttgaataag

SEQ ID NO: 2297490 - DNA, 18 bp, Homo sapiens
atactttccaacattatc

SEQ ID NO: 2297491 - DNA, 13 bp, Homo sapiens
atactttctcaca

SEQ ID NO: 2297492 - DNA, 20 bp, Homo sapiens
atacttttgtgtattctgtg

SEQ ID NO: 2297493 - DNA, 19 bp, Homo sapiens
atagaaaataaaataaatt

SEQ ID NO: 2297494 - DNA, 21 bp, Homo sapiens
atagaaactaaactaaaatag

SEQ ID NO: 2297495 - DNA, 21 bp, Homo sapiens
atagaactgtcccacaaaata

SEQ ID NO: 2297496 - DNA, 22 bp, Homo sapiens
atagaactgtcccacaaaatat

SEQ ID NO: 2297497 - DNA, 21 bp, Homo sapiens
atagacagtttgtaaatgtta

SEQ ID NO: 2297498 - DNA, 17 bp, Homo sapiens
atagacttcgaaaacag

SEQ ID NO: 2297499 - DNA, 22 bp, Homo sapiens
atagaggacacggaccctgtgt

SEQ ID NO: 2297500 - DNA, 22 bp, Homo sapiens
atcatggatcaaccaagttaca

SEQ ID NO: 2297501 - DNA, 19 bp, Homo sapiens
atcatgtgtagatattatg

SEQ ID NO: 2297502 - DNA, 21 bp, Homo sapiens
atcatgtgtagatattatgta

SEQ ID NO: 2297503 - DNA, 19 bp, Homo sapiens
atcattgaaatctttttgc

SEQ ID NO: 2297504 - DNA, 20 bp, Homo sapiens
atcattgagaaataaagcac

SEQ ID NO: 2297505 - DNA, 23 bp, Homo sapiens
atcatttggccgagtcagcacgt

SEQ ID NO: 2297506 - DNA, 21 bp, Homo sapiens
atccaactggaaggctttatt

SEQ ID NO: 2297507 - DNA, 22 bp, Homo sapiens
atccaagtattttatctgtgtt

SEQ ID NO: 2297508 - DNA, 20 bp, Homo sapiens
atccaattaatgattcaatt

SEQ ID NO: 2297509 - DNA, 16 bp, Homo sapiens
atccacacacagcagc

SEQ ID NO: 2297510 - DNA, 15 bp, Homo sapiens
atccacaccctctcc

SEQ ID NO: 2297511 - DNA, 20 bp, Homo sapiens
atccaccaatatcatgtgta

SEQ ID NO: 2297512 - DNA, 15 bp, Homo sapiens
atccagagacctgct

SEQ ID NO: 2297513 - DNA, 19 bp, Homo sapiens
atccagagacctgctccag

SEQ ID NO: 2297514 - DNA, 22 bp, Homo sapiens
atccagagacctgctccagatc

SEQ ID NO: 2297515 - DNA, 22 bp, Homo sapiens
atccagaggtgagggaggcctg

SEQ ID NO: 2297516 - DNA, 14 bp, Homo sapiens
atccagccaggggt

SEQ ID NO: 2297517 - DNA, 16 bp, Homo sapiens
atccagtatcttgaag

SEQ ID NO: 2297518 - DNA, 14 bp, Homo sapiens
atccatatcagctc

SEQ ID NO: 2297519 - DNA, 15 bp, Homo sapiens
atccatcctctgaga

SEQ ID NO: 2297520 - DNA, 19 bp, Homo sapiens
atccatgcggccggcctgg

SEQ ID NO: 2297521 - DNA, 21 bp, Homo sapiens
atccatgcggccggcctgggg

SEQ ID NO: 2297522 - DNA, 23 bp, Homo sapiens
atccatgcggccggcctggggcc

SEQ ID NO: 2297523 - DNA, 12 bp, Homo sapiens
atccattttcta

SEQ ID NO: 2297524 - DNA, 14 bp, Homo sapiens
atccattttctaaa

SEQ ID NO: 2297525 - DNA, 21 bp, Homo sapiens
atccattttctaaactgtttt

SEQ ID NO: 2297526 - DNA, 15 bp, Homo sapiens
atcccacaattgaaa

SEQ ID NO: 2297527 - DNA, 19 bp, Homo sapiens
atcccagctcactgcagcc

SEQ ID NO: 2297528 - DNA, 14 bp, Homo sapiens
atcccggggccatg

SEQ ID NO: 2297529 - DNA, 18 bp, Homo sapiens
atccctcggtcagcaccg

SEQ ID NO: 2297530 - DNA, 15 bp, Homo sapiens
atccctttctcttct

SEQ ID NO: 2297531 - DNA, 17 bp, Homo sapiens
atccctttctcttctga

SEQ ID NO: 2297532 - DNA, 14 bp, Homo sapiens
atcctataaatgtg

SEQ ID NO: 2297533 - DNA, 14 bp, Homo sapiens
atcctcccctctcc

SEQ ID NO: 2297534 - DNA, 21 bp, Homo sapiens
atcctcccgccccagcctcct

SEQ ID NO: 2297535 - DNA, 13 bp, Homo sapiens
atcctctatgtgg

SEQ ID NO: 2297536 - DNA, 24 bp, Homo sapiens
atcctctgcttgtcattctgctaa

SEQ ID NO: 2297537 - DNA, 18 bp, Homo sapiens
atcctctttccccactga

SEQ ID NO: 2297538 - DNA, 12 bp, Homo sapiens
atcctgagccag

SEQ ID NO: 2297539 - DNA, 19 bp, Homo sapiens
atcctgattattgaatgtt

SEQ ID NO: 2297540 - DNA, 20 bp, Homo sapiens
atcctgggcatccccagccc

SEQ ID NO: 2297541 - DNA, 24 bp, Homo sapiens
atcctgggcatccccagccccctg

SEQ ID NO: 2297542 - DNA, 12 bp, Homo sapiens
atcctgtcccat

SEQ ID NO: 2297543 - DNA, 22 bp, Homo sapiens
atcctgtcccatgggctctggc

SEQ ID NO: 2297544 - DNA, 10 bp, Homo sapiens
atcctgtgca

SEQ ID NO: 2297545 - DNA, 11 bp, Homo sapiens
atcctgtgcat

SEQ ID NO: 2297546 - DNA, 13 bp, Homo sapiens
atccttaactgtc

SEQ ID NO: 2297547 - DNA, 14 bp, Homo sapiens
atccttcccgcagc

SEQ ID NO: 2297548 - DNA, 15 bp, Homo sapiens
atccttcccgcagca

SEQ ID NO: 2297549 - DNA, 24 bp, Homo sapiens
atccttcccgcagcaccagcctga

SEQ ID NO: 2297550 - DNA, 22 bp, Homo sapiens
atccttctaaagtgctgggatt

SEQ ID NO: 2297551 - DNA, 19 bp, Homo sapiens
atcctttgactgtgctgga

SEQ ID NO: 2297552 - DNA, 21 bp, Homo sapiens
atccttttgcttcatctggag

SEQ ID NO: 2297553 - DNA, 21 bp, Homo sapiens
atcggggaggttttctccccc

SEQ ID NO: 2297554 - DNA, 18 bp, Homo sapiens
atcgtttcacatctgtat

SEQ ID NO: 2297555 - DNA, 23 bp, Homo sapiens
atctaagtcagtttcacatattt

SEQ ID NO: 2297556 - DNA, 18 bp, Homo sapiens
atctacgtctttattaca

SEQ ID NO: 2297557 - DNA, 15 bp, Homo sapiens
atctattttctatgt

SEQ ID NO: 2297558 - DNA, 18 bp, Homo sapiens
atctattttctatgtact

SEQ ID NO: 2297559 - DNA, 20 bp, Homo sapiens
atctcacttcagttgtggcc

SEQ ID NO: 2297560 - DNA, 14 bp, Homo sapiens
atctcagcttgctg

SEQ ID NO: 2297561 - DNA, 19 bp, Homo sapiens
atctccagccaatttcaaa

SEQ ID NO: 2297562 - DNA, 12 bp, Homo sapiens
atctccatttct

SEQ ID NO: 2297563 - DNA, 21 bp, Homo sapiens
atctccatttctgctcagatt

SEQ ID NO: 2297564 - DNA, 17 bp, Homo sapiens
atctctaaaattctagt

SEQ ID NO: 2297565 - DNA, 23 bp, Homo sapiens
atctctactttcctgatgttgat

SEQ ID NO: 2297566 - DNA, 22 bp, Homo sapiens
atctctcgtgattgataagaac

SEQ ID NO: 2297567 - DNA, 11 bp, Homo sapiens
atctctgagac

SEQ ID NO: 2297568 - DNA, 18 bp, Homo sapiens
atctctgattaaatttaa

SEQ ID NO: 2297569 - DNA, 21 bp, Homo sapiens
atctctgtgactcgcttagct

SEQ ID NO: 2297570 - DNA, 17 bp, Homo sapiens
atctcttgtaccagccc

SEQ ID NO: 2297571 - DNA, 20 bp, Homo sapiens
atctctttagatccaaaata

SEQ ID NO: 2297572 - DNA, 18 bp, Homo sapiens
atctctttccatcttact

SEQ ID NO: 2297573 - DNA, 14 bp, Homo sapiens
atctgaaaagaaat

SEQ ID NO: 2297574 - DNA, 12 bp, Homo sapiens
atctgaaatcta

SEQ ID NO: 2297575 - DNA, 15 bp, Homo sapiens
atctgaaatctacaa

SEQ ID NO: 2297576 - DNA, 13 bp, Homo sapiens
atctgatttgcat

SEQ ID NO: 2297577 - DNA, 21 bp, Homo sapiens
atctgatttgcatattcattc

SEQ ID NO: 2297578 - DNA, 15 bp, Homo sapiens
atctgctgagctctg

SEQ ID NO: 2297579 - DNA, 20 bp, Homo sapiens
atctgctgagctctgacctg

SEQ ID NO: 2297580 - DNA, 21 bp, Homo sapiens
atctgctgcctctgaaaatat

SEQ ID NO: 2297581 - DNA, 17 bp, Homo sapiens
atctgctgggctggcgg

SEQ ID NO: 2297582 - DNA, 20 bp, Homo sapiens
atctggagctggcactgtgg

SEQ ID NO: 2297583 - DNA, 13 bp, Homo sapiens
atctggagtccct

SEQ ID NO: 2297584 - DNA, 16 bp, Homo sapiens
atctgggttttagaaa

SEQ ID NO: 2297585 - DNA, 21 bp, Homo sapiens
atctgtatatcagctctaaag

SEQ ID NO: 2297586 - DNA, 15 bp, Homo sapiens
atctgtctgattcta

SEQ ID NO: 2297587 - DNA, 19 bp, Homo sapiens
atctgtgaatcctttgtac

SEQ ID NO: 2297588 - DNA, 14 bp, Homo sapiens
atctgttactccaa

SEQ ID NO: 2297589 - DNA, 16 bp, Homo sapiens
atctgtttctatgtcc

SEQ ID NO: 2297590 - DNA, 22 bp, Homo sapiens
atcttaattactttcagaatat

SEQ ID NO: 2297591 - DNA, 13 bp, Homo sapiens
atcttacaagttt

SEQ ID NO: 2297592 - DNA, 14 bp, Homo sapiens
atcttacaagttta

SEQ ID NO: 2297593 - DNA, 17 bp, Homo sapiens
atcttatttatatatga

SEQ ID NO: 2297594 - DNA, 23 bp, Homo sapiens
atcttccctttcctcccttctga

SEQ ID NO: 2297595 - DNA, 17 bp, Homo sapiens
atcttgaagacttttct

SEQ ID NO: 2297596 - DNA, 18 bp, Homo sapiens
atcttgaattgtaaggaa

SEQ ID NO: 2297597 - DNA, 15 bp, Homo sapiens
atcttggaatcatgc

SEQ ID NO: 2297598 - DNA, 22 bp, Homo sapiens
atgaaatatttgcttatttata

SEQ ID NO: 2297599 - DNA, 22 bp, Homo sapiens
atgaacagttctcccttcaact

SEQ ID NO: 2297600 - DNA, 15 bp, Homo sapiens
atgaactcaatgcat

SEQ ID NO: 2297601 - DNA, 17 bp, Homo sapiens
atgaactcaatgcatga

SEQ ID NO: 2297602 - DNA, 16 bp, Homo sapiens
atgaactgtatattat

SEQ ID NO: 2297603 - DNA, 17 bp, Homo sapiens
atgaactgtatattatt

SEQ ID NO: 2297604 - DNA, 23 bp, Homo sapiens
atgaataattgaggttaggaacc

SEQ ID NO: 2297605 - DNA, 18 bp, Homo sapiens
atgaatacgtcttgatca

SEQ ID NO: 2297606 - DNA, 17 bp, Homo sapiens
atgaatagtacatgcag

SEQ ID NO: 2297607 - DNA, 20 bp, Homo sapiens
atgaatcagtatgaagacac

SEQ ID NO: 2297608 - DNA, 20 bp, Homo sapiens
atgaatgcctttcaaacatt

SEQ ID NO: 2297609 - DNA, 20 bp, Homo sapiens
atgaatgtcagtgtgactga

SEQ ID NO: 2297610 - DNA, 23 bp, Homo sapiens
atgaattgggggaggacacattt

SEQ ID NO: 2297611 - DNA, 22 bp, Homo sapiens
atgacacataaatctgtctgat

SEQ ID NO: 2297612 - DNA, 18 bp, Homo sapiens
atgacacgaatattgctg

SEQ ID NO: 2297613 - DNA, 19 bp, Homo sapiens
atgacacgaatattgctga

SEQ ID NO: 2297614 - DNA, 20 bp, Homo sapiens
atgacacgaatattgctgat

SEQ ID NO: 2297615 - DNA, 19 bp, Homo sapiens
atgacagaatttgtgaata

SEQ ID NO: 2297616 - DNA, 16 bp, Homo sapiens
atgaccaatctctgtg

SEQ ID NO: 2297617 - DNA, 13 bp, Homo sapiens
atgacctaaatcc

SEQ ID NO: 2297618 - DNA, 14 bp, Homo sapiens
atgacctaaatcca

SEQ ID NO: 2297619 - DNA, 21 bp, Homo sapiens
atgacctaaatccattttcta

SEQ ID NO: 2297620 - DNA, 15 bp, Homo sapiens
atgacctttcaatag

SEQ ID NO: 2297621 - DNA, 21 bp, Homo sapiens
atgacctttcaataggaaaaa

SEQ ID NO: 2297622 - DNA, 22 bp, Homo sapiens
atgacctttcaataggaaaaac

SEQ ID NO: 2297623 - DNA, 23 bp, Homo sapiens
atgacctttcaataggaaaaact

SEQ ID NO: 2297624 - DNA, 12 bp, Homo sapiens
atgactccagaa

SEQ ID NO: 2297625 - DNA, 17 bp, Homo sapiens
atgactccagaatttcc

SEQ ID NO: 2297626 - DNA, 16 bp, Homo sapiens
atgactcttcttatca

SEQ ID NO: 2297627 - DNA, 21 bp, Homo sapiens
atgactcttcttatcacactt

SEQ ID NO: 2297628 - DNA, 12 bp, Homo sapiens
atgagaaatcat

SEQ ID NO: 2297629 - DNA, 15 bp, Homo sapiens
atgagaaatcatgtt

SEQ ID NO: 2297630 - DNA, 18 bp, Homo sapiens
atgagacctcccccaggg

SEQ ID NO: 2297631 - DNA, 21 bp, Homo sapiens
atgtcaaaaatatttttatgt

SEQ ID NO: 2297632 - DNA, 15 bp, Homo sapiens
atgtcagtctgtcca

SEQ ID NO: 2297633 - DNA, 13 bp, Homo sapiens
atgtcagtgtgac

SEQ ID NO: 2297634 - DNA, 22 bp, Homo sapiens
atgtcatactctgtgtaatctc

SEQ ID NO: 2297635 - DNA, 23 bp, Homo sapiens
atgtcatgaaagcacctgccctc

SEQ ID NO: 2297636 - DNA, 23 bp, Homo sapiens
atgtcctaggggccgagggaaat

SEQ ID NO: 2297637 - DNA, 18 bp, Homo sapiens
atgtcctggaagtgtgtg

SEQ ID NO: 2297638 - DNA, 18 bp, Homo sapiens
atgtgatctgtcttgtaa

SEQ ID NO: 2297639 - DNA, 17 bp, Homo sapiens
atgtgatgagaggaaat

SEQ ID NO: 2297640 - DNA, 21 bp, Homo sapiens
atgtgcagacactcaagagcc

SEQ ID NO: 2297641 - DNA, 16 bp, Homo sapiens
atgtgcccaggggagc

SEQ ID NO: 2297642 - DNA, 16 bp, Homo sapiens
atgtgcttcattgttt

SEQ ID NO: 2297643 - DNA, 20 bp, Homo sapiens
atgtgcttttccatctaaaa

SEQ ID NO: 2297644 - DNA, 20 bp, Homo sapiens
atgtggagttcatcttgaat

SEQ ID NO: 2297645 - DNA, 17 bp, Homo sapiens
atgtggctccccctgaa

SEQ ID NO: 2297646 - DNA, 16 bp, Homo sapiens
atgtggcttcttcaac

SEQ ID NO: 2297647 - DNA, 16 bp, Homo sapiens
atgtgggaagttacct

SEQ ID NO: 2297648 - DNA, 17 bp, Homo sapiens
atgtgggaagttacctt

SEQ ID NO: 2297649 - DNA, 15 bp, Homo sapiens
atgtgtacagaaaca

SEQ ID NO: 2297650 - DNA, 16 bp, Homo sapiens
atgtgtacagaaacaa

SEQ ID NO: 2297651 - DNA, 22 bp, Homo sapiens
atgtgtgctcttatccccagct

SEQ ID NO: 2297652 - DNA, 16 bp, Homo sapiens
atgtgttgcaaattat

SEQ ID NO: 2297653 - DNA, 20 bp, Homo sapiens
atgtgttgcaaattattcta

SEQ ID NO: 2297654 - DNA, 18 bp, Homo sapiens
atgttagtgttttaagaa

SEQ ID NO: 2297655 - DNA, 15 bp, Homo sapiens
atgttattttcagtg

SEQ ID NO: 2297656 - DNA, 17 bp, Homo sapiens
atgttattttcagtgct

SEQ ID NO: 2297657 - DNA, 21 bp, Homo sapiens
atgttattttcagtgctttgc

SEQ ID NO: 2297658 - DNA, 14 bp, Homo sapiens
atgtttacattttc

SEQ ID NO: 2297659 - DNA, 18 bp, Homo sapiens
atgtttacattttctttc

SEQ ID NO: 2297660 - DNA, 18 bp, Homo sapiens
atgtttcattattctttc

SEQ ID NO: 2297661 - DNA, 21 bp, Homo sapiens
atgtttctgcagtattctgta

SEQ ID NO: 2297662 - DNA, 13 bp, Homo sapiens
atgtttctttttc

SEQ ID NO: 2297663 - DNA, 21 bp, Homo sapiens
atgtttttctcaaaaagctgc

SEQ ID NO: 2297664 - DNA, 23 bp, Homo sapiens
atgtttttgttttgctttttaaa

SEQ ID NO: 2297665 - DNA, 22 bp, Homo sapiens
attaaaaatatacaatttcttg

SEQ ID NO: 2297666 - DNA, 19 bp, Homo sapiens
attaaaacacaacatcttt

SEQ ID NO: 2297667 - DNA, 23 bp, Homo sapiens
attaaaacacaacatctttttct

SEQ ID NO: 2297668 - DNA, 13 bp, Homo sapiens
attaaaattagtg

SEQ ID NO: 2297669 - DNA, 14 bp, Homo sapiens
attaaaattagtga

SEQ ID NO: 2297670 - DNA, 17 bp, Homo sapiens
attaaatttaatatact

SEQ ID NO: 2297671 - DNA, 19 bp, Homo sapiens
attaaatttaatatactgc

SEQ ID NO: 2297672 - DNA, 21 bp, Homo sapiens
attaaccaaattaacctttca

SEQ ID NO: 2297673 - DNA, 16 bp, Homo sapiens
attaacctttcaggaa

SEQ ID NO: 2297674 - DNA, 21 bp, Homo sapiens
attaatacttccttataaaaa

SEQ ID NO: 2297675 - DNA, 22 bp, Homo sapiens
attaatagtaggattattccta

SEQ ID NO: 2297676 - DNA, 23 bp, Homo sapiens
attaatagtaggattattcctag

SEQ ID NO: 2297677 - DNA, 21 bp, Homo sapiens
attaatatgtacttttccatt

SEQ ID NO: 2297678 - DNA, 12 bp, Homo sapiens
attaatctctaa

SEQ ID NO: 2297679 - DNA, 13 bp, Homo sapiens
attaatctctaaa

SEQ ID NO: 2297680 - DNA, 19 bp, Homo sapiens
attaatctctaaaattcta

SEQ ID NO: 2297681 - DNA, 20 bp, Homo sapiens
attaatctctaaaattctag

SEQ ID NO: 2297682 - DNA, 12 bp, Homo sapiens
attaatttgtgt

SEQ ID NO: 2297683 - DNA, 13 bp, Homo sapiens
attacaaacaaag

SEQ ID NO: 2297684 - DNA, 17 bp, Homo sapiens
attacaaacaaaggatt

SEQ ID NO: 2297685 - DNA, 19 bp, Homo sapiens
attacaaccggttatcagt

SEQ ID NO: 2297686 - DNA, 15 bp, Homo sapiens
attacacaaactatg

SEQ ID NO: 2297687 - DNA, 14 bp, Homo sapiens
attacatcctctgc

SEQ ID NO: 2297688 - DNA, 13 bp, Homo sapiens
attacattaaaat

SEQ ID NO: 2297689 - DNA, 13 bp, Homo sapiens
attacattatgcc

SEQ ID NO: 2297690 - DNA, 17 bp, Homo sapiens
attacatttcatttata

SEQ ID NO: 2297691 - DNA, 20 bp, Homo sapiens
attagaaaatgtatttatag

SEQ ID NO: 2297692 - DNA, 17 bp, Homo sapiens
attagactgaatttaac

SEQ ID NO: 2297693 - DNA, 21 bp, Homo sapiens
attagctctcgcctcaggctt

SEQ ID NO: 2297694 - DNA, 13 bp, Homo sapiens
attagtccctggc

SEQ ID NO: 2297695 - DNA, 20 bp, Homo sapiens
attagttaggtgtgccaaac

SEQ ID NO: 2297696 - DNA, 15 bp, Homo sapiens
attataatgcatcta

SEQ ID NO: 2297697 - DNA, 18 bp, Homo sapiens
attataatgcatctaaac

SEQ ID NO: 2297698 - DNA, 15 bp, Homo sapiens
attatagtctgtact

SEQ ID NO: 2297699 - DNA, 17 bp, Homo sapiens
attatatacaaagctgt

SEQ ID NO: 2297700 - DNA, 16 bp, Homo sapiens
attatattatgaataa

SEQ ID NO: 2297701 - DNA, 13 bp, Homo sapiens
attatcaaagcat

SEQ ID NO: 2297702 - DNA, 15 bp, Homo sapiens
attatcaaagcattg

SEQ ID NO: 2297703 - DNA, 19 bp, Homo sapiens
attatccatcctctgagat

SEQ ID NO: 2297704 - DNA, 14 bp, Homo sapiens
attatcctgtgtga

SEQ ID NO: 2297705 - DNA, 18 bp, Homo sapiens
attatcctgtgtgattac

SEQ ID NO: 2297706 - DNA, 15 bp, Homo sapiens
attatgaagatgttt

SEQ ID NO: 2297707 - DNA, 15 bp, Homo sapiens
attatgtataacaag

SEQ ID NO: 2297708 - DNA, 14 bp, Homo sapiens
attatgtatagaaa

SEQ ID NO: 2297709 - DNA, 16 bp, Homo sapiens
attatgtatagaaaat

SEQ ID NO: 2297710 - DNA, 17 bp, Homo sapiens
attattacactgtaaga

SEQ ID NO: 2297711 - DNA, 17 bp, Homo sapiens
attattattttaaaaat

SEQ ID NO: 2297712 - DNA, 23 bp, Homo sapiens
attattctagtcaactgctgttt

SEQ ID NO: 2297713 - DNA, 16 bp, Homo sapiens
attattgaatgttata

SEQ ID NO: 2297714 - DNA, 23 bp, Homo sapiens
attattgctatatttgctaatac

SEQ ID NO: 2297715 - DNA, 16 bp, Homo sapiens
attattgctgttgctt

SEQ ID NO: 2297716 - DNA, 19 bp, Homo sapiens
attattgctgttgcttgaa

SEQ ID NO: 2297717 - DNA, 14 bp, Homo sapiens
attatttaactaat

SEQ ID NO: 2297718 - DNA, 14 bp, Homo sapiens
attattttaaaaat

SEQ ID NO: 2297719 - DNA, 13 bp, Homo sapiens
attattttctata

SEQ ID NO: 2297720 - DNA, 18 bp, Homo sapiens
attattttctatatttgg

SEQ ID NO: 2297721 - DNA, 18 bp, Homo sapiens
attattttgtcataaaat

SEQ ID NO: 2297722 - DNA, 21 bp, Homo sapiens
attattttgtcataaaatgct

SEQ ID NO: 2297723 - DNA, 23 bp, Homo sapiens
attattttgtcataaaatgctat

SEQ ID NO: 2297724 - DNA, 11 bp, Homo sapiens
attcaacaaat

SEQ ID NO: 2297725 - DNA, 13 bp, Homo sapiens
attcaacaaatga

SEQ ID NO: 2297726 - DNA, 14 bp, Homo sapiens
attcaacacttatt

SEQ ID NO: 2297727 - DNA, 19 bp, Homo sapiens
attcaacacttattttctg

SEQ ID NO: 2297728 - DNA, 18 bp, Homo sapiens
attcaacaggttttcctg

SEQ ID NO: 2297729 - DNA, 23 bp, Homo sapiens
attcacactgtgcgttttagagt

SEQ ID NO: 2297730 - DNA, 21 bp, Homo sapiens
attcagagatgtaccatgtta

SEQ ID NO: 2297731 - DNA, 17 bp, Homo sapiens
attcagcctcgtctctt

SEQ ID NO: 2297732 - DNA, 14 bp, Homo sapiens
attcagctttgtcc

SEQ ID NO: 2297733 - DNA, 17 bp, Homo sapiens
attcagtcctgggcaaa

SEQ ID NO: 2297734 - DNA, 16 bp, Homo sapiens
attcagttgttagtgt

SEQ ID NO: 2297735 - DNA, 23 bp, Homo sapiens
attcagttttagtttcaaaatgt

SEQ ID NO: 2297736 - DNA, 15 bp, Homo sapiens
attcatactaaataa

SEQ ID NO: 2297737 - DNA, 19 bp, Homo sapiens
attcatactaaataaaaca

SEQ ID NO: 2297738 - DNA, 14 bp, Homo sapiens
attcatactttcca

SEQ ID NO: 2297739 - DNA, 18 bp, Homo sapiens
attcatatttatgaatct

SEQ ID NO: 2297740 - DNA, 22 bp, Homo sapiens
attcatctgttgacaatttgcc

SEQ ID NO: 2297741 - DNA, 18 bp, Homo sapiens
attcatggaactttcata

SEQ ID NO: 2297742 - DNA, 20 bp, Homo sapiens
attcatgtgtacagaaacaa

SEQ ID NO: 2297743 - DNA, 15 bp, Homo sapiens
attcattacatcctc

SEQ ID NO: 2297744 - DNA, 13 bp, Homo sapiens
attcattctttat

SEQ ID NO: 2297745 - DNA, 14 bp, Homo sapiens
attcatttacaact

SEQ ID NO: 2297746 - DNA, 20 bp, Homo sapiens
attcatttacaacttccaga

SEQ ID NO: 2297747 - DNA, 22 bp, Homo sapiens
attccaacccaggtctgctttg

SEQ ID NO: 2297748 - DNA, 18 bp, Homo sapiens
attccaagggcccagagg

SEQ ID NO: 2297749 - DNA, 13 bp, Homo sapiens
attccacacattt

SEQ ID NO: 2297750 - DNA, 20 bp, Homo sapiens
attccaccaggattaatctc

SEQ ID NO: 2297751 - DNA, 23 bp, Homo sapiens
attccaccaggattaatctctaa

SEQ ID NO: 2297752 - DNA, 19 bp, Homo sapiens
attccactgaaacctctgt

SEQ ID NO: 2297753 - DNA, 22 bp, Homo sapiens
attccactgaaacctctgttct

SEQ ID NO: 2297754 - DNA, 16 bp, Homo sapiens
attccagaacgccctg

SEQ ID NO: 2297755 - DNA, 19 bp, Homo sapiens
attccagaacgccctgtgt

SEQ ID NO: 2297756 - DNA, 20 bp, Homo sapiens
attccagaacgccctgtgtc

SEQ ID NO: 2297757 - DNA, 17 bp, Homo sapiens
attccagcgtctgctgt

SEQ ID NO: 2297758 - DNA, 19 bp, Homo sapiens
attccagttgtatttgaag

SEQ ID NO: 2297759 - DNA, 23 bp, Homo sapiens
attccctttttcaccctattttc

SEQ ID NO: 2297760 - DNA, 15 bp, Homo sapiens
attctaaaacattct

SEQ ID NO: 2297761 - DNA, 16 bp, Homo sapiens
attctaaaacattctt

SEQ ID NO: 2297762 - DNA, 19 bp, Homo sapiens
attctaaaacattctttaa

SEQ ID NO: 2297763 - DNA, 17 bp, Homo sapiens
attctaagattgtacat

SEQ ID NO: 2297764 - DNA, 23 bp, Homo sapiens
attctaagattgtacatatggaa

SEQ ID NO: 2297765 - DNA, 14 bp, Homo sapiens
attctagtcaactg

SEQ ID NO: 2297766 - DNA, 22 bp, Homo sapiens
attctagtcaactgctgtttta

SEQ ID NO: 2297767 - DNA, 16 bp, Homo sapiens
attctagtctctgatt

SEQ ID NO: 2297768 - DNA, 23 bp, Homo sapiens
attctagtctctgatttgcaaat

SEQ ID NO: 2297769 - DNA, 14 bp, Homo sapiens
attctataaattca

SEQ ID NO: 2297770 - DNA, 16 bp, Homo sapiens
attctatgcctgtatt

SEQ ID NO: 2297771 - DNA, 20 bp, Homo sapiens
attctatgcctgtatttcca

SEQ ID NO: 2297772 - DNA, 16 bp, Homo sapiens
attctgacagagcaag

SEQ ID NO: 2297773 - DNA, 21 bp, Homo sapiens
attctgaccagagctatgaat

SEQ ID NO: 2297774 - DNA, 17 bp, Homo sapiens
attctgctaatttatga

SEQ ID NO: 2297775 - DNA, 21 bp, Homo sapiens
attctgctaatttatgaagat

SEQ ID NO: 2297776 - DNA, 13 bp, Homo sapiens
attctgctgcccc

SEQ ID NO: 2297777 - DNA, 16 bp, Homo sapiens
attctgctgcccccag

SEQ ID NO: 2297778 - DNA, 19 bp, Homo sapiens
attctgtagccaacttaaa

SEQ ID NO: 2297779 - DNA, 16 bp, Homo sapiens
attctgtgcataaaag

SEQ ID NO: 2297780 - DNA, 20 bp, Homo sapiens
attctgtgcataaaagttaa

SEQ ID NO: 2297781 - DNA, 15 bp, Homo sapiens
attctgtggattcta

SEQ ID NO: 2297782 - DNA, 16 bp, Homo sapiens
attctgtggattctat

SEQ ID NO: 2297783 - DNA, 21 bp, Homo sapiens
attctgttgttcagtcctctg

SEQ ID NO: 2297784 - DNA, 22 bp, Homo sapiens
attctgttgttcagtcctctgc

SEQ ID NO: 2297785 - DNA, 14 bp, Homo sapiens
attcttaaatatgt

SEQ ID NO: 2297786 - DNA, 20 bp, Homo sapiens
attcttgctttcacaaatat

SEQ ID NO: 2297787 - DNA, 17 bp, Homo sapiens
attctttctctttgaaa

SEQ ID NO: 2297788 - DNA, 15 bp, Homo sapiens
attcttttatataac

SEQ ID NO: 2297789 - DNA, 23 bp, Homo sapiens
attcttttatataactacattaa

SEQ ID NO: 2297790 - DNA, 18 bp, Homo sapiens
attcttttcagcttgttt

SEQ ID NO: 2297791 - DNA, 22 bp, Homo sapiens
attcttttcagcttgtttctat

SEQ ID NO: 2297792 - DNA, 22 bp, Homo sapiens
attcttttgaaagatggtaatc

SEQ ID NO: 2297793 - DNA, 18 bp, Homo sapiens
attgaaatctttttgctt

SEQ ID NO: 2297794 - DNA, 17 bp, Homo sapiens
attgaaccgtcaatgtg

SEQ ID NO: 2297795 - DNA, 21 bp, Homo sapiens
attgaaccgtcaatgtgaaat

SEQ ID NO: 2297796 - DNA, 22 bp, Homo sapiens
attgaaccgtcaatgtgaaata

SEQ ID NO: 2297797 - DNA, 14 bp, Homo sapiens
attgaatgttatat

SEQ ID NO: 2297798 - DNA, 16 bp, Homo sapiens
attgagatactttttc

SEQ ID NO: 2297799 - DNA, 14 bp, Homo sapiens
attgagggaaaaca

SEQ ID NO: 2297800 - DNA, 22 bp, Homo sapiens
attgagtaatattacatttcat

SEQ ID NO: 2297801 - DNA, 22 bp, Homo sapiens
attgcacttgattaagcttttg

SEQ ID NO: 2297802 - DNA, 15 bp, Homo sapiens
attgctgacagagcc

SEQ ID NO: 2297803 - DNA, 16 bp, Homo sapiens
attgctgatggtgcaa

SEQ ID NO: 2297804 - DNA, 23 bp, Homo sapiens
attgctgatggtgcaatgacctt

SEQ ID NO: 2297805 - DNA, 12 bp, Homo sapiens
attgctgttgct

SEQ ID NO: 2297806 - DNA, 18 bp, Homo sapiens
attggtctatctactggc

SEQ ID NO: 2297807 - DNA, 19 bp, Homo sapiens
attgtacatatggaaatcc

SEQ ID NO: 2297808 - DNA, 13 bp, Homo sapiens
attgtagaacata

SEQ ID NO: 2297809 - DNA, 18 bp, Homo sapiens
attgtagagcacatttag

SEQ ID NO: 2297810 - DNA, 21 bp, Homo sapiens
attgtaggtcaatgaaatatt

SEQ ID NO: 2297811 - DNA, 21 bp, Homo sapiens
attgtattcctcacattcaca

SEQ ID NO: 2297812 - DNA, 13 bp, Homo sapiens
attgtctgctgcc

SEQ ID NO: 2297813 - DNA, 13 bp, Homo sapiens
attgtggctttat

SEQ ID NO: 2297814 - DNA, 24 bp, Homo sapiens
attgtgtaaattcctgttgtctga

SEQ ID NO: 2297815 - DNA, 14 bp, Homo sapiens
attgtgtaactgtt

SEQ ID NO: 2297816 - DNA, 17 bp, Homo sapiens
attgtgtaagaatcact

SEQ ID NO: 2297817 - DNA, 19 bp, Homo sapiens
attgtgttgatttctttcc

SEQ ID NO: 2297818 - DNA, 13 bp, Homo sapiens
attgttaaaacct

SEQ ID NO: 2297819 - DNA, 18 bp, Homo sapiens
attgttgaatgtattctt

SEQ ID NO: 2297820 - DNA, 17 bp, Homo sapiens
attgttggcacagaaca

SEQ ID NO: 2297821 - DNA, 14 bp, Homo sapiens
attgtttaaaagca

SEQ ID NO: 2297822 - DNA, 19 bp, Homo sapiens
atttaaaaaatgaatagta

SEQ ID NO: 2297823 - DNA, 19 bp, Homo sapiens
atttaaaaagcccaacctc

SEQ ID NO: 2297824 - DNA, 14 bp, Homo sapiens
atttaaaaatcttt

SEQ ID NO: 2297825 - DNA, 19 bp, Homo sapiens
atttaaaaatctttcagaa

SEQ ID NO: 2297826 - DNA, 15 bp, Homo sapiens
atttaaaggaaagtt

SEQ ID NO: 2297827 - DNA, 17 bp, Homo sapiens
atttaactgcatataga

SEQ ID NO: 2297828 - DNA, 14 bp, Homo sapiens
atttaatatactgc

SEQ ID NO: 2297829 - DNA, 21 bp, Homo sapiens
atttaatatactgcatatcct

SEQ ID NO: 2297830 - DNA, 14 bp, Homo sapiens
atttaattatatta

SEQ ID NO: 2297831 - DNA, 17 bp, Homo sapiens
atttaattgtgtaactg

SEQ ID NO: 2297832 - DNA, 18 bp, Homo sapiens
atttaattgtgtaactgt

SEQ ID NO: 2297833 - DNA, 18 bp, Homo sapiens
atttaatttctaatttca

SEQ ID NO: 2297834 - DNA, 18 bp, Homo sapiens
atttacaacttccagatt

SEQ ID NO: 2297835 - DNA, 21 bp, Homo sapiens
atttacaacttccagatttga

SEQ ID NO: 2297836 - DNA, 15 bp, Homo sapiens
atttactgtgctaat

SEQ ID NO: 2297837 - DNA, 17 bp, Homo sapiens
atttagaacctgcattt

SEQ ID NO: 2297838 - DNA, 20 bp, Homo sapiens
atttagataacaagaataca

SEQ ID NO: 2297839 - DNA, 17 bp, Homo sapiens
atttagccagaatgttt

SEQ ID NO: 2297840 - DNA, 19 bp, Homo sapiens
atttatactgtagcaatat

SEQ ID NO: 2297841 - DNA, 20 bp, Homo sapiens
atttatactgtagcaatata

SEQ ID NO: 2297842 - DNA, 14 bp, Homo sapiens
atttatattagagt

SEQ ID NO: 2297843 - DNA, 16 bp, Homo sapiens
atttatattagagtgc

SEQ ID NO: 2297844 - DNA, 20 bp, Homo sapiens
atttatattagagtgccctt

SEQ ID NO: 2297845 - DNA, 14 bp, Homo sapiens
atttatctgtgaat

SEQ ID NO: 2297846 - DNA, 19 bp, Homo sapiens
atttattaccgataaatga

SEQ ID NO: 2297847 - DNA, 23 bp, Homo sapiens
atttattcatgtgtacagaaaca

SEQ ID NO: 2297848 - DNA, 11 bp, Homo sapiens
atttcaaatgc

SEQ ID NO: 2297849 - DNA, 17 bp, Homo sapiens
atttcaataacttagaa

SEQ ID NO: 2297850 - DNA, 17 bp, Homo sapiens
atttcaatgattgttta

SEQ ID NO: 2297851 - DNA, 15 bp, Homo sapiens
atttcacagtattta

SEQ ID NO: 2297852 - DNA, 23 bp, Homo sapiens
atttcacgggcaacactcactgc

SEQ ID NO: 2297853 - DNA, 19 bp, Homo sapiens
atttcagagagcttcaact

SEQ ID NO: 2297854 - DNA, 14 bp, Homo sapiens
atttcaggattctc

SEQ ID NO: 2297855 - DNA, 22 bp, Homo sapiens
atttcaggttaaattaaaccaa

SEQ ID NO: 2297856 - DNA, 20 bp, Homo sapiens
atttcatgactggtgcgttc

SEQ ID NO: 2297857 - DNA, 23 bp, Homo sapiens
atttcatgttagtcttaccgaat

SEQ ID NO: 2297858 - DNA, 20 bp, Homo sapiens
atttcatttatactgtagca

SEQ ID NO: 2297859 - DNA, 21 bp, Homo sapiens
atttcatttatactgtagcaa

SEQ ID NO: 2297860 - DNA, 14 bp, Homo sapiens
atttccaaactgtt

SEQ ID NO: 2297861 - DNA, 15 bp, Homo sapiens
atttccaaactgttg

SEQ ID NO: 2297862 - DNA, 15 bp, Homo sapiens
atttccaccaagggt

SEQ ID NO: 2297863 - DNA, 22 bp, Homo sapiens
atttccctaaggagcctgggat

SEQ ID NO: 2297864 - DNA, 23 bp, Homo sapiens
atttcctccacattcatgtacaa

SEQ ID NO: 2297865 - DNA, 18 bp, Homo sapiens
atttctaactaaggacag

SEQ ID NO: 2297866 - DNA, 16 bp, Homo sapiens
atttctaagcttattt

SEQ ID NO: 2297867 - DNA, 21 bp, Homo sapiens
atttctaagcttatttctaac

SEQ ID NO: 2297868 - DNA, 18 bp, Homo sapiens
atttctagcagtatgtgt

SEQ ID NO: 2297869 - DNA, 13 bp, Homo sapiens
atttctatctgca

SEQ ID NO: 2297870 - DNA, 15 bp, Homo sapiens
atttctatctgcaaa

SEQ ID NO: 2297871 - DNA, 18 bp, Homo sapiens
atttctattttgcagcag

SEQ ID NO: 2297872 - DNA, 18 bp, Homo sapiens
atttctcatttagcattg

SEQ ID NO: 2297873 - DNA, 13 bp, Homo sapiens
atttctgcaaaca

SEQ ID NO: 2297874 - DNA, 19 bp, Homo sapiens
atttcttatttgaaagtgt

SEQ ID NO: 2297875 - DNA, 10 bp, Homo sapiens
atttgaaagt

SEQ ID NO: 2297876 - DNA, 22 bp, Homo sapiens
atttgaaagtttccttattttc

SEQ ID NO: 2297877 - DNA, 17 bp, Homo sapiens
atttgatatacagacct

SEQ ID NO: 2297878 - DNA, 21 bp, Homo sapiens
atttgatatacagacctccag

SEQ ID NO: 2297879 - DNA, 22 bp, Homo sapiens
atttgatatacagacctccaga

SEQ ID NO: 2297880 - DNA, 23 bp, Homo sapiens
atttgatatacagacctccagat

SEQ ID NO: 2297881 - DNA, 13 bp, Homo sapiens
atttgcaaatgca

SEQ ID NO: 2297882 - DNA, 23 bp, Homo sapiens
atttgctaataccaactatttca

SEQ ID NO: 2297883 - DNA, 13 bp, Homo sapiens
atttggattcaca

SEQ ID NO: 2297884 - DNA, 15 bp, Homo sapiens
atttggattcacagc

SEQ ID NO: 2297885 - DNA, 14 bp, Homo sapiens
atttggctcgctgt

SEQ ID NO: 2297886 - DNA, 14 bp, Homo sapiens
atttggggacagat

SEQ ID NO: 2297887 - DNA, 19 bp, Homo sapiens
atttggggacagattcagt

SEQ ID NO: 2297888 - DNA, 22 bp, Homo sapiens
atttggggacagattcagtctt

SEQ ID NO: 2297889 - DNA, 22 bp, Homo sapiens
atttggtgtttgcttgaatgct

SEQ ID NO: 2297890 - DNA, 12 bp, Homo sapiens
atttgtagatat

SEQ ID NO: 2297891 - DNA, 16 bp, Homo sapiens
atttgtagatatatat

SEQ ID NO: 2297892 - DNA, 18 bp, Homo sapiens
atttgtagatatatattt

SEQ ID NO: 2297893 - DNA, 16 bp, Homo sapiens
atttgtaggtatacta

SEQ ID NO: 2297894 - DNA, 15 bp, Homo sapiens
caacccccacctccc

SEQ ID NO: 2297895 - DNA, 18 bp, Homo sapiens
caacccccacctcccggt

SEQ ID NO: 2297896 - DNA, 21 bp, Homo sapiens
caacccctgcagctcctctgc

SEQ ID NO: 2297897 - DNA, 14 bp, Homo sapiens
caaccctgccctgc

SEQ ID NO: 2297898 - DNA, 15 bp, Homo sapiens
caaccctgccctgca

SEQ ID NO: 2297899 - DNA, 16 bp, Homo sapiens
caaccctgccctgcac

SEQ ID NO: 2297900 - DNA, 17 bp, Homo sapiens
caaccctgccctgcacc

SEQ ID NO: 2297901 - DNA, 15 bp, Homo sapiens
caacctcgccctctc

SEQ ID NO: 2297902 - DNA, 16 bp, Homo sapiens
caacctcgccctctct

SEQ ID NO: 2297903 - DNA, 20 bp, Homo sapiens
caacctcgctccaactccaa

SEQ ID NO: 2297904 - DNA, 20 bp, Homo sapiens
caacctcttcctcctgacac

SEQ ID NO: 2297905 - DNA, 17 bp, Homo sapiens
caacctggaggctggac

SEQ ID NO: 2297906 - DNA, 19 bp, Homo sapiens
caacctggaggctggacca

SEQ ID NO: 2297907 - DNA, 23 bp, Homo sapiens
caacctggaggctggaccaactg

SEQ ID NO: 2297908 - DNA, 15 bp, Homo sapiens
caactaagttgtatt

SEQ ID NO: 2297909 - DNA, 16 bp, Homo sapiens
caactaagttgtattt

SEQ ID NO: 2297910 - DNA, 14 bp, Homo sapiens
caactaatttttga

SEQ ID NO: 2297911 - DNA, 17 bp, Homo sapiens
caactatttcaataagt

SEQ ID NO: 2297912 - DNA, 13 bp, Homo sapiens
caactgagatgtt

SEQ ID NO: 2297913 - DNA, 15 bp, Homo sapiens
caactgccaaataaa

SEQ ID NO: 2297914 - DNA, 14 bp, Homo sapiens
caactgctgtttta

SEQ ID NO: 2297915 - DNA, 16 bp, Homo sapiens
caactgctgttttatg

SEQ ID NO: 2297916 - DNA, 17 bp, Homo sapiens
caactgtttttgaagaa

SEQ ID NO: 2297917 - DNA, 22 bp, Homo sapiens
caactgtttttgaagaagggaa

SEQ ID NO: 2297918 - DNA, 14 bp, Homo sapiens
caacttaaacctgt

SEQ ID NO: 2297919 - DNA, 19 bp, Homo sapiens
caacttaaacctgtgcttt

SEQ ID NO: 2297920 - DNA, 17 bp, Homo sapiens
caacttttcatttttgc

SEQ ID NO: 2297921 - DNA, 18 bp, Homo sapiens
caacttttctgctacctg

SEQ ID NO: 2297922 - DNA, 12 bp, Homo sapiens
caagaagaatat

SEQ ID NO: 2297923 - DNA, 14 bp, Homo sapiens
caagaagattctaa

SEQ ID NO: 2297924 - DNA, 19 bp, Homo sapiens
caagaagattctaaaacat

SEQ ID NO: 2297925 - DNA, 17 bp, Homo sapiens
caagaatgtctccattg

SEQ ID NO: 2297926 - DNA, 19 bp, Homo sapiens
caagacttgacgcagcccc

SEQ ID NO: 2297927 - DNA, 21 bp, Homo sapiens
caagagacccctgtctggcag

SEQ ID NO: 2297928 - DNA, 15 bp, Homo sapiens
caagagcccttccag

SEQ ID NO: 2297929 - DNA, 23 bp, Homo sapiens
caagataaacacaatttcttcat

SEQ ID NO: 2297930 - DNA, 14 bp, Homo sapiens
caagatcacaaata

SEQ ID NO: 2297931 - DNA, 14 bp, Homo sapiens
caagcacaaactgt

SEQ ID NO: 2297932 - DNA, 19 bp, Homo sapiens
caagcacaaactgtcgtct

SEQ ID NO: 2297933 - DNA, 18 bp, Homo sapiens
caagcattctgtgcataa

SEQ ID NO: 2297934 - DNA, 16 bp, Homo sapiens
caagccacgttgcaga

SEQ ID NO: 2297935 - DNA, 12 bp, Homo sapiens
caagccagagcc

SEQ ID NO: 2297936 - DNA, 20 bp, Homo sapiens
caagctctggaattgttgaa

SEQ ID NO: 2297937 - DNA, 13 bp, Homo sapiens
caagctgttccac

SEQ ID NO: 2297938 - DNA, 14 bp, Homo sapiens
caagctttaacaga

SEQ ID NO: 2297939 - DNA, 16 bp, Homo sapiens
caagctttaacagact

SEQ ID NO: 2297940 - DNA, 16 bp, Homo sapiens
caaggatcctgagcca

SEQ ID NO: 2297941 - DNA, 17 bp, Homo sapiens
caaggatcctgagccag

SEQ ID NO: 2297942 - DNA, 22 bp, Homo sapiens
caaggatcctgagccagatttc

SEQ ID NO: 2297943 - DNA, 17 bp, Homo sapiens
caaggcaaggctgtcaa

SEQ ID NO: 2297944 - DNA, 23 bp, Homo sapiens
caaggctctgctatacagtctat

SEQ ID NO: 2297945 - DNA, 11 bp, Homo sapiens
caaggctgcta

SEQ ID NO: 2297946 - DNA, 15 bp, Homo sapiens
caaggctgctaagtg

SEQ ID NO: 2297947 - DNA, 19 bp, Homo sapiens
caaggctgctaagtggaag

SEQ ID NO: 2297948 - DNA, 21 bp, Homo sapiens
caaggctgtcaattacaggaa

SEQ ID NO: 2297949 - DNA, 20 bp, Homo sapiens
caaggggtggaagggcagga

SEQ ID NO: 2297950 - DNA, 19 bp, Homo sapiens
caagggtatctgctgcctc

SEQ ID NO: 2297951 - DNA, 18 bp, Homo sapiens
caagtattttatctgtgt

SEQ ID NO: 2297952 - DNA, 20 bp, Homo sapiens
caagtattttatctgtgttg

SEQ ID NO: 2297953 - DNA, 20 bp, Homo sapiens
caagtcacggtctaaacaca

SEQ ID NO: 2297954 - DNA, 15 bp, Homo sapiens
caagtcatgggagaa

SEQ ID NO: 2297955 - DNA, 19 bp, Homo sapiens
caagtcatgggagaagagg

SEQ ID NO: 2297956 - DNA, 21 bp, Homo sapiens
caagtgaaaactgatttccca

SEQ ID NO: 2297957 - DNA, 23 bp, Homo sapiens
caagtgtacatttgatttgatat

SEQ ID NO: 2297958 - DNA, 20 bp, Homo sapiens
caagttacatccgctttatg

SEQ ID NO: 2297959 - DNA, 16 bp, Homo sapiens
caagttcattcatact

SEQ ID NO: 2297960 - DNA, 17 bp, Homo sapiens
caataaagaaaaaaata

SEQ ID NO: 2297961 - DNA, 19 bp, Homo sapiens
caataaagaaaaaaatagt

SEQ ID NO: 2297962 - DNA, 18 bp, Homo sapiens
caatactgccgctgcccc

SEQ ID NO: 2297963 - DNA, 19 bp, Homo sapiens
caatactgccgctgccccc

SEQ ID NO: 2297964 - DNA, 23 bp, Homo sapiens
caatactgccgctgcccccaccc

SEQ ID NO: 2297965 - DNA, 20 bp, Homo sapiens
caatacttttgtgtattctg

SEQ ID NO: 2297966 - DNA, 13 bp, Homo sapiens
caataggaaaaac

SEQ ID NO: 2297967 - DNA, 18 bp, Homo sapiens
caataggaaaaactgatt

SEQ ID NO: 2297968 - DNA, 20 bp, Homo sapiens
caataggaaaaactgatttt

SEQ ID NO: 2297969 - DNA, 17 bp, Homo sapiens
caatagtgttgaggagg

SEQ ID NO: 2297970 - DNA, 14 bp, Homo sapiens
caatcatatgtgat

SEQ ID NO: 2297971 - DNA, 15 bp, Homo sapiens
caatcatatgtgatc

SEQ ID NO: 2297972 - DNA, 13 bp, Homo sapiens
caatcatctagat

SEQ ID NO: 2297973 - DNA, 16 bp, Homo sapiens
caatcatcttctccca

SEQ ID NO: 2297974 - DNA, 23 bp, Homo sapiens
caatgaagataaatgctttaaat

SEQ ID NO: 2297975 - DNA, 22 bp, Homo sapiens
caatgaaggctgaatcaaagac

SEQ ID NO: 2297976 - DNA, 15 bp, Homo sapiens
caatgacctttcaat

SEQ ID NO: 2297977 - DNA, 15 bp, Homo sapiens
caatgatataggaaa

SEQ ID NO: 2297978 - DNA, 17 bp, Homo sapiens
caatgatataggaaaat

SEQ ID NO: 2297979 - DNA, 14 bp, Homo sapiens
caatgcaaaccatc

SEQ ID NO: 2297980 - DNA, 19 bp, Homo sapiens
caatgcaaaccatcattga

SEQ ID NO: 2297981 - DNA, 13 bp, Homo sapiens
caatgcatgatga

SEQ ID NO: 2297982 - DNA, 22 bp, Homo sapiens
caatgcatgatgactcttctta

SEQ ID NO: 2297983 - DNA, 14 bp, Homo sapiens
caattaagcagctt

SEQ ID NO: 2297984 - DNA, 21 bp, Homo sapiens
caattaagttattaacatttg

SEQ ID NO: 2297985 - DNA, 16 bp, Homo sapiens
caattaatgattcaat

SEQ ID NO: 2297986 - DNA, 23 bp, Homo sapiens
caattcagttttagtttcaaaat

SEQ ID NO: 2297987 - DNA, 19 bp, Homo sapiens
caattgcacgtttggtgaa

SEQ ID NO: 2297988 - DNA, 19 bp, Homo sapiens
caattgttcttaaaaccaa

SEQ ID NO: 2297989 - DNA, 15 bp, Homo sapiens
caatttaaaggaaag

SEQ ID NO: 2297990 - DNA, 20 bp, Homo sapiens
caatttatgttaacagatga

SEQ ID NO: 2297991 - DNA, 15 bp, Homo sapiens
caattttaaaaaata

SEQ ID NO: 2297992 - DNA, 18 bp, Homo sapiens
caattttaaaaaataaca

SEQ ID NO: 2297993 - DNA, 19 bp, Homo sapiens
caattttaaaaaataacat

SEQ ID NO: 2297994 - DNA, 14 bp, Homo sapiens
cacaaactgtcgtc

SEQ ID NO: 2297995 - DNA, 14 bp, Homo sapiens
cacaagtgaaaact

SEQ ID NO: 2297996 - DNA, 21 bp, Homo sapiens
cacaatggtagctctgaaggg

SEQ ID NO: 2297997 - DNA, 15 bp, Homo sapiens
cacaattcttttgaa

SEQ ID NO: 2297998 - DNA, 14 bp, Homo sapiens
cacacacagcagct

SEQ ID NO: 2297999 - DNA, 14 bp, Homo sapiens
cacacagcagctcc

SEQ ID NO: 2298000 - DNA, 17 bp, Homo sapiens
cacacaggcccatgccc

SEQ ID NO: 2298001 - DNA, 18 bp, Homo sapiens
cacacaggcccatgccct

SEQ ID NO: 2298002 - DNA, 22 bp, Homo sapiens
cacacatgcatcctcccctctc

SEQ ID NO: 2298003 - DNA, 17 bp, Homo sapiens
cacacattctgtataat

SEQ ID NO: 2298004 - DNA, 16 bp, Homo sapiens
cacacattggccgctt

SEQ ID NO: 2298005 - DNA, 16 bp, Homo sapiens
cacaccccgtctgccc

SEQ ID NO: 2298006 - DNA, 18 bp, Homo sapiens
cacaccccgtctgcccct

SEQ ID NO: 2298007 - DNA, 19 bp, Homo sapiens
cacaccgcaccgggctggc

SEQ ID NO: 2298008 - DNA, 13 bp, Homo sapiens
cacacctgtaatc

SEQ ID NO: 2298009 - DNA, 21 bp, Homo sapiens
cacacgccggggctggccctg

SEQ ID NO: 2298010 - DNA, 17 bp, Homo sapiens
cacactgtggaacacta

SEQ ID NO: 2298011 - DNA, 23 bp, Homo sapiens
cacacttccccttgggatgggca

SEQ ID NO: 2298012 - DNA, 14 bp, Homo sapiens
cacacttgcaaatg

SEQ ID NO: 2298013 - DNA, 16 bp, Homo sapiens
cacacttgcaaatgaa

SEQ ID NO: 2298014 - DNA, 21 bp, Homo sapiens
cacagaacaggaggtgtgaat

SEQ ID NO: 2298015 - DNA, 18 bp, Homo sapiens
cacagacccctgggggag

SEQ ID NO: 2298016 - DNA, 12 bp, Homo sapiens
cacagaggcggt

SEQ ID NO: 2298017 - DNA, 21 bp, Homo sapiens
cacagagtttttcaggagaga

SEQ ID NO: 2298018 - DNA, 14 bp, Homo sapiens
cacagataaaaagt

SEQ ID NO: 2298019 - DNA, 13 bp, Homo sapiens
cacagcagctcca

SEQ ID NO: 2298020 - DNA, 23 bp, Homo sapiens
cacagcagctccaacctggaggc

SEQ ID NO: 2298021 - DNA, 15 bp, Homo sapiens
cacagcatgaacctt

SEQ ID NO: 2298022 - DNA, 21 bp, Homo sapiens
cacagcctcacccctgcaggc

SEQ ID NO: 2298023 - DNA, 22 bp, Homo sapiens
cacagcctcacccctgcaggcg

SEQ ID NO: 2298024 - DNA, 15 bp, Homo sapiens
cacagcctcttcctc

SEQ ID NO: 2298025 - DNA, 21 bp, Homo sapiens
cacagcctttgcgctctgggt

SEQ ID NO: 2298026 - DNA, 19 bp, Homo sapiens
cactgtttcttgcttgtac

SEQ ID NO: 2298027 - DNA, 21 bp, Homo sapiens
cactgtttcttgcttgtacct

SEQ ID NO: 2298028 - DNA, 20 bp, Homo sapiens
cacttagcctttcttttctt

SEQ ID NO: 2298029 - DNA, 17 bp, Homo sapiens
cacttcagttgtggcct

SEQ ID NO: 2298030 - DNA, 16 bp, Homo sapiens
cacttctggggccagc

SEQ ID NO: 2298031 - DNA, 19 bp, Homo sapiens
cacttgacatcaactgcat

SEQ ID NO: 2298032 - DNA, 14 bp, Homo sapiens
cacttgcaaatgaa

SEQ ID NO: 2298033 - DNA, 22 bp, Homo sapiens
cactttcctcttcagatcctgg

SEQ ID NO: 2298034 - DNA, 21 bp, Homo sapiens
cactttcgcctcctccagctc

SEQ ID NO: 2298035 - DNA, 14 bp, Homo sapiens
cagaaaaaaataaa

SEQ ID NO: 2298036 - DNA, 12 bp, Homo sapiens
cagaaaagacac

SEQ ID NO: 2298037 - DNA, 19 bp, Homo sapiens
cagaaaattggcagtggca

SEQ ID NO: 2298038 - DNA, 22 bp, Homo sapiens
cagaaaattggcagtggcagag

SEQ ID NO: 2298039 - DNA, 23 bp, Homo sapiens
cagaaaattggcagtggcagaga

SEQ ID NO: 2298040 - DNA, 20 bp, Homo sapiens
cagaaacaactgccaaataa

SEQ ID NO: 2298041 - DNA, 13 bp, Homo sapiens
cagaaacttctca

SEQ ID NO: 2298042 - DNA, 23 bp, Homo sapiens
cagaaatgccgctgtgtccccgc

SEQ ID NO: 2298043 - DNA, 22 bp, Homo sapiens
cagaaattttctacagtacatg

SEQ ID NO: 2298044 - DNA, 17 bp, Homo sapiens
cagaaccagcactccca

SEQ ID NO: 2298045 - DNA, 18 bp, Homo sapiens
cagaaccagcactcccag

SEQ ID NO: 2298046 - DNA, 14 bp, Homo sapiens
cagaaggtattttt

SEQ ID NO: 2298047 - DNA, 17 bp, Homo sapiens
cagaaggtatttttgaa

SEQ ID NO: 2298048 - DNA, 21 bp, Homo sapiens
cagaagtagttttgttcatga

SEQ ID NO: 2298049 - DNA, 14 bp, Homo sapiens
cagaatattttcaa

SEQ ID NO: 2298050 - DNA, 18 bp, Homo sapiens
cagaatcagcacagataa

SEQ ID NO: 2298051 - DNA, 18 bp, Homo sapiens
cagaatgactctggaacc

SEQ ID NO: 2298052 - DNA, 22 bp, Homo sapiens
cagaatgggggtatcctgtgca

SEQ ID NO: 2298053 - DNA, 20 bp, Homo sapiens
cagaatgtttcctgtggaaa

SEQ ID NO: 2298054 - DNA, 22 bp, Homo sapiens
cagaatgtttcctgtggaaata

SEQ ID NO: 2298055 - DNA, 22 bp, Homo sapiens
cagaattgaaccgtcaatgtga

SEQ ID NO: 2298056 - DNA, 21 bp, Homo sapiens
cagaccagcatagttctgcaa

SEQ ID NO: 2298057 - DNA, 13 bp, Homo sapiens
cagaccccatcca

SEQ ID NO: 2298058 - DNA, 20 bp, Homo sapiens
cagaccccatccagccaggg

SEQ ID NO: 2298059 - DNA, 24 bp, Homo sapiens
cagacccctgggggaggcttccag

SEQ ID NO: 2298060 - DNA, 20 bp, Homo sapiens
cagacctagggatcctgaga

SEQ ID NO: 2298061 - DNA, 15 bp, Homo sapiens
cagacctgggccctg

SEQ ID NO: 2298062 - DNA, 17 bp, Homo sapiens
cagacctgggccctggt

SEQ ID NO: 2298063 - DNA, 12 bp, Homo sapiens
cagacggacggg

SEQ ID NO: 2298064 - DNA, 20 bp, Homo sapiens
cagacggacgggacagcggc

SEQ ID NO: 2298065 - DNA, 17 bp, Homo sapiens
cagactcgagagggctg

SEQ ID NO: 2298066 - DNA, 17 bp, Homo sapiens
cagagacctgctccaga

SEQ ID NO: 2298067 - DNA, 18 bp, Homo sapiens
cagagacctgctccagat

SEQ ID NO: 2298068 - DNA, 19 bp, Homo sapiens
cagagacctgctccagatc

SEQ ID NO: 2298069 - DNA, 15 bp, Homo sapiens
cagagacggcagccc

SEQ ID NO: 2298070 - DNA, 10 bp, Homo sapiens
cagagactgc

SEQ ID NO: 2298071 - DNA, 12 bp, Homo sapiens
cagagactgccc

SEQ ID NO: 2298072 - DNA, 13 bp, Homo sapiens
cagagactgccca

SEQ ID NO: 2298073 - DNA, 14 bp, Homo sapiens
cagagactgcccac

SEQ ID NO: 2298074 - DNA, 19 bp, Homo sapiens
cagagactgtttgaatctt

SEQ ID NO: 2298075 - DNA, 16 bp, Homo sapiens
cagagagcttcaacta

SEQ ID NO: 2298076 - DNA, 16 bp, Homo sapiens
cagagatcagaattga

SEQ ID NO: 2298077 - DNA, 14 bp, Homo sapiens
cagagatggcagag

SEQ ID NO: 2298078 - DNA, 18 bp, Homo sapiens
cagagatggcagagccat

SEQ ID NO: 2298079 - DNA, 11 bp, Homo sapiens
cagagatgtac

SEQ ID NO: 2298080 - DNA, 15 bp, Homo sapiens
cagagattagtctta

SEQ ID NO: 2298081 - DNA, 21 bp, Homo sapiens
cagagcagtctaaacagagtc

SEQ ID NO: 2298082 - DNA, 21 bp, Homo sapiens
cagagccatccaccctgagga

SEQ ID NO: 2298083 - DNA, 22 bp, Homo sapiens
cagagccatccaccctgaggag

SEQ ID NO: 2298084 - DNA, 16 bp, Homo sapiens
cagagcccccatggcc

SEQ ID NO: 2298085 - DNA, 17 bp, Homo sapiens
cagagccgcaccctggc

SEQ ID NO: 2298086 - DNA, 18 bp, Homo sapiens
cagagccgcaccctggct

SEQ ID NO: 2298087 - DNA, 19 bp, Homo sapiens
cagagccgcaccctggctg

SEQ ID NO: 2298088 - DNA, 19 bp, Homo sapiens
cagagctcagcacagcctc

SEQ ID NO: 2298089 - DNA, 13 bp, Homo sapiens
cagagctcccagg

SEQ ID NO: 2298090 - DNA, 23 bp, Homo sapiens
cagagctgagtcggctgggcagg

SEQ ID NO: 2298091 - DNA, 20 bp, Homo sapiens
cagaggaccagcacactccc

SEQ ID NO: 2298092 - DNA, 13 bp, Homo sapiens
cagaggcagggcc

SEQ ID NO: 2298093 - DNA, 18 bp, Homo sapiens
cagaggcagggccctggg

SEQ ID NO: 2298094 - DNA, 21 bp, Homo sapiens
cagaggcagggccctggggtc

SEQ ID NO: 2298095 - DNA, 19 bp, Homo sapiens
cagaggtgagggaggcctg

SEQ ID NO: 2298096 - DNA, 17 bp, Homo sapiens
cagagtatatatgtaca

SEQ ID NO: 2298097 - DNA, 23 bp, Homo sapiens
cagagtatatatgtacagttata

SEQ ID NO: 2298098 - DNA, 21 bp, Homo sapiens
cagagtatgtcagtccaataa

SEQ ID NO: 2298099 - DNA, 22 bp, Homo sapiens
cagagtcctgccgacggagcca

SEQ ID NO: 2298100 - DNA, 14 bp, Homo sapiens
cagagtggaaattc

SEQ ID NO: 2298101 - DNA, 20 bp, Homo sapiens
cagatatttaaatttagtgc

SEQ ID NO: 2298102 - DNA, 19 bp, Homo sapiens
cagatccctcggtcagcac

SEQ ID NO: 2298103 - DNA, 21 bp, Homo sapiens
cagatccctcggtcagcaccg

SEQ ID NO: 2298104 - DNA, 13 bp, Homo sapiens
cagatcctctttc

SEQ ID NO: 2298105 - DNA, 18 bp, Homo sapiens
cagatcctgtcccatggg

SEQ ID NO: 2298106 - DNA, 20 bp, Homo sapiens
cagatcctgtcccatgggct

SEQ ID NO: 2298107 - DNA, 12 bp, Homo sapiens
cagatcttacaa

SEQ ID NO: 2298108 - DNA, 15 bp, Homo sapiens
cagatgagaagacta

SEQ ID NO: 2298109 - DNA, 16 bp, Homo sapiens
cagatgagaagactag

SEQ ID NO: 2298110 - DNA, 15 bp, Homo sapiens
cagatgatccatttg

SEQ ID NO: 2298111 - DNA, 24 bp, Homo sapiens
cagatgggtgtcccctggtgcccc

SEQ ID NO: 2298112 - DNA, 14 bp, Homo sapiens
cagattattttcta

SEQ ID NO: 2298113 - DNA, 23 bp, Homo sapiens
cagattattttctatatttggat

SEQ ID NO: 2298114 - DNA, 15 bp, Homo sapiens
cagattcagtcttgc

SEQ ID NO: 2298115 - DNA, 19 bp, Homo sapiens
cagatttcactctccttgg

SEQ ID NO: 2298116 - DNA, 18 bp, Homo sapiens
cagcaaataaaacagtga

SEQ ID NO: 2298117 - DNA, 16 bp, Homo sapiens
cagcaaccagagcact

SEQ ID NO: 2298118 - DNA, 17 bp, Homo sapiens
cagcaaccagagcactg

SEQ ID NO: 2298119 - DNA, 20 bp, Homo sapiens
cagcaaccagagcactgtat

SEQ ID NO: 2298120 - DNA, 21 bp, Homo sapiens
cagcaaccagagcactgtata

SEQ ID NO: 2298121 - DNA, 15 bp, Homo sapiens
cagcaagataaacac

SEQ ID NO: 2298122 - DNA, 23 bp, Homo sapiens
cagcacacatgcatcctcccctc

SEQ ID NO: 2298123 - DNA, 13 bp, Homo sapiens
cagcacagcctca

SEQ ID NO: 2298124 - DNA, 16 bp, Homo sapiens
cagcacagcctcaccc

SEQ ID NO: 2298125 - DNA, 17 bp, Homo sapiens
cagcaccagcctgagcc

SEQ ID NO: 2298126 - DNA, 23 bp, Homo sapiens
cagcaccgtggtgtgaggccccc

SEQ ID NO: 2298127 - DNA, 12 bp, Homo sapiens
cagcactcccag

SEQ ID NO: 2298128 - DNA, 13 bp, Homo sapiens
cagcactcccagg

SEQ ID NO: 2298129 - DNA, 15 bp, Homo sapiens
cagcactcccagggc

SEQ ID NO: 2298130 - DNA, 16 bp, Homo sapiens
cagcactcccagggcc

SEQ ID NO: 2298131 - DNA, 17 bp, Homo sapiens
cagcactcccagggccc

SEQ ID NO: 2298132 - DNA, 16 bp, Homo sapiens
cagcagctccaacctg

SEQ ID NO: 2298133 - DNA, 20 bp, Homo sapiens
cagcagctccaacctggagg

SEQ ID NO: 2298134 - DNA, 22 bp, Homo sapiens
cagcagctggactgggtgggcc

SEQ ID NO: 2298135 - DNA, 20 bp, Homo sapiens
cagcaggtctagaagaacaa

SEQ ID NO: 2298136 - DNA, 17 bp, Homo sapiens
cagcagtaccatcccac

SEQ ID NO: 2298137 - DNA, 19 bp, Homo sapiens
cagcagtctccgctcccgc

SEQ ID NO: 2298138 - DNA, 15 bp, Homo sapiens
cagcatgagattgta

SEQ ID NO: 2298139 - DNA, 18 bp, Homo sapiens
cagcatgagattgtacat

SEQ ID NO: 2298140 - DNA, 20 bp, Homo sapiens
cagcatgagattgtacattt

SEQ ID NO: 2298141 - DNA, 15 bp, Homo sapiens
cagcatgtctactgc

SEQ ID NO: 2298142 - DNA, 12 bp, Homo sapiens
cagccaatttca

SEQ ID NO: 2298143 - DNA, 16 bp, Homo sapiens
cagccaatttcaaaga

SEQ ID NO: 2298144 - DNA, 20 bp, Homo sapiens
cagccaatttcaaagaaaac

SEQ ID NO: 2298145 - DNA, 15 bp, Homo sapiens
cagccccatccttcc

SEQ ID NO: 2298146 - DNA, 14 bp, Homo sapiens
cagccccccagtgt

SEQ ID NO: 2298147 - DNA, 16 bp, Homo sapiens
cagccccccagtgtcc

SEQ ID NO: 2298148 - DNA, 13 bp, Homo sapiens
cagccccctggcc

SEQ ID NO: 2298149 - DNA, 13 bp, Homo sapiens
cagcccctccccg

SEQ ID NO: 2298150 - DNA, 13 bp, Homo sapiens
cagcccctgctgg

SEQ ID NO: 2298151 - DNA, 17 bp, Homo sapiens
cagcccctgctggacca

SEQ ID NO: 2298152 - DNA, 22 bp, Homo sapiens
cagccccttgcttctaagggat

SEQ ID NO: 2298153 - DNA, 15 bp, Homo sapiens
cagcccggtgtgagg

SEQ ID NO: 2298154 - DNA, 16 bp, Homo sapiens
cagccgcgctctgccc

SEQ ID NO: 2298155 - DNA, 18 bp, Homo sapiens
cagccgcgctctgcccct

SEQ ID NO: 2298156 - DNA, 21 bp, Homo sapiens
cagccgtaatggggactctcc

SEQ ID NO: 2298157 - DNA, 23 bp, Homo sapiens
cagccgtaatggggactctccag

SEQ ID NO: 2298158 - DNA, 18 bp, Homo sapiens
cagggtctcactctgttg

SEQ ID NO: 2298159 - DNA, 15 bp, Homo sapiens
cagggtctcgtcagg

SEQ ID NO: 2298160 - DNA, 17 bp, Homo sapiens
cagggtctcgtcaggag

SEQ ID NO: 2298161 - DNA, 16 bp, Homo sapiens
cagggtctgagtgcaa

SEQ ID NO: 2298162 - DNA, 23 bp, Homo sapiens
cagggtgcaggcgcgcaccgccc

SEQ ID NO: 2298163 - DNA, 23 bp, Homo sapiens
cagggtggtggtgcacacctgta

SEQ ID NO: 2298164 - DNA, 12 bp, Homo sapiens
caggtggccagg

SEQ ID NO: 2298165 - DNA, 15 bp, Homo sapiens
caggtgggcagacag

SEQ ID NO: 2298166 - DNA, 21 bp, Homo sapiens
caggtgtaaatatagtagcag

SEQ ID NO: 2298167 - DNA, 20 bp, Homo sapiens
caggtgtgagccacagcact

SEQ ID NO: 2298168 - DNA, 15 bp, Homo sapiens
caggtgttaaaaacc

SEQ ID NO: 2298169 - DNA, 19 bp, Homo sapiens
caggtgttaaaaaccatta

SEQ ID NO: 2298170 - DNA, 14 bp, Homo sapiens
caggtgttcctcct

SEQ ID NO: 2298171 - DNA, 16 bp, Homo sapiens
caggttttcctgaaga

SEQ ID NO: 2298172 - DNA, 12 bp, Homo sapiens
cagtaaccattt

SEQ ID NO: 2298173 - DNA, 21 bp, Homo sapiens
cagtaactgagtgtggcggga

SEQ ID NO: 2298174 - DNA, 21 bp, Homo sapiens
cagtaattcccatctgcttta

SEQ ID NO: 2298175 - DNA, 16 bp, Homo sapiens
cagtaccatcccactg

SEQ ID NO: 2298176 - DNA, 17 bp, Homo sapiens
cagtaccatcccactga

SEQ ID NO: 2298177 - DNA, 23 bp, Homo sapiens
cagtagctgtggggagctggtgg

SEQ ID NO: 2298178 - DNA, 21 bp, Homo sapiens
cagtatcttgaagacttttct

SEQ ID NO: 2298179 - DNA, 15 bp, Homo sapiens
cagtatgaagacact

SEQ ID NO: 2298180 - DNA, 23 bp, Homo sapiens
cagtattgacgacctacatctga

SEQ ID NO: 2298181 - DNA, 15 bp, Homo sapiens
cagtcagcggagagg

SEQ ID NO: 2298182 - DNA, 18 bp, Homo sapiens
cagtcagcggagaggacc

SEQ ID NO: 2298183 - DNA, 13 bp, Homo sapiens
cagtcccacagcc

SEQ ID NO: 2298184 - DNA, 14 bp, Homo sapiens
cagtcccagttccc

SEQ ID NO: 2298185 - DNA, 17 bp, Homo sapiens
cagtctcaaataataat

SEQ ID NO: 2298186 - DNA, 22 bp, Homo sapiens
cagtctcattacagatttagtt

SEQ ID NO: 2298187 - DNA, 21 bp, Homo sapiens
cagtctccgctcccgcagcgg

SEQ ID NO: 2298188 - DNA, 15 bp, Homo sapiens
cagtgaaagaaactg

SEQ ID NO: 2298189 - DNA, 22 bp, Homo sapiens
cagtgaagatgtgtaaataagc

SEQ ID NO: 2298190 - DNA, 23 bp, Homo sapiens
cagtgcagcaaccagagcactgt

SEQ ID NO: 2298191 - DNA, 17 bp, Homo sapiens
cagtgcatgctgtccct

SEQ ID NO: 2298192 - DNA, 19 bp, Homo sapiens
cagtgcatgctgtccctta

SEQ ID NO: 2298193 - DNA, 23 bp, Homo sapiens
cagtgcatgctgtcccttacgtg

SEQ ID NO: 2298194 - DNA, 15 bp, Homo sapiens
cagtgccttatggaa

SEQ ID NO: 2298195 - DNA, 17 bp, Homo sapiens
cagtgccttatggaaca

SEQ ID NO: 2298196 - DNA, 18 bp, Homo sapiens
cagtgccttatggaacac

SEQ ID NO: 2298197 - DNA, 19 bp, Homo sapiens
cagtgccttatggaacact

SEQ ID NO: 2298198 - DNA, 20 bp, Homo sapiens
cagtgccttatggaacactc

SEQ ID NO: 2298199 - DNA, 15 bp, Homo sapiens
cagtgctttgccctt

SEQ ID NO: 2298200 - DNA, 17 bp, Homo sapiens
cagtgctttgcccttga

SEQ ID NO: 2298201 - DNA, 18 bp, Homo sapiens
cagtgctttgcccttgaa

SEQ ID NO: 2298202 - DNA, 14 bp, Homo sapiens
cagtggaagtgatt

SEQ ID NO: 2298203 - DNA, 18 bp, Homo sapiens
cagtggcttggagcagag

SEQ ID NO: 2298204 - DNA, 21 bp, Homo sapiens
cagtggcttggagcagaggtg

SEQ ID NO: 2298205 - DNA, 19 bp, Homo sapiens
cagtggggcccatggcccc

SEQ ID NO: 2298206 - DNA, 20 bp, Homo sapiens
cagtggggcccatggcccca

SEQ ID NO: 2298207 - DNA, 20 bp, Homo sapiens
cagtggttcgggggaaatag

SEQ ID NO: 2298208 - DNA, 13 bp, Homo sapiens
cagtgtccccagg

SEQ ID NO: 2298209 - DNA, 15 bp, Homo sapiens
cagtgtcctcatcta

SEQ ID NO: 2298210 - DNA, 13 bp, Homo sapiens
cagtgttttcttg

SEQ ID NO: 2298211 - DNA, 14 bp, Homo sapiens
cagtgttttcttgt

SEQ ID NO: 2298212 - DNA, 15 bp, Homo sapiens
cagttaatgtgccaa

SEQ ID NO: 2298213 - DNA, 23 bp, Homo sapiens
cagttacagcaggccagaaacat

SEQ ID NO: 2298214 - DNA, 13 bp, Homo sapiens
cagttaccgagga

SEQ ID NO: 2298215 - DNA, 14 bp, Homo sapiens
cagttcttggcctg

SEQ ID NO: 2298216 - DNA, 15 bp, Homo sapiens
cagttcttggcctgc

SEQ ID NO: 2298217 - DNA, 19 bp, Homo sapiens
cagttcttggcctgctagc

SEQ ID NO: 2298218 - DNA, 11 bp, Homo sapiens
cagttgctcat

SEQ ID NO: 2298219 - DNA, 20 bp, Homo sapiens
cagttggactgtggcctcag

SEQ ID NO: 2298220 - DNA, 22 bp, Homo sapiens
cagttggactgtggcctcagga

SEQ ID NO: 2298221 - DNA, 12 bp, Homo sapiens
cagttgggcccc

SEQ ID NO: 2298222 - DNA, 15 bp, Homo sapiens
cagttgggcccccat

SEQ ID NO: 2298223 - DNA, 14 bp, Homo sapiens
cagttggtgatttt

SEQ ID NO: 2298224 - DNA, 23 bp, Homo sapiens
cagttggtgattttagatttctt

SEQ ID NO: 2298225 - DNA, 18 bp, Homo sapiens
cagttgttagtgtgtctt

SEQ ID NO: 2298226 - DNA, 22 bp, Homo sapiens
cagttgttagtgtgtcttagtg

SEQ ID NO: 2298227 - DNA, 23 bp, Homo sapiens
cagtttaaaggggtcccatcagt

SEQ ID NO: 2298228 - DNA, 16 bp, Homo sapiens
cagtttggggcagggg

SEQ ID NO: 2298229 - DNA, 17 bp, Homo sapiens
cagtttggggcaggggg

SEQ ID NO: 2298230 - DNA, 16 bp, Homo sapiens
cagtttgtaaatgtta

SEQ ID NO: 2298231 - DNA, 23 bp, Homo sapiens
cagtttgtaaatgttatttctgc

SEQ ID NO: 2298232 - DNA, 21 bp, Homo sapiens
cataaaaataaccaaaaaatg

SEQ ID NO: 2298233 - DNA, 13 bp, Homo sapiens
cataaaagaatgt

SEQ ID NO: 2298234 - DNA, 17 bp, Homo sapiens
cataaaagaatgtacag

SEQ ID NO: 2298235 - DNA, 19 bp, Homo sapiens
cataaaagaatgtacagaa

SEQ ID NO: 2298236 - DNA, 15 bp, Homo sapiens
cataaaataaataat

SEQ ID NO: 2298237 - DNA, 16 bp, Homo sapiens
cataaaatgctatttt

SEQ ID NO: 2298238 - DNA, 17 bp, Homo sapiens
cataaaatgctatttta

SEQ ID NO: 2298239 - DNA, 18 bp, Homo sapiens
cataaaatgctattttaa

SEQ ID NO: 2298240 - DNA, 19 bp, Homo sapiens
cataaaatgctattttaaa

SEQ ID NO: 2298241 - DNA, 15 bp, Homo sapiens
cataaatagtaaata

SEQ ID NO: 2298242 - DNA, 23 bp, Homo sapiens
cataaatagtaaataatgattca

SEQ ID NO: 2298243 - DNA, 20 bp, Homo sapiens
cataaatctgtctgattcta

SEQ ID NO: 2298244 - DNA, 16 bp, Homo sapiens
cataaccaacatttta

SEQ ID NO: 2298245 - DNA, 19 bp, Homo sapiens
cataatctctttccatctt

SEQ ID NO: 2298246 - DNA, 14 bp, Homo sapiens
cataatgatactga

SEQ ID NO: 2298247 - DNA, 16 bp, Homo sapiens
cataatgatactgaat

SEQ ID NO: 2298248 - DNA, 21 bp, Homo sapiens
catacgtctttagatgctatt

SEQ ID NO: 2298249 - DNA, 23 bp, Homo sapiens
catactcaaagaggccagtactt

SEQ ID NO: 2298250 - DNA, 14 bp, Homo sapiens
catactctgtgtaa

SEQ ID NO: 2298251 - DNA, 19 bp, Homo sapiens
catactctgtgtaatctct

SEQ ID NO: 2298252 - DNA, 15 bp, Homo sapiens
catacttcctggatt

SEQ ID NO: 2298253 - DNA, 16 bp, Homo sapiens
catacttcctggattt

SEQ ID NO: 2298254 - DNA, 17 bp, Homo sapiens
catactttccaacatta

SEQ ID NO: 2298255 - DNA, 21 bp, Homo sapiens
catagaactgtcccacaaaat

SEQ ID NO: 2298256 - DNA, 21 bp, Homo sapiens
catagccattcatttacaact

SEQ ID NO: 2298257 - DNA, 20 bp, Homo sapiens
catagggtccactttggtaa

SEQ ID NO: 2298258 - DNA, 15 bp, Homo sapiens
catagggtttggaag

SEQ ID NO: 2298259 - DNA, 20 bp, Homo sapiens
catagggtttggaagaaagg

SEQ ID NO: 2298260 - DNA, 23 bp, Homo sapiens
catataatttgccagacagagat

SEQ ID NO: 2298261 - DNA, 13 bp, Homo sapiens
catatagtttgtt

SEQ ID NO: 2298262 - DNA, 18 bp, Homo sapiens
catatagtttgttttctt

SEQ ID NO: 2298263 - DNA, 13 bp, Homo sapiens
catatcagctctg

SEQ ID NO: 2298264 - DNA, 18 bp, Homo sapiens
catatcagctctgcataa

SEQ ID NO: 2298265 - DNA, 16 bp, Homo sapiens
catatgattgaaaaga

SEQ ID NO: 2298266 - DNA, 19 bp, Homo sapiens
catatgattgaaaagaaga

SEQ ID NO: 2298267 - DNA, 17 bp, Homo sapiens
catatgtaccctaccct

SEQ ID NO: 2298268 - DNA, 14 bp, Homo sapiens
catatgtgatctgt

SEQ ID NO: 2298269 - DNA, 14 bp, Homo sapiens
catattcattcatg

SEQ ID NO: 2298270 - DNA, 20 bp, Homo sapiens
catcagaaattttctacagt

SEQ ID NO: 2298271 - DNA, 16 bp, Homo sapiens
catcagcccctgctgc

SEQ ID NO: 2298272 - DNA, 21 bp, Homo sapiens
catcagcccctgctgctcctc

SEQ ID NO: 2298273 - DNA, 18 bp, Homo sapiens
catcagcccggtgtgagg

SEQ ID NO: 2298274 - DNA, 14 bp, Homo sapiens
catcatcctcactg

SEQ ID NO: 2298275 - DNA, 15 bp, Homo sapiens
catcattgaaatctt

SEQ ID NO: 2298276 - DNA, 15 bp, Homo sapiens
catcatttcccctcc

SEQ ID NO: 2298277 - DNA, 18 bp, Homo sapiens
catcatttcccctcccgc

SEQ ID NO: 2298278 - DNA, 19 bp, Homo sapiens
catcatttcccctcccgct

SEQ ID NO: 2298279 - DNA, 18 bp, Homo sapiens
catccaactggaaggctt

SEQ ID NO: 2298280 - DNA, 14 bp, Homo sapiens
catccacacacagc

SEQ ID NO: 2298281 - DNA, 15 bp, Homo sapiens
catccacacacagca

SEQ ID NO: 2298282 - DNA, 18 bp, Homo sapiens
catccacacacagcagct

SEQ ID NO: 2298283 - DNA, 20 bp, Homo sapiens
catccacacacagcagctcc

SEQ ID NO: 2298284 - DNA, 14 bp, Homo sapiens
catccacaccctct

SEQ ID NO: 2298285 - DNA, 18 bp, Homo sapiens
catccacaccctctcctt

SEQ ID NO: 2298286 - DNA, 21 bp, Homo sapiens
catccatgcggccggcctggg

SEQ ID NO: 2298287 - DNA, 22 bp, Homo sapiens
catccatggagcacgaggcctt

SEQ ID NO: 2298288 - DNA, 18 bp, Homo sapiens
catcccactgatatcacg

SEQ ID NO: 2298289 - DNA, 22 bp, Homo sapiens
catcccactgatatcacgggcc

SEQ ID NO: 2298290 - DNA, 12 bp, Homo sapiens
catttcatttat

SEQ ID NO: 2298291 - DNA, 22 bp, Homo sapiens
catttcatttatactgtagcaa

SEQ ID NO: 2298292 - DNA, 12 bp, Homo sapiens
catttcccctcc

SEQ ID NO: 2298293 - DNA, 16 bp, Homo sapiens
catttcccctcccgct

SEQ ID NO: 2298294 - DNA, 20 bp, Homo sapiens
catttcccctcccgcttcct

SEQ ID NO: 2298295 - DNA, 15 bp, Homo sapiens
catttccctatttta

SEQ ID NO: 2298296 - DNA, 16 bp, Homo sapiens
catttctcttcctaaa

SEQ ID NO: 2298297 - DNA, 17 bp, Homo sapiens
catttctcttcctaaat

SEQ ID NO: 2298298 - DNA, 20 bp, Homo sapiens
catttcttaccatgcatttc

SEQ ID NO: 2298299 - DNA, 21 bp, Homo sapiens
catttcttagatggagaagtt

SEQ ID NO: 2298300 - DNA, 20 bp, Homo sapiens
catttcttattaaccaaatt

SEQ ID NO: 2298301 - DNA, 21 bp, Homo sapiens
catttgatttgatatacagac

SEQ ID NO: 2298302 - DNA, 17 bp, Homo sapiens
catttgtaatgtatctt

SEQ ID NO: 2298303 - DNA, 18 bp, Homo sapiens
catttgtaatgtatctta

SEQ ID NO: 2298304 - DNA, 16 bp, Homo sapiens
cattttaaaaataaat

SEQ ID NO: 2298305 - DNA, 17 bp, Homo sapiens
cattttactgtctgtaa

SEQ ID NO: 2298306 - DNA, 12 bp, Homo sapiens
cattttctttca

SEQ ID NO: 2298307 - DNA, 14 bp, Homo sapiens
cattttctttcata

SEQ ID NO: 2298308 - DNA, 17 bp, Homo sapiens
cattttgtttccaaagc

SEQ ID NO: 2298309 - DNA, 12 bp, Homo sapiens
catttttcttgg

SEQ ID NO: 2298310 - DNA, 21 bp, Homo sapiens
catttttcttggatctttttg

SEQ ID NO: 2298311 - DNA, 13 bp, Homo sapiens
ccaaaatgtcaat

SEQ ID NO: 2298312 - DNA, 16 bp, Homo sapiens
ccaaacattcttattt

SEQ ID NO: 2298313 - DNA, 15 bp, Homo sapiens
ccaaactaccgttcc

SEQ ID NO: 2298314 - DNA, 21 bp, Homo sapiens
ccaaactgttctgagaaggtg

SEQ ID NO: 2298315 - DNA, 13 bp, Homo sapiens
ccaaagaggcatt

SEQ ID NO: 2298316 - DNA, 19 bp, Homo sapiens
ccaaagcagtgcatgctgt

SEQ ID NO: 2298317 - DNA, 12 bp, Homo sapiens
ccaaataacagt

SEQ ID NO: 2298318 - DNA, 17 bp, Homo sapiens
ccaaatggaaacagagg

SEQ ID NO: 2298319 - DNA, 18 bp, Homo sapiens
ccaacaactccaggaaaa

SEQ ID NO: 2298320 - DNA, 18 bp, Homo sapiens
ccaacaagccagaatcag

SEQ ID NO: 2298321 - DNA, 22 bp, Homo sapiens
ccaacactcacttaattctcat

SEQ ID NO: 2298322 - DNA, 17 bp, Homo sapiens
ccaacatccactctctc

SEQ ID NO: 2298323 - DNA, 16 bp, Homo sapiens
ccaacattatcctgtg

SEQ ID NO: 2298324 - DNA, 14 bp, Homo sapiens
ccaaccagcttgtc

SEQ ID NO: 2298325 - DNA, 15 bp, Homo sapiens
ccaacccccacctcc

SEQ ID NO: 2298326 - DNA, 18 bp, Homo sapiens
ccaacccccacctcccgg

SEQ ID NO: 2298327 - DNA, 20 bp, Homo sapiens
ccaacctcgccctctctcac

SEQ ID NO: 2298328 - DNA, 14 bp, Homo sapiens
ccaacctcgctcca

SEQ ID NO: 2298329 - DNA, 13 bp, Homo sapiens
ccaacctggaggc

SEQ ID NO: 2298330 - DNA, 16 bp, Homo sapiens
ccaacctggaggctgg

SEQ ID NO: 2298331 - DNA, 16 bp, Homo sapiens
ccaactatttcaataa

SEQ ID NO: 2298332 - DNA, 12 bp, Homo sapiens
ccaactgctttg

SEQ ID NO: 2298333 - DNA, 18 bp, Homo sapiens
ccaactgctttgttttgg

SEQ ID NO: 2298334 - DNA, 12 bp, Homo sapiens
ccaactttgtag

SEQ ID NO: 2298335 - DNA, 20 bp, Homo sapiens
ccaagctgtgaccctcaatt

SEQ ID NO: 2298336 - DNA, 14 bp, Homo sapiens
ccaaggctcacatg

SEQ ID NO: 2298337 - DNA, 21 bp, Homo sapiens
ccaagtattttatctgtgttg

SEQ ID NO: 2298338 - DNA, 15 bp, Homo sapiens
ccaagtcatgggaga

SEQ ID NO: 2298339 - DNA, 17 bp, Homo sapiens
ccaagtcatgggagaag

SEQ ID NO: 2298340 - DNA, 22 bp, Homo sapiens
ccaatatcatgtgtagatatta

SEQ ID NO: 2298341 - DNA, 20 bp, Homo sapiens
ccaatcaacagcatgtctac

SEQ ID NO: 2298342 - DNA, 12 bp, Homo sapiens
ccaatgaagata

SEQ ID NO: 2298343 - DNA, 19 bp, Homo sapiens
ccaatgaagataaatgctt

SEQ ID NO: 2298344 - DNA, 20 bp, Homo sapiens
ccaatggctgcatcaaatgc

SEQ ID NO: 2298345 - DNA, 22 bp, Homo sapiens
ccaattaatgattcaattaaca

SEQ ID NO: 2298346 - DNA, 17 bp, Homo sapiens
ccaattttaaaaaataa

SEQ ID NO: 2298347 - DNA, 18 bp, Homo sapiens
ccacaaaatatttctaag

SEQ ID NO: 2298348 - DNA, 14 bp, Homo sapiens
ccacaacaaagtgc

SEQ ID NO: 2298349 - DNA, 21 bp, Homo sapiens
ccacaacaaagtgcttccttt

SEQ ID NO: 2298350 - DNA, 17 bp, Homo sapiens
ccacaataatgaataat

SEQ ID NO: 2298351 - DNA, 18 bp, Homo sapiens
ccacaccccgtctgcccc

SEQ ID NO: 2298352 - DNA, 19 bp, Homo sapiens
ccacaccccgtctgcccct

SEQ ID NO: 2298353 - DNA, 14 bp, Homo sapiens
ccacaccctggagt

SEQ ID NO: 2298354 - DNA, 21 bp, Homo sapiens
ccacaccctggagtggcatgg

SEQ ID NO: 2298355 - DNA, 15 bp, Homo sapiens
ccacacgccggggct

SEQ ID NO: 2298356 - DNA, 17 bp, Homo sapiens
ccacacgccggggctgg

SEQ ID NO: 2298357 - DNA, 23 bp, Homo sapiens
ccacacgccggggctggccctgc

SEQ ID NO: 2298358 - DNA, 11 bp, Homo sapiens
ccacagatcca

SEQ ID NO: 2298359 - DNA, 15 bp, Homo sapiens
ccacagatccatcct

SEQ ID NO: 2298360 - DNA, 15 bp, Homo sapiens
ccacagcatgaacct

SEQ ID NO: 2298361 - DNA, 18 bp, Homo sapiens
ccacaggtaatttctcct

SEQ ID NO: 2298362 - DNA, 22 bp, Homo sapiens
ccacagtggggcccatggcccc

SEQ ID NO: 2298363 - DNA, 24 bp, Homo sapiens
ccacagtggggcccatggccccag

SEQ ID NO: 2298364 - DNA, 14 bp, Homo sapiens
ccacagtggtcagc

SEQ ID NO: 2298365 - DNA, 20 bp, Homo sapiens
ccacatggaacttaaaacat

SEQ ID NO: 2298366 - DNA, 21 bp, Homo sapiens
ccacatggaacttaaaacata

SEQ ID NO: 2298367 - DNA, 14 bp, Homo sapiens
ccacattctgctgc

SEQ ID NO: 2298368 - DNA, 20 bp, Homo sapiens
ccacattctgctgcccccag

SEQ ID NO: 2298369 - DNA, 21 bp, Homo sapiens
ccacattctgctgcccccaga

SEQ ID NO: 2298370 - DNA, 22 bp, Homo sapiens
ccacattctgctgcccccagac

SEQ ID NO: 2298371 - DNA, 19 bp, Homo sapiens
ccaccaagggtatctgctg

SEQ ID NO: 2298372 - DNA, 14 bp, Homo sapiens
ccaccaatatcatg

SEQ ID NO: 2298373 - DNA, 21 bp, Homo sapiens
ccaccaatatcatgtgtagat

SEQ ID NO: 2298374 - DNA, 23 bp, Homo sapiens
ccaccaggattaatctctaaaat

SEQ ID NO: 2298375 - DNA, 22 bp, Homo sapiens
ccacccacaccccgtctgcccc

SEQ ID NO: 2298376 - DNA, 13 bp, Homo sapiens
ccacccccgggtg

SEQ ID NO: 2298377 - DNA, 19 bp, Homo sapiens
ccacccccgggtgcctgtg

SEQ ID NO: 2298378 - DNA, 23 bp, Homo sapiens
ccacccgccccagagactgccca

SEQ ID NO: 2298379 - DNA, 12 bp, Homo sapiens
ccaccctagcct

SEQ ID NO: 2298380 - DNA, 14 bp, Homo sapiens
ccaccctcccctct

SEQ ID NO: 2298381 - DNA, 15 bp, Homo sapiens
ccaccctctgctgca

SEQ ID NO: 2298382 - DNA, 12 bp, Homo sapiens
ccaccctgcttc

SEQ ID NO: 2298383 - DNA, 14 bp, Homo sapiens
ccaccctgcttctg

SEQ ID NO: 2298384 - DNA, 21 bp, Homo sapiens
ccaccctgcttctgctgcctg

SEQ ID NO: 2298385 - DNA, 12 bp, Homo sapiens
ccaccctgggcc

SEQ ID NO: 2298386 - DNA, 14 bp, Homo sapiens
ccaccctgggcctc

SEQ ID NO: 2298387 - DNA, 15 bp, Homo sapiens
ccaccctgggcctcc

SEQ ID NO: 2298388 - DNA, 17 bp, Homo sapiens
ccaccctgggcctcccg

SEQ ID NO: 2298389 - DNA, 19 bp, Homo sapiens
ccaccgcccctggacaggc

SEQ ID NO: 2298390 - DNA, 16 bp, Homo sapiens
ccaccgcgcctacctt

SEQ ID NO: 2298391 - DNA, 21 bp, Homo sapiens
ccacctagaaaggggcccatt

SEQ ID NO: 2298392 - DNA, 20 bp, Homo sapiens
ccacctgaagtgatgatgga

SEQ ID NO: 2298393 - DNA, 12 bp, Homo sapiens
ccacctgaggca

SEQ ID NO: 2298394 - DNA, 15 bp, Homo sapiens
ccacctgcccagtta

SEQ ID NO: 2298395 - DNA, 12 bp, Homo sapiens
ccacctgggaga

SEQ ID NO: 2298396 - DNA, 14 bp, Homo sapiens
ccacgcagagcccc

SEQ ID NO: 2298397 - DNA, 16 bp, Homo sapiens
ccacgcagagccccgg

SEQ ID NO: 2298398 - DNA, 23 bp, Homo sapiens
ccacgcctccatccacacacagc

SEQ ID NO: 2298399 - DNA, 17 bp, Homo sapiens
ccacggccgtccctgac

SEQ ID NO: 2298400 - DNA, 18 bp, Homo sapiens
ccacggggtcgggggagg

SEQ ID NO: 2298401 - DNA, 13 bp, Homo sapiens
ccactcaagacca

SEQ ID NO: 2298402 - DNA, 21 bp, Homo sapiens
ccactccgactccccctcccc

SEQ ID NO: 2298403 - DNA, 21 bp, Homo sapiens
ccactgaaacctctgttctca

SEQ ID NO: 2298404 - DNA, 18 bp, Homo sapiens
ccactggccctgtttctc

SEQ ID NO: 2298405 - DNA, 13 bp, Homo sapiens
ccactggggtggg

SEQ ID NO: 2298406 - DNA, 21 bp, Homo sapiens
ccactgtctgctaccagggct

SEQ ID NO: 2298407 - DNA, 15 bp, Homo sapiens
ccactgtttcttgct

SEQ ID NO: 2298408 - DNA, 17 bp, Homo sapiens
ccactgtttcttgcttg

SEQ ID NO: 2298409 - DNA, 15 bp, Homo sapiens
ccactttccagcctg

SEQ ID NO: 2298410 - DNA, 16 bp, Homo sapiens
ccagaaatgccgctgt

SEQ ID NO: 2298411 - DNA, 17 bp, Homo sapiens
ccagaacgccctgtgtc

SEQ ID NO: 2298412 - DNA, 23 bp, Homo sapiens
ccagaacgccctgtgtccacagt

SEQ ID NO: 2298413 - DNA, 12 bp, Homo sapiens
ccagaatttccc

SEQ ID NO: 2298414 - DNA, 21 bp, Homo sapiens
ccagacctgggccctggttcc

SEQ ID NO: 2298415 - DNA, 17 bp, Homo sapiens
ccagactcgagagggct

SEQ ID NO: 2298416 - DNA, 16 bp, Homo sapiens
ccagagacctgctcca

SEQ ID NO: 2298417 - DNA, 13 bp, Homo sapiens
ccagagactgccc

SEQ ID NO: 2298418 - DNA, 19 bp, Homo sapiens
ccagagactgcccaccctg

SEQ ID NO: 2298419 - DNA, 19 bp, Homo sapiens
ccagagccgcaccctggct

SEQ ID NO: 2298420 - DNA, 14 bp, Homo sapiens
ccagagctcccagg

SEQ ID NO: 2298421 - DNA, 15 bp, Homo sapiens
ccagagctcccagga

SEQ ID NO: 2298422 - DNA, 17 bp, Homo sapiens
ccagagctcccaggacg

SEQ ID NO: 2298423 - DNA, 19 bp, Homo sapiens
ccagagctcccaggacgca

SEQ ID NO: 2298424 - DNA, 17 bp, Homo sapiens
ccagaggtgagggaggc

SEQ ID NO: 2298425 - DNA, 17 bp, Homo sapiens
ccagattattttctata

SEQ ID NO: 2298426 - DNA, 15 bp, Homo sapiens
ccagatttcactctc

SEQ ID NO: 2298427 - DNA, 19 bp, Homo sapiens
ccagatttcactctccttg

SEQ ID NO: 2298428 - DNA, 13 bp, Homo sapiens
ccagatttttaat

SEQ ID NO: 2298429 - DNA, 15 bp, Homo sapiens
ccagcacactcccga

SEQ ID NO: 2298430 - DNA, 15 bp, Homo sapiens
ccagcacctttgtaa

SEQ ID NO: 2298431 - DNA, 13 bp, Homo sapiens
ccagcactcccag

SEQ ID NO: 2298432 - DNA, 14 bp, Homo sapiens
ccagcactcccagg

SEQ ID NO: 2298433 - DNA, 19 bp, Homo sapiens
ccagcactcccagggcccg

SEQ ID NO: 2298434 - DNA, 20 bp, Homo sapiens
ccagcatccatgcggccggc

SEQ ID NO: 2298435 - DNA, 17 bp, Homo sapiens
ccagccccagcgagtct

SEQ ID NO: 2298436 - DNA, 21 bp, Homo sapiens
ccagccgtaatggggactctc

SEQ ID NO: 2298437 - DNA, 17 bp, Homo sapiens
ccagcctcccccaggct

SEQ ID NO: 2298438 - DNA, 12 bp, Homo sapiens
ccagcctcctga

SEQ ID NO: 2298439 - DNA, 15 bp, Homo sapiens
ccagcctcctgagta

SEQ ID NO: 2298440 - DNA, 19 bp, Homo sapiens
ccagcctgagccacagtgg

SEQ ID NO: 2298441 - DNA, 16 bp, Homo sapiens
ccagcgtgggggtggc

SEQ ID NO: 2298442 - DNA, 21 bp, Homo sapiens
ccagcgtgggggtggccactc

SEQ ID NO: 2298443 - DNA, 22 bp, Homo sapiens
ccagcgtgggggtggccactcc

SEQ ID NO: 2298444 - DNA, 23 bp, Homo sapiens
ccagcgtgggggtggccactcct

SEQ ID NO: 2298445 - DNA, 18 bp, Homo sapiens
ccagctcctgccccgccg

SEQ ID NO: 2298446 - DNA, 22 bp, Homo sapiens
ccagctctcccctgcgcaggcc

SEQ ID NO: 2298447 - DNA, 14 bp, Homo sapiens
ccagctggcagcgc

SEQ ID NO: 2298448 - DNA, 22 bp, Homo sapiens
ccagctggctgggtcgcccctc

SEQ ID NO: 2298449 - DNA, 16 bp, Homo sapiens
ccaggaccctgagggt

SEQ ID NO: 2298450 - DNA, 18 bp, Homo sapiens
ccaggactctgccttcca

SEQ ID NO: 2298451 - DNA, 16 bp, Homo sapiens
ccaggagcagcgtgca

SEQ ID NO: 2298452 - DNA, 21 bp, Homo sapiens
ccaggagtgggtgggacacag

SEQ ID NO: 2298453 - DNA, 11 bp, Homo sapiens
ccaggatggcg

SEQ ID NO: 2298454 - DNA, 20 bp, Homo sapiens
ccaggatggcgtgtcccctg

SEQ ID NO: 2298455 - DNA, 23 bp, Homo sapiens
ccaggattaatctctaaaattct

SEQ ID NO: 2298456 - DNA, 15 bp, Homo sapiens
ccaggcaccgcctgc

SEQ ID NO: 2298457 - DNA, 16 bp, Homo sapiens
ccaggcaccgcctgcc

SEQ ID NO: 2298458 - DNA, 15 bp, Homo sapiens
ccaggcatgaccctg

SEQ ID NO: 2298459 - DNA, 19 bp, Homo sapiens
ccaggcatgaccctggagc

SEQ ID NO: 2298460 - DNA, 13 bp, Homo sapiens
ccaggccctgctc

SEQ ID NO: 2298461 - DNA, 21 bp, Homo sapiens
ccaggccgacaggaggccatg

SEQ ID NO: 2298462 - DNA, 15 bp, Homo sapiens
ccaggcggaggggct

SEQ ID NO: 2298463 - DNA, 19 bp, Homo sapiens
ccaggcggaggggcttgga

SEQ ID NO: 2298464 - DNA, 24 bp, Homo sapiens
ccaggcggaggggcttggagcaga

SEQ ID NO: 2298465 - DNA, 15 bp, Homo sapiens
ccaggcgtagggcca

SEQ ID NO: 2298466 - DNA, 17 bp, Homo sapiens
ccaggcgtagggccagg

SEQ ID NO: 2298467 - DNA, 21 bp, Homo sapiens
ccaggcgtagggccagggctc

SEQ ID NO: 2298468 - DNA, 19 bp, Homo sapiens
ccaggctcacaactgtttt

SEQ ID NO: 2298469 - DNA, 14 bp, Homo sapiens
ccaggctgagccga

SEQ ID NO: 2298470 - DNA, 14 bp, Homo sapiens
ccaggctgcgcctg

SEQ ID NO: 2298471 - DNA, 16 bp, Homo sapiens
ccaggctgcgcctgcc

SEQ ID NO: 2298472 - DNA, 15 bp, Homo sapiens
ccagggagctgatgt

SEQ ID NO: 2298473 - DNA, 23 bp, Homo sapiens
ccagggcccgagcgcgtgccttc

SEQ ID NO: 2298474 - DNA, 18 bp, Homo sapiens
ccagggctcacccactgc

SEQ ID NO: 2298475 - DNA, 14 bp, Homo sapiens
ccagggctctggca

SEQ ID NO: 2298476 - DNA, 14 bp, Homo sapiens
ccaggggctgggga

SEQ ID NO: 2298477 - DNA, 17 bp, Homo sapiens
ccagggtgcaggcgcgc

SEQ ID NO: 2298478 - DNA, 21 bp, Homo sapiens
ccagtggactcgcgagagggt

SEQ ID NO: 2298479 - DNA, 12 bp, Homo sapiens
ccagtgttttct

SEQ ID NO: 2298480 - DNA, 15 bp, Homo sapiens
ccagtgttttcttgt

SEQ ID NO: 2298481 - DNA, 14 bp, Homo sapiens
ccagttcatcccaa

SEQ ID NO: 2298482 - DNA, 14 bp, Homo sapiens
ccagttggactgtg

SEQ ID NO: 2298483 - DNA, 16 bp, Homo sapiens
ccagttggactgtggc

SEQ ID NO: 2298484 - DNA, 20 bp, Homo sapiens
ccagttggactgtggcctca

SEQ ID NO: 2298485 - DNA, 21 bp, Homo sapiens
ccagttggactgtggcctcag

SEQ ID NO: 2298486 - DNA, 13 bp, Homo sapiens
ccataaaataaat

SEQ ID NO: 2298487 - DNA, 12 bp, Homo sapiens
ccataagagaaa

SEQ ID NO: 2298488 - DNA, 15 bp, Homo sapiens
ccatatagtttgttt

SEQ ID NO: 2298489 - DNA, 21 bp, Homo sapiens
ccatatgtagcattaaatata

SEQ ID NO: 2298490 - DNA, 12 bp, Homo sapiens
ccatcagaaatt

SEQ ID NO: 2298491 - DNA, 14 bp, Homo sapiens
ccatcagaaatttt

SEQ ID NO: 2298492 - DNA, 13 bp, Homo sapiens
ccatcccactgat

SEQ ID NO: 2298493 - DNA, 23 bp, Homo sapiens
ccatccccgtgttgggtggaccc

SEQ ID NO: 2298494 - DNA, 12 bp, Homo sapiens
ccatcctctgtt

SEQ ID NO: 2298495 - DNA, 14 bp, Homo sapiens
ccatccttaactgt

SEQ ID NO: 2298496 - DNA, 15 bp, Homo sapiens
ccatccttaactgtc

SEQ ID NO: 2298497 - DNA, 12 bp, Homo sapiens
ccatccttcccg

SEQ ID NO: 2298498 - DNA, 17 bp, Homo sapiens
ccatccttcccgcagca

SEQ ID NO: 2298499 - DNA, 14 bp, Homo sapiens
ccatccttgcactt

SEQ ID NO: 2298500 - DNA, 14 bp, Homo sapiens
ccatctaaaatact

SEQ ID NO: 2298501 - DNA, 12 bp, Homo sapiens
ccatctccattg

SEQ ID NO: 2298502 - DNA, 18 bp, Homo sapiens
ccatctcttgtaccagcc

SEQ ID NO: 2298503 - DNA, 13 bp, Homo sapiens
ccatctgctgagc

SEQ ID NO: 2298504 - DNA, 20 bp, Homo sapiens
ccatgaatgatatgctagaa

SEQ ID NO: 2298505 - DNA, 14 bp, Homo sapiens
ccatgattccaagg

SEQ ID NO: 2298506 - DNA, 12 bp, Homo sapiens
ccatgccctccg

SEQ ID NO: 2298507 - DNA, 18 bp, Homo sapiens
ccatgctctttcaccctg

SEQ ID NO: 2298508 - DNA, 19 bp, Homo sapiens
ccatgctctttcaccctgc

SEQ ID NO: 2298509 - DNA, 22 bp, Homo sapiens
ccatgctctttcaccctgccac

SEQ ID NO: 2298510 - DNA, 23 bp, Homo sapiens
ccatggaagctggcaggagacac

SEQ ID NO: 2298511 - DNA, 16 bp, Homo sapiens
ccatggccccagctgg

SEQ ID NO: 2298512 - DNA, 19 bp, Homo sapiens
ccatggtcacagacccctg

SEQ ID NO: 2298513 - DNA, 21 bp, Homo sapiens
ccatgtctgtagttgctttgc

SEQ ID NO: 2298514 - DNA, 20 bp, Homo sapiens
ccatgtggccttgagcaagt

SEQ ID NO: 2298515 - DNA, 14 bp, Homo sapiens
ccatgttgcccaga

SEQ ID NO: 2298516 - DNA, 15 bp, Homo sapiens
ccattagtatcctgt

SEQ ID NO: 2298517 - DNA, 16 bp, Homo sapiens
ccattataaaatcttt

SEQ ID NO: 2298518 - DNA, 18 bp, Homo sapiens
ccattcagcctcgtctct

SEQ ID NO: 2298519 - DNA, 20 bp, Homo sapiens
ccattcatactaaataaaac

SEQ ID NO: 2298520 - DNA, 22 bp, Homo sapiens
ccattctatgactcttgtctcc

SEQ ID NO: 2298521 - DNA, 18 bp, Homo sapiens
ccattgcactccagcctg

SEQ ID NO: 2298522 - DNA, 12 bp, Homo sapiens
ccatttgtaatg

SEQ ID NO: 2298523 - DNA, 14 bp, Homo sapiens
cccaaaacaaagtc

SEQ ID NO: 2298524 - DNA, 11 bp, Homo sapiens
cccaaaagatt

SEQ ID NO: 2298525 - DNA, 14 bp, Homo sapiens
cccaaataaatgtg

SEQ ID NO: 2298526 - DNA, 19 bp, Homo sapiens
cccaaataaatgtgtaaat

SEQ ID NO: 2298527 - DNA, 21 bp, Homo sapiens
cccaacaagtgctctttccac

SEQ ID NO: 2298528 - DNA, 21 bp, Homo sapiens
cccaacctcttcctcctgaca

SEQ ID NO: 2298529 - DNA, 21 bp, Homo sapiens
cccaagcacaaactgtcgtct

SEQ ID NO: 2298530 - DNA, 15 bp, Homo sapiens
cccacaccccgtctg

SEQ ID NO: 2298531 - DNA, 14 bp, Homo sapiens
cccacacctgcctc

SEQ ID NO: 2298532 - DNA, 17 bp, Homo sapiens
cccacacgccggggctg

SEQ ID NO: 2298533 - DNA, 20 bp, Homo sapiens
cccacacgccggggctggcc

SEQ ID NO: 2298534 - DNA, 16 bp, Homo sapiens
cccacagcctcttcct

SEQ ID NO: 2298535 - DNA, 20 bp, Homo sapiens
cccacccaggcaggggcttc

SEQ ID NO: 2298536 - DNA, 18 bp, Homo sapiens
cccacccccgggtgcctg

SEQ ID NO: 2298537 - DNA, 16 bp, Homo sapiens
cccaccccgctgcctg

SEQ ID NO: 2298538 - DNA, 22 bp, Homo sapiens
cccaccccgctgcctggcgggc

SEQ ID NO: 2298539 - DNA, 15 bp, Homo sapiens
cccacccctccatga

SEQ ID NO: 2298540 - DNA, 13 bp, Homo sapiens
cccaccctgggcc

SEQ ID NO: 2298541 - DNA, 18 bp, Homo sapiens
cccaccctgggcctcccg

SEQ ID NO: 2298542 - DNA, 19 bp, Homo sapiens
cccaccctgggcctcccgt

SEQ ID NO: 2298543 - DNA, 12 bp, Homo sapiens
cccacctgccca

SEQ ID NO: 2298544 - DNA, 14 bp, Homo sapiens
cccacctgcccagt

SEQ ID NO: 2298545 - DNA, 16 bp, Homo sapiens
cccacgcttctggagg

SEQ ID NO: 2298546 - DNA, 19 bp, Homo sapiens
cccacggccgtccctgact

SEQ ID NO: 2298547 - DNA, 17 bp, Homo sapiens
cccactccgactccccc

SEQ ID NO: 2298548 - DNA, 19 bp, Homo sapiens
cccactccgactccccctc

SEQ ID NO: 2298549 - DNA, 21 bp, Homo sapiens
cccactttcgcctcctccagc

SEQ ID NO: 2298550 - DNA, 22 bp, Homo sapiens
cccagaaagcctcagagtcctg

SEQ ID NO: 2298551 - DNA, 19 bp, Homo sapiens
cccagaaatgccgctgtgt

SEQ ID NO: 2298552 - DNA, 15 bp, Homo sapiens
cccagaacgggcctc

SEQ ID NO: 2298553 - DNA, 16 bp, Homo sapiens
cccagaacgggcctcc

SEQ ID NO: 2298554 - DNA, 14 bp, Homo sapiens
cccagaccccatcc

SEQ ID NO: 2298555 - DNA, 21 bp, Homo sapiens
cccagaccccatccagccagg

SEQ ID NO: 2298556 - DNA, 22 bp, Homo sapiens
cccggcagccccccagtgtccc

SEQ ID NO: 2298557 - DNA, 21 bp, Homo sapiens
cccggcatcatttcccctccc

SEQ ID NO: 2298558 - DNA, 23 bp, Homo sapiens
cccggcatcatttcccctcccgc

SEQ ID NO: 2298559 - DNA, 21 bp, Homo sapiens
cccggcatgccgagtgcccca

SEQ ID NO: 2298560 - DNA, 14 bp, Homo sapiens
cccggcccacgcag

SEQ ID NO: 2298561 - DNA, 19 bp, Homo sapiens
cccggcccacgcagagccc

SEQ ID NO: 2298562 - DNA, 15 bp, Homo sapiens
cccgggaagcaaatg

SEQ ID NO: 2298563 - DNA, 16 bp, Homo sapiens
cccgggggtccccgga

SEQ ID NO: 2298564 - DNA, 17 bp, Homo sapiens
cccgggggtccccggac

SEQ ID NO: 2298565 - DNA, 14 bp, Homo sapiens
cccgggtgcctgtg

SEQ ID NO: 2298566 - DNA, 16 bp, Homo sapiens
cccggtgtatgcagtg

SEQ ID NO: 2298567 - DNA, 17 bp, Homo sapiens
cccggtgtatgcagtgg

SEQ ID NO: 2298568 - DNA, 18 bp, Homo sapiens
cccggtgtgaggaggggc

SEQ ID NO: 2298569 - DNA, 14 bp, Homo sapiens
cccgtctgcccctt

SEQ ID NO: 2298570 - DNA, 19 bp, Homo sapiens
cccgtgccaaatcctgggc

SEQ ID NO: 2298571 - DNA, 20 bp, Homo sapiens
cccgtgcggcccgtgcgcag

SEQ ID NO: 2298572 - DNA, 18 bp, Homo sapiens
cccgtgtattcaggaccc

SEQ ID NO: 2298573 - DNA, 15 bp, Homo sapiens
ccctaccctgcacat

SEQ ID NO: 2298574 - DNA, 20 bp, Homo sapiens
ccctacgatgggatcattat

SEQ ID NO: 2298575 - DNA, 21 bp, Homo sapiens
ccctagctataccagcagaaa

SEQ ID NO: 2298576 - DNA, 16 bp, Homo sapiens
ccctagtgatttttgg

SEQ ID NO: 2298577 - DNA, 17 bp, Homo sapiens
ccctatctatgtcctgg

SEQ ID NO: 2298578 - DNA, 15 bp, Homo sapiens
ccctcagtctacact

SEQ ID NO: 2298579 - DNA, 23 bp, Homo sapiens
ccctccatgattccaagggccca

SEQ ID NO: 2298580 - DNA, 14 bp, Homo sapiens
ccctcccccacggc

SEQ ID NO: 2298581 - DNA, 13 bp, Homo sapiens
ccctcccccgcag

SEQ ID NO: 2298582 - DNA, 15 bp, Homo sapiens
ccctcccccgcagac

SEQ ID NO: 2298583 - DNA, 13 bp, Homo sapiens
ccctcccgcttcc

SEQ ID NO: 2298584 - DNA, 18 bp, Homo sapiens
ccctcccgcttcctccgg

SEQ ID NO: 2298585 - DNA, 21 bp, Homo sapiens
ccctccctgtaatgcactcct

SEQ ID NO: 2298586 - DNA, 22 bp, Homo sapiens
ccctccctgtaatgcactcctg

SEQ ID NO: 2298587 - DNA, 16 bp, Homo sapiens
ccctccgtccccaggg

SEQ ID NO: 2298588 - DNA, 16 bp, Homo sapiens
ccctccgtcctggcag

SEQ ID NO: 2298589 - DNA, 17 bp, Homo sapiens
ccctcctccttgctgat

SEQ ID NO: 2298590 - DNA, 14 bp, Homo sapiens
ccctcctcgggcgc

SEQ ID NO: 2298591 - DNA, 18 bp, Homo sapiens
ccctcctctgccccctcc

SEQ ID NO: 2298592 - DNA, 19 bp, Homo sapiens
ccctccttttcccactggt

SEQ ID NO: 2298593 - DNA, 13 bp, Homo sapiens
ccctcgctccggg

SEQ ID NO: 2298594 - DNA, 23 bp, Homo sapiens
ccctcggggcaggaagtccctga

SEQ ID NO: 2298595 - DNA, 14 bp, Homo sapiens
ccctctctcaccag

SEQ ID NO: 2298596 - DNA, 16 bp, Homo sapiens
ccctctctcaccagcc

SEQ ID NO: 2298597 - DNA, 18 bp, Homo sapiens
ccctctctcaccagcctt

SEQ ID NO: 2298598 - DNA, 14 bp, Homo sapiens
ccctctggggccct

SEQ ID NO: 2298599 - DNA, 16 bp, Homo sapiens
ccctgacttcccagct

SEQ ID NO: 2298600 - DNA, 18 bp, Homo sapiens
ccctgacttcccagctgg

SEQ ID NO: 2298601 - DNA, 16 bp, Homo sapiens
ccctgagaagcctcat

SEQ ID NO: 2298602 - DNA, 14 bp, Homo sapiens
ccctgaggacctgc

SEQ ID NO: 2298603 - DNA, 19 bp, Homo sapiens
ccctgagggtttccacctt

SEQ ID NO: 2298604 - DNA, 16 bp, Homo sapiens
ccctgccaccctctgc

SEQ ID NO: 2298605 - DNA, 19 bp, Homo sapiens
ccctgccaccctctgctgc

SEQ ID NO: 2298606 - DNA, 20 bp, Homo sapiens
ccctgccaccctctgctgca

SEQ ID NO: 2298607 - DNA, 13 bp, Homo sapiens
ccctgccctgcac

SEQ ID NO: 2298608 - DNA, 14 bp, Homo sapiens
ccctgccctgcacc

SEQ ID NO: 2298609 - DNA, 19 bp, Homo sapiens
ccctgccctggccactggc

SEQ ID NO: 2298610 - DNA, 19 bp, Homo sapiens
ccctgctgctcctcggcca

SEQ ID NO: 2298611 - DNA, 24 bp, Homo sapiens
ccctgctgctcctcggccagagct

SEQ ID NO: 2298612 - DNA, 20 bp, Homo sapiens
ccctggaggggcccatgtgg

SEQ ID NO: 2298613 - DNA, 17 bp, Homo sapiens
ccctgggccccgcctca

SEQ ID NO: 2298614 - DNA, 18 bp, Homo sapiens
ccctgggccccgcctcaa

SEQ ID NO: 2298615 - DNA, 14 bp, Homo sapiens
ccctgggcctcccg

SEQ ID NO: 2298616 - DNA, 18 bp, Homo sapiens
ccctgggggaggcttcca

SEQ ID NO: 2298617 - DNA, 23 bp, Homo sapiens
ccctggggtttccacacaggccc

SEQ ID NO: 2298618 - DNA, 18 bp, Homo sapiens
ccctggttcccccaggac

SEQ ID NO: 2298619 - DNA, 15 bp, Homo sapiens
ccctgtttctcccca

SEQ ID NO: 2298620 - DNA, 20 bp, Homo sapiens
cccttgggatgggcacaggc

SEQ ID NO: 2298621 - DNA, 11 bp, Homo sapiens
cccttttcctt

SEQ ID NO: 2298622 - DNA, 22 bp, Homo sapiens
ccgaaaggtcacctcactcagc

SEQ ID NO: 2298623 - DNA, 18 bp, Homo sapiens
ccgacaggaggccatgcc

SEQ ID NO: 2298624 - DNA, 19 bp, Homo sapiens
ccgaccccacctgaggcag

SEQ ID NO: 2298625 - DNA, 21 bp, Homo sapiens
ccgaccccacctgaggcagga

SEQ ID NO: 2298626 - DNA, 14 bp, Homo sapiens
ccgacggagccact

SEQ ID NO: 2298627 - DNA, 19 bp, Homo sapiens
ccgacggagccactggggt

SEQ ID NO: 2298628 - DNA, 20 bp, Homo sapiens
ccgacggagccactggggtg

SEQ ID NO: 2298629 - DNA, 17 bp, Homo sapiens
ccgagacggcactgaga

SEQ ID NO: 2298630 - DNA, 16 bp, Homo sapiens
ccgagagctgggactc

SEQ ID NO: 2298631 - DNA, 19 bp, Homo sapiens
ccgagccgagctctcctgg

SEQ ID NO: 2298632 - DNA, 19 bp, Homo sapiens
ccgagcgcgtgccttcccc

SEQ ID NO: 2298633 - DNA, 16 bp, Homo sapiens
ccgagctctcctgggc

SEQ ID NO: 2298634 - DNA, 20 bp, Homo sapiens
ccgagctctcctgggccagg

SEQ ID NO: 2298635 - DNA, 19 bp, Homo sapiens
ccgaggcctggctctggag

SEQ ID NO: 2298636 - DNA, 12 bp, Homo sapiens
ccgagggaaatg

SEQ ID NO: 2298637 - DNA, 15 bp, Homo sapiens
ccgataaatgaacat

SEQ ID NO: 2298638 - DNA, 19 bp, Homo sapiens
ccgatggcccgagagctgg

SEQ ID NO: 2298639 - DNA, 11 bp, Homo sapiens
ccgcacccctc

SEQ ID NO: 2298640 - DNA, 12 bp, Homo sapiens
ccgcaccctggc

SEQ ID NO: 2298641 - DNA, 13 bp, Homo sapiens
ccgcaccctggct

SEQ ID NO: 2298642 - DNA, 15 bp, Homo sapiens
ccgcaccctggctgg

SEQ ID NO: 2298643 - DNA, 14 bp, Homo sapiens
ccgcagatcctgtc

SEQ ID NO: 2298644 - DNA, 20 bp, Homo sapiens
ccgcagcgggcgcgggacag

SEQ ID NO: 2298645 - DNA, 21 bp, Homo sapiens
ccgcagggcgctccggcagag

SEQ ID NO: 2298646 - DNA, 20 bp, Homo sapiens
ccgccccagagactgcccac

SEQ ID NO: 2298647 - DNA, 11 bp, Homo sapiens
ccgccccaggc

SEQ ID NO: 2298648 - DNA, 17 bp, Homo sapiens
ccgcccccgccctcgct

SEQ ID NO: 2298649 - DNA, 13 bp, Homo sapiens
ccgcccgcccacc

SEQ ID NO: 2298650 - DNA, 14 bp, Homo sapiens
ccgcccgcccccgc

SEQ ID NO: 2298651 - DNA, 15 bp, Homo sapiens
ccgcccgcccccgcc

SEQ ID NO: 2298652 - DNA, 11 bp, Homo sapiens
ccgcccgccct

SEQ ID NO: 2298653 - DNA, 15 bp, Homo sapiens
ccgcccgccctcctc

SEQ ID NO: 2298654 - DNA, 12 bp, Homo sapiens
ccgccctcctct

SEQ ID NO: 2298655 - DNA, 14 bp, Homo sapiens
ccgccctcctctgc

SEQ ID NO: 2298656 - DNA, 15 bp, Homo sapiens
ccgccctcctctgcc

SEQ ID NO: 2298657 - DNA, 16 bp, Homo sapiens
ccgccctcctctgccc

SEQ ID NO: 2298658 - DNA, 13 bp, Homo sapiens
ccgccctcgctcc

SEQ ID NO: 2298659 - DNA, 21 bp, Homo sapiens
ccgccggttggccggctggcc

SEQ ID NO: 2298660 - DNA, 23 bp, Homo sapiens
ccgcctcaaggaagagccagccg

SEQ ID NO: 2298661 - DNA, 17 bp, Homo sapiens
ccgcctcgggccgcctc

SEQ ID NO: 2298662 - DNA, 20 bp, Homo sapiens
ccgcctcgggccgcctcctc

SEQ ID NO: 2298663 - DNA, 18 bp, Homo sapiens
ccgcctgcccccagcgtg

SEQ ID NO: 2298664 - DNA, 17 bp, Homo sapiens
ccgcgcaccgccatgca

SEQ ID NO: 2298665 - DNA, 17 bp, Homo sapiens
ccgcgcgcgccccgaaa

SEQ ID NO: 2298666 - DNA, 13 bp, Homo sapiens
ccgcgctctgccc

SEQ ID NO: 2298667 - DNA, 14 bp, Homo sapiens
ccgcgctctgcccc

SEQ ID NO: 2298668 - DNA, 19 bp, Homo sapiens
ccgcgctctgcccctccgt

SEQ ID NO: 2298669 - DNA, 16 bp, Homo sapiens
ccgctcaacctctcag

SEQ ID NO: 2298670 - DNA, 16 bp, Homo sapiens
ccgctctcccagacct

SEQ ID NO: 2298671 - DNA, 22 bp, Homo sapiens
ccgctctgccatcagcccctgc

SEQ ID NO: 2298672 - DNA, 18 bp, Homo sapiens
ccgctgcccccaccctgc

SEQ ID NO: 2298673 - DNA, 20 bp, Homo sapiens
ccgctgcccccaccctgctt

SEQ ID NO: 2298674 - DNA, 19 bp, Homo sapiens
ccgctgcctggcgggcagc

SEQ ID NO: 2298675 - DNA, 16 bp, Homo sapiens
ccgctgcttgagtgga

SEQ ID NO: 2298676 - DNA, 23 bp, Homo sapiens
ccgctgcttgagtggacagcagc

SEQ ID NO: 2298677 - DNA, 15 bp, Homo sapiens
ccggagcggctgagg

SEQ ID NO: 2298678 - DNA, 16 bp, Homo sapiens
ccggagcggctgagga

SEQ ID NO: 2298679 - DNA, 14 bp, Homo sapiens
ccggagctgggaag

SEQ ID NO: 2298680 - DNA, 16 bp, Homo sapiens
ccggaggcgcccacct

SEQ ID NO: 2298681 - DNA, 17 bp, Homo sapiens
ccggaggcgcccacctg

SEQ ID NO: 2298682 - DNA, 21 bp, Homo sapiens
ccggaggcgcccacctgccca

SEQ ID NO: 2298683 - DNA, 12 bp, Homo sapiens
ccggcagaggca

SEQ ID NO: 2298684 - DNA, 21 bp, Homo sapiens
ccggcagaggcagggccctgg

SEQ ID NO: 2298685 - DNA, 12 bp, Homo sapiens
ccggcagccccc

SEQ ID NO: 2298686 - DNA, 19 bp, Homo sapiens
ccggcatcatttcccctcc

SEQ ID NO: 2298687 - DNA, 20 bp, Homo sapiens
ccggcatcatttcccctccc

SEQ ID NO: 2298688 - DNA, 19 bp, Homo sapiens
ccggcatgccgagtgcccc

SEQ ID NO: 2298689 - DNA, 18 bp, Homo sapiens
cctgacacctgccgctgc

SEQ ID NO: 2298690 - DNA, 20 bp, Homo sapiens
cctgacacctgccgctgctt

SEQ ID NO: 2298691 - DNA, 19 bp, Homo sapiens
cctgacttcccagctggca

SEQ ID NO: 2298692 - DNA, 23 bp, Homo sapiens
cctgagccacagtggggcccatg

SEQ ID NO: 2298693 - DNA, 16 bp, Homo sapiens
cctgagccagatttca

SEQ ID NO: 2298694 - DNA, 20 bp, Homo sapiens
cctgagccagatttcactct

SEQ ID NO: 2298695 - DNA, 16 bp, Homo sapiens
cctgagctccaccctc

SEQ ID NO: 2298696 - DNA, 16 bp, Homo sapiens
cctgaggcaggagggc

SEQ ID NO: 2298697 - DNA, 19 bp, Homo sapiens
cctgaggcaggagggcatg

SEQ ID NO: 2298698 - DNA, 23 bp, Homo sapiens
cctgaggcaggagggcatgtgca

SEQ ID NO: 2298699 - DNA, 19 bp, Homo sapiens
cctgagggaagagtagctg

SEQ ID NO: 2298700 - DNA, 16 bp, Homo sapiens
cctgagtagctgggac

SEQ ID NO: 2298701 - DNA, 22 bp, Homo sapiens
cctgatattgaagtaaaaaatt

SEQ ID NO: 2298702 - DNA, 18 bp, Homo sapiens
cctgcaccttgggcacgg

SEQ ID NO: 2298703 - DNA, 21 bp, Homo sapiens
cctgcagctgagattccagaa

SEQ ID NO: 2298704 - DNA, 16 bp, Homo sapiens
cctgcaggactcgggc

SEQ ID NO: 2298705 - DNA, 20 bp, Homo sapiens
cctgcaggcggtatccagag

SEQ ID NO: 2298706 - DNA, 18 bp, Homo sapiens
cctgccaccctctgctgc

SEQ ID NO: 2298707 - DNA, 17 bp, Homo sapiens
cctgcccccagcgtggg

SEQ ID NO: 2298708 - DNA, 14 bp, Homo sapiens
cctgccccgccggc

SEQ ID NO: 2298709 - DNA, 12 bp, Homo sapiens
cctgccccggcc

SEQ ID NO: 2298710 - DNA, 14 bp, Homo sapiens
cctgccctccccca

SEQ ID NO: 2298711 - DNA, 16 bp, Homo sapiens
cctgccctcccccacg

SEQ ID NO: 2298712 - DNA, 19 bp, Homo sapiens
cctgccctcccccacggcc

SEQ ID NO: 2298713 - DNA, 13 bp, Homo sapiens
cctgccctgcacc

SEQ ID NO: 2298714 - DNA, 17 bp, Homo sapiens
cctgccgacggagccac

SEQ ID NO: 2298715 - DNA, 19 bp, Homo sapiens
cctgccgacggagccactg

SEQ ID NO: 2298716 - DNA, 19 bp, Homo sapiens
cctgcctctgaactgctgc

SEQ ID NO: 2298717 - DNA, 15 bp, Homo sapiens
cctgcctggcggcag

SEQ ID NO: 2298718 - DNA, 18 bp, Homo sapiens
cctgcctggcggcagggg

SEQ ID NO: 2298719 - DNA, 14 bp, Homo sapiens
cctgcgcaggccct

SEQ ID NO: 2298720 - DNA, 17 bp, Homo sapiens
cctgcgcaggccctccg

SEQ ID NO: 2298721 - DNA, 12 bp, Homo sapiens
cctgcgctcctc

SEQ ID NO: 2298722 - DNA, 14 bp, Homo sapiens
cctgcgctcctctg

SEQ ID NO: 2298723 - DNA, 18 bp, Homo sapiens
cctgcgctcctctgcagc

SEQ ID NO: 2298724 - DNA, 15 bp, Homo sapiens
cctgcgtggcctggg

SEQ ID NO: 2298725 - DNA, 19 bp, Homo sapiens
cctgcgtggcctggggctg

SEQ ID NO: 2298726 - DNA, 22 bp, Homo sapiens
cctgcgtggcctggggctgccg

SEQ ID NO: 2298727 - DNA, 19 bp, Homo sapiens
cctgctacagtagctgtgg

SEQ ID NO: 2298728 - DNA, 15 bp, Homo sapiens
cctgctactgccaac

SEQ ID NO: 2298729 - DNA, 18 bp, Homo sapiens
cctgctactgccaacctc

SEQ ID NO: 2298730 - DNA, 14 bp, Homo sapiens
cctgctagcggctg

SEQ ID NO: 2298731 - DNA, 15 bp, Homo sapiens
cctgctccagatcct

SEQ ID NO: 2298732 - DNA, 21 bp, Homo sapiens
cctgctgagtggtccacattc

SEQ ID NO: 2298733 - DNA, 16 bp, Homo sapiens
cctgctgctcctcggc

SEQ ID NO: 2298734 - DNA, 18 bp, Homo sapiens
cctgctgctcgggaaggc

SEQ ID NO: 2298735 - DNA, 17 bp, Homo sapiens
cctgcttctgctgcctg

SEQ ID NO: 2298736 - DNA, 18 bp, Homo sapiens
cctgcttctgctgcctgt

SEQ ID NO: 2298737 - DNA, 22 bp, Homo sapiens
cctggactctgtggggccacac

SEQ ID NO: 2298738 - DNA, 14 bp, Homo sapiens
cctggagaaggaag

SEQ ID NO: 2298739 - DNA, 14 bp, Homo sapiens
cctggagcccggca

SEQ ID NO: 2298740 - DNA, 15 bp, Homo sapiens
cctggagcccggcag

SEQ ID NO: 2298741 - DNA, 15 bp, Homo sapiens
cctggaggctggacc

SEQ ID NO: 2298742 - DNA, 22 bp, Homo sapiens
cctggaggggcccatgtgggct

SEQ ID NO: 2298743 - DNA, 13 bp, Homo sapiens
cctggagtggcat

SEQ ID NO: 2298744 - DNA, 14 bp, Homo sapiens
cctggagtggcatg

SEQ ID NO: 2298745 - DNA, 16 bp, Homo sapiens
cctggagtggcatggt

SEQ ID NO: 2298746 - DNA, 20 bp, Homo sapiens
cctggagtggcatggtcctg

SEQ ID NO: 2298747 - DNA, 15 bp, Homo sapiens
cctggcaaataatac

SEQ ID NO: 2298748 - DNA, 22 bp, Homo sapiens
cctggccactggccctgtttct

SEQ ID NO: 2298749 - DNA, 18 bp, Homo sapiens
cctggcccctcccacatc

SEQ ID NO: 2298750 - DNA, 13 bp, Homo sapiens
cctggcggcaggg

SEQ ID NO: 2298751 - DNA, 15 bp, Homo sapiens
cctggcggcaggggt

SEQ ID NO: 2298752 - DNA, 13 bp, Homo sapiens
cctggcgggcagc

SEQ ID NO: 2298753 - DNA, 14 bp, Homo sapiens
cctggcgggcagcc

SEQ ID NO: 2298754 - DNA, 16 bp, Homo sapiens
cctggcgggcagcccc

SEQ ID NO: 2298755 - DNA, 17 bp, Homo sapiens
cctggcgggcagcccct

SEQ ID NO: 2298756 - DNA, 18 bp, Homo sapiens
cctggcgggcagcccctg

SEQ ID NO: 2298757 - DNA, 21 bp, Homo sapiens
cctggcgggcagcccctgctg

SEQ ID NO: 2298758 - DNA, 14 bp, Homo sapiens
cctggctctggagc

SEQ ID NO: 2298759 - DNA, 21 bp, Homo sapiens
cctggctggaatgggggccag

SEQ ID NO: 2298760 - DNA, 15 bp, Homo sapiens
cctgggaggctgcgg

SEQ ID NO: 2298761 - DNA, 20 bp, Homo sapiens
cctgggcatccccagccccc

SEQ ID NO: 2298762 - DNA, 21 bp, Homo sapiens
cctgggccccagaaagcctca

SEQ ID NO: 2298763 - DNA, 23 bp, Homo sapiens
cctgggccccagaaagcctcaga

SEQ ID NO: 2298764 - DNA, 12 bp, Homo sapiens
cctgggccctgg

SEQ ID NO: 2298765 - DNA, 14 bp, Homo sapiens
cctgggccctggtt

SEQ ID NO: 2298766 - DNA, 12 bp, Homo sapiens
cctgggcctccc

SEQ ID NO: 2298767 - DNA, 14 bp, Homo sapiens
cctgggcctcccgt

SEQ ID NO: 2298768 - DNA, 15 bp, Homo sapiens
cctgggcctcccgtc

SEQ ID NO: 2298769 - DNA, 18 bp, Homo sapiens
cctgggggaggcttccag

SEQ ID NO: 2298770 - DNA, 22 bp, Homo sapiens
cctgggggaggcttccagctca

SEQ ID NO: 2298771 - DNA, 16 bp, Homo sapiens
cctggggtctctgagc

SEQ ID NO: 2298772 - DNA, 18 bp, Homo sapiens
cctggggtctctgagcag

SEQ ID NO: 2298773 - DNA, 22 bp, Homo sapiens
cctggggtttccacacaggccc

SEQ ID NO: 2298774 - DNA, 16 bp, Homo sapiens
cctggtatggctgcag

SEQ ID NO: 2298775 - DNA, 23 bp, Homo sapiens
cctggtcagttttcacagaggcg

SEQ ID NO: 2298776 - DNA, 15 bp, Homo sapiens
cctggtggtttctgt

SEQ ID NO: 2298777 - DNA, 15 bp, Homo sapiens
cctggttcccccagg

SEQ ID NO: 2298778 - DNA, 20 bp, Homo sapiens
cctggttcccccaggaccct

SEQ ID NO: 2298779 - DNA, 17 bp, Homo sapiens
cctgtaatgcactcctg

SEQ ID NO: 2298780 - DNA, 18 bp, Homo sapiens
cctgtaatgcactcctgc

SEQ ID NO: 2298781 - DNA, 19 bp, Homo sapiens
cctgtaatgcactcctgcc

SEQ ID NO: 2298782 - DNA, 21 bp, Homo sapiens
cctgtaatgcactcctgcccc

SEQ ID NO: 2298783 - DNA, 14 bp, Homo sapiens
cctgtcccatgggc

SEQ ID NO: 2298784 - DNA, 18 bp, Homo sapiens
cctgtcccatgggctctg

SEQ ID NO: 2298785 - DNA, 15 bp, Homo sapiens
cctgtctaatgaaac

SEQ ID NO: 2298786 - DNA, 18 bp, Homo sapiens
cctgtgaccggggtcctg

SEQ ID NO: 2298787 - DNA, 17 bp, Homo sapiens
cctgtgcaaaataaaat

SEQ ID NO: 2298788 - DNA, 20 bp, Homo sapiens
cctgtgcccatggcttctgg

SEQ ID NO: 2298789 - DNA, 12 bp, Homo sapiens
cctgtgctttca

SEQ ID NO: 2298790 - DNA, 16 bp, Homo sapiens
cctgtggaaatatgca

SEQ ID NO: 2298791 - DNA, 14 bp, Homo sapiens
cctgtgtccacagt

SEQ ID NO: 2298792 - DNA, 19 bp, Homo sapiens
cctgttctgtgtctgctgt

SEQ ID NO: 2298793 - DNA, 21 bp, Homo sapiens
ccttaactgtccagtccagtg

SEQ ID NO: 2298794 - DNA, 14 bp, Homo sapiens
ccttacacaatggt

SEQ ID NO: 2298795 - DNA, 20 bp, Homo sapiens
ccttacacaatggttttctt

SEQ ID NO: 2298796 - DNA, 14 bp, Homo sapiens
ccttagcttctggc

SEQ ID NO: 2298797 - DNA, 12 bp, Homo sapiens
ccttatggaaca

SEQ ID NO: 2298798 - DNA, 17 bp, Homo sapiens
ccttatggaacactctg

SEQ ID NO: 2298799 - DNA, 23 bp, Homo sapiens
ccttcagaaaagacacttcaatg

SEQ ID NO: 2298800 - DNA, 10 bp, Homo sapiens
ccttcagtgc

SEQ ID NO: 2298801 - DNA, 12 bp, Homo sapiens
ccttcagtgcct

SEQ ID NO: 2298802 - DNA, 15 bp, Homo sapiens
ccttcagtgccttat

SEQ ID NO: 2298803 - DNA, 19 bp, Homo sapiens
ccttcccgcagcaccagcc

SEQ ID NO: 2298804 - DNA, 15 bp, Homo sapiens
ccttcctgttctgtg

SEQ ID NO: 2298805 - DNA, 20 bp, Homo sapiens
ccttcctgttctgtgtctgc

SEQ ID NO: 2298806 - DNA, 14 bp, Homo sapiens
ccttctacctgcag

SEQ ID NO: 2298807 - DNA, 19 bp, Homo sapiens
ccttctacctgcaggactc

SEQ ID NO: 2298808 - DNA, 19 bp, Homo sapiens
ccttctgataagactggaa

SEQ ID NO: 2298809 - DNA, 20 bp, Homo sapiens
ccttgaggacctccacctgg

SEQ ID NO: 2298810 - DNA, 21 bp, Homo sapiens
ccttgaggacctccacctggg

SEQ ID NO: 2298811 - DNA, 22 bp, Homo sapiens
ccttgaggacctccacctggga

SEQ ID NO: 2298812 - DNA, 22 bp, Homo sapiens
ccttgccacatcgcagcccctg

SEQ ID NO: 2298813 - DNA, 17 bp, Homo sapiens
ccttgcctctgctctgt

SEQ ID NO: 2298814 - DNA, 18 bp, Homo sapiens
ccttgctcaccaagctgt

SEQ ID NO: 2298815 - DNA, 22 bp, Homo sapiens
ccttgctcaccaagctgttcca

SEQ ID NO: 2298816 - DNA, 14 bp, Homo sapiens
ccttgcttcacttt

SEQ ID NO: 2298817 - DNA, 22 bp, Homo sapiens
ccttgcttctaagggatccaga

SEQ ID NO: 2298818 - DNA, 14 bp, Homo sapiens
ccttggatttttga

SEQ ID NO: 2298819 - DNA, 16 bp, Homo sapiens
ccttggcgcgcagccc

SEQ ID NO: 2298820 - DNA, 21 bp, Homo sapiens
ccttggtgtcgggcatgacac

SEQ ID NO: 2298821 - DNA, 22 bp, Homo sapiens
ccttggtgtcgggcatgacacg

SEQ ID NO: 2298822 - DNA, 16 bp, Homo sapiens
cggagccactggggtg

SEQ ID NO: 2298823 - DNA, 21 bp, Homo sapiens
cggagccactggggtgggagg

SEQ ID NO: 2298824 - DNA, 23 bp, Homo sapiens
cggagccactggggtgggagggg

SEQ ID NO: 2298825 - DNA, 13 bp, Homo sapiens
cggagcggctgag

SEQ ID NO: 2298826 - DNA, 14 bp, Homo sapiens
cggagcggctgagg

SEQ ID NO: 2298827 - DNA, 18 bp, Homo sapiens
cggaggcctcgagcagag

SEQ ID NO: 2298828 - DNA, 14 bp, Homo sapiens
cggaggcgcccacc

SEQ ID NO: 2298829 - DNA, 17 bp, Homo sapiens
cggaggcgcccacctgc

SEQ ID NO: 2298830 - DNA, 18 bp, Homo sapiens
cggaggcgcccacctgcc

SEQ ID NO: 2298831 - DNA, 19 bp, Homo sapiens
cggaggcgcccacctgccc

SEQ ID NO: 2298832 - DNA, 20 bp, Homo sapiens
cggaggcgcccacctgccca

SEQ ID NO: 2298833 - DNA, 17 bp, Homo sapiens
cggcaacccctgcagct

SEQ ID NO: 2298834 - DNA, 13 bp, Homo sapiens
cggcaccgcccac

SEQ ID NO: 2298835 - DNA, 16 bp, Homo sapiens
cggcaccgcccaccca

SEQ ID NO: 2298836 - DNA, 16 bp, Homo sapiens
cggcagaggcagggcc

SEQ ID NO: 2298837 - DNA, 18 bp, Homo sapiens
cggcagaggcagggccct

SEQ ID NO: 2298838 - DNA, 11 bp, Homo sapiens
cggcagcccca

SEQ ID NO: 2298839 - DNA, 19 bp, Homo sapiens
cggcagccccatccttccc

SEQ ID NO: 2298840 - DNA, 17 bp, Homo sapiens
cggcatcatttcccctc

SEQ ID NO: 2298841 - DNA, 15 bp, Homo sapiens
cggccaaggacactg

SEQ ID NO: 2298842 - DNA, 14 bp, Homo sapiens
cggccagagctccc

SEQ ID NO: 2298843 - DNA, 15 bp, Homo sapiens
cggccagagctccca

SEQ ID NO: 2298844 - DNA, 18 bp, Homo sapiens
cggcccacgcagagcccc

SEQ ID NO: 2298845 - DNA, 21 bp, Homo sapiens
cggcccacgcagagccccgga

SEQ ID NO: 2298846 - DNA, 13 bp, Homo sapiens
cggccccgcaccc

SEQ ID NO: 2298847 - DNA, 22 bp, Homo sapiens
cggccccgcacccctcctcctt

SEQ ID NO: 2298848 - DNA, 16 bp, Homo sapiens
cggccccgcgcgtgcc

SEQ ID NO: 2298849 - DNA, 17 bp, Homo sapiens
cggccccgcgcgtgccc

SEQ ID NO: 2298850 - DNA, 18 bp, Homo sapiens
cggccccgcgcgtgcccc

SEQ ID NO: 2298851 - DNA, 14 bp, Homo sapiens
cggcccgccacctt

SEQ ID NO: 2298852 - DNA, 18 bp, Homo sapiens
cggcccggcccacgcaga

SEQ ID NO: 2298853 - DNA, 18 bp, Homo sapiens
cggccgcgcaccgccatg

SEQ ID NO: 2298854 - DNA, 14 bp, Homo sapiens
cggccggcctgggg

SEQ ID NO: 2298855 - DNA, 13 bp, Homo sapiens
cggccgtccctga

SEQ ID NO: 2298856 - DNA, 14 bp, Homo sapiens
cggcctctggggag

SEQ ID NO: 2298857 - DNA, 12 bp, Homo sapiens
cggcctgcagcc

SEQ ID NO: 2298858 - DNA, 13 bp, Homo sapiens
cggcctgcagccc

SEQ ID NO: 2298859 - DNA, 15 bp, Homo sapiens
cggcctgcagcccag

SEQ ID NO: 2298860 - DNA, 18 bp, Homo sapiens
cggcctgcagcccagaac

SEQ ID NO: 2298861 - DNA, 23 bp, Homo sapiens
cggcctggggccgggctggcttc

SEQ ID NO: 2298862 - DNA, 15 bp, Homo sapiens
cggctgaacaggccg

SEQ ID NO: 2298863 - DNA, 16 bp, Homo sapiens
cggctgaggacggggc

SEQ ID NO: 2298864 - DNA, 20 bp, Homo sapiens
cggctgaggacggggcagag

SEQ ID NO: 2298865 - DNA, 21 bp, Homo sapiens
cggctgaggacggggcagagc

SEQ ID NO: 2298866 - DNA, 23 bp, Homo sapiens
cggctgaggacggggcagagctg

SEQ ID NO: 2298867 - DNA, 18 bp, Homo sapiens
cggctggccggtccaccc

SEQ ID NO: 2298868 - DNA, 13 bp, Homo sapiens
cggctgggcaggg

SEQ ID NO: 2298869 - DNA, 15 bp, Homo sapiens
cggctgggcagggcc

SEQ ID NO: 2298870 - DNA, 16 bp, Homo sapiens
cggctgggcagggccg

SEQ ID NO: 2298871 - DNA, 14 bp, Homo sapiens
cgggaaggcctgag

SEQ ID NO: 2298872 - DNA, 15 bp, Homo sapiens
cgggaaggcctgagg

SEQ ID NO: 2298873 - DNA, 16 bp, Homo sapiens
cgggaagggtgggccc

SEQ ID NO: 2298874 - DNA, 16 bp, Homo sapiens
cgggacagcggcccgg

SEQ ID NO: 2298875 - DNA, 19 bp, Homo sapiens
cgggacagcggcccggccc

SEQ ID NO: 2298876 - DNA, 20 bp, Homo sapiens
cgggagatccgccctgggct

SEQ ID NO: 2298877 - DNA, 21 bp, Homo sapiens
cgggagcctgcgtggcctggg

SEQ ID NO: 2298878 - DNA, 21 bp, Homo sapiens
cgggcagcccctgctggacca

SEQ ID NO: 2298879 - DNA, 16 bp, Homo sapiens
cgggcatggcagccct

SEQ ID NO: 2298880 - DNA, 19 bp, Homo sapiens
cgggccccatggtcacaga

SEQ ID NO: 2298881 - DNA, 21 bp, Homo sapiens
cgggcccgctcaacctctcag

SEQ ID NO: 2298882 - DNA, 15 bp, Homo sapiens
cgggccgcctcctcc

SEQ ID NO: 2298883 - DNA, 16 bp, Homo sapiens
cgggccgcctcctcca

SEQ ID NO: 2298884 - DNA, 14 bp, Homo sapiens
cgggcctccccggg

SEQ ID NO: 2298885 - DNA, 12 bp, Homo sapiens
cgggcgagaagg

SEQ ID NO: 2298886 - DNA, 15 bp, Homo sapiens
cgggcgcccggactg

SEQ ID NO: 2298887 - DNA, 16 bp, Homo sapiens
cgggcgcctgcgctcc

SEQ ID NO: 2298888 - DNA, 17 bp, Homo sapiens
cgggcgcctgcgctcct

SEQ ID NO: 2298889 - DNA, 22 bp, Homo sapiens
cgggcgcctgcgctcctctgca

SEQ ID NO: 2298890 - DNA, 23 bp, Homo sapiens
cgggcgcctgcgctcctctgcag

SEQ ID NO: 2298891 - DNA, 16 bp, Homo sapiens
cgggcgcgggacagga

SEQ ID NO: 2298892 - DNA, 17 bp, Homo sapiens
cgggctaagtccagctc

SEQ ID NO: 2298893 - DNA, 13 bp, Homo sapiens
cgggctggcttct

SEQ ID NO: 2298894 - DNA, 14 bp, Homo sapiens
cggggacacggcct

SEQ ID NO: 2298895 - DNA, 12 bp, Homo sapiens
cggggcaggaag

SEQ ID NO: 2298896 - DNA, 22 bp, Homo sapiens
cggggccagcatccatgcggcc

SEQ ID NO: 2298897 - DNA, 19 bp, Homo sapiens
cggggctccccttcgcgta

SEQ ID NO: 2298898 - DNA, 12 bp, Homo sapiens
cggggctggccc

SEQ ID NO: 2298899 - DNA, 13 bp, Homo sapiens
cggggctggccct

SEQ ID NO: 2298900 - DNA, 17 bp, Homo sapiens
cggggctggccctgccc

SEQ ID NO: 2298901 - DNA, 22 bp, Homo sapiens
cggggctgtgcgggcgcccgga

SEQ ID NO: 2298902 - DNA, 13 bp, Homo sapiens
cgggggacaggaa

SEQ ID NO: 2298903 - DNA, 18 bp, Homo sapiens
cgggggaggagcaccccc

SEQ ID NO: 2298904 - DNA, 24 bp, Homo sapiens
cgggggaggagcacccccagcctc

SEQ ID NO: 2298905 - DNA, 19 bp, Homo sapiens
cgggggcctagtggcttca

SEQ ID NO: 2298906 - DNA, 15 bp, Homo sapiens
cgggggcggctctgg

SEQ ID NO: 2298907 - DNA, 20 bp, Homo sapiens
cgggggcggctctgggaagc

SEQ ID NO: 2298908 - DNA, 20 bp, Homo sapiens
cgggggctaactggccccag

SEQ ID NO: 2298909 - DNA, 16 bp, Homo sapiens
cggggtcctgaggctg

SEQ ID NO: 2298910 - DNA, 18 bp, Homo sapiens
cggggtcgggggaggagc

SEQ ID NO: 2298911 - DNA, 20 bp, Homo sapiens
cggggtgttgccagcgtggc

SEQ ID NO: 2298912 - DNA, 12 bp, Homo sapiens
cggggttacact

SEQ ID NO: 2298913 - DNA, 23 bp, Homo sapiens
cgggtgcgtgaccggcccgccac

SEQ ID NO: 2298914 - DNA, 22 bp, Homo sapiens
cgggtgtggctcgggtgcccag

SEQ ID NO: 2298915 - DNA, 15 bp, Homo sapiens
cggtccaccccgtcc

SEQ ID NO: 2298916 - DNA, 20 bp, Homo sapiens
cggtccaccccgtcccggcc

SEQ ID NO: 2298917 - DNA, 22 bp, Homo sapiens
cggtccaccccgtcccggcccc

SEQ ID NO: 2298918 - DNA, 16 bp, Homo sapiens
cggtgtatgcagtggt

SEQ ID NO: 2298919 - DNA, 16 bp, Homo sapiens
cgtagggccagggctc

SEQ ID NO: 2298920 - DNA, 21 bp, Homo sapiens
cgtcaatgtgaaataaagagt

SEQ ID NO: 2298921 - DNA, 16 bp, Homo sapiens
cgtcaggaggtgcctg

SEQ ID NO: 2298922 - DNA, 12 bp, Homo sapiens
cgtccccagggt

SEQ ID NO: 2298923 - DNA, 14 bp, Homo sapiens
cgtcccggccccgc

SEQ ID NO: 2298924 - DNA, 14 bp, Homo sapiens
cgtccgcccgccca

SEQ ID NO: 2298925 - DNA, 17 bp, Homo sapiens
cgtccgcccgcccaccc

SEQ ID NO: 2298926 - DNA, 14 bp, Homo sapiens
cgtccggcctgcag

SEQ ID NO: 2298927 - DNA, 15 bp, Homo sapiens
cgtccggcctgcagc

SEQ ID NO: 2298928 - DNA, 19 bp, Homo sapiens
cgtctgccccttgacccca

SEQ ID NO: 2298929 - DNA, 22 bp, Homo sapiens
cgtctgccccttgaccccacac

SEQ ID NO: 2298930 - DNA, 22 bp, Homo sapiens
cgtctgctgttgattccactga

SEQ ID NO: 2298931 - DNA, 14 bp, Homo sapiens
cgtctggtgttctc

SEQ ID NO: 2298932 - DNA, 18 bp, Homo sapiens
cgtgaccggcccgccacc

SEQ ID NO: 2298933 - DNA, 15 bp, Homo sapiens
cgtgagagtcatctc

SEQ ID NO: 2298934 - DNA, 15 bp, Homo sapiens
cgtgcacttgtgatc

SEQ ID NO: 2298935 - DNA, 15 bp, Homo sapiens
cgtgcatttgtgagc

SEQ ID NO: 2298936 - DNA, 13 bp, Homo sapiens
cgtgcccccagcg

SEQ ID NO: 2298937 - DNA, 17 bp, Homo sapiens
cgtgctcttctgttctc

SEQ ID NO: 2298938 - DNA, 19 bp, Homo sapiens
cgtgctcttctgttctcaa

SEQ ID NO: 2298939 - DNA, 16 bp, Homo sapiens
cgtggcaacaggcggg

SEQ ID NO: 2298940 - DNA, 14 bp, Homo sapiens
cgtggcacctcctc

SEQ ID NO: 2298941 - DNA, 15 bp, Homo sapiens
cgtggcacctcctcg

SEQ ID NO: 2298942 - DNA, 15 bp, Homo sapiens
cgtggctgcttcaag

SEQ ID NO: 2298943 - DNA, 22 bp, Homo sapiens
cgtgggggtggccactcctggg

SEQ ID NO: 2298944 - DNA, 19 bp, Homo sapiens
cgtggtgtgaggcccccgg

SEQ ID NO: 2298945 - DNA, 15 bp, Homo sapiens
cgtgttatgactcca

SEQ ID NO: 2298946 - DNA, 16 bp, Homo sapiens
cgtgttcgctggctga

SEQ ID NO: 2298947 - DNA, 19 bp, Homo sapiens
cgtttcatgtagccagcag

SEQ ID NO: 2298948 - DNA, 20 bp, Homo sapiens
ctaaaatagtttaaaaatat

SEQ ID NO: 2298949 - DNA, 18 bp, Homo sapiens
ctaaaattcaacaaatga

SEQ ID NO: 2298950 - DNA, 22 bp, Homo sapiens
ctaaaattctagtctctgattt

SEQ ID NO: 2298951 - DNA, 13 bp, Homo sapiens
ctaaacacacttt

SEQ ID NO: 2298952 - DNA, 19 bp, Homo sapiens
ctaaacccaaataaatgtg

SEQ ID NO: 2298953 - DNA, 14 bp, Homo sapiens
ctaaactctgaaat

SEQ ID NO: 2298954 - DNA, 22 bp, Homo sapiens
ctaaagagctaggaaagagttg

SEQ ID NO: 2298955 - DNA, 20 bp, Homo sapiens
ctcacctctaggcctcagtg

SEQ ID NO: 2298956 - DNA, 15 bp, Homo sapiens
ctcacgcattctctg

SEQ ID NO: 2298957 - DNA, 13 bp, Homo sapiens
ctcactcagcacc

SEQ ID NO: 2298958 - DNA, 12 bp, Homo sapiens
ctcactctgttg

SEQ ID NO: 2298959 - DNA, 15 bp, Homo sapiens
ctcactgcagcctcg

SEQ ID NO: 2298960 - DNA, 23 bp, Homo sapiens
ctcactgcatctttctcttccca

SEQ ID NO: 2298961 - DNA, 21 bp, Homo sapiens
ctcactgcctgcagctgagat

SEQ ID NO: 2298962 - DNA, 22 bp, Homo sapiens
ctcactgcctgcagctgagatt

SEQ ID NO: 2298963 - DNA, 22 bp, Homo sapiens
ctcactgtgttgcccaggctgg

SEQ ID NO: 2298964 - DNA, 22 bp, Homo sapiens
ctcacttaattctcattatgaa

SEQ ID NO: 2298965 - DNA, 14 bp, Homo sapiens
ctcacttttttata

SEQ ID NO: 2298966 - DNA, 17 bp, Homo sapiens
ctcagaaggctctatct

SEQ ID NO: 2298967 - DNA, 20 bp, Homo sapiens
ctcagaaggctctatctgct

SEQ ID NO: 2298968 - DNA, 23 bp, Homo sapiens
ctcagacacgcaggacccaggta

SEQ ID NO: 2298969 - DNA, 15 bp, Homo sapiens
ctcagatccctcggt

SEQ ID NO: 2298970 - DNA, 16 bp, Homo sapiens
ctcagcaaattcttga

SEQ ID NO: 2298971 - DNA, 13 bp, Homo sapiens
ctcagcacagcct

SEQ ID NO: 2298972 - DNA, 16 bp, Homo sapiens
ctcagcaccactcaag

SEQ ID NO: 2298973 - DNA, 17 bp, Homo sapiens
ctcagcaccactcaaga

SEQ ID NO: 2298974 - DNA, 16 bp, Homo sapiens
ctcagcctagcacagg

SEQ ID NO: 2298975 - DNA, 13 bp, Homo sapiens
ctcaggaggcagt

SEQ ID NO: 2298976 - DNA, 21 bp, Homo sapiens
ctcaggaggcagtggcttgga

SEQ ID NO: 2298977 - DNA, 16 bp, Homo sapiens
ctcaggctccccaaga

SEQ ID NO: 2298978 - DNA, 13 bp, Homo sapiens
ctcaggctttcta

SEQ ID NO: 2298979 - DNA, 14 bp, Homo sapiens
ctcaggctttctat

SEQ ID NO: 2298980 - DNA, 20 bp, Homo sapiens
ctcaggtacttctctctcct

SEQ ID NO: 2298981 - DNA, 17 bp, Homo sapiens
ctcagtattgacgacct

SEQ ID NO: 2298982 - DNA, 18 bp, Homo sapiens
ctcagtcccacagcccct

SEQ ID NO: 2298983 - DNA, 19 bp, Homo sapiens
ctcagtgtcctcatctata

SEQ ID NO: 2298984 - DNA, 16 bp, Homo sapiens
ctcagttcttggcctg

SEQ ID NO: 2298985 - DNA, 18 bp, Homo sapiens
ctcagttcttggcctgct

SEQ ID NO: 2298986 - DNA, 21 bp, Homo sapiens
ctcatccttctaaagtgctgg

SEQ ID NO: 2298987 - DNA, 14 bp, Homo sapiens
ctcatctccatgct

SEQ ID NO: 2298988 - DNA, 14 bp, Homo sapiens
ctcatcttgtaaat

SEQ ID NO: 2298989 - DNA, 19 bp, Homo sapiens
ctcatgccgctgtgtctat

SEQ ID NO: 2298990 - DNA, 22 bp, Homo sapiens
ctcattacagctcattcgctcc

SEQ ID NO: 2298991 - DNA, 14 bp, Homo sapiens
ctcattatgaagat

SEQ ID NO: 2298992 - DNA, 12 bp, Homo sapiens
ctcattcctctg

SEQ ID NO: 2298993 - DNA, 20 bp, Homo sapiens
ctcatttagcattgaaataa

SEQ ID NO: 2298994 - DNA, 15 bp, Homo sapiens
ctccaaaaagaaata

SEQ ID NO: 2298995 - DNA, 13 bp, Homo sapiens
ctccaacctggag

SEQ ID NO: 2298996 - DNA, 18 bp, Homo sapiens
ctccaactccaacatcca

SEQ ID NO: 2298997 - DNA, 20 bp, Homo sapiens
ctccaagtcatgggagaaga

SEQ ID NO: 2298998 - DNA, 19 bp, Homo sapiens
ctccacacccgcgccccgc

SEQ ID NO: 2298999 - DNA, 21 bp, Homo sapiens
ctccacattcatgtacaatga

SEQ ID NO: 2299000 - DNA, 20 bp, Homo sapiens
ctccacgggggcctagtggc

SEQ ID NO: 2299001 - DNA, 21 bp, Homo sapiens
ctccagactcgagagggctga

SEQ ID NO: 2299002 - DNA, 23 bp, Homo sapiens
ctccagatcctctttccccactg

SEQ ID NO: 2299003 - DNA, 19 bp, Homo sapiens
ctccagattattttctata

SEQ ID NO: 2299004 - DNA, 22 bp, Homo sapiens
ctccagattattttctatattt

SEQ ID NO: 2299005 - DNA, 14 bp, Homo sapiens
ctccaggcaccgcc

SEQ ID NO: 2299006 - DNA, 15 bp, Homo sapiens
ctccaggcaccgcct

SEQ ID NO: 2299007 - DNA, 20 bp, Homo sapiens
ctccaggcaccgcctgcccc

SEQ ID NO: 2299008 - DNA, 21 bp, Homo sapiens
ctccaggcaccgcctgccccc

SEQ ID NO: 2299009 - DNA, 23 bp, Homo sapiens
ctccaggcaccgcctgcccccag

SEQ ID NO: 2299010 - DNA, 19 bp, Homo sapiens
ctccaggccgacaggaggc

SEQ ID NO: 2299011 - DNA, 17 bp, Homo sapiens
ctccatccttaactgtc

SEQ ID NO: 2299012 - DNA, 18 bp, Homo sapiens
ctccatgattccaagggc

SEQ ID NO: 2299013 - DNA, 21 bp, Homo sapiens
ctccatgctctttcaccctgc

SEQ ID NO: 2299014 - DNA, 15 bp, Homo sapiens
ctccatgtaccttgt

SEQ ID NO: 2299015 - DNA, 18 bp, Homo sapiens
ctccattgcattcatgta

SEQ ID NO: 2299016 - DNA, 18 bp, Homo sapiens
ctccatttctgctcagat

SEQ ID NO: 2299017 - DNA, 21 bp, Homo sapiens
ctcccaacaagtgctctttcc

SEQ ID NO: 2299018 - DNA, 19 bp, Homo sapiens
ctcccaggacgcagggaga

SEQ ID NO: 2299019 - DNA, 13 bp, Homo sapiens
ctcccagggcccg

SEQ ID NO: 2299020 - DNA, 17 bp, Homo sapiens
ctcccagtaatttttct

SEQ ID NO: 2299021 - DNA, 20 bp, Homo sapiens
ctccccacaccctggagtgg

SEQ ID NO: 2299022 - DNA, 21 bp, Homo sapiens
ctcccccacggccgtccctga

SEQ ID NO: 2299023 - DNA, 17 bp, Homo sapiens
ctcccccaggctgcgcc

SEQ ID NO: 2299024 - DNA, 15 bp, Homo sapiens
ctccccgcctcctcc

SEQ ID NO: 2299025 - DNA, 22 bp, Homo sapiens
ctccccgcctcctccctgcctg

SEQ ID NO: 2299026 - DNA, 23 bp, Homo sapiens
ctccccgcctcctccctgcctgg

SEQ ID NO: 2299027 - DNA, 16 bp, Homo sapiens
ctcccgccgcctcggg

SEQ ID NO: 2299028 - DNA, 20 bp, Homo sapiens
ctcccgccgcctcgggccgc

SEQ ID NO: 2299029 - DNA, 12 bp, Homo sapiens
ctcccgcttcct

SEQ ID NO: 2299030 - DNA, 16 bp, Homo sapiens
ctccctactttcttag

SEQ ID NO: 2299031 - DNA, 12 bp, Homo sapiens
ctccctgcctgg

SEQ ID NO: 2299032 - DNA, 19 bp, Homo sapiens
ctccctgcctggcggcagg

SEQ ID NO: 2299033 - DNA, 21 bp, Homo sapiens
ctccctgcctggcggcagggg

SEQ ID NO: 2299034 - DNA, 22 bp, Homo sapiens
ctccctgcttggcttatgaaaa

SEQ ID NO: 2299035 - DNA, 18 bp, Homo sapiens
ctccctggactctgtggg

SEQ ID NO: 2299036 - DNA, 20 bp, Homo sapiens
ctccctgtaatgcactcctg

SEQ ID NO: 2299037 - DNA, 17 bp, Homo sapiens
ctcccttctcctgacct

SEQ ID NO: 2299038 - DNA, 12 bp, Homo sapiens
ctcccttctgat

SEQ ID NO: 2299039 - DNA, 20 bp, Homo sapiens
ctcccttcttctgagtgaat

SEQ ID NO: 2299040 - DNA, 15 bp, Homo sapiens
ctccgactccccctc

SEQ ID NO: 2299041 - DNA, 19 bp, Homo sapiens
ctccgactccccctccccg

SEQ ID NO: 2299042 - DNA, 21 bp, Homo sapiens
ctccgaggttttgaggcggga

SEQ ID NO: 2299043 - DNA, 13 bp, Homo sapiens
ctccgcgggggac

SEQ ID NO: 2299044 - DNA, 17 bp, Homo sapiens
ctccgcgggggacagga

SEQ ID NO: 2299045 - DNA, 20 bp, Homo sapiens
ctccgcgggggacaggaaca

SEQ ID NO: 2299046 - DNA, 14 bp, Homo sapiens
ctccggctggacct

SEQ ID NO: 2299047 - DNA, 17 bp, Homo sapiens
ctccggctggacctggg

SEQ ID NO: 2299048 - DNA, 20 bp, Homo sapiens
ctccgtccccagggtgcagg

SEQ ID NO: 2299049 - DNA, 22 bp, Homo sapiens
ctcctagcaaccaactttacct

SEQ ID NO: 2299050 - DNA, 13 bp, Homo sapiens
ctcctccagactc

SEQ ID NO: 2299051 - DNA, 14 bp, Homo sapiens
ctcctccagactcg

SEQ ID NO: 2299052 - DNA, 22 bp, Homo sapiens
ctcctccagactcgagagggct

SEQ ID NO: 2299053 - DNA, 21 bp, Homo sapiens
ctcctccaggaggactgttct

SEQ ID NO: 2299054 - DNA, 13 bp, Homo sapiens
ctcctcccccacg

SEQ ID NO: 2299055 - DNA, 13 bp, Homo sapiens
ctcctccctgcct

SEQ ID NO: 2299056 - DNA, 14 bp, Homo sapiens
ctcctccctgcctg

SEQ ID NO: 2299057 - DNA, 15 bp, Homo sapiens
ctcctccctgcctgg

SEQ ID NO: 2299058 - DNA, 16 bp, Homo sapiens
ctcctcggccagagct

SEQ ID NO: 2299059 - DNA, 20 bp, Homo sapiens
ctcctcggccagagctccca

SEQ ID NO: 2299060 - DNA, 21 bp, Homo sapiens
ctcctcggccagagctcccag

SEQ ID NO: 2299061 - DNA, 15 bp, Homo sapiens
ctcctcggctggctg

SEQ ID NO: 2299062 - DNA, 22 bp, Homo sapiens
ctcctcgtccggcctgcagccc

SEQ ID NO: 2299063 - DNA, 23 bp, Homo sapiens
ctcctcgtccggcctgcagccca

SEQ ID NO: 2299064 - DNA, 14 bp, Homo sapiens
ctcctctgcagcct

SEQ ID NO: 2299065 - DNA, 15 bp, Homo sapiens
ctcctctgcagcctg

SEQ ID NO: 2299066 - DNA, 16 bp, Homo sapiens
ctcctctgcagcctga

SEQ ID NO: 2299067 - DNA, 13 bp, Homo sapiens
ctcctctgccccc

SEQ ID NO: 2299068 - DNA, 15 bp, Homo sapiens
ctcctctgccccctc

SEQ ID NO: 2299069 - DNA, 18 bp, Homo sapiens
ctcctctgccccctcccc

SEQ ID NO: 2299070 - DNA, 20 bp, Homo sapiens
ctcctgacaccccacttagc

SEQ ID NO: 2299071 - DNA, 14 bp, Homo sapiens
ctcctgagtagctg

SEQ ID NO: 2299072 - DNA, 20 bp, Homo sapiens
ctcctgccactcctcaactg

SEQ ID NO: 2299073 - DNA, 14 bp, Homo sapiens
ctcctgccccgccg

SEQ ID NO: 2299074 - DNA, 13 bp, Homo sapiens
ctcctgctgagtg

SEQ ID NO: 2299075 - DNA, 20 bp, Homo sapiens
ctcctgctgagtggtccaca

SEQ ID NO: 2299076 - DNA, 13 bp, Homo sapiens
ctccttgaataag

SEQ ID NO: 2299077 - DNA, 23 bp, Homo sapiens
ctccttgtcacagaatctccatt

SEQ ID NO: 2299078 - DNA, 23 bp, Homo sapiens
ctcctttctaaggagcactagaa

SEQ ID NO: 2299079 - DNA, 14 bp, Homo sapiens
ctccttttcccact

SEQ ID NO: 2299080 - DNA, 15 bp, Homo sapiens
ctccttttctccact

SEQ ID NO: 2299081 - DNA, 15 bp, Homo sapiens
ctcgacctccctggc

SEQ ID NO: 2299082 - DNA, 18 bp, Homo sapiens
ctcgacctccctggcttg

SEQ ID NO: 2299083 - DNA, 19 bp, Homo sapiens
ctcgacctccctggcttga

SEQ ID NO: 2299084 - DNA, 17 bp, Homo sapiens
ctcgagagggctgagcc

SEQ ID NO: 2299085 - DNA, 20 bp, Homo sapiens
ctcgagttacagacaaagcg

SEQ ID NO: 2299086 - DNA, 15 bp, Homo sapiens
ctcgcgacaatgcaa

SEQ ID NO: 2299087 - DNA, 14 bp, Homo sapiens
ctgagctctgacct

SEQ ID NO: 2299088 - DNA, 23 bp, Homo sapiens
ctgagcttttaccactagactca

SEQ ID NO: 2299089 - DNA, 17 bp, Homo sapiens
ctgaggacggggcagag

SEQ ID NO: 2299090 - DNA, 18 bp, Homo sapiens
ctgaggacggggcagagc

SEQ ID NO: 2299091 - DNA, 20 bp, Homo sapiens
ctgaggacggggcagagctg

SEQ ID NO: 2299092 - DNA, 16 bp, Homo sapiens
ctgaggagtgatgggc

SEQ ID NO: 2299093 - DNA, 19 bp, Homo sapiens
ctgaggagtgatgggcaag

SEQ ID NO: 2299094 - DNA, 23 bp, Homo sapiens
ctgagggaagcccacccgcccca

SEQ ID NO: 2299095 - DNA, 14 bp, Homo sapiens
ctgaggttgggagt

SEQ ID NO: 2299096 - DNA, 14 bp, Homo sapiens
ctgagtcatgtctt

SEQ ID NO: 2299097 - DNA, 15 bp, Homo sapiens
ctgagtcggctgggc

SEQ ID NO: 2299098 - DNA, 17 bp, Homo sapiens
ctgagtcggctgggcag

SEQ ID NO: 2299099 - DNA, 18 bp, Homo sapiens
ctgagtcggctgggcagg

SEQ ID NO: 2299100 - DNA, 21 bp, Homo sapiens
ctgagtcggctgggcagggcc

SEQ ID NO: 2299101 - DNA, 13 bp, Homo sapiens
ctgagtgaatgtt

SEQ ID NO: 2299102 - DNA, 14 bp, Homo sapiens
ctgagtgaatgtta

SEQ ID NO: 2299103 - DNA, 17 bp, Homo sapiens
ctgagtgcaagttcatg

SEQ ID NO: 2299104 - DNA, 23 bp, Homo sapiens
ctgatagagtttaacagatattt

SEQ ID NO: 2299105 - DNA, 19 bp, Homo sapiens
ctgatatacaattagagat

SEQ ID NO: 2299106 - DNA, 15 bp, Homo sapiens
ctgatatcacgggcc

SEQ ID NO: 2299107 - DNA, 15 bp, Homo sapiens
ctgatcacaactttt

SEQ ID NO: 2299108 - DNA, 17 bp, Homo sapiens
ctgatcacaacttttct

SEQ ID NO: 2299109 - DNA, 18 bp, Homo sapiens
ctgatcacaacttttctg

SEQ ID NO: 2299110 - DNA, 12 bp, Homo sapiens
ctgatcattgca

SEQ ID NO: 2299111 - DNA, 23 bp, Homo sapiens
ctgatcattgcagtatcagaggg

SEQ ID NO: 2299112 - DNA, 13 bp, Homo sapiens
ctgatgatataaa

SEQ ID NO: 2299113 - DNA, 17 bp, Homo sapiens
ctgatgggtcctgctgc

SEQ ID NO: 2299114 - DNA, 15 bp, Homo sapiens
ctgatggtgcaatga

SEQ ID NO: 2299115 - DNA, 20 bp, Homo sapiens
ctgattctatgcctgtattt

SEQ ID NO: 2299116 - DNA, 23 bp, Homo sapiens
ctgattctatgcctgtatttcca

SEQ ID NO: 2299117 - DNA, 17 bp, Homo sapiens
ctgatttcaaatgcagt

SEQ ID NO: 2299118 - DNA, 15 bp, Homo sapiens
ctgatttgggtctct

SEQ ID NO: 2299119 - DNA, 18 bp, Homo sapiens
ctgatttttttttccttc

SEQ ID NO: 2299120 - DNA, 19 bp, Homo sapiens
ctgatttttttttccttca

SEQ ID NO: 2299121 - DNA, 20 bp, Homo sapiens
ctgatttttttttccttcag

SEQ ID NO: 2299122 - DNA, 22 bp, Homo sapiens
ctgatttttttttccttcagtg

SEQ ID NO: 2299123 - DNA, 23 bp, Homo sapiens
ctgatttttttttccttcagtgc

SEQ ID NO: 2299124 - DNA, 15 bp, Homo sapiens
ctgcaaacaaacacc

SEQ ID NO: 2299125 - DNA, 20 bp, Homo sapiens
ctgcaaatagtttcaaatga

SEQ ID NO: 2299126 - DNA, 15 bp, Homo sapiens
ctgcaataacagttt

SEQ ID NO: 2299127 - DNA, 17 bp, Homo sapiens
ctgcaataacagtttta

SEQ ID NO: 2299128 - DNA, 21 bp, Homo sapiens
ctgcaatttctccaaagcttg

SEQ ID NO: 2299129 - DNA, 13 bp, Homo sapiens
ctgcacagggtcc

SEQ ID NO: 2299130 - DNA, 12 bp, Homo sapiens
ctgcacattgtt

SEQ ID NO: 2299131 - DNA, 19 bp, Homo sapiens
ctgcacctctcttctgcac

SEQ ID NO: 2299132 - DNA, 23 bp, Homo sapiens
ctgcaccttcactctccagggta

SEQ ID NO: 2299133 - DNA, 15 bp, Homo sapiens
ctgcaccttgggcac

SEQ ID NO: 2299134 - DNA, 23 bp, Homo sapiens
ctgcaccttgggcacgggagagc

SEQ ID NO: 2299135 - DNA, 21 bp, Homo sapiens
ctgcagcctcgacctccctgg

SEQ ID NO: 2299136 - DNA, 13 bp, Homo sapiens
ctgcagcctgagc

SEQ ID NO: 2299137 - DNA, 16 bp, Homo sapiens
ctgcagcctgagctcc

SEQ ID NO: 2299138 - DNA, 23 bp, Homo sapiens
ctgcagcctgagctccaccctcc

SEQ ID NO: 2299139 - DNA, 16 bp, Homo sapiens
ctgcagctcctctgcc

SEQ ID NO: 2299140 - DNA, 14 bp, Homo sapiens
ctgcagtattctgt

SEQ ID NO: 2299141 - DNA, 15 bp, Homo sapiens
ctgcagtattctgta

SEQ ID NO: 2299142 - DNA, 15 bp, Homo sapiens
ctgcataagattata

SEQ ID NO: 2299143 - DNA, 21 bp, Homo sapiens
ctgcatatagataattatcca

SEQ ID NO: 2299144 - DNA, 21 bp, Homo sapiens
ctgcatatcctggtgtctagt

SEQ ID NO: 2299145 - DNA, 20 bp, Homo sapiens
ctgcatcaagatgtgacatg

SEQ ID NO: 2299146 - DNA, 18 bp, Homo sapiens
ctgcatctttctcttccc

SEQ ID NO: 2299147 - DNA, 19 bp, Homo sapiens
ctgcatctttctcttccca

SEQ ID NO: 2299148 - DNA, 16 bp, Homo sapiens
ctgcattcacagctac

SEQ ID NO: 2299149 - DNA, 12 bp, Homo sapiens
ctgccaaataaa

SEQ ID NO: 2299150 - DNA, 16 bp, Homo sapiens
ctgccaaataaaatgt

SEQ ID NO: 2299151 - DNA, 14 bp, Homo sapiens
ctgccaacctcgct

SEQ ID NO: 2299152 - DNA, 17 bp, Homo sapiens
ctgccaacctcgctcca

SEQ ID NO: 2299153 - DNA, 23 bp, Homo sapiens
ctgccaacctcgctccaactcca

SEQ ID NO: 2299154 - DNA, 21 bp, Homo sapiens
ctgccaagagtcaacaggtca

SEQ ID NO: 2299155 - DNA, 13 bp, Homo sapiens
ctgccaccctctg

SEQ ID NO: 2299156 - DNA, 15 bp, Homo sapiens
ctgccatcagaaatt

SEQ ID NO: 2299157 - DNA, 24 bp, Homo sapiens
ctgccatcagcccctgctgctcct

SEQ ID NO: 2299158 - DNA, 17 bp, Homo sapiens
ctgcccaccctgggcct

SEQ ID NO: 2299159 - DNA, 20 bp, Homo sapiens
ctgcccaccctgggcctccc

SEQ ID NO: 2299160 - DNA, 14 bp, Homo sapiens
ctgcccagatgttt

SEQ ID NO: 2299161 - DNA, 13 bp, Homo sapiens
ctgcccccacaga

SEQ ID NO: 2299162 - DNA, 16 bp, Homo sapiens
ctgcccccacagatcc

SEQ ID NO: 2299163 - DNA, 20 bp, Homo sapiens
ctgcccccagcgtgggggtg

SEQ ID NO: 2299164 - DNA, 17 bp, Homo sapiens
ctgcccccgctctgcca

SEQ ID NO: 2299165 - DNA, 14 bp, Homo sapiens
ctgccccctccccc

SEQ ID NO: 2299166 - DNA, 18 bp, Homo sapiens
ctgccccctcccccgcag

SEQ ID NO: 2299167 - DNA, 19 bp, Homo sapiens
ctgccccctcccccgcaga

SEQ ID NO: 2299168 - DNA, 22 bp, Homo sapiens
ctgccccctcccccgcagacag

SEQ ID NO: 2299169 - DNA, 15 bp, Homo sapiens
ctgccccgccggccg

SEQ ID NO: 2299170 - DNA, 16 bp, Homo sapiens
ctgccccggcccaacc

SEQ ID NO: 2299171 - DNA, 22 bp, Homo sapiens
ctgccccggcccaacctcgccc

SEQ ID NO: 2299172 - DNA, 20 bp, Homo sapiens
ctgcccctccgtccccaggg

SEQ ID NO: 2299173 - DNA, 21 bp, Homo sapiens
ctgcccctccgtccccagggt

SEQ ID NO: 2299174 - DNA, 23 bp, Homo sapiens
ctgcccctgctactgccaacctc

SEQ ID NO: 2299175 - DNA, 20 bp, Homo sapiens
ctgccccttgaccccacacg

SEQ ID NO: 2299176 - DNA, 22 bp, Homo sapiens
ctgccctcccccacggccgtcc

SEQ ID NO: 2299177 - DNA, 22 bp, Homo sapiens
ctgccctctgtttcccctcaga

SEQ ID NO: 2299178 - DNA, 15 bp, Homo sapiens
ctgccctgcaccttg

SEQ ID NO: 2299179 - DNA, 19 bp, Homo sapiens
ctgccctgcaccttgggca

SEQ ID NO: 2299180 - DNA, 15 bp, Homo sapiens
ctgccctgccctggc

SEQ ID NO: 2299181 - DNA, 16 bp, Homo sapiens
ctgccctggccactgg

SEQ ID NO: 2299182 - DNA, 17 bp, Homo sapiens
ctgccctggccactggc

SEQ ID NO: 2299183 - DNA, 19 bp, Homo sapiens
ctgccctggccactggccc

SEQ ID NO: 2299184 - DNA, 17 bp, Homo sapiens
ctgccctgtccactctg

SEQ ID NO: 2299185 - DNA, 23 bp, Homo sapiens
ctgccctgtccactctgctcagg

SEQ ID NO: 2299186 - DNA, 18 bp, Homo sapiens
ctgccgacggagccactg

SEQ ID NO: 2299187 - DNA, 22 bp, Homo sapiens
ctgccgacggagccactggggt

SEQ ID NO: 2299188 - DNA, 21 bp, Homo sapiens
ctgccgctgcccccaccctgc

SEQ ID NO: 2299189 - DNA, 13 bp, Homo sapiens
ctgccgctgcttg

SEQ ID NO: 2299190 - DNA, 14 bp, Homo sapiens
ctgccgctgcttga

SEQ ID NO: 2299191 - DNA, 13 bp, Homo sapiens
ctgcctaaatttc

SEQ ID NO: 2299192 - DNA, 16 bp, Homo sapiens
ctgcctccaagtcatg

SEQ ID NO: 2299193 - DNA, 20 bp, Homo sapiens
ctgcctccaagtcatgggag

SEQ ID NO: 2299194 - DNA, 21 bp, Homo sapiens
ctgcctccaagtcatgggaga

SEQ ID NO: 2299195 - DNA, 17 bp, Homo sapiens
ctgcctcctcagcagcc

SEQ ID NO: 2299196 - DNA, 19 bp, Homo sapiens
ctgcctctgaaaatatttt

SEQ ID NO: 2299197 - DNA, 15 bp, Homo sapiens
ctgcctctgaactgc

SEQ ID NO: 2299198 - DNA, 14 bp, Homo sapiens
ctgcctgcagctga

SEQ ID NO: 2299199 - DNA, 16 bp, Homo sapiens
ctgcctgtttggggag

SEQ ID NO: 2299200 - DNA, 17 bp, Homo sapiens
ctgcctgtttggggagg

SEQ ID NO: 2299201 - DNA, 12 bp, Homo sapiens
ctgccttccagg

SEQ ID NO: 2299202 - DNA, 23 bp, Homo sapiens
ctgccttccaggcgtagggccag

SEQ ID NO: 2299203 - DNA, 17 bp, Homo sapiens
ctgcgcaaagggcgggc

SEQ ID NO: 2299204 - DNA, 14 bp, Homo sapiens
ctgcgcaggccctc

SEQ ID NO: 2299205 - DNA, 18 bp, Homo sapiens
ctgcgccccccagtggac

SEQ ID NO: 2299206 - DNA, 12 bp, Homo sapiens
ctgcgcctgccc

SEQ ID NO: 2299207 - DNA, 14 bp, Homo sapiens
ctgcgcctgcccgc

SEQ ID NO: 2299208 - DNA, 15 bp, Homo sapiens
ctgcgcctgcccgcc

SEQ ID NO: 2299209 - DNA, 13 bp, Homo sapiens
ctgcgctcctctg

SEQ ID NO: 2299210 - DNA, 16 bp, Homo sapiens
ctgcgctcctctgcag

SEQ ID NO: 2299211 - DNA, 18 bp, Homo sapiens
ctgcgctcctctgcagcc

SEQ ID NO: 2299212 - DNA, 19 bp, Homo sapiens
ctgcgctcctctgcagcct

SEQ ID NO: 2299213 - DNA, 23 bp, Homo sapiens
ctgcgctcctctgcagcctgagc

SEQ ID NO: 2299214 - DNA, 13 bp, Homo sapiens
ctgcgtcccactg

SEQ ID NO: 2299215 - DNA, 18 bp, Homo sapiens
ctgcgtcccactgagtct

SEQ ID NO: 2299216 - DNA, 19 bp, Homo sapiens
ctgcgtcccactgagtctc

SEQ ID NO: 2299217 - DNA, 16 bp, Homo sapiens
ctgcgtgttctcagag

SEQ ID NO: 2299218 - DNA, 22 bp, Homo sapiens
ctgctaatttatgaagatagtt

SEQ ID NO: 2299219 - DNA, 19 bp, Homo sapiens
ctgggtgggccccacagtg

SEQ ID NO: 2299220 - DNA, 19 bp, Homo sapiens
ctgggtgtgacctgacacc

SEQ ID NO: 2299221 - DNA, 22 bp, Homo sapiens
ctgggtgtgacctgacacctgc

SEQ ID NO: 2299222 - DNA, 22 bp, Homo sapiens
ctgggttgttgcagagtaaatc

SEQ ID NO: 2299223 - DNA, 23 bp, Homo sapiens
ctgggttgttgcagagtaaatcc

SEQ ID NO: 2299224 - DNA, 21 bp, Homo sapiens
ctggtactattgtgaccacag

SEQ ID NO: 2299225 - DNA, 16 bp, Homo sapiens
ctggtcagttttcaca

SEQ ID NO: 2299226 - DNA, 17 bp, Homo sapiens
ctggtcagttttcacag

SEQ ID NO: 2299227 - DNA, 20 bp, Homo sapiens
ctggtcagttttcacagagg

SEQ ID NO: 2299228 - DNA, 20 bp, Homo sapiens
ctggtcgtaaacatctcaga

SEQ ID NO: 2299229 - DNA, 15 bp, Homo sapiens
ctggtgcgttcctaa

SEQ ID NO: 2299230 - DNA, 22 bp, Homo sapiens
ctggtgttctcaatgcttttct

SEQ ID NO: 2299231 - DNA, 23 bp, Homo sapiens
ctggttatagttgatatgtaaca

SEQ ID NO: 2299232 - DNA, 22 bp, Homo sapiens
ctggttcccccaggaccctgag

SEQ ID NO: 2299233 - DNA, 17 bp, Homo sapiens
ctggttgagaaacattg

SEQ ID NO: 2299234 - DNA, 19 bp, Homo sapiens
ctggttgagaaacattgct

SEQ ID NO: 2299235 - DNA, 20 bp, Homo sapiens
ctggttttcattattttccc

SEQ ID NO: 2299236 - DNA, 17 bp, Homo sapiens
ctgtaatgcactcctgc

SEQ ID NO: 2299237 - DNA, 14 bp, Homo sapiens
ctgtaattttgtag

SEQ ID NO: 2299238 - DNA, 19 bp, Homo sapiens
ctgtaattttgtagtagtt

SEQ ID NO: 2299239 - DNA, 18 bp, Homo sapiens
ctgtacgtctggtgttct

SEQ ID NO: 2299240 - DNA, 18 bp, Homo sapiens
ctgtacttcagttctcat

SEQ ID NO: 2299241 - DNA, 20 bp, Homo sapiens
ctgtagcaatatatttgtag

SEQ ID NO: 2299242 - DNA, 17 bp, Homo sapiens
ctgtatctaaaaaataa

SEQ ID NO: 2299243 - DNA, 20 bp, Homo sapiens
ctgtatctaaaaaataactg

SEQ ID NO: 2299244 - DNA, 11 bp, Homo sapiens
ctgtattttct

SEQ ID NO: 2299245 - DNA, 15 bp, Homo sapiens
ctgtattttctttta

SEQ ID NO: 2299246 - DNA, 19 bp, Homo sapiens
ctgtcaattacaggaagta

SEQ ID NO: 2299247 - DNA, 20 bp, Homo sapiens
ctgtcagagaatatgaccta

SEQ ID NO: 2299248 - DNA, 19 bp, Homo sapiens
ctgtcaggcagtagcagct

SEQ ID NO: 2299249 - DNA, 20 bp, Homo sapiens
ctgtcaggcagtagcagctg

SEQ ID NO: 2299250 - DNA, 21 bp, Homo sapiens
ctgtcaggcagtagcagctgt

SEQ ID NO: 2299251 - DNA, 22 bp, Homo sapiens
ctgtcaggcagtagcagctgtg

SEQ ID NO: 2299252 - DNA, 22 bp, Homo sapiens
ctgtcattggttacaaattttt

SEQ ID NO: 2299253 - DNA, 22 bp, Homo sapiens
ctgtccacccgcccctgcccct

SEQ ID NO: 2299254 - DNA, 15 bp, Homo sapiens
ctgtccagtccagtg

SEQ ID NO: 2299255 - DNA, 19 bp, Homo sapiens
ctgtcccatgggctctggc

SEQ ID NO: 2299256 - DNA, 20 bp, Homo sapiens
ctgtcccatgggctctggcc

SEQ ID NO: 2299257 - DNA, 18 bp, Homo sapiens
ctgtccccgagccgagct

SEQ ID NO: 2299258 - DNA, 11 bp, Homo sapiens
ctgtctgattc

SEQ ID NO: 2299259 - DNA, 16 bp, Homo sapiens
ctgtctgattctatgc

SEQ ID NO: 2299260 - DNA, 17 bp, Homo sapiens
ctgtctgattctatgcc

SEQ ID NO: 2299261 - DNA, 18 bp, Homo sapiens
ctgtctgtaagagaattc

SEQ ID NO: 2299262 - DNA, 23 bp, Homo sapiens
ctgtcttcaaccctgccctgcac

SEQ ID NO: 2299263 - DNA, 20 bp, Homo sapiens
ctgtcttgtaatattttgta

SEQ ID NO: 2299264 - DNA, 22 bp, Homo sapiens
ctgtgacaagccaatgtgaatt

SEQ ID NO: 2299265 - DNA, 22 bp, Homo sapiens
ctgtgaccggggtcctgaggct

SEQ ID NO: 2299266 - DNA, 17 bp, Homo sapiens
ctgtgactcgcttagct

SEQ ID NO: 2299267 - DNA, 13 bp, Homo sapiens
ctgtgagcaaagt

SEQ ID NO: 2299268 - DNA, 19 bp, Homo sapiens
ctgtgatgtcatgaaagca

SEQ ID NO: 2299269 - DNA, 17 bp, Homo sapiens
ctgtgccccgaccccac

SEQ ID NO: 2299270 - DNA, 15 bp, Homo sapiens
ctgtggaacactaaa

SEQ ID NO: 2299271 - DNA, 16 bp, Homo sapiens
ctgtggattctatatt

SEQ ID NO: 2299272 - DNA, 17 bp, Homo sapiens
ctgtggattctatattt

SEQ ID NO: 2299273 - DNA, 14 bp, Homo sapiens
ctgtggccacctag

SEQ ID NO: 2299274 - DNA, 13 bp, Homo sapiens
ctgtggcctcagg

SEQ ID NO: 2299275 - DNA, 21 bp, Homo sapiens
ctgtggctgccatcagaaatt

SEQ ID NO: 2299276 - DNA, 22 bp, Homo sapiens
ctgtggggagctggtgggggca

SEQ ID NO: 2299277 - DNA, 18 bp, Homo sapiens
ctgtgttgcccaggctgg

SEQ ID NO: 2299278 - DNA, 21 bp, Homo sapiens
ctgtgttgcccaggctggtct

SEQ ID NO: 2299279 - DNA, 23 bp, Homo sapiens
ctgtgttgcccaggctggtcttg

SEQ ID NO: 2299280 - DNA, 21 bp, Homo sapiens
ctgttacccgcagatcctgtc

SEQ ID NO: 2299281 - DNA, 22 bp, Homo sapiens
ctgttacccgcagatcctgtcc

SEQ ID NO: 2299282 - DNA, 19 bp, Homo sapiens
ctgttagcattattgccaa

SEQ ID NO: 2299283 - DNA, 14 bp, Homo sapiens
ctgttcatttccac

SEQ ID NO: 2299284 - DNA, 13 bp, Homo sapiens
ctgttccctgagg

SEQ ID NO: 2299285 - DNA, 14 bp, Homo sapiens
ctgttccctgagga

SEQ ID NO: 2299286 - DNA, 15 bp, Homo sapiens
ctgttccctgaggac

SEQ ID NO: 2299287 - DNA, 18 bp, Homo sapiens
ctgttccctgaggacctg

SEQ ID NO: 2299288 - DNA, 15 bp, Homo sapiens
ctgttctaactagta

SEQ ID NO: 2299289 - DNA, 15 bp, Homo sapiens
ctgttctttgcagtg

SEQ ID NO: 2299290 - DNA, 23 bp, Homo sapiens
ctgttgacaatttgccatagcag

SEQ ID NO: 2299291 - DNA, 20 bp, Homo sapiens
ctgttgaccaggctggagtg

SEQ ID NO: 2299292 - DNA, 21 bp, Homo sapiens
ctgttgaccaggctggagtga

SEQ ID NO: 2299293 - DNA, 11 bp, Homo sapiens
ctgttgcttga

SEQ ID NO: 2299294 - DNA, 12 bp, Homo sapiens
ctgttgttattc

SEQ ID NO: 2299295 - DNA, 21 bp, Homo sapiens
ctgtttaattcctggaaaact

SEQ ID NO: 2299296 - DNA, 16 bp, Homo sapiens
ctgtttatggtatttt

SEQ ID NO: 2299297 - DNA, 13 bp, Homo sapiens
ctgtttccagggt

SEQ ID NO: 2299298 - DNA, 13 bp, Homo sapiens
ctgtttccccaat

SEQ ID NO: 2299299 - DNA, 15 bp, Homo sapiens
ctgtttctatgtcca

SEQ ID NO: 2299300 - DNA, 13 bp, Homo sapiens
ctgtttcttgctt

SEQ ID NO: 2299301 - DNA, 15 bp, Homo sapiens
ctgtttggtgaggac

SEQ ID NO: 2299302 - DNA, 18 bp, Homo sapiens
ctgtttggtgaggacctg

SEQ ID NO: 2299303 - DNA, 19 bp, Homo sapiens
ctgttttatgtcatactct

SEQ ID NO: 2299304 - DNA, 21 bp, Homo sapiens
ctgttttatgtcatactctgt

SEQ ID NO: 2299305 - DNA, 17 bp, Homo sapiens
ctgttttgggtagctgc

SEQ ID NO: 2299306 - DNA, 16 bp, Homo sapiens
cttaaaataatgattt

SEQ ID NO: 2299307 - DNA, 13 bp, Homo sapiens
cttaaagaatttg

SEQ ID NO: 2299308 - DNA, 16 bp, Homo sapiens
cttaaagaatttgaaa

SEQ ID NO: 2299309 - DNA, 22 bp, Homo sapiens
cttaaatagcatctgctcttct

SEQ ID NO: 2299310 - DNA, 20 bp, Homo sapiens
cttaacataaacttgtactt

SEQ ID NO: 2299311 - DNA, 20 bp, Homo sapiens
cttaactgtccagtccagtg

SEQ ID NO: 2299312 - DNA, 19 bp, Homo sapiens
cttaagatgctaatagaaa

SEQ ID NO: 2299313 - DNA, 18 bp, Homo sapiens
cttaaggaaaagagaaac

SEQ ID NO: 2299314 - DNA, 14 bp, Homo sapiens
cttaatcatatcaa

SEQ ID NO: 2299315 - DNA, 14 bp, Homo sapiens
cttaatgtggccgg

SEQ ID NO: 2299316 - DNA, 20 bp, Homo sapiens
cttaattctcattatgaaga

SEQ ID NO: 2299317 - DNA, 13 bp, Homo sapiens
cttacacaatggt

SEQ ID NO: 2299318 - DNA, 16 bp, Homo sapiens
cttaccatgcatttct

SEQ ID NO: 2299319 - DNA, 16 bp, Homo sapiens
cttataaaaattctag

SEQ ID NO: 2299320 - DNA, 19 bp, Homo sapiens
cttatggaacactctgaga

SEQ ID NO: 2299321 - DNA, 15 bp, Homo sapiens
cttatgtagacaaaa

SEQ ID NO: 2299322 - DNA, 16 bp, Homo sapiens
cttatttctaactatt

SEQ ID NO: 2299323 - DNA, 14 bp, Homo sapiens
cttatttgaaagtg

SEQ ID NO: 2299324 - DNA, 15 bp, Homo sapiens
cttatttgaaagtgt

SEQ ID NO: 2299325 - DNA, 14 bp, Homo sapiens
cttattttagacaa

SEQ ID NO: 2299326 - DNA, 17 bp, Homo sapiens
cttattttcataattca

SEQ ID NO: 2299327 - DNA, 20 bp, Homo sapiens
cttattttcataattcattt

SEQ ID NO: 2299328 - DNA, 18 bp, Homo sapiens
cttattttccacttatct

SEQ ID NO: 2299329 - DNA, 22 bp, Homo sapiens
cttattttctgaattcataaaa

SEQ ID NO: 2299330 - DNA, 15 bp, Homo sapiens
cttcaaaaactgttt

SEQ ID NO: 2299331 - DNA, 14 bp, Homo sapiens
cttcaaccctgccc

SEQ ID NO: 2299332 - DNA, 17 bp, Homo sapiens
cttcaaccctgccctgc

SEQ ID NO: 2299333 - DNA, 10 bp, Homo sapiens
cttcaaggat

SEQ ID NO: 2299334 - DNA, 16 bp, Homo sapiens
cttcagaaaagacact

SEQ ID NO: 2299335 - DNA, 17 bp, Homo sapiens
cttcagaaaagacactt

SEQ ID NO: 2299336 - DNA, 20 bp, Homo sapiens
cttcagaaaagacacttcaa

SEQ ID NO: 2299337 - DNA, 21 bp, Homo sapiens
cttcagaatatggacaaagaa

SEQ ID NO: 2299338 - DNA, 22 bp, Homo sapiens
cttcagacacgcacttctgggg

SEQ ID NO: 2299339 - DNA, 12 bp, Homo sapiens
cttcagcccctg

SEQ ID NO: 2299340 - DNA, 13 bp, Homo sapiens
cttcagtgcctta

SEQ ID NO: 2299341 - DNA, 16 bp, Homo sapiens
cttcagttctcatctt

SEQ ID NO: 2299342 - DNA, 17 bp, Homo sapiens
cttcatctggagtccct

SEQ ID NO: 2299343 - DNA, 19 bp, Homo sapiens
cttcatctggagtccctcc

SEQ ID NO: 2299344 - DNA, 23 bp, Homo sapiens
cttccagatttgagctgcctgga

SEQ ID NO: 2299345 - DNA, 12 bp, Homo sapiens
cttccagcccag

SEQ ID NO: 2299346 - DNA, 17 bp, Homo sapiens
cttccagctcagtccca

SEQ ID NO: 2299347 - DNA, 22 bp, Homo sapiens
cttccagctcagtcccacagcc

SEQ ID NO: 2299348 - DNA, 17 bp, Homo sapiens
cttccagttggactgtg

SEQ ID NO: 2299349 - DNA, 15 bp, Homo sapiens
cttccatatgctctt

SEQ ID NO: 2299350 - DNA, 22 bp, Homo sapiens
cttcccagctggcagcgcctcc

SEQ ID NO: 2299351 - DNA, 19 bp, Homo sapiens
ctttttggtatggtaaaga

SEQ ID NO: 2299352 - DNA, 17 bp, Homo sapiens
cttttttattgaataac

SEQ ID NO: 2299353 - DNA, 15 bp, Homo sapiens
cttttttcaatgtac

SEQ ID NO: 2299354 - DNA, 14 bp, Homo sapiens
gaaaaaaatagttt

SEQ ID NO: 2299355 - DNA, 20 bp, Homo sapiens
gaaaaaaatagttttacatt

SEQ ID NO: 2299356 - DNA, 14 bp, Homo sapiens
gaaaaaattttaaa

SEQ ID NO: 2299357 - DNA, 18 bp, Homo sapiens
gaaaaagaatgaaaacaa

SEQ ID NO: 2299358 - DNA, 13 bp, Homo sapiens
gaaaacaatatgt

SEQ ID NO: 2299359 - DNA, 20 bp, Homo sapiens
gaaaacgtggctgcttcaag

SEQ ID NO: 2299360 - DNA, 16 bp, Homo sapiens
gaaaactgatttccca

SEQ ID NO: 2299361 - DNA, 14 bp, Homo sapiens
gaaaactgggtatg

SEQ ID NO: 2299362 - DNA, 21 bp, Homo sapiens
gaaaactgtttatggtatttt

SEQ ID NO: 2299363 - DNA, 20 bp, Homo sapiens
gaaaagaagaaagtctatgc

SEQ ID NO: 2299364 - DNA, 16 bp, Homo sapiens
gaaaataaaataaatt

SEQ ID NO: 2299365 - DNA, 22 bp, Homo sapiens
gaaaataaaataaattatggct

SEQ ID NO: 2299366 - DNA, 13 bp, Homo sapiens
gaaaatacattgt

SEQ ID NO: 2299367 - DNA, 19 bp, Homo sapiens
gaaaatagcttttattgag

SEQ ID NO: 2299368 - DNA, 19 bp, Homo sapiens
gaaaatatttttttctagc

SEQ ID NO: 2299369 - DNA, 15 bp, Homo sapiens
gaaaatgctttctca

SEQ ID NO: 2299370 - DNA, 23 bp, Homo sapiens
gaaaatggtgaagaatggactta

SEQ ID NO: 2299371 - DNA, 19 bp, Homo sapiens
gaaaatgtaagttatgtgt

SEQ ID NO: 2299372 - DNA, 15 bp, Homo sapiens
gaaacaaaaaatatt

SEQ ID NO: 2299373 - DNA, 13 bp, Homo sapiens
gaaacaactgcca

SEQ ID NO: 2299374 - DNA, 23 bp, Homo sapiens
gaaacactttcttgagcaccagg

SEQ ID NO: 2299375 - DNA, 22 bp, Homo sapiens
gaaacattgctttagacaaatt

SEQ ID NO: 2299376 - DNA, 18 bp, Homo sapiens
gaaaccaattaagcagct

SEQ ID NO: 2299377 - DNA, 12 bp, Homo sapiens
gaaacctctgtt

SEQ ID NO: 2299378 - DNA, 11 bp, Homo sapiens
gaaagaaaatg

SEQ ID NO: 2299379 - DNA, 19 bp, Homo sapiens
gaaagagaaaatgctttct

SEQ ID NO: 2299380 - DNA, 20 bp, Homo sapiens
gaaagatggtaatcttttct

SEQ ID NO: 2299381 - DNA, 20 bp, Homo sapiens
gaaagcagtcagcggagagg

SEQ ID NO: 2299382 - DNA, 21 bp, Homo sapiens
gaaagcagtcagcggagagga

SEQ ID NO: 2299383 - DNA, 13 bp, Homo sapiens
gaaagggagaggg

SEQ ID NO: 2299384 - DNA, 18 bp, Homo sapiens
gaaaggtcacctcactca

SEQ ID NO: 2299385 - DNA, 20 bp, Homo sapiens
gaaaggtcacctcactcagc

SEQ ID NO: 2299386 - DNA, 20 bp, Homo sapiens
gaaagtatctctactttcct

SEQ ID NO: 2299387 - DNA, 14 bp, Homo sapiens
gaaagtctatgctt

SEQ ID NO: 2299388 - DNA, 20 bp, Homo sapiens
gaaagttctattatctgggt

SEQ ID NO: 2299389 - DNA, 14 bp, Homo sapiens
gaaataaatctaaa

SEQ ID NO: 2299390 - DNA, 15 bp, Homo sapiens
gaaataaatctaaat

SEQ ID NO: 2299391 - DNA, 15 bp, Homo sapiens
gaaataataatattt

SEQ ID NO: 2299392 - DNA, 20 bp, Homo sapiens
gaaatacactacaaatgtta

SEQ ID NO: 2299393 - DNA, 16 bp, Homo sapiens
gaaatatgcaacctgt

SEQ ID NO: 2299394 - DNA, 17 bp, Homo sapiens
gaaatatgcaacctgtg

SEQ ID NO: 2299395 - DNA, 18 bp, Homo sapiens
gaaatatgcaacctgtgc

SEQ ID NO: 2299396 - DNA, 18 bp, Homo sapiens
gaaatattaatatgtact

SEQ ID NO: 2299397 - DNA, 20 bp, Homo sapiens
gaaatattaatatgtacttt

SEQ ID NO: 2299398 - DNA, 19 bp, Homo sapiens
gaaatcaccgaaaacgtgg

SEQ ID NO: 2299399 - DNA, 14 bp, Homo sapiens
gaaatccaaaatag

SEQ ID NO: 2299400 - DNA, 12 bp, Homo sapiens
gaaatgagaaat

SEQ ID NO: 2299401 - DNA, 14 bp, Homo sapiens
gaaatgtagttgat

SEQ ID NO: 2299402 - DNA, 16 bp, Homo sapiens
gaaattcacactgtgc

SEQ ID NO: 2299403 - DNA, 17 bp, Homo sapiens
gaaattctataagagac

SEQ ID NO: 2299404 - DNA, 20 bp, Homo sapiens
gaaattgtgccaaagatagc

SEQ ID NO: 2299405 - DNA, 17 bp, Homo sapiens
gaaatttaaaaatcttt

SEQ ID NO: 2299406 - DNA, 20 bp, Homo sapiens
gaaatttacagttactgcct

SEQ ID NO: 2299407 - DNA, 11 bp, Homo sapiens
gaaatttatga

SEQ ID NO: 2299408 - DNA, 13 bp, Homo sapiens
gaaattttctaca

SEQ ID NO: 2299409 - DNA, 18 bp, Homo sapiens
gaaatttttaaatcattt

SEQ ID NO: 2299410 - DNA, 15 bp, Homo sapiens
gaacaaaactccaga

SEQ ID NO: 2299411 - DNA, 14 bp, Homo sapiens
gaacaaggcaaggc

SEQ ID NO: 2299412 - DNA, 17 bp, Homo sapiens
gaacaaggcaaggctgt

SEQ ID NO: 2299413 - DNA, 14 bp, Homo sapiens
gaacacccagcccc

SEQ ID NO: 2299414 - DNA, 16 bp, Homo sapiens
gaacactaaagagcta

SEQ ID NO: 2299415 - DNA, 13 bp, Homo sapiens
gaacagagtatat

SEQ ID NO: 2299416 - DNA, 17 bp, Homo sapiens
gaacagagtatatatgt

SEQ ID NO: 2299417 - DNA, 18 bp, Homo sapiens
gaacaggaggtgtgaatg

SEQ ID NO: 2299418 - DNA, 21 bp, Homo sapiens
gaacaggccgcacatctcact

SEQ ID NO: 2299419 - DNA, 15 bp, Homo sapiens
gaacaggtgttcctc

SEQ ID NO: 2299420 - DNA, 21 bp, Homo sapiens
gaacagttctcccttcaactg

SEQ ID NO: 2299421 - DNA, 22 bp, Homo sapiens
gaacatagatgctacagtattt

SEQ ID NO: 2299422 - DNA, 20 bp, Homo sapiens
gaacatgccctcagctaagc

SEQ ID NO: 2299423 - DNA, 16 bp, Homo sapiens
gaaccagcactcccag

SEQ ID NO: 2299424 - DNA, 17 bp, Homo sapiens
gaaccctctggggccct

SEQ ID NO: 2299425 - DNA, 19 bp, Homo sapiens
gaacctgcatttaagaaca

SEQ ID NO: 2299426 - DNA, 13 bp, Homo sapiens
gaacctgctcttc

SEQ ID NO: 2299427 - DNA, 18 bp, Homo sapiens
gaaccttttgagtgcctt

SEQ ID NO: 2299428 - DNA, 22 bp, Homo sapiens
gaaccttttgagtgccttacac

SEQ ID NO: 2299429 - DNA, 14 bp, Homo sapiens
gaacgccctgtgtc

SEQ ID NO: 2299430 - DNA, 22 bp, Homo sapiens
gaacgtactttctgttatcaag

SEQ ID NO: 2299431 - DNA, 17 bp, Homo sapiens
gaactgctgctggtcac

SEQ ID NO: 2299432 - DNA, 21 bp, Homo sapiens
gaactgtggcacttaggggag

SEQ ID NO: 2299433 - DNA, 14 bp, Homo sapiens
gaactgtggccacc

SEQ ID NO: 2299434 - DNA, 12 bp, Homo sapiens
gaacttaaaaca

SEQ ID NO: 2299435 - DNA, 15 bp, Homo sapiens
gaacttaaaacatat

SEQ ID NO: 2299436 - DNA, 13 bp, Homo sapiens
gaagaaaacttga

SEQ ID NO: 2299437 - DNA, 19 bp, Homo sapiens
gaagaaacacgtggtcatg

SEQ ID NO: 2299438 - DNA, 17 bp, Homo sapiens
gaagaaagtctatgctt

SEQ ID NO: 2299439 - DNA, 21 bp, Homo sapiens
gaagaaatgtagtttacattt

SEQ ID NO: 2299440 - DNA, 19 bp, Homo sapiens
gaagaactagccatgtgct

SEQ ID NO: 2299441 - DNA, 15 bp, Homo sapiens
gaagaaggacttcct

SEQ ID NO: 2299442 - DNA, 13 bp, Homo sapiens
gaagaatataaat

SEQ ID NO: 2299443 - DNA, 13 bp, Homo sapiens
gaagacagagatg

SEQ ID NO: 2299444 - DNA, 19 bp, Homo sapiens
gaagacagagatggcagag

SEQ ID NO: 2299445 - DNA, 21 bp, Homo sapiens
gaagacagagatggcagagcc

SEQ ID NO: 2299446 - DNA, 14 bp, Homo sapiens
gaagagatgctcta

SEQ ID NO: 2299447 - DNA, 12 bp, Homo sapiens
gaagagccagcc

SEQ ID NO: 2299448 - DNA, 16 bp, Homo sapiens
gaagaggggcagcttt

SEQ ID NO: 2299449 - DNA, 19 bp, Homo sapiens
gaagaggggcgctgccccc

SEQ ID NO: 2299450 - DNA, 18 bp, Homo sapiens
gaagatgaatcagtatga

SEQ ID NO: 2299451 - DNA, 18 bp, Homo sapiens
gaagattataaaagccaa

SEQ ID NO: 2299452 - DNA, 13 bp, Homo sapiens
gaagattctaaaa

SEQ ID NO: 2299453 - DNA, 21 bp, Homo sapiens
gaagattctaaaacattcttt

SEQ ID NO: 2299454 - DNA, 22 bp, Homo sapiens
gaagattctaaaacattcttta

SEQ ID NO: 2299455 - DNA, 13 bp, Homo sapiens
gaagcccacccgc

SEQ ID NO: 2299456 - DNA, 16 bp, Homo sapiens
gaagcccacccgcccc

SEQ ID NO: 2299457 - DNA, 18 bp, Homo sapiens
gaagcccacccgccccag

SEQ ID NO: 2299458 - DNA, 21 bp, Homo sapiens
gaagcccacccgccccagaga

SEQ ID NO: 2299459 - DNA, 17 bp, Homo sapiens
gaagcctcatgggagtc

SEQ ID NO: 2299460 - DNA, 15 bp, Homo sapiens
gaagcctcctgctga

SEQ ID NO: 2299461 - DNA, 22 bp, Homo sapiens
gaagctgcctggtgtggagtga

SEQ ID NO: 2299462 - DNA, 20 bp, Homo sapiens
gaaggaaatcccatcagtga

SEQ ID NO: 2299463 - DNA, 13 bp, Homo sapiens
gaaggacttcctg

SEQ ID NO: 2299464 - DNA, 19 bp, Homo sapiens
gaaggcacaggtgtaaata

SEQ ID NO: 2299465 - DNA, 15 bp, Homo sapiens
gaaggccttgttaaa

SEQ ID NO: 2299466 - DNA, 16 bp, Homo sapiens
gaaggcgtgggggaca

SEQ ID NO: 2299467 - DNA, 18 bp, Homo sapiens
gaaggctctatctgctgg

SEQ ID NO: 2299468 - DNA, 21 bp, Homo sapiens
gaagggaggggaagagagagg

SEQ ID NO: 2299469 - DNA, 16 bp, Homo sapiens
gaagggcaggagctca

SEQ ID NO: 2299470 - DNA, 14 bp, Homo sapiens
gaagggtccaccct

SEQ ID NO: 2299471 - DNA, 19 bp, Homo sapiens
gaagggtccaccctagcct

SEQ ID NO: 2299472 - DNA, 14 bp, Homo sapiens
gaagggtgggccct

SEQ ID NO: 2299473 - DNA, 15 bp, Homo sapiens
gaagggtgggccctg

SEQ ID NO: 2299474 - DNA, 14 bp, Homo sapiens
gaaggtcaaggtca

SEQ ID NO: 2299475 - DNA, 12 bp, Homo sapiens
gaagtaataact

SEQ ID NO: 2299476 - DNA, 20 bp, Homo sapiens
gaagtagttttgttcatgaa

SEQ ID NO: 2299477 - DNA, 15 bp, Homo sapiens
gaagtccgaggcctg

SEQ ID NO: 2299478 - DNA, 9 bp, Homo sapiens
gaagtcttg

SEQ ID NO: 2299479 - DNA, 12 bp, Homo sapiens
gaagtcttgtat

SEQ ID NO: 2299480 - DNA, 14 bp, Homo sapiens
gaagtcttgtataa

SEQ ID NO: 2299481 - DNA, 14 bp, Homo sapiens
gaagttacctttta

SEQ ID NO: 2299482 - DNA, 22 bp, Homo sapiens
gaagttaccttttataagacaa

SEQ ID NO: 2299483 - DNA, 16 bp, Homo sapiens
gaataaataaagaaga

SEQ ID NO: 2299484 - DNA, 20 bp, Homo sapiens
gacctgcgcaaagggcgggc

SEQ ID NO: 2299485 - DNA, 22 bp, Homo sapiens
gacctgcgcaaagggcgggcct

SEQ ID NO: 2299486 - DNA, 11 bp, Homo sapiens
gacctgctcca

SEQ ID NO: 2299487 - DNA, 17 bp, Homo sapiens
gacctggggtcccccct

SEQ ID NO: 2299488 - DNA, 21 bp, Homo sapiens
gacctggggtcccccctccct

SEQ ID NO: 2299489 - DNA, 22 bp, Homo sapiens
gacctggggtcccccctccctg

SEQ ID NO: 2299490 - DNA, 13 bp, Homo sapiens
gaccttctgaaga

SEQ ID NO: 2299491 - DNA, 21 bp, Homo sapiens
gacctttcaataggaaaaact

SEQ ID NO: 2299492 - DNA, 15 bp, Homo sapiens
gacgacctacatctg

SEQ ID NO: 2299493 - DNA, 22 bp, Homo sapiens
gacgcagccccccacgcttctg

SEQ ID NO: 2299494 - DNA, 12 bp, Homo sapiens
gacgcagggaga

SEQ ID NO: 2299495 - DNA, 23 bp, Homo sapiens
gacgcagggagaccctgggagag

SEQ ID NO: 2299496 - DNA, 17 bp, Homo sapiens
gacgctggtaactgtta

SEQ ID NO: 2299497 - DNA, 17 bp, Homo sapiens
gacggagccactggggt

SEQ ID NO: 2299498 - DNA, 22 bp, Homo sapiens
gacgggacagcggcccggccca

SEQ ID NO: 2299499 - DNA, 19 bp, Homo sapiens
gacggggacacggcctctg

SEQ ID NO: 2299500 - DNA, 13 bp, Homo sapiens
gacggggcagagc

SEQ ID NO: 2299501 - DNA, 14 bp, Homo sapiens
gacggggcagagct

SEQ ID NO: 2299502 - DNA, 18 bp, Homo sapiens
gacggggcccgccccagg

SEQ ID NO: 2299503 - DNA, 14 bp, Homo sapiens
gacgtgttatgact

SEQ ID NO: 2299504 - DNA, 17 bp, Homo sapiens
gacgtgttatgactcca

SEQ ID NO: 2299505 - DNA, 20 bp, Homo sapiens
gacgtgttatgactccagaa

SEQ ID NO: 2299506 - DNA, 18 bp, Homo sapiens
gactaaataatgatcttc

SEQ ID NO: 2299507 - DNA, 22 bp, Homo sapiens
gactaatgaatgcaaaaagata

SEQ ID NO: 2299508 - DNA, 19 bp, Homo sapiens
gactatgtgtcatgatttc

SEQ ID NO: 2299509 - DNA, 15 bp, Homo sapiens
gactcagttcttggc

SEQ ID NO: 2299510 - DNA, 18 bp, Homo sapiens
gactcagttcttggcctg

SEQ ID NO: 2299511 - DNA, 13 bp, Homo sapiens
gactccaggggct

SEQ ID NO: 2299512 - DNA, 19 bp, Homo sapiens
gactccaggggctggggac

SEQ ID NO: 2299513 - DNA, 13 bp, Homo sapiens
gactccccctccc

SEQ ID NO: 2299514 - DNA, 14 bp, Homo sapiens
gactccccctcccc

SEQ ID NO: 2299515 - DNA, 15 bp, Homo sapiens
gactccccctccccg

SEQ ID NO: 2299516 - DNA, 19 bp, Homo sapiens
gactcgagagggctgagcc

SEQ ID NO: 2299517 - DNA, 24 bp, Homo sapiens
gactcgagagggctgagcccctcc

SEQ ID NO: 2299518 - DNA, 13 bp, Homo sapiens
gactcgcgacaat

SEQ ID NO: 2299519 - DNA, 17 bp, Homo sapiens
gactcgcgacaatgcaa

SEQ ID NO: 2299520 - DNA, 15 bp, Homo sapiens
gactcgcgagagggt

SEQ ID NO: 2299521 - DNA, 17 bp, Homo sapiens
gactcgcgagagggtgc

SEQ ID NO: 2299522 - DNA, 20 bp, Homo sapiens
gactctccaggcaccgcctg

SEQ ID NO: 2299523 - DNA, 21 bp, Homo sapiens
gactctggaaccatcctctgt

SEQ ID NO: 2299524 - DNA, 15 bp, Homo sapiens
gactcttcaaaaact

SEQ ID NO: 2299525 - DNA, 18 bp, Homo sapiens
gactcttcgatgtgccca

SEQ ID NO: 2299526 - DNA, 16 bp, Homo sapiens
gactgaagtaataact

SEQ ID NO: 2299527 - DNA, 19 bp, Homo sapiens
gactgaagtaataactgat

SEQ ID NO: 2299528 - DNA, 12 bp, Homo sapiens
gactgaatgcag

SEQ ID NO: 2299529 - DNA, 23 bp, Homo sapiens
gactgcccaccctgggcctcccg

SEQ ID NO: 2299530 - DNA, 21 bp, Homo sapiens
gactggcccctaggctgctgc

SEQ ID NO: 2299531 - DNA, 17 bp, Homo sapiens
gactgtcttcaaccctg

SEQ ID NO: 2299532 - DNA, 18 bp, Homo sapiens
gactgtcttcaaccctgc

SEQ ID NO: 2299533 - DNA, 19 bp, Homo sapiens
gactgtcttcaaccctgcc

SEQ ID NO: 2299534 - DNA, 22 bp, Homo sapiens
gactgtcttcaaccctgccctg

SEQ ID NO: 2299535 - DNA, 15 bp, Homo sapiens
gactgtggcctcagg

SEQ ID NO: 2299536 - DNA, 16 bp, Homo sapiens
gactgtggcctcagga

SEQ ID NO: 2299537 - DNA, 19 bp, Homo sapiens
gactgtggcctcaggaggc

SEQ ID NO: 2299538 - DNA, 19 bp, Homo sapiens
gacttaagcacacttgaca

SEQ ID NO: 2299539 - DNA, 19 bp, Homo sapiens
gacttaatcatatcaactt

SEQ ID NO: 2299540 - DNA, 19 bp, Homo sapiens
gacttatatatttgaaaga

SEQ ID NO: 2299541 - DNA, 21 bp, Homo sapiens
gacttatatatttgaaagaag

SEQ ID NO: 2299542 - DNA, 15 bp, Homo sapiens
gacttcccagctggc

SEQ ID NO: 2299543 - DNA, 17 bp, Homo sapiens
gacttcgggggcggctc

SEQ ID NO: 2299544 - DNA, 16 bp, Homo sapiens
gagaaaatgctttctc

SEQ ID NO: 2299545 - DNA, 16 bp, Homo sapiens
gagaagcctcatggga

SEQ ID NO: 2299546 - DNA, 18 bp, Homo sapiens
gagaagcctcatgggagt

SEQ ID NO: 2299547 - DNA, 15 bp, Homo sapiens
gagaagttgtgaaag

SEQ ID NO: 2299548 - DNA, 16 bp, Homo sapiens
gagaagttgtgaaaga

SEQ ID NO: 2299549 - DNA, 17 bp, Homo sapiens
gagaatgctggcaaagg

SEQ ID NO: 2299550 - DNA, 22 bp, Homo sapiens
gagaattccagttgtatttgaa

SEQ ID NO: 2299551 - DNA, 22 bp, Homo sapiens
gagaattgtgcgacttcacaaa

SEQ ID NO: 2299552 - DNA, 13 bp, Homo sapiens
gagacactggtct

SEQ ID NO: 2299553 - DNA, 14 bp, Homo sapiens
gagacactggtctc

SEQ ID NO: 2299554 - DNA, 13 bp, Homo sapiens
gagacagggtctc

SEQ ID NO: 2299555 - DNA, 21 bp, Homo sapiens
gagaccacacaccctttggga

SEQ ID NO: 2299556 - DNA, 12 bp, Homo sapiens
gagaccagcctg

SEQ ID NO: 2299557 - DNA, 13 bp, Homo sapiens
gagaccaggactc

SEQ ID NO: 2299558 - DNA, 14 bp, Homo sapiens
gagaccaggactct

SEQ ID NO: 2299559 - DNA, 19 bp, Homo sapiens
gagaccaggactctgcctt

SEQ ID NO: 2299560 - DNA, 16 bp, Homo sapiens
gagaccgagtgtggag

SEQ ID NO: 2299561 - DNA, 17 bp, Homo sapiens
gagacctcccccaggga

SEQ ID NO: 2299562 - DNA, 19 bp, Homo sapiens
gagacctgctccagatcct

SEQ ID NO: 2299563 - DNA, 14 bp, Homo sapiens
gagacggcagcccc

SEQ ID NO: 2299564 - DNA, 16 bp, Homo sapiens
gagacggcagccccat

SEQ ID NO: 2299565 - DNA, 18 bp, Homo sapiens
gagacggtgggaaaataa

SEQ ID NO: 2299566 - DNA, 13 bp, Homo sapiens
gagactatgtgtc

SEQ ID NO: 2299567 - DNA, 13 bp, Homo sapiens
gagactcaggccc

SEQ ID NO: 2299568 - DNA, 15 bp, Homo sapiens
gagactcaggcccac

SEQ ID NO: 2299569 - DNA, 13 bp, Homo sapiens
gagactgcccacc

SEQ ID NO: 2299570 - DNA, 21 bp, Homo sapiens
gagactgcccaccctgggcct

SEQ ID NO: 2299571 - DNA, 16 bp, Homo sapiens
gagagatgtctgttct

SEQ ID NO: 2299572 - DNA, 18 bp, Homo sapiens
gagagcgccacccgcccg

SEQ ID NO: 2299573 - DNA, 14 bp, Homo sapiens
gagaggcatccagt

SEQ ID NO: 2299574 - DNA, 20 bp, Homo sapiens
gagaggcctgggtgtgacct

SEQ ID NO: 2299575 - DNA, 14 bp, Homo sapiens
gagagggctgagcc

SEQ ID NO: 2299576 - DNA, 17 bp, Homo sapiens
gagagggctgagcccct

SEQ ID NO: 2299577 - DNA, 19 bp, Homo sapiens
gagagggctgagcccctcc

SEQ ID NO: 2299578 - DNA, 22 bp, Homo sapiens
gagagggtgccgcgggcgagaa

SEQ ID NO: 2299579 - DNA, 20 bp, Homo sapiens
gagagttgttcccccagggg

SEQ ID NO: 2299580 - DNA, 15 bp, Homo sapiens
gagatcagcattcaa

SEQ ID NO: 2299581 - DNA, 18 bp, Homo sapiens
gagatcagcattcaaaat

SEQ ID NO: 2299582 - DNA, 15 bp, Homo sapiens
gagatccgccctggg

SEQ ID NO: 2299583 - DNA, 19 bp, Homo sapiens
gagatccgccctgggctct

SEQ ID NO: 2299584 - DNA, 17 bp, Homo sapiens
gagatggaatatcaatg

SEQ ID NO: 2299585 - DNA, 15 bp, Homo sapiens
gagatggcagagcca

SEQ ID NO: 2299586 - DNA, 21 bp, Homo sapiens
gagatgtaccatgttaaagag

SEQ ID NO: 2299587 - DNA, 20 bp, Homo sapiens
gagatgtgtccatgtgaaat

SEQ ID NO: 2299588 - DNA, 19 bp, Homo sapiens
gagattccagaacgccctg

SEQ ID NO: 2299589 - DNA, 13 bp, Homo sapiens
gagattggctttg

SEQ ID NO: 2299590 - DNA, 13 bp, Homo sapiens
gagatttgtattt

SEQ ID NO: 2299591 - DNA, 15 bp, Homo sapiens
gagatttgtatttat

SEQ ID NO: 2299592 - DNA, 16 bp, Homo sapiens
gagatttgtatttata

SEQ ID NO: 2299593 - DNA, 19 bp, Homo sapiens
gagcaaagtcatgtcagaa

SEQ ID NO: 2299594 - DNA, 18 bp, Homo sapiens
gagcaaagtgcaggttat

SEQ ID NO: 2299595 - DNA, 12 bp, Homo sapiens
gagcaatgtttt

SEQ ID NO: 2299596 - DNA, 12 bp, Homo sapiens
gagcacccccag

SEQ ID NO: 2299597 - DNA, 18 bp, Homo sapiens
gagcacccccagcctccc

SEQ ID NO: 2299598 - DNA, 21 bp, Homo sapiens
gagcacccccagcctccccca

SEQ ID NO: 2299599 - DNA, 15 bp, Homo sapiens
gagcacggttgcctg

SEQ ID NO: 2299600 - DNA, 17 bp, Homo sapiens
gagcacggttgcctgag

SEQ ID NO: 2299601 - DNA, 17 bp, Homo sapiens
gagcactagaatgagaa

SEQ ID NO: 2299602 - DNA, 20 bp, Homo sapiens
gagcactagaatgagaaatc

SEQ ID NO: 2299603 - DNA, 15 bp, Homo sapiens
gagcactgtataccc

SEQ ID NO: 2299604 - DNA, 16 bp, Homo sapiens
gagcactgtatacccc

SEQ ID NO: 2299605 - DNA, 19 bp, Homo sapiens
gagcagagacggcagcccc

SEQ ID NO: 2299606 - DNA, 19 bp, Homo sapiens
gagcagcgtgcaggagcaa

SEQ ID NO: 2299607 - DNA, 16 bp, Homo sapiens
gagcagtggggagcgg

SEQ ID NO: 2299608 - DNA, 20 bp, Homo sapiens
gagcagtttggggcaggggg

SEQ ID NO: 2299609 - DNA, 19 bp, Homo sapiens
gagccacagtggggcccat

SEQ ID NO: 2299610 - DNA, 14 bp, Homo sapiens
gagccactggggtg

SEQ ID NO: 2299611 - DNA, 18 bp, Homo sapiens
gagccactggggtgggag

SEQ ID NO: 2299612 - DNA, 15 bp, Homo sapiens
gagccagatttcact

SEQ ID NO: 2299613 - DNA, 22 bp, Homo sapiens
gagccatccaccctgaggagtg

SEQ ID NO: 2299614 - DNA, 13 bp, Homo sapiens
gagccccggagca

SEQ ID NO: 2299615 - DNA, 22 bp, Homo sapiens
gagcccctcctctcctcgtccg

SEQ ID NO: 2299616 - DNA, 21 bp, Homo sapiens
gagcccggcagtgcaccccct

SEQ ID NO: 2299617 - DNA, 15 bp, Homo sapiens
gatatcacgggcccg

SEQ ID NO: 2299618 - DNA, 17 bp, Homo sapiens
gatatgaaagagaaaat

SEQ ID NO: 2299619 - DNA, 19 bp, Homo sapiens
gatattatgtatagaaaat

SEQ ID NO: 2299620 - DNA, 20 bp, Homo sapiens
gatattatgtatagaaaata

SEQ ID NO: 2299621 - DNA, 22 bp, Homo sapiens
gatattatgtatagaaaataaa

SEQ ID NO: 2299622 - DNA, 16 bp, Homo sapiens
gatcaaccaagttaca

SEQ ID NO: 2299623 - DNA, 19 bp, Homo sapiens
gatcagacattcagagatt

SEQ ID NO: 2299624 - DNA, 17 bp, Homo sapiens
gatcagacttgatttac

SEQ ID NO: 2299625 - DNA, 17 bp, Homo sapiens
gatcattatttcatgac

SEQ ID NO: 2299626 - DNA, 14 bp, Homo sapiens
gatccagagacctg

SEQ ID NO: 2299627 - DNA, 17 bp, Homo sapiens
gatccagagacctgctc

SEQ ID NO: 2299628 - DNA, 21 bp, Homo sapiens
gatccagagacctgctccaga

SEQ ID NO: 2299629 - DNA, 21 bp, Homo sapiens
gatcccagctcactgcagcct

SEQ ID NO: 2299630 - DNA, 18 bp, Homo sapiens
gatccctcggtcagcacc

SEQ ID NO: 2299631 - DNA, 14 bp, Homo sapiens
gatccgccctgggc

SEQ ID NO: 2299632 - DNA, 16 bp, Homo sapiens
gatccgccctgggctc

SEQ ID NO: 2299633 - DNA, 17 bp, Homo sapiens
gatccgccctgggctct

SEQ ID NO: 2299634 - DNA, 20 bp, Homo sapiens
gatcctcccgccccagcctc

SEQ ID NO: 2299635 - DNA, 21 bp, Homo sapiens
gatcctcccgccccagcctcc

SEQ ID NO: 2299636 - DNA, 24 bp, Homo sapiens
gatcctcccgccccagcctcctga

SEQ ID NO: 2299637 - DNA, 15 bp, Homo sapiens
gatcctctttcccca

SEQ ID NO: 2299638 - DNA, 12 bp, Homo sapiens
gatcctgagcca

SEQ ID NO: 2299639 - DNA, 14 bp, Homo sapiens
gatcctgagccaga

SEQ ID NO: 2299640 - DNA, 15 bp, Homo sapiens
gatcctgagccagat

SEQ ID NO: 2299641 - DNA, 21 bp, Homo sapiens
gatcctgagccagatttcact

SEQ ID NO: 2299642 - DNA, 18 bp, Homo sapiens
gatcctgtcccatgggct

SEQ ID NO: 2299643 - DNA, 20 bp, Homo sapiens
gatcgtttcacatctgtata

SEQ ID NO: 2299644 - DNA, 19 bp, Homo sapiens
gatctaaatggaagcatct

SEQ ID NO: 2299645 - DNA, 20 bp, Homo sapiens
gatctcctgtaattttgtag

SEQ ID NO: 2299646 - DNA, 21 bp, Homo sapiens
gatctggtctcgtgttcgctg

SEQ ID NO: 2299647 - DNA, 23 bp, Homo sapiens
gatctggtctcgtgttcgctggc

SEQ ID NO: 2299648 - DNA, 24 bp, Homo sapiens
gatctggtctcgtgttcgctggct

SEQ ID NO: 2299649 - DNA, 14 bp, Homo sapiens
gatctgtcttgtaa

SEQ ID NO: 2299650 - DNA, 16 bp, Homo sapiens
gatcttacaagtttat

SEQ ID NO: 2299651 - DNA, 17 bp, Homo sapiens
gatgaactcaatgcatg

SEQ ID NO: 2299652 - DNA, 18 bp, Homo sapiens
gatgaccttgaatgatgc

SEQ ID NO: 2299653 - DNA, 13 bp, Homo sapiens
gatgagaagacta

SEQ ID NO: 2299654 - DNA, 16 bp, Homo sapiens
gatgagaggaaatcac

SEQ ID NO: 2299655 - DNA, 20 bp, Homo sapiens
gatgatagacttcgaaaaca

SEQ ID NO: 2299656 - DNA, 18 bp, Homo sapiens
gatgatgggctggagcag

SEQ ID NO: 2299657 - DNA, 23 bp, Homo sapiens
gatgcagaaatgtggatgctctt

SEQ ID NO: 2299658 - DNA, 13 bp, Homo sapiens
gatgccaatgaca

SEQ ID NO: 2299659 - DNA, 15 bp, Homo sapiens
gatgctgggaccctc

SEQ ID NO: 2299660 - DNA, 11 bp, Homo sapiens
gatggcagagg

SEQ ID NO: 2299661 - DNA, 15 bp, Homo sapiens
gatggcgtgtcccct

SEQ ID NO: 2299662 - DNA, 16 bp, Homo sapiens
gatgggatcattattt

SEQ ID NO: 2299663 - DNA, 20 bp, Homo sapiens
gatgggcaaggggccaggaa

SEQ ID NO: 2299664 - DNA, 14 bp, Homo sapiens
gatgggtcctgctg

SEQ ID NO: 2299665 - DNA, 15 bp, Homo sapiens
gatgggtcctgctgc

SEQ ID NO: 2299666 - DNA, 20 bp, Homo sapiens
gatgggtgtcccctggtgcc

SEQ ID NO: 2299667 - DNA, 12 bp, Homo sapiens
gatggtgcaatg

SEQ ID NO: 2299668 - DNA, 15 bp, Homo sapiens
gatggtgcaatgacc

SEQ ID NO: 2299669 - DNA, 19 bp, Homo sapiens
gatgtcagtctgtccacgt

SEQ ID NO: 2299670 - DNA, 17 bp, Homo sapiens
gatgtgcccaggggagc

SEQ ID NO: 2299671 - DNA, 18 bp, Homo sapiens
gatgttagtgttttaaga

SEQ ID NO: 2299672 - DNA, 19 bp, Homo sapiens
gatgttttagagataaata

SEQ ID NO: 2299673 - DNA, 22 bp, Homo sapiens
gatgttttagagataaatattt

SEQ ID NO: 2299674 - DNA, 20 bp, Homo sapiens
gattaatctctaaaattcta

SEQ ID NO: 2299675 - DNA, 22 bp, Homo sapiens
gattaatctctaaaattctagt

SEQ ID NO: 2299676 - DNA, 18 bp, Homo sapiens
gattagcctcgtctttca

SEQ ID NO: 2299677 - DNA, 15 bp, Homo sapiens
gattaggtgtaagac

SEQ ID NO: 2299678 - DNA, 22 bp, Homo sapiens
gattataaacaacagaaacttc

SEQ ID NO: 2299679 - DNA, 15 bp, Homo sapiens
gattcaattaacata

SEQ ID NO: 2299680 - DNA, 13 bp, Homo sapiens
gattcagtcttgc

SEQ ID NO: 2299681 - DNA, 23 bp, Homo sapiens
gattcagtcttgccttacacaaa

SEQ ID NO: 2299682 - DNA, 21 bp, Homo sapiens
gattccaacccaggtctgctt

SEQ ID NO: 2299683 - DNA, 20 bp, Homo sapiens
gattccaagggcccagaggg

SEQ ID NO: 2299684 - DNA, 20 bp, Homo sapiens
gattccactgaaacctctgt

SEQ ID NO: 2299685 - DNA, 17 bp, Homo sapiens
gattccagaacgccctg

SEQ ID NO: 2299686 - DNA, 19 bp, Homo sapiens
gattccagaacgccctgtg

SEQ ID NO: 2299687 - DNA, 17 bp, Homo sapiens
gattccccggagctggg

SEQ ID NO: 2299688 - DNA, 12 bp, Homo sapiens
gattctaaaaca

SEQ ID NO: 2299689 - DNA, 22 bp, Homo sapiens
gattctatgcctgtatttccaa

SEQ ID NO: 2299690 - DNA, 19 bp, Homo sapiens
gattcttttttcaatgtac

SEQ ID NO: 2299691 - DNA, 22 bp, Homo sapiens
gattgaaaagaagaaagtctat

SEQ ID NO: 2299692 - DNA, 15 bp, Homo sapiens
gattgctgcaaagat

SEQ ID NO: 2299693 - DNA, 22 bp, Homo sapiens
gattgtctgctgcctccaagtc

SEQ ID NO: 2299694 - DNA, 12 bp, Homo sapiens
gatttcactctc

SEQ ID NO: 2299695 - DNA, 13 bp, Homo sapiens
gatttcactctcc

SEQ ID NO: 2299696 - DNA, 18 bp, Homo sapiens
gatttcactctccttggt

SEQ ID NO: 2299697 - DNA, 22 bp, Homo sapiens
gatttccctaaggagcctggga

SEQ ID NO: 2299698 - DNA, 16 bp, Homo sapiens
gatttctgttgttatt

SEQ ID NO: 2299699 - DNA, 14 bp, Homo sapiens
gatttgaaaacacc

SEQ ID NO: 2299700 - DNA, 14 bp, Homo sapiens
gatttggctcgctg

SEQ ID NO: 2299701 - DNA, 17 bp, Homo sapiens
gatttggctcgctgtgg

SEQ ID NO: 2299702 - DNA, 16 bp, Homo sapiens
gatttgtatttatatt

SEQ ID NO: 2299703 - DNA, 20 bp, Homo sapiens
gatttgtatttatattagag

SEQ ID NO: 2299704 - DNA, 22 bp, Homo sapiens
gattttagatttctttgattgt

SEQ ID NO: 2299705 - DNA, 16 bp, Homo sapiens
gattttctttctatgt

SEQ ID NO: 2299706 - DNA, 22 bp, Homo sapiens
gatttttttttccttcagtgcc

SEQ ID NO: 2299707 - DNA, 22 bp, Homo sapiens
gcaaaaaaaaaaattacattat

SEQ ID NO: 2299708 - DNA, 10 bp, Homo sapiens
gcaaaaatat

SEQ ID NO: 2299709 - DNA, 11 bp, Homo sapiens
gcaaaaatatt

SEQ ID NO: 2299710 - DNA, 20 bp, Homo sapiens
gcaaaactcagtctcaaata

SEQ ID NO: 2299711 - DNA, 23 bp, Homo sapiens
gcaaaagtcattgctgacagagc

SEQ ID NO: 2299712 - DNA, 16 bp, Homo sapiens
gcaaacaaaatgatgg

SEQ ID NO: 2299713 - DNA, 16 bp, Homo sapiens
gcaaacactgtgtatt

SEQ ID NO: 2299714 - DNA, 19 bp, Homo sapiens
gcaaaccatcattgaaatc

SEQ ID NO: 2299715 - DNA, 20 bp, Homo sapiens
gcaaagtcatgtcagaagga

SEQ ID NO: 2299716 - DNA, 15 bp, Homo sapiens
gcaaatagtttcaaa

SEQ ID NO: 2299717 - DNA, 16 bp, Homo sapiens
gcaaatagtttcaaat

SEQ ID NO: 2299718 - DNA, 14 bp, Homo sapiens
gcaaatgaatgcct

SEQ ID NO: 2299719 - DNA, 19 bp, Homo sapiens
gcaaatgttgtatttcaaa

SEQ ID NO: 2299720 - DNA, 14 bp, Homo sapiens
gcaaattattctag

SEQ ID NO: 2299721 - DNA, 23 bp, Homo sapiens
gcaaattattctagtcaactgct

SEQ ID NO: 2299722 - DNA, 13 bp, Homo sapiens
gcaaccaataaaa

SEQ ID NO: 2299723 - DNA, 17 bp, Homo sapiens
gcaaccagagcactgta

SEQ ID NO: 2299724 - DNA, 14 bp, Homo sapiens
gcaacccctgcagc

SEQ ID NO: 2299725 - DNA, 14 bp, Homo sapiens
gcaacctgtgcaaa

SEQ ID NO: 2299726 - DNA, 20 bp, Homo sapiens
gcaacctgtgcaaaataaaa

SEQ ID NO: 2299727 - DNA, 23 bp, Homo sapiens
gcaacctgtgcaaaataaaatga

SEQ ID NO: 2299728 - DNA, 13 bp, Homo sapiens
gcaacctgttctt

SEQ ID NO: 2299729 - DNA, 14 bp, Homo sapiens
gcaagaagaatata

SEQ ID NO: 2299730 - DNA, 17 bp, Homo sapiens
gcaagctttaacagact

SEQ ID NO: 2299731 - DNA, 14 bp, Homo sapiens
gcaaggctgtcaat

SEQ ID NO: 2299732 - DNA, 22 bp, Homo sapiens
gcaaggtgaacaccactttgtc

SEQ ID NO: 2299733 - DNA, 21 bp, Homo sapiens
gcaagtatgaaccacatggaa

SEQ ID NO: 2299734 - DNA, 15 bp, Homo sapiens
gcaagttcatgtgtg

SEQ ID NO: 2299735 - DNA, 21 bp, Homo sapiens
gcaagttcatgtgtggaaatg

SEQ ID NO: 2299736 - DNA, 14 bp, Homo sapiens
gcaataacagtttt

SEQ ID NO: 2299737 - DNA, 17 bp, Homo sapiens
gcaatagtgttgaggag

SEQ ID NO: 2299738 - DNA, 16 bp, Homo sapiens
gcaatatatttgtagg

SEQ ID NO: 2299739 - DNA, 21 bp, Homo sapiens
gcaatatgtaacatgtctaaa

SEQ ID NO: 2299740 - DNA, 13 bp, Homo sapiens
gcaatgacctttc

SEQ ID NO: 2299741 - DNA, 14 bp, Homo sapiens
gcaatgacctttca

SEQ ID NO: 2299742 - DNA, 20 bp, Homo sapiens
gcaatgacctttcaatagga

SEQ ID NO: 2299743 - DNA, 16 bp, Homo sapiens
gcaatgatcagacttg

SEQ ID NO: 2299744 - DNA, 21 bp, Homo sapiens
gcaattcagtcctgggcaaag

SEQ ID NO: 2299745 - DNA, 11 bp, Homo sapiens
gcacaaactgt

SEQ ID NO: 2299746 - DNA, 14 bp, Homo sapiens
gcacacaatcctat

SEQ ID NO: 2299747 - DNA, 15 bp, Homo sapiens
gcacacctgtaatcc

SEQ ID NO: 2299748 - DNA, 14 bp, Homo sapiens
gcacacttcccctt

SEQ ID NO: 2299749 - DNA, 20 bp, Homo sapiens
gccaatttcaaagaaaacag

SEQ ID NO: 2299750 - DNA, 22 bp, Homo sapiens
gccaatttcaaagaaaacagac

SEQ ID NO: 2299751 - DNA, 12 bp, Homo sapiens
gccacagcactc

SEQ ID NO: 2299752 - DNA, 16 bp, Homo sapiens
gccacagtggggccca

SEQ ID NO: 2299753 - DNA, 18 bp, Homo sapiens
gccacagtggggcccatg

SEQ ID NO: 2299754 - DNA, 21 bp, Homo sapiens
gccacagtggggcccatggcc

SEQ ID NO: 2299755 - DNA, 21 bp, Homo sapiens
gccacattgaaaaatgtccac

SEQ ID NO: 2299756 - DNA, 18 bp, Homo sapiens
gccaccctctgctgcaca

SEQ ID NO: 2299757 - DNA, 19 bp, Homo sapiens
gccaccttgtacagaacca

SEQ ID NO: 2299758 - DNA, 17 bp, Homo sapiens
gccacgcattttgcact

SEQ ID NO: 2299759 - DNA, 18 bp, Homo sapiens
gccacgttgcagaaaaag

SEQ ID NO: 2299760 - DNA, 14 bp, Homo sapiens
gccacgttttcacc

SEQ ID NO: 2299761 - DNA, 15 bp, Homo sapiens
gccactcctgggccc

SEQ ID NO: 2299762 - DNA, 17 bp, Homo sapiens
gccactcctgggcccca

SEQ ID NO: 2299763 - DNA, 14 bp, Homo sapiens
gccactggccctgt

SEQ ID NO: 2299764 - DNA, 23 bp, Homo sapiens
gccactggggtgggagggggcag

SEQ ID NO: 2299765 - DNA, 17 bp, Homo sapiens
gccagagccgcaccctg

SEQ ID NO: 2299766 - DNA, 19 bp, Homo sapiens
gccagagccgcaccctggc

SEQ ID NO: 2299767 - DNA, 21 bp, Homo sapiens
gccagagccgcaccctggctg

SEQ ID NO: 2299768 - DNA, 13 bp, Homo sapiens
gccagagctccca

SEQ ID NO: 2299769 - DNA, 14 bp, Homo sapiens
gccagagctcccag

SEQ ID NO: 2299770 - DNA, 13 bp, Homo sapiens
gccagatttcact

SEQ ID NO: 2299771 - DNA, 19 bp, Homo sapiens
gccagcagaactgaagtgt

SEQ ID NO: 2299772 - DNA, 12 bp, Homo sapiens
gccagcccctcc

SEQ ID NO: 2299773 - DNA, 22 bp, Homo sapiens
gccagcccctccccgcctcctc

SEQ ID NO: 2299774 - DNA, 14 bp, Homo sapiens
gccagcgtggcaac

SEQ ID NO: 2299775 - DNA, 14 bp, Homo sapiens
gccaggaaggggac

SEQ ID NO: 2299776 - DNA, 16 bp, Homo sapiens
gccaggaaggggacag

SEQ ID NO: 2299777 - DNA, 21 bp, Homo sapiens
gccaggaaggggacaggattg

SEQ ID NO: 2299778 - DNA, 19 bp, Homo sapiens
gccaggagtgggtgggaca

SEQ ID NO: 2299779 - DNA, 17 bp, Homo sapiens
gccaggatggcgtgtcc

SEQ ID NO: 2299780 - DNA, 13 bp, Homo sapiens
gccaggctgagcc

SEQ ID NO: 2299781 - DNA, 13 bp, Homo sapiens
gccagggctctgg

SEQ ID NO: 2299782 - DNA, 23 bp, Homo sapiens
gccatatgtaccctaccctgcac

SEQ ID NO: 2299783 - DNA, 13 bp, Homo sapiens
gccatcagcccct

SEQ ID NO: 2299784 - DNA, 17 bp, Homo sapiens
gccatcagcccctgctg

SEQ ID NO: 2299785 - DNA, 13 bp, Homo sapiens
gccatccaccctg

SEQ ID NO: 2299786 - DNA, 17 bp, Homo sapiens
gccatctcagcttgctg

SEQ ID NO: 2299787 - DNA, 12 bp, Homo sapiens
gccatgcatgat

SEQ ID NO: 2299788 - DNA, 17 bp, Homo sapiens
gcccaaataacagtggc

SEQ ID NO: 2299789 - DNA, 13 bp, Homo sapiens
gcccaacccccac

SEQ ID NO: 2299790 - DNA, 15 bp, Homo sapiens
gcccaacccccacct

SEQ ID NO: 2299791 - DNA, 10 bp, Homo sapiens
gcccaacctc

SEQ ID NO: 2299792 - DNA, 17 bp, Homo sapiens
gcccaacctcgccctct

SEQ ID NO: 2299793 - DNA, 21 bp, Homo sapiens
gcccacaataatgaataatca

SEQ ID NO: 2299794 - DNA, 15 bp, Homo sapiens
gcccacacctgcctc

SEQ ID NO: 2299795 - DNA, 16 bp, Homo sapiens
gcccaccccgctgcct

SEQ ID NO: 2299796 - DNA, 21 bp, Homo sapiens
gcccaccccgctgcctggcgg

SEQ ID NO: 2299797 - DNA, 12 bp, Homo sapiens
gcccacccgccc

SEQ ID NO: 2299798 - DNA, 15 bp, Homo sapiens
gcccacccgccccag

SEQ ID NO: 2299799 - DNA, 21 bp, Homo sapiens
gcccacccgccccagagactg

SEQ ID NO: 2299800 - DNA, 19 bp, Homo sapiens
gcccaccctgggcctcccg

SEQ ID NO: 2299801 - DNA, 20 bp, Homo sapiens
gcccaccctgggcctcccgt

SEQ ID NO: 2299802 - DNA, 18 bp, Homo sapiens
gcccaccgcccctggaca

SEQ ID NO: 2299803 - DNA, 14 bp, Homo sapiens
gcccacctgcccag

SEQ ID NO: 2299804 - DNA, 23 bp, Homo sapiens
gcccacgcagagccccggagcac

SEQ ID NO: 2299805 - DNA, 18 bp, Homo sapiens
gcccagaacgggcctccc

SEQ ID NO: 2299806 - DNA, 19 bp, Homo sapiens
gcccagaacgggcctcccc

SEQ ID NO: 2299807 - DNA, 20 bp, Homo sapiens
gcccagaggggcggggccag

SEQ ID NO: 2299808 - DNA, 16 bp, Homo sapiens
gcccagatgttttaga

SEQ ID NO: 2299809 - DNA, 23 bp, Homo sapiens
gcccagcatatgtgccataaaca

SEQ ID NO: 2299810 - DNA, 19 bp, Homo sapiens
gcccaggacggtctgtgcc

SEQ ID NO: 2299811 - DNA, 20 bp, Homo sapiens
gcccaggacggtctgtgccc

SEQ ID NO: 2299812 - DNA, 21 bp, Homo sapiens
gcccaggacggtctgtgcccg

SEQ ID NO: 2299813 - DNA, 20 bp, Homo sapiens
gcccaggggagcgtgttcct

SEQ ID NO: 2299814 - DNA, 16 bp, Homo sapiens
gcccagttagcccggc

SEQ ID NO: 2299815 - DNA, 21 bp, Homo sapiens
gcccagttagcccggccaagg

SEQ ID NO: 2299816 - DNA, 14 bp, Homo sapiens
gcccatgccctccg

SEQ ID NO: 2299817 - DNA, 21 bp, Homo sapiens
gcccatgccctccgtcctggc

SEQ ID NO: 2299818 - DNA, 22 bp, Homo sapiens
gcccatgccctccgtcctggca

SEQ ID NO: 2299819 - DNA, 23 bp, Homo sapiens
gcccatgccctccgtcctggcag

SEQ ID NO: 2299820 - DNA, 13 bp, Homo sapiens
gcccatggcccca

SEQ ID NO: 2299821 - DNA, 14 bp, Homo sapiens
gcccatggccccag

SEQ ID NO: 2299822 - DNA, 22 bp, Homo sapiens
gcccatggccccagctggctgg

SEQ ID NO: 2299823 - DNA, 17 bp, Homo sapiens
gccccacagtggtcagc

SEQ ID NO: 2299824 - DNA, 22 bp, Homo sapiens
gccccagaaatgccgctgtgtc

SEQ ID NO: 2299825 - DNA, 23 bp, Homo sapiens
gccccagaaatgccgctgtgtcc

SEQ ID NO: 2299826 - DNA, 14 bp, Homo sapiens
gccccagagactgc

SEQ ID NO: 2299827 - DNA, 15 bp, Homo sapiens
gccccagcctcctga

SEQ ID NO: 2299828 - DNA, 17 bp, Homo sapiens
gccccagcctcctgagt

SEQ ID NO: 2299829 - DNA, 20 bp, Homo sapiens
gccccagcgagtctggagac

SEQ ID NO: 2299830 - DNA, 17 bp, Homo sapiens
gccccagctggctgggt

SEQ ID NO: 2299831 - DNA, 19 bp, Homo sapiens
gccccaggcggaggggctt

SEQ ID NO: 2299832 - DNA, 23 bp, Homo sapiens
gccccatccttcccgcagcacca

SEQ ID NO: 2299833 - DNA, 24 bp, Homo sapiens
gccccatccttcccgcagcaccag

SEQ ID NO: 2299834 - DNA, 20 bp, Homo sapiens
gccccatggtcacagacccc

SEQ ID NO: 2299835 - DNA, 22 bp, Homo sapiens
gccccatggtcacagacccctg

SEQ ID NO: 2299836 - DNA, 23 bp, Homo sapiens
gccccatggtcacagacccctgg

SEQ ID NO: 2299837 - DNA, 13 bp, Homo sapiens
gcccccacagatc

SEQ ID NO: 2299838 - DNA, 13 bp, Homo sapiens
gcccccaccctgc

SEQ ID NO: 2299839 - DNA, 14 bp, Homo sapiens
gcccccaccctgct

SEQ ID NO: 2299840 - DNA, 12 bp, Homo sapiens
gccccccagtgt

SEQ ID NO: 2299841 - DNA, 23 bp, Homo sapiens
gcccccggaggcgcccacctgcc

SEQ ID NO: 2299842 - DNA, 12 bp, Homo sapiens
gccccctccccc

SEQ ID NO: 2299843 - DNA, 21 bp, Homo sapiens
gccccctcccccgcagacaga

SEQ ID NO: 2299844 - DNA, 11 bp, Homo sapiens
gccccctcctt

SEQ ID NO: 2299845 - DNA, 20 bp, Homo sapiens
gccccctggcccctcccaca

SEQ ID NO: 2299846 - DNA, 22 bp, Homo sapiens
gccccgaccccacctgaggcag

SEQ ID NO: 2299847 - DNA, 13 bp, Homo sapiens
gccccgcacccct

SEQ ID NO: 2299848 - DNA, 22 bp, Homo sapiens
gccccgccggccgcgcaccgcc

SEQ ID NO: 2299849 - DNA, 14 bp, Homo sapiens
gccccgcgcgtgcc

SEQ ID NO: 2299850 - DNA, 21 bp, Homo sapiens
gcccctccccgcctcctccct

SEQ ID NO: 2299851 - DNA, 16 bp, Homo sapiens
gcccctccgtccccag

SEQ ID NO: 2299852 - DNA, 17 bp, Homo sapiens
gcccctccgtccccagg

SEQ ID NO: 2299853 - DNA, 19 bp, Homo sapiens
gcccctccgtccccagggt

SEQ ID NO: 2299854 - DNA, 20 bp, Homo sapiens
gcccctccgtccccagggtg

SEQ ID NO: 2299855 - DNA, 11 bp, Homo sapiens
gcccctcctcg

SEQ ID NO: 2299856 - DNA, 12 bp, Homo sapiens
gcccctcctcgg

SEQ ID NO: 2299857 - DNA, 22 bp, Homo sapiens
gcccctcctcgggcgcctgcgc

SEQ ID NO: 2299858 - DNA, 13 bp, Homo sapiens
gcccctcctctcc

SEQ ID NO: 2299859 - DNA, 14 bp, Homo sapiens
gcccctgctactgc

SEQ ID NO: 2299860 - DNA, 23 bp, Homo sapiens
gcccctgctgctcctcggccaga

SEQ ID NO: 2299861 - DNA, 17 bp, Homo sapiens
gcccctggacaggcttc

SEQ ID NO: 2299862 - DNA, 15 bp, Homo sapiens
gccccttgcttctaa

SEQ ID NO: 2299863 - DNA, 21 bp, Homo sapiens
gcccgagcgcgtgccttcccc

SEQ ID NO: 2299864 - DNA, 19 bp, Homo sapiens
gcccgcccaccccgctgcc

SEQ ID NO: 2299865 - DNA, 23 bp, Homo sapiens
gcccgcccaccccgctgcctggc

SEQ ID NO: 2299866 - DNA, 13 bp, Homo sapiens
gcccgccccaggc

SEQ ID NO: 2299867 - DNA, 21 bp, Homo sapiens
gcccgccccaggccccagcag

SEQ ID NO: 2299868 - DNA, 21 bp, Homo sapiens
gcccgcccccgccctcgctcc

SEQ ID NO: 2299869 - DNA, 15 bp, Homo sapiens
gcccgccctcctctg

SEQ ID NO: 2299870 - DNA, 18 bp, Homo sapiens
gcccgccctcctctgccc

SEQ ID NO: 2299871 - DNA, 20 bp, Homo sapiens
gcccgccctcctctgccccc

SEQ ID NO: 2299872 - DNA, 17 bp, Homo sapiens
gcccgctcaacctctca

SEQ ID NO: 2299873 - DNA, 18 bp, Homo sapiens
gcccggactgaccgaagg

SEQ ID NO: 2299874 - DNA, 20 bp, Homo sapiens
gcccggactgaccgaaggga

SEQ ID NO: 2299875 - DNA, 18 bp, Homo sapiens
gcccggcagtgcaccccc

SEQ ID NO: 2299876 - DNA, 22 bp, Homo sapiens
gcccggccaaggacactgatgg

SEQ ID NO: 2299877 - DNA, 20 bp, Homo sapiens
gcccggcccacgcagagccc

SEQ ID NO: 2299878 - DNA, 14 bp, Homo sapiens
gcccggtgtgagga

SEQ ID NO: 2299879 - DNA, 16 bp, Homo sapiens
gcccgtgcgcagccgc

SEQ ID NO: 2299880 - DNA, 15 bp, Homo sapiens
gccctacgatgggat

SEQ ID NO: 2299881 - DNA, 17 bp, Homo sapiens
gcctgcccgcccgccgg

SEQ ID NO: 2299882 - DNA, 17 bp, Homo sapiens
gcctgcgccccccagtg

SEQ ID NO: 2299883 - DNA, 22 bp, Homo sapiens
gcctgcgccccccagtggactc

SEQ ID NO: 2299884 - DNA, 14 bp, Homo sapiens
gcctgcgctcctct

SEQ ID NO: 2299885 - DNA, 15 bp, Homo sapiens
gcctggcggcagggg

SEQ ID NO: 2299886 - DNA, 13 bp, Homo sapiens
gcctggcgggcag

SEQ ID NO: 2299887 - DNA, 14 bp, Homo sapiens
gcctggcgggcagc

SEQ ID NO: 2299888 - DNA, 20 bp, Homo sapiens
gcctggcgggcagcccctgc

SEQ ID NO: 2299889 - DNA, 13 bp, Homo sapiens
gcctggggctgcc

SEQ ID NO: 2299890 - DNA, 20 bp, Homo sapiens
gcctgtatttccaacaaact

SEQ ID NO: 2299891 - DNA, 14 bp, Homo sapiens
gcctgtgagtgaca

SEQ ID NO: 2299892 - DNA, 16 bp, Homo sapiens
gcctgttccctgagga

SEQ ID NO: 2299893 - DNA, 17 bp, Homo sapiens
gcctgttccctgaggac

SEQ ID NO: 2299894 - DNA, 19 bp, Homo sapiens
gcctgttccctgaggacct

SEQ ID NO: 2299895 - DNA, 15 bp, Homo sapiens
gcctgtttggtgagg

SEQ ID NO: 2299896 - DNA, 14 bp, Homo sapiens
gccttatggaacac

SEQ ID NO: 2299897 - DNA, 18 bp, Homo sapiens
gccttatggaacactctg

SEQ ID NO: 2299898 - DNA, 20 bp, Homo sapiens
gccttatggaacactctgag

SEQ ID NO: 2299899 - DNA, 21 bp, Homo sapiens
gccttatggaacactctgaga

SEQ ID NO: 2299900 - DNA, 22 bp, Homo sapiens
gccttatggaacactctgagac

SEQ ID NO: 2299901 - DNA, 23 bp, Homo sapiens
gccttatggaacactctgagact

SEQ ID NO: 2299902 - DNA, 20 bp, Homo sapiens
gccttcaaaaatgtgctgcc

SEQ ID NO: 2299903 - DNA, 17 bp, Homo sapiens
gccttcagaaaagacac

SEQ ID NO: 2299904 - DNA, 22 bp, Homo sapiens
gccttccccgtgcggcccgtgc

SEQ ID NO: 2299905 - DNA, 20 bp, Homo sapiens
gccttctacctgcaggactc

SEQ ID NO: 2299906 - DNA, 20 bp, Homo sapiens
gccttgaactgtggccacct

SEQ ID NO: 2299907 - DNA, 19 bp, Homo sapiens
gcctttgcgctctgggttt

SEQ ID NO: 2299908 - DNA, 18 bp, Homo sapiens
gcgaaagagcaaagtcat

SEQ ID NO: 2299909 - DNA, 17 bp, Homo sapiens
gcgaagacccggccagg

SEQ ID NO: 2299910 - DNA, 20 bp, Homo sapiens
gcgaagtccgaggcctggct

SEQ ID NO: 2299911 - DNA, 13 bp, Homo sapiens
gcgacaatgcaaa

SEQ ID NO: 2299912 - DNA, 20 bp, Homo sapiens
gcgacaatgcaaaccatcat

SEQ ID NO: 2299913 - DNA, 23 bp, Homo sapiens
gcgacaatgcaaaccatcattga

SEQ ID NO: 2299914 - DNA, 17 bp, Homo sapiens
gcgacttcacaaaatgc

SEQ ID NO: 2299915 - DNA, 14 bp, Homo sapiens
gcgagaagggcgca

SEQ ID NO: 2299916 - DNA, 17 bp, Homo sapiens
gcgatgatgggctggag

SEQ ID NO: 2299917 - DNA, 14 bp, Homo sapiens
gcgcaccgccatgc

SEQ ID NO: 2299918 - DNA, 22 bp, Homo sapiens
gcgcaccgcccaacccccacct

SEQ ID NO: 2299919 - DNA, 16 bp, Homo sapiens
gcgcagccgcgctctg

SEQ ID NO: 2299920 - DNA, 20 bp, Homo sapiens
gcgcagccgcgctctgcccc

SEQ ID NO: 2299921 - DNA, 21 bp, Homo sapiens
gcgcagccgcgctctgcccct

SEQ ID NO: 2299922 - DNA, 11 bp, Homo sapiens
gcgcaggccct

SEQ ID NO: 2299923 - DNA, 13 bp, Homo sapiens
gcgccacccgccc

SEQ ID NO: 2299924 - DNA, 14 bp, Homo sapiens
gcgcccacctgccc

SEQ ID NO: 2299925 - DNA, 20 bp, Homo sapiens
gcgccccccagtggactcgc

SEQ ID NO: 2299926 - DNA, 13 bp, Homo sapiens
gcgccggcgcccc

SEQ ID NO: 2299927 - DNA, 16 bp, Homo sapiens
gcgccggcgccccgga

SEQ ID NO: 2299928 - DNA, 14 bp, Homo sapiens
gcgcctcccgccgc

SEQ ID NO: 2299929 - DNA, 15 bp, Homo sapiens
gcgcctgcgctcctc

SEQ ID NO: 2299930 - DNA, 17 bp, Homo sapiens
gcgcctgcgctcctctg

SEQ ID NO: 2299931 - DNA, 22 bp, Homo sapiens
gcgcctgcgctcctctgcagcc

SEQ ID NO: 2299932 - DNA, 18 bp, Homo sapiens
gcgccttctacctgcagg

SEQ ID NO: 2299933 - DNA, 14 bp, Homo sapiens
gcgcgcaccgccca

SEQ ID NO: 2299934 - DNA, 15 bp, Homo sapiens
gcgcgtgcccccagc

SEQ ID NO: 2299935 - DNA, 23 bp, Homo sapiens
gcgctccggcagaggcagggccc

SEQ ID NO: 2299936 - DNA, 22 bp, Homo sapiens
gcgctccgggacgtggcacctc

SEQ ID NO: 2299937 - DNA, 14 bp, Homo sapiens
gcgctcctctgcag

SEQ ID NO: 2299938 - DNA, 22 bp, Homo sapiens
gcgctcctctgcagcctgagct

SEQ ID NO: 2299939 - DNA, 23 bp, Homo sapiens
gcgctcgaagttgatctccccag

SEQ ID NO: 2299940 - DNA, 13 bp, Homo sapiens
gcgctctgcccct

SEQ ID NO: 2299941 - DNA, 14 bp, Homo sapiens
gcgctctgcccctc

SEQ ID NO: 2299942 - DNA, 20 bp, Homo sapiens
gcgctctgcccctccgtccc

SEQ ID NO: 2299943 - DNA, 20 bp, Homo sapiens
gcgctgcccccacagatcca

SEQ ID NO: 2299944 - DNA, 21 bp, Homo sapiens
gcgctgcccccacagatccat

SEQ ID NO: 2299945 - DNA, 23 bp, Homo sapiens
gcgctgcccccacagatccatcc

SEQ ID NO: 2299946 - DNA, 21 bp, Homo sapiens
gcggaccggagcggctgagga

SEQ ID NO: 2299947 - DNA, 23 bp, Homo sapiens
gcggaggggcttggagcagagac

SEQ ID NO: 2299948 - DNA, 17 bp, Homo sapiens
gcggaggttgcggtgag

SEQ ID NO: 2299949 - DNA, 17 bp, Homo sapiens
gcggcccggcccacgca

SEQ ID NO: 2299950 - DNA, 16 bp, Homo sapiens
gcggcccgtgcgcagc

SEQ ID NO: 2299951 - DNA, 17 bp, Homo sapiens
gcggcccgtgcgcagcc

SEQ ID NO: 2299952 - DNA, 20 bp, Homo sapiens
gcggcccgtgcgcagccgcg

SEQ ID NO: 2299953 - DNA, 22 bp, Homo sapiens
gcggcccgtgcgcagccgcgct

SEQ ID NO: 2299954 - DNA, 13 bp, Homo sapiens
gcggccggcctgg

SEQ ID NO: 2299955 - DNA, 14 bp, Homo sapiens
gcggccggcctggg

SEQ ID NO: 2299956 - DNA, 23 bp, Homo sapiens
gcggccggcctggggccgggctg

SEQ ID NO: 2299957 - DNA, 13 bp, Homo sapiens
gcggctctgggaa

SEQ ID NO: 2299958 - DNA, 14 bp, Homo sapiens
gcggctgaggacgg

SEQ ID NO: 2299959 - DNA, 19 bp, Homo sapiens
gcgggaagggtgggccctg

SEQ ID NO: 2299960 - DNA, 22 bp, Homo sapiens
gcgggaagggtgggccctggag

SEQ ID NO: 2299961 - DNA, 15 bp, Homo sapiens
gcgggacaggacttg

SEQ ID NO: 2299962 - DNA, 19 bp, Homo sapiens
gcgggcagcccctgctgga

SEQ ID NO: 2299963 - DNA, 23 bp, Homo sapiens
gcgggcctgtttggtgaggacct

SEQ ID NO: 2299964 - DNA, 17 bp, Homo sapiens
gcgggggctaactggcc

SEQ ID NO: 2299965 - DNA, 20 bp, Homo sapiens
gcgtgaccggcccgccacct

SEQ ID NO: 2299966 - DNA, 19 bp, Homo sapiens
gcgtgcagttcctgctgcc

SEQ ID NO: 2299967 - DNA, 12 bp, Homo sapiens
gcgtggcctggg

SEQ ID NO: 2299968 - DNA, 20 bp, Homo sapiens
gcgtggtggacatgcacagc

SEQ ID NO: 2299969 - DNA, 16 bp, Homo sapiens
gcgttaagggcagagt

SEQ ID NO: 2299970 - DNA, 12 bp, Homo sapiens
gcgttttagagt

SEQ ID NO: 2299971 - DNA, 13 bp, Homo sapiens
gctaaatgcaaac

SEQ ID NO: 2299972 - DNA, 14 bp, Homo sapiens
gctaacatggaagt

SEQ ID NO: 2299973 - DNA, 19 bp, Homo sapiens
gctaacctcaatttatgtt

SEQ ID NO: 2299974 - DNA, 17 bp, Homo sapiens
gctaactggccccaggc

SEQ ID NO: 2299975 - DNA, 21 bp, Homo sapiens
gctaagtccagctctcccctg

SEQ ID NO: 2299976 - DNA, 21 bp, Homo sapiens
gctaagtggaagacagagatg

SEQ ID NO: 2299977 - DNA, 20 bp, Homo sapiens
gctaataccaactatttcaa

SEQ ID NO: 2299978 - DNA, 14 bp, Homo sapiens
gctaatctcttcta

SEQ ID NO: 2299979 - DNA, 20 bp, Homo sapiens
gctaatgtaatcatttatct

SEQ ID NO: 2299980 - DNA, 15 bp, Homo sapiens
gctacagcaaataaa

SEQ ID NO: 2299981 - DNA, 17 bp, Homo sapiens
gctacagtagctgtggg

SEQ ID NO: 2299982 - DNA, 14 bp, Homo sapiens
gctactcttcagaa

SEQ ID NO: 2299983 - DNA, 20 bp, Homo sapiens
gctactgccaacctcgctcc

SEQ ID NO: 2299984 - DNA, 21 bp, Homo sapiens
gctactgtgttacatgttgta

SEQ ID NO: 2299985 - DNA, 22 bp, Homo sapiens
gctaggataaaccaatcatctt

SEQ ID NO: 2299986 - DNA, 14 bp, Homo sapiens
gctatggaaataca

SEQ ID NO: 2299987 - DNA, 23 bp, Homo sapiens
gctatggaaatacatttagaacc

SEQ ID NO: 2299988 - DNA, 17 bp, Homo sapiens
gctattataatatagaa

SEQ ID NO: 2299989 - DNA, 20 bp, Homo sapiens
gctattataatatagaaaga

SEQ ID NO: 2299990 - DNA, 21 bp, Homo sapiens
gctattgtttataggaaataa

SEQ ID NO: 2299991 - DNA, 22 bp, Homo sapiens
gctattgtttataggaaataaa

SEQ ID NO: 2299992 - DNA, 16 bp, Homo sapiens
gctcaacacatgagaa

SEQ ID NO: 2299993 - DNA, 13 bp, Homo sapiens
gctcaacctctca

SEQ ID NO: 2299994 - DNA, 23 bp, Homo sapiens
gctcacaccgcaccgggctggcc

SEQ ID NO: 2299995 - DNA, 18 bp, Homo sapiens
gctcaccaagctgttcca

SEQ ID NO: 2299996 - DNA, 15 bp, Homo sapiens
gctcagagtccaatg

SEQ ID NO: 2299997 - DNA, 16 bp, Homo sapiens
gctcaggctccccaag

SEQ ID NO: 2299998 - DNA, 16 bp, Homo sapiens
gctcagtcccacagcc

SEQ ID NO: 2299999 - DNA, 18 bp, Homo sapiens
gctcagtcccacagcccc

SEQ ID NO: 2300000 - DNA, 19 bp, Homo sapiens
gctcagtcccacagcccct

SEQ ID NO: 2300001 - DNA, 22 bp, Homo sapiens
gctcatcacccggatagaggac

SEQ ID NO: 2300002 - DNA, 23 bp, Homo sapiens
gctcatcacccggatagaggaca

SEQ ID NO: 2300003 - DNA, 19 bp, Homo sapiens
gctccaccctcccctcttc

SEQ ID NO: 2300004 - DNA, 19 bp, Homo sapiens
gctccagtgttttcttgtg

SEQ ID NO: 2300005 - DNA, 13 bp, Homo sapiens
gctcccaggacgc

SEQ ID NO: 2300006 - DNA, 14 bp, Homo sapiens
gctcccaggacgca

SEQ ID NO: 2300007 - DNA, 12 bp, Homo sapiens
gctccggcagag

SEQ ID NO: 2300008 - DNA, 16 bp, Homo sapiens
gctccggcagaggcag

SEQ ID NO: 2300009 - DNA, 22 bp, Homo sapiens
gctccggcagaggcagggccct

SEQ ID NO: 2300010 - DNA, 22 bp, Homo sapiens
gctccgggtgcgtgaccggccc

SEQ ID NO: 2300011 - DNA, 23 bp, Homo sapiens
gctcctcggccagagctcccagg

SEQ ID NO: 2300012 - DNA, 11 bp, Homo sapiens
gctttctattg

SEQ ID NO: 2300013 - DNA, 21 bp, Homo sapiens
gctttctattggcatggattt

SEQ ID NO: 2300014 - DNA, 11 bp, Homo sapiens
gctttctcatg

SEQ ID NO: 2300015 - DNA, 19 bp, Homo sapiens
gctttgttttggctgctct

SEQ ID NO: 2300016 - DNA, 16 bp, Homo sapiens
ggaaaaaaatgcgtat

SEQ ID NO: 2300017 - DNA, 15 bp, Homo sapiens
ggaaaaatgtatcca

SEQ ID NO: 2300018 - DNA, 16 bp, Homo sapiens
ggaaacagaggaccag

SEQ ID NO: 2300019 - DNA, 14 bp, Homo sapiens
ggaaagttctatta

SEQ ID NO: 2300020 - DNA, 20 bp, Homo sapiens
ggaaagttctattatctggg

SEQ ID NO: 2300021 - DNA, 13 bp, Homo sapiens
ggaaatacattta

SEQ ID NO: 2300022 - DNA, 14 bp, Homo sapiens
ggaaatacatttag

SEQ ID NO: 2300023 - DNA, 15 bp, Homo sapiens
ggaaatacatttaga

SEQ ID NO: 2300024 - DNA, 16 bp, Homo sapiens
ggaaatatgcaacctg

SEQ ID NO: 2300025 - DNA, 22 bp, Homo sapiens
ggaaatcaatttaaaggaaagt

SEQ ID NO: 2300026 - DNA, 14 bp, Homo sapiens
ggaaatcaccgaaa

SEQ ID NO: 2300027 - DNA, 21 bp, Homo sapiens
ggaaatcaccgaaaacgtggc

SEQ ID NO: 2300028 - DNA, 16 bp, Homo sapiens
ggaacactctgagact

SEQ ID NO: 2300029 - DNA, 20 bp, Homo sapiens
ggaacagagtatatatgtac

SEQ ID NO: 2300030 - DNA, 18 bp, Homo sapiens
ggaacctcaaactgggta

SEQ ID NO: 2300031 - DNA, 13 bp, Homo sapiens
ggaagagagaggc

SEQ ID NO: 2300032 - DNA, 18 bp, Homo sapiens
ggaagaggggcgctgccc

SEQ ID NO: 2300033 - DNA, 13 bp, Homo sapiens
ggaagcccacccg

SEQ ID NO: 2300034 - DNA, 21 bp, Homo sapiens
ggaagcccacccgccccagag

SEQ ID NO: 2300035 - DNA, 15 bp, Homo sapiens
ggaagcctcctgctg

SEQ ID NO: 2300036 - DNA, 17 bp, Homo sapiens
ggaagcctcctgctgag

SEQ ID NO: 2300037 - DNA, 19 bp, Homo sapiens
ggaagcctcctgctgagtg

SEQ ID NO: 2300038 - DNA, 16 bp, Homo sapiens
ggaagctggcaggaga

SEQ ID NO: 2300039 - DNA, 12 bp, Homo sapiens
ggaaggagcagt

SEQ ID NO: 2300040 - DNA, 13 bp, Homo sapiens
ggaagggcaggag

SEQ ID NO: 2300041 - DNA, 14 bp, Homo sapiens
ggaagggcaggagc

SEQ ID NO: 2300042 - DNA, 13 bp, Homo sapiens
ggaaggggacagg

SEQ ID NO: 2300043 - DNA, 15 bp, Homo sapiens
ggaaggggacaggat

SEQ ID NO: 2300044 - DNA, 16 bp, Homo sapiens
ggaagtacataaagta

SEQ ID NO: 2300045 - DNA, 16 bp, Homo sapiens
ggaagtactggagaaa

SEQ ID NO: 2300046 - DNA, 18 bp, Homo sapiens
ggaagtccctgagaagcc

SEQ ID NO: 2300047 - DNA, 16 bp, Homo sapiens
ggaataggtttcaaca

SEQ ID NO: 2300048 - DNA, 23 bp, Homo sapiens
ggaatatacatgtaaaaatgttt

SEQ ID NO: 2300049 - DNA, 15 bp, Homo sapiens
ggaattgttgaatgt

SEQ ID NO: 2300050 - DNA, 15 bp, Homo sapiens
ggaatttatttatgt

SEQ ID NO: 2300051 - DNA, 17 bp, Homo sapiens
ggacaaggggtggaagg

SEQ ID NO: 2300052 - DNA, 18 bp, Homo sapiens
ggacaaggggtggaaggg

SEQ ID NO: 2300053 - DNA, 13 bp, Homo sapiens
ggacacggcctct

SEQ ID NO: 2300054 - DNA, 18 bp, Homo sapiens
ggacacggcctctgggga

SEQ ID NO: 2300055 - DNA, 21 bp, Homo sapiens
ggacactgatgggtcctgctg

SEQ ID NO: 2300056 - DNA, 11 bp, Homo sapiens
ggacagcagct

SEQ ID NO: 2300057 - DNA, 18 bp, Homo sapiens
ggacagcggcccggccca

SEQ ID NO: 2300058 - DNA, 19 bp, Homo sapiens
ggacagcggcccggcccac

SEQ ID NO: 2300059 - DNA, 22 bp, Homo sapiens
ggacagcggcccggcccacgca

SEQ ID NO: 2300060 - DNA, 21 bp, Homo sapiens
ggacaggaacacccagcccca

SEQ ID NO: 2300061 - DNA, 19 bp, Homo sapiens
ggacaggattgtctgctgc

SEQ ID NO: 2300062 - DNA, 22 bp, Homo sapiens
ggacaggccagtagggggaggg

SEQ ID NO: 2300063 - DNA, 19 bp, Homo sapiens
ggacaggcttcgtctcaga

SEQ ID NO: 2300064 - DNA, 15 bp, Homo sapiens
ggaccaactgctttg

SEQ ID NO: 2300065 - DNA, 21 bp, Homo sapiens
ggaccactgtttcttgcttgt

SEQ ID NO: 2300066 - DNA, 22 bp, Homo sapiens
ggacccactccgactccccctc

SEQ ID NO: 2300067 - DNA, 15 bp, Homo sapiens
ggaccccattctggg

SEQ ID NO: 2300068 - DNA, 23 bp, Homo sapiens
ggaccctgagggtttccaccttg

SEQ ID NO: 2300069 - DNA, 13 bp, Homo sapiens
ggaccctgtgtgg

SEQ ID NO: 2300070 - DNA, 14 bp, Homo sapiens
ggaccggagcggct

SEQ ID NO: 2300071 - DNA, 19 bp, Homo sapiens
ggaccggagcggctgagga

SEQ ID NO: 2300072 - DNA, 19 bp, Homo sapiens
ggacctccacctgggagat

SEQ ID NO: 2300073 - DNA, 23 bp, Homo sapiens
ggacctggggtcccccctccctg

SEQ ID NO: 2300074 - DNA, 19 bp, Homo sapiens
ggacgcagggagaccctgg

SEQ ID NO: 2300075 - DNA, 13 bp, Homo sapiens
ggacgggacagcg

SEQ ID NO: 2300076 - DNA, 15 bp, Homo sapiens
ggacggggcagagct

SEQ ID NO: 2300077 - DNA, 15 bp, Homo sapiens
ggacggtctgtgccc

SEQ ID NO: 2300078 - DNA, 19 bp, Homo sapiens
ggactcaggaagcaggggg

SEQ ID NO: 2300079 - DNA, 19 bp, Homo sapiens
ggactcagttcttggcctg

SEQ ID NO: 2300080 - DNA, 15 bp, Homo sapiens
ggactccaggggctg

SEQ ID NO: 2300081 - DNA, 13 bp, Homo sapiens
ggactctccaggc

SEQ ID NO: 2300082 - DNA, 18 bp, Homo sapiens
ggactctgccttccaggc

SEQ ID NO: 2300083 - DNA, 16 bp, Homo sapiens
ggactctgtggggcca

SEQ ID NO: 2300084 - DNA, 16 bp, Homo sapiens
ggactgaccgaaggga

SEQ ID NO: 2300085 - DNA, 12 bp, Homo sapiens
ggactgctcagg

SEQ ID NO: 2300086 - DNA, 23 bp, Homo sapiens
ggactgctcaggctccccaagac

SEQ ID NO: 2300087 - DNA, 19 bp, Homo sapiens
ggactgtcttcaaccctgc

SEQ ID NO: 2300088 - DNA, 12 bp, Homo sapiens
ggactgtggcct

SEQ ID NO: 2300089 - DNA, 15 bp, Homo sapiens
ggagaattccagttg

SEQ ID NO: 2300090 - DNA, 17 bp, Homo sapiens
ggagaccaggactctgc

SEQ ID NO: 2300091 - DNA, 21 bp, Homo sapiens
ggagaccaggactctgccttc

SEQ ID NO: 2300092 - DNA, 17 bp, Homo sapiens
ggagactatgtgtcatg

SEQ ID NO: 2300093 - DNA, 15 bp, Homo sapiens
ggagactcaggccca

SEQ ID NO: 2300094 - DNA, 16 bp, Homo sapiens
ggagagcgccacccgc

SEQ ID NO: 2300095 - DNA, 14 bp, Homo sapiens
ggagaggcgagagg

SEQ ID NO: 2300096 - DNA, 21 bp, Homo sapiens
ggagaggttacccgagaagca

SEQ ID NO: 2300097 - DNA, 12 bp, Homo sapiens
ggagagtgaggt

SEQ ID NO: 2300098 - DNA, 23 bp, Homo sapiens
ggagatgagttttaggaccagca

SEQ ID NO: 2300099 - DNA, 18 bp, Homo sapiens
ggagcaaggctgccctgt

SEQ ID NO: 2300100 - DNA, 17 bp, Homo sapiens
ggagcacccccagcctc

SEQ ID NO: 2300101 - DNA, 19 bp, Homo sapiens
ggagcagagacggcagccc

SEQ ID NO: 2300102 - DNA, 20 bp, Homo sapiens
ggagcagagacggcagcccc

SEQ ID NO: 2300103 - DNA, 21 bp, Homo sapiens
ggagcagagacggcagcccca

SEQ ID NO: 2300104 - DNA, 23 bp, Homo sapiens
ggagcagagacggcagccccatc

SEQ ID NO: 2300105 - DNA, 18 bp, Homo sapiens
ggagcagcgtgcaggagc

SEQ ID NO: 2300106 - DNA, 14 bp, Homo sapiens
ggagccatgctctt

SEQ ID NO: 2300107 - DNA, 18 bp, Homo sapiens
ggagcccgcctgcgcccc

SEQ ID NO: 2300108 - DNA, 20 bp, Homo sapiens
ggagcccgcctgcgcccccc

SEQ ID NO: 2300109 - DNA, 19 bp, Homo sapiens
ggagcctgcgtggcctggg

SEQ ID NO: 2300110 - DNA, 21 bp, Homo sapiens
ggagcctgcgtggcctggggc

SEQ ID NO: 2300111 - DNA, 12 bp, Homo sapiens
ggagcctgggat

SEQ ID NO: 2300112 - DNA, 23 bp, Homo sapiens
ggagcggctgaggacggggcaga

SEQ ID NO: 2300113 - DNA, 21 bp, Homo sapiens
ggagcgggggctaactggccc

SEQ ID NO: 2300114 - DNA, 13 bp, Homo sapiens
ggagctagaaaat

SEQ ID NO: 2300115 - DNA, 22 bp, Homo sapiens
ggagctagaaaatgaactgtat

SEQ ID NO: 2300116 - DNA, 14 bp, Homo sapiens
ggagctcacaccgc

SEQ ID NO: 2300117 - DNA, 16 bp, Homo sapiens
ggagctcacaccgcac

SEQ ID NO: 2300118 - DNA, 13 bp, Homo sapiens
ggagctgcttcca

SEQ ID NO: 2300119 - DNA, 19 bp, Homo sapiens
ggagctgggaaggtcccga

SEQ ID NO: 2300120 - DNA, 15 bp, Homo sapiens
ggaggagacagtcag

SEQ ID NO: 2300121 - DNA, 23 bp, Homo sapiens
ggaggagacagtcaggaagcctc

SEQ ID NO: 2300122 - DNA, 15 bp, Homo sapiens
ggaggagactcaggc

SEQ ID NO: 2300123 - DNA, 22 bp, Homo sapiens
ggaggagactcaggcccacatt

SEQ ID NO: 2300124 - DNA, 15 bp, Homo sapiens
ggaggagcaccccca

SEQ ID NO: 2300125 - DNA, 18 bp, Homo sapiens
ggaggcacaaagggcagg

SEQ ID NO: 2300126 - DNA, 21 bp, Homo sapiens
ggaggcacaaagggcaggcct

SEQ ID NO: 2300127 - DNA, 13 bp, Homo sapiens
ggaggctggacca

SEQ ID NO: 2300128 - DNA, 19 bp, Homo sapiens
ggaggctggaccaactgct

SEQ ID NO: 2300129 - DNA, 22 bp, Homo sapiens
ggaggctggaccaactgctttg

SEQ ID NO: 2300130 - DNA, 17 bp, Homo sapiens
ggaggcttccagctcag

SEQ ID NO: 2300131 - DNA, 18 bp, Homo sapiens
ggaggcttccagctcagt

SEQ ID NO: 2300132 - DNA, 14 bp, Homo sapiens
ggagggcctctgga

SEQ ID NO: 2300133 - DNA, 19 bp, Homo sapiens
ggaggggcccatgtgggct

SEQ ID NO: 2300134 - DNA, 12 bp, Homo sapiens
ggaggggcggga

SEQ ID NO: 2300135 - DNA, 11 bp, Homo sapiens
ggagggggcag

SEQ ID NO: 2300136 - DNA, 18 bp, Homo sapiens
ggagggtttgggcagagc

SEQ ID NO: 2300137 - DNA, 20 bp, Homo sapiens
ggaggtcctttggacagctg

SEQ ID NO: 2300138 - DNA, 22 bp, Homo sapiens
ggaggtggggagggcctctgga

SEQ ID NO: 2300139 - DNA, 15 bp, Homo sapiens
ggaggtgtgaatgca

SEQ ID NO: 2300140 - DNA, 16 bp, Homo sapiens
ggaggtgtgaatgcac

SEQ ID NO: 2300141 - DNA, 18 bp, Homo sapiens
ggagtccagacctgggcc

SEQ ID NO: 2300142 - DNA, 22 bp, Homo sapiens
ggagtccagacctgggccctgg

SEQ ID NO: 2300143 - DNA, 18 bp, Homo sapiens
ggagtccctcctccccca

SEQ ID NO: 2300144 - DNA, 16 bp, Homo sapiens
ggagtggctgaccagg

SEQ ID NO: 2300145 - DNA, 21 bp, Homo sapiens
ggagtggctgaccaggccctg

SEQ ID NO: 2300146 - DNA, 18 bp, Homo sapiens
ggagtgggtgggacacag

SEQ ID NO: 2300147 - DNA, 17 bp, Homo sapiens
ggagttgtctgtcctgg

SEQ ID NO: 2300148 - DNA, 20 bp, Homo sapiens
ggagttgtctgtcctggtca

SEQ ID NO: 2300149 - DNA, 15 bp, Homo sapiens
ggataattatatcag

SEQ ID NO: 2300150 - DNA, 22 bp, Homo sapiens
ggatcctgagagggagagactg

SEQ ID NO: 2300151 - DNA, 14 bp, Homo sapiens
ggatcctgagccag

SEQ ID NO: 2300152 - DNA, 18 bp, Homo sapiens
ggatcctgagccagattt

SEQ ID NO: 2300153 - DNA, 23 bp, Homo sapiens
ggatcctgagccagatttcactc

SEQ ID NO: 2300154 - DNA, 22 bp, Homo sapiens
ggatctctgagaccacagaggc

SEQ ID NO: 2300155 - DNA, 14 bp, Homo sapiens
ggatgaaaaaataa

SEQ ID NO: 2300156 - DNA, 18 bp, Homo sapiens
ggatgaactcaatgcatg

SEQ ID NO: 2300157 - DNA, 16 bp, Homo sapiens
ggatgggcacaggctg

SEQ ID NO: 2300158 - DNA, 14 bp, Homo sapiens
ggatgggggctcct

SEQ ID NO: 2300159 - DNA, 16 bp, Homo sapiens
ggatgggggctcctgg

SEQ ID NO: 2300160 - DNA, 20 bp, Homo sapiens
ggatggggttgggctctgcg

SEQ ID NO: 2300161 - DNA, 12 bp, Homo sapiens
ggatgtgctttc

SEQ ID NO: 2300162 - DNA, 21 bp, Homo sapiens
ggattcagtcataaagaggta

SEQ ID NO: 2300163 - DNA, 18 bp, Homo sapiens
ggattctcctttttaccc

SEQ ID NO: 2300164 - DNA, 19 bp, Homo sapiens
ggattcttttttcaatgta

SEQ ID NO: 2300165 - DNA, 14 bp, Homo sapiens
ggatttgaaaacac

SEQ ID NO: 2300166 - DNA, 16 bp, Homo sapiens
ggatttggctcgctgt

SEQ ID NO: 2300167 - DNA, 18 bp, Homo sapiens
ggatttggctcgctgtgg

SEQ ID NO: 2300168 - DNA, 23 bp, Homo sapiens
ggcaacactcactgcctgcagct

SEQ ID NO: 2300169 - DNA, 13 bp, Homo sapiens
ggcaacaggcggg

SEQ ID NO: 2300170 - DNA, 16 bp, Homo sapiens
ggcaaggctgtcaatt

SEQ ID NO: 2300171 - DNA, 16 bp, Homo sapiens
ggcacaaagggcaggc

SEQ ID NO: 2300172 - DNA, 15 bp, Homo sapiens
ggcacaggctgcccc

SEQ ID NO: 2300173 - DNA, 22 bp, Homo sapiens
ggcacaggctgccccacccctc

SEQ ID NO: 2300174 - DNA, 16 bp, Homo sapiens
ggcaccgcccacccac

SEQ ID NO: 2300175 - DNA, 22 bp, Homo sapiens
ggcaccgcccacccacaccccg

SEQ ID NO: 2300176 - DNA, 15 bp, Homo sapiens
ggcaccgcctgcccc

SEQ ID NO: 2300177 - DNA, 20 bp, Homo sapiens
ggcaccgcctgcccccagcg

SEQ ID NO: 2300178 - DNA, 16 bp, Homo sapiens
ggcacgggagagcgcc

SEQ ID NO: 2300179 - DNA, 19 bp, Homo sapiens
ggcacgggagagcgccacc

SEQ ID NO: 2300180 - DNA, 20 bp, Homo sapiens
ggcacggtggctcacacctg

SEQ ID NO: 2300181 - DNA, 23 bp, Homo sapiens
ggcactaaccccattcatgagag

SEQ ID NO: 2300182 - DNA, 22 bp, Homo sapiens
ggcagacgaggcctttgcttta

SEQ ID NO: 2300183 - DNA, 23 bp, Homo sapiens
ggcagagcagtctaaacagagtc

SEQ ID NO: 2300184 - DNA, 14 bp, Homo sapiens
ggcagagctcagca

SEQ ID NO: 2300185 - DNA, 20 bp, Homo sapiens
ggcagagctcagcacagcct

SEQ ID NO: 2300186 - DNA, 14 bp, Homo sapiens
ggcagaggcagggc

SEQ ID NO: 2300187 - DNA, 16 bp, Homo sapiens
ggcagaggcagggccc

SEQ ID NO: 2300188 - DNA, 11 bp, Homo sapiens
ggcagccccat

SEQ ID NO: 2300189 - DNA, 15 bp, Homo sapiens
ggcagccccatcctt

SEQ ID NO: 2300190 - DNA, 18 bp, Homo sapiens
ggcagcccctgctggacc

SEQ ID NO: 2300191 - DNA, 19 bp, Homo sapiens
ggcagcccctgctggacca

SEQ ID NO: 2300192 - DNA, 21 bp, Homo sapiens
ggcagcccctgctggaccaag

SEQ ID NO: 2300193 - DNA, 15 bp, Homo sapiens
ggcagcgcctcccgc

SEQ ID NO: 2300194 - DNA, 14 bp, Homo sapiens
ggcaggaagtccct

SEQ ID NO: 2300195 - DNA, 18 bp, Homo sapiens
ggcaggagacactggtct

SEQ ID NO: 2300196 - DNA, 12 bp, Homo sapiens
ggcaggagctca

SEQ ID NO: 2300197 - DNA, 19 bp, Homo sapiens
ggcaggagtgggctctgag

SEQ ID NO: 2300198 - DNA, 19 bp, Homo sapiens
ggcaggattctgcagctgc

SEQ ID NO: 2300199 - DNA, 21 bp, Homo sapiens
ggcaggattctgcagctgctt

SEQ ID NO: 2300200 - DNA, 22 bp, Homo sapiens
ggcaggcagagctcagcacagc

SEQ ID NO: 2300201 - DNA, 11 bp, Homo sapiens
ggcagggccct

SEQ ID NO: 2300202 - DNA, 12 bp, Homo sapiens
ggcagggccctg

SEQ ID NO: 2300203 - DNA, 23 bp, Homo sapiens
ggcagggccctggggtctctgag

SEQ ID NO: 2300204 - DNA, 13 bp, Homo sapiens
ggcagggccctgt

SEQ ID NO: 2300205 - DNA, 14 bp, Homo sapiens
ggcagggccctgtg

SEQ ID NO: 2300206 - DNA, 17 bp, Homo sapiens
ggcagggccctgtggct

SEQ ID NO: 2300207 - DNA, 19 bp, Homo sapiens
ggcagggccctgtggctcc

SEQ ID NO: 2300208 - DNA, 22 bp, Homo sapiens
ggcagggccctgtggctccagg

SEQ ID NO: 2300209 - DNA, 14 bp, Homo sapiens
ggcagggtctcact

SEQ ID NO: 2300210 - DNA, 15 bp, Homo sapiens
ggcaggtgggcagac

SEQ ID NO: 2300211 - DNA, 13 bp, Homo sapiens
ggcagtagcagct

SEQ ID NO: 2300212 - DNA, 18 bp, Homo sapiens
ggcagtgacgtgagtggg

SEQ ID NO: 2300213 - DNA, 19 bp, Homo sapiens
ggcagtgacgtgagtgggg

SEQ ID NO: 2300214 - DNA, 15 bp, Homo sapiens
ggcagtgcaccccct

SEQ ID NO: 2300215 - DNA, 21 bp, Homo sapiens
ggcagtgcagcaaccagagca

SEQ ID NO: 2300216 - DNA, 22 bp, Homo sapiens
ggcagtgcagcaaccagagcac

SEQ ID NO: 2300217 - DNA, 15 bp, Homo sapiens
ggcagttgcttgtgt

SEQ ID NO: 2300218 - DNA, 18 bp, Homo sapiens
ggcatcatttcccctccc

SEQ ID NO: 2300219 - DNA, 13 bp, Homo sapiens
ggcatccccagcc

SEQ ID NO: 2300220 - DNA, 16 bp, Homo sapiens
ggcatccccagccccc

SEQ ID NO: 2300221 - DNA, 18 bp, Homo sapiens
ggcatgacacgaatattg

SEQ ID NO: 2300222 - DNA, 22 bp, Homo sapiens
ggcatgacacgaatattgctga

SEQ ID NO: 2300223 - DNA, 13 bp, Homo sapiens
ggcatgaccctgg

SEQ ID NO: 2300224 - DNA, 15 bp, Homo sapiens
ggcatgccgagtgcc

SEQ ID NO: 2300225 - DNA, 13 bp, Homo sapiens
ggcatggcagccc

SEQ ID NO: 2300226 - DNA, 22 bp, Homo sapiens
ggcatgtgcagacactcaagag

SEQ ID NO: 2300227 - DNA, 13 bp, Homo sapiens
ggcatttttcttg

SEQ ID NO: 2300228 - DNA, 22 bp, Homo sapiens
ggcatttttcttggatcttttt

SEQ ID NO: 2300229 - DNA, 12 bp, Homo sapiens
ggccaaggacac

SEQ ID NO: 2300230 - DNA, 20 bp, Homo sapiens
ggccaaggacactgatgggt

SEQ ID NO: 2300231 - DNA, 20 bp, Homo sapiens
ggccactcctgggccccaga

SEQ ID NO: 2300232 - DNA, 14 bp, Homo sapiens
ggccactggccctg

SEQ ID NO: 2300233 - DNA, 20 bp, Homo sapiens
ggccactggccctgtttctc

SEQ ID NO: 2300234 - DNA, 11 bp, Homo sapiens
ggccagagctc

SEQ ID NO: 2300235 - DNA, 15 bp, Homo sapiens
ggccagagctcccag

SEQ ID NO: 2300236 - DNA, 16 bp, Homo sapiens
ggccagagctcccagg

SEQ ID NO: 2300237 - DNA, 20 bp, Homo sapiens
ggccagagctcccaggacgc

SEQ ID NO: 2300238 - DNA, 12 bp, Homo sapiens
ggccagcccctc

SEQ ID NO: 2300239 - DNA, 13 bp, Homo sapiens
ggccagcccctcc

SEQ ID NO: 2300240 - DNA, 18 bp, Homo sapiens
ggccagcccctccccgcc

SEQ ID NO: 2300241 - DNA, 15 bp, Homo sapiens
ggccaggaaggggac

SEQ ID NO: 2300242 - DNA, 17 bp, Homo sapiens
ggccaggaaggggacag

SEQ ID NO: 2300243 - DNA, 18 bp, Homo sapiens
ggccatccccgtgttggg

SEQ ID NO: 2300244 - DNA, 22 bp, Homo sapiens
ggccatgcccaccgcccctgga

SEQ ID NO: 2300245 - DNA, 22 bp, Homo sapiens
ggccatggaagctggcaggaga

SEQ ID NO: 2300246 - DNA, 20 bp, Homo sapiens
ggcccaaataacagtggcaa

SEQ ID NO: 2300247 - DNA, 13 bp, Homo sapiens
ggcccaacctcgc

SEQ ID NO: 2300248 - DNA, 19 bp, Homo sapiens
ggcccaacctcgccctctc

SEQ ID NO: 2300249 - DNA, 21 bp, Homo sapiens
ggcccacattgcccacacctg

SEQ ID NO: 2300250 - DNA, 16 bp, Homo sapiens
ggcccacgcagagccc

SEQ ID NO: 2300251 - DNA, 21 bp, Homo sapiens
ggcccacgcagagccccggag

SEQ ID NO: 2300252 - DNA, 23 bp, Homo sapiens
ggcccacgcagagccccggagca

SEQ ID NO: 2300253 - DNA, 20 bp, Homo sapiens
ggcccagaggggcggggcca

SEQ ID NO: 2300254 - DNA, 14 bp, Homo sapiens
ggcccatgccctcc

SEQ ID NO: 2300255 - DNA, 17 bp, Homo sapiens
ggcccatggccccagct

SEQ ID NO: 2300256 - DNA, 19 bp, Homo sapiens
ggcccatggccccagctgg

SEQ ID NO: 2300257 - DNA, 13 bp, Homo sapiens
ggcccatggtgga

SEQ ID NO: 2300258 - DNA, 16 bp, Homo sapiens
ggcccattcagcctcg

SEQ ID NO: 2300259 - DNA, 19 bp, Homo sapiens
ggcccattcagcctcgtct

SEQ ID NO: 2300260 - DNA, 13 bp, Homo sapiens
ggccccacagtgg

SEQ ID NO: 2300261 - DNA, 16 bp, Homo sapiens
ggccccacagtggtca

SEQ ID NO: 2300262 - DNA, 13 bp, Homo sapiens
ggccccagctggc

SEQ ID NO: 2300263 - DNA, 22 bp, Homo sapiens
ggccccaggcggaggggcttgg

SEQ ID NO: 2300264 - DNA, 18 bp, Homo sapiens
ggcccccggaggcgccca

SEQ ID NO: 2300265 - DNA, 21 bp, Homo sapiens
ggcccccggaggcgcccacct

SEQ ID NO: 2300266 - DNA, 14 bp, Homo sapiens
ggccccgcgcgtgc

SEQ ID NO: 2300267 - DNA, 19 bp, Homo sapiens
ggccccgcgcgtgccccca

SEQ ID NO: 2300268 - DNA, 21 bp, Homo sapiens
ggccccgcgcgtgcccccagc

SEQ ID NO: 2300269 - DNA, 16 bp, Homo sapiens
ggcccctcccacatcc

SEQ ID NO: 2300270 - DNA, 20 bp, Homo sapiens
ggcccggcccacgcagagcc

SEQ ID NO: 2300271 - DNA, 17 bp, Homo sapiens
ggcccgtgcgcagccgc

SEQ ID NO: 2300272 - DNA, 14 bp, Homo sapiens
ggccctgccctccc

SEQ ID NO: 2300273 - DNA, 17 bp, Homo sapiens
ggccctgccctccccca

SEQ ID NO: 2300274 - DNA, 19 bp, Homo sapiens
ggccctgccctcccccacg

SEQ ID NO: 2300275 - DNA, 12 bp, Homo sapiens
ggccctggaggg

SEQ ID NO: 2300276 - DNA, 16 bp, Homo sapiens
ggccctgggccccgcc

SEQ ID NO: 2300277 - DNA, 19 bp, Homo sapiens
gggagcctgcgtggcctgg

SEQ ID NO: 2300278 - DNA, 24 bp, Homo sapiens
gggagcctgcgtggcctggggctg

SEQ ID NO: 2300279 - DNA, 17 bp, Homo sapiens
gggaggagactcaggcc

SEQ ID NO: 2300280 - DNA, 21 bp, Homo sapiens
gggaggagttgtctgtcctgg

SEQ ID NO: 2300281 - DNA, 18 bp, Homo sapiens
gggagggaaagggagagg

SEQ ID NO: 2300282 - DNA, 12 bp, Homo sapiens
gggagggcctct

SEQ ID NO: 2300283 - DNA, 13 bp, Homo sapiens
gggaggggaagag

SEQ ID NO: 2300284 - DNA, 15 bp, Homo sapiens
gggaggggggcggtg

SEQ ID NO: 2300285 - DNA, 19 bp, Homo sapiens
gggaggttttctcccccag

SEQ ID NO: 2300286 - DNA, 14 bp, Homo sapiens
gggatccagagacc

SEQ ID NO: 2300287 - DNA, 16 bp, Homo sapiens
gggcaaggggccagga

SEQ ID NO: 2300288 - DNA, 23 bp, Homo sapiens
gggcacacttccccttgggatgg

SEQ ID NO: 2300289 - DNA, 12 bp, Homo sapiens
gggcacaggctg

SEQ ID NO: 2300290 - DNA, 13 bp, Homo sapiens
gggcacaggctgc

SEQ ID NO: 2300291 - DNA, 16 bp, Homo sapiens
gggcacgggagagcgc

SEQ ID NO: 2300292 - DNA, 20 bp, Homo sapiens
gggcacgggagagcgccacc

SEQ ID NO: 2300293 - DNA, 15 bp, Homo sapiens
gggcagagctgagtc

SEQ ID NO: 2300294 - DNA, 16 bp, Homo sapiens
gggcagagctgagtcg

SEQ ID NO: 2300295 - DNA, 16 bp, Homo sapiens
gggcagcccctgctgg

SEQ ID NO: 2300296 - DNA, 18 bp, Homo sapiens
gggcagcggccccgcacc

SEQ ID NO: 2300297 - DNA, 20 bp, Homo sapiens
gggcaggcctgttccctgag

SEQ ID NO: 2300298 - DNA, 15 bp, Homo sapiens
gggcagggccctgtg

SEQ ID NO: 2300299 - DNA, 21 bp, Homo sapiens
gggcagggccctgtggctcca

SEQ ID NO: 2300300 - DNA, 20 bp, Homo sapiens
gggcagggccgcagggcgct

SEQ ID NO: 2300301 - DNA, 19 bp, Homo sapiens
gggcagtgacgtgagtggg

SEQ ID NO: 2300302 - DNA, 17 bp, Homo sapiens
gggcatccccagccccc

SEQ ID NO: 2300303 - DNA, 12 bp, Homo sapiens
gggcatgacacg

SEQ ID NO: 2300304 - DNA, 17 bp, Homo sapiens
gggccagcccctccccg

SEQ ID NO: 2300305 - DNA, 18 bp, Homo sapiens
gggccaggaaggggacag

SEQ ID NO: 2300306 - DNA, 11 bp, Homo sapiens
gggcccagagg

SEQ ID NO: 2300307 - DNA, 12 bp, Homo sapiens
gggcccagaggg

SEQ ID NO: 2300308 - DNA, 22 bp, Homo sapiens
gggcccagaggggcggggccag

SEQ ID NO: 2300309 - DNA, 18 bp, Homo sapiens
gggcccatggccccagct

SEQ ID NO: 2300310 - DNA, 21 bp, Homo sapiens
gggcccatggccccagctggc

SEQ ID NO: 2300311 - DNA, 16 bp, Homo sapiens
gggccccacagtggtc

SEQ ID NO: 2300312 - DNA, 12 bp, Homo sapiens
gggccccacgga

SEQ ID NO: 2300313 - DNA, 19 bp, Homo sapiens
gggccccatggtcacagac

SEQ ID NO: 2300314 - DNA, 21 bp, Homo sapiens
gggccccatggtcacagaccc

SEQ ID NO: 2300315 - DNA, 13 bp, Homo sapiens
gggccccgcctca

SEQ ID NO: 2300316 - DNA, 13 bp, Homo sapiens
gggcccgagcgcg

SEQ ID NO: 2300317 - DNA, 16 bp, Homo sapiens
gggcccgagcgcgtgc

SEQ ID NO: 2300318 - DNA, 18 bp, Homo sapiens
gggcccgccccaggcccc

SEQ ID NO: 2300319 - DNA, 20 bp, Homo sapiens
gggcccgctcaacctctcag

SEQ ID NO: 2300320 - DNA, 21 bp, Homo sapiens
gggcccgctcaacctctcaga

SEQ ID NO: 2300321 - DNA, 24 bp, Homo sapiens
gggccctggttcccccaggaccct

SEQ ID NO: 2300322 - DNA, 13 bp, Homo sapiens
gggccgcagggcg

SEQ ID NO: 2300323 - DNA, 23 bp, Homo sapiens
gggccgcagggcgctccggcaga

SEQ ID NO: 2300324 - DNA, 14 bp, Homo sapiens
gggccgcctcctcc

SEQ ID NO: 2300325 - DNA, 18 bp, Homo sapiens
gggccgcctcctccagac

SEQ ID NO: 2300326 - DNA, 20 bp, Homo sapiens
gggcctcccgtccgtccgcc

SEQ ID NO: 2300327 - DNA, 19 bp, Homo sapiens
gggcctgtttggtgaggac

SEQ ID NO: 2300328 - DNA, 21 bp, Homo sapiens
gggcgcaggaaccgaggactc

SEQ ID NO: 2300329 - DNA, 13 bp, Homo sapiens
gggcgcccggact

SEQ ID NO: 2300330 - DNA, 18 bp, Homo sapiens
gggcgcctgcgctcctct

SEQ ID NO: 2300331 - DNA, 18 bp, Homo sapiens
gggcgcgggacaggactt

SEQ ID NO: 2300332 - DNA, 20 bp, Homo sapiens
gggcgctccggcagaggcag

SEQ ID NO: 2300333 - DNA, 17 bp, Homo sapiens
gggcgctgcccccacag

SEQ ID NO: 2300334 - DNA, 20 bp, Homo sapiens
gggcgctgcccccacagatc

SEQ ID NO: 2300335 - DNA, 22 bp, Homo sapiens
gggcgctgcccccacagatcca

SEQ ID NO: 2300336 - DNA, 14 bp, Homo sapiens
gggctaactggccc

SEQ ID NO: 2300337 - DNA, 20 bp, Homo sapiens
gggctaactggccccaggcg

SEQ ID NO: 2300338 - DNA, 19 bp, Homo sapiens
gggctccacgggggcctag

SEQ ID NO: 2300339 - DNA, 13 bp, Homo sapiens
gggctcctggcag

SEQ ID NO: 2300340 - DNA, 22 bp, Homo sapiens
gggctgactctccagggagctg

SEQ ID NO: 2300341 - DNA, 11 bp, Homo sapiens
gggctgagccc

SEQ ID NO: 2300342 - DNA, 12 bp, Homo sapiens
gggctgagcccc

SEQ ID NO: 2300343 - DNA, 19 bp, Homo sapiens
gggctgagcccctcctctc

SEQ ID NO: 2300344 - DNA, 20 bp, Homo sapiens
gggctgagcccctcctctcc

SEQ ID NO: 2300345 - DNA, 15 bp, Homo sapiens
gggctggccctgccc

SEQ ID NO: 2300346 - DNA, 17 bp, Homo sapiens
gggctggccctgccctc

SEQ ID NO: 2300347 - DNA, 21 bp, Homo sapiens
gggctggccctgccctccccc

SEQ ID NO: 2300348 - DNA, 17 bp, Homo sapiens
gggctggcttctccctg

SEQ ID NO: 2300349 - DNA, 14 bp, Homo sapiens
gggctgggcagggc

SEQ ID NO: 2300350 - DNA, 16 bp, Homo sapiens
gggctgggcagggccc

SEQ ID NO: 2300351 - DNA, 16 bp, Homo sapiens
gggctgtgcgggcgcc

SEQ ID NO: 2300352 - DNA, 17 bp, Homo sapiens
gggcttggagcagagac

SEQ ID NO: 2300353 - DNA, 19 bp, Homo sapiens
ggggacaggaacacccagc

SEQ ID NO: 2300354 - DNA, 23 bp, Homo sapiens
ggggacttcgggggcggctctgg

SEQ ID NO: 2300355 - DNA, 13 bp, Homo sapiens
ggggagcaaggct

SEQ ID NO: 2300356 - DNA, 22 bp, Homo sapiens
ggggaggagcacccccagcctc

SEQ ID NO: 2300357 - DNA, 14 bp, Homo sapiens
ggggaggcttccag

SEQ ID NO: 2300358 - DNA, 19 bp, Homo sapiens
ggggatcataaagttagaa

SEQ ID NO: 2300359 - DNA, 23 bp, Homo sapiens
ggggcaaaagtcattgctgacag

SEQ ID NO: 2300360 - DNA, 18 bp, Homo sapiens
ggggcagcggccccgcac

SEQ ID NO: 2300361 - DNA, 12 bp, Homo sapiens
ggggcaggaagt

SEQ ID NO: 2300362 - DNA, 16 bp, Homo sapiens
ggggccagcccctccc

SEQ ID NO: 2300363 - DNA, 21 bp, Homo sapiens
ggggccaggaaggggacagga

SEQ ID NO: 2300364 - DNA, 17 bp, Homo sapiens
ggggccatggaagctgg

SEQ ID NO: 2300365 - DNA, 13 bp, Homo sapiens
ggggcccatggcc

SEQ ID NO: 2300366 - DNA, 14 bp, Homo sapiens
ggggcccatggccc

SEQ ID NO: 2300367 - DNA, 13 bp, Homo sapiens
ggggcggctctgg

SEQ ID NO: 2300368 - DNA, 16 bp, Homo sapiens
ggggctcctggcagtg

SEQ ID NO: 2300369 - DNA, 17 bp, Homo sapiens
ggggctcctggcagtga

SEQ ID NO: 2300370 - DNA, 11 bp, Homo sapiens
ggggctggagg

SEQ ID NO: 2300371 - DNA, 19 bp, Homo sapiens
ggggctggagggctgggca

SEQ ID NO: 2300372 - DNA, 14 bp, Homo sapiens
ggggctggccctgc

SEQ ID NO: 2300373 - DNA, 21 bp, Homo sapiens
ggggctggccctgccctcccc

SEQ ID NO: 2300374 - DNA, 18 bp, Homo sapiens
ggggctgtgcgggcgccc

SEQ ID NO: 2300375 - DNA, 21 bp, Homo sapiens
ggggctgtgcgggcgcccgga

SEQ ID NO: 2300376 - DNA, 16 bp, Homo sapiens
ggggcttggagcagag

SEQ ID NO: 2300377 - DNA, 24 bp, Homo sapiens
ggggcttggagcagagacggcagc

SEQ ID NO: 2300378 - DNA, 18 bp, Homo sapiens
ggggcttggctcgcaccc

SEQ ID NO: 2300379 - DNA, 22 bp, Homo sapiens
ggggcttttgtgccaggagtgg

SEQ ID NO: 2300380 - DNA, 13 bp, Homo sapiens
gggggcggctctg

SEQ ID NO: 2300381 - DNA, 18 bp, Homo sapiens
gggggctcctggcagtga

SEQ ID NO: 2300382 - DNA, 11 bp, Homo sapiens
ggggggagaaa

SEQ ID NO: 2300383 - DNA, 16 bp, Homo sapiens
ggggtatcctgtgcat

SEQ ID NO: 2300384 - DNA, 21 bp, Homo sapiens
ggggtcgggggaggagcaccc

SEQ ID NO: 2300385 - DNA, 15 bp, Homo sapiens
ggggtctctgagcag

SEQ ID NO: 2300386 - DNA, 18 bp, Homo sapiens
ggggtgccaaaatgccta

SEQ ID NO: 2300387 - DNA, 19 bp, Homo sapiens
ggggtttccacacaggccc

SEQ ID NO: 2300388 - DNA, 20 bp, Homo sapiens
gggtaaattataaatgtttc

SEQ ID NO: 2300389 - DNA, 22 bp, Homo sapiens
gggtaagttgaagggaaatcaa

SEQ ID NO: 2300390 - DNA, 20 bp, Homo sapiens
gggtagctgccacttgaaca

SEQ ID NO: 2300391 - DNA, 13 bp, Homo sapiens
gggtcccccctcc

SEQ ID NO: 2300392 - DNA, 20 bp, Homo sapiens
gggtcggcgccttctacctg

SEQ ID NO: 2300393 - DNA, 14 bp, Homo sapiens
gggtctcactgtgt

SEQ ID NO: 2300394 - DNA, 17 bp, Homo sapiens
gggtggaagggcaggag

SEQ ID NO: 2300395 - DNA, 16 bp, Homo sapiens
gggtgggagggggcag

SEQ ID NO: 2300396 - DNA, 22 bp, Homo sapiens
gggtgtggctcgggtgcccagg

SEQ ID NO: 2300397 - DNA, 13 bp, Homo sapiens
gggttacactgtt

SEQ ID NO: 2300398 - DNA, 18 bp, Homo sapiens
gggtttccacacaggccc

SEQ ID NO: 2300399 - DNA, 22 bp, Homo sapiens
gggtttcctctgccccctcctt

SEQ ID NO: 2300400 - DNA, 19 bp, Homo sapiens
gggtttgcttttgttttgt

SEQ ID NO: 2300401 - DNA, 21 bp, Homo sapiens
ggtaccaagatcacaaatagt

SEQ ID NO: 2300402 - DNA, 16 bp, Homo sapiens
ggtagctctgaaggga

SEQ ID NO: 2300403 - DNA, 12 bp, Homo sapiens
ggtagctgccac

SEQ ID NO: 2300404 - DNA, 21 bp, Homo sapiens
ggtataggacaaggggtggaa

SEQ ID NO: 2300405 - DNA, 12 bp, Homo sapiens
ggtatccagagg

SEQ ID NO: 2300406 - DNA, 13 bp, Homo sapiens
ggtatcctgtgca

SEQ ID NO: 2300407 - DNA, 21 bp, Homo sapiens
ggtatctgctgcctctgaaaa

SEQ ID NO: 2300408 - DNA, 20 bp, Homo sapiens
ggtcacactgtggaacacta

SEQ ID NO: 2300409 - DNA, 23 bp, Homo sapiens
gtcacctcactcagcaccactca

SEQ ID NO: 2300410 - DNA, 19 bp, Homo sapiens
gtcagaaggagacagaatg

SEQ ID NO: 2300411 - DNA, 15 bp, Homo sapiens
gtcagcggagaggac

SEQ ID NO: 2300412 - DNA, 17 bp, Homo sapiens
gtcaggaggtgcctgag

SEQ ID NO: 2300413 - DNA, 15 bp, Homo sapiens
gtcagttgggccccc

SEQ ID NO: 2300414 - DNA, 14 bp, Homo sapiens
gtcataaaatgcta

SEQ ID NO: 2300415 - DNA, 21 bp, Homo sapiens
gtcataaaatgctattttaaa

SEQ ID NO: 2300416 - DNA, 22 bp, Homo sapiens
gtcataaaatgctattttaaaa

SEQ ID NO: 2300417 - DNA, 18 bp, Homo sapiens
gtcatcccggggccatgg

SEQ ID NO: 2300418 - DNA, 19 bp, Homo sapiens
gtcatcccggggccatgga

SEQ ID NO: 2300419 - DNA, 13 bp, Homo sapiens
gtcatgggagaag

SEQ ID NO: 2300420 - DNA, 16 bp, Homo sapiens
gtcatgttgaaggtgc

SEQ ID NO: 2300421 - DNA, 18 bp, Homo sapiens
gtcattccacacatttcc

SEQ ID NO: 2300422 - DNA, 14 bp, Homo sapiens
gtcattctgctaat

SEQ ID NO: 2300423 - DNA, 20 bp, Homo sapiens
gtcattctgctaatttatga

SEQ ID NO: 2300424 - DNA, 21 bp, Homo sapiens
gtcattgctgacagagcccta

SEQ ID NO: 2300425 - DNA, 12 bp, Homo sapiens
gtcatttgtaga

SEQ ID NO: 2300426 - DNA, 14 bp, Homo sapiens
gtccaatgaagata

SEQ ID NO: 2300427 - DNA, 18 bp, Homo sapiens
gtccaatgaagataaatg

SEQ ID NO: 2300428 - DNA, 16 bp, Homo sapiens
gtccacattctgctgc

SEQ ID NO: 2300429 - DNA, 22 bp, Homo sapiens
gtccacattctgctgcccccag

SEQ ID NO: 2300430 - DNA, 17 bp, Homo sapiens
gtccaccccgtcccggc

SEQ ID NO: 2300431 - DNA, 18 bp, Homo sapiens
gtccaccccgtcccggcc

SEQ ID NO: 2300432 - DNA, 14 bp, Homo sapiens
gtccagacctgggc

SEQ ID NO: 2300433 - DNA, 19 bp, Homo sapiens
gtccagacctgggccctgg

SEQ ID NO: 2300434 - DNA, 16 bp, Homo sapiens
gtccagctctcccctg

SEQ ID NO: 2300435 - DNA, 17 bp, Homo sapiens
gtccagctctcccctgc

SEQ ID NO: 2300436 - DNA, 16 bp, Homo sapiens
gtcccacaaaatattt

SEQ ID NO: 2300437 - DNA, 16 bp, Homo sapiens
gtcccatctcacctct

SEQ ID NO: 2300438 - DNA, 16 bp, Homo sapiens
gtcccatgggctctgg

SEQ ID NO: 2300439 - DNA, 19 bp, Homo sapiens
gtccccagggtgcaggcgc

SEQ ID NO: 2300440 - DNA, 10 bp, Homo sapiens
gtccccggac

SEQ ID NO: 2300441 - DNA, 18 bp, Homo sapiens
gtccccggacgctggctc

SEQ ID NO: 2300442 - DNA, 23 bp, Homo sapiens
gtcccgaatggagtccagacctg

SEQ ID NO: 2300443 - DNA, 21 bp, Homo sapiens
gtcccggccccgcgcgtgccc

SEQ ID NO: 2300444 - DNA, 14 bp, Homo sapiens
gtccctgacttccc

SEQ ID NO: 2300445 - DNA, 19 bp, Homo sapiens
gtccctgacttcccagctg

SEQ ID NO: 2300446 - DNA, 23 bp, Homo sapiens
gtccctgacttcccagctggcag

SEQ ID NO: 2300447 - DNA, 23 bp, Homo sapiens
gtccctgagaagcctcatgggag

SEQ ID NO: 2300448 - DNA, 19 bp, Homo sapiens
gtcccttacgtgagtcctg

SEQ ID NO: 2300449 - DNA, 16 bp, Homo sapiens
gtcccttccaggagga

SEQ ID NO: 2300450 - DNA, 20 bp, Homo sapiens
gtccgaggcctggctctgga

SEQ ID NO: 2300451 - DNA, 14 bp, Homo sapiens
gtccggcctgcagc

SEQ ID NO: 2300452 - DNA, 22 bp, Homo sapiens
gtcctaggggccgagggaaatg

SEQ ID NO: 2300453 - DNA, 17 bp, Homo sapiens
gtcctcaggtgaataac

SEQ ID NO: 2300454 - DNA, 16 bp, Homo sapiens
gtcctcttcctcaaag

SEQ ID NO: 2300455 - DNA, 17 bp, Homo sapiens
gtcctgaggctggggct

SEQ ID NO: 2300456 - DNA, 19 bp, Homo sapiens
gtcctgcctaaatttcaca

SEQ ID NO: 2300457 - DNA, 12 bp, Homo sapiens
gtcctgctgctc

SEQ ID NO: 2300458 - DNA, 15 bp, Homo sapiens
gtcctggcagggcag

SEQ ID NO: 2300459 - DNA, 20 bp, Homo sapiens
gtcctggcagggcaggcaga

SEQ ID NO: 2300460 - DNA, 22 bp, Homo sapiens
gtcctggtcagttttcacagag

SEQ ID NO: 2300461 - DNA, 23 bp, Homo sapiens
gtcctggtcagttttcacagagg

SEQ ID NO: 2300462 - DNA, 24 bp, Homo sapiens
gtcctggtcagttttcacagaggc

SEQ ID NO: 2300463 - DNA, 14 bp, Homo sapiens
gtcgcccctcctcg

SEQ ID NO: 2300464 - DNA, 16 bp, Homo sapiens
gtcgcccctcctcggg

SEQ ID NO: 2300465 - DNA, 18 bp, Homo sapiens
gtcggcgccttctacctg

SEQ ID NO: 2300466 - DNA, 16 bp, Homo sapiens
gtcggctgggcagggc

SEQ ID NO: 2300467 - DNA, 17 bp, Homo sapiens
gtcggctgggcagggcc

SEQ ID NO: 2300468 - DNA, 22 bp, Homo sapiens
gtcgggggaggagcacccccag

SEQ ID NO: 2300469 - DNA, 21 bp, Homo sapiens
gtctacactgcaatcatatgt

SEQ ID NO: 2300470 - DNA, 14 bp, Homo sapiens
gtctagaagaacaa

SEQ ID NO: 2300471 - DNA, 22 bp, Homo sapiens
gtctcaaataataataataaca

SEQ ID NO: 2300472 - DNA, 22 bp, Homo sapiens
gtctcactagtttttcctgtgc

SEQ ID NO: 2300473 - DNA, 20 bp, Homo sapiens
gtctcactgtgttgcccagg

SEQ ID NO: 2300474 - DNA, 22 bp, Homo sapiens
gtctcagccgagcccaggggag

SEQ ID NO: 2300475 - DNA, 20 bp, Homo sapiens
gtctccattgttaaatgttc

SEQ ID NO: 2300476 - DNA, 13 bp, Homo sapiens
gtctcgtcaggag

SEQ ID NO: 2300477 - DNA, 20 bp, Homo sapiens
gtctcgtcaggaggtgcctg

SEQ ID NO: 2300478 - DNA, 19 bp, Homo sapiens
gtctcgtgttcgctggctg

SEQ ID NO: 2300479 - DNA, 20 bp, Homo sapiens
gtctcgtgttcgctggctga

SEQ ID NO: 2300480 - DNA, 10 bp, Homo sapiens
gtctgcccct

SEQ ID NO: 2300481 - DNA, 17 bp, Homo sapiens
gtctgccccttgacccc

SEQ ID NO: 2300482 - DNA, 23 bp, Homo sapiens
gtctgctgtaagacggccttgga

SEQ ID NO: 2300483 - DNA, 14 bp, Homo sapiens
gtctggagaccagg

SEQ ID NO: 2300484 - DNA, 14 bp, Homo sapiens
gtctgtaagagaat

SEQ ID NO: 2300485 - DNA, 15 bp, Homo sapiens
gtctgtagttgcttt

SEQ ID NO: 2300486 - DNA, 17 bp, Homo sapiens
gtctgtagttgctttgc

SEQ ID NO: 2300487 - DNA, 14 bp, Homo sapiens
gtctgtcctggtca

SEQ ID NO: 2300488 - DNA, 14 bp, Homo sapiens
gtctgtttcattac

SEQ ID NO: 2300489 - DNA, 15 bp, Homo sapiens
gtcttcaaccctgcc

SEQ ID NO: 2300490 - DNA, 15 bp, Homo sapiens
gtcttcatggtctct

SEQ ID NO: 2300491 - DNA, 22 bp, Homo sapiens
gtcttgatcagacattcagaga

SEQ ID NO: 2300492 - DNA, 16 bp, Homo sapiens
gtgaaaatgtatggat

SEQ ID NO: 2300493 - DNA, 20 bp, Homo sapiens
gtgaagatgtgtaaataagc

SEQ ID NO: 2300494 - DNA, 16 bp, Homo sapiens
gtgaagcatccaggca

SEQ ID NO: 2300495 - DNA, 20 bp, Homo sapiens
gtgaattttaaaatgcaaat

SEQ ID NO: 2300496 - DNA, 15 bp, Homo sapiens
gtgaccggcccgcca

SEQ ID NO: 2300497 - DNA, 20 bp, Homo sapiens
gtgaccggcccgccaccttg

SEQ ID NO: 2300498 - DNA, 13 bp, Homo sapiens
gtgaccggggtcc

SEQ ID NO: 2300499 - DNA, 15 bp, Homo sapiens
gtgaccggggtcctg

SEQ ID NO: 2300500 - DNA, 16 bp, Homo sapiens
gtgaccggggtcctga

SEQ ID NO: 2300501 - DNA, 21 bp, Homo sapiens
gtgacctgacacctgccgctg

SEQ ID NO: 2300502 - DNA, 19 bp, Homo sapiens
gtgagaatcgacctcactg

SEQ ID NO: 2300503 - DNA, 22 bp, Homo sapiens
gtgagaatcgacctcactgtca

SEQ ID NO: 2300504 - DNA, 23 bp, Homo sapiens
gtgagcatacctgtctcagctgt

SEQ ID NO: 2300505 - DNA, 13 bp, Homo sapiens
gtgagccacagca

SEQ ID NO: 2300506 - DNA, 15 bp, Homo sapiens
gtgagctaccaggaa

SEQ ID NO: 2300507 - DNA, 16 bp, Homo sapiens
gtgaggcccccggagg

SEQ ID NO: 2300508 - DNA, 15 bp, Homo sapiens
gtgagggaggacagg

SEQ ID NO: 2300509 - DNA, 14 bp, Homo sapiens
gtgagggaggcctg

SEQ ID NO: 2300510 - DNA, 14 bp, Homo sapiens
gtgaggtgggggca

SEQ ID NO: 2300511 - DNA, 13 bp, Homo sapiens
gtgatactccaag

SEQ ID NO: 2300512 - DNA, 12 bp, Homo sapiens
gtgatcccagct

SEQ ID NO: 2300513 - DNA, 21 bp, Homo sapiens
gtgatcccagctcactgcagc

SEQ ID NO: 2300514 - DNA, 24 bp, Homo sapiens
gtgatcccagctcactgcagcctc

SEQ ID NO: 2300515 - DNA, 21 bp, Homo sapiens
gtgatcctcccgccccagcct

SEQ ID NO: 2300516 - DNA, 21 bp, Homo sapiens
gtgatctaagcagttgcaatg

SEQ ID NO: 2300517 - DNA, 16 bp, Homo sapiens
gtgatgagaggaaatc

SEQ ID NO: 2300518 - DNA, 20 bp, Homo sapiens
gtgcaaaaataaaatggaca

SEQ ID NO: 2300519 - DNA, 18 bp, Homo sapiens
gtgcaatgacctttcaat

SEQ ID NO: 2300520 - DNA, 22 bp, Homo sapiens
gtgcaatgacctttcaatagga

SEQ ID NO: 2300521 - DNA, 16 bp, Homo sapiens
gtgcagacactcaaga

SEQ ID NO: 2300522 - DNA, 21 bp, Homo sapiens
gtgcaggagcaaggctgccct

SEQ ID NO: 2300523 - DNA, 22 bp, Homo sapiens
gtgcaggagcaaggctgccctg

SEQ ID NO: 2300524 - DNA, 22 bp, Homo sapiens
gtgcatgctgtcccttacgtga

SEQ ID NO: 2300525 - DNA, 15 bp, Homo sapiens
gtgccaaatcctggg

SEQ ID NO: 2300526 - DNA, 17 bp, Homo sapiens
gtgccaaatcctgggca

SEQ ID NO: 2300527 - DNA, 14 bp, Homo sapiens
gtgccaggagtggg

SEQ ID NO: 2300528 - DNA, 19 bp, Homo sapiens
gtgccaggagtgggtggga

SEQ ID NO: 2300529 - DNA, 22 bp, Homo sapiens
gtgccaggagtgggtgggacac

SEQ ID NO: 2300530 - DNA, 22 bp, Homo sapiens
gtgcccaggacggtctgtgccc

SEQ ID NO: 2300531 - DNA, 19 bp, Homo sapiens
gtgcccgaggttcctgtca

SEQ ID NO: 2300532 - DNA, 17 bp, Homo sapiens
gtgccgcgggcgagaag

SEQ ID NO: 2300533 - DNA, 20 bp, Homo sapiens
gtgcctgtgaccggggtcct

SEQ ID NO: 2300534 - DNA, 11 bp, Homo sapiens
gtgccttatgg

SEQ ID NO: 2300535 - DNA, 20 bp, Homo sapiens
gtgcgacttcacaaaatgca

SEQ ID NO: 2300536 - DNA, 22 bp, Homo sapiens
gtgcgacttcacaaaatgcaag

SEQ ID NO: 2300537 - DNA, 17 bp, Homo sapiens
gtgcggaccggagcggc

SEQ ID NO: 2300538 - DNA, 14 bp, Homo sapiens
gtgcgttttagagt

SEQ ID NO: 2300539 - DNA, 17 bp, Homo sapiens
gtgctccagtgttttct

SEQ ID NO: 2300540 - DNA, 14 bp, Homo sapiens
gttgttatattcat

SEQ ID NO: 2300541 - DNA, 20 bp, Homo sapiens
gttgttcagtcctctgcact

SEQ ID NO: 2300542 - DNA, 20 bp, Homo sapiens
gttgttcgatcgtttcacat

SEQ ID NO: 2300543 - DNA, 17 bp, Homo sapiens
gtttaaaaaaataacat

SEQ ID NO: 2300544 - DNA, 18 bp, Homo sapiens
gtttaagaaatgagaaat

SEQ ID NO: 2300545 - DNA, 14 bp, Homo sapiens
gtttagctgtgaaa

SEQ ID NO: 2300546 - DNA, 22 bp, Homo sapiens
gtttataggaaataaatctaaa

SEQ ID NO: 2300547 - DNA, 22 bp, Homo sapiens
gtttatggtattttcgtgcatt

SEQ ID NO: 2300548 - DNA, 20 bp, Homo sapiens
gtttcaaagggtaaattata

SEQ ID NO: 2300549 - DNA, 19 bp, Homo sapiens
gtttcatgaagaaaaaatt

SEQ ID NO: 2300550 - DNA, 15 bp, Homo sapiens
gtttccacacaggcc

SEQ ID NO: 2300551 - DNA, 19 bp, Homo sapiens
gtttccacacaggcccatg

SEQ ID NO: 2300552 - DNA, 20 bp, Homo sapiens
gtttcctgtggaaatatgca

SEQ ID NO: 2300553 - DNA, 20 bp, Homo sapiens
gtttctatactgtttgtaat

SEQ ID NO: 2300554 - DNA, 19 bp, Homo sapiens
gtttctccccacaccctgg

SEQ ID NO: 2300555 - DNA, 18 bp, Homo sapiens
gtttctgaatgacatcaa

SEQ ID NO: 2300556 - DNA, 15 bp, Homo sapiens
gtttctgcagtattc

SEQ ID NO: 2300557 - DNA, 23 bp, Homo sapiens
gtttctgtcctcaggtgaataac

SEQ ID NO: 2300558 - DNA, 17 bp, Homo sapiens
gtttcttgcttgtacct

SEQ ID NO: 2300559 - DNA, 20 bp, Homo sapiens
gtttgatcacactattttag

SEQ ID NO: 2300560 - DNA, 19 bp, Homo sapiens
gtttgcattccagcgtctg

SEQ ID NO: 2300561 - DNA, 23 bp, Homo sapiens
gtttgcattccagcgtctgctgt

SEQ ID NO: 2300562 - DNA, 24 bp, Homo sapiens
gtttgcattccagcgtctgctgtt

SEQ ID NO: 2300563 - DNA, 19 bp, Homo sapiens
gtttggggaggggggcggt

SEQ ID NO: 2300564 - DNA, 20 bp, Homo sapiens
gtttgtaaatgttatttctg

SEQ ID NO: 2300565 - DNA, 23 bp, Homo sapiens
gttttaaagggagccatgctctt

SEQ ID NO: 2300566 - DNA, 14 bp, Homo sapiens
gttttaagaaatgt

SEQ ID NO: 2300567 - DNA, 22 bp, Homo sapiens
gttttagaaattctataagaga

SEQ ID NO: 2300568 - DNA, 18 bp, Homo sapiens
gttttagagataaatatt

SEQ ID NO: 2300569 - DNA, 20 bp, Homo sapiens
gttttagagataaatattta

SEQ ID NO: 2300570 - DNA, 19 bp, Homo sapiens
gttttatgtcatactctgt

SEQ ID NO: 2300571 - DNA, 17 bp, Homo sapiens
gttttcattattttccc

SEQ ID NO: 2300572 - DNA, 16 bp, Homo sapiens
gttttctaaatgtttc

SEQ ID NO: 2300573 - DNA, 17 bp, Homo sapiens
gttttctaaatgtttct

SEQ ID NO: 2300574 - DNA, 10 bp, Homo sapiens
gttttctctg

SEQ ID NO: 2300575 - DNA, 14 bp, Homo sapiens
gttttggctgctct

SEQ ID NO: 2300576 - DNA, 15 bp, Homo sapiens
gttttggctgctctc

SEQ ID NO: 2300577 - DNA, 12 bp, Homo sapiens
gtttttctcaaa

SEQ ID NO: 2300578 - DNA, 15 bp, Homo sapiens
gtttttcttgctatg

SEQ ID NO: 2300579 - DNA, 12 bp, Homo sapiens
gtttttgaagaa

SEQ ID NO: 2300580 - DNA, 20 bp, Homo sapiens
gtttttgaagaagggaaatt

SEQ ID NO: 2300581 - DNA, 17 bp, Homo sapiens
gttttttaataaaagtt

SEQ ID NO: 2300582 - DNA, 16 bp, Homo sapiens
gttttttaggaatcag

SEQ ID NO: 2300583 - DNA, 14 bp, Homo sapiens
taaaaaaataacat

SEQ ID NO: 2300584 - DNA, 14 bp, Homo sapiens
taaaaaagaagagg

SEQ ID NO: 2300585 - DNA, 14 bp, Homo sapiens
taaaaaataactgt

SEQ ID NO: 2300586 - DNA, 13 bp, Homo sapiens
taaaaacataaaa

SEQ ID NO: 2300587 - DNA, 17 bp, Homo sapiens
taaaaacataaaatata

SEQ ID NO: 2300588 - DNA, 19 bp, Homo sapiens
taaaaactgcccattgtaa

SEQ ID NO: 2300589 - DNA, 17 bp, Homo sapiens
taaaaagtggaatttct

SEQ ID NO: 2300590 - DNA, 18 bp, Homo sapiens
taaaaagtggaatttctt

SEQ ID NO: 2300591 - DNA, 22 bp, Homo sapiens
taaaaataaccaaaaaatgtga

SEQ ID NO: 2300592 - DNA, 17 bp, Homo sapiens
taaaaattctagtctgt

SEQ ID NO: 2300593 - DNA, 22 bp, Homo sapiens
taaaacacaacatctttttcta

SEQ ID NO: 2300594 - DNA, 16 bp, Homo sapiens
taaaacagtgaaagcc

SEQ ID NO: 2300595 - DNA, 23 bp, Homo sapiens
taaaaccttacttaaagcttgtt

SEQ ID NO: 2300596 - DNA, 13 bp, Homo sapiens
taaaagctttaga

SEQ ID NO: 2300597 - DNA, 18 bp, Homo sapiens
taaaagctttagattgaa

SEQ ID NO: 2300598 - DNA, 22 bp, Homo sapiens
taaaagctttagattgaaattt

SEQ ID NO: 2300599 - DNA, 14 bp, Homo sapiens
taaaataaataatc

SEQ ID NO: 2300600 - DNA, 14 bp, Homo sapiens
taaaataatgattt

SEQ ID NO: 2300601 - DNA, 18 bp, Homo sapiens
taaaataatgatttaagc

SEQ ID NO: 2300602 - DNA, 21 bp, Homo sapiens
taaaatacataaaagaatgta

SEQ ID NO: 2300603 - DNA, 15 bp, Homo sapiens
taaaatagttttcta

SEQ ID NO: 2300604 - DNA, 21 bp, Homo sapiens
taaaatagttttctaaatgtt

SEQ ID NO: 2300605 - DNA, 18 bp, Homo sapiens
taaaatatacaaacatgt

SEQ ID NO: 2300606 - DNA, 21 bp, Homo sapiens
taaaatattgtgtaagaatca

SEQ ID NO: 2300607 - DNA, 12 bp, Homo sapiens
taaaatcaactt

SEQ ID NO: 2300608 - DNA, 14 bp, Homo sapiens
taaaatcaactttt

SEQ ID NO: 2300609 - DNA, 19 bp, Homo sapiens
taaaatgagggacttccct

SEQ ID NO: 2300610 - DNA, 12 bp, Homo sapiens
taaaatgcaaat

SEQ ID NO: 2300611 - DNA, 19 bp, Homo sapiens
taaaatgctattttaaaat

SEQ ID NO: 2300612 - DNA, 22 bp, Homo sapiens
taaaatgctattttaaaattca

SEQ ID NO: 2300613 - DNA, 19 bp, Homo sapiens
taaaatgtttacattttct

SEQ ID NO: 2300614 - DNA, 23 bp, Homo sapiens
taaaatgtttacattttctttca

SEQ ID NO: 2300615 - DNA, 14 bp, Homo sapiens
taaaattcaacaaa

SEQ ID NO: 2300616 - DNA, 18 bp, Homo sapiens
taaaattcaacaaatgat

SEQ ID NO: 2300617 - DNA, 14 bp, Homo sapiens
taaaattcatatta

SEQ ID NO: 2300618 - DNA, 18 bp, Homo sapiens
taaaattgtgttcttaaa

SEQ ID NO: 2300619 - DNA, 22 bp, Homo sapiens
taaaattgtgttcttaaaatat

SEQ ID NO: 2300620 - DNA, 18 bp, Homo sapiens
taaacacacttagaatac

SEQ ID NO: 2300621 - DNA, 19 bp, Homo sapiens
taaacagaagcctgtttca

SEQ ID NO: 2300622 - DNA, 21 bp, Homo sapiens
taaacctgtgctttcatgttt

SEQ ID NO: 2300623 - DNA, 14 bp, Homo sapiens
taaactctgaaatc

SEQ ID NO: 2300624 - DNA, 15 bp, Homo sapiens
taaactgatgtatag

SEQ ID NO: 2300625 - DNA, 20 bp, Homo sapiens
taaagaaaaaaatagtttta

SEQ ID NO: 2300626 - DNA, 14 bp, Homo sapiens
taaagaaaaagata

SEQ ID NO: 2300627 - DNA, 14 bp, Homo sapiens
taaagaaacacttt

SEQ ID NO: 2300628 - DNA, 18 bp, Homo sapiens
taaagaatttgaaagttt

SEQ ID NO: 2300629 - DNA, 20 bp, Homo sapiens
taaagacagaaaaaaataaa

SEQ ID NO: 2300630 - DNA, 22 bp, Homo sapiens
taaagacagaaaaaaataaaaa

SEQ ID NO: 2300631 - DNA, 13 bp, Homo sapiens
taaagacatttaa

SEQ ID NO: 2300632 - DNA, 21 bp, Homo sapiens
taaagacatttaaaatagttt

SEQ ID NO: 2300633 - DNA, 22 bp, Homo sapiens
taaagaggcgtcttgtattttc

SEQ ID NO: 2300634 - DNA, 23 bp, Homo sapiens
taaagaggcgtcttgtattttct

SEQ ID NO: 2300635 - DNA, 17 bp, Homo sapiens
taaagatctcggtgctg

SEQ ID NO: 2300636 - DNA, 20 bp, Homo sapiens
taaaggactggtttttaagt

SEQ ID NO: 2300637 - DNA, 22 bp, Homo sapiens
taaagttagaatctattttcta

SEQ ID NO: 2300638 - DNA, 20 bp, Homo sapiens
taaagttagggcatttttct

SEQ ID NO: 2300639 - DNA, 16 bp, Homo sapiens
taaataaaaatattct

SEQ ID NO: 2300640 - DNA, 13 bp, Homo sapiens
taaataaaacaat

SEQ ID NO: 2300641 - DNA, 17 bp, Homo sapiens
taaataaaacaatgtaa

SEQ ID NO: 2300642 - DNA, 14 bp, Homo sapiens
taaataaagaagaa

SEQ ID NO: 2300643 - DNA, 15 bp, Homo sapiens
taaataaagaagaaa

SEQ ID NO: 2300644 - DNA, 21 bp, Homo sapiens
taaataaagaagaaaataacc

SEQ ID NO: 2300645 - DNA, 23 bp, Homo sapiens
taaataagcgtttaatggtatct

SEQ ID NO: 2300646 - DNA, 14 bp, Homo sapiens
taaataatgatctt

SEQ ID NO: 2300647 - DNA, 18 bp, Homo sapiens
taaataatgcttaacata

SEQ ID NO: 2300648 - DNA, 16 bp, Homo sapiens
taaatagcatctgctc

SEQ ID NO: 2300649 - DNA, 21 bp, Homo sapiens
taaataggtttttcttgctat

SEQ ID NO: 2300650 - DNA, 20 bp, Homo sapiens
taaatagtttacttcacttt

SEQ ID NO: 2300651 - DNA, 15 bp, Homo sapiens
taaatataaaataca

SEQ ID NO: 2300652 - DNA, 20 bp, Homo sapiens
taaatatacagcatgagatt

SEQ ID NO: 2300653 - DNA, 13 bp, Homo sapiens
taaatatttatgc

SEQ ID NO: 2300654 - DNA, 21 bp, Homo sapiens
taaatatttatgcagaaggta

SEQ ID NO: 2300655 - DNA, 18 bp, Homo sapiens
taaatatttcaataactt

SEQ ID NO: 2300656 - DNA, 13 bp, Homo sapiens
taaatcatttcat

SEQ ID NO: 2300657 - DNA, 14 bp, Homo sapiens
taaatccattttct

SEQ ID NO: 2300658 - DNA, 15 bp, Homo sapiens
taaatccattttcta

SEQ ID NO: 2300659 - DNA, 16 bp, Homo sapiens
taaatccattttctaa

SEQ ID NO: 2300660 - DNA, 19 bp, Homo sapiens
taaatccattttctaaact

SEQ ID NO: 2300661 - DNA, 16 bp, Homo sapiens
taaatctgtctgattc

SEQ ID NO: 2300662 - DNA, 20 bp, Homo sapiens
taaatctgtctgattctatg

SEQ ID NO: 2300663 - DNA, 18 bp, Homo sapiens
taaatgcaaacactgtgt

SEQ ID NO: 2300664 - DNA, 16 bp, Homo sapiens
taaatgctatggaaat

SEQ ID NO: 2300665 - DNA, 22 bp, Homo sapiens
taaatgctatggaaatacattt

SEQ ID NO: 2300666 - DNA, 12 bp, Homo sapiens
taaatgctttaa

SEQ ID NO: 2300667 - DNA, 14 bp, Homo sapiens
taaatgctttaaat

SEQ ID NO: 2300668 - DNA, 16 bp, Homo sapiens
taaatgctttaaatag

SEQ ID NO: 2300669 - DNA, 13 bp, Homo sapiens
taaatgtgtaaat

SEQ ID NO: 2300670 - DNA, 21 bp, Homo sapiens
taaatgttatttctgcaaaca

SEQ ID NO: 2300671 - DNA, 14 bp, Homo sapiens
taaatgtttcatga

SEQ ID NO: 2300672 - DNA, 18 bp, Homo sapiens
taaatgtttcatgaagaa

SEQ ID NO: 2300673 - DNA, 18 bp, Homo sapiens
taaatgtttctttttctt

SEQ ID NO: 2300674 - DNA, 13 bp, Homo sapiens
taaattataaatg

SEQ ID NO: 2300675 - DNA, 22 bp, Homo sapiens
taaattataaatgtttcatgaa

SEQ ID NO: 2300676 - DNA, 18 bp, Homo sapiens
taaattcaacacttattt

SEQ ID NO: 2300677 - DNA, 21 bp, Homo sapiens
taaattcaacacttattttct

SEQ ID NO: 2300678 - DNA, 22 bp, Homo sapiens
taaattcaacacttattttctg

SEQ ID NO: 2300679 - DNA, 23 bp, Homo sapiens
taaattcaacacttattttctga

SEQ ID NO: 2300680 - DNA, 18 bp, Homo sapiens
taaatttaactgcatata

SEQ ID NO: 2300681 - DNA, 16 bp, Homo sapiens
taaatttaatatactg

SEQ ID NO: 2300682 - DNA, 20 bp, Homo sapiens
taaattttaatgtaaaattc

SEQ ID NO: 2300683 - DNA, 22 bp, Homo sapiens
taaattttaatgtaaaattcat

SEQ ID NO: 2300684 - DNA, 19 bp, Homo sapiens
taaattttataatgtcata

SEQ ID NO: 2300685 - DNA, 16 bp, Homo sapiens
taacaacaacttaatg

SEQ ID NO: 2300686 - DNA, 18 bp, Homo sapiens
taacaagccaaacattct

SEQ ID NO: 2300687 - DNA, 21 bp, Homo sapiens
taacaagccaaacattcttat

SEQ ID NO: 2300688 - DNA, 12 bp, Homo sapiens
taacagatattt

SEQ ID NO: 2300689 - DNA, 18 bp, Homo sapiens
taacagatatttaaattt

SEQ ID NO: 2300690 - DNA, 23 bp, Homo sapiens
taacagcatccccaaaacaaagt

SEQ ID NO: 2300691 - DNA, 20 bp, Homo sapiens
taacagctaatctttaatat

SEQ ID NO: 2300692 - DNA, 20 bp, Homo sapiens
taacagttggtgattttaga

SEQ ID NO: 2300693 - DNA, 19 bp, Homo sapiens
taacataaacttgtactta

SEQ ID NO: 2300694 - DNA, 12 bp, Homo sapiens
taacatattctt

SEQ ID NO: 2300695 - DNA, 22 bp, Homo sapiens
taacatattcttgctttcacaa

SEQ ID NO: 2300696 - DNA, 13 bp, Homo sapiens
taacatctgaaaa

SEQ ID NO: 2300697 - DNA, 16 bp, Homo sapiens
taacatctgaaaagaa

SEQ ID NO: 2300698 - DNA, 14 bp, Homo sapiens
taaccaaaaaatgt

SEQ ID NO: 2300699 - DNA, 21 bp, Homo sapiens
taaccaacattttaaaaataa

SEQ ID NO: 2300700 - DNA, 14 bp, Homo sapiens
taacccaaaagatt

SEQ ID NO: 2300701 - DNA, 22 bp, Homo sapiens
taacctgggttgttgcagagta

SEQ ID NO: 2300702 - DNA, 14 bp, Homo sapiens
taacctttcaggaa

SEQ ID NO: 2300703 - DNA, 22 bp, Homo sapiens
taactactaagaataaataaag

SEQ ID NO: 2300704 - DNA, 16 bp, Homo sapiens
taactagatctcctgt

SEQ ID NO: 2300705 - DNA, 19 bp, Homo sapiens
taactagcctttttggtat

SEQ ID NO: 2300706 - DNA, 19 bp, Homo sapiens
taactcaatcatgaatgaa

SEQ ID NO: 2300707 - DNA, 23 bp, Homo sapiens
taactgatgagatacatttgatc

SEQ ID NO: 2300708 - DNA, 16 bp, Homo sapiens
taactggatattcttt

SEQ ID NO: 2300709 - DNA, 12 bp, Homo sapiens
taactggcccca

SEQ ID NO: 2300710 - DNA, 16 bp, Homo sapiens
taactggccccaggcg

SEQ ID NO: 2300711 - DNA, 19 bp, Homo sapiens
taactgttaacccagtgtt

SEQ ID NO: 2300712 - DNA, 21 bp, Homo sapiens
taactgttaacccagtgttca

SEQ ID NO: 2300713 - DNA, 14 bp, Homo sapiens
taactgttagaatt

SEQ ID NO: 2300714 - DNA, 15 bp, Homo sapiens
taagaaatgagaaat

SEQ ID NO: 2300715 - DNA, 17 bp, Homo sapiens
taagaaatgagaaattg

SEQ ID NO: 2300716 - DNA, 20 bp, Homo sapiens
taagaacagaacagcaagta

SEQ ID NO: 2300717 - DNA, 19 bp, Homo sapiens
taagaaccttttgagtgcc

SEQ ID NO: 2300718 - DNA, 21 bp, Homo sapiens
taagaagcgaacaaaaagtaa

SEQ ID NO: 2300719 - DNA, 21 bp, Homo sapiens
taagaataaataaagaagaaa

SEQ ID NO: 2300720 - DNA, 16 bp, Homo sapiens
taagaatataaatatt

SEQ ID NO: 2300721 - DNA, 13 bp, Homo sapiens
taagagaaatggt

SEQ ID NO: 2300722 - DNA, 20 bp, Homo sapiens
taagagaaatggtagaagat

SEQ ID NO: 2300723 - DNA, 12 bp, Homo sapiens
taagagacaaag

SEQ ID NO: 2300724 - DNA, 22 bp, Homo sapiens
taagatgggcatagggtttgga

SEQ ID NO: 2300725 - DNA, 12 bp, Homo sapiens
taagattgtaca

SEQ ID NO: 2300726 - DNA, 14 bp, Homo sapiens
taagattgtacata

SEQ ID NO: 2300727 - DNA, 18 bp, Homo sapiens
taagcacacttgacatca

SEQ ID NO: 2300728 - DNA, 15 bp, Homo sapiens
taagcattttactgt

SEQ ID NO: 2300729 - DNA, 15 bp, Homo sapiens
taagcttatttctaa

SEQ ID NO: 2300730 - DNA, 15 bp, Homo sapiens
taaggaaaagagaaa

SEQ ID NO: 2300731 - DNA, 21 bp, Homo sapiens
taaggaagaataaaaaagaag

SEQ ID NO: 2300732 - DNA, 18 bp, Homo sapiens
taagtaaggggcaaaaaa

SEQ ID NO: 2300733 - DNA, 14 bp, Homo sapiens
taagtccacttaaa

SEQ ID NO: 2300734 - DNA, 17 bp, Homo sapiens
taagtccagctctcccc

SEQ ID NO: 2300735 - DNA, 15 bp, Homo sapiens
taagtgctcagtatt

SEQ ID NO: 2300736 - DNA, 14 bp, Homo sapiens
taagtggaagacag

SEQ ID NO: 2300737 - DNA, 20 bp, Homo sapiens
taagtggaagacagagatgg

SEQ ID NO: 2300738 - DNA, 16 bp, Homo sapiens
taagtggacccagctg

SEQ ID NO: 2300739 - DNA, 17 bp, Homo sapiens
taagtttgtctacacta

SEQ ID NO: 2300740 - DNA, 19 bp, Homo sapiens
taataacaacaacttaatg

SEQ ID NO: 2300741 - DNA, 19 bp, Homo sapiens
taataactagatctcctgt

SEQ ID NO: 2300742 - DNA, 21 bp, Homo sapiens
taataactagatctcctgtaa

SEQ ID NO: 2300743 - DNA, 23 bp, Homo sapiens
taataataacaacaacttaatgt

SEQ ID NO: 2300744 - DNA, 18 bp, Homo sapiens
taataattacttaatgtg

SEQ ID NO: 2300745 - DNA, 14 bp, Homo sapiens
taataccaactatt

SEQ ID NO: 2300746 - DNA, 18 bp, Homo sapiens
taataccaactatttcaa

SEQ ID NO: 2300747 - DNA, 14 bp, Homo sapiens
taatagaaaactgt

SEQ ID NO: 2300748 - DNA, 22 bp, Homo sapiens
taatagaagtccatgagttgag

SEQ ID NO: 2300749 - DNA, 14 bp, Homo sapiens
taatataactgtct

SEQ ID NO: 2300750 - DNA, 15 bp, Homo sapiens
taatatactgcatat

SEQ ID NO: 2300751 - DNA, 16 bp, Homo sapiens
taatatactgcatatc

SEQ ID NO: 2300752 - DNA, 13 bp, Homo sapiens
taatatagaaaga

SEQ ID NO: 2300753 - DNA, 14 bp, Homo sapiens
taatatatatatat

SEQ ID NO: 2300754 - DNA, 19 bp, Homo sapiens
taatatatatatatatcag

SEQ ID NO: 2300755 - DNA, 16 bp, Homo sapiens
taatatcttgaagaat

SEQ ID NO: 2300756 - DNA, 18 bp, Homo sapiens
taatatcttgaagaatat

SEQ ID NO: 2300757 - DNA, 22 bp, Homo sapiens
taatatcttgaagaatattgtt

SEQ ID NO: 2300758 - DNA, 19 bp, Homo sapiens
taatatgaatatatacata

SEQ ID NO: 2300759 - DNA, 17 bp, Homo sapiens
taatatgtacttttcca

SEQ ID NO: 2300760 - DNA, 22 bp, Homo sapiens
taatatgtacttttccatttat

SEQ ID NO: 2300761 - DNA, 15 bp, Homo sapiens
taatattacatttca

SEQ ID NO: 2300762 - DNA, 16 bp, Homo sapiens
taatattacatttcat

SEQ ID NO: 2300763 - DNA, 16 bp, Homo sapiens
taatattttgtattat

SEQ ID NO: 2300764 - DNA, 20 bp, Homo sapiens
taatattttgtattattgct

SEQ ID NO: 2300765 - DNA, 20 bp, Homo sapiens
taatcagggaccaccagagg

SEQ ID NO: 2300766 - DNA, 16 bp, Homo sapiens
taatcatatcaactta

SEQ ID NO: 2300767 - DNA, 15 bp, Homo sapiens
taatcatgggttcct

SEQ ID NO: 2300768 - DNA, 16 bp, Homo sapiens
taatcatgggttcctc

SEQ ID NO: 2300769 - DNA, 19 bp, Homo sapiens
taatcatttatcttatcta

SEQ ID NO: 2300770 - DNA, 20 bp, Homo sapiens
taatctctaaaattctagtc

SEQ ID NO: 2300771 - DNA, 22 bp, Homo sapiens
taatctctgattaaatttaata

SEQ ID NO: 2300772 - DNA, 23 bp, Homo sapiens
taatctctgattaaatttaatat

SEQ ID NO: 2300773 - DNA, 14 bp, Homo sapiens
taatctctttccat

SEQ ID NO: 2300774 - DNA, 14 bp, Homo sapiens
taatcttttctgag

SEQ ID NO: 2300775 - DNA, 13 bp, Homo sapiens
taatgaggaaact

SEQ ID NO: 2300776 - DNA, 19 bp, Homo sapiens
taatgatcttccaaatatt

SEQ ID NO: 2300777 - DNA, 22 bp, Homo sapiens
taatgcattattttgtcataaa

SEQ ID NO: 2300778 - DNA, 22 bp, Homo sapiens
taatgcttaacataaacttgta

SEQ ID NO: 2300779 - DNA, 15 bp, Homo sapiens
taatggccaagtgta

SEQ ID NO: 2300780 - DNA, 17 bp, Homo sapiens
taatgtatatctgtaat

SEQ ID NO: 2300781 - DNA, 14 bp, Homo sapiens
taatgtatcttatt

SEQ ID NO: 2300782 - DNA, 13 bp, Homo sapiens
taatgtcatctct

SEQ ID NO: 2300783 - DNA, 12 bp, Homo sapiens
taatgtgccaaa

SEQ ID NO: 2300784 - DNA, 18 bp, Homo sapiens
taatgtttccctcaagaa

SEQ ID NO: 2300785 - DNA, 16 bp, Homo sapiens
taattatattatgaat

SEQ ID NO: 2300786 - DNA, 19 bp, Homo sapiens
taattcccatctgctttat

SEQ ID NO: 2300787 - DNA, 18 bp, Homo sapiens
taattcctggaaaactgg

SEQ ID NO: 2300788 - DNA, 11 bp, Homo sapiens
taattgggtga

SEQ ID NO: 2300789 - DNA, 14 bp, Homo sapiens
taattgtggcttta

SEQ ID NO: 2300790 - DNA, 13 bp, Homo sapiens
taattgtgtaact

SEQ ID NO: 2300791 - DNA, 15 bp, Homo sapiens
taattgtgtaactgt

SEQ ID NO: 2300792 - DNA, 16 bp, Homo sapiens
taattgtgtaactgtt

SEQ ID NO: 2300793 - DNA, 16 bp, Homo sapiens
taattgttacaatttt

SEQ ID NO: 2300794 - DNA, 16 bp, Homo sapiens
taatttatgaagatag

SEQ ID NO: 2300795 - DNA, 17 bp, Homo sapiens
taatttatgaagatagt

SEQ ID NO: 2300796 - DNA, 21 bp, Homo sapiens
taatttatgaagatagtttat

SEQ ID NO: 2300797 - DNA, 10 bp, Homo sapiens
taatttcaag

SEQ ID NO: 2300798 - DNA, 19 bp, Homo sapiens
taatttgccagacagagat

SEQ ID NO: 2300799 - DNA, 13 bp, Homo sapiens
tacaaacaaagga

SEQ ID NO: 2300800 - DNA, 14 bp, Homo sapiens
tacaaacaaaggat

SEQ ID NO: 2300801 - DNA, 19 bp, Homo sapiens
tacaaacaaaggatttgaa

SEQ ID NO: 2300802 - DNA, 14 bp, Homo sapiens
tacaaagctgtcac

SEQ ID NO: 2300803 - DNA, 15 bp, Homo sapiens
tacaaagctgtcact

SEQ ID NO: 2300804 - DNA, 18 bp, Homo sapiens
tacaacttgatactttta

SEQ ID NO: 2300805 - DNA, 15 bp, Homo sapiens
tagcatcctgattat

SEQ ID NO: 2300806 - DNA, 18 bp, Homo sapiens
tagcatcctgattattga

SEQ ID NO: 2300807 - DNA, 20 bp, Homo sapiens
tagcatcctgattattgaat

SEQ ID NO: 2300808 - DNA, 22 bp, Homo sapiens
tagcattaaatataaaatacat

SEQ ID NO: 2300809 - DNA, 15 bp, Homo sapiens
tagcattttggcgct

SEQ ID NO: 2300810 - DNA, 22 bp, Homo sapiens
tagccaacttaaacctgtgctt

SEQ ID NO: 2300811 - DNA, 14 bp, Homo sapiens
tagccagaatgttt

SEQ ID NO: 2300812 - DNA, 15 bp, Homo sapiens
tagccagaatgtttc

SEQ ID NO: 2300813 - DNA, 15 bp, Homo sapiens
tagcccggccaagga

SEQ ID NO: 2300814 - DNA, 23 bp, Homo sapiens
tagcccggccaaggacactgatg

SEQ ID NO: 2300815 - DNA, 19 bp, Homo sapiens
tagcctcgtctttcagcga

SEQ ID NO: 2300816 - DNA, 13 bp, Homo sapiens
tagcctttctttt

SEQ ID NO: 2300817 - DNA, 13 bp, Homo sapiens
tagctagaatatc

SEQ ID NO: 2300818 - DNA, 14 bp, Homo sapiens
taggaaaaactgat

SEQ ID NO: 2300819 - DNA, 21 bp, Homo sapiens
taggaaagagttgagcacagg

SEQ ID NO: 2300820 - DNA, 19 bp, Homo sapiens
taggaacagagtatatatg

SEQ ID NO: 2300821 - DNA, 19 bp, Homo sapiens
taggaacccggcatgccga

SEQ ID NO: 2300822 - DNA, 21 bp, Homo sapiens
taggactaaataatgatcttc

SEQ ID NO: 2300823 - DNA, 18 bp, Homo sapiens
taggaggaatgtgctttt

SEQ ID NO: 2300824 - DNA, 22 bp, Homo sapiens
taggaggaatgtgcttttccat

SEQ ID NO: 2300825 - DNA, 13 bp, Homo sapiens
taggagtggctga

SEQ ID NO: 2300826 - DNA, 22 bp, Homo sapiens
taggagtggctgaccaggccct

SEQ ID NO: 2300827 - DNA, 13 bp, Homo sapiens
taggataaaccaa

SEQ ID NO: 2300828 - DNA, 18 bp, Homo sapiens
taggcctcagtgtcctca

SEQ ID NO: 2300829 - DNA, 20 bp, Homo sapiens
taggcctcagtgtcctcatc

SEQ ID NO: 2300830 - DNA, 19 bp, Homo sapiens
taggctattataatataga

SEQ ID NO: 2300831 - DNA, 12 bp, Homo sapiens
taggctgtattt

SEQ ID NO: 2300832 - DNA, 16 bp, Homo sapiens
taggctgtattttctt

SEQ ID NO: 2300833 - DNA, 23 bp, Homo sapiens
taggctgtggtgcagtaaccatt

SEQ ID NO: 2300834 - DNA, 16 bp, Homo sapiens
tagggcatttttcttg

SEQ ID NO: 2300835 - DNA, 20 bp, Homo sapiens
tagggcatttttcttggatc

SEQ ID NO: 2300836 - DNA, 16 bp, Homo sapiens
taggtcaatgaaatat

SEQ ID NO: 2300837 - DNA, 22 bp, Homo sapiens
taggtggtaaaacctgttctcc

SEQ ID NO: 2300838 - DNA, 15 bp, Homo sapiens
taggtttttcttgct

SEQ ID NO: 2300839 - DNA, 20 bp, Homo sapiens
tagtaaataatgattcaatg

SEQ ID NO: 2300840 - DNA, 15 bp, Homo sapiens
tagtaatggcagagc

SEQ ID NO: 2300841 - DNA, 21 bp, Homo sapiens
tagtagagcaaagacttaatc

SEQ ID NO: 2300842 - DNA, 16 bp, Homo sapiens
tagtaggctaaaaaca

SEQ ID NO: 2300843 - DNA, 17 bp, Homo sapiens
tagtagttgatgaccaa

SEQ ID NO: 2300844 - DNA, 18 bp, Homo sapiens
tagtatttgtatcctggc

SEQ ID NO: 2300845 - DNA, 18 bp, Homo sapiens
tagtcaactgctgtttta

SEQ ID NO: 2300846 - DNA, 15 bp, Homo sapiens
tagtcatatttttgt

SEQ ID NO: 2300847 - DNA, 15 bp, Homo sapiens
tagtccaatgaagat

SEQ ID NO: 2300848 - DNA, 15 bp, Homo sapiens
tagtcctccaaaaca

SEQ ID NO: 2300849 - DNA, 17 bp, Homo sapiens
tagtcctccaaaacaca

SEQ ID NO: 2300850 - DNA, 20 bp, Homo sapiens
tagtgagatttgtatttata

SEQ ID NO: 2300851 - DNA, 23 bp, Homo sapiens
tagtgagtgtggcttagtaatag

SEQ ID NO: 2300852 - DNA, 22 bp, Homo sapiens
tagtgatacactgtatctaaaa

SEQ ID NO: 2300853 - DNA, 16 bp, Homo sapiens
tagtgctcagaatcca

SEQ ID NO: 2300854 - DNA, 17 bp, Homo sapiens
tagtggcttcagcccct

SEQ ID NO: 2300855 - DNA, 17 bp, Homo sapiens
tagtgttgaggagggga

SEQ ID NO: 2300856 - DNA, 20 bp, Homo sapiens
tagtgttttaagaaatgtag

SEQ ID NO: 2300857 - DNA, 15 bp, Homo sapiens
tagttaggtgtgcca

SEQ ID NO: 2300858 - DNA, 17 bp, Homo sapiens
tagttaggtgtgccaaa

SEQ ID NO: 2300859 - DNA, 15 bp, Homo sapiens
tagttcacttactct

SEQ ID NO: 2300860 - DNA, 18 bp, Homo sapiens
tagttccattctatgact

SEQ ID NO: 2300861 - DNA, 14 bp, Homo sapiens
tagttctatttcta

SEQ ID NO: 2300862 - DNA, 18 bp, Homo sapiens
tagttctatttctatctg

SEQ ID NO: 2300863 - DNA, 23 bp, Homo sapiens
tagttctatttctatctgcaaat

SEQ ID NO: 2300864 - DNA, 12 bp, Homo sapiens
tagttctgcaat

SEQ ID NO: 2300865 - DNA, 23 bp, Homo sapiens
tagttctgcaataacagttttaa

SEQ ID NO: 2300866 - DNA, 22 bp, Homo sapiens
tagttgatgaccaatctctgtg

SEQ ID NO: 2300867 - DNA, 18 bp, Homo sapiens
tagttggagctagaaaat

SEQ ID NO: 2300868 - DNA, 16 bp, Homo sapiens
tagtttacttcacttt

SEQ ID NO: 2300869 - DNA, 19 bp, Homo sapiens
tagtttacttcactttcat

SEQ ID NO: 2300870 - DNA, 16 bp, Homo sapiens
tagtttgcatacttcc

SEQ ID NO: 2300871 - DNA, 14 bp, Homo sapiens
tagtttgcattcca

SEQ ID NO: 2300872 - DNA, 21 bp, Homo sapiens
tagtttgcattccagcgtctg

SEQ ID NO: 2300873 - DNA, 13 bp, Homo sapiens
tagttttctaaat

SEQ ID NO: 2300874 - DNA, 16 bp, Homo sapiens
tagtttttcctgtgca

SEQ ID NO: 2300875 - DNA, 13 bp, Homo sapiens
tataaaatacata

SEQ ID NO: 2300876 - DNA, 18 bp, Homo sapiens
tataaaatacataaaaga

SEQ ID NO: 2300877 - DNA, 21 bp, Homo sapiens
tataaacgatatatgtaaata

SEQ ID NO: 2300878 - DNA, 22 bp, Homo sapiens
tataaatgtttcatgaagaaaa

SEQ ID NO: 2300879 - DNA, 17 bp, Homo sapiens
tataacaagccaaacat

SEQ ID NO: 2300880 - DNA, 22 bp, Homo sapiens
tataactacattaaaagcttta

SEQ ID NO: 2300881 - DNA, 13 bp, Homo sapiens
tataatatagaaa

SEQ ID NO: 2300882 - DNA, 14 bp, Homo sapiens
tataatatatatat

SEQ ID NO: 2300883 - DNA, 21 bp, Homo sapiens
tataatttacctgaagtcttt

SEQ ID NO: 2300884 - DNA, 23 bp, Homo sapiens
tataatttgccagacagagatca

SEQ ID NO: 2300885 - DNA, 16 bp, Homo sapiens
tataattttacaaagt

SEQ ID NO: 2300886 - DNA, 14 bp, Homo sapiens
tatacaaagctgtc

SEQ ID NO: 2300887 - DNA, 19 bp, Homo sapiens
tatacaaagctgtcactca

SEQ ID NO: 2300888 - DNA, 21 bp, Homo sapiens
tatacaaagctgtcactcaca

SEQ ID NO: 2300889 - DNA, 18 bp, Homo sapiens
tatacagacctccagatt

SEQ ID NO: 2300890 - DNA, 21 bp, Homo sapiens
tatacagtttttgtaaccata

SEQ ID NO: 2300891 - DNA, 22 bp, Homo sapiens
tatacagtttttgtaaccatat

SEQ ID NO: 2300892 - DNA, 17 bp, Homo sapiens
tatacatacctctctct

SEQ ID NO: 2300893 - DNA, 16 bp, Homo sapiens
tatacatgtatagtga

SEQ ID NO: 2300894 - DNA, 13 bp, Homo sapiens
tatacatttagtt

SEQ ID NO: 2300895 - DNA, 20 bp, Homo sapiens
tataccccgtgaagcatcca

SEQ ID NO: 2300896 - DNA, 22 bp, Homo sapiens
tatactgcatatcctggtgtct

SEQ ID NO: 2300897 - DNA, 17 bp, Homo sapiens
tatactgtagcaatata

SEQ ID NO: 2300898 - DNA, 17 bp, Homo sapiens
tatagacagtttgtaaa

SEQ ID NO: 2300899 - DNA, 21 bp, Homo sapiens
tatagacagtttgtaaatgtt

SEQ ID NO: 2300900 - DNA, 16 bp, Homo sapiens
tataggaaaatacatt

SEQ ID NO: 2300901 - DNA, 22 bp, Homo sapiens
tatagttaattgtggctttatg

SEQ ID NO: 2300902 - DNA, 14 bp, Homo sapiens
tatatacataaaaa

SEQ ID NO: 2300903 - DNA, 21 bp, Homo sapiens
tatatagttacaacattaatt

SEQ ID NO: 2300904 - DNA, 13 bp, Homo sapiens
tatatatatatgt

SEQ ID NO: 2300905 - DNA, 16 bp, Homo sapiens
tatatatatatgtata

SEQ ID NO: 2300906 - DNA, 11 bp, Homo sapiens
tatatatatca

SEQ ID NO: 2300907 - DNA, 13 bp, Homo sapiens
tatatatatcagt

SEQ ID NO: 2300908 - DNA, 15 bp, Homo sapiens
tatatatatgtatat

SEQ ID NO: 2300909 - DNA, 15 bp, Homo sapiens
tatatatcagtttga

SEQ ID NO: 2300910 - DNA, 23 bp, Homo sapiens
tatatatgaagtaagttctgaaa

SEQ ID NO: 2300911 - DNA, 13 bp, Homo sapiens
tatatatgtacag

SEQ ID NO: 2300912 - DNA, 22 bp, Homo sapiens
tatatatgtacagttatacata

SEQ ID NO: 2300913 - DNA, 19 bp, Homo sapiens
tatatatttattattttca

SEQ ID NO: 2300914 - DNA, 11 bp, Homo sapiens
tatatatttcc

SEQ ID NO: 2300915 - DNA, 12 bp, Homo sapiens
tatatatttcca

SEQ ID NO: 2300916 - DNA, 15 bp, Homo sapiens
tatatatttccaaat

SEQ ID NO: 2300917 - DNA, 18 bp, Homo sapiens
tatatatttccaaatatt

SEQ ID NO: 2300918 - DNA, 15 bp, Homo sapiens
tatatatttgaaaga

SEQ ID NO: 2300919 - DNA, 17 bp, Homo sapiens
tatatatttgaaagaag

SEQ ID NO: 2300920 - DNA, 13 bp, Homo sapiens
tatatcagtttga

SEQ ID NO: 2300921 - DNA, 11 bp, Homo sapiens
tatatgtacag

SEQ ID NO: 2300922 - DNA, 12 bp, Homo sapiens
tatatgtacagt

SEQ ID NO: 2300923 - DNA, 13 bp, Homo sapiens
tatatgtacagtt

SEQ ID NO: 2300924 - DNA, 14 bp, Homo sapiens
tatatgtacagtta

SEQ ID NO: 2300925 - DNA, 15 bp, Homo sapiens
tatatgtatatattt

SEQ ID NO: 2300926 - DNA, 20 bp, Homo sapiens
tatatgtatatatttattat

SEQ ID NO: 2300927 - DNA, 15 bp, Homo sapiens
tatatgtcaaaaata

SEQ ID NO: 2300928 - DNA, 20 bp, Homo sapiens
tatattacggaggaacagat

SEQ ID NO: 2300929 - DNA, 12 bp, Homo sapiens
tatattattgct

SEQ ID NO: 2300930 - DNA, 19 bp, Homo sapiens
tatattattgctatatttg

SEQ ID NO: 2300931 - DNA, 21 bp, Homo sapiens
tatattcagagatgtaccatg

SEQ ID NO: 2300932 - DNA, 15 bp, Homo sapiens
tatatttaaaattca

SEQ ID NO: 2300933 - DNA, 12 bp, Homo sapiens
tatatttgaaag

SEQ ID NO: 2300934 - DNA, 12 bp, Homo sapiens
tatcaaatcatt

SEQ ID NO: 2300935 - DNA, 21 bp, Homo sapiens
tatcaaatcattcaaaacttt

SEQ ID NO: 2300936 - DNA, 19 bp, Homo sapiens
tatcaacttaattctgtta

SEQ ID NO: 2300937 - DNA, 13 bp, Homo sapiens
tatcagaactcct

SEQ ID NO: 2300938 - DNA, 21 bp, Homo sapiens
tcaaaaatatttttatgtgaa

SEQ ID NO: 2300939 - DNA, 17 bp, Homo sapiens
tcaaaagtccttagaat

SEQ ID NO: 2300940 - DNA, 21 bp, Homo sapiens
tcaaaatagttctatttctat

SEQ ID NO: 2300941 - DNA, 13 bp, Homo sapiens
tcaaacactgctt

SEQ ID NO: 2300942 - DNA, 19 bp, Homo sapiens
tcaaacactgcttaaggaa

SEQ ID NO: 2300943 - DNA, 13 bp, Homo sapiens
tcaaactgggtat

SEQ ID NO: 2300944 - DNA, 17 bp, Homo sapiens
tcaaagaaaacagacca

SEQ ID NO: 2300945 - DNA, 21 bp, Homo sapiens
tcaaagggtaaattataaatg

SEQ ID NO: 2300946 - DNA, 19 bp, Homo sapiens
tcaaataataataataaca

SEQ ID NO: 2300947 - DNA, 18 bp, Homo sapiens
tcaaatcattcaaaactt

SEQ ID NO: 2300948 - DNA, 22 bp, Homo sapiens
tcaaatgacctagaaacaagga

SEQ ID NO: 2300949 - DNA, 17 bp, Homo sapiens
tcaacacatgagaagaa

SEQ ID NO: 2300950 - DNA, 15 bp, Homo sapiens
tcaacagcatgtcta

SEQ ID NO: 2300951 - DNA, 17 bp, Homo sapiens
tcaacctctcagatccc

SEQ ID NO: 2300952 - DNA, 22 bp, Homo sapiens
tcaactacggttgggagaatga

SEQ ID NO: 2300953 - DNA, 13 bp, Homo sapiens
tcaactcactaga

SEQ ID NO: 2300954 - DNA, 19 bp, Homo sapiens
tcaagaccaaatggaaaca

SEQ ID NO: 2300955 - DNA, 14 bp, Homo sapiens
tcaaggaagagcca

SEQ ID NO: 2300956 - DNA, 16 bp, Homo sapiens
tcaaggaagagccagc

SEQ ID NO: 2300957 - DNA, 19 bp, Homo sapiens
tcaaggaagagccagccgt

SEQ ID NO: 2300958 - DNA, 18 bp, Homo sapiens
tcaaggatcctgagccag

SEQ ID NO: 2300959 - DNA, 19 bp, Homo sapiens
tcaaggatcctgagccaga

SEQ ID NO: 2300960 - DNA, 20 bp, Homo sapiens
tcaagtcattccacacattt

SEQ ID NO: 2300961 - DNA, 15 bp, Homo sapiens
tcaatacttttgtgt

SEQ ID NO: 2300962 - DNA, 21 bp, Homo sapiens
tcaatacttttgtgtattctg

SEQ ID NO: 2300963 - DNA, 17 bp, Homo sapiens
tcaataggaaaaactga

SEQ ID NO: 2300964 - DNA, 12 bp, Homo sapiens
tcaatgaaatat

SEQ ID NO: 2300965 - DNA, 16 bp, Homo sapiens
tcaatgaaatatttgc

SEQ ID NO: 2300966 - DNA, 18 bp, Homo sapiens
tcaatgaaatatttgctt

SEQ ID NO: 2300967 - DNA, 19 bp, Homo sapiens
tcaatgaaatatttgctta

SEQ ID NO: 2300968 - DNA, 17 bp, Homo sapiens
tcaatgaggttatgaga

SEQ ID NO: 2300969 - DNA, 14 bp, Homo sapiens
tcaatgtactgtat

SEQ ID NO: 2300970 - DNA, 19 bp, Homo sapiens
tcaatgtgaaataaagagt

SEQ ID NO: 2300971 - DNA, 18 bp, Homo sapiens
tcaattcatatttatgaa

SEQ ID NO: 2300972 - DNA, 19 bp, Homo sapiens
tcaattcattaataaaata

SEQ ID NO: 2300973 - DNA, 13 bp, Homo sapiens
tcaatttaaagga

SEQ ID NO: 2300974 - DNA, 22 bp, Homo sapiens
tcaatttagtataatatgcagt

SEQ ID NO: 2300975 - DNA, 21 bp, Homo sapiens
tcacaaatagtgttgatcaga

SEQ ID NO: 2300976 - DNA, 20 bp, Homo sapiens
tcacaactgtttttgaagaa

SEQ ID NO: 2300977 - DNA, 13 bp, Homo sapiens
tcacaacttttct

SEQ ID NO: 2300978 - DNA, 15 bp, Homo sapiens
tcacaacttttctgc

SEQ ID NO: 2300979 - DNA, 16 bp, Homo sapiens
tcacaacttttctgct

SEQ ID NO: 2300980 - DNA, 16 bp, Homo sapiens
tcacaagtgaaaactg

SEQ ID NO: 2300981 - DNA, 18 bp, Homo sapiens
tcacaatcatcttctccc

SEQ ID NO: 2300982 - DNA, 11 bp, Homo sapiens
tcacactgtgc

SEQ ID NO: 2300983 - DNA, 18 bp, Homo sapiens
tcacactgtggtgtctct

SEQ ID NO: 2300984 - DNA, 19 bp, Homo sapiens
tcacagacccctgggggag

SEQ ID NO: 2300985 - DNA, 23 bp, Homo sapiens
tcacagctacgtgtgcccctctc

SEQ ID NO: 2300986 - DNA, 23 bp, Homo sapiens
tcacatatttgtagctagaatat

SEQ ID NO: 2300987 - DNA, 17 bp, Homo sapiens
tcacatcatgtaatagt

SEQ ID NO: 2300988 - DNA, 13 bp, Homo sapiens
tcacatctctgta

SEQ ID NO: 2300989 - DNA, 18 bp, Homo sapiens
tcacatgctccttgcctc

SEQ ID NO: 2300990 - DNA, 17 bp, Homo sapiens
tcacatgtggctccccc

SEQ ID NO: 2300991 - DNA, 12 bp, Homo sapiens
tcaccaaaatat

SEQ ID NO: 2300992 - DNA, 16 bp, Homo sapiens
tcaccactgacagatg

SEQ ID NO: 2300993 - DNA, 19 bp, Homo sapiens
tcaccgaaaacgtggctgc

SEQ ID NO: 2300994 - DNA, 21 bp, Homo sapiens
tcaccgaaaacgtggctgctt

SEQ ID NO: 2300995 - DNA, 16 bp, Homo sapiens
tcacctttccaaggcc

SEQ ID NO: 2300996 - DNA, 23 bp, Homo sapiens
tcactctccttggtgtcgggcat

SEQ ID NO: 2300997 - DNA, 22 bp, Homo sapiens
tcactgaataatggaattatgt

SEQ ID NO: 2300998 - DNA, 16 bp, Homo sapiens
tcactgcctgcagctg

SEQ ID NO: 2300999 - DNA, 17 bp, Homo sapiens
tcactgcctgcagctga

SEQ ID NO: 2301000 - DNA, 15 bp, Homo sapiens
tcactgggagaggtt

SEQ ID NO: 2301001 - DNA, 16 bp, Homo sapiens
tcactgtgttgcccag

SEQ ID NO: 2301002 - DNA, 15 bp, Homo sapiens
tcacttaattctcat

SEQ ID NO: 2301003 - DNA, 22 bp, Homo sapiens
tcagaaattttctacagtacat

SEQ ID NO: 2301004 - DNA, 16 bp, Homo sapiens
tcagaactcctttcta

SEQ ID NO: 2301005 - DNA, 17 bp, Homo sapiens
tcagaactcctttctaa

SEQ ID NO: 2301006 - DNA, 17 bp, Homo sapiens
tcagacgacagcccctg

SEQ ID NO: 2301007 - DNA, 17 bp, Homo sapiens
tcagactagagaataat

SEQ ID NO: 2301008 - DNA, 18 bp, Homo sapiens
tcagacttgatttacaag

SEQ ID NO: 2301009 - DNA, 20 bp, Homo sapiens
tcagacttgatttacaagca

SEQ ID NO: 2301010 - DNA, 14 bp, Homo sapiens
tcagataactgggt

SEQ ID NO: 2301011 - DNA, 22 bp, Homo sapiens
tcagatccctcggtcagcaccg

SEQ ID NO: 2301012 - DNA, 15 bp, Homo sapiens
tcagatcttacaagt

SEQ ID NO: 2301013 - DNA, 14 bp, Homo sapiens
tcagcaaattcttg

SEQ ID NO: 2301014 - DNA, 18 bp, Homo sapiens
tcagcaattaaagacatt

SEQ ID NO: 2301015 - DNA, 13 bp, Homo sapiens
tcagcaccactca

SEQ ID NO: 2301016 - DNA, 20 bp, Homo sapiens
tcagcagcctcactgcatct

SEQ ID NO: 2301017 - DNA, 12 bp, Homo sapiens
tcagcatggttt

SEQ ID NO: 2301018 - DNA, 22 bp, Homo sapiens
tcagccaagaattcttaaatat

SEQ ID NO: 2301019 - DNA, 17 bp, Homo sapiens
tcagccgagcccagggg

SEQ ID NO: 2301020 - DNA, 15 bp, Homo sapiens
tcagctacagcaaat

SEQ ID NO: 2301021 - DNA, 12 bp, Homo sapiens
tcagctcagagc

SEQ ID NO: 2301022 - DNA, 14 bp, Homo sapiens
tcagcttgaatgtc

SEQ ID NO: 2301023 - DNA, 21 bp, Homo sapiens
tcagcttgtttctatactgtt

SEQ ID NO: 2301024 - DNA, 23 bp, Homo sapiens
tcaggaccccatctgctgagctc

SEQ ID NO: 2301025 - DNA, 20 bp, Homo sapiens
tcaggaggcagtggcttgga

SEQ ID NO: 2301026 - DNA, 22 bp, Homo sapiens
tcaggaggtgcctgagagcaga

SEQ ID NO: 2301027 - DNA, 23 bp, Homo sapiens
tcaggattctcctttttacccct

SEQ ID NO: 2301028 - DNA, 13 bp, Homo sapiens
tcaggcaaggcag

SEQ ID NO: 2301029 - DNA, 15 bp, Homo sapiens
tcaggcagtagcagc

SEQ ID NO: 2301030 - DNA, 19 bp, Homo sapiens
tcaggcagtagcagctgtg

SEQ ID NO: 2301031 - DNA, 19 bp, Homo sapiens
tcaggcccacattgcccac

SEQ ID NO: 2301032 - DNA, 22 bp, Homo sapiens
tcagggtacaggaaaaaacatt

SEQ ID NO: 2301033 - DNA, 13 bp, Homo sapiens
tcagtcccacagc

SEQ ID NO: 2301034 - DNA, 16 bp, Homo sapiens
tcagtctcaaataata

SEQ ID NO: 2301035 - DNA, 9 bp, Homo sapiens
tcagtgcct

SEQ ID NO: 2301036 - DNA, 11 bp, Homo sapiens
tcagtgcctta

SEQ ID NO: 2301037 - DNA, 19 bp, Homo sapiens
tcagtgccttatggaacac

SEQ ID NO: 2301038 - DNA, 14 bp, Homo sapiens
tcagtgtcctcatc

SEQ ID NO: 2301039 - DNA, 17 bp, Homo sapiens
tcagtgtgactgatctc

SEQ ID NO: 2301040 - DNA, 18 bp, Homo sapiens
tcagtgtgactgatctct

SEQ ID NO: 2301041 - DNA, 22 bp, Homo sapiens
tcagtgtggactgggaagcatt

SEQ ID NO: 2301042 - DNA, 14 bp, Homo sapiens
tcagttatcactac

SEQ ID NO: 2301043 - DNA, 14 bp, Homo sapiens
tcagttcttggcct

SEQ ID NO: 2301044 - DNA, 20 bp, Homo sapiens
tcagttgctctctgttcaag

SEQ ID NO: 2301045 - DNA, 12 bp, Homo sapiens
tcagtttgatca

SEQ ID NO: 2301046 - DNA, 19 bp, Homo sapiens
tcagttttagtttcaaaat

SEQ ID NO: 2301047 - DNA, 21 bp, Homo sapiens
tcagttttagtttcaaaatgt

SEQ ID NO: 2301048 - DNA, 18 bp, Homo sapiens
tcataaaatgctatttta

SEQ ID NO: 2301049 - DNA, 20 bp, Homo sapiens
tcataaaatgctattttaaa

SEQ ID NO: 2301050 - DNA, 22 bp, Homo sapiens
tcataaaatgctattttaaaat

SEQ ID NO: 2301051 - DNA, 12 bp, Homo sapiens
tcataattcatt

SEQ ID NO: 2301052 - DNA, 18 bp, Homo sapiens
tcataattcatttaagaa

SEQ ID NO: 2301053 - DNA, 15 bp, Homo sapiens
tcatactaaataaaa

SEQ ID NO: 2301054 - DNA, 17 bp, Homo sapiens
tcatactaaataaaaca

SEQ ID NO: 2301055 - DNA, 21 bp, Homo sapiens
tcatacttgctccttgaataa

SEQ ID NO: 2301056 - DNA, 12 bp, Homo sapiens
tcatatcaactt

SEQ ID NO: 2301057 - DNA, 12 bp, Homo sapiens
tcatatgtgatc

SEQ ID NO: 2301058 - DNA, 17 bp, Homo sapiens
tcatatgtgatctgtct

SEQ ID NO: 2301059 - DNA, 21 bp, Homo sapiens
tcatatgtgatctgtcttgta

SEQ ID NO: 2301060 - DNA, 23 bp, Homo sapiens
tcatatgtgatctgtcttgtaat

SEQ ID NO: 2301061 - DNA, 21 bp, Homo sapiens
tcatcacccggatagaggaca

SEQ ID NO: 2301062 - DNA, 19 bp, Homo sapiens
tcatcccaatgggggaagt

SEQ ID NO: 2301063 - DNA, 17 bp, Homo sapiens
tcatccgaaagtgagga

SEQ ID NO: 2301064 - DNA, 21 bp, Homo sapiens
tcatcttgtaaataatgctta

SEQ ID NO: 2301065 - DNA, 22 bp, Homo sapiens
tcatgcaaaaaaaaaaatgtca

SEQ ID NO: 2301066 - DNA, 17 bp, Homo sapiens
tcatgccgctgtgtcta

SEQ ID NO: 2301067 - DNA, 16 bp, Homo sapiens
tcatggaccactgttt

SEQ ID NO: 2301068 - DNA, 21 bp, Homo sapiens
tcatggaccactgtttcttgc

SEQ ID NO: 2301069 - DNA, 19 bp, Homo sapiens
tcatgggagtcagggagcc

SEQ ID NO: 2301070 - DNA, 16 bp, Homo sapiens
tccccggacgctggct

SEQ ID NO: 2301071 - DNA, 14 bp, Homo sapiens
tccccggagctggg

SEQ ID NO: 2301072 - DNA, 22 bp, Homo sapiens
tccccggcatcatttcccctcc

SEQ ID NO: 2301073 - DNA, 20 bp, Homo sapiens
tccccgtgcggcccgtgcgc

SEQ ID NO: 2301074 - DNA, 17 bp, Homo sapiens
tcccctaacctgggttg

SEQ ID NO: 2301075 - DNA, 14 bp, Homo sapiens
tcccctctcctagc

SEQ ID NO: 2301076 - DNA, 17 bp, Homo sapiens
tcccctgcctgtgagtg

SEQ ID NO: 2301077 - DNA, 16 bp, Homo sapiens
tcccctgcgcaggccc

SEQ ID NO: 2301078 - DNA, 22 bp, Homo sapiens
tcccctggtgcccctccactct

SEQ ID NO: 2301079 - DNA, 19 bp, Homo sapiens
tccccttcgcgtatttcag

SEQ ID NO: 2301080 - DNA, 22 bp, Homo sapiens
tccccttcgcgtatttcaggat

SEQ ID NO: 2301081 - DNA, 17 bp, Homo sapiens
tccccttgggatgggca

SEQ ID NO: 2301082 - DNA, 19 bp, Homo sapiens
tccccttgggatgggcaca

SEQ ID NO: 2301083 - DNA, 22 bp, Homo sapiens
tccccttgggatgggcacaggc

SEQ ID NO: 2301084 - DNA, 23 bp, Homo sapiens
tccccttgggatgggcacaggct

SEQ ID NO: 2301085 - DNA, 21 bp, Homo sapiens
tcccgcagcaccagcctgagc

SEQ ID NO: 2301086 - DNA, 23 bp, Homo sapiens
tcccgcagcaccagcctgagcca

SEQ ID NO: 2301087 - DNA, 22 bp, Homo sapiens
tcccgcagcgggcgcgggacag

SEQ ID NO: 2301088 - DNA, 23 bp, Homo sapiens
tcccgcagcgggcgcgggacagg

SEQ ID NO: 2301089 - DNA, 13 bp, Homo sapiens
tcccgccccagcc

SEQ ID NO: 2301090 - DNA, 18 bp, Homo sapiens
tcccgccccagcctcctg

SEQ ID NO: 2301091 - DNA, 18 bp, Homo sapiens
tcccgccgcctcgggccg

SEQ ID NO: 2301092 - DNA, 22 bp, Homo sapiens
tcccgccgcctcgggccgcctc

SEQ ID NO: 2301093 - DNA, 15 bp, Homo sapiens
tcccggccccgcgcg

SEQ ID NO: 2301094 - DNA, 19 bp, Homo sapiens
tcccggccccgcgcgtgcc

SEQ ID NO: 2301095 - DNA, 14 bp, Homo sapiens
tcccggggccatgg

SEQ ID NO: 2301096 - DNA, 24 bp, Homo sapiens
tcccggggccatggaagctggcag

SEQ ID NO: 2301097 - DNA, 22 bp, Homo sapiens
tccctattttaggctattataa

SEQ ID NO: 2301098 - DNA, 19 bp, Homo sapiens
tccctctggcactccagaa

SEQ ID NO: 2301099 - DNA, 15 bp, Homo sapiens
tccctgacttcccag

SEQ ID NO: 2301100 - DNA, 19 bp, Homo sapiens
tccctgacttcccagctgg

SEQ ID NO: 2301101 - DNA, 20 bp, Homo sapiens
tccctgcctggcggcagggg

SEQ ID NO: 2301102 - DNA, 21 bp, Homo sapiens
tccctgcttggcttatgaaaa

SEQ ID NO: 2301103 - DNA, 17 bp, Homo sapiens
tccctggactctgtggg

SEQ ID NO: 2301104 - DNA, 17 bp, Homo sapiens
tccctgtaatgcactcc

SEQ ID NO: 2301105 - DNA, 17 bp, Homo sapiens
tccctgtgtaccctcca

SEQ ID NO: 2301106 - DNA, 18 bp, Homo sapiens
tcccttctcctgacctac

SEQ ID NO: 2301107 - DNA, 16 bp, Homo sapiens
tccgactccccctccc

SEQ ID NO: 2301108 - DNA, 19 bp, Homo sapiens
tccgaggcctggctctgga

SEQ ID NO: 2301109 - DNA, 17 bp, Homo sapiens
tccgaggttttgaggcg

SEQ ID NO: 2301110 - DNA, 21 bp, Homo sapiens
tccgaggttttgaggcgggaa

SEQ ID NO: 2301111 - DNA, 12 bp, Homo sapiens
tccgcccgccca

SEQ ID NO: 2301112 - DNA, 14 bp, Homo sapiens
tccgcccgcccacc

SEQ ID NO: 2301113 - DNA, 11 bp, Homo sapiens
tccgccctggg

SEQ ID NO: 2301114 - DNA, 15 bp, Homo sapiens
tccgccctgggctct

SEQ ID NO: 2301115 - DNA, 17 bp, Homo sapiens
tccgctaatctcttcta

SEQ ID NO: 2301116 - DNA, 19 bp, Homo sapiens
tccggcagaggcagggccc

SEQ ID NO: 2301117 - DNA, 21 bp, Homo sapiens
tccggcagaggcagggccctg

SEQ ID NO: 2301118 - DNA, 17 bp, Homo sapiens
tccggcctgcagcccag

SEQ ID NO: 2301119 - DNA, 13 bp, Homo sapiens
tccggctggacct

SEQ ID NO: 2301120 - DNA, 18 bp, Homo sapiens
tccggttgcatactggac

SEQ ID NO: 2301121 - DNA, 13 bp, Homo sapiens
tccgtccccaggg

SEQ ID NO: 2301122 - DNA, 17 bp, Homo sapiens
tccgtccgcccgcccac

SEQ ID NO: 2301123 - DNA, 14 bp, Homo sapiens
tccgtcctggcagg

SEQ ID NO: 2301124 - DNA, 16 bp, Homo sapiens
tcctaaactctgaaat

SEQ ID NO: 2301125 - DNA, 23 bp, Homo sapiens
tcctcaaagggtgccttctagct

SEQ ID NO: 2301126 - DNA, 19 bp, Homo sapiens
tcctcagcacggtgcctcc

SEQ ID NO: 2301127 - DNA, 20 bp, Homo sapiens
tcctcagcagcctcactgca

SEQ ID NO: 2301128 - DNA, 14 bp, Homo sapiens
tcctcatctccatg

SEQ ID NO: 2301129 - DNA, 19 bp, Homo sapiens
tcctcatctccatgctctt

SEQ ID NO: 2301130 - DNA, 17 bp, Homo sapiens
tcctccaaaacacaagg

SEQ ID NO: 2301131 - DNA, 13 bp, Homo sapiens
tcctccagctcct

SEQ ID NO: 2301132 - DNA, 15 bp, Homo sapiens
tcctcccccacgcct

SEQ ID NO: 2301133 - DNA, 13 bp, Homo sapiens
tcctccctgcctg

SEQ ID NO: 2301134 - DNA, 23 bp, Homo sapiens
tcctccggttgcatactggactc

SEQ ID NO: 2301135 - DNA, 20 bp, Homo sapiens
tcctcctcagtcttctcagt

SEQ ID NO: 2301136 - DNA, 13 bp, Homo sapiens
tcctcctgacacc

SEQ ID NO: 2301137 - DNA, 16 bp, Homo sapiens
tcctccttcctcatcc

SEQ ID NO: 2301138 - DNA, 23 bp, Homo sapiens
tcctcgtccggcctgcagcccag

SEQ ID NO: 2301139 - DNA, 14 bp, Homo sapiens
tcctctgccccctc

SEQ ID NO: 2301140 - DNA, 16 bp, Homo sapiens
tcctctgccccctccc

SEQ ID NO: 2301141 - DNA, 20 bp, Homo sapiens
tcctctgccccctcccccgc

SEQ ID NO: 2301142 - DNA, 23 bp, Homo sapiens
tcctctgccccctcccccgcaga

SEQ ID NO: 2301143 - DNA, 17 bp, Homo sapiens
tcctctgcttgtcattc

SEQ ID NO: 2301144 - DNA, 16 bp, Homo sapiens
tcctctgtccccgagc

SEQ ID NO: 2301145 - DNA, 22 bp, Homo sapiens
tcctctgttacccgcagatcct

SEQ ID NO: 2301146 - DNA, 15 bp, Homo sapiens
tcctcttaagacact

SEQ ID NO: 2301147 - DNA, 16 bp, Homo sapiens
tcctctttccccactg

SEQ ID NO: 2301148 - DNA, 11 bp, Homo sapiens
tcctgaataac

SEQ ID NO: 2301149 - DNA, 15 bp, Homo sapiens
tcctgacaccccact

SEQ ID NO: 2301150 - DNA, 14 bp, Homo sapiens
tcctgaccaaagga

SEQ ID NO: 2301151 - DNA, 21 bp, Homo sapiens
tcctgagccagatttcactct

SEQ ID NO: 2301152 - DNA, 15 bp, Homo sapiens
tcctgaggctggggc

SEQ ID NO: 2301153 - DNA, 14 bp, Homo sapiens
tcctgattattgaa

SEQ ID NO: 2301154 - DNA, 18 bp, Homo sapiens
tcctgccgacggagccac

SEQ ID NO: 2301155 - DNA, 20 bp, Homo sapiens
tcctgccgacggagccactg

SEQ ID NO: 2301156 - DNA, 16 bp, Homo sapiens
tcctgcctaaatttca

SEQ ID NO: 2301157 - DNA, 15 bp, Homo sapiens
tcctgcgtgttctca

SEQ ID NO: 2301158 - DNA, 23 bp, Homo sapiens
tcctgctgctcgggaaggcctga

SEQ ID NO: 2301159 - DNA, 14 bp, Homo sapiens
tcctggaaaactgg

SEQ ID NO: 2301160 - DNA, 19 bp, Homo sapiens
tcctggaagtgtgtgtttc

SEQ ID NO: 2301161 - DNA, 20 bp, Homo sapiens
tcctggaagtgtgtgtttct

SEQ ID NO: 2301162 - DNA, 22 bp, Homo sapiens
tcctggcatgggaatgaatgtc

SEQ ID NO: 2301163 - DNA, 12 bp, Homo sapiens
tcctgggccagg

SEQ ID NO: 2301164 - DNA, 15 bp, Homo sapiens
tcctgggccagggtc

SEQ ID NO: 2301165 - DNA, 16 bp, Homo sapiens
tcctgggccagggtct

SEQ ID NO: 2301166 - DNA, 13 bp, Homo sapiens
tcctggtgtctag

SEQ ID NO: 2301167 - DNA, 15 bp, Homo sapiens
tcctggtgtctagtt

SEQ ID NO: 2301168 - DNA, 12 bp, Homo sapiens
tcctgtgagcaa

SEQ ID NO: 2301169 - DNA, 10 bp, Homo sapiens
tcctgtgccc

SEQ ID NO: 2301170 - DNA, 13 bp, Homo sapiens
tcctgtggaaata

SEQ ID NO: 2301171 - DNA, 19 bp, Homo sapiens
tcctgtggaaatatgcaac

SEQ ID NO: 2301172 - DNA, 14 bp, Homo sapiens
tcctgttgcactga

SEQ ID NO: 2301173 - DNA, 23 bp, Homo sapiens
tccttaactgtccagtccagtga

SEQ ID NO: 2301174 - DNA, 22 bp, Homo sapiens
tccttactagattcataatgca

SEQ ID NO: 2301175 - DNA, 14 bp, Homo sapiens
tccttataaaaatt

SEQ ID NO: 2301176 - DNA, 17 bp, Homo sapiens
tccttataaaaattcta

SEQ ID NO: 2301177 - DNA, 17 bp, Homo sapiens
tccttatgcttgggcct

SEQ ID NO: 2301178 - DNA, 12 bp, Homo sapiens
tccttcagtgcc

SEQ ID NO: 2301179 - DNA, 13 bp, Homo sapiens
tccttcagtgcct

SEQ ID NO: 2301180 - DNA, 14 bp, Homo sapiens
tccttcccgcagca

SEQ ID NO: 2301181 - DNA, 16 bp, Homo sapiens
tccttcccgcagcacc

SEQ ID NO: 2301182 - DNA, 18 bp, Homo sapiens
tccttcctgttctgtgtc

SEQ ID NO: 2301183 - DNA, 17 bp, Homo sapiens
tccttctaaagtgctgg

SEQ ID NO: 2301184 - DNA, 15 bp, Homo sapiens
tccttgcacttctgt

SEQ ID NO: 2301185 - DNA, 22 bp, Homo sapiens
tccttgctgcaaggctcttcct

SEQ ID NO: 2301186 - DNA, 18 bp, Homo sapiens
tccttggtgtcgggcatg

SEQ ID NO: 2301187 - DNA, 12 bp, Homo sapiens
tccttgtacttg

SEQ ID NO: 2301188 - DNA, 23 bp, Homo sapiens
tccttgtacttgaataataacca

SEQ ID NO: 2301189 - DNA, 23 bp, Homo sapiens
tcctttgggagctcattcttttc

SEQ ID NO: 2301190 - DNA, 21 bp, Homo sapiens
tccttttgaagctcaactgtt

SEQ ID NO: 2301191 - DNA, 22 bp, Homo sapiens
tccttttgcttcatctggagtc

SEQ ID NO: 2301192 - DNA, 19 bp, Homo sapiens
tccttttttattgaataac

SEQ ID NO: 2301193 - DNA, 16 bp, Homo sapiens
tcgacctccctggctt

SEQ ID NO: 2301194 - DNA, 22 bp, Homo sapiens
tcgacctccctggcttgagtga

SEQ ID NO: 2301195 - DNA, 16 bp, Homo sapiens
tcgagaccagcctgac

SEQ ID NO: 2301196 - DNA, 18 bp, Homo sapiens
tcgagagggctgagcccc

SEQ ID NO: 2301197 - DNA, 17 bp, Homo sapiens
tcgagtccaaaatcatt

SEQ ID NO: 2301198 - DNA, 17 bp, Homo sapiens
tcgagttacagacaaag

SEQ ID NO: 2301199 - DNA, 19 bp, Homo sapiens
tcgcccacgggtgtggctc

SEQ ID NO: 2301200 - DNA, 18 bp, Homo sapiens
tcgccctctctcaccagc

SEQ ID NO: 2301201 - DNA, 20 bp, Homo sapiens
tcgccctctctcaccagcct

SEQ ID NO: 2301202 - DNA, 19 bp, Homo sapiens
tctgcagctgcttttgcat

SEQ ID NO: 2301203 - DNA, 17 bp, Homo sapiens
tctgcagtattctgtag

SEQ ID NO: 2301204 - DNA, 15 bp, Homo sapiens
tctgccatcagcccc

SEQ ID NO: 2301205 - DNA, 20 bp, Homo sapiens
tctgccatcagcccctgctg

SEQ ID NO: 2301206 - DNA, 13 bp, Homo sapiens
tctgccccctccc

SEQ ID NO: 2301207 - DNA, 24 bp, Homo sapiens
tctgccccctcccccgcagacaga

SEQ ID NO: 2301208 - DNA, 12 bp, Homo sapiens
tctgcccctccg

SEQ ID NO: 2301209 - DNA, 22 bp, Homo sapiens
tctgcccctccgtccccagggt

SEQ ID NO: 2301210 - DNA, 17 bp, Homo sapiens
tctgccctgccctggcc

SEQ ID NO: 2301211 - DNA, 20 bp, Homo sapiens
tctgctacctggttttcatt

SEQ ID NO: 2301212 - DNA, 13 bp, Homo sapiens
tctgctgcctcca

SEQ ID NO: 2301213 - DNA, 14 bp, Homo sapiens
tctgctgcctccaa

SEQ ID NO: 2301214 - DNA, 15 bp, Homo sapiens
tctgctgcctccaag

SEQ ID NO: 2301215 - DNA, 16 bp, Homo sapiens
tctgctgcctccaagt

SEQ ID NO: 2301216 - DNA, 17 bp, Homo sapiens
tctgctgcctctgaaaa

SEQ ID NO: 2301217 - DNA, 17 bp, Homo sapiens
tctgctgggctggcggc

SEQ ID NO: 2301218 - DNA, 16 bp, Homo sapiens
tctgctgttgattcca

SEQ ID NO: 2301219 - DNA, 16 bp, Homo sapiens
tctgcttgtcattctg

SEQ ID NO: 2301220 - DNA, 21 bp, Homo sapiens
tctgctttattgcctctgtct

SEQ ID NO: 2301221 - DNA, 14 bp, Homo sapiens
tctggaatactgaa

SEQ ID NO: 2301222 - DNA, 19 bp, Homo sapiens
tctggaattgttgaatgta

SEQ ID NO: 2301223 - DNA, 23 bp, Homo sapiens
tctggagcaaagcagactatgca

SEQ ID NO: 2301224 - DNA, 21 bp, Homo sapiens
tctggagctggcactgtggag

SEQ ID NO: 2301225 - DNA, 22 bp, Homo sapiens
tctggaggtggggagggcctct

SEQ ID NO: 2301226 - DNA, 20 bp, Homo sapiens
tctggcaggtggccagggct

SEQ ID NO: 2301227 - DNA, 18 bp, Homo sapiens
tctggctgactaaatttg

SEQ ID NO: 2301228 - DNA, 22 bp, Homo sapiens
tctggctgactaaatttgggga

SEQ ID NO: 2301229 - DNA, 10 bp, Homo sapiens
tctgggaaga

SEQ ID NO: 2301230 - DNA, 17 bp, Homo sapiens
tctggggccagcccctc

SEQ ID NO: 2301231 - DNA, 21 bp, Homo sapiens
tctggggccagcccctccccg

SEQ ID NO: 2301232 - DNA, 18 bp, Homo sapiens
tctgggttttagaaattc

SEQ ID NO: 2301233 - DNA, 22 bp, Homo sapiens
tctgggttttagaaattctata

SEQ ID NO: 2301234 - DNA, 21 bp, Homo sapiens
tctggtctcgtgttcgctggc

SEQ ID NO: 2301235 - DNA, 21 bp, Homo sapiens
tctggtgttctcaatgctttt

SEQ ID NO: 2301236 - DNA, 13 bp, Homo sapiens
tctgtaaatttaa

SEQ ID NO: 2301237 - DNA, 16 bp, Homo sapiens
tctgtagccaacttaa

SEQ ID NO: 2301238 - DNA, 20 bp, Homo sapiens
tctgtagccaacttaaacct

SEQ ID NO: 2301239 - DNA, 17 bp, Homo sapiens
tctgtccccgagccgag

SEQ ID NO: 2301240 - DNA, 20 bp, Homo sapiens
tctgtccccgagccgagctc

SEQ ID NO: 2301241 - DNA, 11 bp, Homo sapiens
tctgtcctggt

SEQ ID NO: 2301242 - DNA, 12 bp, Homo sapiens
tctgtcttaaag

SEQ ID NO: 2301243 - DNA, 14 bp, Homo sapiens
tctgtcttaaagaa

SEQ ID NO: 2301244 - DNA, 15 bp, Homo sapiens
tctgtcttaaagaat

SEQ ID NO: 2301245 - DNA, 19 bp, Homo sapiens
tctgtcttaaagaatttga

SEQ ID NO: 2301246 - DNA, 13 bp, Homo sapiens
tctgtcttgtaat

SEQ ID NO: 2301247 - DNA, 15 bp, Homo sapiens
tctgtggattctata

SEQ ID NO: 2301248 - DNA, 20 bp, Homo sapiens
tctgtggattctatatttca

SEQ ID NO: 2301249 - DNA, 20 bp, Homo sapiens
tctgtggctgccatcagaaa

SEQ ID NO: 2301250 - DNA, 15 bp, Homo sapiens
tctgttactccaaaa

SEQ ID NO: 2301251 - DNA, 19 bp, Homo sapiens
tctgttactccaaaaagaa

SEQ ID NO: 2301252 - DNA, 23 bp, Homo sapiens
tctgttagcattattgccaaata

SEQ ID NO: 2301253 - DNA, 12 bp, Homo sapiens
tctgttctcaaa

SEQ ID NO: 2301254 - DNA, 13 bp, Homo sapiens
tctgttgaccagg

SEQ ID NO: 2301255 - DNA, 16 bp, Homo sapiens
tctgttgaccaggctg

SEQ ID NO: 2301256 - DNA, 17 bp, Homo sapiens
tctgttgaccaggctgg

SEQ ID NO: 2301257 - DNA, 22 bp, Homo sapiens
tctgttgccacccaggtgatgt

SEQ ID NO: 2301258 - DNA, 21 bp, Homo sapiens
tctgttgttcagtcctctgca

SEQ ID NO: 2301259 - DNA, 22 bp, Homo sapiens
tcttaaagaatttgaaagtttc

SEQ ID NO: 2301260 - DNA, 18 bp, Homo sapiens
tcttaattactttcagaa

SEQ ID NO: 2301261 - DNA, 21 bp, Homo sapiens
tcttacacccgacgcttacca

SEQ ID NO: 2301262 - DNA, 14 bp, Homo sapiens
tcttaggtttccac

SEQ ID NO: 2301263 - DNA, 14 bp, Homo sapiens
tcttagtgtgtgca

SEQ ID NO: 2301264 - DNA, 22 bp, Homo sapiens
tcttatcacacttgcaaatgaa

SEQ ID NO: 2301265 - DNA, 18 bp, Homo sapiens
tcttatctagcaagaaga

SEQ ID NO: 2301266 - DNA, 15 bp, Homo sapiens
tcttattatatatat

SEQ ID NO: 2301267 - DNA, 23 bp, Homo sapiens
tcttattatatatataatatata

SEQ ID NO: 2301268 - DNA, 16 bp, Homo sapiens
tcttatttatatatga

SEQ ID NO: 2301269 - DNA, 18 bp, Homo sapiens
tcttcaaccctgccctgc

SEQ ID NO: 2301270 - DNA, 13 bp, Homo sapiens
tcttccaaatatt

SEQ ID NO: 2301271 - DNA, 18 bp, Homo sapiens
tcttcccatttgtaatgt

SEQ ID NO: 2301272 - DNA, 17 bp, Homo sapiens
tcttcctaccaaatata

SEQ ID NO: 2301273 - DNA, 18 bp, Homo sapiens
tcttcctaccaaatataa

SEQ ID NO: 2301274 - DNA, 12 bp, Homo sapiens
tcttcctcctga

SEQ ID NO: 2301275 - DNA, 19 bp, Homo sapiens
tcttctgcacagctcctcc

SEQ ID NO: 2301276 - DNA, 14 bp, Homo sapiens
tcttcttatcacac

SEQ ID NO: 2301277 - DNA, 21 bp, Homo sapiens
tcttcttatcacacttgcaaa

SEQ ID NO: 2301278 - DNA, 20 bp, Homo sapiens
tcttcttgcggcaccgccca

SEQ ID NO: 2301279 - DNA, 22 bp, Homo sapiens
tcttgaagacttttctttcagc

SEQ ID NO: 2301280 - DNA, 13 bp, Homo sapiens
tcttgaataaact

SEQ ID NO: 2301281 - DNA, 17 bp, Homo sapiens
tcttgaattgtaaggaa

SEQ ID NO: 2301282 - DNA, 22 bp, Homo sapiens
tcttgagcaatgtttttctcaa

SEQ ID NO: 2301283 - DNA, 19 bp, Homo sapiens
tcttgaggcagggtctcac

SEQ ID NO: 2301284 - DNA, 21 bp, Homo sapiens
tcttgatcagacattcagaga

SEQ ID NO: 2301285 - DNA, 19 bp, Homo sapiens
tcttgatgaaacaaaaata

SEQ ID NO: 2301286 - DNA, 17 bp, Homo sapiens
tcttgcggcaccgccca

SEQ ID NO: 2301287 - DNA, 19 bp, Homo sapiens
tcttgcggcaccgcccacc

SEQ ID NO: 2301288 - DNA, 21 bp, Homo sapiens
tcttgcggcaccgcccaccca

SEQ ID NO: 2301289 - DNA, 13 bp, Homo sapiens
tcttgcttgtacc

SEQ ID NO: 2301290 - DNA, 14 bp, Homo sapiens
tcttgcttgtacct

SEQ ID NO: 2301291 - DNA, 18 bp, Homo sapiens
tcttgcttgtacctctgg

SEQ ID NO: 2301292 - DNA, 21 bp, Homo sapiens
tcttgctttcacaaatatagt

SEQ ID NO: 2301293 - DNA, 19 bp, Homo sapiens
tcttgctttgaatgcatgt

SEQ ID NO: 2301294 - DNA, 20 bp, Homo sapiens
tcttgtattttcttcccatt

SEQ ID NO: 2301295 - DNA, 21 bp, Homo sapiens
tcttgtgtgtttattgtcaaa

SEQ ID NO: 2301296 - DNA, 22 bp, Homo sapiens
tctttaacatacatctaagtca

SEQ ID NO: 2301297 - DNA, 17 bp, Homo sapiens
tctttaaggaagaataa

SEQ ID NO: 2301298 - DNA, 22 bp, Homo sapiens
tctttaatataatattatactg

SEQ ID NO: 2301299 - DNA, 23 bp, Homo sapiens
tctttcacccttttctgtttgct

SEQ ID NO: 2301300 - DNA, 16 bp, Homo sapiens
tctttcagaatacaat

SEQ ID NO: 2301301 - DNA, 21 bp, Homo sapiens
tctttcctactctgggaagaa

SEQ ID NO: 2301302 - DNA, 20 bp, Homo sapiens
tctttgcccagttcatccca

SEQ ID NO: 2301303 - DNA, 23 bp, Homo sapiens
tctttggggtctacactgcaatc

SEQ ID NO: 2301304 - DNA, 14 bp, Homo sapiens
tctttgtacagaca

SEQ ID NO: 2301305 - DNA, 19 bp, Homo sapiens
tcttttatatctgtaaatt

SEQ ID NO: 2301306 - DNA, 18 bp, Homo sapiens
tcttttcagcttgtttct

SEQ ID NO: 2301307 - DNA, 10 bp, Homo sapiens
tcttttgtaa

SEQ ID NO: 2301308 - DNA, 13 bp, Homo sapiens
tcttttgtaagtg

SEQ ID NO: 2301309 - DNA, 14 bp, Homo sapiens
tctttttaaatgtg

SEQ ID NO: 2301310 - DNA, 12 bp, Homo sapiens
tctttttccaaa

SEQ ID NO: 2301311 - DNA, 19 bp, Homo sapiens
tgaaaaagaatgaaaacaa

SEQ ID NO: 2301312 - DNA, 19 bp, Homo sapiens
tgaaaaatctagtatttgt

SEQ ID NO: 2301313 - DNA, 19 bp, Homo sapiens
tgaaaacaccactgaacag

SEQ ID NO: 2301314 - DNA, 19 bp, Homo sapiens
tgaaaagaagaaagtctat

SEQ ID NO: 2301315 - DNA, 13 bp, Homo sapiens
tgaaaatactgga

SEQ ID NO: 2301316 - DNA, 20 bp, Homo sapiens
tgaaaccaattaagcagctt

SEQ ID NO: 2301317 - DNA, 13 bp, Homo sapiens
tgaaactggtttt

SEQ ID NO: 2301318 - DNA, 18 bp, Homo sapiens
tgaaagaagtcaaatgaa

SEQ ID NO: 2301319 - DNA, 21 bp, Homo sapiens
tgaaagaagtcaaatgaatga

SEQ ID NO: 2301320 - DNA, 17 bp, Homo sapiens
tgaaagagaaaatgctt

SEQ ID NO: 2301321 - DNA, 15 bp, Homo sapiens
tgaaagatggtaatc

SEQ ID NO: 2301322 - DNA, 19 bp, Homo sapiens
tgaaagtttccttattttc

SEQ ID NO: 2301323 - DNA, 20 bp, Homo sapiens
tgaaagtttccttattttca

SEQ ID NO: 2301324 - DNA, 21 bp, Homo sapiens
tgaaagtttccttattttcat

SEQ ID NO: 2301325 - DNA, 19 bp, Homo sapiens
tgaaataaagactcttgga

SEQ ID NO: 2301326 - DNA, 15 bp, Homo sapiens
tgaaataaagagttc

SEQ ID NO: 2301327 - DNA, 21 bp, Homo sapiens
tgaaataaagagttctccttg

SEQ ID NO: 2301328 - DNA, 14 bp, Homo sapiens
tgaaatatttgctt

SEQ ID NO: 2301329 - DNA, 17 bp, Homo sapiens
tgaaatctttttgcttt

SEQ ID NO: 2301330 - DNA, 17 bp, Homo sapiens
tgaaattctcagaatta

SEQ ID NO: 2301331 - DNA, 19 bp, Homo sapiens
tgaaatttttaaatcattt

SEQ ID NO: 2301332 - DNA, 20 bp, Homo sapiens
tgaaatttttaaatcatttc

SEQ ID NO: 2301333 - DNA, 22 bp, Homo sapiens
tgagtcctggcatgggaatgaa

SEQ ID NO: 2301334 - DNA, 15 bp, Homo sapiens
tgagtcggctgggca

SEQ ID NO: 2301335 - DNA, 17 bp, Homo sapiens
tgagtcggctgggcagg

SEQ ID NO: 2301336 - DNA, 19 bp, Homo sapiens
tgagtcggctgggcagggc

SEQ ID NO: 2301337 - DNA, 20 bp, Homo sapiens
tgagtcggctgggcagggcc

SEQ ID NO: 2301338 - DNA, 20 bp, Homo sapiens
tgagtgaatgttaacatgcg

SEQ ID NO: 2301339 - DNA, 20 bp, Homo sapiens
tgagtgacatcggttcagga

SEQ ID NO: 2301340 - DNA, 13 bp, Homo sapiens
tgagtgccttaca

SEQ ID NO: 2301341 - DNA, 17 bp, Homo sapiens
tgagtgccttacacaat

SEQ ID NO: 2301342 - DNA, 12 bp, Homo sapiens
tgagtggacagc

SEQ ID NO: 2301343 - DNA, 22 bp, Homo sapiens
tgagtggtccacattctgctgc

SEQ ID NO: 2301344 - DNA, 22 bp, Homo sapiens
tgagttacctcatgccgctgtg

SEQ ID NO: 2301345 - DNA, 19 bp, Homo sapiens
tgagtttaaaaaaataaca

SEQ ID NO: 2301346 - DNA, 17 bp, Homo sapiens
tgagtttccagctgctc

SEQ ID NO: 2301347 - DNA, 19 bp, Homo sapiens
tgataaacctgccaagagt

SEQ ID NO: 2301348 - DNA, 22 bp, Homo sapiens
tgatactgaattgttatgtaaa

SEQ ID NO: 2301349 - DNA, 16 bp, Homo sapiens
tgatagatataaagga

SEQ ID NO: 2301350 - DNA, 13 bp, Homo sapiens
tgatataataatt

SEQ ID NO: 2301351 - DNA, 18 bp, Homo sapiens
tgatataattacttaatg

SEQ ID NO: 2301352 - DNA, 19 bp, Homo sapiens
tgatataattacttaatgt

SEQ ID NO: 2301353 - DNA, 19 bp, Homo sapiens
tgatataggaaaatacatt

SEQ ID NO: 2301354 - DNA, 21 bp, Homo sapiens
tgatataggaaaatacattgt

SEQ ID NO: 2301355 - DNA, 23 bp, Homo sapiens
tgatcagacttgatttacaagca

SEQ ID NO: 2301356 - DNA, 17 bp, Homo sapiens
tgatcagatcttacaag

SEQ ID NO: 2301357 - DNA, 20 bp, Homo sapiens
tgatcattgcagtatcagag

SEQ ID NO: 2301358 - DNA, 15 bp, Homo sapiens
tgatcccaatagaat

SEQ ID NO: 2301359 - DNA, 17 bp, Homo sapiens
tgatcccagctcactgc

SEQ ID NO: 2301360 - DNA, 21 bp, Homo sapiens
tgatcccagctcactgcagcc

SEQ ID NO: 2301361 - DNA, 21 bp, Homo sapiens
tgatcctcccgccccagcctc

SEQ ID NO: 2301362 - DNA, 13 bp, Homo sapiens
tgatctgtcttgt

SEQ ID NO: 2301363 - DNA, 14 bp, Homo sapiens
tgatctgtcttgta

SEQ ID NO: 2301364 - DNA, 21 bp, Homo sapiens
tgatcttaattactttcagaa

SEQ ID NO: 2301365 - DNA, 16 bp, Homo sapiens
tgatcttgtaaaaata

SEQ ID NO: 2301366 - DNA, 17 bp, Homo sapiens
tgatgaccaatctctgt

SEQ ID NO: 2301367 - DNA, 20 bp, Homo sapiens
tgatgactcttcttatcaca

SEQ ID NO: 2301368 - DNA, 13 bp, Homo sapiens
tgatgagaggaaa

SEQ ID NO: 2301369 - DNA, 22 bp, Homo sapiens
tgatgatagacttcgaaaacag

SEQ ID NO: 2301370 - DNA, 17 bp, Homo sapiens
tgatgcttgatataata

SEQ ID NO: 2301371 - DNA, 14 bp, Homo sapiens
tgatggcagaggag

SEQ ID NO: 2301372 - DNA, 23 bp, Homo sapiens
tgatggcggctcacaagtgaaaa

SEQ ID NO: 2301373 - DNA, 16 bp, Homo sapiens
tgatgggctggagcag

SEQ ID NO: 2301374 - DNA, 16 bp, Homo sapiens
tgatggtgcaatgacc

SEQ ID NO: 2301375 - DNA, 21 bp, Homo sapiens
tgatgtatagctttaacattt

SEQ ID NO: 2301376 - DNA, 20 bp, Homo sapiens
tgatgtgggaagttaccttt

SEQ ID NO: 2301377 - DNA, 10 bp, Homo sapiens
tgatgttata

SEQ ID NO: 2301378 - DNA, 20 bp, Homo sapiens
tgatgttctttcaccctttt

SEQ ID NO: 2301379 - DNA, 15 bp, Homo sapiens
tgattaattaaaaca

SEQ ID NO: 2301380 - DNA, 14 bp, Homo sapiens
tgattattgaatgt

SEQ ID NO: 2301381 - DNA, 17 bp, Homo sapiens
tgattattgaatgttat

SEQ ID NO: 2301382 - DNA, 13 bp, Homo sapiens
tgattcaatgtga

SEQ ID NO: 2301383 - DNA, 14 bp, Homo sapiens
tgattcaatgtgaa

SEQ ID NO: 2301384 - DNA, 17 bp, Homo sapiens
tgattcaattaacatat

SEQ ID NO: 2301385 - DNA, 15 bp, Homo sapiens
tgattccaagggccc

SEQ ID NO: 2301386 - DNA, 16 bp, Homo sapiens
tgattccaagggccca

SEQ ID NO: 2301387 - DNA, 18 bp, Homo sapiens
tgattccccggagctggg

SEQ ID NO: 2301388 - DNA, 16 bp, Homo sapiens
tgatttaagcatttta

SEQ ID NO: 2301389 - DNA, 13 bp, Homo sapiens
tgatttacaagca

SEQ ID NO: 2301390 - DNA, 13 bp, Homo sapiens
tgatttcaaatgc

SEQ ID NO: 2301391 - DNA, 17 bp, Homo sapiens
tgatttcaaatgcagtc

SEQ ID NO: 2301392 - DNA, 23 bp, Homo sapiens
tgatttcaaatgcagtccagtga

SEQ ID NO: 2301393 - DNA, 17 bp, Homo sapiens
tgatttcaatgattgtt

SEQ ID NO: 2301394 - DNA, 12 bp, Homo sapiens
tgatttctttcc

SEQ ID NO: 2301395 - DNA, 19 bp, Homo sapiens
tgatttgatatacagacct

SEQ ID NO: 2301396 - DNA, 14 bp, Homo sapiens
tgattttaaaactt

SEQ ID NO: 2301397 - DNA, 19 bp, Homo sapiens
tgattttaaaacttttctg

SEQ ID NO: 2301398 - DNA, 17 bp, Homo sapiens
tgatttttttgttcatt

SEQ ID NO: 2301399 - DNA, 17 bp, Homo sapiens
tgcaaaaaaaaaaatgt

SEQ ID NO: 2301400 - DNA, 14 bp, Homo sapiens
tgcaaacactgtgt

SEQ ID NO: 2301401 - DNA, 15 bp, Homo sapiens
tgcaaatagtttcaa

SEQ ID NO: 2301402 - DNA, 21 bp, Homo sapiens
tgcaaatattgctattgttta

SEQ ID NO: 2301403 - DNA, 20 bp, Homo sapiens
tgcaaatgttgtatttcaaa

SEQ ID NO: 2301404 - DNA, 13 bp, Homo sapiens
tgcaaattattct

SEQ ID NO: 2301405 - DNA, 21 bp, Homo sapiens
tgcaaattattctagtcaact

SEQ ID NO: 2301406 - DNA, 15 bp, Homo sapiens
tgcaagaagaatata

SEQ ID NO: 2301407 - DNA, 15 bp, Homo sapiens
tgcaagctttaacag

SEQ ID NO: 2301408 - DNA, 18 bp, Homo sapiens
tgcaaggcaaagtaaaat

SEQ ID NO: 2301409 - DNA, 20 bp, Homo sapiens
tgcaataacagttttaagat

SEQ ID NO: 2301410 - DNA, 15 bp, Homo sapiens
tgcaatatgtaacat

SEQ ID NO: 2301411 - DNA, 13 bp, Homo sapiens
tgcaatcatatgt

SEQ ID NO: 2301412 - DNA, 16 bp, Homo sapiens
tgcaatcatatgtgat

SEQ ID NO: 2301413 - DNA, 20 bp, Homo sapiens
tgcaatcatatgtgatctgt

SEQ ID NO: 2301414 - DNA, 23 bp, Homo sapiens
tgcaatcatatgtgatctgtctt

SEQ ID NO: 2301415 - DNA, 17 bp, Homo sapiens
tgcaatgacctttcaat

SEQ ID NO: 2301416 - DNA, 16 bp, Homo sapiens
tgcaattaaaaagttg

SEQ ID NO: 2301417 - DNA, 23 bp, Homo sapiens
tgcacagctaacatggaagtact

SEQ ID NO: 2301418 - DNA, 17 bp, Homo sapiens
tgcacagtagtgttggg

SEQ ID NO: 2301419 - DNA, 21 bp, Homo sapiens
tgcacagtagtgttgggtgga

SEQ ID NO: 2301420 - DNA, 22 bp, Homo sapiens
tgcacagtagtgttgggtggag

SEQ ID NO: 2301421 - DNA, 23 bp, Homo sapiens
tgcacattaggaacagagtatat

SEQ ID NO: 2301422 - DNA, 21 bp, Homo sapiens
tgcaccttcactctccagggt

SEQ ID NO: 2301423 - DNA, 15 bp, Homo sapiens
tgcacggggccagca

SEQ ID NO: 2301424 - DNA, 23 bp, Homo sapiens
tgcacgtgctcttctgttctcaa

SEQ ID NO: 2301425 - DNA, 17 bp, Homo sapiens
tgcagacactcaagagc

SEQ ID NO: 2301426 - DNA, 14 bp, Homo sapiens
tgcagcaaccagag

SEQ ID NO: 2301427 - DNA, 23 bp, Homo sapiens
tgcagcagaaaggctctgaaggt

SEQ ID NO: 2301428 - DNA, 21 bp, Homo sapiens
tgcagcagtaccatcccactg

SEQ ID NO: 2301429 - DNA, 23 bp, Homo sapiens
tgcagcccagaacgggcctcccc

SEQ ID NO: 2301430 - DNA, 12 bp, Homo sapiens
tgcagcctgagc

SEQ ID NO: 2301431 - DNA, 23 bp, Homo sapiens
tgcagctgagattccagaacgcc

SEQ ID NO: 2301432 - DNA, 19 bp, Homo sapiens
tgcaggaagagatgctcta

SEQ ID NO: 2301433 - DNA, 20 bp, Homo sapiens
tgcagtccagtgagaaatta

SEQ ID NO: 2301434 - DNA, 16 bp, Homo sapiens
tgcagttaattcttgc

SEQ ID NO: 2301435 - DNA, 18 bp, Homo sapiens
tgcatacttcctggattt

SEQ ID NO: 2301436 - DNA, 24 bp, Homo sapiens
tgcatgatgactcttcttatcaca

SEQ ID NO: 2301437 - DNA, 13 bp, Homo sapiens
tgcatgctgtccc

SEQ ID NO: 2301438 - DNA, 15 bp, Homo sapiens
tgcatgctgtccctt

SEQ ID NO: 2301439 - DNA, 16 bp, Homo sapiens
tgcattatgagtaaaa

SEQ ID NO: 2301440 - DNA, 16 bp, Homo sapiens
tgcatttaagaacaga

SEQ ID NO: 2301441 - DNA, 14 bp, Homo sapiens
tgccaaagatagca

SEQ ID NO: 2301442 - DNA, 19 bp, Homo sapiens
tgccaaataaaatgtttac

SEQ ID NO: 2301443 - DNA, 22 bp, Homo sapiens
tgccaaatcctgggcatcccca

SEQ ID NO: 2301444 - DNA, 21 bp, Homo sapiens
tgccaacctcgctccaactcc

SEQ ID NO: 2301445 - DNA, 22 bp, Homo sapiens
tgccacatcgcagcccctgttg

SEQ ID NO: 2301446 - DNA, 13 bp, Homo sapiens
tgccaccctctgc

SEQ ID NO: 2301447 - DNA, 16 bp, Homo sapiens
tgccaccctctgctgc

SEQ ID NO: 2301448 - DNA, 17 bp, Homo sapiens
tgccaccctctgctgca

SEQ ID NO: 2301449 - DNA, 19 bp, Homo sapiens
tgccaccctctgctgcaca

SEQ ID NO: 2301450 - DNA, 24 bp, Homo sapiens
tgccaccctctgctgcacagtagt

SEQ ID NO: 2301451 - DNA, 22 bp, Homo sapiens
tgccacttgaacaaaatctgtt

SEQ ID NO: 2301452 - DNA, 15 bp, Homo sapiens
tgccagacagagatc

SEQ ID NO: 2301453 - DNA, 23 bp, Homo sapiens
tgccaggagtgggtgggacacag

SEQ ID NO: 2301454 - DNA, 16 bp, Homo sapiens
tgccatcagaaatttt

SEQ ID NO: 2301455 - DNA, 19 bp, Homo sapiens
tgccatcagaaattttcta

SEQ ID NO: 2301456 - DNA, 18 bp, Homo sapiens
tgccattagactgaattt

SEQ ID NO: 2301457 - DNA, 21 bp, Homo sapiens
tgcccaacagggcaaccaata

SEQ ID NO: 2301458 - DNA, 15 bp, Homo sapiens
tgcccaccctgggcc

SEQ ID NO: 2301459 - DNA, 17 bp, Homo sapiens
tgcccaccgcccctgga

SEQ ID NO: 2301460 - DNA, 17 bp, Homo sapiens
tgcccactgaacatgct

SEQ ID NO: 2301461 - DNA, 15 bp, Homo sapiens
tgcccagatgtttta

SEQ ID NO: 2301462 - DNA, 18 bp, Homo sapiens
tgcccaggacggtctgtg

SEQ ID NO: 2301463 - DNA, 15 bp, Homo sapiens
tgcccaggctggtct

SEQ ID NO: 2301464 - DNA, 19 bp, Homo sapiens
tggacatgcacagctaaca

SEQ ID NO: 2301465 - DNA, 19 bp, Homo sapiens
tggaccactgtttcttgct

SEQ ID NO: 2301466 - DNA, 15 bp, Homo sapiens
tggacctatctgtaa

SEQ ID NO: 2301467 - DNA, 23 bp, Homo sapiens
tggacgtgttatgactccagaat

SEQ ID NO: 2301468 - DNA, 21 bp, Homo sapiens
tggactcttcaaaaactgttt

SEQ ID NO: 2301469 - DNA, 18 bp, Homo sapiens
tggactgtggcctcagga

SEQ ID NO: 2301470 - DNA, 21 bp, Homo sapiens
tggactgtggcctcaggaggc

SEQ ID NO: 2301471 - DNA, 14 bp, Homo sapiens
tggagaaaatggac

SEQ ID NO: 2301472 - DNA, 23 bp, Homo sapiens
tggagaattccagttgtatttga

SEQ ID NO: 2301473 - DNA, 17 bp, Homo sapiens
tggagaccaggactctg

SEQ ID NO: 2301474 - DNA, 18 bp, Homo sapiens
tggagagctttactttgt

SEQ ID NO: 2301475 - DNA, 15 bp, Homo sapiens
tggagaggcgagagg

SEQ ID NO: 2301476 - DNA, 21 bp, Homo sapiens
tggagcagagacggcagcccc

SEQ ID NO: 2301477 - DNA, 20 bp, Homo sapiens
tggagcagtttggggcaggg

SEQ ID NO: 2301478 - DNA, 23 bp, Homo sapiens
tggagcccgcctgcgccccccag

SEQ ID NO: 2301479 - DNA, 13 bp, Homo sapiens
tggagctgcttcc

SEQ ID NO: 2301480 - DNA, 20 bp, Homo sapiens
tggaggagggtttgggcaga

SEQ ID NO: 2301481 - DNA, 22 bp, Homo sapiens
tggaggagggtttgggcagagc

SEQ ID NO: 2301482 - DNA, 18 bp, Homo sapiens
tggaggatggacgagtga

SEQ ID NO: 2301483 - DNA, 13 bp, Homo sapiens
tggaggctggacc

SEQ ID NO: 2301484 - DNA, 21 bp, Homo sapiens
tggagggctgggcagggccct

SEQ ID NO: 2301485 - DNA, 19 bp, Homo sapiens
tggaggtggggagggcctc

SEQ ID NO: 2301486 - DNA, 22 bp, Homo sapiens
tggaggtggggagggcctctgg

SEQ ID NO: 2301487 - DNA, 22 bp, Homo sapiens
tggaggttgggaggtccaaggt

SEQ ID NO: 2301488 - DNA, 22 bp, Homo sapiens
tggagtccagacctgggccctg

SEQ ID NO: 2301489 - DNA, 15 bp, Homo sapiens
tggagtgaagaaaac

SEQ ID NO: 2301490 - DNA, 17 bp, Homo sapiens
tggagtgaagtggtgtg

SEQ ID NO: 2301491 - DNA, 12 bp, Homo sapiens
tggagtgtcacc

SEQ ID NO: 2301492 - DNA, 20 bp, Homo sapiens
tggataataactagatctcc

SEQ ID NO: 2301493 - DNA, 17 bp, Homo sapiens
tggatatgaaagagaaa

SEQ ID NO: 2301494 - DNA, 20 bp, Homo sapiens
tggatatgaaagagaaaatg

SEQ ID NO: 2301495 - DNA, 20 bp, Homo sapiens
tggatccatacaaaactatc

SEQ ID NO: 2301496 - DNA, 14 bp, Homo sapiens
tggatctaaatgga

SEQ ID NO: 2301497 - DNA, 16 bp, Homo sapiens
tggattctatatttca

SEQ ID NO: 2301498 - DNA, 18 bp, Homo sapiens
tggattctatatttcata

SEQ ID NO: 2301499 - DNA, 14 bp, Homo sapiens
tggattttctttct

SEQ ID NO: 2301500 - DNA, 18 bp, Homo sapiens
tggattttctttctatgt

SEQ ID NO: 2301501 - DNA, 19 bp, Homo sapiens
tggattttctttctatgta

SEQ ID NO: 2301502 - DNA, 23 bp, Homo sapiens
tggcaaataatactaatttataa

SEQ ID NO: 2301503 - DNA, 22 bp, Homo sapiens
tggcacacaatcctataaatgt

SEQ ID NO: 2301504 - DNA, 23 bp, Homo sapiens
tggcacagaacaggaggtgtgaa

SEQ ID NO: 2301505 - DNA, 11 bp, Homo sapiens
tggcagagcca

SEQ ID NO: 2301506 - DNA, 21 bp, Homo sapiens
tggcagagccatccaccctga

SEQ ID NO: 2301507 - DNA, 14 bp, Homo sapiens
tggcagcgcctccc

SEQ ID NO: 2301508 - DNA, 15 bp, Homo sapiens
tggcagcgcctcccg

SEQ ID NO: 2301509 - DNA, 22 bp, Homo sapiens
tggcagcgcctcccgccgcctc

SEQ ID NO: 2301510 - DNA, 16 bp, Homo sapiens
tggcagggcaggcaga

SEQ ID NO: 2301511 - DNA, 17 bp, Homo sapiens
tggcagggcaggcagag

SEQ ID NO: 2301512 - DNA, 16 bp, Homo sapiens
tggcaggtggccaggg

SEQ ID NO: 2301513 - DNA, 22 bp, Homo sapiens
tggcagtgcagcaaccagagca

SEQ ID NO: 2301514 - DNA, 18 bp, Homo sapiens
tggcatagccattcattt

SEQ ID NO: 2301515 - DNA, 13 bp, Homo sapiens
tggcatggtcctg

SEQ ID NO: 2301516 - DNA, 16 bp, Homo sapiens
tggcatggtcctgtgc

SEQ ID NO: 2301517 - DNA, 21 bp, Homo sapiens
tggcatggtcctgtgccccga

SEQ ID NO: 2301518 - DNA, 22 bp, Homo sapiens
tggcattttggctcagagtcca

SEQ ID NO: 2301519 - DNA, 18 bp, Homo sapiens
tggccaagtgtacatttg

SEQ ID NO: 2301520 - DNA, 13 bp, Homo sapiens
tggccactcctgg

SEQ ID NO: 2301521 - DNA, 13 bp, Homo sapiens
tggccactggccc

SEQ ID NO: 2301522 - DNA, 17 bp, Homo sapiens
tggccccagctggctgg

SEQ ID NO: 2301523 - DNA, 20 bp, Homo sapiens
tggccccagctggctgggtc

SEQ ID NO: 2301524 - DNA, 12 bp, Homo sapiens
tggccccaggcg

SEQ ID NO: 2301525 - DNA, 16 bp, Homo sapiens
tggcccctcccacatc

SEQ ID NO: 2301526 - DNA, 15 bp, Homo sapiens
tggccctgccctccc

SEQ ID NO: 2301527 - DNA, 18 bp, Homo sapiens
tggccctgccctccccca

SEQ ID NO: 2301528 - DNA, 22 bp, Homo sapiens
tggccctgccctcccccacggc

SEQ ID NO: 2301529 - DNA, 20 bp, Homo sapiens
tggcctcaagcgatcctcct

SEQ ID NO: 2301530 - DNA, 20 bp, Homo sapiens
tggcctccctttgtgtgcat

SEQ ID NO: 2301531 - DNA, 14 bp, Homo sapiens
tggcctcttctaga

SEQ ID NO: 2301532 - DNA, 22 bp, Homo sapiens
tggcctgctagcggctgaacag

SEQ ID NO: 2301533 - DNA, 21 bp, Homo sapiens
tggcctggtatggctgcagtc

SEQ ID NO: 2301534 - DNA, 21 bp, Homo sapiens
tggccttgagcaagtcccatc

SEQ ID NO: 2301535 - DNA, 17 bp, Homo sapiens
tggcgggaagggtgggc

SEQ ID NO: 2301536 - DNA, 22 bp, Homo sapiens
tggcgggaagggtgggccctgg

SEQ ID NO: 2301537 - DNA, 18 bp, Homo sapiens
tggcgggcagcccctgct

SEQ ID NO: 2301538 - DNA, 19 bp, Homo sapiens
tggctcacacctgtaatcc

SEQ ID NO: 2301539 - DNA, 12 bp, Homo sapiens
tggctccaggag

SEQ ID NO: 2301540 - DNA, 13 bp, Homo sapiens
tggctccaggagc

SEQ ID NO: 2301541 - DNA, 13 bp, Homo sapiens
tggctccccctga

SEQ ID NO: 2301542 - DNA, 16 bp, Homo sapiens
tggctcgcacccccac

SEQ ID NO: 2301543 - DNA, 18 bp, Homo sapiens
tggctcgcacccccactt

SEQ ID NO: 2301544 - DNA, 14 bp, Homo sapiens
tggctcgctgtggt

SEQ ID NO: 2301545 - DNA, 16 bp, Homo sapiens
tggctcgggtgcccag

SEQ ID NO: 2301546 - DNA, 22 bp, Homo sapiens
tggctgactaaatttggggaca

SEQ ID NO: 2301547 - DNA, 14 bp, Homo sapiens
tggctgatttcaaa

SEQ ID NO: 2301548 - DNA, 16 bp, Homo sapiens
tggctgctctccatct

SEQ ID NO: 2301549 - DNA, 20 bp, Homo sapiens
tggctgctctccatctcttg

SEQ ID NO: 2301550 - DNA, 16 bp, Homo sapiens
tggctgcttcaaggat

SEQ ID NO: 2301551 - DNA, 20 bp, Homo sapiens
tggctgggtcgcccctcctc

SEQ ID NO: 2301552 - DNA, 16 bp, Homo sapiens
tggcttatgaaagagg

SEQ ID NO: 2301553 - DNA, 13 bp, Homo sapiens
tggcttcagcccc

SEQ ID NO: 2301554 - DNA, 21 bp, Homo sapiens
tggcttctctgccctgccctg

SEQ ID NO: 2301555 - DNA, 15 bp, Homo sapiens
tggcttggagcagag

SEQ ID NO: 2301556 - DNA, 13 bp, Homo sapiens
tggctttcatttc

SEQ ID NO: 2301557 - DNA, 14 bp, Homo sapiens
tggctttgccttta

SEQ ID NO: 2301558 - DNA, 22 bp, Homo sapiens
tgggaagttaccttttataaga

SEQ ID NO: 2301559 - DNA, 19 bp, Homo sapiens
tgggacgctggtaactgtt

SEQ ID NO: 2301560 - DNA, 13 bp, Homo sapiens
tgggacggaggtc

SEQ ID NO: 2301561 - DNA, 22 bp, Homo sapiens
tgggactcagttcttggcctgc

SEQ ID NO: 2301562 - DNA, 16 bp, Homo sapiens
tgggactgctcaggct

SEQ ID NO: 2301563 - DNA, 13 bp, Homo sapiens
tgggagagtgagg

SEQ ID NO: 2301564 - DNA, 14 bp, Homo sapiens
tgggagatgctggg

SEQ ID NO: 2301565 - DNA, 13 bp, Homo sapiens
tgggaggaggcct

SEQ ID NO: 2301566 - DNA, 18 bp, Homo sapiens
tgggagggggcagggggc

SEQ ID NO: 2301567 - DNA, 21 bp, Homo sapiens
tgggaggtccaaggtcaaggc

SEQ ID NO: 2301568 - DNA, 19 bp, Homo sapiens
tgggagtcagggagccctg

SEQ ID NO: 2301569 - DNA, 20 bp, Homo sapiens
tgggagtcagggagccctgg

SEQ ID NO: 2301570 - DNA, 19 bp, Homo sapiens
tgggatcattatttcatga

SEQ ID NO: 2301571 - DNA, 15 bp, Homo sapiens
tgggatgggcacagg

SEQ ID NO: 2301572 - DNA, 19 bp, Homo sapiens
tgggatgggcacaggctgc

SEQ ID NO: 2301573 - DNA, 12 bp, Homo sapiens
tgggcacaggct

SEQ ID NO: 2301574 - DNA, 21 bp, Homo sapiens
tgggcacaggctgccccaccc

SEQ ID NO: 2301575 - DNA, 15 bp, Homo sapiens
tgggcacgggagagc

SEQ ID NO: 2301576 - DNA, 13 bp, Homo sapiens
tgggcagggccct

SEQ ID NO: 2301577 - DNA, 15 bp, Homo sapiens
tgggcagggccctgt

SEQ ID NO: 2301578 - DNA, 12 bp, Homo sapiens
tgggccccacag

SEQ ID NO: 2301579 - DNA, 13 bp, Homo sapiens
tgggccccacagt

SEQ ID NO: 2301580 - DNA, 22 bp, Homo sapiens
tgggccccagaaagcctcagag

SEQ ID NO: 2301581 - DNA, 12 bp, Homo sapiens
tgggccctggag

SEQ ID NO: 2301582 - DNA, 13 bp, Homo sapiens
tgggccctggagg

SEQ ID NO: 2301583 - DNA, 14 bp, Homo sapiens
tgggccctggaggg

SEQ ID NO: 2301584 - DNA, 21 bp, Homo sapiens
tgggccctggttcccccagga

SEQ ID NO: 2301585 - DNA, 23 bp, Homo sapiens
tgggccctggttcccccaggacc

SEQ ID NO: 2301586 - DNA, 14 bp, Homo sapiens
tgggctctggcccc

SEQ ID NO: 2301587 - DNA, 12 bp, Homo sapiens
tgggctgctgtc

SEQ ID NO: 2301588 - DNA, 22 bp, Homo sapiens
tgggctggagcagtttggggca

SEQ ID NO: 2301589 - DNA, 21 bp, Homo sapiens
tggggacagattcagtcttgc

SEQ ID NO: 2301590 - DNA, 16 bp, Homo sapiens
tggggactctccaggc

SEQ ID NO: 2301591 - DNA, 21 bp, Homo sapiens
tggggaggagactcaggccca

SEQ ID NO: 2301592 - DNA, 14 bp, Homo sapiens
tggggagggcctct

SEQ ID NO: 2301593 - DNA, 17 bp, Homo sapiens
tggggagggcctctgga

SEQ ID NO: 2301594 - DNA, 19 bp, Homo sapiens
tggggagggcctctggaca

SEQ ID NO: 2301595 - DNA, 12 bp, Homo sapiens
tggggccagccc

SEQ ID NO: 2301596 - DNA, 20 bp, Homo sapiens
tgtccacagagtttttcagg

SEQ ID NO: 2301597 - DNA, 22 bp, Homo sapiens
tgtccacagtgattagcctcgt

SEQ ID NO: 2301598 - DNA, 22 bp, Homo sapiens
tgtccccagttaatgtgccaaa

SEQ ID NO: 2301599 - DNA, 15 bp, Homo sapiens
tgtccccattctata

SEQ ID NO: 2301600 - DNA, 22 bp, Homo sapiens
tgtccccgagccgagctctcct

SEQ ID NO: 2301601 - DNA, 17 bp, Homo sapiens
tgtcccctggtgcccct

SEQ ID NO: 2301602 - DNA, 14 bp, Homo sapiens
tgtcccttccagga

SEQ ID NO: 2301603 - DNA, 15 bp, Homo sapiens
tgtccgatttttcca

SEQ ID NO: 2301604 - DNA, 21 bp, Homo sapiens
tgtcctaggggccgagggaaa

SEQ ID NO: 2301605 - DNA, 18 bp, Homo sapiens
tgtcctcaggtgaataac

SEQ ID NO: 2301606 - DNA, 14 bp, Homo sapiens
tgtcctcatctata

SEQ ID NO: 2301607 - DNA, 12 bp, Homo sapiens
tgtcgggcatga

SEQ ID NO: 2301608 - DNA, 19 bp, Homo sapiens
tgtctagcatgctgagtca

SEQ ID NO: 2301609 - DNA, 12 bp, Homo sapiens
tgtctagtatac

SEQ ID NO: 2301610 - DNA, 16 bp, Homo sapiens
tgtctagtttgcatac

SEQ ID NO: 2301611 - DNA, 15 bp, Homo sapiens
tgtctattgtcacat

SEQ ID NO: 2301612 - DNA, 13 bp, Homo sapiens
tgtctgacctagc

SEQ ID NO: 2301613 - DNA, 13 bp, Homo sapiens
tgtctgctgcctc

SEQ ID NO: 2301614 - DNA, 19 bp, Homo sapiens
tgtctgctgcctccaagtc

SEQ ID NO: 2301615 - DNA, 22 bp, Homo sapiens
tgtctgctgcctccaagtcatg

SEQ ID NO: 2301616 - DNA, 23 bp, Homo sapiens
tgtctgctgcctccaagtcatgg

SEQ ID NO: 2301617 - DNA, 13 bp, Homo sapiens
tgtctgtaagaga

SEQ ID NO: 2301618 - DNA, 13 bp, Homo sapiens
tgtgaaataaaga

SEQ ID NO: 2301619 - DNA, 18 bp, Homo sapiens
tgtgaaatttacagttac

SEQ ID NO: 2301620 - DNA, 19 bp, Homo sapiens
tgtgaagtccacttatgta

SEQ ID NO: 2301621 - DNA, 21 bp, Homo sapiens
tgtgaagtccacttatgtaga

SEQ ID NO: 2301622 - DNA, 22 bp, Homo sapiens
tgtgaatatatttttaaagcaa

SEQ ID NO: 2301623 - DNA, 11 bp, Homo sapiens
tgtgaatgcac

SEQ ID NO: 2301624 - DNA, 21 bp, Homo sapiens
tgtgaccggggtcctgaggct

SEQ ID NO: 2301625 - DNA, 13 bp, Homo sapiens
tgtgactcgctta

SEQ ID NO: 2301626 - DNA, 21 bp, Homo sapiens
tgtgactcgcttagctgaaac

SEQ ID NO: 2301627 - DNA, 23 bp, Homo sapiens
tgtgactcgcttagctgaaacct

SEQ ID NO: 2301628 - DNA, 16 bp, Homo sapiens
tgtgagccaaagagaa

SEQ ID NO: 2301629 - DNA, 22 bp, Homo sapiens
tgtgagccaaagagaaaagatt

SEQ ID NO: 2301630 - DNA, 14 bp, Homo sapiens
tgtgagccacagca

SEQ ID NO: 2301631 - DNA, 15 bp, Homo sapiens
tgtgagccacagcac

SEQ ID NO: 2301632 - DNA, 21 bp, Homo sapiens
tgtgagccacagcactcggcc

SEQ ID NO: 2301633 - DNA, 17 bp, Homo sapiens
tgtgaggacagacagaa

SEQ ID NO: 2301634 - DNA, 22 bp, Homo sapiens
tgtgatcccagctcactgcagc

SEQ ID NO: 2301635 - DNA, 23 bp, Homo sapiens
tgtgatcccagctcactgcagcc

SEQ ID NO: 2301636 - DNA, 15 bp, Homo sapiens
tgtgatctaagcagt

SEQ ID NO: 2301637 - DNA, 19 bp, Homo sapiens
tgtgatctgtcttgtaata

SEQ ID NO: 2301638 - DNA, 20 bp, Homo sapiens
tgtgattccccggagctggg

SEQ ID NO: 2301639 - DNA, 14 bp, Homo sapiens
tgtgcaaaataaaa

SEQ ID NO: 2301640 - DNA, 19 bp, Homo sapiens
tgtgcactcacgctcagca

SEQ ID NO: 2301641 - DNA, 15 bp, Homo sapiens
tgtgcataaaagtta

SEQ ID NO: 2301642 - DNA, 19 bp, Homo sapiens
tgtgccaaaatgtcaattt

SEQ ID NO: 2301643 - DNA, 21 bp, Homo sapiens
tgtgccaaaatgtcaattttt

SEQ ID NO: 2301644 - DNA, 12 bp, Homo sapiens
tgtgccaggagt

SEQ ID NO: 2301645 - DNA, 14 bp, Homo sapiens
tgtgccatagaaca

SEQ ID NO: 2301646 - DNA, 23 bp, Homo sapiens
tgtgccccgaccccacctgaggc

SEQ ID NO: 2301647 - DNA, 17 bp, Homo sapiens
tgtgcgccggcgccccg

SEQ ID NO: 2301648 - DNA, 15 bp, Homo sapiens
tgtgctgctgctttt

SEQ ID NO: 2301649 - DNA, 12 bp, Homo sapiens
tgtgctttcatc

SEQ ID NO: 2301650 - DNA, 12 bp, Homo sapiens
tgtgcttttcca

SEQ ID NO: 2301651 - DNA, 16 bp, Homo sapiens
tgtggaaatatgcaac

SEQ ID NO: 2301652 - DNA, 15 bp, Homo sapiens
tgtggagctgcttcc

SEQ ID NO: 2301653 - DNA, 22 bp, Homo sapiens
tgtggcctcattcagcagaatg

SEQ ID NO: 2301654 - DNA, 23 bp, Homo sapiens
tgtggcgggaagggtgggccctg

SEQ ID NO: 2301655 - DNA, 18 bp, Homo sapiens
tgtggctgccatcagaaa

SEQ ID NO: 2301656 - DNA, 13 bp, Homo sapiens
tgtggctttatga

SEQ ID NO: 2301657 - DNA, 19 bp, Homo sapiens
tgtggtctggtgttccagc

SEQ ID NO: 2301658 - DNA, 21 bp, Homo sapiens
tgtgtaaataagcgtttaatg

SEQ ID NO: 2301659 - DNA, 10 bp, Homo sapiens
tgtgtaaatg

SEQ ID NO: 2301660 - DNA, 15 bp, Homo sapiens
tgtgtacagaaacaa

SEQ ID NO: 2301661 - DNA, 15 bp, Homo sapiens
tgtgtactttcttcc

SEQ ID NO: 2301662 - DNA, 17 bp, Homo sapiens
tgtgtactttcttccct

SEQ ID NO: 2301663 - DNA, 17 bp, Homo sapiens
tgtgtagatattatgta

SEQ ID NO: 2301664 - DNA, 22 bp, Homo sapiens
tgtgtcaaagagatgaggaaat

SEQ ID NO: 2301665 - DNA, 14 bp, Homo sapiens
tgtgtcatgatttc

SEQ ID NO: 2301666 - DNA, 19 bp, Homo sapiens
tgtgtccacactaccagtt

SEQ ID NO: 2301667 - DNA, 17 bp, Homo sapiens
tgtgtccataagagaaa

SEQ ID NO: 2301668 - DNA, 12 bp, Homo sapiens
tgtgtgctctta

SEQ ID NO: 2301669 - DNA, 16 bp, Homo sapiens
tgtgtgtttcttgctt

SEQ ID NO: 2301670 - DNA, 18 bp, Homo sapiens
tgtgttgcaaattattct

SEQ ID NO: 2301671 - DNA, 13 bp, Homo sapiens
tgtgttgcccagg

SEQ ID NO: 2301672 - DNA, 13 bp, Homo sapiens
tgtgtttattgtc

SEQ ID NO: 2301673 - DNA, 13 bp, Homo sapiens
tgtgtttcttgct

SEQ ID NO: 2301674 - DNA, 17 bp, Homo sapiens
tgtgtttcttgctttga

SEQ ID NO: 2301675 - DNA, 13 bp, Homo sapiens
tgtgttttcctaa

SEQ ID NO: 2301676 - DNA, 14 bp, Homo sapiens
tgtgttttcctaaa

SEQ ID NO: 2301677 - DNA, 14 bp, Homo sapiens
tgttaaaaaccatt

SEQ ID NO: 2301678 - DNA, 21 bp, Homo sapiens
tgttaaagaggcgtcttgtat

SEQ ID NO: 2301679 - DNA, 14 bp, Homo sapiens
tgttaagaatagaa

SEQ ID NO: 2301680 - DNA, 15 bp, Homo sapiens
tgttaatcatgggtt

SEQ ID NO: 2301681 - DNA, 17 bp, Homo sapiens
tgttactccaaaaagaa

SEQ ID NO: 2301682 - DNA, 16 bp, Homo sapiens
tgttacttaaatagca

SEQ ID NO: 2301683 - DNA, 15 bp, Homo sapiens
tgttagcattattgc

SEQ ID NO: 2301684 - DNA, 12 bp, Homo sapiens
tgttaggggaaa

SEQ ID NO: 2301685 - DNA, 21 bp, Homo sapiens
tgttagtcttaccgaataagg

SEQ ID NO: 2301686 - DNA, 18 bp, Homo sapiens
tgttatattcattcttta

SEQ ID NO: 2301687 - DNA, 13 bp, Homo sapiens
tgttatgactcca

SEQ ID NO: 2301688 - DNA, 17 bp, Homo sapiens
tgttatgactccagaat

SEQ ID NO: 2301689 - DNA, 19 bp, Homo sapiens
tgttatgtaaacatcataa

SEQ ID NO: 2301690 - DNA, 13 bp, Homo sapiens
tgttatttctgca

SEQ ID NO: 2301691 - DNA, 14 bp, Homo sapiens
tgttatttctgcaa

SEQ ID NO: 2301692 - DNA, 15 bp, Homo sapiens
tgttatttctgcaaa

SEQ ID NO: 2301693 - DNA, 12 bp, Homo sapiens
tgttcaggcagg

SEQ ID NO: 2301694 - DNA, 15 bp, Homo sapiens
tgttcagtcctctgc

SEQ ID NO: 2301695 - DNA, 18 bp, Homo sapiens
tgttccagctgaggcagg

SEQ ID NO: 2301696 - DNA, 12 bp, Homo sapiens
tgttccctgagg

SEQ ID NO: 2301697 - DNA, 15 bp, Homo sapiens
tgttccctgaggacc

SEQ ID NO: 2301698 - DNA, 14 bp, Homo sapiens
tgttcgctggctga

SEQ ID NO: 2301699 - DNA, 20 bp, Homo sapiens
tgttctaactagtaatcttg

SEQ ID NO: 2301700 - DNA, 14 bp, Homo sapiens
tgttgaatgtattc

SEQ ID NO: 2301701 - DNA, 20 bp, Homo sapiens
tgttgaccaggctggagtga

SEQ ID NO: 2301702 - DNA, 12 bp, Homo sapiens
tgttgaggaggg

SEQ ID NO: 2301703 - DNA, 17 bp, Homo sapiens
tgttgaggaggggagca

SEQ ID NO: 2301704 - DNA, 23 bp, Homo sapiens
tgttgccaggagatggaatatca

SEQ ID NO: 2301705 - DNA, 15 bp, Homo sapiens
tgttgcccaggctgg

SEQ ID NO: 2301706 - DNA, 20 bp, Homo sapiens
tgttgcccaggctggtcttg

SEQ ID NO: 2301707 - DNA, 14 bp, Homo sapiens
tgttgctgaaacac

SEQ ID NO: 2301708 - DNA, 15 bp, Homo sapiens
tgttggaatgttgtt

SEQ ID NO: 2301709 - DNA, 22 bp, Homo sapiens
tgttggaatgttgttaaatgct

SEQ ID NO: 2301710 - DNA, 13 bp, Homo sapiens
tgttggcacagaa

SEQ ID NO: 2301711 - DNA, 23 bp, Homo sapiens
tgttggggggccccacggagagt

SEQ ID NO: 2301712 - DNA, 14 bp, Homo sapiens
tgttgtatttcaaa

SEQ ID NO: 2301713 - DNA, 13 bp, Homo sapiens
tgttgttaaatgc

SEQ ID NO: 2301714 - DNA, 18 bp, Homo sapiens
tgtttaacccaaaagatt

SEQ ID NO: 2301715 - DNA, 19 bp, Homo sapiens
tgtttaagaaatgagaaat

SEQ ID NO: 2301716 - DNA, 18 bp, Homo sapiens
tgtttacattttctttca

SEQ ID NO: 2301717 - DNA, 19 bp, Homo sapiens
tgtttacattttctttcat

SEQ ID NO: 2301718 - DNA, 14 bp, Homo sapiens
tgtttattgtcaaa

SEQ ID NO: 2301719 - DNA, 19 bp, Homo sapiens
tgtttattgtcaaagtggt

SEQ ID NO: 2301720 - DNA, 22 bp, Homo sapiens
tgtttcaaagggtaaattataa

SEQ ID NO: 2301721 - DNA, 14 bp, Homo sapiens
tgtttcatgaagaa

SEQ ID NO: 2301722 - DNA, 15 bp, Homo sapiens
tgtttcccctcagaa

SEQ ID NO: 2301723 - DNA, 21 bp, Homo sapiens
tgtttccctcaagaacaaaca

SEQ ID NO: 2301724 - DNA, 16 bp, Homo sapiens
tgtttcctgtggaaat

SEQ ID NO: 2301725 - DNA, 20 bp, Homo sapiens
tgtttctgcagtattctgta

SEQ ID NO: 2301726 - DNA, 13 bp, Homo sapiens
tgtttcttgcttg

SEQ ID NO: 2301727 - DNA, 15 bp, Homo sapiens
tgtttcttgcttgta

SEQ ID NO: 2301728 - DNA, 16 bp, Homo sapiens
tgtttcttgcttgtac

SEQ ID NO: 2301729 - DNA, 19 bp, Homo sapiens
tgtttcttgcttgtacctc

SEQ ID NO: 2301730 - DNA, 15 bp, Homo sapiens
ttatctgtgttgtct

SEQ ID NO: 2301731 - DNA, 23 bp, Homo sapiens
ttatgaaaatgtaagttatgtgt

SEQ ID NO: 2301732 - DNA, 22 bp, Homo sapiens
ttatgaagttaacagtctcatt

SEQ ID NO: 2301733 - DNA, 20 bp, Homo sapiens
ttatgactagcaaacaaaaa

SEQ ID NO: 2301734 - DNA, 11 bp, Homo sapiens
ttatgagaaaa

SEQ ID NO: 2301735 - DNA, 16 bp, Homo sapiens
ttatgagtaaaagcag

SEQ ID NO: 2301736 - DNA, 21 bp, Homo sapiens
ttatgataaccaagaatgtct

SEQ ID NO: 2301737 - DNA, 20 bp, Homo sapiens
ttatgctaacaaactgaaaa

SEQ ID NO: 2301738 - DNA, 22 bp, Homo sapiens
ttatgctaacaaactgaaaaat

SEQ ID NO: 2301739 - DNA, 20 bp, Homo sapiens
ttatgtagacaaaacttata

SEQ ID NO: 2301740 - DNA, 23 bp, Homo sapiens
ttatgtcatactctgtgtaatct

SEQ ID NO: 2301741 - DNA, 15 bp, Homo sapiens
ttatgttaacagatg

SEQ ID NO: 2301742 - DNA, 13 bp, Homo sapiens
ttattaaccaaat

SEQ ID NO: 2301743 - DNA, 15 bp, Homo sapiens
ttattaaccaaatta

SEQ ID NO: 2301744 - DNA, 18 bp, Homo sapiens
ttattaaggttacagatt

SEQ ID NO: 2301745 - DNA, 17 bp, Homo sapiens
ttattaccgataaatga

SEQ ID NO: 2301746 - DNA, 14 bp, Homo sapiens
ttattagaatccaa

SEQ ID NO: 2301747 - DNA, 15 bp, Homo sapiens
ttattatagtctgta

SEQ ID NO: 2301748 - DNA, 18 bp, Homo sapiens
ttattatagtctgtactt

SEQ ID NO: 2301749 - DNA, 19 bp, Homo sapiens
ttattattttcatataatt

SEQ ID NO: 2301750 - DNA, 22 bp, Homo sapiens
ttattcatgtgtacagaaacaa

SEQ ID NO: 2301751 - DNA, 13 bp, Homo sapiens
ttattcttccaag

SEQ ID NO: 2301752 - DNA, 22 bp, Homo sapiens
ttattcttccaagttcattcat

SEQ ID NO: 2301753 - DNA, 15 bp, Homo sapiens
ttattgcctctgtct

SEQ ID NO: 2301754 - DNA, 18 bp, Homo sapiens
ttattgcctctgtcttaa

SEQ ID NO: 2301755 - DNA, 15 bp, Homo sapiens
ttattgctatatttg

SEQ ID NO: 2301756 - DNA, 15 bp, Homo sapiens
ttattgctgttgctt

SEQ ID NO: 2301757 - DNA, 16 bp, Homo sapiens
ttatttatatatgaag

SEQ ID NO: 2301758 - DNA, 11 bp, Homo sapiens
ttatttctgca

SEQ ID NO: 2301759 - DNA, 17 bp, Homo sapiens
ttattttaattcagttg

SEQ ID NO: 2301760 - DNA, 17 bp, Homo sapiens
ttattttcagtgctttg

SEQ ID NO: 2301761 - DNA, 18 bp, Homo sapiens
ttattttcataattcatt

SEQ ID NO: 2301762 - DNA, 13 bp, Homo sapiens
ttattttctatat

SEQ ID NO: 2301763 - DNA, 14 bp, Homo sapiens
ttattttctgaatt

SEQ ID NO: 2301764 - DNA, 15 bp, Homo sapiens
ttattttgtcataaa

SEQ ID NO: 2301765 - DNA, 22 bp, Homo sapiens
ttattttgtcataaaatgctat

SEQ ID NO: 2301766 - DNA, 12 bp, Homo sapiens
ttcaaaaactgt

SEQ ID NO: 2301767 - DNA, 18 bp, Homo sapiens
ttcaaaaatgtgctgcct

SEQ ID NO: 2301768 - DNA, 12 bp, Homo sapiens
ttcaaaactttc

SEQ ID NO: 2301769 - DNA, 14 bp, Homo sapiens
ttcaaaccagtttc

SEQ ID NO: 2301770 - DNA, 18 bp, Homo sapiens
ttcaaagaaaacagacca

SEQ ID NO: 2301771 - DNA, 15 bp, Homo sapiens
ttcaaagatacaaga

SEQ ID NO: 2301772 - DNA, 11 bp, Homo sapiens
ttcaacaaatg

SEQ ID NO: 2301773 - DNA, 13 bp, Homo sapiens
ttcaacaaatgat

SEQ ID NO: 2301774 - DNA, 17 bp, Homo sapiens
ttcaacacttattttct

SEQ ID NO: 2301775 - DNA, 21 bp, Homo sapiens
ttcaaccaactgtaatgcagg

SEQ ID NO: 2301776 - DNA, 22 bp, Homo sapiens
ttcaactgtataccgtgtgctc

SEQ ID NO: 2301777 - DNA, 18 bp, Homo sapiens
ttcaaggatcctgagcca

SEQ ID NO: 2301778 - DNA, 19 bp, Homo sapiens
ttcaaggatcctgagccag

SEQ ID NO: 2301779 - DNA, 22 bp, Homo sapiens
ttcaagtcatggggagattcct

SEQ ID NO: 2301780 - DNA, 13 bp, Homo sapiens
ttcaataggaaaa

SEQ ID NO: 2301781 - DNA, 18 bp, Homo sapiens
ttcaataggaaaaactga

SEQ ID NO: 2301782 - DNA, 21 bp, Homo sapiens
ttcaataggaaaaactgattt

SEQ ID NO: 2301783 - DNA, 22 bp, Homo sapiens
ttcaataggaaaaactgatttt

SEQ ID NO: 2301784 - DNA, 14 bp, Homo sapiens
ttcacatctctgta

SEQ ID NO: 2301785 - DNA, 14 bp, Homo sapiens
ttcaccctgccacc

SEQ ID NO: 2301786 - DNA, 13 bp, Homo sapiens
ttcactttcatct

SEQ ID NO: 2301787 - DNA, 13 bp, Homo sapiens
ttcagaaaagaca

SEQ ID NO: 2301788 - DNA, 15 bp, Homo sapiens
ttcagaaatatgaaa

SEQ ID NO: 2301789 - DNA, 19 bp, Homo sapiens
ttcagaatattttcaaaat

SEQ ID NO: 2301790 - DNA, 22 bp, Homo sapiens
ttcagagatgtaccatgttaaa

SEQ ID NO: 2301791 - DNA, 15 bp, Homo sapiens
ttcagagttctctgt

SEQ ID NO: 2301792 - DNA, 19 bp, Homo sapiens
ttcagcagaatgactctgg

SEQ ID NO: 2301793 - DNA, 22 bp, Homo sapiens
ttcagcatctaaagcagcaggt

SEQ ID NO: 2301794 - DNA, 14 bp, Homo sapiens
ttcagccaagaatt

SEQ ID NO: 2301795 - DNA, 19 bp, Homo sapiens
ttcaggaccccatctgctg

SEQ ID NO: 2301796 - DNA, 18 bp, Homo sapiens
ttcagtcacatgtgctct

SEQ ID NO: 2301797 - DNA, 14 bp, Homo sapiens
ttcagtcctctgca

SEQ ID NO: 2301798 - DNA, 13 bp, Homo sapiens
ttcagtgccttat

SEQ ID NO: 2301799 - DNA, 19 bp, Homo sapiens
ttcagtgccttatggaaca

SEQ ID NO: 2301800 - DNA, 18 bp, Homo sapiens
ttcagttttagtttcaaa

SEQ ID NO: 2301801 - DNA, 23 bp, Homo sapiens
ttcataatgacttaagcacactt

SEQ ID NO: 2301802 - DNA, 18 bp, Homo sapiens
ttcataattcatttaaga

SEQ ID NO: 2301803 - DNA, 16 bp, Homo sapiens
ttcatactaaataaaa

SEQ ID NO: 2301804 - DNA, 14 bp, Homo sapiens
ttcatctgttgaca

SEQ ID NO: 2301805 - DNA, 17 bp, Homo sapiens
ttcatgtgttgcaaatt

SEQ ID NO: 2301806 - DNA, 22 bp, Homo sapiens
ttcatgtgttgcaaattattct

SEQ ID NO: 2301807 - DNA, 17 bp, Homo sapiens
ttcattaaacaaacaga

SEQ ID NO: 2301808 - DNA, 19 bp, Homo sapiens
ttcattacatcctctgctt

SEQ ID NO: 2301809 - DNA, 13 bp, Homo sapiens
ttcattattttcc

SEQ ID NO: 2301810 - DNA, 21 bp, Homo sapiens
ttcatttacaacttccagatt

SEQ ID NO: 2301811 - DNA, 23 bp, Homo sapiens
ttcatttcatcttgcaaatgttg

SEQ ID NO: 2301812 - DNA, 12 bp, Homo sapiens
ttccaagggccc

SEQ ID NO: 2301813 - DNA, 22 bp, Homo sapiens
ttccacacatttccctatttta

SEQ ID NO: 2301814 - DNA, 19 bp, Homo sapiens
ttccactgaaacctctgtt

SEQ ID NO: 2301815 - DNA, 20 bp, Homo sapiens
ttccactgaaacctctgttc

SEQ ID NO: 2301816 - DNA, 17 bp, Homo sapiens
ttccagaacgccctgtg

SEQ ID NO: 2301817 - DNA, 18 bp, Homo sapiens
ttccagaacgccctgtgt

SEQ ID NO: 2301818 - DNA, 16 bp, Homo sapiens
ttccagcgtctgctgt

SEQ ID NO: 2301819 - DNA, 11 bp, Homo sapiens
ttccagctcag

SEQ ID NO: 2301820 - DNA, 13 bp, Homo sapiens
ttccagctcagtc

SEQ ID NO: 2301821 - DNA, 15 bp, Homo sapiens
ttccagctcagtccc

SEQ ID NO: 2301822 - DNA, 20 bp, Homo sapiens
ttccagctcagtcccacagc

SEQ ID NO: 2301823 - DNA, 16 bp, Homo sapiens
ttccaggagtgggtcg

SEQ ID NO: 2301824 - DNA, 21 bp, Homo sapiens
ttccaggcatgaccctggagc

SEQ ID NO: 2301825 - DNA, 18 bp, Homo sapiens
ttccaggcgtagggccag

SEQ ID NO: 2301826 - DNA, 14 bp, Homo sapiens
ttccatatgctctt

SEQ ID NO: 2301827 - DNA, 18 bp, Homo sapiens
ttccatcttacttgccct

SEQ ID NO: 2301828 - DNA, 21 bp, Homo sapiens
ttccatgggttgaacaagcca

SEQ ID NO: 2301829 - DNA, 12 bp, Homo sapiens
ttccattctatg

SEQ ID NO: 2301830 - DNA, 20 bp, Homo sapiens
ttccatttatttattcatgt

SEQ ID NO: 2301831 - DNA, 23 bp, Homo sapiens
ttcccaaagcagtgcatgctgtc

SEQ ID NO: 2301832 - DNA, 17 bp, Homo sapiens
ttcccacaattcttttg

SEQ ID NO: 2301833 - DNA, 12 bp, Homo sapiens
ttcccacagcct

SEQ ID NO: 2301834 - DNA, 18 bp, Homo sapiens
ttcccagctggcagcgcc

SEQ ID NO: 2301835 - DNA, 22 bp, Homo sapiens
ttcccagctggcagcgcctccc

SEQ ID NO: 2301836 - DNA, 20 bp, Homo sapiens
ttcccatctgctttattgcc

SEQ ID NO: 2301837 - DNA, 13 bp, Homo sapiens
ttcccatttgtaa

SEQ ID NO: 2301838 - DNA, 14 bp, Homo sapiens
ttcccatttgtaat

SEQ ID NO: 2301839 - DNA, 20 bp, Homo sapiens
ttcccatttgtaatgtatct

SEQ ID NO: 2301840 - DNA, 20 bp, Homo sapiens
ttccccggagctgggaaggt

SEQ ID NO: 2301841 - DNA, 19 bp, Homo sapiens
ttcccctcccgcttcctcc

SEQ ID NO: 2301842 - DNA, 14 bp, Homo sapiens
ttcccgcagcacca

SEQ ID NO: 2301843 - DNA, 22 bp, Homo sapiens
ttcccgcagcaccagcctgagc

SEQ ID NO: 2301844 - DNA, 13 bp, Homo sapiens
ttccctgaggacc

SEQ ID NO: 2301845 - DNA, 21 bp, Homo sapiens
ttccgtgagagtcatctcaaa

SEQ ID NO: 2301846 - DNA, 16 bp, Homo sapiens
ttcctaaactctgaaa

SEQ ID NO: 2301847 - DNA, 19 bp, Homo sapiens
ttcctcctcagtcttctca

SEQ ID NO: 2301848 - DNA, 20 bp, Homo sapiens
ttcctcctgacaccccactt

SEQ ID NO: 2301849 - DNA, 12 bp, Homo sapiens
ttcctgccaagt

SEQ ID NO: 2301850 - DNA, 18 bp, Homo sapiens
ttcctgctacagtagctg

SEQ ID NO: 2301851 - DNA, 12 bp, Homo sapiens
ttcctgctgcct

SEQ ID NO: 2301852 - DNA, 18 bp, Homo sapiens
ttcctggattttctttct

SEQ ID NO: 2301853 - DNA, 19 bp, Homo sapiens
ttcctggattttctttcta

SEQ ID NO: 2301854 - DNA, 21 bp, Homo sapiens
ttcctggattttctttctatg

SEQ ID NO: 2301855 - DNA, 23 bp, Homo sapiens
ttcctggattttctttctatgta

SEQ ID NO: 2301856 - DNA, 12 bp, Homo sapiens
ttcctgtgcctc

SEQ ID NO: 2301857 - DNA, 14 bp, Homo sapiens
ttcctgtggaaata

SEQ ID NO: 2301858 - DNA, 15 bp, Homo sapiens
ttccttattttcata

SEQ ID NO: 2301859 - DNA, 15 bp, Homo sapiens
ttccttcagtgcctt

SEQ ID NO: 2301860 - DNA, 16 bp, Homo sapiens
ttccttcagtgcctta

SEQ ID NO: 2301861 - DNA, 16 bp, Homo sapiens
ttcctttcccagaaaa

SEQ ID NO: 2301862 - DNA, 15 bp, Homo sapiens
ttcgaaaacagatga

SEQ ID NO: 2301863 - DNA, 14 bp, Homo sapiens
ttgtacctctggct

SEQ ID NO: 2301864 - DNA, 14 bp, Homo sapiens
ttgtagatatatat

SEQ ID NO: 2301865 - DNA, 22 bp, Homo sapiens
ttgtagatatatatttccaaat

SEQ ID NO: 2301866 - DNA, 14 bp, Homo sapiens
ttgtaggactaaat

SEQ ID NO: 2301867 - DNA, 14 bp, Homo sapiens
ttgtaggtatacta

SEQ ID NO: 2301868 - DNA, 19 bp, Homo sapiens
ttgtaggtatactatgtaa

SEQ ID NO: 2301869 - DNA, 20 bp, Homo sapiens
ttgtagtagttgatgaccaa

SEQ ID NO: 2301870 - DNA, 16 bp, Homo sapiens
ttgtataactaacagc

SEQ ID NO: 2301871 - DNA, 14 bp, Homo sapiens
ttgtattattgctg

SEQ ID NO: 2301872 - DNA, 23 bp, Homo sapiens
ttgtattttcttcccatttgtaa

SEQ ID NO: 2301873 - DNA, 22 bp, Homo sapiens
ttgtcaaagtggtgagaggcat

SEQ ID NO: 2301874 - DNA, 22 bp, Homo sapiens
ttgtcataaaatgctattttaa

SEQ ID NO: 2301875 - DNA, 20 bp, Homo sapiens
ttgtccaacaactccaggaa

SEQ ID NO: 2301876 - DNA, 11 bp, Homo sapiens
ttgtctctgag

SEQ ID NO: 2301877 - DNA, 18 bp, Homo sapiens
ttgtctgctgcctccaag

SEQ ID NO: 2301878 - DNA, 16 bp, Homo sapiens
ttgtctgtcctggtca

SEQ ID NO: 2301879 - DNA, 10 bp, Homo sapiens
ttgtgccaaa

SEQ ID NO: 2301880 - DNA, 16 bp, Homo sapiens
ttgtgccaaagatagc

SEQ ID NO: 2301881 - DNA, 14 bp, Homo sapiens
ttgtggctttatga

SEQ ID NO: 2301882 - DNA, 20 bp, Homo sapiens
ttgtgtaactgttctttgca

SEQ ID NO: 2301883 - DNA, 15 bp, Homo sapiens
ttgtgtactttcttc

SEQ ID NO: 2301884 - DNA, 14 bp, Homo sapiens
ttgtgtagattgtg

SEQ ID NO: 2301885 - DNA, 19 bp, Homo sapiens
ttgtgtccataagagaaat

SEQ ID NO: 2301886 - DNA, 16 bp, Homo sapiens
ttgtgtttaactgtga

SEQ ID NO: 2301887 - DNA, 21 bp, Homo sapiens
ttgtgttttcctaaacacact

SEQ ID NO: 2301888 - DNA, 23 bp, Homo sapiens
ttgttaaatgctatggaaataca

SEQ ID NO: 2301889 - DNA, 17 bp, Homo sapiens
ttgttcagtcctctgca

SEQ ID NO: 2301890 - DNA, 16 bp, Homo sapiens
ttgttggcacagaaca

SEQ ID NO: 2301891 - DNA, 13 bp, Homo sapiens
ttgtttaaaagca

SEQ ID NO: 2301892 - DNA, 16 bp, Homo sapiens
ttgtttctatactgtt

SEQ ID NO: 2301893 - DNA, 22 bp, Homo sapiens
ttgtttctatactgtttgtaat

SEQ ID NO: 2301894 - DNA, 13 bp, Homo sapiens
ttgttttgctttt

SEQ ID NO: 2301895 - DNA, 15 bp, Homo sapiens
ttgttttggctgctc

SEQ ID NO: 2301896 - DNA, 15 bp, Homo sapiens
tttaaaaaaataaca

SEQ ID NO: 2301897 - DNA, 15 bp, Homo sapiens
tttaaaaaataacat

SEQ ID NO: 2301898 - DNA, 14 bp, Homo sapiens
tttaaaaaatgaat

SEQ ID NO: 2301899 - DNA, 17 bp, Homo sapiens
tttaaaaagttgcacat

SEQ ID NO: 2301900 - DNA, 22 bp, Homo sapiens
tttaaaaatctacgtctttatt

SEQ ID NO: 2301901 - DNA, 17 bp, Homo sapiens
tttaaaatagttttcta

SEQ ID NO: 2301902 - DNA, 21 bp, Homo sapiens
tttaaaatagttttctaaatg

SEQ ID NO: 2301903 - DNA, 15 bp, Homo sapiens
tttaaaattcatgga

SEQ ID NO: 2301904 - DNA, 14 bp, Homo sapiens
tttaaactgatgta

SEQ ID NO: 2301905 - DNA, 16 bp, Homo sapiens
tttaaactgatgtata

SEQ ID NO: 2301906 - DNA, 17 bp, Homo sapiens
tttaaactgatgtatag

SEQ ID NO: 2301907 - DNA, 13 bp, Homo sapiens
tttaaaggaaagt

SEQ ID NO: 2301908 - DNA, 14 bp, Homo sapiens
tttaaataaaagag

SEQ ID NO: 2301909 - DNA, 15 bp, Homo sapiens
tttaacagatattta

SEQ ID NO: 2301910 - DNA, 16 bp, Homo sapiens
tttaacccaaaagatt

SEQ ID NO: 2301911 - DNA, 14 bp, Homo sapiens
tttaatgtaaaatt

SEQ ID NO: 2301912 - DNA, 20 bp, Homo sapiens
tttaattcctggaaaactgg

SEQ ID NO: 2301913 - DNA, 19 bp, Homo sapiens
tttaattgtgtaactgttc

SEQ ID NO: 2301914 - DNA, 18 bp, Homo sapiens
tttacctgaagtctttgt

SEQ ID NO: 2301915 - DNA, 19 bp, Homo sapiens
tttactcaggctttctatt

SEQ ID NO: 2301916 - DNA, 19 bp, Homo sapiens
tttactgtctgtaagagaa

SEQ ID NO: 2301917 - DNA, 15 bp, Homo sapiens
tttactgtgctaatg

SEQ ID NO: 2301918 - DNA, 23 bp, Homo sapiens
tttacttttttaaaattgtgttc

SEQ ID NO: 2301919 - DNA, 15 bp, Homo sapiens
tttagaaattctata

SEQ ID NO: 2301920 - DNA, 16 bp, Homo sapiens
tttagaacctgcattt

SEQ ID NO: 2301921 - DNA, 16 bp, Homo sapiens
tttagccagaatgttt

SEQ ID NO: 2301922 - DNA, 23 bp, Homo sapiens
tttaggctattataatatagaaa

SEQ ID NO: 2301923 - DNA, 23 bp, Homo sapiens
tttagtgctcagaatccacaagt

SEQ ID NO: 2301924 - DNA, 17 bp, Homo sapiens
tttagttgttgaaacaa

SEQ ID NO: 2301925 - DNA, 16 bp, Homo sapiens
tttatataactacatt

SEQ ID NO: 2301926 - DNA, 19 bp, Homo sapiens
tttatatatgaagtaagtt

SEQ ID NO: 2301927 - DNA, 23 bp, Homo sapiens
tttatattcagagatgtaccatg

SEQ ID NO: 2301928 - DNA, 15 bp, Homo sapiens
tttatgaagttaaca

SEQ ID NO: 2301929 - DNA, 18 bp, Homo sapiens
tttattgagtaatattac

SEQ ID NO: 2301930 - DNA, 24 bp, Homo sapiens
tttattgagtaatattacatttca

SEQ ID NO: 2301931 - DNA, 14 bp, Homo sapiens
tttatttatgttct

SEQ ID NO: 2301932 - DNA, 17 bp, Homo sapiens
tttatttatgttctcaa

SEQ ID NO: 2301933 - DNA, 20 bp, Homo sapiens
tttcaaagaaaacagaccag

SEQ ID NO: 2301934 - DNA, 19 bp, Homo sapiens
tttcaaatgagtttaaaaa

SEQ ID NO: 2301935 - DNA, 23 bp, Homo sapiens
tttcaataaagaaaaaaatagtt

SEQ ID NO: 2301936 - DNA, 21 bp, Homo sapiens
tttcaataagtgttgtaccat

SEQ ID NO: 2301937 - DNA, 14 bp, Homo sapiens
tttcaataggaaaa

SEQ ID NO: 2301938 - DNA, 17 bp, Homo sapiens
tttcaataggaaaaact

SEQ ID NO: 2301939 - DNA, 13 bp, Homo sapiens
tttcacagtattt

SEQ ID NO: 2301940 - DNA, 15 bp, Homo sapiens
tttcacatctctgta

SEQ ID NO: 2301941 - DNA, 17 bp, Homo sapiens
tttcaccctattttcag

SEQ ID NO: 2301942 - DNA, 13 bp, Homo sapiens
tttcacctgggat

SEQ ID NO: 2301943 - DNA, 15 bp, Homo sapiens
tttcactctccttgg

SEQ ID NO: 2301944 - DNA, 12 bp, Homo sapiens
tttcagaaatct

SEQ ID NO: 2301945 - DNA, 13 bp, Homo sapiens
tttcagcatggtt

SEQ ID NO: 2301946 - DNA, 15 bp, Homo sapiens
tttcagccaagaatt

SEQ ID NO: 2301947 - DNA, 16 bp, Homo sapiens
tttcagccaagaattc

SEQ ID NO: 2301948 - DNA, 13 bp, Homo sapiens
tttcaggaaagta

SEQ ID NO: 2301949 - DNA, 17 bp, Homo sapiens
tttcaggcaaggcagct

SEQ ID NO: 2301950 - DNA, 22 bp, Homo sapiens
tttcaggcaaggcagctcccag

SEQ ID NO: 2301951 - DNA, 20 bp, Homo sapiens
tttcagtgctttgcccttga

SEQ ID NO: 2301952 - DNA, 14 bp, Homo sapiens
tttcataattcatt

SEQ ID NO: 2301953 - DNA, 22 bp, Homo sapiens
tttcatacttacggcctttaca

SEQ ID NO: 2301954 - DNA, 17 bp, Homo sapiens
tttcatctgagctttta

SEQ ID NO: 2301955 - DNA, 23 bp, Homo sapiens
tttcatctgagcttttaccacta

SEQ ID NO: 2301956 - DNA, 17 bp, Homo sapiens
tttcatgtgttgcaaat

SEQ ID NO: 2301957 - DNA, 21 bp, Homo sapiens
tttcatgtgttgcaaattatt

SEQ ID NO: 2301958 - DNA, 15 bp, Homo sapiens
tttcatgtttaagaa

SEQ ID NO: 2301959 - DNA, 21 bp, Homo sapiens
tttcattactgcccagatgtt

SEQ ID NO: 2301960 - DNA, 23 bp, Homo sapiens
tttcattactgcccagatgtttt

SEQ ID NO: 2301961 - DNA, 16 bp, Homo sapiens
tttcattgagggaaaa

SEQ ID NO: 2301962 - DNA, 14 bp, Homo sapiens
tttccaaactgttg

SEQ ID NO: 2301963 - DNA, 22 bp, Homo sapiens
tttccaaactgttgtctagtat

SEQ ID NO: 2301964 - DNA, 16 bp, Homo sapiens
tttccaaatattctaa

SEQ ID NO: 2301965 - DNA, 22 bp, Homo sapiens
tttccaacaaacttactgtcag

SEQ ID NO: 2301966 - DNA, 17 bp, Homo sapiens
tttccaacattatcctg

SEQ ID NO: 2301967 - DNA, 23 bp, Homo sapiens
tttccaccaagggtatctgctgc

SEQ ID NO: 2301968 - DNA, 21 bp, Homo sapiens
tttcccacaattcttttgaaa

SEQ ID NO: 2301969 - DNA, 22 bp, Homo sapiens
tttcccctcccgcttcctccgg

SEQ ID NO: 2301970 - DNA, 18 bp, Homo sapiens
tttccgaagaccttctga

SEQ ID NO: 2301971 - DNA, 14 bp, Homo sapiens
tttcctgtttccag

SEQ ID NO: 2301972 - DNA, 11 bp, Homo sapiens
tttccttcagt

SEQ ID NO: 2301973 - DNA, 15 bp, Homo sapiens
tttccttcagtgcct

SEQ ID NO: 2301974 - DNA, 21 bp, Homo sapiens
tttccttcagtgccttatgga

SEQ ID NO: 2301975 - DNA, 18 bp, Homo sapiens
tttcgcctcctccagctc

SEQ ID NO: 2301976 - DNA, 16 bp, Homo sapiens
tttcgtgcatttgtga

SEQ ID NO: 2301977 - DNA, 12 bp, Homo sapiens
tttctaaactgt

SEQ ID NO: 2301978 - DNA, 14 bp, Homo sapiens
tttctaaactgttt

SEQ ID NO: 2301979 - DNA, 21 bp, Homo sapiens
tttctaaactgttttcatgtg

SEQ ID NO: 2301980 - DNA, 19 bp, Homo sapiens
tttctaaatgtttcttttt

SEQ ID NO: 2301981 - DNA, 18 bp, Homo sapiens
tttctaagctttcttaca

SEQ ID NO: 2301982 - DNA, 22 bp, Homo sapiens
tttctagctataacaactctat

SEQ ID NO: 2301983 - DNA, 14 bp, Homo sapiens
tttctatatttgga

SEQ ID NO: 2301984 - DNA, 18 bp, Homo sapiens
tttctatgtactagtact

SEQ ID NO: 2301985 - DNA, 15 bp, Homo sapiens
tttctatgtagaact

SEQ ID NO: 2301986 - DNA, 19 bp, Homo sapiens
tttctatgtagaactgttc

SEQ ID NO: 2301987 - DNA, 17 bp, Homo sapiens
tttctcaaaaagctgct

SEQ ID NO: 2301988 - DNA, 12 bp, Homo sapiens
tttctcacatgt

SEQ ID NO: 2301989 - DNA, 10 bp, Homo sapiens
tttctccccc

SEQ ID NO: 2301990 - DNA, 18 bp, Homo sapiens
tttctcctccccaaggac

SEQ ID NO: 2301991 - DNA, 19 bp, Homo sapiens
tttctcgagtccaaaatca

SEQ ID NO: 2301992 - DNA, 11 bp, Homo sapiens
tttctctgtgg

SEQ ID NO: 2301993 - DNA, 20 bp, Homo sapiens
tttctgcaaacaaacacctt

SEQ ID NO: 2301994 - DNA, 19 bp, Homo sapiens
tttctgcagccactattgt

SEQ ID NO: 2301995 - DNA, 19 bp, Homo sapiens
tttctgcagtattctgtag

SEQ ID NO: 2301996 - DNA, 20 bp, Homo sapiens
aaactgttgtctagtataca

SEQ ID NO: 2301997 - DNA, 15 bp, Homo sapiens
aaacttgaacaagaa

SEQ ID NO: 2301998 - DNA, 19 bp, Homo sapiens
aaagaaaaaaatagtttta

SEQ ID NO: 2301999 - DNA, 22 bp, Homo sapiens
aaagaaacactttcttgagcac

SEQ ID NO: 2302000 - DNA, 23 bp, Homo sapiens
aaagaaatattaatatgtacttt

SEQ ID NO: 2302001 - DNA, 16 bp, Homo sapiens
aaagaagaaaataacc

SEQ ID NO: 2302002 - DNA, 19 bp, Homo sapiens
aaagaagaaagtctatgct

SEQ ID NO: 2302003 - DNA, 14 bp, Homo sapiens
aaagaagtcaaatg

SEQ ID NO: 2302004 - DNA, 16 bp, Homo sapiens
aaagaatgaaaacaat

SEQ ID NO: 2302005 - DNA, 14 bp, Homo sapiens
aaagacttaatcat

SEQ ID NO: 2302006 - DNA, 15 bp, Homo sapiens
aaagacttaatcata

SEQ ID NO: 2302007 - DNA, 19 bp, Homo sapiens
aaagacttaatcatatcaa

SEQ ID NO: 2302008 - DNA, 21 bp, Homo sapiens
aaagagaaaatgctttctcat

SEQ ID NO: 2302009 - DNA, 24 bp, Homo sapiens
aaagagaaaatgctttctcatgca

SEQ ID NO: 2302010 - DNA, 14 bp, Homo sapiens
aaagagacaaatag

SEQ ID NO: 2302011 - DNA, 12 bp, Homo sapiens
aaagagcttccc

SEQ ID NO: 2302012 - DNA, 22 bp, Homo sapiens
aaagaggcccaagtgcaaaaga

SEQ ID NO: 2302013 - DNA, 19 bp, Homo sapiens
aaagaggcgtcttgtattt

SEQ ID NO: 2302014 - DNA, 20 bp, Homo sapiens
aaagaggcgtcttgtatttt

SEQ ID NO: 2302015 - DNA, 20 bp, Homo sapiens
aaagagggggaagatggttc

SEQ ID NO: 2302016 - DNA, 16 bp, Homo sapiens
aaagaggtccattaat

SEQ ID NO: 2302017 - DNA, 21 bp, Homo sapiens
aaagaggtccattaatacttc

SEQ ID NO: 2302018 - DNA, 22 bp, Homo sapiens
aaagaggtccattaatacttcc

SEQ ID NO: 2302019 - DNA, 22 bp, Homo sapiens
aaagagttctccttgtacttga

SEQ ID NO: 2302020 - DNA, 17 bp, Homo sapiens
aaagagttgagcacagg

SEQ ID NO: 2302021 - DNA, 15 bp, Homo sapiens
aaagattccatgggt

SEQ ID NO: 2302022 - DNA, 15 bp, Homo sapiens
aaagcagactatgca

SEQ ID NO: 2302023 - DNA, 19 bp, Homo sapiens
aaagcagagatgtattatg

SEQ ID NO: 2302024 - DNA, 13 bp, Homo sapiens
aaagcagtgcatg

SEQ ID NO: 2302025 - DNA, 16 bp, Homo sapiens
aaagcagtgcatgctg

SEQ ID NO: 2302026 - DNA, 20 bp, Homo sapiens
aaagcatttgagctgtggtt

SEQ ID NO: 2302027 - DNA, 12 bp, Homo sapiens
aaagccactttc

SEQ ID NO: 2302028 - DNA, 15 bp, Homo sapiens
aaagctgctatccaa

SEQ ID NO: 2302029 - DNA, 18 bp, Homo sapiens
aaagctttagattgaaat

SEQ ID NO: 2302030 - DNA, 20 bp, Homo sapiens
aaagctttagattgaaattt

SEQ ID NO: 2302031 - DNA, 17 bp, Homo sapiens
aaaggaaagttctatta

SEQ ID NO: 2302032 - DNA, 14 bp, Homo sapiens
aaaggatttgaaaa

SEQ ID NO: 2302033 - DNA, 15 bp, Homo sapiens
aaagggaagaaagga

SEQ ID NO: 2302034 - DNA, 22 bp, Homo sapiens
aaagggcaggcctgttccctga

SEQ ID NO: 2302035 - DNA, 14 bp, Homo sapiens
aaagtagaaaaaaa

SEQ ID NO: 2302036 - DNA, 21 bp, Homo sapiens
aaagtatctctactttcctga

SEQ ID NO: 2302037 - DNA, 21 bp, Homo sapiens
aaagtcattgctgacagagcc

SEQ ID NO: 2302038 - DNA, 20 bp, Homo sapiens
aaagtgaagtccagctccct

SEQ ID NO: 2302039 - DNA, 12 bp, Homo sapiens
aaagtggtgaga

SEQ ID NO: 2302040 - DNA, 19 bp, Homo sapiens
aaagtgttattttgtataa

SEQ ID NO: 2302041 - DNA, 13 bp, Homo sapiens
aaagttagaatct

SEQ ID NO: 2302042 - DNA, 20 bp, Homo sapiens
aaagttagggcatttttctt

SEQ ID NO: 2302043 - DNA, 24 bp, Homo sapiens
aaagttagggcatttttcttggat

SEQ ID NO: 2302044 - DNA, 23 bp, Homo sapiens
aaagttattttccaacaggggct

SEQ ID NO: 2302045 - DNA, 13 bp, Homo sapiens
aaagttctattat

SEQ ID NO: 2302046 - DNA, 21 bp, Homo sapiens
aaagttctgtgtaaacagaag

SEQ ID NO: 2302047 - DNA, 22 bp, Homo sapiens
aaagtttcattagtcatatttt

SEQ ID NO: 2302048 - DNA, 18 bp, Homo sapiens
aaagtttccatgtggcct

SEQ ID NO: 2302049 - DNA, 18 bp, Homo sapiens
aaagtttccttattttca

SEQ ID NO: 2302050 - DNA, 13 bp, Homo sapiens
aaataaaaatatt

SEQ ID NO: 2302051 - DNA, 16 bp, Homo sapiens
aaataaaaatattctc

SEQ ID NO: 2302052 - DNA, 18 bp, Homo sapiens
aaataaaaatattctcca

SEQ ID NO: 2302053 - DNA, 17 bp, Homo sapiens
aaataaaacaatgtaat

SEQ ID NO: 2302054 - DNA, 18 bp, Homo sapiens
aaataaaagaggtccatt

SEQ ID NO: 2302055 - DNA, 21 bp, Homo sapiens
aaataaaatgagttacctcat

SEQ ID NO: 2302056 - DNA, 16 bp, Homo sapiens
aaataaaatgtttaca

SEQ ID NO: 2302057 - DNA, 21 bp, Homo sapiens
aaataaaatgtttacattttc

SEQ ID NO: 2302058 - DNA, 23 bp, Homo sapiens
aaataaaatgtttacattttctt

SEQ ID NO: 2302059 - DNA, 20 bp, Homo sapiens
aaataaagaagaaaataacc

SEQ ID NO: 2302060 - DNA, 15 bp, Homo sapiens
aaataaattatggct

SEQ ID NO: 2302061 - DNA, 14 bp, Homo sapiens
aaataacatattct

SEQ ID NO: 2302062 - DNA, 15 bp, Homo sapiens
aaataacatctgaaa

SEQ ID NO: 2302063 - DNA, 19 bp, Homo sapiens
aaataacatctgaaaagaa

SEQ ID NO: 2302064 - DNA, 16 bp, Homo sapiens
aaataaccaaaaaatg

SEQ ID NO: 2302065 - DNA, 12 bp, Homo sapiens
aaataatgattt

SEQ ID NO: 2302066 - DNA, 19 bp, Homo sapiens
aaatacactacaaatgtta

SEQ ID NO: 2302067 - DNA, 12 bp, Homo sapiens
aaatacatttag

SEQ ID NO: 2302068 - DNA, 16 bp, Homo sapiens
aaatagaatatataaa

SEQ ID NO: 2302069 - DNA, 16 bp, Homo sapiens
aaatagcttttattga

SEQ ID NO: 2302070 - DNA, 20 bp, Homo sapiens
aaatagtaggctaaaaacat

SEQ ID NO: 2302071 - DNA, 23 bp, Homo sapiens
aaatagtcctccaaaacacaagg

SEQ ID NO: 2302072 - DNA, 15 bp, Homo sapiens
aaatagtgttctttt

SEQ ID NO: 2302073 - DNA, 13 bp, Homo sapiens
aaatagttctatt

SEQ ID NO: 2302074 - DNA, 13 bp, Homo sapiens
aaatagtttaaaa

SEQ ID NO: 2302075 - DNA, 15 bp, Homo sapiens
aaatagtttaaaaat

SEQ ID NO: 2302076 - DNA, 20 bp, Homo sapiens
aaatagtttaaaaatattcc

SEQ ID NO: 2302077 - DNA, 22 bp, Homo sapiens
aaatagtttacttcactttcat

SEQ ID NO: 2302078 - DNA, 13 bp, Homo sapiens
aaatagttttaca

SEQ ID NO: 2302079 - DNA, 19 bp, Homo sapiens
aaatagttttctaaatgtt

SEQ ID NO: 2302080 - DNA, 16 bp, Homo sapiens
aaatatacaaacatgt

SEQ ID NO: 2302081 - DNA, 19 bp, Homo sapiens
aaatatgacagaatttgtg

SEQ ID NO: 2302082 - DNA, 21 bp, Homo sapiens
aaatatgcaacctgtgcaaaa

SEQ ID NO: 2302083 - DNA, 22 bp, Homo sapiens
aaatatgcaacctgtgcaaaat

SEQ ID NO: 2302084 - DNA, 18 bp, Homo sapiens
aaatattaatatgtactt

SEQ ID NO: 2302085 - DNA, 12 bp, Homo sapiens
aaatattctgtc

SEQ ID NO: 2302086 - DNA, 23 bp, Homo sapiens
aaatattcttctataaatgaatc

SEQ ID NO: 2302087 - DNA, 15 bp, Homo sapiens
aaatatttatgcaga

SEQ ID NO: 2302088 - DNA, 23 bp, Homo sapiens
aaatatttttatgtgaaggtgtt

SEQ ID NO: 2302089 - DNA, 22 bp, Homo sapiens
aaatatttttttctagctataa

SEQ ID NO: 2302090 - DNA, 18 bp, Homo sapiens
aaatcagactagagaata

SEQ ID NO: 2302091 - DNA, 23 bp, Homo sapiens
aaatcagccttgcacaagtactt

SEQ ID NO: 2302092 - DNA, 22 bp, Homo sapiens
aaatcatggtattcttctgaca

SEQ ID NO: 2302093 - DNA, 21 bp, Homo sapiens
aaatccattttctaaactgtt

SEQ ID NO: 2302094 - DNA, 16 bp, Homo sapiens
aaatctgtctgattct

SEQ ID NO: 2302095 - DNA, 23 bp, Homo sapiens
aaatctgtctgattctatgcctg

SEQ ID NO: 2302096 - DNA, 15 bp, Homo sapiens
aaatctgttagcatt

SEQ ID NO: 2302097 - DNA, 21 bp, Homo sapiens
aaatctgttagcattattgcc

SEQ ID NO: 2302098 - DNA, 12 bp, Homo sapiens
aaatctgttgcc

SEQ ID NO: 2302099 - DNA, 15 bp, Homo sapiens
aaatgaatgagctct

SEQ ID NO: 2302100 - DNA, 13 bp, Homo sapiens
aaatgaatgcctt

SEQ ID NO: 2302101 - DNA, 17 bp, Homo sapiens
aaatgaatgcctttcaa

SEQ ID NO: 2302102 - DNA, 21 bp, Homo sapiens
aaatgaatgcctttcaaacat

SEQ ID NO: 2302103 - DNA, 20 bp, Homo sapiens
aaatgagtttaaaaaaataa

SEQ ID NO: 2302104 - DNA, 20 bp, Homo sapiens
aaatgattcatttttctgtt

SEQ ID NO: 2302105 - DNA, 16 bp, Homo sapiens
aaatgcaaacactgtg

SEQ ID NO: 2302106 - DNA, 20 bp, Homo sapiens
aaatgcagtccagtgagaaa

SEQ ID NO: 2302107 - DNA, 15 bp, Homo sapiens
aaatgctaaatgcaa

SEQ ID NO: 2302108 - DNA, 14 bp, Homo sapiens
aaatgctatggaaa

SEQ ID NO: 2302109 - DNA, 20 bp, Homo sapiens
aaatgctatggaaatacatt

SEQ ID NO: 2302110 - DNA, 22 bp, Homo sapiens
aaatgctatggaaatacattta

SEQ ID NO: 2302111 - DNA, 23 bp, Homo sapiens
aaatgctatggaaatacatttag

SEQ ID NO: 2302112 - DNA, 21 bp, Homo sapiens
aaatgctattttaaaattcat

SEQ ID NO: 2302113 - DNA, 19 bp, Homo sapiens
aaatgctgttggtgagaat

SEQ ID NO: 2302114 - DNA, 13 bp, Homo sapiens
aaatgctttaaat

SEQ ID NO: 2302115 - DNA, 19 bp, Homo sapiens
aaatgctttaaatagttta

SEQ ID NO: 2302116 - DNA, 18 bp, Homo sapiens
aaatggtttacttaacag

SEQ ID NO: 2302117 - DNA, 22 bp, Homo sapiens
aaatgtaagttatgtgttaaat

SEQ ID NO: 2302118 - DNA, 21 bp, Homo sapiens
aaatgtatatgttatttttgg

SEQ ID NO: 2302119 - DNA, 16 bp, Homo sapiens
aaatgtgcttcattgt

SEQ ID NO: 2302120 - DNA, 17 bp, Homo sapiens
aaatgtgcttcattgtt

SEQ ID NO: 2302121 - DNA, 16 bp, Homo sapiens
aaatgtggatgctctt

SEQ ID NO: 2302122 - DNA, 20 bp, Homo sapiens
aaatgtttacattttctttc

SEQ ID NO: 2302123 - DNA, 23 bp, Homo sapiens
aaatgtttacattttctttcata

SEQ ID NO: 2302124 - DNA, 15 bp, Homo sapiens
aaattagtgagattt

SEQ ID NO: 2302125 - DNA, 17 bp, Homo sapiens
aaattcaacacttattt

SEQ ID NO: 2302126 - DNA, 13 bp, Homo sapiens
aaattcacactgt

SEQ ID NO: 2302127 - DNA, 17 bp, Homo sapiens
aagtggaatttcttgtt

SEQ ID NO: 2302128 - DNA, 13 bp, Homo sapiens
aagtgtacaattt

SEQ ID NO: 2302129 - DNA, 22 bp, Homo sapiens
aagtgttgtaccatatgtagca

SEQ ID NO: 2302130 - DNA, 22 bp, Homo sapiens
aagtgtttttctttaatcaaaa

SEQ ID NO: 2302131 - DNA, 18 bp, Homo sapiens
aagttaaagagacaaata

SEQ ID NO: 2302132 - DNA, 22 bp, Homo sapiens
aagttaaagagacaaatagtag

SEQ ID NO: 2302133 - DNA, 12 bp, Homo sapiens
aagttaacatta

SEQ ID NO: 2302134 - DNA, 17 bp, Homo sapiens
aagttagaatctatttt

SEQ ID NO: 2302135 - DNA, 20 bp, Homo sapiens
aagttatgtgttaaatttag

SEQ ID NO: 2302136 - DNA, 18 bp, Homo sapiens
aagttcatcctttgactg

SEQ ID NO: 2302137 - DNA, 23 bp, Homo sapiens
aagttcatgtgtggaaatgggac

SEQ ID NO: 2302138 - DNA, 19 bp, Homo sapiens
aagttcattcatactcaaa

SEQ ID NO: 2302139 - DNA, 24 bp, Homo sapiens
aagttcattcatactcaaagaggc

SEQ ID NO: 2302140 - DNA, 19 bp, Homo sapiens
aagttctgaaaactgttta

SEQ ID NO: 2302141 - DNA, 15 bp, Homo sapiens
aagttgatctcccca

SEQ ID NO: 2302142 - DNA, 23 bp, Homo sapiens
aagttgctaacctcaatttatgt

SEQ ID NO: 2302143 - DNA, 11 bp, Homo sapiens
aagttggctca

SEQ ID NO: 2302144 - DNA, 17 bp, Homo sapiens
aagttgtgataaatttg

SEQ ID NO: 2302145 - DNA, 19 bp, Homo sapiens
aagttgtgataaatttgat

SEQ ID NO: 2302146 - DNA, 14 bp, Homo sapiens
aagtttatgtctca

SEQ ID NO: 2302147 - DNA, 21 bp, Homo sapiens
aataaactccccagcgtatcc

SEQ ID NO: 2302148 - DNA, 19 bp, Homo sapiens
aataaagaagaaaataacc

SEQ ID NO: 2302149 - DNA, 16 bp, Homo sapiens
aataaagactcttgga

SEQ ID NO: 2302150 - DNA, 14 bp, Homo sapiens
aataaatgtgtaaa

SEQ ID NO: 2302151 - DNA, 23 bp, Homo sapiens
aataacaactgagatgttaaaat

SEQ ID NO: 2302152 - DNA, 14 bp, Homo sapiens
aataacatattctt

SEQ ID NO: 2302153 - DNA, 19 bp, Homo sapiens
aataacatctgaaaagaaa

SEQ ID NO: 2302154 - DNA, 14 bp, Homo sapiens
aataacctgtgaat

SEQ ID NO: 2302155 - DNA, 19 bp, Homo sapiens
aataactagatctcctgta

SEQ ID NO: 2302156 - DNA, 14 bp, Homo sapiens
aataactgttagaa

SEQ ID NO: 2302157 - DNA, 21 bp, Homo sapiens
aataagcgtttaatggtatct

SEQ ID NO: 2302158 - DNA, 22 bp, Homo sapiens
aataagtgttgtaccatatgta

SEQ ID NO: 2302159 - DNA, 21 bp, Homo sapiens
aataataacaacaacttaatg

SEQ ID NO: 2302160 - DNA, 13 bp, Homo sapiens
aataataataaca

SEQ ID NO: 2302161 - DNA, 14 bp, Homo sapiens
aataatactaattt

SEQ ID NO: 2302162 - DNA, 20 bp, Homo sapiens
aataatgattcaatgtgaat

SEQ ID NO: 2302163 - DNA, 20 bp, Homo sapiens
aataatggaattatgtataa

SEQ ID NO: 2302164 - DNA, 14 bp, Homo sapiens
aataattacttaat

SEQ ID NO: 2302165 - DNA, 17 bp, Homo sapiens
aataattacttaatgtg

SEQ ID NO: 2302166 - DNA, 14 bp, Homo sapiens
aataattagctata

SEQ ID NO: 2302167 - DNA, 15 bp, Homo sapiens
aataattttaacaga

SEQ ID NO: 2302168 - DNA, 16 bp, Homo sapiens
aatacactacaaatgt

SEQ ID NO: 2302169 - DNA, 13 bp, Homo sapiens
aatacataaaaga

SEQ ID NO: 2302170 - DNA, 22 bp, Homo sapiens
aatacatttagaacctgcattt

SEQ ID NO: 2302171 - DNA, 15 bp, Homo sapiens
aataccaactatttc

SEQ ID NO: 2302172 - DNA, 18 bp, Homo sapiens
aataccaactatttcaat

SEQ ID NO: 2302173 - DNA, 23 bp, Homo sapiens
aatacctccctcatttaagaaaa

SEQ ID NO: 2302174 - DNA, 12 bp, Homo sapiens
aatactaattta

SEQ ID NO: 2302175 - DNA, 13 bp, Homo sapiens
aatactcaccaaa

SEQ ID NO: 2302176 - DNA, 22 bp, Homo sapiens
aatactcaccaaaatatagtta

SEQ ID NO: 2302177 - DNA, 13 bp, Homo sapiens
aatacttccttat

SEQ ID NO: 2302178 - DNA, 15 bp, Homo sapiens
aatagaagaaagaga

SEQ ID NO: 2302179 - DNA, 14 bp, Homo sapiens
aatagaatatataa

SEQ ID NO: 2302180 - DNA, 19 bp, Homo sapiens
aatagatcacggcatgttt

SEQ ID NO: 2302181 - DNA, 15 bp, Homo sapiens
aatagcatctgctct

SEQ ID NO: 2302182 - DNA, 15 bp, Homo sapiens
aatagcttttattga

SEQ ID NO: 2302183 - DNA, 19 bp, Homo sapiens
aatagtaaataatgattca

SEQ ID NO: 2302184 - DNA, 14 bp, Homo sapiens
aatagtaatggttc

SEQ ID NO: 2302185 - DNA, 11 bp, Homo sapiens
aatagtacatg

SEQ ID NO: 2302186 - DNA, 16 bp, Homo sapiens
aatagtgttcttttta

SEQ ID NO: 2302187 - DNA, 20 bp, Homo sapiens
aatagtgttgaggaggggag

SEQ ID NO: 2302188 - DNA, 15 bp, Homo sapiens
aatagtgttgatcag

SEQ ID NO: 2302189 - DNA, 13 bp, Homo sapiens
aatagttctattt

SEQ ID NO: 2302190 - DNA, 19 bp, Homo sapiens
aatagtttaaaaatattcc

SEQ ID NO: 2302191 - DNA, 11 bp, Homo sapiens
aatagttttac

SEQ ID NO: 2302192 - DNA, 22 bp, Homo sapiens
aatagttttctaaatgtttctt

SEQ ID NO: 2302193 - DNA, 17 bp, Homo sapiens
aatataaacttgtgtat

SEQ ID NO: 2302194 - DNA, 19 bp, Homo sapiens
aatataaataaataaaaat

SEQ ID NO: 2302195 - DNA, 23 bp, Homo sapiens
aatataaataaataaaaatattc

SEQ ID NO: 2302196 - DNA, 14 bp, Homo sapiens
aatataatattata

SEQ ID NO: 2302197 - DNA, 16 bp, Homo sapiens
aatatacaaacatgtg

SEQ ID NO: 2302198 - DNA, 20 bp, Homo sapiens
aatatacaaacatgtggcaa

SEQ ID NO: 2302199 - DNA, 18 bp, Homo sapiens
aatatacaatttcttgaa

SEQ ID NO: 2302200 - DNA, 16 bp, Homo sapiens
aatatactaaccattt

SEQ ID NO: 2302201 - DNA, 14 bp, Homo sapiens
aatatactgcatat

SEQ ID NO: 2302202 - DNA, 15 bp, Homo sapiens
aatatagttaattgt

SEQ ID NO: 2302203 - DNA, 22 bp, Homo sapiens
aatatagttgaacaagatttcc

SEQ ID NO: 2302204 - DNA, 23 bp, Homo sapiens
aatatagttgaacaagatttccc

SEQ ID NO: 2302205 - DNA, 15 bp, Homo sapiens
aatatataaacgata

SEQ ID NO: 2302206 - DNA, 11 bp, Homo sapiens
aatatatatat

SEQ ID NO: 2302207 - DNA, 13 bp, Homo sapiens
aatatatatatat

SEQ ID NO: 2302208 - DNA, 19 bp, Homo sapiens
aatatatttttaaagcaaa

SEQ ID NO: 2302209 - DNA, 22 bp, Homo sapiens
aatatcatgtgtagatattatg

SEQ ID NO: 2302210 - DNA, 23 bp, Homo sapiens
aatatcatgtgtagatattatgt

SEQ ID NO: 2302211 - DNA, 14 bp, Homo sapiens
aatatgcaacctgt

SEQ ID NO: 2302212 - DNA, 19 bp, Homo sapiens
aatatgcaacctgtgcaaa

SEQ ID NO: 2302213 - DNA, 20 bp, Homo sapiens
aatatgcagttcctgtgcct

SEQ ID NO: 2302214 - DNA, 15 bp, Homo sapiens
aatatggacaaagaa

SEQ ID NO: 2302215 - DNA, 13 bp, Homo sapiens
aatatgtactttt

SEQ ID NO: 2302216 - DNA, 15 bp, Homo sapiens
aatatgtacttttcc

SEQ ID NO: 2302217 - DNA, 23 bp, Homo sapiens
aatatgtggagttcatcttgaat

SEQ ID NO: 2302218 - DNA, 16 bp, Homo sapiens
aatattaatatgtact

SEQ ID NO: 2302219 - DNA, 17 bp, Homo sapiens
aatattaatatgtactt

SEQ ID NO: 2302220 - DNA, 12 bp, Homo sapiens
aatattacattt

SEQ ID NO: 2302221 - DNA, 18 bp, Homo sapiens
aatattacatttcattta

SEQ ID NO: 2302222 - DNA, 14 bp, Homo sapiens
aatattatacttct

SEQ ID NO: 2302223 - DNA, 13 bp, Homo sapiens
aatattgctgatg

SEQ ID NO: 2302224 - DNA, 21 bp, Homo sapiens
aatattgctgatggtgcaatg

SEQ ID NO: 2302225 - DNA, 15 bp, Homo sapiens
aatatttatgcagaa

SEQ ID NO: 2302226 - DNA, 20 bp, Homo sapiens
aatatttatgcagaaggtat

SEQ ID NO: 2302227 - DNA, 15 bp, Homo sapiens
aatatttctaagctt

SEQ ID NO: 2302228 - DNA, 21 bp, Homo sapiens
aatatttctaagcttatttct

SEQ ID NO: 2302229 - DNA, 15 bp, Homo sapiens
aatatttgcttattt

SEQ ID NO: 2302230 - DNA, 14 bp, Homo sapiens
aatattttcaaaat

SEQ ID NO: 2302231 - DNA, 20 bp, Homo sapiens
aatattttgtattattgctg

SEQ ID NO: 2302232 - DNA, 13 bp, Homo sapiens
aatatttttatgt

SEQ ID NO: 2302233 - DNA, 15 bp, Homo sapiens
aatcaaagacatttc

SEQ ID NO: 2302234 - DNA, 17 bp, Homo sapiens
aatcaaagacatttcat

SEQ ID NO: 2302235 - DNA, 21 bp, Homo sapiens
aatcaccgaaaacgtggctgc

SEQ ID NO: 2302236 - DNA, 13 bp, Homo sapiens
aatcatatgtgat

SEQ ID NO: 2302237 - DNA, 14 bp, Homo sapiens
aatcatatgtgatc

SEQ ID NO: 2302238 - DNA, 22 bp, Homo sapiens
aatcattccccccgtgaagtct

SEQ ID NO: 2302239 - DNA, 18 bp, Homo sapiens
aatccattttctaaactg

SEQ ID NO: 2302240 - DNA, 22 bp, Homo sapiens
aatccattttctaaactgtttt

SEQ ID NO: 2302241 - DNA, 23 bp, Homo sapiens
aatccattttctaaactgttttc

SEQ ID NO: 2302242 - DNA, 16 bp, Homo sapiens
aatcctgttacttaaa

SEQ ID NO: 2302243 - DNA, 13 bp, Homo sapiens
aatctagtatttg

SEQ ID NO: 2302244 - DNA, 16 bp, Homo sapiens
aatctctaaaattcta

SEQ ID NO: 2302245 - DNA, 17 bp, Homo sapiens
aatctctgattaaattt

SEQ ID NO: 2302246 - DNA, 16 bp, Homo sapiens
aatctgtctgattcta

SEQ ID NO: 2302247 - DNA, 19 bp, Homo sapiens
aatctgtctgattctatgc

SEQ ID NO: 2302248 - DNA, 14 bp, Homo sapiens
aatctttaatataa

SEQ ID NO: 2302249 - DNA, 12 bp, Homo sapiens
aatcttttctga

SEQ ID NO: 2302250 - DNA, 13 bp, Homo sapiens
aatcttttctgag

SEQ ID NO: 2302251 - DNA, 21 bp, Homo sapiens
aatgaaatatttgcttattta

SEQ ID NO: 2302252 - DNA, 15 bp, Homo sapiens
aatgaacatttaact

SEQ ID NO: 2302253 - DNA, 16 bp, Homo sapiens
aatgaatgcctttcaa

SEQ ID NO: 2302254 - DNA, 17 bp, Homo sapiens
aatgaatgcctttcaaa

SEQ ID NO: 2302255 - DNA, 13 bp, Homo sapiens
aatgaatgtcagt

SEQ ID NO: 2302256 - DNA, 15 bp, Homo sapiens
aatgaatgtcagtgt

SEQ ID NO: 2302257 - DNA, 21 bp, Homo sapiens
aatgaatgtcagtgtgactga

SEQ ID NO: 2302258 - DNA, 13 bp, Homo sapiens
aatgacctttcaa

SEQ ID NO: 2302259 - DNA, 15 bp, Homo sapiens
aatgacctttcaata

SEQ ID NO: 2302260 - DNA, 23 bp, Homo sapiens
accccgtctgccccttgacccca

SEQ ID NO: 2302261 - DNA, 22 bp, Homo sapiens
acccctaggtcatttgtagata

SEQ ID NO: 2302262 - DNA, 16 bp, Homo sapiens
acccctcctccttgct

SEQ ID NO: 2302263 - DNA, 19 bp, Homo sapiens
acccctcctccttgctgat

SEQ ID NO: 2302264 - DNA, 18 bp, Homo sapiens
acccctctaccaagctgt

SEQ ID NO: 2302265 - DNA, 13 bp, Homo sapiens
acccctgggggag

SEQ ID NO: 2302266 - DNA, 13 bp, Homo sapiens
acccgccccagag

SEQ ID NO: 2302267 - DNA, 14 bp, Homo sapiens
acccgccccagaga

SEQ ID NO: 2302268 - DNA, 16 bp, Homo sapiens
acccgccccagagact

SEQ ID NO: 2302269 - DNA, 21 bp, Homo sapiens
acccgccccagagactgccca

SEQ ID NO: 2302270 - DNA, 16 bp, Homo sapiens
acccgcccgcggccct

SEQ ID NO: 2302271 - DNA, 17 bp, Homo sapiens
acccggcagccccccag

SEQ ID NO: 2302272 - DNA, 11 bp, Homo sapiens
accctattttc

SEQ ID NO: 2302273 - DNA, 13 bp, Homo sapiens
accctcccctctt

SEQ ID NO: 2302274 - DNA, 18 bp, Homo sapiens
accctcggggcaggaagt

SEQ ID NO: 2302275 - DNA, 20 bp, Homo sapiens
accctctgctgcacagtagt

SEQ ID NO: 2302276 - DNA, 15 bp, Homo sapiens
accctgccaccctct

SEQ ID NO: 2302277 - DNA, 20 bp, Homo sapiens
accctgccaccctctgctgc

SEQ ID NO: 2302278 - DNA, 14 bp, Homo sapiens
accctgccctgcac

SEQ ID NO: 2302279 - DNA, 22 bp, Homo sapiens
accctggagcccggcagtgcac

SEQ ID NO: 2302280 - DNA, 14 bp, Homo sapiens
accctggagtggca

SEQ ID NO: 2302281 - DNA, 11 bp, Homo sapiens
accctggctgg

SEQ ID NO: 2302282 - DNA, 15 bp, Homo sapiens
accctgggcctcccg

SEQ ID NO: 2302283 - DNA, 15 bp, Homo sapiens
accgaaaacgtggct

SEQ ID NO: 2302284 - DNA, 21 bp, Homo sapiens
accgaaaacgtggctgcttca

SEQ ID NO: 2302285 - DNA, 22 bp, Homo sapiens
accgaaaacgtggctgcttcaa

SEQ ID NO: 2302286 - DNA, 18 bp, Homo sapiens
accgagtgtggagctgct

SEQ ID NO: 2302287 - DNA, 21 bp, Homo sapiens
accgagtgtggagctgcttcc

SEQ ID NO: 2302288 - DNA, 15 bp, Homo sapiens
accgcaccgggctgg

SEQ ID NO: 2302289 - DNA, 18 bp, Homo sapiens
accgcccacccacacccc

SEQ ID NO: 2302290 - DNA, 17 bp, Homo sapiens
accgcctgcccccagcg

SEQ ID NO: 2302291 - DNA, 17 bp, Homo sapiens
accggagcggctgagga

SEQ ID NO: 2302292 - DNA, 12 bp, Homo sapiens
accgtcaatgtg

SEQ ID NO: 2302293 - DNA, 17 bp, Homo sapiens
accgtcaatgtgaaata

SEQ ID NO: 2302294 - DNA, 20 bp, Homo sapiens
accgtggtgtgaggcccccg

SEQ ID NO: 2302295 - DNA, 21 bp, Homo sapiens
accgtggtgtgaggcccccgg

SEQ ID NO: 2302296 - DNA, 22 bp, Homo sapiens
accgtggtgtgaggcccccgga

SEQ ID NO: 2302297 - DNA, 19 bp, Homo sapiens
acctaaatccattttctaa

SEQ ID NO: 2302298 - DNA, 15 bp, Homo sapiens
acctagggatcctga

SEQ ID NO: 2302299 - DNA, 12 bp, Homo sapiens
acctcaaactgg

SEQ ID NO: 2302300 - DNA, 12 bp, Homo sapiens
acctcaatttat

SEQ ID NO: 2302301 - DNA, 19 bp, Homo sapiens
acctcactcagcaccactc

SEQ ID NO: 2302302 - DNA, 20 bp, Homo sapiens
acctcactcagcaccactca

SEQ ID NO: 2302303 - DNA, 16 bp, Homo sapiens
acctcatgccgctgtg

SEQ ID NO: 2302304 - DNA, 23 bp, Homo sapiens
acctcatgccgctgtgtctatga

SEQ ID NO: 2302305 - DNA, 22 bp, Homo sapiens
acctccagattattttctatat

SEQ ID NO: 2302306 - DNA, 13 bp, Homo sapiens
acctcgccctctc

SEQ ID NO: 2302307 - DNA, 15 bp, Homo sapiens
acctcgccctctctc

SEQ ID NO: 2302308 - DNA, 20 bp, Homo sapiens
acctgacacctgccgctgct

SEQ ID NO: 2302309 - DNA, 22 bp, Homo sapiens
acctgacactaaccagagtcag

SEQ ID NO: 2302310 - DNA, 18 bp, Homo sapiens
acctgaggcaggagggca

SEQ ID NO: 2302311 - DNA, 21 bp, Homo sapiens
acctgatttccatttgcaaca

SEQ ID NO: 2302312 - DNA, 14 bp, Homo sapiens
acctgcaaggcaaa

SEQ ID NO: 2302313 - DNA, 18 bp, Homo sapiens
acctgcaaggcaaagtaa

SEQ ID NO: 2302314 - DNA, 19 bp, Homo sapiens
acctgcaaggcaaagtaaa

SEQ ID NO: 2302315 - DNA, 20 bp, Homo sapiens
acctgcaaggcaaagtaaaa

SEQ ID NO: 2302316 - DNA, 22 bp, Homo sapiens
acctgcctctgaactgctgctg

SEQ ID NO: 2302317 - DNA, 23 bp, Homo sapiens
acctgcctctgaactgctgctgg

SEQ ID NO: 2302318 - DNA, 16 bp, Homo sapiens
acctgctccagatcct

SEQ ID NO: 2302319 - DNA, 22 bp, Homo sapiens
acctgggccctggttcccccag

SEQ ID NO: 2302320 - DNA, 17 bp, Homo sapiens
acctggggtcccccctc

SEQ ID NO: 2302321 - DNA, 13 bp, Homo sapiens
acctggttttcat

SEQ ID NO: 2302322 - DNA, 14 bp, Homo sapiens
acctggttttcatt

SEQ ID NO: 2302323 - DNA, 18 bp, Homo sapiens
acctgtgcaaaataaaat

SEQ ID NO: 2302324 - DNA, 17 bp, Homo sapiens
accttctgaagatctca

SEQ ID NO: 2302325 - DNA, 19 bp, Homo sapiens
accttcttattatatatat

SEQ ID NO: 2302326 - DNA, 15 bp, Homo sapiens
accttggtgagatgg

SEQ ID NO: 2302327 - DNA, 22 bp, Homo sapiens
accttgtacagaaccagcactc

SEQ ID NO: 2302328 - DNA, 21 bp, Homo sapiens
accttgtgtactttcttccct

SEQ ID NO: 2302329 - DNA, 19 bp, Homo sapiens
acctttccaaggccccacc

SEQ ID NO: 2302330 - DNA, 23 bp, Homo sapiens
acctttccaaggccccaccttct

SEQ ID NO: 2302331 - DNA, 13 bp, Homo sapiens
acctttttctctc

SEQ ID NO: 2302332 - DNA, 21 bp, Homo sapiens
acgaatattgctgatggtgca

SEQ ID NO: 2302333 - DNA, 14 bp, Homo sapiens
acgacataagctgg

SEQ ID NO: 2302334 - DNA, 17 bp, Homo sapiens
acgaggccttcagaaaa

SEQ ID NO: 2302335 - DNA, 18 bp, Homo sapiens
acgagtgagctaccagga

SEQ ID NO: 2302336 - DNA, 11 bp, Homo sapiens
acgatatatgt

SEQ ID NO: 2302337 - DNA, 20 bp, Homo sapiens
acgcacttctggggccagcc

SEQ ID NO: 2302338 - DNA, 19 bp, Homo sapiens
acgcagagccccggagcac

SEQ ID NO: 2302339 - DNA, 21 bp, Homo sapiens
acgcagagccccggagcacca

SEQ ID NO: 2302340 - DNA, 21 bp, Homo sapiens
acgccggggctggccctgccc

SEQ ID NO: 2302341 - DNA, 13 bp, Homo sapiens
acgctctctgtct

SEQ ID NO: 2302342 - DNA, 19 bp, Homo sapiens
acgctgcctcctcagcagc

SEQ ID NO: 2302343 - DNA, 22 bp, Homo sapiens
acgcttctggaggtggggaggg

SEQ ID NO: 2302344 - DNA, 23 bp, Homo sapiens
acgcttctggaggtggggagggc

SEQ ID NO: 2302345 - DNA, 18 bp, Homo sapiens
acggagagttgacttggt

SEQ ID NO: 2302346 - DNA, 14 bp, Homo sapiens
acggaggaacagat

SEQ ID NO: 2302347 - DNA, 12 bp, Homo sapiens
acggcagcccca

SEQ ID NO: 2302348 - DNA, 23 bp, Homo sapiens
acggccgtccctgacttcccagc

SEQ ID NO: 2302349 - DNA, 17 bp, Homo sapiens
acgggacagcggcccgg

SEQ ID NO: 2302350 - DNA, 12 bp, Homo sapiens
acgggagagcgc

SEQ ID NO: 2302351 - DNA, 19 bp, Homo sapiens
acgggagagcgccacccgc

SEQ ID NO: 2302352 - DNA, 22 bp, Homo sapiens
acgggcaacactcactgcctgc

SEQ ID NO: 2302353 - DNA, 12 bp, Homo sapiens
acgggcctcccc

SEQ ID NO: 2302354 - DNA, 15 bp, Homo sapiens
acggggacacggcct

SEQ ID NO: 2302355 - DNA, 19 bp, Homo sapiens
acggggacacggcctctgg

SEQ ID NO: 2302356 - DNA, 12 bp, Homo sapiens
acggttgcctga

SEQ ID NO: 2302357 - DNA, 11 bp, Homo sapiens
acgtgagtcct

SEQ ID NO: 2302358 - DNA, 21 bp, Homo sapiens
acgtggagagaagttgccctc

SEQ ID NO: 2302359 - DNA, 21 bp, Homo sapiens
acgttgcagaaaaagagcttc

SEQ ID NO: 2302360 - DNA, 22 bp, Homo sapiens
actaaaaacactggattcattt

SEQ ID NO: 2302361 - DNA, 24 bp, Homo sapiens
actaaaacccctaggtcatttgta

SEQ ID NO: 2302362 - DNA, 13 bp, Homo sapiens
actaaaattcaac

SEQ ID NO: 2302363 - DNA, 19 bp, Homo sapiens
actaaaattcaacaaatga

SEQ ID NO: 2302364 - DNA, 18 bp, Homo sapiens
actaaactaaaatagttt

SEQ ID NO: 2302365 - DNA, 19 bp, Homo sapiens
actaaactaaaatagttta

SEQ ID NO: 2302366 - DNA, 14 bp, Homo sapiens
actaaatttgggga

SEQ ID NO: 2302367 - DNA, 20 bp, Homo sapiens
actaaatttggggacagatt

SEQ ID NO: 2302368 - DNA, 24 bp, Homo sapiens
actaaatttggggacagattcagt

SEQ ID NO: 2302369 - DNA, 11 bp, Homo sapiens
actaaccattt

SEQ ID NO: 2302370 - DNA, 14 bp, Homo sapiens
actaaccatttctt

SEQ ID NO: 2302371 - DNA, 14 bp, Homo sapiens
actaagaataaata

SEQ ID NO: 2302372 - DNA, 14 bp, Homo sapiens
actaaggtcagaag

SEQ ID NO: 2302373 - DNA, 21 bp, Homo sapiens
actaatgaatgcaaaaagata

SEQ ID NO: 2302374 - DNA, 16 bp, Homo sapiens
actaattaaaaaatag

SEQ ID NO: 2302375 - DNA, 17 bp, Homo sapiens
actacacttctgaaact

SEQ ID NO: 2302376 - DNA, 14 bp, Homo sapiens
actacagatctccc

SEQ ID NO: 2302377 - DNA, 15 bp, Homo sapiens
actacagcataaatc

SEQ ID NO: 2302378 - DNA, 19 bp, Homo sapiens
actacttgatataattact

SEQ ID NO: 2302379 - DNA, 15 bp, Homo sapiens
actagaatgagaaat

SEQ ID NO: 2302380 - DNA, 17 bp, Homo sapiens
actagaatgagaaatca

SEQ ID NO: 2302381 - DNA, 19 bp, Homo sapiens
actagagaataatttttgt

SEQ ID NO: 2302382 - DNA, 15 bp, Homo sapiens
actagagactctgtg

SEQ ID NO: 2302383 - DNA, 18 bp, Homo sapiens
actagagactctgtgatc

SEQ ID NO: 2302384 - DNA, 20 bp, Homo sapiens
actagagactctgtgatcta

SEQ ID NO: 2302385 - DNA, 17 bp, Homo sapiens
actagatctcctgtaat

SEQ ID NO: 2302386 - DNA, 17 bp, Homo sapiens
actagcctttttggtat

SEQ ID NO: 2302387 - DNA, 18 bp, Homo sapiens
actaggcaaattgttcaa

SEQ ID NO: 2302388 - DNA, 13 bp, Homo sapiens
actagtaatcttg

SEQ ID NO: 2302389 - DNA, 18 bp, Homo sapiens
actataattttacaaagt

SEQ ID NO: 2302390 - DNA, 23 bp, Homo sapiens
actatccttttttattgaataac

SEQ ID NO: 2302391 - DNA, 16 bp, Homo sapiens
actatggctgtatttt

SEQ ID NO: 2302392 - DNA, 17 bp, Homo sapiens
agatgtattttcaataa

SEQ ID NO: 2302393 - DNA, 15 bp, Homo sapiens
agatgtcagtctgtc

SEQ ID NO: 2302394 - DNA, 13 bp, Homo sapiens
agatgttaaaata

SEQ ID NO: 2302395 - DNA, 14 bp, Homo sapiens
agatgttttagaga

SEQ ID NO: 2302396 - DNA, 18 bp, Homo sapiens
agattaatttgtgtagat

SEQ ID NO: 2302397 - DNA, 19 bp, Homo sapiens
agattaatttgtgtagatt

SEQ ID NO: 2302398 - DNA, 16 bp, Homo sapiens
agattaggtgtaagac

SEQ ID NO: 2302399 - DNA, 17 bp, Homo sapiens
agattatatacaaagct

SEQ ID NO: 2302400 - DNA, 18 bp, Homo sapiens
agattatatacaaagctg

SEQ ID NO: 2302401 - DNA, 17 bp, Homo sapiens
agattcagtcttgcctt

SEQ ID NO: 2302402 - DNA, 12 bp, Homo sapiens
agattgaaattt

SEQ ID NO: 2302403 - DNA, 13 bp, Homo sapiens
agatttagtttac

SEQ ID NO: 2302404 - DNA, 14 bp, Homo sapiens
agatttctagcagt

SEQ ID NO: 2302405 - DNA, 16 bp, Homo sapiens
agatttgtatttatat

SEQ ID NO: 2302406 - DNA, 17 bp, Homo sapiens
agatttttctcatctcc

SEQ ID NO: 2302407 - DNA, 20 bp, Homo sapiens
agcaaacaaaaatagaatat

SEQ ID NO: 2302408 - DNA, 15 bp, Homo sapiens
agcaagaagattcta

SEQ ID NO: 2302409 - DNA, 16 bp, Homo sapiens
agcaagaagattctaa

SEQ ID NO: 2302410 - DNA, 17 bp, Homo sapiens
agcaagcgaaagagcaa

SEQ ID NO: 2302411 - DNA, 17 bp, Homo sapiens
agcaaggctgccctgtc

SEQ ID NO: 2302412 - DNA, 19 bp, Homo sapiens
agcaaggctgctaagtgga

SEQ ID NO: 2302413 - DNA, 18 bp, Homo sapiens
agcaagtatgaaccacat

SEQ ID NO: 2302414 - DNA, 14 bp, Homo sapiens
agcaatgtttttct

SEQ ID NO: 2302415 - DNA, 16 bp, Homo sapiens
agcaatgtttttctca

SEQ ID NO: 2302416 - DNA, 12 bp, Homo sapiens
agcacaaactgt

SEQ ID NO: 2302417 - DNA, 16 bp, Homo sapiens
agcacaaactgtcgtc

SEQ ID NO: 2302418 - DNA, 18 bp, Homo sapiens
agcacagcctcacccctg

SEQ ID NO: 2302419 - DNA, 21 bp, Homo sapiens
agcacagcctcacccctgcag

SEQ ID NO: 2302420 - DNA, 20 bp, Homo sapiens
agcacagctgtgaggacaga

SEQ ID NO: 2302421 - DNA, 21 bp, Homo sapiens
agcacaggcaacattacaaac

SEQ ID NO: 2302422 - DNA, 13 bp, Homo sapiens
agcacatttagtc

SEQ ID NO: 2302423 - DNA, 22 bp, Homo sapiens
agcaccacggggtcgggggagg

SEQ ID NO: 2302424 - DNA, 21 bp, Homo sapiens
agcaccagcctgagccacagt

SEQ ID NO: 2302425 - DNA, 14 bp, Homo sapiens
agcacccccagcct

SEQ ID NO: 2302426 - DNA, 20 bp, Homo sapiens
agcacccccagcctccccca

SEQ ID NO: 2302427 - DNA, 21 bp, Homo sapiens
agcacccccagcctcccccag

SEQ ID NO: 2302428 - DNA, 17 bp, Homo sapiens
agcaccgtggtgtgagg

SEQ ID NO: 2302429 - DNA, 20 bp, Homo sapiens
agcaccgtggtgtgaggccc

SEQ ID NO: 2302430 - DNA, 15 bp, Homo sapiens
agcacggttgcctga

SEQ ID NO: 2302431 - DNA, 16 bp, Homo sapiens
agcacggttgcctgag

SEQ ID NO: 2302432 - DNA, 16 bp, Homo sapiens
agcactagaatgagaa

SEQ ID NO: 2302433 - DNA, 14 bp, Homo sapiens
agcactcccagggc

SEQ ID NO: 2302434 - DNA, 19 bp, Homo sapiens
agcactgccattagactga

SEQ ID NO: 2302435 - DNA, 20 bp, Homo sapiens
agcagaaaacctgttcaggc

SEQ ID NO: 2302436 - DNA, 14 bp, Homo sapiens
agcagaactgaagt

SEQ ID NO: 2302437 - DNA, 22 bp, Homo sapiens
agcagaactgaagtgtgctgtg

SEQ ID NO: 2302438 - DNA, 23 bp, Homo sapiens
agcagagagaagtacttttgatt

SEQ ID NO: 2302439 - DNA, 15 bp, Homo sapiens
agcagcaggtctaga

SEQ ID NO: 2302440 - DNA, 16 bp, Homo sapiens
agcagctccaacctgg

SEQ ID NO: 2302441 - DNA, 19 bp, Homo sapiens
agcagctccaacctggagg

SEQ ID NO: 2302442 - DNA, 20 bp, Homo sapiens
agcagctccaacctggaggc

SEQ ID NO: 2302443 - DNA, 12 bp, Homo sapiens
agcagctggact

SEQ ID NO: 2302444 - DNA, 14 bp, Homo sapiens
agcagctggactgg

SEQ ID NO: 2302445 - DNA, 17 bp, Homo sapiens
agcagctggactgggtg

SEQ ID NO: 2302446 - DNA, 14 bp, Homo sapiens
agcaggttctaggc

SEQ ID NO: 2302447 - DNA, 18 bp, Homo sapiens
agcagtaccatcccactg

SEQ ID NO: 2302448 - DNA, 14 bp, Homo sapiens
agcagtatgtgtgc

SEQ ID NO: 2302449 - DNA, 22 bp, Homo sapiens
agcagtatgtgtgctcttatcc

SEQ ID NO: 2302450 - DNA, 17 bp, Homo sapiens
agcagtcactgggagag

SEQ ID NO: 2302451 - DNA, 18 bp, Homo sapiens
agcagtgcatgctgtccc

SEQ ID NO: 2302452 - DNA, 19 bp, Homo sapiens
agcagttaccgaggagcta

SEQ ID NO: 2302453 - DNA, 18 bp, Homo sapiens
agcagttgcaatgatcag

SEQ ID NO: 2302454 - DNA, 18 bp, Homo sapiens
agcagttgttatattcat

SEQ ID NO: 2302455 - DNA, 16 bp, Homo sapiens
agcagtttggggcagg

SEQ ID NO: 2302456 - DNA, 23 bp, Homo sapiens
agcataaatctgttagcattatt

SEQ ID NO: 2302457 - DNA, 16 bp, Homo sapiens
agcatagttctgcaat

SEQ ID NO: 2302458 - DNA, 19 bp, Homo sapiens
agcatcatggatcaaccaa

SEQ ID NO: 2302459 - DNA, 20 bp, Homo sapiens
agcatggagagaggcctgtg

SEQ ID NO: 2302460 - DNA, 19 bp, Homo sapiens
agcatgtaagaaataagtt

SEQ ID NO: 2302461 - DNA, 15 bp, Homo sapiens
agcatgtctactgct

SEQ ID NO: 2302462 - DNA, 13 bp, Homo sapiens
agcattaaatata

SEQ ID NO: 2302463 - DNA, 15 bp, Homo sapiens
agcattaaatataaa

SEQ ID NO: 2302464 - DNA, 21 bp, Homo sapiens
agcattactttgtagatgtat

SEQ ID NO: 2302465 - DNA, 23 bp, Homo sapiens
agcattagttggagctagaaaat

SEQ ID NO: 2302466 - DNA, 15 bp, Homo sapiens
agcattcaaaatagt

SEQ ID NO: 2302467 - DNA, 18 bp, Homo sapiens
agcattttactgtctgta

SEQ ID NO: 2302468 - DNA, 23 bp, Homo sapiens
agcattttactgtctgtaagaga

SEQ ID NO: 2302469 - DNA, 14 bp, Homo sapiens
agcattttggcgct

SEQ ID NO: 2302470 - DNA, 17 bp, Homo sapiens
agccaaacattcttatt

SEQ ID NO: 2302471 - DNA, 18 bp, Homo sapiens
agccaaacattcttattt

SEQ ID NO: 2302472 - DNA, 17 bp, Homo sapiens
agccaaagagaaaagat

SEQ ID NO: 2302473 - DNA, 14 bp, Homo sapiens
agccaatgtgaatt

SEQ ID NO: 2302474 - DNA, 15 bp, Homo sapiens
agccaatttcaaaga

SEQ ID NO: 2302475 - DNA, 17 bp, Homo sapiens
agccaatttcaaagaaa

SEQ ID NO: 2302476 - DNA, 16 bp, Homo sapiens
agccacagtggggccc

SEQ ID NO: 2302477 - DNA, 18 bp, Homo sapiens
agccactggggtgggagg

SEQ ID NO: 2302478 - DNA, 18 bp, Homo sapiens
agccagaatcagcacaga

SEQ ID NO: 2302479 - DNA, 21 bp, Homo sapiens
agccagaatgtttcctgtgga

SEQ ID NO: 2302480 - DNA, 19 bp, Homo sapiens
agccagagccgcaccctgg

SEQ ID NO: 2302481 - DNA, 23 bp, Homo sapiens
agccagagccgcaccctggctgg

SEQ ID NO: 2302482 - DNA, 14 bp, Homo sapiens
agccagatttcact

SEQ ID NO: 2302483 - DNA, 22 bp, Homo sapiens
agccagatttcactctccttgg

SEQ ID NO: 2302484 - DNA, 17 bp, Homo sapiens
agccaggggtggggatg

SEQ ID NO: 2302485 - DNA, 15 bp, Homo sapiens
agccattcatttaca

SEQ ID NO: 2302486 - DNA, 15 bp, Homo sapiens
agcccaacctcttcc

SEQ ID NO: 2302487 - DNA, 23 bp, Homo sapiens
agcccacccgccccagagactgc

SEQ ID NO: 2302488 - DNA, 15 bp, Homo sapiens
agcccagaacgggcc

SEQ ID NO: 2302489 - DNA, 21 bp, Homo sapiens
agcccagaacgggcctccccg

SEQ ID NO: 2302490 - DNA, 14 bp, Homo sapiens
agcccaggcaatag

SEQ ID NO: 2302491 - DNA, 14 bp, Homo sapiens
agcccatcctctcg

SEQ ID NO: 2302492 - DNA, 19 bp, Homo sapiens
agccccatccttcccgcag

SEQ ID NO: 2302493 - DNA, 20 bp, Homo sapiens
agccccatccttcccgcagc

SEQ ID NO: 2302494 - DNA, 14 bp, Homo sapiens
agccccggagcacc

SEQ ID NO: 2302495 - DNA, 18 bp, Homo sapiens
agcccctccccgcctcct

SEQ ID NO: 2302496 - DNA, 19 bp, Homo sapiens
agcccctccccgcctcctc

SEQ ID NO: 2302497 - DNA, 17 bp, Homo sapiens
agcccctcctctcctcg

SEQ ID NO: 2302498 - DNA, 18 bp, Homo sapiens
agcccctcctctcctcgt

SEQ ID NO: 2302499 - DNA, 13 bp, Homo sapiens
agcccctgctgct

SEQ ID NO: 2302500 - DNA, 18 bp, Homo sapiens
agcccgaagtctgctgct

SEQ ID NO: 2302501 - DNA, 22 bp, Homo sapiens
agcccggccaaggacactgatg

SEQ ID NO: 2302502 - DNA, 17 bp, Homo sapiens
agcccgtcatcttccct

SEQ ID NO: 2302503 - DNA, 21 bp, Homo sapiens
agccctatctatgtcctggaa

SEQ ID NO: 2302504 - DNA, 16 bp, Homo sapiens
agccctcctttggtta

SEQ ID NO: 2302505 - DNA, 20 bp, Homo sapiens
agccgagctctcctgggcca

SEQ ID NO: 2302506 - DNA, 22 bp, Homo sapiens
agccgagctctcctgggccagg

SEQ ID NO: 2302507 - DNA, 15 bp, Homo sapiens
agccgcaccctggct

SEQ ID NO: 2302508 - DNA, 17 bp, Homo sapiens
agccgcaccctggctgg

SEQ ID NO: 2302509 - DNA, 17 bp, Homo sapiens
agccgccttcacagcag

SEQ ID NO: 2302510 - DNA, 17 bp, Homo sapiens
agccgcgctctgcccct

SEQ ID NO: 2302511 - DNA, 18 bp, Homo sapiens
agccgcgctctgcccctc

SEQ ID NO: 2302512 - DNA, 19 bp, Homo sapiens
agccgcgctctgcccctcc

SEQ ID NO: 2302513 - DNA, 14 bp, Homo sapiens
agccgggccccatg

SEQ ID NO: 2302514 - DNA, 19 bp, Homo sapiens
agccgtaatggggactctc

SEQ ID NO: 2302515 - DNA, 16 bp, Homo sapiens
agcctcaactcactag

SEQ ID NO: 2302516 - DNA, 18 bp, Homo sapiens
agcctcagagtcctgccg

SEQ ID NO: 2302517 - DNA, 19 bp, Homo sapiens
agcctcatgggagtcaggg

SEQ ID NO: 2302518 - DNA, 16 bp, Homo sapiens
agcctcccccaggctg

SEQ ID NO: 2302519 - DNA, 17 bp, Homo sapiens
agcctcctgagtagctg

SEQ ID NO: 2302520 - DNA, 21 bp, Homo sapiens
agcctcctgagtagctgggac

SEQ ID NO: 2302521 - DNA, 20 bp, Homo sapiens
agcctcgacctccctggctt

SEQ ID NO: 2302522 - DNA, 11 bp, Homo sapiens
agcctcttcct

SEQ ID NO: 2302523 - DNA, 14 bp, Homo sapiens
agcctgagccacag

SEQ ID NO: 2302524 - DNA, 12 bp, Homo sapiens
aggcagggccct

SEQ ID NO: 2302525 - DNA, 23 bp, Homo sapiens
aggcagtggcttggagcagaggt

SEQ ID NO: 2302526 - DNA, 11 bp, Homo sapiens
aggcatgagct

SEQ ID NO: 2302527 - DNA, 19 bp, Homo sapiens
aggcatgtgatgagaggaa

SEQ ID NO: 2302528 - DNA, 19 bp, Homo sapiens
aggccagtactttgccatc

SEQ ID NO: 2302529 - DNA, 12 bp, Homo sapiens
aggccctgctca

SEQ ID NO: 2302530 - DNA, 12 bp, Homo sapiens
aggcctcagtgt

SEQ ID NO: 2302531 - DNA, 16 bp, Homo sapiens
aggcctcgagcagaga

SEQ ID NO: 2302532 - DNA, 20 bp, Homo sapiens
aggcctgagggaagcccacc

SEQ ID NO: 2302533 - DNA, 13 bp, Homo sapiens
aggcctgcacagg

SEQ ID NO: 2302534 - DNA, 18 bp, Homo sapiens
aggcctggctctggagcc

SEQ ID NO: 2302535 - DNA, 19 bp, Homo sapiens
aggcctggctctggagccc

SEQ ID NO: 2302536 - DNA, 13 bp, Homo sapiens
aggcctgggtgtg

SEQ ID NO: 2302537 - DNA, 19 bp, Homo sapiens
aggcctgttccctgaggac

SEQ ID NO: 2302538 - DNA, 21 bp, Homo sapiens
aggcctgttccctgaggacct

SEQ ID NO: 2302539 - DNA, 17 bp, Homo sapiens
aggcgcccacctgccca

SEQ ID NO: 2302540 - DNA, 19 bp, Homo sapiens
aggcgcccacctgcccagt

SEQ ID NO: 2302541 - DNA, 21 bp, Homo sapiens
aggcgcccacctgcccagtta

SEQ ID NO: 2302542 - DNA, 14 bp, Homo sapiens
aggcgcgcaccgcc

SEQ ID NO: 2302543 - DNA, 21 bp, Homo sapiens
aggcgcgcaccgcccaacccc

SEQ ID NO: 2302544 - DNA, 21 bp, Homo sapiens
aggcgggaaccctctggggcc

SEQ ID NO: 2302545 - DNA, 16 bp, Homo sapiens
aggcggtatccagagg

SEQ ID NO: 2302546 - DNA, 13 bp, Homo sapiens
aggcgtagggcca

SEQ ID NO: 2302547 - DNA, 16 bp, Homo sapiens
aggctaaaaacatttt

SEQ ID NO: 2302548 - DNA, 22 bp, Homo sapiens
aggctaccagaagaggggcagc

SEQ ID NO: 2302549 - DNA, 23 bp, Homo sapiens
aggctcacaactgtttttgaaga

SEQ ID NO: 2302550 - DNA, 21 bp, Homo sapiens
aggctctatctgctgggctgg

SEQ ID NO: 2302551 - DNA, 24 bp, Homo sapiens
aggctctatttcggaaatacacta

SEQ ID NO: 2302552 - DNA, 23 bp, Homo sapiens
aggctgaatcaaagacatttcat

SEQ ID NO: 2302553 - DNA, 18 bp, Homo sapiens
aggctgagccgatctggt

SEQ ID NO: 2302554 - DNA, 21 bp, Homo sapiens
aggctgccccacccctccatg

SEQ ID NO: 2302555 - DNA, 13 bp, Homo sapiens
aggctgccctgtc

SEQ ID NO: 2302556 - DNA, 14 bp, Homo sapiens
aggctgcgcctgcc

SEQ ID NO: 2302557 - DNA, 16 bp, Homo sapiens
aggctgctaagtggaa

SEQ ID NO: 2302558 - DNA, 20 bp, Homo sapiens
aggctgctaagtggaagaca

SEQ ID NO: 2302559 - DNA, 16 bp, Homo sapiens
aggctgctgctgtgac

SEQ ID NO: 2302560 - DNA, 11 bp, Homo sapiens
aggctggacca

SEQ ID NO: 2302561 - DNA, 21 bp, Homo sapiens
aggctggagtgaagtggtgtg

SEQ ID NO: 2302562 - DNA, 20 bp, Homo sapiens
aggctggatgtgctttcatc

SEQ ID NO: 2302563 - DNA, 16 bp, Homo sapiens
aggctggctgtgtata

SEQ ID NO: 2302564 - DNA, 23 bp, Homo sapiens
aggctggtcttgaactcttggcc

SEQ ID NO: 2302565 - DNA, 15 bp, Homo sapiens
aggctgtacatcaga

SEQ ID NO: 2302566 - DNA, 22 bp, Homo sapiens
aggctgtattttcttttatatc

SEQ ID NO: 2302567 - DNA, 16 bp, Homo sapiens
aggcttcgtctcagaa

SEQ ID NO: 2302568 - DNA, 18 bp, Homo sapiens
aggcttcgtctcagaagg

SEQ ID NO: 2302569 - DNA, 22 bp, Homo sapiens
aggctttattcttccaagttca

SEQ ID NO: 2302570 - DNA, 13 bp, Homo sapiens
aggctttcatgtt

SEQ ID NO: 2302571 - DNA, 19 bp, Homo sapiens
aggctttctgggtgtgact

SEQ ID NO: 2302572 - DNA, 13 bp, Homo sapiens
aggctttttccat

SEQ ID NO: 2302573 - DNA, 16 bp, Homo sapiens
agggaaacaaaatatt

SEQ ID NO: 2302574 - DNA, 22 bp, Homo sapiens
agggaaacaaaatatttatttg

SEQ ID NO: 2302575 - DNA, 16 bp, Homo sapiens
agggaaagggagaggg

SEQ ID NO: 2302576 - DNA, 14 bp, Homo sapiens
agggaaatcaattt

SEQ ID NO: 2302577 - DNA, 19 bp, Homo sapiens
agggaaatgctgttggtga

SEQ ID NO: 2302578 - DNA, 17 bp, Homo sapiens
agggaaattcacactgt

SEQ ID NO: 2302579 - DNA, 23 bp, Homo sapiens
agggaaattcacactgtgcgttt

SEQ ID NO: 2302580 - DNA, 19 bp, Homo sapiens
agggaagaaaggaggcagc

SEQ ID NO: 2302581 - DNA, 15 bp, Homo sapiens
agggaagagtagctg

SEQ ID NO: 2302582 - DNA, 16 bp, Homo sapiens
agggaagcccacccgc

SEQ ID NO: 2302583 - DNA, 17 bp, Homo sapiens
agggaagcccacccgcc

SEQ ID NO: 2302584 - DNA, 22 bp, Homo sapiens
agggaagcccacccgccccaga

SEQ ID NO: 2302585 - DNA, 23 bp, Homo sapiens
agggaagcccacccgccccagag

SEQ ID NO: 2302586 - DNA, 16 bp, Homo sapiens
agggacttccctagaa

SEQ ID NO: 2302587 - DNA, 20 bp, Homo sapiens
agggacttccctagaagtct

SEQ ID NO: 2302588 - DNA, 17 bp, Homo sapiens
agggagaggggaagggc

SEQ ID NO: 2302589 - DNA, 17 bp, Homo sapiens
agggatccagagacctg

SEQ ID NO: 2302590 - DNA, 19 bp, Homo sapiens
agggatccagagacctgct

SEQ ID NO: 2302591 - DNA, 22 bp, Homo sapiens
agggatccagagacctgctcca

SEQ ID NO: 2302592 - DNA, 11 bp, Homo sapiens
agggcaggcag

SEQ ID NO: 2302593 - DNA, 15 bp, Homo sapiens
agggcaggcagagct

SEQ ID NO: 2302594 - DNA, 16 bp, Homo sapiens
agggcaggcagagctc

SEQ ID NO: 2302595 - DNA, 17 bp, Homo sapiens
agggcaggcagagctca

SEQ ID NO: 2302596 - DNA, 13 bp, Homo sapiens
agggcaggcctgt

SEQ ID NO: 2302597 - DNA, 16 bp, Homo sapiens
agggcaggcctgttcc

SEQ ID NO: 2302598 - DNA, 23 bp, Homo sapiens
agggcaggcctgttccctgagga

SEQ ID NO: 2302599 - DNA, 18 bp, Homo sapiens
agggccagggctctggca

SEQ ID NO: 2302600 - DNA, 18 bp, Homo sapiens
agggccagttggtgttcc

SEQ ID NO: 2302601 - DNA, 19 bp, Homo sapiens
agggcccgagcgcgtgcct

SEQ ID NO: 2302602 - DNA, 15 bp, Homo sapiens
agggccctggggtct

SEQ ID NO: 2302603 - DNA, 22 bp, Homo sapiens
agggccctggggtctctgagca

SEQ ID NO: 2302604 - DNA, 18 bp, Homo sapiens
agggccgcagggcgctcc

SEQ ID NO: 2302605 - DNA, 19 bp, Homo sapiens
agggcgcaggaaccgagga

SEQ ID NO: 2302606 - DNA, 12 bp, Homo sapiens
agggcgggcctg

SEQ ID NO: 2302607 - DNA, 14 bp, Homo sapiens
agggcgggcctgtt

SEQ ID NO: 2302608 - DNA, 17 bp, Homo sapiens
agggctatgcctccatt

SEQ ID NO: 2302609 - DNA, 22 bp, Homo sapiens
agggctatgcctccatttcaga

SEQ ID NO: 2302610 - DNA, 17 bp, Homo sapiens
agggctgagcccctcct

SEQ ID NO: 2302611 - DNA, 18 bp, Homo sapiens
agggctgggcagggccct

SEQ ID NO: 2302612 - DNA, 19 bp, Homo sapiens
agggctgggcagggccctg

SEQ ID NO: 2302613 - DNA, 20 bp, Homo sapiens
aggggatcataaagttagaa

SEQ ID NO: 2302614 - DNA, 17 bp, Homo sapiens
aggggcaaaaatatttt

SEQ ID NO: 2302615 - DNA, 18 bp, Homo sapiens
aggggcaaaaatattttg

SEQ ID NO: 2302616 - DNA, 17 bp, Homo sapiens
aggggcacacttcccct

SEQ ID NO: 2302617 - DNA, 14 bp, Homo sapiens
aggggccaggaagg

SEQ ID NO: 2302618 - DNA, 13 bp, Homo sapiens
aggggcggggcca

SEQ ID NO: 2302619 - DNA, 14 bp, Homo sapiens
aggggctggagggc

SEQ ID NO: 2302620 - DNA, 21 bp, Homo sapiens
aggggctggagggctgggcag

SEQ ID NO: 2302621 - DNA, 13 bp, Homo sapiens
aggggctggggac

SEQ ID NO: 2302622 - DNA, 22 bp, Homo sapiens
aggggcttcccacagcctcttc

SEQ ID NO: 2302623 - DNA, 19 bp, Homo sapiens
aggggcttggagcagagac

SEQ ID NO: 2302624 - DNA, 22 bp, Homo sapiens
agggggaagatggttcaaagat

SEQ ID NO: 2302625 - DNA, 16 bp, Homo sapiens
agggggagactatgtg

SEQ ID NO: 2302626 - DNA, 15 bp, Homo sapiens
aggggggcggtgagg

SEQ ID NO: 2302627 - DNA, 19 bp, Homo sapiens
agggggtcagttgggcccc

SEQ ID NO: 2302628 - DNA, 14 bp, Homo sapiens
agggggttctggga

SEQ ID NO: 2302629 - DNA, 16 bp, Homo sapiens
agggggttctgggacc

SEQ ID NO: 2302630 - DNA, 14 bp, Homo sapiens
aggggtataggaca

SEQ ID NO: 2302631 - DNA, 23 bp, Homo sapiens
aggggtataggacaaggggtgga

SEQ ID NO: 2302632 - DNA, 15 bp, Homo sapiens
aggggtggaagggca

SEQ ID NO: 2302633 - DNA, 16 bp, Homo sapiens
aggggtggaagggcag

SEQ ID NO: 2302634 - DNA, 20 bp, Homo sapiens
aggggtggaagggcaggagc

SEQ ID NO: 2302635 - DNA, 23 bp, Homo sapiens
aggggtggaagggcaggagctca

SEQ ID NO: 2302636 - DNA, 12 bp, Homo sapiens
agggtaaattat

SEQ ID NO: 2302637 - DNA, 21 bp, Homo sapiens
agggtaaattataaatgtttc

SEQ ID NO: 2302638 - DNA, 23 bp, Homo sapiens
agggtatctgctgcctctgaaaa

SEQ ID NO: 2302639 - DNA, 16 bp, Homo sapiens
agggtccaccctagcc

SEQ ID NO: 2302640 - DNA, 23 bp, Homo sapiens
agggtctcactctgttgaccagg

SEQ ID NO: 2302641 - DNA, 12 bp, Homo sapiens
agggtgccgcgg

SEQ ID NO: 2302642 - DNA, 20 bp, Homo sapiens
agggtgggccctggaggggc

SEQ ID NO: 2302643 - DNA, 23 bp, Homo sapiens
agggtttggaagaaagggagaag

SEQ ID NO: 2302644 - DNA, 15 bp, Homo sapiens
aggtatactatgtaa

SEQ ID NO: 2302645 - DNA, 16 bp, Homo sapiens
aggtatactatgtaag

SEQ ID NO: 2302646 - DNA, 19 bp, Homo sapiens
aggtatgtaaactttcctg

SEQ ID NO: 2302647 - DNA, 15 bp, Homo sapiens
aggtcaatgaaatat

SEQ ID NO: 2302648 - DNA, 23 bp, Homo sapiens
aggtcacttgatcatgctgcagt

SEQ ID NO: 2302649 - DNA, 13 bp, Homo sapiens
aggtcatcccggg

SEQ ID NO: 2302650 - DNA, 22 bp, Homo sapiens
aggtccattaatacttccttat

SEQ ID NO: 2302651 - DNA, 16 bp, Homo sapiens
aggtcctgtgagcaaa

SEQ ID NO: 2302652 - DNA, 19 bp, Homo sapiens
aggtgaacaccactttgtc

SEQ ID NO: 2302653 - DNA, 14 bp, Homo sapiens
aggtgagctacttt

SEQ ID NO: 2302654 - DNA, 16 bp, Homo sapiens
aggtgcctgagagcag

SEQ ID NO: 2302655 - DNA, 20 bp, Homo sapiens
aggtgggggcagcggccccg

SEQ ID NO: 2302656 - DNA, 21 bp, Homo sapiens
atatttccaaatattctaaaa

SEQ ID NO: 2302657 - DNA, 17 bp, Homo sapiens
atatttctcatttagca

SEQ ID NO: 2302658 - DNA, 12 bp, Homo sapiens
atatttgaaaga

SEQ ID NO: 2302659 - DNA, 14 bp, Homo sapiens
atatttgaaagaag

SEQ ID NO: 2302660 - DNA, 15 bp, Homo sapiens
atatttgaaagaagt

SEQ ID NO: 2302661 - DNA, 14 bp, Homo sapiens
atatttgcttattt

SEQ ID NO: 2302662 - DNA, 15 bp, Homo sapiens
atatttgtaggtata

SEQ ID NO: 2302663 - DNA, 16 bp, Homo sapiens
atattttcccatggaa

SEQ ID NO: 2302664 - DNA, 16 bp, Homo sapiens
atattttgtattattg

SEQ ID NO: 2302665 - DNA, 16 bp, Homo sapiens
atatttttatataata

SEQ ID NO: 2302666 - DNA, 16 bp, Homo sapiens
atatttttatgtgaag

SEQ ID NO: 2302667 - DNA, 15 bp, Homo sapiens
atcaaagacatttca

SEQ ID NO: 2302668 - DNA, 17 bp, Homo sapiens
atcaaagacatttcatc

SEQ ID NO: 2302669 - DNA, 22 bp, Homo sapiens
atcaaatcattcaaaactttca

SEQ ID NO: 2302670 - DNA, 14 bp, Homo sapiens
atcaaatgcatgcg

SEQ ID NO: 2302671 - DNA, 20 bp, Homo sapiens
atcaacagcatgtctactgc

SEQ ID NO: 2302672 - DNA, 14 bp, Homo sapiens
atcaaccaagttac

SEQ ID NO: 2302673 - DNA, 15 bp, Homo sapiens
atcaaccaagttaca

SEQ ID NO: 2302674 - DNA, 16 bp, Homo sapiens
atcaaccaagttacac

SEQ ID NO: 2302675 - DNA, 21 bp, Homo sapiens
atcaactgcatcaagatgtga

SEQ ID NO: 2302676 - DNA, 21 bp, Homo sapiens
atcaagatgtgacatgtttta

SEQ ID NO: 2302677 - DNA, 17 bp, Homo sapiens
atcaatacttttgtgta

SEQ ID NO: 2302678 - DNA, 18 bp, Homo sapiens
atcaatacttttgtgtat

SEQ ID NO: 2302679 - DNA, 22 bp, Homo sapiens
atcacaaatagtgttgatcaga

SEQ ID NO: 2302680 - DNA, 16 bp, Homo sapiens
atcacaacttttctgc

SEQ ID NO: 2302681 - DNA, 19 bp, Homo sapiens
atcacaacttttctgctac

SEQ ID NO: 2302682 - DNA, 14 bp, Homo sapiens
atcacactatttta

SEQ ID NO: 2302683 - DNA, 15 bp, Homo sapiens
atcacaggctctgca

SEQ ID NO: 2302684 - DNA, 21 bp, Homo sapiens
atcacaggctctgcatacaca

SEQ ID NO: 2302685 - DNA, 14 bp, Homo sapiens
atcacccaaaactt

SEQ ID NO: 2302686 - DNA, 17 bp, Homo sapiens
atcacctttccaaggcc

SEQ ID NO: 2302687 - DNA, 15 bp, Homo sapiens
atcactacagatctc

SEQ ID NO: 2302688 - DNA, 21 bp, Homo sapiens
atcagaactcctttctaagga

SEQ ID NO: 2302689 - DNA, 15 bp, Homo sapiens
atcagacttgattta

SEQ ID NO: 2302690 - DNA, 16 bp, Homo sapiens
atcagagggtggagat

SEQ ID NO: 2302691 - DNA, 13 bp, Homo sapiens
atcagatcttaca

SEQ ID NO: 2302692 - DNA, 16 bp, Homo sapiens
atcagcattcaaaata

SEQ ID NO: 2302693 - DNA, 18 bp, Homo sapiens
atcagcattcaaaatagt

SEQ ID NO: 2302694 - DNA, 22 bp, Homo sapiens
atcagcattcaaaatagttcta

SEQ ID NO: 2302695 - DNA, 11 bp, Homo sapiens
atcagcccctg

SEQ ID NO: 2302696 - DNA, 19 bp, Homo sapiens
atcagcccggtgtgaggag

SEQ ID NO: 2302697 - DNA, 22 bp, Homo sapiens
atcagctctgcataagattata

SEQ ID NO: 2302698 - DNA, 19 bp, Homo sapiens
atcagggcccaaataacag

SEQ ID NO: 2302699 - DNA, 20 bp, Homo sapiens
atcagggcccaaataacagt

SEQ ID NO: 2302700 - DNA, 16 bp, Homo sapiens
atcataaagttagaat

SEQ ID NO: 2302701 - DNA, 22 bp, Homo sapiens
atcatatgtgatctgtcttgta

SEQ ID NO: 2302702 - DNA, 21 bp, Homo sapiens
atcatgcaaaaaaaaaaatgt

SEQ ID NO: 2302703 - DNA, 15 bp, Homo sapiens
atcatggatcaacca

SEQ ID NO: 2302704 - DNA, 12 bp, Homo sapiens
atcatgtaatag

SEQ ID NO: 2302705 - DNA, 17 bp, Homo sapiens
atcatgtgtagatatta

SEQ ID NO: 2302706 - DNA, 15 bp, Homo sapiens
atcattgaaatcttt

SEQ ID NO: 2302707 - DNA, 21 bp, Homo sapiens
atcattgaaatctttttgctt

SEQ ID NO: 2302708 - DNA, 23 bp, Homo sapiens
atcattgctgctgtagcaacaga

SEQ ID NO: 2302709 - DNA, 14 bp, Homo sapiens
atcatttcccctcc

SEQ ID NO: 2302710 - DNA, 13 bp, Homo sapiens
atccaaaataaat

SEQ ID NO: 2302711 - DNA, 17 bp, Homo sapiens
atccaaaatagtcatgt

SEQ ID NO: 2302712 - DNA, 18 bp, Homo sapiens
atccaaaatagtcatgtt

SEQ ID NO: 2302713 - DNA, 19 bp, Homo sapiens
atccaaaatagtcatgttt

SEQ ID NO: 2302714 - DNA, 22 bp, Homo sapiens
atccaaaatagtcatgtttctg

SEQ ID NO: 2302715 - DNA, 17 bp, Homo sapiens
atccaactggaaggctt

SEQ ID NO: 2302716 - DNA, 24 bp, Homo sapiens
atccaatgatataggaaaatacat

SEQ ID NO: 2302717 - DNA, 17 bp, Homo sapiens
atccacacacagcagct

SEQ ID NO: 2302718 - DNA, 15 bp, Homo sapiens
atccaccaatatcat

SEQ ID NO: 2302719 - DNA, 23 bp, Homo sapiens
atccactctctcttgttcttact

SEQ ID NO: 2302720 - DNA, 21 bp, Homo sapiens
atccagaggtgagggaggcct

SEQ ID NO: 2302721 - DNA, 14 bp, Homo sapiens
atccagtatcttga

SEQ ID NO: 2302722 - DNA, 16 bp, Homo sapiens
atccagtcaaagacgc

SEQ ID NO: 2302723 - DNA, 12 bp, Homo sapiens
atccagtctgaa

SEQ ID NO: 2302724 - DNA, 19 bp, Homo sapiens
atccatccttttgcttcat

SEQ ID NO: 2302725 - DNA, 20 bp, Homo sapiens
atccatgcggccggcctggg

SEQ ID NO: 2302726 - DNA, 23 bp, Homo sapiens
atccatttgaacagttggctgta

SEQ ID NO: 2302727 - DNA, 15 bp, Homo sapiens
atccattttctaaac

SEQ ID NO: 2302728 - DNA, 21 bp, Homo sapiens
atcccactgatatcacgggcc

SEQ ID NO: 2302729 - DNA, 20 bp, Homo sapiens
atccccaaaacaaagtcttt

SEQ ID NO: 2302730 - DNA, 13 bp, Homo sapiens
atccccagctgtt

SEQ ID NO: 2302731 - DNA, 21 bp, Homo sapiens
atcccggggccatggaagctg

SEQ ID NO: 2302732 - DNA, 20 bp, Homo sapiens
atccctccccttgccacatc

SEQ ID NO: 2302733 - DNA, 21 bp, Homo sapiens
atccctcggtcagcaccgtgg

SEQ ID NO: 2302734 - DNA, 18 bp, Homo sapiens
atccgccctgggctctgg

SEQ ID NO: 2302735 - DNA, 13 bp, Homo sapiens
atcctataaatgt

SEQ ID NO: 2302736 - DNA, 14 bp, Homo sapiens
atcctatactggtt

SEQ ID NO: 2302737 - DNA, 17 bp, Homo sapiens
atcctcccgccccagcc

SEQ ID NO: 2302738 - DNA, 20 bp, Homo sapiens
atcctctttccccactgaag

SEQ ID NO: 2302739 - DNA, 12 bp, Homo sapiens
atcctgaataac

SEQ ID NO: 2302740 - DNA, 21 bp, Homo sapiens
atcctgagccagatttcactc

SEQ ID NO: 2302741 - DNA, 17 bp, Homo sapiens
atcctggcaaataatac

SEQ ID NO: 2302742 - DNA, 16 bp, Homo sapiens
atcctgggcatcccca

SEQ ID NO: 2302743 - DNA, 17 bp, Homo sapiens
atcctgggcatccccag

SEQ ID NO: 2302744 - DNA, 16 bp, Homo sapiens
atcctggtgtctagtt

SEQ ID NO: 2302745 - DNA, 20 bp, Homo sapiens
atcctgtcccatgggctctg

SEQ ID NO: 2302746 - DNA, 21 bp, Homo sapiens
atcctgtcccatgggctctgg

SEQ ID NO: 2302747 - DNA, 23 bp, Homo sapiens
atcctgtcccatgggctctggcc

SEQ ID NO: 2302748 - DNA, 16 bp, Homo sapiens
atccttaactgtccag

SEQ ID NO: 2302749 - DNA, 23 bp, Homo sapiens
atccttcccgcagcaccagcctg

SEQ ID NO: 2302750 - DNA, 18 bp, Homo sapiens
atccttctaaagtgctgg

SEQ ID NO: 2302751 - DNA, 14 bp, Homo sapiens
atcgacctcactgt

SEQ ID NO: 2302752 - DNA, 17 bp, Homo sapiens
atcgttacccatttctt

SEQ ID NO: 2302753 - DNA, 16 bp, Homo sapiens
atcgtttcacatctgt

SEQ ID NO: 2302754 - DNA, 19 bp, Homo sapiens
atcgtttcacatctgtata

SEQ ID NO: 2302755 - DNA, 14 bp, Homo sapiens
atctaaaaaataac

SEQ ID NO: 2302756 - DNA, 23 bp, Homo sapiens
atctaaaatactcaccaaaatat

SEQ ID NO: 2302757 - DNA, 15 bp, Homo sapiens
atctaaagcagcagg

SEQ ID NO: 2302758 - DNA, 21 bp, Homo sapiens
atctaaagcagcaggtctaga

SEQ ID NO: 2302759 - DNA, 20 bp, Homo sapiens
atctagcaagaagattctaa

SEQ ID NO: 2302760 - DNA, 21 bp, Homo sapiens
atctagcaagaagattctaaa

SEQ ID NO: 2302761 - DNA, 20 bp, Homo sapiens
atctcaagataggaagaaaa

SEQ ID NO: 2302762 - DNA, 17 bp, Homo sapiens
atctcaataaaccagtg

SEQ ID NO: 2302763 - DNA, 19 bp, Homo sapiens
atctcacctctaggcctca

SEQ ID NO: 2302764 - DNA, 15 bp, Homo sapiens
atctcacttcagttg

SEQ ID NO: 2302765 - DNA, 21 bp, Homo sapiens
atctcacttcagttgtggcct

SEQ ID NO: 2302766 - DNA, 19 bp, Homo sapiens
atctcatccccaaactgta

SEQ ID NO: 2302767 - DNA, 21 bp, Homo sapiens
atctcattacagctcattcgc

SEQ ID NO: 2302768 - DNA, 13 bp, Homo sapiens
atctcctgtaatt

SEQ ID NO: 2302769 - DNA, 21 bp, Homo sapiens
atctctaaaattctagtctct

SEQ ID NO: 2302770 - DNA, 14 bp, Homo sapiens
atctctactttcct

SEQ ID NO: 2302771 - DNA, 15 bp, Homo sapiens
atctctgattaaatt

SEQ ID NO: 2302772 - DNA, 19 bp, Homo sapiens
atctctgattaaatttaat

SEQ ID NO: 2302773 - DNA, 20 bp, Homo sapiens
atctctgattaaatttaata

SEQ ID NO: 2302774 - DNA, 21 bp, Homo sapiens
atctctgctttgtttccttct

SEQ ID NO: 2302775 - DNA, 22 bp, Homo sapiens
atctcttgtaaatacatgtccc

SEQ ID NO: 2302776 - DNA, 19 bp, Homo sapiens
atctcttgtaccagcccag

SEQ ID NO: 2302777 - DNA, 21 bp, Homo sapiens
atctctttagatccaaaataa

SEQ ID NO: 2302778 - DNA, 15 bp, Homo sapiens
atctctttccatctt

SEQ ID NO: 2302779 - DNA, 15 bp, Homo sapiens
atctgaaaagaaatg

SEQ ID NO: 2302780 - DNA, 13 bp, Homo sapiens
atctgaaatctac

SEQ ID NO: 2302781 - DNA, 14 bp, Homo sapiens
atctgaaatctaca

SEQ ID NO: 2302782 - DNA, 18 bp, Homo sapiens
atctgaaatctacaacat

SEQ ID NO: 2302783 - DNA, 15 bp, Homo sapiens
atctgcaaatagttt

SEQ ID NO: 2302784 - DNA, 22 bp, Homo sapiens
atctgctgcctctgaaaatatt

SEQ ID NO: 2302785 - DNA, 13 bp, Homo sapiens
atctgctgggctg

SEQ ID NO: 2302786 - DNA, 19 bp, Homo sapiens
atctggagtccctcctccc

SEQ ID NO: 2302787 - DNA, 22 bp, Homo sapiens
atctgggttttagaaattctat

SEQ ID NO: 2302788 - DNA, 18 bp, Homo sapiens
atttgccaaaaactaaaa

SEQ ID NO: 2302789 - DNA, 22 bp, Homo sapiens
atttgccagacagagatcagaa

SEQ ID NO: 2302790 - DNA, 23 bp, Homo sapiens
atttgccagacagagatcagaat

SEQ ID NO: 2302791 - DNA, 22 bp, Homo sapiens
atttgctaataccaactatttc

SEQ ID NO: 2302792 - DNA, 13 bp, Homo sapiens
atttgcttattta

SEQ ID NO: 2302793 - DNA, 14 bp, Homo sapiens
atttgcttatttat

SEQ ID NO: 2302794 - DNA, 18 bp, Homo sapiens
atttggctcgctgtggtt

SEQ ID NO: 2302795 - DNA, 21 bp, Homo sapiens
atttggtaaaggtatgtaaac

SEQ ID NO: 2302796 - DNA, 16 bp, Homo sapiens
atttgtaatgtatctt

SEQ ID NO: 2302797 - DNA, 14 bp, Homo sapiens
atttgtagatatat

SEQ ID NO: 2302798 - DNA, 15 bp, Homo sapiens
atttgtagatatata

SEQ ID NO: 2302799 - DNA, 18 bp, Homo sapiens
atttgtagctagaatatc

SEQ ID NO: 2302800 - DNA, 18 bp, Homo sapiens
atttgtaggtatactatg

SEQ ID NO: 2302801 - DNA, 19 bp, Homo sapiens
atttgtaggtatactatgt

SEQ ID NO: 2302802 - DNA, 15 bp, Homo sapiens
atttgtatttatatt

SEQ ID NO: 2302803 - DNA, 20 bp, Homo sapiens
atttgtatttatattagagt

SEQ ID NO: 2302804 - DNA, 15 bp, Homo sapiens
atttgtcactgaata

SEQ ID NO: 2302805 - DNA, 15 bp, Homo sapiens
attttaaaaaataac

SEQ ID NO: 2302806 - DNA, 15 bp, Homo sapiens
attttaaaaatctac

SEQ ID NO: 2302807 - DNA, 14 bp, Homo sapiens
attttaaaattcat

SEQ ID NO: 2302808 - DNA, 17 bp, Homo sapiens
attttaacagacatgta

SEQ ID NO: 2302809 - DNA, 19 bp, Homo sapiens
attttaatgtaaaattcat

SEQ ID NO: 2302810 - DNA, 23 bp, Homo sapiens
attttactgtctgtaagagaatt

SEQ ID NO: 2302811 - DNA, 17 bp, Homo sapiens
attttagatttctttga

SEQ ID NO: 2302812 - DNA, 19 bp, Homo sapiens
attttagatttctttgatt

SEQ ID NO: 2302813 - DNA, 15 bp, Homo sapiens
attttataagggcac

SEQ ID NO: 2302814 - DNA, 14 bp, Homo sapiens
attttatgctaagt

SEQ ID NO: 2302815 - DNA, 17 bp, Homo sapiens
attttccaacaggggct

SEQ ID NO: 2302816 - DNA, 15 bp, Homo sapiens
attttccacttatct

SEQ ID NO: 2302817 - DNA, 15 bp, Homo sapiens
attttcgtgcatttg

SEQ ID NO: 2302818 - DNA, 16 bp, Homo sapiens
attttcgtgcatttgt

SEQ ID NO: 2302819 - DNA, 18 bp, Homo sapiens
attttcgtgcatttgtga

SEQ ID NO: 2302820 - DNA, 17 bp, Homo sapiens
attttctaaactgtttt

SEQ ID NO: 2302821 - DNA, 14 bp, Homo sapiens
attttctatgtact

SEQ ID NO: 2302822 - DNA, 18 bp, Homo sapiens
attttctccatgtctgta

SEQ ID NO: 2302823 - DNA, 22 bp, Homo sapiens
attttcttcccatttgtaatgt

SEQ ID NO: 2302824 - DNA, 16 bp, Homo sapiens
attttctttgaaattc

SEQ ID NO: 2302825 - DNA, 19 bp, Homo sapiens
attttcttttatatctgta

SEQ ID NO: 2302826 - DNA, 21 bp, Homo sapiens
attttgctgtcccttttcctt

SEQ ID NO: 2302827 - DNA, 21 bp, Homo sapiens
attttgtatcacctcttcaca

SEQ ID NO: 2302828 - DNA, 13 bp, Homo sapiens
attttgtttccaa

SEQ ID NO: 2302829 - DNA, 14 bp, Homo sapiens
atttttactcaggc

SEQ ID NO: 2302830 - DNA, 22 bp, Homo sapiens
atttttatataatatgaatata

SEQ ID NO: 2302831 - DNA, 13 bp, Homo sapiens
atttttatgtgaa

SEQ ID NO: 2302832 - DNA, 23 bp, Homo sapiens
atttttttatataagttaaagag

SEQ ID NO: 2302833 - DNA, 15 bp, Homo sapiens
atttttttctagcta

SEQ ID NO: 2302834 - DNA, 12 bp, Homo sapiens
atttttttttcc

SEQ ID NO: 2302835 - DNA, 13 bp, Homo sapiens
atttttttttcct

SEQ ID NO: 2302836 - DNA, 20 bp, Homo sapiens
caaaaagaaatattaatatg

SEQ ID NO: 2302837 - DNA, 19 bp, Homo sapiens
caaaaagctgctatccaat

SEQ ID NO: 2302838 - DNA, 21 bp, Homo sapiens
caaaaagctgctatccaatga

SEQ ID NO: 2302839 - DNA, 14 bp, Homo sapiens
caaaaatattttgc

SEQ ID NO: 2302840 - DNA, 13 bp, Homo sapiens
caaaaccccagaa

SEQ ID NO: 2302841 - DNA, 23 bp, Homo sapiens
caaaactcagtctcaaataataa

SEQ ID NO: 2302842 - DNA, 19 bp, Homo sapiens
caaaactgtaccctatgtt

SEQ ID NO: 2302843 - DNA, 12 bp, Homo sapiens
caaaactttcag

SEQ ID NO: 2302844 - DNA, 15 bp, Homo sapiens
caaaacttttggcaa

SEQ ID NO: 2302845 - DNA, 16 bp, Homo sapiens
caaaataaaatgagtt

SEQ ID NO: 2302846 - DNA, 18 bp, Homo sapiens
caaaataaaatgagttac

SEQ ID NO: 2302847 - DNA, 17 bp, Homo sapiens
caaaataattagctata

SEQ ID NO: 2302848 - DNA, 19 bp, Homo sapiens
caaaatagtcatgtttctg

SEQ ID NO: 2302849 - DNA, 15 bp, Homo sapiens
caaaatagttctatt

SEQ ID NO: 2302850 - DNA, 17 bp, Homo sapiens
caaaatgtgattctatg

SEQ ID NO: 2302851 - DNA, 17 bp, Homo sapiens
caaaatgttaacaactt

SEQ ID NO: 2302852 - DNA, 15 bp, Homo sapiens
caaacaaaagttctg

SEQ ID NO: 2302853 - DNA, 14 bp, Homo sapiens
caaacaaaatgatg

SEQ ID NO: 2302854 - DNA, 19 bp, Homo sapiens
caaacaaaggatttgaaaa

SEQ ID NO: 2302855 - DNA, 18 bp, Homo sapiens
caaacacccaagcacaaa

SEQ ID NO: 2302856 - DNA, 21 bp, Homo sapiens
caaacaccttcttattatata

SEQ ID NO: 2302857 - DNA, 22 bp, Homo sapiens
caaacaccttcttattatatat

SEQ ID NO: 2302858 - DNA, 20 bp, Homo sapiens
caaacactgcttaaggaaaa

SEQ ID NO: 2302859 - DNA, 15 bp, Homo sapiens
caaacactgtgtatt

SEQ ID NO: 2302860 - DNA, 19 bp, Homo sapiens
caaacatgtggcaacctgt

SEQ ID NO: 2302861 - DNA, 19 bp, Homo sapiens
caaacattcttattttaga

SEQ ID NO: 2302862 - DNA, 16 bp, Homo sapiens
caaacctctatatgtt

SEQ ID NO: 2302863 - DNA, 21 bp, Homo sapiens
caaactctttgcccagttcat

SEQ ID NO: 2302864 - DNA, 21 bp, Homo sapiens
caaactgtagtaattgttaca

SEQ ID NO: 2302865 - DNA, 15 bp, Homo sapiens
caaacttagaaaggg

SEQ ID NO: 2302866 - DNA, 16 bp, Homo sapiens
caaagacttaatcata

SEQ ID NO: 2302867 - DNA, 18 bp, Homo sapiens
caaagatacaagaaaaag

SEQ ID NO: 2302868 - DNA, 21 bp, Homo sapiens
caaagcagtgcatgctgtccc

SEQ ID NO: 2302869 - DNA, 14 bp, Homo sapiens
caaagctgaagatc

SEQ ID NO: 2302870 - DNA, 18 bp, Homo sapiens
caaagctgtcactcacaa

SEQ ID NO: 2302871 - DNA, 20 bp, Homo sapiens
caaaggatctttgttcctct

SEQ ID NO: 2302872 - DNA, 15 bp, Homo sapiens
caaaggatttgaaaa

SEQ ID NO: 2302873 - DNA, 14 bp, Homo sapiens
caaagggcgggcct

SEQ ID NO: 2302874 - DNA, 21 bp, Homo sapiens
caaagggtaaattataaatgt

SEQ ID NO: 2302875 - DNA, 16 bp, Homo sapiens
caaagtctttggggtc

SEQ ID NO: 2302876 - DNA, 16 bp, Homo sapiens
caaagtgcttcctttt

SEQ ID NO: 2302877 - DNA, 20 bp, Homo sapiens
caaagtgtacaattttcatc

SEQ ID NO: 2302878 - DNA, 22 bp, Homo sapiens
caaagtttggaagtacataaag

SEQ ID NO: 2302879 - DNA, 17 bp, Homo sapiens
caaataaaacagtgaaa

SEQ ID NO: 2302880 - DNA, 19 bp, Homo sapiens
caaataaatgtgtaaatgt

SEQ ID NO: 2302881 - DNA, 11 bp, Homo sapiens
caaataacagt

SEQ ID NO: 2302882 - DNA, 13 bp, Homo sapiens
caaataagacagt

SEQ ID NO: 2302883 - DNA, 11 bp, Homo sapiens
caaataataat

SEQ ID NO: 2302884 - DNA, 16 bp, Homo sapiens
caaataatactaattt

SEQ ID NO: 2302885 - DNA, 22 bp, Homo sapiens
caaatagtaggctaaaaacatt

SEQ ID NO: 2302886 - DNA, 19 bp, Homo sapiens
caaatagtgttgatcagat

SEQ ID NO: 2302887 - DNA, 14 bp, Homo sapiens
caaatatagttgaa

SEQ ID NO: 2302888 - DNA, 21 bp, Homo sapiens
caaatattgctattgtttata

SEQ ID NO: 2302889 - DNA, 23 bp, Homo sapiens
caaatattgctattgtttatagg

SEQ ID NO: 2302890 - DNA, 12 bp, Homo sapiens
caaatcattcaa

SEQ ID NO: 2302891 - DNA, 14 bp, Homo sapiens
caaatcattcaaaa

SEQ ID NO: 2302892 - DNA, 22 bp, Homo sapiens
caaatgaatgcctttcaaacat

SEQ ID NO: 2302893 - DNA, 21 bp, Homo sapiens
caaatgagtttaaaaaaataa

SEQ ID NO: 2302894 - DNA, 17 bp, Homo sapiens
caaatgctaaatgcaaa

SEQ ID NO: 2302895 - DNA, 18 bp, Homo sapiens
caaatgttgtatttcaaa

SEQ ID NO: 2302896 - DNA, 15 bp, Homo sapiens
caaattattctagtc

SEQ ID NO: 2302897 - DNA, 22 bp, Homo sapiens
caaattcttgaataaactcccc

SEQ ID NO: 2302898 - DNA, 15 bp, Homo sapiens
caaattggtgtttct

SEQ ID NO: 2302899 - DNA, 14 bp, Homo sapiens
caaatttttactca

SEQ ID NO: 2302900 - DNA, 19 bp, Homo sapiens
caaatttttactcaggctt

SEQ ID NO: 2302901 - DNA, 20 bp, Homo sapiens
caaatttttactcaggcttt

SEQ ID NO: 2302902 - DNA, 18 bp, Homo sapiens
caacaaagtgcttccttt

SEQ ID NO: 2302903 - DNA, 14 bp, Homo sapiens
caacaactccagga

SEQ ID NO: 2302904 - DNA, 19 bp, Homo sapiens
caacaactccaggaaaact

SEQ ID NO: 2302905 - DNA, 16 bp, Homo sapiens
caacaagtgctcctga

SEQ ID NO: 2302906 - DNA, 22 bp, Homo sapiens
caacaagtgctcctgaaagaaa

SEQ ID NO: 2302907 - DNA, 17 bp, Homo sapiens
caacactcactgcctgc

SEQ ID NO: 2302908 - DNA, 15 bp, Homo sapiens
caacacttattttct

SEQ ID NO: 2302909 - DNA, 23 bp, Homo sapiens
caacaggggctggagggctgggc

SEQ ID NO: 2302910 - DNA, 20 bp, Homo sapiens
caacaggtcacttgatcatg

SEQ ID NO: 2302911 - DNA, 15 bp, Homo sapiens
caacaggttttcctg

SEQ ID NO: 2302912 - DNA, 14 bp, Homo sapiens
caacataatgatac

SEQ ID NO: 2302913 - DNA, 19 bp, Homo sapiens
caacattatcctgtgtgat

SEQ ID NO: 2302914 - DNA, 22 bp, Homo sapiens
caacattatcctgtgtgattac

SEQ ID NO: 2302915 - DNA, 24 bp, Homo sapiens
caacattatcctgtgtgattacag

SEQ ID NO: 2302916 - DNA, 14 bp, Homo sapiens
caacatttccgaag

SEQ ID NO: 2302917 - DNA, 19 bp, Homo sapiens
caacattttaaaaataaat

SEQ ID NO: 2302918 - DNA, 15 bp, Homo sapiens
caaccaaagatgctt

SEQ ID NO: 2302919 - DNA, 19 bp, Homo sapiens
caaccaactgtaatgcagg

SEQ ID NO: 2302920 - DNA, 17 bp, Homo sapiens
cagcccggtgtgaggag

SEQ ID NO: 2302921 - DNA, 21 bp, Homo sapiens
cagccctcggcgctccgggac

SEQ ID NO: 2302922 - DNA, 13 bp, Homo sapiens
cagccgccttcac

SEQ ID NO: 2302923 - DNA, 14 bp, Homo sapiens
cagccgcgctctgc

SEQ ID NO: 2302924 - DNA, 21 bp, Homo sapiens
cagccgcgctctgcccctccg

SEQ ID NO: 2302925 - DNA, 17 bp, Homo sapiens
cagccgtaatggggact

SEQ ID NO: 2302926 - DNA, 19 bp, Homo sapiens
cagccgtaatggggactct

SEQ ID NO: 2302927 - DNA, 21 bp, Homo sapiens
cagcctcccccaggctgcgcc

SEQ ID NO: 2302928 - DNA, 20 bp, Homo sapiens
cagcctcgacctccctggct

SEQ ID NO: 2302929 - DNA, 14 bp, Homo sapiens
cagcctcttcctcc

SEQ ID NO: 2302930 - DNA, 18 bp, Homo sapiens
cagcctgagccacagtgg

SEQ ID NO: 2302931 - DNA, 16 bp, Homo sapiens
cagcctgagctccacc

SEQ ID NO: 2302932 - DNA, 18 bp, Homo sapiens
cagcctgagctccaccct

SEQ ID NO: 2302933 - DNA, 20 bp, Homo sapiens
cagcctgagctccaccctcc

SEQ ID NO: 2302934 - DNA, 18 bp, Homo sapiens
cagccttgaactgtggcc

SEQ ID NO: 2302935 - DNA, 20 bp, Homo sapiens
cagcctttgcgctctgggtt

SEQ ID NO: 2302936 - DNA, 17 bp, Homo sapiens
cagcgagtctggagacc

SEQ ID NO: 2302937 - DNA, 20 bp, Homo sapiens
cagcgattcctgccaagtag

SEQ ID NO: 2302938 - DNA, 14 bp, Homo sapiens
cagcgcctcccgcc

SEQ ID NO: 2302939 - DNA, 15 bp, Homo sapiens
cagcgcctcccgccg

SEQ ID NO: 2302940 - DNA, 19 bp, Homo sapiens
cagcggccccgcacccctc

SEQ ID NO: 2302941 - DNA, 23 bp, Homo sapiens
cagcggccccgcacccctcctcc

SEQ ID NO: 2302942 - DNA, 15 bp, Homo sapiens
cagcggcccggccca

SEQ ID NO: 2302943 - DNA, 20 bp, Homo sapiens
cagcggcccggcccacgcag

SEQ ID NO: 2302944 - DNA, 18 bp, Homo sapiens
cagcgggcgcgggacagg

SEQ ID NO: 2302945 - DNA, 14 bp, Homo sapiens
cagcgtctgctgtt

SEQ ID NO: 2302946 - DNA, 23 bp, Homo sapiens
cagcgtgggggtggccactcctg

SEQ ID NO: 2302947 - DNA, 15 bp, Homo sapiens
cagcgtttctccacc

SEQ ID NO: 2302948 - DNA, 18 bp, Homo sapiens
cagctaacatggaagtac

SEQ ID NO: 2302949 - DNA, 14 bp, Homo sapiens
cagctacctgggag

SEQ ID NO: 2302950 - DNA, 17 bp, Homo sapiens
cagctcactgcagcctc

SEQ ID NO: 2302951 - DNA, 14 bp, Homo sapiens
cagctcagtcccac

SEQ ID NO: 2302952 - DNA, 20 bp, Homo sapiens
cagctcagtcccacagcccc

SEQ ID NO: 2302953 - DNA, 13 bp, Homo sapiens
cagctccaacctg

SEQ ID NO: 2302954 - DNA, 17 bp, Homo sapiens
cagctgactgaatgcag

SEQ ID NO: 2302955 - DNA, 17 bp, Homo sapiens
cagctgaggcaggggga

SEQ ID NO: 2302956 - DNA, 13 bp, Homo sapiens
cagctggcagcgc

SEQ ID NO: 2302957 - DNA, 15 bp, Homo sapiens
cagctggcagcgcct

SEQ ID NO: 2302958 - DNA, 16 bp, Homo sapiens
cagctggcagcgcctc

SEQ ID NO: 2302959 - DNA, 19 bp, Homo sapiens
cagctggcagcgcctcccg

SEQ ID NO: 2302960 - DNA, 22 bp, Homo sapiens
cagctggctgggtcgcccctcc

SEQ ID NO: 2302961 - DNA, 23 bp, Homo sapiens
cagcttgaatgtccccattctat

SEQ ID NO: 2302962 - DNA, 14 bp, Homo sapiens
cagcttgtttctat

SEQ ID NO: 2302963 - DNA, 22 bp, Homo sapiens
cagctttgggatctatatacat

SEQ ID NO: 2302964 - DNA, 22 bp, Homo sapiens
cagctttgtttttggcatttcg

SEQ ID NO: 2302965 - DNA, 23 bp, Homo sapiens
caggaaagtatctctactttcct

SEQ ID NO: 2302966 - DNA, 15 bp, Homo sapiens
caggaaatacagaga

SEQ ID NO: 2302967 - DNA, 16 bp, Homo sapiens
caggaacacccagccc

SEQ ID NO: 2302968 - DNA, 18 bp, Homo sapiens
caggaacacccagcccca

SEQ ID NO: 2302969 - DNA, 18 bp, Homo sapiens
caggaaccgaggactcca

SEQ ID NO: 2302970 - DNA, 19 bp, Homo sapiens
caggaaggggacaggattg

SEQ ID NO: 2302971 - DNA, 23 bp, Homo sapiens
caggaaggggacaggattgtctg

SEQ ID NO: 2302972 - DNA, 14 bp, Homo sapiens
caggaagtactgga

SEQ ID NO: 2302973 - DNA, 16 bp, Homo sapiens
caggaagtccctgaga

SEQ ID NO: 2302974 - DNA, 21 bp, Homo sapiens
caggaagtccctgagaagcct

SEQ ID NO: 2302975 - DNA, 12 bp, Homo sapiens
caggaccccatc

SEQ ID NO: 2302976 - DNA, 13 bp, Homo sapiens
caggaccccatct

SEQ ID NO: 2302977 - DNA, 18 bp, Homo sapiens
caggaccccatctgctga

SEQ ID NO: 2302978 - DNA, 13 bp, Homo sapiens
caggaccctgagg

SEQ ID NO: 2302979 - DNA, 22 bp, Homo sapiens
caggagaatcgcttgaacccag

SEQ ID NO: 2302980 - DNA, 13 bp, Homo sapiens
caggagacactgg

SEQ ID NO: 2302981 - DNA, 21 bp, Homo sapiens
caggagcagcgtgcaggagca

SEQ ID NO: 2302982 - DNA, 14 bp, Homo sapiens
caggaggagacagt

SEQ ID NO: 2302983 - DNA, 17 bp, Homo sapiens
caggaggagacagtcag

SEQ ID NO: 2302984 - DNA, 22 bp, Homo sapiens
caggaggagacagtcaggaagc

SEQ ID NO: 2302985 - DNA, 16 bp, Homo sapiens
caggaggtgcctgaga

SEQ ID NO: 2302986 - DNA, 19 bp, Homo sapiens
caggaggtgcctgagagca

SEQ ID NO: 2302987 - DNA, 22 bp, Homo sapiens
caggagtgggtgggacacagag

SEQ ID NO: 2302988 - DNA, 23 bp, Homo sapiens
caggagtgggtgggacacagaga

SEQ ID NO: 2302989 - DNA, 24 bp, Homo sapiens
caggagtgggtgggacacagagac

SEQ ID NO: 2302990 - DNA, 14 bp, Homo sapiens
caggattctccttt

SEQ ID NO: 2302991 - DNA, 13 bp, Homo sapiens
caggattctgaca

SEQ ID NO: 2302992 - DNA, 14 bp, Homo sapiens
caggattctgacag

SEQ ID NO: 2302993 - DNA, 18 bp, Homo sapiens
caggattgtctgctgcct

SEQ ID NO: 2302994 - DNA, 21 bp, Homo sapiens
caggattgtctgctgcctcca

SEQ ID NO: 2302995 - DNA, 21 bp, Homo sapiens
caggcaatagtgttgaggagg

SEQ ID NO: 2302996 - DNA, 22 bp, Homo sapiens
caggcaccgcctgcccccagcg

SEQ ID NO: 2302997 - DNA, 22 bp, Homo sapiens
caggcaggctttctgggtgtga

SEQ ID NO: 2302998 - DNA, 20 bp, Homo sapiens
caggcagtagcagctgtgtt

SEQ ID NO: 2302999 - DNA, 18 bp, Homo sapiens
caggcatgaccctggagc

SEQ ID NO: 2303000 - DNA, 13 bp, Homo sapiens
caggccctgctca

SEQ ID NO: 2303001 - DNA, 13 bp, Homo sapiens
caggcgcgcaccg

SEQ ID NO: 2303002 - DNA, 14 bp, Homo sapiens
caggcgcgcaccgc

SEQ ID NO: 2303003 - DNA, 17 bp, Homo sapiens
caggcgcgcaccgccca

SEQ ID NO: 2303004 - DNA, 22 bp, Homo sapiens
caggcgcgcaccgcccaacccc

SEQ ID NO: 2303005 - DNA, 19 bp, Homo sapiens
caggcggaggggcttggag

SEQ ID NO: 2303006 - DNA, 23 bp, Homo sapiens
caggcggaggggcttggagcaga

SEQ ID NO: 2303007 - DNA, 15 bp, Homo sapiens
caggcggtatccaga

SEQ ID NO: 2303008 - DNA, 16 bp, Homo sapiens
caggcggtatccagag

SEQ ID NO: 2303009 - DNA, 19 bp, Homo sapiens
caggcggtatccagaggtg

SEQ ID NO: 2303010 - DNA, 16 bp, Homo sapiens
caggcgtagggccagg

SEQ ID NO: 2303011 - DNA, 17 bp, Homo sapiens
caggcgtagggccaggg

SEQ ID NO: 2303012 - DNA, 18 bp, Homo sapiens
caggcgtagggccagggc

SEQ ID NO: 2303013 - DNA, 19 bp, Homo sapiens
caggcgtagggccagggct

SEQ ID NO: 2303014 - DNA, 15 bp, Homo sapiens
caggctcacaactgt

SEQ ID NO: 2303015 - DNA, 13 bp, Homo sapiens
caggctccccaag

SEQ ID NO: 2303016 - DNA, 13 bp, Homo sapiens
caggctgcgcctg

SEQ ID NO: 2303017 - DNA, 17 bp, Homo sapiens
caggctgcgcctgcccg

SEQ ID NO: 2303018 - DNA, 23 bp, Homo sapiens
caggctgcgcctgcccgcccgcc

SEQ ID NO: 2303019 - DNA, 20 bp, Homo sapiens
caggctggagtgaagtggtg

SEQ ID NO: 2303020 - DNA, 22 bp, Homo sapiens
caggctggtcttgaactcttgg

SEQ ID NO: 2303021 - DNA, 20 bp, Homo sapiens
caggcttcgtctcagaaggc

SEQ ID NO: 2303022 - DNA, 21 bp, Homo sapiens
caggcttcgtctcagaaggct

SEQ ID NO: 2303023 - DNA, 12 bp, Homo sapiens
cagggaacaaaa

SEQ ID NO: 2303024 - DNA, 22 bp, Homo sapiens
cagggagaccctgggagagtga

SEQ ID NO: 2303025 - DNA, 12 bp, Homo sapiens
cagggagccctg

SEQ ID NO: 2303026 - DNA, 15 bp, Homo sapiens
cagggagccctgggg

SEQ ID NO: 2303027 - DNA, 16 bp, Homo sapiens
cagggcaggcagagct

SEQ ID NO: 2303028 - DNA, 21 bp, Homo sapiens
cagggcaggcagagctcagca

SEQ ID NO: 2303029 - DNA, 18 bp, Homo sapiens
cagggcccaaataacagt

SEQ ID NO: 2303030 - DNA, 20 bp, Homo sapiens
cagggcccgggaagcaaatg

SEQ ID NO: 2303031 - DNA, 21 bp, Homo sapiens
cagggccctggggtctctgag

SEQ ID NO: 2303032 - DNA, 22 bp, Homo sapiens
cagggccctggggtctctgagc

SEQ ID NO: 2303033 - DNA, 23 bp, Homo sapiens
cagggccctggggtctctgagca

SEQ ID NO: 2303034 - DNA, 14 bp, Homo sapiens
cagggccctgtggc

SEQ ID NO: 2303035 - DNA, 16 bp, Homo sapiens
cagggccctgtggctc

SEQ ID NO: 2303036 - DNA, 17 bp, Homo sapiens
cagggccgcagggcgct

SEQ ID NO: 2303037 - DNA, 18 bp, Homo sapiens
cagggccgcagggcgctc

SEQ ID NO: 2303038 - DNA, 20 bp, Homo sapiens
cagggccgcagggcgctccg

SEQ ID NO: 2303039 - DNA, 15 bp, Homo sapiens
cagggcgctccggca

SEQ ID NO: 2303040 - DNA, 18 bp, Homo sapiens
cagggcgctccggcagag

SEQ ID NO: 2303041 - DNA, 18 bp, Homo sapiens
cagggctctggcaggtgg

SEQ ID NO: 2303042 - DNA, 14 bp, Homo sapiens
caggggctggggac

SEQ ID NO: 2303043 - DNA, 15 bp, Homo sapiens
caggggctggggact

SEQ ID NO: 2303044 - DNA, 22 bp, Homo sapiens
cagggggcttggctcgcacccc

SEQ ID NO: 2303045 - DNA, 15 bp, Homo sapiens
cagggtctcactgtg

SEQ ID NO: 2303046 - DNA, 16 bp, Homo sapiens
cagggtctcgtcagga

SEQ ID NO: 2303047 - DNA, 18 bp, Homo sapiens
cagggtctcgtcaggagg

SEQ ID NO: 2303048 - DNA, 22 bp, Homo sapiens
cagggtctgagtgcaagttcat

SEQ ID NO: 2303049 - DNA, 11 bp, Homo sapiens
cagggtgcagg

SEQ ID NO: 2303050 - DNA, 17 bp, Homo sapiens
cagggtgcaggcgcgca

SEQ ID NO: 2303051 - DNA, 17 bp, Homo sapiens
ccaaatattctaaaaaa

SEQ ID NO: 2303052 - DNA, 20 bp, Homo sapiens
ccaaattctgtggctgccat

SEQ ID NO: 2303053 - DNA, 16 bp, Homo sapiens
ccaaattggtgtttct

SEQ ID NO: 2303054 - DNA, 19 bp, Homo sapiens
ccaacagggcaaccaataa

SEQ ID NO: 2303055 - DNA, 13 bp, Homo sapiens
ccaacatccactc

SEQ ID NO: 2303056 - DNA, 21 bp, Homo sapiens
ccaacattatcctgtgtgatt

SEQ ID NO: 2303057 - DNA, 14 bp, Homo sapiens
ccaacattttaaaa

SEQ ID NO: 2303058 - DNA, 18 bp, Homo sapiens
ccaacattttaaaaataa

SEQ ID NO: 2303059 - DNA, 16 bp, Homo sapiens
ccaacctcgccctctc

SEQ ID NO: 2303060 - DNA, 18 bp, Homo sapiens
ccaacctcgccctctctc

SEQ ID NO: 2303061 - DNA, 19 bp, Homo sapiens
ccaacctcgccctctctca

SEQ ID NO: 2303062 - DNA, 20 bp, Homo sapiens
ccaacctggaggctggacca

SEQ ID NO: 2303063 - DNA, 14 bp, Homo sapiens
ccaactaagttgta

SEQ ID NO: 2303064 - DNA, 14 bp, Homo sapiens
ccaactatttcaat

SEQ ID NO: 2303065 - DNA, 15 bp, Homo sapiens
ccaactatttcaata

SEQ ID NO: 2303066 - DNA, 23 bp, Homo sapiens
ccaactgctttgttttggctgct

SEQ ID NO: 2303067 - DNA, 21 bp, Homo sapiens
ccaactggaaggctttattct

SEQ ID NO: 2303068 - DNA, 15 bp, Homo sapiens
ccaacttaaacctgt

SEQ ID NO: 2303069 - DNA, 18 bp, Homo sapiens
ccaagaatgtctccattg

SEQ ID NO: 2303070 - DNA, 20 bp, Homo sapiens
ccaagcacaaactgtcgtct

SEQ ID NO: 2303071 - DNA, 14 bp, Homo sapiens
ccaagccatcacag

SEQ ID NO: 2303072 - DNA, 15 bp, Homo sapiens
ccaagggcccagagg

SEQ ID NO: 2303073 - DNA, 16 bp, Homo sapiens
ccaagtcatgggagaa

SEQ ID NO: 2303074 - DNA, 20 bp, Homo sapiens
ccaagttcattcatactcaa

SEQ ID NO: 2303075 - DNA, 12 bp, Homo sapiens
ccaatcatctta

SEQ ID NO: 2303076 - DNA, 16 bp, Homo sapiens
ccaatctctgtgactc

SEQ ID NO: 2303077 - DNA, 15 bp, Homo sapiens
ccaattaagcagctt

SEQ ID NO: 2303078 - DNA, 17 bp, Homo sapiens
ccacaacaaagtgcttc

SEQ ID NO: 2303079 - DNA, 12 bp, Homo sapiens
ccacacacagca

SEQ ID NO: 2303080 - DNA, 21 bp, Homo sapiens
ccacacacagcagctccaacc

SEQ ID NO: 2303081 - DNA, 18 bp, Homo sapiens
ccacacgccggggctggc

SEQ ID NO: 2303082 - DNA, 21 bp, Homo sapiens
ccacagatccatccttttgct

SEQ ID NO: 2303083 - DNA, 19 bp, Homo sapiens
ccacagccccttgcttcta

SEQ ID NO: 2303084 - DNA, 15 bp, Homo sapiens
ccacagcctcttcct

SEQ ID NO: 2303085 - DNA, 21 bp, Homo sapiens
ccacagtggggcccatggccc

SEQ ID NO: 2303086 - DNA, 16 bp, Homo sapiens
ccacattctgctgccc

SEQ ID NO: 2303087 - DNA, 23 bp, Homo sapiens
ccaccaagggtatctgctgcctc

SEQ ID NO: 2303088 - DNA, 23 bp, Homo sapiens
ccacccacaccccgtctgcccct

SEQ ID NO: 2303089 - DNA, 17 bp, Homo sapiens
ccaccccgctgcctggc

SEQ ID NO: 2303090 - DNA, 14 bp, Homo sapiens
ccacccgccccaga

SEQ ID NO: 2303091 - DNA, 17 bp, Homo sapiens
ccacccgccccagagac

SEQ ID NO: 2303092 - DNA, 20 bp, Homo sapiens
ccacccgccccagagactgc

SEQ ID NO: 2303093 - DNA, 15 bp, Homo sapiens
ccaccctgcttctgc

SEQ ID NO: 2303094 - DNA, 16 bp, Homo sapiens
ccaccctgcttctgct

SEQ ID NO: 2303095 - DNA, 17 bp, Homo sapiens
ccaccctgcttctgctg

SEQ ID NO: 2303096 - DNA, 13 bp, Homo sapiens
ccaccgcccctgg

SEQ ID NO: 2303097 - DNA, 12 bp, Homo sapiens
ccacctgcccag

SEQ ID NO: 2303098 - DNA, 22 bp, Homo sapiens
ccacctgcccagttagcccggc

SEQ ID NO: 2303099 - DNA, 13 bp, Homo sapiens
ccacctgggagat

SEQ ID NO: 2303100 - DNA, 21 bp, Homo sapiens
ccacctgggagatgctgggac

SEQ ID NO: 2303101 - DNA, 19 bp, Homo sapiens
ccacgcagagccccggagc

SEQ ID NO: 2303102 - DNA, 20 bp, Homo sapiens
ccacgcagagccccggagca

SEQ ID NO: 2303103 - DNA, 13 bp, Homo sapiens
ccacgcttctgga

SEQ ID NO: 2303104 - DNA, 16 bp, Homo sapiens
ccacggcaacccctgc

SEQ ID NO: 2303105 - DNA, 23 bp, Homo sapiens
ccacggggtcgggggaggagcac

SEQ ID NO: 2303106 - DNA, 21 bp, Homo sapiens
ccactagactcaaggaagaat

SEQ ID NO: 2303107 - DNA, 23 bp, Homo sapiens
ccactcaagaccaaatggaaaca

SEQ ID NO: 2303108 - DNA, 17 bp, Homo sapiens
ccactccgactccccct

SEQ ID NO: 2303109 - DNA, 18 bp, Homo sapiens
ccactccgactccccctc

SEQ ID NO: 2303110 - DNA, 16 bp, Homo sapiens
ccactgaaacctctgt

SEQ ID NO: 2303111 - DNA, 22 bp, Homo sapiens
ccactgagtctcattcctctgt

SEQ ID NO: 2303112 - DNA, 14 bp, Homo sapiens
ccactggccctgtt

SEQ ID NO: 2303113 - DNA, 12 bp, Homo sapiens
ccactggggtgg

SEQ ID NO: 2303114 - DNA, 18 bp, Homo sapiens
ccactggggtgggagggg

SEQ ID NO: 2303115 - DNA, 20 bp, Homo sapiens
ccactgtttcttgcttgtac

SEQ ID NO: 2303116 - DNA, 20 bp, Homo sapiens
ccacttagcctttcttttct

SEQ ID NO: 2303117 - DNA, 19 bp, Homo sapiens
ccactttcgcctcctccag

SEQ ID NO: 2303118 - DNA, 21 bp, Homo sapiens
ccactttcgcctcctccagct

SEQ ID NO: 2303119 - DNA, 20 bp, Homo sapiens
ccagaaatgccgctgtgtcc

SEQ ID NO: 2303120 - DNA, 14 bp, Homo sapiens
ccagaacgccctgt

SEQ ID NO: 2303121 - DNA, 13 bp, Homo sapiens
ccagaacgggcct

SEQ ID NO: 2303122 - DNA, 16 bp, Homo sapiens
ccagaacgggcctccc

SEQ ID NO: 2303123 - DNA, 23 bp, Homo sapiens
ccagaatgtttcctgtggaaata

SEQ ID NO: 2303124 - DNA, 19 bp, Homo sapiens
ccagaatttcccaaagcag

SEQ ID NO: 2303125 - DNA, 14 bp, Homo sapiens
ccagaccccatcca

SEQ ID NO: 2303126 - DNA, 20 bp, Homo sapiens
ccagaccccatccagccagg

SEQ ID NO: 2303127 - DNA, 13 bp, Homo sapiens
ccagacctgggcc

SEQ ID NO: 2303128 - DNA, 14 bp, Homo sapiens
ccagacctgggccc

SEQ ID NO: 2303129 - DNA, 17 bp, Homo sapiens
ccagacctgggccctgg

SEQ ID NO: 2303130 - DNA, 20 bp, Homo sapiens
ccagactcgagagggctgag

SEQ ID NO: 2303131 - DNA, 23 bp, Homo sapiens
ccagactcgagagggctgagccc

SEQ ID NO: 2303132 - DNA, 12 bp, Homo sapiens
ccagagacctgc

SEQ ID NO: 2303133 - DNA, 17 bp, Homo sapiens
ccagagacctgctccag

SEQ ID NO: 2303134 - DNA, 14 bp, Homo sapiens
ccagagactgccca

SEQ ID NO: 2303135 - DNA, 12 bp, Homo sapiens
ccagagcactgt

SEQ ID NO: 2303136 - DNA, 18 bp, Homo sapiens
ccagagctcccaggacgc

SEQ ID NO: 2303137 - DNA, 21 bp, Homo sapiens
ccagatcctctttccccactg

SEQ ID NO: 2303138 - DNA, 18 bp, Homo sapiens
ccagattattttctatat

SEQ ID NO: 2303139 - DNA, 23 bp, Homo sapiens
ccagattattttctatatttgga

SEQ ID NO: 2303140 - DNA, 12 bp, Homo sapiens
ccagatttcact

SEQ ID NO: 2303141 - DNA, 12 bp, Homo sapiens
ccagcacactcc

SEQ ID NO: 2303142 - DNA, 13 bp, Homo sapiens
ccagcacactccc

SEQ ID NO: 2303143 - DNA, 14 bp, Homo sapiens
ccagcacactcccg

SEQ ID NO: 2303144 - DNA, 16 bp, Homo sapiens
ccagcacactcccgag

SEQ ID NO: 2303145 - DNA, 16 bp, Homo sapiens
ccagcactcccagggc

SEQ ID NO: 2303146 - DNA, 22 bp, Homo sapiens
ccagcactcccagggcccgagc

SEQ ID NO: 2303147 - DNA, 17 bp, Homo sapiens
ccagcccaggcaatagt

SEQ ID NO: 2303148 - DNA, 17 bp, Homo sapiens
ccagccccctggcccct

SEQ ID NO: 2303149 - DNA, 24 bp, Homo sapiens
ccagcccctccccgcctcctccct

SEQ ID NO: 2303150 - DNA, 12 bp, Homo sapiens
ccagcctccccc

SEQ ID NO: 2303151 - DNA, 14 bp, Homo sapiens
ccagcctcccccag

SEQ ID NO: 2303152 - DNA, 15 bp, Homo sapiens
ccagcctcccccagg

SEQ ID NO: 2303153 - DNA, 16 bp, Homo sapiens
ccagcctcccccaggc

SEQ ID NO: 2303154 - DNA, 22 bp, Homo sapiens
ccagcctcccccaggctgcgcc

SEQ ID NO: 2303155 - DNA, 23 bp, Homo sapiens
ccagcctcccccaggctgcgcct

SEQ ID NO: 2303156 - DNA, 12 bp, Homo sapiens
ccagcctgagcc

SEQ ID NO: 2303157 - DNA, 15 bp, Homo sapiens
ccagcctgagccaca

SEQ ID NO: 2303158 - DNA, 18 bp, Homo sapiens
ccagcctgagccacagtg

SEQ ID NO: 2303159 - DNA, 20 bp, Homo sapiens
ccagcgagtctggagaccag

SEQ ID NO: 2303160 - DNA, 23 bp, Homo sapiens
ccagcgtggggctaacgggcgcc

SEQ ID NO: 2303161 - DNA, 13 bp, Homo sapiens
ccagcgtgggggt

SEQ ID NO: 2303162 - DNA, 14 bp, Homo sapiens
ccagcgtgggggtg

SEQ ID NO: 2303163 - DNA, 24 bp, Homo sapiens
ccagcgtgggggtggccactcctg

SEQ ID NO: 2303164 - DNA, 11 bp, Homo sapiens
ccagctcagtc

SEQ ID NO: 2303165 - DNA, 22 bp, Homo sapiens
ccagctcagtcccacagcccct

SEQ ID NO: 2303166 - DNA, 13 bp, Homo sapiens
ccagctcctgccc

SEQ ID NO: 2303167 - DNA, 21 bp, Homo sapiens
ccagctcctgccccgccggcc

SEQ ID NO: 2303168 - DNA, 14 bp, Homo sapiens
ccagctctcccctg

SEQ ID NO: 2303169 - DNA, 16 bp, Homo sapiens
ccagctctcccctgcg

SEQ ID NO: 2303170 - DNA, 17 bp, Homo sapiens
ccagctctcccctgcgc

SEQ ID NO: 2303171 - DNA, 18 bp, Homo sapiens
ccagctgaggcaggggga

SEQ ID NO: 2303172 - DNA, 12 bp, Homo sapiens
ccagctggcagc

SEQ ID NO: 2303173 - DNA, 16 bp, Homo sapiens
ccagctggcagcgcct

SEQ ID NO: 2303174 - DNA, 14 bp, Homo sapiens
ccagctggctgggt

SEQ ID NO: 2303175 - DNA, 16 bp, Homo sapiens
ccagctggctgggtcg

SEQ ID NO: 2303176 - DNA, 20 bp, Homo sapiens
ccagctggctgggtcgcccc

SEQ ID NO: 2303177 - DNA, 17 bp, Homo sapiens
ccaggaaggggacagga

SEQ ID NO: 2303178 - DNA, 20 bp, Homo sapiens
ccaggacgcagggagaccct

SEQ ID NO: 2303179 - DNA, 20 bp, Homo sapiens
ccaggacggtctgtgcccga

SEQ ID NO: 2303180 - DNA, 21 bp, Homo sapiens
ccaggacggtctgtgcccgag

SEQ ID NO: 2303181 - DNA, 14 bp, Homo sapiens
ccaggactctgcct

SEQ ID NO: 2303182 - DNA, 15 bp, Homo sapiens
ccaggactctgcctt

SEQ ID NO: 2303183 - DNA, 20 bp, Homo sapiens
ccaggactctgccttccagg

SEQ ID NO: 2303184 - DNA, 21 bp, Homo sapiens
ccctgctgctcctcggccaga

SEQ ID NO: 2303185 - DNA, 13 bp, Homo sapiens
ccctgcttctgct

SEQ ID NO: 2303186 - DNA, 17 bp, Homo sapiens
ccctgcttctgctgcct

SEQ ID NO: 2303187 - DNA, 18 bp, Homo sapiens
ccctgcttctgctgcctg

SEQ ID NO: 2303188 - DNA, 15 bp, Homo sapiens
ccctggagcccggca

SEQ ID NO: 2303189 - DNA, 18 bp, Homo sapiens
ccctggagcccggcagtg

SEQ ID NO: 2303190 - DNA, 20 bp, Homo sapiens
ccctggagtggcatggtcct

SEQ ID NO: 2303191 - DNA, 21 bp, Homo sapiens
ccctggccactggccctgttt

SEQ ID NO: 2303192 - DNA, 21 bp, Homo sapiens
ccctggcccctcccacatccc

SEQ ID NO: 2303193 - DNA, 14 bp, Homo sapiens
ccctggctggaatg

SEQ ID NO: 2303194 - DNA, 23 bp, Homo sapiens
ccctggctggaatgggggccagg

SEQ ID NO: 2303195 - DNA, 15 bp, Homo sapiens
ccctggcttgagtga

SEQ ID NO: 2303196 - DNA, 15 bp, Homo sapiens
ccctgggccccgcct

SEQ ID NO: 2303197 - DNA, 16 bp, Homo sapiens
ccctgggccccgcctc

SEQ ID NO: 2303198 - DNA, 13 bp, Homo sapiens
ccctgggcctccc

SEQ ID NO: 2303199 - DNA, 17 bp, Homo sapiens
ccctgggcctcccgtcc

SEQ ID NO: 2303200 - DNA, 19 bp, Homo sapiens
ccctgggggaggcttccag

SEQ ID NO: 2303201 - DNA, 22 bp, Homo sapiens
ccctggggtctctgagcagtgg

SEQ ID NO: 2303202 - DNA, 13 bp, Homo sapiens
ccctggtgcccct

SEQ ID NO: 2303203 - DNA, 17 bp, Homo sapiens
ccctggttcccccagga

SEQ ID NO: 2303204 - DNA, 19 bp, Homo sapiens
ccctggttcccccaggacc

SEQ ID NO: 2303205 - DNA, 20 bp, Homo sapiens
ccctggttcccccaggaccc

SEQ ID NO: 2303206 - DNA, 21 bp, Homo sapiens
ccctggttcccccaggaccct

SEQ ID NO: 2303207 - DNA, 17 bp, Homo sapiens
ccctgtaatgcactcct

SEQ ID NO: 2303208 - DNA, 19 bp, Homo sapiens
ccctgtaatgcactcctgc

SEQ ID NO: 2303209 - DNA, 21 bp, Homo sapiens
ccctgtaatgcactcctgccc

SEQ ID NO: 2303210 - DNA, 16 bp, Homo sapiens
ccctgtctaatgaaac

SEQ ID NO: 2303211 - DNA, 15 bp, Homo sapiens
cccttcagccagaag

SEQ ID NO: 2303212 - DNA, 17 bp, Homo sapiens
cccttcgcgtatttcag

SEQ ID NO: 2303213 - DNA, 18 bp, Homo sapiens
cccttgccacatcgcagc

SEQ ID NO: 2303214 - DNA, 18 bp, Homo sapiens
cccttggggagcaggctc

SEQ ID NO: 2303215 - DNA, 11 bp, Homo sapiens
ccctttcacac

SEQ ID NO: 2303216 - DNA, 16 bp, Homo sapiens
cccttttgcccactgt

SEQ ID NO: 2303217 - DNA, 17 bp, Homo sapiens
cccttttgcccactgtc

SEQ ID NO: 2303218 - DNA, 20 bp, Homo sapiens
ccgaagggacggggcccgcc

SEQ ID NO: 2303219 - DNA, 17 bp, Homo sapiens
ccgaatggagtccagac

SEQ ID NO: 2303220 - DNA, 23 bp, Homo sapiens
ccgacatcagcccggtgtgagga

SEQ ID NO: 2303221 - DNA, 13 bp, Homo sapiens
ccgacggagccac

SEQ ID NO: 2303222 - DNA, 17 bp, Homo sapiens
ccgactccccctccccg

SEQ ID NO: 2303223 - DNA, 21 bp, Homo sapiens
ccgagaagcacttgagcatga

SEQ ID NO: 2303224 - DNA, 19 bp, Homo sapiens
ccgagcacggttgcctgag

SEQ ID NO: 2303225 - DNA, 16 bp, Homo sapiens
ccgagcccaggggagg

SEQ ID NO: 2303226 - DNA, 14 bp, Homo sapiens
ccgagcgcgtgcct

SEQ ID NO: 2303227 - DNA, 22 bp, Homo sapiens
ccgagcgcgtgccttccccgtg

SEQ ID NO: 2303228 - DNA, 21 bp, Homo sapiens
ccgagctctcctgggccaggg

SEQ ID NO: 2303229 - DNA, 10 bp, Homo sapiens
ccgaggactc

SEQ ID NO: 2303230 - DNA, 13 bp, Homo sapiens
ccgagtgccccag

SEQ ID NO: 2303231 - DNA, 16 bp, Homo sapiens
ccgagtgtggagctgc

SEQ ID NO: 2303232 - DNA, 13 bp, Homo sapiens
ccgatccacattg

SEQ ID NO: 2303233 - DNA, 15 bp, Homo sapiens
ccgcacccctcctcc

SEQ ID NO: 2303234 - DNA, 14 bp, Homo sapiens
ccgcaccctggctg

SEQ ID NO: 2303235 - DNA, 14 bp, Homo sapiens
ccgcagcaccagcc

SEQ ID NO: 2303236 - DNA, 16 bp, Homo sapiens
ccgcagcaccagcctg

SEQ ID NO: 2303237 - DNA, 18 bp, Homo sapiens
ccgcagcaccagcctgag

SEQ ID NO: 2303238 - DNA, 19 bp, Homo sapiens
ccgcagcaccagcctgagc

SEQ ID NO: 2303239 - DNA, 20 bp, Homo sapiens
ccgcagcaccagcctgagcc

SEQ ID NO: 2303240 - DNA, 22 bp, Homo sapiens
ccgcagcaccagcctgagccac

SEQ ID NO: 2303241 - DNA, 21 bp, Homo sapiens
ccgcagcgggcgcgggacagg

SEQ ID NO: 2303242 - DNA, 22 bp, Homo sapiens
ccgcagcgggcgcgggacagga

SEQ ID NO: 2303243 - DNA, 19 bp, Homo sapiens
ccgcagggcgctccggcag

SEQ ID NO: 2303244 - DNA, 20 bp, Homo sapiens
ccgcagggcgctccggcaga

SEQ ID NO: 2303245 - DNA, 23 bp, Homo sapiens
ccgcagggcgctccggcagaggc

SEQ ID NO: 2303246 - DNA, 18 bp, Homo sapiens
ccgccatgcatgatgggt

SEQ ID NO: 2303247 - DNA, 18 bp, Homo sapiens
ccgcccaacccccacctc

SEQ ID NO: 2303248 - DNA, 15 bp, Homo sapiens
ccgcccacccacacc

SEQ ID NO: 2303249 - DNA, 15 bp, Homo sapiens
ccgccccagagactg

SEQ ID NO: 2303250 - DNA, 21 bp, Homo sapiens
ccgccccagagactgcccacc

SEQ ID NO: 2303251 - DNA, 13 bp, Homo sapiens
ccgcccctggaca

SEQ ID NO: 2303252 - DNA, 12 bp, Homo sapiens
ccgcccgccccc

SEQ ID NO: 2303253 - DNA, 17 bp, Homo sapiens
ccgccctcctctgcccc

SEQ ID NO: 2303254 - DNA, 13 bp, Homo sapiens
ccgccctgggctc

SEQ ID NO: 2303255 - DNA, 16 bp, Homo sapiens
ccgccctgggctctgg

SEQ ID NO: 2303256 - DNA, 17 bp, Homo sapiens
ccgccctgggctctggg

SEQ ID NO: 2303257 - DNA, 19 bp, Homo sapiens
ccgcctcaaggaagagcca

SEQ ID NO: 2303258 - DNA, 11 bp, Homo sapiens
ccgcctcctcc

SEQ ID NO: 2303259 - DNA, 16 bp, Homo sapiens
ccgcctcctccagact

SEQ ID NO: 2303260 - DNA, 14 bp, Homo sapiens
ccgcctcctccctg

SEQ ID NO: 2303261 - DNA, 15 bp, Homo sapiens
ccgcctcctccctgc

SEQ ID NO: 2303262 - DNA, 16 bp, Homo sapiens
ccgcctcctccctgcc

SEQ ID NO: 2303263 - DNA, 16 bp, Homo sapiens
ccgcctcgggccgcct

SEQ ID NO: 2303264 - DNA, 18 bp, Homo sapiens
ccgcctcgggccgcctcc

SEQ ID NO: 2303265 - DNA, 12 bp, Homo sapiens
ccgcctgccccc

SEQ ID NO: 2303266 - DNA, 14 bp, Homo sapiens
ccgcctgcccccag

SEQ ID NO: 2303267 - DNA, 16 bp, Homo sapiens
ccgcgcaccgccatgc

SEQ ID NO: 2303268 - DNA, 18 bp, Homo sapiens
ccgcgcgtgcccccagcg

SEQ ID NO: 2303269 - DNA, 17 bp, Homo sapiens
ccgcgctctgcccctcc

SEQ ID NO: 2303270 - DNA, 20 bp, Homo sapiens
ccgcgctctgcccctccgtc

SEQ ID NO: 2303271 - DNA, 16 bp, Homo sapiens
ccgctgcccccaccct

SEQ ID NO: 2303272 - DNA, 19 bp, Homo sapiens
ccgctgcccccaccctgct

SEQ ID NO: 2303273 - DNA, 13 bp, Homo sapiens
ccgctgcctggcg

SEQ ID NO: 2303274 - DNA, 22 bp, Homo sapiens
ccgctgcctggcgggcagcccc

SEQ ID NO: 2303275 - DNA, 15 bp, Homo sapiens
ccgctgtgtctatga

SEQ ID NO: 2303276 - DNA, 13 bp, Homo sapiens
ccgcttcctccgg

SEQ ID NO: 2303277 - DNA, 19 bp, Homo sapiens
ccgcttcctccggctggac

SEQ ID NO: 2303278 - DNA, 13 bp, Homo sapiens
ccggacgccgcga

SEQ ID NO: 2303279 - DNA, 18 bp, Homo sapiens
ccggacgctggctcggga

SEQ ID NO: 2303280 - DNA, 14 bp, Homo sapiens
ccggagcggctgag

SEQ ID NO: 2303281 - DNA, 15 bp, Homo sapiens
ccggaggcgcccacc

SEQ ID NO: 2303282 - DNA, 18 bp, Homo sapiens
ccggaggcgcccacctgc

SEQ ID NO: 2303283 - DNA, 16 bp, Homo sapiens
ccggcagaggcagggc

SEQ ID NO: 2303284 - DNA, 17 bp, Homo sapiens
ccggcagccccccagtg

SEQ ID NO: 2303285 - DNA, 21 bp, Homo sapiens
ccggcatcatttcccctcccg

SEQ ID NO: 2303286 - DNA, 23 bp, Homo sapiens
ccggcatcatttcccctcccgct

SEQ ID NO: 2303287 - DNA, 14 bp, Homo sapiens
ccggcatgccgagt

SEQ ID NO: 2303288 - DNA, 16 bp, Homo sapiens
ccggccaaggacactg

SEQ ID NO: 2303289 - DNA, 19 bp, Homo sapiens
ccggccaaggacactgatg

SEQ ID NO: 2303290 - DNA, 22 bp, Homo sapiens
ccggcccaacctcgccctctct

SEQ ID NO: 2303291 - DNA, 15 bp, Homo sapiens
ccggccgcgcaccgc

SEQ ID NO: 2303292 - DNA, 17 bp, Homo sapiens
ccggccgcgcaccgcca

SEQ ID NO: 2303293 - DNA, 18 bp, Homo sapiens
ccggcctggggccgggct

SEQ ID NO: 2303294 - DNA, 19 bp, Homo sapiens
ccgggacgtggcacctcct

SEQ ID NO: 2303295 - DNA, 17 bp, Homo sapiens
ccgggagatccgccctg

SEQ ID NO: 2303296 - DNA, 19 bp, Homo sapiens
ccgggccccatggtcacag

SEQ ID NO: 2303297 - DNA, 22 bp, Homo sapiens
ccgggccccatggtcacagacc

SEQ ID NO: 2303298 - DNA, 23 bp, Homo sapiens
ccgggctggcctgacacaatggt

SEQ ID NO: 2303299 - DNA, 17 bp, Homo sapiens
ccggggctggccctgcc

SEQ ID NO: 2303300 - DNA, 18 bp, Homo sapiens
ccggggctggccctgccc

SEQ ID NO: 2303301 - DNA, 15 bp, Homo sapiens
ccgggtgcctgtgac

SEQ ID NO: 2303302 - DNA, 16 bp, Homo sapiens
ccgggtgcctgtgacc

SEQ ID NO: 2303303 - DNA, 22 bp, Homo sapiens
ccgggtgcgtgaccggcccgcc

SEQ ID NO: 2303304 - DNA, 12 bp, Homo sapiens
ccggtgtgagga

SEQ ID NO: 2303305 - DNA, 21 bp, Homo sapiens
ccggtgtgaggaggggcggga

SEQ ID NO: 2303306 - DNA, 18 bp, Homo sapiens
ccggttggccggctggcc

SEQ ID NO: 2303307 - DNA, 19 bp, Homo sapiens
ccggttggccggctggccg

SEQ ID NO: 2303308 - DNA, 20 bp, Homo sapiens
ccgtaatggggactctccag

SEQ ID NO: 2303309 - DNA, 21 bp, Homo sapiens
ccgtaatggggactctccagg

SEQ ID NO: 2303310 - DNA, 15 bp, Homo sapiens
ccgtcccggccccgc

SEQ ID NO: 2303311 - DNA, 13 bp, Homo sapiens
ccgtccgcccgcc

SEQ ID NO: 2303312 - DNA, 15 bp, Homo sapiens
ccgtccgcccgccca

SEQ ID NO: 2303313 - DNA, 16 bp, Homo sapiens
ccgtccgtccgcccgc

SEQ ID NO: 2303314 - DNA, 21 bp, Homo sapiens
ccgtcctggcagggcaggcag

SEQ ID NO: 2303315 - DNA, 15 bp, Homo sapiens
ccgtgcacggggcca

SEQ ID NO: 2303316 - DNA, 19 bp, Homo sapiens
ccgtgcgcagccgcgctct

SEQ ID NO: 2303317 - DNA, 17 bp, Homo sapiens
cggccgcgcaccgccat

SEQ ID NO: 2303318 - DNA, 19 bp, Homo sapiens
cggccgcgcaccgccatgc

SEQ ID NO: 2303319 - DNA, 13 bp, Homo sapiens
cggccggcctggg

SEQ ID NO: 2303320 - DNA, 12 bp, Homo sapiens
cggcctcagagt

SEQ ID NO: 2303321 - DNA, 14 bp, Homo sapiens
cggcctgcagccca

SEQ ID NO: 2303322 - DNA, 18 bp, Homo sapiens
cggcgccccggacgccgc

SEQ ID NO: 2303323 - DNA, 22 bp, Homo sapiens
cggctggacctggggtcccccc

SEQ ID NO: 2303324 - DNA, 23 bp, Homo sapiens
cggctgggcagggccgcagggcg

SEQ ID NO: 2303325 - DNA, 13 bp, Homo sapiens
cgggaaccctctg

SEQ ID NO: 2303326 - DNA, 15 bp, Homo sapiens
cgggacgtggcacct

SEQ ID NO: 2303327 - DNA, 18 bp, Homo sapiens
cgggacgtggcacctcct

SEQ ID NO: 2303328 - DNA, 19 bp, Homo sapiens
cgggacgtggcacctcctc

SEQ ID NO: 2303329 - DNA, 16 bp, Homo sapiens
cgggagagcgccaccc

SEQ ID NO: 2303330 - DNA, 18 bp, Homo sapiens
cgggagagcgccacccgc

SEQ ID NO: 2303331 - DNA, 19 bp, Homo sapiens
cgggagagcgccacccgcc

SEQ ID NO: 2303332 - DNA, 21 bp, Homo sapiens
cgggagatccgccctgggctc

SEQ ID NO: 2303333 - DNA, 14 bp, Homo sapiens
cgggagcctgcgtg

SEQ ID NO: 2303334 - DNA, 15 bp, Homo sapiens
cgggagcctgcgtgg

SEQ ID NO: 2303335 - DNA, 21 bp, Homo sapiens
cgggcaacactcactgcctgc

SEQ ID NO: 2303336 - DNA, 12 bp, Homo sapiens
cgggcagcccct

SEQ ID NO: 2303337 - DNA, 12 bp, Homo sapiens
cgggcatgacac

SEQ ID NO: 2303338 - DNA, 12 bp, Homo sapiens
cgggccgcctcc

SEQ ID NO: 2303339 - DNA, 19 bp, Homo sapiens
cgggccgcctcctccagac

SEQ ID NO: 2303340 - DNA, 12 bp, Homo sapiens
cgggcgcccgga

SEQ ID NO: 2303341 - DNA, 14 bp, Homo sapiens
cgggcgcctgcgct

SEQ ID NO: 2303342 - DNA, 15 bp, Homo sapiens
cgggcgcgggacagg

SEQ ID NO: 2303343 - DNA, 15 bp, Homo sapiens
cgggctggcctgaca

SEQ ID NO: 2303344 - DNA, 15 bp, Homo sapiens
cggggcagagctgag

SEQ ID NO: 2303345 - DNA, 17 bp, Homo sapiens
cggggcaggaagtccct

SEQ ID NO: 2303346 - DNA, 17 bp, Homo sapiens
cggggcccgccccaggc

SEQ ID NO: 2303347 - DNA, 17 bp, Homo sapiens
cgggggaggagcacccc

SEQ ID NO: 2303348 - DNA, 16 bp, Homo sapiens
cgggggctaactggcc

SEQ ID NO: 2303349 - DNA, 17 bp, Homo sapiens
cggggtcctgaggctgg

SEQ ID NO: 2303350 - DNA, 18 bp, Homo sapiens
cggggtcctgaggctggg

SEQ ID NO: 2303351 - DNA, 15 bp, Homo sapiens
cgggtgcctgtgacc

SEQ ID NO: 2303352 - DNA, 18 bp, Homo sapiens
cgggtgcgtgaccggccc

SEQ ID NO: 2303353 - DNA, 12 bp, Homo sapiens
cggtctgtgccc

SEQ ID NO: 2303354 - DNA, 16 bp, Homo sapiens
cggtgaggtgggggca

SEQ ID NO: 2303355 - DNA, 17 bp, Homo sapiens
cggtgaggtgggggcag

SEQ ID NO: 2303356 - DNA, 22 bp, Homo sapiens
cggtgctgaacgacagtcccag

SEQ ID NO: 2303357 - DNA, 16 bp, Homo sapiens
cggtgtgaggaggggc

SEQ ID NO: 2303358 - DNA, 17 bp, Homo sapiens
cggttgtaggactaaat

SEQ ID NO: 2303359 - DNA, 20 bp, Homo sapiens
cgtaatggggactctccagg

SEQ ID NO: 2303360 - DNA, 13 bp, Homo sapiens
cgtagggccaggg

SEQ ID NO: 2303361 - DNA, 14 bp, Homo sapiens
cgtcaatgtgaaat

SEQ ID NO: 2303362 - DNA, 20 bp, Homo sapiens
cgtcaggaggtgcctgagag

SEQ ID NO: 2303363 - DNA, 13 bp, Homo sapiens
cgtccccagggtg

SEQ ID NO: 2303364 - DNA, 22 bp, Homo sapiens
cgtcccggccccgcgcgtgccc

SEQ ID NO: 2303365 - DNA, 22 bp, Homo sapiens
cgtccctgacttcccagctggc

SEQ ID NO: 2303366 - DNA, 10 bp, Homo sapiens
cgtccggcct

SEQ ID NO: 2303367 - DNA, 17 bp, Homo sapiens
cgtccggcctgcagccc

SEQ ID NO: 2303368 - DNA, 13 bp, Homo sapiens
cgtctcagaaggc

SEQ ID NO: 2303369 - DNA, 14 bp, Homo sapiens
cgtctcagaaggct

SEQ ID NO: 2303370 - DNA, 12 bp, Homo sapiens
cgtctgcccctt

SEQ ID NO: 2303371 - DNA, 13 bp, Homo sapiens
cgtgaagcatcca

SEQ ID NO: 2303372 - DNA, 18 bp, Homo sapiens
cgtgagtcctggcatggg

SEQ ID NO: 2303373 - DNA, 19 bp, Homo sapiens
cgtgagtcctggcatggga

SEQ ID NO: 2303374 - DNA, 17 bp, Homo sapiens
cgtgcacttgtgatcct

SEQ ID NO: 2303375 - DNA, 19 bp, Homo sapiens
cgtgcagttcctgctgcct

SEQ ID NO: 2303376 - DNA, 23 bp, Homo sapiens
cgtgcgcagccgcgctctgcccc

SEQ ID NO: 2303377 - DNA, 12 bp, Homo sapiens
cgtgcggcccgt

SEQ ID NO: 2303378 - DNA, 21 bp, Homo sapiens
cgtgcggcccgtgcgcagccg

SEQ ID NO: 2303379 - DNA, 18 bp, Homo sapiens
cgtgctcttctgttctca

SEQ ID NO: 2303380 - DNA, 20 bp, Homo sapiens
cgtgctcttctgttctcaaa

SEQ ID NO: 2303381 - DNA, 15 bp, Homo sapiens
cgtggcctggggctg

SEQ ID NO: 2303382 - DNA, 12 bp, Homo sapiens
cgtggctgcttc

SEQ ID NO: 2303383 - DNA, 14 bp, Homo sapiens
cgtggctgcttcaa

SEQ ID NO: 2303384 - DNA, 23 bp, Homo sapiens
cgtgggggtggccactcctgggc

SEQ ID NO: 2303385 - DNA, 16 bp, Homo sapiens
cgtggtgtgaggcccc

SEQ ID NO: 2303386 - DNA, 16 bp, Homo sapiens
cgtgtgctccagtgtt

SEQ ID NO: 2303387 - DNA, 19 bp, Homo sapiens
cgtgttatgactccagaat

SEQ ID NO: 2303388 - DNA, 15 bp, Homo sapiens
cgttaagggcagagt

SEQ ID NO: 2303389 - DNA, 18 bp, Homo sapiens
cgtttcacatctgtatat

SEQ ID NO: 2303390 - DNA, 16 bp, Homo sapiens
ctaaaaaataactgtg

SEQ ID NO: 2303391 - DNA, 17 bp, Homo sapiens
ctaaaaacattttaaaa

SEQ ID NO: 2303392 - DNA, 23 bp, Homo sapiens
ctaaaaacattttaaaatcaact

SEQ ID NO: 2303393 - DNA, 21 bp, Homo sapiens
ctaaaattctagtctctgatt

SEQ ID NO: 2303394 - DNA, 14 bp, Homo sapiens
ctaaacccaaataa

SEQ ID NO: 2303395 - DNA, 15 bp, Homo sapiens
ctaaacccaaataaa

SEQ ID NO: 2303396 - DNA, 17 bp, Homo sapiens
ctaaacccaaataaatg

SEQ ID NO: 2303397 - DNA, 17 bp, Homo sapiens
ctaaactgttttcatgt

SEQ ID NO: 2303398 - DNA, 15 bp, Homo sapiens
ctaaagaaaaagata

SEQ ID NO: 2303399 - DNA, 22 bp, Homo sapiens
ctaaaggggactagacagttag

SEQ ID NO: 2303400 - DNA, 21 bp, Homo sapiens
ctaaagttagggcatttttct

SEQ ID NO: 2303401 - DNA, 17 bp, Homo sapiens
ctaaatccattttctaa

SEQ ID NO: 2303402 - DNA, 22 bp, Homo sapiens
ctaaatccattttctaaactgt

SEQ ID NO: 2303403 - DNA, 14 bp, Homo sapiens
ctaaatttgataat

SEQ ID NO: 2303404 - DNA, 20 bp, Homo sapiens
ctaaatttggggacagattc

SEQ ID NO: 2303405 - DNA, 23 bp, Homo sapiens
ctaaatttggggacagattcagt

SEQ ID NO: 2303406 - DNA, 15 bp, Homo sapiens
ctaacatggaagtac

SEQ ID NO: 2303407 - DNA, 13 bp, Homo sapiens
ctaaccatttctt

SEQ ID NO: 2303408 - DNA, 20 bp, Homo sapiens
ctaacctgggttgttgcaga

SEQ ID NO: 2303409 - DNA, 22 bp, Homo sapiens
ctaacctgggttgttgcagagt

SEQ ID NO: 2303410 - DNA, 13 bp, Homo sapiens
ctaacgggcgcct

SEQ ID NO: 2303411 - DNA, 14 bp, Homo sapiens
ctaactaaggacag

SEQ ID NO: 2303412 - DNA, 14 bp, Homo sapiens
ctaactcaaggaat

SEQ ID NO: 2303413 - DNA, 17 bp, Homo sapiens
ctaactggccccaggcg

SEQ ID NO: 2303414 - DNA, 14 bp, Homo sapiens
ctaagaggtgggag

SEQ ID NO: 2303415 - DNA, 21 bp, Homo sapiens
ctaagcagttgcaatgatcag

SEQ ID NO: 2303416 - DNA, 13 bp, Homo sapiens
ctaagcttatttc

SEQ ID NO: 2303417 - DNA, 22 bp, Homo sapiens
ctaaggaatatccagtcaaaga

SEQ ID NO: 2303418 - DNA, 22 bp, Homo sapiens
ctaagtcagtttcacatatttg

SEQ ID NO: 2303419 - DNA, 12 bp, Homo sapiens
ctaagtggaaga

SEQ ID NO: 2303420 - DNA, 14 bp, Homo sapiens
ctaagtggaagaca

SEQ ID NO: 2303421 - DNA, 16 bp, Homo sapiens
ctaagtggaagacaga

SEQ ID NO: 2303422 - DNA, 22 bp, Homo sapiens
ctaagtggaagacagagatggc

SEQ ID NO: 2303423 - DNA, 11 bp, Homo sapiens
ctaatcacctt

SEQ ID NO: 2303424 - DNA, 16 bp, Homo sapiens
ctaatcacctttccaa

SEQ ID NO: 2303425 - DNA, 20 bp, Homo sapiens
ctaatctttaatataatatt

SEQ ID NO: 2303426 - DNA, 23 bp, Homo sapiens
ctaatgaaacaaaaaatattcat

SEQ ID NO: 2303427 - DNA, 22 bp, Homo sapiens
ctaatgggctgctgtcatttta

SEQ ID NO: 2303428 - DNA, 19 bp, Homo sapiens
ctaatgtaatcatttatct

SEQ ID NO: 2303429 - DNA, 21 bp, Homo sapiens
ctacactgcaatcatatgtga

SEQ ID NO: 2303430 - DNA, 15 bp, Homo sapiens
ctacagcaaataaaa

SEQ ID NO: 2303431 - DNA, 18 bp, Homo sapiens
ctacagtagctgtgggga

SEQ ID NO: 2303432 - DNA, 20 bp, Homo sapiens
ctacagtagctgtggggagc

SEQ ID NO: 2303433 - DNA, 21 bp, Homo sapiens
ctacagtagctgtggggagct

SEQ ID NO: 2303434 - DNA, 13 bp, Homo sapiens
ctacataaattgg

SEQ ID NO: 2303435 - DNA, 13 bp, Homo sapiens
ctacatctgaaat

SEQ ID NO: 2303436 - DNA, 17 bp, Homo sapiens
ctacattaaaagcttta

SEQ ID NO: 2303437 - DNA, 13 bp, Homo sapiens
ctaccaaatataa

SEQ ID NO: 2303438 - DNA, 16 bp, Homo sapiens
ctaccaaatataaact

SEQ ID NO: 2303439 - DNA, 19 bp, Homo sapiens
ctaccaactaagttgtatt

SEQ ID NO: 2303440 - DNA, 15 bp, Homo sapiens
ctaccagtatctcca

SEQ ID NO: 2303441 - DNA, 18 bp, Homo sapiens
ctaccgttcccaaattgg

SEQ ID NO: 2303442 - DNA, 19 bp, Homo sapiens
ctacctggttttcattatt

SEQ ID NO: 2303443 - DNA, 20 bp, Homo sapiens
ctacgatgggatcattattt

SEQ ID NO: 2303444 - DNA, 22 bp, Homo sapiens
ctacgtctttattacacaaact

SEQ ID NO: 2303445 - DNA, 13 bp, Homo sapiens
ctactaaaaatat

SEQ ID NO: 2303446 - DNA, 17 bp, Homo sapiens
ctactaagaataaataa

SEQ ID NO: 2303447 - DNA, 15 bp, Homo sapiens
ctactcgagttacag

SEQ ID NO: 2303448 - DNA, 16 bp, Homo sapiens
ctactcgagttacaga

SEQ ID NO: 2303449 - DNA, 19 bp, Homo sapiens
ctactcgagttacagacaa

SEQ ID NO: 2303450 - DNA, 23 bp, Homo sapiens
ctactggcctccctttgtgtgca

SEQ ID NO: 2303451 - DNA, 13 bp, Homo sapiens
ctacttctcttgc

SEQ ID NO: 2303452 - DNA, 14 bp, Homo sapiens
ctactttcctgatg

SEQ ID NO: 2303453 - DNA, 15 bp, Homo sapiens
ctactttttaacaga

SEQ ID NO: 2303454 - DNA, 12 bp, Homo sapiens
ctagaagaacaa

SEQ ID NO: 2303455 - DNA, 16 bp, Homo sapiens
ctagaagctccatgga

SEQ ID NO: 2303456 - DNA, 22 bp, Homo sapiens
ctagaaggatgaacagttctcc

SEQ ID NO: 2303457 - DNA, 23 bp, Homo sapiens
ctagagactctgtgatctaagca

SEQ ID NO: 2303458 - DNA, 16 bp, Homo sapiens
ctagcaaccaacttta

SEQ ID NO: 2303459 - DNA, 22 bp, Homo sapiens
ctagcaagaagattctaaaaca

SEQ ID NO: 2303460 - DNA, 14 bp, Homo sapiens
ctagcacagctgtg

SEQ ID NO: 2303461 - DNA, 21 bp, Homo sapiens
ctagcagtatgtgtgctctta

SEQ ID NO: 2303462 - DNA, 19 bp, Homo sapiens
ctagcctatcaagccttag

SEQ ID NO: 2303463 - DNA, 21 bp, Homo sapiens
ctagctataacaactctattt

SEQ ID NO: 2303464 - DNA, 19 bp, Homo sapiens
ctaggaggctgtgggtttt

SEQ ID NO: 2303465 - DNA, 21 bp, Homo sapiens
ctaggataaaccaatcatctt

SEQ ID NO: 2303466 - DNA, 22 bp, Homo sapiens
ctaggataaaccaatcatctta

SEQ ID NO: 2303467 - DNA, 16 bp, Homo sapiens
ctaggtcatttgtaga

SEQ ID NO: 2303468 - DNA, 21 bp, Homo sapiens
ctaggtctgagaactcaggct

SEQ ID NO: 2303469 - DNA, 20 bp, Homo sapiens
ctagtaagaacgtactttct

SEQ ID NO: 2303470 - DNA, 12 bp, Homo sapiens
ctagtactgtgt

SEQ ID NO: 2303471 - DNA, 15 bp, Homo sapiens
ctagtagagcaaaga

SEQ ID NO: 2303472 - DNA, 14 bp, Homo sapiens
ctagtatttgtatc

SEQ ID NO: 2303473 - DNA, 15 bp, Homo sapiens
ctagtcaactgctgt

SEQ ID NO: 2303474 - DNA, 19 bp, Homo sapiens
ctagtgatacactgtatct

SEQ ID NO: 2303475 - DNA, 14 bp, Homo sapiens
ctagtgatttttgg

SEQ ID NO: 2303476 - DNA, 14 bp, Homo sapiens
ctagtggcttcagc

SEQ ID NO: 2303477 - DNA, 12 bp, Homo sapiens
ctataaatgtga

SEQ ID NO: 2303478 - DNA, 22 bp, Homo sapiens
ctataaattgtagaacatagat

SEQ ID NO: 2303479 - DNA, 16 bp, Homo sapiens
ctatactggttatagt

SEQ ID NO: 2303480 - DNA, 16 bp, Homo sapiens
ctatactgtttgtaat

SEQ ID NO: 2303481 - DNA, 15 bp, Homo sapiens
ctatactttctcaca

SEQ ID NO: 2303482 - DNA, 16 bp, Homo sapiens
ctatatatacatgtat

SEQ ID NO: 2303483 - DNA, 22 bp, Homo sapiens
ctatatatatatatatatgtat

SEQ ID NO: 2303484 - DNA, 14 bp, Homo sapiens
ctatatttcatatt

SEQ ID NO: 2303485 - DNA, 15 bp, Homo sapiens
ctatatttcatattg

SEQ ID NO: 2303486 - DNA, 19 bp, Homo sapiens
ctatatttgctaataccaa

SEQ ID NO: 2303487 - DNA, 23 bp, Homo sapiens
ctatatttggattcacagccttt

SEQ ID NO: 2303488 - DNA, 15 bp, Homo sapiens
ctatctgcaaatagt

SEQ ID NO: 2303489 - DNA, 15 bp, Homo sapiens
ctatctgctgggctg

SEQ ID NO: 2303490 - DNA, 13 bp, Homo sapiens
ctatctgtaagag

SEQ ID NO: 2303491 - DNA, 16 bp, Homo sapiens
ctatgagagatgtgtc

SEQ ID NO: 2303492 - DNA, 14 bp, Homo sapiens
ctatgcctgtattt

SEQ ID NO: 2303493 - DNA, 17 bp, Homo sapiens
ctatggaaatacattta

SEQ ID NO: 2303494 - DNA, 21 bp, Homo sapiens
ctatgtaagggctttaaataa

SEQ ID NO: 2303495 - DNA, 18 bp, Homo sapiens
ctatgtactagtactgtg

SEQ ID NO: 2303496 - DNA, 20 bp, Homo sapiens
ctatgtactagtactgtgta

SEQ ID NO: 2303497 - DNA, 16 bp, Homo sapiens
ctatgtccaaacctgg

SEQ ID NO: 2303498 - DNA, 22 bp, Homo sapiens
ctattaaagaatgttttggaat

SEQ ID NO: 2303499 - DNA, 22 bp, Homo sapiens
ctattatctgggttttagaaat

SEQ ID NO: 2303500 - DNA, 23 bp, Homo sapiens
ctattatctgggttttagaaatt

SEQ ID NO: 2303501 - DNA, 14 bp, Homo sapiens
ctattgtttatagg

SEQ ID NO: 2303502 - DNA, 18 bp, Homo sapiens
ctatttcggaaatacact

SEQ ID NO: 2303503 - DNA, 19 bp, Homo sapiens
ctatttcggaaatacacta

SEQ ID NO: 2303504 - DNA, 14 bp, Homo sapiens
ctatttctatctgc

SEQ ID NO: 2303505 - DNA, 19 bp, Homo sapiens
ctattttaaaattcatgga

SEQ ID NO: 2303506 - DNA, 16 bp, Homo sapiens
ctattttctatgtact

SEQ ID NO: 2303507 - DNA, 13 bp, Homo sapiens
ctcaaactgggta

SEQ ID NO: 2303508 - DNA, 14 bp, Homo sapiens
ctcaacctctcaga

SEQ ID NO: 2303509 - DNA, 18 bp, Homo sapiens
ctcaacctctcagatccc

SEQ ID NO: 2303510 - DNA, 17 bp, Homo sapiens
ctcaagagcccttccag

SEQ ID NO: 2303511 - DNA, 13 bp, Homo sapiens
ctcaatgcatgat

SEQ ID NO: 2303512 - DNA, 17 bp, Homo sapiens
ctcaatgcatgatgact

SEQ ID NO: 2303513 - DNA, 23 bp, Homo sapiens
ctcaatgcatgatgactcttctt

SEQ ID NO: 2303514 - DNA, 17 bp, Homo sapiens
ctcaatgcttttctagc

SEQ ID NO: 2303515 - DNA, 18 bp, Homo sapiens
ctcacaagtgaaaactga

SEQ ID NO: 2303516 - DNA, 22 bp, Homo sapiens
ctcacacgctgcctcctcagca

SEQ ID NO: 2303517 - DNA, 14 bp, Homo sapiens
ctcacatcatgtaa

SEQ ID NO: 2303518 - DNA, 15 bp, Homo sapiens
ctcacatcatgtaat

SEQ ID NO: 2303519 - DNA, 13 bp, Homo sapiens
ctcaccaaaatat

SEQ ID NO: 2303520 - DNA, 14 bp, Homo sapiens
ctcaccagccttga

SEQ ID NO: 2303521 - DNA, 22 bp, Homo sapiens
ctcactagtttttcctgtgcaa

SEQ ID NO: 2303522 - DNA, 15 bp, Homo sapiens
ctcactcagcaccac

SEQ ID NO: 2303523 - DNA, 22 bp, Homo sapiens
ctcactctgttgaccaggctgg

SEQ ID NO: 2303524 - DNA, 23 bp, Homo sapiens
ctcactctgttgaccaggctgga

SEQ ID NO: 2303525 - DNA, 14 bp, Homo sapiens
ctcactgcatcttt

SEQ ID NO: 2303526 - DNA, 16 bp, Homo sapiens
ctcactgcatctttct

SEQ ID NO: 2303527 - DNA, 12 bp, Homo sapiens
ctcactgcctgc

SEQ ID NO: 2303528 - DNA, 16 bp, Homo sapiens
ctcactgcctgcagct

SEQ ID NO: 2303529 - DNA, 20 bp, Homo sapiens
ctcactgcctgcagctgaga

SEQ ID NO: 2303530 - DNA, 20 bp, Homo sapiens
ctcactgtgttgcccaggct

SEQ ID NO: 2303531 - DNA, 15 bp, Homo sapiens
ctcacttcagttgtg

SEQ ID NO: 2303532 - DNA, 22 bp, Homo sapiens
ctcagaaggctctatctgctgg

SEQ ID NO: 2303533 - DNA, 23 bp, Homo sapiens
ctcagaattacaggaaatgcaaa

SEQ ID NO: 2303534 - DNA, 15 bp, Homo sapiens
ctcagcaaattcttg

SEQ ID NO: 2303535 - DNA, 14 bp, Homo sapiens
ctcagcacagcctc

SEQ ID NO: 2303536 - DNA, 14 bp, Homo sapiens
ctcagccgagccca

SEQ ID NO: 2303537 - DNA, 10 bp, Homo sapiens
ctcaggccca

SEQ ID NO: 2303538 - DNA, 17 bp, Homo sapiens
ctcaggcccacattgcc

SEQ ID NO: 2303539 - DNA, 15 bp, Homo sapiens
ctcagtcccacagcc

SEQ ID NO: 2303540 - DNA, 14 bp, Homo sapiens
ctcagtttctctgg

SEQ ID NO: 2303541 - DNA, 20 bp, Homo sapiens
ctcatcacccggatagagga

SEQ ID NO: 2303542 - DNA, 21 bp, Homo sapiens
ctcatccccaaactgtagtaa

SEQ ID NO: 2303543 - DNA, 21 bp, Homo sapiens
ctcatcttgtaaataatgctt

SEQ ID NO: 2303544 - DNA, 17 bp, Homo sapiens
ctcatgccgctgtgtct

SEQ ID NO: 2303545 - DNA, 19 bp, Homo sapiens
ctcatgggagtcagggagc

SEQ ID NO: 2303546 - DNA, 22 bp, Homo sapiens
ctcatgggagtcagggagccct

SEQ ID NO: 2303547 - DNA, 18 bp, Homo sapiens
ctcatgtatttaaagaac

SEQ ID NO: 2303548 - DNA, 18 bp, Homo sapiens
ctcattacagatttagtt

SEQ ID NO: 2303549 - DNA, 13 bp, Homo sapiens
ctcattagctctc

SEQ ID NO: 2303550 - DNA, 20 bp, Homo sapiens
ctcattcctctgtccccgag

SEQ ID NO: 2303551 - DNA, 22 bp, Homo sapiens
ctcattcttttcagcttgtttc

SEQ ID NO: 2303552 - DNA, 21 bp, Homo sapiens
ctcattgtagagcacatttag

SEQ ID NO: 2303553 - DNA, 21 bp, Homo sapiens
ctcatttagcattgaaataat

SEQ ID NO: 2303554 - DNA, 16 bp, Homo sapiens
ctccaaaaagaaatat

SEQ ID NO: 2303555 - DNA, 12 bp, Homo sapiens
ctccaaaacaca

SEQ ID NO: 2303556 - DNA, 20 bp, Homo sapiens
ctccaaaacacaagggagga

SEQ ID NO: 2303557 - DNA, 14 bp, Homo sapiens
ctccaacatccact

SEQ ID NO: 2303558 - DNA, 16 bp, Homo sapiens
ctccaacctggaggct

SEQ ID NO: 2303559 - DNA, 20 bp, Homo sapiens
ctccaacctggaggctggac

SEQ ID NO: 2303560 - DNA, 21 bp, Homo sapiens
ctccaacctggaggctggacc

SEQ ID NO: 2303561 - DNA, 17 bp, Homo sapiens
ctccaagtcatgggaga

SEQ ID NO: 2303562 - DNA, 19 bp, Homo sapiens
ctccaagtcatgggagaag

SEQ ID NO: 2303563 - DNA, 22 bp, Homo sapiens
ctccaagtcatgggagaagagg

SEQ ID NO: 2303564 - DNA, 13 bp, Homo sapiens
ctccacacccgcg

SEQ ID NO: 2303565 - DNA, 14 bp, Homo sapiens
ctccacctgggaga

SEQ ID NO: 2303566 - DNA, 13 bp, Homo sapiens
ctccacgggggcc

SEQ ID NO: 2303567 - DNA, 18 bp, Homo sapiens
ctccacgggggcctagtg

SEQ ID NO: 2303568 - DNA, 19 bp, Homo sapiens
ctccacgggggcctagtgg

SEQ ID NO: 2303569 - DNA, 22 bp, Homo sapiens
ctccagaatttcccaaagcagt

SEQ ID NO: 2303570 - DNA, 21 bp, Homo sapiens
ctccagagctgcggtgtctcc

SEQ ID NO: 2303571 - DNA, 18 bp, Homo sapiens
ctccagatcctctttccc

SEQ ID NO: 2303572 - DNA, 22 bp, Homo sapiens
ctccagccaatttcaaagaaaa

SEQ ID NO: 2303573 - DNA, 18 bp, Homo sapiens
ctccagctcctgccccgc

SEQ ID NO: 2303574 - DNA, 13 bp, Homo sapiens
ctccaggagcagc

SEQ ID NO: 2303575 - DNA, 18 bp, Homo sapiens
ctccaggaggactgttct

SEQ ID NO: 2303576 - DNA, 16 bp, Homo sapiens
ctccaggcaccgcctg

SEQ ID NO: 2303577 - DNA, 17 bp, Homo sapiens
ctccaggcaccgcctgc

SEQ ID NO: 2303578 - DNA, 22 bp, Homo sapiens
ctccaggcaccgcctgccccca

SEQ ID NO: 2303579 - DNA, 13 bp, Homo sapiens
ctccaggggctgg

SEQ ID NO: 2303580 - DNA, 20 bp, Homo sapiens
ctccaggggctggggacttc

SEQ ID NO: 2303581 - DNA, 23 bp, Homo sapiens
ctccataggagggaaggagcagt

SEQ ID NO: 2303582 - DNA, 15 bp, Homo sapiens
ctggcaaataatact

SEQ ID NO: 2303583 - DNA, 20 bp, Homo sapiens
ctggcaaataatactaattt

SEQ ID NO: 2303584 - DNA, 21 bp, Homo sapiens
ctggcagcgcctcccgccgcc

SEQ ID NO: 2303585 - DNA, 13 bp, Homo sapiens
ctggcaggagaca

SEQ ID NO: 2303586 - DNA, 12 bp, Homo sapiens
ctggcagggcag

SEQ ID NO: 2303587 - DNA, 16 bp, Homo sapiens
ctggcagggcaggcag

SEQ ID NO: 2303588 - DNA, 21 bp, Homo sapiens
ctggcagggcaggcagagctc

SEQ ID NO: 2303589 - DNA, 16 bp, Homo sapiens
ctggcaggtggccagg

SEQ ID NO: 2303590 - DNA, 19 bp, Homo sapiens
ctggcaggtggccagggct

SEQ ID NO: 2303591 - DNA, 21 bp, Homo sapiens
ctggcaggtggccagggctcc

SEQ ID NO: 2303592 - DNA, 22 bp, Homo sapiens
ctggcatgggaatgaatgtcag

SEQ ID NO: 2303593 - DNA, 17 bp, Homo sapiens
ctggccactggccctgt

SEQ ID NO: 2303594 - DNA, 20 bp, Homo sapiens
ctggccccaagatgttgggg

SEQ ID NO: 2303595 - DNA, 12 bp, Homo sapiens
ctggccccaggc

SEQ ID NO: 2303596 - DNA, 14 bp, Homo sapiens
ctggccccaggcgg

SEQ ID NO: 2303597 - DNA, 18 bp, Homo sapiens
ctggccccaggcggaggg

SEQ ID NO: 2303598 - DNA, 19 bp, Homo sapiens
ctggccccaggcggagggg

SEQ ID NO: 2303599 - DNA, 13 bp, Homo sapiens
ctggccctgccct

SEQ ID NO: 2303600 - DNA, 15 bp, Homo sapiens
ctggccctgccctcc

SEQ ID NO: 2303601 - DNA, 18 bp, Homo sapiens
ctggccctgggccccgcc

SEQ ID NO: 2303602 - DNA, 18 bp, Homo sapiens
ctggccctgtttctcccc

SEQ ID NO: 2303603 - DNA, 13 bp, Homo sapiens
ctggcctgacaca

SEQ ID NO: 2303604 - DNA, 14 bp, Homo sapiens
ctggcctgacacaa

SEQ ID NO: 2303605 - DNA, 18 bp, Homo sapiens
ctggcctgacacaatggt

SEQ ID NO: 2303606 - DNA, 13 bp, Homo sapiens
ctggcggcagggg

SEQ ID NO: 2303607 - DNA, 18 bp, Homo sapiens
ctggctgggtcgcccctc

SEQ ID NO: 2303608 - DNA, 20 bp, Homo sapiens
ctggctgggtcgcccctcct

SEQ ID NO: 2303609 - DNA, 14 bp, Homo sapiens
ctggcttctccctg

SEQ ID NO: 2303610 - DNA, 15 bp, Homo sapiens
ctggcttctccctgg

SEQ ID NO: 2303611 - DNA, 16 bp, Homo sapiens
ctggcttctccctgga

SEQ ID NO: 2303612 - DNA, 22 bp, Homo sapiens
ctgggaagaaagtaggagtggc

SEQ ID NO: 2303613 - DNA, 17 bp, Homo sapiens
ctgggaagcattacttt

SEQ ID NO: 2303614 - DNA, 16 bp, Homo sapiens
ctgggacccactccga

SEQ ID NO: 2303615 - DNA, 14 bp, Homo sapiens
ctgggactgctcag

SEQ ID NO: 2303616 - DNA, 15 bp, Homo sapiens
ctgggagatgctggg

SEQ ID NO: 2303617 - DNA, 16 bp, Homo sapiens
ctgggcagggccctgt

SEQ ID NO: 2303618 - DNA, 18 bp, Homo sapiens
ctgggcagggccctgtgg

SEQ ID NO: 2303619 - DNA, 20 bp, Homo sapiens
ctgggcagggccctgtggct

SEQ ID NO: 2303620 - DNA, 17 bp, Homo sapiens
ctgggcagggccgcagg

SEQ ID NO: 2303621 - DNA, 19 bp, Homo sapiens
ctgggcagggccgcagggc

SEQ ID NO: 2303622 - DNA, 16 bp, Homo sapiens
ctgggcatccccagcc

SEQ ID NO: 2303623 - DNA, 23 bp, Homo sapiens
ctgggccccagaaagcctcagag

SEQ ID NO: 2303624 - DNA, 17 bp, Homo sapiens
ctgggccccgcctcaag

SEQ ID NO: 2303625 - DNA, 18 bp, Homo sapiens
ctgggccccgcctcaagg

SEQ ID NO: 2303626 - DNA, 14 bp, Homo sapiens
ctgggcctcccgtc

SEQ ID NO: 2303627 - DNA, 21 bp, Homo sapiens
ctgggctgatttgggtctctc

SEQ ID NO: 2303628 - DNA, 19 bp, Homo sapiens
ctggggagaccgagtgtgg

SEQ ID NO: 2303629 - DNA, 11 bp, Homo sapiens
ctggggccctt

SEQ ID NO: 2303630 - DNA, 17 bp, Homo sapiens
ctggggcttttgtgcca

SEQ ID NO: 2303631 - DNA, 20 bp, Homo sapiens
ctgggggaggcttccagctc

SEQ ID NO: 2303632 - DNA, 21 bp, Homo sapiens
ctgggggaggcttccagctca

SEQ ID NO: 2303633 - DNA, 22 bp, Homo sapiens
ctgggggaggcttccagctcag

SEQ ID NO: 2303634 - DNA, 17 bp, Homo sapiens
ctggggtctctgagcag

SEQ ID NO: 2303635 - DNA, 19 bp, Homo sapiens
ctggggtctctgagcagtg

SEQ ID NO: 2303636 - DNA, 18 bp, Homo sapiens
ctggggtgggagggggca

SEQ ID NO: 2303637 - DNA, 22 bp, Homo sapiens
ctggggtgggagggggcagggg

SEQ ID NO: 2303638 - DNA, 23 bp, Homo sapiens
ctggggtgggagggggcaggggg

SEQ ID NO: 2303639 - DNA, 24 bp, Homo sapiens
ctggggtttccacacaggcccatg

SEQ ID NO: 2303640 - DNA, 15 bp, Homo sapiens
ctgggtctaaagggc

SEQ ID NO: 2303641 - DNA, 17 bp, Homo sapiens
ctgggttttagaaattc

SEQ ID NO: 2303642 - DNA, 15 bp, Homo sapiens
ctggtatggctgcag

SEQ ID NO: 2303643 - DNA, 14 bp, Homo sapiens
ctggtctcagagga

SEQ ID NO: 2303644 - DNA, 21 bp, Homo sapiens
ctggtcttgaactcttggcct

SEQ ID NO: 2303645 - DNA, 23 bp, Homo sapiens
ctggtcttgaactcttggcctca

SEQ ID NO: 2303646 - DNA, 18 bp, Homo sapiens
ctggtgtctagtttgcat

SEQ ID NO: 2303647 - DNA, 17 bp, Homo sapiens
ctggttatagttgatat

SEQ ID NO: 2303648 - DNA, 19 bp, Homo sapiens
ctggttcccccaggaccct

SEQ ID NO: 2303649 - DNA, 19 bp, Homo sapiens
ctgtaaatttaactgcata

SEQ ID NO: 2303650 - DNA, 11 bp, Homo sapiens
ctgtaagaaat

SEQ ID NO: 2303651 - DNA, 16 bp, Homo sapiens
ctgtaagacggccttg

SEQ ID NO: 2303652 - DNA, 18 bp, Homo sapiens
ctgtaagaggtactaaaa

SEQ ID NO: 2303653 - DNA, 16 bp, Homo sapiens
ctgtaatgcactcctg

SEQ ID NO: 2303654 - DNA, 19 bp, Homo sapiens
ctgtaccatccatggagca

SEQ ID NO: 2303655 - DNA, 16 bp, Homo sapiens
ctgtagctacaaggga

SEQ ID NO: 2303656 - DNA, 19 bp, Homo sapiens
ctgtagctacaagggaagc

SEQ ID NO: 2303657 - DNA, 20 bp, Homo sapiens
ctgtaggtgaaagaacaagt

SEQ ID NO: 2303658 - DNA, 17 bp, Homo sapiens
ctgtatagacagtttgt

SEQ ID NO: 2303659 - DNA, 22 bp, Homo sapiens
ctgtatagacagtttgtaaatg

SEQ ID NO: 2303660 - DNA, 22 bp, Homo sapiens
ctgtatattattgctatatttg

SEQ ID NO: 2303661 - DNA, 18 bp, Homo sapiens
ctgtatctaaaaaataac

SEQ ID NO: 2303662 - DNA, 12 bp, Homo sapiens
ctgtatttccaa

SEQ ID NO: 2303663 - DNA, 22 bp, Homo sapiens
ctgtattttcttttatatctgt

SEQ ID NO: 2303664 - DNA, 15 bp, Homo sapiens
ctgtatttttagaga

SEQ ID NO: 2303665 - DNA, 23 bp, Homo sapiens
ctgtcaatgaggttatgagaaaa

SEQ ID NO: 2303666 - DNA, 13 bp, Homo sapiens
ctgtcaattacag

SEQ ID NO: 2303667 - DNA, 18 bp, Homo sapiens
ctgtcaattacaggaagt

SEQ ID NO: 2303668 - DNA, 20 bp, Homo sapiens
ctgtcaattacaggaagtac

SEQ ID NO: 2303669 - DNA, 18 bp, Homo sapiens
ctgtcactcacaaaaggc

SEQ ID NO: 2303670 - DNA, 16 bp, Homo sapiens
ctgtcattttatgcta

SEQ ID NO: 2303671 - DNA, 16 bp, Homo sapiens
ctgtccacgtggagag

SEQ ID NO: 2303672 - DNA, 18 bp, Homo sapiens
ctgtccactctgctcagg

SEQ ID NO: 2303673 - DNA, 22 bp, Homo sapiens
ctgtccactctgctcagggccg

SEQ ID NO: 2303674 - DNA, 17 bp, Homo sapiens
ctgtcccatgggctctg

SEQ ID NO: 2303675 - DNA, 23 bp, Homo sapiens
ctgtcccatgggctctggcccca

SEQ ID NO: 2303676 - DNA, 20 bp, Homo sapiens
ctgtcccttacgtgagtcct

SEQ ID NO: 2303677 - DNA, 19 bp, Homo sapiens
ctgtccttcttagaatgtt

SEQ ID NO: 2303678 - DNA, 22 bp, Homo sapiens
ctgtctaatgaaacctgtgtct

SEQ ID NO: 2303679 - DNA, 15 bp, Homo sapiens
ctgtctcttccatgc

SEQ ID NO: 2303680 - DNA, 14 bp, Homo sapiens
ctgtctgattctat

SEQ ID NO: 2303681 - DNA, 18 bp, Homo sapiens
ctgtcttcaaccctgccc

SEQ ID NO: 2303682 - DNA, 20 bp, Homo sapiens
ctgtcttcaaccctgccctg

SEQ ID NO: 2303683 - DNA, 19 bp, Homo sapiens
ctgtcttgtaatattttgt

SEQ ID NO: 2303684 - DNA, 13 bp, Homo sapiens
ctgtctttttcct

SEQ ID NO: 2303685 - DNA, 15 bp, Homo sapiens
ctgtgaccggggtcc

SEQ ID NO: 2303686 - DNA, 22 bp, Homo sapiens
ctgtgagtgacatcggttcagg

SEQ ID NO: 2303687 - DNA, 14 bp, Homo sapiens
ctgtgatctaagca

SEQ ID NO: 2303688 - DNA, 18 bp, Homo sapiens
ctgtgccccgaccccacc

SEQ ID NO: 2303689 - DNA, 21 bp, Homo sapiens
ctgtgcccgaggttcctgtca

SEQ ID NO: 2303690 - DNA, 14 bp, Homo sapiens
ctgtgcgttttaga

SEQ ID NO: 2303691 - DNA, 12 bp, Homo sapiens
ctgtgctctcct

SEQ ID NO: 2303692 - DNA, 15 bp, Homo sapiens
ctgtggaaatatgca

SEQ ID NO: 2303693 - DNA, 16 bp, Homo sapiens
ctgtggaaatatgcaa

SEQ ID NO: 2303694 - DNA, 20 bp, Homo sapiens
ctgtggaaatatgcaacctg

SEQ ID NO: 2303695 - DNA, 13 bp, Homo sapiens
ctgtggaacacta

SEQ ID NO: 2303696 - DNA, 14 bp, Homo sapiens
ctgtggattctata

SEQ ID NO: 2303697 - DNA, 15 bp, Homo sapiens
ctgtggattctatat

SEQ ID NO: 2303698 - DNA, 21 bp, Homo sapiens
ctgtggccacctagaaagggg

SEQ ID NO: 2303699 - DNA, 14 bp, Homo sapiens
ctgtggcctcagga

SEQ ID NO: 2303700 - DNA, 17 bp, Homo sapiens
ctgtggctccaggagca

SEQ ID NO: 2303701 - DNA, 14 bp, Homo sapiens
ctgtggggagctgg

SEQ ID NO: 2303702 - DNA, 22 bp, Homo sapiens
ctgtggtgtctcttggggaagg

SEQ ID NO: 2303703 - DNA, 15 bp, Homo sapiens
ctgtgtccacagtga

SEQ ID NO: 2303704 - DNA, 21 bp, Homo sapiens
ctgtgtccccgcgggcagtga

SEQ ID NO: 2303705 - DNA, 14 bp, Homo sapiens
ctgttactccaaaa

SEQ ID NO: 2303706 - DNA, 21 bp, Homo sapiens
ctgttactccaaaaagaaata

SEQ ID NO: 2303707 - DNA, 14 bp, Homo sapiens
ctgttccacttctc

SEQ ID NO: 2303708 - DNA, 16 bp, Homo sapiens
ctgttccacttctcta

SEQ ID NO: 2303709 - DNA, 17 bp, Homo sapiens
ctgttccacttctctag

SEQ ID NO: 2303710 - DNA, 15 bp, Homo sapiens
ctgttctcaaatgct

SEQ ID NO: 2303711 - DNA, 15 bp, Homo sapiens
ctgttctgagaaggt

SEQ ID NO: 2303712 - DNA, 13 bp, Homo sapiens
ctgttctgtgtct

SEQ ID NO: 2303713 - DNA, 14 bp, Homo sapiens
ctgttctgtgtctg

SEQ ID NO: 2303714 - DNA, 13 bp, Homo sapiens
gagagcgccaccc

SEQ ID NO: 2303715 - DNA, 22 bp, Homo sapiens
gagagcgccacccgcccgcccc

SEQ ID NO: 2303716 - DNA, 13 bp, Homo sapiens
gagagctgggact

SEQ ID NO: 2303717 - DNA, 21 bp, Homo sapiens
gagaggaccccattctgggac

SEQ ID NO: 2303718 - DNA, 21 bp, Homo sapiens
gagaggatttggctcgctgtg

SEQ ID NO: 2303719 - DNA, 12 bp, Homo sapiens
gagagggctgag

SEQ ID NO: 2303720 - DNA, 13 bp, Homo sapiens
gagagggctgagc

SEQ ID NO: 2303721 - DNA, 15 bp, Homo sapiens
gagagggctgagccc

SEQ ID NO: 2303722 - DNA, 20 bp, Homo sapiens
gagagggtgccgcgggcgag

SEQ ID NO: 2303723 - DNA, 13 bp, Homo sapiens
gagataaatattt

SEQ ID NO: 2303724 - DNA, 14 bp, Homo sapiens
gagataaatattta

SEQ ID NO: 2303725 - DNA, 13 bp, Homo sapiens
gagatatttttat

SEQ ID NO: 2303726 - DNA, 20 bp, Homo sapiens
gagatcacgccattgcactc

SEQ ID NO: 2303727 - DNA, 13 bp, Homo sapiens
gagatcagaattg

SEQ ID NO: 2303728 - DNA, 14 bp, Homo sapiens
gagatcagaattga

SEQ ID NO: 2303729 - DNA, 16 bp, Homo sapiens
gagatgagttttagga

SEQ ID NO: 2303730 - DNA, 20 bp, Homo sapiens
gagatggcagagccatccac

SEQ ID NO: 2303731 - DNA, 13 bp, Homo sapiens
gagattaatttgt

SEQ ID NO: 2303732 - DNA, 22 bp, Homo sapiens
gagattccagaacgccctgtgt

SEQ ID NO: 2303733 - DNA, 23 bp, Homo sapiens
gagattccagaacgccctgtgtc

SEQ ID NO: 2303734 - DNA, 15 bp, Homo sapiens
gagattgtacatttt

SEQ ID NO: 2303735 - DNA, 23 bp, Homo sapiens
gagcaagcgaaagagcaaagtca

SEQ ID NO: 2303736 - DNA, 19 bp, Homo sapiens
gagcaatgtttttctcaaa

SEQ ID NO: 2303737 - DNA, 21 bp, Homo sapiens
gagcaatgtttttctcaaaaa

SEQ ID NO: 2303738 - DNA, 21 bp, Homo sapiens
gagcaccagatgacacataaa

SEQ ID NO: 2303739 - DNA, 11 bp, Homo sapiens
gagcaccccca

SEQ ID NO: 2303740 - DNA, 15 bp, Homo sapiens
gagcacccccagcct

SEQ ID NO: 2303741 - DNA, 16 bp, Homo sapiens
gagcacccccagcctc

SEQ ID NO: 2303742 - DNA, 20 bp, Homo sapiens
gagcacccccagcctccccc

SEQ ID NO: 2303743 - DNA, 11 bp, Homo sapiens
gagcagagacg

SEQ ID NO: 2303744 - DNA, 19 bp, Homo sapiens
gagcagagcccccatggcc

SEQ ID NO: 2303745 - DNA, 18 bp, Homo sapiens
gagcagtcactgggagag

SEQ ID NO: 2303746 - DNA, 12 bp, Homo sapiens
gagcagtgggga

SEQ ID NO: 2303747 - DNA, 20 bp, Homo sapiens
gagcagttgttatattcatt

SEQ ID NO: 2303748 - DNA, 18 bp, Homo sapiens
gagcagtttggggcaggg

SEQ ID NO: 2303749 - DNA, 19 bp, Homo sapiens
gagcagtttggggcagggg

SEQ ID NO: 2303750 - DNA, 22 bp, Homo sapiens
gagccaaagcttatgtgacatg

SEQ ID NO: 2303751 - DNA, 14 bp, Homo sapiens
gagccacagcactc

SEQ ID NO: 2303752 - DNA, 18 bp, Homo sapiens
gagccacagtggggccca

SEQ ID NO: 2303753 - DNA, 24 bp, Homo sapiens
gagccacagtggggcccatggccc

SEQ ID NO: 2303754 - DNA, 20 bp, Homo sapiens
gagccactggggtgggaggg

SEQ ID NO: 2303755 - DNA, 21 bp, Homo sapiens
gagccactggggtgggagggg

SEQ ID NO: 2303756 - DNA, 13 bp, Homo sapiens
gagccagatttca

SEQ ID NO: 2303757 - DNA, 19 bp, Homo sapiens
gagccagatttcactctcc

SEQ ID NO: 2303758 - DNA, 20 bp, Homo sapiens
gagccagccgtaatggggac

SEQ ID NO: 2303759 - DNA, 13 bp, Homo sapiens
gagccatccaccc

SEQ ID NO: 2303760 - DNA, 19 bp, Homo sapiens
gagccatccaccctgagga

SEQ ID NO: 2303761 - DNA, 12 bp, Homo sapiens
gagcccctcctc

SEQ ID NO: 2303762 - DNA, 21 bp, Homo sapiens
gagccctatctatgtcctgga

SEQ ID NO: 2303763 - DNA, 23 bp, Homo sapiens
gagccctggggtttccacacagg

SEQ ID NO: 2303764 - DNA, 15 bp, Homo sapiens
gagcccttccaggag

SEQ ID NO: 2303765 - DNA, 19 bp, Homo sapiens
gagcccttccaggagtggg

SEQ ID NO: 2303766 - DNA, 16 bp, Homo sapiens
gagccgagctctcctg

SEQ ID NO: 2303767 - DNA, 18 bp, Homo sapiens
gagccgagctctcctggg

SEQ ID NO: 2303768 - DNA, 15 bp, Homo sapiens
gagccgatctggtct

SEQ ID NO: 2303769 - DNA, 13 bp, Homo sapiens
gagccgcaccctg

SEQ ID NO: 2303770 - DNA, 18 bp, Homo sapiens
gagcctgcgtggcctggg

SEQ ID NO: 2303771 - DNA, 12 bp, Homo sapiens
gagcgccacccg

SEQ ID NO: 2303772 - DNA, 22 bp, Homo sapiens
gagcgccacccgcccgcccccg

SEQ ID NO: 2303773 - DNA, 16 bp, Homo sapiens
gagcgcgtgccttccc

SEQ ID NO: 2303774 - DNA, 15 bp, Homo sapiens
gagcggctgaggacg

SEQ ID NO: 2303775 - DNA, 19 bp, Homo sapiens
gagcgggggctaactggcc

SEQ ID NO: 2303776 - DNA, 17 bp, Homo sapiens
gagctaccaggaagagg

SEQ ID NO: 2303777 - DNA, 18 bp, Homo sapiens
gagctaccaggaagaggg

SEQ ID NO: 2303778 - DNA, 15 bp, Homo sapiens
gagctaggaaagagt

SEQ ID NO: 2303779 - DNA, 15 bp, Homo sapiens
gagctcacaccgcac

SEQ ID NO: 2303780 - DNA, 14 bp, Homo sapiens
gagctcagaggacg

SEQ ID NO: 2303781 - DNA, 14 bp, Homo sapiens
gagctccaccctcc

SEQ ID NO: 2303782 - DNA, 17 bp, Homo sapiens
gagctccaccctcccct

SEQ ID NO: 2303783 - DNA, 23 bp, Homo sapiens
gagctcgcggcgaggacgacttc

SEQ ID NO: 2303784 - DNA, 20 bp, Homo sapiens
gagctctcctgggccagggt

SEQ ID NO: 2303785 - DNA, 18 bp, Homo sapiens
gagctgagtcggctgggc

SEQ ID NO: 2303786 - DNA, 16 bp, Homo sapiens
gaggaacaaggcaagg

SEQ ID NO: 2303787 - DNA, 18 bp, Homo sapiens
gaggaccccattctggga

SEQ ID NO: 2303788 - DNA, 16 bp, Homo sapiens
gaggacctccacctgg

SEQ ID NO: 2303789 - DNA, 21 bp, Homo sapiens
gaggacctccacctgggagat

SEQ ID NO: 2303790 - DNA, 14 bp, Homo sapiens
gaggacctgcggcc

SEQ ID NO: 2303791 - DNA, 22 bp, Homo sapiens
gaggacggggcagagctgagtc

SEQ ID NO: 2303792 - DNA, 13 bp, Homo sapiens
gaggactccaggg

SEQ ID NO: 2303793 - DNA, 14 bp, Homo sapiens
gaggactccagggg

SEQ ID NO: 2303794 - DNA, 14 bp, Homo sapiens
gaggagacagtcag

SEQ ID NO: 2303795 - DNA, 16 bp, Homo sapiens
gaggagactcaggccc

SEQ ID NO: 2303796 - DNA, 13 bp, Homo sapiens
gaggagcaccccc

SEQ ID NO: 2303797 - DNA, 14 bp, Homo sapiens
gaggagcaccccca

SEQ ID NO: 2303798 - DNA, 22 bp, Homo sapiens
gaggagcacccccagcctcccc

SEQ ID NO: 2303799 - DNA, 17 bp, Homo sapiens
gaggaggctgcttccta

SEQ ID NO: 2303800 - DNA, 12 bp, Homo sapiens
gaggaggggagc

SEQ ID NO: 2303801 - DNA, 14 bp, Homo sapiens
gaggaggggcggga

SEQ ID NO: 2303802 - DNA, 21 bp, Homo sapiens
gaggagggtttgggcagagcg

SEQ ID NO: 2303803 - DNA, 16 bp, Homo sapiens
gaggagtgatgggcaa

SEQ ID NO: 2303804 - DNA, 17 bp, Homo sapiens
gaggagtgatgggcaag

SEQ ID NO: 2303805 - DNA, 17 bp, Homo sapiens
gaggagttgtctgtcct

SEQ ID NO: 2303806 - DNA, 18 bp, Homo sapiens
gaggagttgtctgtcctg

SEQ ID NO: 2303807 - DNA, 19 bp, Homo sapiens
gaggatggacgagtgagct

SEQ ID NO: 2303808 - DNA, 20 bp, Homo sapiens
gaggcacaaagggcaggcct

SEQ ID NO: 2303809 - DNA, 22 bp, Homo sapiens
gaggcagcatggagagaggcct

SEQ ID NO: 2303810 - DNA, 13 bp, Homo sapiens
gaggcccccggag

SEQ ID NO: 2303811 - DNA, 14 bp, Homo sapiens
gaggcctggctctg

SEQ ID NO: 2303812 - DNA, 15 bp, Homo sapiens
gaggcctggctctgg

SEQ ID NO: 2303813 - DNA, 13 bp, Homo sapiens
gaggcctgggtgt

SEQ ID NO: 2303814 - DNA, 21 bp, Homo sapiens
gaggcctgggtgtgacctgac

SEQ ID NO: 2303815 - DNA, 13 bp, Homo sapiens
gaggcgcccacct

SEQ ID NO: 2303816 - DNA, 14 bp, Homo sapiens
gaggcgcccacctg

SEQ ID NO: 2303817 - DNA, 17 bp, Homo sapiens
gaggcgcccacctgccc

SEQ ID NO: 2303818 - DNA, 18 bp, Homo sapiens
gaggcgcccacctgccca

SEQ ID NO: 2303819 - DNA, 19 bp, Homo sapiens
gaggcgcccacctgcccag

SEQ ID NO: 2303820 - DNA, 22 bp, Homo sapiens
gaggcgggaaccctctggggcc

SEQ ID NO: 2303821 - DNA, 14 bp, Homo sapiens
gaggcgtcttgtat

SEQ ID NO: 2303822 - DNA, 16 bp, Homo sapiens
gaggctgcggcaggag

SEQ ID NO: 2303823 - DNA, 12 bp, Homo sapiens
gaggctggacca

SEQ ID NO: 2303824 - DNA, 21 bp, Homo sapiens
gaggctggggcttttgtgcca

SEQ ID NO: 2303825 - DNA, 17 bp, Homo sapiens
gaggcttccagctcagt

SEQ ID NO: 2303826 - DNA, 13 bp, Homo sapiens
gagggaaacaaaa

SEQ ID NO: 2303827 - DNA, 15 bp, Homo sapiens
gagggaaagggagag

SEQ ID NO: 2303828 - DNA, 17 bp, Homo sapiens
gagggaagcccacccgc

SEQ ID NO: 2303829 - DNA, 18 bp, Homo sapiens
gagggaagcccacccgcc

SEQ ID NO: 2303830 - DNA, 13 bp, Homo sapiens
gagggaggcctga

SEQ ID NO: 2303831 - DNA, 14 bp, Homo sapiens
gagggcctctggac

SEQ ID NO: 2303832 - DNA, 12 bp, Homo sapiens
gagggctgagcc

SEQ ID NO: 2303833 - DNA, 13 bp, Homo sapiens
gagggctgagccc

SEQ ID NO: 2303834 - DNA, 14 bp, Homo sapiens
gagggctgagcccc

SEQ ID NO: 2303835 - DNA, 12 bp, Homo sapiens
gagggctgggca

SEQ ID NO: 2303836 - DNA, 15 bp, Homo sapiens
gagggctgggcaggg

SEQ ID NO: 2303837 - DNA, 21 bp, Homo sapiens
gagggctgggcagggccctgt

SEQ ID NO: 2303838 - DNA, 13 bp, Homo sapiens
gaggggaagagag

SEQ ID NO: 2303839 - DNA, 13 bp, Homo sapiens
gaggggagcaagg

SEQ ID NO: 2303840 - DNA, 23 bp, Homo sapiens
gaggggcaactgatgaacacagg

SEQ ID NO: 2303841 - DNA, 17 bp, Homo sapiens
gaggggcgctgccccca

SEQ ID NO: 2303842 - DNA, 15 bp, Homo sapiens
gaggggggcggtgag

SEQ ID NO: 2303843 - DNA, 18 bp, Homo sapiens
gagggggtcagttgggcc

SEQ ID NO: 2303844 - DNA, 20 bp, Homo sapiens
gagggggtcagttgggcccc

SEQ ID NO: 2303845 - DNA, 19 bp, Homo sapiens
gaggtcatcccggggccat

SEQ ID NO: 2303846 - DNA, 24 bp, Homo sapiens
gaggtcatcccggggccatggaag

SEQ ID NO: 2303847 - DNA, 16 bp, Homo sapiens
gcccaccgcccctgga

SEQ ID NO: 2303848 - DNA, 15 bp, Homo sapiens
gcccacgcagagccc

SEQ ID NO: 2303849 - DNA, 23 bp, Homo sapiens
gcccacggaggcctcgagcagag

SEQ ID NO: 2303850 - DNA, 20 bp, Homo sapiens
gcccagaacgggcctccccg

SEQ ID NO: 2303851 - DNA, 21 bp, Homo sapiens
gcccagaggggcggggccagg

SEQ ID NO: 2303852 - DNA, 17 bp, Homo sapiens
gcccaggacggtctgtg

SEQ ID NO: 2303853 - DNA, 18 bp, Homo sapiens
gcccaggggaggcacaaa

SEQ ID NO: 2303854 - DNA, 23 bp, Homo sapiens
gcccagttagcccggccaaggac

SEQ ID NO: 2303855 - DNA, 16 bp, Homo sapiens
gcccatggccccagct

SEQ ID NO: 2303856 - DNA, 17 bp, Homo sapiens
gcccatggccccagctg

SEQ ID NO: 2303857 - DNA, 14 bp, Homo sapiens
gcccattcagcctc

SEQ ID NO: 2303858 - DNA, 18 bp, Homo sapiens
gcccattcagcctcgtct

SEQ ID NO: 2303859 - DNA, 13 bp, Homo sapiens
gcccattgtaact

SEQ ID NO: 2303860 - DNA, 15 bp, Homo sapiens
gccccacccctccat

SEQ ID NO: 2303861 - DNA, 18 bp, Homo sapiens
gccccagaaagcctcaga

SEQ ID NO: 2303862 - DNA, 19 bp, Homo sapiens
gccccagaaagcctcagag

SEQ ID NO: 2303863 - DNA, 17 bp, Homo sapiens
gccccagagactgccca

SEQ ID NO: 2303864 - DNA, 23 bp, Homo sapiens
gccccagagactgcccaccctgg

SEQ ID NO: 2303865 - DNA, 14 bp, Homo sapiens
gccccagctggctg

SEQ ID NO: 2303866 - DNA, 22 bp, Homo sapiens
gccccagctggctgggtcgccc

SEQ ID NO: 2303867 - DNA, 12 bp, Homo sapiens
gccccaggcccc

SEQ ID NO: 2303868 - DNA, 14 bp, Homo sapiens
gccccaggccccag

SEQ ID NO: 2303869 - DNA, 15 bp, Homo sapiens
gccccaggccccagc

SEQ ID NO: 2303870 - DNA, 17 bp, Homo sapiens
gccccaggcggaggggc

SEQ ID NO: 2303871 - DNA, 18 bp, Homo sapiens
gccccatcccaaaccctt

SEQ ID NO: 2303872 - DNA, 13 bp, Homo sapiens
gccccatccttcc

SEQ ID NO: 2303873 - DNA, 19 bp, Homo sapiens
gccccatccttcccgcagc

SEQ ID NO: 2303874 - DNA, 17 bp, Homo sapiens
gccccatggtcacagac

SEQ ID NO: 2303875 - DNA, 18 bp, Homo sapiens
gccccatggtcacagacc

SEQ ID NO: 2303876 - DNA, 15 bp, Homo sapiens
gcccccacagatcca

SEQ ID NO: 2303877 - DNA, 12 bp, Homo sapiens
gcccccaccctg

SEQ ID NO: 2303878 - DNA, 16 bp, Homo sapiens
gcccccaccctgcttc

SEQ ID NO: 2303879 - DNA, 14 bp, Homo sapiens
gcccccgccctcgc

SEQ ID NO: 2303880 - DNA, 18 bp, Homo sapiens
gcccccgccctcgctccg

SEQ ID NO: 2303881 - DNA, 21 bp, Homo sapiens
gcccccggaggcgcccacctg

SEQ ID NO: 2303882 - DNA, 14 bp, Homo sapiens
gccccctcccccgc

SEQ ID NO: 2303883 - DNA, 15 bp, Homo sapiens
gccccctcccccgca

SEQ ID NO: 2303884 - DNA, 17 bp, Homo sapiens
gccccctcccccgcaga

SEQ ID NO: 2303885 - DNA, 21 bp, Homo sapiens
gccccctccttttcccactgg

SEQ ID NO: 2303886 - DNA, 21 bp, Homo sapiens
gccccctggcccctcccacat

SEQ ID NO: 2303887 - DNA, 17 bp, Homo sapiens
gccccgcacccctcctc

SEQ ID NO: 2303888 - DNA, 12 bp, Homo sapiens
gccccgcctcaa

SEQ ID NO: 2303889 - DNA, 20 bp, Homo sapiens
gccccgcgcgtgcccccagc

SEQ ID NO: 2303890 - DNA, 16 bp, Homo sapiens
gccccggagcaccacg

SEQ ID NO: 2303891 - DNA, 18 bp, Homo sapiens
gcccctcccacatccccc

SEQ ID NO: 2303892 - DNA, 15 bp, Homo sapiens
gcccctccccgcctc

SEQ ID NO: 2303893 - DNA, 17 bp, Homo sapiens
gcccctccccgcctcct

SEQ ID NO: 2303894 - DNA, 22 bp, Homo sapiens
gcccctccccgcctcctccctg

SEQ ID NO: 2303895 - DNA, 14 bp, Homo sapiens
gcccctccgtcccc

SEQ ID NO: 2303896 - DNA, 18 bp, Homo sapiens
gcccctccgtccccaggg

SEQ ID NO: 2303897 - DNA, 20 bp, Homo sapiens
gcccctcctcgggcgcctgc

SEQ ID NO: 2303898 - DNA, 21 bp, Homo sapiens
gcccctcctcgggcgcctgcg

SEQ ID NO: 2303899 - DNA, 19 bp, Homo sapiens
gcccctcctctcctcgtcc

SEQ ID NO: 2303900 - DNA, 16 bp, Homo sapiens
gcccctctcatggtca

SEQ ID NO: 2303901 - DNA, 15 bp, Homo sapiens
gcccctgcccctgcc

SEQ ID NO: 2303902 - DNA, 13 bp, Homo sapiens
gcccctgctgctc

SEQ ID NO: 2303903 - DNA, 21 bp, Homo sapiens
gcccctgctgctcctcggcca

SEQ ID NO: 2303904 - DNA, 17 bp, Homo sapiens
gcccctgctggaccaag

SEQ ID NO: 2303905 - DNA, 22 bp, Homo sapiens
gcccctggacaggcttcgtctc

SEQ ID NO: 2303906 - DNA, 15 bp, Homo sapiens
gccccttgaccccac

SEQ ID NO: 2303907 - DNA, 16 bp, Homo sapiens
gcccgagagctgggac

SEQ ID NO: 2303908 - DNA, 15 bp, Homo sapiens
gcccgagcgcgtgcc

SEQ ID NO: 2303909 - DNA, 20 bp, Homo sapiens
gcccgagcgcgtgccttccc

SEQ ID NO: 2303910 - DNA, 14 bp, Homo sapiens
gcccgaggttcctg

SEQ ID NO: 2303911 - DNA, 14 bp, Homo sapiens
gcccgcccaccccg

SEQ ID NO: 2303912 - DNA, 17 bp, Homo sapiens
gcccgcccaccccgctg

SEQ ID NO: 2303913 - DNA, 14 bp, Homo sapiens
gcccgccccaggcc

SEQ ID NO: 2303914 - DNA, 16 bp, Homo sapiens
gcccgccctcctctgc

SEQ ID NO: 2303915 - DNA, 19 bp, Homo sapiens
gcccgccctcctctgcccc

SEQ ID NO: 2303916 - DNA, 21 bp, Homo sapiens
gcccgccctcctctgccccct

SEQ ID NO: 2303917 - DNA, 22 bp, Homo sapiens
gcccgccctcctctgccccctc

SEQ ID NO: 2303918 - DNA, 18 bp, Homo sapiens
gcccgccggttggccggc

SEQ ID NO: 2303919 - DNA, 23 bp, Homo sapiens
gcccgccggttggccggctggcc

SEQ ID NO: 2303920 - DNA, 19 bp, Homo sapiens
gcccgctcaacctctcaga

SEQ ID NO: 2303921 - DNA, 18 bp, Homo sapiens
gcccggcccacgcagagc

SEQ ID NO: 2303922 - DNA, 19 bp, Homo sapiens
gcccggcccacgcagagcc

SEQ ID NO: 2303923 - DNA, 22 bp, Homo sapiens
gcccgggagatccgccctgggc

SEQ ID NO: 2303924 - DNA, 16 bp, Homo sapiens
gcccggtgtgaggagg

SEQ ID NO: 2303925 - DNA, 18 bp, Homo sapiens
gcccggtgtgaggagggg

SEQ ID NO: 2303926 - DNA, 15 bp, Homo sapiens
gcccgtgcgcagccg

SEQ ID NO: 2303927 - DNA, 17 bp, Homo sapiens
gccctatctatgtcctg

SEQ ID NO: 2303928 - DNA, 21 bp, Homo sapiens
gccctccaggccgacaggagg

SEQ ID NO: 2303929 - DNA, 17 bp, Homo sapiens
gccctccgcgggggaca

SEQ ID NO: 2303930 - DNA, 11 bp, Homo sapiens
gccctcctctg

SEQ ID NO: 2303931 - DNA, 12 bp, Homo sapiens
gccctcctctgc

SEQ ID NO: 2303932 - DNA, 20 bp, Homo sapiens
gccctcctctgccccctccc

SEQ ID NO: 2303933 - DNA, 23 bp, Homo sapiens
gccctcctctgccccctcccccg

SEQ ID NO: 2303934 - DNA, 22 bp, Homo sapiens
gccctgcaccttgggcacggga

SEQ ID NO: 2303935 - DNA, 10 bp, Homo sapiens
gccctgccct

SEQ ID NO: 2303936 - DNA, 19 bp, Homo sapiens
gccctgccctcccccacgg

SEQ ID NO: 2303937 - DNA, 11 bp, Homo sapiens
gccctgccctg

SEQ ID NO: 2303938 - DNA, 13 bp, Homo sapiens
gccctgccctggc

SEQ ID NO: 2303939 - DNA, 17 bp, Homo sapiens
gccctgccctggccact

SEQ ID NO: 2303940 - DNA, 16 bp, Homo sapiens
gccctggaggggccca

SEQ ID NO: 2303941 - DNA, 16 bp, Homo sapiens
gccctgggccccgcct

SEQ ID NO: 2303942 - DNA, 18 bp, Homo sapiens
gccctgggccccgcctca

SEQ ID NO: 2303943 - DNA, 22 bp, Homo sapiens
gccctggggtttccacacaggc

SEQ ID NO: 2303944 - DNA, 23 bp, Homo sapiens
gccctggggtttccacacaggcc

SEQ ID NO: 2303945 - DNA, 15 bp, Homo sapiens
gccctgtgtccacag

SEQ ID NO: 2303946 - DNA, 20 bp, Homo sapiens
gccctgtttctccccacacc

SEQ ID NO: 2303947 - DNA, 16 bp, Homo sapiens
gcccttccaggagtgg

SEQ ID NO: 2303948 - DNA, 17 bp, Homo sapiens
gcccttccaggagtggg

SEQ ID NO: 2303949 - DNA, 20 bp, Homo sapiens
gccgacaggaggccatgccc

SEQ ID NO: 2303950 - DNA, 17 bp, Homo sapiens
gccgacggagccactgg

SEQ ID NO: 2303951 - DNA, 12 bp, Homo sapiens
gccgagcccagg

SEQ ID NO: 2303952 - DNA, 12 bp, Homo sapiens
gccgagctctcc

SEQ ID NO: 2303953 - DNA, 18 bp, Homo sapiens
gccgagctctcctgggcc

SEQ ID NO: 2303954 - DNA, 24 bp, Homo sapiens
gccgatctggtctcgtgttcgctg

SEQ ID NO: 2303955 - DNA, 13 bp, Homo sapiens
gccgcaccctggc

SEQ ID NO: 2303956 - DNA, 14 bp, Homo sapiens
gccgcaccctggct

SEQ ID NO: 2303957 - DNA, 15 bp, Homo sapiens
gccgcaccctggctg

SEQ ID NO: 2303958 - DNA, 16 bp, Homo sapiens
gccgcaccctggctgg

SEQ ID NO: 2303959 - DNA, 13 bp, Homo sapiens
gccgcagggcgct

SEQ ID NO: 2303960 - DNA, 19 bp, Homo sapiens
gccgcagggcgctccggca

SEQ ID NO: 2303961 - DNA, 17 bp, Homo sapiens
gccgcctcctccagact

SEQ ID NO: 2303962 - DNA, 13 bp, Homo sapiens
gccgcctcgggcc

SEQ ID NO: 2303963 - DNA, 24 bp, Homo sapiens
gccgcctcgggccgcctcctccag

SEQ ID NO: 2303964 - DNA, 13 bp, Homo sapiens
gccgcgcaccgcc

SEQ ID NO: 2303965 - DNA, 18 bp, Homo sapiens
gccgcgctctgcccctcc

SEQ ID NO: 2303966 - DNA, 23 bp, Homo sapiens
gccgcgggcgagaagggcgcagg

SEQ ID NO: 2303967 - DNA, 24 bp, Homo sapiens
gccgcgggcgagaagggcgcagga

SEQ ID NO: 2303968 - DNA, 20 bp, Homo sapiens
gccgctgcccccaccctgct

SEQ ID NO: 2303969 - DNA, 22 bp, Homo sapiens
gccgctgcccccaccctgcttc

SEQ ID NO: 2303970 - DNA, 20 bp, Homo sapiens
gccgctgcttgagtggacag

SEQ ID NO: 2303971 - DNA, 21 bp, Homo sapiens
gccgctgcttgagtggacagc

SEQ ID NO: 2303972 - DNA, 16 bp, Homo sapiens
gccgctgtgtccccgc

SEQ ID NO: 2303973 - DNA, 14 bp, Homo sapiens
gccggcgccccgga

SEQ ID NO: 2303974 - DNA, 15 bp, Homo sapiens
gccggcgccccggac

SEQ ID NO: 2303975 - DNA, 12 bp, Homo sapiens
gccggctggccg

SEQ ID NO: 2303976 - DNA, 18 bp, Homo sapiens
gccgggctggcttctccc

SEQ ID NO: 2303977 - DNA, 14 bp, Homo sapiens
gccggggctggccc

SEQ ID NO: 2303978 - DNA, 17 bp, Homo sapiens
gccgtccctgacttccc

SEQ ID NO: 2303979 - DNA, 20 bp, Homo sapiens
gcctagaacaagccagagcc

SEQ ID NO: 2303980 - DNA, 13 bp, Homo sapiens
gctgtcattttat

SEQ ID NO: 2303981 - DNA, 13 bp, Homo sapiens
gctgtgcgggcgc

SEQ ID NO: 2303982 - DNA, 19 bp, Homo sapiens
gctgtgcgggcgcccggac

SEQ ID NO: 2303983 - DNA, 23 bp, Homo sapiens
gctgtgcgggcgcccggactgac

SEQ ID NO: 2303984 - DNA, 23 bp, Homo sapiens
gctgtggtttctcgtactttcac

SEQ ID NO: 2303985 - DNA, 17 bp, Homo sapiens
gctgtgtttcaaacctg

SEQ ID NO: 2303986 - DNA, 12 bp, Homo sapiens
gctgttgcttga

SEQ ID NO: 2303987 - DNA, 19 bp, Homo sapiens
gctgttttatgtcatactc

SEQ ID NO: 2303988 - DNA, 22 bp, Homo sapiens
gcttaacataaacttgtactta

SEQ ID NO: 2303989 - DNA, 18 bp, Homo sapiens
gcttaaggaaaagagaaa

SEQ ID NO: 2303990 - DNA, 19 bp, Homo sapiens
gcttaaggaaaagagaaac

SEQ ID NO: 2303991 - DNA, 17 bp, Homo sapiens
gcttagctgaaacctaa

SEQ ID NO: 2303992 - DNA, 16 bp, Homo sapiens
gcttaggccagtcagt

SEQ ID NO: 2303993 - DNA, 14 bp, Homo sapiens
gcttatgtttttgt

SEQ ID NO: 2303994 - DNA, 13 bp, Homo sapiens
gcttatttatatt

SEQ ID NO: 2303995 - DNA, 17 bp, Homo sapiens
gcttcaactacttctct

SEQ ID NO: 2303996 - DNA, 14 bp, Homo sapiens
gcttcaaggatcct

SEQ ID NO: 2303997 - DNA, 18 bp, Homo sapiens
gcttcaaggatcctgagc

SEQ ID NO: 2303998 - DNA, 20 bp, Homo sapiens
gcttcagacacgcacttctg

SEQ ID NO: 2303999 - DNA, 17 bp, Homo sapiens
gcttcagcccctggggt

SEQ ID NO: 2304000 - DNA, 19 bp, Homo sapiens
gcttcagcccctggggtac

SEQ ID NO: 2304001 - DNA, 16 bp, Homo sapiens
gcttcattgtttgatt

SEQ ID NO: 2304002 - DNA, 13 bp, Homo sapiens
gcttccagctcag

SEQ ID NO: 2304003 - DNA, 14 bp, Homo sapiens
gcttccagctcagt

SEQ ID NO: 2304004 - DNA, 23 bp, Homo sapiens
gcttccagctcagtcccacagcc

SEQ ID NO: 2304005 - DNA, 21 bp, Homo sapiens
gcttcccacagcctcttcctc

SEQ ID NO: 2304006 - DNA, 12 bp, Homo sapiens
gcttcctccggc

SEQ ID NO: 2304007 - DNA, 20 bp, Homo sapiens
gcttcctccggctggacctg

SEQ ID NO: 2304008 - DNA, 22 bp, Homo sapiens
gcttccttttcagcatggtttg

SEQ ID NO: 2304009 - DNA, 15 bp, Homo sapiens
gcttcgtctcagaag

SEQ ID NO: 2304010 - DNA, 16 bp, Homo sapiens
gcttcgtctcagaagg

SEQ ID NO: 2304011 - DNA, 20 bp, Homo sapiens
gcttctccctggactctgtg

SEQ ID NO: 2304012 - DNA, 14 bp, Homo sapiens
gcttctgctgcctg

SEQ ID NO: 2304013 - DNA, 23 bp, Homo sapiens
gcttgaacccaggtggcggaggt

SEQ ID NO: 2304014 - DNA, 16 bp, Homo sapiens
gcttggagcagagacg

SEQ ID NO: 2304015 - DNA, 22 bp, Homo sapiens
gcttggagcagagacggcagcc

SEQ ID NO: 2304016 - DNA, 15 bp, Homo sapiens
gcttggcttatgaaa

SEQ ID NO: 2304017 - DNA, 16 bp, Homo sapiens
gcttgtacctctggct

SEQ ID NO: 2304018 - DNA, 15 bp, Homo sapiens
gctttaaataaaaga

SEQ ID NO: 2304019 - DNA, 15 bp, Homo sapiens
gctttaacattttgt

SEQ ID NO: 2304020 - DNA, 23 bp, Homo sapiens
gctttactttgtggatatattta

SEQ ID NO: 2304021 - DNA, 14 bp, Homo sapiens
gctttagattgaaa

SEQ ID NO: 2304022 - DNA, 20 bp, Homo sapiens
gctttagattgaaatttatg

SEQ ID NO: 2304023 - DNA, 19 bp, Homo sapiens
gctttcatgttgcaaagaa

SEQ ID NO: 2304024 - DNA, 17 bp, Homo sapiens
gctttcctgtttccagg

SEQ ID NO: 2304025 - DNA, 13 bp, Homo sapiens
gctttctcatgca

SEQ ID NO: 2304026 - DNA, 17 bp, Homo sapiens
gctttctcatgcataga

SEQ ID NO: 2304027 - DNA, 16 bp, Homo sapiens
gctttcttcatgttca

SEQ ID NO: 2304028 - DNA, 18 bp, Homo sapiens
gctttgaatgcatgtgtg

SEQ ID NO: 2304029 - DNA, 18 bp, Homo sapiens
gctttgcggcatctccat

SEQ ID NO: 2304030 - DNA, 22 bp, Homo sapiens
gctttgcggcatctccatttca

SEQ ID NO: 2304031 - DNA, 21 bp, Homo sapiens
gctttgtttaacccaaaagat

SEQ ID NO: 2304032 - DNA, 19 bp, Homo sapiens
gcttttattgagtaatatt

SEQ ID NO: 2304033 - DNA, 20 bp, Homo sapiens
gctttttaaactgatgtata

SEQ ID NO: 2304034 - DNA, 19 bp, Homo sapiens
ggaaaacataatatcttga

SEQ ID NO: 2304035 - DNA, 21 bp, Homo sapiens
ggaaaatagtcctccaaaaca

SEQ ID NO: 2304036 - DNA, 19 bp, Homo sapiens
ggaaacagacctttttctc

SEQ ID NO: 2304037 - DNA, 19 bp, Homo sapiens
ggaaagcagtcagcggaga

SEQ ID NO: 2304038 - DNA, 21 bp, Homo sapiens
ggaaagcagtcagcggagagg

SEQ ID NO: 2304039 - DNA, 21 bp, Homo sapiens
ggaacaaggcaaggctgtcaa

SEQ ID NO: 2304040 - DNA, 17 bp, Homo sapiens
ggaacacccagccccag

SEQ ID NO: 2304041 - DNA, 12 bp, Homo sapiens
ggaacactctga

SEQ ID NO: 2304042 - DNA, 15 bp, Homo sapiens
ggaacactctgagac

SEQ ID NO: 2304043 - DNA, 19 bp, Homo sapiens
ggaaccctctggggccctt

SEQ ID NO: 2304044 - DNA, 20 bp, Homo sapiens
ggaaccctctggggcccttt

SEQ ID NO: 2304045 - DNA, 13 bp, Homo sapiens
ggaaccgaggact

SEQ ID NO: 2304046 - DNA, 14 bp, Homo sapiens
ggaaccgaggactc

SEQ ID NO: 2304047 - DNA, 19 bp, Homo sapiens
ggaaccgaggactccaggg

SEQ ID NO: 2304048 - DNA, 22 bp, Homo sapiens
ggaagaaagtaggagtggctga

SEQ ID NO: 2304049 - DNA, 17 bp, Homo sapiens
ggaagaataaaaaagaa

SEQ ID NO: 2304050 - DNA, 13 bp, Homo sapiens
ggaagacagagat

SEQ ID NO: 2304051 - DNA, 17 bp, Homo sapiens
ggaagacagagatggca

SEQ ID NO: 2304052 - DNA, 22 bp, Homo sapiens
ggaagacagagatggcagagcc

SEQ ID NO: 2304053 - DNA, 23 bp, Homo sapiens
ggaagacagagatggcagagcca

SEQ ID NO: 2304054 - DNA, 14 bp, Homo sapiens
ggaagagccagccg

SEQ ID NO: 2304055 - DNA, 22 bp, Homo sapiens
ggaagcattactttgtagatgt

SEQ ID NO: 2304056 - DNA, 23 bp, Homo sapiens
ggaagcattagttggagctagaa

SEQ ID NO: 2304057 - DNA, 23 bp, Homo sapiens
ggaagcccacccgccccagagac

SEQ ID NO: 2304058 - DNA, 13 bp, Homo sapiens
ggaaggcctgagg

SEQ ID NO: 2304059 - DNA, 15 bp, Homo sapiens
ggaaggcctgaggga

SEQ ID NO: 2304060 - DNA, 19 bp, Homo sapiens
ggaaggcctgagggaagcc

SEQ ID NO: 2304061 - DNA, 14 bp, Homo sapiens
ggaaggggacagga

SEQ ID NO: 2304062 - DNA, 16 bp, Homo sapiens
ggaagggtgggccctg

SEQ ID NO: 2304063 - DNA, 18 bp, Homo sapiens
ggaagggtgggccctgga

SEQ ID NO: 2304064 - DNA, 17 bp, Homo sapiens
ggaagtacataaagtaa

SEQ ID NO: 2304065 - DNA, 12 bp, Homo sapiens
ggaagtactgga

SEQ ID NO: 2304066 - DNA, 19 bp, Homo sapiens
ggaatccatatcagctctg

SEQ ID NO: 2304067 - DNA, 12 bp, Homo sapiens
ggaatgttgtta

SEQ ID NO: 2304068 - DNA, 21 bp, Homo sapiens
ggacaaggggtggaagggcag

SEQ ID NO: 2304069 - DNA, 17 bp, Homo sapiens
ggacacggaccctgtgt

SEQ ID NO: 2304070 - DNA, 14 bp, Homo sapiens
ggacacggcctctg

SEQ ID NO: 2304071 - DNA, 16 bp, Homo sapiens
ggacacggcctctggg

SEQ ID NO: 2304072 - DNA, 21 bp, Homo sapiens
ggacacggcctctggggagac

SEQ ID NO: 2304073 - DNA, 22 bp, Homo sapiens
ggacactgatgggtcctgctgc

SEQ ID NO: 2304074 - DNA, 20 bp, Homo sapiens
ggacagattcagtcttgcct

SEQ ID NO: 2304075 - DNA, 16 bp, Homo sapiens
ggacaggaacacccag

SEQ ID NO: 2304076 - DNA, 22 bp, Homo sapiens
ggacaggattgtctgctgcctc

SEQ ID NO: 2304077 - DNA, 17 bp, Homo sapiens
ggacaggccagtagggg

SEQ ID NO: 2304078 - DNA, 18 bp, Homo sapiens
ggaccactgtttcttgct

SEQ ID NO: 2304079 - DNA, 15 bp, Homo sapiens
ggaccagcacactcc

SEQ ID NO: 2304080 - DNA, 11 bp, Homo sapiens
ggacccagctg

SEQ ID NO: 2304081 - DNA, 20 bp, Homo sapiens
ggaccccatctgctgagctc

SEQ ID NO: 2304082 - DNA, 19 bp, Homo sapiens
ggaccctcggggcaggaag

SEQ ID NO: 2304083 - DNA, 16 bp, Homo sapiens
ggaccggagcggctga

SEQ ID NO: 2304084 - DNA, 17 bp, Homo sapiens
ggaccggagcggctgag

SEQ ID NO: 2304085 - DNA, 13 bp, Homo sapiens
ggacctccacctg

SEQ ID NO: 2304086 - DNA, 18 bp, Homo sapiens
ggacctccacctgggaga

SEQ ID NO: 2304087 - DNA, 23 bp, Homo sapiens
ggacctgcgcaaagggcgggcct

SEQ ID NO: 2304088 - DNA, 20 bp, Homo sapiens
ggacctggggtcccccctcc

SEQ ID NO: 2304089 - DNA, 22 bp, Homo sapiens
ggacgagtgagctaccaggaag

SEQ ID NO: 2304090 - DNA, 23 bp, Homo sapiens
ggacgagtgagctaccaggaaga

SEQ ID NO: 2304091 - DNA, 17 bp, Homo sapiens
ggacgcagggagaccct

SEQ ID NO: 2304092 - DNA, 23 bp, Homo sapiens
ggacgggacagcggcccggccca

SEQ ID NO: 2304093 - DNA, 19 bp, Homo sapiens
ggacggggcccgccccagg

SEQ ID NO: 2304094 - DNA, 20 bp, Homo sapiens
ggactcagttcttggcctgc

SEQ ID NO: 2304095 - DNA, 21 bp, Homo sapiens
ggactcagttcttggcctgct

SEQ ID NO: 2304096 - DNA, 22 bp, Homo sapiens
ggactcagttcttggcctgcta

SEQ ID NO: 2304097 - DNA, 13 bp, Homo sapiens
ggactccaggggc

SEQ ID NO: 2304098 - DNA, 13 bp, Homo sapiens
ggactctgccttc

SEQ ID NO: 2304099 - DNA, 17 bp, Homo sapiens
ggactctgccttccagg

SEQ ID NO: 2304100 - DNA, 19 bp, Homo sapiens
ggactctgccttccaggcg

SEQ ID NO: 2304101 - DNA, 13 bp, Homo sapiens
ggactctgtgggg

SEQ ID NO: 2304102 - DNA, 20 bp, Homo sapiens
ggactgtcttcaaccctgcc

SEQ ID NO: 2304103 - DNA, 22 bp, Homo sapiens
ggactgtcttcaaccctgccct

SEQ ID NO: 2304104 - DNA, 22 bp, Homo sapiens
ggactgtggcctcaggaggcag

SEQ ID NO: 2304105 - DNA, 22 bp, Homo sapiens
ggacttcgggggcggctctggg

SEQ ID NO: 2304106 - DNA, 19 bp, Homo sapiens
ggagaaaatggacgtgtta

SEQ ID NO: 2304107 - DNA, 14 bp, Homo sapiens
ggagaaacctcgga

SEQ ID NO: 2304108 - DNA, 17 bp, Homo sapiens
ggagacagtcaggaagc

SEQ ID NO: 2304109 - DNA, 21 bp, Homo sapiens
ggagaccccttggggagcagg

SEQ ID NO: 2304110 - DNA, 14 bp, Homo sapiens
ggagaccctgggag

SEQ ID NO: 2304111 - DNA, 18 bp, Homo sapiens
ggtcctgcctaaatttca

SEQ ID NO: 2304112 - DNA, 20 bp, Homo sapiens
ggtcctgctgctcgggaagg

SEQ ID NO: 2304113 - DNA, 13 bp, Homo sapiens
ggtcctgtgcccc

SEQ ID NO: 2304114 - DNA, 14 bp, Homo sapiens
ggtcctgtgccccg

SEQ ID NO: 2304115 - DNA, 15 bp, Homo sapiens
ggtcctgtgccccga

SEQ ID NO: 2304116 - DNA, 14 bp, Homo sapiens
ggtcgaggtgggcg

SEQ ID NO: 2304117 - DNA, 13 bp, Homo sapiens
ggtcgcccctcct

SEQ ID NO: 2304118 - DNA, 22 bp, Homo sapiens
ggtcgggggaggagcaccccca

SEQ ID NO: 2304119 - DNA, 21 bp, Homo sapiens
ggtctacactgcaatcatatg

SEQ ID NO: 2304120 - DNA, 20 bp, Homo sapiens
ggtctattttataagggcac

SEQ ID NO: 2304121 - DNA, 19 bp, Homo sapiens
ggtctcactctgttgacca

SEQ ID NO: 2304122 - DNA, 12 bp, Homo sapiens
ggtctctgagca

SEQ ID NO: 2304123 - DNA, 23 bp, Homo sapiens
ggtctcttccagcccagacatcc

SEQ ID NO: 2304124 - DNA, 13 bp, Homo sapiens
ggtgcaatgacct

SEQ ID NO: 2304125 - DNA, 18 bp, Homo sapiens
ggtgcaatgacctttcaa

SEQ ID NO: 2304126 - DNA, 12 bp, Homo sapiens
ggtgcaggcgcg

SEQ ID NO: 2304127 - DNA, 14 bp, Homo sapiens
ggtgcattgtcctt

SEQ ID NO: 2304128 - DNA, 19 bp, Homo sapiens
ggtgccgcgggcgagaagg

SEQ ID NO: 2304129 - DNA, 13 bp, Homo sapiens
ggtgcctgtgacc

SEQ ID NO: 2304130 - DNA, 16 bp, Homo sapiens
ggtgcctttgagttct

SEQ ID NO: 2304131 - DNA, 18 bp, Homo sapiens
ggtgcggaccggagcggc

SEQ ID NO: 2304132 - DNA, 13 bp, Homo sapiens
ggtggaagggcag

SEQ ID NO: 2304133 - DNA, 23 bp, Homo sapiens
ggtggccactcctgggccccaga

SEQ ID NO: 2304134 - DNA, 14 bp, Homo sapiens
ggtggccagggctc

SEQ ID NO: 2304135 - DNA, 16 bp, Homo sapiens
ggtgggagggggcagg

SEQ ID NO: 2304136 - DNA, 16 bp, Homo sapiens
ggtgggccccacagtg

SEQ ID NO: 2304137 - DNA, 13 bp, Homo sapiens
ggtgggccctgga

SEQ ID NO: 2304138 - DNA, 15 bp, Homo sapiens
ggtgggccctggagg

SEQ ID NO: 2304139 - DNA, 21 bp, Homo sapiens
ggtgggggcagcggccccgca

SEQ ID NO: 2304140 - DNA, 15 bp, Homo sapiens
ggtggtcaccaggtc

SEQ ID NO: 2304141 - DNA, 13 bp, Homo sapiens
ggtggtgcacacc

SEQ ID NO: 2304142 - DNA, 10 bp, Homo sapiens
ggtgtaaata

SEQ ID NO: 2304143 - DNA, 17 bp, Homo sapiens
ggtgtcccctggtgccc

SEQ ID NO: 2304144 - DNA, 13 bp, Homo sapiens
ggtgtcgggcatg

SEQ ID NO: 2304145 - DNA, 16 bp, Homo sapiens
ggtgtgagccacagca

SEQ ID NO: 2304146 - DNA, 21 bp, Homo sapiens
ggtgtggctcgggtgcccagg

SEQ ID NO: 2304147 - DNA, 15 bp, Homo sapiens
ggtgtgtccacagag

SEQ ID NO: 2304148 - DNA, 19 bp, Homo sapiens
ggttcccccaggaccctga

SEQ ID NO: 2304149 - DNA, 20 bp, Homo sapiens
ggttccttttgaagctcaac

SEQ ID NO: 2304150 - DNA, 19 bp, Homo sapiens
ggttctaggctaccagaag

SEQ ID NO: 2304151 - DNA, 21 bp, Homo sapiens
ggttgtctcagccgagcccag

SEQ ID NO: 2304152 - DNA, 16 bp, Homo sapiens
ggtttccacacaggcc

SEQ ID NO: 2304153 - DNA, 14 bp, Homo sapiens
ggtttgggcagagc

SEQ ID NO: 2304154 - DNA, 23 bp, Homo sapiens
gtaaaaaatttaaaaagcccaac

SEQ ID NO: 2304155 - DNA, 20 bp, Homo sapiens
gtaaacagaagcctgtttca

SEQ ID NO: 2304156 - DNA, 13 bp, Homo sapiens
gtaaatatagtag

SEQ ID NO: 2304157 - DNA, 22 bp, Homo sapiens
gtaaatatttcaataacttaga

SEQ ID NO: 2304158 - DNA, 15 bp, Homo sapiens
gtaaatgtggacaca

SEQ ID NO: 2304159 - DNA, 14 bp, Homo sapiens
gtaaattcctgttg

SEQ ID NO: 2304160 - DNA, 19 bp, Homo sapiens
gtaaattttataatgtcat

SEQ ID NO: 2304161 - DNA, 16 bp, Homo sapiens
gtaacagctaatcttt

SEQ ID NO: 2304162 - DNA, 18 bp, Homo sapiens
gtaacatgtctaaagtta

SEQ ID NO: 2304163 - DNA, 20 bp, Homo sapiens
gtaactgttctttgcagtga

SEQ ID NO: 2304164 - DNA, 16 bp, Homo sapiens
gtaagaggtactaaaa

SEQ ID NO: 2304165 - DNA, 15 bp, Homo sapiens
gtaagggctttaaat

SEQ ID NO: 2304166 - DNA, 21 bp, Homo sapiens
gtaagggctttaaataaaaga

SEQ ID NO: 2304167 - DNA, 15 bp, Homo sapiens
gtaagttctgaaaac

SEQ ID NO: 2304168 - DNA, 22 bp, Homo sapiens
gtaagttctgaaaactgtttat

SEQ ID NO: 2304169 - DNA, 18 bp, Homo sapiens
gtaagttgaagggaaatc

SEQ ID NO: 2304170 - DNA, 20 bp, Homo sapiens
gtaagttgaagggaaatcaa

SEQ ID NO: 2304171 - DNA, 17 bp, Homo sapiens
gtaatattacatttcat

SEQ ID NO: 2304172 - DNA, 20 bp, Homo sapiens
gtaatattacatttcattta

SEQ ID NO: 2304173 - DNA, 20 bp, Homo sapiens
gtaatcatttatcttatcta

SEQ ID NO: 2304174 - DNA, 14 bp, Homo sapiens
gtaatctctgatta

SEQ ID NO: 2304175 - DNA, 18 bp, Homo sapiens
gtaatgcactcctgcccc

SEQ ID NO: 2304176 - DNA, 14 bp, Homo sapiens
gtaatggcagagca

SEQ ID NO: 2304177 - DNA, 20 bp, Homo sapiens
gtaatgtatcttatttatat

SEQ ID NO: 2304178 - DNA, 14 bp, Homo sapiens
gtaattacattaaa

SEQ ID NO: 2304179 - DNA, 21 bp, Homo sapiens
gtaattttgtagtagttgatg

SEQ ID NO: 2304180 - DNA, 20 bp, Homo sapiens
gtacagttatacatacctct

SEQ ID NO: 2304181 - DNA, 16 bp, Homo sapiens
gtacataaagtaataa

SEQ ID NO: 2304182 - DNA, 21 bp, Homo sapiens
gtacatatggaaatcctgtta

SEQ ID NO: 2304183 - DNA, 16 bp, Homo sapiens
gtaccaagatcacaaa

SEQ ID NO: 2304184 - DNA, 18 bp, Homo sapiens
gtaccaagatcacaaata

SEQ ID NO: 2304185 - DNA, 19 bp, Homo sapiens
gtaccaagatcacaaatag

SEQ ID NO: 2304186 - DNA, 15 bp, Homo sapiens
gtaccatcccactga

SEQ ID NO: 2304187 - DNA, 16 bp, Homo sapiens
gtaccatgttaaagag

SEQ ID NO: 2304188 - DNA, 17 bp, Homo sapiens
gtaccatgttaaagagg

SEQ ID NO: 2304189 - DNA, 20 bp, Homo sapiens
gtacccaaccaaagatgctt

SEQ ID NO: 2304190 - DNA, 21 bp, Homo sapiens
gtaccctaccctgcacattgt

SEQ ID NO: 2304191 - DNA, 14 bp, Homo sapiens
gtacctctggctga

SEQ ID NO: 2304192 - DNA, 14 bp, Homo sapiens
gtactaaaaacact

SEQ ID NO: 2304193 - DNA, 15 bp, Homo sapiens
gtactaaaaacactg

SEQ ID NO: 2304194 - DNA, 13 bp, Homo sapiens
gtactagtactgt

SEQ ID NO: 2304195 - DNA, 16 bp, Homo sapiens
gtactagtactgtgta

SEQ ID NO: 2304196 - DNA, 17 bp, Homo sapiens
gtactagtactgtgtac

SEQ ID NO: 2304197 - DNA, 19 bp, Homo sapiens
gtactagtactgtgtactg

SEQ ID NO: 2304198 - DNA, 16 bp, Homo sapiens
gtactggagaaaatgg

SEQ ID NO: 2304199 - DNA, 16 bp, Homo sapiens
gtactgtatagacagt

SEQ ID NO: 2304200 - DNA, 14 bp, Homo sapiens
gtactttcacatct

SEQ ID NO: 2304201 - DNA, 23 bp, Homo sapiens
gtagagacagggtctcactgtgt

SEQ ID NO: 2304202 - DNA, 22 bp, Homo sapiens
gtagatattatgtatagaaaat

SEQ ID NO: 2304203 - DNA, 23 bp, Homo sapiens
gtagcaatatatttgtaggtata

SEQ ID NO: 2304204 - DNA, 15 bp, Homo sapiens
gtagcattaaatata

SEQ ID NO: 2304205 - DNA, 21 bp, Homo sapiens
gtagctagaatatcctatact

SEQ ID NO: 2304206 - DNA, 17 bp, Homo sapiens
gtagctgtggggagctg

SEQ ID NO: 2304207 - DNA, 11 bp, Homo sapiens
gtaggagtggc

SEQ ID NO: 2304208 - DNA, 23 bp, Homo sapiens
gtaggagtggctgaccaggccct

SEQ ID NO: 2304209 - DNA, 15 bp, Homo sapiens
gtaggctaaaaacat

SEQ ID NO: 2304210 - DNA, 22 bp, Homo sapiens
gtaggctaaaaacattttaaaa

SEQ ID NO: 2304211 - DNA, 22 bp, Homo sapiens
gtaggctgtattttcttttata

SEQ ID NO: 2304212 - DNA, 19 bp, Homo sapiens
gtagtagttgatgaccaat

SEQ ID NO: 2304213 - DNA, 13 bp, Homo sapiens
gtagtgttgggtg

SEQ ID NO: 2304214 - DNA, 17 bp, Homo sapiens
gtagtgttgggtggagg

SEQ ID NO: 2304215 - DNA, 18 bp, Homo sapiens
gtagttgatgaccaatct

SEQ ID NO: 2304216 - DNA, 17 bp, Homo sapiens
gtagttgctttgcggca

SEQ ID NO: 2304217 - DNA, 19 bp, Homo sapiens
gtataacaagccaaacatt

SEQ ID NO: 2304218 - DNA, 22 bp, Homo sapiens
gtataacaagccaaacattctt

SEQ ID NO: 2304219 - DNA, 13 bp, Homo sapiens
gtatactatgtaa

SEQ ID NO: 2304220 - DNA, 11 bp, Homo sapiens
gtatagaaaat

SEQ ID NO: 2304221 - DNA, 14 bp, Homo sapiens
gtatagaaaataaa

SEQ ID NO: 2304222 - DNA, 22 bp, Homo sapiens
gtatagacagtttgtaaatgtt

SEQ ID NO: 2304223 - DNA, 20 bp, Homo sapiens
gtatagttcacttactctta

SEQ ID NO: 2304224 - DNA, 15 bp, Homo sapiens
gtatatatgtacagt

SEQ ID NO: 2304225 - DNA, 22 bp, Homo sapiens
gtatatcagctctaaagcagag

SEQ ID NO: 2304226 - DNA, 19 bp, Homo sapiens
gtatatgtcaaaaatattt

SEQ ID NO: 2304227 - DNA, 12 bp, Homo sapiens
gtatccagaggt

SEQ ID NO: 2304228 - DNA, 19 bp, Homo sapiens
gtatcctggcaaataatac

SEQ ID NO: 2304229 - DNA, 17 bp, Homo sapiens
gtatctaaaaaataact

SEQ ID NO: 2304230 - DNA, 19 bp, Homo sapiens
gtatctaaaaaataactgt

SEQ ID NO: 2304231 - DNA, 18 bp, Homo sapiens
gtatctctactttcctga

SEQ ID NO: 2304232 - DNA, 19 bp, Homo sapiens
gtatctgctgcctctgaaa

SEQ ID NO: 2304233 - DNA, 13 bp, Homo sapiens
gtatctgttactc

SEQ ID NO: 2304234 - DNA, 21 bp, Homo sapiens
gtatctgtttacatccagagt

SEQ ID NO: 2304235 - DNA, 14 bp, Homo sapiens
gtatcttatttata

SEQ ID NO: 2304236 - DNA, 15 bp, Homo sapiens
gtatcttatttatat

SEQ ID NO: 2304237 - DNA, 21 bp, Homo sapiens
gtatgtccagaacaaaagata

SEQ ID NO: 2304238 - DNA, 18 bp, Homo sapiens
gtattcaggaccccatct

SEQ ID NO: 2304239 - DNA, 19 bp, Homo sapiens
gtattctgtggattctata

SEQ ID NO: 2304240 - DNA, 21 bp, Homo sapiens
gtattctgtggattctatatt

SEQ ID NO: 2304241 - DNA, 12 bp, Homo sapiens
gtattcttttat

SEQ ID NO: 2304242 - DNA, 23 bp, Homo sapiens
gtattgacgacctacatctgaaa

SEQ ID NO: 2304243 - DNA, 22 bp, Homo sapiens
taaagagttctccttgtacttg

SEQ ID NO: 2304244 - DNA, 19 bp, Homo sapiens
taaagggagccatgctctt

SEQ ID NO: 2304245 - DNA, 21 bp, Homo sapiens
taaagggctatgcctccattt

SEQ ID NO: 2304246 - DNA, 15 bp, Homo sapiens
taaagtgaccaggct

SEQ ID NO: 2304247 - DNA, 19 bp, Homo sapiens
taaagttagaatctatttt

SEQ ID NO: 2304248 - DNA, 20 bp, Homo sapiens
taaagttagaatctattttc

SEQ ID NO: 2304249 - DNA, 22 bp, Homo sapiens
taaagttagggcatttttcttg

SEQ ID NO: 2304250 - DNA, 14 bp, Homo sapiens
taaataaaaataat

SEQ ID NO: 2304251 - DNA, 15 bp, Homo sapiens
taaataaaaataatt

SEQ ID NO: 2304252 - DNA, 22 bp, Homo sapiens
taaataaaagaggtccattaat

SEQ ID NO: 2304253 - DNA, 12 bp, Homo sapiens
taaatagtaaat

SEQ ID NO: 2304254 - DNA, 22 bp, Homo sapiens
taaatagtatccaactttgtag

SEQ ID NO: 2304255 - DNA, 14 bp, Homo sapiens
taaatagtttactt

SEQ ID NO: 2304256 - DNA, 22 bp, Homo sapiens
taaatagtttacttcactttca

SEQ ID NO: 2304257 - DNA, 16 bp, Homo sapiens
taaatatacagcatga

SEQ ID NO: 2304258 - DNA, 20 bp, Homo sapiens
taaatatatatatatttctc

SEQ ID NO: 2304259 - DNA, 16 bp, Homo sapiens
taaatatttatgcaga

SEQ ID NO: 2304260 - DNA, 18 bp, Homo sapiens
taaatccattttctaaac

SEQ ID NO: 2304261 - DNA, 21 bp, Homo sapiens
taaatccattttctaaactgt

SEQ ID NO: 2304262 - DNA, 15 bp, Homo sapiens
taaatcccacgacat

SEQ ID NO: 2304263 - DNA, 15 bp, Homo sapiens
taaatctaaatataa

SEQ ID NO: 2304264 - DNA, 17 bp, Homo sapiens
taaatctgtctgattct

SEQ ID NO: 2304265 - DNA, 17 bp, Homo sapiens
taaatctgttagcatta

SEQ ID NO: 2304266 - DNA, 20 bp, Homo sapiens
taaatctgttagcattattg

SEQ ID NO: 2304267 - DNA, 17 bp, Homo sapiens
taaatgcaaacactgtg

SEQ ID NO: 2304268 - DNA, 19 bp, Homo sapiens
taaatgctatggaaataca

SEQ ID NO: 2304269 - DNA, 15 bp, Homo sapiens
taaatgctttaaata

SEQ ID NO: 2304270 - DNA, 18 bp, Homo sapiens
taaatgtgcttcattgtt

SEQ ID NO: 2304271 - DNA, 21 bp, Homo sapiens
taaatgtgcttcattgtttga

SEQ ID NO: 2304272 - DNA, 16 bp, Homo sapiens
taaatgttatttctgc

SEQ ID NO: 2304273 - DNA, 14 bp, Homo sapiens
taaattataaatgt

SEQ ID NO: 2304274 - DNA, 16 bp, Homo sapiens
taaattataaatgttt

SEQ ID NO: 2304275 - DNA, 14 bp, Homo sapiens
taaattttaatgta

SEQ ID NO: 2304276 - DNA, 16 bp, Homo sapiens
taaattttaatgtaaa

SEQ ID NO: 2304277 - DNA, 17 bp, Homo sapiens
taaattttaatgtaaaa

SEQ ID NO: 2304278 - DNA, 17 bp, Homo sapiens
taacaacaacttaatgt

SEQ ID NO: 2304279 - DNA, 14 bp, Homo sapiens
taacagatatttaa

SEQ ID NO: 2304280 - DNA, 15 bp, Homo sapiens
taacagatatttaaa

SEQ ID NO: 2304281 - DNA, 21 bp, Homo sapiens
taacataaagaaacactttct

SEQ ID NO: 2304282 - DNA, 20 bp, Homo sapiens
taacatacatctaagtcagt

SEQ ID NO: 2304283 - DNA, 14 bp, Homo sapiens
taacatatatctta

SEQ ID NO: 2304284 - DNA, 23 bp, Homo sapiens
taacatattcttgctttcacaaa

SEQ ID NO: 2304285 - DNA, 18 bp, Homo sapiens
taacatgcgcattttgtg

SEQ ID NO: 2304286 - DNA, 15 bp, Homo sapiens
taacatggaagtact

SEQ ID NO: 2304287 - DNA, 16 bp, Homo sapiens
taacatggaagtacta

SEQ ID NO: 2304288 - DNA, 19 bp, Homo sapiens
taacattttgtttccaaag

SEQ ID NO: 2304289 - DNA, 15 bp, Homo sapiens
taaccaaattaacct

SEQ ID NO: 2304290 - DNA, 21 bp, Homo sapiens
taaccaagaatgtctccattg

SEQ ID NO: 2304291 - DNA, 20 bp, Homo sapiens
taacctcaatttatgttaac

SEQ ID NO: 2304292 - DNA, 23 bp, Homo sapiens
taacctcaatttatgttaacaga

SEQ ID NO: 2304293 - DNA, 22 bp, Homo sapiens
taacctttcaggaaagtatctc

SEQ ID NO: 2304294 - DNA, 16 bp, Homo sapiens
taacctttttgtcttt

SEQ ID NO: 2304295 - DNA, 17 bp, Homo sapiens
taactacattaaaagct

SEQ ID NO: 2304296 - DNA, 19 bp, Homo sapiens
taactacattaaaagcttt

SEQ ID NO: 2304297 - DNA, 14 bp, Homo sapiens
taactactaagaat

SEQ ID NO: 2304298 - DNA, 15 bp, Homo sapiens
taactactaagaata

SEQ ID NO: 2304299 - DNA, 13 bp, Homo sapiens
taactagatctcc

SEQ ID NO: 2304300 - DNA, 23 bp, Homo sapiens
taactgagtgtggcgggaagggt

SEQ ID NO: 2304301 - DNA, 17 bp, Homo sapiens
taactgcatatagataa

SEQ ID NO: 2304302 - DNA, 18 bp, Homo sapiens
taactgtccagtccagtg

SEQ ID NO: 2304303 - DNA, 15 bp, Homo sapiens
taactgtgcactata

SEQ ID NO: 2304304 - DNA, 18 bp, Homo sapiens
taactgttaacccagtgt

SEQ ID NO: 2304305 - DNA, 20 bp, Homo sapiens
taactgttaacccagtgttc

SEQ ID NO: 2304306 - DNA, 12 bp, Homo sapiens
taactgttcttt

SEQ ID NO: 2304307 - DNA, 15 bp, Homo sapiens
taactgttctttgca

SEQ ID NO: 2304308 - DNA, 16 bp, Homo sapiens
taactgttctttgcag

SEQ ID NO: 2304309 - DNA, 19 bp, Homo sapiens
taactgttctttgcagtga

SEQ ID NO: 2304310 - DNA, 21 bp, Homo sapiens
taactgttctttgcagtgaag

SEQ ID NO: 2304311 - DNA, 14 bp, Homo sapiens
taacttagaatgct

SEQ ID NO: 2304312 - DNA, 14 bp, Homo sapiens
taacttatctccag

SEQ ID NO: 2304313 - DNA, 18 bp, Homo sapiens
taagaaatgtatatgcta

SEQ ID NO: 2304314 - DNA, 14 bp, Homo sapiens
taagaacagaacag

SEQ ID NO: 2304315 - DNA, 22 bp, Homo sapiens
taagaaccttttgagtgcctta

SEQ ID NO: 2304316 - DNA, 19 bp, Homo sapiens
taagaacgtactttctgtt

SEQ ID NO: 2304317 - DNA, 12 bp, Homo sapiens
taagaactgtgg

SEQ ID NO: 2304318 - DNA, 15 bp, Homo sapiens
taagaagcgaacaaa

SEQ ID NO: 2304319 - DNA, 22 bp, Homo sapiens
taagacactagtagagcaaaga

SEQ ID NO: 2304320 - DNA, 18 bp, Homo sapiens
taagagacaaagtttgga

SEQ ID NO: 2304321 - DNA, 15 bp, Homo sapiens
taagaggtactaaaa

SEQ ID NO: 2304322 - DNA, 17 bp, Homo sapiens
taagatgctaatagaaa

SEQ ID NO: 2304323 - DNA, 18 bp, Homo sapiens
taagatgggcatagggtt

SEQ ID NO: 2304324 - DNA, 23 bp, Homo sapiens
taagatgggcatagggtttggaa

SEQ ID NO: 2304325 - DNA, 15 bp, Homo sapiens
taagattgtacatat

SEQ ID NO: 2304326 - DNA, 22 bp, Homo sapiens
taagattttatccctttctctt

SEQ ID NO: 2304327 - DNA, 19 bp, Homo sapiens
taagctggtatcagtggtt

SEQ ID NO: 2304328 - DNA, 14 bp, Homo sapiens
taaggaaaagagaa

SEQ ID NO: 2304329 - DNA, 17 bp, Homo sapiens
taaggaaaagagaaaca

SEQ ID NO: 2304330 - DNA, 23 bp, Homo sapiens
taaggaagaataaaaaagaagag

SEQ ID NO: 2304331 - DNA, 13 bp, Homo sapiens
taaggacaggatg

SEQ ID NO: 2304332 - DNA, 21 bp, Homo sapiens
taaggatggaaaggtgacagt

SEQ ID NO: 2304333 - DNA, 21 bp, Homo sapiens
taaggcaggtgggcagacagt

SEQ ID NO: 2304334 - DNA, 17 bp, Homo sapiens
taagggatccagagacc

SEQ ID NO: 2304335 - DNA, 16 bp, Homo sapiens
taagggctttaaataa

SEQ ID NO: 2304336 - DNA, 18 bp, Homo sapiens
taagggctttaaataaaa

SEQ ID NO: 2304337 - DNA, 23 bp, Homo sapiens
taaggggcaaaaaaaaaaattac

SEQ ID NO: 2304338 - DNA, 21 bp, Homo sapiens
taagtagactttaattcttct

SEQ ID NO: 2304339 - DNA, 17 bp, Homo sapiens
taagtcagtttcacata

SEQ ID NO: 2304340 - DNA, 21 bp, Homo sapiens
taagtcagtttcacatatttg

SEQ ID NO: 2304341 - DNA, 16 bp, Homo sapiens
taagtgctacataaat

SEQ ID NO: 2304342 - DNA, 17 bp, Homo sapiens
taagtggaagacagaga

SEQ ID NO: 2304343 - DNA, 17 bp, Homo sapiens
taagtgttgtaccatat

SEQ ID NO: 2304344 - DNA, 20 bp, Homo sapiens
taagttatgtgttaaattta

SEQ ID NO: 2304345 - DNA, 18 bp, Homo sapiens
taagttctgaaaactgtt

SEQ ID NO: 2304346 - DNA, 19 bp, Homo sapiens
taagttgaagggaaatcaa

SEQ ID NO: 2304347 - DNA, 22 bp, Homo sapiens
taagttggctcacatcatgtaa

SEQ ID NO: 2304348 - DNA, 22 bp, Homo sapiens
taagttgtattttaataaagat

SEQ ID NO: 2304349 - DNA, 24 bp, Homo sapiens
taagttgtattttaataaagattc

SEQ ID NO: 2304350 - DNA, 21 bp, Homo sapiens
taataacaacaacttaatgtg

SEQ ID NO: 2304351 - DNA, 23 bp, Homo sapiens
taataactgatgagatacatttg

SEQ ID NO: 2304352 - DNA, 16 bp, Homo sapiens
taatacttccttataa

SEQ ID NO: 2304353 - DNA, 18 bp, Homo sapiens
taatatactaaccatttc

SEQ ID NO: 2304354 - DNA, 17 bp, Homo sapiens
taatatagaaagaaaat

SEQ ID NO: 2304355 - DNA, 16 bp, Homo sapiens
taatatcctgaataac

SEQ ID NO: 2304356 - DNA, 14 bp, Homo sapiens
taatatcttgaaga

SEQ ID NO: 2304357 - DNA, 17 bp, Homo sapiens
taatattacatttcatt

SEQ ID NO: 2304358 - DNA, 21 bp, Homo sapiens
taatatttaggcatgagctct

SEQ ID NO: 2304359 - DNA, 17 bp, Homo sapiens
taatcaaatgattcatt

SEQ ID NO: 2304360 - DNA, 19 bp, Homo sapiens
taatcacctttccaaggcc

SEQ ID NO: 2304361 - DNA, 23 bp, Homo sapiens
taatcatttatcttatctagcaa

SEQ ID NO: 2304362 - DNA, 13 bp, Homo sapiens
taatctctaaaat

SEQ ID NO: 2304363 - DNA, 18 bp, Homo sapiens
taatctctaaaattctag

SEQ ID NO: 2304364 - DNA, 19 bp, Homo sapiens
taatctctaaaattctagt

SEQ ID NO: 2304365 - DNA, 15 bp, Homo sapiens
taatctttaatataa

SEQ ID NO: 2304366 - DNA, 13 bp, Homo sapiens
taatcttttctga

SEQ ID NO: 2304367 - DNA, 16 bp, Homo sapiens
taatgatcttccaaat

SEQ ID NO: 2304368 - DNA, 13 bp, Homo sapiens
taatgatggcaga

SEQ ID NO: 2304369 - DNA, 15 bp, Homo sapiens
taatgatggcagagg

SEQ ID NO: 2304370 - DNA, 20 bp, Homo sapiens
taatgatttaagcattttac

SEQ ID NO: 2304371 - DNA, 23 bp, Homo sapiens
taatgcttaacataaacttgtac

SEQ ID NO: 2304372 - DNA, 15 bp, Homo sapiens
taatggcagagcagt

SEQ ID NO: 2304373 - DNA, 14 bp, Homo sapiens
taatggtatctgtt

SEQ ID NO: 2304374 - DNA, 22 bp, Homo sapiens
tatttccaaatattctaaaaaa

SEQ ID NO: 2304375 - DNA, 13 bp, Homo sapiens
tatttccaacaaa

SEQ ID NO: 2304376 - DNA, 23 bp, Homo sapiens
tatttctaagcttatttctaact

SEQ ID NO: 2304377 - DNA, 15 bp, Homo sapiens
tatttgctaatacca

SEQ ID NO: 2304378 - DNA, 20 bp, Homo sapiens
tatttgctaataccaactat

SEQ ID NO: 2304379 - DNA, 18 bp, Homo sapiens
tatttggattcacagcct

SEQ ID NO: 2304380 - DNA, 21 bp, Homo sapiens
tatttgtagctagaatatcct

SEQ ID NO: 2304381 - DNA, 17 bp, Homo sapiens
tatttgtaggtatacta

SEQ ID NO: 2304382 - DNA, 14 bp, Homo sapiens
tatttgtctcagat

SEQ ID NO: 2304383 - DNA, 19 bp, Homo sapiens
tattttcccacaattcttt

SEQ ID NO: 2304384 - DNA, 17 bp, Homo sapiens
tattttcgtgcatttgt

SEQ ID NO: 2304385 - DNA, 19 bp, Homo sapiens
tattttcgtgcatttgtga

SEQ ID NO: 2304386 - DNA, 19 bp, Homo sapiens
tattttctatatttggatt

SEQ ID NO: 2304387 - DNA, 15 bp, Homo sapiens
tattttctatgtact

SEQ ID NO: 2304388 - DNA, 14 bp, Homo sapiens
tattttctccatgt

SEQ ID NO: 2304389 - DNA, 22 bp, Homo sapiens
tattttctgaattcataaaaat

SEQ ID NO: 2304390 - DNA, 19 bp, Homo sapiens
tattttcttcccatttgta

SEQ ID NO: 2304391 - DNA, 22 bp, Homo sapiens
tattttcttcccatttgtaatg

SEQ ID NO: 2304392 - DNA, 14 bp, Homo sapiens
tattttctttgaaa

SEQ ID NO: 2304393 - DNA, 18 bp, Homo sapiens
tattttctttgaaattca

SEQ ID NO: 2304394 - DNA, 19 bp, Homo sapiens
tattttctttgaaattcat

SEQ ID NO: 2304395 - DNA, 20 bp, Homo sapiens
tattttgtattattgctgtt

SEQ ID NO: 2304396 - DNA, 17 bp, Homo sapiens
tatttttgaagtctcct

SEQ ID NO: 2304397 - DNA, 15 bp, Homo sapiens
tatttttttctagct

SEQ ID NO: 2304398 - DNA, 14 bp, Homo sapiens
tcaaaaagctgcta

SEQ ID NO: 2304399 - DNA, 15 bp, Homo sapiens
tcaaaaagctgctat

SEQ ID NO: 2304400 - DNA, 12 bp, Homo sapiens
tcaaaaatattt

SEQ ID NO: 2304401 - DNA, 13 bp, Homo sapiens
tcaaaaatatttt

SEQ ID NO: 2304402 - DNA, 14 bp, Homo sapiens
tcaaaaatattttt

SEQ ID NO: 2304403 - DNA, 16 bp, Homo sapiens
tcaaaactttcagctg

SEQ ID NO: 2304404 - DNA, 19 bp, Homo sapiens
tcaaaataattagctatat

SEQ ID NO: 2304405 - DNA, 18 bp, Homo sapiens
tcaaaatgttaacaactt

SEQ ID NO: 2304406 - DNA, 15 bp, Homo sapiens
tcaaacactgcttaa

SEQ ID NO: 2304407 - DNA, 16 bp, Homo sapiens
tcaaacattgagactg

SEQ ID NO: 2304408 - DNA, 10 bp, Homo sapiens
tcaaacctgc

SEQ ID NO: 2304409 - DNA, 23 bp, Homo sapiens
tcaaacctgcaaggcaaagtaaa

SEQ ID NO: 2304410 - DNA, 16 bp, Homo sapiens
tcaaagacatttcatc

SEQ ID NO: 2304411 - DNA, 19 bp, Homo sapiens
tcaaagaggccagtacttt

SEQ ID NO: 2304412 - DNA, 20 bp, Homo sapiens
tcaaagaggccagtactttg

SEQ ID NO: 2304413 - DNA, 18 bp, Homo sapiens
tcaaagatacaagaaaaa

SEQ ID NO: 2304414 - DNA, 16 bp, Homo sapiens
tcaaatagcctttctt

SEQ ID NO: 2304415 - DNA, 12 bp, Homo sapiens
tcaaatcattca

SEQ ID NO: 2304416 - DNA, 16 bp, Homo sapiens
tcaaatcattcaaaac

SEQ ID NO: 2304417 - DNA, 22 bp, Homo sapiens
tcaaatgagtttaaaaaaataa

SEQ ID NO: 2304418 - DNA, 13 bp, Homo sapiens
tcaaatgctaaat

SEQ ID NO: 2304419 - DNA, 19 bp, Homo sapiens
tcaacacttattttctgaa

SEQ ID NO: 2304420 - DNA, 17 bp, Homo sapiens
tcaacagcatgtctact

SEQ ID NO: 2304421 - DNA, 21 bp, Homo sapiens
tcaacaggtcacttgatcatg

SEQ ID NO: 2304422 - DNA, 14 bp, Homo sapiens
tcaacatgcatatg

SEQ ID NO: 2304423 - DNA, 14 bp, Homo sapiens
tcaaccaagttaca

SEQ ID NO: 2304424 - DNA, 13 bp, Homo sapiens
tcaaccctgccct

SEQ ID NO: 2304425 - DNA, 14 bp, Homo sapiens
tcaaccctgccctg

SEQ ID NO: 2304426 - DNA, 16 bp, Homo sapiens
tcaactctgaatcaaa

SEQ ID NO: 2304427 - DNA, 19 bp, Homo sapiens
tcaactgatgatagacttc

SEQ ID NO: 2304428 - DNA, 20 bp, Homo sapiens
tcaactgcatcaagatgtga

SEQ ID NO: 2304429 - DNA, 22 bp, Homo sapiens
tcaactgctgttttatgtcata

SEQ ID NO: 2304430 - DNA, 22 bp, Homo sapiens
tcaactgtataccgtgtgctcc

SEQ ID NO: 2304431 - DNA, 14 bp, Homo sapiens
tcaacttttgaaat

SEQ ID NO: 2304432 - DNA, 21 bp, Homo sapiens
tcaagaccaaatggaaacaga

SEQ ID NO: 2304433 - DNA, 17 bp, Homo sapiens
tcaaggaagaataattt

SEQ ID NO: 2304434 - DNA, 18 bp, Homo sapiens
tcaaggaagagccagccg

SEQ ID NO: 2304435 - DNA, 14 bp, Homo sapiens
tcaaggatcctgag

SEQ ID NO: 2304436 - DNA, 15 bp, Homo sapiens
tcaaggatcctgagc

SEQ ID NO: 2304437 - DNA, 17 bp, Homo sapiens
tcaaggatcctgagcca

SEQ ID NO: 2304438 - DNA, 13 bp, Homo sapiens
tcaataggaaaaa

SEQ ID NO: 2304439 - DNA, 14 bp, Homo sapiens
tcaataggaaaaac

SEQ ID NO: 2304440 - DNA, 23 bp, Homo sapiens
tcaatagtacccaaccaaagatg

SEQ ID NO: 2304441 - DNA, 18 bp, Homo sapiens
tcaatatgcctgcaggag

SEQ ID NO: 2304442 - DNA, 17 bp, Homo sapiens
tcaatgaaatatttgct

SEQ ID NO: 2304443 - DNA, 21 bp, Homo sapiens
tcaatgaaatatttgcttatt

SEQ ID NO: 2304444 - DNA, 22 bp, Homo sapiens
tcaatgcatgatgactcttctt

SEQ ID NO: 2304445 - DNA, 19 bp, Homo sapiens
tcaatgcttttctagcaac

SEQ ID NO: 2304446 - DNA, 16 bp, Homo sapiens
tcaatgtactgtattg

SEQ ID NO: 2304447 - DNA, 14 bp, Homo sapiens
tcaatgtgaaataa

SEQ ID NO: 2304448 - DNA, 17 bp, Homo sapiens
tcaatgtgaaataaaga

SEQ ID NO: 2304449 - DNA, 13 bp, Homo sapiens
tcaattacaggaa

SEQ ID NO: 2304450 - DNA, 21 bp, Homo sapiens
tcaattacaggaagtactgga

SEQ ID NO: 2304451 - DNA, 17 bp, Homo sapiens
tcaattggacaattatt

SEQ ID NO: 2304452 - DNA, 17 bp, Homo sapiens
tcaatttaaaggaaagt

SEQ ID NO: 2304453 - DNA, 20 bp, Homo sapiens
tcaatttatgttaacagatg

SEQ ID NO: 2304454 - DNA, 23 bp, Homo sapiens
tcacaaaaggctggatgtgcttt

SEQ ID NO: 2304455 - DNA, 13 bp, Homo sapiens
tcacaaaatgcaa

SEQ ID NO: 2304456 - DNA, 22 bp, Homo sapiens
tcacaaatatagttgaacaaga

SEQ ID NO: 2304457 - DNA, 19 bp, Homo sapiens
tcacaactgtttttgaaga

SEQ ID NO: 2304458 - DNA, 21 bp, Homo sapiens
tcacactgtgcgttttagagt

SEQ ID NO: 2304459 - DNA, 22 bp, Homo sapiens
tcacactgtggaacactaaaga

SEQ ID NO: 2304460 - DNA, 20 bp, Homo sapiens
tcacactgtggtgtctcttg

SEQ ID NO: 2304461 - DNA, 15 bp, Homo sapiens
tcacagaatctccat

SEQ ID NO: 2304462 - DNA, 22 bp, Homo sapiens
tcacagagactgtttgaatctt

SEQ ID NO: 2304463 - DNA, 22 bp, Homo sapiens
tcacagaggcggttgtaagagg

SEQ ID NO: 2304464 - DNA, 13 bp, Homo sapiens
tcacatcatgtaa

SEQ ID NO: 2304465 - DNA, 22 bp, Homo sapiens
tcacatctgtatatcagctcta

SEQ ID NO: 2304466 - DNA, 13 bp, Homo sapiens
tcacatgctcctt

SEQ ID NO: 2304467 - DNA, 22 bp, Homo sapiens
tcaccacaacaaagtgcttcct

SEQ ID NO: 2304468 - DNA, 23 bp, Homo sapiens
tcaccacaacaaagtgcttcctt

SEQ ID NO: 2304469 - DNA, 12 bp, Homo sapiens
tcaccagccttg

SEQ ID NO: 2304470 - DNA, 12 bp, Homo sapiens
tcaccctgccac

SEQ ID NO: 2304471 - DNA, 16 bp, Homo sapiens
tcaccctgccaccctc

SEQ ID NO: 2304472 - DNA, 23 bp, Homo sapiens
tcaccctgccaccctctgctgca

SEQ ID NO: 2304473 - DNA, 14 bp, Homo sapiens
tcaccgaaaacgtg

SEQ ID NO: 2304474 - DNA, 15 bp, Homo sapiens
tcaccgaaaacgtgg

SEQ ID NO: 2304475 - DNA, 20 bp, Homo sapiens
tcaccgaaaacgtggctgct

SEQ ID NO: 2304476 - DNA, 14 bp, Homo sapiens
tcacctagctgctc

SEQ ID NO: 2304477 - DNA, 14 bp, Homo sapiens
tcacctcactcagc

SEQ ID NO: 2304478 - DNA, 15 bp, Homo sapiens
tcacctcactcagca

SEQ ID NO: 2304479 - DNA, 19 bp, Homo sapiens
tcacctcactcagcaccac

SEQ ID NO: 2304480 - DNA, 20 bp, Homo sapiens
tcacctcactcagcaccact

SEQ ID NO: 2304481 - DNA, 17 bp, Homo sapiens
tcacctctaggcctcag

SEQ ID NO: 2304482 - DNA, 18 bp, Homo sapiens
tcacctctaggcctcagt

SEQ ID NO: 2304483 - DNA, 20 bp, Homo sapiens
tcacctctaggcctcagtgt

SEQ ID NO: 2304484 - DNA, 15 bp, Homo sapiens
tcacctgaaacactt

SEQ ID NO: 2304485 - DNA, 11 bp, Homo sapiens
tcacctgggat

SEQ ID NO: 2304486 - DNA, 14 bp, Homo sapiens
tcactaagaatata

SEQ ID NO: 2304487 - DNA, 16 bp, Homo sapiens
tcactaagaatataaa

SEQ ID NO: 2304488 - DNA, 14 bp, Homo sapiens
tcactctccttggt

SEQ ID NO: 2304489 - DNA, 13 bp, Homo sapiens
tcactctgttgac

SEQ ID NO: 2304490 - DNA, 17 bp, Homo sapiens
tcactctgttgaccagg

SEQ ID NO: 2304491 - DNA, 19 bp, Homo sapiens
tcactctgttgaccaggct

SEQ ID NO: 2304492 - DNA, 23 bp, Homo sapiens
tcactgcagcctcgacctccctg

SEQ ID NO: 2304493 - DNA, 18 bp, Homo sapiens
tcactgcatctttctctt

SEQ ID NO: 2304494 - DNA, 15 bp, Homo sapiens
tcactgcctgcagct

SEQ ID NO: 2304495 - DNA, 21 bp, Homo sapiens
tcactgctcacacgctgcctc

SEQ ID NO: 2304496 - DNA, 14 bp, Homo sapiens
tcactgctttgtag

SEQ ID NO: 2304497 - DNA, 20 bp, Homo sapiens
tcactggagtagttgctact

SEQ ID NO: 2304498 - DNA, 20 bp, Homo sapiens
tcactgtgttgcccaggctg

SEQ ID NO: 2304499 - DNA, 15 bp, Homo sapiens
tcacttactcttaca

SEQ ID NO: 2304500 - DNA, 17 bp, Homo sapiens
tcacttcagttgtggcc

SEQ ID NO: 2304501 - DNA, 18 bp, Homo sapiens
tcactttaaatatgaaag

SEQ ID NO: 2304502 - DNA, 11 bp, Homo sapiens
tcagaaaagac

SEQ ID NO: 2304503 - DNA, 13 bp, Homo sapiens
tcagaaaagacac

SEQ ID NO: 2304504 - DNA, 20 bp, Homo sapiens
tcagaactcctttctaagga

SEQ ID NO: 2304505 - DNA, 19 bp, Homo sapiens
tcagaaggagacagaatga

SEQ ID NO: 2304506 - DNA, 12 bp, Homo sapiens
tctaaaattcta

SEQ ID NO: 2304507 - DNA, 20 bp, Homo sapiens
tctaaacccaaataaatgtg

SEQ ID NO: 2304508 - DNA, 13 bp, Homo sapiens
tctaaactgtttt

SEQ ID NO: 2304509 - DNA, 18 bp, Homo sapiens
tctaaactgttttcatgt

SEQ ID NO: 2304510 - DNA, 17 bp, Homo sapiens
tctaaagcagcaggtct

SEQ ID NO: 2304511 - DNA, 22 bp, Homo sapiens
tctaaagttagggcatttttct

SEQ ID NO: 2304512 - DNA, 14 bp, Homo sapiens
tctaagcttatttc

SEQ ID NO: 2304513 - DNA, 22 bp, Homo sapiens
tctaagggatccagagacctgc

SEQ ID NO: 2304514 - DNA, 17 bp, Homo sapiens
tctaatagaagtccatg

SEQ ID NO: 2304515 - DNA, 20 bp, Homo sapiens
tctacaagaaagctgtggct

SEQ ID NO: 2304516 - DNA, 19 bp, Homo sapiens
tctacactaaaatttaaat

SEQ ID NO: 2304517 - DNA, 20 bp, Homo sapiens
tctactcgagttacagacaa

SEQ ID NO: 2304518 - DNA, 21 bp, Homo sapiens
tctactcgagttacagacaaa

SEQ ID NO: 2304519 - DNA, 21 bp, Homo sapiens
tctagaaggatgaacagttct

SEQ ID NO: 2304520 - DNA, 22 bp, Homo sapiens
tctagatggatattagatgccc

SEQ ID NO: 2304521 - DNA, 21 bp, Homo sapiens
tctagcaactgttggataata

SEQ ID NO: 2304522 - DNA, 14 bp, Homo sapiens
tctagcaagaagat

SEQ ID NO: 2304523 - DNA, 19 bp, Homo sapiens
tctagcaagaagattctaa

SEQ ID NO: 2304524 - DNA, 21 bp, Homo sapiens
tctagcaagaagattctaaaa

SEQ ID NO: 2304525 - DNA, 15 bp, Homo sapiens
tctagcacagctgtg

SEQ ID NO: 2304526 - DNA, 17 bp, Homo sapiens
tctagcagtatgtgtgc

SEQ ID NO: 2304527 - DNA, 15 bp, Homo sapiens
tctaggcctcagtgt

SEQ ID NO: 2304528 - DNA, 12 bp, Homo sapiens
tctagtatttgt

SEQ ID NO: 2304529 - DNA, 15 bp, Homo sapiens
tctagtcaactgctg

SEQ ID NO: 2304530 - DNA, 16 bp, Homo sapiens
tctagtctctgatttg

SEQ ID NO: 2304531 - DNA, 17 bp, Homo sapiens
tctagttagcaggaaat

SEQ ID NO: 2304532 - DNA, 21 bp, Homo sapiens
tctagttagcaggaaatagtg

SEQ ID NO: 2304533 - DNA, 15 bp, Homo sapiens
tctagtttgcatact

SEQ ID NO: 2304534 - DNA, 20 bp, Homo sapiens
tctagtttgcatacttcctg

SEQ ID NO: 2304535 - DNA, 16 bp, Homo sapiens
tctatactgtttgtaa

SEQ ID NO: 2304536 - DNA, 23 bp, Homo sapiens
tctatactgtttgtaatatacag

SEQ ID NO: 2304537 - DNA, 18 bp, Homo sapiens
tctatatatacatgtata

SEQ ID NO: 2304538 - DNA, 18 bp, Homo sapiens
tctatatgttgctgaaac

SEQ ID NO: 2304539 - DNA, 13 bp, Homo sapiens
tctatatttcata

SEQ ID NO: 2304540 - DNA, 21 bp, Homo sapiens
tctatatttcatattgagatc

SEQ ID NO: 2304541 - DNA, 20 bp, Homo sapiens
tctatctgcaaatagtttca

SEQ ID NO: 2304542 - DNA, 15 bp, Homo sapiens
tctatctgctgggct

SEQ ID NO: 2304543 - DNA, 12 bp, Homo sapiens
tctatgtactag

SEQ ID NO: 2304544 - DNA, 20 bp, Homo sapiens
tctatgtactagtactgtgt

SEQ ID NO: 2304545 - DNA, 21 bp, Homo sapiens
tctatgtactagtactgtgta

SEQ ID NO: 2304546 - DNA, 15 bp, Homo sapiens
tctatgtagaactgt

SEQ ID NO: 2304547 - DNA, 19 bp, Homo sapiens
tctatgtagaactgttcat

SEQ ID NO: 2304548 - DNA, 12 bp, Homo sapiens
tctatgtcctgg

SEQ ID NO: 2304549 - DNA, 21 bp, Homo sapiens
tctattatctgggttttagaa

SEQ ID NO: 2304550 - DNA, 20 bp, Homo sapiens
tctatttcggaaatacacta

SEQ ID NO: 2304551 - DNA, 11 bp, Homo sapiens
tctattttcta

SEQ ID NO: 2304552 - DNA, 17 bp, Homo sapiens
tctcaaacactgcttaa

SEQ ID NO: 2304553 - DNA, 13 bp, Homo sapiens
tctcaaataataa

SEQ ID NO: 2304554 - DNA, 15 bp, Homo sapiens
tctcaaataataata

SEQ ID NO: 2304555 - DNA, 19 bp, Homo sapiens
tctcaaatgctaaatgcaa

SEQ ID NO: 2304556 - DNA, 16 bp, Homo sapiens
tctcaatgcttttcta

SEQ ID NO: 2304557 - DNA, 16 bp, Homo sapiens
tctcacctagctgctc

SEQ ID NO: 2304558 - DNA, 13 bp, Homo sapiens
tctcacctctagg

SEQ ID NO: 2304559 - DNA, 22 bp, Homo sapiens
tctcactagtttttcctgtgca

SEQ ID NO: 2304560 - DNA, 12 bp, Homo sapiens
tctcactctgtt

SEQ ID NO: 2304561 - DNA, 16 bp, Homo sapiens
tctcactgtgttgccc

SEQ ID NO: 2304562 - DNA, 15 bp, Homo sapiens
tctcacttttttata

SEQ ID NO: 2304563 - DNA, 15 bp, Homo sapiens
tctcagataaagtga

SEQ ID NO: 2304564 - DNA, 14 bp, Homo sapiens
tctcagatccctcg

SEQ ID NO: 2304565 - DNA, 17 bp, Homo sapiens
tctcagcaaattcttga

SEQ ID NO: 2304566 - DNA, 16 bp, Homo sapiens
tctcatgaaggagagg

SEQ ID NO: 2304567 - DNA, 14 bp, Homo sapiens
tctcattatgaaga

SEQ ID NO: 2304568 - DNA, 15 bp, Homo sapiens
tctcattatgaagat

SEQ ID NO: 2304569 - DNA, 18 bp, Homo sapiens
tctcattatgaagatgtt

SEQ ID NO: 2304570 - DNA, 24 bp, Homo sapiens
tctccactgtcataatctctttcc

SEQ ID NO: 2304571 - DNA, 17 bp, Homo sapiens
tctccaggcaccgcctg

SEQ ID NO: 2304572 - DNA, 19 bp, Homo sapiens
tctccaggcaccgcctgcc

SEQ ID NO: 2304573 - DNA, 18 bp, Homo sapiens
tctccatccttaactgtc

SEQ ID NO: 2304574 - DNA, 17 bp, Homo sapiens
tctccatctcttgtacc

SEQ ID NO: 2304575 - DNA, 23 bp, Homo sapiens
tctccatgctctttcaccctgcc

SEQ ID NO: 2304576 - DNA, 16 bp, Homo sapiens
tctccctggactctgt

SEQ ID NO: 2304577 - DNA, 23 bp, Homo sapiens
tctccctggactctgtggggcca

SEQ ID NO: 2304578 - DNA, 13 bp, Homo sapiens
tctcctagagctc

SEQ ID NO: 2304579 - DNA, 20 bp, Homo sapiens
tctcctcgtccggcctgcag

SEQ ID NO: 2304580 - DNA, 20 bp, Homo sapiens
tctcctcttctccctttcct

SEQ ID NO: 2304581 - DNA, 19 bp, Homo sapiens
tctcctgcgtgtgcccact

SEQ ID NO: 2304582 - DNA, 21 bp, Homo sapiens
tctcctgcgtgttctcagagg

SEQ ID NO: 2304583 - DNA, 17 bp, Homo sapiens
tctccttagcttctggc

SEQ ID NO: 2304584 - DNA, 21 bp, Homo sapiens
tctccttggtgtcgggcatga

SEQ ID NO: 2304585 - DNA, 13 bp, Homo sapiens
tctccttgtactt

SEQ ID NO: 2304586 - DNA, 16 bp, Homo sapiens
tctccttgtacttgaa

SEQ ID NO: 2304587 - DNA, 22 bp, Homo sapiens
tctcgtactttcacatctctgt

SEQ ID NO: 2304588 - DNA, 23 bp, Homo sapiens
tctctaaaattctagtctctgat

SEQ ID NO: 2304589 - DNA, 14 bp, Homo sapiens
tctctagacaaaat

SEQ ID NO: 2304590 - DNA, 13 bp, Homo sapiens
tctctcaccagcc

SEQ ID NO: 2304591 - DNA, 15 bp, Homo sapiens
tctctcaccagcctt

SEQ ID NO: 2304592 - DNA, 18 bp, Homo sapiens
tctctctatatatacatg

SEQ ID NO: 2304593 - DNA, 19 bp, Homo sapiens
tctctctatatatacatgt

SEQ ID NO: 2304594 - DNA, 21 bp, Homo sapiens
tctctctatatatacatgtat

SEQ ID NO: 2304595 - DNA, 23 bp, Homo sapiens
tctctgatcacaacttttctgct

SEQ ID NO: 2304596 - DNA, 22 bp, Homo sapiens
tctctggttgccaaatactcat

SEQ ID NO: 2304597 - DNA, 16 bp, Homo sapiens
tctcttccagcccaga

SEQ ID NO: 2304598 - DNA, 14 bp, Homo sapiens
tctcttgattcata

SEQ ID NO: 2304599 - DNA, 15 bp, Homo sapiens
tctgaaaactgttta

SEQ ID NO: 2304600 - DNA, 17 bp, Homo sapiens
tctgaaaagaaatgcta

SEQ ID NO: 2304601 - DNA, 14 bp, Homo sapiens
tctgaaaatatttt

SEQ ID NO: 2304602 - DNA, 21 bp, Homo sapiens
tctgaaaatatttttttctag

SEQ ID NO: 2304603 - DNA, 14 bp, Homo sapiens
tctgaaatctacaa

SEQ ID NO: 2304604 - DNA, 14 bp, Homo sapiens
tctgaactgctgct

SEQ ID NO: 2304605 - DNA, 16 bp, Homo sapiens
tctgaactgctgctgg

SEQ ID NO: 2304606 - DNA, 23 bp, Homo sapiens
tctgaactggactagtgaaaaat

SEQ ID NO: 2304607 - DNA, 13 bp, Homo sapiens
tctgaagatctca

SEQ ID NO: 2304608 - DNA, 17 bp, Homo sapiens
tctgaaggccttgttaa

SEQ ID NO: 2304609 - DNA, 16 bp, Homo sapiens
tctgaagggaggggaa

SEQ ID NO: 2304610 - DNA, 16 bp, Homo sapiens
tctgacctgcccccgc

SEQ ID NO: 2304611 - DNA, 22 bp, Homo sapiens
tctgacctgcccccgctctgcc

SEQ ID NO: 2304612 - DNA, 13 bp, Homo sapiens
tctgagcagtggg

SEQ ID NO: 2304613 - DNA, 14 bp, Homo sapiens
tctgagcagtgggg

SEQ ID NO: 2304614 - DNA, 15 bp, Homo sapiens
tctgagcagtgggga

SEQ ID NO: 2304615 - DNA, 12 bp, Homo sapiens
tctgagctgctg

SEQ ID NO: 2304616 - DNA, 12 bp, Homo sapiens
tctgagtgaatg

SEQ ID NO: 2304617 - DNA, 14 bp, Homo sapiens
tctgatcacaactt

SEQ ID NO: 2304618 - DNA, 17 bp, Homo sapiens
tctgatcacaacttttc

SEQ ID NO: 2304619 - DNA, 19 bp, Homo sapiens
tctgatcacaacttttctg

SEQ ID NO: 2304620 - DNA, 17 bp, Homo sapiens
tctgcacagctcctccc

SEQ ID NO: 2304621 - DNA, 15 bp, Homo sapiens
tctgcagcctgagct

SEQ ID NO: 2304622 - DNA, 18 bp, Homo sapiens
tctgcagcctgagctcca

SEQ ID NO: 2304623 - DNA, 23 bp, Homo sapiens
tctgcagcctgagctccaccctc

SEQ ID NO: 2304624 - DNA, 17 bp, Homo sapiens
tctgccatcagcccctg

SEQ ID NO: 2304625 - DNA, 22 bp, Homo sapiens
tctgccatcagcccctgctgct

SEQ ID NO: 2304626 - DNA, 19 bp, Homo sapiens
tctgccatgtttttgcaaa

SEQ ID NO: 2304627 - DNA, 16 bp, Homo sapiens
tctgccccctcccccg

SEQ ID NO: 2304628 - DNA, 20 bp, Homo sapiens
tctgccccctcccccgcaga

SEQ ID NO: 2304629 - DNA, 22 bp, Homo sapiens
tctgccccctcccccgcagaca

SEQ ID NO: 2304630 - DNA, 23 bp, Homo sapiens
tctgccccctcccccgcagacag

SEQ ID NO: 2304631 - DNA, 21 bp, Homo sapiens
tctgccccttgaccccacacg

SEQ ID NO: 2304632 - DNA, 14 bp, Homo sapiens
tctgccctgccctg

SEQ ID NO: 2304633 - DNA, 22 bp, Homo sapiens
tctgccctgccctggccactgg

SEQ ID NO: 2304634 - DNA, 13 bp, Homo sapiens
tctgccttccagg

SEQ ID NO: 2304635 - DNA, 16 bp, Homo sapiens
tctgctaatttatgaa

SEQ ID NO: 2304636 - DNA, 14 bp, Homo sapiens
tctgctcagggccg

SEQ ID NO: 2304637 - DNA, 20 bp, Homo sapiens
tctgctgagctctgacctgc

SEQ ID NO: 2304638 - DNA, 17 bp, Homo sapiens
tgcagatgactggaaac

SEQ ID NO: 2304639 - DNA, 20 bp, Homo sapiens
tgcagcaaccagagcactgt

SEQ ID NO: 2304640 - DNA, 19 bp, Homo sapiens
tgcagcccagaacgggcct

SEQ ID NO: 2304641 - DNA, 21 bp, Homo sapiens
tgcagcctcgacctccctggc

SEQ ID NO: 2304642 - DNA, 19 bp, Homo sapiens
tgcagcctgagctccaccc

SEQ ID NO: 2304643 - DNA, 17 bp, Homo sapiens
tgcagcttggagacagg

SEQ ID NO: 2304644 - DNA, 22 bp, Homo sapiens
tgcagcttggagacaggattct

SEQ ID NO: 2304645 - DNA, 20 bp, Homo sapiens
tgcaggagcaaggctgccct

SEQ ID NO: 2304646 - DNA, 18 bp, Homo sapiens
tgcaggcgcgcaccgccc

SEQ ID NO: 2304647 - DNA, 19 bp, Homo sapiens
tgcaggcgcgcaccgccca

SEQ ID NO: 2304648 - DNA, 19 bp, Homo sapiens
tgcaggcggtatccagagg

SEQ ID NO: 2304649 - DNA, 21 bp, Homo sapiens
tgcaggcggtatccagaggtg

SEQ ID NO: 2304650 - DNA, 18 bp, Homo sapiens
tgcagtaaccatttaatg

SEQ ID NO: 2304651 - DNA, 14 bp, Homo sapiens
tgcagtattctgta

SEQ ID NO: 2304652 - DNA, 15 bp, Homo sapiens
tgcagtattctgtag

SEQ ID NO: 2304653 - DNA, 15 bp, Homo sapiens
tgcagtgaagatgtg

SEQ ID NO: 2304654 - DNA, 17 bp, Homo sapiens
tgcagttcctgctgcct

SEQ ID NO: 2304655 - DNA, 20 bp, Homo sapiens
tgcagttgctcattgtagag

SEQ ID NO: 2304656 - DNA, 13 bp, Homo sapiens
tgcataagattat

SEQ ID NO: 2304657 - DNA, 20 bp, Homo sapiens
tgcataagattatatacaaa

SEQ ID NO: 2304658 - DNA, 16 bp, Homo sapiens
tgcatacacatgcact

SEQ ID NO: 2304659 - DNA, 14 bp, Homo sapiens
tgcatactggactc

SEQ ID NO: 2304660 - DNA, 19 bp, Homo sapiens
tgcatactggactcttcaa

SEQ ID NO: 2304661 - DNA, 21 bp, Homo sapiens
tgcatacttcctggattttct

SEQ ID NO: 2304662 - DNA, 22 bp, Homo sapiens
tgcatacttcctggattttctt

SEQ ID NO: 2304663 - DNA, 13 bp, Homo sapiens
tgcatagacaagt

SEQ ID NO: 2304664 - DNA, 16 bp, Homo sapiens
tgcatagacaagtgtt

SEQ ID NO: 2304665 - DNA, 20 bp, Homo sapiens
tgcatatcctggtgtctagt

SEQ ID NO: 2304666 - DNA, 21 bp, Homo sapiens
tgcatatcctggtgtctagtt

SEQ ID NO: 2304667 - DNA, 21 bp, Homo sapiens
tgcatattagcatcatgtctt

SEQ ID NO: 2304668 - DNA, 17 bp, Homo sapiens
tgcatcaaatgcatgcg

SEQ ID NO: 2304669 - DNA, 16 bp, Homo sapiens
tgcatcctcccctctc

SEQ ID NO: 2304670 - DNA, 12 bp, Homo sapiens
tgcatgatgggt

SEQ ID NO: 2304671 - DNA, 17 bp, Homo sapiens
tgcattattttgtcata

SEQ ID NO: 2304672 - DNA, 23 bp, Homo sapiens
tgcattattttgtcataaaatgc

SEQ ID NO: 2304673 - DNA, 19 bp, Homo sapiens
tgcattccagcgtctgctg

SEQ ID NO: 2304674 - DNA, 20 bp, Homo sapiens
tgcattcttttggcagttct

SEQ ID NO: 2304675 - DNA, 13 bp, Homo sapiens
tgcattgtccttt

SEQ ID NO: 2304676 - DNA, 15 bp, Homo sapiens
tgcattgtccttttc

SEQ ID NO: 2304677 - DNA, 14 bp, Homo sapiens
tgcatttctcttcc

SEQ ID NO: 2304678 - DNA, 15 bp, Homo sapiens
tgcatttttaccttt

SEQ ID NO: 2304679 - DNA, 21 bp, Homo sapiens
tgccaaaatgtcaatttttaa

SEQ ID NO: 2304680 - DNA, 13 bp, Homo sapiens
tgccaaagatagc

SEQ ID NO: 2304681 - DNA, 21 bp, Homo sapiens
tgccaaagatagcagaagagt

SEQ ID NO: 2304682 - DNA, 20 bp, Homo sapiens
tgccaagagtcaacaggtca

SEQ ID NO: 2304683 - DNA, 15 bp, Homo sapiens
tgccaccctctgctg

SEQ ID NO: 2304684 - DNA, 21 bp, Homo sapiens
tgccacttgaacaaaatctgt

SEQ ID NO: 2304685 - DNA, 20 bp, Homo sapiens
tgccagacagagatcagaat

SEQ ID NO: 2304686 - DNA, 12 bp, Homo sapiens
tgccaggagatg

SEQ ID NO: 2304687 - DNA, 12 bp, Homo sapiens
tgccaggagtgg

SEQ ID NO: 2304688 - DNA, 17 bp, Homo sapiens
tgccatagcagtgctag

SEQ ID NO: 2304689 - DNA, 13 bp, Homo sapiens
tgccatcagaaat

SEQ ID NO: 2304690 - DNA, 18 bp, Homo sapiens
tgccatcagaaattttct

SEQ ID NO: 2304691 - DNA, 15 bp, Homo sapiens
tgccatcagcccctg

SEQ ID NO: 2304692 - DNA, 18 bp, Homo sapiens
tgccatcagcccctgctg

SEQ ID NO: 2304693 - DNA, 19 bp, Homo sapiens
tgccatcagcccctgctgc

SEQ ID NO: 2304694 - DNA, 20 bp, Homo sapiens
tgccatcagcccctgctgct

SEQ ID NO: 2304695 - DNA, 20 bp, Homo sapiens
tgccatgaggaacaaggcaa

SEQ ID NO: 2304696 - DNA, 23 bp, Homo sapiens
tgccatgaggaacaaggcaaggc

SEQ ID NO: 2304697 - DNA, 17 bp, Homo sapiens
tgcccacacctgcctct

SEQ ID NO: 2304698 - DNA, 18 bp, Homo sapiens
tgcccacacctgcctctg

SEQ ID NO: 2304699 - DNA, 11 bp, Homo sapiens
tgcccaccctg

SEQ ID NO: 2304700 - DNA, 14 bp, Homo sapiens
tgcccaccctgggc

SEQ ID NO: 2304701 - DNA, 16 bp, Homo sapiens
tgcccaccctgggcct

SEQ ID NO: 2304702 - DNA, 17 bp, Homo sapiens
tgcccaccctgggcctc

SEQ ID NO: 2304703 - DNA, 20 bp, Homo sapiens
tgcccaccctgggcctcccg

SEQ ID NO: 2304704 - DNA, 16 bp, Homo sapiens
tgcccaccgcccctgg

SEQ ID NO: 2304705 - DNA, 20 bp, Homo sapiens
tgcccaggacggtctgtgcc

SEQ ID NO: 2304706 - DNA, 21 bp, Homo sapiens
tgcccaggggagcgtgttcct

SEQ ID NO: 2304707 - DNA, 16 bp, Homo sapiens
tgcccagttagcccgg

SEQ ID NO: 2304708 - DNA, 16 bp, Homo sapiens
tgcccatggcttctgg

SEQ ID NO: 2304709 - DNA, 23 bp, Homo sapiens
tgccccacccctccatgattcca

SEQ ID NO: 2304710 - DNA, 15 bp, Homo sapiens
tgcccccacagatcc

SEQ ID NO: 2304711 - DNA, 14 bp, Homo sapiens
tgcccccagcgtgg

SEQ ID NO: 2304712 - DNA, 11 bp, Homo sapiens
tgccccctccc

SEQ ID NO: 2304713 - DNA, 15 bp, Homo sapiens
tgccccctcccccgc

SEQ ID NO: 2304714 - DNA, 18 bp, Homo sapiens
tgccccctcccccgcaga

SEQ ID NO: 2304715 - DNA, 19 bp, Homo sapiens
tgccccctcccccgcagac

SEQ ID NO: 2304716 - DNA, 22 bp, Homo sapiens
tgccccctcccccgcagacaga

SEQ ID NO: 2304717 - DNA, 22 bp, Homo sapiens
tgccccctccttttcccactgg

SEQ ID NO: 2304718 - DNA, 21 bp, Homo sapiens
tgccccggcccaacctcgccc

SEQ ID NO: 2304719 - DNA, 18 bp, Homo sapiens
tgcccctccgtccccagg

SEQ ID NO: 2304720 - DNA, 20 bp, Homo sapiens
tgcccctccgtccccagggt

SEQ ID NO: 2304721 - DNA, 21 bp, Homo sapiens
tgccccttgaccccacacgcc

SEQ ID NO: 2304722 - DNA, 16 bp, Homo sapiens
tgcccgaggttcctgt

SEQ ID NO: 2304723 - DNA, 17 bp, Homo sapiens
tgcccgaggttcctgtc

SEQ ID NO: 2304724 - DNA, 11 bp, Homo sapiens
tgccctccccc

SEQ ID NO: 2304725 - DNA, 14 bp, Homo sapiens
tgccctgcaccttg

SEQ ID NO: 2304726 - DNA, 16 bp, Homo sapiens
tgccctgcaccttggg

SEQ ID NO: 2304727 - DNA, 18 bp, Homo sapiens
tgccctgcaccttgggca

SEQ ID NO: 2304728 - DNA, 18 bp, Homo sapiens
tgccctgccctggccact

SEQ ID NO: 2304729 - DNA, 19 bp, Homo sapiens
tgccctggccactggccct

SEQ ID NO: 2304730 - DNA, 21 bp, Homo sapiens
tgccctggccactggccctgt

SEQ ID NO: 2304731 - DNA, 23 bp, Homo sapiens
tgcccttgaattcttttcctctc

SEQ ID NO: 2304732 - DNA, 15 bp, Homo sapiens
tgccgacggagccac

SEQ ID NO: 2304733 - DNA, 19 bp, Homo sapiens
tgccgacggagccactggg

SEQ ID NO: 2304734 - DNA, 14 bp, Homo sapiens
tgccgctgccccca

SEQ ID NO: 2304735 - DNA, 16 bp, Homo sapiens
tgccgctgcccccacc

SEQ ID NO: 2304736 - DNA, 18 bp, Homo sapiens
tgccgctgcccccaccct

SEQ ID NO: 2304737 - DNA, 21 bp, Homo sapiens
tgccgctgcccccaccctgct

SEQ ID NO: 2304738 - DNA, 14 bp, Homo sapiens
tgcctaaatttcac

SEQ ID NO: 2304739 - DNA, 18 bp, Homo sapiens
tgcctagaaacagacctg

SEQ ID NO: 2304740 - DNA, 17 bp, Homo sapiens
tgcctccaagtcatggg

SEQ ID NO: 2304741 - DNA, 19 bp, Homo sapiens
tgcctctgaactgctgctg

SEQ ID NO: 2304742 - DNA, 21 bp, Homo sapiens
tgcctctgaactgctgctggt

SEQ ID NO: 2304743 - DNA, 16 bp, Homo sapiens
tgcctctgctctgtgc

SEQ ID NO: 2304744 - DNA, 17 bp, Homo sapiens
tgcctgagagcagaatg

SEQ ID NO: 2304745 - DNA, 13 bp, Homo sapiens
tgcctgaggtccg

SEQ ID NO: 2304746 - DNA, 17 bp, Homo sapiens
tgcctggagggaatcca

SEQ ID NO: 2304747 - DNA, 13 bp, Homo sapiens
tgcctggcgggca

SEQ ID NO: 2304748 - DNA, 14 bp, Homo sapiens
tgcctgtatttcca

SEQ ID NO: 2304749 - DNA, 20 bp, Homo sapiens
tgcctgtgaccggggtcctg

SEQ ID NO: 2304750 - DNA, 19 bp, Homo sapiens
tgcctgtttggggaggggg

SEQ ID NO: 2304751 - DNA, 16 bp, Homo sapiens
tgccttatggaacact

SEQ ID NO: 2304752 - DNA, 18 bp, Homo sapiens
tgccttatggaacactct

SEQ ID NO: 2304753 - DNA, 22 bp, Homo sapiens
tgccttatggaacactctgaga

SEQ ID NO: 2304754 - DNA, 21 bp, Homo sapiens
tgccttccaggcgtagggcca

SEQ ID NO: 2304755 - DNA, 22 bp, Homo sapiens
tgccttccaggcgtagggccag

SEQ ID NO: 2304756 - DNA, 21 bp, Homo sapiens
tgcctttcaaacattgagact

SEQ ID NO: 2304757 - DNA, 15 bp, Homo sapiens
tgccttttccctctg

SEQ ID NO: 2304758 - DNA, 17 bp, Homo sapiens
tgcgcctgcccgcccgc

SEQ ID NO: 2304759 - DNA, 17 bp, Homo sapiens
tgcgctcctctgcagcc

SEQ ID NO: 2304760 - DNA, 18 bp, Homo sapiens
tgcggaccggagcggctg

SEQ ID NO: 2304761 - DNA, 22 bp, Homo sapiens
tgcggaccggagcggctgagga

SEQ ID NO: 2304762 - DNA, 17 bp, Homo sapiens
tgcggcaccgcccaccc

SEQ ID NO: 2304763 - DNA, 19 bp, Homo sapiens
tgcggcccgtgcgcagccg

SEQ ID NO: 2304764 - DNA, 15 bp, Homo sapiens
tgcggccggcctggg

SEQ ID NO: 2304765 - DNA, 18 bp, Homo sapiens
tgcggccggcctggggcc

SEQ ID NO: 2304766 - DNA, 14 bp, Homo sapiens
tgcggccttgggtc

SEQ ID NO: 2304767 - DNA, 23 bp, Homo sapiens
tgcgtgaccggcccgccaccttg

SEQ ID NO: 2304768 - DNA, 17 bp, Homo sapiens
tgcgtggcctggggctg

SEQ ID NO: 2304769 - DNA, 20 bp, Homo sapiens
tgcgttttagagtatgcaag

SEQ ID NO: 2304770 - DNA, 15 bp, Homo sapiens
ttaatctctaaaatt

SEQ ID NO: 2304771 - DNA, 17 bp, Homo sapiens
ttaatctctaaaattct

SEQ ID NO: 2304772 - DNA, 19 bp, Homo sapiens
ttaatctctaaaattctag

SEQ ID NO: 2304773 - DNA, 16 bp, Homo sapiens
ttaatgatggcagagg

SEQ ID NO: 2304774 - DNA, 16 bp, Homo sapiens
ttaatggtatctgtta

SEQ ID NO: 2304775 - DNA, 19 bp, Homo sapiens
ttaatggtatctgttactc

SEQ ID NO: 2304776 - DNA, 22 bp, Homo sapiens
ttaattaaaacacaacatcttt

SEQ ID NO: 2304777 - DNA, 19 bp, Homo sapiens
ttaattcctggaaaactgg

SEQ ID NO: 2304778 - DNA, 11 bp, Homo sapiens
ttaattctcat

SEQ ID NO: 2304779 - DNA, 15 bp, Homo sapiens
ttaattgtgtaactg

SEQ ID NO: 2304780 - DNA, 20 bp, Homo sapiens
ttaattgtgtaactgttctt

SEQ ID NO: 2304781 - DNA, 11 bp, Homo sapiens
ttaatttgtgt

SEQ ID NO: 2304782 - DNA, 21 bp, Homo sapiens
ttacaacattaattttatgaa

SEQ ID NO: 2304783 - DNA, 20 bp, Homo sapiens
ttacacaaaggggatcataa

SEQ ID NO: 2304784 - DNA, 20 bp, Homo sapiens
ttacacggggttacactgtt

SEQ ID NO: 2304785 - DNA, 17 bp, Homo sapiens
ttacactgaaatccaaa

SEQ ID NO: 2304786 - DNA, 16 bp, Homo sapiens
ttacaggtgtactatg

SEQ ID NO: 2304787 - DNA, 13 bp, Homo sapiens
ttacaggttcctt

SEQ ID NO: 2304788 - DNA, 15 bp, Homo sapiens
ttacatttcatttat

SEQ ID NO: 2304789 - DNA, 13 bp, Homo sapiens
ttaccaaaacata

SEQ ID NO: 2304790 - DNA, 19 bp, Homo sapiens
ttaccacggcaacccctgc

SEQ ID NO: 2304791 - DNA, 15 bp, Homo sapiens
ttacccgcagatcct

SEQ ID NO: 2304792 - DNA, 17 bp, Homo sapiens
ttacctcatgccgctgt

SEQ ID NO: 2304793 - DNA, 20 bp, Homo sapiens
ttacctcatgccgctgtgtc

SEQ ID NO: 2304794 - DNA, 21 bp, Homo sapiens
ttacctccctactttcttaga

SEQ ID NO: 2304795 - DNA, 21 bp, Homo sapiens
ttactaaggcaggtgggcaga

SEQ ID NO: 2304796 - DNA, 18 bp, Homo sapiens
ttactcaggctttctatt

SEQ ID NO: 2304797 - DNA, 19 bp, Homo sapiens
ttactgcccagatgtttta

SEQ ID NO: 2304798 - DNA, 14 bp, Homo sapiens
ttactgtctgtaag

SEQ ID NO: 2304799 - DNA, 18 bp, Homo sapiens
ttactgtctgtaagagaa

SEQ ID NO: 2304800 - DNA, 12 bp, Homo sapiens
ttacttaatgtg

SEQ ID NO: 2304801 - DNA, 13 bp, Homo sapiens
ttacttaatgtgg

SEQ ID NO: 2304802 - DNA, 18 bp, Homo sapiens
ttacttcactttcatctg

SEQ ID NO: 2304803 - DNA, 17 bp, Homo sapiens
ttagaacctgcatttaa

SEQ ID NO: 2304804 - DNA, 16 bp, Homo sapiens
ttagaatctattttct

SEQ ID NO: 2304805 - DNA, 13 bp, Homo sapiens
ttagaatgtcagt

SEQ ID NO: 2304806 - DNA, 13 bp, Homo sapiens
ttagagataaata

SEQ ID NO: 2304807 - DNA, 19 bp, Homo sapiens
ttagagataaatatttatg

SEQ ID NO: 2304808 - DNA, 20 bp, Homo sapiens
ttagagataaatatttatgc

SEQ ID NO: 2304809 - DNA, 19 bp, Homo sapiens
ttagaggggcaaaaatatt

SEQ ID NO: 2304810 - DNA, 22 bp, Homo sapiens
ttagagtgcccttaaaataatg

SEQ ID NO: 2304811 - DNA, 15 bp, Homo sapiens
ttagataacaagaat

SEQ ID NO: 2304812 - DNA, 13 bp, Homo sapiens
ttagattgaaatt

SEQ ID NO: 2304813 - DNA, 17 bp, Homo sapiens
ttagattgaaatttatg

SEQ ID NO: 2304814 - DNA, 22 bp, Homo sapiens
ttagattgaaatttatgactag

SEQ ID NO: 2304815 - DNA, 14 bp, Homo sapiens
ttagatttctttga

SEQ ID NO: 2304816 - DNA, 15 bp, Homo sapiens
ttagcattattgcca

SEQ ID NO: 2304817 - DNA, 19 bp, Homo sapiens
ttagcattattgccaaata

SEQ ID NO: 2304818 - DNA, 22 bp, Homo sapiens
ttagccagaatgtttcctgtgg

SEQ ID NO: 2304819 - DNA, 21 bp, Homo sapiens
ttaggtaatggatatgaaaga

SEQ ID NO: 2304820 - DNA, 15 bp, Homo sapiens
ttagtcatatttttg

SEQ ID NO: 2304821 - DNA, 13 bp, Homo sapiens
ttagtgaatggga

SEQ ID NO: 2304822 - DNA, 17 bp, Homo sapiens
ttagttaggtgtgccaa

SEQ ID NO: 2304823 - DNA, 18 bp, Homo sapiens
ttagttggagctagaaaa

SEQ ID NO: 2304824 - DNA, 13 bp, Homo sapiens
ttagtttcaaaat

SEQ ID NO: 2304825 - DNA, 20 bp, Homo sapiens
ttataaaaattctagtctgt

SEQ ID NO: 2304826 - DNA, 21 bp, Homo sapiens
ttataaaatctttccatctca

SEQ ID NO: 2304827 - DNA, 20 bp, Homo sapiens
ttataaacaacagaaacttc

SEQ ID NO: 2304828 - DNA, 11 bp, Homo sapiens
ttataaatgtt

SEQ ID NO: 2304829 - DNA, 13 bp, Homo sapiens
ttataatatagaa

SEQ ID NO: 2304830 - DNA, 17 bp, Homo sapiens
ttataatgcatctaaac

SEQ ID NO: 2304831 - DNA, 16 bp, Homo sapiens
ttatactgctatattt

SEQ ID NO: 2304832 - DNA, 20 bp, Homo sapiens
ttataggaaataaatctaaa

SEQ ID NO: 2304833 - DNA, 21 bp, Homo sapiens
ttataggaaataaatctaaat

SEQ ID NO: 2304834 - DNA, 22 bp, Homo sapiens
ttatataactacattaaaagct

SEQ ID NO: 2304835 - DNA, 15 bp, Homo sapiens
ttatataatatgaat

SEQ ID NO: 2304836 - DNA, 12 bp, Homo sapiens
ttatatatgaag

SEQ ID NO: 2304837 - DNA, 14 bp, Homo sapiens
ttatatatgaagta

SEQ ID NO: 2304838 - DNA, 12 bp, Homo sapiens
ttatatcatcaa

SEQ ID NO: 2304839 - DNA, 18 bp, Homo sapiens
ttatatcatcaatacttt

SEQ ID NO: 2304840 - DNA, 12 bp, Homo sapiens
ttatatctgtaa

SEQ ID NO: 2304841 - DNA, 18 bp, Homo sapiens
ttatattagagtgccctt

SEQ ID NO: 2304842 - DNA, 13 bp, Homo sapiens
ttatcaaagcatt

SEQ ID NO: 2304843 - DNA, 16 bp, Homo sapiens
ttatcacacttgcaaa

SEQ ID NO: 2304844 - DNA, 20 bp, Homo sapiens
ttatcagaactcctttctaa

SEQ ID NO: 2304845 - DNA, 22 bp, Homo sapiens
ttatcagggcccaaataacagt

SEQ ID NO: 2304846 - DNA, 15 bp, Homo sapiens
ttatcagttggacag

SEQ ID NO: 2304847 - DNA, 17 bp, Homo sapiens
ttatctagcaagaagat

SEQ ID NO: 2304848 - DNA, 21 bp, Homo sapiens
ttatctagcaagaagattcta

SEQ ID NO: 2304849 - DNA, 23 bp, Homo sapiens
ttatctagcaagaagattctaaa

SEQ ID NO: 2304850 - DNA, 20 bp, Homo sapiens
ttatctccagccaatttcaa

SEQ ID NO: 2304851 - DNA, 23 bp, Homo sapiens
ttatctgaactggactagtgaaa

SEQ ID NO: 2304852 - DNA, 11 bp, Homo sapiens
ttatctgtgtt

SEQ ID NO: 2304853 - DNA, 19 bp, Homo sapiens
ttatgcagaaggtattttt

SEQ ID NO: 2304854 - DNA, 21 bp, Homo sapiens
ttatgcccttgagtctagatg

SEQ ID NO: 2304855 - DNA, 17 bp, Homo sapiens
ttatggaacactctgag

SEQ ID NO: 2304856 - DNA, 21 bp, Homo sapiens
ttatggtattttcgtgcattt

SEQ ID NO: 2304857 - DNA, 23 bp, Homo sapiens
ttatggtattttcgtgcatttgt

SEQ ID NO: 2304858 - DNA, 15 bp, Homo sapiens
ttatggtgatactcc

SEQ ID NO: 2304859 - DNA, 20 bp, Homo sapiens
ttatgtcattctctttctca

SEQ ID NO: 2304860 - DNA, 13 bp, Homo sapiens
ttatgttctcaac

SEQ ID NO: 2304861 - DNA, 18 bp, Homo sapiens
ttattattttcatataat

SEQ ID NO: 2304862 - DNA, 22 bp, Homo sapiens
ttattattttcatataatttgc

SEQ ID NO: 2304863 - DNA, 11 bp, Homo sapiens
ttattctagtc

SEQ ID NO: 2304864 - DNA, 16 bp, Homo sapiens
ttattctagtcaactg

SEQ ID NO: 2304865 - DNA, 20 bp, Homo sapiens
ttattctagtcaactgctgt

SEQ ID NO: 2304866 - DNA, 12 bp, Homo sapiens
ttattgaataac

SEQ ID NO: 2304867 - DNA, 12 bp, Homo sapiens
ttattgaatgtt

SEQ ID NO: 2304868 - DNA, 14 bp, Homo sapiens
ttattgagtaatat

SEQ ID NO: 2304869 - DNA, 15 bp, Homo sapiens
ttattgagtaatatt

SEQ ID NO: 2304870 - DNA, 17 bp, Homo sapiens
ttattgagtaatattac

SEQ ID NO: 2304871 - DNA, 23 bp, Homo sapiens
ttattgagtaatattacatttca

SEQ ID NO: 2304872 - DNA, 14 bp, Homo sapiens
ttattgccaaataa

SEQ ID NO: 2304873 - DNA, 14 bp, Homo sapiens
ttattgcctctgtc

SEQ ID NO: 2304874 - DNA, 19 bp, Homo sapiens
ttattgcctctgtcttaaa

SEQ ID NO: 2304875 - DNA, 13 bp, Homo sapiens
ttattgctatatt

SEQ ID NO: 2304876 - DNA, 18 bp, Homo sapiens
ttattgtcaaagtggtga

SEQ ID NO: 2304877 - DNA, 24 bp, Homo sapiens
ttatttagcccataatctctttga

SEQ ID NO: 2304878 - DNA, 23 bp, Homo sapiens
ttattttagacaaccatagaact

SEQ ID NO: 2304879 - DNA, 19 bp, Homo sapiens
ttattttatcacttgccgt

SEQ ID NO: 2304880 - DNA, 22 bp, Homo sapiens
ttattttcagtgctttgccctt

SEQ ID NO: 2304881 - DNA, 13 bp, Homo sapiens
ttattttcatata

SEQ ID NO: 2304882 - DNA, 14 bp, Homo sapiens
ttcaaaaactgttt

SEQ ID NO: 2304883 - DNA, 20 bp, Homo sapiens
ttcaaaaactgttttgggta

SEQ ID NO: 2304884 - DNA, 14 bp, Homo sapiens
ttcaaaactttcag

SEQ ID NO: 2304885 - DNA, 15 bp, Homo sapiens
ttcaaaatagttcta

SEQ ID NO: 2304886 - DNA, 21 bp, Homo sapiens
ttcaaaatagttctatttcta

SEQ ID NO: 2304887 - DNA, 22 bp, Homo sapiens
ttcaaaatagttctatttctat

SEQ ID NO: 2304888 - DNA, 17 bp, Homo sapiens
ttcaaagatacaagaaa

SEQ ID NO: 2304889 - DNA, 19 bp, Homo sapiens
ttcaaagggtaaattataa

SEQ ID NO: 2304890 - DNA, 21 bp, Homo sapiens
ttcaacaggttttcctgaaga

SEQ ID NO: 2304891 - DNA, 14 bp, Homo sapiens
ttcaacatatgaat

SEQ ID NO: 2304892 - DNA, 17 bp, Homo sapiens
ttcaaccctgccctgca

SEQ ID NO: 2304893 - DNA, 23 bp, Homo sapiens
ttcaactgtataccgtgtgctcc

SEQ ID NO: 2304894 - DNA, 22 bp, Homo sapiens
ttcaagtcattccacacatttc

SEQ ID NO: 2304895 - DNA, 23 bp, Homo sapiens
ttcaagtcattccacacatttcc

SEQ ID NO: 2304896 - DNA, 17 bp, Homo sapiens
ttcaataaagaaaaaaa

SEQ ID NO: 2304897 - DNA, 21 bp, Homo sapiens
ttcaataaagaaaaaaatagt

SEQ ID NO: 2304898 - DNA, 19 bp, Homo sapiens
ttcaataagtgttgtacca

SEQ ID NO: 2304899 - DNA, 22 bp, Homo sapiens
ttcaataagtgttgtaccatat

SEQ ID NO: 2304900 - DNA, 20 bp, Homo sapiens
ttcaataggaaaaactgatt

SEQ ID NO: 2304901 - DNA, 16 bp, Homo sapiens
ttcaatgtgaatttta

SEQ ID NO: 2304902 - DNA, 12 bp, Homo sapiens
tttgtgtattct

SEQ ID NO: 2304903 - DNA, 15 bp, Homo sapiens
tttgtgtattctgtg

SEQ ID NO: 2304904 - DNA, 22 bp, Homo sapiens
tttgtgtattctgtggattcta

SEQ ID NO: 2304905 - DNA, 21 bp, Homo sapiens
tttgttgcagttaattcttgc

SEQ ID NO: 2304906 - DNA, 14 bp, Homo sapiens
ttttaaaaaataac

SEQ ID NO: 2304907 - DNA, 17 bp, Homo sapiens
ttttaaaaagttgcaca

SEQ ID NO: 2304908 - DNA, 19 bp, Homo sapiens
ttttaaaaagttgcacatt

SEQ ID NO: 2304909 - DNA, 11 bp, Homo sapiens
ttttaaaatca

SEQ ID NO: 2304910 - DNA, 14 bp, Homo sapiens
ttttaaaattcatg

SEQ ID NO: 2304911 - DNA, 17 bp, Homo sapiens
ttttaaactgatgtata

SEQ ID NO: 2304912 - DNA, 22 bp, Homo sapiens
ttttaaagaagaagtggatcta

SEQ ID NO: 2304913 - DNA, 19 bp, Homo sapiens
ttttaaagatctcggtgct

SEQ ID NO: 2304914 - DNA, 15 bp, Homo sapiens
ttttaaatcatttca

SEQ ID NO: 2304915 - DNA, 10 bp, Homo sapiens
ttttaaatgt

SEQ ID NO: 2304916 - DNA, 16 bp, Homo sapiens
ttttaaatgtgcttca

SEQ ID NO: 2304917 - DNA, 13 bp, Homo sapiens
ttttactgtctgt

SEQ ID NO: 2304918 - DNA, 17 bp, Homo sapiens
ttttagaaattctataa

SEQ ID NO: 2304919 - DNA, 18 bp, Homo sapiens
ttttagagattaatttgt

SEQ ID NO: 2304920 - DNA, 20 bp, Homo sapiens
ttttaggctattataatata

SEQ ID NO: 2304921 - DNA, 13 bp, Homo sapiens
ttttatatctgta

SEQ ID NO: 2304922 - DNA, 16 bp, Homo sapiens
ttttatgtcatactct

SEQ ID NO: 2304923 - DNA, 20 bp, Homo sapiens
ttttattgagtaatattaca

SEQ ID NO: 2304924 - DNA, 14 bp, Homo sapiens
ttttcaataaagaa

SEQ ID NO: 2304925 - DNA, 17 bp, Homo sapiens
ttttcaatgtactgtat

SEQ ID NO: 2304926 - DNA, 21 bp, Homo sapiens
ttttccaacaggggctggagg

SEQ ID NO: 2304927 - DNA, 23 bp, Homo sapiens
ttttccataaccaacattttaaa

SEQ ID NO: 2304928 - DNA, 14 bp, Homo sapiens
ttttccatctaaaa

SEQ ID NO: 2304929 - DNA, 16 bp, Homo sapiens
ttttccatctaaaata

SEQ ID NO: 2304930 - DNA, 16 bp, Homo sapiens
ttttcccacaattctt

SEQ ID NO: 2304931 - DNA, 23 bp, Homo sapiens
ttttcccacaattcttttgaaag

SEQ ID NO: 2304932 - DNA, 14 bp, Homo sapiens
ttttccctctggca

SEQ ID NO: 2304933 - DNA, 17 bp, Homo sapiens
ttttcgtgcatttgtga

SEQ ID NO: 2304934 - DNA, 23 bp, Homo sapiens
ttttctaaactgttttcatgtgt

SEQ ID NO: 2304935 - DNA, 13 bp, Homo sapiens
ttttctaaatgtt

SEQ ID NO: 2304936 - DNA, 16 bp, Homo sapiens
ttttctaaatgtttct

SEQ ID NO: 2304937 - DNA, 22 bp, Homo sapiens
ttttctactcgagttacagaca

SEQ ID NO: 2304938 - DNA, 12 bp, Homo sapiens
ttttctatgtac

SEQ ID NO: 2304939 - DNA, 18 bp, Homo sapiens
ttttctatgtccagcctt

SEQ ID NO: 2304940 - DNA, 16 bp, Homo sapiens
ttttctcaaaaagctg

SEQ ID NO: 2304941 - DNA, 20 bp, Homo sapiens
ttttctctgatcacaacttt

SEQ ID NO: 2304942 - DNA, 16 bp, Homo sapiens
ttttctgaattcataa

SEQ ID NO: 2304943 - DNA, 21 bp, Homo sapiens
ttttctgaattcataaaaata

SEQ ID NO: 2304944 - DNA, 12 bp, Homo sapiens
ttttctgtcttg

SEQ ID NO: 2304945 - DNA, 15 bp, Homo sapiens
ttttcttcccatttg

SEQ ID NO: 2304946 - DNA, 18 bp, Homo sapiens
ttttctttaatcaaaagt

SEQ ID NO: 2304947 - DNA, 21 bp, Homo sapiens
ttttcttttgtaagtgctaca

SEQ ID NO: 2304948 - DNA, 13 bp, Homo sapiens
ttttgaagtcttg

SEQ ID NO: 2304949 - DNA, 16 bp, Homo sapiens
ttttgaagtcttgtat

SEQ ID NO: 2304950 - DNA, 16 bp, Homo sapiens
ttttgcttcatctgga

SEQ ID NO: 2304951 - DNA, 14 bp, Homo sapiens
ttttgggtagctgc

SEQ ID NO: 2304952 - DNA, 19 bp, Homo sapiens
ttttgtggctgatttcaaa

SEQ ID NO: 2304953 - DNA, 17 bp, Homo sapiens
tttttaaatgtgcttca

SEQ ID NO: 2304954 - DNA, 20 bp, Homo sapiens
tttttaatatactaaccatt

SEQ ID NO: 2304955 - DNA, 20 bp, Homo sapiens
tttttagaggggcaaaaata

SEQ ID NO: 2304956 - DNA, 21 bp, Homo sapiens
tttttataaattataatgcat

SEQ ID NO: 2304957 - DNA, 21 bp, Homo sapiens
tttttcaaaacgccatgtcct

SEQ ID NO: 2304958 - DNA, 19 bp, Homo sapiens
tttttcacctgaaacactt

SEQ ID NO: 2304959 - DNA, 11 bp, Homo sapiens
tttttccttca

SEQ ID NO: 2304960 - DNA, 11 bp, Homo sapiens
tttttctcaaa

SEQ ID NO: 2304961 - DNA, 15 bp, Homo sapiens
tttttgaagtcttgt

SEQ ID NO: 2304962 - DNA, 19 bp, Homo sapiens
tttttgaagtcttgtataa

SEQ ID NO: 2304963 - DNA, 14 bp, Homo sapiens
ttttttaatatact

SEQ ID NO: 2304964 - DNA, 16 bp, Homo sapiens
ttttttgctatggaag

SEQ ID NO: 2304965 - DNA, 12 bp, Homo sapiens
tttttttctagc

SEQ ID NO: 2304966 - DNA, 18 bp, Homo sapiens
gttatcatcctattgtct

SEQ ID NO: 2304967 - DNA, 17 bp, Homo sapiens
gttatgagaaaaaaaca

SEQ ID NO: 2304968 - DNA, 15 bp, Homo sapiens
gttatttctgcaaac

SEQ ID NO: 2304969 - DNA, 13 bp, Homo sapiens
gttcaaagataca

SEQ ID NO: 2304970 - DNA, 12 bp, Homo sapiens
gttcatttccac

SEQ ID NO: 2304971 - DNA, 17 bp, Homo sapiens
gttccagggttctcttg

SEQ ID NO: 2304972 - DNA, 21 bp, Homo sapiens
gttctacaggaaatacagaga

SEQ ID NO: 2304973 - DNA, 20 bp, Homo sapiens
gttctaggctaccagaagag

SEQ ID NO: 2304974 - DNA, 21 bp, Homo sapiens
gttctagttagcaggaaatag

SEQ ID NO: 2304975 - DNA, 17 bp, Homo sapiens
gttctcaatgcttttct

SEQ ID NO: 2304976 - DNA, 17 bp, Homo sapiens
gttctcatcttgtaaat

SEQ ID NO: 2304977 - DNA, 11 bp, Homo sapiens
gttctgtgtct

SEQ ID NO: 2304978 - DNA, 16 bp, Homo sapiens
gttctgtgtctgctgt

SEQ ID NO: 2304979 - DNA, 17 bp, Homo sapiens
gttctgtgtctgctgta

SEQ ID NO: 2304980 - DNA, 18 bp, Homo sapiens
gttctttcacccttttct

SEQ ID NO: 2304981 - DNA, 21 bp, Homo sapiens
gttgaatgtattcttttatat

SEQ ID NO: 2304982 - DNA, 16 bp, Homo sapiens
gttgaggaggggagca

SEQ ID NO: 2304983 - DNA, 17 bp, Homo sapiens
gttgcaaattattctag

SEQ ID NO: 2304984 - DNA, 15 bp, Homo sapiens
gttgcaatgatcaga

SEQ ID NO: 2304985 - DNA, 13 bp, Homo sapiens
gttgcaattaaaa

SEQ ID NO: 2304986 - DNA, 15 bp, Homo sapiens
gttgcacaacacaga

SEQ ID NO: 2304987 - DNA, 12 bp, Homo sapiens
gttgccaaagga

SEQ ID NO: 2304988 - DNA, 22 bp, Homo sapiens
gttgctaacctcaatttatgtt

SEQ ID NO: 2304989 - DNA, 13 bp, Homo sapiens
gttggactgtggc

SEQ ID NO: 2304990 - DNA, 14 bp, Homo sapiens
gttggactgtggcc

SEQ ID NO: 2304991 - DNA, 17 bp, Homo sapiens
gttggactgtggcctca

SEQ ID NO: 2304992 - DNA, 13 bp, Homo sapiens
gttggcacagaac

SEQ ID NO: 2304993 - DNA, 17 bp, Homo sapiens
gttggccggctggccgg

SEQ ID NO: 2304994 - DNA, 16 bp, Homo sapiens
gttgtaagaggatgtg

SEQ ID NO: 2304995 - DNA, 22 bp, Homo sapiens
gttgtaggactaaataatgatc

SEQ ID NO: 2304996 - DNA, 11 bp, Homo sapiens
gttgtatttga

SEQ ID NO: 2304997 - DNA, 13 bp, Homo sapiens
gttgtctgtcctg

SEQ ID NO: 2304998 - DNA, 14 bp, Homo sapiens
gttgtctgtcctgg

SEQ ID NO: 2304999 - DNA, 18 bp, Homo sapiens
gttgtgattccccggagc

SEQ ID NO: 2305000 - DNA, 20 bp, Homo sapiens
gttgtgattccccggagctg

SEQ ID NO: 2305001 - DNA, 19 bp, Homo sapiens
gtgagctaccaggaagagg

SEQ ID NO: 2305002 - DNA, 17 bp, Homo sapiens
gtgaggatgaaaaaata

SEQ ID NO: 2305003 - DNA, 22 bp, Homo sapiens
gtgaggcccccggaggcgccca

SEQ ID NO: 2305004 - DNA, 15 bp, Homo sapiens
gtgagggaggcctga

SEQ ID NO: 2305005 - DNA, 17 bp, Homo sapiens
gtgatcccagctcactg

SEQ ID NO: 2305006 - DNA, 23 bp, Homo sapiens
gtgatcccagctcactgcagcct

SEQ ID NO: 2305007 - DNA, 20 bp, Homo sapiens
gtgatcctcccgccccagcc

SEQ ID NO: 2305008 - DNA, 14 bp, Homo sapiens
gtgatctaagcagt

SEQ ID NO: 2305009 - DNA, 15 bp, Homo sapiens
gtgatctgtcttgta

SEQ ID NO: 2305010 - DNA, 18 bp, Homo sapiens
gtgatgacggggtgttgc

SEQ ID NO: 2305011 - DNA, 14 bp, Homo sapiens
gtgatgagaggaaa

SEQ ID NO: 2305012 - DNA, 20 bp, Homo sapiens
gtgatgggcaaggggccagg

SEQ ID NO: 2305013 - DNA, 18 bp, Homo sapiens
gtgattccccggagctgg

SEQ ID NO: 2305014 - DNA, 16 bp, Homo sapiens
gtgcaaaataaaatga

SEQ ID NO: 2305015 - DNA, 15 bp, Homo sapiens
gtgcaatatgtaaca

SEQ ID NO: 2305016 - DNA, 16 bp, Homo sapiens
gtgcagcaaccagagc

SEQ ID NO: 2305017 - DNA, 14 bp, Homo sapiens
gtgcaggcgcgcac

SEQ ID NO: 2305018 - DNA, 18 bp, Homo sapiens
gtgcaggcgcgcaccgcc

SEQ ID NO: 2305019 - DNA, 14 bp, Homo sapiens
gtgcaggttatgca

SEQ ID NO: 2305020 - DNA, 15 bp, Homo sapiens
gtgcagtaaccattt

SEQ ID NO: 2305021 - DNA, 18 bp, Homo sapiens
gtgcagtaaccatttaat

SEQ ID NO: 2305022 - DNA, 22 bp, Homo sapiens
gtgcatacgcctcttgttcatg

SEQ ID NO: 2305023 - DNA, 12 bp, Homo sapiens
gtgcattgtcct

SEQ ID NO: 2305024 - DNA, 16 bp, Homo sapiens
gtgcattgtccttttc

SEQ ID NO: 2305025 - DNA, 22 bp, Homo sapiens
gtgccaaactaccgttcccaaa

SEQ ID NO: 2305026 - DNA, 14 bp, Homo sapiens
gtgccaaagatagc

SEQ ID NO: 2305027 - DNA, 10 bp, Homo sapiens
gtgcccagga

SEQ ID NO: 2305028 - DNA, 17 bp, Homo sapiens
gtgcccaggacggtctg

SEQ ID NO: 2305029 - DNA, 14 bp, Homo sapiens
gtgcccaggggagc

SEQ ID NO: 2305030 - DNA, 17 bp, Homo sapiens
gtgcccgaggttcctgt

SEQ ID NO: 2305031 - DNA, 18 bp, Homo sapiens
gtgcccttaaaataatga

SEQ ID NO: 2305032 - DNA, 20 bp, Homo sapiens
gtgcctgaaggctatccact

SEQ ID NO: 2305033 - DNA, 19 bp, Homo sapiens
gtgcctgagagcagaatga

SEQ ID NO: 2305034 - DNA, 14 bp, Homo sapiens
gtgccttatggaac

SEQ ID NO: 2305035 - DNA, 20 bp, Homo sapiens
gtgccttccccgtgcggccc

SEQ ID NO: 2305036 - DNA, 21 bp, Homo sapiens
gtgccttccccgtgcggcccg

SEQ ID NO: 2305037 - DNA, 15 bp, Homo sapiens
gtgcgacttcacaaa

SEQ ID NO: 2305038 - DNA, 23 bp, Homo sapiens
gtgcgcagccgcgctctgcccct

SEQ ID NO: 2305039 - DNA, 15 bp, Homo sapiens
gtgcgccggcgcccc

SEQ ID NO: 2305040 - DNA, 17 bp, Homo sapiens
gtgcggcccgtgcgcag

SEQ ID NO: 2305041 - DNA, 16 bp, Homo sapiens
gtgctccagtgttttc

SEQ ID NO: 2305042 - DNA, 19 bp, Homo sapiens
taaagaggcgtcttgtatt

SEQ ID NO: 2305043 - DNA, 15 bp, Homo sapiens
taaagagttctcctt

SEQ ID NO: 2305044 - DNA, 18 bp, Homo sapiens
taaaggaaagttctatta

SEQ ID NO: 2305045 - DNA, 23 bp, Homo sapiens
taaaggtgcagttgctcattgta

SEQ ID NO: 2305046 - DNA, 20 bp, Homo sapiens
taaagtaataactgttagaa

SEQ ID NO: 2305047 - DNA, 14 bp, Homo sapiens
taaagttagaatct

SEQ ID NO: 2305048 - DNA, 16 bp, Homo sapiens
taaagttagaatctat

SEQ ID NO: 2305049 - DNA, 21 bp, Homo sapiens
taaagttagggcatttttctt

SEQ ID NO: 2305050 - DNA, 23 bp, Homo sapiens
taaagttagggcatttttcttgg

SEQ ID NO: 2305051 - DNA, 17 bp, Homo sapiens
taaataatgatcttcca

SEQ ID NO: 2305052 - DNA, 20 bp, Homo sapiens
taaataatgatcttccaaat

SEQ ID NO: 2305053 - DNA, 18 bp, Homo sapiens
taaataatgattcaatgt

SEQ ID NO: 2305054 - DNA, 14 bp, Homo sapiens
taaataatgcttaa

SEQ ID NO: 2305055 - DNA, 13 bp, Homo sapiens
taaatagcatctg

SEQ ID NO: 2305056 - DNA, 12 bp, Homo sapiens
taaatataaaat

SEQ ID NO: 2305057 - DNA, 13 bp, Homo sapiens
taaatataaaata

SEQ ID NO: 2305058 - DNA, 21 bp, Homo sapiens
taaatatttcaataacttaga

SEQ ID NO: 2305059 - DNA, 16 bp, Homo sapiens
taaatcagactagaga

SEQ ID NO: 2305060 - DNA, 15 bp, Homo sapiens
taaatctgtctgatt

SEQ ID NO: 2305061 - DNA, 18 bp, Homo sapiens
taaatctgtctgattcta

SEQ ID NO: 2305062 - DNA, 19 bp, Homo sapiens
taaatctgtctgattctat

SEQ ID NO: 2305063 - DNA, 16 bp, Homo sapiens
taaatctgttagcatt

SEQ ID NO: 2305064 - DNA, 23 bp, Homo sapiens
taaatctgttagcattattgcca

SEQ ID NO: 2305065 - DNA, 15 bp, Homo sapiens
taaatgaacatttaa

SEQ ID NO: 2305066 - DNA, 14 bp, Homo sapiens
taaatgctatggaa

SEQ ID NO: 2305067 - DNA, 21 bp, Homo sapiens
taaatgctatggaaatacatt

SEQ ID NO: 2305068 - DNA, 23 bp, Homo sapiens
taaatgctatggaaatacattta

SEQ ID NO: 2305069 - DNA, 18 bp, Homo sapiens
gcaaggctgtcaattaca

SEQ ID NO: 2305070 - DNA, 15 bp, Homo sapiens
gcaaggggccaggaa

SEQ ID NO: 2305071 - DNA, 18 bp, Homo sapiens
gcaagtcgccaggcagga

SEQ ID NO: 2305072 - DNA, 13 bp, Homo sapiens
gcaataacagttt

SEQ ID NO: 2305073 - DNA, 19 bp, Homo sapiens
gcaataacagttttaagat

SEQ ID NO: 2305074 - DNA, 12 bp, Homo sapiens
tgcgcctgcccg

SEQ ID NO: 2305075 - DNA, 12 bp, Homo sapiens
tgcgctcctctg

SEQ ID NO: 2305076 - DNA, 20 bp, Homo sapiens
tgcggaccggagcggctgag

SEQ ID NO: 2305077 - DNA, 13 bp, Homo sapiens
tgcggcaccgccc

SEQ ID NO: 2305078 - DNA, 15 bp, Homo sapiens
tgcggcaccgcccac

SEQ ID NO: 2305079 - DNA, 16 bp, Homo sapiens
tgcggcaccgcccacc

SEQ ID NO: 2305080 - DNA, 19 bp, Homo sapiens
tgcggcaccgcccacccac

SEQ ID NO: 2305081 - DNA, 18 bp, Homo sapiens
tgcggcccgtgcgcagcc

SEQ ID NO: 2305082 - DNA, 13 bp, Homo sapiens
tgcgttttagagt

SEQ ID NO: 2305083 - DNA, 13 bp, Homo sapiens
tgctaacaaactg

SEQ ID NO: 2305084 - DNA, 18 bp, Homo sapiens
tgctaacaaactgaaaaa

SEQ ID NO: 2305085 - DNA, 19 bp, Homo sapiens
tgctaacaaactgaaaaat

SEQ ID NO: 2305086 - DNA, 22 bp, Homo sapiens
tgctaatgggctgctgtcattt

SEQ ID NO: 2305087 - DNA, 15 bp, Homo sapiens
tgctaatgtaatcat

SEQ ID NO: 2305088 - DNA, 15 bp, Homo sapiens
tgctaatttatgaag

SEQ ID NO: 2305089 - DNA, 18 bp, Homo sapiens
tgctacagtagctgtggg

SEQ ID NO: 2305090 - DNA, 13 bp, Homo sapiens
tgctacagtattt

SEQ ID NO: 2305091 - DNA, 16 bp, Homo sapiens
tgctatatttgctaat

SEQ ID NO: 2305092 - DNA, 17 bp, Homo sapiens
tgctatccaatgatata

SEQ ID NO: 2305093 - DNA, 22 bp, Homo sapiens
tgctatggaaatacatttagaa

SEQ ID NO: 2305094 - DNA, 13 bp, Homo sapiens
tgctattgtttat

SEQ ID NO: 2305095 - DNA, 19 bp, Homo sapiens
tgctcaccaagctgttcca

SEQ ID NO: 2305096 - DNA, 13 bp, Homo sapiens
tgctcagaatcca

SEQ ID NO: 2305097 - DNA, 17 bp, Homo sapiens
tgctccagtgttttctt

SEQ ID NO: 2305098 - DNA, 20 bp, Homo sapiens
tgctccagtgttttcttgtg

SEQ ID NO: 2305099 - DNA, 16 bp, Homo sapiens
tgctcctcggccagag

SEQ ID NO: 2305100 - DNA, 22 bp, Homo sapiens
tgctcctcggccagagctccca

SEQ ID NO: 2305101 - DNA, 15 bp, Homo sapiens
tgctccttgaataag

SEQ ID NO: 2305102 - DNA, 18 bp, Homo sapiens
tgctccttgcctctgctc

SEQ ID NO: 2305103 - DNA, 19 bp, Homo sapiens
tgctcgggaaggcctgagg

SEQ ID NO: 2305104 - DNA, 14 bp, Homo sapiens
tgctcttatcccca

SEQ ID NO: 2305105 - DNA, 15 bp, Homo sapiens
tgctcttatccccag

SEQ ID NO: 2305106 - DNA, 16 bp, Homo sapiens
tgctcttatccccagc

SEQ ID NO: 2305107 - DNA, 19 bp, Homo sapiens
tgctcttatccccagctgt

SEQ ID NO: 2305108 - DNA, 18 bp, Homo sapiens
tgctctttcaccctgcca

SEQ ID NO: 2305109 - DNA, 23 bp, Homo sapiens
tgctctttcaccctgccaccctc

SEQ ID NO: 2305110 - DNA, 19 bp, Homo sapiens
tgctgacagagccctatct

SEQ ID NO: 2305111 - DNA, 13 bp, Homo sapiens
tgctgatggtgca

SEQ ID NO: 2305112 - DNA, 17 bp, Homo sapiens
tgctgatggtgcaatga

SEQ ID NO: 2305113 - DNA, 23 bp, Homo sapiens
tgctgatggtgcaatgacctttc

SEQ ID NO: 2305114 - DNA, 12 bp, Homo sapiens
tgctgcacctct

SEQ ID NO: 2305115 - DNA, 21 bp, Homo sapiens
tgctgcccccagaccccatcc

SEQ ID NO: 2305116 - DNA, 14 bp, Homo sapiens
tgctgcctagaaac

SEQ ID NO: 2305117 - DNA, 14 bp, Homo sapiens
tgctgcctccaagt

SEQ ID NO: 2305118 - DNA, 13 bp, Homo sapiens
tgctgctcctcgg

SEQ ID NO: 2305119 - DNA, 20 bp, Homo sapiens
tgctgctcctcggccagagc

SEQ ID NO: 2305120 - DNA, 16 bp, Homo sapiens
tgctgctcgggaaggc

SEQ ID NO: 2305121 - DNA, 19 bp, Homo sapiens
tgctgctcgggaaggcctg

SEQ ID NO: 2305122 - DNA, 16 bp, Homo sapiens
tgctgtaagacggcct

SEQ ID NO: 2305123 - DNA, 13 bp, Homo sapiens
tgctgttgcttga

SEQ ID NO: 2305124 - DNA, 21 bp, Homo sapiens
tgctgtttaattcctggaaaa

SEQ ID NO: 2305125 - DNA, 12 bp, Homo sapiens
tgctgttttatg

SEQ ID NO: 2305126 - DNA, 17 bp, Homo sapiens
tgctgttttatgtcata

SEQ ID NO: 2305127 - DNA, 22 bp, Homo sapiens
tgctgttttatgtcatactctg

SEQ ID NO: 2305128 - DNA, 21 bp, Homo sapiens
tgcttaacataaacttgtact

SEQ ID NO: 2305129 - DNA, 22 bp, Homo sapiens
tgcttaacataaacttgtactt

SEQ ID NO: 2305130 - DNA, 19 bp, Homo sapiens
tgcttaaggaaaagagaaa

SEQ ID NO: 2305131 - DNA, 19 bp, Homo sapiens
tgcttatttatattcagag

SEQ ID NO: 2305132 - DNA, 12 bp, Homo sapiens
tgcttcaaggat

SEQ ID NO: 2305133 - DNA, 20 bp, Homo sapiens
tgcttctaagggatccagag

SEQ ID NO: 2305134 - DNA, 21 bp, Homo sapiens
tgcttctaagggatccagaga

SEQ ID NO: 2305135 - DNA, 12 bp, Homo sapiens
tgcttgaatagc

SEQ ID NO: 2305136 - DNA, 12 bp, Homo sapiens
ttactttcagaa

SEQ ID NO: 2305137 - DNA, 15 bp, Homo sapiens
ttacttttttaaaat

SEQ ID NO: 2305138 - DNA, 17 bp, Homo sapiens
ttagaatctattttcta

SEQ ID NO: 2305139 - DNA, 23 bp, Homo sapiens
ttagaatctattttctatgtact

SEQ ID NO: 2305140 - DNA, 18 bp, Homo sapiens
ttagagattaatttgtgt

SEQ ID NO: 2305141 - DNA, 22 bp, Homo sapiens
ttagagtatgcaagaagaatat

SEQ ID NO: 2305142 - DNA, 20 bp, Homo sapiens
ttagagtgcccttaaaataa

SEQ ID NO: 2305143 - DNA, 21 bp, Homo sapiens
ttagatgctattaaagtttca

SEQ ID NO: 2305144 - DNA, 14 bp, Homo sapiens
ttagcattattgcc

SEQ ID NO: 2305145 - DNA, 16 bp, Homo sapiens
ttagcattattgccaa

SEQ ID NO: 2305146 - DNA, 14 bp, Homo sapiens
ttagccagaatgtt

SEQ ID NO: 2305147 - DNA, 15 bp, Homo sapiens
ttagccagaatgttt

SEQ ID NO: 2305148 - DNA, 23 bp, Homo sapiens
ttagccagaatgtttcctgtgga

SEQ ID NO: 2305149 - DNA, 18 bp, Homo sapiens
ttagctgttggaatgttg

SEQ ID NO: 2305150 - DNA, 14 bp, Homo sapiens
ttaggaacagagta

SEQ ID NO: 2305151 - DNA, 17 bp, Homo sapiens
ttaggaacagagtatat

SEQ ID NO: 2305152 - DNA, 15 bp, Homo sapiens
ttagggcatttttct

SEQ ID NO: 2305153 - DNA, 16 bp, Homo sapiens
ttagggcatttttctt

SEQ ID NO: 2305154 - DNA, 18 bp, Homo sapiens
ttagggcatttttcttgg

SEQ ID NO: 2305155 - DNA, 14 bp, Homo sapiens
ttaggggaaaatag

SEQ ID NO: 2305156 - DNA, 16 bp, Homo sapiens
ttagtaatggcagagc

SEQ ID NO: 2305157 - DNA, 15 bp, Homo sapiens
ttagtatcctgttag

SEQ ID NO: 2305158 - DNA, 16 bp, Homo sapiens
ttagtccaatgaagat

SEQ ID NO: 2305159 - DNA, 17 bp, Homo sapiens
ttagtccaatgaagata

SEQ ID NO: 2305160 - DNA, 21 bp, Homo sapiens
ttataaaaattctagtctgtt

SEQ ID NO: 2305161 - DNA, 22 bp, Homo sapiens
ttataaaaattctagtctgttt

SEQ ID NO: 2305162 - DNA, 13 bp, Homo sapiens
ttataaatgtttc

SEQ ID NO: 2305163 - DNA, 17 bp, Homo sapiens
ttataaatgtttcatga

SEQ ID NO: 2305164 - DNA, 14 bp, Homo sapiens
ttataatatagaaa

SEQ ID NO: 2305165 - DNA, 20 bp, Homo sapiens
ttatactgtagcaatatatt

SEQ ID NO: 2305166 - DNA, 19 bp, Homo sapiens
tggcaggtggccagggctc

SEQ ID NO: 2305167 - DNA, 14 bp, Homo sapiens
tggcagtggcagag

SEQ ID NO: 2305168 - DNA, 22 bp, Homo sapiens
tggcatgggaatgaatgtcagt

SEQ ID NO: 2305169 - DNA, 14 bp, Homo sapiens
tggcatggtcctgt

SEQ ID NO: 2305170 - DNA, 17 bp, Homo sapiens
tggcatggtcctgtgcc

SEQ ID NO: 2305171 - DNA, 14 bp, Homo sapiens
tggcattttggctc

SEQ ID NO: 2305172 - DNA, 16 bp, Homo sapiens
tggcattttggctcag

SEQ ID NO: 2305173 - DNA, 19 bp, Homo sapiens
tggcattttggctcagagt

SEQ ID NO: 2305174 - DNA, 20 bp, Homo sapiens
tggcattttggctcagagtc

SEQ ID NO: 2305175 - DNA, 15 bp, Homo sapiens
tggccaaagtgtaca

SEQ ID NO: 2305176 - DNA, 14 bp, Homo sapiens
tggccaatgtgcat

SEQ ID NO: 2305177 - DNA, 16 bp, Homo sapiens
tggccactcctgggcc

SEQ ID NO: 2305178 - DNA, 15 bp, Homo sapiens
tggccactggccctg

SEQ ID NO: 2305179 - DNA, 17 bp, Homo sapiens
tggccactggccctgtt

SEQ ID NO: 2305180 - DNA, 18 bp, Homo sapiens
tggccactggccctgttt

SEQ ID NO: 2305181 - DNA, 12 bp, Homo sapiens
tggccccagctg

SEQ ID NO: 2305182 - DNA, 14 bp, Homo sapiens
tggccccagctggc

SEQ ID NO: 2305183 - DNA, 17 bp, Homo sapiens
tggccctgccctccccc

SEQ ID NO: 2305184 - DNA, 18 bp, Homo sapiens
tggccctgggccccgcct

SEQ ID NO: 2305185 - DNA, 16 bp, Homo sapiens
tggccgagtcagcacg

SEQ ID NO: 2305186 - DNA, 14 bp, Homo sapiens
tggccggctggccg

SEQ ID NO: 2305187 - DNA, 15 bp, Homo sapiens
tggccggtccacccc

SEQ ID NO: 2305188 - DNA, 13 bp, Homo sapiens
tggcctgctagcg

SEQ ID NO: 2305189 - DNA, 19 bp, Homo sapiens
tggccttgagcaagtccca

SEQ ID NO: 2305190 - DNA, 19 bp, Homo sapiens
tggcgcacccggcagcccc

SEQ ID NO: 2305191 - DNA, 23 bp, Homo sapiens
tggcgggaagggtgggccctgga

SEQ ID NO: 2305192 - DNA, 15 bp, Homo sapiens
tggcgggcagcccct

SEQ ID NO: 2305193 - DNA, 20 bp, Homo sapiens
tggcgggcagcccctgctgg

SEQ ID NO: 2305194 - DNA, 11 bp, Homo sapiens
tggctcagagt

SEQ ID NO: 2305195 - DNA, 13 bp, Homo sapiens
tggctcagagtcc

SEQ ID NO: 2305196 - DNA, 14 bp, Homo sapiens
tggctccaggagca

SEQ ID NO: 2305197 - DNA, 15 bp, Homo sapiens
tggctgaccaggccc

SEQ ID NO: 2305198 - DNA, 17 bp, Homo sapiens
tggctgaccaggccctg

SEQ ID NO: 2305199 - DNA, 19 bp, Homo sapiens
tggctgaccaggccctgct

SEQ ID NO: 2305200 - DNA, 20 bp, Homo sapiens
tggctgactaaatttgggga

SEQ ID NO: 2305201 - DNA, 18 bp, Homo sapiens
tggctgatttcaaatgca

SEQ ID NO: 2305202 - DNA, 21 bp, Homo sapiens
tggctgcagatgactggaaac

SEQ ID NO: 2305203 - DNA, 20 bp, Homo sapiens
tggctgtcctcttaagacac

SEQ ID NO: 2305204 - DNA, 15 bp, Homo sapiens
tggcttcagcccctg

SEQ ID NO: 2305205 - DNA, 17 bp, Homo sapiens
tggcttggagcagaggt

SEQ ID NO: 2305206 - DNA, 17 bp, Homo sapiens
tggctttcctgtttcta

SEQ ID NO: 2305207 - DNA, 18 bp, Homo sapiens
tgggaagttaccttttat

SEQ ID NO: 2305208 - DNA, 16 bp, Homo sapiens
tgggaatgaatgtcag

SEQ ID NO: 2305209 - DNA, 18 bp, Homo sapiens
tgggacacagagaccccc

SEQ ID NO: 2305210 - DNA, 21 bp, Homo sapiens
tgggaccctcggggcaggaag

SEQ ID NO: 2305211 - DNA, 14 bp, Homo sapiens
tgggagagtgaggt

SEQ ID NO: 2305212 - DNA, 16 bp, Homo sapiens
tgggagatgctgggac

SEQ ID NO: 2305213 - DNA, 17 bp, Homo sapiens
tgggagctgtcaggcag

SEQ ID NO: 2305214 - DNA, 15 bp, Homo sapiens
tgggagggggcaggg

SEQ ID NO: 2305215 - DNA, 16 bp, Homo sapiens
tgggaggtccaaggtc

SEQ ID NO: 2305216 - DNA, 15 bp, Homo sapiens
tgggatcattatttc

SEQ ID NO: 2305217 - DNA, 16 bp, Homo sapiens
tgggatgggcacaggc

SEQ ID NO: 2305218 - DNA, 18 bp, Homo sapiens
tgggatgggcacaggctg

SEQ ID NO: 2305219 - DNA, 14 bp, Homo sapiens
tgggcagggccctg

SEQ ID NO: 2305220 - DNA, 12 bp, Homo sapiens
tgggcagggccg

SEQ ID NO: 2305221 - DNA, 13 bp, Homo sapiens
tgggcagggccgc

SEQ ID NO: 2305222 - DNA, 16 bp, Homo sapiens
tgggcagggccgcagg

SEQ ID NO: 2305223 - DNA, 17 bp, Homo sapiens
tgggcatccccagcccc

SEQ ID NO: 2305224 - DNA, 20 bp, Homo sapiens
tgggcatccccagccccctg

SEQ ID NO: 2305225 - DNA, 22 bp, Homo sapiens
tgggcatccccagccccctggc

SEQ ID NO: 2305226 - DNA, 13 bp, Homo sapiens
tgggccagggtct

SEQ ID NO: 2305227 - DNA, 13 bp, Homo sapiens
tgggccccgcctc

SEQ ID NO: 2305228 - DNA, 20 bp, Homo sapiens
tgggccctggttcccccagg

SEQ ID NO: 2305229 - DNA, 21 bp, Homo sapiens
tgggcctcccgtccgtccgcc

SEQ ID NO: 2305230 - DNA, 11 bp, Homo sapiens
tgggctctgcg

SEQ ID NO: 2305231 - DNA, 16 bp, Homo sapiens
tgggctggataaatat

SEQ ID NO: 2305232 - DNA, 23 bp, Homo sapiens
tggggaggagactcaggcccaca

SEQ ID NO: 2305233 - DNA, 16 bp, Homo sapiens
tggggagggcctctgg

SEQ ID NO: 2305234 - DNA, 23 bp, Homo sapiens
tggggcaatgactttcctagaca

SEQ ID NO: 2305235 - DNA, 20 bp, Homo sapiens
tggggcactgtttcttctca

SEQ ID NO: 2305236 - DNA, 13 bp, Homo sapiens
tggggccagcccc

SEQ ID NO: 2305237 - DNA, 19 bp, Homo sapiens
tggggccagcccctccccg

SEQ ID NO: 2305238 - DNA, 19 bp, Homo sapiens
tggggcccatggccccagc

SEQ ID NO: 2305239 - DNA, 23 bp, Homo sapiens
tggggctgtatttttgaaatact

SEQ ID NO: 2305240 - DNA, 20 bp, Homo sapiens
tggggcttttgtgccaggag

SEQ ID NO: 2305241 - DNA, 15 bp, Homo sapiens
tgggggaggcttcca

SEQ ID NO: 2305242 - DNA, 16 bp, Homo sapiens
tgggggcagcggcccc

SEQ ID NO: 2305243 - DNA, 18 bp, Homo sapiens
tgggggctcctggcagtg

SEQ ID NO: 2305244 - DNA, 15 bp, Homo sapiens
tggggtcccccctcc

SEQ ID NO: 2305245 - DNA, 17 bp, Homo sapiens
tggggtctctgagcagt

SEQ ID NO: 2305246 - DNA, 20 bp, Homo sapiens
tggggtgggagggggcaggg

SEQ ID NO: 2305247 - DNA, 16 bp, Homo sapiens
tggggtttccacacag

SEQ ID NO: 2305248 - DNA, 20 bp, Homo sapiens
tggggtttccacacaggccc

SEQ ID NO: 2305249 - DNA, 21 bp, Homo sapiens
tgggtaaaagcagggcagcag

SEQ ID NO: 2305250 - DNA, 20 bp, Homo sapiens
tgggtatttcttatttgaaa

SEQ ID NO: 2305251 - DNA, 15 bp, Homo sapiens
tgggtcctgctgctc

SEQ ID NO: 2305252 - DNA, 13 bp, Homo sapiens
tgggtcgcccctc

SEQ ID NO: 2305253 - DNA, 17 bp, Homo sapiens
tgggtgggacacagaga

SEQ ID NO: 2305254 - DNA, 16 bp, Homo sapiens
tgggttttagaaattc

SEQ ID NO: 2305255 - DNA, 18 bp, Homo sapiens
tgggttttagaaattcta

SEQ ID NO: 2305256 - DNA, 14 bp, Homo sapiens
tggtaatgtgtcaa

SEQ ID NO: 2305257 - DNA, 18 bp, Homo sapiens
tggtattttggcattttg

SEQ ID NO: 2305258 - DNA, 15 bp, Homo sapiens
tggtcacagacccct

SEQ ID NO: 2305259 - DNA, 15 bp, Homo sapiens
tggtcacccccaccc

SEQ ID NO: 2305260 - DNA, 20 bp, Homo sapiens
tggtcagcgattcctgccaa

SEQ ID NO: 2305261 - DNA, 23 bp, Homo sapiens
tggtcagcgattcctgccaagta

SEQ ID NO: 2305262 - DNA, 19 bp, Homo sapiens
tggtcagttttcacagagg

SEQ ID NO: 2305263 - DNA, 17 bp, Homo sapiens
tggtcctgcctaaattt

SEQ ID NO: 2305264 - DNA, 19 bp, Homo sapiens
tggtcgtaaacatctcaga

SEQ ID NO: 2305265 - DNA, 20 bp, Homo sapiens
tggtctcgtgttcgctggct

SEQ ID NO: 2305266 - DNA, 21 bp, Homo sapiens
tggtctcgtgttcgctggctg

SEQ ID NO: 2305267 - DNA, 19 bp, Homo sapiens
tggtcttgaactcttggcc

SEQ ID NO: 2305268 - DNA, 14 bp, Homo sapiens
tggtgagaggcatc

SEQ ID NO: 2305269 - DNA, 19 bp, Homo sapiens
tggtgaggacctgcggcct

SEQ ID NO: 2305270 - DNA, 23 bp, Homo sapiens
tggtgaggacctgcggccttggg

SEQ ID NO: 2305271 - DNA, 15 bp, Homo sapiens
tggtgtcgggcatga

SEQ ID NO: 2305272 - DNA, 19 bp, Homo sapiens
tggtgtcgggcatgacacg

SEQ ID NO: 2305273 - DNA, 13 bp, Homo sapiens
tggtgtgaaaatg

SEQ ID NO: 2305274 - DNA, 13 bp, Homo sapiens
tggtgtgaggccc

SEQ ID NO: 2305275 - DNA, 14 bp, Homo sapiens
tggtgtgaggcccc

SEQ ID NO: 2305276 - DNA, 15 bp, Homo sapiens
tggttacaaattttt

SEQ ID NO: 2305277 - DNA, 16 bp, Homo sapiens
tggttattttctccat

SEQ ID NO: 2305278 - DNA, 23 bp, Homo sapiens
tggttattttctccatgtctgta

SEQ ID NO: 2305279 - DNA, 21 bp, Homo sapiens
tggttcccccaggaccctgag

SEQ ID NO: 2305280 - DNA, 17 bp, Homo sapiens
tggttcgggggaaatag

SEQ ID NO: 2305281 - DNA, 15 bp, Homo sapiens
tggttgagaaacatt

SEQ ID NO: 2305282 - DNA, 12 bp, Homo sapiens
tggtttgcatga

SEQ ID NO: 2305283 - DNA, 12 bp, Homo sapiens
tggttttcatta

SEQ ID NO: 2305284 - DNA, 11 bp, Homo sapiens
tgtaaatgtta

SEQ ID NO: 2305285 - DNA, 21 bp, Homo sapiens
tgtaaatgttatttctgcaaa

SEQ ID NO: 2305286 - DNA, 16 bp, Homo sapiens
tgtaaattcctgttgt

SEQ ID NO: 2305287 - DNA, 20 bp, Homo sapiens
tgtaaatttaactgcatata

SEQ ID NO: 2305288 - DNA, 22 bp, Homo sapiens
tgtaacagttggtgattttaga

SEQ ID NO: 2305289 - DNA, 14 bp, Homo sapiens
tgtaacatttcaca

SEQ ID NO: 2305290 - DNA, 23 bp, Homo sapiens
tgtaaccatatgattgaaaagaa

SEQ ID NO: 2305291 - DNA, 23 bp, Homo sapiens
tgtaactgttctttgcagtgaag

SEQ ID NO: 2305292 - DNA, 16 bp, Homo sapiens
tgtaagacggccttgg

SEQ ID NO: 2305293 - DNA, 13 bp, Homo sapiens
tgtaagagaattc

SEQ ID NO: 2305294 - DNA, 14 bp, Homo sapiens
tgtaagaggatgtg

SEQ ID NO: 2305295 - DNA, 15 bp, Homo sapiens
tgtaaggaatgatta

SEQ ID NO: 2305296 - DNA, 14 bp, Homo sapiens
tgtaagggctttaa

SEQ ID NO: 2305297 - DNA, 22 bp, Homo sapiens
tgtaagtgctacataaattggc

SEQ ID NO: 2305298 - DNA, 22 bp, Homo sapiens
tgtaagttatgtgttaaattta

SEQ ID NO: 2305299 - DNA, 22 bp, Homo sapiens
tgtaatattttgtattattgct

SEQ ID NO: 2305300 - DNA, 14 bp, Homo sapiens
tgtaatcatttatc

SEQ ID NO: 2305301 - DNA, 15 bp, Homo sapiens
tgtaatctctgatta

SEQ ID NO: 2305302 - DNA, 19 bp, Homo sapiens
tgtaatgcactcctgcccc

SEQ ID NO: 2305303 - DNA, 17 bp, Homo sapiens
tgtaatgtatcttattt

SEQ ID NO: 2305304 - DNA, 13 bp, Homo sapiens
tgtacagaaaata

SEQ ID NO: 2305305 - DNA, 14 bp, Homo sapiens
tgtacagaaaatag

SEQ ID NO: 2305306 - DNA, 15 bp, Homo sapiens
tgtacagaaacaact

SEQ ID NO: 2305307 - DNA, 16 bp, Homo sapiens
tgtacagaaacaactg

SEQ ID NO: 2305308 - DNA, 21 bp, Homo sapiens
tgtacagaaccagcactccca

SEQ ID NO: 2305309 - DNA, 22 bp, Homo sapiens
tgtacagaaccagcactcccag

SEQ ID NO: 2305310 - DNA, 21 bp, Homo sapiens
tgtacatatggaaatcctgtt

SEQ ID NO: 2305311 - DNA, 16 bp, Homo sapiens
tgtacatttgatttga

SEQ ID NO: 2305312 - DNA, 24 bp, Homo sapiens
tgtacatttgatttgatatacaga

SEQ ID NO: 2305313 - DNA, 13 bp, Homo sapiens
tgtaccatatgta

SEQ ID NO: 2305314 - DNA, 14 bp, Homo sapiens
tgtaccatatgtag

SEQ ID NO: 2305315 - DNA, 17 bp, Homo sapiens
tgtaccatatgtagcat

SEQ ID NO: 2305316 - DNA, 18 bp, Homo sapiens
tgtaccatatgtagcatt

SEQ ID NO: 2305317 - DNA, 13 bp, Homo sapiens
tgtaccatgttaa

SEQ ID NO: 2305318 - DNA, 18 bp, Homo sapiens
tgtaccatgttgcccaga

SEQ ID NO: 2305319 - DNA, 17 bp, Homo sapiens
tgtaccctatgttcact

SEQ ID NO: 2305320 - DNA, 22 bp, Homo sapiens
tgtaccttgtgtactttcttcc

SEQ ID NO: 2305321 - DNA, 22 bp, Homo sapiens
tgtactacacttctgaaactta

SEQ ID NO: 2305322 - DNA, 16 bp, Homo sapiens
tgtactagtactgtgt

SEQ ID NO: 2305323 - DNA, 21 bp, Homo sapiens
tgtactagtactgtgtactgt

SEQ ID NO: 2305324 - DNA, 14 bp, Homo sapiens
tgtagacaaaactt

SEQ ID NO: 2305325 - DNA, 16 bp, Homo sapiens
tgtagatatatatttc

SEQ ID NO: 2305326 - DNA, 13 bp, Homo sapiens
tgtagatattatg

SEQ ID NO: 2305327 - DNA, 22 bp, Homo sapiens
tgtagatattatgtatagaaaa

SEQ ID NO: 2305328 - DNA, 23 bp, Homo sapiens
tgtagatattatgtatagaaaat

SEQ ID NO: 2305329 - DNA, 17 bp, Homo sapiens
tgtagatgtattttcaa

SEQ ID NO: 2305330 - DNA, 21 bp, Homo sapiens
tgtagcaagtactttggctta

SEQ ID NO: 2305331 - DNA, 13 bp, Homo sapiens
tgtagcaatatat

SEQ ID NO: 2305332 - DNA, 18 bp, Homo sapiens
tgtagcaatatatttgta

SEQ ID NO: 2305333 - DNA, 15 bp, Homo sapiens
tgtagcattaaatat

SEQ ID NO: 2305334 - DNA, 16 bp, Homo sapiens
tgtagcattaaatata

SEQ ID NO: 2305335 - DNA, 17 bp, Homo sapiens
tgtagcattaaatataa

SEQ ID NO: 2305336 - DNA, 21 bp, Homo sapiens
tgtagcattaaatataaaata

SEQ ID NO: 2305337 - DNA, 15 bp, Homo sapiens
tgtaggtcaatgaaa

SEQ ID NO: 2305338 - DNA, 23 bp, Homo sapiens
tgtataacaagccaaacattctt

SEQ ID NO: 2305339 - DNA, 23 bp, Homo sapiens
tgtataccccgtgaagcatccag

SEQ ID NO: 2305340 - DNA, 12 bp, Homo sapiens
tgtatagaaaat

SEQ ID NO: 2305341 - DNA, 18 bp, Homo sapiens
tgtatagaaaataaaata

SEQ ID NO: 2305342 - DNA, 22 bp, Homo sapiens
tgtatagaaaataaaataaatt

SEQ ID NO: 2305343 - DNA, 17 bp, Homo sapiens
tgtatagacagtttgta

SEQ ID NO: 2305344 - DNA, 22 bp, Homo sapiens
tgtatagacagtttgtaaatgt

SEQ ID NO: 2305345 - DNA, 18 bp, Homo sapiens
tgtatatatttattattt

SEQ ID NO: 2305346 - DNA, 13 bp, Homo sapiens
tgtatatctgtaa

SEQ ID NO: 2305347 - DNA, 13 bp, Homo sapiens
tgtatatgttatt

SEQ ID NO: 2305348 - DNA, 13 bp, Homo sapiens
tgtatattattgc

SEQ ID NO: 2305349 - DNA, 23 bp, Homo sapiens
tgtatattattgctatatttgct

SEQ ID NO: 2305350 - DNA, 22 bp, Homo sapiens
tgtatccaacaagccagaatca

SEQ ID NO: 2305351 - DNA, 21 bp, Homo sapiens
tgtatcctggcaaataatact

SEQ ID NO: 2305352 - DNA, 13 bp, Homo sapiens
tgtatctaaaaaa

SEQ ID NO: 2305353 - DNA, 13 bp, Homo sapiens
tgtatcttattta

SEQ ID NO: 2305354 - DNA, 18 bp, Homo sapiens
tgtatcttatttatatat

SEQ ID NO: 2305355 - DNA, 14 bp, Homo sapiens
tgtattattgctgt

SEQ ID NO: 2305356 - DNA, 19 bp, Homo sapiens
tgtattctgtggattctat

SEQ ID NO: 2305357 - DNA, 22 bp, Homo sapiens
tgtattcttttatataactaca

SEQ ID NO: 2305358 - DNA, 12 bp, Homo sapiens
tgtatttaaaga

SEQ ID NO: 2305359 - DNA, 22 bp, Homo sapiens
tgtatttcaaaccagtttcaca

SEQ ID NO: 2305360 - DNA, 13 bp, Homo sapiens
tgtattttaataa

SEQ ID NO: 2305361 - DNA, 18 bp, Homo sapiens
tgtattttaataaagatt

SEQ ID NO: 2305362 - DNA, 16 bp, Homo sapiens
tgtattttcaataaag

SEQ ID NO: 2305363 - DNA, 21 bp, Homo sapiens
tgtattttcttcccatttgta

SEQ ID NO: 2305364 - DNA, 23 bp, Homo sapiens
tgtatttttagagattaatttgt

SEQ ID NO: 2305365 - DNA, 14 bp, Homo sapiens
tgtcaaagtggtga

SEQ ID NO: 2305366 - DNA, 14 bp, Homo sapiens
tgtcaattacagga

SEQ ID NO: 2305367 - DNA, 19 bp, Homo sapiens
tgtcaattacaggaagtac

SEQ ID NO: 2305368 - DNA, 13 bp, Homo sapiens
tgtcactcacaaa

SEQ ID NO: 2305369 - DNA, 21 bp, Homo sapiens
tgtcagaaggagacagaatga

SEQ ID NO: 2305370 - DNA, 22 bp, Homo sapiens
tgtcagaaggagacagaatgag

SEQ ID NO: 2305371 - DNA, 14 bp, Homo sapiens
tgtcagagaatatg

SEQ ID NO: 2305372 - DNA, 16 bp, Homo sapiens
tgtcatactctgtgta

SEQ ID NO: 2305373 - DNA, 17 bp, Homo sapiens
tgtcatactctgtgtaa

SEQ ID NO: 2305374 - DNA, 18 bp, Homo sapiens
tgtcatactctgtgtaat

SEQ ID NO: 2305375 - DNA, 20 bp, Homo sapiens
tgtcatactctgtgtaatct

SEQ ID NO: 2305376 - DNA, 21 bp, Homo sapiens
tgtcatgaaagcacctgccct

SEQ ID NO: 2305377 - DNA, 21 bp, Homo sapiens
tgtccacagtgattagcctcg

SEQ ID NO: 2305378 - DNA, 19 bp, Homo sapiens
tgtccactctgctcagggc

SEQ ID NO: 2305379 - DNA, 19 bp, Homo sapiens
tgtccataagagaaatggt

SEQ ID NO: 2305380 - DNA, 15 bp, Homo sapiens
tgtcccacaaaatat

SEQ ID NO: 2305381 - DNA, 19 bp, Homo sapiens
tgtcccacaaaatatttct

SEQ ID NO: 2305382 - DNA, 19 bp, Homo sapiens
tgtcccatgggctctggcc

SEQ ID NO: 2305383 - DNA, 16 bp, Homo sapiens
tgtccccaggggcaca

SEQ ID NO: 2305384 - DNA, 22 bp, Homo sapiens
tgtccccaggggcacacttccc

SEQ ID NO: 2305385 - DNA, 14 bp, Homo sapiens
tgtccccattctat

SEQ ID NO: 2305386 - DNA, 22 bp, Homo sapiens
tgtccccattctataaattcaa

SEQ ID NO: 2305387 - DNA, 23 bp, Homo sapiens
tgtcccttacgtgagtcctggca

SEQ ID NO: 2305388 - DNA, 18 bp, Homo sapiens
tgtcctcttaagacacta

SEQ ID NO: 2305389 - DNA, 12 bp, Homo sapiens
tgtctactgctt

SEQ ID NO: 2305390 - DNA, 21 bp, Homo sapiens
tgtctagtttgcatacttcct

SEQ ID NO: 2305391 - DNA, 22 bp, Homo sapiens
tgtctagtttgcatacttcctg

SEQ ID NO: 2305392 - DNA, 16 bp, Homo sapiens
tgtctatgaactagag

SEQ ID NO: 2305393 - DNA, 11 bp, Homo sapiens
tgtctccattg

SEQ ID NO: 2305394 - DNA, 20 bp, Homo sapiens
tgtctgatagagtttaacag

SEQ ID NO: 2305395 - DNA, 10 bp, Homo sapiens
tgtctgctgc

SEQ ID NO: 2305396 - DNA, 14 bp, Homo sapiens
tgtctggctgtacg

SEQ ID NO: 2305397 - DNA, 15 bp, Homo sapiens
tgtctggctgtacgt

SEQ ID NO: 2305398 - DNA, 18 bp, Homo sapiens
tgtcttagggaattctga

SEQ ID NO: 2305399 - DNA, 18 bp, Homo sapiens
tgtcttgtaatattttgt

SEQ ID NO: 2305400 - DNA, 21 bp, Homo sapiens
tgtgaccatcatttcccaggc

SEQ ID NO: 2305401 - DNA, 16 bp, Homo sapiens
tgtgaccggggtcctg

SEQ ID NO: 2305402 - DNA, 20 bp, Homo sapiens
tgtgactcgcttagctgaaa

SEQ ID NO: 2305403 - DNA, 15 bp, Homo sapiens
tgtgatcccagctca

SEQ ID NO: 2305404 - DNA, 15 bp, Homo sapiens
tgtgatctgtcttgt

SEQ ID NO: 2305405 - DNA, 19 bp, Homo sapiens
tgtgattccccggagctgg

SEQ ID NO: 2305406 - DNA, 17 bp, Homo sapiens
tgtgcaaaataaaatga

SEQ ID NO: 2305407 - DNA, 15 bp, Homo sapiens
tgtgcaatatgtaac

SEQ ID NO: 2305408 - DNA, 16 bp, Homo sapiens
tgtgcaatatgtaaca

SEQ ID NO: 2305409 - DNA, 22 bp, Homo sapiens
tgtgcagacactcaagagccct

SEQ ID NO: 2305410 - DNA, 17 bp, Homo sapiens
tgtgccaaaatgtcaat

SEQ ID NO: 2305411 - DNA, 18 bp, Homo sapiens
tgtgccaaagatagcaga

SEQ ID NO: 2305412 - DNA, 15 bp, Homo sapiens
tgtgcgttttagagt

SEQ ID NO: 2305413 - DNA, 17 bp, Homo sapiens
tgtgctctcctagagct

SEQ ID NO: 2305414 - DNA, 20 bp, Homo sapiens
tgtgctcttatccccagctg

SEQ ID NO: 2305415 - DNA, 12 bp, Homo sapiens
tgtgcttatgtt

SEQ ID NO: 2305416 - DNA, 15 bp, Homo sapiens
tgtgcttatgttttt

SEQ ID NO: 2305417 - DNA, 13 bp, Homo sapiens
tgtggaaatggga

SEQ ID NO: 2305418 - DNA, 16 bp, Homo sapiens
tgtggaacactaaaga

SEQ ID NO: 2305419 - DNA, 17 bp, Homo sapiens
tgtggaacactaaagag

SEQ ID NO: 2305420 - DNA, 11 bp, Homo sapiens
tgtggagctgc

SEQ ID NO: 2305421 - DNA, 18 bp, Homo sapiens
tgtggagctgcttccagt

SEQ ID NO: 2305422 - DNA, 16 bp, Homo sapiens
tgtggattctatattt

SEQ ID NO: 2305423 - DNA, 21 bp, Homo sapiens
tgtggattctatatttcatat

SEQ ID NO: 2305424 - DNA, 20 bp, Homo sapiens
tgtggcctcattcagcagaa

SEQ ID NO: 2305425 - DNA, 18 bp, Homo sapiens
tgtggcgggaagggtggg

SEQ ID NO: 2305426 - DNA, 20 bp, Homo sapiens
tgtggctcaacacatgagaa

SEQ ID NO: 2305427 - DNA, 17 bp, Homo sapiens
tgtggctccaagctcag

SEQ ID NO: 2305428 - DNA, 18 bp, Homo sapiens
tgtggctccaggagcagc

SEQ ID NO: 2305429 - DNA, 19 bp, Homo sapiens
tgtggctcgggtgcccagg

SEQ ID NO: 2305430 - DNA, 22 bp, Homo sapiens
tgtggctgatttcaaatgcagt

SEQ ID NO: 2305431 - DNA, 14 bp, Homo sapiens
tgtggtattttggc

SEQ ID NO: 2305432 - DNA, 17 bp, Homo sapiens
tgtggtattttggcatt

SEQ ID NO: 2305433 - DNA, 24 bp, Homo sapiens
tgtggttattttctccatgtctgt

SEQ ID NO: 2305434 - DNA, 12 bp, Homo sapiens
tgtgtaactgtt

SEQ ID NO: 2305435 - DNA, 14 bp, Homo sapiens
tgtgtaactgttct

SEQ ID NO: 2305436 - DNA, 16 bp, Homo sapiens
tgtgtaatctctgatt

SEQ ID NO: 2305437 - DNA, 19 bp, Homo sapiens
tgtgtactgtatagacagt

SEQ ID NO: 2305438 - DNA, 13 bp, Homo sapiens
tgtgtattctgtg

SEQ ID NO: 2305439 - DNA, 11 bp, Homo sapiens
tattatctgaa

SEQ ID NO: 2305440 - DNA, 14 bp, Homo sapiens
tattatgaataaaa

SEQ ID NO: 2305441 - DNA, 18 bp, Homo sapiens
tattatggtgatactcca

SEQ ID NO: 2305442 - DNA, 17 bp, Homo sapiens
tattattttaaaaattg

SEQ ID NO: 2305443 - DNA, 21 bp, Homo sapiens
tattcaggaccccatctgctg

SEQ ID NO: 2305444 - DNA, 24 bp, Homo sapiens
tattcaggaccccatctgctgagc

SEQ ID NO: 2305445 - DNA, 16 bp, Homo sapiens
tattcatctgttgaca

SEQ ID NO: 2305446 - DNA, 21 bp, Homo sapiens
tattcattacatcctctgctt

SEQ ID NO: 2305447 - DNA, 20 bp, Homo sapiens
tattctagtcaactgctgtt

SEQ ID NO: 2305448 - DNA, 21 bp, Homo sapiens
tattctagtcaactgctgttt

SEQ ID NO: 2305449 - DNA, 16 bp, Homo sapiens
tattctgtggattcta

SEQ ID NO: 2305450 - DNA, 17 bp, Homo sapiens
tattctgtggattctat

SEQ ID NO: 2305451 - DNA, 18 bp, Homo sapiens
tattctgtggattctata

SEQ ID NO: 2305452 - DNA, 20 bp, Homo sapiens
tattctgtggattctatatt

SEQ ID NO: 2305453 - DNA, 17 bp, Homo sapiens
tattcttccaagttcat

SEQ ID NO: 2305454 - DNA, 16 bp, Homo sapiens
tattcttgctttcaca

SEQ ID NO: 2305455 - DNA, 18 bp, Homo sapiens
tattcttttatataacta

SEQ ID NO: 2305456 - DNA, 21 bp, Homo sapiens
tattgagtaatattacatttc

SEQ ID NO: 2305457 - DNA, 22 bp, Homo sapiens
tattgagtaatattacatttca

SEQ ID NO: 2305458 - DNA, 18 bp, Homo sapiens
tattgatagatgcaagag

SEQ ID NO: 2305459 - DNA, 20 bp, Homo sapiens
tattgcctctgtcttaaaga

SEQ ID NO: 2305460 - DNA, 15 bp, Homo sapiens
tattgtgctgttcta

SEQ ID NO: 2305461 - DNA, 21 bp, Homo sapiens
tatttaaaaagctgactactt

SEQ ID NO: 2305462 - DNA, 14 bp, Homo sapiens
tatttaaatttagt

SEQ ID NO: 2305463 - DNA, 20 bp, Homo sapiens
tatttaactaattaaaaaat

SEQ ID NO: 2305464 - DNA, 20 bp, Homo sapiens
tatttaattatattatgaat

SEQ ID NO: 2305465 - DNA, 22 bp, Homo sapiens
tatttaattatattatgaataa

SEQ ID NO: 2305466 - DNA, 13 bp, Homo sapiens
tatttatatatga

SEQ ID NO: 2305467 - DNA, 16 bp, Homo sapiens
tatttatgttctcaac

SEQ ID NO: 2305468 - DNA, 22 bp, Homo sapiens
tatttattaccgataaatgaac

SEQ ID NO: 2305469 - DNA, 22 bp, Homo sapiens
tatttattcatgtgtacagaaa

SEQ ID NO: 2305470 - DNA, 14 bp, Homo sapiens
tatttcaggattct

SEQ ID NO: 2305471 - DNA, 15 bp, Homo sapiens
tatttcatattgaga

SEQ ID NO: 2305472 - DNA, 17 bp, Homo sapiens
tatttctaagcttattt

SEQ ID NO: 2305473 - DNA, 22 bp, Homo sapiens
tatttctaagcttatttctaac

SEQ ID NO: 2305474 - DNA, 16 bp, Homo sapiens
tatttcttatttgaaa

SEQ ID NO: 2305475 - DNA, 17 bp, Homo sapiens
tatttgaagactgattt

SEQ ID NO: 2305476 - DNA, 13 bp, Homo sapiens
tatttgcttattt

SEQ ID NO: 2305477 - DNA, 16 bp, Homo sapiens
tatttgcttatttata

SEQ ID NO: 2305478 - DNA, 21 bp, Homo sapiens
tatttgtaggtatactatgta

SEQ ID NO: 2305479 - DNA, 22 bp, Homo sapiens
tatttgtaggtatactatgtaa

SEQ ID NO: 2305480 - DNA, 14 bp, Homo sapiens
tattttaaaattca

SEQ ID NO: 2305481 - DNA, 15 bp, Homo sapiens
tattttaaaattcat

SEQ ID NO: 2305482 - DNA, 13 bp, Homo sapiens
tattttaataaag

SEQ ID NO: 2305483 - DNA, 16 bp, Homo sapiens
tattttaatctcagaa

SEQ ID NO: 2305484 - DNA, 21 bp, Homo sapiens
tattttatcacttgccgtgtc

SEQ ID NO: 2305485 - DNA, 15 bp, Homo sapiens
tattttatctgtgtt

SEQ ID NO: 2305486 - DNA, 22 bp, Homo sapiens
tattttcagtgctttgcccttg

SEQ ID NO: 2305487 - DNA, 16 bp, Homo sapiens
tattttcataattcat

SEQ ID NO: 2305488 - DNA, 20 bp, Homo sapiens
tattttcataattcatttaa

SEQ ID NO: 2305489 - DNA, 21 bp, Homo sapiens
tattttcccacaattcttttg

SEQ ID NO: 2305490 - DNA, 20 bp, Homo sapiens
tattttcgtgcatttgtgag

SEQ ID NO: 2305491 - DNA, 17 bp, Homo sapiens
tattttctatgtactag

SEQ ID NO: 2305492 - DNA, 13 bp, Homo sapiens
tattttctgaatt

SEQ ID NO: 2305493 - DNA, 20 bp, Homo sapiens
tattttctgaattcataaaa

SEQ ID NO: 2305494 - DNA, 18 bp, Homo sapiens
tattttcttcccatttgt

SEQ ID NO: 2305495 - DNA, 22 bp, Homo sapiens
tattttgcaagctctggaattg

SEQ ID NO: 2305496 - DNA, 16 bp, Homo sapiens
tattttgtcataaaat

SEQ ID NO: 2305497 - DNA, 22 bp, Homo sapiens
tattttgtcataaaatgctatt

SEQ ID NO: 2305498 - DNA, 14 bp, Homo sapiens
tattttttactaca

SEQ ID NO: 2305499 - DNA, 16 bp, Homo sapiens
tatttttttctagcta

SEQ ID NO: 2305500 - DNA, 16 bp, Homo sapiens
tcaaaagtccttagaa

SEQ ID NO: 2305501 - DNA, 15 bp, Homo sapiens
tcaaaatagttctat

SEQ ID NO: 2305502 - DNA, 16 bp, Homo sapiens
tcaaaatagttctatt

SEQ ID NO: 2305503 - DNA, 17 bp, Homo sapiens
tcaaaatagttctattt

SEQ ID NO: 2305504 - DNA, 18 bp, Homo sapiens
tcaaaatagttctatttc

SEQ ID NO: 2305505 - DNA, 20 bp, Homo sapiens
tcaaaatagttctatttcta

SEQ ID NO: 2305506 - DNA, 22 bp, Homo sapiens
tcaaaatagttctatttctatc

SEQ ID NO: 2305507 - DNA, 15 bp, Homo sapiens
tcaaagacatttcat

SEQ ID NO: 2305508 - DNA, 21 bp, Homo sapiens
tcaaagagatgaggaaataag

SEQ ID NO: 2305509 - DNA, 19 bp, Homo sapiens
tcaaagatacaagaaaaag

SEQ ID NO: 2305510 - DNA, 18 bp, Homo sapiens
tcaaagctttcctgtttc

SEQ ID NO: 2305511 - DNA, 22 bp, Homo sapiens
tcaaagggtaaattataaatgt

SEQ ID NO: 2305512 - DNA, 14 bp, Homo sapiens
tcaaataataataa

SEQ ID NO: 2305513 - DNA, 20 bp, Homo sapiens
tcaaatgagtttaaaaaaat

SEQ ID NO: 2305514 - DNA, 20 bp, Homo sapiens
tcaaatgattcatttttctg

SEQ ID NO: 2305515 - DNA, 23 bp, Homo sapiens
tcaaatgcagtccagtgagaaat

SEQ ID NO: 2305516 - DNA, 15 bp, Homo sapiens
tcaaatgctaaatgc

SEQ ID NO: 2305517 - DNA, 16 bp, Homo sapiens
tcaaatgctaaatgca

SEQ ID NO: 2305518 - DNA, 18 bp, Homo sapiens
tcaacacttattttctga

SEQ ID NO: 2305519 - DNA, 18 bp, Homo sapiens
tcaaccaactgtaatgca

SEQ ID NO: 2305520 - DNA, 16 bp, Homo sapiens
tcaacttaattctgtt

SEQ ID NO: 2305521 - DNA, 13 bp, Homo sapiens
tcaactttttcct

SEQ ID NO: 2305522 - DNA, 16 bp, Homo sapiens
tcaagaacaaacagaa

SEQ ID NO: 2305523 - DNA, 13 bp, Homo sapiens
tcaaggaagagcc

SEQ ID NO: 2305524 - DNA, 17 bp, Homo sapiens
tcaaggaagagccagcc

SEQ ID NO: 2305525 - DNA, 13 bp, Homo sapiens
tcaaggatcctga

SEQ ID NO: 2305526 - DNA, 16 bp, Homo sapiens
tcaaggatcctgagcc

SEQ ID NO: 2305527 - DNA, 20 bp, Homo sapiens
tcaaggatcctgagccagat

SEQ ID NO: 2305528 - DNA, 23 bp, Homo sapiens
tcaaggatcctgagccagatttc

SEQ ID NO: 2305529 - DNA, 17 bp, Homo sapiens
tcaaggcaccagcaaat

SEQ ID NO: 2305530 - DNA, 19 bp, Homo sapiens
tcaaggcagttgcttgtgt

SEQ ID NO: 2305531 - DNA, 12 bp, Homo sapiens
tcaataaagaaa

SEQ ID NO: 2305532 - DNA, 19 bp, Homo sapiens
tcaataaagaaaaaaatag

SEQ ID NO: 2305533 - DNA, 14 bp, Homo sapiens
tcaataacttagaa

SEQ ID NO: 2305534 - DNA, 13 bp, Homo sapiens
tcaataagtgttg

SEQ ID NO: 2305535 - DNA, 18 bp, Homo sapiens
tcaataagtgttgtacca

SEQ ID NO: 2305536 - DNA, 23 bp, Homo sapiens
tcaatacttttgtgtattctgtg

SEQ ID NO: 2305537 - DNA, 18 bp, Homo sapiens
tcaataggaaaaactgat

SEQ ID NO: 2305538 - DNA, 15 bp, Homo sapiens
tcaatgtactgtatt

SEQ ID NO: 2305539 - DNA, 21 bp, Homo sapiens
tcaatgtactgtattgggacg

SEQ ID NO: 2305540 - DNA, 12 bp, Homo sapiens
tcaatgtgaaat

SEQ ID NO: 2305541 - DNA, 13 bp, Homo sapiens
tcaatgtgaaata

SEQ ID NO: 2305542 - DNA, 21 bp, Homo sapiens
tcaatgtgaaataaagagttc

SEQ ID NO: 2305543 - DNA, 19 bp, Homo sapiens
tcaattacaggaagtactg

SEQ ID NO: 2305544 - DNA, 23 bp, Homo sapiens
tcaattacaggaagtactggaga

SEQ ID NO: 2305545 - DNA, 16 bp, Homo sapiens
tcaattcatatttatg

SEQ ID NO: 2305546 - DNA, 20 bp, Homo sapiens
tcaattcattaataaaatac

SEQ ID NO: 2305547 - DNA, 22 bp, Homo sapiens
tcaatttttaacttatctccag

SEQ ID NO: 2305548 - DNA, 12 bp, Homo sapiens
tcacaaaatgca

SEQ ID NO: 2305549 - DNA, 12 bp, Homo sapiens
tcacaactgttt

SEQ ID NO: 2305550 - DNA, 13 bp, Homo sapiens
tcacaactgtttt

SEQ ID NO: 2305551 - DNA, 13 bp, Homo sapiens
tcacactatttta

SEQ ID NO: 2305552 - DNA, 18 bp, Homo sapiens
tcacactgtggaacacta

SEQ ID NO: 2305553 - DNA, 16 bp, Homo sapiens
tcacacttgcaaatga

SEQ ID NO: 2305554 - DNA, 18 bp, Homo sapiens
tcacagaatctccatttc

SEQ ID NO: 2305555 - DNA, 16 bp, Homo sapiens
tcacagacccctgggg

SEQ ID NO: 2305556 - DNA, 22 bp, Homo sapiens
tcacagcctttgcgctctgggt

SEQ ID NO: 2305557 - DNA, 18 bp, Homo sapiens
tcacagctacgtgtgccc

SEQ ID NO: 2305558 - DNA, 23 bp, Homo sapiens
tgtgtattctgtggattctatat

SEQ ID NO: 2305559 - DNA, 14 bp, Homo sapiens
tgtgtccacagtga

SEQ ID NO: 2305560 - DNA, 15 bp, Homo sapiens
tgtgtgaaaatactg

SEQ ID NO: 2305561 - DNA, 16 bp, Homo sapiens
tgtgtgctcttatccc

SEQ ID NO: 2305562 - DNA, 16 bp, Homo sapiens
tgtgtggaaatgggac

SEQ ID NO: 2305563 - DNA, 11 bp, Homo sapiens
tgtgtgtttat

SEQ ID NO: 2305564 - DNA, 23 bp, Homo sapiens
tgtgtgtttattgtcaaagtggt

SEQ ID NO: 2305565 - DNA, 13 bp, Homo sapiens
tgtgtgtttcttg

SEQ ID NO: 2305566 - DNA, 14 bp, Homo sapiens
tgtgtgtttcttgc

SEQ ID NO: 2305567 - DNA, 23 bp, Homo sapiens
tgtgttctaatccaagggccagt

SEQ ID NO: 2305568 - DNA, 18 bp, Homo sapiens
tgtgttcttaaaatattg

SEQ ID NO: 2305569 - DNA, 19 bp, Homo sapiens
tgtgttcttaaaatattgt

SEQ ID NO: 2305570 - DNA, 14 bp, Homo sapiens
tgtgttgcccaggc

SEQ ID NO: 2305571 - DNA, 20 bp, Homo sapiens
tgttaaagaggcgtcttgta

SEQ ID NO: 2305572 - DNA, 15 bp, Homo sapiens
tgttacacaatatgt

SEQ ID NO: 2305573 - DNA, 17 bp, Homo sapiens
tgttacacaatatgtgt

SEQ ID NO: 2305574 - DNA, 16 bp, Homo sapiens
tgttacaggtgtacta

SEQ ID NO: 2305575 - DNA, 18 bp, Homo sapiens
tgttacaggtgtactatg

SEQ ID NO: 2305576 - DNA, 23 bp, Homo sapiens
tgttacccgcagatcctgtccca

SEQ ID NO: 2305577 - DNA, 20 bp, Homo sapiens
tgttactccaaaaagaaata

SEQ ID NO: 2305578 - DNA, 13 bp, Homo sapiens
tgttacttaaata

SEQ ID NO: 2305579 - DNA, 15 bp, Homo sapiens
tgttacttaaatagc

SEQ ID NO: 2305580 - DNA, 21 bp, Homo sapiens
tgttagtgttttaagaaatgt

SEQ ID NO: 2305581 - DNA, 22 bp, Homo sapiens
tgttagtgttttaagaaatgta

SEQ ID NO: 2305582 - DNA, 12 bp, Homo sapiens
tgttatttcaat

SEQ ID NO: 2305583 - DNA, 15 bp, Homo sapiens
tgttattttctttga

SEQ ID NO: 2305584 - DNA, 14 bp, Homo sapiens
tgttcaaaaataac

SEQ ID NO: 2305585 - DNA, 22 bp, Homo sapiens
tgttcactccgggtcaagttgt

SEQ ID NO: 2305586 - DNA, 15 bp, Homo sapiens
tgttcagtcacatgt

SEQ ID NO: 2305587 - DNA, 23 bp, Homo sapiens
tgttccagctgaggcagggggat

SEQ ID NO: 2305588 - DNA, 13 bp, Homo sapiens
tgttcgctggctg

SEQ ID NO: 2305589 - DNA, 21 bp, Homo sapiens
tgttctaatccaagggccagt

SEQ ID NO: 2305590 - DNA, 14 bp, Homo sapiens
tgttctcaatgctt

SEQ ID NO: 2305591 - DNA, 21 bp, Homo sapiens
tgttctcaatgcttttctagc

SEQ ID NO: 2305592 - DNA, 21 bp, Homo sapiens
tgttctccataggagggaagg

SEQ ID NO: 2305593 - DNA, 16 bp, Homo sapiens
tgttctgtgtctgctg

SEQ ID NO: 2305594 - DNA, 17 bp, Homo sapiens
tgttctgtgtctgctgt

SEQ ID NO: 2305595 - DNA, 13 bp, Homo sapiens
tgttcttaaaata

SEQ ID NO: 2305596 - DNA, 17 bp, Homo sapiens
ttgcaaattattctagt

SEQ ID NO: 2305597 - DNA, 19 bp, Homo sapiens
ttgcaaattattctagtca

SEQ ID NO: 2305598 - DNA, 18 bp, Homo sapiens
ttgcacacattggccgct

SEQ ID NO: 2305599 - DNA, 15 bp, Homo sapiens
ttgcacttctgttat

SEQ ID NO: 2305600 - DNA, 11 bp, Homo sapiens
ttgcaggaagg

SEQ ID NO: 2305601 - DNA, 17 bp, Homo sapiens
ttgcagtatcagagggt

SEQ ID NO: 2305602 - DNA, 16 bp, Homo sapiens
ttgcagtgaagatgtg

SEQ ID NO: 2305603 - DNA, 21 bp, Homo sapiens
ttgcataagtggacccagctg

SEQ ID NO: 2305604 - DNA, 21 bp, Homo sapiens
ttgcattccagcgtctgctgt

SEQ ID NO: 2305605 - DNA, 14 bp, Homo sapiens
ttgccatccttgca

SEQ ID NO: 2305606 - DNA, 21 bp, Homo sapiens
ttgcggcaccgcccacccaca

SEQ ID NO: 2305607 - DNA, 18 bp, Homo sapiens
ttgctagtgatacactgt

SEQ ID NO: 2305608 - DNA, 16 bp, Homo sapiens
ttgctatatttgctaa

SEQ ID NO: 2305609 - DNA, 16 bp, Homo sapiens
ttgctattgtttatag

SEQ ID NO: 2305610 - DNA, 15 bp, Homo sapiens
ttgctccttgaataa

SEQ ID NO: 2305611 - DNA, 16 bp, Homo sapiens
ttgctccttgaataag

SEQ ID NO: 2305612 - DNA, 18 bp, Homo sapiens
ttgctgatggtgcaatga

SEQ ID NO: 2305613 - DNA, 20 bp, Homo sapiens
ttgctgatggtgcaatgacc

SEQ ID NO: 2305614 - DNA, 22 bp, Homo sapiens
ttgctgatggtgcaatgacctt

SEQ ID NO: 2305615 - DNA, 15 bp, Homo sapiens
ttgctgttgcttgaa

SEQ ID NO: 2305616 - DNA, 14 bp, Homo sapiens
ttgcttatttatat

SEQ ID NO: 2305617 - DNA, 22 bp, Homo sapiens
ttggaagggtccaccctagcct

SEQ ID NO: 2305618 - DNA, 20 bp, Homo sapiens
ttggaatcccacttatcaaa

SEQ ID NO: 2305619 - DNA, 22 bp, Homo sapiens
ttggacagctgactgaatgcag

SEQ ID NO: 2305620 - DNA, 16 bp, Homo sapiens
ttggacagtaagattt

SEQ ID NO: 2305621 - DNA, 22 bp, Homo sapiens
ttggacggggacacggcctctg

SEQ ID NO: 2305622 - DNA, 16 bp, Homo sapiens
ttggactgtggcctca

SEQ ID NO: 2305623 - DNA, 19 bp, Homo sapiens
ttggagacaggattctgac

SEQ ID NO: 2305624 - DNA, 19 bp, Homo sapiens
ttggagcagagacggcagc

SEQ ID NO: 2305625 - DNA, 22 bp, Homo sapiens
ttggagcagagacggcagcccc

SEQ ID NO: 2305626 - DNA, 23 bp, Homo sapiens
ttggagcagagacggcagcccca

SEQ ID NO: 2305627 - DNA, 20 bp, Homo sapiens
ttggattcacagcctttgcg

SEQ ID NO: 2305628 - DNA, 15 bp, Homo sapiens
ttggcacagaacagg

SEQ ID NO: 2305629 - DNA, 22 bp, Homo sapiens
ttggcaggagtgggctctgagc

SEQ ID NO: 2305630 - DNA, 20 bp, Homo sapiens
ttggccgagtcagcacgtag

SEQ ID NO: 2305631 - DNA, 22 bp, Homo sapiens
ttggctaacatagcacagtatt

SEQ ID NO: 2305632 - DNA, 14 bp, Homo sapiens
ttggcttatgaaaa

SEQ ID NO: 2305633 - DNA, 12 bp, Homo sapiens
ttgggctctgcg

SEQ ID NO: 2305634 - DNA, 12 bp, Homo sapiens
ttggggcagggg

SEQ ID NO: 2305635 - DNA, 15 bp, Homo sapiens
ttggggcttatcaga

SEQ ID NO: 2305636 - DNA, 20 bp, Homo sapiens
ttgggtagctgccacttgaa

SEQ ID NO: 2305637 - DNA, 16 bp, Homo sapiens
ttggtcctgcctaaat

SEQ ID NO: 2305638 - DNA, 12 bp, Homo sapiens
ttggtgaggacc

SEQ ID NO: 2305639 - DNA, 16 bp, Homo sapiens
ttggtgattttagatt

SEQ ID NO: 2305640 - DNA, 21 bp, Homo sapiens
ttgtaaaaatagcaaaatatt

SEQ ID NO: 2305641 - DNA, 13 bp, Homo sapiens
ttgtaaatgttat

SEQ ID NO: 2305642 - DNA, 18 bp, Homo sapiens
ttgtaaatgttatttctg

SEQ ID NO: 2305643 - DNA, 19 bp, Homo sapiens
ttgtaaatgttatttctgc

SEQ ID NO: 2305644 - DNA, 20 bp, Homo sapiens
ttgtaaccatatgattgaaa

SEQ ID NO: 2305645 - DNA, 13 bp, Homo sapiens
ttgtaatattttg

SEQ ID NO: 2305646 - DNA, 15 bp, Homo sapiens
ttgtaatgtatctta

SEQ ID NO: 2305647 - DNA, 13 bp, Homo sapiens
ttgtacagacaac

SEQ ID NO: 2305648 - DNA, 18 bp, Homo sapiens
ttgtaccagcccaggcaa

SEQ ID NO: 2305649 - DNA, 19 bp, Homo sapiens
ttgtacttacactgaaatc

SEQ ID NO: 2305650 - DNA, 17 bp, Homo sapiens
ttgtagatatatatttc

SEQ ID NO: 2305651 - DNA, 18 bp, Homo sapiens
ttgtagatgtattttcaa

SEQ ID NO: 2305652 - DNA, 15 bp, Homo sapiens
ttgtatcctggcaaa

SEQ ID NO: 2305653 - DNA, 20 bp, Homo sapiens
ttgtatcctggcaaataata

SEQ ID NO: 2305654 - DNA, 21 bp, Homo sapiens
ttgtatcctggcaaataatac

SEQ ID NO: 2305655 - DNA, 11 bp, Homo sapiens
ttgtattttaa

SEQ ID NO: 2305656 - DNA, 15 bp, Homo sapiens
ttgtatttttccaga

SEQ ID NO: 2305657 - DNA, 22 bp, Homo sapiens
ttgtcacagaatctccatttct

SEQ ID NO: 2305658 - DNA, 15 bp, Homo sapiens
ttgtcccttccagga

SEQ ID NO: 2305659 - DNA, 15 bp, Homo sapiens
ttgtctgctgcctcc

SEQ ID NO: 2305660 - DNA, 16 bp, Homo sapiens
ttgtctgctgcctcca

SEQ ID NO: 2305661 - DNA, 13 bp, Homo sapiens
ttgtctgtcctgg

SEQ ID NO: 2305662 - DNA, 21 bp, Homo sapiens
ttgtctgtgtatttctatttt

SEQ ID NO: 2305663 - DNA, 16 bp, Homo sapiens
ttgtggatatatttaa

SEQ ID NO: 2305664 - DNA, 18 bp, Homo sapiens
ttgtgtaactgttctttg

SEQ ID NO: 2305665 - DNA, 17 bp, Homo sapiens
ttgtgtgtttattgtca

SEQ ID NO: 2305666 - DNA, 11 bp, Homo sapiens
ttgtgttctta

SEQ ID NO: 2305667 - DNA, 15 bp, Homo sapiens
ttgtgttgttttctc

SEQ ID NO: 2305668 - DNA, 22 bp, Homo sapiens
ttgtgtttaactgtgaacaaat

SEQ ID NO: 2305669 - DNA, 14 bp, Homo sapiens
ttgttaaatgctat

SEQ ID NO: 2305670 - DNA, 15 bp, Homo sapiens
ttgttaaatgctatg

SEQ ID NO: 2305671 - DNA, 12 bp, Homo sapiens
ttgttaaatgtt

SEQ ID NO: 2305672 - DNA, 17 bp, Homo sapiens
ttgttaagagtatcatg

SEQ ID NO: 2305673 - DNA, 13 bp, Homo sapiens
ttgttacaatttt

SEQ ID NO: 2305674 - DNA, 13 bp, Homo sapiens
ttgttatttcaat

SEQ ID NO: 2305675 - DNA, 12 bp, Homo sapiens
ttgttcaaaaat

SEQ ID NO: 2305676 - DNA, 22 bp, Homo sapiens
ttgttctagttagcaggaaata

SEQ ID NO: 2305677 - DNA, 15 bp, Homo sapiens
ttgttgaatgtattc

SEQ ID NO: 2305678 - DNA, 14 bp, Homo sapiens
ttgttgctgctttg

SEQ ID NO: 2305679 - DNA, 12 bp, Homo sapiens
ttgtttaattgt

SEQ ID NO: 2305680 - DNA, 21 bp, Homo sapiens
ttgtttccaaagctgaagatc

SEQ ID NO: 2305681 - DNA, 15 bp, Homo sapiens
ttgtttctatactgt

SEQ ID NO: 2305682 - DNA, 14 bp, Homo sapiens
ttgttttctttttc

SEQ ID NO: 2305683 - DNA, 20 bp, Homo sapiens
tttaaaaaaaatattctgtc

SEQ ID NO: 2305684 - DNA, 19 bp, Homo sapiens
tttaaaaaataatttagat

SEQ ID NO: 2305685 - DNA, 12 bp, Homo sapiens
tttaaaaatatt

SEQ ID NO: 2305686 - DNA, 12 bp, Homo sapiens
tttaaaattcat

SEQ ID NO: 2305687 - DNA, 23 bp, Homo sapiens
tttaaactgatgtatagctttaa

SEQ ID NO: 2305688 - DNA, 20 bp, Homo sapiens
tttaaatatgaaagcctagt

SEQ ID NO: 2305689 - DNA, 23 bp, Homo sapiens
tttaaatgtgcttcattgtttga

SEQ ID NO: 2305690 - DNA, 15 bp, Homo sapiens
tttaacagacatgta

SEQ ID NO: 2305691 - DNA, 18 bp, Homo sapiens
tttaacagatatttaaat

SEQ ID NO: 2305692 - DNA, 13 bp, Homo sapiens
tttaacattttgt

SEQ ID NO: 2305693 - DNA, 21 bp, Homo sapiens
tttaactactaagaataaata

SEQ ID NO: 2305694 - DNA, 15 bp, Homo sapiens
tttaacttatctcca

SEQ ID NO: 2305695 - DNA, 16 bp, Homo sapiens
tttaagaaatgagaaa

SEQ ID NO: 2305696 - DNA, 21 bp, Homo sapiens
tttaagaaatgagaaattgtg

SEQ ID NO: 2305697 - DNA, 13 bp, Homo sapiens
tttaagcatttta

SEQ ID NO: 2305698 - DNA, 20 bp, Homo sapiens
tttaatatactaaccatttc

SEQ ID NO: 2305699 - DNA, 16 bp, Homo sapiens
tttaatggtatctgtt

SEQ ID NO: 2305700 - DNA, 21 bp, Homo sapiens
tttaattgtaggtcaatgaaa

SEQ ID NO: 2305701 - DNA, 14 bp, Homo sapiens
tttacagttactgc

SEQ ID NO: 2305702 - DNA, 16 bp, Homo sapiens
tttacattttctttca

SEQ ID NO: 2305703 - DNA, 17 bp, Homo sapiens
tttacattttctttcat

SEQ ID NO: 2305704 - DNA, 17 bp, Homo sapiens
tttactcaggctttcta

SEQ ID NO: 2305705 - DNA, 15 bp, Homo sapiens
tttacttcactttca

SEQ ID NO: 2305706 - DNA, 20 bp, Homo sapiens
tttagaacagggtttctcag

SEQ ID NO: 2305707 - DNA, 22 bp, Homo sapiens
tttagagattaatttgtgtaga

SEQ ID NO: 2305708 - DNA, 21 bp, Homo sapiens
tttagaggggcaaaaatattt

SEQ ID NO: 2305709 - DNA, 21 bp, Homo sapiens
tttagagtatgcaagaagaat

SEQ ID NO: 2305710 - DNA, 22 bp, Homo sapiens
tttagagtatgcaagaagaata

SEQ ID NO: 2305711 - DNA, 18 bp, Homo sapiens
tttagatattcatacttt

SEQ ID NO: 2305712 - DNA, 19 bp, Homo sapiens
tttagattgaaatttatga

SEQ ID NO: 2305713 - DNA, 14 bp, Homo sapiens
tttaggctattata

SEQ ID NO: 2305714 - DNA, 19 bp, Homo sapiens
tttagtttaccaatcaaca

SEQ ID NO: 2305715 - DNA, 21 bp, Homo sapiens
tttatactgtagcaatatatt

SEQ ID NO: 2305716 - DNA, 15 bp, Homo sapiens
tttatataactacat

SEQ ID NO: 2305717 - DNA, 22 bp, Homo sapiens
tttatgaagttaacagtctcat

SEQ ID NO: 2305718 - DNA, 19 bp, Homo sapiens
tttatggtattttcgtgca

SEQ ID NO: 2305719 - DNA, 13 bp, Homo sapiens
tttatgttctcaa

SEQ ID NO: 2305720 - DNA, 18 bp, Homo sapiens
tttattaccgataaatga

SEQ ID NO: 2305721 - DNA, 15 bp, Homo sapiens
tttattattttcata

SEQ ID NO: 2305722 - DNA, 15 bp, Homo sapiens
tttattgagtaatat

SEQ ID NO: 2305723 - DNA, 21 bp, Homo sapiens
tttattgttatacctttttga

SEQ ID NO: 2305724 - DNA, 21 bp, Homo sapiens
tttcaaacattgagactgcta

SEQ ID NO: 2305725 - DNA, 11 bp, Homo sapiens
tttcaaatgag

SEQ ID NO: 2305726 - DNA, 20 bp, Homo sapiens
tttcaaatgagtttaaaaaa

SEQ ID NO: 2305727 - DNA, 23 bp, Homo sapiens
tttcaaatgagtttaaaaaaata

SEQ ID NO: 2305728 - DNA, 12 bp, Homo sapiens
tttcaaatgcag

SEQ ID NO: 2305729 - DNA, 23 bp, Homo sapiens
tttcaaatgcagtccagtgagaa

SEQ ID NO: 2305730 - DNA, 12 bp, Homo sapiens
tttcaataggaa

SEQ ID NO: 2305731 - DNA, 22 bp, Homo sapiens
tttcacagtatttacaagctat

SEQ ID NO: 2305732 - DNA, 14 bp, Homo sapiens
tttcacatatttgt

SEQ ID NO: 2305733 - DNA, 18 bp, Homo sapiens
gctcctctgcctttgtgc

SEQ ID NO: 2305734 - DNA, 11 bp, Homo sapiens
gctcctgcccc

SEQ ID NO: 2305735 - DNA, 14 bp, Homo sapiens
gctcctgccccgcc

SEQ ID NO: 2305736 - DNA, 16 bp, Homo sapiens
gctcgggaaggcctga

SEQ ID NO: 2305737 - DNA, 19 bp, Homo sapiens
gctcgggaaggcctgaggg

SEQ ID NO: 2305738 - DNA, 23 bp, Homo sapiens
gctcgggaaggcctgagggaagc

SEQ ID NO: 2305739 - DNA, 16 bp, Homo sapiens
gctcgggtgcccagga

SEQ ID NO: 2305740 - DNA, 14 bp, Homo sapiens
gctctaaagcagag

SEQ ID NO: 2305741 - DNA, 18 bp, Homo sapiens
gctctatttcggaaatac

SEQ ID NO: 2305742 - DNA, 22 bp, Homo sapiens
gctctatttcggaaatacacta

SEQ ID NO: 2305743 - DNA, 14 bp, Homo sapiens
gctctccatctctt

SEQ ID NO: 2305744 - DNA, 13 bp, Homo sapiens
gctctcccctgcg

SEQ ID NO: 2305745 - DNA, 20 bp, Homo sapiens
gctctcccctgcgcaggccc

SEQ ID NO: 2305746 - DNA, 16 bp, Homo sapiens
gctctcctgggccagg

SEQ ID NO: 2305747 - DNA, 21 bp, Homo sapiens
gctctgaagggaggggaagag

SEQ ID NO: 2305748 - DNA, 14 bp, Homo sapiens
gctctgcatacaca

SEQ ID NO: 2305749 - DNA, 20 bp, Homo sapiens
gctctgccatcagcccctgc

SEQ ID NO: 2305750 - DNA, 21 bp, Homo sapiens
gctctgccatcagcccctgct

SEQ ID NO: 2305751 - DNA, 13 bp, Homo sapiens
gctctgcccctcc

SEQ ID NO: 2305752 - DNA, 22 bp, Homo sapiens
gctctgcccctccgtccccagg

SEQ ID NO: 2305753 - DNA, 14 bp, Homo sapiens
gctctggcaggtgg

SEQ ID NO: 2305754 - DNA, 22 bp, Homo sapiens
gctctggcaggtggccagggct

SEQ ID NO: 2305755 - DNA, 23 bp, Homo sapiens
gctctggcaggtggccagggctc

SEQ ID NO: 2305756 - DNA, 11 bp, Homo sapiens
gctctggcccc

SEQ ID NO: 2305757 - DNA, 19 bp, Homo sapiens
gctcttatccccagctgtt

SEQ ID NO: 2305758 - DNA, 18 bp, Homo sapiens
gctctttaagtaaaatgt

SEQ ID NO: 2305759 - DNA, 19 bp, Homo sapiens
gctgaatcaaagacatttc

SEQ ID NO: 2305760 - DNA, 22 bp, Homo sapiens
gctgaatcaaagacatttcatc

SEQ ID NO: 2305761 - DNA, 23 bp, Homo sapiens
gctgaatcaaagacatttcatcc

SEQ ID NO: 2305762 - DNA, 15 bp, Homo sapiens
gctgacagagcccta

SEQ ID NO: 2305763 - DNA, 13 bp, Homo sapiens
gctgaccaggccc

SEQ ID NO: 2305764 - DNA, 20 bp, Homo sapiens
gctgactaaatttggggaca

SEQ ID NO: 2305765 - DNA, 15 bp, Homo sapiens
gctgagcccctcctc

SEQ ID NO: 2305766 - DNA, 21 bp, Homo sapiens
gctgagcccctcctctcctcg

SEQ ID NO: 2305767 - DNA, 18 bp, Homo sapiens
gctgagccgatctggtct

SEQ ID NO: 2305768 - DNA, 16 bp, Homo sapiens
gctgaggacggggcag

SEQ ID NO: 2305769 - DNA, 17 bp, Homo sapiens
gctgaggacggggcaga

SEQ ID NO: 2305770 - DNA, 16 bp, Homo sapiens
gctgagtcggctgggc

SEQ ID NO: 2305771 - DNA, 18 bp, Homo sapiens
gctgagtcggctgggcag

SEQ ID NO: 2305772 - DNA, 19 bp, Homo sapiens
gctgagtcggctgggcagg

SEQ ID NO: 2305773 - DNA, 23 bp, Homo sapiens
gctgagtcggctgggcagggccg

SEQ ID NO: 2305774 - DNA, 16 bp, Homo sapiens
gctgatggtgcaatga

SEQ ID NO: 2305775 - DNA, 12 bp, Homo sapiens
gctgatttcaaa

SEQ ID NO: 2305776 - DNA, 14 bp, Homo sapiens
gctgcacagtagtg

SEQ ID NO: 2305777 - DNA, 18 bp, Homo sapiens
gctgcacagtagtgttgg

SEQ ID NO: 2305778 - DNA, 18 bp, Homo sapiens
gctgcatcaaatgcatgc

SEQ ID NO: 2305779 - DNA, 20 bp, Homo sapiens
gctgcatcaaatgcatgcgt

SEQ ID NO: 2305780 - DNA, 20 bp, Homo sapiens
gctgccccacccctccatga

SEQ ID NO: 2305781 - DNA, 14 bp, Homo sapiens
gctgcccccacaga

SEQ ID NO: 2305782 - DNA, 15 bp, Homo sapiens
gctgcccccagaccc

SEQ ID NO: 2305783 - DNA, 18 bp, Homo sapiens
gctgccctgtccactctg

SEQ ID NO: 2305784 - DNA, 20 bp, Homo sapiens
gctgcctccaagtcatggga

SEQ ID NO: 2305785 - DNA, 18 bp, Homo sapiens
gctgcctctgaaaatatt

SEQ ID NO: 2305786 - DNA, 12 bp, Homo sapiens
gctgcctggagg

SEQ ID NO: 2305787 - DNA, 13 bp, Homo sapiens
gctgcctggaggg

SEQ ID NO: 2305788 - DNA, 18 bp, Homo sapiens
gctgcctggcgggcagcc

SEQ ID NO: 2305789 - DNA, 23 bp, Homo sapiens
gctgcctggcgggcagcccctgc

SEQ ID NO: 2305790 - DNA, 12 bp, Homo sapiens
gctgcgcctgcc

SEQ ID NO: 2305791 - DNA, 13 bp, Homo sapiens
gctgcgcctgccc

SEQ ID NO: 2305792 - DNA, 16 bp, Homo sapiens
gctgcgcctgcccgcc

SEQ ID NO: 2305793 - DNA, 14 bp, Homo sapiens
gctgctaagtggaa

SEQ ID NO: 2305794 - DNA, 17 bp, Homo sapiens
gctgctaagtggaagac

SEQ ID NO: 2305795 - DNA, 21 bp, Homo sapiens
gctgctcctcggccagagctc

SEQ ID NO: 2305796 - DNA, 20 bp, Homo sapiens
gctgctcgggaaggcctgag

SEQ ID NO: 2305797 - DNA, 22 bp, Homo sapiens
gctgcttcaaggatcctgagcc

SEQ ID NO: 2305798 - DNA, 14 bp, Homo sapiens
gctgcttccagttg

SEQ ID NO: 2305799 - DNA, 14 bp, Homo sapiens
gctggaccaactgc

SEQ ID NO: 2305800 - DNA, 20 bp, Homo sapiens
gctggacctggggtcccccc

SEQ ID NO: 2305801 - DNA, 23 bp, Homo sapiens
gctggacctggggtcccccctcc

SEQ ID NO: 2305802 - DNA, 14 bp, Homo sapiens
gctggactgggtgg

SEQ ID NO: 2305803 - DNA, 20 bp, Homo sapiens
gctggagcagtttggggcag

SEQ ID NO: 2305804 - DNA, 21 bp, Homo sapiens
gctggagcagtttggggcagg

SEQ ID NO: 2305805 - DNA, 17 bp, Homo sapiens
gctggagggctgggcag

SEQ ID NO: 2305806 - DNA, 21 bp, Homo sapiens
gctggagggctgggcagggcc

SEQ ID NO: 2305807 - DNA, 22 bp, Homo sapiens
gctggagggctgggcagggccc

SEQ ID NO: 2305808 - DNA, 15 bp, Homo sapiens
gctggcagcgcctcc

SEQ ID NO: 2305809 - DNA, 14 bp, Homo sapiens
gctggccctgccct

SEQ ID NO: 2305810 - DNA, 16 bp, Homo sapiens
gtccaaggtcaaggca

SEQ ID NO: 2305811 - DNA, 19 bp, Homo sapiens
gtccacagtgattagcctc

SEQ ID NO: 2305812 - DNA, 13 bp, Homo sapiens
gtccaccctagcc

SEQ ID NO: 2305813 - DNA, 20 bp, Homo sapiens
gtccacttaaataatcctct

SEQ ID NO: 2305814 - DNA, 20 bp, Homo sapiens
gtccagacctgggccctggt

SEQ ID NO: 2305815 - DNA, 18 bp, Homo sapiens
gtccagctctcccctgcg

SEQ ID NO: 2305816 - DNA, 22 bp, Homo sapiens
gtcccacaaaatatttctaagc

SEQ ID NO: 2305817 - DNA, 12 bp, Homo sapiens
gtcccacagccc

SEQ ID NO: 2305818 - DNA, 16 bp, Homo sapiens
gtccccaggggcacac

SEQ ID NO: 2305819 - DNA, 11 bp, Homo sapiens
gtccccagggt

SEQ ID NO: 2305820 - DNA, 23 bp, Homo sapiens
gtccccattctataaattcaaca

SEQ ID NO: 2305821 - DNA, 13 bp, Homo sapiens
gtcccccctccct

SEQ ID NO: 2305822 - DNA, 14 bp, Homo sapiens
gtcccccctccctg

SEQ ID NO: 2305823 - DNA, 19 bp, Homo sapiens
gtccccggacgctggctcg

SEQ ID NO: 2305824 - DNA, 20 bp, Homo sapiens
gtcccgaatggagtccagac

SEQ ID NO: 2305825 - DNA, 15 bp, Homo sapiens
gtccctgacttccca

SEQ ID NO: 2305826 - DNA, 19 bp, Homo sapiens
gtccgaggcctggctctgg

SEQ ID NO: 2305827 - DNA, 21 bp, Homo sapiens
gtccgatggcccgagagctgg

SEQ ID NO: 2305828 - DNA, 13 bp, Homo sapiens
gtccgcccgccca

SEQ ID NO: 2305829 - DNA, 13 bp, Homo sapiens
gtccggcctgcag

SEQ ID NO: 2305830 - DNA, 15 bp, Homo sapiens
gtccggcctgcagcc

SEQ ID NO: 2305831 - DNA, 16 bp, Homo sapiens
gtccggcctgcagccc

SEQ ID NO: 2305832 - DNA, 17 bp, Homo sapiens
gtccggcctgcagccca

SEQ ID NO: 2305833 - DNA, 21 bp, Homo sapiens
gtccgtccgcccgcccacccc

SEQ ID NO: 2305834 - DNA, 22 bp, Homo sapiens
gtcctcacatgactgaagggac

SEQ ID NO: 2305835 - DNA, 15 bp, Homo sapiens
gtcctccaaaacaca

SEQ ID NO: 2305836 - DNA, 15 bp, Homo sapiens
gtcctcttcctcaaa

SEQ ID NO: 2305837 - DNA, 15 bp, Homo sapiens
gtcctgaggctgggg

SEQ ID NO: 2305838 - DNA, 16 bp, Homo sapiens
gtcctgaggctggggc

SEQ ID NO: 2305839 - DNA, 16 bp, Homo sapiens
gtcctgcctaaatttc

SEQ ID NO: 2305840 - DNA, 18 bp, Homo sapiens
gtcctgcctaaatttcac

SEQ ID NO: 2305841 - DNA, 11 bp, Homo sapiens
gtcctgctgct

SEQ ID NO: 2305842 - DNA, 13 bp, Homo sapiens
gtcctgctgctcg

SEQ ID NO: 2305843 - DNA, 13 bp, Homo sapiens
gtgggggtggcca

SEQ ID NO: 2305844 - DNA, 20 bp, Homo sapiens
gtgggtatttcttatttgaa

SEQ ID NO: 2305845 - DNA, 18 bp, Homo sapiens
gtggtccacattctgctg

SEQ ID NO: 2305846 - DNA, 18 bp, Homo sapiens
gtggttcgggggaaatag

SEQ ID NO: 2305847 - DNA, 15 bp, Homo sapiens
gtgtaactgttcttt

SEQ ID NO: 2305848 - DNA, 20 bp, Homo sapiens
gtgtaactgttctttgcagt

SEQ ID NO: 2305849 - DNA, 11 bp, Homo sapiens
gtgtagatatt

SEQ ID NO: 2305850 - DNA, 20 bp, Homo sapiens
gtgtattctgtggattctat

SEQ ID NO: 2305851 - DNA, 12 bp, Homo sapiens
gtgtcccctggt

SEQ ID NO: 2305852 - DNA, 20 bp, Homo sapiens
gtgtcccctggtgcccctcc

SEQ ID NO: 2305853 - DNA, 11 bp, Homo sapiens
gtgtctgctgt

SEQ ID NO: 2305854 - DNA, 13 bp, Homo sapiens
gtgtgacctgaca

SEQ ID NO: 2305855 - DNA, 17 bp, Homo sapiens
gtgtgaggcccccggag

SEQ ID NO: 2305856 - DNA, 21 bp, Homo sapiens
gtgtgcccactgaacatgctc

SEQ ID NO: 2305857 - DNA, 19 bp, Homo sapiens
gtgtggcgggaagggtggg

SEQ ID NO: 2305858 - DNA, 14 bp, Homo sapiens
gtgtgtttcttgct

SEQ ID NO: 2305859 - DNA, 15 bp, Homo sapiens
gtgttaaatttagtg

SEQ ID NO: 2305860 - DNA, 20 bp, Homo sapiens
gtgttattttaatctcagaa

SEQ ID NO: 2305861 - DNA, 17 bp, Homo sapiens
gtgttcctcagtagctt

SEQ ID NO: 2305862 - DNA, 19 bp, Homo sapiens
gtgttcctcctcccctctc

SEQ ID NO: 2305863 - DNA, 20 bp, Homo sapiens
gtgttgaggaggggagcaag

SEQ ID NO: 2305864 - DNA, 12 bp, Homo sapiens
gtgttgcccagg

SEQ ID NO: 2305865 - DNA, 23 bp, Homo sapiens
gtgttgtaccatatgtagcatta

SEQ ID NO: 2305866 - DNA, 16 bp, Homo sapiens
gtgttttaagaaatgt

SEQ ID NO: 2305867 - DNA, 13 bp, Homo sapiens
gtgttttcttgtg

SEQ ID NO: 2305868 - DNA, 14 bp, Homo sapiens
gttaaagagacaaa

SEQ ID NO: 2305869 - DNA, 18 bp, Homo sapiens
gttaaagagacaaatagt

SEQ ID NO: 2305870 - DNA, 23 bp, Homo sapiens
gttaaatgctatggaaatacatt

SEQ ID NO: 2305871 - DNA, 15 bp, Homo sapiens
gttaatgtgccaaaa

SEQ ID NO: 2305872 - DNA, 16 bp, Homo sapiens
gttacaaatttttact

SEQ ID NO: 2305873 - DNA, 21 bp, Homo sapiens
gttacacggggttacactgtt

SEQ ID NO: 2305874 - DNA, 14 bp, Homo sapiens
gttacatagaaagt

SEQ ID NO: 2305875 - DNA, 22 bp, Homo sapiens
gttactgcctaggagttaatga

SEQ ID NO: 2305876 - DNA, 18 bp, Homo sapiens
gttagaatctattttcta

SEQ ID NO: 2305877 - DNA, 22 bp, Homo sapiens
gttagaatctattttctatgta

SEQ ID NO: 2305878 - DNA, 22 bp, Homo sapiens
gttagaattaggtaatggatat

SEQ ID NO: 2305879 - DNA, 22 bp, Homo sapiens
gttaggaacccggcatgccgag

SEQ ID NO: 2305880 - DNA, 13 bp, Homo sapiens
gttaggctgtaca

SEQ ID NO: 2305881 - DNA, 16 bp, Homo sapiens
gttagggcatttttct

SEQ ID NO: 2305882 - DNA, 17 bp, Homo sapiens
gttagtgttttaagaaa

SEQ ID NO: 2305883 - DNA, 21 bp, Homo sapiens
gttagtgttttaagaaatgta

SEQ ID NO: 2305884 - DNA, 18 bp, Homo sapiens
gttatatcatcaatactt

SEQ ID NO: 2305885 - DNA, 18 bp, Homo sapiens
gttatgagaaaaaaacag

SEQ ID NO: 2305886 - DNA, 23 bp, Homo sapiens
gttatgcaagtcgccaggcagga

SEQ ID NO: 2305887 - DNA, 17 bp, Homo sapiens
gttcaaagatacaagaa

SEQ ID NO: 2305888 - DNA, 23 bp, Homo sapiens
gttcaaagatacaagaaaaagta

SEQ ID NO: 2305889 - DNA, 20 bp, Homo sapiens
gttcactccgggtcaagttg

SEQ ID NO: 2305890 - DNA, 12 bp, Homo sapiens
gttcatcttgaa

SEQ ID NO: 2305891 - DNA, 13 bp, Homo sapiens
gttcatcttgaat

SEQ ID NO: 2305892 - DNA, 11 bp, Homo sapiens
gttcattcaca

SEQ ID NO: 2305893 - DNA, 17 bp, Homo sapiens
gttcattcatactcaaa

SEQ ID NO: 2305894 - DNA, 19 bp, Homo sapiens
gttcccccaggaccctgag

SEQ ID NO: 2305895 - DNA, 22 bp, Homo sapiens
gttccctgaggacctgcgcaaa

SEQ ID NO: 2305896 - DNA, 18 bp, Homo sapiens
gttcctaaactctgaaat

SEQ ID NO: 2305897 - DNA, 19 bp, Homo sapiens
gttcctaaagaaaaagata

SEQ ID NO: 2305898 - DNA, 13 bp, Homo sapiens
gttcctgctgcct

SEQ ID NO: 2305899 - DNA, 15 bp, Homo sapiens
gttccttttgaagct

SEQ ID NO: 2305900 - DNA, 15 bp, Homo sapiens
gttctatttctatct

SEQ ID NO: 2305901 - DNA, 16 bp, Homo sapiens
gttctcaatgcttttc

SEQ ID NO: 2305902 - DNA, 18 bp, Homo sapiens
gttctcatgaaggagagg

SEQ ID NO: 2305903 - DNA, 15 bp, Homo sapiens
gttctgaaaactgtt

SEQ ID NO: 2305904 - DNA, 14 bp, Homo sapiens
gttctgggacccac

SEQ ID NO: 2305905 - DNA, 14 bp, Homo sapiens
gttcttggcctgct

SEQ ID NO: 2305906 - DNA, 13 bp, Homo sapiens
gttctttgcagtg

SEQ ID NO: 2305907 - DNA, 14 bp, Homo sapiens
gttctttgcagtga

SEQ ID NO: 2305908 - DNA, 22 bp, Homo sapiens
gttgaacaagccacgttgcaga

SEQ ID NO: 2305909 - DNA, 17 bp, Homo sapiens
gttgatcagatcttaca

SEQ ID NO: 2305910 - DNA, 18 bp, Homo sapiens
gttgcccaggctggtctt

SEQ ID NO: 2305911 - DNA, 15 bp, Homo sapiens
gttggccggctggcc

SEQ ID NO: 2305912 - DNA, 16 bp, Homo sapiens
gttggccggctggccg

SEQ ID NO: 2305913 - DNA, 21 bp, Homo sapiens
gttgtctcagccgagcccagg

SEQ ID NO: 2305914 - DNA, 13 bp, Homo sapiens
gttgtctctctaa

SEQ ID NO: 2305915 - DNA, 22 bp, Homo sapiens
gttgtggcctcattcagcagaa

SEQ ID NO: 2305916 - DNA, 15 bp, Homo sapiens
gttgttaaatgctat

SEQ ID NO: 2305917 - DNA, 18 bp, Homo sapiens
gttgttatattcattctt

SEQ ID NO: 2305918 - DNA, 15 bp, Homo sapiens
gttgttttctctgat

SEQ ID NO: 2305919 - DNA, 21 bp, Homo sapiens
gtttaatggtatctgttactc

SEQ ID NO: 2305920 - DNA, 19 bp, Homo sapiens
gtttacattttctttcata

SEQ ID NO: 2305921 - DNA, 15 bp, Homo sapiens
gtttagaatgtcagt

SEQ ID NO: 2305922 - DNA, 13 bp, Homo sapiens
gtttcaaacctgc

SEQ ID NO: 2305923 - DNA, 22 bp, Homo sapiens
gtttcattactgcccagatgtt

SEQ ID NO: 2305924 - DNA, 19 bp, Homo sapiens
gtttccaaagctgaagatc

SEQ ID NO: 2305925 - DNA, 16 bp, Homo sapiens
gtttccaggcatgacc

SEQ ID NO: 2305926 - DNA, 17 bp, Homo sapiens
gtttcctggttccgttt

SEQ ID NO: 2305927 - DNA, 19 bp, Homo sapiens
gtttctataaattgtagaa

SEQ ID NO: 2305928 - DNA, 13 bp, Homo sapiens
gtttctatactgt

SEQ ID NO: 2305929 - DNA, 22 bp, Homo sapiens
gtttctatactgtttgtaatat

SEQ ID NO: 2305930 - DNA, 17 bp, Homo sapiens
gtttctccccacaccct

SEQ ID NO: 2305931 - DNA, 14 bp, Homo sapiens
gtttctgtctcctc

SEQ ID NO: 2305932 - DNA, 14 bp, Homo sapiens
gtttcttgcttgta

SEQ ID NO: 2305933 - DNA, 18 bp, Homo sapiens
gtttcttgcttgtacctc

SEQ ID NO: 2305934 - DNA, 13 bp, Homo sapiens
gtttcttgctttg

SEQ ID NO: 2305935 - DNA, 19 bp, Homo sapiens
gtttgatttggtcctgcct

SEQ ID NO: 2305936 - DNA, 17 bp, Homo sapiens
gtttgcaaacaaaatga

SEQ ID NO: 2305937 - DNA, 13 bp, Homo sapiens
gtttggggcaggg

SEQ ID NO: 2305938 - DNA, 15 bp, Homo sapiens
gtttggtgaggacct

SEQ ID NO: 2305939 - DNA, 15 bp, Homo sapiens
gtttgtaatatacag

SEQ ID NO: 2305940 - DNA, 23 bp, Homo sapiens
gtttgtaatatacagtttttgta

SEQ ID NO: 2305941 - DNA, 16 bp, Homo sapiens
gttttaagaaatgtag

SEQ ID NO: 2305942 - DNA, 13 bp, Homo sapiens
gttttcctgaaga

SEQ ID NO: 2305943 - DNA, 13 bp, Homo sapiens
gttttctaaatgt

SEQ ID NO: 2305944 - DNA, 21 bp, Homo sapiens
gttttctaaatgtttcttttt

SEQ ID NO: 2305945 - DNA, 10 bp, Homo sapiens
gttttggaca

SEQ ID NO: 2305946 - DNA, 18 bp, Homo sapiens
gttttgggtagctgccac

SEQ ID NO: 2305947 - DNA, 21 bp, Homo sapiens
gtttttagaggggcaaaaata

SEQ ID NO: 2305948 - DNA, 20 bp, Homo sapiens
gtttttctcaaaaagctgct

SEQ ID NO: 2305949 - DNA, 13 bp, Homo sapiens
gtttttcttgcta

SEQ ID NO: 2305950 - DNA, 12 bp, Homo sapiens
gtttttctttaa

SEQ ID NO: 2305951 - DNA, 21 bp, Homo sapiens
taaaaaaaatattctgtcatt

SEQ ID NO: 2305952 - DNA, 14 bp, Homo sapiens
taaaaaataacata

SEQ ID NO: 2305953 - DNA, 12 bp, Homo sapiens
taaaaaataact

SEQ ID NO: 2305954 - DNA, 14 bp, Homo sapiens
taaaaacattttaa

SEQ ID NO: 2305955 - DNA, 18 bp, Homo sapiens
gcttggatccatacaaaa

SEQ ID NO: 2305956 - DNA, 16 bp, Homo sapiens
gcttggctcgcacccc

SEQ ID NO: 2305957 - DNA, 17 bp, Homo sapiens
gcttgtacctctggctg

SEQ ID NO: 2305958 - DNA, 18 bp, Homo sapiens
gcttgtttctatactgtt

SEQ ID NO: 2305959 - DNA, 16 bp, Homo sapiens
gctttagattgaaatt

SEQ ID NO: 2305960 - DNA, 20 bp, Homo sapiens
gctttatgttgcaattaaaa

SEQ ID NO: 2305961 - DNA, 21 bp, Homo sapiens
gctttcatgtttaagaaatga

SEQ ID NO: 2305962 - DNA, 14 bp, Homo sapiens
gctttcctgtttct

SEQ ID NO: 2305963 - DNA, 15 bp, Homo sapiens
gctttgaatgcatgt

SEQ ID NO: 2305964 - DNA, 17 bp, Homo sapiens
gctttgaatgcatgtgt

SEQ ID NO: 2305965 - DNA, 13 bp, Homo sapiens
gctttgcccttga

SEQ ID NO: 2305966 - DNA, 20 bp, Homo sapiens
gctttggggcttatcagaac

SEQ ID NO: 2305967 - DNA, 20 bp, Homo sapiens
gctttgttttggctgctctc

SEQ ID NO: 2305968 - DNA, 22 bp, Homo sapiens
gctttgttttggctgctctcca

SEQ ID NO: 2305969 - DNA, 14 bp, Homo sapiens
ggaaaaactgattt

SEQ ID NO: 2305970 - DNA, 13 bp, Homo sapiens
ggaaataaatcta

SEQ ID NO: 2305971 - DNA, 18 bp, Homo sapiens
ggaaatagttccattcta

SEQ ID NO: 2305972 - DNA, 13 bp, Homo sapiens
ggaaatcaattta

SEQ ID NO: 2305973 - DNA, 14 bp, Homo sapiens
ggaacactctgaga

SEQ ID NO: 2305974 - DNA, 15 bp, Homo sapiens
ggaaccatcctctgt

SEQ ID NO: 2305975 - DNA, 16 bp, Homo sapiens
ggaaccatcctctgtt

SEQ ID NO: 2305976 - DNA, 13 bp, Homo sapiens
ggaacctcaaact

SEQ ID NO: 2305977 - DNA, 15 bp, Homo sapiens
ggaacctcaaactgg

SEQ ID NO: 2305978 - DNA, 13 bp, Homo sapiens
ggaacttaaaaca

SEQ ID NO: 2305979 - DNA, 20 bp, Homo sapiens
ggaagagagaggcctgggtg

SEQ ID NO: 2305980 - DNA, 16 bp, Homo sapiens
ggaagagccagccgta

SEQ ID NO: 2305981 - DNA, 17 bp, Homo sapiens
ggaagagccgagcacct

SEQ ID NO: 2305982 - DNA, 18 bp, Homo sapiens
ggaagagccgagcacctg

SEQ ID NO: 2305983 - DNA, 15 bp, Homo sapiens
ggaagcagggggtcc

SEQ ID NO: 2305984 - DNA, 16 bp, Homo sapiens
ggaagcccacccgccc

SEQ ID NO: 2305985 - DNA, 24 bp, Homo sapiens
ggaagcccacccgccccagagact

SEQ ID NO: 2305986 - DNA, 19 bp, Homo sapiens
ggaagctggcaggagacac

SEQ ID NO: 2305987 - DNA, 20 bp, Homo sapiens
ggaagctggcaggagacact

SEQ ID NO: 2305988 - DNA, 21 bp, Homo sapiens
ggaaggcctgagggaagccca

SEQ ID NO: 2305989 - DNA, 23 bp, Homo sapiens
ggaaggcctgagggaagcccacc

SEQ ID NO: 2305990 - DNA, 18 bp, Homo sapiens
ggaagtactggagaaaat

SEQ ID NO: 2305991 - DNA, 17 bp, Homo sapiens
ggaagtgtgtgtttctt

SEQ ID NO: 2305992 - DNA, 19 bp, Homo sapiens
ggaatgaatgtcagtgtga

SEQ ID NO: 2305993 - DNA, 18 bp, Homo sapiens
ggaatgttgttaaatgct

SEQ ID NO: 2305994 - DNA, 17 bp, Homo sapiens
ggaattgttgaatgtat

SEQ ID NO: 2305995 - DNA, 18 bp, Homo sapiens
ggacagattcagtcttgc

SEQ ID NO: 2305996 - DNA, 15 bp, Homo sapiens
ggacagcagctggac

SEQ ID NO: 2305997 - DNA, 20 bp, Homo sapiens
ggacagcggcccggcccacg

SEQ ID NO: 2305998 - DNA, 19 bp, Homo sapiens
ggacagctgactgaatgca

SEQ ID NO: 2305999 - DNA, 20 bp, Homo sapiens
ggacagctgactgaatgcag

SEQ ID NO: 2306000 - DNA, 17 bp, Homo sapiens
ggacaggaacacccagc

SEQ ID NO: 2306001 - DNA, 20 bp, Homo sapiens
ggacaggaacacccagcccc

SEQ ID NO: 2306002 - DNA, 13 bp, Homo sapiens
ggacaggacttgt

SEQ ID NO: 2306003 - DNA, 14 bp, Homo sapiens
ggacaggacttgtg

SEQ ID NO: 2306004 - DNA, 18 bp, Homo sapiens
ggacaggattgtctgctg

SEQ ID NO: 2306005 - DNA, 20 bp, Homo sapiens
ggacaggcttcgtctcagaa

SEQ ID NO: 2306006 - DNA, 16 bp, Homo sapiens
ggacccactccgactc

SEQ ID NO: 2306007 - DNA, 16 bp, Homo sapiens
ggaccccatctgctga

SEQ ID NO: 2306008 - DNA, 17 bp, Homo sapiens
ggaccccatctgctgag

SEQ ID NO: 2306009 - DNA, 20 bp, Homo sapiens
ggaccctcggggcaggaagt

SEQ ID NO: 2306010 - DNA, 13 bp, Homo sapiens
ggaccctgagggt

SEQ ID NO: 2306011 - DNA, 20 bp, Homo sapiens
ggaccggagcggctgaggac

SEQ ID NO: 2306012 - DNA, 15 bp, Homo sapiens
ggaccgggagcctgc

SEQ ID NO: 2306013 - DNA, 22 bp, Homo sapiens
ggacctccacctgggagatgct

SEQ ID NO: 2306014 - DNA, 17 bp, Homo sapiens
ggacctgcggccttggg

SEQ ID NO: 2306015 - DNA, 19 bp, Homo sapiens
ggacctggggtcccccctc

SEQ ID NO: 2306016 - DNA, 21 bp, Homo sapiens
ggacctggggtcccccctccc

SEQ ID NO: 2306017 - DNA, 22 bp, Homo sapiens
ggacctggggtcccccctccct

SEQ ID NO: 2306018 - DNA, 13 bp, Homo sapiens
ggacgcagggaga

SEQ ID NO: 2306019 - DNA, 14 bp, Homo sapiens
ggacgcagggagac

SEQ ID NO: 2306020 - DNA, 12 bp, Homo sapiens
ggacgccgcgat

SEQ ID NO: 2306021 - DNA, 21 bp, Homo sapiens
ggacgggacagcggcccggcc

SEQ ID NO: 2306022 - DNA, 13 bp, Homo sapiens
ggacggggcccgc

SEQ ID NO: 2306023 - DNA, 13 bp, Homo sapiens
ggacggtctgtgc

SEQ ID NO: 2306024 - DNA, 16 bp, Homo sapiens
ggacgtggcacctcct

SEQ ID NO: 2306025 - DNA, 14 bp, Homo sapiens
taagcttatttcta

SEQ ID NO: 2306026 - DNA, 20 bp, Homo sapiens
taaggcaacatttccgaaga

SEQ ID NO: 2306027 - DNA, 18 bp, Homo sapiens
taaggcaggtgggcagac

SEQ ID NO: 2306028 - DNA, 23 bp, Homo sapiens
taagggagtaggctgtattttct

SEQ ID NO: 2306029 - DNA, 11 bp, Homo sapiens
taagggcagag

SEQ ID NO: 2306030 - DNA, 12 bp, Homo sapiens
taagggcagagt

SEQ ID NO: 2306031 - DNA, 14 bp, Homo sapiens
taagggctttaaat

SEQ ID NO: 2306032 - DNA, 23 bp, Homo sapiens
taagtgaggatgaaaaaataaca

SEQ ID NO: 2306033 - DNA, 19 bp, Homo sapiens
taagtgctacataaattgg

SEQ ID NO: 2306034 - DNA, 16 bp, Homo sapiens
taagtgttgtaccata

SEQ ID NO: 2306035 - DNA, 15 bp, Homo sapiens
taagttaaagagaca

SEQ ID NO: 2306036 - DNA, 15 bp, Homo sapiens
taagttgaagggaaa

SEQ ID NO: 2306037 - DNA, 17 bp, Homo sapiens
taagttgaagggaaatc

SEQ ID NO: 2306038 - DNA, 20 bp, Homo sapiens
taagtttgtctacactaaaa

SEQ ID NO: 2306039 - DNA, 23 bp, Homo sapiens
taataaaataccttttatgtaga

SEQ ID NO: 2306040 - DNA, 14 bp, Homo sapiens
taataaagattcca

SEQ ID NO: 2306041 - DNA, 15 bp, Homo sapiens
taataactagatctc

SEQ ID NO: 2306042 - DNA, 16 bp, Homo sapiens
taataactagatctcc

SEQ ID NO: 2306043 - DNA, 20 bp, Homo sapiens
taataactagatctcctgta

SEQ ID NO: 2306044 - DNA, 13 bp, Homo sapiens
taataactgttag

SEQ ID NO: 2306045 - DNA, 15 bp, Homo sapiens
taataccaactattt

SEQ ID NO: 2306046 - DNA, 17 bp, Homo sapiens
taatacttccttataaa

SEQ ID NO: 2306047 - DNA, 19 bp, Homo sapiens
taatacttccttataaaaa

SEQ ID NO: 2306048 - DNA, 21 bp, Homo sapiens
taatacttccttataaaaatt

SEQ ID NO: 2306049 - DNA, 19 bp, Homo sapiens
taatatactaaccatttct

SEQ ID NO: 2306050 - DNA, 15 bp, Homo sapiens
taatatataatcaaa

SEQ ID NO: 2306051 - DNA, 15 bp, Homo sapiens
taatatcttgaagaa

SEQ ID NO: 2306052 - DNA, 17 bp, Homo sapiens
taatatcttgaagaata

SEQ ID NO: 2306053 - DNA, 13 bp, Homo sapiens
taatatgaatata

SEQ ID NO: 2306054 - DNA, 15 bp, Homo sapiens
taatatgtacttttc

SEQ ID NO: 2306055 - DNA, 13 bp, Homo sapiens
taatattacattt

SEQ ID NO: 2306056 - DNA, 18 bp, Homo sapiens
taatattacatttcattt

SEQ ID NO: 2306057 - DNA, 22 bp, Homo sapiens
taatcaaaagtccttagaatga

SEQ ID NO: 2306058 - DNA, 13 bp, Homo sapiens
taatcacttttca

SEQ ID NO: 2306059 - DNA, 21 bp, Homo sapiens
taatctctaaaattctagtct

SEQ ID NO: 2306060 - DNA, 14 bp, Homo sapiens
taatctttaatata

SEQ ID NO: 2306061 - DNA, 11 bp, Homo sapiens
taatgaataat

SEQ ID NO: 2306062 - DNA, 15 bp, Homo sapiens
taatgacttaagcac

SEQ ID NO: 2306063 - DNA, 21 bp, Homo sapiens
taatgacttaagcacacttga

SEQ ID NO: 2306064 - DNA, 14 bp, Homo sapiens
taatgatactgaat

SEQ ID NO: 2306065 - DNA, 14 bp, Homo sapiens
taatgattcaatgt

SEQ ID NO: 2306066 - DNA, 15 bp, Homo sapiens
taatgattcaatgtg

SEQ ID NO: 2306067 - DNA, 19 bp, Homo sapiens
taatgatttaagcatttta

SEQ ID NO: 2306068 - DNA, 23 bp, Homo sapiens
taatgcactcctgccccggccca

SEQ ID NO: 2306069 - DNA, 12 bp, Homo sapiens
taatgcattatt

SEQ ID NO: 2306070 - DNA, 19 bp, Homo sapiens
taatggcagagcagtctaa

SEQ ID NO: 2306071 - DNA, 20 bp, Homo sapiens
taatgggctgctgtcatttt

SEQ ID NO: 2306072 - DNA, 17 bp, Homo sapiens
taatggggactctccag

SEQ ID NO: 2306073 - DNA, 17 bp, Homo sapiens
taatgtaaaattcatag

SEQ ID NO: 2306074 - DNA, 16 bp, Homo sapiens
taatgtatcttattta

SEQ ID NO: 2306075 - DNA, 21 bp, Homo sapiens
taatgtatcttatttatatat

SEQ ID NO: 2306076 - DNA, 22 bp, Homo sapiens
taatgtgccaaaatgtcaattt

SEQ ID NO: 2306077 - DNA, 17 bp, Homo sapiens
taattaaaacacaacat

SEQ ID NO: 2306078 - DNA, 16 bp, Homo sapiens
taattaaattttaatg

SEQ ID NO: 2306079 - DNA, 14 bp, Homo sapiens
taattacttaatgt

SEQ ID NO: 2306080 - DNA, 21 bp, Homo sapiens
taattactttcagaatatttt

SEQ ID NO: 2306081 - DNA, 16 bp, Homo sapiens
taattatttgtctcag

SEQ ID NO: 2306082 - DNA, 17 bp, Homo sapiens
taattcatttaagaaca

SEQ ID NO: 2306083 - DNA, 22 bp, Homo sapiens
taattcccatctgctttattgc

SEQ ID NO: 2306084 - DNA, 13 bp, Homo sapiens
taattctcattat

SEQ ID NO: 2306085 - DNA, 18 bp, Homo sapiens
taattgtgtaactgttct

SEQ ID NO: 2306086 - DNA, 17 bp, Homo sapiens
taatttacctgaagtct

SEQ ID NO: 2306087 - DNA, 21 bp, Homo sapiens
taatttagatattcatacttt

SEQ ID NO: 2306088 - DNA, 14 bp, Homo sapiens
taatttataatcca

SEQ ID NO: 2306089 - DNA, 15 bp, Homo sapiens
taatttataatccac

SEQ ID NO: 2306090 - DNA, 12 bp, Homo sapiens
tacaaacaaagg

SEQ ID NO: 2306091 - DNA, 21 bp, Homo sapiens
tacaaacaaaggatttgaaaa

SEQ ID NO: 2306092 - DNA, 16 bp, Homo sapiens
tacaaagctgtcactc

SEQ ID NO: 2306093 - DNA, 17 bp, Homo sapiens
tacaaatttttactcag

SEQ ID NO: 2306094 - DNA, 22 bp, Homo sapiens
tacaaatttttactcaggcttt

SEQ ID NO: 2306095 - DNA, 18 bp, Homo sapiens
tacaacttccagatttga

SEQ ID NO: 2306096 - DNA, 18 bp, Homo sapiens
tacaagaaaaagtagaaa

SEQ ID NO: 2306097 - DNA, 20 bp, Homo sapiens
tacaagaaaaagtagaaaaa

SEQ ID NO: 2306098 - DNA, 22 bp, Homo sapiens
tacaagcatcatggatcaacca

SEQ ID NO: 2306099 - DNA, 22 bp, Homo sapiens
tacaataagcgttaagggcaga

SEQ ID NO: 2306100 - DNA, 17 bp, Homo sapiens
tacaattttcatcccac

SEQ ID NO: 2306101 - DNA, 20 bp, Homo sapiens
tacaattttcatcccacaat

SEQ ID NO: 2306102 - DNA, 17 bp, Homo sapiens
tacacaatggttttctt

SEQ ID NO: 2306103 - DNA, 21 bp, Homo sapiens
tacacaatggttttcttgtgt

SEQ ID NO: 2306104 - DNA, 13 bp, Homo sapiens
tacacccaatttt

SEQ ID NO: 2306105 - DNA, 14 bp, Homo sapiens
tacactaaaattta

SEQ ID NO: 2306106 - DNA, 14 bp, Homo sapiens
tacactacaaatgt

SEQ ID NO: 2306107 - DNA, 16 bp, Homo sapiens
tacactgcaatcatat

SEQ ID NO: 2306108 - DNA, 14 bp, Homo sapiens
tacactgtaagaaa

SEQ ID NO: 2306109 - DNA, 13 bp, Homo sapiens
tacactgtatcta

SEQ ID NO: 2306110 - DNA, 17 bp, Homo sapiens
tacactgtatctaaaaa

SEQ ID NO: 2306111 - DNA, 21 bp, Homo sapiens
tacagaaaatagcttttattg

SEQ ID NO: 2306112 - DNA, 18 bp, Homo sapiens
tacagaaacaactgccaa

SEQ ID NO: 2306113 - DNA, 20 bp, Homo sapiens
tacagaaccagcactcccag

SEQ ID NO: 2306114 - DNA, 21 bp, Homo sapiens
tacagaaccagcactcccagg

SEQ ID NO: 2306115 - DNA, 22 bp, Homo sapiens
tacagaaccagcactcccaggg

SEQ ID NO: 2306116 - DNA, 19 bp, Homo sapiens
tacagacaaagcgtggtgg

SEQ ID NO: 2306117 - DNA, 22 bp, Homo sapiens
tacagacaacaaacctgtttct

SEQ ID NO: 2306118 - DNA, 13 bp, Homo sapiens
tacagacctccag

SEQ ID NO: 2306119 - DNA, 15 bp, Homo sapiens
tacagcatgagattg

SEQ ID NO: 2306120 - DNA, 21 bp, Homo sapiens
tacagcatgagattgtacatt

SEQ ID NO: 2306121 - DNA, 20 bp, Homo sapiens
tacagtaactgagtgtggcg

SEQ ID NO: 2306122 - DNA, 18 bp, Homo sapiens
tacagtgatcagttgctc

SEQ ID NO: 2306123 - DNA, 14 bp, Homo sapiens
tacagttatacata

SEQ ID NO: 2306124 - DNA, 13 bp, Homo sapiens
tacataaaagaat

SEQ ID NO: 2306125 - DNA, 23 bp, Homo sapiens
tacatacctctctctatatatac

SEQ ID NO: 2306126 - DNA, 23 bp, Homo sapiens
tacatatggaaatcctgttactt

SEQ ID NO: 2306127 - DNA, 15 bp, Homo sapiens
tacatccagagttct

SEQ ID NO: 2306128 - DNA, 18 bp, Homo sapiens
tacatctagcacagctgt

SEQ ID NO: 2306129 - DNA, 19 bp, Homo sapiens
tacatctagcacagctgtg

SEQ ID NO: 2306130 - DNA, 15 bp, Homo sapiens
tacatctgaaatcta

SEQ ID NO: 2306131 - DNA, 14 bp, Homo sapiens
tacatgtatagtga

SEQ ID NO: 2306132 - DNA, 16 bp, Homo sapiens
tacatgtatagtgagt

SEQ ID NO: 2306133 - DNA, 23 bp, Homo sapiens
tacatgtatagtgagtgtggctt

SEQ ID NO: 2306134 - DNA, 14 bp, Homo sapiens
tacatgtccccctg

SEQ ID NO: 2306135 - DNA, 21 bp, Homo sapiens
tacattaaaagctttagattg

SEQ ID NO: 2306136 - DNA, 23 bp, Homo sapiens
tacatttagaacctgcatttaag

SEQ ID NO: 2306137 - DNA, 11 bp, Homo sapiens
tacatttcatt

SEQ ID NO: 2306138 - DNA, 15 bp, Homo sapiens
tacatttcatttata

SEQ ID NO: 2306139 - DNA, 18 bp, Homo sapiens
tacatttcatttatactg

SEQ ID NO: 2306140 - DNA, 23 bp, Homo sapiens
tacatttgatcttgtaaaaatag

SEQ ID NO: 2306141 - DNA, 22 bp, Homo sapiens
tacatttgatttgatatacaga

SEQ ID NO: 2306142 - DNA, 23 bp, Homo sapiens
taccaaatataaacttgtgtatg

SEQ ID NO: 2306143 - DNA, 22 bp, Homo sapiens
taccaactaagttgtattttaa

SEQ ID NO: 2306144 - DNA, 16 bp, Homo sapiens
taccaagatcacaaat

SEQ ID NO: 2306145 - DNA, 22 bp, Homo sapiens
tacccgagaagcacttgagcat

SEQ ID NO: 2306146 - DNA, 14 bp, Homo sapiens
tacccgcagatcct

SEQ ID NO: 2306147 - DNA, 18 bp, Homo sapiens
tacccgcagatcctgtcc

SEQ ID NO: 2306148 - DNA, 15 bp, Homo sapiens
tacctctaataacct

SEQ ID NO: 2306149 - DNA, 20 bp, Homo sapiens
tacctctctctatatataca

SEQ ID NO: 2306150 - DNA, 16 bp, Homo sapiens
tacctgaagtctttgt

SEQ ID NO: 2306151 - DNA, 19 bp, Homo sapiens
tacctggttttcattattt

SEQ ID NO: 2306152 - DNA, 21 bp, Homo sapiens
tacgacaaaggacgctcccag

SEQ ID NO: 2306153 - DNA, 13 bp, Homo sapiens
tacgctctctgtc

SEQ ID NO: 2306154 - DNA, 14 bp, Homo sapiens
tacgtctggtgttc

SEQ ID NO: 2306155 - DNA, 17 bp, Homo sapiens
tacgtctttagatgcta

SEQ ID NO: 2306156 - DNA, 13 bp, Homo sapiens
tactaaataaaac

SEQ ID NO: 2306157 - DNA, 13 bp, Homo sapiens
tactaagaataaa

SEQ ID NO: 2306158 - DNA, 16 bp, Homo sapiens
tactacagcataaatc

SEQ ID NO: 2306159 - DNA, 20 bp, Homo sapiens
tactacagcataaatctgtt

SEQ ID NO: 2306160 - DNA, 16 bp, Homo sapiens
tactataatttacctg

SEQ ID NO: 2306161 - DNA, 17 bp, Homo sapiens
tagttgaacaagatttc

SEQ ID NO: 2306162 - DNA, 17 bp, Homo sapiens
tagttgagatgtcaaga

SEQ ID NO: 2306163 - DNA, 20 bp, Homo sapiens
tagttgatgaccaatctctg

SEQ ID NO: 2306164 - DNA, 21 bp, Homo sapiens
tagttgatgaccaatctctgt

SEQ ID NO: 2306165 - DNA, 23 bp, Homo sapiens
tagttgatgaccaatctctgtga

SEQ ID NO: 2306166 - DNA, 15 bp, Homo sapiens
tagttgcaaagcatt

SEQ ID NO: 2306167 - DNA, 16 bp, Homo sapiens
tagttggagctagaaa

SEQ ID NO: 2306168 - DNA, 15 bp, Homo sapiens
tagtttcaaaatgtt

SEQ ID NO: 2306169 - DNA, 13 bp, Homo sapiens
tagttttacatta

SEQ ID NO: 2306170 - DNA, 13 bp, Homo sapiens
tataaaatctttc

SEQ ID NO: 2306171 - DNA, 13 bp, Homo sapiens
tataaaatgaggg

SEQ ID NO: 2306172 - DNA, 23 bp, Homo sapiens
tataaacaacagaaacttctcag

SEQ ID NO: 2306173 - DNA, 20 bp, Homo sapiens
tataaaccataaaataaata

SEQ ID NO: 2306174 - DNA, 17 bp, Homo sapiens
tataaacgatatatgta

SEQ ID NO: 2306175 - DNA, 15 bp, Homo sapiens
tataaatgggaagaa

SEQ ID NO: 2306176 - DNA, 11 bp, Homo sapiens
tataaatgttt

SEQ ID NO: 2306177 - DNA, 20 bp, Homo sapiens
tataaatgtttcatgaagaa

SEQ ID NO: 2306178 - DNA, 21 bp, Homo sapiens
tataacaagccaaacattctt

SEQ ID NO: 2306179 - DNA, 20 bp, Homo sapiens
tataagagacaaagtttgga

SEQ ID NO: 2306180 - DNA, 18 bp, Homo sapiens
tataagttaaagagacaa

SEQ ID NO: 2306181 - DNA, 20 bp, Homo sapiens
tataataattacttaatgtg

SEQ ID NO: 2306182 - DNA, 16 bp, Homo sapiens
tataattacttaatgt

SEQ ID NO: 2306183 - DNA, 17 bp, Homo sapiens
tataattacttaatgtg

SEQ ID NO: 2306184 - DNA, 15 bp, Homo sapiens
tataatttccaaact

SEQ ID NO: 2306185 - DNA, 21 bp, Homo sapiens
tataatttgccagacagagat

SEQ ID NO: 2306186 - DNA, 21 bp, Homo sapiens
tataccccgtgaagcatccag

SEQ ID NO: 2306187 - DNA, 14 bp, Homo sapiens
tatactatgtaagg

SEQ ID NO: 2306188 - DNA, 13 bp, Homo sapiens
tatactgcatatc

SEQ ID NO: 2306189 - DNA, 20 bp, Homo sapiens
tatactgtagcaatatattt

SEQ ID NO: 2306190 - DNA, 20 bp, Homo sapiens
tatactgtttgtaatataca

SEQ ID NO: 2306191 - DNA, 15 bp, Homo sapiens
tatactttctcacat

SEQ ID NO: 2306192 - DNA, 14 bp, Homo sapiens
tatagaaaataaaa

SEQ ID NO: 2306193 - DNA, 14 bp, Homo sapiens
tatagacagtttgt

SEQ ID NO: 2306194 - DNA, 18 bp, Homo sapiens
tatagaccccaagcattc

SEQ ID NO: 2306195 - DNA, 15 bp, Homo sapiens
tataggaaaatacat

SEQ ID NO: 2306196 - DNA, 18 bp, Homo sapiens
tataggaaataaatctaa

SEQ ID NO: 2306197 - DNA, 13 bp, Homo sapiens
tataggacaaggg

SEQ ID NO: 2306198 - DNA, 14 bp, Homo sapiens
tatagtctgtactt

SEQ ID NO: 2306199 - DNA, 24 bp, Homo sapiens
tatagtctgtacttcagttctcat

SEQ ID NO: 2306200 - DNA, 15 bp, Homo sapiens
tatagtttgttttct

SEQ ID NO: 2306201 - DNA, 21 bp, Homo sapiens
tatagtttgttttctttttct

SEQ ID NO: 2306202 - DNA, 18 bp, Homo sapiens
tatataaacgatatatgt

SEQ ID NO: 2306203 - DNA, 21 bp, Homo sapiens
tatataaacgatatatgtaaa

SEQ ID NO: 2306204 - DNA, 17 bp, Homo sapiens
tatataagttaaagaga

SEQ ID NO: 2306205 - DNA, 11 bp, Homo sapiens
tatatatatat

SEQ ID NO: 2306206 - DNA, 15 bp, Homo sapiens
tatatatatatcagt

SEQ ID NO: 2306207 - DNA, 14 bp, Homo sapiens
tatatatatatgta

SEQ ID NO: 2306208 - DNA, 13 bp, Homo sapiens
tatatatcagttt

SEQ ID NO: 2306209 - DNA, 16 bp, Homo sapiens
tatatatgaagtaagt

SEQ ID NO: 2306210 - DNA, 11 bp, Homo sapiens
tatatatgtac

SEQ ID NO: 2306211 - DNA, 15 bp, Homo sapiens
tatatatgtacagtt

SEQ ID NO: 2306212 - DNA, 12 bp, Homo sapiens
tatatcagctct

SEQ ID NO: 2306213 - DNA, 13 bp, Homo sapiens
tatatcagctcta

SEQ ID NO: 2306214 - DNA, 16 bp, Homo sapiens
tatatcagctctaaag

SEQ ID NO: 2306215 - DNA, 13 bp, Homo sapiens
tatatctgtaaat

SEQ ID NO: 2306216 - DNA, 14 bp, Homo sapiens
tatatgtaaatata

SEQ ID NO: 2306217 - DNA, 15 bp, Homo sapiens
tatatgtaaatatac

SEQ ID NO: 2306218 - DNA, 20 bp, Homo sapiens
tatatgtacagttatacata

SEQ ID NO: 2306219 - DNA, 15 bp, Homo sapiens
tatatttattatttt

SEQ ID NO: 2306220 - DNA, 16 bp, Homo sapiens
tatatttgaaagaagt

SEQ ID NO: 2306221 - DNA, 15 bp, Homo sapiens
tatatttgtaggtat

SEQ ID NO: 2306222 - DNA, 23 bp, Homo sapiens
tatatttgtaggtatactatgta

SEQ ID NO: 2306223 - DNA, 15 bp, Homo sapiens
tatcaaatcattcaa

SEQ ID NO: 2306224 - DNA, 19 bp, Homo sapiens
tatcaagctaccagctttg

SEQ ID NO: 2306225 - DNA, 17 bp, Homo sapiens
tatcacacttgcaaatg

SEQ ID NO: 2306226 - DNA, 14 bp, Homo sapiens
tatcacctcttcac

SEQ ID NO: 2306227 - DNA, 20 bp, Homo sapiens
tatcagaactcctttctaag

SEQ ID NO: 2306228 - DNA, 22 bp, Homo sapiens
tatcagaactcctttctaagga

SEQ ID NO: 2306229 - DNA, 13 bp, Homo sapiens
tatcagtggttcg

SEQ ID NO: 2306230 - DNA, 13 bp, Homo sapiens
tatccccagctgt

SEQ ID NO: 2306231 - DNA, 13 bp, Homo sapiens
tatcctgaataac

SEQ ID NO: 2306232 - DNA, 15 bp, Homo sapiens
tatctaaaaaataac

SEQ ID NO: 2306233 - DNA, 18 bp, Homo sapiens
tatctaagacaatcacgc

SEQ ID NO: 2306234 - DNA, 21 bp, Homo sapiens
tatctagcaagaagattctaa

SEQ ID NO: 2306235 - DNA, 15 bp, Homo sapiens
tatctatgtcctgga

SEQ ID NO: 2306236 - DNA, 18 bp, Homo sapiens
tatctcaagataggaaga

SEQ ID NO: 2306237 - DNA, 20 bp, Homo sapiens
tatctccagccaatttcaaa

SEQ ID NO: 2306238 - DNA, 15 bp, Homo sapiens
tatctccatccttaa

SEQ ID NO: 2306239 - DNA, 20 bp, Homo sapiens
tatctccatccttaactgtc

SEQ ID NO: 2306240 - DNA, 21 bp, Homo sapiens
tatctccatccttaactgtcc

SEQ ID NO: 2306241 - DNA, 15 bp, Homo sapiens
tatctctactttcct

SEQ ID NO: 2306242 - DNA, 17 bp, Homo sapiens
tatctctactttcctga

SEQ ID NO: 2306243 - DNA, 19 bp, Homo sapiens
tatctctactttcctgatg

SEQ ID NO: 2306244 - DNA, 21 bp, Homo sapiens
tatctgcaaatagtttcaaat

SEQ ID NO: 2306245 - DNA, 18 bp, Homo sapiens
tatctgctgcctctgaaa

SEQ ID NO: 2306246 - DNA, 19 bp, Homo sapiens
tatctgctgcctctgaaaa

SEQ ID NO: 2306247 - DNA, 20 bp, Homo sapiens
tatctgctgcctctgaaaat

SEQ ID NO: 2306248 - DNA, 21 bp, Homo sapiens
tatctgctgcctctgaaaata

SEQ ID NO: 2306249 - DNA, 22 bp, Homo sapiens
tatctgctgcctctgaaaatat

SEQ ID NO: 2306250 - DNA, 21 bp, Homo sapiens
tatctgttactccaaaaagaa

SEQ ID NO: 2306251 - DNA, 15 bp, Homo sapiens
tatcttatctagcaa

SEQ ID NO: 2306252 - DNA, 18 bp, Homo sapiens
tatcttccatatgctctt

SEQ ID NO: 2306253 - DNA, 14 bp, Homo sapiens
tatgaaaatgtaag

SEQ ID NO: 2306254 - DNA, 22 bp, Homo sapiens
tatgaactagagactctgtgat

SEQ ID NO: 2306255 - DNA, 23 bp, Homo sapiens
tatgaactagagactctgtgatc

SEQ ID NO: 2306256 - DNA, 17 bp, Homo sapiens
tatgaagacactgtcaa

SEQ ID NO: 2306257 - DNA, 19 bp, Homo sapiens
tatgaagatgtttttagag

SEQ ID NO: 2306258 - DNA, 23 bp, Homo sapiens
tatgaatatatacataaaaattg

SEQ ID NO: 2306259 - DNA, 11 bp, Homo sapiens
tatgaatctgg

SEQ ID NO: 2306260 - DNA, 22 bp, Homo sapiens
tatgacctaaatccattttcta

SEQ ID NO: 2306261 - DNA, 23 bp, Homo sapiens
tatgacctaaatccattttctaa

SEQ ID NO: 2306262 - DNA, 21 bp, Homo sapiens
tatgactagcaaacaaaaata

SEQ ID NO: 2306263 - DNA, 22 bp, Homo sapiens
tatgactagcaaacaaaaatag

SEQ ID NO: 2306264 - DNA, 17 bp, Homo sapiens
tatgactccagaatttc

SEQ ID NO: 2306265 - DNA, 23 bp, Homo sapiens
tatgactccagaatttcccaaag

SEQ ID NO: 2306266 - DNA, 20 bp, Homo sapiens
tatgagaaaaaaacagcagg

SEQ ID NO: 2306267 - DNA, 20 bp, Homo sapiens
tatgataaccaagaatgtct

SEQ ID NO: 2306268 - DNA, 13 bp, Homo sapiens
tatgatccaagta

SEQ ID NO: 2306269 - DNA, 19 bp, Homo sapiens
tatgattttccctaaaaga

SEQ ID NO: 2306270 - DNA, 13 bp, Homo sapiens
tatgcaacctgtg

SEQ ID NO: 2306271 - DNA, 14 bp, Homo sapiens
tatgcaacctgtgc

SEQ ID NO: 2306272 - DNA, 15 bp, Homo sapiens
tatgcaacctgtgca

SEQ ID NO: 2306273 - DNA, 19 bp, Homo sapiens
tatgcaacctgtgcaaaat

SEQ ID NO: 2306274 - DNA, 22 bp, Homo sapiens
tatgcagcttggagacaggatt

SEQ ID NO: 2306275 - DNA, 13 bp, Homo sapiens
tatgcctccattt

SEQ ID NO: 2306276 - DNA, 19 bp, Homo sapiens
tatgcttaggccagtcagt

SEQ ID NO: 2306277 - DNA, 13 bp, Homo sapiens
tatggaaatacat

SEQ ID NO: 2306278 - DNA, 22 bp, Homo sapiens
tatggaaatacatttagaacct

SEQ ID NO: 2306279 - DNA, 13 bp, Homo sapiens
tatggtattttcg

SEQ ID NO: 2306280 - DNA, 20 bp, Homo sapiens
tatggtattttcgtgcattt

SEQ ID NO: 2306281 - DNA, 22 bp, Homo sapiens
tatggtattttcgtgcatttgt

SEQ ID NO: 2306282 - DNA, 18 bp, Homo sapiens
tatggtgctgctctgtgt

SEQ ID NO: 2306283 - DNA, 17 bp, Homo sapiens
tatgtaagggctttaaa

SEQ ID NO: 2306284 - DNA, 23 bp, Homo sapiens
tatgtaagggctttaaataaaag

SEQ ID NO: 2306285 - DNA, 19 bp, Homo sapiens
tatgtactagtactgtgta

SEQ ID NO: 2306286 - DNA, 17 bp, Homo sapiens
tatgtacttttccattt

SEQ ID NO: 2306287 - DNA, 20 bp, Homo sapiens
tatgtatagaaaataaaata

SEQ ID NO: 2306288 - DNA, 17 bp, Homo sapiens
tatgtcaaaaatatttt

SEQ ID NO: 2306289 - DNA, 17 bp, Homo sapiens
tatgtcagtccaataaa

SEQ ID NO: 2306290 - DNA, 16 bp, Homo sapiens
tatgtcatactctgtg

SEQ ID NO: 2306291 - DNA, 17 bp, Homo sapiens
tatgtgccataaacaga

SEQ ID NO: 2306292 - DNA, 16 bp, Homo sapiens
tatgttgctgaaacac

SEQ ID NO: 2306293 - DNA, 18 bp, Homo sapiens
tattacatttcatttata

SEQ ID NO: 2306294 - DNA, 15 bp, Homo sapiens
tattagccaaagagg

SEQ ID NO: 2306295 - DNA, 13 bp, Homo sapiens
tattataatatag

SEQ ID NO: 2306296 - DNA, 15 bp, Homo sapiens
tattataatatagaa

SEQ ID NO: 2306297 - DNA, 17 bp, Homo sapiens
tattatagtctgtactt

SEQ ID NO: 2306298 - DNA, 13 bp, Homo sapiens
gcagttgcttgtg

SEQ ID NO: 2306299 - DNA, 21 bp, Homo sapiens
gcagttgttatattcattctt

SEQ ID NO: 2306300 - DNA, 17 bp, Homo sapiens
gcagtttggggcagggg

SEQ ID NO: 2306301 - DNA, 20 bp, Homo sapiens
gcataagattatatacaaag

SEQ ID NO: 2306302 - DNA, 14 bp, Homo sapiens
gcatagagctatat

SEQ ID NO: 2306303 - DNA, 21 bp, Homo sapiens
gcatagttctgcaataacagt

SEQ ID NO: 2306304 - DNA, 20 bp, Homo sapiens
gcatatcctggtgtctagtt

SEQ ID NO: 2306305 - DNA, 17 bp, Homo sapiens
gcatcatttcccctccc

SEQ ID NO: 2306306 - DNA, 22 bp, Homo sapiens
gcatccatgcggccggcctggg

SEQ ID NO: 2306307 - DNA, 12 bp, Homo sapiens
gcatccccagcc

SEQ ID NO: 2306308 - DNA, 14 bp, Homo sapiens
gcatccccagcccc

SEQ ID NO: 2306309 - DNA, 16 bp, Homo sapiens
gcatctgatttgcata

SEQ ID NO: 2306310 - DNA, 20 bp, Homo sapiens
gcatgacacgaatattgctg

SEQ ID NO: 2306311 - DNA, 12 bp, Homo sapiens
gcatgaccctgg

SEQ ID NO: 2306312 - DNA, 19 bp, Homo sapiens
gcatgagattgtacatttt

SEQ ID NO: 2306313 - DNA, 16 bp, Homo sapiens
gcatgatgactcttct

SEQ ID NO: 2306314 - DNA, 21 bp, Homo sapiens
gcatgatgactcttcttatca

SEQ ID NO: 2306315 - DNA, 16 bp, Homo sapiens
gcatgggaatgaatgt

SEQ ID NO: 2306316 - DNA, 19 bp, Homo sapiens
gcatgggaatgaatgtcag

SEQ ID NO: 2306317 - DNA, 14 bp, Homo sapiens
gcatggtcctgtgc

SEQ ID NO: 2306318 - DNA, 15 bp, Homo sapiens
gcatggtcctgtgcc

SEQ ID NO: 2306319 - DNA, 18 bp, Homo sapiens
gcatggtcctgtgccccg

SEQ ID NO: 2306320 - DNA, 21 bp, Homo sapiens
gcatgtgatgagaggaaatca

SEQ ID NO: 2306321 - DNA, 20 bp, Homo sapiens
gcatgttgtaacatttcaca

SEQ ID NO: 2306322 - DNA, 23 bp, Homo sapiens
gcattattttgtcataaaatgct

SEQ ID NO: 2306323 - DNA, 21 bp, Homo sapiens
gcattcaaaatagttctattt

SEQ ID NO: 2306324 - DNA, 19 bp, Homo sapiens
gcattccagcgtctgctgt

SEQ ID NO: 2306325 - DNA, 13 bp, Homo sapiens
gcattgaaataat

SEQ ID NO: 2306326 - DNA, 14 bp, Homo sapiens
gcattgaaataata

SEQ ID NO: 2306327 - DNA, 16 bp, Homo sapiens
gcatttaagaacagaa

SEQ ID NO: 2306328 - DNA, 17 bp, Homo sapiens
gcatttctcttcctaaa

SEQ ID NO: 2306329 - DNA, 22 bp, Homo sapiens
gcatttggtaaaggtatgtaaa

SEQ ID NO: 2306330 - DNA, 15 bp, Homo sapiens
gcatttgtgagccaa

SEQ ID NO: 2306331 - DNA, 19 bp, Homo sapiens
gcattttggctcagagtcc

SEQ ID NO: 2306332 - DNA, 16 bp, Homo sapiens
gccaaaatgtcaattt

SEQ ID NO: 2306333 - DNA, 22 bp, Homo sapiens
gccaaaatgtcaatttttaact

SEQ ID NO: 2306334 - DNA, 21 bp, Homo sapiens
gccaaacattcttattttaga

SEQ ID NO: 2306335 - DNA, 16 bp, Homo sapiens
gccaaagatagcagaa

SEQ ID NO: 2306336 - DNA, 22 bp, Homo sapiens
gccaaagtgtacaattttcatc

SEQ ID NO: 2306337 - DNA, 16 bp, Homo sapiens
gccaaataaaatgttt

SEQ ID NO: 2306338 - DNA, 20 bp, Homo sapiens
gccaaatcctgggcatcccc

SEQ ID NO: 2306339 - DNA, 14 bp, Homo sapiens
gccaacctcgctcc

SEQ ID NO: 2306340 - DNA, 23 bp, Homo sapiens
gccaacctcgctccaactccaac

SEQ ID NO: 2306341 - DNA, 18 bp, Homo sapiens
gccaagaattcttaaata

SEQ ID NO: 2306342 - DNA, 16 bp, Homo sapiens
gccaaggacactgatg

SEQ ID NO: 2306343 - DNA, 19 bp, Homo sapiens
gccaattgttcttaaaacc

SEQ ID NO: 2306344 - DNA, 15 bp, Homo sapiens
gccacagtggggccc

SEQ ID NO: 2306345 - DNA, 22 bp, Homo sapiens
gccacagtggggcccatggccc

SEQ ID NO: 2306346 - DNA, 16 bp, Homo sapiens
gccacatcgcagcccc

SEQ ID NO: 2306347 - DNA, 13 bp, Homo sapiens
gccacccaggtga

SEQ ID NO: 2306348 - DNA, 17 bp, Homo sapiens
gccacccgcccgccccc

SEQ ID NO: 2306349 - DNA, 20 bp, Homo sapiens
gccacctagaaaggggccca

SEQ ID NO: 2306350 - DNA, 18 bp, Homo sapiens
gccaccttgtacagaacc

SEQ ID NO: 2306351 - DNA, 17 bp, Homo sapiens
gccacgttgcagaaaaa

SEQ ID NO: 2306352 - DNA, 21 bp, Homo sapiens
gccactattgttagtctcttg

SEQ ID NO: 2306353 - DNA, 21 bp, Homo sapiens
gccactggggtgggagggggc

SEQ ID NO: 2306354 - DNA, 15 bp, Homo sapiens
gccagaatcagcaca

SEQ ID NO: 2306355 - DNA, 20 bp, Homo sapiens
gccagaatcagcacagataa

SEQ ID NO: 2306356 - DNA, 22 bp, Homo sapiens
gccagaatcagcacagataaaa

SEQ ID NO: 2306357 - DNA, 12 bp, Homo sapiens
gccagaatgttt

SEQ ID NO: 2306358 - DNA, 14 bp, Homo sapiens
gccagacagagatc

SEQ ID NO: 2306359 - DNA, 22 bp, Homo sapiens
gccagagccgcaccctggctgg

SEQ ID NO: 2306360 - DNA, 20 bp, Homo sapiens
gccagagctcccaggacgca

SEQ ID NO: 2306361 - DNA, 13 bp, Homo sapiens
gccagcccctccc

SEQ ID NO: 2306362 - DNA, 15 bp, Homo sapiens
gccagcccctccccg

SEQ ID NO: 2306363 - DNA, 23 bp, Homo sapiens
gccagcccctccccgcctcctcc

SEQ ID NO: 2306364 - DNA, 22 bp, Homo sapiens
gccaggatggcgtgtcccctgc

SEQ ID NO: 2306365 - DNA, 23 bp, Homo sapiens
gccagggctccacgggggcctag

SEQ ID NO: 2306366 - DNA, 14 bp, Homo sapiens
gccagggctctggc

SEQ ID NO: 2306367 - DNA, 17 bp, Homo sapiens
gccaggggacctcctgg

SEQ ID NO: 2306368 - DNA, 12 bp, Homo sapiens
gccagggtctcg

SEQ ID NO: 2306369 - DNA, 20 bp, Homo sapiens
gccatcagaaattttctaca

SEQ ID NO: 2306370 - DNA, 14 bp, Homo sapiens
gccatcagcccctg

SEQ ID NO: 2306371 - DNA, 19 bp, Homo sapiens
gccatcagcccctgctgct

SEQ ID NO: 2306372 - DNA, 14 bp, Homo sapiens
gccatccaccctga

SEQ ID NO: 2306373 - DNA, 17 bp, Homo sapiens
gccatccaccctgagga

SEQ ID NO: 2306374 - DNA, 18 bp, Homo sapiens
gccatccaccctgaggag

SEQ ID NO: 2306375 - DNA, 18 bp, Homo sapiens
gccatgaggaacaaggca

SEQ ID NO: 2306376 - DNA, 20 bp, Homo sapiens
gccatgaggaacaaggcaag

SEQ ID NO: 2306377 - DNA, 16 bp, Homo sapiens
gccatgcatgatgggt

SEQ ID NO: 2306378 - DNA, 21 bp, Homo sapiens
gccatgcccaccgcccctgga

SEQ ID NO: 2306379 - DNA, 14 bp, Homo sapiens
gcccaacccccacc

SEQ ID NO: 2306380 - DNA, 16 bp, Homo sapiens
gcccaacctcgccctc

SEQ ID NO: 2306381 - DNA, 21 bp, Homo sapiens
gcccaacctcttcctcctgac

SEQ ID NO: 2306382 - DNA, 13 bp, Homo sapiens
gcccacccacacc

SEQ ID NO: 2306383 - DNA, 15 bp, Homo sapiens
gcccacccacacccc

SEQ ID NO: 2306384 - DNA, 18 bp, Homo sapiens
gcccaccccgctgcctgg

SEQ ID NO: 2306385 - DNA, 14 bp, Homo sapiens
gcccacccgcccca

SEQ ID NO: 2306386 - DNA, 18 bp, Homo sapiens
gcccacccgccccagaga

SEQ ID NO: 2306387 - DNA, 13 bp, Homo sapiens
gcccaccctgggc

SEQ ID NO: 2306388 - DNA, 21 bp, Homo sapiens
gcccaccctgggcctcccgtc

SEQ ID NO: 2306389 - DNA, 12 bp, Homo sapiens
gcccacctgccc

SEQ ID NO: 2306390 - DNA, 15 bp, Homo sapiens
gcccacctgcccagt

SEQ ID NO: 2306391 - DNA, 13 bp, Homo sapiens
gcccacgcagagc

SEQ ID NO: 2306392 - DNA, 14 bp, Homo sapiens
gcccacgcagagcc

SEQ ID NO: 2306393 - DNA, 16 bp, Homo sapiens
gcccacgcagagcccc

SEQ ID NO: 2306394 - DNA, 22 bp, Homo sapiens
gcccacgcagagccccggagca

SEQ ID NO: 2306395 - DNA, 18 bp, Homo sapiens
gcccactgaacatgctca

SEQ ID NO: 2306396 - DNA, 19 bp, Homo sapiens
gcccagaggggcggggcca

SEQ ID NO: 2306397 - DNA, 23 bp, Homo sapiens
gcccaggcaatagtgttgaggag

SEQ ID NO: 2306398 - DNA, 13 bp, Homo sapiens
gcccagttagccc

SEQ ID NO: 2306399 - DNA, 17 bp, Homo sapiens
gcccagttagcccggcc

SEQ ID NO: 2306400 - DNA, 20 bp, Homo sapiens
gcccagttagcccggccaag

SEQ ID NO: 2306401 - DNA, 13 bp, Homo sapiens
gcccatgccctcc

SEQ ID NO: 2306402 - DNA, 18 bp, Homo sapiens
gcccatggccccagctgg

SEQ ID NO: 2306403 - DNA, 19 bp, Homo sapiens
gcccatggccccagctggc

SEQ ID NO: 2306404 - DNA, 15 bp, Homo sapiens
gcccatggcttctgg

SEQ ID NO: 2306405 - DNA, 21 bp, Homo sapiens
gcccatgtgggctgaaggatg

SEQ ID NO: 2306406 - DNA, 13 bp, Homo sapiens
gcccattcagcct

SEQ ID NO: 2306407 - DNA, 13 bp, Homo sapiens
gccccacagtggt

SEQ ID NO: 2306408 - DNA, 16 bp, Homo sapiens
gccccacagtggtcag

SEQ ID NO: 2306409 - DNA, 13 bp, Homo sapiens
gccccacccctcc

SEQ ID NO: 2306410 - DNA, 16 bp, Homo sapiens
gccccagaaagcctca

SEQ ID NO: 2306411 - DNA, 17 bp, Homo sapiens
gccccagaaagcctcag

SEQ ID NO: 2306412 - DNA, 20 bp, Homo sapiens
gccccagaaatgccgctgtg

SEQ ID NO: 2306413 - DNA, 16 bp, Homo sapiens
gccccagagactgccc

SEQ ID NO: 2306414 - DNA, 21 bp, Homo sapiens
gccccagagactgcccaccct

SEQ ID NO: 2306415 - DNA, 22 bp, Homo sapiens
gccccagagactgcccaccctg

SEQ ID NO: 2306416 - DNA, 13 bp, Homo sapiens
gccccagcctcct

SEQ ID NO: 2306417 - DNA, 13 bp, Homo sapiens
gccccagctggct

SEQ ID NO: 2306418 - DNA, 15 bp, Homo sapiens
gccccagctggctgg

SEQ ID NO: 2306419 - DNA, 18 bp, Homo sapiens
gccccagctggctgggtc

SEQ ID NO: 2306420 - DNA, 19 bp, Homo sapiens
gccccagctggctgggtcg

SEQ ID NO: 2306421 - DNA, 20 bp, Homo sapiens
gccccaggccccagcagtct

SEQ ID NO: 2306422 - DNA, 16 bp, Homo sapiens
gccccaggcggagggg

SEQ ID NO: 2306423 - DNA, 15 bp, Homo sapiens
gccccatccttcccg

SEQ ID NO: 2306424 - DNA, 21 bp, Homo sapiens
gccccatccttcccgcagcac

SEQ ID NO: 2306425 - DNA, 19 bp, Homo sapiens
gccccatggtcacagaccc

SEQ ID NO: 2306426 - DNA, 21 bp, Homo sapiens
gccccatggtcacagacccct

SEQ ID NO: 2306427 - DNA, 12 bp, Homo sapiens
gcccccacagat

SEQ ID NO: 2306428 - DNA, 20 bp, Homo sapiens
gcctgaaccgttacaaaaga

SEQ ID NO: 2306429 - DNA, 22 bp, Homo sapiens
gcctgacacaatggtagctctg

SEQ ID NO: 2306430 - DNA, 17 bp, Homo sapiens
gcctgacctttgggact

SEQ ID NO: 2306431 - DNA, 13 bp, Homo sapiens
gcctgagccacag

SEQ ID NO: 2306432 - DNA, 20 bp, Homo sapiens
gcctgagccacagtggggcc

SEQ ID NO: 2306433 - DNA, 21 bp, Homo sapiens
gcctgagccacagtggggccc

SEQ ID NO: 2306434 - DNA, 13 bp, Homo sapiens
gcctgcagcccag

SEQ ID NO: 2306435 - DNA, 14 bp, Homo sapiens
gcctgcagcccaga

SEQ ID NO: 2306436 - DNA, 16 bp, Homo sapiens
gcctgcagcccagaac

SEQ ID NO: 2306437 - DNA, 10 bp, Homo sapiens
gcctgcagct

SEQ ID NO: 2306438 - DNA, 15 bp, Homo sapiens
gcctgcagctgagat

SEQ ID NO: 2306439 - DNA, 12 bp, Homo sapiens
gcctgcccccag

SEQ ID NO: 2306440 - DNA, 14 bp, Homo sapiens
gcctgcgcccccca

SEQ ID NO: 2306441 - DNA, 19 bp, Homo sapiens
gcctgcgccccccagtgga

SEQ ID NO: 2306442 - DNA, 17 bp, Homo sapiens
gcctgcgctcctctgca

SEQ ID NO: 2306443 - DNA, 18 bp, Homo sapiens
gcctgcgctcctctgcag

SEQ ID NO: 2306444 - DNA, 18 bp, Homo sapiens
gcctgcgtggcctggggc

SEQ ID NO: 2306445 - DNA, 19 bp, Homo sapiens
gcctgcgtggcctggggct

SEQ ID NO: 2306446 - DNA, 21 bp, Homo sapiens
gcctgcgtggcctggggctgc

SEQ ID NO: 2306447 - DNA, 15 bp, Homo sapiens
gcctgctagcggctg

SEQ ID NO: 2306448 - DNA, 19 bp, Homo sapiens
gcctggaagagccgagcac

SEQ ID NO: 2306449 - DNA, 14 bp, Homo sapiens
gcctggcggcaggg

SEQ ID NO: 2306450 - DNA, 16 bp, Homo sapiens
gcctggcgggcagccc

SEQ ID NO: 2306451 - DNA, 22 bp, Homo sapiens
gcctggcgggcagcccctgctg

SEQ ID NO: 2306452 - DNA, 23 bp, Homo sapiens
gcctggcgggcagcccctgctgg

SEQ ID NO: 2306453 - DNA, 23 bp, Homo sapiens
gcctggctcacacttggctctga

SEQ ID NO: 2306454 - DNA, 14 bp, Homo sapiens
gcctggctctggag

SEQ ID NO: 2306455 - DNA, 14 bp, Homo sapiens
gcctggggctgccg

SEQ ID NO: 2306456 - DNA, 17 bp, Homo sapiens
gcctggtatggctgcag

SEQ ID NO: 2306457 - DNA, 15 bp, Homo sapiens
gcctgttccctgagg

SEQ ID NO: 2306458 - DNA, 16 bp, Homo sapiens
gcctgtttggggaggg

SEQ ID NO: 2306459 - DNA, 17 bp, Homo sapiens
gcctgtttggggagggg

SEQ ID NO: 2306460 - DNA, 20 bp, Homo sapiens
gcctgtttggggaggggggc

SEQ ID NO: 2306461 - DNA, 16 bp, Homo sapiens
gcctgtttggtgagga

SEQ ID NO: 2306462 - DNA, 16 bp, Homo sapiens
gccttacacaatggtt

SEQ ID NO: 2306463 - DNA, 21 bp, Homo sapiens
gccttacacaatggttttctt

SEQ ID NO: 2306464 - DNA, 19 bp, Homo sapiens
gccttagcactatggacat

SEQ ID NO: 2306465 - DNA, 12 bp, Homo sapiens
gccttccaggcg

SEQ ID NO: 2306466 - DNA, 15 bp, Homo sapiens
gccttccccgtgcgg

SEQ ID NO: 2306467 - DNA, 24 bp, Homo sapiens
gccttgcacaagtacttgagaata

SEQ ID NO: 2306468 - DNA, 22 bp, Homo sapiens
gccttttgttaaacccttctgt

SEQ ID NO: 2306469 - DNA, 17 bp, Homo sapiens
gcgaagtccgaggcctg

SEQ ID NO: 2306470 - DNA, 12 bp, Homo sapiens
gcgacaatgcaa

SEQ ID NO: 2306471 - DNA, 21 bp, Homo sapiens
gcgagtctggagaccaggact

SEQ ID NO: 2306472 - DNA, 14 bp, Homo sapiens
gcgattcctgccaa

SEQ ID NO: 2306473 - DNA, 16 bp, Homo sapiens
gcgcaaagggcgggcc

SEQ ID NO: 2306474 - DNA, 14 bp, Homo sapiens
gcgcaccgcccaac

SEQ ID NO: 2306475 - DNA, 17 bp, Homo sapiens
gcgcaccgcccaacccc

SEQ ID NO: 2306476 - DNA, 19 bp, Homo sapiens
gcgcagccgcgctctgccc

SEQ ID NO: 2306477 - DNA, 15 bp, Homo sapiens
gcgcaggaaccgagg

SEQ ID NO: 2306478 - DNA, 17 bp, Homo sapiens
gcgcaggaaccgaggac

SEQ ID NO: 2306479 - DNA, 18 bp, Homo sapiens
gcgcaggaaccgaggact

SEQ ID NO: 2306480 - DNA, 22 bp, Homo sapiens
gcgcattttgtggctgatttca

SEQ ID NO: 2306481 - DNA, 12 bp, Homo sapiens
gcgccacccgcc

SEQ ID NO: 2306482 - DNA, 15 bp, Homo sapiens
gcgccacccgcccgc

SEQ ID NO: 2306483 - DNA, 12 bp, Homo sapiens
gcgcccacctgc

SEQ ID NO: 2306484 - DNA, 13 bp, Homo sapiens
gcgcccacctgcc

SEQ ID NO: 2306485 - DNA, 16 bp, Homo sapiens
gcgcccacctgcccag

SEQ ID NO: 2306486 - DNA, 15 bp, Homo sapiens
gcgccccccagtgga

SEQ ID NO: 2306487 - DNA, 18 bp, Homo sapiens
gcgccccccagtggactc

SEQ ID NO: 2306488 - DNA, 22 bp, Homo sapiens
gcgccccgaaaggtcacctcac

SEQ ID NO: 2306489 - DNA, 22 bp, Homo sapiens
gcgcccggactgaccgaaggga

SEQ ID NO: 2306490 - DNA, 20 bp, Homo sapiens
gcgccggcgccccggacgcc

SEQ ID NO: 2306491 - DNA, 17 bp, Homo sapiens
gcgcctcccgccgcctc

SEQ ID NO: 2306492 - DNA, 12 bp, Homo sapiens
gcgcgggacagg

SEQ ID NO: 2306493 - DNA, 15 bp, Homo sapiens
gcgctccggcagagg

SEQ ID NO: 2306494 - DNA, 16 bp, Homo sapiens
gcgctccggcagaggc

SEQ ID NO: 2306495 - DNA, 19 bp, Homo sapiens
gcgctcctctgcagcctga

SEQ ID NO: 2306496 - DNA, 13 bp, Homo sapiens
gcgctctgggttt

SEQ ID NO: 2306497 - DNA, 14 bp, Homo sapiens
gcgctgcccccaca

SEQ ID NO: 2306498 - DNA, 17 bp, Homo sapiens
gcgctgcccccacagat

SEQ ID NO: 2306499 - DNA, 18 bp, Homo sapiens
gcgctgcccccacagatc

SEQ ID NO: 2306500 - DNA, 16 bp, Homo sapiens
gcggaggggcttggag

SEQ ID NO: 2306501 - DNA, 20 bp, Homo sapiens
gcggatactcttggagagtt

SEQ ID NO: 2306502 - DNA, 17 bp, Homo sapiens
gcggcaccgcccaccca

SEQ ID NO: 2306503 - DNA, 18 bp, Homo sapiens
gcggcaccgcccacccac

SEQ ID NO: 2306504 - DNA, 16 bp, Homo sapiens
gcggccccgcacccct

SEQ ID NO: 2306505 - DNA, 18 bp, Homo sapiens
gcggccccgcacccctcc

SEQ ID NO: 2306506 - DNA, 21 bp, Homo sapiens
gcggccccgcacccctcctcc

SEQ ID NO: 2306507 - DNA, 21 bp, Homo sapiens
gcggcccggcccacgcagagc

SEQ ID NO: 2306508 - DNA, 20 bp, Homo sapiens
gcggccgacatcagcccggt

SEQ ID NO: 2306509 - DNA, 13 bp, Homo sapiens
gcggcctcagagt

SEQ ID NO: 2306510 - DNA, 14 bp, Homo sapiens
gcggctctgggaag

SEQ ID NO: 2306511 - DNA, 20 bp, Homo sapiens
gcggctgaggacggggcaga

SEQ ID NO: 2306512 - DNA, 23 bp, Homo sapiens
gcggctgaggacggggcagagct

SEQ ID NO: 2306513 - DNA, 15 bp, Homo sapiens
gcgggaaccctctgg

SEQ ID NO: 2306514 - DNA, 13 bp, Homo sapiens
gcgggaagggtgg

SEQ ID NO: 2306515 - DNA, 14 bp, Homo sapiens
gcgggacaggactt

SEQ ID NO: 2306516 - DNA, 12 bp, Homo sapiens
gcgggcagcccc

SEQ ID NO: 2306517 - DNA, 21 bp, Homo sapiens
gcgggcagcccctgctggacc

SEQ ID NO: 2306518 - DNA, 22 bp, Homo sapiens
gcgggcagcccctgctggacca

SEQ ID NO: 2306519 - DNA, 22 bp, Homo sapiens
gcgggcctgtttggtgaggacc

SEQ ID NO: 2306520 - DNA, 20 bp, Homo sapiens
gcgggggctaactggcccca

SEQ ID NO: 2306521 - DNA, 13 bp, Homo sapiens
gcgtagggccagg

SEQ ID NO: 2306522 - DNA, 16 bp, Homo sapiens
gcgtagggccagggct

SEQ ID NO: 2306523 - DNA, 17 bp, Homo sapiens
gcgtagggccagggctc

SEQ ID NO: 2306524 - DNA, 22 bp, Homo sapiens
gcgtatttatttttctgcacct

SEQ ID NO: 2306525 - DNA, 16 bp, Homo sapiens
gcgtcttgtattttct

SEQ ID NO: 2306526 - DNA, 15 bp, Homo sapiens
gcgtgaccggcccgc

SEQ ID NO: 2306527 - DNA, 14 bp, Homo sapiens
gcgtgcccccagcg

SEQ ID NO: 2306528 - DNA, 15 bp, Homo sapiens
gcgtggcctggggct

SEQ ID NO: 2306529 - DNA, 15 bp, Homo sapiens
gcgtgttctcagagg

SEQ ID NO: 2306530 - DNA, 14 bp, Homo sapiens
gcgttaagggcaga

SEQ ID NO: 2306531 - DNA, 17 bp, Homo sapiens
gctaacatggaagtact

SEQ ID NO: 2306532 - DNA, 18 bp, Homo sapiens
gctaacatggaagtacta

SEQ ID NO: 2306533 - DNA, 13 bp, Homo sapiens
gctaactggcccc

SEQ ID NO: 2306534 - DNA, 14 bp, Homo sapiens
gctaactggcccca

SEQ ID NO: 2306535 - DNA, 15 bp, Homo sapiens
gctaactggccccag

SEQ ID NO: 2306536 - DNA, 16 bp, Homo sapiens
gctaactggccccagg

SEQ ID NO: 2306537 - DNA, 21 bp, Homo sapiens
gctaagccccctactgagaaa

SEQ ID NO: 2306538 - DNA, 18 bp, Homo sapiens
gctaagtggaagacagag

SEQ ID NO: 2306539 - DNA, 22 bp, Homo sapiens
gctaagtttgtctacactaaaa

SEQ ID NO: 2306540 - DNA, 19 bp, Homo sapiens
gctaataccaactatttca

SEQ ID NO: 2306541 - DNA, 16 bp, Homo sapiens
gctaatgggctgctgt

SEQ ID NO: 2306542 - DNA, 15 bp, Homo sapiens
gctaatgtaatcatt

SEQ ID NO: 2306543 - DNA, 20 bp, Homo sapiens
gctaccagaagaggggcagc

SEQ ID NO: 2306544 - DNA, 15 bp, Homo sapiens
gctaccaggaagagg

SEQ ID NO: 2306545 - DNA, 21 bp, Homo sapiens
gctacctgggaggctgcggca

SEQ ID NO: 2306546 - DNA, 15 bp, Homo sapiens
gctacctggttttca

SEQ ID NO: 2306547 - DNA, 16 bp, Homo sapiens
gctacctggttttcat

SEQ ID NO: 2306548 - DNA, 19 bp, Homo sapiens
gctagaaaatgaactgtat

SEQ ID NO: 2306549 - DNA, 23 bp, Homo sapiens
gctataacaactctattttttac

SEQ ID NO: 2306550 - DNA, 23 bp, Homo sapiens
gctatatatatatatatatgtat

SEQ ID NO: 2306551 - DNA, 23 bp, Homo sapiens
gctatccaatgatataggaaaat

SEQ ID NO: 2306552 - DNA, 18 bp, Homo sapiens
gctatgcctccatttcag

SEQ ID NO: 2306553 - DNA, 19 bp, Homo sapiens
gctatggaaatacatttag

SEQ ID NO: 2306554 - DNA, 20 bp, Homo sapiens
gctatgttattttcagtgct

SEQ ID NO: 2306555 - DNA, 19 bp, Homo sapiens
gctattataatatagaaag

SEQ ID NO: 2306556 - DNA, 17 bp, Homo sapiens
gctcacaactgtttttg

SEQ ID NO: 2306557 - DNA, 13 bp, Homo sapiens
gctcacacctgta

SEQ ID NO: 2306558 - DNA, 13 bp, Homo sapiens
gctcactgcagcc

SEQ ID NO: 2306559 - DNA, 15 bp, Homo sapiens
gctcactgcagcctc

SEQ ID NO: 2306560 - DNA, 22 bp, Homo sapiens
gctcagcacagcctcacccctg

SEQ ID NO: 2306561 - DNA, 16 bp, Homo sapiens
aactgtttttgaagaa

SEQ ID NO: 2306562 - DNA, 14 bp, Homo sapiens
aacttaatgtgctg

SEQ ID NO: 2306563 - DNA, 17 bp, Homo sapiens
aacttataatttccaaa

SEQ ID NO: 2306564 - DNA, 16 bp, Homo sapiens
aacttctcagttttgg

SEQ ID NO: 2306565 - DNA, 16 bp, Homo sapiens
aactttcctgtactca

SEQ ID NO: 2306566 - DNA, 12 bp, Homo sapiens
aacttttgaaat

SEQ ID NO: 2306567 - DNA, 15 bp, Homo sapiens
aagaaaaaaatagtt

SEQ ID NO: 2306568 - DNA, 21 bp, Homo sapiens
aagaaaaaaatagttttacat

SEQ ID NO: 2306569 - DNA, 12 bp, Homo sapiens
aagaaaaagata

SEQ ID NO: 2306570 - DNA, 14 bp, Homo sapiens
aagaaaaagtagaa

SEQ ID NO: 2306571 - DNA, 22 bp, Homo sapiens
aagaaagggagaaggattcttt

SEQ ID NO: 2306572 - DNA, 14 bp, Homo sapiens
aagaaagtctatgc

SEQ ID NO: 2306573 - DNA, 12 bp, Homo sapiens
aagaaatgagaa

SEQ ID NO: 2306574 - DNA, 15 bp, Homo sapiens
aagaaatgagaaatt

SEQ ID NO: 2306575 - DNA, 21 bp, Homo sapiens
aagaaatgagaaattgtgcca

SEQ ID NO: 2306576 - DNA, 16 bp, Homo sapiens
aagaaatgtagttgat

SEQ ID NO: 2306577 - DNA, 21 bp, Homo sapiens
aagaaatgtagttgatgtatc

SEQ ID NO: 2306578 - DNA, 17 bp, Homo sapiens
aagaacaaaaccccaga

SEQ ID NO: 2306579 - DNA, 16 bp, Homo sapiens
aagaacagaacagcaa

SEQ ID NO: 2306580 - DNA, 14 bp, Homo sapiens
aagaacccttctca

SEQ ID NO: 2306581 - DNA, 16 bp, Homo sapiens
aagaacgtactttctg

SEQ ID NO: 2306582 - DNA, 19 bp, Homo sapiens
aagaagcccgatccacatt

SEQ ID NO: 2306583 - DNA, 21 bp, Homo sapiens
aagaaggcacaggtgtaaata

SEQ ID NO: 2306584 - DNA, 14 bp, Homo sapiens
aagaagggaaattc

SEQ ID NO: 2306585 - DNA, 14 bp, Homo sapiens
aagaagtcaaatga

SEQ ID NO: 2306586 - DNA, 16 bp, Homo sapiens
aagaataaaaaagaag

SEQ ID NO: 2306587 - DNA, 16 bp, Homo sapiens
aagaatcactgcactt

SEQ ID NO: 2306588 - DNA, 14 bp, Homo sapiens
aagaatgaaaacaa

SEQ ID NO: 2306589 - DNA, 15 bp, Homo sapiens
aagaatgtacagaaa

SEQ ID NO: 2306590 - DNA, 16 bp, Homo sapiens
aagaatgtctccattg

SEQ ID NO: 2306591 - DNA, 20 bp, Homo sapiens
aagaatttgaaagtttcctt

SEQ ID NO: 2306592 - DNA, 22 bp, Homo sapiens
aagaatttgaaagtttccttat

SEQ ID NO: 2306593 - DNA, 18 bp, Homo sapiens
aagacagttgggatccaa

SEQ ID NO: 2306594 - DNA, 14 bp, Homo sapiens
aagaccttctgaag

SEQ ID NO: 2306595 - DNA, 20 bp, Homo sapiens
aagaccttctgaagatctca

SEQ ID NO: 2306596 - DNA, 13 bp, Homo sapiens
aagagaaatggta

SEQ ID NO: 2306597 - DNA, 21 bp, Homo sapiens
aagagcaaagtcatgtcagaa

SEQ ID NO: 2306598 - DNA, 15 bp, Homo sapiens
aagaggggcgctgcc

SEQ ID NO: 2306599 - DNA, 15 bp, Homo sapiens
aagaggtactaaaaa

SEQ ID NO: 2306600 - DNA, 12 bp, Homo sapiens
aagataaatgct

SEQ ID NO: 2306601 - DNA, 14 bp, Homo sapiens
aagataaatgcttt

SEQ ID NO: 2306602 - DNA, 20 bp, Homo sapiens
aagataaatgctttaaatag

SEQ ID NO: 2306603 - DNA, 16 bp, Homo sapiens
aagataggaagaaaat

SEQ ID NO: 2306604 - DNA, 21 bp, Homo sapiens
aagatccccattctttctctt

SEQ ID NO: 2306605 - DNA, 13 bp, Homo sapiens
aagatgtgtaaat

SEQ ID NO: 2306606 - DNA, 14 bp, Homo sapiens
aagatgtgtaaata

SEQ ID NO: 2306607 - DNA, 15 bp, Homo sapiens
aagattatatacaaa

SEQ ID NO: 2306608 - DNA, 12 bp, Homo sapiens
aagattccatgg

SEQ ID NO: 2306609 - DNA, 18 bp, Homo sapiens
aagattcctgaatgtaat

SEQ ID NO: 2306610 - DNA, 19 bp, Homo sapiens
aagatttccctaaaaattc

SEQ ID NO: 2306611 - DNA, 18 bp, Homo sapiens
aagattttatccctttct

SEQ ID NO: 2306612 - DNA, 16 bp, Homo sapiens
aagcaaaaaacttcaa

SEQ ID NO: 2306613 - DNA, 14 bp, Homo sapiens
aagcacaaactgtc

SEQ ID NO: 2306614 - DNA, 14 bp, Homo sapiens
aagcactaagaggt

SEQ ID NO: 2306615 - DNA, 15 bp, Homo sapiens
aagcagactatgcag

SEQ ID NO: 2306616 - DNA, 22 bp, Homo sapiens
aagcagagccagtcttcctcct

SEQ ID NO: 2306617 - DNA, 12 bp, Homo sapiens
aagcagggcagc

SEQ ID NO: 2306618 - DNA, 17 bp, Homo sapiens
aagcagtcagcggagag

SEQ ID NO: 2306619 - DNA, 14 bp, Homo sapiens
aagcagtgcatgct

SEQ ID NO: 2306620 - DNA, 22 bp, Homo sapiens
aagcatcatggatcaaccaagt

SEQ ID NO: 2306621 - DNA, 13 bp, Homo sapiens
aagcatccaggca

SEQ ID NO: 2306622 - DNA, 17 bp, Homo sapiens
aagcattactttgtaga

SEQ ID NO: 2306623 - DNA, 18 bp, Homo sapiens
aagcattttactgtctgt

SEQ ID NO: 2306624 - DNA, 20 bp, Homo sapiens
aagcattttactgtctgtaa

SEQ ID NO: 2306625 - DNA, 18 bp, Homo sapiens
aagccaaacattcttatt

SEQ ID NO: 2306626 - DNA, 14 bp, Homo sapiens
aagccactttcctc

SEQ ID NO: 2306627 - DNA, 20 bp, Homo sapiens
aagccactttcctcttcaga

SEQ ID NO: 2306628 - DNA, 20 bp, Homo sapiens
aagccagggcccgggaagca

SEQ ID NO: 2306629 - DNA, 13 bp, Homo sapiens
aagcccacccgcc

SEQ ID NO: 2306630 - DNA, 17 bp, Homo sapiens
aagccgttgacaaggct

SEQ ID NO: 2306631 - DNA, 23 bp, Homo sapiens
aagcctcatgggagtcagggagc

SEQ ID NO: 2306632 - DNA, 15 bp, Homo sapiens
aagcctcctgctgag

SEQ ID NO: 2306633 - DNA, 12 bp, Homo sapiens
aagcgtggtgga

SEQ ID NO: 2306634 - DNA, 15 bp, Homo sapiens
aagcgttaagggcag

SEQ ID NO: 2306635 - DNA, 16 bp, Homo sapiens
aagctggcaggagaca

SEQ ID NO: 2306636 - DNA, 12 bp, Homo sapiens
aagctgttccac

SEQ ID NO: 2306637 - DNA, 22 bp, Homo sapiens
aagctttagattgaaatttatg

SEQ ID NO: 2306638 - DNA, 16 bp, Homo sapiens
aagctttcctgtttcc

SEQ ID NO: 2306639 - DNA, 17 bp, Homo sapiens
aagcttttgtctgtagg

SEQ ID NO: 2306640 - DNA, 23 bp, Homo sapiens
aaggaaaaataagtgggggcagg

SEQ ID NO: 2306641 - DNA, 20 bp, Homo sapiens
aaggaaaacgtgaacaaact

SEQ ID NO: 2306642 - DNA, 19 bp, Homo sapiens
aaggaaaagaggcccaagt

SEQ ID NO: 2306643 - DNA, 20 bp, Homo sapiens
aaggacactgatgggtcctg

SEQ ID NO: 2306644 - DNA, 16 bp, Homo sapiens
aaggactgtgtgacct

SEQ ID NO: 2306645 - DNA, 16 bp, Homo sapiens
aaggacttcctgctac

SEQ ID NO: 2306646 - DNA, 24 bp, Homo sapiens
aaggacttcctgctacagtagctg

SEQ ID NO: 2306647 - DNA, 21 bp, Homo sapiens
aaggagcactagaatgagaaa

SEQ ID NO: 2306648 - DNA, 15 bp, Homo sapiens
aaggatcctgagcca

SEQ ID NO: 2306649 - DNA, 20 bp, Homo sapiens
aaggatcctgagccagattt

SEQ ID NO: 2306650 - DNA, 15 bp, Homo sapiens
aaggattcttttttc

SEQ ID NO: 2306651 - DNA, 19 bp, Homo sapiens
aaggcaggtgggcagacag

SEQ ID NO: 2306652 - DNA, 22 bp, Homo sapiens
aaggcccttcagccagaagact

SEQ ID NO: 2306653 - DNA, 20 bp, Homo sapiens
aaggcctaatgcattatttt

SEQ ID NO: 2306654 - DNA, 21 bp, Homo sapiens
aaggctctatctgctgggctg

SEQ ID NO: 2306655 - DNA, 21 bp, Homo sapiens
aaggctgaatcaaagacattt

SEQ ID NO: 2306656 - DNA, 23 bp, Homo sapiens
aaggctgaatcaaagacatttca

SEQ ID NO: 2306657 - DNA, 17 bp, Homo sapiens
aagggaaatcaatttaa

SEQ ID NO: 2306658 - DNA, 22 bp, Homo sapiens
aagggacggggcccgccccagg

SEQ ID NO: 2306659 - DNA, 22 bp, Homo sapiens
aagggactgaagtatacattta

SEQ ID NO: 2306660 - DNA, 22 bp, Homo sapiens
aagggaggattttgggtggcca

SEQ ID NO: 2306661 - DNA, 13 bp, Homo sapiens
aagggaggggaag

SEQ ID NO: 2306662 - DNA, 15 bp, Homo sapiens
aagggaggggaagag

SEQ ID NO: 2306663 - DNA, 23 bp, Homo sapiens
aagggaggggaagagagaggcct

SEQ ID NO: 2306664 - DNA, 16 bp, Homo sapiens
aagggatccagagacc

SEQ ID NO: 2306665 - DNA, 17 bp, Homo sapiens
aagggatccagagacct

SEQ ID NO: 2306666 - DNA, 15 bp, Homo sapiens
aagggcaggcctgtt

SEQ ID NO: 2306667 - DNA, 18 bp, Homo sapiens
aaggggatcataaagtta

SEQ ID NO: 2306668 - DNA, 20 bp, Homo sapiens
aaggggccaggaaggggaca

SEQ ID NO: 2306669 - DNA, 19 bp, Homo sapiens
aaggtaccaagatcacaaa

SEQ ID NO: 2306670 - DNA, 20 bp, Homo sapiens
aaggtaccaagatcacaaat

SEQ ID NO: 2306671 - DNA, 20 bp, Homo sapiens
aaggtgcagttgctcattgt

SEQ ID NO: 2306672 - DNA, 14 bp, Homo sapiens
aagtaataactgat

SEQ ID NO: 2306673 - DNA, 17 bp, Homo sapiens
aagtactataatttacc

SEQ ID NO: 2306674 - DNA, 17 bp, Homo sapiens
aagtagaaaaaaaaata

SEQ ID NO: 2306675 - DNA, 20 bp, Homo sapiens
aagtagaaaaaaaaataaca

SEQ ID NO: 2306676 - DNA, 14 bp, Homo sapiens
aagtaggagtggct

SEQ ID NO: 2306677 - DNA, 12 bp, Homo sapiens
aagtatacattt

SEQ ID NO: 2306678 - DNA, 20 bp, Homo sapiens
aagtatctctactttcctga

SEQ ID NO: 2306679 - DNA, 22 bp, Homo sapiens
aagtcatgtcagaaggagacag

SEQ ID NO: 2306680 - DNA, 22 bp, Homo sapiens
aagtccacttaaataatcctct

SEQ ID NO: 2306681 - DNA, 21 bp, Homo sapiens
aagtccagctctcccctgcgc

SEQ ID NO: 2306682 - DNA, 20 bp, Homo sapiens
aagtctcgtgagaatatact

SEQ ID NO: 2306683 - DNA, 13 bp, Homo sapiens
aagtctgctgctg

SEQ ID NO: 2306684 - DNA, 19 bp, Homo sapiens
aagtctgcttaccaaaaca

SEQ ID NO: 2306685 - DNA, 16 bp, Homo sapiens
aagtcttgagcaatgt

SEQ ID NO: 2306686 - DNA, 11 bp, Homo sapiens
aagtcttgtat

SEQ ID NO: 2306687 - DNA, 16 bp, Homo sapiens
aagtcttgtataacta

SEQ ID NO: 2306688 - DNA, 18 bp, Homo sapiens
aagtgaggaaatgttttg

SEQ ID NO: 2306689 - DNA, 16 bp, Homo sapiens
aagtgatgatggatga

SEQ ID NO: 2306690 - DNA, 15 bp, Homo sapiens
aagtgctctttccac

SEQ ID NO: 2306691 - DNA, 21 bp, Homo sapiens
aagtgctctttccaccccaaa

SEQ ID NO: 2306692 - DNA, 18 bp, Homo sapiens
aagtggaagacagagatg

SEQ ID NO: 2306693 - DNA, 19 bp, Homo sapiens
aagtggaagacagagatgg

SEQ ID NO: 2306694 - DNA, 14 bp, Homo sapiens
acagcatgtctact

SEQ ID NO: 2306695 - DNA, 19 bp, Homo sapiens
acagccccttgcttctaag

SEQ ID NO: 2306696 - DNA, 12 bp, Homo sapiens
acagcctcaccc

SEQ ID NO: 2306697 - DNA, 18 bp, Homo sapiens
acagcctcacccctgcag

SEQ ID NO: 2306698 - DNA, 19 bp, Homo sapiens
acagcctcacccctgcagg

SEQ ID NO: 2306699 - DNA, 15 bp, Homo sapiens
acagcggcccggccc

SEQ ID NO: 2306700 - DNA, 15 bp, Homo sapiens
acagctaacatggaa

SEQ ID NO: 2306701 - DNA, 17 bp, Homo sapiens
acagctaacatggaagt

SEQ ID NO: 2306702 - DNA, 21 bp, Homo sapiens
acagctacgtgtgcccctctc

SEQ ID NO: 2306703 - DNA, 18 bp, Homo sapiens
acagctgactgaatgcag

SEQ ID NO: 2306704 - DNA, 14 bp, Homo sapiens
acaggaacacccag

SEQ ID NO: 2306705 - DNA, 18 bp, Homo sapiens
acaggaacacccagcccc

SEQ ID NO: 2306706 - DNA, 13 bp, Homo sapiens
acaggaagtactg

SEQ ID NO: 2306707 - DNA, 15 bp, Homo sapiens
acaggaggccatgcc

SEQ ID NO: 2306708 - DNA, 16 bp, Homo sapiens
acaggaggccatgccc

SEQ ID NO: 2306709 - DNA, 17 bp, Homo sapiens
acaggattctcttctca

SEQ ID NO: 2306710 - DNA, 16 bp, Homo sapiens
acaggattgtctgctg

SEQ ID NO: 2306711 - DNA, 20 bp, Homo sapiens
acaggcaacattacaaacaa

SEQ ID NO: 2306712 - DNA, 18 bp, Homo sapiens
acaggccagtagggggag

SEQ ID NO: 2306713 - DNA, 22 bp, Homo sapiens
acaggctgccccacccctccat

SEQ ID NO: 2306714 - DNA, 19 bp, Homo sapiens
acagggtctcactgtgttg

SEQ ID NO: 2306715 - DNA, 23 bp, Homo sapiens
acaggtcttctttaaggaagaat

SEQ ID NO: 2306716 - DNA, 16 bp, Homo sapiens
acaggtgtaaatatag

SEQ ID NO: 2306717 - DNA, 16 bp, Homo sapiens
acaggtgttcctcctc

SEQ ID NO: 2306718 - DNA, 16 bp, Homo sapiens
acaggttccttttgaa

SEQ ID NO: 2306719 - DNA, 22 bp, Homo sapiens
acaggttttcctgaagaattga

SEQ ID NO: 2306720 - DNA, 16 bp, Homo sapiens
acagtaaaacaggctg

SEQ ID NO: 2306721 - DNA, 20 bp, Homo sapiens
acagtaaaacaggctgctta

SEQ ID NO: 2306722 - DNA, 23 bp, Homo sapiens
acagtacatgacccggatgaact

SEQ ID NO: 2306723 - DNA, 22 bp, Homo sapiens
acagtattatagatataaatat

SEQ ID NO: 2306724 - DNA, 19 bp, Homo sapiens
acagtctcattacagattt

SEQ ID NO: 2306725 - DNA, 20 bp, Homo sapiens
acagtctcattacagattta

SEQ ID NO: 2306726 - DNA, 23 bp, Homo sapiens
acagtggggcccatggccccagc

SEQ ID NO: 2306727 - DNA, 19 bp, Homo sapiens
acagtggtcagcgattcct

SEQ ID NO: 2306728 - DNA, 15 bp, Homo sapiens
acagtgtttggacag

SEQ ID NO: 2306729 - DNA, 15 bp, Homo sapiens
acagttgggatccaa

SEQ ID NO: 2306730 - DNA, 19 bp, Homo sapiens
acagtttgtaaatgttatt

SEQ ID NO: 2306731 - DNA, 21 bp, Homo sapiens
acagtttttgtaaccatatga

SEQ ID NO: 2306732 - DNA, 17 bp, Homo sapiens
acataaaagaatgtaca

SEQ ID NO: 2306733 - DNA, 19 bp, Homo sapiens
acataaaagaatgtacaga

SEQ ID NO: 2306734 - DNA, 20 bp, Homo sapiens
acataaaatatacaaacatg

SEQ ID NO: 2306735 - DNA, 14 bp, Homo sapiens
acataaatctgtct

SEQ ID NO: 2306736 - DNA, 18 bp, Homo sapiens
acataaatctgtctgatt

SEQ ID NO: 2306737 - DNA, 15 bp, Homo sapiens
acataatatcttgaa

SEQ ID NO: 2306738 - DNA, 20 bp, Homo sapiens
acatacctctctctatatat

SEQ ID NO: 2306739 - DNA, 13 bp, Homo sapiens
acatagcacagta

SEQ ID NO: 2306740 - DNA, 14 bp, Homo sapiens
acatatatctgatg

SEQ ID NO: 2306741 - DNA, 18 bp, Homo sapiens
acatatggaaatcctgtt

SEQ ID NO: 2306742 - DNA, 19 bp, Homo sapiens
acatatggaaatcctgtta

SEQ ID NO: 2306743 - DNA, 23 bp, Homo sapiens
acatattcttgctttcacaaata

SEQ ID NO: 2306744 - DNA, 21 bp, Homo sapiens
acatatttgtagctagaatat

SEQ ID NO: 2306745 - DNA, 21 bp, Homo sapiens
acatcagcccggtgtgaggag

SEQ ID NO: 2306746 - DNA, 14 bp, Homo sapiens
acatctagcacagc

SEQ ID NO: 2306747 - DNA, 12 bp, Homo sapiens
acatctcagaga

SEQ ID NO: 2306748 - DNA, 20 bp, Homo sapiens
acatctgtatatcagctcta

SEQ ID NO: 2306749 - DNA, 20 bp, Homo sapiens
acatgcacagctaacatgga

SEQ ID NO: 2306750 - DNA, 20 bp, Homo sapiens
acatgcactcagtgtggact

SEQ ID NO: 2306751 - DNA, 15 bp, Homo sapiens
acatgcagaaattga

SEQ ID NO: 2306752 - DNA, 17 bp, Homo sapiens
acatggaacttaaaaca

SEQ ID NO: 2306753 - DNA, 15 bp, Homo sapiens
acatgggttcaattg

SEQ ID NO: 2306754 - DNA, 17 bp, Homo sapiens
acatgtaaaaatgtttc

SEQ ID NO: 2306755 - DNA, 17 bp, Homo sapiens
acatgtatgatttctgt

SEQ ID NO: 2306756 - DNA, 22 bp, Homo sapiens
acattaaaagctttagattgaa

SEQ ID NO: 2306757 - DNA, 15 bp, Homo sapiens
acattaattttatga

SEQ ID NO: 2306758 - DNA, 13 bp, Homo sapiens
acattacaaacaa

SEQ ID NO: 2306759 - DNA, 20 bp, Homo sapiens
acattatgcccttgagtcta

SEQ ID NO: 2306760 - DNA, 17 bp, Homo sapiens
acattgagactgctaga

SEQ ID NO: 2306761 - DNA, 16 bp, Homo sapiens
acattgcccacacctg

SEQ ID NO: 2306762 - DNA, 18 bp, Homo sapiens
acattgctttagacaaat

SEQ ID NO: 2306763 - DNA, 19 bp, Homo sapiens
acatttaaaatagttttct

SEQ ID NO: 2306764 - DNA, 19 bp, Homo sapiens
acatttagaacctgcattt

SEQ ID NO: 2306765 - DNA, 22 bp, Homo sapiens
acatttagaacctgcatttaag

SEQ ID NO: 2306766 - DNA, 15 bp, Homo sapiens
acatttagttaacac

SEQ ID NO: 2306767 - DNA, 23 bp, Homo sapiens
acatttagttaacacacatatat

SEQ ID NO: 2306768 - DNA, 17 bp, Homo sapiens
acattttgtttccaaag

SEQ ID NO: 2306769 - DNA, 17 bp, Homo sapiens
accaaaatatagttaat

SEQ ID NO: 2306770 - DNA, 12 bp, Homo sapiens
accaaatataaa

SEQ ID NO: 2306771 - DNA, 17 bp, Homo sapiens
accaaatataaacttgt

SEQ ID NO: 2306772 - DNA, 20 bp, Homo sapiens
accaaccactgcgaccacaa

SEQ ID NO: 2306773 - DNA, 20 bp, Homo sapiens
accaaggtgcggaccggagc

SEQ ID NO: 2306774 - DNA, 20 bp, Homo sapiens
accaatatcatgtgtagata

SEQ ID NO: 2306775 - DNA, 14 bp, Homo sapiens
accaatctctgtga

SEQ ID NO: 2306776 - DNA, 15 bp, Homo sapiens
accaatctctgtgac

SEQ ID NO: 2306777 - DNA, 16 bp, Homo sapiens
accaccgcgcctacct

SEQ ID NO: 2306778 - DNA, 19 bp, Homo sapiens
accactagactcaaggaag

SEQ ID NO: 2306779 - DNA, 23 bp, Homo sapiens
accactagactcaaggaagaata

SEQ ID NO: 2306780 - DNA, 15 bp, Homo sapiens
accactgaacagaaa

SEQ ID NO: 2306781 - DNA, 16 bp, Homo sapiens
accactgtttcttgct

SEQ ID NO: 2306782 - DNA, 20 bp, Homo sapiens
accagatgacacataaatct

SEQ ID NO: 2306783 - DNA, 17 bp, Homo sapiens
accagcacactcccgag

SEQ ID NO: 2306784 - DNA, 18 bp, Homo sapiens
accagcacactcccgaga

SEQ ID NO: 2306785 - DNA, 15 bp, Homo sapiens
accagcactcccagg

SEQ ID NO: 2306786 - DNA, 23 bp, Homo sapiens
accagcctgagccacagtggggc

SEQ ID NO: 2306787 - DNA, 14 bp, Homo sapiens
accagctgccaaaa

SEQ ID NO: 2306788 - DNA, 17 bp, Homo sapiens
accagctttgtttttgg

SEQ ID NO: 2306789 - DNA, 21 bp, Homo sapiens
accaggactctgccttccagg

SEQ ID NO: 2306790 - DNA, 14 bp, Homo sapiens
accaggccctgctc

SEQ ID NO: 2306791 - DNA, 19 bp, Homo sapiens
accaggctcacaactgttt

SEQ ID NO: 2306792 - DNA, 15 bp, Homo sapiens
accaggctggagtga

SEQ ID NO: 2306793 - DNA, 21 bp, Homo sapiens
accaggtgttaaaaaccatta

SEQ ID NO: 2306794 - DNA, 16 bp, Homo sapiens
accataaaataaataa

SEQ ID NO: 2306795 - DNA, 14 bp, Homo sapiens
accatatgtagcat

SEQ ID NO: 2306796 - DNA, 16 bp, Homo sapiens
accatatgtagcatta

SEQ ID NO: 2306797 - DNA, 19 bp, Homo sapiens
accatatgtagcattaaat

SEQ ID NO: 2306798 - DNA, 20 bp, Homo sapiens
accatatgtagcattaaata

SEQ ID NO: 2306799 - DNA, 22 bp, Homo sapiens
accatatgtagcattaaatata

SEQ ID NO: 2306800 - DNA, 13 bp, Homo sapiens
accatcccactga

SEQ ID NO: 2306801 - DNA, 18 bp, Homo sapiens
acccaaaacacacaattt

SEQ ID NO: 2306802 - DNA, 14 bp, Homo sapiens
acccaacaaccctg

SEQ ID NO: 2306803 - DNA, 14 bp, Homo sapiens
acccaagcacaaac

SEQ ID NO: 2306804 - DNA, 17 bp, Homo sapiens
acccaagcacaaactgt

SEQ ID NO: 2306805 - DNA, 21 bp, Homo sapiens
acccaatacagtctagtttcc

SEQ ID NO: 2306806 - DNA, 17 bp, Homo sapiens
acccaattttaaaaaat

SEQ ID NO: 2306807 - DNA, 18 bp, Homo sapiens
acccaattttaaaaaata

SEQ ID NO: 2306808 - DNA, 21 bp, Homo sapiens
acccacaccccgtctgcccct

SEQ ID NO: 2306809 - DNA, 23 bp, Homo sapiens
acccacaccccgtctgccccttg

SEQ ID NO: 2306810 - DNA, 18 bp, Homo sapiens
acccactccgactccccc

SEQ ID NO: 2306811 - DNA, 19 bp, Homo sapiens
acccactccgactccccct

SEQ ID NO: 2306812 - DNA, 14 bp, Homo sapiens
acccaggtggcgga

SEQ ID NO: 2306813 - DNA, 17 bp, Homo sapiens
acccattcatactaaat

SEQ ID NO: 2306814 - DNA, 14 bp, Homo sapiens
accccacctgaggc

SEQ ID NO: 2306815 - DNA, 14 bp, Homo sapiens
accccatctgctga

SEQ ID NO: 2306816 - DNA, 18 bp, Homo sapiens
accccattctgggactgc

SEQ ID NO: 2306817 - DNA, 13 bp, Homo sapiens
acccccagcctcc

SEQ ID NO: 2306818 - DNA, 14 bp, Homo sapiens
acccccagcctccc

SEQ ID NO: 2306819 - DNA, 18 bp, Homo sapiens
acccccagcctcccccag

SEQ ID NO: 2306820 - DNA, 20 bp, Homo sapiens
acccccagcctcccccaggc

SEQ ID NO: 2306821 - DNA, 15 bp, Homo sapiens
acccccgggtgcctg

SEQ ID NO: 2306822 - DNA, 13 bp, Homo sapiens
accccgtcccggc

SEQ ID NO: 2306823 - DNA, 15 bp, Homo sapiens
accccgtcccggccc

SEQ ID NO: 2306824 - DNA, 13 bp, Homo sapiens
accccgtctgccc

SEQ ID NO: 2306825 - DNA, 16 bp, Homo sapiens
accccgtctgcccctt

SEQ ID NO: 2306826 - DNA, 16 bp, Homo sapiens
acttcagttgtggcct

SEQ ID NO: 2306827 - DNA, 13 bp, Homo sapiens
acttcccagctgg

SEQ ID NO: 2306828 - DNA, 20 bp, Homo sapiens
acttcccagctggcagcgcc

SEQ ID NO: 2306829 - DNA, 23 bp, Homo sapiens
acttccccttgggatgggcacag

SEQ ID NO: 2306830 - DNA, 18 bp, Homo sapiens
acttccctagaagtcttc

SEQ ID NO: 2306831 - DNA, 20 bp, Homo sapiens
acttcctgctacagtagctg

SEQ ID NO: 2306832 - DNA, 17 bp, Homo sapiens
acttcctggattttctt

SEQ ID NO: 2306833 - DNA, 18 bp, Homo sapiens
acttccttataaaaattc

SEQ ID NO: 2306834 - DNA, 14 bp, Homo sapiens
acttctcccttctc

SEQ ID NO: 2306835 - DNA, 11 bp, Homo sapiens
acttctctaga

SEQ ID NO: 2306836 - DNA, 13 bp, Homo sapiens
acttctgaaactt

SEQ ID NO: 2306837 - DNA, 16 bp, Homo sapiens
acttctggggccagcc

SEQ ID NO: 2306838 - DNA, 19 bp, Homo sapiens
acttctggggccagcccct

SEQ ID NO: 2306839 - DNA, 20 bp, Homo sapiens
acttctggggccagcccctc

SEQ ID NO: 2306840 - DNA, 22 bp, Homo sapiens
acttctggggccagcccctccc

SEQ ID NO: 2306841 - DNA, 20 bp, Homo sapiens
acttctgttatcagggccca

SEQ ID NO: 2306842 - DNA, 12 bp, Homo sapiens
acttctgtttca

SEQ ID NO: 2306843 - DNA, 17 bp, Homo sapiens
acttgaacaaaatctgt

SEQ ID NO: 2306844 - DNA, 15 bp, Homo sapiens
acttgaacaagaaat

SEQ ID NO: 2306845 - DNA, 14 bp, Homo sapiens
acttgaattacaac

SEQ ID NO: 2306846 - DNA, 13 bp, Homo sapiens
acttgcaaatgaa

SEQ ID NO: 2306847 - DNA, 19 bp, Homo sapiens
acttgcaaatgaatgcctt

SEQ ID NO: 2306848 - DNA, 20 bp, Homo sapiens
acttgctagtgatacactgt

SEQ ID NO: 2306849 - DNA, 14 bp, Homo sapiens
acttggctctgagg

SEQ ID NO: 2306850 - DNA, 13 bp, Homo sapiens
acttggtagagtt

SEQ ID NO: 2306851 - DNA, 17 bp, Homo sapiens
acttgtgtatgatccaa

SEQ ID NO: 2306852 - DNA, 15 bp, Homo sapiens
actttcatctgagct

SEQ ID NO: 2306853 - DNA, 13 bp, Homo sapiens
actttcctgatgt

SEQ ID NO: 2306854 - DNA, 13 bp, Homo sapiens
actttcgcctcct

SEQ ID NO: 2306855 - DNA, 23 bp, Homo sapiens
actttcgcctcctccagctcctg

SEQ ID NO: 2306856 - DNA, 13 bp, Homo sapiens
actttggtaatgt

SEQ ID NO: 2306857 - DNA, 16 bp, Homo sapiens
acttttctttcagcca

SEQ ID NO: 2306858 - DNA, 15 bp, Homo sapiens
acttttctttttaaa

SEQ ID NO: 2306859 - DNA, 18 bp, Homo sapiens
acttttctttttaaatgt

SEQ ID NO: 2306860 - DNA, 16 bp, Homo sapiens
acttttgtgtattctg

SEQ ID NO: 2306861 - DNA, 20 bp, Homo sapiens
acttttgtgtattctgtgga

SEQ ID NO: 2306862 - DNA, 17 bp, Homo sapiens
actttttcttttgtaag

SEQ ID NO: 2306863 - DNA, 12 bp, Homo sapiens
acttttttataa

SEQ ID NO: 2306864 - DNA, 23 bp, Homo sapiens
acttttttataaattataatgca

SEQ ID NO: 2306865 - DNA, 20 bp, Homo sapiens
agaaaaaaatagttttacat

SEQ ID NO: 2306866 - DNA, 21 bp, Homo sapiens
agaaaaaaatagttttacatt

SEQ ID NO: 2306867 - DNA, 13 bp, Homo sapiens
agaaaaagtagaa

SEQ ID NO: 2306868 - DNA, 17 bp, Homo sapiens
agaaaatagcttttatt

SEQ ID NO: 2306869 - DNA, 20 bp, Homo sapiens
agaaaatagcttttattgag

SEQ ID NO: 2306870 - DNA, 20 bp, Homo sapiens
agaaaatgaactgtatatta

SEQ ID NO: 2306871 - DNA, 15 bp, Homo sapiens
agaaaatgctttctc

SEQ ID NO: 2306872 - DNA, 22 bp, Homo sapiens
agaaaatgctttctcatgcata

SEQ ID NO: 2306873 - DNA, 23 bp, Homo sapiens
agaaaatgctttctcatgcatag

SEQ ID NO: 2306874 - DNA, 16 bp, Homo sapiens
agaaacaactgccaaa

SEQ ID NO: 2306875 - DNA, 24 bp, Homo sapiens
agaaacactttcttgagcaccagg

SEQ ID NO: 2306876 - DNA, 16 bp, Homo sapiens
agaaacgagatttgcc

SEQ ID NO: 2306877 - DNA, 21 bp, Homo sapiens
agaaactaaactaaaatagtt

SEQ ID NO: 2306878 - DNA, 22 bp, Homo sapiens
agaaacttcctttgagaattgt

SEQ ID NO: 2306879 - DNA, 14 bp, Homo sapiens
agaaagctgtggct

SEQ ID NO: 2306880 - DNA, 14 bp, Homo sapiens
agaaaggctctgaa

SEQ ID NO: 2306881 - DNA, 19 bp, Homo sapiens
agaaagggagaaggattct

SEQ ID NO: 2306882 - DNA, 20 bp, Homo sapiens
agaaatattaatatgtactt

SEQ ID NO: 2306883 - DNA, 14 bp, Homo sapiens
agaaatgccgctgt

SEQ ID NO: 2306884 - DNA, 12 bp, Homo sapiens
agaaatgtatat

SEQ ID NO: 2306885 - DNA, 19 bp, Homo sapiens
agaaatgtggatgctcttt

SEQ ID NO: 2306886 - DNA, 18 bp, Homo sapiens
agaaattacaggttcctt

SEQ ID NO: 2306887 - DNA, 15 bp, Homo sapiens
agaaattctataaga

SEQ ID NO: 2306888 - DNA, 22 bp, Homo sapiens
agaaattctataagagacaaag

SEQ ID NO: 2306889 - DNA, 14 bp, Homo sapiens
agaacaaacagaaa

SEQ ID NO: 2306890 - DNA, 18 bp, Homo sapiens
agaacagacgttaccaat

SEQ ID NO: 2306891 - DNA, 22 bp, Homo sapiens
agaacaggaggtgtgaatgcac

SEQ ID NO: 2306892 - DNA, 20 bp, Homo sapiens
agaacaggtgttcctcctcc

SEQ ID NO: 2306893 - DNA, 14 bp, Homo sapiens
agaaccagcactcc

SEQ ID NO: 2306894 - DNA, 17 bp, Homo sapiens
agaaccagcactcccag

SEQ ID NO: 2306895 - DNA, 20 bp, Homo sapiens
agaaccagcactcccagggc

SEQ ID NO: 2306896 - DNA, 13 bp, Homo sapiens
agaacctgcattt

SEQ ID NO: 2306897 - DNA, 23 bp, Homo sapiens
agaaccttttgagtgccttacac

SEQ ID NO: 2306898 - DNA, 13 bp, Homo sapiens
agaacgccctgtg

SEQ ID NO: 2306899 - DNA, 16 bp, Homo sapiens
agaacgccctgtgtcc

SEQ ID NO: 2306900 - DNA, 19 bp, Homo sapiens
agaacgggcctccccgggg

SEQ ID NO: 2306901 - DNA, 13 bp, Homo sapiens
agaactcctttct

SEQ ID NO: 2306902 - DNA, 18 bp, Homo sapiens
agaactgttcatttccac

SEQ ID NO: 2306903 - DNA, 14 bp, Homo sapiens
agaagaaaataacc

SEQ ID NO: 2306904 - DNA, 15 bp, Homo sapiens
agaagaatataaata

SEQ ID NO: 2306905 - DNA, 12 bp, Homo sapiens
agaagataaaaa

SEQ ID NO: 2306906 - DNA, 15 bp, Homo sapiens
agaagcgaacaaaaa

SEQ ID NO: 2306907 - DNA, 17 bp, Homo sapiens
agaaggacttcctgcta

SEQ ID NO: 2306908 - DNA, 21 bp, Homo sapiens
agaaggacttcctgctacagt

SEQ ID NO: 2306909 - DNA, 12 bp, Homo sapiens
agaagggaaatt

SEQ ID NO: 2306910 - DNA, 15 bp, Homo sapiens
agaagtcaaatgaat

SEQ ID NO: 2306911 - DNA, 17 bp, Homo sapiens
agaagtcaaatgaatga

SEQ ID NO: 2306912 - DNA, 18 bp, Homo sapiens
agaagttgccctccaggc

SEQ ID NO: 2306913 - DNA, 20 bp, Homo sapiens
agaataaataaagaagaaaa

SEQ ID NO: 2306914 - DNA, 13 bp, Homo sapiens
agaatacaattca

SEQ ID NO: 2306915 - DNA, 17 bp, Homo sapiens
agaatcgacctcactgt

SEQ ID NO: 2306916 - DNA, 13 bp, Homo sapiens
agaatctattttc

SEQ ID NO: 2306917 - DNA, 22 bp, Homo sapiens
agaatctattttctatgtacta

SEQ ID NO: 2306918 - DNA, 15 bp, Homo sapiens
agaatgactctggaa

SEQ ID NO: 2306919 - DNA, 14 bp, Homo sapiens
agaatgagaaatca

SEQ ID NO: 2306920 - DNA, 15 bp, Homo sapiens
agaatgagaaatcat

SEQ ID NO: 2306921 - DNA, 18 bp, Homo sapiens
agaatgagaaatcatgtt

SEQ ID NO: 2306922 - DNA, 16 bp, Homo sapiens
agaatgcttcaagttt

SEQ ID NO: 2306923 - DNA, 16 bp, Homo sapiens
agaatgtacagaaaat

SEQ ID NO: 2306924 - DNA, 15 bp, Homo sapiens
agaatgtctccattg

SEQ ID NO: 2306925 - DNA, 22 bp, Homo sapiens
agaattgaaccgtcaatgtgaa

SEQ ID NO: 2306926 - DNA, 18 bp, Homo sapiens
agaatttcccaaagcagt

SEQ ID NO: 2306927 - DNA, 22 bp, Homo sapiens
agacaaaacttataatttccaa

SEQ ID NO: 2306928 - DNA, 21 bp, Homo sapiens
agacaaagtttggaagtacat

SEQ ID NO: 2306929 - DNA, 18 bp, Homo sapiens
agacacgcacttctgggg

SEQ ID NO: 2306930 - DNA, 14 bp, Homo sapiens
agacactagtagag

SEQ ID NO: 2306931 - DNA, 20 bp, Homo sapiens
agacactagtagagcaaaga

SEQ ID NO: 2306932 - DNA, 18 bp, Homo sapiens
agacactggtctcagagg

SEQ ID NO: 2306933 - DNA, 17 bp, Homo sapiens
agacactgtcaatgagg

SEQ ID NO: 2306934 - DNA, 21 bp, Homo sapiens
agacagaaaaaaataaaaaca

SEQ ID NO: 2306935 - DNA, 18 bp, Homo sapiens
agacagaaggcaaagttt

SEQ ID NO: 2306936 - DNA, 24 bp, Homo sapiens
agacagacggacgggacagcggcc

SEQ ID NO: 2306937 - DNA, 18 bp, Homo sapiens
agacagagatggcagagc

SEQ ID NO: 2306938 - DNA, 23 bp, Homo sapiens
agacagggtctcactgtgttgcc

SEQ ID NO: 2306939 - DNA, 11 bp, Homo sapiens
agacagtttgt

SEQ ID NO: 2306940 - DNA, 16 bp, Homo sapiens
agacagtttgtaaatg

SEQ ID NO: 2306941 - DNA, 21 bp, Homo sapiens
agacagtttgtaaatgttatt

SEQ ID NO: 2306942 - DNA, 12 bp, Homo sapiens
agaccctgggag

SEQ ID NO: 2306943 - DNA, 13 bp, Homo sapiens
agaccctgggaga

SEQ ID NO: 2306944 - DNA, 20 bp, Homo sapiens
agacctcccccagggagggg

SEQ ID NO: 2306945 - DNA, 12 bp, Homo sapiens
agacctgctcca

SEQ ID NO: 2306946 - DNA, 18 bp, Homo sapiens
agacctgctccagatcct

SEQ ID NO: 2306947 - DNA, 16 bp, Homo sapiens
agacctgggccctggt

SEQ ID NO: 2306948 - DNA, 18 bp, Homo sapiens
agaccttctgaagatctc

SEQ ID NO: 2306949 - DNA, 18 bp, Homo sapiens
agacgaggcctttgcttt

SEQ ID NO: 2306950 - DNA, 14 bp, Homo sapiens
agacgctgagtggg

SEQ ID NO: 2306951 - DNA, 21 bp, Homo sapiens
agactaagttgctaacctcaa

SEQ ID NO: 2306952 - DNA, 21 bp, Homo sapiens
agactatgcagcttggagaca

SEQ ID NO: 2306953 - DNA, 15 bp, Homo sapiens
agactcgagagggct

SEQ ID NO: 2306954 - DNA, 18 bp, Homo sapiens
agactcgagagggctgag

SEQ ID NO: 2306955 - DNA, 19 bp, Homo sapiens
agactcgagagggctgagc

SEQ ID NO: 2306956 - DNA, 21 bp, Homo sapiens
agactcgagagggctgagccc

SEQ ID NO: 2306957 - DNA, 23 bp, Homo sapiens
agactcgagagggctgagcccct

SEQ ID NO: 2306958 - DNA, 19 bp, Homo sapiens
agactctgtgatctaagca

SEQ ID NO: 2306959 - DNA, 17 bp, Homo sapiens
agcctgagctccaccct

SEQ ID NO: 2306960 - DNA, 17 bp, Homo sapiens
agcctgcgtggcctggg

SEQ ID NO: 2306961 - DNA, 17 bp, Homo sapiens
agcctgtgtgaaaatac

SEQ ID NO: 2306962 - DNA, 18 bp, Homo sapiens
agcctttgcgctctgggt

SEQ ID NO: 2306963 - DNA, 12 bp, Homo sapiens
agcgaaagagca

SEQ ID NO: 2306964 - DNA, 13 bp, Homo sapiens
agcgaaagagcaa

SEQ ID NO: 2306965 - DNA, 21 bp, Homo sapiens
agcgatcctccttcctcatcc

SEQ ID NO: 2306966 - DNA, 17 bp, Homo sapiens
agcgattcctgccaagt

SEQ ID NO: 2306967 - DNA, 13 bp, Homo sapiens
agcggagaggacc

SEQ ID NO: 2306968 - DNA, 17 bp, Homo sapiens
agcggccccgcacccct

SEQ ID NO: 2306969 - DNA, 21 bp, Homo sapiens
agcggccccgcacccctcctc

SEQ ID NO: 2306970 - DNA, 22 bp, Homo sapiens
agcggccccgcacccctcctcc

SEQ ID NO: 2306971 - DNA, 14 bp, Homo sapiens
agcggcccggccca

SEQ ID NO: 2306972 - DNA, 17 bp, Homo sapiens
agcggcccggcccacgc

SEQ ID NO: 2306973 - DNA, 18 bp, Homo sapiens
agcggctgaacaggccgc

SEQ ID NO: 2306974 - DNA, 15 bp, Homo sapiens
agcgggcgcgggaca

SEQ ID NO: 2306975 - DNA, 23 bp, Homo sapiens
agcgtggtggacatgcacagcta

SEQ ID NO: 2306976 - DNA, 17 bp, Homo sapiens
agcgttaagggcagagt

SEQ ID NO: 2306977 - DNA, 14 bp, Homo sapiens
agctaaaattttta

SEQ ID NO: 2306978 - DNA, 14 bp, Homo sapiens
agctacagcaaata

SEQ ID NO: 2306979 - DNA, 23 bp, Homo sapiens
agctacagcaaataaaacagtga

SEQ ID NO: 2306980 - DNA, 14 bp, Homo sapiens
agctaccaggaaga

SEQ ID NO: 2306981 - DNA, 16 bp, Homo sapiens
agctaccaggaagagg

SEQ ID NO: 2306982 - DNA, 19 bp, Homo sapiens
agctaccaggaagaggggc

SEQ ID NO: 2306983 - DNA, 16 bp, Homo sapiens
agctagaatatcctat

SEQ ID NO: 2306984 - DNA, 20 bp, Homo sapiens
agctatgagagatgtgtcca

SEQ ID NO: 2306985 - DNA, 17 bp, Homo sapiens
agctcacaccgcaccgg

SEQ ID NO: 2306986 - DNA, 16 bp, Homo sapiens
agctcaggtgcctttg

SEQ ID NO: 2306987 - DNA, 18 bp, Homo sapiens
agctccaacctggaggct

SEQ ID NO: 2306988 - DNA, 22 bp, Homo sapiens
agctccaacctggaggctggac

SEQ ID NO: 2306989 - DNA, 12 bp, Homo sapiens
agctcctgcccc

SEQ ID NO: 2306990 - DNA, 21 bp, Homo sapiens
agctctaaagcagagatgtat

SEQ ID NO: 2306991 - DNA, 22 bp, Homo sapiens
agctctcccctgcgcaggccct

SEQ ID NO: 2306992 - DNA, 14 bp, Homo sapiens
agctctcctgggcc

SEQ ID NO: 2306993 - DNA, 21 bp, Homo sapiens
agctctcctgggccagggtct

SEQ ID NO: 2306994 - DNA, 19 bp, Homo sapiens
agctctgaagggaggggaa

SEQ ID NO: 2306995 - DNA, 16 bp, Homo sapiens
agctctgacctgcccc

SEQ ID NO: 2306996 - DNA, 21 bp, Homo sapiens
agctctgacctgcccccgctc

SEQ ID NO: 2306997 - DNA, 19 bp, Homo sapiens
agctctgcataagattata

SEQ ID NO: 2306998 - DNA, 16 bp, Homo sapiens
agctcttggcaggagt

SEQ ID NO: 2306999 - DNA, 18 bp, Homo sapiens
agctcttggcaggagtgg

SEQ ID NO: 2307000 - DNA, 21 bp, Homo sapiens
agctgaagatccccattcttt

SEQ ID NO: 2307001 - DNA, 17 bp, Homo sapiens
agctgagtcggctgggc

SEQ ID NO: 2307002 - DNA, 18 bp, Homo sapiens
agctgagtcggctgggca

SEQ ID NO: 2307003 - DNA, 23 bp, Homo sapiens
agctgagtcggctgggcagggcc

SEQ ID NO: 2307004 - DNA, 21 bp, Homo sapiens
agctgctatccaatgatatag

SEQ ID NO: 2307005 - DNA, 19 bp, Homo sapiens
agctgcttccagttggact

SEQ ID NO: 2307006 - DNA, 22 bp, Homo sapiens
agctggagtggggtttgctttt

SEQ ID NO: 2307007 - DNA, 12 bp, Homo sapiens
agctggcagcgc

SEQ ID NO: 2307008 - DNA, 16 bp, Homo sapiens
agctggcagcgcctcc

SEQ ID NO: 2307009 - DNA, 13 bp, Homo sapiens
agctggctgggtc

SEQ ID NO: 2307010 - DNA, 22 bp, Homo sapiens
agctggctgggtcgcccctcct

SEQ ID NO: 2307011 - DNA, 23 bp, Homo sapiens
agctggctgggtcgcccctcctc

SEQ ID NO: 2307012 - DNA, 22 bp, Homo sapiens
agctgggactcagttcttggcc

SEQ ID NO: 2307013 - DNA, 20 bp, Homo sapiens
agctgtcactcacaaaaggc

SEQ ID NO: 2307014 - DNA, 12 bp, Homo sapiens
agcttgtttcta

SEQ ID NO: 2307015 - DNA, 14 bp, Homo sapiens
agctttaacatttt

SEQ ID NO: 2307016 - DNA, 18 bp, Homo sapiens
agctttagattgaaattt

SEQ ID NO: 2307017 - DNA, 15 bp, Homo sapiens
agctttcctgtttcc

SEQ ID NO: 2307018 - DNA, 23 bp, Homo sapiens
agctttctaagctttcttacaat

SEQ ID NO: 2307019 - DNA, 13 bp, Homo sapiens
aggaaaaactgat

SEQ ID NO: 2307020 - DNA, 13 bp, Homo sapiens
aggaaaatacatt

SEQ ID NO: 2307021 - DNA, 14 bp, Homo sapiens
aggaaagaaccgaa

SEQ ID NO: 2307022 - DNA, 14 bp, Homo sapiens
aggaaatagtgttc

SEQ ID NO: 2307023 - DNA, 13 bp, Homo sapiens
aggaacaaggcaa

SEQ ID NO: 2307024 - DNA, 17 bp, Homo sapiens
aggaacaaggcaaggct

SEQ ID NO: 2307025 - DNA, 23 bp, Homo sapiens
aggaacaaggcaaggctgtcaat

SEQ ID NO: 2307026 - DNA, 14 bp, Homo sapiens
aggaacacccagcc

SEQ ID NO: 2307027 - DNA, 17 bp, Homo sapiens
aggaacacccagcccca

SEQ ID NO: 2307028 - DNA, 16 bp, Homo sapiens
aggaacagagtatata

SEQ ID NO: 2307029 - DNA, 19 bp, Homo sapiens
aggaacagagtatatatgt

SEQ ID NO: 2307030 - DNA, 16 bp, Homo sapiens
aggaagaaaatttcct

SEQ ID NO: 2307031 - DNA, 16 bp, Homo sapiens
aggaagagatgctcta

SEQ ID NO: 2307032 - DNA, 16 bp, Homo sapiens
aggaagcctcctgctg

SEQ ID NO: 2307033 - DNA, 22 bp, Homo sapiens
aggaagctgcctggtgtggagt

SEQ ID NO: 2307034 - DNA, 11 bp, Homo sapiens
aggaagtactg

SEQ ID NO: 2307035 - DNA, 19 bp, Homo sapiens
aggaagtactggagaaaat

SEQ ID NO: 2307036 - DNA, 20 bp, Homo sapiens
aggaagtccctgagaagcct

SEQ ID NO: 2307037 - DNA, 21 bp, Homo sapiens
aggaatatccagtcaaagacg

SEQ ID NO: 2307038 - DNA, 17 bp, Homo sapiens
aggaatgtgcttttcca

SEQ ID NO: 2307039 - DNA, 13 bp, Homo sapiens
aggacaaggggtg

SEQ ID NO: 2307040 - DNA, 16 bp, Homo sapiens
aggacaaggggtggaa

SEQ ID NO: 2307041 - DNA, 18 bp, Homo sapiens
aggacacggaccctgtgt

SEQ ID NO: 2307042 - DNA, 12 bp, Homo sapiens
aggacactgatg

SEQ ID NO: 2307043 - DNA, 18 bp, Homo sapiens
aggacactgatgggtcct

SEQ ID NO: 2307044 - DNA, 21 bp, Homo sapiens
aggacactgatgggtcctgct

SEQ ID NO: 2307045 - DNA, 21 bp, Homo sapiens
aggacatagcctgcaaagctg

SEQ ID NO: 2307046 - DNA, 22 bp, Homo sapiens
aggaccccatctgctgagctct

SEQ ID NO: 2307047 - DNA, 13 bp, Homo sapiens
aggacctccacct

SEQ ID NO: 2307048 - DNA, 16 bp, Homo sapiens
aggacctccacctggg

SEQ ID NO: 2307049 - DNA, 23 bp, Homo sapiens
aggacctccacctgggagatgct

SEQ ID NO: 2307050 - DNA, 19 bp, Homo sapiens
aggacgcagggagaccctg

SEQ ID NO: 2307051 - DNA, 21 bp, Homo sapiens
aggacgcagggagaccctggg

SEQ ID NO: 2307052 - DNA, 14 bp, Homo sapiens
aggacggggcagag

SEQ ID NO: 2307053 - DNA, 15 bp, Homo sapiens
aggacggggcagagc

SEQ ID NO: 2307054 - DNA, 12 bp, Homo sapiens
aggactccaggg

SEQ ID NO: 2307055 - DNA, 21 bp, Homo sapiens
aggactctgccttccaggcgt

SEQ ID NO: 2307056 - DNA, 14 bp, Homo sapiens
aggactgttctaac

SEQ ID NO: 2307057 - DNA, 18 bp, Homo sapiens
aggagacagtcaggaagc

SEQ ID NO: 2307058 - DNA, 14 bp, Homo sapiens
aggagactcaggcc

SEQ ID NO: 2307059 - DNA, 16 bp, Homo sapiens
aggagactcaggccca

SEQ ID NO: 2307060 - DNA, 20 bp, Homo sapiens
aggagcaaggctgccctgtc

SEQ ID NO: 2307061 - DNA, 21 bp, Homo sapiens
aggagcaaggctgccctgtcc

SEQ ID NO: 2307062 - DNA, 9 bp, Homo sapiens
aggagcacc

SEQ ID NO: 2307063 - DNA, 10 bp, Homo sapiens
aggagcaccc

SEQ ID NO: 2307064 - DNA, 16 bp, Homo sapiens
aggagcacccccagcc

SEQ ID NO: 2307065 - DNA, 20 bp, Homo sapiens
aggagcacccccagcctccc

SEQ ID NO: 2307066 - DNA, 18 bp, Homo sapiens
aggagctcacaccgcacc

SEQ ID NO: 2307067 - DNA, 14 bp, Homo sapiens
aggaggccatgccc

SEQ ID NO: 2307068 - DNA, 16 bp, Homo sapiens
aggagggatagagacg

SEQ ID NO: 2307069 - DNA, 14 bp, Homo sapiens
aggagggcatgtgc

SEQ ID NO: 2307070 - DNA, 14 bp, Homo sapiens
aggaggggagcaag

SEQ ID NO: 2307071 - DNA, 16 bp, Homo sapiens
aggagggtttgggcag

SEQ ID NO: 2307072 - DNA, 16 bp, Homo sapiens
aggagtctgattgcag

SEQ ID NO: 2307073 - DNA, 17 bp, Homo sapiens
aggagtggctgaccagg

SEQ ID NO: 2307074 - DNA, 20 bp, Homo sapiens
aggagttgtctgtcctggtc

SEQ ID NO: 2307075 - DNA, 14 bp, Homo sapiens
aggatcctgagcca

SEQ ID NO: 2307076 - DNA, 17 bp, Homo sapiens
aggatcctgagccagat

SEQ ID NO: 2307077 - DNA, 17 bp, Homo sapiens
aggatctttgttcctct

SEQ ID NO: 2307078 - DNA, 18 bp, Homo sapiens
aggatggcgtgtcccctg

SEQ ID NO: 2307079 - DNA, 20 bp, Homo sapiens
aggatgggggctcctggcag

SEQ ID NO: 2307080 - DNA, 18 bp, Homo sapiens
aggattaatctctaaaat

SEQ ID NO: 2307081 - DNA, 11 bp, Homo sapiens
aggatttgaaa

SEQ ID NO: 2307082 - DNA, 13 bp, Homo sapiens
aggatttggctcg

SEQ ID NO: 2307083 - DNA, 17 bp, Homo sapiens
aggcaaggctgtcaatt

SEQ ID NO: 2307084 - DNA, 20 bp, Homo sapiens
aggcaatagtgttgaggagg

SEQ ID NO: 2307085 - DNA, 19 bp, Homo sapiens
aggcaattcagtcctgggc

SEQ ID NO: 2307086 - DNA, 16 bp, Homo sapiens
aggcacaaagggcagg

SEQ ID NO: 2307087 - DNA, 17 bp, Homo sapiens
aggcacaggtgtaaata

SEQ ID NO: 2307088 - DNA, 21 bp, Homo sapiens
aggcagacgaggcctttgctt

SEQ ID NO: 2307089 - DNA, 21 bp, Homo sapiens
aggcagagctcagcacagcct

SEQ ID NO: 2307090 - DNA, 11 bp, Homo sapiens
aggcagcatgg

SEQ ID NO: 2307091 - DNA, 19 bp, Homo sapiens
aggcaggagggcatgtgca

SEQ ID NO: 2307092 - DNA, 16 bp, Homo sapiens
ataccccgtgaagcat

SEQ ID NO: 2307093 - DNA, 17 bp, Homo sapiens
atactaaataaaacaat

SEQ ID NO: 2307094 - DNA, 16 bp, Homo sapiens
atactacagcataaat

SEQ ID NO: 2307095 - DNA, 18 bp, Homo sapiens
atactatgtaagggcttt

SEQ ID NO: 2307096 - DNA, 15 bp, Homo sapiens
atactcaccaaaata

SEQ ID NO: 2307097 - DNA, 18 bp, Homo sapiens
atactctgtgtaatctct

SEQ ID NO: 2307098 - DNA, 18 bp, Homo sapiens
atactgaattgttatgta

SEQ ID NO: 2307099 - DNA, 21 bp, Homo sapiens
atactgcatatcctggtgtct

SEQ ID NO: 2307100 - DNA, 16 bp, Homo sapiens
atactggactcttcaa

SEQ ID NO: 2307101 - DNA, 19 bp, Homo sapiens
atactggactcttcaaaaa

SEQ ID NO: 2307102 - DNA, 23 bp, Homo sapiens
atactgtagcaatatatttgtag

SEQ ID NO: 2307103 - DNA, 14 bp, Homo sapiens
atactgtatatgtc

SEQ ID NO: 2307104 - DNA, 20 bp, Homo sapiens
atactgtatatgtcaaaaat

SEQ ID NO: 2307105 - DNA, 12 bp, Homo sapiens
atacttccttat

SEQ ID NO: 2307106 - DNA, 20 bp, Homo sapiens
atactttctgagatggtggt

SEQ ID NO: 2307107 - DNA, 17 bp, Homo sapiens
atacttttggggaggag

SEQ ID NO: 2307108 - DNA, 20 bp, Homo sapiens
atagaaaactgtggttaaag

SEQ ID NO: 2307109 - DNA, 13 bp, Homo sapiens
atagaaaataaaa

SEQ ID NO: 2307110 - DNA, 22 bp, Homo sapiens
atagaaaataaaataaattatg

SEQ ID NO: 2307111 - DNA, 22 bp, Homo sapiens
atagaaactaaactaaaatagt

SEQ ID NO: 2307112 - DNA, 13 bp, Homo sapiens
atagaatatataa

SEQ ID NO: 2307113 - DNA, 21 bp, Homo sapiens
atagacaagtgttttgggttt

SEQ ID NO: 2307114 - DNA, 14 bp, Homo sapiens
atagacagtttgta

SEQ ID NO: 2307115 - DNA, 22 bp, Homo sapiens
atagacagtttgtaaatgttat

SEQ ID NO: 2307116 - DNA, 19 bp, Homo sapiens
atagacttcgaaaacagat

SEQ ID NO: 2307117 - DNA, 23 bp, Homo sapiens
atagacttcgaaaacagatgaga

SEQ ID NO: 2307118 - DNA, 18 bp, Homo sapiens
atagagtttaacagatat

SEQ ID NO: 2307119 - DNA, 14 bp, Homo sapiens
atagataacagaga

SEQ ID NO: 2307120 - DNA, 17 bp, Homo sapiens
atagcaatagcatggat

SEQ ID NO: 2307121 - DNA, 23 bp, Homo sapiens
atagcatcctgattattgaatgt

SEQ ID NO: 2307122 - DNA, 14 bp, Homo sapiens
atagcatctgctct

SEQ ID NO: 2307123 - DNA, 19 bp, Homo sapiens
atagcatctgctcttctct

SEQ ID NO: 2307124 - DNA, 18 bp, Homo sapiens
atagccattcatttacaa

SEQ ID NO: 2307125 - DNA, 14 bp, Homo sapiens
atagcttttattga

SEQ ID NO: 2307126 - DNA, 23 bp, Homo sapiens
atagcttttattgagtaatatta

SEQ ID NO: 2307127 - DNA, 16 bp, Homo sapiens
ataggaaaaactgatt

SEQ ID NO: 2307128 - DNA, 17 bp, Homo sapiens
ataggaagacgcagagc

SEQ ID NO: 2307129 - DNA, 22 bp, Homo sapiens
ataggacaaggggtggaagggc

SEQ ID NO: 2307130 - DNA, 23 bp, Homo sapiens
atagtagcagagtcattgttaca

SEQ ID NO: 2307131 - DNA, 20 bp, Homo sapiens
atagtaggctaaaaacattt

SEQ ID NO: 2307132 - DNA, 21 bp, Homo sapiens
atagtaggctaaaaacatttt

SEQ ID NO: 2307133 - DNA, 20 bp, Homo sapiens
atagtcatgtttctgcagta

SEQ ID NO: 2307134 - DNA, 20 bp, Homo sapiens
atagttaattgtggctttat

SEQ ID NO: 2307135 - DNA, 21 bp, Homo sapiens
atagttaattgtggctttatg

SEQ ID NO: 2307136 - DNA, 18 bp, Homo sapiens
atagttccattctatgac

SEQ ID NO: 2307137 - DNA, 19 bp, Homo sapiens
atagttccattctatgact

SEQ ID NO: 2307138 - DNA, 13 bp, Homo sapiens
atagttctatttc

SEQ ID NO: 2307139 - DNA, 14 bp, Homo sapiens
atagttgatatgta

SEQ ID NO: 2307140 - DNA, 15 bp, Homo sapiens
atagtttaaaaatat

SEQ ID NO: 2307141 - DNA, 13 bp, Homo sapiens
atagtttgttttc

SEQ ID NO: 2307142 - DNA, 21 bp, Homo sapiens
atagtttgttttctttttctg

SEQ ID NO: 2307143 - DNA, 15 bp, Homo sapiens
atagttttctaaatg

SEQ ID NO: 2307144 - DNA, 15 bp, Homo sapiens
atataaaatacataa

SEQ ID NO: 2307145 - DNA, 16 bp, Homo sapiens
atataaaatacataaa

SEQ ID NO: 2307146 - DNA, 13 bp, Homo sapiens
atataaacttgtg

SEQ ID NO: 2307147 - DNA, 23 bp, Homo sapiens
atataaacttgtgtatgatccaa

SEQ ID NO: 2307148 - DNA, 13 bp, Homo sapiens
atataactgtctt

SEQ ID NO: 2307149 - DNA, 19 bp, Homo sapiens
atataagttaaagagacaa

SEQ ID NO: 2307150 - DNA, 15 bp, Homo sapiens
atataatatgaatat

SEQ ID NO: 2307151 - DNA, 20 bp, Homo sapiens
atataatttgccagacagag

SEQ ID NO: 2307152 - DNA, 21 bp, Homo sapiens
atataatttgccagacagaga

SEQ ID NO: 2307153 - DNA, 22 bp, Homo sapiens
atataatttgccagacagagat

SEQ ID NO: 2307154 - DNA, 14 bp, Homo sapiens
atatacaaacatgt

SEQ ID NO: 2307155 - DNA, 16 bp, Homo sapiens
atatacagacctccag

SEQ ID NO: 2307156 - DNA, 18 bp, Homo sapiens
atatacagacctccagat

SEQ ID NO: 2307157 - DNA, 22 bp, Homo sapiens
atatacagcatgagattgtaca

SEQ ID NO: 2307158 - DNA, 12 bp, Homo sapiens
atatacataaaa

SEQ ID NO: 2307159 - DNA, 16 bp, Homo sapiens
atatactaaccatttc

SEQ ID NO: 2307160 - DNA, 12 bp, Homo sapiens
atatactgcata

SEQ ID NO: 2307161 - DNA, 13 bp, Homo sapiens
atataggaaaata

SEQ ID NO: 2307162 - DNA, 17 bp, Homo sapiens
atataggaaaatacatt

SEQ ID NO: 2307163 - DNA, 17 bp, Homo sapiens
atatagttgaacaagat

SEQ ID NO: 2307164 - DNA, 23 bp, Homo sapiens
atatagttgaacaagatttccct

SEQ ID NO: 2307165 - DNA, 15 bp, Homo sapiens
atatagtttgttttc

SEQ ID NO: 2307166 - DNA, 19 bp, Homo sapiens
atatataaacgatatatgt

SEQ ID NO: 2307167 - DNA, 22 bp, Homo sapiens
atatataaacgatatatgtaaa

SEQ ID NO: 2307168 - DNA, 13 bp, Homo sapiens
atatataatatat

SEQ ID NO: 2307169 - DNA, 10 bp, Homo sapiens
atatatatat

SEQ ID NO: 2307170 - DNA, 14 bp, Homo sapiens
atatatatatatca

SEQ ID NO: 2307171 - DNA, 15 bp, Homo sapiens
atatatatatatgta

SEQ ID NO: 2307172 - DNA, 15 bp, Homo sapiens
atatatatgagtgaa

SEQ ID NO: 2307173 - DNA, 15 bp, Homo sapiens
atatatcagtttgat

SEQ ID NO: 2307174 - DNA, 17 bp, Homo sapiens
atatatgaagtaagttc

SEQ ID NO: 2307175 - DNA, 18 bp, Homo sapiens
atatatgtaaatatacag

SEQ ID NO: 2307176 - DNA, 13 bp, Homo sapiens
atatatgtacagt

SEQ ID NO: 2307177 - DNA, 13 bp, Homo sapiens
atatatttccaaa

SEQ ID NO: 2307178 - DNA, 20 bp, Homo sapiens
atatatttccaaatattcta

SEQ ID NO: 2307179 - DNA, 14 bp, Homo sapiens
atatcaatgcccaa

SEQ ID NO: 2307180 - DNA, 11 bp, Homo sapiens
atatcagctct

SEQ ID NO: 2307181 - DNA, 20 bp, Homo sapiens
atatcagctctgcataagat

SEQ ID NO: 2307182 - DNA, 17 bp, Homo sapiens
atatcatcaatactttt

SEQ ID NO: 2307183 - DNA, 23 bp, Homo sapiens
atatcatgtgtagatattatgta

SEQ ID NO: 2307184 - DNA, 23 bp, Homo sapiens
atatctgtaaatttaactgcata

SEQ ID NO: 2307185 - DNA, 15 bp, Homo sapiens
atatctgtaatatat

SEQ ID NO: 2307186 - DNA, 19 bp, Homo sapiens
atatctgtaatatataatc

SEQ ID NO: 2307187 - DNA, 19 bp, Homo sapiens
atatgaaagagaaaatgct

SEQ ID NO: 2307188 - DNA, 19 bp, Homo sapiens
atatgaagtaagttctgaa

SEQ ID NO: 2307189 - DNA, 23 bp, Homo sapiens
atatgacctaaatccattttcta

SEQ ID NO: 2307190 - DNA, 18 bp, Homo sapiens
atatgatatatagttaca

SEQ ID NO: 2307191 - DNA, 14 bp, Homo sapiens
atatgtaaatatac

SEQ ID NO: 2307192 - DNA, 19 bp, Homo sapiens
atatgtaacatgtctaaag

SEQ ID NO: 2307193 - DNA, 13 bp, Homo sapiens
atatgtacttttc

SEQ ID NO: 2307194 - DNA, 14 bp, Homo sapiens
atatgtacttttcc

SEQ ID NO: 2307195 - DNA, 13 bp, Homo sapiens
atatgtagcatta

SEQ ID NO: 2307196 - DNA, 13 bp, Homo sapiens
atatgtgatctgt

SEQ ID NO: 2307197 - DNA, 15 bp, Homo sapiens
atatgtgatctgtct

SEQ ID NO: 2307198 - DNA, 16 bp, Homo sapiens
atatgtgatctgtctt

SEQ ID NO: 2307199 - DNA, 20 bp, Homo sapiens
atatgtgatctgtcttgtaa

SEQ ID NO: 2307200 - DNA, 15 bp, Homo sapiens
atatgtggagttcat

SEQ ID NO: 2307201 - DNA, 20 bp, Homo sapiens
atatgtggagttcatcttga

SEQ ID NO: 2307202 - DNA, 12 bp, Homo sapiens
atatgttgctga

SEQ ID NO: 2307203 - DNA, 13 bp, Homo sapiens
atatgtttaatat

SEQ ID NO: 2307204 - DNA, 14 bp, Homo sapiens
atattaatatgtac

SEQ ID NO: 2307205 - DNA, 18 bp, Homo sapiens
atattacatttcatttat

SEQ ID NO: 2307206 - DNA, 18 bp, Homo sapiens
atattacggaggaacaga

SEQ ID NO: 2307207 - DNA, 23 bp, Homo sapiens
atattagagtgcccttaaaataa

SEQ ID NO: 2307208 - DNA, 13 bp, Homo sapiens
atattagccaaag

SEQ ID NO: 2307209 - DNA, 18 bp, Homo sapiens
atattatgtatagaaaat

SEQ ID NO: 2307210 - DNA, 19 bp, Homo sapiens
atattcagagatgtaccat

SEQ ID NO: 2307211 - DNA, 23 bp, Homo sapiens
atattcagagatgtaccatgtta

SEQ ID NO: 2307212 - DNA, 12 bp, Homo sapiens
atattcatctgt

SEQ ID NO: 2307213 - DNA, 17 bp, Homo sapiens
atattcattctttataa

SEQ ID NO: 2307214 - DNA, 22 bp, Homo sapiens
atattcattctttataaaccat

SEQ ID NO: 2307215 - DNA, 17 bp, Homo sapiens
atattctgtcattggtt

SEQ ID NO: 2307216 - DNA, 18 bp, Homo sapiens
atattcttgctttcacaa

SEQ ID NO: 2307217 - DNA, 22 bp, Homo sapiens
atattcttgctttcacaaatat

SEQ ID NO: 2307218 - DNA, 23 bp, Homo sapiens
atattcttgctttcacaaatata

SEQ ID NO: 2307219 - DNA, 16 bp, Homo sapiens
atattgagatcagcat

SEQ ID NO: 2307220 - DNA, 21 bp, Homo sapiens
atattgagatcagcattcaaa

SEQ ID NO: 2307221 - DNA, 20 bp, Homo sapiens
atatttatgcagaaggtatt

SEQ ID NO: 2307222 - DNA, 17 bp, Homo sapiens
atatttattattttcat

SEQ ID NO: 2307223 - DNA, 18 bp, Homo sapiens
atatttccaaatattcta

SEQ ID NO: 2307224 - DNA, 18 bp, Homo sapiens
atgtactagtactgtgta

SEQ ID NO: 2307225 - DNA, 19 bp, Homo sapiens
atgtactagtactgtgtac

SEQ ID NO: 2307226 - DNA, 16 bp, Homo sapiens
atgtagaactgttcat

SEQ ID NO: 2307227 - DNA, 18 bp, Homo sapiens
atgtagaggctttatgtt

SEQ ID NO: 2307228 - DNA, 17 bp, Homo sapiens
atgtagcattaaatata

SEQ ID NO: 2307229 - DNA, 20 bp, Homo sapiens
atgtagcattaaatataaaa

SEQ ID NO: 2307230 - DNA, 22 bp, Homo sapiens
atgtagttgatgtatccaacaa

SEQ ID NO: 2307231 - DNA, 21 bp, Homo sapiens
atgtatactccatagaaacta

SEQ ID NO: 2307232 - DNA, 12 bp, Homo sapiens
atgtatagaaaa

SEQ ID NO: 2307233 - DNA, 14 bp, Homo sapiens
atgtatagctttaa

SEQ ID NO: 2307234 - DNA, 19 bp, Homo sapiens
atgtatagtgagtgtggct

SEQ ID NO: 2307235 - DNA, 14 bp, Homo sapiens
atgtatatatttat

SEQ ID NO: 2307236 - DNA, 16 bp, Homo sapiens
atgtatatatttatta

SEQ ID NO: 2307237 - DNA, 17 bp, Homo sapiens
atgtatcttatttatat

SEQ ID NO: 2307238 - DNA, 19 bp, Homo sapiens
atgtatcttatttatatat

SEQ ID NO: 2307239 - DNA, 22 bp, Homo sapiens
atgtatcttatttatatatgaa

SEQ ID NO: 2307240 - DNA, 14 bp, Homo sapiens
atgtattatggtga

SEQ ID NO: 2307241 - DNA, 21 bp, Homo sapiens
atgtatttaaagaacactgca

SEQ ID NO: 2307242 - DNA, 21 bp, Homo sapiens
atgtattttcaataaagaaaa

SEQ ID NO: 2307243 - DNA, 13 bp, Homo sapiens
atgtcaaaaatat

SEQ ID NO: 2307244 - DNA, 22 bp, Homo sapiens
atgtcaaggcagttgcttgtgt

SEQ ID NO: 2307245 - DNA, 16 bp, Homo sapiens
atgtcaccacaacaaa

SEQ ID NO: 2307246 - DNA, 14 bp, Homo sapiens
atgtcagtctgtcc

SEQ ID NO: 2307247 - DNA, 21 bp, Homo sapiens
atgtcagtgtgactgatctct

SEQ ID NO: 2307248 - DNA, 14 bp, Homo sapiens
atgtcatactctgt

SEQ ID NO: 2307249 - DNA, 17 bp, Homo sapiens
atgtcatactctgtgta

SEQ ID NO: 2307250 - DNA, 22 bp, Homo sapiens
atgtccccattctataaattca

SEQ ID NO: 2307251 - DNA, 22 bp, Homo sapiens
atgtcctaggggccgagggaaa

SEQ ID NO: 2307252 - DNA, 12 bp, Homo sapiens
atgtctactgct

SEQ ID NO: 2307253 - DNA, 12 bp, Homo sapiens
atgtctccattg

SEQ ID NO: 2307254 - DNA, 11 bp, Homo sapiens
atgtctgtagt

SEQ ID NO: 2307255 - DNA, 22 bp, Homo sapiens
atgtctttcctatttgcacacg

SEQ ID NO: 2307256 - DNA, 14 bp, Homo sapiens
atgtgaaataaaga

SEQ ID NO: 2307257 - DNA, 17 bp, Homo sapiens
atgtgatctgtcttgta

SEQ ID NO: 2307258 - DNA, 20 bp, Homo sapiens
atgtgatctgtcttgtaata

SEQ ID NO: 2307259 - DNA, 19 bp, Homo sapiens
atgtgatgagaggaaatca

SEQ ID NO: 2307260 - DNA, 20 bp, Homo sapiens
atgtgcagacactcaagagc

SEQ ID NO: 2307261 - DNA, 14 bp, Homo sapiens
atgtgcttcattgt

SEQ ID NO: 2307262 - DNA, 24 bp, Homo sapiens
atgtggagttcatcttgaattgta

SEQ ID NO: 2307263 - DNA, 17 bp, Homo sapiens
atgtggcttcttcaact

SEQ ID NO: 2307264 - DNA, 11 bp, Homo sapiens
atgtgtaaatg

SEQ ID NO: 2307265 - DNA, 20 bp, Homo sapiens
atgtgtagatattatgtata

SEQ ID NO: 2307266 - DNA, 19 bp, Homo sapiens
atgtgtgctcttatcccca

SEQ ID NO: 2307267 - DNA, 19 bp, Homo sapiens
atgtgttgcaaattattct

SEQ ID NO: 2307268 - DNA, 17 bp, Homo sapiens
atgttaaaatagtcata

SEQ ID NO: 2307269 - DNA, 12 bp, Homo sapiens
atgttaaagagg

SEQ ID NO: 2307270 - DNA, 21 bp, Homo sapiens
atgttaaagaggcgtcttgta

SEQ ID NO: 2307271 - DNA, 22 bp, Homo sapiens
atgttaaagaggcgtcttgtat

SEQ ID NO: 2307272 - DNA, 14 bp, Homo sapiens
atgttaacaacttg

SEQ ID NO: 2307273 - DNA, 19 bp, Homo sapiens
atgttaacatgcgcatttt

SEQ ID NO: 2307274 - DNA, 21 bp, Homo sapiens
atgttagattaggtgtaagac

SEQ ID NO: 2307275 - DNA, 19 bp, Homo sapiens
atgttagtaatggcagagc

SEQ ID NO: 2307276 - DNA, 15 bp, Homo sapiens
atgttagtcttaccg

SEQ ID NO: 2307277 - DNA, 13 bp, Homo sapiens
atgttatttttgg

SEQ ID NO: 2307278 - DNA, 19 bp, Homo sapiens
atgttcagtcacatgtgct

SEQ ID NO: 2307279 - DNA, 20 bp, Homo sapiens
atgttctttcacccttttct

SEQ ID NO: 2307280 - DNA, 12 bp, Homo sapiens
atgttgcccaga

SEQ ID NO: 2307281 - DNA, 19 bp, Homo sapiens
atgttggggggccccacgg

SEQ ID NO: 2307282 - DNA, 21 bp, Homo sapiens
atgttgttaaatgctatggaa

SEQ ID NO: 2307283 - DNA, 19 bp, Homo sapiens
atgttgttcgatcgtttca

SEQ ID NO: 2307284 - DNA, 19 bp, Homo sapiens
atgtttaagaaatgagaaa

SEQ ID NO: 2307285 - DNA, 13 bp, Homo sapiens
atgtttcctgtgg

SEQ ID NO: 2307286 - DNA, 17 bp, Homo sapiens
atgtttcctgtggaaat

SEQ ID NO: 2307287 - DNA, 20 bp, Homo sapiens
atgtttctgcagtattctgt

SEQ ID NO: 2307288 - DNA, 21 bp, Homo sapiens
atgttttagagataaatattt

SEQ ID NO: 2307289 - DNA, 22 bp, Homo sapiens
atgttttagagataaatattta

SEQ ID NO: 2307290 - DNA, 14 bp, Homo sapiens
atgttttgaatgat

SEQ ID NO: 2307291 - DNA, 16 bp, Homo sapiens
atgtttttgttttgct

SEQ ID NO: 2307292 - DNA, 16 bp, Homo sapiens
attaaaaagaatagaa

SEQ ID NO: 2307293 - DNA, 16 bp, Homo sapiens
attaaaagctttagat

SEQ ID NO: 2307294 - DNA, 16 bp, Homo sapiens
attaaaattagtgaga

SEQ ID NO: 2307295 - DNA, 13 bp, Homo sapiens
attaaagacattt

SEQ ID NO: 2307296 - DNA, 21 bp, Homo sapiens
attaaatataaaatacataaa

SEQ ID NO: 2307297 - DNA, 15 bp, Homo sapiens
attaaatttaatata

SEQ ID NO: 2307298 - DNA, 15 bp, Homo sapiens
attaaattttaatgt

SEQ ID NO: 2307299 - DNA, 19 bp, Homo sapiens
attaaattttaatgtaaaa

SEQ ID NO: 2307300 - DNA, 16 bp, Homo sapiens
attaagttattaacat

SEQ ID NO: 2307301 - DNA, 13 bp, Homo sapiens
attaatatgtact

SEQ ID NO: 2307302 - DNA, 22 bp, Homo sapiens
attaatatgtacttttccattt

SEQ ID NO: 2307303 - DNA, 21 bp, Homo sapiens
attacactgtaagaaatgtat

SEQ ID NO: 2307304 - DNA, 15 bp, Homo sapiens
attacaggaaatgca

SEQ ID NO: 2307305 - DNA, 17 bp, Homo sapiens
attacattaaaatggac

SEQ ID NO: 2307306 - DNA, 15 bp, Homo sapiens
attacatttcattta

SEQ ID NO: 2307307 - DNA, 16 bp, Homo sapiens
attacatttcatttat

SEQ ID NO: 2307308 - DNA, 19 bp, Homo sapiens
attactgcccagatgtttt

SEQ ID NO: 2307309 - DNA, 22 bp, Homo sapiens
attactgcccagatgttttaga

SEQ ID NO: 2307310 - DNA, 19 bp, Homo sapiens
attactttgtagatgtatt

SEQ ID NO: 2307311 - DNA, 18 bp, Homo sapiens
attagactgaatttaact

SEQ ID NO: 2307312 - DNA, 18 bp, Homo sapiens
attagagcaagaacattc

SEQ ID NO: 2307313 - DNA, 21 bp, Homo sapiens
attagagtgcccttaaaataa

SEQ ID NO: 2307314 - DNA, 15 bp, Homo sapiens
attagccaaagaggc

SEQ ID NO: 2307315 - DNA, 23 bp, Homo sapiens
attagcctcgtctttcagcgagc

SEQ ID NO: 2307316 - DNA, 23 bp, Homo sapiens
attaggaacagagtatatatgta

SEQ ID NO: 2307317 - DNA, 16 bp, Homo sapiens
attagtcatatttttg

SEQ ID NO: 2307318 - DNA, 20 bp, Homo sapiens
attagtgagatttgtattta

SEQ ID NO: 2307319 - DNA, 20 bp, Homo sapiens
attagttggagctagaaaat

SEQ ID NO: 2307320 - DNA, 21 bp, Homo sapiens
attataaacaacagaaacttc

SEQ ID NO: 2307321 - DNA, 12 bp, Homo sapiens
attataaatgtt

SEQ ID NO: 2307322 - DNA, 13 bp, Homo sapiens
attataaatgttt

SEQ ID NO: 2307323 - DNA, 15 bp, Homo sapiens
attataatatagaaa

SEQ ID NO: 2307324 - DNA, 17 bp, Homo sapiens
attataatgcatctaaa

SEQ ID NO: 2307325 - DNA, 19 bp, Homo sapiens
attatagctcctattaaat

SEQ ID NO: 2307326 - DNA, 16 bp, Homo sapiens
attatatatataatat

SEQ ID NO: 2307327 - DNA, 17 bp, Homo sapiens
attatcctgtgtgatta

SEQ ID NO: 2307328 - DNA, 17 bp, Homo sapiens
attatctgggttttaga

SEQ ID NO: 2307329 - DNA, 21 bp, Homo sapiens
attatgtatagaaaataaaat

SEQ ID NO: 2307330 - DNA, 21 bp, Homo sapiens
attatgtcaattcattaataa

SEQ ID NO: 2307331 - DNA, 18 bp, Homo sapiens
attattacactgtaagaa

SEQ ID NO: 2307332 - DNA, 12 bp, Homo sapiens
attattctagtc

SEQ ID NO: 2307333 - DNA, 22 bp, Homo sapiens
attattgaatgttatatcatca

SEQ ID NO: 2307334 - DNA, 15 bp, Homo sapiens
attattgccaaataa

SEQ ID NO: 2307335 - DNA, 18 bp, Homo sapiens
attattgctgttgcttga

SEQ ID NO: 2307336 - DNA, 12 bp, Homo sapiens
attcaaaatagt

SEQ ID NO: 2307337 - DNA, 15 bp, Homo sapiens
attcaacacttattt

SEQ ID NO: 2307338 - DNA, 13 bp, Homo sapiens
attcaatgtgaat

SEQ ID NO: 2307339 - DNA, 17 bp, Homo sapiens
attcaatgtgaatttta

SEQ ID NO: 2307340 - DNA, 17 bp, Homo sapiens
attcaattaacatatat

SEQ ID NO: 2307341 - DNA, 20 bp, Homo sapiens
attcagagatgtaccatgtt

SEQ ID NO: 2307342 - DNA, 19 bp, Homo sapiens
attcagcagaatgactctg

SEQ ID NO: 2307343 - DNA, 21 bp, Homo sapiens
attcagttgttagtgtgtctt

SEQ ID NO: 2307344 - DNA, 20 bp, Homo sapiens
attcagttttagtttcaaaa

SEQ ID NO: 2307345 - DNA, 16 bp, Homo sapiens
attcataaaaataacc

SEQ ID NO: 2307346 - DNA, 14 bp, Homo sapiens
attcataatgactt

SEQ ID NO: 2307347 - DNA, 15 bp, Homo sapiens
attcataatgactta

SEQ ID NO: 2307348 - DNA, 16 bp, Homo sapiens
attcatactaaataaa

SEQ ID NO: 2307349 - DNA, 18 bp, Homo sapiens
attcatagcatcctgatt

SEQ ID NO: 2307350 - DNA, 17 bp, Homo sapiens
attcatggaactttcat

SEQ ID NO: 2307351 - DNA, 20 bp, Homo sapiens
attcatggaccactgtttct

SEQ ID NO: 2307352 - DNA, 20 bp, Homo sapiens
attcatgtacaatgatgtaa

SEQ ID NO: 2307353 - DNA, 19 bp, Homo sapiens
attcatgtgtacagaaaca

SEQ ID NO: 2307354 - DNA, 21 bp, Homo sapiens
attcattacatcctctgcttg

SEQ ID NO: 2307355 - DNA, 15 bp, Homo sapiens
attcattatgtcaat

SEQ ID NO: 2307356 - DNA, 15 bp, Homo sapiens
cacagacccctgggg

SEQ ID NO: 2307357 - DNA, 21 bp, Homo sapiens
cacagacccctgggggaggct

SEQ ID NO: 2307358 - DNA, 19 bp, Homo sapiens
cacagagacccccgtgcca

SEQ ID NO: 2307359 - DNA, 21 bp, Homo sapiens
cacagagactgtttgaatctt

SEQ ID NO: 2307360 - DNA, 10 bp, Homo sapiens
cacagatcca

SEQ ID NO: 2307361 - DNA, 15 bp, Homo sapiens
cacagcagctccaac

SEQ ID NO: 2307362 - DNA, 14 bp, Homo sapiens
cacagccccttgct

SEQ ID NO: 2307363 - DNA, 15 bp, Homo sapiens
cacagctaacatgga

SEQ ID NO: 2307364 - DNA, 16 bp, Homo sapiens
cacagctaacatggaa

SEQ ID NO: 2307365 - DNA, 22 bp, Homo sapiens
cacagctaacatggaagtacta

SEQ ID NO: 2307366 - DNA, 14 bp, Homo sapiens
cacaggcaacatta

SEQ ID NO: 2307367 - DNA, 18 bp, Homo sapiens
cacaggcaacattacaaa

SEQ ID NO: 2307368 - DNA, 12 bp, Homo sapiens
cacaggctgccc

SEQ ID NO: 2307369 - DNA, 15 bp, Homo sapiens
cacaggctgccccac

SEQ ID NO: 2307370 - DNA, 19 bp, Homo sapiens
cacaggctgccccacccct

SEQ ID NO: 2307371 - DNA, 22 bp, Homo sapiens
cacagtagtgttgggtggagga

SEQ ID NO: 2307372 - DNA, 23 bp, Homo sapiens
cacagtagtgttgggtggaggat

SEQ ID NO: 2307373 - DNA, 17 bp, Homo sapiens
cacagtggggcccatgg

SEQ ID NO: 2307374 - DNA, 20 bp, Homo sapiens
cacagtggggcccatggccc

SEQ ID NO: 2307375 - DNA, 22 bp, Homo sapiens
cacagtggggcccatggcccca

SEQ ID NO: 2307376 - DNA, 13 bp, Homo sapiens
cacagtggtcagc

SEQ ID NO: 2307377 - DNA, 20 bp, Homo sapiens
cacagttctggctataaact

SEQ ID NO: 2307378 - DNA, 23 bp, Homo sapiens
cacatatacatctagcacagctg

SEQ ID NO: 2307379 - DNA, 23 bp, Homo sapiens
cacatcatgtaatagtggctttc

SEQ ID NO: 2307380 - DNA, 17 bp, Homo sapiens
cacatcgcagcccctgt

SEQ ID NO: 2307381 - DNA, 12 bp, Homo sapiens
cacatctcactt

SEQ ID NO: 2307382 - DNA, 12 bp, Homo sapiens
cacatctgtata

SEQ ID NO: 2307383 - DNA, 20 bp, Homo sapiens
cacatgccccccagattgct

SEQ ID NO: 2307384 - DNA, 16 bp, Homo sapiens
cacatggaacttaaaa

SEQ ID NO: 2307385 - DNA, 14 bp, Homo sapiens
cacatggttttcct

SEQ ID NO: 2307386 - DNA, 17 bp, Homo sapiens
cacatgtggctccccct

SEQ ID NO: 2307387 - DNA, 21 bp, Homo sapiens
cacattaggaacagagtatat

SEQ ID NO: 2307388 - DNA, 18 bp, Homo sapiens
cacattcatgtacaatga

SEQ ID NO: 2307389 - DNA, 14 bp, Homo sapiens
cacattctgctgcc

SEQ ID NO: 2307390 - DNA, 16 bp, Homo sapiens
cacattctgctgcccc

SEQ ID NO: 2307391 - DNA, 17 bp, Homo sapiens
cacatttccctatttta

SEQ ID NO: 2307392 - DNA, 21 bp, Homo sapiens
caccaagggtatctgctgcct

SEQ ID NO: 2307393 - DNA, 15 bp, Homo sapiens
caccactgacagatg

SEQ ID NO: 2307394 - DNA, 20 bp, Homo sapiens
caccagcctgagccacagtg

SEQ ID NO: 2307395 - DNA, 22 bp, Homo sapiens
caccagccttgaactgtggcca

SEQ ID NO: 2307396 - DNA, 21 bp, Homo sapiens
caccaggtgttaaaaaccatt

SEQ ID NO: 2307397 - DNA, 13 bp, Homo sapiens
cacccacaccccg

SEQ ID NO: 2307398 - DNA, 19 bp, Homo sapiens
cacccacaccccgtctgcc

SEQ ID NO: 2307399 - DNA, 20 bp, Homo sapiens
cacccacaccccgtctgccc

SEQ ID NO: 2307400 - DNA, 13 bp, Homo sapiens
cacccagccccag

SEQ ID NO: 2307401 - DNA, 11 bp, Homo sapiens
cacccccagcc

SEQ ID NO: 2307402 - DNA, 14 bp, Homo sapiens
cacccccagcctcc

SEQ ID NO: 2307403 - DNA, 16 bp, Homo sapiens
cacccccagcctcccc

SEQ ID NO: 2307404 - DNA, 15 bp, Homo sapiens
cacccccgggtgcct

SEQ ID NO: 2307405 - DNA, 14 bp, Homo sapiens
caccccgctgcctg

SEQ ID NO: 2307406 - DNA, 14 bp, Homo sapiens
caccccgtctgccc

SEQ ID NO: 2307407 - DNA, 15 bp, Homo sapiens
caccccgtctgcccc

SEQ ID NO: 2307408 - DNA, 13 bp, Homo sapiens
cacccctgcaggc

SEQ ID NO: 2307409 - DNA, 12 bp, Homo sapiens
cacccgccccag

SEQ ID NO: 2307410 - DNA, 15 bp, Homo sapiens
cacccgccccagaga

SEQ ID NO: 2307411 - DNA, 14 bp, Homo sapiens
cacccgcccgcccc

SEQ ID NO: 2307412 - DNA, 18 bp, Homo sapiens
cacccgcccgcccccgcc

SEQ ID NO: 2307413 - DNA, 21 bp, Homo sapiens
cacccggatagaggacacgga

SEQ ID NO: 2307414 - DNA, 21 bp, Homo sapiens
cacccggcagccccccagtgt

SEQ ID NO: 2307415 - DNA, 15 bp, Homo sapiens
caccctgaggagtga

SEQ ID NO: 2307416 - DNA, 22 bp, Homo sapiens
caccctgaggagtgatgggcaa

SEQ ID NO: 2307417 - DNA, 14 bp, Homo sapiens
caccctggagtggc

SEQ ID NO: 2307418 - DNA, 17 bp, Homo sapiens
caccctggagtggcatg

SEQ ID NO: 2307419 - DNA, 13 bp, Homo sapiens
caccctgggcctc

SEQ ID NO: 2307420 - DNA, 14 bp, Homo sapiens
caccctgggcctcc

SEQ ID NO: 2307421 - DNA, 16 bp, Homo sapiens
caccctgggcctcccg

SEQ ID NO: 2307422 - DNA, 18 bp, Homo sapiens
caccctgggcctcccgtc

SEQ ID NO: 2307423 - DNA, 19 bp, Homo sapiens
caccgaaaacgtggctgct

SEQ ID NO: 2307424 - DNA, 14 bp, Homo sapiens
caccgcaccgggct

SEQ ID NO: 2307425 - DNA, 14 bp, Homo sapiens
caccgcccacccac

SEQ ID NO: 2307426 - DNA, 17 bp, Homo sapiens
caccgtggtgtgaggcc

SEQ ID NO: 2307427 - DNA, 21 bp, Homo sapiens
caccgtggtgtgaggcccccg

SEQ ID NO: 2307428 - DNA, 13 bp, Homo sapiens
cacctcactcagc

SEQ ID NO: 2307429 - DNA, 14 bp, Homo sapiens
cacctcactcagca

SEQ ID NO: 2307430 - DNA, 16 bp, Homo sapiens
cacctctaggcctcag

SEQ ID NO: 2307431 - DNA, 20 bp, Homo sapiens
cacctctcttctgcacagct

SEQ ID NO: 2307432 - DNA, 23 bp, Homo sapiens
cacctgacactaaccagagtcag

SEQ ID NO: 2307433 - DNA, 17 bp, Homo sapiens
cacctgaggcaggaggg

SEQ ID NO: 2307434 - DNA, 15 bp, Homo sapiens
cacctgcctctgaac

SEQ ID NO: 2307435 - DNA, 19 bp, Homo sapiens
cacctgggagatgctggga

SEQ ID NO: 2307436 - DNA, 12 bp, Homo sapiens
cacctgtaatcc

SEQ ID NO: 2307437 - DNA, 13 bp, Homo sapiens
cacctgtaatccc

SEQ ID NO: 2307438 - DNA, 17 bp, Homo sapiens
caccttgtacagaacca

SEQ ID NO: 2307439 - DNA, 18 bp, Homo sapiens
caccttgtacagaaccag

SEQ ID NO: 2307440 - DNA, 19 bp, Homo sapiens
cacgaatattgctgatggt

SEQ ID NO: 2307441 - DNA, 22 bp, Homo sapiens
cacgaatattgctgatggtgca

SEQ ID NO: 2307442 - DNA, 17 bp, Homo sapiens
cacgacttctgtttcac

SEQ ID NO: 2307443 - DNA, 21 bp, Homo sapiens
cacgattccaacccaggtctg

SEQ ID NO: 2307444 - DNA, 22 bp, Homo sapiens
cacgcaccaccgcgcctacctt

SEQ ID NO: 2307445 - DNA, 22 bp, Homo sapiens
cacgcacttctggggccagccc

SEQ ID NO: 2307446 - DNA, 14 bp, Homo sapiens
cacgcagagccccg

SEQ ID NO: 2307447 - DNA, 15 bp, Homo sapiens
cacgcagagccccgg

SEQ ID NO: 2307448 - DNA, 21 bp, Homo sapiens
cacgcagagccccggagcacc

SEQ ID NO: 2307449 - DNA, 15 bp, Homo sapiens
cacgcaggacccagg

SEQ ID NO: 2307450 - DNA, 21 bp, Homo sapiens
cacgccggggctggccctgcc

SEQ ID NO: 2307451 - DNA, 23 bp, Homo sapiens
cacgcttttcccgtatgctttct

SEQ ID NO: 2307452 - DNA, 15 bp, Homo sapiens
cacggcaacccctgc

SEQ ID NO: 2307453 - DNA, 21 bp, Homo sapiens
cacggccgtccctgacttccc

SEQ ID NO: 2307454 - DNA, 13 bp, Homo sapiens
cacgggagagcgc

SEQ ID NO: 2307455 - DNA, 12 bp, Homo sapiens
cacgggcccgct

SEQ ID NO: 2307456 - DNA, 23 bp, Homo sapiens
cacgggcccgctcaacctctcag

SEQ ID NO: 2307457 - DNA, 17 bp, Homo sapiens
cacggggtcgggggagg

SEQ ID NO: 2307458 - DNA, 23 bp, Homo sapiens
cacggggtcgggggaggagcacc

SEQ ID NO: 2307459 - DNA, 15 bp, Homo sapiens
cacggttgcctgagg

SEQ ID NO: 2307460 - DNA, 16 bp, Homo sapiens
cacggttgcctgaggt

SEQ ID NO: 2307461 - DNA, 18 bp, Homo sapiens
cactaatggccaagtgta

SEQ ID NO: 2307462 - DNA, 12 bp, Homo sapiens
cactacaaatgt

SEQ ID NO: 2307463 - DNA, 23 bp, Homo sapiens
cactagactcaaggaagaataat

SEQ ID NO: 2307464 - DNA, 23 bp, Homo sapiens
cactagtagagcaaagacttaat

SEQ ID NO: 2307465 - DNA, 19 bp, Homo sapiens
cactagtttttcctgtgca

SEQ ID NO: 2307466 - DNA, 14 bp, Homo sapiens
cactcaagaccaaa

SEQ ID NO: 2307467 - DNA, 15 bp, Homo sapiens
cactcaagagccctt

SEQ ID NO: 2307468 - DNA, 22 bp, Homo sapiens
cactcacaatcatcttctccca

SEQ ID NO: 2307469 - DNA, 13 bp, Homo sapiens
cactcactgcctg

SEQ ID NO: 2307470 - DNA, 14 bp, Homo sapiens
cactcagcaccact

SEQ ID NO: 2307471 - DNA, 12 bp, Homo sapiens
cactcccagggc

SEQ ID NO: 2307472 - DNA, 14 bp, Homo sapiens
cactcccagggccc

SEQ ID NO: 2307473 - DNA, 18 bp, Homo sapiens
cactcccagggcccgagc

SEQ ID NO: 2307474 - DNA, 14 bp, Homo sapiens
cactccgactcccc

SEQ ID NO: 2307475 - DNA, 18 bp, Homo sapiens
cactcctcaactgatgat

SEQ ID NO: 2307476 - DNA, 22 bp, Homo sapiens
cactcctgccccggcccaacct

SEQ ID NO: 2307477 - DNA, 12 bp, Homo sapiens
cactctgagact

SEQ ID NO: 2307478 - DNA, 15 bp, Homo sapiens
cactgaaacctctgt

SEQ ID NO: 2307479 - DNA, 19 bp, Homo sapiens
cactgaaacctctgttctc

SEQ ID NO: 2307480 - DNA, 21 bp, Homo sapiens
cactgagtctcattcctctgt

SEQ ID NO: 2307481 - DNA, 14 bp, Homo sapiens
cactgcagcagaaa

SEQ ID NO: 2307482 - DNA, 20 bp, Homo sapiens
cactgcagcctcgacctccc

SEQ ID NO: 2307483 - DNA, 19 bp, Homo sapiens
cactgcatctttctcttcc

SEQ ID NO: 2307484 - DNA, 15 bp, Homo sapiens
cactgcctgcagctg

SEQ ID NO: 2307485 - DNA, 17 bp, Homo sapiens
cactgcctgcagctgag

SEQ ID NO: 2307486 - DNA, 17 bp, Homo sapiens
cactggaacactaatga

SEQ ID NO: 2307487 - DNA, 14 bp, Homo sapiens
cactggtctcagag

SEQ ID NO: 2307488 - DNA, 17 bp, Homo sapiens
cactggtctcagaggag

SEQ ID NO: 2307489 - DNA, 20 bp, Homo sapiens
caggtgatgttagtgtttta

SEQ ID NO: 2307490 - DNA, 15 bp, Homo sapiens
caggtggccagggct

SEQ ID NO: 2307491 - DNA, 17 bp, Homo sapiens
caggtggccagggctcc

SEQ ID NO: 2307492 - DNA, 19 bp, Homo sapiens
caggtggccagggctccac

SEQ ID NO: 2307493 - DNA, 16 bp, Homo sapiens
caggtgggcagacagt

SEQ ID NO: 2307494 - DNA, 12 bp, Homo sapiens
caggtgtaaata

SEQ ID NO: 2307495 - DNA, 14 bp, Homo sapiens
caggtgtaaatata

SEQ ID NO: 2307496 - DNA, 16 bp, Homo sapiens
caggtgttaaaaacca

SEQ ID NO: 2307497 - DNA, 12 bp, Homo sapiens
caggttttcctg

SEQ ID NO: 2307498 - DNA, 17 bp, Homo sapiens
cagtaaaacaggctgct

SEQ ID NO: 2307499 - DNA, 21 bp, Homo sapiens
cagtaagattttatccctttc

SEQ ID NO: 2307500 - DNA, 23 bp, Homo sapiens
cagtaattcccatctgctttatt

SEQ ID NO: 2307501 - DNA, 21 bp, Homo sapiens
cagtagtgttgggtggaggat

SEQ ID NO: 2307502 - DNA, 22 bp, Homo sapiens
cagtatctccatccttaactgt

SEQ ID NO: 2307503 - DNA, 23 bp, Homo sapiens
cagtatctccatccttaactgtc

SEQ ID NO: 2307504 - DNA, 13 bp, Homo sapiens
cagtatgtgtgct

SEQ ID NO: 2307505 - DNA, 13 bp, Homo sapiens
cagtattctgtag

SEQ ID NO: 2307506 - DNA, 18 bp, Homo sapiens
cagtattctgtagccaac

SEQ ID NO: 2307507 - DNA, 19 bp, Homo sapiens
cagtattctgtagccaact

SEQ ID NO: 2307508 - DNA, 19 bp, Homo sapiens
cagtatttacaagctattt

SEQ ID NO: 2307509 - DNA, 22 bp, Homo sapiens
cagtatttacaagctatttttg

SEQ ID NO: 2307510 - DNA, 15 bp, Homo sapiens
cagtcacatgtgctc

SEQ ID NO: 2307511 - DNA, 18 bp, Homo sapiens
cagtcactgggagaggtt

SEQ ID NO: 2307512 - DNA, 16 bp, Homo sapiens
cagtcagcggagagga

SEQ ID NO: 2307513 - DNA, 21 bp, Homo sapiens
cagtcagcggagaggacccca

SEQ ID NO: 2307514 - DNA, 12 bp, Homo sapiens
cagtcaggaagc

SEQ ID NO: 2307515 - DNA, 12 bp, Homo sapiens
cagtcctctgca

SEQ ID NO: 2307516 - DNA, 21 bp, Homo sapiens
cagtctaaacagagtccggga

SEQ ID NO: 2307517 - DNA, 16 bp, Homo sapiens
cagtctcaaataataa

SEQ ID NO: 2307518 - DNA, 17 bp, Homo sapiens
cagtctccgctcccgca

SEQ ID NO: 2307519 - DNA, 15 bp, Homo sapiens
cagtctggagcaaag

SEQ ID NO: 2307520 - DNA, 13 bp, Homo sapiens
cagtctgtccacg

SEQ ID NO: 2307521 - DNA, 21 bp, Homo sapiens
cagtctgtccacgtggagaga

SEQ ID NO: 2307522 - DNA, 17 bp, Homo sapiens
cagtgaacttggctttc

SEQ ID NO: 2307523 - DNA, 23 bp, Homo sapiens
cagtgagaaattacaggttcctt

SEQ ID NO: 2307524 - DNA, 23 bp, Homo sapiens
cagtgattagcctcgtctttcag

SEQ ID NO: 2307525 - DNA, 13 bp, Homo sapiens
cagtgcaccccct

SEQ ID NO: 2307526 - DNA, 14 bp, Homo sapiens
cagtgcatgctgtc

SEQ ID NO: 2307527 - DNA, 22 bp, Homo sapiens
cagtgcatgctgtcccttacgt

SEQ ID NO: 2307528 - DNA, 16 bp, Homo sapiens
cagtgccttatggaac

SEQ ID NO: 2307529 - DNA, 11 bp, Homo sapiens
cagtgctttgc

SEQ ID NO: 2307530 - DNA, 18 bp, Homo sapiens
cagtggatagttgatgag

SEQ ID NO: 2307531 - DNA, 13 bp, Homo sapiens
cagtggggcccat

SEQ ID NO: 2307532 - DNA, 14 bp, Homo sapiens
cagtggggcccatg

SEQ ID NO: 2307533 - DNA, 17 bp, Homo sapiens
cagtggggcccatggcc

SEQ ID NO: 2307534 - DNA, 22 bp, Homo sapiens
cagtggggcccatggccccagc

SEQ ID NO: 2307535 - DNA, 23 bp, Homo sapiens
cagtggggcccatggccccagct

SEQ ID NO: 2307536 - DNA, 14 bp, Homo sapiens
cagtggtcagcgat

SEQ ID NO: 2307537 - DNA, 22 bp, Homo sapiens
cagtggtcagcgattcctgcca

SEQ ID NO: 2307538 - DNA, 18 bp, Homo sapiens
cagtggttcgggggaaat

SEQ ID NO: 2307539 - DNA, 14 bp, Homo sapiens
cagtgtccccaggg

SEQ ID NO: 2307540 - DNA, 18 bp, Homo sapiens
cagtgttcagcatagagc

SEQ ID NO: 2307541 - DNA, 12 bp, Homo sapiens
cagtgttttctt

SEQ ID NO: 2307542 - DNA, 17 bp, Homo sapiens
cagttagcccggccaag

SEQ ID NO: 2307543 - DNA, 15 bp, Homo sapiens
cagttcctgctgcct

SEQ ID NO: 2307544 - DNA, 14 bp, Homo sapiens
cagttctcatcttg

SEQ ID NO: 2307545 - DNA, 21 bp, Homo sapiens
cagttctcatcttgtaaataa

SEQ ID NO: 2307546 - DNA, 19 bp, Homo sapiens
cagttggacagtaagattt

SEQ ID NO: 2307547 - DNA, 17 bp, Homo sapiens
cagttggactgtggcct

SEQ ID NO: 2307548 - DNA, 14 bp, Homo sapiens
cagttgtggcctca

SEQ ID NO: 2307549 - DNA, 19 bp, Homo sapiens
cagttgttatattcattct

SEQ ID NO: 2307550 - DNA, 21 bp, Homo sapiens
cagtttgatcacactatttta

SEQ ID NO: 2307551 - DNA, 15 bp, Homo sapiens
cagtttgtaaatgtt

SEQ ID NO: 2307552 - DNA, 12 bp, Homo sapiens
cagttttcacag

SEQ ID NO: 2307553 - DNA, 12 bp, Homo sapiens
cataaaaaataa

SEQ ID NO: 2307554 - DNA, 16 bp, Homo sapiens
cataaaaataaccaaa

SEQ ID NO: 2307555 - DNA, 11 bp, Homo sapiens
cataaaagaat

SEQ ID NO: 2307556 - DNA, 15 bp, Homo sapiens
cataaaagaatgtac

SEQ ID NO: 2307557 - DNA, 14 bp, Homo sapiens
cataaaataaataa

SEQ ID NO: 2307558 - DNA, 16 bp, Homo sapiens
cataaagaaacacttt

SEQ ID NO: 2307559 - DNA, 14 bp, Homo sapiens
cataaagtaataac

SEQ ID NO: 2307560 - DNA, 18 bp, Homo sapiens
cataaagttagaatctat

SEQ ID NO: 2307561 - DNA, 18 bp, Homo sapiens
cataaatctgtctgattc

SEQ ID NO: 2307562 - DNA, 21 bp, Homo sapiens
cataaatctgtctgattctat

SEQ ID NO: 2307563 - DNA, 16 bp, Homo sapiens
cataaatctgttagca

SEQ ID NO: 2307564 - DNA, 18 bp, Homo sapiens
cataaggtcagctcagag

SEQ ID NO: 2307565 - DNA, 19 bp, Homo sapiens
cataatatcttgaagaata

SEQ ID NO: 2307566 - DNA, 16 bp, Homo sapiens
cataatctctttccat

SEQ ID NO: 2307567 - DNA, 16 bp, Homo sapiens
cataatgcaattagat

SEQ ID NO: 2307568 - DNA, 22 bp, Homo sapiens
cataatgcaattagatagaaaa

SEQ ID NO: 2307569 - DNA, 13 bp, Homo sapiens
cataattcattta

SEQ ID NO: 2307570 - DNA, 14 bp, Homo sapiens
cataattcatttaa

SEQ ID NO: 2307571 - DNA, 22 bp, Homo sapiens
cataccaattccaactttcagg

SEQ ID NO: 2307572 - DNA, 23 bp, Homo sapiens
catacctctctctatatatacat

SEQ ID NO: 2307573 - DNA, 21 bp, Homo sapiens
catacttgctccttgaataag

SEQ ID NO: 2307574 - DNA, 21 bp, Homo sapiens
catactttccaacattatcct

SEQ ID NO: 2307575 - DNA, 15 bp, Homo sapiens
catagagctatatat

SEQ ID NO: 2307576 - DNA, 13 bp, Homo sapiens
catagagtgagtt

SEQ ID NO: 2307577 - DNA, 11 bp, Homo sapiens
catagatgcta

SEQ ID NO: 2307578 - DNA, 15 bp, Homo sapiens
catagcatcctgatt

SEQ ID NO: 2307579 - DNA, 15 bp, Homo sapiens
catagccattcattt

SEQ ID NO: 2307580 - DNA, 16 bp, Homo sapiens
catagttctgcaataa

SEQ ID NO: 2307581 - DNA, 18 bp, Homo sapiens
catagttctgcaataaca

SEQ ID NO: 2307582 - DNA, 14 bp, Homo sapiens
catatacatctagc

SEQ ID NO: 2307583 - DNA, 12 bp, Homo sapiens
catatagtttgt

SEQ ID NO: 2307584 - DNA, 16 bp, Homo sapiens
catatagtttgttttc

SEQ ID NO: 2307585 - DNA, 19 bp, Homo sapiens
catatatgctactagaaaa

SEQ ID NO: 2307586 - DNA, 14 bp, Homo sapiens
catatcaacttaat

SEQ ID NO: 2307587 - DNA, 15 bp, Homo sapiens
catatcagctctgca

SEQ ID NO: 2307588 - DNA, 17 bp, Homo sapiens
catatcagctctgcata

SEQ ID NO: 2307589 - DNA, 15 bp, Homo sapiens
catatcctggtgtct

SEQ ID NO: 2307590 - DNA, 19 bp, Homo sapiens
catatcctggtgtctagtt

SEQ ID NO: 2307591 - DNA, 17 bp, Homo sapiens
catatgattgaaaagaa

SEQ ID NO: 2307592 - DNA, 20 bp, Homo sapiens
catatgattgaaaagaagaa

SEQ ID NO: 2307593 - DNA, 22 bp, Homo sapiens
catatggaaatcctgttactta

SEQ ID NO: 2307594 - DNA, 12 bp, Homo sapiens
catatgtagcat

SEQ ID NO: 2307595 - DNA, 17 bp, Homo sapiens
catatgtagcattaaat

SEQ ID NO: 2307596 - DNA, 18 bp, Homo sapiens
catatgtagcattaaata

SEQ ID NO: 2307597 - DNA, 19 bp, Homo sapiens
catatgtagcattaaatat

SEQ ID NO: 2307598 - DNA, 16 bp, Homo sapiens
catatgtgatctgtct

SEQ ID NO: 2307599 - DNA, 12 bp, Homo sapiens
catattcttgct

SEQ ID NO: 2307600 - DNA, 21 bp, Homo sapiens
catattgagatcagcattcaa

SEQ ID NO: 2307601 - DNA, 16 bp, Homo sapiens
catattgttggcacag

SEQ ID NO: 2307602 - DNA, 14 bp, Homo sapiens
catatttttgtaaa

SEQ ID NO: 2307603 - DNA, 13 bp, Homo sapiens
catcagcccctgc

SEQ ID NO: 2307604 - DNA, 20 bp, Homo sapiens
catcattgaaatctttttgc

SEQ ID NO: 2307605 - DNA, 22 bp, Homo sapiens
catcatttcccctcccgcttcc

SEQ ID NO: 2307606 - DNA, 16 bp, Homo sapiens
catccacacacagcag

SEQ ID NO: 2307607 - DNA, 17 bp, Homo sapiens
catccacacacagcagc

SEQ ID NO: 2307608 - DNA, 15 bp, Homo sapiens
catccacaccctctc

SEQ ID NO: 2307609 - DNA, 14 bp, Homo sapiens
catccaccctgagg

SEQ ID NO: 2307610 - DNA, 18 bp, Homo sapiens
catccatggagcacgagg

SEQ ID NO: 2307611 - DNA, 20 bp, Homo sapiens
catcccaaacccttcagtgc

SEQ ID NO: 2307612 - DNA, 21 bp, Homo sapiens
catccccaaaacaaagtcttt

SEQ ID NO: 2307613 - DNA, 20 bp, Homo sapiens
catcccggggccatggaagc

SEQ ID NO: 2307614 - DNA, 14 bp, Homo sapiens
catcctgattattg

SEQ ID NO: 2307615 - DNA, 17 bp, Homo sapiens
catccttcccgcagcac

SEQ ID NO: 2307616 - DNA, 23 bp, Homo sapiens
catccttcccgcagcaccagcct

SEQ ID NO: 2307617 - DNA, 21 bp, Homo sapiens
catccttgaggacctccacct

SEQ ID NO: 2307618 - DNA, 17 bp, Homo sapiens
catccttgcacttctgt

SEQ ID NO: 2307619 - DNA, 19 bp, Homo sapiens
catccttgcacttctgtta

SEQ ID NO: 2307620 - DNA, 15 bp, Homo sapiens
catccttttgcttca

SEQ ID NO: 2307621 - DNA, 17 bp, Homo sapiens
catccttttgcttcatc

SEQ ID NO: 2307622 - DNA, 16 bp, Homo sapiens
cccatgtgggctgaag

SEQ ID NO: 2307623 - DNA, 18 bp, Homo sapiens
cccatgtgggctgaagga

SEQ ID NO: 2307624 - DNA, 14 bp, Homo sapiens
cccattcagcctcg

SEQ ID NO: 2307625 - DNA, 18 bp, Homo sapiens
ccccaaaacaaagtcttt

SEQ ID NO: 2307626 - DNA, 19 bp, Homo sapiens
ccccaaaacaaagtctttg

SEQ ID NO: 2307627 - DNA, 18 bp, Homo sapiens
ccccaaactgtagtaatt

SEQ ID NO: 2307628 - DNA, 18 bp, Homo sapiens
ccccacaccctggagtgg

SEQ ID NO: 2307629 - DNA, 14 bp, Homo sapiens
ccccacacgccggg

SEQ ID NO: 2307630 - DNA, 20 bp, Homo sapiens
ccccacacgccggggctggc

SEQ ID NO: 2307631 - DNA, 22 bp, Homo sapiens
ccccacacgccggggctggccc

SEQ ID NO: 2307632 - DNA, 13 bp, Homo sapiens
ccccacagatcca

SEQ ID NO: 2307633 - DNA, 15 bp, Homo sapiens
ccccacgcttctgga

SEQ ID NO: 2307634 - DNA, 15 bp, Homo sapiens
ccccacggccgtccc

SEQ ID NO: 2307635 - DNA, 18 bp, Homo sapiens
ccccacggccgtccctga

SEQ ID NO: 2307636 - DNA, 23 bp, Homo sapiens
ccccactttcgcctcctccagct

SEQ ID NO: 2307637 - DNA, 17 bp, Homo sapiens
ccccagagactgcccac

SEQ ID NO: 2307638 - DNA, 22 bp, Homo sapiens
ccccagagactgcccaccctgg

SEQ ID NO: 2307639 - DNA, 10 bp, Homo sapiens
ccccagcctc

SEQ ID NO: 2307640 - DNA, 11 bp, Homo sapiens
ccccagcctcc

SEQ ID NO: 2307641 - DNA, 19 bp, Homo sapiens
ccccaggcggaggggcttg

SEQ ID NO: 2307642 - DNA, 15 bp, Homo sapiens
ccccaggctgcgcct

SEQ ID NO: 2307643 - DNA, 19 bp, Homo sapiens
ccccaggctgcgcctgccc

SEQ ID NO: 2307644 - DNA, 13 bp, Homo sapiens
ccccagggagggg

SEQ ID NO: 2307645 - DNA, 17 bp, Homo sapiens
ccccagggagggggtca

SEQ ID NO: 2307646 - DNA, 20 bp, Homo sapiens
ccccaggggcacacttcccc

SEQ ID NO: 2307647 - DNA, 22 bp, Homo sapiens
ccccagggtgcaggcgcgcacc

SEQ ID NO: 2307648 - DNA, 16 bp, Homo sapiens
ccccagtgtccccagg

SEQ ID NO: 2307649 - DNA, 20 bp, Homo sapiens
ccccagttaatgtgccaaaa

SEQ ID NO: 2307650 - DNA, 13 bp, Homo sapiens
ccccatccttccc

SEQ ID NO: 2307651 - DNA, 17 bp, Homo sapiens
ccccatccttcccgcag

SEQ ID NO: 2307652 - DNA, 20 bp, Homo sapiens
ccccatcgttacccatttct

SEQ ID NO: 2307653 - DNA, 11 bp, Homo sapiens
ccccatctgct

SEQ ID NO: 2307654 - DNA, 20 bp, Homo sapiens
ccccattagtatcctgttag

SEQ ID NO: 2307655 - DNA, 18 bp, Homo sapiens
cccccaagccaaccactt

SEQ ID NO: 2307656 - DNA, 11 bp, Homo sapiens
cccccaccctg

SEQ ID NO: 2307657 - DNA, 12 bp, Homo sapiens
cccccaccctgc

SEQ ID NO: 2307658 - DNA, 13 bp, Homo sapiens
cccccaccctgct

SEQ ID NO: 2307659 - DNA, 15 bp, Homo sapiens
cccccacggccgtcc

SEQ ID NO: 2307660 - DNA, 19 bp, Homo sapiens
cccccactttcgcctcctc

SEQ ID NO: 2307661 - DNA, 21 bp, Homo sapiens
cccccactttcgcctcctcca

SEQ ID NO: 2307662 - DNA, 22 bp, Homo sapiens
cccccactttcgcctcctccag

SEQ ID NO: 2307663 - DNA, 23 bp, Homo sapiens
cccccactttcgcctcctccagc

SEQ ID NO: 2307664 - DNA, 16 bp, Homo sapiens
cccccagcctccccca

SEQ ID NO: 2307665 - DNA, 16 bp, Homo sapiens
cccccaggctgcgcct

SEQ ID NO: 2307666 - DNA, 14 bp, Homo sapiens
cccccagtggactc

SEQ ID NO: 2307667 - DNA, 12 bp, Homo sapiens
cccccatctcca

SEQ ID NO: 2307668 - DNA, 14 bp, Homo sapiens
ccccctcccccgca

SEQ ID NO: 2307669 - DNA, 19 bp, Homo sapiens
ccccgagccgagctctcct

SEQ ID NO: 2307670 - DNA, 22 bp, Homo sapiens
ccccgagccgagctctcctggg

SEQ ID NO: 2307671 - DNA, 20 bp, Homo sapiens
ccccgcacccctcctccttg

SEQ ID NO: 2307672 - DNA, 23 bp, Homo sapiens
ccccgcccgccctcctctgcccc

SEQ ID NO: 2307673 - DNA, 23 bp, Homo sapiens
ccccgcctcaaggaagagccagc

SEQ ID NO: 2307674 - DNA, 16 bp, Homo sapiens
ccccgcctcctccctg

SEQ ID NO: 2307675 - DNA, 22 bp, Homo sapiens
ccccgcgcgtgcccccagcgtg

SEQ ID NO: 2307676 - DNA, 20 bp, Homo sapiens
ccccgctctgccatcagccc

SEQ ID NO: 2307677 - DNA, 22 bp, Homo sapiens
ccccggagctgggaaggtcccg

SEQ ID NO: 2307678 - DNA, 20 bp, Homo sapiens
ccccggaggcgcccacctgc

SEQ ID NO: 2307679 - DNA, 21 bp, Homo sapiens
ccccggaggcgcccacctgcc

SEQ ID NO: 2307680 - DNA, 22 bp, Homo sapiens
ccccggcatcatttcccctccc

SEQ ID NO: 2307681 - DNA, 15 bp, Homo sapiens
ccccgggtgcctgtg

SEQ ID NO: 2307682 - DNA, 23 bp, Homo sapiens
ccccgtctgccccttgaccccac

SEQ ID NO: 2307683 - DNA, 11 bp, Homo sapiens
cccctcccccg

SEQ ID NO: 2307684 - DNA, 14 bp, Homo sapiens
cccctcccccgcag

SEQ ID NO: 2307685 - DNA, 16 bp, Homo sapiens
cccctcccccgcagac

SEQ ID NO: 2307686 - DNA, 15 bp, Homo sapiens
cccctccccgcctcc

SEQ ID NO: 2307687 - DNA, 18 bp, Homo sapiens
cccctccccgcctcctcc

SEQ ID NO: 2307688 - DNA, 20 bp, Homo sapiens
cccctccgtccccagggtgc

SEQ ID NO: 2307689 - DNA, 19 bp, Homo sapiens
cccctcctcgggcgcctgc

SEQ ID NO: 2307690 - DNA, 22 bp, Homo sapiens
cccctcctcgggcgcctgcgct

SEQ ID NO: 2307691 - DNA, 19 bp, Homo sapiens
cccctccttttcccactgg

SEQ ID NO: 2307692 - DNA, 17 bp, Homo sapiens
cccctgcgcaggccctc

SEQ ID NO: 2307693 - DNA, 15 bp, Homo sapiens
cccctgctgctcctc

SEQ ID NO: 2307694 - DNA, 21 bp, Homo sapiens
cccctggggtacttctgtgtt

SEQ ID NO: 2307695 - DNA, 12 bp, Homo sapiens
ccccttgcttct

SEQ ID NO: 2307696 - DNA, 19 bp, Homo sapiens
cccgaaaggtcacctcact

SEQ ID NO: 2307697 - DNA, 12 bp, Homo sapiens
cccgaagttcag

SEQ ID NO: 2307698 - DNA, 19 bp, Homo sapiens
cccgagcgcgtgccttccc

SEQ ID NO: 2307699 - DNA, 13 bp, Homo sapiens
cccgcacccctcc

SEQ ID NO: 2307700 - DNA, 16 bp, Homo sapiens
cccgcacccctcctcc

SEQ ID NO: 2307701 - DNA, 17 bp, Homo sapiens
cccgcacccctcctcct

SEQ ID NO: 2307702 - DNA, 18 bp, Homo sapiens
cccgcagcaccagcctga

SEQ ID NO: 2307703 - DNA, 16 bp, Homo sapiens
cccgcccaccccgctg

SEQ ID NO: 2307704 - DNA, 19 bp, Homo sapiens
cccgcccaccccgctgcct

SEQ ID NO: 2307705 - DNA, 11 bp, Homo sapiens
cccgccccaga

SEQ ID NO: 2307706 - DNA, 16 bp, Homo sapiens
cccgccccagagactg

SEQ ID NO: 2307707 - DNA, 20 bp, Homo sapiens
cccgccccagagactgccca

SEQ ID NO: 2307708 - DNA, 14 bp, Homo sapiens
cccgccccagcctc

SEQ ID NO: 2307709 - DNA, 12 bp, Homo sapiens
cccgccccaggc

SEQ ID NO: 2307710 - DNA, 15 bp, Homo sapiens
cccgccccaggcccc

SEQ ID NO: 2307711 - DNA, 18 bp, Homo sapiens
cccgcccccgccctcgct

SEQ ID NO: 2307712 - DNA, 19 bp, Homo sapiens
cccgccggccgcgcaccgc

SEQ ID NO: 2307713 - DNA, 18 bp, Homo sapiens
cccgccggttggccggct

SEQ ID NO: 2307714 - DNA, 23 bp, Homo sapiens
cccgccggttggccggctggccg

SEQ ID NO: 2307715 - DNA, 16 bp, Homo sapiens
cccgcctcctccctgc

SEQ ID NO: 2307716 - DNA, 19 bp, Homo sapiens
cccgctgcctggcgggcag

SEQ ID NO: 2307717 - DNA, 15 bp, Homo sapiens
cccgcttcctccggc

SEQ ID NO: 2307718 - DNA, 23 bp, Homo sapiens
cccggactgaccgaagggacggg

SEQ ID NO: 2307719 - DNA, 15 bp, Homo sapiens
cccggaggcgcccac

SEQ ID NO: 2307720 - DNA, 16 bp, Homo sapiens
cccggaggcgcccacc

SEQ ID NO: 2307721 - DNA, 16 bp, Homo sapiens
cccggccaaggacact

SEQ ID NO: 2307722 - DNA, 18 bp, Homo sapiens
cccggcccacgcagagcc

SEQ ID NO: 2307723 - DNA, 12 bp, Homo sapiens
cccgggaagcaa

SEQ ID NO: 2307724 - DNA, 13 bp, Homo sapiens
cccggtgtgagga

SEQ ID NO: 2307725 - DNA, 14 bp, Homo sapiens
cccgtccgtccgcc

SEQ ID NO: 2307726 - DNA, 22 bp, Homo sapiens
cccgtgcgcagccgcgctctgc

SEQ ID NO: 2307727 - DNA, 18 bp, Homo sapiens
ccctaggtcatttgtaga

SEQ ID NO: 2307728 - DNA, 15 bp, Homo sapiens
ccctcccccacggcc

SEQ ID NO: 2307729 - DNA, 14 bp, Homo sapiens
ccctcccccgcaga

SEQ ID NO: 2307730 - DNA, 17 bp, Homo sapiens
ccctcccccgcagacag

SEQ ID NO: 2307731 - DNA, 18 bp, Homo sapiens
ccctcccccgcagacaga

SEQ ID NO: 2307732 - DNA, 15 bp, Homo sapiens
ccctccccgcctcct

SEQ ID NO: 2307733 - DNA, 13 bp, Homo sapiens
ccctccccggcat

SEQ ID NO: 2307734 - DNA, 15 bp, Homo sapiens
ccctcccgcttcctc

SEQ ID NO: 2307735 - DNA, 19 bp, Homo sapiens
ccctcccgcttcctccggc

SEQ ID NO: 2307736 - DNA, 14 bp, Homo sapiens
ccctccgtccccag

SEQ ID NO: 2307737 - DNA, 17 bp, Homo sapiens
ccctccgtccccagggt

SEQ ID NO: 2307738 - DNA, 22 bp, Homo sapiens
ccctcctcagcacggtgcctcc

SEQ ID NO: 2307739 - DNA, 21 bp, Homo sapiens
ccctcggggcaggaagtccct

SEQ ID NO: 2307740 - DNA, 15 bp, Homo sapiens
ccctgacttcccagc

SEQ ID NO: 2307741 - DNA, 22 bp, Homo sapiens
ccctgacttcccagctggcagc

SEQ ID NO: 2307742 - DNA, 20 bp, Homo sapiens
ccctgagaagcctcatggga

SEQ ID NO: 2307743 - DNA, 13 bp, Homo sapiens
ccctgaggacctg

SEQ ID NO: 2307744 - DNA, 16 bp, Homo sapiens
ccctgaggagtgatgg

SEQ ID NO: 2307745 - DNA, 22 bp, Homo sapiens
ccctgagggtttccaccttggc

SEQ ID NO: 2307746 - DNA, 19 bp, Homo sapiens
ccctgcaccttgggcacgg

SEQ ID NO: 2307747 - DNA, 13 bp, Homo sapiens
ccctgcaggcggt

SEQ ID NO: 2307748 - DNA, 22 bp, Homo sapiens
ccctgcaggcggtatccagagg

SEQ ID NO: 2307749 - DNA, 17 bp, Homo sapiens
ccctgcattcacagcta

SEQ ID NO: 2307750 - DNA, 17 bp, Homo sapiens
ccctgccaccctctgct

SEQ ID NO: 2307751 - DNA, 17 bp, Homo sapiens
ccctgccctcccccacg

SEQ ID NO: 2307752 - DNA, 18 bp, Homo sapiens
ccctgccctggccactgg

SEQ ID NO: 2307753 - DNA, 13 bp, Homo sapiens
ccctgcgcaggcc

SEQ ID NO: 2307754 - DNA, 13 bp, Homo sapiens
ccctgctgctcct

SEQ ID NO: 2307755 - DNA, 15 bp, Homo sapiens
cgagtgtggagctgc

SEQ ID NO: 2307756 - DNA, 12 bp, Homo sapiens
cgatatatgtaa

SEQ ID NO: 2307757 - DNA, 20 bp, Homo sapiens
cgatcctccttcctcatcct

SEQ ID NO: 2307758 - DNA, 23 bp, Homo sapiens
cgcacccccactttcgcctcctc

SEQ ID NO: 2307759 - DNA, 17 bp, Homo sapiens
cgcacccctcctccttg

SEQ ID NO: 2307760 - DNA, 20 bp, Homo sapiens
cgcacccctcctccttgctg

SEQ ID NO: 2307761 - DNA, 13 bp, Homo sapiens
cgcacccggcagc

SEQ ID NO: 2307762 - DNA, 14 bp, Homo sapiens
cgcaccctggctgg

SEQ ID NO: 2307763 - DNA, 15 bp, Homo sapiens
cgcaccctggctgga

SEQ ID NO: 2307764 - DNA, 14 bp, Homo sapiens
cgcaccgcccaacc

SEQ ID NO: 2307765 - DNA, 22 bp, Homo sapiens
cgcaccgggctggcctgacaca

SEQ ID NO: 2307766 - DNA, 15 bp, Homo sapiens
cgcacttctggggcc

SEQ ID NO: 2307767 - DNA, 20 bp, Homo sapiens
cgcacttctggggccagccc

SEQ ID NO: 2307768 - DNA, 16 bp, Homo sapiens
cgcagacagacagaca

SEQ ID NO: 2307769 - DNA, 14 bp, Homo sapiens
cgcagagccccgga

SEQ ID NO: 2307770 - DNA, 19 bp, Homo sapiens
cgcagagggaatttttccc

SEQ ID NO: 2307771 - DNA, 13 bp, Homo sapiens
cgcagcaccagcc

SEQ ID NO: 2307772 - DNA, 15 bp, Homo sapiens
cgcagcaccagcctg

SEQ ID NO: 2307773 - DNA, 17 bp, Homo sapiens
cgcagcaccagcctgag

SEQ ID NO: 2307774 - DNA, 16 bp, Homo sapiens
cgcagccccccacgct

SEQ ID NO: 2307775 - DNA, 14 bp, Homo sapiens
cgcagcccctgttg

SEQ ID NO: 2307776 - DNA, 16 bp, Homo sapiens
cgcagcccctgttgga

SEQ ID NO: 2307777 - DNA, 18 bp, Homo sapiens
cgcagccgcgctctgccc

SEQ ID NO: 2307778 - DNA, 20 bp, Homo sapiens
cgcagccgcgctctgcccct

SEQ ID NO: 2307779 - DNA, 21 bp, Homo sapiens
cgcagccgcgctctgcccctc

SEQ ID NO: 2307780 - DNA, 16 bp, Homo sapiens
cgcaggaaccgaggac

SEQ ID NO: 2307781 - DNA, 21 bp, Homo sapiens
cgcaggaaccgaggactccag

SEQ ID NO: 2307782 - DNA, 11 bp, Homo sapiens
cgcaggccctc

SEQ ID NO: 2307783 - DNA, 20 bp, Homo sapiens
cgcaggccctccgcggggga

SEQ ID NO: 2307784 - DNA, 14 bp, Homo sapiens
cgcagggagaccct

SEQ ID NO: 2307785 - DNA, 16 bp, Homo sapiens
cgcagggagaccctgg

SEQ ID NO: 2307786 - DNA, 17 bp, Homo sapiens
cgcagggagaccctggg

SEQ ID NO: 2307787 - DNA, 13 bp, Homo sapiens
cgcccacccacac

SEQ ID NO: 2307788 - DNA, 16 bp, Homo sapiens
cgcccaccccgctgcc

SEQ ID NO: 2307789 - DNA, 16 bp, Homo sapiens
cgccccagagactgcc

SEQ ID NO: 2307790 - DNA, 19 bp, Homo sapiens
cgccccagagactgcccac

SEQ ID NO: 2307791 - DNA, 20 bp, Homo sapiens
cgccccagagactgcccacc

SEQ ID NO: 2307792 - DNA, 23 bp, Homo sapiens
cgccccagagactgcccaccctg

SEQ ID NO: 2307793 - DNA, 13 bp, Homo sapiens
cgccccagcctcc

SEQ ID NO: 2307794 - DNA, 16 bp, Homo sapiens
cgccccaggccccagc

SEQ ID NO: 2307795 - DNA, 13 bp, Homo sapiens
cgcccctcctcgg

SEQ ID NO: 2307796 - DNA, 15 bp, Homo sapiens
cgcccgcccaccccg

SEQ ID NO: 2307797 - DNA, 20 bp, Homo sapiens
cgcccgcccaccccgctgcc

SEQ ID NO: 2307798 - DNA, 17 bp, Homo sapiens
cgcccgcccccgccctc

SEQ ID NO: 2307799 - DNA, 16 bp, Homo sapiens
cgcccgccctcctctg

SEQ ID NO: 2307800 - DNA, 13 bp, Homo sapiens
cgccctcctctgc

SEQ ID NO: 2307801 - DNA, 14 bp, Homo sapiens
cgccctcctctgcc

SEQ ID NO: 2307802 - DNA, 19 bp, Homo sapiens
cgccctcctctgccccctc

SEQ ID NO: 2307803 - DNA, 21 bp, Homo sapiens
cgccctcctctgccccctccc

SEQ ID NO: 2307804 - DNA, 17 bp, Homo sapiens
cgccctctctcaccagc

SEQ ID NO: 2307805 - DNA, 12 bp, Homo sapiens
cgccctgtgtcc

SEQ ID NO: 2307806 - DNA, 17 bp, Homo sapiens
cgccctgtgtccacagt

SEQ ID NO: 2307807 - DNA, 21 bp, Homo sapiens
cgccggccgcgcaccgccatg

SEQ ID NO: 2307808 - DNA, 13 bp, Homo sapiens
cgccggcgccccg

SEQ ID NO: 2307809 - DNA, 21 bp, Homo sapiens
cgcctcaaggaagagccagcc

SEQ ID NO: 2307810 - DNA, 13 bp, Homo sapiens
cgcctccatccac

SEQ ID NO: 2307811 - DNA, 14 bp, Homo sapiens
cgcctccatccaca

SEQ ID NO: 2307812 - DNA, 15 bp, Homo sapiens
cgcctcctccagact

SEQ ID NO: 2307813 - DNA, 17 bp, Homo sapiens
cgcctcctccagactcg

SEQ ID NO: 2307814 - DNA, 22 bp, Homo sapiens
cgcctcctccagctcctgcccc

SEQ ID NO: 2307815 - DNA, 16 bp, Homo sapiens
cgcctcctccctgcct

SEQ ID NO: 2307816 - DNA, 14 bp, Homo sapiens
cgcctgagggaaga

SEQ ID NO: 2307817 - DNA, 12 bp, Homo sapiens
cgcctgccccca

SEQ ID NO: 2307818 - DNA, 12 bp, Homo sapiens
cgcctgcccgcc

SEQ ID NO: 2307819 - DNA, 13 bp, Homo sapiens
cgcctgcccgccc

SEQ ID NO: 2307820 - DNA, 18 bp, Homo sapiens
cgcctgcgccccccagtg

SEQ ID NO: 2307821 - DNA, 16 bp, Homo sapiens
cgcctgcgctcctctg

SEQ ID NO: 2307822 - DNA, 23 bp, Homo sapiens
cgcctgcgctcctctgcagcctg

SEQ ID NO: 2307823 - DNA, 14 bp, Homo sapiens
cgccttcacagcag

SEQ ID NO: 2307824 - DNA, 21 bp, Homo sapiens
cgcgaagtccgaggcctggct

SEQ ID NO: 2307825 - DNA, 14 bp, Homo sapiens
cgcgacaatgcaaa

SEQ ID NO: 2307826 - DNA, 15 bp, Homo sapiens
cgcgacaatgcaaac

SEQ ID NO: 2307827 - DNA, 17 bp, Homo sapiens
cgcgacaatgcaaacca

SEQ ID NO: 2307828 - DNA, 12 bp, Homo sapiens
cgcgcaccgcca

SEQ ID NO: 2307829 - DNA, 14 bp, Homo sapiens
cgcgcaccgccatg

SEQ ID NO: 2307830 - DNA, 13 bp, Homo sapiens
cgcgggacaggac

SEQ ID NO: 2307831 - DNA, 23 bp, Homo sapiens
cgcgggacaggacttgtgcgccg

SEQ ID NO: 2307832 - DNA, 13 bp, Homo sapiens
cgcgtgcccccag

SEQ ID NO: 2307833 - DNA, 16 bp, Homo sapiens
cgcgtgcccccagcgt

SEQ ID NO: 2307834 - DNA, 17 bp, Homo sapiens
cgcgtgcccccagcgtg

SEQ ID NO: 2307835 - DNA, 18 bp, Homo sapiens
cgcgtgcccccagcgtgg

SEQ ID NO: 2307836 - DNA, 15 bp, Homo sapiens
cgctcaacctctcag

SEQ ID NO: 2307837 - DNA, 14 bp, Homo sapiens
cgctccaactccaa

SEQ ID NO: 2307838 - DNA, 16 bp, Homo sapiens
cgctccggcagaggca

SEQ ID NO: 2307839 - DNA, 19 bp, Homo sapiens
cgctccggcagaggcaggg

SEQ ID NO: 2307840 - DNA, 22 bp, Homo sapiens
cgctccggcagaggcagggccc

SEQ ID NO: 2307841 - DNA, 12 bp, Homo sapiens
cgctcctctgca

SEQ ID NO: 2307842 - DNA, 15 bp, Homo sapiens
cgctcctctgcagcc

SEQ ID NO: 2307843 - DNA, 23 bp, Homo sapiens
cgctcctctgcagcctgagctcc

SEQ ID NO: 2307844 - DNA, 14 bp, Homo sapiens
cgctctctgtctgg

SEQ ID NO: 2307845 - DNA, 15 bp, Homo sapiens
cgctctgccatcagc

SEQ ID NO: 2307846 - DNA, 18 bp, Homo sapiens
cgctctgccatcagcccc

SEQ ID NO: 2307847 - DNA, 19 bp, Homo sapiens
cgctctgccatcagcccct

SEQ ID NO: 2307848 - DNA, 12 bp, Homo sapiens
cgctctgcccct

SEQ ID NO: 2307849 - DNA, 13 bp, Homo sapiens
cgctgatgttcac

SEQ ID NO: 2307850 - DNA, 14 bp, Homo sapiens
cgctgcccccacag

SEQ ID NO: 2307851 - DNA, 16 bp, Homo sapiens
cgctgcccccacagat

SEQ ID NO: 2307852 - DNA, 19 bp, Homo sapiens
cgctgcccccacagatcca

SEQ ID NO: 2307853 - DNA, 15 bp, Homo sapiens
cgctgcccccaccct

SEQ ID NO: 2307854 - DNA, 12 bp, Homo sapiens
cgctgcctggcg

SEQ ID NO: 2307855 - DNA, 18 bp, Homo sapiens
cgctgcctggcgggcagc

SEQ ID NO: 2307856 - DNA, 21 bp, Homo sapiens
cgctgcttgagtggacagcag

SEQ ID NO: 2307857 - DNA, 20 bp, Homo sapiens
cggaaatacactacaaatgt

SEQ ID NO: 2307858 - DNA, 15 bp, Homo sapiens
cggaccggagcggct

SEQ ID NO: 2307859 - DNA, 19 bp, Homo sapiens
cggaccggagcggctgagg

SEQ ID NO: 2307860 - DNA, 13 bp, Homo sapiens
cggacgggacagc

SEQ ID NO: 2307861 - DNA, 15 bp, Homo sapiens
cggagcggctgagga

SEQ ID NO: 2307862 - DNA, 16 bp, Homo sapiens
cggagcggctgaggac

SEQ ID NO: 2307863 - DNA, 19 bp, Homo sapiens
cggagctgggaaggtcccg

SEQ ID NO: 2307864 - DNA, 12 bp, Homo sapiens
cggaggcgccca

SEQ ID NO: 2307865 - DNA, 15 bp, Homo sapiens
cggaggcgcccacct

SEQ ID NO: 2307866 - DNA, 16 bp, Homo sapiens
cggaggcgcccacctg

SEQ ID NO: 2307867 - DNA, 17 bp, Homo sapiens
cggaggggcttggagca

SEQ ID NO: 2307868 - DNA, 20 bp, Homo sapiens
cggaggggcttggagcagag

SEQ ID NO: 2307869 - DNA, 19 bp, Homo sapiens
cggatgaactcaatgcatg

SEQ ID NO: 2307870 - DNA, 17 bp, Homo sapiens
cggcaccgcccacccac

SEQ ID NO: 2307871 - DNA, 14 bp, Homo sapiens
cggcagaggcaggg

SEQ ID NO: 2307872 - DNA, 15 bp, Homo sapiens
cggcagaggcagggc

SEQ ID NO: 2307873 - DNA, 22 bp, Homo sapiens
cggcagaggcagggccctgggg

SEQ ID NO: 2307874 - DNA, 18 bp, Homo sapiens
cggcatcatttcccctcc

SEQ ID NO: 2307875 - DNA, 16 bp, Homo sapiens
cggccaaggacactga

SEQ ID NO: 2307876 - DNA, 19 bp, Homo sapiens
cggccaaggacactgatgg

SEQ ID NO: 2307877 - DNA, 17 bp, Homo sapiens
cggccagagctcccagg

SEQ ID NO: 2307878 - DNA, 16 bp, Homo sapiens
cggcccaacctcgccc

SEQ ID NO: 2307879 - DNA, 19 bp, Homo sapiens
cggcccacgcagagccccg

SEQ ID NO: 2307880 - DNA, 23 bp, Homo sapiens
cggcccacgcagagccccggagc

SEQ ID NO: 2307881 - DNA, 16 bp, Homo sapiens
cggccccgcacccctc

SEQ ID NO: 2307882 - DNA, 18 bp, Homo sapiens
cggccccgcacccctcct

SEQ ID NO: 2307883 - DNA, 20 bp, Homo sapiens
cggccccgcacccctcctcc

SEQ ID NO: 2307884 - DNA, 19 bp, Homo sapiens
cggccccgcgcgtgccccc

SEQ ID NO: 2307885 - DNA, 22 bp, Homo sapiens
cggccccgcgcgtgcccccagc

SEQ ID NO: 2307886 - DNA, 15 bp, Homo sapiens
cggcccgccaccttg

SEQ ID NO: 2307887 - DNA, 16 bp, Homo sapiens
cggcccggcccacgca

SEQ ID NO: 2307888 - DNA, 20 bp, Homo sapiens
cggcccggcccacgcagagc

SEQ ID NO: 2307889 - DNA, 20 bp, Homo sapiens
ctctggacagatgggtgtcc

SEQ ID NO: 2307890 - DNA, 20 bp, Homo sapiens
ctctggcaggtggccagggc

SEQ ID NO: 2307891 - DNA, 23 bp, Homo sapiens
ctctgggaagcggaaagcagtca

SEQ ID NO: 2307892 - DNA, 21 bp, Homo sapiens
ctctggggagaccgagtgtgg

SEQ ID NO: 2307893 - DNA, 13 bp, Homo sapiens
ctctggggccctt

SEQ ID NO: 2307894 - DNA, 18 bp, Homo sapiens
ctctgtagatacaggggc

SEQ ID NO: 2307895 - DNA, 15 bp, Homo sapiens
ctctgtccccgagcc

SEQ ID NO: 2307896 - DNA, 17 bp, Homo sapiens
ctctgtcttaaagaatt

SEQ ID NO: 2307897 - DNA, 18 bp, Homo sapiens
ctctgtgctctcctagag

SEQ ID NO: 2307898 - DNA, 10 bp, Homo sapiens
ctctgtggcc

SEQ ID NO: 2307899 - DNA, 21 bp, Homo sapiens
ctctgttacccgcagatcctg

SEQ ID NO: 2307900 - DNA, 17 bp, Homo sapiens
ctctgttctcatgaagg

SEQ ID NO: 2307901 - DNA, 15 bp, Homo sapiens
ctctgttgaccaggc

SEQ ID NO: 2307902 - DNA, 17 bp, Homo sapiens
ctctgttgaccaggctg

SEQ ID NO: 2307903 - DNA, 18 bp, Homo sapiens
ctctgttgaccaggctgg

SEQ ID NO: 2307904 - DNA, 20 bp, Homo sapiens
ctctgttgaccaggctggag

SEQ ID NO: 2307905 - DNA, 23 bp, Homo sapiens
ctctgttgaccaggctggagtga

SEQ ID NO: 2307906 - DNA, 16 bp, Homo sapiens
ctcttacgctctctgt

SEQ ID NO: 2307907 - DNA, 14 bp, Homo sapiens
ctcttatccccagc

SEQ ID NO: 2307908 - DNA, 15 bp, Homo sapiens
ctcttcagatcctgg

SEQ ID NO: 2307909 - DNA, 15 bp, Homo sapiens
ctcttccagcccaga

SEQ ID NO: 2307910 - DNA, 14 bp, Homo sapiens
ctcttcctcctgac

SEQ ID NO: 2307911 - DNA, 16 bp, Homo sapiens
ctcttcctcctgacac

SEQ ID NO: 2307912 - DNA, 23 bp, Homo sapiens
ctcttcgatgtgcccaggggagc

SEQ ID NO: 2307913 - DNA, 10 bp, Homo sapiens
ctcttctgac

SEQ ID NO: 2307914 - DNA, 18 bp, Homo sapiens
ctcttctgcacagctcct

SEQ ID NO: 2307915 - DNA, 19 bp, Homo sapiens
ctcttctgttctcaaatgc

SEQ ID NO: 2307916 - DNA, 22 bp, Homo sapiens
ctcttggggaaggatctccccg

SEQ ID NO: 2307917 - DNA, 16 bp, Homo sapiens
ctcttgttcttacttt

SEQ ID NO: 2307918 - DNA, 20 bp, Homo sapiens
ctcttgttcttactttcctg

SEQ ID NO: 2307919 - DNA, 15 bp, Homo sapiens
ctctttcaccctgcc

SEQ ID NO: 2307920 - DNA, 17 bp, Homo sapiens
ctgaaaaagaatgaaaa

SEQ ID NO: 2307921 - DNA, 17 bp, Homo sapiens
ctgaaaaatctagacat

SEQ ID NO: 2307922 - DNA, 23 bp, Homo sapiens
ctgaaaagaaatgctaatgtaat

SEQ ID NO: 2307923 - DNA, 22 bp, Homo sapiens
ctgaaaatatttttttctagct

SEQ ID NO: 2307924 - DNA, 16 bp, Homo sapiens
ctgaaacctctgttct

SEQ ID NO: 2307925 - DNA, 17 bp, Homo sapiens
ctgaaatccaaaatagt

SEQ ID NO: 2307926 - DNA, 20 bp, Homo sapiens
ctgaaatttgctatataatt

SEQ ID NO: 2307927 - DNA, 19 bp, Homo sapiens
ctgaacaggccgcacatct

SEQ ID NO: 2307928 - DNA, 13 bp, Homo sapiens
ctgaactgctgct

SEQ ID NO: 2307929 - DNA, 20 bp, Homo sapiens
ctgaagatccccattctttc

SEQ ID NO: 2307930 - DNA, 14 bp, Homo sapiens
ctgaagggagggga

SEQ ID NO: 2307931 - DNA, 18 bp, Homo sapiens
ctgaagggaggggaagag

SEQ ID NO: 2307932 - DNA, 20 bp, Homo sapiens
ctgaagggaggggaagagag

SEQ ID NO: 2307933 - DNA, 23 bp, Homo sapiens
ctgaagggaggggaagagagagg

SEQ ID NO: 2307934 - DNA, 23 bp, Homo sapiens
ctgaagtgatgatggatgagaaa

SEQ ID NO: 2307935 - DNA, 22 bp, Homo sapiens
ctgaataatggaattatgtata

SEQ ID NO: 2307936 - DNA, 12 bp, Homo sapiens
ctgaatgtaatt

SEQ ID NO: 2307937 - DNA, 16 bp, Homo sapiens
ctgaattgttatgtaa

SEQ ID NO: 2307938 - DNA, 17 bp, Homo sapiens
ctgaattgttatgtaaa

SEQ ID NO: 2307939 - DNA, 21 bp, Homo sapiens
ctgacacaatggtagctctga

SEQ ID NO: 2307940 - DNA, 12 bp, Homo sapiens
ctgacacctgcc

SEQ ID NO: 2307941 - DNA, 21 bp, Homo sapiens
ctgacagagccctatctatgt

SEQ ID NO: 2307942 - DNA, 15 bp, Homo sapiens
ctgaccaacgtggag

SEQ ID NO: 2307943 - DNA, 13 bp, Homo sapiens
ctgaccaggccct

SEQ ID NO: 2307944 - DNA, 14 bp, Homo sapiens
ctgaccaggccctg

SEQ ID NO: 2307945 - DNA, 17 bp, Homo sapiens
ctgaccaggccctgctc

SEQ ID NO: 2307946 - DNA, 18 bp, Homo sapiens
ctgaccaggccctgctca

SEQ ID NO: 2307947 - DNA, 13 bp, Homo sapiens
ctgaccgaaggga

SEQ ID NO: 2307948 - DNA, 23 bp, Homo sapiens
ctgacctgcccccgctctgccat

SEQ ID NO: 2307949 - DNA, 13 bp, Homo sapiens
ctgactaaatttg

SEQ ID NO: 2307950 - DNA, 15 bp, Homo sapiens
ctgactacttgatat

SEQ ID NO: 2307951 - DNA, 16 bp, Homo sapiens
ctgacttcccagctgg

SEQ ID NO: 2307952 - DNA, 17 bp, Homo sapiens
ctgacttcccagctggc

SEQ ID NO: 2307953 - DNA, 18 bp, Homo sapiens
ctgagaagcctcatggga

SEQ ID NO: 2307954 - DNA, 22 bp, Homo sapiens
ctgagaagcctcatgggagtca

SEQ ID NO: 2307955 - DNA, 17 bp, Homo sapiens
ctgagactcgcgacaat

SEQ ID NO: 2307956 - DNA, 19 bp, Homo sapiens
ctgagactcgcgacaatgc

SEQ ID NO: 2307957 - DNA, 20 bp, Homo sapiens
ctgagactcgcgacaatgca

SEQ ID NO: 2307958 - DNA, 16 bp, Homo sapiens
ctgagagcagaatgaa

SEQ ID NO: 2307959 - DNA, 18 bp, Homo sapiens
ctgagagggagagactgc

SEQ ID NO: 2307960 - DNA, 23 bp, Homo sapiens
ctgagattccagaacgccctgtg

SEQ ID NO: 2307961 - DNA, 13 bp, Homo sapiens
ctgagcagtgggg

SEQ ID NO: 2307962 - DNA, 20 bp, Homo sapiens
ctgagccacagtggggccca

SEQ ID NO: 2307963 - DNA, 13 bp, Homo sapiens
ctgagccagattt

SEQ ID NO: 2307964 - DNA, 14 bp, Homo sapiens
ctgagccagatttc

SEQ ID NO: 2307965 - DNA, 15 bp, Homo sapiens
ctgagccagatttca

SEQ ID NO: 2307966 - DNA, 18 bp, Homo sapiens
ctgagccagatttcactc

SEQ ID NO: 2307967 - DNA, 13 bp, Homo sapiens
ctgagcccctcct

SEQ ID NO: 2307968 - DNA, 15 bp, Homo sapiens
ctgagcccctcctct

SEQ ID NO: 2307969 - DNA, 15 bp, Homo sapiens
ctgagccgatctggt

SEQ ID NO: 2307970 - DNA, 19 bp, Homo sapiens
ctgagctccaccctcccct

SEQ ID NO: 2307971 - DNA, 20 bp, Homo sapiens
ctgagctccaccctcccctc

SEQ ID NO: 2307972 - DNA, 13 bp, Homo sapiens
ctgaggacggggc

SEQ ID NO: 2307973 - DNA, 22 bp, Homo sapiens
ctgaggacggggcagagctgag

SEQ ID NO: 2307974 - DNA, 13 bp, Homo sapiens
ctgaggagtgatg

SEQ ID NO: 2307975 - DNA, 21 bp, Homo sapiens
ctgaggcaggagggcatgtgc

SEQ ID NO: 2307976 - DNA, 15 bp, Homo sapiens
ctgaggctggggctt

SEQ ID NO: 2307977 - DNA, 16 bp, Homo sapiens
ctgagggaagcccacc

SEQ ID NO: 2307978 - DNA, 19 bp, Homo sapiens
ctgagggaagcccacccgc

SEQ ID NO: 2307979 - DNA, 22 bp, Homo sapiens
ctgagggaagcccacccgcccc

SEQ ID NO: 2307980 - DNA, 14 bp, Homo sapiens
ctgagggtttccac

SEQ ID NO: 2307981 - DNA, 23 bp, Homo sapiens
ctgaggtaaataaagccactttc

SEQ ID NO: 2307982 - DNA, 21 bp, Homo sapiens
ctgaggtccgatggcccgaga

SEQ ID NO: 2307983 - DNA, 22 bp, Homo sapiens
ctgagtagctgggactagaggc

SEQ ID NO: 2307984 - DNA, 19 bp, Homo sapiens
ctgagtcggctgggcaggg

SEQ ID NO: 2307985 - DNA, 23 bp, Homo sapiens
ctgagtcggctgggcagggccgc

SEQ ID NO: 2307986 - DNA, 14 bp, Homo sapiens
ctgagtctcattcc

SEQ ID NO: 2307987 - DNA, 21 bp, Homo sapiens
ctgagtctcattcctctgtcc

SEQ ID NO: 2307988 - DNA, 23 bp, Homo sapiens
ctgagtggtccacattctgctgc

SEQ ID NO: 2307989 - DNA, 16 bp, Homo sapiens
ctgatagagtttaaca

SEQ ID NO: 2307990 - DNA, 22 bp, Homo sapiens
ctgatagagtttaacagatatt

SEQ ID NO: 2307991 - DNA, 20 bp, Homo sapiens
ctgatatcacgggcccgctc

SEQ ID NO: 2307992 - DNA, 14 bp, Homo sapiens
ctgatattgaagta

SEQ ID NO: 2307993 - DNA, 14 bp, Homo sapiens
ctgatctctcgtga

SEQ ID NO: 2307994 - DNA, 22 bp, Homo sapiens
ctgatgagatacatttgatctt

SEQ ID NO: 2307995 - DNA, 18 bp, Homo sapiens
ctgatgggtcctgctgct

SEQ ID NO: 2307996 - DNA, 17 bp, Homo sapiens
ctgattaaatttaatat

SEQ ID NO: 2307997 - DNA, 21 bp, Homo sapiens
ctgattaaatttaatatactg

SEQ ID NO: 2307998 - DNA, 15 bp, Homo sapiens
ctgattattgaatgt

SEQ ID NO: 2307999 - DNA, 18 bp, Homo sapiens
ctgattattgaatgttat

SEQ ID NO: 2308000 - DNA, 19 bp, Homo sapiens
ctgattctatgcctgtatt

SEQ ID NO: 2308001 - DNA, 17 bp, Homo sapiens
ctgatttgcaaatgcac

SEQ ID NO: 2308002 - DNA, 16 bp, Homo sapiens
ctgatttttttttcct

SEQ ID NO: 2308003 - DNA, 20 bp, Homo sapiens
ctgcaataacagttttaaga

SEQ ID NO: 2308004 - DNA, 18 bp, Homo sapiens
ctgcaataaggggagagt

SEQ ID NO: 2308005 - DNA, 16 bp, Homo sapiens
ctgcaatcatatgtga

SEQ ID NO: 2308006 - DNA, 18 bp, Homo sapiens
ctgcaatcatatgtgatc

SEQ ID NO: 2308007 - DNA, 19 bp, Homo sapiens
ctgcaatcatatgtgatct

SEQ ID NO: 2308008 - DNA, 22 bp, Homo sapiens
ctgcacagtagtgttgggtgga

SEQ ID NO: 2308009 - DNA, 18 bp, Homo sapiens
ctgcactgggaatttatt

SEQ ID NO: 2308010 - DNA, 15 bp, Homo sapiens
ctgcagcctgagctc

SEQ ID NO: 2308011 - DNA, 17 bp, Homo sapiens
ctgcagcctgagctcca

SEQ ID NO: 2308012 - DNA, 22 bp, Homo sapiens
ctgcaggcggtatccagaggtg

SEQ ID NO: 2308013 - DNA, 16 bp, Homo sapiens
ctgcagtattctgtag

SEQ ID NO: 2308014 - DNA, 19 bp, Homo sapiens
ctgcagtcctccggttgca

SEQ ID NO: 2308015 - DNA, 21 bp, Homo sapiens
ctgcataagattatatacaaa

SEQ ID NO: 2308016 - DNA, 23 bp, Homo sapiens
ctgcataagattatatacaaagc

SEQ ID NO: 2308017 - DNA, 20 bp, Homo sapiens
ctgcatctttctcttcccat

SEQ ID NO: 2308018 - DNA, 18 bp, Homo sapiens
ctgccaaataaaatgttt

SEQ ID NO: 2308019 - DNA, 11 bp, Homo sapiens
ctgccaccctc

SEQ ID NO: 2308020 - DNA, 19 bp, Homo sapiens
ctgttctgtgtctgctgta

SEQ ID NO: 2308021 - DNA, 21 bp, Homo sapiens
ctgttgattccactgaaacct

SEQ ID NO: 2308022 - DNA, 19 bp, Homo sapiens
ctgtttacatccagagttc

SEQ ID NO: 2308023 - DNA, 22 bp, Homo sapiens
ctgtttacatccagagttctgt

SEQ ID NO: 2308024 - DNA, 18 bp, Homo sapiens
ctgtttatggtattttcg

SEQ ID NO: 2308025 - DNA, 16 bp, Homo sapiens
ctgtttctccccacac

SEQ ID NO: 2308026 - DNA, 21 bp, Homo sapiens
ctgtttctccccacaccctgg

SEQ ID NO: 2308027 - DNA, 22 bp, Homo sapiens
ctgtttctccccacaccctgga

SEQ ID NO: 2308028 - DNA, 12 bp, Homo sapiens
ctgtttcttgct

SEQ ID NO: 2308029 - DNA, 19 bp, Homo sapiens
ctgtttcttgcttgtacct

SEQ ID NO: 2308030 - DNA, 19 bp, Homo sapiens
ctgtttgctaagtgaggat

SEQ ID NO: 2308031 - DNA, 13 bp, Homo sapiens
ctgtttggggagg

SEQ ID NO: 2308032 - DNA, 17 bp, Homo sapiens
ctgtttggtgaggacct

SEQ ID NO: 2308033 - DNA, 23 bp, Homo sapiens
ctgtttggtgaggacctgcggcc

SEQ ID NO: 2308034 - DNA, 13 bp, Homo sapiens
ctgttttatgtca

SEQ ID NO: 2308035 - DNA, 15 bp, Homo sapiens
ctgttttatgtcata

SEQ ID NO: 2308036 - DNA, 21 bp, Homo sapiens
ctgttttattttaattcagtt

SEQ ID NO: 2308037 - DNA, 14 bp, Homo sapiens
ctgtttttgaagaa

SEQ ID NO: 2308038 - DNA, 19 bp, Homo sapiens
cttaaaatattgtgtaaga

SEQ ID NO: 2308039 - DNA, 16 bp, Homo sapiens
cttaaacctgtgcttt

SEQ ID NO: 2308040 - DNA, 19 bp, Homo sapiens
cttaaacctgtgctttcat

SEQ ID NO: 2308041 - DNA, 14 bp, Homo sapiens
cttaaatagcatct

SEQ ID NO: 2308042 - DNA, 16 bp, Homo sapiens
cttaacataaacttgt

SEQ ID NO: 2308043 - DNA, 23 bp, Homo sapiens
cttaactgtccagtccagtgatg

SEQ ID NO: 2308044 - DNA, 13 bp, Homo sapiens
cttaaggaaaaga

SEQ ID NO: 2308045 - DNA, 20 bp, Homo sapiens
cttaatgtgatgcttgatat

SEQ ID NO: 2308046 - DNA, 14 bp, Homo sapiens
cttaattactttca

SEQ ID NO: 2308047 - DNA, 22 bp, Homo sapiens
cttaattatgctaacaaactga

SEQ ID NO: 2308048 - DNA, 18 bp, Homo sapiens
cttaattctcattatgaa

SEQ ID NO: 2308049 - DNA, 16 bp, Homo sapiens
cttacacaaaggggat

SEQ ID NO: 2308050 - DNA, 21 bp, Homo sapiens
cttacacaaaggggatcataa

SEQ ID NO: 2308051 - DNA, 16 bp, Homo sapiens
cttacactgaaatcca

SEQ ID NO: 2308052 - DNA, 22 bp, Homo sapiens
cttacagtaactgagtgtggcg

SEQ ID NO: 2308053 - DNA, 15 bp, Homo sapiens
cttacgtgagtcctg

SEQ ID NO: 2308054 - DNA, 14 bp, Homo sapiens
cttactcttacacc

SEQ ID NO: 2308055 - DNA, 19 bp, Homo sapiens
cttagaatgagggaaacaa

SEQ ID NO: 2308056 - DNA, 14 bp, Homo sapiens
cttaggagcaaaat

SEQ ID NO: 2308057 - DNA, 14 bp, Homo sapiens
cttaggtttccacg

SEQ ID NO: 2308058 - DNA, 20 bp, Homo sapiens
cttatatatttgaaagaagt

SEQ ID NO: 2308059 - DNA, 15 bp, Homo sapiens
cttatcacacttgca

SEQ ID NO: 2308060 - DNA, 15 bp, Homo sapiens
cttatccccagctgt

SEQ ID NO: 2308061 - DNA, 22 bp, Homo sapiens
cttatctccagccaatttcaaa

SEQ ID NO: 2308062 - DNA, 22 bp, Homo sapiens
cttatgaaaacaccactgaaca

SEQ ID NO: 2308063 - DNA, 17 bp, Homo sapiens
cttattcactgagtctc

SEQ ID NO: 2308064 - DNA, 14 bp, Homo sapiens
cttatttatatatg

SEQ ID NO: 2308065 - DNA, 22 bp, Homo sapiens
cttatttatattcagagatgta

SEQ ID NO: 2308066 - DNA, 15 bp, Homo sapiens
cttcaaccctgccct

SEQ ID NO: 2308067 - DNA, 18 bp, Homo sapiens
cttcaaccctgccctgca

SEQ ID NO: 2308068 - DNA, 22 bp, Homo sapiens
cttcaaccctgccctgcacctt

SEQ ID NO: 2308069 - DNA, 15 bp, Homo sapiens
cttcaaggatcctga

SEQ ID NO: 2308070 - DNA, 17 bp, Homo sapiens
cttcaaggatcctgagc

SEQ ID NO: 2308071 - DNA, 20 bp, Homo sapiens
cttcaaggatcctgagccag

SEQ ID NO: 2308072 - DNA, 22 bp, Homo sapiens
cttcaaggatcctgagccagat

SEQ ID NO: 2308073 - DNA, 23 bp, Homo sapiens
cttcaaggatcctgagccagatt

SEQ ID NO: 2308074 - DNA, 16 bp, Homo sapiens
cttcaatgggagtgaa

SEQ ID NO: 2308075 - DNA, 23 bp, Homo sapiens
cttcagacacgcacttctggggc

SEQ ID NO: 2308076 - DNA, 12 bp, Homo sapiens
cttcagtgcctt

SEQ ID NO: 2308077 - DNA, 14 bp, Homo sapiens
cttcagtgccttat

SEQ ID NO: 2308078 - DNA, 14 bp, Homo sapiens
cttcagttctcatc

SEQ ID NO: 2308079 - DNA, 17 bp, Homo sapiens
cttcatcgcattttgat

SEQ ID NO: 2308080 - DNA, 15 bp, Homo sapiens
cttcatctggagtcc

SEQ ID NO: 2308081 - DNA, 12 bp, Homo sapiens
cttcatggtctc

SEQ ID NO: 2308082 - DNA, 16 bp, Homo sapiens
cttcatgttcagtcac

SEQ ID NO: 2308083 - DNA, 12 bp, Homo sapiens
cttccagctcag

SEQ ID NO: 2308084 - DNA, 21 bp, Homo sapiens
cttccagctcagtcccacagc

SEQ ID NO: 2308085 - DNA, 18 bp, Homo sapiens
cttccaggcgtagggcca

SEQ ID NO: 2308086 - DNA, 23 bp, Homo sapiens
cttccaggcgtagggccagggct

SEQ ID NO: 2308087 - DNA, 19 bp, Homo sapiens
cttccagttggactgtggc

SEQ ID NO: 2308088 - DNA, 17 bp, Homo sapiens
cttccatgatagatata

SEQ ID NO: 2308089 - DNA, 20 bp, Homo sapiens
cttccatgccgtcctgcagt

SEQ ID NO: 2308090 - DNA, 19 bp, Homo sapiens
cttcccaataggtgatctt

SEQ ID NO: 2308091 - DNA, 19 bp, Homo sapiens
cttcccacagcctcttcct

SEQ ID NO: 2308092 - DNA, 15 bp, Homo sapiens
cttcccagctggcag

SEQ ID NO: 2308093 - DNA, 18 bp, Homo sapiens
cttcccagctggcagcgc

SEQ ID NO: 2308094 - DNA, 19 bp, Homo sapiens
cttcccagctggcagcgcc

SEQ ID NO: 2308095 - DNA, 21 bp, Homo sapiens
cttcccatgcaacaccctctt

SEQ ID NO: 2308096 - DNA, 13 bp, Homo sapiens
cttcccatttgta

SEQ ID NO: 2308097 - DNA, 15 bp, Homo sapiens
cttcccatttgtaat

SEQ ID NO: 2308098 - DNA, 18 bp, Homo sapiens
cttccccgtgcggcccgt

SEQ ID NO: 2308099 - DNA, 14 bp, Homo sapiens
cttcccgcagcacc

SEQ ID NO: 2308100 - DNA, 17 bp, Homo sapiens
cttcccgcagcaccagc

SEQ ID NO: 2308101 - DNA, 21 bp, Homo sapiens
cttcccgcagcaccagcctga

SEQ ID NO: 2308102 - DNA, 18 bp, Homo sapiens
cttcctagaaagttctgt

SEQ ID NO: 2308103 - DNA, 21 bp, Homo sapiens
cttcctggattttctttctat

SEQ ID NO: 2308104 - DNA, 23 bp, Homo sapiens
cttcctggattttctttctatgt

SEQ ID NO: 2308105 - DNA, 19 bp, Homo sapiens
cttcgcgtatttcaggatt

SEQ ID NO: 2308106 - DNA, 15 bp, Homo sapiens
cttctaaagtgctgg

SEQ ID NO: 2308107 - DNA, 22 bp, Homo sapiens
cttctaagggatccagagacct

SEQ ID NO: 2308108 - DNA, 16 bp, Homo sapiens
cttctatactttctca

SEQ ID NO: 2308109 - DNA, 19 bp, Homo sapiens
cttctatactttctcacat

SEQ ID NO: 2308110 - DNA, 14 bp, Homo sapiens
cttctatgttcata

SEQ ID NO: 2308111 - DNA, 21 bp, Homo sapiens
cttctccctggactctgtggg

SEQ ID NO: 2308112 - DNA, 15 bp, Homo sapiens
cttctcccttctcct

SEQ ID NO: 2308113 - DNA, 21 bp, Homo sapiens
cttctctgccctgccctggcc

SEQ ID NO: 2308114 - DNA, 12 bp, Homo sapiens
cttctgctgcct

SEQ ID NO: 2308115 - DNA, 14 bp, Homo sapiens
cttctgctgcctgt

SEQ ID NO: 2308116 - DNA, 21 bp, Homo sapiens
cttctggaggtggggagggcc

SEQ ID NO: 2308117 - DNA, 21 bp, Homo sapiens
cttcttgcggcaccgcccacc

SEQ ID NO: 2308118 - DNA, 17 bp, Homo sapiens
cttgaacaaaatctgtt

SEQ ID NO: 2308119 - DNA, 18 bp, Homo sapiens
cttgaacaaaatctgttg

SEQ ID NO: 2308120 - DNA, 20 bp, Homo sapiens
cttgaacaaaatctgttgcc

SEQ ID NO: 2308121 - DNA, 14 bp, Homo sapiens
cttgaactcttggc

SEQ ID NO: 2308122 - DNA, 15 bp, Homo sapiens
cttgaactcttggcc

SEQ ID NO: 2308123 - DNA, 19 bp, Homo sapiens
cttgaactgtggccaccta

SEQ ID NO: 2308124 - DNA, 15 bp, Homo sapiens
cttgaagaaggaaag

SEQ ID NO: 2308125 - DNA, 13 bp, Homo sapiens
cttgaagaatatt

SEQ ID NO: 2308126 - DNA, 15 bp, Homo sapiens
cttgaagaatattgt

SEQ ID NO: 2308127 - DNA, 20 bp, Homo sapiens
cttgaagctgctcactgctc

SEQ ID NO: 2308128 - DNA, 19 bp, Homo sapiens
cttgaatattatacttctt

SEQ ID NO: 2308129 - DNA, 23 bp, Homo sapiens
cttgaatgatgccatgaggaaca

SEQ ID NO: 2308130 - DNA, 19 bp, Homo sapiens
cttgaatgtccccattcta

SEQ ID NO: 2308131 - DNA, 21 bp, Homo sapiens
cttgaatgtccccattctata

SEQ ID NO: 2308132 - DNA, 20 bp, Homo sapiens
cttgagaataaatgagcatt

SEQ ID NO: 2308133 - DNA, 21 bp, Homo sapiens
cttgagcaccaggtgttaaaa

SEQ ID NO: 2308134 - DNA, 15 bp, Homo sapiens
cttgaggacctccac

SEQ ID NO: 2308135 - DNA, 14 bp, Homo sapiens
cttgagtggacagc

SEQ ID NO: 2308136 - DNA, 18 bp, Homo sapiens
cttgatataataattact

SEQ ID NO: 2308137 - DNA, 20 bp, Homo sapiens
cttgatataataattactta

SEQ ID NO: 2308138 - DNA, 23 bp, Homo sapiens
cttgatataataattacttaatg

SEQ ID NO: 2308139 - DNA, 20 bp, Homo sapiens
cttgatataattacttaatg

SEQ ID NO: 2308140 - DNA, 20 bp, Homo sapiens
cttgatcagacattcagaga

SEQ ID NO: 2308141 - DNA, 19 bp, Homo sapiens
cttgattcataatgactta

SEQ ID NO: 2308142 - DNA, 22 bp, Homo sapiens
cttgcaaatgaatgcctttcaa

SEQ ID NO: 2308143 - DNA, 21 bp, Homo sapiens
cttgcaaatgttgtatttcaa

SEQ ID NO: 2308144 - DNA, 14 bp, Homo sapiens
cttgcacttctgtt

SEQ ID NO: 2308145 - DNA, 15 bp, Homo sapiens
cttgcggcaccgccc

SEQ ID NO: 2308146 - DNA, 16 bp, Homo sapiens
cttgctagtgatacac

SEQ ID NO: 2308147 - DNA, 21 bp, Homo sapiens
cttgctatgttattttcagtg

SEQ ID NO: 2308148 - DNA, 22 bp, Homo sapiens
cttgctcaccaagctgttccac

SEQ ID NO: 2308149 - DNA, 17 bp, Homo sapiens
cttgctccttgaataag

SEQ ID NO: 2308150 - DNA, 19 bp, Homo sapiens
cttgcttcttcaccagtta

SEQ ID NO: 2308151 - DNA, 19 bp, Homo sapiens
gacagagatggcagagcca

SEQ ID NO: 2308152 - DNA, 21 bp, Homo sapiens
gacagagccctatctatgtcc

SEQ ID NO: 2308153 - DNA, 16 bp, Homo sapiens
gacagatgggtgtccc

SEQ ID NO: 2308154 - DNA, 14 bp, Homo sapiens
gacagcagctggac

SEQ ID NO: 2308155 - DNA, 21 bp, Homo sapiens
gacagcagctggactgggtgg

SEQ ID NO: 2308156 - DNA, 14 bp, Homo sapiens
gacagcggcccggc

SEQ ID NO: 2308157 - DNA, 16 bp, Homo sapiens
gacagcggcccggccc

SEQ ID NO: 2308158 - DNA, 21 bp, Homo sapiens
gacagcggcccggcccacgca

SEQ ID NO: 2308159 - DNA, 22 bp, Homo sapiens
gacagcggcccggcccacgcag

SEQ ID NO: 2308160 - DNA, 18 bp, Homo sapiens
gacaggaacacccagccc

SEQ ID NO: 2308161 - DNA, 23 bp, Homo sapiens
gacaggacttgtgcgccggcgcc

SEQ ID NO: 2308162 - DNA, 20 bp, Homo sapiens
gacaggattgtctgctgcct

SEQ ID NO: 2308163 - DNA, 23 bp, Homo sapiens
gacaggattgtctgctgcctcca

SEQ ID NO: 2308164 - DNA, 24 bp, Homo sapiens
gacaggattgtctgctgcctccaa

SEQ ID NO: 2308165 - DNA, 22 bp, Homo sapiens
gacaggcttcgtctcagaaggc

SEQ ID NO: 2308166 - DNA, 23 bp, Homo sapiens
gacaggcttcgtctcagaaggct

SEQ ID NO: 2308167 - DNA, 22 bp, Homo sapiens
gacagtgacctctctaggtgtg

SEQ ID NO: 2308168 - DNA, 19 bp, Homo sapiens
gacagtttgtaaatgttat

SEQ ID NO: 2308169 - DNA, 23 bp, Homo sapiens
gacatcaactgcatcaagatgtg

SEQ ID NO: 2308170 - DNA, 13 bp, Homo sapiens
gacatcagcccgg

SEQ ID NO: 2308171 - DNA, 16 bp, Homo sapiens
gacatggcaacaaagg

SEQ ID NO: 2308172 - DNA, 23 bp, Homo sapiens
gacatgtatactccatagaaact

SEQ ID NO: 2308173 - DNA, 17 bp, Homo sapiens
gaccagcatagttctgc

SEQ ID NO: 2308174 - DNA, 17 bp, Homo sapiens
gaccaggactctgcctt

SEQ ID NO: 2308175 - DNA, 18 bp, Homo sapiens
gacccactccgactcccc

SEQ ID NO: 2308176 - DNA, 20 bp, Homo sapiens
gacccactccgactccccct

SEQ ID NO: 2308177 - DNA, 22 bp, Homo sapiens
gacccactccgactccccctcc

SEQ ID NO: 2308178 - DNA, 21 bp, Homo sapiens
gaccccacacgccggggctgg

SEQ ID NO: 2308179 - DNA, 22 bp, Homo sapiens
gaccccacctgaggcaggaggg

SEQ ID NO: 2308180 - DNA, 16 bp, Homo sapiens
gaccccatccagccag

SEQ ID NO: 2308181 - DNA, 17 bp, Homo sapiens
gaccccatccagccagg

SEQ ID NO: 2308182 - DNA, 17 bp, Homo sapiens
gaccccatctgctgagc

SEQ ID NO: 2308183 - DNA, 14 bp, Homo sapiens
gacccctgggggag

SEQ ID NO: 2308184 - DNA, 16 bp, Homo sapiens
gacccctgggggaggc

SEQ ID NO: 2308185 - DNA, 23 bp, Homo sapiens
gacccctgggggaggcttccagc

SEQ ID NO: 2308186 - DNA, 18 bp, Homo sapiens
gaccctcggggcaggaag

SEQ ID NO: 2308187 - DNA, 20 bp, Homo sapiens
gaccctgagggtttccacct

SEQ ID NO: 2308188 - DNA, 18 bp, Homo sapiens
gaccctgggagagtgagg

SEQ ID NO: 2308189 - DNA, 11 bp, Homo sapiens
gaccctgtgtg

SEQ ID NO: 2308190 - DNA, 15 bp, Homo sapiens
gaccggcccgccacc

SEQ ID NO: 2308191 - DNA, 17 bp, Homo sapiens
gaccggcccgccacctt

SEQ ID NO: 2308192 - DNA, 18 bp, Homo sapiens
gaccggggtcctgaggct

SEQ ID NO: 2308193 - DNA, 19 bp, Homo sapiens
gacctaaatccattttcta

SEQ ID NO: 2308194 - DNA, 15 bp, Homo sapiens
gacctacatctgaaa

SEQ ID NO: 2308195 - DNA, 16 bp, Homo sapiens
gacctagggatcctga

SEQ ID NO: 2308196 - DNA, 13 bp, Homo sapiens
gacctccctggct

SEQ ID NO: 2308197 - DNA, 15 bp, Homo sapiens
gacctccctggcttg

SEQ ID NO: 2308198 - DNA, 13 bp, Homo sapiens
gacctgctccaga

SEQ ID NO: 2308199 - DNA, 17 bp, Homo sapiens
gacctgctccagatcct

SEQ ID NO: 2308200 - DNA, 14 bp, Homo sapiens
gacctgggccctgg

SEQ ID NO: 2308201 - DNA, 18 bp, Homo sapiens
gacctggggtcccccctc

SEQ ID NO: 2308202 - DNA, 15 bp, Homo sapiens
gaccttctgaagatc

SEQ ID NO: 2308203 - DNA, 16 bp, Homo sapiens
gaccttggtggtggga

SEQ ID NO: 2308204 - DNA, 20 bp, Homo sapiens
gacgacctacatctgaaatc

SEQ ID NO: 2308205 - DNA, 14 bp, Homo sapiens
gacgagtgagctac

SEQ ID NO: 2308206 - DNA, 20 bp, Homo sapiens
gacgagtgagctaccaggaa

SEQ ID NO: 2308207 - DNA, 17 bp, Homo sapiens
gacgcagggagaccctg

SEQ ID NO: 2308208 - DNA, 21 bp, Homo sapiens
gacgcagggagaccctgggag

SEQ ID NO: 2308209 - DNA, 22 bp, Homo sapiens
gacgcagggagaccctgggaga

SEQ ID NO: 2308210 - DNA, 13 bp, Homo sapiens
gacggcagcccca

SEQ ID NO: 2308211 - DNA, 16 bp, Homo sapiens
gacggcagccccatcc

SEQ ID NO: 2308212 - DNA, 14 bp, Homo sapiens
gacggtctgtgccc

SEQ ID NO: 2308213 - DNA, 11 bp, Homo sapiens
gacgtgttatg

SEQ ID NO: 2308214 - DNA, 16 bp, Homo sapiens
gactacttgatataat

SEQ ID NO: 2308215 - DNA, 19 bp, Homo sapiens
gactcaaggaagaataatt

SEQ ID NO: 2308216 - DNA, 16 bp, Homo sapiens
gactcagttcttggcc

SEQ ID NO: 2308217 - DNA, 18 bp, Homo sapiens
gactccaggggctgggga

SEQ ID NO: 2308218 - DNA, 16 bp, Homo sapiens
gactccccctccccgg

SEQ ID NO: 2308219 - DNA, 20 bp, Homo sapiens
gactccccctccccggcatc

SEQ ID NO: 2308220 - DNA, 16 bp, Homo sapiens
gactccccgcccgccc

SEQ ID NO: 2308221 - DNA, 21 bp, Homo sapiens
gactccccgcccgccctcctc

SEQ ID NO: 2308222 - DNA, 15 bp, Homo sapiens
gactcgagagggctg

SEQ ID NO: 2308223 - DNA, 20 bp, Homo sapiens
gactcgagagggctgagccc

SEQ ID NO: 2308224 - DNA, 21 bp, Homo sapiens
gactcgagagggctgagcccc

SEQ ID NO: 2308225 - DNA, 18 bp, Homo sapiens
gactcgcgacaatgcaaa

SEQ ID NO: 2308226 - DNA, 19 bp, Homo sapiens
gactcgcttagctgaaacc

SEQ ID NO: 2308227 - DNA, 22 bp, Homo sapiens
gactcgggctaagtccagctct

SEQ ID NO: 2308228 - DNA, 19 bp, Homo sapiens
gactctggaaccatcctct

SEQ ID NO: 2308229 - DNA, 20 bp, Homo sapiens
gactctggaaccatcctctg

SEQ ID NO: 2308230 - DNA, 23 bp, Homo sapiens
gactctggaaccatcctctgtta

SEQ ID NO: 2308231 - DNA, 17 bp, Homo sapiens
gactctgtggggccaca

SEQ ID NO: 2308232 - DNA, 17 bp, Homo sapiens
gactcttcaaaaactgt

SEQ ID NO: 2308233 - DNA, 13 bp, Homo sapiens
gactcttcttatc

SEQ ID NO: 2308234 - DNA, 22 bp, Homo sapiens
gactcttcttatcacacttgca

SEQ ID NO: 2308235 - DNA, 18 bp, Homo sapiens
gactgaccgaagggacgg

SEQ ID NO: 2308236 - DNA, 21 bp, Homo sapiens
gactgcaatttctccaaagct

SEQ ID NO: 2308237 - DNA, 10 bp, Homo sapiens
gactgcccac

SEQ ID NO: 2308238 - DNA, 15 bp, Homo sapiens
gactgcccaccctgg

SEQ ID NO: 2308239 - DNA, 21 bp, Homo sapiens
gactgctagaaccaagcacta

SEQ ID NO: 2308240 - DNA, 18 bp, Homo sapiens
gactgggtgggccccaca

SEQ ID NO: 2308241 - DNA, 21 bp, Homo sapiens
gactgtcttcaaccctgccct

SEQ ID NO: 2308242 - DNA, 17 bp, Homo sapiens
gacttcacaaaatgcaa

SEQ ID NO: 2308243 - DNA, 18 bp, Homo sapiens
gacttcacaaaatgcaag

SEQ ID NO: 2308244 - DNA, 21 bp, Homo sapiens
gacttcccagctggcagcgcc

SEQ ID NO: 2308245 - DNA, 14 bp, Homo sapiens
gacttcgaaaacag

SEQ ID NO: 2308246 - DNA, 23 bp, Homo sapiens
gacttcgggggcggctctgggaa

SEQ ID NO: 2308247 - DNA, 19 bp, Homo sapiens
gacttgtgcgccggcgccc

SEQ ID NO: 2308248 - DNA, 17 bp, Homo sapiens
gactttaattcttctct

SEQ ID NO: 2308249 - DNA, 21 bp, Homo sapiens
gacttttagcggtttgcaaac

SEQ ID NO: 2308250 - DNA, 23 bp, Homo sapiens
gacttttctttcagccaagaatt

SEQ ID NO: 2308251 - DNA, 13 bp, Homo sapiens
gagaaaaaaacag

SEQ ID NO: 2308252 - DNA, 15 bp, Homo sapiens
gagaaaaaaacagca

SEQ ID NO: 2308253 - DNA, 22 bp, Homo sapiens
gagaaaatgctttctcatgcat

SEQ ID NO: 2308254 - DNA, 21 bp, Homo sapiens
gagaaacccaagtggaatcat

SEQ ID NO: 2308255 - DNA, 16 bp, Homo sapiens
gagaagactagcagct

SEQ ID NO: 2308256 - DNA, 14 bp, Homo sapiens
gagaagcacttgag

SEQ ID NO: 2308257 - DNA, 19 bp, Homo sapiens
gagaagtacttttgattat

SEQ ID NO: 2308258 - DNA, 21 bp, Homo sapiens
gagaataaatgagcatttttt

SEQ ID NO: 2308259 - DNA, 15 bp, Homo sapiens
gagaataatttttgt

SEQ ID NO: 2308260 - DNA, 13 bp, Homo sapiens
gagaattctaaga

SEQ ID NO: 2308261 - DNA, 23 bp, Homo sapiens
gagacaaagtttggaagtacata

SEQ ID NO: 2308262 - DNA, 15 bp, Homo sapiens
gagacactggtctca

SEQ ID NO: 2308263 - DNA, 19 bp, Homo sapiens
gagacactggtctcagagg

SEQ ID NO: 2308264 - DNA, 22 bp, Homo sapiens
gagacactggtctcagaggagg

SEQ ID NO: 2308265 - DNA, 18 bp, Homo sapiens
gagacagggtctcactgt

SEQ ID NO: 2308266 - DNA, 15 bp, Homo sapiens
gagacagtcaggaag

SEQ ID NO: 2308267 - DNA, 16 bp, Homo sapiens
gagacagtcaggaagc

SEQ ID NO: 2308268 - DNA, 12 bp, Homo sapiens
gagaccaggact

SEQ ID NO: 2308269 - DNA, 15 bp, Homo sapiens
gagaccaggactctg

SEQ ID NO: 2308270 - DNA, 23 bp, Homo sapiens
gagaccgagtgtggagctgcttc

SEQ ID NO: 2308271 - DNA, 14 bp, Homo sapiens
gagacctcccccag

SEQ ID NO: 2308272 - DNA, 13 bp, Homo sapiens
gagacctgctcca

SEQ ID NO: 2308273 - DNA, 13 bp, Homo sapiens
gagacggcagccc

SEQ ID NO: 2308274 - DNA, 19 bp, Homo sapiens
gagacggcagccccatcct

SEQ ID NO: 2308275 - DNA, 14 bp, Homo sapiens
gagactatgtgtca

SEQ ID NO: 2308276 - DNA, 12 bp, Homo sapiens
gagactcaggcc

SEQ ID NO: 2308277 - DNA, 20 bp, Homo sapiens
gagactcgcgacaatgcaaa

SEQ ID NO: 2308278 - DNA, 14 bp, Homo sapiens
gagactgcccaccc

SEQ ID NO: 2308279 - DNA, 20 bp, Homo sapiens
gagactgcccaccctgggcc

SEQ ID NO: 2308280 - DNA, 22 bp, Homo sapiens
gagactgcccaccctgggcctc

SEQ ID NO: 2308281 - DNA, 22 bp, Homo sapiens
gagactgctagaaccaagcact

SEQ ID NO: 2308282 - DNA, 23 bp, Homo sapiens
gcagctgtgtttgagtttctggc

SEQ ID NO: 2308283 - DNA, 16 bp, Homo sapiens
gcagcttggagacagg

SEQ ID NO: 2308284 - DNA, 16 bp, Homo sapiens
gcaggaaccgaggact

SEQ ID NO: 2308285 - DNA, 18 bp, Homo sapiens
gcaggaaccgaggactcc

SEQ ID NO: 2308286 - DNA, 18 bp, Homo sapiens
gcaggaagagatgctcta

SEQ ID NO: 2308287 - DNA, 13 bp, Homo sapiens
gcaggaagtccct

SEQ ID NO: 2308288 - DNA, 15 bp, Homo sapiens
gcaggaagtccctga

SEQ ID NO: 2308289 - DNA, 18 bp, Homo sapiens
gcaggagacactggtctc

SEQ ID NO: 2308290 - DNA, 11 bp, Homo sapiens
gcaggagctca

SEQ ID NO: 2308291 - DNA, 13 bp, Homo sapiens
gcaggagctcaca

SEQ ID NO: 2308292 - DNA, 23 bp, Homo sapiens
gcaggcagacgaggcctttgctt

SEQ ID NO: 2308293 - DNA, 13 bp, Homo sapiens
gcaggcctgttcc

SEQ ID NO: 2308294 - DNA, 23 bp, Homo sapiens
gcaggcctgttccctgaggacct

SEQ ID NO: 2308295 - DNA, 17 bp, Homo sapiens
gcaggcgcgcaccgccc

SEQ ID NO: 2308296 - DNA, 17 bp, Homo sapiens
gcaggcggtatccagag

SEQ ID NO: 2308297 - DNA, 14 bp, Homo sapiens
gcagggagaccctg

SEQ ID NO: 2308298 - DNA, 15 bp, Homo sapiens
gcagggagaccctgg

SEQ ID NO: 2308299 - DNA, 18 bp, Homo sapiens
gcagggagaccctgggag

SEQ ID NO: 2308300 - DNA, 13 bp, Homo sapiens
gcagggccctgtg

SEQ ID NO: 2308301 - DNA, 14 bp, Homo sapiens
gcagggccctgtgg

SEQ ID NO: 2308302 - DNA, 18 bp, Homo sapiens
gcagggccctgtggctcc

SEQ ID NO: 2308303 - DNA, 17 bp, Homo sapiens
gcagggcgctccggcag

SEQ ID NO: 2308304 - DNA, 14 bp, Homo sapiens
gcaggggcttccca

SEQ ID NO: 2308305 - DNA, 23 bp, Homo sapiens
gcagggggcttggctcgcacccc

SEQ ID NO: 2308306 - DNA, 23 bp, Homo sapiens
gcagggggttctgggacccactc

SEQ ID NO: 2308307 - DNA, 21 bp, Homo sapiens
gcaggggtcgcgatgatgggc

SEQ ID NO: 2308308 - DNA, 16 bp, Homo sapiens
gcaggtggccagggct

SEQ ID NO: 2308309 - DNA, 12 bp, Homo sapiens
gcaggtgggcag

SEQ ID NO: 2308310 - DNA, 14 bp, Homo sapiens
gcaggtgggcagac

SEQ ID NO: 2308311 - DNA, 21 bp, Homo sapiens
gcaggtgggcagacagtgacc

SEQ ID NO: 2308312 - DNA, 14 bp, Homo sapiens
gcagtaattcccat

SEQ ID NO: 2308313 - DNA, 22 bp, Homo sapiens
gcagtaattcccatctgcttta

SEQ ID NO: 2308314 - DNA, 17 bp, Homo sapiens
gcagtaccatcccactg

SEQ ID NO: 2308315 - DNA, 16 bp, Homo sapiens
gcagtccagtgagaaa

SEQ ID NO: 2308316 - DNA, 16 bp, Homo sapiens
gcagtctccgctcccg

SEQ ID NO: 2308317 - DNA, 18 bp, Homo sapiens
gcagtctccgctcccgca

SEQ ID NO: 2308318 - DNA, 16 bp, Homo sapiens
gcagtgcagcaaccag

SEQ ID NO: 2308319 - DNA, 21 bp, Homo sapiens
gcagtgcagcaaccagagcac

SEQ ID NO: 2308320 - DNA, 13 bp, Homo sapiens
gcagtggcagaga

SEQ ID NO: 2308321 - DNA, 22 bp, Homo sapiens
gcagtggcttggagcagaggtg

SEQ ID NO: 2308322 - DNA, 15 bp, Homo sapiens
gcagtggtgatgcct

SEQ ID NO: 2308323 - DNA, 21 bp, Homo sapiens
gcagtggtgatgcctaaagga

SEQ ID NO: 2308324 - DNA, 14 bp, Homo sapiens
gcagttcctgtgcc

SEQ ID NO: 2308325 - DNA, 15 bp, Homo sapiens
gcagttcctgtgcct

SEQ ID NO: 2308326 - DNA, 12 bp, Homo sapiens
gcataacacagc

SEQ ID NO: 2308327 - DNA, 16 bp, Homo sapiens
gcataagattatatac

SEQ ID NO: 2308328 - DNA, 21 bp, Homo sapiens
gcatacacatgcactcagtgt

SEQ ID NO: 2308329 - DNA, 15 bp, Homo sapiens
gcatacgcctcttgt

SEQ ID NO: 2308330 - DNA, 13 bp, Homo sapiens
gcatacttctaaa

SEQ ID NO: 2308331 - DNA, 16 bp, Homo sapiens
gcatagacaagtgttt

SEQ ID NO: 2308332 - DNA, 16 bp, Homo sapiens
gcatagccattcattt

SEQ ID NO: 2308333 - DNA, 21 bp, Homo sapiens
gcatagggtttggaagaaagg

SEQ ID NO: 2308334 - DNA, 21 bp, Homo sapiens
gcatcaagatgtgacatgttt

SEQ ID NO: 2308335 - DNA, 16 bp, Homo sapiens
gcatcatttcccctcc

SEQ ID NO: 2308336 - DNA, 20 bp, Homo sapiens
gcatcatttcccctcccgct

SEQ ID NO: 2308337 - DNA, 22 bp, Homo sapiens
gcatcatttcccctcccgcttc

SEQ ID NO: 2308338 - DNA, 12 bp, Homo sapiens
gcatccaggcac

SEQ ID NO: 2308339 - DNA, 17 bp, Homo sapiens
gcatccagtatcttgaa

SEQ ID NO: 2308340 - DNA, 18 bp, Homo sapiens
gcatccagtatcttgaag

SEQ ID NO: 2308341 - DNA, 21 bp, Homo sapiens
gcatccatgcggccggcctgg

SEQ ID NO: 2308342 - DNA, 15 bp, Homo sapiens
gcatccccagccccc

SEQ ID NO: 2308343 - DNA, 19 bp, Homo sapiens
gcatccccagccccctggc

SEQ ID NO: 2308344 - DNA, 13 bp, Homo sapiens
gcatctgatagaa

SEQ ID NO: 2308345 - DNA, 14 bp, Homo sapiens
gcatctgctcttct

SEQ ID NO: 2308346 - DNA, 12 bp, Homo sapiens
gcatctttctct

SEQ ID NO: 2308347 - DNA, 21 bp, Homo sapiens
gcatgacacgaatattgctga

SEQ ID NO: 2308348 - DNA, 15 bp, Homo sapiens
gcatgaccctggagc

SEQ ID NO: 2308349 - DNA, 18 bp, Homo sapiens
gcatgccgagtgccccag

SEQ ID NO: 2308350 - DNA, 14 bp, Homo sapiens
gcatggcagccctc

SEQ ID NO: 2308351 - DNA, 15 bp, Homo sapiens
gcatgtaagaaataa

SEQ ID NO: 2308352 - DNA, 17 bp, Homo sapiens
gcatgtgatgagaggaa

SEQ ID NO: 2308353 - DNA, 22 bp, Homo sapiens
gcatgtgcagacactcaagagc

SEQ ID NO: 2308354 - DNA, 23 bp, Homo sapiens
gcatgtttcccgctccaagagaa

SEQ ID NO: 2308355 - DNA, 12 bp, Homo sapiens
gcattaaatata

SEQ ID NO: 2308356 - DNA, 16 bp, Homo sapiens
gcattaaatataaaat

SEQ ID NO: 2308357 - DNA, 22 bp, Homo sapiens
gcattagttggagctagaaaat

SEQ ID NO: 2308358 - DNA, 21 bp, Homo sapiens
gcattcaaccaactgtaatgc

SEQ ID NO: 2308359 - DNA, 15 bp, Homo sapiens
gcattccagcgtctg

SEQ ID NO: 2308360 - DNA, 18 bp, Homo sapiens
gcattgaaataataatat

SEQ ID NO: 2308361 - DNA, 18 bp, Homo sapiens
gcattgattgcacttgat

SEQ ID NO: 2308362 - DNA, 23 bp, Homo sapiens
gcattgtccttttcttttcttga

SEQ ID NO: 2308363 - DNA, 19 bp, Homo sapiens
gcatttctcttcctaaatt

SEQ ID NO: 2308364 - DNA, 13 bp, Homo sapiens
gcattttggctca

SEQ ID NO: 2308365 - DNA, 18 bp, Homo sapiens
gcattttgtggctgattt

SEQ ID NO: 2308366 - DNA, 17 bp, Homo sapiens
gcatttttacctttcat

SEQ ID NO: 2308367 - DNA, 20 bp, Homo sapiens
gccaaacacccaagcacaaa

SEQ ID NO: 2308368 - DNA, 16 bp, Homo sapiens
gccaaacattcttatt

SEQ ID NO: 2308369 - DNA, 20 bp, Homo sapiens
gccaaagatagcagaagagt

SEQ ID NO: 2308370 - DNA, 22 bp, Homo sapiens
gccaaccactttcacctgggat

SEQ ID NO: 2308371 - DNA, 14 bp, Homo sapiens
gccaaggacactga

SEQ ID NO: 2308372 - DNA, 20 bp, Homo sapiens
gccaaggacactgatgggtc

SEQ ID NO: 2308373 - DNA, 18 bp, Homo sapiens
gccaatttcaaagaaaac

SEQ ID NO: 2308374 - DNA, 20 bp, Homo sapiens
gccacagtggggcccatggc

SEQ ID NO: 2308375 - DNA, 17 bp, Homo sapiens
gccacatcgcagcccct

SEQ ID NO: 2308376 - DNA, 12 bp, Homo sapiens
gccacccgcccg

SEQ ID NO: 2308377 - DNA, 15 bp, Homo sapiens
gccacccgcccgccc

SEQ ID NO: 2308378 - DNA, 19 bp, Homo sapiens
gccaccctctgctgcacag

SEQ ID NO: 2308379 - DNA, 11 bp, Homo sapiens
gccactggccc

SEQ ID NO: 2308380 - DNA, 18 bp, Homo sapiens
gccactggggtgggaggg

SEQ ID NO: 2308381 - DNA, 19 bp, Homo sapiens
gccactggggtgggagggg

SEQ ID NO: 2308382 - DNA, 20 bp, Homo sapiens
gccactggggtgggaggggg

SEQ ID NO: 2308383 - DNA, 16 bp, Homo sapiens
gccagaatgtttcctg

SEQ ID NO: 2308384 - DNA, 15 bp, Homo sapiens
gccagagctcccagg

SEQ ID NO: 2308385 - DNA, 16 bp, Homo sapiens
gccagatttcactctc

SEQ ID NO: 2308386 - DNA, 18 bp, Homo sapiens
gccagatttcactctcct

SEQ ID NO: 2308387 - DNA, 20 bp, Homo sapiens
gccagcccctccccgcctcc

SEQ ID NO: 2308388 - DNA, 21 bp, Homo sapiens
gccagcccctccccgcctcct

SEQ ID NO: 2308389 - DNA, 17 bp, Homo sapiens
gccaggaaggggacagg

SEQ ID NO: 2308390 - DNA, 18 bp, Homo sapiens
gccaggaaggggacagga

SEQ ID NO: 2308391 - DNA, 22 bp, Homo sapiens
gccaggagtgggtgggacacag

SEQ ID NO: 2308392 - DNA, 14 bp, Homo sapiens
gccaggcaggaggc

SEQ ID NO: 2308393 - DNA, 14 bp, Homo sapiens
gccaggctgagccg

SEQ ID NO: 2308394 - DNA, 15 bp, Homo sapiens
gccaggctgagccga

SEQ ID NO: 2308395 - DNA, 15 bp, Homo sapiens
gccagggctccacgg

SEQ ID NO: 2308396 - DNA, 23 bp, Homo sapiens
gccagggtggtggtgcacacctg

SEQ ID NO: 2308397 - DNA, 16 bp, Homo sapiens
gccagttggtgttcct

SEQ ID NO: 2308398 - DNA, 17 bp, Homo sapiens
gccatcagaaattttct

SEQ ID NO: 2308399 - DNA, 20 bp, Homo sapiens
gccatcagcccctgctgctc

SEQ ID NO: 2308400 - DNA, 11 bp, Homo sapiens
gccatgctctt

SEQ ID NO: 2308401 - DNA, 18 bp, Homo sapiens
gcccaacccccacctccc

SEQ ID NO: 2308402 - DNA, 19 bp, Homo sapiens
gcccacaataatgaataat

SEQ ID NO: 2308403 - DNA, 12 bp, Homo sapiens
gcccacacctgc

SEQ ID NO: 2308404 - DNA, 17 bp, Homo sapiens
gcccacacctgcctctg

SEQ ID NO: 2308405 - DNA, 17 bp, Homo sapiens
gcccacattgcccacac

SEQ ID NO: 2308406 - DNA, 21 bp, Homo sapiens
gcccacattgcccacacctgc

SEQ ID NO: 2308407 - DNA, 17 bp, Homo sapiens
gcccacccacaccccgt

SEQ ID NO: 2308408 - DNA, 10 bp, Homo sapiens
gcccaccccg

SEQ ID NO: 2308409 - DNA, 15 bp, Homo sapiens
gcccaccccgctgcc

SEQ ID NO: 2308410 - DNA, 17 bp, Homo sapiens
gcccaccccgctgcctg

SEQ ID NO: 2308411 - DNA, 19 bp, Homo sapiens
gcccaccccgctgcctggc

SEQ ID NO: 2308412 - DNA, 20 bp, Homo sapiens
gcccaccccgctgcctggcg

SEQ ID NO: 2308413 - DNA, 16 bp, Homo sapiens
gcccacccgccccaga

SEQ ID NO: 2308414 - DNA, 19 bp, Homo sapiens
gcccacccgccccagagac

SEQ ID NO: 2308415 - DNA, 20 bp, Homo sapiens
ggagaccgagtgtggagctg

SEQ ID NO: 2308416 - DNA, 22 bp, Homo sapiens
ggagaccgagtgtggagctgct

SEQ ID NO: 2308417 - DNA, 19 bp, Homo sapiens
ggagatccgccctgggctc

SEQ ID NO: 2308418 - DNA, 21 bp, Homo sapiens
ggagatccgccctgggctctg

SEQ ID NO: 2308419 - DNA, 17 bp, Homo sapiens
ggagcaaggctgccctg

SEQ ID NO: 2308420 - DNA, 14 bp, Homo sapiens
ggagcaaggctgct

SEQ ID NO: 2308421 - DNA, 17 bp, Homo sapiens
ggagcaaggctgctaag

SEQ ID NO: 2308422 - DNA, 19 bp, Homo sapiens
ggagcaaggctgctaagtg

SEQ ID NO: 2308423 - DNA, 12 bp, Homo sapiens
ggagcaccccca

SEQ ID NO: 2308424 - DNA, 13 bp, Homo sapiens
ggagcacccccag

SEQ ID NO: 2308425 - DNA, 14 bp, Homo sapiens
ggagcacccccagc

SEQ ID NO: 2308426 - DNA, 16 bp, Homo sapiens
ggagcacccccagcct

SEQ ID NO: 2308427 - DNA, 19 bp, Homo sapiens
ggagcacccccagcctccc

SEQ ID NO: 2308428 - DNA, 18 bp, Homo sapiens
ggagcactagaatgagaa

SEQ ID NO: 2308429 - DNA, 22 bp, Homo sapiens
ggagcactagaatgagaaatca

SEQ ID NO: 2308430 - DNA, 17 bp, Homo sapiens
ggagcagagacggcagc

SEQ ID NO: 2308431 - DNA, 16 bp, Homo sapiens
ggagcagcgtgcagga

SEQ ID NO: 2308432 - DNA, 19 bp, Homo sapiens
ggagcagtttggggcaggg

SEQ ID NO: 2308433 - DNA, 20 bp, Homo sapiens
ggagcagtttggggcagggg

SEQ ID NO: 2308434 - DNA, 21 bp, Homo sapiens
ggagcccgaagtctgctgctg

SEQ ID NO: 2308435 - DNA, 23 bp, Homo sapiens
ggagcctgcgtggcctggggctg

SEQ ID NO: 2308436 - DNA, 14 bp, Homo sapiens
ggagcggctgagga

SEQ ID NO: 2308437 - DNA, 15 bp, Homo sapiens
ggagcggctgaggac

SEQ ID NO: 2308438 - DNA, 20 bp, Homo sapiens
ggagcgggggctaactggcc

SEQ ID NO: 2308439 - DNA, 22 bp, Homo sapiens
ggagcgggggctaactggcccc

SEQ ID NO: 2308440 - DNA, 16 bp, Homo sapiens
ggaggactgttctaac

SEQ ID NO: 2308441 - DNA, 20 bp, Homo sapiens
ggaggagcacccccagcctc

SEQ ID NO: 2308442 - DNA, 21 bp, Homo sapiens
ggaggagggtttgggcagagc

SEQ ID NO: 2308443 - DNA, 18 bp, Homo sapiens
ggaggagttgtctgtcct

SEQ ID NO: 2308444 - DNA, 20 bp, Homo sapiens
ggaggatggacgagtgagct

SEQ ID NO: 2308445 - DNA, 12 bp, Homo sapiens
ggaggccatgcc

SEQ ID NO: 2308446 - DNA, 13 bp, Homo sapiens
ggaggccatgccc

SEQ ID NO: 2308447 - DNA, 15 bp, Homo sapiens
ggaggcgcccacctg

SEQ ID NO: 2308448 - DNA, 16 bp, Homo sapiens
ggaggcgcccacctgc

SEQ ID NO: 2308449 - DNA, 17 bp, Homo sapiens
ggaggcgcccacctgcc

SEQ ID NO: 2308450 - DNA, 18 bp, Homo sapiens
ggaggcgcccacctgccc

SEQ ID NO: 2308451 - DNA, 19 bp, Homo sapiens
ggaggcgcccacctgccca

SEQ ID NO: 2308452 - DNA, 20 bp, Homo sapiens
ggaggcgcccacctgcccag

SEQ ID NO: 2308453 - DNA, 18 bp, Homo sapiens
ggagggaaagggagaggg

SEQ ID NO: 2308454 - DNA, 18 bp, Homo sapiens
ggagggaaggagcagtca

SEQ ID NO: 2308455 - DNA, 18 bp, Homo sapiens
ggagggatagagacgcag

SEQ ID NO: 2308456 - DNA, 13 bp, Homo sapiens
ggagggcatgtgc

SEQ ID NO: 2308457 - DNA, 15 bp, Homo sapiens
ggaggggagcaaggc

SEQ ID NO: 2308458 - DNA, 20 bp, Homo sapiens
ggaggggcccatgtgggctg

SEQ ID NO: 2308459 - DNA, 12 bp, Homo sapiens
ggagggggcagg

SEQ ID NO: 2308460 - DNA, 14 bp, Homo sapiens
ggagggggcagggg

SEQ ID NO: 2308461 - DNA, 20 bp, Homo sapiens
ggagggggtcagttgggccc

SEQ ID NO: 2308462 - DNA, 13 bp, Homo sapiens
ggagtcagggagc

SEQ ID NO: 2308463 - DNA, 19 bp, Homo sapiens
ggagtcagggagccctggg

SEQ ID NO: 2308464 - DNA, 14 bp, Homo sapiens
ggagtccagacctg

SEQ ID NO: 2308465 - DNA, 21 bp, Homo sapiens
ggagtccagacctgggccctg

SEQ ID NO: 2308466 - DNA, 14 bp, Homo sapiens
ggagtgatgggcaa

SEQ ID NO: 2308467 - DNA, 17 bp, Homo sapiens
ggagtggcatggtcctg

SEQ ID NO: 2308468 - DNA, 20 bp, Homo sapiens
ggagtggcatggtcctgtgc

SEQ ID NO: 2308469 - DNA, 15 bp, Homo sapiens
ggatatgaaagagaa

SEQ ID NO: 2308470 - DNA, 13 bp, Homo sapiens
ggatattagatgc

SEQ ID NO: 2308471 - DNA, 15 bp, Homo sapiens
ggatcctgagccaga

SEQ ID NO: 2308472 - DNA, 20 bp, Homo sapiens
ggatcctgagccagatttca

SEQ ID NO: 2308473 - DNA, 19 bp, Homo sapiens
ggatgaactcaatgcatga

SEQ ID NO: 2308474 - DNA, 21 bp, Homo sapiens
ggatggcgtgtcccctgcctg

SEQ ID NO: 2308475 - DNA, 14 bp, Homo sapiens
ggatgggcacaggc

SEQ ID NO: 2308476 - DNA, 17 bp, Homo sapiens
ggatgggcacaggctgc

SEQ ID NO: 2308477 - DNA, 23 bp, Homo sapiens
ggattggaccatgaatgatatgc

SEQ ID NO: 2308478 - DNA, 21 bp, Homo sapiens
ggcaaaagtcattgctgacag

SEQ ID NO: 2308479 - DNA, 20 bp, Homo sapiens
ggcaacaaaggatggctctg

SEQ ID NO: 2308480 - DNA, 17 bp, Homo sapiens
ggcaacattacaaacaa

SEQ ID NO: 2308481 - DNA, 19 bp, Homo sapiens
ggcaacattacaaacaaag

SEQ ID NO: 2308482 - DNA, 14 bp, Homo sapiens
ggcaacccctgcag

SEQ ID NO: 2308483 - DNA, 22 bp, Homo sapiens
ggcaagctggagttaataatct

SEQ ID NO: 2308484 - DNA, 14 bp, Homo sapiens
ggcaaggggccagg

SEQ ID NO: 2308485 - DNA, 18 bp, Homo sapiens
ggcaaggggccaggaagg

SEQ ID NO: 2308486 - DNA, 20 bp, Homo sapiens
ggcaatagtgttgaggaggg

SEQ ID NO: 2308487 - DNA, 14 bp, Homo sapiens
ggcaccgcccaccc

SEQ ID NO: 2308488 - DNA, 13 bp, Homo sapiens
ggcacgggagagc

SEQ ID NO: 2308489 - DNA, 18 bp, Homo sapiens
ggcacgggagagcgccac

SEQ ID NO: 2308490 - DNA, 22 bp, Homo sapiens
ggcacgggagagcgccacccgc

SEQ ID NO: 2308491 - DNA, 23 bp, Homo sapiens
ggcacgggagagcgccacccgcc

SEQ ID NO: 2308492 - DNA, 14 bp, Homo sapiens
ggcactaaccccat

SEQ ID NO: 2308493 - DNA, 19 bp, Homo sapiens
ggcagagctcagcacagcc

SEQ ID NO: 2308494 - DNA, 21 bp, Homo sapiens
ggcagagctgagtcggctggg

SEQ ID NO: 2308495 - DNA, 23 bp, Homo sapiens
ggcagagctgagtcggctgggca

SEQ ID NO: 2308496 - DNA, 12 bp, Homo sapiens
ggcagaggcagg

SEQ ID NO: 2308497 - DNA, 17 bp, Homo sapiens
ggcagaggcagggccct

SEQ ID NO: 2308498 - DNA, 18 bp, Homo sapiens
ggcagcatggagagaggc

SEQ ID NO: 2308499 - DNA, 19 bp, Homo sapiens
ggcagccccatccttcccg

SEQ ID NO: 2308500 - DNA, 22 bp, Homo sapiens
ggcagccccatccttcccgcag

SEQ ID NO: 2308501 - DNA, 13 bp, Homo sapiens
ggcagccccccag

SEQ ID NO: 2308502 - DNA, 18 bp, Homo sapiens
ggcagccccccagtgtcc

SEQ ID NO: 2308503 - DNA, 23 bp, Homo sapiens
ggcagccccccagtgtccccagg

SEQ ID NO: 2308504 - DNA, 14 bp, Homo sapiens
ggcagcccctgctg

SEQ ID NO: 2308505 - DNA, 15 bp, Homo sapiens
ggcagcccctgctgg

SEQ ID NO: 2308506 - DNA, 20 bp, Homo sapiens
ggcagcgcctcccgccgcct

SEQ ID NO: 2308507 - DNA, 21 bp, Homo sapiens
ggcagcgcctcccgccgcctc

SEQ ID NO: 2308508 - DNA, 22 bp, Homo sapiens
ggcagcgcctcccgccgcctcg

SEQ ID NO: 2308509 - DNA, 20 bp, Homo sapiens
ggcagcggccccgcacccct

SEQ ID NO: 2308510 - DNA, 21 bp, Homo sapiens
ggcagcggccccgcacccctc

SEQ ID NO: 2308511 - DNA, 17 bp, Homo sapiens
ggcaggagctcacaccg

SEQ ID NO: 2308512 - DNA, 23 bp, Homo sapiens
ggcaggaggccattccaggagtg

SEQ ID NO: 2308513 - DNA, 20 bp, Homo sapiens
ggcaggagggcatgtgcaga

SEQ ID NO: 2308514 - DNA, 17 bp, Homo sapiens
ggcagggccgcagggcg

SEQ ID NO: 2308515 - DNA, 19 bp, Homo sapiens
ggcagggggttctgggacc

SEQ ID NO: 2308516 - DNA, 13 bp, Homo sapiens
ggcaggtggccag

SEQ ID NO: 2308517 - DNA, 14 bp, Homo sapiens
ggcaggtggccagg

SEQ ID NO: 2308518 - DNA, 14 bp, Homo sapiens
ggcaggtgggcaga

SEQ ID NO: 2308519 - DNA, 14 bp, Homo sapiens
ggcagttgcttgtg

SEQ ID NO: 2308520 - DNA, 17 bp, Homo sapiens
ggcatcatttcccctcc

SEQ ID NO: 2308521 - DNA, 21 bp, Homo sapiens
ggcatccccagccccctggcc

SEQ ID NO: 2308522 - DNA, 13 bp, Homo sapiens
ggcatgagctctt

SEQ ID NO: 2308523 - DNA, 22 bp, Homo sapiens
ggcatgggaatgaatgtcagtg

SEQ ID NO: 2308524 - DNA, 17 bp, Homo sapiens
ggcatggtcctgtgccc

SEQ ID NO: 2308525 - DNA, 23 bp, Homo sapiens
ggcatgtgatgagaggaaatcac

SEQ ID NO: 2308526 - DNA, 21 bp, Homo sapiens
ggcattttggctcagagtcca

SEQ ID NO: 2308527 - DNA, 14 bp, Homo sapiens
ggcatttttcttgg

SEQ ID NO: 2308528 - DNA, 16 bp, Homo sapiens
ggccactcctgggccc

SEQ ID NO: 2308529 - DNA, 14 bp, Homo sapiens
ggccagagctccca

SEQ ID NO: 2308530 - DNA, 19 bp, Homo sapiens
ggccagcatccatgcggcc

SEQ ID NO: 2308531 - DNA, 23 bp, Homo sapiens
ggccagcccctccccgcctcctc

SEQ ID NO: 2308532 - DNA, 19 bp, Homo sapiens
ggccaggaaggggacagga

SEQ ID NO: 2308533 - DNA, 13 bp, Homo sapiens
ggccaggctgagc

SEQ ID NO: 2308534 - DNA, 14 bp, Homo sapiens
ggccaggctgagcc

SEQ ID NO: 2308535 - DNA, 12 bp, Homo sapiens
ggccagggctct

SEQ ID NO: 2308536 - DNA, 13 bp, Homo sapiens
ggccagggctctg

SEQ ID NO: 2308537 - DNA, 14 bp, Homo sapiens
ggccagtactttgc

SEQ ID NO: 2308538 - DNA, 12 bp, Homo sapiens
ggccagtggacc

SEQ ID NO: 2308539 - DNA, 15 bp, Homo sapiens
ggccatccccgtgtt

SEQ ID NO: 2308540 - DNA, 16 bp, Homo sapiens
ggccatgcccaccgcc

SEQ ID NO: 2308541 - DNA, 18 bp, Homo sapiens
ggccatggaagctggcag

SEQ ID NO: 2308542 - DNA, 16 bp, Homo sapiens
ggcccaacctcgccct

SEQ ID NO: 2308543 - DNA, 18 bp, Homo sapiens
ggcccaacctcgccctct

SEQ ID NO: 2308544 - DNA, 22 bp, Homo sapiens
ggcccacgcagagccccggagc

SEQ ID NO: 2308545 - DNA, 14 bp, Homo sapiens
ggcccatggcccca

SEQ ID NO: 2308546 - DNA, 16 bp, Homo sapiens
ggcccatggccccagc

SEQ ID NO: 2308547 - DNA, 13 bp, Homo sapiens
gtatttcttattt

SEQ ID NO: 2308548 - DNA, 15 bp, Homo sapiens
gtattttcgtgcatt

SEQ ID NO: 2308549 - DNA, 20 bp, Homo sapiens
gtattttcttcccatttgta

SEQ ID NO: 2308550 - DNA, 13 bp, Homo sapiens
gtatttttagaga

SEQ ID NO: 2308551 - DNA, 22 bp, Homo sapiens
gtatttttagagattaatttgt

SEQ ID NO: 2308552 - DNA, 16 bp, Homo sapiens
gtattttttatttaat

SEQ ID NO: 2308553 - DNA, 18 bp, Homo sapiens
gtcaaagtggtgagaggc

SEQ ID NO: 2308554 - DNA, 23 bp, Homo sapiens
gtcaactgctgttttatgtcata

SEQ ID NO: 2308555 - DNA, 22 bp, Homo sapiens
gtcaatgaaatatttgcttatt

SEQ ID NO: 2308556 - DNA, 21 bp, Homo sapiens
gtcaatgaggttatgagaaaa

SEQ ID NO: 2308557 - DNA, 13 bp, Homo sapiens
gtcaatgtgaaat

SEQ ID NO: 2308558 - DNA, 19 bp, Homo sapiens
gtcaatgtgaaataaagag

SEQ ID NO: 2308559 - DNA, 16 bp, Homo sapiens
gtcaattacaggaagt

SEQ ID NO: 2308560 - DNA, 19 bp, Homo sapiens
gtcaattcattaataaaat

SEQ ID NO: 2308561 - DNA, 19 bp, Homo sapiens
gtcacagacccctggggga

SEQ ID NO: 2308562 - DNA, 13 bp, Homo sapiens
gtcacatgtgctc

SEQ ID NO: 2308563 - DNA, 21 bp, Homo sapiens
gtcacctcactcagcaccact

SEQ ID NO: 2308564 - DNA, 19 bp, Homo sapiens
gtcactcacaaaaggctgg

SEQ ID NO: 2308565 - DNA, 21 bp, Homo sapiens
gtcactttgcttaagatgcta

SEQ ID NO: 2308566 - DNA, 23 bp, Homo sapiens
gtcagaaaattggcagtggcaga

SEQ ID NO: 2308567 - DNA, 20 bp, Homo sapiens
gtcagcacgtagtttgcatt

SEQ ID NO: 2308568 - DNA, 18 bp, Homo sapiens
gtcagcgattcctgccaa

SEQ ID NO: 2308569 - DNA, 14 bp, Homo sapiens
gtcagcttgaatgt

SEQ ID NO: 2308570 - DNA, 13 bp, Homo sapiens
gtcaggaggtgcc

SEQ ID NO: 2308571 - DNA, 13 bp, Homo sapiens
gtcagggagccct

SEQ ID NO: 2308572 - DNA, 16 bp, Homo sapiens
gtcagggagccctggg

SEQ ID NO: 2308573 - DNA, 13 bp, Homo sapiens
gtcagtctgtcca

SEQ ID NO: 2308574 - DNA, 18 bp, Homo sapiens
gtcagttgggcccccatc

SEQ ID NO: 2308575 - DNA, 15 bp, Homo sapiens
gtcagttttcacaga

SEQ ID NO: 2308576 - DNA, 18 bp, Homo sapiens
gtcagttttcacagaggc

SEQ ID NO: 2308577 - DNA, 16 bp, Homo sapiens
gtcataaaatgctatt

SEQ ID NO: 2308578 - DNA, 12 bp, Homo sapiens
gtcatcttccct

SEQ ID NO: 2308579 - DNA, 16 bp, Homo sapiens
gtcatgggagaagagg

SEQ ID NO: 2308580 - DNA, 17 bp, Homo sapiens
gtcatgggagaagaggg

SEQ ID NO: 2308581 - DNA, 18 bp, Homo sapiens
gtcattctgctaatttat

SEQ ID NO: 2308582 - DNA, 15 bp, Homo sapiens
gtcatttgtagatat

SEQ ID NO: 2308583 - DNA, 16 bp, Homo sapiens
gtcatttgtagatata

SEQ ID NO: 2308584 - DNA, 20 bp, Homo sapiens
gtccaacaactccaggaaaa

SEQ ID NO: 2308585 - DNA, 21 bp, Homo sapiens
gtccaatgaagataaatgctt

SEQ ID NO: 2308586 - DNA, 19 bp, Homo sapiens
gtccaccccgtcccggccc

SEQ ID NO: 2308587 - DNA, 11 bp, Homo sapiens
gtccacccgcc

SEQ ID NO: 2308588 - DNA, 18 bp, Homo sapiens
gtccacccgcccctgccc

SEQ ID NO: 2308589 - DNA, 16 bp, Homo sapiens
gtccacgtggagagaa

SEQ ID NO: 2308590 - DNA, 12 bp, Homo sapiens
gtccagacctgg

SEQ ID NO: 2308591 - DNA, 16 bp, Homo sapiens
gtccagacctgggccc

SEQ ID NO: 2308592 - DNA, 17 bp, Homo sapiens
gtccagacctgggccct

SEQ ID NO: 2308593 - DNA, 13 bp, Homo sapiens
gtccagctctccc

SEQ ID NO: 2308594 - DNA, 15 bp, Homo sapiens
gtccagctctcccct

SEQ ID NO: 2308595 - DNA, 13 bp, Homo sapiens
gtccagtccagtg

SEQ ID NO: 2308596 - DNA, 17 bp, Homo sapiens
gtcccacaaaatatttc

SEQ ID NO: 2308597 - DNA, 19 bp, Homo sapiens
gtcccacaaaatatttcta

SEQ ID NO: 2308598 - DNA, 21 bp, Homo sapiens
gtcccacagccccttgcttct

SEQ ID NO: 2308599 - DNA, 14 bp, Homo sapiens
gtcccactgagtct

SEQ ID NO: 2308600 - DNA, 15 bp, Homo sapiens
gtcccatgggctctg

SEQ ID NO: 2308601 - DNA, 18 bp, Homo sapiens
gtcccatgggctctggcc

SEQ ID NO: 2308602 - DNA, 12 bp, Homo sapiens
gtccccagggtg

SEQ ID NO: 2308603 - DNA, 17 bp, Homo sapiens
gtccccattctataaat

SEQ ID NO: 2308604 - DNA, 20 bp, Homo sapiens
gtccccgagccgagctctcc

SEQ ID NO: 2308605 - DNA, 21 bp, Homo sapiens
gtccctcctcccccacgcctc

SEQ ID NO: 2308606 - DNA, 16 bp, Homo sapiens
gtccctgacttcccag

SEQ ID NO: 2308607 - DNA, 17 bp, Homo sapiens
gtccctgacttcccagc

SEQ ID NO: 2308608 - DNA, 18 bp, Homo sapiens
gtccctgagaagcctcat

SEQ ID NO: 2308609 - DNA, 18 bp, Homo sapiens
gtcccttacgtgagtcct

SEQ ID NO: 2308610 - DNA, 14 bp, Homo sapiens
gtccctttcacact

SEQ ID NO: 2308611 - DNA, 13 bp, Homo sapiens
gtcccttttcctt

SEQ ID NO: 2308612 - DNA, 22 bp, Homo sapiens
gtccgaggcctggctctggagc

SEQ ID NO: 2308613 - DNA, 18 bp, Homo sapiens
gtccgatggcccgagagc

SEQ ID NO: 2308614 - DNA, 16 bp, Homo sapiens
gtccgcccgcccaccc

SEQ ID NO: 2308615 - DNA, 23 bp, Homo sapiens
gtcctcatctataaaatgaggga

SEQ ID NO: 2308616 - DNA, 13 bp, Homo sapiens
gtcctgcagtcct

SEQ ID NO: 2308617 - DNA, 22 bp, Homo sapiens
gtcctgccgacggagccactgg

SEQ ID NO: 2308618 - DNA, 14 bp, Homo sapiens
gtcctgctgctcgg

SEQ ID NO: 2308619 - DNA, 20 bp, Homo sapiens
gtcctgctgctcgggaaggc

SEQ ID NO: 2308620 - DNA, 18 bp, Homo sapiens
gtcctggaagtgtgtgtt

SEQ ID NO: 2308621 - DNA, 14 bp, Homo sapiens
gtcctggcagggca

SEQ ID NO: 2308622 - DNA, 23 bp, Homo sapiens
gtcctggcagggcaggcagagct

SEQ ID NO: 2308623 - DNA, 16 bp, Homo sapiens
gtcctggcatgggaat

SEQ ID NO: 2308624 - DNA, 23 bp, Homo sapiens
gtcctgtggggagcccatcctct

SEQ ID NO: 2308625 - DNA, 11 bp, Homo sapiens
gtcggctgggc

SEQ ID NO: 2308626 - DNA, 13 bp, Homo sapiens
gtcggctgggcag

SEQ ID NO: 2308627 - DNA, 16 bp, Homo sapiens
gtcgggcatgacacga

SEQ ID NO: 2308628 - DNA, 12 bp, Homo sapiens
gtcgggggagga

SEQ ID NO: 2308629 - DNA, 17 bp, Homo sapiens
gtcgggggaggagcacc

SEQ ID NO: 2308630 - DNA, 22 bp, Homo sapiens
gtctacactgcaatcatatgtg

SEQ ID NO: 2308631 - DNA, 12 bp, Homo sapiens
gtctatgaacta

SEQ ID NO: 2308632 - DNA, 23 bp, Homo sapiens
gtctatgaactagagactctgtg

SEQ ID NO: 2308633 - DNA, 18 bp, Homo sapiens
gtctcactagtttttcct

SEQ ID NO: 2308634 - DNA, 23 bp, Homo sapiens
gtctcactagtttttcctgtgca

SEQ ID NO: 2308635 - DNA, 20 bp, Homo sapiens
gtctcactctgttgaccagg

SEQ ID NO: 2308636 - DNA, 21 bp, Homo sapiens
gtctcactgtgttgcccaggc

SEQ ID NO: 2308637 - DNA, 13 bp, Homo sapiens
gtctcagaaggct

SEQ ID NO: 2308638 - DNA, 20 bp, Homo sapiens
gtctcagcaaattcttgaat

SEQ ID NO: 2308639 - DNA, 23 bp, Homo sapiens
gtctcagcaaattcttgaataaa

SEQ ID NO: 2308640 - DNA, 17 bp, Homo sapiens
gtctcattcctctgtcc

SEQ ID NO: 2308641 - DNA, 18 bp, Homo sapiens
gtctcattcctctgtccc

SEQ ID NO: 2308642 - DNA, 18 bp, Homo sapiens
gtctcgtgttcgctggct

SEQ ID NO: 2308643 - DNA, 17 bp, Homo sapiens
gtctctgagcagtgggg

SEQ ID NO: 2308644 - DNA, 16 bp, Homo sapiens
gtctgcacagggtcct

SEQ ID NO: 2308645 - DNA, 16 bp, Homo sapiens
gtctgccccttgaccc

SEQ ID NO: 2308646 - DNA, 19 bp, Homo sapiens
gtctgccccttgaccccac

SEQ ID NO: 2308647 - DNA, 12 bp, Homo sapiens
gtctgctgcctc

SEQ ID NO: 2308648 - DNA, 14 bp, Homo sapiens
gtctgctgcctcca

SEQ ID NO: 2308649 - DNA, 16 bp, Homo sapiens
gtctgctgcctccaag

SEQ ID NO: 2308650 - DNA, 19 bp, Homo sapiens
gtctgcttaccaaaacata

SEQ ID NO: 2308651 - DNA, 17 bp, Homo sapiens
gtctggagaccaggact

SEQ ID NO: 2308652 - DNA, 11 bp, Homo sapiens
gtctgtacttc

SEQ ID NO: 2308653 - DNA, 16 bp, Homo sapiens
gtctgtaggtgaaaga

SEQ ID NO: 2308654 - DNA, 20 bp, Homo sapiens
gtctgtaggtgaaagaacaa

SEQ ID NO: 2308655 - DNA, 16 bp, Homo sapiens
gtctgtagttgctttg

SEQ ID NO: 2308656 - DNA, 17 bp, Homo sapiens
gtctgtccacgtggaga

SEQ ID NO: 2308657 - DNA, 19 bp, Homo sapiens
gtctgtccacgtggagaga

SEQ ID NO: 2308658 - DNA, 13 bp, Homo sapiens
gtctgtcctggtc

SEQ ID NO: 2308659 - DNA, 20 bp, Homo sapiens
gtctgtgcccgaggttcctg

SEQ ID NO: 2308660 - DNA, 22 bp, Homo sapiens
gtctgtgcccgaggttcctgtc

SEQ ID NO: 2308661 - DNA, 17 bp, Homo sapiens
gtcttcaaccctgccct

SEQ ID NO: 2308662 - DNA, 22 bp, Homo sapiens
gtcttcaaccctgccctgcacc

SEQ ID NO: 2308663 - DNA, 23 bp, Homo sapiens
gtcttctttaaggaagaataaaa

SEQ ID NO: 2308664 - DNA, 16 bp, Homo sapiens
gtcttgaactcttggc

SEQ ID NO: 2308665 - DNA, 16 bp, Homo sapiens
gtcttgtaatattttg

SEQ ID NO: 2308666 - DNA, 20 bp, Homo sapiens
gtcttgtaatattttgtatt

SEQ ID NO: 2308667 - DNA, 14 bp, Homo sapiens
gtcttgtattttct

SEQ ID NO: 2308668 - DNA, 22 bp, Homo sapiens
gtctttggggtctacactgcaa

SEQ ID NO: 2308669 - DNA, 23 bp, Homo sapiens
gtgaaaatgtatggatgaattct

SEQ ID NO: 2308670 - DNA, 22 bp, Homo sapiens
gtgaaatttacagttactgcct

SEQ ID NO: 2308671 - DNA, 21 bp, Homo sapiens
gtgaagaatttatctgtgaat

SEQ ID NO: 2308672 - DNA, 16 bp, Homo sapiens
gtgaagatgtgtaaat

SEQ ID NO: 2308673 - DNA, 16 bp, Homo sapiens
gtgaagccagggcccg

SEQ ID NO: 2308674 - DNA, 16 bp, Homo sapiens
gtgaataacagactat

SEQ ID NO: 2308675 - DNA, 18 bp, Homo sapiens
gtgacatcggttcaggag

SEQ ID NO: 2308676 - DNA, 14 bp, Homo sapiens
gtgaccggcccgcc

SEQ ID NO: 2308677 - DNA, 19 bp, Homo sapiens
gtgaccggcccgccacctt

SEQ ID NO: 2308678 - DNA, 22 bp, Homo sapiens
gtgacctctctaggtgtgtcca

SEQ ID NO: 2308679 - DNA, 19 bp, Homo sapiens
taatgtaatcatttatctt

SEQ ID NO: 2308680 - DNA, 21 bp, Homo sapiens
taatgtgtcaaagagatgagg

SEQ ID NO: 2308681 - DNA, 13 bp, Homo sapiens
taattacttaatg

SEQ ID NO: 2308682 - DNA, 13 bp, Homo sapiens
taattcatttaag

SEQ ID NO: 2308683 - DNA, 19 bp, Homo sapiens
taattctcattatgaagat

SEQ ID NO: 2308684 - DNA, 21 bp, Homo sapiens
taattgtaggtcaatgaaata

SEQ ID NO: 2308685 - DNA, 20 bp, Homo sapiens
taattgtgtaactgttcttt

SEQ ID NO: 2308686 - DNA, 20 bp, Homo sapiens
taatttccatgatacaaaga

SEQ ID NO: 2308687 - DNA, 20 bp, Homo sapiens
taatttgccagacagagatc

SEQ ID NO: 2308688 - DNA, 14 bp, Homo sapiens
taattttacaaagt

SEQ ID NO: 2308689 - DNA, 20 bp, Homo sapiens
tacaaacaaaggatttgaaa

SEQ ID NO: 2308690 - DNA, 20 bp, Homo sapiens
tacaaatttttactcaggct

SEQ ID NO: 2308691 - DNA, 19 bp, Homo sapiens
tacaagaaaaagtagaaaa

SEQ ID NO: 2308692 - DNA, 15 bp, Homo sapiens
tacaagctatttttg

SEQ ID NO: 2308693 - DNA, 13 bp, Homo sapiens
tacacaaagggga

SEQ ID NO: 2308694 - DNA, 14 bp, Homo sapiens
tacacaaaggggat

SEQ ID NO: 2308695 - DNA, 23 bp, Homo sapiens
tacacaatggttttcttgtgtgt

SEQ ID NO: 2308696 - DNA, 20 bp, Homo sapiens
tacacctttatctcaagata

SEQ ID NO: 2308697 - DNA, 18 bp, Homo sapiens
tacacggggttacactgt

SEQ ID NO: 2308698 - DNA, 14 bp, Homo sapiens
tacactgaaatcca

SEQ ID NO: 2308699 - DNA, 16 bp, Homo sapiens
tacagaaaatagcttt

SEQ ID NO: 2308700 - DNA, 13 bp, Homo sapiens
tacagacaaagcg

SEQ ID NO: 2308701 - DNA, 14 bp, Homo sapiens
tacagacaaagcgt

SEQ ID NO: 2308702 - DNA, 16 bp, Homo sapiens
tacagatttagtttac

SEQ ID NO: 2308703 - DNA, 17 bp, Homo sapiens
tacagcaaataaaacag

SEQ ID NO: 2308704 - DNA, 21 bp, Homo sapiens
tacagcatagggtccactttg

SEQ ID NO: 2308705 - DNA, 13 bp, Homo sapiens
tacaggaagtact

SEQ ID NO: 2308706 - DNA, 15 bp, Homo sapiens
tacaggaagtactgg

SEQ ID NO: 2308707 - DNA, 22 bp, Homo sapiens
tacaggaagtactggagaaaat

SEQ ID NO: 2308708 - DNA, 12 bp, Homo sapiens
tacaggtgtgag

SEQ ID NO: 2308709 - DNA, 20 bp, Homo sapiens
tacagtagctgtggggagct

SEQ ID NO: 2308710 - DNA, 23 bp, Homo sapiens
tacagtagctgtggggagctggt

SEQ ID NO: 2308711 - DNA, 17 bp, Homo sapiens
tacagtattttttattt

SEQ ID NO: 2308712 - DNA, 18 bp, Homo sapiens
tacagtcatttcctaccc

SEQ ID NO: 2308713 - DNA, 15 bp, Homo sapiens
tacagtgatcagttg

SEQ ID NO: 2308714 - DNA, 20 bp, Homo sapiens
tacataaaagaatgtacaga

SEQ ID NO: 2308715 - DNA, 14 bp, Homo sapiens
tacatacctctctc

SEQ ID NO: 2308716 - DNA, 19 bp, Homo sapiens
tacatacctctctctatat

SEQ ID NO: 2308717 - DNA, 22 bp, Homo sapiens
tacatatggaaatcctgttact

SEQ ID NO: 2308718 - DNA, 16 bp, Homo sapiens
tacatctgaaatctac

SEQ ID NO: 2308719 - DNA, 22 bp, Homo sapiens
tacatgacccggatgaactcaa

SEQ ID NO: 2308720 - DNA, 15 bp, Homo sapiens
tacatgcagaaattg

SEQ ID NO: 2308721 - DNA, 20 bp, Homo sapiens
tacatgtaaaaatgtttcct

SEQ ID NO: 2308722 - DNA, 15 bp, Homo sapiens
tacatgtccccctgt

SEQ ID NO: 2308723 - DNA, 13 bp, Homo sapiens
tacattaaaagct

SEQ ID NO: 2308724 - DNA, 17 bp, Homo sapiens
tacattaaaagctttag

SEQ ID NO: 2308725 - DNA, 15 bp, Homo sapiens
tacattaaaatggac

SEQ ID NO: 2308726 - DNA, 18 bp, Homo sapiens
tacattgtgttttcctaa

SEQ ID NO: 2308727 - DNA, 13 bp, Homo sapiens
tacatttcattta

SEQ ID NO: 2308728 - DNA, 17 bp, Homo sapiens
tacatttcatttatact

SEQ ID NO: 2308729 - DNA, 20 bp, Homo sapiens
tacatttcatttatactgta

SEQ ID NO: 2308730 - DNA, 14 bp, Homo sapiens
tacattttctttca

SEQ ID NO: 2308731 - DNA, 16 bp, Homo sapiens
tacattttctttcata

SEQ ID NO: 2308732 - DNA, 16 bp, Homo sapiens
taccaaatataaactt

SEQ ID NO: 2308733 - DNA, 18 bp, Homo sapiens
taccaaatataaacttgt

SEQ ID NO: 2308734 - DNA, 18 bp, Homo sapiens
taccaagatcacaaatag

SEQ ID NO: 2308735 - DNA, 22 bp, Homo sapiens
taccaatcaacagcatgtctac

SEQ ID NO: 2308736 - DNA, 13 bp, Homo sapiens
taccagcccaggc

SEQ ID NO: 2308737 - DNA, 16 bp, Homo sapiens
taccagtatctccatc

SEQ ID NO: 2308738 - DNA, 15 bp, Homo sapiens
taccatatgtagcat

SEQ ID NO: 2308739 - DNA, 14 bp, Homo sapiens
taccatcccactga

SEQ ID NO: 2308740 - DNA, 18 bp, Homo sapiens
taccatgagaaatcatgc

SEQ ID NO: 2308741 - DNA, 14 bp, Homo sapiens
taccatgcatttct

SEQ ID NO: 2308742 - DNA, 15 bp, Homo sapiens
taccatgttaaagag

SEQ ID NO: 2308743 - DNA, 16 bp, Homo sapiens
taccatgttgcccaga

SEQ ID NO: 2308744 - DNA, 13 bp, Homo sapiens
tacccatttctta

SEQ ID NO: 2308745 - DNA, 15 bp, Homo sapiens
taccctgcacattgt

SEQ ID NO: 2308746 - DNA, 19 bp, Homo sapiens
taccgaggagctaaacatg

SEQ ID NO: 2308747 - DNA, 17 bp, Homo sapiens
tacctcatgccgctgtg

SEQ ID NO: 2308748 - DNA, 17 bp, Homo sapiens
tacctctggctgactaa

SEQ ID NO: 2308749 - DNA, 21 bp, Homo sapiens
tacctctggctgactaaattt

SEQ ID NO: 2308750 - DNA, 13 bp, Homo sapiens
tacctgaagtctt

SEQ ID NO: 2308751 - DNA, 21 bp, Homo sapiens
tacctttaaaaaataatttag

SEQ ID NO: 2308752 - DNA, 17 bp, Homo sapiens
tacgcaggcatctgatt

SEQ ID NO: 2308753 - DNA, 14 bp, Homo sapiens
tacgctctctgtct

SEQ ID NO: 2308754 - DNA, 14 bp, Homo sapiens
tactaaaaacactg

SEQ ID NO: 2308755 - DNA, 17 bp, Homo sapiens
tactaaaaatatgaaat

SEQ ID NO: 2308756 - DNA, 17 bp, Homo sapiens
tactaaccatttcttat

SEQ ID NO: 2308757 - DNA, 22 bp, Homo sapiens
tactaagaataaataaagaaga

SEQ ID NO: 2308758 - DNA, 22 bp, Homo sapiens
tactacagcataaatctgttag

SEQ ID NO: 2308759 - DNA, 18 bp, Homo sapiens
tactagtactgtgtactg

SEQ ID NO: 2308760 - DNA, 22 bp, Homo sapiens
tactatgtaagggctttaaata

SEQ ID NO: 2308761 - DNA, 17 bp, Homo sapiens
tactcaccaaaatatag

SEQ ID NO: 2308762 - DNA, 15 bp, Homo sapiens
tactcaggctttcta

SEQ ID NO: 2308763 - DNA, 22 bp, Homo sapiens
tactcgagttacagacaaagcg

SEQ ID NO: 2308764 - DNA, 15 bp, Homo sapiens
tactctgtgtaatct

SEQ ID NO: 2308765 - DNA, 19 bp, Homo sapiens
tactgaaaaagaatgaaaa

SEQ ID NO: 2308766 - DNA, 22 bp, Homo sapiens
tactgaattgttatgtaaacat

SEQ ID NO: 2308767 - DNA, 23 bp, Homo sapiens
tactgaattgttatgtaaacatc

SEQ ID NO: 2308768 - DNA, 17 bp, Homo sapiens
tactgccgctgccccca

SEQ ID NO: 2308769 - DNA, 21 bp, Homo sapiens
tactgcctaggagttaatgat

SEQ ID NO: 2308770 - DNA, 13 bp, Homo sapiens
tactgctatattt

SEQ ID NO: 2308771 - DNA, 16 bp, Homo sapiens
tactggagaaaatgga

SEQ ID NO: 2308772 - DNA, 11 bp, Homo sapiens
tactgtagcaa

SEQ ID NO: 2308773 - DNA, 13 bp, Homo sapiens
tactgtagcaata

SEQ ID NO: 2308774 - DNA, 13 bp, Homo sapiens
tactgtatatgtc

SEQ ID NO: 2308775 - DNA, 19 bp, Homo sapiens
tactgtatatgtcaaaaat

SEQ ID NO: 2308776 - DNA, 21 bp, Homo sapiens
tactgtatatgtcaaaaatat

SEQ ID NO: 2308777 - DNA, 15 bp, Homo sapiens
tactgtcagagaata

SEQ ID NO: 2308778 - DNA, 17 bp, Homo sapiens
tactgtctgtaagagaa

SEQ ID NO: 2308779 - DNA, 12 bp, Homo sapiens
tactgtttgtaa

SEQ ID NO: 2308780 - DNA, 20 bp, Homo sapiens
tacttaaatagcatctgctc

SEQ ID NO: 2308781 - DNA, 23 bp, Homo sapiens
tacttcactttcatctgagcttt

SEQ ID NO: 2308782 - DNA, 14 bp, Homo sapiens
tacttcctggattt

SEQ ID NO: 2308783 - DNA, 17 bp, Homo sapiens
tacttgatataattact

SEQ ID NO: 2308784 - DNA, 16 bp, Homo sapiens
tactttcacatctctg

SEQ ID NO: 2308785 - DNA, 22 bp, Homo sapiens
tactttcctgatgttgataata

SEQ ID NO: 2308786 - DNA, 21 bp, Homo sapiens
tactttgtggatatatttaaa

SEQ ID NO: 2308787 - DNA, 15 bp, Homo sapiens
tacttttccatttat

SEQ ID NO: 2308788 - DNA, 23 bp, Homo sapiens
tacttttccatttatttattcat

SEQ ID NO: 2308789 - DNA, 17 bp, Homo sapiens
tactttttcttttgtaa

SEQ ID NO: 2308790 - DNA, 15 bp, Homo sapiens
tagaaaaaaaaataa

SEQ ID NO: 2308791 - DNA, 20 bp, Homo sapiens
tagaaaataaaataaattat

SEQ ID NO: 2308792 - DNA, 22 bp, Homo sapiens
tagaaagttctgtgtaaacaga

SEQ ID NO: 2308793 - DNA, 16 bp, Homo sapiens
tagaacaagccagagc

SEQ ID NO: 2308794 - DNA, 18 bp, Homo sapiens
tagaacagggtttctcag

SEQ ID NO: 2308795 - DNA, 14 bp, Homo sapiens
tagaaccaagcact

SEQ ID NO: 2308796 - DNA, 18 bp, Homo sapiens
tagaactgttcatttcca

SEQ ID NO: 2308797 - DNA, 20 bp, Homo sapiens
tagaagatgaatcagtatga

SEQ ID NO: 2308798 - DNA, 18 bp, Homo sapiens
tagaagtccatgagttga

SEQ ID NO: 2308799 - DNA, 11 bp, Homo sapiens
tagaatatata

SEQ ID NO: 2308800 - DNA, 22 bp, Homo sapiens
tagaatatcctatactggttat

SEQ ID NO: 2308801 - DNA, 17 bp, Homo sapiens
tagaatctattttctat

SEQ ID NO: 2308802 - DNA, 19 bp, Homo sapiens
tagaatctattttctatgt

SEQ ID NO: 2308803 - DNA, 16 bp, Homo sapiens
tagaatgagaaatcat

SEQ ID NO: 2308804 - DNA, 21 bp, Homo sapiens
tagaatgagggaaacaaaata

SEQ ID NO: 2308805 - DNA, 18 bp, Homo sapiens
tagacagtttgtaaatgt

SEQ ID NO: 2308806 - DNA, 20 bp, Homo sapiens
tagacagtttgtaaatgtta

SEQ ID NO: 2308807 - DNA, 21 bp, Homo sapiens
tagacagtttgtaaatgttat

SEQ ID NO: 2308808 - DNA, 22 bp, Homo sapiens
tagacagtttgtaaatgttatt

SEQ ID NO: 2308809 - DNA, 18 bp, Homo sapiens
tagacttcgaaaacagat

SEQ ID NO: 2308810 - DNA, 17 bp, Homo sapiens
tagagaataatttttgt

SEQ ID NO: 2308811 - DNA, 21 bp, Homo sapiens
tcagaaggctctatctgctgg

SEQ ID NO: 2308812 - DNA, 19 bp, Homo sapiens
tcagaatatggacaaagaa

SEQ ID NO: 2308813 - DNA, 14 bp, Homo sapiens
tcagaatattttca

SEQ ID NO: 2308814 - DNA, 15 bp, Homo sapiens
tcagaatattttcaa

SEQ ID NO: 2308815 - DNA, 16 bp, Homo sapiens
tcagaatattttcaaa

SEQ ID NO: 2308816 - DNA, 21 bp, Homo sapiens
tcagaattacaggaaatgcaa

SEQ ID NO: 2308817 - DNA, 15 bp, Homo sapiens
tcagacattcagaga

SEQ ID NO: 2308818 - DNA, 21 bp, Homo sapiens
tcagagcccatggcttccctg

SEQ ID NO: 2308819 - DNA, 23 bp, Homo sapiens
tcagagggtggagatgtcagtct

SEQ ID NO: 2308820 - DNA, 14 bp, Homo sapiens
tcagagtccaatgt

SEQ ID NO: 2308821 - DNA, 23 bp, Homo sapiens
tcagagtcctgccgacggagcca

SEQ ID NO: 2308822 - DNA, 20 bp, Homo sapiens
tcagatcctggtctgcacct

SEQ ID NO: 2308823 - DNA, 13 bp, Homo sapiens
tcagatcttacaa

SEQ ID NO: 2308824 - DNA, 19 bp, Homo sapiens
tcagattccccccatctcc

SEQ ID NO: 2308825 - DNA, 22 bp, Homo sapiens
tcagattccccccatctccatt

SEQ ID NO: 2308826 - DNA, 18 bp, Homo sapiens
tcagcacagataaaaagt

SEQ ID NO: 2308827 - DNA, 18 bp, Homo sapiens
tcagcacagcctcacccc

SEQ ID NO: 2308828 - DNA, 23 bp, Homo sapiens
tcagcaccgtggtgtgaggcccc

SEQ ID NO: 2308829 - DNA, 20 bp, Homo sapiens
tcagcacgtagtttgcattc

SEQ ID NO: 2308830 - DNA, 22 bp, Homo sapiens
tcagcacgtagtttgcattcca

SEQ ID NO: 2308831 - DNA, 20 bp, Homo sapiens
tcagcagaatgactctggaa

SEQ ID NO: 2308832 - DNA, 23 bp, Homo sapiens
tcagcatctaaagcagcaggtct

SEQ ID NO: 2308833 - DNA, 15 bp, Homo sapiens
tcagcattcaaaata

SEQ ID NO: 2308834 - DNA, 16 bp, Homo sapiens
tcagcattcaaaatag

SEQ ID NO: 2308835 - DNA, 23 bp, Homo sapiens
tcagcattcaaaatagttctatt

SEQ ID NO: 2308836 - DNA, 18 bp, Homo sapiens
tcagcccggtgtgaggag

SEQ ID NO: 2308837 - DNA, 14 bp, Homo sapiens
tcagcggagaggac

SEQ ID NO: 2308838 - DNA, 13 bp, Homo sapiens
tcagcttgctggg

SEQ ID NO: 2308839 - DNA, 16 bp, Homo sapiens
tcagcttgtttctata

SEQ ID NO: 2308840 - DNA, 14 bp, Homo sapiens
tcaggaccccatct

SEQ ID NO: 2308841 - DNA, 15 bp, Homo sapiens
tcaggaccccatctg

SEQ ID NO: 2308842 - DNA, 18 bp, Homo sapiens
tcaggaccccatctgctg

SEQ ID NO: 2308843 - DNA, 20 bp, Homo sapiens
tcaggaccccatctgctgag

SEQ ID NO: 2308844 - DNA, 19 bp, Homo sapiens
tcaggaggagacagtcagg

SEQ ID NO: 2308845 - DNA, 15 bp, Homo sapiens
tcaggaggtgcctga

SEQ ID NO: 2308846 - DNA, 15 bp, Homo sapiens
tcaggcaaggcagct

SEQ ID NO: 2308847 - DNA, 20 bp, Homo sapiens
tcaggcaaggcagctcccag

SEQ ID NO: 2308848 - DNA, 13 bp, Homo sapiens
tcaggcccacatt

SEQ ID NO: 2308849 - DNA, 17 bp, Homo sapiens
tcagggaccaccagagg

SEQ ID NO: 2308850 - DNA, 14 bp, Homo sapiens
tcagggagccctgg

SEQ ID NO: 2308851 - DNA, 17 bp, Homo sapiens
tcagtaatcacttttca

SEQ ID NO: 2308852 - DNA, 16 bp, Homo sapiens
tcagtatgaagacact

SEQ ID NO: 2308853 - DNA, 15 bp, Homo sapiens
tcagtcacatgtgct

SEQ ID NO: 2308854 - DNA, 16 bp, Homo sapiens
tcagtcccacagcccc

SEQ ID NO: 2308855 - DNA, 17 bp, Homo sapiens
tcagtcccacagcccct

SEQ ID NO: 2308856 - DNA, 17 bp, Homo sapiens
tcagtctcaaataataa

SEQ ID NO: 2308857 - DNA, 22 bp, Homo sapiens
tcagtgacctactacgcagagg

SEQ ID NO: 2308858 - DNA, 16 bp, Homo sapiens
tcagtgccaaaaacaa

SEQ ID NO: 2308859 - DNA, 14 bp, Homo sapiens
tcagtgccttatgg

SEQ ID NO: 2308860 - DNA, 13 bp, Homo sapiens
tcagtgtgactga

SEQ ID NO: 2308861 - DNA, 14 bp, Homo sapiens
tcagttctcatctt

SEQ ID NO: 2308862 - DNA, 13 bp, Homo sapiens
tcagttcttggcc

SEQ ID NO: 2308863 - DNA, 15 bp, Homo sapiens
tcagttcttggcctg

SEQ ID NO: 2308864 - DNA, 18 bp, Homo sapiens
tcagttcttggcctgcta

SEQ ID NO: 2308865 - DNA, 18 bp, Homo sapiens
tcagttgctctctgttca

SEQ ID NO: 2308866 - DNA, 12 bp, Homo sapiens
tcagttgtggcc

SEQ ID NO: 2308867 - DNA, 13 bp, Homo sapiens
tcagtttctctgg

SEQ ID NO: 2308868 - DNA, 16 bp, Homo sapiens
tcagtttgatcacact

SEQ ID NO: 2308869 - DNA, 12 bp, Homo sapiens
tcagttttcaca

SEQ ID NO: 2308870 - DNA, 14 bp, Homo sapiens
tcagttttcacaga

SEQ ID NO: 2308871 - DNA, 16 bp, Homo sapiens
tcagttttcacagagg

SEQ ID NO: 2308872 - DNA, 18 bp, Homo sapiens
tcagttttcacagaggcg

SEQ ID NO: 2308873 - DNA, 17 bp, Homo sapiens
tcataaaaataaccaaa

SEQ ID NO: 2308874 - DNA, 13 bp, Homo sapiens
tcataaaatgcta

SEQ ID NO: 2308875 - DNA, 19 bp, Homo sapiens
tcataaaatgctattttaa

SEQ ID NO: 2308876 - DNA, 20 bp, Homo sapiens
tcataaagttagaatctatt

SEQ ID NO: 2308877 - DNA, 17 bp, Homo sapiens
tcataatctctttccat

SEQ ID NO: 2308878 - DNA, 20 bp, Homo sapiens
tcataatctctttccatctt

SEQ ID NO: 2308879 - DNA, 23 bp, Homo sapiens
tcataatttccatgatacaaaga

SEQ ID NO: 2308880 - DNA, 13 bp, Homo sapiens
tcatactctgtgt

SEQ ID NO: 2308881 - DNA, 22 bp, Homo sapiens
tcatacttgctccttgaataag

SEQ ID NO: 2308882 - DNA, 14 bp, Homo sapiens
tcatactttccaac

SEQ ID NO: 2308883 - DNA, 24 bp, Homo sapiens
tcatcaatacttttgtgtattctg

SEQ ID NO: 2308884 - DNA, 16 bp, Homo sapiens
tcatctcaaacactgc

SEQ ID NO: 2308885 - DNA, 17 bp, Homo sapiens
tcatctcaaacactgct

SEQ ID NO: 2308886 - DNA, 17 bp, Homo sapiens
tcatctccatgctcttt

SEQ ID NO: 2308887 - DNA, 11 bp, Homo sapiens
tcatctgagct

SEQ ID NO: 2308888 - DNA, 20 bp, Homo sapiens
tcatctggagtccctcctcc

SEQ ID NO: 2308889 - DNA, 13 bp, Homo sapiens
tcatctgttgaca

SEQ ID NO: 2308890 - DNA, 13 bp, Homo sapiens
tcatcttaacttg

SEQ ID NO: 2308891 - DNA, 18 bp, Homo sapiens
tcatcttccctttcctcc

SEQ ID NO: 2308892 - DNA, 13 bp, Homo sapiens
tcatcttctccca

SEQ ID NO: 2308893 - DNA, 19 bp, Homo sapiens
tcatcttgaattgtaagga

SEQ ID NO: 2308894 - DNA, 22 bp, Homo sapiens
tcatcttgcaaatgttgtattt

SEQ ID NO: 2308895 - DNA, 13 bp, Homo sapiens
tcatcttgtaaat

SEQ ID NO: 2308896 - DNA, 22 bp, Homo sapiens
tcatgaaagcacctgccctctg

SEQ ID NO: 2308897 - DNA, 14 bp, Homo sapiens
tcatgcatagacaa

SEQ ID NO: 2308898 - DNA, 21 bp, Homo sapiens
tcatgccgctgtgtctatgaa

SEQ ID NO: 2308899 - DNA, 18 bp, Homo sapiens
tcatggaccactgtttct

SEQ ID NO: 2308900 - DNA, 22 bp, Homo sapiens
tcatggaccactgtttcttgct

SEQ ID NO: 2308901 - DNA, 14 bp, Homo sapiens
tcatggatcaacca

SEQ ID NO: 2308902 - DNA, 21 bp, Homo sapiens
tcatggatcaaccaagttaca

SEQ ID NO: 2308903 - DNA, 22 bp, Homo sapiens
tcatgtaatagtggctttcatt

SEQ ID NO: 2308904 - DNA, 14 bp, Homo sapiens
tcatgtctttccta

SEQ ID NO: 2308905 - DNA, 12 bp, Homo sapiens
tcatgtgtacag

SEQ ID NO: 2308906 - DNA, 14 bp, Homo sapiens
tcatgtttaagaaa

SEQ ID NO: 2308907 - DNA, 23 bp, Homo sapiens
tcatgtttaagaaatgagaaatt

SEQ ID NO: 2308908 - DNA, 22 bp, Homo sapiens
tcatgtttggtggggccatcca

SEQ ID NO: 2308909 - DNA, 14 bp, Homo sapiens
tcattatgaagatg

SEQ ID NO: 2308910 - DNA, 14 bp, Homo sapiens
tcattattttccca

SEQ ID NO: 2308911 - DNA, 19 bp, Homo sapiens
tcattcatggaccactgtt

SEQ ID NO: 2308912 - DNA, 17 bp, Homo sapiens
tcattccacacatttcc

SEQ ID NO: 2308913 - DNA, 12 bp, Homo sapiens
tcattcctctgt

SEQ ID NO: 2308914 - DNA, 20 bp, Homo sapiens
tcattctgctaatttatgaa

SEQ ID NO: 2308915 - DNA, 15 bp, Homo sapiens
tcattcttttcgcca

SEQ ID NO: 2308916 - DNA, 19 bp, Homo sapiens
tcattgtagagcacattta

SEQ ID NO: 2308917 - DNA, 11 bp, Homo sapiens
tcattgttaca

SEQ ID NO: 2308918 - DNA, 21 bp, Homo sapiens
tcatttaatttctaatttcaa

SEQ ID NO: 2308919 - DNA, 19 bp, Homo sapiens
tcatttacaacttccagat

SEQ ID NO: 2308920 - DNA, 18 bp, Homo sapiens
tcatttatactgtagcaa

SEQ ID NO: 2308921 - DNA, 19 bp, Homo sapiens
tcatttatactgtagcaat

SEQ ID NO: 2308922 - DNA, 12 bp, Homo sapiens
tcatttatctta

SEQ ID NO: 2308923 - DNA, 20 bp, Homo sapiens
tcatttcccctcccgcttcc

SEQ ID NO: 2308924 - DNA, 12 bp, Homo sapiens
tcatttgcatat

SEQ ID NO: 2308925 - DNA, 12 bp, Homo sapiens
tcatttgtagat

SEQ ID NO: 2308926 - DNA, 13 bp, Homo sapiens
tcatttgtagata

SEQ ID NO: 2308927 - DNA, 15 bp, Homo sapiens
tcatttgtagatata

SEQ ID NO: 2308928 - DNA, 12 bp, Homo sapiens
tccaaaactgta

SEQ ID NO: 2308929 - DNA, 14 bp, Homo sapiens
tccaaaataaatgg

SEQ ID NO: 2308930 - DNA, 21 bp, Homo sapiens
tccaaaatagtcatgtttctg

SEQ ID NO: 2308931 - DNA, 23 bp, Homo sapiens
tccaaaatagtcatgtttctgca

SEQ ID NO: 2308932 - DNA, 12 bp, Homo sapiens
tccaaaatcatt

SEQ ID NO: 2308933 - DNA, 16 bp, Homo sapiens
tccaaacccaagtctt

SEQ ID NO: 2308934 - DNA, 21 bp, Homo sapiens
tccaaacccaagtcttgagca

SEQ ID NO: 2308935 - DNA, 16 bp, Homo sapiens
tccaaagctgaagatc

SEQ ID NO: 2308936 - DNA, 19 bp, Homo sapiens
tccaagagaattcacttta

SEQ ID NO: 2308937 - DNA, 21 bp, Homo sapiens
tccaagtattttatctgtgtt

SEQ ID NO: 2308938 - DNA, 16 bp, Homo sapiens
tccaatgatataggaa

SEQ ID NO: 2308939 - DNA, 19 bp, Homo sapiens
tccaatgtaccatgttgcc

SEQ ID NO: 2308940 - DNA, 14 bp, Homo sapiens
tccacacaggccca

SEQ ID NO: 2308941 - DNA, 12 bp, Homo sapiens
tccacaccctct

SEQ ID NO: 2308942 - DNA, 20 bp, Homo sapiens
tccacaccctctccttgtca

SEQ ID NO: 2308943 - DNA, 19 bp, Homo sapiens
tccacattcatgtacaatg

SEQ ID NO: 2308944 - DNA, 16 bp, Homo sapiens
tctgctgcacagtagt

SEQ ID NO: 2308945 - DNA, 22 bp, Homo sapiens
tctgctgcctccaagtcatggg

SEQ ID NO: 2308946 - DNA, 11 bp, Homo sapiens
tctgctgcctg

SEQ ID NO: 2308947 - DNA, 13 bp, Homo sapiens
tctgctggtcact

SEQ ID NO: 2308948 - DNA, 14 bp, Homo sapiens
tctgcttaccaaaa

SEQ ID NO: 2308949 - DNA, 19 bp, Homo sapiens
tctgcttgtcattctgcta

SEQ ID NO: 2308950 - DNA, 15 bp, Homo sapiens
tctggaaccatcctc

SEQ ID NO: 2308951 - DNA, 19 bp, Homo sapiens
tctggaaccatcctctgtt

SEQ ID NO: 2308952 - DNA, 16 bp, Homo sapiens
tctggaattgttgaat

SEQ ID NO: 2308953 - DNA, 17 bp, Homo sapiens
tctggaattgttgaatg

SEQ ID NO: 2308954 - DNA, 14 bp, Homo sapiens
tctggagcaaagca

SEQ ID NO: 2308955 - DNA, 15 bp, Homo sapiens
tctgggaagaatgtc

SEQ ID NO: 2308956 - DNA, 12 bp, Homo sapiens
tctgggactgct

SEQ ID NO: 2308957 - DNA, 22 bp, Homo sapiens
tctgggctgatttgggtctctc

SEQ ID NO: 2308958 - DNA, 14 bp, Homo sapiens
tctggggccagccc

SEQ ID NO: 2308959 - DNA, 15 bp, Homo sapiens
tctggggccagcccc

SEQ ID NO: 2308960 - DNA, 19 bp, Homo sapiens
tctggggccagcccctccc

SEQ ID NO: 2308961 - DNA, 16 bp, Homo sapiens
tctgtaaatttaactg

SEQ ID NO: 2308962 - DNA, 20 bp, Homo sapiens
tctgtaagaggtactaaaaa

SEQ ID NO: 2308963 - DNA, 16 bp, Homo sapiens
tctgtatatcagctct

SEQ ID NO: 2308964 - DNA, 19 bp, Homo sapiens
tctgtcattggttacaaat

SEQ ID NO: 2308965 - DNA, 20 bp, Homo sapiens
tctgtcattggttacaaatt

SEQ ID NO: 2308966 - DNA, 24 bp, Homo sapiens
tctgtccccgagccgagctctcct

SEQ ID NO: 2308967 - DNA, 13 bp, Homo sapiens
tctgtcctggtca

SEQ ID NO: 2308968 - DNA, 14 bp, Homo sapiens
tctgtcctggtcag

SEQ ID NO: 2308969 - DNA, 22 bp, Homo sapiens
tctgtcctggtcagttttcaca

SEQ ID NO: 2308970 - DNA, 12 bp, Homo sapiens
tctgtcttgtaa

SEQ ID NO: 2308971 - DNA, 19 bp, Homo sapiens
tctgtcttgtaatattttg

SEQ ID NO: 2308972 - DNA, 20 bp, Homo sapiens
tctgtcttgtaatattttgt

SEQ ID NO: 2308973 - DNA, 21 bp, Homo sapiens
tctgtgactcgcttagctgaa

SEQ ID NO: 2308974 - DNA, 17 bp, Homo sapiens
tctgtgccatagaacaa

SEQ ID NO: 2308975 - DNA, 19 bp, Homo sapiens
tctgtgcccgaggttcctg

SEQ ID NO: 2308976 - DNA, 22 bp, Homo sapiens
tctgtgcccgaggttcctgtca

SEQ ID NO: 2308977 - DNA, 15 bp, Homo sapiens
tctgtggctgccatc

SEQ ID NO: 2308978 - DNA, 13 bp, Homo sapiens
tctgtgtctgctg

SEQ ID NO: 2308979 - DNA, 13 bp, Homo sapiens
tctgttacacaat

SEQ ID NO: 2308980 - DNA, 20 bp, Homo sapiens
tctgttactccaaaaagaaa

SEQ ID NO: 2308981 - DNA, 23 bp, Homo sapiens
tctgttactccaaaaagaaatat

SEQ ID NO: 2308982 - DNA, 21 bp, Homo sapiens
tctgttctcaaatgctaaatg

SEQ ID NO: 2308983 - DNA, 20 bp, Homo sapiens
tctgtttcccctcagaacac

SEQ ID NO: 2308984 - DNA, 18 bp, Homo sapiens
tcttaaaatattgtgtaa

SEQ ID NO: 2308985 - DNA, 13 bp, Homo sapiens
tcttaaagaattt

SEQ ID NO: 2308986 - DNA, 22 bp, Homo sapiens
tcttaaatatgtggagttcatc

SEQ ID NO: 2308987 - DNA, 15 bp, Homo sapiens
tcttaagacactagt

SEQ ID NO: 2308988 - DNA, 18 bp, Homo sapiens
tcttaccatgcatttctc

SEQ ID NO: 2308989 - DNA, 15 bp, Homo sapiens
tcttacgctctctgt

SEQ ID NO: 2308990 - DNA, 17 bp, Homo sapiens
tcttatcacacttgcaa

SEQ ID NO: 2308991 - DNA, 19 bp, Homo sapiens
tcttattaaccaaattaac

SEQ ID NO: 2308992 - DNA, 14 bp, Homo sapiens
tcttatttatatat

SEQ ID NO: 2308993 - DNA, 19 bp, Homo sapiens
tcttatttatatatgaagt

SEQ ID NO: 2308994 - DNA, 15 bp, Homo sapiens
tcttcaaaaactgtt

SEQ ID NO: 2308995 - DNA, 14 bp, Homo sapiens
tcttcaaccctgcc

SEQ ID NO: 2308996 - DNA, 15 bp, Homo sapiens
tcttcaaccctgccc

SEQ ID NO: 2308997 - DNA, 14 bp, Homo sapiens
tcttcatggtctct

SEQ ID NO: 2308998 - DNA, 17 bp, Homo sapiens
tcttcatgttcagtcac

SEQ ID NO: 2308999 - DNA, 13 bp, Homo sapiens
tcttccagcccag

SEQ ID NO: 2309000 - DNA, 22 bp, Homo sapiens
tcttccagcccagacatcctgt

SEQ ID NO: 2309001 - DNA, 21 bp, Homo sapiens
tcttcccatgcaacaccctct

SEQ ID NO: 2309002 - DNA, 14 bp, Homo sapiens
tcttcccatttgta

SEQ ID NO: 2309003 - DNA, 19 bp, Homo sapiens
tcttcccatttgtaatgta

SEQ ID NO: 2309004 - DNA, 17 bp, Homo sapiens
tcttccctttcctccct

SEQ ID NO: 2309005 - DNA, 18 bp, Homo sapiens
tcttcttatcacacttgc

SEQ ID NO: 2309006 - DNA, 22 bp, Homo sapiens
tcttcttatcacacttgcaaat

SEQ ID NO: 2309007 - DNA, 23 bp, Homo sapiens
tcttcttgcggcaccgcccaccc

SEQ ID NO: 2309008 - DNA, 19 bp, Homo sapiens
tcttgaactcttggcctca

SEQ ID NO: 2309009 - DNA, 16 bp, Homo sapiens
tcttgaagaatattgt

SEQ ID NO: 2309010 - DNA, 11 bp, Homo sapiens
tcttgaataaa

SEQ ID NO: 2309011 - DNA, 21 bp, Homo sapiens
tcttgaattgtaaggaatgat

SEQ ID NO: 2309012 - DNA, 14 bp, Homo sapiens
tcttgagcaatgtt

SEQ ID NO: 2309013 - DNA, 22 bp, Homo sapiens
tcttgatcagacattcagagat

SEQ ID NO: 2309014 - DNA, 16 bp, Homo sapiens
tcttgccttacacaaa

SEQ ID NO: 2309015 - DNA, 17 bp, Homo sapiens
tcttgctttcacaaata

SEQ ID NO: 2309016 - DNA, 17 bp, Homo sapiens
tcttggatctttttgca

SEQ ID NO: 2309017 - DNA, 21 bp, Homo sapiens
tcttggggaaggatctccccg

SEQ ID NO: 2309018 - DNA, 19 bp, Homo sapiens
tcttgtaatattttgtatt

SEQ ID NO: 2309019 - DNA, 13 bp, Homo sapiens
tcttgtattttct

SEQ ID NO: 2309020 - DNA, 13 bp, Homo sapiens
tcttgtgtgttta

SEQ ID NO: 2309021 - DNA, 18 bp, Homo sapiens
tcttgtgttgttttctct

SEQ ID NO: 2309022 - DNA, 19 bp, Homo sapiens
tctttaacatacatctaag

SEQ ID NO: 2309023 - DNA, 21 bp, Homo sapiens
tctttaaggaagaataaaaaa

SEQ ID NO: 2309024 - DNA, 18 bp, Homo sapiens
tctttaatataatattat
